United States Patent 7,026,443 (INDUCING CELLULAR IMMUNE RESPONSES TO HUMAN PAPILLOMAVIRUS USING PEPTIDE AND NUCLEIC ACID COMPOSITIONS) - sequence listing, part 2

SEQ ID NO: 4313 - protein, 10 aa, Artificial Sequence
  Peptide Derived from Human Papillomavirus
VTVVDTTPST

SEQ ID NO: 4314 - protein, 8 aa, Artificial Sequence
  Peptide Derived from Human Papillomavirus
VVDTTPST

SEQ ID NO: 4315 - protein, 10 aa, Artificial Sequence
  Peptide Derived from Human Papillomavirus
VVDTTPSTNL

SEQ ID NO: 4316 - protein, 11 aa, Artificial Sequence
  Peptide Derived from Human Papillomavirus
VVDTTPSTNLT

SEQ ID NO: 4317 - protein, 8 aa, Artificial Sequence
  Peptide Derived from Human Papillomavirus
VVNTDDYV

SEQ ID NO: 4318 - protein, 9 aa, Artificial Sequence
  Peptide Derived from Human Papillomavirus
VVNTDDYVT

SEQ ID NO: 4319 - protein, 11 aa, Artificial Sequence
  Peptide Derived from Human Papillomavirus
VVNTDDYVTPT

SEQ ID NO: 4320 - protein, 8 aa, Artificial Sequence
  Peptide Derived from Human Papillomavirus
WACAGVEI

SEQ ID NO: 4321 - protein, 9 aa, Artificial Sequence
  Peptide Derived from Human Papillomavirus
YIHSMNSSI

SEQ ID NO: 4322 - protein, 10 aa, Artificial Sequence
  Peptide Derived from Human Papillomavirus
YIHSMNSSIL

SEQ ID NO: 4323 - protein, 9 aa, Artificial Sequence
  Peptide Derived from Human Papillomavirus
YIILFLRNV

SEQ ID NO: 4324 - protein, 11 aa, Artificial Sequence
  Peptide Derived from Human Papillomavirus
YIILFLRNVNV

SEQ ID NO: 4325 - protein, 9 aa, Artificial Sequence
  Peptide Derived from Human Papillomavirus
YIKGTGMPA

SEQ ID NO: 4326 - protein, 8 aa, Artificial Sequence
  Peptide Derived from Human Papillomavirus
YLPPPSVA

SEQ ID NO: 4327 - protein, 10 aa, Artificial Sequence
  Peptide Derived from Human Papillomavirus
YLPPPSVARV

SEQ ID NO: 4328 - protein, 11 aa, Artificial Sequence
  Peptide Derived from Human Papillomavirus
YLPPPSVARVV

SEQ ID NO: 4329 - protein, 8 aa, Artificial Sequence
  Peptide Derived from Human Papillomavirus
YQYRVFRV

SEQ ID NO: 4330 - protein, 10 aa, Artificial Sequence
  Peptide Derived from Human Papillomavirus
YQYRVFRVQL

SEQ ID NO: 4331 - protein, 11 aa, Artificial Sequence
  Peptide Derived from Human Papillomavirus
YTRVLILHYHL

SEQ ID NO: 4332 - protein, 11 aa, Artificial Sequence
  Peptide Derived from Human Papillomavirus
YVTPTSIFYHA

SEQ ID NO: 4333 - protein, 9 aa, Artificial Sequence
  Peptide Derived from Human Papillomavirus
AARRKRASV

SEQ ID NO: 4334 - protein, 10 aa, Artificial Sequence
  Peptide Derived from Human Papillomavirus
AARRKRASVT

SEQ ID NO: 4335 - protein, 8 aa, Artificial Sequence
  Peptide Derived from Human Papillomavirus
ALTSRRGT

SEQ ID NO: 4336 - protein, 9 aa, Artificial Sequence
  Peptide Derived from Human Papillomavirus
ALTSRRGTV

SEQ ID NO: 4337 - protein, 10 aa, Artificial Sequence
  Peptide Derived from Human Papillomavirus
ATEDNDLFDI

SEQ ID NO: 4338 - protein, 9 aa, Artificial Sequence
  Peptide Derived from Human Papillomavirus
ATMFTRSGT

SEQ ID NO: 4339 - protein, 11 aa, Artificial Sequence
  Peptide Derived from Human Papillomavirus
ATMFTRSGTQI

SEQ ID NO: 4340 - protein, 10 aa, Artificial Sequence
  Peptide Derived from Human Papillomavirus
AVLDITPSST

SEQ ID NO: 4341 - protein, 9 aa, Artificial Sequence
  Peptide Derived from Human Papillomavirus
AVPVPSRST

SEQ ID NO: 4342 - protein, 10 aa, Artificial Sequence
  Peptide Derived from Human Papillomavirus
AVPVPSRSTT

SEQ ID NO: 4343 - protein, 9 aa, Artificial Sequence
  Peptide Derived from Human Papillomavirus
DIIRLHRPA

SEQ ID NO: 4344 - protein, 10 aa, Artificial Sequence
  Peptide Derived from Human Papillomavirus
DIIRLHRPAL

SEQ ID NO: 4345 - protein, 11 aa, Artificial Sequence
  Peptide Derived from Human Papillomavirus
DIIRLHRPALT

SEQ ID NO: 4346 - protein, 8 aa, Artificial Sequence
  Peptide Derived from Human Papillomavirus
DITLPSTT

SEQ ID NO: 4347 - protein, 10 aa, Artificial Sequence
  Peptide Derived from Human Papillomavirus
DITLPSTTSV

SEQ ID NO: 4348 - protein, 9 aa, Artificial Sequence
  Peptide Derived from Human Papillomavirus
DITPSSTSV

SEQ ID NO: 4349 - protein, 11 aa, Artificial Sequence
  Peptide Derived from Human Papillomavirus
DITPSSTSVSI

SEQ ID NO: 4350 - protein, 8 aa, Artificial Sequence
  Peptide Derived from Human Papillomavirus
DITSAGTT

SEQ ID NO: 4351 - protein, 9 aa, Artificial Sequence
  Peptide Derived from Human Papillomavirus
DITSAGTTT

SEQ ID NO: 4352 - protein, 11 aa, Artificial Sequence
  Peptide Derived from Human Papillomavirus
DITSAGTTTPA

SEQ ID NO: 4353 - protein, 10 aa, Artificial Sequence
  Peptide Derived from Human Papillomavirus
DIYADDMDPA

SEQ ID NO: 4354 - protein, 11 aa, Artificial Sequence
  Peptide Derived from Human Papillomavirus
DIYADDMDPAV

SEQ ID NO: 4355 - protein, 10 aa, Artificial Sequence
  Peptide Derived from Human Papillomavirus
DLFDIYADDM

SEQ ID NO: 4356 - protein, 11 aa, Artificial Sequence
  Peptide Derived from Human Papillomavirus
DLYKTCKQSGT

SEQ ID NO: 4357 - protein, 8 aa, Artificial Sequence
  Peptide Derived from Human Papillomavirus
DMDPAVPV

SEQ ID NO: 4358 - protein, 9 aa, Artificial Sequence
  Peptide Derived from Human Papillomavirus
DVGPTRPPV

SEQ ID NO: 4359 - protein, 10 aa, Artificial Sequence
  Peptide Derived from Human Papillomavirus
DVGPTRPPVV

SEQ ID NO: 4360 - protein, 11 aa, Artificial Sequence
  Peptide Derived from Human Papillomavirus
DVGPTRPPVVI

SEQ ID NO: 4361 - protein, 8 aa, Artificial Sequence
  Peptide Derived from Human Papillomavirus
DVPDSDFM

SEQ ID NO: 4362 - protein, 10 aa, Artificial Sequence
  Peptide Derived from Human Papillomavirus
DVPDSDFMDI

SEQ ID NO: 4363 - protein, 11 aa, Artificial Sequence
  Peptide Derived from Human Papillomavirus
DVPDSDFMDII

SEQ ID NO: 4364 - protein, 10 aa, Artificial Sequence
  Peptide Derived from Human Papillomavirus
DVPVYTGPDI

SEQ ID NO: 4365 - protein, 11 aa, Artificial Sequence
  Peptide Derived from Human Papillomavirus
DVPVYTGPDIT

SEQ ID NO: 4366 - protein, 9 aa, Artificial Sequence
  Peptide Derived from Human Papillomavirus
DVVPKVEGT

SEQ ID NO: 4367 - protein, 10 aa, Artificial Sequence
  Peptide Derived from Human Papillomavirus
DVVPKVEGTT

SEQ ID NO: 4368 - protein, 11 aa, Artificial Sequence
  Peptide Derived from Human Papillomavirus
DVVPKVEGTTL

SEQ ID NO: 4369 - protein, 8 aa, Artificial Sequence
  Peptide Derived from Human Papillomavirus
EIPLQTFA

SEQ ID NO: 4370 - protein, 8 aa, Artificial Sequence
  Peptide Derived from Human Papillomavirus
ELQPLVSA

SEQ ID NO: 4371 - protein, 9 aa, Artificial Sequence
  Peptide Derived from Human Papillomavirus
ELQPLVSAT

SEQ ID NO: 4372 - protein, 8 aa, Artificial Sequence
  Peptide Derived from Human Papillomavirus
EVAGNVFV

SEQ ID NO: 4373 - protein, 10 aa, Artificial Sequence
  Peptide Derived from Human Papillomavirus
EVAGNVFVGT

SEQ ID NO: 4374 - protein, 8 aa, Artificial Sequence
  Peptide Derived from Human Papillomavirus
EVPQTGEV

SEQ ID NO: 4375 - protein, 9 aa, Artificial Sequence
  Peptide Derived from Human Papillomavirus
EVPQTGEVA

SEQ ID NO: 4376 - protein, 8 aa, Artificial Sequence
  Peptide Derived from Human Papillomavirus
FADGFVAA

SEQ ID NO: 4377 - protein, 9 aa, Artificial Sequence
  Peptide Derived from Human Papillomavirus
FAFFKYSPT

SEQ ID NO: 4378 - protein, 10 aa, Artificial Sequence
  Peptide Derived from Human Papillomavirus
FAFFKYSPTI

SEQ ID NO: 4379 - protein, 11 aa, Artificial Sequence
  Peptide Derived from Human Papillomavirus
FASSGTGEEPI

SEQ ID NO: 4380 - protein, 9 aa, Artificial Sequence
  Peptide Derived from Human Papillomavirus
FIPKKRKRV

SEQ ID NO: 4381 - protein, 9 aa, Artificial Sequence
  Peptide Derived from Human Papillomavirus
FLGGLGIGT

SEQ ID NO: 4382 - protein, 8 aa, Artificial Sequence
  Peptide Derived from Human Papillomavirus
FLTRPSSL

SEQ ID NO: 4383 - protein, 9 aa, Artificial Sequence
  Peptide Derived from Human Papillomavirus
FLTRPSSLI

SEQ ID NO: 4384 - protein, 10 aa, Artificial Sequence
  Peptide Derived from Human Papillomavirus
FLTRPSSLIT

SEQ ID NO: 4385 - protein, 11 aa, Artificial Sequence
  Peptide Derived from Human Papillomavirus
FMDIIRLHRPA

SEQ ID NO: 4386 - protein, 9 aa, Artificial Sequence
  Peptide Derived from Human Papillomavirus
FTGTSGFDI

SEQ ID NO: 4387 - protein, 10 aa, Artificial Sequence
  Peptide Derived from Human Papillomavirus
FTGTSGFDIT

SEQ ID NO: 4388 - protein, 11 aa, Artificial Sequence
  Peptide Derived from Human Papillomavirus
FTNPAFSDPSI

SEQ ID NO: 4389 - protein, 8 aa, Artificial Sequence
  Peptide Derived from Human Papillomavirus
FTRSGTQI

SEQ ID NO: 4390 - protein, 10 aa, Artificial Sequence
  Peptide Derived from Human Papillomavirus
FTRSGTQIGA

SEQ ID NO: 4391 - protein, 9 aa, Artificial Sequence
  Peptide Derived from Human Papillomavirus
FVGTPTSGT

SEQ ID NO: 4392 - protein, 8 aa, Artificial Sequence
  Peptide Derived from Human Papillomavirus
GAPRPTFT

SEQ ID NO: 4393 - protein, 10 aa, Artificial Sequence
  Peptide Derived from Human Papillomavirus
GAPRPTFTGT

SEQ ID NO: 4394 - protein, 10 aa, Artificial Sequence
  Peptide Derived from Human Papillomavirus
GARVHFYHDI

SEQ ID NO: 4395 - protein, 9 aa, Artificial Sequence
  Peptide Derived from Human Papillomavirus
GIFLGGLGI

SEQ ID NO: 4396 - protein, 11 aa, Artificial Sequence
  Peptide Derived from Human Papillomavirus
GIFLGGLGIGT

SEQ ID NO: 4397 - protein, 8 aa, Artificial Sequence
  Peptide Derived from Human Papillomavirus
GIGTGSGT

SEQ ID NO: 4398 - protein, 9 aa, Artificial Sequence
  Peptide Derived from Human Papillomavirus
GIHGTHYYL

SEQ ID NO: 4399 - protein, 10 aa, Artificial Sequence
  Peptide Derived from Human Papillomavirus
GLGIGTGSGT

SEQ ID NO: 4400 - protein, 8 aa, Artificial Sequence
  Peptide Derived from Human Papillomavirus
GQRATMFT

SEQ ID NO: 4401 - protein, 8 aa, Artificial Sequence
  Peptide Derived from Human Papillomavirus
GTCPPDVV

SEQ ID NO: 4402 - protein, 11 aa, Artificial Sequence
  Peptide Derived from Human Papillomavirus
GTCPPDVVPKV

SEQ ID NO: 4403 - protein, 10 aa, Artificial Sequence
  Peptide Derived from Human Papillomavirus
GTGEEPISST

SEQ ID NO: 4404 - protein, 9 aa, Artificial Sequence
  Peptide Derived from Human Papillomavirus
GTGGRTGYI

SEQ ID NO: 4405 - protein, 11 aa, Artificial Sequence
  Peptide Derived from Human Papillomavirus
GTGGRTGYIPL

SEQ ID NO: 4406 - protein, 10 aa, Artificial Sequence
  Peptide Derived from Human Papillomavirus
GTGSGTGGRT

SEQ ID NO: 4407 - protein, 8 aa, Artificial Sequence
  Peptide Derived from Human Papillomavirus
GTHGYEEI

SEQ ID NO: 4408 - protein, 10 aa, Artificial Sequence
  Peptide Derived from Human Papillomavirus
GTHGYEEIPL

SEQ ID NO: 4409 - protein, 9 aa, Artificial Sequence
  Peptide Derived from Human Papillomavirus
GTHYYLWPL

SEQ ID NO: 4410 - protein, 8 aa, Artificial Sequence
  Peptide Derived from Human Papillomavirus
GTQIGARV

SEQ ID NO: 4411 - protein, 8 aa, Artificial Sequence
  Peptide Derived from Human Papillomavirus
GTSGFDIT

SEQ ID NO: 4412 - protein, 10 aa, Artificial Sequence
  Peptide Derived from Human Papillomavirus
GTSGFDITSA

SEQ ID NO: 4413 - protein, 8 aa, Artificial Sequence
  Peptide Derived from Human Papillomavirus
GTTLADKI

SEQ ID NO: 4414 - protein, 9 aa, Artificial Sequence
  Peptide Derived from Human Papillomavirus
GTTLADKIL

SEQ ID NO: 4415 - protein, 8 aa, Artificial Sequence
  Peptide Derived from Human Papillomavirus
GTTTPAVL

SEQ ID NO: 4416 - protein, 10 aa, Artificial Sequence
  Peptide Derived from Human Papillomavirus
GTTTPAVLDI

SEQ ID NO: 4417 - protein, 11 aa, Artificial Sequence
  Peptide Derived from Human Papillomavirus
GTTTPAVLDIT

SEQ ID NO: 4418 - protein, 8 aa, Artificial Sequence
  Peptide Derived from Human Papillomavirus
GTVRFSRL

SEQ ID NO: 4419 - protein, 8 aa, Artificial Sequence
  Peptide Derived from Human Papillomavirus
IAPSPEYI

SEQ ID NO: 4420 - protein, 10 aa, Artificial Sequence
  Peptide Derived from Human Papillomavirus
IAPSPEYIEL

SEQ ID NO: 4421 - protein, 10 aa, Artificial Sequence
  Peptide Derived from Human Papillomavirus
IIEVPQTGEV

SEQ ID NO: 4422 - protein, 11 aa, Artificial Sequence
  Peptide Derived from Human Papillomavirus
IIEVPQTGEVA

SEQ ID NO: 4423 - protein, 8 aa, Artificial Sequence
  Peptide Derived from Human Papillomavirus
IIRLHRPA

SEQ ID NO: 4424 - protein, 9 aa, Artificial Sequence
  Peptide Derived from Human Papillomavirus
IIRLHRPAL

SEQ ID NO: 4425 - protein, 10 aa, Artificial Sequence
  Peptide Derived from Human Papillomavirus
IIRLHRPALT

SEQ ID NO: 4426 - protein, 9 aa, Artificial Sequence
  Peptide Derived from Human Papillomavirus
ILQWSSLGI

SEQ ID NO: 4427 - protein, 11 aa, Artificial Sequence
  Peptide Derived from Human Papillomavirus
ILQWSSLGIFL

SEQ ID NO: 4428 - protein, 9 aa, Artificial Sequence
  Peptide Derived from Human Papillomavirus
ITLPSTTSV

SEQ ID NO: 4429 - protein, 8 aa, Artificial Sequence
  Peptide Derived from Human Papillomavirus
ITPSSTSV

SEQ ID NO: 4430 - protein, 10 aa, Artificial Sequence
  Peptide Derived from Human Papillomavirus
ITPSSTSVSI

SEQ ID NO: 4431 - protein, 8 aa, Artificial Sequence
  Peptide Derived from Human Papillomavirus
ITSAGTTT

SEQ ID NO: 4432 - protein, 10 aa, Artificial Sequence
  Peptide Derived from Human Papillomavirus
ITSAGTTTPA

SEQ ID NO: 4433 - protein, 11 aa, Artificial Sequence
  Peptide Derived from Human Papillomavirus
ITSAGTTTPAV

SEQ ID NO: 4434 - protein, 11 aa, Artificial Sequence
  Peptide Derived from Human Papillomavirus
ITYDNPAFEPV

SEQ ID NO: 4435 - protein, 8 aa, Artificial Sequence
  Peptide Derived from Human Papillomavirus
IVSPTAPA

SEQ ID NO: 4436 - protein, 10 aa, Artificial Sequence
  Peptide Derived from Human Papillomavirus
IVSPTAPAST

SEQ ID NO: 4437 - protein, 10 aa, Artificial Sequence
  Peptide Derived from Human Papillomavirus
IVTLIEDSSV

SEQ ID NO: 4438 - protein, 11 aa, Artificial Sequence
  Peptide Derived from Human Papillomavirus
IVTLIEDSSVV

SEQ ID NO: 4439 - protein, 8 aa, Artificial Sequence
  Peptide Derived from Human Papillomavirus
KILQWSSL

SEQ ID NO: 4440 - protein, 10 aa, Artificial Sequence
  Peptide Derived from Human Papillomavirus
KILQWSSLGI

SEQ ID NO: 4441 - protein, 10 aa, Artificial Sequence
  Peptide Derived from Human Papillomavirus
KQSGTCPPDV

SEQ ID NO: 4442 - protein, 11 aa, Artificial Sequence
  Peptide Derived from Human Papillomavirus
KQSGTCPPDVV

SEQ ID NO: 4443 - protein, 8 aa, Artificial Sequence
  Peptide Derived from Human Papillomavirus
KTCKQSGT

SEQ ID NO: 4444 - protein, 8 aa, Artificial Sequence
  Peptide Derived from Human Papillomavirus
KVEGTTLA

SEQ ID NO: 4445 - protein, 11 aa, Artificial Sequence
  Peptide Derived from Human Papillomavirus
KVEGTTLADKI

SEQ ID NO: 4446 - protein, 11 aa, Artificial Sequence
  Peptide Derived from Human Papillomavirus
LADKILQWSSL

SEQ ID NO: 4447 - protein, 8 aa, Artificial Sequence
  Peptide Derived from Human Papillomavirus
LIEDSSVV

SEQ ID NO: 4448 - protein, 9 aa, Artificial Sequence
  Peptide Derived from Human Papillomavirus
LIEDSSVVT

SEQ ID NO: 4449 - protein, 8 aa, Artificial Sequence
  Peptide Derived from Human Papillomavirus
LITYDNPA

SEQ ID NO: 4450 - protein, 8 aa, Artificial Sequence
  Peptide Derived from Human Papillomavirus
LQPLVSAT

SEQ ID NO: 4451 - protein, 9 aa, Artificial Sequence
  Peptide Derived from Human Papillomavirus
LQTFASSGT

SEQ ID NO: 4452 - protein, 8 aa, Artificial Sequence
  Peptide Derived from Human Papillomavirus
LQWSSLGI

SEQ ID NO: 4453 - protein, 10 aa, Artificial Sequence
  Peptide Derived from Human Papillomavirus
LQWSSLGIFL

SEQ ID NO: 4454 - protein, 9 aa, Artificial Sequence
  Peptide Derived from Human Papillomavirus
LTFDPRSDV

SEQ ID NO: 4455 - protein, 8 aa, Artificial Sequence
  Peptide Derived from Human Papillomavirus
LTRPSSLI

SEQ ID NO: 4456 - protein, 9 aa, Artificial Sequence
  Peptide Derived from Human Papillomavirus
LTRPSSLIT

SEQ ID NO: 4457 - protein, 8 aa, Artificial Sequence
  Peptide Derived from Human Papillomavirus
LTSRRGTV

SEQ ID NO: 4458 - protein, 9 aa, Artificial Sequence
  Peptide Derived from Human Papillomavirus
LTSSWDVPV

SEQ ID NO: 4459 - protein, 11 aa, Artificial Sequence
  Peptide Derived from Human Papillomavirus
LTSSWDVPVYT

SEQ ID NO: 4460 - protein, 10 aa, Artificial Sequence
  Peptide Derived from Human Papillomavirus
LVSATEDNDL

SEQ ID NO: 4461 - protein, 9 aa, Artificial Sequence
  Peptide Derived from Human Papillomavirus
NTVVDVGPT

SEQ ID NO: 4462 - protein, 8 aa, Artificial Sequence
  Peptide Derived from Human Papillomavirus
NVFVGTPT

SEQ ID NO: 4463 - protein, 11 aa, Artificial Sequence
  Peptide Derived from Human Papillomavirus
NVFVGTPTSGT

SEQ ID NO: 4464 - protein, 8 aa, Artificial Sequence
  Peptide Derived from Human Papillomavirus
PAFEPVDT

SEQ ID NO: 4465 - protein, 9 aa, Artificial Sequence
  Peptide Derived from Human Papillomavirus
PAFEPVDTT

SEQ ID NO: 4466 - protein, 10 aa, Artificial Sequence
  Peptide Derived from Human Papillomavirus
PAFEPVDTTL

SEQ ID NO: 4467 - protein, 11 aa, Artificial Sequence
  Peptide Derived from Human Papillomavirus
PAFEPVDTTLT

SEQ ID NO: 4468 - protein, 8 aa, Artificial Sequence
  Peptide Derived from Human Papillomavirus
PAFSDPSI

SEQ ID NO: 4469 - protein, 9 aa, Artificial Sequence
  Peptide Derived from Human Papillomavirus
PAFSDPSII

SEQ ID NO: 4470 - protein, 11 aa, Artificial Sequence
  Peptide Derived from Human Papillomavirus
PAFSDPSIIEV

SEQ ID NO: 4471 - protein, 9 aa, Artificial Sequence
  Peptide Derived from Human Papillomavirus
PALTSRRGT

SEQ ID NO: 4472 - protein, 10 aa, Artificial Sequence
  Peptide Derived from Human Papillomavirus
PALTSRRGTV

SEQ ID NO: 4473 - protein, 9 aa, Artificial Sequence
  Peptide Derived from Human Papillomavirus
PASTQYIGI

SEQ ID NO: 4474 - protein, 11 aa, Artificial Sequence
  Peptide Derived from Human Papillomavirus
PAVLDITPSST

SEQ ID NO: 4475 - protein, 10 aa, Artificial Sequence
  Peptide Derived from Human Papillomavirus
PAVPVPSRST

SEQ ID NO: 4476 - protein, 11 aa, Artificial Sequence
  Peptide Derived from Human Papillomavirus
PAVPVPSRSTT

SEQ ID NO: 4477 - protein, 9 aa, Artificial Sequence
  Peptide Derived from Human Papillomavirus
PIAPSPEYI

SEQ ID NO: 4478 - protein, 11 aa, Artificial Sequence
  Peptide Derived from Human Papillomavirus
PIAPSPEYIEL

SEQ ID NO: 4479 - protein, 9 aa, Artificial Sequence
  Peptide Derived from Human Papillomavirus
PISSTPLPT

SEQ ID NO: 4480 - protein, 10 aa, Artificial Sequence
  Peptide Derived from Human Papillomavirus
PISSTPLPTV

SEQ ID NO: 4481 - protein, 9 aa, Artificial Sequence
  Peptide Derived from Human Papillomavirus
PIVSPTAPA

SEQ ID NO: 4482 - protein, 11 aa, Artificial Sequence
  Peptide Derived from Human Papillomavirus
PIVSPTAPAST

SEQ ID NO: 4483 - protein, 8 aa, Artificial Sequence
  Peptide Derived from Human Papillomavirus
PLGGRSNT

SEQ ID NO: 4484 - protein, 9 aa, Artificial Sequence
  Peptide Derived from Human Papillomavirus
PLGGRSNTV

SEQ ID NO: 4485 - protein, 10 aa, Artificial Sequence
  Peptide Derived from Human Papillomavirus
PLGGRSNTVV

SEQ ID NO: 4486 - protein, 8 aa, Artificial Sequence
  Peptide Derived from Human Papillomavirus
PLPTVRRV

SEQ ID NO: 4487 - protein, 9 aa, Artificial Sequence
  Peptide Derived from Human Papillomavirus
PLPTVRRVA

SEQ ID NO: 4488 - protein, 10 aa, Artificial Sequence
  Peptide Derived from Human Papillomavirus
PLQTFASSGT

SEQ ID NO: 4489 - protein, 8 aa, Artificial Sequence
  Peptide Derived from Human Papillomavirus
PLTSSWDV

SEQ ID NO: 4490 - protein, 10 aa, Artificial Sequence
  Peptide Derived from Human Papillomavirus
PLTSSWDVPV

SEQ ID NO: 4491 - protein, 11 aa, Artificial Sequence
  Peptide Derived from Human Papillomavirus
PLVSATEDNDL

SEQ ID NO: 4492 - protein, 10 aa, Artificial Sequence
  Peptide Derived from Human Papillomavirus
PQTGEVAGNV

SEQ ID NO: 4493 - protein, 10 aa, Artificial Sequence
  Peptide Derived from Human Papillomavirus
PTAPASTQYI

SEQ ID NO: 4494 - protein, 8 aa, Artificial Sequence
  Peptide Derived from Human Papillomavirus
PTDPSIVT

SEQ ID NO: 4495 - protein, 9 aa, Artificial Sequence
  Peptide Derived from Human Papillomavirus
PTDPSIVTL

SEQ ID NO: 4496 - protein, 10 aa, Artificial Sequence
  Peptide Derived from Human Papillomavirus
PTDPSIVTLI

SEQ ID NO: 4497 - protein, 11 aa, Artificial Sequence
  Peptide Derived from Human Papillomavirus
PTFTGTSGFDI

SEQ ID NO: 4498 - protein, 8 aa, Artificial Sequence
  Peptide Derived from Human Papillomavirus
PTRPPVVI

SEQ ID NO: 4499 - protein, 11 aa, Artificial Sequence
  Peptide Derived from Human Papillomavirus
PTRPPVVIEPV

SEQ ID NO: 4500 - protein, 11 aa, Artificial Sequence
  Peptide Derived from Human Papillomavirus
PTSGTHGYEEI

SEQ ID NO: 4501 - protein, 11 aa, Artificial Sequence
  Peptide Derived from Human Papillomavirus
PTVRRVAGPRL

SEQ ID NO: 4502 - protein, 9 aa, Artificial Sequence
  Peptide Derived from Human Papillomavirus
PVGPTDPSI

SEQ ID NO: 4503 - protein, 10 aa, Artificial Sequence
  Peptide Derived from Human Papillomavirus
PVGPTDPSIV

SEQ ID NO: 4504 - protein, 11 aa, Artificial Sequence
  Peptide Derived from Human Papillomavirus
PVGPTDPSIVT

SEQ ID NO: 4505 - protein, 8 aa, Artificial Sequence
  Peptide Derived from Human Papillomavirus
PVPSRSTT

SEQ ID NO: 4506 - protein, 11 aa, Artificial Sequence
  Peptide Derived from Human Papillomavirus
PVPSRSTTSFA

SEQ ID NO: 4507 - protein, 10 aa, Artificial Sequence
  Peptide Derived from Human Papillomavirus
PVVIEPVGPT

SEQ ID NO: 4508 - protein, 8 aa, Artificial Sequence
  Peptide Derived from Human Papillomavirus
PVYTGPDI

SEQ ID NO: 4509 - protein, 9 aa, Artificial Sequence
  Peptide Derived from Human Papillomavirus
PVYTGPDIT

SEQ ID NO: 4510 - protein, 10 aa, Artificial Sequence
  Peptide Derived from Human Papillomavirus
PVYTGPDITL

SEQ ID NO: 4511 - protein, 11 aa, Artificial Sequence
  Peptide Derived from Human Papillomavirus
QQVSVANPEFL

SEQ ID NO: 4512 - protein, 8 aa, Artificial Sequence
  Peptide Derived from Human Papillomavirus
QTFASSGT

SEQ ID NO: 4513 - protein, 9 aa, Artificial Sequence
  Peptide Derived from Human Papillomavirus
QTGEVAGNV

SEQ ID NO: 4514 - protein, 11 aa, Artificial Sequence
  Peptide Derived from Human Papillomavirus
QTGEVAGNVFV

SEQ ID NO: 4515 - protein, 10 aa, Artificial Sequence
  Peptide Derived from Human Papillomavirus
QVSVANPEFL

SEQ ID NO: 4516 - protein, 11 aa, Artificial Sequence
  Peptide Derived from Human Papillomavirus
QVSVANPEFLT

SEQ ID NO: 4517 - protein, 8 aa, Artificial Sequence
  Peptide Derived from Human Papillomavirus
RAARRKRA

SEQ ID NO: 4518 - protein, 10 aa, Artificial Sequence
  Peptide Derived from Human Papillomavirus
RAARRKRASV

SEQ ID NO: 4519 - protein, 11 aa, Artificial Sequence
  Peptide Derived from Human Papillomavirus
RAARRKRASVT

SEQ ID NO: 4520 - protein, 10 aa, Artificial Sequence
  Peptide Derived from Human Papillomavirus
RASVTDLYKT

SEQ ID NO: 4521 - protein, 10 aa, Artificial Sequence
  Peptide Derived from Human Papillomavirus
RATMFTRSGT

SEQ ID NO: 4522 - protein, 8 aa, Artificial Sequence
  Peptide Derived from Human Papillomavirus
RAYQQVSV

SEQ ID NO: 4523 - protein, 9 aa, Artificial Sequence
  Peptide Derived from Human Papillomavirus
RAYQQVSVA

SEQ ID NO: 4524 - protein, 8 aa, Artificial Sequence
  Peptide Derived from Human Papillomavirus
RLGQRATM

SEQ ID NO: 4525 - protein, 10 aa, Artificial Sequence
  Peptide Derived from Human Papillomavirus
RLGQRATMFT

SEQ ID NO: 4526 - protein, 8 aa, Artificial Sequence
  Peptide Derived from Human Papillomavirus
RLHRPALT

SEQ ID NO: 4527 - protein, 10 aa, Artificial Sequence
  Peptide Derived from Human Papillomavirus
RLYSRAYQQV

SEQ ID NO: 4528 - protein, 11 aa, Artificial Sequence
  Peptide Derived from Human Papillomavirus
RVAGPRLYSRA

SEQ ID NO: 4529 - protein, 8 aa, Artificial Sequence
  Peptide Derived from Human Papillomavirus
RVHFYHDI

SEQ ID NO: 4530 - protein, 11 aa, Artificial Sequence
  Peptide Derived from Human Papillomavirus
RVHFYHDISPI

SEQ ID NO: 4531 - protein, 11 aa, Artificial Sequence
  Peptide Derived from Human Papillomavirus
RVPYFFADGFV

SEQ ID NO: 4532 - protein, 8 aa, Artificial Sequence
  Peptide Derived from Human Papillomavirus
SAGTTTPA

SEQ ID NO: 4533 - protein, 9 aa, Artificial Sequence
  Peptide Derived from Human Papillomavirus
SAGTTTPAV

SEQ ID NO: 4534 - protein, 10 aa, Artificial Sequence
  Peptide Derived from Human Papillomavirus
SAGTTTPAVL

SEQ ID NO: 4535 - protein, 8 aa, Artificial Sequence
  Peptide Derived from Human Papillomavirus
SASSYSNV

SEQ ID NO: 4536 - protein, 9 aa, Artificial Sequence
  Peptide Derived from Human Papillomavirus
SASSYSNVT

SEQ ID NO: 4537 - protein, 10 aa, Artificial Sequence
  Peptide Derived from Human Papillomavirus
SASSYSNVTV

SEQ ID NO: 4538 - protein, 8 aa, Artificial Sequence
  Peptide Derived from Human Papillomavirus
SATEDNDL

SEQ ID NO: 4539 - protein, 11 aa, Artificial Sequence
  Peptide Derived from Human Papillomavirus
SATEDNDLFDI

SEQ ID NO: 4540 - protein, 8 aa, Artificial Sequence
  Peptide Derived from Human Papillomavirus
SIIEVPQT

SEQ ID NO: 4541 - protein, 11 aa, Artificial Sequence
  Peptide Derived from Human Papillomavirus
SIIEVPQTGEV

SEQ ID NO: 4542 - protein, 8 aa, Artificial Sequence
  Peptide Derived from Human Papillomavirus
SISTTNFT

SEQ ID NO: 4543 - protein, 11 aa, Artificial Sequence
  Peptide Derived from Human Papillomavirus
SISTTNFTNPA

SEQ ID NO: 4544 - protein, 11 aa, Artificial Sequence
  Peptide Derived from Human Papillomavirus
SIVTLIEDSSV

SEQ ID NO: 4545 - protein, 9 aa, Artificial Sequence
  Peptide Derived from Human Papillomavirus
SLGIFLGGL

SEQ ID NO: 4546 - protein, 11 aa, Artificial Sequence
  Peptide Derived from Human Papillomavirus
SLGIFLGGLGI

SEQ ID NO: 4547 - protein, 9 aa, Artificial Sequence
  Peptide Derived from Human Papillomavirus
SLITYDNPA

SEQ ID NO: 4548 - protein, 10 aa, Artificial Sequence
  Peptide Derived from Human Papillomavirus
STPLPTVRRV

SEQ ID NO: 4549 - protein, 11 aa, Artificial Sequence
  Peptide Derived from Human Papillomavirus
STPLPTVRRVA

SEQ ID NO: 4550 - protein, 10 aa, Artificial Sequence
  Peptide Derived from Human Papillomavirus
STQYIGIHGT

SEQ ID NO: 4551 - protein, 8 aa, Artificial Sequence
  Peptide Derived from Human Papillomavirus
STSVSIST

SEQ ID NO: 4552 - protein, 9 aa, Artificial Sequence
  Peptide Derived from Human Papillomavirus
STSVSISTT

SEQ ID NO: 4553 - protein, 9 aa, Artificial Sequence
  Peptide Derived from Human Papillomavirus
STTNFTNPA

SEQ ID NO: 4554 - protein, 8 aa, Artificial Sequence
  Peptide Derived from Human Papillomavirus
STTSVWPI

SEQ ID NO: 4555 - protein, 9 aa, Artificial Sequence
  Peptide Derived from Human Papillomavirus
STTSVWPIV

SEQ ID NO: 4556 - protein, 8 aa, Artificial Sequence
  Peptide Derived from Human Papillomavirus
SVANPEFL

SEQ ID NO: 4557 - protein, 9 aa, Artificial Sequence
  Peptide Derived from Human Papillomavirus
SVANPEFLT

SEQ ID NO: 4558 - protein, 10 aa, Artificial Sequence
  Peptide Derived from Human Papillomavirus
SVSISTTNFT

SEQ ID NO: 4559 - protein, 8 aa, Artificial Sequence
  Peptide Derived from Human Papillomavirus
SVTDLYKT

SEQ ID NO: 4560 - protein, 11 aa, Artificial Sequence
  Peptide Derived from Human Papillomavirus
SVVTSGAPRPT

SEQ ID NO: 4561 - protein, 9 aa, Artificial Sequence
  Peptide Derived from Human Papillomavirus
SVWPIVSPT

SEQ ID NO: 4562 - protein, 10 aa, Artificial Sequence
  Peptide Derived from Human Papillomavirus
SVWPIVSPTA

SEQ ID NO: 4563 - protein, 9 aa, Artificial Sequence
  Peptide Derived from Human Papillomavirus
TAPASTQYI

SEQ ID NO: 4564 - protein, 11 aa, Artificial Sequence
  Peptide Derived from Human Papillomavirus
TAPASTQYIGI

SEQ ID NO: 4565 - protein, 11 aa, Artificial Sequence
  Peptide Derived from Human Papillomavirus
TISSASSYSNV

SEQ ID NO: 4566 - protein, 8 aa, Artificial Sequence
  Peptide Derived from Human Papillomavirus
TLIEDSSV

SEQ ID NO: 4567 - protein, 9 aa, Artificial Sequence
  Peptide Derived from Human Papillomavirus
TLIEDSSVV

SEQ ID NO: 4568 - protein, 10 aa, Artificial Sequence
  Peptide Derived from Human Papillomavirus
TLIEDSSVVT

SEQ ID NO: 4569 - protein, 8 aa, Artificial Sequence
  Peptide Derived from Human Papillomavirus
TLPSTTSV

SEQ ID NO: 4570 - protein, 11 aa, Artificial Sequence
  Peptide Derived from Human Papillomavirus
TLPSTTSVWPI

SEQ ID NO: 4571 - protein, 10 aa, Artificial Sequence
  Peptide Derived from Human Papillomavirus
TLTFDPRSDV

SEQ ID NO: 4572 - protein, 8 aa, Artificial Sequence
  Peptide Derived from Human Papillomavirus
TMFTRSGT

SEQ ID NO: 4573 - protein, 10 aa, Artificial Sequence
  Peptide Derived from Human Papillomavirus
TMFTRSGTQI

SEQ ID NO: 4574 - protein, 9 aa, Artificial Sequence
  Peptide Derived from Human Papillomavirus
TQYIGIHGT

SEQ ID NO: 4575 - protein, 8 aa, Artificial Sequence
  Peptide Derived from Human Papillomavirus
TTLADKIL

SEQ ID NO: 4576 - protein, 11 aa, Artificial Sequence
  Peptide Derived from Human Papillomavirus
TTLTFDPRSDV

SEQ ID NO: 4577 - protein, 8 aa, Artificial Sequence
  Peptide Derived from Human Papillomavirus
TTNFTNPA

SEQ ID NO: 4578 - protein, 8 aa, Artificial Sequence
  Peptide Derived from Human Papillomavirus
TTPAVLDI

SEQ ID NO: 4579 - protein, 9 aa, Artificial Sequence
  Peptide Derived from Human Papillomavirus
TTPAVLDIT

SEQ ID NO: 4580 - protein, 8 aa, Artificial Sequence
  Peptide Derived from Human Papillomavirus
TTSVWPIV

SEQ ID NO: 4581 - protein, 11 aa, Artificial Sequence
  Peptide Derived from Human Papillomavirus
TTSVWPIVSPT

SEQ ID NO: 4582 - protein, 9 aa, Artificial Sequence
  Peptide Derived from Human Papillomavirus
TTTPAVLDI

SEQ ID NO: 4583 - protein, 10 aa, Artificial Sequence
  Peptide Derived from Human Papillomavirus
TTTPAVLDIT

SEQ ID NO: 4584 - protein, 10 aa, Artificial Sequence
  Peptide Derived from Human Papillomavirus
TVPLTSSWDV

SEQ ID NO: 4585 - protein, 11 aa, Artificial Sequence
  Peptide Derived from Human Papillomavirus
TVRFSRLGQRA

SEQ ID NO: 4586 - protein, 10 aa, Artificial Sequence
  Peptide Derived from Human Papillomavirus
TVRRVAGPRL

SEQ ID NO: 4587 - protein, 8 aa, Artificial Sequence
  Peptide Derived from Human Papillomavirus
TVVDVGPT

SEQ ID NO: 4588 - protein, 9 aa, Artificial Sequence
  Peptide Derived from Human Papillomavirus
VAGNVFVGT

SEQ ID NO: 4589 - protein, 11 aa, Artificial Sequence
  Peptide Derived from Human Papillomavirus
VAGNVFVGTPT

SEQ ID NO: 4590 - protein, 10 aa, Artificial Sequence
  Peptide Derived from Human Papillomavirus
VAGPRLYSRA

SEQ ID NO: 4591 - protein, 8 aa, Artificial Sequence
  Peptide Derived from Human Papillomavirus
VANPEFLT

SEQ ID NO: 4592 - protein, 8 aa, Artificial Sequence
  Peptide Derived from Human Papillomavirus
VIEPVGPT

SEQ ID NO: 4593 - protein, 9 aa, Artificial Sequence
  Peptide Derived from Human Papillomavirus
VLDITPSST

SEQ ID NO: 4594 - protein, 11 aa, Artificial Sequence
  Peptide Derived from Human Papillomavirus
VLDITPSSTSV

SEQ ID NO: 4595 - protein, 9 aa, Artificial Sequence
  Peptide Derived from Human Papillomavirus
VTLIEDSSV

SEQ ID NO: 4596 - protein, 10 aa, Artificial Sequence
  Peptide Derived from Human Papillomavirus
VTLIEDSSVV

SEQ ID NO: 4597 - protein, 11 aa, Artificial Sequence
  Peptide Derived from Human Papillomavirus
VTLIEDSSVVT

SEQ ID NO: 4598 - protein, 9 aa, Artificial Sequence
  Peptide Derived from Human Papillomavirus
VTSGAPRPT

SEQ ID NO: 4599 - protein, 11 aa, Artificial Sequence
  Peptide Derived from Human Papillomavirus
VTSGAPRPTFT

SEQ ID NO: 4600 - protein, 11 aa, Artificial Sequence
  Peptide Derived from Human Papillomavirus
VTVPLTSSWDV

SEQ ID NO: 4601 - protein, 11 aa, Artificial Sequence
  Peptide Derived from Human Papillomavirus
VVDVGPTRPPV

SEQ ID NO: 4602 - protein, 9 aa, Artificial Sequence
  Peptide Derived from Human Papillomavirus
VVIEPVGPT

SEQ ID NO: 4603 - protein, 8 aa, Artificial Sequence
  Peptide Derived from Human Papillomavirus
VVPKVEGT

SEQ ID NO: 4604 - protein, 9 aa, Artificial Sequence
  Peptide Derived from Human Papillomavirus
VVPKVEGTT

SEQ ID NO: 4605 - protein, 10 aa, Artificial Sequence
  Peptide Derived from Human Papillomavirus
VVPKVEGTTL

SEQ ID NO: 4606 - protein, 11 aa, Artificial Sequence
  Peptide Derived from Human Papillomavirus
VVPKVEGTTLA

SEQ ID NO: 4607 - protein, 10 aa, Artificial Sequence
  Peptide Derived from Human Papillomavirus
VVTSGAPRPT

SEQ ID NO: 4608 - protein, 8 aa, Artificial Sequence
  Peptide Derived from Human Papillomavirus
YADDMDPA

SEQ ID NO: 4609 - protein, 9 aa, Artificial Sequence
  Peptide Derived from Human Papillomavirus
YADDMDPAV

SEQ ID NO: 4610 - protein, 11 aa, Artificial Sequence
  Peptide Derived from Human Papillomavirus
YADDMDPAVPV

SEQ ID NO: 4611 - protein, 8 aa, Artificial Sequence
  Peptide Derived from Human Papillomavirus
YIELQPLV

SEQ ID NO: 4612 - protein, 10 aa, Artificial Sequence
  Peptide Derived from Human Papillomavirus
YIELQPLVSA

SEQ ID NO: 4613 - protein, 11 aa, Artificial Sequence
  Peptide Derived from Human Papillomavirus
YIELQPLVSAT

SEQ ID NO: 4614 - protein, 11 aa, Artificial Sequence
  Peptide Derived from Human Papillomavirus
YIGIHGTHYYL

SEQ ID NO: 4615 - protein, 10 aa, Artificial Sequence
  Peptide Derived from Human Papillomavirus
YIPLGGRSNT

SEQ ID NO: 4616 - protein, 11 aa, Artificial Sequence
  Peptide Derived from Human Papillomavirus
YIPLGGRSNTV

SEQ ID NO: 4617 - protein, 9 aa, Artificial Sequence
  Peptide Derived from Human Papillomavirus
YLWPLYYFI

SEQ ID NO: 4618 - protein, 8 aa, Artificial Sequence
  Peptide Derived from Human Papillomavirus
YTGPDITL

SEQ ID NO: 4619 - protein, 11 aa, Artificial Sequence
  Peptide Derived from Human Papillomavirus
YTGPDITLPST

SEQ ID NO: 4620 - protein, 9 aa, Artificial Sequence
  Peptide Derived from Human Papillomavirus
AAALYWYRT

SEQ ID NO: 4621 - protein, 11 aa, Artificial Sequence
  Peptide Derived from Human Papillomavirus
AAALYWYRTGM

SEQ ID NO: 4622 - protein, 8 aa, Artificial Sequence
  Peptide Derived from Human Papillomavirus
AAFGVTGT

SEQ ID NO: 4623 - protein, 9 aa, Artificial Sequence
  Peptide Derived from Human Papillomavirus
AAFGVTGTV

SEQ ID NO: 4624 - protein, 10 aa, Artificial Sequence
  Peptide Derived from Human Papillomavirus
AAFGVTGTVA

SEQ ID NO: 4625 - protein, 8 aa, Artificial Sequence
  Peptide Derived from Human Papillomavirus
AALYWYRT

SEQ ID NO: 4626 - protein, 10 aa, Artificial Sequence
  Peptide Derived from Human Papillomavirus
AALYWYRTGM

SEQ ID NO: 4627 - protein, 10 aa, Artificial Sequence
  Peptide Derived from Human Papillomavirus
AAMLGKFKEL

SEQ ID NO: 4628 - protein, 10 aa, Artificial Sequence
  Peptide Derived from Human Papillomavirus
AICIENNSKT

SEQ ID NO: 4629 - protein, 11 aa, Artificial Sequence
  Peptide Derived from Human Papillomavirus
AICIENNSKTA

SEQ ID NO: 4630 - protein, 9 aa, Artificial Sequence
  Peptide Derived from Human Papillomavirus
ALDGNPVSI

SEQ ID NO: 4631 - protein, 11 aa, Artificial Sequence
  Peptide Derived from Human Papillomavirus
ALDGNPVSIDV

SEQ ID NO: 4632 - protein, 8 aa, Artificial Sequence
  Peptide Derived from Human Papillomavirus
ALFHAQEA

SEQ ID NO: 4633 - protein, 9 aa, Artificial Sequence
  Peptide Derived from Human Papillomavirus
ALKLFLKGV

SEQ ID NO: 4634 - protein, 10 aa, Artificial Sequence
  Peptide Derived from Human Papillomavirus
ALMQLKCPPL

SEQ ID NO: 4635 - protein, 11 aa, Artificial Sequence
  Peptide Derived from Human Papillomavirus
ALMQLKCPPLL

SEQ ID NO: 4636 - protein, 9 aa, Artificial Sequence
  Peptide Derived from Human Papillomavirus
ALYWYRTGM

SEQ ID NO: 4637 - protein, 9 aa, Artificial Sequence
  Peptide Derived from Human Papillomavirus
AMLGKFKEL

SEQ ID NO: 4638 - protein, 10 aa, Artificial Sequence
  Peptide Derived from Human Papillomavirus
AQALFHAQEA

SEQ ID NO: 4639 - protein, 8 aa, Artificial Sequence
  Peptide Derived from Human Papillomavirus
AQEAEEHA

SEQ ID NO: 4640 - protein, 10 aa, Artificial Sequence
  Peptide Derived from Human Papillomavirus
AQEAEEHAEA

SEQ ID NO: 4641 - protein, 11 aa, Artificial Sequence
  Peptide Derived from Human Papillomavirus
AQEAEEHAEAV

SEQ ID NO: 4642 - protein, 10 aa, Artificial Sequence
  Peptide Derived from Human Papillomavirus
AQLADSDSNA

SEQ ID NO: 4643 - protein, 9 aa, Artificial Sequence
  Peptide Derived from Human Papillomavirus
ATTPCWHYI

SEQ ID NO: 4644 - protein, 11 aa, Artificial Sequence
  Peptide Derived from Human Papillomavirus
AVIDRQTGDNI

SEQ ID NO: 4645 - protein, 10 aa, Artificial Sequence
  Peptide Derived from Human Papillomavirus
AVQVLKRKYV

SEQ ID NO: 4646 - protein, 10 aa, Artificial Sequence
  Peptide Derived from Human Papillomavirus
CAFLKSNSQA

SEQ ID NO: 4647 - protein, 8 aa, Artificial Sequence
  Peptide Derived from Human Papillomavirus
CAKNRITI

SEQ ID NO: 4648 - protein, 11 aa, Artificial Sequence
  Peptide Derived from Human Papillomavirus
CAKNRITIEKL

SEQ ID NO: 4649 - protein, 8 aa, Artificial Sequence
  Peptide Derived from Human Papillomavirus
CIENNSKT

SEQ ID NO: 4650 - protein, 9 aa, Artificial Sequence
  Peptide Derived from Human Papillomavirus
CIENNSKTA

SEQ ID NO: 4651 - protein, 10 aa, Artificial Sequence
  Peptide Derived from Human Papillomavirus
CILIHGAPNT

SEQ ID NO: 4652 - protein, 8 aa, Artificial Sequence
  Peptide Derived from Human Papillomavirus
CISTNCML

SEQ ID NO: 4653 - protein, 9 aa, Artificial Sequence
  Peptide Derived from Human Papillomavirus
CISTNCMLI

SEQ ID NO: 4654 - protein, 9 aa, Artificial Sequence
  Peptide Derived from Human Papillomavirus
CLYCHLQSL

SEQ ID NO: 4655 - protein, 10 aa, Artificial Sequence
  Peptide Derived from Human Papillomavirus
CLYCHLQSLA

SEQ ID NO: 4656 - protein, 9 aa, Artificial Sequence
  Peptide Derived from Human Papillomavirus
CMLIQPPKL

SEQ ID NO: 4657 - protein, 8 aa, Artificial Sequence
  Peptide Derived from Human Papillomavirus
CTDWCVAA

SEQ ID NO: 4658 - protein, 11 aa, Artificial Sequence
  Peptide Derived from Human Papillomavirus
CTDWCVAAFGV

SEQ ID NO: 4659 - protein, 8 aa, Artificial Sequence
  Peptide Derived from Human Papillomavirus
CVAAFGVT

SEQ ID NO: 4660 - protein, 10 aa, Artificial Sequence
  Peptide Derived from Human Papillomavirus
CVAAFGVTGT

SEQ ID NO: 4661 - protein, 11 aa, Artificial Sequence
  Peptide Derived from Human Papillomavirus
CVAAFGVTGTV

SEQ ID NO: 4662 - protein, 10 aa, Artificial Sequence
  Peptide Derived from Human Papillomavirus
CVDYNISPRL

SEQ ID NO: 4663 - protein, 9 aa, Artificial Sequence
  Peptide Derived from Human Papillomavirus
CVSGQNIRT

SEQ ID NO: 4664 - protein, 10 aa, Artificial Sequence
  Peptide Derived from Human Papillomavirus
CVSGQNIRTL

SEQ ID NO: 4665 - protein, 10 aa, Artificial Sequence
  Peptide Derived from Human Papillomavirus
DAKIGMLDDA

SEQ ID NO: 4666 - protein, 11 aa, Artificial Sequence
  Peptide Derived from Human Papillomavirus
DAKIGMLDDAT

SEQ ID NO: 4667 - protein, 10 aa, Artificial Sequence
  Peptide Derived from Human Papillomavirus
DATTPCWHYI

SEQ ID NO: 4668 - protein, 10 aa, Artificial Sequence
  Peptide Derived from Human Papillomavirus
DISSCVDYNI

SEQ ID NO: 4669 - protein, 11 aa, Artificial Sequence
  Peptide Derived from Human Papillomavirus
DIVKFLRYQQI

SEQ ID NO: 4670 - protein, 9 aa, Artificial Sequence
  Peptide Derived from Human Papillomavirus
DLSQMVQWA

SEQ ID NO: 4671 - protein, 11 aa, Artificial Sequence
  Peptide Derived from Human Papillomavirus
DMVDFIDNCNV

SEQ ID NO: 4672 - protein, 10 aa, Artificial Sequence
  Peptide Derived from Human Papillomavirus
DTGEDMVDFI

SEQ ID NO: 4673 - protein, 9 aa, Artificial Sequence
  Peptide Derived from Human Papillomavirus
DTTFDLSQM

SEQ ID NO: 4674 - protein, 10 aa, Artificial Sequence
  Peptide Derived from Human Papillomavirus
DTTFDLSQMV

SEQ ID NO: 4675 - protein, 8 aa, Artificial Sequence
  Peptide Derived from Human Papillomavirus
DVKHKALM

SEQ ID NO: 4676 - protein, 10 aa, Artificial Sequence
  Peptide Derived from Human Papillomavirus
DVKHKALMQL

SEQ ID NO: 4677 - protein, 8 aa, Artificial Sequence
  Peptide Derived from Human Papillomavirus
DVMDDSEI

SEQ ID NO: 4678 - protein, 9 aa, Artificial Sequence
  Peptide Derived from Human Papillomavirus
DVMDDSEIA

SEQ ID NO: 4679 - protein, 10 aa, Artificial Sequence
  Peptide Derived from Human Papillomavirus
DVYGETPEWI

SEQ ID NO: 4680 - protein, 8 aa, Artificial Sequence
  Peptide Derived from Human Papillomavirus
EAEEHAEA

SEQ ID NO: 4681 - protein, 9 aa, Artificial Sequence
  Peptide Derived from Human Papillomavirus
EAEEHAEAV

SEQ ID NO: 4682 - protein, 11 aa, Artificial Sequence
  Peptide Derived from Human Papillomavirus
EAEEHAEAVQV

SEQ ID NO: 4683 - protein, 8 aa, Artificial Sequence
  Peptide Derived from Human Papillomavirus
EAETAQAL

SEQ ID NO: 4684 - protein, 11 aa, Artificial Sequence
  Peptide Derived from Human Papillomavirus
EAETAQALFHA

SEQ ID NO: 4685 - protein, 8 aa, Artificial Sequence
  Peptide Derived from Human Papillomavirus
EAVIDRQT

SEQ ID NO: 4686 - protein, 11 aa, Artificial Sequence
  Peptide Derived from Human Papillomavirus
EAVQVLKRKYV

SEQ ID NO: 4687 - protein, 9 aa, Artificial Sequence
  Peptide Derived from Human Papillomavirus
EIAYKYAQL

SEQ ID NO: 4688 - protein, 10 aa, Artificial Sequence
  Peptide Derived from Human Papillomavirus
EIAYKYAQLA

SEQ ID NO: 4689 - protein, 10 aa, Artificial Sequence
  Peptide Derived from Human Papillomavirus
ELPDSGYGNT

SEQ ID NO: 4690 - protein, 8 aa, Artificial Sequence
  Peptide Derived from Human Papillomavirus
ELYGVSFM

SEQ ID NO: 4691 - protein, 10 aa, Artificial Sequence
  Peptide Derived from Human Papillomavirus
ELYGVSFMEL

SEQ ID NO: 4692 - protein, 11 aa, Artificial Sequence
  Peptide Derived from Human Papillomavirus
ELYGVSFMELI

SEQ ID NO: 4693 - protein, 9 aa, Artificial Sequence
  Peptide Derived from Human Papillomavirus
ETAQALFHA

SEQ ID NO: 4694 - protein, 10 aa, Artificial Sequence
  Peptide Derived from Human Papillomavirus
ETPEWIERQT

SEQ ID NO: 4695 - protein, 11 aa, Artificial Sequence
  Peptide Derived from Human Papillomavirus
ETPEWIERQTV

SEQ ID NO: 4696 - protein, 8 aa, Artificial Sequence
  Peptide Derived from Human Papillomavirus
ETPTRNIL

SEQ ID NO: 4697 - protein, 10 aa, Artificial Sequence
  Peptide Derived from Human Papillomavirus
ETPTRNILQV

SEQ ID NO: 4698 - protein, 11 aa, Artificial Sequence
  Peptide Derived from Human Papillomavirus
ETPTRNILQVL

SEQ ID NO: 4699 - protein, 8 aa, Artificial Sequence
  Peptide Derived from Human Papillomavirus
ETQQMVQV

SEQ ID NO: 4700 - protein, 8 aa, Artificial Sequence
  Peptide Derived from Human Papillomavirus
EVETQQMV

SEQ ID NO: 4701 - protein, 10 aa, Artificial Sequence
  Peptide Derived from Human Papillomavirus
EVETQQMVQV

SEQ ID NO: 4702 - protein, 11 aa, Artificial Sequence
  Peptide Derived from Human Papillomavirus
FLKGVPKKNCI

SEQ ID NO: 4703 - protein, 8 aa, Artificial Sequence
  Peptide Derived from Human Papillomavirus
FLKSNSQA

SEQ ID NO: 4704 - protein, 10 aa, Artificial Sequence
  Peptide Derived from Human Papillomavirus
FLKSNSQAKI

SEQ ID NO: 4705 - protein, 11 aa, Artificial Sequence
  Peptide Derived from Human Papillomavirus
FLKSNSQAKIV

SEQ ID NO: 4706 - protein, 10 aa, Artificial Sequence
  Peptide Derived from Human Papillomavirus
FLQGCIISYA

SEQ ID NO: 4707 - protein, 10 aa, Artificial Sequence
  Peptide Derived from Human Papillomavirus
FLRYQQIEFV

SEQ ID NO: 4708 - protein, 9 aa, Artificial Sequence
  Peptide Derived from Human Papillomavirus
FLSALKLFL

SEQ ID NO: 4709 - protein, 9 aa, Artificial Sequence
  Peptide Derived from Human Papillomavirus
FQSNKSTCT

SEQ ID NO: 4710 - protein, 8 aa, Artificial Sequence
  Peptide Derived from Human Papillomavirus
FVSFLSAL

SEQ ID NO: 4711 - protein, 10 aa, Artificial Sequence
  Peptide Derived from Human Papillomavirus
FVSFLSALKL

SEQ ID NO: 4712 - protein, 8 aa, Artificial Sequence
  Peptide Derived from Human Papillomavirus
GMLDDATT

SEQ ID NO: 4713 - protein, 8 aa, Artificial Sequence
  Peptide Derived from Human Papillomavirus
GMSLISFL

SEQ ID NO: 4714 - protein, 8 aa, Artificial Sequence
  Peptide Derived from Human Papillomavirus
GMSNISDV

SEQ ID NO: 4715 - protein, 8 aa, Artificial Sequence
  Peptide Derived from Human Papillomavirus
GMVMLMLV

SEQ ID NO: 4716 - protein, 11 aa, Artificial Sequence
  Peptide Derived from Human Papillomavirus
GQWIKSRCDKV

SEQ ID NO: 4717 - protein, 10 aa, Artificial Sequence
  Peptide Derived from Human Papillomavirus
GTGCNGWFYV

SEQ ID NO: 4718 - protein, 10 aa, Artificial Sequence
  Peptide Derived from Human Papillomavirus
GTHSERENET

SEQ ID NO: 4719 - protein, 10 aa, Artificial Sequence
  Peptide Derived from Human Papillomavirus
GTMCRHYKRA

SEQ ID NO: 4720 - protein, 9 aa, Artificial Sequence
  Peptide Derived from Human Papillomavirus
GTVAEGFKT

SEQ ID NO: 4721 - protein, 10 aa, Artificial Sequence
  Peptide Derived from Human Papillomavirus
GTVAEGFKTL

SEQ ID NO: 4722 - protein, 11 aa, Artificial Sequence
  Peptide Derived from Human Papillomavirus
GTVAEGFKTLL

SEQ ID NO: 4723 - protein, 8 aa, Artificial Sequence
  Peptide Derived from Human Papillomavirus
GVPKKNCI

SEQ ID NO: 4724 - protein, 9 aa, Artificial Sequence
  Peptide Derived from Human Papillomavirus
GVPKKNCIL

SEQ ID NO: 4725 - protein, 10 aa, Artificial Sequence
  Peptide Derived from Human Papillomavirus
GVPKKNCILI

SEQ ID NO: 4726 - protein, 8 aa, Artificial Sequence
  Peptide Derived from Human Papillomavirus
GVSFMELI

SEQ ID NO: 4727 - protein, 8 aa, Artificial Sequence
  Peptide Derived from Human Papillomavirus
HAEAVQVL

SEQ ID NO: 4728 - protein, 9 aa, Artificial Sequence
  Peptide Derived from Human Papillomavirus
HAQEAEEHA

SEQ ID NO: 4729 - protein, 11 aa, Artificial Sequence
  Peptide Derived from Human Papillomavirus
HAQEAEEHAEA

SEQ ID NO: 4730 - protein, 11 aa, Artificial Sequence
  Peptide Derived from Human Papillomavirus
HLQSLACSWGM

SEQ ID NO: 4731 - protein, 8 aa, Artificial Sequence
  Peptide Derived from Human Papillomavirus
IAYKYAQL

SEQ ID NO: 4732 - protein, 9 aa, Artificial Sequence
  Peptide Derived from Human Papillomavirus
IAYKYAQLA

SEQ ID NO: 4733 - protein, 9 aa, Artificial Sequence
  Peptide Derived from Human Papillomavirus
ILIHGAPNT

SEQ ID NO: 4734 - protein, 9 aa, Artificial Sequence
  Peptide Derived from Human Papillomavirus
IQPPKLRST

SEQ ID NO: 4735 - protein, 10 aa, Artificial Sequence
  Peptide Derived from Human Papillomavirus
IQPPKLRSTA

SEQ ID NO: 4736 - protein, 11 aa, Artificial Sequence
  Peptide Derived from Human Papillomavirus
IQPPKLRSTAA

SEQ ID NO: 4737 - protein, 10 aa, Artificial Sequence
  Peptide Derived from Human Papillomavirus
ITIEKLLEKL

SEQ ID NO: 4738 - protein, 11 aa, Artificial Sequence
  Peptide Derived from Human Papillomavirus
ITIEKLLEKLL

SEQ ID NO: 4739 - protein, 8 aa, Artificial Sequence
  Peptide Derived from Human Papillomavirus
IVKDCGTM

SEQ ID NO: 4740 - protein, 10 aa, Artificial Sequence
  Peptide Derived from Human Papillomavirus
IVKFLRYQQI

SEQ ID NO: 4741 - protein, 11 aa, Artificial Sequence
  Peptide Derived from Human Papillomavirus
KAAMLGKFKEL

SEQ ID NO: 4742 - protein, 11 aa, Artificial Sequence
  Peptide Derived from Human Papillomavirus
KAICIENNSKT

SEQ ID NO: 4743 - protein, 11 aa, Artificial Sequence
  Peptide Derived from Human Papillomavirus
KALMQLKCPPL

SEQ ID NO: 4744 - protein, 8 aa, Artificial Sequence
  Peptide Derived from Human Papillomavirus
KIGMLDDA

SEQ ID NO: 4745 - protein, 9 aa, Artificial Sequence
  Peptide Derived from Human Papillomavirus
KIGMLDDAT

SEQ ID NO: 4746 - protein, 10 aa, Artificial Sequence
  Peptide Derived from Human Papillomavirus
KIGMLDDATT

SEQ ID NO: 4747 - protein, 8 aa, Artificial Sequence
  Peptide Derived from Human Papillomavirus
KIVKDCGT

SEQ ID NO: 4748 - protein, 9 aa, Artificial Sequence
  Peptide Derived from Human Papillomavirus
KIVKDCGTM

SEQ ID NO: 4749 - protein, 10 aa, Artificial Sequence
  Peptide Derived from Human Papillomavirus
KLLCISTNCM

SEQ ID NO: 4750 - protein, 11 aa, Artificial Sequence
  Peptide Derived from Human Papillomavirus
KLLCISTNCML

SEQ ID NO: 4751 - protein, 9 aa, Artificial Sequence
  Peptide Derived from Human Papillomavirus
KLLEKLLCI

SEQ ID NO: 4752 - protein, 11 aa, Artificial Sequence
  Peptide Derived from Human Papillomavirus
KLLEKLLCIST

SEQ ID NO: 4753 - protein, 8 aa, Artificial Sequence
  Peptide Derived from Human Papillomavirus
KLRSTAAA

SEQ ID NO: 4754 - protein, 9 aa, Artificial Sequence
  Peptide Derived from Human Papillomavirus
KLRSTAAAL

SEQ ID NO: 4755 - protein, 10 aa, Artificial Sequence
  Peptide Derived from Human Papillomavirus
KTAKRRLFEL

SEQ ID NO: 4756 - protein, 9 aa, Artificial Sequence
  Peptide Derived from Human Papillomavirus
KTLLQPYCL

SEQ ID NO: 4757 - protein, 8 aa, Artificial Sequence
  Peptide Derived from Human Papillomavirus
KTSNGKAA

SEQ ID NO: 4758 - protein, 9 aa, Artificial Sequence
  Peptide Derived from Human Papillomavirus
KTSNGKAAM

SEQ ID NO: 4759 - protein, 10 aa, Artificial Sequence
  Peptide Derived from Human Papillomavirus
KTSNGKAAML

SEQ ID NO: 4760 - protein, 11 aa, Artificial Sequence
  Peptide Derived from Human Papillomavirus
KVSDEGDWRDI

SEQ ID NO: 4761 - protein, 8 aa, Artificial Sequence
  Peptide Derived from Human Papillomavirus
LACSWGMV

SEQ ID NO: 4762 - protein, 9 aa, Artificial Sequence
  Peptide Derived from Human Papillomavirus
LACSWGMVM

SEQ ID NO: 4763 - protein, 10 aa, Artificial Sequence
  Peptide Derived from Human Papillomavirus
LACSWGMVML

SEQ ID NO: 4764 - protein, 11 aa, Artificial Sequence
  Peptide Derived from Human Papillomavirus
LACSWGMVMLM

SEQ ID NO: 4765 - protein, 8 aa, Artificial Sequence
  Peptide Derived from Human Papillomavirus
LADAKIGM

SEQ ID NO: 4766 - protein, 9 aa, Artificial Sequence
  Peptide Derived from Human Papillomavirus
LADAKIGML

SEQ ID NO: 4767 - protein, 8 aa, Artificial Sequence
  Peptide Derived from Human Papillomavirus
LADSDSNA

SEQ ID NO: 4768 - protein, 10 aa, Artificial Sequence
  Peptide Derived from Human Papillomavirus
LADSDSNACA

SEQ ID NO: 4769 - protein, 8 aa, Artificial Sequence
  Peptide Derived from Human Papillomavirus
LIHGAPNT

SEQ ID NO: 4770 - protein, 10 aa, Artificial Sequence
  Peptide Derived from Human Papillomavirus
LIQPPKLRST

SEQ ID NO: 4771 - protein, 11 aa, Artificial Sequence
  Peptide Derived from Human Papillomavirus
LIQPPKLRSTA

SEQ ID NO: 4772 - protein, 11 aa, Artificial Sequence
  Peptide Derived from Human Papillomavirus
LIRPFQSNKST

SEQ ID NO: 4773 - protein, 9 aa, Artificial Sequence
  Peptide Derived from Human Papillomavirus
LISFLQGCI

SEQ ID NO: 4774 - protein, 10 aa, Artificial Sequence
  Peptide Derived from Human Papillomavirus
LISFLQGCII

SEQ ID NO: 4775 - protein, 8 aa, Artificial Sequence
  Peptide Derived from Human Papillomavirus
LITSNINA

SEQ ID NO: 4776 - protein, 9 aa, Artificial Sequence
  Peptide Derived from Human Papillomavirus
LLCISTNCM

SEQ ID NO: 4777 - protein, 10 aa, Artificial Sequence
  Peptide Derived from Human Papillomavirus
LLCISTNCML

SEQ ID NO: 4778 - protein, 11 aa, Artificial Sequence
  Peptide Derived from Human Papillomavirus
LLCISTNCMLI

SEQ ID NO: 4779 - protein, 8 aa, Artificial Sequence
  Peptide Derived from Human Papillomavirus
LLEKLLCI

SEQ ID NO: 4780 - protein, 10 aa, Artificial Sequence
  Peptide Derived from Human Papillomavirus
LLEKLLCIST

SEQ ID NO: 4781 - protein, 9 aa, Artificial Sequence
  Peptide Derived from Human Papillomavirus
LLITSNINA

SEQ ID NO: 4782 - protein, 11 aa, Artificial Sequence
  Peptide Derived from Human Papillomavirus
LLQPYCLYCHL

SEQ ID NO: 4783 - protein, 9 aa, Artificial Sequence
  Peptide Derived from Human Papillomavirus
LMLVRFKCA

SEQ ID NO: 4784 - protein, 9 aa, Artificial Sequence
  Peptide Derived from Human Papillomavirus
LMQLKCPPL

SEQ ID NO: 4785 - protein, 10 aa, Artificial Sequence
  Peptide Derived from Human Papillomavirus
LMQLKCPPLL

SEQ ID NO: 4786 - protein, 11 aa, Artificial Sequence
  Peptide Derived from Human Papillomavirus
LMQLKCPPLLI

SEQ ID NO: 4787 - protein, 9 aa, Artificial Sequence
  Peptide Derived from Human Papillomavirus
LQGCIISYA

SEQ ID NO: 4788 - protein, 8 aa, Artificial Sequence
  Peptide Derived from Human Papillomavirus
LQHSFNDT

SEQ ID NO: 4789 - protein, 9 aa, Artificial Sequence
  Peptide Derived from Human Papillomavirus
LQHSFNDTT

SEQ ID NO: 4790 - protein, 9 aa, Artificial Sequence
  Peptide Derived from Human Papillomavirus
LQPLADAKI

SEQ ID NO: 4791 - protein, 11 aa, Artificial Sequence
  Peptide Derived from Human Papillomavirus
LQPLADAKIGM

SEQ ID NO: 4792 - protein, 10 aa, Artificial Sequence
  Peptide Derived from Human Papillomavirus
LQPYCLYCHL

SEQ ID NO: 4793 - protein, 10 aa, Artificial Sequence
  Peptide Derived from Human Papillomavirus
LQSLACSWGM

SEQ ID NO: 4794 - protein, 11 aa, Artificial Sequence
  Peptide Derived from Human Papillomavirus
LQSLACSWGMV

SEQ ID NO: 4795 - protein, 11 aa, Artificial Sequence
  Peptide Derived from Human Papillomavirus
LQVLKTSNGKA

SEQ ID NO: 4796 - protein, 11 aa, Artificial Sequence
  Peptide Derived from Human Papillomavirus
LVRFKCAKNRI

SEQ ID NO: 4797 - protein, 8 aa, Artificial Sequence
  Peptide Derived from Human Papillomavirus
MLGKFKEL

SEQ ID NO: 4798 - protein, 11 aa, Artificial Sequence
  Peptide Derived from Human Papillomavirus
MLGKFKELYGV

SEQ ID NO: 4799 - protein, 8 aa, Artificial Sequence
  Peptide Derived from Human Papillomavirus
MLIQPPKL

SEQ ID NO: 4800 - protein, 11 aa, Artificial Sequence
  Peptide Derived from Human Papillomavirus
MLIQPPKLRST

SEQ ID NO: 4801 - protein, 10 aa, Artificial Sequence
  Peptide Derived from Human Papillomavirus
MLMLVRFKCA

SEQ ID NO: 4802 - protein, 8 aa, Artificial Sequence
  Peptide Derived from Human Papillomavirus
MLVRFKCA

SEQ ID NO: 4803 - protein, 8 aa, Artificial Sequence
  Peptide Derived from Human Papillomavirus
MQLKCPPL

SEQ ID NO: 4804 - protein, 9 aa, Artificial Sequence
  Peptide Derived from Human Papillomavirus
MQLKCPPLL

SEQ ID NO: 4805 - protein, 10 aa, Artificial Sequence
  Peptide Derived from Human Papillomavirus
MQLKCPPLLI

SEQ ID NO: 4806 - protein, 11 aa, Artificial Sequence
  Peptide Derived from Human Papillomavirus
MQLKCPPLLIT

SEQ ID NO: 4807 - protein, 10 aa, Artificial Sequence
  Peptide Derived from Human Papillomavirus
MVDFIDNCNV

SEQ ID NO: 4808 - protein, 9 aa, Artificial Sequence
  Peptide Derived from Human Papillomavirus
MVQVEEQQT

SEQ ID NO: 4809 - protein, 10 aa, Artificial Sequence
  Peptide Derived from Human Papillomavirus
MVQVEEQQTT

SEQ ID NO: 4810 - protein, 11 aa, Artificial Sequence
  Peptide Derived from Human Papillomavirus
MVQVEEQQTTL

SEQ ID NO: 4811 - protein, 10 aa, Artificial Sequence
  Peptide Derived from Human Papillomavirus
MVQWAYDNDV

SEQ ID NO: 4812 - protein, 11 aa, Artificial Sequence
  Peptide Derived from Human Papillomavirus
MVQWAYDNDVM

SEQ ID NO: 4813 - protein, 11 aa, Artificial Sequence
  Peptide Derived from Human Papillomavirus
NAGKDDRWPYL

SEQ ID NO: 4814 - protein, 8 aa, Artificial Sequence
  Peptide Derived from Human Papillomavirus
NALDGNPV

SEQ ID NO: 4815 - protein, 10 aa, Artificial Sequence
  Peptide Derived from Human Papillomavirus
NALDGNPVSI

SEQ ID NO: 4816 - protein, 8 aa, Artificial Sequence
  Peptide Derived from Human Papillomavirus
NILQVLKT

SEQ ID NO: 4817 - protein, 9 aa, Artificial Sequence
  Peptide Derived from Human Papillomavirus
NISDVYGET

SEQ ID NO: 4818 - protein, 8 aa, Artificial Sequence
  Peptide Derived from Human Papillomavirus
NISPRLKA

SEQ ID NO: 4819 - protein, 9 aa, Artificial Sequence
  Peptide Derived from Human Papillomavirus
NISPRLKAI

SEQ ID NO: 4820 - protein, 11 aa, Artificial Sequence
  Peptide Derived from Human Papillomavirus
NISPRLKAICI

SEQ ID NO: 4821 - protein, 8 aa, Artificial Sequence
  Peptide Derived from Human Papillomavirus
NQAEAETA

SEQ ID NO: 4822 - protein, 10 aa, Artificial Sequence
  Peptide Derived from Human Papillomavirus
NQAEAETAQA

SEQ ID NO: 4823 - protein, 11 aa, Artificial Sequence
  Peptide Derived from Human Papillomavirus
NQAEAETAQAL

SEQ ID NO: 4824 - protein, 9 aa, Artificial Sequence
  Peptide Derived from Human Papillomavirus
NTEVETQQM

SEQ ID NO: 4825 - protein, 10 aa, Artificial Sequence
  Peptide Derived from Human Papillomavirus
NTEVETQQMV

SEQ ID NO: 4826 - protein, 9 aa, Artificial Sequence
  Peptide Derived from Human Papillomavirus
NTGKSYFGM

SEQ ID NO: 4827 - protein, 11 aa, Artificial Sequence
  Peptide Derived from Human Papillomavirus
NTGKSYFGMSL

SEQ ID NO: 4828 - protein, 9 aa, Artificial Sequence
  Peptide Derived from Human Papillomavirus
NVYNNQAEA

SEQ ID NO: 4829 - protein, 11 aa, Artificial Sequence
  Peptide Derived from Human Papillomavirus
NVYNNQAEAET

SEQ ID NO: 4830 - protein, 9 aa, Artificial Sequence
  Peptide Derived from Human Papillomavirus
PAGTDGEGT

SEQ ID NO: 4831 - protein, 9 aa, Artificial Sequence
  Peptide Derived from Human Papillomavirus
PLADAKIGM

SEQ ID NO: 4832 - protein, 10 aa, Artificial Sequence
  Peptide Derived from Human Papillomavirus
PLADAKIGML

SEQ ID NO: 4833 - protein, 8 aa, Artificial Sequence
  Peptide Derived from Human Papillomavirus
PLLITSNI

SEQ ID NO: 4834 - protein, 10 aa, Artificial Sequence
  Peptide Derived from Human Papillomavirus
PLLITSNINA

SEQ ID NO: 4835 - protein, 9 aa, Artificial Sequence
  Peptide Derived from Human Papillomavirus
PLSDISSCV

SEQ ID NO: 4836 - protein, 8 aa, Artificial Sequence
  Peptide Derived from Human Papillomavirus
PTRNILQV

SEQ ID NO: 4837 - protein, 9 aa, Artificial Sequence
  Peptide Derived from Human Papillomavirus
PTRNILQVL

SEQ ID NO: 4838 - protein, 11 aa, Artificial Sequence
  Peptide Derived from Human Papillomavirus
PTRNILQVLKT

SEQ ID NO: 4839 - protein, 10 aa, Artificial Sequence
  Peptide Derived from Human Papillomavirus
PVSIDVKHKA

SEQ ID NO: 4840 - protein, 11 aa, Artificial Sequence
  Peptide Derived from Human Papillomavirus
PVSIDVKHKAL

SEQ ID NO: 4841 - protein, 9 aa, Artificial Sequence
  Peptide Derived from Human Papillomavirus
QAEAETAQA

SEQ ID NO: 4842 - protein, 10 aa, Artificial Sequence
  Peptide Derived from Human Papillomavirus
QAEAETAQAL

SEQ ID NO: 4843 - protein, 10 aa, Artificial Sequence
  Peptide Derived from Human Papillomavirus
QAKIVKDCGT

SEQ ID NO: 4844 - protein, 11 aa, Artificial Sequence
  Peptide Derived from Human Papillomavirus
QAKIVKDCGTM

SEQ ID NO: 4845 - protein, 9 aa, Artificial Sequence
  Peptide Derived from Human Papillomavirus
QALFHAQEA

SEQ ID NO: 4846 - protein, 8 aa, Artificial Sequence
  Peptide Derived from Human Papillomavirus
QIEFVSFL

SEQ ID NO: 4847 - protein, 10 aa, Artificial Sequence
  Peptide Derived from Human Papillomavirus
QIEFVSFLSA

SEQ ID NO: 4848 - protein, 11 aa, Artificial Sequence
  Peptide Derived from Human Papillomavirus
QIEFVSFLSAL

SEQ ID NO: 4849 - protein, 9 aa, Artificial Sequence
  Peptide Derived from Human Papillomavirus
QLADSDSNA

SEQ ID NO: 4850 - protein, 11 aa, Artificial Sequence
  Peptide Derived from Human Papillomavirus
QLADSDSNACA

SEQ ID NO: 4851 - protein, 8 aa, Artificial Sequence
  Peptide Derived from Human Papillomavirus
QLKCPPLL

SEQ ID NO: 4852 - protein, 9 aa, Artificial Sequence
  Peptide Derived from Human Papillomavirus
QLKCPPLLI

SEQ ID NO: 4853 - protein, 10 aa, Artificial Sequence
  Peptide Derived from Human Papillomavirus
QLKCPPLLIT

SEQ ID NO: 4854 - protein, 8 aa, Artificial Sequence
  Peptide Derived from Human Papillomavirus
QMSMGQWI

SEQ ID NO: 4855 - protein, 10 aa, Artificial Sequence
  Peptide Derived from Human Papillomavirus
QMVQVEEQQT

SEQ ID NO: 4856 - protein, 11 aa, Artificial Sequence
  Peptide Derived from Human Papillomavirus
QMVQVEEQQTT

SEQ ID NO: 4857 - protein, 11 aa, Artificial Sequence
  Peptide Derived from Human Papillomavirus
QMVQWAYDNDV

SEQ ID NO: 4858 - protein, 9 aa, Artificial Sequence
  Peptide Derived from Human Papillomavirus
QQIEFVSFL

SEQ ID NO: 4859 - protein, 11 aa, Artificial Sequence
  Peptide Derived from Human Papillomavirus
QQIEFVSFLSA

SEQ ID NO: 4860 - protein, 11 aa, Artificial Sequence
  Peptide Derived from Human Papillomavirus
QQMVQVEEQQT

SEQ ID NO: 4861 - protein, 11 aa, Artificial Sequence
  Peptide Derived from Human Papillomavirus
QTVLQHSFNDT

SEQ ID NO: 4862 - protein, 8 aa, Artificial Sequence
  Peptide Derived from Human Papillomavirus
QVEEQQTT

SEQ ID NO: 4863 - protein, 9 aa, Artificial Sequence
  Peptide Derived from Human Papillomavirus
QVEEQQTTL

SEQ ID NO: 4864 - protein, 8 aa, Artificial Sequence
  Peptide Derived from Human Papillomavirus
QVLKRKYV

SEQ ID NO: 4865 - protein, 10 aa, Artificial Sequence
  Peptide Derived from Human Papillomavirus
QVLKTSNGKA

SEQ ID NO: 4866 - protein, 11 aa, Artificial Sequence
  Peptide Derived from Human Papillomavirus
QVLKTSNGKAA

SEQ ID NO: 4867 - protein, 9 aa, Artificial Sequence
  Peptide Derived from Human Papillomavirus
RAEKRQMSM

SEQ ID NO: 4868 - protein, 8 aa, Artificial Sequence
  Peptide Derived from Human Papillomavirus
RITIEKLL

SEQ ID NO: 4869 - protein, 11 aa, Artificial Sequence
  Peptide Derived from Human Papillomavirus
RITIEKLLEKL

SEQ ID NO: 4870 - protein, 9 aa, Artificial Sequence
  Peptide Derived from Human Papillomavirus
RQMSMGQWI

SEQ ID NO: 4871 - protein, 10 aa, Artificial Sequence
  Peptide Derived from Human Papillomavirus
RTGMSNISDV

SEQ ID NO: 4872 - protein, 8 aa, Artificial Sequence
  Peptide Derived from Human Papillomavirus
RTWCRLNL

SEQ ID NO: 4873 - protein, 10 aa, Artificial Sequence
  Peptide Derived from Human Papillomavirus
SALKLFLKGV

SEQ ID NO: 4874 - protein, 8 aa, Artificial Sequence
  Peptide Derived from Human Papillomavirus
SIDVKHKA

SEQ ID NO: 4875 - protein, 9 aa, Artificial Sequence
  Peptide Derived from Human Papillomavirus
SIDVKHKAL

SEQ ID NO: 4876 - protein, 10 aa, Artificial Sequence
  Peptide Derived from Human Papillomavirus
SIDVKHKALM

SEQ ID NO: 4877 - protein, 8 aa, Artificial Sequence
  Peptide Derived from Human Papillomavirus
SLACSWGM

SEQ ID NO: 4878 - protein, 9 aa, Artificial Sequence
  Peptide Derived from Human Papillomavirus
SLACSWGMV

SEQ ID NO: 4879 - protein, 10 aa, Artificial Sequence
  Peptide Derived from Human Papillomavirus
SLACSWGMVM

SEQ ID NO: 4880 - protein, 11 aa, Artificial Sequence
  Peptide Derived from Human Papillomavirus
SLACSWGMVML

SEQ ID NO: 4881 - protein, 10 aa, Artificial Sequence
  Peptide Derived from Human Papillomavirus
SLISFLQGCI

SEQ ID NO: 4882 - protein, 11 aa, Artificial Sequence
  Peptide Derived from Human Papillomavirus
SLISFLQGCII

SEQ ID NO: 4883 - protein, 11 aa, Artificial Sequence
  Peptide Derived from Human Papillomavirus
SQAKIVKDCGT

SEQ ID NO: 4884 - protein, 11 aa, Artificial Sequence
  Peptide Derived from Human Papillomavirus
STAAALYWYRT

SEQ ID NO: 4885 - protein, 8 aa, Artificial Sequence
  Peptide Derived from Human Papillomavirus
STCTDWCV

SEQ ID NO: 4886 - protein, 9 aa, Artificial Sequence
  Peptide Derived from Human Papillomavirus
STCTDWCVA

SEQ ID NO: 4887 - protein, 10 aa, Artificial Sequence
  Peptide Derived from Human Papillomavirus
STCTDWCVAA

SEQ ID NO: 4888 - protein, 11 aa, Artificial Sequence
  Peptide Derived from Human Papillomavirus
STFKCVSGQNI

SEQ ID NO: 4889 - protein, 10 aa, Artificial Sequence
  Peptide Derived from Human Papillomavirus
TAAALYWYRT

SEQ ID NO: 4890 - protein, 9 aa, Artificial Sequence
  Peptide Derived from Human Papillomavirus
TAKRRLFEL

SEQ ID NO: 4891 - protein, 8 aa, Artificial Sequence
  Peptide Derived from Human Papillomavirus
TAQALFHA

SEQ ID NO: 4892 - protein, 11 aa, Artificial Sequence
  Peptide Derived from Human Papillomavirus
TAQALFHAQEA

SEQ ID NO: 4893 - protein, 9 aa, Artificial Sequence
  Peptide Derived from Human Papillomavirus
TIEKLLEKL

SEQ ID NO: 4894 - protein, 10 aa, Artificial Sequence
  Peptide Derived from Human Papillomavirus
TIEKLLEKLL

SEQ ID NO: 4895 - protein, 8 aa, Artificial Sequence
  Peptide Derived from Human Papillomavirus
TLLQPYCL

SEQ ID NO: 4896 - protein, 10 aa, Artificial Sequence
  Peptide Derived from Human Papillomavirus
TLSCNGSDGT

SEQ ID NO: 4897 - protein, 9 aa, Artificial Sequence
  Peptide Derived from Human Papillomavirus
TMCRHYKRA

SEQ ID NO: 4898 - protein, 8 aa, Artificial Sequence
  Peptide Derived from Human Papillomavirus
TTFDLSQM

SEQ ID NO: 4899 - protein, 9 aa, Artificial Sequence
  Peptide Derived from Human Papillomavirus
TTFDLSQMV

SEQ ID NO: 4900 - protein, 11 aa, Artificial Sequence
  Peptide Derived from Human Papillomavirus
TTLSCNGSDGT

SEQ ID NO: 4901 - protein, 8 aa, Artificial Sequence
  Peptide Derived from Human Papillomavirus
TTPCWHYI

SEQ ID NO: 4902 - protein, 8 aa, Artificial Sequence
  Peptide Derived from Human Papillomavirus
TVAEGFKT

SEQ ID NO: 4903 - protein, 9 aa, Artificial Sequence
  Peptide Derived from Human Papillomavirus
TVAEGFKTL

SEQ ID NO: 4904 - protein, 10 aa, Artificial Sequence
  Peptide Derived from Human Papillomavirus
TVAEGFKTLL

SEQ ID NO: 4905 - protein, 10 aa, Artificial Sequence
  Peptide Derived from Human Papillomavirus
TVLQHSFNDT

SEQ ID NO: 4906 - protein, 11 aa, Artificial Sequence
  Peptide Derived from Human Papillomavirus
TVLQHSFNDTT

SEQ ID NO: 4907 - protein, 9 aa, Artificial Sequence
  Peptide Derived from Human Papillomavirus
VAAFGVTGT

SEQ ID NO: 4908 - protein, 10 aa, Artificial Sequence
  Peptide Derived from Human Papillomavirus
VAAFGVTGTV

SEQ ID NO: 4909 - protein, 11 aa, Artificial Sequence
  Peptide Derived from Human Papillomavirus
VAAFGVTGTVA

SEQ ID NO: 4910 - protein, 8 aa, Artificial Sequence
  Peptide Derived from Human Papillomavirus
VAEGFKTL

SEQ ID NO: 4911 - protein, 9 aa, Artificial Sequence
  Peptide Derived from Human Papillomavirus
VAEGFKTLL

SEQ ID NO: 4912 - protein, 10 aa, Artificial Sequence
  Peptide Derived from Human Papillomavirus
VIDRQTGDNI

SEQ ID NO: 4913 - protein, 11 aa, Artificial Sequence
  Peptide Derived from Human Papillomavirus
VLKRKYVGSPL

SEQ ID NO: 4914 - protein, 9 aa, Artificial Sequence
  Peptide Derived from Human Papillomavirus
VLKTSNGKA

SEQ ID NO: 4915 - protein, 10 aa, Artificial Sequence
  Peptide Derived from Human Papillomavirus
VLKTSNGKAA

SEQ ID NO: 4916 - protein, 11 aa, Artificial Sequence
  Peptide Derived from Human Papillomavirus
VLKTSNGKAAM

SEQ ID NO: 4917 - protein, 9 aa, Artificial Sequence
  Peptide Derived from Human Papillomavirus
VLQHSFNDT

SEQ ID NO: 4918 - protein, 10 aa, Artificial Sequence
  Peptide Derived from Human Papillomavirus
VLQHSFNDTT

SEQ ID NO: 4919 - protein, 8 aa, Artificial Sequence
  Peptide Derived from Human Papillomavirus
VMDDSEIA

SEQ ID NO: 4920 - protein, 11 aa, Artificial Sequence
  Peptide Derived from Human Papillomavirus
VMLMLVRFKCA

SEQ ID NO: 4921 - protein, 8 aa, Artificial Sequence
  Peptide Derived from Human Papillomavirus
VQVEEQQT

SEQ ID NO: 4922 - protein, 9 aa, Artificial Sequence
  Peptide Derived from Human Papillomavirus
VQVEEQQTT

SEQ ID NO: 4923 - protein, 10 aa, Artificial Sequence
  Peptide Derived from Human Papillomavirus
VQVEEQQTTL

SEQ ID NO: 4924 - protein, 9 aa, Artificial Sequence
  Peptide Derived from Human Papillomavirus
VQVLKRKYV

SEQ ID NO: 4925 - protein, 9 aa, Artificial Sequence
  Peptide Derived from Human Papillomavirus
VQWAYDNDV

SEQ ID NO: 4926 - protein, 10 aa, Artificial Sequence
  Peptide Derived from Human Papillomavirus
VQWAYDNDVM

SEQ ID NO: 4927 - protein, 11 aa, Artificial Sequence
  Peptide Derived from Human Papillomavirus
VTGTVAEGFKT

SEQ ID NO: 4928 - protein, 8 aa, Artificial Sequence
  Peptide Derived from Human Papillomavirus
WAYDNDVM

SEQ ID NO: 4929 - protein, 8 aa, Artificial Sequence
  Peptide Derived from Human Papillomavirus
WIERQTVL

SEQ ID NO: 4930 - protein, 9 aa, Artificial Sequence
  Peptide Derived from Human Papillomavirus
WIKSRCDKV

SEQ ID NO: 4931 - protein, 8 aa, Artificial Sequence
  Peptide Derived from Human Papillomavirus
WLQPLADA

SEQ ID NO: 4932 - protein, 10 aa, Artificial Sequence
  Peptide Derived from Human Papillomavirus
WLQPLADAKI

SEQ ID NO: 4933 - protein, 10 aa, Artificial Sequence
  Peptide Derived from Human Papillomavirus
YANSKSHFWL

SEQ ID NO: 4934 - protein, 11 aa, Artificial Sequence
  Peptide Derived from Human Papillomavirus
YAQLADSDSNA

SEQ ID NO: 4935 - protein, 9 aa, Artificial Sequence
  Peptide Derived from Human Papillomavirus
YIDNYLRNA

SEQ ID NO: 4936 - protein, 10 aa, Artificial Sequence
  Peptide Derived from Human Papillomavirus
YIDNYLRNAL

SEQ ID NO: 4937 - protein, 8 aa, Artificial Sequence
  Peptide Derived from Human Papillomavirus
YLHSRLVV

SEQ ID NO: 4938 - protein, 10 aa, Artificial Sequence
  Peptide Derived from Human Papillomavirus
YLHSRLVVFT

SEQ ID NO: 4939 - protein, 11 aa, Artificial Sequence
  Peptide Derived from Human Papillomavirus
YLRNALDGNPV

SEQ ID NO: 4940 - protein, 10 aa, Artificial Sequence
  Peptide Derived from Human Papillomavirus
YQQIEFVSFL

SEQ ID NO: 4941 - protein, 10 aa, Artificial Sequence
  Peptide Derived from Human Papillomavirus
YVEAVIDRQT

SEQ ID NO: 4942 - protein, 9 aa, Artificial Sequence
  Peptide Derived from Human Papillomavirus
YVGSPLSDI

SEQ ID NO: 4943 - protein, 8 aa, Artificial Sequence
  Peptide Derived from Human Papillomavirus
AAACTNQT

SEQ ID NO: 4944 - protein, 10 aa, Artificial Sequence
  Peptide Derived from Human Papillomavirus
AAACTNQTRA

SEQ ID NO: 4945 - protein, 11 aa, Artificial Sequence
  Peptide Derived from Human Papillomavirus
AAACTNQTRAV

SEQ ID NO: 4946 - protein, 9 aa, Artificial Sequence
  Peptide Derived from Human Papillomavirus
AACTNQTRA

SEQ ID NO: 4947 - protein, 10 aa, Artificial Sequence
  Peptide Derived from Human Papillomavirus
AACTNQTRAV

SEQ ID NO: 4948 - protein, 8 aa, Artificial Sequence
  Peptide Derived from Human Papillomavirus
AIELQMML

SEQ ID NO: 4949 - protein, 10 aa, Artificial Sequence
  Peptide Derived from Human Papillomavirus
AIELQMMLET

SEQ ID NO: 4950 - protein, 11 aa, Artificial Sequence
  Peptide Derived from Human Papillomavirus
AIELQMMLETL

SEQ ID NO: 4951 - protein, 8 aa, Artificial Sequence
  Peptide Derived from Human Papillomavirus
AIVTLTYI

SEQ ID NO: 4952 - protein, 10 aa, Artificial Sequence
  Peptide Derived from Human Papillomavirus
AIVTLTYIST

SEQ ID NO: 4953 - protein, 8 aa, Artificial Sequence
  Peptide Derived from Human Papillomavirus
ALGTSEGV

SEQ ID NO: 4954 - protein, 11 aa, Artificial Sequence
  Peptide Derived from Human Papillomavirus
ALGTSEGVRRA

SEQ ID NO: 4955 - protein, 9 aa, Artificial Sequence
  Peptide Derived from Human Papillomavirus
ALQAIELQM

SEQ ID NO: 4956 - protein, 10 aa, Artificial Sequence
  Peptide Derived from Human Papillomavirus
ALQAIELQMM

SEQ ID NO: 4957 - protein, 11 aa, Artificial Sequence
  Peptide Derived from Human Papillomavirus
ALQAIELQMML

SEQ ID NO: 4958 - protein, 9 aa, Artificial Sequence
  Peptide Derived from Human Papillomavirus
ALSVSKAKA

SEQ ID NO: 4959 - protein, 10 aa, Artificial Sequence
  Peptide Derived from Human Papillomavirus
ALSVSKAKAL

SEQ ID NO: 4960 - protein, 8 aa, Artificial Sequence
  Peptide Derived from Human Papillomavirus
ATTPIIHL

SEQ ID NO: 4961 - protein, 10 aa, Artificial Sequence
  Peptide Derived from Human Papillomavirus
ATTSTKRPRT

SEQ ID NO: 4962 - protein, 8 aa, Artificial Sequence
  Peptide Derived from Human Papillomavirus
AVSCPATT

SEQ ID NO: 4963 - protein, 10 aa, Artificial Sequence
  Peptide Derived from Human Papillomavirus
AVSCPATTPI

SEQ ID NO: 4964 - protein, 11 aa, Artificial Sequence
  Peptide Derived from Human Papillomavirus
AVSCPATTPII

SEQ ID NO: 4965 - protein, 9 aa, Artificial Sequence
  Peptide Derived from Human Papillomavirus
CALGTSEGV

SEQ ID NO: 4966 - protein, 8 aa, Artificial Sequence
  Peptide Derived from Human Papillomavirus
CIDGQCTV

SEQ ID NO: 4967 - protein, 9 aa, Artificial Sequence
  Peptide Derived from Human Papillomavirus
CIDGQCTVV

SEQ ID NO: 4968 - protein, 8 aa, Artificial Sequence
  Peptide Derived from Human Papillomavirus
CLKKHGYT

SEQ ID NO: 4969 - protein, 9 aa, Artificial Sequence
  Peptide Derived from Human Papillomavirus
CLKKHGYTV

SEQ ID NO: 4970 - protein, 11 aa, Artificial Sequence
  Peptide Derived from Human Papillomavirus
CLKKHGYTVEV

SEQ ID NO: 4971 - protein, 9 aa, Artificial Sequence
  Peptide Derived from Human Papillomavirus
CTDGKHKNA

SEQ ID NO: 4972 - protein, 10 aa, Artificial Sequence
  Peptide Derived from Human Papillomavirus
CTDGKHKNAI

SEQ ID NO: 4973 - protein, 11 aa, Artificial Sequence
  Peptide Derived from Human Papillomavirus
CTDGKHKNAIV

SEQ ID NO: 4974 - protein, 8 aa, Artificial Sequence
  Peptide Derived from Human Papillomavirus
CTNQTRAV

SEQ ID NO: 4975 - protein, 8 aa, Artificial Sequence
  Peptide Derived from Human Papillomavirus
CTVVEGQV

SEQ ID NO: 4976 - protein, 10 aa, Artificial Sequence
  Peptide Derived from Human Papillomavirus
CVLMYKAREM

SEQ ID NO: 4977 - protein, 8 aa, Artificial Sequence
  Peptide Derived from Human Papillomavirus
DANILKCL

SEQ ID NO: 4978 - protein, 9 aa, Artificial Sequence
  Peptide Derived from Human Papillomavirus
DVHNTMHYT

SEQ ID NO: 4979 - protein, 8 aa, Artificial Sequence
  Peptide Derived from Human Papillomavirus
EISFAGIV

SEQ ID NO: 4980 - protein, 9 aa, Artificial Sequence
  Peptide Derived from Human Papillomavirus
EISFAGIVT

SEQ ID NO: 4981 - protein, 11 aa, Artificial Sequence
  Peptide Derived from Human Papillomavirus
EISFAGIVTKL

SEQ ID NO: 4982 - protein, 8 aa, Artificial Sequence
  Peptide Derived from Human Papillomavirus
ELQMMLET

SEQ ID NO: 4983 - protein, 9 aa, Artificial Sequence
  Peptide Derived from Human Papillomavirus
ELQMMLETL

SEQ ID NO: 4984 - protein, 8 aa, Artificial Sequence
  Peptide Derived from Human Papillomavirus
ELYLTAPT

SEQ ID NO: 4985 - protein, 11 aa, Artificial Sequence
  Peptide Derived from Human Papillomavirus
ELYLTAPTGCL

SEQ ID NO: 4986 - protein, 11 aa, Artificial Sequence
  Peptide Derived from Human Papillomavirus
EMGIHSINHQV

SEQ ID NO: 4987 - protein, 10 aa, Artificial Sequence
  Peptide Derived from Human Papillomavirus
EQVSSTWHWT

SEQ ID NO: 4988 - protein, 9 aa, Artificial Sequence
  Peptide Derived from Human Papillomavirus
ETLSQRLNV

SEQ ID NO: 4989 - protein, 8 aa, Artificial Sequence
  Peptide Derived from Human Papillomavirus
EVHAGGQV

SEQ ID NO: 4990 - protein, 9 aa, Artificial Sequence
  Peptide Derived from Human Papillomavirus
EVHAGGQVI

SEQ ID NO: 4991 - protein, 10 aa, Artificial Sequence
  Peptide Derived from Human Papillomavirus
EVHAGGQVIV

SEQ ID NO: 4992 - protein, 8 aa, Artificial Sequence
  Peptide Derived from Human Papillomavirus
EVQFDGDV

SEQ ID NO: 4993 - protein, 11 aa, Artificial Sequence
  Peptide Derived from Human Papillomavirus
EVQFDGDVHNT

SEQ ID NO: 4994 - protein, 8 aa, Artificial Sequence
  Peptide Derived from Human Papillomavirus
FAGIVTKL

SEQ ID NO: 4995 - protein, 10 aa, Artificial Sequence
  Peptide Derived from Human Papillomavirus
FAGIVTKLPT

SEQ ID NO: 4996 - protein, 11 aa, Artificial Sequence
  Peptide Derived from Human Papillomavirus
FAGIVTKLPTA

SEQ ID NO: 4997 - protein, 11 aa, Artificial Sequence
  Peptide Derived from Human Papillomavirus
FIYLCIDGQCT

SEQ ID NO: 4998 - protein, 10 aa, Artificial Sequence
  Peptide Derived from Human Papillomavirus
FLNTVKIPNT

SEQ ID NO: 4999 - protein, 11 aa, Artificial Sequence
  Peptide Derived from Human Papillomavirus
FLNTVKIPNTV

SEQ ID NO: 5000 - protein, 10 aa, Artificial Sequence
  Peptide Derived from Human Papillomavirus
FTEEAKKYGT

SEQ ID NO: 5001 - protein, 8 aa, Artificial Sequence
  Peptide Derived from Human Papillomavirus
FVNFTEEA

SEQ ID NO: 5002 - protein, 9 aa, Artificial Sequence
  Peptide Derived from Human Papillomavirus
GIHSINHQV

SEQ ID NO: 5003 - protein, 10 aa, Artificial Sequence
  Peptide Derived from Human Papillomavirus
GIHSINHQVV

SEQ ID NO: 5004 - protein, 8 aa, Artificial Sequence
  Peptide Derived from Human Papillomavirus
GIVTKLPT

SEQ ID NO: 5005 - protein, 9 aa, Artificial Sequence
  Peptide Derived from Human Papillomavirus
GIVTKLPTA

SEQ ID NO: 5006 - protein, 10 aa, Artificial Sequence
  Peptide Derived from Human Papillomavirus
GIYYVHEGHI

SEQ ID NO: 5007 - protein, 11 aa, Artificial Sequence
  Peptide Derived from Human Papillomavirus
GIYYVHEGHIT

SEQ ID NO: 5008 - protein, 10 aa, Artificial Sequence
  Peptide Derived from Human Papillomavirus
GQCTVVEGQV

SEQ ID NO: 5009 - protein, 10 aa, Artificial Sequence
  Peptide Derived from Human Papillomavirus
GQVIVFPESV

SEQ ID NO: 5010 - protein, 8 aa, Artificial Sequence
  Peptide Derived from Human Papillomavirus
GQVNCKGI

SEQ ID NO: 5011 - protein, 11 aa, Artificial Sequence
  Peptide Derived from Human Papillomavirus
GQVNCKGIYYV

SEQ ID NO: 5012 - protein, 8 aa, Artificial Sequence
  Peptide Derived from Human Papillomavirus
GTGKKWEV

SEQ ID NO: 5013 - protein, 10 aa, Artificial Sequence
  Peptide Derived from Human Papillomavirus
GTGKKWEVHA

SEQ ID NO: 5014 - protein, 9 aa, Artificial Sequence
  Peptide Derived from Human Papillomavirus
GTSEGVRRA

SEQ ID NO: 5015 - protein, 10 aa, Artificial Sequence
  Peptide Derived from Human Papillomavirus
GTSEGVRRAT

SEQ ID NO: 5016 - protein, 11 aa, Artificial Sequence
  Peptide Derived from Human Papillomavirus
GTSEGVRRATT

SEQ ID NO: 5017 - protein, 9 aa, Artificial Sequence
  Peptide Derived from Human Papillomavirus
GVISAAACT

SEQ ID NO: 5018 - protein, 9 aa, Artificial Sequence
  Peptide Derived from Human Papillomavirus
GVRRATTST

SEQ ID NO: 5019 - protein, 8 aa, Artificial Sequence
  Peptide Derived from Human Papillomavirus
HAGGQVIV

SEQ ID NO: 5020 - protein, 8 aa, Artificial Sequence
  Peptide Derived from Human Papillomavirus
HIDYWKHI

SEQ ID NO: 5021 - protein, 10 aa, Artificial Sequence
  Peptide Derived from Human Papillomavirus
HIDYWKHIRL

SEQ ID NO: 5022 - protein, 8 aa, Artificial Sequence
  Peptide Derived from Human Papillomavirus
HIRLECVL

SEQ ID NO: 5023 - protein, 9 aa, Artificial Sequence
  Peptide Derived from Human Papillomavirus
HIRLECVLM

SEQ ID NO: 5024 - protein, 9 aa, Artificial Sequence
  Peptide Derived from Human Papillomavirus
HITYFVNFT

SEQ ID NO: 5025 - protein, 8 aa, Artificial Sequence
  Peptide Derived from Human Papillomavirus
HLKGDANI

SEQ ID NO: 5026 - protein, 9 aa, Artificial Sequence
  Peptide Derived from Human Papillomavirus
HLKGDANIL

SEQ ID NO: 5027 - protein, 9 aa, Artificial Sequence
  Peptide Derived from Human Papillomavirus
HQVVPALSV

SEQ ID NO: 5028 - protein, 8 aa, Artificial Sequence
  Peptide Derived from Human Papillomavirus
IIHLKGDA

SEQ ID NO: 5029 - protein, 10 aa, Artificial Sequence
  Peptide Derived from Human Papillomavirus
IIHLKGDANI

SEQ ID NO: 5030 - protein, 11 aa, Artificial Sequence
  Peptide Derived from Human Papillomavirus
IIHLKGDANIL

SEQ ID NO: 5031 - protein, 9 aa, Artificial Sequence
  Peptide Derived from Human Papillomavirus
ILKCLRYRL

SEQ ID NO: 5032 - protein, 8 aa, Artificial Sequence
  Peptide Derived from Human Papillomavirus
ITYFVNFT

SEQ ID NO: 5033 - protein, 11 aa, Artificial Sequence
  Peptide Derived from Human Papillomavirus
ITYFVNFTEEA

SEQ ID NO: 5034 - protein, 8 aa, Artificial Sequence
  Peptide Derived from Human Papillomavirus
IVTKLPTA

SEQ ID NO: 5035 - protein, 11 aa, Artificial Sequence
  Peptide Derived from Human Papillomavirus
IVTKLPTANNT

SEQ ID NO: 5036 - protein, 9 aa, Artificial Sequence
  Peptide Derived from Human Papillomavirus
IVTLTYIST

SEQ ID NO: 5037 - protein, 8 aa, Artificial Sequence
  Peptide Derived from Human Papillomavirus
KAKALQAI

SEQ ID NO: 5038 - protein, 10 aa, Artificial Sequence
  Peptide Derived from Human Papillomavirus
KAKALQAIEL

SEQ ID NO: 5039 - protein, 8 aa, Artificial Sequence
  Peptide Derived from Human Papillomavirus
KALQAIEL

SEQ ID NO: 5040 - protein, 10 aa, Artificial Sequence
  Peptide Derived from Human Papillomavirus
KALQAIELQM

SEQ ID NO: 5041 - protein, 11 aa, Artificial Sequence
  Peptide Derived from Human Papillomavirus
KALQAIELQMM

SEQ ID NO: 5042 - protein, 10 aa, Artificial Sequence
  Peptide Derived from Human Papillomavirus
KAREMGIHSI

SEQ ID NO: 5043 - protein, 8 aa, Artificial Sequence
  Peptide Derived from Human Papillomavirus
KIPNTVSV

SEQ ID NO: 5044 - protein, 10 aa, Artificial Sequence
  Peptide Derived from Human Papillomavirus
KIPNTVSVST

SEQ ID NO: 5045 - protein, 8 aa, Artificial Sequence
  Peptide Derived from Human Papillomavirus
KLLRGDSV

SEQ ID NO: 5046 - protein, 11 aa, Artificial Sequence
  Peptide Derived from Human Papillomavirus
KLLRGDSVDSV

SEQ ID NO: 5047 - protein, 8 aa, Artificial Sequence
  Peptide Derived from Human Papillomavirus
KLPTANNT

SEQ ID NO: 5048 - protein, 9 aa, Artificial Sequence
  Peptide Derived from Human Papillomavirus
KLPTANNTT

SEQ ID NO: 5049 - protein, 10 aa, Artificial Sequence
  Peptide Derived from Human Papillomavirus
KLPTANNTTT

SEQ ID NO: 5050 - protein, 10 aa, Artificial Sequence
  Peptide Derived from Human Papillomavirus
KQLYEQVSST

SEQ ID NO: 5051 - protein, 11 aa, Artificial Sequence
  Peptide Derived from Human Papillomavirus
KTCALGTSEGV

SEQ ID NO: 5052 - protein, 10 aa, Artificial Sequence
  Peptide Derived from Human Papillomavirus
LLRGDSVDSV

SEQ ID NO: 5053 - protein, 8 aa, Artificial Sequence
  Peptide Derived from Human Papillomavirus
LMYKAREM

SEQ ID NO: 5054 - protein, 10 aa, Artificial Sequence
  Peptide Derived from Human Papillomavirus
LMYKAREMGI

SEQ ID NO: 5055 - protein, 8 aa, Artificial Sequence
  Peptide Derived from Human Papillomavirus
LQAIELQM

SEQ ID NO: 5056 - protein, 9 aa, Artificial Sequence
  Peptide Derived from Human Papillomavirus
LQAIELQMM

SEQ ID NO: 5057 - protein, 10 aa, Artificial Sequence
  Peptide Derived from Human Papillomavirus
LQAIELQMML

SEQ ID NO: 5058 - protein, 8 aa, Artificial Sequence
  Peptide Derived from Human Papillomavirus
LQMMLETL

SEQ ID NO: 5059 - protein, 11 aa, Artificial Sequence
  Peptide Derived from Human Papillomavirus
LQMMLETLNNT

SEQ ID NO: 5060 - protein, 8 aa, Artificial Sequence
  Peptide Derived from Human Papillomavirus
LTAPTGCL

SEQ ID NO: 5061 - protein, 8 aa, Artificial Sequence
  Peptide Derived from Human Papillomavirus
MLETLNNT

SEQ ID NO: 5062 - protein, 9 aa, Artificial Sequence
  Peptide Derived from Human Papillomavirus
MMLETLNNT

SEQ ID NO: 5063 - protein, 8 aa, Artificial Sequence
  Peptide Derived from Human Papillomavirus
MQQTSLEL

SEQ ID NO: 5064 - protein, 10 aa, Artificial Sequence
  Peptide Derived from Human Papillomavirus
MQQTSLELYL

SEQ ID NO: 5065 - protein, 11 aa, Artificial Sequence
  Peptide Derived from Human Papillomavirus
MQQTSLELYLT

SEQ ID NO: 5066 - protein, 9 aa, Artificial Sequence
  Peptide Derived from Human Papillomavirus
NAIVTLTYI

SEQ ID NO: 5067 - protein, 11 aa, Artificial Sequence
  Peptide Derived from Human Papillomavirus
NAIVTLTYIST

SEQ ID NO: 5068 - protein, 10 aa, Artificial Sequence
  Peptide Derived from Human Papillomavirus
NILKCLRYRL

SEQ ID NO: 5069 - protein, 10 aa, Artificial Sequence
  Peptide Derived from Human Papillomavirus
NQTRAVSCPA

SEQ ID NO: 5070 - protein, 11 aa, Artificial Sequence
  Peptide Derived from Human Papillomavirus
NQTRAVSCPAT

SEQ ID NO: 5071 - protein, 10 aa, Artificial Sequence
  Peptide Derived from Human Papillomavirus
NTEYKNEDWT

SEQ ID NO: 5072 - protein, 11 aa, Artificial Sequence
  Peptide Derived from Human Papillomavirus
NTEYKNEDWTM

SEQ ID NO: 5073 - protein, 8 aa, Artificial Sequence
  Peptide Derived from Human Papillomavirus
NTHHPNKL

SEQ ID NO: 5074 - protein, 9 aa, Artificial Sequence
  Peptide Derived from Human Papillomavirus
NTHHPNKLL

SEQ ID NO: 5075 - protein, 11 aa, Artificial Sequence
  Peptide Derived from Human Papillomavirus
NTMHYTNWKFI

SEQ ID NO: 5076 - protein, 9 aa, Artificial Sequence
  Peptide Derived from Human Papillomavirus
NTTTSNSKT

SEQ ID NO: 5077 - protein, 11 aa, Artificial Sequence
  Peptide Derived from Human Papillomavirus
NTTTSNSKTCA

SEQ ID NO: 5078 - protein, 8 aa, Artificial Sequence
  Peptide Derived from Human Papillomavirus
NTVKIPNT

SEQ ID NO: 5079 - protein, 9 aa, Artificial Sequence
  Peptide Derived from Human Papillomavirus
NTVKIPNTV

SEQ ID NO: 5080 - protein, 11 aa, Artificial Sequence
  Peptide Derived from Human Papillomavirus
NTVKIPNTVSV

SEQ ID NO: 5081 - protein, 10 aa, Artificial Sequence
  Peptide Derived from Human Papillomavirus
NTVSVSTGYM

SEQ ID NO: 5082 - protein, 11 aa, Artificial Sequence
  Peptide Derived from Human Papillomavirus
NTVSVSTGYMT

SEQ ID NO: 5083 - protein, 8 aa, Artificial Sequence
  Peptide Derived from Human Papillomavirus
NVCQDKIL

SEQ ID NO: 5084 - protein, 8 aa, Artificial Sequence
  Peptide Derived from Human Papillomavirus
PALSVSKA

SEQ ID NO: 5085 - protein, 10 aa, Artificial Sequence
  Peptide Derived from Human Papillomavirus
PALSVSKAKA

SEQ ID NO: 5086 - protein, 11 aa, Artificial Sequence
  Peptide Derived from Human Papillomavirus
PALSVSKAKAL

SEQ ID NO: 5087 - protein, 9 aa, Artificial Sequence
  Peptide Derived from Human Papillomavirus
PATTPIIHL

SEQ ID NO: 5088 - protein, 9 aa, Artificial Sequence
  Peptide Derived from Human Papillomavirus
PIIHLKGDA

SEQ ID NO: 5089 - protein, 11 aa, Artificial Sequence
  Peptide Derived from Human Papillomavirus
PIIHLKGDANI

SEQ ID NO: 5090 - protein, 8 aa, Artificial Sequence
  Peptide Derived from Human Papillomavirus
PTANNTTT

SEQ ID NO: 5091 - protein, 11 aa, Artificial Sequence
  Peptide Derived from Human Papillomavirus
PTGCLKKHGYT

SEQ ID NO: 5092 - protein, 8 aa, Artificial Sequence
  Peptide Derived from Human Papillomavirus
QAIELQMM

SEQ ID NO: 5093 - protein, 9 aa, Artificial Sequence
  Peptide Derived from Human Papillomavirus
QAIELQMML

SEQ ID NO: 5094 - protein, 11 aa, Artificial Sequence
  Peptide Derived from Human Papillomavirus
QAIELQMMLET

SEQ ID NO: 5095 - protein, 9 aa, Artificial Sequence
  Peptide Derived from Human Papillomavirus
QLYEQVSST

SEQ ID NO: 5096 - protein, 10 aa, Artificial Sequence
  Peptide Derived from Human Papillomavirus
QMMLETLNNT

SEQ ID NO: 5097 - protein, 9 aa, Artificial Sequence
  Peptide Derived from Human Papillomavirus
QQTSLELYL

SEQ ID NO: 5098 - protein, 10 aa, Artificial Sequence
  Peptide Derived from Human Papillomavirus
QQTSLELYLT

SEQ ID NO: 5099 - protein, 11 aa, Artificial Sequence
  Peptide Derived from Human Papillomavirus
QQTSLELYLTA

SEQ ID NO: 5100 - protein, 9 aa, Artificial Sequence
  Peptide Derived from Human Papillomavirus
QTRAVSCPA

SEQ ID NO: 5101 - protein, 10 aa, Artificial Sequence
  Peptide Derived from Human Papillomavirus
QTRAVSCPAT

SEQ ID NO: 5102 - protein, 11 aa, Artificial Sequence
  Peptide Derived from Human Papillomavirus
QTRAVSCPATT

SEQ ID NO: 5103 - protein, 8 aa, Artificial Sequence
  Peptide Derived from Human Papillomavirus
QTSLELYL

SEQ ID NO: 5104 - protein, 9 aa, Artificial Sequence
  Peptide Derived from Human Papillomavirus
QTSLELYLT

SEQ ID NO: 5105 - protein, 10 aa, Artificial Sequence
  Peptide Derived from Human Papillomavirus
QTSLELYLTA

SEQ ID NO: 5106 - protein, 9 aa, Artificial Sequence
  Peptide Derived from Human Papillomavirus
QVIVFPESV

SEQ ID NO: 5107 - protein, 10 aa, Artificial Sequence
  Peptide Derived from Human Papillomavirus
QVNCKGIYYV

SEQ ID NO: 5108 - protein, 9 aa, Artificial Sequence
  Peptide Derived from Human Papillomavirus
QVSSTWHWT

SEQ ID NO: 5109 - protein, 11 aa, Artificial Sequence
  Peptide Derived from Human Papillomavirus
QVSSTWHWTCT

SEQ ID NO: 5110 - protein, 8 aa, Artificial Sequence
  Peptide Derived from Human Papillomavirus
QVVPALSV

SEQ ID NO: 5111 - protein, 11 aa, Artificial Sequence
  Peptide Derived from Human Papillomavirus
QVVPALSVSKA

SEQ ID NO: 5112 - protein, 11 aa, Artificial Sequence
  Peptide Derived from Human Papillomavirus
RATTSTKRPRT

SEQ ID NO: 5113 - protein, 8 aa, Artificial Sequence
  Peptide Derived from Human Papillomavirus
RAVSCPAT

SEQ ID NO: 5114 - protein, 9 aa, Artificial Sequence
  Peptide Derived from Human Papillomavirus
RAVSCPATT

SEQ ID NO: 5115 - protein, 11 aa, Artificial Sequence
  Peptide Derived from Human Papillomavirus
RAVSCPATTPI

SEQ ID NO: 5116 - protein, 10 aa, Artificial Sequence
  Peptide Derived from Human Papillomavirus
RLECVLMYKA

SEQ ID NO: 5117 - protein, 9 aa, Artificial Sequence
  Peptide Derived from Human Papillomavirus
RLNVCQDKI

SEQ ID NO: 5118 - protein, 10 aa, Artificial Sequence
  Peptide Derived from Human Papillomavirus
RLNVCQDKIL

SEQ ID NO: 5119 - protein, 8 aa, Artificial Sequence
  Peptide Derived from Human Papillomavirus
RLSKYKQL

SEQ ID NO: 5120 - protein, 9 aa, Artificial Sequence
  Peptide Derived from Human Papillomavirus
RTEPEHRNT

SEQ ID NO: 5121 - protein, 9 aa, Artificial Sequence
  Peptide Derived from Human Papillomavirus
SAAACTNQT

SEQ ID NO: 5122 - protein, 11 aa, Artificial Sequence
  Peptide Derived from Human Papillomavirus
SAAACTNQTRA

SEQ ID NO: 5123 - protein, 9 aa, Artificial Sequence
  Peptide Derived from Human Papillomavirus
SINHQVVPA

SEQ ID NO: 5124 - protein, 10 aa, Artificial Sequence
  Peptide Derived from Human Papillomavirus
SINHQVVPAL

SEQ ID NO: 5125 - protein, 8 aa, Artificial Sequence
  Peptide Derived from Human Papillomavirus
SLELYLTA

SEQ ID NO: 5126 - protein, 10 aa, Artificial Sequence
  Peptide Derived from Human Papillomavirus
SLELYLTAPT

SEQ ID NO: 5127 - protein, 9 aa, Artificial Sequence
  Peptide Derived from Human Papillomavirus
SQRDDFLNT

SEQ ID NO: 5128 - protein, 10 aa, Artificial Sequence
  Peptide Derived from Human Papillomavirus
SQRDDFLNTV

SEQ ID NO: 5129 - protein, 11 aa, Artificial Sequence
  Peptide Derived from Human Papillomavirus
SQRLNVCQDKI

SEQ ID NO: 5130 - protein, 9 aa, Artificial Sequence
  Peptide Derived from Human Papillomavirus
STSQRDDFL

SEQ ID NO: 5131 - protein, 11 aa, Artificial Sequence
  Peptide Derived from Human Papillomavirus
STSQRDDFLNT

SEQ ID NO: 5132 - protein, 8 aa, Artificial Sequence
  Peptide Derived from Human Papillomavirus
STWHWTCT

SEQ ID NO: 5133 - protein, 9 aa, Artificial Sequence
  Peptide Derived from Human Papillomavirus
SVDSVNCGV

SEQ ID NO: 5134 - protein, 10 aa, Artificial Sequence
  Peptide Derived from Human Papillomavirus
SVDSVNCGVI

SEQ ID NO: 5135 - protein, 8 aa, Artificial Sequence
  Peptide Derived from Human Papillomavirus
SVFSSDEI

SEQ ID NO: 5136 - protein, 11 aa, Artificial Sequence
  Peptide Derived from Human Papillomavirus
SVFSSDEISFA

SEQ ID NO: 5137 - protein, 9 aa, Artificial Sequence
  Peptide Derived from Human Papillomavirus
SVNCGVISA

SEQ ID NO: 5138 - protein, 10 aa, Artificial Sequence
  Peptide Derived from Human Papillomavirus
SVNCGVISAA

SEQ ID NO: 5139 - protein, 11 aa, Artificial Sequence
  Peptide Derived from Human Papillomavirus
SVNCGVISAAA

SEQ ID NO: 5140 - protein, 8 aa, Artificial Sequence
  Peptide Derived from Human Papillomavirus
SVSKAKAL

SEQ ID NO: 5141 - protein, 10 aa, Artificial Sequence
  Peptide Derived from Human Papillomavirus
SVSKAKALQA

SEQ ID NO: 5142 - protein, 11 aa, Artificial Sequence
  Peptide Derived from Human Papillomavirus
SVSKAKALQAI

SEQ ID NO: 5143 - protein, 8 aa, Artificial Sequence
  Peptide Derived from Human Papillomavirus
SVSTGYMT

SEQ ID NO: 5144 - protein, 9 aa, Artificial Sequence
  Peptide Derived from Human Papillomavirus
SVSTGYMTI

SEQ ID NO: 5145 - protein, 8 aa, Artificial Sequence
  Peptide Derived from Human Papillomavirus
TLSQRLNV

SEQ ID NO: 5146 - protein, 10 aa, Artificial Sequence
  Peptide Derived from Human Papillomavirus
TMHYTNWKFI

SEQ ID NO: 5147 - protein, 9 aa, Artificial Sequence
  Peptide Derived from Human Papillomavirus
TMQQTSLEL

SEQ ID NO: 5148 - protein, 11 aa, Artificial Sequence
  Peptide Derived from Human Papillomavirus
TMQQTSLELYL

SEQ ID NO: 5149 - protein, 11 aa, Artificial Sequence
  Peptide Derived from Human Papillomavirus
TTPIIHLKGDA

SEQ ID NO: 5150 - protein, 9 aa, Artificial Sequence
  Peptide Derived from Human Papillomavirus
TTSNSKTCA

SEQ ID NO: 5151 - protein, 10 aa, Artificial Sequence
  Peptide Derived from Human Papillomavirus
TTSNSKTCAL

SEQ ID NO: 5152 - protein, 9 aa, Artificial Sequence
  Peptide Derived from Human Papillomavirus
TTSTKRPRT

SEQ ID NO: 5153 - protein, 8 aa, Artificial Sequence
  Peptide Derived from Human Papillomavirus
TTTSNSKT

SEQ ID NO: 5154 - protein, 10 aa, Artificial Sequence
  Peptide Derived from Human Papillomavirus
TTTSNSKTCA

SEQ ID NO: 5155 - protein, 11 aa, Artificial Sequence
  Peptide Derived from Human Papillomavirus
TTTSNSKTCAL

SEQ ID NO: 5156 - protein, 10 aa, Artificial Sequence
  Peptide Derived from Human Papillomavirus
TVEVQFDGDV

SEQ ID NO: 5157 - protein, 8 aa, Artificial Sequence
  Peptide Derived from Human Papillomavirus
TVKIPNTV

SEQ ID NO: 5158 - protein, 10 aa, Artificial Sequence
  Peptide Derived from Human Papillomavirus
TVKIPNTVSV

SEQ ID NO: 5159 - protein, 9 aa, Artificial Sequence
  Peptide Derived from Human Papillomavirus
TVSVSTGYM

SEQ ID NO: 5160 - protein, 10 aa, Artificial Sequence
  Peptide Derived from Human Papillomavirus
TVSVSTGYMT

SEQ ID NO: 5161 - protein, 11 aa, Artificial Sequence
  Peptide Derived from Human Papillomavirus
TVSVSTGYMTI

SEQ ID NO: 5162 - protein, 8 aa, Artificial Sequence
  Peptide Derived from Human Papillomavirus
VISAAACT

SEQ ID NO: 5163 - protein, 11 aa, Artificial Sequence
  Peptide Derived from Human Papillomavirus
VISAAACTNQT

SEQ ID NO: 5164 - protein, 8 aa, Artificial Sequence
  Peptide Derived from Human Papillomavirus
VIVFPESV

SEQ ID NO: 5165 - protein, 9 aa, Artificial Sequence
  Peptide Derived from Human Papillomavirus
VLMYKAREM

SEQ ID NO: 5166 - protein, 11 aa, Artificial Sequence
  Peptide Derived from Human Papillomavirus
VLMYKAREMGI

SEQ ID NO: 5167 - protein, 10 aa, Artificial Sequence
  Peptide Derived from Human Papillomavirus
VQFDGDVHNT

SEQ ID NO: 5168 - protein, 11 aa, Artificial Sequence
  Peptide Derived from Human Papillomavirus
VQFDGDVHNTM

SEQ ID NO: 5169 - protein, 10 aa, Artificial Sequence
  Peptide Derived from Human Papillomavirus
VTKLPTANNT

SEQ ID NO: 5170 - protein, 11 aa, Artificial Sequence
  Peptide Derived from Human Papillomavirus
VTKLPTANNTT

SEQ ID NO: 5171 - protein, 8 aa, Artificial Sequence
  Peptide Derived from Human Papillomavirus
VTLTYIST

SEQ ID NO: 5172 - protein, 11 aa, Artificial Sequence
  Peptide Derived from Human Papillomavirus
VVEGQVNCKGI

SEQ ID NO: 5173 - protein, 10 aa, Artificial Sequence
  Peptide Derived from Human Papillomavirus
VVPALSVSKA

SEQ ID NO: 5174 - protein, 11 aa, Artificial Sequence
  Peptide Derived from Human Papillomavirus
WTCTDGKHKNA

SEQ ID NO: 5175 - protein, 8 aa, Artificial Sequence
  Peptide Derived from Human Papillomavirus
WTMQQTSL

SEQ ID NO: 5176 - protein, 10 aa, Artificial Sequence
  Peptide Derived from Human Papillomavirus
WTMQQTSLEL

SEQ ID NO: 5177 - protein, 11 aa, Artificial Sequence
  Peptide Derived from Human Papillomavirus
YISTSQRDDFL

SEQ ID NO: 5178 - protein, 9 aa, Artificial Sequence
  Peptide Derived from Human Papillomavirus
YLCIDGQCT

SEQ ID NO: 5179 - protein, 10 aa, Artificial Sequence
  Peptide Derived from Human Papillomavirus
YLCIDGQCTV

SEQ ID NO: 5180 - protein, 11 aa, Artificial Sequence
  Peptide Derived from Human Papillomavirus
YLCIDGQCTVV

SEQ ID NO: 5181 - protein, 9 aa, Artificial Sequence
  Peptide Derived from Human Papillomavirus
YLTAPTGCL

SEQ ID NO: 5182 - protein, 9 aa, Artificial Sequence
  Peptide Derived from Human Papillomavirus
YTNWKFIYL

SEQ ID NO: 5183 - protein, 11 aa, Artificial Sequence
  Peptide Derived from Human Papillomavirus
YTNWKFIYLCI

SEQ ID NO: 5184 - protein, 11 aa, Artificial Sequence
  Peptide Derived from Human Papillomavirus
YTVEVQFDGDV

SEQ ID NO: 5185 - protein, 8 aa, Artificial Sequence
  Peptide Derived from Human Papillomavirus
YVHEGHIT

SEQ ID NO: 5186 - protein, 11 aa, Artificial Sequence
  Peptide Derived from Human Papillomavirus
YVHEGHITYFV

SEQ ID NO: 5187 - protein, 8 aa, Artificial Sequence
  Peptide Derived from Human Papillomavirus
ATLLLLIV

SEQ ID NO: 5188 - protein, 9 aa, Artificial Sequence
  Peptide Derived from Human Papillomavirus
ATLLLLIVI

SEQ ID NO: 5189 - protein, 10 aa, Artificial Sequence
  Peptide Derived from Human Papillomavirus
ATLLLLIVIL

SEQ ID NO: 5190 - protein, 10 aa, Artificial Sequence
  Peptide Derived from Human Papillomavirus
ATSPLRCFCI

SEQ ID NO: 5191 - protein, 9 aa, Artificial Sequence
  Peptide Derived from Human Papillomavirus
CIYVVFIYI

SEQ ID NO: 5192 - protein, 11 aa, Artificial Sequence
  Peptide Derived from Human Papillomavirus
CIYVVFIYIPL

SEQ ID NO: 5193 - protein, 8 aa, Artificial Sequence
  Peptide Derived from Human Papillomavirus
CLVIRPLV

SEQ ID NO: 5194 - protein, 9 aa, Artificial Sequence
  Peptide Derived from Human Papillomavirus
CLVIRPLVL

SEQ ID NO: 5195 - protein, 11 aa, Artificial Sequence
  Peptide Derived from Human Papillomavirus
CLVIRPLVLSV

SEQ ID NO: 5196 - protein, 8 aa, Artificial Sequence
  Peptide Derived from Human Papillomavirus
CVLLFVCL

SEQ ID NO: 5197 - protein, 9 aa, Artificial Sequence
  Peptide Derived from Human Papillomavirus
CVLLFVCLV

SEQ ID NO: 5198 - protein, 10 aa, Artificial Sequence
  Peptide Derived from Human Papillomavirus
CVLLFVCLVI

SEQ ID NO: 5199 - protein, 9 aa, Artificial Sequence
  Peptide Derived from Human Papillomavirus
ELNISTVSI

SEQ ID NO: 5200 - protein, 10 aa, Artificial Sequence
  Peptide Derived from Human Papillomavirus
ELNISTVSIV

SEQ ID NO: 5201 - protein, 11 aa, Artificial Sequence
  Peptide Derived from Human Papillomavirus
ELNISTVSIVL

SEQ ID NO: 5202 - protein, 8 aa, Artificial Sequence
  Peptide Derived from Human Papillomavirus
FIYIPLFV

SEQ ID NO: 5203 - protein, 9 aa, Artificial Sequence
  Peptide Derived from Human Papillomavirus
FIYIPLFVI

SEQ ID NO: 5204 - protein, 11 aa, Artificial Sequence
  Peptide Derived from Human Papillomavirus
FIYIPLFVIHT

SEQ ID NO: 5205 - protein, 8 aa, Artificial Sequence
  Peptide Derived from Human Papillomavirus
FLLCFCVL

SEQ ID NO: 5206 - protein, 9 aa, Artificial Sequence
  Peptide Derived from Human Papillomavirus
FLLCFCVLL

SEQ ID NO: 5207 - protein, 11 aa, Artificial Sequence
  Peptide Derived from Human Papillomavirus
FLLCFCVLLFV

SEQ ID NO: 5208 - protein, 9 aa, Artificial Sequence
  Peptide Derived from Human Papillomavirus
FVCLVIRPL

SEQ ID NO: 5209 - protein, 10 aa, Artificial Sequence
  Peptide Derived from Human Papillomavirus
FVCLVIRPLV

SEQ ID NO: 5210 - protein, 11 aa, Artificial Sequence
  Peptide Derived from Human Papillomavirus
FVCLVIRPLVL

SEQ ID NO: 5211 - protein, 10 aa, Artificial Sequence
  Peptide Derived from Human Papillomavirus
FVIHTHASFL

SEQ ID NO: 5212 - protein, 11 aa, Artificial Sequence
  Peptide Derived from Human Papillomavirus
IATSPLRCFCI

SEQ ID NO: 5213 - protein, 10 aa, Artificial Sequence
  Peptide Derived from Human Papillomavirus
ILWVIATSPL

SEQ ID NO: 5214 - protein, 8 aa, Artificial Sequence
  Peptide Derived from Human Papillomavirus
IVILWVIA

SEQ ID NO: 5215 - protein, 9 aa, Artificial Sequence
  Peptide Derived from Human Papillomavirus
IVILWVIAT

SEQ ID NO: 5216 - protein, 11 aa, Artificial Sequence
  Peptide Derived from Human Papillomavirus
IVLCFLLCFCV

SEQ ID NO: 5217 - protein, 8 aa, Artificial Sequence
  Peptide Derived from Human Papillomavirus
LIVILWVI

SEQ ID NO: 5218 - protein, 9 aa, Artificial Sequence
  Peptide Derived from Human Papillomavirus
LIVILWVIA

SEQ ID NO: 5219 - protein, 10 aa, Artificial Sequence
  Peptide Derived from Human Papillomavirus
LIVILWVIAT

SEQ ID NO: 5220 - protein, 8 aa, Artificial Sequence
  Peptide Derived from Human Papillomavirus
LLCFCVLL

SEQ ID NO: 5221 - protein, 10 aa, Artificial Sequence
  Peptide Derived from Human Papillomavirus
LLCFCVLLFV

SEQ ID NO: 5222 - protein, 8 aa, Artificial Sequence
  Peptide Derived from Human Papillomavirus
LLFVCLVI

SEQ ID NO: 5223 - protein, 11 aa, Artificial Sequence
  Peptide Derived from Human Papillomavirus
LLFVCLVIRPL

SEQ ID NO: 5224 - protein, 8 aa, Artificial Sequence
  Peptide Derived from Human Papillomavirus
LLIVILWV

SEQ ID NO: 5225 - protein, 9 aa, Artificial Sequence
  Peptide Derived from Human Papillomavirus
LLIVILWVI

SEQ ID NO: 5226 - protein, 10 aa, Artificial Sequence
  Peptide Derived from Human Papillomavirus
LLIVILWVIA

SEQ ID NO: 5227 - protein, 11 aa, Artificial Sequence
  Peptide Derived from Human Papillomavirus
LLIVILWVIAT

SEQ ID NO: 5228 - protein, 9 aa, Artificial Sequence
  Peptide Derived from Human Papillomavirus
LLLIVILWV

SEQ ID NO: 5229 - protein, 10 aa, Artificial Sequence
  Peptide Derived from Human Papillomavirus
LLLIVILWVI

SEQ ID NO: 5230 - protein, 11 aa, Artificial Sequence
  Peptide Derived from Human Papillomavirus
LLLIVILWVIA

SEQ ID NO: 5231 - protein, 8 aa, Artificial Sequence
  Peptide Derived from Human Papillomavirus
LLLLIVIL

SEQ ID NO: 5232 - protein, 10 aa, Artificial Sequence
  Peptide Derived from Human Papillomavirus
LLLLIVILWV

SEQ ID NO: 5233 - protein, 11 aa, Artificial Sequence
  Peptide Derived from Human Papillomavirus
LLLLIVILWVI

SEQ ID NO: 5234 - protein, 8 aa, Artificial Sequence
  Peptide Derived from Human Papillomavirus
LVIRPLVL

SEQ ID NO: 5235 - protein, 10 aa, Artificial Sequence
  Peptide Derived from Human Papillomavirus
LVIRPLVLSV

SEQ ID NO: 5236 - protein, 9 aa, Artificial Sequence
  Peptide Derived from Human Papillomavirus
LVLSVSVYA

SEQ ID NO: 5237 - protein, 10 aa, Artificial Sequence
  Peptide Derived from Human Papillomavirus
LVLSVSVYAT

SEQ ID NO: 5238 - protein, 11 aa, Artificial Sequence
  Peptide Derived from Human Papillomavirus
LVLSVSVYATL

SEQ ID NO: 5239 - protein, 8 aa, Artificial Sequence
  Peptide Derived from Human Papillomavirus
MIELNIST

SEQ ID NO: 5240 - protein, 9 aa, Artificial Sequence
  Peptide Derived from Human Papillomavirus
MIELNISTV

SEQ ID NO: 5241 - protein, 11 aa, Artificial Sequence
  Peptide Derived from Human Papillomavirus
MIELNISTVSI

SEQ ID NO: 5242 - protein, 8 aa, Artificial Sequence
  Peptide Derived from Human Papillomavirus
NISTVSIV

SEQ ID NO: 5243 - protein, 9 aa, Artificial Sequence
  Peptide Derived from Human Papillomavirus
NISTVSIVL

SEQ ID NO: 5244 - protein, 9 aa, Artificial Sequence
  Peptide Derived from Human Papillomavirus
PLFVIHTHA

SEQ ID NO: 5245 - protein, 9 aa, Artificial Sequence
  Peptide Derived from Human Papillomavirus
PLRCFCIYV

SEQ ID NO: 5246 - protein, 10 aa, Artificial Sequence
  Peptide Derived from Human Papillomavirus
PLRCFCIYVV

SEQ ID NO: 5247 - protein, 8 aa, Artificial Sequence
  Peptide Derived from Human Papillomavirus
PLVLSVSV

SEQ ID NO: 5248 - protein, 10 aa, Artificial Sequence
  Peptide Derived from Human Papillomavirus
PLVLSVSVYA

SEQ ID NO: 5249 - protein, 11 aa, Artificial Sequence
  Peptide Derived from Human Papillomavirus
PLVLSVSVYAT

SEQ ID NO: 5250 - protein, 8 aa, Artificial Sequence
  Peptide Derived from Human Papillomavirus
SIVLCFLL

SEQ ID NO: 5251 - protein, 10 aa, Artificial Sequence
  Peptide Derived from Human Papillomavirus
STVSIVLCFL

SEQ ID NO: 5252 - protein, 11 aa, Artificial Sequence
  Peptide Derived from Human Papillomavirus
STVSIVLCFLL

SEQ ID NO: 5253 - protein, 8 aa, Artificial Sequence
  Peptide Derived from Human Papillomavirus
SVSVYATL

SEQ ID NO: 5254 - protein, 9 aa, Artificial Sequence
  Peptide Derived from Human Papillomavirus
SVSVYATLL

SEQ ID NO: 5255 - protein, 10 aa, Artificial Sequence
  Peptide Derived from Human Papillomavirus
SVSVYATLLL

SEQ ID NO: 5256 - protein, 11 aa, Artificial Sequence
  Peptide Derived from Human Papillomavirus
SVSVYATLLLL

SEQ ID NO: 5257 - protein, 8 aa, Artificial Sequence
  Peptide Derived from Human Papillomavirus
SVYATLLL

SEQ ID NO: 5258 - protein, 9 aa, Artificial Sequence
  Peptide Derived from Human Papillomavirus
SVYATLLLL

SEQ ID NO: 5259 - protein, 10 aa, Artificial Sequence
  Peptide Derived from Human Papillomavirus
SVYATLLLLI

SEQ ID NO: 5260 - protein, 11 aa, Artificial Sequence
  Peptide Derived from Human Papillomavirus
SVYATLLLLIV

SEQ ID NO: 5261 - protein, 8 aa, Artificial Sequence
  Peptide Derived from Human Papillomavirus
TLLLLIVI

SEQ ID NO: 5262 - protein, 9 aa, Artificial Sequence
  Peptide Derived from Human Papillomavirus
TLLLLIVIL

SEQ ID NO: 5263 - protein, 11 aa, Artificial Sequence
  Peptide Derived from Human Papillomavirus
TLLLLIVILWV

SEQ ID NO: 5264 - protein, 9 aa, Artificial Sequence
  Peptide Derived from Human Papillomavirus
TVSIVLCFL

SEQ ID NO: 5265 - protein, 10 aa, Artificial Sequence
  Peptide Derived from Human Papillomavirus
TVSIVLCFLL

SEQ ID NO: 5266 - protein, 9 aa, Artificial Sequence
  Peptide Derived from Human Papillomavirus
VIHTHASFL

SEQ ID NO: 5267 - protein, 8 aa, Artificial Sequence
  Peptide Derived from Human Papillomavirus
VILWVIAT

SEQ ID NO: 5268 - protein, 11 aa, Artificial Sequence
  Peptide Derived from Human Papillomavirus
VILWVIATSPL

SEQ ID NO: 5269 - protein, 9 aa, Artificial Sequence
  Peptide Derived from Human Papillomavirus
VIRPLVLSV

SEQ ID NO: 5270 - protein, 11 aa, Artificial Sequence
  Peptide Derived from Human Papillomavirus
VIRPLVLSVSV

SEQ ID NO: 5271 - protein, 10 aa, Artificial Sequence
  Peptide Derived from Human Papillomavirus
VLCFLLCFCV

SEQ ID NO: 5272 - protein, 11 aa, Artificial Sequence
  Peptide Derived from Human Papillomavirus
VLCFLLCFCVL

SEQ ID NO: 5273 - protein, 8 aa, Artificial Sequence
  Peptide Derived from Human Papillomavirus
VLLFVCLV

SEQ ID NO: 5274 - protein, 9 aa, Artificial Sequence
  Peptide Derived from Human Papillomavirus
VLLFVCLVI

SEQ ID NO: 5275 - protein, 8 aa, Artificial Sequence
  Peptide Derived from Human Papillomavirus
VLSVSVYA

SEQ ID NO: 5276 - protein, 9 aa, Artificial Sequence
  Peptide Derived from Human Papillomavirus
VLSVSVYAT

SEQ ID NO: 5277 - protein, 10 aa, Artificial Sequence
  Peptide Derived from Human Papillomavirus
VLSVSVYATL

SEQ ID NO: 5278 - protein, 11 aa, Artificial Sequence
  Peptide Derived from Human Papillomavirus
VLSVSVYATLL

SEQ ID NO: 5279 - protein, 8 aa, Artificial Sequence
  Peptide Derived from Human Papillomavirus
VVFIYIPL

SEQ ID NO: 5280 - protein, 10 aa, Artificial Sequence
  Peptide Derived from Human Papillomavirus
VVFIYIPLFV

SEQ ID NO: 5281 - protein, 11 aa, Artificial Sequence
  Peptide Derived from Human Papillomavirus
VVFIYIPLFVI

SEQ ID NO: 5282 - protein, 8 aa, Artificial Sequence
  Peptide Derived from Human Papillomavirus
WVIATSPL

SEQ ID NO: 5283 - protein, 8 aa, Artificial Sequence
  Peptide Derived from Human Papillomavirus
YATLLLLI

SEQ ID NO: 5284 - protein, 9 aa, Artificial Sequence
  Peptide Derived from Human Papillomavirus
YATLLLLIV

SEQ ID NO: 5285 - protein, 10 aa, Artificial Sequence
  Peptide Derived from Human Papillomavirus
YATLLLLIVI

SEQ ID NO: 5286 - protein, 11 aa, Artificial Sequence
  Peptide Derived from Human Papillomavirus
YATLLLLIVIL

SEQ ID NO: 5287 - protein, 9 aa, Artificial Sequence
  Peptide Derived from Human Papillomavirus
YIPLFVIHT

SEQ ID NO: 5288 - protein, 11 aa, Artificial Sequence
  Peptide Derived from Human Papillomavirus
YIPLFVIHTHA

SEQ ID NO: 5289 - protein, 9 aa, Artificial Sequence
  Peptide Derived from Human Papillomavirus
YVVFIYIPL

SEQ ID NO: 5290 - protein, 11 aa, Artificial Sequence
  Peptide Derived from Human Papillomavirus
YVVFIYIPLFV

SEQ ID NO: 5291 - protein, 9 aa, Artificial Sequence
  Peptide Derived from Human Papillomavirus
ALEIPYDEL

SEQ ID NO: 5292 - protein, 11 aa, Artificial Sequence
  Peptide Derived from Human Papillomavirus
ALEIPYDELRL

SEQ ID NO: 5293 - protein, 10 aa, Artificial Sequence
  Peptide Derived from Human Papillomavirus
CIACWRRPRT

SEQ ID NO: 5294 - protein, 8 aa, Artificial Sequence
  Peptide Derived from Human Papillomavirus
CITCQRPL

SEQ ID NO: 5295 - protein, 8 aa, Artificial Sequence
  Peptide Derived from Human Papillomavirus
CLRFYSKV

SEQ ID NO: 5296 - protein, 11 aa, Artificial Sequence
  Peptide Derived from Human Papillomavirus
CTKCLRFYSKV

SEQ ID NO: 5297 - protein, 8 aa, Artificial Sequence
  Peptide Derived from Human Papillomavirus
CVYCKGQL

SEQ ID NO: 5298 - protein, 9 aa, Artificial Sequence
  Peptide Derived from Human Papillomavirus
CVYCKGQLT

SEQ ID NO: 5299 - protein, 11 aa, Artificial Sequence
  Peptide Derived from Human Papillomavirus
CVYCKGQLTET

SEQ ID NO: 5300 - protein, 8 aa, Artificial Sequence
  Peptide Derived from Human Papillomavirus
DLLIRCIT

SEQ ID NO: 5301 - protein, 10 aa, Artificial Sequence
  Peptide Derived from Human Papillomavirus
DLTIVYRDDT

SEQ ID NO: 5302 - protein, 8 aa, Artificial Sequence
  Peptide Derived from Human Papillomavirus
DTPHGVCT

SEQ ID NO: 5303 - protein, 11 aa, Artificial Sequence
  Peptide Derived from Human Papillomavirus
DTPHGVCTKCL

SEQ ID NO: 5304 - protein, 9 aa, Artificial Sequence
  Peptide Derived from Human Papillomavirus
EIPYDELRL

SEQ ID NO: 5305 - protein, 8 aa, Artificial Sequence
  Peptide Derived from Human Papillomavirus
ELSSALEI

SEQ ID NO: 5306 - protein, 8 aa, Artificial Sequence
  Peptide Derived from Human Papillomavirus
ETEVLDFA

SEQ ID NO: 5307 - protein, 10 aa, Artificial Sequence
  Peptide Derived from Human Papillomavirus
ETEVLDFAFT

SEQ ID NO: 5308 - protein, 8 aa, Artificial Sequence
  Peptide Derived from Human Papillomavirus
EVLDFAFT

SEQ ID NO: 5309 - protein, 10 aa, Artificial Sequence
  Peptide Derived from Human Papillomavirus
EVLDFAFTDL

SEQ ID NO: 5310 - protein, 11 aa, Artificial Sequence
  Peptide Derived from Human Papillomavirus
EVLDFAFTDLT

SEQ ID NO: 5311 - protein, 8 aa, Artificial Sequence
  Peptide Derived from Human Papillomavirus
FAFTDLTI

SEQ ID NO: 5312 - protein, 9 aa, Artificial Sequence
  Peptide Derived from Human Papillomavirus
FAFTDLTIV

SEQ ID NO: 5313 - protein, 10 aa, Artificial Sequence
  Peptide Derived from Human Papillomavirus
GICDLLIRCI

SEQ ID NO: 5314 - protein, 11 aa, Artificial Sequence
  Peptide Derived from Human Papillomavirus
GICDLLIRCIT

SEQ ID NO: 5315 - protein, 8 aa, Artificial Sequence
  Peptide Derived from Human Papillomavirus
GQLTETEV

SEQ ID NO: 5316 - protein, 9 aa, Artificial Sequence
  Peptide Derived from Human Papillomavirus
GQLTETEVL

SEQ ID NO: 5317 - protein, 8 aa, Artificial Sequence
  Peptide Derived from Human Papillomavirus
GTTLEKLT

SEQ ID NO: 5318 - protein, 11 aa, Artificial Sequence
  Peptide Derived from Human Papillomavirus
HLDKKKRFHNI

SEQ ID NO: 5319 - protein, 9 aa, Artificial Sequence
  Peptide Derived from Human Papillomavirus
IACWRRPRT

SEQ ID NO: 5320 - protein, 11 aa, Artificial Sequence
  Peptide Derived from Human Papillomavirus
IACWRRPRTET

SEQ ID NO: 5321 - protein, 11 aa, Artificial Sequence
  Peptide Derived from Human Papillomavirus
IVYRDDTPHGV

SEQ ID NO: 5322 - protein, 8 aa, Artificial Sequence
  Peptide Derived from Human Papillomavirus
KLHELSSA

SEQ ID NO: 5323 - protein, 9 aa, Artificial Sequence
  Peptide Derived from Human Papillomavirus
KLHELSSAL

SEQ ID NO: 5324 - protein, 11 aa, Artificial Sequence
  Peptide Derived from Human Papillomavirus
KLHELSSALEI

SEQ ID NO: 5325 - protein, 10 aa, Artificial Sequence
  Peptide Derived from Human Papillomavirus
KLTNKGICDL

SEQ ID NO: 5326 - protein, 11 aa, Artificial Sequence
  Peptide Derived from Human Papillomavirus
KLTNKGICDLL

SEQ ID NO: 5327 - protein, 11 aa, Artificial Sequence
  Peptide Derived from Human Papillomavirus
LIRCITCQRPL

SEQ ID NO: 5328 - protein, 10 aa, Artificial Sequence
  Peptide Derived from Human Papillomavirus
LTETEVLDFA

SEQ ID NO: 5329 - protein, 9 aa, Artificial Sequence
  Peptide Derived from Human Papillomavirus
LTIVYRDDT

SEQ ID NO: 5330 - protein, 9 aa, Artificial Sequence
  Peptide Derived from Human Papillomavirus
LTNKGICDL

SEQ ID NO: 5331 - protein, 10 aa, Artificial Sequence
  Peptide Derived from Human Papillomavirus
LTNKGICDLL

SEQ ID NO: 5332 - protein, 11 aa, Artificial Sequence
  Peptide Derived from Human Papillomavirus
LTNKGICDLLI

SEQ ID NO: 5333 - protein, 11 aa, Artificial Sequence
  Peptide Derived from Human Papillomavirus
NIGGRWTGRCI

SEQ ID NO: 5334 - protein, 8 aa, Artificial Sequence
  Peptide Derived from Human Papillomavirus
PAERPRKL

SEQ ID NO: 5335 - protein, 11 aa, Artificial Sequence
  Peptide Derived from Human Papillomavirus
PAERPRKLHEL

SEQ ID NO: 5336 - protein, 11 aa, Artificial Sequence
  Peptide Derived from Human Papillomavirus
PLCPEEKQRHL

SEQ ID NO: 5337 - protein, 8 aa, Artificial Sequence
  Peptide Derived from Human Papillomavirus
QLTETEVL

SEQ ID NO: 5338 - protein, 11 aa, Artificial Sequence
  Peptide Derived from Human Papillomavirus
QLTETEVLDFA

SEQ ID NO: 5339 - protein, 11 aa, Artificial Sequence
  Peptide Derived from Human Papillomavirus
RLNCVYCKGQL

SEQ ID NO: 5340 - protein, 10 aa, Artificial Sequence
  Peptide Derived from Human Papillomavirus
SALEIPYDEL

SEQ ID NO: 5341 - protein, 10 aa, Artificial Sequence
  Peptide Derived from Human Papillomavirus
SVYGTTLEKL

SEQ ID NO: 5342 - protein, 11 aa, Artificial Sequence
  Peptide Derived from Human Papillomavirus
SVYGTTLEKLT

SEQ ID NO: 5343 - protein, 8 aa, Artificial Sequence
  Peptide Derived from Human Papillomavirus
TIVYRDDT

SEQ ID NO: 5344 - protein, 10 aa, Artificial Sequence
  Peptide Derived from Human Papillomavirus
TLEKLTNKGI

SEQ ID NO: 5345 - protein, 11 aa, Artificial Sequence
  Peptide Derived from Human Papillomavirus
TTLEKLTNKGI

SEQ ID NO: 5346 - protein, 9 aa, Artificial Sequence
  Peptide Derived from Human Papillomavirus
VLDFAFTDL

SEQ ID NO: 5347 - protein, 10 aa, Artificial Sequence
  Peptide Derived from Human Papillomavirus
VLDFAFTDLT

SEQ ID NO: 5348 - protein, 11 aa, Artificial Sequence
  Peptide Derived from Human Papillomavirus
VLDFAFTDLTI

SEQ ID NO: 5349 - protein, 10 aa, Artificial Sequence
  Peptide Derived from Human Papillomavirus
ATDLHCYEQL

SEQ ID NO: 5350 - protein, 9 aa, Artificial Sequence
  Peptide Derived from Human Papillomavirus
CQCKSTLRL

SEQ ID NO: 5351 - protein, 11 aa, Artificial Sequence
  Peptide Derived from Human Papillomavirus
CQCKSTLRLCV

SEQ ID NO: 5352 - protein, 9 aa, Artificial Sequence
  Peptide Derived from Human Papillomavirus
CVQSTQVDI

SEQ ID NO: 5353 - protein, 11 aa, Artificial Sequence
  Peptide Derived from Human Papillomavirus
CVQSTQVDIRI

SEQ ID NO: 5354 - protein, 8 aa, Artificial Sequence
  Peptide Derived from Human Papillomavirus
DIRILQEL

SEQ ID NO: 5355 - protein, 9 aa, Artificial Sequence
  Peptide Derived from Human Papillomavirus
DIRILQELL

SEQ ID NO: 5356 - protein, 10 aa, Artificial Sequence
  Peptide Derived from Human Papillomavirus
DIRILQELLM

SEQ ID NO: 5357 - protein, 8 aa, Artificial Sequence
  Peptide Derived from Human Papillomavirus
DLHCYEQL

SEQ ID NO: 5358 - protein, 9 aa, Artificial Sequence
  Peptide Derived from Human Papillomavirus
DLQPEATDL

SEQ ID NO: 5359 - protein, 8 aa, Artificial Sequence
  Peptide Derived from Human Papillomavirus
DTSNYNIV

SEQ ID NO: 5360 - protein, 9 aa, Artificial Sequence
  Peptide Derived from Human Papillomavirus
DTSNYNIVT

SEQ ID NO: 5361 - protein, 10 aa, Artificial Sequence
  Peptide Derived from Human Papillomavirus
DVIDSPAGQA

SEQ ID NO: 5362 - protein, 11 aa, Artificial Sequence
  Peptide Derived from Human Papillomavirus
EATDLHCYEQL

SEQ ID NO: 5363 - protein, 9 aa, Artificial Sequence
  Peptide Derived from Human Papillomavirus
ELLMGSFGI

SEQ ID NO: 5364 - protein, 10 aa, Artificial Sequence
  Peptide Derived from Human Papillomavirus
ELLMGSFGIV

SEQ ID NO: 5365 - protein, 9 aa, Artificial Sequence
  Peptide Derived from Human Papillomavirus
ETPTLQDYV

SEQ ID NO: 5366 - protein, 10 aa, Artificial Sequence
  Peptide Derived from Human Papillomavirus
ETPTLQDYVL

SEQ ID NO: 5367 - protein, 9 aa, Artificial Sequence
  Peptide Derived from Human Papillomavirus
GIVCPNCST

SEQ ID NO: 5368 - protein, 11 aa, Artificial Sequence
  Peptide Derived from Human Papillomavirus
GIVCPNCSTRL

SEQ ID NO: 5369 - protein, 8 aa, Artificial Sequence
  Peptide Derived from Human Papillomavirus
IVCPNCST

SEQ ID NO: 5370 - protein, 10 aa, Artificial Sequence
  Peptide Derived from Human Papillomavirus
IVCPNCSTRL

SEQ ID NO: 5371 - protein, 11 aa, Artificial Sequence
  Peptide Derived from Human Papillomavirus
IVTFCCQCKST

SEQ ID NO: 5372 - protein, 8 aa, Artificial Sequence
  Peptide Derived from Human Papillomavirus
LLMGSFGI

SEQ ID NO: 5373 - protein, 9 aa, Artificial Sequence
  Peptide Derived from Human Papillomavirus
LLMGSFGIV

SEQ ID NO: 5374 - protein, 8 aa, Artificial Sequence
  Peptide Derived from Human Papillomavirus
LMGSFGIV

SEQ ID NO: 5375 - protein, 8 aa, Artificial Sequence
  Peptide Derived from Human Papillomavirus
LQDYVLDL

SEQ ID NO: 5376 - protein, 11 aa, Artificial Sequence
  Peptide Derived from Human Papillomavirus
LQELLMGSFGI

SEQ ID NO: 5377 - protein, 8 aa, Artificial Sequence
  Peptide Derived from Human Papillomavirus
LQPEATDL

SEQ ID NO: 5378 - protein, 9 aa, Artificial Sequence
  Peptide Derived from Human Papillomavirus
PAGQAEPDT

SEQ ID NO: 5379 - protein, 8 aa, Artificial Sequence
  Peptide Derived from Human Papillomavirus
PTLQDYVL

SEQ ID NO: 5380 - protein, 10 aa, Artificial Sequence
  Peptide Derived from Human Papillomavirus
PTLQDYVLDL

SEQ ID NO: 5381 - protein, 11 aa, Artificial Sequence
  Peptide Derived from Human Papillomavirus
QAEPDTSNYNI

SEQ ID NO: 5382 - protein, 11 aa, Artificial Sequence
  Peptide Derived from Human Papillomavirus
QLPDSSDEEDV

SEQ ID NO: 5383 - protein, 10 aa, Artificial Sequence
  Peptide Derived from Human Papillomavirus
QVDIRILQEL

SEQ ID NO: 5384 - protein, 11 aa, Artificial Sequence
  Peptide Derived from Human Papillomavirus
QVDIRILQELL

SEQ ID NO: 5385 - protein, 8 aa, Artificial Sequence
  Peptide Derived from Human Papillomavirus
RILQELLM

SEQ ID NO: 5386 - protein, 9 aa, Artificial Sequence
  Peptide Derived from Human Papillomavirus
RLCVQSTQV

SEQ ID NO: 5387 - protein, 11 aa, Artificial Sequence
  Peptide Derived from Human Papillomavirus
RLCVQSTQVDI

SEQ ID NO: 5388 - protein, 10 aa, Artificial Sequence
  Peptide Derived from Human Papillomavirus
STLRLCVQST

SEQ ID NO: 5389 - protein, 8 aa, Artificial Sequence
  Peptide Derived from Human Papillomavirus
STQVDIRI

SEQ ID NO: 5390 - protein, 9 aa, Artificial Sequence
  Peptide Derived from Human Papillomavirus
STQVDIRIL

SEQ ID NO: 5391 - protein, 9 aa, Artificial Sequence
  Peptide Derived from Human Papillomavirus
TLQDYVLDL

SEQ ID NO: 5392 - protein, 9 aa, Artificial Sequence
  Peptide Derived from Human Papillomavirus
TLRLCVQST

SEQ ID NO: 5393 - protein, 11 aa, Artificial Sequence
  Peptide Derived from Human Papillomavirus
TLRLCVQSTQV

SEQ ID NO: 5394 - protein, 8 aa, Artificial Sequence
  Peptide Derived from Human Papillomavirus
TQVDIRIL

SEQ ID NO: 5395 - protein, 11 aa, Artificial Sequence
  Peptide Derived from Human Papillomavirus
TQVDIRILQEL

SEQ ID NO: 5396 - protein, 9 aa, Artificial Sequence
  Peptide Derived from Human Papillomavirus
VIDSPAGQA

SEQ ID NO: 5397 - protein, 8 aa, Artificial Sequence
  Peptide Derived from Human Papillomavirus
VLDLQPEA

SEQ ID NO: 5398 - protein, 9 aa, Artificial Sequence
  Peptide Derived from Human Papillomavirus
VLDLQPEAT

SEQ ID NO: 5399 - protein, 11 aa, Artificial Sequence
  Peptide Derived from Human Papillomavirus
VLDLQPEATDL

SEQ ID NO: 5400 - protein, 8 aa, Artificial Sequence
  Peptide Derived from Human Papillomavirus
VQSTQVDI

SEQ ID NO: 5401 - protein, 10 aa, Artificial Sequence
  Peptide Derived from Human Papillomavirus
VQSTQVDIRI

SEQ ID NO: 5402 - protein, 11 aa, Artificial Sequence
  Peptide Derived from Human Papillomavirus
VQSTQVDIRIL

SEQ ID NO: 5403 - protein, 10 aa, Artificial Sequence
  Peptide Derived from Human Papillomavirus
VTFCCQCKST

SEQ ID NO: 5404 - protein, 11 aa, Artificial Sequence
  Peptide Derived from Human Papillomavirus
VTFCCQCKSTL

SEQ ID NO: 5405 - protein, 9 aa, Artificial Sequence
  Peptide Derived from Human Papillomavirus
YVLDLQPEA

SEQ ID NO: 5406 - protein, 10 aa, Artificial Sequence
  Peptide Derived from Human Papillomavirus
YVLDLQPEAT

SEQ ID NO: 5407 - protein, 8 aa, Artificial Sequence
  Peptide Derived from Human Papillomavirus
AAIANSDT

SEQ ID NO: 5408 - protein, 9 aa, Artificial Sequence
  Peptide Derived from Human Papillomavirus
AAIANSDTT

SEQ ID NO: 5409 - protein, 8 aa, Artificial Sequence
  Peptide Derived from Human Papillomavirus
AIANSDTT

SEQ ID NO: 5410 - protein, 10 aa, Artificial Sequence
  Peptide Derived from Human Papillomavirus
AILEDWNFGL

SEQ ID NO: 5411 - protein, 11 aa, Artificial Sequence
  Peptide Derived from Human Papillomavirus
AILEDWNFGLT

SEQ ID NO: 5412 - protein, 8 aa, Artificial Sequence
  Peptide Derived from Human Papillomavirus
AITCQKTA

SEQ ID NO: 5413 - protein, 10 aa, Artificial Sequence
  Peptide Derived from Human Papillomavirus
AITPGDCPPL

SEQ ID NO: 5414 - protein, 9 aa, Artificial Sequence
  Peptide Derived from Human Papillomavirus
ALQDTKSNV

SEQ ID NO: 5415 - protein, 11 aa, Artificial Sequence
  Peptide Derived from Human Papillomavirus
ALQDTKSNVPL

SEQ ID NO: 5416 - protein, 10 aa, Artificial Sequence
  Peptide Derived from Human Papillomavirus
AMDFTALQDT

SEQ ID NO: 5417 - protein, 8 aa, Artificial Sequence
  Peptide Derived from Human Papillomavirus
AQGHNNGI

SEQ ID NO: 5418 - protein, 10 aa, Artificial Sequence
  Peptide Derived from Human Papillomavirus
AQIFNKPYWM

SEQ ID NO: 5419 - protein, 11 aa, Artificial Sequence
  Peptide Derived from Human Papillomavirus
ATLANSTYFPT

SEQ ID NO: 5420 - protein, 8 aa, Artificial Sequence
  Peptide Derived from Human Papillomavirus
ATVYLPPV

SEQ ID NO: 5421 - protein, 10 aa, Artificial Sequence
  Peptide Derived from Human Papillomavirus
ATVYLPPVPV

SEQ ID NO: 5422 - protein, 9 aa, Artificial Sequence
  Peptide Derived from Human Papillomavirus
CAAIANSDT

SEQ ID NO: 5423 - protein, 10 aa, Artificial Sequence
  Peptide Derived from Human Papillomavirus
CAAIANSDTT

SEQ ID NO: 5424 - protein, 9 aa, Artificial Sequence
  Peptide Derived from Human Papillomavirus
CISMDYKQT

SEQ ID NO: 5425 - protein, 11 aa, Artificial Sequence
  Peptide Derived from Human Papillomavirus
CISMDYKQTQL

SEQ ID NO: 5426 - protein, 9 aa, Artificial Sequence
  Peptide Derived from Human Papillomavirus
CLLGCKPPI

SEQ ID NO: 5427 - protein, 11 aa, Artificial Sequence
  Peptide Derived from Human Papillomavirus
DAQIFNKPYWM

SEQ ID NO: 5428 - protein, 9 aa, Artificial Sequence
  Peptide Derived from Human Papillomavirus
DIMTYIHSM

SEQ ID NO: 5429 - protein, 8 aa, Artificial Sequence
  Peptide Derived from Human Papillomavirus
DLQFIFQL

SEQ ID NO: 5430 - protein, 11 aa, Artificial Sequence
  Peptide Derived from Human Papillomavirus
DLQFIFQLCKI

SEQ ID NO: 5431 - protein, 10 aa, Artificial Sequence
  Peptide Derived from Human Papillomavirus
DLYIKGSGST

SEQ ID NO: 5432 - protein, 11 aa, Artificial Sequence
  Peptide Derived from Human Papillomavirus
DLYIKGSGSTA

SEQ ID NO: 5433 - protein, 9 aa, Artificial Sequence
  Peptide Derived from Human Papillomavirus
DMVDTGFGA

SEQ ID NO: 5434 - protein, 10 aa, Artificial Sequence
  Peptide Derived from Human Papillomavirus
DMVDTGFGAM

SEQ ID NO: 5435 - protein, 10 aa, Artificial Sequence
  Peptide Derived from Human Papillomavirus
DQFPLGRKFL

SEQ ID NO: 5436 - protein, 11 aa, Artificial Sequence
  Peptide Derived from Human Papillomavirus
DQFPLGRKFLL

SEQ ID NO: 5437 - protein, 9 aa, Artificial Sequence
  Peptide Derived from Human Papillomavirus
DTENSNRYA

SEQ ID NO: 5438 - protein, 10 aa, Artificial Sequence
  Peptide Derived from Human Papillomavirus
DTGFGAMDFT

SEQ ID NO: 5439 - protein, 11 aa, Artificial Sequence
  Peptide Derived from Human Papillomavirus
DTGFGAMDFTA

SEQ ID NO: 5440 - protein, 8 aa, Artificial Sequence
  Peptide Derived from Human Papillomavirus
DTKSNVPL

SEQ ID NO: 5441 - protein, 10 aa, Artificial Sequence
  Peptide Derived from Human Papillomavirus
DTKSNVPLDI

SEQ ID NO: 5442 - protein, 9 aa, Artificial Sequence
  Peptide Derived from Human Papillomavirus
DTSFYNPET

SEQ ID NO: 5443 - protein, 8 aa, Artificial Sequence
  Peptide Derived from Human Papillomavirus
DTTRSTNM

SEQ ID NO: 5444 - protein, 10 aa, Artificial Sequence
  Peptide Derived from Human Papillomavirus
DTTRSTNMSV

SEQ ID NO: 5445 - protein, 10 aa, Artificial Sequence
  Peptide Derived from Human Papillomavirus
DTYRFVTSQA

SEQ ID NO: 5446 - protein, 11 aa, Artificial Sequence
  Peptide Derived from Human Papillomavirus
DTYRFVTSQAI

SEQ ID NO: 5447 - protein, 9 aa, Artificial Sequence
  Peptide Derived from Human Papillomavirus
EATVYLPPV

SEQ ID NO: 5448 - protein, 11 aa, Artificial Sequence
  Peptide Derived from Human Papillomavirus
EATVYLPPVPV

SEQ ID NO: 5449 - protein, 8 aa, Artificial Sequence
  Peptide Derived from Human Papillomavirus
ETQRLVWA

SEQ ID NO: 5450 - protein, 10 aa, Artificial Sequence
  Peptide Derived from Human Papillomavirus
ETQRLVWACV

SEQ ID NO: 5451 - protein, 8 aa, Artificial Sequence
  Peptide Derived from Human Papillomavirus
EVGRGQPL

SEQ ID NO: 5452 - protein, 10 aa, Artificial Sequence
  Peptide Derived from Human Papillomavirus
EVGRGQPLGV

SEQ ID NO: 5453 - protein, 10 aa, Artificial Sequence
  Peptide Derived from Human Papillomavirus
EVNLKEKFSA

SEQ ID NO: 5454 - protein, 8 aa, Artificial Sequence
  Peptide Derived from Human Papillomavirus
FIFQLCKI

SEQ ID NO: 5455 - protein, 9 aa, Artificial Sequence
  Peptide Derived from Human Papillomavirus
FIFQLCKIT

SEQ ID NO: 5456 - protein, 10 aa, Artificial Sequence
  Peptide Derived from Human Papillomavirus
FIFQLCKITL

SEQ ID NO: 5457 - protein, 9 aa, Artificial Sequence
  Peptide Derived from Human Papillomavirus
FLLQAGYRA

SEQ ID NO: 5458 - protein, 8 aa, Artificial Sequence
  Peptide Derived from Human Papillomavirus
FQLCKITL

SEQ ID NO: 5459 - protein, 10 aa, Artificial Sequence
  Peptide Derived from Human Papillomavirus
FQLCKITLSA

SEQ ID NO: 5460 - protein, 11 aa, Artificial Sequence
  Peptide Derived from Human Papillomavirus
FTALQDTKSNV

SEQ ID NO: 5461 - protein, 11 aa, Artificial Sequence
  Peptide Derived from Human Papillomavirus
FVRHFFNRSGT

SEQ ID NO: 5462 - protein, 8 aa, Artificial Sequence
  Peptide Derived from Human Papillomavirus
FVTSQAIT

SEQ ID NO: 5463 - protein, 8 aa, Artificial Sequence
  Peptide Derived from Human Papillomavirus
FVTVVDTT

SEQ ID NO: 5464 - protein, 11 aa, Artificial Sequence
  Peptide Derived from Human Papillomavirus
FVTVVDTTRST

SEQ ID NO: 5465 - protein, 8 aa, Artificial Sequence
  Peptide Derived from Human Papillomavirus
GAMDFTAL

SEQ ID NO: 5466 - protein, 11 aa, Artificial Sequence
  Peptide Derived from Human Papillomavirus
GAMDFTALQDT

SEQ ID NO: 5467 - protein, 8 aa, Artificial Sequence
  Peptide Derived from Human Papillomavirus
GICWGNQL

SEQ ID NO: 5468 - protein, 10 aa, Artificial Sequence
  Peptide Derived from Human Papillomavirus
GICWGNQLFV

SEQ ID NO: 5469 - protein, 11 aa, Artificial Sequence
  Peptide Derived from Human Papillomavirus
GICWGNQLFVT

SEQ ID NO: 5470 - protein, 8 aa, Artificial Sequence
  Peptide Derived from Human Papillomavirus
GISGHPLL

SEQ ID NO: 5471 - protein, 10 aa, Artificial Sequence
  Peptide Derived from Human Papillomavirus
GLEVGRGQPL

SEQ ID NO: 5472 - protein, 9 aa, Artificial Sequence
  Peptide Derived from Human Papillomavirus
GLQYRVFRV

SEQ ID NO: 5473 - protein, 11 aa, Artificial Sequence
  Peptide Derived from Human Papillomavirus
GLQYRVFRVRL

SEQ ID NO: 5474 - protein, 10 aa, Artificial Sequence
  Peptide Derived from Human Papillomavirus
GLTTPPSGSL

SEQ ID NO: 5475 - protein, 8 aa, Artificial Sequence
  Peptide Derived from Human Papillomavirus
GQPLGVGI

SEQ ID NO: 5476 - protein, 8 aa, Artificial Sequence
  Peptide Derived from Human Papillomavirus
GTDNRECI

SEQ ID NO: 5477 - protein, 10 aa, Artificial Sequence
  Peptide Derived from Human Papillomavirus
GTDNRECISM

SEQ ID NO: 5478 - protein, 9 aa, Artificial Sequence
  Peptide Derived from Human Papillomavirus
GTVGESVPT

SEQ ID NO: 5479 - protein, 11 aa, Artificial Sequence
  Peptide Derived from Human Papillomavirus
GTVGESVPTDL

SEQ ID NO: 5480 - protein, 9 aa, Artificial Sequence
  Peptide Derived from Human Papillomavirus
GVGISGHPL

SEQ ID NO: 5481 - protein, 10 aa, Artificial Sequence
  Peptide Derived from Human Papillomavirus
GVGISGHPLL

SEQ ID NO: 5482 - protein, 8 aa, Artificial Sequence
  Peptide Derived from Human Papillomavirus
HAGSARLL

SEQ ID NO: 5483 - protein, 9 aa, Artificial Sequence
  Peptide Derived from Human Papillomavirus
HAGSARLLT

SEQ ID NO: 5484 - protein, 10 aa, Artificial Sequence
  Peptide Derived from Human Papillomavirus
HAGSARLLTV

SEQ ID NO: 5485 - protein, 9 aa, Artificial Sequence
  Peptide Derived from Human Papillomavirus
ILEDWNFGL

SEQ ID NO: 5486 - protein, 10 aa, Artificial Sequence
  Peptide Derived from Human Papillomavirus
ILEDWNFGLT

SEQ ID NO: 5487 - protein, 11 aa, Artificial Sequence
  Peptide Derived from Human Papillomavirus
ILEDWNFGLTT

SEQ ID NO: 5488 - protein, 8 aa, Artificial Sequence
  Peptide Derived from Human Papillomavirus
IMTYIHSM

SEQ ID NO: 5489 - protein, 11 aa, Artificial Sequence
  Peptide Derived from Human Papillomavirus
IMTYIHSMNPA

SEQ ID NO: 5490 - protein, 9 aa, Artificial Sequence
  Peptide Derived from Human Papillomavirus
IQDGDMVDT

SEQ ID NO: 5491 - protein, 8 aa, Artificial Sequence
  Peptide Derived from Human Papillomavirus
ITLSADIM

SEQ ID NO: 5492 - protein, 9 aa, Artificial Sequence
  Peptide Derived from Human Papillomavirus
ITLSADIMT

SEQ ID NO: 5493 - protein, 11 aa, Artificial Sequence
  Peptide Derived from Human Papillomavirus
ITLSADIMTYI

SEQ ID NO: 5494 - protein, 9 aa, Artificial Sequence
  Peptide Derived from Human Papillomavirus
ITPGDCPPL

SEQ ID NO: 5495 - protein, 11 aa, Artificial Sequence
  Peptide Derived from Human Papillomavirus
ITPGDCPPLEL

SEQ ID NO: 5496 - protein, 9 aa, Artificial Sequence
  Peptide Derived from Human Papillomavirus
IVVPKVSGL

SEQ ID NO: 5497 - protein, 10 aa, Artificial Sequence
  Peptide Derived from Human Papillomavirus
KAGKRSAPSA

SEQ ID NO: 5498 - protein, 8 aa, Artificial Sequence
  Peptide Derived from Human Papillomavirus
KITLSADI

SEQ ID NO: 5499 - protein, 9 aa, Artificial Sequence
  Peptide Derived from Human Papillomavirus
KITLSADIM

SEQ ID NO: 5500 - protein, 10 aa, Artificial Sequence
  Peptide Derived from Human Papillomavirus
KITLSADIMT

SEQ ID NO: 5501 - protein, 10 aa, Artificial Sequence
  Peptide Derived from Human Papillomavirus
KIVVPKVSGL

SEQ ID NO: 5502 - protein, 10 aa, Artificial Sequence
  Peptide Derived from Human Papillomavirus
KMVAEPYGDT

SEQ ID NO: 5503 - protein, 11 aa, Artificial Sequence
  Peptide Derived from Human Papillomavirus
KMVAEPYGDTL

SEQ ID NO: 5504 - protein, 8 aa, Artificial Sequence
  Peptide Derived from Human Papillomavirus
KQTQLCLL

SEQ ID NO: 5505 - protein, 9 aa, Artificial Sequence
  Peptide Derived from Human Papillomavirus
KVSGLQYRV

SEQ ID NO: 5506 - protein, 9 aa, Artificial Sequence
  Peptide Derived from Human Papillomavirus
KVVSTDEYV

SEQ ID NO: 5507 - protein, 10 aa, Artificial Sequence
  Peptide Derived from Human Papillomavirus
KVVSTDEYVT

SEQ ID NO: 5508 - protein, 9 aa, Artificial Sequence
  Peptide Derived from Human Papillomavirus
LANSTYFPT

SEQ ID NO: 5509 - protein, 8 aa, Artificial Sequence
  Peptide Derived from Human Papillomavirus
LLGCKPPI

SEQ ID NO: 5510 - protein, 8 aa, Artificial Sequence
  Peptide Derived from Human Papillomavirus
LLNKFDDT

SEQ ID NO: 5511 - protein, 8 aa, Artificial Sequence
  Peptide Derived from Human Papillomavirus
LLQAGYRA

SEQ ID NO: 5512 - protein, 11 aa, Artificial Sequence
  Peptide Derived from Human Papillomavirus
LLTVGHPYYSI

SEQ ID NO: 5513 - protein, 8 aa, Artificial Sequence
  Peptide Derived from Human Papillomavirus
LQDTKSNV

SEQ ID NO: 5514 - protein, 10 aa, Artificial Sequence
  Peptide Derived from Human Papillomavirus
LQDTKSNVPL

SEQ ID NO: 5515 - protein, 10 aa, Artificial Sequence
  Peptide Derived from Human Papillomavirus
LQFIFQLCKI

SEQ ID NO: 5516 - protein, 11 aa, Artificial Sequence
  Peptide Derived from Human Papillomavirus
LQFIFQLCKIT

SEQ ID NO: 5517 - protein, 8 aa, Artificial Sequence
  Peptide Derived from Human Papillomavirus
LQYRVFRV

SEQ ID NO: 5518 - protein, 10 aa, Artificial Sequence
  Peptide Derived from Human Papillomavirus
LQYRVFRVRL

SEQ ID NO: 5519 - protein, 9 aa, Artificial Sequence
  Peptide Derived from Human Papillomavirus
LTTPPSGSL

SEQ ID NO: 5520 - protein, 10 aa, Artificial Sequence
  Peptide Derived from Human Papillomavirus
LTVGHPYYSI

SEQ ID NO: 5521 - protein, 8 aa, Artificial Sequence
  Peptide Derived from Human Papillomavirus
LVWACVGL

SEQ ID NO: 5522 - protein, 10 aa, Artificial Sequence
  Peptide Derived from Human Papillomavirus
LVWACVGLEV

SEQ ID NO: 5523 - protein, 11 aa, Artificial Sequence
  Peptide Derived from Human Papillomavirus
MQRAQGHNNGI

SEQ ID NO: 5524 - protein, 10 aa, Artificial Sequence
  Peptide Derived from Human Papillomavirus
MTYIHSMNPA

SEQ ID NO: 5525 - protein, 11 aa, Artificial Sequence
  Peptide Derived from Human Papillomavirus
MTYIHSMNPAI

SEQ ID NO: 5526 - protein, 9 aa, Artificial Sequence
  Peptide Derived from Human Papillomavirus
MVAEPYGDT

SEQ ID NO: 5527 - protein, 10 aa, Artificial Sequence
  Peptide Derived from Human Papillomavirus
MVAEPYGDTL

SEQ ID NO: 5528 - protein, 8 aa, Artificial Sequence
  Peptide Derived from Human Papillomavirus
MVDTGFGA

SEQ ID NO: 5529 - protein, 9 aa, Artificial Sequence
  Peptide Derived from Human Papillomavirus
MVDTGFGAM

SEQ ID NO: 5530 - protein, 8 aa, Artificial Sequence
  Peptide Derived from Human Papillomavirus
MVTSDAQI

SEQ ID NO: 5531 - protein, 11 aa, Artificial Sequence
  Peptide Derived from Human Papillomavirus
NAITPGDCPPL

SEQ ID NO: 5532 - protein, 9 aa, Artificial Sequence
  Peptide Derived from Human Papillomavirus
NIYYHAGSA

SEQ ID NO: 5533 - protein, 11 aa, Artificial Sequence
  Peptide Derived from Human Papillomavirus
NIYYHAGSARL

SEQ ID NO: 5534 - protein, 8 aa, Artificial Sequence
  Peptide Derived from Human Papillomavirus
NLKEKFSA

SEQ ID NO: 5535 - protein, 10 aa, Artificial Sequence
  Peptide Derived from Human Papillomavirus
NLKEKFSADL

SEQ ID NO: 5536 - protein, 8 aa, Artificial Sequence
  Peptide Derived from Human Papillomavirus
NMSVCAAI

SEQ ID NO: 5537 - protein, 9 aa, Artificial Sequence
  Peptide Derived from Human Papillomavirus
NMSVCAAIA

SEQ ID NO: 5538 - protein, 8 aa, Artificial Sequence
  Peptide Derived from Human Papillomavirus
NQLFVTVV

SEQ ID NO: 5539 - protein, 10 aa, Artificial Sequence
  Peptide Derived from Human Papillomavirus
NQLFVTVVDT

SEQ ID NO: 5540 - protein, 11 aa, Artificial Sequence
  Peptide Derived from Human Papillomavirus
NQLFVTVVDTT

SEQ ID NO: 5541 - protein, 10 aa, Artificial Sequence
  Peptide Derived from Human Papillomavirus
NVPLDICNSI

SEQ ID NO: 5542 - protein, 11 aa, Artificial Sequence
  Peptide Derived from Human Papillomavirus
PAILEDWNFGL

SEQ ID NO: 5543 - protein, 8 aa, Artificial Sequence
  Peptide Derived from Human Papillomavirus
PLDICNSI

SEQ ID NO: 5544 - protein, 8 aa, Artificial Sequence
  Peptide Derived from Human Papillomavirus
PLELKNSV

SEQ ID NO: 5545 - protein, 9 aa, Artificial Sequence
  Peptide Derived from Human Papillomavirus
PLELKNSVI

SEQ ID NO: 5546 - protein, 8 aa, Artificial Sequence
  Peptide Derived from Human Papillomavirus
PLGRKFLL

SEQ ID NO: 5547 - protein, 10 aa, Artificial Sequence
  Peptide Derived from Human Papillomavirus
PLGRKFLLQA

SEQ ID NO: 5548 - protein, 11 aa, Artificial Sequence
  Peptide Derived from Human Papillomavirus
PLGVGISGHPL

SEQ ID NO: 5549 - protein, 9 aa, Artificial Sequence
  Peptide Derived from Human Papillomavirus
PLLNKFDDT

SEQ ID NO: 5550 - protein, 8 aa, Artificial Sequence
  Peptide Derived from Human Papillomavirus
PTPSGSMV

SEQ ID NO: 5551 - protein, 9 aa, Artificial Sequence
  Peptide Derived from Human Papillomavirus
PTPSGSMVT

SEQ ID NO: 5552 - protein, 8 aa, Artificial Sequence
  Peptide Derived from Human Papillomavirus
PVPVSKVV

SEQ ID NO: 5553 - protein, 10 aa, Artificial Sequence
  Peptide Derived from Human Papillomavirus
PVPVSKVVST

SEQ ID NO: 5554 - protein, 8 aa, Artificial Sequence
  Peptide Derived from Human Papillomavirus
PVSKVVST

SEQ ID NO: 5555 - protein, 8 aa, Artificial Sequence
  Peptide Derived from Human Papillomavirus
QAITCQKT

SEQ ID NO: 5556 - protein, 9 aa, Artificial Sequence
  Peptide Derived from Human Papillomavirus
QAITCQKTA

SEQ ID NO: 5557 - protein, 9 aa, Artificial Sequence
  Peptide Derived from Human Papillomavirus
QIFNKPYWM

SEQ ID NO: 5558 - protein, 9 aa, Artificial Sequence
  Peptide Derived from Human Papillomavirus
QLCKITLSA

SEQ ID NO: 5559 - protein, 11 aa, Artificial Sequence
  Peptide Derived from Human Papillomavirus
QLCKITLSADI

SEQ ID NO: 5560 - protein, 11 aa, Artificial Sequence
  Peptide Derived from Human Papillomavirus
QLCLLGCKPPI

SEQ ID NO: 5561 - protein, 9 aa, Artificial Sequence
  Peptide Derived from Human Papillomavirus
QLFVTVVDT

SEQ ID NO: 5562 - protein, 10 aa, Artificial Sequence
  Peptide Derived from Human Papillomavirus
QLFVTVVDTT

SEQ ID NO: 5563 - protein, 9 aa, Artificial Sequence
  Peptide Derived from Human Papillomavirus
RAQGHNNGI

SEQ ID NO: 5564 - protein, 8 aa, Artificial Sequence
  Peptide Derived from Human Papillomavirus
RARPKFKA

SEQ ID NO: 5565 - protein, 9 aa, Artificial Sequence
  Peptide Derived from Human Papillomavirus
RLVWACVGL

SEQ ID NO: 5566 - protein, 11 aa, Artificial Sequence
  Peptide Derived from Human Papillomavirus
RLVWACVGLEV

SEQ ID NO: 5567 - protein, 8 aa, Artificial Sequence
  Peptide Derived from Human Papillomavirus
RTNIYYHA

SEQ ID NO: 5568 - protein, 11 aa, Artificial Sequence
  Peptide Derived from Human Papillomavirus
RTNIYYHAGSA

SEQ ID NO: 5569 - protein, 8 aa, Artificial Sequence
  Peptide Derived from Human Papillomavirus
SADIMTYI

SEQ ID NO: 5570 - protein, 11 aa, Artificial Sequence
  Peptide Derived from Human Papillomavirus
SADIMTYIHSM

SEQ ID NO: 5571 - protein, 9 aa, Artificial Sequence
  Peptide Derived from Human Papillomavirus
SADLDQFPL

SEQ ID NO: 5572 - protein, 8 aa, Artificial Sequence
  Peptide Derived from Human Papillomavirus
SAPSASTT

SEQ ID NO: 5573 - protein, 9 aa, Artificial Sequence
  Peptide Derived from Human Papillomavirus
SAPSASTTT

SEQ ID NO: 5574 - protein, 11 aa, Artificial Sequence
  Peptide Derived from Human Papillomavirus
SAPSASTTTPA

SEQ ID NO: 5575 - protein, 8 aa, Artificial Sequence
  Peptide Derived from Human Papillomavirus
SASTTTPA

SEQ ID NO: 5576 - protein, 9 aa, Artificial Sequence
  Peptide Derived from Human Papillomavirus
SICKYPDYL

SEQ ID NO: 5577 - protein, 11 aa, Artificial Sequence
  Peptide Derived from Human Papillomavirus
SICKYPDYLKM

SEQ ID NO: 5578 - protein, 11 aa, Artificial Sequence
  Peptide Derived from Human Papillomavirus
SIPKSDNPKKI

SEQ ID NO: 5579 - protein, 9 aa, Artificial Sequence
  Peptide Derived from Human Papillomavirus
SLEDTYRFV

SEQ ID NO: 5580 - protein, 10 aa, Artificial Sequence
  Peptide Derived from Human Papillomavirus
SLEDTYRFVT

SEQ ID NO: 5581 - protein, 8 aa, Artificial Sequence
  Peptide Derived from Human Papillomavirus
SLWRPSEA

SEQ ID NO: 5582 - protein, 9 aa, Artificial Sequence
  Peptide Derived from Human Papillomavirus
SLWRPSEAT

SEQ ID NO: 5583 - protein, 10 aa, Artificial Sequence
  Peptide Derived from Human Papillomavirus
SLWRPSEATV

SEQ ID NO: 5584 - protein, 9 aa, Artificial Sequence
  Peptide Derived from Human Papillomavirus
SMDYKQTQL

SEQ ID NO: 5585 - protein, 11 aa, Artificial Sequence
  Peptide Derived from Human Papillomavirus
SMDYKQTQLCL

SEQ ID NO: 5586 - protein, 9 aa, Artificial Sequence
  Peptide Derived from Human Papillomavirus
SMVTSDAQI

SEQ ID NO: 5587 - protein, 9 aa, Artificial Sequence
  Peptide Derived from Human Papillomavirus
SQAITCQKT

SEQ ID NO: 5588 - protein, 10 aa, Artificial Sequence
  Peptide Derived from Human Papillomavirus
SQAITCQKTA

SEQ ID NO: 5589 - protein, 9 aa, Artificial Sequence
  Peptide Derived from Human Papillomavirus
STATLANST

SEQ ID NO: 5590 - protein, 9 aa, Artificial Sequence
  Peptide Derived from Human Papillomavirus
STDEYVTRT

SEQ ID NO: 5591 - protein, 11 aa, Artificial Sequence
  Peptide Derived from Human Papillomavirus
STDEYVTRTNI

SEQ ID NO: 5592 - protein, 8 aa, Artificial Sequence
  Peptide Derived from Human Papillomavirus
STNMSVCA

SEQ ID NO: 5593 - protein, 9 aa, Artificial Sequence
  Peptide Derived from Human Papillomavirus
STNMSVCAA

SEQ ID NO: 5594 - protein, 10 aa, Artificial Sequence
  Peptide Derived from Human Papillomavirus
STNMSVCAAI

SEQ ID NO: 5595 - protein, 11 aa, Artificial Sequence
  Peptide Derived from Human Papillomavirus
STNMSVCAAIA

SEQ ID NO: 5596 - protein, 11 aa, Artificial Sequence
  Peptide Derived from Human Papillomavirus
STTTPAKRKKT

SEQ ID NO: 5597 - protein, 11 aa, Artificial Sequence
  Peptide Derived from Human Papillomavirus
STYFPTPSGSM

SEQ ID NO: 5598 - protein, 11 aa, Artificial Sequence
  Peptide Derived from Human Papillomavirus
SVCAAIANSDT

SEQ ID NO: 5599 - protein, 8 aa, Artificial Sequence
  Peptide Derived from Human Papillomavirus
SVIQDGDM

SEQ ID NO: 5600 - protein, 9 aa, Artificial Sequence
  Peptide Derived from Human Papillomavirus
SVIQDGDMV

SEQ ID NO: 5601 - protein, 11 aa, Artificial Sequence
  Peptide Derived from Human Papillomavirus
SVIQDGDMVDT

SEQ ID NO: 5602 - protein, 8 aa, Artificial Sequence
  Peptide Derived from Human Papillomavirus
SVPTDLYI

SEQ ID NO: 5603 - protein, 10 aa, Artificial Sequence
  Peptide Derived from Human Papillomavirus
TALQDTKSNV

SEQ ID NO: 5604 - protein, 8 aa, Artificial Sequence
  Peptide Derived from Human Papillomavirus
TATLANST

SEQ ID NO: 5605 - protein, 10 aa, Artificial Sequence
  Peptide Derived from Human Papillomavirus
TLANSTYFPT

SEQ ID NO: 5606 - protein, 11 aa, Artificial Sequence
  Peptide Derived from Human Papillomavirus
TLFFYLRREQM

SEQ ID NO: 5607 - protein, 8 aa, Artificial Sequence
  Peptide Derived from Human Papillomavirus
TLSADIMT

SEQ ID NO: 5608 - protein, 10 aa, Artificial Sequence
  Peptide Derived from Human Papillomavirus
TLSADIMTYI

SEQ ID NO: 5609 - protein, 9 aa, Artificial Sequence
  Peptide Derived from Human Papillomavirus
TQRLVWACV

SEQ ID NO: 5610 - protein, 11 aa, Artificial Sequence
  Peptide Derived from Human Papillomavirus
TQRLVWACVGL

SEQ ID NO: 5611 - protein, 9 aa, Artificial Sequence
  Peptide Derived from Human Papillomavirus
TTPAKRKKT

SEQ ID NO: 5612 - protein, 8 aa, Artificial Sequence
  Peptide Derived from Human Papillomavirus
TTPPSGSL

SEQ ID NO: 5613 - protein, 11 aa, Artificial Sequence
  Peptide Derived from Human Papillomavirus
TTPPSGSLEDT

SEQ ID NO: 5614 - protein, 9 aa, Artificial Sequence
  Peptide Derived from Human Papillomavirus
TTRSTNMSV

SEQ ID NO: 5615 - protein, 11 aa, Artificial Sequence
  Peptide Derived from Human Papillomavirus
TTRSTNMSVCA

SEQ ID NO: 5616 - protein, 10 aa, Artificial Sequence
  Peptide Derived from Human Papillomavirus
TTTPAKRKKT

SEQ ID NO: 5617 - protein, 8 aa, Artificial Sequence
  Peptide Derived from Human Papillomavirus
TVGESVPT

SEQ ID NO: 5618 - protein, 10 aa, Artificial Sequence
  Peptide Derived from Human Papillomavirus
TVGESVPTDL

SEQ ID NO: 5619 - protein, 9 aa, Artificial Sequence
  Peptide Derived from Human Papillomavirus
TVGHPYYSI

SEQ ID NO: 5620 - protein, 9 aa, Artificial Sequence
  Peptide Derived from Human Papillomavirus
TVVDTTRST

SEQ ID NO: 5621 - protein, 11 aa, Artificial Sequence
  Peptide Derived from Human Papillomavirus
TVVDTTRSTNM

SEQ ID NO: 5622 - protein, 9 aa, Artificial Sequence
  Peptide Derived from Human Papillomavirus
TVYLPPVPV

SEQ ID NO: 5623 - protein, 8 aa, Artificial Sequence
  Peptide Derived from Human Papillomavirus
VAEPYGDT

SEQ ID NO: 5624 - protein, 9 aa, Artificial Sequence
  Peptide Derived from Human Papillomavirus
VAEPYGDTL

SEQ ID NO: 5625 - protein, 8 aa, Artificial Sequence
  Peptide Derived from Human Papillomavirus
VIQDGDMV

SEQ ID NO: 5626 - protein, 10 aa, Artificial Sequence
  Peptide Derived from Human Papillomavirus
VIQDGDMVDT

SEQ ID NO: 5627 - protein, 10 aa, Artificial Sequence
  Peptide Derived from Human Papillomavirus
VTRTNIYYHA

SEQ ID NO: 5628 - protein, 11 aa, Artificial Sequence
  Peptide Derived from Human Papillomavirus
VTSQAITCQKT

SEQ ID NO: 5629 - protein, 10 aa, Artificial Sequence
  Peptide Derived from Human Papillomavirus
VTVVDTTRST

SEQ ID NO: 5630 - protein, 8 aa, Artificial Sequence
  Peptide Derived from Human Papillomavirus
VVDTTRST

SEQ ID NO: 5631 - protein, 10 aa, Artificial Sequence
  Peptide Derived from Human Papillomavirus
VVDTTRSTNM

SEQ ID NO: 5632 - protein, 8 aa, Artificial Sequence
  Peptide Derived from Human Papillomavirus
VVPKVSGL

SEQ ID NO: 5633 - protein, 8 aa, Artificial Sequence
  Peptide Derived from Human Papillomavirus
VVSTDEYV

SEQ ID NO: 5634 - protein, 9 aa, Artificial Sequence
  Peptide Derived from Human Papillomavirus
VVSTDEYVT

SEQ ID NO: 5635 - protein, 11 aa, Artificial Sequence
  Peptide Derived from Human Papillomavirus
VVSTDEYVTRT

SEQ ID NO: 5636 - protein, 8 aa, Artificial Sequence
  Peptide Derived from Human Papillomavirus
WACVGLEV

SEQ ID NO: 5637 - protein, 8 aa, Artificial Sequence
  Peptide Derived from Human Papillomavirus
YIHSMNPA

SEQ ID NO: 5638 - protein, 9 aa, Artificial Sequence
  Peptide Derived from Human Papillomavirus
YIHSMNPAI

SEQ ID NO: 5639 - protein, 10 aa, Artificial Sequence
  Peptide Derived from Human Papillomavirus
YIHSMNPAIL

SEQ ID NO: 5640 - protein, 8 aa, Artificial Sequence
  Peptide Derived from Human Papillomavirus
YIKGSGST

SEQ ID NO: 5641 - protein, 9 aa, Artificial Sequence
  Peptide Derived from Human Papillomavirus
YIKGSGSTA

SEQ ID NO: 5642 - protein, 10 aa, Artificial Sequence
  Peptide Derived from Human Papillomavirus
YIKGSGSTAT

SEQ ID NO: 5643 - protein, 11 aa, Artificial Sequence
  Peptide Derived from Human Papillomavirus
YIKGSGSTATL

SEQ ID NO: 5644 - protein, 10 aa, Artificial Sequence
  Peptide Derived from Human Papillomavirus
YLPPVPVSKV

SEQ ID NO: 5645 - protein, 11 aa, Artificial Sequence
  Peptide Derived from Human Papillomavirus
YLPPVPVSKVV

SEQ ID NO: 5646 - protein, 10 aa, Artificial Sequence
  Peptide Derived from Human Papillomavirus
YLRHGEEFDL

SEQ ID NO: 5647 - protein, 9 aa, Artificial Sequence
  Peptide Derived from Human Papillomavirus
YLRREQMFV

SEQ ID NO: 5648 - protein, 8 aa, Artificial Sequence
  Peptide Derived from Human Papillomavirus
YVFWEVNL

SEQ ID NO: 5649 - protein, 11 aa, Artificial Sequence
  Peptide Derived from Human Papillomavirus
YVTRTNIYYHA

SEQ ID NO: 5650 - protein, 9 aa, Artificial Sequence
  Peptide Derived from Human Papillomavirus
AAGTCPSDV

SEQ ID NO: 5651 - protein, 10 aa, Artificial Sequence
  Peptide Derived from Human Papillomavirus
AAGTCPSDVI

SEQ ID NO: 5652 - protein, 8 aa, Artificial Sequence
  Peptide Derived from Human Papillomavirus
AILDVTSV

SEQ ID NO: 5653 - protein, 10 aa, Artificial Sequence
  Peptide Derived from Human Papillomavirus
AILDVTSVST

SEQ ID NO: 5654 - protein, 8 aa, Artificial Sequence
  Peptide Derived from Human Papillomavirus
ALHRPALT

SEQ ID NO: 5655 - protein, 8 aa, Artificial Sequence
  Peptide Derived from Human Papillomavirus
ALTSRRNT

SEQ ID NO: 5656 - protein, 9 aa, Artificial Sequence
  Peptide Derived from Human Papillomavirus
ALTSRRNTV

SEQ ID NO: 5657 - protein, 9 aa, Artificial Sequence
  Peptide Derived from Human Papillomavirus
ATHNVSPST

SEQ ID NO: 5658 - protein, 10 aa, Artificial Sequence
  Peptide Derived from Human Papillomavirus
ATHNVSPSTA

SEQ ID NO: 5659 - protein, 11 aa, Artificial Sequence
  Peptide Derived from Human Papillomavirus
ATHNVSPSTAV

SEQ ID NO: 5660 - protein, 10 aa, Artificial Sequence
  Peptide Derived from Human Papillomavirus
ATQLYQTCKA

SEQ ID NO: 5661 - protein, 11 aa, Artificial Sequence
  Peptide Derived from Human Papillomavirus
ATQLYQTCKAA

SEQ ID NO: 5662 - protein, 8 aa, Artificial Sequence
  Peptide Derived from Human Papillomavirus
ATQQVKVI

SEQ ID NO: 5663 - protein, 11 aa, Artificial Sequence
  Peptide Derived from Human Papillomavirus
ATQQVKVIDPT

SEQ ID NO: 5664 - protein, 9 aa, Artificial Sequence
  Peptide Derived from Human Papillomavirus
ATTADTTPA

SEQ ID NO: 5665 - protein, 10 aa, Artificial Sequence
  Peptide Derived from Human Papillomavirus
ATTADTTPAI

SEQ ID NO: 5666 - protein, 11 aa, Artificial Sequence
  Peptide Derived from Human Papillomavirus
ATTADTTPAIL

SEQ ID NO: 5667 - protein, 11 aa, Artificial Sequence
  Peptide Derived from Human Papillomavirus
ATTTSTLNDGL

SEQ ID NO: 5668 - protein, 8 aa, Artificial Sequence
  Peptide Derived from Human Papillomavirus
AVQSTSAV

SEQ ID NO: 5669 - protein, 10 aa, Artificial Sequence
  Peptide Derived from Human Papillomavirus
AVQSTSAVSA

SEQ ID NO: 5670 - protein, 8 aa, Artificial Sequence
  Peptide Derived from Human Papillomavirus
AVSAYVPT

SEQ ID NO: 5671 - protein, 10 aa, Artificial Sequence
  Peptide Derived from Human Papillomavirus
AVSAYVPTNT

SEQ ID NO: 5672 - protein, 11 aa, Artificial Sequence
  Peptide Derived from Human Papillomavirus
AVSAYVPTNTT

SEQ ID NO: 5673 - protein, 8 aa, Artificial Sequence
  Peptide Derived from Human Papillomavirus
DIATTADT

SEQ ID NO: 5674 - protein, 9 aa, Artificial Sequence
  Peptide Derived from Human Papillomavirus
DIATTADTT

SEQ ID NO: 5675 - protein, 11 aa, Artificial Sequence
  Peptide Derived from Human Papillomavirus
DIATTADTTPA

SEQ ID NO: 5676 - protein, 9 aa, Artificial Sequence
  Peptide Derived from Human Papillomavirus
DIIALHRPA

SEQ ID NO: 5677 - protein, 10 aa, Artificial Sequence
  Peptide Derived from Human Papillomavirus
DIIALHRPAL

SEQ ID NO: 5678 - protein, 11 aa, Artificial Sequence
  Peptide Derived from Human Papillomavirus
DIIALHRPALT

SEQ ID NO: 5679 - protein, 10 aa, Artificial Sequence
  Peptide Derived from Human Papillomavirus
DIPIFSGPDV

SEQ ID NO: 5680 - protein, 8 aa, Artificial Sequence
  Peptide Derived from Human Papillomavirus
DISSINPA

SEQ ID NO: 5681 - protein, 9 aa, Artificial Sequence
  Peptide Derived from Human Papillomavirus
DIYADTDFT

SEQ ID NO: 5682 - protein, 10 aa, Artificial Sequence
  Peptide Derived from Human Papillomavirus
DIYADTDFTV

SEQ ID NO: 5683 - protein, 9 aa, Artificial Sequence
  Peptide Derived from Human Papillomavirus
DQILRYGSM

SEQ ID NO: 5684 - protein, 11 aa, Artificial Sequence
  Peptide Derived from Human Papillomavirus
DQILRYGSMGV

SEQ ID NO: 5685 - protein, 8 aa, Artificial Sequence
  Peptide Derived from Human Papillomavirus
DTDFTVDT

SEQ ID NO: 5686 - protein, 10 aa, Artificial Sequence
  Peptide Derived from Human Papillomavirus
DTDFTVDTPA

SEQ ID NO: 5687 - protein, 11 aa, Artificial Sequence
  Peptide Derived from Human Papillomavirus
DTDFTVDTPAT

SEQ ID NO: 5688 - protein, 8 aa, Artificial Sequence
  Peptide Derived from Human Papillomavirus
DTPATHNV

SEQ ID NO: 5689 - protein, 9 aa, Artificial Sequence
  Peptide Derived from Human Papillomavirus
DTTPAILDV

SEQ ID NO: 5690 - protein, 10 aa, Artificial Sequence
  Peptide Derived from Human Papillomavirus
DTTPAILDVT

SEQ ID NO: 5691 - protein, 8 aa, Artificial Sequence
  Peptide Derived from Human Papillomavirus
DVGAPAPI

SEQ ID NO: 5692 - protein, 9 aa, Artificial Sequence
  Peptide Derived from Human Papillomavirus
DVIPKIEHT

SEQ ID NO: 5693 - protein, 10 aa, Artificial Sequence
  Peptide Derived from Human Papillomavirus
DVIPKIEHTT

SEQ ID NO: 5694 - protein, 11 aa, Artificial Sequence
  Peptide Derived from Human Papillomavirus
DVIPKIEHTTI

SEQ ID NO: 5695 - protein, 9 aa, Artificial Sequence
  Peptide Derived from Human Papillomavirus
DVPIEHAPT

SEQ ID NO: 5696 - protein, 11 aa, Artificial Sequence
  Peptide Derived from Human Papillomavirus
DVPIEHAPTQV

SEQ ID NO: 5697 - protein, 10 aa, Artificial Sequence
  Peptide Derived from Human Papillomavirus
EASIPIRPPV

SEQ ID NO: 5698 - protein, 8 aa, Artificial Sequence
  Peptide Derived from Human Papillomavirus
EIPMDTFI

SEQ ID NO: 5699 - protein, 9 aa, Artificial Sequence
  Peptide Derived from Human Papillomavirus
EIPMDTFIV

SEQ ID NO: 5700 - protein, 11 aa, Artificial Sequence
  Peptide Derived from Human Papillomavirus
EIPMDTFIVST

SEQ ID NO: 5701 - protein, 9 aa, Artificial Sequence
  Peptide Derived from Human Papillomavirus
EMQPLGASA

SEQ ID NO: 5702 - protein, 10 aa, Artificial Sequence
  Peptide Derived from Human Papillomavirus
EMQPLGASAT

SEQ ID NO: 5703 - protein, 11 aa, Artificial Sequence
  Peptide Derived from Human Papillomavirus
EMQPLGASATT

SEQ ID NO: 5704 - protein, 8 aa, Artificial Sequence
  Peptide Derived from Human Papillomavirus
ETSGHLLL

SEQ ID NO: 5705 - protein, 9 aa, Artificial Sequence
  Peptide Derived from Human Papillomavirus
ETVNAEESL

SEQ ID NO: 5706 - protein, 10 aa, Artificial Sequence
  Peptide Derived from Human Papillomavirus
FIVSTNNENI

SEQ ID NO: 5707 - protein, 11 aa, Artificial Sequence
  Peptide Derived from Human Papillomavirus
FIVSTNNENIT

SEQ ID NO: 5708 - protein, 11 aa, Artificial Sequence
  Peptide Derived from Human Papillomavirus
FLDIIALHRPA

SEQ ID NO: 5709 - protein, 8 aa, Artificial Sequence
  Peptide Derived from Human Papillomavirus
FLSAPKQL

SEQ ID NO: 5710 - protein, 9 aa, Artificial Sequence
  Peptide Derived from Human Papillomavirus
FLSAPKQLI

SEQ ID NO: 5711 - protein, 10 aa, Artificial Sequence
  Peptide Derived from Human Papillomavirus
FLSAPKQLIT

SEQ ID NO: 5712 - protein, 11 aa, Artificial Sequence
  Peptide Derived from Human Papillomavirus
FTDPSVLQPPT

SEQ ID NO: 5713 - protein, 8 aa, Artificial Sequence
  Peptide Derived from Human Papillomavirus
FTDVSVAA

SEQ ID NO: 5714 - protein, 8 aa, Artificial Sequence
  Peptide Derived from Human Papillomavirus
FTVDTPAT

SEQ ID NO: 5715 - protein, 11 aa, Artificial Sequence
  Peptide Derived from Human Papillomavirus
FTVDTPATHNV

SEQ ID NO: 5716 - protein, 9 aa, Artificial Sequence
  Peptide Derived from Human Papillomavirus
FVDGGDFYL

SEQ ID NO: 5717 - protein, 11 aa, Artificial Sequence
  Peptide Derived from Human Papillomavirus
GAPAPIPHPPT

SEQ ID NO: 5718 - protein, 10 aa, Artificial Sequence
  Peptide Derived from Human Papillomavirus
GARVHYYYDI

SEQ ID NO: 5719 - protein, 9 aa, Artificial Sequence
  Peptide Derived from Human Papillomavirus
GASATTTST

SEQ ID NO: 5720 - protein, 10 aa, Artificial Sequence
  Peptide Derived from Human Papillomavirus
GASATTTSTL

SEQ ID NO: 5721 - protein, 8 aa, Artificial Sequence
  Peptide Derived from Human Papillomavirus
GATIGARV

SEQ ID NO: 5722 - protein, 8 aa, Artificial Sequence
  Peptide Derived from Human Papillomavirus
GIGSGSGT

SEQ ID NO: 5723 - protein, 9 aa, Artificial Sequence
  Peptide Derived from Human Papillomavirus
GIVDVGAPA

SEQ ID NO: 5724 - protein, 11 aa, Artificial Sequence
  Peptide Derived from Human Papillomavirus
GIVDVGAPAPI

SEQ ID NO: 5725 - protein, 10 aa, Artificial Sequence
  Peptide Derived from Human Papillomavirus
GLGIGSGSGT

SEQ ID NO: 5726 - protein, 9 aa, Artificial Sequence
  Peptide Derived from Human Papillomavirus
GLYDIYADT

SEQ ID NO: 5727 - protein, 10 aa, Artificial Sequence
  Peptide Derived from Human Papillomavirus
GLYSKATQQV

SEQ ID NO: 5728 - protein, 8 aa, Artificial Sequence
  Peptide Derived from Human Papillomavirus
GTCPSDVI

SEQ ID NO: 5729 - protein, 11 aa, Artificial Sequence
  Peptide Derived from Human Papillomavirus
GTCPSDVIPKI

SEQ ID NO: 5730 - protein, 9 aa, Artificial Sequence
  Peptide Derived from Human Papillomavirus
GTGGRTGYV

SEQ ID NO: 5731 - protein, 11 aa, Artificial Sequence
  Peptide Derived from Human Papillomavirus
GTGGRTGYVPL

SEQ ID NO: 5732 - protein, 9 aa, Artificial Sequence
  Peptide Derived from Human Papillomavirus
GVFFGGLGI

SEQ ID NO: 5733 - protein, 8 aa, Artificial Sequence
  Peptide Derived from Human Papillomavirus
GVRRPARL

SEQ ID NO: 5734 - protein, 10 aa, Artificial Sequence
  Peptide Derived from Human Papillomavirus
GVRRPARLGL

SEQ ID NO: 5735 - protein, 11 aa, Artificial Sequence
  Peptide Derived from Human Papillomavirus
HAPTQVFPFPL

SEQ ID NO: 5736 - protein, 9 aa, Artificial Sequence
  Peptide Derived from Human Papillomavirus
HLLLSSSSI

SEQ ID NO: 5737 - protein, 11 aa, Artificial Sequence
  Peptide Derived from Human Papillomavirus
HLLLSSSSIST

SEQ ID NO: 5738 - protein, 8 aa, Artificial Sequence
  Peptide Derived from Human Papillomavirus
HTTIADQI

SEQ ID NO: 5739 - protein, 9 aa, Artificial Sequence
  Peptide Derived from Human Papillomavirus
HTTIADQIL

SEQ ID NO: 5740 - protein, 11 aa, Artificial Sequence
  Peptide Derived from Human Papillomavirus
IADQILRYGSM

SEQ ID NO: 5741 - protein, 8 aa, Artificial Sequence
  Peptide Derived from Human Papillomavirus
IALHRPAL

SEQ ID NO: 5742 - protein, 9 aa, Artificial Sequence
  Peptide Derived from Human Papillomavirus
IALHRPALT

SEQ ID NO: 5743 - protein, 8 aa, Artificial Sequence
  Peptide Derived from Human Papillomavirus
IAPDPDFL

SEQ ID NO: 5744 - protein, 10 aa, Artificial Sequence
  Peptide Derived from Human Papillomavirus
IAPDPDFLDI

SEQ ID NO: 5745 - protein, 11 aa, Artificial Sequence
  Peptide Derived from Human Papillomavirus
IAPDPDFLDII

SEQ ID NO: 5746 - protein, 8 aa, Artificial Sequence
  Peptide Derived from Human Papillomavirus
IATTADTT

SEQ ID NO: 5747 - protein, 10 aa, Artificial Sequence
  Peptide Derived from Human Papillomavirus
IATTADTTPA

SEQ ID NO: 5748 - protein, 11 aa, Artificial Sequence
  Peptide Derived from Human Papillomavirus
IATTADTTPAI

SEQ ID NO: 5749 - protein, 8 aa, Artificial Sequence
  Peptide Derived from Human Papillomavirus
IIALHRPA

SEQ ID NO: 5750 - protein, 9 aa, Artificial Sequence
  Peptide Derived from Human Papillomavirus
IIALHRPAL

SEQ ID NO: 5751 - protein, 10 aa, Artificial Sequence
  Peptide Derived from Human Papillomavirus
IIALHRPALT

SEQ ID NO: 5752 - protein, 9 aa, Artificial Sequence
  Peptide Derived from Human Papillomavirus
ILDVTSVST

SEQ ID NO: 5753 - protein, 9 aa, Artificial Sequence
  Peptide Derived from Human Papillomavirus
ILRYGSMGV

SEQ ID NO: 5754 - protein, 10 aa, Artificial Sequence
  Peptide Derived from Human Papillomavirus
ITSSTPIPGV

SEQ ID NO: 5755 - protein, 10 aa, Artificial Sequence
  Peptide Derived from Human Papillomavirus
ITYENPAYET

SEQ ID NO: 5756 - protein, 11 aa, Artificial Sequence
  Peptide Derived from Human Papillomavirus
ITYENPAYETV

SEQ ID NO: 5757 - protein, 8 aa, Artificial Sequence
  Peptide Derived from Human Papillomavirus
IVDVGAPA

SEQ ID NO: 5758 - protein, 10 aa, Artificial Sequence
  Peptide Derived from Human Papillomavirus
IVDVGAPAPI

SEQ ID NO: 5759 - protein, 10 aa, Artificial Sequence
  Peptide Derived from Human Papillomavirus
IVSLVEESGI

SEQ ID NO: 5760 - protein, 11 aa, Artificial Sequence
  Peptide Derived from Human Papillomavirus
IVSLVEESGIV

SEQ ID NO: 5761 - protein, 9 aa, Artificial Sequence
  Peptide Derived from Human Papillomavirus
IVSTNNENI

SEQ ID NO: 5762 - protein, 10 aa, Artificial Sequence
  Peptide Derived from Human Papillomavirus
IVSTNNENIT

SEQ ID NO: 5763 - protein, 10 aa, Artificial Sequence
  Peptide Derived from Human Papillomavirus
KAAGTCPSDV

SEQ ID NO: 5764 - protein, 11 aa, Artificial Sequence
  Peptide Derived from Human Papillomavirus
KAAGTCPSDVI

SEQ ID NO: 5765 - protein, 8 aa, Artificial Sequence
  Peptide Derived from Human Papillomavirus
KATQQVKV

SEQ ID NO: 5766 - protein, 9 aa, Artificial Sequence
  Peptide Derived from Human Papillomavirus
KATQQVKVI

SEQ ID NO: 5767 - protein, 8 aa, Artificial Sequence
  Peptide Derived from Human Papillomavirus
KIEHTTIA

SEQ ID NO: 5768 - protein, 11 aa, Artificial Sequence
  Peptide Derived from Human Papillomavirus
KIEHTTIADQI

SEQ ID NO: 5769 - protein, 10 aa, Artificial Sequence
  Peptide Derived from Human Papillomavirus
KQLITYENPA

SEQ ID NO: 5770 - protein, 10 aa, Artificial Sequence
  Peptide Derived from Human Papillomavirus
KQTLRTRSGA

SEQ ID NO: 5771 - protein, 11 aa, Artificial Sequence
  Peptide Derived from Human Papillomavirus
KQTLRTRSGAT

SEQ ID NO: 5772 - protein, 8 aa, Artificial Sequence
  Peptide Derived from Human Papillomavirus
KVIDPTFL

SEQ ID NO: 5773 - protein, 10 aa, Artificial Sequence
  Peptide Derived from Human Papillomavirus
KVIDPTFLSA

SEQ ID NO: 5774 - protein, 8 aa, Artificial Sequence
  Peptide Derived from Human Papillomavirus
LAPTTPQV

SEQ ID NO: 5775 - protein, 10 aa, Artificial Sequence
  Peptide Derived from Human Papillomavirus
LAPTTPQVSI

SEQ ID NO: 5776 - protein, 8 aa, Artificial Sequence
  Peptide Derived from Human Papillomavirus
LITYENPA

SEQ ID NO: 5777 - protein, 11 aa, Artificial Sequence
  Peptide Derived from Human Papillomavirus
LITYENPAYET

SEQ ID NO: 5778 - protein, 8 aa, Artificial Sequence
  Peptide Derived from Human Papillomavirus
LLLSSSSI

SEQ ID NO: 5779 - protein, 10 aa, Artificial Sequence
  Peptide Derived from Human Papillomavirus
LLLSSSSIST

SEQ ID NO: 5780 - protein, 9 aa, Artificial Sequence
  Peptide Derived from Human Papillomavirus
LLSSSSIST

SEQ ID NO: 5781 - protein, 9 aa, Artificial Sequence
  Peptide Derived from Human Papillomavirus
LQPPTPAET

SEQ ID NO: 5782 - protein, 8 aa, Artificial Sequence
  Peptide Derived from Human Papillomavirus
LTSRRNTV

SEQ ID NO: 5783 - protein, 8 aa, Artificial Sequence
  Peptide Derived from Human Papillomavirus
LVEESGIV

SEQ ID NO: 5784 - protein, 10 aa, Artificial Sequence
  Peptide Derived from Human Papillomavirus
LVEESGIVDV

SEQ ID NO: 5785 - protein, 9 aa, Artificial Sequence
  Peptide Derived from Human Papillomavirus
MLKRRRKRV

SEQ ID NO: 5786 - protein, 8 aa, Artificial Sequence
  Peptide Derived from Human Papillomavirus
MQPLGASA

SEQ ID NO: 5787 - protein, 9 aa, Artificial Sequence
  Peptide Derived from Human Papillomavirus
MQPLGASAT

SEQ ID NO: 5788 - protein, 10 aa, Artificial Sequence
  Peptide Derived from Human Papillomavirus
MQPLGASATT

SEQ ID NO: 5789 - protein, 11 aa, Artificial Sequence
  Peptide Derived from Human Papillomavirus
MQPLGASATTT

SEQ ID NO: 5790 - protein, 11 aa, Artificial Sequence
  Peptide Derived from Human Papillomavirus
NAEESLYFSNT

SEQ ID NO: 5791 - protein, 9 aa, Artificial Sequence
  Peptide Derived from Human Papillomavirus
NIAPDPDFL

SEQ ID NO: 5792 - protein, 11 aa, Artificial Sequence
  Peptide Derived from Human Papillomavirus
NIAPDPDFLDI

SEQ ID NO: 5793 - protein, 8 aa, Artificial Sequence
  Peptide Derived from Human Papillomavirus
NITSSTPI

SEQ ID NO: 5794 - protein, 11 aa, Artificial Sequence
  Peptide Derived from Human Papillomavirus
NITSSTPIPGV

SEQ ID NO: 5795 - protein, 8 aa, Artificial Sequence
  Peptide Derived from Human Papillomavirus
NTTVPLST

SEQ ID NO: 5796 - protein, 8 aa, Artificial Sequence
  Peptide Derived from Human Papillomavirus
NTVRYSRL

SEQ ID NO: 5797 - protein, 8 aa, Artificial Sequence
  Peptide Derived from Human Papillomavirus
NVSPSTAV

SEQ ID NO: 5798 - protein, 11 aa, Artificial Sequence
  Peptide Derived from Human Papillomavirus
NVSPSTAVQST

SEQ ID NO: 5799 - protein, 8 aa, Artificial Sequence
  Peptide Derived from Human Papillomavirus
PAETSGHL

SEQ ID NO: 5800 - protein, 9 aa, Artificial Sequence
  Peptide Derived from Human Papillomavirus
PAETSGHLL

SEQ ID NO: 5801 - protein, 10 aa, Artificial Sequence
  Peptide Derived from Human Papillomavirus
PAETSGHLLL

SEQ ID NO: 5802 - protein, 8 aa, Artificial Sequence
  Peptide Derived from Human Papillomavirus
PAGESIEM

SEQ ID NO: 5803 - protein, 11 aa, Artificial Sequence
  Peptide Derived from Human Papillomavirus
PAGESIEMQPL

SEQ ID NO: 5804 - protein, 9 aa, Artificial Sequence
  Peptide Derived from Human Papillomavirus
PAILDVTSV

SEQ ID NO: 5805 - protein, 11 aa, Artificial Sequence
  Peptide Derived from Human Papillomavirus
PAILDVTSVST

SEQ ID NO: 5806 - protein, 9 aa, Artificial Sequence
  Peptide Derived from Human Papillomavirus
PALTSRRNT

SEQ ID NO: 5807 - protein, 10 aa, Artificial Sequence
  Peptide Derived from Human Papillomavirus
PALTSRRNTV

SEQ ID NO: 5808 - protein, 9 aa, Artificial Sequence
  Peptide Derived from Human Papillomavirus
PAPIPHPPT

SEQ ID NO: 5809 - protein, 10 aa, Artificial Sequence
  Peptide Derived from Human Papillomavirus
PAPIPHPPTT

SEQ ID NO: 5810 - protein, 10 aa, Artificial Sequence
  Peptide Derived from Human Papillomavirus
PARLGLYSKA

SEQ ID NO: 5811 - protein, 11 aa, Artificial Sequence
  Peptide Derived from Human Papillomavirus
PARLGLYSKAT

SEQ ID NO: 5812 - protein, 10 aa, Artificial Sequence
  Peptide Derived from Human Papillomavirus
PATHNVSPST

SEQ ID NO: 5813 - protein, 11 aa, Artificial Sequence
  Peptide Derived from Human Papillomavirus
PATHNVSPSTA

SEQ ID NO: 5814 - protein, 8 aa, Artificial Sequence
  Peptide Derived from Human Papillomavirus
PAYETVNA

SEQ ID NO: 5815 - protein, 9 aa, Artificial Sequence
  Peptide Derived from Human Papillomavirus
PIEHAPTQV

SEQ ID NO: 5816 - protein, 8 aa, Artificial Sequence
  Peptide Derived from Human Papillomavirus
PIFSGPDV

SEQ ID NO: 5817 - protein, 10 aa, Artificial Sequence
  Peptide Derived from Human Papillomavirus
PIFSGPDVPI

SEQ ID NO: 5818 - protein, 9 aa, Artificial Sequence
  Peptide Derived from Human Papillomavirus
PIPGVRRPA

SEQ ID NO: 5819 - protein, 11 aa, Artificial Sequence
  Peptide Derived from Human Papillomavirus
PIPGVRRPARL

SEQ ID NO: 5820 - protein, 8 aa, Artificial Sequence
  Peptide Derived from Human Papillomavirus
PIPHPPTT

SEQ ID NO: 5821 - protein, 8 aa, Artificial Sequence
  Peptide Derived from Human Papillomavirus
PIRPPVSI

SEQ ID NO: 5822 - protein, 11 aa, Artificial Sequence
  Peptide Derived from Human Papillomavirus
PIRPPVSIDPV

SEQ ID NO: 5823 - protein, 9 aa, Artificial Sequence
  Peptide Derived from Human Papillomavirus
PLAPTTPQV

SEQ ID NO: 5824 - protein, 11 aa, Artificial Sequence
  Peptide Derived from Human Papillomavirus
PLAPTTPQVSI

SEQ ID NO: 5825 - protein, 9 aa, Artificial Sequence
  Peptide Derived from Human Papillomavirus
PLDPSIVSL

SEQ ID NO: 5826 - protein, 10 aa, Artificial Sequence
  Peptide Derived from Human Papillomavirus
PLDPSIVSLV

SEQ ID NO: 5827 - protein, 8 aa, Artificial Sequence
  Peptide Derived from Human Papillomavirus
PLGASATT

SEQ ID NO: 5828 - protein, 9 aa, Artificial Sequence
  Peptide Derived from Human Papillomavirus
PLGASATTT

SEQ ID NO: 5829 - protein, 11 aa, Artificial Sequence
  Peptide Derived from Human Papillomavirus
PLGASATTTST

SEQ ID NO: 5830 - protein, 8 aa, Artificial Sequence
  Peptide Derived from Human Papillomavirus
PLSTGFDI

SEQ ID NO: 5831 - protein, 10 aa, Artificial Sequence
  Peptide Derived from Human Papillomavirus
PLSTGFDIPI

SEQ ID NO: 5832 - protein, 8 aa, Artificial Sequence
  Peptide Derived from Human Papillomavirus
PLSTRPST

SEQ ID NO: 5833 - protein, 9 aa, Artificial Sequence
  Peptide Derived from Human Papillomavirus
PLSTRPSTV

SEQ ID NO: 5834 - protein, 9 aa, Artificial Sequence
  Peptide Derived from Human Papillomavirus
PMDTFIVST

SEQ ID NO: 5835 - protein, 10 aa, Artificial Sequence
  Peptide Derived from Human Papillomavirus
PTFLSAPKQL

SEQ ID NO: 5836 - protein, 11 aa, Artificial Sequence
  Peptide Derived from Human Papillomavirus
PTFLSAPKQLI

SEQ ID NO: 5837 - protein, 8 aa, Artificial Sequence
  Peptide Derived from Human Papillomavirus
PTFTDPSV

SEQ ID NO: 5838 - protein, 9 aa, Artificial Sequence
  Peptide Derived from Human Papillomavirus
PTFTDPSVL

SEQ ID NO: 5839 - protein, 8 aa, Artificial Sequence
  Peptide Derived from Human Papillomavirus
PTNTTVPL

SEQ ID NO: 5840 - protein, 10 aa, Artificial Sequence
  Peptide Derived from Human Papillomavirus
PTNTTVPLST

SEQ ID NO: 5841 - protein, 10 aa, Artificial Sequence
  Peptide Derived from Human Papillomavirus
PTPAETSGHL

SEQ ID NO: 5842 - protein, 11 aa, Artificial Sequence
  Peptide Derived from Human Papillomavirus
PTPAETSGHLL

SEQ ID NO: 5843 - protein, 9 aa, Artificial Sequence
  Peptide Derived from Human Papillomavirus
PTQVFPFPL

SEQ ID NO: 5844 - protein, 10 aa, Artificial Sequence
  Peptide Derived from Human Papillomavirus
PTQVFPFPLA

SEQ ID NO: 5845 - protein, 8 aa, Artificial Sequence
  Peptide Derived from Human Papillomavirus
PTTPQVSI

SEQ ID NO: 5846 - protein, 10 aa, Artificial Sequence
  Peptide Derived from Human Papillomavirus
PTTPQVSIFV

SEQ ID NO: 5847 - protein, 8 aa, Artificial Sequence
  Peptide Derived from Human Papillomavirus
PTTSGFDI

SEQ ID NO: 5848 - protein, 9 aa, Artificial Sequence
  Peptide Derived from Human Papillomavirus
PTTSGFDIA

SEQ ID NO: 5849 - protein, 10 aa, Artificial Sequence
  Peptide Derived from Human Papillomavirus
PTTSGFDIAT

SEQ ID NO: 5850 - protein, 11 aa, Artificial Sequence
  Peptide Derived from Human Papillomavirus
PTTSGFDIATT

SEQ ID NO: 5851 - protein, 9 aa, Artificial Sequence
  Peptide Derived from Human Papillomavirus
PVGPLDPSI

SEQ ID NO: 5852 - protein, 10 aa, Artificial Sequence
  Peptide Derived from Human Papillomavirus
PVGPLDPSIV

SEQ ID NO: 5853 - protein, 10 aa, Artificial Sequence
  Peptide Derived from Human Papillomavirus
PVSIDPVGPL

SEQ ID NO: 5854 - protein, 8 aa, Artificial Sequence
  Peptide Derived from Human Papillomavirus
QILRYGSM

SEQ ID NO: 5855 - protein, 10 aa, Artificial Sequence
  Peptide Derived from Human Papillomavirus
QILRYGSMGV

SEQ ID NO: 5856 - protein, 9 aa, Artificial Sequence
  Peptide Derived from Human Papillomavirus
QLITYENPA

SEQ ID NO: 5857 - protein, 8 aa, Artificial Sequence
  Peptide Derived from Human Papillomavirus
QLYQTCKA

SEQ ID NO: 5858 - protein, 9 aa, Artificial Sequence
  Peptide Derived from Human Papillomavirus
QLYQTCKAA

SEQ ID NO: 5859 - protein, 11 aa, Artificial Sequence
  Peptide Derived from Human Papillomavirus
QLYQTCKAAGT

SEQ ID NO: 5860 - protein, 9 aa, Artificial Sequence
  Peptide Derived from Human Papillomavirus
QQVKVIDPT

SEQ ID NO: 5861 - protein, 11 aa, Artificial Sequence
  Peptide Derived from Human Papillomavirus
QQVKVIDPTFL

SEQ ID NO: 5862 - protein, 8 aa, Artificial Sequence
  Peptide Derived from Human Papillomavirus
QTCKAAGT

SEQ ID NO: 5863 - protein, 9 aa, Artificial Sequence
  Peptide Derived from Human Papillomavirus
QTLRTRSGA

SEQ ID NO: 5864 - protein, 10 aa, Artificial Sequence
  Peptide Derived from Human Papillomavirus
QTLRTRSGAT

SEQ ID NO: 5865 - protein, 11 aa, Artificial Sequence
  Peptide Derived from Human Papillomavirus
QTLRTRSGATI

SEQ ID NO: 5866 - protein, 8 aa, Artificial Sequence
  Peptide Derived from Human Papillomavirus
QVFPFPLA

SEQ ID NO: 5867 - protein, 10 aa, Artificial Sequence
  Peptide Derived from Human Papillomavirus
QVFPFPLAPT

SEQ ID NO: 5868 - protein, 11 aa, Artificial Sequence
  Peptide Derived from Human Papillomavirus
QVFPFPLAPTT

SEQ ID NO: 5869 - protein, 8 aa, Artificial Sequence
  Peptide Derived from Human Papillomavirus
QVKVIDPT

SEQ ID NO: 5870 - protein, 10 aa, Artificial Sequence
  Peptide Derived from Human Papillomavirus
QVKVIDPTFL

SEQ ID NO: 5871 - protein, 10 aa, Artificial Sequence
  Peptide Derived from Human Papillomavirus
RASATQLYQT

SEQ ID NO: 5872 - protein, 8 aa, Artificial Sequence
  Peptide Derived from Human Papillomavirus
RLGLYSKA

SEQ ID NO: 5873 - protein, 9 aa, Artificial Sequence
  Peptide Derived from Human Papillomavirus
RLGLYSKAT

SEQ ID NO: 5874 - protein, 8 aa, Artificial Sequence
  Peptide Derived from Human Papillomavirus
RLGNKQTL

SEQ ID NO: 5875 - protein, 10 aa, Artificial Sequence
  Peptide Derived from Human Papillomavirus
RLGNKQTLRT

SEQ ID NO: 5876 - protein, 9 aa, Artificial Sequence
  Peptide Derived from Human Papillomavirus
RTGYVPLST

SEQ ID NO: 5877 - protein, 8 aa, Artificial Sequence
  Peptide Derived from Human Papillomavirus
RTKRASAT

SEQ ID NO: 5878 - protein, 10 aa, Artificial Sequence
  Peptide Derived from Human Papillomavirus
RTKRASATQL

SEQ ID NO: 5879 - protein, 8 aa, Artificial Sequence
  Peptide Derived from Human Papillomavirus
RTRSGATI

SEQ ID NO: 5880 - protein, 10 aa, Artificial Sequence
  Peptide Derived from Human Papillomavirus
RTRSGATIGA

SEQ ID NO: 5881 - protein, 8 aa, Artificial Sequence
  Peptide Derived from Human Papillomavirus
RVHYYYDI

SEQ ID NO: 5882 - protein, 11 aa, Artificial Sequence
  Peptide Derived from Human Papillomavirus
RVHYYYDISSI

SEQ ID NO: 5883 - protein, 9 aa, Artificial Sequence
  Peptide Derived from Human Papillomavirus
RVSYFFTDV

SEQ ID NO: 5884 - protein, 11 aa, Artificial Sequence
  Peptide Derived from Human Papillomavirus
RVSYFFTDVSV

SEQ ID NO: 5885 - protein, 8 aa, Artificial Sequence
  Peptide Derived from Human Papillomavirus
SAPKQLIT

SEQ ID NO: 5886 - protein, 8 aa, Artificial Sequence
  Peptide Derived from Human Papillomavirus
SATQLYQT

SEQ ID NO: 5887 - protein, 11 aa, Artificial Sequence
  Peptide Derived from Human Papillomavirus
SATQLYQTCKA

SEQ ID NO: 5888 - protein, 8 aa, Artificial Sequence
  Peptide Derived from Human Papillomavirus
SATTTSTL

SEQ ID NO: 5889 - protein, 9 aa, Artificial Sequence
  Peptide Derived from Human Papillomavirus
SAVSAYVPT

SEQ ID NO: 5890 - protein, 11 aa, Artificial Sequence
  Peptide Derived from Human Papillomavirus
SAVSAYVPTNT

SEQ ID NO: 5891 - protein, 8 aa, Artificial Sequence
  Peptide Derived from Human Papillomavirus
SAYVPTNT

SEQ ID NO: 5892 - protein, 9 aa, Artificial Sequence
  Peptide Derived from Human Papillomavirus
SAYVPTNTT

SEQ ID NO: 5893 - protein, 10 aa, Artificial Sequence
  Peptide Derived from Human Papillomavirus
SAYVPTNTTV

SEQ ID NO: 5894 - protein, 8 aa, Artificial Sequence
  Peptide Derived from Human Papillomavirus
SIDPVGPL

SEQ ID NO: 5895 - protein, 9 aa, Artificial Sequence
  Peptide Derived from Human Papillomavirus
SIEMQPLGA

SEQ ID NO: 5896 - protein, 11 aa, Artificial Sequence
  Peptide Derived from Human Papillomavirus
SIEMQPLGASA

SEQ ID NO: 5897 - protein, 11 aa, Artificial Sequence
  Peptide Derived from Human Papillomavirus
SIFVDGGDFYL

SEQ ID NO: 5898 - protein, 9 aa, Artificial Sequence
  Peptide Derived from Human Papillomavirus
SINPAGESI

SEQ ID NO: 5899 - protein, 11 aa, Artificial Sequence
  Peptide Derived from Human Papillomavirus
SINPAGESIEM

SEQ ID NO: 5900 - protein, 8 aa, Artificial Sequence
  Peptide Derived from Human Papillomavirus
SIPIRPPV

SEQ ID NO: 5901 - protein, 10 aa, Artificial Sequence
  Peptide Derived from Human Papillomavirus
SIPIRPPVSI

SEQ ID NO: 5902 - protein, 10 aa, Artificial Sequence
  Peptide Derived from Human Papillomavirus
SISTHNYEEI

SEQ ID NO: 5903 - protein, 11 aa, Artificial Sequence
  Peptide Derived from Human Papillomavirus
SIVSLVEESGI

SEQ ID NO: 5904 - protein, 8 aa, Artificial Sequence
  Peptide Derived from Human Papillomavirus
SLVEESGI

SEQ ID NO: 5905 - protein, 9 aa, Artificial Sequence
  Peptide Derived from Human Papillomavirus
SLVEESGIV

SEQ ID NO: 5906 - protein, 11 aa, Artificial Sequence
  Peptide Derived from Human Papillomavirus
SLVEESGIVDV

SEQ ID NO: 5907 - protein, 11 aa, Artificial Sequence
  Peptide Derived from Human Papillomavirus
SLYFSNTSHNI

SEQ ID NO: 5908 - protein, 9 aa, Artificial Sequence
  Peptide Derived from Human Papillomavirus
SMGVFFGGL

SEQ ID NO: 5909 - protein, 11 aa, Artificial Sequence
  Peptide Derived from Human Papillomavirus
SMGVFFGGLGI

SEQ ID NO: 5910 - protein, 9 aa, Artificial Sequence
  Peptide Derived from Human Papillomavirus
STAVQSTSA

SEQ ID NO: 5911 - protein, 10 aa, Artificial Sequence
  Peptide Derived from Human Papillomavirus
STAVQSTSAV

SEQ ID NO: 5912 - protein, 8 aa, Artificial Sequence
  Peptide Derived from Human Papillomavirus
STGFDIPI

SEQ ID NO: 5913 - protein, 9 aa, Artificial Sequence
  Peptide Derived from Human Papillomavirus
STHENPTFT

SEQ ID NO: 5914 - protein, 8 aa, Artificial Sequence
  Peptide Derived from Human Papillomavirus
STHNYEEI

SEQ ID NO: 5915 - protein, 10 aa, Artificial Sequence
  Peptide Derived from Human Papillomavirus
STHNYEEIPM

SEQ ID NO: 5916 - protein, 8 aa, Artificial Sequence
  Peptide Derived from Human Papillomavirus
STKRTKRA

SEQ ID NO: 5917 - protein, 10 aa, Artificial Sequence
  Peptide Derived from Human Papillomavirus
STKRTKRASA

SEQ ID NO: 5918 - protein, 11 aa, Artificial Sequence
  Peptide Derived from Human Papillomavirus
STKRTKRASAT

SEQ ID NO: 5919 - protein, 10 aa, Artificial Sequence
  Peptide Derived from Human Papillomavirus
STLNDGLYDI

SEQ ID NO: 5920 - protein, 8 aa, Artificial Sequence
  Peptide Derived from Human Papillomavirus
STNNENIT

SEQ ID NO: 5921 - protein, 11 aa, Artificial Sequence
  Peptide Derived from Human Papillomavirus
STNNENITSST

SEQ ID NO: 5922 - protein, 11 aa, Artificial Sequence
  Peptide Derived from Human Papillomavirus
STPIPGVRRPA

SEQ ID NO: 5923 - protein, 10 aa, Artificial Sequence
  Peptide Derived from Human Papillomavirus
STRPSTVSEA

SEQ ID NO: 5924 - protein, 9 aa, Artificial Sequence
  Peptide Derived from Human Papillomavirus
STSAVSAYV

SEQ ID NO: 5925 - protein, 11 aa, Artificial Sequence
  Peptide Derived from Human Papillomavirus
STSAVSAYVPT

SEQ ID NO: 5926 - protein, 8 aa, Artificial Sequence
  Peptide Derived from Human Papillomavirus
STVSEASI

SEQ ID NO: 5927 - protein, 10 aa, Artificial Sequence
  Peptide Derived from Human Papillomavirus
STVSEASIPI

SEQ ID NO: 5928 - protein, 9 aa, Artificial Sequence
  Peptide Derived from Human Papillomavirus
SVLQPPTPA

SEQ ID NO: 5929 - protein, 11 aa, Artificial Sequence
  Peptide Derived from Human Papillomavirus
SVLQPPTPAET

SEQ ID NO: 5930 - protein, 9 aa, Artificial Sequence
  Peptide Derived from Human Papillomavirus
SVSTHENPT

SEQ ID NO: 5931 - protein, 11 aa, Artificial Sequence
  Peptide Derived from Human Papillomavirus
SVSTHENPTFT

SEQ ID NO: 5932 - protein, 8 aa, Artificial Sequence
  Peptide Derived from Human Papillomavirus
TADTTPAI

SEQ ID NO: 5933 - protein, 9 aa, Artificial Sequence
  Peptide Derived from Human Papillomavirus
TADTTPAIL

SEQ ID NO: 5934 - protein, 11 aa, Artificial Sequence
  Peptide Derived from Human Papillomavirus
TADTTPAILDV

SEQ ID NO: 5935 - protein, 8 aa, Artificial Sequence
  Peptide Derived from Human Papillomavirus
TAVQSTSA

SEQ ID NO: 5936 - protein, 9 aa, Artificial Sequence
  Peptide Derived from Human Papillomavirus
TAVQSTSAV

SEQ ID NO: 5937 - protein, 11 aa, Artificial Sequence
  Peptide Derived from Human Papillomavirus
TAVQSTSAVSA

SEQ ID NO: 5938 - protein, 9 aa, Artificial Sequence
  Peptide Derived from Human Papillomavirus
TLNDGLYDI

SEQ ID NO: 5939 - protein, 11 aa, Artificial Sequence
  Peptide Derived from Human Papillomavirus
TLNDGLYDIYA

SEQ ID NO: 5940 - protein, 8 aa, Artificial Sequence
  Peptide Derived from Human Papillomavirus
TLRTRSGA

SEQ ID NO: 5941 - protein, 9 aa, Artificial Sequence
  Peptide Derived from Human Papillomavirus
TLRTRSGAT

SEQ ID NO: 5942 - protein, 10 aa, Artificial Sequence
  Peptide Derived from Human Papillomavirus
TLRTRSGATI

SEQ ID NO: 5943 - protein, 9 aa, Artificial Sequence
  Peptide Derived from Human Papillomavirus
TQLYQTCKA

SEQ ID NO: 5944 - protein, 10 aa, Artificial Sequence
  Peptide Derived from Human Papillomavirus
TQLYQTCKAA

SEQ ID NO: 5945 - protein, 10 aa, Artificial Sequence
  Peptide Derived from Human Papillomavirus
TQQVKVIDPT

SEQ ID NO: 5946 - protein, 8 aa, Artificial Sequence
  Peptide Derived from Human Papillomavirus
TQVFPFPL

SEQ ID NO: 5947 - protein, 9 aa, Artificial Sequence
  Peptide Derived from Human Papillomavirus
TQVFPFPLA

SEQ ID NO: 5948 - protein, 11 aa, Artificial Sequence
  Peptide Derived from Human Papillomavirus
TQVFPFPLAPT

SEQ ID NO: 5949 - protein, 8 aa, Artificial Sequence
  Peptide Derived from Human Papillomavirus
TTADTTPA

SEQ ID NO: 5950 - protein, 9 aa, Artificial Sequence
  Peptide Derived from Human Papillomavirus
TTADTTPAI

SEQ ID NO: 5951 - protein, 10 aa, Artificial Sequence
  Peptide Derived from Human Papillomavirus
TTADTTPAIL

SEQ ID NO: 5952 - protein, 8 aa, Artificial Sequence
  Peptide Derived from Human Papillomavirus
TTIADQIL

SEQ ID NO: 5953 - protein, 8 aa, Artificial Sequence
  Peptide Derived from Human Papillomavirus
TTPAILDV

SEQ ID NO: 5954 - protein, 9 aa, Artificial Sequence
  Peptide Derived from Human Papillomavirus
TTPAILDVT

SEQ ID NO: 5955 - protein, 11 aa, Artificial Sequence
  Peptide Derived from Human Papillomavirus
TTPAILDVTSV

SEQ ID NO: 5956 - protein, 9 aa, Artificial Sequence
  Peptide Derived from Human Papillomavirus
TTPQVSIFV

SEQ ID NO: 5957 - protein, 8 aa, Artificial Sequence
  Peptide Derived from Human Papillomavirus
TTSGFDIA

SEQ ID NO: 5958 - protein, 9 aa, Artificial Sequence
  Peptide Derived from Human Papillomavirus
TTSGFDIAT

SEQ ID NO: 5959 - protein, 10 aa, Artificial Sequence
  Peptide Derived from Human Papillomavirus
TTSGFDIATT

SEQ ID NO: 5960 - protein, 11 aa, Artificial Sequence
  Peptide Derived from Human Papillomavirus
TTSGFDIATTA

SEQ ID NO: 5961 - protein, 9 aa, Artificial Sequence
  Peptide Derived from Human Papillomavirus
TTSTLNDGL

SEQ ID NO: 5962 - protein, 10 aa, Artificial Sequence
  Peptide Derived from Human Papillomavirus
TTTSTLNDGL

SEQ ID NO: 5963 - protein, 11 aa, Artificial Sequence
  Peptide Derived from Human Papillomavirus
TTVPLSTGFDI

SEQ ID NO: 5964 - protein, 10 aa, Artificial Sequence
  Peptide Derived from Human Papillomavirus
TVDTPATHNV

SEQ ID NO: 5965 - protein, 8 aa, Artificial Sequence
  Peptide Derived from Human Papillomavirus
TVNAEESL

SEQ ID NO: 5966 - protein, 10 aa, Artificial Sequence
  Peptide Derived from Human Papillomavirus
TVPLSTGFDI

SEQ ID NO: 5967 - protein, 9 aa, Artificial Sequence
  Peptide Derived from Human Papillomavirus
TVSEASIPI

SEQ ID NO: 5968 - protein, 9 aa, Artificial Sequence
  Peptide Derived from Human Papillomavirus
VIDPTFLSA

SEQ ID NO: 5969 - protein, 8 aa, Artificial Sequence
  Peptide Derived from Human Papillomavirus
VIPKIEHT

SEQ ID NO: 5970 - protein, 9 aa, Artificial Sequence
  Peptide Derived from Human Papillomavirus
VIPKIEHTT

SEQ ID NO: 5971 - protein, 10 aa, Artificial Sequence
  Peptide Derived from Human Papillomavirus
VIPKIEHTTI

SEQ ID NO: 5972 - protein, 11 aa, Artificial Sequence
  Peptide Derived from Human Papillomavirus
VIPKIEHTTIA

SEQ ID NO: 5973 - protein, 8 aa, Artificial Sequence
  Peptide Derived from Human Papillomavirus
VLQPPTPA

SEQ ID NO: 5974 - protein, 10 aa, Artificial Sequence
  Peptide Derived from Human Papillomavirus
VLQPPTPAET

SEQ ID NO: 5975 - protein, 9 aa, Artificial Sequence
  Peptide Derived from Human Papillomavirus
VQSTSAVSA

SEQ ID NO: 5976 - protein, 11 aa, Artificial Sequence
  Peptide Derived from Human Papillomavirus
VQSTSAVSAYV

SEQ ID NO: 5977 - protein, 11 aa, Artificial Sequence
  Peptide Derived from Human Papillomavirus
VTSVSTHENPT

SEQ ID NO: 5978 - protein, 8 aa, Artificial Sequence
  Peptide Derived from Human Papillomavirus
YADTDFTV

SEQ ID NO: 5979 - protein, 10 aa, Artificial Sequence
  Peptide Derived from Human Papillomavirus
YADTDFTVDT

SEQ ID NO: 5980 - protein, 8 aa, Artificial Sequence
  Peptide Derived from Human Papillomavirus
YLHPSYYM

SEQ ID NO: 5981 - protein, 9 aa, Artificial Sequence
  Peptide Derived from Human Papillomavirus
YLHPSYYML

SEQ ID NO: 5982 - protein, 10 aa, Artificial Sequence
  Peptide Derived from Human Papillomavirus
YMLKRRRKRV

SEQ ID NO: 5983 - protein, 9 aa, Artificial Sequence
  Peptide Derived from Human Papillomavirus
YQTCKAAGT

SEQ ID NO: 5984 - protein, 10 aa, Artificial Sequence
  Peptide Derived from Human Papillomavirus
YVPLSTRPST

SEQ ID NO: 5985 - protein, 11 aa, Artificial Sequence
  Peptide Derived from Human Papillomavirus
YVPLSTRPSTV

SEQ ID NO: 5986 - protein, 8 aa, Artificial Sequence
  Peptide Derived from Human Papillomavirus
YVPTNTTV

SEQ ID NO: 5987 - protein, 10 aa, Artificial Sequence
  Peptide Derived from Human Papillomavirus
YVPTNTTVPL

SEQ ID NO: 5988 - protein, 11 aa, Artificial Sequence
  Peptide Derived from Human Papillomavirus
AAAFLKSNSQA

SEQ ID NO: 5989 - protein, 8 aa, Artificial Sequence
  Peptide Derived from Human Papillomavirus
AACSQSAA

SEQ ID NO: 5990 - protein, 11 aa, Artificial Sequence
  Peptide Derived from Human Papillomavirus
AACSQSAAEDV

SEQ ID NO: 5991 - protein, 9 aa, Artificial Sequence
  Peptide Derived from Human Papillomavirus
AAEDVVDRA

SEQ ID NO: 5992 - protein, 10 aa, Artificial Sequence
  Peptide Derived from Human Papillomavirus
AAEDVVDRAA

SEQ ID NO: 5993 - protein, 10 aa, Artificial Sequence
  Peptide Derived from Human Papillomavirus
AAFLKSNSQA

SEQ ID NO: 5994 - protein, 9 aa, Artificial Sequence
  Peptide Derived from Human Papillomavirus
AANPCRTSI

SEQ ID NO: 5995 - protein, 8 aa, Artificial Sequence
  Peptide Derived from Human Papillomavirus
AARALFNI

SEQ ID NO: 5996 - protein, 9 aa, Artificial Sequence
  Peptide Derived from Human Papillomavirus
ALDGNEISI

SEQ ID NO: 5997 - protein, 11 aa, Artificial Sequence
  Peptide Derived from Human Papillomavirus
ALDGNEISIDV

SEQ ID NO: 5998 - protein, 8 aa, Artificial Sequence
  Peptide Derived from Human Papillomavirus
ALKRKFAA

SEQ ID NO: 5999 - protein, 10 aa, Artificial Sequence
  Peptide Derived from Human Papillomavirus
ALVQLKCPPL

SEQ ID NO: 6000 - protein, 11 aa, Artificial Sequence
  Peptide Derived from Human Papillomavirus
ALVQLKCPPLL

SEQ ID NO: 6001 - protein, 8 aa, Artificial Sequence
  Peptide Derived from Human Papillomavirus
ALYWFRTA

SEQ ID NO: 6002 - protein, 9 aa, Artificial Sequence
  Peptide Derived from Human Papillomavirus
ALYWFRTAM

SEQ ID NO: 6003 - protein, 8 aa, Artificial Sequence
  Peptide Derived from Human Papillomavirus
AMSNISDV

SEQ ID NO: 6004 - protein, 11 aa, Artificial Sequence
  Peptide Derived from Human Papillomavirus
AMSNISDVQGT

SEQ ID NO: 6005 - protein, 10 aa, Artificial Sequence
  Peptide Derived from Human Papillomavirus
AQLADSNSNA

SEQ ID NO: 6006 - protein, 11 aa, Artificial Sequence
  Peptide Derived from Human Papillomavirus
AQLADSNSNAA

SEQ ID NO: 6007 - protein, 10 aa, Artificial Sequence
  Peptide Derived from Human Papillomavirus
AVCALKRKFA

SEQ ID NO: 6008 - protein, 11 aa, Artificial Sequence
  Peptide Derived from Human Papillomavirus
AVCALKRKFAA

SEQ ID NO: 6009 - protein, 11 aa, Artificial Sequence
  Peptide Derived from Human Papillomavirus
AVIERRTGDNI

SEQ ID NO: 6010 - protein, 8 aa, Artificial Sequence
  Peptide Derived from Human Papillomavirus
CALKRKFA

SEQ ID NO: 6011 - protein, 9 aa, Artificial Sequence
  Peptide Derived from Human Papillomavirus
CALKRKFAA

SEQ ID NO: 6012 - protein, 8 aa, Artificial Sequence
  Peptide Derived from Human Papillomavirus
CALYWFRT

SEQ ID NO: 6013 - protein, 9 aa, Artificial Sequence
  Peptide Derived from Human Papillomavirus
CALYWFRTA

SEQ ID NO: 6014 - protein, 10 aa, Artificial Sequence
  Peptide Derived from Human Papillomavirus
CALYWFRTAM

SEQ ID NO: 6015 - protein, 11 aa, Artificial Sequence
  Peptide Derived from Human Papillomavirus
CITGYGISPSV

SEQ ID NO: 6016 - protein, 8 aa, Artificial Sequence
  Peptide Derived from Human Papillomavirus
CLTCDRGI

SEQ ID NO: 6017 - protein, 9 aa, Artificial Sequence
  Peptide Derived from Human Papillomavirus
CLTCDRGII

SEQ ID NO: 6018 - protein, 10 aa, Artificial Sequence
  Peptide Derived from Human Papillomavirus
CLTCDRGIII

SEQ ID NO: 6019 - protein, 11 aa, Artificial Sequence
  Peptide Derived from Human Papillomavirus
CLTCDRGIIIL

SEQ ID NO: 6020 - protein, 8 aa, Artificial Sequence
  Peptide Derived from Human Papillomavirus
CMLICGPA

SEQ ID NO: 6021 - protein, 10 aa, Artificial Sequence
  Peptide Derived from Human Papillomavirus
CMLICGPANT

SEQ ID NO: 6022 - protein, 9 aa, Artificial Sequence
  Peptide Derived from Human Papillomavirus
CMVIEPPKL

SEQ ID NO: 6023 - protein, 11 aa, Artificial Sequence
  Peptide Derived from Human Papillomavirus
CTDWCITGYGI

SEQ ID NO: 6024 - protein, 9 aa, Artificial Sequence
  Peptide Derived from Human Papillomavirus
CTGWFEVEA

SEQ ID NO: 6025 - protein, 10 aa, Artificial Sequence
  Peptide Derived from Human Papillomavirus
CTGWFEVEAV

SEQ ID NO: 6026 - protein, 11 aa, Artificial Sequence
  Peptide Derived from Human Papillomavirus
CTGWFEVEAVI

SEQ ID NO: 6027 - protein, 8 aa, Artificial Sequence
  Peptide Derived from Human Papillomavirus
CTYRKRKI

SEQ ID NO: 6028 - protein, 11 aa, Artificial Sequence
  Peptide Derived from Human Papillomavirus
CTYRKRKIDEL

SEQ ID NO: 6029 - protein, 10 aa, Artificial Sequence
  Peptide Derived from Human Papillomavirus
CVNSKSHFWL

SEQ ID NO: 6030 - protein, 10 aa, Artificial Sequence
  Peptide Derived from Human Papillomavirus
DAKIGMIDDV

SEQ ID NO: 6031 - protein, 11 aa, Artificial Sequence
  Peptide Derived from Human Papillomavirus
DAKIGMIDDVT

SEQ ID NO: 6032 - protein, 9 aa, Artificial Sequence
  Peptide Derived from Human Papillomavirus
DIAYYYAQL

SEQ ID NO: 6033 - protein, 10 aa, Artificial Sequence
  Peptide Derived from Human Papillomavirus
DIAYYYAQLA

SEQ ID NO: 6034 - protein, 10 aa, Artificial Sequence
  Peptide Derived from Human Papillomavirus
DLLEFIDDSM

SEQ ID NO: 6035 - protein, 8 aa, Artificial Sequence
  Peptide Derived from Human Papillomavirus
DLNAVCAL

SEQ ID NO: 6036 - protein, 9 aa, Artificial Sequence
  Peptide Derived from Human Papillomavirus
DLSEMVQWA

SEQ ID NO: 6037 - protein, 8 aa, Artificial Sequence
  Peptide Derived from Human Papillomavirus
DTEAARAL

SEQ ID NO: 6038 - protein, 11 aa, Artificial Sequence
  Peptide Derived from Human Papillomavirus
DTEAARALFNI

SEQ ID NO: 6039 - protein, 8 aa, Artificial Sequence
  Peptide Derived from Human Papillomavirus
DVKHRALV

SEQ ID NO: 6040 - protein, 10 aa, Artificial Sequence
  Peptide Derived from Human Papillomavirus
DVKHRALVQL

SEQ ID NO: 6041 - protein, 10 aa, Artificial Sequence
  Peptide Derived from Human Papillomavirus
DVQGTTPEWI

SEQ ID NO: 6042 - protein, 8 aa, Artificial Sequence
  Peptide Derived from Human Papillomavirus
DVTPISWT

SEQ ID NO: 6043 - protein, 10 aa, Artificial Sequence
  Peptide Derived from Human Papillomavirus
DVTPISWTYI

SEQ ID NO: 6044 - protein, 9 aa, Artificial Sequence
  Peptide Derived from Human Papillomavirus
EAARALFNI

SEQ ID NO: 6045 - protein, 8 aa, Artificial Sequence
  Peptide Derived from Human Papillomavirus
EAVIERRT

SEQ ID NO: 6046 - protein, 8 aa, Artificial Sequence
  Peptide Derived from Human Papillomavirus
EAYGISFM

SEQ ID NO: 6047 - protein, 10 aa, Artificial Sequence
  Peptide Derived from Human Papillomavirus
EAYGISFMEL

SEQ ID NO: 6048 - protein, 11 aa, Artificial Sequence
  Peptide Derived from Human Papillomavirus
EAYGISFMELV

SEQ ID NO: 6049 - protein, 10 aa, Artificial Sequence
  Peptide Derived from Human Papillomavirus
EISIDVKHRA

SEQ ID NO: 6050 - protein, 11 aa, Artificial Sequence
  Peptide Derived from Human Papillomavirus
EISIDVKHRAL

SEQ ID NO: 6051 - protein, 11 aa, Artificial Sequence
  Peptide Derived from Human Papillomavirus
EISNVLHSSNT

SEQ ID NO: 6052 - protein, 10 aa, Artificial Sequence
  Peptide Derived from Human Papillomavirus
ELEDSGYGNT

SEQ ID NO: 6053 - protein, 8 aa, Artificial Sequence
  Peptide Derived from Human Papillomavirus
ELTDDSDI

SEQ ID NO: 6054 - protein, 9 aa, Artificial Sequence
  Peptide Derived from Human Papillomavirus
ELTDDSDIA

SEQ ID NO: 6055 - protein, 11 aa, Artificial Sequence
  Peptide Derived from Human Papillomavirus
ELVRPFKSDKT

SEQ ID NO: 6056 - protein, 11 aa, Artificial Sequence
  Peptide Derived from Human Papillomavirus
EMVQWAYDNEL

SEQ ID NO: 6057 - protein, 8 aa, Artificial Sequence
  Peptide Derived from Human Papillomavirus
ETADDSGT

SEQ ID NO: 6058 - protein, 10 aa, Artificial Sequence
  Peptide Derived from Human Papillomavirus
ETADDSGTDL

SEQ ID NO: 6059 - protein, 11 aa, Artificial Sequence
  Peptide Derived from Human Papillomavirus
ETADDSGTDLL

SEQ ID NO: 6060 - protein, 11 aa, Artificial Sequence
  Peptide Derived from Human Papillomavirus
ETCMVIEPPKL

SEQ ID NO: 6061 - protein, 10 aa, Artificial Sequence
  Peptide Derived from Human Papillomavirus
ETNVDSCENV

SEQ ID NO: 6062 - protein, 11 aa, Artificial Sequence
  Peptide Derived from Human Papillomavirus
ETNVDSCENVT

SEQ ID NO: 6063 - protein, 9 aa, Artificial Sequence
  Peptide Derived from Human Papillomavirus
ETQQMVQQV

SEQ ID NO: 6064 - protein, 10 aa, Artificial Sequence
  Peptide Derived from Human Papillomavirus
EVEAVIERRT

SEQ ID NO: 6065 - protein, 8 aa, Artificial Sequence
  Peptide Derived from Human Papillomavirus
EVETQQMV

SEQ ID NO: 6066 - protein, 11 aa, Artificial Sequence
  Peptide Derived from Human Papillomavirus
EVETQQMVQQV

SEQ ID NO: 6067 - protein, 8 aa, Artificial Sequence
  Peptide Derived from Human Papillomavirus
EVSCETNV

SEQ ID NO: 6068 - protein, 8 aa, Artificial Sequence
  Peptide Derived from Human Papillomavirus
FAACSQSA

SEQ ID NO: 6069 - protein, 9 aa, Artificial Sequence
  Peptide Derived from Human Papillomavirus
FAACSQSAA

SEQ ID NO: 6070 - protein, 10 aa, Artificial Sequence
  Peptide Derived from Human Papillomavirus
FIDDSMENSI

SEQ ID NO: 6071 - protein, 9 aa, Artificial Sequence
  Peptide Derived from Human Papillomavirus
FLGAFKKFL

SEQ ID NO: 6072 - protein, 10 aa, Artificial Sequence
  Peptide Derived from Human Papillomavirus
FLKGCVISCV

SEQ ID NO: 6073 - protein, 11 aa, Artificial Sequence
  Peptide Derived from Human Papillomavirus
FLKGIPKKSCM

SEQ ID NO: 6074 - protein, 8 aa, Artificial Sequence
  Peptide Derived from Human Papillomavirus
FLKSNSQA

SEQ ID NO: 6075 - protein, 10 aa, Artificial Sequence
  Peptide Derived from Human Papillomavirus
FLKSNSQAKI

SEQ ID NO: 6076 - protein, 11 aa, Artificial Sequence
  Peptide Derived from Human Papillomavirus
FLKSNSQAKIV

SEQ ID NO: 6077 - protein, 10 aa, Artificial Sequence
  Peptide Derived from Human Papillomavirus
GAFKKFLKGI

SEQ ID NO: 6078 - protein, 8 aa, Artificial Sequence
  Peptide Derived from Human Papillomavirus
GIIILLLI

SEQ ID NO: 6079 - protein, 10 aa, Artificial Sequence
  Peptide Derived from Human Papillomavirus
GIMCRHYKKA

SEQ ID NO: 6080 - protein, 8 aa, Artificial Sequence
  Peptide Derived from Human Papillomavirus
GIPKKSCM

SEQ ID NO: 6081 - protein, 9 aa, Artificial Sequence
  Peptide Derived from Human Papillomavirus
GIPKKSCML

SEQ ID NO: 6082 - protein, 10 aa, Artificial Sequence
  Peptide Derived from Human Papillomavirus
GIPKKSCMLI

SEQ ID NO: 6083 - protein, 8 aa, Artificial Sequence
  Peptide Derived from Human Papillomavirus
GISFMELV

SEQ ID NO: 6084 - protein, 10 aa, Artificial Sequence
  Peptide Derived from Human Papillomavirus
GISPSVAESL

SEQ ID NO: 6085 - protein, 10 aa, Artificial Sequence
  Peptide Derived from Human Papillomavirus
GMGCTGWFEV

SEQ ID NO: 6086 - protein, 9 aa, Artificial Sequence
  Peptide Derived from Human Papillomavirus
GMIDDVTPI

SEQ ID NO: 6087 - protein, 8 aa, Artificial Sequence
  Peptide Derived from Human Papillomavirus
GMSLIQFL

SEQ ID NO: 6088 - protein, 11 aa, Artificial Sequence
  Peptide Derived from Human Papillomavirus
GQWIQSRCEKT

SEQ ID NO: 6089 - protein, 8 aa, Artificial Sequence
  Peptide Derived from Human Papillomavirus
GTDLLEFI

SEQ ID NO: 6090 - protein, 9 aa, Artificial Sequence
  Peptide Derived from Human Papillomavirus
GTDSRWPYL

SEQ ID NO: 6091 - protein, 10 aa, Artificial Sequence
  Peptide Derived from Human Papillomavirus
GTNGAGMGCT

SEQ ID NO: 6092 - protein, 10 aa, Artificial Sequence
  Peptide Derived from Human Papillomavirus
GTTPEWIDRL

SEQ ID NO: 6093 - protein, 11 aa, Artificial Sequence
  Peptide Derived from Human Papillomavirus
GTTPEWIDRLT

SEQ ID NO: 6094 - protein, 8 aa, Artificial Sequence
  Peptide Derived from Human Papillomavirus
GVGDDSEV

SEQ ID NO: 6095 - protein, 11 aa, Artificial Sequence
  Peptide Derived from Human Papillomavirus
HLQCLTCDRGI

SEQ ID NO: 6096 - protein, 8 aa, Artificial Sequence
  Peptide Derived from Human Papillomavirus
IAYYYAQL

SEQ ID NO: 6097 - protein, 9 aa, Artificial Sequence
  Peptide Derived from Human Papillomavirus
IAYYYAQLA

SEQ ID NO: 6098 - protein, 8 aa, Artificial Sequence
  Peptide Derived from Human Papillomavirus
ILYKFKEA

SEQ ID NO: 6099 - protein, 11 aa, Artificial Sequence
  Peptide Derived from Human Papillomavirus
ILYKFKEAYGI

SEQ ID NO: 6100 - protein, 9 aa, Artificial Sequence
  Peptide Derived from Human Papillomavirus
IMCRHYKKA

SEQ ID NO: 6101 - protein, 8 aa, Artificial Sequence
  Peptide Derived from Human Papillomavirus
IQADTEAA

SEQ ID NO: 6102 - protein, 10 aa, Artificial Sequence
  Peptide Derived from Human Papillomavirus
IQADTEAARA

SEQ ID NO: 6103 - protein, 11 aa, Artificial Sequence
  Peptide Derived from Human Papillomavirus
IQADTEAARAL

SEQ ID NO: 6104 - protein, 8 aa, Artificial Sequence
  Peptide Derived from Human Papillomavirus
IQEGEDDL

SEQ ID NO: 6105 - protein, 10 aa, Artificial Sequence
  Peptide Derived from Human Papillomavirus
IQEGEDDLNA

SEQ ID NO: 6106 - protein, 11 aa, Artificial Sequence
  Peptide Derived from Human Papillomavirus
IQEGEDDLNAV

SEQ ID NO: 6107 - protein, 8 aa, Artificial Sequence
  Peptide Derived from Human Papillomavirus
IQFLKGCV

SEQ ID NO: 6108 - protein, 9 aa, Artificial Sequence
  Peptide Derived from Human Papillomavirus
IQFLKGCVI

SEQ ID NO: 6109 - protein, 8 aa, Artificial Sequence
  Peptide Derived from Human Papillomavirus
IQSRCEKT

SEQ ID NO: 6110 - protein, 10 aa, Artificial Sequence
  Peptide Derived from Human Papillomavirus
ITGYGISPSV

SEQ ID NO: 6111 - protein, 11 aa, Artificial Sequence
  Peptide Derived from Human Papillomavirus
ITGYGISPSVA

SEQ ID NO: 6112 - protein, 8 aa, Artificial Sequence
  Peptide Derived from Human Papillomavirus
IVKDCGIM

SEQ ID NO: 6113 - protein, 10 aa, Artificial Sequence
  Peptide Derived from Human Papillomavirus
IVQLLRYQNI

SEQ ID NO: 6114 - protein, 9 aa, Artificial Sequence
  Peptide Derived from Human Papillomavirus
KAEKRKMSI

SEQ ID NO: 6115 - protein, 11 aa, Artificial Sequence
  Peptide Derived from Human Papillomavirus
KANILYKFKEA

SEQ ID NO: 6116 - protein, 8 aa, Artificial Sequence
  Peptide Derived from Human Papillomavirus
KIGMIDDV

SEQ ID NO: 6117 - protein, 9 aa, Artificial Sequence
  Peptide Derived from Human Papillomavirus
KIGMIDDVT

SEQ ID NO: 6118 - protein, 11 aa, Artificial Sequence
  Peptide Derived from Human Papillomavirus
KIGMIDDVTPI

SEQ ID NO: 6119 - protein, 8 aa, Artificial Sequence
  Peptide Derived from Human Papillomavirus
KIVKDCGI

SEQ ID NO: 6120 - protein, 9 aa, Artificial Sequence
  Peptide Derived from Human Papillomavirus
KIVKDCGIM

SEQ ID NO: 6121 - protein, 9 aa, Artificial Sequence
  Peptide Derived from Human Papillomavirus
KLMSNLLSI

SEQ ID NO: 6122 - protein, 8 aa, Artificial Sequence
  Peptide Derived from Human Papillomavirus
KLRSQTCA

SEQ ID NO: 6123 - protein, 9 aa, Artificial Sequence
  Peptide Derived from Human Papillomavirus
KLRSQTCAL

SEQ ID NO: 6124 - protein, 8 aa, Artificial Sequence
  Peptide Derived from Human Papillomavirus
KMSIGQWI

SEQ ID NO: 6125 - protein, 9 aa, Artificial Sequence
  Peptide Derived from Human Papillomavirus
KQHSLYTHL

SEQ ID NO: 6126 - protein, 11 aa, Artificial Sequence
  Peptide Derived from Human Papillomavirus
KTNDGGNWRPI

SEQ ID NO: 6127 - protein, 9 aa, Artificial Sequence
  Peptide Derived from Human Papillomavirus
KTSCTDWCI

SEQ ID NO: 6128 - protein, 10 aa, Artificial Sequence
  Peptide Derived from Human Papillomavirus
KTSCTDWCIT

SEQ ID NO: 6129 - protein, 9 aa, Artificial Sequence
  Peptide Derived from Human Papillomavirus
KVLIKQHSL

SEQ ID NO: 6130 - protein, 11 aa, Artificial Sequence
  Peptide Derived from Human Papillomavirus
KVLIKQHSLYT

SEQ ID NO: 6131 - protein, 8 aa, Artificial Sequence
  Peptide Derived from Human Papillomavirus
LADSNSNA

SEQ ID NO: 6132 - protein, 9 aa, Artificial Sequence
  Peptide Derived from Human Papillomavirus
LADSNSNAA

SEQ ID NO: 6133 - protein, 10 aa, Artificial Sequence
  Peptide Derived from Human Papillomavirus
LADSNSNAAA

SEQ ID NO: 6134 - protein, 8 aa, Artificial Sequence
  Peptide Derived from Human Papillomavirus
LICGPANT

SEQ ID NO: 6135 - protein, 9 aa, Artificial Sequence
  Peptide Derived from Human Papillomavirus
LIKQHSLYT

SEQ ID NO: 6136 - protein, 11 aa, Artificial Sequence
  Peptide Derived from Human Papillomavirus
LIKQHSLYTHL

SEQ ID NO: 6137 - protein, 9 aa, Artificial Sequence
  Peptide Derived from Human Papillomavirus
LIQFLKGCV

SEQ ID NO: 6138 - protein, 10 aa, Artificial Sequence
  Peptide Derived from Human Papillomavirus
LIQFLKGCVI

SEQ ID NO: 6139 - protein, 11 aa, Artificial Sequence
  Peptide Derived from Human Papillomavirus
LIRFRCSKNRL

SEQ ID NO: 6140 - protein, 9 aa, Artificial Sequence
  Peptide Derived from Human Papillomavirus
LLEFIDDSM

SEQ ID NO: 6141 - protein, 9 aa, Artificial Sequence
  Peptide Derived from Human Papillomavirus
LLLTSNTNA

SEQ ID NO: 6142 - protein, 11 aa, Artificial Sequence
  Peptide Derived from Human Papillomavirus
LLLTSNTNAGT

SEQ ID NO: 6143 - protein, 10 aa, Artificial Sequence
  Peptide Derived from Human Papillomavirus
LLRYQNIEFT

SEQ ID NO: 6144 - protein, 11 aa, Artificial Sequence
  Peptide Derived from Human Papillomavirus
LLRYQNIEFTA

SEQ ID NO: 6145 - protein, 9 aa, Artificial Sequence
  Peptide Derived from Human Papillomavirus
LLSIPETCM

SEQ ID NO: 6146 - protein, 10 aa, Artificial Sequence
  Peptide Derived from Human Papillomavirus
LLSIPETCMV

SEQ ID NO: 6147 - protein, 11 aa, Artificial Sequence
  Peptide Derived from Human Papillomavirus
LLSIPETCMVI

SEQ ID NO: 6148 - protein, 8 aa, Artificial Sequence
  Peptide Derived from Human Papillomavirus
LLTSNTNA

SEQ ID NO: 6149 - protein, 10 aa, Artificial Sequence
  Peptide Derived from Human Papillomavirus
LLTSNTNAGT

SEQ ID NO: 6150 - protein, 8 aa, Artificial Sequence
  Peptide Derived from Human Papillomavirus
LMSNLLSI

SEQ ID NO: 6151 - protein, 11 aa, Artificial Sequence
  Peptide Derived from Human Papillomavirus
LMSNLLSIPET

SEQ ID NO: 6152 - protein, 10 aa, Artificial Sequence
  Peptide Derived from Human Papillomavirus
LQCLTCDRGI

SEQ ID NO: 6153 - protein, 11 aa, Artificial Sequence
  Peptide Derived from Human Papillomavirus
LQCLTCDRGII

SEQ ID NO: 6154 - protein, 8 aa, Artificial Sequence
  Peptide Derived from Human Papillomavirus
LQEISNVL

SEQ ID NO: 6155 - protein, 9 aa, Artificial Sequence
  Peptide Derived from Human Papillomavirus
LQHSFNDNI

SEQ ID NO: 6156 - protein, 9 aa, Artificial Sequence
  Peptide Derived from Human Papillomavirus
LQPLSDAKI

SEQ ID NO: 6157 - protein, 11 aa, Artificial Sequence
  Peptide Derived from Human Papillomavirus
LQPLSDAKIGM

SEQ ID NO: 6158 - protein, 8 aa, Artificial Sequence
  Peptide Derived from Human Papillomavirus
LTCDRGII

SEQ ID NO: 6159 - protein, 9 aa, Artificial Sequence
  Peptide Derived from Human Papillomavirus
LTCDRGIII

SEQ ID NO: 6160 - protein, 10 aa, Artificial Sequence
  Peptide Derived from Human Papillomavirus
LTCDRGIIIL

SEQ ID NO: 6161 - protein, 11 aa, Artificial Sequence
  Peptide Derived from Human Papillomavirus
LTCDRGIIILL

SEQ ID NO: 6162 - protein, 8 aa, Artificial Sequence
  Peptide Derived from Human Papillomavirus
LTDDSDIA

SEQ ID NO: 6163 - protein, 9 aa, Artificial Sequence
  Peptide Derived from Human Papillomavirus
LTSNTNAGT

SEQ ID NO: 6164 - protein, 10 aa, Artificial Sequence
  Peptide Derived from Human Papillomavirus
LTVAKLMSNL

SEQ ID NO: 6165 - protein, 11 aa, Artificial Sequence
  Peptide Derived from Human Papillomavirus
LTVAKLMSNLL

SEQ ID NO: 6166 - protein, 9 aa, Artificial Sequence
  Peptide Derived from Human Papillomavirus
LVQLKCPPL

SEQ ID NO: 6167 - protein, 10 aa, Artificial Sequence
  Peptide Derived from Human Papillomavirus
LVQLKCPPLL

SEQ ID NO: 6168 - protein, 11 aa, Artificial Sequence
  Peptide Derived from Human Papillomavirus
LVQLKCPPLLL

SEQ ID NO: 6169 - protein, 10 aa, Artificial Sequence
  Peptide Derived from Human Papillomavirus
LVRPFKSDKT

SEQ ID NO: 6170 - protein, 10 aa, Artificial Sequence
  Peptide Derived from Human Papillomavirus
MADPEGTNGA

SEQ ID NO: 6171 - protein, 8 aa, Artificial Sequence
  Peptide Derived from Human Papillomavirus
MIDDVTPI

SEQ ID NO: 6172 - protein, 11 aa, Artificial Sequence
  Peptide Derived from Human Papillomavirus
MIDDVTPISWT

SEQ ID NO: 6173 - protein, 9 aa, Artificial Sequence
  Peptide Derived from Human Papillomavirus
MLICGPANT

SEQ ID NO: 6174 - protein, 8 aa, Artificial Sequence
  Peptide Derived from Human Papillomavirus
MVIEPPKL

SEQ ID NO: 6175 - protein, 10 aa, Artificial Sequence
  Peptide Derived from Human Papillomavirus
MVQWAYDNEL

SEQ ID NO: 6176 - protein, 11 aa, Artificial Sequence
  Peptide Derived from Human Papillomavirus
MVQWAYDNELT

SEQ ID NO: 6177 - protein, 11 aa, Artificial Sequence
  Peptide Derived from Human Papillomavirus
NAGTDSRWPYL

SEQ ID NO: 6178 - protein, 8 aa, Artificial Sequence
  Peptide Derived from Human Papillomavirus
NALDGNEI

SEQ ID NO: 6179 - protein, 10 aa, Artificial Sequence
  Peptide Derived from Human Papillomavirus
NALDGNEISI

SEQ ID NO: 6180 - protein, 11 aa, Artificial Sequence
  Peptide Derived from Human Papillomavirus
NAVCALKRKFA

SEQ ID NO: 6181 - protein, 8 aa, Artificial Sequence
  Peptide Derived from Human Papillomavirus
NIEFTAFL

SEQ ID NO: 6182 - protein, 10 aa, Artificial Sequence
  Peptide Derived from Human Papillomavirus
NIEFTAFLGA

SEQ ID NO: 6183 - protein, 8 aa, Artificial Sequence
  Peptide Derived from Human Papillomavirus
NIFDLSEM

SEQ ID NO: 6184 - protein, 9 aa, Artificial Sequence
  Peptide Derived from Human Papillomavirus
NIFDLSEMV

SEQ ID NO: 6185 - protein, 9 aa, Artificial Sequence
  Peptide Derived from Human Papillomavirus
NILYKFKEA

SEQ ID NO: 6186 - protein, 9 aa, Artificial Sequence
  Peptide Derived from Human Papillomavirus
NIQEGEDDL

SEQ ID NO: 6187 - protein, 11 aa, Artificial Sequence
  Peptide Derived from Human Papillomavirus
NIQEGEDDLNA

SEQ ID NO: 6188 - protein, 8 aa, Artificial Sequence
  Peptide Derived from Human Papillomavirus
NISDVQGT

SEQ ID NO: 6189 - protein, 9 aa, Artificial Sequence
  Peptide Derived from Human Papillomavirus
NISDVQGTT

SEQ ID NO: 6190 - protein, 9 aa, Artificial Sequence
  Peptide Derived from Human Papillomavirus
NISEDEDET

SEQ ID NO: 6191 - protein, 10 aa, Artificial Sequence
  Peptide Derived from Human Papillomavirus
NISEDEDETA

SEQ ID NO: 6192 - protein, 9 aa, Artificial Sequence
  Peptide Derived from Human Papillomavirus
NISTFKCSA

SEQ ID NO: 6193 - protein, 8 aa, Artificial Sequence
  Peptide Derived from Human Papillomavirus
NLLSIPET

SEQ ID NO: 6194 - protein, 10 aa, Artificial Sequence
  Peptide Derived from Human Papillomavirus
NLLSIPETCM

SEQ ID NO: 6195 - protein, 11 aa, Artificial Sequence
  Peptide Derived from Human Papillomavirus
NLLSIPETCMV

SEQ ID NO: 6196 - protein, 10 aa, Artificial Sequence
  Peptide Derived from Human Papillomavirus
NLNDLESSGV

SEQ ID NO: 6197 - protein, 9 aa, Artificial Sequence
  Peptide Derived from Human Papillomavirus
NTEVETQQM

SEQ ID NO: 6198 - protein, 10 aa, Artificial Sequence
  Peptide Derived from Human Papillomavirus
NTEVETQQMV

SEQ ID NO: 6199 - protein, 9 aa, Artificial Sequence
  Peptide Derived from Human Papillomavirus
NTGKSYFGM

SEQ ID NO: 6200 - protein, 11 aa, Artificial Sequence
  Peptide Derived from Human Papillomavirus
NTGKSYFGMSL

SEQ ID NO: 6201 - protein, 8 aa, Artificial Sequence
  Peptide Derived from Human Papillomavirus
NVDSCENV

SEQ ID NO: 6202 - protein, 9 aa, Artificial Sequence
  Peptide Derived from Human Papillomavirus
NVDSCENVT

SEQ ID NO: 6203 - protein, 10 aa, Artificial Sequence
  Peptide Derived from Human Papillomavirus
NVDSCENVTL

SEQ ID NO: 6204 - protein, 8 aa, Artificial Sequence
  Peptide Derived from Human Papillomavirus
NVLHSSNT

SEQ ID NO: 6205 - protein, 10 aa, Artificial Sequence
  Peptide Derived from Human Papillomavirus
NVLHSSNTKA

SEQ ID NO: 6206 - protein, 10 aa, Artificial Sequence
  Peptide Derived from Human Papillomavirus
NVTLQEISNV

SEQ ID NO: 6207 - protein, 11 aa, Artificial Sequence
  Peptide Derived from Human Papillomavirus
NVTLQEISNVL

SEQ ID NO: 6208 - protein, 11 aa, Artificial Sequence
  Peptide Derived from Human Papillomavirus
PANTGKSYFGM

SEQ ID NO: 6209 - protein, 11 aa, Artificial Sequence
  Peptide Derived from Human Papillomavirus
PISWTYIDDYM

SEQ ID NO: 6210 - protein, 11 aa, Artificial Sequence
  Peptide Derived from Human Papillomavirus
PIVQLLRYQNI

SEQ ID NO: 6211 - protein, 8 aa, Artificial Sequence
  Peptide Derived from Human Papillomavirus
PLLLTSNT

SEQ ID NO: 6212 - protein, 10 aa, Artificial Sequence
  Peptide Derived from Human Papillomavirus
PLLLTSNTNA

SEQ ID NO: 6213 - protein, 9 aa, Artificial Sequence
  Peptide Derived from Human Papillomavirus
PLSDAKIGM

SEQ ID NO: 6214 - protein, 10 aa, Artificial Sequence
  Peptide Derived from Human Papillomavirus
PLSDAKIGMI

SEQ ID NO: 6215 - protein, 9 aa, Artificial Sequence
  Peptide Derived from Human Papillomavirus
QADTEAARA

SEQ ID NO: 6216 - protein, 10 aa, Artificial Sequence
  Peptide Derived from Human Papillomavirus
QADTEAARAL

SEQ ID NO: 6217 - protein, 10 aa, Artificial Sequence
  Peptide Derived from Human Papillomavirus
QAKIVKDCGI

SEQ ID NO: 6218 - protein, 11 aa, Artificial Sequence
  Peptide Derived from Human Papillomavirus
QAKIVKDCGIM

SEQ ID NO: 6219 - protein, 9 aa, Artificial Sequence
  Peptide Derived from Human Papillomavirus
QLADSNSNA

SEQ ID NO: 6220 - protein, 10 aa, Artificial Sequence
  Peptide Derived from Human Papillomavirus
QLADSNSNAA

SEQ ID NO: 6221 - protein, 11 aa, Artificial Sequence
  Peptide Derived from Human Papillomavirus
QLADSNSNAAA

SEQ ID NO: 6222 - protein, 8 aa, Artificial Sequence
  Peptide Derived from Human Papillomavirus
QLKCPPLL

SEQ ID NO: 6223 - protein, 9 aa, Artificial Sequence
  Peptide Derived from Human Papillomavirus
QLKCPPLLL

SEQ ID NO: 6224 - protein, 10 aa, Artificial Sequence
  Peptide Derived from Human Papillomavirus
QLKCPPLLLT

SEQ ID NO: 6225 - protein, 8 aa, Artificial Sequence
  Peptide Derived from Human Papillomavirus
QLLRYQNI

SEQ ID NO: 6226 - protein, 11 aa, Artificial Sequence
  Peptide Derived from Human Papillomavirus
QLLRYQNIEFT

SEQ ID NO: 6227 - protein, 10 aa, Artificial Sequence
  Peptide Derived from Human Papillomavirus
QQVESQNGDT

SEQ ID NO: 6228 - protein, 10 aa, Artificial Sequence
  Peptide Derived from Human Papillomavirus
QTCALYWFRT

SEQ ID NO: 6229 - protein, 11 aa, Artificial Sequence
  Peptide Derived from Human Papillomavirus
QTCALYWFRTA

SEQ ID NO: 6230 - protein, 9 aa, Artificial Sequence
  Peptide Derived from Human Papillomavirus
QVESQNGDT

SEQ ID NO: 6231 - protein, 11 aa, Artificial Sequence
  Peptide Derived from Human Papillomavirus
QVESQNGDTNL

SEQ ID NO: 6232 - protein, 8 aa, Artificial Sequence
  Peptide Derived from Human Papillomavirus
RAANPCRT

SEQ ID NO: 6233 - protein, 10 aa, Artificial Sequence
  Peptide Derived from Human Papillomavirus
RAANPCRTSI

SEQ ID NO: 6234 - protein, 11 aa, Artificial Sequence
  Peptide Derived from Human Papillomavirus
RALVQLKCPPL

SEQ ID NO: 6235 - protein, 8 aa, Artificial Sequence
  Peptide Derived from Human Papillomavirus
RLTVAKLM

SEQ ID NO: 6236 - protein, 11 aa, Artificial Sequence
  Peptide Derived from Human Papillomavirus
RLTVAKLMSNL

SEQ ID NO: 6237 - protein, 10 aa, Artificial Sequence
  Peptide Derived from Human Papillomavirus
RTAMSNISDV

SEQ ID NO: 6238 - protein, 11 aa, Artificial Sequence
  Peptide Derived from Human Papillomavirus
RTSINKNKECT

SEQ ID NO: 6239 - protein, 8 aa, Artificial Sequence
  Peptide Derived from Human Papillomavirus
RTWCKLDL

SEQ ID NO: 6240 - protein, 9 aa, Artificial Sequence
  Peptide Derived from Human Papillomavirus
RTWCKLDLI

SEQ ID NO: 6241 - protein, 10 aa, Artificial Sequence
  Peptide Derived from Human Papillomavirus
SAAEDVVDRA

SEQ ID NO: 6242 - protein, 11 aa, Artificial Sequence
  Peptide Derived from Human Papillomavirus
SAAEDVVDRAA

SEQ ID NO: 6243 - protein, 9 aa, Artificial Sequence
  Peptide Derived from Human Papillomavirus
SAGENTRSL

SEQ ID NO: 6244 - protein, 8 aa, Artificial Sequence
  Peptide Derived from Human Papillomavirus
SIDVKHRA

SEQ ID NO: 6245 - protein, 9 aa, Artificial Sequence
  Peptide Derived from Human Papillomavirus
SIDVKHRAL

SEQ ID NO: 6246 - protein, 10 aa, Artificial Sequence
  Peptide Derived from Human Papillomavirus
SIDVKHRALV

SEQ ID NO: 6247 - protein, 9 aa, Artificial Sequence
  Peptide Derived from Human Papillomavirus
SINKNKECT

SEQ ID NO: 6248 - protein, 8 aa, Artificial Sequence
  Peptide Derived from Human Papillomavirus
SIPETCMV

SEQ ID NO: 6249 - protein, 9 aa, Artificial Sequence
  Peptide Derived from Human Papillomavirus
SIPETCMVI

SEQ ID NO: 6250 - protein, 8 aa, Artificial Sequence
  Peptide Derived from Human Papillomavirus
SIQADTEA

SEQ ID NO: 6251 - protein, 9 aa, Artificial Sequence
  Peptide Derived from Human Papillomavirus
SIQADTEAA

SEQ ID NO: 6252 - protein, 11 aa, Artificial Sequence
  Peptide Derived from Human Papillomavirus
SIQADTEAARA

SEQ ID NO: 6253 - protein, 10 aa, Artificial Sequence
  Peptide Derived from Human Papillomavirus
SLIQFLKGCV

SEQ ID NO: 6254 - protein, 11 aa, Artificial Sequence
  Peptide Derived from Human Papillomavirus
SLIQFLKGCVI

SEQ ID NO: 6255 - protein, 11 aa, Artificial Sequence
  Peptide Derived from Human Papillomavirus
SLKVLIKQHSL

SEQ ID NO: 6256 - protein, 9 aa, Artificial Sequence
  Peptide Derived from Human Papillomavirus
SLYTHLQCL

SEQ ID NO: 6257 - protein, 10 aa, Artificial Sequence
  Peptide Derived from Human Papillomavirus
SLYTHLQCLT

SEQ ID NO: 6258 - protein, 8 aa, Artificial Sequence
  Peptide Derived from Human Papillomavirus
SMENSIQA

SEQ ID NO: 6259 - protein, 10 aa, Artificial Sequence
  Peptide Derived from Human Papillomavirus
SMENSIQADT

SEQ ID NO: 6260 - protein, 11 aa, Artificial Sequence
  Peptide Derived from Human Papillomavirus
SQAKIVKDCGI

SEQ ID NO: 6261 - protein, 8 aa, Artificial Sequence
  Peptide Derived from Human Papillomavirus
SQNGDTNL

SEQ ID NO: 6262 - protein, 11 aa, Artificial Sequence
  Peptide Derived from Human Papillomavirus
SQNGDTNLNDL

SEQ ID NO: 6263 - protein, 8 aa, Artificial Sequence
  Peptide Derived from Human Papillomavirus
SQSAAEDV

SEQ ID NO: 6264 - protein, 9 aa, Artificial Sequence
  Peptide Derived from Human Papillomavirus
SQSAAEDVV

SEQ ID NO: 6265 - protein, 11 aa, Artificial Sequence
  Peptide Derived from Human Papillomavirus
SQTCALYWFRT

SEQ ID NO: 6266 - protein, 11 aa, Artificial Sequence
  Peptide Derived from Human Papillomavirus
STFKCSAGENT

SEQ ID NO: 6267 - protein, 8 aa, Artificial Sequence
  Peptide Derived from Human Papillomavirus
SVAESLKV

SEQ ID NO: 6268 - protein, 9 aa, Artificial Sequence
  Peptide Derived from Human Papillomavirus
SVAESLKVL

SEQ ID NO: 6269 - protein, 10 aa, Artificial Sequence
  Peptide Derived from Human Papillomavirus
SVAESLKVLI

SEQ ID NO: 6270 - protein, 9 aa, Artificial Sequence
  Peptide Derived from Human Papillomavirus
TADDSGTDL

SEQ ID NO: 6271 - protein, 10 aa, Artificial Sequence
  Peptide Derived from Human Papillomavirus
TADDSGTDLL

SEQ ID NO: 6272 - protein, 11 aa, Artificial Sequence
  Peptide Derived from Human Papillomavirus
TAFLGAFKKFL

SEQ ID NO: 6273 - protein, 9 aa, Artificial Sequence
  Peptide Derived from Human Papillomavirus
TAMSNISDV

SEQ ID NO: 6274 - protein, 8 aa, Artificial Sequence
  Peptide Derived from Human Papillomavirus
TLQEISNV

SEQ ID NO: 6275 - protein, 9 aa, Artificial Sequence
  Peptide Derived from Human Papillomavirus
TLQEISNVL

SEQ ID NO: 6276 - protein, 8 aa, Artificial Sequence
  Peptide Derived from Human Papillomavirus
TQQMVQQV

SEQ ID NO: 6277 - protein, 9 aa, Artificial Sequence
  Peptide Derived from Human Papillomavirus
TTPEWIDRL

SEQ ID NO: 6278 - protein, 10 aa, Artificial Sequence
  Peptide Derived from Human Papillomavirus
TTPEWIDRLT

SEQ ID NO: 6279 - protein, 11 aa, Artificial Sequence
  Peptide Derived from Human Papillomavirus
TTPEWIDRLTV

SEQ ID NO: 6280 - protein, 9 aa, Artificial Sequence
  Peptide Derived from Human Papillomavirus
TVAKLMSNL

SEQ ID NO: 6281 - protein, 10 aa, Artificial Sequence
  Peptide Derived from Human Papillomavirus
TVAKLMSNLL

SEQ ID NO: 6282 - protein, 11 aa, Artificial Sequence
  Peptide Derived from Human Papillomavirus
TVLQHSFNDNI

SEQ ID NO: 6283 - protein, 8 aa, Artificial Sequence
  Peptide Derived from Human Papillomavirus
VAESLKVL

SEQ ID NO: 6284 - protein, 9 aa, Artificial Sequence
  Peptide Derived from Human Papillomavirus
VAESLKVLI

SEQ ID NO: 6285 - protein, 8 aa, Artificial Sequence
  Peptide Derived from Human Papillomavirus
VAKLMSNL

SEQ ID NO: 6286 - protein, 9 aa, Artificial Sequence
  Peptide Derived from Human Papillomavirus
VAKLMSNLL

SEQ ID NO: 6287 - protein, 11 aa, Artificial Sequence
  Peptide Derived from Human Papillomavirus
VAKLMSNLLSI

SEQ ID NO: 6288 - protein, 11 aa, Artificial Sequence
  Peptide Derived from Human Papillomavirus
VIEPPKLRSQT

SEQ ID NO: 6289 - protein, 10 aa, Artificial Sequence
  Peptide Derived from Human Papillomavirus
VIERRTGDNI

SEQ ID NO: 6290 - protein, 9 aa, Artificial Sequence
  Peptide Derived from Human Papillomavirus
VLHSSNTKA

SEQ ID NO: 6291 - protein, 11 aa, Artificial Sequence
  Peptide Derived from Human Papillomavirus
VLHSSNTKANI

SEQ ID NO: 6292 - protein, 8 aa, Artificial Sequence
  Peptide Derived from Human Papillomavirus
VLIKQHSL

SEQ ID NO: 6293 - protein, 10 aa, Artificial Sequence
  Peptide Derived from Human Papillomavirus
VLIKQHSLYT

SEQ ID NO: 6294 - protein, 10 aa, Artificial Sequence
  Peptide Derived from Human Papillomavirus
VLQHSFNDNI

SEQ ID NO: 6295 - protein, 9 aa, Artificial Sequence
  Peptide Derived from Human Papillomavirus
VQGTTPEWI

SEQ ID NO: 6296 - protein, 8 aa, Artificial Sequence
  Peptide Derived from Human Papillomavirus
VQLKCPPL

SEQ ID NO: 6297 - protein, 9 aa, Artificial Sequence
  Peptide Derived from Human Papillomavirus
VQLKCPPLL

SEQ ID NO: 6298 - protein, 10 aa, Artificial Sequence
  Peptide Derived from Human Papillomavirus
VQLKCPPLLL

SEQ ID NO: 6299 - protein, 11 aa, Artificial Sequence
  Peptide Derived from Human Papillomavirus
VQLKCPPLLLT

SEQ ID NO: 6300 - protein, 9 aa, Artificial Sequence
  Peptide Derived from Human Papillomavirus
VQLLRYQNI

SEQ ID NO: 6301 - protein, 11 aa, Artificial Sequence
  Peptide Derived from Human Papillomavirus
VQQVESQNGDT

SEQ ID NO: 6302 - protein, 9 aa, Artificial Sequence
  Peptide Derived from Human Papillomavirus
VQWAYDNEL

SEQ ID NO: 6303 - protein, 10 aa, Artificial Sequence
  Peptide Derived from Human Papillomavirus
VQWAYDNELT

SEQ ID NO: 6304 - protein, 9 aa, Artificial Sequence
  Peptide Derived from Human Papillomavirus
VTLQEISNV

SEQ ID NO: 6305 - protein, 10 aa, Artificial Sequence
  Peptide Derived from Human Papillomavirus
VTLQEISNVL

SEQ ID NO: 6306 - protein, 9 aa, Artificial Sequence
  Peptide Derived from Human Papillomavirus
VTPISWTYI

SEQ ID NO: 6307 - protein, 11 aa, Artificial Sequence
  Peptide Derived from Human Papillomavirus
VVDRAANPCRT

SEQ ID NO: 6308 - protein, 8 aa, Artificial Sequence
  Peptide Derived from Human Papillomavirus
WAYDNELT

SEQ ID NO: 6309 - protein, 8 aa, Artificial Sequence
  Peptide Derived from Human Papillomavirus
WIDRLTVL

SEQ ID NO: 6310 - protein, 9 aa, Artificial Sequence
  Peptide Derived from Human Papillomavirus
WIQSRCEKT

SEQ ID NO: 6311 - protein, 8 aa, Artificial Sequence
  Peptide Derived from Human Papillomavirus
WLQPLSDA

SEQ ID NO: 6312 - protein, 10 aa, Artificial Sequence
  Peptide Derived from Human Papillomavirus
WLQPLSDAKI

SEQ ID NO: 6313 - protein, 8 aa, Artificial Sequence
  Peptide Derived from Human Papillomavirus
WTYIDDYM

SEQ ID NO: 6314 - protein, 11 aa, Artificial Sequence
  Peptide Derived from Human Papillomavirus
WTYIDDYMRNA

SEQ ID NO: 6315 - protein, 11 aa, Artificial Sequence
  Peptide Derived from Human Papillomavirus
YAQLADSNSNA

SEQ ID NO: 6316 - protein, 9 aa, Artificial Sequence
  Peptide Derived from Human Papillomavirus
YIDDYMRNA

SEQ ID NO: 6317 - protein, 10 aa, Artificial Sequence
  Peptide Derived from Human Papillomavirus
YIDDYMRNAL

SEQ ID NO: 6318 - protein, 8 aa, Artificial Sequence
  Peptide Derived from Human Papillomavirus
YLHSRLTV

SEQ ID NO: 6319 - protein, 11 aa, Artificial Sequence
  Peptide Derived from Human Papillomavirus
YMRNALDGNEI

SEQ ID NO: 6320 - protein, 8 aa, Artificial Sequence
  Peptide Derived from Human Papillomavirus
YQNIEFTA

SEQ ID NO: 6321 - protein, 10 aa, Artificial Sequence
  Peptide Derived from Human Papillomavirus
YQNIEFTAFL

SEQ ID NO: 6322 - protein, 8 aa, Artificial Sequence
  Peptide Derived from Human Papillomavirus
YTHLQCLT

SEQ ID NO: 6323 - protein, 9 aa, Artificial Sequence
  Peptide Derived from Human Papillomavirus
AAAKRRRPA

SEQ ID NO: 6324 - protein, 11 aa, Artificial Sequence
  Peptide Derived from Human Papillomavirus
AAAKRRRPADT

SEQ ID NO: 6325 - protein, 8 aa, Artificial Sequence
  Peptide Derived from Human Papillomavirus
AAKRRRPA

SEQ ID NO: 6326 - protein, 10 aa, Artificial Sequence
  Peptide Derived from Human Papillomavirus
AAKRRRPADT

SEQ ID NO: 6327 - protein, 11 aa, Artificial Sequence
  Peptide Derived from Human Papillomavirus
AAKRRRPADTT

SEQ ID NO: 6328 - protein, 9 aa, Artificial Sequence
  Peptide Derived from Human Papillomavirus
AAKYSKTQM

SEQ ID NO: 6329 - protein, 9 aa, Artificial Sequence
  Peptide Derived from Human Papillomavirus
ALDNRTART

SEQ ID NO: 6330 - protein, 10 aa, Artificial Sequence
  Peptide Derived from Human Papillomavirus
ALDNRTARTA

SEQ ID NO: 6331 - protein, 11 aa, Artificial Sequence
  Peptide Derived from Human Papillomavirus
ALDNRTARTAT

SEQ ID NO: 6332 - protein, 9 aa, Artificial Sequence
  Peptide Derived from Human Papillomavirus
ALLYTAKQM

SEQ ID NO: 6333 - protein, 10 aa, Artificial Sequence
  Peptide Derived from Human Papillomavirus
AQPLTKLFCA

SEQ ID NO: 6334 - protein, 10 aa, Artificial Sequence
  Peptide Derived from Human Papillomavirus
ATNCTNKQRT

SEQ ID NO: 6335 - protein, 11 aa, Artificial Sequence
  Peptide Derived from Human Papillomavirus
ATNCTNKQRTV

SEQ ID NO: 6336 - protein, 9 aa, Artificial Sequence
  Peptide Derived from Human Papillomavirus
AVQEKILDL

SEQ ID NO: 6337 - protein, 10 aa, Artificial Sequence
  Peptide Derived from Human Papillomavirus
CADPALDNRT

SEQ ID NO: 6338 - protein, 11 aa, Artificial Sequence
  Peptide Derived from Human Papillomavirus
CADPALDNRTA

SEQ ID NO: 6339 - protein, 10 aa, Artificial Sequence
  Peptide Derived from Human Papillomavirus
CALLYTAKQM

SEQ ID NO: 6340 - protein, 8 aa, Artificial Sequence
  Peptide Derived from Human Papillomavirus
CTMVTGKV

SEQ ID NO: 6341 - protein, 11 aa, Artificial Sequence
  Peptide Derived from Human Papillomavirus
CTMVTGKVDYI

SEQ ID NO: 6342 - protein, 8 aa, Artificial Sequence
  Peptide Derived from Human Papillomavirus
CTNKQRTV

SEQ ID NO: 6343 - protein, 8 aa, Artificial Sequence
  Peptide Derived from Human Papillomavirus
DAAKYSKT

SEQ ID NO: 6344 - protein, 10 aa, Artificial Sequence
  Peptide Derived from Human Papillomavirus
DAAKYSKTQM

SEQ ID NO: 6345 - protein, 11 aa, Artificial Sequence
  Peptide Derived from Human Papillomavirus
DLPSQIEHWKL

SEQ ID NO: 6346 - protein, 8 aa, Artificial Sequence
  Peptide Derived from Human Papillomavirus
DLYEADKT

SEQ ID NO: 6347 - protein, 10 aa, Artificial Sequence
  Peptide Derived from Human Papillomavirus
DLYEADKTDL

SEQ ID NO: 6348 - protein, 9 aa, Artificial Sequence
  Peptide Derived from Human Papillomavirus
DTAQPLTKL

SEQ ID NO: 6349 - protein, 10 aa, Artificial Sequence
  Peptide Derived from Human Papillomavirus
DTCTMVTGKV

SEQ ID NO: 6350 - protein, 9 aa, Artificial Sequence
  Peptide Derived from Human Papillomavirus
DTTDTAQPL

SEQ ID NO: 6351 - protein, 10 aa, Artificial Sequence
  Peptide Derived from Human Papillomavirus
DTTDTAQPLT

SEQ ID NO: 6352 - protein, 11 aa, Artificial Sequence
  Peptide Derived from Human Papillomavirus
EADKTDLPSQI

SEQ ID NO: 6353 - protein, 8 aa, Artificial Sequence
  Peptide Derived from Human Papillomavirus
EISARLNA

SEQ ID NO: 6354 - protein, 9 aa, Artificial Sequence
  Peptide Derived from Human Papillomavirus
EISARLNAV

SEQ ID NO: 6355 - protein, 9 aa, Artificial Sequence
  Peptide Derived from Human Papillomavirus
EIYIIEEDT

SEQ ID NO: 6356 - protein, 11 aa, Artificial Sequence
  Peptide Derived from Human Papillomavirus
EIYIIEEDTCT

SEQ ID NO: 6357 - protein, 8 aa, Artificial Sequence
  Peptide Derived from Human Papillomavirus
ELQMALET

SEQ ID NO: 6358 - protein, 9 aa, Artificial Sequence
  Peptide Derived from Human Papillomavirus
ELQMALETL

SEQ ID NO: 6359 - protein, 9 aa, Artificial Sequence
  Peptide Derived from Human Papillomavirus
ELYSSMSST

SEQ ID NO: 6360 - protein, 8 aa, Artificial Sequence
  Peptide Derived from Human Papillomavirus
EQQQQMFL

SEQ ID NO: 6361 - protein, 10 aa, Artificial Sequence
  Peptide Derived from Human Papillomavirus
EQQQQMFLGT

SEQ ID NO: 6362 - protein, 11 aa, Artificial Sequence
  Peptide Derived from Human Papillomavirus
EQQQQMFLGTV

SEQ ID NO: 6363 - protein, 10 aa, Artificial Sequence
  Peptide Derived from Human Papillomavirus
ETLSKSQYST

SEQ ID NO: 6364 - protein, 8 aa, Artificial Sequence
  Peptide Derived from Human Papillomavirus
EVHVGGQV

SEQ ID NO: 6365 - protein, 9 aa, Artificial Sequence
  Peptide Derived from Human Papillomavirus
EVHVGGQVI

SEQ ID NO: 6366 - protein, 10 aa, Artificial Sequence
  Peptide Derived from Human Papillomavirus
EVHVGGQVIV

SEQ ID NO: 6367 - protein, 10 aa, Artificial Sequence
  Peptide Derived from Human Papillomavirus
FLGTVKIPPT

SEQ ID NO: 6368 - protein, 11 aa, Artificial Sequence
  Peptide Derived from Human Papillomavirus
FLGTVKIPPTV

SEQ ID NO: 6369 - protein, 8 aa, Artificial Sequence
  Peptide Derived from Human Papillomavirus
FQVIELQM

SEQ ID NO: 6370 - protein, 9 aa, Artificial Sequence
  Peptide Derived from Human Papillomavirus
FQVIELQMA

SEQ ID NO: 6371 - protein, 10 aa, Artificial Sequence
  Peptide Derived from Human Papillomavirus
FQVIELQMAL

SEQ ID NO: 6372 - protein, 9 aa, Artificial Sequence
  Peptide Derived from Human Papillomavirus
FVTEQQQQM

SEQ ID NO: 6373 - protein, 11 aa, Artificial Sequence
  Peptide Derived from Human Papillomavirus
FVTEQQQQMFL

SEQ ID NO: 6374 - protein, 8 aa, Artificial Sequence
  Peptide Derived from Human Papillomavirus
GIVTVTFV

SEQ ID NO: 6375 - protein, 9 aa, Artificial Sequence
  Peptide Derived from Human Papillomavirus
GIVTVTFVT

SEQ ID NO: 6376 - protein, 11 aa, Artificial Sequence
  Peptide Derived from Human Papillomavirus
GMYYIHNCEKV

SEQ ID NO: 6377 - protein, 8 aa, Artificial Sequence
  Peptide Derived from Human Papillomavirus
GQVIVCPT

SEQ ID NO: 6378 - protein, 10 aa, Artificial Sequence
  Peptide Derived from Human Papillomavirus
GQVIVCPTSI

SEQ ID NO: 6379 - protein, 8 aa, Artificial Sequence
  Peptide Derived from Human Papillomavirus
GTVKIPPT

SEQ ID NO: 6380 - protein, 9 aa, Artificial Sequence
  Peptide Derived from Human Papillomavirus
GTVKIPPTV

SEQ ID NO: 6381 - protein, 11 aa, Artificial Sequence
  Peptide Derived from Human Papillomavirus
GTVKIPPTVQI

SEQ ID NO: 6382 - protein, 10 aa, Artificial Sequence
  Peptide Derived from Human Papillomavirus
HLCHQVVPSL

SEQ ID NO: 6383 - protein, 11 aa, Artificial Sequence
  Peptide Derived from Human Papillomavirus
HLCHQVVPSLL

SEQ ID NO: 6384 - protein, 9 aa, Artificial Sequence
  Peptide Derived from Human Papillomavirus
HLKGESNSL

SEQ ID NO: 6385 - protein, 8 aa, Artificial Sequence
  Peptide Derived from Human Papillomavirus
HQVVPSLL

SEQ ID NO: 6386 - protein, 9 aa, Artificial Sequence
  Peptide Derived from Human Papillomavirus
HQVVPSLLA

SEQ ID NO: 6387 - protein, 8 aa, Artificial Sequence
  Peptide Derived from Human Papillomavirus
HVGGQVIV

SEQ ID NO: 6388 - protein, 11 aa, Artificial Sequence
  Peptide Derived from Human Papillomavirus
HVGGQVIVCPT

SEQ ID NO: 6389 - protein, 8 aa, Artificial Sequence
  Peptide Derived from Human Papillomavirus
IIEEDTCT

SEQ ID NO: 6390 - protein, 9 aa, Artificial Sequence
  Peptide Derived from Human Papillomavirus
IIEEDTCTM

SEQ ID NO: 6391 - protein, 10 aa, Artificial Sequence
  Peptide Derived from Human Papillomavirus
IIEEDTCTMV

SEQ ID NO: 6392 - protein, 11 aa, Artificial Sequence
  Peptide Derived from Human Papillomavirus
IIEEDTCTMVT

SEQ ID NO: 6393 - protein, 10 aa, Artificial Sequence
  Peptide Derived from Human Papillomavirus
ILDLYEADKT

SEQ ID NO: 6394 - protein, 11 aa, Artificial Sequence
  Peptide Derived from Human Papillomavirus
IVHLKGESNSL

SEQ ID NO: 6395 - protein, 8 aa, Artificial Sequence
  Peptide Derived from Human Papillomavirus
IVTVTFVT

SEQ ID NO: 6396 - protein, 8 aa, Artificial Sequence
  Peptide Derived from Human Papillomavirus
KAFQVIEL

SEQ ID NO: 6397 - protein, 10 aa, Artificial Sequence
  Peptide Derived from Human Papillomavirus
KAFQVIELQM

SEQ ID NO: 6398 - protein, 11 aa, Artificial Sequence
  Peptide Derived from Human Papillomavirus
KAFQVIELQMA

SEQ ID NO: 6399 - protein, 8 aa, Artificial Sequence
  Peptide Derived from Human Papillomavirus
KILDLYEA

SEQ ID NO: 6400 - protein, 11 aa, Artificial Sequence
  Peptide Derived from Human Papillomavirus
KILDLYEADKT

SEQ ID NO: 6401 - protein, 8 aa, Artificial Sequence
  Peptide Derived from Human Papillomavirus
KIPPTVQI

SEQ ID NO: 6402 - protein, 10 aa, Artificial Sequence
  Peptide Derived from Human Papillomavirus
KIPPTVQIST

SEQ ID NO: 6403 - protein, 8 aa, Artificial Sequence
  Peptide Derived from Human Papillomavirus
KLFCADPA

SEQ ID NO: 6404 - protein, 9 aa, Artificial Sequence
  Peptide Derived from Human Papillomavirus
KLFCADPAL

SEQ ID NO: 6405 - protein, 8 aa, Artificial Sequence
  Peptide Derived from Human Papillomavirus
KLIRMECA

SEQ ID NO: 6406 - protein, 9 aa, Artificial Sequence
  Peptide Derived from Human Papillomavirus
KLIRMECAL

SEQ ID NO: 6407 - protein, 10 aa, Artificial Sequence
  Peptide Derived from Human Papillomavirus
KLIRMECALL

SEQ ID NO: 6408 - protein, 8 aa, Artificial Sequence
  Peptide Derived from Human Papillomavirus
KQGETVTV

SEQ ID NO: 6409 - protein, 8 aa, Artificial Sequence
  Peptide Derived from Human Papillomavirus
KQMGFSHL

SEQ ID NO: 6410 - protein, 10 aa, Artificial Sequence
  Peptide Derived from Human Papillomavirus
KQRTVCSSNV

SEQ ID NO: 6411 - protein, 11 aa, Artificial Sequence
  Peptide Derived from Human Papillomavirus
KQRTVCSSNVA

SEQ ID NO: 6412 - protein, 8 aa, Artificial Sequence
  Peptide Derived from Human Papillomavirus
KTDLPSQI

SEQ ID NO: 6413 - protein, 8 aa, Artificial Sequence
  Peptide Derived from Human Papillomavirus
KTKAFQVI

SEQ ID NO: 6414 - protein, 10 aa, Artificial Sequence
  Peptide Derived from Human Papillomavirus
KTKAFQVIEL

SEQ ID NO: 6415 - protein, 9 aa, Artificial Sequence
  Peptide Derived from Human Papillomavirus
KTQMWEVHV

SEQ ID NO: 6416 - protein, 10 aa, Artificial Sequence
  Peptide Derived from Human Papillomavirus
KVDYIGMYYI

SEQ ID NO: 6417 - protein, 11 aa, Artificial Sequence
  Peptide Derived from Human Papillomavirus
KVYFKYFKEDA

SEQ ID NO: 6418 - protein, 10 aa, Artificial Sequence
  Peptide Derived from Human Papillomavirus
LASKTKAFQV

SEQ ID NO: 6419 - protein, 11 aa, Artificial Sequence
  Peptide Derived from Human Papillomavirus
LASKTKAFQVI

SEQ ID NO: 6420 - protein, 8 aa, Artificial Sequence
  Peptide Derived from Human Papillomavirus
LIRMECAL

SEQ ID NO: 6421 - protein, 9 aa, Artificial Sequence
  Peptide Derived from Human Papillomavirus
LIRMECALL

SEQ ID NO: 6422 - protein, 11 aa, Artificial Sequence
  Peptide Derived from Human Papillomavirus
LIRMECALLYT

SEQ ID NO: 6423 - protein, 8 aa, Artificial Sequence
  Peptide Derived from Human Papillomavirus
LLASKTKA

SEQ ID NO: 6424 - protein, 11 aa, Artificial Sequence
  Peptide Derived from Human Papillomavirus
LLASKTKAFQV

SEQ ID NO: 6425 - protein, 8 aa, Artificial Sequence
  Peptide Derived from Human Papillomavirus
LLYTAKQM

SEQ ID NO: 6426 - protein, 8 aa, Artificial Sequence
  Peptide Derived from Human Papillomavirus
LQMALETL

SEQ ID NO: 6427 - protein, 8 aa, Artificial Sequence
  Peptide Derived from Human Papillomavirus
LQQTSLEV

SEQ ID NO: 6428 - protein, 10 aa, Artificial Sequence
  Peptide Derived from Human Papillomavirus
LQQTSLEVWL

SEQ ID NO: 6429 - protein, 10 aa, Artificial Sequence
  Peptide Derived from Human Papillomavirus
LTKLFCADPA

SEQ ID NO: 6430 - protein, 11 aa, Artificial Sequence
  Peptide Derived from Human Papillomavirus
LTKLFCADPAL

SEQ ID NO: 6431 - protein, 9 aa, Artificial Sequence
  Peptide Derived from Human Papillomavirus
MVTGKVDYI

SEQ ID NO: 6432 - protein, 11 aa, Artificial Sequence
  Peptide Derived from Human Papillomavirus
MVTGKVDYIGM

SEQ ID NO: 6433 - protein, 8 aa, Artificial Sequence
  Peptide Derived from Human Papillomavirus
NAVQEKIL

SEQ ID NO: 6434 - protein, 10 aa, Artificial Sequence
  Peptide Derived from Human Papillomavirus
NAVQEKILDL

SEQ ID NO: 6435 - protein, 8 aa, Artificial Sequence
  Peptide Derived from Human Papillomavirus
NQISTTET

SEQ ID NO: 6436 - protein, 9 aa, Artificial Sequence
  Peptide Derived from Human Papillomavirus
NQISTTETA

SEQ ID NO: 6437 - protein, 11 aa, Artificial Sequence
  Peptide Derived from Human Papillomavirus
NQISTTETADI

SEQ ID NO: 6438 - protein, 11 aa, Artificial Sequence
  Peptide Derived from Human Papillomavirus
NTMDYTNWGEI

SEQ ID NO: 6439 - protein, 8 aa, Artificial Sequence
  Peptide Derived from Human Papillomavirus
NVAPIVHL

SEQ ID NO: 6440 - protein, 8 aa, Artificial Sequence
  Peptide Derived from Human Papillomavirus
PADTTDTA

SEQ ID NO: 6441 - protein, 11 aa, Artificial Sequence
  Peptide Derived from Human Papillomavirus
PADTTDTAQPL

SEQ ID NO: 6442 - protein, 8 aa, Artificial Sequence
  Peptide Derived from Human Papillomavirus
PALDNRTA

SEQ ID NO: 6443 - protein, 10 aa, Artificial Sequence
  Peptide Derived from Human Papillomavirus
PALDNRTART

SEQ ID NO: 6444 - protein, 11 aa, Artificial Sequence
  Peptide Derived from Human Papillomavirus
PALDNRTARTA

SEQ ID NO: 6445 - protein, 8 aa, Artificial Sequence
  Peptide Derived from Human Papillomavirus
PLTKLFCA

SEQ ID NO: 6446 - protein, 11 aa, Artificial Sequence
  Peptide Derived from Human Papillomavirus
PLTKLFCADPA

SEQ ID NO: 6447 - protein, 11 aa, Artificial Sequence
  Peptide Derived from Human Papillomavirus
PQAAAKRRRPA

SEQ ID NO: 6448 - protein, 9 aa, Artificial Sequence
  Peptide Derived from Human Papillomavirus
PTSISSNQI

SEQ ID NO: 6449 - protein, 11 aa, Artificial Sequence
  Peptide Derived from Human Papillomavirus
PTSISSNQIST

SEQ ID NO: 6450 - protein, 10 aa, Artificial Sequence
  Peptide Derived from Human Papillomavirus
PTVQISTGFM

SEQ ID NO: 6451 - protein, 11 aa, Artificial Sequence
  Peptide Derived from Human Papillomavirus
PTVQISTGFMT

SEQ ID NO: 6452 - protein, 10 aa, Artificial Sequence
  Peptide Derived from Human Papillomavirus
QAAAKRRRPA

SEQ ID NO: 6453 - protein, 8 aa, Artificial Sequence
  Peptide Derived from Human Papillomavirus
QIEHWKLI

SEQ ID NO: 6454 - protein, 10 aa, Artificial Sequence
  Peptide Derived from Human Papillomavirus
QIEHWKLIRM

SEQ ID NO: 6455 - protein, 8 aa, Artificial Sequence
  Peptide Derived from Human Papillomavirus
QISTGFMT

SEQ ID NO: 6456 - protein, 9 aa, Artificial Sequence
  Peptide Derived from Human Papillomavirus
QISTGFMTL

SEQ ID NO: 6457 - protein, 8 aa, Artificial Sequence
  Peptide Derived from Human Papillomavirus
QISTTETA

SEQ ID NO: 6458 - protein, 10 aa, Artificial Sequence
  Peptide Derived from Human Papillomavirus
QISTTETADI

SEQ ID NO: 6459 - protein, 9 aa, Artificial Sequence
  Peptide Derived from Human Papillomavirus
QMFLGTVKI

SEQ ID NO: 6460 - protein, 11 aa, Artificial Sequence
  Peptide Derived from Human Papillomavirus
QMGFSHLCHQV

SEQ ID NO: 6461 - protein, 11 aa, Artificial Sequence
  Peptide Derived from Human Papillomavirus
QMWEVHVGGQV

SEQ ID NO: 6462 - protein, 8 aa, Artificial Sequence
  Peptide Derived from Human Papillomavirus
QQMFLGTV

SEQ ID NO: 6463 - protein, 10 aa, Artificial Sequence
  Peptide Derived from Human Papillomavirus
QQMFLGTVKI

SEQ ID NO: 6464 - protein, 8 aa, Artificial Sequence
  Peptide Derived from Human Papillomavirus
QQQMFLGT

SEQ ID NO: 6465 - protein, 9 aa, Artificial Sequence
  Peptide Derived from Human Papillomavirus
QQQMFLGTV

SEQ ID NO: 6466 - protein, 11 aa, Artificial Sequence
  Peptide Derived from Human Papillomavirus
QQQMFLGTVKI

SEQ ID NO: 6467 - protein, 9 aa, Artificial Sequence
  Peptide Derived from Human Papillomavirus
QQQQMFLGT

SEQ ID NO: 6468 - protein, 10 aa, Artificial Sequence
  Peptide Derived from Human Papillomavirus
QQQQMFLGTV

SEQ ID NO: 6469 - protein, 9 aa, Artificial Sequence
  Peptide Derived from Human Papillomavirus
QQTSLEVWL

SEQ ID NO: 6470 - protein, 11 aa, Artificial Sequence
  Peptide Derived from Human Papillomavirus
QTDNDNRPPQA

SEQ ID NO: 6471 - protein, 8 aa, Artificial Sequence
  Peptide Derived from Human Papillomavirus
QTSLEVWL

SEQ ID NO: 6472 - protein, 8 aa, Artificial Sequence
  Peptide Derived from Human Papillomavirus
QVIELQMA

SEQ ID NO: 6473 - protein, 9 aa, Artificial Sequence
  Peptide Derived from Human Papillomavirus
QVIELQMAL

SEQ ID NO: 6474 - protein, 11 aa, Artificial Sequence
  Peptide Derived from Human Papillomavirus
QVIELQMALET

SEQ ID NO: 6475 - protein, 9 aa, Artificial Sequence
  Peptide Derived from Human Papillomavirus
QVIVCPTSI

SEQ ID NO: 6476 - protein, 8 aa, Artificial Sequence
  Peptide Derived from Human Papillomavirus
QVVPSLLA

SEQ ID NO: 6477 - protein, 11 aa, Artificial Sequence
  Peptide Derived from Human Papillomavirus
QVVPSLLASKT

SEQ ID NO: 6478 - protein, 8 aa, Artificial Sequence
  Peptide Derived from Human Papillomavirus
RLKPYKEL

SEQ ID NO: 6479 - protein, 9 aa, Artificial Sequence
  Peptide Derived from Human Papillomavirus
RLNAVQEKI

SEQ ID NO: 6480 - protein, 10 aa, Artificial Sequence
  Peptide Derived from Human Papillomavirus
RLNAVQEKIL

SEQ ID NO: 6481 - protein, 9 aa, Artificial Sequence
  Peptide Derived from Human Papillomavirus
RMECALLYT

SEQ ID NO: 6482 - protein, 10 aa, Artificial Sequence
  Peptide Derived from Human Papillomavirus
RMECALLYTA

SEQ ID NO: 6483 - protein, 10 aa, Artificial Sequence
  Peptide Derived from Human Papillomavirus
RTARTATNCT

SEQ ID NO: 6484 - protein, 8 aa, Artificial Sequence
  Peptide Derived from Human Papillomavirus
RTVCSSNV

SEQ ID NO: 6485 - protein, 9 aa, Artificial Sequence
  Peptide Derived from Human Papillomavirus
RTVCSSNVA

SEQ ID NO: 6486 - protein, 11 aa, Artificial Sequence
  Peptide Derived from Human Papillomavirus
RTVCSSNVAPI

SEQ ID NO: 6487 - protein, 11 aa, Artificial Sequence
  Peptide Derived from Human Papillomavirus
SARLNAVQEKI

SEQ ID NO: 6488 - protein, 9 aa, Artificial Sequence
  Peptide Derived from Human Papillomavirus
SISSNQIST

SEQ ID NO: 6489 - protein, 10 aa, Artificial Sequence
  Peptide Derived from Human Papillomavirus
SISSNQISTT

SEQ ID NO: 6490 - protein, 9 aa, Artificial Sequence
  Peptide Derived from Human Papillomavirus
SLKCLRYRL

SEQ ID NO: 6491 - protein, 9 aa, Artificial Sequence
  Peptide Derived from Human Papillomavirus
SLLASKTKA

SEQ ID NO: 6492 - protein, 9 aa, Artificial Sequence
  Peptide Derived from Human Papillomavirus
SMSSTWHWT

SEQ ID NO: 6493 - protein, 8 aa, Artificial Sequence
  Peptide Derived from Human Papillomavirus
SQIEHWKL

SEQ ID NO: 6494 - protein, 9 aa, Artificial Sequence
  Peptide Derived from Human Papillomavirus
SQIEHWKLI

SEQ ID NO: 6495 - protein, 11 aa, Artificial Sequence
  Peptide Derived from Human Papillomavirus
SQIEHWKLIRM

SEQ ID NO: 6496 - protein, 8 aa, Artificial Sequence
  Peptide Derived from Human Papillomavirus
SQWTLQQT

SEQ ID NO: 6497 - protein, 10 aa, Artificial Sequence
  Peptide Derived from Human Papillomavirus
SQWTLQQTSL

SEQ ID NO: 6498 - protein, 9 aa, Artificial Sequence
  Peptide Derived from Human Papillomavirus
SQYSTSQWT

SEQ ID NO: 6499 - protein, 10 aa, Artificial Sequence
  Peptide Derived from Human Papillomavirus
SQYSTSQWTL

SEQ ID NO: 6500 - protein, 10 aa, Artificial Sequence
  Peptide Derived from Human Papillomavirus
STSQWTLQQT

SEQ ID NO: 6501 - protein, 8 aa, Artificial Sequence
  Peptide Derived from Human Papillomavirus
STTETADI

SEQ ID NO: 6502 - protein, 10 aa, Artificial Sequence
  Peptide Derived from Human Papillomavirus
STTETADIQT

SEQ ID NO: 6503 - protein, 10 aa, Artificial Sequence
  Peptide Derived from Human Papillomavirus
TAKQMGFSHL

SEQ ID NO: 6504 - protein, 8 aa, Artificial Sequence
  Peptide Derived from Human Papillomavirus
TAQPLTKL

SEQ ID NO: 6505 - protein, 11 aa, Artificial Sequence
  Peptide Derived from Human Papillomavirus
TAQPLTKLFCA

SEQ ID NO: 6506 - protein, 9 aa, Artificial Sequence
  Peptide Derived from Human Papillomavirus
TARTATNCT

SEQ ID NO: 6507 - protein, 11 aa, Artificial Sequence
  Peptide Derived from Human Papillomavirus
TATNCTNKQRT

SEQ ID NO: 6508 - protein, 9 aa, Artificial Sequence
  Peptide Derived from Human Papillomavirus
TLQQTSLEV

SEQ ID NO: 6509 - protein, 11 aa, Artificial Sequence
  Peptide Derived from Human Papillomavirus
TLQQTSLEVWL

SEQ ID NO: 6510 - protein, 9 aa, Artificial Sequence
  Peptide Derived from Human Papillomavirus
TLSKSQYST

SEQ ID NO: 6511 - protein, 10 aa, Artificial Sequence
  Peptide Derived from Human Papillomavirus
TMDYTNWGEI

SEQ ID NO: 6512 - protein, 10 aa, Artificial Sequence
  Peptide Derived from Human Papillomavirus
TMVTGKVDYI

SEQ ID NO: 6513 - protein, 8 aa, Artificial Sequence
  Peptide Derived from Human Papillomavirus
TQMWEVHV

SEQ ID NO: 6514 - protein, 8 aa, Artificial Sequence
  Peptide Derived from Human Papillomavirus
TTDTAQPL

SEQ ID NO: 6515 - protein, 9 aa, Artificial Sequence
  Peptide Derived from Human Papillomavirus
TTDTAQPLT

SEQ ID NO: 6516 - protein, 11 aa, Artificial Sequence
  Peptide Derived from Human Papillomavirus
TTDTAQPLTKL

SEQ ID NO: 6517 - protein, 9 aa, Artificial Sequence
  Peptide Derived from Human Papillomavirus
TTETADIQT

SEQ ID NO: 6518 - protein, 8 aa, Artificial Sequence
  Peptide Derived from Human Papillomavirus
TVCSSNVA

SEQ ID NO: 6519 - protein, 10 aa, Artificial Sequence
  Peptide Derived from Human Papillomavirus
TVCSSNVAPI

SEQ ID NO: 6520 - protein, 11 aa, Artificial Sequence
  Peptide Derived from Human Papillomavirus
TVCSSNVAPIV

SEQ ID NO: 6521 - protein, 8 aa, Artificial Sequence
  Peptide Derived from Human Papillomavirus
TVKIPPTV

SEQ ID NO: 6522 - protein, 10 aa, Artificial Sequence
  Peptide Derived from Human Papillomavirus
TVKIPPTVQI

SEQ ID NO: 6523 - protein, 9 aa, Artificial Sequence
  Peptide Derived from Human Papillomavirus
TVQISTGFM

SEQ ID NO: 6524 - protein, 10 aa, Artificial Sequence
  Peptide Derived from Human Papillomavirus
TVQISTGFMT

SEQ ID NO: 6525 - protein, 11 aa, Artificial Sequence
  Peptide Derived from Human Papillomavirus
TVQISTGFMTL

SEQ ID NO: 6526 - protein, 11 aa, Artificial Sequence
  Peptide Derived from Human Papillomavirus
TVQYDNDKKNT

SEQ ID NO: 6527 - protein, 8 aa, Artificial Sequence
  Peptide Derived from Human Papillomavirus
VIELQMAL

SEQ ID NO: 6528 - protein, 10 aa, Artificial Sequence
  Peptide Derived from Human Papillomavirus
VIELQMALET

SEQ ID NO: 6529 - protein, 11 aa, Artificial Sequence
  Peptide Derived from Human Papillomavirus
VIELQMALETL

SEQ ID NO: 6530 - protein, 8 aa, Artificial Sequence
  Peptide Derived from Human Papillomavirus
VIVCPTSI

SEQ ID NO: 6531 - protein, 8 aa, Artificial Sequence
  Peptide Derived from Human Papillomavirus
VQEKILDL

SEQ ID NO: 6532 - protein, 11 aa, Artificial Sequence
  Peptide Derived from Human Papillomavirus
VQEKILDLYEA

SEQ ID NO: 6533 - protein, 8 aa, Artificial Sequence
  Peptide Derived from Human Papillomavirus
VQISTGFM

SEQ ID NO: 6534 - protein, 9 aa, Artificial Sequence
  Peptide Derived from Human Papillomavirus
VQISTGFMT

SEQ ID NO: 6535 - protein, 10 aa, Artificial Sequence
  Peptide Derived from Human Papillomavirus
VQISTGFMTL

SEQ ID NO: 6536 - protein, 10 aa, Artificial Sequence
  Peptide Derived from Human Papillomavirus
VQYDNDKKNT

SEQ ID NO: 6537 - protein, 11 aa, Artificial Sequence
  Peptide Derived from Human Papillomavirus
VQYDNDKKNTM

SEQ ID NO: 6538 - protein, 8 aa, Artificial Sequence
  Peptide Derived from Human Papillomavirus
VTEQQQQM

SEQ ID NO: 6539 - protein, 10 aa, Artificial Sequence
  Peptide Derived from Human Papillomavirus
VTEQQQQMFL

SEQ ID NO: 6540 - protein, 11 aa, Artificial Sequence
  Peptide Derived from Human Papillomavirus
VTFVTEQQQQM

SEQ ID NO: 6541 - protein, 8 aa, Artificial Sequence
  Peptide Derived from Human Papillomavirus
VTGKVDYI

SEQ ID NO: 6542 - protein, 10 aa, Artificial Sequence
  Peptide Derived from Human Papillomavirus
VTGKVDYIGM

SEQ ID NO: 6543 - protein, 10 aa, Artificial Sequence
  Peptide Derived from Human Papillomavirus
VVPSLLASKT

SEQ ID NO: 6544 - protein, 8 aa, Artificial Sequence
  Peptide Derived from Human Papillomavirus
WTLQQTSL

SEQ ID NO: 6545 - protein, 10 aa, Artificial Sequence
  Peptide Derived from Human Papillomavirus
WTLQQTSLEV

SEQ ID NO: 6546 - protein, 8 aa, Artificial Sequence
  Peptide Derived from Human Papillomavirus
YIHNCEKV

SEQ ID NO: 6547 - protein, 9 aa, Artificial Sequence
  Peptide Derived from Human Papillomavirus
YIIEEDTCT

SEQ ID NO: 6548 - protein, 10 aa, Artificial Sequence
  Peptide Derived from Human Papillomavirus
YIIEEDTCTM

SEQ ID NO: 6549 - protein, 11 aa, Artificial Sequence
  Peptide Derived from Human Papillomavirus
YIIEEDTCTMV

SEQ ID NO: 6550 - protein, 11 aa, Artificial Sequence
  Peptide Derived from Human Papillomavirus
YTAKQMGFSHL

SEQ ID NO: 6551 - protein, 9 aa, Artificial Sequence
  Peptide Derived from Human Papillomavirus
YTNWGEIYI

SEQ ID NO: 6552 - protein, 10 aa, Artificial Sequence
  Peptide Derived from Human Papillomavirus
YTNWGEIYII

SEQ ID NO: 6553 - protein, 9 aa, Artificial Sequence
  Peptide Derived from Human Papillomavirus
CINFHAQHM

SEQ ID NO: 6554 - protein, 10 aa, Artificial Sequence
  Peptide Derived from Human Papillomavirus
CINFHAQHMT

SEQ ID NO: 6555 - protein, 9 aa, Artificial Sequence
  Peptide Derived from Human Papillomavirus
CLSLLLRPL

SEQ ID NO: 6556 - protein, 10 aa, Artificial Sequence
  Peptide Derived from Human Papillomavirus
CLSLLLRPLI

SEQ ID NO: 6557 - protein, 11 aa, Artificial Sequence
  Peptide Derived from Human Papillomavirus
CLSLLLRPLIL

SEQ ID NO: 6558 - protein, 9 aa, Artificial Sequence
  Peptide Derived from Human Papillomavirus
FILFLCLSL

SEQ ID NO: 6559 - protein, 10 aa, Artificial Sequence
  Peptide Derived from Human Papillomavirus
FILFLCLSLL

SEQ ID NO: 6560 - protein, 11 aa, Artificial Sequence
  Peptide Derived from Human Papillomavirus
FILFLCLSLLL

SEQ ID NO: 6561 - protein, 8 aa, Artificial Sequence
  Peptide Derived from Human Papillomavirus
FLCLSLLL

SEQ ID NO: 6562 - protein, 11 aa, Artificial Sequence
  Peptide Derived from Human Papillomavirus
FLCLSLLLRPL

SEQ ID NO: 6563 - protein, 9 aa, Artificial Sequence
  Peptide Derived from Human Papillomavirus
FLYLPMMCI

SEQ ID NO: 6564 - protein, 8 aa, Artificial Sequence
  Peptide Derived from Human Papillomavirus
FVFVLCFI

SEQ ID NO: 6565 - protein, 9 aa, Artificial Sequence
  Peptide Derived from Human Papillomavirus
FVFVLCFIL

SEQ ID NO: 6566 - protein, 11 aa, Artificial Sequence
  Peptide Derived from Human Papillomavirus
FVFVLCFILFL

SEQ ID NO: 6567 - protein, 8 aa, Artificial Sequence
  Peptide Derived from Human Papillomavirus
FVGSPLKI

SEQ ID NO: 6568 - protein, 9 aa, Artificial Sequence
  Peptide Derived from Human Papillomavirus
FVLCFILFL

SEQ ID NO: 6569 - protein, 11 aa, Artificial Sequence
  Peptide Derived from Human Papillomavirus
FVLCFILFLCL

SEQ ID NO: 6570 - protein, 8 aa, Artificial Sequence
  Peptide Derived from Human Papillomavirus
ILFLCLSL

SEQ ID NO: 6571 - protein, 9 aa, Artificial Sequence
  Peptide Derived from Human Papillomavirus
ILFLCLSLL

SEQ ID NO: 6572 - protein, 10 aa, Artificial Sequence
  Peptide Derived from Human Papillomavirus
ILFLCLSLLL

SEQ ID NO: 6573 - protein, 8 aa, Artificial Sequence
  Peptide Derived from Human Papillomavirus
ILSISTYA

SEQ ID NO: 6574 - protein, 10 aa, Artificial Sequence
  Peptide Derived from Human Papillomavirus
ILSISTYAWL

SEQ ID NO: 6575 - protein, 11 aa, Artificial Sequence
  Peptide Derived from Human Papillomavirus
ILSISTYAWLL

SEQ ID NO: 6576 - protein, 8 aa, Artificial Sequence
  Peptide Derived from Human Papillomavirus
KIFFCYLL

SEQ ID NO: 6577 - protein, 10 aa, Artificial Sequence
  Peptide Derived from Human Papillomavirus
KIFFCYLLFL

SEQ ID NO: 6578 - protein, 9 aa, Artificial Sequence
  Peptide Derived from Human Papillomavirus
LILSISTYA

SEQ ID NO: 6579 - protein, 11 aa, Artificial Sequence
  Peptide Derived from Human Papillomavirus
LILSISTYAWL

SEQ ID NO: 6580 - protein, 8 aa, Artificial Sequence
  Peptide Derived from Human Papillomavirus
LLFLYLPM

SEQ ID NO: 6581 - protein, 9 aa, Artificial Sequence
  Peptide Derived from Human Papillomavirus
LLFLYLPMM

SEQ ID NO: 6582 - protein, 11 aa, Artificial Sequence
  Peptide Derived from Human Papillomavirus
LLFLYLPMMCI

SEQ ID NO: 6583 - protein, 8 aa, Artificial Sequence
  Peptide Derived from Human Papillomavirus
LLLRPLIL

SEQ ID NO: 6584 - protein, 10 aa, Artificial Sequence
  Peptide Derived from Human Papillomavirus
LLLRPLILSI

SEQ ID NO: 6585 - protein, 11 aa, Artificial Sequence
  Peptide Derived from Human Papillomavirus
LLLWVFVGSPL

SEQ ID NO: 6586 - protein, 9 aa, Artificial Sequence
  Peptide Derived from Human Papillomavirus
LLRPLILSI

SEQ ID NO: 6587 - protein, 11 aa, Artificial Sequence
  Peptide Derived from Human Papillomavirus
LLRPLILSIST

SEQ ID NO: 6588 - protein, 8 aa, Artificial Sequence
  Peptide Derived from Human Papillomavirus
LLVLVLLL

SEQ ID NO: 6589 - protein, 10 aa, Artificial Sequence
  Peptide Derived from Human Papillomavirus
LLVLVLLLWV

SEQ ID NO: 6590 - protein, 10 aa, Artificial Sequence
  Peptide Derived from Human Papillomavirus
LLWVFVGSPL

SEQ ID NO: 6591 - protein, 9 aa, Artificial Sequence
  Peptide Derived from Human Papillomavirus
LVLLLWVFV

SEQ ID NO: 6592 - protein, 9 aa, Artificial Sequence
  Peptide Derived from Human Papillomavirus
LVLVLLLWV

SEQ ID NO: 6593 - protein, 11 aa, Artificial Sequence
  Peptide Derived from Human Papillomavirus
LVLVLLLWVFV

SEQ ID NO: 6594 - protein, 10 aa, Artificial Sequence
  Peptide Derived from Human Papillomavirus
MIFVFVLCFI

SEQ ID NO: 6595 - protein, 11 aa, Artificial Sequence
  Peptide Derived from Human Papillomavirus
MIFVFVLCFIL

SEQ ID NO: 6596 - protein, 8 aa, Artificial Sequence
  Peptide Derived from Human Papillomavirus
MMCINFHA

SEQ ID NO: 6597 - protein, 11 aa, Artificial Sequence
  Peptide Derived from Human Papillomavirus
MMCINFHAQHM

SEQ ID NO: 6598 - protein, 8 aa, Artificial Sequence
  Peptide Derived from Human Papillomavirus
PLILSIST

SEQ ID NO: 6599 - protein, 10 aa, Artificial Sequence
  Peptide Derived from Human Papillomavirus
PLILSISTYA

SEQ ID NO: 6600 - protein, 9 aa, Artificial Sequence
  Peptide Derived from Human Papillomavirus
PLKIFFCYL

SEQ ID NO: 6601 - protein, 10 aa, Artificial Sequence
  Peptide Derived from Human Papillomavirus
PLKIFFCYLL

SEQ ID NO: 6602 - protein, 9 aa, Artificial Sequence
  Peptide Derived from Human Papillomavirus
PMMCINFHA

SEQ ID NO: 6603 - protein, 8 aa, Artificial Sequence
  Peptide Derived from Human Papillomavirus
SISTYAWL

SEQ ID NO: 6604 - protein, 9 aa, Artificial Sequence
  Peptide Derived from Human Papillomavirus
SISTYAWLL

SEQ ID NO: 6605 - protein, 10 aa, Artificial Sequence
  Peptide Derived from Human Papillomavirus
SISTYAWLLV

SEQ ID NO: 6606 - protein, 11 aa, Artificial Sequence
  Peptide Derived from Human Papillomavirus
SISTYAWLLVL

SEQ ID NO: 6607 - protein, 8 aa, Artificial Sequence
  Peptide Derived from Human Papillomavirus
SLLLRPLI

SEQ ID NO: 6608 - protein, 9 aa, Artificial Sequence
  Peptide Derived from Human Papillomavirus
SLLLRPLIL

SEQ ID NO: 6609 - protein, 11 aa, Artificial Sequence
  Peptide Derived from Human Papillomavirus
SLLLRPLILSI

SEQ ID NO: 6610 - protein, 8 aa, Artificial Sequence
  Peptide Derived from Human Papillomavirus
STYAWLLV

SEQ ID NO: 6611 - protein, 9 aa, Artificial Sequence
  Peptide Derived from Human Papillomavirus
STYAWLLVL

SEQ ID NO: 6612 - protein, 10 aa, Artificial Sequence
  Peptide Derived from Human Papillomavirus
STYAWLLVLV

SEQ ID NO: 6613 - protein, 11 aa, Artificial Sequence
  Peptide Derived from Human Papillomavirus
STYAWLLVLVL

SEQ ID NO: 6614 - protein, 8 aa, Artificial Sequence
  Peptide Derived from Human Papillomavirus
VLCFILFL

SEQ ID NO: 6615 - protein, 10 aa, Artificial Sequence
  Peptide Derived from Human Papillomavirus
VLCFILFLCL

SEQ ID NO: 6616 - protein, 8 aa, Artificial Sequence
  Peptide Derived from Human Papillomavirus
VLLLWVFV

SEQ ID NO: 6617 - protein, 8 aa, Artificial Sequence
  Peptide Derived from Human Papillomavirus
VLVLLLWV

SEQ ID NO: 6618 - protein, 10 aa, Artificial Sequence
  Peptide Derived from Human Papillomavirus
VLVLLLWVFV

SEQ ID NO: 6619 - protein, 8 aa, Artificial Sequence
  Peptide Derived from Human Papillomavirus
WLLVLVLL

SEQ ID NO: 6620 - protein, 9 aa, Artificial Sequence
  Peptide Derived from Human Papillomavirus
WLLVLVLLL

SEQ ID NO: 6621 - protein, 11 aa, Artificial Sequence
  Peptide Derived from Human Papillomavirus
WLLVLVLLLWV

SEQ ID NO: 6622 - protein, 8 aa, Artificial Sequence
  Peptide Derived from Human Papillomavirus
WVFVGSPL

SEQ ID NO: 6623 - protein, 10 aa, Artificial Sequence
  Peptide Derived from Human Papillomavirus
WVFVGSPLKI

SEQ ID NO: 6624 - protein, 8 aa, Artificial Sequence
  Peptide Derived from Human Papillomavirus
YAWLLVLV

SEQ ID NO: 6625 - protein, 9 aa, Artificial Sequence
  Peptide Derived from Human Papillomavirus
YAWLLVLVL

SEQ ID NO: 6626 - protein, 10 aa, Artificial Sequence
  Peptide Derived from Human Papillomavirus
YAWLLVLVLL

SEQ ID NO: 6627 - protein, 11 aa, Artificial Sequence
  Peptide Derived from Human Papillomavirus
YAWLLVLVLLL

SEQ ID NO: 6628 - protein, 9 aa, Artificial Sequence
  Peptide Derived from Human Papillomavirus
YLLFLYLPM

SEQ ID NO: 6629 - protein, 10 aa, Artificial Sequence
  Peptide Derived from Human Papillomavirus
YLLFLYLPMM

SEQ ID NO: 6630 - protein, 11 aa, Artificial Sequence
  Peptide Derived from Human Papillomavirus
YLPMMCINFHA

SEQ ID NO: 6631 - protein, 11 aa, Artificial Sequence
  Peptide Derived from Human Papillomavirus
AACWRSRRRET

SEQ ID NO: 6632 - protein, 9 aa, Artificial Sequence
  Peptide Derived from Human Papillomavirus
ALETTIHNI

SEQ ID NO: 6633 - protein, 11 aa, Artificial Sequence
  Peptide Derived from Human Papillomavirus
ALETTIHNIEL

SEQ ID NO: 6634 - protein, 8 aa, Artificial Sequence
  Peptide Derived from Human Papillomavirus
CIICQRPL

SEQ ID NO: 6635 - protein, 8 aa, Artificial Sequence
  Peptide Derived from Human Papillomavirus
CLRFLSKI

SEQ ID NO: 6636 - protein, 8 aa, Artificial Sequence
  Peptide Derived from Human Papillomavirus
CQALETTI

SEQ ID NO: 6637 - protein, 11 aa, Artificial Sequence
  Peptide Derived from Human Papillomavirus
CQALETTIHNI

SEQ ID NO: 6638 - protein, 8 aa, Artificial Sequence
  Peptide Derived from Human Papillomavirus
CVECKKPL

SEQ ID NO: 6639 - protein, 8 aa, Artificial Sequence
  Peptide Derived from Human Papillomavirus
DLCQALET

SEQ ID NO: 6640 - protein, 9 aa, Artificial Sequence
  Peptide Derived from Human Papillomavirus
DLCQALETT

SEQ ID NO: 6641 - protein, 10 aa, Artificial Sequence
  Peptide Derived from Human Papillomavirus
DLCQALETTI

SEQ ID NO: 6642 - protein, 9 aa, Artificial Sequence
  Peptide Derived from Human Papillomavirus
DLNKRFHNI

SEQ ID NO: 6643 - protein, 8 aa, Artificial Sequence
  Peptide Derived from Human Papillomavirus
DTEEKPRT

SEQ ID NO: 6644 - protein, 9 aa, Artificial Sequence
  Peptide Derived from Human Papillomavirus
DTEEKPRTL

SEQ ID NO: 6645 - protein, 8 aa, Artificial Sequence
  Peptide Derived from Human Papillomavirus
EILIRCII

SEQ ID NO: 6646 - protein, 11 aa, Artificial Sequence
  Peptide Derived from Human Papillomavirus
ELQCVECKKPL

SEQ ID NO: 6647 - protein, 8 aa, Artificial Sequence
  Peptide Derived from Human Papillomavirus
EQTVKKPL

SEQ ID NO: 6648 - protein, 11 aa, Artificial Sequence
  Peptide Derived from Human Papillomavirus
EQTVKKPLNEI

SEQ ID NO: 6649 - protein, 9 aa, Artificial Sequence
  Peptide Derived from Human Papillomavirus
ETTIHNIEL

SEQ ID NO: 6650 - protein, 8 aa, Artificial Sequence
  Peptide Derived from Human Papillomavirus
EVYDFAFA

SEQ ID NO: 6651 - protein, 10 aa, Artificial Sequence
  Peptide Derived from Human Papillomavirus
EVYDFAFADL

SEQ ID NO: 6652 - protein, 11 aa, Artificial Sequence
  Peptide Derived from Human Papillomavirus
EVYDFAFADLT

SEQ ID NO: 6653 - protein, 8 aa, Artificial Sequence
  Peptide Derived from Human Papillomavirus
FAFADLTV

SEQ ID NO: 6654 - protein, 9 aa, Artificial Sequence
  Peptide Derived from Human Papillomavirus
FAFADLTVV

SEQ ID NO: 6655 - protein, 10 aa, Artificial Sequence
  Peptide Derived from Human Papillomavirus
FQDTEEKPRT

SEQ ID NO: 6656 - protein, 11 aa, Artificial Sequence
  Peptide Derived from Human Papillomavirus
FQDTEEKPRTL

SEQ ID NO: 6657 - protein, 10 aa, Artificial Sequence
  Peptide Derived from Human Papillomavirus
GICKLCLRFL

SEQ ID NO: 6658 - protein, 11 aa, Artificial Sequence
  Peptide Derived from Human Papillomavirus
HVDLNKRFHNI

SEQ ID NO: 6659 - protein, 10 aa, Artificial Sequence
  Peptide Derived from Human Papillomavirus
KLCLRFLSKI

SEQ ID NO: 6660 - protein, 11 aa, Artificial Sequence
  Peptide Derived from Human Papillomavirus
LIRCIICQRPL

SEQ ID NO: 6661 - protein, 10 aa, Artificial Sequence
  Peptide Derived from Human Papillomavirus
LQCVECKKPL

SEQ ID NO: 6662 - protein, 10 aa, Artificial Sequence
  Peptide Derived from Human Papillomavirus
LQRSEVYDFA

SEQ ID NO: 6663 - protein, 11 aa, Artificial Sequence
  Peptide Derived from Human Papillomavirus
NISGRWAGRCA

SEQ ID NO: 6664 - protein, 11 aa, Artificial Sequence
  Peptide Derived from Human Papillomavirus
NTLEQTVKKPL

SEQ ID NO: 6665 - protein, 11 aa, Artificial Sequence
  Peptide Derived from Human Papillomavirus
PLCPQEKKRHV

SEQ ID NO: 6666 - protein, 10 aa, Artificial Sequence
  Peptide Derived from Human Papillomavirus
PLNEILIRCI

SEQ ID NO: 6667 - protein, 11 aa, Artificial Sequence
  Peptide Derived from Human Papillomavirus
PLNEILIRCII

SEQ ID NO: 6668 - protein, 11 aa, Artificial Sequence
  Peptide Derived from Human Papillomavirus
PLQRSEVYDFA

SEQ ID NO: 6669 - protein, 8 aa, Artificial Sequence
  Peptide Derived from Human Papillomavirus
PQEKKRHV

SEQ ID NO: 6670 - protein, 10 aa, Artificial Sequence
  Peptide Derived from Human Papillomavirus
PQEKKRHVDL

SEQ ID NO: 6671 - protein, 10 aa, Artificial Sequence
  Peptide Derived from Human Papillomavirus
QALETTIHNI

SEQ ID NO: 6672 - protein, 10 aa, Artificial Sequence
  Peptide Derived from Human Papillomavirus
QTVKKPLNEI

SEQ ID NO: 6673 - protein, 11 aa, Artificial Sequence
  Peptide Derived from Human Papillomavirus
QTVKKPLNEIL

SEQ ID NO: 6674 - protein, 9 aa, Artificial Sequence
  Peptide Derived from Human Papillomavirus
RTLHDLCQA

SEQ ID NO: 6675 - protein, 10 aa, Artificial Sequence
  Peptide Derived from Human Papillomavirus
RTLHDLCQAL

SEQ ID NO: 6676 - protein, 10 aa, Artificial Sequence
  Peptide Derived from Human Papillomavirus
SVYGNTLEQT

SEQ ID NO: 6677 - protein, 11 aa, Artificial Sequence
  Peptide Derived from Human Papillomavirus
SVYGNTLEQTV

SEQ ID NO: 6678 - protein, 10 aa, Artificial Sequence
  Peptide Derived from Human Papillomavirus
TIHNIELQCV

SEQ ID NO: 6679 - protein, 10 aa, Artificial Sequence
  Peptide Derived from Human Papillomavirus
TLEQTVKKPL

SEQ ID NO: 6680 - protein, 8 aa, Artificial Sequence
  Peptide Derived from Human Papillomavirus
TLHDLCQA

SEQ ID NO: 6681 - protein, 9 aa, Artificial Sequence
  Peptide Derived from Human Papillomavirus
TLHDLCQAL

SEQ ID NO: 6682 - protein, 11 aa, Artificial Sequence
  Peptide Derived from Human Papillomavirus
TLHDLCQALET

SEQ ID NO: 6683 - protein, 8 aa, Artificial Sequence
  Peptide Derived from Human Papillomavirus
TTIHNIEL

SEQ ID NO: 6684 - protein, 11 aa, Artificial Sequence
  Peptide Derived from Human Papillomavirus
TTIHNIELQCV

SEQ ID NO: 6685 - protein, 9 aa, Artificial Sequence
  Peptide Derived from Human Papillomavirus
TVKKPLNEI

SEQ ID NO: 6686 - protein, 10 aa, Artificial Sequence
  Peptide Derived from Human Papillomavirus
TVKKPLNEIL

SEQ ID NO: 6687 - protein, 11 aa, Artificial Sequence
  Peptide Derived from Human Papillomavirus
TVKKPLNEILI

SEQ ID NO: 6688 - protein, 11 aa, Artificial Sequence
  Peptide Derived from Human Papillomavirus
VVYREGNPFGI

SEQ ID NO: 6689 - protein, 10 aa, Artificial Sequence
  Peptide Derived from Human Papillomavirus
AQPATADYYI

SEQ ID NO: 6690 - protein, 11 aa, Artificial Sequence
  Peptide Derived from Human Papillomavirus
AQPATADYYIV

SEQ ID NO: 6691 - protein, 8 aa, Artificial Sequence
  Peptide Derived from Human Papillomavirus
ATADYYIV

SEQ ID NO: 6692 - protein, 9 aa, Artificial Sequence
  Peptide Derived from Human Papillomavirus
ATADYYIVT

SEQ ID NO: 6693 - protein, 9 aa, Artificial Sequence
  Peptide Derived from Human Papillomavirus
CVNSTASDL

SEQ ID NO: 6694 - protein, 11 aa, Artificial Sequence
  Peptide Derived from Human Papillomavirus
CVNSTASDLRT

SEQ ID NO: 6695 - protein, 8 aa, Artificial Sequence
  Peptide Derived from Human Papillomavirus
DLRTIQQL

SEQ ID NO: 6696 - protein, 9 aa, Artificial Sequence
  Peptide Derived from Human Papillomavirus
DLRTIQQLL

SEQ ID NO: 6697 - protein, 10 aa, Artificial Sequence
  Peptide Derived from Human Papillomavirus
DLRTIQQLLM

SEQ ID NO: 6698 - protein, 8 aa, Artificial Sequence
  Peptide Derived from Human Papillomavirus
DLYCYEQL

SEQ ID NO: 6699 - protein, 9 aa, Artificial Sequence
  Peptide Derived from Human Papillomavirus
DLYPEPTDL

SEQ ID NO: 6700 - protein, 9 aa, Artificial Sequence
  Peptide Derived from Human Papillomavirus
GLDRPDGQA

SEQ ID NO: 6701 - protein, 8 aa, Artificial Sequence
  Peptide Derived from Human Papillomavirus
GQAQPATA

SEQ ID NO: 6702 - protein, 9 aa, Artificial Sequence
  Peptide Derived from Human Papillomavirus
GTVNIVCPT

SEQ ID NO: 6703 - protein, 11 aa, Artificial Sequence
  Peptide Derived from Human Papillomavirus
GTVNIVCPTCA

SEQ ID NO: 6704 - protein, 9 aa, Artificial Sequence
  Peptide Derived from Human Papillomavirus
HTCNTTVRL

SEQ ID NO: 6705 - protein, 11 aa, Artificial Sequence
  Peptide Derived from Human Papillomavirus
HTCNTTVRLCV

SEQ ID NO: 6706 - protein, 8 aa, Artificial Sequence
  Peptide Derived from Human Papillomavirus
IQQLLMGT

SEQ ID NO: 6707 - protein, 9 aa, Artificial Sequence
  Peptide Derived from Human Papillomavirus
IQQLLMGTV

SEQ ID NO: 6708 - protein, 11 aa, Artificial Sequence
  Peptide Derived from Human Papillomavirus
IQQLLMGTVNI

SEQ ID NO: 6709 - protein, 10 aa, Artificial Sequence
  Peptide Derived from Human Papillomavirus
IVTCCHTCNT

SEQ ID NO: 6710 - protein, 11 aa, Artificial Sequence
  Peptide Derived from Human Papillomavirus
IVTCCHTCNTT

SEQ ID NO: 6711 - protein, 8 aa, Artificial Sequence
  Peptide Derived from Human Papillomavirus
LLMGTVNI

SEQ ID NO: 6712 - protein, 9 aa, Artificial Sequence
  Peptide Derived from Human Papillomavirus
LLMGTVNIV

SEQ ID NO: 6713 - protein, 8 aa, Artificial Sequence
  Peptide Derived from Human Papillomavirus
LMGTVNIV

SEQ ID NO: 6714 - protein, 11 aa, Artificial Sequence
  Peptide Derived from Human Papillomavirus
LMGTVNIVCPT

SEQ ID NO: 6715 - protein, 8 aa, Artificial Sequence
  Peptide Derived from Human Papillomavirus
NIVCPTCA

SEQ ID NO: 6716 - protein, 8 aa, Artificial Sequence
  Peptide Derived from Human Papillomavirus
NTTVRLCV

SEQ ID NO: 6717 - protein, 11 aa, Artificial Sequence
  Peptide Derived from Human Papillomavirus
NTTVRLCVNST

SEQ ID NO: 6718 - protein, 8 aa, Artificial Sequence
  Peptide Derived from Human Papillomavirus
PATADYYI

SEQ ID NO: 6719 - protein, 9 aa, Artificial Sequence
  Peptide Derived from Human Papillomavirus
PATADYYIV

SEQ ID NO: 6720 - protein, 10 aa, Artificial Sequence
  Peptide Derived from Human Papillomavirus
PATADYYIVT

SEQ ID NO: 6721 - protein, 10 aa, Artificial Sequence
  Peptide Derived from Human Papillomavirus
PTDLYCYEQL

SEQ ID NO: 6722 - protein, 8 aa, Artificial Sequence
  Peptide Derived from Human Papillomavirus
PTLKEYVL

SEQ ID NO: 6723 - protein, 10 aa, Artificial Sequence
  Peptide Derived from Human Papillomavirus
PTLKEYVLDL

SEQ ID NO: 6724 - protein, 11 aa, Artificial Sequence
  Peptide Derived from Human Papillomavirus
QAQPATADYYI

SEQ ID NO: 6725 - protein, 9 aa, Artificial Sequence
  Peptide Derived from Human Papillomavirus
QLLMGTVNI

SEQ ID NO: 6726 - protein, 10 aa, Artificial Sequence
  Peptide Derived from Human Papillomavirus
QLLMGTVNIV

SEQ ID NO: 6727 - protein, 8 aa, Artificial Sequence
  Peptide Derived from Human Papillomavirus
QQLLMGTV

SEQ ID NO: 6728 - protein, 10 aa, Artificial Sequence
  Peptide Derived from Human Papillomavirus
QQLLMGTVNI

SEQ ID NO: 6729 - protein, 11 aa, Artificial Sequence
  Peptide Derived from Human Papillomavirus
QQLLMGTVNIV

SEQ ID NO: 6730 - protein, 8 aa, Artificial Sequence
  Peptide Derived from Human Papillomavirus
RLCVNSTA

SEQ ID NO: 6731 - protein, 11 aa, Artificial Sequence
  Peptide Derived from Human Papillomavirus
RLCVNSTASDL

SEQ ID NO: 6732 - protein, 8 aa, Artificial Sequence
  Peptide Derived from Human Papillomavirus
RTIQQLLM

SEQ ID NO: 6733 - protein, 10 aa, Artificial Sequence
  Peptide Derived from Human Papillomavirus
RTIQQLLMGT

SEQ ID NO: 6734 - protein, 11 aa, Artificial Sequence
  Peptide Derived from Human Papillomavirus
RTIQQLLMGTV

SEQ ID NO: 6735 - protein, 8 aa, Artificial Sequence
  Peptide Derived from Human Papillomavirus
STASDLRT

SEQ ID NO: 6736 - protein, 9 aa, Artificial Sequence
  Peptide Derived from Human Papillomavirus
STASDLRTI

SEQ ID NO: 6737 - protein, 8 aa, Artificial Sequence
  Peptide Derived from Human Papillomavirus
TADYYIVT

SEQ ID NO: 6738 - protein, 8 aa, Artificial Sequence
  Peptide Derived from Human Papillomavirus
TASDLRTI

SEQ ID NO: 6739 - protein, 11 aa, Artificial Sequence
  Peptide Derived from Human Papillomavirus
TASDLRTIQQL

SEQ ID NO: 6740 - protein, 9 aa, Artificial Sequence
  Peptide Derived from Human Papillomavirus
TIQQLLMGT

SEQ ID NO: 6741 - protein, 10 aa, Artificial Sequence
  Peptide Derived from Human Papillomavirus
TIQQLLMGTV

SEQ ID NO: 6742 - protein, 9 aa, Artificial Sequence
  Peptide Derived from Human Papillomavirus
TLKEYVLDL

SEQ ID NO: 6743 - protein, 10 aa, Artificial Sequence
  Peptide Derived from Human Papillomavirus
TTVRLCVNST

SEQ ID NO: 6744 - protein, 11 aa, Artificial Sequence
  Peptide Derived from Human Papillomavirus
TTVRLCVNSTA

SEQ ID NO: 6745 - protein, 8 aa, Artificial Sequence
  Peptide Derived from Human Papillomavirus
TVNIVCPT

SEQ ID NO: 6746 - protein, 10 aa, Artificial Sequence
  Peptide Derived from Human Papillomavirus
TVNIVCPTCA

SEQ ID NO: 6747 - protein, 9 aa, Artificial Sequence
  Peptide Derived from Human Papillomavirus
TVRLCVNST

SEQ ID NO: 6748 - protein, 10 aa, Artificial Sequence
  Peptide Derived from Human Papillomavirus
TVRLCVNSTA

SEQ ID NO: 6749 - protein, 9 aa, Artificial Sequence
  Peptide Derived from Human Papillomavirus
VLDLYPEPT

SEQ ID NO: 6750 - protein, 11 aa, Artificial Sequence
  Peptide Derived from Human Papillomavirus
VLDLYPEPTDL

SEQ ID NO: 6751 - protein, 9 aa, Artificial Sequence
  Peptide Derived from Human Papillomavirus
VTCCHTCNT

SEQ ID NO: 6752 - protein, 10 aa, Artificial Sequence
  Peptide Derived from Human Papillomavirus
VTCCHTCNTT

SEQ ID NO: 6753 - protein, 11 aa, Artificial Sequence
  Peptide Derived from Human Papillomavirus
VTCCHTCNTTV

SEQ ID NO: 6754 - protein, 8 aa, Artificial Sequence
  Peptide Derived from Human Papillomavirus
YIVTCCHT

SEQ ID NO: 6755 - protein, 11 aa, Artificial Sequence
  Peptide Derived from Human Papillomavirus
YIVTCCHTCNT

SEQ ID NO: 6756 - protein, 10 aa, Artificial Sequence
  Peptide Derived from Human Papillomavirus
YVLDLYPEPT

SEQ ID NO: 6757 - protein, 10 aa, Artificial Sequence
  Peptide Derived from Human Papillomavirus
AAPANDCPPL

SEQ ID NO: 6758 - protein, 8 aa, Artificial Sequence
  Peptide Derived from Human Papillomavirus
AAPTSTRT

SEQ ID NO: 6759 - protein, 11 aa, Artificial Sequence
  Peptide Derived from Human Papillomavirus
AAPTSTRTSSA

SEQ ID NO: 6760 - protein, 8 aa, Artificial Sequence
  Peptide Derived from Human Papillomavirus
AITCQKTV

SEQ ID NO: 6761 - protein, 8 aa, Artificial Sequence
  Peptide Derived from Human Papillomavirus
AQGHNNGI

SEQ ID NO: 6762 - protein, 8 aa, Artificial Sequence
  Peptide Derived from Human Papillomavirus
ATVYLPPV

SEQ ID NO: 6763 - protein, 10 aa, Artificial Sequence
  Peptide Derived from Human Papillomavirus
ATVYLPPVPV

SEQ ID NO: 6764 - protein, 9 aa, Artificial Sequence
  Peptide Derived from Human Papillomavirus
AVGHPYFSI

SEQ ID NO: 6765 - protein, 8 aa, Artificial Sequence
  Peptide Derived from Human Papillomavirus
AVPDDLYI

SEQ ID NO: 6766 - protein, 9 aa, Artificial Sequence
  Peptide Derived from Human Papillomavirus
CLLGCKPPT

SEQ ID NO: 6767 - protein, 9 aa, Artificial Sequence
  Peptide Derived from Human Papillomavirus
CLSMDYKQT

SEQ ID NO: 6768 - protein, 11 aa, Artificial Sequence
  Peptide Derived from Human Papillomavirus
CLSMDYKQTQL

SEQ ID NO: 6769 - protein, 9 aa, Artificial Sequence
  Peptide Derived from Human Papillomavirus
CMDFKTLQA

SEQ ID NO: 6770 - protein, 9 aa, Artificial Sequence
  Peptide Derived from Human Papillomavirus
CTQVTSDST

SEQ ID NO: 6771 - protein, 10 aa, Artificial Sequence
  Peptide Derived from Human Papillomavirus
DILEDWQFGL

SEQ ID NO: 6772 - protein, 11 aa, Artificial Sequence
  Peptide Derived from Human Papillomavirus
DILEDWQFGLT

SEQ ID NO: 6773 - protein, 8 aa, Artificial Sequence
  Peptide Derived from Human Papillomavirus
DLKEKFSA

SEQ ID NO: 6774 - protein, 10 aa, Artificial Sequence
  Peptide Derived from Human Papillomavirus
DLKEKFSADL

SEQ ID NO: 6775 - protein, 8 aa, Artificial Sequence
  Peptide Derived from Human Papillomavirus
DLQFVFQL

SEQ ID NO: 6776 - protein, 11 aa, Artificial Sequence
  Peptide Derived from Human Papillomavirus
DLQFVFQLCKV

SEQ ID NO: 6777 - protein, 9 aa, Artificial Sequence
  Peptide Derived from Human Papillomavirus
DLYIKGSGT

SEQ ID NO: 6778 - protein, 10 aa, Artificial Sequence
  Peptide Derived from Human Papillomavirus
DLYIKGSGTT

SEQ ID NO: 6779 - protein, 11 aa, Artificial Sequence
  Peptide Derived from Human Papillomavirus
DLYIKGSGTTA

SEQ ID NO: 6780 - protein, 10 aa, Artificial Sequence
  Peptide Derived from Human Papillomavirus
DMVDTGFGCM

SEQ ID NO: 6781 - protein, 10 aa, Artificial Sequence
  Peptide Derived from Human Papillomavirus
DQFPLGRKFL

SEQ ID NO: 6782 - protein, 11 aa, Artificial Sequence
  Peptide Derived from Human Papillomavirus
DQFPLGRKFLL

SEQ ID NO: 6783 - protein, 11 aa, Artificial Sequence
  Peptide Derived from Human Papillomavirus
DTGFGCMDFKT

SEQ ID NO: 6784 - protein, 8 aa, Artificial Sequence
  Peptide Derived from Human Papillomavirus
DTQRLVWA

SEQ ID NO: 6785 - protein, 10 aa, Artificial Sequence
  Peptide Derived from Human Papillomavirus
DTQRLVWACV

SEQ ID NO: 6786 - protein, 9 aa, Artificial Sequence
  Peptide Derived from Human Papillomavirus
DTSFYNPDT

SEQ ID NO: 6787 - protein, 8 aa, Artificial Sequence
  Peptide Derived from Human Papillomavirus
DTTRSTNM

SEQ ID NO: 6788 - protein, 9 aa, Artificial Sequence
  Peptide Derived from Human Papillomavirus
DTTRSTNMT

SEQ ID NO: 6789 - protein, 10 aa, Artificial Sequence
  Peptide Derived from Human Papillomavirus
DTTRSTNMTL

SEQ ID NO: 6790 - protein, 10 aa, Artificial Sequence
  Peptide Derived from Human Papillomavirus
DTYRFVTSQA

SEQ ID NO: 6791 - protein, 11 aa, Artificial Sequence
  Peptide Derived from Human Papillomavirus
DTYRFVTSQAI

SEQ ID NO: 6792 - protein, 10 aa, Artificial Sequence
  Peptide Derived from Human Papillomavirus
DVPIDICGST

SEQ ID NO: 6793 - protein, 9 aa, Artificial Sequence
  Peptide Derived from Human Papillomavirus
EATVYLPPV

SEQ ID NO: 6794 - protein, 11 aa, Artificial Sequence
  Peptide Derived from Human Papillomavirus
EATVYLPPVPV

SEQ ID NO: 6795 - protein, 9 aa, Artificial Sequence
  Peptide Derived from Human Papillomavirus
EAVPDDLYI

SEQ ID NO: 6796 - protein, 8 aa, Artificial Sequence
  Peptide Derived from Human Papillomavirus
EIGRGQPL

SEQ ID NO: 6797 - protein, 10 aa, Artificial Sequence
  Peptide Derived from Human Papillomavirus
EIGRGQPLGV

SEQ ID NO: 6798 - protein, 10 aa, Artificial Sequence
  Peptide Derived from Human Papillomavirus
EVDLKEKFSA

SEQ ID NO: 6799 - protein, 8 aa, Artificial Sequence
  Peptide Derived from Human Papillomavirus
EVMTYIHA

SEQ ID NO: 6800 - protein, 9 aa, Artificial Sequence
  Peptide Derived from Human Papillomavirus
EVMTYIHAM

SEQ ID NO: 6801 - protein, 9 aa, Artificial Sequence
  Peptide Derived from Human Papillomavirus
FLLQAGLKA

SEQ ID NO: 6802 - protein, 9 aa, Artificial Sequence
  Peptide Derived from Human Papillomavirus
FLRREQMFV

SEQ ID NO: 6803 - protein, 8 aa, Artificial Sequence
  Peptide Derived from Human Papillomavirus
FQLCKVTL

SEQ ID NO: 6804 - protein, 9 aa, Artificial Sequence
  Peptide Derived from Human Papillomavirus
FQLCKVTLT

SEQ ID NO: 6805 - protein, 10 aa, Artificial Sequence
  Peptide Derived from Human Papillomavirus
FQLCKVTLTA

SEQ ID NO: 6806 - protein, 8 aa, Artificial Sequence
  Peptide Derived from Human Papillomavirus
FVFQLCKV

SEQ ID NO: 6807 - protein, 9 aa, Artificial Sequence
  Peptide Derived from Human Papillomavirus
FVFQLCKVT

SEQ ID NO: 6808 - protein, 10 aa, Artificial Sequence
  Peptide Derived from Human Papillomavirus
FVFQLCKVTL

SEQ ID NO: 6809 - protein, 11 aa, Artificial Sequence
  Peptide Derived from Human Papillomavirus
FVFQLCKVTLT

SEQ ID NO: 6810 - protein, 9 aa, Artificial Sequence
  Peptide Derived from Human Papillomavirus
FVRHFFNRA

SEQ ID NO: 6811 - protein, 11 aa, Artificial Sequence
  Peptide Derived from Human Papillomavirus
FVRHFFNRAGT

SEQ ID NO: 6812 - protein, 8 aa, Artificial Sequence
  Peptide Derived from Human Papillomavirus
FVTSQAIT

SEQ ID NO: 6813 - protein, 8 aa, Artificial Sequence
  Peptide Derived from Human Papillomavirus
FVTVVDTT

SEQ ID NO: 6814 - protein, 11 aa, Artificial Sequence
  Peptide Derived from Human Papillomavirus
FVTVVDTTRST

SEQ ID NO: 6815 - protein, 8 aa, Artificial Sequence
  Peptide Derived from Human Papillomavirus
GADNRECL

SEQ ID NO: 6816 - protein, 10 aa, Artificial Sequence
  Peptide Derived from Human Papillomavirus
GADNRECLSM

SEQ ID NO: 6817 - protein, 8 aa, Artificial Sequence
  Peptide Derived from Human Papillomavirus
GICWGNQV

SEQ ID NO: 6818 - protein, 10 aa, Artificial Sequence
  Peptide Derived from Human Papillomavirus
GICWGNQVFV

SEQ ID NO: 6819 - protein, 11 aa, Artificial Sequence
  Peptide Derived from Human Papillomavirus
GICWGNQVFVT

SEQ ID NO: 6820 - protein, 8 aa, Artificial Sequence
  Peptide Derived from Human Papillomavirus
GISGHPLL

SEQ ID NO: 6821 - protein, 10 aa, Artificial Sequence
  Peptide Derived from Human Papillomavirus
GLEIGRGQPL

SEQ ID NO: 6822 - protein, 8 aa, Artificial Sequence
  Peptide Derived from Human Papillomavirus
GLKAKPKL

SEQ ID NO: 6823 - protein, 11 aa, Artificial Sequence
  Peptide Derived from Human Papillomavirus
GLKAKPKLKRA

SEQ ID NO: 6824 - protein, 9 aa, Artificial Sequence
  Peptide Derived from Human Papillomavirus
GLQYRVFRV

SEQ ID NO: 6825 - protein, 11 aa, Artificial Sequence
  Peptide Derived from Human Papillomavirus
GLQYRVFRVRL

SEQ ID NO: 6826 - protein, 8 aa, Artificial Sequence
  Peptide Derived from Human Papillomavirus
GLTPPPSA

SEQ ID NO: 6827 - protein, 10 aa, Artificial Sequence
  Peptide Derived from Human Papillomavirus
GLTPPPSASL

SEQ ID NO: 6828 - protein, 11 aa, Artificial Sequence
  Peptide Derived from Human Papillomavirus
GQPGADNRECL

SEQ ID NO: 6829 - protein, 8 aa, Artificial Sequence
  Peptide Derived from Human Papillomavirus
GQPLGVGI

SEQ ID NO: 6830 - protein, 11 aa, Artificial Sequence
  Peptide Derived from Human Papillomavirus
GTLGEAVPDDL

SEQ ID NO: 6831 - protein, 10 aa, Artificial Sequence
  Peptide Derived from Human Papillomavirus
GTTASIQSSA

SEQ ID NO: 6832 - protein, 8 aa, Artificial Sequence
  Peptide Derived from Human Papillomavirus
GVACTNAA

SEQ ID NO: 6833 - protein, 10 aa, Artificial Sequence
  Peptide Derived from Human Papillomavirus
GVACTNAAPA

SEQ ID NO: 6834 - protein, 9 aa, Artificial Sequence
  Peptide Derived from Human Papillomavirus
GVGISGHPL

SEQ ID NO: 6835 - protein, 10 aa, Artificial Sequence
  Peptide Derived from Human Papillomavirus
GVGISGHPLL

SEQ ID NO: 6836 - protein, 8 aa, Artificial Sequence
  Peptide Derived from Human Papillomavirus
HAMNPDIL

SEQ ID NO: 6837 - protein, 10 aa, Artificial Sequence
  Peptide Derived from Human Papillomavirus
HVEEYDLQFV

SEQ ID NO: 6838 - protein, 8 aa, Artificial Sequence
  Peptide Derived from Human Papillomavirus
IIEDGDMV

SEQ ID NO: 6839 - protein, 10 aa, Artificial Sequence
  Peptide Derived from Human Papillomavirus
IIEDGDMVDT

SEQ ID NO: 6840 - protein, 9 aa, Artificial Sequence
  Peptide Derived from Human Papillomavirus
ILEDWQFGL

SEQ ID NO: 6841 - protein, 10 aa, Artificial Sequence
  Peptide Derived from Human Papillomavirus
ILEDWQFGLT

SEQ ID NO: 6842 - protein, 9 aa, Artificial Sequence
  Peptide Derived from Human Papillomavirus
IQSSAFFPT

SEQ ID NO: 6843 - protein, 9 aa, Artificial Sequence
  Peptide Derived from Human Papillomavirus
KAKPKLKRA

SEQ ID NO: 6844 - protein, 10 aa, Artificial Sequence
  Peptide Derived from Human Papillomavirus
KAKPKLKRAA

SEQ ID NO: 6845 - protein, 8 aa, Artificial Sequence
  Peptide Derived from Human Papillomavirus
KLKRAAPT

SEQ ID NO: 6846 - protein, 10 aa, Artificial Sequence
  Peptide Derived from Human Papillomavirus
KLKRAAPTST

SEQ ID NO: 6847 - protein, 10 aa, Artificial Sequence
  Peptide Derived from Human Papillomavirus
KLLVPKVSGL

SEQ ID NO: 6848 - protein, 11 aa, Artificial Sequence
  Peptide Derived from Human Papillomavirus
KMTSEPYGDSL

SEQ ID NO: 6849 - protein, 8 aa, Artificial Sequence
  Peptide Derived from Human Papillomavirus
KQTQLCLL

SEQ ID NO: 6850 - protein, 10 aa, Artificial Sequence
  Peptide Derived from Human Papillomavirus
KTLQANKSDV

SEQ ID NO: 6851 - protein, 9 aa, Artificial Sequence
  Peptide Derived from Human Papillomavirus
KVSGLQYRV

SEQ ID NO: 6852 - protein, 8 aa, Artificial Sequence
  Peptide Derived from Human Papillomavirus
KVTLTAEV

SEQ ID NO: 6853 - protein, 9 aa, Artificial Sequence
  Peptide Derived from Human Papillomavirus
KVTLTAEVM

SEQ ID NO: 6854 - protein, 10 aa, Artificial Sequence
  Peptide Derived from Human Papillomavirus
KVTLTAEVMT

SEQ ID NO: 6855 - protein, 9 aa, Artificial Sequence
  Peptide Derived from Human Papillomavirus
KVVSTDEYV

SEQ ID NO: 6856 - protein, 10 aa, Artificial Sequence
  Peptide Derived from Human Papillomavirus
LAVGHPYFSI

SEQ ID NO: 6857 - protein, 11 aa, Artificial Sequence
  Peptide Derived from Human Papillomavirus
LINTIIEDGDM

SEQ ID NO: 6858 - protein, 11 aa, Artificial Sequence
  Peptide Derived from Human Papillomavirus
LLAVGHPYFSI

SEQ ID NO: 6859 - protein, 8 aa, Artificial Sequence
  Peptide Derived from Human Papillomavirus
LLGCKPPT

SEQ ID NO: 6860 - protein, 8 aa, Artificial Sequence
  Peptide Derived from Human Papillomavirus
LLNKFDDT

SEQ ID NO: 6861 - protein, 10 aa, Artificial Sequence
  Peptide Derived from Human Papillomavirus
LLNKFDDTET

SEQ ID NO: 6862 - protein, 8 aa, Artificial Sequence
  Peptide Derived from Human Papillomavirus
LLQAGLKA

SEQ ID NO: 6863 - protein, 9 aa, Artificial Sequence
  Peptide Derived from Human Papillomavirus
LLVPKVSGL

SEQ ID NO: 6864 - protein, 11 aa, Artificial Sequence
  Peptide Derived from Human Papillomavirus
LQAGLKAKPKL

SEQ ID NO: 6865 - protein, 8 aa, Artificial Sequence
  Peptide Derived from Human Papillomavirus
LQANKSDV

SEQ ID NO: 6866 - protein, 10 aa, Artificial Sequence
  Peptide Derived from Human Papillomavirus
LQANKSDVPI

SEQ ID NO: 6867 - protein, 8 aa, Artificial Sequence
  Peptide Derived from Human Papillomavirus
LQDTYRFV

SEQ ID NO: 6868 - protein, 9 aa, Artificial Sequence
  Peptide Derived from Human Papillomavirus
LQDTYRFVT

SEQ ID NO: 6869 - protein, 10 aa, Artificial Sequence
  Peptide Derived from Human Papillomavirus
LQFVFQLCKV

SEQ ID NO: 6870 - protein, 11 aa, Artificial Sequence
  Peptide Derived from Human Papillomavirus
LQFVFQLCKVT

SEQ ID NO: 6871 - protein, 11 aa, Artificial Sequence
  Peptide Derived from Human Papillomavirus
LQRAQGHNNGI

SEQ ID NO: 6872 - protein, 8 aa, Artificial Sequence
  Peptide Derived from Human Papillomavirus
LQYRVFRV

SEQ ID NO: 6873 - protein, 10 aa, Artificial Sequence
  Peptide Derived from Human Papillomavirus
LQYRVFRVRL

SEQ ID NO: 6874 - protein, 9 aa, Artificial Sequence
  Peptide Derived from Human Papillomavirus
LTAEVMTYI

SEQ ID NO: 6875 - protein, 11 aa, Artificial Sequence
  Peptide Derived from Human Papillomavirus
LTAEVMTYIHA

SEQ ID NO: 6876 - protein, 9 aa, Artificial Sequence
  Peptide Derived from Human Papillomavirus
LTPPPSASL

SEQ ID NO: 6877 - protein, 8 aa, Artificial Sequence
  Peptide Derived from Human Papillomavirus
LVPKVSGL

SEQ ID NO: 6878 - protein, 8 aa, Artificial Sequence
  Peptide Derived from Human Papillomavirus
LVWACVGL

SEQ ID NO: 6879 - protein, 10 aa, Artificial Sequence
  Peptide Derived from Human Papillomavirus
LVWACVGLEI

SEQ ID NO: 6880 - protein, 8 aa, Artificial Sequence
  Peptide Derived from Human Papillomavirus
MTLCTQVT

SEQ ID NO: 6881 - protein, 10 aa, Artificial Sequence
  Peptide Derived from Human Papillomavirus
MTSEPYGDSL

SEQ ID NO: 6882 - protein, 11 aa, Artificial Sequence
  Peptide Derived from Human Papillomavirus
MTYIHAMNPDI

SEQ ID NO: 6883 - protein, 9 aa, Artificial Sequence
  Peptide Derived from Human Papillomavirus
MVDTGFGCM

SEQ ID NO: 6884 - protein, 8 aa, Artificial Sequence
  Peptide Derived from Human Papillomavirus
MVTSESQL

SEQ ID NO: 6885 - protein, 11 aa, Artificial Sequence
  Peptide Derived from Human Papillomavirus
NAAPANDCPPL

SEQ ID NO: 6886 - protein, 10 aa, Artificial Sequence
  Peptide Derived from Human Papillomavirus
NAKKLLVPKV

SEQ ID NO: 6887 - protein, 8 aa, Artificial Sequence
  Peptide Derived from Human Papillomavirus
NMTLCTQV

SEQ ID NO: 6888 - protein, 9 aa, Artificial Sequence
  Peptide Derived from Human Papillomavirus
NMTLCTQVT

SEQ ID NO: 6889 - protein, 8 aa, Artificial Sequence
  Peptide Derived from Human Papillomavirus
NQVFVTVV

SEQ ID NO: 6890 - protein, 10 aa, Artificial Sequence
  Peptide Derived from Human Papillomavirus
NQVFVTVVDT

SEQ ID NO: 6891 - protein, 11 aa, Artificial Sequence
  Peptide Derived from Human Papillomavirus
NQVFVTVVDTT

SEQ ID NO: 6892 - protein, 9 aa, Artificial Sequence
  Peptide Derived from Human Papillomavirus
NTIIEDGDM

SEQ ID NO: 6893 - protein, 10 aa, Artificial Sequence
  Peptide Derived from Human Papillomavirus
NTIIEDGDMV

SEQ ID NO: 6894 - protein, 8 aa, Artificial Sequence
  Peptide Derived from Human Papillomavirus
PANDCPPL

SEQ ID NO: 6895 - protein, 10 aa, Artificial Sequence
  Peptide Derived from Human Papillomavirus
PANDCPPLEL

SEQ ID NO: 6896 - protein, 11 aa, Artificial Sequence
  Peptide Derived from Human Papillomavirus
PANDCPPLELI

SEQ ID NO: 6897 - protein, 8 aa, Artificial Sequence
  Peptide Derived from Human Papillomavirus
PIDICGST

SEQ ID NO: 6898 - protein, 8 aa, Artificial Sequence
  Peptide Derived from Human Papillomavirus
PLELINTI

SEQ ID NO: 6899 - protein, 9 aa, Artificial Sequence
  Peptide Derived from Human Papillomavirus
PLELINTII

SEQ ID NO: 6900 - protein, 10 aa, Artificial Sequence
  Peptide Derived from Human Papillomavirus
PLGKYTFWEV

SEQ ID NO: 6901 - protein, 8 aa, Artificial Sequence
  Peptide Derived from Human Papillomavirus
PLGRKFLL

SEQ ID NO: 6902 - protein, 10 aa, Artificial Sequence
  Peptide Derived from Human Papillomavirus
PLGRKFLLQA

SEQ ID NO: 6903 - protein, 11 aa, Artificial Sequence
  Peptide Derived from Human Papillomavirus
PLGVGISGHPL

SEQ ID NO: 6904 - protein, 9 aa, Artificial Sequence
  Peptide Derived from Human Papillomavirus
PLLNKFDDT

SEQ ID NO: 6905 - protein, 11 aa, Artificial Sequence
  Peptide Derived from Human Papillomavirus
PLLNKFDDTET

SEQ ID NO: 6906 - protein, 10 aa, Artificial Sequence
  Peptide Derived from Human Papillomavirus
PTGEHWGKGV

SEQ ID NO: 6907 - protein, 11 aa, Artificial Sequence
  Peptide Derived from Human Papillomavirus
PTGEHWGKGVA

SEQ ID NO: 6908 - protein, 8 aa, Artificial Sequence
  Peptide Derived from Human Papillomavirus
PTNAKKLL

SEQ ID NO: 6909 - protein, 9 aa, Artificial Sequence
  Peptide Derived from Human Papillomavirus
PTNAKKLLV

SEQ ID NO: 6910 - protein, 8 aa, Artificial Sequence
  Peptide Derived from Human Papillomavirus
PTPSGSMV

SEQ ID NO: 6911 - protein, 9 aa, Artificial Sequence
  Peptide Derived from Human Papillomavirus
PTPSGSMVT

SEQ ID NO: 6912 - protein, 9 aa, Artificial Sequence
  Peptide Derived from Human Papillomavirus
PTSTRTSSA

SEQ ID NO: 6913 - protein, 8 aa, Artificial Sequence
  Peptide Derived from Human Papillomavirus
PVPVSKVV

SEQ ID NO: 6914 - protein, 10 aa, Artificial Sequence
  Peptide Derived from Human Papillomavirus
PVPVSKVVST

SEQ ID NO: 6915 - protein, 8 aa, Artificial Sequence
  Peptide Derived from Human Papillomavirus
PVSKVVST

SEQ ID NO: 6916 - protein, 10 aa, Artificial Sequence
  Peptide Derived from Human Papillomavirus
QAGLKAKPKL

SEQ ID NO: 6917 - protein, 8 aa, Artificial Sequence
  Peptide Derived from Human Papillomavirus
QAITCQKT

SEQ ID NO: 6918 - protein, 9 aa, Artificial Sequence
  Peptide Derived from Human Papillomavirus
QAITCQKTV

SEQ ID NO: 6919 - protein, 9 aa, Artificial Sequence
  Peptide Derived from Human Papillomavirus
QANKSDVPI

SEQ ID NO: 6920 - protein, 11 aa, Artificial Sequence
  Peptide Derived from Human Papillomavirus
QANKSDVPIDI

SEQ ID NO: 6921 - protein, 8 aa, Artificial Sequence
  Peptide Derived from Human Papillomavirus
QLCKVTLT

SEQ ID NO: 6922 - protein, 9 aa, Artificial Sequence
  Peptide Derived from Human Papillomavirus
QLCKVTLTA

SEQ ID NO: 6923 - protein, 11 aa, Artificial Sequence
  Peptide Derived from Human Papillomavirus
QLCKVTLTAEV

SEQ ID NO: 6924 - protein, 11 aa, Artificial Sequence
  Peptide Derived from Human Papillomavirus
QLCLLGCKPPT

SEQ ID NO: 6925 - protein, 9 aa, Artificial Sequence
  Peptide Derived from Human Papillomavirus
QLFNKPYWL

SEQ ID NO: 6926 - protein, 11 aa, Artificial Sequence
  Peptide Derived from Human Papillomavirus
QMFVRHFFNRA

SEQ ID NO: 6927 - protein, 9 aa, Artificial Sequence
  Peptide Derived from Human Papillomavirus
QVFVTVVDT

SEQ ID NO: 6928 - protein, 10 aa, Artificial Sequence
  Peptide Derived from Human Papillomavirus
QVFVTVVDTT

SEQ ID NO: 6929 - protein, 9 aa, Artificial Sequence
  Peptide Derived from Human Papillomavirus
RAAPTSTRT

SEQ ID NO: 6930 - protein, 8 aa, Artificial Sequence
  Peptide Derived from Human Papillomavirus
RAGTLGEA

SEQ ID NO: 6931 - protein, 9 aa, Artificial Sequence
  Peptide Derived from Human Papillomavirus
RAGTLGEAV

SEQ ID NO: 6932 - protein, 9 aa, Artificial Sequence
  Peptide Derived from Human Papillomavirus
RAQGHNNGI

SEQ ID NO: 6933 - protein, 9 aa, Artificial Sequence
  Peptide Derived from Human Papillomavirus
RLVWACVGL

SEQ ID NO: 6934 - protein, 11 aa, Artificial Sequence
  Peptide Derived from Human Papillomavirus
RLVWACVGLEI

SEQ ID NO: 6935 - protein, 8 aa, Artificial Sequence
  Peptide Derived from Human Papillomavirus
RTSIYYYA

SEQ ID NO: 6936 - protein, 10 aa, Artificial Sequence
  Peptide Derived from Human Papillomavirus
RTSSAKRKKV

SEQ ID NO: 6937 - protein, 9 aa, Artificial Sequence
  Peptide Derived from Human Papillomavirus
SADLDQFPL

SEQ ID NO: 6938 - protein, 11 aa, Artificial Sequence
  Peptide Derived from Human Papillomavirus
SAFFPTPSGSM

SEQ ID NO: 6939 - protein, 11 aa, Artificial Sequence
  Peptide Derived from Human Papillomavirus
SASLQDTYRFV

SEQ ID NO: 6940 - protein, 8 aa, Artificial Sequence
  Peptide Derived from Human Papillomavirus
SIKNPTNA

SEQ ID NO: 6941 - protein, 11 aa, Artificial Sequence
  Peptide Derived from Human Papillomavirus
SIKNPTNAKKL

SEQ ID NO: 6942 - protein, 10 aa, Artificial Sequence
  Peptide Derived from Human Papillomavirus
SIQSSAFFPT

SEQ ID NO: 6943 - protein, 11 aa, Artificial Sequence
  Peptide Derived from Human Papillomavirus
SIYYYAGSSRL

SEQ ID NO: 6944 - protein, 11 aa, Artificial Sequence
  Peptide Derived from Human Papillomavirus
SLFFFLRREQM

SEQ ID NO: 6945 - protein, 9 aa, Artificial Sequence
  Peptide Derived from Human Papillomavirus
SLQDTYRFV

SEQ ID NO: 6946 - protein, 10 aa, Artificial Sequence
  Peptide Derived from Human Papillomavirus
SLQDTYRFVT

SEQ ID NO: 6947 - protein, 9 aa, Artificial Sequence
  Peptide Derived from Human Papillomavirus
SMDYKQTQL

SEQ ID NO: 6948 - protein, 11 aa, Artificial Sequence
  Peptide Derived from Human Papillomavirus
SMDYKQTQLCL

SEQ ID NO: 6949 - protein, 9 aa, Artificial Sequence
  Peptide Derived from Human Papillomavirus
SMVTSESQL

SEQ ID NO: 6950 - protein, 9 aa, Artificial Sequence
  Peptide Derived from Human Papillomavirus
SQAITCQKT

SEQ ID NO: 6951 - protein, 10 aa, Artificial Sequence
  Peptide Derived from Human Papillomavirus
SQAITCQKTV

SEQ ID NO: 6952 - protein, 10 aa, Artificial Sequence
  Peptide Derived from Human Papillomavirus
SQLFNKPYWL

SEQ ID NO: 6953 - protein, 9 aa, Artificial Sequence
  Peptide Derived from Human Papillomavirus
STCKYPDYL

SEQ ID NO: 6954 - protein, 11 aa, Artificial Sequence
  Peptide Derived from Human Papillomavirus
STCKYPDYLKM

SEQ ID NO: 6955 - protein, 9 aa, Artificial Sequence
  Peptide Derived from Human Papillomavirus
STDEYVSRT

SEQ ID NO: 6956 - protein, 11 aa, Artificial Sequence
  Peptide Derived from Human Papillomavirus
STDEYVSRTSI

SEQ ID NO: 6957 - protein, 8 aa, Artificial Sequence
  Peptide Derived from Human Papillomavirus
STNMTLCT

SEQ ID NO: 6958 - protein, 10 aa, Artificial Sequence
  Peptide Derived from Human Papillomavirus
STNMTLCTQV

SEQ ID NO: 6959 - protein, 11 aa, Artificial Sequence
  Peptide Derived from Human Papillomavirus
STNMTLCTQVT

SEQ ID NO: 6960 - protein, 8 aa, Artificial Sequence
  Peptide Derived from Human Papillomavirus
SVWRPSEA

SEQ ID NO: 6961 - protein, 9 aa, Artificial Sequence
  Peptide Derived from Human Papillomavirus
SVWRPSEAT

SEQ ID NO: 6962 - protein, 10 aa, Artificial Sequence
  Peptide Derived from Human Papillomavirus
SVWRPSEATV

SEQ ID NO: 6963 - protein, 8 aa, Artificial Sequence
  Peptide Derived from Human Papillomavirus
TAEVMTYI

SEQ ID NO: 6964 - protein, 10 aa, Artificial Sequence
  Peptide Derived from Human Papillomavirus
TAEVMTYIHA

SEQ ID NO: 6965 - protein, 11 aa, Artificial Sequence
  Peptide Derived from Human Papillomavirus
TAEVMTYIHAM

SEQ ID NO: 6966 - protein, 8 aa, Artificial Sequence
  Peptide Derived from Human Papillomavirus
TASIQSSA

SEQ ID NO: 6967 - protein, 8 aa, Artificial Sequence
  Peptide Derived from Human Papillomavirus
TIIEDGDM

SEQ ID NO: 6968 - protein, 9 aa, Artificial Sequence
  Peptide Derived from Human Papillomavirus
TIIEDGDMV

SEQ ID NO: 6969 - protein, 11 aa, Artificial Sequence
  Peptide Derived from Human Papillomavirus
TIIEDGDMVDT

SEQ ID NO: 6970 - protein, 11 aa, Artificial Sequence
  Peptide Derived from Human Papillomavirus
TLCTQVTSDST

SEQ ID NO: 6971 - protein, 10 aa, Artificial Sequence
  Peptide Derived from Human Papillomavirus
TLGEAVPDDL

SEQ ID NO: 6972 - protein, 9 aa, Artificial Sequence
  Peptide Derived from Human Papillomavirus
TLQANKSDV

SEQ ID NO: 6973 - protein, 11 aa, Artificial Sequence
  Peptide Derived from Human Papillomavirus
TLQANKSDVPI

SEQ ID NO: 6974 - protein, 8 aa, Artificial Sequence
  Peptide Derived from Human Papillomavirus
TLTAEVMT

SEQ ID NO: 6975 - protein, 10 aa, Artificial Sequence
  Peptide Derived from Human Papillomavirus
TLTAEVMTYI

SEQ ID NO: 6976 - protein, 9 aa, Artificial Sequence
  Peptide Derived from Human Papillomavirus
TQRLVWACV

SEQ ID NO: 6977 - protein, 11 aa, Artificial Sequence
  Peptide Derived from Human Papillomavirus
TQRLVWACVGL

SEQ ID NO: 6978 - protein, 8 aa, Artificial Sequence
  Peptide Derived from Human Papillomavirus
TQVTSDST

SEQ ID NO: 6979 - protein, 9 aa, Artificial Sequence
  Peptide Derived from Human Papillomavirus
TTASIQSSA

SEQ ID NO: 6980 - protein, 8 aa, Artificial Sequence
  Peptide Derived from Human Papillomavirus
TTRSTNMT

SEQ ID NO: 6981 - protein, 9 aa, Artificial Sequence
  Peptide Derived from Human Papillomavirus
TTRSTNMTL

SEQ ID NO: 6982 - protein, 11 aa, Artificial Sequence
  Peptide Derived from Human Papillomavirus
TTRSTNMTLCT

SEQ ID NO: 6983 - protein, 11 aa, Artificial Sequence
  Peptide Derived from Human Papillomavirus
TVPPKEKEDPL

SEQ ID NO: 6984 - protein, 9 aa, Artificial Sequence
  Peptide Derived from Human Papillomavirus
TVVDTTRST

SEQ ID NO: 6985 - protein, 11 aa, Artificial Sequence
  Peptide Derived from Human Papillomavirus
TVVDTTRSTNM

SEQ ID NO: 6986 - protein, 9 aa, Artificial Sequence
  Peptide Derived from Human Papillomavirus
TVYLPPVPV

SEQ ID NO: 6987 - protein, 9 aa, Artificial Sequence
  Peptide Derived from Human Papillomavirus
VACTNAAPA

SEQ ID NO: 6988 - protein, 8 aa, Artificial Sequence
  Peptide Derived from Human Papillomavirus
VMTYIHAM

SEQ ID NO: 6989 - protein, 8 aa, Artificial Sequence
  Peptide Derived from Human Papillomavirus
VTLTAEVM

SEQ ID NO: 6990 - protein, 9 aa, Artificial Sequence
  Peptide Derived from Human Papillomavirus
VTLTAEVMT

SEQ ID NO: 6991 - protein, 11 aa, Artificial Sequence
  Peptide Derived from Human Papillomavirus
VTLTAEVMTYI

SEQ ID NO: 6992 - protein, 11 aa, Artificial Sequence
  Peptide Derived from Human Papillomavirus
VTSQAITCQKT

SEQ ID NO: 6993 - protein, 10 aa, Artificial Sequence
  Peptide Derived from Human Papillomavirus
VTVVDTTRST

SEQ ID NO: 6994 - protein, 8 aa, Artificial Sequence
  Peptide Derived from Human Papillomavirus
VVDTTRST

SEQ ID NO: 6995 - protein, 10 aa, Artificial Sequence
  Peptide Derived from Human Papillomavirus
VVDTTRSTNM

SEQ ID NO: 6996 - protein, 11 aa, Artificial Sequence
  Peptide Derived from Human Papillomavirus
VVDTTRSTNMT

SEQ ID NO: 6997 - protein, 8 aa, Artificial Sequence
  Peptide Derived from Human Papillomavirus
VVSTDEYV

SEQ ID NO: 6998 - protein, 11 aa, Artificial Sequence
  Peptide Derived from Human Papillomavirus
VVSTDEYVSRT

SEQ ID NO: 6999 - protein, 8 aa, Artificial Sequence
  Peptide Derived from Human Papillomavirus
WACVGLEI

SEQ ID NO: 7000 - protein, 11 aa, Artificial Sequence
  Peptide Derived from Human Papillomavirus
WQFGLTPPPSA

SEQ ID NO: 7001 - protein, 8 aa, Artificial Sequence
  Peptide Derived from Human Papillomavirus
YAGSSRLL

SEQ ID NO: 7002 - protein, 9 aa, Artificial Sequence
  Peptide Derived from Human Papillomavirus
YAGSSRLLA

SEQ ID NO: 7003 - protein, 10 aa, Artificial Sequence
  Peptide Derived from Human Papillomavirus
YAGSSRLLAV

SEQ ID NO: 7004 - protein, 9 aa, Artificial Sequence
  Peptide Derived from Human Papillomavirus
YIHAMNPDI

SEQ ID NO: 7005 - protein, 10 aa, Artificial Sequence
  Peptide Derived from Human Papillomavirus
YIHAMNPDIL

SEQ ID NO: 7006 - protein, 8 aa, Artificial Sequence
  Peptide Derived from Human Papillomavirus
YIKGSGTT

SEQ ID NO: 7007 - protein, 9 aa, Artificial Sequence
  Peptide Derived from Human Papillomavirus
YIKGSGTTA

SEQ ID NO: 7008 - protein, 11 aa, Artificial Sequence
  Peptide Derived from Human Papillomavirus
YIKGSGTTASI

SEQ ID NO: 7009 - protein, 10 aa, Artificial Sequence
  Peptide Derived from Human Papillomavirus
YIRHVEEYDL

SEQ ID NO: 7010 - protein, 10 aa, Artificial Sequence
  Peptide Derived from Human Papillomavirus
YLPPVPVSKV

SEQ ID NO: 7011 - protein, 11 aa, Artificial Sequence
  Peptide Derived from Human Papillomavirus
YLPPVPVSKVV

SEQ ID NO: 7012 - protein, 8 aa, Artificial Sequence
  Peptide Derived from Human Papillomavirus
YTFWEVDL

SEQ ID NO: 7013 - protein, 11 aa, Artificial Sequence
  Peptide Derived from Human Papillomavirus
YVSRTSIYYYA

SEQ ID NO: 7014 - protein, 8 aa, Artificial Sequence
  Peptide Derived from Human Papillomavirus
AAIPLQPI

SEQ ID NO: 7015 - protein, 8 aa, Artificial Sequence
  Peptide Derived from Human Papillomavirus
AIINVSSV

SEQ ID NO: 7016 - protein, 11 aa, Artificial Sequence
  Peptide Derived from Human Papillomavirus
AIPLQPIRPPV

SEQ ID NO: 7017 - protein, 8 aa, Artificial Sequence
  Peptide Derived from Human Papillomavirus
AITSRRHT

SEQ ID NO: 7018 - protein, 9 aa, Artificial Sequence
  Peptide Derived from Human Papillomavirus
AITSRRHTV

SEQ ID NO: 7019 - protein, 8 aa, Artificial Sequence
  Peptide Derived from Human Papillomavirus
ALHRPAIT

SEQ ID NO: 7020 - protein, 9 aa, Artificial Sequence
  Peptide Derived from Human Papillomavirus
ATGTCPPDV

SEQ ID NO: 7021 - protein, 10 aa, Artificial Sequence
  Peptide Derived from Human Papillomavirus
ATGTCPPDVI

SEQ ID NO: 7022 - protein, 11 aa, Artificial Sequence
  Peptide Derived from Human Papillomavirus
ATLKTRSGKQI

SEQ ID NO: 7023 - protein, 10 aa, Artificial Sequence
  Peptide Derived from Human Papillomavirus
ATQLYQTCKA

SEQ ID NO: 7024 - protein, 11 aa, Artificial Sequence
  Peptide Derived from Human Papillomavirus
ATQLYQTCKAT

SEQ ID NO: 7025 - protein, 8 aa, Artificial Sequence
  Peptide Derived from Human Papillomavirus
ATTRTSNV

SEQ ID NO: 7026 - protein, 10 aa, Artificial Sequence
  Peptide Derived from Human Papillomavirus
ATTRTSNVSI

SEQ ID NO: 7027 - protein, 9 aa, Artificial Sequence
  Peptide Derived from Human Papillomavirus
DIIALHRPA

SEQ ID NO: 7028 - protein, 10 aa, Artificial Sequence
  Peptide Derived from Human Papillomavirus
DIIALHRPAI

SEQ ID NO: 7029 - protein, 11 aa, Artificial Sequence
  Peptide Derived from Human Papillomavirus
DIIALHRPAIT

SEQ ID NO: 7030 - protein, 9 aa, Artificial Sequence
  Peptide Derived from Human Papillomavirus
DIPSPLFPT

SEQ ID NO: 7031 - protein, 11 aa, Artificial Sequence
  Peptide Derived from Human Papillomavirus
DISPAPDPDFL

SEQ ID NO: 7032 - protein, 8 aa, Artificial Sequence
  Peptide Derived from Human Papillomavirus
DLSPIVPL

SEQ ID NO: 7033 - protein, 11 aa, Artificial Sequence
  Peptide Derived from Human Papillomavirus
DLSPIVPLDHT

SEQ ID NO: 7034 - protein, 9 aa, Artificial Sequence
  Peptide Derived from Human Papillomavirus
DQILKYGSL

SEQ ID NO: 7035 - protein, 11 aa, Artificial Sequence
  Peptide Derived from Human Papillomavirus
DQILKYGSLGV

SEQ ID NO: 7036 - protein, 8 aa, Artificial Sequence
  Peptide Derived from Human Papillomavirus
DTIVVDGA

SEQ ID NO: 7037 - protein, 11 aa, Artificial Sequence
  Peptide Derived from Human Papillomavirus
DTIVVDGADFV

SEQ ID NO: 7038 - protein, 10 aa, Artificial Sequence
  Peptide Derived from Human Papillomavirus
DTLQFQHSDI

SEQ ID NO: 7039 - protein, 10 aa, Artificial Sequence
  Peptide Derived from Human Papillomavirus
DTPVMSGPDI

SEQ ID NO: 7040 - protein, 9 aa, Artificial Sequence
  Peptide Derived from Human Papillomavirus
DTSTSSYSI

SEQ ID NO: 7041 - protein, 9 aa, Artificial Sequence
  Peptide Derived from Human Papillomavirus
DTTPAIINV

SEQ ID NO: 7042 - protein, 10 aa, Artificial Sequence
  Peptide Derived from Human Papillomavirus
DTVGPLDSSI

SEQ ID NO: 7043 - protein, 11 aa, Artificial Sequence
  Peptide Derived from Human Papillomavirus
DTVGPLDSSIV

SEQ ID NO: 7044 - protein, 9 aa, Artificial Sequence
  Peptide Derived from Human Papillomavirus
DVDNVHTPM

SEQ ID NO: 7045 - protein, 10 aa, Artificial Sequence
  Peptide Derived from Human Papillomavirus
DVIPKVEGST

SEQ ID NO: 7046 - protein, 11 aa, Artificial Sequence
  Peptide Derived from Human Papillomavirus
DVIPKVEGSTI

SEQ ID NO: 7047 - protein, 8 aa, Artificial Sequence
  Peptide Derived from Human Papillomavirus
DVTTSADT

SEQ ID NO: 7048 - protein, 9 aa, Artificial Sequence
  Peptide Derived from Human Papillomavirus
DVTTSADTT

SEQ ID NO: 7049 - protein, 11 aa, Artificial Sequence
  Peptide Derived from Human Papillomavirus
DVTTSADTTPA

SEQ ID NO: 7050 - protein, 10 aa, Artificial Sequence
  Peptide Derived from Human Papillomavirus
DVYADDVDNV

SEQ ID NO: 7051 - protein, 9 aa, Artificial Sequence
  Peptide Derived from Human Papillomavirus
EAGAPAPSI

SEQ ID NO: 7052 - protein, 11 aa, Artificial Sequence
  Peptide Derived from Human Papillomavirus
EAGAPAPSIPT

SEQ ID NO: 7053 - protein, 8 aa, Artificial Sequence
  Peptide Derived from Human Papillomavirus
ELQPLHDT

SEQ ID NO: 7054 - protein, 10 aa, Artificial Sequence
  Peptide Derived from Human Papillomavirus
ELQPLHDTST

SEQ ID NO: 7055 - protein, 8 aa, Artificial Sequence
  Peptide Derived from Human Papillomavirus
EQYELQPL

SEQ ID NO: 7056 - protein, 11 aa, Artificial Sequence
  Peptide Derived from Human Papillomavirus
EQYELQPLHDT

SEQ ID NO: 7057 - protein, 9 aa, Artificial Sequence
  Peptide Derived from Human Papillomavirus
ETSFIEAGA

SEQ ID NO: 7058 - protein, 11 aa, Artificial Sequence
  Peptide Derived from Human Papillomavirus
ETSFIEAGAPA

SEQ ID NO: 7059 - protein, 9 aa, Artificial Sequence
  Peptide Derived from Human Papillomavirus
FATTRTSNV

SEQ ID NO: 7060 - protein, 11 aa, Artificial Sequence
  Peptide Derived from Human Papillomavirus
FATTRTSNVSI

SEQ ID NO: 7061 - protein, 8 aa, Artificial Sequence
  Peptide Derived from Human Papillomavirus
FIEAGAPA

SEQ ID NO: 7062 - protein, 11 aa, Artificial Sequence
  Peptide Derived from Human Papillomavirus
FIEAGAPAPSI

SEQ ID NO: 7063 - protein, 8 aa, Artificial Sequence
  Peptide Derived from Human Papillomavirus
FIFSSPTV

SEQ ID NO: 7064 - protein, 10 aa, Artificial Sequence
  Peptide Derived from Human Papillomavirus
FIFSSPTVST

SEQ ID NO: 7065 - protein, 11 aa, Artificial Sequence
  Peptide Derived from Human Papillomavirus
FLDIIALHRPA

SEQ ID NO: 7066 - protein, 8 aa, Artificial Sequence
  Peptide Derived from Human Papillomavirus
FLTSPHKL

SEQ ID NO: 7067 - protein, 9 aa, Artificial Sequence
  Peptide Derived from Human Papillomavirus
FLTSPHKLI

SEQ ID NO: 7068 - protein, 10 aa, Artificial Sequence
  Peptide Derived from Human Papillomavirus
FLTSPHKLIT

SEQ ID NO: 7069 - protein, 9 aa, Artificial Sequence
  Peptide Derived from Human Papillomavirus
FQHSDISPA

SEQ ID NO: 7070 - protein, 8 aa, Artificial Sequence
  Peptide Derived from Human Papillomavirus
FTDVRVAA

SEQ ID NO: 7071 - protein, 11 aa, Artificial Sequence
  Peptide Derived from Human Papillomavirus
FTEPSVLHPPA

SEQ ID NO: 7072 - protein, 9 aa, Artificial Sequence
  Peptide Derived from Human Papillomavirus
FVLHPSYFI

SEQ ID NO: 7073 - protein, 10 aa, Artificial Sequence
  Peptide Derived from Human Papillomavirus
FVLHPSYFIL

SEQ ID NO: 7074 - protein, 10 aa, Artificial Sequence
  Peptide Derived from Human Papillomavirus
FVVSTDSSNV

SEQ ID NO: 7075 - protein, 11 aa, Artificial Sequence
  Peptide Derived from Human Papillomavirus
FVVSTDSSNVT

SEQ ID NO: 7076 - protein, 9 aa, Artificial Sequence
  Peptide Derived from Human Papillomavirus
GAPAPSIPT

SEQ ID NO: 7077 - protein, 10 aa, Artificial Sequence
  Peptide Derived from Human Papillomavirus
GARIHYYQDL

SEQ ID NO: 7078 - protein, 10 aa, Artificial Sequence
  Peptide Derived from Human Papillomavirus
GLYDVYADDV

SEQ ID NO: 7079 - protein, 10 aa, Artificial Sequence
  Peptide Derived from Human Papillomavirus
GLYSRNTQQV

SEQ ID NO: 7080 - protein, 8 aa, Artificial Sequence
  Peptide Derived from Human Papillomavirus
GQKATLKT

SEQ ID NO: 7081 - protein, 8 aa, Artificial Sequence
  Peptide Derived from Human Papillomavirus
GTCPPDVI

SEQ ID NO: 7082 - protein, 11 aa, Artificial Sequence
  Peptide Derived from Human Papillomavirus
GTCPPDVIPKV

SEQ ID NO: 7083 - protein, 8 aa, Artificial Sequence
  Peptide Derived from Human Papillomavirus
GTDPPTAA

SEQ ID NO: 7084 - protein, 9 aa, Artificial Sequence
  Peptide Derived from Human Papillomavirus
GTDPPTAAI

SEQ ID NO: 7085 - protein, 11 aa, Artificial Sequence
  Peptide Derived from Human Papillomavirus
GTDPPTAAIPL

SEQ ID NO: 7086 - protein, 10 aa, Artificial Sequence
  Peptide Derived from Human Papillomavirus
GTGSGSGGRT

SEQ ID NO: 7087 - protein, 9 aa, Artificial Sequence
  Peptide Derived from Human Papillomavirus
GVFFGGLGI

SEQ ID NO: 7088 - protein, 11 aa, Artificial Sequence
  Peptide Derived from Human Papillomavirus
GVFFGGLGIGT

SEQ ID NO: 7089 - protein, 11 aa, Artificial Sequence
  Peptide Derived from Human Papillomavirus
HLNPTFTEPSV

SEQ ID NO: 7090 - protein, 10 aa, Artificial Sequence
  Peptide Derived from Human Papillomavirus
HTPMQHSYST

SEQ ID NO: 7091 - protein, 10 aa, Artificial Sequence
  Peptide Derived from Human Papillomavirus
HTVPNEQYEL

SEQ ID NO: 7092 - protein, 8 aa, Artificial Sequence
  Peptide Derived from Human Papillomavirus
HTVRFSRV

SEQ ID NO: 7093 - protein, 11 aa, Artificial Sequence
  Peptide Derived from Human Papillomavirus
IADQILKYGSL

SEQ ID NO: 7094 - protein, 8 aa, Artificial Sequence
  Peptide Derived from Human Papillomavirus
IALHRPAI

SEQ ID NO: 7095 - protein, 9 aa, Artificial Sequence
  Peptide Derived from Human Papillomavirus
IALHRPAIT

SEQ ID NO: 7096 - protein, 8 aa, Artificial Sequence
  Peptide Derived from Human Papillomavirus
IIALHRPA

SEQ ID NO: 7097 - protein, 9 aa, Artificial Sequence
  Peptide Derived from Human Papillomavirus
IIALHRPAI

SEQ ID NO: 7098 - protein, 10 aa, Artificial Sequence
  Peptide Derived from Human Papillomavirus
IIALHRPAIT

SEQ ID NO: 7099 - protein, 9 aa, Artificial Sequence
  Peptide Derived from Human Papillomavirus
ILKYGSLGV

SEQ ID NO: 7100 - protein, 8 aa, Artificial Sequence
  Peptide Derived from Human Papillomavirus
IQTISTHL

SEQ ID NO: 7101 - protein, 11 aa, Artificial Sequence
  Peptide Derived from Human Papillomavirus
IQTISTHLNPT

SEQ ID NO: 7102 - protein, 8 aa, Artificial Sequence
  Peptide Derived from Human Papillomavirus
ITSRRHTV

SEQ ID NO: 7103 - protein, 8 aa, Artificial Sequence
  Peptide Derived from Human Papillomavirus
IVPLDHTV

SEQ ID NO: 7104 - protein, 8 aa, Artificial Sequence
  Peptide Derived from Human Papillomavirus
IVSLIEET

SEQ ID NO: 7105 - protein, 11 aa, Artificial Sequence
  Peptide Derived from Human Papillomavirus
IVSLIEETSFI

SEQ ID NO: 7106 - protein, 9 aa, Artificial Sequence
  Peptide Derived from Human Papillomavirus
IVVDGADFV

SEQ ID NO: 7107 - protein, 10 aa, Artificial Sequence
  Peptide Derived from Human Papillomavirus
IVVDGADFVL

SEQ ID NO: 7108 - protein, 10 aa, Artificial Sequence
  Peptide Derived from Human Papillomavirus
KATGTCPPDV

SEQ ID NO: 7109 - protein, 11 aa, Artificial Sequence
  Peptide Derived from Human Papillomavirus
KATGTCPPDVI

SEQ ID NO: 7110 - protein, 9 aa, Artificial Sequence
  Peptide Derived from Human Papillomavirus
KLITYDNPA

SEQ ID NO: 7111 - protein, 8 aa, Artificial Sequence
  Peptide Derived from Human Papillomavirus
KTRSGKQI

SEQ ID NO: 7112 - protein, 10 aa, Artificial Sequence
  Peptide Derived from Human Papillomavirus
KTRSGKQIGA

SEQ ID NO: 7113 - protein, 8 aa, Artificial Sequence
  Peptide Derived from Human Papillomavirus
KVEGSTIA

SEQ ID NO: 7114 - protein, 11 aa, Artificial Sequence
  Peptide Derived from Human Papillomavirus
KVEGSTIADQI

SEQ ID NO: 7115 - protein, 8 aa, Artificial Sequence
  Peptide Derived from Human Papillomavirus
KVVDPAFL

SEQ ID NO: 7116 - protein, 9 aa, Artificial Sequence
  Peptide Derived from Human Papillomavirus
KVVDPAFLT

SEQ ID NO: 7117 - protein, 8 aa, Artificial Sequence
  Peptide Derived from Human Papillomavirus
LIEETSFI

SEQ ID NO: 7118 - protein, 10 aa, Artificial Sequence
  Peptide Derived from Human Papillomavirus
LIEETSFIEA

SEQ ID NO: 7119 - protein, 8 aa, Artificial Sequence
  Peptide Derived from Human Papillomavirus
LITYDNPA

SEQ ID NO: 7120 - protein, 8 aa, Artificial Sequence
  Peptide Derived from Human Papillomavirus
LQFQHSDI

SEQ ID NO: 7121 - protein, 11 aa, Artificial Sequence
  Peptide Derived from Human Papillomavirus
LQFQHSDISPA

SEQ ID NO: 7122 - protein, 8 aa, Artificial Sequence
  Peptide Derived from Human Papillomavirus
LQPIRPPV

SEQ ID NO: 7123 - protein, 9 aa, Artificial Sequence
  Peptide Derived from Human Papillomavirus
LQPIRPPVT

SEQ ID NO: 7124 - protein, 10 aa, Artificial Sequence
  Peptide Derived from Human Papillomavirus
LQPIRPPVTV

SEQ ID NO: 7125 - protein, 9 aa, Artificial Sequence
  Peptide Derived from Human Papillomavirus
LQPLHDTST

SEQ ID NO: 7126 - protein, 8 aa, Artificial Sequence
  Peptide Derived from Human Papillomavirus
LTSPHKLI

SEQ ID NO: 7127 - protein, 9 aa, Artificial Sequence
  Peptide Derived from Human Papillomavirus
LTSPHKLIT

SEQ ID NO: 7128 - protein, 9 aa, Artificial Sequence
  Peptide Derived from Human Papillomavirus
MQHSYSTFA

SEQ ID NO: 7129 - protein, 10 aa, Artificial Sequence
  Peptide Derived from Human Papillomavirus
MQHSYSTFAT

SEQ ID NO: 7130 - protein, 11 aa, Artificial Sequence
  Peptide Derived from Human Papillomavirus
MQHSYSTFATT

SEQ ID NO: 7131 - protein, 8 aa, Artificial Sequence
  Peptide Derived from Human Papillomavirus
NIPMDTFV

SEQ ID NO: 7132 - protein, 9 aa, Artificial Sequence
  Peptide Derived from Human Papillomavirus
NIPMDTFVV

SEQ ID NO: 7133 - protein, 11 aa, Artificial Sequence
  Peptide Derived from Human Papillomavirus
NIPMDTFVVST

SEQ ID NO: 7134 - protein, 8 aa, Artificial Sequence
  Peptide Derived from Human Papillomavirus
NTGFDTPV

SEQ ID NO: 7135 - protein, 9 aa, Artificial Sequence
  Peptide Derived from Human Papillomavirus
NTGFDTPVM

SEQ ID NO: 7136 - protein, 8 aa, Artificial Sequence
  Peptide Derived from Human Papillomavirus
NTQQVKVV

SEQ ID NO: 7137 - protein, 11 aa, Artificial Sequence
  Peptide Derived from Human Papillomavirus
NTQQVKVVDPA

SEQ ID NO: 7138 - protein, 8 aa, Artificial Sequence
  Peptide Derived from Human Papillomavirus
NVSIPLNT

SEQ ID NO: 7139 - protein, 10 aa, Artificial Sequence
  Peptide Derived from Human Papillomavirus
NVSSVGESSI

SEQ ID NO: 7140 - protein, 8 aa, Artificial Sequence
  Peptide Derived from Human Papillomavirus
NVTSSTPI

SEQ ID NO: 7141 - protein, 9 aa, Artificial Sequence
  Peptide Derived from Human Papillomavirus
PAEASGHFI

SEQ ID NO: 7142 - protein, 11 aa, Artificial Sequence
  Peptide Derived from Human Papillomavirus
PAFESFDPEDT

SEQ ID NO: 7143 - protein, 10 aa, Artificial Sequence
  Peptide Derived from Human Papillomavirus
PAFLTSPHKL

SEQ ID NO: 7144 - protein, 11 aa, Artificial Sequence
  Peptide Derived from Human Papillomavirus
PAFLTSPHKLI

SEQ ID NO: 7145 - protein, 9 aa, Artificial Sequence
  Peptide Derived from Human Papillomavirus
PAIINVSSV

SEQ ID NO: 7146 - protein, 9 aa, Artificial Sequence
  Peptide Derived from Human Papillomavirus
PAITSRRHT

SEQ ID NO: 7147 - protein, 10 aa, Artificial Sequence
  Peptide Derived from Human Papillomavirus
PAITSRRHTV

SEQ ID NO: 7148 - protein, 11 aa, Artificial Sequence
  Peptide Derived from Human Papillomavirus
PAPAEASGHFI

SEQ ID NO: 7149 - protein, 8 aa, Artificial Sequence
  Peptide Derived from Human Papillomavirus
PAPDPDFL

SEQ ID NO: 7150 - protein, 10 aa, Artificial Sequence
  Peptide Derived from Human Papillomavirus
PAPDPDFLDI

SEQ ID NO: 7151 - protein, 11 aa, Artificial Sequence
  Peptide Derived from Human Papillomavirus
PAPDPDFLDII

SEQ ID NO: 7152 - protein, 8 aa, Artificial Sequence
  Peptide Derived from Human Papillomavirus
PIGTDPPT

SEQ ID NO: 7153 - protein, 9 aa, Artificial Sequence
  Peptide Derived from Human Papillomavirus
PIGTDPPTA

SEQ ID NO: 7154 - protein, 10 aa, Artificial Sequence
  Peptide Derived from Human Papillomavirus
PIGTDPPTAA

SEQ ID NO: 7155 - protein, 11 aa, Artificial Sequence
  Peptide Derived from Human Papillomavirus
PIGTDPPTAAI

SEQ ID NO: 7156 - protein, 8 aa, Artificial Sequence
  Peptide Derived from Human Papillomavirus
PIPGSRPV

SEQ ID NO: 7157 - protein, 9 aa, Artificial Sequence
  Peptide Derived from Human Papillomavirus
PIPGSRPVA

SEQ ID NO: 7158 - protein, 11 aa, Artificial Sequence
  Peptide Derived from Human Papillomavirus
PIPGSRPVARL

SEQ ID NO: 7159 - protein, 8 aa, Artificial Sequence
  Peptide Derived from Human Papillomavirus
PIRPPVTV

SEQ ID NO: 7160 - protein, 10 aa, Artificial Sequence
  Peptide Derived from Human Papillomavirus
PIRPPVTVDT

SEQ ID NO: 7161 - protein, 11 aa, Artificial Sequence
  Peptide Derived from Human Papillomavirus
PIRPPVTVDTV

SEQ ID NO: 7162 - protein, 10 aa, Artificial Sequence
  Peptide Derived from Human Papillomavirus
PISPFFPFDT

SEQ ID NO: 7163 - protein, 11 aa, Artificial Sequence
  Peptide Derived from Human Papillomavirus
PISPFFPFDTI

SEQ ID NO: 7164 - protein, 8 aa, Artificial Sequence
  Peptide Derived from Human Papillomavirus
PIVPLDHT

SEQ ID NO: 7165 - protein, 9 aa, Artificial Sequence
  Peptide Derived from Human Papillomavirus
PIVPLDHTV

SEQ ID NO: 7166 - protein, 9 aa, Artificial Sequence
  Peptide Derived from Human Papillomavirus
PLDSSIVSL

SEQ ID NO: 7167 - protein, 10 aa, Artificial Sequence
  Peptide Derived from Human Papillomavirus
PLDSSIVSLI

SEQ ID NO: 7168 - protein, 10 aa, Artificial Sequence
  Peptide Derived from Human Papillomavirus
PLFPTSSPFV

SEQ ID NO: 7169 - protein, 8 aa, Artificial Sequence
  Peptide Derived from Human Papillomavirus
PLNTGFDT

SEQ ID NO: 7170 - protein, 10 aa, Artificial Sequence
  Peptide Derived from Human Papillomavirus
PLNTGFDTPV

SEQ ID NO: 7171 - protein, 11 aa, Artificial Sequence
  Peptide Derived from Human Papillomavirus
PLNTGFDTPVM

SEQ ID NO: 7172 - protein, 9 aa, Artificial Sequence
  Peptide Derived from Human Papillomavirus
PLQPIRPPV

SEQ ID NO: 7173 - protein, 10 aa, Artificial Sequence
  Peptide Derived from Human Papillomavirus
PLQPIRPPVT

SEQ ID NO: 7174 - protein, 11 aa, Artificial Sequence
  Peptide Derived from Human Papillomavirus
PLQPIRPPVTV

SEQ ID NO: 7175 - protein, 9 aa, Artificial Sequence
  Peptide Derived from Human Papillomavirus
PMDTFVVST

SEQ ID NO: 7176 - protein, 8 aa, Artificial Sequence
  Peptide Derived from Human Papillomavirus
PMQHSYST

SEQ ID NO: 7177 - protein, 10 aa, Artificial Sequence
  Peptide Derived from Human Papillomavirus
PMQHSYSTFA

SEQ ID NO: 7178 - protein, 11 aa, Artificial Sequence
  Peptide Derived from Human Papillomavirus
PMQHSYSTFAT

SEQ ID NO: 7179 - protein, 10 aa, Artificial Sequence
  Peptide Derived from Human Papillomavirus
PTAAIPLQPI

SEQ ID NO: 7180 - protein, 8 aa, Artificial Sequence
  Peptide Derived from Human Papillomavirus
PTFTEPSV

SEQ ID NO: 7181 - protein, 9 aa, Artificial Sequence
  Peptide Derived from Human Papillomavirus
PTFTEPSVL

SEQ ID NO: 7182 - protein, 8 aa, Artificial Sequence
  Peptide Derived from Human Papillomavirus
PTPSGFDV

SEQ ID NO: 7183 - protein, 9 aa, Artificial Sequence
  Peptide Derived from Human Papillomavirus
PTPSGFDVT

SEQ ID NO: 7184 - protein, 10 aa, Artificial Sequence
  Peptide Derived from Human Papillomavirus
PTPSGFDVTT

SEQ ID NO: 7185 - protein, 9 aa, Artificial Sequence
  Peptide Derived from Human Papillomavirus
PTSSPFVPI

SEQ ID NO: 7186 - protein, 11 aa, Artificial Sequence
  Peptide Derived from Human Papillomavirus
PTVSTQSYENI

SEQ ID NO: 7187 - protein, 8 aa, Artificial Sequence
  Peptide Derived from Human Papillomavirus
PVMSGPDI

SEQ ID NO: 7188 - protein, 10 aa, Artificial Sequence
  Peptide Derived from Human Papillomavirus
PVTVDTVGPL

SEQ ID NO: 7189 - protein, 8 aa, Artificial Sequence
  Peptide Derived from Human Papillomavirus
QILKYGSL

SEQ ID NO: 7190 - protein, 10 aa, Artificial Sequence
  Peptide Derived from Human Papillomavirus
QILKYGSLGV

SEQ ID NO: 7191 - protein, 8 aa, Artificial Sequence
  Peptide Derived from Human Papillomavirus
QLYQTCKA

SEQ ID NO: 7192 - protein, 9 aa, Artificial Sequence
  Peptide Derived from Human Papillomavirus
QLYQTCKAT

SEQ ID NO: 7193 - protein, 11 aa, Artificial Sequence
  Peptide Derived from Human Papillomavirus
QLYQTCKATGT

SEQ ID NO: 7194 - protein, 9 aa, Artificial Sequence
  Peptide Derived from Human Papillomavirus
QQVKVVDPA

SEQ ID NO: 7195 - protein, 11 aa, Artificial Sequence
  Peptide Derived from Human Papillomavirus
QQVKVVDPAFL

SEQ ID NO: 7196 - protein, 8 aa, Artificial Sequence
  Peptide Derived from Human Papillomavirus
QTCKATGT

SEQ ID NO: 7197 - protein, 10 aa, Artificial Sequence
  Peptide Derived from Human Papillomavirus
QTISTHLNPT

SEQ ID NO: 7198 - protein, 8 aa, Artificial Sequence
  Peptide Derived from Human Papillomavirus
QVKVVDPA

SEQ ID NO: 7199 - protein, 10 aa, Artificial Sequence
  Peptide Derived from Human Papillomavirus
QVKVVDPAFL

SEQ ID NO: 7200 - protein, 11 aa, Artificial Sequence
  Peptide Derived from Human Papillomavirus
QVKVVDPAFLT

SEQ ID NO: 7201 - protein, 10 aa, Artificial Sequence
  Peptide Derived from Human Papillomavirus
RASATQLYQT

SEQ ID NO: 7202 - protein, 8 aa, Artificial Sequence
  Peptide Derived from Human Papillomavirus
RIHYYQDL

SEQ ID NO: 7203 - protein, 11 aa, Artificial Sequence
  Peptide Derived from Human Papillomavirus
RIHYYQDLSPI

SEQ ID NO: 7204 - protein, 9 aa, Artificial Sequence
  Peptide Derived from Human Papillomavirus
RLGLYSRNT

SEQ ID NO: 7205 - protein, 9 aa, Artificial Sequence
  Peptide Derived from Human Papillomavirus
RTGYVPIGT

SEQ ID NO: 7206 - protein, 9 aa, Artificial Sequence
  Peptide Derived from Human Papillomavirus
RTSNVSIPL

SEQ ID NO: 7207 - protein, 11 aa, Artificial Sequence
  Peptide Derived from Human Papillomavirus
RTSNVSIPLNT

SEQ ID NO: 7208 - protein, 8 aa, Artificial Sequence
  Peptide Derived from Human Papillomavirus
RVGQKATL

SEQ ID NO: 7209 - protein, 10 aa, Artificial Sequence
  Peptide Derived from Human Papillomavirus
RVGQKATLKT

SEQ ID NO: 7210 - protein, 8 aa, Artificial Sequence
  Peptide Derived from Human Papillomavirus
SADTTPAI

SEQ ID NO: 7211 - protein, 9 aa, Artificial Sequence
  Peptide Derived from Human Papillomavirus
SADTTPAII

SEQ ID NO: 7212 - protein, 11 aa, Artificial Sequence
  Peptide Derived from Human Papillomavirus
SADTTPAIINV

SEQ ID NO: 7213 - protein, 8 aa, Artificial Sequence
  Peptide Derived from Human Papillomavirus
SATQLYQT

SEQ ID NO: 7214 - protein, 11 aa, Artificial Sequence
  Peptide Derived from Human Papillomavirus
SATQLYQTCKA

SEQ ID NO: 7215 - protein, 9 aa, Artificial Sequence
  Peptide Derived from Human Papillomavirus
SINDGLYDV

SEQ ID NO: 7216 - protein, 11 aa, Artificial Sequence
  Peptide Derived from Human Papillomavirus
SINDGLYDVYA

SEQ ID NO: 7217 - protein, 10 aa, Artificial Sequence
  Peptide Derived from Human Papillomavirus
SIPLNTGFDT

SEQ ID NO: 7218 - protein, 10 aa, Artificial Sequence
  Peptide Derived from Human Papillomavirus
SIPTPSGFDV

SEQ ID NO: 7219 - protein, 11 aa, Artificial Sequence
  Peptide Derived from Human Papillomavirus
SIPTPSGFDVT

SEQ ID NO: 7220 - protein, 9 aa, Artificial Sequence
  Peptide Derived from Human Papillomavirus
SIQTISTHL

SEQ ID NO: 7221 - protein, 9 aa, Artificial Sequence
  Peptide Derived from Human Papillomavirus
SIVSLIEET

SEQ ID NO: 7222 - protein, 9 aa, Artificial Sequence
  Peptide Derived from Human Papillomavirus
SLGVFFGGL

SEQ ID NO: 7223 - protein, 11 aa, Artificial Sequence
  Peptide Derived from Human Papillomavirus
SLGVFFGGLGI

SEQ ID NO: 7224 - protein, 9 aa, Artificial Sequence
  Peptide Derived from Human Papillomavirus
SLIEETSFI

SEQ ID NO: 7225 - protein, 11 aa, Artificial Sequence
  Peptide Derived from Human Papillomavirus
SLIEETSFIEA

SEQ ID NO: 7226 - protein, 8 aa, Artificial Sequence
  Peptide Derived from Human Papillomavirus
STDSSNVT

SEQ ID NO: 7227 - protein, 11 aa, Artificial Sequence
  Peptide Derived from Human Papillomavirus
STDSSNVTSST

SEQ ID NO: 7228 - protein, 8 aa, Artificial Sequence
  Peptide Derived from Human Papillomavirus
STFATTRT

SEQ ID NO: 7229 - protein, 11 aa, Artificial Sequence
  Peptide Derived from Human Papillomavirus
STFATTRTSNV

SEQ ID NO: 7230 - protein, 9 aa, Artificial Sequence
  Peptide Derived from Human Papillomavirus
STHLNPTFT

SEQ ID NO: 7231 - protein, 8 aa, Artificial Sequence
  Peptide Derived from Human Papillomavirus
STIADQIL

SEQ ID NO: 7232 - protein, 10 aa, Artificial Sequence
  Peptide Derived from Human Papillomavirus
STPIPGSRPV

SEQ ID NO: 7233 - protein, 11 aa, Artificial Sequence
  Peptide Derived from Human Papillomavirus
STPIPGSRPVA

SEQ ID NO: 7234 - protein, 8 aa, Artificial Sequence
  Peptide Derived from Human Papillomavirus
STQSYENI

SEQ ID NO: 7235 - protein, 10 aa, Artificial Sequence
  Peptide Derived from Human Papillomavirus
STQSYENIPM

SEQ ID NO: 7236 - protein, 9 aa, Artificial Sequence
  Peptide Derived from Human Papillomavirus
STRRKRASA

SEQ ID NO: 7237 - protein, 10 aa, Artificial Sequence
  Peptide Derived from Human Papillomavirus
STRRKRASAT

SEQ ID NO: 7238 - protein, 11 aa, Artificial Sequence
  Peptide Derived from Human Papillomavirus
STSSYSINDGL

SEQ ID NO: 7239 - protein, 9 aa, Artificial Sequence
  Peptide Derived from Human Papillomavirus
SVGESSIQT

SEQ ID NO: 7240 - protein, 10 aa, Artificial Sequence
  Peptide Derived from Human Papillomavirus
SVGESSIQTI

SEQ ID NO: 7241 - protein, 9 aa, Artificial Sequence
  Peptide Derived from Human Papillomavirus
SVLHPPAPA

SEQ ID NO: 7242 - protein, 11 aa, Artificial Sequence
  Peptide Derived from Human Papillomavirus
SVLHPPAPAEA

SEQ ID NO: 7243 - protein, 9 aa, Artificial Sequence
  Peptide Derived from Human Papillomavirus
TAAIPLQPI

SEQ ID NO: 7244 - protein, 9 aa, Artificial Sequence
  Peptide Derived from Human Papillomavirus
TISTHLNPT

SEQ ID NO: 7245 - protein, 11 aa, Artificial Sequence
  Peptide Derived from Human Papillomavirus
TISTHLNPTFT

SEQ ID NO: 7246 - protein, 10 aa, Artificial Sequence
  Peptide Derived from Human Papillomavirus
TIVVDGADFV

SEQ ID NO: 7247 - protein, 11 aa, Artificial Sequence
  Peptide Derived from Human Papillomavirus
TIVVDGADFVL

SEQ ID NO: 7248 - protein, 10 aa, Artificial Sequence
  Peptide Derived from Human Papillomavirus
TLKTRSGKQI

SEQ ID NO: 7249 - protein, 9 aa, Artificial Sequence
  Peptide Derived from Human Papillomavirus
TLQFQHSDI

SEQ ID NO: 7250 - protein, 9 aa, Artificial Sequence
  Peptide Derived from Human Papillomavirus
TQLYQTCKA

SEQ ID NO: 7251 - protein, 10 aa, Artificial Sequence
  Peptide Derived from Human Papillomavirus
TQLYQTCKAT

SEQ ID NO: 7252 - protein, 10 aa, Artificial Sequence
  Peptide Derived from Human Papillomavirus
TQQVKVVDPA

SEQ ID NO: 7253 - protein, 9 aa, Artificial Sequence
  Peptide Derived from Human Papillomavirus
TQSYENIPM

SEQ ID NO: 7254 - protein, 11 aa, Artificial Sequence
  Peptide Derived from Human Papillomavirus
TQSYENIPMDT

SEQ ID NO: 7255 - protein, 8 aa, Artificial Sequence
  Peptide Derived from Human Papillomavirus
TTPAIINV

SEQ ID NO: 7256 - protein, 11 aa, Artificial Sequence
  Peptide Derived from Human Papillomavirus
TTPAIINVSSV

SEQ ID NO: 7257 - protein, 9 aa, Artificial Sequence
  Peptide Derived from Human Papillomavirus
TTRTSNVSI

SEQ ID NO: 7258 - protein, 11 aa, Artificial Sequence
  Peptide Derived from Human Papillomavirus
TTRTSNVSIPL

SEQ ID NO: 7259 - protein, 9 aa, Artificial Sequence
  Peptide Derived from Human Papillomavirus
TTSADTTPA

SEQ ID NO: 7260 - protein, 10 aa, Artificial Sequence
  Peptide Derived from Human Papillomavirus
TTSADTTPAI

SEQ ID NO: 7261 - protein, 11 aa, Artificial Sequence
  Peptide Derived from Human Papillomavirus
TTSADTTPAII

SEQ ID NO: 7262 - protein, 8 aa, Artificial Sequence
  Peptide Derived from Human Papillomavirus
TVDTVGPL

SEQ ID NO: 7263 - protein, 9 aa, Artificial Sequence
  Peptide Derived from Human Papillomavirus
TVGPLDSSI

SEQ ID NO: 7264 - protein, 10 aa, Artificial Sequence
  Peptide Derived from Human Papillomavirus
TVGPLDSSIV

SEQ ID NO: 7265 - protein, 9 aa, Artificial Sequence
  Peptide Derived from Human Papillomavirus
TVPNEQYEL

SEQ ID NO: 7266 - protein, 11 aa, Artificial Sequence
  Peptide Derived from Human Papillomavirus
TVRFSRVGQKA

SEQ ID NO: 7267 - protein, 10 aa, Artificial Sequence
  Peptide Derived from Human Papillomavirus
TVSTQSYENI

SEQ ID NO: 7268 - protein, 11 aa, Artificial Sequence
  Peptide Derived from Human Papillomavirus
VARLGLYSRNT

SEQ ID NO: 7269 - protein, 9 aa, Artificial Sequence
  Peptide Derived from Human Papillomavirus
VIPKVEGST

SEQ ID NO: 7270 - protein, 10 aa, Artificial Sequence
  Peptide Derived from Human Papillomavirus
VIPKVEGSTI

SEQ ID NO: 7271 - protein, 11 aa, Artificial Sequence
  Peptide Derived from Human Papillomavirus
VIPKVEGSTIA

SEQ ID NO: 7272 - protein, 8 aa, Artificial Sequence
  Peptide Derived from Human Papillomavirus
VLHPPAPA

SEQ ID NO: 7273 - protein, 10 aa, Artificial Sequence
  Peptide Derived from Human Papillomavirus
VLHPPAPAEA

SEQ ID NO: 7274 - protein, 8 aa, Artificial Sequence
  Peptide Derived from Human Papillomavirus
VLHPSYFI

SEQ ID NO: 7275 - protein, 9 aa, Artificial Sequence
  Peptide Derived from Human Papillomavirus
VLHPSYFIL

SEQ ID NO: 7276 - protein, 11 aa, Artificial Sequence
  Peptide Derived from Human Papillomavirus
VMSGPDIPSPL

SEQ ID NO: 7277 - protein, 8 aa, Artificial Sequence
  Peptide Derived from Human Papillomavirus
VTTSADTT

SEQ ID NO: 7278 - protein, 10 aa, Artificial Sequence
  Peptide Derived from Human Papillomavirus
VTTSADTTPA

SEQ ID NO: 7279 - protein, 11 aa, Artificial Sequence
  Peptide Derived from Human Papillomavirus
VTTSADTTPAI

SEQ ID NO: 7280 - protein, 9 aa, Artificial Sequence
  Peptide Derived from Human Papillomavirus
VTVDTVGPL

SEQ ID NO: 7281 - protein, 8 aa, Artificial Sequence
  Peptide Derived from Human Papillomavirus
VVDGADFV

SEQ ID NO: 7282 - protein, 9 aa, Artificial Sequence
  Peptide Derived from Human Papillomavirus
VVDGADFVL

SEQ ID NO: 7283 - protein, 8 aa, Artificial Sequence
  Peptide Derived from Human Papillomavirus
VVDPAFLT

SEQ ID NO: 7284 - protein, 9 aa, Artificial Sequence
  Peptide Derived from Human Papillomavirus
VVSTDSSNV

SEQ ID NO: 7285 - protein, 10 aa, Artificial Sequence
  Peptide Derived from Human Papillomavirus
VVSTDSSNVT

SEQ ID NO: 7286 - protein, 8 aa, Artificial Sequence
  Peptide Derived from Human Papillomavirus
YADDVDNV

SEQ ID NO: 7287 - protein, 10 aa, Artificial Sequence
  Peptide Derived from Human Papillomavirus
YADDVDNVHT

SEQ ID NO: 7288 - protein, 8 aa, Artificial Sequence
  Peptide Derived from Human Papillomavirus
YQDLSPIV

SEQ ID NO: 7289 - protein, 10 aa, Artificial Sequence
  Peptide Derived from Human Papillomavirus
YQDLSPIVPL

SEQ ID NO: 7290 - protein, 9 aa, Artificial Sequence
  Peptide Derived from Human Papillomavirus
YQTCKATGT

SEQ ID NO: 7291 - protein, 10 aa, Artificial Sequence
  Peptide Derived from Human Papillomavirus
YVPIGTDPPT

SEQ ID NO: 7292 - protein, 11 aa, Artificial Sequence
  Peptide Derived from Human Papillomavirus
YVPIGTDPPTA

SEQ ID NO: 7293 - protein, 11 aa, Artificial Sequence
  Peptide Derived from Human Papillomavirus
AAAFLKSNCQA

SEQ ID NO: 7294 - protein, 8 aa, Artificial Sequence
  Peptide Derived from Human Papillomavirus
AAETQVTV

SEQ ID NO: 7295 - protein, 10 aa, Artificial Sequence
  Peptide Derived from Human Papillomavirus
AAETQVTVNT

SEQ ID NO: 7296 - protein, 10 aa, Artificial Sequence
  Peptide Derived from Human Papillomavirus
AAFLKSNCQA

SEQ ID NO: 7297 - protein, 8 aa, Artificial Sequence
  Peptide Derived from Human Papillomavirus
AALYWYRT

SEQ ID NO: 7298 - protein, 10 aa, Artificial Sequence
  Peptide Derived from Human Papillomavirus
AALYWYRTGI

SEQ ID NO: 7299 - protein, 10 aa, Artificial Sequence
  Peptide Derived from Human Papillomavirus
AAMLAVFKDI

SEQ ID NO: 7300 - protein, 8 aa, Artificial Sequence
  Peptide Derived from Human Papillomavirus
AIFGVNPT

SEQ ID NO: 7301 - protein, 9 aa, Artificial Sequence
  Peptide Derived from Human Papillomavirus
AIFGVNPTV

SEQ ID NO: 7302 - protein, 10 aa, Artificial Sequence
  Peptide Derived from Human Papillomavirus
AIFGVNPTVA

SEQ ID NO: 7303 - protein, 9 aa, Artificial Sequence
  Peptide Derived from Human Papillomavirus
ALDGNPISI

SEQ ID NO: 7304 - protein, 8 aa, Artificial Sequence
  Peptide Derived from Human Papillomavirus
ALFHAQEV

SEQ ID NO: 7305 - protein, 9 aa, Artificial Sequence
  Peptide Derived from Human Papillomavirus
ALKEFLKGT

SEQ ID NO: 7306 - protein, 9 aa, Artificial Sequence
  Peptide Derived from Human Papillomavirus
ALYWYRTGI

SEQ ID NO: 7307 - protein, 9 aa, Artificial Sequence
  Peptide Derived from Human Papillomavirus
AMLAVFKDI

SEQ ID NO: 7308 - protein, 9 aa, Artificial Sequence
  Peptide Derived from Human Papillomavirus
AMLDDATHT

SEQ ID NO: 7309 - protein, 10 aa, Artificial Sequence
  Peptide Derived from Human Papillomavirus
AQALFHAQEV

SEQ ID NO: 7310 - protein, 8 aa, Artificial Sequence
  Peptide Derived from Human Papillomavirus
AQEVQNDA

SEQ ID NO: 7311 - protein, 10 aa, Artificial Sequence
  Peptide Derived from Human Papillomavirus
AQEVQNDAQV

SEQ ID NO: 7312 - protein, 11 aa, Artificial Sequence
  Peptide Derived from Human Papillomavirus
AQEVQNDAQVL

SEQ ID NO: 7313 - protein, 8 aa, Artificial Sequence
  Peptide Derived from Human Papillomavirus
AQKRQMNM

SEQ ID NO: 7314 - protein, 10 aa, Artificial Sequence
  Peptide Derived from Human Papillomavirus
AQLADCNSNA

SEQ ID NO: 7315 - protein, 11 aa, Artificial Sequence
  Peptide Derived from Human Papillomavirus
AQLADCNSNAA

SEQ ID NO: 7316 - protein, 8 aa, Artificial Sequence
  Peptide Derived from Human Papillomavirus
ATDTGSDM

SEQ ID NO: 7317 - protein, 9 aa, Artificial Sequence
  Peptide Derived from Human Papillomavirus
ATDTGSDMV

SEQ ID NO: 7318 - protein, 10 aa, Artificial Sequence
  Peptide Derived from Human Papillomavirus
ATLYAHIQCL

SEQ ID NO: 7319 - protein, 9 aa, Artificial Sequence
  Peptide Derived from Human Papillomavirus
AVFKDIYGL

SEQ ID NO: 7320 - protein, 10 aa, Artificial Sequence
  Peptide Derived from Human Papillomavirus
AVMCRHYKRA

SEQ ID NO: 7321 - protein, 11 aa, Artificial Sequence
  Peptide Derived from Human Papillomavirus
CAVMCRHYKRA

SEQ ID NO: 7322 - protein, 8 aa, Artificial Sequence
  Peptide Derived from Human Papillomavirus
CILLYGPA

SEQ ID NO: 7323 - protein, 10 aa, Artificial Sequence
  Peptide Derived from Human Papillomavirus
CILLYGPANT

SEQ ID NO: 7324 - protein, 8 aa, Artificial Sequence
  Peptide Derived from Human Papillomavirus
CLDCKWGV

SEQ ID NO: 7325 - protein, 9 aa, Artificial Sequence
  Peptide Derived from Human Papillomavirus
CLDCKWGVL

SEQ ID NO: 7326 - protein, 10 aa, Artificial Sequence
  Peptide Derived from Human Papillomavirus
CLDCKWGVLI

SEQ ID NO: 7327 - protein, 11 aa, Artificial Sequence
  Peptide Derived from Human Papillomavirus
CLDCKWGVLIL

SEQ ID NO: 7328 - protein, 9 aa, Artificial Sequence
  Peptide Derived from Human Papillomavirus
CMLIEPPKL

SEQ ID NO: 7329 - protein, 10 aa, Artificial Sequence
  Peptide Derived from Human Papillomavirus
CQAKYLKDCA

SEQ ID NO: 7330 - protein, 11 aa, Artificial Sequence
  Peptide Derived from Human Papillomavirus
CQAKYLKDCAV

SEQ ID NO: 7331 - protein, 8 aa, Artificial Sequence
  Peptide Derived from Human Papillomavirus
CTDWVMAI

SEQ ID NO: 7332 - protein, 11 aa, Artificial Sequence
  Peptide Derived from Human Papillomavirus
CTDWVMAIFGV

SEQ ID NO: 7333 - protein, 10 aa, Artificial Sequence
  Peptide Derived from Human Papillomavirus
CVTGQNTRPL

SEQ ID NO: 7334 - protein, 11 aa, Artificial Sequence
  Peptide Derived from Human Papillomavirus
DADTEGIPFGT

SEQ ID NO: 7335 - protein, 8 aa, Artificial Sequence
  Peptide Derived from Human Papillomavirus
DAQVLHLL

SEQ ID NO: 7336 - protein, 8 aa, Artificial Sequence
  Peptide Derived from Human Papillomavirus
DATHTCWT

SEQ ID NO: 7337 - protein, 8 aa, Artificial Sequence
  Peptide Derived from Human Papillomavirus
DIYGLSFT

SEQ ID NO: 7338 - protein, 10 aa, Artificial Sequence
  Peptide Derived from Human Papillomavirus
DIYGLSFTDL

SEQ ID NO: 7339 - protein, 11 aa, Artificial Sequence
  Peptide Derived from Human Papillomavirus
DIYGLSFTDLV

SEQ ID NO: 7340 - protein, 9 aa, Artificial Sequence
  Peptide Derived from Human Papillomavirus
DLHEDDEDA

SEQ ID NO: 7341 - protein, 11 aa, Artificial Sequence
  Peptide Derived from Human Papillomavirus
DLHEDDEDADT

SEQ ID NO: 7342 - protein, 9 aa, Artificial Sequence
  Peptide Derived from Human Papillomavirus
DLSDMVQWA

SEQ ID NO: 7343 - protein, 9 aa, Artificial Sequence
  Peptide Derived from Human Papillomavirus
DLSPRLQEI

SEQ ID NO: 7344 - protein, 11 aa, Artificial Sequence
  Peptide Derived from Human Papillomavirus
DLSPRLQEISL

SEQ ID NO: 7345 - protein, 8 aa, Artificial Sequence
  Peptide Derived from Human Papillomavirus
DLTDESDM

SEQ ID NO: 7346 - protein, 9 aa, Artificial Sequence
  Peptide Derived from Human Papillomavirus
DLTDESDMA

SEQ ID NO: 7347 - protein, 11 aa, Artificial Sequence
  Peptide Derived from Human Papillomavirus
DLVRNFKSDKT

SEQ ID NO: 7348 - protein, 9 aa, Artificial Sequence
  Peptide Derived from Human Papillomavirus
DMAFQYAQL

SEQ ID NO: 7349 - protein, 10 aa, Artificial Sequence
  Peptide Derived from Human Papillomavirus
DMAFQYAQLA

SEQ ID NO: 7350 - protein, 8 aa, Artificial Sequence
  Peptide Derived from Human Papillomavirus
DMVDFIDT

SEQ ID NO: 7351 - protein, 10 aa, Artificial Sequence
  Peptide Derived from Human Papillomavirus
DMVDFIDTQL

SEQ ID NO: 7352 - protein, 11 aa, Artificial Sequence
  Peptide Derived from Human Papillomavirus
DMVQWAFDNDL

SEQ ID NO: 7353 - protein, 8 aa, Artificial Sequence
  Peptide Derived from Human Papillomavirus
DTDLSPRL

SEQ ID NO: 7354 - protein, 11 aa, Artificial Sequence
  Peptide Derived from Human Papillomavirus
DTDLSPRLQEI

SEQ ID NO: 7355 - protein, 9 aa, Artificial Sequence
  Peptide Derived from Human Papillomavirus
DTEGIPFGT

SEQ ID NO: 7356 - protein, 10 aa, Artificial Sequence
  Peptide Derived from Human Papillomavirus
DTGSDMVDFI

SEQ ID NO: 7357 - protein, 10 aa, Artificial Sequence
  Peptide Derived from Human Papillomavirus
DTKVAMLDDA

SEQ ID NO: 7358 - protein, 11 aa, Artificial Sequence
  Peptide Derived from Human Papillomavirus
DTKVAMLDDAT

SEQ ID NO: 7359 - protein, 9 aa, Artificial Sequence
  Peptide Derived from Human Papillomavirus
DTPEWIQRL

SEQ ID NO: 7360 - protein, 10 aa, Artificial Sequence
  Peptide Derived from Human Papillomavirus
DTPEWIQRLT

SEQ ID NO: 7361 - protein, 11 aa, Artificial Sequence
  Peptide Derived from Human Papillomavirus
DTPEWIQRLTI

SEQ ID NO: 7362 - protein, 10 aa, Artificial Sequence
  Peptide Derived from Human Papillomavirus
DTQLSICEQA

SEQ ID NO: 7363 - protein, 10 aa, Artificial Sequence
  Peptide Derived from Human Papillomavirus
DVISDDEDET

SEQ ID NO: 7364 - protein, 11 aa, Artificial Sequence
  Peptide Derived from Human Papillomavirus
DVISDDEDETA

SEQ ID NO: 7365 - protein, 8 aa, Artificial Sequence
  Peptide Derived from Human Papillomavirus
EAAETQVT

SEQ ID NO: 7366 - protein, 9 aa, Artificial Sequence
  Peptide Derived from Human Papillomavirus
EAAETQVTV

SEQ ID NO: 7367 - protein, 11 aa, Artificial Sequence
  Peptide Derived from Human Papillomavirus
EAAETQVTVNT

SEQ ID NO: 7368 - protein, 11 aa, Artificial Sequence
  Peptide Derived from Human Papillomavirus
EISLNSGHKKA

SEQ ID NO: 7369 - protein, 8 aa, Artificial Sequence
  Peptide Derived from Human Papillomavirus
ELKELLQA

SEQ ID NO: 7370 - protein, 10 aa, Artificial Sequence
  Peptide Derived from Human Papillomavirus
ELLQASNKKA

SEQ ID NO: 7371 - protein, 11 aa, Artificial Sequence
  Peptide Derived from Human Papillomavirus
ELLQASNKKAA

SEQ ID NO: 7372 - protein, 8 aa, Artificial Sequence
  Peptide Derived from Human Papillomavirus
EQAEQETA

SEQ ID NO: 7373 - protein, 10 aa, Artificial Sequence
  Peptide Derived from Human Papillomavirus
EQAEQETAQA

SEQ ID NO: 7374 - protein, 11 aa, Artificial Sequence
  Peptide Derived from Human Papillomavirus
EQAEQETAQAL

SEQ ID NO: 7375 - protein, 8 aa, Artificial Sequence
  Peptide Derived from Human Papillomavirus
EQETAQAL

SEQ ID NO: 7376 - protein, 11 aa, Artificial Sequence
  Peptide Derived from Human Papillomavirus
EQETAQALFHA

SEQ ID NO: 7377 - protein, 9 aa, Artificial Sequence
  Peptide Derived from Human Papillomavirus
EQLSVDTDL

SEQ ID NO: 7378 - protein, 9 aa, Artificial Sequence
  Peptide Derived from Human Papillomavirus
ETAQALFHA

SEQ ID NO: 7379 - protein, 10 aa, Artificial Sequence
  Peptide Derived from Human Papillomavirus
ETATDTGSDM

SEQ ID NO: 7380 - protein, 11 aa, Artificial Sequence
  Peptide Derived from Human Papillomavirus
ETATDTGSDMV

SEQ ID NO: 7381 - protein, 11 aa, Artificial Sequence
  Peptide Derived from Human Papillomavirus
ETCMLIEPPKL

SEQ ID NO: 7382 - protein, 8 aa, Artificial Sequence
  Peptide Derived from Human Papillomavirus
ETIVEKKT

SEQ ID NO: 7383 - protein, 11 aa, Artificial Sequence
  Peptide Derived from Human Papillomavirus
ETIVEKKTGDV

SEQ ID NO: 7384 - protein, 8 aa, Artificial Sequence
  Peptide Derived from Human Papillomavirus
ETQVTVNT

SEQ ID NO: 7385 - protein, 10 aa, Artificial Sequence
  Peptide Derived from Human Papillomavirus
ETQVTVNTNA

SEQ ID NO: 7386 - protein, 9 aa, Artificial Sequence
  Peptide Derived from Human Papillomavirus
EVEAAETQV

SEQ ID NO: 7387 - protein, 10 aa, Artificial Sequence
  Peptide Derived from Human Papillomavirus
EVEAAETQVT

SEQ ID NO: 7388 - protein, 11 aa, Artificial Sequence
  Peptide Derived from Human Papillomavirus
EVEAAETQVTV

SEQ ID NO: 7389 - protein, 8 aa, Artificial Sequence
  Peptide Derived from Human Papillomavirus
EVQNDAQV

SEQ ID NO: 7390 - protein, 9 aa, Artificial Sequence
  Peptide Derived from Human Papillomavirus
EVQNDAQVL

SEQ ID NO: 7391 - protein, 11 aa, Artificial Sequence
  Peptide Derived from Human Papillomavirus
EVQNDAQVLHL

SEQ ID NO: 7392 - protein, 10 aa, Artificial Sequence
  Peptide Derived from Human Papillomavirus
EVSGDTPEWI

SEQ ID NO: 7393 - protein, 11 aa, Artificial Sequence
  Peptide Derived from Human Papillomavirus
FAGGSKENSPL

SEQ ID NO: 7394 - protein, 8 aa, Artificial Sequence
  Peptide Derived from Human Papillomavirus
FIDTQLSI

SEQ ID NO: 7395 - protein, 8 aa, Artificial Sequence
  Peptide Derived from Human Papillomavirus
FIHFLQGA

SEQ ID NO: 7396 - protein, 9 aa, Artificial Sequence
  Peptide Derived from Human Papillomavirus
FIHFLQGAI

SEQ ID NO: 7397 - protein, 10 aa, Artificial Sequence
  Peptide Derived from Human Papillomavirus
FIHFLQGAII

SEQ ID NO: 7398 - protein, 8 aa, Artificial Sequence
  Peptide Derived from Human Papillomavirus
FISFLRAL

SEQ ID NO: 7399 - protein, 11 aa, Artificial Sequence
  Peptide Derived from Human Papillomavirus
FLKGTPKKNCI

SEQ ID NO: 7400 - protein, 8 aa, Artificial Sequence
  Peptide Derived from Human Papillomavirus
FLKSNCQA

SEQ ID NO: 7401 - protein, 11 aa, Artificial Sequence
  Peptide Derived from Human Papillomavirus
FLKSNCQAKYL

SEQ ID NO: 7402 - protein, 10 aa, Artificial Sequence
  Peptide Derived from Human Papillomavirus
FLQGAIISFV

SEQ ID NO: 7403 - protein, 9 aa, Artificial Sequence
  Peptide Derived from Human Papillomavirus
FLRALKEFL

SEQ ID NO: 7404 - protein, 10 aa, Artificial Sequence
  Peptide Derived from Human Papillomavirus
FLRYQGVEFI

SEQ ID NO: 7405 - protein, 10 aa, Artificial Sequence
  Peptide Derived from Human Papillomavirus
FVETIVEKKT

SEQ ID NO: 7406 - protein, 10 aa, Artificial Sequence
  Peptide Derived from Human Papillomavirus
FVNSNSHFWL

SEQ ID NO: 7407 - protein, 9 aa, Artificial Sequence
  Peptide Derived from Human Papillomavirus
GIDDSNFDL

SEQ ID NO: 7408 - protein, 10 aa, Artificial Sequence
  Peptide Derived from Human Papillomavirus
GIPFGTFKCV

SEQ ID NO: 7409 - protein, 11 aa, Artificial Sequence
  Peptide Derived from Human Papillomavirus
GIPFGTFKCVT

SEQ ID NO: 7410 - protein, 8 aa, Artificial Sequence
  Peptide Derived from Human Papillomavirus
GISNISEV

SEQ ID NO: 7411 - protein, 8 aa, Artificial Sequence
  Peptide Derived from Human Papillomavirus
GLSFTDLV

SEQ ID NO: 7412 - protein, 8 aa, Artificial Sequence
  Peptide Derived from Human Papillomavirus
GLSTLLHV

SEQ ID NO: 7413 - protein, 11 aa, Artificial Sequence
  Peptide Derived from Human Papillomavirus
GLSTLLHVPET

SEQ ID NO: 7414 - protein, 8 aa, Artificial Sequence
  Peptide Derived from Human Papillomavirus
GMSFIHFL

SEQ ID NO: 7415 - protein, 11 aa, Artificial Sequence
  Peptide Derived from Human Papillomavirus
GMSFIHFLQGA

SEQ ID NO: 7416 - protein, 11 aa, Artificial Sequence
  Peptide Derived from Human Papillomavirus
GTFKCVTGQNT

SEQ ID NO: 7417 - protein, 10 aa, Artificial Sequence
  Peptide Derived from Human Papillomavirus
GTGCNGWFFV

SEQ ID NO: 7418 - protein, 8 aa, Artificial Sequence
  Peptide Derived from Human Papillomavirus
GTPKKNCI

SEQ ID NO: 7419 - protein, 9 aa, Artificial Sequence
  Peptide Derived from Human Papillomavirus
GTPKKNCIL

SEQ ID NO: 7420 - protein, 10 aa, Artificial Sequence
  Peptide Derived from Human Papillomavirus
GTPKKNCILL

SEQ ID NO: 7421 - protein, 8 aa, Artificial Sequence
  Peptide Derived from Human Papillomavirus
GVEFISFL

SEQ ID NO: 7422 - protein, 10 aa, Artificial Sequence
  Peptide Derived from Human Papillomavirus
GVEFISFLRA

SEQ ID NO: 7423 - protein, 11 aa, Artificial Sequence
  Peptide Derived from Human Papillomavirus
GVEFISFLRAL

SEQ ID NO: 7424 - protein, 8 aa, Artificial Sequence
  Peptide Derived from Human Papillomavirus
GVLILALL

SEQ ID NO: 7425 - protein, 9 aa, Artificial Sequence
  Peptide Derived from Human Papillomavirus
HAQEVQNDA

SEQ ID NO: 7426 - protein, 11 aa, Artificial Sequence
  Peptide Derived from Human Papillomavirus
HAQEVQNDAQV

SEQ ID NO: 7427 - protein, 11 aa, Artificial Sequence
  Peptide Derived from Human Papillomavirus
HIQCLDCKWGV

SEQ ID NO: 7428 - protein, 8 aa, Artificial Sequence
  Peptide Derived from Human Papillomavirus
HLLKRKFA

SEQ ID NO: 7429 - protein, 11 aa, Artificial Sequence
  Peptide Derived from Human Papillomavirus
HTCWTYFDNYM

SEQ ID NO: 7430 - protein, 8 aa, Artificial Sequence
  Peptide Derived from Human Papillomavirus
HVPETCML

SEQ ID NO: 7431 - protein, 9 aa, Artificial Sequence
  Peptide Derived from Human Papillomavirus
HVPETCMLI

SEQ ID NO: 7432 - protein, 10 aa, Artificial Sequence
  Peptide Derived from Human Papillomavirus
ILLTSNIDPA

SEQ ID NO: 7433 - protein, 9 aa, Artificial Sequence
  Peptide Derived from Human Papillomavirus
ILLYGPANT

SEQ ID NO: 7434 - protein, 10 aa, Artificial Sequence
  Peptide Derived from Human Papillomavirus
IQCLDCKWGV

SEQ ID NO: 7435 - protein, 11 aa, Artificial Sequence
  Peptide Derived from Human Papillomavirus
IQCLDCKWGVL

SEQ ID NO: 7436 - protein, 11 aa, Artificial Sequence
  Peptide Derived from Human Papillomavirus
IQRLTIIQHGI

SEQ ID NO: 7437 - protein, 8 aa, Artificial Sequence
  Peptide Derived from Human Papillomavirus
ITELKELL

SEQ ID NO: 7438 - protein, 10 aa, Artificial Sequence
  Peptide Derived from Human Papillomavirus
ITELKELLQA

SEQ ID NO: 7439 - protein, 9 aa, Artificial Sequence
  Peptide Derived from Human Papillomavirus
IVEKKTGDV

SEQ ID NO: 7440 - protein, 10 aa, Artificial Sequence
  Peptide Derived from Human Papillomavirus
IVEKKTGDVI

SEQ ID NO: 7441 - protein, 10 aa, Artificial Sequence
  Peptide Derived from Human Papillomavirus
IVQFLRYQGV

SEQ ID NO: 7442 - protein, 11 aa, Artificial Sequence
  Peptide Derived from Human Papillomavirus
KAAMLAVFKDI

SEQ ID NO: 7443 - protein, 8 aa, Artificial Sequence
  Peptide Derived from Human Papillomavirus
KAKRRLFT

SEQ ID NO: 7444 - protein, 9 aa, Artificial Sequence
  Peptide Derived from Human Papillomavirus
KAKRRLFTI

SEQ ID NO: 7445 - protein, 11 aa, Artificial Sequence
  Peptide Derived from Human Papillomavirus
KIDEGGDWRPI

SEQ ID NO: 7446 - protein, 8 aa, Artificial Sequence
  Peptide Derived from Human Papillomavirus
KLRSSVAA

SEQ ID NO: 7447 - protein, 9 aa, Artificial Sequence
  Peptide Derived from Human Papillomavirus
KLRSSVAAL

SEQ ID NO: 7448 - protein, 8 aa, Artificial Sequence
  Peptide Derived from Human Papillomavirus
KTLIKPAT

SEQ ID NO: 7449 - protein, 9 aa, Artificial Sequence
  Peptide Derived from Human Papillomavirus
KTLIKPATL

SEQ ID NO: 7450 - protein, 11 aa, Artificial Sequence
  Peptide Derived from Human Papillomavirus
KTLIKPATLYA

SEQ ID NO: 7451 - protein, 8 aa, Artificial Sequence
  Peptide Derived from Human Papillomavirus
KTTCTDWV

SEQ ID NO: 7452 - protein, 9 aa, Artificial Sequence
  Peptide Derived from Human Papillomavirus
KTTCTDWVM

SEQ ID NO: 7453 - protein, 10 aa, Artificial Sequence
  Peptide Derived from Human Papillomavirus
KTTCTDWVMA

SEQ ID NO: 7454 - protein, 11 aa, Artificial Sequence
  Peptide Derived from Human Papillomavirus
KTTCTDWVMAI

SEQ ID NO: 7455 - protein, 8 aa, Artificial Sequence
  Peptide Derived from Human Papillomavirus
KVAMLDDA

SEQ ID NO: 7456 - protein, 9 aa, Artificial Sequence
  Peptide Derived from Human Papillomavirus
KVAMLDDAT

SEQ ID NO: 7457 - protein, 11 aa, Artificial Sequence
  Peptide Derived from Human Papillomavirus
KVAMLDDATHT

SEQ ID NO: 7458 - protein, 8 aa, Artificial Sequence
  Peptide Derived from Human Papillomavirus
LADCNSNA

SEQ ID NO: 7459 - protein, 9 aa, Artificial Sequence
  Peptide Derived from Human Papillomavirus
LADCNSNAA

SEQ ID NO: 7460 - protein, 10 aa, Artificial Sequence
  Peptide Derived from Human Papillomavirus
LADCNSNAAA

SEQ ID NO: 7461 - protein, 8 aa, Artificial Sequence
  Peptide Derived from Human Papillomavirus
LADTKVAM

SEQ ID NO: 7462 - protein, 9 aa, Artificial Sequence
  Peptide Derived from Human Papillomavirus
LADTKVAML

SEQ ID NO: 7463 - protein, 10 aa, Artificial Sequence
  Peptide Derived from Human Papillomavirus
LAVFKDIYGL

SEQ ID NO: 7464 - protein, 11 aa, Artificial Sequence
  Peptide Derived from Human Papillomavirus
LIEPPKLRSSV

SEQ ID NO: 7465 - protein, 9 aa, Artificial Sequence
  Peptide Derived from Human Papillomavirus
LIKPATLYA

SEQ ID NO: 7466 - protein, 11 aa, Artificial Sequence
  Peptide Derived from Human Papillomavirus
LIKPATLYAHI

SEQ ID NO: 7467 - protein, 9 aa, Artificial Sequence
  Peptide Derived from Human Papillomavirus
LLHVPETCM

SEQ ID NO: 7468 - protein, 10 aa, Artificial Sequence
  Peptide Derived from Human Papillomavirus
LLHVPETCML

SEQ ID NO: 7469 - protein, 11 aa, Artificial Sequence
  Peptide Derived from Human Papillomavirus
LLHVPETCMLI

SEQ ID NO: 7470 - protein, 9 aa, Artificial Sequence
  Peptide Derived from Human Papillomavirus
LLQASNKKA

SEQ ID NO: 7471 - protein, 10 aa, Artificial Sequence
  Peptide Derived from Human Papillomavirus
LLQASNKKAA

SEQ ID NO: 7472 - protein, 11 aa, Artificial Sequence
  Peptide Derived from Human Papillomavirus
LLQASNKKAAM

SEQ ID NO: 7473 - protein, 9 aa, Artificial Sequence
  Peptide Derived from Human Papillomavirus
LLQLKCPPI

SEQ ID NO: 7474 - protein, 10 aa, Artificial Sequence
  Peptide Derived from Human Papillomavirus
LLQLKCPPIL

SEQ ID NO: 7475 - protein, 11 aa, Artificial Sequence
  Peptide Derived from Human Papillomavirus
LLQLKCPPILL

SEQ ID NO: 7476 - protein, 11 aa, Artificial Sequence
  Peptide Derived from Human Papillomavirus
LLRYKCGKNRL

SEQ ID NO: 7477 - protein, 9 aa, Artificial Sequence
  Peptide Derived from Human Papillomavirus
LLTSNIDPA

SEQ ID NO: 7478 - protein, 8 aa, Artificial Sequence
  Peptide Derived from Human Papillomavirus
LLYGPANT

SEQ ID NO: 7479 - protein, 8 aa, Artificial Sequence
  Peptide Derived from Human Papillomavirus
LQASNKKA

SEQ ID NO: 7480 - protein, 9 aa, Artificial Sequence
  Peptide Derived from Human Papillomavirus
LQASNKKAA

SEQ ID NO: 7481 - protein, 10 aa, Artificial Sequence
  Peptide Derived from Human Papillomavirus
LQASNKKAAM

SEQ ID NO: 7482 - protein, 11 aa, Artificial Sequence
  Peptide Derived from Human Papillomavirus
LQASNKKAAML

SEQ ID NO: 7483 - protein, 9 aa, Artificial Sequence
  Peptide Derived from Human Papillomavirus
LQGAIISFV

SEQ ID NO: 7484 - protein, 8 aa, Artificial Sequence
  Peptide Derived from Human Papillomavirus
LQLKCPPI

SEQ ID NO: 7485 - protein, 9 aa, Artificial Sequence
  Peptide Derived from Human Papillomavirus
LQLKCPPIL

SEQ ID NO: 7486 - protein, 10 aa, Artificial Sequence
  Peptide Derived from Human Papillomavirus
LQLKCPPILL

SEQ ID NO: 7487 - protein, 11 aa, Artificial Sequence
  Peptide Derived from Human Papillomavirus
LQLKCPPILLT

SEQ ID NO: 7488 - protein, 8 aa, Artificial Sequence
  Peptide Derived from Human Papillomavirus
LTDESDMA

SEQ ID NO: 7489 - protein, 8 aa, Artificial Sequence
  Peptide Derived from Human Papillomavirus
LTIIQHGI

SEQ ID NO: 7490 - protein, 8 aa, Artificial Sequence
  Peptide Derived from Human Papillomavirus
LTSNIDPA

SEQ ID NO: 7491 - protein, 9 aa, Artificial Sequence
  Peptide Derived from Human Papillomavirus
LTVAKGLST

SEQ ID NO: 7492 - protein, 10 aa, Artificial Sequence
  Peptide Derived from Human Papillomavirus
LTVAKGLSTL

SEQ ID NO: 7493 - protein, 11 aa, Artificial Sequence
  Peptide Derived from Human Papillomavirus
LTVAKGLSTLL

SEQ ID NO: 7494 - protein, 10 aa, Artificial Sequence
  Peptide Derived from Human Papillomavirus
LVRNFKSDKT

SEQ ID NO: 7495 - protein, 11 aa, Artificial Sequence
  Peptide Derived from Human Papillomavirus
LVRNFKSDKTT

SEQ ID NO: 7496 - protein, 8 aa, Artificial Sequence
  Peptide Derived from Human Papillomavirus
MAFQYAQL

SEQ ID NO: 7497 - protein, 9 aa, Artificial Sequence
  Peptide Derived from Human Papillomavirus
MAFQYAQLA

SEQ ID NO: 7498 - protein, 9 aa, Artificial Sequence
  Peptide Derived from Human Papillomavirus
MAIFGVNPT

SEQ ID NO: 7499 - protein, 10 aa, Artificial Sequence
  Peptide Derived from Human Papillomavirus
MAIFGVNPTV

SEQ ID NO: 7500 - protein, 11 aa, Artificial Sequence
  Peptide Derived from Human Papillomavirus
MAIFGVNPTVA

SEQ ID NO: 7501 - protein, 8 aa, Artificial Sequence
  Peptide Derived from Human Papillomavirus
MLAVFKDI

SEQ ID NO: 7502 - protein, 11 aa, Artificial Sequence
  Peptide Derived from Human Papillomavirus
MLAVFKDIYGL

SEQ ID NO: 7503 - protein, 8 aa, Artificial Sequence
  Peptide Derived from Human Papillomavirus
MLDDATHT

SEQ ID NO: 7504 - protein, 11 aa, Artificial Sequence
  Peptide Derived from Human Papillomavirus
MLDDATHTCWT

SEQ ID NO: 7505 - protein, 8 aa, Artificial Sequence
  Peptide Derived from Human Papillomavirus
MLIEPPKL

SEQ ID NO: 7506 - protein, 9 aa, Artificial Sequence
  Peptide Derived from Human Papillomavirus
MVDFIDTQL

SEQ ID NO: 7507 - protein, 11 aa, Artificial Sequence
  Peptide Derived from Human Papillomavirus
MVDFIDTQLSI

SEQ ID NO: 7508 - protein, 10 aa, Artificial Sequence
  Peptide Derived from Human Papillomavirus
MVQWAFDNDL

SEQ ID NO: 7509 - protein, 11 aa, Artificial Sequence
  Peptide Derived from Human Papillomavirus
MVQWAFDNDLT

SEQ ID NO: 7510 - protein, 8 aa, Artificial Sequence
  Peptide Derived from Human Papillomavirus
NAENGGSV

SEQ ID NO: 7511 - protein, 11 aa, Artificial Sequence
  Peptide Derived from Human Papillomavirus
NAENGGSVHST

SEQ ID NO: 7512 - protein, 11 aa, Artificial Sequence
  Peptide Derived from Human Papillomavirus
NAENVDPHCSI

SEQ ID NO: 7513 - protein, 8 aa, Artificial Sequence
  Peptide Derived from Human Papillomavirus
NALDGNPI

SEQ ID NO: 7514 - protein, 10 aa, Artificial Sequence
  Peptide Derived from Human Papillomavirus
NALDGNPISI

SEQ ID NO: 7515 - protein, 9 aa, Artificial Sequence
  Peptide Derived from Human Papillomavirus
NISEVSGDT

SEQ ID NO: 7516 - protein, 9 aa, Artificial Sequence
  Peptide Derived from Human Papillomavirus
NTGKSYFGM

SEQ ID NO: 7517 - protein, 10 aa, Artificial Sequence
  Peptide Derived from Human Papillomavirus
NTNAENGGSV

SEQ ID NO: 7518 - protein, 8 aa, Artificial Sequence
  Peptide Derived from Human Papillomavirus
NVDPHCSI

SEQ ID NO: 7519 - protein, 9 aa, Artificial Sequence
  Peptide Derived from Human Papillomavirus
NVDPHCSIT

SEQ ID NO: 7520 - protein, 11 aa, Artificial Sequence
  Peptide Derived from Human Papillomavirus
NVDPHCSITEL

SEQ ID NO: 7521 - protein, 10 aa, Artificial Sequence
  Peptide Derived from Human Papillomavirus
PAKDNKWPYL

SEQ ID NO: 7522 - protein, 11 aa, Artificial Sequence
  Peptide Derived from Human Papillomavirus
PANTGKSYFGM

SEQ ID NO: 7523 - protein, 8 aa, Artificial Sequence
  Peptide Derived from Human Papillomavirus
PATLYAHI

SEQ ID NO: 7524 - protein, 11 aa, Artificial Sequence
  Peptide Derived from Human Papillomavirus
PATLYAHIQCL

SEQ ID NO: 7525 - protein, 8 aa, Artificial Sequence
  Peptide Derived from Human Papillomavirus
PILLTSNI

SEQ ID NO: 7526 - protein, 11 aa, Artificial Sequence
  Peptide Derived from Human Papillomavirus
PILLTSNIDPA

SEQ ID NO: 7527 - protein, 11 aa, Artificial Sequence
  Peptide Derived from Human Papillomavirus
PISIDRKHKPL

SEQ ID NO: 7528 - protein, 11 aa, Artificial Sequence
  Peptide Derived from Human Papillomavirus
PIVQFLRYQGV

SEQ ID NO: 7529 - protein, 8 aa, Artificial Sequence
  Peptide Derived from Human Papillomavirus
PLADTKVA

SEQ ID NO: 7530 - protein, 9 aa, Artificial Sequence
  Peptide Derived from Human Papillomavirus
PLADTKVAM

SEQ ID NO: 7531 - protein, 10 aa, Artificial Sequence
  Peptide Derived from Human Papillomavirus
PLADTKVAML

SEQ ID NO: 7532 - protein, 8 aa, Artificial Sequence
  Peptide Derived from Human Papillomavirus
PLGEQLSV

SEQ ID NO: 7533 - protein, 10 aa, Artificial Sequence
  Peptide Derived from Human Papillomavirus
PLGEQLSVDT

SEQ ID NO: 7534 - protein, 10 aa, Artificial Sequence
  Peptide Derived from Human Papillomavirus
PLLQLKCPPI

SEQ ID NO: 7535 - protein, 11 aa, Artificial Sequence
  Peptide Derived from Human Papillomavirus
PLLQLKCPPIL

SEQ ID NO: 7536 - protein, 9 aa, Artificial Sequence
  Peptide Derived from Human Papillomavirus
PTVAEGFKT

SEQ ID NO: 7537 - protein, 10 aa, Artificial Sequence
  Peptide Derived from Human Papillomavirus
PTVAEGFKTL

SEQ ID NO: 7538 - protein, 11 aa, Artificial Sequence
  Peptide Derived from Human Papillomavirus
PTVAEGFKTLI

SEQ ID NO: 7539 - protein, 9 aa, Artificial Sequence
  Peptide Derived from Human Papillomavirus
QAEQETAQA

SEQ ID NO: 7540 - protein, 10 aa, Artificial Sequence
  Peptide Derived from Human Papillomavirus
QAEQETAQAL

SEQ ID NO: 7541 - protein, 9 aa, Artificial Sequence
  Peptide Derived from Human Papillomavirus
QAKYLKDCA

SEQ ID NO: 7542 - protein, 10 aa, Artificial Sequence
  Peptide Derived from Human Papillomavirus
QAKYLKDCAV

SEQ ID NO: 7543 - protein, 11 aa, Artificial Sequence
  Peptide Derived from Human Papillomavirus
QAKYLKDCAVM

SEQ ID NO: 7544 - protein, 9 aa, Artificial Sequence
  Peptide Derived from Human Papillomavirus
QALFHAQEV

SEQ ID NO: 7545 - protein, 8 aa, Artificial Sequence
  Peptide Derived from Human Papillomavirus
QASNKKAA

SEQ ID NO: 7546 - protein, 9 aa, Artificial Sequence
  Peptide Derived from Human Papillomavirus
QASNKKAAM

SEQ ID NO: 7547 - protein, 10 aa, Artificial Sequence
  Peptide Derived from Human Papillomavirus
QASNKKAAML

SEQ ID NO: 7548 - protein, 11 aa, Artificial Sequence
  Peptide Derived from Human Papillomavirus
QASNKKAAMLA

SEQ ID NO: 7549 - protein, 9 aa, Artificial Sequence
  Peptide Derived from Human Papillomavirus
QLADCNSNA

SEQ ID NO: 7550 - protein, 10 aa, Artificial Sequence
  Peptide Derived from Human Papillomavirus
QLADCNSNAA

SEQ ID NO: 7551 - protein, 11 aa, Artificial Sequence
  Peptide Derived from Human Papillomavirus
QLADCNSNAAA

SEQ ID NO: 7552 - protein, 8 aa, Artificial Sequence
  Peptide Derived from Human Papillomavirus
QLKCPPIL

SEQ ID NO: 7553 - protein, 9 aa, Artificial Sequence
  Peptide Derived from Human Papillomavirus
QLKCPPILL

SEQ ID NO: 7554 - protein, 10 aa, Artificial Sequence
  Peptide Derived from Human Papillomavirus
QLKCPPILLT

SEQ ID NO: 7555 - protein, 8 aa, Artificial Sequence
  Peptide Derived from Human Papillomavirus
QLSICEQA

SEQ ID NO: 7556 - protein, 8 aa, Artificial Sequence
  Peptide Derived from Human Papillomavirus
QLSVDTDL

SEQ ID NO: 7557 - protein, 8 aa, Artificial Sequence
  Peptide Derived from Human Papillomavirus
QMNMSQWI

SEQ ID NO: 7558 - protein, 11 aa, Artificial Sequence
  Peptide Derived from Human Papillomavirus
QVLHLLKRKFA

SEQ ID NO: 7559 - protein, 8 aa, Artificial Sequence
  Peptide Derived from Human Papillomavirus
QVTVNTNA

SEQ ID NO: 7560 - protein, 10 aa, Artificial Sequence
  Peptide Derived from Human Papillomavirus
RALKEFLKGT

SEQ ID NO: 7561 - protein, 9 aa, Artificial Sequence
  Peptide Derived from Human Papillomavirus
RAQKRQMNM

SEQ ID NO: 7562 - protein, 11 aa, Artificial Sequence
  Peptide Derived from Human Papillomavirus
RLDLHEDDEDA

SEQ ID NO: 7563 - protein, 9 aa, Artificial Sequence
  Peptide Derived from Human Papillomavirus
RLTIIQHGI

SEQ ID NO: 7564 - protein, 8 aa, Artificial Sequence
  Peptide Derived from Human Papillomavirus
RLTVAKGL

SEQ ID NO: 7565 - protein, 10 aa, Artificial Sequence
  Peptide Derived from Human Papillomavirus
RLTVAKGLST

SEQ ID NO: 7566 - protein, 11 aa, Artificial Sequence
  Peptide Derived from Human Papillomavirus
RLTVAKGLSTL

SEQ ID NO: 7567 - protein, 9 aa, Artificial Sequence
  Peptide Derived from Human Papillomavirus
RQMNMSQWI

SEQ ID NO: 7568 - protein, 10 aa, Artificial Sequence
  Peptide Derived from Human Papillomavirus
RTGISNISEV

SEQ ID NO: 7569 - protein, 8 aa, Artificial Sequence
  Peptide Derived from Human Papillomavirus
RTWSRLDL

SEQ ID NO: 7570 - protein, 10 aa, Artificial Sequence
  Peptide Derived from Human Papillomavirus
RVTVFTFPHA

SEQ ID NO: 7571 - protein, 10 aa, Artificial Sequence
  Peptide Derived from Human Papillomavirus
SICEQAEQET

SEQ ID NO: 7572 - protein, 11 aa, Artificial Sequence
  Peptide Derived from Human Papillomavirus
SICEQAEQETA

SEQ ID NO: 7573 - protein, 9 aa, Artificial Sequence
  Peptide Derived from Human Papillomavirus
SIDRKHKPL

SEQ ID NO: 7574 - protein, 10 aa, Artificial Sequence
  Peptide Derived from Human Papillomavirus
SIDRKHKPLL

SEQ ID NO: 7575 - protein, 8 aa, Artificial Sequence
  Peptide Derived from Human Papillomavirus
SITELKEL

SEQ ID NO: 7576 - protein, 9 aa, Artificial Sequence
  Peptide Derived from Human Papillomavirus
SITELKELL

SEQ ID NO: 7577 - protein, 11 aa, Artificial Sequence
  Peptide Derived from Human Papillomavirus
SITELKELLQA

SEQ ID NO: 7578 - protein, 9 aa, Artificial Sequence
  Peptide Derived from Human Papillomavirus
SLNSGHKKA

SEQ ID NO: 7579 - protein, 11 aa, Artificial Sequence
  Peptide Derived from Human Papillomavirus
SQWIKYRCSKI

SEQ ID NO: 7580 - protein, 9 aa, Artificial Sequence
  Peptide Derived from Human Papillomavirus
STLLHVPET

SEQ ID NO: 7581 - protein, 11 aa, Artificial Sequence
  Peptide Derived from Human Papillomavirus
STLLHVPETCM

SEQ ID NO: 7582 - protein, 10 aa, Artificial Sequence
  Peptide Derived from Human Papillomavirus
SVAALYWYRT

SEQ ID NO: 7583 - protein, 10 aa, Artificial Sequence
  Peptide Derived from Human Papillomavirus
SVDTDLSPRL

SEQ ID NO: 7584 - protein, 8 aa, Artificial Sequence
  Peptide Derived from Human Papillomavirus
TAQALFHA

SEQ ID NO: 7585 - protein, 11 aa, Artificial Sequence
  Peptide Derived from Human Papillomavirus
TAQALFHAQEV

SEQ ID NO: 7586 - protein, 9 aa, Artificial Sequence
  Peptide Derived from Human Papillomavirus
TATDTGSDM

SEQ ID NO: 7587 - protein, 10 aa, Artificial Sequence
  Peptide Derived from Human Papillomavirus
TATDTGSDMV

SEQ ID NO: 7588 - protein, 10 aa, Artificial Sequence
  Peptide Derived from Human Papillomavirus
TIVEKKTGDV

SEQ ID NO: 7589 - protein, 11 aa, Artificial Sequence
  Peptide Derived from Human Papillomavirus
TIVEKKTGDVI

SEQ ID NO: 7590 - protein, 8 aa, Artificial Sequence
  Peptide Derived from Human Papillomavirus
TLIKPATL

SEQ ID NO: 7591 - protein, 10 aa, Artificial Sequence
  Peptide Derived from Human Papillomavirus
TLIKPATLYA

SEQ ID NO: 7592 - protein, 8 aa, Artificial Sequence
  Peptide Derived from Human Papillomavirus
TLLHVPET

SEQ ID NO: 7593 - protein, 10 aa, Artificial Sequence
  Peptide Derived from Human Papillomavirus
TLLHVPETCM

SEQ ID NO: 7594 - protein, 11 aa, Artificial Sequence
  Peptide Derived from Human Papillomavirus
TLLHVPETCML

SEQ ID NO: 7595 - protein, 9 aa, Artificial Sequence
  Peptide Derived from Human Papillomavirus
TLYAHIQCL

SEQ ID NO: 7596 - protein, 9 aa, Artificial Sequence
  Peptide Derived from Human Papillomavirus
TQLSICEQA

SEQ ID NO: 7597 - protein, 9 aa, Artificial Sequence
  Peptide Derived from Human Papillomavirus
TQVTVNTNA

SEQ ID NO: 7598 - protein, 8 aa, Artificial Sequence
  Peptide Derived from Human Papillomavirus
TTCTDWVM

SEQ ID NO: 7599 - protein, 9 aa, Artificial Sequence
  Peptide Derived from Human Papillomavirus
TTCTDWVMA

SEQ ID NO: 7600 - protein, 10 aa, Artificial Sequence
  Peptide Derived from Human Papillomavirus
TTCTDWVMAI

SEQ ID NO: 7601 - protein, 8 aa, Artificial Sequence
  Peptide Derived from Human Papillomavirus
TVAEGFKT

SEQ ID NO: 7602 - protein, 9 aa, Artificial Sequence
  Peptide Derived from Human Papillomavirus
TVAEGFKTL

SEQ ID NO: 7603 - protein, 10 aa, Artificial Sequence
  Peptide Derived from Human Papillomavirus
TVAEGFKTLI

SEQ ID NO: 7604 - protein, 8 aa, Artificial Sequence
  Peptide Derived from Human Papillomavirus
TVAKGLST

SEQ ID NO: 7605 - protein, 9 aa, Artificial Sequence
  Peptide Derived from Human Papillomavirus
TVAKGLSTL

SEQ ID NO: 7606 - protein, 10 aa, Artificial Sequence
  Peptide Derived from Human Papillomavirus
TVAKGLSTLL

SEQ ID NO: 7607 - protein, 8 aa, Artificial Sequence
  Peptide Derived from Human Papillomavirus
TVFTFPHA

SEQ ID NO: 7608 - protein, 9 aa, Artificial Sequence
  Peptide Derived from Human Papillomavirus
VAALYWYRT

SEQ ID NO: 7609 - protein, 11 aa, Artificial Sequence
  Peptide Derived from Human Papillomavirus
VAALYWYRTGI

SEQ ID NO: 7610 - protein, 8 aa, Artificial Sequence
  Peptide Derived from Human Papillomavirus
VAEGFKTL

SEQ ID NO: 7611 - protein, 9 aa, Artificial Sequence
  Peptide Derived from Human Papillomavirus
VAEGFKTLI

SEQ ID NO: 7612 - protein, 8 aa, Artificial Sequence
  Peptide Derived from Human Papillomavirus
VAKGLSTL

SEQ ID NO: 7613 - protein, 9 aa, Artificial Sequence
  Peptide Derived from Human Papillomavirus
VAKGLSTLL

SEQ ID NO: 7614 - protein, 11 aa, Artificial Sequence
  Peptide Derived from Human Papillomavirus
VAKGLSTLLHV

SEQ ID NO: 7615 - protein, 8 aa, Artificial Sequence
  Peptide Derived from Human Papillomavirus
VAMLDDAT

SEQ ID NO: 7616 - protein, 10 aa, Artificial Sequence
  Peptide Derived from Human Papillomavirus
VAMLDDATHT

SEQ ID NO: 7617 - protein, 9 aa, Artificial Sequence
  Peptide Derived from Human Papillomavirus
VISDDEDET

SEQ ID NO: 7618 - protein, 10 aa, Artificial Sequence
  Peptide Derived from Human Papillomavirus
VISDDEDETA

SEQ ID NO: 7619 - protein, 11 aa, Artificial Sequence
  Peptide Derived from Human Papillomavirus
VISDDEDETAT

SEQ ID NO: 7620 - protein, 10 aa, Artificial Sequence
  Peptide Derived from Human Papillomavirus
VLHLLKRKFA

SEQ ID NO: 7621 - protein, 10 aa, Artificial Sequence
  Peptide Derived from Human Papillomavirus
VMAIFGVNPT

SEQ ID NO: 7622 - protein, 11 aa, Artificial Sequence
  Peptide Derived from Human Papillomavirus
VMAIFGVNPTV

SEQ ID NO: 7623 - protein, 9 aa, Artificial Sequence
  Peptide Derived from Human Papillomavirus
VMCRHYKRA

SEQ ID NO: 7624 - protein, 9 aa, Artificial Sequence
  Peptide Derived from Human Papillomavirus
VQFLRYQGV

SEQ ID NO: 7625 - protein, 8 aa, Artificial Sequence
  Peptide Derived from Human Papillomavirus
VQNDAQVL

SEQ ID NO: 7626 - protein, 10 aa, Artificial Sequence
  Peptide Derived from Human Papillomavirus
VQNDAQVLHL

SEQ ID NO: 7627 - protein, 11 aa, Artificial Sequence
  Peptide Derived from Human Papillomavirus
VQNDAQVLHLL

SEQ ID NO: 7628 - protein, 9 aa, Artificial Sequence
  Peptide Derived from Human Papillomavirus
VQWAFDNDL

SEQ ID NO: 7629 - protein, 10 aa, Artificial Sequence
  Peptide Derived from Human Papillomavirus
VQWAFDNDLT

SEQ ID NO: 7630 - protein, 9 aa, Artificial Sequence
  Peptide Derived from Human Papillomavirus
VTGQNTRPL

SEQ ID NO: 7631 - protein, 9 aa, Artificial Sequence
  Peptide Derived from Human Papillomavirus
VTVFTFPHA

SEQ ID NO: 7632 - protein, 8 aa, Artificial Sequence
  Peptide Derived from Human Papillomavirus
WAFDNDLT

SEQ ID NO: 7633 - protein, 9 aa, Artificial Sequence
  Peptide Derived from Human Papillomavirus
WIKYRCSKI

SEQ ID NO: 7634 - protein, 8 aa, Artificial Sequence
  Peptide Derived from Human Papillomavirus
WIQRLTII

SEQ ID NO: 7635 - protein, 8 aa, Artificial Sequence
  Peptide Derived from Human Papillomavirus
WLEPLADT

SEQ ID NO: 7636 - protein, 10 aa, Artificial Sequence
  Peptide Derived from Human Papillomavirus
WLEPLADTKV

SEQ ID NO: 7637 - protein, 11 aa, Artificial Sequence
  Peptide Derived from Human Papillomavirus
WLEPLADTKVA

SEQ ID NO: 7638 - protein, 8 aa, Artificial Sequence
  Peptide Derived from Human Papillomavirus
WTYFDNYM

SEQ ID NO: 7639 - protein, 11 aa, Artificial Sequence
  Peptide Derived from Human Papillomavirus
WTYFDNYMRNA

SEQ ID NO: 7640 - protein, 8 aa, Artificial Sequence
  Peptide Derived from Human Papillomavirus
WVMAIFGV

SEQ ID NO: 7641 - protein, 11 aa, Artificial Sequence
  Peptide Derived from Human Papillomavirus
WVMAIFGVNPT

SEQ ID NO: 7642 - protein, 11 aa, Artificial Sequence
  Peptide Derived from Human Papillomavirus
YAQLADCNSNA

SEQ ID NO: 7643 - protein, 8 aa, Artificial Sequence
  Peptide Derived from Human Papillomavirus
YLESRVTV

SEQ ID NO: 7644 - protein, 10 aa, Artificial Sequence
  Peptide Derived from Human Papillomavirus
YLESRVTVFT

SEQ ID NO: 7645 - protein, 8 aa, Artificial Sequence
  Peptide Derived from Human Papillomavirus
YLKDCAVM

SEQ ID NO: 7646 - protein, 11 aa, Artificial Sequence
  Peptide Derived from Human Papillomavirus
YMRNALDGNPI

SEQ ID NO: 7647 - protein, 10 aa, Artificial Sequence
  Peptide Derived from Human Papillomavirus
YQGVEFISFL

SEQ ID NO: 7648 - protein, 9 aa, Artificial Sequence
  Peptide Derived from Human Papillomavirus
AACVSYWGV

SEQ ID NO: 7649 - protein, 8 aa, Artificial Sequence
  Peptide Derived from Human Papillomavirus
AIELQMAL

SEQ ID NO: 7650 - protein, 11 aa, Artificial Sequence
  Peptide Derived from Human Papillomavirus
AIELQMALKGL

SEQ ID NO: 7651 - protein, 11 aa, Artificial Sequence
  Peptide Derived from Human Papillomavirus
AILFTAREHGI

SEQ ID NO: 7652 - protein, 11 aa, Artificial Sequence
  Peptide Derived from Human Papillomavirus
AQSKYNNEEWT

SEQ ID NO: 7653 - protein, 10 aa, Artificial Sequence
  Peptide Derived from Human Papillomavirus
ATKRPRQCGL

SEQ ID NO: 7654 - protein, 11 aa, Artificial Sequence
  Peptide Derived from Human Papillomavirus
ATKRPRQCGLT

SEQ ID NO: 7655 - protein, 8 aa, Artificial Sequence
  Peptide Derived from Human Papillomavirus
ATQIVRQL

SEQ ID NO: 7656 - protein, 11 aa, Artificial Sequence
  Peptide Derived from Human Papillomavirus
ATQIVRQLQHA

SEQ ID NO: 7657 - protein, 10 aa, Artificial Sequence
  Peptide Derived from Human Papillomavirus
CLRYRLRKYA

SEQ ID NO: 7658 - protein, 10 aa, Artificial Sequence
  Peptide Derived from Human Papillomavirus
CMNYVVWDSI

SEQ ID NO: 7659 - protein, 10 aa, Artificial Sequence
  Peptide Derived from Human Papillomavirus
CVSYWGVYYI

SEQ ID NO: 7660 - protein, 11 aa, Artificial Sequence
  Peptide Derived from Human Papillomavirus
DINSQISYWQL

SEQ ID NO: 7661 - protein, 9 aa, Artificial Sequence
  Peptide Derived from Human Papillomavirus
DTCEELWNT

SEQ ID NO: 7662 - protein, 8 aa, Artificial Sequence
  Peptide Derived from Human Papillomavirus
DTVSATQI

SEQ ID NO: 7663 - protein, 9 aa, Artificial Sequence
  Peptide Derived from Human Papillomavirus
DTVSATQIV

SEQ ID NO: 7664 - protein, 9 aa, Artificial Sequence
  Peptide Derived from Human Papillomavirus
DVVTIPNSV

SEQ ID NO: 7665 - protein, 11 aa, Artificial Sequence
  Peptide Derived from Human Papillomavirus
DVVTIPNSVQI

SEQ ID NO: 7666 - protein, 9 aa, Artificial Sequence
  Peptide Derived from Human Papillomavirus
EISSTWHWT

SEQ ID NO: 7667 - protein, 9 aa, Artificial Sequence
  Peptide Derived from Human Papillomavirus
ELQMALKGL

SEQ ID NO: 7668 - protein, 10 aa, Artificial Sequence
  Peptide Derived from Human Papillomavirus
ELQMALKGLA

SEQ ID NO: 7669 - protein, 9 aa, Artificial Sequence
  Peptide Derived from Human Papillomavirus
EQHHGRVNT

SEQ ID NO: 7670 - protein, 11 aa, Artificial Sequence
  Peptide Derived from Human Papillomavirus
EQHHGRVNTHV

SEQ ID NO: 7671 - protein, 8 aa, Artificial Sequence
  Peptide Derived from Human Papillomavirus
ETGIWDKT

SEQ ID NO: 7672 - protein, 9 aa, Artificial Sequence
  Peptide Derived from Human Papillomavirus
ETGIWDKTA

SEQ ID NO: 7673 - protein, 10 aa, Artificial Sequence
  Peptide Derived from Human Papillomavirus
ETGIWDKTAA

SEQ ID NO: 7674 - protein, 8 aa, Artificial Sequence
  Peptide Derived from Human Papillomavirus
EVQRNTFL

SEQ ID NO: 7675 - protein, 10 aa, Artificial Sequence
  Peptide Derived from Human Papillomavirus
EVQRNTFLDV

SEQ ID NO: 7676 - protein, 11 aa, Artificial Sequence
  Peptide Derived from Human Papillomavirus
EVQRNTFLDVV

SEQ ID NO: 7677 - protein, 8 aa, Artificial Sequence
  Peptide Derived from Human Papillomavirus
EVQYGGNV

SEQ ID NO: 7678 - protein, 9 aa, Artificial Sequence
  Peptide Derived from Human Papillomavirus
EVQYGGNVI

SEQ ID NO: 7679 - protein, 11 aa, Artificial Sequence
  Peptide Derived from Human Papillomavirus
FLDVVTIPNSV

SEQ ID NO: 7680 - protein, 8 aa, Artificial Sequence
  Peptide Derived from Human Papillomavirus
FTAREHGI

SEQ ID NO: 7681 - protein, 9 aa, Artificial Sequence
  Peptide Derived from Human Papillomavirus
FTAREHGIT

SEQ ID NO: 7682 - protein, 11 aa, Artificial Sequence
  Peptide Derived from Human Papillomavirus
FTAREHGITKL

SEQ ID NO: 7683 - protein, 11 aa, Artificial Sequence
  Peptide Derived from Human Papillomavirus
GILTVTYNSEV

SEQ ID NO: 7684 - protein, 9 aa, Artificial Sequence
  Peptide Derived from Human Papillomavirus
GITKLNHQV

SEQ ID NO: 7685 - protein, 10 aa, Artificial Sequence
  Peptide Derived from Human Papillomavirus
GITKLNHQVV

SEQ ID NO: 7686 - protein, 8 aa, Artificial Sequence
  Peptide Derived from Human Papillomavirus
GIWDKTAA

SEQ ID NO: 7687 - protein, 10 aa, Artificial Sequence
  Peptide Derived from Human Papillomavirus
GIWDKTAACV

SEQ ID NO: 7688 - protein, 10 aa, Artificial Sequence
  Peptide Derived from Human Papillomavirus
GLTEQHHGRV

SEQ ID NO: 7689 - protein, 9 aa, Artificial Sequence
  Peptide Derived from Human Papillomavirus
GTPKPHIQT

SEQ ID NO: 7690 - protein, 11 aa, Artificial Sequence
  Peptide Derived from Human Papillomavirus
GTPKPHIQTPA

SEQ ID NO: 7691 - protein, 10 aa, Artificial Sequence
  Peptide Derived from Human Papillomavirus
GVYYIKDGDT

SEQ ID NO: 7692 - protein, 11 aa, Artificial Sequence
  Peptide Derived from Human Papillomavirus
GVYYIKDGDTT

SEQ ID NO: 7693 - protein, 9 aa, Artificial Sequence
  Peptide Derived from Human Papillomavirus
HASTSTPKT

SEQ ID NO: 7694 - protein, 10 aa, Artificial Sequence
  Peptide Derived from Human Papillomavirus
HASTSTPKTA

SEQ ID NO: 7695 - protein, 9 aa, Artificial Sequence
  Peptide Derived from Human Papillomavirus
HLKGDKNSL

SEQ ID NO: 7696 - protein, 9 aa, Artificial Sequence
  Peptide Derived from Human Papillomavirus
HQVVPPINI

SEQ ID NO: 7697 - protein, 11 aa, Artificial Sequence
  Peptide Derived from Human Papillomavirus
HVHNPLLCSST

SEQ ID NO: 7698 - protein, 11 aa, Artificial Sequence
  Peptide Derived from Human Papillomavirus
IIHLKGDKNSL

SEQ ID NO: 7699 - protein, 10 aa, Artificial Sequence
  Peptide Derived from Human Papillomavirus
ILFTAREHGI

SEQ ID NO: 7700 - protein, 11 aa, Artificial Sequence
  Peptide Derived from Human Papillomavirus
ILFTAREHGIT

SEQ ID NO: 7701 - protein, 10 aa, Artificial Sequence
  Peptide Derived from Human Papillomavirus
ILTVTYNSEV

SEQ ID NO: 7702 - protein, 10 aa, Artificial Sequence
  Peptide Derived from Human Papillomavirus
ITETGIWDKT

SEQ ID NO: 7703 - protein, 11 aa, Artificial Sequence
  Peptide Derived from Human Papillomavirus
ITETGIWDKTA

SEQ ID NO: 7704 - protein, 8 aa, Artificial Sequence
  Peptide Derived from Human Papillomavirus
ITKLNHQV

SEQ ID NO: 7705 - protein, 9 aa, Artificial Sequence
  Peptide Derived from Human Papillomavirus
ITKLNHQVV

SEQ ID NO: 7706 - protein, 8 aa, Artificial Sequence
  Peptide Derived from Human Papillomavirus
IVRQLQHA

SEQ ID NO: 7707 - protein, 10 aa, Artificial Sequence
  Peptide Derived from Human Papillomavirus
IVRQLQHAST

SEQ ID NO: 7708 - protein, 8 aa, Artificial Sequence
  Peptide Derived from Human Papillomavirus
KAHKAIEL

SEQ ID NO: 7709 - protein, 10 aa, Artificial Sequence
  Peptide Derived from Human Papillomavirus
KAHKAIELQM

SEQ ID NO: 7710 - protein, 11 aa, Artificial Sequence
  Peptide Derived from Human Papillomavirus
KAHKAIELQMA

SEQ ID NO: 7711 - protein, 8 aa, Artificial Sequence
  Peptide Derived from Human Papillomavirus
KAIELQMA

SEQ ID NO: 7712 - protein, 9 aa, Artificial Sequence
  Peptide Derived from Human Papillomavirus
KAIELQMAL

SEQ ID NO: 7713 - protein, 10 aa, Artificial Sequence
  Peptide Derived from Human Papillomavirus
KLNHQVVPPI

SEQ ID NO: 7714 - protein, 9 aa, Artificial Sequence
  Peptide Derived from Human Papillomavirus
KMQTPKESL

SEQ ID NO: 7715 - protein, 11 aa, Artificial Sequence
  Peptide Derived from Human Papillomavirus
KTAACVSYWGV

SEQ ID NO: 7716 - protein, 8 aa, Artificial Sequence
  Peptide Derived from Human Papillomavirus
KVCSGNTT

SEQ ID NO: 7717 - protein, 10 aa, Artificial Sequence
  Peptide Derived from Human Papillomavirus
KVCSGNTTPI

SEQ ID NO: 7718 - protein, 11 aa, Artificial Sequence
  Peptide Derived from Human Papillomavirus
KVCSGNTTPII

SEQ ID NO: 7719 - protein, 8 aa, Artificial Sequence
  Peptide Derived from Human Papillomavirus
LIRLENAI

SEQ ID NO: 7720 - protein, 9 aa, Artificial Sequence
  Peptide Derived from Human Papillomavirus
LIRLENAIL

SEQ ID NO: 7721 - protein, 11 aa, Artificial Sequence
  Peptide Derived from Human Papillomavirus
LIRLENAILFT

SEQ ID NO: 7722 - protein, 8 aa, Artificial Sequence
  Peptide Derived from Human Papillomavirus
LQDTCEEL

SEQ ID NO: 7723 - protein, 11 aa, Artificial Sequence
  Peptide Derived from Human Papillomavirus
LQDTCEELWNT

SEQ ID NO: 7724 - protein, 8 aa, Artificial Sequence
  Peptide Derived from Human Papillomavirus
LQHASTST

SEQ ID NO: 7725 - protein, 11 aa, Artificial Sequence
  Peptide Derived from Human Papillomavirus
LQHASTSTPKT

SEQ ID NO: 7726 - protein, 8 aa, Artificial Sequence
  Peptide Derived from Human Papillomavirus
LQMALKGL

SEQ ID NO: 7727 - protein, 9 aa, Artificial Sequence
  Peptide Derived from Human Papillomavirus
LQMALKGLA

SEQ ID NO: 7728 - protein, 9 aa, Artificial Sequence
  Peptide Derived from Human Papillomavirus
LTEQHHGRV

SEQ ID NO: 7729 - protein, 11 aa, Artificial Sequence
  Peptide Derived from Human Papillomavirus
LTEQHHGRVNT

SEQ ID NO: 7730 - protein, 9 aa, Artificial Sequence
  Peptide Derived from Human Papillomavirus
LTVTYNSEV

SEQ ID NO: 7731 - protein, 8 aa, Artificial Sequence
  Peptide Derived from Human Papillomavirus
MQTPKESL

SEQ ID NO: 7732 - protein, 10 aa, Artificial Sequence
  Peptide Derived from Human Papillomavirus
NISKSKAHKA

SEQ ID NO: 7733 - protein, 11 aa, Artificial Sequence
  Peptide Derived from Human Papillomavirus
NISKSKAHKAI

SEQ ID NO: 7734 - protein, 8 aa, Artificial Sequence
  Peptide Derived from Human Papillomavirus
NTFLDVVT

SEQ ID NO: 7735 - protein, 9 aa, Artificial Sequence
  Peptide Derived from Human Papillomavirus
NTFLDVVTI

SEQ ID NO: 7736 - protein, 8 aa, Artificial Sequence
  Peptide Derived from Human Papillomavirus
NTGILTVT

SEQ ID NO: 7737 - protein, 8 aa, Artificial Sequence
  Peptide Derived from Human Papillomavirus
NTHVHNPL

SEQ ID NO: 7738 - protein, 9 aa, Artificial Sequence
  Peptide Derived from Human Papillomavirus
NTHVHNPLL

SEQ ID NO: 7739 - protein, 8 aa, Artificial Sequence
  Peptide Derived from Human Papillomavirus
NTTPIIHL

SEQ ID NO: 7740 - protein, 11 aa, Artificial Sequence
  Peptide Derived from Human Papillomavirus
NTWEVQYGGNV

SEQ ID NO: 7741 - protein, 9 aa, Artificial Sequence
  Peptide Derived from Human Papillomavirus
NVIDCNDSM

SEQ ID NO: 7742 - protein, 11 aa, Artificial Sequence
  Peptide Derived from Human Papillomavirus
PATKRPRQCGL

SEQ ID NO: 7743 - protein, 9 aa, Artificial Sequence
  Peptide Derived from Human Papillomavirus
PINISKSKA

SEQ ID NO: 7744 - protein, 8 aa, Artificial Sequence
  Peptide Derived from Human Papillomavirus
QISVGYMT

SEQ ID NO: 7745 - protein, 9 aa, Artificial Sequence
  Peptide Derived from Human Papillomavirus
QISVGYMTI

SEQ ID NO: 7746 - protein, 8 aa, Artificial Sequence
  Peptide Derived from Human Papillomavirus
QISYWQLI

SEQ ID NO: 7747 - protein, 10 aa, Artificial Sequence
  Peptide Derived from Human Papillomavirus
QISYWQLIRL

SEQ ID NO: 7748 - protein, 9 aa, Artificial Sequence
  Peptide Derived from Human Papillomavirus
QIVRQLQHA

SEQ ID NO: 7749 - protein, 11 aa, Artificial Sequence
  Peptide Derived from Human Papillomavirus
QIVRQLQHAST

SEQ ID NO: 7750 - protein, 8 aa, Artificial Sequence
  Peptide Derived from Human Papillomavirus
QLIRLENA

SEQ ID NO: 7751 - protein, 9 aa, Artificial Sequence
  Peptide Derived from Human Papillomavirus
QLIRLENAI

SEQ ID NO: 7752 - protein, 10 aa, Artificial Sequence
  Peptide Derived from Human Papillomavirus
QLIRLENAIL

SEQ ID NO: 7753 - protein, 9 aa, Artificial Sequence
  Peptide Derived from Human Papillomavirus
QLQHASTST

SEQ ID NO: 7754 - protein, 8 aa, Artificial Sequence
  Peptide Derived from Human Papillomavirus
QMALKGLA

SEQ ID NO: 7755 - protein, 11 aa, Artificial Sequence
  Peptide Derived from Human Papillomavirus
QTPKESLSERL

SEQ ID NO: 7756 - protein, 8 aa, Artificial Sequence
  Peptide Derived from Human Papillomavirus
QVVPPINI

SEQ ID NO: 7757 - protein, 9 aa, Artificial Sequence
  Peptide Derived from Human Papillomavirus
RLENAILFT

SEQ ID NO: 7758 - protein, 10 aa, Artificial Sequence
  Peptide Derived from Human Papillomavirus
RLENAILFTA

SEQ ID NO: 7759 - protein, 9 aa, Artificial Sequence
  Peptide Derived from Human Papillomavirus
RLSALQDKI

SEQ ID NO: 7760 - protein, 10 aa, Artificial Sequence
  Peptide Derived from Human Papillomavirus
RLSALQDKIL

SEQ ID NO: 7761 - protein, 8 aa, Artificial Sequence
  Peptide Derived from Human Papillomavirus
RQLQHAST

SEQ ID NO: 7762 - protein, 10 aa, Artificial Sequence
  Peptide Derived from Human Papillomavirus
RQLQHASTST

SEQ ID NO: 7763 - protein, 10 aa, Artificial Sequence
  Peptide Derived from Human Papillomavirus
RVNTHVHNPL

SEQ ID NO: 7764 - protein, 11 aa, Artificial Sequence
  Peptide Derived from Human Papillomavirus
RVNTHVHNPLL

SEQ ID NO: 7765 - protein, 8 aa, Artificial Sequence
  Peptide Derived from Human Papillomavirus
SALQDKIL

SEQ ID NO: 7766 - protein, 9 aa, Artificial Sequence
  Peptide Derived from Human Papillomavirus
SATQIVRQL

SEQ ID NO: 7767 - protein, 8 aa, Artificial Sequence
  Peptide Derived from Human Papillomavirus
SIYYITET

SEQ ID NO: 7768 - protein, 10 aa, Artificial Sequence
  Peptide Derived from Human Papillomavirus
SIYYITETGI

SEQ ID NO: 7769 - protein, 9 aa, Artificial Sequence
  Peptide Derived from Human Papillomavirus
SLKCLRYRL

SEQ ID NO: 7770 - protein, 8 aa, Artificial Sequence
  Peptide Derived from Human Papillomavirus
SLSERLSA

SEQ ID NO: 7771 - protein, 9 aa, Artificial Sequence
  Peptide Derived from Human Papillomavirus
SLSERLSAL

SEQ ID NO: 7772 - protein, 9 aa, Artificial Sequence
  Peptide Derived from Human Papillomavirus
SMCSTSDDT

SEQ ID NO: 7773 - protein, 10 aa, Artificial Sequence
  Peptide Derived from Human Papillomavirus
SMCSTSDDTV

SEQ ID NO: 7774 - protein, 10 aa, Artificial Sequence
  Peptide Derived from Human Papillomavirus
SQCFKKGGKT

SEQ ID NO: 7775 - protein, 11 aa, Artificial Sequence
  Peptide Derived from Human Papillomavirus
SQCFKKGGKTV

SEQ ID NO: 7776 - protein, 8 aa, Artificial Sequence
  Peptide Derived from Human Papillomavirus
SQISYWQL

SEQ ID NO: 7777 - protein, 9 aa, Artificial Sequence
  Peptide Derived from Human Papillomavirus
SQISYWQLI

SEQ ID NO: 7778 - protein, 11 aa, Artificial Sequence
  Peptide Derived from Human Papillomavirus
SQISYWQLIRL

SEQ ID NO: 7779 - protein, 8 aa, Artificial Sequence
  Peptide Derived from Human Papillomavirus
STPKTASV

SEQ ID NO: 7780 - protein, 10 aa, Artificial Sequence
  Peptide Derived from Human Papillomavirus
STPKTASVGT

SEQ ID NO: 7781 - protein, 9 aa, Artificial Sequence
  Peptide Derived from Human Papillomavirus
STSDDTVSA

SEQ ID NO: 7782 - protein, 10 aa, Artificial Sequence
  Peptide Derived from Human Papillomavirus
STSDDTVSAT

SEQ ID NO: 7783 - protein, 10 aa, Artificial Sequence
  Peptide Derived from Human Papillomavirus
STSNNKRRKV

SEQ ID NO: 7784 - protein, 8 aa, Artificial Sequence
  Peptide Derived from Human Papillomavirus
STSTPKTA

SEQ ID NO: 7785 - protein, 10 aa, Artificial Sequence
  Peptide Derived from Human Papillomavirus
STSTPKTASV

SEQ ID NO: 7786 - protein, 9 aa, Artificial Sequence
  Peptide Derived from Human Papillomavirus
SVGTPKPHI

SEQ ID NO: 7787 - protein, 11 aa, Artificial Sequence
  Peptide Derived from Human Papillomavirus
SVGTPKPHIQT

SEQ ID NO: 7788 - protein, 9 aa, Artificial Sequence
  Peptide Derived from Human Papillomavirus
SVQISVGYM

SEQ ID NO: 7789 - protein, 10 aa, Artificial Sequence
  Peptide Derived from Human Papillomavirus
SVQISVGYMT

SEQ ID NO: 7790 - protein, 11 aa, Artificial Sequence
  Peptide Derived from Human Papillomavirus
SVQISVGYMTI

SEQ ID NO: 7791 - protein, 10 aa, Artificial Sequence
  Peptide Derived from Human Papillomavirus
TAACVSYWGV

SEQ ID NO: 7792 - protein, 8 aa, Artificial Sequence
  Peptide Derived from Human Papillomavirus
TAREHGIT

SEQ ID NO: 7793 - protein, 10 aa, Artificial Sequence
  Peptide Derived from Human Papillomavirus
TAREHGITKL

SEQ ID NO: 7794 - protein, 11 aa, Artificial Sequence
  Peptide Derived from Human Papillomavirus
TASVGTPKPHI

SEQ ID NO: 7795 - protein, 8 aa, Artificial Sequence
  Peptide Derived from Human Papillomavirus
TIPNSVQI

SEQ ID NO: 7796 - protein, 10 aa, Artificial Sequence
  Peptide Derived from Human Papillomavirus
TIPNSVQISV

SEQ ID NO: 7797 - protein, 9 aa, Artificial Sequence
  Peptide Derived from Human Papillomavirus
TLQDTCEEL

SEQ ID NO: 7798 - protein, 10 aa, Artificial Sequence
  Peptide Derived from Human Papillomavirus
TQIVRQLQHA

SEQ ID NO: 7799 - protein, 8 aa, Artificial Sequence
  Peptide Derived from Human Papillomavirus
TVSATQIV

SEQ ID NO: 7800 - protein, 11 aa, Artificial Sequence
  Peptide Derived from Human Papillomavirus
TVSATQIVRQL

SEQ ID NO: 7801 - protein, 8 aa, Artificial Sequence
  Peptide Derived from Human Papillomavirus
TVTYNSEV

SEQ ID NO: 7802 - protein, 8 aa, Artificial Sequence
  Peptide Derived from Human Papillomavirus
VIDCNDSM

SEQ ID NO: 7803 - protein, 11 aa, Artificial Sequence
  Peptide Derived from Human Papillomavirus
VIDCNDSMCST

SEQ ID NO: 7804 - protein, 8 aa, Artificial Sequence
  Peptide Derived from Human Papillomavirus
VQISVGYM

SEQ ID NO: 7805 - protein, 9 aa, Artificial Sequence
  Peptide Derived from Human Papillomavirus
VQISVGYMT

SEQ ID NO: 7806 - protein, 10 aa, Artificial Sequence
  Peptide Derived from Human Papillomavirus
VQISVGYMTI

SEQ ID NO: 7807 - protein, 9 aa, Artificial Sequence
  Peptide Derived from Human Papillomavirus
VQRNTFLDV

SEQ ID NO: 7808 - protein, 10 aa, Artificial Sequence
  Peptide Derived from Human Papillomavirus
VQRNTFLDVV

SEQ ID NO: 7809 - protein, 11 aa, Artificial Sequence
  Peptide Derived from Human Papillomavirus
VQRNTFLDVVT

SEQ ID NO: 7810 - protein, 8 aa, Artificial Sequence
  Peptide Derived from Human Papillomavirus
VQYGGNVI

SEQ ID NO: 7811 - protein, 9 aa, Artificial Sequence
  Peptide Derived from Human Papillomavirus
VTIPNSVQI

SEQ ID NO: 7812 - protein, 11 aa, Artificial Sequence
  Peptide Derived from Human Papillomavirus
VTIPNSVQISV

SEQ ID NO: 7813 - protein, 11 aa, Artificial Sequence
  Peptide Derived from Human Papillomavirus
VTYNSEVQRNT

SEQ ID NO: 7814 - protein, 8 aa, Artificial Sequence
  Peptide Derived from Human Papillomavirus
VVTIPNSV

SEQ ID NO: 7815 - protein, 10 aa, Artificial Sequence
  Peptide Derived from Human Papillomavirus
VVTIPNSVQI

SEQ ID NO: 7816 - protein, 9 aa, Artificial Sequence
  Peptide Derived from Human Papillomavirus
VVWDSIYYI

SEQ ID NO: 7817 - protein, 10 aa, Artificial Sequence
  Peptide Derived from Human Papillomavirus
VVWDSIYYIT

SEQ ID NO: 7818 - protein, 9 aa, Artificial Sequence
  Peptide Derived from Human Papillomavirus
WQLIRLENA

SEQ ID NO: 7819 - protein, 10 aa, Artificial Sequence
  Peptide Derived from Human Papillomavirus
WQLIRLENAI

SEQ ID NO: 7820 - protein, 11 aa, Artificial Sequence
  Peptide Derived from Human Papillomavirus
WQLIRLENAIL

SEQ ID NO: 7821 - protein, 8 aa, Artificial Sequence
  Peptide Derived from Human Papillomavirus
WTGCNKNT

SEQ ID NO: 7822 - protein, 10 aa, Artificial Sequence
  Peptide Derived from Human Papillomavirus
WTGCNKNTGI

SEQ ID NO: 7823 - protein, 11 aa, Artificial Sequence
  Peptide Derived from Human Papillomavirus
WTGCNKNTGIL

SEQ ID NO: 7824 - protein, 10 aa, Artificial Sequence
  Peptide Derived from Human Papillomavirus
WTLQDTCEEL

SEQ ID NO: 7825 - protein, 8 aa, Artificial Sequence
  Peptide Derived from Human Papillomavirus
YADHYSEI

SEQ ID NO: 7826 - protein, 11 aa, Artificial Sequence
  Peptide Derived from Human Papillomavirus
YADHYSEISST

SEQ ID NO: 7827 - protein, 8 aa, Artificial Sequence
  Peptide Derived from Human Papillomavirus
YIKDGDTT

SEQ ID NO: 7828 - protein, 11 aa, Artificial Sequence
  Peptide Derived from Human Papillomavirus
YIKDGDTTYYV

SEQ ID NO: 7829 - protein, 11 aa, Artificial Sequence
  Peptide Derived from Human Papillomavirus
YITETGIWDKT

SEQ ID NO: 7830 - protein, 10 aa, Artificial Sequence
  Peptide Derived from Human Papillomavirus
YVVWDSIYYI

SEQ ID NO: 7831 - protein, 11 aa, Artificial Sequence
  Peptide Derived from Human Papillomavirus
YVVWDSIYYIT

SEQ ID NO: 7832 - protein, 8 aa, Artificial Sequence
  Peptide Derived from Human Papillomavirus
ATLERTEV

SEQ ID NO: 7833 - protein, 11 aa, Artificial Sequence
  Peptide Derived from Human Papillomavirus
CIAYAACHKCI

SEQ ID NO: 7834 - protein, 8 aa, Artificial Sequence
  Peptide Derived from Human Papillomavirus
CIDFYSRI

SEQ ID NO: 7835 - protein, 11 aa, Artificial Sequence
  Peptide Derived from Human Papillomavirus
CIDFYSRIREL

SEQ ID NO: 7836 - protein, 8 aa, Artificial Sequence
  Peptide Derived from Human Papillomavirus
CLRCQKPL

SEQ ID NO: 7837 - protein, 11 aa, Artificial Sequence
  Peptide Derived from Human Papillomavirus
CLRCQKPLNPA

SEQ ID NO: 7838 - protein, 8 aa, Artificial Sequence
  Peptide Derived from Human Papillomavirus
CQKPLNPA

SEQ ID NO: 7839 - protein, 8 aa, Artificial Sequence
  Peptide Derived from Human Papillomavirus
CTELNTSL

SEQ ID NO: 7840 - protein, 11 aa, Artificial Sequence
  Peptide Derived from Human Papillomavirus
CTELNTSLQDV

SEQ ID NO: 7841 - protein, 8 aa, Artificial Sequence
  Peptide Derived from Human Papillomavirus
CVYCKATL

SEQ ID NO: 7842 - protein, 11 aa, Artificial Sequence
  Peptide Derived from Human Papillomavirus
CVYCKATLERT

SEQ ID NO: 7843 - protein, 8 aa, Artificial Sequence
  Peptide Derived from Human Papillomavirus
DLCTELNT

SEQ ID NO: 7844 - protein, 10 aa, Artificial Sequence
  Peptide Derived from Human Papillomavirus
DLCTELNTSL

SEQ ID NO: 7845 - protein, 10 aa, Artificial Sequence
  Peptide Derived from Human Papillomavirus
DLFIVYRDCI

SEQ ID NO: 7846 - protein, 11 aa, Artificial Sequence
  Peptide Derived from Human Papillomavirus
DLFIVYRDCIA

SEQ ID NO: 7847 - protein, 8 aa, Artificial Sequence
  Peptide Derived from Human Papillomavirus
DQARQERL

SEQ ID NO: 7848 - protein, 11 aa, Artificial Sequence
  Peptide Derived from Human Papillomavirus
DVSIACVYCKA

SEQ ID NO: 7849 - protein, 9 aa, Artificial Sequence
  Peptide Derived from Human Papillomavirus
ELNTSLQDV

SEQ ID NO: 7850 - protein, 11 aa, Artificial Sequence
  Peptide Derived from Human Papillomavirus
ELNTSLQDVSI

SEQ ID NO: 7851 - protein, 9 aa, Artificial Sequence
  Peptide Derived from Human Papillomavirus
ELRYYSNSV

SEQ ID NO: 7852 - protein, 10 aa, Artificial Sequence
  Peptide Derived from Human Papillomavirus
ELYNLLIRCL

SEQ ID NO: 7853 - protein, 9 aa, Artificial Sequence
  Peptide Derived from Human Papillomavirus
ETLEKITNT

SEQ ID NO: 7854 - protein, 11 aa, Artificial Sequence
  Peptide Derived from Human Papillomavirus
ETLEKITNTEL

SEQ ID NO: 7855 - protein, 10 aa, Artificial Sequence
  Peptide Derived from Human Papillomavirus
EVYQFAFKDL

SEQ ID NO: 7856 - protein, 8 aa, Artificial Sequence
  Peptide Derived from Human Papillomavirus
FAFKDLFI

SEQ ID NO: 7857 - protein, 9 aa, Artificial Sequence
  Peptide Derived from Human Papillomavirus
FAFKDLFIV

SEQ ID NO: 7858 - protein, 8 aa, Artificial Sequence
  Peptide Derived from Human Papillomavirus
FIVYRDCI

SEQ ID NO: 7859 - protein, 9 aa, Artificial Sequence
  Peptide Derived from Human Papillomavirus
FIVYRDCIA

SEQ ID NO: 7860 - protein, 11 aa, Artificial Sequence
  Peptide Derived from Human Papillomavirus
FIVYRDCIAYA

SEQ ID NO: 7861 - protein, 10 aa, Artificial Sequence
  Peptide Derived from Human Papillomavirus
GQCNTCCDQA

SEQ ID NO: 7862 - protein, 9 aa, Artificial Sequence
  Peptide Derived from Human Papillomavirus
GQYRGQCNT

SEQ ID NO: 7863 - protein, 11 aa, Artificial Sequence
  Peptide Derived from Human Papillomavirus
HLKDKRRFHSI

SEQ ID NO: 7864 - protein, 8 aa, Artificial Sequence
  Peptide Derived from Human Papillomavirus
IACVYCKA

SEQ ID NO: 7865 - protein, 9 aa, Artificial Sequence
  Peptide Derived from Human Papillomavirus
IACVYCKAT

SEQ ID NO: 7866 - protein, 10 aa, Artificial Sequence
  Peptide Derived from Human Papillomavirus
IACVYCKATL

SEQ ID NO: 7867 - protein, 11 aa, Artificial Sequence
  Peptide Derived from Human Papillomavirus
IAGQYRGQCNT

SEQ ID NO: 7868 - protein, 10 aa, Artificial Sequence
  Peptide Derived from Human Papillomavirus
IAYAACHKCI

SEQ ID NO: 7869 - protein, 9 aa, Artificial Sequence
  Peptide Derived from Human Papillomavirus
ITNTELYNL

SEQ ID NO: 7870 - protein, 10 aa, Artificial Sequence
  Peptide Derived from Human Papillomavirus
ITNTELYNLL

SEQ ID NO: 7871 - protein, 11 aa, Artificial Sequence
  Peptide Derived from Human Papillomavirus
ITNTELYNLLI

SEQ ID NO: 7872 - protein, 8 aa, Artificial Sequence
  Peptide Derived from Human Papillomavirus
IVYRDCIA

SEQ ID NO: 7873 - protein, 10 aa, Artificial Sequence
  Peptide Derived from Human Papillomavirus
IVYRDCIAYA

SEQ ID NO: 7874 - protein, 11 aa, Artificial Sequence
  Peptide Derived from Human Papillomavirus
IVYRDCIAYAA

SEQ ID NO: 7875 - protein, 9 aa, Artificial Sequence
  Peptide Derived from Human Papillomavirus
KATLERTEV

SEQ ID NO: 7876 - protein, 10 aa, Artificial Sequence
  Peptide Derived from Human Papillomavirus
KITNTELYNL

SEQ ID NO: 7877 - protein, 11 aa, Artificial Sequence
  Peptide Derived from Human Papillomavirus
KITNTELYNLL

SEQ ID NO: 7878 - protein, 9 aa, Artificial Sequence
  Peptide Derived from Human Papillomavirus
KLPDLCTEL

SEQ ID NO: 7879 - protein, 11 aa, Artificial Sequence
  Peptide Derived from Human Papillomavirus
KLPDLCTELNT

SEQ ID NO: 7880 - protein, 11 aa, Artificial Sequence
  Peptide Derived from Human Papillomavirus
LIRCLRCQKPL

SEQ ID NO: 7881 - protein, 9 aa, Artificial Sequence
  Peptide Derived from Human Papillomavirus
LQDVSIACV

SEQ ID NO: 7882 - protein, 8 aa, Artificial Sequence
  Peptide Derived from Human Papillomavirus
MARFDDPT

SEQ ID NO: 7883 - protein, 8 aa, Artificial Sequence
  Peptide Derived from Human Papillomavirus
NTELYNLL

SEQ ID NO: 7884 - protein, 9 aa, Artificial Sequence
  Peptide Derived from Human Papillomavirus
NTELYNLLI

SEQ ID NO: 7885 - protein, 9 aa, Artificial Sequence
  Peptide Derived from Human Papillomavirus
NTSLQDVSI

SEQ ID NO: 7886 - protein, 10 aa, Artificial Sequence
  Peptide Derived from Human Papillomavirus
NTSLQDVSIA

SEQ ID NO: 7887 - protein, 8 aa, Artificial Sequence
  Peptide Derived from Human Papillomavirus
PAEKRRHL

SEQ ID NO: 7888 - protein, 11 aa, Artificial Sequence
  Peptide Derived from Human Papillomavirus
PLNPAEKRRHL

SEQ ID NO: 7889 - protein, 8 aa, Artificial Sequence
  Peptide Derived from Human Papillomavirus
PTQRPYKL

SEQ ID NO: 7890 - protein, 11 aa, Artificial Sequence
  Peptide Derived from Human Papillomavirus
PTQRPYKLPDL

SEQ ID NO: 7891 - protein, 8 aa, Artificial Sequence
  Peptide Derived from Human Papillomavirus
RLRRRRET

SEQ ID NO: 7892 - protein, 10 aa, Artificial Sequence
  Peptide Derived from Human Papillomavirus
RLRRRRETQV

SEQ ID NO: 7893 - protein, 11 aa, Artificial Sequence
  Peptide Derived from Human Papillomavirus
RQERLRRRRET

SEQ ID NO: 7894 - protein, 8 aa, Artificial Sequence
  Peptide Derived from Human Papillomavirus
RTEVYQFA

SEQ ID NO: 7895 - protein, 9 aa, Artificial Sequence
  Peptide Derived from Human Papillomavirus
SIACVYCKA

SEQ ID NO: 7896 - protein, 10 aa, Artificial Sequence
  Peptide Derived from Human Papillomavirus
SIACVYCKAT

SEQ ID NO: 7897 - protein, 11 aa, Artificial Sequence
  Peptide Derived from Human Papillomavirus
SIACVYCKATL

SEQ ID NO: 7898 - protein, 8 aa, Artificial Sequence
  Peptide Derived from Human Papillomavirus
SLQDVSIA

SEQ ID NO: 7899 - protein, 10 aa, Artificial Sequence
  Peptide Derived from Human Papillomavirus
SLQDVSIACV

SEQ ID NO: 7900 - protein, 10 aa, Artificial Sequence
  Peptide Derived from Human Papillomavirus
SVYGETLEKI

SEQ ID NO: 7901 - protein, 11 aa, Artificial Sequence
  Peptide Derived from Human Papillomavirus
SVYGETLEKIT

SEQ ID NO: 7902 - protein, 8 aa, Artificial Sequence
  Peptide Derived from Human Papillomavirus
TLEKITNT

SEQ ID NO: 7903 - protein, 10 aa, Artificial Sequence
  Peptide Derived from Human Papillomavirus
TLEKITNTEL

SEQ ID NO: 7904 - protein, 11 aa, Artificial Sequence
  Peptide Derived from Human Papillomavirus
TLERTEVYQFA

SEQ ID NO: 7905 - protein, 10 aa, Artificial Sequence
  Peptide Derived from Human Papillomavirus
TQRPYKLPDL

SEQ ID NO: 7906 - protein, 8 aa, Artificial Sequence
  Peptide Derived from Human Papillomavirus
YAACHKCI

SEQ ID NO: 7907 - protein, 8 aa, Artificial Sequence
  Peptide Derived from Human Papillomavirus
YQFAFKDL

SEQ ID NO: 7908 - protein, 10 aa, Artificial Sequence
  Peptide Derived from Human Papillomavirus
YQFAFKDLFI

SEQ ID NO: 7909 - protein, 11 aa, Artificial Sequence
  Peptide Derived from Human Papillomavirus
YQFAFKDLFIV

SEQ ID NO: 7910 - protein, 8 aa, Artificial Sequence
  Peptide Derived from Human Papillomavirus
AQLPARRA

SEQ ID NO: 7911 - protein, 8 aa, Artificial Sequence
  Peptide Derived from Human Papillomavirus
ATLQEIVL

SEQ ID NO: 7912 - protein, 10 aa, Artificial Sequence
  Peptide Derived from Human Papillomavirus
ATLQEIVLHL

SEQ ID NO: 7913 - protein, 10 aa, Artificial Sequence
  Peptide Derived from Human Papillomavirus
CVCCKCDGRI

SEQ ID NO: 7914 - protein, 8 aa, Artificial Sequence
  Peptide Derived from Human Papillomavirus
DLLCYEQL

SEQ ID NO: 7915 - protein, 8 aa, Artificial Sequence
  Peptide Derived from Human Papillomavirus
DLRTLQQL

SEQ ID NO: 7916 - protein, 10 aa, Artificial Sequence
  Peptide Derived from Human Papillomavirus
DLRTLQQLFL

SEQ ID NO: 7917 - protein, 8 aa, Artificial Sequence
  Peptide Derived from Human Papillomavirus
EADGVSHA

SEQ ID NO: 7918 - protein, 10 aa, Artificial Sequence
  Peptide Derived from Human Papillomavirus
EADGVSHAQL

SEQ ID NO: 7919 - protein, 8 aa, Artificial Sequence
  Peptide Derived from Human Papillomavirus
ELDPVDLL

SEQ ID NO: 7920 - protein, 8 aa, Artificial Sequence
  Peptide Derived from Human Papillomavirus
ELTVESSA

SEQ ID NO: 7921 - protein, 11 aa, Artificial Sequence
  Peptide Derived from Human Papillomavirus
ELTVESSADDL

SEQ ID NO: 7922 - protein, 8 aa, Artificial Sequence
  Peptide Derived from Human Papillomavirus
FLSTLSFV

SEQ ID NO: 7923 - protein, 8 aa, Artificial Sequence
  Peptide Derived from Human Papillomavirus
FVCPWCAT

SEQ ID NO: 7924 - protein, 9 aa, Artificial Sequence
  Peptide Derived from Human Papillomavirus
GVSHAQLPA

SEQ ID NO: 7925 - protein, 9 aa, Artificial Sequence
  Peptide Derived from Human Papillomavirus
HAQLPARRA

SEQ ID NO: 7926 - protein, 8 aa, Artificial Sequence
  Peptide Derived from Human Papillomavirus
HLEPQNEL

SEQ ID NO: 7927 - protein, 11 aa, Artificial Sequence
  Peptide Derived from Human Papillomavirus
HLEPQNELDPV

SEQ ID NO: 7928 - protein, 11 aa, Artificial Sequence
  Peptide Derived from Human Papillomavirus
IVLHLEPQNEL

SEQ ID NO: 7929 - protein, 8 aa, Artificial Sequence
  Peptide Derived from Human Papillomavirus
LQEIVLHL

SEQ ID NO: 7930 - protein, 8 aa, Artificial Sequence
  Peptide Derived from Human Papillomavirus
LQQLFLST

SEQ ID NO: 7931 - protein, 9 aa, Artificial Sequence
  Peptide Derived from Human Papillomavirus
LQQLFLSTL

SEQ ID NO: 7932 - protein, 10 aa, Artificial Sequence
  Peptide Derived from Human Papillomavirus
LTVESSADDL

SEQ ID NO: 7933 - protein, 8 aa, Artificial Sequence
  Peptide Derived from Human Papillomavirus
PQNELDPV

SEQ ID NO: 7934 - protein, 10 aa, Artificial Sequence
  Peptide Derived from Human Papillomavirus
PQNELDPVDL

SEQ ID NO: 7935 - protein, 11 aa, Artificial Sequence
  Peptide Derived from Human Papillomavirus
PQNELDPVDLL

SEQ ID NO: 7936 - protein, 9 aa, Artificial Sequence
  Peptide Derived from Human Papillomavirus
PQRHKILCV

SEQ ID NO: 7937 - protein, 10 aa, Artificial Sequence
  Peptide Derived from Human Papillomavirus
PVDLLCYEQL

SEQ ID NO: 7938 - protein, 10 aa, Artificial Sequence
  Peptide Derived from Human Papillomavirus
QLFLSTLSFV

SEQ ID NO: 7939 - protein, 8 aa, Artificial Sequence
  Peptide Derived from Human Papillomavirus
QQLFLSTL

SEQ ID NO: 7940 - protein, 11 aa, Artificial Sequence
  Peptide Derived from Human Papillomavirus
QQLFLSTLSFV

SEQ ID NO: 7941 - protein, 9 aa, Artificial Sequence
  Peptide Derived from Human Papillomavirus
RAEPQRHKI

SEQ ID NO: 7942 - protein, 10 aa, Artificial Sequence
  Peptide Derived from Human Papillomavirus
RAEPQRHKIL

SEQ ID NO: 7943 - protein, 8 aa, Artificial Sequence
  Peptide Derived from Human Papillomavirus
RATLQEIV

SEQ ID NO: 7944 - protein, 9 aa, Artificial Sequence
  Peptide Derived from Human Papillomavirus
RATLQEIVL

SEQ ID NO: 7945 - protein, 11 aa, Artificial Sequence
  Peptide Derived from Human Papillomavirus
RATLQEIVLHL

SEQ ID NO: 7946 - protein, 10 aa, Artificial Sequence
  Peptide Derived from Human Papillomavirus
RIELTVESSA

SEQ ID NO: 7947 - protein, 8 aa, Artificial Sequence
  Peptide Derived from Human Papillomavirus
RTLQQLFL

SEQ ID NO: 7948 - protein, 10 aa, Artificial Sequence
  Peptide Derived from Human Papillomavirus
RTLQQLFLST

SEQ ID NO: 7949 - protein, 11 aa, Artificial Sequence
  Peptide Derived from Human Papillomavirus
RTLQQLFLSTL

SEQ ID NO: 7950 - protein, 8 aa, Artificial Sequence
  Peptide Derived from Human Papillomavirus
SADDLRTL

SEQ ID NO: 7951 - protein, 11 aa, Artificial Sequence
  Peptide Derived from Human Papillomavirus
SADDLRTLQQL

SEQ ID NO: 7952 - protein, 11 aa, Artificial Sequence
  Peptide Derived from Human Papillomavirus
STLSFVCPWCA

SEQ ID NO: 7953 - protein, 9 aa, Artificial Sequence
  Peptide Derived from Human Papillomavirus
TLQEIVLHL

SEQ ID NO: 7954 - protein, 9 aa, Artificial Sequence
  Peptide Derived from Human Papillomavirus
TLQQLFLST

SEQ ID NO: 7955 - protein, 10 aa, Artificial Sequence
  Peptide Derived from Human Papillomavirus
TLQQLFLSTL

SEQ ID NO: 7956 - protein, 10 aa, Artificial Sequence
  Peptide Derived from Human Papillomavirus
TLSFVCPWCA

SEQ ID NO: 7957 - protein, 11 aa, Artificial Sequence
  Peptide Derived from Human Papillomavirus
TLSFVCPWCAT

SEQ ID NO: 7958 - protein, 9 aa, Artificial Sequence
  Peptide Derived from Human Papillomavirus
TVESSADDL

SEQ ID NO: 7959 - protein, 11 aa, Artificial Sequence
  Peptide Derived from Human Papillomavirus
TVESSADDLRT

SEQ ID NO: 7960 - protein, 10 aa, Artificial Sequence
  Peptide Derived from Human Papillomavirus
VLHLEPQNEL

SEQ ID NO: 7961 - protein, 11 aa, Artificial Sequence
  Peptide Derived from Human Papillomavirus
AASTSTASRPA

SEQ ID NO: 7962 - protein, 10 aa, Artificial Sequence
  Peptide Derived from Human Papillomavirus
AATAVITQDV

SEQ ID NO: 7963 - protein, 10 aa, Artificial Sequence
  Peptide Derived from Human Papillomavirus
AIGEHWAKGT

SEQ ID NO: 7964 - protein, 11 aa, Artificial Sequence
  Peptide Derived from Human Papillomavirus
AIGEHWAKGTL

SEQ ID NO: 7965 - protein, 10 aa, Artificial Sequence
  Peptide Derived from Human Papillomavirus
ALPDPNKFGL

SEQ ID NO: 7966 - protein, 9 aa, Artificial Sequence
  Peptide Derived from Human Papillomavirus
ALWRPSDST

SEQ ID NO: 7967 - protein, 10 aa, Artificial Sequence
  Peptide Derived from Human Papillomavirus
ALWRPSDSTV

SEQ ID NO: 7968 - protein, 10 aa, Artificial Sequence
  Peptide Derived from Human Papillomavirus
AMDFSTLQDT

SEQ ID NO: 7969 - protein, 8 aa, Artificial Sequence
  Peptide Derived from Human Papillomavirus
AQGHNNGI

SEQ ID NO: 7970 - protein, 11 aa, Artificial Sequence
  Peptide Derived from Human Papillomavirus
AQLQPGDCPPL

SEQ ID NO: 7971 - protein, 9 aa, Artificial Sequence
  Peptide Derived from Human Papillomavirus
ATAVITQDV

SEQ ID NO: 7972 - protein, 11 aa, Artificial Sequence
  Peptide Derived from Human Papillomavirus
AVITQDVRDNV

SEQ ID NO: 7973 - protein, 8 aa, Artificial Sequence
  Peptide Derived from Human Papillomavirus
AVTCQKDT

SEQ ID NO: 7974 - protein, 9 aa, Artificial Sequence
  Peptide Derived from Human Papillomavirus
AVTCQKDTT

SEQ ID NO: 7975 - protein, 8 aa, Artificial Sequence
  Peptide Derived from Human Papillomavirus
CASTQNPV

SEQ ID NO: 7976 - protein, 11 aa, Artificial Sequence
  Peptide Derived from Human Papillomavirus
CASTQNPVPNT

SEQ ID NO: 7977 - protein, 8 aa, Artificial Sequence
  Peptide Derived from Human Papillomavirus
CILGCVPA

SEQ ID NO: 7978 - protein, 9 aa, Artificial Sequence
  Peptide Derived from Human Papillomavirus
CILGCVPAI

SEQ ID NO: 7979 - protein, 9 aa, Artificial Sequence
  Peptide Derived from Human Papillomavirus
CLRREQLFA

SEQ ID NO: 7980 - protein, 11 aa, Artificial Sequence
  Peptide Derived from Human Papillomavirus
CQSICKYPDYL

SEQ ID NO: 7981 - protein, 9 aa, Artificial Sequence
  Peptide Derived from Human Papillomavirus
CTITLTAEV

SEQ ID NO: 7982 - protein, 10 aa, Artificial Sequence
  Peptide Derived from Human Papillomavirus
CTITLTAEVM

SEQ ID NO: 7983 - protein, 10 aa, Artificial Sequence
  Peptide Derived from Human Papillomavirus
CVPAIGEHWA

SEQ ID NO: 7984 - protein, 11 aa, Artificial Sequence
  Peptide Derived from Human Papillomavirus
CVYSPSPSGSI

SEQ ID NO: 7985 - protein, 10 aa, Artificial Sequence
  Peptide Derived from Human Papillomavirus
DLKEKFSSDL

SEQ ID NO: 7986 - protein, 8 aa, Artificial Sequence
  Peptide Derived from Human Papillomavirus
DLQFIFQL

SEQ ID NO: 7987 - protein, 10 aa, Artificial Sequence
  Peptide Derived from Human Papillomavirus
DLQFIFQLCT

SEQ ID NO: 7988 - protein, 11 aa, Artificial Sequence
  Peptide Derived from Human Papillomavirus
DLQFIFQLCTI

SEQ ID NO: 7989 - protein, 9 aa, Artificial Sequence
  Peptide Derived from Human Papillomavirus
DLYIKGTSA

SEQ ID NO: 7990 - protein, 11 aa, Artificial Sequence
  Peptide Derived from Human Papillomavirus
DLYIKGTSANM

SEQ ID NO: 7991 - protein, 9 aa, Artificial Sequence
  Peptide Derived from Human Papillomavirus
DMVDTGYGA

SEQ ID NO: 7992 - protein, 10 aa, Artificial Sequence
  Peptide Derived from Human Papillomavirus
DMVDTGYGAM

SEQ ID NO: 7993 - protein, 10 aa, Artificial Sequence
  Peptide Derived from Human Papillomavirus
DQYPLGRKFL

SEQ ID NO: 7994 - protein, 11 aa, Artificial Sequence
  Peptide Derived from Human Papillomavirus
DQYPLGRKFLV

SEQ ID NO: 7995 - protein, 8 aa, Artificial Sequence
  Peptide Derived from Human Papillomavirus
DTESAHAA

SEQ ID NO: 7996 - protein, 9 aa, Artificial Sequence
  Peptide Derived from Human Papillomavirus
DTESAHAAT

SEQ ID NO: 7997 - protein, 10 aa, Artificial Sequence
  Peptide Derived from Human Papillomavirus
DTESAHAATA

SEQ ID NO: 7998 - protein, 11 aa, Artificial Sequence
  Peptide Derived from Human Papillomavirus
DTESAHAATAV

SEQ ID NO: 7999 - protein, 11 aa, Artificial Sequence
  Peptide Derived from Human Papillomavirus
DTGYGAMDFST

SEQ ID NO: 8000 - protein, 8 aa, Artificial Sequence
  Peptide Derived from Human Papillomavirus
DTKCEVPL

SEQ ID NO: 8001 - protein, 10 aa, Artificial Sequence
  Peptide Derived from Human Papillomavirus
DTKCEVPLDI

SEQ ID NO: 8002 - protein, 8 aa, Artificial Sequence
  Peptide Derived from Human Papillomavirus
DTTRSTNL

SEQ ID NO: 8003 - protein, 9 aa, Artificial Sequence
  Peptide Derived from Human Papillomavirus
DTTRSTNLT

SEQ ID NO: 8004 - protein, 10 aa, Artificial Sequence
  Peptide Derived from Human Papillomavirus
DTTRSTNLTL

SEQ ID NO: 8005 - protein, 9 aa, Artificial Sequence
  Peptide Derived from Human Papillomavirus
DTVPTDLYI

SEQ ID NO: 8006 - protein, 9 aa, Artificial Sequence
  Peptide Derived from Human Papillomavirus
DTYRFVQSV

SEQ ID NO: 8007 - protein, 10 aa, Artificial Sequence
  Peptide Derived from Human Papillomavirus
DTYRFVQSVA

SEQ ID NO: 8008 - protein, 11 aa, Artificial Sequence
  Peptide Derived from Human Papillomavirus
DTYRFVQSVAV

SEQ ID NO: 8009 - protein, 8 aa, Artificial Sequence
  Peptide Derived from Human Papillomavirus
DVRDNVSV

SEQ ID NO: 8010 - protein, 8 aa, Artificial Sequence
  Peptide Derived from Human Papillomavirus
EIGRGQPL

SEQ ID NO: 8011 - protein, 10 aa, Artificial Sequence
  Peptide Derived from Human Papillomavirus
EIGRGQPLGI

SEQ ID NO: 8012 - protein, 8 aa, Artificial Sequence
  Peptide Derived from Human Papillomavirus
ETQRLVWA

SEQ ID NO: 8013 - protein, 10 aa, Artificial Sequence
  Peptide Derived from Human Papillomavirus
ETQRLVWACV

SEQ ID NO: 8014 - protein, 9 aa, Artificial Sequence
  Peptide Derived from Human Papillomavirus
EVMSYIHSM

SEQ ID NO: 8015 - protein, 10 aa, Artificial Sequence
  Peptide Derived from Human Papillomavirus
EVPLDICQSI

SEQ ID NO: 8016 - protein, 9 aa, Artificial Sequence
  Peptide Derived from Human Papillomavirus
FARHFWNRA

SEQ ID NO: 8017 - protein, 11 aa, Artificial Sequence
  Peptide Derived from Human Papillomavirus
FARHFWNRAGV

SEQ ID NO: 8018 - protein, 8 aa, Artificial Sequence
  Peptide Derived from Human Papillomavirus
FIFQLCTI

SEQ ID NO: 8019 - protein, 9 aa, Artificial Sequence
  Peptide Derived from Human Papillomavirus
FIFQLCTIT

SEQ ID NO: 8020 - protein, 10 aa, Artificial Sequence
  Peptide Derived from Human Papillomavirus
FIFQLCTITL

SEQ ID NO: 8021 - protein, 11 aa, Artificial Sequence
  Peptide Derived from Human Papillomavirus
FIFQLCTITLT

SEQ ID NO: 8022 - protein, 10 aa, Artificial Sequence
  Peptide Derived from Human Papillomavirus
FLKNVNVFPI

SEQ ID NO: 8023 - protein, 8 aa, Artificial Sequence
  Peptide Derived from Human Papillomavirus
FQLCTITL

SEQ ID NO: 8024 - protein, 9 aa, Artificial Sequence
  Peptide Derived from Human Papillomavirus
FQLCTITLT

SEQ ID NO: 8025 - protein, 10 aa, Artificial Sequence
  Peptide Derived from Human Papillomavirus
FQLCTITLTA

SEQ ID NO: 8026 - protein, 8 aa, Artificial Sequence
  Peptide Derived from Human Papillomavirus
FVQSVAVT

SEQ ID NO: 8027 - protein, 8 aa, Artificial Sequence
  Peptide Derived from Human Papillomavirus
FVTVVDTT

SEQ ID NO: 8028 - protein, 11 aa, Artificial Sequence
  Peptide Derived from Human Papillomavirus
FVTVVDTTRST

SEQ ID NO: 8029 - protein, 8 aa, Artificial Sequence
  Peptide Derived from Human Papillomavirus
GAGNKQAV

SEQ ID NO: 8030 - protein, 11 aa, Artificial Sequence
  Peptide Derived from Human Papillomavirus
GAGNKQAVPKV

SEQ ID NO: 8031 - protein, 8 aa, Artificial Sequence
  Peptide Derived from Human Papillomavirus
GAMDFSTL

SEQ ID NO: 8032 - protein, 11 aa, Artificial Sequence
  Peptide Derived from Human Papillomavirus
GAMDFSTLQDT

SEQ ID NO: 8033 - protein, 8 aa, Artificial Sequence
  Peptide Derived from Human Papillomavirus
GICWHNQL

SEQ ID NO: 8034 - protein, 10 aa, Artificial Sequence
  Peptide Derived from Human Papillomavirus
GICWHNQLFV

SEQ ID NO: 8035 - protein, 11 aa, Artificial Sequence
  Peptide Derived from Human Papillomavirus
GICWHNQLFVT

SEQ ID NO: 8036 - protein, 9 aa, Artificial Sequence
  Peptide Derived from Human Papillomavirus
GIIIFLKNV

SEQ ID NO: 8037 - protein, 11 aa, Artificial Sequence
  Peptide Derived from Human Papillomavirus
GIIIFLKNVNV

SEQ ID NO: 8038 - protein, 8 aa, Artificial Sequence
  Peptide Derived from Human Papillomavirus
GLRRRPTI

SEQ ID NO: 8039 - protein, 11 aa, Artificial Sequence
  Peptide Derived from Human Papillomavirus
GLSGHPFYNKL

SEQ ID NO: 8040 - protein, 10 aa, Artificial Sequence
  Peptide Derived from Human Papillomavirus
GMEIGRGQPL

SEQ ID NO: 8041 - protein, 8 aa, Artificial Sequence
  Peptide Derived from Human Papillomavirus
GQPLGIGL

SEQ ID NO: 8042 - protein, 9 aa, Artificial Sequence
  Peptide Derived from Human Papillomavirus
GTLCKPAQL

SEQ ID NO: 8043 - protein, 9 aa, Artificial Sequence
  Peptide Derived from Human Papillomavirus
GTSANMRET

SEQ ID NO: 8044 - protein, 9 aa, Artificial Sequence
  Peptide Derived from Human Papillomavirus
GVMGDTVPT

SEQ ID NO: 8045 - protein, 11 aa, Artificial Sequence
  Peptide Derived from Human Papillomavirus
GVMGDTVPTDL

SEQ ID NO: 8046 - protein, 8 aa, Artificial Sequence
  Peptide Derived from Human Papillomavirus
GVPPPPTT

SEQ ID NO: 8047 - protein, 10 aa, Artificial Sequence
  Peptide Derived from Human Papillomavirus
GVPPPPTTSL

SEQ ID NO: 8048 - protein, 11 aa, Artificial Sequence
  Peptide Derived from Human Papillomavirus
GVPPPPTTSLV

SEQ ID NO: 8049 - protein, 8 aa, Artificial Sequence
  Peptide Derived from Human Papillomavirus
HAATAVIT

SEQ ID NO: 8050 - protein, 11 aa, Artificial Sequence
  Peptide Derived from Human Papillomavirus
HAATAVITQDV

SEQ ID NO: 8051 - protein, 8 aa, Artificial Sequence
  Peptide Derived from Human Papillomavirus
HAGSSRLL

SEQ ID NO: 8052 - protein, 9 aa, Artificial Sequence
  Peptide Derived from Human Papillomavirus
HAGSSRLLT

SEQ ID NO: 8053 - protein, 10 aa, Artificial Sequence
  Peptide Derived from Human Papillomavirus
HAGSSRLLTV

SEQ ID NO: 8054 - protein, 10 aa, Artificial Sequence
  Peptide Derived from Human Papillomavirus
HVEEYDLQFI

SEQ ID NO: 8055 - protein, 8 aa, Artificial Sequence
  Peptide Derived from Human Papillomavirus
IIEDGDMV

SEQ ID NO: 8056 - protein, 10 aa, Artificial Sequence
  Peptide Derived from Human Papillomavirus
IIEDGDMVDT

SEQ ID NO: 8057 - protein, 9 aa, Artificial Sequence
  Peptide Derived from Human Papillomavirus
IIFLKNVNV

SEQ ID NO: 8058 - protein, 8 aa, Artificial Sequence
  Peptide Derived from Human Papillomavirus
IIIFLKNV

SEQ ID NO: 8059 - protein, 10 aa, Artificial Sequence
  Peptide Derived from Human Papillomavirus
IIIFLKNVNV

SEQ ID NO: 8060 - protein, 8 aa, Artificial Sequence
  Peptide Derived from Human Papillomavirus
IIYGHGII

SEQ ID NO: 8061 - protein, 9 aa, Artificial Sequence
  Peptide Derived from Human Papillomavirus
IIYGHGIII

SEQ ID NO: 8062 - protein, 11 aa, Artificial Sequence
  Peptide Derived from Human Papillomavirus
IIYGHGIIIFL

SEQ ID NO: 8063 - protein, 9 aa, Artificial Sequence
  Peptide Derived from Human Papillomavirus
ILENWNFGV

SEQ ID NO: 8064 - protein, 8 aa, Artificial Sequence
  Peptide Derived from Human Papillomavirus
ILGCVPAI

SEQ ID NO: 8065 - protein, 8 aa, Artificial Sequence
  Peptide Derived from Human Papillomavirus
ITLTAEVM

SEQ ID NO: 8066 - protein, 11 aa, Artificial Sequence
  Peptide Derived from Human Papillomavirus
ITLTAEVMSYI

SEQ ID NO: 8067 - protein, 9 aa, Artificial Sequence
  Peptide Derived from Human Papillomavirus
ITQDVRDNV

SEQ ID NO: 8068 - protein, 11 aa, Artificial Sequence
  Peptide Derived from Human Papillomavirus
ITQDVRDNVSV

SEQ ID NO: 8069 - protein, 8 aa, Artificial Sequence
  Peptide Derived from Human Papillomavirus
ITTSDSQL

SEQ ID NO: 8070 - protein, 9 aa, Artificial Sequence
  Peptide Derived from Human Papillomavirus
KAQGHNNGI

SEQ ID NO: 8071 - protein, 8 aa, Artificial Sequence
  Peptide Derived from Human Papillomavirus
KLDDTESA

SEQ ID NO: 8072 - protein, 10 aa, Artificial Sequence
  Peptide Derived from Human Papillomavirus
KLDDTESAHA

SEQ ID NO: 8073 - protein, 11 aa, Artificial Sequence
  Peptide Derived from Human Papillomavirus
KLDDTESAHAA

SEQ ID NO: 8074 - protein, 9 aa, Artificial Sequence
  Peptide Derived from Human Papillomavirus
KLKFWTVDL

SEQ ID NO: 8075 - protein, 9 aa, Artificial Sequence
  Peptide Derived from Human Papillomavirus
KQAVPKVSA

SEQ ID NO: 8076 - protein, 8 aa, Artificial Sequence
  Peptide Derived from Human Papillomavirus
KQDPYDKL

SEQ ID NO: 8077 - protein, 8 aa, Artificial Sequence
  Peptide Derived from Human Papillomavirus
KQTQLCIL

SEQ ID NO: 8078 - protein, 11 aa, Artificial Sequence
  Peptide Derived from Human Papillomavirus
KQTQLCILGCV

SEQ ID NO: 8079 - protein, 9 aa, Artificial Sequence
  Peptide Derived from Human Papillomavirus
KVSAYQYRV

SEQ ID NO: 8080 - protein, 11 aa, Artificial Sequence
  Peptide Derived from Human Papillomavirus
LLTVGNPYFRV

SEQ ID NO: 8081 - protein, 8 aa, Artificial Sequence
  Peptide Derived from Human Papillomavirus
LQDTKCEV

SEQ ID NO: 8082 - protein, 10 aa, Artificial Sequence
  Peptide Derived from Human Papillomavirus
LQDTKCEVPL

SEQ ID NO: 8083 - protein, 9 aa, Artificial Sequence
  Peptide Derived from Human Papillomavirus
LQFIFQLCT

SEQ ID NO: 8084 - protein, 10 aa, Artificial Sequence
  Peptide Derived from Human Papillomavirus
LQFIFQLCTI

SEQ ID NO: 8085 - protein, 11 aa, Artificial Sequence
  Peptide Derived from Human Papillomavirus
LQFIFQLCTIT

SEQ ID NO: 8086 - protein, 9 aa, Artificial Sequence
  Peptide Derived from Human Papillomavirus
LQPGDCPPL

SEQ ID NO: 8087 - protein, 11 aa, Artificial Sequence
  Peptide Derived from Human Papillomavirus
LQPGDCPPLEL

SEQ ID NO: 8088 - protein, 9 aa, Artificial Sequence
  Peptide Derived from Human Papillomavirus
LTAEVMSYI

SEQ ID NO: 8089 - protein, 11 aa, Artificial Sequence
  Peptide Derived from Human Papillomavirus
LTLCASTQNPV

SEQ ID NO: 8090 - protein, 10 aa, Artificial Sequence
  Peptide Derived from Human Papillomavirus
LTVGNPYFRV

SEQ ID NO: 8091 - protein, 11 aa, Artificial Sequence
  Peptide Derived from Human Papillomavirus
LTVGNPYFRVV

SEQ ID NO: 8092 - protein, 8 aa, Artificial Sequence
  Peptide Derived from Human Papillomavirus
LVDTYRFV

SEQ ID NO: 8093 - protein, 11 aa, Artificial Sequence
  Peptide Derived from Human Papillomavirus
LVDTYRFVQSV

SEQ ID NO: 8094 - protein, 11 aa, Artificial Sequence
  Peptide Derived from Human Papillomavirus
LVQAGLRRRPT

SEQ ID NO: 8095 - protein, 8 aa, Artificial Sequence
  Peptide Derived from Human Papillomavirus
LVWACVGM

SEQ ID NO: 8096 - protein, 10 aa, Artificial Sequence
  Peptide Derived from Human Papillomavirus
LVWACVGMEI

SEQ ID NO: 8097 - protein, 11 aa, Artificial Sequence
  Peptide Derived from Human Papillomavirus
MAHNIIYGHGI

SEQ ID NO: 8098 - protein, 10 aa, Artificial Sequence
  Peptide Derived from Human Papillomavirus
MALWRPSDST

SEQ ID NO: 8099 - protein, 11 aa, Artificial Sequence
  Peptide Derived from Human Papillomavirus
MALWRPSDSTV

SEQ ID NO: 8100 - protein, 8 aa, Artificial Sequence
  Peptide Derived from Human Papillomavirus
MVDTGYGA

SEQ ID NO: 8101 - protein, 9 aa, Artificial Sequence
  Peptide Derived from Human Papillomavirus
MVDTGYGAM

SEQ ID NO: 8102 - protein, 8 aa, Artificial Sequence
  Peptide Derived from Human Papillomavirus
NIIYGHGI

SEQ ID NO: 8103 - protein, 9 aa, Artificial Sequence
  Peptide Derived from Human Papillomavirus
NIIYGHGII

SEQ ID NO: 8104 - protein, 10 aa, Artificial Sequence
  Peptide Derived from Human Papillomavirus
NIIYGHGIII

SEQ ID NO: 8105 - protein, 8 aa, Artificial Sequence
  Peptide Derived from Human Papillomavirus
NLTLCAST

SEQ ID NO: 8106 - protein, 10 aa, Artificial Sequence
  Peptide Derived from Human Papillomavirus
NMRETPGSCV

SEQ ID NO: 8107 - protein, 8 aa, Artificial Sequence
  Peptide Derived from Human Papillomavirus
NQLFVTVV

SEQ ID NO: 8108 - protein, 10 aa, Artificial Sequence
  Peptide Derived from Human Papillomavirus
NQLFVTVVDT

SEQ ID NO: 8109 - protein, 11 aa, Artificial Sequence
  Peptide Derived from Human Papillomavirus
NQLFVTVVDTT

SEQ ID NO: 8110 - protein, 9 aa, Artificial Sequence
  Peptide Derived from Human Papillomavirus
NTDDYVSRT

SEQ ID NO: 8111 - protein, 11 aa, Artificial Sequence
  Peptide Derived from Human Papillomavirus
NTDDYVSRTSI

SEQ ID NO: 8112 - protein, 9 aa, Artificial Sequence
  Peptide Derived from Human Papillomavirus
NTIIEDGDM

SEQ ID NO: 8113 - protein, 10 aa, Artificial Sequence
  Peptide Derived from Human Papillomavirus
NTIIEDGDMV

SEQ ID NO: 8114 - protein, 9 aa, Artificial Sequence
  Peptide Derived from Human Papillomavirus
NVFPIFLQM

SEQ ID NO: 8115 - protein, 10 aa, Artificial Sequence
  Peptide Derived from Human Papillomavirus
NVFPIFLQMA

SEQ ID NO: 8116 - protein, 11 aa, Artificial Sequence
  Peptide Derived from Human Papillomavirus
NVFPIFLQMAL

SEQ ID NO: 8117 - protein, 9 aa, Artificial Sequence
  Peptide Derived from Human Papillomavirus
NVNVFPIFL

SEQ ID NO: 8118 - protein, 11 aa, Artificial Sequence
  Peptide Derived from Human Papillomavirus
NVNVFPIFLQM

SEQ ID NO: 8119 - protein, 9 aa, Artificial Sequence
  Peptide Derived from Human Papillomavirus
NVSVDYKQT

SEQ ID NO: 8120 - protein, 11 aa, Artificial Sequence
  Peptide Derived from Human Papillomavirus
NVSVDYKQTQL

SEQ ID NO: 8121 - protein, 8 aa, Artificial Sequence
  Peptide Derived from Human Papillomavirus
PAASTSTA

SEQ ID NO: 8122 - protein, 8 aa, Artificial Sequence
  Peptide Derived from Human Papillomavirus
PAIGEHWA

SEQ ID NO: 8123 - protein, 11 aa, Artificial Sequence
  Peptide Derived from Human Papillomavirus
PAIGEHWAKGT

SEQ ID NO: 8124 - protein, 8 aa, Artificial Sequence
  Peptide Derived from Human Papillomavirus
PIFLQMAL

SEQ ID NO: 8125 - protein, 8 aa, Artificial Sequence
  Peptide Derived from Human Papillomavirus
PLDICQSI

SEQ ID NO: 8126 - protein, 8 aa, Artificial Sequence
  Peptide Derived from Human Papillomavirus
PLELKNTI

SEQ ID NO: 8127 - protein, 9 aa, Artificial Sequence
  Peptide Derived from Human Papillomavirus
PLELKNTII

SEQ ID NO: 8128 - protein, 8 aa, Artificial Sequence
  Peptide Derived from Human Papillomavirus
PLGRKFLV

SEQ ID NO: 8129 - protein, 10 aa, Artificial Sequence
  Peptide Derived from Human Papillomavirus
PLGRKFLVQA

SEQ ID NO: 8130 - protein, 9 aa, Artificial Sequence
  Peptide Derived from Human Papillomavirus
PTDLYIKGT

SEQ ID NO: 8131 - protein, 11 aa, Artificial Sequence
  Peptide Derived from Human Papillomavirus
PTDLYIKGTSA

SEQ ID NO: 8132 - protein, 10 aa, Artificial Sequence
  Peptide Derived from Human Papillomavirus
PTIGPRKRPA

SEQ ID NO: 8133 - protein, 11 aa, Artificial Sequence
  Peptide Derived from Human Papillomavirus
PTIGPRKRPAA

SEQ ID NO: 8134 - protein, 11 aa, Artificial Sequence
  Peptide Derived from Human Papillomavirus
PTKFKHYSRHV

SEQ ID NO: 8135 - protein, 8 aa, Artificial Sequence
  Peptide Derived from Human Papillomavirus
PTTSLVDT

SEQ ID NO: 8136 - protein, 9 aa, Artificial Sequence
  Peptide Derived from Human Papillomavirus
PVPNTYDPT

SEQ ID NO: 8137 - protein, 9 aa, Artificial Sequence
  Peptide Derived from Human Papillomavirus
QAGLRRRPT

SEQ ID NO: 8138 - protein, 10 aa, Artificial Sequence
  Peptide Derived from Human Papillomavirus
QAGLRRRPTI

SEQ ID NO: 8139 - protein, 8 aa, Artificial Sequence
  Peptide Derived from Human Papillomavirus
QAVPKVSA

SEQ ID NO: 8140 - protein, 8 aa, Artificial Sequence
  Peptide Derived from Human Papillomavirus
QLCILGCV

SEQ ID NO: 8141 - protein, 10 aa, Artificial Sequence
  Peptide Derived from Human Papillomavirus
QLCILGCVPA

SEQ ID NO: 8142 - protein, 11 aa, Artificial Sequence
  Peptide Derived from Human Papillomavirus
QLCILGCVPAI

SEQ ID NO: 8143 - protein, 8 aa, Artificial Sequence
  Peptide Derived from Human Papillomavirus
QLCTITLT

SEQ ID NO: 8144 - protein, 9 aa, Artificial Sequence
  Peptide Derived from Human Papillomavirus
QLCTITLTA

SEQ ID NO: 8145 - protein, 11 aa, Artificial Sequence
  Peptide Derived from Human Papillomavirus
QLCTITLTAEV

SEQ ID NO: 8146 - protein, 11 aa, Artificial Sequence
  Peptide Derived from Human Papillomavirus
QLFARHFWNRA

SEQ ID NO: 8147 - protein, 9 aa, Artificial Sequence
  Peptide Derived from Human Papillomavirus
QLFNKPYWL

SEQ ID NO: 8148 - protein, 9 aa, Artificial Sequence
  Peptide Derived from Human Papillomavirus
QLFVTVVDT

SEQ ID NO: 8149 - protein, 10 aa, Artificial Sequence
  Peptide Derived from Human Papillomavirus
QLFVTVVDTT

SEQ ID NO: 8150 - protein, 10 aa, Artificial Sequence
  Peptide Derived from Human Papillomavirus
QLQPGDCPPL

SEQ ID NO: 8151 - protein, 11 aa, Artificial Sequence
  Peptide Derived from Human Papillomavirus
QMALWRPSDST

SEQ ID NO: 8152 - protein, 11 aa, Artificial Sequence
  Peptide Derived from Human Papillomavirus
QMSADPYGDSM

SEQ ID NO: 8153 - protein, 10 aa, Artificial Sequence
  Peptide Derived from Human Papillomavirus
QTQLCILGCV

SEQ ID NO: 8154 - protein, 8 aa, Artificial Sequence
  Peptide Derived from Human Papillomavirus
RAGVMGDT

SEQ ID NO: 8155 - protein, 9 aa, Artificial Sequence
  Peptide Derived from Human Papillomavirus
RAGVMGDTV

SEQ ID NO: 8156 - protein, 11 aa, Artificial Sequence
  Peptide Derived from Human Papillomavirus
RAGVMGDTVPT

SEQ ID NO: 8157 - protein, 9 aa, Artificial Sequence
  Peptide Derived from Human Papillomavirus
RLVWACVGM

SEQ ID NO: 8158 - protein, 11 aa, Artificial Sequence
  Peptide Derived from Human Papillomavirus
RLVWACVGMEI

SEQ ID NO: 8159 - protein, 8 aa, Artificial Sequence
  Peptide Derived from Human Papillomavirus
RTSIFYHA

SEQ ID NO: 8160 - protein, 9 aa, Artificial Sequence
  Peptide Derived from Human Papillomavirus
RVVNTDDYV

SEQ ID NO: 8161 - protein, 9 aa, Artificial Sequence
  Peptide Derived from Human Papillomavirus
SADPYGDSM

SEQ ID NO: 8162 - protein, 8 aa, Artificial Sequence
  Peptide Derived from Human Papillomavirus
SAHAATAV

SEQ ID NO: 8163 - protein, 9 aa, Artificial Sequence
  Peptide Derived from Human Papillomavirus
SAHAATAVI

SEQ ID NO: 8164 - protein, 10 aa, Artificial Sequence
  Peptide Derived from Human Papillomavirus
SAHAATAVIT

SEQ ID NO: 8165 - protein, 10 aa, Artificial Sequence
  Peptide Derived from Human Papillomavirus
SAYQYRVFRV

SEQ ID NO: 8166 - protein, 11 aa, Artificial Sequence
  Peptide Derived from Human Papillomavirus
SAYQYRVFRVA

SEQ ID NO: 8167 - protein, 9 aa, Artificial Sequence
  Peptide Derived from Human Papillomavirus
SICKYPDYL

SEQ ID NO: 8168 - protein, 11 aa, Artificial Sequence
  Peptide Derived from Human Papillomavirus
SICKYPDYLQM

SEQ ID NO: 8169 - protein, 11 aa, Artificial Sequence
  Peptide Derived from Human Papillomavirus
SIFYHAGSSRL

SEQ ID NO: 8170 - protein, 10 aa, Artificial Sequence
  Peptide Derived from Human Papillomavirus
SILENWNFGV

SEQ ID NO: 8171 - protein, 9 aa, Artificial Sequence
  Peptide Derived from Human Papillomavirus
SITTSDSQL

SEQ ID NO: 8172 - protein, 9 aa, Artificial Sequence
  Peptide Derived from Human Papillomavirus
SLVDTYRFV

SEQ ID NO: 8173 - protein, 11 aa, Artificial Sequence
  Peptide Derived from Human Papillomavirus
SMFFCLRREQL

SEQ ID NO: 8174 - protein, 10 aa, Artificial Sequence
  Peptide Derived from Human Papillomavirus
SQLFNKPYWL

SEQ ID NO: 8175 - protein, 10 aa, Artificial Sequence
  Peptide Derived from Human Papillomavirus
STASRPAKRV

SEQ ID NO: 8176 - protein, 8 aa, Artificial Sequence
  Peptide Derived from Human Papillomavirus
STIYNPET

SEQ ID NO: 8177 - protein, 11 aa, Artificial Sequence
  Peptide Derived from Human Papillomavirus
STIYNPETQRL

SEQ ID NO: 8178 - protein, 10 aa, Artificial Sequence
  Peptide Derived from Human Papillomavirus
STLQDTKCEV

SEQ ID NO: 8179 - protein, 8 aa, Artificial Sequence
  Peptide Derived from Human Papillomavirus
STNLTLCA

SEQ ID NO: 8180 - protein, 10 aa, Artificial Sequence
  Peptide Derived from Human Papillomavirus
STNLTLCAST

SEQ ID NO: 8181 - protein, 9 aa, Artificial Sequence
  Peptide Derived from Human Papillomavirus
STQNPVPNT

SEQ ID NO: 8182 - protein, 9 aa, Artificial Sequence
  Peptide Derived from Human Papillomavirus
STSTASRPA

SEQ ID NO: 8183 - protein, 10 aa, Artificial Sequence
  Peptide Derived from Human Papillomavirus
STVYLPPPSV

SEQ ID NO: 8184 - protein, 11 aa, Artificial Sequence
  Peptide Derived from Human Papillomavirus
STVYLPPPSVA

SEQ ID NO: 8185 - protein, 8 aa, Artificial Sequence
  Peptide Derived from Human Papillomavirus
SVARVVNT

SEQ ID NO: 8186 - protein, 10 aa, Artificial Sequence
  Peptide Derived from Human Papillomavirus
SVAVTCQKDT

SEQ ID NO: 8187 - protein, 11 aa, Artificial Sequence
  Peptide Derived from Human Papillomavirus
SVAVTCQKDTT

SEQ ID NO: 8188 - protein, 9 aa, Artificial Sequence
  Peptide Derived from Human Papillomavirus
SVDYKQTQL

SEQ ID NO: 8189 - protein, 11 aa, Artificial Sequence
  Peptide Derived from Human Papillomavirus
SVDYKQTQLCI

SEQ ID NO: 8190 - protein, 8 aa, Artificial Sequence
  Peptide Derived from Human Papillomavirus
TAEVMSYI

SEQ ID NO: 8191 - protein, 11 aa, Artificial Sequence
  Peptide Derived from Human Papillomavirus
TAEVMSYIHSM

SEQ ID NO: 8192 - protein, 9 aa, Artificial Sequence
  Peptide Derived from Human Papillomavirus
TASRPAKRV

SEQ ID NO: 8193 - protein, 11 aa, Artificial Sequence
  Peptide Derived from Human Papillomavirus
TASRPAKRVRI

SEQ ID NO: 8194 - protein, 8 aa, Artificial Sequence
  Peptide Derived from Human Papillomavirus
TAVITQDV

SEQ ID NO: 8195 - protein, 9 aa, Artificial Sequence
  Peptide Derived from Human Papillomavirus
TIGPRKRPA

SEQ ID NO: 8196 - protein, 10 aa, Artificial Sequence
  Peptide Derived from Human Papillomavirus
TIGPRKRPAA

SEQ ID NO: 8197 - protein, 8 aa, Artificial Sequence
  Peptide Derived from Human Papillomavirus
TIIEDGDM

SEQ ID NO: 8198 - protein, 9 aa, Artificial Sequence
  Peptide Derived from Human Papillomavirus
TIIEDGDMV

SEQ ID NO: 8199 - protein, 11 aa, Artificial Sequence
  Peptide Derived from Human Papillomavirus
TIIEDGDMVDT

SEQ ID NO: 8200 - protein, 8 aa, Artificial Sequence
  Peptide Derived from Human Papillomavirus
TITLTAEV

SEQ ID NO: 8201 - protein, 9 aa, Artificial Sequence
  Peptide Derived from Human Papillomavirus
TITLTAEVM

SEQ ID NO: 8202 - protein, 10 aa, Artificial Sequence
  Peptide Derived from Human Papillomavirus
TIYNPETQRL

SEQ ID NO: 8203 - protein, 11 aa, Artificial Sequence
  Peptide Derived from Human Papillomavirus
TIYNPETQRLV

SEQ ID NO: 8204 - protein, 10 aa, Artificial Sequence
  Peptide Derived from Human Papillomavirus
TLCASTQNPV

SEQ ID NO: 8205 - protein, 8 aa, Artificial Sequence
  Peptide Derived from Human Papillomavirus
TLCKPAQL

SEQ ID NO: 8206 - protein, 9 aa, Artificial Sequence
  Peptide Derived from Human Papillomavirus
TLQDTKCEV

SEQ ID NO: 8207 - protein, 11 aa, Artificial Sequence
  Peptide Derived from Human Papillomavirus
TLQDTKCEVPL

SEQ ID NO: 8208 - protein, 10 aa, Artificial Sequence
  Peptide Derived from Human Papillomavirus
TLTAEVMSYI

SEQ ID NO: 8209 - protein, 8 aa, Artificial Sequence
  Peptide Derived from Human Papillomavirus
TQDVRDNV

SEQ ID NO: 8210 - protein, 10 aa, Artificial Sequence
  Peptide Derived from Human Papillomavirus
TQDVRDNVSV

SEQ ID NO: 8211 - protein, 9 aa, Artificial Sequence
  Peptide Derived from Human Papillomavirus
TQLCILGCV

SEQ ID NO: 8212 - protein, 11 aa, Artificial Sequence
  Peptide Derived from Human Papillomavirus
TQLCILGCVPA

SEQ ID NO: 8213 - protein, 8 aa, Artificial Sequence
  Peptide Derived from Human Papillomavirus
TQNPVPNT

SEQ ID NO: 8214 - protein, 9 aa, Artificial Sequence
  Peptide Derived from Human Papillomavirus
TQRLVWACV

SEQ ID NO: 8215 - protein, 11 aa, Artificial Sequence
  Peptide Derived from Human Papillomavirus
TQRLVWACVGM

SEQ ID NO: 8216 - protein, 8 aa, Artificial Sequence
  Peptide Derived from Human Papillomavirus
TTRSTNLT

SEQ ID NO: 8217 - protein, 9 aa, Artificial Sequence
  Peptide Derived from Human Papillomavirus
TTRSTNLTL

SEQ ID NO: 8218 - protein, 11 aa, Artificial Sequence
  Peptide Derived from Human Papillomavirus
TTRSTNLTLCA

SEQ ID NO: 8219 - protein, 11 aa, Artificial Sequence
  Peptide Derived from Human Papillomavirus
TTSLVDTYRFV

SEQ ID NO: 8220 - protein, 9 aa, Artificial Sequence
  Peptide Derived from Human Papillomavirus
TVGNPYFRV

SEQ ID NO: 8221 - protein, 10 aa, Artificial Sequence
  Peptide Derived from Human Papillomavirus
TVGNPYFRVV

SEQ ID NO: 8222 - protein, 8 aa, Artificial Sequence
  Peptide Derived from Human Papillomavirus
TVPTDLYI

SEQ ID NO: 8223 - protein, 11 aa, Artificial Sequence
  Peptide Derived from Human Papillomavirus
TVPTDLYIKGT

SEQ ID NO: 8224 - protein, 9 aa, Artificial Sequence
  Peptide Derived from Human Papillomavirus
TVVDTTRST

SEQ ID NO: 8225 - protein, 11 aa, Artificial Sequence
  Peptide Derived from Human Papillomavirus
TVVDTTRSTNL

SEQ ID NO: 8226 - protein, 9 aa, Artificial Sequence
  Peptide Derived from Human Papillomavirus
TVYLPPPSV

SEQ ID NO: 8227 - protein, 10 aa, Artificial Sequence
  Peptide Derived from Human Papillomavirus
TVYLPPPSVA

SEQ ID NO: 8228 - protein, 11 aa, Artificial Sequence
  Peptide Derived from Human Papillomavirus
VALPDPNKFGL

SEQ ID NO: 8229 - protein, 11 aa, Artificial Sequence
  Peptide Derived from Human Papillomavirus
VARVVNTDDYV

SEQ ID NO: 8230 - protein, 9 aa, Artificial Sequence
  Peptide Derived from Human Papillomavirus
VAVTCQKDT

SEQ ID NO: 8231 - protein, 10 aa, Artificial Sequence
  Peptide Derived from Human Papillomavirus
VAVTCQKDTT

SEQ ID NO: 8232 - protein, 10 aa, Artificial Sequence
  Peptide Derived from Human Papillomavirus
VITQDVRDNV

SEQ ID NO: 8233 - protein, 8 aa, Artificial Sequence
  Peptide Derived from Human Papillomavirus
VMGDTVPT

SEQ ID NO: 8234 - protein, 10 aa, Artificial Sequence
  Peptide Derived from Human Papillomavirus
VMGDTVPTDL

SEQ ID NO: 8235 - protein, 8 aa, Artificial Sequence
  Peptide Derived from Human Papillomavirus
VMSYIHSM

SEQ ID NO: 8236 - protein, 10 aa, Artificial Sequence
  Peptide Derived from Human Papillomavirus
VQAGLRRRPT

SEQ ID NO: 8237 - protein, 11 aa, Artificial Sequence
  Peptide Derived from Human Papillomavirus
VQAGLRRRPTI

SEQ ID NO: 8238 - protein, 8 aa, Artificial Sequence
  Peptide Derived from Human Papillomavirus
VTCQKDTT

SEQ ID NO: 8239 - protein, 10 aa, Artificial Sequence
  Peptide Derived from Human Papillomavirus
VTVVDTTRST

SEQ ID NO: 8240 - protein, 8 aa, Artificial Sequence
  Peptide Derived from Human Papillomavirus
VVDTTRST

SEQ ID NO: 8241 - protein, 10 aa, Artificial Sequence
  Peptide Derived from Human Papillomavirus
VVDTTRSTNL

SEQ ID NO: 8242 - protein, 11 aa, Artificial Sequence
  Peptide Derived from Human Papillomavirus
VVDTTRSTNLT

SEQ ID NO: 8243 - protein, 8 aa, Artificial Sequence
  Peptide Derived from Human Papillomavirus
VVNTDDYV

SEQ ID NO: 8244 - protein, 11 aa, Artificial Sequence
  Peptide Derived from Human Papillomavirus
VVNTDDYVSRT

SEQ ID NO: 8245 - protein, 11 aa, Artificial Sequence
  Peptide Derived from Human Papillomavirus
VVPSGAGNKQA

SEQ ID NO: 8246 - protein, 8 aa, Artificial Sequence
  Peptide Derived from Human Papillomavirus
WACVGMEI

SEQ ID NO: 8247 - protein, 10 aa, Artificial Sequence
  Peptide Derived from Human Papillomavirus
WAKGTLCKPA

SEQ ID NO: 8248 - protein, 9 aa, Artificial Sequence
  Peptide Derived from Human Papillomavirus
YIHSMNSSI

SEQ ID NO: 8249 - protein, 10 aa, Artificial Sequence
  Peptide Derived from Human Papillomavirus
YIHSMNSSIL

SEQ ID NO: 8250 - protein, 9 aa, Artificial Sequence
  Peptide Derived from Human Papillomavirus
YIKGTSANM

SEQ ID NO: 8251 - protein, 8 aa, Artificial Sequence
  Peptide Derived from Human Papillomavirus
YLPPPSVA

SEQ ID NO: 8252 - protein, 10 aa, Artificial Sequence
  Peptide Derived from Human Papillomavirus
YLPPPSVARV

SEQ ID NO: 8253 - protein, 11 aa, Artificial Sequence
  Peptide Derived from Human Papillomavirus
YLPPPSVARVV

SEQ ID NO: 8254 - protein, 8 aa, Artificial Sequence
  Peptide Derived from Human Papillomavirus
YQYRVFRV

SEQ ID NO: 8255 - protein, 9 aa, Artificial Sequence
  Peptide Derived from Human Papillomavirus
YQYRVFRVA

SEQ ID NO: 8256 - protein, 10 aa, Artificial Sequence
  Peptide Derived from Human Papillomavirus
YQYRVFRVAL

SEQ ID NO: 8257 - protein, 11 aa, Artificial Sequence
  Peptide Derived from Human Papillomavirus
YVSRTSIFYHA

SEQ ID NO: 8258 - protein, 9 aa, Artificial Sequence
  Peptide Derived from Human Papillomavirus
AARRKRASA

SEQ ID NO: 8259 - protein, 10 aa, Artificial Sequence
  Peptide Derived from Human Papillomavirus
AARRKRASAT

SEQ ID NO: 8260 - protein, 8 aa, Artificial Sequence
  Peptide Derived from Human Papillomavirus
AASSYSNV

SEQ ID NO: 8261 - protein, 9 aa, Artificial Sequence
  Peptide Derived from Human Papillomavirus
AASSYSNVT

SEQ ID NO: 8262 - protein, 10 aa, Artificial Sequence
  Peptide Derived from Human Papillomavirus
AASSYSNVTV

SEQ ID NO: 8263 - protein, 8 aa, Artificial Sequence
  Peptide Derived from Human Papillomavirus
AATEEIEL

SEQ ID NO: 8264 - protein, 11 aa, Artificial Sequence
  Peptide Derived from Human Papillomavirus
AATEEIELQPL

SEQ ID NO: 8265 - protein, 8 aa, Artificial Sequence
  Peptide Derived from Human Papillomavirus
ALSSRRGT

SEQ ID NO: 8266 - protein, 9 aa, Artificial Sequence
  Peptide Derived from Human Papillomavirus
ALSSRRGTV

SEQ ID NO: 8267 - protein, 10 aa, Artificial Sequence
  Peptide Derived from Human Papillomavirus
ATEEIELQPL

SEQ ID NO: 8268 - protein, 11 aa, Artificial Sequence
  Peptide Derived from Human Papillomavirus
ATEEIELQPLI

SEQ ID NO: 8269 - protein, 11 aa, Artificial Sequence
  Peptide Derived from Human Papillomavirus
ATMFTRSGKQI

SEQ ID NO: 8270 - protein, 10 aa, Artificial Sequence
  Peptide Derived from Human Papillomavirus
ATNDSDLFDV

SEQ ID NO: 8271 - protein, 8 aa, Artificial Sequence
  Peptide Derived from Human Papillomavirus
AVLDITPT

SEQ ID NO: 8272 - protein, 9 aa, Artificial Sequence
  Peptide Derived from Human Papillomavirus
AVLDITPTV

SEQ ID NO: 8273 - protein, 8 aa, Artificial Sequence
  Peptide Derived from Human Papillomavirus
DIILPSHT

SEQ ID NO: 8274 - protein, 10 aa, Artificial Sequence
  Peptide Derived from Human Papillomavirus
DIILPSHTPM

SEQ ID NO: 8275 - protein, 9 aa, Artificial Sequence
  Peptide Derived from Human Papillomavirus
DIIRLHRPA

SEQ ID NO: 8276 - protein, 10 aa, Artificial Sequence
  Peptide Derived from Human Papillomavirus
DIIRLHRPAL

SEQ ID NO: 8277 - protein, 8 aa, Artificial Sequence
  Peptide Derived from Human Papillomavirus
DISPIAAT

SEQ ID NO: 8278 - protein, 11 aa, Artificial Sequence
  Peptide Derived from Human Papillomavirus
DISPIAATEEI

SEQ ID NO: 8279 - protein, 9 aa, Artificial Sequence
  Peptide Derived from Human Papillomavirus
DITPTVDSV

SEQ ID NO: 8280 - protein, 11 aa, Artificial Sequence
  Peptide Derived from Human Papillomavirus
DITPTVDSVSI

SEQ ID NO: 8281 - protein, 11 aa, Artificial Sequence
  Peptide Derived from Human Papillomavirus
DLYRTCKQSGT

SEQ ID NO: 8282 - protein, 9 aa, Artificial Sequence
  Peptide Derived from Human Papillomavirus
DTTLSFEPT

SEQ ID NO: 8283 - protein, 9 aa, Artificial Sequence
  Peptide Derived from Human Papillomavirus
DVGPTRPPV

SEQ ID NO: 8284 - protein, 10 aa, Artificial Sequence
  Peptide Derived from Human Papillomavirus
DVGPTRPPVV

SEQ ID NO: 8285 - protein, 11 aa, Artificial Sequence
  Peptide Derived from Human Papillomavirus
DVGPTRPPVVI

SEQ ID NO: 8286 - protein, 9 aa, Artificial Sequence
  Peptide Derived from Human Papillomavirus
DVINKVEGT

SEQ ID NO: 8287 - protein, 10 aa, Artificial Sequence
  Peptide Derived from Human Papillomavirus
DVINKVEGTT

SEQ ID NO: 8288 - protein, 11 aa, Artificial Sequence
  Peptide Derived from Human Papillomavirus
DVINKVEGTTL

SEQ ID NO: 8289 - protein, 10 aa, Artificial Sequence
  Peptide Derived from Human Papillomavirus
DVPIYTGPDI

SEQ ID NO: 8290 - protein, 11 aa, Artificial Sequence
  Peptide Derived from Human Papillomavirus
DVPIYTGPDII

SEQ ID NO: 8291 - protein, 10 aa, Artificial Sequence
  Peptide Derived from Human Papillomavirus
DVYADFPPPA

SEQ ID NO: 8292 - protein, 8 aa, Artificial Sequence
  Peptide Derived from Human Papillomavirus
EIELQPLI

SEQ ID NO: 8293 - protein, 10 aa, Artificial Sequence
  Peptide Derived from Human Papillomavirus
EIELQPLISA

SEQ ID NO: 8294 - protein, 11 aa, Artificial Sequence
  Peptide Derived from Human Papillomavirus
EIELQPLISAT

SEQ ID NO: 8295 - protein, 8 aa, Artificial Sequence
  Peptide Derived from Human Papillomavirus
EIPLQTFA

SEQ ID NO: 8296 - protein, 8 aa, Artificial Sequence
  Peptide Derived from Human Papillomavirus
EITSSGTT

SEQ ID NO: 8297 - protein, 9 aa, Artificial Sequence
  Peptide Derived from Human Papillomavirus
EITSSGTTT

SEQ ID NO: 8298 - protein, 11 aa, Artificial Sequence
  Peptide Derived from Human Papillomavirus
EITSSGTTTPA

SEQ ID NO: 8299 - protein, 8 aa, Artificial Sequence
  Peptide Derived from Human Papillomavirus
ELQPLISA

SEQ ID NO: 8300 - protein, 9 aa, Artificial Sequence
  Peptide Derived from Human Papillomavirus
ELQPLISAT

SEQ ID NO: 8301 - protein, 8 aa, Artificial Sequence
  Peptide Derived from Human Papillomavirus
EVPQTGEV

SEQ ID NO: 8302 - protein, 8 aa, Artificial Sequence
  Peptide Derived from Human Papillomavirus
EVSGNIFV

SEQ ID NO: 8303 - protein, 10 aa, Artificial Sequence
  Peptide Derived from Human Papillomavirus
EVSGNIFVGT

SEQ ID NO: 8304 - protein, 8 aa, Artificial Sequence
  Peptide Derived from Human Papillomavirus
FADGFVAA

SEQ ID NO: 8305 - protein, 8 aa, Artificial Sequence
  Peptide Derived from Human Papillomavirus
FASSGSGT

SEQ ID NO: 8306 - protein, 11 aa, Artificial Sequence
  Peptide Derived from Human Papillomavirus
FASSGSGTEPI

SEQ ID NO: 8307 - protein, 9 aa, Artificial Sequence
  Peptide Derived from Human Papillomavirus
FLGGLGIGT

SEQ ID NO: 8308 - protein, 8 aa, Artificial Sequence
  Peptide Derived from Human Papillomavirus
FLTHPSSL

SEQ ID NO: 8309 - protein, 9 aa, Artificial Sequence
  Peptide Derived from Human Papillomavirus
FLTHPSSLV

SEQ ID NO: 8310 - protein, 10 aa, Artificial Sequence
  Peptide Derived from Human Papillomavirus
FLTHPSSLVT

SEQ ID NO: 8311 - protein, 11 aa, Artificial Sequence
  Peptide Derived from Human Papillomavirus
FMDIIRLHRPA

SEQ ID NO: 8312 - protein, 9 aa, Artificial Sequence
  Peptide Derived from Human Papillomavirus
FTGTSGFEI

SEQ ID NO: 8313 - protein, 10 aa, Artificial Sequence
  Peptide Derived from Human Papillomavirus
FTGTSGFEIT

SEQ ID NO: 8314 - protein, 11 aa, Artificial Sequence
  Peptide Derived from Human Papillomavirus
FTNPAFSDPSI

SEQ ID NO: 8315 - protein, 8 aa, Artificial Sequence
  Peptide Derived from Human Papillomavirus
FTRSGKQI

SEQ ID NO: 8316 - protein, 8 aa, Artificial Sequence
  Peptide Derived from Human Papillomavirus
FTYPKYSL

SEQ ID NO: 8317 - protein, 9 aa, Artificial Sequence
  Peptide Derived from Human Papillomavirus
FTYPKYSLT

SEQ ID NO: 8318 - protein, 10 aa, Artificial Sequence
  Peptide Derived from Human Papillomavirus
FTYPKYSLTM

SEQ ID NO: 8319 - protein, 8 aa, Artificial Sequence
  Peptide Derived from Human Papillomavirus
GAPVPTFT

SEQ ID NO: 8320 - protein, 10 aa, Artificial Sequence
  Peptide Derived from Human Papillomavirus
GAPVPTFTGT

SEQ ID NO: 8321 - protein, 9 aa, Artificial Sequence
  Peptide Derived from Human Papillomavirus
GIFLGGLGI

SEQ ID NO: 8322 - protein, 11 aa, Artificial Sequence
  Peptide Derived from Human Papillomavirus
GIFLGGLGIGT

SEQ ID NO: 8323 - protein, 9 aa, Artificial Sequence
  Peptide Derived from Human Papillomavirus
GIHGTQYYL

SEQ ID NO: 8324 - protein, 8 aa, Artificial Sequence
  Peptide Derived from Human Papillomavirus
GQRATMFT

SEQ ID NO: 8325 - protein, 8 aa, Artificial Sequence
  Peptide Derived from Human Papillomavirus
GTCPPDVI

SEQ ID NO: 8326 - protein, 11 aa, Artificial Sequence
  Peptide Derived from Human Papillomavirus
GTCPPDVINKV

SEQ ID NO: 8327 - protein, 8 aa, Artificial Sequence
  Peptide Derived from Human Papillomavirus
GTEPISST

SEQ ID NO: 8328 - protein, 10 aa, Artificial Sequence
  Peptide Derived from Human Papillomavirus
GTEPISSTPL

SEQ ID NO: 8329 - protein, 10 aa, Artificial Sequence
  Peptide Derived from Human Papillomavirus
GTGSGSGGRT

SEQ ID NO: 8330 - protein, 8 aa, Artificial Sequence
  Peptide Derived from Human Papillomavirus
GTSGFEIT

SEQ ID NO: 8331 - protein, 8 aa, Artificial Sequence
  Peptide Derived from Human Papillomavirus
GTTLADKI

SEQ ID NO: 8332 - protein, 9 aa, Artificial Sequence
  Peptide Derived from Human Papillomavirus
GTTLADKIL

SEQ ID NO: 8333 - protein, 8 aa, Artificial Sequence
  Peptide Derived from Human Papillomavirus
GTTTPAVL

SEQ ID NO: 8334 - protein, 10 aa, Artificial Sequence
  Peptide Derived from Human Papillomavirus
GTTTPAVLDI

SEQ ID NO: 8335 - protein, 11 aa, Artificial Sequence
  Peptide Derived from Human Papillomavirus
GTTTPAVLDIT

SEQ ID NO: 8336 - protein, 8 aa, Artificial Sequence
  Peptide Derived from Human Papillomavirus
GTVRFSRL

SEQ ID NO: 8337 - protein, 8 aa, Artificial Sequence
  Peptide Derived from Human Papillomavirus
HTPMWPST

SEQ ID NO: 8338 - protein, 11 aa, Artificial Sequence
  Peptide Derived from Human Papillomavirus
HTPMWPSTSPT

SEQ ID NO: 8339 - protein, 9 aa, Artificial Sequence
  Peptide Derived from Human Papillomavirus
IAATEEIEL

SEQ ID NO: 8340 - protein, 10 aa, Artificial Sequence
  Peptide Derived from Human Papillomavirus
IIEVPQTGEV

SEQ ID NO: 8341 - protein, 9 aa, Artificial Sequence
  Peptide Derived from Human Papillomavirus
IILPSHTPM

SEQ ID NO: 8342 - protein, 8 aa, Artificial Sequence
  Peptide Derived from Human Papillomavirus
IIRLHRPA

SEQ ID NO: 8343 - protein, 9 aa, Artificial Sequence
  Peptide Derived from Human Papillomavirus
IIRLHRPAL

SEQ ID NO: 8344 - protein, 8 aa, Artificial Sequence
  Peptide Derived from Human Papillomavirus
ILPSHTPM

SEQ ID NO: 8345 - protein, 9 aa, Artificial Sequence
  Peptide Derived from Human Papillomavirus
ILQWSSLGI

SEQ ID NO: 8346 - protein, 11 aa, Artificial Sequence
  Peptide Derived from Human Papillomavirus
ILQWSSLGIFL

SEQ ID NO: 8347 - protein, 8 aa, Artificial Sequence
  Peptide Derived from Human Papillomavirus
ITPTVDSV

SEQ ID NO: 8348 - protein, 10 aa, Artificial Sequence
  Peptide Derived from Human Papillomavirus
ITPTVDSVSI

SEQ ID NO: 8349 - protein, 8 aa, Artificial Sequence
  Peptide Derived from Human Papillomavirus
ITSSGTTT

SEQ ID NO: 8350 - protein, 10 aa, Artificial Sequence
  Peptide Derived from Human Papillomavirus
ITSSGTTTPA

SEQ ID NO: 8351 - protein, 11 aa, Artificial Sequence
  Peptide Derived from Human Papillomavirus
ITSSGTTTPAV

SEQ ID NO: 8352 - protein, 10 aa, Artificial Sequence
  Peptide Derived from Human Papillomavirus
IVTLVEDSSV

SEQ ID NO: 8353 - protein, 11 aa, Artificial Sequence
  Peptide Derived from Human Papillomavirus
IVTLVEDSSVV

SEQ ID NO: 8354 - protein, 8 aa, Artificial Sequence
  Peptide Derived from Human Papillomavirus
KILQWSSL

SEQ ID NO: 8355 - protein, 10 aa, Artificial Sequence
  Peptide Derived from Human Papillomavirus
KILQWSSLGI

SEQ ID NO: 8356 - protein, 10 aa, Artificial Sequence
  Peptide Derived from Human Papillomavirus
KQSGTCPPDV

SEQ ID NO: 8357 - protein, 11 aa, Artificial Sequence
  Peptide Derived from Human Papillomavirus
KQSGTCPPDVI

SEQ ID NO: 8358 - protein, 8 aa, Artificial Sequence
  Peptide Derived from Human Papillomavirus
KVEGTTLA

SEQ ID NO: 8359 - protein, 11 aa, Artificial Sequence
  Peptide Derived from Human Papillomavirus
KVEGTTLADKI

SEQ ID NO: 8360 - protein, 11 aa, Artificial Sequence
  Peptide Derived from Human Papillomavirus
LADKILQWSSL

SEQ ID NO: 8361 - protein, 10 aa, Artificial Sequence
  Peptide Derived from Human Papillomavirus
LISATNDSDL

SEQ ID NO: 8362 - protein, 8 aa, Artificial Sequence
  Peptide Derived from Human Papillomavirus
LQPLISAT

SEQ ID NO: 8363 - protein, 11 aa, Artificial Sequence
  Peptide Derived from Human Papillomavirus
LQTFASSGSGT

SEQ ID NO: 8364 - protein, 8 aa, Artificial Sequence
  Peptide Derived from Human Papillomavirus
LQWSSLGI

SEQ ID NO: 8365 - protein, 10 aa, Artificial Sequence
  Peptide Derived from Human Papillomavirus
LQWSSLGIFL

SEQ ID NO: 8366 - protein, 8 aa, Artificial Sequence
  Peptide Derived from Human Papillomavirus
LTHPSSLV

SEQ ID NO: 8367 - protein, 9 aa, Artificial Sequence
  Peptide Derived from Human Papillomavirus
LTHPSSLVT

SEQ ID NO: 8368 - protein, 8 aa, Artificial Sequence
  Peptide Derived from Human Papillomavirus
LTMPSTAA

SEQ ID NO: 8369 - protein, 9 aa, Artificial Sequence
  Peptide Derived from Human Papillomavirus
LTSAWDVPI

SEQ ID NO: 8370 - protein, 11 aa, Artificial Sequence
  Peptide Derived from Human Papillomavirus
LTSAWDVPIYT

SEQ ID NO: 8371 - protein, 8 aa, Artificial Sequence
  Peptide Derived from Human Papillomavirus
LVEDSSVV

SEQ ID NO: 8372 - protein, 9 aa, Artificial Sequence
  Peptide Derived from Human Papillomavirus
LVEDSSVVA

SEQ ID NO: 8373 - protein, 8 aa, Artificial Sequence
  Peptide Derived from Human Papillomavirus
LVTFDNPA

SEQ ID NO: 8374 - protein, 8 aa, Artificial Sequence
  Peptide Derived from Human Papillomavirus
NASTTTYI

SEQ ID NO: 8375 - protein, 10 aa, Artificial Sequence
  Peptide Derived from Human Papillomavirus
NASTTTYIGI

SEQ ID NO: 8376 - protein, 8 aa, Artificial Sequence
  Peptide Derived from Human Papillomavirus
NIFVGTPT

SEQ ID NO: 8377 - protein, 8 aa, Artificial Sequence
  Peptide Derived from Human Papillomavirus
NQQVRVST

SEQ ID NO: 8378 - protein, 9 aa, Artificial Sequence
  Peptide Derived from Human Papillomavirus
NTVVDVGPT

SEQ ID NO: 8379 - protein, 8 aa, Artificial Sequence
  Peptide Derived from Human Papillomavirus
NVPDSDFM

SEQ ID NO: 8380 - protein, 10 aa, Artificial Sequence
  Peptide Derived from Human Papillomavirus
NVPDSDFMDI

SEQ ID NO: 8381 - protein, 11 aa, Artificial Sequence
  Peptide Derived from Human Papillomavirus
NVPDSDFMDII

SEQ ID NO: 8382 - protein, 9 aa, Artificial Sequence
  Peptide Derived from Human Papillomavirus
NVTVPLTSA

SEQ ID NO: 8383 - protein, 8 aa, Artificial Sequence
  Peptide Derived from Human Papillomavirus
PAFSDPSI

SEQ ID NO: 8384 - protein, 9 aa, Artificial Sequence
  Peptide Derived from Human Papillomavirus
PAFSDPSII

SEQ ID NO: 8385 - protein, 11 aa, Artificial Sequence
  Peptide Derived from Human Papillomavirus
PAFSDPSIIEV

SEQ ID NO: 8386 - protein, 9 aa, Artificial Sequence
  Peptide Derived from Human Papillomavirus
PALSSRRGT

SEQ ID NO: 8387 - protein, 10 aa, Artificial Sequence
  Peptide Derived from Human Papillomavirus
PALSSRRGTV

SEQ ID NO: 8388 - protein, 8 aa, Artificial Sequence
  Peptide Derived from Human Papillomavirus
PASTTPST

SEQ ID NO: 8389 - protein, 9 aa, Artificial Sequence
  Peptide Derived from Human Papillomavirus
PASTTPSTI

SEQ ID NO: 8390 - protein, 9 aa, Artificial Sequence
  Peptide Derived from Human Papillomavirus
PAVLDITPT

SEQ ID NO: 8391 - protein, 10 aa, Artificial Sequence
  Peptide Derived from Human Papillomavirus
PAVLDITPTV

SEQ ID NO: 8392 - protein, 8 aa, Artificial Sequence
  Peptide Derived from Human Papillomavirus
PAYEPLDT

SEQ ID NO: 8393 - protein, 9 aa, Artificial Sequence
  Peptide Derived from Human Papillomavirus
PAYEPLDTT

SEQ ID NO: 8394 - protein, 10 aa, Artificial Sequence
  Peptide Derived from Human Papillomavirus
PAYEPLDTTL

SEQ ID NO: 8395 - protein, 8 aa, Artificial Sequence
  Peptide Derived from Human Papillomavirus
PIAATEEI

SEQ ID NO: 8396 - protein, 10 aa, Artificial Sequence
  Peptide Derived from Human Papillomavirus
PIAATEEIEL

SEQ ID NO: 8397 - protein, 9 aa, Artificial Sequence
  Peptide Derived from Human Papillomavirus
PISSTPLPT

SEQ ID NO: 8398 - protein, 10 aa, Artificial Sequence
  Peptide Derived from Human Papillomavirus
PISSTPLPTV

SEQ ID NO: 8399 - protein, 8 aa, Artificial Sequence
  Peptide Derived from Human Papillomavirus
PIYTGPDI

SEQ ID NO: 8400 - protein, 9 aa, Artificial Sequence
  Peptide Derived from Human Papillomavirus
PIYTGPDII

SEQ ID NO: 8401 - protein, 10 aa, Artificial Sequence
  Peptide Derived from Human Papillomavirus
PIYTGPDIIL

SEQ ID NO: 8402 - protein, 11 aa, Artificial Sequence
  Peptide Derived from Human Papillomavirus
PLDTTLSFEPT

SEQ ID NO: 8403 - protein, 8 aa, Artificial Sequence
  Peptide Derived from Human Papillomavirus
PLGGRSNT

SEQ ID NO: 8404 - protein, 9 aa, Artificial Sequence
  Peptide Derived from Human Papillomavirus
PLGGRSNTV

SEQ ID NO: 8405 - protein, 10 aa, Artificial Sequence
  Peptide Derived from Human Papillomavirus
PLGGRSNTVV

SEQ ID NO: 8406 - protein, 11 aa, Artificial Sequence
  Peptide Derived from Human Papillomavirus
PLISATNDSDL

SEQ ID NO: 8407 - protein, 8 aa, Artificial Sequence
  Peptide Derived from Human Papillomavirus
PLPTVRRV

SEQ ID NO: 8408 - protein, 8 aa, Artificial Sequence
  Peptide Derived from Human Papillomavirus
PLTSAWDV

SEQ ID NO: 8409 - protein, 10 aa, Artificial Sequence
  Peptide Derived from Human Papillomavirus
PLTSAWDVPI

SEQ ID NO: 8410 - protein, 9 aa, Artificial Sequence
  Peptide Derived from Human Papillomavirus
PMWPSTSPT

SEQ ID NO: 8411 - protein, 11 aa, Artificial Sequence
  Peptide Derived from Human Papillomavirus
PMWPSTSPTNA

SEQ ID NO: 8412 - protein, 10 aa, Artificial Sequence
  Peptide Derived from Human Papillomavirus
PQTGEVSGNI

SEQ ID NO: 8413 - protein, 8 aa, Artificial Sequence
  Peptide Derived from Human Papillomavirus
PTDPSIVT

SEQ ID NO: 8414 - protein, 9 aa, Artificial Sequence
  Peptide Derived from Human Papillomavirus
PTDPSIVTL

SEQ ID NO: 8415 - protein, 10 aa, Artificial Sequence
  Peptide Derived from Human Papillomavirus
PTDPSIVTLV

SEQ ID NO: 8416 - protein, 11 aa, Artificial Sequence
  Peptide Derived from Human Papillomavirus
PTFTGTSGFEI

SEQ ID NO: 8417 - protein, 8 aa, Artificial Sequence
  Peptide Derived from Human Papillomavirus
PTNASTTT

SEQ ID NO: 8418 - protein, 10 aa, Artificial Sequence
  Peptide Derived from Human Papillomavirus
PTNASTTTYI

SEQ ID NO: 8419 - protein, 8 aa, Artificial Sequence
  Peptide Derived from Human Papillomavirus
PTRPPVVI

SEQ ID NO: 8420 - protein, 11 aa, Artificial Sequence
  Peptide Derived from Human Papillomavirus
PTRPPVVIEPV

SEQ ID NO: 8421 - protein, 11 aa, Artificial Sequence
  Peptide Derived from Human Papillomavirus
PTSGSHGYEEI

SEQ ID NO: 8422 - protein, 11 aa, Artificial Sequence
  Peptide Derived from Human Papillomavirus
PTSNVPDSDFM

SEQ ID NO: 8423 - protein, 8 aa, Artificial Sequence
  Peptide Derived from Human Papillomavirus
PTVDSVSI

SEQ ID NO: 8424 - protein, 11 aa, Artificial Sequence
  Peptide Derived from Human Papillomavirus
PTVDSVSISST

SEQ ID NO: 8425 - protein, 11 aa, Artificial Sequence
  Peptide Derived from Human Papillomavirus
PTVRRVRGPRL

SEQ ID NO: 8426 - protein, 9 aa, Artificial Sequence
  Peptide Derived from Human Papillomavirus
PVGPTDPSI

SEQ ID NO: 8427 - protein, 10 aa, Artificial Sequence
  Peptide Derived from Human Papillomavirus
PVGPTDPSIV

SEQ ID NO: 8428 - protein, 11 aa, Artificial Sequence
  Peptide Derived from Human Papillomavirus
PVGPTDPSIVT

SEQ ID NO: 8429 - protein, 8 aa, Artificial Sequence
  Peptide Derived from Human Papillomavirus
PVPTFTGT

SEQ ID NO: 8430 - protein, 10 aa, Artificial Sequence
  Peptide Derived from Human Papillomavirus
PVVIEPVGPT

SEQ ID NO: 8431 - protein, 11 aa, Artificial Sequence
  Peptide Derived from Human Papillomavirus
QQVRVSTSQFL

SEQ ID NO: 8432 - protein, 10 aa, Artificial Sequence
  Peptide Derived from Human Papillomavirus
QTFASSGSGT

SEQ ID NO: 8433 - protein, 9 aa, Artificial Sequence
  Peptide Derived from Human Papillomavirus
QTGEVSGNI

SEQ ID NO: 8434 - protein, 11 aa, Artificial Sequence
  Peptide Derived from Human Papillomavirus
QTGEVSGNIFV

SEQ ID NO: 8435 - protein, 10 aa, Artificial Sequence
  Peptide Derived from Human Papillomavirus
QVRVSTSQFL

SEQ ID NO: 8436 - protein, 11 aa, Artificial Sequence
  Peptide Derived from Human Papillomavirus
QVRVSTSQFLT

SEQ ID NO: 8437 - protein, 8 aa, Artificial Sequence
  Peptide Derived from Human Papillomavirus
RAARRKRA

SEQ ID NO: 8438 - protein, 10 aa, Artificial Sequence
  Peptide Derived from Human Papillomavirus
RAARRKRASA

SEQ ID NO: 8439 - protein, 11 aa, Artificial Sequence
  Peptide Derived from Human Papillomavirus
RAARRKRASAT

SEQ ID NO: 8440 - protein, 8 aa, Artificial Sequence
  Peptide Derived from Human Papillomavirus
RANQQVRV

SEQ ID NO: 8441 - protein, 10 aa, Artificial Sequence
  Peptide Derived from Human Papillomavirus
RANQQVRVST

SEQ ID NO: 8442 - protein, 10 aa, Artificial Sequence
  Peptide Derived from Human Papillomavirus
RASATDLYRT

SEQ ID NO: 8443 - protein, 11 aa, Artificial Sequence
  Peptide Derived from Human Papillomavirus
RIPYFFADGFV

SEQ ID NO: 8444 - protein, 8 aa, Artificial Sequence
  Peptide Derived from Human Papillomavirus
RLGQRATM

SEQ ID NO: 8445 - protein, 10 aa, Artificial Sequence
  Peptide Derived from Human Papillomavirus
RLGQRATMFT

SEQ ID NO: 8446 - protein, 10 aa, Artificial Sequence
  Peptide Derived from Human Papillomavirus
RLYSRANQQV

SEQ ID NO: 8447 - protein, 8 aa, Artificial Sequence
  Peptide Derived from Human Papillomavirus
RTCKQSGT

SEQ ID NO: 8448 - protein, 8 aa, Artificial Sequence
  Peptide Derived from Human Papillomavirus
RVHFYHDI

SEQ ID NO: 8449 - protein, 11 aa, Artificial Sequence
  Peptide Derived from Human Papillomavirus
RVHFYHDISPI

SEQ ID NO: 8450 - protein, 11 aa, Artificial Sequence
  Peptide Derived from Human Papillomavirus
RVRGPRLYSRA

SEQ ID NO: 8451 - protein, 8 aa, Artificial Sequence
  Peptide Derived from Human Papillomavirus
RVSTSQFL

SEQ ID NO: 8452 - protein, 9 aa, Artificial Sequence
  Peptide Derived from Human Papillomavirus
RVSTSQFLT

SEQ ID NO: 8453 - protein, 8 aa, Artificial Sequence
  Peptide Derived from Human Papillomavirus
SATDLYRT

SEQ ID NO: 8454 - protein, 8 aa, Artificial Sequence
  Peptide Derived from Human Papillomavirus
SATNDSDL

SEQ ID NO: 8455 - protein, 11 aa, Artificial Sequence
  Peptide Derived from Human Papillomavirus
SATNDSDLFDV

SEQ ID NO: 8456 - protein, 9 aa, Artificial Sequence
  Peptide Derived from Human Papillomavirus
SAWDVPIYT

SEQ ID NO: 8457 - protein, 8 aa, Artificial Sequence
  Peptide Derived from Human Papillomavirus
SIIEVPQT

SEQ ID NO: 8458 - protein, 11 aa, Artificial Sequence
  Peptide Derived from Human Papillomavirus
SIIEVPQTGEV

SEQ ID NO: 8459 - protein, 8 aa, Artificial Sequence
  Peptide Derived from Human Papillomavirus
SISSTSFT

SEQ ID NO: 8460 - protein, 11 aa, Artificial Sequence
  Peptide Derived from Human Papillomavirus
SISSTSFTNPA

SEQ ID NO: 8461 - protein, 11 aa, Artificial Sequence
  Peptide Derived from Human Papillomavirus
SIVTLVEDSSV

SEQ ID NO: 8462 - protein, 9 aa, Artificial Sequence
  Peptide Derived from Human Papillomavirus
SLGIFLGGL

SEQ ID NO: 8463 - protein, 11 aa, Artificial Sequence
  Peptide Derived from Human Papillomavirus
SLGIFLGGLGI

SEQ ID NO: 8464 - protein, 8 aa, Artificial Sequence
  Peptide Derived from Human Papillomavirus
SLTMPSTA

SEQ ID NO: 8465 - protein, 9 aa, Artificial Sequence
  Peptide Derived from Human Papillomavirus
SLTMPSTAA

SEQ ID NO: 8466 - protein, 9 aa, Artificial Sequence
  Peptide Derived from Human Papillomavirus
SLVTFDNPA

SEQ ID NO: 8467 - protein, 10 aa, Artificial Sequence
  Peptide Derived from Human Papillomavirus
SQFLTHPSSL

SEQ ID NO: 8468 - protein, 11 aa, Artificial Sequence
  Peptide Derived from Human Papillomavirus
SQFLTHPSSLV

SEQ ID NO: 8469 - protein, 10 aa, Artificial Sequence
  Peptide Derived from Human Papillomavirus
STAASSYSNV

SEQ ID NO: 8470 - protein, 11 aa, Artificial Sequence
  Peptide Derived from Human Papillomavirus
STAASSYSNVT

SEQ ID NO: 8471 - protein, 8 aa, Artificial Sequence
  Peptide Derived from Human Papillomavirus
STIHKSFT

SEQ ID NO: 8472 - protein, 10 aa, Artificial Sequence
  Peptide Derived from Human Papillomavirus
STPLPTVRRV

SEQ ID NO: 8473 - protein, 8 aa, Artificial Sequence
  Peptide Derived from Human Papillomavirus
STSFTNPA

SEQ ID NO: 8474 - protein, 9 aa, Artificial Sequence
  Peptide Derived from Human Papillomavirus
STSPTNAST

SEQ ID NO: 8475 - protein, 10 aa, Artificial Sequence
  Peptide Derived from Human Papillomavirus
STSPTNASTT

SEQ ID NO: 8476 - protein, 11 aa, Artificial Sequence
  Peptide Derived from Human Papillomavirus
STSPTNASTTT

SEQ ID NO: 8477 - protein, 8 aa, Artificial Sequence
  Peptide Derived from Human Papillomavirus
STTTYIGI

SEQ ID NO: 8478 - protein, 11 aa, Artificial Sequence
  Peptide Derived from Human Papillomavirus
STTTYIGIHGT

SEQ ID NO: 8479 - protein, 10 aa, Artificial Sequence
  Peptide Derived from Human Papillomavirus
SVSISSTSFT

SEQ ID NO: 8480 - protein, 9 aa, Artificial Sequence
  Peptide Derived from Human Papillomavirus
SVVASGAPV

SEQ ID NO: 8481 - protein, 11 aa, Artificial Sequence
  Peptide Derived from Human Papillomavirus
SVVASGAPVPT

SEQ ID NO: 8482 - protein, 9 aa, Artificial Sequence
  Peptide Derived from Human Papillomavirus
TAASSYSNV

SEQ ID NO: 8483 - protein, 10 aa, Artificial Sequence
  Peptide Derived from Human Papillomavirus
TAASSYSNVT

SEQ ID NO: 8484 - protein, 11 aa, Artificial Sequence
  Peptide Derived from Human Papillomavirus
TAASSYSNVTV

SEQ ID NO: 8485 - protein, 10 aa, Artificial Sequence
  Peptide Derived from Human Papillomavirus
TLSFEPTSNV

SEQ ID NO: 8486 - protein, 8 aa, Artificial Sequence
  Peptide Derived from Human Papillomavirus
TLVEDSSV

SEQ ID NO: 8487 - protein, 9 aa, Artificial Sequence
  Peptide Derived from Human Papillomavirus
TLVEDSSVV

SEQ ID NO: 8488 - protein, 10 aa, Artificial Sequence
  Peptide Derived from Human Papillomavirus
TLVEDSSVVA

SEQ ID NO: 8489 - protein, 10 aa, Artificial Sequence
  Peptide Derived from Human Papillomavirus
TMFTRSGKQI

SEQ ID NO: 8490 - protein, 8 aa, Artificial Sequence
  Peptide Derived from Human Papillomavirus
TTLADKIL

SEQ ID NO: 8491 - protein, 8 aa, Artificial Sequence
  Peptide Derived from Human Papillomavirus
TTLSFEPT

SEQ ID NO: 8492 - protein, 11 aa, Artificial Sequence
  Peptide Derived from Human Papillomavirus
TTLSFEPTSNV

SEQ ID NO: 8493 - protein, 8 aa, Artificial Sequence
  Peptide Derived from Human Papillomavirus
TTPAVLDI

SEQ ID NO: 8494 - protein, 9 aa, Artificial Sequence
  Peptide Derived from Human Papillomavirus
TTPAVLDIT

SEQ ID NO: 8495 - protein, 11 aa, Artificial Sequence
  Peptide Derived from Human Papillomavirus
TTPAVLDITPT

SEQ ID NO: 8496 - protein, 11 aa, Artificial Sequence
  Peptide Derived from Human Papillomavirus
TTPSTIHKSFT

SEQ ID NO: 8497 - protein, 9 aa, Artificial Sequence
  Peptide Derived from Human Papillomavirus
TTTPAVLDI

SEQ ID NO: 8498 - protein, 10 aa, Artificial Sequence
  Peptide Derived from Human Papillomavirus
TTTPAVLDIT

SEQ ID NO: 8499 - protein, 10 aa, Artificial Sequence
  Peptide Derived from Human Papillomavirus
TTTYIGIHGT

SEQ ID NO: 8500 - protein, 9 aa, Artificial Sequence
  Peptide Derived from Human Papillomavirus
TTYIGIHGT

SEQ ID NO: 8501 - protein, 10 aa, Artificial Sequence
  Peptide Derived from Human Papillomavirus
TVDSVSISST

SEQ ID NO: 8502 - protein, 10 aa, Artificial Sequence
  Peptide Derived from Human Papillomavirus
TVPLTSAWDV

SEQ ID NO: 8503 - protein, 11 aa, Artificial Sequence
  Peptide Derived from Human Papillomavirus
TVRFSRLGQRA

SEQ ID NO: 8504 - protein, 10 aa, Artificial Sequence
  Peptide Derived from Human Papillomavirus
TVRRVRGPRL

SEQ ID NO: 8505 - protein, 8 aa, Artificial Sequence
  Peptide Derived from Human Papillomavirus
TVVDVGPT

SEQ ID NO: 8506 - protein, 9 aa, Artificial Sequence
  Peptide Derived from Human Papillomavirus
VASGAPVPT

SEQ ID NO: 8507 - protein, 11 aa, Artificial Sequence
  Peptide Derived from Human Papillomavirus
VASGAPVPTFT

SEQ ID NO: 8508 - protein, 8 aa, Artificial Sequence
  Peptide Derived from Human Papillomavirus
VIEPVGPT

SEQ ID NO: 8509 - protein, 8 aa, Artificial Sequence
  Peptide Derived from Human Papillomavirus
VINKVEGT

SEQ ID NO: 8510 - protein, 9 aa, Artificial Sequence
  Peptide Derived from Human Papillomavirus
VINKVEGTT

SEQ ID NO: 8511 - protein, 10 aa, Artificial Sequence
  Peptide Derived from Human Papillomavirus
VINKVEGTTL

SEQ ID NO: 8512 - protein, 11 aa, Artificial Sequence
  Peptide Derived from Human Papillomavirus
VINKVEGTTLA

SEQ ID NO: 8513 - protein, 8 aa, Artificial Sequence
  Peptide Derived from Human Papillomavirus
VLDITPTV

SEQ ID NO: 8514 - protein, 11 aa, Artificial Sequence
  Peptide Derived from Human Papillomavirus
VLDITPTVDSV

SEQ ID NO: 8515 - protein, 11 aa, Artificial Sequence
  Peptide Derived from Human Papillomavirus
VTFDNPAYEPL

SEQ ID NO: 8516 - protein, 9 aa, Artificial Sequence
  Peptide Derived from Human Papillomavirus
VTLVEDSSV

SEQ ID NO: 8517 - protein, 10 aa, Artificial Sequence
  Peptide Derived from Human Papillomavirus
VTLVEDSSVV

SEQ ID NO: 8518 - protein, 11 aa, Artificial Sequence
  Peptide Derived from Human Papillomavirus
VTLVEDSSVVA

SEQ ID NO: 8519 - protein, 8 aa, Artificial Sequence
  Peptide Derived from Human Papillomavirus
VTVPLTSA

SEQ ID NO: 8520 - protein, 11 aa, Artificial Sequence
  Peptide Derived from Human Papillomavirus
VTVPLTSAWDV

SEQ ID NO: 8521 - protein, 8 aa, Artificial Sequence
  Peptide Derived from Human Papillomavirus
VVASGAPV

SEQ ID NO: 8522 - protein, 10 aa, Artificial Sequence
  Peptide Derived from Human Papillomavirus
VVASGAPVPT

SEQ ID NO: 8523 - protein, 11 aa, Artificial Sequence
  Peptide Derived from Human Papillomavirus
VVDVGPTRPPV

SEQ ID NO: 8524 - protein, 9 aa, Artificial Sequence
  Peptide Derived from Human Papillomavirus
VVIEPVGPT

SEQ ID NO: 8525 - protein, 8 aa, Artificial Sequence
  Peptide Derived from Human Papillomavirus
YADFPPPA

SEQ ID NO: 8526 - protein, 10 aa, Artificial Sequence
  Peptide Derived from Human Papillomavirus
YADFPPPAST

SEQ ID NO: 8527 - protein, 11 aa, Artificial Sequence
  Peptide Derived from Human Papillomavirus
YADFPPPASTT

SEQ ID NO: 8528 - protein, 11 aa, Artificial Sequence
  Peptide Derived from Human Papillomavirus
YIGIHGTQYYL

SEQ ID NO: 8529 - protein, 8 aa, Artificial Sequence
  Peptide Derived from Human Papillomavirus
YTGPDIIL

SEQ ID NO: 8530 - protein, 10 aa, Artificial Sequence
  Peptide Derived from Human Papillomavirus
YVPLGGRSNT

SEQ ID NO: 8531 - protein, 11 aa, Artificial Sequence
  Peptide Derived from Human Papillomavirus
YVPLGGRSNTV

SEQ ID NO: 8532 - protein, 8 aa, Artificial Sequence
  Peptide Derived from Human Papillomavirus
AIEVQIAL

SEQ ID NO: 8533 - protein, 11 aa, Artificial Sequence
  Peptide Derived from Human Papillomavirus
AIEVQIALESL

SEQ ID NO: 8534 - protein, 8 aa, Artificial Sequence
  Peptide Derived from Human Papillomavirus
ALESLSTT

SEQ ID NO: 8535 - protein, 9 aa, Artificial Sequence
  Peptide Derived from Human Papillomavirus
ALESLSTTI

SEQ ID NO: 8536 - protein, 9 aa, Artificial Sequence
  Peptide Derived from Human Papillomavirus
CLQVCKAKA

SEQ ID NO: 8537 - protein, 10 aa, Artificial Sequence
  Peptide Derived from Human Papillomavirus
CMQYVAWKYI

SEQ ID NO: 8538 - protein, 8 aa, Artificial Sequence
  Peptide Derived from Human Papillomavirus
CVTTHTHI

SEQ ID NO: 8539 - protein, 11 aa, Artificial Sequence
  Peptide Derived from Human Papillomavirus
CVTTHTHISDT

SEQ ID NO: 8540 - protein, 8 aa, Artificial Sequence
  Peptide Derived from Human Papillomavirus
DTCEELWL

SEQ ID NO: 8541 - protein, 9 aa, Artificial Sequence
  Peptide Derived from Human Papillomavirus
DTCEELWLT

SEQ ID NO: 8542 - protein, 9 aa, Artificial Sequence
  Peptide Derived from Human Papillomavirus
DVTSTYHWT

SEQ ID NO: 8543 - protein, 11 aa, Artificial Sequence
  Peptide Derived from Human Papillomavirus
DVTSTYHWTST

SEQ ID NO: 8544 - protein, 10 aa, Artificial Sequence
  Peptide Derived from Human Papillomavirus
EAKKFGCKNI

SEQ ID NO: 8545 - protein, 8 aa, Artificial Sequence
  Peptide Derived from Human Papillomavirus
ETQRNSFL

SEQ ID NO: 8546 - protein, 11 aa, Artificial Sequence
  Peptide Derived from Human Papillomavirus
ETQRNSFLSHV

SEQ ID NO: 8547 - protein, 8 aa, Artificial Sequence
  Peptide Derived from Human Papillomavirus
ETVNEYNT

SEQ ID NO: 8548 - protein, 11 aa, Artificial Sequence
  Peptide Derived from Human Papillomavirus
ETVNEYNTHKT

SEQ ID NO: 8549 - protein, 9 aa, Artificial Sequence
  Peptide Derived from Human Papillomavirus
EVHMENESI

SEQ ID NO: 8550 - protein, 9 aa, Artificial Sequence
  Peptide Derived from Human Papillomavirus
EVQIALESL

SEQ ID NO: 8551 - protein, 11 aa, Artificial Sequence
  Peptide Derived from Human Papillomavirus
EVQIALESLST

SEQ ID NO: 8552 - protein, 9 aa, Artificial Sequence
  Peptide Derived from Human Papillomavirus
FLSHVKIPV

SEQ ID NO: 8553 - protein, 10 aa, Artificial Sequence
  Peptide Derived from Human Papillomavirus
FLSHVKIPVV

SEQ ID NO: 8554 - protein, 9 aa, Artificial Sequence
  Peptide Derived from Human Papillomavirus
FQKYKTLFV

SEQ ID NO: 8555 - protein, 11 aa, Artificial Sequence
  Peptide Derived from Human Papillomavirus
FQKYKTLFVDV

SEQ ID NO: 8556 - protein, 11 aa, Artificial Sequence
  Peptide Derived from Human Papillomavirus
FVDVTSTYHWT

SEQ ID NO: 8557 - protein, 11 aa, Artificial Sequence
  Peptide Derived from Human Papillomavirus
GIYYVHDGHKT

SEQ ID NO: 8558 - protein, 10 aa, Artificial Sequence
  Peptide Derived from Human Papillomavirus
GVDYRGIYYV

SEQ ID NO: 8559 - protein, 9 aa, Artificial Sequence
  Peptide Derived from Human Papillomavirus
HAKCVTTHT

SEQ ID NO: 8560 - protein, 11 aa, Artificial Sequence
  Peptide Derived from Human Papillomavirus
HAKCVTTHTHI

SEQ ID NO: 8561 - protein, 8 aa, Artificial Sequence
  Peptide Derived from Human Papillomavirus
HISDTDNT

SEQ ID NO: 8562 - protein, 9 aa, Artificial Sequence
  Peptide Derived from Human Papillomavirus
HLKGEPNRL

SEQ ID NO: 8563 - protein, 10 aa, Artificial Sequence
  Peptide Derived from Human Papillomavirus
HTHISDTDNT

SEQ ID NO: 8564 - protein, 10 aa, Artificial Sequence
  Peptide Derived from Human Papillomavirus
HVKIPVVYRL

SEQ ID NO: 8565 - protein, 11 aa, Artificial Sequence
  Peptide Derived from Human Papillomavirus
HVKIPVVYRLV

SEQ ID NO: 8566 - protein, 8 aa, Artificial Sequence
  Peptide Derived from Human Papillomavirus
IALESLST

SEQ ID NO: 8567 - protein, 9 aa, Artificial Sequence
  Peptide Derived from Human Papillomavirus
IALESLSTT

SEQ ID NO: 8568 - protein, 10 aa, Artificial Sequence
  Peptide Derived from Human Papillomavirus
IALESLSTTI

SEQ ID NO: 8569 - protein, 10 aa, Artificial Sequence
  Peptide Derived from Human Papillomavirus
IITIIYKDET

SEQ ID NO: 8570 - protein, 9 aa, Artificial Sequence
  Peptide Derived from Human Papillomavirus
ITIIYKDET

SEQ ID NO: 8571 - protein, 8 aa, Artificial Sequence
  Peptide Derived from Human Papillomavirus
KACSAIEV

SEQ ID NO: 8572 - protein, 10 aa, Artificial Sequence
  Peptide Derived from Human Papillomavirus
KACSAIEVQI

SEQ ID NO: 8573 - protein, 11 aa, Artificial Sequence
  Peptide Derived from Human Papillomavirus
KACSAIEVQIA

SEQ ID NO: 8574 - protein, 8 aa, Artificial Sequence
  Peptide Derived from Human Papillomavirus
KAKACSAI

SEQ ID NO: 8575 - protein, 10 aa, Artificial Sequence
  Peptide Derived from Human Papillomavirus
KAKACSAIEV

SEQ ID NO: 8576 - protein, 8 aa, Artificial Sequence
  Peptide Derived from Human Papillomavirus
KIPVVYRL

SEQ ID NO: 8577 - protein, 9 aa, Artificial Sequence
  Peptide Derived from Human Papillomavirus
KIPVVYRLV

SEQ ID NO: 8578 - protein, 8 aa, Artificial Sequence
  Peptide Derived from Human Papillomavirus
KTLFVDVT

SEQ ID NO: 8579 - protein, 10 aa, Artificial Sequence
  Peptide Derived from Human Papillomavirus
KTLFVDVTST

SEQ ID NO: 8580 - protein, 8 aa, Artificial Sequence
  Peptide Derived from Human Papillomavirus
KTTPVVHL

SEQ ID NO: 8581 - protein, 8 aa, Artificial Sequence
  Peptide Derived from Human Papillomavirus
KTTTTTST

SEQ ID NO: 8582 - protein, 10 aa, Artificial Sequence
  Peptide Derived from Human Papillomavirus
KTTTTTSTSV

SEQ ID NO: 8583 - protein, 11 aa, Artificial Sequence
  Peptide Derived from Human Papillomavirus
KTYYTDFEQEA

SEQ ID NO: 8584 - protein, 11 aa, Artificial Sequence
  Peptide Derived from Human Papillomavirus
KVCSGVDYRGI

SEQ ID NO: 8585 - protein, 8 aa, Artificial Sequence
  Peptide Derived from Human Papillomavirus
LQVCKAKA

SEQ ID NO: 8586 - protein, 11 aa, Artificial Sequence
  Peptide Derived from Human Papillomavirus
LQVCKAKACSA

SEQ ID NO: 8587 - protein, 9 aa, Artificial Sequence
  Peptide Derived from Human Papillomavirus
MQYVAWKYI

SEQ ID NO: 8588 - protein, 10 aa, Artificial Sequence
  Peptide Derived from Human Papillomavirus
MVPCLQVCKA

SEQ ID NO: 8589 - protein, 9 aa, Artificial Sequence
  Peptide Derived from Human Papillomavirus
NTDSRSRSI

SEQ ID NO: 8590 - protein, 8 aa, Artificial Sequence
  Peptide Derived from Human Papillomavirus
NTHKTTTT

SEQ ID NO: 8591 - protein, 9 aa, Artificial Sequence
  Peptide Derived from Human Papillomavirus
NTHKTTTTT

SEQ ID NO: 8592 - protein, 11 aa, Artificial Sequence
  Peptide Derived from Human Papillomavirus
NTHKTTTTTST

SEQ ID NO: 8593 - protein, 8 aa, Artificial Sequence
  Peptide Derived from Human Papillomavirus
NVSPVETV

SEQ ID NO: 8594 - protein, 10 aa, Artificial Sequence
  Peptide Derived from Human Papillomavirus
PVETVNEYNT

SEQ ID NO: 8595 - protein, 9 aa, Artificial Sequence
  Peptide Derived from Human Papillomavirus
QIALESLST

SEQ ID NO: 8596 - protein, 10 aa, Artificial Sequence
  Peptide Derived from Human Papillomavirus
QIALESLSTT

SEQ ID NO: 8597 - protein, 11 aa, Artificial Sequence
  Peptide Derived from Human Papillomavirus
QIALESLSTTI

SEQ ID NO: 8598 - protein, 10 aa, Artificial Sequence
  Peptide Derived from Human Papillomavirus
QVCKAKACSA

SEQ ID NO: 8599 - protein, 11 aa, Artificial Sequence
  Peptide Derived from Human Papillomavirus
QVCKAKACSAI

SEQ ID NO: 8600 - protein, 8 aa, Artificial Sequence
  Peptide Derived from Human Papillomavirus
SAIEVQIA

SEQ ID NO: 8601 - protein, 9 aa, Artificial Sequence
  Peptide Derived from Human Papillomavirus
SAIEVQIAL

SEQ ID NO: 8602 - protein, 11 aa, Artificial Sequence
  Peptide Derived from Human Papillomavirus
SIITIIYKDET

SEQ ID NO: 8603 - protein, 8 aa, Artificial Sequence
  Peptide Derived from Human Papillomavirus
SIYCPDSV

SEQ ID NO: 8604 - protein, 11 aa, Artificial Sequence
  Peptide Derived from Human Papillomavirus
SIYCPDSVSST

SEQ ID NO: 8605 - protein, 10 aa, Artificial Sequence
  Peptide Derived from Human Papillomavirus
STCRYNVSPV

SEQ ID NO: 8606 - protein, 9 aa, Artificial Sequence
  Peptide Derived from Human Papillomavirus
STDNKNYSI

SEQ ID NO: 8607 - protein, 10 aa, Artificial Sequence
  Peptide Derived from Human Papillomavirus
STDNKNYSII

SEQ ID NO: 8608 - protein, 11 aa, Artificial Sequence
  Peptide Derived from Human Papillomavirus
STDNKNYSIIT

SEQ ID NO: 8609 - protein, 9 aa, Artificial Sequence
  Peptide Derived from Human Papillomavirus
STSVGNQDA

SEQ ID NO: 8610 - protein, 10 aa, Artificial Sequence
  Peptide Derived from Human Papillomavirus
STSVGNQDAA

SEQ ID NO: 8611 - protein, 11 aa, Artificial Sequence
  Peptide Derived from Human Papillomavirus
STSVGNQDAAV

SEQ ID NO: 8612 - protein, 11 aa, Artificial Sequence
  Peptide Derived from Human Papillomavirus
STTIYNNEEWT

SEQ ID NO: 8613 - protein, 8 aa, Artificial Sequence
  Peptide Derived from Human Papillomavirus
STYHWTST

SEQ ID NO: 8614 - protein, 8 aa, Artificial Sequence
  Peptide Derived from Human Papillomavirus
SVGNQDAA

SEQ ID NO: 8615 - protein, 9 aa, Artificial Sequence
  Peptide Derived from Human Papillomavirus
SVGNQDAAV

SEQ ID NO: 8616 - protein, 10 aa, Artificial Sequence
  Peptide Derived from Human Papillomavirus
SVSSTCRYNV

SEQ ID NO: 8617 - protein, 8 aa, Artificial Sequence
  Peptide Derived from Human Papillomavirus
TIIYKDET

SEQ ID NO: 8618 - protein, 9 aa, Artificial Sequence
  Peptide Derived from Human Papillomavirus
TIYNNEEWT

SEQ ID NO: 8619 - protein, 10 aa, Artificial Sequence
  Peptide Derived from Human Papillomavirus
TIYNNEEWTL

SEQ ID NO: 8620 - protein, 9 aa, Artificial Sequence
  Peptide Derived from Human Papillomavirus
TLFVDVTST

SEQ ID NO: 8621 - protein, 9 aa, Artificial Sequence
  Peptide Derived from Human Papillomavirus
TLRDTCEEL

SEQ ID NO: 8622 - protein, 11 aa, Artificial Sequence
  Peptide Derived from Human Papillomavirus
TLRDTCEELWL

SEQ ID NO: 8623 - protein, 10 aa, Artificial Sequence
  Peptide Derived from Human Papillomavirus
TQRNSFLSHV

SEQ ID NO: 8624 - protein, 9 aa, Artificial Sequence
  Peptide Derived from Human Papillomavirus
TTHTHISDT

SEQ ID NO: 8625 - protein, 10 aa, Artificial Sequence
  Peptide Derived from Human Papillomavirus
TTIYNNEEWT

SEQ ID NO: 8626 - protein, 11 aa, Artificial Sequence
  Peptide Derived from Human Papillomavirus
TTIYNNEEWTL

SEQ ID NO: 8627 - protein, 11 aa, Artificial Sequence
  Peptide Derived from Human Papillomavirus
TTSTSVGNQDA

SEQ ID NO: 8628 - protein, 8 aa, Artificial Sequence
  Peptide Derived from Human Papillomavirus
TTTTSTSV

SEQ ID NO: 8629 - protein, 9 aa, Artificial Sequence
  Peptide Derived from Human Papillomavirus
TTTTTSTSV

SEQ ID NO: 8630 - protein, 10 aa, Artificial Sequence
  Peptide Derived from Human Papillomavirus
TVNEYNTHKT

SEQ ID NO: 8631 - protein, 11 aa, Artificial Sequence
  Peptide Derived from Human Papillomavirus
TVNEYNTHKTT

SEQ ID NO: 8632 - protein, 8 aa, Artificial Sequence
  Peptide Derived from Human Papillomavirus
VQIALESL

SEQ ID NO: 8633 - protein, 10 aa, Artificial Sequence
  Peptide Derived from Human Papillomavirus
VQIALESLST

SEQ ID NO: 8634 - protein, 11 aa, Artificial Sequence
  Peptide Derived from Human Papillomavirus
VQIALESLSTT

SEQ ID NO: 8635 - protein, 8 aa, Artificial Sequence
  Peptide Derived from Human Papillomavirus
VTSTYHWT

SEQ ID NO: 8636 - protein, 10 aa, Artificial Sequence
  Peptide Derived from Human Papillomavirus
VTSTYHWTST

SEQ ID NO: 8637 - protein, 10 aa, Artificial Sequence
  Peptide Derived from Human Papillomavirus
VTTHTHISDT

SEQ ID NO: 8638 - protein, 11 aa, Artificial Sequence
  Peptide Derived from Human Papillomavirus
VVHLKGEPNRL

SEQ ID NO: 8639 - protein, 8 aa, Artificial Sequence
  Peptide Derived from Human Papillomavirus
WQKVCSGV

SEQ ID NO: 8640 - protein, 10 aa, Artificial Sequence
  Peptide Derived from Human Papillomavirus
WTLRDTCEEL

SEQ ID NO: 8641 - protein, 11 aa, Artificial Sequence
  Peptide Derived from Human Papillomavirus
WTSTDNKNYSI

SEQ ID NO: 8642 - protein, 8 aa, Artificial Sequence
  Peptide Derived from Human Papillomavirus
YTDFEQEA

SEQ ID NO: 8643 - protein, 8 aa, Artificial Sequence
  Peptide Derived from Human Papillomavirus
YVHDGHKT

SEQ ID NO: 8644 - protein, 11 aa, Artificial Sequence
  Peptide Derived from Human Papillomavirus
YVHDGHKTYYT

SEQ ID NO: 8645 - protein, 11 aa, Artificial Sequence
  Peptide Derived from Human Papillomavirus
ATLESITKKQL

SEQ ID NO: 8646 - protein, 8 aa, Artificial Sequence
  Peptide Derived from Human Papillomavirus
AVCRVCLL

SEQ ID NO: 8647 - protein, 8 aa, Artificial Sequence
  Peptide Derived from Human Papillomavirus
CLGCWRQT

SEQ ID NO: 8648 - protein, 8 aa, Artificial Sequence
  Peptide Derived from Human Papillomavirus
CLLFYSKV

SEQ ID NO: 8649 - protein, 8 aa, Artificial Sequence
  Peptide Derived from Human Papillomavirus
CVYCKKEL

SEQ ID NO: 8650 - protein, 9 aa, Artificial Sequence
  Peptide Derived from Human Papillomavirus
CVYCKKELT

SEQ ID NO: 8651 - protein, 11 aa, Artificial Sequence
  Peptide Derived from Human Papillomavirus
CVYCKKELTRA

SEQ ID NO: 8652 - protein, 9 aa, Artificial Sequence
  Peptide Derived from Human Papillomavirus
EIPLIDLRL

SEQ ID NO: 8653 - protein, 11 aa, Artificial Sequence
  Peptide Derived from Human Papillomavirus
ELTRAEVYNFA

SEQ ID NO: 8654 - protein, 8 aa, Artificial Sequence
  Peptide Derived from Human Papillomavirus
EVLEIPLI

SEQ ID NO: 8655 - protein, 10 aa, Artificial Sequence
  Peptide Derived from Human Papillomavirus
EVLEIPLIDL

SEQ ID NO: 8656 - protein, 8 aa, Artificial Sequence
  Peptide Derived from Human Papillomavirus
EVYNFACT

SEQ ID NO: 8657 - protein, 10 aa, Artificial Sequence
  Peptide Derived from Human Papillomavirus
EVYNFACTEL

SEQ ID NO: 8658 - protein, 8 aa, Artificial Sequence
  Peptide Derived from Human Papillomavirus
FACTELKL

SEQ ID NO: 8659 - protein, 9 aa, Artificial Sequence
  Peptide Derived from Human Papillomavirus
FACTELKLV

SEQ ID NO: 8660 - protein, 8 aa, Artificial Sequence
  Peptide Derived from Human Papillomavirus
GATLESIT

SEQ ID NO: 8661 - protein, 8 aa, Artificial Sequence
  Peptide Derived from Human Papillomavirus
HLIAHGWT

SEQ ID NO: 8662 - protein, 8 aa, Artificial Sequence
  Peptide Derived from Human Papillomavirus
HLSEVLEI

SEQ ID NO: 8663 - protein, 10 aa, Artificial Sequence
  Peptide Derived from Human Papillomavirus
HLSEVLEIPL

SEQ ID NO: 8664 - protein, 11 aa, Artificial Sequence
  Peptide Derived from Human Papillomavirus
HLSEVLEIPLI

SEQ ID NO: 8665 - protein, 10 aa, Artificial Sequence
  Peptide Derived from Human Papillomavirus
IAHGWTGSCL

SEQ ID NO: 8666 - protein, 9 aa, Artificial Sequence
  Peptide Derived from Human Papillomavirus
ITKKQLCDL

SEQ ID NO: 8667 - protein, 10 aa, Artificial Sequence
  Peptide Derived from Human Papillomavirus
ITKKQLCDLL

SEQ ID NO: 8668 - protein, 11 aa, Artificial Sequence
  Peptide Derived from Human Papillomavirus
ITKKQLCDLLI

SEQ ID NO: 8669 - protein, 11 aa, Artificial Sequence
  Peptide Derived from Human Papillomavirus
KLVYRDDFPYA

SEQ ID NO: 8670 - protein, 8 aa, Artificial Sequence
  Peptide Derived from Human Papillomavirus
KQLCDLLI

SEQ ID NO: 8671 - protein, 11 aa, Artificial Sequence
  Peptide Derived from Human Papillomavirus
LIAHGWTGSCL

SEQ ID NO: 8672 - protein, 9 aa, Artificial Sequence
  Peptide Derived from Human Papillomavirus
LIDLRLSCV

SEQ ID NO: 8673 - protein, 11 aa, Artificial Sequence
  Peptide Derived from Human Papillomavirus
LIRCYRCQSPL

SEQ ID NO: 8674 - protein, 8 aa, Artificial Sequence
  Peptide Derived from Human Papillomavirus
LTPEEKQL

SEQ ID NO: 8675 - protein, 10 aa, Artificial Sequence
  Peptide Derived from Human Papillomavirus
LTRAEVYNFA

SEQ ID NO: 8676 - protein, 10 aa, Artificial Sequence
  Peptide Derived from Human Papillomavirus
LVYRDDFPYA

SEQ ID NO: 8677 - protein, 11 aa, Artificial Sequence
  Peptide Derived from Human Papillomavirus
LVYRDDFPYAV

SEQ ID NO: 8678 - protein, 10 aa, Artificial Sequence
  Peptide Derived from Human Papillomavirus
PLIDLRLSCV

SEQ ID NO: 8679 - protein, 9 aa, Artificial Sequence
  Peptide Derived from Human Papillomavirus
PLTPEEKQL

SEQ ID NO: 8680 - protein, 8 aa, Artificial Sequence
  Peptide Derived from Human Papillomavirus
PQERPRSL

SEQ ID NO: 8681 - protein, 11 aa, Artificial Sequence
  Peptide Derived from Human Papillomavirus
PQERPRSLHHL

SEQ ID NO: 8682 - protein, 10 aa, Artificial Sequence
  Peptide Derived from Human Papillomavirus
QTSREPREST

SEQ ID NO: 8683 - protein, 11 aa, Artificial Sequence
  Peptide Derived from Human Papillomavirus
QTSREPRESTV

SEQ ID NO: 8684 - protein, 8 aa, Artificial Sequence
  Peptide Derived from Human Papillomavirus
RAEVYNFA

SEQ ID NO: 8685 - protein, 10 aa, Artificial Sequence
  Peptide Derived from Human Papillomavirus
RAEVYNFACT

SEQ ID NO: 8686 - protein, 11 aa, Artificial Sequence
  Peptide Derived from Human Papillomavirus
RLSCVYCKKEL

SEQ ID NO: 8687 - protein, 11 aa, Artificial Sequence
  Peptide Derived from Human Papillomavirus
RQTSREPREST

SEQ ID NO: 8688 - protein, 10 aa, Artificial Sequence
  Peptide Derived from Human Papillomavirus
RVCLLFYSKV

SEQ ID NO: 8689 - protein, 10 aa, Artificial Sequence
  Peptide Derived from Human Papillomavirus
SITKKQLCDL

SEQ ID NO: 8690 - protein, 11 aa, Artificial Sequence
  Peptide Derived from Human Papillomavirus
SITKKQLCDLL

SEQ ID NO: 8691 - protein, 8 aa, Artificial Sequence
  Peptide Derived from Human Papillomavirus
SLHHLSEV

SEQ ID NO: 8692 - protein, 9 aa, Artificial Sequence
  Peptide Derived from Human Papillomavirus
SLHHLSEVL

SEQ ID NO: 8693 - protein, 11 aa, Artificial Sequence
  Peptide Derived from Human Papillomavirus
SLHHLSEVLEI

SEQ ID NO: 8694 - protein, 10 aa, Artificial Sequence
  Peptide Derived from Human Papillomavirus
SVYGATLESI

SEQ ID NO: 8695 - protein, 11 aa, Artificial Sequence
  Peptide Derived from Human Papillomavirus
SVYGATLESIT

SEQ ID NO: 8696 - protein, 10 aa, Artificial Sequence
  Peptide Derived from Human Papillomavirus
TLESITKKQL

SEQ ID NO: 8697 - protein, 9 aa, Artificial Sequence
  Peptide Derived from Human Papillomavirus
VLEIPLIDL

SEQ ID NO: 8698 - protein, 11 aa, Artificial Sequence
  Peptide Derived from Human Papillomavirus
VLEIPLIDLRL

SEQ ID NO: 8699 - protein, 8 aa, Artificial Sequence
  Peptide Derived from Human Papillomavirus
YAVCRVCL

SEQ ID NO: 8700 - protein, 9 aa, Artificial Sequence
  Peptide Derived from Human Papillomavirus
YAVCRVCLL

SEQ ID NO: 8701 - protein, 8 aa, Artificial Sequence
  Peptide Derived from Human Papillomavirus
ALTVTCPL

SEQ ID NO: 8702 - protein, 10 aa, Artificial Sequence
  Peptide Derived from Human Papillomavirus
ALTVTCPLCA

SEQ ID NO: 8703 - protein, 9 aa, Artificial Sequence
  Peptide Derived from Human Papillomavirus
DIQSTKEDL

SEQ ID NO: 8704 - protein, 11 aa, Artificial Sequence
  Peptide Derived from Human Papillomavirus
DIQSTKEDLRV

SEQ ID NO: 8705 - protein, 8 aa, Artificial Sequence
  Peptide Derived from Human Papillomavirus
DLQCNEQL

SEQ ID NO: 8706 - protein, 8 aa, Artificial Sequence
  Peptide Derived from Human Papillomavirus
DLRVVQQL

SEQ ID NO: 8707 - protein, 9 aa, Artificial Sequence
  Peptide Derived from Human Papillomavirus
DLRVVQQLL

SEQ ID NO: 8708 - protein, 10 aa, Artificial Sequence
  Peptide Derived from Human Papillomavirus
DLRVVQQLLM

SEQ ID NO: 8709 - protein, 10 aa, Artificial Sequence
  Peptide Derived from Human Papillomavirus
DVVLELTPQT

SEQ ID NO: 8710 - protein, 10 aa, Artificial Sequence
  Peptide Derived from Human Papillomavirus
EIDLQCNEQL

SEQ ID NO: 8711 - protein, 8 aa, Artificial Sequence
  Peptide Derived from Human Papillomavirus
ELTPQTEI

SEQ ID NO: 8712 - protein, 10 aa, Artificial Sequence
  Peptide Derived from Human Papillomavirus
ELTPQTEIDL

SEQ ID NO: 8713 - protein, 10 aa, Artificial Sequence
  Peptide Derived from Human Papillomavirus
FVVQLDIQST

SEQ ID NO: 8714 - protein, 9 aa, Artificial Sequence
  Peptide Derived from Human Papillomavirus
GALTVTCPL

SEQ ID NO: 8715 - protein, 11 aa, Artificial Sequence
  Peptide Derived from Human Papillomavirus
GALTVTCPLCA

SEQ ID NO: 8716 - protein, 9 aa, Artificial Sequence
  Peptide Derived from Human Papillomavirus
HLQERPQQA

SEQ ID NO: 8717 - protein, 8 aa, Artificial Sequence
  Peptide Derived from Human Papillomavirus
HTCYLIHV

SEQ ID NO: 8718 - protein, 10 aa, Artificial Sequence
  Peptide Derived from Human Papillomavirus
HVPCCECKFV

SEQ ID NO: 8719 - protein, 11 aa, Artificial Sequence
  Peptide Derived from Human Papillomavirus
HVPCCECKFVV

SEQ ID NO: 8720 - protein, 8 aa, Artificial Sequence
  Peptide Derived from Human Papillomavirus
IQSTKEDL

SEQ ID NO: 8721 - protein, 10 aa, Artificial Sequence
  Peptide Derived from Human Papillomavirus
IQSTKEDLRV

SEQ ID NO: 8722 - protein, 11 aa, Artificial Sequence
  Peptide Derived from Human Papillomavirus
IQSTKEDLRVV

SEQ ID NO: 8723 - protein, 8 aa, Artificial Sequence
  Peptide Derived from Human Papillomavirus
KQHTCYLI

SEQ ID NO: 8724 - protein, 10 aa, Artificial Sequence
  Peptide Derived from Human Papillomavirus
KQHTCYLIHV

SEQ ID NO: 8725 - protein, 8 aa, Artificial Sequence
  Peptide Derived from Human Papillomavirus
KVPTLQDV

SEQ ID NO: 8726 - protein, 9 aa, Artificial Sequence
  Peptide Derived from Human Papillomavirus
KVPTLQDVV

SEQ ID NO: 8727 - protein, 10 aa, Artificial Sequence
  Peptide Derived from Human Papillomavirus
KVPTLQDVVL

SEQ ID NO: 8728 - protein, 8 aa, Artificial Sequence
  Peptide Derived from Human Papillomavirus
LLMGALTV

SEQ ID NO: 8729 - protein, 9 aa, Artificial Sequence
  Peptide Derived from Human Papillomavirus
LLMGALTVT

SEQ ID NO: 8730 - protein, 8 aa, Artificial Sequence
  Peptide Derived from Human Papillomavirus
LMGALTVT

SEQ ID NO: 8731 - protein, 11 aa, Artificial Sequence
  Peptide Derived from Human Papillomavirus
LMGALTVTCPL

SEQ ID NO: 8732 - protein, 8 aa, Artificial Sequence
  Peptide Derived from Human Papillomavirus
LQDVVLEL

SEQ ID NO: 8733 - protein, 9 aa, Artificial Sequence
  Peptide Derived from Human Papillomavirus
LQDVVLELT

SEQ ID NO: 8734 - protein, 8 aa, Artificial Sequence
  Peptide Derived from Human Papillomavirus
LQERPQQA

SEQ ID NO: 8735 - protein, 11 aa, Artificial Sequence
  Peptide Derived from Human Papillomavirus
LQERPQQARQA

SEQ ID NO: 8736 - protein, 9 aa, Artificial Sequence
  Peptide Derived from Human Papillomavirus
LTPQTEIDL

SEQ ID NO: 8737 - protein, 9 aa, Artificial Sequence
  Peptide Derived from Human Papillomavirus
LTVTCPLCA

SEQ ID NO: 8738 - protein, 11 aa, Artificial Sequence
  Peptide Derived from Human Papillomavirus
PQQARQAKQHT

SEQ ID NO: 8739 - protein, 8 aa, Artificial Sequence
  Peptide Derived from Human Papillomavirus
PTLQDVVL

SEQ ID NO: 8740 - protein, 10 aa, Artificial Sequence
  Peptide Derived from Human Papillomavirus
PTLQDVVLEL

SEQ ID NO: 8741 - protein, 11 aa, Artificial Sequence
  Peptide Derived from Human Papillomavirus
PTLQDVVLELT

SEQ ID NO: 8742 - protein, 9 aa, Artificial Sequence
  Peptide Derived from Human Papillomavirus
QAKQHTCYL

SEQ ID NO: 8743 - protein, 10 aa, Artificial Sequence
  Peptide Derived from Human Papillomavirus
QAKQHTCYLI

SEQ ID NO: 8744 - protein, 9 aa, Artificial Sequence
  Peptide Derived from Human Papillomavirus
QARQAKQHT

SEQ ID NO: 8745 - protein, 11 aa, Artificial Sequence
  Peptide Derived from Human Papillomavirus
QLDIQSTKEDL

SEQ ID NO: 8746 - protein, 8 aa, Artificial Sequence
  Peptide Derived from Human Papillomavirus
QLLMGALT

SEQ ID NO: 8747 - protein, 9 aa, Artificial Sequence
  Peptide Derived from Human Papillomavirus
QLLMGALTV

SEQ ID NO: 8748 - protein, 10 aa, Artificial Sequence
  Peptide Derived from Human Papillomavirus
QLLMGALTVT

SEQ ID NO: 8749 - protein, 10 aa, Artificial Sequence
  Peptide Derived from Human Papillomavirus
QQARQAKQHT

SEQ ID NO: 8750 - protein, 8 aa, Artificial Sequence
  Peptide Derived from Human Papillomavirus
QQLLMGAL

SEQ ID NO: 8751 - protein, 9 aa, Artificial Sequence
  Peptide Derived from Human Papillomavirus
QQLLMGALT

SEQ ID NO: 8752 - protein, 10 aa, Artificial Sequence
  Peptide Derived from Human Papillomavirus
QQLLMGALTV

SEQ ID NO: 8753 - protein, 11 aa, Artificial Sequence
  Peptide Derived from Human Papillomavirus
QQLLMGALTVT

SEQ ID NO: 8754 - protein, 10 aa, Artificial Sequence
  Peptide Derived from Human Papillomavirus
RQAKQHTCYL

SEQ ID NO: 8755 - protein, 11 aa, Artificial Sequence
  Peptide Derived from Human Papillomavirus
RQAKQHTCYLI

SEQ ID NO: 8756 - protein, 8 aa, Artificial Sequence
  Peptide Derived from Human Papillomavirus
RVVQQLLM

SEQ ID NO: 8757 - protein, 10 aa, Artificial Sequence
  Peptide Derived from Human Papillomavirus
RVVQQLLMGA

SEQ ID NO: 8758 - protein, 11 aa, Artificial Sequence
  Peptide Derived from Human Papillomavirus
RVVQQLLMGAL

SEQ ID NO: 8759 - protein, 8 aa, Artificial Sequence
  Peptide Derived from Human Papillomavirus
STKEDLRV

SEQ ID NO: 8760 - protein, 9 aa, Artificial Sequence
  Peptide Derived from Human Papillomavirus
STKEDLRVV

SEQ ID NO: 8761 - protein, 9 aa, Artificial Sequence
  Peptide Derived from Human Papillomavirus
TLQDVVLEL

SEQ ID NO: 8762 - protein, 10 aa, Artificial Sequence
  Peptide Derived from Human Papillomavirus
TLQDVVLELT

SEQ ID NO: 8763 - protein, 8 aa, Artificial Sequence
  Peptide Derived from Human Papillomavirus
TVTCPLCA

SEQ ID NO: 8764 - protein, 8 aa, Artificial Sequence
  Peptide Derived from Human Papillomavirus
VLELTPQT

SEQ ID NO: 8765 - protein, 10 aa, Artificial Sequence
  Peptide Derived from Human Papillomavirus
VLELTPQTEI

SEQ ID NO: 8766 - protein, 8 aa, Artificial Sequence
  Peptide Derived from Human Papillomavirus
VQLDIQST

SEQ ID NO: 8767 - protein, 8 aa, Artificial Sequence
  Peptide Derived from Human Papillomavirus
VQQLLMGA

SEQ ID NO: 8768 - protein, 9 aa, Artificial Sequence
  Peptide Derived from Human Papillomavirus
VQQLLMGAL

SEQ ID NO: 8769 - protein, 10 aa, Artificial Sequence
  Peptide Derived from Human Papillomavirus
VQQLLMGALT

SEQ ID NO: 8770 - protein, 11 aa, Artificial Sequence
  Peptide Derived from Human Papillomavirus
VQQLLMGALTV

SEQ ID NO: 8771 - protein, 9 aa, Artificial Sequence
  Peptide Derived from Human Papillomavirus
VVLELTPQT

SEQ ID NO: 8772 - protein, 11 aa, Artificial Sequence
  Peptide Derived from Human Papillomavirus
VVLELTPQTEI

SEQ ID NO: 8773 - protein, 9 aa, Artificial Sequence
  Peptide Derived from Human Papillomavirus
VVQLDIQST

SEQ ID NO: 8774 - protein, 9 aa, Artificial Sequence
  Peptide Derived from Human Papillomavirus
VVQQLLMGA

SEQ ID NO: 8775 - protein, 10 aa, Artificial Sequence
  Peptide Derived from Human Papillomavirus
VVQQLLMGAL

SEQ ID NO: 8776 - protein, 11 aa, Artificial Sequence
  Peptide Derived from Human Papillomavirus
VVQQLLMGALT

SEQ ID NO: 8777 - protein, 11 aa, Artificial Sequence
  Peptide Derived from Human Papillomavirus
AITCQREQPPT

SEQ ID NO: 8778 - protein, 10 aa, Artificial Sequence
  Peptide Derived from Human Papillomavirus
AMGEHWTKGA

SEQ ID NO: 8779 - protein, 11 aa, Artificial Sequence
  Peptide Derived from Human Papillomavirus
AMGEHWTKGAV

SEQ ID NO: 8780 - protein, 8 aa, Artificial Sequence
  Peptide Derived from Human Papillomavirus
AQGHNNGI

SEQ ID NO: 8781 - protein, 10 aa, Artificial Sequence
  Peptide Derived from Human Papillomavirus
AQLFNKPYWL

SEQ ID NO: 8782 - protein, 9 aa, Artificial Sequence
  Peptide Derived from Human Papillomavirus
ATDSYVKRT

SEQ ID NO: 8783 - protein, 11 aa, Artificial Sequence
  Peptide Derived from Human Papillomavirus
ATDSYVKRTSI

SEQ ID NO: 8784 - protein, 10 aa, Artificial Sequence
  Peptide Derived from Human Papillomavirus
ATEQLSKYDA

SEQ ID NO: 8785 - protein, 8 aa, Artificial Sequence
  Peptide Derived from Human Papillomavirus
ATPSGSMI

SEQ ID NO: 8786 - protein, 9 aa, Artificial Sequence
  Peptide Derived from Human Papillomavirus
ATPSGSMIT

SEQ ID NO: 8787 - protein, 8 aa, Artificial Sequence
  Peptide Derived from Human Papillomavirus
ATSKKRSA

SEQ ID NO: 8788 - protein, 10 aa, Artificial Sequence
  Peptide Derived from Human Papillomavirus
ATSKKRSAPT

SEQ ID NO: 8789 - protein, 11 aa, Artificial Sequence
  Peptide Derived from Human Papillomavirus
ATSLEDKYRYV

SEQ ID NO: 8790 - protein, 10 aa, Artificial Sequence
  Peptide Derived from Human Papillomavirus
ATWRPSENKV

SEQ ID NO: 8791 - protein, 10 aa, Artificial Sequence
  Peptide Derived from Human Papillomavirus
AVATSKKRSA

SEQ ID NO: 8792 - protein, 8 aa, Artificial Sequence
  Peptide Derived from Human Papillomavirus
AVCKSTQV

SEQ ID NO: 8793 - protein, 9 aa, Artificial Sequence
  Peptide Derived from Human Papillomavirus
AVCKSTQVT

SEQ ID NO: 8794 - protein, 10 aa, Artificial Sequence
  Peptide Derived from Human Papillomavirus
AVCKSTQVTT

SEQ ID NO: 8795 - protein, 9 aa, Artificial Sequence
  Peptide Derived from Human Papillomavirus
AVGHPYYSV

SEQ ID NO: 8796 - protein, 10 aa, Artificial Sequence
  Peptide Derived from Human Papillomavirus
AVGHPYYSVT

SEQ ID NO: 8797 - protein, 9 aa, Artificial Sequence
  Peptide Derived from Human Papillomavirus
AVNVFPIFL

SEQ ID NO: 8798 - protein, 11 aa, Artificial Sequence
  Peptide Derived from Human Papillomavirus
AVNVFPIFLQM

SEQ ID NO: 8799 - protein, 8 aa, Artificial Sequence
  Peptide Derived from Human Papillomavirus
CIFLDVGA

SEQ ID NO: 8800 - protein, 9 aa, Artificial Sequence
  Peptide Derived from Human Papillomavirus
CIFLDVGAV

SEQ ID NO: 8801 - protein, 11 aa, Artificial Sequence
  Peptide Derived from Human Papillomavirus
CIFLDVGAVNV

SEQ ID NO: 8802 - protein, 8 aa, Artificial Sequence
  Peptide Derived from Human Papillomavirus
CIVGCTPA

SEQ ID NO: 8803 - protein, 9 aa, Artificial Sequence
  Peptide Derived from Human Papillomavirus
CIVGCTPAM

SEQ ID NO: 8804 - protein, 8 aa, Artificial Sequence
  Peptide Derived from Human Papillomavirus
CQREQPPT

SEQ ID NO: 8805 - protein, 10 aa, Artificial Sequence
  Peptide Derived from Human Papillomavirus
CTPAMGEHWT

SEQ ID NO: 8806 - protein, 9 aa, Artificial Sequence
  Peptide Derived from Human Papillomavirus
DARKINQYL

SEQ ID NO: 8807 - protein, 11 aa, Artificial Sequence
  Peptide Derived from Human Papillomavirus
DAYGDSMWFYL

SEQ ID NO: 8808 - protein, 9 aa, Artificial Sequence
  Peptide Derived from Human Papillomavirus
DMIDTGFGA

SEQ ID NO: 8809 - protein, 10 aa, Artificial Sequence
  Peptide Derived from Human Papillomavirus
DMIDTGFGAM

SEQ ID NO: 8810 - protein, 8 aa, Artificial Sequence
  Peptide Derived from Human Papillomavirus
DQERLVWA

SEQ ID NO: 8811 - protein, 10 aa, Artificial Sequence
  Peptide Derived from Human Papillomavirus
DQERLVWACV

SEQ ID NO: 8812 - protein, 10 aa, Artificial Sequence
  Peptide Derived from Human Papillomavirus
DQFPLGRKFL

SEQ ID NO: 8813 - protein, 11 aa, Artificial Sequence
  Peptide Derived from Human Papillomavirus
DQFPLGRKFLM

SEQ ID NO: 8814 - protein, 8 aa, Artificial Sequence
  Peptide Derived from Human Papillomavirus
DTESSNLA

SEQ ID NO: 8815 - protein, 11 aa, Artificial Sequence
  Peptide Derived from Human Papillomavirus
DTGFGAMDFKV

SEQ ID NO: 8816 - protein, 8 aa, Artificial Sequence
  Peptide Derived from Human Papillomavirus
DTTRSTNM

SEQ ID NO: 8817 - protein, 9 aa, Artificial Sequence
  Peptide Derived from Human Papillomavirus
DTTRSTNMT

SEQ ID NO: 8818 - protein, 10 aa, Artificial Sequence
  Peptide Derived from Human Papillomavirus
DTTRSTNMTI

SEQ ID NO: 8819 - protein, 10 aa, Artificial Sequence
  Peptide Derived from Human Papillomavirus
DVGAVNVFPI

SEQ ID NO: 8820 - protein, 10 aa, Artificial Sequence
  Peptide Derived from Human Papillomavirus
DVNLQDSFST

SEQ ID NO: 8821 - protein, 11 aa, Artificial Sequence
  Peptide Derived from Human Papillomavirus
EAQLFNKPYWL

SEQ ID NO: 8822 - protein, 8 aa, Artificial Sequence
  Peptide Derived from Human Papillomavirus
ELQFVFQL

SEQ ID NO: 8823 - protein, 11 aa, Artificial Sequence
  Peptide Derived from Human Papillomavirus
ELQFVFQLCKI

SEQ ID NO: 8824 - protein, 8 aa, Artificial Sequence
  Peptide Derived from Human Papillomavirus
EQLSKYDA

SEQ ID NO: 8825 - protein, 11 aa, Artificial Sequence
  Peptide Derived from Human Papillomavirus
EQLSKYDARKI

SEQ ID NO: 8826 - protein, 11 aa, Artificial Sequence
  Peptide Derived from Human Papillomavirus
EQPPTEKQDPL

SEQ ID NO: 8827 - protein, 9 aa, Artificial Sequence
  Peptide Derived from Human Papillomavirus
ETIPAELYL

SEQ ID NO: 8828 - protein, 8 aa, Artificial Sequence
  Peptide Derived from Human Papillomavirus
EVGRGQPL

SEQ ID NO: 8829 - protein, 10 aa, Artificial Sequence
  Peptide Derived from Human Papillomavirus
EVGRGQPLGA

SEQ ID NO: 8830 - protein, 9 aa, Artificial Sequence
  Peptide Derived from Human Papillomavirus
EVMAYLHNM

SEQ ID NO: 8831 - protein, 11 aa, Artificial Sequence
  Peptide Derived from Human Papillomavirus
EVMAYLHNMNA

SEQ ID NO: 8832 - protein, 10 aa, Artificial Sequence
  Peptide Derived from Human Papillomavirus
EVPLDIVQST

SEQ ID NO: 8833 - protein, 9 aa, Artificial Sequence
  Peptide Derived from Human Papillomavirus
FARHYFNRA

SEQ ID NO: 8834 - protein, 9 aa, Artificial Sequence
  Peptide Derived from Human Papillomavirus
FLDVGAVNV

SEQ ID NO: 8835 - protein, 8 aa, Artificial Sequence
  Peptide Derived from Human Papillomavirus
FQLCKITL

SEQ ID NO: 8836 - protein, 10 aa, Artificial Sequence
  Peptide Derived from Human Papillomavirus
FQLCKITLSA

SEQ ID NO: 8837 - protein, 8 aa, Artificial Sequence
  Peptide Derived from Human Papillomavirus
FVFQLCKI

SEQ ID NO: 8838 - protein, 9 aa, Artificial Sequence
  Peptide Derived from Human Papillomavirus
FVFQLCKIT

SEQ ID NO: 8839 - protein, 10 aa, Artificial Sequence
  Peptide Derived from Human Papillomavirus
FVFQLCKITL

SEQ ID NO: 8840 - protein, 8 aa, Artificial Sequence
  Peptide Derived from Human Papillomavirus
FVTVVDTT

SEQ ID NO: 8841 - protein, 11 aa, Artificial Sequence
  Peptide Derived from Human Papillomavirus
FVTVVDTTRST

SEQ ID NO: 8842 - protein, 9 aa, Artificial Sequence
  Peptide Derived from Human Papillomavirus
GAGLSGHPL

SEQ ID NO: 8843 - protein, 8 aa, Artificial Sequence
  Peptide Derived from Human Papillomavirus
GAMDFKVL

SEQ ID NO: 8844 - protein, 9 aa, Artificial Sequence
  Peptide Derived from Human Papillomavirus
GAVCKSTQV

SEQ ID NO: 8845 - protein, 10 aa, Artificial Sequence
  Peptide Derived from Human Papillomavirus
GAVCKSTQVT

SEQ ID NO: 8846 - protein, 11 aa, Artificial Sequence
  Peptide Derived from Human Papillomavirus
GAVCKSTQVTT

SEQ ID NO: 8847 - protein, 8 aa, Artificial Sequence
  Peptide Derived from Human Papillomavirus
GAVNVFPI

SEQ ID NO: 8848 - protein, 10 aa, Artificial Sequence
  Peptide Derived from Human Papillomavirus
GAVNVFPIFL

SEQ ID NO: 8849 - protein, 8 aa, Artificial Sequence
  Peptide Derived from Human Papillomavirus
GICWGNQL

SEQ ID NO: 8850 - protein, 10 aa, Artificial Sequence
  Peptide Derived from Human Papillomavirus
GICWGNQLFV

SEQ ID NO: 8851 - protein, 11 aa, Artificial Sequence
  Peptide Derived from Human Papillomavirus
GICWGNQLFVT

SEQ ID NO: 8852 - protein, 8 aa, Artificial Sequence
  Peptide Derived from Human Papillomavirus
GLCIFLDV

SEQ ID NO: 8853 - protein, 10 aa, Artificial Sequence
  Peptide Derived from Human Papillomavirus
GLCIFLDVGA

SEQ ID NO: 8854 - protein, 11 aa, Artificial Sequence
  Peptide Derived from Human Papillomavirus
GLCIFLDVGAV

SEQ ID NO: 8855 - protein, 10 aa, Artificial Sequence
  Peptide Derived from Human Papillomavirus
GLEVGRGQPL

SEQ ID NO: 8856 - protein, 11 aa, Artificial Sequence
  Peptide Derived from Human Papillomavirus
GLSGHPLFNRL

SEQ ID NO: 8857 - protein, 8 aa, Artificial Sequence
  Peptide Derived from Human Papillomavirus
GLSPPVAT

SEQ ID NO: 8858 - protein, 10 aa, Artificial Sequence
  Peptide Derived from Human Papillomavirus
GLSPPVATSL

SEQ ID NO: 8859 - protein, 8 aa, Artificial Sequence
  Peptide Derived from Human Papillomavirus
GQPLGAGL

SEQ ID NO: 8860 - protein, 8 aa, Artificial Sequence
  Peptide Derived from Human Papillomavirus
GTRSKPAV

SEQ ID NO: 8861 - protein, 9 aa, Artificial Sequence
  Peptide Derived from Human Papillomavirus
GTRSKPAVA

SEQ ID NO: 8862 - protein, 10 aa, Artificial Sequence
  Peptide Derived from Human Papillomavirus
GTRSKPAVAT

SEQ ID NO: 8863 - protein, 8 aa, Artificial Sequence
  Peptide Derived from Human Papillomavirus
HAGSSRLL

SEQ ID NO: 8864 - protein, 9 aa, Artificial Sequence
  Peptide Derived from Human Papillomavirus
HAGSSRLLA

SEQ ID NO: 8865 - protein, 10 aa, Artificial Sequence
  Peptide Derived from Human Papillomavirus
HAGSSRLLAV

SEQ ID NO: 8866 - protein, 10 aa, Artificial Sequence
  Peptide Derived from Human Papillomavirus
HVEEYELQFV

SEQ ID NO: 8867 - protein, 10 aa, Artificial Sequence
  Peptide Derived from Human Papillomavirus
ITCQREQPPT

SEQ ID NO: 8868 - protein, 8 aa, Artificial Sequence
  Peptide Derived from Human Papillomavirus
ITLSAEVM

SEQ ID NO: 8869 - protein, 9 aa, Artificial Sequence
  Peptide Derived from Human Papillomavirus
ITLSAEVMA

SEQ ID NO: 8870 - protein, 11 aa, Artificial Sequence
  Peptide Derived from Human Papillomavirus
ITLSAEVMAYL

SEQ ID NO: 8871 - protein, 8 aa, Artificial Sequence
  Peptide Derived from Human Papillomavirus
IVGCTPAM

SEQ ID NO: 8872 - protein, 8 aa, Artificial Sequence
  Peptide Derived from Human Papillomavirus
KAEVPLDI

SEQ ID NO: 8873 - protein, 9 aa, Artificial Sequence
  Peptide Derived from Human Papillomavirus
KAEVPLDIV

SEQ ID NO: 8874 - protein, 9 aa, Artificial Sequence
  Peptide Derived from Human Papillomavirus
KINQYLRHV

SEQ ID NO: 8875 - protein, 8 aa, Artificial Sequence
  Peptide Derived from Human Papillomavirus
KITLSAEV

SEQ ID NO: 8876 - protein, 9 aa, Artificial Sequence
  Peptide Derived from Human Papillomavirus
KITLSAEVM

SEQ ID NO: 8877 - protein, 10 aa, Artificial Sequence
  Peptide Derived from Human Papillomavirus
KITLSAEVMA

SEQ ID NO: 8878 - protein, 11 aa, Artificial Sequence
  Peptide Derived from Human Papillomavirus
KMSADAYGDSM

SEQ ID NO: 8879 - protein, 8 aa, Artificial Sequence
  Peptide Derived from Human Papillomavirus
KQTQLCIV

SEQ ID NO: 8880 - protein, 11 aa, Artificial Sequence
  Peptide Derived from Human Papillomavirus
KQTQLCIVGCT

SEQ ID NO: 8881 - protein, 9 aa, Artificial Sequence
  Peptide Derived from Human Papillomavirus
KTNIPKVSA

SEQ ID NO: 8882 - protein, 8 aa, Artificial Sequence
  Peptide Derived from Human Papillomavirus
KVGETIPA

SEQ ID NO: 8883 - protein, 10 aa, Artificial Sequence
  Peptide Derived from Human Papillomavirus
KVGETIPAEL

SEQ ID NO: 8884 - protein, 8 aa, Artificial Sequence
  Peptide Derived from Human Papillomavirus
KVLQESKA

SEQ ID NO: 8885 - protein, 10 aa, Artificial Sequence
  Peptide Derived from Human Papillomavirus
KVLQESKAEV

SEQ ID NO: 8886 - protein, 9 aa, Artificial Sequence
  Peptide Derived from Human Papillomavirus
KVSAYQYRV

SEQ ID NO: 8887 - protein, 9 aa, Artificial Sequence
  Peptide Derived from Human Papillomavirus
KVVATDSYV

SEQ ID NO: 8888 - protein, 9 aa, Artificial Sequence
  Peptide Derived from Human Papillomavirus
KVYLPPTPV

SEQ ID NO: 8889 - protein, 9 aa, Artificial Sequence
  Peptide Derived from Human Papillomavirus
LAKYKFWDV

SEQ ID NO: 8890 - protein, 11 aa, Artificial Sequence
  Peptide Derived from Human Papillomavirus
LAKYKFWDVNL

SEQ ID NO: 8891 - protein, 8 aa, Artificial Sequence
  Peptide Derived from Human Papillomavirus
LALINTPI

SEQ ID NO: 8892 - protein, 10 aa, Artificial Sequence
  Peptide Derived from Human Papillomavirus
LAVGHPYYSV

SEQ ID NO: 8893 - protein, 11 aa, Artificial Sequence
  Peptide Derived from Human Papillomavirus
LAVGHPYYSVT

SEQ ID NO: 8894 - protein, 11 aa, Artificial Sequence
  Peptide Derived from Human Papillomavirus
LINTPIEDGDM

SEQ ID NO: 8895 - protein, 11 aa, Artificial Sequence
  Peptide Derived from Human Papillomavirus
LLAVGHPYYSV

SEQ ID NO: 8896 - protein, 9 aa, Artificial Sequence
  Peptide Derived from Human Papillomavirus
LLEDWNIGL

SEQ ID NO: 8897 - protein, 11 aa, Artificial Sequence
  Peptide Derived from Human Papillomavirus
LMQLGTRSKPA

SEQ ID NO: 8898 - protein, 9 aa, Artificial Sequence
  Peptide Derived from Human Papillomavirus
LQDSFSTDL

SEQ ID NO: 8899 - protein, 8 aa, Artificial Sequence
  Peptide Derived from Human Papillomavirus
LQESKAEV

SEQ ID NO: 8900 - protein, 10 aa, Artificial Sequence
  Peptide Derived from Human Papillomavirus
LQESKAEVPL

SEQ ID NO: 8901 - protein, 10 aa, Artificial Sequence
  Peptide Derived from Human Papillomavirus
LQFVFQLCKI

SEQ ID NO: 8902 - protein, 11 aa, Artificial Sequence
  Peptide Derived from Human Papillomavirus
LQFVFQLCKIT

SEQ ID NO: 8903 - protein, 11 aa, Artificial Sequence
  Peptide Derived from Human Papillomavirus
LQRAQGHNNGI

SEQ ID NO: 8904 - protein, 8 aa, Artificial Sequence
  Peptide Derived from Human Papillomavirus
LVWACVGL

SEQ ID NO: 8905 - protein, 10 aa, Artificial Sequence
  Peptide Derived from Human Papillomavirus
LVWACVGLEV

SEQ ID NO: 8906 - protein, 11 aa, Artificial Sequence
  Peptide Derived from Human Papillomavirus
MATWRPSENKV

SEQ ID NO: 8907 - protein, 9 aa, Artificial Sequence
  Peptide Derived from Human Papillomavirus
MAYLHNMNA

SEQ ID NO: 8908 - protein, 11 aa, Artificial Sequence
  Peptide Derived from Human Papillomavirus
MAYLHNMNANL

SEQ ID NO: 8909 - protein, 8 aa, Artificial Sequence
  Peptide Derived from Human Papillomavirus
MIDTGFGA

SEQ ID NO: 8910 - protein, 9 aa, Artificial Sequence
  Peptide Derived from Human Papillomavirus
MIDTGFGAM

SEQ ID NO: 8911 - protein, 8 aa, Artificial Sequence
  Peptide Derived from Human Papillomavirus
MITSEAQL

SEQ ID NO: 8912 - protein, 8 aa, Artificial Sequence
  Peptide Derived from Human Papillomavirus
MMLPMMYI

SEQ ID NO: 8913 - protein, 10 aa, Artificial Sequence
  Peptide Derived from Human Papillomavirus
MMYIYRDPPL

SEQ ID NO: 8914 - protein, 10 aa, Artificial Sequence
  Peptide Derived from Human Papillomavirus
MQLGTRSKPA

SEQ ID NO: 8915 - protein, 11 aa, Artificial Sequence
  Peptide Derived from Human Papillomavirus
MQLGTRSKPAV

SEQ ID NO: 8916 - protein, 10 aa, Artificial Sequence
  Peptide Derived from Human Papillomavirus
MTISTATEQL

SEQ ID NO: 8917 - protein, 10 aa, Artificial Sequence
  Peptide Derived from Human Papillomavirus
NANLLEDWNI

SEQ ID NO: 8918 - protein, 8 aa, Artificial Sequence
  Peptide Derived from Human Papillomavirus
NIGLSPPV

SEQ ID NO: 8919 - protein, 9 aa, Artificial Sequence
  Peptide Derived from Human Papillomavirus
NIGLSPPVA

SEQ ID NO: 8920 - protein, 10 aa, Artificial Sequence
  Peptide Derived from Human Papillomavirus
NIGLSPPVAT

SEQ ID NO: 8921 - protein, 9 aa, Artificial Sequence
  Peptide Derived from Human Papillomavirus
NISVDGKQT

SEQ ID NO: 8922 - protein, 11 aa, Artificial Sequence
  Peptide Derived from Human Papillomavirus
NISVDGKQTQL

SEQ ID NO: 8923 - protein, 10 aa, Artificial Sequence
  Peptide Derived from Human Papillomavirus
NIYNPDQERL

SEQ ID NO: 8924 - protein, 11 aa, Artificial Sequence
  Peptide Derived from Human Papillomavirus
NIYNPDQERLV

SEQ ID NO: 8925 - protein, 8 aa, Artificial Sequence
  Peptide Derived from Human Papillomavirus
NLANNNVI

SEQ ID NO: 8926 - protein, 8 aa, Artificial Sequence
  Peptide Derived from Human Papillomavirus
NLLEDWNI

SEQ ID NO: 8927 - protein, 10 aa, Artificial Sequence
  Peptide Derived from Human Papillomavirus
NLLEDWNIGL

SEQ ID NO: 8928 - protein, 8 aa, Artificial Sequence
  Peptide Derived from Human Papillomavirus
NLQDSFST

SEQ ID NO: 8929 - protein, 10 aa, Artificial Sequence
  Peptide Derived from Human Papillomavirus
NLQDSFSTDL

SEQ ID NO: 8930 - protein, 8 aa, Artificial Sequence
  Peptide Derived from Human Papillomavirus
NMTISTAT

SEQ ID NO: 8931 - protein, 11 aa, Artificial Sequence
  Peptide Derived from Human Papillomavirus
NMTISTATEQL

SEQ ID NO: 8932 - protein, 8 aa, Artificial Sequence
  Peptide Derived from Human Papillomavirus
NQLFVTVV

SEQ ID NO: 8933 - protein, 10 aa, Artificial Sequence
  Peptide Derived from Human Papillomavirus
NQLFVTVVDT

SEQ ID NO: 8934 - protein, 11 aa, Artificial Sequence
  Peptide Derived from Human Papillomavirus
NQLFVTVVDTT

SEQ ID NO: 8935 - protein, 9 aa, Artificial Sequence
  Peptide Derived from Human Papillomavirus
NTKTNIPKV

SEQ ID NO: 8936 - protein, 11 aa, Artificial Sequence
  Peptide Derived from Human Papillomavirus
NTKTNIPKVSA

SEQ ID NO: 8937 - protein, 9 aa, Artificial Sequence
  Peptide Derived from Human Papillomavirus
NTPIEDGDM

SEQ ID NO: 8938 - protein, 10 aa, Artificial Sequence
  Peptide Derived from Human Papillomavirus
NTPIEDGDMI

SEQ ID NO: 8939 - protein, 9 aa, Artificial Sequence
  Peptide Derived from Human Papillomavirus
NVFPIFLQM

SEQ ID NO: 8940 - protein, 10 aa, Artificial Sequence
  Peptide Derived from Human Papillomavirus
NVFPIFLQMA

SEQ ID NO: 8941 - protein, 11 aa, Artificial Sequence
  Peptide Derived from Human Papillomavirus
NVFPIFLQMAT

SEQ ID NO: 8942 - protein, 10 aa, Artificial Sequence
  Peptide Derived from Human Papillomavirus
NVIEDSRDNI

SEQ ID NO: 8943 - protein, 8 aa, Artificial Sequence
  Peptide Derived from Human Papillomavirus
PAMGEHWT

SEQ ID NO: 8944 - protein, 11 aa, Artificial Sequence
  Peptide Derived from Human Papillomavirus
PAMGEHWTKGA

SEQ ID NO: 8945 - protein, 11 aa, Artificial Sequence
  Peptide Derived from Human Papillomavirus
PAVATSKKRSA

SEQ ID NO: 8946 - protein, 8 aa, Artificial Sequence
  Peptide Derived from Human Papillomavirus
PIEDGDMI

SEQ ID NO: 8947 - protein, 10 aa, Artificial Sequence
  Peptide Derived from Human Papillomavirus
PIEDGDMIDT

SEQ ID NO: 8948 - protein, 8 aa, Artificial Sequence
  Peptide Derived from Human Papillomavirus
PIFLQMAT

SEQ ID NO: 8949 - protein, 10 aa, Artificial Sequence
  Peptide Derived from Human Papillomavirus
PLAKYKFWDV

SEQ ID NO: 8950 - protein, 9 aa, Artificial Sequence
  Peptide Derived from Human Papillomavirus
PLALINTPI

SEQ ID NO: 8951 - protein, 8 aa, Artificial Sequence
  Peptide Derived from Human Papillomavirus
PLDIVQST

SEQ ID NO: 8952 - protein, 9 aa, Artificial Sequence
  Peptide Derived from Human Papillomavirus
PLFNRLDDT

SEQ ID NO: 8953 - protein, 11 aa, Artificial Sequence
  Peptide Derived from Human Papillomavirus
PLGAGLSGHPL

SEQ ID NO: 8954 - protein, 8 aa, Artificial Sequence
  Peptide Derived from Human Papillomavirus
PLGRKFLM

SEQ ID NO: 8955 - protein, 10 aa, Artificial Sequence
  Peptide Derived from Human Papillomavirus
PLGRKFLMQL

SEQ ID NO: 8956 - protein, 8 aa, Artificial Sequence
  Peptide Derived from Human Papillomavirus
PLHYGLCI

SEQ ID NO: 8957 - protein, 10 aa, Artificial Sequence
  Peptide Derived from Human Papillomavirus
PLHYGLCIFL

SEQ ID NO: 8958 - protein, 11 aa, Artificial Sequence
  Peptide Derived from Human Papillomavirus
PMMYIYRDPPL

SEQ ID NO: 8959 - protein, 8 aa, Artificial Sequence
  Peptide Derived from Human Papillomavirus
PTEKQDPL

SEQ ID NO: 8960 - protein, 9 aa, Artificial Sequence
  Peptide Derived from Human Papillomavirus
PTEKQDPLA

SEQ ID NO: 8961 - protein, 8 aa, Artificial Sequence
  Peptide Derived from Human Papillomavirus
PTPVSKVV

SEQ ID NO: 8962 - protein, 9 aa, Artificial Sequence
  Peptide Derived from Human Papillomavirus
PTPVSKVVA

SEQ ID NO: 8963 - protein, 10 aa, Artificial Sequence
  Peptide Derived from Human Papillomavirus
PTPVSKVVAT

SEQ ID NO: 8964 - protein, 8 aa, Artificial Sequence
  Peptide Derived from Human Papillomavirus
PTSTSTPA

SEQ ID NO: 8965 - protein, 8 aa, Artificial Sequence
  Peptide Derived from Human Papillomavirus
PVSKVVAT

SEQ ID NO: 8966 - protein, 8 aa, Artificial Sequence
  Peptide Derived from Human Papillomavirus
QLCIVGCT

SEQ ID NO: 8967 - protein, 10 aa, Artificial Sequence
  Peptide Derived from Human Papillomavirus
QLCIVGCTPA

SEQ ID NO: 8968 - protein, 11 aa, Artificial Sequence
  Peptide Derived from Human Papillomavirus
QLCIVGCTPAM

SEQ ID NO: 8969 - protein, 9 aa, Artificial Sequence
  Peptide Derived from Human Papillomavirus
QLCKITLSA

SEQ ID NO: 8970 - protein, 11 aa, Artificial Sequence
  Peptide Derived from Human Papillomavirus
QLCKITLSAEV

SEQ ID NO: 8971 - protein, 11 aa, Artificial Sequence
  Peptide Derived from Human Papillomavirus
QLFARHYFNRA

SEQ ID NO: 8972 - protein, 9 aa, Artificial Sequence
  Peptide Derived from Human Papillomavirus
QLFNKPYWL

SEQ ID NO: 8973 - protein, 9 aa, Artificial Sequence
  Peptide Derived from Human Papillomavirus
QLFVTVVDT

SEQ ID NO: 8974 - protein, 10 aa, Artificial Sequence
  Peptide Derived from Human Papillomavirus
QLFVTVVDTT

SEQ ID NO: 8975 - protein, 9 aa, Artificial Sequence
  Peptide Derived from Human Papillomavirus
QLGTRSKPA

SEQ ID NO: 8976 - protein, 10 aa, Artificial Sequence
  Peptide Derived from Human Papillomavirus
QLGTRSKPAV

SEQ ID NO: 8977 - protein, 11 aa, Artificial Sequence
  Peptide Derived from Human Papillomavirus
QLGTRSKPAVA

SEQ ID NO: 8978 - protein, 10 aa, Artificial Sequence
  Peptide Derived from Human Papillomavirus
QLSKYDARKI

SEQ ID NO: 8979 - protein, 10 aa, Artificial Sequence
  Peptide Derived from Human Papillomavirus
QTQLCIVGCT

SEQ ID NO: 8980 - protein, 10 aa, Artificial Sequence
  Peptide Derived from Human Papillomavirus
QVTTGDCPPL

SEQ ID NO: 8981 - protein, 11 aa, Artificial Sequence
  Peptide Derived from Human Papillomavirus
QVTTGDCPPLA

SEQ ID NO: 8982 - protein, 8 aa, Artificial Sequence
  Peptide Derived from Human Papillomavirus
RAGKVGET

SEQ ID NO: 8983 - protein, 9 aa, Artificial Sequence
  Peptide Derived from Human Papillomavirus
RAGKVGETI

SEQ ID NO: 8984 - protein, 11 aa, Artificial Sequence
  Peptide Derived from Human Papillomavirus
RAGKVGETIPA

SEQ ID NO: 8985 - protein, 9 aa, Artificial Sequence
  Peptide Derived from Human Papillomavirus
RAQGHNNGI

SEQ ID NO: 8986 - protein, 10 aa, Artificial Sequence
  Peptide Derived from Human Papillomavirus
RLDDTESSNL

SEQ ID NO: 8987 - protein, 11 aa, Artificial Sequence
  Peptide Derived from Human Papillomavirus
RLDDTESSNLA

SEQ ID NO: 8988 - protein, 10 aa, Artificial Sequence
  Peptide Derived from Human Papillomavirus
RLPDPNKFGL

SEQ ID NO: 8989 - protein, 9 aa, Artificial Sequence
  Peptide Derived from Human Papillomavirus
RLVWACVGL

SEQ ID NO: 8990 - protein, 11 aa, Artificial Sequence
  Peptide Derived from Human Papillomavirus
RLVWACVGLEV

SEQ ID NO: 8991 - protein, 8 aa, Artificial Sequence
  Peptide Derived from Human Papillomavirus
RTSIFYHA

SEQ ID NO: 8992 - protein, 9 aa, Artificial Sequence
  Peptide Derived from Human Papillomavirus
SADAYGDSM

SEQ ID NO: 8993 - protein, 8 aa, Artificial Sequence
  Peptide Derived from Human Papillomavirus
SAEVMAYL

SEQ ID NO: 8994 - protein, 11 aa, Artificial Sequence
  Peptide Derived from Human Papillomavirus
SAEVMAYLHNM

SEQ ID NO: 8995 - protein, 8 aa, Artificial Sequence
  Peptide Derived from Human Papillomavirus
SAPTSTST

SEQ ID NO: 8996 - protein, 10 aa, Artificial Sequence
  Peptide Derived from Human Papillomavirus
SAPTSTSTPA

SEQ ID NO: 8997 - protein, 10 aa, Artificial Sequence
  Peptide Derived from Human Papillomavirus
SAYQYRVFRV

SEQ ID NO: 8998 - protein, 11 aa, Artificial Sequence
  Peptide Derived from Human Papillomavirus
SIFYHAGSSRL

SEQ ID NO: 8999 - protein, 9 aa, Artificial Sequence
  Peptide Derived from Human Papillomavirus
SLEDKYRYV

SEQ ID NO: 9000 - protein, 9 aa, Artificial Sequence
  Peptide Derived from Human Papillomavirus
SMITSEAQL

SEQ ID NO: 9001 - protein, 11 aa, Artificial Sequence
  Peptide Derived from Human Papillomavirus
SMWFYLRREQL

SEQ ID NO: 9002 - protein, 9 aa, Artificial Sequence
  Peptide Derived from Human Papillomavirus
STCKYPDYL

SEQ ID NO: 9003 - protein, 11 aa, Artificial Sequence
  Peptide Derived from Human Papillomavirus
STCKYPDYLKM

SEQ ID NO: 9004 - protein, 9 aa, Artificial Sequence
  Peptide Derived from Human Papillomavirus
STDLDQFPL

SEQ ID NO: 9005 - protein, 8 aa, Artificial Sequence
  Peptide Derived from Human Papillomavirus
STNMTIST

SEQ ID NO: 9006 - protein, 9 aa, Artificial Sequence
  Peptide Derived from Human Papillomavirus
STNMTISTA

SEQ ID NO: 9007 - protein, 10 aa, Artificial Sequence
  Peptide Derived from Human Papillomavirus
STNMTISTAT

SEQ ID NO: 9008 - protein, 9 aa, Artificial Sequence
  Peptide Derived from Human Papillomavirus
SVDGKQTQL

SEQ ID NO: 9009 - protein, 11 aa, Artificial Sequence
  Peptide Derived from Human Papillomavirus
SVDGKQTQLCI

SEQ ID NO: 9010 - protein, 9 aa, Artificial Sequence
  Peptide Derived from Human Papillomavirus
SVTKDNTKT

SEQ ID NO: 9011 - protein, 11 aa, Artificial Sequence
  Peptide Derived from Human Papillomavirus
SVTKDNTKTNI

SEQ ID NO: 9012 - protein, 11 aa, Artificial Sequence
  Peptide Derived from Human Papillomavirus
SVYVATPSGSM

SEQ ID NO: 9013 - protein, 11 aa, Artificial Sequence
  Peptide Derived from Human Papillomavirus
TATEQLSKYDA

SEQ ID NO: 9014 - protein, 8 aa, Artificial Sequence
  Peptide Derived from Human Papillomavirus
TIPAELYL

SEQ ID NO: 9015 - protein, 9 aa, Artificial Sequence
  Peptide Derived from Human Papillomavirus
TISTATEQL

SEQ ID NO: 9016 - protein, 8 aa, Artificial Sequence
  Peptide Derived from Human Papillomavirus
TLSAEVMA

SEQ ID NO: 9017 - protein, 10 aa, Artificial Sequence
  Peptide Derived from Human Papillomavirus
TLSAEVMAYL

SEQ ID NO: 9018 - protein, 9 aa, Artificial Sequence
  Peptide Derived from Human Papillomavirus
TQLCIVGCT

SEQ ID NO: 9019 - protein, 11 aa, Artificial Sequence
  Peptide Derived from Human Papillomavirus
TQLCIVGCTPA

SEQ ID NO: 9020 - protein, 11 aa, Artificial Sequence
  Peptide Derived from Human Papillomavirus
TQVTTGDCPPL

SEQ ID NO: 9021 - protein, 8 aa, Artificial Sequence
  Peptide Derived from Human Papillomavirus
TTGDCPPL

SEQ ID NO: 9022 - protein, 9 aa, Artificial Sequence
  Peptide Derived from Human Papillomavirus
TTGDCPPLA

SEQ ID NO: 9023 - protein, 10 aa, Artificial Sequence
  Peptide Derived from Human Papillomavirus
TTGDCPPLAL

SEQ ID NO: 9024 - protein, 11 aa, Artificial Sequence
  Peptide Derived from Human Papillomavirus
TTGDCPPLALI

SEQ ID NO: 9025 - protein, 8 aa, Artificial Sequence
  Peptide Derived from Human Papillomavirus
TTRSTNMT

SEQ ID NO: 9026 - protein, 9 aa, Artificial Sequence
  Peptide Derived from Human Papillomavirus
TTRSTNMTI

SEQ ID NO: 9027 - protein, 11 aa, Artificial Sequence
  Peptide Derived from Human Papillomavirus
TTRSTNMTIST

SEQ ID NO: 9028 - protein, 9 aa, Artificial Sequence
  Peptide Derived from Human Papillomavirus
TVVDTTRST

SEQ ID NO: 9029 - protein, 11 aa, Artificial Sequence
  Peptide Derived from Human Papillomavirus
TVVDTTRSTNM

SEQ ID NO: 9030 - protein, 10 aa, Artificial Sequence
  Peptide Derived from Human Papillomavirus
VATDSYVKRT

SEQ ID NO: 9031 - protein, 8 aa, Artificial Sequence
  Peptide Derived from Human Papillomavirus
VATPSGSM

SEQ ID NO: 9032 - protein, 9 aa, Artificial Sequence
  Peptide Derived from Human Papillomavirus
VATPSGSMI

SEQ ID NO: 9033 - protein, 10 aa, Artificial Sequence
  Peptide Derived from Human Papillomavirus
VATPSGSMIT

SEQ ID NO: 9034 - protein, 9 aa, Artificial Sequence
  Peptide Derived from Human Papillomavirus
VATSKKRSA

SEQ ID NO: 9035 - protein, 11 aa, Artificial Sequence
  Peptide Derived from Human Papillomavirus
VATSKKRSAPT

SEQ ID NO: 9036 - protein, 9 aa, Artificial Sequence
  Peptide Derived from Human Papillomavirus
VIEDSRDNI

SEQ ID NO: 9037 - protein, 11 aa, Artificial Sequence
  Peptide Derived from Human Papillomavirus
VIEDSRDNISV

SEQ ID NO: 9038 - protein, 9 aa, Artificial Sequence
  Peptide Derived from Human Papillomavirus
VLQESKAEV

SEQ ID NO: 9039 - protein, 11 aa, Artificial Sequence
  Peptide Derived from Human Papillomavirus
VLQESKAEVPL

SEQ ID NO: 9040 - protein, 8 aa, Artificial Sequence
  Peptide Derived from Human Papillomavirus
VMAYLHNM

SEQ ID NO: 9041 - protein, 10 aa, Artificial Sequence
  Peptide Derived from Human Papillomavirus
VMAYLHNMNA

SEQ ID NO: 9042 - protein, 11 aa, Artificial Sequence
  Peptide Derived from Human Papillomavirus
VQSTCKYPDYL

SEQ ID NO: 9043 - protein, 8 aa, Artificial Sequence
  Peptide Derived from Human Papillomavirus
VTKDNTKT

SEQ ID NO: 9044 - protein, 10 aa, Artificial Sequence
  Peptide Derived from Human Papillomavirus
VTKDNTKTNI

SEQ ID NO: 9045 - protein, 9 aa, Artificial Sequence
  Peptide Derived from Human Papillomavirus
VTTGDCPPL

SEQ ID NO: 9046 - protein, 10 aa, Artificial Sequence
  Peptide Derived from Human Papillomavirus
VTTGDCPPLA

SEQ ID NO: 9047 - protein, 11 aa, Artificial Sequence
  Peptide Derived from Human Papillomavirus
VTTGDCPPLAL

SEQ ID NO: 9048 - protein, 10 aa, Artificial Sequence
  Peptide Derived from Human Papillomavirus
VTVVDTTRST

SEQ ID NO: 9049 - protein, 8 aa, Artificial Sequence
  Peptide Derived from Human Papillomavirus
VVATDSYV

SEQ ID NO: 9050 - protein, 11 aa, Artificial Sequence
  Peptide Derived from Human Papillomavirus
VVATDSYVKRT

SEQ ID NO: 9051 - protein, 8 aa, Artificial Sequence
  Peptide Derived from Human Papillomavirus
VVDTTRST

SEQ ID NO: 9052 - protein, 10 aa, Artificial Sequence
  Peptide Derived from Human Papillomavirus
VVDTTRSTNM

SEQ ID NO: 9053 - protein, 11 aa, Artificial Sequence
  Peptide Derived from Human Papillomavirus
VVDTTRSTNMT

SEQ ID NO: 9054 - protein, 8 aa, Artificial Sequence
  Peptide Derived from Human Papillomavirus
WACVGLEV

SEQ ID NO: 9055 - protein, 10 aa, Artificial Sequence
  Peptide Derived from Human Papillomavirus
WTKGAVCKST

SEQ ID NO: 9056 - protein, 8 aa, Artificial Sequence
  Peptide Derived from Human Papillomavirus
YIYRDPPL

SEQ ID NO: 9057 - protein, 9 aa, Artificial Sequence
  Peptide Derived from Human Papillomavirus
YLHNMNANL

SEQ ID NO: 9058 - protein, 10 aa, Artificial Sequence
  Peptide Derived from Human Papillomavirus
YLHNMNANLL

SEQ ID NO: 9059 - protein, 8 aa, Artificial Sequence
  Peptide Derived from Human Papillomavirus
YLKMSADA

SEQ ID NO: 9060 - protein, 10 aa, Artificial Sequence
  Peptide Derived from Human Papillomavirus
YLPPTPVSKV

SEQ ID NO: 9061 - protein, 11 aa, Artificial Sequence
  Peptide Derived from Human Papillomavirus
YLPPTPVSKVV

SEQ ID NO: 9062 - protein, 10 aa, Artificial Sequence
  Peptide Derived from Human Papillomavirus
YLRHVEEYEL

SEQ ID NO: 9063 - protein, 9 aa, Artificial Sequence
  Peptide Derived from Human Papillomavirus
YLRREQLFA

SEQ ID NO: 9064 - protein, 8 aa, Artificial Sequence
  Peptide Derived from Human Papillomavirus
YQYRVFRV

SEQ ID NO: 9065 - protein, 10 aa, Artificial Sequence
  Peptide Derived from Human Papillomavirus
YQYRVFRVRL

SEQ ID NO: 9066 - protein, 9 aa, Artificial Sequence
  Peptide Derived from Human Papillomavirus
YVATPSGSM

SEQ ID NO: 9067 - protein, 10 aa, Artificial Sequence
  Peptide Derived from Human Papillomavirus
YVATPSGSMI

SEQ ID NO: 9068 - protein, 11 aa, Artificial Sequence
  Peptide Derived from Human Papillomavirus
YVATPSGSMIT

SEQ ID NO: 9069 - protein, 11 aa, Artificial Sequence
  Peptide Derived from Human Papillomavirus
YVKRTSIFYHA

SEQ ID NO: 9070 - protein, 8 aa, Artificial Sequence
  Peptide Derived from Human Papillomavirus
YVRSTAIT

SEQ ID NO: 9071 - protein, 9 aa, Artificial Sequence
  Peptide Derived from Human Papillomavirus
AAPRLYRKA

SEQ ID NO: 9072 - protein, 8 aa, Artificial Sequence
  Peptide Derived from Human Papillomavirus
ALHRPAFT

SEQ ID NO: 9073 - protein, 9 aa, Artificial Sequence
  Peptide Derived from Human Papillomavirus
ALHRPAFTT

SEQ ID NO: 9074 - protein, 8 aa, Artificial Sequence
  Peptide Derived from Human Papillomavirus
AQAEEIEM

SEQ ID NO: 9075 - protein, 11 aa, Artificial Sequence
  Peptide Derived from Human Papillomavirus
AQAEEIEMQPL

SEQ ID NO: 9076 - protein, 9 aa, Artificial Sequence
  Peptide Derived from Human Papillomavirus
ATIQTRRGT

SEQ ID NO: 9077 - protein, 11 aa, Artificial Sequence
  Peptide Derived from Human Papillomavirus
ATIQTRRGTQI

SEQ ID NO: 9078 - protein, 10 aa, Artificial Sequence
  Peptide Derived from Human Papillomavirus
ATLVSADNPL

SEQ ID NO: 9079 - protein, 9 aa, Artificial Sequence
  Peptide Derived from Human Papillomavirus
ATPSAHLPI

SEQ ID NO: 9080 - protein, 10 aa, Artificial Sequence
  Peptide Derived from Human Papillomavirus
ATQLYKTCKL

SEQ ID NO: 9081 - protein, 9 aa, Artificial Sequence
  Peptide Derived from Human Papillomavirus
ATRRKRASA

SEQ ID NO: 9082 - protein, 10 aa, Artificial Sequence
  Peptide Derived from Human Papillomavirus
ATRRKRASAT

SEQ ID NO: 9083 - protein, 10 aa, Artificial Sequence
  Peptide Derived from Human Papillomavirus
AVHGSGTEPI

SEQ ID NO: 9084 - protein, 8 aa, Artificial Sequence
  Peptide Derived from Human Papillomavirus
AVLDITPT

SEQ ID NO: 9085 - protein, 11 aa, Artificial Sequence
  Peptide Derived from Human Papillomavirus
AVLDITPTSST

SEQ ID NO: 9086 - protein, 8 aa, Artificial Sequence
  Peptide Derived from Human Papillomavirus
DISPIAQA

SEQ ID NO: 9087 - protein, 11 aa, Artificial Sequence
  Peptide Derived from Human Papillomavirus
DISPIAQAEEI

SEQ ID NO: 9088 - protein, 8 aa, Artificial Sequence
  Peptide Derived from Human Papillomavirus
DITPTSST

SEQ ID NO: 9089 - protein, 9 aa, Artificial Sequence
  Peptide Derived from Human Papillomavirus
DITPTSSTV

SEQ ID NO: 9090 - protein, 11 aa, Artificial Sequence
  Peptide Derived from Human Papillomavirus
DITPTSSTVHV

SEQ ID NO: 9091 - protein, 10 aa, Artificial Sequence
  Peptide Derived from Human Papillomavirus
DIVLPTGPST

SEQ ID NO: 9092 - protein, 10 aa, Artificial Sequence
  Peptide Derived from Human Papillomavirus
DIYANIDDEA

SEQ ID NO: 9093 - protein, 11 aa, Artificial Sequence
  Peptide Derived from Human Papillomavirus
DTSLAFSPSGV

SEQ ID NO: 9094 - protein, 8 aa, Artificial Sequence
  Peptide Derived from Human Papillomavirus
DVTHDVYI

SEQ ID NO: 9095 - protein, 9 aa, Artificial Sequence
  Peptide Derived from Human Papillomavirus
DVTPARPPI

SEQ ID NO: 9096 - protein, 10 aa, Artificial Sequence
  Peptide Derived from Human Papillomavirus
DVTPARPPIV

SEQ ID NO: 9097 - protein, 11 aa, Artificial Sequence
  Peptide Derived from Human Papillomavirus
DVTPARPPIVV

SEQ ID NO: 9098 - protein, 10 aa, Artificial Sequence
  Peptide Derived from Human Papillomavirus
DVVNKIEQKT

SEQ ID NO: 9099 - protein, 10 aa, Artificial Sequence
  Peptide Derived from Human Papillomavirus
DVYIQGSSFA

SEQ ID NO: 9100 - protein, 11 aa, Artificial Sequence
  Peptide Derived from Human Papillomavirus
DVYIQGSSFAL

SEQ ID NO: 9101 - protein, 10 aa, Artificial Sequence
  Peptide Derived from Human Papillomavirus
EAPGLSSQSV

SEQ ID NO: 9102 - protein, 11 aa, Artificial Sequence
  Peptide Derived from Human Papillomavirus
EAPGLSSQSVA

SEQ ID NO: 9103 - protein, 8 aa, Artificial Sequence
  Peptide Derived from Human Papillomavirus
EAPQTGEV

SEQ ID NO: 9104 - protein, 8 aa, Artificial Sequence
  Peptide Derived from Human Papillomavirus
EIEMQPLL

SEQ ID NO: 9105 - protein, 10 aa, Artificial Sequence
  Peptide Derived from Human Papillomavirus
EIEMQPLLSA

SEQ ID NO: 9106 - protein, 8 aa, Artificial Sequence
  Peptide Derived from Human Papillomavirus
EIPMQTFA

SEQ ID NO: 9107 - protein, 9 aa, Artificial Sequence
  Peptide Derived from Human Papillomavirus
EIPMQTFAV

SEQ ID NO: 9108 - protein, 8 aa, Artificial Sequence
  Peptide Derived from Human Papillomavirus
EITSSSTT

SEQ ID NO: 9109 - protein, 9 aa, Artificial Sequence
  Peptide Derived from Human Papillomavirus
EITSSSTTT

SEQ ID NO: 9110 - protein, 11 aa, Artificial Sequence
  Peptide Derived from Human Papillomavirus
EITSSSTTTPA

SEQ ID NO: 9111 - protein, 8 aa, Artificial Sequence
  Peptide Derived from Human Papillomavirus
EMQPLLSA

SEQ ID NO: 9112 - protein, 9 aa, Artificial Sequence
  Peptide Derived from Human Papillomavirus
EQKTWADKI

SEQ ID NO: 9113 - protein, 10 aa, Artificial Sequence
  Peptide Derived from Human Papillomavirus
EQKTWADKIL

SEQ ID NO: 9114 - protein, 10 aa, Artificial Sequence
  Peptide Derived from Human Papillomavirus
ETPFYSGPDI

SEQ ID NO: 9115 - protein, 11 aa, Artificial Sequence
  Peptide Derived from Human Papillomavirus
ETPFYSGPDIV

SEQ ID NO: 9116 - protein, 8 aa, Artificial Sequence
  Peptide Derived from Human Papillomavirus
EVSGNILI

SEQ ID NO: 9117 - protein, 10 aa, Artificial Sequence
  Peptide Derived from Human Papillomavirus
EVSGNILIST

SEQ ID NO: 9118 - protein, 8 aa, Artificial Sequence
  Peptide Derived from Human Papillomavirus
FADGDVAA

SEQ ID NO: 9119 - protein, 8 aa, Artificial Sequence
  Peptide Derived from Human Papillomavirus
FASNTTNV

SEQ ID NO: 9120 - protein, 9 aa, Artificial Sequence
  Peptide Derived from Human Papillomavirus
FASNTTNVT

SEQ ID NO: 9121 - protein, 10 aa, Artificial Sequence
  Peptide Derived from Human Papillomavirus
FASNTTNVTA

SEQ ID NO: 9122 - protein, 8 aa, Artificial Sequence
  Peptide Derived from Human Papillomavirus
FAVHGSGT

SEQ ID NO: 9123 - protein, 11 aa, Artificial Sequence
  Peptide Derived from Human Papillomavirus
FAVHGSGTEPI

SEQ ID NO: 9124 - protein, 9 aa, Artificial Sequence
  Peptide Derived from Human Papillomavirus
FIDPPVIEA

SEQ ID NO: 9125 - protein, 8 aa, Artificial Sequence
  Peptide Derived from Human Papillomavirus
FLDRPATL

SEQ ID NO: 9126 - protein, 9 aa, Artificial Sequence
  Peptide Derived from Human Papillomavirus
FLDRPATLV

SEQ ID NO: 9127 - protein, 11 aa, Artificial Sequence
  Peptide Derived from Human Papillomavirus
FLDRPATLVSA

SEQ ID NO: 9128 - protein, 11 aa, Artificial Sequence
  Peptide Derived from Human Papillomavirus
FMNIVALHRPA

SEQ ID NO: 9129 - protein, 10 aa, Artificial Sequence
  Peptide Derived from Human Papillomavirus
FQQVKVTDPA

SEQ ID NO: 9130 - protein, 9 aa, Artificial Sequence
  Peptide Derived from Human Papillomavirus
FTGSGGFEI

SEQ ID NO: 9131 - protein, 10 aa, Artificial Sequence
  Peptide Derived from Human Papillomavirus
FTGSGGFEIT

SEQ ID NO: 9132 - protein, 8 aa, Artificial Sequence
  Peptide Derived from Human Papillomavirus
FTTRRGGV

SEQ ID NO: 9133 - protein, 9 aa, Artificial Sequence
  Peptide Derived from Human Papillomavirus
FTYFGGLGI

SEQ ID NO: 9134 - protein, 11 aa, Artificial Sequence
  Peptide Derived from Human Papillomavirus
FTYFGGLGIGT

SEQ ID NO: 9135 - protein, 9 aa, Artificial Sequence
  Peptide Derived from Human Papillomavirus
FVPQSPYDV

SEQ ID NO: 9136 - protein, 10 aa, Artificial Sequence
  Peptide Derived from Human Papillomavirus
FVPQSPYDVT

SEQ ID NO: 9137 - protein, 8 aa, Artificial Sequence
  Peptide Derived from Human Papillomavirus
GAGIPNFT

SEQ ID NO: 9138 - protein, 10 aa, Artificial Sequence
  Peptide Derived from Human Papillomavirus
GARVHYYYDI

SEQ ID NO: 9139 - protein, 8 aa, Artificial Sequence
  Peptide Derived from Human Papillomavirus
GIHSYEEI

SEQ ID NO: 9140 - protein, 10 aa, Artificial Sequence
  Peptide Derived from Human Papillomavirus
GIHSYEEIPM

SEQ ID NO: 9141 - protein, 8 aa, Artificial Sequence
  Peptide Derived from Human Papillomavirus
GLGIGTGT

SEQ ID NO: 9142 - protein, 8 aa, Artificial Sequence
  Peptide Derived from Human Papillomavirus
GLSSQSVA

SEQ ID NO: 9143 - protein, 9 aa, Artificial Sequence
  Peptide Derived from Human Papillomavirus
GLSSQSVAT

SEQ ID NO: 9144 - protein, 9 aa, Artificial Sequence
  Peptide Derived from Human Papillomavirus
GLYDIYANI

SEQ ID NO: 9145 - protein, 8 aa, Artificial Sequence
  Peptide Derived from Human Papillomavirus
GTCPEDVV

SEQ ID NO: 9146 - protein, 11 aa, Artificial Sequence
  Peptide Derived from Human Papillomavirus
GTCPEDVVNKI

SEQ ID NO: 9147 - protein, 8 aa, Artificial Sequence
  Peptide Derived from Human Papillomavirus
GTEPISST

SEQ ID NO: 9148 - protein, 10 aa, Artificial Sequence
  Peptide Derived from Human Papillomavirus
GTEPISSTPI

SEQ ID NO: 9149 - protein, 8 aa, Artificial Sequence
  Peptide Derived from Human Papillomavirus
GTGSGGRA

SEQ ID NO: 9150 - protein, 11 aa, Artificial Sequence
  Peptide Derived from Human Papillomavirus
GTGSGGRAGYV

SEQ ID NO: 9151 - protein, 10 aa, Artificial Sequence
  Peptide Derived from Human Papillomavirus
GTGTGSGGRA

SEQ ID NO: 9152 - protein, 8 aa, Artificial Sequence
  Peptide Derived from Human Papillomavirus
GTQIGARV

SEQ ID NO: 9153 - protein, 9 aa, Artificial Sequence
  Peptide Derived from Human Papillomavirus
GVAPDPDFM

SEQ ID NO: 9154 - protein, 11 aa, Artificial Sequence
  Peptide Derived from Human Papillomavirus
GVAPDPDFMNI

SEQ ID NO: 9155 - protein, 11 aa, Artificial Sequence
  Peptide Derived from Human Papillomavirus
GVRFSRLGRKA

SEQ ID NO: 9156 - protein, 8 aa, Artificial Sequence
  Peptide Derived from Human Papillomavirus
HITNPLFI

SEQ ID NO: 9157 - protein, 8 aa, Artificial Sequence
  Peptide Derived from Human Papillomavirus
HLPIKPST

SEQ ID NO: 9158 - protein, 9 aa, Artificial Sequence
  Peptide Derived from Human Papillomavirus
HLPIKPSTL

SEQ ID NO: 9159 - protein, 8 aa, Artificial Sequence
  Peptide Derived from Human Papillomavirus
HVSSTHIT

SEQ ID NO: 9160 - protein, 11 aa, Artificial Sequence
  Peptide Derived from Human Papillomavirus
HVSSTHITNPL

SEQ ID NO: 9161 - protein, 10 aa, Artificial Sequence
  Peptide Derived from Human Papillomavirus
IAAPRLYRKA

SEQ ID NO: 9162 - protein, 9 aa, Artificial Sequence
  Peptide Derived from Human Papillomavirus
IAQAEEIEM

SEQ ID NO: 9163 - protein, 10 aa, Artificial Sequence
  Peptide Derived from Human Papillomavirus
ILISTPTSGI

SEQ ID NO: 9164 - protein, 9 aa, Artificial Sequence
  Peptide Derived from Human Papillomavirus
ILQWGSLFT

SEQ ID NO: 9165 - protein, 8 aa, Artificial Sequence
  Peptide Derived from Human Papillomavirus
IQGSSFAL

SEQ ID NO: 9166 - protein, 11 aa, Artificial Sequence
  Peptide Derived from Human Papillomavirus
IQGSSFALWPV

SEQ ID NO: 9167 - protein, 9 aa, Artificial Sequence
  Peptide Derived from Human Papillomavirus
IQTRRGTQI

SEQ ID NO: 9168 - protein, 11 aa, Artificial Sequence
  Peptide Derived from Human Papillomavirus
IQTRRGTQIGA

SEQ ID NO: 9169 - protein, 11 aa, Artificial Sequence
  Peptide Derived from Human Papillomavirus
ITNPLFIDPPV

SEQ ID NO: 9170 - protein, 8 aa, Artificial Sequence
  Peptide Derived from Human Papillomavirus
ITPTSSTV

SEQ ID NO: 9171 - protein, 10 aa, Artificial Sequence
  Peptide Derived from Human Papillomavirus
ITPTSSTVHV

SEQ ID NO: 9172 - protein, 8 aa, Artificial Sequence
  Peptide Derived from Human Papillomavirus
ITSSSTTT

SEQ ID NO: 9173 - protein, 10 aa, Artificial Sequence
  Peptide Derived from Human Papillomavirus
ITSSSTTTPA

SEQ ID NO: 9174 - protein, 11 aa, Artificial Sequence
  Peptide Derived from Human Papillomavirus
ITSSSTTTPAV

SEQ ID NO: 9175 - protein, 8 aa, Artificial Sequence
  Peptide Derived from Human Papillomavirus
IVALHRPA

SEQ ID NO: 9176 - protein, 10 aa, Artificial Sequence
  Peptide Derived from Human Papillomavirus
IVALHRPAFT

SEQ ID NO: 9177 - protein, 11 aa, Artificial Sequence
  Peptide Derived from Human Papillomavirus
IVALHRPAFTT

SEQ ID NO: 9178 - protein, 11 aa, Artificial Sequence
  Peptide Derived from Human Papillomavirus
IVDVTPARPPI

SEQ ID NO: 9179 - protein, 9 aa, Artificial Sequence
  Peptide Derived from Human Papillomavirus
IVLPTGPST

SEQ ID NO: 9180 - protein, 10 aa, Artificial Sequence
  Peptide Derived from Human Papillomavirus
IVTLVEESSV

SEQ ID NO: 9181 - protein, 11 aa, Artificial Sequence
  Peptide Derived from Human Papillomavirus
IVTLVEESSVI

SEQ ID NO: 9182 - protein, 9 aa, Artificial Sequence
  Peptide Derived from Human Papillomavirus
IVVESVGPT

SEQ ID NO: 9183 - protein, 8 aa, Artificial Sequence
  Peptide Derived from Human Papillomavirus
KAFQQVKV

SEQ ID NO: 9184 - protein, 9 aa, Artificial Sequence
  Peptide Derived from Human Papillomavirus
KAFQQVKVT

SEQ ID NO: 9185 - protein, 10 aa, Artificial Sequence
  Peptide Derived from Human Papillomavirus
KATIQTRRGT

SEQ ID NO: 9186 - protein, 8 aa, Artificial Sequence
  Peptide Derived from Human Papillomavirus
KIEQKTWA

SEQ ID NO: 9187 - protein, 11 aa, Artificial Sequence
  Peptide Derived from Human Papillomavirus
KIEQKTWADKI

SEQ ID NO: 9188 - protein, 8 aa, Artificial Sequence
  Peptide Derived from Human Papillomavirus
KILQWGSL

SEQ ID NO: 9189 - protein, 10 aa, Artificial Sequence
  Peptide Derived from Human Papillomavirus
KILQWGSLFT

SEQ ID NO: 9190 - protein, 10 aa, Artificial Sequence
  Peptide Derived from Human Papillomavirus
KLSGTCPEDV

SEQ ID NO: 9191 - protein, 11 aa, Artificial Sequence
  Peptide Derived from Human Papillomavirus
KLSGTCPEDVV

SEQ ID NO: 9192 - protein, 8 aa, Artificial Sequence
  Peptide Derived from Human Papillomavirus
KTCKLSGT

SEQ ID NO: 9193 - protein, 8 aa, Artificial Sequence
  Peptide Derived from Human Papillomavirus
KTWADKIL

SEQ ID NO: 9194 - protein, 8 aa, Artificial Sequence
  Peptide Derived from Human Papillomavirus
KVTDPAFL

SEQ ID NO: 9195 - protein, 8 aa, Artificial Sequence
  Peptide Derived from Human Papillomavirus
LAFSPSGV

SEQ ID NO: 9196 - protein, 9 aa, Artificial Sequence
  Peptide Derived from Human Papillomavirus
LAFSPSGVA

SEQ ID NO: 9197 - protein, 9 aa, Artificial Sequence
  Peptide Derived from Human Papillomavirus
LISTPTSGI

SEQ ID NO: 9198 - protein, 11 aa, Artificial Sequence
  Peptide Derived from Human Papillomavirus
LLSANNSFDGL

SEQ ID NO: 9199 - protein, 8 aa, Artificial Sequence
  Peptide Derived from Human Papillomavirus
LQWGSLFT

SEQ ID NO: 9200 - protein, 8 aa, Artificial Sequence
  Peptide Derived from Human Papillomavirus
LVEESSVI

SEQ ID NO: 9201 - protein, 8 aa, Artificial Sequence
  Peptide Derived from Human Papillomavirus
LVSADNPL

SEQ ID NO: 9202 - protein, 11 aa, Artificial Sequence
  Peptide Derived from Human Papillomavirus
MQTFAVHGSGT

SEQ ID NO: 9203 - protein, 9 aa, Artificial Sequence
  Peptide Derived from Human Papillomavirus
NIDDEAPGL

SEQ ID NO: 9204 - protein, 8 aa, Artificial Sequence
  Peptide Derived from Human Papillomavirus
NILISTPT

SEQ ID NO: 9205 - protein, 11 aa, Artificial Sequence
  Peptide Derived from Human Papillomavirus
NILISTPTSGI

SEQ ID NO: 9206 - protein, 9 aa, Artificial Sequence
  Peptide Derived from Human Papillomavirus
NIVALHRPA

SEQ ID NO: 9207 - protein, 11 aa, Artificial Sequence
  Peptide Derived from Human Papillomavirus
NIVALHRPAFT

SEQ ID NO: 9208 - protein, 9 aa, Artificial Sequence
  Peptide Derived from Human Papillomavirus
NTTNVTAPL

SEQ ID NO: 9209 - protein, 9 aa, Artificial Sequence
  Peptide Derived from Human Papillomavirus
NVTAPLGNV

SEQ ID NO: 9210 - protein, 8 aa, Artificial Sequence
  Peptide Derived from Human Papillomavirus
PAFLDRPA

SEQ ID NO: 9211 - protein, 9 aa, Artificial Sequence
  Peptide Derived from Human Papillomavirus
PAFLDRPAT

SEQ ID NO: 9212 - protein, 10 aa, Artificial Sequence
  Peptide Derived from Human Papillomavirus
PAFLDRPATL

SEQ ID NO: 9213 - protein, 11 aa, Artificial Sequence
  Peptide Derived from Human Papillomavirus
PAFLDRPATLV

SEQ ID NO: 9214 - protein, 10 aa, Artificial Sequence
  Peptide Derived from Human Papillomavirus
PAFTTRRGGV

SEQ ID NO: 9215 - protein, 8 aa, Artificial Sequence
  Peptide Derived from Human Papillomavirus
PARPPIVV

SEQ ID NO: 9216 - protein, 11 aa, Artificial Sequence
  Peptide Derived from Human Papillomavirus
PARPPIVVESV

SEQ ID NO: 9217 - protein, 11 aa, Artificial Sequence
  Peptide Derived from Human Papillomavirus
PATLVSADNPL

SEQ ID NO: 9218 - protein, 9 aa, Artificial Sequence
  Peptide Derived from Human Papillomavirus
PAVLDITPT

SEQ ID NO: 9219 - protein, 8 aa, Artificial Sequence
  Peptide Derived from Human Papillomavirus
PIAQAEEI

SEQ ID NO: 9220 - protein, 10 aa, Artificial Sequence
  Peptide Derived from Human Papillomavirus
PIAQAEEIEM

SEQ ID NO: 9221 - protein, 10 aa, Artificial Sequence
  Peptide Derived from Human Papillomavirus
PIKPSTLSFA

SEQ ID NO: 9222 - protein, 8 aa, Artificial Sequence
  Peptide Derived from Human Papillomavirus
PIPGFRRI

SEQ ID NO: 9223 - protein, 9 aa, Artificial Sequence
  Peptide Derived from Human Papillomavirus
PIPGFRRIA

SEQ ID NO: 9224 - protein, 10 aa, Artificial Sequence
  Peptide Derived from Human Papillomavirus
PIPGFRRIAA

SEQ ID NO: 9225 - protein, 10 aa, Artificial Sequence
  Peptide Derived from Human Papillomavirus
PIVVESVGPT

SEQ ID NO: 9226 - protein, 8 aa, Artificial Sequence
  Peptide Derived from Human Papillomavirus
PLFEGTDT

SEQ ID NO: 9227 - protein, 10 aa, Artificial Sequence
  Peptide Derived from Human Papillomavirus
PLFEGTDTSL

SEQ ID NO: 9228 - protein, 11 aa, Artificial Sequence
  Peptide Derived from Human Papillomavirus
PLFEGTDTSLA

SEQ ID NO: 9229 - protein, 8 aa, Artificial Sequence
  Peptide Derived from Human Papillomavirus
PLFIDPPV

SEQ ID NO: 9230 - protein, 9 aa, Artificial Sequence
  Peptide Derived from Human Papillomavirus
PLFIDPPVI

SEQ ID NO: 9231 - protein, 11 aa, Artificial Sequence
  Peptide Derived from Human Papillomavirus
PLFIDPPVIEA

SEQ ID NO: 9232 - protein, 8 aa, Artificial Sequence
  Peptide Derived from Human Papillomavirus
PLGNVWET

SEQ ID NO: 9233 - protein, 8 aa, Artificial Sequence
  Peptide Derived from Human Papillomavirus
PLGSRPST

SEQ ID NO: 9234 - protein, 9 aa, Artificial Sequence
  Peptide Derived from Human Papillomavirus
PLGSRPSTI

SEQ ID NO: 9235 - protein, 10 aa, Artificial Sequence
  Peptide Derived from Human Papillomavirus
PLGSRPSTIV

SEQ ID NO: 9236 - protein, 8 aa, Artificial Sequence
  Peptide Derived from Human Papillomavirus
PQSPYDVT

SEQ ID NO: 9237 - protein, 11 aa, Artificial Sequence
  Peptide Derived from Human Papillomavirus
PQSPYDVTHDV

SEQ ID NO: 9238 - protein, 10 aa, Artificial Sequence
  Peptide Derived from Human Papillomavirus
PQTGEVSGNI

SEQ ID NO: 9239 - protein, 11 aa, Artificial Sequence
  Peptide Derived from Human Papillomavirus
PQTGEVSGNIL

SEQ ID NO: 9240 - protein, 8 aa, Artificial Sequence
  Peptide Derived from Human Papillomavirus
PTDPSIVT

SEQ ID NO: 9241 - protein, 9 aa, Artificial Sequence
  Peptide Derived from Human Papillomavirus
PTDPSIVTL

SEQ ID NO: 9242 - protein, 10 aa, Artificial Sequence
  Peptide Derived from Human Papillomavirus
PTDPSIVTLV

SEQ ID NO: 9243 - protein, 10 aa, Artificial Sequence
  Peptide Derived from Human Papillomavirus
PTGPSTWPFV

SEQ ID NO: 9244 - protein, 11 aa, Artificial Sequence
  Peptide Derived from Human Papillomavirus
PTSGIHSYEEI

SEQ ID NO: 9245 - protein, 8 aa, Artificial Sequence
  Peptide Derived from Human Papillomavirus
PTSSTVHV

SEQ ID NO: 9246 - protein, 11 aa, Artificial Sequence
  Peptide Derived from Human Papillomavirus
PTSSTVHVSST

SEQ ID NO: 9247 - protein, 8 aa, Artificial Sequence
  Peptide Derived from Human Papillomavirus
PVIEAPQT

SEQ ID NO: 9248 - protein, 11 aa, Artificial Sequence
  Peptide Derived from Human Papillomavirus
PVIEAPQTGEV

SEQ ID NO: 9249 - protein, 10 aa, Artificial Sequence
  Peptide Derived from Human Papillomavirus
QAEEIEMQPL

SEQ ID NO: 9250 - protein, 11 aa, Artificial Sequence
  Peptide Derived from Human Papillomavirus
QAEEIEMQPLL

SEQ ID NO: 9251 - protein, 8 aa, Artificial Sequence
  Peptide Derived from Human Papillomavirus
QLYKTCKL

SEQ ID NO: 9252 - protein, 11 aa, Artificial Sequence
  Peptide Derived from Human Papillomavirus
QLYKTCKLSGT

SEQ ID NO: 9253 - protein, 9 aa, Artificial Sequence
  Peptide Derived from Human Papillomavirus
QQVKVTDPA

SEQ ID NO: 9254 - protein, 11 aa, Artificial Sequence
  Peptide Derived from Human Papillomavirus
QQVKVTDPAFL

SEQ ID NO: 9255 - protein, 10 aa, Artificial Sequence
  Peptide Derived from Human Papillomavirus
QTFAVHGSGT

SEQ ID NO: 9256 - protein, 9 aa, Artificial Sequence
  Peptide Derived from Human Papillomavirus
QTGEVSGNI

SEQ ID NO: 9257 - protein, 10 aa, Artificial Sequence
  Peptide Derived from Human Papillomavirus
QTGEVSGNIL

SEQ ID NO: 9258 - protein, 11 aa, Artificial Sequence
  Peptide Derived from Human Papillomavirus
QTGEVSGNILI

SEQ ID NO: 9259 - protein, 8 aa, Artificial Sequence
  Peptide Derived from Human Papillomavirus
QTRRGTQI

SEQ ID NO: 9260 - protein, 10 aa, Artificial Sequence
  Peptide Derived from Human Papillomavirus
QTRRGTQIGA

SEQ ID NO: 9261 - protein, 8 aa, Artificial Sequence
  Peptide Derived from Human Papillomavirus
QVKVTDPA

SEQ ID NO: 9262 - protein, 10 aa, Artificial Sequence
  Peptide Derived from Human Papillomavirus
QVKVTDPAFL

SEQ ID NO: 9263 - protein, 10 aa, Artificial Sequence
  Peptide Derived from Human Papillomavirus
RASATQLYKT

SEQ ID NO: 9264 - protein, 8 aa, Artificial Sequence
  Peptide Derived from Human Papillomavirus
RATRRKRA

SEQ ID NO: 9265 - protein, 10 aa, Artificial Sequence
  Peptide Derived from Human Papillomavirus
RATRRKRASA

SEQ ID NO: 9266 - protein, 11 aa, Artificial Sequence
  Peptide Derived from Human Papillomavirus
RATRRKRASAT

SEQ ID NO: 9267 - protein, 11 aa, Artificial Sequence
  Peptide Derived from Human Papillomavirus
RIAAPRLYRKA

SEQ ID NO: 9268 - protein, 11 aa, Artificial Sequence
  Peptide Derived from Human Papillomavirus
RIPYFFADGDV

SEQ ID NO: 9269 - protein, 8 aa, Artificial Sequence
  Peptide Derived from Human Papillomavirus
RLGRKATI

SEQ ID NO: 9270 - protein, 10 aa, Artificial Sequence
  Peptide Derived from Human Papillomavirus
RLGRKATIQT

SEQ ID NO: 9271 - protein, 10 aa, Artificial Sequence
  Peptide Derived from Human Papillomavirus
RLYRKAFQQV

SEQ ID NO: 9272 - protein, 8 aa, Artificial Sequence
  Peptide Derived from Human Papillomavirus
RVHYYYDI

SEQ ID NO: 9273 - protein, 11 aa, Artificial Sequence
  Peptide Derived from Human Papillomavirus
RVHYYYDISPI

SEQ ID NO: 9274 - protein, 10 aa, Artificial Sequence
  Peptide Derived from Human Papillomavirus
SADNPLFEGT

SEQ ID NO: 9275 - protein, 10 aa, Artificial Sequence
  Peptide Derived from Human Papillomavirus
SAHLPIKPST

SEQ ID NO: 9276 - protein, 11 aa, Artificial Sequence
  Peptide Derived from Human Papillomavirus
SAHLPIKPSTL

SEQ ID NO: 9277 - protein, 9 aa, Artificial Sequence
  Peptide Derived from Human Papillomavirus
SANNSFDGL

SEQ ID NO: 9278 - protein, 8 aa, Artificial Sequence
  Peptide Derived from Human Papillomavirus
SATQLYKT

SEQ ID NO: 9279 - protein, 11 aa, Artificial Sequence
  Peptide Derived from Human Papillomavirus
SATQLYKTCKL

SEQ ID NO: 9280 - protein, 11 aa, Artificial Sequence
  Peptide Derived from Human Papillomavirus
SIVTLVEESSV

SEQ ID NO: 9281 - protein, 9 aa, Artificial Sequence
  Peptide Derived from Human Papillomavirus
SLAFSPSGV

SEQ ID NO: 9282 - protein, 10 aa, Artificial Sequence
  Peptide Derived from Human Papillomavirus
SLAFSPSGVA

SEQ ID NO: 9283 - protein, 9 aa, Artificial Sequence
  Peptide Derived from Human Papillomavirus
SLFTYFGGL

SEQ ID NO: 9284 - protein, 11 aa, Artificial Sequence
  Peptide Derived from Human Papillomavirus
SLFTYFGGLGI

SEQ ID NO: 9285 - protein, 9 aa, Artificial Sequence
  Peptide Derived from Human Papillomavirus
SQSVATPSA

SEQ ID NO: 9286 - protein, 11 aa, Artificial Sequence
  Peptide Derived from Human Papillomavirus
SQSVATPSAHL

SEQ ID NO: 9287 - protein, 8 aa, Artificial Sequence
  Peptide Derived from Human Papillomavirus
STHITNPL

SEQ ID NO: 9288 - protein, 10 aa, Artificial Sequence
  Peptide Derived from Human Papillomavirus
STHITNPLFI

SEQ ID NO: 9289 - protein, 9 aa, Artificial Sequence
  Peptide Derived from Human Papillomavirus
STIVDVTPA

SEQ ID NO: 9290 - protein, 9 aa, Artificial Sequence
  Peptide Derived from Human Papillomavirus
STLSFASNT

SEQ ID NO: 9291 - protein, 10 aa, Artificial Sequence
  Peptide Derived from Human Papillomavirus
STLSFASNTT

SEQ ID NO: 9292 - protein, 10 aa, Artificial Sequence
  Peptide Derived from Human Papillomavirus
STPIPGFRRI

SEQ ID NO: 9293 - protein, 11 aa, Artificial Sequence
  Peptide Derived from Human Papillomavirus
STPIPGFRRIA

SEQ ID NO: 9294 - protein, 8 aa, Artificial Sequence
  Peptide Derived from Human Papillomavirus
STTTPAVL

SEQ ID NO: 9295 - protein, 10 aa, Artificial Sequence
  Peptide Derived from Human Papillomavirus
STTTPAVLDI

SEQ ID NO: 9296 - protein, 11 aa, Artificial Sequence
  Peptide Derived from Human Papillomavirus
STTTPAVLDIT

SEQ ID NO: 9297 - protein, 8 aa, Artificial Sequence
  Peptide Derived from Human Papillomavirus
STVHVSST

SEQ ID NO: 9298 - protein, 10 aa, Artificial Sequence
  Peptide Derived from Human Papillomavirus
STVHVSSTHI

SEQ ID NO: 9299 - protein, 11 aa, Artificial Sequence
  Peptide Derived from Human Papillomavirus
STVHVSSTHIT

SEQ ID NO: 9300 - protein, 9 aa, Artificial Sequence
  Peptide Derived from Human Papillomavirus
SVATPSAHL

SEQ ID NO: 9301 - protein, 11 aa, Artificial Sequence
  Peptide Derived from Human Papillomavirus
SVATPSAHLPI

SEQ ID NO: 9302 - protein, 9 aa, Artificial Sequence
  Peptide Derived from Human Papillomavirus
SVGPTDPSI

SEQ ID NO: 9303 - protein, 10 aa, Artificial Sequence
  Peptide Derived from Human Papillomavirus
SVGPTDPSIV

SEQ ID NO: 9304 - protein, 11 aa, Artificial Sequence
  Peptide Derived from Human Papillomavirus
SVGPTDPSIVT

SEQ ID NO: 9305 - protein, 9 aa, Artificial Sequence
  Peptide Derived from Human Papillomavirus
SVIESGAGI

SEQ ID NO: 9306 - protein, 10 aa, Artificial Sequence
  Peptide Derived from Human Papillomavirus
TAPLGNVWET

SEQ ID NO: 9307 - protein, 8 aa, Artificial Sequence
  Peptide Derived from Human Papillomavirus
TIQTRRGT

SEQ ID NO: 9308 - protein, 10 aa, Artificial Sequence
  Peptide Derived from Human Papillomavirus
TIQTRRGTQI

SEQ ID NO: 9309 - protein, 8 aa, Artificial Sequence
  Peptide Derived from Human Papillomavirus
TIVDVTPA

SEQ ID NO: 9310 - protein, 8 aa, Artificial Sequence
  Peptide Derived from Human Papillomavirus
TLSFASNT

SEQ ID NO: 9311 - protein, 9 aa, Artificial Sequence
  Peptide Derived from Human Papillomavirus
TLSFASNTT

SEQ ID NO: 9312 - protein, 11 aa, Artificial Sequence
  Peptide Derived from Human Papillomavirus
TLSFASNTTNV

SEQ ID NO: 9313 - protein, 8 aa, Artificial Sequence
  Peptide Derived from Human Papillomavirus
TLVEESSV

SEQ ID NO: 9314 - protein, 9 aa, Artificial Sequence
  Peptide Derived from Human Papillomavirus
TLVEESSVI

SEQ ID NO: 9315 - protein, 9 aa, Artificial Sequence
  Peptide Derived from Human Papillomavirus
TLVSADNPL

SEQ ID NO: 9316 - protein, 9 aa, Artificial Sequence
  Peptide Derived from Human Papillomavirus
TQLYKTCKL

SEQ ID NO: 9317 - protein, 8 aa, Artificial Sequence
  Peptide Derived from Human Papillomavirus
TTNVTAPL

SEQ ID NO: 9318 - protein, 11 aa, Artificial Sequence
  Peptide Derived from Human Papillomavirus
TTNVTAPLGNV

SEQ ID NO: 9319 - protein, 8 aa, Artificial Sequence
  Peptide Derived from Human Papillomavirus
TTPAVLDI

SEQ ID NO: 9320 - protein, 9 aa, Artificial Sequence
  Peptide Derived from Human Papillomavirus
TTPAVLDIT

SEQ ID NO: 9321 - protein, 11 aa, Artificial Sequence
  Peptide Derived from Human Papillomavirus
TTPAVLDITPT

SEQ ID NO: 9322 - protein, 9 aa, Artificial Sequence
  Peptide Derived from Human Papillomavirus
TTTPAVLDI

SEQ ID NO: 9323 - protein, 10 aa, Artificial Sequence
  Peptide Derived from Human Papillomavirus
TTTPAVLDIT

SEQ ID NO: 9324 - protein, 9 aa, Artificial Sequence
  Peptide Derived from Human Papillomavirus
TVHVSSTHI

SEQ ID NO: 9325 - protein, 10 aa, Artificial Sequence
  Peptide Derived from Human Papillomavirus
TVHVSSTHIT

SEQ ID NO: 9326 - protein, 11 aa, Artificial Sequence
  Peptide Derived from Human Papillomavirus
VAHRATRRKRA

SEQ ID NO: 9327 - protein, 9 aa, Artificial Sequence
  Peptide Derived from Human Papillomavirus
VALHRPAFT

SEQ ID NO: 9328 - protein, 10 aa, Artificial Sequence
  Peptide Derived from Human Papillomavirus
VALHRPAFTT

SEQ ID NO: 9329 - protein, 8 aa, Artificial Sequence
  Peptide Derived from Human Papillomavirus
VAPDPDFM

SEQ ID NO: 9330 - protein, 10 aa, Artificial Sequence
  Peptide Derived from Human Papillomavirus
VAPDPDFMNI

SEQ ID NO: 9331 - protein, 11 aa, Artificial Sequence
  Peptide Derived from Human Papillomavirus
VAPDPDFMNIV

SEQ ID NO: 9332 - protein, 8 aa, Artificial Sequence
  Peptide Derived from Human Papillomavirus
VATPSAHL

SEQ ID NO: 9333 - protein, 10 aa, Artificial Sequence
  Peptide Derived from Human Papillomavirus
VATPSAHLPI

SEQ ID NO: 9334 - protein, 10 aa, Artificial Sequence
  Peptide Derived from Human Papillomavirus
VIEAPQTGEV

SEQ ID NO: 9335 - protein, 8 aa, Artificial Sequence
  Peptide Derived from Human Papillomavirus
VIESGAGI

SEQ ID NO: 9336 - protein, 10 aa, Artificial Sequence
  Peptide Derived from Human Papillomavirus
VLDITPTSST

SEQ ID NO: 9337 - protein, 11 aa, Artificial Sequence
  Peptide Derived from Human Papillomavirus
VLDITPTSSTV

SEQ ID NO: 9338 - protein, 8 aa, Artificial Sequence
  Peptide Derived from Human Papillomavirus
VLPTGPST

SEQ ID NO: 9339 - protein, 8 aa, Artificial Sequence
  Peptide Derived from Human Papillomavirus
VTAPLGNV

SEQ ID NO: 9340 - protein, 11 aa, Artificial Sequence
  Peptide Derived from Human Papillomavirus
VTAPLGNVWET

SEQ ID NO: 9341 - protein, 11 aa, Artificial Sequence
  Peptide Derived from Human Papillomavirus
VTDPAFLDRPA

SEQ ID NO: 9342 - protein, 9 aa, Artificial Sequence
  Peptide Derived from Human Papillomavirus
VTLVEESSV

SEQ ID NO: 9343 - protein, 10 aa, Artificial Sequence
  Peptide Derived from Human Papillomavirus
VTLVEESSVI

SEQ ID NO: 9344 - protein, 8 aa, Artificial Sequence
  Peptide Derived from Human Papillomavirus
VTPARPPI

SEQ ID NO: 9345 - protein, 9 aa, Artificial Sequence
  Peptide Derived from Human Papillomavirus
VTPARPPIV

SEQ ID NO: 9346 - protein, 10 aa, Artificial Sequence
  Peptide Derived from Human Papillomavirus
VTPARPPIVV

SEQ ID NO: 9347 - protein, 8 aa, Artificial Sequence
  Peptide Derived from Human Papillomavirus
VVESVGPT

SEQ ID NO: 9348 - protein, 9 aa, Artificial Sequence
  Peptide Derived from Human Papillomavirus
VVNKIEQKT

SEQ ID NO: 9349 - protein, 11 aa, Artificial Sequence
  Peptide Derived from Human Papillomavirus
VVNKIEQKTWA

SEQ ID NO: 9350 - protein, 11 aa, Artificial Sequence
  Peptide Derived from Human Papillomavirus
WADKILQWGSL

SEQ ID NO: 9351 - protein, 8 aa, Artificial Sequence
  Peptide Derived from Human Papillomavirus
YANIDDEA

SEQ ID NO: 9352 - protein, 11 aa, Artificial Sequence
  Peptide Derived from Human Papillomavirus
YANIDDEAPGL

SEQ ID NO: 9353 - protein, 8 aa, Artificial Sequence
  Peptide Derived from Human Papillomavirus
YIQGSSFA

SEQ ID NO: 9354 - protein, 9 aa, Artificial Sequence
  Peptide Derived from Human Papillomavirus
YIQGSSFAL

SEQ ID NO: 9355 - protein, 10 aa, Artificial Sequence
  Peptide Derived from Human Papillomavirus
YVPLGSRPST

SEQ ID NO: 9356 - protein, 11 aa, Artificial Sequence
  Peptide Derived from Human Papillomavirus
YVPLGSRPSTI

SEQ ID NO: 9357 - protein, 8 aa, Artificial Sequence
  Peptide Derived from Human Papillomavirus
AAALYWYK

SEQ ID NO: 9358 - protein, 8 aa, Artificial Sequence
  Peptide Derived from Human Papillomavirus
AAMLAKFK

SEQ ID NO: 9359 - protein, 9 aa, Artificial Sequence
  Peptide Derived from Human Papillomavirus
AICIEKQSR

SEQ ID NO: 9360 - protein, 9 aa, Artificial Sequence
  Peptide Derived from Human Papillomavirus
ALFTAQEAK

SEQ ID NO: 9361 - protein, 11 aa, Artificial Sequence
  Peptide Derived from Human Papillomavirus
ALKRFLQGIPK

SEQ ID NO: 9362 - protein, 8 aa, Artificial Sequence
  Peptide Derived from Human Papillomavirus
ATMCRHYK

SEQ ID NO: 9363 - protein, 9 aa, Artificial Sequence
  Peptide Derived from Human Papillomavirus
ATMCRHYKR

SEQ ID NO: 9364 - protein, 8 aa, Artificial Sequence
  Peptide Derived from Human Papillomavirus
AVQVLKRK

SEQ ID NO: 9365 - protein, 9 aa, Artificial Sequence
  Peptide Derived from Human Papillomavirus
CATMCRHYK

SEQ ID NO: 9366 - protein, 10 aa, Artificial Sequence
  Peptide Derived from Human Papillomavirus
CATMCRHYKR

SEQ ID NO: 9367 - protein, 10 aa, Artificial Sequence
  Peptide Derived from Human Papillomavirus
CIEKQSRAAK

SEQ ID NO: 9368 - protein, 11 aa, Artificial Sequence
  Peptide Derived from Human Papillomavirus
CIEKQSRAAKR

SEQ ID NO: 9369 - protein, 8 aa, Artificial Sequence
  Peptide Derived from Human Papillomavirus
CMMIEPPK

SEQ ID NO: 9370 - protein, 10 aa, Artificial Sequence
  Peptide Derived from Human Papillomavirus
CMMIEPPKLR

SEQ ID NO: 9371 - protein, 9 aa, Artificial Sequence
  Peptide Derived from Human Papillomavirus
CVDNNISPR

SEQ ID NO: 9372 - protein, 11 aa, Artificial Sequence
  Peptide Derived from Human Papillomavirus
CVDNNISPRLK

SEQ ID NO: 9373 - protein, 8 aa, Artificial Sequence
  Peptide Derived from Human Papillomavirus
DAVQVLKR

SEQ ID NO: 9374 - protein, 9 aa, Artificial Sequence
  Peptide Derived from Human Papillomavirus
DAVQVLKRK

SEQ ID NO: 9375 - protein, 11 aa, Artificial Sequence
  Peptide Derived from Human Papillomavirus
DIVDDSEIAYK

SEQ ID NO: 9376 - protein, 10 aa, Artificial Sequence
  Peptide Derived from Human Papillomavirus
DSRWPYLHNR

SEQ ID NO: 9377 - protein, 11 aa, Artificial Sequence
  Peptide Derived from Human Papillomavirus
DTNSNASAFLK

SEQ ID NO: 9378 - protein, 8 aa, Artificial Sequence
  Peptide Derived from Human Papillomavirus
DTPEWIQR

SEQ ID NO: 9379 - protein, 11 aa, Artificial Sequence
  Peptide Derived from Human Papillomavirus
DVKHRPLVQLK

SEQ ID NO: 9380 - protein, 8 aa, Artificial Sequence
  Peptide Derived from Human Papillomavirus
ELNDKNWK

SEQ ID NO: 9381 - protein, 10 aa, Artificial Sequence
  Peptide Derived from Human Papillomavirus
ELVRPFKSNK

SEQ ID NO: 9382 - protein, 9 aa, Artificial Sequence
  Peptide Derived from Human Papillomavirus
ETIEKLLSK

SEQ ID NO: 9383 - protein, 11 aa, Artificial Sequence
  Peptide Derived from Human Papillomavirus
ETQQMLQVEGR

SEQ ID NO: 9384 - protein, 9 aa, Artificial Sequence
  Peptide Derived from Human Papillomavirus
FLKSNSQAK

SEQ ID NO: 9385 - protein, 8 aa, Artificial Sequence
  Peptide Derived from Human Papillomavirus
FLQGIPKK

SEQ ID NO: 9386 - protein, 9 aa, Artificial Sequence
  Peptide Derived from Human Papillomavirus
FMSFLTALK

SEQ ID NO: 9387 - protein, 10 aa, Artificial Sequence
  Peptide Derived from Human Papillomavirus
FMSFLTALKR

SEQ ID NO: 9388 - protein, 9 aa, Artificial Sequence
  Peptide Derived from Human Papillomavirus
FSELVRPFK

SEQ ID NO: 9389 - protein, 10 aa, Artificial Sequence
  Peptide Derived from Human Papillomavirus
FTAQEAKQHR

SEQ ID NO: 9390 - protein, 11 aa, Artificial Sequence
  Peptide Derived from Human Papillomavirus
GLTPSIADSIK

SEQ ID NO: 9391 - protein, 9 aa, Artificial Sequence
  Peptide Derived from Human Papillomavirus
GMVVLLLVR

SEQ ID NO: 9392 - protein, 11 aa, Artificial Sequence
  Peptide Derived from Human Papillomavirus
GMVVLLLVRYK

SEQ ID NO: 9393 - protein, 10 aa, Artificial Sequence
  Peptide Derived from Human Papillomavirus
GSGGEGVSER

SEQ ID NO: 9394 - protein, 10 aa, Artificial Sequence
  Peptide Derived from Human Papillomavirus
GSVICFVNSK

SEQ ID NO: 9395 - protein, 9 aa, Artificial Sequence
  Peptide Derived from Human Papillomavirus
GVSFSELVR

SEQ ID NO: 9396 - protein, 10 aa, Artificial Sequence
  Peptide Derived from Human Papillomavirus
HALFTAQEAK

SEQ ID NO: 9397 - protein, 11 aa, Artificial Sequence
  Peptide Derived from Human Papillomavirus
ILLYGAANTGK

SEQ ID NO: 9398 - protein, 11 aa, Artificial Sequence
  Peptide Derived from Human Papillomavirus
ILNVLKTSNAK

SEQ ID NO: 9399 - protein, 10 aa, Artificial Sequence
  Peptide Derived from Human Papillomavirus
IVDDSEIAYK

SEQ ID NO: 9400 - protein, 10 aa, Artificial Sequence
  Peptide Derived from Human Papillomavirus
IVKDCATMCR

SEQ ID NO: 9401 - protein, 9 aa, Artificial Sequence
  Peptide Derived from Human Papillomavirus
KAAMLAKFK

SEQ ID NO: 9402 - protein, 10 aa, Artificial Sequence
  Peptide Derived from Human Papillomavirus
KAICIEKQSR

SEQ ID NO: 9403 - protein, 11 aa, Artificial Sequence
  Peptide Derived from Human Papillomavirus
KIVKDCATMCR

SEQ ID NO: 9404 - protein, 10 aa, Artificial Sequence
  Peptide Derived from Human Papillomavirus
KSFFSRTWSR

SEQ ID NO: 9405 - protein, 10 aa, Artificial Sequence
  Peptide Derived from Human Papillomavirus
KSLFGMSLMK

SEQ ID NO: 9406 - protein, 10 aa, Artificial Sequence
  Peptide Derived from Human Papillomavirus
KSNSQAKIVK

SEQ ID NO: 9407 - protein, 10 aa, Artificial Sequence
  Peptide Derived from Human Papillomavirus
LLLVRYKCGK

SEQ ID NO: 9408 - protein, 9 aa, Artificial Sequence
  Peptide Derived from Human Papillomavirus
LLVRYKCGK

SEQ ID NO: 9409 - protein, 11 aa, Artificial Sequence
  Peptide Derived from Human Papillomavirus
LLVRYKCGKNR

SEQ ID NO: 9410 - protein, 10 aa, Artificial Sequence
  Peptide Derived from Human Papillomavirus
LLYGAANTGK

SEQ ID NO: 9411 - protein, 9 aa, Artificial Sequence
  Peptide Derived from Human Papillomavirus
LSLHEDEDK

SEQ ID NO: 9412 - protein, 9 aa, Artificial Sequence
  Peptide Derived from Human Papillomavirus
LTNILNVLK

SEQ ID NO: 9413 - protein, 10 aa, Artificial Sequence
  Peptide Derived from Human Papillomavirus
LTPSIADSIK

SEQ ID NO: 9414 - protein, 9 aa, Artificial Sequence
  Peptide Derived from Human Papillomavirus
LVRPFKSNK

SEQ ID NO: 9415 - protein, 8 aa, Artificial Sequence
  Peptide Derived from Human Papillomavirus
LVRYKCGK

SEQ ID NO: 9416 - protein, 10 aa, Artificial Sequence
  Peptide Derived from Human Papillomavirus
LVRYKCGKNR

SEQ ID NO: 9417 - protein, 9 aa, Artificial Sequence
  Peptide Derived from Human Papillomavirus
LVSMDVKHR

SEQ ID NO: 9418 - protein, 8 aa, Artificial Sequence
  Peptide Derived from Human Papillomavirus
MIEPPKLR

SEQ ID NO: 9419 - protein, 9 aa, Artificial Sequence
  Peptide Derived from Human Papillomavirus
MMIEPPKLR

SEQ ID NO: 9420 - protein, 8 aa, Artificial Sequence
  Peptide Derived from Human Papillomavirus
MSFLTALK

SEQ ID NO: 9421 - protein, 9 aa, Artificial Sequence
  Peptide Derived from Human Papillomavirus
MSFLTALKR

SEQ ID NO: 9422 - protein, 8 aa, Artificial Sequence
  Peptide Derived from Human Papillomavirus
MSMSQWIK

SEQ ID NO: 9423 - protein, 10 aa, Artificial Sequence
  Peptide Derived from Human Papillomavirus
MSMSQWIKYR

SEQ ID NO: 9424 - protein, 8 aa, Artificial Sequence
  Peptide Derived from Human Papillomavirus
MSQWIKYR

SEQ ID NO: 9425 - protein, 11 aa, Artificial Sequence
  Peptide Derived from Human Papillomavirus
MSQWIKYRCDR

SEQ ID NO: 9426 - protein, 8 aa, Artificial Sequence
  Peptide Derived from Human Papillomavirus
MVVLLLVR

SEQ ID NO: 9427 - protein, 10 aa, Artificial Sequence
  Peptide Derived from Human Papillomavirus
MVVLLLVRYK

SEQ ID NO: 9428 - protein, 9 aa, Artificial Sequence
  Peptide Derived from Human Papillomavirus
NAKAAMLAK

SEQ ID NO: 9429 - protein, 11 aa, Artificial Sequence
  Peptide Derived from Human Papillomavirus
NAKAAMLAKFK

SEQ ID NO: 9430 - protein, 9 aa, Artificial Sequence
  Peptide Derived from Human Papillomavirus
NINAGTDSR

SEQ ID NO: 9431 - protein, 8 aa, Artificial Sequence
  Peptide Derived from Human Papillomavirus
NLVSMDVK

SEQ ID NO: 9432 - protein, 10 aa, Artificial Sequence
  Peptide Derived from Human Papillomavirus
NLVSMDVKHR

SEQ ID NO: 9433 - protein, 9 aa, Artificial Sequence
  Peptide Derived from Human Papillomavirus
NSNASAFLK

SEQ ID NO: 9434 - protein, 8 aa, Artificial Sequence
  Peptide Derived from Human Papillomavirus
NSQAKIVK

SEQ ID NO: 9435 - protein, 9 aa, Artificial Sequence
  Peptide Derived from Human Papillomavirus
NVLKTSNAK

SEQ ID NO: 9436 - protein, 10 aa, Artificial Sequence
  Peptide Derived from Human Papillomavirus
PLTNILNVLK

SEQ ID NO: 9437 - protein, 10 aa, Artificial Sequence
  Peptide Derived from Human Papillomavirus
PMCMMIEPPK

SEQ ID NO: 9438 - protein, 8 aa, Artificial Sequence
  Peptide Derived from Human Papillomavirus
PSIADSIK

SEQ ID NO: 9439 - protein, 8 aa, Artificial Sequence
  Peptide Derived from Human Papillomavirus
PVYELNDK

SEQ ID NO: 9440 - protein, 11 aa, Artificial Sequence
  Peptide Derived from Human Papillomavirus
PVYELNDKNWK

SEQ ID NO: 9441 - protein, 8 aa, Artificial Sequence
  Peptide Derived from Human Papillomavirus
QMLQVEGR

SEQ ID NO: 9442 - protein, 9 aa, Artificial Sequence
  Peptide Derived from Human Papillomavirus
QMSMSQWIK

SEQ ID NO: 9443 - protein, 11 aa, Artificial Sequence
  Peptide Derived from Human Papillomavirus
QMSMSQWIKYR

SEQ ID NO: 9444 - protein, 8 aa, Artificial Sequence
  Peptide Derived from Human Papillomavirus
QSRAAKRR

SEQ ID NO: 9445 - protein, 9 aa, Artificial Sequence
  Peptide Derived from Human Papillomavirus
RLKAICIEK

SEQ ID NO: 9446 - protein, 10 aa, Artificial Sequence
  Peptide Derived from Human Papillomavirus
RLSLHEDEDK

SEQ ID NO: 9447 - protein, 11 aa, Artificial Sequence
  Peptide Derived from Human Papillomavirus
RSTAAALYWYK

SEQ ID NO: 9448 - protein, 9 aa, Artificial Sequence
  Peptide Derived from Human Papillomavirus
RVDDGGDWK

SEQ ID NO: 9449 - protein, 11 aa, Artificial Sequence
  Peptide Derived from Human Papillomavirus
SAFLKSNSQAK

SEQ ID NO: 9450 - protein, 9 aa, Artificial Sequence
  Peptide Derived from Human Papillomavirus
SLFGMSLMK

SEQ ID NO: 9451 - protein, 8 aa, Artificial Sequence
  Peptide Derived from Human Papillomavirus
SLHEDEDK

SEQ ID NO: 9452 - protein, 9 aa, Artificial Sequence
  Peptide Derived from Human Papillomavirus
SMSQWIKYR

SEQ ID NO: 9453 - protein, 10 aa, Artificial Sequence
  Peptide Derived from Human Papillomavirus
STAAALYWYK

SEQ ID NO: 9454 - protein, 9 aa, Artificial Sequence
  Peptide Derived from Human Papillomavirus
SVICFVNSK

SEQ ID NO: 9455 - protein, 9 aa, Artificial Sequence
  Peptide Derived from Human Papillomavirus
TAAALYWYK

SEQ ID NO: 9456 - protein, 9 aa, Artificial Sequence
  Peptide Derived from Human Papillomavirus
TAQEAKQHR

SEQ ID NO: 9457 - protein, 8 aa, Artificial Sequence
  Peptide Derived from Human Papillomavirus
TIEKLLSK

SEQ ID NO: 9458 - protein, 8 aa, Artificial Sequence
  Peptide Derived from Human Papillomavirus
TMCRHYKR

SEQ ID NO: 9459 - protein, 11 aa, Artificial Sequence
  Peptide Derived from Human Papillomavirus
TMCRHYKRAEK

SEQ ID NO: 9460 - protein, 11 aa, Artificial Sequence
  Peptide Derived from Human Papillomavirus
TSNAKAAMLAK

SEQ ID NO: 9461 - protein, 11 aa, Artificial Sequence
  Peptide Derived from Human Papillomavirus
TSNINAGTDSR

SEQ ID NO: 9462 - protein, 8 aa, Artificial Sequence
  Peptide Derived from Human Papillomavirus
VICFVNSK

SEQ ID NO: 9463 - protein, 8 aa, Artificial Sequence
  Peptide Derived from Human Papillomavirus
VLKTSNAK

SEQ ID NO: 9464 - protein, 8 aa, Artificial Sequence
  Peptide Derived from Human Papillomavirus
VLLLVRYK

SEQ ID NO: 9465 - protein, 11 aa, Artificial Sequence
  Peptide Derived from Human Papillomavirus
VLLLVRYKCGK

SEQ ID NO: 9466 - protein, 8 aa, Artificial Sequence
  Peptide Derived from Human Papillomavirus
VSFSELVR

SEQ ID NO: 9467 - protein, 11 aa, Artificial Sequence
  Peptide Derived from Human Papillomavirus
VSFSELVRPFK

SEQ ID NO: 9468 - protein, 8 aa, Artificial Sequence
  Peptide Derived from Human Papillomavirus
VSMDVKHR

SEQ ID NO: 9469 - protein, 9 aa, Artificial Sequence
  Peptide Derived from Human Papillomavirus
VVLLLVRYK

SEQ ID NO: 9470 - protein, 8 aa, Artificial Sequence
  Peptide Derived from Human Papillomavirus
WIKYRCDR

SEQ ID NO: 9471 - protein, 9 aa, Artificial Sequence
  Peptide Derived from Human Papillomavirus
WLQPLADAK

SEQ ID NO: 9472 - protein, 8 aa, Artificial Sequence
  Peptide Derived from Human Papillomavirus
YVEAVVEK

SEQ ID NO: 9473 - protein, 9 aa, Artificial Sequence
  Peptide Derived from Human Papillomavirus
YVEAVVEKK

SEQ ID NO: 9474 - protein, 8 aa, Artificial Sequence
  Peptide Derived from Human Papillomavirus
CAIYYKAR

SEQ ID NO: 9475 - protein, 8 aa, Artificial Sequence
  Peptide Derived from Human Papillomavirus
CLRYRFKK

SEQ ID NO: 9476 - protein, 9 aa, Artificial Sequence
  Peptide Derived from Human Papillomavirus
DAEKYSKNK

SEQ ID NO: 9477 - protein, 9 aa, Artificial Sequence
  Peptide Derived from Human Papillomavirus
DANTLKCLR

SEQ ID NO: 9478 - protein, 11 aa, Artificial Sequence
  Peptide Derived from Human Papillomavirus
DANTLKCLRYR

SEQ ID NO: 9479 - protein, 10 aa, Artificial Sequence
  Peptide Derived from Human Papillomavirus
DLRDHIDYWK

SEQ ID NO: 9480 - protein, 10 aa, Artificial Sequence
  Peptide Derived from Human Papillomavirus
DTGNPCHTTK

SEQ ID NO: 9481 - protein, 8 aa, Artificial Sequence
  Peptide Derived from Human Papillomavirus
ETQTTIQR

SEQ ID NO: 9482 - protein, 10 aa, Artificial Sequence
  Peptide Derived from Human Papillomavirus
ETQTTIQRPR

SEQ ID NO: 9483 - protein, 9 aa, Artificial Sequence
  Peptide Derived from Human Papillomavirus
EVSSPEIIR

SEQ ID NO: 9484 - protein, 9 aa, Artificial Sequence
  Peptide Derived from Human Papillomavirus
FLSQVKIPK

SEQ ID NO: 9485 - protein, 10 aa, Artificial Sequence
  Peptide Derived from Human Papillomavirus
FVQFKDDAEK

SEQ ID NO: 9486 - protein, 10 aa, Artificial Sequence
  Peptide Derived from Human Papillomavirus
GIRTYFVQFK

SEQ ID NO: 9487 - protein, 10 aa, Artificial Sequence
  Peptide Derived from Human Papillomavirus
GLYYVHEGIR

SEQ ID NO: 9488 - protein, 11 aa, Artificial Sequence
  Peptide Derived from Human Papillomavirus
GTEETQTTIQR

SEQ ID NO: 9489 - protein, 9 aa, Artificial Sequence
  Peptide Derived from Human Papillomavirus
HIDYWKHMR

SEQ ID NO: 9490 - protein, 10 aa, Artificial Sequence
  Peptide Derived from Human Papillomavirus
HLKGDANTLK

SEQ ID NO: 9491 - protein, 11 aa, Artificial Sequence
  Peptide Derived from Human Papillomavirus
HMRLECAIYYK

SEQ ID NO: 9492 - protein, 8 aa, Artificial Sequence
  Peptide Derived from Human Papillomavirus
HTTKLLHR

SEQ ID NO: 9493 - protein, 10 aa, Artificial Sequence
  Peptide Derived from Human Papillomavirus
ILTAFNSSHK

SEQ ID NO: 9494 - protein, 8 aa, Artificial Sequence
  Peptide Derived from Human Papillomavirus
KAREMGFK

SEQ ID NO: 9495 - protein, 11 aa, Artificial Sequence
  Peptide Derived from Human Papillomavirus
LANHPAATHTK

SEQ ID NO: 9496 - protein, 8 aa, Artificial Sequence
  Peptide Derived from Human Papillomavirus
LSQVKIPK

SEQ ID NO: 9497 - protein, 9 aa, Artificial Sequence
  Peptide Derived from Human Papillomavirus
LTAFNSSHK

SEQ ID NO: 9498 - protein, 11 aa, Artificial Sequence
  Peptide Derived from Human Papillomavirus
LTAFNSSHKGR

SEQ ID NO: 9499 - protein, 9 aa, Artificial Sequence
  Peptide Derived from Human Papillomavirus
LTAPTGCIK

SEQ ID NO: 9500 - protein, 10 aa, Artificial Sequence
  Peptide Derived from Human Papillomavirus
LTAPTGCIKK

SEQ ID NO: 9501 - protein, 9 aa, Artificial Sequence
  Peptide Derived from Human Papillomavirus
LTYDSEWQR

SEQ ID NO: 9502 - protein, 11 aa, Artificial Sequence
  Peptide Derived from Human Papillomavirus
NSNTTPIVHLK

SEQ ID NO: 9503 - protein, 8 aa, Artificial Sequence
  Peptide Derived from Human Papillomavirus
NSQYSNEK

SEQ ID NO: 9504 - protein, 9 aa, Artificial Sequence
  Peptide Derived from Human Papillomavirus
NTLKCLRYR

SEQ ID NO: 9505 - protein, 11 aa, Artificial Sequence
  Peptide Derived from Human Papillomavirus
NTLKCLRYRFK

SEQ ID NO: 9506 - protein, 9 aa, Artificial Sequence
  Peptide Derived from Human Papillomavirus
NTTPIVHLK

SEQ ID NO: 9507 - protein, 11 aa, Artificial Sequence
  Peptide Derived from Human Papillomavirus
PILTAFNSSHK

SEQ ID NO: 9508 - protein, 9 aa, Artificial Sequence
  Peptide Derived from Human Papillomavirus
PTLAVSKNK

SEQ ID NO: 9509 - protein, 8 aa, Artificial Sequence
  Peptide Derived from Human Papillomavirus
QTTIQRPR

SEQ ID NO: 9510 - protein, 10 aa, Artificial Sequence
  Peptide Derived from Human Papillomavirus
QVVPTLAVSK

SEQ ID NO: 9511 - protein, 9 aa, Artificial Sequence
  Peptide Derived from Human Papillomavirus
RLECAIYYK

SEQ ID NO: 9512 - protein, 11 aa, Artificial Sequence
  Peptide Derived from Human Papillomavirus
RLECAIYYKAR

SEQ ID NO: 9513 - protein, 8 aa, Artificial Sequence
  Peptide Derived from Human Papillomavirus
RLNVCQDK

SEQ ID NO: 9514 - protein, 8 aa, Artificial Sequence
  Peptide Derived from Human Papillomavirus
RTYFVQFK

SEQ ID NO: 9515 - protein, 11 aa, Artificial Sequence
  Peptide Derived from Human Papillomavirus
STWHWTGHNVK

SEQ ID NO: 9516 - protein, 8 aa, Artificial Sequence
  Peptide Derived from Human Papillomavirus
TAFNSSHK

SEQ ID NO: 9517 - protein, 10 aa, Artificial Sequence
  Peptide Derived from Human Papillomavirus
TAFNSSHKGR

SEQ ID NO: 9518 - protein, 8 aa, Artificial Sequence
  Peptide Derived from Human Papillomavirus
TAPTGCIK

SEQ ID NO: 9519 - protein, 9 aa, Artificial Sequence
  Peptide Derived from Human Papillomavirus
TAPTGCIKK

SEQ ID NO: 9520 - protein, 11 aa, Artificial Sequence
  Peptide Derived from Human Papillomavirus
TIYNSQYSNEK

SEQ ID NO: 9521 - protein, 8 aa, Artificial Sequence
  Peptide Derived from Human Papillomavirus
TLAVSKNK

SEQ ID NO: 9522 - protein, 8 aa, Artificial Sequence
  Peptide Derived from Human Papillomavirus
TLKCLRYR

SEQ ID NO: 9523 - protein, 10 aa, Artificial Sequence
  Peptide Derived from Human Papillomavirus
TLKCLRYRFK

SEQ ID NO: 9524 - protein, 11 aa, Artificial Sequence
  Peptide Derived from Human Papillomavirus
TLKCLRYRFKK

SEQ ID NO: 9525 - protein, 10 aa, Artificial Sequence
  Peptide Derived from Human Papillomavirus
TLTYDSEWQR

SEQ ID NO: 9526 - protein, 8 aa, Artificial Sequence
  Peptide Derived from Human Papillomavirus
TTPIVHLK

SEQ ID NO: 9527 - protein, 8 aa, Artificial Sequence
  Peptide Derived from Human Papillomavirus
VSSPEIIR

SEQ ID NO: 9528 - protein, 11 aa, Artificial Sequence
  Peptide Derived from Human Papillomavirus
VTLTYDSEWQR

SEQ ID NO: 9529 - protein, 9 aa, Artificial Sequence
  Peptide Derived from Human Papillomavirus
VVPTLAVSK

SEQ ID NO: 9530 - protein, 11 aa, Artificial Sequence
  Peptide Derived from Human Papillomavirus
VVPTLAVSKNK

SEQ ID NO: 9531 - protein, 9 aa, Artificial Sequence
  Peptide Derived from Human Papillomavirus
WTGHNVKHK

SEQ ID NO: 9532 - protein, 10 aa, Artificial Sequence
  Peptide Derived from Human Papillomavirus
YLTAPTGCIK

SEQ ID NO: 9533 - protein, 11 aa, Artificial Sequence
  Peptide Derived from Human Papillomavirus
YLTAPTGCIKK

SEQ ID NO: 9534 - protein, 11 aa, Artificial Sequence
  Peptide Derived from Human Papillomavirus
CVLLCVCLLIR

SEQ ID NO: 9535 - protein, 8 aa, Artificial Sequence
  Peptide Derived from Human Papillomavirus
FLIHTHAR

SEQ ID NO: 9536 - protein, 8 aa, Artificial Sequence
  Peptide Derived from Human Papillomavirus
ITAASAFR

SEQ ID NO: 9537 - protein, 9 aa, Artificial Sequence
  Peptide Derived from Human Papillomavirus
LLCVCLLIR

SEQ ID NO: 9538 - protein, 11 aa, Artificial Sequence
  Peptide Derived from Human Papillomavirus
LLWITAASAFR

SEQ ID NO: 9539 - protein, 10 aa, Artificial Sequence
  Peptide Derived from Human Papillomavirus
PLFLIHTHAR

SEQ ID NO: 9540 - protein, 10 aa, Artificial Sequence
  Peptide Derived from Human Papillomavirus
VLLCVCLLIR

SEQ ID NO: 9541 - protein, 9 aa, Artificial Sequence
  Peptide Derived from Human Papillomavirus
WITAASAFR

SEQ ID NO: 9542 - protein, 9 aa, Artificial Sequence
  Peptide Derived from Human Papillomavirus
AMFQDPQER

SEQ ID NO: 9543 - protein, 11 aa, Artificial Sequence
  Peptide Derived from Human Papillomavirus
AMFQDPQERPR

SEQ ID NO: 9544 - protein, 8 aa, Artificial Sequence
  Peptide Derived from Human Papillomavirus
AVCDKCLK

SEQ ID NO: 9545 - protein, 9 aa, Artificial Sequence
  Peptide Derived from Human Papillomavirus
CMSCCRSSR

SEQ ID NO: 9546 - protein, 11 aa, Artificial Sequence
  Peptide Derived from Human Papillomavirus
CMSCCRSSRTR

SEQ ID NO: 9547 - protein, 10 aa, Artificial Sequence
  Peptide Derived from Human Papillomavirus
CVYCKQQLLR

SEQ ID NO: 9548 - protein, 11 aa, Artificial Sequence
  Peptide Derived from Human Papillomavirus
CVYCKQQLLRR

SEQ ID NO: 9549 - protein, 10 aa, Artificial Sequence
  Peptide Derived from Human Papillomavirus
DIILECVYCK

SEQ ID NO: 9550 - protein, 11 aa, Artificial Sequence
  Peptide Derived from Human Papillomavirus
DLLIRCINCQK

SEQ ID NO: 9551 - protein, 8 aa, Artificial Sequence
  Peptide Derived from Human Papillomavirus
EVYDFAFR

SEQ ID NO: 9552 - protein, 11 aa, Artificial Sequence
  Peptide Derived from Human Papillomavirus
FAFRDLCIVYR

SEQ ID NO: 9553 - protein, 10 aa, Artificial Sequence
  Peptide Derived from Human Papillomavirus
GTTLEQQYNK

SEQ ID NO: 9554 - protein, 9 aa, Artificial Sequence
  Peptide Derived from Human Papillomavirus
IILECVYCK

SEQ ID NO: 9555 - protein, 8 aa, Artificial Sequence
  Peptide Derived from Human Papillomavirus
ILECVYCK

SEQ ID NO: 9556 - protein, 9 aa, Artificial Sequence
  Peptide Derived from Human Papillomavirus
LIRCINCQK

SEQ ID NO: 9557 - protein, 10 aa, Artificial Sequence
  Peptide Derived from Human Papillomavirus
LLIRCINCQK

SEQ ID NO: 9558 - protein, 8 aa, Artificial Sequence
  Peptide Derived from Human Papillomavirus
MSCCRSSR

SEQ ID NO: 9559 - protein, 10 aa, Artificial Sequence
  Peptide Derived from Human Papillomavirus
MSCCRSSRTR

SEQ ID NO: 9560 - protein, 11 aa, Artificial Sequence
  Peptide Derived from Human Papillomavirus
MSCCRSSRTRR

SEQ ID NO: 9561 - protein, 9 aa, Artificial Sequence
  Peptide Derived from Human Papillomavirus
NIRGRWTGR

SEQ ID NO: 9562 - protein, 8 aa, Artificial Sequence
  Peptide Derived from Human Papillomavirus
PLCDLLIR

SEQ ID NO: 9563 - protein, 9 aa, Artificial Sequence
  Peptide Derived from Human Papillomavirus
PLCPEEKQR

SEQ ID NO: 9564 - protein, 11 aa, Artificial Sequence
  Peptide Derived from Human Papillomavirus
RTAMFQDPQER

SEQ ID NO: 9565 - protein, 10 aa, Artificial Sequence
  Peptide Derived from Human Papillomavirus
TAMFQDPQER

SEQ ID NO: 9566 - protein, 8 aa, Artificial Sequence
  Peptide Derived from Human Papillomavirus
TLEQQYNK

SEQ ID NO: 9567 - protein, 9 aa, Artificial Sequence
  Peptide Derived from Human Papillomavirus
TTLEQQYNK

SEQ ID NO: 9568 - protein, 10 aa, Artificial Sequence
  Peptide Derived from Human Papillomavirus
WTGRCMSCCR

SEQ ID NO: 9569 - protein, 9 aa, Artificial Sequence
  Peptide Derived from Human Papillomavirus
YAVCDKCLK

SEQ ID NO: 9570 - protein, 8 aa, Artificial Sequence
  Peptide Derived from Human Papillomavirus
YSKISEYR

SEQ ID NO: 9571 - protein, 10 aa, Artificial Sequence
  Peptide Derived from Human Papillomavirus
CVQSTHVDIR

SEQ ID NO: 9572 - protein, 10 aa, Artificial Sequence
  Peptide Derived from Human Papillomavirus
GIVCPICSQK

SEQ ID NO: 9573 - protein, 9 aa, Artificial Sequence
  Peptide Derived from Human Papillomavirus
IVCPICSQK

SEQ ID NO: 9574 - protein, 8 aa, Artificial Sequence
  Peptide Derived from Human Papillomavirus
NIVTFCCK

SEQ ID NO: 9575 - protein, 9 aa, Artificial Sequence
  Peptide Derived from Human Papillomavirus
PAGQAEPDR

SEQ ID NO: 9576 - protein, 8 aa, Artificial Sequence
  Peptide Derived from Human Papillomavirus
QSTHVDIR

SEQ ID NO: 9577 - protein, 11 aa, Artificial Sequence
  Peptide Derived from Human Papillomavirus
AAISTSETTYK

SEQ ID NO: 9578 - protein, 9 aa, Artificial Sequence
  Peptide Derived from Human Papillomavirus
AANAGVDNR

SEQ ID NO: 9579 - protein, 10 aa, Artificial Sequence
  Peptide Derived from Human Papillomavirus
AISTSETTYK

SEQ ID NO: 9580 - protein, 11 aa, Artificial Sequence
  Peptide Derived from Human Papillomavirus
AMDFTTLQANK

SEQ ID NO: 9581 - protein, 10 aa, Artificial Sequence
  Peptide Derived from Human Papillomavirus
AVGHPYFPIK

SEQ ID NO: 9582 - protein, 11 aa, Artificial Sequence
  Peptide Derived from Human Papillomavirus
AVGHPYFPIKK

SEQ ID NO: 9583 - protein, 8 aa, Artificial Sequence
  Peptide Derived from Human Papillomavirus
CVGVEVGR

SEQ ID NO: 9584 - protein, 8 aa, Artificial Sequence
  Peptide Derived from Human Papillomavirus
DICTSICK

SEQ ID NO: 9585 - protein, 9 aa, Artificial Sequence
  Peptide Derived from Human Papillomavirus
DLDQFPLGR

SEQ ID NO: 9586 - protein, 10 aa, Artificial Sequence
  Peptide Derived from Human Papillomavirus
DLDQFPLGRK

SEQ ID NO: 9587 - protein, 10 aa, Artificial Sequence
  Peptide Derived from Human Papillomavirus
DLQFIFQLCK

SEQ ID NO: 9588 - protein, 8 aa, Artificial Sequence
  Peptide Derived from Human Papillomavirus
DSLFFYLR

SEQ ID NO: 9589 - protein, 9 aa, Artificial Sequence
  Peptide Derived from Human Papillomavirus
DSLFFYLRR

SEQ ID NO: 9590 - protein, 11 aa, Artificial Sequence
  Peptide Derived from Human Papillomavirus
DTSFYNPDTQR

SEQ ID NO: 9591 - protein, 10 aa, Artificial Sequence
  Peptide Derived from Human Papillomavirus
ETTYKNTNFK

SEQ ID NO: 9592 - protein, 8 aa, Artificial Sequence
  Peptide Derived from Human Papillomavirus
FLLQAGLK

SEQ ID NO: 9593 - protein, 10 aa, Artificial Sequence
  Peptide Derived from Human Papillomavirus
FLLQAGLKAK

SEQ ID NO: 9594 - protein, 8 aa, Artificial Sequence
  Peptide Derived from Human Papillomavirus
FTTLQANK

SEQ ID NO: 9595 - protein, 8 aa, Artificial Sequence
  Peptide Derived from Human Papillomavirus
FVRHLFNR

SEQ ID NO: 9596 - protein, 11 aa, Artificial Sequence
  Peptide Derived from Human Papillomavirus
FVTSQAIACQK

SEQ ID NO: 9597 - protein, 9 aa, Artificial Sequence
  Peptide Derived from Human Papillomavirus
FVTVVDTTR

SEQ ID NO: 9598 - protein, 10 aa, Artificial Sequence
  Peptide Derived from Human Papillomavirus
GISGHPLLNK

SEQ ID NO: 9599 - protein, 8 aa, Artificial Sequence
  Peptide Derived from Human Papillomavirus
GLQYRVFR

SEQ ID NO: 9600 - protein, 8 aa, Artificial Sequence
  Peptide Derived from Human Papillomavirus
GTLEDTYR

SEQ ID NO: 9601 - protein, 9 aa, Artificial Sequence
  Peptide Derived from Human Papillomavirus
ISGHPLLNK

SEQ ID NO: 9602 - protein, 9 aa, Artificial Sequence
  Peptide Derived from Human Papillomavirus
ISTSETTYK

SEQ ID NO: 9603 - protein, 10 aa, Artificial Sequence
  Peptide Derived from Human Papillomavirus
KAKPKFTLGK

SEQ ID NO: 9604 - protein, 11 aa, Artificial Sequence
  Peptide Derived from Human Papillomavirus
KAKPKFTLGKR

SEQ ID NO: 9605 - protein, 8 aa, Artificial Sequence
  Peptide Derived from Human Papillomavirus
KVSGLQYR

SEQ ID NO: 9606 - protein, 11 aa, Artificial Sequence
  Peptide Derived from Human Papillomavirus
KVSGLQYRVFR

SEQ ID NO: 9607 - protein, 11 aa, Artificial Sequence
  Peptide Derived from Human Papillomavirus
KVVSTDEYVAR

SEQ ID NO: 9608 - protein, 11 aa, Artificial Sequence
  Peptide Derived from Human Papillomavirus
LAVGHPYFPIK

SEQ ID NO: 9609 - protein, 9 aa, Artificial Sequence
  Peptide Derived from Human Papillomavirus
LLQAGLKAK

SEQ ID NO: 9610 - protein, 11 aa, Artificial Sequence
  Peptide Derived from Human Papillomavirus
LLQAGLKAKPK

SEQ ID NO: 9611 - protein, 11 aa, Artificial Sequence
  Peptide Derived from Human Papillomavirus
LVPKVSGLQYR

SEQ ID NO: 9612 - protein, 11 aa, Artificial Sequence
  Peptide Derived from Human Papillomavirus
MVTSDAQIFNK

SEQ ID NO: 9613 - protein, 10 aa, Artificial Sequence
  Peptide Derived from Human Papillomavirus
NIYYHAGTSR

SEQ ID NO: 9614 - protein, 9 aa, Artificial Sequence
  Peptide Derived from Human Papillomavirus
NTNFKEYLR

SEQ ID NO: 9615 - protein, 9 aa, Artificial Sequence
  Peptide Derived from Human Papillomavirus
NVPDDLYIK

SEQ ID NO: 9616 - protein, 9 aa, Artificial Sequence
  Peptide Derived from Human Papillomavirus
PAPKEDPLK

SEQ ID NO: 9617 - protein, 10 aa, Artificial Sequence
  Peptide Derived from Human Papillomavirus
PAPKEDPLKK

SEQ ID NO: 9618 - protein, 8 aa, Artificial Sequence
  Peptide Derived from Human Papillomavirus
PIGEHWGK

SEQ ID NO: 9619 - protein, 9 aa, Artificial Sequence
  Peptide Derived from Human Papillomavirus
PIKKPNNNK

SEQ ID NO: 9620 - protein, 10 aa, Artificial Sequence
  Peptide Derived from Human Papillomavirus
PLDICTSICK

SEQ ID NO: 9621 - protein, 11 aa, Artificial Sequence
  Peptide Derived from Human Papillomavirus
PTTSSTSTTAK

SEQ ID NO: 9622 - protein, 9 aa, Artificial Sequence
  Peptide Derived from Human Papillomavirus
QAGLKAKPK

SEQ ID NO: 9623 - protein, 11 aa, Artificial Sequence
  Peptide Derived from Human Papillomavirus
QIFNKPYWLQR

SEQ ID NO: 9624 - protein, 8 aa, Artificial Sequence
  Peptide Derived from Human Papillomavirus
QLCLIGCK

SEQ ID NO: 9625 - protein, 11 aa, Artificial Sequence
  Peptide Derived from Human Papillomavirus
QLFVTVVDTTR

SEQ ID NO: 9626 - protein, 10 aa, Artificial Sequence
  Peptide Derived from Human Papillomavirus
QMFVRHLFNR

SEQ ID NO: 9627 - protein, 10 aa, Artificial Sequence
  Peptide Derived from Human Papillomavirus
QTQLCLIGCK

SEQ ID NO: 9628 - protein, 9 aa, Artificial Sequence
  Peptide Derived from Human Papillomavirus
RIHLPDPNK

SEQ ID NO: 9629 - protein, 11 aa, Artificial Sequence
  Peptide Derived from Human Papillomavirus
SADLDQFPLGR

SEQ ID NO: 9630 - protein, 10 aa, Artificial Sequence
  Peptide Derived from Human Papillomavirus
SICKYPDYIK

SEQ ID NO: 9631 - protein, 8 aa, Artificial Sequence
  Peptide Derived from Human Papillomavirus
SLFFYLRR

SEQ ID NO: 9632 - protein, 8 aa, Artificial Sequence
  Peptide Derived from Human Papillomavirus
SSTSTTAK

SEQ ID NO: 9633 - protein, 9 aa, Artificial Sequence
  Peptide Derived from Human Papillomavirus
SSTSTTAKR

SEQ ID NO: 9634 - protein, 10 aa, Artificial Sequence
  Peptide Derived from Human Papillomavirus
SSTSTTAKRK

SEQ ID NO: 9635 - protein, 11 aa, Artificial Sequence
  Peptide Derived from Human Papillomavirus
SSTSTTAKRKK

SEQ ID NO: 9636 - protein, 8 aa, Artificial Sequence
  Peptide Derived from Human Papillomavirus
STDEYVAR

SEQ ID NO: 9637 - protein, 8 aa, Artificial Sequence
  Peptide Derived from Human Papillomavirus
STSETTYK

SEQ ID NO: 9638 - protein, 8 aa, Artificial Sequence
  Peptide Derived from Human Papillomavirus
STSTTAKR

SEQ ID NO: 9639 - protein, 9 aa, Artificial Sequence
  Peptide Derived from Human Papillomavirus
STSTTAKRK

SEQ ID NO: 9640 - protein, 10 aa, Artificial Sequence
  Peptide Derived from Human Papillomavirus
STSTTAKRKK

SEQ ID NO: 9641 - protein, 11 aa, Artificial Sequence
  Peptide Derived from Human Papillomavirus
STSTTAKRKKR

SEQ ID NO: 9642 - protein, 8 aa, Artificial Sequence
  Peptide Derived from Human Papillomavirus
STTAKRKK

SEQ ID NO: 9643 - protein, 9 aa, Artificial Sequence
  Peptide Derived from Human Papillomavirus
STTAKRKKR

SEQ ID NO: 9644 - protein, 10 aa, Artificial Sequence
  Peptide Derived from Human Papillomavirus
STTAKRKKRK

SEQ ID NO: 9645 - protein, 8 aa, Artificial Sequence
  Peptide Derived from Human Papillomavirus
TAKRKKRK

SEQ ID NO: 9646 - protein, 9 aa, Artificial Sequence
  Peptide Derived from Human Papillomavirus
TSDAQIFNK

SEQ ID NO: 9647 - protein, 10 aa, Artificial Sequence
  Peptide Derived from Human Papillomavirus
TSFYNPDTQR

SEQ ID NO: 9648 - protein, 11 aa, Artificial Sequence
  Peptide Derived from Human Papillomavirus
TSICKYPDYIK

SEQ ID NO: 9649 - protein, 9 aa, Artificial Sequence
  Peptide Derived from Human Papillomavirus
TSQAIACQK

SEQ ID NO: 9650 - protein, 9 aa, Artificial Sequence
  Peptide Derived from Human Papillomavirus
TSSTSTTAK

SEQ ID NO: 9651 - protein, 10 aa, Artificial Sequence
  Peptide Derived from Human Papillomavirus
TSSTSTTAKR

SEQ ID NO: 9652 - protein, 11 aa, Artificial Sequence
  Peptide Derived from Human Papillomavirus
TSSTSTTAKRK

SEQ ID NO: 9653 - protein, 8 aa, Artificial Sequence
  Peptide Derived from Human Papillomavirus
TSTTAKRK

SEQ ID NO: 9654 - protein, 9 aa, Artificial Sequence
  Peptide Derived from Human Papillomavirus
TSTTAKRKK

SEQ ID NO: 9655 - protein, 10 aa, Artificial Sequence
  Peptide Derived from Human Papillomavirus
TSTTAKRKKR

SEQ ID NO: 9656 - protein, 11 aa, Artificial Sequence
  Peptide Derived from Human Papillomavirus
TSTTAKRKKRK

SEQ ID NO: 9657 - protein, 8 aa, Artificial Sequence
  Peptide Derived from Human Papillomavirus
TTAKRKKR

SEQ ID NO: 9658 - protein, 9 aa, Artificial Sequence
  Peptide Derived from Human Papillomavirus
TTAKRKKRK

SEQ ID NO: 9659 - protein, 10 aa, Artificial Sequence
  Peptide Derived from Human Papillomavirus
TTSSTSTTAK

SEQ ID NO: 9660 - protein, 11 aa, Artificial Sequence
  Peptide Derived from Human Papillomavirus
TTSSTSTTAKR

SEQ ID NO: 9661 - protein, 9 aa, Artificial Sequence
  Peptide Derived from Human Papillomavirus
TTYKNTNFK

SEQ ID NO: 9662 - protein, 11 aa, Artificial Sequence
  Peptide Derived from Human Papillomavirus
TVYLPPVPVSK

SEQ ID NO: 9663 - protein, 10 aa, Artificial Sequence
  Peptide Derived from Human Papillomavirus
VSGLQYRVFR

SEQ ID NO: 9664 - protein, 9 aa, Artificial Sequence
  Peptide Derived from Human Papillomavirus
VSTDEYVAR

SEQ ID NO: 9665 - protein, 10 aa, Artificial Sequence
  Peptide Derived from Human Papillomavirus
VTSDAQIFNK

SEQ ID NO: 9666 - protein, 10 aa, Artificial Sequence
  Peptide Derived from Human Papillomavirus
VTSQAIACQK

SEQ ID NO: 9667 - protein, 8 aa, Artificial Sequence
  Peptide Derived from Human Papillomavirus
VTVVDTTR

SEQ ID NO: 9668 - protein, 10 aa, Artificial Sequence
  Peptide Derived from Human Papillomavirus
VVSTDEYVAR

SEQ ID NO: 9669 - protein, 10 aa, Artificial Sequence
  Peptide Derived from Human Papillomavirus
WACVGVEVGR

SEQ ID NO: 9670 - protein, 10 aa, Artificial Sequence
  Peptide Derived from Human Papillomavirus
YAANAGVDNR

SEQ ID NO: 9671 - protein, 9 aa, Artificial Sequence
  Peptide Derived from Human Papillomavirus
YLPPVPVSK

SEQ ID NO: 9672 - protein, 10 aa, Artificial Sequence
  Peptide Derived from Human Papillomavirus
YLRREQMFVR

SEQ ID NO: 9673 - protein, 9 aa, Artificial Sequence
  Peptide Derived from Human Papillomavirus
YTFWEVNLK

SEQ ID NO: 9674 - protein, 11 aa, Artificial Sequence
  Peptide Derived from Human Papillomavirus
YTFWEVNLKEK

SEQ ID NO: 9675 - protein, 10 aa, Artificial Sequence
  Peptide Derived from Human Papillomavirus
ALHRPALTSR

SEQ ID NO: 9676 - protein, 11 aa, Artificial Sequence
  Peptide Derived from Human Papillomavirus
ALHRPALTSRR

SEQ ID NO: 9677 - protein, 10 aa, Artificial Sequence
  Peptide Derived from Human Papillomavirus
ALTSRRTGIR

SEQ ID NO: 9678 - protein, 8 aa, Artificial Sequence
  Peptide Derived from Human Papillomavirus
ASATQLYK

SEQ ID NO: 9679 - protein, 11 aa, Artificial Sequence
  Peptide Derived from Human Papillomavirus
ASATQLYKTCK

SEQ ID NO: 9680 - protein, 9 aa, Artificial Sequence
  Peptide Derived from Human Papillomavirus
ATDTLAPVR

SEQ ID NO: 9681 - protein, 9 aa, Artificial Sequence
  Peptide Derived from Human Papillomavirus
ATQLYKTCK

SEQ ID NO: 9682 - protein, 9 aa, Artificial Sequence
  Peptide Derived from Human Papillomavirus
DIIPKVEGK

SEQ ID NO: 9683 - protein, 9 aa, Artificial Sequence
  Peptide Derived from Human Papillomavirus
FLDIVALHR

SEQ ID NO: 9684 - protein, 11 aa, Artificial Sequence
  Peptide Derived from Human Papillomavirus
GIGTGSGTGGR

SEQ ID NO: 9685 - protein, 10 aa, Artificial Sequence
  Peptide Derived from Human Papillomavirus
GIRYSRIGNK

SEQ ID NO: 9686 - protein, 11 aa, Artificial Sequence
  Peptide Derived from Human Papillomavirus
GLYSRTTQQVK

SEQ ID NO: 9687 - protein, 10 aa, Artificial Sequence
  Peptide Derived from Human Papillomavirus
GTCPPDIIPK

SEQ ID NO: 9688 - protein, 9 aa, Artificial Sequence
  Peptide Derived from Human Papillomavirus
GTGSGTGGR

SEQ ID NO: 9689 - protein, 8 aa, Artificial Sequence
  Peptide Derived from Human Papillomavirus
IIPKVEGK

SEQ ID NO: 9690 - protein, 9 aa, Artificial Sequence
  Peptide Derived from Human Papillomavirus
LTSRRTGIR

SEQ ID NO: 9691 - protein, 8 aa, Artificial Sequence
  Peptide Derived from Human Papillomavirus
MLRKRRKR

SEQ ID NO: 9692 - protein, 9 aa, Artificial Sequence
  Peptide Derived from Human Papillomavirus
PAFITTPTK

SEQ ID NO: 9693 - protein, 11 aa, Artificial Sequence
  Peptide Derived from Human Papillomavirus
PALTSRRTGIR

SEQ ID NO: 9694 - protein, 10 aa, Artificial Sequence
  Peptide Derived from Human Papillomavirus
PIPGSRPVAR

SEQ ID NO: 9695 - protein, 8 aa, Artificial Sequence
  Peptide Derived from Human Papillomavirus
PSYYMLRK

SEQ ID NO: 9696 - protein, 9 aa, Artificial Sequence
  Peptide Derived from Human Papillomavirus
PSYYMLRKR

SEQ ID NO: 9697 - protein, 10 aa, Artificial Sequence
  Peptide Derived from Human Papillomavirus
PSYYMLRKRR

SEQ ID NO: 9698 - protein, 11 aa, Artificial Sequence
  Peptide Derived from Human Papillomavirus
PSYYMLRKRRK

SEQ ID NO: 9699 - protein, 11 aa, Artificial Sequence
  Peptide Derived from Human Papillomavirus
PTATDTLAPVR

SEQ ID NO: 9700 - protein, 10 aa, Artificial Sequence
  Peptide Derived from Human Papillomavirus
PVARLGLYSR

SEQ ID NO: 9701 - protein, 9 aa, Artificial Sequence
  Peptide Derived from Human Papillomavirus
QTLRTRSGK

SEQ ID NO: 9702 - protein, 9 aa, Artificial Sequence
  Peptide Derived from Human Papillomavirus
RASATQLYK

SEQ ID NO: 9703 - protein, 9 aa, Artificial Sequence
  Peptide Derived from Human Papillomavirus
RIGNKQTLR

SEQ ID NO: 9704 - protein, 11 aa, Artificial Sequence
  Peptide Derived from Human Papillomavirus
RIGNKQTLRTR

SEQ ID NO: 9705 - protein, 8 aa, Artificial Sequence
  Peptide Derived from Human Papillomavirus
RSAKRTKR

SEQ ID NO: 9706 - protein, 9 aa, Artificial Sequence
  Peptide Derived from Human Papillomavirus
RSGKSIGAK

SEQ ID NO: 9707 - protein, 8 aa, Artificial Sequence
  Peptide Derived from Human Papillomavirus
RTGIRYSR

SEQ ID NO: 9708 - protein, 10 aa, Artificial Sequence
  Peptide Derived from Human Papillomavirus
RTGYIPLGTR

SEQ ID NO: 9709 - protein, 11 aa, Artificial Sequence
  Peptide Derived from Human Papillomavirus
RTRSGKSIGAK

SEQ ID NO: 9710 - protein, 10 aa, Artificial Sequence
  Peptide Derived from Human Papillomavirus
SATQLYKTCK

SEQ ID NO: 9711 - protein, 9 aa, Artificial Sequence
  Peptide Derived from Human Papillomavirus
SSTPIPGSR

SEQ ID NO: 9712 - protein, 8 aa, Artificial Sequence
  Peptide Derived from Human Papillomavirus
STPIPGSR

SEQ ID NO: 9713 - protein, 10 aa, Artificial Sequence
  Peptide Derived from Human Papillomavirus
TATDTLAPVR

SEQ ID NO: 9714 - protein, 8 aa, Artificial Sequence
  Peptide Derived from Human Papillomavirus
TLRTRSGK

SEQ ID NO: 9715 - protein, 8 aa, Artificial Sequence
  Peptide Derived from Human Papillomavirus
TSRRTGIR

SEQ ID NO: 9716 - protein, 11 aa, Artificial Sequence
  Peptide Derived from Human Papillomavirus
TSRRTGIRYSR

SEQ ID NO: 9717 - protein, 10 aa, Artificial Sequence
  Peptide Derived from Human Papillomavirus
TSSTPIPGSR

SEQ ID NO: 9718 - protein, 11 aa, Artificial Sequence
  Peptide Derived from Human Papillomavirus
VALHRPALTSR

SEQ ID NO: 9719 - protein, 9 aa, Artificial Sequence
  Peptide Derived from Human Papillomavirus
VARLGLYSR

SEQ ID NO: 9720 - protein, 11 aa, Artificial Sequence
  Peptide Derived from Human Papillomavirus
VTSSTPIPGSR

SEQ ID NO: 9721 - protein, 10 aa, Artificial Sequence
  Peptide Derived from Human Papillomavirus
YLHPSYYMLR

SEQ ID NO: 9722 - protein, 11 aa, Artificial Sequence
  Peptide Derived from Human Papillomavirus
YLHPSYYMLRK

SEQ ID NO: 9723 - protein, 8 aa, Artificial Sequence
  Peptide Derived from Human Papillomavirus
YMLRKRRK

SEQ ID NO: 9724 - protein, 9 aa, Artificial Sequence
  Peptide Derived from Human Papillomavirus
YMLRKRRKR

SEQ ID NO: 9725 - protein, 11 aa, Artificial Sequence
  Peptide Derived from Human Papillomavirus
YSRIGNKQTLR

SEQ ID NO: 9726 - protein, 9 aa, Artificial Sequence
  Peptide Derived from Human Papillomavirus
YSRTTQQVK

SEQ ID NO: 9727 - protein, 11 aa, Artificial Sequence
  Peptide Derived from Human Papillomavirus
AAFLKSNCQAK

SEQ ID NO: 9728 - protein, 11 aa, Artificial Sequence
  Peptide Derived from Human Papillomavirus
ALDGNPISIDR

SEQ ID NO: 9729 - protein, 11 aa, Artificial Sequence
  Peptide Derived from Human Papillomavirus
ALKSFLKGTPK

SEQ ID NO: 9730 - protein, 9 aa, Artificial Sequence
  Peptide Derived from Human Papillomavirus
ALLRYKCGK

SEQ ID NO: 9731 - protein, 11 aa, Artificial Sequence
  Peptide Derived from Human Papillomavirus
ALLRYKCGKSR

SEQ ID NO: 9732 - protein, 8 aa, Artificial Sequence
  Peptide Derived from Human Papillomavirus
ATMCKHYR

SEQ ID NO: 9733 - protein, 9 aa, Artificial Sequence
  Peptide Derived from Human Papillomavirus
ATMCKHYRR

SEQ ID NO: 9734 - protein, 9 aa, Artificial Sequence
  Peptide Derived from Human Papillomavirus
CATMCKHYR

SEQ ID NO: 9735 - protein, 10 aa, Artificial Sequence
  Peptide Derived from Human Papillomavirus
CATMCKHYRR

SEQ ID NO: 9736 - protein, 8 aa, Artificial Sequence
  Peptide Derived from Human Papillomavirus
CMLIQPPK

SEQ ID NO: 9737 - protein, 10 aa, Artificial Sequence
  Peptide Derived from Human Papillomavirus
CMLIQPPKLR

SEQ ID NO: 9738 - protein, 11 aa, Artificial Sequence
  Peptide Derived from Human Papillomavirus
CSKIDEGGDWR

SEQ ID NO: 9739 - protein, 11 aa, Artificial Sequence
  Peptide Derived from Human Papillomavirus
CTIAQLKDLLK

SEQ ID NO: 9740 - protein, 9 aa, Artificial Sequence
  Peptide Derived from Human Papillomavirus
DAQVLHVLK

SEQ ID NO: 9741 - protein, 10 aa, Artificial Sequence
  Peptide Derived from Human Papillomavirus
DAQVLHVLKR

SEQ ID NO: 9742 - protein, 11 aa, Artificial Sequence
  Peptide Derived from Human Papillomavirus
DAQVLHVLKRK

SEQ ID NO: 9743 - protein, 8 aa, Artificial Sequence
  Peptide Derived from Human Papillomavirus
DLLKVNNK

SEQ ID NO: 9744 - protein, 10 aa, Artificial Sequence
  Peptide Derived from Human Papillomavirus
DLVRNFKSDK

SEQ ID NO: 9745 - protein, 11 aa, Artificial Sequence
  Peptide Derived from Human Papillomavirus
DSNSNAAAFLK

SEQ ID NO: 9746 - protein, 11 aa, Artificial Sequence
  Peptide Derived from Human Papillomavirus
DTEGNPFGTFK

SEQ ID NO: 9747 - protein, 8 aa, Artificial Sequence
  Peptide Derived from Human Papillomavirus
DTPEWIQR

SEQ ID NO: 9748 - protein, 8 aa, Artificial Sequence
  Peptide Derived from Human Papillomavirus
EINDKNWK

SEQ ID NO: 9749 - protein, 9 aa, Artificial Sequence
  Peptide Derived from Human Papillomavirus
EISLNSGQK

SEQ ID NO: 9750 - protein, 10 aa, Artificial Sequence
  Peptide Derived from Human Papillomavirus
EISLNSGQKK

SEQ ID NO: 9751 - protein, 10 aa, Artificial Sequence
  Peptide Derived from Human Papillomavirus
ETCMLIQPPK

SEQ ID NO: 9752 - protein, 9 aa, Artificial Sequence
  Peptide Derived from Human Papillomavirus
EVDTELSPR

SEQ ID NO: 9753 - protein, 9 aa, Artificial Sequence
  Peptide Derived from Human Papillomavirus
FITFLGALK

SEQ ID NO: 9754 - protein, 10 aa, Artificial Sequence
  Peptide Derived from Human Papillomavirus
FLGALKSFLK

SEQ ID NO: 9755 - protein, 8 aa, Artificial Sequence
  Peptide Derived from Human Papillomavirus
FLKGTPKK

SEQ ID NO: 9756 - protein, 9 aa, Artificial Sequence
  Peptide Derived from Human Papillomavirus
FLKSNCQAK

SEQ ID NO: 9757 - protein, 9 aa, Artificial Sequence
  Peptide Derived from Human Papillomavirus
FTDLVRNFK

SEQ ID NO: 9758 - protein, 8 aa, Artificial Sequence
  Peptide Derived from Human Papillomavirus
GALKSFLK

SEQ ID NO: 9759 - protein, 8 aa, Artificial Sequence
  Peptide Derived from Human Papillomavirus
GAMLAVFK

SEQ ID NO: 9760 - protein, 9 aa, Artificial Sequence
  Peptide Derived from Human Papillomavirus
GLSFTDLVR

SEQ ID NO: 9761 - protein, 11 aa, Artificial Sequence
  Peptide Derived from Human Papillomavirus
GSTENSPLGER

SEQ ID NO: 9762 - protein, 9 aa, Artificial Sequence
  Peptide Derived from Human Papillomavirus
GVLILALLR

SEQ ID NO: 9763 - protein, 11 aa, Artificial Sequence
  Peptide Derived from Human Papillomavirus
GVLILALLRYK

SEQ ID NO: 9764 - protein, 11 aa, Artificial Sequence
  Peptide Derived from Human Papillomavirus
GVNPTIAEGFK

SEQ ID NO: 9765 - protein, 8 aa, Artificial Sequence
  Peptide Derived from Human Papillomavirus
HIQCLDCK

SEQ ID NO: 9766 - protein, 9 aa, Artificial Sequence
  Peptide Derived from Human Papillomavirus
IAQLKDLLK

SEQ ID NO: 9767 - protein, 8 aa, Artificial Sequence
  Peptide Derived from Human Papillomavirus
ILALLRYK

SEQ ID NO: 9768 - protein, 11 aa, Artificial Sequence
  Peptide Derived from Human Papillomavirus
ILALLRYKCGK

SEQ ID NO: 9769 - protein, 11 aa, Artificial Sequence
  Peptide Derived from Human Papillomavirus
ILLTTNIHPAK

SEQ ID NO: 9770 - protein, 8 aa, Artificial Sequence
  Peptide Derived from Human Papillomavirus
ISIDRKHK

SEQ ID NO: 9771 - protein, 8 aa, Artificial Sequence
  Peptide Derived from Human Papillomavirus
ISLNSGQK

SEQ ID NO: 9772 - protein, 9 aa, Artificial Sequence
  Peptide Derived from Human Papillomavirus
ISLNSGQKK

SEQ ID NO: 9773 - protein, 11 aa, Artificial Sequence
  Peptide Derived from Human Papillomavirus
ISLNSGQKKAK

SEQ ID NO: 9774 - protein, 8 aa, Artificial Sequence
  Peptide Derived from Human Papillomavirus
ITFLGALK

SEQ ID NO: 9775 - protein, 9 aa, Artificial Sequence
  Peptide Derived from Human Papillomavirus
KIDEGGDWR

SEQ ID NO: 9776 - protein, 9 aa, Artificial Sequence
  Peptide Derived from Human Papillomavirus
KLRAGQNHR

SEQ ID NO: 9777 - protein, 9 aa, Artificial Sequence
  Peptide Derived from Human Papillomavirus
KSFLKGTPK

SEQ ID NO: 9778 - protein, 10 aa, Artificial Sequence
  Peptide Derived from Human Papillomavirus
KSFLKGTPKK

SEQ ID NO: 9779 - protein, 10 aa, Artificial Sequence
  Peptide Derived from Human Papillomavirus
KSNCQAKYLK

SEQ ID NO: 9780 - protein, 8 aa, Artificial Sequence
  Peptide Derived from Human Papillomavirus
KSRLTVAK

SEQ ID NO: 9781 - protein, 10 aa, Artificial Sequence
  Peptide Derived from Human Papillomavirus
LALLRYKCGK

SEQ ID NO: 9782 - protein, 9 aa, Artificial Sequence
  Peptide Derived from Human Papillomavirus
LILALLRYK

SEQ ID NO: 9783 - protein, 8 aa, Artificial Sequence
  Peptide Derived from Human Papillomavirus
LIQPPKLR

SEQ ID NO: 9784 - protein, 8 aa, Artificial Sequence
  Peptide Derived from Human Papillomavirus
LLRYKCGK

SEQ ID NO: 9785 - protein, 10 aa, Artificial Sequence
  Peptide Derived from Human Papillomavirus
LLRYKCGKSR

SEQ ID NO: 9786 - protein, 10 aa, Artificial Sequence
  Peptide Derived from Human Papillomavirus
LLTTNIHPAK

SEQ ID NO: 9787 - protein, 8 aa, Artificial Sequence
  Peptide Derived from Human Papillomavirus
LSFTDLVR

SEQ ID NO: 9788 - protein, 11 aa, Artificial Sequence
  Peptide Derived from Human Papillomavirus
LSFTDLVRNFK

SEQ ID NO: 9789 - protein, 9 aa, Artificial Sequence
  Peptide Derived from Human Papillomavirus
LTTNIHPAK

SEQ ID NO: 9790 - protein, 11 aa, Artificial Sequence
  Peptide Derived from Human Papillomavirus
LVFCGPANTGK

SEQ ID NO: 9791 - protein, 9 aa, Artificial Sequence
  Peptide Derived from Human Papillomavirus
LVRNFKSDK

SEQ ID NO: 9792 - protein, 9 aa, Artificial Sequence
  Peptide Derived from Human Papillomavirus
MLIQPPKLR

SEQ ID NO: 9793 - protein, 8 aa, Artificial Sequence
  Peptide Derived from Human Papillomavirus
MSQWIRFR

SEQ ID NO: 9794 - protein, 11 aa, Artificial Sequence
  Peptide Derived from Human Papillomavirus
MSQWIRFRCSK

SEQ ID NO: 9795 - protein, 9 aa, Artificial Sequence
  Peptide Derived from Human Papillomavirus
NIHPAKDNR

SEQ ID NO: 9796 - protein, 9 aa, Artificial Sequence
  Peptide Derived from Human Papillomavirus
NMSQWIRFR

SEQ ID NO: 9797 - protein, 8 aa, Artificial Sequence
  Peptide Derived from Human Papillomavirus
NSGQKKAK

SEQ ID NO: 9798 - protein, 9 aa, Artificial Sequence
  Peptide Derived from Human Papillomavirus
NSGQKKAKR

SEQ ID NO: 9799 - protein, 10 aa, Artificial Sequence
  Peptide Derived from Human Papillomavirus
NSGQKKAKRR

SEQ ID NO: 9800 - protein, 9 aa, Artificial Sequence
  Peptide Derived from Human Papillomavirus
NSNAAAFLK

SEQ ID NO: 9801 - protein, 9 aa, Artificial Sequence
  Peptide Derived from Human Papillomavirus
PISIDRKHK

SEQ ID NO: 9802 - protein, 8 aa, Artificial Sequence
  Peptide Derived from Human Papillomavirus
PTIAEGFK

SEQ ID NO: 9803 - protein, 8 aa, Artificial Sequence
  Peptide Derived from Human Papillomavirus
PVYEINDK

SEQ ID NO: 9804 - protein, 11 aa, Artificial Sequence
  Peptide Derived from Human Papillomavirus
PVYEINDKNWK

SEQ ID NO: 9805 - protein, 11 aa, Artificial Sequence
  Peptide Derived from Human Papillomavirus
QLKDLLKVNNK

SEQ ID NO: 9806 - protein, 9 aa, Artificial Sequence
  Peptide Derived from Human Papillomavirus
QMNMSQWIR

SEQ ID NO: 9807 - protein, 11 aa, Artificial Sequence
  Peptide Derived from Human Papillomavirus
QMNMSQWIRFR

SEQ ID NO: 9808 - protein, 8 aa, Artificial Sequence
  Peptide Derived from Human Papillomavirus
QVLHVLKR

SEQ ID NO: 9809 - protein, 9 aa, Artificial Sequence
  Peptide Derived from Human Papillomavirus
QVLHVLKRK

SEQ ID NO: 9810 - protein, 11 aa, Artificial Sequence
  Peptide Derived from Human Papillomavirus
RLEVDTELSPR

SEQ ID NO: 9811 - protein, 11 aa, Artificial Sequence
  Peptide Derived from Human Papillomavirus
RSSVAALYWYR

SEQ ID NO: 9812 - protein, 8 aa, Artificial Sequence
  Peptide Derived from Human Papillomavirus
SLNSGQKK

SEQ ID NO: 9813 - protein, 10 aa, Artificial Sequence
  Peptide Derived from Human Papillomavirus
SLNSGQKKAK

SEQ ID NO: 9814 - protein, 11 aa, Artificial Sequence
  Peptide Derived from Human Papillomavirus
SLNSGQKKAKR

SEQ ID NO: 9815 - protein, 10 aa, Artificial Sequence
  Peptide Derived from Human Papillomavirus
SSVAALYWYR

SEQ ID NO: 9816 - protein, 10 aa, Artificial Sequence
  Peptide Derived from Human Papillomavirus
STENSPLGER

SEQ ID NO: 9817 - protein, 9 aa, Artificial Sequence
  Peptide Derived from Human Papillomavirus
SVAALYWYR

SEQ ID NO: 9818 - protein, 10 aa, Artificial Sequence
  Peptide Derived from Human Papillomavirus
TIAQLKDLLK

SEQ ID NO: 9819 - protein, 8 aa, Artificial Sequence
  Peptide Derived from Human Papillomavirus
TMCKHYRR

SEQ ID NO: 9820 - protein, 11 aa, Artificial Sequence
  Peptide Derived from Human Papillomavirus
TMCKHYRRAQK

SEQ ID NO: 9821 - protein, 8 aa, Artificial Sequence
  Peptide Derived from Human Papillomavirus
TTNIHPAK

SEQ ID NO: 9822 - protein, 11 aa, Artificial Sequence
  Peptide Derived from Human Papillomavirus
TTNIHPAKDNR

SEQ ID NO: 9823 - protein, 8 aa, Artificial Sequence
  Peptide Derived from Human Papillomavirus
VAALYWYR

SEQ ID NO: 9824 - protein, 8 aa, Artificial Sequence
  Peptide Derived from Human Papillomavirus
VLHVLKRK

SEQ ID NO: 9825 - protein, 8 aa, Artificial Sequence
  Peptide Derived from Human Papillomavirus
VLILALLR

SEQ ID NO: 9826 - protein, 10 aa, Artificial Sequence
  Peptide Derived from Human Papillomavirus
VLILALLRYK

SEQ ID NO: 9827 - protein, 11 aa, Artificial Sequence
  Peptide Derived from Human Papillomavirus
VMGDTPEWIQR

SEQ ID NO: 9828 - protein, 8 aa, Artificial Sequence
  Peptide Derived from Human Papillomavirus
WIRFRCSK

SEQ ID NO: 9829 - protein, 9 aa, Artificial Sequence
  Peptide Derived from Human Papillomavirus
WLEPLTDTK

SEQ ID NO: 9830 - protein, 9 aa, Artificial Sequence
  Peptide Derived from Human Papillomavirus
WTYFDTYMR

SEQ ID NO: 9831 - protein, 10 aa, Artificial Sequence
  Peptide Derived from Human Papillomavirus
YAHIQCLDCK

SEQ ID NO: 9832 - protein, 10 aa, Artificial Sequence
  Peptide Derived from Human Papillomavirus
YLKDCATMCK

SEQ ID NO: 9833 - protein, 8 aa, Artificial Sequence
  Peptide Derived from Human Papillomavirus
YVQAIVDK

SEQ ID NO: 9834 - protein, 9 aa, Artificial Sequence
  Peptide Derived from Human Papillomavirus
YVQAIVDKK

SEQ ID NO: 9835 - protein, 9 aa, Artificial Sequence
  Peptide Derived from Human Papillomavirus
AATPTGNNK

SEQ ID NO: 9836 - protein, 10 aa, Artificial Sequence
  Peptide Derived from Human Papillomavirus
AATPTGNNKR

SEQ ID NO: 9837 - protein, 11 aa, Artificial Sequence
  Peptide Derived from Human Papillomavirus
AATPTGNNKRR

SEQ ID NO: 9838 - protein, 9 aa, Artificial Sequence
  Peptide Derived from Human Papillomavirus
ALQGLAQSR

SEQ ID NO: 9839 - protein, 11 aa, Artificial Sequence
  Peptide Derived from Human Papillomavirus
ALQGLAQSRYK

SEQ ID NO: 9840 - protein, 8 aa, Artificial Sequence
  Peptide Derived from Human Papillomavirus
ATPTGNNK

SEQ ID NO: 9841 - protein, 9 aa, Artificial Sequence
  Peptide Derived from Human Papillomavirus
ATPTGNNKR

SEQ ID NO: 9842 - protein, 10 aa, Artificial Sequence
  Peptide Derived from Human Papillomavirus
ATPTGNNKRR

SEQ ID NO: 9843 - protein, 11 aa, Artificial Sequence
  Peptide Derived from Human Papillomavirus
ATPTGNNKRRK

SEQ ID NO: 9844 - protein, 8 aa, Artificial Sequence
  Peptide Derived from Human Papillomavirus
CLRYRLRK

SEQ ID NO: 9845 - protein, 11 aa, Artificial Sequence
  Peptide Derived from Human Papillomavirus
CVSHRGLYYVK

SEQ ID NO: 9846 - protein, 11 aa, Artificial Sequence
  Peptide Derived from Human Papillomavirus
DSQIQYWQLIR

SEQ ID NO: 9847 - protein, 10 aa, Artificial Sequence
  Peptide Derived from Human Papillomavirus
DTVSATQLVK

SEQ ID NO: 9848 - protein, 10 aa, Artificial Sequence
  Peptide Derived from Human Papillomavirus
GAATPTGNNK

SEQ ID NO: 9849 - protein, 11 aa, Artificial Sequence
  Peptide Derived from Human Papillomavirus
GAATPTGNNKR

SEQ ID NO: 9850 - protein, 8 aa, Artificial Sequence
  Peptide Derived from Human Papillomavirus
GLAQSRYK

SEQ ID NO: 9851 - protein, 10 aa, Artificial Sequence
  Peptide Derived from Human Papillomavirus
HLKGDRNSLK

SEQ ID NO: 9852 - protein, 8 aa, Artificial Sequence
  Peptide Derived from Human Papillomavirus
HSETQRTK

SEQ ID NO: 9853 - protein, 10 aa, Artificial Sequence
  Peptide Derived from Human Papillomavirus
IIDHYENDSK

SEQ ID NO: 9854 - protein, 8 aa, Artificial Sequence
  Peptide Derived from Human Papillomavirus
IIHLKGDR

SEQ ID NO: 9855 - protein, 8 aa, Artificial Sequence
  Peptide Derived from Human Papillomavirus
ISKSKAHK

SEQ ID NO: 9856 - protein, 11 aa, Artificial Sequence
  Peptide Derived from Human Papillomavirus
KIIDHYENDSK

SEQ ID NO: 9857 - protein, 9 aa, Artificial Sequence
  Peptide Derived from Human Papillomavirus
KTATCVSHR

SEQ ID NO: 9858 - protein, 11 aa, Artificial Sequence
  Peptide Derived from Human Papillomavirus
KTYGQTSAATR

SEQ ID NO: 9859 - protein, 11 aa, Artificial Sequence
  Peptide Derived from Human Papillomavirus
LSERLSCVQDK

SEQ ID NO: 9860 - protein, 11 aa, Artificial Sequence
  Peptide Derived from Human Papillomavirus
LTVTYHSETQR

SEQ ID NO: 9861 - protein, 10 aa, Artificial Sequence
  Peptide Derived from Human Papillomavirus
MALQGLAQSR

SEQ ID NO: 9862 - protein, 9 aa, Artificial Sequence
  Peptide Derived from Human Papillomavirus
MTDAGTWDK

SEQ ID NO: 9863 - protein, 8 aa, Artificial Sequence
  Peptide Derived from Human Papillomavirus
NAIFFAAR

SEQ ID NO: 9864 - protein, 9 aa, Artificial Sequence
  Peptide Derived from Human Papillomavirus
NISKSKAHK

SEQ ID NO: 9865 - protein, 9 aa, Artificial Sequence
  Peptide Derived from Human Papillomavirus
NSLKCLRYR

SEQ ID NO: 9866 - protein, 11 aa, Artificial Sequence
  Peptide Derived from Human Papillomavirus
NSLKCLRYRLR

SEQ ID NO: 9867 - protein, 9 aa, Artificial Sequence
  Peptide Derived from Human Papillomavirus
NTEPTHCFK

SEQ ID NO: 9868 - protein, 10 aa, Artificial Sequence
  Peptide Derived from Human Papillomavirus
NTEPTHCFKK

SEQ ID NO: 9869 - protein, 8 aa, Artificial Sequence
  Peptide Derived from Human Papillomavirus
NTFYIEFK

SEQ ID NO: 9870 - protein, 9 aa, Artificial Sequence
  Peptide Derived from Human Papillomavirus
NTTPIIHLK

SEQ ID NO: 9871 - protein, 9 aa, Artificial Sequence
  Peptide Derived from Human Papillomavirus
PAYNISKSK

SEQ ID NO: 9872 - protein, 9 aa, Artificial Sequence
  Peptide Derived from Human Papillomavirus
PIIHLKGDR

SEQ ID NO: 9873 - protein, 8 aa, Artificial Sequence
  Peptide Derived from Human Papillomavirus
PTGNNKRR

SEQ ID NO: 9874 - protein, 9 aa, Artificial Sequence
  Peptide Derived from Human Papillomavirus
PTGNNKRRK

SEQ ID NO: 9875 - protein, 9 aa, Artificial Sequence
  Peptide Derived from Human Papillomavirus
QIQYWQLIR

SEQ ID NO: 9876 - protein, 11 aa, Artificial Sequence
  Peptide Derived from Human Papillomavirus
QMALQGLAQSR

SEQ ID NO: 9877 - protein, 10 aa, Artificial Sequence
  Peptide Derived from Human Papillomavirus
QTPKETLSER

SEQ ID NO: 9878 - protein, 11 aa, Artificial Sequence
  Peptide Derived from Human Papillomavirus
QTVQVYFDGNK

SEQ ID NO: 9879 - protein, 10 aa, Artificial Sequence
  Peptide Derived from Human Papillomavirus
QVVPAYNISK

SEQ ID NO: 9880 - protein, 8 aa, Artificial Sequence
  Peptide Derived from Human Papillomavirus
QVYFDGNK

SEQ ID NO: 9881 - protein, 10 aa, Artificial Sequence
  Peptide Derived from Human Papillomavirus
RLRKHSDHYR

SEQ ID NO: 9882 - protein, 8 aa, Artificial Sequence
  Peptide Derived from Human Papillomavirus
RLSCVQDK

SEQ ID NO: 9883 - protein, 8 aa, Artificial Sequence
  Peptide Derived from Human Papillomavirus
SLKCLRYR

SEQ ID NO: 9884 - protein, 10 aa, Artificial Sequence
  Peptide Derived from Human Papillomavirus
SLKCLRYRLR

SEQ ID NO: 9885 - protein, 11 aa, Artificial Sequence
  Peptide Derived from Human Papillomavirus
SLKCLRYRLRK

SEQ ID NO: 9886 - protein, 10 aa, Artificial Sequence
  Peptide Derived from Human Papillomavirus
SSTVSVGTAK

SEQ ID NO: 9887 - protein, 9 aa, Artificial Sequence
  Peptide Derived from Human Papillomavirus
STVSVGTAK

SEQ ID NO: 9888 - protein, 8 aa, Artificial Sequence
  Peptide Derived from Human Papillomavirus
TATCVSHR

SEQ ID NO: 9889 - protein, 8 aa, Artificial Sequence
  Peptide Derived from Human Papillomavirus
TTPIIHLK

SEQ ID NO: 9890 - protein, 11 aa, Artificial Sequence
  Peptide Derived from Human Papillomavirus
TTPIIHLKGDR

SEQ ID NO: 9891 - protein, 10 aa, Artificial Sequence
  Peptide Derived from Human Papillomavirus
TVQVYFDGNK

SEQ ID NO: 9892 - protein, 9 aa, Artificial Sequence
  Peptide Derived from Human Papillomavirus
TVSATQLVK

SEQ ID NO: 9893 - protein, 8 aa, Artificial Sequence
  Peptide Derived from Human Papillomavirus
TVSVGTAK

SEQ ID NO: 9894 - protein, 10 aa, Artificial Sequence
  Peptide Derived from Human Papillomavirus
TVTYHSETQR

SEQ ID NO: 9895 - protein, 8 aa, Artificial Sequence
  Peptide Derived from Human Papillomavirus
VSATQLVK

SEQ ID NO: 9896 - protein, 10 aa, Artificial Sequence
  Peptide Derived from Human Papillomavirus
VSHRGLYYVK

SEQ ID NO: 9897 - protein, 9 aa, Artificial Sequence
  Peptide Derived from Human Papillomavirus
VTYHSETQR

SEQ ID NO: 9898 - protein, 11 aa, Artificial Sequence
  Peptide Derived from Human Papillomavirus
VTYHSETQRTK

SEQ ID NO: 9899 - protein, 9 aa, Artificial Sequence
  Peptide Derived from Human Papillomavirus
VVPAYNISK

SEQ ID NO: 9900 - protein, 11 aa, Artificial Sequence
  Peptide Derived from Human Papillomavirus
VVPAYNISKSK

SEQ ID NO: 9901 - protein, 8 aa, Artificial Sequence
  Peptide Derived from Human Papillomavirus
WTGAGNEK

SEQ ID NO: 9902 - protein, 10 aa, Artificial Sequence
  Peptide Derived from Human Papillomavirus
YIEFKSECEK

SEQ ID NO: 9903 - protein, 10 aa, Artificial Sequence
  Peptide Derived from Human Papillomavirus
YMTDAGTWDK

SEQ ID NO: 9904 - protein, 11 aa, Artificial Sequence
  Peptide Derived from Human Papillomavirus
YSSTVSVGTAK

SEQ ID NO: 9905 - protein, 9 aa, Artificial Sequence
  Peptide Derived from Human Papillomavirus
CIDFYSRIR

SEQ ID NO: 9906 - protein, 10 aa, Artificial Sequence
  Peptide Derived from Human Papillomavirus
DIEITCVYCK

SEQ ID NO: 9907 - protein, 10 aa, Artificial Sequence
  Peptide Derived from Human Papillomavirus
DSIPHAACHK

SEQ ID NO: 9908 - protein, 10 aa, Artificial Sequence
  Peptide Derived from Human Papillomavirus
DSVYGDTLEK

SEQ ID NO: 9909 - protein, 8 aa, Artificial Sequence
  Peptide Derived from Human Papillomavirus
EITCVYCK

SEQ ID NO: 9910 - protein, 11 aa, Artificial Sequence
  Peptide Derived from Human Papillomavirus
ELTEVFEFAFK

SEQ ID NO: 9911 - protein, 8 aa, Artificial Sequence
  Peptide Derived from Human Papillomavirus
EVFEFAFK

SEQ ID NO: 9912 - protein, 11 aa, Artificial Sequence
  Peptide Derived from Human Papillomavirus
FAFKDLFVVYR

SEQ ID NO: 9913 - protein, 8 aa, Artificial Sequence
  Peptide Derived from Human Papillomavirus
GLYNLLIR

SEQ ID NO: 9914 - protein, 11 aa, Artificial Sequence
  Peptide Derived from Human Papillomavirus
GLYNLLIRCLR

SEQ ID NO: 9915 - protein, 8 aa, Artificial Sequence
  Peptide Derived from Human Papillomavirus
HSCCNRAR

SEQ ID NO: 9916 - protein, 11 aa, Artificial Sequence
  Peptide Derived from Human Papillomavirus
HSCCNRARQER

SEQ ID NO: 9917 - protein, 8 aa, Artificial Sequence
  Peptide Derived from Human Papillomavirus
KLRHLNEK

SEQ ID NO: 9918 - protein, 9 aa, Artificial Sequence
  Peptide Derived from Human Papillomavirus
KLRHLNEKR

SEQ ID NO: 9919 - protein, 10 aa, Artificial Sequence
  Peptide Derived from Human Papillomavirus
KLRHLNEKRR

SEQ ID NO: 9920 - protein, 9 aa, Artificial Sequence
  Peptide Derived from Human Papillomavirus
LIRCLRCQK

SEQ ID NO: 9921 - protein, 10 aa, Artificial Sequence
  Peptide Derived from Human Papillomavirus
LLIRCLRCQK

SEQ ID NO: 9922 - protein, 10 aa, Artificial Sequence
  Peptide Derived from Human Papillomavirus
LTEVFEFAFK

SEQ ID NO: 9923 - protein, 9 aa, Artificial Sequence
  Peptide Derived from Human Papillomavirus
MARFEDPTR

SEQ ID NO: 9924 - protein, 10 aa, Artificial Sequence
  Peptide Derived from Human Papillomavirus
MARFEDPTRR

SEQ ID NO: 9925 - protein, 8 aa, Artificial Sequence
  Peptide Derived from Human Papillomavirus
NLLIRCLR

SEQ ID NO: 9926 - protein, 11 aa, Artificial Sequence
  Peptide Derived from Human Papillomavirus
NLLIRCLRCQK

SEQ ID NO: 9927 - protein, 10 aa, Artificial Sequence
  Peptide Derived from Human Papillomavirus
NTGLYNLLIR

SEQ ID NO: 9928 - protein, 11 aa, Artificial Sequence
  Peptide Derived from Human Papillomavirus
PAEKLRHLNEK

SEQ ID NO: 9929 - protein, 9 aa, Artificial Sequence
  Peptide Derived from Human Papillomavirus
PLNPAEKLR

SEQ ID NO: 9930 - protein, 9 aa, Artificial Sequence
  Peptide Derived from Human Papillomavirus
RARQERLQR

SEQ ID NO: 9931 - protein, 10 aa, Artificial Sequence
  Peptide Derived from Human Papillomavirus
RARQERLQRR

SEQ ID NO: 9932 - protein, 11 aa, Artificial Sequence
  Peptide Derived from Human Papillomavirus
RARQERLQRRR

SEQ ID NO: 9933 - protein, 9 aa, Artificial Sequence
  Peptide Derived from Human Papillomavirus
SIPHAACHK

SEQ ID NO: 9934 - protein, 9 aa, Artificial Sequence
  Peptide Derived from Human Papillomavirus
SVYGDTLEK

SEQ ID NO: 9935 - protein, 8 aa, Artificial Sequence
  Peptide Derived from Human Papillomavirus
YSRIRELR

SEQ ID NO: 9936 - protein, 9 aa, Artificial Sequence
  Peptide Derived from Human Papillomavirus
CMCCKCEAR

SEQ ID NO: 9937 - protein, 11 aa, Artificial Sequence
  Peptide Derived from Human Papillomavirus
CMCCKCEARIK

SEQ ID NO: 9938 - protein, 8 aa, Artificial Sequence
  Peptide Derived from Human Papillomavirus
ESSADDLR

SEQ ID NO: 9939 - protein, 10 aa, Artificial Sequence
  Peptide Derived from Human Papillomavirus
GVNHQHLPAR

SEQ ID NO: 9940 - protein, 11 aa, Artificial Sequence
  Peptide Derived from Human Papillomavirus
GVNHQHLPARR

SEQ ID NO: 9941 - protein, 11 aa, Artificial Sequence
  Peptide Derived from Human Papillomavirus
HLPARRAEPQR

SEQ ID NO: 9942 - protein, 9 aa, Artificial Sequence
  Peptide Derived from Human Papillomavirus
HTMLCMCCK

SEQ ID NO: 9943 - protein, 11 aa, Artificial Sequence
  Peptide Derived from Human Papillomavirus
LVVESSADDLR

SEQ ID NO: 9944 - protein, 11 aa, Artificial Sequence
  Peptide Derived from Human Papillomavirus
MLCMCCKCEAR

SEQ ID NO: 9945 - protein, 9 aa, Artificial Sequence
  Peptide Derived from Human Papillomavirus
PARRAEPQR

SEQ ID NO: 9946 - protein, 8 aa, Artificial Sequence
  Peptide Derived from Human Papillomavirus
TMLCMCCK

SEQ ID NO: 9947 - protein, 10 aa, Artificial Sequence
  Peptide Derived from Human Papillomavirus
VVESSADDLR

SEQ ID NO: 9948 - protein, 11 aa, Artificial Sequence
  Peptide Derived from Human Papillomavirus
AATSNVSEDVR

SEQ ID NO: 9949 - protein, 8 aa, Artificial Sequence
  Peptide Derived from Human Papillomavirus
AIGEHWAK

SEQ ID NO: 9950 - protein, 11 aa, Artificial Sequence
  Peptide Derived from Human Papillomavirus
AMDFSTLQDTK

SEQ ID NO: 9951 - protein, 9 aa, Artificial Sequence
  Peptide Derived from Human Papillomavirus
ATKFKQYSR

SEQ ID NO: 9952 - protein, 10 aa, Artificial Sequence
  Peptide Derived from Human Papillomavirus
ATSNVSEDVR

SEQ ID NO: 9953 - protein, 9 aa, Artificial Sequence
  Peptide Derived from Human Papillomavirus
ATTSSKPAK

SEQ ID NO: 9954 - protein, 10 aa, Artificial Sequence
  Peptide Derived from Human Papillomavirus
ATTSSKPAKR

SEQ ID NO: 9955 - protein, 8 aa, Artificial Sequence
  Peptide Derived from Human Papillomavirus
CAGVEIGR

SEQ ID NO: 9956 - protein, 11 aa, Artificial Sequence
  Peptide Derived from Human Papillomavirus
CAPAIGEHWAK

SEQ ID NO: 9957 - protein, 10 aa, Artificial Sequence
  Peptide Derived from Human Papillomavirus
CLRREQLFAR

SEQ ID NO: 9958 - protein, 8 aa, Artificial Sequence
  Peptide Derived from Human Papillomavirus
DAAPAENK

SEQ ID NO: 9959 - protein, 10 aa, Artificial Sequence
  Peptide Derived from Human Papillomavirus
DATKFKQYSR

SEQ ID NO: 9960 - protein, 8 aa, Artificial Sequence
  Peptide Derived from Human Papillomavirus
DICQSICK

SEQ ID NO: 9961 - protein, 11 aa, Artificial Sequence
  Peptide Derived from Human Papillomavirus
DIPKVSAYQYR

SEQ ID NO: 9962 - protein, 9 aa, Artificial Sequence
  Peptide Derived from Human Papillomavirus
DLDQYPLGR

SEQ ID NO: 9963 - protein, 10 aa, Artificial Sequence
  Peptide Derived from Human Papillomavirus
DLDQYPLGRK

SEQ ID NO: 9964 - protein, 8 aa, Artificial Sequence
  Peptide Derived from Human Papillomavirus
DSMFFCLR

SEQ ID NO: 9965 - protein, 9 aa, Artificial Sequence
  Peptide Derived from Human Papillomavirus
DSMFFCLRR

SEQ ID NO: 9966 - protein, 11 aa, Artificial Sequence
  Peptide Derived from Human Papillomavirus
DTSIYNPETQR

SEQ ID NO: 9967 - protein, 10 aa, Artificial Sequence
  Peptide Derived from Human Papillomavirus
DTVPQSLYIK

SEQ ID NO: 9968 - protein, 11 aa, Artificial Sequence
  Peptide Derived from Human Papillomavirus
DVRDNVSVDYK

SEQ ID NO: 9969 - protein, 8 aa, Artificial Sequence
  Peptide Derived from Human Papillomavirus
FARHFWNR

SEQ ID NO: 9970 - protein, 8 aa, Artificial Sequence
  Peptide Derived from Human Papillomavirus
FLQMALWR

SEQ ID NO: 9971 - protein, 8 aa, Artificial Sequence
  Peptide Derived from Human Papillomavirus
FLVQAGLR

SEQ ID NO: 9972 - protein, 9 aa, Artificial Sequence
  Peptide Derived from Human Papillomavirus
FLVQAGLRR

SEQ ID NO: 9973 - protein, 10 aa, Artificial Sequence
  Peptide Derived from Human Papillomavirus
FLVQAGLRRK

SEQ ID NO: 9974 - protein, 8 aa, Artificial Sequence
  Peptide Derived from Human Papillomavirus
FSTLQDTK

SEQ ID NO: 9975 - protein, 11 aa, Artificial Sequence
  Peptide Derived from Human Papillomavirus
FVQSVAITCQK

SEQ ID NO: 9976 - protein, 11 aa, Artificial Sequence
  Peptide Derived from Human Papillomavirus
GLRRKPTIGPR

SEQ ID NO: 9977 - protein, 10 aa, Artificial Sequence
  Peptide Derived from Human Papillomavirus
GLSGHPFYNK

SEQ ID NO: 9978 - protein, 11 aa, Artificial Sequence
  Peptide Derived from Human Papillomavirus
IVTSDSQLFNK

SEQ ID NO: 9979 - protein, 10 aa, Artificial Sequence
  Peptide Derived from Human Papillomavirus
KLKFWNVDLK

SEQ ID NO: 9980 - protein, 8 aa, Artificial Sequence
  Peptide Derived from Human Papillomavirus
KVSAYQYR

SEQ ID NO: 9981 - protein, 11 aa, Artificial Sequence
  Peptide Derived from Human Papillomavirus
KVSAYQYRVFR

SEQ ID NO: 9982 - protein, 10 aa, Artificial Sequence
  Peptide Derived from Human Papillomavirus
LLTVGNPYFR

SEQ ID NO: 9983 - protein, 9 aa, Artificial Sequence
  Peptide Derived from Human Papillomavirus
LSGHPFYNK

SEQ ID NO: 9984 - protein, 9 aa, Artificial Sequence
  Peptide Derived from Human Papillomavirus
LTVGNPYFR

SEQ ID NO: 9985 - protein, 8 aa, Artificial Sequence
  Peptide Derived from Human Papillomavirus
LVQAGLRR

SEQ ID NO: 9986 - protein, 9 aa, Artificial Sequence
  Peptide Derived from Human Papillomavirus
LVQAGLRRK

SEQ ID NO: 9987 - protein, 10 aa, Artificial Sequence
  Peptide Derived from Human Papillomavirus
PAENKDPYDK

SEQ ID NO: 9988 - protein, 9 aa, Artificial Sequence
  Peptide Derived from Human Papillomavirus
PAIGEHWAK

SEQ ID NO: 9989 - protein, 8 aa, Artificial Sequence
  Peptide Derived from Human Papillomavirus
PAKRVRVR

SEQ ID NO: 9990 - protein, 10 aa, Artificial Sequence
  Peptide Derived from Human Papillomavirus
PAKRVRVRAR

SEQ ID NO: 9991 - protein, 11 aa, Artificial Sequence
  Peptide Derived from Human Papillomavirus
PAKRVRVRARK

SEQ ID NO: 9992 - protein, 10 aa, Artificial Sequence
  Peptide Derived from Human Papillomavirus
PIFLQMALWR

SEQ ID NO: 9993 - protein, 10 aa, Artificial Sequence
  Peptide Derived from Human Papillomavirus
PLDICQSICK

SEQ ID NO: 9994 - protein, 10 aa, Artificial Sequence
  Peptide Derived from Human Papillomavirus
PLYGPLYHPR

SEQ ID NO: 9995 - protein, 8 aa, Artificial Sequence
  Peptide Derived from Human Papillomavirus
PSATTSSK

SEQ ID NO: 9996 - protein, 11 aa, Artificial Sequence
  Peptide Derived from Human Papillomavirus
PSATTSSKPAK

SEQ ID NO: 9997 - protein, 8 aa, Artificial Sequence
  Peptide Derived from Human Papillomavirus
PTIGPRKR

SEQ ID NO: 9998 - protein, 10 aa, Artificial Sequence
  Peptide Derived from Human Papillomavirus
PTTSLVDTYR

SEQ ID NO: 9999 - protein, 10 aa, Artificial Sequence
  Peptide Derived from Human Papillomavirus
PVPGQYDATK

SEQ ID NO: 10000 - protein, 10 aa, Artificial Sequence
  Peptide Derived from Human Papillomavirus
QLFARHFWNR

SEQ ID NO: 10001 - protein, 11 aa, Artificial Sequence
  Peptide Derived from Human Papillomavirus
QLFNKPYWLHK

SEQ ID NO: 10002 - protein, 9 aa, Artificial Sequence
  Peptide Derived from Human Papillomavirus
QSVAITCQK

SEQ ID NO: 10003 - protein, 11 aa, Artificial Sequence
  Peptide Derived from Human Papillomavirus
RLLTVGNPYFR

SEQ ID NO: 10004 - protein, 11 aa, Artificial Sequence
  Peptide Derived from Human Papillomavirus
RSAPSATTSSK

SEQ ID NO: 10005 - protein, 9 aa, Artificial Sequence
  Peptide Derived from Human Papillomavirus
RVPAGGGNK

SEQ ID NO: 10006 - protein, 9 aa, Artificial Sequence
  Peptide Derived from Human Papillomavirus
RVQLPDPNK

SEQ ID NO: 10007 - protein, 8 aa, Artificial Sequence
  Peptide Derived from Human Papillomavirus
RVRVRARK

SEQ ID NO: 10008 - protein, 10 aa, Artificial Sequence
  Peptide Derived from Human Papillomavirus
SAPSATTSSK

SEQ ID NO: 10009 - protein, 10 aa, Artificial Sequence
  Peptide Derived from Human Papillomavirus
SATTSSKPAK

SEQ ID NO: 10010 - protein, 11 aa, Artificial Sequence
  Peptide Derived from Human Papillomavirus
SATTSSKPAKR

SEQ ID NO: 10011 - protein, 9 aa, Artificial Sequence
  Peptide Derived from Human Papillomavirus
SAYQYRVFR

SEQ ID NO: 10012 - protein, 10 aa, Artificial Sequence
  Peptide Derived from Human Papillomavirus
SIFYHAGSSR

SEQ ID NO: 10013 - protein, 9 aa, Artificial Sequence
  Peptide Derived from Human Papillomavirus
SIYNPETQR

SEQ ID NO: 10014 - protein, 11 aa, Artificial Sequence
  Peptide Derived from Human Papillomavirus
SLDLDQYPLGR

SEQ ID NO: 10015 - protein, 8 aa, Artificial Sequence
  Peptide Derived from Human Papillomavirus
SMFFCLRR

SEQ ID NO: 10016 - protein, 9 aa, Artificial Sequence
  Peptide Derived from Human Papillomavirus
SSKPAKRVR

SEQ ID NO: 10017 - protein, 11 aa, Artificial Sequence
  Peptide Derived from Human Papillomavirus
SSKPAKRVRVR

SEQ ID NO: 10018 - protein, 8 aa, Artificial Sequence
  Peptide Derived from Human Papillomavirus
SVAITCQK

SEQ ID NO: 10019 - protein, 9 aa, Artificial Sequence
  Peptide Derived from Human Papillomavirus
TSDSQLFNK

SEQ ID NO: 10020 - protein, 11 aa, Artificial Sequence
  Peptide Derived from Human Papillomavirus
TSIFYHAGSSR

SEQ ID NO: 10021 - protein, 10 aa, Artificial Sequence
  Peptide Derived from Human Papillomavirus
TSIYNPETQR

SEQ ID NO: 10022 - protein, 8 aa, Artificial Sequence
  Peptide Derived from Human Papillomavirus
TSLVDTYR

SEQ ID NO: 10023 - protein, 9 aa, Artificial Sequence
  Peptide Derived from Human Papillomavirus
TSNVSEDVR

SEQ ID NO: 10024 - protein, 8 aa, Artificial Sequence
  Peptide Derived from Human Papillomavirus
TSSKPAKR

SEQ ID NO: 10025 - protein, 10 aa, Artificial Sequence
  Peptide Derived from Human Papillomavirus
TSSKPAKRVR

SEQ ID NO: 10026 - protein, 9 aa, Artificial Sequence
  Peptide Derived from Human Papillomavirus
TTSLVDTYR

SEQ ID NO: 10027 - protein, 8 aa, Artificial Sequence
  Peptide Derived from Human Papillomavirus
TTSSKPAK

SEQ ID NO: 10028 - protein, 9 aa, Artificial Sequence
  Peptide Derived from Human Papillomavirus
TTSSKPAKR

SEQ ID NO: 10029 - protein, 11 aa, Artificial Sequence
  Peptide Derived from Human Papillomavirus
TTSSKPAKRVR

SEQ ID NO: 10030 - protein, 8 aa, Artificial Sequence
  Peptide Derived from Human Papillomavirus
TVGNPYFR

SEQ ID NO: 10031 - protein, 9 aa, Artificial Sequence
  Peptide Derived from Human Papillomavirus
TVPQSLYIK

SEQ ID NO: 10032 - protein, 11 aa, Artificial Sequence
  Peptide Derived from Human Papillomavirus
TVYLPPPSVAR

SEQ ID NO: 10033 - protein, 10 aa, Artificial Sequence
  Peptide Derived from Human Papillomavirus
VSAYQYRVFR

SEQ ID NO: 10034 - protein, 10 aa, Artificial Sequence
  Peptide Derived from Human Papillomavirus
VTSDSQLFNK

SEQ ID NO: 10035 - protein, 10 aa, Artificial Sequence
  Peptide Derived from Human Papillomavirus
WACAGVEIGR

SEQ ID NO: 10036 - protein, 8 aa, Artificial Sequence
  Peptide Derived from Human Papillomavirus
WAKGTACK

SEQ ID NO: 10037 - protein, 10 aa, Artificial Sequence
  Peptide Derived from Human Papillomavirus
WAKGTACKSR

SEQ ID NO: 10038 - protein, 9 aa, Artificial Sequence
  Peptide Derived from Human Papillomavirus
YLPPPSVAR

SEQ ID NO: 10039 - protein, 10 aa, Artificial Sequence
  Peptide Derived from Human Papillomavirus
ALTSRRGTVR

SEQ ID NO: 10040 - protein, 8 aa, Artificial Sequence
  Peptide Derived from Human Papillomavirus
ASVTDLYK

SEQ ID NO: 10041 - protein, 11 aa, Artificial Sequence
  Peptide Derived from Human Papillomavirus
ASVTDLYKTCK

SEQ ID NO: 10042 - protein, 11 aa, Artificial Sequence
  Peptide Derived from Human Papillomavirus
DMDPAVPVPSR

SEQ ID NO: 10043 - protein, 9 aa, Artificial Sequence
  Peptide Derived from Human Papillomavirus
DSDFMDIIR

SEQ ID NO: 10044 - protein, 11 aa, Artificial Sequence
  Peptide Derived from Human Papillomavirus
DSSVVTSGAPR

SEQ ID NO: 10045 - protein, 9 aa, Artificial Sequence
  Peptide Derived from Human Papillomavirus
DTTLTFDPR

SEQ ID NO: 10046 - protein, 8 aa, Artificial Sequence
  Peptide Derived from Human Papillomavirus
FIPKKRKR

SEQ ID NO: 10047 - protein, 9 aa, Artificial Sequence
  Peptide Derived from Human Papillomavirus
FMDIIRLHR

SEQ ID NO: 10048 - protein, 11 aa, Artificial Sequence
  Peptide Derived from Human Papillomavirus
FTRSGTQIGAR

SEQ ID NO: 10049 - protein, 11 aa, Artificial Sequence
  Peptide Derived from Human Papillomavirus
GIGTGSGTGGR

SEQ ID NO: 10050 - protein, 10 aa, Artificial Sequence
  Peptide Derived from Human Papillomavirus
GTCPPDVVPK

SEQ ID NO: 10051 - protein, 9 aa, Artificial Sequence
  Peptide Derived from Human Papillomavirus
GTGSGTGGR

SEQ ID NO: 10052 - protein, 11 aa, Artificial Sequence
  Peptide Derived from Human Papillomavirus
GTVRFSRLGQR

SEQ ID NO: 10053 - protein, 10 aa, Artificial Sequence
  Peptide Derived from Human Papillomavirus
ISSTPLPTVR

SEQ ID NO: 10054 - protein, 11 aa, Artificial Sequence
  Peptide Derived from Human Papillomavirus
ISSTPLPTVRR

SEQ ID NO: 10055 - protein, 10 aa, Artificial Sequence
  Peptide Derived from Human Papillomavirus
KVEGTTLADK

SEQ ID NO: 10056 - protein, 9 aa, Artificial Sequence
  Peptide Derived from Human Papillomavirus
LTSRRGTVR

SEQ ID NO: 10057 - protein, 8 aa, Artificial Sequence
  Peptide Derived from Human Papillomavirus
MVSHRAAR

SEQ ID NO: 10058 - protein, 9 aa, Artificial Sequence
  Peptide Derived from Human Papillomavirus
MVSHRAARR

SEQ ID NO: 10059 - protein, 10 aa, Artificial Sequence
  Peptide Derived from Human Papillomavirus
MVSHRAARRK

SEQ ID NO: 10060 - protein, 11 aa, Artificial Sequence
  Peptide Derived from Human Papillomavirus
MVSHRAARRKR

SEQ ID NO: 10061 - protein, 10 aa, Artificial Sequence
  Peptide Derived from Human Papillomavirus
NTVVDVGPTR

SEQ ID NO: 10062 - protein, 11 aa, Artificial Sequence
  Peptide Derived from Human Papillomavirus
PALTSRRGTVR

SEQ ID NO: 10063 - protein, 8 aa, Artificial Sequence
  Peptide Derived from Human Papillomavirus
PAVPVPSR

SEQ ID NO: 10064 - protein, 11 aa, Artificial Sequence
  Peptide Derived from Human Papillomavirus
PISSTPLPTVR

SEQ ID NO: 10065 - protein, 8 aa, Artificial Sequence
  Peptide Derived from Human Papillomavirus
PLYYFIPK

SEQ ID NO: 10066 - protein, 9 aa, Artificial Sequence
  Peptide Derived from Human Papillomavirus
PLYYFIPKK

SEQ ID NO: 10067 - protein, 10 aa, Artificial Sequence
  Peptide Derived from Human Papillomavirus
PLYYFIPKKR

SEQ ID NO: 10068 - protein, 11 aa, Artificial Sequence
  Peptide Derived from Human Papillomavirus
PLYYFIPKKRK

SEQ ID NO: 10069 - protein, 10 aa, Artificial Sequence
  Peptide Derived from Human Papillomavirus
PTVRRVAGPR

SEQ ID NO: 10070 - protein, 11 aa, Artificial Sequence
  Peptide Derived from Human Papillomavirus
PVDTTLTFDPR

SEQ ID NO: 10071 - protein, 9 aa, Artificial Sequence
  Peptide Derived from Human Papillomavirus
RASVTDLYK

SEQ ID NO: 10072 - protein, 11 aa, Artificial Sequence
  Peptide Derived from Human Papillomavirus
RLGQRATMFTR

SEQ ID NO: 10073 - protein, 10 aa, Artificial Sequence
  Peptide Derived from Human Papillomavirus
RLHRPALTSR

SEQ ID NO: 10074 - protein, 11 aa, Artificial Sequence
  Peptide Derived from Human Papillomavirus
RLHRPALTSRR

SEQ ID NO: 10075 - protein, 9 aa, Artificial Sequence
  Peptide Derived from Human Papillomavirus
RSGTQIGAR

SEQ ID NO: 10076 - protein, 10 aa, Artificial Sequence
  Peptide Derived from Human Papillomavirus
RSTTSFAFFK

SEQ ID NO: 10077 - protein, 10 aa, Artificial Sequence
  Peptide Derived from Human Papillomavirus
RTGYIPLGGR

SEQ ID NO: 10078 - protein, 10 aa, Artificial Sequence
  Peptide Derived from Human Papillomavirus
RVAGPRLYSR

SEQ ID NO: 10079 - protein, 9 aa, Artificial Sequence
  Peptide Derived from Human Papillomavirus
SSTPLPTVR

SEQ ID NO: 10080 - protein, 10 aa, Artificial Sequence
  Peptide Derived from Human Papillomavirus
SSTPLPTVRR

SEQ ID NO: 10081 - protein, 10 aa, Artificial Sequence
  Peptide Derived from Human Papillomavirus
SSVVTSGAPR

SEQ ID NO: 10082 - protein, 8 aa, Artificial Sequence
  Peptide Derived from Human Papillomavirus
STPLPTVR

SEQ ID NO: 10083 - protein, 9 aa, Artificial Sequence
  Peptide Derived from Human Papillomavirus
STPLPTVRR

SEQ ID NO: 10084 - protein, 9 aa, Artificial Sequence
  Peptide Derived from Human Papillomavirus
STTSFAFFK

SEQ ID NO: 10085 - protein, 10 aa, Artificial Sequence
  Peptide Derived from Human Papillomavirus
SVANPEFLTR

SEQ ID NO: 10086 - protein, 10 aa, Artificial Sequence
  Peptide Derived from Human Papillomavirus
SVTDLYKTCK

SEQ ID NO: 10087 - protein, 9 aa, Artificial Sequence
  Peptide Derived from Human Papillomavirus
SVVTSGAPR

SEQ ID NO: 10088 - protein, 8 aa, Artificial Sequence
  Peptide Derived from Human Papillomavirus
TSRRGTVR

SEQ ID NO: 10089 - protein, 11 aa, Artificial Sequence
  Peptide Derived from Human Papillomavirus
TSRRGTVRFSR

SEQ ID NO: 10090 - protein, 8 aa, Artificial Sequence
  Peptide Derived from Human Papillomavirus
TTLTFDPR

SEQ ID NO: 10091 - protein, 8 aa, Artificial Sequence
  Peptide Derived from Human Papillomavirus
TTSFAFFK

SEQ ID NO: 10092 - protein, 10 aa, Artificial Sequence
  Peptide Derived from Human Papillomavirus
TVRFSRLGQR

SEQ ID NO: 10093 - protein, 9 aa, Artificial Sequence
  Peptide Derived from Human Papillomavirus
TVRRVAGPR

SEQ ID NO: 10094 - protein, 9 aa, Artificial Sequence
  Peptide Derived from Human Papillomavirus
TVVDVGPTR

SEQ ID NO: 10095 - protein, 9 aa, Artificial Sequence
  Peptide Derived from Human Papillomavirus
VAGPRLYSR

SEQ ID NO: 10096 - protein, 9 aa, Artificial Sequence
  Peptide Derived from Human Papillomavirus
VANPEFLTR

SEQ ID NO: 10097 - protein, 8 aa, Artificial Sequence
  Peptide Derived from Human Papillomavirus
VSHRAARR

SEQ ID NO: 10098 - protein, 9 aa, Artificial Sequence
  Peptide Derived from Human Papillomavirus
VSHRAARRK

SEQ ID NO: 10099 - protein, 10 aa, Artificial Sequence
  Peptide Derived from Human Papillomavirus
VSHRAARRKR

SEQ ID NO: 10100 - protein, 11 aa, Artificial Sequence
  Peptide Derived from Human Papillomavirus
VSVANPEFLTR

SEQ ID NO: 10101 - protein, 9 aa, Artificial Sequence
  Peptide Derived from Human Papillomavirus
VTDLYKTCK

SEQ ID NO: 10102 - protein, 8 aa, Artificial Sequence
  Peptide Derived from Human Papillomavirus
VVDVGPTR

SEQ ID NO: 10103 - protein, 8 aa, Artificial Sequence
  Peptide Derived from Human Papillomavirus
VVTSGAPR

SEQ ID NO: 10104 - protein, 11 aa, Artificial Sequence
  Peptide Derived from Human Papillomavirus
YLWPLYYFIPK

SEQ ID NO: 10105 - protein, 8 aa, Artificial Sequence
  Peptide Derived from Human Papillomavirus
AAALYWYR

SEQ ID NO: 10106 - protein, 8 aa, Artificial Sequence
  Peptide Derived from Human Papillomavirus
AAMLGKFK

SEQ ID NO: 10107 - protein, 9 aa, Artificial Sequence
  Peptide Derived from Human Papillomavirus
AICIENNSK

SEQ ID NO: 10108 - protein, 11 aa, Artificial Sequence
  Peptide Derived from Human Papillomavirus
ALKLFLKGVPK

SEQ ID NO: 10109 - protein, 8 aa, Artificial Sequence
  Peptide Derived from Human Papillomavirus
AVQVLKRK

SEQ ID NO: 10110 - protein, 11 aa, Artificial Sequence
  Peptide Derived from Human Papillomavirus
CAFLKSNSQAK

SEQ ID NO: 10111 - protein, 10 aa, Artificial Sequence
  Peptide Derived from Human Papillomavirus
CAKNRITIEK

SEQ ID NO: 10112 - protein, 10 aa, Artificial Sequence
  Peptide Derived from Human Papillomavirus
CIENNSKTAK

SEQ ID NO: 10113 - protein, 11 aa, Artificial Sequence
  Peptide Derived from Human Papillomavirus
CIENNSKTAKR

SEQ ID NO: 10114 - protein, 9 aa, Artificial Sequence
  Peptide Derived from Human Papillomavirus
CIISYANSK

SEQ ID NO: 10115 - protein, 8 aa, Artificial Sequence
  Peptide Derived from Human Papillomavirus
CMLIQPPK

SEQ ID NO: 10116 - protein, 10 aa, Artificial Sequence
  Peptide Derived from Human Papillomavirus
CMLIQPPKLR

SEQ ID NO: 10117 - protein, 9 aa, Artificial Sequence
  Peptide Derived from Human Papillomavirus
CVDYNISPR

SEQ ID NO: 10118 - protein, 11 aa, Artificial Sequence
  Peptide Derived from Human Papillomavirus
CVDYNISPRLK

SEQ ID NO: 10119 - protein, 8 aa, Artificial Sequence
  Peptide Derived from Human Papillomavirus
CVSGQNIR

SEQ ID NO: 10120 - protein, 11 aa, Artificial Sequence
  Peptide Derived from Human Papillomavirus
DSDSNACAFLK

SEQ ID NO: 10121 - protein, 9 aa, Artificial Sequence
  Peptide Derived from Human Papillomavirus
DSNACAFLK

SEQ ID NO: 10122 - protein, 11 aa, Artificial Sequence
  Peptide Derived from Human Papillomavirus
DVKHKALMQLK

SEQ ID NO: 10123 - protein, 11 aa, Artificial Sequence
  Peptide Derived from Human Papillomavirus
DVMDDSEIAYK

SEQ ID NO: 10124 - protein, 8 aa, Artificial Sequence
  Peptide Derived from Human Papillomavirus
EAVQVLKR

SEQ ID NO: 10125 - protein, 9 aa, Artificial Sequence
  Peptide Derived from Human Papillomavirus
EAVQVLKRK

SEQ ID NO: 10126 - protein, 10 aa, Artificial Sequence
  Peptide Derived from Human Papillomavirus
ELIRPFQSNK

SEQ ID NO: 10127 - protein, 8 aa, Artificial Sequence
  Peptide Derived from Human Papillomavirus
ELSDKNWK

SEQ ID NO: 10128 - protein, 8 aa, Artificial Sequence
  Peptide Derived from Human Papillomavirus
ETPEWIER

SEQ ID NO: 10129 - protein, 8 aa, Artificial Sequence
  Peptide Derived from Human Papillomavirus
FLKGVPKK

SEQ ID NO: 10130 - protein, 9 aa, Artificial Sequence
  Peptide Derived from Human Papillomavirus
FLKSNSQAK

SEQ ID NO: 10131 - protein, 10 aa, Artificial Sequence
  Peptide Derived from Human Papillomavirus
FLSALKLFLK

SEQ ID NO: 10132 - protein, 11 aa, Artificial Sequence
  Peptide Derived from Human Papillomavirus
FTFPNPFPFDK

SEQ ID NO: 10133 - protein, 9 aa, Artificial Sequence
  Peptide Derived from Human Papillomavirus
FVSFLSALK

SEQ ID NO: 10134 - protein, 9 aa, Artificial Sequence
  Peptide Derived from Human Papillomavirus
GMVMLMLVR

SEQ ID NO: 10135 - protein, 11 aa, Artificial Sequence
  Peptide Derived from Human Papillomavirus
GMVMLMLVRFK

SEQ ID NO: 10136 - protein, 9 aa, Artificial Sequence
  Peptide Derived from Human Papillomavirus
GSDGTHSER

SEQ ID NO: 10137 - protein, 8 aa, Artificial Sequence
  Peptide Derived from Human Papillomavirus
GTMCRHYK

SEQ ID NO: 10138 - protein, 9 aa, Artificial Sequence
  Peptide Derived from Human Papillomavirus
GTMCRHYKR

SEQ ID NO: 10139 - protein, 8 aa, Artificial Sequence
  Peptide Derived from Human Papillomavirus
GTVAEGFK

SEQ ID NO: 10140 - protein, 9 aa, Artificial Sequence
  Peptide Derived from Human Papillomavirus
GVSFMELIR

SEQ ID NO: 10141 - protein, 11 aa, Artificial Sequence
  Peptide Derived from Human Papillomavirus
GVTGTVAEGFK

SEQ ID NO: 10142 - protein, 9 aa, Artificial Sequence
  Peptide Derived from Human Papillomavirus
HAEAVQVLK

SEQ ID NO: 10143 - protein, 10 aa, Artificial Sequence
  Peptide Derived from Human Papillomavirus
HAEAVQVLKR

SEQ ID NO: 10144 - protein, 11 aa, Artificial Sequence
  Peptide Derived from Human Papillomavirus
HAEAVQVLKRK

SEQ ID NO: 10145 - protein, 11 aa, Artificial Sequence
  Peptide Derived from Human Papillomavirus
HSERENETPTR

SEQ ID NO: 10146 - protein, 8 aa, Artificial Sequence
  Peptide Derived from Human Papillomavirus
IISYANSK

SEQ ID NO: 10147 - protein, 11 aa, Artificial Sequence
  Peptide Derived from Human Papillomavirus
ILIHGAPNTGK

SEQ ID NO: 10148 - protein, 11 aa, Artificial Sequence
  Peptide Derived from Human Papillomavirus
ILQVLKTSNGK

SEQ ID NO: 10149 - protein, 9 aa, Artificial Sequence
  Peptide Derived from Human Papillomavirus
ITIEKLLEK

SEQ ID NO: 10150 - protein, 9 aa, Artificial Sequence
  Peptide Derived from Human Papillomavirus
ITSNINAGK

SEQ ID NO: 10151 - protein, 10 aa, Artificial Sequence
  Peptide Derived from Human Papillomavirus
IVKDCGTMCR

SEQ ID NO: 10152 - protein, 9 aa, Artificial Sequence
  Peptide Derived from Human Papillomavirus
KAAMLGKFK

SEQ ID NO: 10153 - protein, 10 aa, Artificial Sequence
  Peptide Derived from Human Papillomavirus
KAICIENNSK

SEQ ID NO: 10154 - protein, 11 aa, Artificial Sequence
  Peptide Derived from Human Papillomavirus
KIVKDCGTMCR

SEQ ID NO: 10155 - protein, 9 aa, Artificial Sequence
  Peptide Derived from Human Papillomavirus
KLFLKGVPK

SEQ ID NO: 10156 - protein, 10 aa, Artificial Sequence
  Peptide Derived from Human Papillomavirus
KLFLKGVPKK

SEQ ID NO: 10157 - protein, 10 aa, Artificial Sequence
  Peptide Derived from Human Papillomavirus
KSFFSRTWCR

SEQ ID NO: 10158 - protein, 10 aa, Artificial Sequence
  Peptide Derived from Human Papillomavirus
KSNSQAKIVK

SEQ ID NO: 10159 - protein, 9 aa, Artificial Sequence
  Peptide Derived from Human Papillomavirus
KVSDEGDWR

SEQ ID NO: 10160 - protein, 10 aa, Artificial Sequence
  Peptide Derived from Human Papillomavirus
LIHGAPNTGK

SEQ ID NO: 10161 - protein, 8 aa, Artificial Sequence
  Peptide Derived from Human Papillomavirus
LIQPPKLR

SEQ ID NO: 10162 - protein, 9 aa, Artificial Sequence
  Peptide Derived from Human Papillomavirus
LIRPFQSNK

SEQ ID NO: 10163 - protein, 10 aa, Artificial Sequence
  Peptide Derived from Human Papillomavirus
LITSNINAGK

SEQ ID NO: 10164 - protein, 11 aa, Artificial Sequence
  Peptide Derived from Human Papillomavirus
LLITSNINAGK

SEQ ID NO: 10165 - protein, 10 aa, Artificial Sequence
  Peptide Derived from Human Papillomavirus
LMLVRFKCAK

SEQ ID NO: 10166 - protein, 9 aa, Artificial Sequence
  Peptide Derived from Human Papillomavirus
LSALKLFLK

SEQ ID NO: 10167 - protein, 8 aa, Artificial Sequence
  Peptide Derived from Human Papillomavirus
LVRFKCAK

SEQ ID NO: 10168 - protein, 10 aa, Artificial Sequence
  Peptide Derived from Human Papillomavirus
LVRFKCAKNR

SEQ ID NO: 10169 - protein, 9 aa, Artificial Sequence
  Peptide Derived from Human Papillomavirus
MLIQPPKLR

SEQ ID NO: 10170 - protein, 8 aa, Artificial Sequence
  Peptide Derived from Human Papillomavirus
MLMLVRFK

SEQ ID NO: 10171 - protein, 11 aa, Artificial Sequence
  Peptide Derived from Human Papillomavirus
MLMLVRFKCAK

SEQ ID NO: 10172 - protein, 9 aa, Artificial Sequence
  Peptide Derived from Human Papillomavirus
MLVRFKCAK

SEQ ID NO: 10173 - protein, 11 aa, Artificial Sequence
  Peptide Derived from Human Papillomavirus
MLVRFKCAKNR

SEQ ID NO: 10174 - protein, 8 aa, Artificial Sequence
  Peptide Derived from Human Papillomavirus
MSMGQWIK

SEQ ID NO: 10175 - protein, 10 aa, Artificial Sequence
  Peptide Derived from Human Papillomavirus
MSMGQWIKSR

SEQ ID NO: 10176 - protein, 8 aa, Artificial Sequence
  Peptide Derived from Human Papillomavirus
MVMLMLVR

SEQ ID NO: 10177 - protein, 10 aa, Artificial Sequence
  Peptide Derived from Human Papillomavirus
MVMLMLVRFK

SEQ ID NO: 10178 - protein, 9 aa, Artificial Sequence
  Peptide Derived from Human Papillomavirus
NINAGKDDR

SEQ ID NO: 10179 - protein, 8 aa, Artificial Sequence
  Peptide Derived from Human Papillomavirus
NLHEEEDK

SEQ ID NO: 10180 - protein, 8 aa, Artificial Sequence
  Peptide Derived from Human Papillomavirus
NSKTAKRR

SEQ ID NO: 10181 - protein, 8 aa, Artificial Sequence
  Peptide Derived from Human Papillomavirus
NSQAKIVK

SEQ ID NO: 10182 - protein, 10 aa, Artificial Sequence
  Peptide Derived from Human Papillomavirus
PTRNILQVLK

SEQ ID NO: 10183 - protein, 9 aa, Artificial Sequence
  Peptide Derived from Human Papillomavirus
PVSIDVKHK

SEQ ID NO: 10184 - protein, 8 aa, Artificial Sequence
  Peptide Derived from Human Papillomavirus
PVYELSDK

SEQ ID NO: 10185 - protein, 11 aa, Artificial Sequence
  Peptide Derived from Human Papillomavirus
PVYELSDKNWK

SEQ ID NO: 10186 - protein, 9 aa, Artificial Sequence
  Peptide Derived from Human Papillomavirus
QMSMGQWIK

SEQ ID NO: 10187 - protein, 11 aa, Artificial Sequence
  Peptide Derived from Human Papillomavirus
QMSMGQWIKSR

SEQ ID NO: 10188 - protein, 9 aa, Artificial Sequence
  Peptide Derived from Human Papillomavirus
QVLKTSNGK

SEQ ID NO: 10189 - protein, 10 aa, Artificial Sequence
  Peptide Derived from Human Papillomavirus
RITIEKLLEK

SEQ ID NO: 10190 - protein, 10 aa, Artificial Sequence
  Peptide Derived from Human Papillomavirus
RLNLHEEEDK

SEQ ID NO: 10191 - protein, 11 aa, Artificial Sequence
  Peptide Derived from Human Papillomavirus
RSTAAALYWYR

SEQ ID NO: 10192 - protein, 8 aa, Artificial Sequence
  Peptide Derived from Human Papillomavirus
SALKLFLK

SEQ ID NO: 10193 - protein, 9 aa, Artificial Sequence
  Peptide Derived from Human Papillomavirus
SMGQWIKSR

SEQ ID NO: 10194 - protein, 11 aa, Artificial Sequence
  Peptide Derived from Human Papillomavirus
SSCVDYNISPR

SEQ ID NO: 10195 - protein, 10 aa, Artificial Sequence
  Peptide Derived from Human Papillomavirus
STAAALYWYR

SEQ ID NO: 10196 - protein, 11 aa, Artificial Sequence
  Peptide Derived from Human Papillomavirus
STNCMLIQPPK

SEQ ID NO: 10197 - protein, 9 aa, Artificial Sequence
  Peptide Derived from Human Papillomavirus
TAAALYWYR

SEQ ID NO: 10198 - protein, 8 aa, Artificial Sequence
  Peptide Derived from Human Papillomavirus
TIEKLLEK

SEQ ID NO: 10199 - protein, 8 aa, Artificial Sequence
  Peptide Derived from Human Papillomavirus
TMCRHYKR

SEQ ID NO: 10200 - protein, 11 aa, Artificial Sequence
  Peptide Derived from Human Papillomavirus
TMCRHYKRAEK

SEQ ID NO: 10201 - protein, 11 aa, Artificial Sequence
  Peptide Derived from Human Papillomavirus
TSNGKAAMLGK

SEQ ID NO: 10202 - protein, 8 aa, Artificial Sequence
  Peptide Derived from Human Papillomavirus
TSNINAGK

SEQ ID NO: 10203 - protein, 11 aa, Artificial Sequence
  Peptide Derived from Human Papillomavirus
TSNINAGKDDR

SEQ ID NO: 10204 - protein, 8 aa, Artificial Sequence
  Peptide Derived from Human Papillomavirus
VLKTSNGK

SEQ ID NO: 10205 - protein, 10 aa, Artificial Sequence
  Peptide Derived from Human Papillomavirus
VMDDSEIAYK

SEQ ID NO: 10206 - protein, 9 aa, Artificial Sequence
  Peptide Derived from Human Papillomavirus
VMLMLVRFK

SEQ ID NO: 10207 - protein, 8 aa, Artificial Sequence
  Peptide Derived from Human Papillomavirus
VSDEGDWR

SEQ ID NO: 10208 - protein, 8 aa, Artificial Sequence
  Peptide Derived from Human Papillomavirus
VSFLSALK

SEQ ID NO: 10209 - protein, 8 aa, Artificial Sequence
  Peptide Derived from Human Papillomavirus
VSFMELIR

SEQ ID NO: 10210 - protein, 8 aa, Artificial Sequence
  Peptide Derived from Human Papillomavirus
VSIDVKHK

SEQ ID NO: 10211 - protein, 10 aa, Artificial Sequence
  Peptide Derived from Human Papillomavirus
VTGTVAEGFK

SEQ ID NO: 10212 - protein, 8 aa, Artificial Sequence
  Peptide Derived from Human Papillomavirus
WIKSRCDK

SEQ ID NO: 10213 - protein, 9 aa, Artificial Sequence
  Peptide Derived from Human Papillomavirus
WLQPLADAK

SEQ ID NO: 10214 - protein, 8 aa, Artificial Sequence
  Peptide Derived from Human Papillomavirus
YVEAVIDR

SEQ ID NO: 10215 - protein, 9 aa, Artificial Sequence
  Peptide Derived from Human Papillomavirus
AAACTNQTR

SEQ ID NO: 10216 - protein, 8 aa, Artificial Sequence
  Peptide Derived from Human Papillomavirus
AACTNQTR

SEQ ID NO: 10217 - protein, 9 aa, Artificial Sequence
  Peptide Derived from Human Papillomavirus
ALGTSEGVR

SEQ ID NO: 10218 - protein, 10 aa, Artificial Sequence
  Peptide Derived from Human Papillomavirus
ALGTSEGVRR

SEQ ID NO: 10219 - protein, 8 aa, Artificial Sequence
  Peptide Derived from Human Papillomavirus
ALSVSKAK

SEQ ID NO: 10220 - protein, 9 aa, Artificial Sequence
  Peptide Derived from Human Papillomavirus
ATTPIIHLK

SEQ ID NO: 10221 - protein, 9 aa, Artificial Sequence
  Peptide Derived from Human Papillomavirus
ATTSTKRPR

SEQ ID NO: 10222 - protein, 10 aa, Artificial Sequence
  Peptide Derived from Human Papillomavirus
CALGTSEGVR

SEQ ID NO: 10223 - protein, 11 aa, Artificial Sequence
  Peptide Derived from Human Papillomavirus
CALGTSEGVRR

SEQ ID NO: 10224 - protein, 8 aa, Artificial Sequence
  Peptide Derived from Human Papillomavirus
CLRYRLSK

SEQ ID NO: 10225 - protein, 10 aa, Artificial Sequence
  Peptide Derived from Human Papillomavirus
CLRYRLSKYK

SEQ ID NO: 10226 - protein, 11 aa, Artificial Sequence
  Peptide Derived from Human Papillomavirus
CTVVEGQVNCK

SEQ ID NO: 10227 - protein, 8 aa, Artificial Sequence
  Peptide Derived from Human Papillomavirus
CVLMYKAR

SEQ ID NO: 10228 - protein, 9 aa, Artificial Sequence
  Peptide Derived from Human Papillomavirus
DANILKCLR

SEQ ID NO: 10229 - protein, 11 aa, Artificial Sequence
  Peptide Derived from Human Papillomavirus
DANILKCLRYR

SEQ ID NO: 10230 - protein, 9 aa, Artificial Sequence
  Peptide Derived from Human Papillomavirus
EAKKYGTGK

SEQ ID NO: 10231 - protein, 10 aa, Artificial Sequence
  Peptide Derived from Human Papillomavirus
EAKKYGTGKK

SEQ ID NO: 10232 - protein, 10 aa, Artificial Sequence
  Peptide Derived from Human Papillomavirus
EISFAGIVTK

SEQ ID NO: 10233 - protein, 9 aa, Artificial Sequence
  Peptide Derived from Human Papillomavirus
ETLNNTEYK

SEQ ID NO: 10234 - protein, 9 aa, Artificial Sequence
  Peptide Derived from Human Papillomavirus
FVNFTEEAK

SEQ ID NO: 10235 - protein, 10 aa, Artificial Sequence
  Peptide Derived from Human Papillomavirus
FVNFTEEAKK

SEQ ID NO: 10236 - protein, 8 aa, Artificial Sequence
  Peptide Derived from Human Papillomavirus
GTSEGVRR

SEQ ID NO: 10237 - protein, 10 aa, Artificial Sequence
  Peptide Derived from Human Papillomavirus
GVRRATTSTK

SEQ ID NO: 10238 - protein, 11 aa, Artificial Sequence
  Peptide Derived from Human Papillomavirus
GVRRATTSTKR

SEQ ID NO: 10239 - protein, 9 aa, Artificial Sequence
  Peptide Derived from Human Papillomavirus
HIDYWKHIR

SEQ ID NO: 10240 - protein, 11 aa, Artificial Sequence
  Peptide Derived from Human Papillomavirus
HIRLECVLMYK

SEQ ID NO: 10241 - protein, 10 aa, Artificial Sequence
  Peptide Derived from Human Papillomavirus
HLKGDANILK

SEQ ID NO: 10242 - protein, 10 aa, Artificial Sequence
  Peptide Derived from Human Papillomavirus
ILEHYENDSK

SEQ ID NO: 10243 - protein, 11 aa, Artificial Sequence
  Peptide Derived from Human Papillomavirus
ILEHYENDSKR

SEQ ID NO: 10244 - protein, 8 aa, Artificial Sequence
  Peptide Derived from Human Papillomavirus
ILKCLRYR

SEQ ID NO: 10245 - protein, 11 aa, Artificial Sequence
  Peptide Derived from Human Papillomavirus
ILKCLRYRLSK

SEQ ID NO: 10246 - protein, 11 aa, Artificial Sequence
  Peptide Derived from Human Papillomavirus
ISAAACTNQTR

SEQ ID NO: 10247 - protein, 9 aa, Artificial Sequence
  Peptide Derived from Human Papillomavirus
ISFAGIVTK

SEQ ID NO: 10248 - protein, 11 aa, Artificial Sequence
  Peptide Derived from Human Papillomavirus
KILEHYENDSK

SEQ ID NO: 10249 - protein, 11 aa, Artificial Sequence
  Peptide Derived from Human Papillomavirus
LSQRLNVCQDK

SEQ ID NO: 10250 - protein, 9 aa, Artificial Sequence
  Peptide Derived from Human Papillomavirus
LTAPTGCLK

SEQ ID NO: 10251 - protein, 10 aa, Artificial Sequence
  Peptide Derived from Human Papillomavirus
LTAPTGCLKK

SEQ ID NO: 10252 - protein, 9 aa, Artificial Sequence
  Peptide Derived from Human Papillomavirus
LTYISTSQR

SEQ ID NO: 10253 - protein, 11 aa, Artificial Sequence
  Peptide Derived from Human Papillomavirus
MLETLNNTEYK

SEQ ID NO: 10254 - protein, 9 aa, Artificial Sequence
  Peptide Derived from Human Papillomavirus
NILKCLRYR

SEQ ID NO: 10255 - protein, 10 aa, Artificial Sequence
  Peptide Derived from Human Papillomavirus
NTHHPNKLLR

SEQ ID NO: 10256 - protein, 9 aa, Artificial Sequence
  Peptide Derived from Human Papillomavirus
NTMHYTNWK

SEQ ID NO: 10257 - protein, 8 aa, Artificial Sequence
  Peptide Derived from Human Papillomavirus
NTTTSNSK

SEQ ID NO: 10258 - protein, 9 aa, Artificial Sequence
  Peptide Derived from Human Papillomavirus
PALSVSKAK

SEQ ID NO: 10259 - protein, 10 aa, Artificial Sequence
  Peptide Derived from Human Papillomavirus
PATTPIIHLK

SEQ ID NO: 10260 - protein, 10 aa, Artificial Sequence
  Peptide Derived from Human Papillomavirus
QVVPALSVSK

SEQ ID NO: 10261 - protein, 8 aa, Artificial Sequence
  Peptide Derived from Human Papillomavirus
RATTSTKR

SEQ ID NO: 10262 - protein, 10 aa, Artificial Sequence
  Peptide Derived from Human Papillomavirus
RATTSTKRPR

SEQ ID NO: 10263 - protein, 10 aa, Artificial Sequence
  Peptide Derived from Human Papillomavirus
RLCDHIDYWK

SEQ ID NO: 10264 - protein, 9 aa, Artificial Sequence
  Peptide Derived from Human Papillomavirus
RLECVLMYK

SEQ ID NO: 10265 - protein, 11 aa, Artificial Sequence
  Peptide Derived from Human Papillomavirus
RLECVLMYKAR

SEQ ID NO: 10266 - protein, 8 aa, Artificial Sequence
  Peptide Derived from Human Papillomavirus
RLNVCQDK

SEQ ID NO: 10267 - protein, 10 aa, Artificial Sequence
  Peptide Derived from Human Papillomavirus
SAAACTNQTR

SEQ ID NO: 10268 - protein, 11 aa, Artificial Sequence
  Peptide Derived from Human Papillomavirus
STWHWTCTDGK

SEQ ID NO: 10269 - protein, 11 aa, Artificial Sequence
  Peptide Derived from Human Papillomavirus
TANNTTTSNSK

SEQ ID NO: 10270 - protein, 8 aa, Artificial Sequence
  Peptide Derived from Human Papillomavirus
TAPTGCLK

SEQ ID NO: 10271 - protein, 9 aa, Artificial Sequence
  Peptide Derived from Human Papillomavirus
TAPTGCLKK

SEQ ID NO: 10272 - protein, 8 aa, Artificial Sequence
  Peptide Derived from Human Papillomavirus
TLNNTEYK

SEQ ID NO: 10273 - protein, 10 aa, Artificial Sequence
  Peptide Derived from Human Papillomavirus
TLTYISTSQR

SEQ ID NO: 10274 - protein, 8 aa, Artificial Sequence
  Peptide Derived from Human Papillomavirus
TMHYTNWK

SEQ ID NO: 10275 - protein, 8 aa, Artificial Sequence
  Peptide Derived from Human Papillomavirus
TTPIIHLK

SEQ ID NO: 10276 - protein, 8 aa, Artificial Sequence
  Peptide Derived from Human Papillomavirus
TTSTKRPR

SEQ ID NO: 10277 - protein, 10 aa, Artificial Sequence
  Peptide Derived from Human Papillomavirus
TVVEGQVNCK

SEQ ID NO: 10278 - protein, 11 aa, Artificial Sequence
  Peptide Derived from Human Papillomavirus
VTLTYISTSQR

SEQ ID NO: 10279 - protein, 9 aa, Artificial Sequence
  Peptide Derived from Human Papillomavirus
VVEGQVNCK

SEQ ID NO: 10280 - protein, 9 aa, Artificial Sequence
  Peptide Derived from Human Papillomavirus
VVPALSVSK

SEQ ID NO: 10281 - protein, 11 aa, Artificial Sequence
  Peptide Derived from Human Papillomavirus
VVPALSVSKAK

SEQ ID NO: 10282 - protein, 9 aa, Artificial Sequence
  Peptide Derived from Human Papillomavirus
WTCTDGKHK

SEQ ID NO: 10283 - protein, 10 aa, Artificial Sequence
  Peptide Derived from Human Papillomavirus
YLTAPTGCLK

SEQ ID NO: 10284 - protein, 11 aa, Artificial Sequence
  Peptide Derived from Human Papillomavirus
YLTAPTGCLKK

SEQ ID NO: 10285 - protein, 11 aa, Artificial Sequence
  Peptide Derived from Human Papillomavirus
CVLLFVCLVIR

SEQ ID NO: 10286 - protein, 11 aa, Artificial Sequence
  Peptide Derived from Human Papillomavirus
ILWVIATSPLR

SEQ ID NO: 10287 - protein, 9 aa, Artificial Sequence
  Peptide Derived from Human Papillomavirus
LLFVCLVIR

SEQ ID NO: 10288 - protein, 8 aa, Artificial Sequence
  Peptide Derived from Human Papillomavirus
VIATSPLR

SEQ ID NO: 10289 - protein, 10 aa, Artificial Sequence
  Peptide Derived from Human Papillomavirus
VLLFVCLVIR

SEQ ID NO: 10290 - protein, 9 aa, Artificial Sequence
  Peptide Derived from Human Papillomavirus
WVIATSPLR

SEQ ID NO: 10291 - protein, 10 aa, Artificial Sequence
  Peptide Derived from Human Papillomavirus
ALEIPYDELR

SEQ ID NO: 10292 - protein, 9 aa, Artificial Sequence
  Peptide Derived from Human Papillomavirus
CIACWRRPR

SEQ ID NO: 10293 - protein, 10 aa, Artificial Sequence
  Peptide Derived from Human Papillomavirus
CTKCLRFYSK

SEQ ID NO: 10294 - protein, 11 aa, Artificial Sequence
  Peptide Derived from Human Papillomavirus
DLLIRCITCQR

SEQ ID NO: 10295 - protein, 9 aa, Artificial Sequence
  Peptide Derived from Human Papillomavirus
DTPHGVCTK

SEQ ID NO: 10296 - protein, 8 aa, Artificial Sequence
  Peptide Derived from Human Papillomavirus
EIPYDELR

SEQ ID NO: 10297 - protein, 10 aa, Artificial Sequence
  Peptide Derived from Human Papillomavirus
ELRLNCVYCK

SEQ ID NO: 10298 - protein, 11 aa, Artificial Sequence
  Peptide Derived from Human Papillomavirus
FAFTDLTIVYR

SEQ ID NO: 10299 - protein, 9 aa, Artificial Sequence
  Peptide Derived from Human Papillomavirus
FTDLTIVYR

SEQ ID NO: 10300 - protein, 8 aa, Artificial Sequence
  Peptide Derived from Human Papillomavirus
GICDLLIR

SEQ ID NO: 10301 - protein, 10 aa, Artificial Sequence
  Peptide Derived from Human Papillomavirus
GTTLEKLTNK

SEQ ID NO: 10302 - protein, 8 aa, Artificial Sequence
  Peptide Derived from Human Papillomavirus
GVCTKCLR

SEQ ID NO: 10303 - protein, 8 aa, Artificial Sequence
  Peptide Derived from Human Papillomavirus
IACWRRPR

SEQ ID NO: 10304 - protein, 9 aa, Artificial Sequence
  Peptide Derived from Human Papillomavirus
KVSEFRWYR

SEQ ID NO: 10305 - protein, 9 aa, Artificial Sequence
  Peptide Derived from Human Papillomavirus
LIRCITCQR

SEQ ID NO: 10306 - protein, 10 aa, Artificial Sequence
  Peptide Derived from Human Papillomavirus
LLIRCITCQR

SEQ ID NO: 10307 - protein, 9 aa, Artificial Sequence
  Peptide Derived from Human Papillomavirus
NIGGRWTGR

SEQ ID NO: 10308 - protein, 9 aa, Artificial Sequence
  Peptide Derived from Human Papillomavirus
PLCPEEKQR

SEQ ID NO: 10309 - protein, 8 aa, Artificial Sequence
  Peptide Derived from Human Papillomavirus
RLNCVYCK

SEQ ID NO: 10310 - protein, 11 aa, Artificial Sequence
  Peptide Derived from Human Papillomavirus
SALEIPYDELR

SEQ ID NO: 10311 - protein, 9 aa, Artificial Sequence
  Peptide Derived from Human Papillomavirus
SVYGTTLEK

SEQ ID NO: 10312 - protein, 8 aa, Artificial Sequence
  Peptide Derived from Human Papillomavirus
TLEKLTNK

SEQ ID NO: 10313 - protein, 9 aa, Artificial Sequence
  Peptide Derived from Human Papillomavirus
TTLEKLTNK

SEQ ID NO: 10314 - protein, 8 aa, Artificial Sequence
  Peptide Derived from Human Papillomavirus
VSEFRWYR

SEQ ID NO: 10315 - protein, 10 aa, Artificial Sequence
  Peptide Derived from Human Papillomavirus
WTGRCIACWR

SEQ ID NO: 10316 - protein, 11 aa, Artificial Sequence
  Peptide Derived from Human Papillomavirus
WTGRCIACWRR

SEQ ID NO: 10317 - protein, 8 aa, Artificial Sequence
  Peptide Derived from Human Papillomavirus
YSKVSEFR

SEQ ID NO: 10318 - protein, 11 aa, Artificial Sequence
  Peptide Derived from Human Papillomavirus
YSKVSEFRWYR

SEQ ID NO: 10319 - protein, 10 aa, Artificial Sequence
  Peptide Derived from Human Papillomavirus
YSVYGTTLEK

SEQ ID NO: 10320 - protein, 10 aa, Artificial Sequence
  Peptide Derived from Human Papillomavirus
CVQSTQVDIR

SEQ ID NO: 10321 - protein, 10 aa, Artificial Sequence
  Peptide Derived from Human Papillomavirus
GIVCPNCSTR

SEQ ID NO: 10322 - protein, 9 aa, Artificial Sequence
  Peptide Derived from Human Papillomavirus
IVCPNCSTR

SEQ ID NO: 10323 - protein, 9 aa, Artificial Sequence
  Peptide Derived from Human Papillomavirus
IVTFCCQCK

SEQ ID NO: 10324 - protein, 10 aa, Artificial Sequence
  Peptide Derived from Human Papillomavirus
NIVTFCCQCK

SEQ ID NO: 10325 - protein, 8 aa, Artificial Sequence
  Peptide Derived from Human Papillomavirus
QSTQVDIR

SEQ ID NO: 10326 - protein, 8 aa, Artificial Sequence
  Peptide Derived from Human Papillomavirus
VTFCCQCK

SEQ ID NO: 10327 - protein, 11 aa, Artificial Sequence
  Peptide Derived from Human Papillomavirus
AAIANSDTTFK

SEQ ID NO: 10328 - protein, 10 aa, Artificial Sequence
  Peptide Derived from Human Papillomavirus
AIANSDTTFK

SEQ ID NO: 10329 - protein, 11 aa, Artificial Sequence
  Peptide Derived from Human Papillomavirus
AITCQKTAPQK

SEQ ID NO: 10330 - protein, 11 aa, Artificial Sequence
  Peptide Derived from Human Papillomavirus
AMDFTALQDTK

SEQ ID NO: 10331 - protein, 8 aa, Artificial Sequence
  Peptide Derived from Human Papillomavirus
ASTTTPAK

SEQ ID NO: 10332 - protein, 9 aa, Artificial Sequence
  Peptide Derived from Human Papillomavirus
ASTTTPAKR

SEQ ID NO: 10333 - protein, 10 aa, Artificial Sequence
  Peptide Derived from Human Papillomavirus
ASTTTPAKRK

SEQ ID NO: 10334 - protein, 11 aa, Artificial Sequence
  Peptide Derived from Human Papillomavirus
ASTTTPAKRKK

SEQ ID NO: 10335 - protein, 8 aa, Artificial Sequence
  Peptide Derived from Human Papillomavirus
CVGLEVGR

SEQ ID NO: 10336 - protein, 8 aa, Artificial Sequence
  Peptide Derived from Human Papillomavirus
DICNSICK

SEQ ID NO: 10337 - protein, 9 aa, Artificial Sequence
  Peptide Derived from Human Papillomavirus
DLDQFPLGR

SEQ ID NO: 10338 - protein, 10 aa, Artificial Sequence
  Peptide Derived from Human Papillomavirus
DLDQFPLGRK

SEQ ID NO: 10339 - protein, 10 aa, Artificial Sequence
  Peptide Derived from Human Papillomavirus
DLQFIFQLCK

SEQ ID NO: 10340 - protein, 8 aa, Artificial Sequence
  Peptide Derived from Human Papillomavirus
DTLFFYLR

SEQ ID NO: 10341 - protein, 9 aa, Artificial Sequence
  Peptide Derived from Human Papillomavirus
DTLFFYLRR

SEQ ID NO: 10342 - protein, 11 aa, Artificial Sequence
  Peptide Derived from Human Papillomavirus
DTSFYNPETQR

SEQ ID NO: 10343 - protein, 10 aa, Artificial Sequence
  Peptide Derived from Human Papillomavirus
DTTFKSSNFK

SEQ ID NO: 10344 - protein, 10 aa, Artificial Sequence
  Peptide Derived from Human Papillomavirus
ESVPTDLYIK

SEQ ID NO: 10345 - protein, 8 aa, Artificial Sequence
  Peptide Derived from Human Papillomavirus
FLLQAGYR

SEQ ID NO: 10346 - protein, 10 aa, Artificial Sequence
  Peptide Derived from Human Papillomavirus
FLLQAGYRAR

SEQ ID NO: 10347 - protein, 8 aa, Artificial Sequence
  Peptide Derived from Human Papillomavirus
FTALQDTK

SEQ ID NO: 10348 - protein, 8 aa, Artificial Sequence
  Peptide Derived from Human Papillomavirus
FVRHFFNR

SEQ ID NO: 10349 - protein, 11 aa, Artificial Sequence
  Peptide Derived from Human Papillomavirus
FVTSQAITCQK

SEQ ID NO: 10350 - protein, 9 aa, Artificial Sequence
  Peptide Derived from Human Papillomavirus
FVTVVDTTR

SEQ ID NO: 10351 - protein, 10 aa, Artificial Sequence
  Peptide Derived from Human Papillomavirus
GISGHPLLNK

SEQ ID NO: 10352 - protein, 8 aa, Artificial Sequence
  Peptide Derived from Human Papillomavirus
GLQYRVFR

SEQ ID NO: 10353 - protein, 10 aa, Artificial Sequence
  Peptide Derived from Human Papillomavirus
GLQYRVFRVR

SEQ ID NO: 10354 - protein, 8 aa, Artificial Sequence
  Peptide Derived from Human Papillomavirus
GSLEDTYR

SEQ ID NO: 10355 - protein, 9 aa, Artificial Sequence
  Peptide Derived from Human Papillomavirus
IANSDTTFK

SEQ ID NO: 10356 - protein, 9 aa, Artificial Sequence
  Peptide Derived from Human Papillomavirus
ISGHPLLNK

SEQ ID NO: 10357 - protein, 10 aa, Artificial Sequence
  Peptide Derived from Human Papillomavirus
ITCQKTAPQK

SEQ ID NO: 10358 - protein, 10 aa, Artificial Sequence
  Peptide Derived from Human Papillomavirus
KSSNFKEYLR

SEQ ID NO: 10359 - protein, 8 aa, Artificial Sequence
  Peptide Derived from Human Papillomavirus
KTAPQKPK

SEQ ID NO: 10360 - protein, 8 aa, Artificial Sequence
  Peptide Derived from Human Papillomavirus
KVSGLQYR

SEQ ID NO: 10361 - protein, 11 aa, Artificial Sequence
  Peptide Derived from Human Papillomavirus
KVSGLQYRVFR

SEQ ID NO: 10362 - protein, 11 aa, Artificial Sequence
  Peptide Derived from Human Papillomavirus
KVVSTDEYVTR

SEQ ID NO: 10363 - protein, 9 aa, Artificial Sequence
  Peptide Derived from Human Papillomavirus
LLQAGYRAR

SEQ ID NO: 10364 - protein, 11 aa, Artificial Sequence
  Peptide Derived from Human Papillomavirus
LLQAGYRARPK

SEQ ID NO: 10365 - protein, 11 aa, Artificial Sequence
  Peptide Derived from Human Papillomavirus
MVTSDAQIFNK

SEQ ID NO: 10366 - protein, 10 aa, Artificial Sequence
  Peptide Derived from Human Papillomavirus
NIYYHAGSAR

SEQ ID NO: 10367 - protein, 11 aa, Artificial Sequence
  Peptide Derived from Human Papillomavirus
NSICKYPDYLK

SEQ ID NO: 10368 - protein, 8 aa, Artificial Sequence
  Peptide Derived from Human Papillomavirus
PAKRKKTK

SEQ ID NO: 10369 - protein, 9 aa, Artificial Sequence
  Peptide Derived from Human Papillomavirus
PAKRKKTKK

SEQ ID NO: 10370 - protein, 8 aa, Artificial Sequence
  Peptide Derived from Human Papillomavirus
PIGEHWGK

SEQ ID NO: 10371 - protein, 10 aa, Artificial Sequence
  Peptide Derived from Human Papillomavirus
PLDICNSICK

SEQ ID NO: 10372 - protein, 10 aa, Artificial Sequence
  Peptide Derived from Human Papillomavirus
PSASTTTPAK

SEQ ID NO: 10373 - protein, 11 aa, Artificial Sequence
  Peptide Derived from Human Papillomavirus
PSASTTTPAKR

SEQ ID NO: 10374 - protein, 10 aa, Artificial Sequence
  Peptide Derived from Human Papillomavirus
PSGSLEDTYR

SEQ ID NO: 10375 - protein, 9 aa, Artificial Sequence
  Peptide Derived from Human Papillomavirus
QAGYRARPK

SEQ ID NO: 10376 - protein, 11 aa, Artificial Sequence
  Peptide Derived from Human Papillomavirus
QAGYRARPKFK

SEQ ID NO: 10377 - protein, 11 aa, Artificial Sequence
  Peptide Derived from Human Papillomavirus
QIFNKPYWMQR

SEQ ID NO: 10378 - protein, 8 aa, Artificial Sequence
  Peptide Derived from Human Papillomavirus
QLCLLGCK

SEQ ID NO: 10379 - protein, 11 aa, Artificial Sequence
  Peptide Derived from Human Papillomavirus
QLFVTVVDTTR

SEQ ID NO: 10380 - protein, 10 aa, Artificial Sequence
  Peptide Derived from Human Papillomavirus
QMFVRHFFNR

SEQ ID NO: 10381 - protein, 10 aa, Artificial Sequence
  Peptide Derived from Human Papillomavirus
QTQLCLLGCK

SEQ ID NO: 10382 - protein, 10 aa, Artificial Sequence
  Peptide Derived from Human Papillomavirus
RARPKFKAGK

SEQ ID NO: 10383 - protein, 11 aa, Artificial Sequence
  Peptide Derived from Human Papillomavirus
RARPKFKAGKR

SEQ ID NO: 10384 - protein, 9 aa, Artificial Sequence
  Peptide Derived from Human Papillomavirus
RVRLPDPNK

SEQ ID NO: 10385 - protein, 11 aa, Artificial Sequence
  Peptide Derived from Human Papillomavirus
SADLDQFPLGR

SEQ ID NO: 10386 - protein, 9 aa, Artificial Sequence
  Peptide Derived from Human Papillomavirus
SASTTTPAK

SEQ ID NO: 10387 - protein, 10 aa, Artificial Sequence
  Peptide Derived from Human Papillomavirus
SASTTTPAKR

SEQ ID NO: 10388 - protein, 11 aa, Artificial Sequence
  Peptide Derived from Human Papillomavirus
SASTTTPAKRK

SEQ ID NO: 10389 - protein, 10 aa, Artificial Sequence
  Peptide Derived from Human Papillomavirus
SICKYPDYLK

SEQ ID NO: 10390 - protein, 9 aa, Artificial Sequence
  Peptide Derived from Human Papillomavirus
SIPKSDNPK

SEQ ID NO: 10391 - protein, 10 aa, Artificial Sequence
  Peptide Derived from Human Papillomavirus
SIPKSDNPKK

SEQ ID NO: 10392 - protein, 9 aa, Artificial Sequence
  Peptide Derived from Human Papillomavirus
SSNFKEYLR

SEQ ID NO: 10393 - protein, 8 aa, Artificial Sequence
  Peptide Derived from Human Papillomavirus
STDEYVTR

SEQ ID NO: 10394 - protein, 8 aa, Artificial Sequence
  Peptide Derived from Human Papillomavirus
STTTPAKR

SEQ ID NO: 10395 - protein, 9 aa, Artificial Sequence
  Peptide Derived from Human Papillomavirus
STTTPAKRK

SEQ ID NO: 10396 - protein, 10 aa, Artificial Sequence
  Peptide Derived from Human Papillomavirus
STTTPAKRKK

SEQ ID NO: 10397 - protein, 9 aa, Artificial Sequence
  Peptide Derived from Human Papillomavirus
SVPTDLYIK

SEQ ID NO: 10398 - protein, 8 aa, Artificial Sequence
  Peptide Derived from Human Papillomavirus
TLFFYLRR

SEQ ID NO: 10399 - protein, 9 aa, Artificial Sequence
  Peptide Derived from Human Papillomavirus
TSDAQIFNK

SEQ ID NO: 10400 - protein, 10 aa, Artificial Sequence
  Peptide Derived from Human Papillomavirus
TSFYNPETQR

SEQ ID NO: 10401 - protein, 9 aa, Artificial Sequence
  Peptide Derived from Human Papillomavirus
TSQAITCQK

SEQ ID NO: 10402 - protein, 9 aa, Artificial Sequence
  Peptide Derived from Human Papillomavirus
TTFKSSNFK

SEQ ID NO: 10403 - protein, 8 aa, Artificial Sequence
  Peptide Derived from Human Papillomavirus
TTPAKRKK

SEQ ID NO: 10404 - protein, 10 aa, Artificial Sequence
  Peptide Derived from Human Papillomavirus
TTPAKRKKTK

SEQ ID NO: 10405 - protein, 11 aa, Artificial Sequence
  Peptide Derived from Human Papillomavirus
TTPAKRKKTKK

SEQ ID NO: 10406 - protein, 8 aa, Artificial Sequence
  Peptide Derived from Human Papillomavirus
TTTPAKRK

SEQ ID NO: 10407 - protein, 9 aa, Artificial Sequence
  Peptide Derived from Human Papillomavirus
TTTPAKRKK

SEQ ID NO: 10408 - protein, 11 aa, Artificial Sequence
  Peptide Derived from Human Papillomavirus
TTTPAKRKKTK

SEQ ID NO: 10409 - protein, 11 aa, Artificial Sequence
  Peptide Derived from Human Papillomavirus
TVGHPYYSIPK

SEQ ID NO: 10410 - protein, 11 aa, Artificial Sequence
  Peptide Derived from Human Papillomavirus
TVYLPPVPVSK

SEQ ID NO: 10411 - protein, 10 aa, Artificial Sequence
  Peptide Derived from Human Papillomavirus
VSGLQYRVFR

SEQ ID NO: 10412 - protein, 9 aa, Artificial Sequence
  Peptide Derived from Human Papillomavirus
VSTDEYVTR

SEQ ID NO: 10413 - protein, 10 aa, Artificial Sequence
  Peptide Derived from Human Papillomavirus
VTSDAQIFNK

SEQ ID NO: 10414 - protein, 10 aa, Artificial Sequence
  Peptide Derived from Human Papillomavirus
VTSQAITCQK

SEQ ID NO: 10415 - protein, 8 aa, Artificial Sequence
  Peptide Derived from Human Papillomavirus
VTVVDTTR

SEQ ID NO: 10416 - protein, 11 aa, Artificial Sequence
  Peptide Derived from Human Papillomavirus
VVPKVSGLQYR

SEQ ID NO: 10417 - protein, 10 aa, Artificial Sequence
  Peptide Derived from Human Papillomavirus
VVSTDEYVTR

SEQ ID NO: 10418 - protein, 10 aa, Artificial Sequence
  Peptide Derived from Human Papillomavirus
WACVGLEVGR

SEQ ID NO: 10419 - protein, 10 aa, Artificial Sequence
  Peptide Derived from Human Papillomavirus
YAGGPGTDNR

SEQ ID NO: 10420 - protein, 9 aa, Artificial Sequence
  Peptide Derived from Human Papillomavirus
YLPPVPVSK

SEQ ID NO: 10421 - protein, 10 aa, Artificial Sequence
  Peptide Derived from Human Papillomavirus
YLRREQMFVR

SEQ ID NO: 10422 - protein, 10 aa, Artificial Sequence
  Peptide Derived from Human Papillomavirus
YSIPKSDNPK

SEQ ID NO: 10423 - protein, 11 aa, Artificial Sequence
  Peptide Derived from Human Papillomavirus
YSIPKSDNPKK

SEQ ID NO: 10424 - protein, 9 aa, Artificial Sequence
  Peptide Derived from Human Papillomavirus
YVFWEVNLK

SEQ ID NO: 10425 - protein, 11 aa, Artificial Sequence
  Peptide Derived from Human Papillomavirus
YVFWEVNLKEK

SEQ ID NO: 10426 - protein, 10 aa, Artificial Sequence
  Peptide Derived from Human Papillomavirus
ALHRPALTSR

SEQ ID NO: 10427 - protein, 11 aa, Artificial Sequence
  Peptide Derived from Human Papillomavirus
ALHRPALTSRR

SEQ ID NO: 10428 - protein, 10 aa, Artificial Sequence
  Peptide Derived from Human Papillomavirus
ALTSRRNTVR

SEQ ID NO: 10429 - protein, 11 aa, Artificial Sequence
  Peptide Derived from Human Papillomavirus
ASATQLYQTCK

SEQ ID NO: 10430 - protein, 9 aa, Artificial Sequence
  Peptide Derived from Human Papillomavirus
ATQLYQTCK

SEQ ID NO: 10431 - protein, 9 aa, Artificial Sequence
  Peptide Derived from Human Papillomavirus
FLDIIALHR

SEQ ID NO: 10432 - protein, 11 aa, Artificial Sequence
  Peptide Derived from Human Papillomavirus
GIGSGSGTGGR

SEQ ID NO: 10433 - protein, 11 aa, Artificial Sequence
  Peptide Derived from Human Papillomavirus
GLYSKATQQVK

SEQ ID NO: 10434 - protein, 9 aa, Artificial Sequence
  Peptide Derived from Human Papillomavirus
GSGSGTGGR

SEQ ID NO: 10435 - protein, 10 aa, Artificial Sequence
  Peptide Derived from Human Papillomavirus
GTCPSDVIPK

SEQ ID NO: 10436 - protein, 10 aa, Artificial Sequence
  Peptide Derived from Human Papillomavirus
HTTIADQILR

SEQ ID NO: 10437 - protein, 11 aa, Artificial Sequence
  Peptide Derived from Human Papillomavirus
IALHRPALTSR

SEQ ID NO: 10438 - protein, 11 aa, Artificial Sequence
  Peptide Derived from Human Papillomavirus
ITSSTPIPGVR

SEQ ID NO: 10439 - protein, 9 aa, Artificial Sequence
  Peptide Derived from Human Papillomavirus
LTSRRNTVR

SEQ ID NO: 10440 - protein, 8 aa, Artificial Sequence
  Peptide Derived from Human Papillomavirus
MLKRRRKR

SEQ ID NO: 10441 - protein, 11 aa, Artificial Sequence
  Peptide Derived from Human Papillomavirus
NTVRYSRLGNK

SEQ ID NO: 10442 - protein, 11 aa, Artificial Sequence
  Peptide Derived from Human Papillomavirus
PALTSRRNTVR

SEQ ID NO: 10443 - protein, 9 aa, Artificial Sequence
  Peptide Derived from Human Papillomavirus
PARLGLYSK

SEQ ID NO: 10444 - protein, 10 aa, Artificial Sequence
  Peptide Derived from Human Papillomavirus
PIPGVRRPAR

SEQ ID NO: 10445 - protein, 8 aa, Artificial Sequence
  Peptide Derived from Human Papillomavirus
PSYYMLKR

SEQ ID NO: 10446 - protein, 9 aa, Artificial Sequence
  Peptide Derived from Human Papillomavirus
PSYYMLKRR

SEQ ID NO: 10447 - protein, 10 aa, Artificial Sequence
  Peptide Derived from Human Papillomavirus
PSYYMLKRRR

SEQ ID NO: 10448 - protein, 11 aa, Artificial Sequence
  Peptide Derived from Human Papillomavirus
PSYYMLKRRRK

SEQ ID NO: 10449 - protein, 8 aa, Artificial Sequence
  Peptide Derived from Human Papillomavirus
PTFLSAPK

SEQ ID NO: 10450 - protein, 9 aa, Artificial Sequence
  Peptide Derived from Human Papillomavirus
RLGNKQTLR

SEQ ID NO: 10451 - protein, 11 aa, Artificial Sequence
  Peptide Derived from Human Papillomavirus
RLGNKQTLRTR

SEQ ID NO: 10452 - protein, 9 aa, Artificial Sequence
  Peptide Derived from Human Papillomavirus
RSGATIGAR

SEQ ID NO: 10453 - protein, 8 aa, Artificial Sequence
  Peptide Derived from Human Papillomavirus
RSKRSTKR

SEQ ID NO: 10454 - protein, 10 aa, Artificial Sequence
  Peptide Derived from Human Papillomavirus
RSKRSTKRTK

SEQ ID NO: 10455 - protein, 11 aa, Artificial Sequence
  Peptide Derived from Human Papillomavirus
RSKRSTKRTKR

SEQ ID NO: 10456 - protein, 8 aa, Artificial Sequence
  Peptide Derived from Human Papillomavirus
RSTKRTKR

SEQ ID NO: 10457 - protein, 10 aa, Artificial Sequence
  Peptide Derived from Human Papillomavirus
RTGYVPLSTR

SEQ ID NO: 10458 - protein, 11 aa, Artificial Sequence
  Peptide Derived from Human Papillomavirus
RTRSGATIGAR

SEQ ID NO: 10459 - protein, 10 aa, Artificial Sequence
  Peptide Derived from Human Papillomavirus
SATQLYQTCK

SEQ ID NO: 10460 - protein, 9 aa, Artificial Sequence
  Peptide Derived from Human Papillomavirus
SSTPIPGVR

SEQ ID NO: 10461 - protein, 10 aa, Artificial Sequence
  Peptide Derived from Human Papillomavirus
SSTPIPGVRR

SEQ ID NO: 10462 - protein, 8 aa, Artificial Sequence
  Peptide Derived from Human Papillomavirus
STPIPGVR

SEQ ID NO: 10463 - protein, 9 aa, Artificial Sequence
  Peptide Derived from Human Papillomavirus
STPIPGVRR

SEQ ID NO: 10464 - protein, 11 aa, Artificial Sequence
  Peptide Derived from Human Papillomavirus
STVSEASIPIR

SEQ ID NO: 10465 - protein, 8 aa, Artificial Sequence
  Peptide Derived from Human Papillomavirus
TIADQILR

SEQ ID NO: 10466 - protein, 8 aa, Artificial Sequence
  Peptide Derived from Human Papillomavirus
TSRRNTVR

SEQ ID NO: 10467 - protein, 11 aa, Artificial Sequence
  Peptide Derived from Human Papillomavirus
TSRRNTVRYSR

SEQ ID NO: 10468 - protein, 10 aa, Artificial Sequence
  Peptide Derived from Human Papillomavirus
TSSTPIPGVR

SEQ ID NO: 10469 - protein, 11 aa, Artificial Sequence
  Peptide Derived from Human Papillomavirus
TSSTPIPGVRR

SEQ ID NO: 10470 - protein, 9 aa, Artificial Sequence
  Peptide Derived from Human Papillomavirus
TTIADQILR

SEQ ID NO: 10471 - protein, 10 aa, Artificial Sequence
  Peptide Derived from Human Papillomavirus
TVRYSRLGNK

SEQ ID NO: 10472 - protein, 10 aa, Artificial Sequence
  Peptide Derived from Human Papillomavirus
TVSEASIPIR

SEQ ID NO: 10473 - protein, 11 aa, Artificial Sequence
  Peptide Derived from Human Papillomavirus
VIDPTFLSAPK

SEQ ID NO: 10474 - protein, 9 aa, Artificial Sequence
  Peptide Derived from Human Papillomavirus
VSEASIPIR

SEQ ID NO: 10475 - protein, 10 aa, Artificial Sequence
  Peptide Derived from Human Papillomavirus
YLHPSYYMLK

SEQ ID NO: 10476 - protein, 11 aa, Artificial Sequence
  Peptide Derived from Human Papillomavirus
YLHPSYYMLKR

SEQ ID NO: 10477 - protein, 8 aa, Artificial Sequence
  Peptide Derived from Human Papillomavirus
YMLKRRRK

SEQ ID NO: 10478 - protein, 9 aa, Artificial Sequence
  Peptide Derived from Human Papillomavirus
YMLKRRRKR

SEQ ID NO: 10479 - protein, 9 aa, Artificial Sequence
  Peptide Derived from Human Papillomavirus
YSKATQQVK

SEQ ID NO: 10480 - protein, 11 aa, Artificial Sequence
  Peptide Derived from Human Papillomavirus
YSRLGNKQTLR

SEQ ID NO: 10481 - protein, 8 aa, Artificial Sequence
  Peptide Derived from Human Papillomavirus
AAEDVVDR

SEQ ID NO: 10482 - protein, 11 aa, Artificial Sequence
  Peptide Derived from Human Papillomavirus
AAFLKSNSQAK

SEQ ID NO: 10483 - protein, 11 aa, Artificial Sequence
  Peptide Derived from Human Papillomavirus
AANPCRTSINK

SEQ ID NO: 10484 - protein, 8 aa, Artificial Sequence
  Peptide Derived from Human Papillomavirus
AINDENWK

SEQ ID NO: 10485 - protein, 8 aa, Artificial Sequence
  Peptide Derived from Human Papillomavirus
AVCALKRK

SEQ ID NO: 10486 - protein, 8 aa, Artificial Sequence
  Peptide Derived from Human Papillomavirus
CMVIEPPK

SEQ ID NO: 10487 - protein, 10 aa, Artificial Sequence
  Peptide Derived from Human Papillomavirus
CMVIEPPKLR

SEQ ID NO: 10488 - protein, 8 aa, Artificial Sequence
  Peptide Derived from Human Papillomavirus
CSAGENTR

SEQ ID NO: 10489 - protein, 11 aa, Artificial Sequence
  Peptide Derived from Human Papillomavirus
CSAGENTRSLR

SEQ ID NO: 10490 - protein, 10 aa, Artificial Sequence
  Peptide Derived from Human Papillomavirus
CSKNRLTVAK

SEQ ID NO: 10491 - protein, 9 aa, Artificial Sequence
  Peptide Derived from Human Papillomavirus
CVISCVNSK

SEQ ID NO: 10492 - protein, 8 aa, Artificial Sequence
  Peptide Derived from Human Papillomavirus
DLIEEEDK

SEQ ID NO: 10493 - protein, 9 aa, Artificial Sequence
  Peptide Derived from Human Papillomavirus
DLNAVCALK

SEQ ID NO: 10494 - protein, 10 aa, Artificial Sequence
  Peptide Derived from Human Papillomavirus
DLNAVCALKR

SEQ ID NO: 10495 - protein, 11 aa, Artificial Sequence
  Peptide Derived from Human Papillomavirus
DLNAVCALKRK

SEQ ID NO: 10496 - protein, 11 aa, Artificial Sequence
  Peptide Derived from Human Papillomavirus
DSNSNAAAFLK

SEQ ID NO: 10497 - protein, 10 aa, Artificial Sequence
  Peptide Derived from Human Papillomavirus
DSRWPYLHSR

SEQ ID NO: 10498 - protein, 11 aa, Artificial Sequence
  Peptide Derived from Human Papillomavirus
DVKHRALVQLK

SEQ ID NO: 10499 - protein, 11 aa, Artificial Sequence
  Peptide Derived from Human Papillomavirus
DVVDRAANPCR

SEQ ID NO: 10500 - protein, 9 aa, Artificial Sequence
  Peptide Derived from Human Papillomavirus
EISIDVKHR

SEQ ID NO: 10501 - protein, 10 aa, Artificial Sequence
  Peptide Derived from Human Papillomavirus
ELVRPFKSDK

SEQ ID NO: 10502 - protein, 8 aa, Artificial Sequence
  Peptide Derived from Human Papillomavirus
ESLKVLIK

SEQ ID NO: 10503 - protein, 10 aa, Artificial Sequence
  Peptide Derived from Human Papillomavirus
ETCMVIEPPK

SEQ ID NO: 10504 - protein, 8 aa, Artificial Sequence
  Peptide Derived from Human Papillomavirus
EVEAVIER

SEQ ID NO: 10505 - protein, 9 aa, Artificial Sequence
  Peptide Derived from Human Papillomavirus
EVEAVIERR

SEQ ID NO: 10506 - protein, 10 aa, Artificial Sequence
  Peptide Derived from Human Papillomavirus
FLGAFKKFLK

SEQ ID NO: 10507 - protein, 8 aa, Artificial Sequence
  Peptide Derived from Human Papillomavirus
FLKGIPKK

SEQ ID NO: 10508 - protein, 9 aa, Artificial Sequence
  Peptide Derived from Human Papillomavirus
FLKSNSQAK

SEQ ID NO: 10509 - protein, 9 aa, Artificial Sequence
  Peptide Derived from Human Papillomavirus
FMELVRPFK

SEQ ID NO: 10510 - protein, 9 aa, Artificial Sequence
  Peptide Derived from Human Papillomavirus
FTAFLGAFK

SEQ ID NO: 10511 - protein, 10 aa, Artificial Sequence
  Peptide Derived from Human Papillomavirus
FTAFLGAFKK

SEQ ID NO: 10512 - protein, 8 aa, Artificial Sequence
  Peptide Derived from Human Papillomavirus
GAFKKFLK

SEQ ID NO: 10513 - protein, 9 aa, Artificial Sequence
  Peptide Derived from Human Papillomavirus
GIIILLLIR

SEQ ID NO: 10514 - protein, 11 aa, Artificial Sequence
  Peptide Derived from Human Papillomavirus
GIIILLLIRFR

SEQ ID NO: 10515 - protein, 8 aa, Artificial Sequence
  Peptide Derived from Human Papillomavirus
GIMCRHYK

SEQ ID NO: 10516 - protein, 9 aa, Artificial Sequence
  Peptide Derived from Human Papillomavirus
GIMCRHYKK

SEQ ID NO: 10517 - protein, 9 aa, Artificial Sequence
  Peptide Derived from Human Papillomavirus
GISFMELVR

SEQ ID NO: 10518 - protein, 11 aa, Artificial Sequence
  Peptide Derived from Human Papillomavirus
GISPSVAESLK

SEQ ID NO: 10519 - protein, 9 aa, Artificial Sequence
  Peptide Derived from Human Papillomavirus
GMSLIQFLK

SEQ ID NO: 10520 - protein, 9 aa, Artificial Sequence
  Peptide Derived from Human Papillomavirus
GTTPEWIDR

SEQ ID NO: 10521 - protein, 9 aa, Artificial Sequence
  Peptide Derived from Human Papillomavirus
HLQCLTCDR

SEQ ID NO: 10522 - protein, 10 aa, Artificial Sequence
  Peptide Derived from Human Papillomavirus
HSRLTVFEFK

SEQ ID NO: 10523 - protein, 8 aa, Artificial Sequence
  Peptide Derived from Human Papillomavirus
IIILLLIR

SEQ ID NO: 10524 - protein, 10 aa, Artificial Sequence
  Peptide Derived from Human Papillomavirus
IIILLLIRFR

SEQ ID NO: 10525 - protein, 9 aa, Artificial Sequence
  Peptide Derived from Human Papillomavirus
IILLLIRFR

SEQ ID NO: 10526 - protein, 8 aa, Artificial Sequence
  Peptide Derived from Human Papillomavirus
ILLLIRFR

SEQ ID NO: 10527 - protein, 11 aa, Artificial Sequence
  Peptide Derived from Human Papillomavirus
ILLLIRFRCSK

SEQ ID NO: 10528 - protein, 8 aa, Artificial Sequence
  Peptide Derived from Human Papillomavirus
IMCRHYKK

SEQ ID NO: 10529 - protein, 11 aa, Artificial Sequence
  Peptide Derived from Human Papillomavirus
IMCRHYKKAEK

SEQ ID NO: 10530 - protein, 8 aa, Artificial Sequence
  Peptide Derived from Human Papillomavirus
ISFMELVR

SEQ ID NO: 10531 - protein, 11 aa, Artificial Sequence
  Peptide Derived from Human Papillomavirus
ISFMELVRPFK

SEQ ID NO: 10532 - protein, 8 aa, Artificial Sequence
  Peptide Derived from Human Papillomavirus
ISIDVKHR

SEQ ID NO: 10533 - protein, 11 aa, Artificial Sequence
  Peptide Derived from Human Papillomavirus
ISNVLHSSNTK

SEQ ID NO: 10534 - protein, 10 aa, Artificial Sequence
  Peptide Derived from Human Papillomavirus
ISPSVAESLK

SEQ ID NO: 10535 - protein, 11 aa, Artificial Sequence
  Peptide Derived from Human Papillomavirus
ISWTYIDDYMR

SEQ ID NO: 10536 - protein, 10 aa, Artificial Sequence
  Peptide Derived from Human Papillomavirus
IVKDCGIMCR

SEQ ID NO: 10537 - protein, 9 aa, Artificial Sequence
  Peptide Derived from Human Papillomavirus
KANILYKFK

SEQ ID NO: 10538 - protein, 11 aa, Artificial Sequence
  Peptide Derived from Human Papillomavirus
KIVKDCGIMCR

SEQ ID NO: 10539 - protein, 10 aa, Artificial Sequence
  Peptide Derived from Human Papillomavirus
KLDLIEEEDK

SEQ ID NO: 10540 - protein, 11 aa, Artificial Sequence
  Peptide Derived from Human Papillomavirus
KMSIGQWIQSR

SEQ ID NO: 10541 - protein, 10 aa, Artificial Sequence
  Peptide Derived from Human Papillomavirus
KSFFSRTWCK

SEQ ID NO: 10542 - protein, 10 aa, Artificial Sequence
  Peptide Derived from Human Papillomavirus
KSNSQAKIVK

SEQ ID NO: 10543 - protein, 9 aa, Artificial Sequence
  Peptide Derived from Human Papillomavirus
KTNDGGNWR

SEQ ID NO: 10544 - protein, 10 aa, Artificial Sequence
  Peptide Derived from Human Papillomavirus
LICGPANTGK

SEQ ID NO: 10545 - protein, 8 aa, Artificial Sequence
  Peptide Derived from Human Papillomavirus
LIRFRCSK

SEQ ID NO: 10546 - protein, 10 aa, Artificial Sequence
  Peptide Derived from Human Papillomavirus
LIRFRCSKNR

SEQ ID NO: 10547 - protein, 9 aa, Artificial Sequence
  Peptide Derived from Human Papillomavirus
LLIRFRCSK

SEQ ID NO: 10548 - protein, 11 aa, Artificial Sequence
  Peptide Derived from Human Papillomavirus
LLIRFRCSKNR

SEQ ID NO: 10549 - protein, 10 aa, Artificial Sequence
  Peptide Derived from Human Papillomavirus
LLLIRFRCSK

SEQ ID NO: 10550 - protein, 9 aa, Artificial Sequence
  Peptide Derived from Human Papillomavirus
LVRPFKSDK

SEQ ID NO: 10551 - protein, 11 aa, Artificial Sequence
  Peptide Derived from Human Papillomavirus
MLICGPANTGK

SEQ ID NO: 10552 - protein, 10 aa, Artificial Sequence
  Peptide Derived from Human Papillomavirus
MSIGQWIQSR

SEQ ID NO: 10553 - protein, 8 aa, Artificial Sequence
  Peptide Derived from Human Papillomavirus
MSLIQFLK

SEQ ID NO: 10554 - protein, 9 aa, Artificial Sequence
  Peptide Derived from Human Papillomavirus
MVIEPPKLR

SEQ ID NO: 10555 - protein, 8 aa, Artificial Sequence
  Peptide Derived from Human Papillomavirus
NAVCALKR

SEQ ID NO: 10556 - protein, 9 aa, Artificial Sequence
  Peptide Derived from Human Papillomavirus
NAVCALKRK

SEQ ID NO: 10557 - protein, 11 aa, Artificial Sequence
  Peptide Derived from Human Papillomavirus
NSIQADTEAAR

SEQ ID NO: 10558 - protein, 9 aa, Artificial Sequence
  Peptide Derived from Human Papillomavirus
NSNAAAFLK

SEQ ID NO: 10559 - protein, 8 aa, Artificial Sequence
  Peptide Derived from Human Papillomavirus
NSQAKIVK

SEQ ID NO: 10560 - protein, 9 aa, Artificial Sequence
  Peptide Derived from Human Papillomavirus
NTKANILYK

SEQ ID NO: 10561 - protein, 11 aa, Artificial Sequence
  Peptide Derived from Human Papillomavirus
NTKANILYKFK

SEQ ID NO: 10562 - protein, 9 aa, Artificial Sequence
  Peptide Derived from Human Papillomavirus
NTNAGTDSR

SEQ ID NO: 10563 - protein, 9 aa, Artificial Sequence
  Peptide Derived from Human Papillomavirus
NVLHSSNTK

SEQ ID NO: 10564 - protein, 8 aa, Artificial Sequence
  Peptide Derived from Human Papillomavirus
PSVAESLK

SEQ ID NO: 10565 - protein, 11 aa, Artificial Sequence
  Peptide Derived from Human Papillomavirus
PVYAINDENWK

SEQ ID NO: 10566 - protein, 8 aa, Artificial Sequence
  Peptide Derived from Human Papillomavirus
QADTEAAR

SEQ ID NO: 10567 - protein, 10 aa, Artificial Sequence
  Peptide Derived from Human Papillomavirus
QSAAEDVVDR

SEQ ID NO: 10568 - protein, 9 aa, Artificial Sequence
  Peptide Derived from Human Papillomavirus
QTCALYWFR

SEQ ID NO: 10569 - protein, 8 aa, Artificial Sequence
  Peptide Derived from Human Papillomavirus
RLTVFEFK

SEQ ID NO: 10570 - protein, 11 aa, Artificial Sequence
  Peptide Derived from Human Papillomavirus
RSQTCALYWFR

SEQ ID NO: 10571 - protein, 8 aa, Artificial Sequence
  Peptide Derived from Human Papillomavirus
RTSINKNK

SEQ ID NO: 10572 - protein, 9 aa, Artificial Sequence
  Peptide Derived from Human Papillomavirus
SAAEDVVDR

SEQ ID NO: 10573 - protein, 10 aa, Artificial Sequence
  Peptide Derived from Human Papillomavirus
SAGENTRSLR

SEQ ID NO: 10574 - protein, 9 aa, Artificial Sequence
  Peptide Derived from Human Papillomavirus
SIGQWIQSR

SEQ ID NO: 10575 - protein, 11 aa, Artificial Sequence
  Peptide Derived from Human Papillomavirus
SINKNKECTYR

SEQ ID NO: 10576 - protein, 10 aa, Artificial Sequence
  Peptide Derived from Human Papillomavirus
SIQADTEAAR

SEQ ID NO: 10577 - protein, 11 aa, Artificial Sequence
  Peptide Derived from Human Papillomavirus
SSNTKANILYK

SEQ ID NO: 10578 - protein, 11 aa, Artificial Sequence
  Peptide Derived from Human Papillomavirus
SVAESLKVLIK

SEQ ID NO: 10579 - protein, 8 aa, Artificial Sequence
  Peptide Derived from Human Papillomavirus
TAFLGAFK

SEQ ID NO: 10580 - protein, 9 aa, Artificial Sequence
  Peptide Derived from Human Papillomavirus
TAFLGAFKK

SEQ ID NO: 10581 - protein, 11 aa, Artificial Sequence
  Peptide Derived from Human Papillomavirus
TSNTNAGTDSR

SEQ ID NO: 10582 - protein, 8 aa, Artificial Sequence
  Peptide Derived from Human Papillomavirus
TTPEWIDR

SEQ ID NO: 10583 - protein, 10 aa, Artificial Sequence
  Peptide Derived from Human Papillomavirus
VAESLKVLIK

SEQ ID NO: 10584 - protein, 8 aa, Artificial Sequence
  Peptide Derived from Human Papillomavirus
VIEPPKLR

SEQ ID NO: 10585 - protein, 8 aa, Artificial Sequence
  Peptide Derived from Human Papillomavirus
VISCVNSK

SEQ ID NO: 10586 - protein, 8 aa, Artificial Sequence
  Peptide Derived from Human Papillomavirus
VLHSSNTK

SEQ ID NO: 10587 - protein, 10 aa, Artificial Sequence
  Peptide Derived from Human Papillomavirus
VVDRAANPCR

SEQ ID NO: 10588 - protein, 8 aa, Artificial Sequence
  Peptide Derived from Human Papillomavirus
WIQSRCEK

SEQ ID NO: 10589 - protein, 9 aa, Artificial Sequence
  Peptide Derived from Human Papillomavirus
WLQPLSDAK

SEQ ID NO: 10590 - protein, 9 aa, Artificial Sequence
  Peptide Derived from Human Papillomavirus
WTYIDDYMR

SEQ ID NO: 10591 - protein, 9 aa, Artificial Sequence
  Peptide Derived from Human Papillomavirus
YAINDENWK

SEQ ID NO: 10592 - protein, 11 aa, Artificial Sequence
  Peptide Derived from Human Papillomavirus
YTHLQCLTCDR

SEQ ID NO: 10593 - protein, 8 aa, Artificial Sequence
  Peptide Derived from Human Papillomavirus
ALDNRTAR

SEQ ID NO: 10594 - protein, 9 aa, Artificial Sequence
  Peptide Derived from Human Papillomavirus
ATNCTNKQR

SEQ ID NO: 10595 - protein, 9 aa, Artificial Sequence
  Peptide Derived from Human Papillomavirus
CADPALDNR

SEQ ID NO: 10596 - protein, 8 aa, Artificial Sequence
  Peptide Derived from Human Papillomavirus
CALLYTAK

SEQ ID NO: 10597 - protein, 10 aa, Artificial Sequence
  Peptide Derived from Human Papillomavirus
CLRYRLKPYK

SEQ ID NO: 10598 - protein, 9 aa, Artificial Sequence
  Peptide Derived from Human Papillomavirus
DIQTDNDNR

SEQ ID NO: 10599 - protein, 10 aa, Artificial Sequence
  Peptide Derived from Human Papillomavirus
DLPSQIEHWK

SEQ ID NO: 10600 - protein, 8 aa, Artificial Sequence
  Peptide Derived from Human Papillomavirus
DTAQPLTK

SEQ ID NO: 10601 - protein, 9 aa, Artificial Sequence
  Peptide Derived from Human Papillomavirus
DTCTMVTGK

SEQ ID NO: 10602 - protein, 11 aa, Artificial Sequence
  Peptide Derived from Human Papillomavirus
DTTDTAQPLTK

SEQ ID NO: 10603 - protein, 11 aa, Artificial Sequence
  Peptide Derived from Human Papillomavirus
ELQMALETLSK

SEQ ID NO: 10604 - protein, 9 aa, Artificial Sequence
  Peptide Derived from Human Papillomavirus
ESNSLKCLR

SEQ ID NO: 10605 - protein, 11 aa, Artificial Sequence
  Peptide Derived from Human Papillomavirus
ESNSLKCLRYR

SEQ ID NO: 10606 - protein, 11 aa, Artificial Sequence
  Peptide Derived from Human Papillomavirus
ETVTVQYDNDK

SEQ ID NO: 10607 - protein, 9 aa, Artificial Sequence
  Peptide Derived from Human Papillomavirus
EVWLCEPPK

SEQ ID NO: 10608 - protein, 10 aa, Artificial Sequence
  Peptide Derived from Human Papillomavirus
GMYYIHNCEK

SEQ ID NO: 10609 - protein, 10 aa, Artificial Sequence
  Peptide Derived from Human Papillomavirus
HLKGESNSLK

SEQ ID NO: 10610 - protein, 9 aa, Artificial Sequence
  Peptide Derived from Human Papillomavirus
ILDLYEADK

SEQ ID NO: 10611 - protein, 11 aa, Artificial Sequence
  Peptide Derived from Human Papillomavirus
ISARLNAVQEK

SEQ ID NO: 10612 - protein, 10 aa, Artificial Sequence
  Peptide Derived from Human Papillomavirus
KILDLYEADK

SEQ ID NO: 10613 - protein, 8 aa, Artificial Sequence
  Peptide Derived from Human Papillomavirus
KVYFKYFK

SEQ ID NO: 10614 - protein, 8 aa, Artificial Sequence
  Peptide Derived from Human Papillomavirus
MALETLSK

SEQ ID NO: 10615 - protein, 9 aa, Artificial Sequence
  Peptide Derived from Human Papillomavirus
NSLKCLRYR

SEQ ID NO: 10616 - protein, 11 aa, Artificial Sequence
  Peptide Derived from Human Papillomavirus
NSLKCLRYRLK

SEQ ID NO: 10617 - protein, 9 aa, Artificial Sequence
  Peptide Derived from Human Papillomavirus
NVAPIVHLK

SEQ ID NO: 10618 - protein, 9 aa, Artificial Sequence
  Peptide Derived from Human Papillomavirus
PALDNRTAR

SEQ ID NO: 10619 - protein, 9 aa, Artificial Sequence
  Peptide Derived from Human Papillomavirus
PSLLASKTK

SEQ ID NO: 10620 - protein, 8 aa, Artificial Sequence
  Peptide Derived from Human Papillomavirus
PSQIEHWK

SEQ ID NO: 10621 - protein, 11 aa, Artificial Sequence
  Peptide Derived from Human Papillomavirus
PSQIEHWKLIR

SEQ ID NO: 10622 - protein, 8 aa, Artificial Sequence
  Peptide Derived from Human Papillomavirus
QAAAKRRR

SEQ ID NO: 10623 - protein, 9 aa, Artificial Sequence
  Peptide Derived from Human Papillomavirus
QIEHWKLIR

SEQ ID NO: 10624 - protein, 9 aa, Artificial Sequence
  Peptide Derived from Human Papillomavirus
QMALETLSK

SEQ ID NO: 10625 - protein, 8 aa, Artificial Sequence
  Peptide Derived from Human Papillomavirus
QMFLGTVK

SEQ ID NO: 10626 - protein, 10 aa, Artificial Sequence
  Peptide Derived from Human Papillomavirus
QVVPSLLASK

SEQ ID NO: 10627 - protein, 8 aa, Artificial Sequence
  Peptide Derived from Human Papillomavirus
RLNAVQEK

SEQ ID NO: 10628 - protein, 11 aa, Artificial Sequence
  Peptide Derived from Human Papillomavirus
RMECALLYTAK

SEQ ID NO: 10629 - protein, 9 aa, Artificial Sequence
  Peptide Derived from Human Papillomavirus
RTATNCTNK

SEQ ID NO: 10630 - protein, 11 aa, Artificial Sequence
  Peptide Derived from Human Papillomavirus
RTATNCTNKQR

SEQ ID NO: 10631 - protein, 10 aa, Artificial Sequence
  Peptide Derived from Human Papillomavirus
SARLNAVQEK

SEQ ID NO: 10632 - protein, 11 aa, Artificial Sequence
  Peptide Derived from Human Papillomavirus
SLEVWLCEPPK

SEQ ID NO: 10633 - protein, 8 aa, Artificial Sequence
  Peptide Derived from Human Papillomavirus
SLKCLRYR

SEQ ID NO: 10634 - protein, 10 aa, Artificial Sequence
  Peptide Derived from Human Papillomavirus
SLKCLRYRLK

SEQ ID NO: 10635 - protein, 8 aa, Artificial Sequence
  Peptide Derived from Human Papillomavirus
SLLASKTK

SEQ ID NO: 10636 - protein, 11 aa, Artificial Sequence
  Peptide Derived from Human Papillomavirus
SSNVAPIVHLK

SEQ ID NO: 10637 - protein, 11 aa, Artificial Sequence
  Peptide Derived from Human Papillomavirus
SSTWHWTSDNK

SEQ ID NO: 10638 - protein, 10 aa, Artificial Sequence
  Peptide Derived from Human Papillomavirus
STWHWTSDNK

SEQ ID NO: 10639 - protein, 11 aa, Artificial Sequence
  Peptide Derived from Human Papillomavirus
TADIQTDNDNR

SEQ ID NO: 10640 - protein, 11 aa, Artificial Sequence
  Peptide Derived from Human Papillomavirus
TARTATNCTNK

SEQ ID NO: 10641 - protein, 8 aa, Artificial Sequence
  Peptide Derived from Human Papillomavirus
TATNCTNK

SEQ ID NO: 10642 - protein, 10 aa, Artificial Sequence
  Peptide Derived from Human Papillomavirus
TATNCTNKQR

SEQ ID NO: 10643 - protein, 8 aa, Artificial Sequence
  Peptide Derived from Human Papillomavirus
TSDNKNSK

SEQ ID NO: 10644 - protein, 10 aa, Artificial Sequence
  Peptide Derived from Human Papillomavirus
TTDTAQPLTK

SEQ ID NO: 10645 - protein, 8 aa, Artificial Sequence
  Peptide Derived from Human Papillomavirus
TVQYDNDK

SEQ ID NO: 10646 - protein, 9 aa, Artificial Sequence
  Peptide Derived from Human Papillomavirus
TVQYDNDKK

SEQ ID NO: 10647 - protein, 10 aa, Artificial Sequence
  Peptide Derived from Human Papillomavirus
TVTVQYDNDK

SEQ ID NO: 10648 - protein, 11 aa, Artificial Sequence
  Peptide Derived from Human Papillomavirus
TVTVQYDNDKK

SEQ ID NO: 10649 - protein, 8 aa, Artificial Sequence
  Peptide Derived from Human Papillomavirus
VAPIVHLK

SEQ ID NO: 10650 - protein, 9 aa, Artificial Sequence
  Peptide Derived from Human Papillomavirus
VTVQYDNDK

SEQ ID NO: 10651 - protein, 10 aa, Artificial Sequence
  Peptide Derived from Human Papillomavirus
VTVQYDNDKK

SEQ ID NO: 10652 - protein, 9 aa, Artificial Sequence
  Peptide Derived from Human Papillomavirus
VVPSLLASK

SEQ ID NO: 10653 - protein, 11 aa, Artificial Sequence
  Peptide Derived from Human Papillomavirus
VVPSLLASKTK

SEQ ID NO: 10654 - protein, 10 aa, Artificial Sequence
  Peptide Derived from Human Papillomavirus
WLCEPPKCFK

SEQ ID NO: 10655 - protein, 11 aa, Artificial Sequence
  Peptide Derived from Human Papillomavirus
WLCEPPKCFKK

SEQ ID NO: 10656 - protein, 9 aa, Artificial Sequence
  Peptide Derived from Human Papillomavirus
WTSDNKNSK

SEQ ID NO: 10657 - protein, 11 aa, Artificial Sequence
  Peptide Derived from Human Papillomavirus
YIHNCEKVYFK

SEQ ID NO: 10658 - protein, 9 aa, Artificial Sequence
  Peptide Derived from Human Papillomavirus
FLCLSLLLR

SEQ ID NO: 10659 - protein, 11 aa, Artificial Sequence
  Peptide Derived from Human Papillomavirus
ILFLCLSLLLR

SEQ ID NO: 10660 - protein, 11 aa, Artificial Sequence
  Peptide Derived from Human Papillomavirus
LLWVFVGSPLK

SEQ ID NO: 10661 - protein, 9 aa, Artificial Sequence
  Peptide Derived from Human Papillomavirus
WVFVGSPLK

SEQ ID NO: 10662 - protein, 8 aa, Artificial Sequence
  Peptide Derived from Human Papillomavirus
AACWRSRR

SEQ ID NO: 10663 - protein, 9 aa, Artificial Sequence
  Peptide Derived from Human Papillomavirus
AACWRSRRR

SEQ ID NO: 10664 - protein, 8 aa, Artificial Sequence
  Peptide Derived from Human Papillomavirus
CAACWRSR

SEQ ID NO: 10665 - protein, 9 aa, Artificial Sequence
  Peptide Derived from Human Papillomavirus
CAACWRSRR

SEQ ID NO: 10666 - protein, 10 aa, Artificial Sequence
  Peptide Derived from Human Papillomavirus
CAACWRSRRR

SEQ ID NO: 10667 - protein, 10 aa, Artificial Sequence
  Peptide Derived from Human Papillomavirus
CVECKKPLQR

SEQ ID NO: 10668 - protein, 11 aa, Artificial Sequence
  Peptide Derived from Human Papillomavirus
EILIRCIICQR

SEQ ID NO: 10669 - protein, 8 aa, Artificial Sequence
  Peptide Derived from Human Papillomavirus
ELQCVECK

SEQ ID NO: 10670 - protein, 9 aa, Artificial Sequence
  Peptide Derived from Human Papillomavirus
ELQCVECKK

SEQ ID NO: 10671 - protein, 9 aa, Artificial Sequence
  Peptide Derived from Human Papillomavirus
FADLTVVYR

SEQ ID NO: 10672 - protein, 11 aa, Artificial Sequence
  Peptide Derived from Human Papillomavirus
FAFADLTVVYR

SEQ ID NO: 10673 - protein, 9 aa, Artificial Sequence
  Peptide Derived from Human Papillomavirus
FLSKISEYR

SEQ ID NO: 10674 - protein, 8 aa, Artificial Sequence
  Peptide Derived from Human Papillomavirus
GICKLCLR

SEQ ID NO: 10675 - protein, 10 aa, Artificial Sequence
  Peptide Derived from Human Papillomavirus
ILIRCIICQR

SEQ ID NO: 10676 - protein, 8 aa, Artificial Sequence
  Peptide Derived from Human Papillomavirus
ISGRWAGR

SEQ ID NO: 10677 - protein, 9 aa, Artificial Sequence
  Peptide Derived from Human Papillomavirus
KLCLRFLSK

SEQ ID NO: 10678 - protein, 9 aa, Artificial Sequence
  Peptide Derived from Human Papillomavirus
LIRCIICQR

SEQ ID NO: 10679 - protein, 8 aa, Artificial Sequence
  Peptide Derived from Human Papillomavirus
LSKISEYR

SEQ ID NO: 10680 - protein, 10 aa, Artificial Sequence
  Peptide Derived from Human Papillomavirus
NIELQCVECK

SEQ ID NO: 10681 - protein, 11 aa, Artificial Sequence
  Peptide Derived from Human Papillomavirus
NIELQCVECKK

SEQ ID NO: 10682 - protein, 9 aa, Artificial Sequence
  Peptide Derived from Human Papillomavirus
NISGRWAGR

SEQ ID NO: 10683 - protein, 8 aa, Artificial Sequence
  Peptide Derived from Human Papillomavirus
NTLEQTVK

SEQ ID NO: 10684 - protein, 9 aa, Artificial Sequence
  Peptide Derived from Human Papillomavirus
NTLEQTVKK

SEQ ID NO: 10685 - protein, 8 aa, Artificial Sequence
  Peptide Derived from Human Papillomavirus
PLCPQEKK

SEQ ID NO: 10686 - protein, 9 aa, Artificial Sequence
  Peptide Derived from Human Papillomavirus
PLCPQEKKR

SEQ ID NO: 10687 - protein, 8 aa, Artificial Sequence
  Peptide Derived from Human Papillomavirus
PLNEILIR

SEQ ID NO: 10688 - protein, 8 aa, Artificial Sequence
  Peptide Derived from Human Papillomavirus
TLEQTVKK

SEQ ID NO: 10689 - protein, 10 aa, Artificial Sequence
  Peptide Derived from Human Papillomavirus
WAGRCAACWR

SEQ ID NO: 10690 - protein, 10 aa, Artificial Sequence
  Peptide Derived from Human Papillomavirus
CVNSTASDLR

SEQ ID NO: 10691 - protein, 11 aa, Artificial Sequence
  Peptide Derived from Human Papillomavirus
DSSDEDEGLDR

SEQ ID NO: 10692 - protein, 8 aa, Artificial Sequence
  Peptide Derived from Human Papillomavirus
HTCNTTVR

SEQ ID NO: 10693 - protein, 8 aa, Artificial Sequence
  Peptide Derived from Human Papillomavirus
NSTASDLR

SEQ ID NO: 10694 - protein, 10 aa, Artificial Sequence
  Peptide Derived from Human Papillomavirus
SSDEDEGLDR

SEQ ID NO: 10695 - protein, 11 aa, Artificial Sequence
  Peptide Derived from Human Papillomavirus
AITCQKTVPPK

SEQ ID NO: 10696 - protein, 8 aa, Artificial Sequence
  Peptide Derived from Human Papillomavirus
ASLQDTYR

SEQ ID NO: 10697 - protein, 10 aa, Artificial Sequence
  Peptide Derived from Human Papillomavirus
AVGHPYFSIK

SEQ ID NO: 10698 - protein, 9 aa, Artificial Sequence
  Peptide Derived from Human Papillomavirus
AVPDDLYIK

SEQ ID NO: 10699 - protein, 11 aa, Artificial Sequence
  Peptide Derived from Human Papillomavirus
CMDFKTLQANK

SEQ ID NO: 10700 - protein, 11 aa, Artificial Sequence
  Peptide Derived from Human Papillomavirus
CTQVTSDSTYK

SEQ ID NO: 10701 - protein, 8 aa, Artificial Sequence
  Peptide Derived from Human Papillomavirus
CVGLEIGR

SEQ ID NO: 10702 - protein, 8 aa, Artificial Sequence
  Peptide Derived from Human Papillomavirus
DICGSTCK

SEQ ID NO: 10703 - protein, 9 aa, Artificial Sequence
  Peptide Derived from Human Papillomavirus
DLDQFPLGR

SEQ ID NO: 10704 - protein, 10 aa, Artificial Sequence
  Peptide Derived from Human Papillomavirus
DLDQFPLGRK

SEQ ID NO: 10705 - protein, 10 aa, Artificial Sequence
  Peptide Derived from Human Papillomavirus
DLQFVFQLCK

SEQ ID NO: 10706 - protein, 8 aa, Artificial Sequence
  Peptide Derived from Human Papillomavirus
DSLFFFLR

SEQ ID NO: 10707 - protein, 9 aa, Artificial Sequence
  Peptide Derived from Human Papillomavirus
DSLFFFLRR

SEQ ID NO: 10708 - protein, 10 aa, Artificial Sequence
  Peptide Derived from Human Papillomavirus
DSTYKNENFK

SEQ ID NO: 10709 - protein, 10 aa, Artificial Sequence
  Peptide Derived from Human Papillomavirus
DTGFGCMDFK

SEQ ID NO: 10710 - protein, 11 aa, Artificial Sequence
  Peptide Derived from Human Papillomavirus
DTSFYNPDTQR

SEQ ID NO: 10711 - protein, 10 aa, Artificial Sequence
  Peptide Derived from Human Papillomavirus
EAVPDDLYIK

SEQ ID NO: 10712 - protein, 8 aa, Artificial Sequence
  Peptide Derived from Human Papillomavirus
FLLQAGLK

SEQ ID NO: 10713 - protein, 10 aa, Artificial Sequence
  Peptide Derived from Human Papillomavirus
FLLQAGLKAK

SEQ ID NO: 10714 - protein, 10 aa, Artificial Sequence
  Peptide Derived from Human Papillomavirus
FLRREQMFVR

SEQ ID NO: 10715 - protein, 10 aa, Artificial Sequence
  Peptide Derived from Human Papillomavirus
FSIKNPTNAK

SEQ ID NO: 10716 - protein, 11 aa, Artificial Sequence
  Peptide Derived from Human Papillomavirus
FSIKNPTNAKK

SEQ ID NO: 10717 - protein, 8 aa, Artificial Sequence
  Peptide Derived from Human Papillomavirus
FVRHFFNR

SEQ ID NO: 10718 - protein, 11 aa, Artificial Sequence
  Peptide Derived from Human Papillomavirus
FVTSQAITCQK

SEQ ID NO: 10719 - protein, 9 aa, Artificial Sequence
  Peptide Derived from Human Papillomavirus
FVTVVDTTR

SEQ ID NO: 10720 - protein, 10 aa, Artificial Sequence
  Peptide Derived from Human Papillomavirus
GISGHPLLNK

SEQ ID NO: 10721 - protein, 9 aa, Artificial Sequence
  Peptide Derived from Human Papillomavirus
GLKAKPKLK

SEQ ID NO: 10722 - protein, 10 aa, Artificial Sequence
  Peptide Derived from Human Papillomavirus
GLKAKPKLKR

SEQ ID NO: 10723 - protein, 8 aa, Artificial Sequence
  Peptide Derived from Human Papillomavirus
GLQYRVFR

SEQ ID NO: 10724 - protein, 10 aa, Artificial Sequence
  Peptide Derived from Human Papillomavirus
GLQYRVFRVR

SEQ ID NO: 10725 - protein, 11 aa, Artificial Sequence
  Peptide Derived from Human Papillomavirus
GSTCKYPDYLK

SEQ ID NO: 10726 - protein, 9 aa, Artificial Sequence
  Peptide Derived from Human Papillomavirus
ISGHPLLNK

SEQ ID NO: 10727 - protein, 10 aa, Artificial Sequence
  Peptide Derived from Human Papillomavirus
ITCQKTVPPK

SEQ ID NO: 10728 - protein, 8 aa, Artificial Sequence
  Peptide Derived from Human Papillomavirus
KAKPKLKR

SEQ ID NO: 10729 - protein, 11 aa, Artificial Sequence
  Peptide Derived from Human Papillomavirus
KLKRAAPTSTR

SEQ ID NO: 10730 - protein, 8 aa, Artificial Sequence
  Peptide Derived from Human Papillomavirus
KTVPPKEK

SEQ ID NO: 10731 - protein, 8 aa, Artificial Sequence
  Peptide Derived from Human Papillomavirus
KVSGLQYR

SEQ ID NO: 10732 - protein, 11 aa, Artificial Sequence
  Peptide Derived from Human Papillomavirus
KVSGLQYRVFR

SEQ ID NO: 10733 - protein, 11 aa, Artificial Sequence
  Peptide Derived from Human Papillomavirus
KVVSTDEYVSR

SEQ ID NO: 10734 - protein, 11 aa, Artificial Sequence
  Peptide Derived from Human Papillomavirus
LAVGHPYFSIK

SEQ ID NO: 10735 - protein, 9 aa, Artificial Sequence
  Peptide Derived from Human Papillomavirus
LLQAGLKAK

SEQ ID NO: 10736 - protein, 11 aa, Artificial Sequence
  Peptide Derived from Human Papillomavirus
LLQAGLKAKPK

SEQ ID NO: 10737 - protein, 11 aa, Artificial Sequence
  Peptide Derived from Human Papillomavirus
LVPKVSGLQYR

SEQ ID NO: 10738 - protein, 11 aa, Artificial Sequence
  Peptide Derived from Human Papillomavirus
MVTSESQLFNK

SEQ ID NO: 10739 - protein, 9 aa, Artificial Sequence
  Peptide Derived from Human Papillomavirus
NAKKLLVPK

SEQ ID NO: 10740 - protein, 10 aa, Artificial Sequence
  Peptide Derived from Human Papillomavirus
PIDICGSTCK

SEQ ID NO: 10741 - protein, 10 aa, Artificial Sequence
  Peptide Derived from Human Papillomavirus
PSASLQDTYR

SEQ ID NO: 10742 - protein, 8 aa, Artificial Sequence
  Peptide Derived from Human Papillomavirus
PTGEHWGK

SEQ ID NO: 10743 - protein, 11 aa, Artificial Sequence
  Peptide Derived from Human Papillomavirus
PTNAKKLLVPK

SEQ ID NO: 10744 - protein, 10 aa, Artificial Sequence
  Peptide Derived from Human Papillomavirus
PTSTRTSSAK

SEQ ID NO: 10745 - protein, 11 aa, Artificial Sequence
  Peptide Derived from Human Papillomavirus
PTSTRTSSAKR

SEQ ID NO: 10746 - protein, 9 aa, Artificial Sequence
  Peptide Derived from Human Papillomavirus
QAGLKAKPK

SEQ ID NO: 10747 - protein, 11 aa, Artificial Sequence
  Peptide Derived from Human Papillomavirus
QAGLKAKPKLK

SEQ ID NO: 10748 - protein, 8 aa, Artificial Sequence
  Peptide Derived from Human Papillomavirus
QLCLLGCK

SEQ ID NO: 10749 - protein, 11 aa, Artificial Sequence
  Peptide Derived from Human Papillomavirus
QLFNKPYWLQR

SEQ ID NO: 10750 - protein, 10 aa, Artificial Sequence
  Peptide Derived from Human Papillomavirus
QMFVRHFFNR

SEQ ID NO: 10751 - protein, 10 aa, Artificial Sequence
  Peptide Derived from Human Papillomavirus
QTQLCLLGCK

SEQ ID NO: 10752 - protein, 11 aa, Artificial Sequence
  Peptide Derived from Human Papillomavirus
QVFVTVVDTTR

SEQ ID NO: 10753 - protein, 9 aa, Artificial Sequence
  Peptide Derived from Human Papillomavirus
QVTSDSTYK

SEQ ID NO: 10754 - protein, 8 aa, Artificial Sequence
  Peptide Derived from Human Papillomavirus
RAAPTSTR

SEQ ID NO: 10755 - protein, 8 aa, Artificial Sequence
  Peptide Derived from Human Papillomavirus
RTSSAKRK

SEQ ID NO: 10756 - protein, 9 aa, Artificial Sequence
  Peptide Derived from Human Papillomavirus
RTSSAKRKK

SEQ ID NO: 10757 - protein, 11 aa, Artificial Sequence
  Peptide Derived from Human Papillomavirus
RTSSAKRKKVK

SEQ ID NO: 10758 - protein, 9 aa, Artificial Sequence
  Peptide Derived from Human Papillomavirus
RVRLPDPNK

SEQ ID NO: 10759 - protein, 11 aa, Artificial Sequence
  Peptide Derived from Human Papillomavirus
SADLDQFPLGR

SEQ ID NO: 10760 - protein, 8 aa, Artificial Sequence
  Peptide Derived from Human Papillomavirus
SAKRKKVK

SEQ ID NO: 10761 - protein, 9 aa, Artificial Sequence
  Peptide Derived from Human Papillomavirus
SAKRKKVKK

SEQ ID NO: 10762 - protein, 9 aa, Artificial Sequence
  Peptide Derived from Human Papillomavirus
SASLQDTYR

SEQ ID NO: 10763 - protein, 9 aa, Artificial Sequence
  Peptide Derived from Human Papillomavirus
SIKNPTNAK

SEQ ID NO: 10764 - protein, 10 aa, Artificial Sequence
  Peptide Derived from Human Papillomavirus
SIKNPTNAKK

SEQ ID NO: 10765 - protein, 10 aa, Artificial Sequence
  Peptide Derived from Human Papillomavirus
SIYYYAGSSR

SEQ ID NO: 10766 - protein, 8 aa, Artificial Sequence
  Peptide Derived from Human Papillomavirus
SLFFFLRR

SEQ ID NO: 10767 - protein, 9 aa, Artificial Sequence
  Peptide Derived from Human Papillomavirus
SSAKRKKVK

SEQ ID NO: 10768 - protein, 10 aa, Artificial Sequence
  Peptide Derived from Human Papillomavirus
SSAKRKKVKK

SEQ ID NO: 10769 - protein, 10 aa, Artificial Sequence
  Peptide Derived from Human Papillomavirus
STCKYPDYLK

SEQ ID NO: 10770 - protein, 8 aa, Artificial Sequence
  Peptide Derived from Human Papillomavirus
STDEYVSR

SEQ ID NO: 10771 - protein, 8 aa, Artificial Sequence
  Peptide Derived from Human Papillomavirus
STRTSSAK

SEQ ID NO: 10772 - protein, 9 aa, Artificial Sequence
  Peptide Derived from Human Papillomavirus
STRTSSAKR

SEQ ID NO: 10773 - protein, 10 aa, Artificial Sequence
  Peptide Derived from Human Papillomavirus
STRTSSAKRK

SEQ ID NO: 10774 - protein, 11 aa, Artificial Sequence
  Peptide Derived from Human Papillomavirus
STRTSSAKRKK

SEQ ID NO: 10775 - protein, 9 aa, Artificial Sequence
  Peptide Derived from Human Papillomavirus
STYKNENFK

SEQ ID NO: 10776 - protein, 9 aa, Artificial Sequence
  Peptide Derived from Human Papillomavirus
TSESQLFNK

SEQ ID NO: 10777 - protein, 10 aa, Artificial Sequence
  Peptide Derived from Human Papillomavirus
TSFYNPDTQR

SEQ ID NO: 10778 - protein, 11 aa, Artificial Sequence
  Peptide Derived from Human Papillomavirus
TSIYYYAGSSR

SEQ ID NO: 10779 - protein, 9 aa, Artificial Sequence
  Peptide Derived from Human Papillomavirus
TSQAITCQK

SEQ ID NO: 10780 - protein, 8 aa, Artificial Sequence
  Peptide Derived from Human Papillomavirus
TSSAKRKK

SEQ ID NO: 10781 - protein, 10 aa, Artificial Sequence
  Peptide Derived from Human Papillomavirus
TSSAKRKKVK

SEQ ID NO: 10782 - protein, 11 aa, Artificial Sequence
  Peptide Derived from Human Papillomavirus
TSSAKRKKVKK

SEQ ID NO: 10783 - protein, 9 aa, Artificial Sequence
  Peptide Derived from Human Papillomavirus
TSTRTSSAK

SEQ ID NO: 10784 - protein, 10 aa, Artificial Sequence
  Peptide Derived from Human Papillomavirus
TSTRTSSAKR

SEQ ID NO: 10785 - protein, 11 aa, Artificial Sequence
  Peptide Derived from Human Papillomavirus
TSTRTSSAKRK

SEQ ID NO: 10786 - protein, 11 aa, Artificial Sequence
  Peptide Derived from Human Papillomavirus
TVYLPPVPVSK

SEQ ID NO: 10787 - protein, 10 aa, Artificial Sequence
  Peptide Derived from Human Papillomavirus
VSGLQYRVFR

SEQ ID NO: 10788 - protein, 9 aa, Artificial Sequence
  Peptide Derived from Human Papillomavirus
VSTDEYVSR

SEQ ID NO: 10789 - protein, 8 aa, Artificial Sequence
  Peptide Derived from Human Papillomavirus
VTSDSTYK

SEQ ID NO: 10790 - protein, 10 aa, Artificial Sequence
  Peptide Derived from Human Papillomavirus
VTSESQLFNK

SEQ ID NO: 10791 - protein, 10 aa, Artificial Sequence
  Peptide Derived from Human Papillomavirus
VTSQAITCQK

SEQ ID NO: 10792 - protein, 8 aa, Artificial Sequence
  Peptide Derived from Human Papillomavirus
VTVVDTTR

SEQ ID NO: 10793 - protein, 10 aa, Artificial Sequence
  Peptide Derived from Human Papillomavirus
VVSTDEYVSR

SEQ ID NO: 10794 - protein, 10 aa, Artificial Sequence
  Peptide Derived from Human Papillomavirus
WACVGLEIGR

SEQ ID NO: 10795 - protein, 9 aa, Artificial Sequence
  Peptide Derived from Human Papillomavirus
YLPPVPVSK

SEQ ID NO: 10796 - protein, 9 aa, Artificial Sequence
  Peptide Derived from Human Papillomavirus
YTFWEVDLK

SEQ ID NO: 10797 - protein, 11 aa, Artificial Sequence
  Peptide Derived from Human Papillomavirus
YTFWEVDLKEK

SEQ ID NO: 10798 - protein, 9 aa, Artificial Sequence
  Peptide Derived from Human Papillomavirus
AAIPLQPIR

SEQ ID NO: 10799 - protein, 8 aa, Artificial Sequence
  Peptide Derived from Human Papillomavirus
AIPLQPIR

SEQ ID NO: 10800 - protein, 10 aa, Artificial Sequence
  Peptide Derived from Human Papillomavirus
AITSRRHTVR

SEQ ID NO: 10801 - protein, 10 aa, Artificial Sequence
  Peptide Derived from Human Papillomavirus
ALHRPAITSR

SEQ ID NO: 10802 - protein, 11 aa, Artificial Sequence
  Peptide Derived from Human Papillomavirus
ALHRPAITSRR

SEQ ID NO: 10803 - protein, 11 aa, Artificial Sequence
  Peptide Derived from Human Papillomavirus
ASATQLYQTCK

SEQ ID NO: 10804 - protein, 9 aa, Artificial Sequence
  Peptide Derived from Human Papillomavirus
ATLKTRSGK

SEQ ID NO: 10805 - protein, 9 aa, Artificial Sequence
  Peptide Derived from Human Papillomavirus
ATQLYQTCK

SEQ ID NO: 10806 - protein, 8 aa, Artificial Sequence
  Peptide Derived from Human Papillomavirus
FILRRRRK

SEQ ID NO: 10807 - protein, 9 aa, Artificial Sequence
  Peptide Derived from Human Papillomavirus
FILRRRRKR

SEQ ID NO: 10808 - protein, 9 aa, Artificial Sequence
  Peptide Derived from Human Papillomavirus
FLDIIALHR

SEQ ID NO: 10809 - protein, 11 aa, Artificial Sequence
  Peptide Derived from Human Papillomavirus
FSRVGQKATLK

SEQ ID NO: 10810 - protein, 11 aa, Artificial Sequence
  Peptide Derived from Human Papillomavirus
FVLHPSYFILR

SEQ ID NO: 10811 - protein, 11 aa, Artificial Sequence
  Peptide Derived from Human Papillomavirus
GIGTGSGSGGR

SEQ ID NO: 10812 - protein, 11 aa, Artificial Sequence
  Peptide Derived from Human Papillomavirus
GLYSRNTQQVK

SEQ ID NO: 10813 - protein, 10 aa, Artificial Sequence
  Peptide Derived from Human Papillomavirus
GSTIADQILK

SEQ ID NO: 10814 - protein, 10 aa, Artificial Sequence
  Peptide Derived from Human Papillomavirus
GTCPPDVIPK

SEQ ID NO: 10815 - protein, 9 aa, Artificial Sequence
  Peptide Derived from Human Papillomavirus
GTGSGSGGR

SEQ ID NO: 10816 - protein, 10 aa, Artificial Sequence
  Peptide Derived from Human Papillomavirus
HSYSTFATTR

SEQ ID NO: 10817 - protein, 11 aa, Artificial Sequence
  Peptide Derived from Human Papillomavirus
HTVRFSRVGQK

SEQ ID NO: 10818 - protein, 11 aa, Artificial Sequence
  Peptide Derived from Human Papillomavirus
IALHRPAITSR

SEQ ID NO: 10819 - protein, 8 aa, Artificial Sequence
  Peptide Derived from Human Papillomavirus
ILRRRRKR

SEQ ID NO: 10820 - protein, 9 aa, Artificial Sequence
  Peptide Derived from Human Papillomavirus
ITSRRHTVR

SEQ ID NO: 10821 - protein, 10 aa, Artificial Sequence
  Peptide Derived from Human Papillomavirus
KATLKTRSGK

SEQ ID NO: 10822 - protein, 11 aa, Artificial Sequence
  Peptide Derived from Human Papillomavirus
KTRSGKQIGAR

SEQ ID NO: 10823 - protein, 9 aa, Artificial Sequence
  Peptide Derived from Human Papillomavirus
PAFLTSPHK

SEQ ID NO: 10824 - protein, 11 aa, Artificial Sequence
  Peptide Derived from Human Papillomavirus
PAITSRRHTVR

SEQ ID NO: 10825 - protein, 10 aa, Artificial Sequence
  Peptide Derived from Human Papillomavirus
PIPGSRPVAR

SEQ ID NO: 10826 - protein, 8 aa, Artificial Sequence
  Peptide Derived from Human Papillomavirus
PSYFILRR

SEQ ID NO: 10827 - protein, 9 aa, Artificial Sequence
  Peptide Derived from Human Papillomavirus
PSYFILRRR

SEQ ID NO: 10828 - protein, 10 aa, Artificial Sequence
  Peptide Derived from Human Papillomavirus
PSYFILRRRR

SEQ ID NO: 10829 - protein, 11 aa, Artificial Sequence
  Peptide Derived from Human Papillomavirus
PSYFILRRRRK

SEQ ID NO: 10830 - protein, 11 aa, Artificial Sequence
  Peptide Derived from Human Papillomavirus
PTAAIPLQPIR

SEQ ID NO: 10831 - protein, 10 aa, Artificial Sequence
  Peptide Derived from Human Papillomavirus
PVARLGLYSR

SEQ ID NO: 10832 - protein, 9 aa, Artificial Sequence
  Peptide Derived from Human Papillomavirus
RSGKQIGAR

SEQ ID NO: 10833 - protein, 9 aa, Artificial Sequence
  Peptide Derived from Human Papillomavirus
RVGQKATLK

SEQ ID NO: 10834 - protein, 11 aa, Artificial Sequence
  Peptide Derived from Human Papillomavirus
RVGQKATLKTR

SEQ ID NO: 10835 - protein, 10 aa, Artificial Sequence
  Peptide Derived from Human Papillomavirus
SATQLYQTCK

SEQ ID NO: 10836 - protein, 9 aa, Artificial Sequence
  Peptide Derived from Human Papillomavirus
SSTPIPGSR

SEQ ID NO: 10837 - protein, 9 aa, Artificial Sequence
  Peptide Derived from Human Papillomavirus
STIADQILK

SEQ ID NO: 10838 - protein, 8 aa, Artificial Sequence
  Peptide Derived from Human Papillomavirus
STPIPGSR

SEQ ID NO: 10839 - protein, 10 aa, Artificial Sequence
  Peptide Derived from Human Papillomavirus
TAAIPLQPIR

SEQ ID NO: 10840 - protein, 8 aa, Artificial Sequence
  Peptide Derived from Human Papillomavirus
TIADQILK

SEQ ID NO: 10841 - protein, 8 aa, Artificial Sequence
  Peptide Derived from Human Papillomavirus
TLKTRSGK

SEQ ID NO: 10842 - protein, 8 aa, Artificial Sequence
  Peptide Derived from Human Papillomavirus
TSRRHTVR

SEQ ID NO: 10843 - protein, 11 aa, Artificial Sequence
  Peptide Derived from Human Papillomavirus
TSRRHTVRFSR

SEQ ID NO: 10844 - protein, 10 aa, Artificial Sequence
  Peptide Derived from Human Papillomavirus
TSSTPIPGSR

SEQ ID NO: 10845 - protein, 10 aa, Artificial Sequence
  Peptide Derived from Human Papillomavirus
TVRFSRVGQK

SEQ ID NO: 10846 - protein, 9 aa, Artificial Sequence
  Peptide Derived from Human Papillomavirus
VARLGLYSR

SEQ ID NO: 10847 - protein, 10 aa, Artificial Sequence
  Peptide Derived from Human Papillomavirus
VLHPSYFILR

SEQ ID NO: 10848 - protein, 11 aa, Artificial Sequence
  Peptide Derived from Human Papillomavirus
VLHPSYFILRR

SEQ ID NO: 10849 - protein, 11 aa, Artificial Sequence
  Peptide Derived from Human Papillomavirus
VTSSTPIPGSR

SEQ ID NO: 10850 - protein, 9 aa, Artificial Sequence
  Peptide Derived from Human Papillomavirus
YSRNTQQVK

SEQ ID NO: 10851 - protein, 8 aa, Artificial Sequence
  Peptide Derived from Human Papillomavirus
YSTFATTR

SEQ ID NO: 10852 - protein, 11 aa, Artificial Sequence
  Peptide Derived from Human Papillomavirus
AAFLKSNCQAK

SEQ ID NO: 10853 - protein, 8 aa, Artificial Sequence
  Peptide Derived from Human Papillomavirus
AAMLAVFK

SEQ ID NO: 10854 - protein, 11 aa, Artificial Sequence
  Peptide Derived from Human Papillomavirus
ALDGNPISIDR

SEQ ID NO: 10855 - protein, 11 aa, Artificial Sequence
  Peptide Derived from Human Papillomavirus
ALKEFLKGTPK

SEQ ID NO: 10856 - protein, 9 aa, Artificial Sequence
  Peptide Derived from Human Papillomavirus
ALLRYKCGK

SEQ ID NO: 10857 - protein, 11 aa, Artificial Sequence
  Peptide Derived from Human Papillomavirus
ALLRYKCGKNR

SEQ ID NO: 10858 - protein, 8 aa, Artificial Sequence
  Peptide Derived from Human Papillomavirus
AVMCRHYK

SEQ ID NO: 10859 - protein, 9 aa, Artificial Sequence
  Peptide Derived from Human Papillomavirus
AVMCRHYKR

SEQ ID NO: 10860 - protein, 9 aa, Artificial Sequence
  Peptide Derived from Human Papillomavirus
CAVMCRHYK

SEQ ID NO: 10861 - protein, 10 aa, Artificial Sequence
  Peptide Derived from Human Papillomavirus
CAVMCRHYKR

SEQ ID NO: 10862 - protein, 8 aa, Artificial Sequence
  Peptide Derived from Human Papillomavirus
CMLIEPPK

SEQ ID NO: 10863 - protein, 10 aa, Artificial Sequence
  Peptide Derived from Human Papillomavirus
CMLIEPPKLR

SEQ ID NO: 10864 - protein, 11 aa, Artificial Sequence
  Peptide Derived from Human Papillomavirus
CSKIDEGGDWR

SEQ ID NO: 10865 - protein, 8 aa, Artificial Sequence
  Peptide Derived from Human Papillomavirus
CVTGQNTR

SEQ ID NO: 10866 - protein, 9 aa, Artificial Sequence
  Peptide Derived from Human Papillomavirus
DAQVLHLLK

SEQ ID NO: 10867 - protein, 10 aa, Artificial Sequence
  Peptide Derived from Human Papillomavirus
DAQVLHLLKR

SEQ ID NO: 10868 - protein, 11 aa, Artificial Sequence
  Peptide Derived from Human Papillomavirus
DAQVLHLLKRK

SEQ ID NO: 10869 - protein, 10 aa, Artificial Sequence
  Peptide Derived from Human Papillomavirus
DLVRNFKSDK

SEQ ID NO: 10870 - protein, 11 aa, Artificial Sequence
  Peptide Derived from Human Papillomavirus
DTEGIPFGTFK

SEQ ID NO: 10871 - protein, 8 aa, Artificial Sequence
  Peptide Derived from Human Papillomavirus
DTPEWIQR

SEQ ID NO: 10872 - protein, 8 aa, Artificial Sequence
  Peptide Derived from Human Papillomavirus
EINDKNWK

SEQ ID NO: 10873 - protein, 9 aa, Artificial Sequence
  Peptide Derived from Human Papillomavirus
EISLNSGHK

SEQ ID NO: 10874 - protein, 10 aa, Artificial Sequence
  Peptide Derived from Human Papillomavirus
EISLNSGHKK

SEQ ID NO: 10875 - protein, 11 aa, Artificial Sequence
  Peptide Derived from Human Papillomavirus
ELKELLQASNK

SEQ ID NO: 10876 - protein, 8 aa, Artificial Sequence
  Peptide Derived from Human Papillomavirus
ELLQASNK

SEQ ID NO: 10877 - protein, 9 aa, Artificial Sequence
  Peptide Derived from Human Papillomavirus
ELLQASNKK

SEQ ID NO: 10878 - protein, 10 aa, Artificial Sequence
  Peptide Derived from Human Papillomavirus
ETCMLIEPPK

SEQ ID NO: 10879 - protein, 9 aa, Artificial Sequence
  Peptide Derived from Human Papillomavirus
FISFLRALK

SEQ ID NO: 10880 - protein, 8 aa, Artificial Sequence
  Peptide Derived from Human Papillomavirus
FLKGTPKK

SEQ ID NO: 10881 - protein, 9 aa, Artificial Sequence
  Peptide Derived from Human Papillomavirus
FLKSNCQAK

SEQ ID NO: 10882 - protein, 10 aa, Artificial Sequence
  Peptide Derived from Human Papillomavirus
FLRALKEFLK

SEQ ID NO: 10883 - protein, 9 aa, Artificial Sequence
  Peptide Derived from Human Papillomavirus
FTDLVRNFK

SEQ ID NO: 10884 - protein, 11 aa, Artificial Sequence
  Peptide Derived from Human Papillomavirus
FTFPHAFPFDK

SEQ ID NO: 10885 - protein, 8 aa, Artificial Sequence
  Peptide Derived from Human Papillomavirus
FVETIVEK

SEQ ID NO: 10886 - protein, 9 aa, Artificial Sequence
  Peptide Derived from Human Papillomavirus
FVETIVEKK

SEQ ID NO: 10887 - protein, 8 aa, Artificial Sequence
  Peptide Derived from Human Papillomavirus
GIPFGTFK

SEQ ID NO: 10888 - protein, 9 aa, Artificial Sequence
  Peptide Derived from Human Papillomavirus
GLSFTDLVR

SEQ ID NO: 10889 - protein, 9 aa, Artificial Sequence
  Peptide Derived from Human Papillomavirus
GVEFISFLR

SEQ ID NO: 10890 - protein, 9 aa, Artificial Sequence
  Peptide Derived from Human Papillomavirus
GVLILALLR

SEQ ID NO: 10891 - protein, 11 aa, Artificial Sequence
  Peptide Derived from Human Papillomavirus
GVLILALLRYK

SEQ ID NO: 10892 - protein, 11 aa, Artificial Sequence
  Peptide Derived from Human Papillomavirus
GVNPTVAEGFK

SEQ ID NO: 10893 - protein, 8 aa, Artificial Sequence
  Peptide Derived from Human Papillomavirus
HIQCLDCK

SEQ ID NO: 10894 - protein, 8 aa, Artificial Sequence
  Peptide Derived from Human Papillomavirus
ILALLRYK

SEQ ID NO: 10895 - protein, 11 aa, Artificial Sequence
  Peptide Derived from Human Papillomavirus
ILALLRYKCGK

SEQ ID NO: 10896 - protein, 11 aa, Artificial Sequence
  Peptide Derived from Human Papillomavirus
ILLTSNIDPAK

SEQ ID NO: 10897 - protein, 11 aa, Artificial Sequence
  Peptide Derived from Human Papillomavirus
ILLYGPANTGK

SEQ ID NO: 10898 - protein, 8 aa, Artificial Sequence
  Peptide Derived from Human Papillomavirus
ISFLRALK

SEQ ID NO: 10899 - protein, 8 aa, Artificial Sequence
  Peptide Derived from Human Papillomavirus
ISIDRKHK

SEQ ID NO: 10900 - protein, 8 aa, Artificial Sequence
  Peptide Derived from Human Papillomavirus
ISLNSGHK

SEQ ID NO: 10901 - protein, 9 aa, Artificial Sequence
  Peptide Derived from Human Papillomavirus
ISLNSGHKK

SEQ ID NO: 10902 - protein, 11 aa, Artificial Sequence
  Peptide Derived from Human Papillomavirus
ISLNSGHKKAK

SEQ ID NO: 10903 - protein, 9 aa, Artificial Sequence
  Peptide Derived from Human Papillomavirus
KAAMLAVFK

SEQ ID NO: 10904 - protein, 9 aa, Artificial Sequence
  Peptide Derived from Human Papillomavirus
KIDEGGDWR

SEQ ID NO: 10905 - protein, 10 aa, Artificial Sequence
  Peptide Derived from Human Papillomavirus
KSNCQAKYLK

SEQ ID NO: 10906 - protein, 10 aa, Artificial Sequence
  Peptide Derived from Human Papillomavirus
LALLRYKCGK

SEQ ID NO: 10907 - protein, 8 aa, Artificial Sequence
  Peptide Derived from Human Papillomavirus
LIEPPKLR

SEQ ID NO: 10908 - protein, 9 aa, Artificial Sequence
  Peptide Derived from Human Papillomavirus
LILALLRYK

SEQ ID NO: 10909 - protein, 11 aa, Artificial Sequence
  Peptide Derived from Human Papillomavirus
LLKRKFAGGSK

SEQ ID NO: 10910 - protein, 8 aa, Artificial Sequence
  Peptide Derived from Human Papillomavirus
LLQASNKK

SEQ ID NO: 10911 - protein, 8 aa, Artificial Sequence
  Peptide Derived from Human Papillomavirus
LLRYKCGK

SEQ ID NO: 10912 - protein, 10 aa, Artificial Sequence
  Peptide Derived from Human Papillomavirus
LLRYKCGKNR

SEQ ID NO: 10913 - protein, 10 aa, Artificial Sequence
  Peptide Derived from Human Papillomavirus
LLTSNIDPAK

SEQ ID NO: 10914 - protein, 10 aa, Artificial Sequence
  Peptide Derived from Human Papillomavirus
LLYGPANTGK

SEQ ID NO: 10915 - protein, 8 aa, Artificial Sequence
  Peptide Derived from Human Papillomavirus
LSFTDLVR

SEQ ID NO: 10916 - protein, 11 aa, Artificial Sequence
  Peptide Derived from Human Papillomavirus
LSFTDLVRNFK

SEQ ID NO: 10917 - protein, 10 aa, Artificial Sequence
  Peptide Derived from Human Papillomavirus
LSVDTDLSPR

SEQ ID NO: 10918 - protein, 9 aa, Artificial Sequence
  Peptide Derived from Human Papillomavirus
LTSNIDPAK

SEQ ID NO: 10919 - protein, 9 aa, Artificial Sequence
  Peptide Derived from Human Papillomavirus
LVRNFKSDK

SEQ ID NO: 10920 - protein, 9 aa, Artificial Sequence
  Peptide Derived from Human Papillomavirus
MLIEPPKLR

SEQ ID NO: 10921 - protein, 8 aa, Artificial Sequence
  Peptide Derived from Human Papillomavirus
MSQWIKYR

SEQ ID NO: 10922 - protein, 11 aa, Artificial Sequence
  Peptide Derived from Human Papillomavirus
MSQWIKYRCSK

SEQ ID NO: 10923 - protein, 9 aa, Artificial Sequence
  Peptide Derived from Human Papillomavirus
NIDPAKDNK

SEQ ID NO: 10924 - protein, 9 aa, Artificial Sequence
  Peptide Derived from Human Papillomavirus
NMSQWIKYR

SEQ ID NO: 10925 - protein, 8 aa, Artificial Sequence
  Peptide Derived from Human Papillomavirus
NSGHKKAK

SEQ ID NO: 10926 - protein, 9 aa, Artificial Sequence
  Peptide Derived from Human Papillomavirus
NSGHKKAKR

SEQ ID NO: 10927 - protein, 10 aa, Artificial Sequence
  Peptide Derived from Human Papillomavirus
NSGHKKAKRR

SEQ ID NO: 10928 - protein, 9 aa, Artificial Sequence
  Peptide Derived from Human Papillomavirus
NSNAAAFLK

SEQ ID NO: 10929 - protein, 9 aa, Artificial Sequence
  Peptide Derived from Human Papillomavirus
PISIDRKHK

SEQ ID NO: 10930 - protein, 8 aa, Artificial Sequence
  Peptide Derived from Human Papillomavirus
PTVAEGFK

SEQ ID NO: 10931 - protein, 8 aa, Artificial Sequence
  Peptide Derived from Human Papillomavirus
PVYEINDK

SEQ ID NO: 10932 - protein, 11 aa, Artificial Sequence
  Peptide Derived from Human Papillomavirus
PVYEINDKNWK

SEQ ID NO: 10933 - protein, 11 aa, Artificial Sequence
  Peptide Derived from Human Papillomavirus
QLSVDTDLSPR

SEQ ID NO: 10934 - protein, 9 aa, Artificial Sequence
  Peptide Derived from Human Papillomavirus
QMNMSQWIK

SEQ ID NO: 10935 - protein, 11 aa, Artificial Sequence
  Peptide Derived from Human Papillomavirus
QMNMSQWIKYR

SEQ ID NO: 10936 - protein, 8 aa, Artificial Sequence
  Peptide Derived from Human Papillomavirus
QVLHLLKR

SEQ ID NO: 10937 - protein, 9 aa, Artificial Sequence
  Peptide Derived from Human Papillomavirus
QVLHLLKRK

SEQ ID NO: 10938 - protein, 8 aa, Artificial Sequence
  Peptide Derived from Human Papillomavirus
RALKEFLK

SEQ ID NO: 10939 - protein, 11 aa, Artificial Sequence
  Peptide Derived from Human Papillomavirus
RSSVAALYWYR

SEQ ID NO: 10940 - protein, 8 aa, Artificial Sequence
  Peptide Derived from Human Papillomavirus
SLNSGHKK

SEQ ID NO: 10941 - protein, 10 aa, Artificial Sequence
  Peptide Derived from Human Papillomavirus
SLNSGHKKAK

SEQ ID NO: 10942 - protein, 11 aa, Artificial Sequence
  Peptide Derived from Human Papillomavirus
SLNSGHKKAKR

SEQ ID NO: 10943 - protein, 10 aa, Artificial Sequence
  Peptide Derived from Human Papillomavirus
SSVAALYWYR

SEQ ID NO: 10944 - protein, 9 aa, Artificial Sequence
  Peptide Derived from Human Papillomavirus
SVAALYWYR

SEQ ID NO: 10945 - protein, 9 aa, Artificial Sequence
  Peptide Derived from Human Papillomavirus
SVDTDLSPR

SEQ ID NO: 10946 - protein, 8 aa, Artificial Sequence
  Peptide Derived from Human Papillomavirus
TSNIDPAK

SEQ ID NO: 10947 - protein, 11 aa, Artificial Sequence
  Peptide Derived from Human Papillomavirus
TSNIDPAKDNK

SEQ ID NO: 10948 - protein, 11 aa, Artificial Sequence
  Peptide Derived from Human Papillomavirus
TVAEGFKTLIK

SEQ ID NO: 10949 - protein, 8 aa, Artificial Sequence
  Peptide Derived from Human Papillomavirus
VAALYWYR

SEQ ID NO: 10950 - protein, 10 aa, Artificial Sequence
  Peptide Derived from Human Papillomavirus
VAEGFKTLIK

SEQ ID NO: 10951 - protein, 8 aa, Artificial Sequence
  Peptide Derived from Human Papillomavirus
VLHLLKRK

SEQ ID NO: 10952 - protein, 8 aa, Artificial Sequence
  Peptide Derived from Human Papillomavirus
VLILALLR

SEQ ID NO: 10953 - protein, 10 aa, Artificial Sequence
  Peptide Derived from Human Papillomavirus
VLILALLRYK

SEQ ID NO: 10954 - protein, 8 aa, Artificial Sequence
  Peptide Derived from Human Papillomavirus
VMCRHYKR

SEQ ID NO: 10955 - protein, 11 aa, Artificial Sequence
  Peptide Derived from Human Papillomavirus
VMCRHYKRAQK

SEQ ID NO: 10956 - protein, 11 aa, Artificial Sequence
  Peptide Derived from Human Papillomavirus
VSGDTPEWIQR

SEQ ID NO: 10957 - protein, 8 aa, Artificial Sequence
  Peptide Derived from Human Papillomavirus
WIKYRCSK

SEQ ID NO: 10958 - protein, 9 aa, Artificial Sequence
  Peptide Derived from Human Papillomavirus
WLEPLADTK

SEQ ID NO: 10959 - protein, 9 aa, Artificial Sequence
  Peptide Derived from Human Papillomavirus
WTYFDNYMR

SEQ ID NO: 10960 - protein, 10 aa, Artificial Sequence
  Peptide Derived from Human Papillomavirus
YAHIQCLDCK

SEQ ID NO: 10961 - protein, 10 aa, Artificial Sequence
  Peptide Derived from Human Papillomavirus
YLKDCAVMCR

SEQ ID NO: 10962 - protein, 9 aa, Artificial Sequence
  Peptide Derived from Human Papillomavirus
AIELQMALK

SEQ ID NO: 10963 - protein, 9 aa, Artificial Sequence
  Peptide Derived from Human Papillomavirus
ALKGLAQSK

SEQ ID NO: 10964 - protein, 8 aa, Artificial Sequence
  Peptide Derived from Human Papillomavirus
CLRYRLRK

SEQ ID NO: 10965 - protein, 8 aa, Artificial Sequence
  Peptide Derived from Human Papillomavirus
CSSTSNNK

SEQ ID NO: 10966 - protein, 9 aa, Artificial Sequence
  Peptide Derived from Human Papillomavirus
CSSTSNNKR

SEQ ID NO: 10967 - protein, 10 aa, Artificial Sequence
  Peptide Derived from Human Papillomavirus
CSSTSNNKRR

SEQ ID NO: 10968 - protein, 11 aa, Artificial Sequence
  Peptide Derived from Human Papillomavirus
CSSTSNNKRRK

SEQ ID NO: 10969 - protein, 11 aa, Artificial Sequence
  Peptide Derived from Human Papillomavirus
CVSYWGVYYIK

SEQ ID NO: 10970 - protein, 9 aa, Artificial Sequence
  Peptide Derived from Human Papillomavirus
DTTYYVQFK

SEQ ID NO: 10971 - protein, 10 aa, Artificial Sequence
  Peptide Derived from Human Papillomavirus
DTVSATQIVR

SEQ ID NO: 10972 - protein, 10 aa, Artificial Sequence
  Peptide Derived from Human Papillomavirus
FTAREHGITK

SEQ ID NO: 10973 - protein, 9 aa, Artificial Sequence
  Peptide Derived from Human Papillomavirus
GLTEQHHGR

SEQ ID NO: 10974 - protein, 8 aa, Artificial Sequence
  Peptide Derived from Human Papillomavirus
HASTSTPK

SEQ ID NO: 10975 - protein, 8 aa, Artificial Sequence
  Peptide Derived from Human Papillomavirus
HIQTPATK

SEQ ID NO: 10976 - protein, 9 aa, Artificial Sequence
  Peptide Derived from Human Papillomavirus
HIQTPATKR

SEQ ID NO: 10977 - protein, 11 aa, Artificial Sequence
  Peptide Derived from Human Papillomavirus
HIQTPATKRPR

SEQ ID NO: 10978 - protein, 10 aa, Artificial Sequence
  Peptide Derived from Human Papillomavirus
HLKGDKNSLK

SEQ ID NO: 10979 - protein, 8 aa, Artificial Sequence
  Peptide Derived from Human Papillomavirus
HVYFDGNK

SEQ ID NO: 10980 - protein, 8 aa, Artificial Sequence
  Peptide Derived from Human Papillomavirus
IIHLKGDK

SEQ ID NO: 10981 - protein, 10 aa, Artificial Sequence
  Peptide Derived from Human Papillomavirus
ILDHYENDSK

SEQ ID NO: 10982 - protein, 8 aa, Artificial Sequence
  Peptide Derived from Human Papillomavirus
ISKSKAHK

SEQ ID NO: 10983 - protein, 8 aa, Artificial Sequence
  Peptide Derived from Human Papillomavirus
ISYWQLIR

SEQ ID NO: 10984 - protein, 9 aa, Artificial Sequence
  Peptide Derived from Human Papillomavirus
ITETGIWDK

SEQ ID NO: 10985 - protein, 10 aa, Artificial Sequence
  Peptide Derived from Human Papillomavirus
KAIELQMALK

SEQ ID NO: 10986 - protein, 11 aa, Artificial Sequence
  Peptide Derived from Human Papillomavirus
KILDHYENDSK

SEQ ID NO: 10987 - protein, 9 aa, Artificial Sequence
  Peptide Derived from Human Papillomavirus
KTASVGTPK

SEQ ID NO: 10988 - protein, 11 aa, Artificial Sequence
  Peptide Derived from Human Papillomavirus
KTVHVYFDGNK

SEQ ID NO: 10989 - protein, 10 aa, Artificial Sequence
  Peptide Derived from Human Papillomavirus
LLCSSTSNNK

SEQ ID NO: 10990 - protein, 11 aa, Artificial Sequence
  Peptide Derived from Human Papillomavirus
LLCSSTSNNKR

SEQ ID NO: 10991 - protein, 11 aa, Artificial Sequence
  Peptide Derived from Human Papillomavirus
LSERLSALQDK

SEQ ID NO: 10992 - protein, 8 aa, Artificial Sequence
  Peptide Derived from Human Papillomavirus
LTEQHHGR

SEQ ID NO: 10993 - protein, 11 aa, Artificial Sequence
  Peptide Derived from Human Papillomavirus
LTVTYNSEVQR

SEQ ID NO: 10994 - protein, 10 aa, Artificial Sequence
  Peptide Derived from Human Papillomavirus
MALKGLAQSK

SEQ ID NO: 10995 - protein, 8 aa, Artificial Sequence
  Peptide Derived from Human Papillomavirus
NAILFTAR

SEQ ID NO: 10996 - protein, 9 aa, Artificial Sequence
  Peptide Derived from Human Papillomavirus
NISKSKAHK

SEQ ID NO: 10997 - protein, 9 aa, Artificial Sequence
  Peptide Derived from Human Papillomavirus
NSLKCLRYR

SEQ ID NO: 10998 - protein, 11 aa, Artificial Sequence
  Peptide Derived from Human Papillomavirus
NSLKCLRYRLR

SEQ ID NO: 10999 - protein, 11 aa, Artificial Sequence
  Peptide Derived from Human Papillomavirus
NSQISYWQLIR

SEQ ID NO: 11000 - protein, 9 aa, Artificial Sequence
  Peptide Derived from Human Papillomavirus
NTEPSQCFK

SEQ ID NO: 11001 - protein, 10 aa, Artificial Sequence
  Peptide Derived from Human Papillomavirus
NTEPSQCFKK

SEQ ID NO: 11002 - protein, 9 aa, Artificial Sequence
  Peptide Derived from Human Papillomavirus
NTTPIIHLK

SEQ ID NO: 11003 - protein, 9 aa, Artificial Sequence
  Peptide Derived from Human Papillomavirus
PIIHLKGDK

SEQ ID NO: 11004 - protein, 8 aa, Artificial Sequence
  Peptide Derived from Human Papillomavirus
PINISKSK

SEQ ID NO: 11005 - protein, 11 aa, Artificial Sequence
  Peptide Derived from Human Papillomavirus
PINISKSKAHK

SEQ ID NO: 11006 - protein, 11 aa, Artificial Sequence
  Peptide Derived from Human Papillomavirus
PLLCSSTSNNK

SEQ ID NO: 11007 - protein, 10 aa, Artificial Sequence
  Peptide Derived from Human Papillomavirus
PSQCFKKGGK

SEQ ID NO: 11008 - protein, 9 aa, Artificial Sequence
  Peptide Derived from Human Papillomavirus
QISYWQLIR

SEQ ID NO: 11009 - protein, 11 aa, Artificial Sequence
  Peptide Derived from Human Papillomavirus
QLQHASTSTPK

SEQ ID NO: 11010 - protein, 11 aa, Artificial Sequence
  Peptide Derived from Human Papillomavirus
QMALKGLAQSK

SEQ ID NO: 11011 - protein, 9 aa, Artificial Sequence
  Peptide Derived from Human Papillomavirus
QTPATKRPR

SEQ ID NO: 11012 - protein, 10 aa, Artificial Sequence
  Peptide Derived from Human Papillomavirus
QTPKESLSER

SEQ ID NO: 11013 - protein, 10 aa, Artificial Sequence
  Peptide Derived from Human Papillomavirus
QVVPPINISK

SEQ ID NO: 11014 - protein, 11 aa, Artificial Sequence
  Peptide Derived from Human Papillomavirus
RLENAILFTAR

SEQ ID NO: 11015 - protein, 8 aa, Artificial Sequence
  Peptide Derived from Human Papillomavirus
RLSALQDK

SEQ ID NO: 11016 - protein, 8 aa, Artificial Sequence
  Peptide Derived from Human Papillomavirus
SLKCLRYR

SEQ ID NO: 11017 - protein, 10 aa, Artificial Sequence
  Peptide Derived from Human Papillomavirus
SLKCLRYRLR

SEQ ID NO: 11018 - protein, 11 aa, Artificial Sequence
  Peptide Derived from Human Papillomavirus
SLKCLRYRLRK

SEQ ID NO: 11019 - protein, 8 aa, Artificial Sequence
  Peptide Derived from Human Papillomavirus
SSTSNNKR

SEQ ID NO: 11020 - protein, 9 aa, Artificial Sequence
  Peptide Derived from Human Papillomavirus
SSTSNNKRR

SEQ ID NO: 11021 - protein, 10 aa, Artificial Sequence
  Peptide Derived from Human Papillomavirus
SSTSNNKRRK

SEQ ID NO: 11022 - protein, 11 aa, Artificial Sequence
  Peptide Derived from Human Papillomavirus
SSTWHWTGCNK

SEQ ID NO: 11023 - protein, 8 aa, Artificial Sequence
  Peptide Derived from Human Papillomavirus
STSNNKRR

SEQ ID NO: 11024 - protein, 9 aa, Artificial Sequence
  Peptide Derived from Human Papillomavirus
STSNNKRRK

SEQ ID NO: 11025 - protein, 10 aa, Artificial Sequence
  Peptide Derived from Human Papillomavirus
STWHWTGCNK

SEQ ID NO: 11026 - protein, 9 aa, Artificial Sequence
  Peptide Derived from Human Papillomavirus
TAREHGITK

SEQ ID NO: 11027 - protein, 8 aa, Artificial Sequence
  Peptide Derived from Human Papillomavirus
TASVGTPK

SEQ ID NO: 11028 - protein, 8 aa, Artificial Sequence
  Peptide Derived from Human Papillomavirus
TSNNKRRK

SEQ ID NO: 11029 - protein, 8 aa, Artificial Sequence
  Peptide Derived from Human Papillomavirus
TTPIIHLK

SEQ ID NO: 11030 - protein, 11 aa, Artificial Sequence
  Peptide Derived from Human Papillomavirus
TTPIIHLKGDK

SEQ ID NO: 11031 - protein, 8 aa, Artificial Sequence
  Peptide Derived from Human Papillomavirus
TTYYVQFK

SEQ ID NO: 11032 - protein, 10 aa, Artificial Sequence
  Peptide Derived from Human Papillomavirus
TVHVYFDGNK

SEQ ID NO: 11033 - protein, 9 aa, Artificial Sequence
  Peptide Derived from Human Papillomavirus
TVSATQIVR

SEQ ID NO: 11034 - protein, 10 aa, Artificial Sequence
  Peptide Derived from Human Papillomavirus
TVTYNSEVQR

SEQ ID NO: 11035 - protein, 8 aa, Artificial Sequence
  Peptide Derived from Human Papillomavirus
VSATQIVR

SEQ ID NO: 11036 - protein, 10 aa, Artificial Sequence
  Peptide Derived from Human Papillomavirus
VSYWGVYYIK

SEQ ID NO: 11037 - protein, 9 aa, Artificial Sequence
  Peptide Derived from Human Papillomavirus
VTYNSEVQR

SEQ ID NO: 11038 - protein, 9 aa, Artificial Sequence
  Peptide Derived from Human Papillomavirus
VVPPINISK

SEQ ID NO: 11039 - protein, 11 aa, Artificial Sequence
  Peptide Derived from Human Papillomavirus
VVPPINISKSK

SEQ ID NO: 11040 - protein, 10 aa, Artificial Sequence
  Peptide Derived from Human Papillomavirus
YITETGIWDK

SEQ ID NO: 11041 - protein, 10 aa, Artificial Sequence
  Peptide Derived from Human Papillomavirus
YVQFKSECEK

SEQ ID NO: 11042 - protein, 9 aa, Artificial Sequence
  Peptide Derived from Human Papillomavirus
CIAYAACHK

SEQ ID NO: 11043 - protein, 9 aa, Artificial Sequence
  Peptide Derived from Human Papillomavirus
CIDFYSRIR

SEQ ID NO: 11044 - protein, 10 aa, Artificial Sequence
  Peptide Derived from Human Papillomavirus
CVYCKATLER

SEQ ID NO: 11045 - protein, 10 aa, Artificial Sequence
  Peptide Derived from Human Papillomavirus
DVSIACVYCK

SEQ ID NO: 11046 - protein, 8 aa, Artificial Sequence
  Peptide Derived from Human Papillomavirus
ELYNLLIR

SEQ ID NO: 11047 - protein, 11 aa, Artificial Sequence
  Peptide Derived from Human Papillomavirus
ELYNLLIRCLR

SEQ ID NO: 11048 - protein, 8 aa, Artificial Sequence
  Peptide Derived from Human Papillomavirus
EVYQFAFK

SEQ ID NO: 11049 - protein, 11 aa, Artificial Sequence
  Peptide Derived from Human Papillomavirus
FAFKDLFIVYR

SEQ ID NO: 11050 - protein, 8 aa, Artificial Sequence
  Peptide Derived from Human Papillomavirus
HSIAGQYR

SEQ ID NO: 11051 - protein, 8 aa, Artificial Sequence
  Peptide Derived from Human Papillomavirus
IAYAACHK

SEQ ID NO: 11052 - protein, 9 aa, Artificial Sequence
  Peptide Derived from Human Papillomavirus
LIRCLRCQK

SEQ ID NO: 11053 - protein, 10 aa, Artificial Sequence
  Peptide Derived from Human Papillomavirus
LLIRCLRCQK

SEQ ID NO: 11054 - protein, 10 aa, Artificial Sequence
  Peptide Derived from Human Papillomavirus
MARFDDPTQR

SEQ ID NO: 11055 - protein, 8 aa, Artificial Sequence
  Peptide Derived from Human Papillomavirus
NLLIRCLR

SEQ ID NO: 11056 - protein, 11 aa, Artificial Sequence
  Peptide Derived from Human Papillomavirus
NLLIRCLRCQK

SEQ ID NO: 11057 - protein, 10 aa, Artificial Sequence
  Peptide Derived from Human Papillomavirus
NSVYGETLEK

SEQ ID NO: 11058 - protein, 8 aa, Artificial Sequence
  Peptide Derived from Human Papillomavirus
NTCCDQAR

SEQ ID NO: 11059 - protein, 11 aa, Artificial Sequence
  Peptide Derived from Human Papillomavirus
NTCCDQARQER

SEQ ID NO: 11060 - protein, 10 aa, Artificial Sequence
  Peptide Derived from Human Papillomavirus
NTELYNLLIR

SEQ ID NO: 11061 - protein, 9 aa, Artificial Sequence
  Peptide Derived from Human Papillomavirus
PAEKRRHLK

SEQ ID NO: 11062 - protein, 11 aa, Artificial Sequence
  Peptide Derived from Human Papillomavirus
PAEKRRHLKDK

SEQ ID NO: 11063 - protein, 8 aa, Artificial Sequence
  Peptide Derived from Human Papillomavirus
PLNPAEKR

SEQ ID NO: 11064 - protein, 9 aa, Artificial Sequence
  Peptide Derived from Human Papillomavirus
PLNPAEKRR

SEQ ID NO: 11065 - protein, 8 aa, Artificial Sequence
  Peptide Derived from Human Papillomavirus
QARQERLR

SEQ ID NO: 11066 - protein, 9 aa, Artificial Sequence
  Peptide Derived from Human Papillomavirus
QARQERLRR

SEQ ID NO: 11067 - protein, 10 aa, Artificial Sequence
  Peptide Derived from Human Papillomavirus
QARQERLRRR

SEQ ID NO: 11068 - protein, 11 aa, Artificial Sequence
  Peptide Derived from Human Papillomavirus
QARQERLRRRR

SEQ ID NO: 11069 - protein, 10 aa, Artificial Sequence
  Peptide Derived from Human Papillomavirus
RTEVYQFAFK

SEQ ID NO: 11070 - protein, 8 aa, Artificial Sequence
  Peptide Derived from Human Papillomavirus
SIACVYCK

SEQ ID NO: 11071 - protein, 9 aa, Artificial Sequence
  Peptide Derived from Human Papillomavirus
SVYGETLEK

SEQ ID NO: 11072 - protein, 9 aa, Artificial Sequence
  Peptide Derived from Human Papillomavirus
VSIACVYCK

SEQ ID NO: 11073 - protein, 8 aa, Artificial Sequence
  Peptide Derived from Human Papillomavirus
YSRIRELR

SEQ ID NO: 11074 - protein, 9 aa, Artificial Sequence
  Peptide Derived from Human Papillomavirus
CVCCKCDGR

SEQ ID NO: 11075 - protein, 8 aa, Artificial Sequence
  Peptide Derived from Human Papillomavirus
ESSADDLR

SEQ ID NO: 11076 - protein, 10 aa, Artificial Sequence
  Peptide Derived from Human Papillomavirus
GVSHAQLPAR

SEQ ID NO: 11077 - protein, 11 aa, Artificial Sequence
  Peptide Derived from Human Papillomavirus
GVSHAQLPARR

SEQ ID NO: 11078 - protein, 8 aa, Artificial Sequence
  Peptide Derived from Human Papillomavirus
HAQLPARR

SEQ ID NO: 11079 - protein, 11 aa, Artificial Sequence
  Peptide Derived from Human Papillomavirus
ILCVCCKCDGR

SEQ ID NO: 11080 - protein, 8 aa, Artificial Sequence
  Peptide Derived from Human Papillomavirus
KILCVCCK

SEQ ID NO: 11081 - protein, 11 aa, Artificial Sequence
  Peptide Derived from Human Papillomavirus
LTVESSADDLR

SEQ ID NO: 11082 - protein, 9 aa, Artificial Sequence
  Peptide Derived from Human Papillomavirus
PARRAEPQR

SEQ ID NO: 11083 - protein, 11 aa, Artificial Sequence
  Peptide Derived from Human Papillomavirus
PARRAEPQRHK

SEQ ID NO: 11084 - protein, 11 aa, Artificial Sequence
  Peptide Derived from Human Papillomavirus
QLPARRAEPQR

SEQ ID NO: 11085 - protein, 8 aa, Artificial Sequence
  Peptide Derived from Human Papillomavirus
RAEPQRHK

SEQ ID NO: 11086 - protein, 10 aa, Artificial Sequence
  Peptide Derived from Human Papillomavirus
TVESSADDLR

SEQ ID NO: 11087 - protein, 9 aa, Artificial Sequence
  Peptide Derived from Human Papillomavirus
VSHAQLPAR

SEQ ID NO: 11088 - protein, 10 aa, Artificial Sequence
  Peptide Derived from Human Papillomavirus
VSHAQLPARR

SEQ ID NO: 11089 - protein, 9 aa, Artificial Sequence
  Peptide Derived from Human Papillomavirus
AASTSTASR

SEQ ID NO: 11090 - protein, 11 aa, Artificial Sequence
  Peptide Derived from Human Papillomavirus
AATAVITQDVR

SEQ ID NO: 11091 - protein, 8 aa, Artificial Sequence
  Peptide Derived from Human Papillomavirus
AIGEHWAK

SEQ ID NO: 11092 - protein, 11 aa, Artificial Sequence
  Peptide Derived from Human Papillomavirus
AMDFSTLQDTK

SEQ ID NO: 11093 - protein, 9 aa, Artificial Sequence
  Peptide Derived from Human Papillomavirus
ASRPAKRVR

SEQ ID NO: 11094 - protein, 11 aa, Artificial Sequence
  Peptide Derived from Human Papillomavirus
ASRPAKRVRIR

SEQ ID NO: 11095 - protein, 8 aa, Artificial Sequence
  Peptide Derived from Human Papillomavirus
ASTSTASR

SEQ ID NO: 11096 - protein, 11 aa, Artificial Sequence
  Peptide Derived from Human Papillomavirus
ASTSTASRPAK

SEQ ID NO: 11097 - protein, 10 aa, Artificial Sequence
  Peptide Derived from Human Papillomavirus
ATAVITQDVR

SEQ ID NO: 11098 - protein, 8 aa, Artificial Sequence
  Peptide Derived from Human Papillomavirus
AVITQDVR

SEQ ID NO: 11099 - protein, 11 aa, Artificial Sequence
  Peptide Derived from Human Papillomavirus
AVPKVSAYQYR

SEQ ID NO: 11100 - protein, 10 aa, Artificial Sequence
  Peptide Derived from Human Papillomavirus
CLRREQLFAR

SEQ ID NO: 11101 - protein, 8 aa, Artificial Sequence
  Peptide Derived from Human Papillomavirus
CVGMEIGR

SEQ ID NO: 11102 - protein, 11 aa, Artificial Sequence
  Peptide Derived from Human Papillomavirus
CVPAIGEHWAK

SEQ ID NO: 11103 - protein, 8 aa, Artificial Sequence
  Peptide Derived from Human Papillomavirus
DICQSICK

SEQ ID NO: 11104 - protein, 9 aa, Artificial Sequence
  Peptide Derived from Human Papillomavirus
DLDQYPLGR

SEQ ID NO: 11105 - protein, 10 aa, Artificial Sequence
  Peptide Derived from Human Papillomavirus
DLDQYPLGRK

SEQ ID NO: 11106 - protein, 8 aa, Artificial Sequence
  Peptide Derived from Human Papillomavirus
DSMFFCLR

SEQ ID NO: 11107 - protein, 9 aa, Artificial Sequence
  Peptide Derived from Human Papillomavirus
DSMFFCLRR

SEQ ID NO: 11108 - protein, 11 aa, Artificial Sequence
  Peptide Derived from Human Papillomavirus
DSTIYNPETQR

SEQ ID NO: 11109 - protein, 10 aa, Artificial Sequence
  Peptide Derived from Human Papillomavirus
DTVPTDLYIK

SEQ ID NO: 11110 - protein, 11 aa, Artificial Sequence
  Peptide Derived from Human Papillomavirus
DVRDNVSVDYK

SEQ ID NO: 11111 - protein, 8 aa, Artificial Sequence
  Peptide Derived from Human Papillomavirus
FARHFWNR

SEQ ID NO: 11112 - protein, 8 aa, Artificial Sequence
  Peptide Derived from Human Papillomavirus
FLQMALWR

SEQ ID NO: 11113 - protein, 8 aa, Artificial Sequence
  Peptide Derived from Human Papillomavirus
FLVQAGLR

SEQ ID NO: 11114 - protein, 9 aa, Artificial Sequence
  Peptide Derived from Human Papillomavirus
FLVQAGLRR

SEQ ID NO: 11115 - protein, 10 aa, Artificial Sequence
  Peptide Derived from Human Papillomavirus
FLVQAGLRRR

SEQ ID NO: 11116 - protein, 8 aa, Artificial Sequence
  Peptide Derived from Human Papillomavirus
FSTLQDTK

SEQ ID NO: 11117 - protein, 11 aa, Artificial Sequence
  Peptide Derived from Human Papillomavirus
FVQSVAVTCQK

SEQ ID NO: 11118 - protein, 9 aa, Artificial Sequence
  Peptide Derived from Human Papillomavirus
FVTVVDTTR

SEQ ID NO: 11119 - protein, 10 aa, Artificial Sequence
  Peptide Derived from Human Papillomavirus
GAGNKQAVPK

SEQ ID NO: 11120 - protein, 11 aa, Artificial Sequence
  Peptide Derived from Human Papillomavirus
GLRRRPTIGPR

SEQ ID NO: 11121 - protein, 10 aa, Artificial Sequence
  Peptide Derived from Human Papillomavirus
GLSGHPFYNK

SEQ ID NO: 11122 - protein, 11 aa, Artificial Sequence
  Peptide Derived from Human Papillomavirus
ITTSDSQLFNK

SEQ ID NO: 11123 - protein, 10 aa, Artificial Sequence
  Peptide Derived from Human Papillomavirus
KLKFWTVDLK

SEQ ID NO: 11124 - protein, 8 aa, Artificial Sequence
  Peptide Derived from Human Papillomavirus
KVSAYQYR

SEQ ID NO: 11125 - protein, 11 aa, Artificial Sequence
  Peptide Derived from Human Papillomavirus
KVSAYQYRVFR

SEQ ID NO: 11126 - protein, 10 aa, Artificial Sequence
  Peptide Derived from Human Papillomavirus
LLTVGNPYFR

SEQ ID NO: 11127 - protein, 9 aa, Artificial Sequence
  Peptide Derived from Human Papillomavirus
LSGHPFYNK

SEQ ID NO: 11128 - protein, 9 aa, Artificial Sequence
  Peptide Derived from Human Papillomavirus
LTVGNPYFR

SEQ ID NO: 11129 - protein, 8 aa, Artificial Sequence
  Peptide Derived from Human Papillomavirus
LVQAGLRR

SEQ ID NO: 11130 - protein, 9 aa, Artificial Sequence
  Peptide Derived from Human Papillomavirus
LVQAGLRRR

SEQ ID NO: 11131 - protein, 8 aa, Artificial Sequence
  Peptide Derived from Human Papillomavirus
NTDDYVSR

SEQ ID NO: 11132 - protein, 9 aa, Artificial Sequence
  Peptide Derived from Human Papillomavirus
NTYDPTKFK

SEQ ID NO: 11133 - protein, 10 aa, Artificial Sequence
  Peptide Derived from Human Papillomavirus
PAASTSTASR

SEQ ID NO: 11134 - protein, 9 aa, Artificial Sequence
  Peptide Derived from Human Papillomavirus
PAIGEHWAK

SEQ ID NO: 11135 - protein, 8 aa, Artificial Sequence
  Peptide Derived from Human Papillomavirus
PAKRVRIR

SEQ ID NO: 11136 - protein, 10 aa, Artificial Sequence
  Peptide Derived from Human Papillomavirus
PAKRVRIRSK

SEQ ID NO: 11137 - protein, 11 aa, Artificial Sequence
  Peptide Derived from Human Papillomavirus
PAKRVRIRSKK

SEQ ID NO: 11138 - protein, 10 aa, Artificial Sequence
  Peptide Derived from Human Papillomavirus
PIFLQMALWR

SEQ ID NO: 11139 - protein, 10 aa, Artificial Sequence
  Peptide Derived from Human Papillomavirus
PLDICQSICK

SEQ ID NO: 11140 - protein, 8 aa, Artificial Sequence
  Peptide Derived from Human Papillomavirus
PTIGPRKR

SEQ ID NO: 11141 - protein, 9 aa, Artificial Sequence
  Peptide Derived from Human Papillomavirus
PTKFKHYSR

SEQ ID NO: 11142 - protein, 10 aa, Artificial Sequence
  Peptide Derived from Human Papillomavirus
PTTSLVDTYR

SEQ ID NO: 11143 - protein, 10 aa, Artificial Sequence
  Peptide Derived from Human Papillomavirus
PVPNTYDPTK

SEQ ID NO: 11144 - protein, 10 aa, Artificial Sequence
  Peptide Derived from Human Papillomavirus
QLFARHFWNR

SEQ ID NO: 11145 - protein, 11 aa, Artificial Sequence
  Peptide Derived from Human Papillomavirus
QLFNKPYWLHK

SEQ ID NO: 11146 - protein, 11 aa, Artificial Sequence
  Peptide Derived from Human Papillomavirus
QLFVTVVDTTR

SEQ ID NO: 11147 - protein, 9 aa, Artificial Sequence
  Peptide Derived from Human Papillomavirus
QSVAVTCQK

SEQ ID NO: 11148 - protein, 11 aa, Artificial Sequence
  Peptide Derived from Human Papillomavirus
RLLTVGNPYFR

SEQ ID NO: 11149 - protein, 9 aa, Artificial Sequence
  Peptide Derived from Human Papillomavirus
RVALPDPNK

SEQ ID NO: 11150 - protein, 8 aa, Artificial Sequence
  Peptide Derived from Human Papillomavirus
RVRIRSKK

SEQ ID NO: 11151 - protein, 11 aa, Artificial Sequence
  Peptide Derived from Human Papillomavirus
RVVNTDDYVSR

SEQ ID NO: 11152 - protein, 10 aa, Artificial Sequence
  Peptide Derived from Human Papillomavirus
RVVPSGAGNK

SEQ ID NO: 11153 - protein, 9 aa, Artificial Sequence
  Peptide Derived from Human Papillomavirus
SAYQYRVFR

SEQ ID NO: 11154 - protein, 10 aa, Artificial Sequence
  Peptide Derived from Human Papillomavirus
SIFYHAGSSR

SEQ ID NO: 11155 - protein, 8 aa, Artificial Sequence
  Peptide Derived from Human Papillomavirus
SMFFCLRR

SEQ ID NO: 11156 - protein, 11 aa, Artificial Sequence
  Peptide Derived from Human Papillomavirus
SSDLDQYPLGR

SEQ ID NO: 11157 - protein, 8 aa, Artificial Sequence
  Peptide Derived from Human Papillomavirus
STASRPAK

SEQ ID NO: 11158 - protein, 9 aa, Artificial Sequence
  Peptide Derived from Human Papillomavirus
STASRPAKR

SEQ ID NO: 11159 - protein, 11 aa, Artificial Sequence
  Peptide Derived from Human Papillomavirus
STASRPAKRVR

SEQ ID NO: 11160 - protein, 10 aa, Artificial Sequence
  Peptide Derived from Human Papillomavirus
STIYNPETQR

SEQ ID NO: 11161 - protein, 10 aa, Artificial Sequence
  Peptide Derived from Human Papillomavirus
STSTASRPAK

SEQ ID NO: 11162 - protein, 11 aa, Artificial Sequence
  Peptide Derived from Human Papillomavirus
STSTASRPAKR

SEQ ID NO: 11163 - protein, 8 aa, Artificial Sequence
  Peptide Derived from Human Papillomavirus
SVAVTCQK

SEQ ID NO: 11164 - protein, 8 aa, Artificial Sequence
  Peptide Derived from Human Papillomavirus
TASRPAKR

SEQ ID NO: 11165 - protein, 10 aa, Artificial Sequence
  Peptide Derived from Human Papillomavirus
TASRPAKRVR

SEQ ID NO: 11166 - protein, 9 aa, Artificial Sequence
  Peptide Derived from Human Papillomavirus
TAVITQDVR

SEQ ID NO: 11167 - protein, 9 aa, Artificial Sequence
  Peptide Derived from Human Papillomavirus
TIYNPETQR

SEQ ID NO: 11168 - protein, 9 aa, Artificial Sequence
  Peptide Derived from Human Papillomavirus
TSDSQLFNK

SEQ ID NO: 11169 - protein, 11 aa, Artificial Sequence
  Peptide Derived from Human Papillomavirus
TSIFYHAGSSR

SEQ ID NO: 11170 - protein, 8 aa, Artificial Sequence
  Peptide Derived from Human Papillomavirus
TSLVDTYR

SEQ ID NO: 11171 - protein, 9 aa, Artificial Sequence
  Peptide Derived from Human Papillomavirus
TSTASRPAK

SEQ ID NO: 11172 - protein, 10 aa, Artificial Sequence
  Peptide Derived from Human Papillomavirus
TSTASRPAKR

SEQ ID NO: 11173 - protein, 10 aa, Artificial Sequence
  Peptide Derived from Human Papillomavirus
TTSDSQLFNK

SEQ ID NO: 11174 - protein, 9 aa, Artificial Sequence
  Peptide Derived from Human Papillomavirus
TTSLVDTYR

SEQ ID NO: 11175 - protein, 8 aa, Artificial Sequence
  Peptide Derived from Human Papillomavirus
TVGNPYFR

SEQ ID NO: 11176 - protein, 9 aa, Artificial Sequence
  Peptide Derived from Human Papillomavirus
TVPTDLYIK

SEQ ID NO: 11177 - protein, 11 aa, Artificial Sequence
  Peptide Derived from Human Papillomavirus
TVYLPPPSVAR

SEQ ID NO: 11178 - protein, 8 aa, Artificial Sequence
  Peptide Derived from Human Papillomavirus
VALPDPNK

SEQ ID NO: 11179 - protein, 10 aa, Artificial Sequence
  Peptide Derived from Human Papillomavirus
VSAYQYRVFR

SEQ ID NO: 11180 - protein, 8 aa, Artificial Sequence
  Peptide Derived from Human Papillomavirus
VTVVDTTR

SEQ ID NO: 11181 - protein, 10 aa, Artificial Sequence
  Peptide Derived from Human Papillomavirus
VVNTDDYVSR

SEQ ID NO: 11182 - protein, 9 aa, Artificial Sequence
  Peptide Derived from Human Papillomavirus
VVPSGAGNK

SEQ ID NO: 11183 - protein, 10 aa, Artificial Sequence
  Peptide Derived from Human Papillomavirus
WACVGMEIGR

SEQ ID NO: 11184 - protein, 8 aa, Artificial Sequence
  Peptide Derived from Human Papillomavirus
WAKGTLCK

SEQ ID NO: 11185 - protein, 8 aa, Artificial Sequence
  Peptide Derived from Human Papillomavirus
WTVDLKEK

SEQ ID NO: 11186 - protein, 10 aa, Artificial Sequence
  Peptide Derived from Human Papillomavirus
YIKGTSANMR

SEQ ID NO: 11187 - protein, 9 aa, Artificial Sequence
  Peptide Derived from Human Papillomavirus
YLPPPSVAR

SEQ ID NO: 11188 - protein, 10 aa, Artificial Sequence
  Peptide Derived from Human Papillomavirus
ALSSRRGTVR

SEQ ID NO: 11189 - protein, 8 aa, Artificial Sequence
  Peptide Derived from Human Papillomavirus
ASATDLYR

SEQ ID NO: 11190 - protein, 11 aa, Artificial Sequence
  Peptide Derived from Human Papillomavirus
ASATDLYRTCK

SEQ ID NO: 11191 - protein, 10 aa, Artificial Sequence
  Peptide Derived from Human Papillomavirus
ASTTPSTIHK

SEQ ID NO: 11192 - protein, 9 aa, Artificial Sequence
  Peptide Derived from Human Papillomavirus
ATDLYRTCK

SEQ ID NO: 11193 - protein, 9 aa, Artificial Sequence
  Peptide Derived from Human Papillomavirus
ATMFTRSGK

SEQ ID NO: 11194 - protein, 9 aa, Artificial Sequence
  Peptide Derived from Human Papillomavirus
DSDFMDIIR

SEQ ID NO: 11195 - protein, 9 aa, Artificial Sequence
  Peptide Derived from Human Papillomavirus
FMDIIRLHR

SEQ ID NO: 11196 - protein, 11 aa, Artificial Sequence
  Peptide Derived from Human Papillomavirus
FTRSGKQIGGR

SEQ ID NO: 11197 - protein, 11 aa, Artificial Sequence
  Peptide Derived from Human Papillomavirus
GIGTGSGSGGR

SEQ ID NO: 11198 - protein, 10 aa, Artificial Sequence
  Peptide Derived from Human Papillomavirus
GTCPPDVINK

SEQ ID NO: 11199 - protein, 9 aa, Artificial Sequence
  Peptide Derived from Human Papillomavirus
GTGSGSGGR

SEQ ID NO: 11200 - protein, 11 aa, Artificial Sequence
  Peptide Derived from Human Papillomavirus
GTVRFSRLGQR

SEQ ID NO: 11201 - protein, 10 aa, Artificial Sequence
  Peptide Derived from Human Papillomavirus
ISSTPLPTVR

SEQ ID NO: 11202 - protein, 11 aa, Artificial Sequence
  Peptide Derived from Human Papillomavirus
ISSTPLPTVRR

SEQ ID NO: 11203 - protein, 10 aa, Artificial Sequence
  Peptide Derived from Human Papillomavirus
KVEGTTLADK

SEQ ID NO: 11204 - protein, 9 aa, Artificial Sequence
  Peptide Derived from Human Papillomavirus
LSSRRGTVR

SEQ ID NO: 11205 - protein, 8 aa, Artificial Sequence
  Peptide Derived from Human Papillomavirus
MVSHRAAR

SEQ ID NO: 11206 - protein, 9 aa, Artificial Sequence
  Peptide Derived from Human Papillomavirus
MVSHRAARR

SEQ ID NO: 11207 - protein, 10 aa, Artificial Sequence
  Peptide Derived from Human Papillomavirus
MVSHRAARRK

SEQ ID NO: 11208 - protein, 11 aa, Artificial Sequence
  Peptide Derived from Human Papillomavirus
MVSHRAARRKR

SEQ ID NO: 11209 - protein, 10 aa, Artificial Sequence
  Peptide Derived from Human Papillomavirus
NTVVDVGPTR

SEQ ID NO: 11210 - protein, 11 aa, Artificial Sequence
  Peptide Derived from Human Papillomavirus
PALSSRRGTVR

SEQ ID NO: 11211 - protein, 11 aa, Artificial Sequence
  Peptide Derived from Human Papillomavirus
PASTTPSTIHK

SEQ ID NO: 11212 - protein, 11 aa, Artificial Sequence
  Peptide Derived from Human Papillomavirus
PISSTPLPTVR

SEQ ID NO: 11213 - protein, 9 aa, Artificial Sequence
  Peptide Derived from Human Papillomavirus
PLPTVRRVR

SEQ ID NO: 11214 - protein, 10 aa, Artificial Sequence
  Peptide Derived from Human Papillomavirus
PTVRRVRGPR

SEQ ID NO: 11215 - protein, 9 aa, Artificial Sequence
  Peptide Derived from Human Papillomavirus
RASATDLYR

SEQ ID NO: 11216 - protein, 10 aa, Artificial Sequence
  Peptide Derived from Human Papillomavirus
RATMFTRSGK

SEQ ID NO: 11217 - protein, 11 aa, Artificial Sequence
  Peptide Derived from Human Papillomavirus
RLGQRATMFTR

SEQ ID NO: 11218 - protein, 10 aa, Artificial Sequence
  Peptide Derived from Human Papillomavirus
RLHRPALSSR

SEQ ID NO: 11219 - protein, 11 aa, Artificial Sequence
  Peptide Derived from Human Papillomavirus
RLHRPALSSRR

SEQ ID NO: 11220 - protein, 11 aa, Artificial Sequence
  Peptide Derived from Human Papillomavirus
RLYSRANQQVR

SEQ ID NO: 11221 - protein, 9 aa, Artificial Sequence
  Peptide Derived from Human Papillomavirus
RSGKQIGGR

SEQ ID NO: 11222 - protein, 10 aa, Artificial Sequence
  Peptide Derived from Human Papillomavirus
RTGYVPLGGR

SEQ ID NO: 11223 - protein, 10 aa, Artificial Sequence
  Peptide Derived from Human Papillomavirus
RVRGPRLYSR

SEQ ID NO: 11224 - protein, 10 aa, Artificial Sequence
  Peptide Derived from Human Papillomavirus
SATDLYRTCK

SEQ ID NO: 11225 - protein, 8 aa, Artificial Sequence
  Peptide Derived from Human Papillomavirus
SSRRGTVR

SEQ ID NO: 11226 - protein, 11 aa, Artificial Sequence
  Peptide Derived from Human Papillomavirus
SSRRGTVRFSR

SEQ ID NO: 11227 - protein, 9 aa, Artificial Sequence
  Peptide Derived from Human Papillomavirus
SSTPLPTVR

SEQ ID NO: 11228 - protein, 10 aa, Artificial Sequence
  Peptide Derived from Human Papillomavirus
SSTPLPTVRR

SEQ ID NO: 11229 - protein, 11 aa, Artificial Sequence
  Peptide Derived from Human Papillomavirus
STIHKSFTYPK

SEQ ID NO: 11230 - protein, 8 aa, Artificial Sequence
  Peptide Derived from Human Papillomavirus
STPLPTVR

SEQ ID NO: 11231 - protein, 9 aa, Artificial Sequence
  Peptide Derived from Human Papillomavirus
STPLPTVRR

SEQ ID NO: 11232 - protein, 11 aa, Artificial Sequence
  Peptide Derived from Human Papillomavirus
STPLPTVRRVR

SEQ ID NO: 11233 - protein, 9 aa, Artificial Sequence
  Peptide Derived from Human Papillomavirus
STTPSTIHK

SEQ ID NO: 11234 - protein, 10 aa, Artificial Sequence
  Peptide Derived from Human Papillomavirus
TIHKSFTYPK

SEQ ID NO: 11235 - protein, 8 aa, Artificial Sequence
  Peptide Derived from Human Papillomavirus
TMFTRSGK

SEQ ID NO: 11236 - protein, 8 aa, Artificial Sequence
  Peptide Derived from Human Papillomavirus
TTPSTIHK

SEQ ID NO: 11237 - protein, 10 aa, Artificial Sequence
  Peptide Derived from Human Papillomavirus
TVRFSRLGQR

SEQ ID NO: 11238 - protein, 9 aa, Artificial Sequence
  Peptide Derived from Human Papillomavirus
TVRRVRGPR

SEQ ID NO: 11239 - protein, 9 aa, Artificial Sequence
  Peptide Derived from Human Papillomavirus
TVVDVGPTR

SEQ ID NO: 11240 - protein, 8 aa, Artificial Sequence
  Peptide Derived from Human Papillomavirus
VSHRAARR

SEQ ID NO: 11241 - protein, 9 aa, Artificial Sequence
  Peptide Derived from Human Papillomavirus
VSHRAARRK

SEQ ID NO: 11242 - protein, 10 aa, Artificial Sequence
  Peptide Derived from Human Papillomavirus
VSHRAARRKR

SEQ ID NO: 11243 - protein, 8 aa, Artificial Sequence
  Peptide Derived from Human Papillomavirus
VVDVGPTR

SEQ ID NO: 11244 - protein, 11 aa, Artificial Sequence
  Peptide Derived from Human Papillomavirus
YLWPWYYYFPK

SEQ ID NO: 11245 - protein, 9 aa, Artificial Sequence
  Peptide Derived from Human Papillomavirus
YSRANQQVR

SEQ ID NO: 11246 - protein, 9 aa, Artificial Sequence
  Peptide Derived from Human Papillomavirus
AAVSHRPGK

SEQ ID NO: 11247 - protein, 10 aa, Artificial Sequence
  Peptide Derived from Human Papillomavirus
AAVSHRPGKR

SEQ ID NO: 11248 - protein, 8 aa, Artificial Sequence
  Peptide Derived from Human Papillomavirus
AVSHRPGK

SEQ ID NO: 11249 - protein, 9 aa, Artificial Sequence
  Peptide Derived from Human Papillomavirus
AVSHRPGKR

SEQ ID NO: 11250 - protein, 11 aa, Artificial Sequence
  Peptide Derived from Human Papillomavirus
AVSHRPGKRPR

SEQ ID NO: 11251 - protein, 8 aa, Artificial Sequence
  Peptide Derived from Human Papillomavirus
CLQVCKAK

SEQ ID NO: 11252 - protein, 8 aa, Artificial Sequence
  Peptide Derived from Human Papillomavirus
CMQYVAWK

SEQ ID NO: 11253 - protein, 10 aa, Artificial Sequence
  Peptide Derived from Human Papillomavirus
DAAVSHRPGK

SEQ ID NO: 11254 - protein, 11 aa, Artificial Sequence
  Peptide Derived from Human Papillomavirus
DAAVSHRPGKR

SEQ ID NO: 11255 - protein, 9 aa, Artificial Sequence
  Peptide Derived from Human Papillomavirus
DSSRESHAK

SEQ ID NO: 11256 - protein, 8 aa, Artificial Sequence
  Peptide Derived from Human Papillomavirus
DSVSSTCR

SEQ ID NO: 11257 - protein, 8 aa, Artificial Sequence
  Peptide Derived from Human Papillomavirus
DTDNTDSR

SEQ ID NO: 11258 - protein, 10 aa, Artificial Sequence
  Peptide Derived from Human Papillomavirus
DTDNTDSRSR

SEQ ID NO: 11259 - protein, 8 aa, Artificial Sequence
  Peptide Derived from Human Papillomavirus
EAKKFGCK

SEQ ID NO: 11260 - protein, 8 aa, Artificial Sequence
  Peptide Derived from Human Papillomavirus
ELWLTEPK

SEQ ID NO: 11261 - protein, 9 aa, Artificial Sequence
  Peptide Derived from Human Papillomavirus
ELWLTEPKK

SEQ ID NO: 11262 - protein, 8 aa, Artificial Sequence
  Peptide Derived from Human Papillomavirus
ESEFDSSR

SEQ ID NO: 11263 - protein, 10 aa, Artificial Sequence
  Peptide Derived from Human Papillomavirus
ETVNEYNTHK

SEQ ID NO: 11264 - protein, 8 aa, Artificial Sequence
  Peptide Derived from Human Papillomavirus
EVWFDGSK

SEQ ID NO: 11265 - protein, 10 aa, Artificial Sequence
  Peptide Derived from Human Papillomavirus
GIYYVHDGHK

SEQ ID NO: 11266 - protein, 10 aa, Artificial Sequence
  Peptide Derived from Human Papillomavirus
HIEVWFDGSK

SEQ ID NO: 11267 - protein, 11 aa, Artificial Sequence
  Peptide Derived from Human Papillomavirus
HISDTDNTDSR

SEQ ID NO: 11268 - protein, 8 aa, Artificial Sequence
  Peptide Derived from Human Papillomavirus
HLKGEPNR

SEQ ID NO: 11269 - protein, 10 aa, Artificial Sequence
  Peptide Derived from Human Papillomavirus
HLKGEPNRLK

SEQ ID NO: 11270 - protein, 9 aa, Artificial Sequence
  Peptide Derived from Human Papillomavirus
HVKIPVVYR

SEQ ID NO: 11271 - protein, 9 aa, Artificial Sequence
  Peptide Derived from Human Papillomavirus
IIYKDETQR

SEQ ID NO: 11272 - protein, 10 aa, Artificial Sequence
  Peptide Derived from Human Papillomavirus
ISDTDNTDSR

SEQ ID NO: 11273 - protein, 11 aa, Artificial Sequence
  Peptide Derived from Human Papillomavirus
ITIIYKDETQR

SEQ ID NO: 11274 - protein, 9 aa, Artificial Sequence
  Peptide Derived from Human Papillomavirus
KTTPVVHLK

SEQ ID NO: 11275 - protein, 9 aa, Artificial Sequence
  Peptide Derived from Human Papillomavirus
KVCSGVDYR

SEQ ID NO: 11276 - protein, 11 aa, Artificial Sequence
  Peptide Derived from Human Papillomavirus
LSHVKIPVVYR

SEQ ID NO: 11277 - protein, 9 aa, Artificial Sequence
  Peptide Derived from Human Papillomavirus
LTEPKKCFK

SEQ ID NO: 11278 - protein, 10 aa, Artificial Sequence
  Peptide Derived from Human Papillomavirus
LTEPKKCFKK

SEQ ID NO: 11279 - protein, 9 aa, Artificial Sequence
  Peptide Derived from Human Papillomavirus
MVPCLQVCK

SEQ ID NO: 11280 - protein, 11 aa, Artificial Sequence
  Peptide Derived from Human Papillomavirus
MVPCLQVCKAK

SEQ ID NO: 11281 - protein, 8 aa, Artificial Sequence
  Peptide Derived from Human Papillomavirus
NSFLSHVK

SEQ ID NO: 11282 - protein, 11 aa, Artificial Sequence
  Peptide Derived from Human Papillomavirus
PVVHLKGEPNR

SEQ ID NO: 11283 - protein, 10 aa, Artificial Sequence
  Peptide Derived from Human Papillomavirus
PVVYRLVWDK

SEQ ID NO: 11284 - protein, 8 aa, Artificial Sequence
  Peptide Derived from Human Papillomavirus
RLKCCRYR

SEQ ID NO: 11285 - protein, 11 aa, Artificial Sequence
  Peptide Derived from Human Papillomavirus
RLKCCRYRFQK

SEQ ID NO: 11286 - protein, 11 aa, Artificial Sequence
  Peptide Derived from Human Papillomavirus
RLRESEFDSSR

SEQ ID NO: 11287 - protein, 8 aa, Artificial Sequence
  Peptide Derived from Human Papillomavirus
SIITIIYK

SEQ ID NO: 11288 - protein, 11 aa, Artificial Sequence
  Peptide Derived from Human Papillomavirus
SINNNNHPGDK

SEQ ID NO: 11289 - protein, 8 aa, Artificial Sequence
  Peptide Derived from Human Papillomavirus
SSRESHAK

SEQ ID NO: 11290 - protein, 11 aa, Artificial Sequence
  Peptide Derived from Human Papillomavirus
STYHWTSTDNK

SEQ ID NO: 11291 - protein, 10 aa, Artificial Sequence
  Peptide Derived from Human Papillomavirus
TIIYKDETQR

SEQ ID NO: 11292 - protein, 11 aa, Artificial Sequence
  Peptide Derived from Human Papillomavirus
TIYNNEEWTLR

SEQ ID NO: 11293 - protein, 8 aa, Artificial Sequence
  Peptide Derived from Human Papillomavirus
TTPVVHLK

SEQ ID NO: 11294 - protein, 9 aa, Artificial Sequence
  Peptide Derived from Human Papillomavirus
TVNEYNTHK

SEQ ID NO: 11295 - protein, 8 aa, Artificial Sequence
  Peptide Derived from Human Papillomavirus
VSHRPGKR

SEQ ID NO: 11296 - protein, 10 aa, Artificial Sequence
  Peptide Derived from Human Papillomavirus
VSHRPGKRPR

SEQ ID NO: 11297 - protein, 10 aa, Artificial Sequence
  Peptide Derived from Human Papillomavirus
VVHLKGEPNR

SEQ ID NO: 11298 - protein, 9 aa, Artificial Sequence
  Peptide Derived from Human Papillomavirus
VVYRLVWDK

SEQ ID NO: 11299 - protein, 10 aa, Artificial Sequence
  Peptide Derived from Human Papillomavirus
WLTEPKKCFK

SEQ ID NO: 11300 - protein, 11 aa, Artificial Sequence
  Peptide Derived from Human Papillomavirus
WLTEPKKCFKK

SEQ ID NO: 11301 - protein, 9 aa, Artificial Sequence
  Peptide Derived from Human Papillomavirus
YSIITIIYK

SEQ ID NO: 11302 - protein, 9 aa, Artificial Sequence
  Peptide Derived from Human Papillomavirus
YTDFEQEAK

SEQ ID NO: 11303 - protein, 10 aa, Artificial Sequence
  Peptide Derived from Human Papillomavirus
YTDFEQEAKK

SEQ ID NO: 11304 - protein, 8 aa, Artificial Sequence
  Peptide Derived from Human Papillomavirus
ATLESITK

SEQ ID NO: 11305 - protein, 9 aa, Artificial Sequence
  Peptide Derived from Human Papillomavirus
ATLESITKK

SEQ ID NO: 11306 - protein, 10 aa, Artificial Sequence
  Peptide Derived from Human Papillomavirus
CLGCWRQTSR

SEQ ID NO: 11307 - protein, 9 aa, Artificial Sequence
  Peptide Derived from Human Papillomavirus
CLLFYSKVR

SEQ ID NO: 11308 - protein, 10 aa, Artificial Sequence
  Peptide Derived from Human Papillomavirus
CLLFYSKVRK

SEQ ID NO: 11309 - protein, 9 aa, Artificial Sequence
  Peptide Derived from Human Papillomavirus
CTELKLVYR

SEQ ID NO: 11310 - protein, 10 aa, Artificial Sequence
  Peptide Derived from Human Papillomavirus
CVYCKKELTR

SEQ ID NO: 11311 - protein, 8 aa, Artificial Sequence
  Peptide Derived from Human Papillomavirus
DLLIRCYR

SEQ ID NO: 11312 - protein, 10 aa, Artificial Sequence
  Peptide Derived from Human Papillomavirus
DLRLSCVYCK

SEQ ID NO: 11313 - protein, 11 aa, Artificial Sequence
  Peptide Derived from Human Papillomavirus
DLRLSCVYCKK

SEQ ID NO: 11314 - protein, 8 aa, Artificial Sequence
  Peptide Derived from Human Papillomavirus
EIPLIDLR

SEQ ID NO: 11315 - protein, 11 aa, Artificial Sequence
  Peptide Derived from Human Papillomavirus
EVLEIPLIDLR

SEQ ID NO: 11316 - protein, 11 aa, Artificial Sequence
  Peptide Derived from Human Papillomavirus
EVYNFACTELK

SEQ ID NO: 11317 - protein, 11 aa, Artificial Sequence
  Peptide Derived from Human Papillomavirus
FACTELKLVYR

SEQ ID NO: 11318 - protein, 9 aa, Artificial Sequence
  Peptide Derived from Human Papillomavirus
GATLESITK

SEQ ID NO: 11319 - protein, 10 aa, Artificial Sequence
  Peptide Derived from Human Papillomavirus
GATLESITKK

SEQ ID NO: 11320 - protein, 8 aa, Artificial Sequence
  Peptide Derived from Human Papillomavirus
GSCLGCWR

SEQ ID NO: 11321 - protein, 8 aa, Artificial Sequence
  Peptide Derived from Human Papillomavirus
LLFYSKVR

SEQ ID NO: 11322 - protein, 9 aa, Artificial Sequence
  Peptide Derived from Human Papillomavirus
LLFYSKVRK

SEQ ID NO: 11323 - protein, 11 aa, Artificial Sequence
  Peptide Derived from Human Papillomavirus
LLFYSKVRKYR

SEQ ID NO: 11324 - protein, 8 aa, Artificial Sequence
  Peptide Derived from Human Papillomavirus
LSCVYCKK

SEQ ID NO: 11325 - protein, 8 aa, Artificial Sequence
  Peptide Derived from Human Papillomavirus
QLCDLLIR

SEQ ID NO: 11326 - protein, 11 aa, Artificial Sequence
  Peptide Derived from Human Papillomavirus
QLCDLLIRCYR

SEQ ID NO: 11327 - protein, 8 aa, Artificial Sequence
  Peptide Derived from Human Papillomavirus
QLHCDRKR

SEQ ID NO: 11328 - protein, 9 aa, Artificial Sequence
  Peptide Derived from Human Papillomavirus
QLHCDRKRR

SEQ ID NO: 11329 - protein, 9 aa, Artificial Sequence
  Peptide Derived from Human Papillomavirus
QSPLTPEEK

SEQ ID NO: 11330 - protein, 8 aa, Artificial Sequence
  Peptide Derived from Human Papillomavirus
RLSCVYCK

SEQ ID NO: 11331 - protein, 9 aa, Artificial Sequence
  Peptide Derived from Human Papillomavirus
RLSCVYCKK

SEQ ID NO: 11332 - protein, 9 aa, Artificial Sequence
  Peptide Derived from Human Papillomavirus
RVCLLFYSK

SEQ ID NO: 11333 - protein, 11 aa, Artificial Sequence
  Peptide Derived from Human Papillomavirus
RVCLLFYSKVR

SEQ ID NO: 11334 - protein, 8 aa, Artificial Sequence
  Peptide Derived from Human Papillomavirus
TLESITKK

SEQ ID NO: 11335 - protein, 10 aa, Artificial Sequence
  Peptide Derived from Human Papillomavirus
VLEIPLIDLR

SEQ ID NO: 11336 - protein, 10 aa, Artificial Sequence
  Peptide Derived from Human Papillomavirus
WTGSCLGCWR

SEQ ID NO: 11337 - protein, 8 aa, Artificial Sequence
  Peptide Derived from Human Papillomavirus
YSKVRKYR

SEQ ID NO: 11338 - protein, 10 aa, Artificial Sequence
  Peptide Derived from Human Papillomavirus
DIQSTKEDLR

SEQ ID NO: 11339 - protein, 8 aa, Artificial Sequence
  Peptide Derived from Human Papillomavirus
EVDHLQER

SEQ ID NO: 11340 - protein, 11 aa, Artificial Sequence
  Peptide Derived from Human Papillomavirus
FVVQLDIQSTK

SEQ ID NO: 11341 - protein, 10 aa, Artificial Sequence
  Peptide Derived from Human Papillomavirus
HLQERPQQAR

SEQ ID NO: 11342 - protein, 8 aa, Artificial Sequence
  Peptide Derived from Human Papillomavirus
HVPCCECK

SEQ ID NO: 11343 - protein, 10 aa, Artificial Sequence
  Peptide Derived from Human Papillomavirus
LIHVPCCECK

SEQ ID NO: 11344 - protein, 8 aa, Artificial Sequence
  Peptide Derived from Human Papillomavirus
QLDIQSTK

SEQ ID NO: 11345 - protein, 8 aa, Artificial Sequence
  Peptide Derived from Human Papillomavirus
QSTKEDLR

SEQ ID NO: 11346 - protein, 10 aa, Artificial Sequence
  Peptide Derived from Human Papillomavirus
VVQLDIQSTK

SEQ ID NO: 11347 - protein, 11 aa, Artificial Sequence
  Peptide Derived from Human Papillomavirus
YLIHVPCCECK

SEQ ID NO: 11348 - protein, 11 aa, Artificial Sequence
  Peptide Derived from Human Papillomavirus
AMDFKVLQESK

SEQ ID NO: 11349 - protein, 8 aa, Artificial Sequence
  Peptide Derived from Human Papillomavirus
AMGEHWTK

SEQ ID NO: 11350 - protein, 8 aa, Artificial Sequence
  Peptide Derived from Human Papillomavirus
ATDSYVKR

SEQ ID NO: 11351 - protein, 11 aa, Artificial Sequence
  Peptide Derived from Human Papillomavirus
ATEQLSKYDAR

SEQ ID NO: 11352 - protein, 9 aa, Artificial Sequence
  Peptide Derived from Human Papillomavirus
ATSLEDKYR

SEQ ID NO: 11353 - protein, 9 aa, Artificial Sequence
  Peptide Derived from Human Papillomavirus
ATWRPSENK

SEQ ID NO: 11354 - protein, 8 aa, Artificial Sequence
  Peptide Derived from Human Papillomavirus
AVATSKKR

SEQ ID NO: 11355 - protein, 11 aa, Artificial Sequence
  Peptide Derived from Human Papillomavirus
AVGHPYYSVTK

SEQ ID NO: 11356 - protein, 11 aa, Artificial Sequence
  Peptide Derived from Human Papillomavirus
CTPAMGEHWTK

SEQ ID NO: 11357 - protein, 8 aa, Artificial Sequence
  Peptide Derived from Human Papillomavirus
CVGLEVGR

SEQ ID NO: 11358 - protein, 10 aa, Artificial Sequence
  Peptide Derived from Human Papillomavirus
DARKINQYLR

SEQ ID NO: 11359 - protein, 8 aa, Artificial Sequence
  Peptide Derived from Human Papillomavirus
DIVQSTCK

SEQ ID NO: 11360 - protein, 9 aa, Artificial Sequence
  Peptide Derived from Human Papillomavirus
DLDQFPLGR

SEQ ID NO: 11361 - protein, 10 aa, Artificial Sequence
  Peptide Derived from Human Papillomavirus
DLDQFPLGRK

SEQ ID NO: 11362 - protein, 8 aa, Artificial Sequence
  Peptide Derived from Human Papillomavirus
DSMWFYLR

SEQ ID NO: 11363 - protein, 9 aa, Artificial Sequence
  Peptide Derived from Human Papillomavirus
DSMWFYLRR

SEQ ID NO: 11364 - protein, 11 aa, Artificial Sequence
  Peptide Derived from Human Papillomavirus
DSRDNISVDGK

SEQ ID NO: 11365 - protein, 10 aa, Artificial Sequence
  Peptide Derived from Human Papillomavirus
DTGFGAMDFK

SEQ ID NO: 11366 - protein, 11 aa, Artificial Sequence
  Peptide Derived from Human Papillomavirus
DTNIYNPDQER

SEQ ID NO: 11367 - protein, 10 aa, Artificial Sequence
  Peptide Derived from Human Papillomavirus
ELQFVFQLCK

SEQ ID NO: 11368 - protein, 10 aa, Artificial Sequence
  Peptide Derived from Human Papillomavirus
ELYLKGSNGR

SEQ ID NO: 11369 - protein, 10 aa, Artificial Sequence
  Peptide Derived from Human Papillomavirus
ETIPAELYLK

SEQ ID NO: 11370 - protein, 8 aa, Artificial Sequence
  Peptide Derived from Human Papillomavirus
FARHYFNR

SEQ ID NO: 11371 - protein, 11 aa, Artificial Sequence
  Peptide Derived from Human Papillomavirus
FARHYFNRAGK

SEQ ID NO: 11372 - protein, 8 aa, Artificial Sequence
  Peptide Derived from Human Papillomavirus
FLMQLGTR

SEQ ID NO: 11373 - protein, 10 aa, Artificial Sequence
  Peptide Derived from Human Papillomavirus
FLMQLGTRSK

SEQ ID NO: 11374 - protein, 8 aa, Artificial Sequence
  Peptide Derived from Human Papillomavirus
FLQMATWR

SEQ ID NO: 11375 - protein, 9 aa, Artificial Sequence
  Peptide Derived from Human Papillomavirus
FVTVVDTTR

SEQ ID NO: 11376 - protein, 10 aa, Artificial Sequence
  Peptide Derived from Human Papillomavirus
GLSGHPLFNR

SEQ ID NO: 11377 - protein, 10 aa, Artificial Sequence
  Peptide Derived from Human Papillomavirus
ISTATEQLSK

SEQ ID NO: 11378 - protein, 10 aa, Artificial Sequence
  Peptide Derived from Human Papillomavirus
ITSEAQLFNK

SEQ ID NO: 11379 - protein, 8 aa, Artificial Sequence
  Peptide Derived from Human Papillomavirus
KVSAYQYR

SEQ ID NO: 11380 - protein, 11 aa, Artificial Sequence
  Peptide Derived from Human Papillomavirus
KVSAYQYRVFR

SEQ ID NO: 11381 - protein, 10 aa, Artificial Sequence
  Peptide Derived from Human Papillomavirus
KVVATDSYVK

SEQ ID NO: 11382 - protein, 11 aa, Artificial Sequence
  Peptide Derived from Human Papillomavirus
KVVATDSYVKR

SEQ ID NO: 11383 - protein, 11 aa, Artificial Sequence
  Peptide Derived from Human Papillomavirus
KVYLPPTPVSK

SEQ ID NO: 11384 - protein, 11 aa, Artificial Sequence
  Peptide Derived from Human Papillomavirus
LANNNVIEDSR

SEQ ID NO: 11385 - protein, 9 aa, Artificial Sequence
  Peptide Derived from Human Papillomavirus
LMQLGTRSK

SEQ ID NO: 11386 - protein, 9 aa, Artificial Sequence
  Peptide Derived from Human Papillomavirus
LSGHPLFNR

SEQ ID NO: 11387 - protein, 8 aa, Artificial Sequence
  Peptide Derived from Human Papillomavirus
LSKYDARK

SEQ ID NO: 11388 - protein, 10 aa, Artificial Sequence
  Peptide Derived from Human Papillomavirus
MATWRPSENK

SEQ ID NO: 11389 - protein, 11 aa, Artificial Sequence
  Peptide Derived from Human Papillomavirus
MITSEAQLFNK

SEQ ID NO: 11390 - protein, 9 aa, Artificial Sequence
  Peptide Derived from Human Papillomavirus
MLPMMYIYR

SEQ ID NO: 11391 - protein, 10 aa, Artificial Sequence
  Peptide Derived from Human Papillomavirus
MMLPMMYIYR

SEQ ID NO: 11392 - protein, 11 aa, Artificial Sequence
  Peptide Derived from Human Papillomavirus
NIPKVSAYQYR

SEQ ID NO: 11393 - protein, 9 aa, Artificial Sequence
  Peptide Derived from Human Papillomavirus
NIYNPDQER

SEQ ID NO: 11394 - protein, 8 aa, Artificial Sequence
  Peptide Derived from Human Papillomavirus
NTKTNIPK

SEQ ID NO: 11395 - protein, 9 aa, Artificial Sequence
  Peptide Derived from Human Papillomavirus
PAMGEHWTK

SEQ ID NO: 11396 - protein, 8 aa, Artificial Sequence
  Peptide Derived from Human Papillomavirus
PAVATSKK

SEQ ID NO: 11397 - protein, 9 aa, Artificial Sequence
  Peptide Derived from Human Papillomavirus
PAVATSKKR

SEQ ID NO: 11398 - protein, 10 aa, Artificial Sequence
  Peptide Derived from Human Papillomavirus
PIFLQMATWR

SEQ ID NO: 11399 - protein, 10 aa, Artificial Sequence
  Peptide Derived from Human Papillomavirus
PLDIVQSTCK

SEQ ID NO: 11400 - protein, 10 aa, Artificial Sequence
  Peptide Derived from Human Papillomavirus
PTEKQDPLAK

SEQ ID NO: 11401 - protein, 9 aa, Artificial Sequence
  Peptide Derived from Human Papillomavirus
PTSTSTPAK

SEQ ID NO: 11402 - protein, 10 aa, Artificial Sequence
  Peptide Derived from Human Papillomavirus
PTSTSTPAKR

SEQ ID NO: 11403 - protein, 11 aa, Artificial Sequence
  Peptide Derived from Human Papillomavirus
PTSTSTPAKRK

SEQ ID NO: 11404 - protein, 9 aa, Artificial Sequence
  Peptide Derived from Human Papillomavirus
PVATSLEDK

SEQ ID NO: 11405 - protein, 11 aa, Artificial Sequence
  Peptide Derived from Human Papillomavirus
PVATSLEDKYR

SEQ ID NO: 11406 - protein, 10 aa, Artificial Sequence
  Peptide Derived from Human Papillomavirus
QLFARHYFNR

SEQ ID NO: 11407 - protein, 11 aa, Artificial Sequence
  Peptide Derived from Human Papillomavirus
QLFNKPYWLQR

SEQ ID NO: 11408 - protein, 11 aa, Artificial Sequence
  Peptide Derived from Human Papillomavirus
QLFVTVVDTTR

SEQ ID NO: 11409 - protein, 8 aa, Artificial Sequence
  Peptide Derived from Human Papillomavirus
QLSKYDAR

SEQ ID NO: 11410 - protein, 9 aa, Artificial Sequence
  Peptide Derived from Human Papillomavirus
QLSKYDARK

SEQ ID NO: 11411 - protein, 11 aa, Artificial Sequence
  Peptide Derived from Human Papillomavirus
QMATWRPSENK

SEQ ID NO: 11412 - protein, 11 aa, Artificial Sequence
  Peptide Derived from Human Papillomavirus
QSTCKYPDYLK

SEQ ID NO: 11413 - protein, 10 aa, Artificial Sequence
  Peptide Derived from Human Papillomavirus
RSKPAVATSK

SEQ ID NO: 11414 - protein, 11 aa, Artificial Sequence
  Peptide Derived from Human Papillomavirus
RSKPAVATSKK

SEQ ID NO: 11415 - protein, 9 aa, Artificial Sequence
  Peptide Derived from Human Papillomavirus
RSTAITCQR

SEQ ID NO: 11416 - protein, 9 aa, Artificial Sequence
  Peptide Derived from Human Papillomavirus
RVRLPDPNK

SEQ ID NO: 11417 - protein, 11 aa, Artificial Sequence
  Peptide Derived from Human Papillomavirus
SAPTSTSTPAK

SEQ ID NO: 11418 - protein, 9 aa, Artificial Sequence
  Peptide Derived from Human Papillomavirus
SAYQYRVFR

SEQ ID NO: 11419 - protein, 11 aa, Artificial Sequence
  Peptide Derived from Human Papillomavirus
SAYQYRVFRVR

SEQ ID NO: 11420 - protein, 10 aa, Artificial Sequence
  Peptide Derived from Human Papillomavirus
SIFYHAGSSR

SEQ ID NO: 11421 - protein, 10 aa, Artificial Sequence
  Peptide Derived from Human Papillomavirus
SLEDKYRYVR

SEQ ID NO: 11422 - protein, 8 aa, Artificial Sequence
  Peptide Derived from Human Papillomavirus
SMWFYLRR

SEQ ID NO: 11423 - protein, 8 aa, Artificial Sequence
  Peptide Derived from Human Papillomavirus
STAITCQR

SEQ ID NO: 11424 - protein, 9 aa, Artificial Sequence
  Peptide Derived from Human Papillomavirus
STATEQLSK

SEQ ID NO: 11425 - protein, 10 aa, Artificial Sequence
  Peptide Derived from Human Papillomavirus
STCKYPDYLK

SEQ ID NO: 11426 - protein, 11 aa, Artificial Sequence
  Peptide Derived from Human Papillomavirus
STDLDQFPLGR

SEQ ID NO: 11427 - protein, 8 aa, Artificial Sequence
  Peptide Derived from Human Papillomavirus
STPAKRKR

SEQ ID NO: 11428 - protein, 9 aa, Artificial Sequence
  Peptide Derived from Human Papillomavirus
STPAKRKRR

SEQ ID NO: 11429 - protein, 8 aa, Artificial Sequence
  Peptide Derived from Human Papillomavirus
STSTPAKR

SEQ ID NO: 11430 - protein, 9 aa, Artificial Sequence
  Peptide Derived from Human Papillomavirus
STSTPAKRK

SEQ ID NO: 11431 - protein, 10 aa, Artificial Sequence
  Peptide Derived from Human Papillomavirus
STSTPAKRKR

SEQ ID NO: 11432 - protein, 11 aa, Artificial Sequence
  Peptide Derived from Human Papillomavirus
STSTPAKRKRR

SEQ ID NO: 11433 - protein, 8 aa, Artificial Sequence
  Peptide Derived from Human Papillomavirus
SVTKDNTK

SEQ ID NO: 11434 - protein, 8 aa, Artificial Sequence
  Peptide Derived from Human Papillomavirus
TATEQLSK

SEQ ID NO: 11435 - protein, 9 aa, Artificial Sequence
  Peptide Derived from Human Papillomavirus
TIPAELYLK

SEQ ID NO: 11436 - protein, 11 aa, Artificial Sequence
  Peptide Derived from Human Papillomavirus
TISTATEQLSK

SEQ ID NO: 11437 - protein, 9 aa, Artificial Sequence
  Peptide Derived from Human Papillomavirus
TSEAQLFNK

SEQ ID NO: 11438 - protein, 11 aa, Artificial Sequence
  Peptide Derived from Human Papillomavirus
TSIFYHAGSSR

SEQ ID NO: 11439 - protein, 8 aa, Artificial Sequence
  Peptide Derived from Human Papillomavirus
TSLEDKYR

SEQ ID NO: 11440 - protein, 11 aa, Artificial Sequence
  Peptide Derived from Human Papillomavirus
TSLEDKYRYVR

SEQ ID NO: 11441 - protein, 8 aa, Artificial Sequence
  Peptide Derived from Human Papillomavirus
TSTPAKRK

SEQ ID NO: 11442 - protein, 9 aa, Artificial Sequence
  Peptide Derived from Human Papillomavirus
TSTPAKRKR

SEQ ID NO: 11443 - protein, 10 aa, Artificial Sequence
  Peptide Derived from Human Papillomavirus
TSTPAKRKRR

SEQ ID NO: 11444 - protein, 8 aa, Artificial Sequence
  Peptide Derived from Human Papillomavirus
TSTSTPAK

SEQ ID NO: 11445 - protein, 9 aa, Artificial Sequence
  Peptide Derived from Human Papillomavirus
TSTSTPAKR

SEQ ID NO: 11446 - protein, 10 aa, Artificial Sequence
  Peptide Derived from Human Papillomavirus
TSTSTPAKRK

SEQ ID NO: 11447 - protein, 11 aa, Artificial Sequence
  Peptide Derived from Human Papillomavirus
TSTSTPAKRKR

SEQ ID NO: 11448 - protein, 8 aa, Artificial Sequence
  Peptide Derived from Human Papillomavirus
VATDSYVK

SEQ ID NO: 11449 - protein, 9 aa, Artificial Sequence
  Peptide Derived from Human Papillomavirus
VATDSYVKR

SEQ ID NO: 11450 - protein, 8 aa, Artificial Sequence
  Peptide Derived from Human Papillomavirus
VATSLEDK

SEQ ID NO: 11451 - protein, 10 aa, Artificial Sequence
  Peptide Derived from Human Papillomavirus
VATSLEDKYR

SEQ ID NO: 11452 - protein, 10 aa, Artificial Sequence
  Peptide Derived from Human Papillomavirus
VSAYQYRVFR

SEQ ID NO: 11453 - protein, 8 aa, Artificial Sequence
  Peptide Derived from Human Papillomavirus
VTVVDTTR

SEQ ID NO: 11454 - protein, 9 aa, Artificial Sequence
  Peptide Derived from Human Papillomavirus
VVATDSYVK

SEQ ID NO: 11455 - protein, 10 aa, Artificial Sequence
  Peptide Derived from Human Papillomavirus
VVATDSYVKR

SEQ ID NO: 11456 - protein, 10 aa, Artificial Sequence
  Peptide Derived from Human Papillomavirus
WACVGLEVGR

SEQ ID NO: 11457 - protein, 8 aa, Artificial Sequence
  Peptide Derived from Human Papillomavirus
WTKGAVCK

SEQ ID NO: 11458 - protein, 8 aa, Artificial Sequence
  Peptide Derived from Human Papillomavirus
YLKGSNGR

SEQ ID NO: 11459 - protein, 9 aa, Artificial Sequence
  Peptide Derived from Human Papillomavirus
YLPPTPVSK

SEQ ID NO: 11460 - protein, 10 aa, Artificial Sequence
  Peptide Derived from Human Papillomavirus
YLRREQLFAR

SEQ ID NO: 11461 - protein, 9 aa, Artificial Sequence
  Peptide Derived from Human Papillomavirus
YSVTKDNTK

SEQ ID NO: 11462 - protein, 11 aa, Artificial Sequence
  Peptide Derived from Human Papillomavirus
YVRSTAITCQR

SEQ ID NO: 11463 - protein, 8 aa, Artificial Sequence
  Peptide Derived from Human Papillomavirus
AAPRLYRK

SEQ ID NO: 11464 - protein, 10 aa, Artificial Sequence
  Peptide Derived from Human Papillomavirus
ALHRPAFTTR

SEQ ID NO: 11465 - protein, 11 aa, Artificial Sequence
  Peptide Derived from Human Papillomavirus
ALHRPAFTTRR

SEQ ID NO: 11466 - protein, 9 aa, Artificial Sequence
  Peptide Derived from Human Papillomavirus
ALWPVYFFR

SEQ ID NO: 11467 - protein, 10 aa, Artificial Sequence
  Peptide Derived from Human Papillomavirus
ALWPVYFFRR

SEQ ID NO: 11468 - protein, 11 aa, Artificial Sequence
  Peptide Derived from Human Papillomavirus
ALWPVYFFRRR

SEQ ID NO: 11469 - protein, 8 aa, Artificial Sequence
  Peptide Derived from Human Papillomavirus
ASATQLYK

SEQ ID NO: 11470 - protein, 11 aa, Artificial Sequence
  Peptide Derived from Human Papillomavirus
ASATQLYKTCK

SEQ ID NO: 11471 - protein, 10 aa, Artificial Sequence
  Peptide Derived from Human Papillomavirus
ATPSAHLPIK

SEQ ID NO: 11472 - protein, 9 aa, Artificial Sequence
  Peptide Derived from Human Papillomavirus
ATQLYKTCK

SEQ ID NO: 11473 - protein, 9 aa, Artificial Sequence
  Peptide Derived from Human Papillomavirus
DVVNKIEQK

SEQ ID NO: 11474 - protein, 10 aa, Artificial Sequence
  Peptide Derived from Human Papillomavirus
FALWPVYFFR

SEQ ID NO: 11475 - protein, 11 aa, Artificial Sequence
  Peptide Derived from Human Papillomavirus
FALWPVYFFRR

SEQ ID NO: 11476 - protein, 9 aa, Artificial Sequence
  Peptide Derived from Human Papillomavirus
FMNIVALHR

SEQ ID NO: 11477 - protein, 9 aa, Artificial Sequence
  Peptide Derived from Human Papillomavirus
FTTRRGGVR

SEQ ID NO: 11478 - protein, 11 aa, Artificial Sequence
  Peptide Derived from Human Papillomavirus
GIGTGTGSGGR

SEQ ID NO: 11479 - protein, 10 aa, Artificial Sequence
  Peptide Derived from Human Papillomavirus
GTCPEDVVNK

SEQ ID NO: 11480 - protein, 9 aa, Artificial Sequence
  Peptide Derived from Human Papillomavirus
GTGTGSGGR

SEQ ID NO: 11481 - protein, 9 aa, Artificial Sequence
  Peptide Derived from Human Papillomavirus
GVRFSRLGR

SEQ ID NO: 11482 - protein, 10 aa, Artificial Sequence
  Peptide Derived from Human Papillomavirus
GVRFSRLGRK

SEQ ID NO: 11483 - protein, 8 aa, Artificial Sequence
  Peptide Derived from Human Papillomavirus
IAAPRLYR

SEQ ID NO: 11484 - protein, 9 aa, Artificial Sequence
  Peptide Derived from Human Papillomavirus
IAAPRLYRK

SEQ ID NO: 11485 - protein, 10 aa, Artificial Sequence
  Peptide Derived from Human Papillomavirus
ISSTPIPGFR

SEQ ID NO: 11486 - protein, 11 aa, Artificial Sequence
  Peptide Derived from Human Papillomavirus
ISSTPIPGFRR

SEQ ID NO: 11487 - protein, 8 aa, Artificial Sequence
  Peptide Derived from Human Papillomavirus
IVDVTPAR

SEQ ID NO: 11488 - protein, 8 aa, Artificial Sequence
  Peptide Derived from Human Papillomavirus
KATIQTRR

SEQ ID NO: 11489 - protein, 10 aa, Artificial Sequence
  Peptide Derived from Human Papillomavirus
KIEQKTWADK

SEQ ID NO: 11490 - protein, 10 aa, Artificial Sequence
  Peptide Derived from Human Papillomavirus
KVTDPAFLDR

SEQ ID NO: 11491 - protein, 8 aa, Artificial Sequence
  Peptide Derived from Human Papillomavirus
MVAHRATR

SEQ ID NO: 11492 - protein, 9 aa, Artificial Sequence
  Peptide Derived from Human Papillomavirus
MVAHRATRR

SEQ ID NO: 11493 - protein, 10 aa, Artificial Sequence
  Peptide Derived from Human Papillomavirus
MVAHRATRRK

SEQ ID NO: 11494 - protein, 11 aa, Artificial Sequence
  Peptide Derived from Human Papillomavirus
MVAHRATRRKR

SEQ ID NO: 11495 - protein, 11 aa, Artificial Sequence
  Peptide Derived from Human Papillomavirus
PAFTTRRGGVR

SEQ ID NO: 11496 - protein, 11 aa, Artificial Sequence
  Peptide Derived from Human Papillomavirus
PISSTPIPGFR

SEQ ID NO: 11497 - protein, 8 aa, Artificial Sequence
  Peptide Derived from Human Papillomavirus
PSAHLPIK

SEQ ID NO: 11498 - protein, 11 aa, Artificial Sequence
  Peptide Derived from Human Papillomavirus
PSTIVDVTPAR

SEQ ID NO: 11499 - protein, 8 aa, Artificial Sequence
  Peptide Derived from Human Papillomavirus
PVYFFRRR

SEQ ID NO: 11500 - protein, 9 aa, Artificial Sequence
  Peptide Derived from Human Papillomavirus
PVYFFRRRR

SEQ ID NO: 11501 - protein, 10 aa, Artificial Sequence
  Peptide Derived from Human Papillomavirus
PVYFFRRRRR

SEQ ID NO: 11502 - protein, 11 aa, Artificial Sequence
  Peptide Derived from Human Papillomavirus
PVYFFRRRRRK

SEQ ID NO: 11503 - protein, 11 aa, Artificial Sequence
  Peptide Derived from Human Papillomavirus
QTRRGTQIGAR

SEQ ID NO: 11504 - protein, 10 aa, Artificial Sequence
  Peptide Derived from Human Papillomavirus
RAGYVPLGSR

SEQ ID NO: 11505 - protein, 9 aa, Artificial Sequence
  Peptide Derived from Human Papillomavirus
RASATQLYK

SEQ ID NO: 11506 - protein, 9 aa, Artificial Sequence
  Peptide Derived from Human Papillomavirus
RIAAPRLYR

SEQ ID NO: 11507 - protein, 10 aa, Artificial Sequence
  Peptide Derived from Human Papillomavirus
RIAAPRLYRK

SEQ ID NO: 11508 - protein, 11 aa, Artificial Sequence
  Peptide Derived from Human Papillomavirus
RLGRKATIQTR

SEQ ID NO: 11509 - protein, 11 aa, Artificial Sequence
  Peptide Derived from Human Papillomavirus
RLYRKAFQQVK

SEQ ID NO: 11510 - protein, 10 aa, Artificial Sequence
  Peptide Derived from Human Papillomavirus
SATQLYKTCK

SEQ ID NO: 11511 - protein, 9 aa, Artificial Sequence
  Peptide Derived from Human Papillomavirus
SSTPIPGFR

SEQ ID NO: 11512 - protein, 10 aa, Artificial Sequence
  Peptide Derived from Human Papillomavirus
SSTPIPGFRR

SEQ ID NO: 11513 - protein, 10 aa, Artificial Sequence
  Peptide Derived from Human Papillomavirus
STIVDVTPAR

SEQ ID NO: 11514 - protein, 8 aa, Artificial Sequence
  Peptide Derived from Human Papillomavirus
STPIPGFR

SEQ ID NO: 11515 - protein, 9 aa, Artificial Sequence
  Peptide Derived from Human Papillomavirus
STPIPGFRR

SEQ ID NO: 11516 - protein, 9 aa, Artificial Sequence
  Peptide Derived from Human Papillomavirus
TIVDVTPAR

SEQ ID NO: 11517 - protein, 8 aa, Artificial Sequence
  Peptide Derived from Human Papillomavirus
TTRRGGVR

SEQ ID NO: 11518 - protein, 11 aa, Artificial Sequence
  Peptide Derived from Human Papillomavirus
TTRRGGVRFSR

SEQ ID NO: 11519 - protein, 8 aa, Artificial Sequence
  Peptide Derived from Human Papillomavirus
VAHRATRR

SEQ ID NO: 11520 - protein, 9 aa, Artificial Sequence
  Peptide Derived from Human Papillomavirus
VAHRATRRK

SEQ ID NO: 11521 - protein, 10 aa, Artificial Sequence
  Peptide Derived from Human Papillomavirus
VAHRATRRKR

SEQ ID NO: 11522 - protein, 11 aa, Artificial Sequence
  Peptide Derived from Human Papillomavirus
VALHRPAFTTR

SEQ ID NO: 11523 - protein, 11 aa, Artificial Sequence
  Peptide Derived from Human Papillomavirus
VATPSAHLPIK

SEQ ID NO: 11524 - protein, 9 aa, Artificial Sequence
  Peptide Derived from Human Papillomavirus
VTDPAFLDR

SEQ ID NO: 11525 - protein, 8 aa, Artificial Sequence
  Peptide Derived from Human Papillomavirus
VVNKIEQK

SEQ ID NO: 11526 - protein, 8 aa, Artificial Sequence
  Peptide Derived from Human Papillomavirus
AFGLTPSI

SEQ ID NO: 11527 - protein, 11 aa, Artificial Sequence
  Peptide Derived from Human Papillomavirus
AFLKSNSQAKI

SEQ ID NO: 11528 - protein, 9 aa, Artificial Sequence
  Peptide Derived from Human Papillomavirus
ALDGNLVSM

SEQ ID NO: 11529 - protein, 9 aa, Artificial Sequence
  Peptide Derived from Human Papillomavirus
ALKRFLQGI

SEQ ID NO: 11530 - protein, 9 aa, Artificial Sequence
  Peptide Derived from Human Papillomavirus
ALYWYKTGI

SEQ ID NO: 11531 - protein, 9 aa, Artificial Sequence
  Peptide Derived from Human Papillomavirus
AMLAKFKEL

SEQ ID NO: 11532 - protein, 10 aa, Artificial Sequence
  Peptide Derived from Human Papillomavirus
AMLAKFKELY

SEQ ID NO: 11533 - protein, 8 aa, Artificial Sequence
  Peptide Derived from Human Papillomavirus
ATVPCWNY

SEQ ID NO: 11534 - protein, 9 aa, Artificial Sequence
  Peptide Derived from Human Papillomavirus
ATVPCWNYI

SEQ ID NO: 11535 - protein, 9 aa, Artificial Sequence
  Peptide Derived from Human Papillomavirus
AVQVLKRKY

SEQ ID NO: 11536 - protein, 10 aa, Artificial Sequence
  Peptide Derived from Human Papillomavirus
AVQVLKRKYL

SEQ ID NO: 11537 - protein, 11 aa, Artificial Sequence
  Peptide Derived from Human Papillomavirus
AVVEKKTGDAI

SEQ ID NO: 11538 - protein, 9 aa, Artificial Sequence
  Peptide Derived from Human Papillomavirus
CFVNSKSHF

SEQ ID NO: 11539 - protein, 10 aa, Artificial Sequence
  Peptide Derived from Human Papillomavirus
CFVNSKSHFW

SEQ ID NO: 11540 - protein, 11 aa, Artificial Sequence
  Peptide Derived from Human Papillomavirus
CFVNSKSHFWL

SEQ ID NO: 11541 - protein, 11 aa, Artificial Sequence
  Peptide Derived from Human Papillomavirus
CIAAFGLTPSI

SEQ ID NO: 11542 - protein, 9 aa, Artificial Sequence
  Peptide Derived from Human Papillomavirus
CLYLHIQSL

SEQ ID NO: 11543 - protein, 9 aa, Artificial Sequence
  Peptide Derived from Human Papillomavirus
CMMIEPPKL

SEQ ID NO: 11544 - protein, 8 aa, Artificial Sequence
  Peptide Derived from Human Papillomavirus
CTFELSQM

SEQ ID NO: 11545 - protein, 11 aa, Artificial Sequence
  Peptide Derived from Human Papillomavirus
CTFELSQMVQW

SEQ ID NO: 11546 - protein, 10 aa, Artificial Sequence
  Peptide Derived from Human Papillomavirus
CVDNNISPRL

SEQ ID NO: 11547 - protein, 10 aa, Artificial Sequence
  Peptide Derived from Human Papillomavirus
CVSGQNTNTL

SEQ ID NO: 11548 - protein, 8 aa, Artificial Sequence
  Peptide Derived from Human Papillomavirus
CVSPMCMM

SEQ ID NO: 11549 - protein, 9 aa, Artificial Sequence
  Peptide Derived from Human Papillomavirus
CVSPMCMMI

SEQ ID NO: 11550 - protein, 9 aa, Artificial Sequence
  Peptide Derived from Human Papillomavirus
CWNYIDDNL

SEQ ID NO: 11551 - protein, 9 aa, Artificial Sequence
  Peptide Derived from Human Papillomavirus
DFIVNDNDY

SEQ ID NO: 11552 - protein, 10 aa, Artificial Sequence
  Peptide Derived from Human Papillomavirus
DFIVNDNDYL

SEQ ID NO: 11553 - protein, 10 aa, Artificial Sequence
  Peptide Derived from Human Papillomavirus
DISGCVDNNI

SEQ ID NO: 11554 - protein, 8 aa, Artificial Sequence
  Peptide Derived from Human Papillomavirus
DIVDDSEI

SEQ ID NO: 11555 - protein, 10 aa, Artificial Sequence
  Peptide Derived from Human Papillomavirus
DIVDDSEIAY

SEQ ID NO: 11556 - protein, 9 aa, Artificial Sequence
  Peptide Derived from Human Papillomavirus
DTGEDLVDF

SEQ ID NO: 11557 - protein, 10 aa, Artificial Sequence
  Peptide Derived from Human Papillomavirus
DTGEDLVDFI

SEQ ID NO: 11558 - protein, 9 aa, Artificial Sequence
  Peptide Derived from Human Papillomavirus
DTNSNASAF

SEQ ID NO: 11559 - protein, 10 aa, Artificial Sequence
  Peptide Derived from Human Papillomavirus
DTNSNASAFL

SEQ ID NO: 11560 - protein, 10 aa, Artificial Sequence
  Peptide Derived from Human Papillomavirus
DVKHRPLVQL

SEQ ID NO: 11561 - protein, 9 aa, Artificial Sequence
  Peptide Derived from Human Papillomavirus
DWCIAAFGL

SEQ ID NO: 11562 - protein, 8 aa, Artificial Sequence
  Peptide Derived from Human Papillomavirus
DWKQIVMF

SEQ ID NO: 11563 - protein, 9 aa, Artificial Sequence
  Peptide Derived from Human Papillomavirus
DWKQIVMFL

SEQ ID NO: 11564 - protein, 11 aa, Artificial Sequence
  Peptide Derived from Human Papillomavirus
DWKQIVMFLRY

SEQ ID NO: 11565 - protein, 9 aa, Artificial Sequence
  Peptide Derived from Human Papillomavirus
EFMSFLTAL

SEQ ID NO: 11566 - protein, 9 aa, Artificial Sequence
  Peptide Derived from Human Papillomavirus
EIAYKYAQL

SEQ ID NO: 11567 - protein, 10 aa, Artificial Sequence
  Peptide Derived from Human Papillomavirus
ELNDKNWKSF

SEQ ID NO: 11568 - protein, 11 aa, Artificial Sequence
  Peptide Derived from Human Papillomavirus
ELNDKNWKSFF

SEQ ID NO: 11569 - protein, 8 aa, Artificial Sequence
  Peptide Derived from Human Papillomavirus
ELSQMVQW

SEQ ID NO: 11570 - protein, 10 aa, Artificial Sequence
  Peptide Derived from Human Papillomavirus
ELSQMVQWAY

SEQ ID NO: 11571 - protein, 10 aa, Artificial Sequence
  Peptide Derived from Human Papillomavirus
ELYGVSFSEL

SEQ ID NO: 11572 - protein, 8 aa, Artificial Sequence
  Peptide Derived from Human Papillomavirus
ETETAHAL

SEQ ID NO: 11573 - protein, 9 aa, Artificial Sequence
  Peptide Derived from Human Papillomavirus
ETETAHALF

SEQ ID NO: 11574 - protein, 9 aa, Artificial Sequence
  Peptide Derived from Human Papillomavirus
ETETPCSQY

SEQ ID NO: 11575 - protein, 10 aa, Artificial Sequence
  Peptide Derived from Human Papillomavirus
ETIEKLLSKL

SEQ ID NO: 11576 - protein, 11 aa, Artificial Sequence
  Peptide Derived from Human Papillomavirus
ETIEKLLSKLL

SEQ ID NO: 11577 - protein, 8 aa, Artificial Sequence
  Peptide Derived from Human Papillomavirus
EVETQQML

SEQ ID NO: 11578 - protein, 9 aa, Artificial Sequence
  Peptide Derived from Human Papillomavirus
EVYGDTPEW

SEQ ID NO: 11579 - protein, 10 aa, Artificial Sequence
  Peptide Derived from Human Papillomavirus
EVYGDTPEWI

SEQ ID NO: 11580 - protein, 9 aa, Artificial Sequence
  Peptide Derived from Human Papillomavirus
EWIQRQTVL

SEQ ID NO: 11581 - protein, 9 aa, Artificial Sequence
  Peptide Derived from Human Papillomavirus
FFSRTWSRL

SEQ ID NO: 11582 - protein, 11 aa, Artificial Sequence
  Peptide Derived from Human Papillomavirus
FFSRTWSRLSL

SEQ ID NO: 11583 - protein, 8 aa, Artificial Sequence
  Peptide Derived from Human Papillomavirus
FIVNDNDY

SEQ ID NO: 11584 - protein, 9 aa, Artificial Sequence
  Peptide Derived from Human Papillomavirus
FIVNDNDYL

SEQ ID NO: 11585 - protein, 10 aa, Artificial Sequence
  Peptide Derived from Human Papillomavirus
FLKSNSQAKI

SEQ ID NO: 11586 - protein, 11 aa, Artificial Sequence
  Peptide Derived from Human Papillomavirus
FLQGIPKKNCI

SEQ ID NO: 11587 - protein, 9 aa, Artificial Sequence
  Peptide Derived from Human Papillomavirus
FLQGSVICF

SEQ ID NO: 11588 - protein, 9 aa, Artificial Sequence
  Peptide Derived from Human Papillomavirus
FLRYQGVEF

SEQ ID NO: 11589 - protein, 10 aa, Artificial Sequence
  Peptide Derived from Human Papillomavirus
FLRYQGVEFM

SEQ ID NO: 11590 - protein, 8 aa, Artificial Sequence
  Peptide Derived from Human Papillomavirus
FLTALKRF

SEQ ID NO: 11591 - protein, 9 aa, Artificial Sequence
  Peptide Derived from Human Papillomavirus
FLTALKRFL

SEQ ID NO: 11592 - protein, 8 aa, Artificial Sequence
  Peptide Derived from Human Papillomavirus
FMSFLTAL

SEQ ID NO: 11593 - protein, 11 aa, Artificial Sequence
  Peptide Derived from Human Papillomavirus
FMSFLTALKRF

SEQ ID NO: 11594 - protein, 9 aa, Artificial Sequence
  Peptide Derived from Human Papillomavirus
FTFPNEFPF

SEQ ID NO: 11595 - protein, 8 aa, Artificial Sequence
  Peptide Derived from Human Papillomavirus
FVNSKSHF

SEQ ID NO: 11596 - protein, 9 aa, Artificial Sequence
  Peptide Derived from Human Papillomavirus
FVNSKSHFW

SEQ ID NO: 11597 - protein, 10 aa, Artificial Sequence
  Peptide Derived from Human Papillomavirus
FVNSKSHFWL

SEQ ID NO: 11598 - protein, 11 aa, Artificial Sequence
  Peptide Derived from Human Papillomavirus
FWLQPLADAKI

SEQ ID NO: 11599 - protein, 8 aa, Artificial Sequence
  Peptide Derived from Human Papillomavirus
GIPKKNCI

SEQ ID NO: 11600 - protein, 9 aa, Artificial Sequence
  Peptide Derived from Human Papillomavirus
GIPKKNCIL

SEQ ID NO: 11601 - protein, 10 aa, Artificial Sequence
  Peptide Derived from Human Papillomavirus
GIPKKNCILL

SEQ ID NO: 11602 - protein, 11 aa, Artificial Sequence
  Peptide Derived from Human Papillomavirus
GIPKKNCILLY

SEQ ID NO: 11603 - protein, 9 aa, Artificial Sequence
  Peptide Derived from Human Papillomavirus
GISNISEVY

SEQ ID NO: 11604 - protein, 10 aa, Artificial Sequence
  Peptide Derived from Human Papillomavirus
GLTPSIADSI

SEQ ID NO: 11605 - protein, 11 aa, Artificial Sequence
  Peptide Derived from Human Papillomavirus
GMLDDATVPCW

SEQ ID NO: 11606 - protein, 8 aa, Artificial Sequence
  Peptide Derived from Human Papillomavirus
GMSLMKFL

SEQ ID NO: 11607 - protein, 10 aa, Artificial Sequence
  Peptide Derived from Human Papillomavirus
GMVVLLLVRY

SEQ ID NO: 11608 - protein, 8 aa, Artificial Sequence
  Peptide Derived from Human Papillomavirus
GTDSRWPY

SEQ ID NO: 11609 - protein, 9 aa, Artificial Sequence
  Peptide Derived from Human Papillomavirus
GTDSRWPYL

SEQ ID NO: 11610 - protein, 8 aa, Artificial Sequence
  Peptide Derived from Human Papillomavirus
GTGCNGWF

SEQ ID NO: 11611 - protein, 9 aa, Artificial Sequence
  Peptide Derived from Human Papillomavirus
GTGCNGWFY

SEQ ID NO: 11612 - protein, 8 aa, Artificial Sequence
  Peptide Derived from Human Papillomavirus
GVEFMSFL

SEQ ID NO: 11613 - protein, 11 aa, Artificial Sequence
  Peptide Derived from Human Papillomavirus
GVEFMSFLTAL

SEQ ID NO: 11614 - protein, 8 aa, Artificial Sequence
  Peptide Derived from Human Papillomavirus
GVSERHTI

SEQ ID NO: 11615 - protein, 11 aa, Artificial Sequence
  Peptide Derived from Human Papillomavirus
GVSFSELVRPF

SEQ ID NO: 11616 - protein, 9 aa, Artificial Sequence
  Peptide Derived from Human Papillomavirus
HIQSLACSW

SEQ ID NO: 11617 - protein, 11 aa, Artificial Sequence
  Peptide Derived from Human Papillomavirus
HIQSLACSWGM

SEQ ID NO: 11618 - protein, 8 aa, Artificial Sequence
  Peptide Derived from Human Papillomavirus
HTICQTPL

SEQ ID NO: 11619 - protein, 11 aa, Artificial Sequence
  Peptide Derived from Human Papillomavirus
HTICQTPLTNI

SEQ ID NO: 11620 - protein, 10 aa, Artificial Sequence
  Peptide Derived from Human Papillomavirus
HYKRAEKKQM

SEQ ID NO: 11621 - protein, 9 aa, Artificial Sequence
  Peptide Derived from Human Papillomavirus
IVDDSEIAY

SEQ ID NO: 11622 - protein, 11 aa, Artificial Sequence
  Peptide Derived from Human Papillomavirus
IVDDSEIAYKY

SEQ ID NO: 11623 - protein, 8 aa, Artificial Sequence
  Peptide Derived from Human Papillomavirus
IVKDCATM

SEQ ID NO: 11624 - protein, 8 aa, Artificial Sequence
  Peptide Derived from Human Papillomavirus
IVNDNDYL

SEQ ID NO: 11625 - protein, 10 aa, Artificial Sequence
  Peptide Derived from Human Papillomavirus
KFKELYGVSF

SEQ ID NO: 11626 - protein, 8 aa, Artificial Sequence
  Peptide Derived from Human Papillomavirus
KFLQGSVI

SEQ ID NO: 11627 - protein, 10 aa, Artificial Sequence
  Peptide Derived from Human Papillomavirus
KFLQGSVICF

SEQ ID NO: 11628 - protein, 9 aa, Artificial Sequence
  Peptide Derived from Human Papillomavirus
KIVKDCATM

SEQ ID NO: 11629 - protein, 8 aa, Artificial Sequence
  Peptide Derived from Human Papillomavirus
KLLCVSPM

SEQ ID NO: 11630 - protein, 10 aa, Artificial Sequence
  Peptide Derived from Human Papillomavirus
KLLCVSPMCM

SEQ ID NO: 11631 - protein, 11 aa, Artificial Sequence
  Peptide Derived from Human Papillomavirus
KLLCVSPMCMM

SEQ ID NO: 11632 - protein, 9 aa, Artificial Sequence
  Peptide Derived from Human Papillomavirus
KLRSTAAAL

SEQ ID NO: 11633 - protein, 10 aa, Artificial Sequence
  Peptide Derived from Human Papillomavirus
KLRSTAAALY

SEQ ID NO: 11634 - protein, 11 aa, Artificial Sequence
  Peptide Derived from Human Papillomavirus
KLRSTAAALYW

SEQ ID NO: 11635 - protein, 11 aa, Artificial Sequence
  Peptide Derived from Human Papillomavirus
KTGISNISEVY

SEQ ID NO: 11636 - protein, 9 aa, Artificial Sequence
  Peptide Derived from Human Papillomavirus
KTLLQQYCL

SEQ ID NO: 11637 - protein, 10 aa, Artificial Sequence
  Peptide Derived from Human Papillomavirus
KTLLQQYCLY

SEQ ID NO: 11638 - protein, 11 aa, Artificial Sequence
  Peptide Derived from Human Papillomavirus
KTLLQQYCLYL

SEQ ID NO: 11639 - protein, 9 aa, Artificial Sequence
  Peptide Derived from Human Papillomavirus
KTSNAKAAM

SEQ ID NO: 11640 - protein, 10 aa, Artificial Sequence
  Peptide Derived from Human Papillomavirus
KTSNAKAAML

SEQ ID NO: 11641 - protein, 10 aa, Artificial Sequence
  Peptide Derived from Human Papillomavirus
KYLVSPLSDI

SEQ ID NO: 11642 - protein, 9 aa, Artificial Sequence
  Peptide Derived from Human Papillomavirus
LFESEDSGY

SEQ ID NO: 11643 - protein, 9 aa, Artificial Sequence
  Peptide Derived from Human Papillomavirus
LFGMSLMKF

SEQ ID NO: 11644 - protein, 10 aa, Artificial Sequence
  Peptide Derived from Human Papillomavirus
LFGMSLMKFL

SEQ ID NO: 11645 - protein, 9 aa, Artificial Sequence
  Peptide Derived from Human Papillomavirus
LLCVSPMCM

SEQ ID NO: 11646 - protein, 10 aa, Artificial Sequence
  Peptide Derived from Human Papillomavirus
LLCVSPMCMM

SEQ ID NO: 11647 - protein, 11 aa, Artificial Sequence
  Peptide Derived from Human Papillomavirus
LLCVSPMCMMI

SEQ ID NO: 11648 - protein, 8 aa, Artificial Sequence
  Peptide Derived from Human Papillomavirus
LLQQYCLY

SEQ ID NO: 11649 - protein, 9 aa, Artificial Sequence
  Peptide Derived from Human Papillomavirus
LLQQYCLYL

SEQ ID NO: 11650 - protein, 11 aa, Artificial Sequence
  Peptide Derived from Human Papillomavirus
LLQQYCLYLHI

SEQ ID NO: 11651 - protein, 11 aa, Artificial Sequence
  Peptide Derived from Human Papillomavirus
LLSKLLCVSPM

SEQ ID NO: 11652 - protein, 10 aa, Artificial Sequence
  Peptide Derived from Human Papillomavirus
LMKFLQGSVI

SEQ ID NO: 11653 - protein, 8 aa, Artificial Sequence
  Peptide Derived from Human Papillomavirus
LTALKRFL

SEQ ID NO: 11654 - protein, 11 aa, Artificial Sequence
  Peptide Derived from Human Papillomavirus
LTALKRFLQGI

SEQ ID NO: 11655 - protein, 8 aa, Artificial Sequence
  Peptide Derived from Human Papillomavirus
LTNILNVL

SEQ ID NO: 11656 - protein, 9 aa, Artificial Sequence
  Peptide Derived from Human Papillomavirus
LTPSIADSI

SEQ ID NO: 11657 - protein, 11 aa, Artificial Sequence
  Peptide Derived from Human Papillomavirus
LVDFIVNDNDY

SEQ ID NO: 11658 - protein, 9 aa, Artificial Sequence
  Peptide Derived from Human Papillomavirus
LVQLKCPPL

SEQ ID NO: 11659 - protein, 10 aa, Artificial Sequence
  Peptide Derived from Human Papillomavirus
LVQLKCPPLL

SEQ ID NO: 11660 - protein, 11 aa, Artificial Sequence
  Peptide Derived from Human Papillomavirus
LVQLKCPPLLI

SEQ ID NO: 11661 - protein, 11 aa, Artificial Sequence
  Peptide Derived from Human Papillomavirus
LVSMDVKHRPL

SEQ ID NO: 11662 - protein, 8 aa, Artificial Sequence
  Peptide Derived from Human Papillomavirus
LVSPLSDI

SEQ ID NO: 11663 - protein, 10 aa, Artificial Sequence
  Peptide Derived from Human Papillomavirus
LVVFTFPNEF

SEQ ID NO: 11664 - protein, 11 aa, Artificial Sequence
  Peptide Derived from Human Papillomavirus
LYGAANTGKSL

SEQ ID NO: 11665 - protein, 9 aa, Artificial Sequence
  Peptide Derived from Human Papillomavirus
LYGVSFSEL

SEQ ID NO: 11666 - protein, 8 aa, Artificial Sequence
  Peptide Derived from Human Papillomavirus
LYLHIQSL

SEQ ID NO: 11667 - protein, 8 aa, Artificial Sequence
  Peptide Derived from Human Papillomavirus
LYWYKTGI

SEQ ID NO: 11668 - protein, 11 aa, Artificial Sequence
  Peptide Derived from Human Papillomavirus
LYWYKTGISNI

SEQ ID NO: 11669 - protein, 10 aa, Artificial Sequence
  Peptide Derived from Human Papillomavirus
MFLRYQGVEF

SEQ ID NO: 11670 - protein, 11 aa, Artificial Sequence
  Peptide Derived from Human Papillomavirus
MFLRYQGVEFM

SEQ ID NO: 11671 - protein, 8 aa, Artificial Sequence
  Peptide Derived from Human Papillomavirus
MLAKFKEL

SEQ ID NO: 11672 - protein, 9 aa, Artificial Sequence
  Peptide Derived from Human Papillomavirus
MLAKFKELY

SEQ ID NO: 11673 - protein, 10 aa, Artificial Sequence
  Peptide Derived from Human Papillomavirus
MLDDATVPCW

SEQ ID NO: 11674 - protein, 8 aa, Artificial Sequence
  Peptide Derived from Human Papillomavirus
MMIEPPKL

SEQ ID NO: 11675 - protein, 10 aa, Artificial Sequence
  Peptide Derived from Human Papillomavirus
MVQWAYDNDI

SEQ ID NO: 11676 - protein, 9 aa, Artificial Sequence
  Peptide Derived from Human Papillomavirus
MVVLLLVRY

SEQ ID NO: 11677 - protein, 10 aa, Artificial Sequence
  Peptide Derived from Human Papillomavirus
NINAGTDSRW

SEQ ID NO: 11678 - protein, 9 aa, Artificial Sequence
  Peptide Derived from Human Papillomavirus
NISPRLKAI

SEQ ID NO: 11679 - protein, 11 aa, Artificial Sequence
  Peptide Derived from Human Papillomavirus
NISPRLKAICI

SEQ ID NO: 11680 - protein, 10 aa, Artificial Sequence
  Peptide Derived from Human Papillomavirus
NLRNALDGNL

SEQ ID NO: 11681 - protein, 9 aa, Artificial Sequence
  Peptide Derived from Human Papillomavirus
NTEVETQQM

SEQ ID NO: 11682 - protein, 10 aa, Artificial Sequence
  Peptide Derived from Human Papillomavirus
NTEVETQQML

SEQ ID NO: 11683 - protein, 9 aa, Artificial Sequence
  Peptide Derived from Human Papillomavirus
NTGKSLFGM

SEQ ID NO: 11684 - protein, 11 aa, Artificial Sequence
  Peptide Derived from Human Papillomavirus
NTGKSLFGMSL

SEQ ID NO: 11685 - protein, 10 aa, Artificial Sequence
  Peptide Derived from Human Papillomavirus
NWKSFFSRTW

SEQ ID NO: 11686 - protein, 11 aa, Artificial Sequence
  Peptide Derived from Human Papillomavirus
NYIDDNLRNAL

SEQ ID NO: 11687 - protein, 10 aa, Artificial Sequence
  Peptide Derived from Human Papillomavirus
PFDENGNPVY

SEQ ID NO: 11688 - protein, 9 aa, Artificial Sequence
  Peptide Derived from Human Papillomavirus
PLADAKIGM

SEQ ID NO: 11689 - protein, 10 aa, Artificial Sequence
  Peptide Derived from Human Papillomavirus
PLADAKIGML

SEQ ID NO: 11690 - protein, 8 aa, Artificial Sequence
  Peptide Derived from Human Papillomavirus
PLLITSNI

SEQ ID NO: 11691 - protein, 9 aa, Artificial Sequence
  Peptide Derived from Human Papillomavirus
PLTNILNVL

SEQ ID NO: 11692 - protein, 10 aa, Artificial Sequence
  Peptide Derived from Human Papillomavirus
PLVQLKCPPL

SEQ ID NO: 11693 - protein, 11 aa, Artificial Sequence
  Peptide Derived from Human Papillomavirus
PLVQLKCPPLL

SEQ ID NO: 11694 - protein, 11 aa, Artificial Sequence
  Peptide Derived from Human Papillomavirus
PMCMMIEPPKL

SEQ ID NO: 11695 - protein, 10 aa, Artificial Sequence
  Peptide Derived from Human Papillomavirus
PVYELNDKNW

SEQ ID NO: 11696 - protein, 10 aa, Artificial Sequence
  Peptide Derived from Human Papillomavirus
PYLHNRLVVF

SEQ ID NO: 11697 - protein, 8 aa, Artificial Sequence
  Peptide Derived from Human Papillomavirus
QIVMFLRY

SEQ ID NO: 11698 - protein, 8 aa, Artificial Sequence
  Peptide Derived from Human Papillomavirus
QLKCPPLL

SEQ ID NO: 11699 - protein, 9 aa, Artificial Sequence
  Peptide Derived from Human Papillomavirus
QLKCPPLLI

SEQ ID NO: 11700 - protein, 8 aa, Artificial Sequence
  Peptide Derived from Human Papillomavirus
QMSMSQWI

SEQ ID NO: 11701 - protein, 10 aa, Artificial Sequence
  Peptide Derived from Human Papillomavirus
QMSMSQWIKY

SEQ ID NO: 11702 - protein, 11 aa, Artificial Sequence
  Peptide Derived from Human Papillomavirus
QMVQWAYDNDI

SEQ ID NO: 11703 - protein, 8 aa, Artificial Sequence
  Peptide Derived from Human Papillomavirus
QTPLTNIL

SEQ ID NO: 11704 - protein, 11 aa, Artificial Sequence
  Peptide Derived from Human Papillomavirus
QTPLTNILNVL

SEQ ID NO: 11705 - protein, 8 aa, Artificial Sequence
  Peptide Derived from Human Papillomavirus
QTVLQHSF

SEQ ID NO: 11706 - protein, 8 aa, Artificial Sequence
  Peptide Derived from Human Papillomavirus
QVLKRKYL

SEQ ID NO: 11707 - protein, 8 aa, Artificial Sequence
  Peptide Derived from Human Papillomavirus
QWAYDNDI

SEQ ID NO: 11708 - protein, 8 aa, Artificial Sequence
  Peptide Derived from Human Papillomavirus
QYCLYLHI

SEQ ID NO: 11709 - protein, 11 aa, Artificial Sequence
  Peptide Derived from Human Papillomavirus
QYCLYLHIQSL

SEQ ID NO: 11710 - protein, 10 aa, Artificial Sequence
  Peptide Derived from Human Papillomavirus
RLFESEDSGY

SEQ ID NO: 11711 - protein, 11 aa, Artificial Sequence
  Peptide Derived from Human Papillomavirus
RLVVFTFPNEF

SEQ ID NO: 11712 - protein, 8 aa, Artificial Sequence
  Peptide Derived from Human Papillomavirus
RTWSRLSL

SEQ ID NO: 11713 - protein, 8 aa, Artificial Sequence
  Peptide Derived from Human Papillomavirus
RVDDGGDW

SEQ ID NO: 11714 - protein, 11 aa, Artificial Sequence
  Peptide Derived from Human Papillomavirus
RVDDGGDWKQI

SEQ ID NO: 11715 - protein, 9 aa, Artificial Sequence
  Peptide Derived from Human Papillomavirus
RWPYLHNRL

SEQ ID NO: 11716 - protein, 11 aa, Artificial Sequence
  Peptide Derived from Human Papillomavirus
RYKCGKNRETI

SEQ ID NO: 11717 - protein, 8 aa, Artificial Sequence
  Peptide Derived from Human Papillomavirus
RYQGVEFM

SEQ ID NO: 11718 - protein, 10 aa, Artificial Sequence
  Peptide Derived from Human Papillomavirus
RYQGVEFMSF

SEQ ID NO: 11719 - protein, 11 aa, Artificial Sequence
  Peptide Derived from Human Papillomavirus
RYQGVEFMSFL

SEQ ID NO: 11720 - protein, 10 aa, Artificial Sequence
  Peptide Derived from Human Papillomavirus
SFFSRTWSRL

SEQ ID NO: 11721 - protein, 9 aa, Artificial Sequence
  Peptide Derived from Human Papillomavirus
SFLTALKRF

SEQ ID NO: 11722 - protein, 10 aa, Artificial Sequence
  Peptide Derived from Human Papillomavirus
SFLTALKRFL

SEQ ID NO: 11723 - protein, 9 aa, Artificial Sequence
  Peptide Derived from Human Papillomavirus
SFNDCTFEL

SEQ ID NO: 11724 - protein, 9 aa, Artificial Sequence
  Peptide Derived from Human Papillomavirus
SFSELVRPF

SEQ ID NO: 11725 - protein, 9 aa, Artificial Sequence
  Peptide Derived from Human Papillomavirus
SIADSIKTL

SEQ ID NO: 11726 - protein, 10 aa, Artificial Sequence
  Peptide Derived from Human Papillomavirus
SIADSIKTLL

SEQ ID NO: 11727 - protein, 9 aa, Artificial Sequence
  Peptide Derived from Human Papillomavirus
SIKTLLQQY

SEQ ID NO: 11728 - protein, 11 aa, Artificial Sequence
  Peptide Derived from Human Papillomavirus
SIKTLLQQYCL

SEQ ID NO: 11729 - protein, 8 aa, Artificial Sequence
  Peptide Derived from Human Papillomavirus
SLACSWGM

SEQ ID NO: 11730 - protein, 11 aa, Artificial Sequence
  Peptide Derived from Human Papillomavirus
SLACSWGMVVL

SEQ ID NO: 11731 - protein, 8 aa, Artificial Sequence
  Peptide Derived from Human Papillomavirus
SLFGMSLM

SEQ ID NO: 11732 - protein, 10 aa, Artificial Sequence
  Peptide Derived from Human Papillomavirus
SLFGMSLMKF

SEQ ID NO: 11733 - protein, 11 aa, Artificial Sequence
  Peptide Derived from Human Papillomavirus
SLFGMSLMKFL

SEQ ID NO: 11734 - protein, 11 aa, Artificial Sequence
  Peptide Derived from Human Papillomavirus
SLMKFLQGSVI

SEQ ID NO: 11735 - protein, 9 aa, Artificial Sequence
  Peptide Derived from Human Papillomavirus
SMDVKHRPL

SEQ ID NO: 11736 - protein, 8 aa, Artificial Sequence
  Peptide Derived from Human Papillomavirus
SMSQWIKY

SEQ ID NO: 11737 - protein, 8 aa, Artificial Sequence
  Peptide Derived from Human Papillomavirus
STAAALYW

SEQ ID NO: 11738 - protein, 9 aa, Artificial Sequence
  Peptide Derived from Human Papillomavirus
STAAALYWY

SEQ ID NO: 11739 - protein, 8 aa, Artificial Sequence
  Peptide Derived from Human Papillomavirus
STCCDWCI

SEQ ID NO: 11740 - protein, 11 aa, Artificial Sequence
  Peptide Derived from Human Papillomavirus
STCCDWCIAAF

SEQ ID NO: 11741 - protein, 8 aa, Artificial Sequence
  Peptide Derived from Human Papillomavirus
SWGMVVLL

SEQ ID NO: 11742 - protein, 9 aa, Artificial Sequence
  Peptide Derived from Human Papillomavirus
SWGMVVLLL

SEQ ID NO: 11743 - protein, 10 aa, Artificial Sequence
  Peptide Derived from Human Papillomavirus
TFELSQMVQW

SEQ ID NO: 11744 - protein, 8 aa, Artificial Sequence
  Peptide Derived from Human Papillomavirus
TFPNEFPF

SEQ ID NO: 11745 - protein, 10 aa, Artificial Sequence
  Peptide Derived from Human Papillomavirus
TICQTPLTNI

SEQ ID NO: 11746 - protein, 11 aa, Artificial Sequence
  Peptide Derived from Human Papillomavirus
TICQTPLTNIL

SEQ ID NO: 11747 - protein, 9 aa, Artificial Sequence
  Peptide Derived from Human Papillomavirus
TIEKLLSKL

SEQ ID NO: 11748 - protein, 10 aa, Artificial Sequence
  Peptide Derived from Human Papillomavirus
TIEKLLSKLL

SEQ ID NO: 11749 - protein, 8 aa, Artificial Sequence
  Peptide Derived from Human Papillomavirus
TLLQQYCL

SEQ ID NO: 11750 - protein, 9 aa, Artificial Sequence
  Peptide Derived from Human Papillomavirus
TLLQQYCLY

SEQ ID NO: 11751 - protein, 10 aa, Artificial Sequence
  Peptide Derived from Human Papillomavirus
TLLQQYCLYL

SEQ ID NO: 11752 - protein, 8 aa, Artificial Sequence
  Peptide Derived from Human Papillomavirus
TVPCWNYI

SEQ ID NO: 11753 - protein, 8 aa, Artificial Sequence
  Peptide Derived from Human Papillomavirus
VFTFPNEF

SEQ ID NO: 11754 - protein, 10 aa, Artificial Sequence
  Peptide Derived from Human Papillomavirus
VFTFPNEFPF

SEQ ID NO: 11755 - protein, 11 aa, Artificial Sequence
  Peptide Derived from Human Papillomavirus
VICFVNSKSHF

SEQ ID NO: 11756 - protein, 11 aa, Artificial Sequence
  Peptide Derived from Human Papillomavirus
VLKRKYLVSPL

SEQ ID NO: 11757 - protein, 11 aa, Artificial Sequence
  Peptide Derived from Human Papillomavirus
VLKTSNAKAAM

SEQ ID NO: 11758 - protein, 11 aa, Artificial Sequence
  Peptide Derived from Human Papillomavirus
VLQHSFNDCTF

SEQ ID NO: 11759 - protein, 11 aa, Artificial Sequence
  Peptide Derived from Human Papillomavirus
VMFLRYQGVEF

SEQ ID NO: 11760 - protein, 10 aa, Artificial Sequence
  Peptide Derived from Human Papillomavirus
VVEKKTGDAI

SEQ ID NO: 11761 - protein, 9 aa, Artificial Sequence
  Peptide Derived from Human Papillomavirus
VVFTFPNEF

SEQ ID NO: 11762 - protein, 11 aa, Artificial Sequence
  Peptide Derived from Human Papillomavirus
VVFTFPNEFPF

SEQ ID NO: 11763 - protein, 8 aa, Artificial Sequence
  Peptide Derived from Human Papillomavirus
VVLLLVRY

SEQ ID NO: 11764 - protein, 9 aa, Artificial Sequence
  Peptide Derived from Human Papillomavirus
VYELNDKNW

SEQ ID NO: 11765 - protein, 8 aa, Artificial Sequence
  Peptide Derived from Human Papillomavirus
VYGDTPEW

SEQ ID NO: 11766 - protein, 9 aa, Artificial Sequence
  Peptide Derived from Human Papillomavirus
VYGDTPEWI

SEQ ID NO: 11767 - protein, 8 aa, Artificial Sequence
  Peptide Derived from Human Papillomavirus
WIQRQTVL

SEQ ID NO: 11768 - protein, 10 aa, Artificial Sequence
  Peptide Derived from Human Papillomavirus
WLQPLADAKI

SEQ ID NO: 11769 - protein, 9 aa, Artificial Sequence
  Peptide Derived from Human Papillomavirus
WYKTGISNI

SEQ ID NO: 11770 - protein, 10 aa, Artificial Sequence
  Peptide Derived from Human Papillomavirus
YIDDNLRNAL

SEQ ID NO: 11771 - protein, 11 aa, Artificial Sequence
  Peptide Derived from Human Papillomavirus
YLHIQSLACSW

SEQ ID NO: 11772 - protein, 9 aa, Artificial Sequence
  Peptide Derived from Human Papillomavirus
YLHNRLVVF

SEQ ID NO: 11773 - protein, 11 aa, Artificial Sequence
  Peptide Derived from Human Papillomavirus
YLHNRLVVFTF

SEQ ID NO: 11774 - protein, 9 aa, Artificial Sequence
  Peptide Derived from Human Papillomavirus
YLVSPLSDI

SEQ ID NO: 11775 - protein, 10 aa, Artificial Sequence
  Peptide Derived from Human Papillomavirus
YWYKTGISNI

SEQ ID NO: 11776 - protein, 10 aa, Artificial Sequence
  Peptide Derived from Human Papillomavirus
AFNSSHKGRI

SEQ ID NO: 11777 - protein, 8 aa, Artificial Sequence
  Peptide Derived from Human Papillomavirus
AIELQLTL

SEQ ID NO: 11778 - protein, 11 aa, Artificial Sequence
  Peptide Derived from Human Papillomavirus
AIELQLTLETI

SEQ ID NO: 11779 - protein, 11 aa, Artificial Sequence
  Peptide Derived from Human Papillomavirus
AIVTLTYDSEW

SEQ ID NO: 11780 - protein, 9 aa, Artificial Sequence
  Peptide Derived from Human Papillomavirus
AIYYKAREM

SEQ ID NO: 11781 - protein, 11 aa, Artificial Sequence
  Peptide Derived from Human Papillomavirus
AIYYKAREMGF

SEQ ID NO: 11782 - protein, 11 aa, Artificial Sequence
  Peptide Derived from Human Papillomavirus
ALGTEETQTTI

SEQ ID NO: 11783 - protein, 9 aa, Artificial Sequence
  Peptide Derived from Human Papillomavirus
ALQAIELQL

SEQ ID NO: 11784 - protein, 11 aa, Artificial Sequence
  Peptide Derived from Human Papillomavirus
ALQAIELQLTL

SEQ ID NO: 11785 - protein, 9 aa, Artificial Sequence
  Peptide Derived from Human Papillomavirus
ATHTKAVAL

SEQ ID NO: 11786 - protein, 8 aa, Artificial Sequence
  Peptide Derived from Human Papillomavirus
AVSKNKAL

SEQ ID NO: 11787 - protein, 11 aa, Artificial Sequence
  Peptide Derived from Human Papillomavirus
AVSKNKALQAI

SEQ ID NO: 11788 - protein, 8 aa, Artificial Sequence
  Peptide Derived from Human Papillomavirus
AVSSTWHW

SEQ ID NO: 11789 - protein, 11 aa, Artificial Sequence
  Peptide Derived from Human Papillomavirus
CTLYTAVSSTW

SEQ ID NO: 11790 - protein, 8 aa, Artificial Sequence
  Peptide Derived from Human Papillomavirus
DICNTMHY

SEQ ID NO: 11791 - protein, 11 aa, Artificial Sequence
  Peptide Derived from Human Papillomavirus
DICNTMHYTNW

SEQ ID NO: 11792 - protein, 8 aa, Artificial Sequence
  Peptide Derived from Human Papillomavirus
DLRDHIDY

SEQ ID NO: 11793 - protein, 9 aa, Artificial Sequence
  Peptide Derived from Human Papillomavirus
DLRDHIDYW

SEQ ID NO: 11794 - protein, 11 aa, Artificial Sequence
  Peptide Derived from Human Papillomavirus
DTGNPCHTTKL

SEQ ID NO: 11795 - protein, 8 aa, Artificial Sequence
  Peptide Derived from Human Papillomavirus
DVSLEVYL

SEQ ID NO: 11796 - protein, 8 aa, Artificial Sequence
  Peptide Derived from Human Papillomavirus
DYWKHMRL

SEQ ID NO: 11797 - protein, 9 aa, Artificial Sequence
  Peptide Derived from Human Papillomavirus
ELQLTLETI

SEQ ID NO: 11798 - protein, 10 aa, Artificial Sequence
  Peptide Derived from Human Papillomavirus
ELQLTLETIY

SEQ ID NO: 11799 - protein, 8 aa, Artificial Sequence
  Peptide Derived from Human Papillomavirus
ETIYNSQY

SEQ ID NO: 11800 - protein, 9 aa, Artificial Sequence
  Peptide Derived from Human Papillomavirus
EVHAGGQVI

SEQ ID NO: 11801 - protein, 10 aa, Artificial Sequence
  Peptide Derived from Human Papillomavirus
EVHAGGQVIL

SEQ ID NO: 11802 - protein, 8 aa, Artificial Sequence
  Peptide Derived from Human Papillomavirus
EVQFDGDI

SEQ ID NO: 11803 - protein, 8 aa, Artificial Sequence
  Peptide Derived from Human Papillomavirus
EVSSPEII

SEQ ID NO: 11804 - protein, 11 aa, Artificial Sequence
  Peptide Derived from Human Papillomavirus
EVYLTAPTGCI

SEQ ID NO: 11805 - protein, 8 aa, Artificial Sequence
  Peptide Derived from Human Papillomavirus
EWQRDQFL

SEQ ID NO: 11806 - protein, 11 aa, Artificial Sequence
  Peptide Derived from Human Papillomavirus
FLSQVKIPKTI

SEQ ID NO: 11807 - protein, 11 aa, Artificial Sequence
  Peptide Derived from Human Papillomavirus
FVQFKDDAEKY

SEQ ID NO: 11808 - protein, 9 aa, Artificial Sequence
  Peptide Derived from Human Papillomavirus
GIRTYFVQF

SEQ ID NO: 11809 - protein, 9 aa, Artificial Sequence
  Peptide Derived from Human Papillomavirus
GLYYVHEGI

SEQ ID NO: 11810 - protein, 9 aa, Artificial Sequence
  Peptide Derived from Human Papillomavirus
GTEETQTTI

SEQ ID NO: 11811 - protein, 8 aa, Artificial Sequence
  Peptide Derived from Human Papillomavirus
GYTVEVQF

SEQ ID NO: 11812 - protein, 8 aa, Artificial Sequence
  Peptide Derived from Human Papillomavirus
HIDYWKHM

SEQ ID NO: 11813 - protein, 10 aa, Artificial Sequence
  Peptide Derived from Human Papillomavirus
HIDYWKHMRL

SEQ ID NO: 11814 - protein, 10 aa, Artificial Sequence
  Peptide Derived from Human Papillomavirus
HINHQVVPTL

SEQ ID NO: 11815 - protein, 9 aa, Artificial Sequence
  Peptide Derived from Human Papillomavirus
HLKGDANTL

SEQ ID NO: 11816 - protein, 8 aa, Artificial Sequence
  Peptide Derived from Human Papillomavirus
HMRLECAI

SEQ ID NO: 11817 - protein, 9 aa, Artificial Sequence
  Peptide Derived from Human Papillomavirus
HMRLECAIY

SEQ ID NO: 11818 - protein, 10 aa, Artificial Sequence
  Peptide Derived from Human Papillomavirus
HMRLECAIYY

SEQ ID NO: 11819 - protein, 9 aa, Artificial Sequence
  Peptide Derived from Human Papillomavirus
HYENDSTDL

SEQ ID NO: 11820 - protein, 8 aa, Artificial Sequence
  Peptide Derived from Human Papillomavirus
HYTNWTHI

SEQ ID NO: 11821 - protein, 9 aa, Artificial Sequence
  Peptide Derived from Human Papillomavirus
HYTNWTHIY

SEQ ID NO: 11822 - protein, 10 aa, Artificial Sequence
  Peptide Derived from Human Papillomavirus
HYTNWTHIYI

SEQ ID NO: 11823 - protein, 8 aa, Artificial Sequence
  Peptide Derived from Human Papillomavirus
ILCPTSVF

SEQ ID NO: 11824 - protein, 8 aa, Artificial Sequence
  Peptide Derived from Human Papillomavirus
ITVSTGFM

SEQ ID NO: 11825 - protein, 10 aa, Artificial Sequence
  Peptide Derived from Human Papillomavirus
ITVSTGFMSI

SEQ ID NO: 11826 - protein, 11 aa, Artificial Sequence
  Peptide Derived from Human Papillomavirus
IVHLKGDANTL

SEQ ID NO: 11827 - protein, 10 aa, Artificial Sequence
  Peptide Derived from Human Papillomavirus
IVTLTYDSEW

SEQ ID NO: 11828 - protein, 11 aa, Artificial Sequence
  Peptide Derived from Human Papillomavirus
IYNSQYSNEKW

SEQ ID NO: 11829 - protein, 8 aa, Artificial Sequence
  Peptide Derived from Human Papillomavirus
IYYKAREM

SEQ ID NO: 11830 - protein, 10 aa, Artificial Sequence
  Peptide Derived from Human Papillomavirus
IYYKAREMGF

SEQ ID NO: 11831 - protein, 9 aa, Artificial Sequence
  Peptide Derived from Human Papillomavirus
KTITVSTGF

SEQ ID NO: 11832 - protein, 10 aa, Artificial Sequence
  Peptide Derived from Human Papillomavirus
KTITVSTGFM

SEQ ID NO: 11833 - protein, 9 aa, Artificial Sequence
  Peptide Derived from Human Papillomavirus
KWTLQDVSL

SEQ ID NO: 11834 - protein, 8 aa, Artificial Sequence
  Peptide Derived from Human Papillomavirus
KYSKNKVW

SEQ ID NO: 11835 - protein, 8 aa, Artificial Sequence
  Peptide Derived from Human Papillomavirus
LTAPTGCI

SEQ ID NO: 11836 - protein, 11 aa, Artificial Sequence
  Peptide Derived from Human Papillomavirus
LTHYENDSTDL

SEQ ID NO: 11837 - protein, 11 aa, Artificial Sequence
  Peptide Derived from Human Papillomavirus
LTLETIYNSQY

SEQ ID NO: 11838 - protein, 9 aa, Artificial Sequence
  Peptide Derived from Human Papillomavirus
LYTAVSSTW

SEQ ID NO: 11839 - protein, 11 aa, Artificial Sequence
  Peptide Derived from Human Papillomavirus
LYTAVSSTWHW

SEQ ID NO: 11840 - protein, 8 aa, Artificial Sequence
  Peptide Derived from Human Papillomavirus
LYYVHEGI

SEQ ID NO: 11841 - protein, 11 aa, Artificial Sequence
  Peptide Derived from Human Papillomavirus
LYYVHEGIRTY

SEQ ID NO: 11842 - protein, 8 aa, Artificial Sequence
  Peptide Derived from Human Papillomavirus
NTLKCLRY

SEQ ID NO: 11843 - protein, 10 aa, Artificial Sequence
  Peptide Derived from Human Papillomavirus
NTLKCLRYRF

SEQ ID NO: 11844 - protein, 8 aa, Artificial Sequence
  Peptide Derived from Human Papillomavirus
NTMHYTNW

SEQ ID NO: 11845 - protein, 11 aa, Artificial Sequence
  Peptide Derived from Human Papillomavirus
NTMHYTNWTHI

SEQ ID NO: 11846 - protein, 8 aa, Artificial Sequence
  Peptide Derived from Human Papillomavirus
NTTPIVHL

SEQ ID NO: 11847 - protein, 8 aa, Artificial Sequence
  Peptide Derived from Human Papillomavirus
NVCQDKIL

SEQ ID NO: 11848 - protein, 11 aa, Artificial Sequence
  Peptide Derived from Human Papillomavirus
NVCQDKILTHY

SEQ ID NO: 11849 - protein, 8 aa, Artificial Sequence
  Peptide Derived from Human Papillomavirus
NVKHKSAI

SEQ ID NO: 11850 - protein, 11 aa, Artificial Sequence
  Peptide Derived from Human Papillomavirus
NVKHKSAIVTL

SEQ ID NO: 11851 - protein, 10 aa, Artificial Sequence
  Peptide Derived from Human Papillomavirus
PTGCIKKHGY

SEQ ID NO: 11852 - protein, 11 aa, Artificial Sequence
  Peptide Derived from Human Papillomavirus
PTLAVSKNKAL

SEQ ID NO: 11853 - protein, 10 aa, Artificial Sequence
  Peptide Derived from Human Papillomavirus
QFDGDICNTM

SEQ ID NO: 11854 - protein, 9 aa, Artificial Sequence
  Peptide Derived from Human Papillomavirus
QFKDDAEKY

SEQ ID NO: 11855 - protein, 8 aa, Artificial Sequence
  Peptide Derived from Human Papillomavirus
QFLSQVKI

SEQ ID NO: 11856 - protein, 8 aa, Artificial Sequence
  Peptide Derived from Human Papillomavirus
QLTLETIY

SEQ ID NO: 11857 - protein, 8 aa, Artificial Sequence
  Peptide Derived from Human Papillomavirus
QVDYYGLY

SEQ ID NO: 11858 - protein, 9 aa, Artificial Sequence
  Peptide Derived from Human Papillomavirus
QVDYYGLYY

SEQ ID NO: 11859 - protein, 10 aa, Artificial Sequence
  Peptide Derived from Human Papillomavirus
QVILCPTSVF

SEQ ID NO: 11860 - protein, 8 aa, Artificial Sequence
  Peptide Derived from Human Papillomavirus
QVKIPKTI

SEQ ID NO: 11861 - protein, 9 aa, Artificial Sequence
  Peptide Derived from Human Papillomavirus
QYSNEKWTL

SEQ ID NO: 11862 - protein, 8 aa, Artificial Sequence
  Peptide Derived from Human Papillomavirus
RFKKHCTL

SEQ ID NO: 11863 - protein, 9 aa, Artificial Sequence
  Peptide Derived from Human Papillomavirus
RFKKHCTLY

SEQ ID NO: 11864 - protein, 11 aa, Artificial Sequence
  Peptide Derived from Human Papillomavirus
RINCNSNTTPI

SEQ ID NO: 11865 - protein, 8 aa, Artificial Sequence
  Peptide Derived from Human Papillomavirus
RLECAIYY

SEQ ID NO: 11866 - protein, 9 aa, Artificial Sequence
  Peptide Derived from Human Papillomavirus
RLNVCQDKI

SEQ ID NO: 11867 - protein, 10 aa, Artificial Sequence
  Peptide Derived from Human Papillomavirus
RLNVCQDKIL

SEQ ID NO: 11868 - protein, 10 aa, Artificial Sequence
  Peptide Derived from Human Papillomavirus
RYRFKKHCTL

SEQ ID NO: 11869 - protein, 11 aa, Artificial Sequence
  Peptide Derived from Human Papillomavirus
RYRFKKHCTLY

SEQ ID NO: 11870 - protein, 8 aa, Artificial Sequence
  Peptide Derived from Human Papillomavirus
STDLRDHI

SEQ ID NO: 11871 - protein, 10 aa, Artificial Sequence
  Peptide Derived from Human Papillomavirus
STDLRDHIDY

SEQ ID NO: 11872 - protein, 11 aa, Artificial Sequence
  Peptide Derived from Human Papillomavirus
STDLRDHIDYW

SEQ ID NO: 11873 - protein, 8 aa, Artificial Sequence
  Peptide Derived from Human Papillomavirus
SVDSAPIL

SEQ ID NO: 11874 - protein, 11 aa, Artificial Sequence
  Peptide Derived from Human Papillomavirus
SVDSAPILTAF

SEQ ID NO: 11875 - protein, 11 aa, Artificial Sequence
  Peptide Derived from Human Papillomavirus
SVTVVEGQVDY

SEQ ID NO: 11876 - protein, 8 aa, Artificial Sequence
  Peptide Derived from Human Papillomavirus
TITVSTGF

SEQ ID NO: 11877 - protein, 9 aa, Artificial Sequence
  Peptide Derived from Human Papillomavirus
TITVSTGFM

SEQ ID NO: 11878 - protein, 11 aa, Artificial Sequence
  Peptide Derived from Human Papillomavirus
TITVSTGFMSI

SEQ ID NO: 11879 - protein, 10 aa, Artificial Sequence
  Peptide Derived from Human Papillomavirus
TLAVSKNKAL

SEQ ID NO: 11880 - protein, 10 aa, Artificial Sequence
  Peptide Derived from Human Papillomavirus
TLETIYNSQY

SEQ ID NO: 11881 - protein, 9 aa, Artificial Sequence
  Peptide Derived from Human Papillomavirus
TLKCLRYRF

SEQ ID NO: 11882 - protein, 10 aa, Artificial Sequence
  Peptide Derived from Human Papillomavirus
TLQDVSLEVY

SEQ ID NO: 11883 - protein, 11 aa, Artificial Sequence
  Peptide Derived from Human Papillomavirus
TLQDVSLEVYL

SEQ ID NO: 11884 - protein, 8 aa, Artificial Sequence
  Peptide Derived from Human Papillomavirus
TLTYDSEW

SEQ ID NO: 11885 - protein, 10 aa, Artificial Sequence
  Peptide Derived from Human Papillomavirus
TLYTAVSSTW

SEQ ID NO: 11886 - protein, 10 aa, Artificial Sequence
  Peptide Derived from Human Papillomavirus
TMHYTNWTHI

SEQ ID NO: 11887 - protein, 11 aa, Artificial Sequence
  Peptide Derived from Human Papillomavirus
TMHYTNWTHIY

SEQ ID NO: 11888 - protein, 10 aa, Artificial Sequence
  Peptide Derived from Human Papillomavirus
TVEVQFDGDI

SEQ ID NO: 11889 - protein, 9 aa, Artificial Sequence
  Peptide Derived from Human Papillomavirus
TVSTGFMSI

SEQ ID NO: 11890 - protein, 9 aa, Artificial Sequence
  Peptide Derived from Human Papillomavirus
TVVEGQVDY

SEQ ID NO: 11891 - protein, 10 aa, Artificial Sequence
  Peptide Derived from Human Papillomavirus
TVVEGQVDYY

SEQ ID NO: 11892 - protein, 11 aa, Artificial Sequence
  Peptide Derived from Human Papillomavirus
TYDSEWQRDQF

SEQ ID NO: 11893 - protein, 9 aa, Artificial Sequence
  Peptide Derived from Human Papillomavirus
VILCPTSVF

SEQ ID NO: 11894 - protein, 9 aa, Artificial Sequence
  Peptide Derived from Human Papillomavirus
VTLTYDSEW

SEQ ID NO: 11895 - protein, 10 aa, Artificial Sequence
  Peptide Derived from Human Papillomavirus
VTVVEGQVDY

SEQ ID NO: 11896 - protein, 11 aa, Artificial Sequence
  Peptide Derived from Human Papillomavirus
VTVVEGQVDYY

SEQ ID NO: 11897 - protein, 8 aa, Artificial Sequence
  Peptide Derived from Human Papillomavirus
VVEGQVDY

SEQ ID NO: 11898 - protein, 9 aa, Artificial Sequence
  Peptide Derived from Human Papillomavirus
VVEGQVDYY

SEQ ID NO: 11899 - protein, 11 aa, Artificial Sequence
  Peptide Derived from Human Papillomavirus
VVEGQVDYYGL

SEQ ID NO: 11900 - protein, 11 aa, Artificial Sequence
  Peptide Derived from Human Papillomavirus
VWEVHAGGQVI

SEQ ID NO: 11901 - protein, 10 aa, Artificial Sequence
  Peptide Derived from Human Papillomavirus
VYLTAPTGCI

SEQ ID NO: 11902 - protein, 8 aa, Artificial Sequence
  Peptide Derived from Human Papillomavirus
WTLQDVSL

SEQ ID NO: 11903 - protein, 11 aa, Artificial Sequence
  Peptide Derived from Human Papillomavirus
WTLQDVSLEVY

SEQ ID NO: 11904 - protein, 9 aa, Artificial Sequence
  Peptide Derived from Human Papillomavirus
YLTAPTGCI

SEQ ID NO: 11905 - protein, 8 aa, Artificial Sequence
  Peptide Derived from Human Papillomavirus
YTAVSSTW

SEQ ID NO: 11906 - protein, 10 aa, Artificial Sequence
  Peptide Derived from Human Papillomavirus
YTAVSSTWHW

SEQ ID NO: 11907 - protein, 8 aa, Artificial Sequence
  Peptide Derived from Human Papillomavirus
YTNWTHIY

SEQ ID NO: 11908 - protein, 9 aa, Artificial Sequence
  Peptide Derived from Human Papillomavirus
YTNWTHIYI

SEQ ID NO: 11909 - protein, 11 aa, Artificial Sequence
  Peptide Derived from Human Papillomavirus
YTVEVQFDGDI

SEQ ID NO: 11910 - protein, 9 aa, Artificial Sequence
  Peptide Derived from Human Papillomavirus
YVHEGIRTY

SEQ ID NO: 11911 - protein, 10 aa, Artificial Sequence
  Peptide Derived from Human Papillomavirus
YVHEGIRTYF

SEQ ID NO: 11912 - protein, 11 aa, Artificial Sequence
  Peptide Derived from Human Papillomavirus
YWKHMRLECAI

SEQ ID NO: 11913 - protein, 11 aa, Artificial Sequence
  Peptide Derived from Human Papillomavirus
YYGLYYVHEGI

SEQ ID NO: 11914 - protein, 9 aa, Artificial Sequence
  Peptide Derived from Human Papillomavirus
YYKAREMGF

SEQ ID NO: 11915 - protein, 10 aa, Artificial Sequence
  Peptide Derived from Human Papillomavirus
YYVHEGIRTY

SEQ ID NO: 11916 - protein, 11 aa, Artificial Sequence
  Peptide Derived from Human Papillomavirus
YYVHEGIRTYF

SEQ ID NO: 11917 - protein, 8 aa, Artificial Sequence
  Peptide Derived from Human Papillomavirus
AFRCFIVY

SEQ ID NO: 11918 - protein, 9 aa, Artificial Sequence
  Peptide Derived from Human Papillomavirus
AFRCFIVYI

SEQ ID NO: 11919 - protein, 10 aa, Artificial Sequence
  Peptide Derived from Human Papillomavirus
AFRCFIVYII

SEQ ID NO: 11920 - protein, 11 aa, Artificial Sequence
  Peptide Derived from Human Papillomavirus
AFRCFIVYIIF

SEQ ID NO: 11921 - protein, 10 aa, Artificial Sequence
  Peptide Derived from Human Papillomavirus
CFCVLLCVCL

SEQ ID NO: 11922 - protein, 11 aa, Artificial Sequence
  Peptide Derived from Human Papillomavirus
CFCVLLCVCLL

SEQ ID NO: 11923 - protein, 8 aa, Artificial Sequence
  Peptide Derived from Human Papillomavirus
CFIVYIIF

SEQ ID NO: 11924 - protein, 10 aa, Artificial Sequence
  Peptide Derived from Human Papillomavirus
CFIVYIIFVY

SEQ ID NO: 11925 - protein, 11 aa, Artificial Sequence
  Peptide Derived from Human Papillomavirus
CFIVYIIFVYI

SEQ ID NO: 11926 - protein, 9 aa, Artificial Sequence
  Peptide Derived from Human Papillomavirus
CFLLCFCVL

SEQ ID NO: 11927 - protein, 10 aa, Artificial Sequence
  Peptide Derived from Human Papillomavirus
CFLLCFCVLL

SEQ ID NO: 11928 - protein, 8 aa, Artificial Sequence
  Peptide Derived from Human Papillomavirus
CLLIRPLL

SEQ ID NO: 11929 - protein, 9 aa, Artificial Sequence
  Peptide Derived from Human Papillomavirus
CLLIRPLLL

SEQ ID NO: 11930 - protein, 9 aa, Artificial Sequence
  Peptide Derived from Human Papillomavirus
CVCLLIRPL

SEQ ID NO: 11931 - protein, 10 aa, Artificial Sequence
  Peptide Derived from Human Papillomavirus
CVCLLIRPLL

SEQ ID NO: 11932 - protein, 11 aa, Artificial Sequence
  Peptide Derived from Human Papillomavirus
CVCLLIRPLLL

SEQ ID NO: 11933 - protein, 8 aa, Artificial Sequence
  Peptide Derived from Human Papillomavirus
CVLLCVCL

SEQ ID NO: 11934 - protein, 9 aa, Artificial Sequence
  Peptide Derived from Human Papillomavirus
CVLLCVCLL

SEQ ID NO: 11935 - protein, 10 aa, Artificial Sequence
  Peptide Derived from Human Papillomavirus
CVLLCVCLLI

SEQ ID NO: 11936 - protein, 8 aa, Artificial Sequence
  Peptide Derived from Human Papillomavirus
DTASTTLL

SEQ ID NO: 11937 - protein, 11 aa, Artificial Sequence
  Peptide Derived from Human Papillomavirus
DTASTTLLACF

SEQ ID NO: 11938 - protein, 9 aa, Artificial Sequence
  Peptide Derived from Human Papillomavirus
FIVYIIFVY

SEQ ID NO: 11939 - protein, 10 aa, Artificial Sequence
  Peptide Derived from Human Papillomavirus
FIVYIIFVYI

SEQ ID NO: 11940 - protein, 9 aa, Artificial Sequence
  Peptide Derived from Human Papillomavirus
FLIHTHARF

SEQ ID NO: 11941 - protein, 10 aa, Artificial Sequence
  Peptide Derived from Human Papillomavirus
FLIHTHARFL

SEQ ID NO: 11942 - protein, 11 aa, Artificial Sequence
  Peptide Derived from Human Papillomavirus
FLIHTHARFLI

SEQ ID NO: 11943 - protein, 8 aa, Artificial Sequence
  Peptide Derived from Human Papillomavirus
FLLCFCVL

SEQ ID NO: 11944 - protein, 9 aa, Artificial Sequence
  Peptide Derived from Human Papillomavirus
FLLCFCVLL

SEQ ID NO: 11945 - protein, 8 aa, Artificial Sequence
  Peptide Derived from Human Papillomavirus
FVYIPLFL

SEQ ID NO: 11946 - protein, 9 aa, Artificial Sequence
  Peptide Derived from Human Papillomavirus
FVYIPLFLI

SEQ ID NO: 11947 - protein, 8 aa, Artificial Sequence
  Peptide Derived from Human Papillomavirus
HTHARFLI

SEQ ID NO: 11948 - protein, 8 aa, Artificial Sequence
  Peptide Derived from Human Papillomavirus
IFVYIPLF

SEQ ID NO: 11949 - protein, 9 aa, Artificial Sequence
  Peptide Derived from Human Papillomavirus
IFVYIPLFL

SEQ ID NO: 11950 - protein, 10 aa, Artificial Sequence
  Peptide Derived from Human Papillomavirus
IFVYIPLFLI

SEQ ID NO: 11951 - protein, 8 aa, Artificial Sequence
  Peptide Derived from Human Papillomavirus
IIFVYIPL

SEQ ID NO: 11952 - protein, 9 aa, Artificial Sequence
  Peptide Derived from Human Papillomavirus
IIFVYIPLF

SEQ ID NO: 11953 - protein, 10 aa, Artificial Sequence
  Peptide Derived from Human Papillomavirus
IIFVYIPLFL

SEQ ID NO: 11954 - protein, 11 aa, Artificial Sequence
  Peptide Derived from Human Papillomavirus
IIFVYIPLFLI

SEQ ID NO: 11955 - protein, 8 aa, Artificial Sequence
  Peptide Derived from Human Papillomavirus
IILVLLLW

SEQ ID NO: 11956 - protein, 9 aa, Artificial Sequence
  Peptide Derived from Human Papillomavirus
IILVLLLWI

SEQ ID NO: 11957 - protein, 8 aa, Artificial Sequence
  Peptide Derived from Human Papillomavirus
ILVLLLWI

SEQ ID NO: 11958 - protein, 10 aa, Artificial Sequence
  Peptide Derived from Human Papillomavirus
ITAASAFRCF

SEQ ID NO: 11959 - protein, 11 aa, Artificial Sequence
  Peptide Derived from Human Papillomavirus
ITAASAFRCFI

SEQ ID NO: 11960 - protein, 8 aa, Artificial Sequence
  Peptide Derived from Human Papillomavirus
IVYIIFVY

SEQ ID NO: 11961 - protein, 9 aa, Artificial Sequence
  Peptide Derived from Human Papillomavirus
IVYIIFVYI

SEQ ID NO: 11962 - protein, 11 aa, Artificial Sequence
  Peptide Derived from Human Papillomavirus
IVYIIFVYIPL

SEQ ID NO: 11963 - protein, 10 aa, Artificial Sequence
  Peptide Derived from Human Papillomavirus
LFLIHTHARF

SEQ ID NO: 11964 - protein, 11 aa, Artificial Sequence
  Peptide Derived from Human Papillomavirus
LFLIHTHARFL

SEQ ID NO: 11965 - protein, 8 aa, Artificial Sequence
  Peptide Derived from Human Papillomavirus
LIHTHARF

SEQ ID NO: 11966 - protein, 9 aa, Artificial Sequence
  Peptide Derived from Human Papillomavirus
LIHTHARFL

SEQ ID NO: 11967 - protein, 10 aa, Artificial Sequence
  Peptide Derived from Human Papillomavirus
LIHTHARFLI

SEQ ID NO: 11968 - protein, 8 aa, Artificial Sequence
  Peptide Derived from Human Papillomavirus
LIILVLLL

SEQ ID NO: 11969 - protein, 9 aa, Artificial Sequence
  Peptide Derived from Human Papillomavirus
LIILVLLLW

SEQ ID NO: 11970 - protein, 10 aa, Artificial Sequence
  Peptide Derived from Human Papillomavirus
LIILVLLLWI

SEQ ID NO: 11971 - protein, 9 aa, Artificial Sequence
  Peptide Derived from Human Papillomavirus
LLACFLLCF

SEQ ID NO: 11972 - protein, 8 aa, Artificial Sequence
  Peptide Derived from Human Papillomavirus
LLCFCVLL

SEQ ID NO: 11973 - protein, 8 aa, Artificial Sequence
  Peptide Derived from Human Papillomavirus
LLCVCLLI

SEQ ID NO: 11974 - protein, 11 aa, Artificial Sequence
  Peptide Derived from Human Papillomavirus
LLCVCLLIRPL

SEQ ID NO: 11975 - protein, 8 aa, Artificial Sequence
  Peptide Derived from Human Papillomavirus
LLIRPLLL

SEQ ID NO: 11976 - protein, 8 aa, Artificial Sequence
  Peptide Derived from Human Papillomavirus
LLLSVSTY

SEQ ID NO: 11977 - protein, 11 aa, Artificial Sequence
  Peptide Derived from Human Papillomavirus
LLLSVSTYTSL

SEQ ID NO: 11978 - protein, 11 aa, Artificial Sequence
  Peptide Derived from Human Papillomavirus
LLLWITAASAF

SEQ ID NO: 11979 - protein, 10 aa, Artificial Sequence
  Peptide Derived from Human Papillomavirus
LLSVSTYTSL

SEQ ID NO: 11980 - protein, 11 aa, Artificial Sequence
  Peptide Derived from Human Papillomavirus
LLSVSTYTSLI

SEQ ID NO: 11981 - protein, 10 aa, Artificial Sequence
  Peptide Derived from Human Papillomavirus
LLWITAASAF

SEQ ID NO: 11982 - protein, 9 aa, Artificial Sequence
  Peptide Derived from Human Papillomavirus
LWITAASAF

SEQ ID NO: 11983 - protein, 11 aa, Artificial Sequence
  Peptide Derived from Human Papillomavirus
MTNLDTASTTL

SEQ ID NO: 11984 - protein, 9 aa, Artificial Sequence
  Peptide Derived from Human Papillomavirus
NLDTASTTL

SEQ ID NO: 11985 - protein, 10 aa, Artificial Sequence
  Peptide Derived from Human Papillomavirus
NLDTASTTLL

SEQ ID NO: 11986 - protein, 11 aa, Artificial Sequence
  Peptide Derived from Human Papillomavirus
PLFLIHTHARF

SEQ ID NO: 11987 - protein, 9 aa, Artificial Sequence
  Peptide Derived from Human Papillomavirus
PLLLSVSTY

SEQ ID NO: 11988 - protein, 8 aa, Artificial Sequence
  Peptide Derived from Human Papillomavirus
SLIILVLL

SEQ ID NO: 11989 - protein, 9 aa, Artificial Sequence
  Peptide Derived from Human Papillomavirus
SLIILVLLL

SEQ ID NO: 11990 - protein, 10 aa, Artificial Sequence
  Peptide Derived from Human Papillomavirus
SLIILVLLLW

SEQ ID NO: 11991 - protein, 11 aa, Artificial Sequence
  Peptide Derived from Human Papillomavirus
SLIILVLLLWI

SEQ ID NO: 11992 - protein, 8 aa, Artificial Sequence
  Peptide Derived from Human Papillomavirus
STTLLACF

SEQ ID NO: 11993 - protein, 9 aa, Artificial Sequence
  Peptide Derived from Human Papillomavirus
STTLLACFL

SEQ ID NO: 11994 - protein, 10 aa, Artificial Sequence
  Peptide Derived from Human Papillomavirus
STTLLACFLL

SEQ ID NO: 11995 - protein, 8 aa, Artificial Sequence
  Peptide Derived from Human Papillomavirus
STYTSLII

SEQ ID NO: 11996 - protein, 9 aa, Artificial Sequence
  Peptide Derived from Human Papillomavirus
STYTSLIIL

SEQ ID NO: 11997 - protein, 11 aa, Artificial Sequence
  Peptide Derived from Human Papillomavirus
STYTSLIILVL

SEQ ID NO: 11998 - protein, 8 aa, Artificial Sequence
  Peptide Derived from Human Papillomavirus
SVSTYTSL

SEQ ID NO: 11999 - protein, 9 aa, Artificial Sequence
  Peptide Derived from Human Papillomavirus
SVSTYTSLI

SEQ ID NO: 12000 - protein, 10 aa, Artificial Sequence
  Peptide Derived from Human Papillomavirus
SVSTYTSLII

SEQ ID NO: 12001 - protein, 11 aa, Artificial Sequence
  Peptide Derived from Human Papillomavirus
SVSTYTSLIIL

SEQ ID NO: 12002 - protein, 8 aa, Artificial Sequence
  Peptide Derived from Human Papillomavirus
TLLACFLL

SEQ ID NO: 12003 - protein, 10 aa, Artificial Sequence
  Peptide Derived from Human Papillomavirus
TLLACFLLCF

SEQ ID NO: 12004 - protein, 8 aa, Artificial Sequence
  Peptide Derived from Human Papillomavirus
TTLLACFL

SEQ ID NO: 12005 - protein, 9 aa, Artificial Sequence
  Peptide Derived from Human Papillomavirus
TTLLACFLL

SEQ ID NO: 12006 - protein, 11 aa, Artificial Sequence
  Peptide Derived from Human Papillomavirus
TTLLACFLLCF

SEQ ID NO: 12007 - protein, 8 aa, Artificial Sequence
  Peptide Derived from Human Papillomavirus
TYTSLIIL

SEQ ID NO: 12008 - protein, 10 aa, Artificial Sequence
  Peptide Derived from Human Papillomavirus
TYTSLIILVL

SEQ ID NO: 12009 - protein, 11 aa, Artificial Sequence
  Peptide Derived from Human Papillomavirus
TYTSLIILVLL

SEQ ID NO: 12010 - protein, 8 aa, Artificial Sequence
  Peptide Derived from Human Papillomavirus
VLLCVCLL

SEQ ID NO: 12011 - protein, 9 aa, Artificial Sequence
  Peptide Derived from Human Papillomavirus
VLLCVCLLI

SEQ ID NO: 12012 - protein, 8 aa, Artificial Sequence
  Peptide Derived from Human Papillomavirus
VYIIFVYI

SEQ ID NO: 12013 - protein, 10 aa, Artificial Sequence
  Peptide Derived from Human Papillomavirus
VYIIFVYIPL

SEQ ID NO: 12014 - protein, 11 aa, Artificial Sequence
  Peptide Derived from Human Papillomavirus
VYIIFVYIPLF

SEQ ID NO: 12015 - protein, 8 aa, Artificial Sequence
  Peptide Derived from Human Papillomavirus
VYIPLFLI

SEQ ID NO: 12016 - protein, 8 aa, Artificial Sequence
  Peptide Derived from Human Papillomavirus
WITAASAF

SEQ ID NO: 12017 - protein, 11 aa, Artificial Sequence
  Peptide Derived from Human Papillomavirus
WITAASAFRCF

SEQ ID NO: 12018 - protein, 9 aa, Artificial Sequence
  Peptide Derived from Human Papillomavirus
YIIFVYIPL

SEQ ID NO: 12019 - protein, 10 aa, Artificial Sequence
  Peptide Derived from Human Papillomavirus
YIIFVYIPLF

SEQ ID NO: 12020 - protein, 11 aa, Artificial Sequence
  Peptide Derived from Human Papillomavirus
YIIFVYIPLFL

SEQ ID NO: 12021 - protein, 9 aa, Artificial Sequence
  Peptide Derived from Human Papillomavirus
YTSLIILVL

SEQ ID NO: 12022 - protein, 10 aa, Artificial Sequence
  Peptide Derived from Human Papillomavirus
YTSLIILVLL

SEQ ID NO: 12023 - protein, 11 aa, Artificial Sequence
  Peptide Derived from Human Papillomavirus
YTSLIILVLLL

SEQ ID NO: 12024 - protein, 9 aa, Artificial Sequence
  Peptide Derived from Human Papillomavirus
AFRDLCIVY

SEQ ID NO: 12025 - protein, 9 aa, Artificial Sequence
  Peptide Derived from Human Papillomavirus
AVCDKCLKF

SEQ ID NO: 12026 - protein, 10 aa, Artificial Sequence
  Peptide Derived from Human Papillomavirus
AVCDKCLKFY

SEQ ID NO: 12027 - protein, 8 aa, Artificial Sequence
  Peptide Derived from Human Papillomavirus
CINCQKPL

SEQ ID NO: 12028 - protein, 10 aa, Artificial Sequence
  Peptide Derived from Human Papillomavirus
CIVYRDGNPY

SEQ ID NO: 12029 - protein, 8 aa, Artificial Sequence
  Peptide Derived from Human Papillomavirus
CLKFYSKI

SEQ ID NO: 12030 - protein, 11 aa, Artificial Sequence
  Peptide Derived from Human Papillomavirus
CLKFYSKISEY

SEQ ID NO: 12031 - protein, 8 aa, Artificial Sequence
  Peptide Derived from Human Papillomavirus
CTELQTTI

SEQ ID NO: 12032 - protein, 11 aa, Artificial Sequence
  Peptide Derived from Human Papillomavirus
CTELQTTIHDI

SEQ ID NO: 12033 - protein, 8 aa, Artificial Sequence
  Peptide Derived from Human Papillomavirus
CVYCKQQL

SEQ ID NO: 12034 - protein, 9 aa, Artificial Sequence
  Peptide Derived from Human Papillomavirus
CVYCKQQLL

SEQ ID NO: 12035 - protein, 9 aa, Artificial Sequence
  Peptide Derived from Human Papillomavirus
CYSLYGTTL

SEQ ID NO: 12036 - protein, 9 aa, Artificial Sequence
  Peptide Derived from Human Papillomavirus
DFAFRDLCI

SEQ ID NO: 12037 - protein, 11 aa, Artificial Sequence
  Peptide Derived from Human Papillomavirus
DFAFRDLCIVY

SEQ ID NO: 12038 - protein, 8 aa, Artificial Sequence
  Peptide Derived from Human Papillomavirus
DIILECVY

SEQ ID NO: 12039 - protein, 9 aa, Artificial Sequence
  Peptide Derived from Human Papillomavirus
ELQTTIHDI

SEQ ID NO: 12040 - protein, 10 aa, Artificial Sequence
  Peptide Derived from Human Papillomavirus
ELQTTIHDII

SEQ ID NO: 12041 - protein, 11 aa, Artificial Sequence
  Peptide Derived from Human Papillomavirus
ELQTTIHDIIL

SEQ ID NO: 12042 - protein, 10 aa, Artificial Sequence
  Peptide Derived from Human Papillomavirus
EVYDFAFRDL

SEQ ID NO: 12043 - protein, 9 aa, Artificial Sequence
  Peptide Derived from Human Papillomavirus
EYRHYCYSL

SEQ ID NO: 12044 - protein, 10 aa, Artificial Sequence
  Peptide Derived from Human Papillomavirus
EYRHYCYSLY

SEQ ID NO: 12045 - protein, 8 aa, Artificial Sequence
  Peptide Derived from Human Papillomavirus
FYSKISEY

SEQ ID NO: 12046 - protein, 11 aa, Artificial Sequence
  Peptide Derived from Human Papillomavirus
FYSKISEYRHY

SEQ ID NO: 12047 - protein, 8 aa, Artificial Sequence
  Peptide Derived from Human Papillomavirus
GTTLEQQY

SEQ ID NO: 12048 - protein, 8 aa, Artificial Sequence
  Peptide Derived from Human Papillomavirus
HLDKKQRF

SEQ ID NO: 12049 - protein, 11 aa, Artificial Sequence
  Peptide Derived from Human Papillomavirus
HLDKKQRFHNI

SEQ ID NO: 12050 - protein, 11 aa, Artificial Sequence
  Peptide Derived from Human Papillomavirus
HYCYSLYGTTL

SEQ ID NO: 12051 - protein, 11 aa, Artificial Sequence
  Peptide Derived from Human Papillomavirus
ILECVYCKQQL

SEQ ID NO: 12052 - protein, 9 aa, Artificial Sequence
  Peptide Derived from Human Papillomavirus
IVYRDGNPY

SEQ ID NO: 12053 - protein, 9 aa, Artificial Sequence
  Peptide Derived from Human Papillomavirus
KFYSKISEY

SEQ ID NO: 12054 - protein, 8 aa, Artificial Sequence
  Peptide Derived from Human Papillomavirus
KISEYRHY

SEQ ID NO: 12055 - protein, 10 aa, Artificial Sequence
  Peptide Derived from Human Papillomavirus
KISEYRHYCY

SEQ ID NO: 12056 - protein, 9 aa, Artificial Sequence
  Peptide Derived from Human Papillomavirus
KLPQLCTEL

SEQ ID NO: 12057 - protein, 11 aa, Artificial Sequence
  Peptide Derived from Human Papillomavirus
LIRCINCQKPL

SEQ ID NO: 12058 - protein, 9 aa, Artificial Sequence
  Peptide Derived from Human Papillomavirus
LLRREVYDF

SEQ ID NO: 12059 - protein, 11 aa, Artificial Sequence
  Peptide Derived from Human Papillomavirus
LLRREVYDFAF

SEQ ID NO: 12060 - protein, 10 aa, Artificial Sequence
  Peptide Derived from Human Papillomavirus
LYGTTLEQQY

SEQ ID NO: 12061 - protein, 11 aa, Artificial Sequence
  Peptide Derived from Human Papillomavirus
NIRGRWTGRCM

SEQ ID NO: 12062 - protein, 10 aa, Artificial Sequence
  Peptide Derived from Human Papillomavirus
PLCDLLIRCI

SEQ ID NO: 12063 - protein, 11 aa, Artificial Sequence
  Peptide Derived from Human Papillomavirus
PLCPEEKQRHL

SEQ ID NO: 12064 - protein, 9 aa, Artificial Sequence
  Peptide Derived from Human Papillomavirus
PYAVCDKCL

SEQ ID NO: 12065 - protein, 11 aa, Artificial Sequence
  Peptide Derived from Human Papillomavirus
PYAVCDKCLKF

SEQ ID NO: 12066 - protein, 10 aa, Artificial Sequence
  Peptide Derived from Human Papillomavirus
QLCTELQTTI

SEQ ID NO: 12067 - protein, 8 aa, Artificial Sequence
  Peptide Derived from Human Papillomavirus
QLLRREVY

SEQ ID NO: 12068 - protein, 10 aa, Artificial Sequence
  Peptide Derived from Human Papillomavirus
QLLRREVYDF

SEQ ID NO: 12069 - protein, 8 aa, Artificial Sequence
  Peptide Derived from Human Papillomavirus
QTTIHDII

SEQ ID NO: 12070 - protein, 9 aa, Artificial Sequence
  Peptide Derived from Human Papillomavirus
QTTIHDIIL

SEQ ID NO: 12071 - protein, 9 aa, Artificial Sequence
  Peptide Derived from Human Papillomavirus
QYNKPLCDL

SEQ ID NO: 12072 - protein, 10 aa, Artificial Sequence
  Peptide Derived from Human Papillomavirus
QYNKPLCDLL

SEQ ID NO: 12073 - protein, 11 aa, Artificial Sequence
  Peptide Derived from Human Papillomavirus
QYNKPLCDLLI

SEQ ID NO: 12074 - protein, 9 aa, Artificial Sequence
  Peptide Derived from Human Papillomavirus
RFHNIRGRW

SEQ ID NO: 12075 - protein, 8 aa, Artificial Sequence
  Peptide Derived from Human Papillomavirus
RTRRETQL

SEQ ID NO: 12076 - protein, 11 aa, Artificial Sequence
  Peptide Derived from Human Papillomavirus
SLYGTTLEQQY

SEQ ID NO: 12077 - protein, 11 aa, Artificial Sequence
  Peptide Derived from Human Papillomavirus
TIHDIILECVY

SEQ ID NO: 12078 - protein, 10 aa, Artificial Sequence
  Peptide Derived from Human Papillomavirus
TLEQQYNKPL

SEQ ID NO: 12079 - protein, 8 aa, Artificial Sequence
  Peptide Derived from Human Papillomavirus
TTIHDIIL

SEQ ID NO: 12080 - protein, 11 aa, Artificial Sequence
  Peptide Derived from Human Papillomavirus
TTLEQQYNKPL

SEQ ID NO: 12081 - protein, 8 aa, Artificial Sequence
  Peptide Derived from Human Papillomavirus
VYCKQQLL

SEQ ID NO: 12082 - protein, 9 aa, Artificial Sequence
  Peptide Derived from Human Papillomavirus
VYDFAFRDL

SEQ ID NO: 12083 - protein, 11 aa, Artificial Sequence
  Peptide Derived from Human Papillomavirus
VYDFAFRDLCI

SEQ ID NO: 12084 - protein, 8 aa, Artificial Sequence
  Peptide Derived from Human Papillomavirus
VYRDGNPY

SEQ ID NO: 12085 - protein, 9 aa, Artificial Sequence
  Peptide Derived from Human Papillomavirus
CVQSTHVDI

SEQ ID NO: 12086 - protein, 8 aa, Artificial Sequence
  Peptide Derived from Human Papillomavirus
DIRTLEDL

SEQ ID NO: 12087 - protein, 9 aa, Artificial Sequence
  Peptide Derived from Human Papillomavirus
DIRTLEDLL

SEQ ID NO: 12088 - protein, 10 aa, Artificial Sequence
  Peptide Derived from Human Papillomavirus
DIRTLEDLLM

SEQ ID NO: 12089 - protein, 9 aa, Artificial Sequence
  Peptide Derived from Human Papillomavirus
DLLMGTLGI

SEQ ID NO: 12090 - protein, 9 aa, Artificial Sequence
  Peptide Derived from Human Papillomavirus
DLQPETTDL

SEQ ID NO: 12091 - protein, 10 aa, Artificial Sequence
  Peptide Derived from Human Papillomavirus
DLQPETTDLY

SEQ ID NO: 12092 - protein, 8 aa, Artificial Sequence
  Peptide Derived from Human Papillomavirus
DLYCYEQL

SEQ ID NO: 12093 - protein, 8 aa, Artificial Sequence
  Peptide Derived from Human Papillomavirus
DTPTLHEY

SEQ ID NO: 12094 - protein, 9 aa, Artificial Sequence
  Peptide Derived from Human Papillomavirus
DTPTLHEYM

SEQ ID NO: 12095 - protein, 10 aa, Artificial Sequence
  Peptide Derived from Human Papillomavirus
DTPTLHEYML

SEQ ID NO: 12096 - protein, 8 aa, Artificial Sequence
  Peptide Derived from Human Papillomavirus
ETTDLYCY

SEQ ID NO: 12097 - protein, 11 aa, Artificial Sequence
  Peptide Derived from Human Papillomavirus
ETTDLYCYEQL

SEQ ID NO: 12098 - protein, 9 aa, Artificial Sequence
  Peptide Derived from Human Papillomavirus
GTLGIVCPI

SEQ ID NO: 12099 - protein, 10 aa, Artificial Sequence
  Peptide Derived from Human Papillomavirus
HVDIRTLEDL

SEQ ID NO: 12100 - protein, 11 aa, Artificial Sequence
  Peptide Derived from Human Papillomavirus
HVDIRTLEDLL

SEQ ID NO: 12101 - protein, 8 aa, Artificial Sequence
  Peptide Derived from Human Papillomavirus
LLMGTLGI

SEQ ID NO: 12102 - protein, 11 aa, Artificial Sequence
  Peptide Derived from Human Papillomavirus
LMGTLGIVCPI

SEQ ID NO: 12103 - protein, 11 aa, Artificial Sequence
  Peptide Derived from Human Papillomavirus
MLDLQPETTDL

SEQ ID NO: 12104 - protein, 8 aa, Artificial Sequence
  Peptide Derived from Human Papillomavirus
PTLHEYML

SEQ ID NO: 12105 - protein, 10 aa, Artificial Sequence
  Peptide Derived from Human Papillomavirus
PTLHEYMLDL

SEQ ID NO: 12106 - protein, 11 aa, Artificial Sequence
  Peptide Derived from Human Papillomavirus
RLCVQSTHVDI

SEQ ID NO: 12107 - protein, 8 aa, Artificial Sequence
  Peptide Derived from Human Papillomavirus
RTLEDLLM

SEQ ID NO: 12108 - protein, 11 aa, Artificial Sequence
  Peptide Derived from Human Papillomavirus
RTLEDLLMGTL

SEQ ID NO: 12109 - protein, 9 aa, Artificial Sequence
  Peptide Derived from Human Papillomavirus
STHVDIRTL

SEQ ID NO: 12110 - protein, 10 aa, Artificial Sequence
  Peptide Derived from Human Papillomavirus
TFCCKCDSTL

SEQ ID NO: 12111 - protein, 10 aa, Artificial Sequence
  Peptide Derived from Human Papillomavirus
TLEDLLMGTL

SEQ ID NO: 12112 - protein, 8 aa, Artificial Sequence
  Peptide Derived from Human Papillomavirus
TLGIVCPI

SEQ ID NO: 12113 - protein, 9 aa, Artificial Sequence
  Peptide Derived from Human Papillomavirus
TLHEYMLDL

SEQ ID NO: 12114 - protein, 10 aa, Artificial Sequence
  Peptide Derived from Human Papillomavirus
TTDLYCYEQL

SEQ ID NO: 12115 - protein, 11 aa, Artificial Sequence
  Peptide Derived from Human Papillomavirus
VTFCCKCDSTL

SEQ ID NO: 12116 - protein, 9 aa, Artificial Sequence
  Peptide Derived from Human Papillomavirus
AISTSETTY

SEQ ID NO: 12117 - protein, 10 aa, Artificial Sequence
  Peptide Derived from Human Papillomavirus
AVGENVPDDL

SEQ ID NO: 12118 - protein, 11 aa, Artificial Sequence
  Peptide Derived from Human Papillomavirus
AVGENVPDDLY

SEQ ID NO: 12119 - protein, 9 aa, Artificial Sequence
  Peptide Derived from Human Papillomavirus
AVGHPYFPI

SEQ ID NO: 12120 - protein, 10 aa, Artificial Sequence
  Peptide Derived from Human Papillomavirus
AVNPGDCPPL

SEQ ID NO: 12121 - protein, 11 aa, Artificial Sequence
  Peptide Derived from Human Papillomavirus
CISMDYKQTQL

SEQ ID NO: 12122 - protein, 9 aa, Artificial Sequence
  Peptide Derived from Human Papillomavirus
CLIGCKPPI

SEQ ID NO: 12123 - protein, 10 aa, Artificial Sequence
  Peptide Derived from Human Papillomavirus
CTSICKYPDY

SEQ ID NO: 12124 - protein, 11 aa, Artificial Sequence
  Peptide Derived from Human Papillomavirus
CTSICKYPDYI

SEQ ID NO: 12125 - protein, 9 aa, Artificial Sequence
  Peptide Derived from Human Papillomavirus
CYENDVNVY

SEQ ID NO: 12126 - protein, 11 aa, Artificial Sequence
  Peptide Derived from Human Papillomavirus
CYENDVNVYHI

SEQ ID NO: 12127 - protein, 9 aa, Artificial Sequence
  Peptide Derived from Human Papillomavirus
DICTSICKY

SEQ ID NO: 12128 - protein, 11 aa, Artificial Sequence
  Peptide Derived from Human Papillomavirus
DLDQFPLGRKF

SEQ ID NO: 12129 - protein, 8 aa, Artificial Sequence
  Peptide Derived from Human Papillomavirus
DLQFIFQL

SEQ ID NO: 12130 - protein, 11 aa, Artificial Sequence
  Peptide Derived from Human Papillomavirus
DLQFIFQLCKI

SEQ ID NO: 12131 - protein, 10 aa, Artificial Sequence
  Peptide Derived from Human Papillomavirus
DMVDTGFGAM

SEQ ID NO: 12132 - protein, 8 aa, Artificial Sequence
  Peptide Derived from Human Papillomavirus
DTENASAY

SEQ ID NO: 12133 - protein, 9 aa, Artificial Sequence
  Peptide Derived from Human Papillomavirus
DTGFGAMDF

SEQ ID NO: 12134 - protein, 8 aa, Artificial Sequence
  Peptide Derived from Human Papillomavirus
DTTRSTNM

SEQ ID NO: 12135 - protein, 10 aa, Artificial Sequence
  Peptide Derived from Human Papillomavirus
DTTRSTNMSL

SEQ ID NO: 12136 - protein, 11 aa, Artificial Sequence
  Peptide Derived from Human Papillomavirus
DTYRFVTSQAI

SEQ ID NO: 12137 - protein, 9 aa, Artificial Sequence
  Peptide Derived from Human Papillomavirus
DVMTYIHSM

SEQ ID NO: 12138 - protein, 8 aa, Artificial Sequence
  Peptide Derived from Human Papillomavirus
DVNVYHIF

SEQ ID NO: 12139 - protein, 9 aa, Artificial Sequence
  Peptide Derived from Human Papillomavirus
DVNVYHIFF

SEQ ID NO: 12140 - protein, 11 aa, Artificial Sequence
  Peptide Derived from Human Papillomavirus
DVNVYHIFFQM

SEQ ID NO: 12141 - protein, 10 aa, Artificial Sequence
  Peptide Derived from Human Papillomavirus
DYIKMVSEPY

SEQ ID NO: 12142 - protein, 9 aa, Artificial Sequence
  Peptide Derived from Human Papillomavirus
DYKQTQLCL

SEQ ID NO: 12143 - protein, 10 aa, Artificial Sequence
  Peptide Derived from Human Papillomavirus
DYKQTQLCLI

SEQ ID NO: 12144 - protein, 9 aa, Artificial Sequence
  Peptide Derived from Human Papillomavirus
ETTYKNTNF

SEQ ID NO: 12145 - protein, 8 aa, Artificial Sequence
  Peptide Derived from Human Papillomavirus
EVGRGQPL

SEQ ID NO: 12146 - protein, 8 aa, Artificial Sequence
  Peptide Derived from Human Papillomavirus
EVNLKEKF

SEQ ID NO: 12147 - protein, 10 aa, Artificial Sequence
  Peptide Derived from Human Papillomavirus
EVPLDICTSI

SEQ ID NO: 12148 - protein, 8 aa, Artificial Sequence
  Peptide Derived from Human Papillomavirus
EYDLQFIF

SEQ ID NO: 12149 - protein, 10 aa, Artificial Sequence
  Peptide Derived from Human Papillomavirus
EYDLQFIFQL

SEQ ID NO: 12150 - protein, 9 aa, Artificial Sequence
  Peptide Derived from Human Papillomavirus
EYLRHGEEY

SEQ ID NO: 12151 - protein, 11 aa, Artificial Sequence
  Peptide Derived from Human Papillomavirus
EYLRHGEEYDL

SEQ ID NO: 12152 - protein, 8 aa, Artificial Sequence
  Peptide Derived from Human Papillomavirus
EYVARTNI

SEQ ID NO: 12153 - protein, 9 aa, Artificial Sequence
  Peptide Derived from Human Papillomavirus
EYVARTNIY

SEQ ID NO: 12154 - protein, 10 aa, Artificial Sequence
  Peptide Derived from Human Papillomavirus
EYVARTNIYY

SEQ ID NO: 12155 - protein, 8 aa, Artificial Sequence
  Peptide Derived from Human Papillomavirus
FFQMSLWL

SEQ ID NO: 12156 - protein, 9 aa, Artificial Sequence
  Peptide Derived from Human Papillomavirus
FFYLRREQM

SEQ ID NO: 12157 - protein, 10 aa, Artificial Sequence
  Peptide Derived from Human Papillomavirus
FFYLRREQMF

SEQ ID NO: 12158 - protein, 8 aa, Artificial Sequence
  Peptide Derived from Human Papillomavirus
FIFQLCKI

SEQ ID NO: 12159 - protein, 10 aa, Artificial Sequence
  Peptide Derived from Human Papillomavirus
FIFQLCKITL

SEQ ID NO: 12160 - protein, 10 aa, Artificial Sequence
  Peptide Derived from Human Papillomavirus
FIYILVITCY

SEQ ID NO: 12161 - protein, 10 aa, Artificial Sequence
  Peptide Derived from Human Papillomavirus
FWEVNLKEKF

SEQ ID NO: 12162 - protein, 8 aa, Artificial Sequence
  Peptide Derived from Human Papillomavirus
FYLRREQM

SEQ ID NO: 12163 - protein, 9 aa, Artificial Sequence
  Peptide Derived from Human Papillomavirus
FYLRREQMF

SEQ ID NO: 12164 - protein, 9 aa, Artificial Sequence
  Peptide Derived from Human Papillomavirus
FYNPDTQRL

SEQ ID NO: 12165 - protein, 11 aa, Artificial Sequence
  Peptide Derived from Human Papillomavirus
FYNPDTQRLVW

SEQ ID NO: 12166 - protein, 10 aa, Artificial Sequence
  Peptide Derived from Human Papillomavirus
GFGAMDFTTL

SEQ ID NO: 12167 - protein, 8 aa, Artificial Sequence
  Peptide Derived from Human Papillomavirus
GFPDTSFY

SEQ ID NO: 12168 - protein, 8 aa, Artificial Sequence
  Peptide Derived from Human Papillomavirus
GICWGNQL

SEQ ID NO: 12169 - protein, 9 aa, Artificial Sequence
  Peptide Derived from Human Papillomavirus
GICWGNQLF

SEQ ID NO: 12170 - protein, 8 aa, Artificial Sequence
  Peptide Derived from Human Papillomavirus
GISGHPLL

SEQ ID NO: 12171 - protein, 11 aa, Artificial Sequence
  Peptide Derived from Human Papillomavirus
GISGHPLLNKL

SEQ ID NO: 12172 - protein, 8 aa, Artificial Sequence
  Peptide Derived from Human Papillomavirus
GLKAKPKF

SEQ ID NO: 12173 - protein, 10 aa, Artificial Sequence
  Peptide Derived from Human Papillomavirus
GLKAKPKFTL

SEQ ID NO: 12174 - protein, 10 aa, Artificial Sequence
  Peptide Derived from Human Papillomavirus
GLQPPPGGTL

SEQ ID NO: 12175 - protein, 9 aa, Artificial Sequence
  Peptide Derived from Human Papillomavirus
GLQYRVFRI

SEQ ID NO: 12176 - protein, 11 aa, Artificial Sequence
  Peptide Derived from Human Papillomavirus
GLQYRVFRIHL

SEQ ID NO: 12177 - protein, 9 aa, Artificial Sequence
  Peptide Derived from Human Papillomavirus
GTLEDTYRF

SEQ ID NO: 12178 - protein, 8 aa, Artificial Sequence
  Peptide Derived from Human Papillomavirus
GVDNRECI

SEQ ID NO: 12179 - protein, 10 aa, Artificial Sequence
  Peptide Derived from Human Papillomavirus
GVDNRECISM

SEQ ID NO: 12180 - protein, 10 aa, Artificial Sequence
  Peptide Derived from Human Papillomavirus
GVEVGRGQPL

SEQ ID NO: 12181 - protein, 9 aa, Artificial Sequence
  Peptide Derived from Human Papillomavirus
GVGISGHPL

SEQ ID NO: 12182 - protein, 10 aa, Artificial Sequence
  Peptide Derived from Human Papillomavirus
GVGISGHPLL

SEQ ID NO: 12183 - protein, 8 aa, Artificial Sequence
  Peptide Derived from Human Papillomavirus
HIFFQMSL

SEQ ID NO: 12184 - protein, 9 aa, Artificial Sequence
  Peptide Derived from Human Papillomavirus
HIFFQMSLW

SEQ ID NO: 12185 - protein, 10 aa, Artificial Sequence
  Peptide Derived from Human Papillomavirus
HIFFQMSLWL

SEQ ID NO: 12186 - protein, 8 aa, Artificial Sequence
  Peptide Derived from Human Papillomavirus
HLPDPNKF

SEQ ID NO: 12187 - protein, 10 aa, Artificial Sequence
  Peptide Derived from Human Papillomavirus
HLPDPNKFGF

SEQ ID NO: 12188 - protein, 11 aa, Artificial Sequence
  Peptide Derived from Human Papillomavirus
HTPPAPKEDPL

SEQ ID NO: 12189 - protein, 8 aa, Artificial Sequence
  Peptide Derived from Human Papillomavirus
IFFQMSLW

SEQ ID NO: 12190 - protein, 9 aa, Artificial Sequence
  Peptide Derived from Human Papillomavirus
IFFQMSLWL

SEQ ID NO: 12191 - protein, 8 aa, Artificial Sequence
  Peptide Derived from Human Papillomavirus
IFNKPYWL

SEQ ID NO: 12192 - protein, 9 aa, Artificial Sequence
  Peptide Derived from Human Papillomavirus
IFQLCKITL

SEQ ID NO: 12193 - protein, 9 aa, Artificial Sequence
  Peptide Derived from Human Papillomavirus
ILEDWNFGL

SEQ ID NO: 12194 - protein, 9 aa, Artificial Sequence
  Peptide Derived from Human Papillomavirus
ILVPKVSGL

SEQ ID NO: 12195 - protein, 11 aa, Artificial Sequence
  Peptide Derived from Human Papillomavirus
ILVPKVSGLQY

SEQ ID NO: 12196 - protein, 11 aa, Artificial Sequence
  Peptide Derived from Human Papillomavirus
ITCYENDVNVY

SEQ ID NO: 12197 - protein, 8 aa, Artificial Sequence
  Peptide Derived from Human Papillomavirus
ITLTADVM

SEQ ID NO: 12198 - protein, 10 aa, Artificial Sequence
  Peptide Derived from Human Papillomavirus
ITLTADVMTY

SEQ ID NO: 12199 - protein, 11 aa, Artificial Sequence
  Peptide Derived from Human Papillomavirus
ITLTADVMTYI

SEQ ID NO: 12200 - protein, 9 aa, Artificial Sequence
  Peptide Derived from Human Papillomavirus
IYILVITCY

SEQ ID NO: 12201 - protein, 10 aa, Artificial Sequence
  Peptide Derived from Human Papillomavirus
IYYHAGTSRL

SEQ ID NO: 12202 - protein, 11 aa, Artificial Sequence
  Peptide Derived from Human Papillomavirus
IYYHAGTSRLL

SEQ ID NO: 12203 - protein, 9 aa, Artificial Sequence
  Peptide Derived from Human Papillomavirus
KFGFPDTSF

SEQ ID NO: 12204 - protein, 10 aa, Artificial Sequence
  Peptide Derived from Human Papillomavirus
KFGFPDTSFY

SEQ ID NO: 12205 - protein, 8 aa, Artificial Sequence
  Peptide Derived from Human Papillomavirus
KFLLQAGL

SEQ ID NO: 12206 - protein, 9 aa, Artificial Sequence
  Peptide Derived from Human Papillomavirus
KFSADLDQF

SEQ ID NO: 12207 - protein, 11 aa, Artificial Sequence
  Peptide Derived from Human Papillomavirus
KFSADLDQFPL

SEQ ID NO: 12208 - protein, 10 aa, Artificial Sequence
  Peptide Derived from Human Papillomavirus
KILVPKVSGL

SEQ ID NO: 12209 - protein, 9 aa, Artificial Sequence
  Peptide Derived from Human Papillomavirus
KITLTADVM

SEQ ID NO: 12210 - protein, 11 aa, Artificial Sequence
  Peptide Derived from Human Papillomavirus
KITLTADVMTY

SEQ ID NO: 12211 - protein, 11 aa, Artificial Sequence
  Peptide Derived from Human Papillomavirus
KLDDTENASAY

SEQ ID NO: 12212 - protein, 11 aa, Artificial Sequence
  Peptide Derived from Human Papillomavirus
KMVSEPYGDSL

SEQ ID NO: 12213 - protein, 10 aa, Artificial Sequence
  Peptide Derived from Human Papillomavirus
KVSGLQYRVF

SEQ ID NO: 12214 - protein, 8 aa, Artificial Sequence
  Peptide Derived from Human Papillomavirus
KVVSTDEY

SEQ ID NO: 12215 - protein, 8 aa, Artificial Sequence
  Peptide Derived from Human Papillomavirus
KYPDYIKM

SEQ ID NO: 12216 - protein, 9 aa, Artificial Sequence
  Peptide Derived from Human Papillomavirus
KYTFWEVNL

SEQ ID NO: 12217 - protein, 10 aa, Artificial Sequence
  Peptide Derived from Human Papillomavirus
LFFYLRREQM

SEQ ID NO: 12218 - protein, 11 aa, Artificial Sequence
  Peptide Derived from Human Papillomavirus
LFFYLRREQMF

SEQ ID NO: 12219 - protein, 8 aa, Artificial Sequence
  Peptide Derived from Human Papillomavirus
LIGCKPPI

SEQ ID NO: 12220 - protein, 11 aa, Artificial Sequence
  Peptide Derived from Human Papillomavirus
LINTVIQDGDM

SEQ ID NO: 12221 - protein, 8 aa, Artificial Sequence
  Peptide Derived from Human Papillomavirus
LLAVGHPY

SEQ ID NO: 12222 - protein, 9 aa, Artificial Sequence
  Peptide Derived from Human Papillomavirus
LLAVGHPYF

SEQ ID NO: 12223 - protein, 11 aa, Artificial Sequence
  Peptide Derived from Human Papillomavirus
LLAVGHPYFPI

SEQ ID NO: 12224 - protein, 8 aa, Artificial Sequence
  Peptide Derived from Human Papillomavirus
LTADVMTY

SEQ ID NO: 12225 - protein, 9 aa, Artificial Sequence
  Peptide Derived from Human Papillomavirus
LTADVMTYI

SEQ ID NO: 12226 - protein, 8 aa, Artificial Sequence
  Peptide Derived from Human Papillomavirus
LVPKVSGL

SEQ ID NO: 12227 - protein, 10 aa, Artificial Sequence
  Peptide Derived from Human Papillomavirus
LVPKVSGLQY

SEQ ID NO: 12228 - protein, 10 aa, Artificial Sequence
  Peptide Derived from Human Papillomavirus
LWLPSEATVY

SEQ ID NO: 12229 - protein, 11 aa, Artificial Sequence
  Peptide Derived from Human Papillomavirus
LWLPSEATVYL

SEQ ID NO: 12230 - protein, 11 aa, Artificial Sequence
  Peptide Derived from Human Papillomavirus
MTYIHSMNSTI

SEQ ID NO: 12231 - protein, 9 aa, Artificial Sequence
  Peptide Derived from Human Papillomavirus
MVDTGFGAM

SEQ ID NO: 12232 - protein, 11 aa, Artificial Sequence
  Peptide Derived from Human Papillomavirus
MVDTGFGAMDF

SEQ ID NO: 12233 - protein, 10 aa, Artificial Sequence
  Peptide Derived from Human Papillomavirus
MVSEPYGDSL

SEQ ID NO: 12234 - protein, 11 aa, Artificial Sequence
  Peptide Derived from Human Papillomavirus
MVSEPYGDSLF

SEQ ID NO: 12235 - protein, 8 aa, Artificial Sequence
  Peptide Derived from Human Papillomavirus
MVTSDAQI

SEQ ID NO: 12236 - protein, 9 aa, Artificial Sequence
  Peptide Derived from Human Papillomavirus
MVTSDAQIF

SEQ ID NO: 12237 - protein, 11 aa, Artificial Sequence
  Peptide Derived from Human Papillomavirus
NIYYHAGTSRL

SEQ ID NO: 12238 - protein, 8 aa, Artificial Sequence
  Peptide Derived from Human Papillomavirus
NLASSNYF

SEQ ID NO: 12239 - protein, 10 aa, Artificial Sequence
  Peptide Derived from Human Papillomavirus
NLKEKFSADL

SEQ ID NO: 12240 - protein, 8 aa, Artificial Sequence
  Peptide Derived from Human Papillomavirus
NMSLCAAI

SEQ ID NO: 12241 - protein, 8 aa, Artificial Sequence
  Peptide Derived from Human Papillomavirus
NTNFKEYL

SEQ ID NO: 12242 - protein, 9 aa, Artificial Sequence
  Peptide Derived from Human Papillomavirus
NTVIQDGDM

SEQ ID NO: 12243 - protein, 8 aa, Artificial Sequence
  Peptide Derived from Human Papillomavirus
NVPDDLYI

SEQ ID NO: 12244 - protein, 9 aa, Artificial Sequence
  Peptide Derived from Human Papillomavirus
NVYHIFFQM

SEQ ID NO: 12245 - protein, 11 aa, Artificial Sequence
  Peptide Derived from Human Papillomavirus
NVYHIFFQMSL

SEQ ID NO: 12246 - protein, 10 aa, Artificial Sequence
  Peptide Derived from Human Papillomavirus
NYFPTPSGSM

SEQ ID NO: 12247 - protein, 10 aa, Artificial Sequence
  Peptide Derived from Human Papillomavirus
PIKKPNNNKI

SEQ ID NO: 12248 - protein, 11 aa, Artificial Sequence
  Peptide Derived from Human Papillomavirus
PIKKPNNNKIL

SEQ ID NO: 12249 - protein, 8 aa, Artificial Sequence
  Peptide Derived from Human Papillomavirus
PLDICTSI

SEQ ID NO: 12250 - protein, 11 aa, Artificial Sequence
  Peptide Derived from Human Papillomavirus
PLDICTSICKY

SEQ ID NO: 12251 - protein, 9 aa, Artificial Sequence
  Peptide Derived from Human Papillomavirus
PLELINTVI

SEQ ID NO: 12252 - protein, 8 aa, Artificial Sequence
  Peptide Derived from Human Papillomavirus
PLGRKFLL

SEQ ID NO: 12253 - protein, 11 aa, Artificial Sequence
  Peptide Derived from Human Papillomavirus
PLGVGISGHPL

SEQ ID NO: 12254 - protein, 8 aa, Artificial Sequence
  Peptide Derived from Human Papillomavirus
PLKKYTFW

SEQ ID NO: 12255 - protein, 11 aa, Artificial Sequence
  Peptide Derived from Human Papillomavirus
PVSKVVSTDEY

SEQ ID NO: 12256 - protein, 8 aa, Artificial Sequence
  Peptide Derived from Human Papillomavirus
PYGDSLFF

SEQ ID NO: 12257 - protein, 9 aa, Artificial Sequence
  Peptide Derived from Human Papillomavirus
PYGDSLFFY

SEQ ID NO: 12258 - protein, 10 aa, Artificial Sequence
  Peptide Derived from Human Papillomavirus
PYGDSLFFYL

SEQ ID NO: 12259 - protein, 9 aa, Artificial Sequence
  Peptide Derived from Human Papillomavirus
QFIFQLCKI

SEQ ID NO: 12260 - protein, 11 aa, Artificial Sequence
  Peptide Derived from Human Papillomavirus
QFIFQLCKITL

SEQ ID NO: 12261 - protein, 8 aa, Artificial Sequence
  Peptide Derived from Human Papillomavirus
QFPLGRKF

SEQ ID NO: 12262 - protein, 9 aa, Artificial Sequence
  Peptide Derived from Human Papillomavirus
QFPLGRKFL

SEQ ID NO: 12263 - protein, 10 aa, Artificial Sequence
  Peptide Derived from Human Papillomavirus
QFPLGRKFLL

SEQ ID NO: 12264 - protein, 8 aa, Artificial Sequence
  Peptide Derived from Human Papillomavirus
QIFNKPYW

SEQ ID NO: 12265 - protein, 9 aa, Artificial Sequence
  Peptide Derived from Human Papillomavirus
QIFNKPYWL

SEQ ID NO: 12266 - protein, 11 aa, Artificial Sequence
  Peptide Derived from Human Papillomavirus
QLCLIGCKPPI

SEQ ID NO: 12267 - protein, 8 aa, Artificial Sequence
  Peptide Derived from Human Papillomavirus
QMFVRHLF

SEQ ID NO: 12268 - protein, 8 aa, Artificial Sequence
  Peptide Derived from Human Papillomavirus
QVTFIYIL

SEQ ID NO: 12269 - protein, 10 aa, Artificial Sequence
  Peptide Derived from Human Papillomavirus
QVTFIYILVI

SEQ ID NO: 12270 - protein, 9 aa, Artificial Sequence
  Peptide Derived from Human Papillomavirus
QYRVFRIHL

SEQ ID NO: 12271 - protein, 8 aa, Artificial Sequence
  Peptide Derived from Human Papillomavirus
RFVTSQAI

SEQ ID NO: 12272 - protein, 10 aa, Artificial Sequence
  Peptide Derived from Human Papillomavirus
RIHLPDPNKF

SEQ ID NO: 12273 - protein, 9 aa, Artificial Sequence
  Peptide Derived from Human Papillomavirus
RLLAVGHPY

SEQ ID NO: 12274 - protein, 10 aa, Artificial Sequence
  Peptide Derived from Human Papillomavirus
RLLAVGHPYF

SEQ ID NO: 12275 - protein, 10 aa, Artificial Sequence
  Peptide Derived from Human Papillomavirus
SFYNPDTQRL

SEQ ID NO: 12276 - protein, 8 aa, Artificial Sequence
  Peptide Derived from Human Papillomavirus
SICKYPDY

SEQ ID NO: 12277 - protein, 9 aa, Artificial Sequence
  Peptide Derived from Human Papillomavirus
SICKYPDYI

SEQ ID NO: 12278 - protein, 11 aa, Artificial Sequence
  Peptide Derived from Human Papillomavirus
SICKYPDYIKM

SEQ ID NO: 12279 - protein, 11 aa, Artificial Sequence
  Peptide Derived from Human Papillomavirus
SLFFYLRREQM

SEQ ID NO: 12280 - protein, 11 aa, Artificial Sequence
  Peptide Derived from Human Papillomavirus
SLWLPSEATVY

SEQ ID NO: 12281 - protein, 9 aa, Artificial Sequence
  Peptide Derived from Human Papillomavirus
SMDYKQTQL

SEQ ID NO: 12282 - protein, 11 aa, Artificial Sequence
  Peptide Derived from Human Papillomavirus
SMDYKQTQLCL

SEQ ID NO: 12283 - protein, 10 aa, Artificial Sequence
  Peptide Derived from Human Papillomavirus
SMNSTILEDW

SEQ ID NO: 12284 - protein, 9 aa, Artificial Sequence
  Peptide Derived from Human Papillomavirus
SMVTSDAQI

SEQ ID NO: 12285 - protein, 10 aa, Artificial Sequence
  Peptide Derived from Human Papillomavirus
SMVTSDAQIF

SEQ ID NO: 12286 - protein, 10 aa, Artificial Sequence
  Peptide Derived from Human Papillomavirus
STANLASSNY

SEQ ID NO: 12287 - protein, 11 aa, Artificial Sequence
  Peptide Derived from Human Papillomavirus
STANLASSNYF

SEQ ID NO: 12288 - protein, 11 aa, Artificial Sequence
  Peptide Derived from Human Papillomavirus
STDEYVARTNI

SEQ ID NO: 12289 - protein, 9 aa, Artificial Sequence
  Peptide Derived from Human Papillomavirus
STILEDWNF

SEQ ID NO: 12290 - protein, 11 aa, Artificial Sequence
  Peptide Derived from Human Papillomavirus
STILEDWNFGL

SEQ ID NO: 12291 - protein, 10 aa, Artificial Sequence
  Peptide Derived from Human Papillomavirus
STNMSLCAAI

SEQ ID NO: 12292 - protein, 11 aa, Artificial Sequence
  Peptide Derived from Human Papillomavirus
STTAKRKKRKL

SEQ ID NO: 12293 - protein, 8 aa, Artificial Sequence
  Peptide Derived from Human Papillomavirus
TFIYILVI

SEQ ID NO: 12294 - protein, 11 aa, Artificial Sequence
  Peptide Derived from Human Papillomavirus
TFIYILVITCY

SEQ ID NO: 12295 - protein, 11 aa, Artificial Sequence
  Peptide Derived from Human Papillomavirus
TFWEVNLKEKF

SEQ ID NO: 12296 - protein, 8 aa, Artificial Sequence
  Peptide Derived from Human Papillomavirus
TILEDWNF

SEQ ID NO: 12297 - protein, 10 aa, Artificial Sequence
  Peptide Derived from Human Papillomavirus
TILEDWNFGL

SEQ ID NO: 12298 - protein, 8 aa, Artificial Sequence
  Peptide Derived from Human Papillomavirus
TLEDTYRF

SEQ ID NO: 12299 - protein, 11 aa, Artificial Sequence
  Peptide Derived from Human Papillomavirus
TLQANKSEVPL

SEQ ID NO: 12300 - protein, 9 aa, Artificial Sequence
  Peptide Derived from Human Papillomavirus
TLTADVMTY

SEQ ID NO: 12301 - protein, 10 aa, Artificial Sequence
  Peptide Derived from Human Papillomavirus
TLTADVMTYI

SEQ ID NO: 12302 - protein, 10 aa, Artificial Sequence
  Peptide Derived from Human Papillomavirus
TTAKRKKRKL

SEQ ID NO: 12303 - protein, 9 aa, Artificial Sequence
  Peptide Derived from Human Papillomavirus
TTRSTNMSL

SEQ ID NO: 12304 - protein, 8 aa, Artificial Sequence
  Peptide Derived from Human Papillomavirus
TTYKNTNF

SEQ ID NO: 12305 - protein, 11 aa, Artificial Sequence
  Peptide Derived from Human Papillomavirus
TTYKNTNFKEY

SEQ ID NO: 12306 - protein, 8 aa, Artificial Sequence
  Peptide Derived from Human Papillomavirus
TVIQDGDM

SEQ ID NO: 12307 - protein, 11 aa, Artificial Sequence
  Peptide Derived from Human Papillomavirus
TVVDTTRSTNM

SEQ ID NO: 12308 - protein, 10 aa, Artificial Sequence
  Peptide Derived from Human Papillomavirus
TYIHSMNSTI

SEQ ID NO: 12309 - protein, 11 aa, Artificial Sequence
  Peptide Derived from Human Papillomavirus
TYIHSMNSTIL

SEQ ID NO: 12310 - protein, 10 aa, Artificial Sequence
  Peptide Derived from Human Papillomavirus
TYKNTNFKEY

SEQ ID NO: 12311 - protein, 11 aa, Artificial Sequence
  Peptide Derived from Human Papillomavirus
TYKNTNFKEYL

SEQ ID NO: 12312 - protein, 10 aa, Artificial Sequence
  Peptide Derived from Human Papillomavirus
TYRFVTSQAI

SEQ ID NO: 12313 - protein, 8 aa, Artificial Sequence
  Peptide Derived from Human Papillomavirus
VMTYIHSM

SEQ ID NO: 12314 - protein, 9 aa, Artificial Sequence
  Peptide Derived from Human Papillomavirus
VTFIYILVI

SEQ ID NO: 12315 - protein, 8 aa, Artificial Sequence
  Peptide Derived from Human Papillomavirus
VTSDAQIF

SEQ ID NO: 12316 - protein, 10 aa, Artificial Sequence
  Peptide Derived from Human Papillomavirus
VVDTTRSTNM

SEQ ID NO: 12317 - protein, 8 aa, Artificial Sequence
  Peptide Derived from Human Papillomavirus
VYHIFFQM

SEQ ID NO: 12318 - protein, 10 aa, Artificial Sequence
  Peptide Derived from Human Papillomavirus
VYHIFFQMSL

SEQ ID NO: 12319 - protein, 11 aa, Artificial Sequence
  Peptide Derived from Human Papillomavirus
VYHIFFQMSLW

SEQ ID NO: 12320 - protein, 9 aa, Artificial Sequence
  Peptide Derived from Human Papillomavirus
WLPSEATVY

SEQ ID NO: 12321 - protein, 10 aa, Artificial Sequence
  Peptide Derived from Human Papillomavirus
WLPSEATVYL

SEQ ID NO: 12322 - protein, 9 aa, Artificial Sequence
  Peptide Derived from Human Papillomavirus
YFPTPSGSM

SEQ ID NO: 12323 - protein, 9 aa, Artificial Sequence
  Peptide Derived from Human Papillomavirus
YIHSMNSTI

SEQ ID NO: 12324 - protein, 10 aa, Artificial Sequence
  Peptide Derived from Human Papillomavirus
YIHSMNSTIL

SEQ ID NO: 12325 - protein, 11 aa, Artificial Sequence
  Peptide Derived from Human Papillomavirus
YIKGSGSTANL

SEQ ID NO: 12326 - protein, 9 aa, Artificial Sequence
  Peptide Derived from Human Papillomavirus
YIKMVSEPY

SEQ ID NO: 12327 - protein, 8 aa, Artificial Sequence
  Peptide Derived from Human Papillomavirus
YILVITCY

SEQ ID NO: 12328 - protein, 8 aa, Artificial Sequence
  Peptide Derived from Human Papillomavirus
YLRHGEEY

SEQ ID NO: 12329 - protein, 10 aa, Artificial Sequence
  Peptide Derived from Human Papillomavirus
YLRHGEEYDL

SEQ ID NO: 12330 - protein, 8 aa, Artificial Sequence
  Peptide Derived from Human Papillomavirus
YLRREQMF

SEQ ID NO: 12331 - protein, 8 aa, Artificial Sequence
  Peptide Derived from Human Papillomavirus
YTFWEVNL

SEQ ID NO: 12332 - protein, 8 aa, Artificial Sequence
  Peptide Derived from Human Papillomavirus
YVARTNIY

SEQ ID NO: 12333 - protein, 9 aa, Artificial Sequence
  Peptide Derived from Human Papillomavirus
YVARTNIYY

SEQ ID NO: 12334 - protein, 9 aa, Artificial Sequence
  Peptide Derived from Human Papillomavirus
YYHAGTSRL

SEQ ID NO: 12335 - protein, 10 aa, Artificial Sequence
  Peptide Derived from Human Papillomavirus
YYHAGTSRLL

SEQ ID NO: 12336 - protein, 9 aa, Artificial Sequence
  Peptide Derived from Human Papillomavirus
AFITTPTKL

SEQ ID NO: 12337 - protein, 10 aa, Artificial Sequence
  Peptide Derived from Human Papillomavirus
AFITTPTKLI

SEQ ID NO: 12338 - protein, 10 aa, Artificial Sequence
  Peptide Derived from Human Papillomavirus
ALPTSINNGL

SEQ ID NO: 12339 - protein, 11 aa, Artificial Sequence
  Peptide Derived from Human Papillomavirus
ALPTSINNGLY

SEQ ID NO: 12340 - protein, 9 aa, Artificial Sequence
  Peptide Derived from Human Papillomavirus
ALTSRRTGI

SEQ ID NO: 12341 - protein, 11 aa, Artificial Sequence
  Peptide Derived from Human Papillomavirus
ALTSRRTGIRY

SEQ ID NO: 12342 - protein, 11 aa, Artificial Sequence
  Peptide Derived from Human Papillomavirus
AYEGIDVDNTL

SEQ ID NO: 12343 - protein, 8 aa, Artificial Sequence
  Peptide Derived from Human Papillomavirus
DFLDIVAL

SEQ ID NO: 12344 - protein, 11 aa, Artificial Sequence
  Peptide Derived from Human Papillomavirus
DFSTIDSAEEI

SEQ ID NO: 12345 - protein, 8 aa, Artificial Sequence
  Peptide Derived from Human Papillomavirus
DFYLHPSY

SEQ ID NO: 12346 - protein, 9 aa, Artificial Sequence
  Peptide Derived from Human Papillomavirus
DFYLHPSYY

SEQ ID NO: 12347 - protein, 10 aa, Artificial Sequence
  Peptide Derived from Human Papillomavirus
DFYLHPSYYM

SEQ ID NO: 12348 - protein, 11 aa, Artificial Sequence
  Peptide Derived from Human Papillomavirus
DFYLHPSYYML

SEQ ID NO: 12349 - protein, 11 aa, Artificial Sequence
  Peptide Derived from Human Papillomavirus
DIIPKVEGKTI

SEQ ID NO: 12350 - protein, 10 aa, Artificial Sequence
  Peptide Derived from Human Papillomavirus
DIVALHRPAL

SEQ ID NO: 12351 - protein, 8 aa, Artificial Sequence
  Peptide Derived from Human Papillomavirus
DIYADDFI

SEQ ID NO: 12352 - protein, 10 aa, Artificial Sequence
  Peptide Derived from Human Papillomavirus
DTLAPVRPPL

SEQ ID NO: 12353 - protein, 9 aa, Artificial Sequence
  Peptide Derived from Human Papillomavirus
DTTPAILDI

SEQ ID NO: 12354 - protein, 8 aa, Artificial Sequence
  Peptide Derived from Human Papillomavirus
DVDNTLYF

SEQ ID NO: 12355 - protein, 8 aa, Artificial Sequence
  Peptide Derived from Human Papillomavirus
EIPMDTFI

SEQ ID NO: 12356 - protein, 10 aa, Artificial Sequence
  Peptide Derived from Human Papillomavirus
ELQTITPSTY

SEQ ID NO: 12357 - protein, 8 aa, Artificial Sequence
  Peptide Derived from Human Papillomavirus
ETGGHFTL

SEQ ID NO: 12358 - protein, 8 aa, Artificial Sequence
  Peptide Derived from Human Papillomavirus
FITTPTKL

SEQ ID NO: 12359 - protein, 9 aa, Artificial Sequence
  Peptide Derived from Human Papillomavirus
FITTPTKLI

SEQ ID NO: 12360 - protein, 11 aa, Artificial Sequence
  Peptide Derived from Human Papillomavirus
FITTPTKLITY

SEQ ID NO: 12361 - protein, 8 aa, Artificial Sequence
  Peptide Derived from Human Papillomavirus
FTLSSSTI

SEQ ID NO: 12362 - protein, 8 aa, Artificial Sequence
  Peptide Derived from Human Papillomavirus
FYLHPSYY

SEQ ID NO: 12363 - protein, 9 aa, Artificial Sequence
  Peptide Derived from Human Papillomavirus
FYLHPSYYM

SEQ ID NO: 12364 - protein, 10 aa, Artificial Sequence
  Peptide Derived from Human Papillomavirus
FYLHPSYYML

SEQ ID NO: 12365 - protein, 8 aa, Artificial Sequence
  Peptide Derived from Human Papillomavirus
GIDVDNTL

SEQ ID NO: 12366 - protein, 9 aa, Artificial Sequence
  Peptide Derived from Human Papillomavirus
GIDVDNTLY

SEQ ID NO: 12367 - protein, 10 aa, Artificial Sequence
  Peptide Derived from Human Papillomavirus
GIDVDNTLYF

SEQ ID NO: 12368 - protein, 10 aa, Artificial Sequence
  Peptide Derived from Human Papillomavirus
GLYDIYADDF

SEQ ID NO: 12369 - protein, 11 aa, Artificial Sequence
  Peptide Derived from Human Papillomavirus
GLYDIYADDFI

SEQ ID NO: 12370 - protein, 8 aa, Artificial Sequence
  Peptide Derived from Human Papillomavirus
GTCPPDII

SEQ ID NO: 12371 - protein, 8 aa, Artificial Sequence
  Peptide Derived from Human Papillomavirus
GTGGRTGY

SEQ ID NO: 12372 - protein, 9 aa, Artificial Sequence
  Peptide Derived from Human Papillomavirus
GTGGRTGYI

SEQ ID NO: 12373 - protein, 11 aa, Artificial Sequence
  Peptide Derived from Human Papillomavirus
GTGGRTGYIPL

SEQ ID NO: 12374 - protein, 11 aa, Artificial Sequence
  Peptide Derived from Human Papillomavirus
GTRPPTATDTL

SEQ ID NO: 12375 - protein, 9 aa, Artificial Sequence
  Peptide Derived from Human Papillomavirus
GVFFGGLGI

SEQ ID NO: 12376 - protein, 9 aa, Artificial Sequence
  Peptide Derived from Human Papillomavirus
GYIPANTTI

SEQ ID NO: 12377 - protein, 11 aa, Artificial Sequence
  Peptide Derived from Human Papillomavirus
GYIPANTTIPF

SEQ ID NO: 12378 - protein, 9 aa, Artificial Sequence
  Peptide Derived from Human Papillomavirus
HFTLSSSTI

SEQ ID NO: 12379 - protein, 9 aa, Artificial Sequence
  Peptide Derived from Human Papillomavirus
HYYYDFSTI

SEQ ID NO: 12380 - protein, 8 aa, Artificial Sequence
  Peptide Derived from Human Papillomavirus
IIADAGDF

SEQ ID NO: 12381 - protein, 9 aa, Artificial Sequence
  Peptide Derived from Human Papillomavirus
IIADAGDFY

SEQ ID NO: 12382 - protein, 10 aa, Artificial Sequence
  Peptide Derived from Human Papillomavirus
IIADAGDFYL

SEQ ID NO: 12383 - protein, 10 aa, Artificial Sequence
  Peptide Derived from Human Papillomavirus
IIPKVEGKTI

SEQ ID NO: 12384 - protein, 10 aa, Artificial Sequence
  Peptide Derived from Human Papillomavirus
ILQYGSMGVF

SEQ ID NO: 12385 - protein, 11 aa, Artificial Sequence
  Peptide Derived from Human Papillomavirus
ILQYGSMGVFF

SEQ ID NO: 12386 - protein, 8 aa, Artificial Sequence
  Peptide Derived from Human Papillomavirus
ITDQAPSL

SEQ ID NO: 12387 - protein, 9 aa, Artificial Sequence
  Peptide Derived from Human Papillomavirus
ITDQAPSLI

SEQ ID NO: 12388 - protein, 11 aa, Artificial Sequence
  Peptide Derived from Human Papillomavirus
ITDQAPSLIPI

SEQ ID NO: 12389 - protein, 8 aa, Artificial Sequence
  Peptide Derived from Human Papillomavirus
ITTPTKLI

SEQ ID NO: 12390 - protein, 10 aa, Artificial Sequence
  Peptide Derived from Human Papillomavirus
ITTPTKLITY

SEQ ID NO: 12391 - protein, 11 aa, Artificial Sequence
  Peptide Derived from Human Papillomavirus
ITTSTDTTPAI

SEQ ID NO: 12392 - protein, 8 aa, Artificial Sequence
  Peptide Derived from Human Papillomavirus
ITYDNPAY

SEQ ID NO: 12393 - protein, 11 aa, Artificial Sequence
  Peptide Derived from Human Papillomavirus
ITYDNPAYEGI

SEQ ID NO: 12394 - protein, 9 aa, Artificial Sequence
  Peptide Derived from Human Papillomavirus
IVALHRPAL

SEQ ID NO: 12395 - protein, 8 aa, Artificial Sequence
  Peptide Derived from Human Papillomavirus
IVPGSPQY

SEQ ID NO: 12396 - protein, 10 aa, Artificial Sequence
  Peptide Derived from Human Papillomavirus
IVPGSPQYTI

SEQ ID NO: 12397 - protein, 11 aa, Artificial Sequence
  Peptide Derived from Human Papillomavirus
IVPGSPQYTII

SEQ ID NO: 12398 - protein, 10 aa, Artificial Sequence
  Peptide Derived from Human Papillomavirus
IVSLVEETSF

SEQ ID NO: 12399 - protein, 11 aa, Artificial Sequence
  Peptide Derived from Human Papillomavirus
IVSLVEETSFI

SEQ ID NO: 12400 - protein, 10 aa, Artificial Sequence
  Peptide Derived from Human Papillomavirus
KLITYDNPAY

SEQ ID NO: 12401 - protein, 8 aa, Artificial Sequence
  Peptide Derived from Human Papillomavirus
KTIADQIL

SEQ ID NO: 12402 - protein, 10 aa, Artificial Sequence
  Peptide Derived from Human Papillomavirus
KTIADQILQY

SEQ ID NO: 12403 - protein, 11 aa, Artificial Sequence
  Peptide Derived from Human Papillomavirus
KVEGKTIADQI

SEQ ID NO: 12404 - protein, 8 aa, Artificial Sequence
  Peptide Derived from Human Papillomavirus
KVHYYYDF

SEQ ID NO: 12405 - protein, 11 aa, Artificial Sequence
  Peptide Derived from Human Papillomavirus
KVHYYYDFSTI

SEQ ID NO: 12406 - protein, 8 aa, Artificial Sequence
  Peptide Derived from Human Papillomavirus
KVVDPAFI

SEQ ID NO: 12407 - protein, 11 aa, Artificial Sequence
  Peptide Derived from Human Papillomavirus
LIPIVPGSPQY

SEQ ID NO: 12408 - protein, 9 aa, Artificial Sequence
  Peptide Derived from Human Papillomavirus
LITYDNPAY

SEQ ID NO: 12409 - protein, 8 aa, Artificial Sequence
  Peptide Derived from Human Papillomavirus
LTSRRTGI

SEQ ID NO: 12410 - protein, 10 aa, Artificial Sequence
  Peptide Derived from Human Papillomavirus
LTSRRTGIRY

SEQ ID NO: 12411 - protein, 8 aa, Artificial Sequence
  Peptide Derived from Human Papillomavirus
LVEETSFI

SEQ ID NO: 12412 - protein, 9 aa, Artificial Sequence
  Peptide Derived from Human Papillomavirus
LVSGPDIPI

SEQ ID NO: 12413 - protein, 11 aa, Artificial Sequence
  Peptide Derived from Human Papillomavirus
LVSGPDIPINI

SEQ ID NO: 12414 - protein, 9 aa, Artificial Sequence
  Peptide Derived from Human Papillomavirus
LYDIYADDF

SEQ ID NO: 12415 - protein, 10 aa, Artificial Sequence
  Peptide Derived from Human Papillomavirus
LYDIYADDFI

SEQ ID NO: 12416 - protein, 10 aa, Artificial Sequence
  Peptide Derived from Human Papillomavirus
LYFSSNDNSI

SEQ ID NO: 12417 - protein, 9 aa, Artificial Sequence
  Peptide Derived from Human Papillomavirus
MLRKRRKRL

SEQ ID NO: 12418 - protein, 11 aa, Artificial Sequence
  Peptide Derived from Human Papillomavirus
MLRKRRKRLPY

SEQ ID NO: 12419 - protein, 8 aa, Artificial Sequence
  Peptide Derived from Human Papillomavirus
NIAPDPDF

SEQ ID NO: 12420 - protein, 9 aa, Artificial Sequence
  Peptide Derived from Human Papillomavirus
NIAPDPDFL

SEQ ID NO: 12421 - protein, 11 aa, Artificial Sequence
  Peptide Derived from Human Papillomavirus
NIAPDPDFLDI

SEQ ID NO: 12422 - protein, 10 aa, Artificial Sequence
  Peptide Derived from Human Papillomavirus
NIPLVSGPDI

SEQ ID NO: 12423 - protein, 9 aa, Artificial Sequence
  Peptide Derived from Human Papillomavirus
NITDQAPSL

SEQ ID NO: 12424 - protein, 10 aa, Artificial Sequence
  Peptide Derived from Human Papillomavirus
NITDQAPSLI

SEQ ID NO: 12425 - protein, 10 aa, Artificial Sequence
  Peptide Derived from Human Papillomavirus
NTTIPFGGAY

SEQ ID NO: 12426 - protein, 9 aa, Artificial Sequence
  Peptide Derived from Human Papillomavirus
NTVTSSTPI

SEQ ID NO: 12427 - protein, 10 aa, Artificial Sequence
  Peptide Derived from Human Papillomavirus
NYEEIPMDTF

SEQ ID NO: 12428 - protein, 11 aa, Artificial Sequence
  Peptide Derived from Human Papillomavirus
NYEEIPMDTFI

SEQ ID NO: 12429 - protein, 8 aa, Artificial Sequence
  Peptide Derived from Human Papillomavirus
PFGGAYNI

SEQ ID NO: 12430 - protein, 10 aa, Artificial Sequence
  Peptide Derived from Human Papillomavirus
PFGGAYNIPL

SEQ ID NO: 12431 - protein, 11 aa, Artificial Sequence
  Peptide Derived from Human Papillomavirus
PINITDQAPSL

SEQ ID NO: 12432 - protein, 11 aa, Artificial Sequence
  Peptide Derived from Human Papillomavirus
PIPGSRPVARL

SEQ ID NO: 12433 - protein, 9 aa, Artificial Sequence
  Peptide Derived from Human Papillomavirus
PIVPGSPQY

SEQ ID NO: 12434 - protein, 11 aa, Artificial Sequence
  Peptide Derived from Human Papillomavirus
PIVPGSPQYTI

SEQ ID NO: 12435 - protein, 8 aa, Artificial Sequence
  Peptide Derived from Human Papillomavirus
PLVSGPDI

SEQ ID NO: 12436 - protein, 10 aa, Artificial Sequence
  Peptide Derived from Human Papillomavirus
PLVSGPDIPI

SEQ ID NO: 12437 - protein, 9 aa, Artificial Sequence
  Peptide Derived from Human Papillomavirus
PTFTDPSVL

SEQ ID NO: 12438 - protein, 10 aa, Artificial Sequence
  Peptide Derived from Human Papillomavirus
PTPAETGGHF

SEQ ID NO: 12439 - protein, 8 aa, Artificial Sequence
  Peptide Derived from Human Papillomavirus
PTSINNGL

SEQ ID NO: 12440 - protein, 9 aa, Artificial Sequence
  Peptide Derived from Human Papillomavirus
PTSINNGLY

SEQ ID NO: 12441 - protein, 11 aa, Artificial Sequence
  Peptide Derived from Human Papillomavirus
PTSINNGLYDI

SEQ ID NO: 12442 - protein, 8 aa, Artificial Sequence
  Peptide Derived from Human Papillomavirus
PVARLGLY

SEQ ID NO: 12443 - protein, 9 aa, Artificial Sequence
  Peptide Derived from Human Papillomavirus
PVGPSDPSI

SEQ ID NO: 12444 - protein, 10 aa, Artificial Sequence
  Peptide Derived from Human Papillomavirus
PVPSVPSTSL

SEQ ID NO: 12445 - protein, 9 aa, Artificial Sequence
  Peptide Derived from Human Papillomavirus
PYFFSDVSL

SEQ ID NO: 12446 - protein, 8 aa, Artificial Sequence
  Peptide Derived from Human Papillomavirus
QILQYGSM

SEQ ID NO: 12447 - protein, 11 aa, Artificial Sequence
  Peptide Derived from Human Papillomavirus
QILQYGSMGVF

SEQ ID NO: 12448 - protein, 8 aa, Artificial Sequence
  Peptide Derived from Human Papillomavirus
QTITPSTY

SEQ ID NO: 12449 - protein, 11 aa, Artificial Sequence
  Peptide Derived from Human Papillomavirus
QTLRTRSGKSI

SEQ ID NO: 12450 - protein, 9 aa, Artificial Sequence
  Peptide Derived from Human Papillomavirus
QVKVVDPAF

SEQ ID NO: 12451 - protein, 10 aa, Artificial Sequence
  Peptide Derived from Human Papillomavirus
QVKVVDPAFI

SEQ ID NO: 12452 - protein, 8 aa, Artificial Sequence
  Peptide Derived from Human Papillomavirus
QYGSMGVF

SEQ ID NO: 12453 - protein, 9 aa, Artificial Sequence
  Peptide Derived from Human Papillomavirus
QYGSMGVFF

SEQ ID NO: 12454 - protein, 11 aa, Artificial Sequence
  Peptide Derived from Human Papillomavirus
QYTIIADAGDF

SEQ ID NO: 12455 - protein, 8 aa, Artificial Sequence
  Peptide Derived from Human Papillomavirus
RIGNKQTL

SEQ ID NO: 12456 - protein, 11 aa, Artificial Sequence
  Peptide Derived from Human Papillomavirus
RLPYFFSDVSL

SEQ ID NO: 12457 - protein, 9 aa, Artificial Sequence
  Peptide Derived from Human Papillomavirus
RTGIRYSRI

SEQ ID NO: 12458 - protein, 10 aa, Artificial Sequence
  Peptide Derived from Human Papillomavirus
RTKRASATQL

SEQ ID NO: 12459 - protein, 11 aa, Artificial Sequence
  Peptide Derived from Human Papillomavirus
RTKRASATQLY

SEQ ID NO: 12460 - protein, 8 aa, Artificial Sequence
  Peptide Derived from Human Papillomavirus
RTRSGKSI

SEQ ID NO: 12461 - protein, 11 aa, Artificial Sequence
  Peptide Derived from Human Papillomavirus
RYSRIGNKQTL

SEQ ID NO: 12462 - protein, 8 aa, Artificial Sequence
  Peptide Derived from Human Papillomavirus
SIGAKVHY

SEQ ID NO: 12463 - protein, 9 aa, Artificial Sequence
  Peptide Derived from Human Papillomavirus
SIGAKVHYY

SEQ ID NO: 12464 - protein, 10 aa, Artificial Sequence
  Peptide Derived from Human Papillomavirus
SIGAKVHYYY

SEQ ID NO: 12465 - protein, 10 aa, Artificial Sequence
  Peptide Derived from Human Papillomavirus
SINIAPDPDF

SEQ ID NO: 12466 - protein, 11 aa, Artificial Sequence
  Peptide Derived from Human Papillomavirus
SINIAPDPDFL

SEQ ID NO: 12467 - protein, 9 aa, Artificial Sequence
  Peptide Derived from Human Papillomavirus
SINNGLYDI

SEQ ID NO: 12468 - protein, 10 aa, Artificial Sequence
  Peptide Derived from Human Papillomavirus
SINNGLYDIY

SEQ ID NO: 12469 - protein, 9 aa, Artificial Sequence
  Peptide Derived from Human Papillomavirus
SIPPDVSGF

SEQ ID NO: 12470 - protein, 11 aa, Artificial Sequence
  Peptide Derived from Human Papillomavirus
SIPPDVSGFSI

SEQ ID NO: 12471 - protein, 11 aa, Artificial Sequence
  Peptide Derived from Human Papillomavirus
SIVSLVEETSF

SEQ ID NO: 12472 - protein, 8 aa, Artificial Sequence
  Peptide Derived from Human Papillomavirus
SLVEETSF

SEQ ID NO: 12473 - protein, 9 aa, Artificial Sequence
  Peptide Derived from Human Papillomavirus
SLVEETSFI

SEQ ID NO: 12474 - protein, 9 aa, Artificial Sequence
  Peptide Derived from Human Papillomavirus
SMGVFFGGL

SEQ ID NO: 12475 - protein, 11 aa, Artificial Sequence
  Peptide Derived from Human Papillomavirus
SMGVFFGGLGI

SEQ ID NO: 12476 - protein, 8 aa, Artificial Sequence
  Peptide Derived from Human Papillomavirus
STDTTPAI

SEQ ID NO: 12477 - protein, 9 aa, Artificial Sequence
  Peptide Derived from Human Papillomavirus
STDTTPAIL

SEQ ID NO: 12478 - protein, 11 aa, Artificial Sequence
  Peptide Derived from Human Papillomavirus
STDTTPAILDI

SEQ ID NO: 12479 - protein, 8 aa, Artificial Sequence
  Peptide Derived from Human Papillomavirus
STHNYEEI

SEQ ID NO: 12480 - protein, 10 aa, Artificial Sequence
  Peptide Derived from Human Papillomavirus
STHNYEEIPM

SEQ ID NO: 12481 - protein, 9 aa, Artificial Sequence
  Peptide Derived from Human Papillomavirus
STIDSAEEI

SEQ ID NO: 12482 - protein, 11 aa, Artificial Sequence
  Peptide Derived from Human Papillomavirus
STIDSAEEIEL

SEQ ID NO: 12483 - protein, 8 aa, Artificial Sequence
  Peptide Derived from Human Papillomavirus
STISTHNY

SEQ ID NO: 12484 - protein, 11 aa, Artificial Sequence
  Peptide Derived from Human Papillomavirus
STISTHNYEEI

SEQ ID NO: 12485 - protein, 8 aa, Artificial Sequence
  Peptide Derived from Human Papillomavirus
STSLSGYI

SEQ ID NO: 12486 - protein, 11 aa, Artificial Sequence
  Peptide Derived from Human Papillomavirus
STYTTTSHAAL

SEQ ID NO: 12487 - protein, 10 aa, Artificial Sequence
  Peptide Derived from Human Papillomavirus
SVPSTSLSGY

SEQ ID NO: 12488 - protein, 11 aa, Artificial Sequence
  Peptide Derived from Human Papillomavirus
SVPSTSLSGYI

SEQ ID NO: 12489 - protein, 8 aa, Artificial Sequence
  Peptide Derived from Human Papillomavirus
TFTDPSVL

SEQ ID NO: 12490 - protein, 9 aa, Artificial Sequence
  Peptide Derived from Human Papillomavirus
TIADQILQY

SEQ ID NO: 12491 - protein, 8 aa, Artificial Sequence
  Peptide Derived from Human Papillomavirus
TIDSAEEI

SEQ ID NO: 12492 - protein, 10 aa, Artificial Sequence
  Peptide Derived from Human Papillomavirus
TIDSAEEIEL

SEQ ID NO: 12493 - protein, 9 aa, Artificial Sequence
  Peptide Derived from Human Papillomavirus
TIIADAGDF

SEQ ID NO: 12494 - protein, 10 aa, Artificial Sequence
  Peptide Derived from Human Papillomavirus
TIIADAGDFY

SEQ ID NO: 12495 - protein, 11 aa, Artificial Sequence
  Peptide Derived from Human Papillomavirus
TIIADAGDFYL

SEQ ID NO: 12496 - protein, 8 aa, Artificial Sequence
  Peptide Derived from Human Papillomavirus
TIPFGGAY

SEQ ID NO: 12497 - protein, 10 aa, Artificial Sequence
  Peptide Derived from Human Papillomavirus
TIPFGGAYNI

SEQ ID NO: 12498 - protein, 10 aa, Artificial Sequence
  Peptide Derived from Human Papillomavirus
TISTHNYEEI

SEQ ID NO: 12499 - protein, 9 aa, Artificial Sequence
  Peptide Derived from Human Papillomavirus
TLAPVRPPL

SEQ ID NO: 12500 - protein, 10 aa, Artificial Sequence
  Peptide Derived from Human Papillomavirus
TLRTRSGKSI

SEQ ID NO: 12501 - protein, 11 aa, Artificial Sequence
  Peptide Derived from Human Papillomavirus
TLYFSSNDNSI

SEQ ID NO: 12502 - protein, 8 aa, Artificial Sequence
  Peptide Derived from Human Papillomavirus
TTHNNPTF

SEQ ID NO: 12503 - protein, 9 aa, Artificial Sequence
  Peptide Derived from Human Papillomavirus
TTIPFGGAY

SEQ ID NO: 12504 - protein, 11 aa, Artificial Sequence
  Peptide Derived from Human Papillomavirus
TTIPFGGAYNI

SEQ ID NO: 12505 - protein, 8 aa, Artificial Sequence
  Peptide Derived from Human Papillomavirus
TTPAILDI

SEQ ID NO: 12506 - protein, 9 aa, Artificial Sequence
  Peptide Derived from Human Papillomavirus
TTPTKLITY

SEQ ID NO: 12507 - protein, 11 aa, Artificial Sequence
  Peptide Derived from Human Papillomavirus
TTSHAALPTSI

SEQ ID NO: 12508 - protein, 10 aa, Artificial Sequence
  Peptide Derived from Human Papillomavirus
TTSTDTTPAI

SEQ ID NO: 12509 - protein, 11 aa, Artificial Sequence
  Peptide Derived from Human Papillomavirus
TTSTDTTPAIL

SEQ ID NO: 12510 - protein, 8 aa, Artificial Sequence
  Peptide Derived from Human Papillomavirus
TTTSHAAL

SEQ ID NO: 12511 - protein, 11 aa, Artificial Sequence
  Peptide Derived from Human Papillomavirus
TTVTTHNNPTF

SEQ ID NO: 12512 - protein, 8 aa, Artificial Sequence
  Peptide Derived from Human Papillomavirus
TVTSSTPI

SEQ ID NO: 12513 - protein, 10 aa, Artificial Sequence
  Peptide Derived from Human Papillomavirus
TVTTHNNPTF

SEQ ID NO: 12514 - protein, 10 aa, Artificial Sequence
  Peptide Derived from Human Papillomavirus
TYDNPAYEGI

SEQ ID NO: 12515 - protein, 10 aa, Artificial Sequence
  Peptide Derived from Human Papillomavirus
TYTTTSHAAL

SEQ ID NO: 12516 - protein, 8 aa, Artificial Sequence
  Peptide Derived from Human Papillomavirus
VFFGGLGI

SEQ ID NO: 12517 - protein, 9 aa, Artificial Sequence
  Peptide Derived from Human Papillomavirus
VTTHNNPTF

SEQ ID NO: 12518 - protein, 8 aa, Artificial Sequence
  Peptide Derived from Human Papillomavirus
YFFSDVSL

SEQ ID NO: 12519 - protein, 9 aa, Artificial Sequence
  Peptide Derived from Human Papillomavirus
YFSSNDNSI

SEQ ID NO: 12520 - protein, 11 aa, Artificial Sequence
  Peptide Derived from Human Papillomavirus
YFSSNDNSINI

SEQ ID NO: 12521 - protein, 8 aa, Artificial Sequence
  Peptide Derived from Human Papillomavirus
YIPANTTI

SEQ ID NO: 12522 - protein, 10 aa, Artificial Sequence
  Peptide Derived from Human Papillomavirus
YIPANTTIPF

SEQ ID NO: 12523 - protein, 8 aa, Artificial Sequence
  Peptide Derived from Human Papillomavirus
YLHPSYYM

SEQ ID NO: 12524 - protein, 9 aa, Artificial Sequence
  Peptide Derived from Human Papillomavirus
YLHPSYYML

SEQ ID NO: 12525 - protein, 10 aa, Artificial Sequence
  Peptide Derived from Human Papillomavirus
YMLRKRRKRL

SEQ ID NO: 12526 - protein, 10 aa, Artificial Sequence
  Peptide Derived from Human Papillomavirus
YTIIADAGDF

SEQ ID NO: 12527 - protein, 11 aa, Artificial Sequence
  Peptide Derived from Human Papillomavirus
YTIIADAGDFY

SEQ ID NO: 12528 - protein, 9 aa, Artificial Sequence
  Peptide Derived from Human Papillomavirus
YTTTSHAAL

SEQ ID NO: 12529 - protein, 11 aa, Artificial Sequence
  Peptide Derived from Human Papillomavirus
YYMLRKRRKRL

SEQ ID NO: 12530 - protein, 8 aa, Artificial Sequence
  Peptide Derived from Human Papillomavirus
YYYDFSTI

SEQ ID NO: 12531 - protein, 11 aa, Artificial Sequence
  Peptide Derived from Human Papillomavirus
AFLKSNCQAKY

SEQ ID NO: 12532 - protein, 9 aa, Artificial Sequence
  Peptide Derived from Human Papillomavirus
AIFGVNPTI

SEQ ID NO: 12533 - protein, 11 aa, Artificial Sequence
  Peptide Derived from Human Papillomavirus
AIVDKKTGDVI

SEQ ID NO: 12534 - protein, 9 aa, Artificial Sequence
  Peptide Derived from Human Papillomavirus
ALDGNPISI

SEQ ID NO: 12535 - protein, 9 aa, Artificial Sequence
  Peptide Derived from Human Papillomavirus
ALYWYRTGI

SEQ ID NO: 12536 - protein, 10 aa, Artificial Sequence
  Peptide Derived from Human Papillomavirus
AMLAVFKDTY

SEQ ID NO: 12537 - protein, 11 aa, Artificial Sequence
  Peptide Derived from Human Papillomavirus
AMLDDATTTCW

SEQ ID NO: 12538 - protein, 8 aa, Artificial Sequence
  Peptide Derived from Human Papillomavirus
ATDTGSDM

SEQ ID NO: 12539 - protein, 11 aa, Artificial Sequence
  Peptide Derived from Human Papillomavirus
ATDTGSDMVDF

SEQ ID NO: 12540 - protein, 8 aa, Artificial Sequence
  Peptide Derived from Human Papillomavirus
ATTTCWTY

SEQ ID NO: 12541 - protein, 9 aa, Artificial Sequence
  Peptide Derived from Human Papillomavirus
ATTTCWTYF

SEQ ID NO: 12542 - protein, 9 aa, Artificial Sequence
  Peptide Derived from Human Papillomavirus
AVFKDTYGL

SEQ ID NO: 12543 - protein, 11 aa, Artificial Sequence
  Peptide Derived from Human Papillomavirus
AVFKDTYGLSF

SEQ ID NO: 12544 - protein, 10 aa, Artificial Sequence
  Peptide Derived from Human Papillomavirus
CFFERTWSRL

SEQ ID NO: 12545 - protein, 9 aa, Artificial Sequence
  Peptide Derived from Human Papillomavirus
CLDCKWGVL

SEQ ID NO: 12546 - protein, 10 aa, Artificial Sequence
  Peptide Derived from Human Papillomavirus
CLDCKWGVLI

SEQ ID NO: 12547 - protein, 11 aa, Artificial Sequence
  Peptide Derived from Human Papillomavirus
CLDCKWGVLIL

SEQ ID NO: 12548 - protein, 9 aa, Artificial Sequence
  Peptide Derived from Human Papillomavirus
CMLIQPPKL

SEQ ID NO: 12549 - protein, 8 aa, Artificial Sequence
  Peptide Derived from Human Papillomavirus
CTDWVTAI

SEQ ID NO: 12550 - protein, 9 aa, Artificial Sequence
  Peptide Derived from Human Papillomavirus
CTDWVTAIF

SEQ ID NO: 12551 - protein, 9 aa, Artificial Sequence
  Peptide Derived from Human Papillomavirus
CTIAQLKDL

SEQ ID NO: 12552 - protein, 10 aa, Artificial Sequence
  Peptide Derived from Human Papillomavirus
CTIAQLKDLL

SEQ ID NO: 12553 - protein, 8 aa, Artificial Sequence
  Peptide Derived from Human Papillomavirus
CWTYFDTY

SEQ ID NO: 12554 - protein, 9 aa, Artificial Sequence
  Peptide Derived from Human Papillomavirus
CWTYFDTYM

SEQ ID NO: 12555 - protein, 9 aa, Artificial Sequence
  Peptide Derived from Human Papillomavirus
DFIDTQGTF

SEQ ID NO: 12556 - protein, 8 aa, Artificial Sequence
  Peptide Derived from Human Papillomavirus
DLSEMVQW

SEQ ID NO: 12557 - protein, 10 aa, Artificial Sequence
  Peptide Derived from Human Papillomavirus
DLSEMVQWAF

SEQ ID NO: 12558 - protein, 8 aa, Artificial Sequence
  Peptide Derived from Human Papillomavirus
DMAFEYAL

SEQ ID NO: 12559 - protein, 9 aa, Artificial Sequence
  Peptide Derived from Human Papillomavirus
DMAFEYALL

SEQ ID NO: 12560 - protein, 10 aa, Artificial Sequence
  Peptide Derived from Human Papillomavirus
DTEGNPFGTF

SEQ ID NO: 12561 - protein, 8 aa, Artificial Sequence
  Peptide Derived from Human Papillomavirus
DTELSPRL

SEQ ID NO: 12562 - protein, 11 aa, Artificial Sequence
  Peptide Derived from Human Papillomavirus
DTELSPRLQEI

SEQ ID NO: 12563 - protein, 9 aa, Artificial Sequence
  Peptide Derived from Human Papillomavirus
DTGSDMVDF

SEQ ID NO: 12564 - protein, 10 aa, Artificial Sequence
  Peptide Derived from Human Papillomavirus
DTGSDMVDFI

SEQ ID NO: 12565 - protein, 9 aa, Artificial Sequence
  Peptide Derived from Human Papillomavirus
DTPEWIQRL

SEQ ID NO: 12566 - protein, 11 aa, Artificial Sequence
  Peptide Derived from Human Papillomavirus
DTPEWIQRLTI

SEQ ID NO: 12567 - protein, 10 aa, Artificial Sequence
  Peptide Derived from Human Papillomavirus
DTYGLSFTDL

SEQ ID NO: 12568 - protein, 8 aa, Artificial Sequence
  Peptide Derived from Human Papillomavirus
DTYMRNAL

SEQ ID NO: 12569 - protein, 8 aa, Artificial Sequence
  Peptide Derived from Human Papillomavirus
DWRPIVQF

SEQ ID NO: 12570 - protein, 9 aa, Artificial Sequence
  Peptide Derived from Human Papillomavirus
DWRPIVQFL

SEQ ID NO: 12571 - protein, 11 aa, Artificial Sequence
  Peptide Derived from Human Papillomavirus
DWRPIVQFLRY

SEQ ID NO: 12572 - protein, 9 aa, Artificial Sequence
  Peptide Derived from Human Papillomavirus
EFITFLGAL

SEQ ID NO: 12573 - protein, 8 aa, Artificial Sequence
  Peptide Derived from Human Papillomavirus
EFPNAFPF

SEQ ID NO: 12574 - protein, 10 aa, Artificial Sequence
  Peptide Derived from Human Papillomavirus
EINDKNWKCF

SEQ ID NO: 12575 - protein, 11 aa, Artificial Sequence
  Peptide Derived from Human Papillomavirus
EINDKNWKCFF

SEQ ID NO: 12576 - protein, 8 aa, Artificial Sequence
  Peptide Derived from Human Papillomavirus
ELETAQAL

SEQ ID NO: 12577 - protein, 9 aa, Artificial Sequence
  Peptide Derived from Human Papillomavirus
ELETAQALF

SEQ ID NO: 12578 - protein, 9 aa, Artificial Sequence
  Peptide Derived from Human Papillomavirus
ELSPRLQEI

SEQ ID NO: 12579 - protein, 11 aa, Artificial Sequence
  Peptide Derived from Human Papillomavirus
ELSPRLQEISL

SEQ ID NO: 12580 - protein, 8 aa, Artificial Sequence
  Peptide Derived from Human Papillomavirus
ELTDESDM

SEQ ID NO: 12581 - protein, 10 aa, Artificial Sequence
  Peptide Derived from Human Papillomavirus
ELTDESDMAF

SEQ ID NO: 12582 - protein, 11 aa, Artificial Sequence
  Peptide Derived from Human Papillomavirus
EMVQWAFDNEL

SEQ ID NO: 12583 - protein, 11 aa, Artificial Sequence
  Peptide Derived from Human Papillomavirus
ETCMLIQPPKL

SEQ ID NO: 12584 - protein, 10 aa, Artificial Sequence
  Peptide Derived from Human Papillomavirus
EVDTELSPRL

SEQ ID NO: 12585 - protein, 9 aa, Artificial Sequence
  Peptide Derived from Human Papillomavirus
EVHNDAQVL

SEQ ID NO: 12586 - protein, 9 aa, Artificial Sequence
  Peptide Derived from Human Papillomavirus
EVMGDTPEW

SEQ ID NO: 12587 - protein, 10 aa, Artificial Sequence
  Peptide Derived from Human Papillomavirus
EVMGDTPEWI

SEQ ID NO: 12588 - protein, 8 aa, Artificial Sequence
  Peptide Derived from Human Papillomavirus
EWIQRLTI

SEQ ID NO: 12589 - protein, 9 aa, Artificial Sequence
  Peptide Derived from Human Papillomavirus
EWIQRLTII

SEQ ID NO: 12590 - protein, 9 aa, Artificial Sequence
  Peptide Derived from Human Papillomavirus
FFERTWSRL

SEQ ID NO: 12591 - protein, 11 aa, Artificial Sequence
  Peptide Derived from Human Papillomavirus
FFERTWSRLDL

SEQ ID NO: 12592 - protein, 8 aa, Artificial Sequence
  Peptide Derived from Human Papillomavirus
FIDTQGTF

SEQ ID NO: 12593 - protein, 10 aa, Artificial Sequence
  Peptide Derived from Human Papillomavirus
FIHFIQGAVI

SEQ ID NO: 12594 - protein, 10 aa, Artificial Sequence
  Peptide Derived from Human Papillomavirus
FILYAHIQCL

SEQ ID NO: 12595 - protein, 9 aa, Artificial Sequence
  Peptide Derived from Human Papillomavirus
FIQGAVISF

SEQ ID NO: 12596 - protein, 8 aa, Artificial Sequence
  Peptide Derived from Human Papillomavirus
FITFLGAL

SEQ ID NO: 12597 - protein, 11 aa, Artificial Sequence
  Peptide Derived from Human Papillomavirus
FITFLGALKSF

SEQ ID NO: 12598 - protein, 8 aa, Artificial Sequence
  Peptide Derived from Human Papillomavirus
FLGALKSF

SEQ ID NO: 12599 - protein, 9 aa, Artificial Sequence
  Peptide Derived from Human Papillomavirus
FLGALKSFL

SEQ ID NO: 12600 - protein, 11 aa, Artificial Sequence
  Peptide Derived from Human Papillomavirus
FLKGTPKKNCL

SEQ ID NO: 12601 - protein, 10 aa, Artificial Sequence
  Peptide Derived from Human Papillomavirus
FLKSNCQAKY

SEQ ID NO: 12602 - protein, 11 aa, Artificial Sequence
  Peptide Derived from Human Papillomavirus
FLKSNCQAKYL

SEQ ID NO: 12603 - protein, 9 aa, Artificial Sequence
  Peptide Derived from Human Papillomavirus
FLRYQQIEF

SEQ ID NO: 12604 - protein, 10 aa, Artificial Sequence
  Peptide Derived from Human Papillomavirus
FLRYQQIEFI

SEQ ID NO: 12605 - protein, 8 aa, Artificial Sequence
  Peptide Derived from Human Papillomavirus
FTDLVRNF

SEQ ID NO: 12606 - protein, 8 aa, Artificial Sequence
  Peptide Derived from Human Papillomavirus
FTISDSGY

SEQ ID NO: 12607 - protein, 8 aa, Artificial Sequence
  Peptide Derived from Human Papillomavirus
FVNSTSHF

SEQ ID NO: 12608 - protein, 9 aa, Artificial Sequence
  Peptide Derived from Human Papillomavirus
FVNSTSHFW

SEQ ID NO: 12609 - protein, 10 aa, Artificial Sequence
  Peptide Derived from Human Papillomavirus
FVNSTSHFWL

SEQ ID NO: 12610 - protein, 9 aa, Artificial Sequence
  Peptide Derived from Human Papillomavirus
GFKTLIQPF

SEQ ID NO: 12611 - protein, 10 aa, Artificial Sequence
  Peptide Derived from Human Papillomavirus
GFKTLIQPFI

SEQ ID NO: 12612 - protein, 11 aa, Artificial Sequence
  Peptide Derived from Human Papillomavirus
GFKTLIQPFIL

SEQ ID NO: 12613 - protein, 9 aa, Artificial Sequence
  Peptide Derived from Human Papillomavirus
GIDDSNFDL

SEQ ID NO: 12614 - protein, 9 aa, Artificial Sequence
  Peptide Derived from Human Papillomavirus
GISNISEVM

SEQ ID NO: 12615 - protein, 11 aa, Artificial Sequence
  Peptide Derived from Human Papillomavirus
GLSFTDLVRNF

SEQ ID NO: 12616 - protein, 8 aa, Artificial Sequence
  Peptide Derived from Human Papillomavirus
GMSFIHFI

SEQ ID NO: 12617 - protein, 9 aa, Artificial Sequence
  Peptide Derived from Human Papillomavirus
GTFCEQAEL

SEQ ID NO: 12618 - protein, 8 aa, Artificial Sequence
  Peptide Derived from Human Papillomavirus
GTGCNGWF

SEQ ID NO: 12619 - protein, 9 aa, Artificial Sequence
  Peptide Derived from Human Papillomavirus
GTGCNGWFY

SEQ ID NO: 12620 - protein, 8 aa, Artificial Sequence
  Peptide Derived from Human Papillomavirus
GTPKKNCL

SEQ ID NO: 12621 - protein, 10 aa, Artificial Sequence
  Peptide Derived from Human Papillomavirus
GTPKKNCLVF

SEQ ID NO: 12622 - protein, 8 aa, Artificial Sequence
  Peptide Derived from Human Papillomavirus
GTSDNSNI

SEQ ID NO: 12623 - protein, 8 aa, Artificial Sequence
  Peptide Derived from Human Papillomavirus
GVLILALL

SEQ ID NO: 12624 - protein, 10 aa, Artificial Sequence
  Peptide Derived from Human Papillomavirus
GVLILALLRY

SEQ ID NO: 12625 - protein, 10 aa, Artificial Sequence
  Peptide Derived from Human Papillomavirus
GVNPTIAEGF

SEQ ID NO: 12626 - protein, 8 aa, Artificial Sequence
  Peptide Derived from Human Papillomavirus
GWFYVQAI

SEQ ID NO: 12627 - protein, 8 aa, Artificial Sequence
  Peptide Derived from Human Papillomavirus
HFIQGAVI

SEQ ID NO: 12628 - protein, 10 aa, Artificial Sequence
  Peptide Derived from Human Papillomavirus
HFIQGAVISF

SEQ ID NO: 12629 - protein, 9 aa, Artificial Sequence
  Peptide Derived from Human Papillomavirus
HIQCLDCKW

SEQ ID NO: 12630 - protein, 8 aa, Artificial Sequence
  Peptide Derived from Human Papillomavirus
HVPETCML

SEQ ID NO: 12631 - protein, 9 aa, Artificial Sequence
  Peptide Derived from Human Papillomavirus
HVPETCMLI

SEQ ID NO: 12632 - protein, 10 aa, Artificial Sequence
  Peptide Derived from Human Papillomavirus
HYRRAQKRQM

SEQ ID NO: 12633 - protein, 8 aa, Artificial Sequence
  Peptide Derived from Human Papillomavirus
IFGVNPTI

SEQ ID NO: 12634 - protein, 11 aa, Artificial Sequence
  Peptide Derived from Human Papillomavirus
IIQHGIDDSNF

SEQ ID NO: 12635 - protein, 9 aa, Artificial Sequence
  Peptide Derived from Human Papillomavirus
ILYAHIQCL

SEQ ID NO: 12636 - protein, 10 aa, Artificial Sequence
  Peptide Derived from Human Papillomavirus
ITFLGALKSF

SEQ ID NO: 12637 - protein, 11 aa, Artificial Sequence
  Peptide Derived from Human Papillomavirus
ITFLGALKSFL

SEQ ID NO: 12638 - protein, 10 aa, Artificial Sequence
  Peptide Derived from Human Papillomavirus
ITVFEFPNAF

SEQ ID NO: 12639 - protein, 10 aa, Artificial Sequence
  Peptide Derived from Human Papillomavirus
IVDKKTGDVI

SEQ ID NO: 12640 - protein, 10 aa, Artificial Sequence
  Peptide Derived from Human Papillomavirus
IVQFLRYQQI

SEQ ID NO: 12641 - protein, 8 aa, Artificial Sequence
  Peptide Derived from Human Papillomavirus
KIDEGGDW

SEQ ID NO: 12642 - protein, 11 aa, Artificial Sequence
  Peptide Derived from Human Papillomavirus
KIDEGGDWRPI

SEQ ID NO: 12643 - protein, 11 aa, Artificial Sequence
  Peptide Derived from Human Papillomavirus
KLRAGQNHRPL

SEQ ID NO: 12644 - protein, 9 aa, Artificial Sequence
  Peptide Derived from Human Papillomavirus
KLRSSVAAL

SEQ ID NO: 12645 - protein, 10 aa, Artificial Sequence
  Peptide Derived from Human Papillomavirus
KLRSSVAALY

SEQ ID NO: 12646 - protein, 11 aa, Artificial Sequence
  Peptide Derived from Human Papillomavirus
KLRSSVAALYW

SEQ ID NO: 12647 - protein, 8 aa, Artificial Sequence
  Peptide Derived from Human Papillomavirus
KTLIQPFI

SEQ ID NO: 12648 - protein, 9 aa, Artificial Sequence
  Peptide Derived from Human Papillomavirus
KTLIQPFIL

SEQ ID NO: 12649 - protein, 10 aa, Artificial Sequence
  Peptide Derived from Human Papillomavirus
KTLIQPFILY

SEQ ID NO: 12650 - protein, 11 aa, Artificial Sequence
  Peptide Derived from Human Papillomavirus
KTTCTDWVTAI

SEQ ID NO: 12651 - protein, 9 aa, Artificial Sequence
  Peptide Derived from Human Papillomavirus
KVNNKQGAM

SEQ ID NO: 12652 - protein, 10 aa, Artificial Sequence
  Peptide Derived from Human Papillomavirus
KVNNKQGAML

SEQ ID NO: 12653 - protein, 9 aa, Artificial Sequence
  Peptide Derived from Human Papillomavirus
KWGVLILAL

SEQ ID NO: 12654 - protein, 10 aa, Artificial Sequence
  Peptide Derived from Human Papillomavirus
KWGVLILALL

SEQ ID NO: 12655 - protein, 9 aa, Artificial Sequence
  Peptide Derived from Human Papillomavirus
KYLKDCATM

SEQ ID NO: 12656 - protein, 9 aa, Artificial Sequence
  Peptide Derived from Human Papillomavirus
LFTISDSGY

SEQ ID NO: 12657 - protein, 8 aa, Artificial Sequence
  Peptide Derived from Human Papillomavirus
LILALLRY

SEQ ID NO: 12658 - protein, 9 aa, Artificial Sequence
  Peptide Derived from Human Papillomavirus
LIQLKCPPI

SEQ ID NO: 12659 - protein, 10 aa, Artificial Sequence
  Peptide Derived from Human Papillomavirus
LIQLKCPPIL

SEQ ID NO: 12660 - protein, 11 aa, Artificial Sequence
  Peptide Derived from Human Papillomavirus
LIQLKCPPILL

SEQ ID NO: 12661 - protein, 8 aa, Artificial Sequence
  Peptide Derived from Human Papillomavirus
LIQPFILY

SEQ ID NO: 12662 - protein, 11 aa, Artificial Sequence
  Peptide Derived from Human Papillomavirus
LIQPFILYAHI

SEQ ID NO: 12663 - protein, 9 aa, Artificial Sequence
  Peptide Derived from Human Papillomavirus
LLHVPETCM

SEQ ID NO: 12664 - protein, 10 aa, Artificial Sequence
  Peptide Derived from Human Papillomavirus
LLHVPETCML

SEQ ID NO: 12665 - protein, 11 aa, Artificial Sequence
  Peptide Derived from Human Papillomavirus
LLHVPETCMLI

SEQ ID NO: 12666 - protein, 11 aa, Artificial Sequence
  Peptide Derived from Human Papillomavirus
LLKVNNKQGAM

SEQ ID NO: 12667 - protein, 11 aa, Artificial Sequence
  Peptide Derived from Human Papillomavirus
LLRYKCGKSRL

SEQ ID NO: 12668 - protein, 9 aa, Artificial Sequence
  Peptide Derived from Human Papillomavirus
LTDESDMAF

SEQ ID NO: 12669 - protein, 11 aa, Artificial Sequence
  Peptide Derived from Human Papillomavirus
LTDESDMAFEY

SEQ ID NO: 12670 - protein, 8 aa, Artificial Sequence
  Peptide Derived from Human Papillomavirus
LTDTKVAM

SEQ ID NO: 12671 - protein, 9 aa, Artificial Sequence
  Peptide Derived from Human Papillomavirus
LTDTKVAML

SEQ ID NO: 12672 - protein, 8 aa, Artificial Sequence
  Peptide Derived from Human Papillomavirus
LTIIQHGI

SEQ ID NO: 12673 - protein, 10 aa, Artificial Sequence
  Peptide Derived from Human Papillomavirus
LTVAKGLSTL

SEQ ID NO: 12674 - protein, 11 aa, Artificial Sequence
  Peptide Derived from Human Papillomavirus
LTVAKGLSTLL

SEQ ID NO: 12675 - protein, 8 aa, Artificial Sequence
  Peptide Derived from Human Papillomavirus
LYAHIQCL

SEQ ID NO: 12676 - protein, 8 aa, Artificial Sequence
  Peptide Derived from Human Papillomavirus
LYWYRTGI

SEQ ID NO: 12677 - protein, 11 aa, Artificial Sequence
  Peptide Derived from Human Papillomavirus
LYWYRTGISNI

SEQ ID NO: 12678 - protein, 9 aa, Artificial Sequence
  Peptide Derived from Human Papillomavirus
MLAVFKDTY

SEQ ID NO: 12679 - protein, 11 aa, Artificial Sequence
  Peptide Derived from Human Papillomavirus
MLAVFKDTYGL

SEQ ID NO: 12680 - protein, 10 aa, Artificial Sequence
  Peptide Derived from Human Papillomavirus
MLDDATTTCW

SEQ ID NO: 12681 - protein, 8 aa, Artificial Sequence
  Peptide Derived from Human Papillomavirus
MLIQPPKL

SEQ ID NO: 12682 - protein, 11 aa, Artificial Sequence
  Peptide Derived from Human Papillomavirus
MVDFIDTQGTF

SEQ ID NO: 12683 - protein, 10 aa, Artificial Sequence
  Peptide Derived from Human Papillomavirus
MVQWAFDNEL

SEQ ID NO: 12684 - protein, 10 aa, Artificial Sequence
  Peptide Derived from Human Papillomavirus
NFDLSEMVQW

SEQ ID NO: 12685 - protein, 11 aa, Artificial Sequence
  Peptide Derived from Human Papillomavirus
NIENVNPQCTI

SEQ ID NO: 12686 - protein, 10 aa, Artificial Sequence
  Peptide Derived from Human Papillomavirus
NIHPAKDNRW

SEQ ID NO: 12687 - protein, 8 aa, Artificial Sequence
  Peptide Derived from Human Papillomavirus
NMSQWIRF

SEQ ID NO: 12688 - protein, 9 aa, Artificial Sequence
  Peptide Derived from Human Papillomavirus
NTGKSYFGM

SEQ ID NO: 12689 - protein, 11 aa, Artificial Sequence
  Peptide Derived from Human Papillomavirus
NTGKSYFGMSF

SEQ ID NO: 12690 - protein, 11 aa, Artificial Sequence
  Peptide Derived from Human Papillomavirus
NVCSGGSTEAI

SEQ ID NO: 12691 - protein, 8 aa, Artificial Sequence
  Peptide Derived from Human Papillomavirus
NVNPQCTI

SEQ ID NO: 12692 - protein, 11 aa, Artificial Sequence
  Peptide Derived from Human Papillomavirus
NVNPQCTIAQL

SEQ ID NO: 12693 - protein, 10 aa, Artificial Sequence
  Peptide Derived from Human Papillomavirus
NWKCFFERTW

SEQ ID NO: 12694 - protein, 10 aa, Artificial Sequence
  Peptide Derived from Human Papillomavirus
PFDKNGNPVY

SEQ ID NO: 12695 - protein, 8 aa, Artificial Sequence
  Peptide Derived from Human Papillomavirus
PFILYAHI

SEQ ID NO: 12696 - protein, 11 aa, Artificial Sequence
  Peptide Derived from Human Papillomavirus
PFILYAHIQCL

SEQ ID NO: 12697 - protein, 8 aa, Artificial Sequence
  Peptide Derived from Human Papillomavirus
PILLTTNI

SEQ ID NO: 12698 - protein, 11 aa, Artificial Sequence
  Peptide Derived from Human Papillomavirus
PISIDRKHKPL

SEQ ID NO: 12699 - protein, 8 aa, Artificial Sequence
  Peptide Derived from Human Papillomavirus
PIVQFLRY

SEQ ID NO: 12700 - protein, 11 aa, Artificial Sequence
  Peptide Derived from Human Papillomavirus
PIVQFLRYQQI

SEQ ID NO: 12701 - protein, 10 aa, Artificial Sequence
  Peptide Derived from Human Papillomavirus
PLIQLKCPPI

SEQ ID NO: 12702 - protein, 11 aa, Artificial Sequence
  Peptide Derived from Human Papillomavirus
PLIQLKCPPIL

SEQ ID NO: 12703 - protein, 9 aa, Artificial Sequence
  Peptide Derived from Human Papillomavirus
PLTDTKVAM

SEQ ID NO: 12704 - protein, 10 aa, Artificial Sequence
  Peptide Derived from Human Papillomavirus
PLTDTKVAML

SEQ ID NO: 12705 - protein, 10 aa, Artificial Sequence
  Peptide Derived from Human Papillomavirus
PTIAEGFKTL

SEQ ID NO: 12706 - protein, 11 aa, Artificial Sequence
  Peptide Derived from Human Papillomavirus
PTIAEGFKTLI

SEQ ID NO: 12707 - protein, 10 aa, Artificial Sequence
  Peptide Derived from Human Papillomavirus
PVYEINDKNW

SEQ ID NO: 12708 - protein, 10 aa, Artificial Sequence
  Peptide Derived from Human Papillomavirus
PYLESRITVF

SEQ ID NO: 12709 - protein, 8 aa, Artificial Sequence
  Peptide Derived from Human Papillomavirus
QFLRYQQI

SEQ ID NO: 12710 - protein, 10 aa, Artificial Sequence
  Peptide Derived from Human Papillomavirus
QFLRYQQIEF

SEQ ID NO: 12711 - protein, 11 aa, Artificial Sequence
  Peptide Derived from Human Papillomavirus
QFLRYQQIEFI

SEQ ID NO: 12712 - protein, 8 aa, Artificial Sequence
  Peptide Derived from Human Papillomavirus
QIEFITFL

SEQ ID NO: 12713 - protein, 11 aa, Artificial Sequence
  Peptide Derived from Human Papillomavirus
QIEFITFLGAL

SEQ ID NO: 12714 - protein, 8 aa, Artificial Sequence
  Peptide Derived from Human Papillomavirus
QLKCPPIL

SEQ ID NO: 12715 - protein, 9 aa, Artificial Sequence
  Peptide Derived from Human Papillomavirus
QLKCPPILL

SEQ ID NO: 12716 - protein, 8 aa, Artificial Sequence
  Peptide Derived from Human Papillomavirus
QMNMSQWI

SEQ ID NO: 12717 - protein, 10 aa, Artificial Sequence
  Peptide Derived from Human Papillomavirus
QMNMSQWIRF

SEQ ID NO: 12718 - protein, 10 aa, Artificial Sequence
  Peptide Derived from Human Papillomavirus
QVLHVLKRKF

SEQ ID NO: 12719 - protein, 8 aa, Artificial Sequence
  Peptide Derived from Human Papillomavirus
QWAFDNEL

SEQ ID NO: 12720 - protein, 10 aa, Artificial Sequence
  Peptide Derived from Human Papillomavirus
QWIRFRCSKI

SEQ ID NO: 12721 - protein, 11 aa, Artificial Sequence
  Peptide Derived from Human Papillomavirus
RITVFEFPNAF

SEQ ID NO: 12722 - protein, 8 aa, Artificial Sequence
  Peptide Derived from Human Papillomavirus
RLEVDTEL

SEQ ID NO: 12723 - protein, 10 aa, Artificial Sequence
  Peptide Derived from Human Papillomavirus
RLFTISDSGY

SEQ ID NO: 12724 - protein, 9 aa, Artificial Sequence
  Peptide Derived from Human Papillomavirus
RLTIIQHGI

SEQ ID NO: 12725 - protein, 8 aa, Artificial Sequence
  Peptide Derived from Human Papillomavirus
RLTVAKGL

SEQ ID NO: 12726 - protein, 11 aa, Artificial Sequence
  Peptide Derived from Human Papillomavirus
RLTVAKGLSTL

SEQ ID NO: 12727 - protein, 11 aa, Artificial Sequence
  Peptide Derived from Human Papillomavirus
RTGISNISEVM

SEQ ID NO: 12728 - protein, 8 aa, Artificial Sequence
  Peptide Derived from Human Papillomavirus
RTWSRLDL

SEQ ID NO: 12729 - protein, 9 aa, Artificial Sequence
  Peptide Derived from Human Papillomavirus
RWPYLESRI

SEQ ID NO: 12730 - protein, 9 aa, Artificial Sequence
  Peptide Derived from Human Papillomavirus
RYKCGKSRL

SEQ ID NO: 12731 - protein, 8 aa, Artificial Sequence
  Peptide Derived from Human Papillomavirus
RYQQIEFI

SEQ ID NO: 12732 - protein, 10 aa, Artificial Sequence
  Peptide Derived from Human Papillomavirus
RYQQIEFITF

SEQ ID NO: 12733 - protein, 11 aa, Artificial Sequence
  Peptide Derived from Human Papillomavirus
RYQQIEFITFL

SEQ ID NO: 12734 - protein, 11 aa, Artificial Sequence
  Peptide Derived from Human Papillomavirus
SFIHFIQGAVI

SEQ ID NO: 12735 - protein, 9 aa, Artificial Sequence
  Peptide Derived from Human Papillomavirus
SFTDLVRNF

SEQ ID NO: 12736 - protein, 9 aa, Artificial Sequence
  Peptide Derived from Human Papillomavirus
SFVNSTSHF

SEQ ID NO: 12737 - protein, 10 aa, Artificial Sequence
  Peptide Derived from Human Papillomavirus
SFVNSTSHFW

SEQ ID NO: 12738 - protein, 11 aa, Artificial Sequence
  Peptide Derived from Human Papillomavirus
SFVNSTSHFWL

SEQ ID NO: 12739 - protein, 9 aa, Artificial Sequence
  Peptide Derived from Human Papillomavirus
SIDRKHKPL

SEQ ID NO: 12740 - protein, 10 aa, Artificial Sequence
  Peptide Derived from Human Papillomavirus
SIDRKHKPLI

SEQ ID NO: 12741 - protein, 11 aa, Artificial Sequence
  Peptide Derived from Human Papillomavirus
STENSPLGERL

SEQ ID NO: 12742 - protein, 11 aa, Artificial Sequence
  Peptide Derived from Human Papillomavirus
STLLHVPETCM

SEQ ID NO: 12743 - protein, 10 aa, Artificial Sequence
  Peptide Derived from Human Papillomavirus
STSHFWLEPL

SEQ ID NO: 12744 - protein, 8 aa, Artificial Sequence
  Peptide Derived from Human Papillomavirus
SVAALYWY

SEQ ID NO: 12745 - protein, 11 aa, Artificial Sequence
  Peptide Derived from Human Papillomavirus
SVDGTSDNSNI

SEQ ID NO: 12746 - protein, 8 aa, Artificial Sequence
  Peptide Derived from Human Papillomavirus
SYFGMSFI

SEQ ID NO: 12747 - protein, 10 aa, Artificial Sequence
  Peptide Derived from Human Papillomavirus
SYFGMSFIHF

SEQ ID NO: 12748 - protein, 11 aa, Artificial Sequence
  Peptide Derived from Human Papillomavirus
SYFGMSFIHFI

SEQ ID NO: 12749 - protein, 8 aa, Artificial Sequence
  Peptide Derived from Human Papillomavirus
TFCEQAEL

SEQ ID NO: 12750 - protein, 9 aa, Artificial Sequence
  Peptide Derived from Human Papillomavirus
TFLGALKSF

SEQ ID NO: 12751 - protein, 10 aa, Artificial Sequence
  Peptide Derived from Human Papillomavirus
TFLGALKSFL

SEQ ID NO: 12752 - protein, 9 aa, Artificial Sequence
  Peptide Derived from Human Papillomavirus
TIAEGFKTL

SEQ ID NO: 12753 - protein, 10 aa, Artificial Sequence
  Peptide Derived from Human Papillomavirus
TIAEGFKTLI

SEQ ID NO: 12754 - protein, 8 aa, Artificial Sequence
  Peptide Derived from Human Papillomavirus
TIAQLKDL

SEQ ID NO: 12755 - protein, 9 aa, Artificial Sequence
  Peptide Derived from Human Papillomavirus
TIAQLKDLL

SEQ ID NO: 12756 - protein, 8 aa, Artificial Sequence
  Peptide Derived from Human Papillomavirus
TLIQPFIL

SEQ ID NO: 12757 - protein, 9 aa, Artificial Sequence
  Peptide Derived from Human Papillomavirus
TLIQPFILY

SEQ ID NO: 12758 - protein, 10 aa, Artificial Sequence
  Peptide Derived from Human Papillomavirus
TLLHVPETCM

SEQ ID NO: 12759 - protein, 11 aa, Artificial Sequence
  Peptide Derived from Human Papillomavirus
TLLHVPETCML

SEQ ID NO: 12760 - protein, 10 aa, Artificial Sequence
  Peptide Derived from Human Papillomavirus
TTCTDWVTAI

SEQ ID NO: 12761 - protein, 11 aa, Artificial Sequence
  Peptide Derived from Human Papillomavirus
TTCTDWVTAIF

SEQ ID NO: 12762 - protein, 10 aa, Artificial Sequence
  Peptide Derived from Human Papillomavirus
TTCWTYFDTY

SEQ ID NO: 12763 - protein, 11 aa, Artificial Sequence
  Peptide Derived from Human Papillomavirus
TTCWTYFDTYM

SEQ ID NO: 12764 - protein, 8 aa, Artificial Sequence
  Peptide Derived from Human Papillomavirus
TTTCWTYF

SEQ ID NO: 12765 - protein, 11 aa, Artificial Sequence
  Peptide Derived from Human Papillomavirus
TTTCWTYFDTY

SEQ ID NO: 12766 - protein, 9 aa, Artificial Sequence
  Peptide Derived from Human Papillomavirus
TVAKGLSTL

SEQ ID NO: 12767 - protein, 10 aa, Artificial Sequence
  Peptide Derived from Human Papillomavirus
TVAKGLSTLL

SEQ ID NO: 12768 - protein, 9 aa, Artificial Sequence
  Peptide Derived from Human Papillomavirus
TVFEFPNAF

SEQ ID NO: 12769 - protein, 11 aa, Artificial Sequence
  Peptide Derived from Human Papillomavirus
TVFEFPNAFPF

SEQ ID NO: 12770 - protein, 11 aa, Artificial Sequence
  Peptide Derived from Human Papillomavirus
TYFDTYMRNAL

SEQ ID NO: 12771 - protein, 9 aa, Artificial Sequence
  Peptide Derived from Human Papillomavirus
TYGLSFTDL

SEQ ID NO: 12772 - protein, 8 aa, Artificial Sequence
  Peptide Derived from Human Papillomavirus
VFEFPNAF

SEQ ID NO: 12773 - protein, 10 aa, Artificial Sequence
  Peptide Derived from Human Papillomavirus
VFEFPNAFPF

SEQ ID NO: 12774 - protein, 8 aa, Artificial Sequence
  Peptide Derived from Human Papillomavirus
VFKDTYGL

SEQ ID NO: 12775 - protein, 10 aa, Artificial Sequence
  Peptide Derived from Human Papillomavirus
VFKDTYGLSF

SEQ ID NO: 12776 - protein, 11 aa, Artificial Sequence
  Peptide Derived from Human Papillomavirus
VISFVNSTSHF

SEQ ID NO: 12777 - protein, 9 aa, Artificial Sequence
  Peptide Derived from Human Papillomavirus
VLHVLKRKF

SEQ ID NO: 12778 - protein, 9 aa, Artificial Sequence
  Peptide Derived from Human Papillomavirus
VLILALLRY

SEQ ID NO: 12779 - protein, 8 aa, Artificial Sequence
  Peptide Derived from Human Papillomavirus
VMGDTPEW

SEQ ID NO: 12780 - protein, 9 aa, Artificial Sequence
  Peptide Derived from Human Papillomavirus
VMGDTPEWI

SEQ ID NO: 12781 - protein, 11 aa, Artificial Sequence
  Peptide Derived from Human Papillomavirus
VTAIFGVNPTI

SEQ ID NO: 12782 - protein, 9 aa, Artificial Sequence
  Peptide Derived from Human Papillomavirus
VYEINDKNW

SEQ ID NO: 12783 - protein, 8 aa, Artificial Sequence
  Peptide Derived from Human Papillomavirus
WIQRLTII

SEQ ID NO: 12784 - protein, 9 aa, Artificial Sequence
  Peptide Derived from Human Papillomavirus
WIRFRCSKI

SEQ ID NO: 12785 - protein, 8 aa, Artificial Sequence
  Peptide Derived from Human Papillomavirus
WTYFDTYM

SEQ ID NO: 12786 - protein, 9 aa, Artificial Sequence
  Peptide Derived from Human Papillomavirus
WYRTGISNI

SEQ ID NO: 12787 - protein, 10 aa, Artificial Sequence
  Peptide Derived from Human Papillomavirus
YFDTYMRNAL

SEQ ID NO: 12788 - protein, 9 aa, Artificial Sequence
  Peptide Derived from Human Papillomavirus
YFGMSFIHF

SEQ ID NO: 12789 - protein, 10 aa, Artificial Sequence
  Peptide Derived from Human Papillomavirus
YFGMSFIHFI

SEQ ID NO: 12790 - protein, 9 aa, Artificial Sequence
  Peptide Derived from Human Papillomavirus
YLESRITVF

SEQ ID NO: 12791 - protein, 11 aa, Artificial Sequence
  Peptide Derived from Human Papillomavirus
YLESRITVFEF

SEQ ID NO: 12792 - protein, 8 aa, Artificial Sequence
  Peptide Derived from Human Papillomavirus
YLKDCATM

SEQ ID NO: 12793 - protein, 11 aa, Artificial Sequence
  Peptide Derived from Human Papillomavirus
YMRNALDGNPI

SEQ ID NO: 12794 - protein, 10 aa, Artificial Sequence
  Peptide Derived from Human Papillomavirus
YWYRTGISNI

SEQ ID NO: 12795 - protein, 8 aa, Artificial Sequence
  Peptide Derived from Human Papillomavirus
AIELQMAL

SEQ ID NO: 12796 - protein, 11 aa, Artificial Sequence
  Peptide Derived from Human Papillomavirus
AIELQMALQGL

SEQ ID NO: 12797 - protein, 11 aa, Artificial Sequence
  Peptide Derived from Human Papillomavirus
AIFFAAREHGI

SEQ ID NO: 12798 - protein, 8 aa, Artificial Sequence
  Peptide Derived from Human Papillomavirus
AIPDSVQI

SEQ ID NO: 12799 - protein, 9 aa, Artificial Sequence
  Peptide Derived from Human Papillomavirus
AIPDSVQIL

SEQ ID NO: 12800 - protein, 10 aa, Artificial Sequence
  Peptide Derived from Human Papillomavirus
ALQGLAQSRY

SEQ ID NO: 12801 - protein, 9 aa, Artificial Sequence
  Peptide Derived from Human Papillomavirus
ATCVSHRGL

SEQ ID NO: 12802 - protein, 10 aa, Artificial Sequence
  Peptide Derived from Human Papillomavirus
ATCVSHRGLY

SEQ ID NO: 12803 - protein, 11 aa, Artificial Sequence
  Peptide Derived from Human Papillomavirus
ATCVSHRGLYY

SEQ ID NO: 12804 - protein, 8 aa, Artificial Sequence
  Peptide Derived from Human Papillomavirus
ATQLVKQL

SEQ ID NO: 12805 - protein, 9 aa, Artificial Sequence
  Peptide Derived from Human Papillomavirus
ATRPGHCGL

SEQ ID NO: 12806 - protein, 8 aa, Artificial Sequence
  Peptide Derived from Human Papillomavirus
AWDSVYYM

SEQ ID NO: 12807 - protein, 11 aa, Artificial Sequence
  Peptide Derived from Human Papillomavirus
CMTYVAWDSVY

SEQ ID NO: 12808 - protein, 10 aa, Artificial Sequence
  Peptide Derived from Human Papillomavirus
CVQDKIIDHY

SEQ ID NO: 12809 - protein, 8 aa, Artificial Sequence
  Peptide Derived from Human Papillomavirus
CVSHRGLY

SEQ ID NO: 12810 - protein, 9 aa, Artificial Sequence
  Peptide Derived from Human Papillomavirus
CVSHRGLYY

SEQ ID NO: 12811 - protein, 8 aa, Artificial Sequence
  Peptide Derived from Human Papillomavirus
DIDSQIQY

SEQ ID NO: 12812 - protein, 9 aa, Artificial Sequence
  Peptide Derived from Human Papillomavirus
DIDSQIQYW

SEQ ID NO: 12813 - protein, 11 aa, Artificial Sequence
  Peptide Derived from Human Papillomavirus
DIDSQIQYWQL

SEQ ID NO: 12814 - protein, 8 aa, Artificial Sequence
  Peptide Derived from Human Papillomavirus
DISSTWHW

SEQ ID NO: 12815 - protein, 8 aa, Artificial Sequence
  Peptide Derived from Human Papillomavirus
DTVSATQL

SEQ ID NO: 12816 - protein, 11 aa, Artificial Sequence
  Peptide Derived from Human Papillomavirus
DWTLQDTCEEL

SEQ ID NO: 12817 - protein, 9 aa, Artificial Sequence
  Peptide Derived from Human Papillomavirus
EFKSECEKY

SEQ ID NO: 12818 - protein, 9 aa, Artificial Sequence
  Peptide Derived from Human Papillomavirus
ELQMALQGL

SEQ ID NO: 12819 - protein, 11 aa, Artificial Sequence
  Peptide Derived from Human Papillomavirus
ELWNTEPTHCF

SEQ ID NO: 12820 - protein, 8 aa, Artificial Sequence
  Peptide Derived from Human Papillomavirus
ETQRTKFL

SEQ ID NO: 12821 - protein, 9 aa, Artificial Sequence
  Peptide Derived from Human Papillomavirus
EVHFGNNVI

SEQ ID NO: 12822 - protein, 9 aa, Artificial Sequence
  Peptide Derived from Human Papillomavirus
FFAAREHGI

SEQ ID NO: 12823 - protein, 9 aa, Artificial Sequence
  Peptide Derived from Human Papillomavirus
GLYYVKEGY

SEQ ID NO: 12824 - protein, 9 aa, Artificial Sequence
  Peptide Derived from Human Papillomavirus
GYNTFYIEF

SEQ ID NO: 12825 - protein, 9 aa, Artificial Sequence
  Peptide Derived from Human Papillomavirus
HLKGDRNSL

SEQ ID NO: 12826 - protein, 9 aa, Artificial Sequence
  Peptide Derived from Human Papillomavirus
HYENDSKDI

SEQ ID NO: 12827 - protein, 9 aa, Artificial Sequence
  Peptide Derived from Human Papillomavirus
HYRDISSTW

SEQ ID NO: 12828 - protein, 11 aa, Artificial Sequence
  Peptide Derived from Human Papillomavirus
HYRDISSTWHW

SEQ ID NO: 12829 - protein, 10 aa, Artificial Sequence
  Peptide Derived from Human Papillomavirus
IFFAAREHGI

SEQ ID NO: 12830 - protein, 11 aa, Artificial Sequence
  Peptide Derived from Human Papillomavirus
IIHLKGDRNSL

SEQ ID NO: 12831 - protein, 8 aa, Artificial Sequence
  Peptide Derived from Human Papillomavirus
ILVGYMTM

SEQ ID NO: 12832 - protein, 8 aa, Artificial Sequence
  Peptide Derived from Human Papillomavirus
KFLNTVAI

SEQ ID NO: 12833 - protein, 10 aa, Artificial Sequence
  Peptide Derived from Human Papillomavirus
KLCSGNTTPI

SEQ ID NO: 12834 - protein, 11 aa, Artificial Sequence
  Peptide Derived from Human Papillomavirus
KLCSGNTTPII

SEQ ID NO: 12835 - protein, 11 aa, Artificial Sequence
  Peptide Derived from Human Papillomavirus
KTATCVSHRGL

SEQ ID NO: 12836 - protein, 9 aa, Artificial Sequence
  Peptide Derived from Human Papillomavirus
KTGILTVTY

SEQ ID NO: 12837 - protein, 8 aa, Artificial Sequence
  Peptide Derived from Human Papillomavirus
KYGNTGTW

SEQ ID NO: 12838 - protein, 8 aa, Artificial Sequence
  Peptide Derived from Human Papillomavirus
LIRWENAI

SEQ ID NO: 12839 - protein, 9 aa, Artificial Sequence
  Peptide Derived from Human Papillomavirus
LIRWENAIF

SEQ ID NO: 12840 - protein, 10 aa, Artificial Sequence
  Peptide Derived from Human Papillomavirus
LIRWENAIFF

SEQ ID NO: 12841 - protein, 10 aa, Artificial Sequence
  Peptide Derived from Human Papillomavirus
LWNTEPTHCF

SEQ ID NO: 12842 - protein, 8 aa, Artificial Sequence
  Peptide Derived from Human Papillomavirus
LYYVKEGY

SEQ ID NO: 12843 - protein, 11 aa, Artificial Sequence
  Peptide Derived from Human Papillomavirus
LYYVKEGYNTF

SEQ ID NO: 12844 - protein, 10 aa, Artificial Sequence
  Peptide Derived from Human Papillomavirus
MTYVAWDSVY

SEQ ID NO: 12845 - protein, 11 aa, Artificial Sequence
  Peptide Derived from Human Papillomavirus
MTYVAWDSVYY

SEQ ID NO: 12846 - protein, 11 aa, Artificial Sequence
  Peptide Derived from Human Papillomavirus
NISKSKAHKAI

SEQ ID NO: 12847 - protein, 8 aa, Artificial Sequence
  Peptide Derived from Human Papillomavirus
NTEPTHCF

SEQ ID NO: 12848 - protein, 9 aa, Artificial Sequence
  Peptide Derived from Human Papillomavirus
NTGTWEVHF

SEQ ID NO: 12849 - protein, 8 aa, Artificial Sequence
  Peptide Derived from Human Papillomavirus
NTTPIIHL

SEQ ID NO: 12850 - protein, 11 aa, Artificial Sequence
  Peptide Derived from Human Papillomavirus
NTVAIPDSVQI

SEQ ID NO: 12851 - protein, 9 aa, Artificial Sequence
  Peptide Derived from Human Papillomavirus
NVIDCNDSM

SEQ ID NO: 12852 - protein, 10 aa, Artificial Sequence
  Peptide Derived from Human Papillomavirus
PTGNNKRRKL

SEQ ID NO: 12853 - protein, 9 aa, Artificial Sequence
  Peptide Derived from Human Papillomavirus
QILVGYMTM

SEQ ID NO: 12854 - protein, 8 aa, Artificial Sequence
  Peptide Derived from Human Papillomavirus
QIQYWQLI

SEQ ID NO: 12855 - protein, 10 aa, Artificial Sequence
  Peptide Derived from Human Papillomavirus
QIQYWQLIRW

SEQ ID NO: 12856 - protein, 9 aa, Artificial Sequence
  Peptide Derived from Human Papillomavirus
QLIRWENAI

SEQ ID NO: 12857 - protein, 10 aa, Artificial Sequence
  Peptide Derived from Human Papillomavirus
QLIRWENAIF

SEQ ID NO: 12858 - protein, 11 aa, Artificial Sequence
  Peptide Derived from Human Papillomavirus
QLIRWENAIFF

SEQ ID NO: 12859 - protein, 9 aa, Artificial Sequence
  Peptide Derived from Human Papillomavirus
QLQHTPSPY

SEQ ID NO: 12860 - protein, 11 aa, Artificial Sequence
  Peptide Derived from Human Papillomavirus
QTLNHQVVPAY

SEQ ID NO: 12861 - protein, 11 aa, Artificial Sequence
  Peptide Derived from Human Papillomavirus
QTPKETLSERL

SEQ ID NO: 12862 - protein, 8 aa, Artificial Sequence
  Peptide Derived from Human Papillomavirus
QVVPAYNI

SEQ ID NO: 12863 - protein, 8 aa, Artificial Sequence
  Peptide Derived from Human Papillomavirus
QYWQLIRW

SEQ ID NO: 12864 - protein, 9 aa, Artificial Sequence
  Peptide Derived from Human Papillomavirus
RLRKHSDHY

SEQ ID NO: 12865 - protein, 9 aa, Artificial Sequence
  Peptide Derived from Human Papillomavirus
RLSCVQDKI

SEQ ID NO: 12866 - protein, 10 aa, Artificial Sequence
  Peptide Derived from Human Papillomavirus
RLSCVQDKII

SEQ ID NO: 12867 - protein, 10 aa, Artificial Sequence
  Peptide Derived from Human Papillomavirus
RTKFLNTVAI

SEQ ID NO: 12868 - protein, 8 aa, Artificial Sequence
  Peptide Derived from Human Papillomavirus
RWENAIFF

SEQ ID NO: 12869 - protein, 9 aa, Artificial Sequence
  Peptide Derived from Human Papillomavirus
RYKTEDWTL

SEQ ID NO: 12870 - protein, 11 aa, Artificial Sequence
  Peptide Derived from Human Papillomavirus
RYRLRKHSDHY

SEQ ID NO: 12871 - protein, 9 aa, Artificial Sequence
  Peptide Derived from Human Papillomavirus
SLKCLRYRL

SEQ ID NO: 12872 - protein, 11 aa, Artificial Sequence
  Peptide Derived from Human Papillomavirus
STVSVGTAKTY

SEQ ID NO: 12873 - protein, 8 aa, Artificial Sequence
  Peptide Derived from Human Papillomavirus
SVGTAKTY

SEQ ID NO: 12874 - protein, 8 aa, Artificial Sequence
  Peptide Derived from Human Papillomavirus
SVQILVGY

SEQ ID NO: 12875 - protein, 9 aa, Artificial Sequence
  Peptide Derived from Human Papillomavirus
SVQILVGYM

SEQ ID NO: 12876 - protein, 11 aa, Artificial Sequence
  Peptide Derived from Human Papillomavirus
SVQILVGYMTM

SEQ ID NO: 12877 - protein, 11 aa, Artificial Sequence
  Peptide Derived from Human Papillomavirus
SVYYMTDAGTW

SEQ ID NO: 12878 - protein, 10 aa, Artificial Sequence
  Peptide Derived from Human Papillomavirus
TLNHQVVPAY

SEQ ID NO: 12879 - protein, 9 aa, Artificial Sequence
  Peptide Derived from Human Papillomavirus
TLQDTCEEL

SEQ ID NO: 12880 - protein, 10 aa, Artificial Sequence
  Peptide Derived from Human Papillomavirus
TLQDTCEELW

SEQ ID NO: 12881 - protein, 10 aa, Artificial Sequence
  Peptide Derived from Human Papillomavirus
TVAIPDSVQI

SEQ ID NO: 12882 - protein, 11 aa, Artificial Sequence
  Peptide Derived from Human Papillomavirus
TVAIPDSVQIL

SEQ ID NO: 12883 - protein, 11 aa, Artificial Sequence
  Peptide Derived from Human Papillomavirus
TVSATQLVKQL

SEQ ID NO: 12884 - protein, 10 aa, Artificial Sequence
  Peptide Derived from Human Papillomavirus
TVSVGTAKTY

SEQ ID NO: 12885 - protein, 11 aa, Artificial Sequence
  Peptide Derived from Human Papillomavirus
TWEVHFGNNVI

SEQ ID NO: 12886 - protein, 11 aa, Artificial Sequence
  Peptide Derived from Human Papillomavirus
TYHSETQRTKF

SEQ ID NO: 12887 - protein, 9 aa, Artificial Sequence
  Peptide Derived from Human Papillomavirus
TYVAWDSVY

SEQ ID NO: 12888 - protein, 10 aa, Artificial Sequence
  Peptide Derived from Human Papillomavirus
TYVAWDSVYY

SEQ ID NO: 12889 - protein, 11 aa, Artificial Sequence
  Peptide Derived from Human Papillomavirus
TYVAWDSVYYM

SEQ ID NO: 12890 - protein, 8 aa, Artificial Sequence
  Peptide Derived from Human Papillomavirus
VIDCNDSM

SEQ ID NO: 12891 - protein, 11 aa, Artificial Sequence
  Peptide Derived from Human Papillomavirus
VYFDGNKDNCM

SEQ ID NO: 12892 - protein, 10 aa, Artificial Sequence
  Peptide Derived from Human Papillomavirus
VYYMTDAGTW

SEQ ID NO: 12893 - protein, 11 aa, Artificial Sequence
  Peptide Derived from Human Papillomavirus
WTGAGNEKTGI

SEQ ID NO: 12894 - protein, 10 aa, Artificial Sequence
  Peptide Derived from Human Papillomavirus
WTLQDTCEEL

SEQ ID NO: 12895 - protein, 11 aa, Artificial Sequence
  Peptide Derived from Human Papillomavirus
WTLQDTCEELW

SEQ ID NO: 12896 - protein, 10 aa, Artificial Sequence
  Peptide Derived from Human Papillomavirus
YFDGNKDNCM

SEQ ID NO: 12897 - protein, 11 aa, Artificial Sequence
  Peptide Derived from Human Papillomavirus
YIEFKSECEKY

SEQ ID NO: 12898 - protein, 8 aa, Artificial Sequence
  Peptide Derived from Human Papillomavirus
YMTDAGTW

SEQ ID NO: 12899 - protein, 8 aa, Artificial Sequence
  Peptide Derived from Human Papillomavirus
YVAWDSVY

SEQ ID NO: 12900 - protein, 9 aa, Artificial Sequence
  Peptide Derived from Human Papillomavirus
YVAWDSVYY

SEQ ID NO: 12901 - protein, 10 aa, Artificial Sequence
  Peptide Derived from Human Papillomavirus
YVAWDSVYYM

SEQ ID NO: 12902 - protein, 9 aa, Artificial Sequence
  Peptide Derived from Human Papillomavirus
YVKEGYNTF

SEQ ID NO: 12903 - protein, 10 aa, Artificial Sequence
  Peptide Derived from Human Papillomavirus
YVKEGYNTFY

SEQ ID NO: 12904 - protein, 11 aa, Artificial Sequence
  Peptide Derived from Human Papillomavirus
YVKEGYNTFYI

SEQ ID NO: 12905 - protein, 11 aa, Artificial Sequence
  Peptide Derived from Human Papillomavirus
YWQLIRWENAI

SEQ ID NO: 12906 - protein, 9 aa, Artificial Sequence
  Peptide Derived from Human Papillomavirus
YYMTDAGTW

SEQ ID NO: 12907 - protein, 10 aa, Artificial Sequence
  Peptide Derived from Human Papillomavirus
YYVKEGYNTF

SEQ ID NO: 12908 - protein, 11 aa, Artificial Sequence
  Peptide Derived from Human Papillomavirus
YYVKEGYNTFY

SEQ ID NO: 12909 - protein, 9 aa, Artificial Sequence
  Peptide Derived from Human Papillomavirus
AFTVYVFCF

SEQ ID NO: 12910 - protein, 10 aa, Artificial Sequence
  Peptide Derived from Human Papillomavirus
AFTVYVFCFL

SEQ ID NO: 12911 - protein, 11 aa, Artificial Sequence
  Peptide Derived from Human Papillomavirus
AFTVYVFCFLL

SEQ ID NO: 12912 - protein, 9 aa, Artificial Sequence
  Peptide Derived from Human Papillomavirus
ATAFTVYVF

SEQ ID NO: 12913 - protein, 11 aa, Artificial Sequence
  Peptide Derived from Human Papillomavirus
ATAFTVYVFCF

SEQ ID NO: 12914 - protein, 8 aa, Artificial Sequence
  Peptide Derived from Human Papillomavirus
AWVLVFVY

SEQ ID NO: 12915 - protein, 9 aa, Artificial Sequence
  Peptide Derived from Human Papillomavirus
AWVLVFVYI

SEQ ID NO: 12916 - protein, 8 aa, Artificial Sequence
  Peptide Derived from Human Papillomavirus
AYAWVLVF

SEQ ID NO: 12917 - protein, 10 aa, Artificial Sequence
  Peptide Derived from Human Papillomavirus
AYAWVLVFVY

SEQ ID NO: 12918 - protein, 11 aa, Artificial Sequence
  Peptide Derived from Human Papillomavirus
AYAWVLVFVYI

SEQ ID NO: 12919 - protein, 8 aa, Artificial Sequence
  Peptide Derived from Human Papillomavirus
CFLLPMLL

SEQ ID NO: 12920 - protein, 9 aa, Artificial Sequence
  Peptide Derived from Human Papillomavirus
CFLLPMLLL

SEQ ID NO: 12921 - protein, 11 aa, Artificial Sequence
  Peptide Derived from Human Papillomavirus
CFLLPMLLLHI

SEQ ID NO: 12922 - protein, 9 aa, Artificial Sequence
  Peptide Derived from Human Papillomavirus
CMCAYAWVL

SEQ ID NO: 12923 - protein, 11 aa, Artificial Sequence
  Peptide Derived from Human Papillomavirus
CMCAYAWVLVF

SEQ ID NO: 12924 - protein, 10 aa, Artificial Sequence
  Peptide Derived from Human Papillomavirus
CMYVCCHVPL

SEQ ID NO: 12925 - protein, 11 aa, Artificial Sequence
  Peptide Derived from Human Papillomavirus
CMYVCCHVPLL

SEQ ID NO: 12926 - protein, 9 aa, Artificial Sequence
  Peptide Derived from Human Papillomavirus
FLFCFCVCM

SEQ ID NO: 12927 - protein, 10 aa, Artificial Sequence
  Peptide Derived from Human Papillomavirus
FLFCFCVCMY

SEQ ID NO: 12928 - protein, 8 aa, Artificial Sequence
  Peptide Derived from Human Papillomavirus
FLLPMLLL

SEQ ID NO: 12929 - protein, 10 aa, Artificial Sequence
  Peptide Derived from Human Papillomavirus
FLLPMLLLHI

SEQ ID NO: 12930 - protein, 8 aa, Artificial Sequence
  Peptide Derived from Human Papillomavirus
FTVYVFCF

SEQ ID NO: 12931 - protein, 9 aa, Artificial Sequence
  Peptide Derived from Human Papillomavirus
FTVYVFCFL

SEQ ID NO: 12932 - protein, 10 aa, Artificial Sequence
  Peptide Derived from Human Papillomavirus
FTVYVFCFLL

SEQ ID NO: 12933 - protein, 8 aa, Artificial Sequence
  Peptide Derived from Human Papillomavirus
HIHAILSL

SEQ ID NO: 12934 - protein, 10 aa, Artificial Sequence
  Peptide Derived from Human Papillomavirus
HVPLLPSVCM

SEQ ID NO: 12935 - protein, 10 aa, Artificial Sequence
  Peptide Derived from Human Papillomavirus
IFLFCFCVCM

SEQ ID NO: 12936 - protein, 11 aa, Artificial Sequence
  Peptide Derived from Human Papillomavirus
IFLFCFCVCMY

SEQ ID NO: 12937 - protein, 8 aa, Artificial Sequence
  Peptide Derived from Human Papillomavirus
ITSPATAF

SEQ ID NO: 12938 - protein, 11 aa, Artificial Sequence
  Peptide Derived from Human Papillomavirus
ITSPATAFTVY

SEQ ID NO: 12939 - protein, 11 aa, Artificial Sequence
  Peptide Derived from Human Papillomavirus
IVVITSPATAF

SEQ ID NO: 12940 - protein, 8 aa, Artificial Sequence
  Peptide Derived from Human Papillomavirus
LFCFCVCM

SEQ ID NO: 12941 - protein, 9 aa, Artificial Sequence
  Peptide Derived from Human Papillomavirus
LFCFCVCMY

SEQ ID NO: 12942 - protein, 11 aa, Artificial Sequence
  Peptide Derived from Human Papillomavirus
LIFLFCFCVCM

SEQ ID NO: 12943 - protein, 8 aa, Artificial Sequence
  Peptide Derived from Human Papillomavirus
LLHIHAIL

SEQ ID NO: 12944 - protein, 10 aa, Artificial Sequence
  Peptide Derived from Human Papillomavirus
LLHIHAILSL

SEQ ID NO: 12945 - protein, 8 aa, Artificial Sequence
  Peptide Derived from Human Papillomavirus
LLLHIHAI

SEQ ID NO: 12946 - protein, 9 aa, Artificial Sequence
  Peptide Derived from Human Papillomavirus
LLLHIHAIL

SEQ ID NO: 12947 - protein, 11 aa, Artificial Sequence
  Peptide Derived from Human Papillomavirus
LLLHIHAILSL

SEQ ID NO: 12948 - protein, 9 aa, Artificial Sequence
  Peptide Derived from Human Papillomavirus
LLPMLLLHI

SEQ ID NO: 12949 - protein, 10 aa, Artificial Sequence
  Peptide Derived from Human Papillomavirus
LLPSVCMCAY

SEQ ID NO: 12950 - protein, 9 aa, Artificial Sequence
  Peptide Derived from Human Papillomavirus
LVFVYIVVI

SEQ ID NO: 12951 - protein, 9 aa, Artificial Sequence
  Peptide Derived from Human Papillomavirus
MLLLHIHAI

SEQ ID NO: 12952 - protein, 10 aa, Artificial Sequence
  Peptide Derived from Human Papillomavirus
MLLLHIHAIL

SEQ ID NO: 12953 - protein, 8 aa, Artificial Sequence
  Peptide Derived from Human Papillomavirus
MLSLIFLF

SEQ ID NO: 12954 - protein, 10 aa, Artificial Sequence
  Peptide Derived from Human Papillomavirus
MLSLIFLFCF

SEQ ID NO: 12955 - protein, 9 aa, Artificial Sequence
  Peptide Derived from Human Papillomavirus
MYVCCHVPL

SEQ ID NO: 12956 - protein, 10 aa, Artificial Sequence
  Peptide Derived from Human Papillomavirus
MYVCCHVPLL

SEQ ID NO: 12957 - protein, 8 aa, Artificial Sequence
  Peptide Derived from Human Papillomavirus
PLLPSVCM

SEQ ID NO: 12958 - protein, 11 aa, Artificial Sequence
  Peptide Derived from Human Papillomavirus
PLLPSVCMCAY

SEQ ID NO: 12959 - protein, 10 aa, Artificial Sequence
  Peptide Derived from Human Papillomavirus
PMLLLHIHAI

SEQ ID NO: 12960 - protein, 11 aa, Artificial Sequence
  Peptide Derived from Human Papillomavirus
PMLLLHIHAIL

SEQ ID NO: 12961 - protein, 8 aa, Artificial Sequence
  Peptide Derived from Human Papillomavirus
SLIFLFCF

SEQ ID NO: 12962 - protein, 9 aa, Artificial Sequence
  Peptide Derived from Human Papillomavirus
SVCMCAYAW

SEQ ID NO: 12963 - protein, 11 aa, Artificial Sequence
  Peptide Derived from Human Papillomavirus
SVCMCAYAWVL

SEQ ID NO: 12964 - protein, 8 aa, Artificial Sequence
  Peptide Derived from Human Papillomavirus
TVYVFCFL

SEQ ID NO: 12965 - protein, 9 aa, Artificial Sequence
  Peptide Derived from Human Papillomavirus
TVYVFCFLL

SEQ ID NO: 12966 - protein, 11 aa, Artificial Sequence
  Peptide Derived from Human Papillomavirus
TVYVFCFLLPM

SEQ ID NO: 12967 - protein, 8 aa, Artificial Sequence
  Peptide Derived from Human Papillomavirus
VFCFLLPM

SEQ ID NO: 12968 - protein, 9 aa, Artificial Sequence
  Peptide Derived from Human Papillomavirus
VFCFLLPML

SEQ ID NO: 12969 - protein, 10 aa, Artificial Sequence
  Peptide Derived from Human Papillomavirus
VFCFLLPMLL

SEQ ID NO: 12970 - protein, 11 aa, Artificial Sequence
  Peptide Derived from Human Papillomavirus
VFCFLLPMLLL

SEQ ID NO: 12971 - protein, 8 aa, Artificial Sequence
  Peptide Derived from Human Papillomavirus
VFVYIVVI

SEQ ID NO: 12972 - protein, 9 aa, Artificial Sequence
  Peptide Derived from Human Papillomavirus
VITSPATAF

SEQ ID NO: 12973 - protein, 10 aa, Artificial Sequence
  Peptide Derived from Human Papillomavirus
VLVFVYIVVI

SEQ ID NO: 12974 - protein, 10 aa, Artificial Sequence
  Peptide Derived from Human Papillomavirus
VVITSPATAF

SEQ ID NO: 12975 - protein, 8 aa, Artificial Sequence
  Peptide Derived from Human Papillomavirus
VYVFCFLL

SEQ ID NO: 12976 - protein, 10 aa, Artificial Sequence
  Peptide Derived from Human Papillomavirus
VYVFCFLLPM

SEQ ID NO: 12977 - protein, 11 aa, Artificial Sequence
  Peptide Derived from Human Papillomavirus
VYVFCFLLPML

SEQ ID NO: 12978 - protein, 8 aa, Artificial Sequence
  Peptide Derived from Human Papillomavirus
WVLVFVYI

SEQ ID NO: 12979 - protein, 11 aa, Artificial Sequence
  Peptide Derived from Human Papillomavirus
WVLVFVYIVVI

SEQ ID NO: 12980 - protein, 8 aa, Artificial Sequence
  Peptide Derived from Human Papillomavirus
YVCCHVPL

SEQ ID NO: 12981 - protein, 9 aa, Artificial Sequence
  Peptide Derived from Human Papillomavirus
YVCCHVPLL

SEQ ID NO: 12982 - protein, 9 aa, Artificial Sequence
  Peptide Derived from Human Papillomavirus
YVFCFLLPM

SEQ ID NO: 12983 - protein, 10 aa, Artificial Sequence
  Peptide Derived from Human Papillomavirus
YVFCFLLPML

SEQ ID NO: 12984 - protein, 11 aa, Artificial Sequence
  Peptide Derived from Human Papillomavirus
YVFCFLLPMLL

SEQ ID NO: 12985 - protein, 9 aa, Artificial Sequence
  Peptide Derived from Human Papillomavirus
AFKDLFVVY

SEQ ID NO: 12986 - protein, 8 aa, Artificial Sequence
  Peptide Derived from Human Papillomavirus
CIDFYSRI

SEQ ID NO: 12987 - protein, 11 aa, Artificial Sequence
  Peptide Derived from Human Papillomavirus
CIDFYSRIREL

SEQ ID NO: 12988 - protein, 8 aa, Artificial Sequence
  Peptide Derived from Human Papillomavirus
CLRCQKPL

SEQ ID NO: 12989 - protein, 8 aa, Artificial Sequence
  Peptide Derived from Human Papillomavirus
CTELNTSL

SEQ ID NO: 12990 - protein, 11 aa, Artificial Sequence
  Peptide Derived from Human Papillomavirus
CTELNTSLQDI

SEQ ID NO: 12991 - protein, 8 aa, Artificial Sequence
  Peptide Derived from Human Papillomavirus
CVYCKTVL

SEQ ID NO: 12992 - protein, 10 aa, Artificial Sequence
  Peptide Derived from Human Papillomavirus
CVYCKTVLEL

SEQ ID NO: 12993 - protein, 9 aa, Artificial Sequence
  Peptide Derived from Human Papillomavirus
DFYSRIREL

SEQ ID NO: 12994 - protein, 8 aa, Artificial Sequence
  Peptide Derived from Human Papillomavirus
DIEITCVY

SEQ ID NO: 12995 - protein, 10 aa, Artificial Sequence
  Peptide Derived from Human Papillomavirus
DLCTELNTSL

SEQ ID NO: 12996 - protein, 10 aa, Artificial Sequence
  Peptide Derived from Human Papillomavirus
DLFVVYRDSI

SEQ ID NO: 12997 - protein, 11 aa, Artificial Sequence
  Peptide Derived from Human Papillomavirus
DTLEKLTNTGL

SEQ ID NO: 12998 - protein, 8 aa, Artificial Sequence
  Peptide Derived from Human Papillomavirus
EFAFKDLF

SEQ ID NO: 12999 - protein, 11 aa, Artificial Sequence
  Peptide Derived from Human Papillomavirus
EFAFKDLFVVY

SEQ ID NO: 13000 - protein, 11 aa, Artificial Sequence
  Peptide Derived from Human Papillomavirus
EITCVYCKTVL

SEQ ID NO: 13001 - protein, 9 aa, Artificial Sequence
  Peptide Derived from Human Papillomavirus
ELNTSLQDI

SEQ ID NO: 13002 - protein, 11 aa, Artificial Sequence
  Peptide Derived from Human Papillomavirus
ELNTSLQDIEI

SEQ ID NO: 13003 - protein, 10 aa, Artificial Sequence
  Peptide Derived from Human Papillomavirus
ELRHYSDSVY

SEQ ID NO: 13004 - protein, 8 aa, Artificial Sequence
  Peptide Derived from Human Papillomavirus
ELTEVFEF

SEQ ID NO: 13005 - protein, 10 aa, Artificial Sequence
  Peptide Derived from Human Papillomavirus
ELTEVFEFAF

SEQ ID NO: 13006 - protein, 10 aa, Artificial Sequence
  Peptide Derived from Human Papillomavirus
EVFEFAFKDL

SEQ ID NO: 13007 - protein, 11 aa, Artificial Sequence
  Peptide Derived from Human Papillomavirus
EVFEFAFKDLF

SEQ ID NO: 13008 - protein, 8 aa, Artificial Sequence
  Peptide Derived from Human Papillomavirus
FVVYRDSI

SEQ ID NO: 13009 - protein, 8 aa, Artificial Sequence
  Peptide Derived from Human Papillomavirus
FYSRIREL

SEQ ID NO: 13010 - protein, 11 aa, Artificial Sequence
  Peptide Derived from Human Papillomavirus
FYSRIRELRHY

SEQ ID NO: 13011 - protein, 10 aa, Artificial Sequence
  Peptide Derived from Human Papillomavirus
GLYNLLIRCL

SEQ ID NO: 13012 - protein, 8 aa, Artificial Sequence
  Peptide Derived from Human Papillomavirus
HLNEKRRF

SEQ ID NO: 13013 - protein, 11 aa, Artificial Sequence
  Peptide Derived from Human Papillomavirus
HLNEKRRFHNI

SEQ ID NO: 13014 - protein, 11 aa, Artificial Sequence
  Peptide Derived from Human Papillomavirus
HYSDSVYGDTL

SEQ ID NO: 13015 - protein, 10 aa, Artificial Sequence
  Peptide Derived from Human Papillomavirus
ITCVYCKTVL

SEQ ID NO: 13016 - protein, 9 aa, Artificial Sequence
  Peptide Derived from Human Papillomavirus
KLPDLCTEL

SEQ ID NO: 13017 - protein, 11 aa, Artificial Sequence
  Peptide Derived from Human Papillomavirus
KLRHLNEKRRF

SEQ ID NO: 13018 - protein, 8 aa, Artificial Sequence
  Peptide Derived from Human Papillomavirus
KLTNTGLY

SEQ ID NO: 13019 - protein, 10 aa, Artificial Sequence
  Peptide Derived from Human Papillomavirus
KLTNTGLYNL

SEQ ID NO: 13020 - protein, 11 aa, Artificial Sequence
  Peptide Derived from Human Papillomavirus
KLTNTGLYNLL

SEQ ID NO: 13021 - protein, 10 aa, Artificial Sequence
  Peptide Derived from Human Papillomavirus
KTVLELTEVF

SEQ ID NO: 13022 - protein, 9 aa, Artificial Sequence
  Peptide Derived from Human Papillomavirus
LFVVYRDSI

SEQ ID NO: 13023 - protein, 11 aa, Artificial Sequence
  Peptide Derived from Human Papillomavirus
LIRCLRCQKPL

SEQ ID NO: 13024 - protein, 9 aa, Artificial Sequence
  Peptide Derived from Human Papillomavirus
LTEVFEFAF

SEQ ID NO: 13025 - protein, 9 aa, Artificial Sequence
  Peptide Derived from Human Papillomavirus
LTNTGLYNL

SEQ ID NO: 13026 - protein, 10 aa, Artificial Sequence
  Peptide Derived from Human Papillomavirus
LTNTGLYNLL

SEQ ID NO: 13027 - protein, 11 aa, Artificial Sequence
  Peptide Derived from Human Papillomavirus
LTNTGLYNLLI

SEQ ID NO: 13028 - protein, 9 aa, Artificial Sequence
  Peptide Derived from Human Papillomavirus
LYNLLIRCL

SEQ ID NO: 13029 - protein, 8 aa, Artificial Sequence
  Peptide Derived from Human Papillomavirus
NTGLYNLL

SEQ ID NO: 13030 - protein, 9 aa, Artificial Sequence
  Peptide Derived from Human Papillomavirus
NTGLYNLLI

SEQ ID NO: 13031 - protein, 9 aa, Artificial Sequence
  Peptide Derived from Human Papillomavirus
NTSLQDIEI

SEQ ID NO: 13032 - protein, 8 aa, Artificial Sequence
  Peptide Derived from Human Papillomavirus
PLNPAEKL

SEQ ID NO: 13033 - protein, 11 aa, Artificial Sequence
  Peptide Derived from Human Papillomavirus
PLNPAEKLRHL

SEQ ID NO: 13034 - protein, 8 aa, Artificial Sequence
  Peptide Derived from Human Papillomavirus
PTRRPYKL

SEQ ID NO: 13035 - protein, 11 aa, Artificial Sequence
  Peptide Derived from Human Papillomavirus
PTRRPYKLPDL

SEQ ID NO: 13036 - protein, 11 aa, Artificial Sequence
  Peptide Derived from Human Papillomavirus
PYKLPDLCTEL

SEQ ID NO: 13037 - protein, 10 aa, Artificial Sequence
  Peptide Derived from Human Papillomavirus
RFEDPTRRPY

SEQ ID NO: 13038 - protein, 9 aa, Artificial Sequence
  Peptide Derived from Human Papillomavirus
RFHNIAGHY

SEQ ID NO: 13039 - protein, 8 aa, Artificial Sequence
  Peptide Derived from Human Papillomavirus
RIRELRHY

SEQ ID NO: 13040 - protein, 11 aa, Artificial Sequence
  Peptide Derived from Human Papillomavirus
SIPHAACHKCI

SEQ ID NO: 13041 - protein, 11 aa, Artificial Sequence
  Peptide Derived from Human Papillomavirus
SLQDIEITCVY

SEQ ID NO: 13042 - protein, 10 aa, Artificial Sequence
  Peptide Derived from Human Papillomavirus
SVYGDTLEKL

SEQ ID NO: 13043 - protein, 10 aa, Artificial Sequence
  Peptide Derived from Human Papillomavirus
TLEKLTNTGL

SEQ ID NO: 13044 - protein, 11 aa, Artificial Sequence
  Peptide Derived from Human Papillomavirus
TLEKLTNTGLY

SEQ ID NO: 13045 - protein, 9 aa, Artificial Sequence
  Peptide Derived from Human Papillomavirus
TVLELTEVF

SEQ ID NO: 13046 - protein, 11 aa, Artificial Sequence
  Peptide Derived from Human Papillomavirus
TVLELTEVFEF

SEQ ID NO: 13047 - protein, 9 aa, Artificial Sequence
  Peptide Derived from Human Papillomavirus
VFEFAFKDL

SEQ ID NO: 13048 - protein, 10 aa, Artificial Sequence
  Peptide Derived from Human Papillomavirus
VFEFAFKDLF

SEQ ID NO: 13049 - protein, 8 aa, Artificial Sequence
  Peptide Derived from Human Papillomavirus
VLELTEVF

SEQ ID NO: 13050 - protein, 10 aa, Artificial Sequence
  Peptide Derived from Human Papillomavirus
VLELTEVFEF

SEQ ID NO: 13051 - protein, 9 aa, Artificial Sequence
  Peptide Derived from Human Papillomavirus
VYCKTVLEL

SEQ ID NO: 13052 - protein, 9 aa, Artificial Sequence
  Peptide Derived from Human Papillomavirus
VYGDTLEKL

SEQ ID NO: 13053 - protein, 10 aa, Artificial Sequence
  Peptide Derived from Human Papillomavirus
AFQQLFLNTL

SEQ ID NO: 13054 - protein, 8 aa, Artificial Sequence
  Peptide Derived from Human Papillomavirus
ATLQDIVL

SEQ ID NO: 13055 - protein, 10 aa, Artificial Sequence
  Peptide Derived from Human Papillomavirus
ATLQDIVLHL

SEQ ID NO: 13056 - protein, 10 aa, Artificial Sequence
  Peptide Derived from Human Papillomavirus
CMCCKCEARI

SEQ ID NO: 13057 - protein, 8 aa, Artificial Sequence
  Peptide Derived from Human Papillomavirus
DLLCHEQL

SEQ ID NO: 13058 - protein, 8 aa, Artificial Sequence
  Peptide Derived from Human Papillomavirus
DLRAFQQL

SEQ ID NO: 13059 - protein, 9 aa, Artificial Sequence
  Peptide Derived from Human Papillomavirus
DLRAFQQLF

SEQ ID NO: 13060 - protein, 10 aa, Artificial Sequence
  Peptide Derived from Human Papillomavirus
DLRAFQQLFL

SEQ ID NO: 13061 - protein, 10 aa, Artificial Sequence
  Peptide Derived from Human Papillomavirus
EIDGVNHQHL

SEQ ID NO: 13062 - protein, 11 aa, Artificial Sequence
  Peptide Derived from Human Papillomavirus
FLNTLSFVCPW

SEQ ID NO: 13063 - protein, 8 aa, Artificial Sequence
  Peptide Derived from Human Papillomavirus
HLEPQNEI

SEQ ID NO: 13064 - protein, 11 aa, Artificial Sequence
  Peptide Derived from Human Papillomavirus
IVLHLEPQNEI

SEQ ID NO: 13065 - protein, 11 aa, Artificial Sequence
  Peptide Derived from Human Papillomavirus
KLVVESSADDL

SEQ ID NO: 13066 - protein, 8 aa, Artificial Sequence
  Peptide Derived from Human Papillomavirus
LFLNTLSF

SEQ ID NO: 13067 - protein, 10 aa, Artificial Sequence
  Peptide Derived from Human Papillomavirus
LVVESSADDL

SEQ ID NO: 13068 - protein, 9 aa, Artificial Sequence
  Peptide Derived from Human Papillomavirus
NTLSFVCPW

SEQ ID NO: 13069 - protein, 10 aa, Artificial Sequence
  Peptide Derived from Human Papillomavirus
PVDLLCHEQL

SEQ ID NO: 13070 - protein, 9 aa, Artificial Sequence
  Peptide Derived from Human Papillomavirus
QLFLNTLSF

SEQ ID NO: 13071 - protein, 9 aa, Artificial Sequence
  Peptide Derived from Human Papillomavirus
TLQDIVLHL

SEQ ID NO: 13072 - protein, 8 aa, Artificial Sequence
  Peptide Derived from Human Papillomavirus
TLSFVCPW

SEQ ID NO: 13073 - protein, 10 aa, Artificial Sequence
  Peptide Derived from Human Papillomavirus
VLHLEPQNEI

SEQ ID NO: 13074 - protein, 9 aa, Artificial Sequence
  Peptide Derived from Human Papillomavirus
VVESSADDL

SEQ ID NO: 13075 - protein, 11 aa, Artificial Sequence
  Peptide Derived from Human Papillomavirus
ALWRPSDNTVY

SEQ ID NO: 13076 - protein, 11 aa, Artificial Sequence
  Peptide Derived from Human Papillomavirus
AYQYRVFRVQL

SEQ ID NO: 13077 - protein, 9 aa, Artificial Sequence
  Peptide Derived from Human Papillomavirus
CILGCAPAI

SEQ ID NO: 13078 - protein, 8 aa, Artificial Sequence
  Peptide Derived from Human Papillomavirus
CLRREQLF

SEQ ID NO: 13079 - protein, 8 aa, Artificial Sequence
  Peptide Derived from Human Papillomavirus
CLYTRVLI

SEQ ID NO: 13080 - protein, 9 aa, Artificial Sequence
  Peptide Derived from Human Papillomavirus
CLYTRVLIL

SEQ ID NO: 13081 - protein, 11 aa, Artificial Sequence
  Peptide Derived from Human Papillomavirus
CLYTRVLILHY

SEQ ID NO: 13082 - protein, 10 aa, Artificial Sequence
  Peptide Derived from Human Papillomavirus
CTITLTADVM

SEQ ID NO: 13083 - protein, 11 aa, Artificial Sequence
  Peptide Derived from Human Papillomavirus
CVYSPSPSGSI

SEQ ID NO: 13084 - protein, 9 aa, Artificial Sequence
  Peptide Derived from Human Papillomavirus
DICQSICKY

SEQ ID NO: 13085 - protein, 8 aa, Artificial Sequence
  Peptide Derived from Human Papillomavirus
DIPKVSAY

SEQ ID NO: 13086 - protein, 10 aa, Artificial Sequence
  Peptide Derived from Human Papillomavirus
DIPKVSAYQY

SEQ ID NO: 13087 - protein, 11 aa, Artificial Sequence
  Peptide Derived from Human Papillomavirus
DLDQYPLGRKF

SEQ ID NO: 13088 - protein, 8 aa, Artificial Sequence
  Peptide Derived from Human Papillomavirus
DLKEKFSL

SEQ ID NO: 13089 - protein, 10 aa, Artificial Sequence
  Peptide Derived from Human Papillomavirus
DLKEKFSLDL

SEQ ID NO: 13090 - protein, 8 aa, Artificial Sequence
  Peptide Derived from Human Papillomavirus
DLQFIFQL

SEQ ID NO: 13091 - protein, 11 aa, Artificial Sequence
  Peptide Derived from Human Papillomavirus
DLQFIFQLCTI

SEQ ID NO: 13092 - protein, 10 aa, Artificial Sequence
  Peptide Derived from Human Papillomavirus
DMVDTGYGAM

SEQ ID NO: 13093 - protein, 9 aa, Artificial Sequence
  Peptide Derived from Human Papillomavirus
DTGYGAMDF

SEQ ID NO: 13094 - protein, 8 aa, Artificial Sequence
  Peptide Derived from Human Papillomavirus
DTKCEVPL

SEQ ID NO: 13095 - protein, 10 aa, Artificial Sequence
  Peptide Derived from Human Papillomavirus
DTKCEVPLDI

SEQ ID NO: 13096 - protein, 8 aa, Artificial Sequence
  Peptide Derived from Human Papillomavirus
DTTPSTNL

SEQ ID NO: 13097 - protein, 10 aa, Artificial Sequence
  Peptide Derived from Human Papillomavirus
DTTPSTNLTI

SEQ ID NO: 13098 - protein, 8 aa, Artificial Sequence
  Peptide Derived from Human Papillomavirus
DTVPQSLY

SEQ ID NO: 13099 - protein, 9 aa, Artificial Sequence
  Peptide Derived from Human Papillomavirus
DTVPQSLYI

SEQ ID NO: 13100 - protein, 11 aa, Artificial Sequence
  Peptide Derived from Human Papillomavirus
DTYRFVQSVAI

SEQ ID NO: 13101 - protein, 9 aa, Artificial Sequence
  Peptide Derived from Human Papillomavirus
DVMSYIHSM

SEQ ID NO: 13102 - protein, 10 aa, Artificial Sequence
  Peptide Derived from Human Papillomavirus
DVRDNVSVDY

SEQ ID NO: 13103 - protein, 9 aa, Artificial Sequence
  Peptide Derived from Human Papillomavirus
DYKQTQLCI

SEQ ID NO: 13104 - protein, 10 aa, Artificial Sequence
  Peptide Derived from Human Papillomavirus
DYKQTQLCIL

SEQ ID NO: 13105 - protein, 10 aa, Artificial Sequence
  Peptide Derived from Human Papillomavirus
DYLQMSADPY

SEQ ID NO: 13106 - protein, 8 aa, Artificial Sequence
  Peptide Derived from Human Papillomavirus
DYVTPTSI

SEQ ID NO: 13107 - protein, 9 aa, Artificial Sequence
  Peptide Derived from Human Papillomavirus
DYVTPTSIF

SEQ ID NO: 13108 - protein, 10 aa, Artificial Sequence
  Peptide Derived from Human Papillomavirus
DYVTPTSIFY

SEQ ID NO: 13109 - protein, 8 aa, Artificial Sequence
  Peptide Derived from Human Papillomavirus
EIGRGQPL

SEQ ID NO: 13110 - protein, 10 aa, Artificial Sequence
  Peptide Derived from Human Papillomavirus
EVPLDICQSI

SEQ ID NO: 13111 - protein, 8 aa, Artificial Sequence
  Peptide Derived from Human Papillomavirus
EYDLQFIF

SEQ ID NO: 13112 - protein, 10 aa, Artificial Sequence
  Peptide Derived from Human Papillomavirus
EYDLQFIFQL

SEQ ID NO: 13113 - protein, 9 aa, Artificial Sequence
  Peptide Derived from Human Papillomavirus
FFCLRREQL

SEQ ID NO: 13114 - protein, 10 aa, Artificial Sequence
  Peptide Derived from Human Papillomavirus
FFCLRREQLF

SEQ ID NO: 13115 - protein, 8 aa, Artificial Sequence
  Peptide Derived from Human Papillomavirus
FIFQLCTI

SEQ ID NO: 13116 - protein, 10 aa, Artificial Sequence
  Peptide Derived from Human Papillomavirus
FIFQLCTITL

SEQ ID NO: 13117 - protein, 8 aa, Artificial Sequence
  Peptide Derived from Human Papillomavirus
FLRNVNVF

SEQ ID NO: 13118 - protein, 10 aa, Artificial Sequence
  Peptide Derived from Human Papillomavirus
FLRNVNVFPI

SEQ ID NO: 13119 - protein, 11 aa, Artificial Sequence
  Peptide Derived from Human Papillomavirus
FLRNVNVFPIF

SEQ ID NO: 13120 - protein, 8 aa, Artificial Sequence
  Peptide Derived from Human Papillomavirus
FWNRAGTM

SEQ ID NO: 13121 - protein, 10 aa, Artificial Sequence
  Peptide Derived from Human Papillomavirus
FWNVDLKEKF

SEQ ID NO: 13122 - protein, 9 aa, Artificial Sequence
  Peptide Derived from Human Papillomavirus
FYHAGSSRL

SEQ ID NO: 13123 - protein, 10 aa, Artificial Sequence
  Peptide Derived from Human Papillomavirus
FYHAGSSRLL

SEQ ID NO: 13124 - protein, 8 aa, Artificial Sequence
  Peptide Derived from Human Papillomavirus
GLPDTSIY

SEQ ID NO: 13125 - protein, 8 aa, Artificial Sequence
  Peptide Derived from Human Papillomavirus
GLRRKPTI

SEQ ID NO: 13126 - protein, 8 aa, Artificial Sequence
  Peptide Derived from Human Papillomavirus
GLSGHPFY

SEQ ID NO: 13127 - protein, 11 aa, Artificial Sequence
  Peptide Derived from Human Papillomavirus
GLSGHPFYNKL

SEQ ID NO: 13128 - protein, 11 aa, Artificial Sequence
  Peptide Derived from Human Papillomavirus
GMPASPGSCVY

SEQ ID NO: 13129 - protein, 9 aa, Artificial Sequence
  Peptide Derived from Human Papillomavirus
GTACKSRPL

SEQ ID NO: 13130 - protein, 11 aa, Artificial Sequence
  Peptide Derived from Human Papillomavirus
GTMGDTVPQSL

SEQ ID NO: 13131 - protein, 8 aa, Artificial Sequence
  Peptide Derived from Human Papillomavirus
GVCWHNQL

SEQ ID NO: 13132 - protein, 9 aa, Artificial Sequence
  Peptide Derived from Human Papillomavirus
GVCWHNQLF

SEQ ID NO: 13133 - protein, 10 aa, Artificial Sequence
  Peptide Derived from Human Papillomavirus
GVEIGRGQPL

SEQ ID NO: 13134 - protein, 9 aa, Artificial Sequence
  Peptide Derived from Human Papillomavirus
GVGLSGHPF

SEQ ID NO: 13135 - protein, 10 aa, Artificial Sequence
  Peptide Derived from Human Papillomavirus
GVGLSGHPFY

SEQ ID NO: 13136 - protein, 10 aa, Artificial Sequence
  Peptide Derived from Human Papillomavirus
GVPPPPTTSL

SEQ ID NO: 13137 - protein, 10 aa, Artificial Sequence
  Peptide Derived from Human Papillomavirus
GYGAMDFSTL

SEQ ID NO: 13138 - protein, 9 aa, Artificial Sequence
  Peptide Derived from Human Papillomavirus
HFWNRAGTM

SEQ ID NO: 13139 - protein, 8 aa, Artificial Sequence
  Peptide Derived from Human Papillomavirus
HIIICGHY

SEQ ID NO: 13140 - protein, 9 aa, Artificial Sequence
  Peptide Derived from Human Papillomavirus
HIIICGHYI

SEQ ID NO: 13141 - protein, 10 aa, Artificial Sequence
  Peptide Derived from Human Papillomavirus
HIIICGHYII

SEQ ID NO: 13142 - protein, 11 aa, Artificial Sequence
  Peptide Derived from Human Papillomavirus
HIIICGHYIIL

SEQ ID NO: 13143 - protein, 9 aa, Artificial Sequence
  Peptide Derived from Human Papillomavirus
HLLPLYGPL

SEQ ID NO: 13144 - protein, 10 aa, Artificial Sequence
  Peptide Derived from Human Papillomavirus
HLLPLYGPLY

SEQ ID NO: 13145 - protein, 9 aa, Artificial Sequence
  Peptide Derived from Human Papillomavirus
HVEEYDLQF

SEQ ID NO: 13146 - protein, 10 aa, Artificial Sequence
  Peptide Derived from Human Papillomavirus
HVEEYDLQFI

SEQ ID NO: 13147 - protein, 11 aa, Artificial Sequence
  Peptide Derived from Human Papillomavirus
HVEEYDLQFIF

SEQ ID NO: 13148 - protein, 8 aa, Artificial Sequence
  Peptide Derived from Human Papillomavirus
HYHLLPLY

SEQ ID NO: 13149 - protein, 11 aa, Artificial Sequence
  Peptide Derived from Human Papillomavirus
HYHLLPLYGPL

SEQ ID NO: 13150 - protein, 8 aa, Artificial Sequence
  Peptide Derived from Human Papillomavirus
IFLQMALW

SEQ ID NO: 13151 - protein, 9 aa, Artificial Sequence
  Peptide Derived from Human Papillomavirus
IFQLCTITL

SEQ ID NO: 13152 - protein, 10 aa, Artificial Sequence
  Peptide Derived from Human Papillomavirus
IFYHAGSSRL

SEQ ID NO: 13153 - protein, 11 aa, Artificial Sequence
  Peptide Derived from Human Papillomavirus
IFYHAGSSRLL

SEQ ID NO: 13154 - protein, 8 aa, Artificial Sequence
  Peptide Derived from Human Papillomavirus
IICGHYII

SEQ ID NO: 13155 - protein, 9 aa, Artificial Sequence
  Peptide Derived from Human Papillomavirus
IICGHYIIL

SEQ ID NO: 13156 - protein, 10 aa, Artificial Sequence
  Peptide Derived from Human Papillomavirus
IICGHYIILF

SEQ ID NO: 13157 - protein, 11 aa, Artificial Sequence
  Peptide Derived from Human Papillomavirus
IICGHYIILFL

SEQ ID NO: 13158 - protein, 8 aa, Artificial Sequence
  Peptide Derived from Human Papillomavirus
IIICGHYI

SEQ ID NO: 13159 - protein, 9 aa, Artificial Sequence
  Peptide Derived from Human Papillomavirus
IIICGHYII

SEQ ID NO: 13160 - protein, 10 aa, Artificial Sequence
  Peptide Derived from Human Papillomavirus
IIICGHYIIL

SEQ ID NO: 13161 - protein, 11 aa, Artificial Sequence
  Peptide Derived from Human Papillomavirus
IIICGHYIILF

SEQ ID NO: 13162 - protein, 11 aa, Artificial Sequence
  Peptide Derived from Human Papillomavirus
IILFLRNVNVF

SEQ ID NO: 13163 - protein, 10 aa, Artificial Sequence
  Peptide Derived from Human Papillomavirus
ILFLRNVNVF

SEQ ID NO: 13164 - protein, 8 aa, Artificial Sequence
  Peptide Derived from Human Papillomavirus
ILGCAPAI

SEQ ID NO: 13165 - protein, 9 aa, Artificial Sequence
  Peptide Derived from Human Papillomavirus
ILHYHLLPL

SEQ ID NO: 13166 - protein, 10 aa, Artificial Sequence
  Peptide Derived from Human Papillomavirus
ILHYHLLPLY

SEQ ID NO: 13167 - protein, 8 aa, Artificial Sequence
  Peptide Derived from Human Papillomavirus
ILVYMVHI

SEQ ID NO: 13168 - protein, 9 aa, Artificial Sequence
  Peptide Derived from Human Papillomavirus
ILVYMVHII

SEQ ID NO: 13169 - protein, 10 aa, Artificial Sequence
  Peptide Derived from Human Papillomavirus
ILVYMVHIII

SEQ ID NO: 13170 - protein, 8 aa, Artificial Sequence
  Peptide Derived from Human Papillomavirus
ITLTADVM

SEQ ID NO: 13171 - protein, 10 aa, Artificial Sequence
  Peptide Derived from Human Papillomavirus
ITLTADVMSY

SEQ ID NO: 13172 - protein, 11 aa, Artificial Sequence
  Peptide Derived from Human Papillomavirus
ITLTADVMSYI

SEQ ID NO: 13173 - protein, 8 aa, Artificial Sequence
  Peptide Derived from Human Papillomavirus
IVTSDSQL

SEQ ID NO: 13174 - protein, 9 aa, Artificial Sequence
  Peptide Derived from Human Papillomavirus
IVTSDSQLF

SEQ ID NO: 13175 - protein, 9 aa, Artificial Sequence
  Peptide Derived from Human Papillomavirus
IYNPETQRL

SEQ ID NO: 13176 - protein, 11 aa, Artificial Sequence
  Peptide Derived from Human Papillomavirus
IYNPETQRLVW

SEQ ID NO: 13177 - protein, 9 aa, Artificial Sequence
  Peptide Derived from Human Papillomavirus
KFGLPDTSI

SEQ ID NO: 13178 - protein, 10 aa, Artificial Sequence
  Peptide Derived from Human Papillomavirus
KFGLPDTSIY

SEQ ID NO: 13179 - protein, 8 aa, Artificial Sequence
  Peptide Derived from Human Papillomavirus
KFLVQAGL

SEQ ID NO: 13180 - protein, 9 aa, Artificial Sequence
  Peptide Derived from Human Papillomavirus
KFSLDLDQY

SEQ ID NO: 13181 - protein, 11 aa, Artificial Sequence
  Peptide Derived from Human Papillomavirus
KFSLDLDQYPL

SEQ ID NO: 13182 - protein, 11 aa, Artificial Sequence
  Peptide Derived from Human Papillomavirus
KFWNVDLKEKF

SEQ ID NO: 13183 - protein, 9 aa, Artificial Sequence
  Peptide Derived from Human Papillomavirus
KLKFWNVDL

SEQ ID NO: 13184 - protein, 10 aa, Artificial Sequence
  Peptide Derived from Human Papillomavirus
KVSAYQYRVF

SEQ ID NO: 13185 - protein, 8 aa, Artificial Sequence
  Peptide Derived from Human Papillomavirus
KYPDYLQM

SEQ ID NO: 13186 - protein, 9 aa, Artificial Sequence
  Peptide Derived from Human Papillomavirus
LFLRNVNVF

SEQ ID NO: 13187 - protein, 11 aa, Artificial Sequence
  Peptide Derived from Human Papillomavirus
LFLRNVNVFPI

SEQ ID NO: 13188 - protein, 8 aa, Artificial Sequence
  Peptide Derived from Human Papillomavirus
LFNKPYWL

SEQ ID NO: 13189 - protein, 8 aa, Artificial Sequence
  Peptide Derived from Human Papillomavirus
LILHYHLL

SEQ ID NO: 13190 - protein, 10 aa, Artificial Sequence
  Peptide Derived from Human Papillomavirus
LILHYHLLPL

SEQ ID NO: 13191 - protein, 11 aa, Artificial Sequence
  Peptide Derived from Human Papillomavirus
LILHYHLLPLY

SEQ ID NO: 13192 - protein, 8 aa, Artificial Sequence
  Peptide Derived from Human Papillomavirus
LLPLYGPL

SEQ ID NO: 13193 - protein, 9 aa, Artificial Sequence
  Peptide Derived from Human Papillomavirus
LLPLYGPLY

SEQ ID NO: 13194 - protein, 8 aa, Artificial Sequence
  Peptide Derived from Human Papillomavirus
LLTVGNPY

SEQ ID NO: 13195 - protein, 9 aa, Artificial Sequence
  Peptide Derived from Human Papillomavirus
LLTVGNPYF

SEQ ID NO: 13196 - protein, 8 aa, Artificial Sequence
  Peptide Derived from Human Papillomavirus
LTADVMSY

SEQ ID NO: 13197 - protein, 9 aa, Artificial Sequence
  Peptide Derived from Human Papillomavirus
LTADVMSYI

SEQ ID NO: 13198 - protein, 8 aa, Artificial Sequence
  Peptide Derived from Human Papillomavirus
LTVGNPYF

SEQ ID NO: 13199 - protein, 10 aa, Artificial Sequence
  Peptide Derived from Human Papillomavirus
LVWACAGVEI

SEQ ID NO: 13200 - protein, 8 aa, Artificial Sequence
  Peptide Derived from Human Papillomavirus
LVYMVHII

SEQ ID NO: 13201 - protein, 9 aa, Artificial Sequence
  Peptide Derived from Human Papillomavirus
LVYMVHIII

SEQ ID NO: 13202 - protein, 10 aa, Artificial Sequence
  Peptide Derived from Human Papillomavirus
LWRPSDNTVY

SEQ ID NO: 13203 - protein, 11 aa, Artificial Sequence
  Peptide Derived from Human Papillomavirus
LWRPSDNTVYL

SEQ ID NO: 13204 - protein, 11 aa, Artificial Sequence
  Peptide Derived from Human Papillomavirus
LYGPLYHPRPL

SEQ ID NO: 13205 - protein, 9 aa, Artificial Sequence
  Peptide Derived from Human Papillomavirus
LYHPRPLPL

SEQ ID NO: 13206 - protein, 8 aa, Artificial Sequence
  Peptide Derived from Human Papillomavirus
LYIKGTGM

SEQ ID NO: 13207 - protein, 8 aa, Artificial Sequence
  Peptide Derived from Human Papillomavirus
LYTRVLIL

SEQ ID NO: 13208 - protein, 10 aa, Artificial Sequence
  Peptide Derived from Human Papillomavirus
LYTRVLILHY

SEQ ID NO: 13209 - protein, 10 aa, Artificial Sequence
  Peptide Derived from Human Papillomavirus
MFFCLRREQL

SEQ ID NO: 13210 - protein, 11 aa, Artificial Sequence
  Peptide Derived from Human Papillomavirus
MFFCLRREQLF

SEQ ID NO: 13211 - protein, 9 aa, Artificial Sequence
  Peptide Derived from Human Papillomavirus
MVDTGYGAM

SEQ ID NO: 13212 - protein, 11 aa, Artificial Sequence
  Peptide Derived from Human Papillomavirus
MVDTGYGAMDF

SEQ ID NO: 13213 - protein, 10 aa, Artificial Sequence
  Peptide Derived from Human Papillomavirus
MVHIIICGHY

SEQ ID NO: 13214 - protein, 11 aa, Artificial Sequence
  Peptide Derived from Human Papillomavirus
MVHIIICGHYI

SEQ ID NO: 13215 - protein, 11 aa, Artificial Sequence
  Peptide Derived from Human Papillomavirus
NTDDYVTPTSI

SEQ ID NO: 13216 - protein, 9 aa, Artificial Sequence
  Peptide Derived from Human Papillomavirus
NTVLEDGDM

SEQ ID NO: 13217 - protein, 8 aa, Artificial Sequence
  Peptide Derived from Human Papillomavirus
NVDLKEKF

SEQ ID NO: 13218 - protein, 10 aa, Artificial Sequence
  Peptide Derived from Human Papillomavirus
NVDLKEKFSL

SEQ ID NO: 13219 - protein, 9 aa, Artificial Sequence
  Peptide Derived from Human Papillomavirus
NVFPIFLQM

SEQ ID NO: 13220 - protein, 11 aa, Artificial Sequence
  Peptide Derived from Human Papillomavirus
NVFPIFLQMAL

SEQ ID NO: 13221 - protein, 8 aa, Artificial Sequence
  Peptide Derived from Human Papillomavirus
NVNVFPIF

SEQ ID NO: 13222 - protein, 9 aa, Artificial Sequence
  Peptide Derived from Human Papillomavirus
NVNVFPIFL

SEQ ID NO: 13223 - protein, 11 aa, Artificial Sequence
  Peptide Derived from Human Papillomavirus
NVNVFPIFLQM

SEQ ID NO: 13224 - protein, 11 aa, Artificial Sequence
  Peptide Derived from Human Papillomavirus
NVSVDYKQTQL

SEQ ID NO: 13225 - protein, 8 aa, Artificial Sequence
  Peptide Derived from Human Papillomavirus
PIFLQMAL

SEQ ID NO: 13226 - protein, 9 aa, Artificial Sequence
  Peptide Derived from Human Papillomavirus
PIFLQMALW

SEQ ID NO: 13227 - protein, 8 aa, Artificial Sequence
  Peptide Derived from Human Papillomavirus
PLDICQSI

SEQ ID NO: 13228 - protein, 11 aa, Artificial Sequence
  Peptide Derived from Human Papillomavirus
PLDICQSICKY

SEQ ID NO: 13229 - protein, 9 aa, Artificial Sequence
  Peptide Derived from Human Papillomavirus
PLELKNTVL

SEQ ID NO: 13230 - protein, 11 aa, Artificial Sequence
  Peptide Derived from Human Papillomavirus
PLGVGLSGHPF

SEQ ID NO: 13231 - protein, 8 aa, Artificial Sequence
  Peptide Derived from Human Papillomavirus
PLHSILVY

SEQ ID NO: 13232 - protein, 9 aa, Artificial Sequence
  Peptide Derived from Human Papillomavirus
PLHSILVYM

SEQ ID NO: 13233 - protein, 8 aa, Artificial Sequence
  Peptide Derived from Human Papillomavirus
PLPLHSIL

SEQ ID NO: 13234 - protein, 10 aa, Artificial Sequence
  Peptide Derived from Human Papillomavirus
PLPLHSILVY

SEQ ID NO: 13235 - protein, 11 aa, Artificial Sequence
  Peptide Derived from Human Papillomavirus
PLPLHSILVYM

SEQ ID NO: 13236 - protein, 10 aa, Artificial Sequence
  Peptide Derived from Human Papillomavirus
PLSQGDCPPL

SEQ ID NO: 13237 - protein, 8 aa, Artificial Sequence
  Peptide Derived from Human Papillomavirus
PLYHPRPL

SEQ ID NO: 13238 - protein, 10 aa, Artificial Sequence
  Peptide Derived from Human Papillomavirus
PLYHPRPLPL

SEQ ID NO: 13239 - protein, 9 aa, Artificial Sequence
  Peptide Derived from Human Papillomavirus
PTTSLVDTY

SEQ ID NO: 13240 - protein, 11 aa, Artificial Sequence
  Peptide Derived from Human Papillomavirus
PTTSLVDTYRF

SEQ ID NO: 13241 - protein, 11 aa, Artificial Sequence
  Peptide Derived from Human Papillomavirus
PVPGQYDATKF

SEQ ID NO: 13242 - protein, 8 aa, Artificial Sequence
  Peptide Derived from Human Papillomavirus
PYDKLKFW

SEQ ID NO: 13243 - protein, 8 aa, Artificial Sequence
  Peptide Derived from Human Papillomavirus
PYGDSMFF

SEQ ID NO: 13244 - protein, 10 aa, Artificial Sequence
  Peptide Derived from Human Papillomavirus
PYGDSMFFCL

SEQ ID NO: 13245 - protein, 9 aa, Artificial Sequence
  Peptide Derived from Human Papillomavirus
QFIFQLCTI

SEQ ID NO: 13246 - protein, 11 aa, Artificial Sequence
  Peptide Derived from Human Papillomavirus
QFIFQLCTITL

SEQ ID NO: 13247 - protein, 11 aa, Artificial Sequence
  Peptide Derived from Human Papillomavirus
QLCILGCAPAI

SEQ ID NO: 13248 - protein, 8 aa, Artificial Sequence
  Peptide Derived from Human Papillomavirus
QLFARHFW

SEQ ID NO: 13249 - protein, 8 aa, Artificial Sequence
  Peptide Derived from Human Papillomavirus
QLFNKPYW

SEQ ID NO: 13250 - protein, 9 aa, Artificial Sequence
  Peptide Derived from Human Papillomavirus
QLFNKPYWL

SEQ ID NO: 13251 - protein, 8 aa, Artificial Sequence
  Peptide Derived from Human Papillomavirus
QLPDPNKF

SEQ ID NO: 13252 - protein, 10 aa, Artificial Sequence
  Peptide Derived from Human Papillomavirus
QLPDPNKFGL

SEQ ID NO: 13253 - protein, 11 aa, Artificial Sequence
  Peptide Derived from Human Papillomavirus
QMSADPYGDSM

SEQ ID NO: 13254 - protein, 10 aa, Artificial Sequence
  Peptide Derived from Human Papillomavirus
QYDATKFKQY

SEQ ID NO: 13255 - protein, 8 aa, Artificial Sequence
  Peptide Derived from Human Papillomavirus
QYPLGRKF

SEQ ID NO: 13256 - protein, 9 aa, Artificial Sequence
  Peptide Derived from Human Papillomavirus
QYPLGRKFL

SEQ ID NO: 13257 - protein, 9 aa, Artificial Sequence
  Peptide Derived from Human Papillomavirus
QYRVFRVQL

SEQ ID NO: 13258 - protein, 9 aa, Artificial Sequence
  Peptide Derived from Human Papillomavirus
QYSRHVEEY

SEQ ID NO: 13259 - protein, 11 aa, Artificial Sequence
  Peptide Derived from Human Papillomavirus
QYSRHVEEYDL

SEQ ID NO: 13260 - protein, 8 aa, Artificial Sequence
  Peptide Derived from Human Papillomavirus
RFVQSVAI

SEQ ID NO: 13261 - protein, 9 aa, Artificial Sequence
  Peptide Derived from Human Papillomavirus
RLLTVGNPY

SEQ ID NO: 13262 - protein, 10 aa, Artificial Sequence
  Peptide Derived from Human Papillomavirus
RLLTVGNPYF

SEQ ID NO: 13263 - protein, 11 aa, Artificial Sequence
  Peptide Derived from Human Papillomavirus
RLVWACAGVEI

SEQ ID NO: 13264 - protein, 9 aa, Artificial Sequence
  Peptide Derived from Human Papillomavirus
RVLILHYHL

SEQ ID NO: 13265 - protein, 10 aa, Artificial Sequence
  Peptide Derived from Human Papillomavirus
RVLILHYHLL

SEQ ID NO: 13266 - protein, 10 aa, Artificial Sequence
  Peptide Derived from Human Papillomavirus
RVQLPDPNKF

SEQ ID NO: 13267 - protein, 8 aa, Artificial Sequence
  Peptide Derived from Human Papillomavirus
RVVNTDDY

SEQ ID NO: 13268 - protein, 8 aa, Artificial Sequence
  Peptide Derived from Human Papillomavirus
SICKYPDY

SEQ ID NO: 13269 - protein, 9 aa, Artificial Sequence
  Peptide Derived from Human Papillomavirus
SICKYPDYL

SEQ ID NO: 13270 - protein, 11 aa, Artificial Sequence
  Peptide Derived from Human Papillomavirus
SICKYPDYLQM

SEQ ID NO: 13271 - protein, 11 aa, Artificial Sequence
  Peptide Derived from Human Papillomavirus
SIFYHAGSSRL

SEQ ID NO: 13272 - protein, 8 aa, Artificial Sequence
  Peptide Derived from Human Papillomavirus
SILEDWNF

SEQ ID NO: 13273 - protein, 9 aa, Artificial Sequence
  Peptide Derived from Human Papillomavirus
SILVYMVHI

SEQ ID NO: 13274 - protein, 10 aa, Artificial Sequence
  Peptide Derived from Human Papillomavirus
SILVYMVHII

SEQ ID NO: 13275 - protein, 11 aa, Artificial Sequence
  Peptide Derived from Human Papillomavirus
SILVYMVHIII

SEQ ID NO: 13276 - protein, 9 aa, Artificial Sequence
  Peptide Derived from Human Papillomavirus
SIVTSDSQL

SEQ ID NO: 13277 - protein, 10 aa, Artificial Sequence
  Peptide Derived from Human Papillomavirus
SIVTSDSQLF

SEQ ID NO: 13278 - protein, 10 aa, Artificial Sequence
  Peptide Derived from Human Papillomavirus
SIYNPETQRL

SEQ ID NO: 13279 - protein, 9 aa, Artificial Sequence
  Peptide Derived from Human Papillomavirus
SLDLDQYPL

SEQ ID NO: 13280 - protein, 8 aa, Artificial Sequence
  Peptide Derived from Human Papillomavirus
SLVDTYRF

SEQ ID NO: 13281 - protein, 9 aa, Artificial Sequence
  Peptide Derived from Human Papillomavirus
SLYIKGTGM

SEQ ID NO: 13282 - protein, 11 aa, Artificial Sequence
  Peptide Derived from Human Papillomavirus
SMFFCLRREQL

SEQ ID NO: 13283 - protein, 10 aa, Artificial Sequence
  Peptide Derived from Human Papillomavirus
SMNSSILEDW

SEQ ID NO: 13284 - protein, 10 aa, Artificial Sequence
  Peptide Derived from Human Papillomavirus
STQSPVPGQY

SEQ ID NO: 13285 - protein, 11 aa, Artificial Sequence
  Peptide Derived from Human Papillomavirus
SVARVVNTDDY

SEQ ID NO: 13286 - protein, 9 aa, Artificial Sequence
  Peptide Derived from Human Papillomavirus
SVDYKQTQL

SEQ ID NO: 13287 - protein, 11 aa, Artificial Sequence
  Peptide Derived from Human Papillomavirus
SVDYKQTQLCI

SEQ ID NO: 13288 - protein, 10 aa, Artificial Sequence
  Peptide Derived from Human Papillomavirus
SYIHSMNSSI

SEQ ID NO: 13289 - protein, 11 aa, Artificial Sequence
  Peptide Derived from Human Papillomavirus
SYIHSMNSSIL

SEQ ID NO: 13290 - protein, 9 aa, Artificial Sequence
  Peptide Derived from Human Papillomavirus
TITLTADVM

SEQ ID NO: 13291 - protein, 11 aa, Artificial Sequence
  Peptide Derived from Human Papillomavirus
TITLTADVMSY

SEQ ID NO: 13292 - protein, 11 aa, Artificial Sequence
  Peptide Derived from Human Papillomavirus
TLQDTKCEVPL

SEQ ID NO: 13293 - protein, 9 aa, Artificial Sequence
  Peptide Derived from Human Papillomavirus
TLTADVMSY

SEQ ID NO: 13294 - protein, 10 aa, Artificial Sequence
  Peptide Derived from Human Papillomavirus
TLTADVMSYI

SEQ ID NO: 13295 - protein, 10 aa, Artificial Sequence
  Peptide Derived from Human Papillomavirus
TMGDTVPQSL

SEQ ID NO: 13296 - protein, 11 aa, Artificial Sequence
  Peptide Derived from Human Papillomavirus
TMGDTVPQSLY

SEQ ID NO: 13297 - protein, 9 aa, Artificial Sequence
  Peptide Derived from Human Papillomavirus
TTPSTNLTI

SEQ ID NO: 13298 - protein, 8 aa, Artificial Sequence
  Peptide Derived from Human Papillomavirus
TTSLVDTY

SEQ ID NO: 13299 - protein, 10 aa, Artificial Sequence
  Peptide Derived from Human Papillomavirus
TTSLVDTYRF

SEQ ID NO: 13300 - protein, 8 aa, Artificial Sequence
  Peptide Derived from Human Papillomavirus
TVLEDGDM

SEQ ID NO: 13301 - protein, 8 aa, Artificial Sequence
  Peptide Derived from Human Papillomavirus
TVPQSLYI

SEQ ID NO: 13302 - protein, 11 aa, Artificial Sequence
  Peptide Derived from Human Papillomavirus
TVVDTTPSTNL

SEQ ID NO: 13303 - protein, 10 aa, Artificial Sequence
  Peptide Derived from Human Papillomavirus
TYRFVQSVAI

SEQ ID NO: 13304 - protein, 8 aa, Artificial Sequence
  Peptide Derived from Human Papillomavirus
VFPIFLQM

SEQ ID NO: 13305 - protein, 10 aa, Artificial Sequence
  Peptide Derived from Human Papillomavirus
VFPIFLQMAL

SEQ ID NO: 13306 - protein, 11 aa, Artificial Sequence
  Peptide Derived from Human Papillomavirus
VFPIFLQMALW

SEQ ID NO: 13307 - protein, 8 aa, Artificial Sequence
  Peptide Derived from Human Papillomavirus
VLILHYHL

SEQ ID NO: 13308 - protein, 9 aa, Artificial Sequence
  Peptide Derived from Human Papillomavirus
VLILHYHLL

SEQ ID NO: 13309 - protein, 11 aa, Artificial Sequence
  Peptide Derived from Human Papillomavirus
VLILHYHLLPL

SEQ ID NO: 13310 - protein, 8 aa, Artificial Sequence
  Peptide Derived from Human Papillomavirus
VMSYIHSM

SEQ ID NO: 13311 - protein, 8 aa, Artificial Sequence
  Peptide Derived from Human Papillomavirus
VTPTSIFY

SEQ ID NO: 13312 - protein, 8 aa, Artificial Sequence
  Peptide Derived from Human Papillomavirus
VTSDSQLF

SEQ ID NO: 13313 - protein, 10 aa, Artificial Sequence
  Peptide Derived from Human Papillomavirus
VVDTTPSTNL

SEQ ID NO: 13314 - protein, 9 aa, Artificial Sequence
  Peptide Derived from Human Papillomavirus
VWACAGVEI

SEQ ID NO: 13315 - protein, 8 aa, Artificial Sequence
  Peptide Derived from Human Papillomavirus
VYMVHIII

SEQ ID NO: 13316 - protein, 10 aa, Artificial Sequence
  Peptide Derived from Human Papillomavirus
VYSPSPSGSI

SEQ ID NO: 13317 - protein, 9 aa, Artificial Sequence
  Peptide Derived from Human Papillomavirus
YIHSMNSSI

SEQ ID NO: 13318 - protein, 10 aa, Artificial Sequence
  Peptide Derived from Human Papillomavirus
YIHSMNSSIL

SEQ ID NO: 13319 - protein, 9 aa, Artificial Sequence
  Peptide Derived from Human Papillomavirus
YLQMSADPY

SEQ ID NO: 13320 - protein, 11 aa, Artificial Sequence
  Peptide Derived from Human Papillomavirus
YMVHIIICGHY

SEQ ID NO: 13321 - protein, 9 aa, Artificial Sequence
  Peptide Derived from Human Papillomavirus
YTRVLILHY

SEQ ID NO: 13322 - protein, 11 aa, Artificial Sequence
  Peptide Derived from Human Papillomavirus
YTRVLILHYHL

SEQ ID NO: 13323 - protein, 8 aa, Artificial Sequence
  Peptide Derived from Human Papillomavirus
YVTPTSIF

SEQ ID NO: 13324 - protein, 9 aa, Artificial Sequence
  Peptide Derived from Human Papillomavirus
YVTPTSIFY

SEQ ID NO: 13325 - protein, 9 aa, Artificial Sequence
  Peptide Derived from Human Papillomavirus
AFEPVDTTL

SEQ ID NO: 13326 - protein, 11 aa, Artificial Sequence
  Peptide Derived from Human Papillomavirus
AFEPVDTTLTF

SEQ ID NO: 13327 - protein, 9 aa, Artificial Sequence
  Peptide Derived from Human Papillomavirus
AFFKYSPTI

SEQ ID NO: 13328 - protein, 8 aa, Artificial Sequence
  Peptide Derived from Human Papillomavirus
AFSDPSII

SEQ ID NO: 13329 - protein, 11 aa, Artificial Sequence
  Peptide Derived from Human Papillomavirus
ALTSRRGTVRF

SEQ ID NO: 13330 - protein, 8 aa, Artificial Sequence
  Peptide Derived from Human Papillomavirus
ATEDNDLF

SEQ ID NO: 13331 - protein, 10 aa, Artificial Sequence
  Peptide Derived from Human Papillomavirus
ATEDNDLFDI

SEQ ID NO: 13332 - protein, 11 aa, Artificial Sequence
  Peptide Derived from Human Papillomavirus
ATEDNDLFDIY

SEQ ID NO: 13333 - protein, 11 aa, Artificial Sequence
  Peptide Derived from Human Papillomavirus
ATMFTRSGTQI

SEQ ID NO: 13334 - protein, 8 aa, Artificial Sequence
  Peptide Derived from Human Papillomavirus
DFMDIIRL

SEQ ID NO: 13335 - protein, 10 aa, Artificial Sequence
  Peptide Derived from Human Papillomavirus
DIIRLHRPAL

SEQ ID NO: 13336 - protein, 11 aa, Artificial Sequence
  Peptide Derived from Human Papillomavirus
DISPIAPSPEY

SEQ ID NO: 13337 - protein, 11 aa, Artificial Sequence
  Peptide Derived from Human Papillomavirus
DITLPSTTSVW

SEQ ID NO: 13338 - protein, 11 aa, Artificial Sequence
  Peptide Derived from Human Papillomavirus
DITPSSTSVSI

SEQ ID NO: 13339 - protein, 10 aa, Artificial Sequence
  Peptide Derived from Human Papillomavirus
DLFDIYADDM

SEQ ID NO: 13340 - protein, 11 aa, Artificial Sequence
  Peptide Derived from Human Papillomavirus
DVGPTRPPVVI

SEQ ID NO: 13341 - protein, 8 aa, Artificial Sequence
  Peptide Derived from Human Papillomavirus
DVPDSDFM

SEQ ID NO: 13342 - protein, 10 aa, Artificial Sequence
  Peptide Derived from Human Papillomavirus
DVPDSDFMDI

SEQ ID NO: 13343 - protein, 11 aa, Artificial Sequence
  Peptide Derived from Human Papillomavirus
DVPDSDFMDII

SEQ ID NO: 13344 - protein, 10 aa, Artificial Sequence
  Peptide Derived from Human Papillomavirus
DVPVYTGPDI

SEQ ID NO: 13345 - protein, 11 aa, Artificial Sequence
  Peptide Derived from Human Papillomavirus
DVVPKVEGTTL

SEQ ID NO: 13346 - protein, 9 aa, Artificial Sequence
  Peptide Derived from Human Papillomavirus
EFLTRPSSL

SEQ ID NO: 13347 - protein, 10 aa, Artificial Sequence
  Peptide Derived from Human Papillomavirus
EFLTRPSSLI

SEQ ID NO: 13348 - protein, 8 aa, Artificial Sequence
  Peptide Derived from Human Papillomavirus
EYIELQPL

SEQ ID NO: 13349 - protein, 8 aa, Artificial Sequence
  Peptide Derived from Human Papillomavirus
FFKYSPTI

SEQ ID NO: 13350 - protein, 11 aa, Artificial Sequence
  Peptide Derived from Human Papillomavirus
FIPKKRKRVPY

SEQ ID NO: 13351 - protein, 8 aa, Artificial Sequence
  Peptide Derived from Human Papillomavirus
FLTRPSSL

SEQ ID NO: 13352 - protein, 9 aa, Artificial Sequence
  Peptide Derived from Human Papillomavirus
FLTRPSSLI

SEQ ID NO: 13353 - protein, 11 aa, Artificial Sequence
  Peptide Derived from Human Papillomavirus
FLTRPSSLITY

SEQ ID NO: 13354 - protein, 9 aa, Artificial Sequence
  Peptide Derived from Human Papillomavirus
FTGTSGFDI

SEQ ID NO: 13355 - protein, 11 aa, Artificial Sequence
  Peptide Derived from Human Papillomavirus
FTNPAFSDPSI

SEQ ID NO: 13356 - protein, 8 aa, Artificial Sequence
  Peptide Derived from Human Papillomavirus
FTRSGTQI

SEQ ID NO: 13357 - protein, 8 aa, Artificial Sequence
  Peptide Derived from Human Papillomavirus
FYHDISPI

SEQ ID NO: 13358 - protein, 9 aa, Artificial Sequence
  Peptide Derived from Human Papillomavirus
GIFLGGLGI

SEQ ID NO: 13359 - protein, 8 aa, Artificial Sequence
  Peptide Derived from Human Papillomavirus
GIHGTHYY

SEQ ID NO: 13360 - protein, 9 aa, Artificial Sequence
  Peptide Derived from Human Papillomavirus
GIHGTHYYL

SEQ ID NO: 13361 - protein, 10 aa, Artificial Sequence
  Peptide Derived from Human Papillomavirus
GIHGTHYYLW

SEQ ID NO: 13362 - protein, 8 aa, Artificial Sequence
  Peptide Derived from Human Papillomavirus
GTGGRTGY

SEQ ID NO: 13363 - protein, 9 aa, Artificial Sequence
  Peptide Derived from Human Papillomavirus
GTGGRTGYI

SEQ ID NO: 13364 - protein, 11 aa, Artificial Sequence
  Peptide Derived from Human Papillomavirus
GTGGRTGYIPL

SEQ ID NO: 13365 - protein, 8 aa, Artificial Sequence
  Peptide Derived from Human Papillomavirus
GTHGYEEI

SEQ ID NO: 13366 - protein, 10 aa, Artificial Sequence
  Peptide Derived from Human Papillomavirus
GTHGYEEIPL

SEQ ID NO: 13367 - protein, 9 aa, Artificial Sequence
  Peptide Derived from Human Papillomavirus
GTHYYLWPL

SEQ ID NO: 13368 - protein, 10 aa, Artificial Sequence
  Peptide Derived from Human Papillomavirus
GTHYYLWPLY

SEQ ID NO: 13369 - protein, 11 aa, Artificial Sequence
  Peptide Derived from Human Papillomavirus
GTHYYLWPLYY

SEQ ID NO: 13370 - protein, 10 aa, Artificial Sequence
  Peptide Derived from Human Papillomavirus
GTPTSGTHGY

SEQ ID NO: 13371 - protein, 10 aa, Artificial Sequence
  Peptide Derived from Human Papillomavirus
GTQIGARVHF

SEQ ID NO: 13372 - protein, 11 aa, Artificial Sequence
  Peptide Derived from Human Papillomavirus
GTQIGARVHFY

SEQ ID NO: 13373 - protein, 8 aa, Artificial Sequence
  Peptide Derived from Human Papillomavirus
GTTLADKI

SEQ ID NO: 13374 - protein, 9 aa, Artificial Sequence
  Peptide Derived from Human Papillomavirus
GTTLADKIL

SEQ ID NO: 13375 - protein, 11 aa, Artificial Sequence
  Peptide Derived from Human Papillomavirus
GTTLADKILQW

SEQ ID NO: 13376 - protein, 8 aa, Artificial Sequence
  Peptide Derived from Human Papillomavirus
GTTTPAVL

SEQ ID NO: 13377 - protein, 10 aa, Artificial Sequence
  Peptide Derived from Human Papillomavirus
GTTTPAVLDI

SEQ ID NO: 13378 - protein, 8 aa, Artificial Sequence
  Peptide Derived from Human Papillomavirus
GTVRFSRL

SEQ ID NO: 13379 - protein, 10 aa, Artificial Sequence
  Peptide Derived from Human Papillomavirus
GYEEIPLQTF

SEQ ID NO: 13380 - protein, 9 aa, Artificial Sequence
  Peptide Derived from Human Papillomavirus
HFYHDISPI

SEQ ID NO: 13381 - protein, 8 aa, Artificial Sequence
  Peptide Derived from Human Papillomavirus
HYYLWPLY

SEQ ID NO: 13382 - protein, 9 aa, Artificial Sequence
  Peptide Derived from Human Papillomavirus
HYYLWPLYY

SEQ ID NO: 13383 - protein, 10 aa, Artificial Sequence
  Peptide Derived from Human Papillomavirus
HYYLWPLYYF

SEQ ID NO: 13384 - protein, 11 aa, Artificial Sequence
  Peptide Derived from Human Papillomavirus
HYYLWPLYYFI

SEQ ID NO: 13385 - protein, 8 aa, Artificial Sequence
  Peptide Derived from Human Papillomavirus
IFLGGLGI

SEQ ID NO: 13386 - protein, 9 aa, Artificial Sequence
  Peptide Derived from Human Papillomavirus
IIRLHRPAL

SEQ ID NO: 13387 - protein, 9 aa, Artificial Sequence
  Peptide Derived from Human Papillomavirus
ILQWSSLGI

SEQ ID NO: 13388 - protein, 10 aa, Artificial Sequence
  Peptide Derived from Human Papillomavirus
ILQWSSLGIF

SEQ ID NO: 13389 - protein, 11 aa, Artificial Sequence
  Peptide Derived from Human Papillomavirus
ILQWSSLGIFL

SEQ ID NO: 13390 - protein, 10 aa, Artificial Sequence
  Peptide Derived from Human Papillomavirus
ITLPSTTSVW

SEQ ID NO: 13391 - protein, 10 aa, Artificial Sequence
  Peptide Derived from Human Papillomavirus
ITPSSTSVSI

SEQ ID NO: 13392 - protein, 8 aa, Artificial Sequence
  Peptide Derived from Human Papillomavirus
ITYDNPAF

SEQ ID NO: 13393 - protein, 8 aa, Artificial Sequence
  Peptide Derived from Human Papillomavirus
KILQWSSL

SEQ ID NO: 13394 - protein, 10 aa, Artificial Sequence
  Peptide Derived from Human Papillomavirus
KILQWSSLGI

SEQ ID NO: 13395 - protein, 11 aa, Artificial Sequence
  Peptide Derived from Human Papillomavirus
KILQWSSLGIF

SEQ ID NO: 13396 - protein, 11 aa, Artificial Sequence
  Peptide Derived from Human Papillomavirus
KVEGTTLADKI

SEQ ID NO: 13397 - protein, 9 aa, Artificial Sequence
  Peptide Derived from Human Papillomavirus
LFDIYADDM

SEQ ID NO: 13398 - protein, 9 aa, Artificial Sequence
  Peptide Derived from Human Papillomavirus
LITYDNPAF

SEQ ID NO: 13399 - protein, 8 aa, Artificial Sequence
  Peptide Derived from Human Papillomavirus
LTRPSSLI

SEQ ID NO: 13400 - protein, 10 aa, Artificial Sequence
  Peptide Derived from Human Papillomavirus
LTRPSSLITY

SEQ ID NO: 13401 - protein, 10 aa, Artificial Sequence
  Peptide Derived from Human Papillomavirus
LTSRRGTVRF

SEQ ID NO: 13402 - protein, 10 aa, Artificial Sequence
  Peptide Derived from Human Papillomavirus
LTSSWDVPVY

SEQ ID NO: 13403 - protein, 10 aa, Artificial Sequence
  Peptide Derived from Human Papillomavirus
LVSATEDNDL

SEQ ID NO: 13404 - protein, 11 aa, Artificial Sequence
  Peptide Derived from Human Papillomavirus
LVSATEDNDLF

SEQ ID NO: 13405 - protein, 8 aa, Artificial Sequence
  Peptide Derived from Human Papillomavirus
LWPLYYFI

SEQ ID NO: 13406 - protein, 9 aa, Artificial Sequence
  Peptide Derived from Human Papillomavirus
MFTRSGTQI

SEQ ID NO: 13407 - protein, 10 aa, Artificial Sequence
  Peptide Derived from Human Papillomavirus
NVTVPLTSSW

SEQ ID NO: 13408 - protein, 8 aa, Artificial Sequence
  Peptide Derived from Human Papillomavirus
PIAPSPEY

SEQ ID NO: 13409 - protein, 9 aa, Artificial Sequence
  Peptide Derived from Human Papillomavirus
PIAPSPEYI

SEQ ID NO: 13410 - protein, 11 aa, Artificial Sequence
  Peptide Derived from Human Papillomavirus
PIAPSPEYIEL

SEQ ID NO: 13411 - protein, 11 aa, Artificial Sequence
  Peptide Derived from Human Papillomavirus
PLTSSWDVPVY

SEQ ID NO: 13412 - protein, 11 aa, Artificial Sequence
  Peptide Derived from Human Papillomavirus
PLVSATEDNDL

SEQ ID NO: 13413 - protein, 9 aa, Artificial Sequence
  Peptide Derived from Human Papillomavirus
PTAPASTQY

SEQ ID NO: 13414 - protein, 10 aa, Artificial Sequence
  Peptide Derived from Human Papillomavirus
PTAPASTQYI

SEQ ID NO: 13415 - protein, 9 aa, Artificial Sequence
  Peptide Derived from Human Papillomavirus
PTDPSIVTL

SEQ ID NO: 13416 - protein, 10 aa, Artificial Sequence
  Peptide Derived from Human Papillomavirus
PTDPSIVTLI

SEQ ID NO: 13417 - protein, 9 aa, Artificial Sequence
  Peptide Derived from Human Papillomavirus
PTFTGTSGF

SEQ ID NO: 13418 - protein, 11 aa, Artificial Sequence
  Peptide Derived from Human Papillomavirus
PTFTGTSGFDI

SEQ ID NO: 13419 - protein, 9 aa, Artificial Sequence
  Peptide Derived from Human Papillomavirus
PTISSASSY

SEQ ID NO: 13420 - protein, 8 aa, Artificial Sequence
  Peptide Derived from Human Papillomavirus
PTRPPVVI

SEQ ID NO: 13421 - protein, 8 aa, Artificial Sequence
  Peptide Derived from Human Papillomavirus
PTSGTHGY

SEQ ID NO: 13422 - protein, 11 aa, Artificial Sequence
  Peptide Derived from Human Papillomavirus
PTSGTHGYEEI

SEQ ID NO: 13423 - protein, 11 aa, Artificial Sequence
  Peptide Derived from Human Papillomavirus
PTVRRVAGPRL

SEQ ID NO: 13424 - protein, 8 aa, Artificial Sequence
  Peptide Derived from Human Papillomavirus
PVDTTLTF

SEQ ID NO: 13425 - protein, 9 aa, Artificial Sequence
  Peptide Derived from Human Papillomavirus
PVGPTDPSI

SEQ ID NO: 13426 - protein, 10 aa, Artificial Sequence
  Peptide Derived from Human Papillomavirus
PVPSRSTTSF

SEQ ID NO: 13427 - protein, 8 aa, Artificial Sequence
  Peptide Derived from Human Papillomavirus
PVYTGPDI

SEQ ID NO: 13428 - protein, 10 aa, Artificial Sequence
  Peptide Derived from Human Papillomavirus
PVYTGPDITL

SEQ ID NO: 13429 - protein, 8 aa, Artificial Sequence
  Peptide Derived from Human Papillomavirus
PYFFADGF

SEQ ID NO: 13430 - protein, 8 aa, Artificial Sequence
  Peptide Derived from Human Papillomavirus
QIGARVHF

SEQ ID NO: 13431 - protein, 9 aa, Artificial Sequence
  Peptide Derived from Human Papillomavirus
QIGARVHFY

SEQ ID NO: 13432 - protein, 10 aa, Artificial Sequence
  Peptide Derived from Human Papillomavirus
QTGEVAGNVF

SEQ ID NO: 13433 - protein, 9 aa, Artificial Sequence
  Peptide Derived from Human Papillomavirus
QVSVANPEF

SEQ ID NO: 13434 - protein, 10 aa, Artificial Sequence
  Peptide Derived from Human Papillomavirus
QVSVANPEFL

SEQ ID NO: 13435 - protein, 8 aa, Artificial Sequence
  Peptide Derived from Human Papillomavirus
QWSSLGIF

SEQ ID NO: 13436 - protein, 9 aa, Artificial Sequence
  Peptide Derived from Human Papillomavirus
QWSSLGIFL

SEQ ID NO: 13437 - protein, 10 aa, Artificial Sequence
  Peptide Derived from Human Papillomavirus
QYIGIHGTHY

SEQ ID NO: 13438 - protein, 11 aa, Artificial Sequence
  Peptide Derived from Human Papillomavirus
QYIGIHGTHYY

SEQ ID NO: 13439 - protein, 11 aa, Artificial Sequence
  Peptide Derived from Human Papillomavirus
RFSRLGQRATM

SEQ ID NO: 13440 - protein, 8 aa, Artificial Sequence
  Peptide Derived from Human Papillomavirus
RLGQRATM

SEQ ID NO: 13441 - protein, 9 aa, Artificial Sequence
  Peptide Derived from Human Papillomavirus
RLGQRATMF

SEQ ID NO: 13442 - protein, 8 aa, Artificial Sequence
  Peptide Derived from Human Papillomavirus
RVAGPRLY

SEQ ID NO: 13443 - protein, 8 aa, Artificial Sequence
  Peptide Derived from Human Papillomavirus
RVHFYHDI

SEQ ID NO: 13444 - protein, 11 aa, Artificial Sequence
  Peptide Derived from Human Papillomavirus
RVHFYHDISPI

SEQ ID NO: 13445 - protein, 10 aa, Artificial Sequence
  Peptide Derived from Human Papillomavirus
RVPYFFADGF

SEQ ID NO: 13446 - protein, 11 aa, Artificial Sequence
  Peptide Derived from Human Papillomavirus
SFAFFKYSPTI

SEQ ID NO: 13447 - protein, 9 aa, Artificial Sequence
  Peptide Derived from Human Papillomavirus
SLGIFLGGL

SEQ ID NO: 13448 - protein, 11 aa, Artificial Sequence
  Peptide Derived from Human Papillomavirus
SLGIFLGGLGI

SEQ ID NO: 13449 - protein, 10 aa, Artificial Sequence
  Peptide Derived from Human Papillomavirus
SLITYDNPAF

SEQ ID NO: 13450 - protein, 11 aa, Artificial Sequence
  Peptide Derived from Human Papillomavirus
STSVSISTTNF

SEQ ID NO: 13451 - protein, 10 aa, Artificial Sequence
  Peptide Derived from Human Papillomavirus
STTNFTNPAF

SEQ ID NO: 13452 - protein, 8 aa, Artificial Sequence
  Peptide Derived from Human Papillomavirus
STTSFAFF

SEQ ID NO: 13453 - protein, 10 aa, Artificial Sequence
  Peptide Derived from Human Papillomavirus
STTSFAFFKY

SEQ ID NO: 13454 - protein, 8 aa, Artificial Sequence
  Peptide Derived from Human Papillomavirus
STTSVWPI

SEQ ID NO: 13455 - protein, 8 aa, Artificial Sequence
  Peptide Derived from Human Papillomavirus
SVANPEFL

SEQ ID NO: 13456 - protein, 9 aa, Artificial Sequence
  Peptide Derived from Human Papillomavirus
SVSISTTNF

SEQ ID NO: 13457 - protein, 9 aa, Artificial Sequence
  Peptide Derived from Human Papillomavirus
SYSNVTVPL

SEQ ID NO: 13458 - protein, 8 aa, Artificial Sequence
  Peptide Derived from Human Papillomavirus
TFTGTSGF

SEQ ID NO: 13459 - protein, 10 aa, Artificial Sequence
  Peptide Derived from Human Papillomavirus
TFTGTSGFDI

SEQ ID NO: 13460 - protein, 8 aa, Artificial Sequence
  Peptide Derived from Human Papillomavirus
TISSASSY

SEQ ID NO: 13461 - protein, 9 aa, Artificial Sequence
  Peptide Derived from Human Papillomavirus
TLADKILQW

SEQ ID NO: 13462 - protein, 9 aa, Artificial Sequence
  Peptide Derived from Human Papillomavirus
TLPSTTSVW

SEQ ID NO: 13463 - protein, 11 aa, Artificial Sequence
  Peptide Derived from Human Papillomavirus
TLPSTTSVWPI

SEQ ID NO: 13464 - protein, 10 aa, Artificial Sequence
  Peptide Derived from Human Papillomavirus
TMFTRSGTQI

SEQ ID NO: 13465 - protein, 8 aa, Artificial Sequence
  Peptide Derived from Human Papillomavirus
TTLADKIL

SEQ ID NO: 13466 - protein, 10 aa, Artificial Sequence
  Peptide Derived from Human Papillomavirus
TTLADKILQW

SEQ ID NO: 13467 - protein, 9 aa, Artificial Sequence
  Peptide Derived from Human Papillomavirus
TTNFTNPAF

SEQ ID NO: 13468 - protein, 8 aa, Artificial Sequence
  Peptide Derived from Human Papillomavirus
TTPAVLDI

SEQ ID NO: 13469 - protein, 9 aa, Artificial Sequence
  Peptide Derived from Human Papillomavirus
TTSFAFFKY

SEQ ID NO: 13470 - protein, 9 aa, Artificial Sequence
  Peptide Derived from Human Papillomavirus
TTTPAVLDI

SEQ ID NO: 13471 - protein, 8 aa, Artificial Sequence
  Peptide Derived from Human Papillomavirus
TVPLTSSW

SEQ ID NO: 13472 - protein, 10 aa, Artificial Sequence
  Peptide Derived from Human Papillomavirus
TVRRVAGPRL

SEQ ID NO: 13473 - protein, 11 aa, Artificial Sequence
  Peptide Derived from Human Papillomavirus
TVRRVAGPRLY

SEQ ID NO: 13474 - protein, 10 aa, Artificial Sequence
  Peptide Derived from Human Papillomavirus
VTSGAPRPTF

SEQ ID NO: 13475 - protein, 9 aa, Artificial Sequence
  Peptide Derived from Human Papillomavirus
VTVPLTSSW

SEQ ID NO: 13476 - protein, 10 aa, Artificial Sequence
  Peptide Derived from Human Papillomavirus
VVPKVEGTTL

SEQ ID NO: 13477 - protein, 11 aa, Artificial Sequence
  Peptide Derived from Human Papillomavirus
VVTSGAPRPTF

SEQ ID NO: 13478 - protein, 9 aa, Artificial Sequence
  Peptide Derived from Human Papillomavirus
VYTGPDITL

SEQ ID NO: 13479 - protein, 9 aa, Artificial Sequence
  Peptide Derived from Human Papillomavirus
YIGIHGTHY

SEQ ID NO: 13480 - protein, 10 aa, Artificial Sequence
  Peptide Derived from Human Papillomavirus
YIGIHGTHYY

SEQ ID NO: 13481 - protein, 11 aa, Artificial Sequence
  Peptide Derived from Human Papillomavirus
YIGIHGTHYYL

SEQ ID NO: 13482 - protein, 8 aa, Artificial Sequence
  Peptide Derived from Human Papillomavirus
YLWPLYYF

SEQ ID NO: 13483 - protein, 9 aa, Artificial Sequence
  Peptide Derived from Human Papillomavirus
YLWPLYYFI

SEQ ID NO: 13484 - protein, 8 aa, Artificial Sequence
  Peptide Derived from Human Papillomavirus
YTGPDITL

SEQ ID NO: 13485 - protein, 8 aa, Artificial Sequence
  Peptide Derived from Human Papillomavirus
YYLWPLYY

SEQ ID NO: 13486 - protein, 9 aa, Artificial Sequence
  Peptide Derived from Human Papillomavirus
YYLWPLYYF

SEQ ID NO: 13487 - protein, 10 aa, Artificial Sequence
  Peptide Derived from Human Papillomavirus
YYLWPLYYFI

SEQ ID NO: 13488 - protein, 11 aa, Artificial Sequence
  Peptide Derived from Human Papillomavirus
AFLKSNSQAKI

SEQ ID NO: 13489 - protein, 9 aa, Artificial Sequence
  Peptide Derived from Human Papillomavirus
ALDGNPVSI

SEQ ID NO: 13490 - protein, 10 aa, Artificial Sequence
  Peptide Derived from Human Papillomavirus
ALMQLKCPPL

SEQ ID NO: 13491 - protein, 11 aa, Artificial Sequence
  Peptide Derived from Human Papillomavirus
ALMQLKCPPLL

SEQ ID NO: 13492 - protein, 9 aa, Artificial Sequence
  Peptide Derived from Human Papillomavirus
ALYWYRTGM

SEQ ID NO: 13493 - protein, 9 aa, Artificial Sequence
  Peptide Derived from Human Papillomavirus
AMLGKFKEL

SEQ ID NO: 13494 - protein, 10 aa, Artificial Sequence
  Peptide Derived from Human Papillomavirus
AMLGKFKELY

SEQ ID NO: 13495 - protein, 8 aa, Artificial Sequence
  Peptide Derived from Human Papillomavirus
ATTPCWHY

SEQ ID NO: 13496 - protein, 9 aa, Artificial Sequence
  Peptide Derived from Human Papillomavirus
ATTPCWHYI

SEQ ID NO: 13497 - protein, 11 aa, Artificial Sequence
  Peptide Derived from Human Papillomavirus
AVIDRQTGDNI

SEQ ID NO: 13498 - protein, 9 aa, Artificial Sequence
  Peptide Derived from Human Papillomavirus
AVQVLKRKY

SEQ ID NO: 13499 - protein, 8 aa, Artificial Sequence
  Peptide Derived from Human Papillomavirus
CISTNCML

SEQ ID NO: 13500 - protein, 9 aa, Artificial Sequence
  Peptide Derived from Human Papillomavirus
CISTNCMLI

SEQ ID NO: 13501 - protein, 9 aa, Artificial Sequence
  Peptide Derived from Human Papillomavirus
CLYCHLQSL

SEQ ID NO: 13502 - protein, 9 aa, Artificial Sequence
  Peptide Derived from Human Papillomavirus
CMLIQPPKL

SEQ ID NO: 13503 - protein, 9 aa, Artificial Sequence
  Peptide Derived from Human Papillomavirus
CTDWCVAAF

SEQ ID NO: 13504 - protein, 10 aa, Artificial Sequence
  Peptide Derived from Human Papillomavirus
CVDYNISPRL

SEQ ID NO: 13505 - protein, 10 aa, Artificial Sequence
  Peptide Derived from Human Papillomavirus
CVSGQNIRTL

SEQ ID NO: 13506 - protein, 8 aa, Artificial Sequence
  Peptide Derived from Human Papillomavirus
CWHYIDNY

SEQ ID NO: 13507 - protein, 9 aa, Artificial Sequence
  Peptide Derived from Human Papillomavirus
CWHYIDNYL

SEQ ID NO: 13508 - protein, 9 aa, Artificial Sequence
  Peptide Derived from Human Papillomavirus
DFIDNCNVY

SEQ ID NO: 13509 - protein, 8 aa, Artificial Sequence
  Peptide Derived from Human Papillomavirus
DISSCVDY

SEQ ID NO: 13510 - protein, 10 aa, Artificial Sequence
  Peptide Derived from Human Papillomavirus
DISSCVDYNI

SEQ ID NO: 13511 - protein, 8 aa, Artificial Sequence
  Peptide Derived from Human Papillomavirus
DIVKFLRY

SEQ ID NO: 13512 - protein, 11 aa, Artificial Sequence
  Peptide Derived from Human Papillomavirus
DIVKFLRYQQI

SEQ ID NO: 13513 - protein, 8 aa, Artificial Sequence
  Peptide Derived from Human Papillomavirus
DLSQMVQW

SEQ ID NO: 13514 - protein, 10 aa, Artificial Sequence
  Peptide Derived from Human Papillomavirus
DLSQMVQWAY

SEQ ID NO: 13515 - protein, 9 aa, Artificial Sequence
  Peptide Derived from Human Papillomavirus
DTGEDMVDF

SEQ ID NO: 13516 - protein, 10 aa, Artificial Sequence
  Peptide Derived from Human Papillomavirus
DTGEDMVDFI

SEQ ID NO: 13517 - protein, 9 aa, Artificial Sequence
  Peptide Derived from Human Papillomavirus
DTTFDLSQM

SEQ ID NO: 13518 - protein, 8 aa, Artificial Sequence
  Peptide Derived from Human Papillomavirus
DVKHKALM

SEQ ID NO: 13519 - protein, 10 aa, Artificial Sequence
  Peptide Derived from Human Papillomavirus
DVKHKALMQL

SEQ ID NO: 13520 - protein, 8 aa, Artificial Sequence
  Peptide Derived from Human Papillomavirus
DVMDDSEI

SEQ ID NO: 13521 - protein, 10 aa, Artificial Sequence
  Peptide Derived from Human Papillomavirus
DVMDDSEIAY

SEQ ID NO: 13522 - protein, 9 aa, Artificial Sequence
  Peptide Derived from Human Papillomavirus
DVYGETPEW

SEQ ID NO: 13523 - protein, 10 aa, Artificial Sequence
  Peptide Derived from Human Papillomavirus
DVYGETPEWI

SEQ ID NO: 13524 - protein, 8 aa, Artificial Sequence
  Peptide Derived from Human Papillomavirus
DWRDIVKF

SEQ ID NO: 13525 - protein, 9 aa, Artificial Sequence
  Peptide Derived from Human Papillomavirus
DWRDIVKFL

SEQ ID NO: 13526 - protein, 11 aa, Artificial Sequence
  Peptide Derived from Human Papillomavirus
DWRDIVKFLRY

SEQ ID NO: 13527 - protein, 8 aa, Artificial Sequence
  Peptide Derived from Human Papillomavirus
DYNISPRL

SEQ ID NO: 13528 - protein, 11 aa, Artificial Sequence
  Peptide Derived from Human Papillomavirus
DYNISPRLKAI

SEQ ID NO: 13529 - protein, 9 aa, Artificial Sequence
  Peptide Derived from Human Papillomavirus
EFVSFLSAL

SEQ ID NO: 13530 - protein, 11 aa, Artificial Sequence
  Peptide Derived from Human Papillomavirus
EFVSFLSALKL

SEQ ID NO: 13531 - protein, 9 aa, Artificial Sequence
  Peptide Derived from Human Papillomavirus
EIAYKYAQL

SEQ ID NO: 13532 - protein, 10 aa, Artificial Sequence
  Peptide Derived from Human Papillomavirus
ELSDKNWKSF

SEQ ID NO: 13533 - protein, 11 aa, Artificial Sequence
  Peptide Derived from Human Papillomavirus
ELSDKNWKSFF

SEQ ID NO: 13534 - protein, 8 aa, Artificial Sequence
  Peptide Derived from Human Papillomavirus
ELYGVSFM

SEQ ID NO: 13535 - protein, 10 aa, Artificial Sequence
  Peptide Derived from Human Papillomavirus
ELYGVSFMEL

SEQ ID NO: 13536 - protein, 11 aa, Artificial Sequence
  Peptide Derived from Human Papillomavirus
ELYGVSFMELI

SEQ ID NO: 13537 - protein, 8 aa, Artificial Sequence
  Peptide Derived from Human Papillomavirus
ETPTRNIL

SEQ ID NO: 13538 - protein, 11 aa, Artificial Sequence
  Peptide Derived from Human Papillomavirus
ETPTRNILQVL

SEQ ID NO: 13539 - protein, 9 aa, Artificial Sequence
  Peptide Derived from Human Papillomavirus
EWIERQTVL

SEQ ID NO: 13540 - protein, 9 aa, Artificial Sequence
  Peptide Derived from Human Papillomavirus
FFSRTWCRL

SEQ ID NO: 13541 - protein, 11 aa, Artificial Sequence
  Peptide Derived from Human Papillomavirus
FFSRTWCRLNL

SEQ ID NO: 13542 - protein, 8 aa, Artificial Sequence
  Peptide Derived from Human Papillomavirus
FIDNCNVY

SEQ ID NO: 13543 - protein, 11 aa, Artificial Sequence
  Peptide Derived from Human Papillomavirus
FLKGVPKKNCI

SEQ ID NO: 13544 - protein, 10 aa, Artificial Sequence
  Peptide Derived from Human Papillomavirus
FLKSNSQAKI

SEQ ID NO: 13545 - protein, 9 aa, Artificial Sequence
  Peptide Derived from Human Papillomavirus
FLQGCIISY

SEQ ID NO: 13546 - protein, 9 aa, Artificial Sequence
  Peptide Derived from Human Papillomavirus
FLRYQQIEF

SEQ ID NO: 13547 - protein, 8 aa, Artificial Sequence
  Peptide Derived from Human Papillomavirus
FLSALKLF

SEQ ID NO: 13548 - protein, 9 aa, Artificial Sequence
  Peptide Derived from Human Papillomavirus
FLSALKLFL

SEQ ID NO: 13549 - protein, 8 aa, Artificial Sequence
  Peptide Derived from Human Papillomavirus
FMELIRPF

SEQ ID NO: 13550 - protein, 9 aa, Artificial Sequence
  Peptide Derived from Human Papillomavirus
FTFPNPFPF

SEQ ID NO: 13551 - protein, 8 aa, Artificial Sequence
  Peptide Derived from Human Papillomavirus
FVSFLSAL

SEQ ID NO: 13552 - protein, 10 aa, Artificial Sequence
  Peptide Derived from Human Papillomavirus
FVSFLSALKL

SEQ ID NO: 13553 - protein, 11 aa, Artificial Sequence
  Peptide Derived from Human Papillomavirus
FVSFLSALKLF

SEQ ID NO: 13554 - protein, 11 aa, Artificial Sequence
  Peptide Derived from Human Papillomavirus
FWLQPLADAKI

SEQ ID NO: 13555 - protein, 9 aa, Artificial Sequence
  Peptide Derived from Human Papillomavirus
GFKTLLQPY

SEQ ID NO: 13556 - protein, 11 aa, Artificial Sequence
  Peptide Derived from Human Papillomavirus
GFKTLLQPYCL

SEQ ID NO: 13557 - protein, 11 aa, Artificial Sequence
  Peptide Derived from Human Papillomavirus
GMLDDATTPCW

SEQ ID NO: 13558 - protein, 8 aa, Artificial Sequence
  Peptide Derived from Human Papillomavirus
GMSLISFL

SEQ ID NO: 13559 - protein, 9 aa, Artificial Sequence
  Peptide Derived from Human Papillomavirus
GMSNISDVY

SEQ ID NO: 13560 - protein, 10 aa, Artificial Sequence
  Peptide Derived from Human Papillomavirus
GMVMLMLVRF

SEQ ID NO: 13561 - protein, 8 aa, Artificial Sequence
  Peptide Derived from Human Papillomavirus
GTGCNGWF

SEQ ID NO: 13562 - protein, 9 aa, Artificial Sequence
  Peptide Derived from Human Papillomavirus
GTGCNGWFY

SEQ ID NO: 13563 - protein, 10 aa, Artificial Sequence
  Peptide Derived from Human Papillomavirus
GTVAEGFKTL

SEQ ID NO: 13564 - protein, 11 aa, Artificial Sequence
  Peptide Derived from Human Papillomavirus
GTVAEGFKTLL

SEQ ID NO: 13565 - protein, 8 aa, Artificial Sequence
  Peptide Derived from Human Papillomavirus
GVPKKNCI

SEQ ID NO: 13566 - protein, 9 aa, Artificial Sequence
  Peptide Derived from Human Papillomavirus
GVPKKNCIL

SEQ ID NO: 13567 - protein, 10 aa, Artificial Sequence
  Peptide Derived from Human Papillomavirus
GVPKKNCILI

SEQ ID NO: 13568 - protein, 8 aa, Artificial Sequence
  Peptide Derived from Human Papillomavirus
GVSFMELI

SEQ ID NO: 13569 - protein, 11 aa, Artificial Sequence
  Peptide Derived from Human Papillomavirus
GVSFMELIRPF

SEQ ID NO: 13570 - protein, 10 aa, Artificial Sequence
  Peptide Derived from Human Papillomavirus
GVTGTVAEGF

SEQ ID NO: 13571 - protein, 9 aa, Artificial Sequence
  Peptide Derived from Human Papillomavirus
GWFYVEAVI

SEQ ID NO: 13572 - protein, 9 aa, Artificial Sequence
  Peptide Derived from Human Papillomavirus
HLQSLACSW

SEQ ID NO: 13573 - protein, 11 aa, Artificial Sequence
  Peptide Derived from Human Papillomavirus
HLQSLACSWGM

SEQ ID NO: 13574 - protein, 11 aa, Artificial Sequence
  Peptide Derived from Human Papillomavirus
HYIDNYLRNAL

SEQ ID NO: 13575 - protein, 10 aa, Artificial Sequence
  Peptide Derived from Human Papillomavirus
HYKRAEKRQM

SEQ ID NO: 13576 - protein, 11 aa, Artificial Sequence
  Peptide Derived from Human Papillomavirus
IISYANSKSHF

SEQ ID NO: 13577 - protein, 10 aa, Artificial Sequence
  Peptide Derived from Human Papillomavirus
ITIEKLLEKL

SEQ ID NO: 13578 - protein, 11 aa, Artificial Sequence
  Peptide Derived from Human Papillomavirus
ITIEKLLEKLL

SEQ ID NO: 13579 - protein, 8 aa, Artificial Sequence
  Peptide Derived from Human Papillomavirus
IVKDCGTM

SEQ ID NO: 13580 - protein, 10 aa, Artificial Sequence
  Peptide Derived from Human Papillomavirus
IVKFLRYQQI

SEQ ID NO: 13581 - protein, 10 aa, Artificial Sequence
  Peptide Derived from Human Papillomavirus
KFKELYGVSF

SEQ ID NO: 13582 - protein, 11 aa, Artificial Sequence
  Peptide Derived from Human Papillomavirus
KFKELYGVSFM

SEQ ID NO: 13583 - protein, 8 aa, Artificial Sequence
  Peptide Derived from Human Papillomavirus
KFLRYQQI

SEQ ID NO: 13584 - protein, 10 aa, Artificial Sequence
  Peptide Derived from Human Papillomavirus
KFLRYQQIEF

SEQ ID NO: 13585 - protein, 9 aa, Artificial Sequence
  Peptide Derived from Human Papillomavirus
KIVKDCGTM

SEQ ID NO: 13586 - protein, 10 aa, Artificial Sequence
  Peptide Derived from Human Papillomavirus
KLLCISTNCM

SEQ ID NO: 13587 - protein, 11 aa, Artificial Sequence
  Peptide Derived from Human Papillomavirus
KLLCISTNCML

SEQ ID NO: 13588 - protein, 9 aa, Artificial Sequence
  Peptide Derived from Human Papillomavirus
KLLEKLLCI

SEQ ID NO: 13589 - protein, 9 aa, Artificial Sequence
  Peptide Derived from Human Papillomavirus
KLRSTAAAL

SEQ ID NO: 13590 - protein, 10 aa, Artificial Sequence
  Peptide Derived from Human Papillomavirus
KLRSTAAALY

SEQ ID NO: 13591 - protein, 11 aa, Artificial Sequence
  Peptide Derived from Human Papillomavirus
KLRSTAAALYW

SEQ ID NO: 13592 - protein, 8 aa, Artificial Sequence
  Peptide Derived from Human Papillomavirus
KTAKRRLF

SEQ ID NO: 13593 - protein, 10 aa, Artificial Sequence
  Peptide Derived from Human Papillomavirus
KTAKRRLFEL

SEQ ID NO: 13594 - protein, 9 aa, Artificial Sequence
  Peptide Derived from Human Papillomavirus
KTLLQPYCL

SEQ ID NO: 13595 - protein, 10 aa, Artificial Sequence
  Peptide Derived from Human Papillomavirus
KTLLQPYCLY

SEQ ID NO: 13596 - protein, 9 aa, Artificial Sequence
  Peptide Derived from Human Papillomavirus
KTSNGKAAM

SEQ ID NO: 13597 - protein, 10 aa, Artificial Sequence
  Peptide Derived from Human Papillomavirus
KTSNGKAAML

SEQ ID NO: 13598 - protein, 8 aa, Artificial Sequence
  Peptide Derived from Human Papillomavirus
KVSDEGDW

SEQ ID NO: 13599 - protein, 11 aa, Artificial Sequence
  Peptide Derived from Human Papillomavirus
KVSDEGDWRDI

SEQ ID NO: 13600 - protein, 10 aa, Artificial Sequence
  Peptide Derived from Human Papillomavirus
KYVGSPLSDI

SEQ ID NO: 13601 - protein, 9 aa, Artificial Sequence
  Peptide Derived from Human Papillomavirus
LFELPDSGY

SEQ ID NO: 13602 - protein, 9 aa, Artificial Sequence
  Peptide Derived from Human Papillomavirus
LISFLQGCI

SEQ ID NO: 13603 - protein, 10 aa, Artificial Sequence
  Peptide Derived from Human Papillomavirus
LISFLQGCII

SEQ ID NO: 13604 - protein, 9 aa, Artificial Sequence
  Peptide Derived from Human Papillomavirus
LLCISTNCM

SEQ ID NO: 13605 - protein, 10 aa, Artificial Sequence
  Peptide Derived from Human Papillomavirus
LLCISTNCML

SEQ ID NO: 13606 - protein, 11 aa, Artificial Sequence
  Peptide Derived from Human Papillomavirus
LLCISTNCMLI

SEQ ID NO: 13607 - protein, 8 aa, Artificial Sequence
  Peptide Derived from Human Papillomavirus
LLEKLLCI

SEQ ID NO: 13608 - protein, 8 aa, Artificial Sequence
  Peptide Derived from Human Papillomavirus
LLQPYCLY

SEQ ID NO: 13609 - protein, 11 aa, Artificial Sequence
  Peptide Derived from Human Papillomavirus
LLQPYCLYCHL

SEQ ID NO: 13610 - protein, 9 aa, Artificial Sequence
  Peptide Derived from Human Papillomavirus
LMQLKCPPL

SEQ ID NO: 13611 - protein, 10 aa, Artificial Sequence
  Peptide Derived from Human Papillomavirus
LMQLKCPPLL

SEQ ID NO: 13612 - protein, 11 aa, Artificial Sequence
  Peptide Derived from Human Papillomavirus
LMQLKCPPLLI

SEQ ID NO: 13613 - protein, 11 aa, Artificial Sequence
  Peptide Derived from Human Papillomavirus
LVRFKCAKNRI

SEQ ID NO: 13614 - protein, 10 aa, Artificial Sequence
  Peptide Derived from Human Papillomavirus
LVVFTFPNPF

SEQ ID NO: 13615 - protein, 8 aa, Artificial Sequence
  Peptide Derived from Human Papillomavirus
LYCHLQSL

SEQ ID NO: 13616 - protein, 9 aa, Artificial Sequence
  Peptide Derived from Human Papillomavirus
LYGVSFMEL

SEQ ID NO: 13617 - protein, 10 aa, Artificial Sequence
  Peptide Derived from Human Papillomavirus
LYGVSFMELI

SEQ ID NO: 13618 - protein, 8 aa, Artificial Sequence
  Peptide Derived from Human Papillomavirus
LYWYRTGM

SEQ ID NO: 13619 - protein, 11 aa, Artificial Sequence
  Peptide Derived from Human Papillomavirus
LYWYRTGMSNI

SEQ ID NO: 13620 - protein, 10 aa, Artificial Sequence
  Peptide Derived from Human Papillomavirus
MLDDATTPCW

SEQ ID NO: 13621 - protein, 8 aa, Artificial Sequence
  Peptide Derived from Human Papillomavirus
MLGKFKEL

SEQ ID NO: 13622 - protein, 9 aa, Artificial Sequence
  Peptide Derived from Human Papillomavirus
MLGKFKELY

SEQ ID NO: 13623 - protein, 8 aa, Artificial Sequence
  Peptide Derived from Human Papillomavirus
MLIQPPKL

SEQ ID NO: 13624 - protein, 11 aa, Artificial Sequence
  Peptide Derived from Human Papillomavirus
MVDFIDNCNVY

SEQ ID NO: 13625 - protein, 9 aa, Artificial Sequence
  Peptide Derived from Human Papillomavirus
MVMLMLVRF

SEQ ID NO: 13626 - protein, 11 aa, Artificial Sequence
  Peptide Derived from Human Papillomavirus
MVQVEEQQTTL

SEQ ID NO: 13627 - protein, 11 aa, Artificial Sequence
  Peptide Derived from Human Papillomavirus
MVQWAYDNDVM

SEQ ID NO: 13628 - protein, 10 aa, Artificial Sequence
  Peptide Derived from Human Papillomavirus
NINAGKDDRW

SEQ ID NO: 13629 - protein, 9 aa, Artificial Sequence
  Peptide Derived from Human Papillomavirus
NISPRLKAI

SEQ ID NO: 13630 - protein, 11 aa, Artificial Sequence
  Peptide Derived from Human Papillomavirus
NISPRLKAICI

SEQ ID NO: 13631 - protein, 9 aa, Artificial Sequence
  Peptide Derived from Human Papillomavirus
NTEVETQQM

SEQ ID NO: 13632 - protein, 9 aa, Artificial Sequence
  Peptide Derived from Human Papillomavirus
NTGKSYFGM

SEQ ID NO: 13633 - protein, 11 aa, Artificial Sequence
  Peptide Derived from Human Papillomavirus
NTGKSYFGMSL

SEQ ID NO: 13634 - protein, 10 aa, Artificial Sequence
  Peptide Derived from Human Papillomavirus
NWKSFFSRTW

SEQ ID NO: 13635 - protein, 10 aa, Artificial Sequence
  Peptide Derived from Human Papillomavirus
PFDKNGNPVY

SEQ ID NO: 13636 - protein, 9 aa, Artificial Sequence
  Peptide Derived from Human Papillomavirus
PLADAKIGM

SEQ ID NO: 13637 - protein, 10 aa, Artificial Sequence
  Peptide Derived from Human Papillomavirus
PLADAKIGML

SEQ ID NO: 13638 - protein, 8 aa, Artificial Sequence
  Peptide Derived from Human Papillomavirus
PLLITSNI

SEQ ID NO: 13639 - protein, 11 aa, Artificial Sequence
  Peptide Derived from Human Papillomavirus
PLSDISSCVDY

SEQ ID NO: 13640 - protein, 9 aa, Artificial Sequence
  Peptide Derived from Human Papillomavirus
PTRNILQVL

SEQ ID NO: 13641 - protein, 11 aa, Artificial Sequence
  Peptide Derived from Human Papillomavirus
PVSIDVKHKAL

SEQ ID NO: 13642 - protein, 10 aa, Artificial Sequence
  Peptide Derived from Human Papillomavirus
PVYELSDKNW

SEQ ID NO: 13643 - protein, 8 aa, Artificial Sequence
  Peptide Derived from Human Papillomavirus
PYCLYCHL

SEQ ID NO: 13644 - protein, 11 aa, Artificial Sequence
  Peptide Derived from Human Papillomavirus
PYCLYCHLQSL

SEQ ID NO: 13645 - protein, 10 aa, Artificial Sequence
  Peptide Derived from Human Papillomavirus
PYLHSRLVVF

SEQ ID NO: 13646 - protein, 8 aa, Artificial Sequence
  Peptide Derived from Human Papillomavirus
QIEFVSFL

SEQ ID NO: 13647 - protein, 11 aa, Artificial Sequence
  Peptide Derived from Human Papillomavirus
QIEFVSFLSAL

SEQ ID NO: 13648 - protein, 8 aa, Artificial Sequence
  Peptide Derived from Human Papillomavirus
QLKCPPLL

SEQ ID NO: 13649 - protein, 9 aa, Artificial Sequence
  Peptide Derived from Human Papillomavirus
QLKCPPLLI

SEQ ID NO: 13650 - protein, 8 aa, Artificial Sequence
  Peptide Derived from Human Papillomavirus
QMSMGQWI

SEQ ID NO: 13651 - protein, 8 aa, Artificial Sequence
  Peptide Derived from Human Papillomavirus
QTVLQHSF

SEQ ID NO: 13652 - protein, 9 aa, Artificial Sequence
  Peptide Derived from Human Papillomavirus
QVEEQQTTL

SEQ ID NO: 13653 - protein, 9 aa, Artificial Sequence
  Peptide Derived from Human Papillomavirus
QWAYDNDVM

SEQ ID NO: 13654 - protein, 9 aa, Artificial Sequence
  Peptide Derived from Human Papillomavirus
RFKCAKNRI

SEQ ID NO: 13655 - protein, 11 aa, Artificial Sequence
  Peptide Derived from Human Papillomavirus
RFKCAKNRITI

SEQ ID NO: 13656 - protein, 8 aa, Artificial Sequence
  Peptide Derived from Human Papillomavirus
RITIEKLL

SEQ ID NO: 13657 - protein, 11 aa, Artificial Sequence
  Peptide Derived from Human Papillomavirus
RITIEKLLEKL

SEQ ID NO: 13658 - protein, 10 aa, Artificial Sequence
  Peptide Derived from Human Papillomavirus
RLFELPDSGY

SEQ ID NO: 13659 - protein, 11 aa, Artificial Sequence
  Peptide Derived from Human Papillomavirus
RLVVFTFPNPF

SEQ ID NO: 13660 - protein, 11 aa, Artificial Sequence
  Peptide Derived from Human Papillomavirus
RTGMSNISDVY

SEQ ID NO: 13661 - protein, 8 aa, Artificial Sequence
  Peptide Derived from Human Papillomavirus
RTWCRLNL

SEQ ID NO: 13662 - protein, 9 aa, Artificial Sequence
  Peptide Derived from Human Papillomavirus
RWPYLHSRL

SEQ ID NO: 13663 - protein, 10 aa, Artificial Sequence
  Peptide Derived from Human Papillomavirus
RYQQIEFVSF

SEQ ID NO: 13664 - protein, 11 aa, Artificial Sequence
  Peptide Derived from Human Papillomavirus
RYQQIEFVSFL

SEQ ID NO: 13665 - protein, 10 aa, Artificial Sequence
  Peptide Derived from Human Papillomavirus
SFFSRTWCRL

SEQ ID NO: 13666 - protein, 8 aa, Artificial Sequence
  Peptide Derived from Human Papillomavirus
SFLQGCII

SEQ ID NO: 13667 - protein, 10 aa, Artificial Sequence
  Peptide Derived from Human Papillomavirus
SFLQGCIISY

SEQ ID NO: 13668 - protein, 8 aa, Artificial Sequence
  Peptide Derived from Human Papillomavirus
SFLSALKL

SEQ ID NO: 13669 - protein, 9 aa, Artificial Sequence
  Peptide Derived from Human Papillomavirus
SFLSALKLF

SEQ ID NO: 13670 - protein, 10 aa, Artificial Sequence
  Peptide Derived from Human Papillomavirus
SFLSALKLFL

SEQ ID NO: 13671 - protein, 9 aa, Artificial Sequence
  Peptide Derived from Human Papillomavirus
SFMELIRPF

SEQ ID NO: 13672 - protein, 9 aa, Artificial Sequence
  Peptide Derived from Human Papillomavirus
SFNDTTFDL

SEQ ID NO: 13673 - protein, 9 aa, Artificial Sequence
  Peptide Derived from Human Papillomavirus
SIDVKHKAL

SEQ ID NO: 13674 - protein, 10 aa, Artificial Sequence
  Peptide Derived from Human Papillomavirus
SIDVKHKALM

SEQ ID NO: 13675 - protein, 8 aa, Artificial Sequence
  Peptide Derived from Human Papillomavirus
SLACSWGM

SEQ ID NO: 13676 - protein, 10 aa, Artificial Sequence
  Peptide Derived from Human Papillomavirus
SLACSWGMVM

SEQ ID NO: 13677 - protein, 11 aa, Artificial Sequence
  Peptide Derived from Human Papillomavirus
SLACSWGMVML

SEQ ID NO: 13678 - protein, 10 aa, Artificial Sequence
  Peptide Derived from Human Papillomavirus
SLISFLQGCI

SEQ ID NO: 13679 - protein, 11 aa, Artificial Sequence
  Peptide Derived from Human Papillomavirus
SLISFLQGCII

SEQ ID NO: 13680 - protein, 8 aa, Artificial Sequence
  Peptide Derived from Human Papillomavirus
STAAALYW

SEQ ID NO: 13681 - protein, 9 aa, Artificial Sequence
  Peptide Derived from Human Papillomavirus
STAAALYWY

SEQ ID NO: 13682 - protein, 11 aa, Artificial Sequence
  Peptide Derived from Human Papillomavirus
STCTDWCVAAF

SEQ ID NO: 13683 - protein, 11 aa, Artificial Sequence
  Peptide Derived from Human Papillomavirus
STFKCVSGQNI

SEQ ID NO: 13684 - protein, 8 aa, Artificial Sequence
  Peptide Derived from Human Papillomavirus
SWGMVMLM

SEQ ID NO: 13685 - protein, 9 aa, Artificial Sequence
  Peptide Derived from Human Papillomavirus
SWGMVMLML

SEQ ID NO: 13686 - protein, 9 aa, Artificial Sequence
  Peptide Derived from Human Papillomavirus
SYANSKSHF

SEQ ID NO: 13687 - protein, 10 aa, Artificial Sequence
  Peptide Derived from Human Papillomavirus
SYANSKSHFW

SEQ ID NO: 13688 - protein, 11 aa, Artificial Sequence
  Peptide Derived from Human Papillomavirus
SYANSKSHFWL

SEQ ID NO: 13689 - protein, 8 aa, Artificial Sequence
  Peptide Derived from Human Papillomavirus
SYFGMSLI

SEQ ID NO: 13690 - protein, 10 aa, Artificial Sequence
  Peptide Derived from Human Papillomavirus
SYFGMSLISF

SEQ ID NO: 13691 - protein, 11 aa, Artificial Sequence
  Peptide Derived from Human Papillomavirus
SYFGMSLISFL

SEQ ID NO: 13692 - protein, 10 aa, Artificial Sequence
  Peptide Derived from Human Papillomavirus
TFDLSQMVQW

SEQ ID NO: 13693 - protein, 10 aa, Artificial Sequence
  Peptide Derived from Human Papillomavirus
TFKCVSGQNI

SEQ ID NO: 13694 - protein, 8 aa, Artificial Sequence
  Peptide Derived from Human Papillomavirus
TFPNPFPF

SEQ ID NO: 13695 - protein, 9 aa, Artificial Sequence
  Peptide Derived from Human Papillomavirus
TIEKLLEKL

SEQ ID NO: 13696 - protein, 10 aa, Artificial Sequence
  Peptide Derived from Human Papillomavirus
TIEKLLEKLL

SEQ ID NO: 13697 - protein, 8 aa, Artificial Sequence
  Peptide Derived from Human Papillomavirus
TLLQPYCL

SEQ ID NO: 13698 - protein, 9 aa, Artificial Sequence
  Peptide Derived from Human Papillomavirus
TLLQPYCLY

SEQ ID NO: 13699 - protein, 8 aa, Artificial Sequence
  Peptide Derived from Human Papillomavirus
TTFDLSQM

SEQ ID NO: 13700 - protein, 11 aa, Artificial Sequence
  Peptide Derived from Human Papillomavirus
TTFDLSQMVQW

SEQ ID NO: 13701 - protein, 8 aa, Artificial Sequence
  Peptide Derived from Human Papillomavirus
TTPCWHYI

SEQ ID NO: 13702 - protein, 11 aa, Artificial Sequence
  Peptide Derived from Human Papillomavirus
TTPCWHYIDNY

SEQ ID NO: 13703 - protein, 9 aa, Artificial Sequence
  Peptide Derived from Human Papillomavirus
TVAEGFKTL

SEQ ID NO: 13704 - protein, 10 aa, Artificial Sequence
  Peptide Derived from Human Papillomavirus
TVAEGFKTLL

SEQ ID NO: 13705 - protein, 8 aa, Artificial Sequence
  Peptide Derived from Human Papillomavirus
VFTFPNPF

SEQ ID NO: 13706 - protein, 10 aa, Artificial Sequence
  Peptide Derived from Human Papillomavirus
VFTFPNPFPF

SEQ ID NO: 13707 - protein, 10 aa, Artificial Sequence
  Peptide Derived from Human Papillomavirus
VIDRQTGDNI

SEQ ID NO: 13708 - protein, 11 aa, Artificial Sequence
  Peptide Derived from Human Papillomavirus
VLKRKYVGSPL

SEQ ID NO: 13709 - protein, 11 aa, Artificial Sequence
  Peptide Derived from Human Papillomavirus
VLKTSNGKAAM

SEQ ID NO: 13710 - protein, 11 aa, Artificial Sequence
  Peptide Derived from Human Papillomavirus
VLQHSFNDTTF

SEQ ID NO: 13711 - protein, 9 aa, Artificial Sequence
  Peptide Derived from Human Papillomavirus
VMDDSEIAY

SEQ ID NO: 13712 - protein, 11 aa, Artificial Sequence
  Peptide Derived from Human Papillomavirus
VMDDSEIAYKY

SEQ ID NO: 13713 - protein, 8 aa, Artificial Sequence
  Peptide Derived from Human Papillomavirus
VMLMLVRF

SEQ ID NO: 13714 - protein, 9 aa, Artificial Sequence
  Peptide Derived from Human Papillomavirus
VTGTVAEGF

SEQ ID NO: 13715 - protein, 9 aa, Artificial Sequence
  Peptide Derived from Human Papillomavirus
VVFTFPNPF

SEQ ID NO: 13716 - protein, 11 aa, Artificial Sequence
  Peptide Derived from Human Papillomavirus
VVFTFPNPFPF

SEQ ID NO: 13717 - protein, 9 aa, Artificial Sequence
  Peptide Derived from Human Papillomavirus
VYELSDKNW

SEQ ID NO: 13718 - protein, 8 aa, Artificial Sequence
  Peptide Derived from Human Papillomavirus
VYGETPEW

SEQ ID NO: 13719 - protein, 9 aa, Artificial Sequence
  Peptide Derived from Human Papillomavirus
VYGETPEWI

SEQ ID NO: 13720 - protein, 8 aa, Artificial Sequence
  Peptide Derived from Human Papillomavirus
WFYVEAVI

SEQ ID NO: 13721 - protein, 8 aa, Artificial Sequence
  Peptide Derived from Human Papillomavirus
WIERQTVL

SEQ ID NO: 13722 - protein, 10 aa, Artificial Sequence
  Peptide Derived from Human Papillomavirus
WLQPLADAKI

SEQ ID NO: 13723 - protein, 9 aa, Artificial Sequence
  Peptide Derived from Human Papillomavirus
WYRTGMSNI

SEQ ID NO: 13724 - protein, 9 aa, Artificial Sequence
  Peptide Derived from Human Papillomavirus
YFGMSLISF

SEQ ID NO: 13725 - protein, 10 aa, Artificial Sequence
  Peptide Derived from Human Papillomavirus
YFGMSLISFL

SEQ ID NO: 13726 - protein, 10 aa, Artificial Sequence
  Peptide Derived from Human Papillomavirus
YIDNYLRNAL

SEQ ID NO: 13727 - protein, 9 aa, Artificial Sequence
  Peptide Derived from Human Papillomavirus
YLHSRLVVF

SEQ ID NO: 13728 - protein, 11 aa, Artificial Sequence
  Peptide Derived from Human Papillomavirus
YLHSRLVVFTF

SEQ ID NO: 13729 - protein, 9 aa, Artificial Sequence
  Peptide Derived from Human Papillomavirus
YVGSPLSDI

SEQ ID NO: 13730 - protein, 10 aa, Artificial Sequence
  Peptide Derived from Human Papillomavirus
YWYRTGMSNI

SEQ ID NO: 13731 - protein, 8 aa, Artificial Sequence
  Peptide Derived from Human Papillomavirus
AIELQMML

SEQ ID NO: 13732 - protein, 11 aa, Artificial Sequence
  Peptide Derived from Human Papillomavirus
AIELQMMLETL

SEQ ID NO: 13733 - protein, 8 aa, Artificial Sequence
  Peptide Derived from Human Papillomavirus
AIVTLTYI

SEQ ID NO: 13734 - protein, 9 aa, Artificial Sequence
  Peptide Derived from Human Papillomavirus
ALQAIELQM

SEQ ID NO: 13735 - protein, 10 aa, Artificial Sequence
  Peptide Derived from Human Papillomavirus
ALQAIELQMM

SEQ ID NO: 13736 - protein, 11 aa, Artificial Sequence
  Peptide Derived from Human Papillomavirus
ALQAIELQMML

SEQ ID NO: 13737 - protein, 10 aa, Artificial Sequence
  Peptide Derived from Human Papillomavirus
ALSVSKAKAL

SEQ ID NO: 13738 - protein, 8 aa, Artificial Sequence
  Peptide Derived from Human Papillomavirus
ATTPIIHL

SEQ ID NO: 13739 - protein, 10 aa, Artificial Sequence
  Peptide Derived from Human Papillomavirus
AVSCPATTPI

SEQ ID NO: 13740 - protein, 11 aa, Artificial Sequence
  Peptide Derived from Human Papillomavirus
AVSCPATTPII

SEQ ID NO: 13741 - protein, 9 aa, Artificial Sequence
  Peptide Derived from Human Papillomavirus
CLRYRLSKY

SEQ ID NO: 13742 - protein, 10 aa, Artificial Sequence
  Peptide Derived from Human Papillomavirus
CTDGKHKNAI

SEQ ID NO: 13743 - protein, 10 aa, Artificial Sequence
  Peptide Derived from Human Papillomavirus
CVLMYKAREM

SEQ ID NO: 13744 - protein, 8 aa, Artificial Sequence
  Peptide Derived from Human Papillomavirus
DFLNTVKI

SEQ ID NO: 13745 - protein, 8 aa, Artificial Sequence
  Peptide Derived from Human Papillomavirus
DVHNTMHY

SEQ ID NO: 13746 - protein, 11 aa, Artificial Sequence
  Peptide Derived from Human Papillomavirus
DVHNTMHYTNW

SEQ ID NO: 13747 - protein, 9 aa, Artificial Sequence
  Peptide Derived from Human Papillomavirus
DWTMQQTSL

SEQ ID NO: 13748 - protein, 11 aa, Artificial Sequence
  Peptide Derived from Human Papillomavirus
DWTMQQTSLEL

SEQ ID NO: 13749 - protein, 8 aa, Artificial Sequence
  Peptide Derived from Human Papillomavirus
DYWKHIRL

SEQ ID NO: 13750 - protein, 11 aa, Artificial Sequence
  Peptide Derived from Human Papillomavirus
EISFAGIVTKL

SEQ ID NO: 13751 - protein, 9 aa, Artificial Sequence
  Peptide Derived from Human Papillomavirus
ELQMMLETL

SEQ ID NO: 13752 - protein, 11 aa, Artificial Sequence
  Peptide Derived from Human Papillomavirus
ELYLTAPTGCL

SEQ ID NO: 13753 - protein, 8 aa, Artificial Sequence
  Peptide Derived from Human Papillomavirus
ETLNNTEY

SEQ ID NO: 13754 - protein, 9 aa, Artificial Sequence
  Peptide Derived from Human Papillomavirus
EVHAGGQVI

SEQ ID NO: 13755 - protein, 11 aa, Artificial Sequence
  Peptide Derived from Human Papillomavirus
EVHAGGQVIVF

SEQ ID NO: 13756 - protein, 9 aa, Artificial Sequence
  Peptide Derived from Human Papillomavirus
EYKNEDWTM

SEQ ID NO: 13757 - protein, 8 aa, Artificial Sequence
  Peptide Derived from Human Papillomavirus
FTEEAKKY

SEQ ID NO: 13758 - protein, 11 aa, Artificial Sequence
  Peptide Derived from Human Papillomavirus
FVNFTEEAKKY

SEQ ID NO: 13759 - protein, 10 aa, Artificial Sequence
  Peptide Derived from Human Papillomavirus
GIYYVHEGHI

SEQ ID NO: 13760 - protein, 8 aa, Artificial Sequence
  Peptide Derived from Human Papillomavirus
GYTVEVQF

SEQ ID NO: 13761 - protein, 8 aa, Artificial Sequence
  Peptide Derived from Human Papillomavirus
HIDYWKHI

SEQ ID NO: 13762 - protein, 10 aa, Artificial Sequence
  Peptide Derived from Human Papillomavirus
HIDYWKHIRL

SEQ ID NO: 13763 - protein, 8 aa, Artificial Sequence
  Peptide Derived from Human Papillomavirus
HIRLECVL

SEQ ID NO: 13764 - protein, 9 aa, Artificial Sequence
  Peptide Derived from Human Papillomavirus
HIRLECVLM

SEQ ID NO: 13765 - protein, 10 aa, Artificial Sequence
  Peptide Derived from Human Papillomavirus
HIRLECVLMY

SEQ ID NO: 13766 - protein, 8 aa, Artificial Sequence
  Peptide Derived from Human Papillomavirus
HITYFVNF

SEQ ID NO: 13767 - protein, 8 aa, Artificial Sequence
  Peptide Derived from Human Papillomavirus
HLKGDANI

SEQ ID NO: 13768 - protein, 9 aa, Artificial Sequence
  Peptide Derived from Human Papillomavirus
HLKGDANIL

SEQ ID NO: 13769 - protein, 9 aa, Artificial Sequence
  Peptide Derived from Human Papillomavirus
HYENDSKRL

SEQ ID NO: 13770 - protein, 8 aa, Artificial Sequence
  Peptide Derived from Human Papillomavirus
HYTNWKFI

SEQ ID NO: 13771 - protein, 9 aa, Artificial Sequence
  Peptide Derived from Human Papillomavirus
HYTNWKFIY

SEQ ID NO: 13772 - protein, 10 aa, Artificial Sequence
  Peptide Derived from Human Papillomavirus
HYTNWKFIYL

SEQ ID NO: 13773 - protein, 10 aa, Artificial Sequence
  Peptide Derived from Human Papillomavirus
IIHLKGDANI

SEQ ID NO: 13774 - protein, 11 aa, Artificial Sequence
  Peptide Derived from Human Papillomavirus
IIHLKGDANIL

SEQ ID NO: 13775 - protein, 9 aa, Artificial Sequence
  Peptide Derived from Human Papillomavirus
ILKCLRYRL

SEQ ID NO: 13776 - protein, 8 aa, Artificial Sequence
  Peptide Derived from Human Papillomavirus
IVFPESVF

SEQ ID NO: 13777 - protein, 9 aa, Artificial Sequence
  Peptide Derived from Human Papillomavirus
IYYVHEGHI

SEQ ID NO: 13778 - protein, 11 aa, Artificial Sequence
  Peptide Derived from Human Papillomavirus
IYYVHEGHITY

SEQ ID NO: 13779 - protein, 11 aa, Artificial Sequence
  Peptide Derived from Human Papillomavirus
KWEVHAGGQVI

SEQ ID NO: 13780 - protein, 8 aa, Artificial Sequence
  Peptide Derived from Human Papillomavirus
KYGTGKKW

SEQ ID NO: 13781 - protein, 8 aa, Artificial Sequence
  Peptide Derived from Human Papillomavirus
LMYKAREM

SEQ ID NO: 13782 - protein, 10 aa, Artificial Sequence
  Peptide Derived from Human Papillomavirus
LMYKAREMGI

SEQ ID NO: 13783 - protein, 8 aa, Artificial Sequence
  Peptide Derived from Human Papillomavirus
LTAPTGCL

SEQ ID NO: 13784 - protein, 9 aa, Artificial Sequence
  Peptide Derived from Human Papillomavirus
LYEQVSSTW

SEQ ID NO: 13785 - protein, 11 aa, Artificial Sequence
  Peptide Derived from Human Papillomavirus
LYEQVSSTWHW

SEQ ID NO: 13786 - protein, 10 aa, Artificial Sequence
  Peptide Derived from Human Papillomavirus
LYLTAPTGCL

SEQ ID NO: 13787 - protein, 10 aa, Artificial Sequence
  Peptide Derived from Human Papillomavirus
MLETLNNTEY

SEQ ID NO: 13788 - protein, 11 aa, Artificial Sequence
  Peptide Derived from Human Papillomavirus
MMLETLNNTEY

SEQ ID NO: 13789 - protein, 9 aa, Artificial Sequence
  Peptide Derived from Human Papillomavirus
MYKAREMGI

SEQ ID NO: 13790 - protein, 9 aa, Artificial Sequence
  Peptide Derived from Human Papillomavirus
NFTEEAKKY

SEQ ID NO: 13791 - protein, 8 aa, Artificial Sequence
  Peptide Derived from Human Papillomavirus
NILKCLRY

SEQ ID NO: 13792 - protein, 10 aa, Artificial Sequence
  Peptide Derived from Human Papillomavirus
NILKCLRYRL

SEQ ID NO: 13793 - protein, 9 aa, Artificial Sequence
  Peptide Derived from Human Papillomavirus
NTEYKNEDW

SEQ ID NO: 13794 - protein, 11 aa, Artificial Sequence
  Peptide Derived from Human Papillomavirus
NTEYKNEDWTM

SEQ ID NO: 13795 - protein, 8 aa, Artificial Sequence
  Peptide Derived from Human Papillomavirus
NTHHPNKL

SEQ ID NO: 13796 - protein, 9 aa, Artificial Sequence
  Peptide Derived from Human Papillomavirus
NTHHPNKLL

SEQ ID NO: 13797 - protein, 8 aa, Artificial Sequence
  Peptide Derived from Human Papillomavirus
NTMHYTNW

SEQ ID NO: 13798 - protein, 10 aa, Artificial Sequence
  Peptide Derived from Human Papillomavirus
NTMHYTNWKF

SEQ ID NO: 13799 - protein, 11 aa, Artificial Sequence
  Peptide Derived from Human Papillomavirus
NTMHYTNWKFI

SEQ ID NO: 13800 - protein, 9 aa, Artificial Sequence
  Peptide Derived from Human Papillomavirus
NTVSVSTGY

SEQ ID NO: 13801 - protein, 10 aa, Artificial Sequence
  Peptide Derived from Human Papillomavirus
NTVSVSTGYM

SEQ ID NO: 13802 - protein, 8 aa, Artificial Sequence
  Peptide Derived from Human Papillomavirus
NVCQDKIL

SEQ ID NO: 13803 - protein, 11 aa, Artificial Sequence
  Peptide Derived from Human Papillomavirus
NVCQDKILEHY

SEQ ID NO: 13804 - protein, 9 aa, Artificial Sequence
  Peptide Derived from Human Papillomavirus
NWKFIYLCI

SEQ ID NO: 13805 - protein, 11 aa, Artificial Sequence
  Peptide Derived from Human Papillomavirus
PIIHLKGDANI

SEQ ID NO: 13806 - protein, 10 aa, Artificial Sequence
  Peptide Derived from Human Papillomavirus
PTGCLKKHGY

SEQ ID NO: 13807 - protein, 10 aa, Artificial Sequence
  Peptide Derived from Human Papillomavirus
QFDGDVHNTM

SEQ ID NO: 13808 - protein, 10 aa, Artificial Sequence
  Peptide Derived from Human Papillomavirus
QLYEQVSSTW

SEQ ID NO: 13809 - protein, 8 aa, Artificial Sequence
  Peptide Derived from Human Papillomavirus
QTSLELYL

SEQ ID NO: 13810 - protein, 10 aa, Artificial Sequence
  Peptide Derived from Human Papillomavirus
QVIVFPESVF

SEQ ID NO: 13811 - protein, 8 aa, Artificial Sequence
  Peptide Derived from Human Papillomavirus
QVNCKGIY

SEQ ID NO: 13812 - protein, 9 aa, Artificial Sequence
  Peptide Derived from Human Papillomavirus
QVNCKGIYY

SEQ ID NO: 13813 - protein, 8 aa, Artificial Sequence
  Peptide Derived from Human Papillomavirus
QVSSTWHW

SEQ ID NO: 13814 - protein, 8 aa, Artificial Sequence
  Peptide Derived from Human Papillomavirus
RLCDHIDY

SEQ ID NO: 13815 - protein, 9 aa, Artificial Sequence
  Peptide Derived from Human Papillomavirus
RLCDHIDYW

SEQ ID NO: 13816 - protein, 8 aa, Artificial Sequence
  Peptide Derived from Human Papillomavirus
RLECVLMY

SEQ ID NO: 13817 - protein, 9 aa, Artificial Sequence
  Peptide Derived from Human Papillomavirus
RLNVCQDKI

SEQ ID NO: 13818 - protein, 10 aa, Artificial Sequence
  Peptide Derived from Human Papillomavirus
RLNVCQDKIL

SEQ ID NO: 13819 - protein, 8 aa, Artificial Sequence
  Peptide Derived from Human Papillomavirus
RLSKYKQL

SEQ ID NO: 13820 - protein, 9 aa, Artificial Sequence
  Peptide Derived from Human Papillomavirus
RLSKYKQLY

SEQ ID NO: 13821 - protein, 10 aa, Artificial Sequence
  Peptide Derived from Human Papillomavirus
RYRLSKYKQL

SEQ ID NO: 13822 - protein, 11 aa, Artificial Sequence
  Peptide Derived from Human Papillomavirus
RYRLSKYKQLY

SEQ ID NO: 13823 - protein, 9 aa, Artificial Sequence
  Peptide Derived from Human Papillomavirus
SFAGIVTKL

SEQ ID NO: 13824 - protein, 10 aa, Artificial Sequence
  Peptide Derived from Human Papillomavirus
SINHQVVPAL

SEQ ID NO: 13825 - protein, 8 aa, Artificial Sequence
  Peptide Derived from Human Papillomavirus
STSQRDDF

SEQ ID NO: 13826 - protein, 9 aa, Artificial Sequence
  Peptide Derived from Human Papillomavirus
STSQRDDFL

SEQ ID NO: 13827 - protein, 10 aa, Artificial Sequence
  Peptide Derived from Human Papillomavirus
SVDSVNCGVI

SEQ ID NO: 13828 - protein, 8 aa, Artificial Sequence
  Peptide Derived from Human Papillomavirus
SVFSSDEI

SEQ ID NO: 13829 - protein, 10 aa, Artificial Sequence
  Peptide Derived from Human Papillomavirus
SVFSSDEISF

SEQ ID NO: 13830 - protein, 8 aa, Artificial Sequence
  Peptide Derived from Human Papillomavirus
SVSKAKAL

SEQ ID NO: 13831 - protein, 11 aa, Artificial Sequence
  Peptide Derived from Human Papillomavirus
SVSKAKALQAI

SEQ ID NO: 13832 - protein, 9 aa, Artificial Sequence
  Peptide Derived from Human Papillomavirus
SVSTGYMTI

SEQ ID NO: 13833 - protein, 9 aa, Artificial Sequence
  Peptide Derived from Human Papillomavirus
TMHYTNWKF

SEQ ID NO: 13834 - protein, 10 aa, Artificial Sequence
  Peptide Derived from Human Papillomavirus
TMHYTNWKFI

SEQ ID NO: 13835 - protein, 11 aa, Artificial Sequence
  Peptide Derived from Human Papillomavirus
TMHYTNWKFIY

SEQ ID NO: 13836 - protein, 9 aa, Artificial Sequence
  Peptide Derived from Human Papillomavirus
TMQQTSLEL

SEQ ID NO: 13837 - protein, 10 aa, Artificial Sequence
  Peptide Derived from Human Papillomavirus
TMQQTSLELY

SEQ ID NO: 13838 - protein, 11 aa, Artificial Sequence
  Peptide Derived from Human Papillomavirus
TMQQTSLELYL

SEQ ID NO: 13839 - protein, 10 aa, Artificial Sequence
  Peptide Derived from Human Papillomavirus
TTSNSKTCAL

SEQ ID NO: 13840 - protein, 11 aa, Artificial Sequence
  Peptide Derived from Human Papillomavirus
TTTSNSKTCAL

SEQ ID NO: 13841 - protein, 8 aa, Artificial Sequence
  Peptide Derived from Human Papillomavirus
TVSVSTGY

SEQ ID NO: 13842 - protein, 9 aa, Artificial Sequence
  Peptide Derived from Human Papillomavirus
TVSVSTGYM

SEQ ID NO: 13843 - protein, 11 aa, Artificial Sequence
  Peptide Derived from Human Papillomavirus
TVSVSTGYMTI

SEQ ID NO: 13844 - protein, 11 aa, Artificial Sequence
  Peptide Derived from Human Papillomavirus
TYISTSQRDDF

SEQ ID NO: 13845 - protein, 9 aa, Artificial Sequence
  Peptide Derived from Human Papillomavirus
VFSSDEISF

SEQ ID NO: 13846 - protein, 9 aa, Artificial Sequence
  Peptide Derived from Human Papillomavirus
VIVFPESVF

SEQ ID NO: 13847 - protein, 9 aa, Artificial Sequence
  Peptide Derived from Human Papillomavirus
VLMYKAREM

SEQ ID NO: 13848 - protein, 11 aa, Artificial Sequence
  Peptide Derived from Human Papillomavirus
VLMYKAREMGI

SEQ ID NO: 13849 - protein, 11 aa, Artificial Sequence
  Peptide Derived from Human Papillomavirus
VVEGQVNCKGI

SEQ ID NO: 13850 - protein, 8 aa, Artificial Sequence
  Peptide Derived from Human Papillomavirus
WTMQQTSL

SEQ ID NO: 13851 - protein, 10 aa, Artificial Sequence
  Peptide Derived from Human Papillomavirus
WTMQQTSLEL

SEQ ID NO: 13852 - protein, 11 aa, Artificial Sequence
  Peptide Derived from Human Papillomavirus
WTMQQTSLELY

SEQ ID NO: 13853 - protein, 10 aa, Artificial Sequence
  Peptide Derived from Human Papillomavirus
YISTSQRDDF

SEQ ID NO: 13854 - protein, 11 aa, Artificial Sequence
  Peptide Derived from Human Papillomavirus
YISTSQRDDFL

SEQ ID NO: 13855 - protein, 9 aa, Artificial Sequence
  Peptide Derived from Human Papillomavirus
YLTAPTGCL

SEQ ID NO: 13856 - protein, 8 aa, Artificial Sequence
  Peptide Derived from Human Papillomavirus
YTNWKFIY

SEQ ID NO: 13857 - protein, 9 aa, Artificial Sequence
  Peptide Derived from Human Papillomavirus
YTNWKFIYL

SEQ ID NO: 13858 - protein, 11 aa, Artificial Sequence
  Peptide Derived from Human Papillomavirus
YTNWKFIYLCI

SEQ ID NO: 13859 - protein, 9 aa, Artificial Sequence
  Peptide Derived from Human Papillomavirus
YVHEGHITY

SEQ ID NO: 13860 - protein, 10 aa, Artificial Sequence
  Peptide Derived from Human Papillomavirus
YVHEGHITYF

SEQ ID NO: 13861 - protein, 11 aa, Artificial Sequence
  Peptide Derived from Human Papillomavirus
YWKHIRLECVL

SEQ ID NO: 13862 - protein, 8 aa, Artificial Sequence
  Peptide Derived from Human Papillomavirus
YYVHEGHI

SEQ ID NO: 13863 - protein, 10 aa, Artificial Sequence
  Peptide Derived from Human Papillomavirus
YYVHEGHITY

SEQ ID NO: 13864 - protein, 11 aa, Artificial Sequence
  Peptide Derived from Human Papillomavirus
YYVHEGHITYF

SEQ ID NO: 13865 - protein, 9 aa, Artificial Sequence
  Peptide Derived from Human Papillomavirus
ATLLLLIVI

SEQ ID NO: 13866 - protein, 10 aa, Artificial Sequence
  Peptide Derived from Human Papillomavirus
ATLLLLIVIL

SEQ ID NO: 13867 - protein, 11 aa, Artificial Sequence
  Peptide Derived from Human Papillomavirus
ATLLLLIVILW

SEQ ID NO: 13868 - protein, 8 aa, Artificial Sequence
  Peptide Derived from Human Papillomavirus
ATSPLRCF

SEQ ID NO: 13869 - protein, 10 aa, Artificial Sequence
  Peptide Derived from Human Papillomavirus
ATSPLRCFCI

SEQ ID NO: 13870 - protein, 11 aa, Artificial Sequence
  Peptide Derived from Human Papillomavirus
ATSPLRCFCIY

SEQ ID NO: 13871 - protein, 8 aa, Artificial Sequence
  Peptide Derived from Human Papillomavirus
CFCIYVVF

SEQ ID NO: 13872 - protein, 9 aa, Artificial Sequence
  Peptide Derived from Human Papillomavirus
CFCIYVVFI

SEQ ID NO: 13873 - protein, 10 aa, Artificial Sequence
  Peptide Derived from Human Papillomavirus
CFCIYVVFIY

SEQ ID NO: 13874 - protein, 11 aa, Artificial Sequence
  Peptide Derived from Human Papillomavirus
CFCIYVVFIYI

SEQ ID NO: 13875 - protein, 10 aa, Artificial Sequence
  Peptide Derived from Human Papillomavirus
CFCVLLFVCL

SEQ ID NO: 13876 - protein, 9 aa, Artificial Sequence
  Peptide Derived from Human Papillomavirus
CFLLCFCVL

SEQ ID NO: 13877 - protein, 10 aa, Artificial Sequence
  Peptide Derived from Human Papillomavirus
CFLLCFCVLL

SEQ ID NO: 13878 - protein, 11 aa, Artificial Sequence
  Peptide Derived from Human Papillomavirus
CFLLCFCVLLF

SEQ ID NO: 13879 - protein, 8 aa, Artificial Sequence
  Peptide Derived from Human Papillomavirus
CIYVVFIY

SEQ ID NO: 13880 - protein, 9 aa, Artificial Sequence
  Peptide Derived from Human Papillomavirus
CIYVVFIYI

SEQ ID NO: 13881 - protein, 11 aa, Artificial Sequence
  Peptide Derived from Human Papillomavirus
CIYVVFIYIPL

SEQ ID NO: 13882 - protein, 9 aa, Artificial Sequence
  Peptide Derived from Human Papillomavirus
CLVIRPLVL

SEQ ID NO: 13883 - protein, 8 aa, Artificial Sequence
  Peptide Derived from Human Papillomavirus
CVLLFVCL

SEQ ID NO: 13884 - protein, 10 aa, Artificial Sequence
  Peptide Derived from Human Papillomavirus
CVLLFVCLVI

SEQ ID NO: 13885 - protein, 9 aa, Artificial Sequence
  Peptide Derived from Human Papillomavirus
ELNISTVSI

SEQ ID NO: 13886 - protein, 11 aa, Artificial Sequence
  Peptide Derived from Human Papillomavirus
ELNISTVSIVL

SEQ ID NO: 13887 - protein, 9 aa, Artificial Sequence
  Peptide Derived from Human Papillomavirus
FIYIPLFVI

SEQ ID NO: 13888 - protein, 8 aa, Artificial Sequence
  Peptide Derived from Human Papillomavirus
FLLCFCVL

SEQ ID NO: 13889 - protein, 9 aa, Artificial Sequence
  Peptide Derived from Human Papillomavirus
FLLCFCVLL

SEQ ID NO: 13890 - protein, 10 aa, Artificial Sequence
  Peptide Derived from Human Papillomavirus
FLLCFCVLLF

SEQ ID NO: 13891 - protein, 9 aa, Artificial Sequence
  Peptide Derived from Human Papillomavirus
FVCLVIRPL

SEQ ID NO: 13892 - protein, 11 aa, Artificial Sequence
  Peptide Derived from Human Papillomavirus
FVCLVIRPLVL

SEQ ID NO: 13893 - protein, 9 aa, Artificial Sequence
  Peptide Derived from Human Papillomavirus
FVIHTHASF

SEQ ID NO: 13894 - protein, 10 aa, Artificial Sequence
  Peptide Derived from Human Papillomavirus
FVIHTHASFL

SEQ ID NO: 13895 - protein, 10 aa, Artificial Sequence
  Peptide Derived from Human Papillomavirus
ILWVIATSPL

SEQ ID NO: 13896 - protein, 9 aa, Artificial Sequence
  Peptide Derived from Human Papillomavirus
IVLCFLLCF

SEQ ID NO: 13897 - protein, 8 aa, Artificial Sequence
  Peptide Derived from Human Papillomavirus
IYIPLFVI

SEQ ID NO: 13898 - protein, 8 aa, Artificial Sequence
  Peptide Derived from Human Papillomavirus
IYVVFIYI

SEQ ID NO: 13899 - protein, 10 aa, Artificial Sequence
  Peptide Derived from Human Papillomavirus
IYVVFIYIPL

SEQ ID NO: 13900 - protein, 11 aa, Artificial Sequence
  Peptide Derived from Human Papillomavirus
IYVVFIYIPLF

SEQ ID NO: 13901 - protein, 10 aa, Artificial Sequence
  Peptide Derived from Human Papillomavirus
LFVCLVIRPL

SEQ ID NO: 13902 - protein, 10 aa, Artificial Sequence
  Peptide Derived from Human Papillomavirus
LFVIHTHASF

SEQ ID NO: 13903 - protein, 11 aa, Artificial Sequence
  Peptide Derived from Human Papillomavirus
LFVIHTHASFL

SEQ ID NO: 13904 - protein, 8 aa, Artificial Sequence
  Peptide Derived from Human Papillomavirus
LIVILWVI

SEQ ID NO: 13905 - protein, 8 aa, Artificial Sequence
  Peptide Derived from Human Papillomavirus
LLCFCVLL

SEQ ID NO: 13906 - protein, 9 aa, Artificial Sequence
  Peptide Derived from Human Papillomavirus
LLCFCVLLF

SEQ ID NO: 13907 - protein, 8 aa, Artificial Sequence
  Peptide Derived from Human Papillomavirus
LLFVCLVI

SEQ ID NO: 13908 - protein, 11 aa, Artificial Sequence
  Peptide Derived from Human Papillomavirus
LLFVCLVIRPL

SEQ ID NO: 13909 - protein, 9 aa, Artificial Sequence
  Peptide Derived from Human Papillomavirus
LLIVILWVI

SEQ ID NO: 13910 - protein, 8 aa, Artificial Sequence
  Peptide Derived from Human Papillomavirus
LLLIVILW

SEQ ID NO: 13911 - protein, 10 aa, Artificial Sequence
  Peptide Derived from Human Papillomavirus
LLLIVILWVI

SEQ ID NO: 13912 - protein, 8 aa, Artificial Sequence
  Peptide Derived from Human Papillomavirus
LLLLIVIL

SEQ ID NO: 13913 - protein, 9 aa, Artificial Sequence
  Peptide Derived from Human Papillomavirus
LLLLIVILW

SEQ ID NO: 13914 - protein, 11 aa, Artificial Sequence
  Peptide Derived from Human Papillomavirus
LLLLIVILWVI

SEQ ID NO: 13915 - protein, 8 aa, Artificial Sequence
  Peptide Derived from Human Papillomavirus
LVIRPLVL

SEQ ID NO: 13916 - protein, 8 aa, Artificial Sequence
  Peptide Derived from Human Papillomavirus
LVLSVSVY

SEQ ID NO: 13917 - protein, 11 aa, Artificial Sequence
  Peptide Derived from Human Papillomavirus
LVLSVSVYATL

SEQ ID NO: 13918 - protein, 9 aa, Artificial Sequence
  Peptide Derived from Human Papillomavirus
LWVIATSPL

SEQ ID NO: 13919 - protein, 11 aa, Artificial Sequence
  Peptide Derived from Human Papillomavirus
MIELNISTVSI

SEQ ID NO: 13920 - protein, 9 aa, Artificial Sequence
  Peptide Derived from Human Papillomavirus
NISTVSIVL

SEQ ID NO: 13921 - protein, 11 aa, Artificial Sequence
  Peptide Derived from Human Papillomavirus
NISTVSIVLCF

SEQ ID NO: 13922 - protein, 11 aa, Artificial Sequence
  Peptide Derived from Human Papillomavirus
PLFVIHTHASF

SEQ ID NO: 13923 - protein, 8 aa, Artificial Sequence
  Peptide Derived from Human Papillomavirus
PLRCFCIY

SEQ ID NO: 13924 - protein, 11 aa, Artificial Sequence
  Peptide Derived from Human Papillomavirus
PLRCFCIYVVF

SEQ ID NO: 13925 - protein, 9 aa, Artificial Sequence
  Peptide Derived from Human Papillomavirus
PLVLSVSVY

SEQ ID NO: 13926 - protein, 8 aa, Artificial Sequence
  Peptide Derived from Human Papillomavirus
SIVLCFLL

SEQ ID NO: 13927 - protein, 10 aa, Artificial Sequence
  Peptide Derived from Human Papillomavirus
SIVLCFLLCF

SEQ ID NO: 13928 - protein, 9 aa, Artificial Sequence
  Peptide Derived from Human Papillomavirus
STVSIVLCF

SEQ ID NO: 13929 - protein, 10 aa, Artificial Sequence
  Peptide Derived from Human Papillomavirus
STVSIVLCFL

SEQ ID NO: 13930 - protein, 11 aa, Artificial Sequence
  Peptide Derived from Human Papillomavirus
STVSIVLCFLL

SEQ ID NO: 13931 - protein, 8 aa, Artificial Sequence
  Peptide Derived from Human Papillomavirus
SVSVYATL

SEQ ID NO: 13932 - protein, 9 aa, Artificial Sequence
  Peptide Derived from Human Papillomavirus
SVSVYATLL

SEQ ID NO: 13933 - protein, 10 aa, Artificial Sequence
  Peptide Derived from Human Papillomavirus
SVSVYATLLL

SEQ ID NO: 13934 - protein, 11 aa, Artificial Sequence
  Peptide Derived from Human Papillomavirus
SVSVYATLLLL

SEQ ID NO: 13935 - protein, 8 aa, Artificial Sequence
  Peptide Derived from Human Papillomavirus
SVYATLLL

SEQ ID NO: 13936 - protein, 9 aa, Artificial Sequence
  Peptide Derived from Human Papillomavirus
SVYATLLLL

SEQ ID NO: 13937 - protein, 10 aa, Artificial Sequence
  Peptide Derived from Human Papillomavirus
SVYATLLLLI

SEQ ID NO: 13938 - protein, 8 aa, Artificial Sequence
  Peptide Derived from Human Papillomavirus
TLLLLIVI

SEQ ID NO: 13939 - protein, 9 aa, Artificial Sequence
  Peptide Derived from Human Papillomavirus
TLLLLIVIL

SEQ ID NO: 13940 - protein, 10 aa, Artificial Sequence
  Peptide Derived from Human Papillomavirus
TLLLLIVILW

SEQ ID NO: 13941 - protein, 8 aa, Artificial Sequence
  Peptide Derived from Human Papillomavirus
TVSIVLCF

SEQ ID NO: 13942 - protein, 9 aa, Artificial Sequence
  Peptide Derived from Human Papillomavirus
TVSIVLCFL

SEQ ID NO: 13943 - protein, 10 aa, Artificial Sequence
  Peptide Derived from Human Papillomavirus
TVSIVLCFLL

SEQ ID NO: 13944 - protein, 8 aa, Artificial Sequence
  Peptide Derived from Human Papillomavirus
VFIYIPLF

SEQ ID NO: 13945 - protein, 10 aa, Artificial Sequence
  Peptide Derived from Human Papillomavirus
VFIYIPLFVI

SEQ ID NO: 13946 - protein, 10 aa, Artificial Sequence
  Peptide Derived from Human Papillomavirus
VIATSPLRCF

SEQ ID NO: 13947 - protein, 8 aa, Artificial Sequence
  Peptide Derived from Human Papillomavirus
VIHTHASF

SEQ ID NO: 13948 - protein, 9 aa, Artificial Sequence
  Peptide Derived from Human Papillomavirus
VIHTHASFL

SEQ ID NO: 13949 - protein, 11 aa, Artificial Sequence
  Peptide Derived from Human Papillomavirus
VILWVIATSPL

SEQ ID NO: 13950 - protein, 8 aa, Artificial Sequence
  Peptide Derived from Human Papillomavirus
VLCFLLCF

SEQ ID NO: 13951 - protein, 11 aa, Artificial Sequence
  Peptide Derived from Human Papillomavirus
VLCFLLCFCVL

SEQ ID NO: 13952 - protein, 9 aa, Artificial Sequence
  Peptide Derived from Human Papillomavirus
VLLFVCLVI

SEQ ID NO: 13953 - protein, 10 aa, Artificial Sequence
  Peptide Derived from Human Papillomavirus
VLSVSVYATL

SEQ ID NO: 13954 - protein, 11 aa, Artificial Sequence
  Peptide Derived from Human Papillomavirus
VLSVSVYATLL

SEQ ID NO: 13955 - protein, 8 aa, Artificial Sequence
  Peptide Derived from Human Papillomavirus
VVFIYIPL

SEQ ID NO: 13956 - protein, 9 aa, Artificial Sequence
  Peptide Derived from Human Papillomavirus
VVFIYIPLF

SEQ ID NO: 13957 - protein, 11 aa, Artificial Sequence
  Peptide Derived from Human Papillomavirus
VVFIYIPLFVI

SEQ ID NO: 13958 - protein, 8 aa, Artificial Sequence
  Peptide Derived from Human Papillomavirus
VYATLLLL

SEQ ID NO: 13959 - protein, 9 aa, Artificial Sequence
  Peptide Derived from Human Papillomavirus
VYATLLLLI

SEQ ID NO: 13960 - protein, 11 aa, Artificial Sequence
  Peptide Derived from Human Papillomavirus
VYATLLLLIVI

SEQ ID NO: 13961 - protein, 8 aa, Artificial Sequence
  Peptide Derived from Human Papillomavirus
WVIATSPL

SEQ ID NO: 13962 - protein, 11 aa, Artificial Sequence
  Peptide Derived from Human Papillomavirus
WVIATSPLRCF

SEQ ID NO: 13963 - protein, 9 aa, Artificial Sequence
  Peptide Derived from Human Papillomavirus
YVVFIYIPL

SEQ ID NO: 13964 - protein, 10 aa, Artificial Sequence
  Peptide Derived from Human Papillomavirus
YVVFIYIPLF

SEQ ID NO: 13965 - protein, 9 aa, Artificial Sequence
  Peptide Derived from Human Papillomavirus
AFTDLTIVY

SEQ ID NO: 13966 - protein, 9 aa, Artificial Sequence
  Peptide Derived from Human Papillomavirus
ALEIPYDEL

SEQ ID NO: 13967 - protein, 11 aa, Artificial Sequence
  Peptide Derived from Human Papillomavirus
ALEIPYDELRL

SEQ ID NO: 13968 - protein, 8 aa, Artificial Sequence
  Peptide Derived from Human Papillomavirus
CITCQRPL

SEQ ID NO: 13969 - protein, 11 aa, Artificial Sequence
  Peptide Derived from Human Papillomavirus
CLRFYSKVSEF

SEQ ID NO: 13970 - protein, 8 aa, Artificial Sequence
  Peptide Derived from Human Papillomavirus
CTKCLRFY

SEQ ID NO: 13971 - protein, 8 aa, Artificial Sequence
  Peptide Derived from Human Papillomavirus
CVYCKGQL

SEQ ID NO: 13972 - protein, 9 aa, Artificial Sequence
  Peptide Derived from Human Papillomavirus
DFAFTDLTI

SEQ ID NO: 13973 - protein, 11 aa, Artificial Sequence
  Peptide Derived from Human Papillomavirus
DFAFTDLTIVY

SEQ ID NO: 13974 - protein, 11 aa, Artificial Sequence
  Peptide Derived from Human Papillomavirus
DTPHGVCTKCL

SEQ ID NO: 13975 - protein, 10 aa, Artificial Sequence
  Peptide Derived from Human Papillomavirus
EFRWYRYSVY

SEQ ID NO: 13976 - protein, 9 aa, Artificial Sequence
  Peptide Derived from Human Papillomavirus
EIPYDELRL

SEQ ID NO: 13977 - protein, 8 aa, Artificial Sequence
  Peptide Derived from Human Papillomavirus
ELRLNCVY

SEQ ID NO: 13978 - protein, 8 aa, Artificial Sequence
  Peptide Derived from Human Papillomavirus
ELSSALEI

SEQ ID NO: 13979 - protein, 10 aa, Artificial Sequence
  Peptide Derived from Human Papillomavirus
ELSSALEIPY

SEQ ID NO: 13980 - protein, 9 aa, Artificial Sequence
  Peptide Derived from Human Papillomavirus
ETEVLDFAF

SEQ ID NO: 13981 - protein, 10 aa, Artificial Sequence
  Peptide Derived from Human Papillomavirus
EVLDFAFTDL

SEQ ID NO: 13982 - protein, 8 aa, Artificial Sequence
  Peptide Derived from Human Papillomavirus
FTDLTIVY

SEQ ID NO: 13983 - protein, 8 aa, Artificial Sequence
  Peptide Derived from Human Papillomavirus
FYSKVSEF

SEQ ID NO: 13984 - protein, 10 aa, Artificial Sequence
  Peptide Derived from Human Papillomavirus
FYSKVSEFRW

SEQ ID NO: 13985 - protein, 11 aa, Artificial Sequence
  Peptide Derived from Human Papillomavirus
FYSKVSEFRWY

SEQ ID NO: 13986 - protein, 10 aa, Artificial Sequence
  Peptide Derived from Human Papillomavirus
GICDLLIRCI

SEQ ID NO: 13987 - protein, 9 aa, Artificial Sequence
  Peptide Derived from Human Papillomavirus
GVCTKCLRF

SEQ ID NO: 13988 - protein, 10 aa, Artificial Sequence
  Peptide Derived from Human Papillomavirus
GVCTKCLRFY

SEQ ID NO: 13989 - protein, 8 aa, Artificial Sequence
  Peptide Derived from Human Papillomavirus
HLDKKKRF

SEQ ID NO: 13990 - protein, 11 aa, Artificial Sequence
  Peptide Derived from Human Papillomavirus
HLDKKKRFHNI

SEQ ID NO: 13991 - protein, 9 aa, Artificial Sequence
  Peptide Derived from Human Papillomavirus
KLHELSSAL

SEQ ID NO: 13992 - protein, 11 aa, Artificial Sequence
  Peptide Derived from Human Papillomavirus
KLHELSSALEI

SEQ ID NO: 13993 - protein, 10 aa, Artificial Sequence
  Peptide Derived from Human Papillomavirus
KLTNKGICDL

SEQ ID NO: 13994 - protein, 11 aa, Artificial Sequence
  Peptide Derived from Human Papillomavirus
KLTNKGICDLL

SEQ ID NO: 13995 - protein, 8 aa, Artificial Sequence
  Peptide Derived from Human Papillomavirus
KVSEFRWY

SEQ ID NO: 13996 - protein, 10 aa, Artificial Sequence
  Peptide Derived from Human Papillomavirus
KVSEFRWYRY

SEQ ID NO: 13997 - protein, 11 aa, Artificial Sequence
  Peptide Derived from Human Papillomavirus
LIRCITCQRPL

SEQ ID NO: 13998 - protein, 9 aa, Artificial Sequence
  Peptide Derived from Human Papillomavirus
LTETEVLDF

SEQ ID NO: 13999 - protein, 11 aa, Artificial Sequence
  Peptide Derived from Human Papillomavirus
LTETEVLDFAF

SEQ ID NO: 14000 - protein, 9 aa, Artificial Sequence
  Peptide Derived from Human Papillomavirus
LTNKGICDL

SEQ ID NO: 14001 - protein, 10 aa, Artificial Sequence
  Peptide Derived from Human Papillomavirus
LTNKGICDLL

SEQ ID NO: 14002 - protein, 11 aa, Artificial Sequence
  Peptide Derived from Human Papillomavirus
LTNKGICDLLI

SEQ ID NO: 14003 - protein, 11 aa, Artificial Sequence
  Peptide Derived from Human Papillomavirus
NIGGRWTGRCI

SEQ ID NO: 14004 - protein, 11 aa, Artificial Sequence
  Peptide Derived from Human Papillomavirus
PLCPEEKQRHL

SEQ ID NO: 14005 - protein, 11 aa, Artificial Sequence
  Peptide Derived from Human Papillomavirus
PYDELRLNCVY

SEQ ID NO: 14006 - protein, 8 aa, Artificial Sequence
  Peptide Derived from Human Papillomavirus
QLTETEVL

SEQ ID NO: 14007 - protein, 10 aa, Artificial Sequence
  Peptide Derived from Human Papillomavirus
QLTETEVLDF

SEQ ID NO: 14008 - protein, 9 aa, Artificial Sequence
  Peptide Derived from Human Papillomavirus
RFHNIGGRW

SEQ ID NO: 14009 - protein, 9 aa, Artificial Sequence
  Peptide Derived from Human Papillomavirus
RFYSKVSEF

SEQ ID NO: 14010 - protein, 11 aa, Artificial Sequence
  Peptide Derived from Human Papillomavirus
RFYSKVSEFRW

SEQ ID NO: 14011 - protein, 11 aa, Artificial Sequence
  Peptide Derived from Human Papillomavirus
RLNCVYCKGQL

SEQ ID NO: 14012 - protein, 10 aa, Artificial Sequence
  Peptide Derived from Human Papillomavirus
RWTGRCIACW

SEQ ID NO: 14013 - protein, 8 aa, Artificial Sequence
  Peptide Derived from Human Papillomavirus
RWYRYSVY

SEQ ID NO: 14014 - protein, 9 aa, Artificial Sequence
  Peptide Derived from Human Papillomavirus
RYSVYGTTL

SEQ ID NO: 14015 - protein, 10 aa, Artificial Sequence
  Peptide Derived from Human Papillomavirus
SVYGTTLEKL

SEQ ID NO: 14016 - protein, 10 aa, Artificial Sequence
  Peptide Derived from Human Papillomavirus
TLEKLTNKGI

SEQ ID NO: 14017 - protein, 11 aa, Artificial Sequence
  Peptide Derived from Human Papillomavirus
TTLEKLTNKGI

SEQ ID NO: 14018 - protein, 9 aa, Artificial Sequence
  Peptide Derived from Human Papillomavirus
VLDFAFTDL

SEQ ID NO: 14019 - protein, 11 aa, Artificial Sequence
  Peptide Derived from Human Papillomavirus
VLDFAFTDLTI

SEQ ID NO: 14020 - protein, 9 aa, Artificial Sequence
  Peptide Derived from Human Papillomavirus
VYGTTLEKL

SEQ ID NO: 14021 - protein, 9 aa, Artificial Sequence
  Peptide Derived from Human Papillomavirus
WTGRCIACW

SEQ ID NO: 14022 - protein, 11 aa, Artificial Sequence
  Peptide Derived from Human Papillomavirus
WYRYSVYGTTL

SEQ ID NO: 14023 - protein, 10 aa, Artificial Sequence
  Peptide Derived from Human Papillomavirus
ATDLHCYEQL

SEQ ID NO: 14024 - protein, 9 aa, Artificial Sequence
  Peptide Derived from Human Papillomavirus
CVQSTQVDI

SEQ ID NO: 14025 - protein, 11 aa, Artificial Sequence
  Peptide Derived from Human Papillomavirus
CVQSTQVDIRI

SEQ ID NO: 14026 - protein, 8 aa, Artificial Sequence
  Peptide Derived from Human Papillomavirus
DIRILQEL

SEQ ID NO: 14027 - protein, 9 aa, Artificial Sequence
  Peptide Derived from Human Papillomavirus
DIRILQELL

SEQ ID NO: 14028 - protein, 10 aa, Artificial Sequence
  Peptide Derived from Human Papillomavirus
DIRILQELLM

SEQ ID NO: 14029 - protein, 8 aa, Artificial Sequence
  Peptide Derived from Human Papillomavirus
DLHCYEQL

SEQ ID NO: 14030 - protein, 9 aa, Artificial Sequence
  Peptide Derived from Human Papillomavirus
DLQPEATDL

SEQ ID NO: 14031 - protein, 10 aa, Artificial Sequence
  Peptide Derived from Human Papillomavirus
DTSNYNIVTF

SEQ ID NO: 14032 - protein, 9 aa, Artificial Sequence
  Peptide Derived from Human Papillomavirus
ELLMGSFGI

SEQ ID NO: 14033 - protein, 8 aa, Artificial Sequence
  Peptide Derived from Human Papillomavirus
ETPTLQDY

SEQ ID NO: 14034 - protein, 10 aa, Artificial Sequence
  Peptide Derived from Human Papillomavirus
ETPTLQDYVL

SEQ ID NO: 14035 - protein, 11 aa, Artificial Sequence
  Peptide Derived from Human Papillomavirus
GIVCPNCSTRL

SEQ ID NO: 14036 - protein, 10 aa, Artificial Sequence
  Peptide Derived from Human Papillomavirus
ILQELLMGSF

SEQ ID NO: 14037 - protein, 10 aa, Artificial Sequence
  Peptide Derived from Human Papillomavirus
IVCPNCSTRL

SEQ ID NO: 14038 - protein, 8 aa, Artificial Sequence
  Peptide Derived from Human Papillomavirus
LLMGSFGI

SEQ ID NO: 14039 - protein, 8 aa, Artificial Sequence
  Peptide Derived from Human Papillomavirus
PTLQDYVL

SEQ ID NO: 14040 - protein, 10 aa, Artificial Sequence
  Peptide Derived from Human Papillomavirus
PTLQDYVLDL

SEQ ID NO: 14041 - protein, 10 aa, Artificial Sequence
  Peptide Derived from Human Papillomavirus
QVDIRILQEL

SEQ ID NO: 14042 - protein, 11 aa, Artificial Sequence
  Peptide Derived from Human Papillomavirus
QVDIRILQELL

SEQ ID NO: 14043 - protein, 8 aa, Artificial Sequence
  Peptide Derived from Human Papillomavirus
RILQELLM

SEQ ID NO: 14044 - protein, 11 aa, Artificial Sequence
  Peptide Derived from Human Papillomavirus
RILQELLMGSF

SEQ ID NO: 14045 - protein, 11 aa, Artificial Sequence
  Peptide Derived from Human Papillomavirus
RLCVQSTQVDI

SEQ ID NO: 14046 - protein, 8 aa, Artificial Sequence
  Peptide Derived from Human Papillomavirus
STQVDIRI

SEQ ID NO: 14047 - protein, 9 aa, Artificial Sequence
  Peptide Derived from Human Papillomavirus
STQVDIRIL

SEQ ID NO: 14048 - protein, 10 aa, Artificial Sequence
  Peptide Derived from Human Papillomavirus
TFCCQCKSTL

SEQ ID NO: 14049 - protein, 9 aa, Artificial Sequence
  Peptide Derived from Human Papillomavirus
TLQDYVLDL

SEQ ID NO: 14050 - protein, 11 aa, Artificial Sequence
  Peptide Derived from Human Papillomavirus
VLDLQPEATDL

SEQ ID NO: 14051 - protein, 11 aa, Artificial Sequence
  Peptide Derived from Human Papillomavirus
VTFCCQCKSTL

SEQ ID NO: 14052 - protein, 9 aa, Artificial Sequence
  Peptide Derived from Human Papillomavirus
AIANSDTTF

SEQ ID NO: 14053 - protein, 8 aa, Artificial Sequence
  Peptide Derived from Human Papillomavirus
AILEDWNF

SEQ ID NO: 14054 - protein, 10 aa, Artificial Sequence
  Peptide Derived from Human Papillomavirus
AILEDWNFGL

SEQ ID NO: 14055 - protein, 10 aa, Artificial Sequence
  Peptide Derived from Human Papillomavirus
AITPGDCPPL

SEQ ID NO: 14056 - protein, 11 aa, Artificial Sequence
  Peptide Derived from Human Papillomavirus
ALQDTKSNVPL

SEQ ID NO: 14057 - protein, 8 aa, Artificial Sequence
  Peptide Derived from Human Papillomavirus
ATLANSTY

SEQ ID NO: 14058 - protein, 9 aa, Artificial Sequence
  Peptide Derived from Human Papillomavirus
ATLANSTYF

SEQ ID NO: 14059 - protein, 11 aa, Artificial Sequence
  Peptide Derived from Human Papillomavirus
CISMDYKQTQL

SEQ ID NO: 14060 - protein, 9 aa, Artificial Sequence
  Peptide Derived from Human Papillomavirus
CLLGCKPPI

SEQ ID NO: 14061 - protein, 9 aa, Artificial Sequence
  Peptide Derived from Human Papillomavirus
DICNSICKY

SEQ ID NO: 14062 - protein, 9 aa, Artificial Sequence
  Peptide Derived from Human Papillomavirus
DIMTYIHSM

SEQ ID NO: 14063 - protein, 11 aa, Artificial Sequence
  Peptide Derived from Human Papillomavirus
DLDQFPLGRKF

SEQ ID NO: 14064 - protein, 8 aa, Artificial Sequence
  Peptide Derived from Human Papillomavirus
DLQFIFQL

SEQ ID NO: 14065 - protein, 11 aa, Artificial Sequence
  Peptide Derived from Human Papillomavirus
DLQFIFQLCKI

SEQ ID NO: 14066 - protein, 10 aa, Artificial Sequence
  Peptide Derived from Human Papillomavirus
DMVDTGFGAM

SEQ ID NO: 14067 - protein, 8 aa, Artificial Sequence
  Peptide Derived from Human Papillomavirus
DTENSNRY

SEQ ID NO: 14068 - protein, 9 aa, Artificial Sequence
  Peptide Derived from Human Papillomavirus
DTGFGAMDF

SEQ ID NO: 14069 - protein, 8 aa, Artificial Sequence
  Peptide Derived from Human Papillomavirus
DTKSNVPL

SEQ ID NO: 14070 - protein, 10 aa, Artificial Sequence
  Peptide Derived from Human Papillomavirus
DTKSNVPLDI

SEQ ID NO: 14071 - protein, 9 aa, Artificial Sequence
  Peptide Derived from Human Papillomavirus
DTTFKSSNF

SEQ ID NO: 14072 - protein, 8 aa, Artificial Sequence
  Peptide Derived from Human Papillomavirus
DTTRSTNM

SEQ ID NO: 14073 - protein, 11 aa, Artificial Sequence
  Peptide Derived from Human Papillomavirus
DTYRFVTSQAI

SEQ ID NO: 14074 - protein, 9 aa, Artificial Sequence
  Peptide Derived from Human Papillomavirus
DYKQTQLCL

SEQ ID NO: 14075 - protein, 10 aa, Artificial Sequence
  Peptide Derived from Human Papillomavirus
DYKQTQLCLL

SEQ ID NO: 14076 - protein, 10 aa, Artificial Sequence
  Peptide Derived from Human Papillomavirus
DYLKMVAEPY

SEQ ID NO: 14077 - protein, 9 aa, Artificial Sequence
  Peptide Derived from Human Papillomavirus
DYVFWEVNL

SEQ ID NO: 14078 - protein, 8 aa, Artificial Sequence
  Peptide Derived from Human Papillomavirus
EFDLQFIF

SEQ ID NO: 14079 - protein, 10 aa, Artificial Sequence
  Peptide Derived from Human Papillomavirus
EFDLQFIFQL

SEQ ID NO: 14080 - protein, 8 aa, Artificial Sequence
  Peptide Derived from Human Papillomavirus
EVGRGQPL

SEQ ID NO: 14081 - protein, 8 aa, Artificial Sequence
  Peptide Derived from Human Papillomavirus
EVNLKEKF

SEQ ID NO: 14082 - protein, 9 aa, Artificial Sequence
  Peptide Derived from Human Papillomavirus
EYLRHGEEF

SEQ ID NO: 14083 - protein, 11 aa, Artificial Sequence
  Peptide Derived from Human Papillomavirus
EYLRHGEEFDL

SEQ ID NO: 14084 - protein, 8 aa, Artificial Sequence
  Peptide Derived from Human Papillomavirus
EYVTRTNI

SEQ ID NO: 14085 - protein, 9 aa, Artificial Sequence
  Peptide Derived from Human Papillomavirus
EYVTRTNIY

SEQ ID NO: 14086 - protein, 10 aa, Artificial Sequence
  Peptide Derived from Human Papillomavirus
EYVTRTNIYY

SEQ ID NO: 14087 - protein, 9 aa, Artificial Sequence
  Peptide Derived from Human Papillomavirus
FFYLRREQM

SEQ ID NO: 14088 - protein, 10 aa, Artificial Sequence
  Peptide Derived from Human Papillomavirus
FFYLRREQMF

SEQ ID NO: 14089 - protein, 8 aa, Artificial Sequence
  Peptide Derived from Human Papillomavirus
FIFQLCKI

SEQ ID NO: 14090 - protein, 10 aa, Artificial Sequence
  Peptide Derived from Human Papillomavirus
FIFQLCKITL

SEQ ID NO: 14091 - protein, 10 aa, Artificial Sequence
  Peptide Derived from Human Papillomavirus
FWEVNLKEKF

SEQ ID NO: 14092 - protein, 8 aa, Artificial Sequence
  Peptide Derived from Human Papillomavirus
FYLRREQM

SEQ ID NO: 14093 - protein, 9 aa, Artificial Sequence
  Peptide Derived from Human Papillomavirus
FYLRREQMF

SEQ ID NO: 14094 - protein, 9 aa, Artificial Sequence
  Peptide Derived from Human Papillomavirus
FYNPETQRL

SEQ ID NO: 14095 - protein, 11 aa, Artificial Sequence
  Peptide Derived from Human Papillomavirus
FYNPETQRLVW

SEQ ID NO: 14096 - protein, 10 aa, Artificial Sequence
  Peptide Derived from Human Papillomavirus
GFGAMDFTAL

SEQ ID NO: 14097 - protein, 8 aa, Artificial Sequence
  Peptide Derived from Human Papillomavirus
GFPDTSFY

SEQ ID NO: 14098 - protein, 8 aa, Artificial Sequence
  Peptide Derived from Human Papillomavirus
GICWGNQL

SEQ ID NO: 14099 - protein, 9 aa, Artificial Sequence
  Peptide Derived from Human Papillomavirus
GICWGNQLF

SEQ ID NO: 14100 - protein, 8 aa, Artificial Sequence
  Peptide Derived from Human Papillomavirus
GISGHPLL

SEQ ID NO: 14101 - protein, 11 aa, Artificial Sequence
  Peptide Derived from Human Papillomavirus
GISGHPLLNKF

SEQ ID NO: 14102 - protein, 10 aa, Artificial Sequence
  Peptide Derived from Human Papillomavirus
GLEVGRGQPL

SEQ ID NO: 14103 - protein, 11 aa, Artificial Sequence
  Peptide Derived from Human Papillomavirus
GLQYRVFRVRL

SEQ ID NO: 14104 - protein, 10 aa, Artificial Sequence
  Peptide Derived from Human Papillomavirus
GLTTPPSGSL

SEQ ID NO: 14105 - protein, 8 aa, Artificial Sequence
  Peptide Derived from Human Papillomavirus
GTDNRECI

SEQ ID NO: 14106 - protein, 10 aa, Artificial Sequence
  Peptide Derived from Human Papillomavirus
GTDNRECISM

SEQ ID NO: 14107 - protein, 11 aa, Artificial Sequence
  Peptide Derived from Human Papillomavirus
GTVGESVPTDL

SEQ ID NO: 14108 - protein, 9 aa, Artificial Sequence
  Peptide Derived from Human Papillomavirus
GVGISGHPL

SEQ ID NO: 14109 - protein, 10 aa, Artificial Sequence
  Peptide Derived from Human Papillomavirus
GVGISGHPLL

SEQ ID NO: 14110 - protein, 8 aa, Artificial Sequence
  Peptide Derived from Human Papillomavirus
GYRARPKF

SEQ ID NO: 14111 - protein, 8 aa, Artificial Sequence
  Peptide Derived from Human Papillomavirus
IFNKPYWM

SEQ ID NO: 14112 - protein, 9 aa, Artificial Sequence
  Peptide Derived from Human Papillomavirus
IFQLCKITL

SEQ ID NO: 14113 - protein, 9 aa, Artificial Sequence
  Peptide Derived from Human Papillomavirus
ILEDWNFGL

SEQ ID NO: 14114 - protein, 8 aa, Artificial Sequence
  Peptide Derived from Human Papillomavirus
IMTYIHSM

SEQ ID NO: 14115 - protein, 8 aa, Artificial Sequence
  Peptide Derived from Human Papillomavirus
ITLSADIM

SEQ ID NO: 14116 - protein, 10 aa, Artificial Sequence
  Peptide Derived from Human Papillomavirus
ITLSADIMTY

SEQ ID NO: 14117 - protein, 11 aa, Artificial Sequence
  Peptide Derived from Human Papillomavirus
ITLSADIMTYI

SEQ ID NO: 14118 - protein, 9 aa, Artificial Sequence
  Peptide Derived from Human Papillomavirus
ITPGDCPPL

SEQ ID NO: 14119 - protein, 11 aa, Artificial Sequence
  Peptide Derived from Human Papillomavirus
ITPGDCPPLEL

SEQ ID NO: 14120 - protein, 9 aa, Artificial Sequence
  Peptide Derived from Human Papillomavirus
IVVPKVSGL

SEQ ID NO: 14121 - protein, 11 aa, Artificial Sequence
  Peptide Derived from Human Papillomavirus
IVVPKVSGLQY

SEQ ID NO: 14122 - protein, 10 aa, Artificial Sequence
  Peptide Derived from Human Papillomavirus
IYYHAGSARL

SEQ ID NO: 14123 - protein, 11 aa, Artificial Sequence
  Peptide Derived from Human Papillomavirus
IYYHAGSARLL

SEQ ID NO: 14124 - protein, 11 aa, Artificial Sequence
  Peptide Derived from Human Papillomavirus
KFDDTENSNRY

SEQ ID NO: 14125 - protein, 9 aa, Artificial Sequence
  Peptide Derived from Human Papillomavirus
KFGFPDTSF

SEQ ID NO: 14126 - protein, 10 aa, Artificial Sequence
  Peptide Derived from Human Papillomavirus
KFGFPDTSFY

SEQ ID NO: 14127 - protein, 8 aa, Artificial Sequence
  Peptide Derived from Human Papillomavirus
KFLLQAGY

SEQ ID NO: 14128 - protein, 9 aa, Artificial Sequence
  Peptide Derived from Human Papillomavirus
KFSADLDQF

SEQ ID NO: 14129 - protein, 11 aa, Artificial Sequence
  Peptide Derived from Human Papillomavirus
KFSADLDQFPL

SEQ ID NO: 14130 - protein, 8 aa, Artificial Sequence
  Peptide Derived from Human Papillomavirus
KITLSADI

SEQ ID NO: 14131 - protein, 9 aa, Artificial Sequence
  Peptide Derived from Human Papillomavirus
KITLSADIM

SEQ ID NO: 14132 - protein, 11 aa, Artificial Sequence
  Peptide Derived from Human Papillomavirus
KITLSADIMTY

SEQ ID NO: 14133 - protein, 10 aa, Artificial Sequence
  Peptide Derived from Human Papillomavirus
KIVVPKVSGL

SEQ ID NO: 14134 - protein, 11 aa, Artificial Sequence
  Peptide Derived from Human Papillomavirus
KMVAEPYGDTL

SEQ ID NO: 14135 - protein, 10 aa, Artificial Sequence
  Peptide Derived from Human Papillomavirus
KVSGLQYRVF

SEQ ID NO: 14136 - protein, 8 aa, Artificial Sequence
  Peptide Derived from Human Papillomavirus
KVVSTDEY

SEQ ID NO: 14137 - protein, 8 aa, Artificial Sequence
  Peptide Derived from Human Papillomavirus
KYPDYLKM

SEQ ID NO: 14138 - protein, 10 aa, Artificial Sequence
  Peptide Derived from Human Papillomavirus
LFFYLRREQM

SEQ ID NO: 14139 - protein, 11 aa, Artificial Sequence
  Peptide Derived from Human Papillomavirus
LFFYLRREQMF

SEQ ID NO: 14140 - protein, 8 aa, Artificial Sequence
  Peptide Derived from Human Papillomavirus
LLGCKPPI

SEQ ID NO: 14141 - protein, 8 aa, Artificial Sequence
  Peptide Derived from Human Papillomavirus
LLTVGHPY

SEQ ID NO: 14142 - protein, 9 aa, Artificial Sequence
  Peptide Derived from Human Papillomavirus
LLTVGHPYY

SEQ ID NO: 14143 - protein, 11 aa, Artificial Sequence
  Peptide Derived from Human Papillomavirus
LLTVGHPYYSI

SEQ ID NO: 14144 - protein, 9 aa, Artificial Sequence
  Peptide Derived from Human Papillomavirus
LTTPPSGSL

SEQ ID NO: 14145 - protein, 8 aa, Artificial Sequence
  Peptide Derived from Human Papillomavirus
LTVGHPYY

SEQ ID NO: 14146 - protein, 10 aa, Artificial Sequence
  Peptide Derived from Human Papillomavirus
LTVGHPYYSI

SEQ ID NO: 14147 - protein, 8 aa, Artificial Sequence
  Peptide Derived from Human Papillomavirus
LVWACVGL

SEQ ID NO: 14148 - protein, 10 aa, Artificial Sequence
  Peptide Derived from Human Papillomavirus
LWRPSEATVY

SEQ ID NO: 14149 - protein, 11 aa, Artificial Sequence
  Peptide Derived from Human Papillomavirus
LWRPSEATVYL

SEQ ID NO: 14150 - protein, 11 aa, Artificial Sequence
  Peptide Derived from Human Papillomavirus
MTYIHSMNPAI

SEQ ID NO: 14151 - protein, 10 aa, Artificial Sequence
  Peptide Derived from Human Papillomavirus
MVAEPYGDTL

SEQ ID NO: 14152 - protein, 11 aa, Artificial Sequence
  Peptide Derived from Human Papillomavirus
MVAEPYGDTLF

SEQ ID NO: 14153 - protein, 9 aa, Artificial Sequence
  Peptide Derived from Human Papillomavirus
MVDTGFGAM

SEQ ID NO: 14154 - protein, 11 aa, Artificial Sequence
  Peptide Derived from Human Papillomavirus
MVDTGFGAMDF

SEQ ID NO: 14155 - protein, 8 aa, Artificial Sequence
  Peptide Derived from Human Papillomavirus
MVTSDAQI

SEQ ID NO: 14156 - protein, 9 aa, Artificial Sequence
  Peptide Derived from Human Papillomavirus
MVTSDAQIF

SEQ ID NO: 14157 - protein, 11 aa, Artificial Sequence
  Peptide Derived from Human Papillomavirus
NIYYHAGSARL

SEQ ID NO: 14158 - protein, 10 aa, Artificial Sequence
  Peptide Derived from Human Papillomavirus
NLKEKFSADL

SEQ ID NO: 14159 - protein, 8 aa, Artificial Sequence
  Peptide Derived from Human Papillomavirus
NMSVCAAI

SEQ ID NO: 14160 - protein, 10 aa, Artificial Sequence
  Peptide Derived from Human Papillomavirus
NVPLDICNSI

SEQ ID NO: 14161 - protein, 8 aa, Artificial Sequence
  Peptide Derived from Human Papillomavirus
PFKDYVFW

SEQ ID NO: 14162 - protein, 8 aa, Artificial Sequence
  Peptide Derived from Human Papillomavirus
PLDICNSI

SEQ ID NO: 14163 - protein, 11 aa, Artificial Sequence
  Peptide Derived from Human Papillomavirus
PLDICNSICKY

SEQ ID NO: 14164 - protein, 9 aa, Artificial Sequence
  Peptide Derived from Human Papillomavirus
PLELKNSVI

SEQ ID NO: 14165 - protein, 8 aa, Artificial Sequence
  Peptide Derived from Human Papillomavirus
PLGRKFLL

SEQ ID NO: 14166 - protein, 11 aa, Artificial Sequence
  Peptide Derived from Human Papillomavirus
PLGVGISGHPL

SEQ ID NO: 14167 - protein, 11 aa, Artificial Sequence
  Peptide Derived from Human Papillomavirus
PVSKVVSTDEY

SEQ ID NO: 14168 - protein, 8 aa, Artificial Sequence
  Peptide Derived from Human Papillomavirus
PYGDTLFF

SEQ ID NO: 14169 - protein, 9 aa, Artificial Sequence
  Peptide Derived from Human Papillomavirus
PYGDTLFFY

SEQ ID NO: 14170 - protein, 10 aa, Artificial Sequence
  Peptide Derived from Human Papillomavirus
PYGDTLFFYL

SEQ ID NO: 14171 - protein, 9 aa, Artificial Sequence
  Peptide Derived from Human Papillomavirus
QFIFQLCKI

SEQ ID NO: 14172 - protein, 11 aa, Artificial Sequence
  Peptide Derived from Human Papillomavirus
QFIFQLCKITL

SEQ ID NO: 14173 - protein, 8 aa, Artificial Sequence
  Peptide Derived from Human Papillomavirus
QFPLGRKF

SEQ ID NO: 14174 - protein, 9 aa, Artificial Sequence
  Peptide Derived from Human Papillomavirus
QFPLGRKFL

SEQ ID NO: 14175 - protein, 10 aa, Artificial Sequence
  Peptide Derived from Human Papillomavirus
QFPLGRKFLL

SEQ ID NO: 14176 - protein, 8 aa, Artificial Sequence
  Peptide Derived from Human Papillomavirus
QIFNKPYW

SEQ ID NO: 14177 - protein, 9 aa, Artificial Sequence
  Peptide Derived from Human Papillomavirus
QIFNKPYWM

SEQ ID NO: 14178 - protein, 11 aa, Artificial Sequence
  Peptide Derived from Human Papillomavirus
QLCKITLSADI

SEQ ID NO: 14179 - protein, 11 aa, Artificial Sequence
  Peptide Derived from Human Papillomavirus
QLCLLGCKPPI

SEQ ID NO: 14180 - protein, 8 aa, Artificial Sequence
  Peptide Derived from Human Papillomavirus
QMFVRHFF

SEQ ID NO: 14181 - protein, 9 aa, Artificial Sequence
  Peptide Derived from Human Papillomavirus
QYRVFRVRL

SEQ ID NO: 14182 - protein, 8 aa, Artificial Sequence
  Peptide Derived from Human Papillomavirus
RFVTSQAI

SEQ ID NO: 14183 - protein, 9 aa, Artificial Sequence
  Peptide Derived from Human Papillomavirus
RLLTVGHPY

SEQ ID NO: 14184 - protein, 10 aa, Artificial Sequence
  Peptide Derived from Human Papillomavirus
RLLTVGHPYY

SEQ ID NO: 14185 - protein, 8 aa, Artificial Sequence
  Peptide Derived from Human Papillomavirus
RLPDPNKF

SEQ ID NO: 14186 - protein, 10 aa, Artificial Sequence
  Peptide Derived from Human Papillomavirus
RLPDPNKFGF

SEQ ID NO: 14187 - protein, 9 aa, Artificial Sequence
  Peptide Derived from Human Papillomavirus
RLVWACVGL

SEQ ID NO: 14188 - protein, 10 aa, Artificial Sequence
  Peptide Derived from Human Papillomavirus
RVRLPDPNKF

SEQ ID NO: 14189 - protein, 10 aa, Artificial Sequence
  Peptide Derived from Human Papillomavirus
SFYNPETQRL

SEQ ID NO: 14190 - protein, 8 aa, Artificial Sequence
  Peptide Derived from Human Papillomavirus
SICKYPDY

SEQ ID NO: 14191 - protein, 9 aa, Artificial Sequence
  Peptide Derived from Human Papillomavirus
SICKYPDYL

SEQ ID NO: 14192 - protein, 11 aa, Artificial Sequence
  Peptide Derived from Human Papillomavirus
SICKYPDYLKM

SEQ ID NO: 14193 - protein, 11 aa, Artificial Sequence
  Peptide Derived from Human Papillomavirus
SIPKSDNPKKI

SEQ ID NO: 14194 - protein, 8 aa, Artificial Sequence
  Peptide Derived from Human Papillomavirus
SLEDTYRF

SEQ ID NO: 14195 - protein, 11 aa, Artificial Sequence
  Peptide Derived from Human Papillomavirus
SLWRPSEATVY

SEQ ID NO: 14196 - protein, 9 aa, Artificial Sequence
  Peptide Derived from Human Papillomavirus
SMDYKQTQL

SEQ ID NO: 14197 - protein, 11 aa, Artificial Sequence
  Peptide Derived from Human Papillomavirus
SMDYKQTQLCL

SEQ ID NO: 14198 - protein, 10 aa, Artificial Sequence
  Peptide Derived from Human Papillomavirus
SMNPAILEDW

SEQ ID NO: 14199 - protein, 9 aa, Artificial Sequence
  Peptide Derived from Human Papillomavirus
SMVTSDAQI

SEQ ID NO: 14200 - protein, 10 aa, Artificial Sequence
  Peptide Derived from Human Papillomavirus
SMVTSDAQIF

SEQ ID NO: 14201 - protein, 10 aa, Artificial Sequence
  Peptide Derived from Human Papillomavirus
STATLANSTY

SEQ ID NO: 14202 - protein, 11 aa, Artificial Sequence
  Peptide Derived from Human Papillomavirus
STATLANSTYF

SEQ ID NO: 14203 - protein, 11 aa, Artificial Sequence
  Peptide Derived from Human Papillomavirus
STDEYVTRTNI

SEQ ID NO: 14204 - protein, 10 aa, Artificial Sequence
  Peptide Derived from Human Papillomavirus
STNMSVCAAI

SEQ ID NO: 14205 - protein, 11 aa, Artificial Sequence
  Peptide Derived from Human Papillomavirus
STYFPTPSGSM

SEQ ID NO: 14206 - protein, 8 aa, Artificial Sequence
  Peptide Derived from Human Papillomavirus
SVIQDGDM

SEQ ID NO: 14207 - protein, 8 aa, Artificial Sequence
  Peptide Derived from Human Papillomavirus
SVPTDLYI

SEQ ID NO: 14208 - protein, 10 aa, Artificial Sequence
  Peptide Derived from Human Papillomavirus
TFKSSNFKEY

SEQ ID NO: 14209 - protein, 11 aa, Artificial Sequence
  Peptide Derived from Human Papillomavirus
TFKSSNFKEYL

SEQ ID NO: 14210 - protein, 8 aa, Artificial Sequence
  Peptide Derived from Human Papillomavirus
TLANSTYF

SEQ ID NO: 14211 - protein, 11 aa, Artificial Sequence
  Peptide Derived from Human Papillomavirus
TLFFYLRREQM

SEQ ID NO: 14212 - protein, 9 aa, Artificial Sequence
  Peptide Derived from Human Papillomavirus
TLSADIMTY

SEQ ID NO: 14213 - protein, 10 aa, Artificial Sequence
  Peptide Derived from Human Papillomavirus
TLSADIMTYI

SEQ ID NO: 14214 - protein, 8 aa, Artificial Sequence
  Peptide Derived from Human Papillomavirus
TTFKSSNF

SEQ ID NO: 14215 - protein, 11 aa, Artificial Sequence
  Peptide Derived from Human Papillomavirus
TTFKSSNFKEY

SEQ ID NO: 14216 - protein, 8 aa, Artificial Sequence
  Peptide Derived from Human Papillomavirus
TTPPSGSL

SEQ ID NO: 14217 - protein, 10 aa, Artificial Sequence
  Peptide Derived from Human Papillomavirus
TVGESVPTDL

SEQ ID NO: 14218 - protein, 11 aa, Artificial Sequence
  Peptide Derived from Human Papillomavirus
TVGESVPTDLY

SEQ ID NO: 14219 - protein, 9 aa, Artificial Sequence
  Peptide Derived from Human Papillomavirus
TVGHPYYSI

SEQ ID NO: 14220 - protein, 11 aa, Artificial Sequence
  Peptide Derived from Human Papillomavirus
TVVDTTRSTNM

SEQ ID NO: 14221 - protein, 10 aa, Artificial Sequence
  Peptide Derived from Human Papillomavirus
TYFPTPSGSM

SEQ ID NO: 14222 - protein, 10 aa, Artificial Sequence
  Peptide Derived from Human Papillomavirus
TYIHSMNPAI

SEQ ID NO: 14223 - protein, 11 aa, Artificial Sequence
  Peptide Derived from Human Papillomavirus
TYIHSMNPAIL

SEQ ID NO: 14224 - protein, 10 aa, Artificial Sequence
  Peptide Derived from Human Papillomavirus
TYRFVTSQAI

SEQ ID NO: 14225 - protein, 11 aa, Artificial Sequence
  Peptide Derived from Human Papillomavirus
VFWEVNLKEKF

SEQ ID NO: 14226 - protein, 8 aa, Artificial Sequence
  Peptide Derived from Human Papillomavirus
VTRTNIYY

SEQ ID NO: 14227 - protein, 8 aa, Artificial Sequence
  Peptide Derived from Human Papillomavirus
VTSDAQIF

SEQ ID NO: 14228 - protein, 10 aa, Artificial Sequence
  Peptide Derived from Human Papillomavirus
VVDTTRSTNM

SEQ ID NO: 14229 - protein, 8 aa, Artificial Sequence
  Peptide Derived from Human Papillomavirus
VVPKVSGL

SEQ ID NO: 14230 - protein, 10 aa, Artificial Sequence
  Peptide Derived from Human Papillomavirus
VVPKVSGLQY

SEQ ID NO: 14231 - protein, 9 aa, Artificial Sequence
  Peptide Derived from Human Papillomavirus
YFPTPSGSM

SEQ ID NO: 14232 - protein, 9 aa, Artificial Sequence
  Peptide Derived from Human Papillomavirus
YIHSMNPAI

SEQ ID NO: 14233 - protein, 10 aa, Artificial Sequence
  Peptide Derived from Human Papillomavirus
YIHSMNPAIL

SEQ ID NO: 14234 - protein, 11 aa, Artificial Sequence
  Peptide Derived from Human Papillomavirus
YIKGSGSTATL

SEQ ID NO: 14235 - protein, 9 aa, Artificial Sequence
  Peptide Derived from Human Papillomavirus
YLKMVAEPY

SEQ ID NO: 14236 - protein, 8 aa, Artificial Sequence
  Peptide Derived from Human Papillomavirus
YLRHGEEF

SEQ ID NO: 14237 - protein, 10 aa, Artificial Sequence
  Peptide Derived from Human Papillomavirus
YLRHGEEFDL

SEQ ID NO: 14238 - protein, 8 aa, Artificial Sequence
  Peptide Derived from Human Papillomavirus
YLRREQMF

SEQ ID NO: 14239 - protein, 8 aa, Artificial Sequence
  Peptide Derived from Human Papillomavirus
YVFWEVNL

SEQ ID NO: 14240 - protein, 8 aa, Artificial Sequence
  Peptide Derived from Human Papillomavirus
YVTRTNIY

SEQ ID NO: 14241 - protein, 9 aa, Artificial Sequence
  Peptide Derived from Human Papillomavirus
YVTRTNIYY

SEQ ID NO: 14242 - protein, 9 aa, Artificial Sequence
  Peptide Derived from Human Papillomavirus
YYHAGSARL

SEQ ID NO: 14243 - protein, 10 aa, Artificial Sequence
  Peptide Derived from Human Papillomavirus
YYHAGSARLL

SEQ ID NO: 14244 - protein, 11 aa, Artificial Sequence
  Peptide Derived from Human Papillomavirus
ALTSRRNTVRY

SEQ ID NO: 14245 - protein, 9 aa, Artificial Sequence
  Peptide Derived from Human Papillomavirus
ATIGARVHY

SEQ ID NO: 14246 - protein, 10 aa, Artificial Sequence
  Peptide Derived from Human Papillomavirus
ATIGARVHYY

SEQ ID NO: 14247 - protein, 11 aa, Artificial Sequence
  Peptide Derived from Human Papillomavirus
ATIGARVHYYY

SEQ ID NO: 14248 - protein, 8 aa, Artificial Sequence
  Peptide Derived from Human Papillomavirus
ATQQVKVI

SEQ ID NO: 14249 - protein, 10 aa, Artificial Sequence
  Peptide Derived from Human Papillomavirus
ATTADTTPAI

SEQ ID NO: 14250 - protein, 11 aa, Artificial Sequence
  Peptide Derived from Human Papillomavirus
ATTADTTPAIL

SEQ ID NO: 14251 - protein, 11 aa, Artificial Sequence
  Peptide Derived from Human Papillomavirus
ATTTSTLNDGL

SEQ ID NO: 14252 - protein, 11 aa, Artificial Sequence
  Peptide Derived from Human Papillomavirus
AVQSTSAVSAY

SEQ ID NO: 14253 - protein, 11 aa, Artificial Sequence
  Peptide Derived from Human Papillomavirus
AYETVNAEESL

SEQ ID NO: 14254 - protein, 11 aa, Artificial Sequence
  Peptide Derived from Human Papillomavirus
AYVPTNTTVPL

SEQ ID NO: 14255 - protein, 8 aa, Artificial Sequence
  Peptide Derived from Human Papillomavirus
DFLDIIAL

SEQ ID NO: 14256 - protein, 8 aa, Artificial Sequence
  Peptide Derived from Human Papillomavirus
DFYLHPSY

SEQ ID NO: 14257 - protein, 9 aa, Artificial Sequence
  Peptide Derived from Human Papillomavirus
DFYLHPSYY

SEQ ID NO: 14258 - protein, 10 aa, Artificial Sequence
  Peptide Derived from Human Papillomavirus
DFYLHPSYYM

SEQ ID NO: 14259 - protein, 11 aa, Artificial Sequence
  Peptide Derived from Human Papillomavirus
DFYLHPSYYML

SEQ ID NO: 14260 - protein, 10 aa, Artificial Sequence
  Peptide Derived from Human Papillomavirus
DIIALHRPAL

SEQ ID NO: 14261 - protein, 8 aa, Artificial Sequence
  Peptide Derived from Human Papillomavirus
DIYADTDF

SEQ ID NO: 14262 - protein, 8 aa, Artificial Sequence
  Peptide Derived from Human Papillomavirus
DVGAPAPI

SEQ ID NO: 14263 - protein, 11 aa, Artificial Sequence
  Peptide Derived from Human Papillomavirus
DVIPKIEHTTI

SEQ ID NO: 14264 - protein, 8 aa, Artificial Sequence
  Peptide Derived from Human Papillomavirus
EIPMDTFI

SEQ ID NO: 14265 - protein, 8 aa, Artificial Sequence
  Peptide Derived from Human Papillomavirus
ETSGHLLL

SEQ ID NO: 14266 - protein, 9 aa, Artificial Sequence
  Peptide Derived from Human Papillomavirus
ETVNAEESL

SEQ ID NO: 14267 - protein, 10 aa, Artificial Sequence
  Peptide Derived from Human Papillomavirus
ETVNAEESLY

SEQ ID NO: 14268 - protein, 11 aa, Artificial Sequence
  Peptide Derived from Human Papillomavirus
ETVNAEESLYF

SEQ ID NO: 14269 - protein, 10 aa, Artificial Sequence
  Peptide Derived from Human Papillomavirus
FIVSTNNENI

SEQ ID NO: 14270 - protein, 8 aa, Artificial Sequence
  Peptide Derived from Human Papillomavirus
FLSAPKQL

SEQ ID NO: 14271 - protein, 9 aa, Artificial Sequence
  Peptide Derived from Human Papillomavirus
FLSAPKQLI

SEQ ID NO: 14272 - protein, 11 aa, Artificial Sequence
  Peptide Derived from Human Papillomavirus
FLSAPKQLITY

SEQ ID NO: 14273 - protein, 8 aa, Artificial Sequence
  Peptide Derived from Human Papillomavirus
FVDGGDFY

SEQ ID NO: 14274 - protein, 9 aa, Artificial Sequence
  Peptide Derived from Human Papillomavirus
FVDGGDFYL

SEQ ID NO: 14275 - protein, 8 aa, Artificial Sequence
  Peptide Derived from Human Papillomavirus
FYLHPSYY

SEQ ID NO: 14276 - protein, 9 aa, Artificial Sequence
  Peptide Derived from Human Papillomavirus
FYLHPSYYM

SEQ ID NO: 14277 - protein, 10 aa, Artificial Sequence
  Peptide Derived from Human Papillomavirus
FYLHPSYYML

SEQ ID NO: 14278 - protein, 11 aa, Artificial Sequence
  Peptide Derived from Human Papillomavirus
GIVDVGAPAPI

SEQ ID NO: 14279 - protein, 11 aa, Artificial Sequence
  Peptide Derived from Human Papillomavirus
GLYDIYADTDF

SEQ ID NO: 14280 - protein, 8 aa, Artificial Sequence
  Peptide Derived from Human Papillomavirus
GTCPSDVI

SEQ ID NO: 14281 - protein, 11 aa, Artificial Sequence
  Peptide Derived from Human Papillomavirus
GTCPSDVIPKI

SEQ ID NO: 14282 - protein, 8 aa, Artificial Sequence
  Peptide Derived from Human Papillomavirus
GTGGRTGY

SEQ ID NO: 14283 - protein, 11 aa, Artificial Sequence
  Peptide Derived from Human Papillomavirus
GTGGRTGYVPL

SEQ ID NO: 14284 - protein, 9 aa, Artificial Sequence
  Peptide Derived from Human Papillomavirus
GVFFGGLGI

SEQ ID NO: 14285 - protein, 8 aa, Artificial Sequence
  Peptide Derived from Human Papillomavirus
GVRRPARL

SEQ ID NO: 14286 - protein, 10 aa, Artificial Sequence
  Peptide Derived from Human Papillomavirus
GVRRPARLGL

SEQ ID NO: 14287 - protein, 11 aa, Artificial Sequence
  Peptide Derived from Human Papillomavirus
GVRRPARLGLY

SEQ ID NO: 14288 - protein, 9 aa, Artificial Sequence
  Peptide Derived from Human Papillomavirus
HLLLSSSSI

SEQ ID NO: 14289 - protein, 8 aa, Artificial Sequence
  Peptide Derived from Human Papillomavirus
HTTIADQI

SEQ ID NO: 14290 - protein, 9 aa, Artificial Sequence
  Peptide Derived from Human Papillomavirus
HTTIADQIL

SEQ ID NO: 14291 - protein, 11 aa, Artificial Sequence
  Peptide Derived from Human Papillomavirus
HTTIADQILRY

SEQ ID NO: 14292 - protein, 9 aa, Artificial Sequence
  Peptide Derived from Human Papillomavirus
HYYYDISSI

SEQ ID NO: 14293 - protein, 9 aa, Artificial Sequence
  Peptide Derived from Human Papillomavirus
IFSGPDVPI

SEQ ID NO: 14294 - protein, 8 aa, Artificial Sequence
  Peptide Derived from Human Papillomavirus
IFVDGGDF

SEQ ID NO: 14295 - protein, 9 aa, Artificial Sequence
  Peptide Derived from Human Papillomavirus
IFVDGGDFY

SEQ ID NO: 14296 - protein, 10 aa, Artificial Sequence
  Peptide Derived from Human Papillomavirus
IFVDGGDFYL

SEQ ID NO: 14297 - protein, 9 aa, Artificial Sequence
  Peptide Derived from Human Papillomavirus
IIALHRPAL

SEQ ID NO: 14298 - protein, 10 aa, Artificial Sequence
  Peptide Derived from Human Papillomavirus
ILRYGSMGVF

SEQ ID NO: 14299 - protein, 11 aa, Artificial Sequence
  Peptide Derived from Human Papillomavirus
ILRYGSMGVFF

SEQ ID NO: 14300 - protein, 8 aa, Artificial Sequence
  Peptide Derived from Human Papillomavirus
ITYENPAY

SEQ ID NO: 14301 - protein, 10 aa, Artificial Sequence
  Peptide Derived from Human Papillomavirus
IVDVGAPAPI

SEQ ID NO: 14302 - protein, 10 aa, Artificial Sequence
  Peptide Derived from Human Papillomavirus
IVSLVEESGI

SEQ ID NO: 14303 - protein, 9 aa, Artificial Sequence
  Peptide Derived from Human Papillomavirus
IVSTNNENI

SEQ ID NO: 14304 - protein, 11 aa, Artificial Sequence
  Peptide Derived from Human Papillomavirus
KIEHTTIADQI

SEQ ID NO: 14305 - protein, 8 aa, Artificial Sequence
  Peptide Derived from Human Papillomavirus
KVIDPTFL

SEQ ID NO: 14306 - protein, 9 aa, Artificial Sequence
  Peptide Derived from Human Papillomavirus
LITYENPAY

SEQ ID NO: 14307 - protein, 8 aa, Artificial Sequence
  Peptide Derived from Human Papillomavirus
LLLSSSSI

SEQ ID NO: 14308 - protein, 10 aa, Artificial Sequence
  Peptide Derived from Human Papillomavirus
LTSRRNTVRY

SEQ ID NO: 14309 - protein, 10 aa, Artificial Sequence
  Peptide Derived from Human Papillomavirus
LYDIYADTDF

SEQ ID NO: 14310 - protein, 10 aa, Artificial Sequence
  Peptide Derived from Human Papillomavirus
LYFSNTSHNI

SEQ ID NO: 14311 - protein, 11 aa, Artificial Sequence
  Peptide Derived from Human Papillomavirus
MLKRRRKRVSY

SEQ ID NO: 14312 - protein, 8 aa, Artificial Sequence
  Peptide Derived from Human Papillomavirus
NIAPDPDF

SEQ ID NO: 14313 - protein, 9 aa, Artificial Sequence
  Peptide Derived from Human Papillomavirus
NIAPDPDFL

SEQ ID NO: 14314 - protein, 11 aa, Artificial Sequence
  Peptide Derived from Human Papillomavirus
NIAPDPDFLDI

SEQ ID NO: 14315 - protein, 8 aa, Artificial Sequence
  Peptide Derived from Human Papillomavirus
NITSSTPI

SEQ ID NO: 14316 - protein, 10 aa, Artificial Sequence
  Peptide Derived from Human Papillomavirus
NTTVPLSTGF

SEQ ID NO: 14317 - protein, 8 aa, Artificial Sequence
  Peptide Derived from Human Papillomavirus
NTVRYSRL

SEQ ID NO: 14318 - protein, 10 aa, Artificial Sequence
  Peptide Derived from Human Papillomavirus
NYEEIPMDTF

SEQ ID NO: 14319 - protein, 11 aa, Artificial Sequence
  Peptide Derived from Human Papillomavirus
NYEEIPMDTFI

SEQ ID NO: 14320 - protein, 10 aa, Artificial Sequence
  Peptide Derived from Human Papillomavirus
PIEHAPTQVF

SEQ ID NO: 14321 - protein, 10 aa, Artificial Sequence
  Peptide Derived from Human Papillomavirus
PIFSGPDVPI

SEQ ID NO: 14322 - protein, 11 aa, Artificial Sequence
  Peptide Derived from Human Papillomavirus
PIPGVRRPARL

SEQ ID NO: 14323 - protein, 11 aa, Artificial Sequence
  Peptide Derived from Human Papillomavirus
PIPHPPTTSGF

SEQ ID NO: 14324 - protein, 8 aa, Artificial Sequence
  Peptide Derived from Human Papillomavirus
PIRPPVSI

SEQ ID NO: 14325 - protein, 11 aa, Artificial Sequence
  Peptide Derived from Human Papillomavirus
PLAPTTPQVSI

SEQ ID NO: 14326 - protein, 9 aa, Artificial Sequence
  Peptide Derived from Human Papillomavirus
PLDPSIVSL

SEQ ID NO: 14327 - protein, 8 aa, Artificial Sequence
  Peptide Derived from Human Papillomavirus
PLSTGFDI

SEQ ID NO: 14328 - protein, 10 aa, Artificial Sequence
  Peptide Derived from Human Papillomavirus
PLSTGFDIPI

SEQ ID NO: 14329 - protein, 11 aa, Artificial Sequence
  Peptide Derived from Human Papillomavirus
PLSTGFDIPIF

SEQ ID NO: 14330 - protein, 10 aa, Artificial Sequence
  Peptide Derived from Human Papillomavirus
PTFLSAPKQL

SEQ ID NO: 14331 - protein, 11 aa, Artificial Sequence
  Peptide Derived from Human Papillomavirus
PTFLSAPKQLI

SEQ ID NO: 14332 - protein, 9 aa, Artificial Sequence
  Peptide Derived from Human Papillomavirus
PTFTDPSVL

SEQ ID NO: 14333 - protein, 8 aa, Artificial Sequence
  Peptide Derived from Human Papillomavirus
PTNTTVPL

SEQ ID NO: 14334 - protein, 10 aa, Artificial Sequence
  Peptide Derived from Human Papillomavirus
PTPAETSGHL

SEQ ID NO: 14335 - protein, 11 aa, Artificial Sequence
  Peptide Derived from Human Papillomavirus
PTPAETSGHLL

SEQ ID NO: 14336 - protein, 9 aa, Artificial Sequence
  Peptide Derived from Human Papillomavirus
PTQVFPFPL

SEQ ID NO: 14337 - protein, 8 aa, Artificial Sequence
  Peptide Derived from Human Papillomavirus
PTTPQVSI

SEQ ID NO: 14338 - protein, 9 aa, Artificial Sequence
  Peptide Derived from Human Papillomavirus
PTTPQVSIF

SEQ ID NO: 14339 - protein, 8 aa, Artificial Sequence
  Peptide Derived from Human Papillomavirus
PTTSGFDI

SEQ ID NO: 14340 - protein, 9 aa, Artificial Sequence
  Peptide Derived from Human Papillomavirus
PVGPLDPSI

SEQ ID NO: 14341 - protein, 10 aa, Artificial Sequence
  Peptide Derived from Human Papillomavirus
PVSIDPVGPL

SEQ ID NO: 14342 - protein, 8 aa, Artificial Sequence
  Peptide Derived from Human Papillomavirus
QILRYGSM

SEQ ID NO: 14343 - protein, 11 aa, Artificial Sequence
  Peptide Derived from Human Papillomavirus
QILRYGSMGVF

SEQ ID NO: 14344 - protein, 10 aa, Artificial Sequence
  Peptide Derived from Human Papillomavirus
QLITYENPAY

SEQ ID NO: 14345 - protein, 11 aa, Artificial Sequence
  Peptide Derived from Human Papillomavirus
QTLRTRSGATI

SEQ ID NO: 14346 - protein, 9 aa, Artificial Sequence
  Peptide Derived from Human Papillomavirus
QVKVIDPTF

SEQ ID NO: 14347 - protein, 10 aa, Artificial Sequence
  Peptide Derived from Human Papillomavirus
QVKVIDPTFL

SEQ ID NO: 14348 - protein, 11 aa, Artificial Sequence
  Peptide Derived from Human Papillomavirus
QVSIFVDGGDF

SEQ ID NO: 14349 - protein, 8 aa, Artificial Sequence
  Peptide Derived from Human Papillomavirus
RLGNKQTL

SEQ ID NO: 14350 - protein, 10 aa, Artificial Sequence
  Peptide Derived from Human Papillomavirus
RTKRASATQL

SEQ ID NO: 14351 - protein, 11 aa, Artificial Sequence
  Peptide Derived from Human Papillomavirus
RTKRASATQLY

SEQ ID NO: 14352 - protein, 8 aa, Artificial Sequence
  Peptide Derived from Human Papillomavirus
RTRSGATI

SEQ ID NO: 14353 - protein, 8 aa, Artificial Sequence
  Peptide Derived from Human Papillomavirus
RVHYYYDI

SEQ ID NO: 14354 - protein, 11 aa, Artificial Sequence
  Peptide Derived from Human Papillomavirus
RVHYYYDISSI

SEQ ID NO: 14355 - protein, 8 aa, Artificial Sequence
  Peptide Derived from Human Papillomavirus
RYGSMGVF

SEQ ID NO: 14356 - protein, 9 aa, Artificial Sequence
  Peptide Derived from Human Papillomavirus
RYGSMGVFF

SEQ ID NO: 14357 - protein, 11 aa, Artificial Sequence
  Peptide Derived from Human Papillomavirus
RYSRLGNKQTL

SEQ ID NO: 14358 - protein, 8 aa, Artificial Sequence
  Peptide Derived from Human Papillomavirus
SIDPVGPL

SEQ ID NO: 14359 - protein, 9 aa, Artificial Sequence
  Peptide Derived from Human Papillomavirus
SIFVDGGDF

SEQ ID NO: 14360 - protein, 10 aa, Artificial Sequence
  Peptide Derived from Human Papillomavirus
SIFVDGGDFY

SEQ ID NO: 14361 - protein, 11 aa, Artificial Sequence
  Peptide Derived from Human Papillomavirus
SIFVDGGDFYL

SEQ ID NO: 14362 - protein, 9 aa, Artificial Sequence
  Peptide Derived from Human Papillomavirus
SINPAGESI

SEQ ID NO: 14363 - protein, 11 aa, Artificial Sequence
  Peptide Derived from Human Papillomavirus
SINPAGESIEM

SEQ ID NO: 14364 - protein, 10 aa, Artificial Sequence
  Peptide Derived from Human Papillomavirus
SIPIRPPVSI

SEQ ID NO: 14365 - protein, 10 aa, Artificial Sequence
  Peptide Derived from Human Papillomavirus
SISTHNYEEI

SEQ ID NO: 14366 - protein, 11 aa, Artificial Sequence
  Peptide Derived from Human Papillomavirus
SIVSLVEESGI

SEQ ID NO: 14367 - protein, 8 aa, Artificial Sequence
  Peptide Derived from Human Papillomavirus
SLVEESGI

SEQ ID NO: 14368 - protein, 11 aa, Artificial Sequence
  Peptide Derived from Human Papillomavirus
SLYFSNTSHNI

SEQ ID NO: 14369 - protein, 9 aa, Artificial Sequence
  Peptide Derived from Human Papillomavirus
SMGVFFGGL

SEQ ID NO: 14370 - protein, 11 aa, Artificial Sequence
  Peptide Derived from Human Papillomavirus
SMGVFFGGLGI

SEQ ID NO: 14371 - protein, 8 aa, Artificial Sequence
  Peptide Derived from Human Papillomavirus
STGFDIPI

SEQ ID NO: 14372 - protein, 9 aa, Artificial Sequence
  Peptide Derived from Human Papillomavirus
STGFDIPIF

SEQ ID NO: 14373 - protein, 8 aa, Artificial Sequence
  Peptide Derived from Human Papillomavirus
STHENPTF

SEQ ID NO: 14374 - protein, 8 aa, Artificial Sequence
  Peptide Derived from Human Papillomavirus
STHNYEEI

SEQ ID NO: 14375 - protein, 10 aa, Artificial Sequence
  Peptide Derived from Human Papillomavirus
STHNYEEIPM

SEQ ID NO: 14376 - protein, 8 aa, Artificial Sequence
  Peptide Derived from Human Papillomavirus
STLNDGLY

SEQ ID NO: 14377 - protein, 10 aa, Artificial Sequence
  Peptide Derived from Human Papillomavirus
STLNDGLYDI

SEQ ID NO: 14378 - protein, 11 aa, Artificial Sequence
  Peptide Derived from Human Papillomavirus
STLNDGLYDIY

SEQ ID NO: 14379 - protein, 8 aa, Artificial Sequence
  Peptide Derived from Human Papillomavirus
STSAVSAY

SEQ ID NO: 14380 - protein, 8 aa, Artificial Sequence
  Peptide Derived from Human Papillomavirus
STVSEASI

SEQ ID NO: 14381 - protein, 10 aa, Artificial Sequence
  Peptide Derived from Human Papillomavirus
STVSEASIPI

SEQ ID NO: 14382 - protein, 10 aa, Artificial Sequence
  Peptide Derived from Human Papillomavirus
SVSTHENPTF

SEQ ID NO: 14383 - protein, 11 aa, Artificial Sequence
  Peptide Derived from Human Papillomavirus
TFIVSTNNENI

SEQ ID NO: 14384 - protein, 9 aa, Artificial Sequence
  Peptide Derived from Human Papillomavirus
TFLSAPKQL

SEQ ID NO: 14385 - protein, 10 aa, Artificial Sequence
  Peptide Derived from Human Papillomavirus
TFLSAPKQLI

SEQ ID NO: 14386 - protein, 8 aa, Artificial Sequence
  Peptide Derived from Human Papillomavirus
TFTDPSVL

SEQ ID NO: 14387 - protein, 9 aa, Artificial Sequence
  Peptide Derived from Human Papillomavirus
TIADQILRY

SEQ ID NO: 14388 - protein, 8 aa, Artificial Sequence
  Peptide Derived from Human Papillomavirus
TIGARVHY

SEQ ID NO: 14389 - protein, 9 aa, Artificial Sequence
  Peptide Derived from Human Papillomavirus
TIGARVHYY

SEQ ID NO: 14390 - protein, 10 aa, Artificial Sequence
  Peptide Derived from Human Papillomavirus
TIGARVHYYY

SEQ ID NO: 14391 - protein, 9 aa, Artificial Sequence
  Peptide Derived from Human Papillomavirus
TLNDGLYDI

SEQ ID NO: 14392 - protein, 10 aa, Artificial Sequence
  Peptide Derived from Human Papillomavirus
TLNDGLYDIY

SEQ ID NO: 14393 - protein, 10 aa, Artificial Sequence
  Peptide Derived from Human Papillomavirus
TLRTRSGATI

SEQ ID NO: 14394 - protein, 9 aa, Artificial Sequence
  Peptide Derived from Human Papillomavirus
TTADTTPAI

SEQ ID NO: 14395 - protein, 10 aa, Artificial Sequence
  Peptide Derived from Human Papillomavirus
TTADTTPAIL

SEQ ID NO: 14396 - protein, 8 aa, Artificial Sequence
  Peptide Derived from Human Papillomavirus
TTIADQIL

SEQ ID NO: 14397 - protein, 10 aa, Artificial Sequence
  Peptide Derived from Human Papillomavirus
TTIADQILRY

SEQ ID NO: 14398 - protein, 8 aa, Artificial Sequence
  Peptide Derived from Human Papillomavirus
TTPQVSIF

SEQ ID NO: 14399 - protein, 9 aa, Artificial Sequence
  Peptide Derived from Human Papillomavirus
TTSTLNDGL

SEQ ID NO: 14400 - protein, 10 aa, Artificial Sequence
  Peptide Derived from Human Papillomavirus
TTSTLNDGLY

SEQ ID NO: 14401 - protein, 10 aa, Artificial Sequence
  Peptide Derived from Human Papillomavirus
TTTSTLNDGL

SEQ ID NO: 14402 - protein, 11 aa, Artificial Sequence
  Peptide Derived from Human Papillomavirus
TTTSTLNDGLY

SEQ ID NO: 14403 - protein, 9 aa, Artificial Sequence
  Peptide Derived from Human Papillomavirus
TTVPLSTGF

SEQ ID NO: 14404 - protein, 11 aa, Artificial Sequence
  Peptide Derived from Human Papillomavirus
TTVPLSTGFDI

SEQ ID NO: 14405 - protein, 8 aa, Artificial Sequence
  Peptide Derived from Human Papillomavirus
TVNAEESL

SEQ ID NO: 14406 - protein, 9 aa, Artificial Sequence
  Peptide Derived from Human Papillomavirus
TVNAEESLY

SEQ ID NO: 14407 - protein, 10 aa, Artificial Sequence
  Peptide Derived from Human Papillomavirus
TVNAEESLYF

SEQ ID NO: 14408 - protein, 8 aa, Artificial Sequence
  Peptide Derived from Human Papillomavirus
TVPLSTGF

SEQ ID NO: 14409 - protein, 10 aa, Artificial Sequence
  Peptide Derived from Human Papillomavirus
TVPLSTGFDI

SEQ ID NO: 14410 - protein, 9 aa, Artificial Sequence
  Peptide Derived from Human Papillomavirus
TVSEASIPI

SEQ ID NO: 14411 - protein, 8 aa, Artificial Sequence
  Peptide Derived from Human Papillomavirus
VFFGGLGI

SEQ ID NO: 14412 - protein, 10 aa, Artificial Sequence
  Peptide Derived from Human Papillomavirus
VIPKIEHTTI

SEQ ID NO: 14413 - protein, 9 aa, Artificial Sequence
  Peptide Derived from Human Papillomavirus
YFSNTSHNI

SEQ ID NO: 14414 - protein, 8 aa, Artificial Sequence
  Peptide Derived from Human Papillomavirus
YLHPSYYM

SEQ ID NO: 14415 - protein, 9 aa, Artificial Sequence
  Peptide Derived from Human Papillomavirus
YLHPSYYML

SEQ ID NO: 14416 - protein, 10 aa, Artificial Sequence
  Peptide Derived from Human Papillomavirus
YVPTNTTVPL

SEQ ID NO: 14417 - protein, 8 aa, Artificial Sequence
  Peptide Derived from Human Papillomavirus
YYYDISSI

SEQ ID NO: 14418 - protein, 9 aa, Artificial Sequence
  Peptide Derived from Human Papillomavirus
AFKKFLKGI

SEQ ID NO: 14419 - protein, 9 aa, Artificial Sequence
  Peptide Derived from Human Papillomavirus
AFLGAFKKF

SEQ ID NO: 14420 - protein, 10 aa, Artificial Sequence
  Peptide Derived from Human Papillomavirus
AFLGAFKKFL

SEQ ID NO: 14421 - protein, 11 aa, Artificial Sequence
  Peptide Derived from Human Papillomavirus
AFLKSNSQAKI

SEQ ID NO: 14422 - protein, 10 aa, Artificial Sequence
  Peptide Derived from Human Papillomavirus
AINDENWKSF

SEQ ID NO: 14423 - protein, 11 aa, Artificial Sequence
  Peptide Derived from Human Papillomavirus
AINDENWKSFF

SEQ ID NO: 14424 - protein, 9 aa, Artificial Sequence
  Peptide Derived from Human Papillomavirus
ALDGNEISI

SEQ ID NO: 14425 - protein, 10 aa, Artificial Sequence
  Peptide Derived from Human Papillomavirus
ALVQLKCPPL

SEQ ID NO: 14426 - protein, 11 aa, Artificial Sequence
  Peptide Derived from Human Papillomavirus
ALVQLKCPPLL

SEQ ID NO: 14427 - protein, 9 aa, Artificial Sequence
  Peptide Derived from Human Papillomavirus
ALYWFRTAM

SEQ ID NO: 14428 - protein, 9 aa, Artificial Sequence
  Peptide Derived from Human Papillomavirus
AVCALKRKF

SEQ ID NO: 14429 - protein, 11 aa, Artificial Sequence
  Peptide Derived from Human Papillomavirus
AVIERRTGDNI

SEQ ID NO: 14430 - protein, 9 aa, Artificial Sequence
  Peptide Derived from Human Papillomavirus
AYGISFMEL

SEQ ID NO: 14431 - protein, 8 aa, Artificial Sequence
  Peptide Derived from Human Papillomavirus
CLTCDRGI

SEQ ID NO: 14432 - protein, 9 aa, Artificial Sequence
  Peptide Derived from Human Papillomavirus
CLTCDRGII

SEQ ID NO: 14433 - protein, 10 aa, Artificial Sequence
  Peptide Derived from Human Papillomavirus
CLTCDRGIII

SEQ ID NO: 14434 - protein, 11 aa, Artificial Sequence
  Peptide Derived from Human Papillomavirus
CLTCDRGIIIL

SEQ ID NO: 14435 - protein, 9 aa, Artificial Sequence
  Peptide Derived from Human Papillomavirus
CMVIEPPKL

SEQ ID NO: 14436 - protein, 9 aa, Artificial Sequence
  Peptide Derived from Human Papillomavirus
CTDWCITGY

SEQ ID NO: 14437 - protein, 11 aa, Artificial Sequence
  Peptide Derived from Human Papillomavirus
CTDWCITGYGI

SEQ ID NO: 14438 - protein, 11 aa, Artificial Sequence
  Peptide Derived from Human Papillomavirus
CTGWFEVEAVI

SEQ ID NO: 14439 - protein, 8 aa, Artificial Sequence
  Peptide Derived from Human Papillomavirus
CTYRKRKI

SEQ ID NO: 14440 - protein, 11 aa, Artificial Sequence
  Peptide Derived from Human Papillomavirus
CTYRKRKIDEL

SEQ ID NO: 14441 - protein, 8 aa, Artificial Sequence
  Peptide Derived from Human Papillomavirus
CVNSKSHF

SEQ ID NO: 14442 - protein, 9 aa, Artificial Sequence
  Peptide Derived from Human Papillomavirus
CVNSKSHFW

SEQ ID NO: 14443 - protein, 10 aa, Artificial Sequence
  Peptide Derived from Human Papillomavirus
CVNSKSHFWL

SEQ ID NO: 14444 - protein, 9 aa, Artificial Sequence
  Peptide Derived from Human Papillomavirus
DIAYYYAQL

SEQ ID NO: 14445 - protein, 10 aa, Artificial Sequence
  Peptide Derived from Human Papillomavirus
DLLEFIDDSM

SEQ ID NO: 14446 - protein, 8 aa, Artificial Sequence
  Peptide Derived from Human Papillomavirus
DLNAVCAL

SEQ ID NO: 14447 - protein, 8 aa, Artificial Sequence
  Peptide Derived from Human Papillomavirus
DLSEMVQW

SEQ ID NO: 14448 - protein, 10 aa, Artificial Sequence
  Peptide Derived from Human Papillomavirus
DLSEMVQWAY

SEQ ID NO: 14449 - protein, 8 aa, Artificial Sequence
  Peptide Derived from Human Papillomavirus
DTEAARAL

SEQ ID NO: 14450 - protein, 9 aa, Artificial Sequence
  Peptide Derived from Human Papillomavirus
DTEAARALF

SEQ ID NO: 14451 - protein, 11 aa, Artificial Sequence
  Peptide Derived from Human Papillomavirus
DTEAARALFNI

SEQ ID NO: 14452 - protein, 10 aa, Artificial Sequence
  Peptide Derived from Human Papillomavirus
DVKHRALVQL

SEQ ID NO: 14453 - protein, 9 aa, Artificial Sequence
  Peptide Derived from Human Papillomavirus
DVQGTTPEW

SEQ ID NO: 14454 - protein, 10 aa, Artificial Sequence
  Peptide Derived from Human Papillomavirus
DVQGTTPEWI

SEQ ID NO: 14455 - protein, 9 aa, Artificial Sequence
  Peptide Derived from Human Papillomavirus
DVTPISWTY

SEQ ID NO: 14456 - protein, 10 aa, Artificial Sequence
  Peptide Derived from Human Papillomavirus
DVTPISWTYI

SEQ ID NO: 14457 - protein, 9 aa, Artificial Sequence
  Peptide Derived from Human Papillomavirus
DWCITGYGI

SEQ ID NO: 14458 - protein, 11 aa, Artificial Sequence
  Peptide Derived from Human Papillomavirus
EFIDDSMENSI

SEQ ID NO: 14459 - protein, 8 aa, Artificial Sequence
  Peptide Derived from Human Papillomavirus
EFKNPFPF

SEQ ID NO: 14460 - protein, 9 aa, Artificial Sequence
  Peptide Derived from Human Papillomavirus
EFTAFLGAF

SEQ ID NO: 14461 - protein, 11 aa, Artificial Sequence
  Peptide Derived from Human Papillomavirus
EISIDVKHRAL

SEQ ID NO: 14462 - protein, 8 aa, Artificial Sequence
  Peptide Derived from Human Papillomavirus
ELTDDSDI

SEQ ID NO: 14463 - protein, 10 aa, Artificial Sequence
  Peptide Derived from Human Papillomavirus
ELTDDSDIAY

SEQ ID NO: 14464 - protein, 11 aa, Artificial Sequence
  Peptide Derived from Human Papillomavirus
ELTDDSDIAYY

SEQ ID NO: 14465 - protein, 11 aa, Artificial Sequence
  Peptide Derived from Human Papillomavirus
EMVQWAYDNEL

SEQ ID NO: 14466 - protein, 10 aa, Artificial Sequence
  Peptide Derived from Human Papillomavirus
ETADDSGTDL

SEQ ID NO: 14467 - protein, 11 aa, Artificial Sequence
  Peptide Derived from Human Papillomavirus
ETADDSGTDLL

SEQ ID NO: 14468 - protein, 11 aa, Artificial Sequence
  Peptide Derived from Human Papillomavirus
ETCMVIEPPKL

SEQ ID NO: 14469 - protein, 9 aa, Artificial Sequence
  Peptide Derived from Human Papillomavirus
EWIDRLTVL

SEQ ID NO: 14470 - protein, 9 aa, Artificial Sequence
  Peptide Derived from Human Papillomavirus
FFSRTWCKL

SEQ ID NO: 14471 - protein, 11 aa, Artificial Sequence
  Peptide Derived from Human Papillomavirus
FFSRTWCKLDL

SEQ ID NO: 14472 - protein, 10 aa, Artificial Sequence
  Peptide Derived from Human Papillomavirus
FIDDSMENSI

SEQ ID NO: 14473 - protein, 8 aa, Artificial Sequence
  Peptide Derived from Human Papillomavirus
FLGAFKKF

SEQ ID NO: 14474 - protein, 9 aa, Artificial Sequence
  Peptide Derived from Human Papillomavirus
FLGAFKKFL

SEQ ID NO: 14475 - protein, 11 aa, Artificial Sequence
  Peptide Derived from Human Papillomavirus
FLKGIPKKSCM

SEQ ID NO: 14476 - protein, 10 aa, Artificial Sequence
  Peptide Derived from Human Papillomavirus
FLKSNSQAKI

SEQ ID NO: 14477 - protein, 8 aa, Artificial Sequence
  Peptide Derived from Human Papillomavirus
FMELVRPF

SEQ ID NO: 14478 - protein, 8 aa, Artificial Sequence
  Peptide Derived from Human Papillomavirus
FTAFLGAF

SEQ ID NO: 14479 - protein, 11 aa, Artificial Sequence
  Peptide Derived from Human Papillomavirus
FTAFLGAFKKF

SEQ ID NO: 14480 - protein, 11 aa, Artificial Sequence
  Peptide Derived from Human Papillomavirus
FWLQPLSDAKI

SEQ ID NO: 14481 - protein, 8 aa, Artificial Sequence
  Peptide Derived from Human Papillomavirus
GIIILLLI

SEQ ID NO: 14482 - protein, 10 aa, Artificial Sequence
  Peptide Derived from Human Papillomavirus
GIIILLLIRF

SEQ ID NO: 14483 - protein, 8 aa, Artificial Sequence
  Peptide Derived from Human Papillomavirus
GIPKKSCM

SEQ ID NO: 14484 - protein, 9 aa, Artificial Sequence
  Peptide Derived from Human Papillomavirus
GIPKKSCML

SEQ ID NO: 14485 - protein, 10 aa, Artificial Sequence
  Peptide Derived from Human Papillomavirus
GIPKKSCMLI

SEQ ID NO: 14486 - protein, 11 aa, Artificial Sequence
  Peptide Derived from Human Papillomavirus
GISFMELVRPF

SEQ ID NO: 14487 - protein, 10 aa, Artificial Sequence
  Peptide Derived from Human Papillomavirus
GISPSVAESL

SEQ ID NO: 14488 - protein, 8 aa, Artificial Sequence
  Peptide Derived from Human Papillomavirus
GMGCTGWF

SEQ ID NO: 14489 - protein, 9 aa, Artificial Sequence
  Peptide Derived from Human Papillomavirus
GMIDDVTPI

SEQ ID NO: 14490 - protein, 11 aa, Artificial Sequence
  Peptide Derived from Human Papillomavirus
GMIDDVTPISW

SEQ ID NO: 14491 - protein, 8 aa, Artificial Sequence
  Peptide Derived from Human Papillomavirus
GMSLIQFL

SEQ ID NO: 14492 - protein, 8 aa, Artificial Sequence
  Peptide Derived from Human Papillomavirus
GTDLLEFI

SEQ ID NO: 14493 - protein, 8 aa, Artificial Sequence
  Peptide Derived from Human Papillomavirus
GTDSRWPY

SEQ ID NO: 14494 - protein, 9 aa, Artificial Sequence
  Peptide Derived from Human Papillomavirus
GTDSRWPYL

SEQ ID NO: 14495 - protein, 10 aa, Artificial Sequence
  Peptide Derived from Human Papillomavirus
GTTPEWIDRL

SEQ ID NO: 14496 - protein, 9 aa, Artificial Sequence
  Peptide Derived from Human Papillomavirus
GWFEVEAVI

SEQ ID NO: 14497 - protein, 11 aa, Artificial Sequence
  Peptide Derived from Human Papillomavirus
HLQCLTCDRGI

SEQ ID NO: 14498 - protein, 10 aa, Artificial Sequence
  Peptide Derived from Human Papillomavirus
HYKKAEKRKM

SEQ ID NO: 14499 - protein, 10 aa, Artificial Sequence
  Peptide Derived from Human Papillomavirus
IFDLSEMVQW

SEQ ID NO: 14500 - protein, 9 aa, Artificial Sequence
  Peptide Derived from Human Papillomavirus
IIILLLIRF

SEQ ID NO: 14501 - protein, 8 aa, Artificial Sequence
  Peptide Derived from Human Papillomavirus
IILLLIRF

SEQ ID NO: 14502 - protein, 9 aa, Artificial Sequence
  Peptide Derived from Human Papillomavirus
ILYKFKEAY

SEQ ID NO: 14503 - protein, 11 aa, Artificial Sequence
  Peptide Derived from Human Papillomavirus
ILYKFKEAYGI

SEQ ID NO: 14504 - protein, 8 aa, Artificial Sequence
  Peptide Derived from Human Papillomavirus
IVKDCGIM

SEQ ID NO: 14505 - protein, 10 aa, Artificial Sequence
  Peptide Derived from Human Papillomavirus
IVQLLRYQNI

SEQ ID NO: 14506 - protein, 8 aa, Artificial Sequence
  Peptide Derived from Human Papillomavirus
KFKEAYGI

SEQ ID NO: 14507 - protein, 10 aa, Artificial Sequence
  Peptide Derived from Human Papillomavirus
KFKEAYGISF

SEQ ID NO: 14508 - protein, 11 aa, Artificial Sequence
  Peptide Derived from Human Papillomavirus
KFKEAYGISFM

SEQ ID NO: 14509 - protein, 10 aa, Artificial Sequence
  Peptide Derived from Human Papillomavirus
KIDELEDSGY

SEQ ID NO: 14510 - protein, 11 aa, Artificial Sequence
  Peptide Derived from Human Papillomavirus
KIGMIDDVTPI

SEQ ID NO: 14511 - protein, 8 aa, Artificial Sequence
  Peptide Derived from Human Papillomavirus
KIVKDCGI

SEQ ID NO: 14512 - protein, 9 aa, Artificial Sequence
  Peptide Derived from Human Papillomavirus
KIVKDCGIM

SEQ ID NO: 14513 - protein, 9 aa, Artificial Sequence
  Peptide Derived from Human Papillomavirus
KLMSNLLSI

SEQ ID NO: 14514 - protein, 9 aa, Artificial Sequence
  Peptide Derived from Human Papillomavirus
KLRSQTCAL

SEQ ID NO: 14515 - protein, 10 aa, Artificial Sequence
  Peptide Derived from Human Papillomavirus
KLRSQTCALY

SEQ ID NO: 14516 - protein, 11 aa, Artificial Sequence
  Peptide Derived from Human Papillomavirus
KLRSQTCALYW

SEQ ID NO: 14517 - protein, 8 aa, Artificial Sequence
  Peptide Derived from Human Papillomavirus
KMSIGQWI

SEQ ID NO: 14518 - protein, 8 aa, Artificial Sequence
  Peptide Derived from Human Papillomavirus
KTNDGGNW

SEQ ID NO: 14519 - protein, 11 aa, Artificial Sequence
  Peptide Derived from Human Papillomavirus
KTNDGGNWRPI

SEQ ID NO: 14520 - protein, 9 aa, Artificial Sequence
  Peptide Derived from Human Papillomavirus
KTSCTDWCI

SEQ ID NO: 14521 - protein, 9 aa, Artificial Sequence
  Peptide Derived from Human Papillomavirus
KVLIKQHSL

SEQ ID NO: 14522 - protein, 10 aa, Artificial Sequence
  Peptide Derived from Human Papillomavirus
KVLIKQHSLY

SEQ ID NO: 14523 - protein, 11 aa, Artificial Sequence
  Peptide Derived from Human Papillomavirus
LFNIQEGEDDL

SEQ ID NO: 14524 - protein, 8 aa, Artificial Sequence
  Peptide Derived from Human Papillomavirus
LIKQHSLY

SEQ ID NO: 14525 - protein, 11 aa, Artificial Sequence
  Peptide Derived from Human Papillomavirus
LIKQHSLYTHL

SEQ ID NO: 14526 - protein, 10 aa, Artificial Sequence
  Peptide Derived from Human Papillomavirus
LIQFLKGCVI

SEQ ID NO: 14527 - protein, 11 aa, Artificial Sequence
  Peptide Derived from Human Papillomavirus
LIRFRCSKNRL

SEQ ID NO: 14528 - protein, 9 aa, Artificial Sequence
  Peptide Derived from Human Papillomavirus
LLEFIDDSM

SEQ ID NO: 14529 - protein, 9 aa, Artificial Sequence
  Peptide Derived from Human Papillomavirus
LLRYQNIEF

SEQ ID NO: 14530 - protein, 9 aa, Artificial Sequence
  Peptide Derived from Human Papillomavirus
LLSIPETCM

SEQ ID NO: 14531 - protein, 11 aa, Artificial Sequence
  Peptide Derived from Human Papillomavirus
LLSIPETCMVI

SEQ ID NO: 14532 - protein, 8 aa, Artificial Sequence
  Peptide Derived from Human Papillomavirus
LMSNLLSI

SEQ ID NO: 14533 - protein, 8 aa, Artificial Sequence
  Peptide Derived from Human Papillomavirus
LTCDRGII

SEQ ID NO: 14534 - protein, 9 aa, Artificial Sequence
  Peptide Derived from Human Papillomavirus
LTCDRGIII

SEQ ID NO: 14535 - protein, 10 aa, Artificial Sequence
  Peptide Derived from Human Papillomavirus
LTCDRGIIIL

SEQ ID NO: 14536 - protein, 11 aa, Artificial Sequence
  Peptide Derived from Human Papillomavirus
LTCDRGIIILL

SEQ ID NO: 14537 - protein, 9 aa, Artificial Sequence
  Peptide Derived from Human Papillomavirus
LTDDSDIAY

SEQ ID NO: 14538 - protein, 10 aa, Artificial Sequence
  Peptide Derived from Human Papillomavirus
LTDDSDIAYY

SEQ ID NO: 14539 - protein, 11 aa, Artificial Sequence
  Peptide Derived from Human Papillomavirus
LTDDSDIAYYY

SEQ ID NO: 14540 - protein, 10 aa, Artificial Sequence
  Peptide Derived from Human Papillomavirus
LTVAKLMSNL

SEQ ID NO: 14541 - protein, 11 aa, Artificial Sequence
  Peptide Derived from Human Papillomavirus
LTVAKLMSNLL

SEQ ID NO: 14542 - protein, 10 aa, Artificial Sequence
  Peptide Derived from Human Papillomavirus
LTVFEFKNPF

SEQ ID NO: 14543 - protein, 8 aa, Artificial Sequence
  Peptide Derived from Human Papillomavirus
LTVLQHSF

SEQ ID NO: 14544 - protein, 9 aa, Artificial Sequence
  Peptide Derived from Human Papillomavirus
LVQLKCPPL

SEQ ID NO: 14545 - protein, 10 aa, Artificial Sequence
  Peptide Derived from Human Papillomavirus
LVQLKCPPLL

SEQ ID NO: 14546 - protein, 11 aa, Artificial Sequence
  Peptide Derived from Human Papillomavirus
LVQLKCPPLLL

SEQ ID NO: 14547 - protein, 8 aa, Artificial Sequence
  Peptide Derived from Human Papillomavirus
LYKFKEAY

SEQ ID NO: 14548 - protein, 10 aa, Artificial Sequence
  Peptide Derived from Human Papillomavirus
LYKFKEAYGI

SEQ ID NO: 14549 - protein, 8 aa, Artificial Sequence
  Peptide Derived from Human Papillomavirus
LYTHLQCL

SEQ ID NO: 14550 - protein, 8 aa, Artificial Sequence
  Peptide Derived from Human Papillomavirus
LYWFRTAM

SEQ ID NO: 14551 - protein, 11 aa, Artificial Sequence
  Peptide Derived from Human Papillomavirus
LYWFRTAMSNI

SEQ ID NO: 14552 - protein, 8 aa, Artificial Sequence
  Peptide Derived from Human Papillomavirus
MIDDVTPI

SEQ ID NO: 14553 - protein, 10 aa, Artificial Sequence
  Peptide Derived from Human Papillomavirus
MIDDVTPISW

SEQ ID NO: 14554 - protein, 8 aa, Artificial Sequence
  Peptide Derived from Human Papillomavirus
MVIEPPKL

SEQ ID NO: 14555 - protein, 10 aa, Artificial Sequence
  Peptide Derived from Human Papillomavirus
MVQWAYDNEL

SEQ ID NO: 14556 - protein, 8 aa, Artificial Sequence
  Peptide Derived from Human Papillomavirus
NIEFTAFL

SEQ ID NO: 14557 - protein, 11 aa, Artificial Sequence
  Peptide Derived from Human Papillomavirus
NIEFTAFLGAF

SEQ ID NO: 14558 - protein, 8 aa, Artificial Sequence
  Peptide Derived from Human Papillomavirus
NIFDLSEM

SEQ ID NO: 14559 - protein, 11 aa, Artificial Sequence
  Peptide Derived from Human Papillomavirus
NIFDLSEMVQW

SEQ ID NO: 14560 - protein, 10 aa, Artificial Sequence
  Peptide Derived from Human Papillomavirus
NILYKFKEAY

SEQ ID NO: 14561 - protein, 9 aa, Artificial Sequence
  Peptide Derived from Human Papillomavirus
NIQEGEDDL

SEQ ID NO: 14562 - protein, 10 aa, Artificial Sequence
  Peptide Derived from Human Papillomavirus
NLLSIPETCM

SEQ ID NO: 14563 - protein, 9 aa, Artificial Sequence
  Peptide Derived from Human Papillomavirus
NTEVETQQM

SEQ ID NO: 14564 - protein, 9 aa, Artificial Sequence
  Peptide Derived from Human Papillomavirus
NTGKSYFGM

SEQ ID NO: 14565 - protein, 11 aa, Artificial Sequence
  Peptide Derived from Human Papillomavirus
NTGKSYFGMSL

SEQ ID NO: 14566 - protein, 8 aa, Artificial Sequence
  Peptide Derived from Human Papillomavirus
NTKANILY

SEQ ID NO: 14567 - protein, 10 aa, Artificial Sequence
  Peptide Derived from Human Papillomavirus
NTKANILYKF

SEQ ID NO: 14568 - protein, 10 aa, Artificial Sequence
  Peptide Derived from Human Papillomavirus
NTNAGTDSRW

SEQ ID NO: 14569 - protein, 10 aa, Artificial Sequence
  Peptide Derived from Human Papillomavirus
NVDSCENVTL

SEQ ID NO: 14570 - protein, 11 aa, Artificial Sequence
  Peptide Derived from Human Papillomavirus
NVTLQEISNVL

SEQ ID NO: 14571 - protein, 10 aa, Artificial Sequence
  Peptide Derived from Human Papillomavirus
NWKSFFSRTW

SEQ ID NO: 14572 - protein, 8 aa, Artificial Sequence
  Peptide Derived from Human Papillomavirus
NWRPIVQL

SEQ ID NO: 14573 - protein, 9 aa, Artificial Sequence
  Peptide Derived from Human Papillomavirus
NWRPIVQLL

SEQ ID NO: 14574 - protein, 11 aa, Artificial Sequence
  Peptide Derived from Human Papillomavirus
NWRPIVQLLRY

SEQ ID NO: 14575 - protein, 10 aa, Artificial Sequence
  Peptide Derived from Human Papillomavirus
PFDENGNPVY

SEQ ID NO: 14576 - protein, 10 aa, Artificial Sequence
  Peptide Derived from Human Papillomavirus
PISWTYIDDY

SEQ ID NO: 14577 - protein, 11 aa, Artificial Sequence
  Peptide Derived from Human Papillomavirus
PISWTYIDDYM

SEQ ID NO: 14578 - protein, 8 aa, Artificial Sequence
  Peptide Derived from Human Papillomavirus
PIVQLLRY

SEQ ID NO: 14579 - protein, 11 aa, Artificial Sequence
  Peptide Derived from Human Papillomavirus
PIVQLLRYQNI

SEQ ID NO: 14580 - protein, 9 aa, Artificial Sequence
  Peptide Derived from Human Papillomavirus
PLSDAKIGM

SEQ ID NO: 14581 - protein, 10 aa, Artificial Sequence
  Peptide Derived from Human Papillomavirus
PLSDAKIGMI

SEQ ID NO: 14582 - protein, 10 aa, Artificial Sequence
  Peptide Derived from Human Papillomavirus
PVYAINDENW

SEQ ID NO: 14583 - protein, 10 aa, Artificial Sequence
  Peptide Derived from Human Papillomavirus
PYLHSRLTVF

SEQ ID NO: 14584 - protein, 8 aa, Artificial Sequence
  Peptide Derived from Human Papillomavirus
QFLKGCVI

SEQ ID NO: 14585 - protein, 8 aa, Artificial Sequence
  Peptide Derived from Human Papillomavirus
QLKCPPLL

SEQ ID NO: 14586 - protein, 9 aa, Artificial Sequence
  Peptide Derived from Human Papillomavirus
QLKCPPLLL

SEQ ID NO: 14587 - protein, 8 aa, Artificial Sequence
  Peptide Derived from Human Papillomavirus
QLLRYQNI

SEQ ID NO: 14588 - protein, 10 aa, Artificial Sequence
  Peptide Derived from Human Papillomavirus
QLLRYQNIEF

SEQ ID NO: 14589 - protein, 8 aa, Artificial Sequence
  Peptide Derived from Human Papillomavirus
QTCALYWF

SEQ ID NO: 14590 - protein, 11 aa, Artificial Sequence
  Peptide Derived from Human Papillomavirus
QVESQNGDTNL

SEQ ID NO: 14591 - protein, 8 aa, Artificial Sequence
  Peptide Derived from Human Papillomavirus
QWAYDNEL

SEQ ID NO: 14592 - protein, 9 aa, Artificial Sequence
  Peptide Derived from Human Papillomavirus
RFRCSKNRL

SEQ ID NO: 14593 - protein, 8 aa, Artificial Sequence
  Peptide Derived from Human Papillomavirus
RLTVAKLM

SEQ ID NO: 14594 - protein, 11 aa, Artificial Sequence
  Peptide Derived from Human Papillomavirus
RLTVAKLMSNL

SEQ ID NO: 14595 - protein, 11 aa, Artificial Sequence
  Peptide Derived from Human Papillomavirus
RLTVFEFKNPF

SEQ ID NO: 14596 - protein, 9 aa, Artificial Sequence
  Peptide Derived from Human Papillomavirus
RLTVLQHSF

SEQ ID NO: 14597 - protein, 8 aa, Artificial Sequence
  Peptide Derived from Human Papillomavirus
RTWCKLDL

SEQ ID NO: 14598 - protein, 9 aa, Artificial Sequence
  Peptide Derived from Human Papillomavirus
RTWCKLDLI

SEQ ID NO: 14599 - protein, 9 aa, Artificial Sequence
  Peptide Derived from Human Papillomavirus
RWPYLHSRL

SEQ ID NO: 14600 - protein, 10 aa, Artificial Sequence
  Peptide Derived from Human Papillomavirus
RYQNIEFTAF

SEQ ID NO: 14601 - protein, 11 aa, Artificial Sequence
  Peptide Derived from Human Papillomavirus
RYQNIEFTAFL

SEQ ID NO: 14602 - protein, 10 aa, Artificial Sequence
  Peptide Derived from Human Papillomavirus
SFFSRTWCKL

SEQ ID NO: 14603 - protein, 9 aa, Artificial Sequence
  Peptide Derived from Human Papillomavirus
SFMELVRPF

SEQ ID NO: 14604 - protein, 9 aa, Artificial Sequence
  Peptide Derived from Human Papillomavirus
SFNDNIFDL

SEQ ID NO: 14605 - protein, 9 aa, Artificial Sequence
  Peptide Derived from Human Papillomavirus
SIDVKHRAL

SEQ ID NO: 14606 - protein, 10 aa, Artificial Sequence
  Peptide Derived from Human Papillomavirus
SINKNKECTY

SEQ ID NO: 14607 - protein, 9 aa, Artificial Sequence
  Peptide Derived from Human Papillomavirus
SIPETCMVI

SEQ ID NO: 14608 - protein, 11 aa, Artificial Sequence
  Peptide Derived from Human Papillomavirus
SLIQFLKGCVI

SEQ ID NO: 14609 - protein, 11 aa, Artificial Sequence
  Peptide Derived from Human Papillomavirus
SLKVLIKQHSL

SEQ ID NO: 14610 - protein, 9 aa, Artificial Sequence
  Peptide Derived from Human Papillomavirus
SLYTHLQCL

SEQ ID NO: 14611 - protein, 9 aa, Artificial Sequence
  Peptide Derived from Human Papillomavirus
SVAESLKVL

SEQ ID NO: 14612 - protein, 10 aa, Artificial Sequence
  Peptide Derived from Human Papillomavirus
SVAESLKVLI

SEQ ID NO: 14613 - protein, 8 aa, Artificial Sequence
  Peptide Derived from Human Papillomavirus
SWTYIDDY

SEQ ID NO: 14614 - protein, 9 aa, Artificial Sequence
  Peptide Derived from Human Papillomavirus
SWTYIDDYM

SEQ ID NO: 14615 - protein, 8 aa, Artificial Sequence
  Peptide Derived from Human Papillomavirus
SYFGMSLI

SEQ ID NO: 14616 - protein, 10 aa, Artificial Sequence
  Peptide Derived from Human Papillomavirus
SYFGMSLIQF

SEQ ID NO: 14617 - protein, 11 aa, Artificial Sequence
  Peptide Derived from Human Papillomavirus
SYFGMSLIQFL

SEQ ID NO: 14618 - protein, 9 aa, Artificial Sequence
  Peptide Derived from Human Papillomavirus
TLQEISNVL

SEQ ID NO: 14619 - protein, 9 aa, Artificial Sequence
  Peptide Derived from Human Papillomavirus
TTPEWIDRL

SEQ ID NO: 14620 - protein, 9 aa, Artificial Sequence
  Peptide Derived from Human Papillomavirus
TVAKLMSNL

SEQ ID NO: 14621 - protein, 10 aa, Artificial Sequence
  Peptide Derived from Human Papillomavirus
TVAKLMSNLL

SEQ ID NO: 14622 - protein, 9 aa, Artificial Sequence
  Peptide Derived from Human Papillomavirus
TVFEFKNPF

SEQ ID NO: 14623 - protein, 11 aa, Artificial Sequence
  Peptide Derived from Human Papillomavirus
TVFEFKNPFPF

SEQ ID NO: 14624 - protein, 11 aa, Artificial Sequence
  Peptide Derived from Human Papillomavirus
TVLQHSFNDNI

SEQ ID NO: 14625 - protein, 8 aa, Artificial Sequence
  Peptide Derived from Human Papillomavirus
TWCKLDLI

SEQ ID NO: 14626 - protein, 11 aa, Artificial Sequence
  Peptide Derived from Human Papillomavirus
TYIDDYMRNAL

SEQ ID NO: 14627 - protein, 10 aa, Artificial Sequence
  Peptide Derived from Human Papillomavirus
TYRKRKIDEL

SEQ ID NO: 14628 - protein, 8 aa, Artificial Sequence
  Peptide Derived from Human Papillomavirus
VFEFKNPF

SEQ ID NO: 14629 - protein, 10 aa, Artificial Sequence
  Peptide Derived from Human Papillomavirus
VFEFKNPFPF

SEQ ID NO: 14630 - protein, 10 aa, Artificial Sequence
  Peptide Derived from Human Papillomavirus
VIERRTGDNI

SEQ ID NO: 14631 - protein, 11 aa, Artificial Sequence
  Peptide Derived from Human Papillomavirus
VISCVNSKSHF

SEQ ID NO: 14632 - protein, 11 aa, Artificial Sequence
  Peptide Derived from Human Papillomavirus
VLHSSNTKANI

SEQ ID NO: 14633 - protein, 8 aa, Artificial Sequence
  Peptide Derived from Human Papillomavirus
VLIKQHSL

SEQ ID NO: 14634 - protein, 9 aa, Artificial Sequence
  Peptide Derived from Human Papillomavirus
VLIKQHSLY

SEQ ID NO: 14635 - protein, 10 aa, Artificial Sequence
  Peptide Derived from Human Papillomavirus
VLQHSFNDNI

SEQ ID NO: 14636 - protein, 11 aa, Artificial Sequence
  Peptide Derived from Human Papillomavirus
VLQHSFNDNIF

SEQ ID NO: 14637 - protein, 10 aa, Artificial Sequence
  Peptide Derived from Human Papillomavirus
VTLQEISNVL

SEQ ID NO: 14638 - protein, 8 aa, Artificial Sequence
  Peptide Derived from Human Papillomavirus
VTPISWTY

SEQ ID NO: 14639 - protein, 9 aa, Artificial Sequence
  Peptide Derived from Human Papillomavirus
VTPISWTYI

SEQ ID NO: 14640 - protein, 9 aa, Artificial Sequence
  Peptide Derived from Human Papillomavirus
VYAINDENW

SEQ ID NO: 14641 - protein, 8 aa, Artificial Sequence
  Peptide Derived from Human Papillomavirus
WFEVEAVI

SEQ ID NO: 14642 - protein, 9 aa, Artificial Sequence
  Peptide Derived from Human Papillomavirus
WFRTAMSNI

SEQ ID NO: 14643 - protein, 8 aa, Artificial Sequence
  Peptide Derived from Human Papillomavirus
WIDRLTVL

SEQ ID NO: 14644 - protein, 10 aa, Artificial Sequence
  Peptide Derived from Human Papillomavirus
WLQPLSDAKI

SEQ ID NO: 14645 - protein, 8 aa, Artificial Sequence
  Peptide Derived from Human Papillomavirus
WTYIDDYM

SEQ ID NO: 14646 - protein, 9 aa, Artificial Sequence
  Peptide Derived from Human Papillomavirus
YFGMSLIQF

SEQ ID NO: 14647 - protein, 10 aa, Artificial Sequence
  Peptide Derived from Human Papillomavirus
YFGMSLIQFL

SEQ ID NO: 14648 - protein, 10 aa, Artificial Sequence
  Peptide Derived from Human Papillomavirus
YIDDYMRNAL

SEQ ID NO: 14649 - protein, 9 aa, Artificial Sequence
  Peptide Derived from Human Papillomavirus
YLHSRLTVF

SEQ ID NO: 14650 - protein, 11 aa, Artificial Sequence
  Peptide Derived from Human Papillomavirus
YLHSRLTVFEF

SEQ ID NO: 14651 - protein, 11 aa, Artificial Sequence
  Peptide Derived from Human Papillomavirus
YMRNALDGNEI

SEQ ID NO: 14652 - protein, 10 aa, Artificial Sequence
  Peptide Derived from Human Papillomavirus
YWFRTAMSNI

SEQ ID NO: 14653 - protein, 9 aa, Artificial Sequence
  Peptide Derived from Human Papillomavirus
AFQVIELQM

SEQ ID NO: 14654 - protein, 11 aa, Artificial Sequence
  Peptide Derived from Human Papillomavirus
AFQVIELQMAL

SEQ ID NO: 14655 - protein, 10 aa, Artificial Sequence
  Peptide Derived from Human Papillomavirus
ALETLSKSQY

SEQ ID NO: 14656 - protein, 9 aa, Artificial Sequence
  Peptide Derived from Human Papillomavirus
ALLYTAKQM

SEQ ID NO: 14657 - protein, 11 aa, Artificial Sequence
  Peptide Derived from Human Papillomavirus
ALLYTAKQMGF

SEQ ID NO: 14658 - protein, 9 aa, Artificial Sequence
  Peptide Derived from Human Papillomavirus
AVQEKILDL

SEQ ID NO: 14659 - protein, 10 aa, Artificial Sequence
  Peptide Derived from Human Papillomavirus
AVQEKILDLY

SEQ ID NO: 14660 - protein, 9 aa, Artificial Sequence
  Peptide Derived from Human Papillomavirus
CLRYRLKPY

SEQ ID NO: 14661 - protein, 10 aa, Artificial Sequence
  Peptide Derived from Human Papillomavirus
CTMVTGKVDY

SEQ ID NO: 14662 - protein, 11 aa, Artificial Sequence
  Peptide Derived from Human Papillomavirus
CTMVTGKVDYI

SEQ ID NO: 14663 - protein, 9 aa, Artificial Sequence
  Peptide Derived from Human Papillomavirus
DLPSQIEHW

SEQ ID NO: 14664 - protein, 11 aa, Artificial Sequence
  Peptide Derived from Human Papillomavirus
DLPSQIEHWKL

SEQ ID NO: 14665 - protein, 10 aa, Artificial Sequence
  Peptide Derived from Human Papillomavirus
DLYEADKTDL

SEQ ID NO: 14666 - protein, 9 aa, Artificial Sequence
  Peptide Derived from Human Papillomavirus
DTAQPLTKL

SEQ ID NO: 14667 - protein, 10 aa, Artificial Sequence
  Peptide Derived from Human Papillomavirus
DTAQPLTKLF

SEQ ID NO: 14668 - protein, 9 aa, Artificial Sequence
  Peptide Derived from Human Papillomavirus
DTTDTAQPL

SEQ ID NO: 14669 - protein, 8 aa, Artificial Sequence
  Peptide Derived from Human Papillomavirus
DYIGMYYI

SEQ ID NO: 14670 - protein, 8 aa, Artificial Sequence
  Peptide Derived from Human Papillomavirus
DYTNWGEI

SEQ ID NO: 14671 - protein, 9 aa, Artificial Sequence
  Peptide Derived from Human Papillomavirus
DYTNWGEIY

SEQ ID NO: 14672 - protein, 10 aa, Artificial Sequence
  Peptide Derived from Human Papillomavirus
DYTNWGEIYI

SEQ ID NO: 14673 - protein, 11 aa, Artificial Sequence
  Peptide Derived from Human Papillomavirus
DYTNWGEIYII

SEQ ID NO: 14674 - protein, 9 aa, Artificial Sequence
  Peptide Derived from Human Papillomavirus
ELQMALETL

SEQ ID NO: 14675 - protein, 10 aa, Artificial Sequence
  Peptide Derived from Human Papillomavirus
ELYSSMSSTW

SEQ ID NO: 14676 - protein, 8 aa, Artificial Sequence
  Peptide Derived from Human Papillomavirus
ETLSKSQY

SEQ ID NO: 14677 - protein, 9 aa, Artificial Sequence
  Peptide Derived from Human Papillomavirus
EVHVGGQVI

SEQ ID NO: 14678 - protein, 11 aa, Artificial Sequence
  Peptide Derived from Human Papillomavirus
EVWLCEPPKCF

SEQ ID NO: 14679 - protein, 9 aa, Artificial Sequence
  Peptide Derived from Human Papillomavirus
FVTEQQQQM

SEQ ID NO: 14680 - protein, 10 aa, Artificial Sequence
  Peptide Derived from Human Papillomavirus
FVTEQQQQMF

SEQ ID NO: 14681 - protein, 11 aa, Artificial Sequence
  Peptide Derived from Human Papillomavirus
FVTEQQQQMFL

SEQ ID NO: 14682 - protein, 11 aa, Artificial Sequence
  Peptide Derived from Human Papillomavirus
GTVKIPPTVQI

SEQ ID NO: 14683 - protein, 10 aa, Artificial Sequence
  Peptide Derived from Human Papillomavirus
HLCHQVVPSL

SEQ ID NO: 14684 - protein, 11 aa, Artificial Sequence
  Peptide Derived from Human Papillomavirus
HLCHQVVPSLL

SEQ ID NO: 14685 - protein, 9 aa, Artificial Sequence
  Peptide Derived from Human Papillomavirus
HLKGESNSL

SEQ ID NO: 14686 - protein, 11 aa, Artificial Sequence
  Peptide Derived from Human Papillomavirus
HWKLIRMECAL

SEQ ID NO: 14687 - protein, 9 aa, Artificial Sequence
  Peptide Derived from Human Papillomavirus
IIEEDTCTM

SEQ ID NO: 14688 - protein, 11 aa, Artificial Sequence
  Peptide Derived from Human Papillomavirus
IVHLKGESNSL

SEQ ID NO: 14689 - protein, 11 aa, Artificial Sequence
  Peptide Derived from Human Papillomavirus
IYIIEEDTCTM

SEQ ID NO: 14690 - protein, 8 aa, Artificial Sequence
  Peptide Derived from Human Papillomavirus
KIPPTVQI

SEQ ID NO: 14691 - protein, 9 aa, Artificial Sequence
  Peptide Derived from Human Papillomavirus
KLFCADPAL

SEQ ID NO: 14692 - protein, 9 aa, Artificial Sequence
  Peptide Derived from Human Papillomavirus
KLIRMECAL

SEQ ID NO: 14693 - protein, 10 aa, Artificial Sequence
  Peptide Derived from Human Papillomavirus
KLIRMECALL

SEQ ID NO: 14694 - protein, 11 aa, Artificial Sequence
  Peptide Derived from Human Papillomavirus
KLIRMECALLY

SEQ ID NO: 14695 - protein, 8 aa, Artificial Sequence
  Peptide Derived from Human Papillomavirus
KTDLPSQI

SEQ ID NO: 14696 - protein, 11 aa, Artificial Sequence
  Peptide Derived from Human Papillomavirus
KTDLPSQIEHW

SEQ ID NO: 14697 - protein, 8 aa, Artificial Sequence
  Peptide Derived from Human Papillomavirus
KTKAFQVI

SEQ ID NO: 14698 - protein, 10 aa, Artificial Sequence
  Peptide Derived from Human Papillomavirus
KTKAFQVIEL

SEQ ID NO: 14699 - protein, 8 aa, Artificial Sequence
  Peptide Derived from Human Papillomavirus
KVDYIGMY

SEQ ID NO: 14700 - protein, 9 aa, Artificial Sequence
  Peptide Derived from Human Papillomavirus
KVDYIGMYY

SEQ ID NO: 14701 - protein, 10 aa, Artificial Sequence
  Peptide Derived from Human Papillomavirus
KVDYIGMYYI

SEQ ID NO: 14702 - protein, 10 aa, Artificial Sequence
  Peptide Derived from Human Papillomavirus
KYFKEDAAKY

SEQ ID NO: 14703 - protein, 8 aa, Artificial Sequence
  Peptide Derived from Human Papillomavirus
KYSKTQMW

SEQ ID NO: 14704 - protein, 8 aa, Artificial Sequence
  Peptide Derived from Human Papillomavirus
LFCADPAL

SEQ ID NO: 14705 - protein, 8 aa, Artificial Sequence
  Peptide Derived from Human Papillomavirus
LIRMECAL

SEQ ID NO: 14706 - protein, 9 aa, Artificial Sequence
  Peptide Derived from Human Papillomavirus
LIRMECALL

SEQ ID NO: 14707 - protein, 10 aa, Artificial Sequence
  Peptide Derived from Human Papillomavirus
LIRMECALLY

SEQ ID NO: 14708 - protein, 9 aa, Artificial Sequence
  Peptide Derived from Human Papillomavirus
LLASKTKAF

SEQ ID NO: 14709 - protein, 8 aa, Artificial Sequence
  Peptide Derived from Human Papillomavirus
LLYTAKQM

SEQ ID NO: 14710 - protein, 10 aa, Artificial Sequence
  Peptide Derived from Human Papillomavirus
LLYTAKQMGF

SEQ ID NO: 14711 - protein, 11 aa, Artificial Sequence
  Peptide Derived from Human Papillomavirus
LTKLFCADPAL

SEQ ID NO: 14712 - protein, 9 aa, Artificial Sequence
  Peptide Derived from Human Papillomavirus
LYEADKTDL

SEQ ID NO: 14713 - protein, 9 aa, Artificial Sequence
  Peptide Derived from Human Papillomavirus
LYSSMSSTW

SEQ ID NO: 14714 - protein, 11 aa, Artificial Sequence
  Peptide Derived from Human Papillomavirus
LYSSMSSTWHW

SEQ ID NO: 14715 - protein, 9 aa, Artificial Sequence
  Peptide Derived from Human Papillomavirus
LYTAKQMGF

SEQ ID NO: 14716 - protein, 8 aa, Artificial Sequence
  Peptide Derived from Human Papillomavirus
MFLGTVKI

SEQ ID NO: 14717 - protein, 8 aa, Artificial Sequence
  Peptide Derived from Human Papillomavirus
MVTGKVDY

SEQ ID NO: 14718 - protein, 9 aa, Artificial Sequence
  Peptide Derived from Human Papillomavirus
MVTGKVDYI

SEQ ID NO: 14719 - protein, 11 aa, Artificial Sequence
  Peptide Derived from Human Papillomavirus
MVTGKVDYIGM

SEQ ID NO: 14720 - protein, 11 aa, Artificial Sequence
  Peptide Derived from Human Papillomavirus
MWEVHVGGQVI

SEQ ID NO: 14721 - protein, 11 aa, Artificial Sequence
  Peptide Derived from Human Papillomavirus
MYYIHNCEKVY

SEQ ID NO: 14722 - protein, 8 aa, Artificial Sequence
  Peptide Derived from Human Papillomavirus
NTMDYTNW

SEQ ID NO: 14723 - protein, 11 aa, Artificial Sequence
  Peptide Derived from Human Papillomavirus
NTMDYTNWGEI

SEQ ID NO: 14724 - protein, 8 aa, Artificial Sequence
  Peptide Derived from Human Papillomavirus
NVAPIVHL

SEQ ID NO: 14725 - protein, 8 aa, Artificial Sequence
  Peptide Derived from Human Papillomavirus
NWGEIYII

SEQ ID NO: 14726 - protein, 9 aa, Artificial Sequence
  Peptide Derived from Human Papillomavirus
PTSISSNQI

SEQ ID NO: 14727 - protein, 9 aa, Artificial Sequence
  Peptide Derived from Human Papillomavirus
PTVQISTGF

SEQ ID NO: 14728 - protein, 10 aa, Artificial Sequence
  Peptide Derived from Human Papillomavirus
PTVQISTGFM

SEQ ID NO: 14729 - protein, 9 aa, Artificial Sequence
  Peptide Derived from Human Papillomavirus
PYKELYSSM

SEQ ID NO: 14730 - protein, 8 aa, Artificial Sequence
  Peptide Derived from Human Papillomavirus
QIEHWKLI

SEQ ID NO: 14731 - protein, 10 aa, Artificial Sequence
  Peptide Derived from Human Papillomavirus
QIEHWKLIRM

SEQ ID NO: 14732 - protein, 9 aa, Artificial Sequence
  Peptide Derived from Human Papillomavirus
QISTGFMTL

SEQ ID NO: 14733 - protein, 10 aa, Artificial Sequence
  Peptide Derived from Human Papillomavirus
QISTTETADI

SEQ ID NO: 14734 - protein, 9 aa, Artificial Sequence
  Peptide Derived from Human Papillomavirus
QMFLGTVKI

SEQ ID NO: 14735 - protein, 8 aa, Artificial Sequence
  Peptide Derived from Human Papillomavirus
QTSLEVWL

SEQ ID NO: 14736 - protein, 9 aa, Artificial Sequence
  Peptide Derived from Human Papillomavirus
QVIELQMAL

SEQ ID NO: 14737 - protein, 9 aa, Artificial Sequence
  Peptide Derived from Human Papillomavirus
QVIVCPTSI

SEQ ID NO: 14738 - protein, 9 aa, Artificial Sequence
  Peptide Derived from Human Papillomavirus
QWTLQQTSL

SEQ ID NO: 14739 - protein, 10 aa, Artificial Sequence
  Peptide Derived from Human Papillomavirus
QYDNDKKNTM

SEQ ID NO: 14740 - protein, 9 aa, Artificial Sequence
  Peptide Derived from Human Papillomavirus
QYSTSQWTL

SEQ ID NO: 14741 - protein, 8 aa, Artificial Sequence
  Peptide Derived from Human Papillomavirus
RLKPYKEL

SEQ ID NO: 14742 - protein, 9 aa, Artificial Sequence
  Peptide Derived from Human Papillomavirus
RLKPYKELY

SEQ ID NO: 14743 - protein, 9 aa, Artificial Sequence
  Peptide Derived from Human Papillomavirus
RLNAVQEKI

SEQ ID NO: 14744 - protein, 10 aa, Artificial Sequence
  Peptide Derived from Human Papillomavirus
RLNAVQEKIL

SEQ ID NO: 14745 - protein, 8 aa, Artificial Sequence
  Peptide Derived from Human Papillomavirus
RMECALLY

SEQ ID NO: 14746 - protein, 11 aa, Artificial Sequence
  Peptide Derived from Human Papillomavirus
RTVCSSNVAPI

SEQ ID NO: 14747 - protein, 10 aa, Artificial Sequence
  Peptide Derived from Human Papillomavirus
RYRLKPYKEL

SEQ ID NO: 14748 - protein, 11 aa, Artificial Sequence
  Peptide Derived from Human Papillomavirus
RYRLKPYKELY

SEQ ID NO: 14749 - protein, 9 aa, Artificial Sequence
  Peptide Derived from Human Papillomavirus
SLKCLRYRL

SEQ ID NO: 14750 - protein, 10 aa, Artificial Sequence
  Peptide Derived from Human Papillomavirus
SLLASKTKAF

SEQ ID NO: 14751 - protein, 8 aa, Artificial Sequence
  Peptide Derived from Human Papillomavirus
SMSSTWHW

SEQ ID NO: 14752 - protein, 8 aa, Artificial Sequence
  Peptide Derived from Human Papillomavirus
STTETADI

SEQ ID NO: 14753 - protein, 10 aa, Artificial Sequence
  Peptide Derived from Human Papillomavirus
TFVTEQQQQM

SEQ ID NO: 14754 - protein, 11 aa, Artificial Sequence
  Peptide Derived from Human Papillomavirus
TFVTEQQQQMF

SEQ ID NO: 14755 - protein, 10 aa, Artificial Sequence
  Peptide Derived from Human Papillomavirus
TLQQTSLEVW

SEQ ID NO: 14756 - protein, 11 aa, Artificial Sequence
  Peptide Derived from Human Papillomavirus
TLQQTSLEVWL

SEQ ID NO: 14757 - protein, 10 aa, Artificial Sequence
  Peptide Derived from Human Papillomavirus
TMDYTNWGEI

SEQ ID NO: 14758 - protein, 11 aa, Artificial Sequence
  Peptide Derived from Human Papillomavirus
TMDYTNWGEIY

SEQ ID NO: 14759 - protein, 9 aa, Artificial Sequence
  Peptide Derived from Human Papillomavirus
TMVTGKVDY

SEQ ID NO: 14760 - protein, 10 aa, Artificial Sequence
  Peptide Derived from Human Papillomavirus
TMVTGKVDYI

SEQ ID NO: 14761 - protein, 8 aa, Artificial Sequence
  Peptide Derived from Human Papillomavirus
TTDTAQPL

SEQ ID NO: 14762 - protein, 11 aa, Artificial Sequence
  Peptide Derived from Human Papillomavirus
TTDTAQPLTKL

SEQ ID NO: 14763 - protein, 10 aa, Artificial Sequence
  Peptide Derived from Human Papillomavirus
TVCSSNVAPI

SEQ ID NO: 14764 - protein, 10 aa, Artificial Sequence
  Peptide Derived from Human Papillomavirus
TVKIPPTVQI

SEQ ID NO: 14765 - protein, 8 aa, Artificial Sequence
  Peptide Derived from Human Papillomavirus
TVQISTGF

SEQ ID NO: 14766 - protein, 9 aa, Artificial Sequence
  Peptide Derived from Human Papillomavirus
TVQISTGFM

SEQ ID NO: 14767 - protein, 11 aa, Artificial Sequence
  Peptide Derived from Human Papillomavirus
TVQISTGFMTL

SEQ ID NO: 14768 - protein, 8 aa, Artificial Sequence
  Peptide Derived from Human Papillomavirus
VIELQMAL

SEQ ID NO: 14769 - protein, 11 aa, Artificial Sequence
  Peptide Derived from Human Papillomavirus
VIELQMALETL

SEQ ID NO: 14770 - protein, 8 aa, Artificial Sequence
  Peptide Derived from Human Papillomavirus
VIVCPTSI

SEQ ID NO: 14771 - protein, 8 aa, Artificial Sequence
  Peptide Derived from Human Papillomavirus
VTEQQQQM

SEQ ID NO: 14772 - protein, 9 aa, Artificial Sequence
  Peptide Derived from Human Papillomavirus
VTEQQQQMF

SEQ ID NO: 14773 - protein, 10 aa, Artificial Sequence
  Peptide Derived from Human Papillomavirus
VTEQQQQMFL

SEQ ID NO: 14774 - protein, 11 aa, Artificial Sequence
  Peptide Derived from Human Papillomavirus
VTFVTEQQQQM

SEQ ID NO: 14775 - protein, 8 aa, Artificial Sequence
  Peptide Derived from Human Papillomavirus
VTGKVDYI

SEQ ID NO: 14776 - protein, 10 aa, Artificial Sequence
  Peptide Derived from Human Papillomavirus
VTGKVDYIGM

SEQ ID NO: 14777 - protein, 11 aa, Artificial Sequence
  Peptide Derived from Human Papillomavirus
VTGKVDYIGMY

SEQ ID NO: 14778 - protein, 10 aa, Artificial Sequence
  Peptide Derived from Human Papillomavirus
VWLCEPPKCF

SEQ ID NO: 14779 - protein, 9 aa, Artificial Sequence
  Peptide Derived from Human Papillomavirus
WLCEPPKCF

SEQ ID NO: 14780 - protein, 8 aa, Artificial Sequence
  Peptide Derived from Human Papillomavirus
WTLQQTSL

SEQ ID NO: 14781 - protein, 11 aa, Artificial Sequence
  Peptide Derived from Human Papillomavirus
WTLQQTSLEVW

SEQ ID NO: 14782 - protein, 9 aa, Artificial Sequence
  Peptide Derived from Human Papillomavirus
YFKEDAAKY

SEQ ID NO: 14783 - protein, 9 aa, Artificial Sequence
  Peptide Derived from Human Papillomavirus
YIHNCEKVY

SEQ ID NO: 14784 - protein, 10 aa, Artificial Sequence
  Peptide Derived from Human Papillomavirus
YIHNCEKVYF

SEQ ID NO: 14785 - protein, 10 aa, Artificial Sequence
  Peptide Derived from Human Papillomavirus
YIIEEDTCTM

SEQ ID NO: 14786 - protein, 8 aa, Artificial Sequence
  Peptide Derived from Human Papillomavirus
YTAKQMGF

SEQ ID NO: 14787 - protein, 11 aa, Artificial Sequence
  Peptide Derived from Human Papillomavirus
YTAKQMGFSHL

SEQ ID NO: 14788 - protein, 8 aa, Artificial Sequence
  Peptide Derived from Human Papillomavirus
YTNWGEIY

SEQ ID NO: 14789 - protein, 9 aa, Artificial Sequence
  Peptide Derived from Human Papillomavirus
YTNWGEIYI

SEQ ID NO: 14790 - protein, 10 aa, Artificial Sequence
  Peptide Derived from Human Papillomavirus
YTNWGEIYII

SEQ ID NO: 14791 - protein, 10 aa, Artificial Sequence
  Peptide Derived from Human Papillomavirus
YYIHNCEKVY

SEQ ID NO: 14792 - protein, 11 aa, Artificial Sequence
  Peptide Derived from Human Papillomavirus
YYIHNCEKVYF

SEQ ID NO: 14793 - protein, 8 aa, Artificial Sequence
  Peptide Derived from Human Papillomavirus
AWLLVLVL

SEQ ID NO: 14794 - protein, 9 aa, Artificial Sequence
  Peptide Derived from Human Papillomavirus
AWLLVLVLL

SEQ ID NO: 14795 - protein, 10 aa, Artificial Sequence
  Peptide Derived from Human Papillomavirus
AWLLVLVLLL

SEQ ID NO: 14796 - protein, 11 aa, Artificial Sequence
  Peptide Derived from Human Papillomavirus
AWLLVLVLLLW

SEQ ID NO: 14797 - protein, 8 aa, Artificial Sequence
  Peptide Derived from Human Papillomavirus
CFILFLCL

SEQ ID NO: 14798 - protein, 10 aa, Artificial Sequence
  Peptide Derived from Human Papillomavirus
CFILFLCLSL

SEQ ID NO: 14799 - protein, 11 aa, Artificial Sequence
  Peptide Derived from Human Papillomavirus
CFILFLCLSLL

SEQ ID NO: 14800 - protein, 9 aa, Artificial Sequence
  Peptide Derived from Human Papillomavirus
CINFHAQHM

SEQ ID NO: 14801 - protein, 9 aa, Artificial Sequence
  Peptide Derived from Human Papillomavirus
CLSLLLRPL

SEQ ID NO: 14802 - protein, 10 aa, Artificial Sequence
  Peptide Derived from Human Papillomavirus
CLSLLLRPLI

SEQ ID NO: 14803 - protein, 11 aa, Artificial Sequence
  Peptide Derived from Human Papillomavirus
CLSLLLRPLIL

SEQ ID NO: 14804 - protein, 8 aa, Artificial Sequence
  Peptide Derived from Human Papillomavirus
CYLLFLYL

SEQ ID NO: 14805 - protein, 10 aa, Artificial Sequence
  Peptide Derived from Human Papillomavirus
CYLLFLYLPM

SEQ ID NO: 14806 - protein, 11 aa, Artificial Sequence
  Peptide Derived from Human Papillomavirus
CYLLFLYLPMM

SEQ ID NO: 14807 - protein, 8 aa, Artificial Sequence
  Peptide Derived from Human Papillomavirus
FFCYLLFL

SEQ ID NO: 14808 - protein, 9 aa, Artificial Sequence
  Peptide Derived from Human Papillomavirus
FFCYLLFLY

SEQ ID NO: 14809 - protein, 10 aa, Artificial Sequence
  Peptide Derived from Human Papillomavirus
FFCYLLFLYL

SEQ ID NO: 14810 - protein, 9 aa, Artificial Sequence
  Peptide Derived from Human Papillomavirus
FILFLCLSL

SEQ ID NO: 14811 - protein, 10 aa, Artificial Sequence
  Peptide Derived from Human Papillomavirus
FILFLCLSLL

SEQ ID NO: 14812 - protein, 11 aa, Artificial Sequence
  Peptide Derived from Human Papillomavirus
FILFLCLSLLL

SEQ ID NO: 14813 - protein, 8 aa, Artificial Sequence
  Peptide Derived from Human Papillomavirus
FLCLSLLL

SEQ ID NO: 14814 - protein, 11 aa, Artificial Sequence
  Peptide Derived from Human Papillomavirus
FLCLSLLLRPL

SEQ ID NO: 14815 - protein, 9 aa, Artificial Sequence
  Peptide Derived from Human Papillomavirus
FLYLPMMCI

SEQ ID NO: 14816 - protein, 11 aa, Artificial Sequence
  Peptide Derived from Human Papillomavirus
FLYLPMMCINF

SEQ ID NO: 14817 - protein, 8 aa, Artificial Sequence
  Peptide Derived from Human Papillomavirus
FVFVLCFI

SEQ ID NO: 14818 - protein, 9 aa, Artificial Sequence
  Peptide Derived from Human Papillomavirus
FVFVLCFIL

SEQ ID NO: 14819 - protein, 10 aa, Artificial Sequence
  Peptide Derived from Human Papillomavirus
FVFVLCFILF

SEQ ID NO: 14820 - protein, 11 aa, Artificial Sequence
  Peptide Derived from Human Papillomavirus
FVFVLCFILFL

SEQ ID NO: 14821 - protein, 8 aa, Artificial Sequence
  Peptide Derived from Human Papillomavirus
FVGSPLKI

SEQ ID NO: 14822 - protein, 9 aa, Artificial Sequence
  Peptide Derived from Human Papillomavirus
FVGSPLKIF

SEQ ID NO: 14823 - protein, 10 aa, Artificial Sequence
  Peptide Derived from Human Papillomavirus
FVGSPLKIFF

SEQ ID NO: 14824 - protein, 8 aa, Artificial Sequence
  Peptide Derived from Human Papillomavirus
FVLCFILF

SEQ ID NO: 14825 - protein, 9 aa, Artificial Sequence
  Peptide Derived from Human Papillomavirus
FVLCFILFL

SEQ ID NO: 14826 - protein, 11 aa, Artificial Sequence
  Peptide Derived from Human Papillomavirus
FVLCFILFLCL

SEQ ID NO: 14827 - protein, 8 aa, Artificial Sequence
  Peptide Derived from Human Papillomavirus
IFFCYLLF

SEQ ID NO: 14828 - protein, 9 aa, Artificial Sequence
  Peptide Derived from Human Papillomavirus
IFFCYLLFL

SEQ ID NO: 14829 - protein, 10 aa, Artificial Sequence
  Peptide Derived from Human Papillomavirus
IFFCYLLFLY

SEQ ID NO: 14830 - protein, 11 aa, Artificial Sequence
  Peptide Derived from Human Papillomavirus
IFFCYLLFLYL

SEQ ID NO: 14831 - protein, 8 aa, Artificial Sequence
  Peptide Derived from Human Papillomavirus
IFVFVLCF

SEQ ID NO: 14832 - protein, 9 aa, Artificial Sequence
  Peptide Derived from Human Papillomavirus
IFVFVLCFI

SEQ ID NO: 14833 - protein, 10 aa, Artificial Sequence
  Peptide Derived from Human Papillomavirus
IFVFVLCFIL

SEQ ID NO: 14834 - protein, 11 aa, Artificial Sequence
  Peptide Derived from Human Papillomavirus
IFVFVLCFILF

SEQ ID NO: 14835 - protein, 8 aa, Artificial Sequence
  Peptide Derived from Human Papillomavirus
ILFLCLSL

SEQ ID NO: 14836 - protein, 9 aa, Artificial Sequence
  Peptide Derived from Human Papillomavirus
ILFLCLSLL

SEQ ID NO: 14837 - protein, 10 aa, Artificial Sequence
  Peptide Derived from Human Papillomavirus
ILFLCLSLLL

SEQ ID NO: 14838 - protein, 9 aa, Artificial Sequence
  Peptide Derived from Human Papillomavirus
ILSISTYAW

SEQ ID NO: 14839 - protein, 10 aa, Artificial Sequence
  Peptide Derived from Human Papillomavirus
ILSISTYAWL

SEQ ID NO: 14840 - protein, 11 aa, Artificial Sequence
  Peptide Derived from Human Papillomavirus
ILSISTYAWLL

SEQ ID NO: 14841 - protein, 8 aa, Artificial Sequence
  Peptide Derived from Human Papillomavirus
KIFFCYLL

SEQ ID NO: 14842 - protein, 9 aa, Artificial Sequence
  Peptide Derived from Human Papillomavirus
KIFFCYLLF

SEQ ID NO: 14843 - protein, 10 aa, Artificial Sequence
  Peptide Derived from Human Papillomavirus
KIFFCYLLFL

SEQ ID NO: 14844 - protein, 11 aa, Artificial Sequence
  Peptide Derived from Human Papillomavirus
KIFFCYLLFLY

SEQ ID NO: 14845 - protein, 8 aa, Artificial Sequence
  Peptide Derived from Human Papillomavirus
LFLCLSLL

SEQ ID NO: 14846 - protein, 9 aa, Artificial Sequence
  Peptide Derived from Human Papillomavirus
LFLCLSLLL

SEQ ID NO: 14847 - protein, 8 aa, Artificial Sequence
  Peptide Derived from Human Papillomavirus
LFLYLPMM

SEQ ID NO: 14848 - protein, 10 aa, Artificial Sequence
  Peptide Derived from Human Papillomavirus
LFLYLPMMCI

SEQ ID NO: 14849 - protein, 8 aa, Artificial Sequence
  Peptide Derived from Human Papillomavirus
LILSISTY

SEQ ID NO: 14850 - protein, 10 aa, Artificial Sequence
  Peptide Derived from Human Papillomavirus
LILSISTYAW

SEQ ID NO: 14851 - protein, 11 aa, Artificial Sequence
  Peptide Derived from Human Papillomavirus
LILSISTYAWL

SEQ ID NO: 14852 - protein, 8 aa, Artificial Sequence
  Peptide Derived from Human Papillomavirus
LLFLYLPM

SEQ ID NO: 14853 - protein, 9 aa, Artificial Sequence
  Peptide Derived from Human Papillomavirus
LLFLYLPMM

SEQ ID NO: 14854 - protein, 11 aa, Artificial Sequence
  Peptide Derived from Human Papillomavirus
LLFLYLPMMCI

SEQ ID NO: 14855 - protein, 8 aa, Artificial Sequence
  Peptide Derived from Human Papillomavirus
LLLRPLIL

SEQ ID NO: 14856 - protein, 10 aa, Artificial Sequence
  Peptide Derived from Human Papillomavirus
LLLRPLILSI

SEQ ID NO: 14857 - protein, 11 aa, Artificial Sequence
  Peptide Derived from Human Papillomavirus
LLLWVFVGSPL

SEQ ID NO: 14858 - protein, 9 aa, Artificial Sequence
  Peptide Derived from Human Papillomavirus
LLRPLILSI

SEQ ID NO: 14859 - protein, 8 aa, Artificial Sequence
  Peptide Derived from Human Papillomavirus
LLVLVLLL

SEQ ID NO: 14860 - protein, 9 aa, Artificial Sequence
  Peptide Derived from Human Papillomavirus
LLVLVLLLW

SEQ ID NO: 14861 - protein, 11 aa, Artificial Sequence
  Peptide Derived from Human Papillomavirus
LLVLVLLLWVF

SEQ ID NO: 14862 - protein, 10 aa, Artificial Sequence
  Peptide Derived from Human Papillomavirus
LLWVFVGSPL

SEQ ID NO: 14863 - protein, 8 aa, Artificial Sequence
  Peptide Derived from Human Papillomavirus
LVLLLWVF

SEQ ID NO: 14864 - protein, 8 aa, Artificial Sequence
  Peptide Derived from Human Papillomavirus
LVLVLLLW

SEQ ID NO: 14865 - protein, 10 aa, Artificial Sequence
  Peptide Derived from Human Papillomavirus
LVLVLLLWVF

SEQ ID NO: 14866 - protein, 9 aa, Artificial Sequence
  Peptide Derived from Human Papillomavirus
LWVFVGSPL

SEQ ID NO: 14867 - protein, 11 aa, Artificial Sequence
  Peptide Derived from Human Papillomavirus
LWVFVGSPLKI

SEQ ID NO: 14868 - protein, 8 aa, Artificial Sequence
  Peptide Derived from Human Papillomavirus
LYLPMMCI

SEQ ID NO: 14869 - protein, 10 aa, Artificial Sequence
  Peptide Derived from Human Papillomavirus
LYLPMMCINF

SEQ ID NO: 14870 - protein, 9 aa, Artificial Sequence
  Peptide Derived from Human Papillomavirus
MIFVFVLCF

SEQ ID NO: 14871 - protein, 10 aa, Artificial Sequence
  Peptide Derived from Human Papillomavirus
MIFVFVLCFI

SEQ ID NO: 14872 - protein, 11 aa, Artificial Sequence
  Peptide Derived from Human Papillomavirus
MIFVFVLCFIL

SEQ ID NO: 14873 - protein, 11 aa, Artificial Sequence
  Peptide Derived from Human Papillomavirus
MMCINFHAQHM

SEQ ID NO: 14874 - protein, 9 aa, Artificial Sequence
  Peptide Derived from Human Papillomavirus
PLILSISTY

SEQ ID NO: 14875 - protein, 11 aa, Artificial Sequence
  Peptide Derived from Human Papillomavirus
PLILSISTYAW

SEQ ID NO: 14876 - protein, 8 aa, Artificial Sequence
  Peptide Derived from Human Papillomavirus
PLKIFFCY

SEQ ID NO: 14877 - protein, 9 aa, Artificial Sequence
  Peptide Derived from Human Papillomavirus
PLKIFFCYL

SEQ ID NO: 14878 - protein, 10 aa, Artificial Sequence
  Peptide Derived from Human Papillomavirus
PLKIFFCYLL

SEQ ID NO: 14879 - protein, 11 aa, Artificial Sequence
  Peptide Derived from Human Papillomavirus
PLKIFFCYLLF

SEQ ID NO: 14880 - protein, 8 aa, Artificial Sequence
  Peptide Derived from Human Papillomavirus
SISTYAWL

SEQ ID NO: 14881 - protein, 9 aa, Artificial Sequence
  Peptide Derived from Human Papillomavirus
SISTYAWLL

SEQ ID NO: 14882 - protein, 11 aa, Artificial Sequence
  Peptide Derived from Human Papillomavirus
SISTYAWLLVL

SEQ ID NO: 14883 - protein, 8 aa, Artificial Sequence
  Peptide Derived from Human Papillomavirus
SLLLRPLI

SEQ ID NO: 14884 - protein, 9 aa, Artificial Sequence
  Peptide Derived from Human Papillomavirus
SLLLRPLIL

SEQ ID NO: 14885 - protein, 11 aa, Artificial Sequence
  Peptide Derived from Human Papillomavirus
SLLLRPLILSI

SEQ ID NO: 14886 - protein, 9 aa, Artificial Sequence
  Peptide Derived from Human Papillomavirus
STYAWLLVL

SEQ ID NO: 14887 - protein, 11 aa, Artificial Sequence
  Peptide Derived from Human Papillomavirus
STYAWLLVLVL

SEQ ID NO: 14888 - protein, 8 aa, Artificial Sequence
  Peptide Derived from Human Papillomavirus
TYAWLLVL

SEQ ID NO: 14889 - protein, 10 aa, Artificial Sequence
  Peptide Derived from Human Papillomavirus
TYAWLLVLVL

SEQ ID NO: 14890 - protein, 11 aa, Artificial Sequence
  Peptide Derived from Human Papillomavirus
TYAWLLVLVLL

SEQ ID NO: 14891 - protein, 9 aa, Artificial Sequence
  Peptide Derived from Human Papillomavirus
VFVGSPLKI

SEQ ID NO: 14892 - protein, 10 aa, Artificial Sequence
  Peptide Derived from Human Papillomavirus
VFVGSPLKIF

SEQ ID NO: 14893 - protein, 11 aa, Artificial Sequence
  Peptide Derived from Human Papillomavirus
VFVGSPLKIFF

SEQ ID NO: 14894 - protein, 8 aa, Artificial Sequence
  Peptide Derived from Human Papillomavirus
VFVLCFIL

SEQ ID NO: 14895 - protein, 9 aa, Artificial Sequence
  Peptide Derived from Human Papillomavirus
VFVLCFILF

SEQ ID NO: 14896 - protein, 10 aa, Artificial Sequence
  Peptide Derived from Human Papillomavirus
VFVLCFILFL

SEQ ID NO: 14897 - protein, 8 aa, Artificial Sequence
  Peptide Derived from Human Papillomavirus
VLCFILFL

SEQ ID NO: 14898 - protein, 10 aa, Artificial Sequence
  Peptide Derived from Human Papillomavirus
VLCFILFLCL

SEQ ID NO: 14899 - protein, 9 aa, Artificial Sequence
  Peptide Derived from Human Papillomavirus
VLVLLLWVF

SEQ ID NO: 14900 - protein, 8 aa, Artificial Sequence
  Peptide Derived from Human Papillomavirus
WLLVLVLL

SEQ ID NO: 14901 - protein, 9 aa, Artificial Sequence
  Peptide Derived from Human Papillomavirus
WLLVLVLLL

SEQ ID NO: 14902 - protein, 10 aa, Artificial Sequence
  Peptide Derived from Human Papillomavirus
WLLVLVLLLW

SEQ ID NO: 14903 - protein, 8 aa, Artificial Sequence
  Peptide Derived from Human Papillomavirus
WVFVGSPL

SEQ ID NO: 14904 - protein, 10 aa, Artificial Sequence
  Peptide Derived from Human Papillomavirus
WVFVGSPLKI

SEQ ID NO: 14905 - protein, 11 aa, Artificial Sequence
  Peptide Derived from Human Papillomavirus
WVFVGSPLKIF

SEQ ID NO: 14906 - protein, 9 aa, Artificial Sequence
  Peptide Derived from Human Papillomavirus
YLLFLYLPM

SEQ ID NO: 14907 - protein, 10 aa, Artificial Sequence
  Peptide Derived from Human Papillomavirus
YLLFLYLPMM

SEQ ID NO: 14908 - protein, 9 aa, Artificial Sequence
  Peptide Derived from Human Papillomavirus
YLPMMCINF

SEQ ID NO: 14909 - protein, 9 aa, Artificial Sequence
  Peptide Derived from Human Papillomavirus
AFADLTVVY

SEQ ID NO: 14910 - protein, 9 aa, Artificial Sequence
  Peptide Derived from Human Papillomavirus
ALETTIHNI

SEQ ID NO: 14911 - protein, 11 aa, Artificial Sequence
  Peptide Derived from Human Papillomavirus
ALETTIHNIEL

SEQ ID NO: 14912 - protein, 8 aa, Artificial Sequence
  Peptide Derived from Human Papillomavirus
CIICQRPL

SEQ ID NO: 14913 - protein, 8 aa, Artificial Sequence
  Peptide Derived from Human Papillomavirus
CLRFLSKI

SEQ ID NO: 14914 - protein, 11 aa, Artificial Sequence
  Peptide Derived from Human Papillomavirus
CLRFLSKISEY

SEQ ID NO: 14915 - protein, 8 aa, Artificial Sequence
  Peptide Derived from Human Papillomavirus
CVECKKPL

SEQ ID NO: 14916 - protein, 11 aa, Artificial Sequence
  Peptide Derived from Human Papillomavirus
CWRSRRRETAL

SEQ ID NO: 14917 - protein, 11 aa, Artificial Sequence
  Peptide Derived from Human Papillomavirus
DFAFADLTVVY

SEQ ID NO: 14918 - protein, 10 aa, Artificial Sequence
  Peptide Derived from Human Papillomavirus
DLCQALETTI

SEQ ID NO: 14919 - protein, 9 aa, Artificial Sequence
  Peptide Derived from Human Papillomavirus
DLNKRFHNI

SEQ ID NO: 14920 - protein, 9 aa, Artificial Sequence
  Peptide Derived from Human Papillomavirus
DTEEKPRTL

SEQ ID NO: 14921 - protein, 8 aa, Artificial Sequence
  Peptide Derived from Human Papillomavirus
EILIRCII

SEQ ID NO: 14922 - protein, 11 aa, Artificial Sequence
  Peptide Derived from Human Papillomavirus
ELQCVECKKPL

SEQ ID NO: 14923 - protein, 9 aa, Artificial Sequence
  Peptide Derived from Human Papillomavirus
ETTIHNIEL

SEQ ID NO: 14924 - protein, 10 aa, Artificial Sequence
  Peptide Derived from Human Papillomavirus
EVYDFAFADL

SEQ ID NO: 14925 - protein, 10 aa, Artificial Sequence
  Peptide Derived from Human Papillomavirus
EYRHYNYSVY

SEQ ID NO: 14926 - protein, 8 aa, Artificial Sequence
  Peptide Derived from Human Papillomavirus
FLSKISEY

SEQ ID NO: 14927 - protein, 11 aa, Artificial Sequence
  Peptide Derived from Human Papillomavirus
FLSKISEYRHY

SEQ ID NO: 14928 - protein, 9 aa, Artificial Sequence
  Peptide Derived from Human Papillomavirus
GICKLCLRF

SEQ ID NO: 14929 - protein, 10 aa, Artificial Sequence
  Peptide Derived from Human Papillomavirus
GICKLCLRFL

SEQ ID NO: 14930 - protein, 8 aa, Artificial Sequence
  Peptide Derived from Human Papillomavirus
HVDLNKRF

SEQ ID NO: 14931 - protein, 11 aa, Artificial Sequence
  Peptide Derived from Human Papillomavirus
HVDLNKRFHNI

SEQ ID NO: 14932 - protein, 11 aa, Artificial Sequence
  Peptide Derived from Human Papillomavirus
HYNYSVYGNTL

SEQ ID NO: 14933 - protein, 8 aa, Artificial Sequence
  Peptide Derived from Human Papillomavirus
KISEYRHY

SEQ ID NO: 14934 - protein, 10 aa, Artificial Sequence
  Peptide Derived from Human Papillomavirus
KISEYRHYNY

SEQ ID NO: 14935 - protein, 10 aa, Artificial Sequence
  Peptide Derived from Human Papillomavirus
KLCLRFLSKI

SEQ ID NO: 14936 - protein, 11 aa, Artificial Sequence
  Peptide Derived from Human Papillomavirus
LIRCIICQRPL

SEQ ID NO: 14937 - protein, 11 aa, Artificial Sequence
  Peptide Derived from Human Papillomavirus
LTVVYREGNPF

SEQ ID NO: 14938 - protein, 11 aa, Artificial Sequence
  Peptide Derived from Human Papillomavirus
NTLEQTVKKPL

SEQ ID NO: 14939 - protein, 9 aa, Artificial Sequence
  Peptide Derived from Human Papillomavirus
NYSVYGNTL

SEQ ID NO: 14940 - protein, 9 aa, Artificial Sequence
  Peptide Derived from Human Papillomavirus
PFGICKLCL

SEQ ID NO: 14941 - protein, 11 aa, Artificial Sequence
  Peptide Derived from Human Papillomavirus
PFGICKLCLRF

SEQ ID NO: 14942 - protein, 10 aa, Artificial Sequence
  Peptide Derived from Human Papillomavirus
PLNEILIRCI

SEQ ID NO: 14943 - protein, 11 aa, Artificial Sequence
  Peptide Derived from Human Papillomavirus
PLNEILIRCII

SEQ ID NO: 14944 - protein, 8 aa, Artificial Sequence
  Peptide Derived from Human Papillomavirus
PLQRSEVY

SEQ ID NO: 14945 - protein, 10 aa, Artificial Sequence
  Peptide Derived from Human Papillomavirus
PLQRSEVYDF

SEQ ID NO: 14946 - protein, 10 aa, Artificial Sequence
  Peptide Derived from Human Papillomavirus
QTVKKPLNEI

SEQ ID NO: 14947 - protein, 11 aa, Artificial Sequence
  Peptide Derived from Human Papillomavirus
QTVKKPLNEIL

SEQ ID NO: 14948 - protein, 9 aa, Artificial Sequence
  Peptide Derived from Human Papillomavirus
RFHNISGRW

SEQ ID NO: 14949 - protein, 9 aa, Artificial Sequence
  Peptide Derived from Human Papillomavirus
RFLSKISEY

SEQ ID NO: 14950 - protein, 10 aa, Artificial Sequence
  Peptide Derived from Human Papillomavirus
RTLHDLCQAL

SEQ ID NO: 14951 - protein, 10 aa, Artificial Sequence
  Peptide Derived from Human Papillomavirus
RWAGRCAACW

SEQ ID NO: 14952 - protein, 10 aa, Artificial Sequence
  Peptide Derived from Human Papillomavirus
TLEQTVKKPL

SEQ ID NO: 14953 - protein, 9 aa, Artificial Sequence
  Peptide Derived from Human Papillomavirus
TLHDLCQAL

SEQ ID NO: 14954 - protein, 8 aa, Artificial Sequence
  Peptide Derived from Human Papillomavirus
TTIHNIEL

SEQ ID NO: 14955 - protein, 9 aa, Artificial Sequence
  Peptide Derived from Human Papillomavirus
TVKKPLNEI

SEQ ID NO: 14956 - protein, 10 aa, Artificial Sequence
  Peptide Derived from Human Papillomavirus
TVKKPLNEIL

SEQ ID NO: 14957 - protein, 11 aa, Artificial Sequence
  Peptide Derived from Human Papillomavirus
TVKKPLNEILI

SEQ ID NO: 14958 - protein, 10 aa, Artificial Sequence
  Peptide Derived from Human Papillomavirus
TVVYREGNPF

SEQ ID NO: 14959 - protein, 9 aa, Artificial Sequence
  Peptide Derived from Human Papillomavirus
VVYREGNPF

SEQ ID NO: 14960 - protein, 11 aa, Artificial Sequence
  Peptide Derived from Human Papillomavirus
VVYREGNPFGI

SEQ ID NO: 14961 - protein, 9 aa, Artificial Sequence
  Peptide Derived from Human Papillomavirus
VYDFAFADL

SEQ ID NO: 14962 - protein, 8 aa, Artificial Sequence
  Peptide Derived from Human Papillomavirus
VYREGNPF

SEQ ID NO: 14963 - protein, 10 aa, Artificial Sequence
  Peptide Derived from Human Papillomavirus
VYREGNPFGI

SEQ ID NO: 14964 - protein, 9 aa, Artificial Sequence
  Peptide Derived from Human Papillomavirus
CVNSTASDL

SEQ ID NO: 14965 - protein, 8 aa, Artificial Sequence
  Peptide Derived from Human Papillomavirus
DLRTIQQL

SEQ ID NO: 14966 - protein, 9 aa, Artificial Sequence
  Peptide Derived from Human Papillomavirus
DLRTIQQLL

SEQ ID NO: 14967 - protein, 10 aa, Artificial Sequence
  Peptide Derived from Human Papillomavirus
DLRTIQQLLM

SEQ ID NO: 14968 - protein, 8 aa, Artificial Sequence
  Peptide Derived from Human Papillomavirus
DLYCYEQL

SEQ ID NO: 14969 - protein, 9 aa, Artificial Sequence
  Peptide Derived from Human Papillomavirus
DLYPEPTDL

SEQ ID NO: 14970 - protein, 10 aa, Artificial Sequence
  Peptide Derived from Human Papillomavirus
DLYPEPTDLY

SEQ ID NO: 14971 - protein, 9 aa, Artificial Sequence
  Peptide Derived from Human Papillomavirus
HTCNTTVRL

SEQ ID NO: 14972 - protein, 8 aa, Artificial Sequence
  Peptide Derived from Human Papillomavirus
LLMGTVNI

SEQ ID NO: 14973 - protein, 8 aa, Artificial Sequence
  Peptide Derived from Human Papillomavirus
LYPEPTDL

SEQ ID NO: 14974 - protein, 9 aa, Artificial Sequence
  Peptide Derived from Human Papillomavirus
LYPEPTDLY

SEQ ID NO: 14975 - protein, 11 aa, Artificial Sequence
  Peptide Derived from Human Papillomavirus
LYPEPTDLYCY

SEQ ID NO: 14976 - protein, 10 aa, Artificial Sequence
  Peptide Derived from Human Papillomavirus
PTDLYCYEQL

SEQ ID NO: 14977 - protein, 8 aa, Artificial Sequence
  Peptide Derived from Human Papillomavirus
PTLKEYVL

SEQ ID NO: 14978 - protein, 10 aa, Artificial Sequence
  Peptide Derived from Human Papillomavirus
PTLKEYVLDL

SEQ ID NO: 14979 - protein, 11 aa, Artificial Sequence
  Peptide Derived from Human Papillomavirus
PTLKEYVLDLY

SEQ ID NO: 14980 - protein, 9 aa, Artificial Sequence
  Peptide Derived from Human Papillomavirus
QLLMGTVNI

SEQ ID NO: 14981 - protein, 11 aa, Artificial Sequence
  Peptide Derived from Human Papillomavirus
RLCVNSTASDL

SEQ ID NO: 14982 - protein, 8 aa, Artificial Sequence
  Peptide Derived from Human Papillomavirus
RTIQQLLM

SEQ ID NO: 14983 - protein, 9 aa, Artificial Sequence
  Peptide Derived from Human Papillomavirus
STASDLRTI

SEQ ID NO: 14984 - protein, 9 aa, Artificial Sequence
  Peptide Derived from Human Papillomavirus
TLKEYVLDL

SEQ ID NO: 14985 - protein, 10 aa, Artificial Sequence
  Peptide Derived from Human Papillomavirus
TLKEYVLDLY

SEQ ID NO: 14986 - protein, 11 aa, Artificial Sequence
  Peptide Derived from Human Papillomavirus
VLDLYPEPTDL

SEQ ID NO: 14987 - protein, 10 aa, Artificial Sequence
  Peptide Derived from Human Papillomavirus
AFFPTPSGSM

SEQ ID NO: 14988 - protein, 10 aa, Artificial Sequence
  Peptide Derived from Human Papillomavirus
AMNPDILEDW

SEQ ID NO: 14989 - protein, 9 aa, Artificial Sequence
  Peptide Derived from Human Papillomavirus
AVGHPYFSI

SEQ ID NO: 14990 - protein, 8 aa, Artificial Sequence
  Peptide Derived from Human Papillomavirus
AVPDDLYI

SEQ ID NO: 14991 - protein, 11 aa, Artificial Sequence
  Peptide Derived from Human Papillomavirus
CLSMDYKQTQL

SEQ ID NO: 14992 - protein, 10 aa, Artificial Sequence
  Peptide Derived from Human Papillomavirus
CTQVTSDSTY

SEQ ID NO: 14993 - protein, 9 aa, Artificial Sequence
  Peptide Derived from Human Papillomavirus
DICGSTCKY

SEQ ID NO: 14994 - protein, 8 aa, Artificial Sequence
  Peptide Derived from Human Papillomavirus
DILEDWQF

SEQ ID NO: 14995 - protein, 10 aa, Artificial Sequence
  Peptide Derived from Human Papillomavirus
DILEDWQFGL

SEQ ID NO: 14996 - protein, 11 aa, Artificial Sequence
  Peptide Derived from Human Papillomavirus
DLDQFPLGRKF

SEQ ID NO: 14997 - protein, 10 aa, Artificial Sequence
  Peptide Derived from Human Papillomavirus
DLKEKFSADL

SEQ ID NO: 14998 - protein, 8 aa, Artificial Sequence
  Peptide Derived from Human Papillomavirus
DLQFVFQL

SEQ ID NO: 14999 - protein, 10 aa, Artificial Sequence
  Peptide Derived from Human Papillomavirus
DMVDTGFGCM

SEQ ID NO: 15000 - protein, 8 aa, Artificial Sequence
  Peptide Derived from Human Papillomavirus
DTETGNKY

SEQ ID NO: 15001 - protein, 9 aa, Artificial Sequence
  Peptide Derived from Human Papillomavirus
DTGFGCMDF

SEQ ID NO: 15002 - protein, 8 aa, Artificial Sequence
  Peptide Derived from Human Papillomavirus
DTTRSTNM

SEQ ID NO: 15003 - protein, 10 aa, Artificial Sequence
  Peptide Derived from Human Papillomavirus
DTTRSTNMTL

SEQ ID NO: 15004 - protein, 11 aa, Artificial Sequence
  Peptide Derived from Human Papillomavirus
DTYRFVTSQAI

SEQ ID NO: 15005 - protein, 9 aa, Artificial Sequence
  Peptide Derived from Human Papillomavirus
DYKQTQLCL

SEQ ID NO: 15006 - protein, 10 aa, Artificial Sequence
  Peptide Derived from Human Papillomavirus
DYKQTQLCLL

SEQ ID NO: 15007 - protein, 10 aa, Artificial Sequence
  Peptide Derived from Human Papillomavirus
DYLKMTSEPY

SEQ ID NO: 15008 - protein, 8 aa, Artificial Sequence
  Peptide Derived from Human Papillomavirus
EIGRGQPL

SEQ ID NO: 15009 - protein, 8 aa, Artificial Sequence
  Peptide Derived from Human Papillomavirus
EVDLKEKF

SEQ ID NO: 15010 - protein, 9 aa, Artificial Sequence
  Peptide Derived from Human Papillomavirus
EVMTYIHAM

SEQ ID NO: 15011 - protein, 8 aa, Artificial Sequence
  Peptide Derived from Human Papillomavirus
EYDLQFVF

SEQ ID NO: 15012 - protein, 10 aa, Artificial Sequence
  Peptide Derived from Human Papillomavirus
EYDLQFVFQL

SEQ ID NO: 15013 - protein, 9 aa, Artificial Sequence
  Peptide Derived from Human Papillomavirus
EYIRHVEEY

SEQ ID NO: 15014 - protein, 11 aa, Artificial Sequence
  Peptide Derived from Human Papillomavirus
EYIRHVEEYDL

SEQ ID NO: 15015 - protein, 8 aa, Artificial Sequence
  Peptide Derived from Human Papillomavirus
EYVSRTSI

SEQ ID NO: 15016 - protein, 9 aa, Artificial Sequence
  Peptide Derived from Human Papillomavirus
EYVSRTSIY

SEQ ID NO: 15017 - protein, 10 aa, Artificial Sequence
  Peptide Derived from Human Papillomavirus
EYVSRTSIYY

SEQ ID NO: 15018 - protein, 11 aa, Artificial Sequence
  Peptide Derived from Human Papillomavirus
EYVSRTSIYYY

SEQ ID NO: 15019 - protein, 9 aa, Artificial Sequence
  Peptide Derived from Human Papillomavirus
FFFLRREQM

SEQ ID NO: 15020 - protein, 10 aa, Artificial Sequence
  Peptide Derived from Human Papillomavirus
FFFLRREQMF

SEQ ID NO: 15021 - protein, 8 aa, Artificial Sequence
  Peptide Derived from Human Papillomavirus
FFLRREQM

SEQ ID NO: 15022 - protein, 9 aa, Artificial Sequence
  Peptide Derived from Human Papillomavirus
FFLRREQMF

SEQ ID NO: 15023 - protein, 8 aa, Artificial Sequence
  Peptide Derived from Human Papillomavirus
FFNRAGTL

SEQ ID NO: 15024 - protein, 9 aa, Artificial Sequence
  Peptide Derived from Human Papillomavirus
FFPTPSGSM

SEQ ID NO: 15025 - protein, 8 aa, Artificial Sequence
  Peptide Derived from Human Papillomavirus
FLRREQMF

SEQ ID NO: 15026 - protein, 10 aa, Artificial Sequence
  Peptide Derived from Human Papillomavirus
FVFQLCKVTL

SEQ ID NO: 15027 - protein, 10 aa, Artificial Sequence
  Peptide Derived from Human Papillomavirus
FWEVDLKEKF

SEQ ID NO: 15028 - protein, 9 aa, Artificial Sequence
  Peptide Derived from Human Papillomavirus
FYNPDTQRL

SEQ ID NO: 15029 - protein, 11 aa, Artificial Sequence
  Peptide Derived from Human Papillomavirus
FYNPDTQRLVW

SEQ ID NO: 15030 - protein, 10 aa, Artificial Sequence
  Peptide Derived from Human Papillomavirus
GFGCMDFKTL

SEQ ID NO: 15031 - protein, 8 aa, Artificial Sequence
  Peptide Derived from Human Papillomavirus
GFPDTSFY

SEQ ID NO: 15032 - protein, 9 aa, Artificial Sequence
  Peptide Derived from Human Papillomavirus
GICWGNQVF

SEQ ID NO: 15033 - protein, 8 aa, Artificial Sequence
  Peptide Derived from Human Papillomavirus
GISGHPLL

SEQ ID NO: 15034 - protein, 11 aa, Artificial Sequence
  Peptide Derived from Human Papillomavirus
GISGHPLLNKF

SEQ ID NO: 15035 - protein, 10 aa, Artificial Sequence
  Peptide Derived from Human Papillomavirus
GLEIGRGQPL

SEQ ID NO: 15036 - protein, 8 aa, Artificial Sequence
  Peptide Derived from Human Papillomavirus
GLKAKPKL

SEQ ID NO: 15037 - protein, 11 aa, Artificial Sequence
  Peptide Derived from Human Papillomavirus
GLQYRVFRVRL

SEQ ID NO: 15038 - protein, 10 aa, Artificial Sequence
  Peptide Derived from Human Papillomavirus
GLTPPPSASL

SEQ ID NO: 15039 - protein, 11 aa, Artificial Sequence
  Peptide Derived from Human Papillomavirus
GTLGEAVPDDL

SEQ ID NO: 15040 - protein, 11 aa, Artificial Sequence
  Peptide Derived from Human Papillomavirus
GTTASIQSSAF

SEQ ID NO: 15041 - protein, 9 aa, Artificial Sequence
  Peptide Derived from Human Papillomavirus
GVGISGHPL

SEQ ID NO: 15042 - protein, 10 aa, Artificial Sequence
  Peptide Derived from Human Papillomavirus
GVGISGHPLL

SEQ ID NO: 15043 - protein, 9 aa, Artificial Sequence
  Peptide Derived from Human Papillomavirus
HFFNRAGTL

SEQ ID NO: 15044 - protein, 9 aa, Artificial Sequence
  Peptide Derived from Human Papillomavirus
HVEEYDLQF

SEQ ID NO: 15045 - protein, 11 aa, Artificial Sequence
  Peptide Derived from Human Papillomavirus
HVEEYDLQFVF

SEQ ID NO: 15046 - protein, 9 aa, Artificial Sequence
  Peptide Derived from Human Papillomavirus
ILEDWQFGL

SEQ ID NO: 15047 - protein, 10 aa, Artificial Sequence
  Peptide Derived from Human Papillomavirus
IYYYAGSSRL

SEQ ID NO: 15048 - protein, 11 aa, Artificial Sequence
  Peptide Derived from Human Papillomavirus
IYYYAGSSRLL

SEQ ID NO: 15049 - protein, 11 aa, Artificial Sequence
  Peptide Derived from Human Papillomavirus
KFDDTETGNKY

SEQ ID NO: 15050 - protein, 9 aa, Artificial Sequence
  Peptide Derived from Human Papillomavirus
KFGFPDTSF

SEQ ID NO: 15051 - protein, 10 aa, Artificial Sequence
  Peptide Derived from Human Papillomavirus
KFGFPDTSFY

SEQ ID NO: 15052 - protein, 8 aa, Artificial Sequence
  Peptide Derived from Human Papillomavirus
KFLLQAGL

SEQ ID NO: 15053 - protein, 9 aa, Artificial Sequence
  Peptide Derived from Human Papillomavirus
KFSADLDQF

SEQ ID NO: 15054 - protein, 11 aa, Artificial Sequence
  Peptide Derived from Human Papillomavirus
KFSADLDQFPL

SEQ ID NO: 15055 - protein, 10 aa, Artificial Sequence
  Peptide Derived from Human Papillomavirus
KLLVPKVSGL

SEQ ID NO: 15056 - protein, 11 aa, Artificial Sequence
  Peptide Derived from Human Papillomavirus
KMTSEPYGDSL

SEQ ID NO: 15057 - protein, 10 aa, Artificial Sequence
  Peptide Derived from Human Papillomavirus
KVSGLQYRVF

SEQ ID NO: 15058 - protein, 9 aa, Artificial Sequence
  Peptide Derived from Human Papillomavirus
KVTLTAEVM

SEQ ID NO: 15059 - protein, 11 aa, Artificial Sequence
  Peptide Derived from Human Papillomavirus
KVTLTAEVMTY

SEQ ID NO: 15060 - protein, 8 aa, Artificial Sequence
  Peptide Derived from Human Papillomavirus
KVVSTDEY

SEQ ID NO: 15061 - protein, 8 aa, Artificial Sequence
  Peptide Derived from Human Papillomavirus
KYPDYLKM

SEQ ID NO: 15062 - protein, 9 aa, Artificial Sequence
  Peptide Derived from Human Papillomavirus
KYTFWEVDL

SEQ ID NO: 15063 - protein, 10 aa, Artificial Sequence
  Peptide Derived from Human Papillomavirus
LFFFLRREQM

SEQ ID NO: 15064 - protein, 11 aa, Artificial Sequence
  Peptide Derived from Human Papillomavirus
LFFFLRREQMF

SEQ ID NO: 15065 - protein, 8 aa, Artificial Sequence
  Peptide Derived from Human Papillomavirus
LFNKPYWL

SEQ ID NO: 15066 - protein, 11 aa, Artificial Sequence
  Peptide Derived from Human Papillomavirus
LINTIIEDGDM

SEQ ID NO: 15067 - protein, 8 aa, Artificial Sequence
  Peptide Derived from Human Papillomavirus
LLAVGHPY

SEQ ID NO: 15068 - protein, 9 aa, Artificial Sequence
  Peptide Derived from Human Papillomavirus
LLAVGHPYF

SEQ ID NO: 15069 - protein, 11 aa, Artificial Sequence
  Peptide Derived from Human Papillomavirus
LLAVGHPYFSI

SEQ ID NO: 15070 - protein, 9 aa, Artificial Sequence
  Peptide Derived from Human Papillomavirus
LLVPKVSGL

SEQ ID NO: 15071 - protein, 11 aa, Artificial Sequence
  Peptide Derived from Human Papillomavirus
LLVPKVSGLQY

SEQ ID NO: 15072 - protein, 8 aa, Artificial Sequence
  Peptide Derived from Human Papillomavirus
LTAEVMTY

SEQ ID NO: 15073 - protein, 9 aa, Artificial Sequence
  Peptide Derived from Human Papillomavirus
LTAEVMTYI

SEQ ID NO: 15074 - protein, 9 aa, Artificial Sequence
  Peptide Derived from Human Papillomavirus
LTPPPSASL

SEQ ID NO: 15075 - protein, 8 aa, Artificial Sequence
  Peptide Derived from Human Papillomavirus
LVPKVSGL

SEQ ID NO: 15076 - protein, 10 aa, Artificial Sequence
  Peptide Derived from Human Papillomavirus
LVPKVSGLQY

SEQ ID NO: 15077 - protein, 8 aa, Artificial Sequence
  Peptide Derived from Human Papillomavirus
LVWACVGL

SEQ ID NO: 15078 - protein, 10 aa, Artificial Sequence
  Peptide Derived from Human Papillomavirus
LVWACVGLEI

SEQ ID NO: 15079 - protein, 10 aa, Artificial Sequence
  Peptide Derived from Human Papillomavirus
MTSEPYGDSL

SEQ ID NO: 15080 - protein, 11 aa, Artificial Sequence
  Peptide Derived from Human Papillomavirus
MTSEPYGDSLF

SEQ ID NO: 15081 - protein, 11 aa, Artificial Sequence
  Peptide Derived from Human Papillomavirus
MTYIHAMNPDI

SEQ ID NO: 15082 - protein, 9 aa, Artificial Sequence
  Peptide Derived from Human Papillomavirus
MVDTGFGCM

SEQ ID NO: 15083 - protein, 11 aa, Artificial Sequence
  Peptide Derived from Human Papillomavirus
MVDTGFGCMDF

SEQ ID NO: 15084 - protein, 8 aa, Artificial Sequence
  Peptide Derived from Human Papillomavirus
MVTSESQL

SEQ ID NO: 15085 - protein, 9 aa, Artificial Sequence
  Peptide Derived from Human Papillomavirus
MVTSESQLF

SEQ ID NO: 15086 - protein, 9 aa, Artificial Sequence
  Peptide Derived from Human Papillomavirus
NTIIEDGDM

SEQ ID NO: 15087 - protein, 11 aa, Artificial Sequence
  Peptide Derived from Human Papillomavirus
PIDICGSTCKY

SEQ ID NO: 15088 - protein, 8 aa, Artificial Sequence
  Peptide Derived from Human Papillomavirus
PLELINTI

SEQ ID NO: 15089 - protein, 9 aa, Artificial Sequence
  Peptide Derived from Human Papillomavirus
PLELINTII

SEQ ID NO: 15090 - protein, 8 aa, Artificial Sequence
  Peptide Derived from Human Papillomavirus
PLGKYTFW

SEQ ID NO: 15091 - protein, 8 aa, Artificial Sequence
  Peptide Derived from Human Papillomavirus
PLGRKFLL

SEQ ID NO: 15092 - protein, 11 aa, Artificial Sequence
  Peptide Derived from Human Papillomavirus
PLGVGISGHPL

SEQ ID NO: 15093 - protein, 8 aa, Artificial Sequence
  Peptide Derived from Human Papillomavirus
PTNAKKLL

SEQ ID NO: 15094 - protein, 11 aa, Artificial Sequence
  Peptide Derived from Human Papillomavirus
PVSKVVSTDEY

SEQ ID NO: 15095 - protein, 8 aa, Artificial Sequence
  Peptide Derived from Human Papillomavirus
PYGDSLFF

SEQ ID NO: 15096 - protein, 9 aa, Artificial Sequence
  Peptide Derived from Human Papillomavirus
PYGDSLFFF

SEQ ID NO: 15097 - protein, 10 aa, Artificial Sequence
  Peptide Derived from Human Papillomavirus
PYGDSLFFFL

SEQ ID NO: 15098 - protein, 8 aa, Artificial Sequence
  Peptide Derived from Human Papillomavirus
QFPLGRKF

SEQ ID NO: 15099 - protein, 9 aa, Artificial Sequence
  Peptide Derived from Human Papillomavirus
QFPLGRKFL

SEQ ID NO: 15100 - protein, 10 aa, Artificial Sequence
  Peptide Derived from Human Papillomavirus
QFPLGRKFLL

SEQ ID NO: 15101 - protein, 11 aa, Artificial Sequence
  Peptide Derived from Human Papillomavirus
QFVFQLCKVTL

SEQ ID NO: 15102 - protein, 8 aa, Artificial Sequence
  Peptide Derived from Human Papillomavirus
QLFNKPYW

SEQ ID NO: 15103 - protein, 9 aa, Artificial Sequence
  Peptide Derived from Human Papillomavirus
QLFNKPYWL

SEQ ID NO: 15104 - protein, 8 aa, Artificial Sequence
  Peptide Derived from Human Papillomavirus
QMFVRHFF

SEQ ID NO: 15105 - protein, 8 aa, Artificial Sequence
  Peptide Derived from Human Papillomavirus
QVTSDSTY

SEQ ID NO: 15106 - protein, 9 aa, Artificial Sequence
  Peptide Derived from Human Papillomavirus
QYRVFRVRL

SEQ ID NO: 15107 - protein, 8 aa, Artificial Sequence
  Peptide Derived from Human Papillomavirus
RFVTSQAI

SEQ ID NO: 15108 - protein, 9 aa, Artificial Sequence
  Peptide Derived from Human Papillomavirus
RLLAVGHPY

SEQ ID NO: 15109 - protein, 10 aa, Artificial Sequence
  Peptide Derived from Human Papillomavirus
RLLAVGHPYF

SEQ ID NO: 15110 - protein, 8 aa, Artificial Sequence
  Peptide Derived from Human Papillomavirus
RLPDPNKF

SEQ ID NO: 15111 - protein, 10 aa, Artificial Sequence
  Peptide Derived from Human Papillomavirus
RLPDPNKFGF

SEQ ID NO: 15112 - protein, 9 aa, Artificial Sequence
  Peptide Derived from Human Papillomavirus
RLVWACVGL

SEQ ID NO: 15113 - protein, 11 aa, Artificial Sequence
  Peptide Derived from Human Papillomavirus
RLVWACVGLEI

SEQ ID NO: 15114 - protein, 10 aa, Artificial Sequence
  Peptide Derived from Human Papillomavirus
RVRLPDPNKF

SEQ ID NO: 15115 - protein, 10 aa, Artificial Sequence
  Peptide Derived from Human Papillomavirus
SFYNPDTQRL

SEQ ID NO: 15116 - protein, 11 aa, Artificial Sequence
  Peptide Derived from Human Papillomavirus
SIKNPTNAKKL

SEQ ID NO: 15117 - protein, 8 aa, Artificial Sequence
  Peptide Derived from Human Papillomavirus
SIQSSAFF

SEQ ID NO: 15118 - protein, 11 aa, Artificial Sequence
  Peptide Derived from Human Papillomavirus
SIYYYAGSSRL

SEQ ID NO: 15119 - protein, 11 aa, Artificial Sequence
  Peptide Derived from Human Papillomavirus
SLFFFLRREQM

SEQ ID NO: 15120 - protein, 8 aa, Artificial Sequence
  Peptide Derived from Human Papillomavirus
SLQDTYRF

SEQ ID NO: 15121 - protein, 9 aa, Artificial Sequence
  Peptide Derived from Human Papillomavirus
SMDYKQTQL

SEQ ID NO: 15122 - protein, 11 aa, Artificial Sequence
  Peptide Derived from Human Papillomavirus
SMDYKQTQLCL

SEQ ID NO: 15123 - protein, 9 aa, Artificial Sequence
  Peptide Derived from Human Papillomavirus
SMVTSESQL

SEQ ID NO: 15124 - protein, 10 aa, Artificial Sequence
  Peptide Derived from Human Papillomavirus
SMVTSESQLF

SEQ ID NO: 15125 - protein, 8 aa, Artificial Sequence
  Peptide Derived from Human Papillomavirus
STCKYPDY

SEQ ID NO: 15126 - protein, 9 aa, Artificial Sequence
  Peptide Derived from Human Papillomavirus
STCKYPDYL

SEQ ID NO: 15127 - protein, 11 aa, Artificial Sequence
  Peptide Derived from Human Papillomavirus
STCKYPDYLKM

SEQ ID NO: 15128 - protein, 11 aa, Artificial Sequence
  Peptide Derived from Human Papillomavirus
STDEYVSRTSI

SEQ ID NO: 15129 - protein, 8 aa, Artificial Sequence
  Peptide Derived from Human Papillomavirus
STYKNENF

SEQ ID NO: 15130 - protein, 11 aa, Artificial Sequence
  Peptide Derived from Human Papillomavirus
STYKNENFKEY

SEQ ID NO: 15131 - protein, 11 aa, Artificial Sequence
  Peptide Derived from Human Papillomavirus
SVWRPSEATVY

SEQ ID NO: 15132 - protein, 11 aa, Artificial Sequence
  Peptide Derived from Human Papillomavirus
TFWEVDLKEKF

SEQ ID NO: 15133 - protein, 8 aa, Artificial Sequence
  Peptide Derived from Human Papillomavirus
TIIEDGDM

SEQ ID NO: 15134 - protein, 10 aa, Artificial Sequence
  Peptide Derived from Human Papillomavirus
TLGEAVPDDL

SEQ ID NO: 15135 - protein, 11 aa, Artificial Sequence
  Peptide Derived from Human Papillomavirus
TLGEAVPDDLY

SEQ ID NO: 15136 - protein, 11 aa, Artificial Sequence
  Peptide Derived from Human Papillomavirus
TLQANKSDVPI

SEQ ID NO: 15137 - protein, 9 aa, Artificial Sequence
  Peptide Derived from Human Papillomavirus
TLTAEVMTY

SEQ ID NO: 15138 - protein, 10 aa, Artificial Sequence
  Peptide Derived from Human Papillomavirus
TLTAEVMTYI

SEQ ID NO: 15139 - protein, 10 aa, Artificial Sequence
  Peptide Derived from Human Papillomavirus
TTASIQSSAF

SEQ ID NO: 15140 - protein, 11 aa, Artificial Sequence
  Peptide Derived from Human Papillomavirus
TTASIQSSAFF

SEQ ID NO: 15141 - protein, 9 aa, Artificial Sequence
  Peptide Derived from Human Papillomavirus
TTRSTNMTL

SEQ ID NO: 15142 - protein, 11 aa, Artificial Sequence
  Peptide Derived from Human Papillomavirus
TVPPKEKEDPL

SEQ ID NO: 15143 - protein, 11 aa, Artificial Sequence
  Peptide Derived from Human Papillomavirus
TVVDTTRSTNM

SEQ ID NO: 15144 - protein, 10 aa, Artificial Sequence
  Peptide Derived from Human Papillomavirus
TYIHAMNPDI

SEQ ID NO: 15145 - protein, 11 aa, Artificial Sequence
  Peptide Derived from Human Papillomavirus
TYIHAMNPDIL

SEQ ID NO: 15146 - protein, 10 aa, Artificial Sequence
  Peptide Derived from Human Papillomavirus
TYKNENFKEY

SEQ ID NO: 15147 - protein, 11 aa, Artificial Sequence
  Peptide Derived from Human Papillomavirus
TYKNENFKEYI

SEQ ID NO: 15148 - protein, 10 aa, Artificial Sequence
  Peptide Derived from Human Papillomavirus
TYRFVTSQAI

SEQ ID NO: 15149 - protein, 9 aa, Artificial Sequence
  Peptide Derived from Human Papillomavirus
VFQLCKVTL

SEQ ID NO: 15150 - protein, 8 aa, Artificial Sequence
  Peptide Derived from Human Papillomavirus
VMTYIHAM

SEQ ID NO: 15151 - protein, 8 aa, Artificial Sequence
  Peptide Derived from Human Papillomavirus
VTLTAEVM

SEQ ID NO: 15152 - protein, 10 aa, Artificial Sequence
  Peptide Derived from Human Papillomavirus
VTLTAEVMTY

SEQ ID NO: 15153 - protein, 11 aa, Artificial Sequence
  Peptide Derived from Human Papillomavirus
VTLTAEVMTYI

SEQ ID NO: 15154 - protein, 8 aa, Artificial Sequence
  Peptide Derived from Human Papillomavirus
VTSESQLF

SEQ ID NO: 15155 - protein, 10 aa, Artificial Sequence
  Peptide Derived from Human Papillomavirus
VVDTTRSTNM

SEQ ID NO: 15156 - protein, 9 aa, Artificial Sequence
  Peptide Derived from Human Papillomavirus
VWACVGLEI

SEQ ID NO: 15157 - protein, 10 aa, Artificial Sequence
  Peptide Derived from Human Papillomavirus
VWRPSEATVY

SEQ ID NO: 15158 - protein, 11 aa, Artificial Sequence
  Peptide Derived from Human Papillomavirus
VWRPSEATVYL

SEQ ID NO: 15159 - protein, 9 aa, Artificial Sequence
  Peptide Derived from Human Papillomavirus
YIHAMNPDI

SEQ ID NO: 15160 - protein, 10 aa, Artificial Sequence
  Peptide Derived from Human Papillomavirus
YIHAMNPDIL

SEQ ID NO: 15161 - protein, 11 aa, Artificial Sequence
  Peptide Derived from Human Papillomavirus
YIKGSGTTASI

SEQ ID NO: 15162 - protein, 8 aa, Artificial Sequence
  Peptide Derived from Human Papillomavirus
YIRHVEEY

SEQ ID NO: 15163 - protein, 10 aa, Artificial Sequence
  Peptide Derived from Human Papillomavirus
YIRHVEEYDL

SEQ ID NO: 15164 - protein, 9 aa, Artificial Sequence
  Peptide Derived from Human Papillomavirus
YLKMTSEPY

SEQ ID NO: 15165 - protein, 8 aa, Artificial Sequence
  Peptide Derived from Human Papillomavirus
YTFWEVDL

SEQ ID NO: 15166 - protein, 8 aa, Artificial Sequence
  Peptide Derived from Human Papillomavirus
YVSRTSIY

SEQ ID NO: 15167 - protein, 9 aa, Artificial Sequence
  Peptide Derived from Human Papillomavirus
YVSRTSIYY

SEQ ID NO: 15168 - protein, 10 aa, Artificial Sequence
  Peptide Derived from Human Papillomavirus
YVSRTSIYYY

SEQ ID NO: 15169 - protein, 8 aa, Artificial Sequence
  Peptide Derived from Human Papillomavirus
YYAGSSRL

SEQ ID NO: 15170 - protein, 9 aa, Artificial Sequence
  Peptide Derived from Human Papillomavirus
YYAGSSRLL

SEQ ID NO: 15171 - protein, 9 aa, Artificial Sequence
  Peptide Derived from Human Papillomavirus
YYYAGSSRL

SEQ ID NO: 15172 - protein, 10 aa, Artificial Sequence
  Peptide Derived from Human Papillomavirus
YYYAGSSRLL

SEQ ID NO: 15173 - protein, 11 aa, Artificial Sequence
  Peptide Derived from Human Papillomavirus
AFESFDPEDTL

SEQ ID NO: 15174 - protein, 9 aa, Artificial Sequence
  Peptide Derived from Human Papillomavirus
AFLTSPHKL

SEQ ID NO: 15175 - protein, 10 aa, Artificial Sequence
  Peptide Derived from Human Papillomavirus
AFLTSPHKLI

SEQ ID NO: 15176 - protein, 11 aa, Artificial Sequence
  Peptide Derived from Human Papillomavirus
AITSRRHTVRF

SEQ ID NO: 15177 - protein, 10 aa, Artificial Sequence
  Peptide Derived from Human Papillomavirus
ATGTCPPDVI

SEQ ID NO: 15178 - protein, 11 aa, Artificial Sequence
  Peptide Derived from Human Papillomavirus
ATLKTRSGKQI

SEQ ID NO: 15179 - protein, 10 aa, Artificial Sequence
  Peptide Derived from Human Papillomavirus
ATTRTSNVSI

SEQ ID NO: 15180 - protein, 8 aa, Artificial Sequence
  Peptide Derived from Human Papillomavirus
DFLDIIAL

SEQ ID NO: 15181 - protein, 8 aa, Artificial Sequence
  Peptide Derived from Human Papillomavirus
DFVLHPSY

SEQ ID NO: 15182 - protein, 9 aa, Artificial Sequence
  Peptide Derived from Human Papillomavirus
DFVLHPSYF

SEQ ID NO: 15183 - protein, 10 aa, Artificial Sequence
  Peptide Derived from Human Papillomavirus
DFVLHPSYFI

SEQ ID NO: 15184 - protein, 11 aa, Artificial Sequence
  Peptide Derived from Human Papillomavirus
DFVLHPSYFIL

SEQ ID NO: 15185 - protein, 10 aa, Artificial Sequence
  Peptide Derived from Human Papillomavirus
DIIALHRPAI

SEQ ID NO: 15186 - protein, 10 aa, Artificial Sequence
  Peptide Derived from Human Papillomavirus
DISPAPDPDF

SEQ ID NO: 15187 - protein, 11 aa, Artificial Sequence
  Peptide Derived from Human Papillomavirus
DISPAPDPDFL

SEQ ID NO: 15188 - protein, 8 aa, Artificial Sequence
  Peptide Derived from Human Papillomavirus
DLSPIVPL

SEQ ID NO: 15189 - protein, 10 aa, Artificial Sequence
  Peptide Derived from Human Papillomavirus
DTIVVDGADF

SEQ ID NO: 15190 - protein, 10 aa, Artificial Sequence
  Peptide Derived from Human Papillomavirus
DTLQFQHSDI

SEQ ID NO: 15191 - protein, 10 aa, Artificial Sequence
  Peptide Derived from Human Papillomavirus
DTPVMSGPDI

SEQ ID NO: 15192 - protein, 9 aa, Artificial Sequence
  Peptide Derived from Human Papillomavirus
DTSTSSYSI

SEQ ID NO: 15193 - protein, 10 aa, Artificial Sequence
  Peptide Derived from Human Papillomavirus
DTVGPLDSSI

SEQ ID NO: 15194 - protein, 9 aa, Artificial Sequence
  Peptide Derived from Human Papillomavirus
DVDNVHTPM

SEQ ID NO: 15195 - protein, 11 aa, Artificial Sequence
  Peptide Derived from Human Papillomavirus
DVIPKVEGSTI

SEQ ID NO: 15196 - protein, 11 aa, Artificial Sequence
  Peptide Derived from Human Papillomavirus
FIEAGAPAPSI

SEQ ID NO: 15197 - protein, 10 aa, Artificial Sequence
  Peptide Derived from Human Papillomavirus
FILRRRRKRF

SEQ ID NO: 15198 - protein, 8 aa, Artificial Sequence
  Peptide Derived from Human Papillomavirus
FLTSPHKL

SEQ ID NO: 15199 - protein, 9 aa, Artificial Sequence
  Peptide Derived from Human Papillomavirus
FLTSPHKLI

SEQ ID NO: 15200 - protein, 11 aa, Artificial Sequence
  Peptide Derived from Human Papillomavirus
FLTSPHKLITY

SEQ ID NO: 15201 - protein, 8 aa, Artificial Sequence
  Peptide Derived from Human Papillomavirus
FVLHPSYF

SEQ ID NO: 15202 - protein, 9 aa, Artificial Sequence
  Peptide Derived from Human Papillomavirus
FVLHPSYFI

SEQ ID NO: 15203 - protein, 10 aa, Artificial Sequence
  Peptide Derived from Human Papillomavirus
FVLHPSYFIL

SEQ ID NO: 15204 - protein, 8 aa, Artificial Sequence
  Peptide Derived from Human Papillomavirus
FVPISPFF

SEQ ID NO: 15205 - protein, 10 aa, Artificial Sequence
  Peptide Derived from Human Papillomavirus
FVPISPFFPF

SEQ ID NO: 15206 - protein, 8 aa, Artificial Sequence
  Peptide Derived from Human Papillomavirus
GTCPPDVI

SEQ ID NO: 15207 - protein, 9 aa, Artificial Sequence
  Peptide Derived from Human Papillomavirus
GTDPPTAAI

SEQ ID NO: 15208 - protein, 11 aa, Artificial Sequence
  Peptide Derived from Human Papillomavirus
GTDPPTAAIPL

SEQ ID NO: 15209 - protein, 9 aa, Artificial Sequence
  Peptide Derived from Human Papillomavirus
GVFFGGLGI

SEQ ID NO: 15210 - protein, 8 aa, Artificial Sequence
  Peptide Derived from Human Papillomavirus
HTPMQHSY

SEQ ID NO: 15211 - protein, 11 aa, Artificial Sequence
  Peptide Derived from Human Papillomavirus
HTPMQHSYSTF

SEQ ID NO: 15212 - protein, 8 aa, Artificial Sequence
  Peptide Derived from Human Papillomavirus
HTVPNEQY

SEQ ID NO: 15213 - protein, 10 aa, Artificial Sequence
  Peptide Derived from Human Papillomavirus
HTVPNEQYEL

SEQ ID NO: 15214 - protein, 9 aa, Artificial Sequence
  Peptide Derived from Human Papillomavirus
HYYQDLSPI

SEQ ID NO: 15215 - protein, 9 aa, Artificial Sequence
  Peptide Derived from Human Papillomavirus
IIALHRPAI

SEQ ID NO: 15216 - protein, 10 aa, Artificial Sequence
  Peptide Derived from Human Papillomavirus
ILKYGSLGVF

SEQ ID NO: 15217 - protein, 11 aa, Artificial Sequence
  Peptide Derived from Human Papillomavirus
ILKYGSLGVFF

SEQ ID NO: 15218 - protein, 9 aa, Artificial Sequence
  Peptide Derived from Human Papillomavirus
ILRRRRKRF

SEQ ID NO: 15219 - protein, 11 aa, Artificial Sequence
  Peptide Derived from Human Papillomavirus
ILRRRRKRFPY

SEQ ID NO: 15220 - protein, 10 aa, Artificial Sequence
  Peptide Derived from Human Papillomavirus
ITSRRHTVRF

SEQ ID NO: 15221 - protein, 8 aa, Artificial Sequence
  Peptide Derived from Human Papillomavirus
ITYDNPAF

SEQ ID NO: 15222 - protein, 11 aa, Artificial Sequence
  Peptide Derived from Human Papillomavirus
ITYDNPAFESF

SEQ ID NO: 15223 - protein, 10 aa, Artificial Sequence
  Peptide Derived from Human Papillomavirus
IVSLIEETSF

SEQ ID NO: 15224 - protein, 11 aa, Artificial Sequence
  Peptide Derived from Human Papillomavirus
IVSLIEETSFI

SEQ ID NO: 15225 - protein, 8 aa, Artificial Sequence
  Peptide Derived from Human Papillomavirus
IVVDGADF

SEQ ID NO: 15226 - protein, 10 aa, Artificial Sequence
  Peptide Derived from Human Papillomavirus
IVVDGADFVL

SEQ ID NO: 15227 - protein, 10 aa, Artificial Sequence
  Peptide Derived from Human Papillomavirus
KLITYDNPAF

SEQ ID NO: 15228 - protein, 8 aa, Artificial Sequence
  Peptide Derived from Human Papillomavirus
KTRSGKQI

SEQ ID NO: 15229 - protein, 11 aa, Artificial Sequence
  Peptide Derived from Human Papillomavirus
KVEGSTIADQI

SEQ ID NO: 15230 - protein, 8 aa, Artificial Sequence
  Peptide Derived from Human Papillomavirus
KVVDPAFL

SEQ ID NO: 15231 - protein, 8 aa, Artificial Sequence
  Peptide Derived from Human Papillomavirus
KYGSLGVF

SEQ ID NO: 15232 - protein, 9 aa, Artificial Sequence
  Peptide Derived from Human Papillomavirus
KYGSLGVFF

SEQ ID NO: 15233 - protein, 8 aa, Artificial Sequence
  Peptide Derived from Human Papillomavirus
LFPTSSPF

SEQ ID NO: 15234 - protein, 11 aa, Artificial Sequence
  Peptide Derived from Human Papillomavirus
LFPTSSPFVPI

SEQ ID NO: 15235 - protein, 8 aa, Artificial Sequence
  Peptide Derived from Human Papillomavirus
LIEETSFI

SEQ ID NO: 15236 - protein, 9 aa, Artificial Sequence
  Peptide Derived from Human Papillomavirus
LITYDNPAF

SEQ ID NO: 15237 - protein, 8 aa, Artificial Sequence
  Peptide Derived from Human Papillomavirus
LTSPHKLI

SEQ ID NO: 15238 - protein, 10 aa, Artificial Sequence
  Peptide Derived from Human Papillomavirus
LTSPHKLITY

SEQ ID NO: 15239 - protein, 9 aa, Artificial Sequence
  Peptide Derived from Human Papillomavirus
NTGFDTPVM

SEQ ID NO: 15240 - protein, 10 aa, Artificial Sequence
  Peptide Derived from Human Papillomavirus
NVHTPMQHSY

SEQ ID NO: 15241 - protein, 10 aa, Artificial Sequence
  Peptide Derived from Human Papillomavirus
NVSIPLNTGF

SEQ ID NO: 15242 - protein, 10 aa, Artificial Sequence
  Peptide Derived from Human Papillomavirus
NVSSVGESSI

SEQ ID NO: 15243 - protein, 8 aa, Artificial Sequence
  Peptide Derived from Human Papillomavirus
NVTSSTPI

SEQ ID NO: 15244 - protein, 8 aa, Artificial Sequence
  Peptide Derived from Human Papillomavirus
PFFPFDTI

SEQ ID NO: 15245 - protein, 8 aa, Artificial Sequence
  Peptide Derived from Human Papillomavirus
PFVPISPF

SEQ ID NO: 15246 - protein, 9 aa, Artificial Sequence
  Peptide Derived from Human Papillomavirus
PFVPISPFF

SEQ ID NO: 15247 - protein, 11 aa, Artificial Sequence
  Peptide Derived from Human Papillomavirus
PFVPISPFFPF

SEQ ID NO: 15248 - protein, 11 aa, Artificial Sequence
  Peptide Derived from Human Papillomavirus
PIGTDPPTAAI

SEQ ID NO: 15249 - protein, 11 aa, Artificial Sequence
  Peptide Derived from Human Papillomavirus
PIPGSRPVARL

SEQ ID NO: 15250 - protein, 8 aa, Artificial Sequence
  Peptide Derived from Human Papillomavirus
PISPFFPF

SEQ ID NO: 15251 - protein, 11 aa, Artificial Sequence
  Peptide Derived from Human Papillomavirus
PISPFFPFDTI

SEQ ID NO: 15252 - protein, 11 aa, Artificial Sequence
  Peptide Derived from Human Papillomavirus
PLDHTVPNEQY

SEQ ID NO: 15253 - protein, 9 aa, Artificial Sequence
  Peptide Derived from Human Papillomavirus
PLDSSIVSL

SEQ ID NO: 15254 - protein, 10 aa, Artificial Sequence
  Peptide Derived from Human Papillomavirus
PLDSSIVSLI

SEQ ID NO: 15255 - protein, 9 aa, Artificial Sequence
  Peptide Derived from Human Papillomavirus
PLFPTSSPF

SEQ ID NO: 15256 - protein, 10 aa, Artificial Sequence
  Peptide Derived from Human Papillomavirus
PLHDTSTSSY

SEQ ID NO: 15257 - protein, 11 aa, Artificial Sequence
  Peptide Derived from Human Papillomavirus
PLNTGFDTPVM

SEQ ID NO: 15258 - protein, 9 aa, Artificial Sequence
  Peptide Derived from Human Papillomavirus
PMQHSYSTF

SEQ ID NO: 15259 - protein, 10 aa, Artificial Sequence
  Peptide Derived from Human Papillomavirus
PTAAIPLQPI

SEQ ID NO: 15260 - protein, 9 aa, Artificial Sequence
  Peptide Derived from Human Papillomavirus
PTFTEPSVL

SEQ ID NO: 15261 - protein, 9 aa, Artificial Sequence
  Peptide Derived from Human Papillomavirus
PTSSPFVPI

SEQ ID NO: 15262 - protein, 8 aa, Artificial Sequence
  Peptide Derived from Human Papillomavirus
PTVSTQSY

SEQ ID NO: 15263 - protein, 11 aa, Artificial Sequence
  Peptide Derived from Human Papillomavirus
PTVSTQSYENI

SEQ ID NO: 15264 - protein, 8 aa, Artificial Sequence
  Peptide Derived from Human Papillomavirus
PVARLGLY

SEQ ID NO: 15265 - protein, 8 aa, Artificial Sequence
  Peptide Derived from Human Papillomavirus
PVMSGPDI

SEQ ID NO: 15266 - protein, 10 aa, Artificial Sequence
  Peptide Derived from Human Papillomavirus
PVTVDTVGPL

SEQ ID NO: 15267 - protein, 8 aa, Artificial Sequence
  Peptide Derived from Human Papillomavirus
QIGARIHY

SEQ ID NO: 15268 - protein, 9 aa, Artificial Sequence
  Peptide Derived from Human Papillomavirus
QIGARIHYY

SEQ ID NO: 15269 - protein, 8 aa, Artificial Sequence
  Peptide Derived from Human Papillomavirus
QILKYGSL

SEQ ID NO: 15270 - protein, 11 aa, Artificial Sequence
  Peptide Derived from Human Papillomavirus
QILKYGSLGVF

SEQ ID NO: 15271 - protein, 11 aa, Artificial Sequence
  Peptide Derived from Human Papillomavirus
QTISTHLNPTF

SEQ ID NO: 15272 - protein, 9 aa, Artificial Sequence
  Peptide Derived from Human Papillomavirus
QVKVVDPAF

SEQ ID NO: 15273 - protein, 10 aa, Artificial Sequence
  Peptide Derived from Human Papillomavirus
QVKVVDPAFL

SEQ ID NO: 15274 - protein, 11 aa, Artificial Sequence
  Peptide Derived from Human Papillomavirus
RFSRVGQKATL

SEQ ID NO: 15275 - protein, 8 aa, Artificial Sequence
  Peptide Derived from Human Papillomavirus
RIHYYQDL

SEQ ID NO: 15276 - protein, 11 aa, Artificial Sequence
  Peptide Derived from Human Papillomavirus
RIHYYQDLSPI

SEQ ID NO: 15277 - protein, 9 aa, Artificial Sequence
  Peptide Derived from Human Papillomavirus
RTSNVSIPL

SEQ ID NO: 15278 - protein, 8 aa, Artificial Sequence
  Peptide Derived from Human Papillomavirus
RVGQKATL

SEQ ID NO: 15279 - protein, 8 aa, Artificial Sequence
  Peptide Derived from Human Papillomavirus
SFDPEDTL

SEQ ID NO: 15280 - protein, 10 aa, Artificial Sequence
  Peptide Derived from Human Papillomavirus
SFDPEDTLQF

SEQ ID NO: 15281 - protein, 10 aa, Artificial Sequence
  Peptide Derived from Human Papillomavirus
SINDGLYDVY

SEQ ID NO: 15282 - protein, 8 aa, Artificial Sequence
  Peptide Derived from Human Papillomavirus
SIPLNTGF

SEQ ID NO: 15283 - protein, 8 aa, Artificial Sequence
  Peptide Derived from Human Papillomavirus
SIPTPSGF

SEQ ID NO: 15284 - protein, 9 aa, Artificial Sequence
  Peptide Derived from Human Papillomavirus
SIQTISTHL

SEQ ID NO: 15285 - protein, 11 aa, Artificial Sequence
  Peptide Derived from Human Papillomavirus
SIVSLIEETSF

SEQ ID NO: 15286 - protein, 9 aa, Artificial Sequence
  Peptide Derived from Human Papillomavirus
SLGVFFGGL

SEQ ID NO: 15287 - protein, 11 aa, Artificial Sequence
  Peptide Derived from Human Papillomavirus
SLGVFFGGLGI

SEQ ID NO: 15288 - protein, 8 aa, Artificial Sequence
  Peptide Derived from Human Papillomavirus
SLIEETSF

SEQ ID NO: 15289 - protein, 9 aa, Artificial Sequence
  Peptide Derived from Human Papillomavirus
SLIEETSFI

SEQ ID NO: 15290 - protein, 8 aa, Artificial Sequence
  Peptide Derived from Human Papillomavirus
STHLNPTF

SEQ ID NO: 15291 - protein, 8 aa, Artificial Sequence
  Peptide Derived from Human Papillomavirus
STIADQIL

SEQ ID NO: 15292 - protein, 10 aa, Artificial Sequence
  Peptide Derived from Human Papillomavirus
STIADQILKY

SEQ ID NO: 15293 - protein, 8 aa, Artificial Sequence
  Peptide Derived from Human Papillomavirus
STQSYENI

SEQ ID NO: 15294 - protein, 10 aa, Artificial Sequence
  Peptide Derived from Human Papillomavirus
STQSYENIPM

SEQ ID NO: 15295 - protein, 11 aa, Artificial Sequence
  Peptide Derived from Human Papillomavirus
STSSYSINDGL

SEQ ID NO: 15296 - protein, 10 aa, Artificial Sequence
  Peptide Derived from Human Papillomavirus
SVGESSIQTI

SEQ ID NO: 15297 - protein, 10 aa, Artificial Sequence
  Peptide Derived from Human Papillomavirus
SYENIPMDTF

SEQ ID NO: 15298 - protein, 8 aa, Artificial Sequence
  Peptide Derived from Human Papillomavirus
SYSINDGL

SEQ ID NO: 15299 - protein, 9 aa, Artificial Sequence
  Peptide Derived from Human Papillomavirus
SYSINDGLY

SEQ ID NO: 15300 - protein, 8 aa, Artificial Sequence
  Peptide Derived from Human Papillomavirus
TFTEPSVL

SEQ ID NO: 15301 - protein, 9 aa, Artificial Sequence
  Peptide Derived from Human Papillomavirus
TIADQILKY

SEQ ID NO: 15302 - protein, 10 aa, Artificial Sequence
  Peptide Derived from Human Papillomavirus
TISTHLNPTF

SEQ ID NO: 15303 - protein, 9 aa, Artificial Sequence
  Peptide Derived from Human Papillomavirus
TIVVDGADF

SEQ ID NO: 15304 - protein, 11 aa, Artificial Sequence
  Peptide Derived from Human Papillomavirus
TIVVDGADFVL

SEQ ID NO: 15305 - protein, 10 aa, Artificial Sequence
  Peptide Derived from Human Papillomavirus
TLKTRSGKQI

SEQ ID NO: 15306 - protein, 9 aa, Artificial Sequence
  Peptide Derived from Human Papillomavirus
TLQFQHSDI

SEQ ID NO: 15307 - protein, 9 aa, Artificial Sequence
  Peptide Derived from Human Papillomavirus
TTRTSNVSI

SEQ ID NO: 15308 - protein, 11 aa, Artificial Sequence
  Peptide Derived from Human Papillomavirus
TTRTSNVSIPL

SEQ ID NO: 15309 - protein, 10 aa, Artificial Sequence
  Peptide Derived from Human Papillomavirus
TTSADTTPAI

SEQ ID NO: 15310 - protein, 11 aa, Artificial Sequence
  Peptide Derived from Human Papillomavirus
TTSADTTPAII

SEQ ID NO: 15311 - protein, 8 aa, Artificial Sequence
  Peptide Derived from Human Papillomavirus
TVDTVGPL

SEQ ID NO: 15312 - protein, 9 aa, Artificial Sequence
  Peptide Derived from Human Papillomavirus
TVGPLDSSI

SEQ ID NO: 15313 - protein, 9 aa, Artificial Sequence
  Peptide Derived from Human Papillomavirus
TVPNEQYEL

SEQ ID NO: 15314 - protein, 10 aa, Artificial Sequence
  Peptide Derived from Human Papillomavirus
TVSTQSYENI

SEQ ID NO: 15315 - protein, 10 aa, Artificial Sequence
  Peptide Derived from Human Papillomavirus
TYDNPAFESF

SEQ ID NO: 15316 - protein, 8 aa, Artificial Sequence
  Peptide Derived from Human Papillomavirus
VFFGGLGI

SEQ ID NO: 15317 - protein, 10 aa, Artificial Sequence
  Peptide Derived from Human Papillomavirus
VIPKVEGSTI

SEQ ID NO: 15318 - protein, 8 aa, Artificial Sequence
  Peptide Derived from Human Papillomavirus
VLHPSYFI

SEQ ID NO: 15319 - protein, 9 aa, Artificial Sequence
  Peptide Derived from Human Papillomavirus
VLHPSYFIL

SEQ ID NO: 15320 - protein, 11 aa, Artificial Sequence
  Peptide Derived from Human Papillomavirus
VMSGPDIPSPL

SEQ ID NO: 15321 - protein, 11 aa, Artificial Sequence
  Peptide Derived from Human Papillomavirus
VTTSADTTPAI

SEQ ID NO: 15322 - protein, 9 aa, Artificial Sequence
  Peptide Derived from Human Papillomavirus
VTVDTVGPL

SEQ ID NO: 15323 - protein, 9 aa, Artificial Sequence
  Peptide Derived from Human Papillomavirus
VVDGADFVL

SEQ ID NO: 15324 - protein, 11 aa, Artificial Sequence
  Peptide Derived from Human Papillomavirus
YFILRRRRKRF

SEQ ID NO: 15325 - protein, 8 aa, Artificial Sequence
  Peptide Derived from Human Papillomavirus
YYQDLSPI

SEQ ID NO: 15326 - protein, 11 aa, Artificial Sequence
  Peptide Derived from Human Papillomavirus
YYQDLSPIVPL

SEQ ID NO: 15327 - protein, 11 aa, Artificial Sequence
  Peptide Derived from Human Papillomavirus
AFLKSNCQAKY

SEQ ID NO: 15328 - protein, 9 aa, Artificial Sequence
  Peptide Derived from Human Papillomavirus
ALDGNPISI

SEQ ID NO: 15329 - protein, 9 aa, Artificial Sequence
  Peptide Derived from Human Papillomavirus
ALYWYRTGI

SEQ ID NO: 15330 - protein, 9 aa, Artificial Sequence
  Peptide Derived from Human Papillomavirus
AMLAVFKDI

SEQ ID NO: 15331 - protein, 10 aa, Artificial Sequence
  Peptide Derived from Human Papillomavirus
AMLAVFKDIY

SEQ ID NO: 15332 - protein, 11 aa, Artificial Sequence
  Peptide Derived from Human Papillomavirus
AMLDDATHTCW

SEQ ID NO: 15333 - protein, 8 aa, Artificial Sequence
  Peptide Derived from Human Papillomavirus
ATDTGSDM

SEQ ID NO: 15334 - protein, 11 aa, Artificial Sequence
  Peptide Derived from Human Papillomavirus
ATDTGSDMVDF

SEQ ID NO: 15335 - protein, 8 aa, Artificial Sequence
  Peptide Derived from Human Papillomavirus
ATHTCWTY

SEQ ID NO: 15336 - protein, 9 aa, Artificial Sequence
  Peptide Derived from Human Papillomavirus
ATHTCWTYF

SEQ ID NO: 15337 - protein, 10 aa, Artificial Sequence
  Peptide Derived from Human Papillomavirus
ATLYAHIQCL

SEQ ID NO: 15338 - protein, 9 aa, Artificial Sequence
  Peptide Derived from Human Papillomavirus
AVFKDIYGL

SEQ ID NO: 15339 - protein, 11 aa, Artificial Sequence
  Peptide Derived from Human Papillomavirus
AVFKDIYGLSF

SEQ ID NO: 15340 - protein, 10 aa, Artificial Sequence
  Peptide Derived from Human Papillomavirus
CFFERTWSRL

SEQ ID NO: 15341 - protein, 9 aa, Artificial Sequence
  Peptide Derived from Human Papillomavirus
CLDCKWGVL

SEQ ID NO: 15342 - protein, 10 aa, Artificial Sequence
  Peptide Derived from Human Papillomavirus
CLDCKWGVLI

SEQ ID NO: 15343 - protein, 11 aa, Artificial Sequence
  Peptide Derived from Human Papillomavirus
CLDCKWGVLIL

SEQ ID NO: 15344 - protein, 9 aa, Artificial Sequence
  Peptide Derived from Human Papillomavirus
CMLIEPPKL

SEQ ID NO: 15345 - protein, 8 aa, Artificial Sequence
  Peptide Derived from Human Papillomavirus
CTDWVMAI

SEQ ID NO: 15346 - protein, 9 aa, Artificial Sequence
  Peptide Derived from Human Papillomavirus
CTDWVMAIF

SEQ ID NO: 15347 - protein, 10 aa, Artificial Sequence
  Peptide Derived from Human Papillomavirus
CVTGQNTRPL

SEQ ID NO: 15348 - protein, 8 aa, Artificial Sequence
  Peptide Derived from Human Papillomavirus
CWTYFDNY

SEQ ID NO: 15349 - protein, 9 aa, Artificial Sequence
  Peptide Derived from Human Papillomavirus
CWTYFDNYM

SEQ ID NO: 15350 - protein, 9 aa, Artificial Sequence
  Peptide Derived from Human Papillomavirus
DFIDTQLSI

SEQ ID NO: 15351 - protein, 10 aa, Artificial Sequence
  Peptide Derived from Human Papillomavirus
DIYGLSFTDL

SEQ ID NO: 15352 - protein, 8 aa, Artificial Sequence
  Peptide Derived from Human Papillomavirus
DLSDMVQW

SEQ ID NO: 15353 - protein, 10 aa, Artificial Sequence
  Peptide Derived from Human Papillomavirus
DLSDMVQWAF

SEQ ID NO: 15354 - protein, 9 aa, Artificial Sequence
  Peptide Derived from Human Papillomavirus
DLSPRLQEI

SEQ ID NO: 15355 - protein, 11 aa, Artificial Sequence
  Peptide Derived from Human Papillomavirus
DLSPRLQEISL

SEQ ID NO: 15356 - protein, 8 aa, Artificial Sequence
  Peptide Derived from Human Papillomavirus
DLTDESDM

SEQ ID NO: 15357 - protein, 10 aa, Artificial Sequence
  Peptide Derived from Human Papillomavirus
DLTDESDMAF

SEQ ID NO: 15358 - protein, 9 aa, Artificial Sequence
  Peptide Derived from Human Papillomavirus
DMAFQYAQL

SEQ ID NO: 15359 - protein, 10 aa, Artificial Sequence
  Peptide Derived from Human Papillomavirus
DMVDFIDTQL

SEQ ID NO: 15360 - protein, 11 aa, Artificial Sequence
  Peptide Derived from Human Papillomavirus
DMVQWAFDNDL

SEQ ID NO: 15361 - protein, 8 aa, Artificial Sequence
  Peptide Derived from Human Papillomavirus
DTDLSPRL

SEQ ID NO: 15362 - protein, 11 aa, Artificial Sequence
  Peptide Derived from Human Papillomavirus
DTDLSPRLQEI

SEQ ID NO: 15363 - protein, 10 aa, Artificial Sequence
  Peptide Derived from Human Papillomavirus
DTEGIPFGTF

SEQ ID NO: 15364 - protein, 9 aa, Artificial Sequence
  Peptide Derived from Human Papillomavirus
DTGSDMVDF

SEQ ID NO: 15365 - protein, 10 aa, Artificial Sequence
  Peptide Derived from Human Papillomavirus
DTGSDMVDFI

SEQ ID NO: 15366 - protein, 9 aa, Artificial Sequence
  Peptide Derived from Human Papillomavirus
DTPEWIQRL

SEQ ID NO: 15367 - protein, 11 aa, Artificial Sequence
  Peptide Derived from Human Papillomavirus
DTPEWIQRLTI

SEQ ID NO: 15368 - protein, 8 aa, Artificial Sequence
  Peptide Derived from Human Papillomavirus
DWRPIVQF

SEQ ID NO: 15369 - protein, 9 aa, Artificial Sequence
  Peptide Derived from Human Papillomavirus
DWRPIVQFL

SEQ ID NO: 15370 - protein, 11 aa, Artificial Sequence
  Peptide Derived from Human Papillomavirus
DWRPIVQFLRY

SEQ ID NO: 15371 - protein, 9 aa, Artificial Sequence
  Peptide Derived from Human Papillomavirus
EFISFLRAL

SEQ ID NO: 15372 - protein, 10 aa, Artificial Sequence
  Peptide Derived from Human Papillomavirus
EINDKNWKCF

SEQ ID NO: 15373 - protein, 11 aa, Artificial Sequence
  Peptide Derived from Human Papillomavirus
EINDKNWKCFF

SEQ ID NO: 15374 - protein, 10 aa, Artificial Sequence
  Peptide Derived from Human Papillomavirus
ETATDTGSDM

SEQ ID NO: 15375 - protein, 11 aa, Artificial Sequence
  Peptide Derived from Human Papillomavirus
ETCMLIEPPKL

SEQ ID NO: 15376 - protein, 9 aa, Artificial Sequence
  Peptide Derived from Human Papillomavirus
EVQNDAQVL

SEQ ID NO: 15377 - protein, 11 aa, Artificial Sequence
  Peptide Derived from Human Papillomavirus
EVQNDAQVLHL

SEQ ID NO: 15378 - protein, 9 aa, Artificial Sequence
  Peptide Derived from Human Papillomavirus
EVSGDTPEW

SEQ ID NO: 15379 - protein, 10 aa, Artificial Sequence
  Peptide Derived from Human Papillomavirus
EVSGDTPEWI

SEQ ID NO: 15380 - protein, 8 aa, Artificial Sequence
  Peptide Derived from Human Papillomavirus
EWIQRLTI

SEQ ID NO: 15381 - protein, 9 aa, Artificial Sequence
  Peptide Derived from Human Papillomavirus
EWIQRLTII

SEQ ID NO: 15382 - protein, 9 aa, Artificial Sequence
  Peptide Derived from Human Papillomavirus
FFERTWSRL

SEQ ID NO: 15383 - protein, 11 aa, Artificial Sequence
  Peptide Derived from Human Papillomavirus
FFERTWSRLDL

SEQ ID NO: 15384 - protein, 8 aa, Artificial Sequence
  Peptide Derived from Human Papillomavirus
FIDTQLSI

SEQ ID NO: 15385 - protein, 9 aa, Artificial Sequence
  Peptide Derived from Human Papillomavirus
FIHFLQGAI

SEQ ID NO: 15386 - protein, 10 aa, Artificial Sequence
  Peptide Derived from Human Papillomavirus
FIHFLQGAII

SEQ ID NO: 15387 - protein, 8 aa, Artificial Sequence
  Peptide Derived from Human Papillomavirus
FISFLRAL

SEQ ID NO: 15388 - protein, 11 aa, Artificial Sequence
  Peptide Derived from Human Papillomavirus
FISFLRALKEF

SEQ ID NO: 15389 - protein, 11 aa, Artificial Sequence
  Peptide Derived from Human Papillomavirus
FLKGTPKKNCI

SEQ ID NO: 15390 - protein, 10 aa, Artificial Sequence
  Peptide Derived from Human Papillomavirus
FLKSNCQAKY

SEQ ID NO: 15391 - protein, 11 aa, Artificial Sequence
  Peptide Derived from Human Papillomavirus
FLKSNCQAKYL

SEQ ID NO: 15392 - protein, 9 aa, Artificial Sequence
  Peptide Derived from Human Papillomavirus
FLQGAIISF

SEQ ID NO: 15393 - protein, 8 aa, Artificial Sequence
  Peptide Derived from Human Papillomavirus
FLRALKEF

SEQ ID NO: 15394 - protein, 9 aa, Artificial Sequence
  Peptide Derived from Human Papillomavirus
FLRALKEFL

SEQ ID NO: 15395 - protein, 9 aa, Artificial Sequence
  Peptide Derived from Human Papillomavirus
FLRYQGVEF

SEQ ID NO: 15396 - protein, 10 aa, Artificial Sequence
  Peptide Derived from Human Papillomavirus
FLRYQGVEFI

SEQ ID NO: 15397 - protein, 8 aa, Artificial Sequence
  Peptide Derived from Human Papillomavirus
FTDLVRNF

SEQ ID NO: 15398 - protein, 9 aa, Artificial Sequence
  Peptide Derived from Human Papillomavirus
FTFPHAFPF

SEQ ID NO: 15399 - protein, 8 aa, Artificial Sequence
  Peptide Derived from Human Papillomavirus
FTISDSGY

SEQ ID NO: 15400 - protein, 8 aa, Artificial Sequence
  Peptide Derived from Human Papillomavirus
FVNSNSHF

SEQ ID NO: 15401 - protein, 9 aa, Artificial Sequence
  Peptide Derived from Human Papillomavirus
FVNSNSHFW

SEQ ID NO: 15402 - protein, 10 aa, Artificial Sequence
  Peptide Derived from Human Papillomavirus
FVNSNSHFWL

SEQ ID NO: 15403 - protein, 11 aa, Artificial Sequence
  Peptide Derived from Human Papillomavirus
GFKTLIKPATL

SEQ ID NO: 15404 - protein, 9 aa, Artificial Sequence
  Peptide Derived from Human Papillomavirus
GIDDSNFDL

SEQ ID NO: 15405 - protein, 11 aa, Artificial Sequence
  Peptide Derived from Human Papillomavirus
GLSFTDLVRNF

SEQ ID NO: 15406 - protein, 8 aa, Artificial Sequence
  Peptide Derived from Human Papillomavirus
GMSFIHFL

SEQ ID NO: 15407 - protein, 8 aa, Artificial Sequence
  Peptide Derived from Human Papillomavirus
GTGCNGWF

SEQ ID NO: 15408 - protein, 9 aa, Artificial Sequence
  Peptide Derived from Human Papillomavirus
GTGCNGWFF

SEQ ID NO: 15409 - protein, 8 aa, Artificial Sequence
  Peptide Derived from Human Papillomavirus
GTPKKNCI

SEQ ID NO: 15410 - protein, 9 aa, Artificial Sequence
  Peptide Derived from Human Papillomavirus
GTPKKNCIL

SEQ ID NO: 15411 - protein, 10 aa, Artificial Sequence
  Peptide Derived from Human Papillomavirus
GTPKKNCILL

SEQ ID NO: 15412 - protein, 11 aa, Artificial Sequence
  Peptide Derived from Human Papillomavirus
GTPKKNCILLY

SEQ ID NO: 15413 - protein, 8 aa, Artificial Sequence
  Peptide Derived from Human Papillomavirus
GVEFISFL

SEQ ID NO: 15414 - protein, 11 aa, Artificial Sequence
  Peptide Derived from Human Papillomavirus
GVEFISFLRAL

SEQ ID NO: 15415 - protein, 8 aa, Artificial Sequence
  Peptide Derived from Human Papillomavirus
GVLILALL

SEQ ID NO: 15416 - protein, 10 aa, Artificial Sequence
  Peptide Derived from Human Papillomavirus
GVLILALLRY

SEQ ID NO: 15417 - protein, 10 aa, Artificial Sequence
  Peptide Derived from Human Papillomavirus
GVNPTVAEGF

SEQ ID NO: 15418 - protein, 8 aa, Artificial Sequence
  Peptide Derived from Human Papillomavirus
GWFFVETI

SEQ ID NO: 15419 - protein, 8 aa, Artificial Sequence
  Peptide Derived from Human Papillomavirus
HFLQGAII

SEQ ID NO: 15420 - protein, 10 aa, Artificial Sequence
  Peptide Derived from Human Papillomavirus
HFLQGAIISF

SEQ ID NO: 15421 - protein, 9 aa, Artificial Sequence
  Peptide Derived from Human Papillomavirus
HIQCLDCKW

SEQ ID NO: 15422 - protein, 10 aa, Artificial Sequence
  Peptide Derived from Human Papillomavirus
HTCWTYFDNY

SEQ ID NO: 15423 - protein, 11 aa, Artificial Sequence
  Peptide Derived from Human Papillomavirus
HTCWTYFDNYM

SEQ ID NO: 15424 - protein, 8 aa, Artificial Sequence
  Peptide Derived from Human Papillomavirus
HVPETCML

SEQ ID NO: 15425 - protein, 9 aa, Artificial Sequence
  Peptide Derived from Human Papillomavirus
HVPETCMLI

SEQ ID NO: 15426 - protein, 10 aa, Artificial Sequence
  Peptide Derived from Human Papillomavirus
HYKRAQKRQM

SEQ ID NO: 15427 - protein, 11 aa, Artificial Sequence
  Peptide Derived from Human Papillomavirus
IIQHGIDDSNF

SEQ ID NO: 15428 - protein, 11 aa, Artificial Sequence
  Peptide Derived from Human Papillomavirus
IISFVNSNSHF

SEQ ID NO: 15429 - protein, 8 aa, Artificial Sequence
  Peptide Derived from Human Papillomavirus
ITELKELL

SEQ ID NO: 15430 - protein, 10 aa, Artificial Sequence
  Peptide Derived from Human Papillomavirus
IVEKKTGDVI

SEQ ID NO: 15431 - protein, 9 aa, Artificial Sequence
  Peptide Derived from Human Papillomavirus
IYGLSFTDL

SEQ ID NO: 15432 - protein, 8 aa, Artificial Sequence
  Peptide Derived from Human Papillomavirus
KIDEGGDW

SEQ ID NO: 15433 - protein, 11 aa, Artificial Sequence
  Peptide Derived from Human Papillomavirus
KIDEGGDWRPI

SEQ ID NO: 15434 - protein, 9 aa, Artificial Sequence
  Peptide Derived from Human Papillomavirus
KLRSSVAAL

SEQ ID NO: 15435 - protein, 10 aa, Artificial Sequence
  Peptide Derived from Human Papillomavirus
KLRSSVAALY

SEQ ID NO: 15436 - protein, 11 aa, Artificial Sequence
  Peptide Derived from Human Papillomavirus
KLRSSVAALYW

SEQ ID NO: 15437 - protein, 9 aa, Artificial Sequence
  Peptide Derived from Human Papillomavirus
KTLIKPATL

SEQ ID NO: 15438 - protein, 10 aa, Artificial Sequence
  Peptide Derived from Human Papillomavirus
KTLIKPATLY

SEQ ID NO: 15439 - protein, 9 aa, Artificial Sequence
  Peptide Derived from Human Papillomavirus
KTTCTDWVM

SEQ ID NO: 15440 - protein, 11 aa, Artificial Sequence
  Peptide Derived from Human Papillomavirus
KTTCTDWVMAI

SEQ ID NO: 15441 - protein, 9 aa, Artificial Sequence
  Peptide Derived from Human Papillomavirus
KWGVLILAL

SEQ ID NO: 15442 - protein, 10 aa, Artificial Sequence
  Peptide Derived from Human Papillomavirus
KWGVLILALL

SEQ ID NO: 15443 - protein, 9 aa, Artificial Sequence
  Peptide Derived from Human Papillomavirus
KYLKDCAVM

SEQ ID NO: 15444 - protein, 9 aa, Artificial Sequence
  Peptide Derived from Human Papillomavirus
LFTISDSGY

SEQ ID NO: 15445 - protein, 8 aa, Artificial Sequence
  Peptide Derived from Human Papillomavirus
LIKPATLY

SEQ ID NO: 15446 - protein, 11 aa, Artificial Sequence
  Peptide Derived from Human Papillomavirus
LIKPATLYAHI

SEQ ID NO: 15447 - protein, 8 aa, Artificial Sequence
  Peptide Derived from Human Papillomavirus
LILALLRY

SEQ ID NO: 15448 - protein, 9 aa, Artificial Sequence
  Peptide Derived from Human Papillomavirus
LLHVPETCM

SEQ ID NO: 15449 - protein, 10 aa, Artificial Sequence
  Peptide Derived from Human Papillomavirus
LLHVPETCML

SEQ ID NO: 15450 - protein, 11 aa, Artificial Sequence
  Peptide Derived from Human Papillomavirus
LLHVPETCMLI

SEQ ID NO: 15451 - protein, 11 aa, Artificial Sequence
  Peptide Derived from Human Papillomavirus
LLQASNKKAAM

SEQ ID NO: 15452 - protein, 9 aa, Artificial Sequence
  Peptide Derived from Human Papillomavirus
LLQLKCPPI

SEQ ID NO: 15453 - protein, 10 aa, Artificial Sequence
  Peptide Derived from Human Papillomavirus
LLQLKCPPIL

SEQ ID NO: 15454 - protein, 11 aa, Artificial Sequence
  Peptide Derived from Human Papillomavirus
LLQLKCPPILL

SEQ ID NO: 15455 - protein, 11 aa, Artificial Sequence
  Peptide Derived from Human Papillomavirus
LLRYKCGKNRL

SEQ ID NO: 15456 - protein, 9 aa, Artificial Sequence
  Peptide Derived from Human Papillomavirus
LTDESDMAF

SEQ ID NO: 15457 - protein, 11 aa, Artificial Sequence
  Peptide Derived from Human Papillomavirus
LTDESDMAFQY

SEQ ID NO: 15458 - protein, 8 aa, Artificial Sequence
  Peptide Derived from Human Papillomavirus
LTIIQHGI

SEQ ID NO: 15459 - protein, 10 aa, Artificial Sequence
  Peptide Derived from Human Papillomavirus
LTVAKGLSTL

SEQ ID NO: 15460 - protein, 11 aa, Artificial Sequence
  Peptide Derived from Human Papillomavirus
LTVAKGLSTLL

SEQ ID NO: 15461 - protein, 8 aa, Artificial Sequence
  Peptide Derived from Human Papillomavirus
LYAHIQCL

SEQ ID NO: 15462 - protein, 11 aa, Artificial Sequence
  Peptide Derived from Human Papillomavirus
LYGPANTGKSY

SEQ ID NO: 15463 - protein, 8 aa, Artificial Sequence
  Peptide Derived from Human Papillomavirus
LYWYRTGI

SEQ ID NO: 15464 - protein, 11 aa, Artificial Sequence
  Peptide Derived from Human Papillomavirus
LYWYRTGISNI

SEQ ID NO: 15465 - protein, 8 aa, Artificial Sequence
  Peptide Derived from Human Papillomavirus
MLAVFKDI

SEQ ID NO: 15466 - protein, 9 aa, Artificial Sequence
  Peptide Derived from Human Papillomavirus
MLAVFKDIY

SEQ ID NO: 15467 - protein, 11 aa, Artificial Sequence
  Peptide Derived from Human Papillomavirus
MLAVFKDIYGL

SEQ ID NO: 15468 - protein, 10 aa, Artificial Sequence
  Peptide Derived from Human Papillomavirus
MLDDATHTCW

SEQ ID NO: 15469 - protein, 8 aa, Artificial Sequence
  Peptide Derived from Human Papillomavirus
MLIEPPKL

SEQ ID NO: 15470 - protein, 9 aa, Artificial Sequence
  Peptide Derived from Human Papillomavirus
MVDFIDTQL

SEQ ID NO: 15471 - protein, 11 aa, Artificial Sequence
  Peptide Derived from Human Papillomavirus
MVDFIDTQLSI

SEQ ID NO: 15472 - protein, 10 aa, Artificial Sequence
  Peptide Derived from Human Papillomavirus
MVQWAFDNDL

SEQ ID NO: 15473 - protein, 10 aa, Artificial Sequence
  Peptide Derived from Human Papillomavirus
NFDLSDMVQW

SEQ ID NO: 15474 - protein, 10 aa, Artificial Sequence
  Peptide Derived from Human Papillomavirus
NIDPAKDNKW

SEQ ID NO: 15475 - protein, 8 aa, Artificial Sequence
  Peptide Derived from Human Papillomavirus
NMSQWIKY

SEQ ID NO: 15476 - protein, 9 aa, Artificial Sequence
  Peptide Derived from Human Papillomavirus
NTGKSYFGM

SEQ ID NO: 15477 - protein, 11 aa, Artificial Sequence
  Peptide Derived from Human Papillomavirus
NTGKSYFGMSF

SEQ ID NO: 15478 - protein, 8 aa, Artificial Sequence
  Peptide Derived from Human Papillomavirus
NVDPHCSI

SEQ ID NO: 15479 - protein, 11 aa, Artificial Sequence
  Peptide Derived from Human Papillomavirus
NVDPHCSITEL

SEQ ID NO: 15480 - protein, 10 aa, Artificial Sequence
  Peptide Derived from Human Papillomavirus
NWKCFFERTW

SEQ ID NO: 15481 - protein, 10 aa, Artificial Sequence
  Peptide Derived from Human Papillomavirus
PFDKNGNPVY

SEQ ID NO: 15482 - protein, 8 aa, Artificial Sequence
  Peptide Derived from Human Papillomavirus
PILLTSNI

SEQ ID NO: 15483 - protein, 11 aa, Artificial Sequence
  Peptide Derived from Human Papillomavirus
PISIDRKHKPL

SEQ ID NO: 15484 - protein, 8 aa, Artificial Sequence
  Peptide Derived from Human Papillomavirus
PIVQFLRY

SEQ ID NO: 15485 - protein, 9 aa, Artificial Sequence
  Peptide Derived from Human Papillomavirus
PLADTKVAM

SEQ ID NO: 15486 - protein, 10 aa, Artificial Sequence
  Peptide Derived from Human Papillomavirus
PLADTKVAML

SEQ ID NO: 15487 - protein, 10 aa, Artificial Sequence
  Peptide Derived from Human Papillomavirus
PLLQLKCPPI

SEQ ID NO: 15488 - protein, 11 aa, Artificial Sequence
  Peptide Derived from Human Papillomavirus
PLLQLKCPPIL

SEQ ID NO: 15489 - protein, 10 aa, Artificial Sequence
  Peptide Derived from Human Papillomavirus
PTVAEGFKTL

SEQ ID NO: 15490 - protein, 11 aa, Artificial Sequence
  Peptide Derived from Human Papillomavirus
PTVAEGFKTLI

SEQ ID NO: 15491 - protein, 10 aa, Artificial Sequence
  Peptide Derived from Human Papillomavirus
PVYEINDKNW

SEQ ID NO: 15492 - protein, 10 aa, Artificial Sequence
  Peptide Derived from Human Papillomavirus
PYLESRVTVF

SEQ ID NO: 15493 - protein, 10 aa, Artificial Sequence
  Peptide Derived from Human Papillomavirus
QFLRYQGVEF

SEQ ID NO: 15494 - protein, 11 aa, Artificial Sequence
  Peptide Derived from Human Papillomavirus
QFLRYQGVEFI

SEQ ID NO: 15495 - protein, 8 aa, Artificial Sequence
  Peptide Derived from Human Papillomavirus
QLKCPPIL

SEQ ID NO: 15496 - protein, 9 aa, Artificial Sequence
  Peptide Derived from Human Papillomavirus
QLKCPPILL

SEQ ID NO: 15497 - protein, 8 aa, Artificial Sequence
  Peptide Derived from Human Papillomavirus
QLSVDTDL

SEQ ID NO: 15498 - protein, 8 aa, Artificial Sequence
  Peptide Derived from Human Papillomavirus
QMNMSQWI

SEQ ID NO: 15499 - protein, 10 aa, Artificial Sequence
  Peptide Derived from Human Papillomavirus
QMNMSQWIKY

SEQ ID NO: 15500 - protein, 10 aa, Artificial Sequence
  Peptide Derived from Human Papillomavirus
QVLHLLKRKF

SEQ ID NO: 15501 - protein, 8 aa, Artificial Sequence
  Peptide Derived from Human Papillomavirus
QWAFDNDL

SEQ ID NO: 15502 - protein, 10 aa, Artificial Sequence
  Peptide Derived from Human Papillomavirus
QWIKYRCSKI

SEQ ID NO: 15503 - protein, 10 aa, Artificial Sequence
  Peptide Derived from Human Papillomavirus
RLFTISDSGY

SEQ ID NO: 15504 - protein, 9 aa, Artificial Sequence
  Peptide Derived from Human Papillomavirus
RLTIIQHGI

SEQ ID NO: 15505 - protein, 8 aa, Artificial Sequence
  Peptide Derived from Human Papillomavirus
RLTVAKGL

SEQ ID NO: 15506 - protein, 11 aa, Artificial Sequence
  Peptide Derived from Human Papillomavirus
RLTVAKGLSTL

SEQ ID NO: 15507 - protein, 8 aa, Artificial Sequence
  Peptide Derived from Human Papillomavirus
RTWSRLDL

SEQ ID NO: 15508 - protein, 11 aa, Artificial Sequence
  Peptide Derived from Human Papillomavirus
RVTVFTFPHAF

SEQ ID NO: 15509 - protein, 9 aa, Artificial Sequence
  Peptide Derived from Human Papillomavirus
RYKCGKNRL

SEQ ID NO: 15510 - protein, 8 aa, Artificial Sequence
  Peptide Derived from Human Papillomavirus
RYQGVEFI

SEQ ID NO: 15511 - protein, 10 aa, Artificial Sequence
  Peptide Derived from Human Papillomavirus
RYQGVEFISF

SEQ ID NO: 15512 - protein, 11 aa, Artificial Sequence
  Peptide Derived from Human Papillomavirus
RYQGVEFISFL

SEQ ID NO: 15513 - protein, 10 aa, Artificial Sequence
  Peptide Derived from Human Papillomavirus
SFIHFLQGAI

SEQ ID NO: 15514 - protein, 11 aa, Artificial Sequence
  Peptide Derived from Human Papillomavirus
SFIHFLQGAII

SEQ ID NO: 15515 - protein, 9 aa, Artificial Sequence
  Peptide Derived from Human Papillomavirus
SFLRALKEF

SEQ ID NO: 15516 - protein, 10 aa, Artificial Sequence
  Peptide Derived from Human Papillomavirus
SFLRALKEFL

SEQ ID NO: 15517 - protein, 9 aa, Artificial Sequence
  Peptide Derived from Human Papillomavirus
SFTDLVRNF

SEQ ID NO: 15518 - protein, 9 aa, Artificial Sequence
  Peptide Derived from Human Papillomavirus
SFVNSNSHF

SEQ ID NO: 15519 - protein, 10 aa, Artificial Sequence
  Peptide Derived from Human Papillomavirus
SFVNSNSHFW

SEQ ID NO: 15520 - protein, 11 aa, Artificial Sequence
  Peptide Derived from Human Papillomavirus
SFVNSNSHFWL

SEQ ID NO: 15521 - protein, 9 aa, Artificial Sequence
  Peptide Derived from Human Papillomavirus
SIDRKHKPL

SEQ ID NO: 15522 - protein, 10 aa, Artificial Sequence
  Peptide Derived from Human Papillomavirus
SIDRKHKPLL

SEQ ID NO: 15523 - protein, 8 aa, Artificial Sequence
  Peptide Derived from Human Papillomavirus
SITELKEL

SEQ ID NO: 15524 - protein, 9 aa, Artificial Sequence
  Peptide Derived from Human Papillomavirus
SITELKELL

SEQ ID NO: 15525 - protein, 11 aa, Artificial Sequence
  Peptide Derived from Human Papillomavirus
STLLHVPETCM

SEQ ID NO: 15526 - protein, 8 aa, Artificial Sequence
  Peptide Derived from Human Papillomavirus
SVAALYWY

SEQ ID NO: 15527 - protein, 10 aa, Artificial Sequence
  Peptide Derived from Human Papillomavirus
SVDTDLSPRL

SEQ ID NO: 15528 - protein, 8 aa, Artificial Sequence
  Peptide Derived from Human Papillomavirus
SYFGMSFI

SEQ ID NO: 15529 - protein, 10 aa, Artificial Sequence
  Peptide Derived from Human Papillomavirus
SYFGMSFIHF

SEQ ID NO: 15530 - protein, 11 aa, Artificial Sequence
  Peptide Derived from Human Papillomavirus
SYFGMSFIHFL

SEQ ID NO: 15531 - protein, 8 aa, Artificial Sequence
  Peptide Derived from Human Papillomavirus
TFPHAFPF

SEQ ID NO: 15532 - protein, 11 aa, Artificial Sequence
  Peptide Derived from Human Papillomavirus
TIVEKKTGDVI

SEQ ID NO: 15533 - protein, 8 aa, Artificial Sequence
  Peptide Derived from Human Papillomavirus
TLIKPATL

SEQ ID NO: 15534 - protein, 9 aa, Artificial Sequence
  Peptide Derived from Human Papillomavirus
TLIKPATLY

SEQ ID NO: 15535 - protein, 10 aa, Artificial Sequence
  Peptide Derived from Human Papillomavirus
TLLHVPETCM

SEQ ID NO: 15536 - protein, 11 aa, Artificial Sequence
  Peptide Derived from Human Papillomavirus
TLLHVPETCML

SEQ ID NO: 15537 - protein, 9 aa, Artificial Sequence
  Peptide Derived from Human Papillomavirus
TLYAHIQCL

SEQ ID NO: 15538 - protein, 8 aa, Artificial Sequence
  Peptide Derived from Human Papillomavirus
TTCTDWVM

SEQ ID NO: 15539 - protein, 10 aa, Artificial Sequence
  Peptide Derived from Human Papillomavirus
TTCTDWVMAI

SEQ ID NO: 15540 - protein, 11 aa, Artificial Sequence
  Peptide Derived from Human Papillomavirus
TTCTDWVMAIF

SEQ ID NO: 15541 - protein, 9 aa, Artificial Sequence
  Peptide Derived from Human Papillomavirus
TVAEGFKTL

SEQ ID NO: 15542 - protein, 10 aa, Artificial Sequence
  Peptide Derived from Human Papillomavirus
TVAEGFKTLI

SEQ ID NO: 15543 - protein, 9 aa, Artificial Sequence
  Peptide Derived from Human Papillomavirus
TVAKGLSTL

SEQ ID NO: 15544 - protein, 10 aa, Artificial Sequence
  Peptide Derived from Human Papillomavirus
TVAKGLSTLL

SEQ ID NO: 15545 - protein, 9 aa, Artificial Sequence
  Peptide Derived from Human Papillomavirus
TVFTFPHAF

SEQ ID NO: 15546 - protein, 11 aa, Artificial Sequence
  Peptide Derived from Human Papillomavirus
TVFTFPHAFPF

SEQ ID NO: 15547 - protein, 11 aa, Artificial Sequence
  Peptide Derived from Human Papillomavirus
TYFDNYMRNAL

SEQ ID NO: 15548 - protein, 8 aa, Artificial Sequence
  Peptide Derived from Human Papillomavirus
VFKDIYGL

SEQ ID NO: 15549 - protein, 10 aa, Artificial Sequence
  Peptide Derived from Human Papillomavirus
VFKDIYGLSF

SEQ ID NO: 15550 - protein, 8 aa, Artificial Sequence
  Peptide Derived from Human Papillomavirus
VFTFPHAF

SEQ ID NO: 15551 - protein, 10 aa, Artificial Sequence
  Peptide Derived from Human Papillomavirus
VFTFPHAFPF

SEQ ID NO: 15552 - protein, 9 aa, Artificial Sequence
  Peptide Derived from Human Papillomavirus
VLHLLKRKF

SEQ ID NO: 15553 - protein, 9 aa, Artificial Sequence
  Peptide Derived from Human Papillomavirus
VLILALLRY

SEQ ID NO: 15554 - protein, 9 aa, Artificial Sequence
  Peptide Derived from Human Papillomavirus
VTGQNTRPL

SEQ ID NO: 15555 - protein, 10 aa, Artificial Sequence
  Peptide Derived from Human Papillomavirus
VTVFTFPHAF

SEQ ID NO: 15556 - protein, 9 aa, Artificial Sequence
  Peptide Derived from Human Papillomavirus
VYEINDKNW

SEQ ID NO: 15557 - protein, 9 aa, Artificial Sequence
  Peptide Derived from Human Papillomavirus
WIKYRCSKI

SEQ ID NO: 15558 - protein, 8 aa, Artificial Sequence
  Peptide Derived from Human Papillomavirus
WIQRLTII

SEQ ID NO: 15559 - protein, 8 aa, Artificial Sequence
  Peptide Derived from Human Papillomavirus
WTYFDNYM

SEQ ID NO: 15560 - protein, 9 aa, Artificial Sequence
  Peptide Derived from Human Papillomavirus
WYRTGISNI

SEQ ID NO: 15561 - protein, 10 aa, Artificial Sequence
  Peptide Derived from Human Papillomavirus
YFDNYMRNAL

SEQ ID NO: 15562 - protein, 9 aa, Artificial Sequence
  Peptide Derived from Human Papillomavirus
YFGMSFIHF

SEQ ID NO: 15563 - protein, 10 aa, Artificial Sequence
  Peptide Derived from Human Papillomavirus
YFGMSFIHFL

SEQ ID NO: 15564 - protein, 9 aa, Artificial Sequence
  Peptide Derived from Human Papillomavirus
YLESRVTVF

SEQ ID NO: 15565 - protein, 11 aa, Artificial Sequence
  Peptide Derived from Human Papillomavirus
YLESRVTVFTF

SEQ ID NO: 15566 - protein, 8 aa, Artificial Sequence
  Peptide Derived from Human Papillomavirus
YLKDCAVM

SEQ ID NO: 15567 - protein, 11 aa, Artificial Sequence
  Peptide Derived from Human Papillomavirus
YMRNALDGNPI

SEQ ID NO: 15568 - protein, 10 aa, Artificial Sequence
  Peptide Derived from Human Papillomavirus
YWYRTGISNI

SEQ ID NO: 15569 - protein, 8 aa, Artificial Sequence
  Peptide Derived from Human Papillomavirus
AIELQMAL

SEQ ID NO: 15570 - protein, 11 aa, Artificial Sequence
  Peptide Derived from Human Papillomavirus
AIELQMALKGL

SEQ ID NO: 15571 - protein, 11 aa, Artificial Sequence
  Peptide Derived from Human Papillomavirus
AILFTAREHGI

SEQ ID NO: 15572 - protein, 10 aa, Artificial Sequence
  Peptide Derived from Human Papillomavirus
ALKGLAQSKY

SEQ ID NO: 15573 - protein, 10 aa, Artificial Sequence
  Peptide Derived from Human Papillomavirus
ALQDKILDHY

SEQ ID NO: 15574 - protein, 10 aa, Artificial Sequence
  Peptide Derived from Human Papillomavirus
ATKRPRQCGL

SEQ ID NO: 15575 - protein, 8 aa, Artificial Sequence
  Peptide Derived from Human Papillomavirus
ATQIVRQL

SEQ ID NO: 15576 - protein, 9 aa, Artificial Sequence
  Peptide Derived from Human Papillomavirus
CLRYRLRKY

SEQ ID NO: 15577 - protein, 10 aa, Artificial Sequence
  Peptide Derived from Human Papillomavirus
CMNYVVWDSI

SEQ ID NO: 15578 - protein, 11 aa, Artificial Sequence
  Peptide Derived from Human Papillomavirus
CMNYVVWDSIY

SEQ ID NO: 15579 - protein, 8 aa, Artificial Sequence
  Peptide Derived from Human Papillomavirus
CVSYWGVY

SEQ ID NO: 15580 - protein, 9 aa, Artificial Sequence
  Peptide Derived from Human Papillomavirus
CVSYWGVYY

SEQ ID NO: 15581 - protein, 10 aa, Artificial Sequence
  Peptide Derived from Human Papillomavirus
CVSYWGVYYI

SEQ ID NO: 15582 - protein, 8 aa, Artificial Sequence
  Peptide Derived from Human Papillomavirus
DINSQISY

SEQ ID NO: 15583 - protein, 9 aa, Artificial Sequence
  Peptide Derived from Human Papillomavirus
DINSQISYW

SEQ ID NO: 15584 - protein, 11 aa, Artificial Sequence
  Peptide Derived from Human Papillomavirus
DINSQISYWQL

SEQ ID NO: 15585 - protein, 8 aa, Artificial Sequence
  Peptide Derived from Human Papillomavirus
DTTYYVQF

SEQ ID NO: 15586 - protein, 8 aa, Artificial Sequence
  Peptide Derived from Human Papillomavirus
DTVSATQI

SEQ ID NO: 15587 - protein, 11 aa, Artificial Sequence
  Peptide Derived from Human Papillomavirus
DVVTIPNSVQI

SEQ ID NO: 15588 - protein, 8 aa, Artificial Sequence
  Peptide Derived from Human Papillomavirus
EISSTWHW

SEQ ID NO: 15589 - protein, 9 aa, Artificial Sequence
  Peptide Derived from Human Papillomavirus
ELQMALKGL

SEQ ID NO: 15590 - protein, 11 aa, Artificial Sequence
  Peptide Derived from Human Papillomavirus
ELWNTEPSQCF

SEQ ID NO: 15591 - protein, 8 aa, Artificial Sequence
  Peptide Derived from Human Papillomavirus
EVQRNTFL

SEQ ID NO: 15592 - protein, 9 aa, Artificial Sequence
  Peptide Derived from Human Papillomavirus
EVQYGGNVI

SEQ ID NO: 15593 - protein, 11 aa, Artificial Sequence
  Peptide Derived from Human Papillomavirus
EWTLQDTCEEL

SEQ ID NO: 15594 - protein, 8 aa, Artificial Sequence
  Peptide Derived from Human Papillomavirus
FTAREHGI

SEQ ID NO: 15595 - protein, 11 aa, Artificial Sequence
  Peptide Derived from Human Papillomavirus
FTAREHGITKL

SEQ ID NO: 15596 - protein, 9 aa, Artificial Sequence
  Peptide Derived from Human Papillomavirus
HLKGDKNSL

SEQ ID NO: 15597 - protein, 11 aa, Artificial Sequence
  Peptide Derived from Human Papillomavirus
HWTGCNKNTGI

SEQ ID NO: 15598 - protein, 9 aa, Artificial Sequence
  Peptide Derived from Human Papillomavirus
HYENDSKDI

SEQ ID NO: 15599 - protein, 9 aa, Artificial Sequence
  Peptide Derived from Human Papillomavirus
HYSEISSTW

SEQ ID NO: 15600 - protein, 11 aa, Artificial Sequence
  Peptide Derived from Human Papillomavirus
HYSEISSTWHW

SEQ ID NO: 15601 - protein, 11 aa, Artificial Sequence
  Peptide Derived from Human Papillomavirus
IIHLKGDKNSL

SEQ ID NO: 15602 - protein, 10 aa, Artificial Sequence
  Peptide Derived from Human Papillomavirus
ILFTAREHGI

SEQ ID NO: 15603 - protein, 11 aa, Artificial Sequence
  Peptide Derived from Human Papillomavirus
IWDKTAACVSY

SEQ ID NO: 15604 - protein, 9 aa, Artificial Sequence
  Peptide Derived from Human Papillomavirus
IYYITETGI

SEQ ID NO: 15605 - protein, 10 aa, Artificial Sequence
  Peptide Derived from Human Papillomavirus
IYYITETGIW

SEQ ID NO: 15606 - protein, 10 aa, Artificial Sequence
  Peptide Derived from Human Papillomavirus
KLNHQVVPPI

SEQ ID NO: 15607 - protein, 9 aa, Artificial Sequence
  Peptide Derived from Human Papillomavirus
KMQTPKESL

SEQ ID NO: 15608 - protein, 8 aa, Artificial Sequence
  Peptide Derived from Human Papillomavirus
KTAACVSY

SEQ ID NO: 15609 - protein, 9 aa, Artificial Sequence
  Peptide Derived from Human Papillomavirus
KTAACVSYW

SEQ ID NO: 15610 - protein, 10 aa, Artificial Sequence
  Peptide Derived from Human Papillomavirus
KVCSGNTTPI

SEQ ID NO: 15611 - protein, 11 aa, Artificial Sequence
  Peptide Derived from Human Papillomavirus
KVCSGNTTPII

SEQ ID NO: 15612 - protein, 9 aa, Artificial Sequence
  Peptide Derived from Human Papillomavirus
KYADHYSEI

SEQ ID NO: 15613 - protein, 8 aa, Artificial Sequence
  Peptide Derived from Human Papillomavirus
KYGNSNTW

SEQ ID NO: 15614 - protein, 9 aa, Artificial Sequence
  Peptide Derived from Human Papillomavirus
KYNNEEWTL

SEQ ID NO: 15615 - protein, 9 aa, Artificial Sequence
  Peptide Derived from Human Papillomavirus
LFTAREHGI

SEQ ID NO: 15616 - protein, 8 aa, Artificial Sequence
  Peptide Derived from Human Papillomavirus
LIRLENAI

SEQ ID NO: 15617 - protein, 9 aa, Artificial Sequence
  Peptide Derived from Human Papillomavirus
LIRLENAIL

SEQ ID NO: 15618 - protein, 10 aa, Artificial Sequence
  Peptide Derived from Human Papillomavirus
LIRLENAILF

SEQ ID NO: 15619 - protein, 10 aa, Artificial Sequence
  Peptide Derived from Human Papillomavirus
LWNTEPSQCF

SEQ ID NO: 15620 - protein, 11 aa, Artificial Sequence
  Peptide Derived from Human Papillomavirus
NISKSKAHKAI

SEQ ID NO: 15621 - protein, 8 aa, Artificial Sequence
  Peptide Derived from Human Papillomavirus
NTEPSQCF

SEQ ID NO: 15622 - protein, 9 aa, Artificial Sequence
  Peptide Derived from Human Papillomavirus
NTFLDVVTI

SEQ ID NO: 15623 - protein, 9 aa, Artificial Sequence
  Peptide Derived from Human Papillomavirus
NTGILTVTY

SEQ ID NO: 15624 - protein, 8 aa, Artificial Sequence
  Peptide Derived from Human Papillomavirus
NTHVHNPL

SEQ ID NO: 15625 - protein, 9 aa, Artificial Sequence
  Peptide Derived from Human Papillomavirus
NTHVHNPLL

SEQ ID NO: 15626 - protein, 8 aa, Artificial Sequence
  Peptide Derived from Human Papillomavirus
NTTPIIHL

SEQ ID NO: 15627 - protein, 9 aa, Artificial Sequence
  Peptide Derived from Human Papillomavirus
NVIDCNDSM

SEQ ID NO: 15628 - protein, 8 aa, Artificial Sequence
  Peptide Derived from Human Papillomavirus
NYVVWDSI

SEQ ID NO: 15629 - protein, 9 aa, Artificial Sequence
  Peptide Derived from Human Papillomavirus
NYVVWDSIY

SEQ ID NO: 15630 - protein, 10 aa, Artificial Sequence
  Peptide Derived from Human Papillomavirus
NYVVWDSIYY

SEQ ID NO: 15631 - protein, 11 aa, Artificial Sequence
  Peptide Derived from Human Papillomavirus
NYVVWDSIYYI

SEQ ID NO: 15632 - protein, 9 aa, Artificial Sequence
  Peptide Derived from Human Papillomavirus
QFKSECEKY

SEQ ID NO: 15633 - protein, 9 aa, Artificial Sequence
  Peptide Derived from Human Papillomavirus
QISVGYMTI

SEQ ID NO: 15634 - protein, 8 aa, Artificial Sequence
  Peptide Derived from Human Papillomavirus
QISYWQLI

SEQ ID NO: 15635 - protein, 10 aa, Artificial Sequence
  Peptide Derived from Human Papillomavirus
QISYWQLIRL

SEQ ID NO: 15636 - protein, 9 aa, Artificial Sequence
  Peptide Derived from Human Papillomavirus
QLIRLENAI

SEQ ID NO: 15637 - protein, 10 aa, Artificial Sequence
  Peptide Derived from Human Papillomavirus
QLIRLENAIL

SEQ ID NO: 15638 - protein, 11 aa, Artificial Sequence
  Peptide Derived from Human Papillomavirus
QLIRLENAILF

SEQ ID NO: 15639 - protein, 11 aa, Artificial Sequence
  Peptide Derived from Human Papillomavirus
QTPKESLSERL

SEQ ID NO: 15640 - protein, 8 aa, Artificial Sequence
  Peptide Derived from Human Papillomavirus
QVVPPINI

SEQ ID NO: 15641 - protein, 8 aa, Artificial Sequence
  Peptide Derived from Human Papillomavirus
RLENAILF

SEQ ID NO: 15642 - protein, 9 aa, Artificial Sequence
  Peptide Derived from Human Papillomavirus
RLRKYADHY

SEQ ID NO: 15643 - protein, 9 aa, Artificial Sequence
  Peptide Derived from Human Papillomavirus
RLSALQDKI

SEQ ID NO: 15644 - protein, 10 aa, Artificial Sequence
  Peptide Derived from Human Papillomavirus
RLSALQDKIL

SEQ ID NO: 15645 - protein, 10 aa, Artificial Sequence
  Peptide Derived from Human Papillomavirus
RVNTHVHNPL

SEQ ID NO: 15646 - protein, 11 aa, Artificial Sequence
  Peptide Derived from Human Papillomavirus
RVNTHVHNPLL

SEQ ID NO: 15647 - protein, 11 aa, Artificial Sequence
  Peptide Derived from Human Papillomavirus
RYRLRKYADHY

SEQ ID NO: 15648 - protein, 10 aa, Artificial Sequence
  Peptide Derived from Human Papillomavirus
SIYYITETGI

SEQ ID NO: 15649 - protein, 11 aa, Artificial Sequence
  Peptide Derived from Human Papillomavirus
SIYYITETGIW

SEQ ID NO: 15650 - protein, 9 aa, Artificial Sequence
  Peptide Derived from Human Papillomavirus
SLKCLRYRL

SEQ ID NO: 15651 - protein, 9 aa, Artificial Sequence
  Peptide Derived from Human Papillomavirus
SLSERLSAL

SEQ ID NO: 15652 - protein, 9 aa, Artificial Sequence
  Peptide Derived from Human Papillomavirus
SVGTPKPHI

SEQ ID NO: 15653 - protein, 8 aa, Artificial Sequence
  Peptide Derived from Human Papillomavirus
SVQISVGY

SEQ ID NO: 15654 - protein, 9 aa, Artificial Sequence
  Peptide Derived from Human Papillomavirus
SVQISVGYM

SEQ ID NO: 15655 - protein, 11 aa, Artificial Sequence
  Peptide Derived from Human Papillomavirus
SVQISVGYMTI

SEQ ID NO: 15656 - protein, 8 aa, Artificial Sequence
  Peptide Derived from Human Papillomavirus
SYWGVYYI

SEQ ID NO: 15657 - protein, 8 aa, Artificial Sequence
  Peptide Derived from Human Papillomavirus
SYWQLIRL

SEQ ID NO: 15658 - protein, 8 aa, Artificial Sequence
  Peptide Derived from Human Papillomavirus
TFLDVVTI

SEQ ID NO: 15659 - protein, 8 aa, Artificial Sequence
  Peptide Derived from Human Papillomavirus
TIPNSVQI

SEQ ID NO: 15660 - protein, 9 aa, Artificial Sequence
  Peptide Derived from Human Papillomavirus
TLQDTCEEL

SEQ ID NO: 15661 - protein, 10 aa, Artificial Sequence
  Peptide Derived from Human Papillomavirus
TLQDTCEELW

SEQ ID NO: 15662 - protein, 11 aa, Artificial Sequence
  Peptide Derived from Human Papillomavirus
TVSATQIVRQL

SEQ ID NO: 15663 - protein, 11 aa, Artificial Sequence
  Peptide Derived from Human Papillomavirus
TWEVQYGGNVI

SEQ ID NO: 15664 - protein, 11 aa, Artificial Sequence
  Peptide Derived from Human Papillomavirus
TYNSEVQRNTF

SEQ ID NO: 15665 - protein, 8 aa, Artificial Sequence
  Peptide Derived from Human Papillomavirus
VIDCNDSM

SEQ ID NO: 15666 - protein, 9 aa, Artificial Sequence
  Peptide Derived from Human Papillomavirus
VTIPNSVQI

SEQ ID NO: 15667 - protein, 10 aa, Artificial Sequence
  Peptide Derived from Human Papillomavirus
VVTIPNSVQI

SEQ ID NO: 15668 - protein, 8 aa, Artificial Sequence
  Peptide Derived from Human Papillomavirus
VVWDSIYY

SEQ ID NO: 15669 - protein, 9 aa, Artificial Sequence
  Peptide Derived from Human Papillomavirus
VVWDSIYYI

SEQ ID NO: 15670 - protein, 8 aa, Artificial Sequence
  Peptide Derived from Human Papillomavirus
VWDSIYYI

SEQ ID NO: 15671 - protein, 11 aa, Artificial Sequence
  Peptide Derived from Human Papillomavirus
VYFDGNKDNCM

SEQ ID NO: 15672 - protein, 11 aa, Artificial Sequence
  Peptide Derived from Human Papillomavirus
VYYIKDGDTTY

SEQ ID NO: 15673 - protein, 10 aa, Artificial Sequence
  Peptide Derived from Human Papillomavirus
WTGCNKNTGI

SEQ ID NO: 15674 - protein, 11 aa, Artificial Sequence
  Peptide Derived from Human Papillomavirus
WTGCNKNTGIL

SEQ ID NO: 15675 - protein, 10 aa, Artificial Sequence
  Peptide Derived from Human Papillomavirus
WTLQDTCEEL

SEQ ID NO: 15676 - protein, 11 aa, Artificial Sequence
  Peptide Derived from Human Papillomavirus
WTLQDTCEELW

SEQ ID NO: 15677 - protein, 10 aa, Artificial Sequence
  Peptide Derived from Human Papillomavirus
YFDGNKDNCM

SEQ ID NO: 15678 - protein, 9 aa, Artificial Sequence
  Peptide Derived from Human Papillomavirus
YIKDGDTTY

SEQ ID NO: 15679 - protein, 10 aa, Artificial Sequence
  Peptide Derived from Human Papillomavirus
YIKDGDTTYY

SEQ ID NO: 15680 - protein, 8 aa, Artificial Sequence
  Peptide Derived from Human Papillomavirus
YITETGIW

SEQ ID NO: 15681 - protein, 11 aa, Artificial Sequence
  Peptide Derived from Human Papillomavirus
YVQFKSECEKY

SEQ ID NO: 15682 - protein, 8 aa, Artificial Sequence
  Peptide Derived from Human Papillomavirus
YVVWDSIY

SEQ ID NO: 15683 - protein, 9 aa, Artificial Sequence
  Peptide Derived from Human Papillomavirus
YVVWDSIYY

SEQ ID NO: 15684 - protein, 10 aa, Artificial Sequence
  Peptide Derived from Human Papillomavirus
YVVWDSIYYI

SEQ ID NO: 15685 - protein, 11 aa, Artificial Sequence
  Peptide Derived from Human Papillomavirus
YWQLIRLENAI

SEQ ID NO: 15686 - protein, 10 aa, Artificial Sequence
  Peptide Derived from Human Papillomavirus
YYIKDGDTTY

SEQ ID NO: 15687 - protein, 11 aa, Artificial Sequence
  Peptide Derived from Human Papillomavirus
YYIKDGDTTYY

SEQ ID NO: 15688 - protein, 8 aa, Artificial Sequence
  Peptide Derived from Human Papillomavirus
YYITETGI

SEQ ID NO: 15689 - protein, 9 aa, Artificial Sequence
  Peptide Derived from Human Papillomavirus
YYITETGIW

SEQ ID NO: 15690 - protein, 9 aa, Artificial Sequence
  Peptide Derived from Human Papillomavirus
AFKDLFIVY

SEQ ID NO: 15691 - protein, 9 aa, Artificial Sequence
  Peptide Derived from Human Papillomavirus
ATLERTEVY

SEQ ID NO: 15692 - protein, 11 aa, Artificial Sequence
  Peptide Derived from Human Papillomavirus
ATLERTEVYQF

SEQ ID NO: 15693 - protein, 9 aa, Artificial Sequence
  Peptide Derived from Human Papillomavirus
AYAACHKCI

SEQ ID NO: 15694 - protein, 11 aa, Artificial Sequence
  Peptide Derived from Human Papillomavirus
AYAACHKCIDF

SEQ ID NO: 15695 - protein, 11 aa, Artificial Sequence
  Peptide Derived from Human Papillomavirus
CIAYAACHKCI

SEQ ID NO: 15696 - protein, 8 aa, Artificial Sequence
  Peptide Derived from Human Papillomavirus
CIDFYSRI

SEQ ID NO: 15697 - protein, 11 aa, Artificial Sequence
  Peptide Derived from Human Papillomavirus
CIDFYSRIREL

SEQ ID NO: 15698 - protein, 8 aa, Artificial Sequence
  Peptide Derived from Human Papillomavirus
CLRCQKPL

SEQ ID NO: 15699 - protein, 8 aa, Artificial Sequence
  Peptide Derived from Human Papillomavirus
CTELNTSL

SEQ ID NO: 15700 - protein, 8 aa, Artificial Sequence
  Peptide Derived from Human Papillomavirus
CVYCKATL

SEQ ID NO: 15701 - protein, 9 aa, Artificial Sequence
  Peptide Derived from Human Papillomavirus
DFYSRIREL

SEQ ID NO: 15702 - protein, 11 aa, Artificial Sequence
  Peptide Derived from Human Papillomavirus
DFYSRIRELRY

SEQ ID NO: 15703 - protein, 10 aa, Artificial Sequence
  Peptide Derived from Human Papillomavirus
DLCTELNTSL

SEQ ID NO: 15704 - protein, 10 aa, Artificial Sequence
  Peptide Derived from Human Papillomavirus
DLFIVYRDCI

SEQ ID NO: 15705 - protein, 8 aa, Artificial Sequence
  Peptide Derived from Human Papillomavirus
DVSIACVY

SEQ ID NO: 15706 - protein, 11 aa, Artificial Sequence
  Peptide Derived from Human Papillomavirus
ELNTSLQDVSI

SEQ ID NO: 15707 - protein, 10 aa, Artificial Sequence
  Peptide Derived from Human Papillomavirus
ELRYYSNSVY

SEQ ID NO: 15708 - protein, 10 aa, Artificial Sequence
  Peptide Derived from Human Papillomavirus
ELYNLLIRCL

SEQ ID NO: 15709 - protein, 11 aa, Artificial Sequence
  Peptide Derived from Human Papillomavirus
ETLEKITNTEL

SEQ ID NO: 15710 - protein, 10 aa, Artificial Sequence
  Peptide Derived from Human Papillomavirus
EVYQFAFKDL

SEQ ID NO: 15711 - protein, 11 aa, Artificial Sequence
  Peptide Derived from Human Papillomavirus
EVYQFAFKDLF

SEQ ID NO: 15712 - protein, 8 aa, Artificial Sequence
  Peptide Derived from Human Papillomavirus
FIVYRDCI

SEQ ID NO: 15713 - protein, 10 aa, Artificial Sequence
  Peptide Derived from Human Papillomavirus
FIVYRDCIAY

SEQ ID NO: 15714 - protein, 8 aa, Artificial Sequence
  Peptide Derived from Human Papillomavirus
FYSRIREL

SEQ ID NO: 15715 - protein, 10 aa, Artificial Sequence
  Peptide Derived from Human Papillomavirus
FYSRIRELRY

SEQ ID NO: 15716 - protein, 11 aa, Artificial Sequence
  Peptide Derived from Human Papillomavirus
FYSRIRELRYY

SEQ ID NO: 15717 - protein, 8 aa, Artificial Sequence
  Peptide Derived from Human Papillomavirus
HLKDKRRF

SEQ ID NO: 15718 - protein, 11 aa, Artificial Sequence
  Peptide Derived from Human Papillomavirus
HLKDKRRFHSI

SEQ ID NO: 15719 - protein, 9 aa, Artificial Sequence
  Peptide Derived from Human Papillomavirus
ITNTELYNL

SEQ ID NO: 15720 - protein, 10 aa, Artificial Sequence
  Peptide Derived from Human Papillomavirus
ITNTELYNLL

SEQ ID NO: 15721 - protein, 11 aa, Artificial Sequence
  Peptide Derived from Human Papillomavirus
ITNTELYNLLI

SEQ ID NO: 15722 - protein, 9 aa, Artificial Sequence
  Peptide Derived from Human Papillomavirus
IVYRDCIAY

SEQ ID NO: 15723 - protein, 8 aa, Artificial Sequence
  Peptide Derived from Human Papillomavirus
KITNTELY

SEQ ID NO: 15724 - protein, 10 aa, Artificial Sequence
  Peptide Derived from Human Papillomavirus
KITNTELYNL

SEQ ID NO: 15725 - protein, 11 aa, Artificial Sequence
  Peptide Derived from Human Papillomavirus
KITNTELYNLL

SEQ ID NO: 15726 - protein, 9 aa, Artificial Sequence
  Peptide Derived from Human Papillomavirus
KLPDLCTEL

SEQ ID NO: 15727 - protein, 9 aa, Artificial Sequence
  Peptide Derived from Human Papillomavirus
LFIVYRDCI

SEQ ID NO: 15728 - protein, 11 aa, Artificial Sequence
  Peptide Derived from Human Papillomavirus
LFIVYRDCIAY

SEQ ID NO: 15729 - protein, 11 aa, Artificial Sequence
  Peptide Derived from Human Papillomavirus
LIRCLRCQKPL

SEQ ID NO: 15730 - protein, 9 aa, Artificial Sequence
  Peptide Derived from Human Papillomavirus
LYNLLIRCL

SEQ ID NO: 15731 - protein, 8 aa, Artificial Sequence
  Peptide Derived from Human Papillomavirus
NTELYNLL

SEQ ID NO: 15732 - protein, 9 aa, Artificial Sequence
  Peptide Derived from Human Papillomavirus
NTELYNLLI

SEQ ID NO: 15733 - protein, 9 aa, Artificial Sequence
  Peptide Derived from Human Papillomavirus
NTSLQDVSI

SEQ ID NO: 15734 - protein, 11 aa, Artificial Sequence
  Peptide Derived from Human Papillomavirus
PLNPAEKRRHL

SEQ ID NO: 15735 - protein, 8 aa, Artificial Sequence
  Peptide Derived from Human Papillomavirus
PTQRPYKL

SEQ ID NO: 15736 - protein, 11 aa, Artificial Sequence
  Peptide Derived from Human Papillomavirus
PTQRPYKLPDL

SEQ ID NO: 15737 - protein, 11 aa, Artificial Sequence
  Peptide Derived from Human Papillomavirus
PYKLPDLCTEL

SEQ ID NO: 15738 - protein, 8 aa, Artificial Sequence
  Peptide Derived from Human Papillomavirus
QFAFKDLF

SEQ ID NO: 15739 - protein, 9 aa, Artificial Sequence
  Peptide Derived from Human Papillomavirus
QFAFKDLFI

SEQ ID NO: 15740 - protein, 11 aa, Artificial Sequence
  Peptide Derived from Human Papillomavirus
QFAFKDLFIVY

SEQ ID NO: 15741 - protein, 10 aa, Artificial Sequence
  Peptide Derived from Human Papillomavirus
RFDDPTQRPY

SEQ ID NO: 15742 - protein, 9 aa, Artificial Sequence
  Peptide Derived from Human Papillomavirus
RFHSIAGQY

SEQ ID NO: 15743 - protein, 8 aa, Artificial Sequence
  Peptide Derived from Human Papillomavirus
RIRELRYY

SEQ ID NO: 15744 - protein, 9 aa, Artificial Sequence
  Peptide Derived from Human Papillomavirus
RTEVYQFAF

SEQ ID NO: 15745 - protein, 8 aa, Artificial Sequence
  Peptide Derived from Human Papillomavirus
RYYSNSVY

SEQ ID NO: 15746 - protein, 11 aa, Artificial Sequence
  Peptide Derived from Human Papillomavirus
SIACVYCKATL

SEQ ID NO: 15747 - protein, 11 aa, Artificial Sequence
  Peptide Derived from Human Papillomavirus
SLQDVSIACVY

SEQ ID NO: 15748 - protein, 10 aa, Artificial Sequence
  Peptide Derived from Human Papillomavirus
SVYGETLEKI

SEQ ID NO: 15749 - protein, 10 aa, Artificial Sequence
  Peptide Derived from Human Papillomavirus
TLEKITNTEL

SEQ ID NO: 15750 - protein, 11 aa, Artificial Sequence
  Peptide Derived from Human Papillomavirus
TLEKITNTELY

SEQ ID NO: 15751 - protein, 8 aa, Artificial Sequence
  Peptide Derived from Human Papillomavirus
TLERTEVY

SEQ ID NO: 15752 - protein, 10 aa, Artificial Sequence
  Peptide Derived from Human Papillomavirus
TLERTEVYQF

SEQ ID NO: 15753 - protein, 9 aa, Artificial Sequence
  Peptide Derived from Human Papillomavirus
VYGETLEKI

SEQ ID NO: 15754 - protein, 9 aa, Artificial Sequence
  Peptide Derived from Human Papillomavirus
VYQFAFKDL

SEQ ID NO: 15755 - protein, 10 aa, Artificial Sequence
  Peptide Derived from Human Papillomavirus
VYQFAFKDLF

SEQ ID NO: 15756 - protein, 11 aa, Artificial Sequence
  Peptide Derived from Human Papillomavirus
VYQFAFKDLFI

SEQ ID NO: 15757 - protein, 8 aa, Artificial Sequence
  Peptide Derived from Human Papillomavirus
VYRDCIAY

SEQ ID NO: 15758 - protein, 11 aa, Artificial Sequence
  Peptide Derived from Human Papillomavirus
YYSNSVYGETL

SEQ ID NO: 15759 - protein, 8 aa, Artificial Sequence
  Peptide Derived from Human Papillomavirus
ATLQEIVL

SEQ ID NO: 15760 - protein, 10 aa, Artificial Sequence
  Peptide Derived from Human Papillomavirus
ATLQEIVLHL

SEQ ID NO: 15761 - protein, 10 aa, Artificial Sequence
  Peptide Derived from Human Papillomavirus
CVCCKCDGRI

SEQ ID NO: 15762 - protein, 8 aa, Artificial Sequence
  Peptide Derived from Human Papillomavirus
DLLCYEQL

SEQ ID NO: 15763 - protein, 8 aa, Artificial Sequence
  Peptide Derived from Human Papillomavirus
DLRTLQQL

SEQ ID NO: 15764 - protein, 9 aa, Artificial Sequence
  Peptide Derived from Human Papillomavirus
DLRTLQQLF

SEQ ID NO: 15765 - protein, 10 aa, Artificial Sequence
  Peptide Derived from Human Papillomavirus
DLRTLQQLFL

SEQ ID NO: 15766 - protein, 8 aa, Artificial Sequence
  Peptide Derived from Human Papillomavirus
ELDPVDLL

SEQ ID NO: 15767 - protein, 10 aa, Artificial Sequence
  Peptide Derived from Human Papillomavirus
ELDPVDLLCY

SEQ ID NO: 15768 - protein, 11 aa, Artificial Sequence
  Peptide Derived from Human Papillomavirus
ELTVESSADDL

SEQ ID NO: 15769 - protein, 11 aa, Artificial Sequence
  Peptide Derived from Human Papillomavirus
FLSTLSFVCPW

SEQ ID NO: 15770 - protein, 8 aa, Artificial Sequence
  Peptide Derived from Human Papillomavirus
HLEPQNEL

SEQ ID NO: 15771 - protein, 11 aa, Artificial Sequence
  Peptide Derived from Human Papillomavirus
IVLHLEPQNEL

SEQ ID NO: 15772 - protein, 8 aa, Artificial Sequence
  Peptide Derived from Human Papillomavirus
LFLSTLSF

SEQ ID NO: 15773 - protein, 10 aa, Artificial Sequence
  Peptide Derived from Human Papillomavirus
LTVESSADDL

SEQ ID NO: 15774 - protein, 10 aa, Artificial Sequence
  Peptide Derived from Human Papillomavirus
PVDLLCYEQL

SEQ ID NO: 15775 - protein, 9 aa, Artificial Sequence
  Peptide Derived from Human Papillomavirus
QLFLSTLSF

SEQ ID NO: 15776 - protein, 8 aa, Artificial Sequence
  Peptide Derived from Human Papillomavirus
RTLQQLFL

SEQ ID NO: 15777 - protein, 11 aa, Artificial Sequence
  Peptide Derived from Human Papillomavirus
RTLQQLFLSTL

SEQ ID NO: 15778 - protein, 9 aa, Artificial Sequence
  Peptide Derived from Human Papillomavirus
STLSFVCPW

SEQ ID NO: 15779 - protein, 9 aa, Artificial Sequence
  Peptide Derived from Human Papillomavirus
TLQEIVLHL

SEQ ID NO: 15780 - protein, 10 aa, Artificial Sequence
  Peptide Derived from Human Papillomavirus
TLQQLFLSTL

SEQ ID NO: 15781 - protein, 8 aa, Artificial Sequence
  Peptide Derived from Human Papillomavirus
TLSFVCPW

SEQ ID NO: 15782 - protein, 9 aa, Artificial Sequence
  Peptide Derived from Human Papillomavirus
TVESSADDL

SEQ ID NO: 15783 - protein, 10 aa, Artificial Sequence
  Peptide Derived from Human Papillomavirus
VLHLEPQNEL

SEQ ID NO: 15784 - protein, 11 aa, Artificial Sequence
  Peptide Derived from Human Papillomavirus
AIGEHWAKGTL

SEQ ID NO: 15785 - protein, 8 aa, Artificial Sequence
  Peptide Derived from Human Papillomavirus
ALPDPNKF

SEQ ID NO: 15786 - protein, 10 aa, Artificial Sequence
  Peptide Derived from Human Papillomavirus
ALPDPNKFGL

SEQ ID NO: 15787 - protein, 11 aa, Artificial Sequence
  Peptide Derived from Human Papillomavirus
ALWRPSDSTVY

SEQ ID NO: 15788 - protein, 8 aa, Artificial Sequence
  Peptide Derived from Human Papillomavirus
AVPKVSAY

SEQ ID NO: 15789 - protein, 10 aa, Artificial Sequence
  Peptide Derived from Human Papillomavirus
AVPKVSAYQY

SEQ ID NO: 15790 - protein, 11 aa, Artificial Sequence
  Peptide Derived from Human Papillomavirus
AYQYRVFRVAL

SEQ ID NO: 15791 - protein, 9 aa, Artificial Sequence
  Peptide Derived from Human Papillomavirus
CILGCVPAI

SEQ ID NO: 15792 - protein, 8 aa, Artificial Sequence
  Peptide Derived from Human Papillomavirus
CLRREQLF

SEQ ID NO: 15793 - protein, 10 aa, Artificial Sequence
  Peptide Derived from Human Papillomavirus
CTITLTAEVM

SEQ ID NO: 15794 - protein, 9 aa, Artificial Sequence
  Peptide Derived from Human Papillomavirus
CVPAIGEHW

SEQ ID NO: 15795 - protein, 11 aa, Artificial Sequence
  Peptide Derived from Human Papillomavirus
CVYSPSPSGSI

SEQ ID NO: 15796 - protein, 9 aa, Artificial Sequence
  Peptide Derived from Human Papillomavirus
DICQSICKY

SEQ ID NO: 15797 - protein, 11 aa, Artificial Sequence
  Peptide Derived from Human Papillomavirus
DLDQYPLGRKF

SEQ ID NO: 15798 - protein, 10 aa, Artificial Sequence
  Peptide Derived from Human Papillomavirus
DLKEKFSSDL

SEQ ID NO: 15799 - protein, 8 aa, Artificial Sequence
  Peptide Derived from Human Papillomavirus
DLQFIFQL

SEQ ID NO: 15800 - protein, 11 aa, Artificial Sequence
  Peptide Derived from Human Papillomavirus
DLQFIFQLCTI

SEQ ID NO: 15801 - protein, 11 aa, Artificial Sequence
  Peptide Derived from Human Papillomavirus
DLYIKGTSANM

SEQ ID NO: 15802 - protein, 10 aa, Artificial Sequence
  Peptide Derived from Human Papillomavirus
DMVDTGYGAM

SEQ ID NO: 15803 - protein, 9 aa, Artificial Sequence
  Peptide Derived from Human Papillomavirus
DTGYGAMDF

SEQ ID NO: 15804 - protein, 8 aa, Artificial Sequence
  Peptide Derived from Human Papillomavirus
DTKCEVPL

SEQ ID NO: 15805 - protein, 10 aa, Artificial Sequence
  Peptide Derived from Human Papillomavirus
DTKCEVPLDI

SEQ ID NO: 15806 - protein, 11 aa, Artificial Sequence
  Peptide Derived from Human Papillomavirus
DTTPPEKQDPY

SEQ ID NO: 15807 - protein, 8 aa, Artificial Sequence
  Peptide Derived from Human Papillomavirus
DTTRSTNL

SEQ ID NO: 15808 - protein, 10 aa, Artificial Sequence
  Peptide Derived from Human Papillomavirus
DTTRSTNLTL

SEQ ID NO: 15809 - protein, 8 aa, Artificial Sequence
  Peptide Derived from Human Papillomavirus
DTVPTDLY

SEQ ID NO: 15810 - protein, 9 aa, Artificial Sequence
  Peptide Derived from Human Papillomavirus
DTVPTDLYI

SEQ ID NO: 15811 - protein, 10 aa, Artificial Sequence
  Peptide Derived from Human Papillomavirus
DVRDNVSVDY

SEQ ID NO: 15812 - protein, 9 aa, Artificial Sequence
  Peptide Derived from Human Papillomavirus
DYKQTQLCI

SEQ ID NO: 15813 - protein, 10 aa, Artificial Sequence
  Peptide Derived from Human Papillomavirus
DYKQTQLCIL

SEQ ID NO: 15814 - protein, 10 aa, Artificial Sequence
  Peptide Derived from Human Papillomavirus
DYLQMSADPY

SEQ ID NO: 15815 - protein, 8 aa, Artificial Sequence
  Peptide Derived from Human Papillomavirus
DYVSRTSI

SEQ ID NO: 15816 - protein, 9 aa, Artificial Sequence
  Peptide Derived from Human Papillomavirus
DYVSRTSIF

SEQ ID NO: 15817 - protein, 10 aa, Artificial Sequence
  Peptide Derived from Human Papillomavirus
DYVSRTSIFY

SEQ ID NO: 15818 - protein, 8 aa, Artificial Sequence
  Peptide Derived from Human Papillomavirus
EIGRGQPL

SEQ ID NO: 15819 - protein, 10 aa, Artificial Sequence
  Peptide Derived from Human Papillomavirus
EIGRGQPLGI

SEQ ID NO: 15820 - protein, 8 aa, Artificial Sequence
  Peptide Derived from Human Papillomavirus
ETPGSCVY

SEQ ID NO: 15821 - protein, 9 aa, Artificial Sequence
  Peptide Derived from Human Papillomavirus
EVMSYIHSM

SEQ ID NO: 15822 - protein, 10 aa, Artificial Sequence
  Peptide Derived from Human Papillomavirus
EVPLDICQSI

SEQ ID NO: 15823 - protein, 8 aa, Artificial Sequence
  Peptide Derived from Human Papillomavirus
EYDLQFIF

SEQ ID NO: 15824 - protein, 10 aa, Artificial Sequence
  Peptide Derived from Human Papillomavirus
EYDLQFIFQL

SEQ ID NO: 15825 - protein, 9 aa, Artificial Sequence
  Peptide Derived from Human Papillomavirus
FFCLRREQL

SEQ ID NO: 15826 - protein, 10 aa, Artificial Sequence
  Peptide Derived from Human Papillomavirus
FFCLRREQLF

SEQ ID NO: 15827 - protein, 8 aa, Artificial Sequence
  Peptide Derived from Human Papillomavirus
FIFQLCTI

SEQ ID NO: 15828 - protein, 10 aa, Artificial Sequence
  Peptide Derived from Human Papillomavirus
FIFQLCTITL

SEQ ID NO: 15829 - protein, 8 aa, Artificial Sequence
  Peptide Derived from Human Papillomavirus
FLKNVNVF

SEQ ID NO: 15830 - protein, 10 aa, Artificial Sequence
  Peptide Derived from Human Papillomavirus
FLKNVNVFPI

SEQ ID NO: 15831 - protein, 11 aa, Artificial Sequence
  Peptide Derived from Human Papillomavirus
FLKNVNVFPIF

SEQ ID NO: 15832 - protein, 8 aa, Artificial Sequence
  Peptide Derived from Human Papillomavirus
FWNRAGVM

SEQ ID NO: 15833 - protein, 10 aa, Artificial Sequence
  Peptide Derived from Human Papillomavirus
FWTVDLKEKF

SEQ ID NO: 15834 - protein, 9 aa, Artificial Sequence
  Peptide Derived from Human Papillomavirus
FYHAGSSRL

SEQ ID NO: 15835 - protein, 10 aa, Artificial Sequence
  Peptide Derived from Human Papillomavirus
FYHAGSSRLL

SEQ ID NO: 15836 - protein, 8 aa, Artificial Sequence
  Peptide Derived from Human Papillomavirus
GICWHNQL

SEQ ID NO: 15837 - protein, 9 aa, Artificial Sequence
  Peptide Derived from Human Papillomavirus
GICWHNQLF

SEQ ID NO: 15838 - protein, 9 aa, Artificial Sequence
  Peptide Derived from Human Papillomavirus
GIGLSGHPF

SEQ ID NO: 15839 - protein, 10 aa, Artificial Sequence
  Peptide Derived from Human Papillomavirus
GIGLSGHPFY

SEQ ID NO: 15840 - protein, 8 aa, Artificial Sequence
  Peptide Derived from Human Papillomavirus
GLPDSTIY

SEQ ID NO: 15841 - protein, 8 aa, Artificial Sequence
  Peptide Derived from Human Papillomavirus
GLRRRPTI

SEQ ID NO: 15842 - protein, 8 aa, Artificial Sequence
  Peptide Derived from Human Papillomavirus
GLSGHPFY

SEQ ID NO: 15843 - protein, 11 aa, Artificial Sequence
  Peptide Derived from Human Papillomavirus
GLSGHPFYNKL

SEQ ID NO: 15844 - protein, 10 aa, Artificial Sequence
  Peptide Derived from Human Papillomavirus
GMEIGRGQPL

SEQ ID NO: 15845 - protein, 9 aa, Artificial Sequence
  Peptide Derived from Human Papillomavirus
GTLCKPAQL

SEQ ID NO: 15846 - protein, 11 aa, Artificial Sequence
  Peptide Derived from Human Papillomavirus
GVMGDTVPTDL

SEQ ID NO: 15847 - protein, 10 aa, Artificial Sequence
  Peptide Derived from Human Papillomavirus
GVPPPPTTSL

SEQ ID NO: 15848 - protein, 10 aa, Artificial Sequence
  Peptide Derived from Human Papillomavirus
GYGAMDFSTL

SEQ ID NO: 15849 - protein, 9 aa, Artificial Sequence
  Peptide Derived from Human Papillomavirus
HFWNRAGVM

SEQ ID NO: 15850 - protein, 9 aa, Artificial Sequence
  Peptide Derived from Human Papillomavirus
HVEEYDLQF

SEQ ID NO: 15851 - protein, 10 aa, Artificial Sequence
  Peptide Derived from Human Papillomavirus
HVEEYDLQFI

SEQ ID NO: 15852 - protein, 11 aa, Artificial Sequence
  Peptide Derived from Human Papillomavirus
HVEEYDLQFIF

SEQ ID NO: 15853 - protein, 9 aa, Artificial Sequence
  Peptide Derived from Human Papillomavirus
HYSRHVEEY

SEQ ID NO: 15854 - protein, 11 aa, Artificial Sequence
  Peptide Derived from Human Papillomavirus
HYSRHVEEYDL

SEQ ID NO: 15855 - protein, 9 aa, Artificial Sequence
  Peptide Derived from Human Papillomavirus
IFLKNVNVF

SEQ ID NO: 15856 - protein, 11 aa, Artificial Sequence
  Peptide Derived from Human Papillomavirus
IFLKNVNVFPI

SEQ ID NO: 15857 - protein, 8 aa, Artificial Sequence
  Peptide Derived from Human Papillomavirus
IFLQMALW

SEQ ID NO: 15858 - protein, 9 aa, Artificial Sequence
  Peptide Derived from Human Papillomavirus
IFQLCTITL

SEQ ID NO: 15859 - protein, 10 aa, Artificial Sequence
  Peptide Derived from Human Papillomavirus
IFYHAGSSRL

SEQ ID NO: 15860 - protein, 11 aa, Artificial Sequence
  Peptide Derived from Human Papillomavirus
IFYHAGSSRLL

SEQ ID NO: 15861 - protein, 10 aa, Artificial Sequence
  Peptide Derived from Human Papillomavirus
IIFLKNVNVF

SEQ ID NO: 15862 - protein, 11 aa, Artificial Sequence
  Peptide Derived from Human Papillomavirus
IIIFLKNVNVF

SEQ ID NO: 15863 - protein, 8 aa, Artificial Sequence
  Peptide Derived from Human Papillomavirus
IIYGHGII

SEQ ID NO: 15864 - protein, 9 aa, Artificial Sequence
  Peptide Derived from Human Papillomavirus
IIYGHGIII

SEQ ID NO: 15865 - protein, 10 aa, Artificial Sequence
  Peptide Derived from Human Papillomavirus
IIYGHGIIIF

SEQ ID NO: 15866 - protein, 11 aa, Artificial Sequence
  Peptide Derived from Human Papillomavirus
IIYGHGIIIFL

SEQ ID NO: 15867 - protein, 8 aa, Artificial Sequence
  Peptide Derived from Human Papillomavirus
ILGCVPAI

SEQ ID NO: 15868 - protein, 8 aa, Artificial Sequence
  Peptide Derived from Human Papillomavirus
ITLTAEVM

SEQ ID NO: 15869 - protein, 10 aa, Artificial Sequence
  Peptide Derived from Human Papillomavirus
ITLTAEVMSY

SEQ ID NO: 15870 - protein, 11 aa, Artificial Sequence
  Peptide Derived from Human Papillomavirus
ITLTAEVMSYI

SEQ ID NO: 15871 - protein, 8 aa, Artificial Sequence
  Peptide Derived from Human Papillomavirus
ITTSDSQL

SEQ ID NO: 15872 - protein, 9 aa, Artificial Sequence
  Peptide Derived from Human Papillomavirus
ITTSDSQLF

SEQ ID NO: 15873 - protein, 8 aa, Artificial Sequence
  Peptide Derived from Human Papillomavirus
IYGHGIII

SEQ ID NO: 15874 - protein, 9 aa, Artificial Sequence
  Peptide Derived from Human Papillomavirus
IYGHGIIIF

SEQ ID NO: 15875 - protein, 10 aa, Artificial Sequence
  Peptide Derived from Human Papillomavirus
IYGHGIIIFL

SEQ ID NO: 15876 - protein, 9 aa, Artificial Sequence
  Peptide Derived from Human Papillomavirus
IYNPETQRL

SEQ ID NO: 15877 - protein, 11 aa, Artificial Sequence
  Peptide Derived from Human Papillomavirus
IYNPETQRLVW

SEQ ID NO: 15878 - protein, 9 aa, Artificial Sequence
  Peptide Derived from Human Papillomavirus
KFGLPDSTI

SEQ ID NO: 15879 - protein, 10 aa, Artificial Sequence
  Peptide Derived from Human Papillomavirus
KFGLPDSTIY

SEQ ID NO: 15880 - protein, 8 aa, Artificial Sequence
  Peptide Derived from Human Papillomavirus
KFLVQAGL

SEQ ID NO: 15881 - protein, 9 aa, Artificial Sequence
  Peptide Derived from Human Papillomavirus
KFSSDLDQY

SEQ ID NO: 15882 - protein, 11 aa, Artificial Sequence
  Peptide Derived from Human Papillomavirus
KFSSDLDQYPL

SEQ ID NO: 15883 - protein, 11 aa, Artificial Sequence
  Peptide Derived from Human Papillomavirus
KFWTVDLKEKF

SEQ ID NO: 15884 - protein, 9 aa, Artificial Sequence
  Peptide Derived from Human Papillomavirus
KLKFWTVDL

SEQ ID NO: 15885 - protein, 10 aa, Artificial Sequence
  Peptide Derived from Human Papillomavirus
KVSAYQYRVF

SEQ ID NO: 15886 - protein, 8 aa, Artificial Sequence
  Peptide Derived from Human Papillomavirus
KYPDYLQM

SEQ ID NO: 15887 - protein, 8 aa, Artificial Sequence
  Peptide Derived from Human Papillomavirus
LFNKPYWL

SEQ ID NO: 15888 - protein, 8 aa, Artificial Sequence
  Peptide Derived from Human Papillomavirus
LLTVGNPY

SEQ ID NO: 15889 - protein, 9 aa, Artificial Sequence
  Peptide Derived from Human Papillomavirus
LLTVGNPYF

SEQ ID NO: 15890 - protein, 8 aa, Artificial Sequence
  Peptide Derived from Human Papillomavirus
LTAEVMSY

SEQ ID NO: 15891 - protein, 9 aa, Artificial Sequence
  Peptide Derived from Human Papillomavirus
LTAEVMSYI

SEQ ID NO: 15892 - protein, 8 aa, Artificial Sequence
  Peptide Derived from Human Papillomavirus
LTVGNPYF

SEQ ID NO: 15893 - protein, 8 aa, Artificial Sequence
  Peptide Derived from Human Papillomavirus
LVWACVGM

SEQ ID NO: 15894 - protein, 10 aa, Artificial Sequence
  Peptide Derived from Human Papillomavirus
LVWACVGMEI

SEQ ID NO: 15895 - protein, 10 aa, Artificial Sequence
  Peptide Derived from Human Papillomavirus
LWRPSDSTVY

SEQ ID NO: 15896 - protein, 11 aa, Artificial Sequence
  Peptide Derived from Human Papillomavirus
LWRPSDSTVYL

SEQ ID NO: 15897 - protein, 10 aa, Artificial Sequence
  Peptide Derived from Human Papillomavirus
LYIKGTSANM

SEQ ID NO: 15898 - protein, 10 aa, Artificial Sequence
  Peptide Derived from Human Papillomavirus
MFFCLRREQL

SEQ ID NO: 15899 - protein, 11 aa, Artificial Sequence
  Peptide Derived from Human Papillomavirus
MFFCLRREQLF

SEQ ID NO: 15900 - protein, 9 aa, Artificial Sequence
  Peptide Derived from Human Papillomavirus
MVDTGYGAM

SEQ ID NO: 15901 - protein, 11 aa, Artificial Sequence
  Peptide Derived from Human Papillomavirus
MVDTGYGAMDF

SEQ ID NO: 15902 - protein, 8 aa, Artificial Sequence
  Peptide Derived from Human Papillomavirus
NIIYGHGI

SEQ ID NO: 15903 - protein, 9 aa, Artificial Sequence
  Peptide Derived from Human Papillomavirus
NIIYGHGII

SEQ ID NO: 15904 - protein, 10 aa, Artificial Sequence
  Peptide Derived from Human Papillomavirus
NIIYGHGIII

SEQ ID NO: 15905 - protein, 11 aa, Artificial Sequence
  Peptide Derived from Human Papillomavirus
NIIYGHGIIIF

SEQ ID NO: 15906 - protein, 11 aa, Artificial Sequence
  Peptide Derived from Human Papillomavirus
NMRETPGSCVY

SEQ ID NO: 15907 - protein, 11 aa, Artificial Sequence
  Peptide Derived from Human Papillomavirus
NTDDYVSRTSI

SEQ ID NO: 15908 - protein, 9 aa, Artificial Sequence
  Peptide Derived from Human Papillomavirus
NTIIEDGDM

SEQ ID NO: 15909 - protein, 8 aa, Artificial Sequence
  Peptide Derived from Human Papillomavirus
NTYDPTKF

SEQ ID NO: 15910 - protein, 11 aa, Artificial Sequence
  Peptide Derived from Human Papillomavirus
NTYDPTKFKHY

SEQ ID NO: 15911 - protein, 9 aa, Artificial Sequence
  Peptide Derived from Human Papillomavirus
NVFPIFLQM

SEQ ID NO: 15912 - protein, 11 aa, Artificial Sequence
  Peptide Derived from Human Papillomavirus
NVFPIFLQMAL

SEQ ID NO: 15913 - protein, 8 aa, Artificial Sequence
  Peptide Derived from Human Papillomavirus
NVNVFPIF

SEQ ID NO: 15914 - protein, 9 aa, Artificial Sequence
  Peptide Derived from Human Papillomavirus
NVNVFPIFL

SEQ ID NO: 15915 - protein, 11 aa, Artificial Sequence
  Peptide Derived from Human Papillomavirus
NVNVFPIFLQM

SEQ ID NO: 15916 - protein, 11 aa, Artificial Sequence
  Peptide Derived from Human Papillomavirus
NVSVDYKQTQL

SEQ ID NO: 15917 - protein, 8 aa, Artificial Sequence
  Peptide Derived from Human Papillomavirus
PIFLQMAL

SEQ ID NO: 15918 - protein, 9 aa, Artificial Sequence
  Peptide Derived from Human Papillomavirus
PIFLQMALW

SEQ ID NO: 15919 - protein, 8 aa, Artificial Sequence
  Peptide Derived from Human Papillomavirus
PLDICQSI

SEQ ID NO: 15920 - protein, 11 aa, Artificial Sequence
  Peptide Derived from Human Papillomavirus
PLDICQSICKY

SEQ ID NO: 15921 - protein, 8 aa, Artificial Sequence
  Peptide Derived from Human Papillomavirus
PLELKNTI

SEQ ID NO: 15922 - protein, 9 aa, Artificial Sequence
  Peptide Derived from Human Papillomavirus
PLELKNTII

SEQ ID NO: 15923 - protein, 11 aa, Artificial Sequence
  Peptide Derived from Human Papillomavirus
PLGIGLSGHPF

SEQ ID NO: 15924 - protein, 9 aa, Artificial Sequence
  Peptide Derived from Human Papillomavirus
PTTSLVDTY

SEQ ID NO: 15925 - protein, 11 aa, Artificial Sequence
  Peptide Derived from Human Papillomavirus
PTTSLVDTYRF

SEQ ID NO: 15926 - protein, 11 aa, Artificial Sequence
  Peptide Derived from Human Papillomavirus
PVPNTYDPTKF

SEQ ID NO: 15927 - protein, 8 aa, Artificial Sequence
  Peptide Derived from Human Papillomavirus
PYDKLKFW

SEQ ID NO: 15928 - protein, 8 aa, Artificial Sequence
  Peptide Derived from Human Papillomavirus
PYGDSMFF

SEQ ID NO: 15929 - protein, 10 aa, Artificial Sequence
  Peptide Derived from Human Papillomavirus
PYGDSMFFCL

SEQ ID NO: 15930 - protein, 9 aa, Artificial Sequence
  Peptide Derived from Human Papillomavirus
QFIFQLCTI

SEQ ID NO: 15931 - protein, 11 aa, Artificial Sequence
  Peptide Derived from Human Papillomavirus
QFIFQLCTITL

SEQ ID NO: 15932 - protein, 11 aa, Artificial Sequence
  Peptide Derived from Human Papillomavirus
QLCILGCVPAI

SEQ ID NO: 15933 - protein, 8 aa, Artificial Sequence
  Peptide Derived from Human Papillomavirus
QLFARHFW

SEQ ID NO: 15934 - protein, 8 aa, Artificial Sequence
  Peptide Derived from Human Papillomavirus
QLFNKPYW

SEQ ID NO: 15935 - protein, 9 aa, Artificial Sequence
  Peptide Derived from Human Papillomavirus
QLFNKPYWL

SEQ ID NO: 15936 - protein, 10 aa, Artificial Sequence
  Peptide Derived from Human Papillomavirus
QLQPGDCPPL

SEQ ID NO: 15937 - protein, 11 aa, Artificial Sequence
  Peptide Derived from Human Papillomavirus
QMSADPYGDSM

SEQ ID NO: 15938 - protein, 8 aa, Artificial Sequence
  Peptide Derived from Human Papillomavirus
QYPLGRKF

SEQ ID NO: 15939 - protein, 9 aa, Artificial Sequence
  Peptide Derived from Human Papillomavirus
QYPLGRKFL

SEQ ID NO: 15940 - protein, 9 aa, Artificial Sequence
  Peptide Derived from Human Papillomavirus
QYRVFRVAL

SEQ ID NO: 15941 - protein, 9 aa, Artificial Sequence
  Peptide Derived from Human Papillomavirus
RLLTVGNPY

SEQ ID NO: 15942 - protein, 10 aa, Artificial Sequence
  Peptide Derived from Human Papillomavirus
RLLTVGNPYF

SEQ ID NO: 15943 - protein, 9 aa, Artificial Sequence
  Peptide Derived from Human Papillomavirus
RLVWACVGM

SEQ ID NO: 15944 - protein, 11 aa, Artificial Sequence
  Peptide Derived from Human Papillomavirus
RLVWACVGMEI

SEQ ID NO: 15945 - protein, 10 aa, Artificial Sequence
  Peptide Derived from Human Papillomavirus
RVALPDPNKF

SEQ ID NO: 15946 - protein, 8 aa, Artificial Sequence
  Peptide Derived from Human Papillomavirus
RVVNTDDY

SEQ ID NO: 15947 - protein, 8 aa, Artificial Sequence
  Peptide Derived from Human Papillomavirus
SICKYPDY

SEQ ID NO: 15948 - protein, 9 aa, Artificial Sequence
  Peptide Derived from Human Papillomavirus
SICKYPDYL

SEQ ID NO: 15949 - protein, 11 aa, Artificial Sequence
  Peptide Derived from Human Papillomavirus
SICKYPDYLQM

SEQ ID NO: 15950 - protein, 11 aa, Artificial Sequence
  Peptide Derived from Human Papillomavirus
SIFYHAGSSRL

SEQ ID NO: 15951 - protein, 8 aa, Artificial Sequence
  Peptide Derived from Human Papillomavirus
SILENWNF

SEQ ID NO: 15952 - protein, 9 aa, Artificial Sequence
  Peptide Derived from Human Papillomavirus
SITTSDSQL

SEQ ID NO: 15953 - protein, 10 aa, Artificial Sequence
  Peptide Derived from Human Papillomavirus
SITTSDSQLF

SEQ ID NO: 15954 - protein, 8 aa, Artificial Sequence
  Peptide Derived from Human Papillomavirus
SLVDTYRF

SEQ ID NO: 15955 - protein, 11 aa, Artificial Sequence
  Peptide Derived from Human Papillomavirus
SMFFCLRREQL

SEQ ID NO: 15956 - protein, 10 aa, Artificial Sequence
  Peptide Derived from Human Papillomavirus
SMNSSILENW

SEQ ID NO: 15957 - protein, 11 aa, Artificial Sequence
  Peptide Derived from Human Papillomavirus
STIYNPETQRL

SEQ ID NO: 15958 - protein, 10 aa, Artificial Sequence
  Peptide Derived from Human Papillomavirus
STQNPVPNTY

SEQ ID NO: 15959 - protein, 11 aa, Artificial Sequence
  Peptide Derived from Human Papillomavirus
SVARVVNTDDY

SEQ ID NO: 15960 - protein, 9 aa, Artificial Sequence
  Peptide Derived from Human Papillomavirus
SVDYKQTQL

SEQ ID NO: 15961 - protein, 11 aa, Artificial Sequence
  Peptide Derived from Human Papillomavirus
SVDYKQTQLCI

SEQ ID NO: 15962 - protein, 10 aa, Artificial Sequence
  Peptide Derived from Human Papillomavirus
SYIHSMNSSI

SEQ ID NO: 15963 - protein, 11 aa, Artificial Sequence
  Peptide Derived from Human Papillomavirus
SYIHSMNSSIL

SEQ ID NO: 15964 - protein, 8 aa, Artificial Sequence
  Peptide Derived from Human Papillomavirus
TIIEDGDM

SEQ ID NO: 15965 - protein, 9 aa, Artificial Sequence
  Peptide Derived from Human Papillomavirus
TITLTAEVM

SEQ ID NO: 15966 - protein, 11 aa, Artificial Sequence
  Peptide Derived from Human Papillomavirus
TITLTAEVMSY

SEQ ID NO: 15967 - protein, 10 aa, Artificial Sequence
  Peptide Derived from Human Papillomavirus
TIYNPETQRL

SEQ ID NO: 15968 - protein, 8 aa, Artificial Sequence
  Peptide Derived from Human Papillomavirus
TLCKPAQL

SEQ ID NO: 15969 - protein, 11 aa, Artificial Sequence
  Peptide Derived from Human Papillomavirus
TLQDTKCEVPL

SEQ ID NO: 15970 - protein, 9 aa, Artificial Sequence
  Peptide Derived from Human Papillomavirus
TLTAEVMSY

SEQ ID NO: 15971 - protein, 10 aa, Artificial Sequence
  Peptide Derived from Human Papillomavirus
TLTAEVMSYI

SEQ ID NO: 15972 - protein, 10 aa, Artificial Sequence
  Peptide Derived from Human Papillomavirus
TTPPEKQDPY

SEQ ID NO: 15973 - protein, 9 aa, Artificial Sequence
  Peptide Derived from Human Papillomavirus
TTRSTNLTL

SEQ ID NO: 15974 - protein, 8 aa, Artificial Sequence
  Peptide Derived from Human Papillomavirus
TTSDSQLF

SEQ ID NO: 15975 - protein, 8 aa, Artificial Sequence
  Peptide Derived from Human Papillomavirus
TTSLVDTY

SEQ ID NO: 15976 - protein, 10 aa, Artificial Sequence
  Peptide Derived from Human Papillomavirus
TTSLVDTYRF

SEQ ID NO: 15977 - protein, 8 aa, Artificial Sequence
  Peptide Derived from Human Papillomavirus
TVDLKEKF

SEQ ID NO: 15978 - protein, 8 aa, Artificial Sequence
  Peptide Derived from Human Papillomavirus
TVPTDLYI

SEQ ID NO: 15979 - protein, 11 aa, Artificial Sequence
  Peptide Derived from Human Papillomavirus
TVVDTTRSTNL

SEQ ID NO: 15980 - protein, 10 aa, Artificial Sequence
  Peptide Derived from Human Papillomavirus
TYDPTKFKHY

SEQ ID NO: 15981 - protein, 8 aa, Artificial Sequence
  Peptide Derived from Human Papillomavirus
VFPIFLQM

SEQ ID NO: 15982 - protein, 10 aa, Artificial Sequence
  Peptide Derived from Human Papillomavirus
VFPIFLQMAL

SEQ ID NO: 15983 - protein, 11 aa, Artificial Sequence
  Peptide Derived from Human Papillomavirus
VFPIFLQMALW

SEQ ID NO: 15984 - protein, 10 aa, Artificial Sequence
  Peptide Derived from Human Papillomavirus
VMGDTVPTDL

SEQ ID NO: 15985 - protein, 11 aa, Artificial Sequence
  Peptide Derived from Human Papillomavirus
VMGDTVPTDLY

SEQ ID NO: 15986 - protein, 8 aa, Artificial Sequence
  Peptide Derived from Human Papillomavirus
VMSYIHSM

SEQ ID NO: 15987 - protein, 10 aa, Artificial Sequence
  Peptide Derived from Human Papillomavirus
VVDTTRSTNL

SEQ ID NO: 15988 - protein, 9 aa, Artificial Sequence
  Peptide Derived from Human Papillomavirus
VWACVGMEI

SEQ ID NO: 15989 - protein, 10 aa, Artificial Sequence
  Peptide Derived from Human Papillomavirus
VYSPSPSGSI

SEQ ID NO: 15990 - protein, 9 aa, Artificial Sequence
  Peptide Derived from Human Papillomavirus
WTVDLKEKF

SEQ ID NO: 15991 - protein, 9 aa, Artificial Sequence
  Peptide Derived from Human Papillomavirus
YIHSMNSSI

SEQ ID NO: 15992 - protein, 10 aa, Artificial Sequence
  Peptide Derived from Human Papillomavirus
YIHSMNSSIL

SEQ ID NO: 15993 - protein, 9 aa, Artificial Sequence
  Peptide Derived from Human Papillomavirus
YIKGTSANM

SEQ ID NO: 15994 - protein, 9 aa, Artificial Sequence
  Peptide Derived from Human Papillomavirus
YLQMSADPY

SEQ ID NO: 15995 - protein, 8 aa, Artificial Sequence
  Peptide Derived from Human Papillomavirus
YVSRTSIF

SEQ ID NO: 15996 - protein, 9 aa, Artificial Sequence
  Peptide Derived from Human Papillomavirus
YVSRTSIFY

SEQ ID NO: 15997 - protein, 8 aa, Artificial Sequence
  Peptide Derived from Human Papillomavirus
AFSDPSII

SEQ ID NO: 15998 - protein, 11 aa, Artificial Sequence
  Peptide Derived from Human Papillomavirus
ALSSRRGTVRF

SEQ ID NO: 15999 - protein, 10 aa, Artificial Sequence
  Peptide Derived from Human Papillomavirus
ATEEIELQPL

SEQ ID NO: 16000 - protein, 11 aa, Artificial Sequence
  Peptide Derived from Human Papillomavirus
ATEEIELQPLI

SEQ ID NO: 16001 - protein, 11 aa, Artificial Sequence
  Peptide Derived from Human Papillomavirus
ATMFTRSGKQI

SEQ ID NO: 16002 - protein, 8 aa, Artificial Sequence
  Peptide Derived from Human Papillomavirus
ATNDSDLF

SEQ ID NO: 16003 - protein, 11 aa, Artificial Sequence
  Peptide Derived from Human Papillomavirus
ATNDSDLFDVY

SEQ ID NO: 16004 - protein, 9 aa, Artificial Sequence
  Peptide Derived from Human Papillomavirus
AYEPLDTTL

SEQ ID NO: 16005 - protein, 11 aa, Artificial Sequence
  Peptide Derived from Human Papillomavirus
AYEPLDTTLSF

SEQ ID NO: 16006 - protein, 8 aa, Artificial Sequence
  Peptide Derived from Human Papillomavirus
DFMDIIRL

SEQ ID NO: 16007 - protein, 10 aa, Artificial Sequence
  Peptide Derived from Human Papillomavirus
DIILPSHTPM

SEQ ID NO: 16008 - protein, 11 aa, Artificial Sequence
  Peptide Derived from Human Papillomavirus
DIILPSHTPMW

SEQ ID NO: 16009 - protein, 10 aa, Artificial Sequence
  Peptide Derived from Human Papillomavirus
DIIRLHRPAL

SEQ ID NO: 16010 - protein, 11 aa, Artificial Sequence
  Peptide Derived from Human Papillomavirus
DISPIAATEEI

SEQ ID NO: 16011 - protein, 11 aa, Artificial Sequence
  Peptide Derived from Human Papillomavirus
DITPTVDSVSI

SEQ ID NO: 16012 - protein, 9 aa, Artificial Sequence
  Peptide Derived from Human Papillomavirus
DLFDVYADF

SEQ ID NO: 16013 - protein, 11 aa, Artificial Sequence
  Peptide Derived from Human Papillomavirus
DVGPTRPPVVI

SEQ ID NO: 16014 - protein, 11 aa, Artificial Sequence
  Peptide Derived from Human Papillomavirus
DVINKVEGTTL

SEQ ID NO: 16015 - protein, 10 aa, Artificial Sequence
  Peptide Derived from Human Papillomavirus
DVPIYTGPDI

SEQ ID NO: 16016 - protein, 11 aa, Artificial Sequence
  Peptide Derived from Human Papillomavirus
DVPIYTGPDII

SEQ ID NO: 16017 - protein, 8 aa, Artificial Sequence
  Peptide Derived from Human Papillomavirus
EIELQPLI

SEQ ID NO: 16018 - protein, 8 aa, Artificial Sequence
  Peptide Derived from Human Papillomavirus
FLTHPSSL

SEQ ID NO: 16019 - protein, 11 aa, Artificial Sequence
  Peptide Derived from Human Papillomavirus
FLTHPSSLVTF

SEQ ID NO: 16020 - protein, 9 aa, Artificial Sequence
  Peptide Derived from Human Papillomavirus
FTGTSGFEI

SEQ ID NO: 16021 - protein, 11 aa, Artificial Sequence
  Peptide Derived from Human Papillomavirus
FTNPAFSDPSI

SEQ ID NO: 16022 - protein, 8 aa, Artificial Sequence
  Peptide Derived from Human Papillomavirus
FTRSGKQI

SEQ ID NO: 16023 - protein, 8 aa, Artificial Sequence
  Peptide Derived from Human Papillomavirus
FTYPKYSL

SEQ ID NO: 16024 - protein, 10 aa, Artificial Sequence
  Peptide Derived from Human Papillomavirus
FTYPKYSLTM

SEQ ID NO: 16025 - protein, 8 aa, Artificial Sequence
  Peptide Derived from Human Papillomavirus
FYHDISPI

SEQ ID NO: 16026 - protein, 9 aa, Artificial Sequence
  Peptide Derived from Human Papillomavirus
GIFLGGLGI

SEQ ID NO: 16027 - protein, 8 aa, Artificial Sequence
  Peptide Derived from Human Papillomavirus
GIHGTQYY

SEQ ID NO: 16028 - protein, 9 aa, Artificial Sequence
  Peptide Derived from Human Papillomavirus
GIHGTQYYL

SEQ ID NO: 16029 - protein, 10 aa, Artificial Sequence
  Peptide Derived from Human Papillomavirus
GIHGTQYYLW

SEQ ID NO: 16030 - protein, 8 aa, Artificial Sequence
  Peptide Derived from Human Papillomavirus
GTCPPDVI

SEQ ID NO: 16031 - protein, 10 aa, Artificial Sequence
  Peptide Derived from Human Papillomavirus
GTEPISSTPL

SEQ ID NO: 16032 - protein, 10 aa, Artificial Sequence
  Peptide Derived from Human Papillomavirus
GTPTSGSHGY

SEQ ID NO: 16033 - protein, 9 aa, Artificial Sequence
  Peptide Derived from Human Papillomavirus
GTQYYLWPW

SEQ ID NO: 16034 - protein, 10 aa, Artificial Sequence
  Peptide Derived from Human Papillomavirus
GTQYYLWPWY

SEQ ID NO: 16035 - protein, 11 aa, Artificial Sequence
  Peptide Derived from Human Papillomavirus
GTQYYLWPWYY

SEQ ID NO: 16036 - protein, 8 aa, Artificial Sequence
  Peptide Derived from Human Papillomavirus
GTTLADKI

SEQ ID NO: 16037 - protein, 9 aa, Artificial Sequence
  Peptide Derived from Human Papillomavirus
GTTLADKIL

SEQ ID NO: 16038 - protein, 11 aa, Artificial Sequence
  Peptide Derived from Human Papillomavirus
GTTLADKILQW

SEQ ID NO: 16039 - protein, 8 aa, Artificial Sequence
  Peptide Derived from Human Papillomavirus
GTTTPAVL

SEQ ID NO: 16040 - protein, 10 aa, Artificial Sequence
  Peptide Derived from Human Papillomavirus
GTTTPAVLDI

SEQ ID NO: 16041 - protein, 8 aa, Artificial Sequence
  Peptide Derived from Human Papillomavirus
GTVRFSRL

SEQ ID NO: 16042 - protein, 10 aa, Artificial Sequence
  Peptide Derived from Human Papillomavirus
GYEEIPLQTF

SEQ ID NO: 16043 - protein, 9 aa, Artificial Sequence
  Peptide Derived from Human Papillomavirus
HFYHDISPI

SEQ ID NO: 16044 - protein, 8 aa, Artificial Sequence
  Peptide Derived from Human Papillomavirus
IFLGGLGI

SEQ ID NO: 16045 - protein, 9 aa, Artificial Sequence
  Peptide Derived from Human Papillomavirus
IILPSHTPM

SEQ ID NO: 16046 - protein, 10 aa, Artificial Sequence
  Peptide Derived from Human Papillomavirus
IILPSHTPMW

SEQ ID NO: 16047 - protein, 9 aa, Artificial Sequence
  Peptide Derived from Human Papillomavirus
IIRLHRPAL

SEQ ID NO: 16048 - protein, 8 aa, Artificial Sequence
  Peptide Derived from Human Papillomavirus
ILPSHTPM

SEQ ID NO: 16049 - protein, 9 aa, Artificial Sequence
  Peptide Derived from Human Papillomavirus
ILPSHTPMW

SEQ ID NO: 16050 - protein, 9 aa, Artificial Sequence
  Peptide Derived from Human Papillomavirus
ILQWSSLGI

SEQ ID NO: 16051 - protein, 10 aa, Artificial Sequence
  Peptide Derived from Human Papillomavirus
ILQWSSLGIF

SEQ ID NO: 16052 - protein, 11 aa, Artificial Sequence
  Peptide Derived from Human Papillomavirus
ILQWSSLGIFL

SEQ ID NO: 16053 - protein, 10 aa, Artificial Sequence
  Peptide Derived from Human Papillomavirus
ITPTVDSVSI

SEQ ID NO: 16054 - protein, 8 aa, Artificial Sequence
  Peptide Derived from Human Papillomavirus
IYTGPDII

SEQ ID NO: 16055 - protein, 9 aa, Artificial Sequence
  Peptide Derived from Human Papillomavirus
IYTGPDIIL

SEQ ID NO: 16056 - protein, 8 aa, Artificial Sequence
  Peptide Derived from Human Papillomavirus
KILQWSSL

SEQ ID NO: 16057 - protein, 10 aa, Artificial Sequence
  Peptide Derived from Human Papillomavirus
KILQWSSLGI

SEQ ID NO: 16058 - protein, 11 aa, Artificial Sequence
  Peptide Derived from Human Papillomavirus
KILQWSSLGIF

SEQ ID NO: 16059 - protein, 11 aa, Artificial Sequence
  Peptide Derived from Human Papillomavirus
KVEGTTLADKI

SEQ ID NO: 16060 - protein, 8 aa, Artificial Sequence
  Peptide Derived from Human Papillomavirus
LFDVYADF

SEQ ID NO: 16061 - protein, 10 aa, Artificial Sequence
  Peptide Derived from Human Papillomavirus
LISATNDSDL

SEQ ID NO: 16062 - protein, 11 aa, Artificial Sequence
  Peptide Derived from Human Papillomavirus
LISATNDSDLF

SEQ ID NO: 16063 - protein, 10 aa, Artificial Sequence
  Peptide Derived from Human Papillomavirus
LTHPSSLVTF

SEQ ID NO: 16064 - protein, 11 aa, Artificial Sequence
  Peptide Derived from Human Papillomavirus
LTMPSTAASSY

SEQ ID NO: 16065 - protein, 9 aa, Artificial Sequence
  Peptide Derived from Human Papillomavirus
LTSAWDVPI

SEQ ID NO: 16066 - protein, 10 aa, Artificial Sequence
  Peptide Derived from Human Papillomavirus
LTSAWDVPIY

SEQ ID NO: 16067 - protein, 9 aa, Artificial Sequence
  Peptide Derived from Human Papillomavirus
LVTFDNPAY

SEQ ID NO: 16068 - protein, 8 aa, Artificial Sequence
  Peptide Derived from Human Papillomavirus
LWPWYYYF

SEQ ID NO: 16069 - protein, 9 aa, Artificial Sequence
  Peptide Derived from Human Papillomavirus
MFTRSGKQI

SEQ ID NO: 16070 - protein, 8 aa, Artificial Sequence
  Peptide Derived from Human Papillomavirus
NVPDSDFM

SEQ ID NO: 16071 - protein, 10 aa, Artificial Sequence
  Peptide Derived from Human Papillomavirus
NVPDSDFMDI

SEQ ID NO: 16072 - protein, 11 aa, Artificial Sequence
  Peptide Derived from Human Papillomavirus
NVPDSDFMDII

SEQ ID NO: 16073 - protein, 10 aa, Artificial Sequence
  Peptide Derived from Human Papillomavirus
NVTVPLTSAW

SEQ ID NO: 16074 - protein, 8 aa, Artificial Sequence
  Peptide Derived from Human Papillomavirus
PIAATEEI

SEQ ID NO: 16075 - protein, 10 aa, Artificial Sequence
  Peptide Derived from Human Papillomavirus
PIAATEEIEL

SEQ ID NO: 16076 - protein, 8 aa, Artificial Sequence
  Peptide Derived from Human Papillomavirus
PIYTGPDI

SEQ ID NO: 16077 - protein, 9 aa, Artificial Sequence
  Peptide Derived from Human Papillomavirus
PIYTGPDII

SEQ ID NO: 16078 - protein, 10 aa, Artificial Sequence
  Peptide Derived from Human Papillomavirus
PIYTGPDIIL

SEQ ID NO: 16079 - protein, 8 aa, Artificial Sequence
  Peptide Derived from Human Papillomavirus
PLDTTLSF

SEQ ID NO: 16080 - protein, 11 aa, Artificial Sequence
  Peptide Derived from Human Papillomavirus
PLISATNDSDL

SEQ ID NO: 16081 - protein, 10 aa, Artificial Sequence
  Peptide Derived from Human Papillomavirus
PLTSAWDVPI

SEQ ID NO: 16082 - protein, 11 aa, Artificial Sequence
  Peptide Derived from Human Papillomavirus
PLTSAWDVPIY

SEQ ID NO: 16083 - protein, 9 aa, Artificial Sequence
  Peptide Derived from Human Papillomavirus
PTDPSIVTL

SEQ ID NO: 16084 - protein, 9 aa, Artificial Sequence
  Peptide Derived from Human Papillomavirus
PTFTGTSGF

SEQ ID NO: 16085 - protein, 11 aa, Artificial Sequence
  Peptide Derived from Human Papillomavirus
PTFTGTSGFEI

SEQ ID NO: 16086 - protein, 9 aa, Artificial Sequence
  Peptide Derived from Human Papillomavirus
PTNASTTTY

SEQ ID NO: 16087 - protein, 10 aa, Artificial Sequence
  Peptide Derived from Human Papillomavirus
PTNASTTTYI

SEQ ID NO: 16088 - protein, 8 aa, Artificial Sequence
  Peptide Derived from Human Papillomavirus
PTRPPVVI

SEQ ID NO: 16089 - protein, 8 aa, Artificial Sequence
  Peptide Derived from Human Papillomavirus
PTSGSHGY

SEQ ID NO: 16090 - protein, 11 aa, Artificial Sequence
  Peptide Derived from Human Papillomavirus
PTSGSHGYEEI

SEQ ID NO: 16091 - protein, 10 aa, Artificial Sequence
  Peptide Derived from Human Papillomavirus
PTSNVPDSDF

SEQ ID NO: 16092 - protein, 11 aa, Artificial Sequence
  Peptide Derived from Human Papillomavirus
PTSNVPDSDFM

SEQ ID NO: 16093 - protein, 8 aa, Artificial Sequence
  Peptide Derived from Human Papillomavirus
PTVDSVSI

SEQ ID NO: 16094 - protein, 11 aa, Artificial Sequence
  Peptide Derived from Human Papillomavirus
PTVRRVRGPRL

SEQ ID NO: 16095 - protein, 9 aa, Artificial Sequence
  Peptide Derived from Human Papillomavirus
PVGPTDPSI

SEQ ID NO: 16096 - protein, 11 aa, Artificial Sequence
  Peptide Derived from Human Papillomavirus
PVPTFTGTSGF

SEQ ID NO: 16097 - protein, 8 aa, Artificial Sequence
  Peptide Derived from Human Papillomavirus
PYFFADGF

SEQ ID NO: 16098 - protein, 9 aa, Artificial Sequence
  Peptide Derived from Human Papillomavirus
QFLTHPSSL

SEQ ID NO: 16099 - protein, 8 aa, Artificial Sequence
  Peptide Derived from Human Papillomavirus
QIGGRVHF

SEQ ID NO: 16100 - protein, 9 aa, Artificial Sequence
  Peptide Derived from Human Papillomavirus
QIGGRVHFY

SEQ ID NO: 16101 - protein, 9 aa, Artificial Sequence
  Peptide Derived from Human Papillomavirus
QTGEVSGNI

SEQ ID NO: 16102 - protein, 10 aa, Artificial Sequence
  Peptide Derived from Human Papillomavirus
QTGEVSGNIF

SEQ ID NO: 16103 - protein, 9 aa, Artificial Sequence
  Peptide Derived from Human Papillomavirus
QVRVSTSQF

SEQ ID NO: 16104 - protein, 10 aa, Artificial Sequence
  Peptide Derived from Human Papillomavirus
QVRVSTSQFL

SEQ ID NO: 16105 - protein, 8 aa, Artificial Sequence
  Peptide Derived from Human Papillomavirus
QWSSLGIF

SEQ ID NO: 16106 - protein, 9 aa, Artificial Sequence
  Peptide Derived from Human Papillomavirus
QWSSLGIFL

SEQ ID NO: 16107 - protein, 8 aa, Artificial Sequence
  Peptide Derived from Human Papillomavirus
QYYLWPWY

SEQ ID NO: 16108 - protein, 9 aa, Artificial Sequence
  Peptide Derived from Human Papillomavirus
QYYLWPWYY

SEQ ID NO: 16109 - protein, 10 aa, Artificial Sequence
  Peptide Derived from Human Papillomavirus
QYYLWPWYYY

SEQ ID NO: 16110 - protein, 11 aa, Artificial Sequence
  Peptide Derived from Human Papillomavirus
QYYLWPWYYYF

SEQ ID NO: 16111 - protein, 11 aa, Artificial Sequence
  Peptide Derived from Human Papillomavirus
RFSRLGQRATM

SEQ ID NO: 16112 - protein, 10 aa, Artificial Sequence
  Peptide Derived from Human Papillomavirus
RIPYFFADGF

SEQ ID NO: 16113 - protein, 8 aa, Artificial Sequence
  Peptide Derived from Human Papillomavirus
RLGQRATM

SEQ ID NO: 16114 - protein, 9 aa, Artificial Sequence
  Peptide Derived from Human Papillomavirus
RLGQRATMF

SEQ ID NO: 16115 - protein, 8 aa, Artificial Sequence
  Peptide Derived from Human Papillomavirus
RVHFYHDI

SEQ ID NO: 16116 - protein, 11 aa, Artificial Sequence
  Peptide Derived from Human Papillomavirus
RVHFYHDISPI

SEQ ID NO: 16117 - protein, 8 aa, Artificial Sequence
  Peptide Derived from Human Papillomavirus
RVRGPRLY

SEQ ID NO: 16118 - protein, 8 aa, Artificial Sequence
  Peptide Derived from Human Papillomavirus
RVSTSQFL

SEQ ID NO: 16119 - protein, 9 aa, Artificial Sequence
  Peptide Derived from Human Papillomavirus
SFTYPKYSL

SEQ ID NO: 16120 - protein, 11 aa, Artificial Sequence
  Peptide Derived from Human Papillomavirus
SFTYPKYSLTM

SEQ ID NO: 16121 - protein, 9 aa, Artificial Sequence
  Peptide Derived from Human Papillomavirus
SLGIFLGGL

SEQ ID NO: 16122 - protein, 11 aa, Artificial Sequence
  Peptide Derived from Human Papillomavirus
SLGIFLGGLGI

SEQ ID NO: 16123 - protein, 10 aa, Artificial Sequence
  Peptide Derived from Human Papillomavirus
SLVTFDNPAY

SEQ ID NO: 16124 - protein, 9 aa, Artificial Sequence
  Peptide Derived from Human Papillomavirus
STIHKSFTY

SEQ ID NO: 16125 - protein, 9 aa, Artificial Sequence
  Peptide Derived from Human Papillomavirus
STSFTNPAF

SEQ ID NO: 16126 - protein, 11 aa, Artificial Sequence
  Peptide Derived from Human Papillomavirus
STTPSTIHKSF

SEQ ID NO: 16127 - protein, 8 aa, Artificial Sequence
  Peptide Derived from Human Papillomavirus
STTTYIGI

SEQ ID NO: 16128 - protein, 9 aa, Artificial Sequence
  Peptide Derived from Human Papillomavirus
SVSISSTSF

SEQ ID NO: 16129 - protein, 9 aa, Artificial Sequence
  Peptide Derived from Human Papillomavirus
SYSNVTVPL

SEQ ID NO: 16130 - protein, 10 aa, Artificial Sequence
  Peptide Derived from Human Papillomavirus
TFDNPAYEPL

SEQ ID NO: 16131 - protein, 8 aa, Artificial Sequence
  Peptide Derived from Human Papillomavirus
TFTGTSGF

SEQ ID NO: 16132 - protein, 10 aa, Artificial Sequence
  Peptide Derived from Human Papillomavirus
TFTGTSGFEI

SEQ ID NO: 16133 - protein, 8 aa, Artificial Sequence
  Peptide Derived from Human Papillomavirus
TIHKSFTY

SEQ ID NO: 16134 - protein, 11 aa, Artificial Sequence
  Peptide Derived from Human Papillomavirus
TIHKSFTYPKY

SEQ ID NO: 16135 - protein, 9 aa, Artificial Sequence
  Peptide Derived from Human Papillomavirus
TLADKILQW

SEQ ID NO: 16136 - protein, 10 aa, Artificial Sequence
  Peptide Derived from Human Papillomavirus
TMFTRSGKQI

SEQ ID NO: 16137 - protein, 10 aa, Artificial Sequence
  Peptide Derived from Human Papillomavirus
TMPSTAASSY

SEQ ID NO: 16138 - protein, 8 aa, Artificial Sequence
  Peptide Derived from Human Papillomavirus
TTLADKIL

SEQ ID NO: 16139 - protein, 10 aa, Artificial Sequence
  Peptide Derived from Human Papillomavirus
TTLADKILQW

SEQ ID NO: 16140 - protein, 8 aa, Artificial Sequence
  Peptide Derived from Human Papillomavirus
TTPAVLDI

SEQ ID NO: 16141 - protein, 10 aa, Artificial Sequence
  Peptide Derived from Human Papillomavirus
TTPSTIHKSF

SEQ ID NO: 16142 - protein, 9 aa, Artificial Sequence
  Peptide Derived from Human Papillomavirus
TTTPAVLDI

SEQ ID NO: 16143 - protein, 11 aa, Artificial Sequence
  Peptide Derived from Human Papillomavirus
TTYIGIHGTQY

SEQ ID NO: 16144 - protein, 8 aa, Artificial Sequence
  Peptide Derived from Human Papillomavirus
TVPLTSAW

SEQ ID NO: 16145 - protein, 10 aa, Artificial Sequence
  Peptide Derived from Human Papillomavirus
TVRRVRGPRL

SEQ ID NO: 16146 - protein, 11 aa, Artificial Sequence
  Peptide Derived from Human Papillomavirus
TVRRVRGPRLY

SEQ ID NO: 16147 - protein, 10 aa, Artificial Sequence
  Peptide Derived from Human Papillomavirus
TYIGIHGTQY

SEQ ID NO: 16148 - protein, 11 aa, Artificial Sequence
  Peptide Derived from Human Papillomavirus
TYIGIHGTQYY

SEQ ID NO: 16149 - protein, 9 aa, Artificial Sequence
  Peptide Derived from Human Papillomavirus
TYPKYSLTM

SEQ ID NO: 16150 - protein, 10 aa, Artificial Sequence
  Peptide Derived from Human Papillomavirus
VINKVEGTTL

SEQ ID NO: 16151 - protein, 8 aa, Artificial Sequence
  Peptide Derived from Human Papillomavirus
VTFDNPAY

SEQ ID NO: 16152 - protein, 11 aa, Artificial Sequence
  Peptide Derived from Human Papillomavirus
VTFDNPAYEPL

SEQ ID NO: 16153 - protein, 9 aa, Artificial Sequence
  Peptide Derived from Human Papillomavirus
VTVPLTSAW

SEQ ID NO: 16154 - protein, 11 aa, Artificial Sequence
  Peptide Derived from Human Papillomavirus
VVASGAPVPTF

SEQ ID NO: 16155 - protein, 9 aa, Artificial Sequence
  Peptide Derived from Human Papillomavirus
YFPKKRKRI

SEQ ID NO: 16156 - protein, 11 aa, Artificial Sequence
  Peptide Derived from Human Papillomavirus
YFPKKRKRIPY

SEQ ID NO: 16157 - protein, 9 aa, Artificial Sequence
  Peptide Derived from Human Papillomavirus
YIGIHGTQY

SEQ ID NO: 16158 - protein, 10 aa, Artificial Sequence
  Peptide Derived from Human Papillomavirus
YIGIHGTQYY

SEQ ID NO: 16159 - protein, 11 aa, Artificial Sequence
  Peptide Derived from Human Papillomavirus
YIGIHGTQYYL

SEQ ID NO: 16160 - protein, 8 aa, Artificial Sequence
  Peptide Derived from Human Papillomavirus
YLWPWYYY

SEQ ID NO: 16161 - protein, 9 aa, Artificial Sequence
  Peptide Derived from Human Papillomavirus
YLWPWYYYF

SEQ ID NO: 16162 - protein, 8 aa, Artificial Sequence
  Peptide Derived from Human Papillomavirus
YTGPDIIL

SEQ ID NO: 16163 - protein, 10 aa, Artificial Sequence
  Peptide Derived from Human Papillomavirus
YYFPKKRKRI

SEQ ID NO: 16164 - protein, 8 aa, Artificial Sequence
  Peptide Derived from Human Papillomavirus
YYLWPWYY

SEQ ID NO: 16165 - protein, 9 aa, Artificial Sequence
  Peptide Derived from Human Papillomavirus
YYLWPWYYY

SEQ ID NO: 16166 - protein, 10 aa, Artificial Sequence
  Peptide Derived from Human Papillomavirus
YYLWPWYYYF

SEQ ID NO: 16167 - protein, 11 aa, Artificial Sequence
  Peptide Derived from Human Papillomavirus
YYYFPKKRKRI

SEQ ID NO: 16168 - protein, 8 aa, Artificial Sequence
  Peptide Derived from Human Papillomavirus
AIEVQIAL

SEQ ID NO: 16169 - protein, 11 aa, Artificial Sequence
  Peptide Derived from Human Papillomavirus
AIEVQIALESL

SEQ ID NO: 16170 - protein, 9 aa, Artificial Sequence
  Peptide Derived from Human Papillomavirus
ALESLSTTI

SEQ ID NO: 16171 - protein, 10 aa, Artificial Sequence
  Peptide Derived from Human Papillomavirus
ALESLSTTIY

SEQ ID NO: 16172 - protein, 9 aa, Artificial Sequence
  Peptide Derived from Human Papillomavirus
CFKKEGQHI

SEQ ID NO: 16173 - protein, 9 aa, Artificial Sequence
  Peptide Derived from Human Papillomavirus
CMQYVAWKY

SEQ ID NO: 16174 - protein, 10 aa, Artificial Sequence
  Peptide Derived from Human Papillomavirus
CMQYVAWKYI

SEQ ID NO: 16175 - protein, 11 aa, Artificial Sequence
  Peptide Derived from Human Papillomavirus
CMQYVAWKYIY

SEQ ID NO: 16176 - protein, 8 aa, Artificial Sequence
  Peptide Derived from Human Papillomavirus
CVTTHTHI

SEQ ID NO: 16177 - protein, 9 aa, Artificial Sequence
  Peptide Derived from Human Papillomavirus
DFEQEAKKF

SEQ ID NO: 16178 - protein, 8 aa, Artificial Sequence
  Peptide Derived from Human Papillomavirus
DTCEELWL

SEQ ID NO: 16179 - protein, 8 aa, Artificial Sequence
  Peptide Derived from Human Papillomavirus
DVTSTYHW

SEQ ID NO: 16180 - protein, 11 aa, Artificial Sequence
  Peptide Derived from Human Papillomavirus
ELWLTEPKKCF

SEQ ID NO: 16181 - protein, 8 aa, Artificial Sequence
  Peptide Derived from Human Papillomavirus
ETQRNSFL

SEQ ID NO: 16182 - protein, 9 aa, Artificial Sequence
  Peptide Derived from Human Papillomavirus
EVHMENESI

SEQ ID NO: 16183 - protein, 10 aa, Artificial Sequence
  Peptide Derived from Human Papillomavirus
EVHMENESIY

SEQ ID NO: 16184 - protein, 9 aa, Artificial Sequence
  Peptide Derived from Human Papillomavirus
EVQIALESL

SEQ ID NO: 16185 - protein, 11 aa, Artificial Sequence
  Peptide Derived from Human Papillomavirus
EWTLRDTCEEL

SEQ ID NO: 16186 - protein, 11 aa, Artificial Sequence
  Peptide Derived from Human Papillomavirus
FLSHVKIPVVY

SEQ ID NO: 16187 - protein, 8 aa, Artificial Sequence
  Peptide Derived from Human Papillomavirus
FVDVTSTY

SEQ ID NO: 16188 - protein, 10 aa, Artificial Sequence
  Peptide Derived from Human Papillomavirus
FVDVTSTYHW

SEQ ID NO: 16189 - protein, 8 aa, Artificial Sequence
  Peptide Derived from Human Papillomavirus
GVDYRGIY

SEQ ID NO: 16190 - protein, 9 aa, Artificial Sequence
  Peptide Derived from Human Papillomavirus
GVDYRGIYY

SEQ ID NO: 16191 - protein, 11 aa, Artificial Sequence
  Peptide Derived from Human Papillomavirus
GWQKVCSGVDY

SEQ ID NO: 16192 - protein, 9 aa, Artificial Sequence
  Peptide Derived from Human Papillomavirus
HLKGEPNRL

SEQ ID NO: 16193 - protein, 8 aa, Artificial Sequence
  Peptide Derived from Human Papillomavirus
HMENESIY

SEQ ID NO: 16194 - protein, 8 aa, Artificial Sequence
  Peptide Derived from Human Papillomavirus
HVKIPVVY

SEQ ID NO: 16195 - protein, 10 aa, Artificial Sequence
  Peptide Derived from Human Papillomavirus
HVKIPVVYRL

SEQ ID NO: 16196 - protein, 10 aa, Artificial Sequence
  Peptide Derived from Human Papillomavirus
HWTSTDNKNY

SEQ ID NO: 16197 - protein, 11 aa, Artificial Sequence
  Peptide Derived from Human Papillomavirus
IWEVHMENESI

SEQ ID NO: 16198 - protein, 11 aa, Artificial Sequence
  Peptide Derived from Human Papillomavirus
IYKDETQRNSF

SEQ ID NO: 16199 - protein, 9 aa, Artificial Sequence
  Peptide Derived from Human Papillomavirus
IYNNEEWTL

SEQ ID NO: 16200 - protein, 9 aa, Artificial Sequence
  Peptide Derived from Human Papillomavirus
IYYNGDCGW

SEQ ID NO: 16201 - protein, 11 aa, Artificial Sequence
  Peptide Derived from Human Papillomavirus
IYYVHDGHKTY

SEQ ID NO: 16202 - protein, 8 aa, Artificial Sequence
  Peptide Derived from Human Papillomavirus
KFGCKNIW

SEQ ID NO: 16203 - protein, 8 aa, Artificial Sequence
  Peptide Derived from Human Papillomavirus
KIPVVYRL

SEQ ID NO: 16204 - protein, 10 aa, Artificial Sequence
  Peptide Derived from Human Papillomavirus
KIPVVYRLVW

SEQ ID NO: 16205 - protein, 11 aa, Artificial Sequence
  Peptide Derived from Human Papillomavirus
KTLFVDVTSTY

SEQ ID NO: 16206 - protein, 8 aa, Artificial Sequence
  Peptide Derived from Human Papillomavirus
KTTPVVHL

SEQ ID NO: 16207 - protein, 8 aa, Artificial Sequence
  Peptide Derived from Human Papillomavirus
KVCSGVDY

SEQ ID NO: 16208 - protein, 11 aa, Artificial Sequence
  Peptide Derived from Human Papillomavirus
KVCSGVDYRGI

SEQ ID NO: 16209 - protein, 11 aa, Artificial Sequence
  Peptide Derived from Human Papillomavirus
KYIYYNGDCGW

SEQ ID NO: 16210 - protein, 9 aa, Artificial Sequence
  Peptide Derived from Human Papillomavirus
LFVDVTSTY

SEQ ID NO: 16211 - protein, 11 aa, Artificial Sequence
  Peptide Derived from Human Papillomavirus
LFVDVTSTYHW

SEQ ID NO: 16212 - protein, 8 aa, Artificial Sequence
  Peptide Derived from Human Papillomavirus
LTEPKKCF

SEQ ID NO: 16213 - protein, 10 aa, Artificial Sequence
  Peptide Derived from Human Papillomavirus
LWLTEPKKCF

SEQ ID NO: 16214 - protein, 9 aa, Artificial Sequence
  Peptide Derived from Human Papillomavirus
NTDSRSRSI

SEQ ID NO: 16215 - protein, 11 aa, Artificial Sequence
  Peptide Derived from Human Papillomavirus
NVSPVETVNEY

SEQ ID NO: 16216 - protein, 8 aa, Artificial Sequence
  Peptide Derived from Human Papillomavirus
NYSIITII

SEQ ID NO: 16217 - protein, 9 aa, Artificial Sequence
  Peptide Derived from Human Papillomavirus
NYSIITIIY

SEQ ID NO: 16218 - protein, 8 aa, Artificial Sequence
  Peptide Derived from Human Papillomavirus
PVETVNEY

SEQ ID NO: 16219 - protein, 8 aa, Artificial Sequence
  Peptide Derived from Human Papillomavirus
PVVYRLVW

SEQ ID NO: 16220 - protein, 11 aa, Artificial Sequence
  Peptide Derived from Human Papillomavirus
QIALESLSTTI

SEQ ID NO: 16221 - protein, 11 aa, Artificial Sequence
  Peptide Derived from Human Papillomavirus
QVCKAKACSAI

SEQ ID NO: 16222 - protein, 8 aa, Artificial Sequence
  Peptide Derived from Human Papillomavirus
QYVAWKYI

SEQ ID NO: 16223 - protein, 9 aa, Artificial Sequence
  Peptide Derived from Human Papillomavirus
QYVAWKYIY

SEQ ID NO: 16224 - protein, 10 aa, Artificial Sequence
  Peptide Derived from Human Papillomavirus
QYVAWKYIYY

SEQ ID NO: 16225 - protein, 8 aa, Artificial Sequence
  Peptide Derived from Human Papillomavirus
RFQKYKTL

SEQ ID NO: 16226 - protein, 9 aa, Artificial Sequence
  Peptide Derived from Human Papillomavirus
RFQKYKTLF

SEQ ID NO: 16227 - protein, 9 aa, Artificial Sequence
  Peptide Derived from Human Papillomavirus
RLKCCRYRF

SEQ ID NO: 16228 - protein, 10 aa, Artificial Sequence
  Peptide Derived from Human Papillomavirus
RYRFQKYKTL

SEQ ID NO: 16229 - protein, 11 aa, Artificial Sequence
  Peptide Derived from Human Papillomavirus
RYRFQKYKTLF

SEQ ID NO: 16230 - protein, 8 aa, Artificial Sequence
  Peptide Derived from Human Papillomavirus
SFLSHVKI

SEQ ID NO: 16231 - protein, 9 aa, Artificial Sequence
  Peptide Derived from Human Papillomavirus
STDNKNYSI

SEQ ID NO: 16232 - protein, 10 aa, Artificial Sequence
  Peptide Derived from Human Papillomavirus
STDNKNYSII

SEQ ID NO: 16233 - protein, 10 aa, Artificial Sequence
  Peptide Derived from Human Papillomavirus
STTIYNNEEW

SEQ ID NO: 16234 - protein, 8 aa, Artificial Sequence
  Peptide Derived from Human Papillomavirus
SVSSTCRY

SEQ ID NO: 16235 - protein, 8 aa, Artificial Sequence
  Peptide Derived from Human Papillomavirus
TIYNNEEW

SEQ ID NO: 16236 - protein, 10 aa, Artificial Sequence
  Peptide Derived from Human Papillomavirus
TIYNNEEWTL

SEQ ID NO: 16237 - protein, 10 aa, Artificial Sequence
  Peptide Derived from Human Papillomavirus
TLFVDVTSTY

SEQ ID NO: 16238 - protein, 9 aa, Artificial Sequence
  Peptide Derived from Human Papillomavirus
TLRDTCEEL

SEQ ID NO: 16239 - protein, 10 aa, Artificial Sequence
  Peptide Derived from Human Papillomavirus
TLRDTCEELW

SEQ ID NO: 16240 - protein, 11 aa, Artificial Sequence
  Peptide Derived from Human Papillomavirus
TLRDTCEELWL

SEQ ID NO: 16241 - protein, 9 aa, Artificial Sequence
  Peptide Derived from Human Papillomavirus
TTIYNNEEW

SEQ ID NO: 16242 - protein, 11 aa, Artificial Sequence
  Peptide Derived from Human Papillomavirus
TTIYNNEEWTL

SEQ ID NO: 16243 - protein, 11 aa, Artificial Sequence
  Peptide Derived from Human Papillomavirus
VVHLKGEPNRL

SEQ ID NO: 16244 - protein, 11 aa, Artificial Sequence
  Peptide Derived from Human Papillomavirus
VWFDGSKNNCM

SEQ ID NO: 16245 - protein, 10 aa, Artificial Sequence
  Peptide Derived from Human Papillomavirus
WFDGSKNNCM

SEQ ID NO: 16246 - protein, 9 aa, Artificial Sequence
  Peptide Derived from Human Papillomavirus
WLTEPKKCF

SEQ ID NO: 16247 - protein, 10 aa, Artificial Sequence
  Peptide Derived from Human Papillomavirus
WTLRDTCEEL

SEQ ID NO: 16248 - protein, 11 aa, Artificial Sequence
  Peptide Derived from Human Papillomavirus
WTLRDTCEELW

SEQ ID NO: 16249 - protein, 9 aa, Artificial Sequence
  Peptide Derived from Human Papillomavirus
WTSTDNKNY

SEQ ID NO: 16250 - protein, 11 aa, Artificial Sequence
  Peptide Derived from Human Papillomavirus
WTSTDNKNYSI

SEQ ID NO: 16251 - protein, 10 aa, Artificial Sequence
  Peptide Derived from Human Papillomavirus
YIYYNGDCGW

SEQ ID NO: 16252 - protein, 11 aa, Artificial Sequence
  Peptide Derived from Human Papillomavirus
YTDFEQEAKKF

SEQ ID NO: 16253 - protein, 8 aa, Artificial Sequence
  Peptide Derived from Human Papillomavirus
YVAWKYIY

SEQ ID NO: 16254 - protein, 9 aa, Artificial Sequence
  Peptide Derived from Human Papillomavirus
YVAWKYIYY

SEQ ID NO: 16255 - protein, 9 aa, Artificial Sequence
  Peptide Derived from Human Papillomavirus
YVHDGHKTY

SEQ ID NO: 16256 - protein, 10 aa, Artificial Sequence
  Peptide Derived from Human Papillomavirus
YVHDGHKTYY

SEQ ID NO: 16257 - protein, 8 aa, Artificial Sequence
  Peptide Derived from Human Papillomavirus
YYNGDCGW

SEQ ID NO: 16258 - protein, 10 aa, Artificial Sequence
  Peptide Derived from Human Papillomavirus
YYVHDGHKTY

SEQ ID NO: 16259 - protein, 11 aa, Artificial Sequence
  Peptide Derived from Human Papillomavirus
YYVHDGHKTYY

SEQ ID NO: 16260 - protein, 11 aa, Artificial Sequence
  Peptide Derived from Human Papillomavirus
ATLESITKKQL

SEQ ID NO: 16261 - protein, 8 aa, Artificial Sequence
  Peptide Derived from Human Papillomavirus
AVCRVCLL

SEQ ID NO: 16262 - protein, 9 aa, Artificial Sequence
  Peptide Derived from Human Papillomavirus
AVCRVCLLF

SEQ ID NO: 16263 - protein, 10 aa, Artificial Sequence
  Peptide Derived from Human Papillomavirus
AVCRVCLLFY

SEQ ID NO: 16264 - protein, 11 aa, Artificial Sequence
  Peptide Derived from Human Papillomavirus
CLLFYSKVRKY

SEQ ID NO: 16265 - protein, 8 aa, Artificial Sequence
  Peptide Derived from Human Papillomavirus
CTELKLVY

SEQ ID NO: 16266 - protein, 8 aa, Artificial Sequence
  Peptide Derived from Human Papillomavirus
CVYCKKEL

SEQ ID NO: 16267 - protein, 8 aa, Artificial Sequence
  Peptide Derived from Human Papillomavirus
CYRCQSPL

SEQ ID NO: 16268 - protein, 11 aa, Artificial Sequence
  Peptide Derived from Human Papillomavirus
DFPYAVCRVCL

SEQ ID NO: 16269 - protein, 8 aa, Artificial Sequence
  Peptide Derived from Human Papillomavirus
DLRLSCVY

SEQ ID NO: 16270 - protein, 9 aa, Artificial Sequence
  Peptide Derived from Human Papillomavirus
DYSVYGATL

SEQ ID NO: 16271 - protein, 9 aa, Artificial Sequence
  Peptide Derived from Human Papillomavirus
EIPLIDLRL

SEQ ID NO: 16272 - protein, 10 aa, Artificial Sequence
  Peptide Derived from Human Papillomavirus
ELKLVYRDDF

SEQ ID NO: 16273 - protein, 8 aa, Artificial Sequence
  Peptide Derived from Human Papillomavirus
ELTRAEVY

SEQ ID NO: 16274 - protein, 10 aa, Artificial Sequence
  Peptide Derived from Human Papillomavirus
ELTRAEVYNF

SEQ ID NO: 16275 - protein, 8 aa, Artificial Sequence
  Peptide Derived from Human Papillomavirus
EVLEIPLI

SEQ ID NO: 16276 - protein, 10 aa, Artificial Sequence
  Peptide Derived from Human Papillomavirus
EVLEIPLIDL

SEQ ID NO: 16277 - protein, 10 aa, Artificial Sequence
  Peptide Derived from Human Papillomavirus
EVYNFACTEL

SEQ ID NO: 16278 - protein, 8 aa, Artificial Sequence
  Peptide Derived from Human Papillomavirus
FYSKVRKY

SEQ ID NO: 16279 - protein, 10 aa, Artificial Sequence
  Peptide Derived from Human Papillomavirus
FYSKVRKYRY

SEQ ID NO: 16280 - protein, 11 aa, Artificial Sequence
  Peptide Derived from Human Papillomavirus
FYSKVRKYRYY

SEQ ID NO: 16281 - protein, 10 aa, Artificial Sequence
  Peptide Derived from Human Papillomavirus
GWTGSCLGCW

SEQ ID NO: 16282 - protein, 8 aa, Artificial Sequence
  Peptide Derived from Human Papillomavirus
HLSEVLEI

SEQ ID NO: 16283 - protein, 10 aa, Artificial Sequence
  Peptide Derived from Human Papillomavirus
HLSEVLEIPL

SEQ ID NO: 16284 - protein, 11 aa, Artificial Sequence
  Peptide Derived from Human Papillomavirus
HLSEVLEIPLI

SEQ ID NO: 16285 - protein, 9 aa, Artificial Sequence
  Peptide Derived from Human Papillomavirus
ITKKQLCDL

SEQ ID NO: 16286 - protein, 10 aa, Artificial Sequence
  Peptide Derived from Human Papillomavirus
ITKKQLCDLL

SEQ ID NO: 16287 - protein, 11 aa, Artificial Sequence
  Peptide Derived from Human Papillomavirus
ITKKQLCDLLI

SEQ ID NO: 16288 - protein, 8 aa, Artificial Sequence
  Peptide Derived from Human Papillomavirus
KLVYRDDF

SEQ ID NO: 16289 - protein, 10 aa, Artificial Sequence
  Peptide Derived from Human Papillomavirus
KLVYRDDFPY

SEQ ID NO: 16290 - protein, 8 aa, Artificial Sequence
  Peptide Derived from Human Papillomavirus
KVRKYRYY

SEQ ID NO: 16291 - protein, 10 aa, Artificial Sequence
  Peptide Derived from Human Papillomavirus
KVRKYRYYDY

SEQ ID NO: 16292 - protein, 10 aa, Artificial Sequence
  Peptide Derived from Human Papillomavirus
KYRYYDYSVY

SEQ ID NO: 16293 - protein, 9 aa, Artificial Sequence
  Peptide Derived from Human Papillomavirus
LFYSKVRKY

SEQ ID NO: 16294 - protein, 11 aa, Artificial Sequence
  Peptide Derived from Human Papillomavirus
LFYSKVRKYRY

SEQ ID NO: 16295 - protein, 11 aa, Artificial Sequence
  Peptide Derived from Human Papillomavirus
LIAHGWTGSCL

SEQ ID NO: 16296 - protein, 10 aa, Artificial Sequence
  Peptide Derived from Human Papillomavirus
LIDLRLSCVY

SEQ ID NO: 16297 - protein, 11 aa, Artificial Sequence
  Peptide Derived from Human Papillomavirus
LIRCYRCQSPL

SEQ ID NO: 16298 - protein, 10 aa, Artificial Sequence
  Peptide Derived from Human Papillomavirus
LLFYSKVRKY

SEQ ID NO: 16299 - protein, 8 aa, Artificial Sequence
  Peptide Derived from Human Papillomavirus
LTPEEKQL

SEQ ID NO: 16300 - protein, 9 aa, Artificial Sequence
  Peptide Derived from Human Papillomavirus
LTRAEVYNF

SEQ ID NO: 16301 - protein, 9 aa, Artificial Sequence
  Peptide Derived from Human Papillomavirus
LVYRDDFPY

SEQ ID NO: 16302 - protein, 9 aa, Artificial Sequence
  Peptide Derived from Human Papillomavirus
NFACTELKL

SEQ ID NO: 16303 - protein, 11 aa, Artificial Sequence
  Peptide Derived from Human Papillomavirus
NFACTELKLVY

SEQ ID NO: 16304 - protein, 11 aa, Artificial Sequence
  Peptide Derived from Human Papillomavirus
PLIDLRLSCVY

SEQ ID NO: 16305 - protein, 9 aa, Artificial Sequence
  Peptide Derived from Human Papillomavirus
PLTPEEKQL

SEQ ID NO: 16306 - protein, 9 aa, Artificial Sequence
  Peptide Derived from Human Papillomavirus
PYAVCRVCL

SEQ ID NO: 16307 - protein, 10 aa, Artificial Sequence
  Peptide Derived from Human Papillomavirus
PYAVCRVCLL

SEQ ID NO: 16308 - protein, 11 aa, Artificial Sequence
  Peptide Derived from Human Papillomavirus
PYAVCRVCLLF

SEQ ID NO: 16309 - protein, 10 aa, Artificial Sequence
  Peptide Derived from Human Papillomavirus
QLCDLLIRCY

SEQ ID NO: 16310 - protein, 10 aa, Artificial Sequence
  Peptide Derived from Human Papillomavirus
QLHCDRKRRF

SEQ ID NO: 16311 - protein, 9 aa, Artificial Sequence
  Peptide Derived from Human Papillomavirus
RFHLIAHGW

SEQ ID NO: 16312 - protein, 11 aa, Artificial Sequence
  Peptide Derived from Human Papillomavirus
RLSCVYCKKEL

SEQ ID NO: 16313 - protein, 8 aa, Artificial Sequence
  Peptide Derived from Human Papillomavirus
RYYDYSVY

SEQ ID NO: 16314 - protein, 10 aa, Artificial Sequence
  Peptide Derived from Human Papillomavirus
SITKKQLCDL

SEQ ID NO: 16315 - protein, 11 aa, Artificial Sequence
  Peptide Derived from Human Papillomavirus
SITKKQLCDLL

SEQ ID NO: 16316 - protein, 9 aa, Artificial Sequence
  Peptide Derived from Human Papillomavirus
SLHHLSEVL

SEQ ID NO: 16317 - protein, 11 aa, Artificial Sequence
  Peptide Derived from Human Papillomavirus
SLHHLSEVLEI

SEQ ID NO: 16318 - protein, 10 aa, Artificial Sequence
  Peptide Derived from Human Papillomavirus
SVYGATLESI

SEQ ID NO: 16319 - protein, 10 aa, Artificial Sequence
  Peptide Derived from Human Papillomavirus
TLESITKKQL

SEQ ID NO: 16320 - protein, 9 aa, Artificial Sequence
  Peptide Derived from Human Papillomavirus
VLEIPLIDL

SEQ ID NO: 16321 - protein, 11 aa, Artificial Sequence
  Peptide Derived from Human Papillomavirus
VLEIPLIDLRL

SEQ ID NO: 16322 - protein, 9 aa, Artificial Sequence
  Peptide Derived from Human Papillomavirus
VYGATLESI

SEQ ID NO: 16323 - protein, 9 aa, Artificial Sequence
  Peptide Derived from Human Papillomavirus
VYNFACTEL

SEQ ID NO: 16324 - protein, 11 aa, Artificial Sequence
  Peptide Derived from Human Papillomavirus
VYNFACTELKL

SEQ ID NO: 16325 - protein, 8 aa, Artificial Sequence
  Peptide Derived from Human Papillomavirus
VYRDDFPY

SEQ ID NO: 16326 - protein, 9 aa, Artificial Sequence
  Peptide Derived from Human Papillomavirus
WTGSCLGCW

SEQ ID NO: 16327 - protein, 11 aa, Artificial Sequence
  Peptide Derived from Human Papillomavirus
YYDYSVYGATL

SEQ ID NO: 16328 - protein, 8 aa, Artificial Sequence
  Peptide Derived from Human Papillomavirus
ALTVTCPL

SEQ ID NO: 16329 - protein, 9 aa, Artificial Sequence
  Peptide Derived from Human Papillomavirus
DIQSTKEDL

SEQ ID NO: 16330 - protein, 8 aa, Artificial Sequence
  Peptide Derived from Human Papillomavirus
DLQCNEQL

SEQ ID NO: 16331 - protein, 8 aa, Artificial Sequence
  Peptide Derived from Human Papillomavirus
DLRVVQQL

SEQ ID NO: 16332 - protein, 9 aa, Artificial Sequence
  Peptide Derived from Human Papillomavirus
DLRVVQQLL

SEQ ID NO: 16333 - protein, 10 aa, Artificial Sequence
  Peptide Derived from Human Papillomavirus
DLRVVQQLLM

SEQ ID NO: 16334 - protein, 10 aa, Artificial Sequence
  Peptide Derived from Human Papillomavirus
EIDLQCNEQL

SEQ ID NO: 16335 - protein, 8 aa, Artificial Sequence
  Peptide Derived from Human Papillomavirus
ELTPQTEI

SEQ ID NO: 16336 - protein, 10 aa, Artificial Sequence
  Peptide Derived from Human Papillomavirus
ELTPQTEIDL

SEQ ID NO: 16337 - protein, 9 aa, Artificial Sequence
  Peptide Derived from Human Papillomavirus
HVPCCECKF

SEQ ID NO: 16338 - protein, 8 aa, Artificial Sequence
  Peptide Derived from Human Papillomavirus
KFVVQLDI

SEQ ID NO: 16339 - protein, 10 aa, Artificial Sequence
  Peptide Derived from Human Papillomavirus
KVPTLQDVVL

SEQ ID NO: 16340 - protein, 11 aa, Artificial Sequence
  Peptide Derived from Human Papillomavirus
LIHVPCCECKF

SEQ ID NO: 16341 - protein, 11 aa, Artificial Sequence
  Peptide Derived from Human Papillomavirus
LMGALTVTCPL

SEQ ID NO: 16342 - protein, 9 aa, Artificial Sequence
  Peptide Derived from Human Papillomavirus
LTPQTEIDL

SEQ ID NO: 16343 - protein, 8 aa, Artificial Sequence
  Peptide Derived from Human Papillomavirus
PTLQDVVL

SEQ ID NO: 16344 - protein, 10 aa, Artificial Sequence
  Peptide Derived from Human Papillomavirus
PTLQDVVLEL

SEQ ID NO: 16345 - protein, 11 aa, Artificial Sequence
  Peptide Derived from Human Papillomavirus
QLDIQSTKEDL

SEQ ID NO: 16346 - protein, 8 aa, Artificial Sequence
  Peptide Derived from Human Papillomavirus
RVVQQLLM

SEQ ID NO: 16347 - protein, 11 aa, Artificial Sequence
  Peptide Derived from Human Papillomavirus
RVVQQLLMGAL

SEQ ID NO: 16348 - protein, 9 aa, Artificial Sequence
  Peptide Derived from Human Papillomavirus
TLQDVVLEL

SEQ ID NO: 16349 - protein, 10 aa, Artificial Sequence
  Peptide Derived from Human Papillomavirus
VLELTPQTEI

SEQ ID NO: 16350 - protein, 11 aa, Artificial Sequence
  Peptide Derived from Human Papillomavirus
VVLELTPQTEI

SEQ ID NO: 16351 - protein, 10 aa, Artificial Sequence
  Peptide Derived from Human Papillomavirus
VVQQLLMGAL

SEQ ID NO: 16352 - protein, 11 aa, Artificial Sequence
  Peptide Derived from Human Papillomavirus
ATDSYVKRTSI

SEQ ID NO: 16353 - protein, 8 aa, Artificial Sequence
  Peptide Derived from Human Papillomavirus
ATEQLSKY

SEQ ID NO: 16354 - protein, 8 aa, Artificial Sequence
  Peptide Derived from Human Papillomavirus
ATPSGSMI

SEQ ID NO: 16355 - protein, 8 aa, Artificial Sequence
  Peptide Derived from Human Papillomavirus
ATSLEDKY

SEQ ID NO: 16356 - protein, 10 aa, Artificial Sequence
  Peptide Derived from Human Papillomavirus
ATSLEDKYRY

SEQ ID NO: 16357 - protein, 11 aa, Artificial Sequence
  Peptide Derived from Human Papillomavirus
ATWRPSENKVY

SEQ ID NO: 16358 - protein, 8 aa, Artificial Sequence
  Peptide Derived from Human Papillomavirus
AVNVFPIF

SEQ ID NO: 16359 - protein, 9 aa, Artificial Sequence
  Peptide Derived from Human Papillomavirus
AVNVFPIFL

SEQ ID NO: 16360 - protein, 11 aa, Artificial Sequence
  Peptide Derived from Human Papillomavirus
AVNVFPIFLQM

SEQ ID NO: 16361 - protein, 8 aa, Artificial Sequence
  Peptide Derived from Human Papillomavirus
AYGDSMWF

SEQ ID NO: 16362 - protein, 9 aa, Artificial Sequence
  Peptide Derived from Human Papillomavirus
AYGDSMWFY

SEQ ID NO: 16363 - protein, 10 aa, Artificial Sequence
  Peptide Derived from Human Papillomavirus
AYGDSMWFYL

SEQ ID NO: 16364 - protein, 10 aa, Artificial Sequence
  Peptide Derived from Human Papillomavirus
AYLHNMNANL

SEQ ID NO: 16365 - protein, 11 aa, Artificial Sequence
  Peptide Derived from Human Papillomavirus
AYLHNMNANLL

SEQ ID NO: 16366 - protein, 11 aa, Artificial Sequence
  Peptide Derived from Human Papillomavirus
AYQYRVFRVRL

SEQ ID NO: 16367 - protein, 9 aa, Artificial Sequence
  Peptide Derived from Human Papillomavirus
CIVGCTPAM

SEQ ID NO: 16368 - protein, 9 aa, Artificial Sequence
  Peptide Derived from Human Papillomavirus
CTPAMGEHW

SEQ ID NO: 16369 - protein, 9 aa, Artificial Sequence
  Peptide Derived from Human Papillomavirus
DIVQSTCKY

SEQ ID NO: 16370 - protein, 11 aa, Artificial Sequence
  Peptide Derived from Human Papillomavirus
DLDQFPLGRKF

SEQ ID NO: 16371 - protein, 10 aa, Artificial Sequence
  Peptide Derived from Human Papillomavirus
DMIDTGFGAM

SEQ ID NO: 16372 - protein, 9 aa, Artificial Sequence
  Peptide Derived from Human Papillomavirus
DTGFGAMDF

SEQ ID NO: 16373 - protein, 8 aa, Artificial Sequence
  Peptide Derived from Human Papillomavirus
DTTRSTNM

SEQ ID NO: 16374 - protein, 10 aa, Artificial Sequence
  Peptide Derived from Human Papillomavirus
DTTRSTNMTI

SEQ ID NO: 16375 - protein, 8 aa, Artificial Sequence
  Peptide Derived from Human Papillomavirus
DVGAVNVF

SEQ ID NO: 16376 - protein, 10 aa, Artificial Sequence
  Peptide Derived from Human Papillomavirus
DVGAVNVFPI

SEQ ID NO: 16377 - protein, 11 aa, Artificial Sequence
  Peptide Derived from Human Papillomavirus
DVGAVNVFPIF

SEQ ID NO: 16378 - protein, 8 aa, Artificial Sequence
  Peptide Derived from Human Papillomavirus
DVNLQDSF

SEQ ID NO: 16379 - protein, 10 aa, Artificial Sequence
  Peptide Derived from Human Papillomavirus
DYLKMSADAY

SEQ ID NO: 16380 - protein, 8 aa, Artificial Sequence
  Peptide Derived from Human Papillomavirus
ELQFVFQL

SEQ ID NO: 16381 - protein, 11 aa, Artificial Sequence
  Peptide Derived from Human Papillomavirus
ELQFVFQLCKI

SEQ ID NO: 16382 - protein, 8 aa, Artificial Sequence
  Peptide Derived from Human Papillomavirus
ETIPAELY

SEQ ID NO: 16383 - protein, 9 aa, Artificial Sequence
  Peptide Derived from Human Papillomavirus
ETIPAELYL

SEQ ID NO: 16384 - protein, 8 aa, Artificial Sequence
  Peptide Derived from Human Papillomavirus
EVGRGQPL

SEQ ID NO: 16385 - protein, 9 aa, Artificial Sequence
  Peptide Derived from Human Papillomavirus
EVMAYLHNM

SEQ ID NO: 16386 - protein, 8 aa, Artificial Sequence
  Peptide Derived from Human Papillomavirus
EYELQFVF

SEQ ID NO: 16387 - protein, 10 aa, Artificial Sequence
  Peptide Derived from Human Papillomavirus
EYELQFVFQL

SEQ ID NO: 16388 - protein, 10 aa, Artificial Sequence
  Peptide Derived from Human Papillomavirus
FLDVGAVNVF

SEQ ID NO: 16389 - protein, 8 aa, Artificial Sequence
  Peptide Derived from Human Papillomavirus
FVFQLCKI

SEQ ID NO: 16390 - protein, 10 aa, Artificial Sequence
  Peptide Derived from Human Papillomavirus
FVFQLCKITL

SEQ ID NO: 16391 - protein, 10 aa, Artificial Sequence
  Peptide Derived from Human Papillomavirus
FWDVNLQDSF

SEQ ID NO: 16392 - protein, 9 aa, Artificial Sequence
  Peptide Derived from Human Papillomavirus
FYHAGSSRL

SEQ ID NO: 16393 - protein, 10 aa, Artificial Sequence
  Peptide Derived from Human Papillomavirus
FYHAGSSRLL

SEQ ID NO: 16394 - protein, 8 aa, Artificial Sequence
  Peptide Derived from Human Papillomavirus
FYLRREQL

SEQ ID NO: 16395 - protein, 9 aa, Artificial Sequence
  Peptide Derived from Human Papillomavirus
FYLRREQLF

SEQ ID NO: 16396 - protein, 10 aa, Artificial Sequence
  Peptide Derived from Human Papillomavirus
GFGAMDFKVL

SEQ ID NO: 16397 - protein, 8 aa, Artificial Sequence
  Peptide Derived from Human Papillomavirus
GICWGNQL

SEQ ID NO: 16398 - protein, 9 aa, Artificial Sequence
  Peptide Derived from Human Papillomavirus
GICWGNQLF

SEQ ID NO: 16399 - protein, 10 aa, Artificial Sequence
  Peptide Derived from Human Papillomavirus
GLEVGRGQPL

SEQ ID NO: 16400 - protein, 8 aa, Artificial Sequence
  Peptide Derived from Human Papillomavirus
GLPDTNIY

SEQ ID NO: 16401 - protein, 8 aa, Artificial Sequence
  Peptide Derived from Human Papillomavirus
GLSGHPLF

SEQ ID NO: 16402 - protein, 11 aa, Artificial Sequence
  Peptide Derived from Human Papillomavirus
GLSGHPLFNRL

SEQ ID NO: 16403 - protein, 10 aa, Artificial Sequence
  Peptide Derived from Human Papillomavirus
GLSPPVATSL

SEQ ID NO: 16404 - protein, 9 aa, Artificial Sequence
  Peptide Derived from Human Papillomavirus
HVEEYELQF

SEQ ID NO: 16405 - protein, 11 aa, Artificial Sequence
  Peptide Derived from Human Papillomavirus
HVEEYELQFVF

SEQ ID NO: 16406 - protein, 8 aa, Artificial Sequence
  Peptide Derived from Human Papillomavirus
HYGLCIFL

SEQ ID NO: 16407 - protein, 11 aa, Artificial Sequence
  Peptide Derived from Human Papillomavirus
IFLDVGAVNVF

SEQ ID NO: 16408 - protein, 8 aa, Artificial Sequence
  Peptide Derived from Human Papillomavirus
IFLQMATW

SEQ ID NO: 16409 - protein, 10 aa, Artificial Sequence
  Peptide Derived from Human Papillomavirus
IFYHAGSSRL

SEQ ID NO: 16410 - protein, 11 aa, Artificial Sequence
  Peptide Derived from Human Papillomavirus
IFYHAGSSRLL

SEQ ID NO: 16411 - protein, 8 aa, Artificial Sequence
  Peptide Derived from Human Papillomavirus
ITLSAEVM

SEQ ID NO: 16412 - protein, 10 aa, Artificial Sequence
  Peptide Derived from Human Papillomavirus
ITLSAEVMAY

SEQ ID NO: 16413 - protein, 11 aa, Artificial Sequence
  Peptide Derived from Human Papillomavirus
ITLSAEVMAYL

SEQ ID NO: 16414 - protein, 8 aa, Artificial Sequence
  Peptide Derived from Human Papillomavirus
ITSEAQLF

SEQ ID NO: 16415 - protein, 8 aa, Artificial Sequence
  Peptide Derived from Human Papillomavirus
IVGCTPAM

SEQ ID NO: 16416 - protein, 8 aa, Artificial Sequence
  Peptide Derived from Human Papillomavirus
IVQSTCKY

SEQ ID NO: 16417 - protein, 11 aa, Artificial Sequence
  Peptide Derived from Human Papillomavirus
IVQSTCKYPDY

SEQ ID NO: 16418 - protein, 9 aa, Artificial Sequence
  Peptide Derived from Human Papillomavirus
IYNPDQERL

SEQ ID NO: 16419 - protein, 11 aa, Artificial Sequence
  Peptide Derived from Human Papillomavirus
IYNPDQERLVW

SEQ ID NO: 16420 - protein, 9 aa, Artificial Sequence
  Peptide Derived from Human Papillomavirus
IYRDPPLHY

SEQ ID NO: 16421 - protein, 11 aa, Artificial Sequence
  Peptide Derived from Human Papillomavirus
IYRDPPLHYGL

SEQ ID NO: 16422 - protein, 9 aa, Artificial Sequence
  Peptide Derived from Human Papillomavirus
KFGLPDTNI

SEQ ID NO: 16423 - protein, 10 aa, Artificial Sequence
  Peptide Derived from Human Papillomavirus
KFGLPDTNIY

SEQ ID NO: 16424 - protein, 11 aa, Artificial Sequence
  Peptide Derived from Human Papillomavirus
KFWDVNLQDSF

SEQ ID NO: 16425 - protein, 9 aa, Artificial Sequence
  Peptide Derived from Human Papillomavirus
KITLSAEVM

SEQ ID NO: 16426 - protein, 11 aa, Artificial Sequence
  Peptide Derived from Human Papillomavirus
KITLSAEVMAY

SEQ ID NO: 16427 - protein, 11 aa, Artificial Sequence
  Peptide Derived from Human Papillomavirus
KMSADAYGDSM

SEQ ID NO: 16428 - protein, 10 aa, Artificial Sequence
  Peptide Derived from Human Papillomavirus
KTNIPKVSAY

SEQ ID NO: 16429 - protein, 10 aa, Artificial Sequence
  Peptide Derived from Human Papillomavirus
KVGETIPAEL

SEQ ID NO: 16430 - protein, 11 aa, Artificial Sequence
  Peptide Derived from Human Papillomavirus
KVGETIPAELY

SEQ ID NO: 16431 - protein, 10 aa, Artificial Sequence
  Peptide Derived from Human Papillomavirus
KVSAYQYRVF

SEQ ID NO: 16432 - protein, 8 aa, Artificial Sequence
  Peptide Derived from Human Papillomavirus
KVVATDSY

SEQ ID NO: 16433 - protein, 10 aa, Artificial Sequence
  Peptide Derived from Human Papillomavirus
KYDARKINQY

SEQ ID NO: 16434 - protein, 11 aa, Artificial Sequence
  Peptide Derived from Human Papillomavirus
KYDARKINQYL

SEQ ID NO: 16435 - protein, 9 aa, Artificial Sequence
  Peptide Derived from Human Papillomavirus
KYKFWDVNL

SEQ ID NO: 16436 - protein, 8 aa, Artificial Sequence
  Peptide Derived from Human Papillomavirus
KYPDYLKM

SEQ ID NO: 16437 - protein, 10 aa, Artificial Sequence
  Peptide Derived from Human Papillomavirus
KYRYVRSTAI

SEQ ID NO: 16438 - protein, 8 aa, Artificial Sequence
  Peptide Derived from Human Papillomavirus
LFNKPYWL

SEQ ID NO: 16439 - protein, 11 aa, Artificial Sequence
  Peptide Derived from Human Papillomavirus
LINTPIEDGDM

SEQ ID NO: 16440 - protein, 8 aa, Artificial Sequence
  Peptide Derived from Human Papillomavirus
LLAVGHPY

SEQ ID NO: 16441 - protein, 9 aa, Artificial Sequence
  Peptide Derived from Human Papillomavirus
LLAVGHPYY

SEQ ID NO: 16442 - protein, 9 aa, Artificial Sequence
  Peptide Derived from Human Papillomavirus
LLEDWNIGL

SEQ ID NO: 16443 - protein, 8 aa, Artificial Sequence
  Peptide Derived from Human Papillomavirus
LVWACVGL

SEQ ID NO: 16444 - protein, 9 aa, Artificial Sequence
  Peptide Derived from Human Papillomavirus
MIDTGFGAM

SEQ ID NO: 16445 - protein, 11 aa, Artificial Sequence
  Peptide Derived from Human Papillomavirus
MIDTGFGAMDF

SEQ ID NO: 16446 - protein, 8 aa, Artificial Sequence
  Peptide Derived from Human Papillomavirus
MITSEAQL

SEQ ID NO: 16447 - protein, 9 aa, Artificial Sequence
  Peptide Derived from Human Papillomavirus
MITSEAQLF

SEQ ID NO: 16448 - protein, 8 aa, Artificial Sequence
  Peptide Derived from Human Papillomavirus
MLPMMYIY

SEQ ID NO: 16449 - protein, 8 aa, Artificial Sequence
  Peptide Derived from Human Papillomavirus
MMLPMMYI

SEQ ID NO: 16450 - protein, 9 aa, Artificial Sequence
  Peptide Derived from Human Papillomavirus
MMLPMMYIY

SEQ ID NO: 16451 - protein, 10 aa, Artificial Sequence
  Peptide Derived from Human Papillomavirus
MMYIYRDPPL

SEQ ID NO: 16452 - protein, 10 aa, Artificial Sequence
  Peptide Derived from Human Papillomavirus
MTISTATEQL

SEQ ID NO: 16453 - protein, 10 aa, Artificial Sequence
  Peptide Derived from Human Papillomavirus
MWFYLRREQL

SEQ ID NO: 16454 - protein, 11 aa, Artificial Sequence
  Peptide Derived from Human Papillomavirus
MWFYLRREQLF

SEQ ID NO: 16455 - protein, 9 aa, Artificial Sequence
  Peptide Derived from Human Papillomavirus
MYIYRDPPL

SEQ ID NO: 16456 - protein, 11 aa, Artificial Sequence
  Peptide Derived from Human Papillomavirus
MYIYRDPPLHY

SEQ ID NO: 16457 - protein, 8 aa, Artificial Sequence
  Peptide Derived from Human Papillomavirus
NIPKVSAY

SEQ ID NO: 16458 - protein, 10 aa, Artificial Sequence
  Peptide Derived from Human Papillomavirus
NIPKVSAYQY

SEQ ID NO: 16459 - protein, 11 aa, Artificial Sequence
  Peptide Derived from Human Papillomavirus
NISVDGKQTQL

SEQ ID NO: 16460 - protein, 10 aa, Artificial Sequence
  Peptide Derived from Human Papillomavirus
NIYNPDQERL

SEQ ID NO: 16461 - protein, 8 aa, Artificial Sequence
  Peptide Derived from Human Papillomavirus
NLANNNVI

SEQ ID NO: 16462 - protein, 8 aa, Artificial Sequence
  Peptide Derived from Human Papillomavirus
NLLEDWNI

SEQ ID NO: 16463 - protein, 10 aa, Artificial Sequence
  Peptide Derived from Human Papillomavirus
NLLEDWNIGL

SEQ ID NO: 16464 - protein, 10 aa, Artificial Sequence
  Peptide Derived from Human Papillomavirus
NLQDSFSTDL

SEQ ID NO: 16465 - protein, 10 aa, Artificial Sequence
  Peptide Derived from Human Papillomavirus
NMNANLLEDW

SEQ ID NO: 16466 - protein, 11 aa, Artificial Sequence
  Peptide Derived from Human Papillomavirus
NMTISTATEQL

SEQ ID NO: 16467 - protein, 9 aa, Artificial Sequence
  Peptide Derived from Human Papillomavirus
NTPIEDGDM

SEQ ID NO: 16468 - protein, 10 aa, Artificial Sequence
  Peptide Derived from Human Papillomavirus
NTPIEDGDMI

SEQ ID NO: 16469 - protein, 9 aa, Artificial Sequence
  Peptide Derived from Human Papillomavirus
NVFPIFLQM

SEQ ID NO: 16470 - protein, 10 aa, Artificial Sequence
  Peptide Derived from Human Papillomavirus
NVIEDSRDNI

SEQ ID NO: 16471 - protein, 8 aa, Artificial Sequence
  Peptide Derived from Human Papillomavirus
PIEDGDMI

SEQ ID NO: 16472 - protein, 9 aa, Artificial Sequence
  Peptide Derived from Human Papillomavirus
PIFLQMATW

SEQ ID NO: 16473 - protein, 8 aa, Artificial Sequence
  Peptide Derived from Human Papillomavirus
PLAKYKFW

SEQ ID NO: 16474 - protein, 9 aa, Artificial Sequence
  Peptide Derived from Human Papillomavirus
PLALINTPI

SEQ ID NO: 16475 - protein, 11 aa, Artificial Sequence
  Peptide Derived from Human Papillomavirus
PLDIVQSTCKY

SEQ ID NO: 16476 - protein, 11 aa, Artificial Sequence
  Peptide Derived from Human Papillomavirus
PLGAGLSGHPL

SEQ ID NO: 16477 - protein, 8 aa, Artificial Sequence
  Peptide Derived from Human Papillomavirus
PLGRKFLM

SEQ ID NO: 16478 - protein, 10 aa, Artificial Sequence
  Peptide Derived from Human Papillomavirus
PLGRKFLMQL

SEQ ID NO: 16479 - protein, 8 aa, Artificial Sequence
  Peptide Derived from Human Papillomavirus
PLHYGLCI

SEQ ID NO: 16480 - protein, 9 aa, Artificial Sequence
  Peptide Derived from Human Papillomavirus
PLHYGLCIF

SEQ ID NO: 16481 - protein, 10 aa, Artificial Sequence
  Peptide Derived from Human Papillomavirus
PLHYGLCIFL

SEQ ID NO: 16482 - protein, 11 aa, Artificial Sequence
  Peptide Derived from Human Papillomavirus
PMMYIYRDPPL

SEQ ID NO: 16483 - protein, 8 aa, Artificial Sequence
  Peptide Derived from Human Papillomavirus
PTEKQDPL

SEQ ID NO: 16484 - protein, 11 aa, Artificial Sequence
  Peptide Derived from Human Papillomavirus
PTEKQDPLAKY

SEQ ID NO: 16485 - protein, 10 aa, Artificial Sequence
  Peptide Derived from Human Papillomavirus
PVATSLEDKY

SEQ ID NO: 16486 - protein, 11 aa, Artificial Sequence
  Peptide Derived from Human Papillomavirus
PVSKVVATDSY

SEQ ID NO: 16487 - protein, 8 aa, Artificial Sequence
  Peptide Derived from Human Papillomavirus
QFPLGRKF

SEQ ID NO: 16488 - protein, 9 aa, Artificial Sequence
  Peptide Derived from Human Papillomavirus
QFPLGRKFL

SEQ ID NO: 16489 - protein, 10 aa, Artificial Sequence
  Peptide Derived from Human Papillomavirus
QFPLGRKFLM

SEQ ID NO: 16490 - protein, 9 aa, Artificial Sequence
  Peptide Derived from Human Papillomavirus
QFVFQLCKI

SEQ ID NO: 16491 - protein, 11 aa, Artificial Sequence
  Peptide Derived from Human Papillomavirus
QFVFQLCKITL

SEQ ID NO: 16492 - protein, 11 aa, Artificial Sequence
  Peptide Derived from Human Papillomavirus
QLCIVGCTPAM

SEQ ID NO: 16493 - protein, 8 aa, Artificial Sequence
  Peptide Derived from Human Papillomavirus
QLFARHYF

SEQ ID NO: 16494 - protein, 8 aa, Artificial Sequence
  Peptide Derived from Human Papillomavirus
QLFNKPYW

SEQ ID NO: 16495 - protein, 9 aa, Artificial Sequence
  Peptide Derived from Human Papillomavirus
QLFNKPYWL

SEQ ID NO: 16496 - protein, 10 aa, Artificial Sequence
  Peptide Derived from Human Papillomavirus
QLSKYDARKI

SEQ ID NO: 16497 - protein, 10 aa, Artificial Sequence
  Peptide Derived from Human Papillomavirus
QVTTGDCPPL

SEQ ID NO: 16498 - protein, 9 aa, Artificial Sequence
  Peptide Derived from Human Papillomavirus
QYLRHVEEY

SEQ ID NO: 16499 - protein, 11 aa, Artificial Sequence
  Peptide Derived from Human Papillomavirus
QYLRHVEEYEL

SEQ ID NO: 16500 - protein, 9 aa, Artificial Sequence
  Peptide Derived from Human Papillomavirus
QYRVFRVRL

SEQ ID NO: 16501 - protein, 10 aa, Artificial Sequence
  Peptide Derived from Human Papillomavirus
RLDDTESSNL

SEQ ID NO: 16502 - protein, 9 aa, Artificial Sequence
  Peptide Derived from Human Papillomavirus
RLLAVGHPY

SEQ ID NO: 16503 - protein, 10 aa, Artificial Sequence
  Peptide Derived from Human Papillomavirus
RLLAVGHPYY

SEQ ID NO: 16504 - protein, 8 aa, Artificial Sequence
  Peptide Derived from Human Papillomavirus
RLPDPNKF

SEQ ID NO: 16505 - protein, 10 aa, Artificial Sequence
  Peptide Derived from Human Papillomavirus
RLPDPNKFGL

SEQ ID NO: 16506 - protein, 9 aa, Artificial Sequence
  Peptide Derived from Human Papillomavirus
RLVWACVGL

SEQ ID NO: 16507 - protein, 10 aa, Artificial Sequence
  Peptide Derived from Human Papillomavirus
RVRLPDPNKF

SEQ ID NO: 16508 - protein, 8 aa, Artificial Sequence
  Peptide Derived from Human Papillomavirus
RYVRSTAI

SEQ ID NO: 16509 - protein, 9 aa, Artificial Sequence
  Peptide Derived from Human Papillomavirus
SFSTDLDQF

SEQ ID NO: 16510 - protein, 11 aa, Artificial Sequence
  Peptide Derived from Human Papillomavirus
SFSTDLDQFPL

SEQ ID NO: 16511 - protein, 11 aa, Artificial Sequence
  Peptide Derived from Human Papillomavirus
SIFYHAGSSRL

SEQ ID NO: 16512 - protein, 8 aa, Artificial Sequence
  Peptide Derived from Human Papillomavirus
SLEDKYRY

SEQ ID NO: 16513 - protein, 9 aa, Artificial Sequence
  Peptide Derived from Human Papillomavirus
SMITSEAQL

SEQ ID NO: 16514 - protein, 10 aa, Artificial Sequence
  Peptide Derived from Human Papillomavirus
SMITSEAQLF

SEQ ID NO: 16515 - protein, 11 aa, Artificial Sequence
  Peptide Derived from Human Papillomavirus
SMWFYLRREQL

SEQ ID NO: 16516 - protein, 10 aa, Artificial Sequence
  Peptide Derived from Human Papillomavirus
STATEQLSKY

SEQ ID NO: 16517 - protein, 8 aa, Artificial Sequence
  Peptide Derived from Human Papillomavirus
STCKYPDY

SEQ ID NO: 16518 - protein, 9 aa, Artificial Sequence
  Peptide Derived from Human Papillomavirus
STCKYPDYL

SEQ ID NO: 16519 - protein, 11 aa, Artificial Sequence
  Peptide Derived from Human Papillomavirus
STCKYPDYLKM

SEQ ID NO: 16520 - protein, 9 aa, Artificial Sequence
  Peptide Derived from Human Papillomavirus
STDLDQFPL

SEQ ID NO: 16521 - protein, 9 aa, Artificial Sequence
  Peptide Derived from Human Papillomavirus
SVDGKQTQL

SEQ ID NO: 16522 - protein, 11 aa, Artificial Sequence
  Peptide Derived from Human Papillomavirus
SVDGKQTQLCI

SEQ ID NO: 16523 - protein, 11 aa, Artificial Sequence
  Peptide Derived from Human Papillomavirus
SVTKDNTKTNI

SEQ ID NO: 16524 - protein, 11 aa, Artificial Sequence
  Peptide Derived from Human Papillomavirus
SVYVATPSGSM

SEQ ID NO: 16525 - protein, 8 aa, Artificial Sequence
  Peptide Derived from Human Papillomavirus
SYVKRTSI

SEQ ID NO: 16526 - protein, 9 aa, Artificial Sequence
  Peptide Derived from Human Papillomavirus
SYVKRTSIF

SEQ ID NO: 16527 - protein, 10 aa, Artificial Sequence
  Peptide Derived from Human Papillomavirus
SYVKRTSIFY

SEQ ID NO: 16528 - protein, 8 aa, Artificial Sequence
  Peptide Derived from Human Papillomavirus
TIPAELYL

SEQ ID NO: 16529 - protein, 9 aa, Artificial Sequence
  Peptide Derived from Human Papillomavirus
TISTATEQL

SEQ ID NO: 16530 - protein, 9 aa, Artificial Sequence
  Peptide Derived from Human Papillomavirus
TLSAEVMAY

SEQ ID NO: 16531 - protein, 10 aa, Artificial Sequence
  Peptide Derived from Human Papillomavirus
TLSAEVMAYL

SEQ ID NO: 16532 - protein, 8 aa, Artificial Sequence
  Peptide Derived from Human Papillomavirus
TTGDCPPL

SEQ ID NO: 16533 - protein, 10 aa, Artificial Sequence
  Peptide Derived from Human Papillomavirus
TTGDCPPLAL

SEQ ID NO: 16534 - protein, 11 aa, Artificial Sequence
  Peptide Derived from Human Papillomavirus
TTGDCPPLALI

SEQ ID NO: 16535 - protein, 9 aa, Artificial Sequence
  Peptide Derived from Human Papillomavirus
TTRSTNMTI

SEQ ID NO: 16536 - protein, 11 aa, Artificial Sequence
  Peptide Derived from Human Papillomavirus
TVVDTTRSTNM

SEQ ID NO: 16537 - protein, 10 aa, Artificial Sequence
  Peptide Derived from Human Papillomavirus
TWRPSENKVY

SEQ ID NO: 16538 - protein, 11 aa, Artificial Sequence
  Peptide Derived from Human Papillomavirus
TWRPSENKVYL

SEQ ID NO: 16539 - protein, 8 aa, Artificial Sequence
  Peptide Derived from Human Papillomavirus
VFPIFLQM

SEQ ID NO: 16540 - protein, 11 aa, Artificial Sequence
  Peptide Derived from Human Papillomavirus
VFPIFLQMATW

SEQ ID NO: 16541 - protein, 9 aa, Artificial Sequence
  Peptide Derived from Human Papillomavirus
VFQLCKITL

SEQ ID NO: 16542 - protein, 9 aa, Artificial Sequence
  Peptide Derived from Human Papillomavirus
VIEDSRDNI

SEQ ID NO: 16543 - protein, 11 aa, Artificial Sequence
  Peptide Derived from Human Papillomavirus
VLQESKAEVPL

SEQ ID NO: 16544 - protein, 8 aa, Artificial Sequence
  Peptide Derived from Human Papillomavirus
VMAYLHNM

SEQ ID NO: 16545 - protein, 10 aa, Artificial Sequence
  Peptide Derived from Human Papillomavirus
VTKDNTKTNI

SEQ ID NO: 16546 - protein, 9 aa, Artificial Sequence
  Peptide Derived from Human Papillomavirus
VTTGDCPPL

SEQ ID NO: 16547 - protein, 11 aa, Artificial Sequence
  Peptide Derived from Human Papillomavirus
VTTGDCPPLAL

SEQ ID NO: 16548 - protein, 10 aa, Artificial Sequence
  Peptide Derived from Human Papillomavirus
VVDTTRSTNM

SEQ ID NO: 16549 - protein, 10 aa, Artificial Sequence
  Peptide Derived from Human Papillomavirus
VYVATPSGSM

SEQ ID NO: 16550 - protein, 11 aa, Artificial Sequence
  Peptide Derived from Human Papillomavirus
VYVATPSGSMI

SEQ ID NO: 16551 - protein, 9 aa, Artificial Sequence
  Peptide Derived from Human Papillomavirus
WFYLRREQL

SEQ ID NO: 16552 - protein, 10 aa, Artificial Sequence
  Peptide Derived from Human Papillomavirus
WFYLRREQLF

SEQ ID NO: 16553 - protein, 8 aa, Artificial Sequence
  Peptide Derived from Human Papillomavirus
YIYRDPPL

SEQ ID NO: 16554 - protein, 10 aa, Artificial Sequence
  Peptide Derived from Human Papillomavirus
YIYRDPPLHY

SEQ ID NO: 16555 - protein, 9 aa, Artificial Sequence
  Peptide Derived from Human Papillomavirus
YLHNMNANL

SEQ ID NO: 16556 - protein, 10 aa, Artificial Sequence
  Peptide Derived from Human Papillomavirus
YLHNMNANLL

SEQ ID NO: 16557 - protein, 9 aa, Artificial Sequence
  Peptide Derived from Human Papillomavirus
YLKMSADAY

SEQ ID NO: 16558 - protein, 8 aa, Artificial Sequence
  Peptide Derived from Human Papillomavirus
YLRHVEEY

SEQ ID NO: 16559 - protein, 10 aa, Artificial Sequence
  Peptide Derived from Human Papillomavirus
YLRHVEEYEL

SEQ ID NO: 16560 - protein, 8 aa, Artificial Sequence
  Peptide Derived from Human Papillomavirus
YLRREQLF

SEQ ID NO: 16561 - protein, 9 aa, Artificial Sequence
  Peptide Derived from Human Papillomavirus
YVATPSGSM

SEQ ID NO: 16562 - protein, 10 aa, Artificial Sequence
  Peptide Derived from Human Papillomavirus
YVATPSGSMI

SEQ ID NO: 16563 - protein, 8 aa, Artificial Sequence
  Peptide Derived from Human Papillomavirus
YVKRTSIF

SEQ ID NO: 16564 - protein, 9 aa, Artificial Sequence
  Peptide Derived from Human Papillomavirus
YVKRTSIFY

SEQ ID NO: 16565 - protein, 9 aa, Artificial Sequence
  Peptide Derived from Human Papillomavirus
AFLDRPATL

SEQ ID NO: 16566 - protein, 11 aa, Artificial Sequence
  Peptide Derived from Human Papillomavirus
AFTTRRGGVRF

SEQ ID NO: 16567 - protein, 8 aa, Artificial Sequence
  Peptide Derived from Human Papillomavirus
ALWPVYFF

SEQ ID NO: 16568 - protein, 11 aa, Artificial Sequence
  Peptide Derived from Human Papillomavirus
ATIQTRRGTQI

SEQ ID NO: 16569 - protein, 10 aa, Artificial Sequence
  Peptide Derived from Human Papillomavirus
ATLVSADNPL

SEQ ID NO: 16570 - protein, 11 aa, Artificial Sequence
  Peptide Derived from Human Papillomavirus
ATLVSADNPLF

SEQ ID NO: 16571 - protein, 9 aa, Artificial Sequence
  Peptide Derived from Human Papillomavirus
ATPSAHLPI

SEQ ID NO: 16572 - protein, 10 aa, Artificial Sequence
  Peptide Derived from Human Papillomavirus
ATQLYKTCKL

SEQ ID NO: 16573 - protein, 10 aa, Artificial Sequence
  Peptide Derived from Human Papillomavirus
AVHGSGTEPI

SEQ ID NO: 16574 - protein, 8 aa, Artificial Sequence
  Peptide Derived from Human Papillomavirus
DFMNIVAL

SEQ ID NO: 16575 - protein, 11 aa, Artificial Sequence
  Peptide Derived from Human Papillomavirus
DISPIAQAEEI

SEQ ID NO: 16576 - protein, 11 aa, Artificial Sequence
  Peptide Derived from Human Papillomavirus
DIVLPTGPSTW

SEQ ID NO: 16577 - protein, 8 aa, Artificial Sequence
  Peptide Derived from Human Papillomavirus
DVTHDVYI

SEQ ID NO: 16578 - protein, 9 aa, Artificial Sequence
  Peptide Derived from Human Papillomavirus
DVTPARPPI

SEQ ID NO: 16579 - protein, 11 aa, Artificial Sequence
  Peptide Derived from Human Papillomavirus
DVVNKIEQKTW

SEQ ID NO: 16580 - protein, 9 aa, Artificial Sequence
  Peptide Derived from Human Papillomavirus
DVYIQGSSF

SEQ ID NO: 16581 - protein, 11 aa, Artificial Sequence
  Peptide Derived from Human Papillomavirus
DVYIQGSSFAL

SEQ ID NO: 16582 - protein, 8 aa, Artificial Sequence
  Peptide Derived from Human Papillomavirus
EIEMQPLL

SEQ ID NO: 16583 - protein, 10 aa, Artificial Sequence
  Peptide Derived from Human Papillomavirus
ETPFYSGPDI

SEQ ID NO: 16584 - protein, 8 aa, Artificial Sequence
  Peptide Derived from Human Papillomavirus
EVSGNILI

SEQ ID NO: 16585 - protein, 10 aa, Artificial Sequence
  Peptide Derived from Human Papillomavirus
FFRRRRRKRI

SEQ ID NO: 16586 - protein, 8 aa, Artificial Sequence
  Peptide Derived from Human Papillomavirus
FLDRPATL

SEQ ID NO: 16587 - protein, 9 aa, Artificial Sequence
  Peptide Derived from Human Papillomavirus
FTGSGGFEI

SEQ ID NO: 16588 - protein, 10 aa, Artificial Sequence
  Peptide Derived from Human Papillomavirus
FTTRRGGVRF

SEQ ID NO: 16589 - protein, 9 aa, Artificial Sequence
  Peptide Derived from Human Papillomavirus
FTYFGGLGI

SEQ ID NO: 16590 - protein, 9 aa, Artificial Sequence
  Peptide Derived from Human Papillomavirus
FYSGPDIVL

SEQ ID NO: 16591 - protein, 10 aa, Artificial Sequence
  Peptide Derived from Human Papillomavirus
GFRRIAAPRL

SEQ ID NO: 16592 - protein, 11 aa, Artificial Sequence
  Peptide Derived from Human Papillomavirus
GFRRIAAPRLY

SEQ ID NO: 16593 - protein, 8 aa, Artificial Sequence
  Peptide Derived from Human Papillomavirus
GIHSYEEI

SEQ ID NO: 16594 - protein, 10 aa, Artificial Sequence
  Peptide Derived from Human Papillomavirus
GIHSYEEIPM

SEQ ID NO: 16595 - protein, 11 aa, Artificial Sequence
  Peptide Derived from Human Papillomavirus
GIPNFTGSGGF

SEQ ID NO: 16596 - protein, 9 aa, Artificial Sequence
  Peptide Derived from Human Papillomavirus
GLYDIYANI

SEQ ID NO: 16597 - protein, 11 aa, Artificial Sequence
  Peptide Derived from Human Papillomavirus
GTCPEDVVNKI

SEQ ID NO: 16598 - protein, 8 aa, Artificial Sequence
  Peptide Derived from Human Papillomavirus
GTDTSLAF

SEQ ID NO: 16599 - protein, 10 aa, Artificial Sequence
  Peptide Derived from Human Papillomavirus
GTEPISSTPI

SEQ ID NO: 16600 - protein, 10 aa, Artificial Sequence
  Peptide Derived from Human Papillomavirus
GTGSGGRAGY

SEQ ID NO: 16601 - protein, 10 aa, Artificial Sequence
  Peptide Derived from Human Papillomavirus
GTQIGARVHY

SEQ ID NO: 16602 - protein, 11 aa, Artificial Sequence
  Peptide Derived from Human Papillomavirus
GTQIGARVHYY

SEQ ID NO: 16603 - protein, 8 aa, Artificial Sequence
  Peptide Derived from Human Papillomavirus
GVAPDPDF

SEQ ID NO: 16604 - protein, 9 aa, Artificial Sequence
  Peptide Derived from Human Papillomavirus
GVAPDPDFM

SEQ ID NO: 16605 - protein, 11 aa, Artificial Sequence
  Peptide Derived from Human Papillomavirus
GVAPDPDFMNI

SEQ ID NO: 16606 - protein, 8 aa, Artificial Sequence
  Peptide Derived from Human Papillomavirus
HITNPLFI

SEQ ID NO: 16607 - protein, 9 aa, Artificial Sequence
  Peptide Derived from Human Papillomavirus
HLPIKPSTL

SEQ ID NO: 16608 - protein, 11 aa, Artificial Sequence
  Peptide Derived from Human Papillomavirus
HLPIKPSTLSF

SEQ ID NO: 16609 - protein, 11 aa, Artificial Sequence
  Peptide Derived from Human Papillomavirus
HVSSTHITNPL

SEQ ID NO: 16610 - protein, 9 aa, Artificial Sequence
  Peptide Derived from Human Papillomavirus
HYYYDISPI

SEQ ID NO: 16611 - protein, 10 aa, Artificial Sequence
  Peptide Derived from Human Papillomavirus
ILISTPTSGI

SEQ ID NO: 16612 - protein, 8 aa, Artificial Sequence
  Peptide Derived from Human Papillomavirus
ILQWGSLF

SEQ ID NO: 16613 - protein, 10 aa, Artificial Sequence
  Peptide Derived from Human Papillomavirus
ILQWGSLFTY

SEQ ID NO: 16614 - protein, 11 aa, Artificial Sequence
  Peptide Derived from Human Papillomavirus
ILQWGSLFTYF

SEQ ID NO: 16615 - protein, 9 aa, Artificial Sequence
  Peptide Derived from Human Papillomavirus
IVALHRPAF

SEQ ID NO: 16616 - protein, 11 aa, Artificial Sequence
  Peptide Derived from Human Papillomavirus
IVDVTPARPPI

SEQ ID NO: 16617 - protein, 10 aa, Artificial Sequence
  Peptide Derived from Human Papillomavirus
IVLPTGPSTW

SEQ ID NO: 16618 - protein, 11 aa, Artificial Sequence
  Peptide Derived from Human Papillomavirus
IVTLVEESSVI

SEQ ID NO: 16619 - protein, 11 aa, Artificial Sequence
  Peptide Derived from Human Papillomavirus
KIEQKTWADKI

SEQ ID NO: 16620 - protein, 8 aa, Artificial Sequence
  Peptide Derived from Human Papillomavirus
KILQWGSL

SEQ ID NO: 16621 - protein, 9 aa, Artificial Sequence
  Peptide Derived from Human Papillomavirus
KILQWGSLF

SEQ ID NO: 16622 - protein, 11 aa, Artificial Sequence
  Peptide Derived from Human Papillomavirus
KILQWGSLFTY

SEQ ID NO: 16623 - protein, 8 aa, Artificial Sequence
  Peptide Derived from Human Papillomavirus
KTWADKIL

SEQ ID NO: 16624 - protein, 10 aa, Artificial Sequence
  Peptide Derived from Human Papillomavirus
KTWADKILQW

SEQ ID NO: 16625 - protein, 8 aa, Artificial Sequence
  Peptide Derived from Human Papillomavirus
KVTDPAFL

SEQ ID NO: 16626 - protein, 9 aa, Artificial Sequence
  Peptide Derived from Human Papillomavirus
LFEGTDTSL

SEQ ID NO: 16627 - protein, 11 aa, Artificial Sequence
  Peptide Derived from Human Papillomavirus
LFEGTDTSLAF

SEQ ID NO: 16628 - protein, 8 aa, Artificial Sequence
  Peptide Derived from Human Papillomavirus
LFIDPPVI

SEQ ID NO: 16629 - protein, 8 aa, Artificial Sequence
  Peptide Derived from Human Papillomavirus
LFTYFGGL

SEQ ID NO: 16630 - protein, 10 aa, Artificial Sequence
  Peptide Derived from Human Papillomavirus
LFTYFGGLGI

SEQ ID NO: 16631 - protein, 9 aa, Artificial Sequence
  Peptide Derived from Human Papillomavirus
LISTPTSGI

SEQ ID NO: 16632 - protein, 8 aa, Artificial Sequence
  Peptide Derived from Human Papillomavirus
LLSANNSF

SEQ ID NO: 16633 - protein, 11 aa, Artificial Sequence
  Peptide Derived from Human Papillomavirus
LLSANNSFDGL

SEQ ID NO: 16634 - protein, 8 aa, Artificial Sequence
  Peptide Derived from Human Papillomavirus
LVEESSVI

SEQ ID NO: 16635 - protein, 8 aa, Artificial Sequence
  Peptide Derived from Human Papillomavirus
LVSADNPL

SEQ ID NO: 16636 - protein, 9 aa, Artificial Sequence
  Peptide Derived from Human Papillomavirus
LVSADNPLF

SEQ ID NO: 16637 - protein, 8 aa, Artificial Sequence
  Peptide Derived from Human Papillomavirus
LYDIYANI

SEQ ID NO: 16638 - protein, 8 aa, Artificial Sequence
  Peptide Derived from Human Papillomavirus
NFTGSGGF

SEQ ID NO: 16639 - protein, 10 aa, Artificial Sequence
  Peptide Derived from Human Papillomavirus
NFTGSGGFEI

SEQ ID NO: 16640 - protein, 9 aa, Artificial Sequence
  Peptide Derived from Human Papillomavirus
NIDDEAPGL

SEQ ID NO: 16641 - protein, 11 aa, Artificial Sequence
  Peptide Derived from Human Papillomavirus
NILISTPTSGI

SEQ ID NO: 16642 - protein, 10 aa, Artificial Sequence
  Peptide Derived from Human Papillomavirus
NIVALHRPAF

SEQ ID NO: 16643 - protein, 9 aa, Artificial Sequence
  Peptide Derived from Human Papillomavirus
NTTNVTAPL

SEQ ID NO: 16644 - protein, 10 aa, Artificial Sequence
  Peptide Derived from Human Papillomavirus
NVTAPLGNVW

SEQ ID NO: 16645 - protein, 8 aa, Artificial Sequence
  Peptide Derived from Human Papillomavirus
NVWETPFY

SEQ ID NO: 16646 - protein, 8 aa, Artificial Sequence
  Peptide Derived from Human Papillomavirus
PFVPQSPY

SEQ ID NO: 16647 - protein, 8 aa, Artificial Sequence
  Peptide Derived from Human Papillomavirus
PFYSGPDI

SEQ ID NO: 16648 - protein, 10 aa, Artificial Sequence
  Peptide Derived from Human Papillomavirus
PFYSGPDIVL

SEQ ID NO: 16649 - protein, 8 aa, Artificial Sequence
  Peptide Derived from Human Papillomavirus
PIAQAEEI

SEQ ID NO: 16650 - protein, 10 aa, Artificial Sequence
  Peptide Derived from Human Papillomavirus
PIAQAEEIEM

SEQ ID NO: 16651 - protein, 9 aa, Artificial Sequence
  Peptide Derived from Human Papillomavirus
PIKPSTLSF

SEQ ID NO: 16652 - protein, 8 aa, Artificial Sequence
  Peptide Derived from Human Papillomavirus
PIPGFRRI

SEQ ID NO: 16653 - protein, 10 aa, Artificial Sequence
  Peptide Derived from Human Papillomavirus
PISSTPIPGF

SEQ ID NO: 16654 - protein, 10 aa, Artificial Sequence
  Peptide Derived from Human Papillomavirus
PLFEGTDTSL

SEQ ID NO: 16655 - protein, 9 aa, Artificial Sequence
  Peptide Derived from Human Papillomavirus
PLFIDPPVI

SEQ ID NO: 16656 - protein, 10 aa, Artificial Sequence
  Peptide Derived from Human Papillomavirus
PLGNVWETPF

SEQ ID NO: 16657 - protein, 11 aa, Artificial Sequence
  Peptide Derived from Human Papillomavirus
PLGNVWETPFY

SEQ ID NO: 16658 - protein, 9 aa, Artificial Sequence
  Peptide Derived from Human Papillomavirus
PLGSRPSTI

SEQ ID NO: 16659 - protein, 9 aa, Artificial Sequence
  Peptide Derived from Human Papillomavirus
PLLSANNSF

SEQ ID NO: 16660 - protein, 9 aa, Artificial Sequence
  Peptide Derived from Human Papillomavirus
PTDPSIVTL

SEQ ID NO: 16661 - protein, 9 aa, Artificial Sequence
  Peptide Derived from Human Papillomavirus
PTGPSTWPF

SEQ ID NO: 16662 - protein, 8 aa, Artificial Sequence
  Peptide Derived from Human Papillomavirus
PTSGIHSY

SEQ ID NO: 16663 - protein, 11 aa, Artificial Sequence
  Peptide Derived from Human Papillomavirus
PTSGIHSYEEI

SEQ ID NO: 16664 - protein, 9 aa, Artificial Sequence
  Peptide Derived from Human Papillomavirus
PYDVTHDVY

SEQ ID NO: 16665 - protein, 10 aa, Artificial Sequence
  Peptide Derived from Human Papillomavirus
PYDVTHDVYI

SEQ ID NO: 16666 - protein, 8 aa, Artificial Sequence
  Peptide Derived from Human Papillomavirus
QIGARVHY

SEQ ID NO: 16667 - protein, 9 aa, Artificial Sequence
  Peptide Derived from Human Papillomavirus
QIGARVHYY

SEQ ID NO: 16668 - protein, 10 aa, Artificial Sequence
  Peptide Derived from Human Papillomavirus
QIGARVHYYY

SEQ ID NO: 16669 - protein, 8 aa, Artificial Sequence
  Peptide Derived from Human Papillomavirus
QLYKTCKL

SEQ ID NO: 16670 - protein, 9 aa, Artificial Sequence
  Peptide Derived from Human Papillomavirus
QTGEVSGNI

SEQ ID NO: 16671 - protein, 10 aa, Artificial Sequence
  Peptide Derived from Human Papillomavirus
QTGEVSGNIL

SEQ ID NO: 16672 - protein, 11 aa, Artificial Sequence
  Peptide Derived from Human Papillomavirus
QTGEVSGNILI

SEQ ID NO: 16673 - protein, 8 aa, Artificial Sequence
  Peptide Derived from Human Papillomavirus
QTRRGTQI

SEQ ID NO: 16674 - protein, 9 aa, Artificial Sequence
  Peptide Derived from Human Papillomavirus
QVKVTDPAF

SEQ ID NO: 16675 - protein, 10 aa, Artificial Sequence
  Peptide Derived from Human Papillomavirus
QVKVTDPAFL

SEQ ID NO: 16676 - protein, 8 aa, Artificial Sequence
  Peptide Derived from Human Papillomavirus
QWGSLFTY

SEQ ID NO: 16677 - protein, 9 aa, Artificial Sequence
  Peptide Derived from Human Papillomavirus
QWGSLFTYF

SEQ ID NO: 16678 - protein, 11 aa, Artificial Sequence
  Peptide Derived from Human Papillomavirus
RFSRLGRKATI

SEQ ID NO: 16679 - protein, 8 aa, Artificial Sequence
  Peptide Derived from Human Papillomavirus
RIAAPRLY

SEQ ID NO: 16680 - protein, 8 aa, Artificial Sequence
  Peptide Derived from Human Papillomavirus
RLGRKATI

SEQ ID NO: 16681 - protein, 8 aa, Artificial Sequence
  Peptide Derived from Human Papillomavirus
RVHYYYDI

SEQ ID NO: 16682 - protein, 11 aa, Artificial Sequence
  Peptide Derived from Human Papillomavirus
RVHYYYDISPI

SEQ ID NO: 16683 - protein, 8 aa, Artificial Sequence
  Peptide Derived from Human Papillomavirus
SFALWPVY

SEQ ID NO: 16684 - protein, 9 aa, Artificial Sequence
  Peptide Derived from Human Papillomavirus
SFALWPVYF

SEQ ID NO: 16685 - protein, 10 aa, Artificial Sequence
  Peptide Derived from Human Papillomavirus
SFALWPVYFF

SEQ ID NO: 16686 - protein, 8 aa, Artificial Sequence
  Peptide Derived from Human Papillomavirus
SFDGLYDI

SEQ ID NO: 16687 - protein, 9 aa, Artificial Sequence
  Peptide Derived from Human Papillomavirus
SFDGLYDIY

SEQ ID NO: 16688 - protein, 9 aa, Artificial Sequence
  Peptide Derived from Human Papillomavirus
SLFTYFGGL

SEQ ID NO: 16689 - protein, 11 aa, Artificial Sequence
  Peptide Derived from Human Papillomavirus
SLFTYFGGLGI

SEQ ID NO: 16690 - protein, 8 aa, Artificial Sequence
  Peptide Derived from Human Papillomavirus
STHITNPL

SEQ ID NO: 16691 - protein, 9 aa, Artificial Sequence
  Peptide Derived from Human Papillomavirus
STHITNPLF

SEQ ID NO: 16692 - protein, 10 aa, Artificial Sequence
  Peptide Derived from Human Papillomavirus
STHITNPLFI

SEQ ID NO: 16693 - protein, 10 aa, Artificial Sequence
  Peptide Derived from Human Papillomavirus
STPIPGFRRI

SEQ ID NO: 16694 - protein, 10 aa, Artificial Sequence
  Peptide Derived from Human Papillomavirus
STPTSGIHSY

SEQ ID NO: 16695 - protein, 8 aa, Artificial Sequence
  Peptide Derived from Human Papillomavirus
STTTPAVL

SEQ ID NO: 16696 - protein, 10 aa, Artificial Sequence
  Peptide Derived from Human Papillomavirus
STTTPAVLDI

SEQ ID NO: 16697 - protein, 10 aa, Artificial Sequence
  Peptide Derived from Human Papillomavirus
STVHVSSTHI

SEQ ID NO: 16698 - protein, 11 aa, Artificial Sequence
  Peptide Derived from Human Papillomavirus
STWPFVPQSPY

SEQ ID NO: 16699 - protein, 9 aa, Artificial Sequence
  Peptide Derived from Human Papillomavirus
SVATPSAHL

SEQ ID NO: 16700 - protein, 11 aa, Artificial Sequence
  Peptide Derived from Human Papillomavirus
SVATPSAHLPI

SEQ ID NO: 16701 - protein, 9 aa, Artificial Sequence
  Peptide Derived from Human Papillomavirus
SVGPTDPSI

SEQ ID NO: 16702 - protein, 9 aa, Artificial Sequence
  Peptide Derived from Human Papillomavirus
SVIESGAGI

SEQ ID NO: 16703 - protein, 10 aa, Artificial Sequence
  Peptide Derived from Human Papillomavirus
SYEEIPMQTF

SEQ ID NO: 16704 - protein, 10 aa, Artificial Sequence
  Peptide Derived from Human Papillomavirus
TIQTRRGTQI

SEQ ID NO: 16705 - protein, 9 aa, Artificial Sequence
  Peptide Derived from Human Papillomavirus
TLVEESSVI

SEQ ID NO: 16706 - protein, 9 aa, Artificial Sequence
  Peptide Derived from Human Papillomavirus
TLVSADNPL

SEQ ID NO: 16707 - protein, 10 aa, Artificial Sequence
  Peptide Derived from Human Papillomavirus
TLVSADNPLF

SEQ ID NO: 16708 - protein, 8 aa, Artificial Sequence
  Peptide Derived from Human Papillomavirus
TTNVTAPL

SEQ ID NO: 16709 - protein, 8 aa, Artificial Sequence
  Peptide Derived from Human Papillomavirus
TTPAVLDI

SEQ ID NO: 16710 - protein, 9 aa, Artificial Sequence
  Peptide Derived from Human Papillomavirus
TTRRGGVRF

SEQ ID NO: 16711 - protein, 9 aa, Artificial Sequence
  Peptide Derived from Human Papillomavirus
TTTPAVLDI

SEQ ID NO: 16712 - protein, 9 aa, Artificial Sequence
  Peptide Derived from Human Papillomavirus
TVHVSSTHI

SEQ ID NO: 16713 - protein, 9 aa, Artificial Sequence
  Peptide Derived from Human Papillomavirus
TWADKILQW

SEQ ID NO: 16714 - protein, 10 aa, Artificial Sequence
  Peptide Derived from Human Papillomavirus
TWPFVPQSPY

SEQ ID NO: 16715 - protein, 8 aa, Artificial Sequence
  Peptide Derived from Human Papillomavirus
TYFGGLGI

SEQ ID NO: 16716 - protein, 8 aa, Artificial Sequence
  Peptide Derived from Human Papillomavirus
VIESGAGI

SEQ ID NO: 16717 - protein, 11 aa, Artificial Sequence
  Peptide Derived from Human Papillomavirus
VIESGAGIPNF

SEQ ID NO: 16718 - protein, 9 aa, Artificial Sequence
  Peptide Derived from Human Papillomavirus
VLPTGPSTW

SEQ ID NO: 16719 - protein, 11 aa, Artificial Sequence
  Peptide Derived from Human Papillomavirus
VLPTGPSTWPF

SEQ ID NO: 16720 - protein, 9 aa, Artificial Sequence
  Peptide Derived from Human Papillomavirus
VTAPLGNVW

SEQ ID NO: 16721 - protein, 10 aa, Artificial Sequence
  Peptide Derived from Human Papillomavirus
VTLVEESSVI

SEQ ID NO: 16722 - protein, 8 aa, Artificial Sequence
  Peptide Derived from Human Papillomavirus
VTPARPPI

SEQ ID NO: 16723 - protein, 10 aa, Artificial Sequence
  Peptide Derived from Human Papillomavirus
VVNKIEQKTW

SEQ ID NO: 16724 - protein, 8 aa, Artificial Sequence
  Peptide Derived from Human Papillomavirus
VYIQGSSF

SEQ ID NO: 16725 - protein, 10 aa, Artificial Sequence
  Peptide Derived from Human Papillomavirus
VYIQGSSFAL

SEQ ID NO: 16726 - protein, 11 aa, Artificial Sequence
  Peptide Derived from Human Papillomavirus
VYIQGSSFALW

SEQ ID NO: 16727 - protein, 11 aa, Artificial Sequence
  Peptide Derived from Human Papillomavirus
YFFRRRRRKRI

SEQ ID NO: 16728 - protein, 9 aa, Artificial Sequence
  Peptide Derived from Human Papillomavirus
YIQGSSFAL

SEQ ID NO: 16729 - protein, 10 aa, Artificial Sequence
  Peptide Derived from Human Papillomavirus
YIQGSSFALW

SEQ ID NO: 16730 - protein, 11 aa, Artificial Sequence
  Peptide Derived from Human Papillomavirus
YVPLGSRPSTI

SEQ ID NO: 16731 - protein, 8 aa, Artificial Sequence
  Peptide Derived from Human Papillomavirus
YYYDISPI

SEQ ID NO: 16732 - protein, 10 aa, Artificial Sequence
  Peptide Derived from Human Papillomavirus
CPPLLITSNI

SEQ ID NO: 16733 - protein, 9 aa, Artificial Sequence
  Peptide Derived from Human Papillomavirus
EPPKLRSTA

SEQ ID NO: 16734 - protein, 10 aa, Artificial Sequence
  Peptide Derived from Human Papillomavirus
EPPKLRSTAA

SEQ ID NO: 16735 - protein, 11 aa, Artificial Sequence
  Peptide Derived from Human Papillomavirus
EPPKLRSTAAA

SEQ ID NO: 16736 - protein, 10 aa, Artificial Sequence
  Peptide Derived from Human Papillomavirus
FPFDENGNPV

SEQ ID NO: 16737 - protein, 11 aa, Artificial Sequence
  Peptide Derived from Human Papillomavirus
FPFDENGNPVY

SEQ ID NO: 16738 - protein, 8 aa, Artificial Sequence
  Peptide Derived from Human Papillomavirus
IPKKNCIL

SEQ ID NO: 16739 - protein, 9 aa, Artificial Sequence
  Peptide Derived from Human Papillomavirus
IPKKNCILL

SEQ ID NO: 16740 - protein, 10 aa, Artificial Sequence
  Peptide Derived from Human Papillomavirus
IPKKNCILLY

SEQ ID NO: 16741 - protein, 11 aa, Artificial Sequence
  Peptide Derived from Human Papillomavirus
NPVYELNDKNW

SEQ ID NO: 16742 - protein, 8 aa, Artificial Sequence
  Peptide Derived from Human Papillomavirus
PPKLRSTA

SEQ ID NO: 16743 - protein, 9 aa, Artificial Sequence
  Peptide Derived from Human Papillomavirus
PPKLRSTAA

SEQ ID NO: 16744 - protein, 10 aa, Artificial Sequence
  Peptide Derived from Human Papillomavirus
PPKLRSTAAA

SEQ ID NO: 16745 - protein, 11 aa, Artificial Sequence
  Peptide Derived from Human Papillomavirus
PPKLRSTAAAL

SEQ ID NO: 16746 - protein, 9 aa, Artificial Sequence
  Peptide Derived from Human Papillomavirus
PPLLITSNI

SEQ ID NO: 16747 - protein, 11 aa, Artificial Sequence
  Peptide Derived from Human Papillomavirus
PPLLITSNINA

SEQ ID NO: 16748 - protein, 8 aa, Artificial Sequence
  Peptide Derived from Human Papillomavirus
QPLADAKI

SEQ ID NO: 16749 - protein, 10 aa, Artificial Sequence
  Peptide Derived from Human Papillomavirus
QPLADAKIGM

SEQ ID NO: 16750 - protein, 11 aa, Artificial Sequence
  Peptide Derived from Human Papillomavirus
QPLADAKIGML

SEQ ID NO: 16751 - protein, 11 aa, Artificial Sequence
  Peptide Derived from Human Papillomavirus
RPLVQLKCPPL

SEQ ID NO: 16752 - protein, 10 aa, Artificial Sequence
  Peptide Derived from Human Papillomavirus
SPLSDISGCV

SEQ ID NO: 16753 - protein, 9 aa, Artificial Sequence
  Peptide Derived from Human Papillomavirus
SPRLKAICI

SEQ ID NO: 16754 - protein, 10 aa, Artificial Sequence
  Peptide Derived from Human Papillomavirus
TPEWIQRQTV

SEQ ID NO: 16755 - protein, 11 aa, Artificial Sequence
  Peptide Derived from Human Papillomavirus
TPEWIQRQTVL

SEQ ID NO: 16756 - protein, 9 aa, Artificial Sequence
  Peptide Derived from Human Papillomavirus
TPLTNILNV

SEQ ID NO: 16757 - protein, 10 aa, Artificial Sequence
  Peptide Derived from Human Papillomavirus
TPLTNILNVL

SEQ ID NO: 16758 - protein, 8 aa, Artificial Sequence
  Peptide Derived from Human Papillomavirus
TPSIADSI

SEQ ID NO: 16759 - protein, 11 aa, Artificial Sequence
  Peptide Derived from Human Papillomavirus
TPSIADSIKTL

SEQ ID NO: 16760 - protein, 11 aa, Artificial Sequence
  Peptide Derived from Human Papillomavirus
VPCWNYIDDNL

SEQ ID NO: 16761 - protein, 8 aa, Artificial Sequence
  Peptide Derived from Human Papillomavirus
WPYLHNRL

SEQ ID NO: 16762 - protein, 9 aa, Artificial Sequence
  Peptide Derived from Human Papillomavirus
WPYLHNRLV

SEQ ID NO: 16763 - protein, 10 aa, Artificial Sequence
  Peptide Derived from Human Papillomavirus
WPYLHNRLVV

SEQ ID NO: 16764 - protein, 11 aa, Artificial Sequence
  Peptide Derived from Human Papillomavirus
WPYLHNRLVVF

SEQ ID NO: 16765 - protein, 11 aa, Artificial Sequence
  Peptide Derived from Human Papillomavirus
APTGCIKKHGY

SEQ ID NO: 16766 - protein, 11 aa, Artificial Sequence
  Peptide Derived from Human Papillomavirus
CPTSVFSSNEV

SEQ ID NO: 16767 - protein, 9 aa, Artificial Sequence
  Peptide Derived from Human Papillomavirus
HPAATHTKA

SEQ ID NO: 16768 - protein, 10 aa, Artificial Sequence
  Peptide Derived from Human Papillomavirus
HPAATHTKAV

SEQ ID NO: 16769 - protein, 11 aa, Artificial Sequence
  Peptide Derived from Human Papillomavirus
HPAATHTKAVA

SEQ ID NO: 16770 - protein, 11 aa, Artificial Sequence
  Peptide Derived from Human Papillomavirus
IPKTITVSTGF

SEQ ID NO: 16771 - protein, 8 aa, Artificial Sequence
  Peptide Derived from Human Papillomavirus
NPCHTTKL

SEQ ID NO: 16772 - protein, 9 aa, Artificial Sequence
  Peptide Derived from Human Papillomavirus
NPCHTTKLL

SEQ ID NO: 16773 - protein, 9 aa, Artificial Sequence
  Peptide Derived from Human Papillomavirus
SPEIIRQHL

SEQ ID NO: 16774 - protein, 10 aa, Artificial Sequence
  Peptide Derived from Human Papillomavirus
SPEIIRQHLA

SEQ ID NO: 16775 - protein, 10 aa, Artificial Sequence
  Peptide Derived from Human Papillomavirus
TPIVHLKGDA

SEQ ID NO: 16776 - protein, 11 aa, Artificial Sequence
  Peptide Derived from Human Papillomavirus
VPTLAVSKNKA

SEQ ID NO: 16777 - protein, 10 aa, Artificial Sequence
  Peptide Derived from Human Papillomavirus
IPLFLIHTHA

SEQ ID NO: 16778 - protein, 10 aa, Artificial Sequence
  Peptide Derived from Human Papillomavirus
RPLLLSVSTY

SEQ ID NO: 16779 - protein, 9 aa, Artificial Sequence
  Peptide Derived from Human Papillomavirus
CPEEKQRHL

SEQ ID NO: 16780 - protein, 9 aa, Artificial Sequence
  Peptide Derived from Human Papillomavirus
DPQERPRKL

SEQ ID NO: 16781 - protein, 8 aa, Artificial Sequence
  Peptide Derived from Human Papillomavirus
KPLCDLLI

SEQ ID NO: 16782 - protein, 11 aa, Artificial Sequence
  Peptide Derived from Human Papillomavirus
KPLCDLLIRCI

SEQ ID NO: 16783 - protein, 8 aa, Artificial Sequence
  Peptide Derived from Human Papillomavirus
LPQLCTEL

SEQ ID NO: 16784 - protein, 10 aa, Artificial Sequence
  Peptide Derived from Human Papillomavirus
NPYAVCDKCL

SEQ ID NO: 16785 - protein, 8 aa, Artificial Sequence
  Peptide Derived from Human Papillomavirus
RPRKLPQL

SEQ ID NO: 16786 - protein, 9 aa, Artificial Sequence
  Peptide Derived from Human Papillomavirus
EPDRAHYNI

SEQ ID NO: 16787 - protein, 10 aa, Artificial Sequence
  Peptide Derived from Human Papillomavirus
EPDRAHYNIV

SEQ ID NO: 16788 - protein, 11 aa, Artificial Sequence
  Peptide Derived from Human Papillomavirus
GPAGQAEPDRA

SEQ ID NO: 16789 - protein, 8 aa, Artificial Sequence
  Peptide Derived from Human Papillomavirus
QPETTDLY

SEQ ID NO: 16790 - protein, 10 aa, Artificial Sequence
  Peptide Derived from Human Papillomavirus
QPETTDLYCY

SEQ ID NO: 16791 - protein, 8 aa, Artificial Sequence
  Peptide Derived from Human Papillomavirus
TPTLHEYM

SEQ ID NO: 16792 - protein, 9 aa, Artificial Sequence
  Peptide Derived from Human Papillomavirus
TPTLHEYML

SEQ ID NO: 16793 - protein, 11 aa, Artificial Sequence
  Peptide Derived from Human Papillomavirus
TPTLHEYMLDL

SEQ ID NO: 16794 - protein, 10 aa, Artificial Sequence
  Peptide Derived from Human Papillomavirus
APKEDPLKKY

SEQ ID NO: 16795 - protein, 10 aa, Artificial Sequence
  Peptide Derived from Human Papillomavirus
CPPLELINTV

SEQ ID NO: 16796 - protein, 11 aa, Artificial Sequence
  Peptide Derived from Human Papillomavirus
CPPLELINTVI

SEQ ID NO: 16797 - protein, 8 aa, Artificial Sequence
  Peptide Derived from Human Papillomavirus
DPLKKYTF

SEQ ID NO: 16798 - protein, 9 aa, Artificial Sequence
  Peptide Derived from Human Papillomavirus
DPLKKYTFW

SEQ ID NO: 16799 - protein, 11 aa, Artificial Sequence
  Peptide Derived from Human Papillomavirus
DPLKKYTFWEV

SEQ ID NO: 16800 - protein, 8 aa, Artificial Sequence
  Peptide Derived from Human Papillomavirus
EPYGDSLF

SEQ ID NO: 16801 - protein, 9 aa, Artificial Sequence
  Peptide Derived from Human Papillomavirus
EPYGDSLFF

SEQ ID NO: 16802 - protein, 10 aa, Artificial Sequence
  Peptide Derived from Human Papillomavirus
EPYGDSLFFY

SEQ ID NO: 16803 - protein, 11 aa, Artificial Sequence
  Peptide Derived from Human Papillomavirus
EPYGDSLFFYL

SEQ ID NO: 16804 - protein, 11 aa, Artificial Sequence
  Peptide Derived from Human Papillomavirus
FPIKKPNNNKI

SEQ ID NO: 16805 - protein, 8 aa, Artificial Sequence
  Peptide Derived from Human Papillomavirus
FPLGRKFL

SEQ ID NO: 16806 - protein, 9 aa, Artificial Sequence
  Peptide Derived from Human Papillomavirus
FPLGRKFLL

SEQ ID NO: 16807 - protein, 11 aa, Artificial Sequence
  Peptide Derived from Human Papillomavirus
FPLGRKFLLQA

SEQ ID NO: 16808 - protein, 8 aa, Artificial Sequence
  Peptide Derived from Human Papillomavirus
FPTPSGSM

SEQ ID NO: 16809 - protein, 9 aa, Artificial Sequence
  Peptide Derived from Human Papillomavirus
FPTPSGSMV

SEQ ID NO: 16810 - protein, 11 aa, Artificial Sequence
  Peptide Derived from Human Papillomavirus
KPKFTLGKRKA

SEQ ID NO: 16811 - protein, 8 aa, Artificial Sequence
  Peptide Derived from Human Papillomavirus
KPNNNKIL

SEQ ID NO: 16812 - protein, 9 aa, Artificial Sequence
  Peptide Derived from Human Papillomavirus
KPNNNKILV

SEQ ID NO: 16813 - protein, 8 aa, Artificial Sequence
  Peptide Derived from Human Papillomavirus
KPPIGEHW

SEQ ID NO: 16814 - protein, 8 aa, Artificial Sequence
  Peptide Derived from Human Papillomavirus
KPYWLQRA

SEQ ID NO: 16815 - protein, 9 aa, Artificial Sequence
  Peptide Derived from Human Papillomavirus
LPDPNKFGF

SEQ ID NO: 16816 - protein, 9 aa, Artificial Sequence
  Peptide Derived from Human Papillomavirus
LPPVPVSKV

SEQ ID NO: 16817 - protein, 10 aa, Artificial Sequence
  Peptide Derived from Human Papillomavirus
LPPVPVSKVV

SEQ ID NO: 16818 - protein, 8 aa, Artificial Sequence
  Peptide Derived from Human Papillomavirus
LPSEATVY

SEQ ID NO: 16819 - protein, 9 aa, Artificial Sequence
  Peptide Derived from Human Papillomavirus
LPSEATVYL

SEQ ID NO: 16820 - protein, 8 aa, Artificial Sequence
  Peptide Derived from Human Papillomavirus
NPDTQRLV

SEQ ID NO: 16821 - protein, 9 aa, Artificial Sequence
  Peptide Derived from Human Papillomavirus
NPDTQRLVW

SEQ ID NO: 16822 - protein, 10 aa, Artificial Sequence
  Peptide Derived from Human Papillomavirus
NPDTQRLVWA

SEQ ID NO: 16823 - protein, 8 aa, Artificial Sequence
  Peptide Derived from Human Papillomavirus
NPGDCPPL

SEQ ID NO: 16824 - protein, 10 aa, Artificial Sequence
  Peptide Derived from Human Papillomavirus
NPGDCPPLEL

SEQ ID NO: 16825 - protein, 11 aa, Artificial Sequence
  Peptide Derived from Human Papillomavirus
NPGDCPPLELI

SEQ ID NO: 16826 - protein, 9 aa, Artificial Sequence
  Peptide Derived from Human Papillomavirus
PPAPKEDPL

SEQ ID NO: 16827 - protein, 10 aa, Artificial Sequence
  Peptide Derived from Human Papillomavirus
PPGGTLEDTY

SEQ ID NO: 16828 - protein, 9 aa, Artificial Sequence
  Peptide Derived from Human Papillomavirus
PPLELINTV

SEQ ID NO: 16829 - protein, 10 aa, Artificial Sequence
  Peptide Derived from Human Papillomavirus
PPLELINTVI

SEQ ID NO: 16830 - protein, 11 aa, Artificial Sequence
  Peptide Derived from Human Papillomavirus
PPPGGTLEDTY

SEQ ID NO: 16831 - protein, 8 aa, Artificial Sequence
  Peptide Derived from Human Papillomavirus
PPVPVSKV

SEQ ID NO: 16832 - protein, 9 aa, Artificial Sequence
  Peptide Derived from Human Papillomavirus
PPVPVSKVV

SEQ ID NO: 16833 - protein, 8 aa, Artificial Sequence
  Peptide Derived from Human Papillomavirus
QPPPGGTL

SEQ ID NO: 16834 - protein, 8 aa, Artificial Sequence
  Peptide Derived from Human Papillomavirus
SPCTNVAV

SEQ ID NO: 16835 - protein, 10 aa, Artificial Sequence
  Peptide Derived from Human Papillomavirus
TPPAPKEDPL

SEQ ID NO: 16836 - protein, 11 aa, Artificial Sequence
  Peptide Derived from Human Papillomavirus
TPSGSMVTSDA

SEQ ID NO: 16837 - protein, 11 aa, Artificial Sequence
  Peptide Derived from Human Papillomavirus
TPTTSSTSTTA

SEQ ID NO: 16838 - protein, 9 aa, Artificial Sequence
  Peptide Derived from Human Papillomavirus
VPKVSGLQY

SEQ ID NO: 16839 - protein, 11 aa, Artificial Sequence
  Peptide Derived from Human Papillomavirus
VPKVSGLQYRV

SEQ ID NO: 16840 - protein, 9 aa, Artificial Sequence
  Peptide Derived from Human Papillomavirus
VPLDICTSI

SEQ ID NO: 16841 - protein, 8 aa, Artificial Sequence
  Peptide Derived from Human Papillomavirus
YPDYIKMV

SEQ ID NO: 16842 - protein, 9 aa, Artificial Sequence
  Peptide Derived from Human Papillomavirus
APDPDFLDI

SEQ ID NO: 16843 - protein, 10 aa, Artificial Sequence
  Peptide Derived from Human Papillomavirus
APDPDFLDIV

SEQ ID NO: 16844 - protein, 11 aa, Artificial Sequence
  Peptide Derived from Human Papillomavirus
APDPDFLDIVA

SEQ ID NO: 16845 - protein, 8 aa, Artificial Sequence
  Peptide Derived from Human Papillomavirus
APSLIPIV

SEQ ID NO: 16846 - protein, 8 aa, Artificial Sequence
  Peptide Derived from Human Papillomavirus
APTSVPSI

SEQ ID NO: 16847 - protein, 9 aa, Artificial Sequence
  Peptide Derived from Human Papillomavirus
APVRPPLTV

SEQ ID NO: 16848 - protein, 9 aa, Artificial Sequence
  Peptide Derived from Human Papillomavirus
CPPDIIPKV

SEQ ID NO: 16849 - protein, 11 aa, Artificial Sequence
  Peptide Derived from Human Papillomavirus
DPAFITTPTKL

SEQ ID NO: 16850 - protein, 8 aa, Artificial Sequence
  Peptide Derived from Human Papillomavirus
DPDFLDIV

SEQ ID NO: 16851 - protein, 9 aa, Artificial Sequence
  Peptide Derived from Human Papillomavirus
DPDFLDIVA

SEQ ID NO: 16852 - protein, 10 aa, Artificial Sequence
  Peptide Derived from Human Papillomavirus
DPDFLDIVAL

SEQ ID NO: 16853 - protein, 8 aa, Artificial Sequence
  Peptide Derived from Human Papillomavirus
DPSIVSLV

SEQ ID NO: 16854 - protein, 11 aa, Artificial Sequence
  Peptide Derived from Human Papillomavirus
DPSVLQPPTPA

SEQ ID NO: 16855 - protein, 10 aa, Artificial Sequence
  Peptide Derived from Human Papillomavirus
DPVGPSDPSI

SEQ ID NO: 16856 - protein, 11 aa, Artificial Sequence
  Peptide Derived from Human Papillomavirus
DPVGPSDPSIV

SEQ ID NO: 16857 - protein, 8 aa, Artificial Sequence
  Peptide Derived from Human Papillomavirus
GPDIPINI

SEQ ID NO: 16858 - protein, 8 aa, Artificial Sequence
  Peptide Derived from Human Papillomavirus
GPSDPSIV

SEQ ID NO: 16859 - protein, 10 aa, Artificial Sequence
  Peptide Derived from Human Papillomavirus
GPSDPSIVSL

SEQ ID NO: 16860 - protein, 11 aa, Artificial Sequence
  Peptide Derived from Human Papillomavirus
GPSDPSIVSLV

SEQ ID NO: 16861 - protein, 9 aa, Artificial Sequence
  Peptide Derived from Human Papillomavirus
IPANTTIPF

SEQ ID NO: 16862 - protein, 9 aa, Artificial Sequence
  Peptide Derived from Human Papillomavirus
IPFGGAYNI

SEQ ID NO: 16863 - protein, 11 aa, Artificial Sequence
  Peptide Derived from Human Papillomavirus
IPFGGAYNIPL

SEQ ID NO: 16864 - protein, 8 aa, Artificial Sequence
  Peptide Derived from Human Papillomavirus
IPGSRPVA

SEQ ID NO: 16865 - protein, 10 aa, Artificial Sequence
  Peptide Derived from Human Papillomavirus
IPGSRPVARL

SEQ ID NO: 16866 - protein, 9 aa, Artificial Sequence
  Peptide Derived from Human Papillomavirus
IPINITDQA

SEQ ID NO: 16867 - protein, 10 aa, Artificial Sequence
  Peptide Derived from Human Papillomavirus
IPIVPGSPQY

SEQ ID NO: 16868 - protein, 9 aa, Artificial Sequence
  Peptide Derived from Human Papillomavirus
IPKVEGKTI

SEQ ID NO: 16869 - protein, 10 aa, Artificial Sequence
  Peptide Derived from Human Papillomavirus
IPKVEGKTIA

SEQ ID NO: 16870 - protein, 10 aa, Artificial Sequence
  Peptide Derived from Human Papillomavirus
IPLGTRPPTA

SEQ ID NO: 16871 - protein, 9 aa, Artificial Sequence
  Peptide Derived from Human Papillomavirus
IPLVSGPDI

SEQ ID NO: 16872 - protein, 11 aa, Artificial Sequence
  Peptide Derived from Human Papillomavirus
IPLVSGPDIPI

SEQ ID NO: 16873 - protein, 8 aa, Artificial Sequence
  Peptide Derived from Human Papillomavirus
IPMDTFIV

SEQ ID NO: 16874 - protein, 8 aa, Artificial Sequence
  Peptide Derived from Human Papillomavirus
IPPDVSGF

SEQ ID NO: 16875 - protein, 10 aa, Artificial Sequence
  Peptide Derived from Human Papillomavirus
IPPDVSGFSI

SEQ ID NO: 16876 - protein, 9 aa, Artificial Sequence
  Peptide Derived from Human Papillomavirus
LPTSINNGL

SEQ ID NO: 16877 - protein, 10 aa, Artificial Sequence
  Peptide Derived from Human Papillomavirus
LPTSINNGLY

SEQ ID NO: 16878 - protein, 8 aa, Artificial Sequence
  Peptide Derived from Human Papillomavirus
LPYFFSDV

SEQ ID NO: 16879 - protein, 10 aa, Artificial Sequence
  Peptide Derived from Human Papillomavirus
LPYFFSDVSL

SEQ ID NO: 16880 - protein, 11 aa, Artificial Sequence
  Peptide Derived from Human Papillomavirus
LPYFFSDVSLA

SEQ ID NO: 16881 - protein, 9 aa, Artificial Sequence
  Peptide Derived from Human Papillomavirus
NPAYEGIDV

SEQ ID NO: 16882 - protein, 11 aa, Artificial Sequence
  Peptide Derived from Human Papillomavirus
NPNTVTSSTPI

SEQ ID NO: 16883 - protein, 9 aa, Artificial Sequence
  Peptide Derived from Human Papillomavirus
NPTFTDPSV

SEQ ID NO: 16884 - protein, 10 aa, Artificial Sequence
  Peptide Derived from Human Papillomavirus
NPTFTDPSVL

SEQ ID NO: 16885 - protein, 8 aa, Artificial Sequence
  Peptide Derived from Human Papillomavirus
PPDIIPKV

SEQ ID NO: 16886 - protein, 9 aa, Artificial Sequence
  Peptide Derived from Human Papillomavirus
PPDVSGFSI

SEQ ID NO: 16887 - protein, 8 aa, Artificial Sequence
  Peptide Derived from Human Papillomavirus
PPLTVDPV

SEQ ID NO: 16888 - protein, 8 aa, Artificial Sequence
  Peptide Derived from Human Papillomavirus
PPTATDTL

SEQ ID NO: 16889 - protein, 9 aa, Artificial Sequence
  Peptide Derived from Human Papillomavirus
PPTATDTLA

SEQ ID NO: 16890 - protein, 11 aa, Artificial Sequence
  Peptide Derived from Human Papillomavirus
PPTATDTLAPV

SEQ ID NO: 16891 - protein, 11 aa, Artificial Sequence
  Peptide Derived from Human Papillomavirus
PPTPAETGGHF

SEQ ID NO: 16892 - protein, 11 aa, Artificial Sequence
  Peptide Derived from Human Papillomavirus
RPALTSRRTGI

SEQ ID NO: 16893 - protein, 9 aa, Artificial Sequence
  Peptide Derived from Human Papillomavirus
RPPLTVDPV

SEQ ID NO: 16894 - protein, 9 aa, Artificial Sequence
  Peptide Derived from Human Papillomavirus
RPPTATDTL

SEQ ID NO: 16895 - protein, 10 aa, Artificial Sequence
  Peptide Derived from Human Papillomavirus
RPPTATDTLA

SEQ ID NO: 16896 - protein, 8 aa, Artificial Sequence
  Peptide Derived from Human Papillomavirus
RPVARLGL

SEQ ID NO: 16897 - protein, 9 aa, Artificial Sequence
  Peptide Derived from Human Papillomavirus
RPVARLGLY

SEQ ID NO: 16898 - protein, 8 aa, Artificial Sequence
  Peptide Derived from Human Papillomavirus
SPQYTIIA

SEQ ID NO: 16899 - protein, 10 aa, Artificial Sequence
  Peptide Derived from Human Papillomavirus
SPQYTIIADA

SEQ ID NO: 16900 - protein, 9 aa, Artificial Sequence
  Peptide Derived from Human Papillomavirus
TPAETGGHF

SEQ ID NO: 16901 - protein, 11 aa, Artificial Sequence
  Peptide Derived from Human Papillomavirus
TPAETGGHFTL

SEQ ID NO: 16902 - protein, 11 aa, Artificial Sequence
  Peptide Derived from Human Papillomavirus
TPAILDINNTV

SEQ ID NO: 16903 - protein, 9 aa, Artificial Sequence
  Peptide Derived from Human Papillomavirus
TPIPGSRPV

SEQ ID NO: 16904 - protein, 10 aa, Artificial Sequence
  Peptide Derived from Human Papillomavirus
TPIPGSRPVA

SEQ ID NO: 16905 - protein, 11 aa, Artificial Sequence
  Peptide Derived from Human Papillomavirus
TPSTYTTTSHA

SEQ ID NO: 16906 - protein, 8 aa, Artificial Sequence
  Peptide Derived from Human Papillomavirus
TPTKLITY

SEQ ID NO: 16907 - protein, 11 aa, Artificial Sequence
  Peptide Derived from Human Papillomavirus
TPVPSVPSTSL

SEQ ID NO: 16908 - protein, 9 aa, Artificial Sequence
  Peptide Derived from Human Papillomavirus
VPGSPQYTI

SEQ ID NO: 16909 - protein, 10 aa, Artificial Sequence
  Peptide Derived from Human Papillomavirus
VPGSPQYTII

SEQ ID NO: 16910 - protein, 11 aa, Artificial Sequence
  Peptide Derived from Human Papillomavirus
VPGSPQYTIIA

SEQ ID NO: 16911 - protein, 8 aa, Artificial Sequence
  Peptide Derived from Human Papillomavirus
VPSIPPDV

SEQ ID NO: 16912 - protein, 11 aa, Artificial Sequence
  Peptide Derived from Human Papillomavirus
VPSIPPDVSGF

SEQ ID NO: 16913 - protein, 9 aa, Artificial Sequence
  Peptide Derived from Human Papillomavirus
VPSTSLSGY

SEQ ID NO: 16914 - protein, 10 aa, Artificial Sequence
  Peptide Derived from Human Papillomavirus
VPSTSLSGYI

SEQ ID NO: 16915 - protein, 9 aa, Artificial Sequence
  Peptide Derived from Human Papillomavirus
VPSVPSTSL

SEQ ID NO: 16916 - protein, 10 aa, Artificial Sequence
  Peptide Derived from Human Papillomavirus
CPPILLTTNI

SEQ ID NO: 16917 - protein, 8 aa, Artificial Sequence
  Peptide Derived from Human Papillomavirus
EPLTDTKV

SEQ ID NO: 16918 - protein, 9 aa, Artificial Sequence
  Peptide Derived from Human Papillomavirus
EPLTDTKVA

SEQ ID NO: 16919 - protein, 10 aa, Artificial Sequence
  Peptide Derived from Human Papillomavirus
EPLTDTKVAM

SEQ ID NO: 16920 - protein, 11 aa, Artificial Sequence
  Peptide Derived from Human Papillomavirus
EPLTDTKVAML

SEQ ID NO: 16921 - protein, 10 aa, Artificial Sequence
  Peptide Derived from Human Papillomavirus
FPFDKNGNPV

SEQ ID NO: 16922 - protein, 11 aa, Artificial Sequence
  Peptide Derived from Human Papillomavirus
FPFDKNGNPVY

SEQ ID NO: 16923 - protein, 9 aa, Artificial Sequence
  Peptide Derived from Human Papillomavirus
GPANTGKSY

SEQ ID NO: 16924 - protein, 10 aa, Artificial Sequence
  Peptide Derived from Human Papillomavirus
GPANTGKSYF

SEQ ID NO: 16925 - protein, 8 aa, Artificial Sequence
  Peptide Derived from Human Papillomavirus
HPAKDNRW

SEQ ID NO: 16926 - protein, 10 aa, Artificial Sequence
  Peptide Derived from Human Papillomavirus
HPAKDNRWPY

SEQ ID NO: 16927 - protein, 11 aa, Artificial Sequence
  Peptide Derived from Human Papillomavirus
HPAKDNRWPYL

SEQ ID NO: 16928 - protein, 11 aa, Artificial Sequence
  Peptide Derived from Human Papillomavirus
KPLIQLKCPPI

SEQ ID NO: 16929 - protein, 8 aa, Artificial Sequence
  Peptide Derived from Human Papillomavirus
NPFGTFKL

SEQ ID NO: 16930 - protein, 10 aa, Artificial Sequence
  Peptide Derived from Human Papillomavirus
NPFGTFKLRA

SEQ ID NO: 16931 - protein, 9 aa, Artificial Sequence
  Peptide Derived from Human Papillomavirus
NPQCTIAQL

SEQ ID NO: 16932 - protein, 8 aa, Artificial Sequence
  Peptide Derived from Human Papillomavirus
NPTIAEGF

SEQ ID NO: 16933 - protein, 11 aa, Artificial Sequence
  Peptide Derived from Human Papillomavirus
NPTIAEGFKTL

SEQ ID NO: 16934 - protein, 11 aa, Artificial Sequence
  Peptide Derived from Human Papillomavirus
NPVYEINDKNW

SEQ ID NO: 16935 - protein, 9 aa, Artificial Sequence
  Peptide Derived from Human Papillomavirus
PPILLTTNI

SEQ ID NO: 16936 - protein, 8 aa, Artificial Sequence
  Peptide Derived from Human Papillomavirus
PPKLRSSV

SEQ ID NO: 16937 - protein, 9 aa, Artificial Sequence
  Peptide Derived from Human Papillomavirus
PPKLRSSVA

SEQ ID NO: 16938 - protein, 10 aa, Artificial Sequence
  Peptide Derived from Human Papillomavirus
PPKLRSSVAA

SEQ ID NO: 16939 - protein, 11 aa, Artificial Sequence
  Peptide Derived from Human Papillomavirus
PPKLRSSVAAL

SEQ ID NO: 16940 - protein, 9 aa, Artificial Sequence
  Peptide Derived from Human Papillomavirus
QPFILYAHI

SEQ ID NO: 16941 - protein, 9 aa, Artificial Sequence
  Peptide Derived from Human Papillomavirus
QPPKLRSSV

SEQ ID NO: 16942 - protein, 10 aa, Artificial Sequence
  Peptide Derived from Human Papillomavirus
QPPKLRSSVA

SEQ ID NO: 16943 - protein, 11 aa, Artificial Sequence
  Peptide Derived from Human Papillomavirus
QPPKLRSSVAA

SEQ ID NO: 16944 - protein, 9 aa, Artificial Sequence
  Peptide Derived from Human Papillomavirus
RPIVQFLRY

SEQ ID NO: 16945 - protein, 9 aa, Artificial Sequence
  Peptide Derived from Human Papillomavirus
SPLGERLEV

SEQ ID NO: 16946 - protein, 9 aa, Artificial Sequence
  Peptide Derived from Human Papillomavirus
SPRLQEISL

SEQ ID NO: 16947 - protein, 8 aa, Artificial Sequence
  Peptide Derived from Human Papillomavirus
TPEWIQRL

SEQ ID NO: 16948 - protein, 10 aa, Artificial Sequence
  Peptide Derived from Human Papillomavirus
TPEWIQRLTI

SEQ ID NO: 16949 - protein, 11 aa, Artificial Sequence
  Peptide Derived from Human Papillomavirus
TPEWIQRLTII

SEQ ID NO: 16950 - protein, 8 aa, Artificial Sequence
  Peptide Derived from Human Papillomavirus
TPKKNCLV

SEQ ID NO: 16951 - protein, 9 aa, Artificial Sequence
  Peptide Derived from Human Papillomavirus
TPKKNCLVF

SEQ ID NO: 16952 - protein, 8 aa, Artificial Sequence
  Peptide Derived from Human Papillomavirus
VPETCMLI

SEQ ID NO: 16953 - protein, 8 aa, Artificial Sequence
  Peptide Derived from Human Papillomavirus
WPYLESRI

SEQ ID NO: 16954 - protein, 10 aa, Artificial Sequence
  Peptide Derived from Human Papillomavirus
WPYLESRITV

SEQ ID NO: 16955 - protein, 11 aa, Artificial Sequence
  Peptide Derived from Human Papillomavirus
WPYLESRITVF

SEQ ID NO: 16956 - protein, 9 aa, Artificial Sequence
  Peptide Derived from Human Papillomavirus
GPVNPLLGA

SEQ ID NO: 16957 - protein, 10 aa, Artificial Sequence
  Peptide Derived from Human Papillomavirus
GPVNPLLGAA

SEQ ID NO: 16958 - protein, 8 aa, Artificial Sequence
  Peptide Derived from Human Papillomavirus
IPDSVQIL

SEQ ID NO: 16959 - protein, 9 aa, Artificial Sequence
  Peptide Derived from Human Papillomavirus
IPDSVQILV

SEQ ID NO: 16960 - protein, 11 aa, Artificial Sequence
  Peptide Derived from Human Papillomavirus
IPDSVQILVGY

SEQ ID NO: 16961 - protein, 8 aa, Artificial Sequence
  Peptide Derived from Human Papillomavirus
RPGHCGLA

SEQ ID NO: 16962 - protein, 9 aa, Artificial Sequence
  Peptide Derived from Human Papillomavirus
SPYSSTVSV

SEQ ID NO: 16963 - protein, 10 aa, Artificial Sequence
  Peptide Derived from Human Papillomavirus
TPKETLSERL

SEQ ID NO: 16964 - protein, 9 aa, Artificial Sequence
  Peptide Derived from Human Papillomavirus
TPSPYSSTV

SEQ ID NO: 16965 - protein, 11 aa, Artificial Sequence
  Peptide Derived from Human Papillomavirus
TPSPYSSTVSV

SEQ ID NO: 16966 - protein, 11 aa, Artificial Sequence
  Peptide Derived from Human Papillomavirus
TPTGNNKRRKL

SEQ ID NO: 16967 - protein, 11 aa, Artificial Sequence
  Peptide Derived from Human Papillomavirus
VPAYNISKSKA

SEQ ID NO: 16968 - protein, 8 aa, Artificial Sequence
  Peptide Derived from Human Papillomavirus
LPMLLLHI

SEQ ID NO: 16969 - protein, 10 aa, Artificial Sequence
  Peptide Derived from Human Papillomavirus
LPMLLLHIHA

SEQ ID NO: 16970 - protein, 11 aa, Artificial Sequence
  Peptide Derived from Human Papillomavirus
LPMLLLHIHAI

SEQ ID NO: 16971 - protein, 8 aa, Artificial Sequence
  Peptide Derived from Human Papillomavirus
LPSVCMCA

SEQ ID NO: 16972 - protein, 9 aa, Artificial Sequence
  Peptide Derived from Human Papillomavirus
LPSVCMCAY

SEQ ID NO: 16973 - protein, 10 aa, Artificial Sequence
  Peptide Derived from Human Papillomavirus
LPSVCMCAYA

SEQ ID NO: 16974 - protein, 11 aa, Artificial Sequence
  Peptide Derived from Human Papillomavirus
LPSVCMCAYAW

SEQ ID NO: 16975 - protein, 8 aa, Artificial Sequence
  Peptide Derived from Human Papillomavirus
SPATAFTV

SEQ ID NO: 16976 - protein, 9 aa, Artificial Sequence
  Peptide Derived from Human Papillomavirus
SPATAFTVY

SEQ ID NO: 16977 - protein, 10 aa, Artificial Sequence
  Peptide Derived from Human Papillomavirus
SPATAFTVYV

SEQ ID NO: 16978 - protein, 11 aa, Artificial Sequence
  Peptide Derived from Human Papillomavirus
SPATAFTVYVF

SEQ ID NO: 16979 - protein, 9 aa, Artificial Sequence
  Peptide Derived from Human Papillomavirus
VPLLPSVCM

SEQ ID NO: 16980 - protein, 11 aa, Artificial Sequence
  Peptide Derived from Human Papillomavirus
VPLLPSVCMCA

SEQ ID NO: 16981 - protein, 9 aa, Artificial Sequence
  Peptide Derived from Human Papillomavirus
DPTRRPYKL

SEQ ID NO: 16982 - protein, 10 aa, Artificial Sequence
  Peptide Derived from Human Papillomavirus
IPHAACHKCI

SEQ ID NO: 16983 - protein, 9 aa, Artificial Sequence
  Peptide Derived from Human Papillomavirus
KPLNPAEKL

SEQ ID NO: 16984 - protein, 8 aa, Artificial Sequence
  Peptide Derived from Human Papillomavirus
LPDLCTEL

SEQ ID NO: 16985 - protein, 9 aa, Artificial Sequence
  Peptide Derived from Human Papillomavirus
NPAEKLRHL

SEQ ID NO: 16986 - protein, 8 aa, Artificial Sequence
  Peptide Derived from Human Papillomavirus
RPYKLPDL

SEQ ID NO: 16987 - protein, 8 aa, Artificial Sequence
  Peptide Derived from Human Papillomavirus
EPQNEIPV

SEQ ID NO: 16988 - protein, 10 aa, Artificial Sequence
  Peptide Derived from Human Papillomavirus
EPQNEIPVDL

SEQ ID NO: 16989 - protein, 11 aa, Artificial Sequence
  Peptide Derived from Human Papillomavirus
EPQNEIPVDLL

SEQ ID NO: 16990 - protein, 8 aa, Artificial Sequence
  Peptide Derived from Human Papillomavirus
EPQRHTML

SEQ ID NO: 16991 - protein, 10 aa, Artificial Sequence
  Peptide Derived from Human Papillomavirus
EPQRHTMLCM

SEQ ID NO: 16992 - protein, 9 aa, Artificial Sequence
  Peptide Derived from Human Papillomavirus
GPKATLQDI

SEQ ID NO: 16993 - protein, 10 aa, Artificial Sequence
  Peptide Derived from Human Papillomavirus
GPKATLQDIV

SEQ ID NO: 16994 - protein, 11 aa, Artificial Sequence
  Peptide Derived from Human Papillomavirus
GPKATLQDIVL

SEQ ID NO: 16995 - protein, 11 aa, Artificial Sequence
  Peptide Derived from Human Papillomavirus
IPVDLLCHEQL

SEQ ID NO: 16996 - protein, 9 aa, Artificial Sequence
  Peptide Derived from Human Papillomavirus
APAENKDPY

SEQ ID NO: 16997 - protein, 8 aa, Artificial Sequence
  Peptide Derived from Human Papillomavirus
APAIGEHW

SEQ ID NO: 16998 - protein, 9 aa, Artificial Sequence
  Peptide Derived from Human Papillomavirus
APAIGEHWA

SEQ ID NO: 16999 - protein, 11 aa, Artificial Sequence
  Peptide Derived from Human Papillomavirus
APSATTSSKPA

SEQ ID NO: 17000 - protein, 10 aa, Artificial Sequence
  Peptide Derived from Human Papillomavirus
CPPLELKNTV

SEQ ID NO: 17001 - protein, 11 aa, Artificial Sequence
  Peptide Derived from Human Papillomavirus
CPPLELKNTVL

SEQ ID NO: 17002 - protein, 8 aa, Artificial Sequence
  Peptide Derived from Human Papillomavirus
DPYDKLKF

SEQ ID NO: 17003 - protein, 9 aa, Artificial Sequence
  Peptide Derived from Human Papillomavirus
DPYDKLKFW

SEQ ID NO: 17004 - protein, 11 aa, Artificial Sequence
  Peptide Derived from Human Papillomavirus
DPYDKLKFWNV

SEQ ID NO: 17005 - protein, 8 aa, Artificial Sequence
  Peptide Derived from Human Papillomavirus
DPYGDSMF

SEQ ID NO: 17006 - protein, 9 aa, Artificial Sequence
  Peptide Derived from Human Papillomavirus
DPYGDSMFF

SEQ ID NO: 17007 - protein, 11 aa, Artificial Sequence
  Peptide Derived from Human Papillomavirus
DPYGDSMFFCL

SEQ ID NO: 17008 - protein, 8 aa, Artificial Sequence
  Peptide Derived from Human Papillomavirus
FPIFLQMA

SEQ ID NO: 17009 - protein, 9 aa, Artificial Sequence
  Peptide Derived from Human Papillomavirus
FPIFLQMAL

SEQ ID NO: 17010 - protein, 10 aa, Artificial Sequence
  Peptide Derived from Human Papillomavirus
FPIFLQMALW

SEQ ID NO: 17011 - protein, 9 aa, Artificial Sequence
  Peptide Derived from Human Papillomavirus
GPLYHPRPL

SEQ ID NO: 17012 - protein, 11 aa, Artificial Sequence
  Peptide Derived from Human Papillomavirus
GPLYHPRPLPL

SEQ ID NO: 17013 - protein, 10 aa, Artificial Sequence
  Peptide Derived from Human Papillomavirus
GPRKRSAPSA

SEQ ID NO: 17014 - protein, 10 aa, Artificial Sequence
  Peptide Derived from Human Papillomavirus
HPRPLPLHSI

SEQ ID NO: 17015 - protein, 11 aa, Artificial Sequence
  Peptide Derived from Human Papillomavirus
HPRPLPLHSIL

SEQ ID NO: 17016 - protein, 9 aa, Artificial Sequence
  Peptide Derived from Human Papillomavirus
IPKVSAYQY

SEQ ID NO: 17017 - protein, 11 aa, Artificial Sequence
  Peptide Derived from Human Papillomavirus
IPKVSAYQYRV

SEQ ID NO: 17018 - protein, 8 aa, Artificial Sequence
  Peptide Derived from Human Papillomavirus
KPAKRVRV

SEQ ID NO: 17019 - protein, 10 aa, Artificial Sequence
  Peptide Derived from Human Papillomavirus
KPAKRVRVRA

SEQ ID NO: 17020 - protein, 11 aa, Artificial Sequence
  Peptide Derived from Human Papillomavirus
KPTIGPRKRSA

SEQ ID NO: 17021 - protein, 8 aa, Artificial Sequence
  Peptide Derived from Human Papillomavirus
KPYWLHKA

SEQ ID NO: 17022 - protein, 9 aa, Artificial Sequence
  Peptide Derived from Human Papillomavirus
LPDPNKFGL

SEQ ID NO: 17023 - protein, 8 aa, Artificial Sequence
  Peptide Derived from Human Papillomavirus
LPLHSILV

SEQ ID NO: 17024 - protein, 9 aa, Artificial Sequence
  Peptide Derived from Human Papillomavirus
LPLHSILVY

SEQ ID NO: 17025 - protein, 10 aa, Artificial Sequence
  Peptide Derived from Human Papillomavirus
LPLHSILVYM

SEQ ID NO: 17026 - protein, 11 aa, Artificial Sequence
  Peptide Derived from Human Papillomavirus
LPLHSILVYMV

SEQ ID NO: 17027 - protein, 8 aa, Artificial Sequence
  Peptide Derived from Human Papillomavirus
LPLYGPLY

SEQ ID NO: 17028 - protein, 9 aa, Artificial Sequence
  Peptide Derived from Human Papillomavirus
LPPPSVARV

SEQ ID NO: 17029 - protein, 10 aa, Artificial Sequence
  Peptide Derived from Human Papillomavirus
LPPPSVARVV

SEQ ID NO: 17030 - protein, 9 aa, Artificial Sequence
  Peptide Derived from Human Papillomavirus
MPASPGSCV

SEQ ID NO: 17031 - protein, 10 aa, Artificial Sequence
  Peptide Derived from Human Papillomavirus
MPASPGSCVY

SEQ ID NO: 17032 - protein, 8 aa, Artificial Sequence
  Peptide Derived from Human Papillomavirus
NPETQRLV

SEQ ID NO: 17033 - protein, 9 aa, Artificial Sequence
  Peptide Derived from Human Papillomavirus
NPETQRLVW

SEQ ID NO: 17034 - protein, 10 aa, Artificial Sequence
  Peptide Derived from Human Papillomavirus
NPETQRLVWA

SEQ ID NO: 17035 - protein, 8 aa, Artificial Sequence
  Peptide Derived from Human Papillomavirus
NPYFRVPA

SEQ ID NO: 17036 - protein, 9 aa, Artificial Sequence
  Peptide Derived from Human Papillomavirus
PPLELKNTV

SEQ ID NO: 17037 - protein, 10 aa, Artificial Sequence
  Peptide Derived from Human Papillomavirus
PPLELKNTVL

SEQ ID NO: 17038 - protein, 8 aa, Artificial Sequence
  Peptide Derived from Human Papillomavirus
PPPPTTSL

SEQ ID NO: 17039 - protein, 9 aa, Artificial Sequence
  Peptide Derived from Human Papillomavirus
PPPPTTSLV

SEQ ID NO: 17040 - protein, 8 aa, Artificial Sequence
  Peptide Derived from Human Papillomavirus
PPPSVARV

SEQ ID NO: 17041 - protein, 9 aa, Artificial Sequence
  Peptide Derived from Human Papillomavirus
PPPSVARVV

SEQ ID NO: 17042 - protein, 8 aa, Artificial Sequence
  Peptide Derived from Human Papillomavirus
PPPTTSLV

SEQ ID NO: 17043 - protein, 11 aa, Artificial Sequence
  Peptide Derived from Human Papillomavirus
PPPTTSLVDTY

SEQ ID NO: 17044 - protein, 8 aa, Artificial Sequence
  Peptide Derived from Human Papillomavirus
PPSVARVV

SEQ ID NO: 17045 - protein, 10 aa, Artificial Sequence
  Peptide Derived from Human Papillomavirus
PPTTSLVDTY

SEQ ID NO: 17046 - protein, 8 aa, Artificial Sequence
  Peptide Derived from Human Papillomavirus
RPLPLHSI

SEQ ID NO: 17047 - protein, 9 aa, Artificial Sequence
  Peptide Derived from Human Papillomavirus
RPLPLHSIL

SEQ ID NO: 17048 - protein, 10 aa, Artificial Sequence
  Peptide Derived from Human Papillomavirus
RPLPLHSILV

SEQ ID NO: 17049 - protein, 11 aa, Artificial Sequence
  Peptide Derived from Human Papillomavirus
RPLPLHSILVY

SEQ ID NO: 17050 - protein, 11 aa, Artificial Sequence
  Peptide Derived from Human Papillomavirus
RPLSQGDCPPL

SEQ ID NO: 17051 - protein, 8 aa, Artificial Sequence
  Peptide Derived from Human Papillomavirus
RPSDNTVY

SEQ ID NO: 17052 - protein, 9 aa, Artificial Sequence
  Peptide Derived from Human Papillomavirus
RPSDNTVYL

SEQ ID NO: 17053 - protein, 8 aa, Artificial Sequence
  Peptide Derived from Human Papillomavirus
SPSPSGSI

SEQ ID NO: 17054 - protein, 9 aa, Artificial Sequence
  Peptide Derived from Human Papillomavirus
SPSPSGSIV

SEQ ID NO: 17055 - protein, 9 aa, Artificial Sequence
  Peptide Derived from Human Papillomavirus
SPVPGQYDA

SEQ ID NO: 17056 - protein, 8 aa, Artificial Sequence
  Peptide Derived from Human Papillomavirus
TPSTNLTI

SEQ ID NO: 17057 - protein, 10 aa, Artificial Sequence
  Peptide Derived from Human Papillomavirus
TPSTNLTICA

SEQ ID NO: 17058 - protein, 9 aa, Artificial Sequence
  Peptide Derived from Human Papillomavirus
TPTSIFYHA

SEQ ID NO: 17059 - protein, 11 aa, Artificial Sequence
  Peptide Derived from Human Papillomavirus
VPAGGGNKQDI

SEQ ID NO: 17060 - protein, 10 aa, Artificial Sequence
  Peptide Derived from Human Papillomavirus
VPGQYDATKF

SEQ ID NO: 17061 - protein, 9 aa, Artificial Sequence
  Peptide Derived from Human Papillomavirus
VPLDICQSI

SEQ ID NO: 17062 - protein, 9 aa, Artificial Sequence
  Peptide Derived from Human Papillomavirus
VPPPPTTSL

SEQ ID NO: 17063 - protein, 10 aa, Artificial Sequence
  Peptide Derived from Human Papillomavirus
VPPPPTTSLV

SEQ ID NO: 17064 - protein, 9 aa, Artificial Sequence
  Peptide Derived from Human Papillomavirus
YPDYLQMSA

SEQ ID NO: 17065 - protein, 8 aa, Artificial Sequence
  Peptide Derived from Human Papillomavirus
YPLGRKFL

SEQ ID NO: 17066 - protein, 9 aa, Artificial Sequence
  Peptide Derived from Human Papillomavirus
YPLGRKFLV

SEQ ID NO: 17067 - protein, 11 aa, Artificial Sequence
  Peptide Derived from Human Papillomavirus
YPLGRKFLVQA

SEQ ID NO: 17068 - protein, 8 aa, Artificial Sequence
  Peptide Derived from Human Papillomavirus
APASTQYI

SEQ ID NO: 17069 - protein, 10 aa, Artificial Sequence
  Peptide Derived from Human Papillomavirus
APASTQYIGI

SEQ ID NO: 17070 - protein, 9 aa, Artificial Sequence
  Peptide Derived from Human Papillomavirus
APSPEYIEL

SEQ ID NO: 17071 - protein, 9 aa, Artificial Sequence
  Peptide Derived from Human Papillomavirus
CPPDVVPKV

SEQ ID NO: 17072 - protein, 11 aa, Artificial Sequence
  Peptide Derived from Human Papillomavirus
DPRSDVPDSDF

SEQ ID NO: 17073 - protein, 8 aa, Artificial Sequence
  Peptide Derived from Human Papillomavirus
DPSIVTLI

SEQ ID NO: 17074 - protein, 8 aa, Artificial Sequence
  Peptide Derived from Human Papillomavirus
EPISSTPL

SEQ ID NO: 17075 - protein, 11 aa, Artificial Sequence
  Peptide Derived from Human Papillomavirus
EPISSTPLPTV

SEQ ID NO: 17076 - protein, 9 aa, Artificial Sequence
  Peptide Derived from Human Papillomavirus
EPVDTTLTF

SEQ ID NO: 17077 - protein, 10 aa, Artificial Sequence
  Peptide Derived from Human Papillomavirus
EPVGPTDPSI

SEQ ID NO: 17078 - protein, 11 aa, Artificial Sequence
  Peptide Derived from Human Papillomavirus
EPVGPTDPSIV

SEQ ID NO: 17079 - protein, 8 aa, Artificial Sequence
  Peptide Derived from Human Papillomavirus
GPRLYSRA

SEQ ID NO: 17080 - protein, 9 aa, Artificial Sequence
  Peptide Derived from Human Papillomavirus
GPRLYSRAY

SEQ ID NO: 17081 - protein, 8 aa, Artificial Sequence
  Peptide Derived from Human Papillomavirus
GPTDPSIV

SEQ ID NO: 17082 - protein, 10 aa, Artificial Sequence
  Peptide Derived from Human Papillomavirus
GPTDPSIVTL

SEQ ID NO: 17083 - protein, 11 aa, Artificial Sequence
  Peptide Derived from Human Papillomavirus
GPTDPSIVTLI

SEQ ID NO: 17084 - protein, 8 aa, Artificial Sequence
  Peptide Derived from Human Papillomavirus
GPTRPPVV

SEQ ID NO: 17085 - protein, 9 aa, Artificial Sequence
  Peptide Derived from Human Papillomavirus
GPTRPPVVI

SEQ ID NO: 17086 - protein, 8 aa, Artificial Sequence
  Peptide Derived from Human Papillomavirus
IPKKRKRV

SEQ ID NO: 17087 - protein, 10 aa, Artificial Sequence
  Peptide Derived from Human Papillomavirus
IPKKRKRVPY

SEQ ID NO: 17088 - protein, 11 aa, Artificial Sequence
  Peptide Derived from Human Papillomavirus
IPKKRKRVPYF

SEQ ID NO: 17089 - protein, 10 aa, Artificial Sequence
  Peptide Derived from Human Papillomavirus
IPLGGRSNTV

SEQ ID NO: 17090 - protein, 11 aa, Artificial Sequence
  Peptide Derived from Human Papillomavirus
IPLGGRSNTVV

SEQ ID NO: 17091 - protein, 8 aa, Artificial Sequence
  Peptide Derived from Human Papillomavirus
LPSTTSVW

SEQ ID NO: 17092 - protein, 10 aa, Artificial Sequence
  Peptide Derived from Human Papillomavirus
LPSTTSVWPI

SEQ ID NO: 17093 - protein, 11 aa, Artificial Sequence
  Peptide Derived from Human Papillomavirus
LPSTTSVWPIV

SEQ ID NO: 17094 - protein, 8 aa, Artificial Sequence
  Peptide Derived from Human Papillomavirus
LPTVRRVA

SEQ ID NO: 17095 - protein, 11 aa, Artificial Sequence
  Peptide Derived from Human Papillomavirus
NPAFEPVDTTL

SEQ ID NO: 17096 - protein, 9 aa, Artificial Sequence
  Peptide Derived from Human Papillomavirus
NPAFSDPSI

SEQ ID NO: 17097 - protein, 10 aa, Artificial Sequence
  Peptide Derived from Human Papillomavirus
NPAFSDPSII

SEQ ID NO: 17098 - protein, 11 aa, Artificial Sequence
  Peptide Derived from Human Papillomavirus
NPEFLTRPSSL

SEQ ID NO: 17099 - protein, 8 aa, Artificial Sequence
  Peptide Derived from Human Papillomavirus
PPDVVPKV

SEQ ID NO: 17100 - protein, 8 aa, Artificial Sequence
  Peptide Derived from Human Papillomavirus
PPVVIEPV

SEQ ID NO: 17101 - protein, 11 aa, Artificial Sequence
  Peptide Derived from Human Papillomavirus
RPALTSRRGTV

SEQ ID NO: 17102 - protein, 9 aa, Artificial Sequence
  Peptide Derived from Human Papillomavirus
RPPVVIEPV

SEQ ID NO: 17103 - protein, 8 aa, Artificial Sequence
  Peptide Derived from Human Papillomavirus
RPSSLITY

SEQ ID NO: 17104 - protein, 10 aa, Artificial Sequence
  Peptide Derived from Human Papillomavirus
RPTFTGTSGF

SEQ ID NO: 17105 - protein, 10 aa, Artificial Sequence
  Peptide Derived from Human Papillomavirus
SPEYIELQPL

SEQ ID NO: 17106 - protein, 11 aa, Artificial Sequence
  Peptide Derived from Human Papillomavirus
SPEYIELQPLV

SEQ ID NO: 17107 - protein, 9 aa, Artificial Sequence
  Peptide Derived from Human Papillomavirus
SPIAPSPEY

SEQ ID NO: 17108 - protein, 10 aa, Artificial Sequence
  Peptide Derived from Human Papillomavirus
SPIAPSPEYI

SEQ ID NO: 17109 - protein, 10 aa, Artificial Sequence
  Peptide Derived from Human Papillomavirus
SPTAPASTQY

SEQ ID NO: 17110 - protein, 11 aa, Artificial Sequence
  Peptide Derived from Human Papillomavirus
SPTAPASTQYI

SEQ ID NO: 17111 - protein, 10 aa, Artificial Sequence
  Peptide Derived from Human Papillomavirus
SPTISSASSY

SEQ ID NO: 17112 - protein, 9 aa, Artificial Sequence
  Peptide Derived from Human Papillomavirus
TPLPTVRRV

SEQ ID NO: 17113 - protein, 10 aa, Artificial Sequence
  Peptide Derived from Human Papillomavirus
TPLPTVRRVA

SEQ ID NO: 17114 - protein, 9 aa, Artificial Sequence
  Peptide Derived from Human Papillomavirus
TPSSTSVSI

SEQ ID NO: 17115 - protein, 9 aa, Artificial Sequence
  Peptide Derived from Human Papillomavirus
TPTSGTHGY

SEQ ID NO: 17116 - protein, 9 aa, Artificial Sequence
  Peptide Derived from Human Papillomavirus
VPDSDFMDI

SEQ ID NO: 17117 - protein, 10 aa, Artificial Sequence
  Peptide Derived from Human Papillomavirus
VPDSDFMDII

SEQ ID NO: 17118 - protein, 9 aa, Artificial Sequence
  Peptide Derived from Human Papillomavirus
VPKVEGTTL

SEQ ID NO: 17119 - protein, 10 aa, Artificial Sequence
  Peptide Derived from Human Papillomavirus
VPKVEGTTLA

SEQ ID NO: 17120 - protein, 9 aa, Artificial Sequence
  Peptide Derived from Human Papillomavirus
VPLTSSWDV

SEQ ID NO: 17121 - protein, 11 aa, Artificial Sequence
  Peptide Derived from Human Papillomavirus
VPLTSSWDVPV

SEQ ID NO: 17122 - protein, 8 aa, Artificial Sequence
  Peptide Derived from Human Papillomavirus
VPQTGEVA

SEQ ID NO: 17123 - protein, 11 aa, Artificial Sequence
  Peptide Derived from Human Papillomavirus
VPQTGEVAGNV

SEQ ID NO: 17124 - protein, 9 aa, Artificial Sequence
  Peptide Derived from Human Papillomavirus
VPSRSTTSF

SEQ ID NO: 17125 - protein, 10 aa, Artificial Sequence
  Peptide Derived from Human Papillomavirus
VPSRSTTSFA

SEQ ID NO: 17126 - protein, 11 aa, Artificial Sequence
  Peptide Derived from Human Papillomavirus
VPSRSTTSFAF

SEQ ID NO: 17127 - protein, 11 aa, Artificial Sequence
  Peptide Derived from Human Papillomavirus
VPVPSRSTTSF

SEQ ID NO: 17128 - protein, 9 aa, Artificial Sequence
  Peptide Derived from Human Papillomavirus
VPVYTGPDI

SEQ ID NO: 17129 - protein, 11 aa, Artificial Sequence
  Peptide Derived from Human Papillomavirus
VPVYTGPDITL

SEQ ID NO: 17130 - protein, 9 aa, Artificial Sequence
  Peptide Derived from Human Papillomavirus
VPYFFADGF

SEQ ID NO: 17131 - protein, 10 aa, Artificial Sequence
  Peptide Derived from Human Papillomavirus
VPYFFADGFV

SEQ ID NO: 17132 - protein, 11 aa, Artificial Sequence
  Peptide Derived from Human Papillomavirus
VPYFFADGFVA

SEQ ID NO: 17133 - protein, 8 aa, Artificial Sequence
  Peptide Derived from Human Papillomavirus
WPIVSPTA

SEQ ID NO: 17134 - protein, 10 aa, Artificial Sequence
  Peptide Derived from Human Papillomavirus
WPIVSPTAPA

SEQ ID NO: 17135 - protein, 8 aa, Artificial Sequence
  Peptide Derived from Human Papillomavirus
APNTGKSY

SEQ ID NO: 17136 - protein, 9 aa, Artificial Sequence
  Peptide Derived from Human Papillomavirus
APNTGKSYF

SEQ ID NO: 17137 - protein, 11 aa, Artificial Sequence
  Peptide Derived from Human Papillomavirus
APNTGKSYFGM

SEQ ID NO: 17138 - protein, 10 aa, Artificial Sequence
  Peptide Derived from Human Papillomavirus
CPPLLITSNI

SEQ ID NO: 17139 - protein, 10 aa, Artificial Sequence
  Peptide Derived from Human Papillomavirus
FPFDKNGNPV

SEQ ID NO: 17140 - protein, 11 aa, Artificial Sequence
  Peptide Derived from Human Papillomavirus
FPFDKNGNPVY

SEQ ID NO: 17141 - protein, 11 aa, Artificial Sequence
  Peptide Derived from Human Papillomavirus
LPDSGYGNTEV

SEQ ID NO: 17142 - protein, 11 aa, Artificial Sequence
  Peptide Derived from Human Papillomavirus
NPVSIDVKHKA

SEQ ID NO: 17143 - protein, 11 aa, Artificial Sequence
  Peptide Derived from Human Papillomavirus
NPVYELSDKNW

SEQ ID NO: 17144 - protein, 8 aa, Artificial Sequence
  Peptide Derived from Human Papillomavirus
PPKLRSTA

SEQ ID NO: 17145 - protein, 9 aa, Artificial Sequence
  Peptide Derived from Human Papillomavirus
PPKLRSTAA

SEQ ID NO: 17146 - protein, 10 aa, Artificial Sequence
  Peptide Derived from Human Papillomavirus
PPKLRSTAAA

SEQ ID NO: 17147 - protein, 11 aa, Artificial Sequence
  Peptide Derived from Human Papillomavirus
PPKLRSTAAAL

SEQ ID NO: 17148 - protein, 9 aa, Artificial Sequence
  Peptide Derived from Human Papillomavirus
PPLLITSNI

SEQ ID NO: 17149 - protein, 11 aa, Artificial Sequence
  Peptide Derived from Human Papillomavirus
PPLLITSNINA

SEQ ID NO: 17150 - protein, 8 aa, Artificial Sequence
  Peptide Derived from Human Papillomavirus
QPLADAKI

SEQ ID NO: 17151 - protein, 10 aa, Artificial Sequence
  Peptide Derived from Human Papillomavirus
QPLADAKIGM

SEQ ID NO: 17152 - protein, 11 aa, Artificial Sequence
  Peptide Derived from Human Papillomavirus
QPLADAKIGML

SEQ ID NO: 17153 - protein, 9 aa, Artificial Sequence
  Peptide Derived from Human Papillomavirus
QPPKLRSTA

SEQ ID NO: 17154 - protein, 10 aa, Artificial Sequence
  Peptide Derived from Human Papillomavirus
QPPKLRSTAA

SEQ ID NO: 17155 - protein, 11 aa, Artificial Sequence
  Peptide Derived from Human Papillomavirus
QPPKLRSTAAA

SEQ ID NO: 17156 - protein, 9 aa, Artificial Sequence
  Peptide Derived from Human Papillomavirus
QPYCLYCHL

SEQ ID NO: 17157 - protein, 10 aa, Artificial Sequence
  Peptide Derived from Human Papillomavirus
SPLSDISSCV

SEQ ID NO: 17158 - protein, 9 aa, Artificial Sequence
  Peptide Derived from Human Papillomavirus
SPRLKAICI

SEQ ID NO: 17159 - protein, 10 aa, Artificial Sequence
  Peptide Derived from Human Papillomavirus
TPCWHYIDNY

SEQ ID NO: 17160 - protein, 11 aa, Artificial Sequence
  Peptide Derived from Human Papillomavirus
TPCWHYIDNYL

SEQ ID NO: 17161 - protein, 10 aa, Artificial Sequence
  Peptide Derived from Human Papillomavirus
TPEWIERQTV

SEQ ID NO: 17162 - protein, 11 aa, Artificial Sequence
  Peptide Derived from Human Papillomavirus
TPEWIERQTVL

SEQ ID NO: 17163 - protein, 9 aa, Artificial Sequence
  Peptide Derived from Human Papillomavirus
TPTRNILQV

SEQ ID NO: 17164 - protein, 10 aa, Artificial Sequence
  Peptide Derived from Human Papillomavirus
TPTRNILQVL

SEQ ID NO: 17165 - protein, 8 aa, Artificial Sequence
  Peptide Derived from Human Papillomavirus
VPKKNCIL

SEQ ID NO: 17166 - protein, 9 aa, Artificial Sequence
  Peptide Derived from Human Papillomavirus
VPKKNCILI

SEQ ID NO: 17167 - protein, 8 aa, Artificial Sequence
  Peptide Derived from Human Papillomavirus
WPYLHSRL

SEQ ID NO: 17168 - protein, 9 aa, Artificial Sequence
  Peptide Derived from Human Papillomavirus
WPYLHSRLV

SEQ ID NO: 17169 - protein, 10 aa, Artificial Sequence
  Peptide Derived from Human Papillomavirus
WPYLHSRLVV

SEQ ID NO: 17170 - protein, 11 aa, Artificial Sequence
  Peptide Derived from Human Papillomavirus
WPYLHSRLVVF

SEQ ID NO: 17171 - protein, 11 aa, Artificial Sequence
  Peptide Derived from Human Papillomavirus
APTGCLKKHGY

SEQ ID NO: 17172 - protein, 8 aa, Artificial Sequence
  Peptide Derived from Human Papillomavirus
CPATTPII

SEQ ID NO: 17173 - protein, 10 aa, Artificial Sequence
  Peptide Derived from Human Papillomavirus
CPATTPIIHL

SEQ ID NO: 17174 - protein, 11 aa, Artificial Sequence
  Peptide Derived from Human Papillomavirus
FPESVFSSDEI

SEQ ID NO: 17175 - protein, 11 aa, Artificial Sequence
  Peptide Derived from Human Papillomavirus
HPNKLLRGDSV

SEQ ID NO: 17176 - protein, 11 aa, Artificial Sequence
  Peptide Derived from Human Papillomavirus
IPNTVSVSTGY

SEQ ID NO: 17177 - protein, 10 aa, Artificial Sequence
  Peptide Derived from Human Papillomavirus
TPIIHLKGDA

SEQ ID NO: 17178 - protein, 9 aa, Artificial Sequence
  Peptide Derived from Human Papillomavirus
VPALSVSKA

SEQ ID NO: 17179 - protein, 11 aa, Artificial Sequence
  Peptide Derived from Human Papillomavirus
VPALSVSKAKA

SEQ ID NO: 17180 - protein, 10 aa, Artificial Sequence
  Peptide Derived from Human Papillomavirus
IPLFVIHTHA

SEQ ID NO: 17181 - protein, 9 aa, Artificial Sequence
  Peptide Derived from Human Papillomavirus
RPLVLSVSV

SEQ ID NO: 17182 - protein, 10 aa, Artificial Sequence
  Peptide Derived from Human Papillomavirus
RPLVLSVSVY

SEQ ID NO: 17183 - protein, 11 aa, Artificial Sequence
  Peptide Derived from Human Papillomavirus
RPLVLSVSVYA

SEQ ID NO: 17184 - protein, 8 aa, Artificial Sequence
  Peptide Derived from Human Papillomavirus
SPLRCFCI

SEQ ID NO: 17185 - protein, 9 aa, Artificial Sequence
  Peptide Derived from Human Papillomavirus
SPLRCFCIY

SEQ ID NO: 17186 - protein, 10 aa, Artificial Sequence
  Peptide Derived from Human Papillomavirus
SPLRCFCIYV

SEQ ID NO: 17187 - protein, 11 aa, Artificial Sequence
  Peptide Derived from Human Papillomavirus
SPLRCFCIYVV

SEQ ID NO: 17188 - protein, 9 aa, Artificial Sequence
  Peptide Derived from Human Papillomavirus
CPEEKQRHL

SEQ ID NO: 17189 - protein, 8 aa, Artificial Sequence
  Peptide Derived from Human Papillomavirus
IPYDELRL

SEQ ID NO: 17190 - protein, 11 aa, Artificial Sequence
  Peptide Derived from Human Papillomavirus
IPYDELRLNCV

SEQ ID NO: 17191 - protein, 9 aa, Artificial Sequence
  Peptide Derived from Human Papillomavirus
NPAERPRKL

SEQ ID NO: 17192 - protein, 8 aa, Artificial Sequence
  Peptide Derived from Human Papillomavirus
RPRKLHEL

SEQ ID NO: 17193 - protein, 11 aa, Artificial Sequence
  Peptide Derived from Human Papillomavirus
RPRKLHELSSA

SEQ ID NO: 17194 - protein, 8 aa, Artificial Sequence
  Peptide Derived from Human Papillomavirus
RPRTETQV

SEQ ID NO: 17195 - protein, 10 aa, Artificial Sequence
  Peptide Derived from Human Papillomavirus
TPHGVCTKCL

SEQ ID NO: 17196 - protein, 8 aa, Artificial Sequence
  Peptide Derived from Human Papillomavirus
CPNCSTRL

SEQ ID NO: 17197 - protein, 9 aa, Artificial Sequence
  Peptide Derived from Human Papillomavirus
EPDTSNYNI

SEQ ID NO: 17198 - protein, 10 aa, Artificial Sequence
  Peptide Derived from Human Papillomavirus
EPDTSNYNIV

SEQ ID NO: 17199 - protein, 10 aa, Artificial Sequence
  Peptide Derived from Human Papillomavirus
LPDSSDEEDV

SEQ ID NO: 17200 - protein, 11 aa, Artificial Sequence
  Peptide Derived from Human Papillomavirus
LPDSSDEEDVI

SEQ ID NO: 17201 - protein, 10 aa, Artificial Sequence
  Peptide Derived from Human Papillomavirus
QPEATDLHCY

SEQ ID NO: 17202 - protein, 8 aa, Artificial Sequence
  Peptide Derived from Human Papillomavirus
TPTLQDYV

SEQ ID NO: 17203 - protein, 9 aa, Artificial Sequence
  Peptide Derived from Human Papillomavirus
TPTLQDYVL

SEQ ID NO: 17204 - protein, 11 aa, Artificial Sequence
  Peptide Derived from Human Papillomavirus
TPTLQDYVLDL

SEQ ID NO: 17205 - protein, 10 aa, Artificial Sequence
  Peptide Derived from Human Papillomavirus
APQKPKEDPF

SEQ ID NO: 17206 - protein, 10 aa, Artificial Sequence
  Peptide Derived from Human Papillomavirus
APSASTTTPA

SEQ ID NO: 17207 - protein, 10 aa, Artificial Sequence
  Peptide Derived from Human Papillomavirus
CPPLELKNSV

SEQ ID NO: 17208 - protein, 11 aa, Artificial Sequence
  Peptide Derived from Human Papillomavirus
CPPLELKNSVI

SEQ ID NO: 17209 - protein, 8 aa, Artificial Sequence
  Peptide Derived from Human Papillomavirus
DPFKDYVF

SEQ ID NO: 17210 - protein, 9 aa, Artificial Sequence
  Peptide Derived from Human Papillomavirus
DPFKDYVFW

SEQ ID NO: 17211 - protein, 11 aa, Artificial Sequence
  Peptide Derived from Human Papillomavirus
DPFKDYVFWEV

SEQ ID NO: 17212 - protein, 8 aa, Artificial Sequence
  Peptide Derived from Human Papillomavirus
EPYGDTLF

SEQ ID NO: 17213 - protein, 9 aa, Artificial Sequence
  Peptide Derived from Human Papillomavirus
EPYGDTLFF

SEQ ID NO: 17214 - protein, 10 aa, Artificial Sequence
  Peptide Derived from Human Papillomavirus
EPYGDTLFFY

SEQ ID NO: 17215 - protein, 11 aa, Artificial Sequence
  Peptide Derived from Human Papillomavirus
EPYGDTLFFYL

SEQ ID NO: 17216 - protein, 8 aa, Artificial Sequence
  Peptide Derived from Human Papillomavirus
FPLGRKFL

SEQ ID NO: 17217 - protein, 9 aa, Artificial Sequence
  Peptide Derived from Human Papillomavirus
FPLGRKFLL

SEQ ID NO: 17218 - protein, 11 aa, Artificial Sequence
  Peptide Derived from Human Papillomavirus
FPLGRKFLLQA

SEQ ID NO: 17219 - protein, 8 aa, Artificial Sequence
  Peptide Derived from Human Papillomavirus
FPTPSGSM

SEQ ID NO: 17220 - protein, 9 aa, Artificial Sequence
  Peptide Derived from Human Papillomavirus
FPTPSGSMV

SEQ ID NO: 17221 - protein, 10 aa, Artificial Sequence
  Peptide Derived from Human Papillomavirus
GPGTDNRECI

SEQ ID NO: 17222 - protein, 10 aa, Artificial Sequence
  Peptide Derived from Human Papillomavirus
IPKSDNPKKI

SEQ ID NO: 17223 - protein, 11 aa, Artificial Sequence
  Peptide Derived from Human Papillomavirus
IPKSDNPKKIV

SEQ ID NO: 17224 - protein, 10 aa, Artificial Sequence
  Peptide Derived from Human Papillomavirus
KPKEDPFKDY

SEQ ID NO: 17225 - protein, 11 aa, Artificial Sequence
  Peptide Derived from Human Papillomavirus
KPKEDPFKDYV

SEQ ID NO: 17226 - protein, 8 aa, Artificial Sequence
  Peptide Derived from Human Papillomavirus
KPPIGEHW

SEQ ID NO: 17227 - protein, 8 aa, Artificial Sequence
  Peptide Derived from Human Papillomavirus
KPYWMQRA

SEQ ID NO: 17228 - protein, 9 aa, Artificial Sequence
  Peptide Derived from Human Papillomavirus
LPDPNKFGF

SEQ ID NO: 17229 - protein, 9 aa, Artificial Sequence
  Peptide Derived from Human Papillomavirus
LPPVPVSKV

SEQ ID NO: 17230 - protein, 10 aa, Artificial Sequence
  Peptide Derived from Human Papillomavirus
LPPVPVSKVV

SEQ ID NO: 17231 - protein, 8 aa, Artificial Sequence
  Peptide Derived from Human Papillomavirus
NPAILEDW

SEQ ID NO: 17232 - protein, 10 aa, Artificial Sequence
  Peptide Derived from Human Papillomavirus
NPAILEDWNF

SEQ ID NO: 17233 - protein, 8 aa, Artificial Sequence
  Peptide Derived from Human Papillomavirus
NPETQRLV

SEQ ID NO: 17234 - protein, 9 aa, Artificial Sequence
  Peptide Derived from Human Papillomavirus
NPETQRLVW

SEQ ID NO: 17235 - protein, 10 aa, Artificial Sequence
  Peptide Derived from Human Papillomavirus
NPETQRLVWA

SEQ ID NO: 17236 - protein, 10 aa, Artificial Sequence
  Peptide Derived from Human Papillomavirus
NPKKIVVPKV

SEQ ID NO: 17237 - protein, 9 aa, Artificial Sequence
  Peptide Derived from Human Papillomavirus
PPLELKNSV

SEQ ID NO: 17238 - protein, 10 aa, Artificial Sequence
  Peptide Derived from Human Papillomavirus
PPLELKNSVI

SEQ ID NO: 17239 - protein, 10 aa, Artificial Sequence
  Peptide Derived from Human Papillomavirus
PPSGSLEDTY

SEQ ID NO: 17240 - protein, 8 aa, Artificial Sequence
  Peptide Derived from Human Papillomavirus
PPVPVSKV

SEQ ID NO: 17241 - protein, 9 aa, Artificial Sequence
  Peptide Derived from Human Papillomavirus
PPVPVSKVV

SEQ ID NO: 17242 - protein, 11 aa, Artificial Sequence
  Peptide Derived from Human Papillomavirus
RPKFKAGKRSA

SEQ ID NO: 17243 - protein, 8 aa, Artificial Sequence
  Peptide Derived from Human Papillomavirus
RPSEATVY

SEQ ID NO: 17244 - protein, 9 aa, Artificial Sequence
  Peptide Derived from Human Papillomavirus
RPSEATVYL

SEQ ID NO: 17245 - protein, 8 aa, Artificial Sequence
  Peptide Derived from Human Papillomavirus
SPCSNNAI

SEQ ID NO: 17246 - protein, 8 aa, Artificial Sequence
  Peptide Derived from Human Papillomavirus
TPGDCPPL

SEQ ID NO: 17247 - protein, 10 aa, Artificial Sequence
  Peptide Derived from Human Papillomavirus
TPGDCPPLEL

SEQ ID NO: 17248 - protein, 11 aa, Artificial Sequence
  Peptide Derived from Human Papillomavirus
TPPSGSLEDTY

SEQ ID NO: 17249 - protein, 11 aa, Artificial Sequence
  Peptide Derived from Human Papillomavirus
TPSGSMVTSDA

SEQ ID NO: 17250 - protein, 9 aa, Artificial Sequence
  Peptide Derived from Human Papillomavirus
VPKVSGLQY

SEQ ID NO: 17251 - protein, 11 aa, Artificial Sequence
  Peptide Derived from Human Papillomavirus
VPKVSGLQYRV

SEQ ID NO: 17252 - protein, 9 aa, Artificial Sequence
  Peptide Derived from Human Papillomavirus
VPLDICNSI

SEQ ID NO: 17253 - protein, 8 aa, Artificial Sequence
  Peptide Derived from Human Papillomavirus
YPDYLKMV

SEQ ID NO: 17254 - protein, 9 aa, Artificial Sequence
  Peptide Derived from Human Papillomavirus
YPDYLKMVA

SEQ ID NO: 17255 - protein, 9 aa, Artificial Sequence
  Peptide Derived from Human Papillomavirus
APDPDFLDI

SEQ ID NO: 17256 - protein, 10 aa, Artificial Sequence
  Peptide Derived from Human Papillomavirus
APDPDFLDII

SEQ ID NO: 17257 - protein, 11 aa, Artificial Sequence
  Peptide Derived from Human Papillomavirus
APDPDFLDIIA

SEQ ID NO: 17258 - protein, 8 aa, Artificial Sequence
  Peptide Derived from Human Papillomavirus
APKQLITY

SEQ ID NO: 17259 - protein, 8 aa, Artificial Sequence
  Peptide Derived from Human Papillomavirus
APTQVFPF

SEQ ID NO: 17260 - protein, 10 aa, Artificial Sequence
  Peptide Derived from Human Papillomavirus
APTQVFPFPL

SEQ ID NO: 17261 - protein, 11 aa, Artificial Sequence
  Peptide Derived from Human Papillomavirus
APTQVFPFPLA

SEQ ID NO: 17262 - protein, 9 aa, Artificial Sequence
  Peptide Derived from Human Papillomavirus
APTTPQVSI

SEQ ID NO: 17263 - protein, 10 aa, Artificial Sequence
  Peptide Derived from Human Papillomavirus
APTTPQVSIF

SEQ ID NO: 17264 - protein, 11 aa, Artificial Sequence
  Peptide Derived from Human Papillomavirus
APTTPQVSIFV

SEQ ID NO: 17265 - protein, 9 aa, Artificial Sequence
  Peptide Derived from Human Papillomavirus
CPSDVIPKI

SEQ ID NO: 17266 - protein, 8 aa, Artificial Sequence
  Peptide Derived from Human Papillomavirus
DPDFLDII

SEQ ID NO: 17267 - protein, 9 aa, Artificial Sequence
  Peptide Derived from Human Papillomavirus
DPDFLDIIA

SEQ ID NO: 17268 - protein, 10 aa, Artificial Sequence
  Peptide Derived from Human Papillomavirus
DPDFLDIIAL

SEQ ID NO: 17269 - protein, 8 aa, Artificial Sequence
  Peptide Derived from Human Papillomavirus
DPSIVSLV

SEQ ID NO: 17270 - protein, 11 aa, Artificial Sequence
  Peptide Derived from Human Papillomavirus
DPSVLQPPTPA

SEQ ID NO: 17271 - protein, 11 aa, Artificial Sequence
  Peptide Derived from Human Papillomavirus
DPTFLSAPKQL

SEQ ID NO: 17272 - protein, 10 aa, Artificial Sequence
  Peptide Derived from Human Papillomavirus
DPVGPLDPSI

SEQ ID NO: 17273 - protein, 11 aa, Artificial Sequence
  Peptide Derived from Human Papillomavirus
DPVGPLDPSIV

SEQ ID NO: 17274 - protein, 10 aa, Artificial Sequence
  Peptide Derived from Human Papillomavirus
FPLAPTTPQV

SEQ ID NO: 17275 - protein, 9 aa, Artificial Sequence
  Peptide Derived from Human Papillomavirus
GPDVPIEHA

SEQ ID NO: 17276 - protein, 8 aa, Artificial Sequence
  Peptide Derived from Human Papillomavirus
GPLDPSIV

SEQ ID NO: 17277 - protein, 10 aa, Artificial Sequence
  Peptide Derived from Human Papillomavirus
GPLDPSIVSL

SEQ ID NO: 17278 - protein, 11 aa, Artificial Sequence
  Peptide Derived from Human Papillomavirus
GPLDPSIVSLV

SEQ ID NO: 17279 - protein, 8 aa, Artificial Sequence
  Peptide Derived from Human Papillomavirus
HPPTTSGF

SEQ ID NO: 17280 - protein, 10 aa, Artificial Sequence
  Peptide Derived from Human Papillomavirus
HPPTTSGFDI

SEQ ID NO: 17281 - protein, 11 aa, Artificial Sequence
  Peptide Derived from Human Papillomavirus
HPPTTSGFDIA

SEQ ID NO: 17282 - protein, 8 aa, Artificial Sequence
  Peptide Derived from Human Papillomavirus
IPGVRRPA

SEQ ID NO: 17283 - protein, 10 aa, Artificial Sequence
  Peptide Derived from Human Papillomavirus
IPGVRRPARL

SEQ ID NO: 17284 - protein, 10 aa, Artificial Sequence
  Peptide Derived from Human Papillomavirus
IPHPPTTSGF

SEQ ID NO: 17285 - protein, 9 aa, Artificial Sequence
  Peptide Derived from Human Papillomavirus
IPIFSGPDV

SEQ ID NO: 17286 - protein, 11 aa, Artificial Sequence
  Peptide Derived from Human Papillomavirus
IPIFSGPDVPI

SEQ ID NO: 17287 - protein, 9 aa, Artificial Sequence
  Peptide Derived from Human Papillomavirus
IPIRPPVSI

SEQ ID NO: 17288 - protein, 9 aa, Artificial Sequence
  Peptide Derived from Human Papillomavirus
IPKIEHTTI

SEQ ID NO: 17289 - protein, 10 aa, Artificial Sequence
  Peptide Derived from Human Papillomavirus
IPKIEHTTIA

SEQ ID NO: 17290 - protein, 8 aa, Artificial Sequence
  Peptide Derived from Human Papillomavirus
IPMDTFIV

SEQ ID NO: 17291 - protein, 9 aa, Artificial Sequence
  Peptide Derived from Human Papillomavirus
NPAGESIEM

SEQ ID NO: 17292 - protein, 9 aa, Artificial Sequence
  Peptide Derived from Human Papillomavirus
NPAYETVNA

SEQ ID NO: 17293 - protein, 9 aa, Artificial Sequence
  Peptide Derived from Human Papillomavirus
NPTFTDPSV

SEQ ID NO: 17294 - protein, 10 aa, Artificial Sequence
  Peptide Derived from Human Papillomavirus
NPTFTDPSVL

SEQ ID NO: 17295 - protein, 11 aa, Artificial Sequence
  Peptide Derived from Human Papillomavirus
PPTPAETSGHL

SEQ ID NO: 17296 - protein, 9 aa, Artificial Sequence
  Peptide Derived from Human Papillomavirus
PPTTSGFDI

SEQ ID NO: 17297 - protein, 10 aa, Artificial Sequence
  Peptide Derived from Human Papillomavirus
PPTTSGFDIA

SEQ ID NO: 17298 - protein, 8 aa, Artificial Sequence
  Peptide Derived from Human Papillomavirus
PPVSIDPV

SEQ ID NO: 17299 - protein, 11 aa, Artificial Sequence
  Peptide Derived from Human Papillomavirus
PPVSIDPVGPL

SEQ ID NO: 17300 - protein, 11 aa, Artificial Sequence
  Peptide Derived from Human Papillomavirus
RPALTSRRNTV

SEQ ID NO: 17301 - protein, 8 aa, Artificial Sequence
  Peptide Derived from Human Papillomavirus
RPARLGLY

SEQ ID NO: 17302 - protein, 11 aa, Artificial Sequence
  Peptide Derived from Human Papillomavirus
RPARLGLYSKA

SEQ ID NO: 17303 - protein, 9 aa, Artificial Sequence
  Peptide Derived from Human Papillomavirus
RPPVSIDPV

SEQ ID NO: 17304 - protein, 8 aa, Artificial Sequence
  Peptide Derived from Human Papillomavirus
RPSTVSEA

SEQ ID NO: 17305 - protein, 10 aa, Artificial Sequence
  Peptide Derived from Human Papillomavirus
RPSTVSEASI

SEQ ID NO: 17306 - protein, 11 aa, Artificial Sequence
  Peptide Derived from Human Papillomavirus
SPSTAVQSTSA

SEQ ID NO: 17307 - protein, 9 aa, Artificial Sequence
  Peptide Derived from Human Papillomavirus
TPAETSGHL

SEQ ID NO: 17308 - protein, 10 aa, Artificial Sequence
  Peptide Derived from Human Papillomavirus
TPAETSGHLL

SEQ ID NO: 17309 - protein, 11 aa, Artificial Sequence
  Peptide Derived from Human Papillomavirus
TPAETSGHLLL

SEQ ID NO: 17310 - protein, 10 aa, Artificial Sequence
  Peptide Derived from Human Papillomavirus
TPAILDVTSV

SEQ ID NO: 17311 - protein, 10 aa, Artificial Sequence
  Peptide Derived from Human Papillomavirus
TPIPGVRRPA

SEQ ID NO: 17312 - protein, 8 aa, Artificial Sequence
  Peptide Derived from Human Papillomavirus
TPQVSIFV

SEQ ID NO: 17313 - protein, 10 aa, Artificial Sequence
  Peptide Derived from Human Papillomavirus
VPIEHAPTQV

SEQ ID NO: 17314 - protein, 11 aa, Artificial Sequence
  Peptide Derived from Human Papillomavirus
VPIEHAPTQVF

SEQ ID NO: 17315 - protein, 9 aa, Artificial Sequence
  Peptide Derived from Human Papillomavirus
VPLSTGFDI

SEQ ID NO: 17316 - protein, 11 aa, Artificial Sequence
  Peptide Derived from Human Papillomavirus
VPLSTGFDIPI

SEQ ID NO: 17317 - protein, 10 aa, Artificial Sequence
  Peptide Derived from Human Papillomavirus
VPLSTRPSTV

SEQ ID NO: 17318 - protein, 9 aa, Artificial Sequence
  Peptide Derived from Human Papillomavirus
VPTNTTVPL

SEQ ID NO: 17319 - protein, 8 aa, Artificial Sequence
  Peptide Derived from Human Papillomavirus
DPEGTNGA

SEQ ID NO: 17320 - protein, 10 aa, Artificial Sequence
  Peptide Derived from Human Papillomavirus
DPEGTNGAGM

SEQ ID NO: 17321 - protein, 11 aa, Artificial Sequence
  Peptide Derived from Human Papillomavirus
EPPKLRSQTCA

SEQ ID NO: 17322 - protein, 10 aa, Artificial Sequence
  Peptide Derived from Human Papillomavirus
FPFDENGNPV

SEQ ID NO: 17323 - protein, 11 aa, Artificial Sequence
  Peptide Derived from Human Papillomavirus
FPFDENGNPVY

SEQ ID NO: 17324 - protein, 9 aa, Artificial Sequence
  Peptide Derived from Human Papillomavirus
GPANTGKSY

SEQ ID NO: 17325 - protein, 10 aa, Artificial Sequence
  Peptide Derived from Human Papillomavirus
GPANTGKSYF

SEQ ID NO: 17326 - protein, 8 aa, Artificial Sequence
  Peptide Derived from Human Papillomavirus
IPETCMVI

SEQ ID NO: 17327 - protein, 8 aa, Artificial Sequence
  Peptide Derived from Human Papillomavirus
IPKKSCML

SEQ ID NO: 17328 - protein, 9 aa, Artificial Sequence
  Peptide Derived from Human Papillomavirus
IPKKSCMLI

SEQ ID NO: 17329 - protein, 11 aa, Artificial Sequence
  Peptide Derived from Human Papillomavirus
NPVYAINDENW

SEQ ID NO: 17330 - protein, 10 aa, Artificial Sequence
  Peptide Derived from Human Papillomavirus
PPKLRSQTCA

SEQ ID NO: 17331 - protein, 11 aa, Artificial Sequence
  Peptide Derived from Human Papillomavirus
PPKLRSQTCAL

SEQ ID NO: 17332 - protein, 11 aa, Artificial Sequence
  Peptide Derived from Human Papillomavirus
PPLLLTSNTNA

SEQ ID NO: 17333 - protein, 8 aa, Artificial Sequence
  Peptide Derived from Human Papillomavirus
QPLSDAKI

SEQ ID NO: 17334 - protein, 10 aa, Artificial Sequence
  Peptide Derived from Human Papillomavirus
QPLSDAKIGM

SEQ ID NO: 17335 - protein, 11 aa, Artificial Sequence
  Peptide Derived from Human Papillomavirus
QPLSDAKIGMI

SEQ ID NO: 17336 - protein, 9 aa, Artificial Sequence
  Peptide Derived from Human Papillomavirus
RPIVQLLRY

SEQ ID NO: 17337 - protein, 8 aa, Artificial Sequence
  Peptide Derived from Human Papillomavirus
SPSVAESL

SEQ ID NO: 17338 - protein, 10 aa, Artificial Sequence
  Peptide Derived from Human Papillomavirus
SPSVAESLKV

SEQ ID NO: 17339 - protein, 11 aa, Artificial Sequence
  Peptide Derived from Human Papillomavirus
SPSVAESLKVL

SEQ ID NO: 17340 - protein, 8 aa, Artificial Sequence
  Peptide Derived from Human Papillomavirus
TPEWIDRL

SEQ ID NO: 17341 - protein, 10 aa, Artificial Sequence
  Peptide Derived from Human Papillomavirus
TPEWIDRLTV

SEQ ID NO: 17342 - protein, 11 aa, Artificial Sequence
  Peptide Derived from Human Papillomavirus
TPEWIDRLTVL

SEQ ID NO: 17343 - protein, 8 aa, Artificial Sequence
  Peptide Derived from Human Papillomavirus
TPISWTYI

SEQ ID NO: 17344 - protein, 11 aa, Artificial Sequence
  Peptide Derived from Human Papillomavirus
TPISWTYIDDY

SEQ ID NO: 17345 - protein, 8 aa, Artificial Sequence
  Peptide Derived from Human Papillomavirus
WPYLHSRL

SEQ ID NO: 17346 - protein, 10 aa, Artificial Sequence
  Peptide Derived from Human Papillomavirus
WPYLHSRLTV

SEQ ID NO: 17347 - protein, 11 aa, Artificial Sequence
  Peptide Derived from Human Papillomavirus
WPYLHSRLTVF

SEQ ID NO: 17348 - protein, 10 aa, Artificial Sequence
  Peptide Derived from Human Papillomavirus
CPTSISSNQI

SEQ ID NO: 17349 - protein, 9 aa, Artificial Sequence
  Peptide Derived from Human Papillomavirus
DPALDNRTA

SEQ ID NO: 17350 - protein, 11 aa, Artificial Sequence
  Peptide Derived from Human Papillomavirus
IPPTVQISTGF

SEQ ID NO: 17351 - protein, 10 aa, Artificial Sequence
  Peptide Derived from Human Papillomavirus
KPYKELYSSM

SEQ ID NO: 17352 - protein, 8 aa, Artificial Sequence
  Peptide Derived from Human Papillomavirus
LPSQIEHW

SEQ ID NO: 17353 - protein, 10 aa, Artificial Sequence
  Peptide Derived from Human Papillomavirus
LPSQIEHWKL

SEQ ID NO: 17354 - protein, 11 aa, Artificial Sequence
  Peptide Derived from Human Papillomavirus
LPSQIEHWKLI

SEQ ID NO: 17355 - protein, 10 aa, Artificial Sequence
  Peptide Derived from Human Papillomavirus
PPTVQISTGF

SEQ ID NO: 17356 - protein, 11 aa, Artificial Sequence
  Peptide Derived from Human Papillomavirus
PPTVQISTGFM

SEQ ID NO: 17357 - protein, 9 aa, Artificial Sequence
  Peptide Derived from Human Papillomavirus
QPLTKLFCA

SEQ ID NO: 17358 - protein, 9 aa, Artificial Sequence
  Peptide Derived from Human Papillomavirus
RPADTTDTA

SEQ ID NO: 17359 - protein, 11 aa, Artificial Sequence
  Peptide Derived from Human Papillomavirus
VPSLLASKTKA

SEQ ID NO: 17360 - protein, 8 aa, Artificial Sequence
  Peptide Derived from Human Papillomavirus
LPMMCINF

SEQ ID NO: 17361 - protein, 10 aa, Artificial Sequence
  Peptide Derived from Human Papillomavirus
LPMMCINFHA

SEQ ID NO: 17362 - protein, 10 aa, Artificial Sequence
  Peptide Derived from Human Papillomavirus
RPLILSISTY

SEQ ID NO: 17363 - protein, 11 aa, Artificial Sequence
  Peptide Derived from Human Papillomavirus
RPLILSISTYA

SEQ ID NO: 17364 - protein, 9 aa, Artificial Sequence
  Peptide Derived from Human Papillomavirus
SPLKIFFCY

SEQ ID NO: 17365 - protein, 10 aa, Artificial Sequence
  Peptide Derived from Human Papillomavirus
SPLKIFFCYL

SEQ ID NO: 17366 - protein, 11 aa, Artificial Sequence
  Peptide Derived from Human Papillomavirus
SPLKIFFCYLL

SEQ ID NO: 17367 - protein, 9 aa, Artificial Sequence
  Peptide Derived from Human Papillomavirus
CPQEKKRHV

SEQ ID NO: 17368 - protein, 11 aa, Artificial Sequence
  Peptide Derived from Human Papillomavirus
CPQEKKRHVDL

SEQ ID NO: 17369 - protein, 8 aa, Artificial Sequence
  Peptide Derived from Human Papillomavirus
KPLNEILI

SEQ ID NO: 17370 - protein, 11 aa, Artificial Sequence
  Peptide Derived from Human Papillomavirus
KPLNEILIRCI

SEQ ID NO: 17371 - protein, 8 aa, Artificial Sequence
  Peptide Derived from Human Papillomavirus
KPLQRSEV

SEQ ID NO: 17372 - protein, 9 aa, Artificial Sequence
  Peptide Derived from Human Papillomavirus
KPLQRSEVY

SEQ ID NO: 17373 - protein, 11 aa, Artificial Sequence
  Peptide Derived from Human Papillomavirus
KPLQRSEVYDF

SEQ ID NO: 17374 - protein, 8 aa, Artificial Sequence
  Peptide Derived from Human Papillomavirus
KPRTLHDL

SEQ ID NO: 17375 - protein, 11 aa, Artificial Sequence
  Peptide Derived from Human Papillomavirus
KPRTLHDLCQA

SEQ ID NO: 17376 - protein, 8 aa, Artificial Sequence
  Peptide Derived from Human Papillomavirus
NPFGICKL

SEQ ID NO: 17377 - protein, 10 aa, Artificial Sequence
  Peptide Derived from Human Papillomavirus
NPFGICKLCL

SEQ ID NO: 17378 - protein, 8 aa, Artificial Sequence
  Peptide Derived from Human Papillomavirus
EPTDLYCY

SEQ ID NO: 17379 - protein, 11 aa, Artificial Sequence
  Peptide Derived from Human Papillomavirus
EPTDLYCYEQL

SEQ ID NO: 17380 - protein, 8 aa, Artificial Sequence
  Peptide Derived from Human Papillomavirus
KPTLKEYV

SEQ ID NO: 17381 - protein, 9 aa, Artificial Sequence
  Peptide Derived from Human Papillomavirus
KPTLKEYVL

SEQ ID NO: 17382 - protein, 11 aa, Artificial Sequence
  Peptide Derived from Human Papillomavirus
KPTLKEYVLDL

SEQ ID NO: 17383 - protein, 8 aa, Artificial Sequence
  Peptide Derived from Human Papillomavirus
QPATADYY

SEQ ID NO: 17384 - protein, 9 aa, Artificial Sequence
  Peptide Derived from Human Papillomavirus
QPATADYYI

SEQ ID NO: 17385 - protein, 10 aa, Artificial Sequence
  Peptide Derived from Human Papillomavirus
QPATADYYIV

SEQ ID NO: 17386 - protein, 9 aa, Artificial Sequence
  Peptide Derived from Human Papillomavirus
RPDGQAQPA

SEQ ID NO: 17387 - protein, 11 aa, Artificial Sequence
  Peptide Derived from Human Papillomavirus
RPDGQAQPATA

SEQ ID NO: 17388 - protein, 8 aa, Artificial Sequence
  Peptide Derived from Human Papillomavirus
YPEPTDLY

SEQ ID NO: 17389 - protein, 10 aa, Artificial Sequence
  Peptide Derived from Human Papillomavirus
YPEPTDLYCY

SEQ ID NO: 17390 - protein, 9 aa, Artificial Sequence
  Peptide Derived from Human Papillomavirus
APANDCPPL

SEQ ID NO: 17391 - protein, 11 aa, Artificial Sequence
  Peptide Derived from Human Papillomavirus
APANDCPPLEL

SEQ ID NO: 17392 - protein, 10 aa, Artificial Sequence
  Peptide Derived from Human Papillomavirus
APTSTRTSSA

SEQ ID NO: 17393 - protein, 10 aa, Artificial Sequence
  Peptide Derived from Human Papillomavirus
CPPLELINTI

SEQ ID NO: 17394 - protein, 11 aa, Artificial Sequence
  Peptide Derived from Human Papillomavirus
CPPLELINTII

SEQ ID NO: 17395 - protein, 8 aa, Artificial Sequence
  Peptide Derived from Human Papillomavirus
DPLGKYTF

SEQ ID NO: 17396 - protein, 9 aa, Artificial Sequence
  Peptide Derived from Human Papillomavirus
DPLGKYTFW

SEQ ID NO: 17397 - protein, 11 aa, Artificial Sequence
  Peptide Derived from Human Papillomavirus
DPLGKYTFWEV

SEQ ID NO: 17398 - protein, 8 aa, Artificial Sequence
  Peptide Derived from Human Papillomavirus
EPYGDSLF

SEQ ID NO: 17399 - protein, 9 aa, Artificial Sequence
  Peptide Derived from Human Papillomavirus
EPYGDSLFF

SEQ ID NO: 17400 - protein, 10 aa, Artificial Sequence
  Peptide Derived from Human Papillomavirus
EPYGDSLFFF

SEQ ID NO: 17401 - protein, 11 aa, Artificial Sequence
  Peptide Derived from Human Papillomavirus
EPYGDSLFFFL

SEQ ID NO: 17402 - protein, 8 aa, Artificial Sequence
  Peptide Derived from Human Papillomavirus
FPLGRKFL

SEQ ID NO: 17403 - protein, 9 aa, Artificial Sequence
  Peptide Derived from Human Papillomavirus
FPLGRKFLL

SEQ ID NO: 17404 - protein, 11 aa, Artificial Sequence
  Peptide Derived from Human Papillomavirus
FPLGRKFLLQA

SEQ ID NO: 17405 - protein, 8 aa, Artificial Sequence
  Peptide Derived from Human Papillomavirus
FPTPSGSM

SEQ ID NO: 17406 - protein, 9 aa, Artificial Sequence
  Peptide Derived from Human Papillomavirus
FPTPSGSMV

SEQ ID NO: 17407 - protein, 8 aa, Artificial Sequence
  Peptide Derived from Human Papillomavirus
KPKLKRAA

SEQ ID NO: 17408 - protein, 8 aa, Artificial Sequence
  Peptide Derived from Human Papillomavirus
KPPTGEHW

SEQ ID NO: 17409 - protein, 8 aa, Artificial Sequence
  Peptide Derived from Human Papillomavirus
KPYWLQRA

SEQ ID NO: 17410 - protein, 9 aa, Artificial Sequence
  Peptide Derived from Human Papillomavirus
LPDPNKFGF

SEQ ID NO: 17411 - protein, 9 aa, Artificial Sequence
  Peptide Derived from Human Papillomavirus
LPPVPVSKV

SEQ ID NO: 17412 - protein, 10 aa, Artificial Sequence
  Peptide Derived from Human Papillomavirus
LPPVPVSKVV

SEQ ID NO: 17413 - protein, 8 aa, Artificial Sequence
  Peptide Derived from Human Papillomavirus
NPDILEDW

SEQ ID NO: 17414 - protein, 10 aa, Artificial Sequence
  Peptide Derived from Human Papillomavirus
NPDILEDWQF

SEQ ID NO: 17415 - protein, 8 aa, Artificial Sequence
  Peptide Derived from Human Papillomavirus
NPDTQRLV

SEQ ID NO: 17416 - protein, 9 aa, Artificial Sequence
  Peptide Derived from Human Papillomavirus
NPDTQRLVW

SEQ ID NO: 17417 - protein, 10 aa, Artificial Sequence
  Peptide Derived from Human Papillomavirus
NPDTQRLVWA

SEQ ID NO: 17418 - protein, 8 aa, Artificial Sequence
  Peptide Derived from Human Papillomavirus
NPTNAKKL

SEQ ID NO: 17419 - protein, 9 aa, Artificial Sequence
  Peptide Derived from Human Papillomavirus
NPTNAKKLL

SEQ ID NO: 17420 - protein, 10 aa, Artificial Sequence
  Peptide Derived from Human Papillomavirus
NPTNAKKLLV

SEQ ID NO: 17421 - protein, 9 aa, Artificial Sequence
  Peptide Derived from Human Papillomavirus
PPKEKEDPL

SEQ ID NO: 17422 - protein, 9 aa, Artificial Sequence
  Peptide Derived from Human Papillomavirus
PPLELINTI

SEQ ID NO: 17423 - protein, 10 aa, Artificial Sequence
  Peptide Derived from Human Papillomavirus
PPLELINTII

SEQ ID NO: 17424 - protein, 11 aa, Artificial Sequence
  Peptide Derived from Human Papillomavirus
PPPSASLQDTY

SEQ ID NO: 17425 - protein, 10 aa, Artificial Sequence
  Peptide Derived from Human Papillomavirus
PPSASLQDTY

SEQ ID NO: 17426 - protein, 11 aa, Artificial Sequence
  Peptide Derived from Human Papillomavirus
PPTGEHWGKGV

SEQ ID NO: 17427 - protein, 8 aa, Artificial Sequence
  Peptide Derived from Human Papillomavirus
PPVPVSKV

SEQ ID NO: 17428 - protein, 9 aa, Artificial Sequence
  Peptide Derived from Human Papillomavirus
PPVPVSKVV

SEQ ID NO: 17429 - protein, 10 aa, Artificial Sequence
  Peptide Derived from Human Papillomavirus
QPGADNRECL

SEQ ID NO: 17430 - protein, 8 aa, Artificial Sequence
  Peptide Derived from Human Papillomavirus
RPSEATVY

SEQ ID NO: 17431 - protein, 9 aa, Artificial Sequence
  Peptide Derived from Human Papillomavirus
RPSEATVYL

SEQ ID NO: 17432 - protein, 8 aa, Artificial Sequence
  Peptide Derived from Human Papillomavirus
TPPPSASL

SEQ ID NO: 17433 - protein, 9 aa, Artificial Sequence
  Peptide Derived from Human Papillomavirus
VPKVSGLQY

SEQ ID NO: 17434 - protein, 11 aa, Artificial Sequence
  Peptide Derived from Human Papillomavirus
VPKVSGLQYRV

SEQ ID NO: 17435 - protein, 10 aa, Artificial Sequence
  Peptide Derived from Human Papillomavirus
VPPKEKEDPL

SEQ ID NO: 17436 - protein, 9 aa, Artificial Sequence
  Peptide Derived from Human Papillomavirus
APAEASGHF

SEQ ID NO: 17437 - protein, 10 aa, Artificial Sequence
  Peptide Derived from Human Papillomavirus
APAEASGHFI

SEQ ID NO: 17438 - protein, 11 aa, Artificial Sequence
  Peptide Derived from Human Papillomavirus
APAEASGHFIF

SEQ ID NO: 17439 - protein, 9 aa, Artificial Sequence
  Peptide Derived from Human Papillomavirus
APDPDFLDI

SEQ ID NO: 17440 - protein, 10 aa, Artificial Sequence
  Peptide Derived from Human Papillomavirus
APDPDFLDII

SEQ ID NO: 17441 - protein, 11 aa, Artificial Sequence
  Peptide Derived from Human Papillomavirus
APDPDFLDIIA

SEQ ID NO: 17442 - protein, 10 aa, Artificial Sequence
  Peptide Derived from Human Papillomavirus
APSIPTPSGF

SEQ ID NO: 17443 - protein, 9 aa, Artificial Sequence
  Peptide Derived from Human Papillomavirus
CPPDVIPKV

SEQ ID NO: 17444 - protein, 11 aa, Artificial Sequence
  Peptide Derived from Human Papillomavirus
DPAFLTSPHKL

SEQ ID NO: 17445 - protein, 8 aa, Artificial Sequence
  Peptide Derived from Human Papillomavirus
DPDFLDII

SEQ ID NO: 17446 - protein, 9 aa, Artificial Sequence
  Peptide Derived from Human Papillomavirus
DPDFLDIIA

SEQ ID NO: 17447 - protein, 10 aa, Artificial Sequence
  Peptide Derived from Human Papillomavirus
DPDFLDIIAL

SEQ ID NO: 17448 - protein, 8 aa, Artificial Sequence
  Peptide Derived from Human Papillomavirus
DPEDTLQF

SEQ ID NO: 17449 - protein, 9 aa, Artificial Sequence
  Peptide Derived from Human Papillomavirus
DPPTAAIPL

SEQ ID NO: 17450 - protein, 9 aa, Artificial Sequence
  Peptide Derived from Human Papillomavirus
EPSVLHPPA

SEQ ID NO: 17451 - protein, 11 aa, Artificial Sequence
  Peptide Derived from Human Papillomavirus
EPSVLHPPAPA

SEQ ID NO: 17452 - protein, 8 aa, Artificial Sequence
  Peptide Derived from Human Papillomavirus
FPFDTIVV

SEQ ID NO: 17453 - protein, 11 aa, Artificial Sequence
  Peptide Derived from Human Papillomavirus
FPFDTIVVDGA

SEQ ID NO: 17454 - protein, 8 aa, Artificial Sequence
  Peptide Derived from Human Papillomavirus
FPTSSPFV

SEQ ID NO: 17455 - protein, 10 aa, Artificial Sequence
  Peptide Derived from Human Papillomavirus
FPTSSPFVPI

SEQ ID NO: 17456 - protein, 8 aa, Artificial Sequence
  Peptide Derived from Human Papillomavirus
FPYFFTDV

SEQ ID NO: 17457 - protein, 10 aa, Artificial Sequence
  Peptide Derived from Human Papillomavirus
FPYFFTDVRV

SEQ ID NO: 17458 - protein, 11 aa, Artificial Sequence
  Peptide Derived from Human Papillomavirus
FPYFFTDVRVA

SEQ ID NO: 17459 - protein, 8 aa, Artificial Sequence
  Peptide Derived from Human Papillomavirus
GPDIPSPL

SEQ ID NO: 17460 - protein, 9 aa, Artificial Sequence
  Peptide Derived from Human Papillomavirus
GPDIPSPLF

SEQ ID NO: 17461 - protein, 8 aa, Artificial Sequence
  Peptide Derived from Human Papillomavirus
GPLDSSIV

SEQ ID NO: 17462 - protein, 10 aa, Artificial Sequence
  Peptide Derived from Human Papillomavirus
GPLDSSIVSL

SEQ ID NO: 17463 - protein, 11 aa, Artificial Sequence
  Peptide Derived from Human Papillomavirus
GPLDSSIVSLI

SEQ ID NO: 17464 - protein, 8 aa, Artificial Sequence
  Peptide Derived from Human Papillomavirus
HPPAPAEA

SEQ ID NO: 17465 - protein, 8 aa, Artificial Sequence
  Peptide Derived from Human Papillomavirus
IPGSRPVA

SEQ ID NO: 17466 - protein, 10 aa, Artificial Sequence
  Peptide Derived from Human Papillomavirus
IPGSRPVARL

SEQ ID NO: 17467 - protein, 9 aa, Artificial Sequence
  Peptide Derived from Human Papillomavirus
IPKVEGSTI

SEQ ID NO: 17468 - protein, 10 aa, Artificial Sequence
  Peptide Derived from Human Papillomavirus
IPKVEGSTIA

SEQ ID NO: 17469 - protein, 11 aa, Artificial Sequence
  Peptide Derived from Human Papillomavirus
IPLNTGFDTPV

SEQ ID NO: 17470 - protein, 10 aa, Artificial Sequence
  Peptide Derived from Human Papillomavirus
IPLQPIRPPV

SEQ ID NO: 17471 - protein, 8 aa, Artificial Sequence
  Peptide Derived from Human Papillomavirus
IPMDTFVV

SEQ ID NO: 17472 - protein, 9 aa, Artificial Sequence
  Peptide Derived from Human Papillomavirus
IPTPSGFDV

SEQ ID NO: 17473 - protein, 9 aa, Artificial Sequence
  Peptide Derived from Human Papillomavirus
NPTFTEPSV

SEQ ID NO: 17474 - protein, 10 aa, Artificial Sequence
  Peptide Derived from Human Papillomavirus
NPTFTEPSVL

SEQ ID NO: 17475 - protein, 11 aa, Artificial Sequence
  Peptide Derived from Human Papillomavirus
PPAPAEASGHF

SEQ ID NO: 17476 - protein, 8 aa, Artificial Sequence
  Peptide Derived from Human Papillomavirus
PPDVIPKV

SEQ ID NO: 17477 - protein, 8 aa, Artificial Sequence
  Peptide Derived from Human Papillomavirus
PPTAAIPL

SEQ ID NO: 17478 - protein, 11 aa, Artificial Sequence
  Peptide Derived from Human Papillomavirus
PPTAAIPLQPI

SEQ ID NO: 17479 - protein, 8 aa, Artificial Sequence
  Peptide Derived from Human Papillomavirus
PPVTVDTV

SEQ ID NO: 17480 - protein, 11 aa, Artificial Sequence
  Peptide Derived from Human Papillomavirus
PPVTVDTVGPL

SEQ ID NO: 17481 - protein, 9 aa, Artificial Sequence
  Peptide Derived from Human Papillomavirus
QPIRPPVTV

SEQ ID NO: 17482 - protein, 11 aa, Artificial Sequence
  Peptide Derived from Human Papillomavirus
QPLHDTSTSSY

SEQ ID NO: 17483 - protein, 11 aa, Artificial Sequence
  Peptide Derived from Human Papillomavirus
RPAITSRRHTV

SEQ ID NO: 17484 - protein, 9 aa, Artificial Sequence
  Peptide Derived from Human Papillomavirus
RPPVTVDTV

SEQ ID NO: 17485 - protein, 8 aa, Artificial Sequence
  Peptide Derived from Human Papillomavirus
RPVARLGL

SEQ ID NO: 17486 - protein, 9 aa, Artificial Sequence
  Peptide Derived from Human Papillomavirus
RPVARLGLY

SEQ ID NO: 17487 - protein, 8 aa, Artificial Sequence
  Peptide Derived from Human Papillomavirus
SPAPDPDF

SEQ ID NO: 17488 - protein, 9 aa, Artificial Sequence
  Peptide Derived from Human Papillomavirus
SPAPDPDFL

SEQ ID NO: 17489 - protein, 11 aa, Artificial Sequence
  Peptide Derived from Human Papillomavirus
SPAPDPDFLDI

SEQ ID NO: 17490 - protein, 9 aa, Artificial Sequence
  Peptide Derived from Human Papillomavirus
SPFFPFDTI

SEQ ID NO: 17491 - protein, 10 aa, Artificial Sequence
  Peptide Derived from Human Papillomavirus
SPFFPFDTIV

SEQ ID NO: 17492 - protein, 11 aa, Artificial Sequence
  Peptide Derived from Human Papillomavirus
SPFFPFDTIVV

SEQ ID NO: 17493 - protein, 9 aa, Artificial Sequence
  Peptide Derived from Human Papillomavirus
SPFVPISPF

SEQ ID NO: 17494 - protein, 10 aa, Artificial Sequence
  Peptide Derived from Human Papillomavirus
SPFVPISPFF

SEQ ID NO: 17495 - protein, 8 aa, Artificial Sequence
  Peptide Derived from Human Papillomavirus
SPHKLITY

SEQ ID NO: 17496 - protein, 10 aa, Artificial Sequence
  Peptide Derived from Human Papillomavirus
SPIVPLDHTV

SEQ ID NO: 17497 - protein, 10 aa, Artificial Sequence
  Peptide Derived from Human Papillomavirus
SPLFPTSSPF

SEQ ID NO: 17498 - protein, 11 aa, Artificial Sequence
  Peptide Derived from Human Papillomavirus
SPLFPTSSPFV

SEQ ID NO: 17499 - protein, 9 aa, Artificial Sequence
  Peptide Derived from Human Papillomavirus
SPTVSTQSY

SEQ ID NO: 17500 - protein, 10 aa, Artificial Sequence
  Peptide Derived from Human Papillomavirus
TPAIINVSSV

SEQ ID NO: 17501 - protein, 9 aa, Artificial Sequence
  Peptide Derived from Human Papillomavirus
TPIPGSRPV

SEQ ID NO: 17502 - protein, 10 aa, Artificial Sequence
  Peptide Derived from Human Papillomavirus
TPIPGSRPVA

SEQ ID NO: 17503 - protein, 10 aa, Artificial Sequence
  Peptide Derived from Human Papillomavirus
TPMQHSYSTF

SEQ ID NO: 17504 - protein, 11 aa, Artificial Sequence
  Peptide Derived from Human Papillomavirus
TPMQHSYSTFA

SEQ ID NO: 17505 - protein, 11 aa, Artificial Sequence
  Peptide Derived from Human Papillomavirus
TPSGFDVTTSA

SEQ ID NO: 17506 - protein, 9 aa, Artificial Sequence
  Peptide Derived from Human Papillomavirus
TPVMSGPDI

SEQ ID NO: 17507 - protein, 10 aa, Artificial Sequence
  Peptide Derived from Human Papillomavirus
VPIGTDPPTA

SEQ ID NO: 17508 - protein, 11 aa, Artificial Sequence
  Peptide Derived from Human Papillomavirus
VPIGTDPPTAA

SEQ ID NO: 17509 - protein, 9 aa, Artificial Sequence
  Peptide Derived from Human Papillomavirus
VPISPFFPF

SEQ ID NO: 17510 - protein, 8 aa, Artificial Sequence
  Peptide Derived from Human Papillomavirus
VPNEQYEL

SEQ ID NO: 17511 - protein, 11 aa, Artificial Sequence
  Peptide Derived from Human Papillomavirus
VPNEQYELQPL

SEQ ID NO: 17512 - protein, 10 aa, Artificial Sequence
  Peptide Derived from Human Papillomavirus
CPPILLTSNI

SEQ ID NO: 17513 - protein, 8 aa, Artificial Sequence
  Peptide Derived from Human Papillomavirus
DPAKDNKW

SEQ ID NO: 17514 - protein, 10 aa, Artificial Sequence
  Peptide Derived from Human Papillomavirus
DPAKDNKWPY

SEQ ID NO: 17515 - protein, 11 aa, Artificial Sequence
  Peptide Derived from Human Papillomavirus
DPAKDNKWPYL

SEQ ID NO: 17516 - protein, 9 aa, Artificial Sequence
  Peptide Derived from Human Papillomavirus
DPHCSITEL

SEQ ID NO: 17517 - protein, 8 aa, Artificial Sequence
  Peptide Derived from Human Papillomavirus
EPLADTKV

SEQ ID NO: 17518 - protein, 9 aa, Artificial Sequence
  Peptide Derived from Human Papillomavirus
EPLADTKVA

SEQ ID NO: 17519 - protein, 10 aa, Artificial Sequence
  Peptide Derived from Human Papillomavirus
EPLADTKVAM

SEQ ID NO: 17520 - protein, 11 aa, Artificial Sequence
  Peptide Derived from Human Papillomavirus
EPLADTKVAML

SEQ ID NO: 17521 - protein, 9 aa, Artificial Sequence
  Peptide Derived from Human Papillomavirus
EPPKLRSSV

SEQ ID NO: 17522 - protein, 10 aa, Artificial Sequence
  Peptide Derived from Human Papillomavirus
EPPKLRSSVA

SEQ ID NO: 17523 - protein, 11 aa, Artificial Sequence
  Peptide Derived from Human Papillomavirus
EPPKLRSSVAA

SEQ ID NO: 17524 - protein, 10 aa, Artificial Sequence
  Peptide Derived from Human Papillomavirus
FPFDKNGNPV

SEQ ID NO: 17525 - protein, 11 aa, Artificial Sequence
  Peptide Derived from Human Papillomavirus
FPFDKNGNPVY

SEQ ID NO: 17526 - protein, 9 aa, Artificial Sequence
  Peptide Derived from Human Papillomavirus
GPANTGKSY

SEQ ID NO: 17527 - protein, 10 aa, Artificial Sequence
  Peptide Derived from Human Papillomavirus
GPANTGKSYF

SEQ ID NO: 17528 - protein, 9 aa, Artificial Sequence
  Peptide Derived from Human Papillomavirus
IPFGTFKCV

SEQ ID NO: 17529 - protein, 9 aa, Artificial Sequence
  Peptide Derived from Human Papillomavirus
KPATLYAHI

SEQ ID NO: 17530 - protein, 11 aa, Artificial Sequence
  Peptide Derived from Human Papillomavirus
KPLLQLKCPPI

SEQ ID NO: 17531 - protein, 8 aa, Artificial Sequence
  Peptide Derived from Human Papillomavirus
NPTVAEGF

SEQ ID NO: 17532 - protein, 11 aa, Artificial Sequence
  Peptide Derived from Human Papillomavirus
NPTVAEGFKTL

SEQ ID NO: 17533 - protein, 11 aa, Artificial Sequence
  Peptide Derived from Human Papillomavirus
NPVYEINDKNW

SEQ ID NO: 17534 - protein, 9 aa, Artificial Sequence
  Peptide Derived from Human Papillomavirus
PPILLTSNI

SEQ ID NO: 17535 - protein, 8 aa, Artificial Sequence
  Peptide Derived from Human Papillomavirus
PPKLRSSV

SEQ ID NO: 17536 - protein, 9 aa, Artificial Sequence
  Peptide Derived from Human Papillomavirus
PPKLRSSVA

SEQ ID NO: 17537 - protein, 10 aa, Artificial Sequence
  Peptide Derived from Human Papillomavirus
PPKLRSSVAA

SEQ ID NO: 17538 - protein, 11 aa, Artificial Sequence
  Peptide Derived from Human Papillomavirus
PPKLRSSVAAL

SEQ ID NO: 17539 - protein, 9 aa, Artificial Sequence
  Peptide Derived from Human Papillomavirus
RPIVQFLRY

SEQ ID NO: 17540 - protein, 9 aa, Artificial Sequence
  Peptide Derived from Human Papillomavirus
SPLGEQLSV

SEQ ID NO: 17541 - protein, 9 aa, Artificial Sequence
  Peptide Derived from Human Papillomavirus
SPRLQEISL

SEQ ID NO: 17542 - protein, 8 aa, Artificial Sequence
  Peptide Derived from Human Papillomavirus
TPEWIQRL

SEQ ID NO: 17543 - protein, 10 aa, Artificial Sequence
  Peptide Derived from Human Papillomavirus
TPEWIQRLTI

SEQ ID NO: 17544 - protein, 11 aa, Artificial Sequence
  Peptide Derived from Human Papillomavirus
TPEWIQRLTII

SEQ ID NO: 17545 - protein, 8 aa, Artificial Sequence
  Peptide Derived from Human Papillomavirus
TPKKNCIL

SEQ ID NO: 17546 - protein, 9 aa, Artificial Sequence
  Peptide Derived from Human Papillomavirus
TPKKNCILL

SEQ ID NO: 17547 - protein, 10 aa, Artificial Sequence
  Peptide Derived from Human Papillomavirus
TPKKNCILLY

SEQ ID NO: 17548 - protein, 8 aa, Artificial Sequence
  Peptide Derived from Human Papillomavirus
VPETCMLI

SEQ ID NO: 17549 - protein, 8 aa, Artificial Sequence
  Peptide Derived from Human Papillomavirus
WPYLESRV

SEQ ID NO: 17550 - protein, 10 aa, Artificial Sequence
  Peptide Derived from Human Papillomavirus
WPYLESRVTV

SEQ ID NO: 17551 - protein, 11 aa, Artificial Sequence
  Peptide Derived from Human Papillomavirus
WPYLESRVTVF

SEQ ID NO: 17552 - protein, 9 aa, Artificial Sequence
  Peptide Derived from Human Papillomavirus
IPNSVQISV

SEQ ID NO: 17553 - protein, 11 aa, Artificial Sequence
  Peptide Derived from Human Papillomavirus
IPNSVQISVGY

SEQ ID NO: 17554 - protein, 8 aa, Artificial Sequence
  Peptide Derived from Human Papillomavirus
KPHIQTPA

SEQ ID NO: 17555 - protein, 10 aa, Artificial Sequence
  Peptide Derived from Human Papillomavirus
PPINISKSKA

SEQ ID NO: 17556 - protein, 10 aa, Artificial Sequence
  Peptide Derived from Human Papillomavirus
TPKESLSERL

SEQ ID NO: 17557 - protein, 10 aa, Artificial Sequence
  Peptide Derived from Human Papillomavirus
TPKPHIQTPA

SEQ ID NO: 17558 - protein, 11 aa, Artificial Sequence
  Peptide Derived from Human Papillomavirus
VPPINISKSKA

SEQ ID NO: 17559 - protein, 9 aa, Artificial Sequence
  Peptide Derived from Human Papillomavirus
DPTQRPYKL

SEQ ID NO: 17560 - protein, 8 aa, Artificial Sequence
  Peptide Derived from Human Papillomavirus
LPDLCTEL

SEQ ID NO: 17561 - protein, 9 aa, Artificial Sequence
  Peptide Derived from Human Papillomavirus
NPAEKRRHL

SEQ ID NO: 17562 - protein, 8 aa, Artificial Sequence
  Peptide Derived from Human Papillomavirus
RPYKLPDL

SEQ ID NO: 17563 - protein, 8 aa, Artificial Sequence
  Peptide Derived from Human Papillomavirus
DPVDLLCY

SEQ ID NO: 17564 - protein, 11 aa, Artificial Sequence
  Peptide Derived from Human Papillomavirus
DPVDLLCYEQL

SEQ ID NO: 17565 - protein, 9 aa, Artificial Sequence
  Peptide Derived from Human Papillomavirus
EPQNELDPV

SEQ ID NO: 17566 - protein, 11 aa, Artificial Sequence
  Peptide Derived from Human Papillomavirus
EPQNELDPVDL

SEQ ID NO: 17567 - protein, 8 aa, Artificial Sequence
  Peptide Derived from Human Papillomavirus
EPQRHKIL

SEQ ID NO: 17568 - protein, 10 aa, Artificial Sequence
  Peptide Derived from Human Papillomavirus
EPQRHKILCV

SEQ ID NO: 17569 - protein, 9 aa, Artificial Sequence
  Peptide Derived from Human Papillomavirus
GPRATLQEI

SEQ ID NO: 17570 - protein, 10 aa, Artificial Sequence
  Peptide Derived from Human Papillomavirus
GPRATLQEIV

SEQ ID NO: 17571 - protein, 11 aa, Artificial Sequence
  Peptide Derived from Human Papillomavirus
GPRATLQEIVL

SEQ ID NO: 17572 - protein, 10 aa, Artificial Sequence
  Peptide Derived from Human Papillomavirus
CPPLELKNTI

SEQ ID NO: 17573 - protein, 11 aa, Artificial Sequence
  Peptide Derived from Human Papillomavirus
CPPLELKNTII

SEQ ID NO: 17574 - protein, 8 aa, Artificial Sequence
  Peptide Derived from Human Papillomavirus
DPTKFKHY

SEQ ID NO: 17575 - protein, 8 aa, Artificial Sequence
  Peptide Derived from Human Papillomavirus
DPYDKLKF

SEQ ID NO: 17576 - protein, 9 aa, Artificial Sequence
  Peptide Derived from Human Papillomavirus
DPYDKLKFW

SEQ ID NO: 17577 - protein, 11 aa, Artificial Sequence
  Peptide Derived from Human Papillomavirus
DPYDKLKFWTV

SEQ ID NO: 17578 - protein, 8 aa, Artificial Sequence
  Peptide Derived from Human Papillomavirus
DPYGDSMF

SEQ ID NO: 17579 - protein, 9 aa, Artificial Sequence
  Peptide Derived from Human Papillomavirus
DPYGDSMFF

SEQ ID NO: 17580 - protein, 11 aa, Artificial Sequence
  Peptide Derived from Human Papillomavirus
DPYGDSMFFCL

SEQ ID NO: 17581 - protein, 8 aa, Artificial Sequence
  Peptide Derived from Human Papillomavirus
FPIFLQMA

SEQ ID NO: 17582 - protein, 9 aa, Artificial Sequence
  Peptide Derived from Human Papillomavirus
FPIFLQMAL

SEQ ID NO: 17583 - protein, 10 aa, Artificial Sequence
  Peptide Derived from Human Papillomavirus
FPIFLQMALW

SEQ ID NO: 17584 - protein, 8 aa, Artificial Sequence
  Peptide Derived from Human Papillomavirus
GPRKRPAA

SEQ ID NO: 17585 - protein, 8 aa, Artificial Sequence
  Peptide Derived from Human Papillomavirus
KPYWLHKA

SEQ ID NO: 17586 - protein, 9 aa, Artificial Sequence
  Peptide Derived from Human Papillomavirus
LPDPNKFGL

SEQ ID NO: 17587 - protein, 9 aa, Artificial Sequence
  Peptide Derived from Human Papillomavirus
LPPPSVARV

SEQ ID NO: 17588 - protein, 10 aa, Artificial Sequence
  Peptide Derived from Human Papillomavirus
LPPPSVARVV

SEQ ID NO: 17589 - protein, 8 aa, Artificial Sequence
  Peptide Derived from Human Papillomavirus
NPETQRLV

SEQ ID NO: 17590 - protein, 9 aa, Artificial Sequence
  Peptide Derived from Human Papillomavirus
NPETQRLVW

SEQ ID NO: 17591 - protein, 10 aa, Artificial Sequence
  Peptide Derived from Human Papillomavirus
NPETQRLVWA

SEQ ID NO: 17592 - protein, 11 aa, Artificial Sequence
  Peptide Derived from Human Papillomavirus
NPYFRVVPSGA

SEQ ID NO: 17593 - protein, 8 aa, Artificial Sequence
  Peptide Derived from Human Papillomavirus
PPEKQDPY

SEQ ID NO: 17594 - protein, 11 aa, Artificial Sequence
  Peptide Derived from Human Papillomavirus
PPEKQDPYDKL

SEQ ID NO: 17595 - protein, 9 aa, Artificial Sequence
  Peptide Derived from Human Papillomavirus
PPLELKNTI

SEQ ID NO: 17596 - protein, 10 aa, Artificial Sequence
  Peptide Derived from Human Papillomavirus
PPLELKNTII

SEQ ID NO: 17597 - protein, 8 aa, Artificial Sequence
  Peptide Derived from Human Papillomavirus
PPPPTTSL

SEQ ID NO: 17598 - protein, 9 aa, Artificial Sequence
  Peptide Derived from Human Papillomavirus
PPPPTTSLV

SEQ ID NO: 17599 - protein, 8 aa, Artificial Sequence
  Peptide Derived from Human Papillomavirus
PPPSVARV

SEQ ID NO: 17600 - protein, 9 aa, Artificial Sequence
  Peptide Derived from Human Papillomavirus
PPPSVARVV

SEQ ID NO: 17601 - protein, 8 aa, Artificial Sequence
  Peptide Derived from Human Papillomavirus
PPPTTSLV

SEQ ID NO: 17602 - protein, 11 aa, Artificial Sequence
  Peptide Derived from Human Papillomavirus
PPPTTSLVDTY

SEQ ID NO: 17603 - protein, 8 aa, Artificial Sequence
  Peptide Derived from Human Papillomavirus
PPSVARVV

SEQ ID NO: 17604 - protein, 10 aa, Artificial Sequence
  Peptide Derived from Human Papillomavirus
PPTTSLVDTY

SEQ ID NO: 17605 - protein, 8 aa, Artificial Sequence
  Peptide Derived from Human Papillomavirus
QPGDCPPL

SEQ ID NO: 17606 - protein, 10 aa, Artificial Sequence
  Peptide Derived from Human Papillomavirus
QPGDCPPLEL

SEQ ID NO: 17607 - protein, 9 aa, Artificial Sequence
  Peptide Derived from Human Papillomavirus
RPAASTSTA

SEQ ID NO: 17608 - protein, 8 aa, Artificial Sequence
  Peptide Derived from Human Papillomavirus
RPAKRVRI

SEQ ID NO: 17609 - protein, 8 aa, Artificial Sequence
  Peptide Derived from Human Papillomavirus
RPSDSTVY

SEQ ID NO: 17610 - protein, 9 aa, Artificial Sequence
  Peptide Derived from Human Papillomavirus
RPSDSTVYL

SEQ ID NO: 17611 - protein, 11 aa, Artificial Sequence
  Peptide Derived from Human Papillomavirus
RPTIGPRKRPA

SEQ ID NO: 17612 - protein, 8 aa, Artificial Sequence
  Peptide Derived from Human Papillomavirus
SPSPSGSI

SEQ ID NO: 17613 - protein, 9 aa, Artificial Sequence
  Peptide Derived from Human Papillomavirus
TPPEKQDPY

SEQ ID NO: 17614 - protein, 8 aa, Artificial Sequence
  Peptide Derived from Human Papillomavirus
VPAIGEHW

SEQ ID NO: 17615 - protein, 9 aa, Artificial Sequence
  Peptide Derived from Human Papillomavirus
VPAIGEHWA

SEQ ID NO: 17616 - protein, 9 aa, Artificial Sequence
  Peptide Derived from Human Papillomavirus
VPKVSAYQY

SEQ ID NO: 17617 - protein, 11 aa, Artificial Sequence
  Peptide Derived from Human Papillomavirus
VPKVSAYQYRV

SEQ ID NO: 17618 - protein, 9 aa, Artificial Sequence
  Peptide Derived from Human Papillomavirus
VPLDICQSI

SEQ ID NO: 17619 - protein, 10 aa, Artificial Sequence
  Peptide Derived from Human Papillomavirus
VPNTYDPTKF

SEQ ID NO: 17620 - protein, 9 aa, Artificial Sequence
  Peptide Derived from Human Papillomavirus
VPPPPTTSL

SEQ ID NO: 17621 - protein, 10 aa, Artificial Sequence
  Peptide Derived from Human Papillomavirus
VPPPPTTSLV

SEQ ID NO: 17622 - protein, 10 aa, Artificial Sequence
  Peptide Derived from Human Papillomavirus
VPSGAGNKQA

SEQ ID NO: 17623 - protein, 11 aa, Artificial Sequence
  Peptide Derived from Human Papillomavirus
VPSGAGNKQAV

SEQ ID NO: 17624 - protein, 9 aa, Artificial Sequence
  Peptide Derived from Human Papillomavirus
YPDYLQMSA

SEQ ID NO: 17625 - protein, 8 aa, Artificial Sequence
  Peptide Derived from Human Papillomavirus
YPLGRKFL

SEQ ID NO: 17626 - protein, 9 aa, Artificial Sequence
  Peptide Derived from Human Papillomavirus
YPLGRKFLV

SEQ ID NO: 17627 - protein, 11 aa, Artificial Sequence
  Peptide Derived from Human Papillomavirus
YPLGRKFLVQA

SEQ ID NO: 17628 - protein, 9 aa, Artificial Sequence
  Peptide Derived from Human Papillomavirus
CPPDVINKV

SEQ ID NO: 17629 - protein, 8 aa, Artificial Sequence
  Peptide Derived from Human Papillomavirus
DPSIVTLV

SEQ ID NO: 17630 - protein, 8 aa, Artificial Sequence
  Peptide Derived from Human Papillomavirus
EPISSTPL

SEQ ID NO: 17631 - protein, 11 aa, Artificial Sequence
  Peptide Derived from Human Papillomavirus
EPISSTPLPTV

SEQ ID NO: 17632 - protein, 9 aa, Artificial Sequence
  Peptide Derived from Human Papillomavirus
EPLDTTLSF

SEQ ID NO: 17633 - protein, 11 aa, Artificial Sequence
  Peptide Derived from Human Papillomavirus
EPTSNVPDSDF

SEQ ID NO: 17634 - protein, 10 aa, Artificial Sequence
  Peptide Derived from Human Papillomavirus
EPVGPTDPSI

SEQ ID NO: 17635 - protein, 11 aa, Artificial Sequence
  Peptide Derived from Human Papillomavirus
EPVGPTDPSIV

SEQ ID NO: 17636 - protein, 8 aa, Artificial Sequence
  Peptide Derived from Human Papillomavirus
FPKKRKRI

SEQ ID NO: 17637 - protein, 10 aa, Artificial Sequence
  Peptide Derived from Human Papillomavirus
FPKKRKRIPY

SEQ ID NO: 17638 - protein, 11 aa, Artificial Sequence
  Peptide Derived from Human Papillomavirus
FPKKRKRIPYF

SEQ ID NO: 17639 - protein, 8 aa, Artificial Sequence
  Peptide Derived from Human Papillomavirus
GPRLYSRA

SEQ ID NO: 17640 - protein, 8 aa, Artificial Sequence
  Peptide Derived from Human Papillomavirus
GPTDPSIV

SEQ ID NO: 17641 - protein, 10 aa, Artificial Sequence
  Peptide Derived from Human Papillomavirus
GPTDPSIVTL

SEQ ID NO: 17642 - protein, 11 aa, Artificial Sequence
  Peptide Derived from Human Papillomavirus
GPTDPSIVTLV

SEQ ID NO: 17643 - protein, 8 aa, Artificial Sequence
  Peptide Derived from Human Papillomavirus
GPTRPPVV

SEQ ID NO: 17644 - protein, 9 aa, Artificial Sequence
  Peptide Derived from Human Papillomavirus
GPTRPPVVI

SEQ ID NO: 17645 - protein, 8 aa, Artificial Sequence
  Peptide Derived from Human Papillomavirus
HPSSLVTF

SEQ ID NO: 17646 - protein, 9 aa, Artificial Sequence
  Peptide Derived from Human Papillomavirus
IPYFFADGF

SEQ ID NO: 17647 - protein, 10 aa, Artificial Sequence
  Peptide Derived from Human Papillomavirus
IPYFFADGFV

SEQ ID NO: 17648 - protein, 11 aa, Artificial Sequence
  Peptide Derived from Human Papillomavirus
IPYFFADGFVA

SEQ ID NO: 17649 - protein, 8 aa, Artificial Sequence
  Peptide Derived from Human Papillomavirus
LPSHTPMW

SEQ ID NO: 17650 - protein, 9 aa, Artificial Sequence
  Peptide Derived from Human Papillomavirus
MPSTAASSY

SEQ ID NO: 17651 - protein, 9 aa, Artificial Sequence
  Peptide Derived from Human Papillomavirus
NPAFSDPSI

SEQ ID NO: 17652 - protein, 10 aa, Artificial Sequence
  Peptide Derived from Human Papillomavirus
NPAFSDPSII

SEQ ID NO: 17653 - protein, 11 aa, Artificial Sequence
  Peptide Derived from Human Papillomavirus
NPAYEPLDTTL

SEQ ID NO: 17654 - protein, 10 aa, Artificial Sequence
  Peptide Derived from Human Papillomavirus
PPASTTPSTI

SEQ ID NO: 17655 - protein, 8 aa, Artificial Sequence
  Peptide Derived from Human Papillomavirus
PPDVINKV

SEQ ID NO: 17656 - protein, 11 aa, Artificial Sequence
  Peptide Derived from Human Papillomavirus
PPPASTTPSTI

SEQ ID NO: 17657 - protein, 8 aa, Artificial Sequence
  Peptide Derived from Human Papillomavirus
PPVVIEPV

SEQ ID NO: 17658 - protein, 11 aa, Artificial Sequence
  Peptide Derived from Human Papillomavirus
RPALSSRRGTV

SEQ ID NO: 17659 - protein, 9 aa, Artificial Sequence
  Peptide Derived from Human Papillomavirus
RPPVVIEPV

SEQ ID NO: 17660 - protein, 9 aa, Artificial Sequence
  Peptide Derived from Human Papillomavirus
SPIAATEEI

SEQ ID NO: 17661 - protein, 11 aa, Artificial Sequence
  Peptide Derived from Human Papillomavirus
SPIAATEEIEL

SEQ ID NO: 17662 - protein, 10 aa, Artificial Sequence
  Peptide Derived from Human Papillomavirus
SPTNASTTTY

SEQ ID NO: 17663 - protein, 11 aa, Artificial Sequence
  Peptide Derived from Human Papillomavirus
SPTNASTTTYI

SEQ ID NO: 17664 - protein, 11 aa, Artificial Sequence
  Peptide Derived from Human Papillomavirus
TPAVLDITPTV

SEQ ID NO: 17665 - protein, 9 aa, Artificial Sequence
  Peptide Derived from Human Papillomavirus
TPLPTVRRV

SEQ ID NO: 17666 - protein, 9 aa, Artificial Sequence
  Peptide Derived from Human Papillomavirus
TPSTIHKSF

SEQ ID NO: 17667 - protein, 11 aa, Artificial Sequence
  Peptide Derived from Human Papillomavirus
TPSTIHKSFTY

SEQ ID NO: 17668 - protein, 9 aa, Artificial Sequence
  Peptide Derived from Human Papillomavirus
TPTSGSHGY

SEQ ID NO: 17669 - protein, 9 aa, Artificial Sequence
  Peptide Derived from Human Papillomavirus
TPTVDSVSI

SEQ ID NO: 17670 - protein, 9 aa, Artificial Sequence
  Peptide Derived from Human Papillomavirus
VPDSDFMDI

SEQ ID NO: 17671 - protein, 10 aa, Artificial Sequence
  Peptide Derived from Human Papillomavirus
VPDSDFMDII

SEQ ID NO: 17672 - protein, 9 aa, Artificial Sequence
  Peptide Derived from Human Papillomavirus
VPIYTGPDI

SEQ ID NO: 17673 - protein, 10 aa, Artificial Sequence
  Peptide Derived from Human Papillomavirus
VPIYTGPDII

SEQ ID NO: 17674 - protein, 11 aa, Artificial Sequence
  Peptide Derived from Human Papillomavirus
VPIYTGPDIIL

SEQ ID NO: 17675 - protein, 10 aa, Artificial Sequence
  Peptide Derived from Human Papillomavirus
VPLGGRSNTV

SEQ ID NO: 17676 - protein, 11 aa, Artificial Sequence
  Peptide Derived from Human Papillomavirus
VPLGGRSNTVV

SEQ ID NO: 17677 - protein, 9 aa, Artificial Sequence
  Peptide Derived from Human Papillomavirus
VPLTSAWDV

SEQ ID NO: 17678 - protein, 11 aa, Artificial Sequence
  Peptide Derived from Human Papillomavirus
VPLTSAWDVPI

SEQ ID NO: 17679 - protein, 11 aa, Artificial Sequence
  Peptide Derived from Human Papillomavirus
VPQTGEVSGNI

SEQ ID NO: 17680 - protein, 10 aa, Artificial Sequence
  Peptide Derived from Human Papillomavirus
VPTFTGTSGF

SEQ ID NO: 17681 - protein, 9 aa, Artificial Sequence
  Peptide Derived from Human Papillomavirus
WPSTSPTNA

SEQ ID NO: 17682 - protein, 8 aa, Artificial Sequence
  Peptide Derived from Human Papillomavirus
YPKYSLTM

SEQ ID NO: 17683 - protein, 11 aa, Artificial Sequence
  Peptide Derived from Human Papillomavirus
CPDSVSSTCRY

SEQ ID NO: 17684 - protein, 10 aa, Artificial Sequence
  Peptide Derived from Human Papillomavirus
EPNRLKCCRY

SEQ ID NO: 17685 - protein, 9 aa, Artificial Sequence
  Peptide Derived from Human Papillomavirus
HPGDKTTPV

SEQ ID NO: 17686 - protein, 10 aa, Artificial Sequence
  Peptide Derived from Human Papillomavirus
HPGDKTTPVV

SEQ ID NO: 17687 - protein, 8 aa, Artificial Sequence
  Peptide Derived from Human Papillomavirus
IPVVYRLV

SEQ ID NO: 17688 - protein, 9 aa, Artificial Sequence
  Peptide Derived from Human Papillomavirus
IPVVYRLVW

SEQ ID NO: 17689 - protein, 8 aa, Artificial Sequence
  Peptide Derived from Human Papillomavirus
RPGKRPRL

SEQ ID NO: 17690 - protein, 9 aa, Artificial Sequence
  Peptide Derived from Human Papillomavirus
RPRLRESEF

SEQ ID NO: 17691 - protein, 9 aa, Artificial Sequence
  Peptide Derived from Human Papillomavirus
SPVETVNEY

SEQ ID NO: 17692 - protein, 9 aa, Artificial Sequence
  Peptide Derived from Human Papillomavirus
VPCLQVCKA

SEQ ID NO: 17693 - protein, 11 aa, Artificial Sequence
  Peptide Derived from Human Papillomavirus
VPCLQVCKAKA

SEQ ID NO: 17694 - protein, 8 aa, Artificial Sequence
  Peptide Derived from Human Papillomavirus
FPYAVCRV

SEQ ID NO: 17695 - protein, 10 aa, Artificial Sequence
  Peptide Derived from Human Papillomavirus
FPYAVCRVCL

SEQ ID NO: 17696 - protein, 11 aa, Artificial Sequence
  Peptide Derived from Human Papillomavirus
FPYAVCRVCLL

SEQ ID NO: 17697 - protein, 8 aa, Artificial Sequence
  Peptide Derived from Human Papillomavirus
IPLIDLRL

SEQ ID NO: 17698 - protein, 11 aa, Artificial Sequence
  Peptide Derived from Human Papillomavirus
IPLIDLRLSCV

SEQ ID NO: 17699 - protein, 9 aa, Artificial Sequence
  Peptide Derived from Human Papillomavirus
NPQERPRSL

SEQ ID NO: 17700 - protein, 8 aa, Artificial Sequence
  Peptide Derived from Human Papillomavirus
RPRSLHHL

SEQ ID NO: 17701 - protein, 11 aa, Artificial Sequence
  Peptide Derived from Human Papillomavirus
RPRSLHHLSEV

SEQ ID NO: 17702 - protein, 10 aa, Artificial Sequence
  Peptide Derived from Human Papillomavirus
SPLTPEEKQL

SEQ ID NO: 17703 - protein, 8 aa, Artificial Sequence
  Peptide Derived from Human Papillomavirus
RPQQARQA

SEQ ID NO: 17704 - protein, 8 aa, Artificial Sequence
  Peptide Derived from Human Papillomavirus
TPQTEIDL

SEQ ID NO: 17705 - protein, 8 aa, Artificial Sequence
  Peptide Derived from Human Papillomavirus
VPCCECKF

SEQ ID NO: 17706 - protein, 9 aa, Artificial Sequence
  Peptide Derived from Human Papillomavirus
VPCCECKFV

SEQ ID NO: 17707 - protein, 10 aa, Artificial Sequence
  Peptide Derived from Human Papillomavirus
VPCCECKFVV

SEQ ID NO: 17708 - protein, 8 aa, Artificial Sequence
  Peptide Derived from Human Papillomavirus
VPTLQDVV

SEQ ID NO: 17709 - protein, 9 aa, Artificial Sequence
  Peptide Derived from Human Papillomavirus
VPTLQDVVL

SEQ ID NO: 17710 - protein, 11 aa, Artificial Sequence
  Peptide Derived from Human Papillomavirus
VPTLQDVVLEL

SEQ ID NO: 17711 - protein, 9 aa, Artificial Sequence
  Peptide Derived from Human Papillomavirus
APTSTSTPA

SEQ ID NO: 17712 - protein, 11 aa, Artificial Sequence
  Peptide Derived from Human Papillomavirus
CPPLALINTPI

SEQ ID NO: 17713 - protein, 8 aa, Artificial Sequence
  Peptide Derived from Human Papillomavirus
DPLAKYKF

SEQ ID NO: 17714 - protein, 9 aa, Artificial Sequence
  Peptide Derived from Human Papillomavirus
DPLAKYKFW

SEQ ID NO: 17715 - protein, 11 aa, Artificial Sequence
  Peptide Derived from Human Papillomavirus
DPLAKYKFWDV

SEQ ID NO: 17716 - protein, 8 aa, Artificial Sequence
  Peptide Derived from Human Papillomavirus
DPPLHYGL

SEQ ID NO: 17717 - protein, 10 aa, Artificial Sequence
  Peptide Derived from Human Papillomavirus
DPPLHYGLCI

SEQ ID NO: 17718 - protein, 11 aa, Artificial Sequence
  Peptide Derived from Human Papillomavirus
DPPLHYGLCIF

SEQ ID NO: 17719 - protein, 8 aa, Artificial Sequence
  Peptide Derived from Human Papillomavirus
EPPPSSVY

SEQ ID NO: 17720 - protein, 9 aa, Artificial Sequence
  Peptide Derived from Human Papillomavirus
EPPPSSVYV

SEQ ID NO: 17721 - protein, 10 aa, Artificial Sequence
  Peptide Derived from Human Papillomavirus
EPPPSSVYVA

SEQ ID NO: 17722 - protein, 8 aa, Artificial Sequence
  Peptide Derived from Human Papillomavirus
FPIFLQMA

SEQ ID NO: 17723 - protein, 10 aa, Artificial Sequence
  Peptide Derived from Human Papillomavirus
FPIFLQMATW

SEQ ID NO: 17724 - protein, 8 aa, Artificial Sequence
  Peptide Derived from Human Papillomavirus
FPLGRKFL

SEQ ID NO: 17725 - protein, 9 aa, Artificial Sequence
  Peptide Derived from Human Papillomavirus
FPLGRKFLM

SEQ ID NO: 17726 - protein, 11 aa, Artificial Sequence
  Peptide Derived from Human Papillomavirus
FPLGRKFLMQL

SEQ ID NO: 17727 - protein, 9 aa, Artificial Sequence
  Peptide Derived from Human Papillomavirus
IPKVSAYQY

SEQ ID NO: 17728 - protein, 11 aa, Artificial Sequence
  Peptide Derived from Human Papillomavirus
IPKVSAYQYRV

SEQ ID NO: 17729 - protein, 8 aa, Artificial Sequence
  Peptide Derived from Human Papillomavirus
KPYWLQRA

SEQ ID NO: 17730 - protein, 9 aa, Artificial Sequence
  Peptide Derived from Human Papillomavirus
LPDPNKFGL

SEQ ID NO: 17731 - protein, 9 aa, Artificial Sequence
  Peptide Derived from Human Papillomavirus
LPPTPVSKV

SEQ ID NO: 17732 - protein, 10 aa, Artificial Sequence
  Peptide Derived from Human Papillomavirus
LPPTPVSKVV

SEQ ID NO: 17733 - protein, 11 aa, Artificial Sequence
  Peptide Derived from Human Papillomavirus
LPPTPVSKVVA

SEQ ID NO: 17734 - protein, 8 aa, Artificial Sequence
  Peptide Derived from Human Papillomavirus
NPDQERLV

SEQ ID NO: 17735 - protein, 9 aa, Artificial Sequence
  Peptide Derived from Human Papillomavirus
NPDQERLVW

SEQ ID NO: 17736 - protein, 10 aa, Artificial Sequence
  Peptide Derived from Human Papillomavirus
NPDQERLVWA

SEQ ID NO: 17737 - protein, 10 aa, Artificial Sequence
  Peptide Derived from Human Papillomavirus
PPLALINTPI

SEQ ID NO: 17738 - protein, 9 aa, Artificial Sequence
  Peptide Derived from Human Papillomavirus
PPLHYGLCI

SEQ ID NO: 17739 - protein, 10 aa, Artificial Sequence
  Peptide Derived from Human Papillomavirus
PPLHYGLCIF

SEQ ID NO: 17740 - protein, 11 aa, Artificial Sequence
  Peptide Derived from Human Papillomavirus
PPLHYGLCIFL

SEQ ID NO: 17741 - protein, 8 aa, Artificial Sequence
  Peptide Derived from Human Papillomavirus
PPPSSVYV

SEQ ID NO: 17742 - protein, 9 aa, Artificial Sequence
  Peptide Derived from Human Papillomavirus
PPPSSVYVA

SEQ ID NO: 17743 - protein, 8 aa, Artificial Sequence
  Peptide Derived from Human Papillomavirus
PPSSVYVA

SEQ ID NO: 17744 - protein, 9 aa, Artificial Sequence
  Peptide Derived from Human Papillomavirus
PPTEKQDPL

SEQ ID NO: 17745 - protein, 10 aa, Artificial Sequence
  Peptide Derived from Human Papillomavirus
PPTEKQDPLA

SEQ ID NO: 17746 - protein, 8 aa, Artificial Sequence
  Peptide Derived from Human Papillomavirus
PPTPVSKV

SEQ ID NO: 17747 - protein, 9 aa, Artificial Sequence
  Peptide Derived from Human Papillomavirus
PPTPVSKVV

SEQ ID NO: 17748 - protein, 10 aa, Artificial Sequence
  Peptide Derived from Human Papillomavirus
PPTPVSKVVA

SEQ ID NO: 17749 - protein, 11 aa, Artificial Sequence
  Peptide Derived from Human Papillomavirus
PPVATSLEDKY

SEQ ID NO: 17750 - protein, 10 aa, Artificial Sequence
  Peptide Derived from Human Papillomavirus
QPPTEKQDPL

SEQ ID NO: 17751 - protein, 11 aa, Artificial Sequence
  Peptide Derived from Human Papillomavirus
QPPTEKQDPLA

SEQ ID NO: 17752 - protein, 8 aa, Artificial Sequence
  Peptide Derived from Human Papillomavirus
RPSENKVY

SEQ ID NO: 17753 - protein, 9 aa, Artificial Sequence
  Peptide Derived from Human Papillomavirus
RPSENKVYL

SEQ ID NO: 17754 - protein, 8 aa, Artificial Sequence
  Peptide Derived from Human Papillomavirus
SPPVATSL

SEQ ID NO: 17755 - protein, 8 aa, Artificial Sequence
  Peptide Derived from Human Papillomavirus
TPAMGEHW

SEQ ID NO: 17756 - protein, 8 aa, Artificial Sequence
  Peptide Derived from Human Papillomavirus
TPIEDGDM

SEQ ID NO: 17757 - protein, 9 aa, Artificial Sequence
  Peptide Derived from Human Papillomavirus
TPIEDGDMI

SEQ ID NO: 17758 - protein, 11 aa, Artificial Sequence
  Peptide Derived from Human Papillomavirus
TPSGSMITSEA

SEQ ID NO: 17759 - protein, 8 aa, Artificial Sequence
  Peptide Derived from Human Papillomavirus
TPVSKVVA

SEQ ID NO: 17760 - protein, 9 aa, Artificial Sequence
  Peptide Derived from Human Papillomavirus
YPDYLKMSA

SEQ ID NO: 17761 - protein, 11 aa, Artificial Sequence
  Peptide Derived from Human Papillomavirus
YPDYLKMSADA

SEQ ID NO: 17762 - protein, 9 aa, Artificial Sequence
  Peptide Derived from Human Papillomavirus
APDPDFMNI

SEQ ID NO: 17763 - protein, 10 aa, Artificial Sequence
  Peptide Derived from Human Papillomavirus
APDPDFMNIV

SEQ ID NO: 17764 - protein, 11 aa, Artificial Sequence
  Peptide Derived from Human Papillomavirus
APDPDFMNIVA

SEQ ID NO: 17765 - protein, 9 aa, Artificial Sequence
  Peptide Derived from Human Papillomavirus
APGLSSQSV

SEQ ID NO: 17766 - protein, 10 aa, Artificial Sequence
  Peptide Derived from Human Papillomavirus
APGLSSQSVA

SEQ ID NO: 17767 - protein, 11 aa, Artificial Sequence
  Peptide Derived from Human Papillomavirus
APLGNVWETPF

SEQ ID NO: 17768 - protein, 11 aa, Artificial Sequence
  Peptide Derived from Human Papillomavirus
APQTGEVSGNI

SEQ ID NO: 17769 - protein, 8 aa, Artificial Sequence
  Peptide Derived from Human Papillomavirus
APRLYRKA

SEQ ID NO: 17770 - protein, 9 aa, Artificial Sequence
  Peptide Derived from Human Papillomavirus
APRLYRKAF

SEQ ID NO: 17771 - protein, 9 aa, Artificial Sequence
  Peptide Derived from Human Papillomavirus
CPEDVVNKI

SEQ ID NO: 17772 - protein, 9 aa, Artificial Sequence
  Peptide Derived from Human Papillomavirus
DPAFLDRPA

SEQ ID NO: 17773 - protein, 11 aa, Artificial Sequence
  Peptide Derived from Human Papillomavirus
DPAFLDRPATL

SEQ ID NO: 17774 - protein, 8 aa, Artificial Sequence
  Peptide Derived from Human Papillomavirus
DPDFMNIV

SEQ ID NO: 17775 - protein, 9 aa, Artificial Sequence
  Peptide Derived from Human Papillomavirus
DPDFMNIVA

SEQ ID NO: 17776 - protein, 10 aa, Artificial Sequence
  Peptide Derived from Human Papillomavirus
DPDFMNIVAL

SEQ ID NO: 17777 - protein, 8 aa, Artificial Sequence
  Peptide Derived from Human Papillomavirus
DPSIVTLV

SEQ ID NO: 17778 - protein, 8 aa, Artificial Sequence
  Peptide Derived from Human Papillomavirus
EPISSTPI

SEQ ID NO: 17779 - protein, 11 aa, Artificial Sequence
  Peptide Derived from Human Papillomavirus
EPISSTPIPGF

SEQ ID NO: 17780 - protein, 8 aa, Artificial Sequence
  Peptide Derived from Human Papillomavirus
GPSTWPFV

SEQ ID NO: 17781 - protein, 8 aa, Artificial Sequence
  Peptide Derived from Human Papillomavirus
GPTDPSIV

SEQ ID NO: 17782 - protein, 10 aa, Artificial Sequence
  Peptide Derived from Human Papillomavirus
GPTDPSIVTL

SEQ ID NO: 17783 - protein, 11 aa, Artificial Sequence
  Peptide Derived from Human Papillomavirus
GPTDPSIVTLV

SEQ ID NO: 17784 - protein, 8 aa, Artificial Sequence
  Peptide Derived from Human Papillomavirus
IPGFRRIA

SEQ ID NO: 17785 - protein, 9 aa, Artificial Sequence
  Peptide Derived from Human Papillomavirus
IPGFRRIAA

SEQ ID NO: 17786 - protein, 8 aa, Artificial Sequence
  Peptide Derived from Human Papillomavirus
IPMQTFAV

SEQ ID NO: 17787 - protein, 10 aa, Artificial Sequence
  Peptide Derived from Human Papillomavirus
IPNFTGSGGF

SEQ ID NO: 17788 - protein, 10 aa, Artificial Sequence
  Peptide Derived from Human Papillomavirus
IPYFFADGDV

SEQ ID NO: 17789 - protein, 11 aa, Artificial Sequence
  Peptide Derived from Human Papillomavirus
IPYFFADGDVA

SEQ ID NO: 17790 - protein, 8 aa, Artificial Sequence
  Peptide Derived from Human Papillomavirus
KPSTLSFA

SEQ ID NO: 17791 - protein, 8 aa, Artificial Sequence
  Peptide Derived from Human Papillomavirus
LPIKPSTL

SEQ ID NO: 17792 - protein, 10 aa, Artificial Sequence
  Peptide Derived from Human Papillomavirus
LPIKPSTLSF

SEQ ID NO: 17793 - protein, 11 aa, Artificial Sequence
  Peptide Derived from Human Papillomavirus
LPIKPSTLSFA

SEQ ID NO: 17794 - protein, 8 aa, Artificial Sequence
  Peptide Derived from Human Papillomavirus
LPTGPSTW

SEQ ID NO: 17795 - protein, 10 aa, Artificial Sequence
  Peptide Derived from Human Papillomavirus
LPTGPSTWPF

SEQ ID NO: 17796 - protein, 11 aa, Artificial Sequence
  Peptide Derived from Human Papillomavirus
LPTGPSTWPFV

SEQ ID NO: 17797 - protein, 11 aa, Artificial Sequence
  Peptide Derived from Human Papillomavirus
NPLFEGTDTSL

SEQ ID NO: 17798 - protein, 9 aa, Artificial Sequence
  Peptide Derived from Human Papillomavirus
NPLFIDPPV

SEQ ID NO: 17799 - protein, 10 aa, Artificial Sequence
  Peptide Derived from Human Papillomavirus
NPLFIDPPVI

SEQ ID NO: 17800 - protein, 8 aa, Artificial Sequence
  Peptide Derived from Human Papillomavirus
PPIVVESV

SEQ ID NO: 17801 - protein, 10 aa, Artificial Sequence
  Peptide Derived from Human Papillomavirus
QPLLSANNSF

SEQ ID NO: 17802 - protein, 11 aa, Artificial Sequence
  Peptide Derived from Human Papillomavirus
RPAFTTRRGGV

SEQ ID NO: 17803 - protein, 8 aa, Artificial Sequence
  Peptide Derived from Human Papillomavirus
RPATLVSA

SEQ ID NO: 17804 - protein, 9 aa, Artificial Sequence
  Peptide Derived from Human Papillomavirus
RPPIVVESV

SEQ ID NO: 17805 - protein, 8 aa, Artificial Sequence
  Peptide Derived from Human Papillomavirus
RPSTIVDV

SEQ ID NO: 17806 - protein, 11 aa, Artificial Sequence
  Peptide Derived from Human Papillomavirus
RPSTIVDVTPA

SEQ ID NO: 17807 - protein, 9 aa, Artificial Sequence
  Peptide Derived from Human Papillomavirus
SPIAQAEEI

SEQ ID NO: 17808 - protein, 11 aa, Artificial Sequence
  Peptide Derived from Human Papillomavirus
SPIAQAEEIEM

SEQ ID NO: 17809 - protein, 11 aa, Artificial Sequence
  Peptide Derived from Human Papillomavirus
SPSGVAPDPDF

SEQ ID NO: 17810 - protein, 9 aa, Artificial Sequence
  Peptide Derived from Human Papillomavirus
SPYDVTHDV

SEQ ID NO: 17811 - protein, 10 aa, Artificial Sequence
  Peptide Derived from Human Papillomavirus
SPYDVTHDVY

SEQ ID NO: 17812 - protein, 11 aa, Artificial Sequence
  Peptide Derived from Human Papillomavirus
SPYDVTHDVYI

SEQ ID NO: 17813 - protein, 8 aa, Artificial Sequence
  Peptide Derived from Human Papillomavirus
TPARPPIV

SEQ ID NO: 17814 - protein, 9 aa, Artificial Sequence
  Peptide Derived from Human Papillomavirus
TPARPPIVV

SEQ ID NO: 17815 - protein, 9 aa, Artificial Sequence
  Peptide Derived from Human Papillomavirus
TPFYSGPDI

SEQ ID NO: 17816 - protein, 10 aa, Artificial Sequence
  Peptide Derived from Human Papillomavirus
TPFYSGPDIV

SEQ ID NO: 17817 - protein, 11 aa, Artificial Sequence
  Peptide Derived from Human Papillomavirus
TPFYSGPDIVL

SEQ ID NO: 17818 - protein, 9 aa, Artificial Sequence
  Peptide Derived from Human Papillomavirus
TPIPGFRRI

SEQ ID NO: 17819 - protein, 10 aa, Artificial Sequence
  Peptide Derived from Human Papillomavirus
TPIPGFRRIA

SEQ ID NO: 17820 - protein, 11 aa, Artificial Sequence
  Peptide Derived from Human Papillomavirus
TPIPGFRRIAA

SEQ ID NO: 17821 - protein, 8 aa, Artificial Sequence
  Peptide Derived from Human Papillomavirus
TPSAHLPI

SEQ ID NO: 17822 - protein, 9 aa, Artificial Sequence
  Peptide Derived from Human Papillomavirus
TPTSGIHSY

SEQ ID NO: 17823 - protein, 9 aa, Artificial Sequence
  Peptide Derived from Human Papillomavirus
TPTSSTVHV

SEQ ID NO: 17824 - protein, 10 aa, Artificial Sequence
  Peptide Derived from Human Papillomavirus
VPLGSRPSTI

SEQ ID NO: 17825 - protein, 11 aa, Artificial Sequence
  Peptide Derived from Human Papillomavirus
VPLGSRPSTIV

SEQ ID NO: 17826 - protein, 8 aa, Artificial Sequence
  Peptide Derived from Human Papillomavirus
VPQSPYDV

SEQ ID NO: 17827 - protein, 9 aa, Artificial Sequence
  Peptide Derived from Human Papillomavirus
WPFVPQSPY

SEQ ID NO: 17828 - protein, 11 aa, Artificial Sequence
  Peptide Derived from Human Papillomavirus
WPFVPQSPYDV

SEQ ID NO: 17829 - protein, 10 aa, Artificial Sequence
  Peptide Derived from Human Papillomavirus
AHALFTAQEA

SEQ ID NO: 17830 - protein, 9 aa, Artificial Sequence
  Peptide Derived from Human Papillomavirus
AKAAMLAKF

SEQ ID NO: 17831 - protein, 9 aa, Artificial Sequence
  Peptide Derived from Human Papillomavirus
AKFKELYGV

SEQ ID NO: 17832 - protein, 11 aa, Artificial Sequence
  Peptide Derived from Human Papillomavirus
AKFKELYGVSF

SEQ ID NO: 17833 - protein, 9 aa, Artificial Sequence
  Peptide Derived from Human Papillomavirus
AKIGMLDDA

SEQ ID NO: 17834 - protein, 11 aa, Artificial Sequence
  Peptide Derived from Human Papillomavirus
AKIGMLDDATV

SEQ ID NO: 17835 - protein, 8 aa, Artificial Sequence
  Peptide Derived from Human Papillomavirus
AKIVKDCA

SEQ ID NO: 17836 - protein, 10 aa, Artificial Sequence
  Peptide Derived from Human Papillomavirus
AKIVKDCATM

SEQ ID NO: 17837 - protein, 8 aa, Artificial Sequence
  Peptide Derived from Human Papillomavirus
AKQHRDAV

SEQ ID NO: 17838 - protein, 10 aa, Artificial Sequence
  Peptide Derived from Human Papillomavirus
AKQHRDAVQV

SEQ ID NO: 17839 - protein, 11 aa, Artificial Sequence
  Peptide Derived from Human Papillomavirus
AKQHRDAVQVL

SEQ ID NO: 17840 - protein, 9 aa, Artificial Sequence
  Peptide Derived from Human Papillomavirus
DKENDGDSL

SEQ ID NO: 17841 - protein, 8 aa, Artificial Sequence
  Peptide Derived from Human Papillomavirus
DKNWKSFF

SEQ ID NO: 17842 - protein, 9 aa, Artificial Sequence
  Peptide Derived from Human Papillomavirus
DRVDDGGDW

SEQ ID NO: 17843 - protein, 10 aa, Artificial Sequence
  Peptide Derived from Human Papillomavirus
EKKQMSMSQW

SEQ ID NO: 17844 - protein, 11 aa, Artificial Sequence
  Peptide Derived from Human Papillomavirus
EKKQMSMSQWI

SEQ ID NO: 17845 - protein, 8 aa, Artificial Sequence
  Peptide Derived from Human Papillomavirus
EKKTGDAI

SEQ ID NO: 17846 - protein, 8 aa, Artificial Sequence
  Peptide Derived from Human Papillomavirus
EKLLSKLL

SEQ ID NO: 17847 - protein, 10 aa, Artificial Sequence
  Peptide Derived from Human Papillomavirus
EKLLSKLLCV

SEQ ID NO: 17848 - protein, 11 aa, Artificial Sequence
  Peptide Derived from Human Papillomavirus
EKQSRAAKRRL

SEQ ID NO: 17849 - protein, 10 aa, Artificial Sequence
  Peptide Derived from Human Papillomavirus
ERHTICQTPL

SEQ ID NO: 17850 - protein, 9 aa, Artificial Sequence
  Peptide Derived from Human Papillomavirus
FKELYGVSF

SEQ ID NO: 17851 - protein, 11 aa, Artificial Sequence
  Peptide Derived from Human Papillomavirus
FKSNKSTCCDW

SEQ ID NO: 17852 - protein, 10 aa, Artificial Sequence
  Peptide Derived from Human Papillomavirus
GKNRETIEKL

SEQ ID NO: 17853 - protein, 11 aa, Artificial Sequence
  Peptide Derived from Human Papillomavirus
GKNRETIEKLL

SEQ ID NO: 17854 - protein, 9 aa, Artificial Sequence
  Peptide Derived from Human Papillomavirus
GKSLFGMSL

SEQ ID NO: 17855 - protein, 10 aa, Artificial Sequence
  Peptide Derived from Human Papillomavirus
GKSLFGMSLM

SEQ ID NO: 17856 - protein, 8 aa, Artificial Sequence
  Peptide Derived from Human Papillomavirus
HRDAVQVL

SEQ ID NO: 17857 - protein, 8 aa, Artificial Sequence
  Peptide Derived from Human Papillomavirus
IKTLLQQY

SEQ ID NO: 17858 - protein, 10 aa, Artificial Sequence
  Peptide Derived from Human Papillomavirus
IKTLLQQYCL

SEQ ID NO: 17859 - protein, 11 aa, Artificial Sequence
  Peptide Derived from Human Papillomavirus
IKTLLQQYCLY

SEQ ID NO: 17860 - protein, 8 aa, Artificial Sequence
  Peptide Derived from Human Papillomavirus
IKYRCDRV

SEQ ID NO: 17861 - protein, 8 aa, Artificial Sequence
  Peptide Derived from Human Papillomavirus
KHRPLVQL

SEQ ID NO: 17862 - protein, 8 aa, Artificial Sequence
  Peptide Derived from Human Papillomavirus
KKNCILLY

SEQ ID NO: 17863 - protein, 10 aa, Artificial Sequence
  Peptide Derived from Human Papillomavirus
KKNCILLYGA

SEQ ID NO: 17864 - protein, 11 aa, Artificial Sequence
  Peptide Derived from Human Papillomavirus
KKNCILLYGAA

SEQ ID NO: 17865 - protein, 9 aa, Artificial Sequence
  Peptide Derived from Human Papillomavirus
KKQMSMSQW

SEQ ID NO: 17866 - protein, 10 aa, Artificial Sequence
  Peptide Derived from Human Papillomavirus
KKQMSMSQWI

SEQ ID NO: 17867 - protein, 8 aa, Artificial Sequence
  Peptide Derived from Human Papillomavirus
KRAEKKQM

SEQ ID NO: 17868 - protein, 10 aa, Artificial Sequence
  Peptide Derived from Human Papillomavirus
KRAEKKQMSM

SEQ ID NO: 17869 - protein, 9 aa, Artificial Sequence
  Peptide Derived from Human Papillomavirus
KRKYLVSPL

SEQ ID NO: 17870 - protein, 10 aa, Artificial Sequence
  Peptide Derived from Human Papillomavirus
LHIQSLACSW

SEQ ID NO: 17871 - protein, 8 aa, Artificial Sequence
  Peptide Derived from Human Papillomavirus
LHNRLVVF

SEQ ID NO: 17872 - protein, 10 aa, Artificial Sequence
  Peptide Derived from Human Papillomavirus
LHNRLVVFTF

SEQ ID NO: 17873 - protein, 8 aa, Artificial Sequence
  Peptide Derived from Human Papillomavirus
LKCPPLLI

SEQ ID NO: 17874 - protein, 8 aa, Artificial Sequence
  Peptide Derived from Human Papillomavirus
LKRFLQGI

SEQ ID NO: 17875 - protein, 10 aa, Artificial Sequence
  Peptide Derived from Human Papillomavirus
LKRKYLVSPL

SEQ ID NO: 17876 - protein, 9 aa, Artificial Sequence
  Peptide Derived from Human Papillomavirus
LKSNSQAKI

SEQ ID NO: 17877 - protein, 10 aa, Artificial Sequence
  Peptide Derived from Human Papillomavirus
LKSNSQAKIV

SEQ ID NO: 17878 - protein, 8 aa, Artificial Sequence
  Peptide Derived from Human Papillomavirus
LKTSNAKA

SEQ ID NO: 17879 - protein, 9 aa, Artificial Sequence
  Peptide Derived from Human Papillomavirus
LKTSNAKAA

SEQ ID NO: 17880 - protein, 10 aa, Artificial Sequence
  Peptide Derived from Human Papillomavirus
LKTSNAKAAM

SEQ ID NO: 17881 - protein, 11 aa, Artificial Sequence
  Peptide Derived from Human Papillomavirus
LKTSNAKAAML

SEQ ID NO: 17882 - protein, 9 aa, Artificial Sequence
  Peptide Derived from Human Papillomavirus
LRNALDGNL

SEQ ID NO: 17883 - protein, 10 aa, Artificial Sequence
  Peptide Derived from Human Papillomavirus
LRNALDGNLV

SEQ ID NO: 17884 - protein, 8 aa, Artificial Sequence
  Peptide Derived from Human Papillomavirus
LRSTAAAL

SEQ ID NO: 17885 - protein, 9 aa, Artificial Sequence
  Peptide Derived from Human Papillomavirus
LRSTAAALY

SEQ ID NO: 17886 - protein, 10 aa, Artificial Sequence
  Peptide Derived from Human Papillomavirus
LRSTAAALYW

SEQ ID NO: 17887 - protein, 11 aa, Artificial Sequence
  Peptide Derived from Human Papillomavirus
LRSTAAALYWY

SEQ ID NO: 17888 - protein, 8 aa, Artificial Sequence
  Peptide Derived from Human Papillomavirus
LRYQGVEF

SEQ ID NO: 17889 - protein, 9 aa, Artificial Sequence
  Peptide Derived from Human Papillomavirus
LRYQGVEFM

SEQ ID NO: 17890 - protein, 11 aa, Artificial Sequence
  Peptide Derived from Human Papillomavirus
LRYQGVEFMSF

SEQ ID NO: 17891 - protein, 8 aa, Artificial Sequence
  Peptide Derived from Human Papillomavirus
MKFLQGSV

SEQ ID NO: 17892 - protein, 9 aa, Artificial Sequence
  Peptide Derived from Human Papillomavirus
MKFLQGSVI

SEQ ID NO: 17893 - protein, 11 aa, Artificial Sequence
  Peptide Derived from Human Papillomavirus
MKFLQGSVICF

SEQ ID NO: 17894 - protein, 8 aa, Artificial Sequence
  Peptide Derived from Human Papillomavirus
NKSTCCDW

SEQ ID NO: 17895 - protein, 10 aa, Artificial Sequence
  Peptide Derived from Human Papillomavirus
NKSTCCDWCI

SEQ ID NO: 17896 - protein, 11 aa, Artificial Sequence
  Peptide Derived from Human Papillomavirus
NKSTCCDWCIA

SEQ ID NO: 17897 - protein, 8 aa, Artificial Sequence
  Peptide Derived from Human Papillomavirus
NRETIEKL

SEQ ID NO: 17898 - protein, 9 aa, Artificial Sequence
  Peptide Derived from Human Papillomavirus
NRETIEKLL

SEQ ID NO: 17899 - protein, 8 aa, Artificial Sequence
  Peptide Derived from Human Papillomavirus
NRLVVFTF

SEQ ID NO: 17900 - protein, 8 aa, Artificial Sequence
  Peptide Derived from Human Papillomavirus
PKKNCILL

SEQ ID NO: 17901 - protein, 9 aa, Artificial Sequence
  Peptide Derived from Human Papillomavirus
PKKNCILLY

SEQ ID NO: 17902 - protein, 11 aa, Artificial Sequence
  Peptide Derived from Human Papillomavirus
PKKNCILLYGA

SEQ ID NO: 17903 - protein, 8 aa, Artificial Sequence
  Peptide Derived from Human Papillomavirus
PKLRSTAA

SEQ ID NO: 17904 - protein, 9 aa, Artificial Sequence
  Peptide Derived from Human Papillomavirus
PKLRSTAAA

SEQ ID NO: 17905 - protein, 10 aa, Artificial Sequence
  Peptide Derived from Human Papillomavirus
PKLRSTAAAL

SEQ ID NO: 17906 - protein, 11 aa, Artificial Sequence
  Peptide Derived from Human Papillomavirus
PKLRSTAAALY

SEQ ID NO: 17907 - protein, 8 aa, Artificial Sequence
  Peptide Derived from Human Papillomavirus
PRLKAICI

SEQ ID NO: 17908 - protein, 8 aa, Artificial Sequence
  Peptide Derived from Human Papillomavirus
QHRDAVQV

SEQ ID NO: 17909 - protein, 9 aa, Artificial Sequence
  Peptide Derived from Human Papillomavirus
QHRDAVQVL

SEQ ID NO: 17910 - protein, 9 aa, Artificial Sequence
  Peptide Derived from Human Papillomavirus
QHSFNDCTF

SEQ ID NO: 17911 - protein, 11 aa, Artificial Sequence
  Peptide Derived from Human Papillomavirus
QHSFNDCTFEL

SEQ ID NO: 17912 - protein, 10 aa, Artificial Sequence
  Peptide Derived from Human Papillomavirus
QRQTVLQHSF

SEQ ID NO: 17913 - protein, 11 aa, Artificial Sequence
  Peptide Derived from Human Papillomavirus
RHETETPCSQY

SEQ ID NO: 17914 - protein, 9 aa, Artificial Sequence
  Peptide Derived from Human Papillomavirus
RHTICQTPL

SEQ ID NO: 17915 - protein, 11 aa, Artificial Sequence
  Peptide Derived from Human Papillomavirus
RHYKRAEKKQM

SEQ ID NO: 17916 - protein, 8 aa, Artificial Sequence
  Peptide Derived from Human Papillomavirus
RKYLVSPL

SEQ ID NO: 17917 - protein, 11 aa, Artificial Sequence
  Peptide Derived from Human Papillomavirus
RKYLVSPLSDI

SEQ ID NO: 17918 - protein, 11 aa, Artificial Sequence
  Peptide Derived from Human Papillomavirus
RRLFESEDSGY

SEQ ID NO: 17919 - protein, 8 aa, Artificial Sequence
  Peptide Derived from Human Papillomavirus
SHFWLQPL

SEQ ID NO: 17920 - protein, 9 aa, Artificial Sequence
  Peptide Derived from Human Papillomavirus
SHFWLQPLA

SEQ ID NO: 17921 - protein, 11 aa, Artificial Sequence
  Peptide Derived from Human Papillomavirus
SHFWLQPLADA

SEQ ID NO: 17922 - protein, 9 aa, Artificial Sequence
  Peptide Derived from Human Papillomavirus
SKLLCVSPM

SEQ ID NO: 17923 - protein, 11 aa, Artificial Sequence
  Peptide Derived from Human Papillomavirus
SKLLCVSPMCM

SEQ ID NO: 17924 - protein, 10 aa, Artificial Sequence
  Peptide Derived from Human Papillomavirus
SKSHFWLQPL

SEQ ID NO: 17925 - protein, 11 aa, Artificial Sequence
  Peptide Derived from Human Papillomavirus
SKSHFWLQPLA

SEQ ID NO: 17926 - protein, 8 aa, Artificial Sequence
  Peptide Derived from Human Papillomavirus
SRAAKRRL

SEQ ID NO: 17927 - protein, 9 aa, Artificial Sequence
  Peptide Derived from Human Papillomavirus
SRAAKRRLF

SEQ ID NO: 17928 - protein, 9 aa, Artificial Sequence
  Peptide Derived from Human Papillomavirus
SRTWSRLSL

SEQ ID NO: 17929 - protein, 10 aa, Artificial Sequence
  Peptide Derived from Human Papillomavirus
SRWPYLHNRL

SEQ ID NO: 17930 - protein, 11 aa, Artificial Sequence
  Peptide Derived from Human Papillomavirus
SRWPYLHNRLV

SEQ ID NO: 17931 - protein, 11 aa, Artificial Sequence
  Peptide Derived from Human Papillomavirus
VKDCATMCRHY

SEQ ID NO: 17932 - protein, 9 aa, Artificial Sequence
  Peptide Derived from Human Papillomavirus
VKHRPLVQL

SEQ ID NO: 17933 - protein, 8 aa, Artificial Sequence
  Peptide Derived from Human Papillomavirus
WKQIVMFL

SEQ ID NO: 17934 - protein, 10 aa, Artificial Sequence
  Peptide Derived from Human Papillomavirus
WKQIVMFLRY

SEQ ID NO: 17935 - protein, 9 aa, Artificial Sequence
  Peptide Derived from Human Papillomavirus
WKSFFSRTW

SEQ ID NO: 17936 - protein, 10 aa, Artificial Sequence
  Peptide Derived from Human Papillomavirus
YKCGKNRETI

SEQ ID NO: 17937 - protein, 9 aa, Artificial Sequence
  Peptide Derived from Human Papillomavirus
YKRAEKKQM

SEQ ID NO: 17938 - protein, 11 aa, Artificial Sequence
  Peptide Derived from Human Papillomavirus
YKRAEKKQMSM

SEQ ID NO: 17939 - protein, 8 aa, Artificial Sequence
  Peptide Derived from Human Papillomavirus
YKTGISNI

SEQ ID NO: 17940 - protein, 11 aa, Artificial Sequence
  Peptide Derived from Human Papillomavirus
YKTGISNISEV

SEQ ID NO: 17941 - protein, 9 aa, Artificial Sequence
  Peptide Derived from Human Papillomavirus
AREMGFKHI

SEQ ID NO: 17942 - protein, 9 aa, Artificial Sequence
  Peptide Derived from Human Papillomavirus
DHIDYWKHM

SEQ ID NO: 17943 - protein, 11 aa, Artificial Sequence
  Peptide Derived from Human Papillomavirus
DHIDYWKHMRL

SEQ ID NO: 17944 - protein, 8 aa, Artificial Sequence
  Peptide Derived from Human Papillomavirus
EKWTLQDV

SEQ ID NO: 17945 - protein, 10 aa, Artificial Sequence
  Peptide Derived from Human Papillomavirus
EKWTLQDVSL

SEQ ID NO: 17946 - protein, 8 aa, Artificial Sequence
  Peptide Derived from Human Papillomavirus
EKYSKNKV

SEQ ID NO: 17947 - protein, 9 aa, Artificial Sequence
  Peptide Derived from Human Papillomavirus
EKYSKNKVW

SEQ ID NO: 17948 - protein, 11 aa, Artificial Sequence
  Peptide Derived from Human Papillomavirus
EKYSKNKVWEV

SEQ ID NO: 17949 - protein, 8 aa, Artificial Sequence
  Peptide Derived from Human Papillomavirus
FKDDAEKY

SEQ ID NO: 17950 - protein, 8 aa, Artificial Sequence
  Peptide Derived from Human Papillomavirus
FKHINHQV

SEQ ID NO: 17951 - protein, 9 aa, Artificial Sequence
  Peptide Derived from Human Papillomavirus
FKHINHQVV

SEQ ID NO: 17952 - protein, 8 aa, Artificial Sequence
  Peptide Derived from Human Papillomavirus
FKKHCTLY

SEQ ID NO: 17953 - protein, 10 aa, Artificial Sequence
  Peptide Derived from Human Papillomavirus
FKKHCTLYTA

SEQ ID NO: 17954 - protein, 11 aa, Artificial Sequence
  Peptide Derived from Human Papillomavirus
FKKHCTLYTAV

SEQ ID NO: 17955 - protein, 9 aa, Artificial Sequence
  Peptide Derived from Human Papillomavirus
GHNVKHKSA

SEQ ID NO: 17956 - protein, 10 aa, Artificial Sequence
  Peptide Derived from Human Papillomavirus
GHNVKHKSAI

SEQ ID NO: 17957 - protein, 11 aa, Artificial Sequence
  Peptide Derived from Human Papillomavirus
GHNVKHKSAIV

SEQ ID NO: 17958 - protein, 8 aa, Artificial Sequence
  Peptide Derived from Human Papillomavirus
HKSAIVTL

SEQ ID NO: 17959 - protein, 10 aa, Artificial Sequence
  Peptide Derived from Human Papillomavirus
HKSAIVTLTY

SEQ ID NO: 17960 - protein, 8 aa, Artificial Sequence
  Peptide Derived from Human Papillomavirus
HRDSVDSA

SEQ ID NO: 17961 - protein, 10 aa, Artificial Sequence
  Peptide Derived from Human Papillomavirus
HRDSVDSAPI

SEQ ID NO: 17962 - protein, 11 aa, Artificial Sequence
  Peptide Derived from Human Papillomavirus
HRDSVDSAPIL

SEQ ID NO: 17963 - protein, 8 aa, Artificial Sequence
  Peptide Derived from Human Papillomavirus
IKKHGYTV

SEQ ID NO: 17964 - protein, 10 aa, Artificial Sequence
  Peptide Derived from Human Papillomavirus
IKKHGYTVEV

SEQ ID NO: 17965 - protein, 10 aa, Artificial Sequence
  Peptide Derived from Human Papillomavirus
IRQHLANHPA

SEQ ID NO: 17966 - protein, 11 aa, Artificial Sequence
  Peptide Derived from Human Papillomavirus
IRQHLANHPAA

SEQ ID NO: 17967 - protein, 8 aa, Artificial Sequence
  Peptide Derived from Human Papillomavirus
IRTYFVQF

SEQ ID NO: 17968 - protein, 8 aa, Artificial Sequence
  Peptide Derived from Human Papillomavirus
KHCTLYTA

SEQ ID NO: 17969 - protein, 9 aa, Artificial Sequence
  Peptide Derived from Human Papillomavirus
KHCTLYTAV

SEQ ID NO: 17970 - protein, 8 aa, Artificial Sequence
  Peptide Derived from Human Papillomavirus
KHGYTVEV

SEQ ID NO: 17971 - protein, 10 aa, Artificial Sequence
  Peptide Derived from Human Papillomavirus
KHGYTVEVQF

SEQ ID NO: 17972 - protein, 8 aa, Artificial Sequence
  Peptide Derived from Human Papillomavirus
KHINHQVV

SEQ ID NO: 17973 - protein, 11 aa, Artificial Sequence
  Peptide Derived from Human Papillomavirus
KHINHQVVPTL

SEQ ID NO: 17974 - protein, 9 aa, Artificial Sequence
  Peptide Derived from Human Papillomavirus
KHKSAIVTL

SEQ ID NO: 17975 - protein, 11 aa, Artificial Sequence
  Peptide Derived from Human Papillomavirus
KHKSAIVTLTY

SEQ ID NO: 17976 - protein, 8 aa, Artificial Sequence
  Peptide Derived from Human Papillomavirus
KHMRLECA

SEQ ID NO: 17977 - protein, 9 aa, Artificial Sequence
  Peptide Derived from Human Papillomavirus
KHMRLECAI

SEQ ID NO: 17978 - protein, 10 aa, Artificial Sequence
  Peptide Derived from Human Papillomavirus
KHMRLECAIY

SEQ ID NO: 17979 - protein, 11 aa, Artificial Sequence
  Peptide Derived from Human Papillomavirus
KHMRLECAIYY

SEQ ID NO: 17980 - protein, 9 aa, Artificial Sequence
  Peptide Derived from Human Papillomavirus
KKHCTLYTA

SEQ ID NO: 17981 - protein, 10 aa, Artificial Sequence
  Peptide Derived from Human Papillomavirus
KKHCTLYTAV

SEQ ID NO: 17982 - protein, 9 aa, Artificial Sequence
  Peptide Derived from Human Papillomavirus
KKHGYTVEV

SEQ ID NO: 17983 - protein, 11 aa, Artificial Sequence
  Peptide Derived from Human Papillomavirus
KKHGYTVEVQF

SEQ ID NO: 17984 - protein, 9 aa, Artificial Sequence
  Peptide Derived from Human Papillomavirus
LHRDSVDSA

SEQ ID NO: 17985 - protein, 11 aa, Artificial Sequence
  Peptide Derived from Human Papillomavirus
LHRDSVDSAPI

SEQ ID NO: 17986 - protein, 8 aa, Artificial Sequence
  Peptide Derived from Human Papillomavirus
LKCLRYRF

SEQ ID NO: 17987 - protein, 8 aa, Artificial Sequence
  Peptide Derived from Human Papillomavirus
LKGDANTL

SEQ ID NO: 17988 - protein, 11 aa, Artificial Sequence
  Peptide Derived from Human Papillomavirus
LKGDANTLKCL

SEQ ID NO: 17989 - protein, 8 aa, Artificial Sequence
  Peptide Derived from Human Papillomavirus
LRDHIDYW

SEQ ID NO: 17990 - protein, 11 aa, Artificial Sequence
  Peptide Derived from Human Papillomavirus
LRDHIDYWKHM

SEQ ID NO: 17991 - protein, 11 aa, Artificial Sequence
  Peptide Derived from Human Papillomavirus
LRYRFKKHCTL

SEQ ID NO: 17992 - protein, 9 aa, Artificial Sequence
  Peptide Derived from Human Papillomavirus
MHYTNWTHI

SEQ ID NO: 17993 - protein, 10 aa, Artificial Sequence
  Peptide Derived from Human Papillomavirus
MHYTNWTHIY

SEQ ID NO: 17994 - protein, 11 aa, Artificial Sequence
  Peptide Derived from Human Papillomavirus
MHYTNWTHIYI

SEQ ID NO: 17995 - protein, 8 aa, Artificial Sequence
  Peptide Derived from Human Papillomavirus
MRLECAIY

SEQ ID NO: 17996 - protein, 9 aa, Artificial Sequence
  Peptide Derived from Human Papillomavirus
MRLECAIYY

SEQ ID NO: 17997 - protein, 11 aa, Artificial Sequence
  Peptide Derived from Human Papillomavirus
MRLECAIYYKA

SEQ ID NO: 17998 - protein, 10 aa, Artificial Sequence
  Peptide Derived from Human Papillomavirus
NHPAATHTKA

SEQ ID NO: 17999 - protein, 11 aa, Artificial Sequence
  Peptide Derived from Human Papillomavirus
NHPAATHTKAV

SEQ ID NO: 18000 - protein, 8 aa, Artificial Sequence
  Peptide Derived from Human Papillomavirus
NHQVVPTL

SEQ ID NO: 18001 - protein, 9 aa, Artificial Sequence
  Peptide Derived from Human Papillomavirus
NHQVVPTLA

SEQ ID NO: 18002 - protein, 10 aa, Artificial Sequence
  Peptide Derived from Human Papillomavirus
NHQVVPTLAV

SEQ ID NO: 18003 - protein, 9 aa, Artificial Sequence
  Peptide Derived from Human Papillomavirus
NKALQAIEL

SEQ ID NO: 18004 - protein, 11 aa, Artificial Sequence
  Peptide Derived from Human Papillomavirus
NKALQAIELQL

SEQ ID NO: 18005 - protein, 8 aa, Artificial Sequence
  Peptide Derived from Human Papillomavirus
NKVWEVHA

SEQ ID NO: 18006 - protein, 10 aa, Artificial Sequence
  Peptide Derived from Human Papillomavirus
PKTITVSTGF

SEQ ID NO: 18007 - protein, 11 aa, Artificial Sequence
  Peptide Derived from Human Papillomavirus
PKTITVSTGFM

SEQ ID NO: 18008 - protein, 8 aa, Artificial Sequence
  Peptide Derived from Human Papillomavirus
QHLANHPA

SEQ ID NO: 18009 - protein, 9 aa, Artificial Sequence
  Peptide Derived from Human Papillomavirus
QHLANHPAA

SEQ ID NO: 18010 - protein, 9 aa, Artificial Sequence
  Peptide Derived from Human Papillomavirus
QRDQFLSQV

SEQ ID NO: 18011 - protein, 11 aa, Artificial Sequence
  Peptide Derived from Human Papillomavirus
QRDQFLSQVKI

SEQ ID NO: 18012 - protein, 10 aa, Artificial Sequence
  Peptide Derived from Human Papillomavirus
QRLNVCQDKI

SEQ ID NO: 18013 - protein, 11 aa, Artificial Sequence
  Peptide Derived from Human Papillomavirus
QRLNVCQDKIL

SEQ ID NO: 18014 - protein, 8 aa, Artificial Sequence
  Peptide Derived from Human Papillomavirus
SKNKALQA

SEQ ID NO: 18015 - protein, 9 aa, Artificial Sequence
  Peptide Derived from Human Papillomavirus
SKNKALQAI

SEQ ID NO: 18016 - protein, 11 aa, Artificial Sequence
  Peptide Derived from Human Papillomavirus
SKNKALQAIEL

SEQ ID NO: 18017 - protein, 8 aa, Artificial Sequence
  Peptide Derived from Human Papillomavirus
SKNKVWEV

SEQ ID NO: 18018 - protein, 10 aa, Artificial Sequence
  Peptide Derived from Human Papillomavirus
SKNKVWEVHA

SEQ ID NO: 18019 - protein, 9 aa, Artificial Sequence
  Peptide Derived from Human Papillomavirus
THIYICEEA

SEQ ID NO: 18020 - protein, 11 aa, Artificial Sequence
  Peptide Derived from Human Papillomavirus
THIYICEEASV

SEQ ID NO: 18021 - protein, 8 aa, Artificial Sequence
  Peptide Derived from Human Papillomavirus
THTKAVAL

SEQ ID NO: 18022 - protein, 10 aa, Artificial Sequence
  Peptide Derived from Human Papillomavirus
THYENDSTDL

SEQ ID NO: 18023 - protein, 9 aa, Artificial Sequence
  Peptide Derived from Human Papillomavirus
TKLLHRDSV

SEQ ID NO: 18024 - protein, 8 aa, Artificial Sequence
  Peptide Derived from Human Papillomavirus
VHAGGQVI

SEQ ID NO: 18025 - protein, 9 aa, Artificial Sequence
  Peptide Derived from Human Papillomavirus
VHAGGQVIL

SEQ ID NO: 18026 - protein, 8 aa, Artificial Sequence
  Peptide Derived from Human Papillomavirus
VHEGIRTY

SEQ ID NO: 18027 - protein, 9 aa, Artificial Sequence
  Peptide Derived from Human Papillomavirus
VHEGIRTYF

SEQ ID NO: 18028 - protein, 10 aa, Artificial Sequence
  Peptide Derived from Human Papillomavirus
VHEGIRTYFV

SEQ ID NO: 18029 - protein, 10 aa, Artificial Sequence
  Peptide Derived from Human Papillomavirus
VHLKGDANTL

SEQ ID NO: 18030 - protein, 8 aa, Artificial Sequence
  Peptide Derived from Human Papillomavirus
VKHKSAIV

SEQ ID NO: 18031 - protein, 10 aa, Artificial Sequence
  Peptide Derived from Human Papillomavirus
VKHKSAIVTL

SEQ ID NO: 18032 - protein, 9 aa, Artificial Sequence
  Peptide Derived from Human Papillomavirus
VKIPKTITV

SEQ ID NO: 18033 - protein, 8 aa, Artificial Sequence
  Peptide Derived from Human Papillomavirus
WHWTGHNV

SEQ ID NO: 18034 - protein, 9 aa, Artificial Sequence
  Peptide Derived from Human Papillomavirus
WKHMRLECA

SEQ ID NO: 18035 - protein, 10 aa, Artificial Sequence
  Peptide Derived from Human Papillomavirus
WKHMRLECAI

SEQ ID NO: 18036 - protein, 11 aa, Artificial Sequence
  Peptide Derived from Human Papillomavirus
WKHMRLECAIY

SEQ ID NO: 18037 - protein, 8 aa, Artificial Sequence
  Peptide Derived from Human Papillomavirus
YKAREMGF

SEQ ID NO: 18038 - protein, 11 aa, Artificial Sequence
  Peptide Derived from Human Papillomavirus
YKAREMGFKHI

SEQ ID NO: 18039 - protein, 9 aa, Artificial Sequence
  Peptide Derived from Human Papillomavirus
YRFKKHCTL

SEQ ID NO: 18040 - protein, 10 aa, Artificial Sequence
  Peptide Derived from Human Papillomavirus
YRFKKHCTLY

SEQ ID NO: 18041 - protein, 8 aa, Artificial Sequence
  Peptide Derived from Human Papillomavirus
FRCFIVYI

SEQ ID NO: 18042 - protein, 9 aa, Artificial Sequence
  Peptide Derived from Human Papillomavirus
FRCFIVYII

SEQ ID NO: 18043 - protein, 10 aa, Artificial Sequence
  Peptide Derived from Human Papillomavirus
FRCFIVYIIF

SEQ ID NO: 18044 - protein, 11 aa, Artificial Sequence
  Peptide Derived from Human Papillomavirus
FRCFIVYIIFV

SEQ ID NO: 18045 - protein, 8 aa, Artificial Sequence
  Peptide Derived from Human Papillomavirus
IHTHARFL

SEQ ID NO: 18046 - protein, 9 aa, Artificial Sequence
  Peptide Derived from Human Papillomavirus
IHTHARFLI

SEQ ID NO: 18047 - protein, 8 aa, Artificial Sequence
  Peptide Derived from Human Papillomavirus
IRPLLLSV

SEQ ID NO: 18048 - protein, 11 aa, Artificial Sequence
  Peptide Derived from Human Papillomavirus
IRPLLLSVSTY

SEQ ID NO: 18049 - protein, 10 aa, Artificial Sequence
  Peptide Derived from Human Papillomavirus
CKQQLLRREV

SEQ ID NO: 18050 - protein, 11 aa, Artificial Sequence
  Peptide Derived from Human Papillomavirus
CKQQLLRREVY

SEQ ID NO: 18051 - protein, 10 aa, Artificial Sequence
  Peptide Derived from Human Papillomavirus
DKCLKFYSKI

SEQ ID NO: 18052 - protein, 9 aa, Artificial Sequence
  Peptide Derived from Human Papillomavirus
DKKQRFHNI

SEQ ID NO: 18053 - protein, 9 aa, Artificial Sequence
  Peptide Derived from Human Papillomavirus
ERPRKLPQL

SEQ ID NO: 18054 - protein, 8 aa, Artificial Sequence
  Peptide Derived from Human Papillomavirus
FHNIRGRW

SEQ ID NO: 18055 - protein, 8 aa, Artificial Sequence
  Peptide Derived from Human Papillomavirus
FRDLCIVY

SEQ ID NO: 18056 - protein, 8 aa, Artificial Sequence
  Peptide Derived from Human Papillomavirus
GRWTGRCM

SEQ ID NO: 18057 - protein, 9 aa, Artificial Sequence
  Peptide Derived from Human Papillomavirus
IHDIILECV

SEQ ID NO: 18058 - protein, 10 aa, Artificial Sequence
  Peptide Derived from Human Papillomavirus
IHDIILECVY

SEQ ID NO: 18059 - protein, 10 aa, Artificial Sequence
  Peptide Derived from Human Papillomavirus
IRCINCQKPL

SEQ ID NO: 18060 - protein, 10 aa, Artificial Sequence
  Peptide Derived from Human Papillomavirus
IRGRWTGRCM

SEQ ID NO: 18061 - protein, 8 aa, Artificial Sequence
  Peptide Derived from Human Papillomavirus
KKQRFHNI

SEQ ID NO: 18062 - protein, 10 aa, Artificial Sequence
  Peptide Derived from Human Papillomavirus
LKFYSKISEY

SEQ ID NO: 18063 - protein, 8 aa, Artificial Sequence
  Peptide Derived from Human Papillomavirus
LRREVYDF

SEQ ID NO: 18064 - protein, 9 aa, Artificial Sequence
  Peptide Derived from Human Papillomavirus
LRREVYDFA

SEQ ID NO: 18065 - protein, 10 aa, Artificial Sequence
  Peptide Derived from Human Papillomavirus
LRREVYDFAF

SEQ ID NO: 18066 - protein, 8 aa, Artificial Sequence
  Peptide Derived from Human Papillomavirus
MHQKRTAM

SEQ ID NO: 18067 - protein, 9 aa, Artificial Sequence
  Peptide Derived from Human Papillomavirus
MHQKRTAMF

SEQ ID NO: 18068 - protein, 8 aa, Artificial Sequence
  Peptide Derived from Human Papillomavirus
NKPLCDLL

SEQ ID NO: 18069 - protein, 9 aa, Artificial Sequence
  Peptide Derived from Human Papillomavirus
NKPLCDLLI

SEQ ID NO: 18070 - protein, 11 aa, Artificial Sequence
  Peptide Derived from Human Papillomavirus
PRKLPQLCTEL

SEQ ID NO: 18071 - protein, 10 aa, Artificial Sequence
  Peptide Derived from Human Papillomavirus
QRFHNIRGRW

SEQ ID NO: 18072 - protein, 10 aa, Artificial Sequence
  Peptide Derived from Human Papillomavirus
QRHLDKKQRF

SEQ ID NO: 18073 - protein, 9 aa, Artificial Sequence
  Peptide Derived from Human Papillomavirus
RHLDKKQRF

SEQ ID NO: 18074 - protein, 8 aa, Artificial Sequence
  Peptide Derived from Human Papillomavirus
RHYCYSLY

SEQ ID NO: 18075 - protein, 10 aa, Artificial Sequence
  Peptide Derived from Human Papillomavirus
RKLPQLCTEL

SEQ ID NO: 18076 - protein, 8 aa, Artificial Sequence
  Peptide Derived from Human Papillomavirus
RREVYDFA

SEQ ID NO: 18077 - protein, 9 aa, Artificial Sequence
  Peptide Derived from Human Papillomavirus
RREVYDFAF

SEQ ID NO: 18078 - protein, 9 aa, Artificial Sequence
  Peptide Derived from Human Papillomavirus
SKISEYRHY

SEQ ID NO: 18079 - protein, 11 aa, Artificial Sequence
  Peptide Derived from Human Papillomavirus
SKISEYRHYCY

SEQ ID NO: 18080 - protein, 9 aa, Artificial Sequence
  Peptide Derived from Human Papillomavirus
SRTRRETQL

SEQ ID NO: 18081 - protein, 8 aa, Artificial Sequence
  Peptide Derived from Human Papillomavirus
YRDGNPYA

SEQ ID NO: 18082 - protein, 9 aa, Artificial Sequence
  Peptide Derived from Human Papillomavirus
YRDGNPYAV

SEQ ID NO: 18083 - protein, 8 aa, Artificial Sequence
  Peptide Derived from Human Papillomavirus
YRHYCYSL

SEQ ID NO: 18084 - protein, 9 aa, Artificial Sequence
  Peptide Derived from Human Papillomavirus
YRHYCYSLY

SEQ ID NO: 18085 - protein, 8 aa, Artificial Sequence
  Peptide Derived from Human Papillomavirus
AHYNIVTF

SEQ ID NO: 18086 - protein, 9 aa, Artificial Sequence
  Peptide Derived from Human Papillomavirus
CKCDSTLRL

SEQ ID NO: 18087 - protein, 11 aa, Artificial Sequence
  Peptide Derived from Human Papillomavirus
CKCDSTLRLCV

SEQ ID NO: 18088 - protein, 8 aa, Artificial Sequence
  Peptide Derived from Human Papillomavirus
DRAHYNIV

SEQ ID NO: 18089 - protein, 10 aa, Artificial Sequence
  Peptide Derived from Human Papillomavirus
DRAHYNIVTF

SEQ ID NO: 18090 - protein, 8 aa, Artificial Sequence
  Peptide Derived from Human Papillomavirus
IRTLEDLL

SEQ ID NO: 18091 - protein, 9 aa, Artificial Sequence
  Peptide Derived from Human Papillomavirus
IRTLEDLLM

SEQ ID NO: 18092 - protein, 8 aa, Artificial Sequence
  Peptide Derived from Human Papillomavirus
LHEYMLDL

SEQ ID NO: 18093 - protein, 10 aa, Artificial Sequence
  Peptide Derived from Human Papillomavirus
LRLCVQSTHV

SEQ ID NO: 18094 - protein, 8 aa, Artificial Sequence
  Peptide Derived from Human Papillomavirus
MHGDTPTL

SEQ ID NO: 18095 - protein, 11 aa, Artificial Sequence
  Peptide Derived from Human Papillomavirus
MHGDTPTLHEY

SEQ ID NO: 18096 - protein, 8 aa, Artificial Sequence
  Peptide Derived from Human Papillomavirus
THVDIRTL

SEQ ID NO: 18097 - protein, 11 aa, Artificial Sequence
  Peptide Derived from Human Papillomavirus
THVDIRTLEDL

SEQ ID NO: 18098 - protein, 8 aa, Artificial Sequence
  Peptide Derived from Human Papillomavirus
AKRKKRKL

SEQ ID NO: 18099 - protein, 9 aa, Artificial Sequence
  Peptide Derived from Human Papillomavirus
ARTNIYYHA

SEQ ID NO: 18100 - protein, 9 aa, Artificial Sequence
  Peptide Derived from Human Papillomavirus
CKITLTADV

SEQ ID NO: 18101 - protein, 10 aa, Artificial Sequence
  Peptide Derived from Human Papillomavirus
CKITLTADVM

SEQ ID NO: 18102 - protein, 9 aa, Artificial Sequence
  Peptide Derived from Human Papillomavirus
CKPPIGEHW

SEQ ID NO: 18103 - protein, 9 aa, Artificial Sequence
  Peptide Derived from Human Papillomavirus
CKYPDYIKM

SEQ ID NO: 18104 - protein, 10 aa, Artificial Sequence
  Peptide Derived from Human Papillomavirus
CKYPDYIKMV

SEQ ID NO: 18105 - protein, 10 aa, Artificial Sequence
  Peptide Derived from Human Papillomavirus
EKFSADLDQF

SEQ ID NO: 18106 - protein, 11 aa, Artificial Sequence
  Peptide Derived from Human Papillomavirus
FKEYLRHGEEY

SEQ ID NO: 18107 - protein, 11 aa, Artificial Sequence
  Peptide Derived from Human Papillomavirus
FRIHLPDPNKF

SEQ ID NO: 18108 - protein, 8 aa, Artificial Sequence
  Peptide Derived from Human Papillomavirus
GHNNGICW

SEQ ID NO: 18109 - protein, 8 aa, Artificial Sequence
  Peptide Derived from Human Papillomavirus
GHPLLNKL

SEQ ID NO: 18110 - protein, 9 aa, Artificial Sequence
  Peptide Derived from Human Papillomavirus
GKGSPCTNV

SEQ ID NO: 18111 - protein, 10 aa, Artificial Sequence
  Peptide Derived from Human Papillomavirus
GKGSPCTNVA

SEQ ID NO: 18112 - protein, 11 aa, Artificial Sequence
  Peptide Derived from Human Papillomavirus
GKGSPCTNVAV

SEQ ID NO: 18113 - protein, 8 aa, Artificial Sequence
  Peptide Derived from Human Papillomavirus
GRGQPLGV

SEQ ID NO: 18114 - protein, 10 aa, Artificial Sequence
  Peptide Derived from Human Papillomavirus
GRGQPLGVGI

SEQ ID NO: 18115 - protein, 8 aa, Artificial Sequence
  Peptide Derived from Human Papillomavirus
GRKFLLQA

SEQ ID NO: 18116 - protein, 10 aa, Artificial Sequence
  Peptide Derived from Human Papillomavirus
GRKFLLQAGL

SEQ ID NO: 18117 - protein, 9 aa, Artificial Sequence
  Peptide Derived from Human Papillomavirus
IHLPDPNKF

SEQ ID NO: 18118 - protein, 11 aa, Artificial Sequence
  Peptide Derived from Human Papillomavirus
IHLPDPNKFGF

SEQ ID NO: 18119 - protein, 8 aa, Artificial Sequence
  Peptide Derived from Human Papillomavirus
IHSMNSTI

SEQ ID NO: 18120 - protein, 9 aa, Artificial Sequence
  Peptide Derived from Human Papillomavirus
IHSMNSTIL

SEQ ID NO: 18121 - protein, 8 aa, Artificial Sequence
  Peptide Derived from Human Papillomavirus
IKGSGSTA

SEQ ID NO: 18122 - protein, 10 aa, Artificial Sequence
  Peptide Derived from Human Papillomavirus
IKGSGSTANL

SEQ ID NO: 18123 - protein, 11 aa, Artificial Sequence
  Peptide Derived from Human Papillomavirus
IKGSGSTANLA

SEQ ID NO: 18124 - protein, 9 aa, Artificial Sequence
  Peptide Derived from Human Papillomavirus
IKKPNNNKI

SEQ ID NO: 18125 - protein, 10 aa, Artificial Sequence
  Peptide Derived from Human Papillomavirus
IKKPNNNKIL

SEQ ID NO: 18126 - protein, 11 aa, Artificial Sequence
  Peptide Derived from Human Papillomavirus
IKKPNNNKILV

SEQ ID NO: 18127 - protein, 8 aa, Artificial Sequence
  Peptide Derived from Human Papillomavirus
IKMVSEPY

SEQ ID NO: 18128 - protein, 8 aa, Artificial Sequence
  Peptide Derived from Human Papillomavirus
KKPNNNKI

SEQ ID NO: 18129 - protein, 9 aa, Artificial Sequence
  Peptide Derived from Human Papillomavirus
KKPNNNKIL

SEQ ID NO: 18130 - protein, 10 aa, Artificial Sequence
  Peptide Derived from Human Papillomavirus
KKPNNNKILV

SEQ ID NO: 18131 - protein, 8 aa, Artificial Sequence
  Peptide Derived from Human Papillomavirus
KKYTFWEV

SEQ ID NO: 18132 - protein, 10 aa, Artificial Sequence
  Peptide Derived from Human Papillomavirus
KKYTFWEVNL

SEQ ID NO: 18133 - protein, 9 aa, Artificial Sequence
  Peptide Derived from Human Papillomavirus
LKAKPKFTL

SEQ ID NO: 18134 - protein, 9 aa, Artificial Sequence
  Peptide Derived from Human Papillomavirus
LKEKFSADL

SEQ ID NO: 18135 - protein, 9 aa, Artificial Sequence
  Peptide Derived from Human Papillomavirus
LKKYTFWEV

SEQ ID NO: 18136 - protein, 11 aa, Artificial Sequence
  Peptide Derived from Human Papillomavirus
LKKYTFWEVNL

SEQ ID NO: 18137 - protein, 9 aa, Artificial Sequence
  Peptide Derived from Human Papillomavirus
LRHGEEYDL

SEQ ID NO: 18138 - protein, 11 aa, Artificial Sequence
  Peptide Derived from Human Papillomavirus
LRHGEEYDLQF

SEQ ID NO: 18139 - protein, 8 aa, Artificial Sequence
  Peptide Derived from Human Papillomavirus
LRREQMFV

SEQ ID NO: 18140 - protein, 11 aa, Artificial Sequence
  Peptide Derived from Human Papillomavirus
LRREQMFVRHL

SEQ ID NO: 18141 - protein, 10 aa, Artificial Sequence
  Peptide Derived from Human Papillomavirus
NKFGFPDTSF

SEQ ID NO: 18142 - protein, 11 aa, Artificial Sequence
  Peptide Derived from Human Papillomavirus
NKFGFPDTSFY

SEQ ID NO: 18143 - protein, 8 aa, Artificial Sequence
  Peptide Derived from Human Papillomavirus
NKILVPKV

SEQ ID NO: 18144 - protein, 11 aa, Artificial Sequence
  Peptide Derived from Human Papillomavirus
NKILVPKVSGL

SEQ ID NO: 18145 - protein, 9 aa, Artificial Sequence
  Peptide Derived from Human Papillomavirus
NKLDDTENA

SEQ ID NO: 18146 - protein, 11 aa, Artificial Sequence
  Peptide Derived from Human Papillomavirus
NKLDDTENASA

SEQ ID NO: 18147 - protein, 9 aa, Artificial Sequence
  Peptide Derived from Human Papillomavirus
NKPYWLQRA

SEQ ID NO: 18148 - protein, 9 aa, Artificial Sequence
  Peptide Derived from Human Papillomavirus
NKSEVPLDI

SEQ ID NO: 18149 - protein, 10 aa, Artificial Sequence
  Peptide Derived from Human Papillomavirus
NRAGAVGENV

SEQ ID NO: 18150 - protein, 9 aa, Artificial Sequence
  Peptide Derived from Human Papillomavirus
NRECISMDY

SEQ ID NO: 18151 - protein, 9 aa, Artificial Sequence
  Peptide Derived from Human Papillomavirus
PKEDPLKKY

SEQ ID NO: 18152 - protein, 11 aa, Artificial Sequence
  Peptide Derived from Human Papillomavirus
PKEDPLKKYTF

SEQ ID NO: 18153 - protein, 10 aa, Artificial Sequence
  Peptide Derived from Human Papillomavirus
PKFTLGKRKA

SEQ ID NO: 18154 - protein, 8 aa, Artificial Sequence
  Peptide Derived from Human Papillomavirus
PKVSGLQY

SEQ ID NO: 18155 - protein, 10 aa, Artificial Sequence
  Peptide Derived from Human Papillomavirus
PKVSGLQYRV

SEQ ID NO: 18156 - protein, 11 aa, Artificial Sequence
  Peptide Derived from Human Papillomavirus
PKVSGLQYRVF

SEQ ID NO: 18157 - protein, 10 aa, Artificial Sequence
  Peptide Derived from Human Papillomavirus
QRAQGHNNGI

SEQ ID NO: 18158 - protein, 8 aa, Artificial Sequence
  Peptide Derived from Human Papillomavirus
QRLVWACV

SEQ ID NO: 18159 - protein, 10 aa, Artificial Sequence
  Peptide Derived from Human Papillomavirus
QRLVWACVGV

SEQ ID NO: 18160 - protein, 8 aa, Artificial Sequence
  Peptide Derived from Human Papillomavirus
RHGEEYDL

SEQ ID NO: 18161 - protein, 10 aa, Artificial Sequence
  Peptide Derived from Human Papillomavirus
RHGEEYDLQF

SEQ ID NO: 18162 - protein, 11 aa, Artificial Sequence
  Peptide Derived from Human Papillomavirus
RHGEEYDLQFI

SEQ ID NO: 18163 - protein, 9 aa, Artificial Sequence
  Peptide Derived from Human Papillomavirus
RHLFNRAGA

SEQ ID NO: 18164 - protein, 10 aa, Artificial Sequence
  Peptide Derived from Human Papillomavirus
RHLFNRAGAV

SEQ ID NO: 18165 - protein, 9 aa, Artificial Sequence
  Peptide Derived from Human Papillomavirus
RKFLLQAGL

SEQ ID NO: 18166 - protein, 11 aa, Artificial Sequence
  Peptide Derived from Human Papillomavirus
RKFLLQAGLKA

SEQ ID NO: 18167 - protein, 10 aa, Artificial Sequence
  Peptide Derived from Human Papillomavirus
RREQMFVRHL

SEQ ID NO: 18168 - protein, 11 aa, Artificial Sequence
  Peptide Derived from Human Papillomavirus
RREQMFVRHLF

SEQ ID NO: 18169 - protein, 9 aa, Artificial Sequence
  Peptide Derived from Human Papillomavirus
SKVVSTDEY

SEQ ID NO: 18170 - protein, 10 aa, Artificial Sequence
  Peptide Derived from Human Papillomavirus
SKVVSTDEYV

SEQ ID NO: 18171 - protein, 11 aa, Artificial Sequence
  Peptide Derived from Human Papillomavirus
SKVVSTDEYVA

SEQ ID NO: 18172 - protein, 10 aa, Artificial Sequence
  Peptide Derived from Human Papillomavirus
SRLLAVGHPY

SEQ ID NO: 18173 - protein, 11 aa, Artificial Sequence
  Peptide Derived from Human Papillomavirus
SRLLAVGHPYF

SEQ ID NO: 18174 - protein, 8 aa, Artificial Sequence
  Peptide Derived from Human Papillomavirus
TRSTNMSL

SEQ ID NO: 18175 - protein, 10 aa, Artificial Sequence
  Peptide Derived from Human Papillomavirus
TRSTNMSLCA

SEQ ID NO: 18176 - protein, 11 aa, Artificial Sequence
  Peptide Derived from Human Papillomavirus
TRSTNMSLCAA

SEQ ID NO: 18177 - protein, 8 aa, Artificial Sequence
  Peptide Derived from Human Papillomavirus
VRHLFNRA

SEQ ID NO: 18178 - protein, 10 aa, Artificial Sequence
  Peptide Derived from Human Papillomavirus
VRHLFNRAGA

SEQ ID NO: 18179 - protein, 11 aa, Artificial Sequence
  Peptide Derived from Human Papillomavirus
VRHLFNRAGAV

SEQ ID NO: 18180 - protein, 8 aa, Artificial Sequence
  Peptide Derived from Human Papillomavirus
YHAGTSRL

SEQ ID NO: 18181 - protein, 9 aa, Artificial Sequence
  Peptide Derived from Human Papillomavirus
YHAGTSRLL

SEQ ID NO: 18182 - protein, 10 aa, Artificial Sequence
  Peptide Derived from Human Papillomavirus
YHAGTSRLLA

SEQ ID NO: 18183 - protein, 11 aa, Artificial Sequence
  Peptide Derived from Human Papillomavirus
YHAGTSRLLAV

SEQ ID NO: 18184 - protein, 9 aa, Artificial Sequence
  Peptide Derived from Human Papillomavirus
YHIFFQMSL

SEQ ID NO: 18185 - protein, 10 aa, Artificial Sequence
  Peptide Derived from Human Papillomavirus
YHIFFQMSLW

SEQ ID NO: 18186 - protein, 11 aa, Artificial Sequence
  Peptide Derived from Human Papillomavirus
YHIFFQMSLWL

SEQ ID NO: 18187 - protein, 9 aa, Artificial Sequence
  Peptide Derived from Human Papillomavirus
YKNTNFKEY

SEQ ID NO: 18188 - protein, 10 aa, Artificial Sequence
  Peptide Derived from Human Papillomavirus
YKNTNFKEYL

SEQ ID NO: 18189 - protein, 8 aa, Artificial Sequence
  Peptide Derived from Human Papillomavirus
YKQTQLCL

SEQ ID NO: 18190 - protein, 9 aa, Artificial Sequence
  Peptide Derived from Human Papillomavirus
YKQTQLCLI

SEQ ID NO: 18191 - protein, 8 aa, Artificial Sequence
  Peptide Derived from Human Papillomavirus
YRFVTSQA

SEQ ID NO: 18192 - protein, 9 aa, Artificial Sequence
  Peptide Derived from Human Papillomavirus
YRFVTSQAI

SEQ ID NO: 18193 - protein, 10 aa, Artificial Sequence
  Peptide Derived from Human Papillomavirus
YRFVTSQAIA

SEQ ID NO: 18194 - protein, 8 aa, Artificial Sequence
  Peptide Derived from Human Papillomavirus
YRVFRIHL

SEQ ID NO: 18195 - protein, 9 aa, Artificial Sequence
  Peptide Derived from Human Papillomavirus
AKRTKRASA

SEQ ID NO: 18196 - protein, 9 aa, Artificial Sequence
  Peptide Derived from Human Papillomavirus
AKVHYYYDF

SEQ ID NO: 18197 - protein, 11 aa, Artificial Sequence
  Peptide Derived from Human Papillomavirus
CKQAGTCPPDI

SEQ ID NO: 18198 - protein, 10 aa, Artificial Sequence
  Peptide Derived from Human Papillomavirus
GHFTLSSSTI

SEQ ID NO: 18199 - protein, 8 aa, Artificial Sequence
  Peptide Derived from Human Papillomavirus
GKSIGAKV

SEQ ID NO: 18200 - protein, 10 aa, Artificial Sequence
  Peptide Derived from Human Papillomavirus
GKSIGAKVHY

SEQ ID NO: 18201 - protein, 11 aa, Artificial Sequence
  Peptide Derived from Human Papillomavirus
GKSIGAKVHYY

SEQ ID NO: 18202 - protein, 8 aa, Artificial Sequence
  Peptide Derived from Human Papillomavirus
GKTIADQI

SEQ ID NO: 18203 - protein, 9 aa, Artificial Sequence
  Peptide Derived from Human Papillomavirus
GKTIADQIL

SEQ ID NO: 18204 - protein, 11 aa, Artificial Sequence
  Peptide Derived from Human Papillomavirus
GKTIADQILQY

SEQ ID NO: 18205 - protein, 8 aa, Artificial Sequence
  Peptide Derived from Human Papillomavirus
GRTGYIPL

SEQ ID NO: 18206 - protein, 11 aa, Artificial Sequence
  Peptide Derived from Human Papillomavirus
HKRSAKRTKRA

SEQ ID NO: 18207 - protein, 8 aa, Artificial Sequence
  Peptide Derived from Human Papillomavirus
KRASATQL

SEQ ID NO: 18208 - protein, 9 aa, Artificial Sequence
  Peptide Derived from Human Papillomavirus
KRASATQLY

SEQ ID NO: 18209 - protein, 10 aa, Artificial Sequence
  Peptide Derived from Human Papillomavirus
KRLPYFFSDV

SEQ ID NO: 18210 - protein, 8 aa, Artificial Sequence
  Peptide Derived from Human Papillomavirus
KRRKRLPY

SEQ ID NO: 18211 - protein, 9 aa, Artificial Sequence
  Peptide Derived from Human Papillomavirus
KRRKRLPYF

SEQ ID NO: 18212 - protein, 10 aa, Artificial Sequence
  Peptide Derived from Human Papillomavirus
KRRKRLPYFF

SEQ ID NO: 18213 - protein, 10 aa, Artificial Sequence
  Peptide Derived from Human Papillomavirus
KRSAKRTKRA

SEQ ID NO: 18214 - protein, 8 aa, Artificial Sequence
  Peptide Derived from Human Papillomavirus
KRTKRASA

SEQ ID NO: 18215 - protein, 11 aa, Artificial Sequence
  Peptide Derived from Human Papillomavirus
KRTKRASATQL

SEQ ID NO: 18216 - protein, 8 aa, Artificial Sequence
  Peptide Derived from Human Papillomavirus
LHPSYYML

SEQ ID NO: 18217 - protein, 8 aa, Artificial Sequence
  Peptide Derived from Human Papillomavirus
LRKRRKRL

SEQ ID NO: 18218 - protein, 10 aa, Artificial Sequence
  Peptide Derived from Human Papillomavirus
LRKRRKRLPY

SEQ ID NO: 18219 - protein, 11 aa, Artificial Sequence
  Peptide Derived from Human Papillomavirus
LRKRRKRLPYF

SEQ ID NO: 18220 - protein, 9 aa, Artificial Sequence
  Peptide Derived from Human Papillomavirus
LRTRSGKSI

SEQ ID NO: 18221 - protein, 11 aa, Artificial Sequence
  Peptide Derived from Human Papillomavirus
LRTRSGKSIGA

SEQ ID NO: 18222 - protein, 8 aa, Artificial Sequence
  Peptide Derived from Human Papillomavirus
PKVEGKTI

SEQ ID NO: 18223 - protein, 9 aa, Artificial Sequence
  Peptide Derived from Human Papillomavirus
PKVEGKTIA

SEQ ID NO: 18224 - protein, 8 aa, Artificial Sequence
  Peptide Derived from Human Papillomavirus
RKRLPYFF

SEQ ID NO: 18225 - protein, 11 aa, Artificial Sequence
  Peptide Derived from Human Papillomavirus
RKRLPYFFSDV

SEQ ID NO: 18226 - protein, 9 aa, Artificial Sequence
  Peptide Derived from Human Papillomavirus
RKRRKRLPY

SEQ ID NO: 18227 - protein, 10 aa, Artificial Sequence
  Peptide Derived from Human Papillomavirus
RKRRKRLPYF

SEQ ID NO: 18228 - protein, 11 aa, Artificial Sequence
  Peptide Derived from Human Papillomavirus
RKRRKRLPYFF

SEQ ID NO: 18229 - protein, 8 aa, Artificial Sequence
  Peptide Derived from Human Papillomavirus
RRKRLPYF

SEQ ID NO: 18230 - protein, 9 aa, Artificial Sequence
  Peptide Derived from Human Papillomavirus
RRKRLPYFF

SEQ ID NO: 18231 - protein, 10 aa, Artificial Sequence
  Peptide Derived from Human Papillomavirus
RRTGIRYSRI

SEQ ID NO: 18232 - protein, 9 aa, Artificial Sequence
  Peptide Derived from Human Papillomavirus
SHAALPTSI

SEQ ID NO: 18233 - protein, 9 aa, Artificial Sequence
  Peptide Derived from Human Papillomavirus
SRIGNKQTL

SEQ ID NO: 18234 - protein, 9 aa, Artificial Sequence
  Peptide Derived from Human Papillomavirus
SRPVARLGL

SEQ ID NO: 18235 - protein, 10 aa, Artificial Sequence
  Peptide Derived from Human Papillomavirus
SRPVARLGLY

SEQ ID NO: 18236 - protein, 8 aa, Artificial Sequence
  Peptide Derived from Human Papillomavirus
SRRTGIRY

SEQ ID NO: 18237 - protein, 11 aa, Artificial Sequence
  Peptide Derived from Human Papillomavirus
SRRTGIRYSRI

SEQ ID NO: 18238 - protein, 9 aa, Artificial Sequence
  Peptide Derived from Human Papillomavirus
SRTTQQVKV

SEQ ID NO: 18239 - protein, 10 aa, Artificial Sequence
  Peptide Derived from Human Papillomavirus
SRTTQQVKVV

SEQ ID NO: 18240 - protein, 9 aa, Artificial Sequence
  Peptide Derived from Human Papillomavirus
THNYEEIPM

SEQ ID NO: 18241 - protein, 10 aa, Artificial Sequence
  Peptide Derived from Human Papillomavirus
TKLITYDNPA

SEQ ID NO: 18242 - protein, 11 aa, Artificial Sequence
  Peptide Derived from Human Papillomavirus
TKLITYDNPAY

SEQ ID NO: 18243 - protein, 9 aa, Artificial Sequence
  Peptide Derived from Human Papillomavirus
TKRASATQL

SEQ ID NO: 18244 - protein, 10 aa, Artificial Sequence
  Peptide Derived from Human Papillomavirus
TKRASATQLY

SEQ ID NO: 18245 - protein, 10 aa, Artificial Sequence
  Peptide Derived from Human Papillomavirus
TRPPTATDTL

SEQ ID NO: 18246 - protein, 11 aa, Artificial Sequence
  Peptide Derived from Human Papillomavirus
TRPPTATDTLA

SEQ ID NO: 18247 - protein, 9 aa, Artificial Sequence
  Peptide Derived from Human Papillomavirus
TRSGKSIGA

SEQ ID NO: 18248 - protein, 11 aa, Artificial Sequence
  Peptide Derived from Human Papillomavirus
TRSGKSIGAKV

SEQ ID NO: 18249 - protein, 10 aa, Artificial Sequence
  Peptide Derived from Human Papillomavirus
VHYYYDFSTI

SEQ ID NO: 18250 - protein, 8 aa, Artificial Sequence
  Peptide Derived from Human Papillomavirus
VKVVDPAF

SEQ ID NO: 18251 - protein, 9 aa, Artificial Sequence
  Peptide Derived from Human Papillomavirus
VKVVDPAFI

SEQ ID NO: 18252 - protein, 10 aa, Artificial Sequence
  Peptide Derived from Human Papillomavirus
VRPPLTVDPV

SEQ ID NO: 18253 - protein, 10 aa, Artificial Sequence
  Peptide Derived from Human Papillomavirus
AHIQCLDCKW

SEQ ID NO: 18254 - protein, 8 aa, Artificial Sequence
  Peptide Derived from Human Papillomavirus
AKDNRWPY

SEQ ID NO: 18255 - protein, 9 aa, Artificial Sequence
  Peptide Derived from Human Papillomavirus
AKDNRWPYL

SEQ ID NO: 18256 - protein, 8 aa, Artificial Sequence
  Peptide Derived from Human Papillomavirus
AKGLSTLL

SEQ ID NO: 18257 - protein, 10 aa, Artificial Sequence
  Peptide Derived from Human Papillomavirus
AKGLSTLLHV

SEQ ID NO: 18258 - protein, 8 aa, Artificial Sequence
  Peptide Derived from Human Papillomavirus
AKRRLFTI

SEQ ID NO: 18259 - protein, 8 aa, Artificial Sequence
  Peptide Derived from Human Papillomavirus
AKYLKDCA

SEQ ID NO: 18260 - protein, 10 aa, Artificial Sequence
  Peptide Derived from Human Papillomavirus
AKYLKDCATM

SEQ ID NO: 18261 - protein, 8 aa, Artificial Sequence
  Peptide Derived from Human Papillomavirus
CKWGVLIL

SEQ ID NO: 18262 - protein, 9 aa, Artificial Sequence
  Peptide Derived from Human Papillomavirus
CKWGVLILA

SEQ ID NO: 18263 - protein, 10 aa, Artificial Sequence
  Peptide Derived from Human Papillomavirus
CKWGVLILAL

SEQ ID NO: 18264 - protein, 11 aa, Artificial Sequence
  Peptide Derived from Human Papillomavirus
CKWGVLILALL

SEQ ID NO: 18265 - protein, 8 aa, Artificial Sequence
  Peptide Derived from Human Papillomavirus
DKKTGDVI

SEQ ID NO: 18266 - protein, 8 aa, Artificial Sequence
  Peptide Derived from Human Papillomavirus
DKNGNPVY

SEQ ID NO: 18267 - protein, 10 aa, Artificial Sequence
  Peptide Derived from Human Papillomavirus
DKNGNPVYEI

SEQ ID NO: 18268 - protein, 8 aa, Artificial Sequence
  Peptide Derived from Human Papillomavirus
DKNWKCFF

SEQ ID NO: 18269 - protein, 8 aa, Artificial Sequence
  Peptide Derived from Human Papillomavirus
DKTTCTDW

SEQ ID NO: 18270 - protein, 9 aa, Artificial Sequence
  Peptide Derived from Human Papillomavirus
DKTTCTDWV

SEQ ID NO: 18271 - protein, 11 aa, Artificial Sequence
  Peptide Derived from Human Papillomavirus
DKTTCTDWVTA

SEQ ID NO: 18272 - protein, 8 aa, Artificial Sequence
  Peptide Derived from Human Papillomavirus
DRKHKPLI

SEQ ID NO: 18273 - protein, 10 aa, Artificial Sequence
  Peptide Derived from Human Papillomavirus
DRKHKPLIQL

SEQ ID NO: 18274 - protein, 9 aa, Artificial Sequence
  Peptide Derived from Human Papillomavirus
ERLEVDTEL

SEQ ID NO: 18275 - protein, 9 aa, Artificial Sequence
  Peptide Derived from Human Papillomavirus
ERTWSRLDL

SEQ ID NO: 18276 - protein, 10 aa, Artificial Sequence
  Peptide Derived from Human Papillomavirus
FHAQEVHNDA

SEQ ID NO: 18277 - protein, 9 aa, Artificial Sequence
  Peptide Derived from Human Papillomavirus
FKDTYGLSF

SEQ ID NO: 18278 - protein, 11 aa, Artificial Sequence
  Peptide Derived from Human Papillomavirus
FKSDKTTCTDW

SEQ ID NO: 18279 - protein, 8 aa, Artificial Sequence
  Peptide Derived from Human Papillomavirus
FKTLIQPF

SEQ ID NO: 18280 - protein, 9 aa, Artificial Sequence
  Peptide Derived from Human Papillomavirus
FKTLIQPFI

SEQ ID NO: 18281 - protein, 10 aa, Artificial Sequence
  Peptide Derived from Human Papillomavirus
FKTLIQPFIL

SEQ ID NO: 18282 - protein, 11 aa, Artificial Sequence
  Peptide Derived from Human Papillomavirus
FKTLIQPFILY

SEQ ID NO: 18283 - protein, 8 aa, Artificial Sequence
  Peptide Derived from Human Papillomavirus
GKSRLTVA

SEQ ID NO: 18284 - protein, 11 aa, Artificial Sequence
  Peptide Derived from Human Papillomavirus
GKSRLTVAKGL

SEQ ID NO: 18285 - protein, 9 aa, Artificial Sequence
  Peptide Derived from Human Papillomavirus
GKSYFGMSF

SEQ ID NO: 18286 - protein, 10 aa, Artificial Sequence
  Peptide Derived from Human Papillomavirus
GKSYFGMSFI

SEQ ID NO: 18287 - protein, 8 aa, Artificial Sequence
  Peptide Derived from Human Papillomavirus
IHFIQGAV

SEQ ID NO: 18288 - protein, 9 aa, Artificial Sequence
  Peptide Derived from Human Papillomavirus
IHFIQGAVI

SEQ ID NO: 18289 - protein, 11 aa, Artificial Sequence
  Peptide Derived from Human Papillomavirus
IHFIQGAVISF

SEQ ID NO: 18290 - protein, 9 aa, Artificial Sequence
  Peptide Derived from Human Papillomavirus
IHPAKDNRW

SEQ ID NO: 18291 - protein, 11 aa, Artificial Sequence
  Peptide Derived from Human Papillomavirus
IHPAKDNRWPY

SEQ ID NO: 18292 - protein, 8 aa, Artificial Sequence
  Peptide Derived from Human Papillomavirus
IRFRCSKI

SEQ ID NO: 18293 - protein, 8 aa, Artificial Sequence
  Peptide Derived from Human Papillomavirus
KHKPLIQL

SEQ ID NO: 18294 - protein, 11 aa, Artificial Sequence
  Peptide Derived from Human Papillomavirus
KHYRRAQKRQM

SEQ ID NO: 18295 - protein, 8 aa, Artificial Sequence
  Peptide Derived from Human Papillomavirus
KKAKRRLF

SEQ ID NO: 18296 - protein, 10 aa, Artificial Sequence
  Peptide Derived from Human Papillomavirus
KKAKRRLFTI

SEQ ID NO: 18297 - protein, 11 aa, Artificial Sequence
  Peptide Derived from Human Papillomavirus
KKNCLVFCGPA

SEQ ID NO: 18298 - protein, 9 aa, Artificial Sequence
  Peptide Derived from Human Papillomavirus
KRQMNMSQW

SEQ ID NO: 18299 - protein, 10 aa, Artificial Sequence
  Peptide Derived from Human Papillomavirus
KRQMNMSQWI

SEQ ID NO: 18300 - protein, 8 aa, Artificial Sequence
  Peptide Derived from Human Papillomavirus
LHEEEEDA

SEQ ID NO: 18301 - protein, 8 aa, Artificial Sequence
  Peptide Derived from Human Papillomavirus
LHVLKRKF

SEQ ID NO: 18302 - protein, 9 aa, Artificial Sequence
  Peptide Derived from Human Papillomavirus
LHVLKRKFA

SEQ ID NO: 18303 - protein, 8 aa, Artificial Sequence
  Peptide Derived from Human Papillomavirus
LHVPETCM

SEQ ID NO: 18304 - protein, 9 aa, Artificial Sequence
  Peptide Derived from Human Papillomavirus
LHVPETCML

SEQ ID NO: 18305 - protein, 10 aa, Artificial Sequence
  Peptide Derived from Human Papillomavirus
LHVPETCMLI

SEQ ID NO: 18306 - protein, 8 aa, Artificial Sequence
  Peptide Derived from Human Papillomavirus
LKCPPILL

SEQ ID NO: 18307 - protein, 11 aa, Artificial Sequence
  Peptide Derived from Human Papillomavirus
LKDCATMCKHY

SEQ ID NO: 18308 - protein, 10 aa, Artificial Sequence
  Peptide Derived from Human Papillomavirus
LKGTPKKNCL

SEQ ID NO: 18309 - protein, 11 aa, Artificial Sequence
  Peptide Derived from Human Papillomavirus
LKGTPKKNCLV

SEQ ID NO: 18310 - protein, 9 aa, Artificial Sequence
  Peptide Derived from Human Papillomavirus
LKSNCQAKY

SEQ ID NO: 18311 - protein, 10 aa, Artificial Sequence
  Peptide Derived from Human Papillomavirus
LKSNCQAKYL

SEQ ID NO: 18312 - protein, 9 aa, Artificial Sequence
  Peptide Derived from Human Papillomavirus
LKVNNKQGA

SEQ ID NO: 18313 - protein, 10 aa, Artificial Sequence
  Peptide Derived from Human Papillomavirus
LKVNNKQGAM

SEQ ID NO: 18314 - protein, 11 aa, Artificial Sequence
  Peptide Derived from Human Papillomavirus
LKVNNKQGAML

SEQ ID NO: 18315 - protein, 10 aa, Artificial Sequence
  Peptide Derived from Human Papillomavirus
LRAGQNHRPL

SEQ ID NO: 18316 - protein, 8 aa, Artificial Sequence
  Peptide Derived from Human Papillomavirus
LRSSVAAL

SEQ ID NO: 18317 - protein, 9 aa, Artificial Sequence
  Peptide Derived from Human Papillomavirus
LRSSVAALY

SEQ ID NO: 18318 - protein, 10 aa, Artificial Sequence
  Peptide Derived from Human Papillomavirus
LRSSVAALYW

SEQ ID NO: 18319 - protein, 11 aa, Artificial Sequence
  Peptide Derived from Human Papillomavirus
LRSSVAALYWY

SEQ ID NO: 18320 - protein, 10 aa, Artificial Sequence
  Peptide Derived from Human Papillomavirus
LRYKCGKSRL

SEQ ID NO: 18321 - protein, 8 aa, Artificial Sequence
  Peptide Derived from Human Papillomavirus
LRYQQIEF

SEQ ID NO: 18322 - protein, 9 aa, Artificial Sequence
  Peptide Derived from Human Papillomavirus
LRYQQIEFI

SEQ ID NO: 18323 - protein, 11 aa, Artificial Sequence
  Peptide Derived from Human Papillomavirus
LRYQQIEFITF

SEQ ID NO: 18324 - protein, 10 aa, Artificial Sequence
  Peptide Derived from Human Papillomavirus
MRNALDGNPI

SEQ ID NO: 18325 - protein, 8 aa, Artificial Sequence
  Peptide Derived from Human Papillomavirus
NKQGAMLA

SEQ ID NO: 18326 - protein, 9 aa, Artificial Sequence
  Peptide Derived from Human Papillomavirus
NKQGAMLAV

SEQ ID NO: 18327 - protein, 10 aa, Artificial Sequence
  Peptide Derived from Human Papillomavirus
NKQGAMLAVF

SEQ ID NO: 18328 - protein, 10 aa, Artificial Sequence
  Peptide Derived from Human Papillomavirus
NRWPYLESRI

SEQ ID NO: 18329 - protein, 8 aa, Artificial Sequence
  Peptide Derived from Human Papillomavirus
PKKNCLVF

SEQ ID NO: 18330 - protein, 8 aa, Artificial Sequence
  Peptide Derived from Human Papillomavirus
PKLRSSVA

SEQ ID NO: 18331 - protein, 9 aa, Artificial Sequence
  Peptide Derived from Human Papillomavirus
PKLRSSVAA

SEQ ID NO: 18332 - protein, 10 aa, Artificial Sequence
  Peptide Derived from Human Papillomavirus
PKLRSSVAAL

SEQ ID NO: 18333 - protein, 11 aa, Artificial Sequence
  Peptide Derived from Human Papillomavirus
PKLRSSVAALY

SEQ ID NO: 18334 - protein, 8 aa, Artificial Sequence
  Peptide Derived from Human Papillomavirus
PRLQEISL

SEQ ID NO: 18335 - protein, 9 aa, Artificial Sequence
  Peptide Derived from Human Papillomavirus
QHGIDDSNF

SEQ ID NO: 18336 - protein, 11 aa, Artificial Sequence
  Peptide Derived from Human Papillomavirus
QHGIDDSNFDL

SEQ ID NO: 18337 - protein, 8 aa, Artificial Sequence
  Peptide Derived from Human Papillomavirus
QKKAKRRL

SEQ ID NO: 18338 - protein, 9 aa, Artificial Sequence
  Peptide Derived from Human Papillomavirus
QKKAKRRLF

SEQ ID NO: 18339 - protein, 11 aa, Artificial Sequence
  Peptide Derived from Human Papillomavirus
QKKAKRRLFTI

SEQ ID NO: 18340 - protein, 10 aa, Artificial Sequence
  Peptide Derived from Human Papillomavirus
QKRQMNMSQW

SEQ ID NO: 18341 - protein, 11 aa, Artificial Sequence
  Peptide Derived from Human Papillomavirus
QKRQMNMSQWI

SEQ ID NO: 18342 - protein, 10 aa, Artificial Sequence
  Peptide Derived from Human Papillomavirus
QRLTIIQHGI

SEQ ID NO: 18343 - protein, 9 aa, Artificial Sequence
  Peptide Derived from Human Papillomavirus
RKHKPLIQL

SEQ ID NO: 18344 - protein, 8 aa, Artificial Sequence
  Peptide Derived from Human Papillomavirus
RRAQKRQM

SEQ ID NO: 18345 - protein, 10 aa, Artificial Sequence
  Peptide Derived from Human Papillomavirus
RRAQKRQMNM

SEQ ID NO: 18346 - protein, 11 aa, Artificial Sequence
  Peptide Derived from Human Papillomavirus
RRLFTISDSGY

SEQ ID NO: 18347 - protein, 8 aa, Artificial Sequence
  Peptide Derived from Human Papillomavirus
SHFWLEPL

SEQ ID NO: 18348 - protein, 9 aa, Artificial Sequence
  Peptide Derived from Human Papillomavirus
SKIDEGGDW

SEQ ID NO: 18349 - protein, 8 aa, Artificial Sequence
  Peptide Derived from Human Papillomavirus
SRITVFEF

SEQ ID NO: 18350 - protein, 11 aa, Artificial Sequence
  Peptide Derived from Human Papillomavirus
SRITVFEFPNA

SEQ ID NO: 18351 - protein, 9 aa, Artificial Sequence
  Peptide Derived from Human Papillomavirus
SRLTVAKGL

SEQ ID NO: 18352 - protein, 9 aa, Artificial Sequence
  Peptide Derived from Human Papillomavirus
TKVAMLDDA

SEQ ID NO: 18353 - protein, 8 aa, Artificial Sequence
  Peptide Derived from Human Papillomavirus
VHNDAQVL

SEQ ID NO: 18354 - protein, 10 aa, Artificial Sequence
  Peptide Derived from Human Papillomavirus
VHNDAQVLHV

SEQ ID NO: 18355 - protein, 11 aa, Artificial Sequence
  Peptide Derived from Human Papillomavirus
VHNDAQVLHVL

SEQ ID NO: 18356 - protein, 9 aa, Artificial Sequence
  Peptide Derived from Human Papillomavirus
WKCFFERTW

SEQ ID NO: 18357 - protein, 8 aa, Artificial Sequence
  Peptide Derived from Human Papillomavirus
WRPIVQFL

SEQ ID NO: 18358 - protein, 10 aa, Artificial Sequence
  Peptide Derived from Human Papillomavirus
WRPIVQFLRY

SEQ ID NO: 18359 - protein, 8 aa, Artificial Sequence
  Peptide Derived from Human Papillomavirus
YKCGKSRL

SEQ ID NO: 18360 - protein, 10 aa, Artificial Sequence
  Peptide Derived from Human Papillomavirus
YKCGKSRLTV

SEQ ID NO: 18361 - protein, 11 aa, Artificial Sequence
  Peptide Derived from Human Papillomavirus
YKCGKSRLTVA

SEQ ID NO: 18362 - protein, 9 aa, Artificial Sequence
  Peptide Derived from Human Papillomavirus
YRRAQKRQM

SEQ ID NO: 18363 - protein, 11 aa, Artificial Sequence
  Peptide Derived from Human Papillomavirus
YRRAQKRQMNM

SEQ ID NO: 18364 - protein, 8 aa, Artificial Sequence
  Peptide Derived from Human Papillomavirus
YRTGISNI

SEQ ID NO: 18365 - protein, 11 aa, Artificial Sequence
  Peptide Derived from Human Papillomavirus
YRTGISNISEV

SEQ ID NO: 18366 - protein, 9 aa, Artificial Sequence
  Peptide Derived from Human Papillomavirus
AHKAIELQM

SEQ ID NO: 18367 - protein, 10 aa, Artificial Sequence
  Peptide Derived from Human Papillomavirus
AHKAIELQMA

SEQ ID NO: 18368 - protein, 11 aa, Artificial Sequence
  Peptide Derived from Human Papillomavirus
AHKAIELQMAL

SEQ ID NO: 18369 - protein, 9 aa, Artificial Sequence
  Peptide Derived from Human Papillomavirus
AKTYGQTSA

SEQ ID NO: 18370 - protein, 10 aa, Artificial Sequence
  Peptide Derived from Human Papillomavirus
AKTYGQTSAA

SEQ ID NO: 18371 - protein, 9 aa, Artificial Sequence
  Peptide Derived from Human Papillomavirus
AREHGIQTL

SEQ ID NO: 18372 - protein, 10 aa, Artificial Sequence
  Peptide Derived from Human Papillomavirus
DHYENDSKDI

SEQ ID NO: 18373 - protein, 10 aa, Artificial Sequence
  Peptide Derived from Human Papillomavirus
DHYRDISSTW

SEQ ID NO: 18374 - protein, 8 aa, Artificial Sequence
  Peptide Derived from Human Papillomavirus
DRNSLKCL

SEQ ID NO: 18375 - protein, 10 aa, Artificial Sequence
  Peptide Derived from Human Papillomavirus
DRNSLKCLRY

SEQ ID NO: 18376 - protein, 11 aa, Artificial Sequence
  Peptide Derived from Human Papillomavirus
EHGIQTLNHQV

SEQ ID NO: 18377 - protein, 8 aa, Artificial Sequence
  Peptide Derived from Human Papillomavirus
EKQHCGPV

SEQ ID NO: 18378 - protein, 11 aa, Artificial Sequence
  Peptide Derived from Human Papillomavirus
EKQHCGPVNPL

SEQ ID NO: 18379 - protein, 8 aa, Artificial Sequence
  Peptide Derived from Human Papillomavirus
EKTGILTV

SEQ ID NO: 18380 - protein, 10 aa, Artificial Sequence
  Peptide Derived from Human Papillomavirus
EKTGILTVTY

SEQ ID NO: 18381 - protein, 9 aa, Artificial Sequence
  Peptide Derived from Human Papillomavirus
EKYGNTGTW

SEQ ID NO: 18382 - protein, 11 aa, Artificial Sequence
  Peptide Derived from Human Papillomavirus
EKYGNTGTWEV

SEQ ID NO: 18383 - protein, 10 aa, Artificial Sequence
  Peptide Derived from Human Papillomavirus
ERLSCVQDKI

SEQ ID NO: 18384 - protein, 11 aa, Artificial Sequence
  Peptide Derived from Human Papillomavirus
ERLSCVQDKII

SEQ ID NO: 18385 - protein, 8 aa, Artificial Sequence
  Peptide Derived from Human Papillomavirus
FKKGGQTV

SEQ ID NO: 18386 - protein, 10 aa, Artificial Sequence
  Peptide Derived from Human Papillomavirus
FKKGGQTVQV

SEQ ID NO: 18387 - protein, 11 aa, Artificial Sequence
  Peptide Derived from Human Papillomavirus
FKKGGQTVQVY

SEQ ID NO: 18388 - protein, 8 aa, Artificial Sequence
  Peptide Derived from Human Papillomavirus
FKSECEKY

SEQ ID NO: 18389 - protein, 8 aa, Artificial Sequence
  Peptide Derived from Human Papillomavirus
HKAIELQM

SEQ ID NO: 18390 - protein, 9 aa, Artificial Sequence
  Peptide Derived from Human Papillomavirus
HKAIELQMA

SEQ ID NO: 18391 - protein, 10 aa, Artificial Sequence
  Peptide Derived from Human Papillomavirus
HKAIELQMAL

SEQ ID NO: 18392 - protein, 11 aa, Artificial Sequence
  Peptide Derived from Human Papillomavirus
HRGLYYVKEGY

SEQ ID NO: 18393 - protein, 10 aa, Artificial Sequence
  Peptide Derived from Human Papillomavirus
IHLKGDRNSL

SEQ ID NO: 18394 - protein, 8 aa, Artificial Sequence
  Peptide Derived from Human Papillomavirus
IRWENAIF

SEQ ID NO: 18395 - protein, 9 aa, Artificial Sequence
  Peptide Derived from Human Papillomavirus
IRWENAIFF

SEQ ID NO: 18396 - protein, 10 aa, Artificial Sequence
  Peptide Derived from Human Papillomavirus
IRWENAIFFA

SEQ ID NO: 18397 - protein, 11 aa, Artificial Sequence
  Peptide Derived from Human Papillomavirus
IRWENAIFFAA

SEQ ID NO: 18398 - protein, 9 aa, Artificial Sequence
  Peptide Derived from Human Papillomavirus
KHSDHYRDI

SEQ ID NO: 18399 - protein, 9 aa, Artificial Sequence
  Peptide Derived from Human Papillomavirus
KKGGQTVQV

SEQ ID NO: 18400 - protein, 10 aa, Artificial Sequence
  Peptide Derived from Human Papillomavirus
KKGGQTVQVY

SEQ ID NO: 18401 - protein, 11 aa, Artificial Sequence
  Peptide Derived from Human Papillomavirus
KKGGQTVQVYF

SEQ ID NO: 18402 - protein, 8 aa, Artificial Sequence
  Peptide Derived from Human Papillomavirus
LKCLRYRL

SEQ ID NO: 18403 - protein, 8 aa, Artificial Sequence
  Peptide Derived from Human Papillomavirus
LKGDRNSL

SEQ ID NO: 18404 - protein, 11 aa, Artificial Sequence
  Peptide Derived from Human Papillomavirus
LKGDRNSLKCL

SEQ ID NO: 18405 - protein, 8 aa, Artificial Sequence
  Peptide Derived from Human Papillomavirus
LRKHSDHY

SEQ ID NO: 18406 - protein, 11 aa, Artificial Sequence
  Peptide Derived from Human Papillomavirus
LRKHSDHYRDI

SEQ ID NO: 18407 - protein, 8 aa, Artificial Sequence
  Peptide Derived from Human Papillomavirus
NHQVVPAY

SEQ ID NO: 18408 - protein, 10 aa, Artificial Sequence
  Peptide Derived from Human Papillomavirus
NHQVVPAYNI

SEQ ID NO: 18409 - protein, 8 aa, Artificial Sequence
  Peptide Derived from Human Papillomavirus
NKDNCMTY

SEQ ID NO: 18410 - protein, 9 aa, Artificial Sequence
  Peptide Derived from Human Papillomavirus
NKDNCMTYV

SEQ ID NO: 18411 - protein, 10 aa, Artificial Sequence
  Peptide Derived from Human Papillomavirus
NKDNCMTYVA

SEQ ID NO: 18412 - protein, 11 aa, Artificial Sequence
  Peptide Derived from Human Papillomavirus
NKDNCMTYVAW

SEQ ID NO: 18413 - protein, 9 aa, Artificial Sequence
  Peptide Derived from Human Papillomavirus
PKETLSERL

SEQ ID NO: 18414 - protein, 9 aa, Artificial Sequence
  Peptide Derived from Human Papillomavirus
QHCGPVNPL

SEQ ID NO: 18415 - protein, 10 aa, Artificial Sequence
  Peptide Derived from Human Papillomavirus
QHCGPVNPLL

SEQ ID NO: 18416 - protein, 11 aa, Artificial Sequence
  Peptide Derived from Human Papillomavirus
QHTPSPYSSTV

SEQ ID NO: 18417 - protein, 9 aa, Artificial Sequence
  Peptide Derived from Human Papillomavirus
QRTKFLNTV

SEQ ID NO: 18418 - protein, 10 aa, Artificial Sequence
  Peptide Derived from Human Papillomavirus
QRTKFLNTVA

SEQ ID NO: 18419 - protein, 11 aa, Artificial Sequence
  Peptide Derived from Human Papillomavirus
QRTKFLNTVAI

SEQ ID NO: 18420 - protein, 10 aa, Artificial Sequence
  Peptide Derived from Human Papillomavirus
RKHSDHYRDI

SEQ ID NO: 18421 - protein, 11 aa, Artificial Sequence
  Peptide Derived from Human Papillomavirus
RKLCSGNTTPI

SEQ ID NO: 18422 - protein, 8 aa, Artificial Sequence
  Peptide Derived from Human Papillomavirus
SHRGLYYV

SEQ ID NO: 18423 - protein, 9 aa, Artificial Sequence
  Peptide Derived from Human Papillomavirus
SKAHKAIEL

SEQ ID NO: 18424 - protein, 11 aa, Artificial Sequence
  Peptide Derived from Human Papillomavirus
SKAHKAIELQM

SEQ ID NO: 18425 - protein, 8 aa, Artificial Sequence
  Peptide Derived from Human Papillomavirus
SKDIDSQI

SEQ ID NO: 18426 - protein, 10 aa, Artificial Sequence
  Peptide Derived from Human Papillomavirus
SKDIDSQIQY

SEQ ID NO: 18427 - protein, 11 aa, Artificial Sequence
  Peptide Derived from Human Papillomavirus
SKDIDSQIQYW

SEQ ID NO: 18428 - protein, 8 aa, Artificial Sequence
  Peptide Derived from Human Papillomavirus
SKSKAHKA

SEQ ID NO: 18429 - protein, 9 aa, Artificial Sequence
  Peptide Derived from Human Papillomavirus
SKSKAHKAI

SEQ ID NO: 18430 - protein, 11 aa, Artificial Sequence
  Peptide Derived from Human Papillomavirus
SKSKAHKAIEL

SEQ ID NO: 18431 - protein, 8 aa, Artificial Sequence
  Peptide Derived from Human Papillomavirus
SRYKTEDW

SEQ ID NO: 18432 - protein, 10 aa, Artificial Sequence
  Peptide Derived from Human Papillomavirus
SRYKTEDWTL

SEQ ID NO: 18433 - protein, 11 aa, Artificial Sequence
  Peptide Derived from Human Papillomavirus
THCFKKGGQTV

SEQ ID NO: 18434 - protein, 8 aa, Artificial Sequence
  Peptide Derived from Human Papillomavirus
TKFLNTVA

SEQ ID NO: 18435 - protein, 9 aa, Artificial Sequence
  Peptide Derived from Human Papillomavirus
TKFLNTVAI

SEQ ID NO: 18436 - protein, 8 aa, Artificial Sequence
  Peptide Derived from Human Papillomavirus
TRPGHCGL

SEQ ID NO: 18437 - protein, 9 aa, Artificial Sequence
  Peptide Derived from Human Papillomavirus
TRPGHCGLA

SEQ ID NO: 18438 - protein, 8 aa, Artificial Sequence
  Peptide Derived from Human Papillomavirus
VHFGNNVI

SEQ ID NO: 18439 - protein, 8 aa, Artificial Sequence
  Peptide Derived from Human Papillomavirus
VKEGYNTF

SEQ ID NO: 18440 - protein, 9 aa, Artificial Sequence
  Peptide Derived from Human Papillomavirus
VKEGYNTFY

SEQ ID NO: 18441 - protein, 10 aa, Artificial Sequence
  Peptide Derived from Human Papillomavirus
VKEGYNTFYI

SEQ ID NO: 18442 - protein, 11 aa, Artificial Sequence
  Peptide Derived from Human Papillomavirus
VKQLQHTPSPY

SEQ ID NO: 18443 - protein, 10 aa, Artificial Sequence
  Peptide Derived from Human Papillomavirus
YHSETQRTKF

SEQ ID NO: 18444 - protein, 11 aa, Artificial Sequence
  Peptide Derived from Human Papillomavirus
YHSETQRTKFL

SEQ ID NO: 18445 - protein, 8 aa, Artificial Sequence
  Peptide Derived from Human Papillomavirus
YKTEDWTL

SEQ ID NO: 18446 - protein, 8 aa, Artificial Sequence
  Peptide Derived from Human Papillomavirus
YRDISSTW

SEQ ID NO: 18447 - protein, 10 aa, Artificial Sequence
  Peptide Derived from Human Papillomavirus
YRDISSTWHW

SEQ ID NO: 18448 - protein, 10 aa, Artificial Sequence
  Peptide Derived from Human Papillomavirus
YRLRKHSDHY

SEQ ID NO: 18449 - protein, 9 aa, Artificial Sequence
  Peptide Derived from Human Papillomavirus
CHVPLLPSV

SEQ ID NO: 18450 - protein, 11 aa, Artificial Sequence
  Peptide Derived from Human Papillomavirus
CHVPLLPSVCM

SEQ ID NO: 18451 - protein, 9 aa, Artificial Sequence
  Peptide Derived from Human Papillomavirus
LHIHAILSL

SEQ ID NO: 18452 - protein, 11 aa, Artificial Sequence
  Peptide Derived from Human Papillomavirus
ARFEDPTRRPY

SEQ ID NO: 18453 - protein, 8 aa, Artificial Sequence
  Peptide Derived from Human Papillomavirus
CHKCIDFY

SEQ ID NO: 18454 - protein, 11 aa, Artificial Sequence
  Peptide Derived from Human Papillomavirus
CHKCIDFYSRI

SEQ ID NO: 18455 - protein, 8 aa, Artificial Sequence
  Peptide Derived from Human Papillomavirus
CHSCCNRA

SEQ ID NO: 18456 - protein, 10 aa, Artificial Sequence
  Peptide Derived from Human Papillomavirus
CKTVLELTEV

SEQ ID NO: 18457 - protein, 11 aa, Artificial Sequence
  Peptide Derived from Human Papillomavirus
CKTVLELTEVF

SEQ ID NO: 18458 - protein, 8 aa, Artificial Sequence
  Peptide Derived from Human Papillomavirus
EKLTNTGL

SEQ ID NO: 18459 - protein, 9 aa, Artificial Sequence
  Peptide Derived from Human Papillomavirus
EKLTNTGLY

SEQ ID NO: 18460 - protein, 11 aa, Artificial Sequence
  Peptide Derived from Human Papillomavirus
EKLTNTGLYNL

SEQ ID NO: 18461 - protein, 8 aa, Artificial Sequence
  Peptide Derived from Human Papillomavirus
EKRRFHNI

SEQ ID NO: 18462 - protein, 9 aa, Artificial Sequence
  Peptide Derived from Human Papillomavirus
EKRRFHNIA

SEQ ID NO: 18463 - protein, 11 aa, Artificial Sequence
  Peptide Derived from Human Papillomavirus
ERLQRRRETQV

SEQ ID NO: 18464 - protein, 8 aa, Artificial Sequence
  Peptide Derived from Human Papillomavirus
FHNIAGHY

SEQ ID NO: 18465 - protein, 8 aa, Artificial Sequence
  Peptide Derived from Human Papillomavirus
FKDLFVVY

SEQ ID NO: 18466 - protein, 10 aa, Artificial Sequence
  Peptide Derived from Human Papillomavirus
HKCIDFYSRI

SEQ ID NO: 18467 - protein, 10 aa, Artificial Sequence
  Peptide Derived from Human Papillomavirus
IRCLRCQKPL

SEQ ID NO: 18468 - protein, 11 aa, Artificial Sequence
  Peptide Derived from Human Papillomavirus
IRELRHYSDSV

SEQ ID NO: 18469 - protein, 8 aa, Artificial Sequence
  Peptide Derived from Human Papillomavirus
KRRFHNIA

SEQ ID NO: 18470 - protein, 11 aa, Artificial Sequence
  Peptide Derived from Human Papillomavirus
KRRFHNIAGHY

SEQ ID NO: 18471 - protein, 10 aa, Artificial Sequence
  Peptide Derived from Human Papillomavirus
LRCQKPLNPA

SEQ ID NO: 18472 - protein, 10 aa, Artificial Sequence
  Peptide Derived from Human Papillomavirus
LRHLNEKRRF

SEQ ID NO: 18473 - protein, 8 aa, Artificial Sequence
  Peptide Derived from Human Papillomavirus
LRHYSDSV

SEQ ID NO: 18474 - protein, 9 aa, Artificial Sequence
  Peptide Derived from Human Papillomavirus
LRHYSDSVY

SEQ ID NO: 18475 - protein, 8 aa, Artificial Sequence
  Peptide Derived from Human Papillomavirus
NRARQERL

SEQ ID NO: 18476 - protein, 9 aa, Artificial Sequence
  Peptide Derived from Human Papillomavirus
PHAACHKCI

SEQ ID NO: 18477 - protein, 11 aa, Artificial Sequence
  Peptide Derived from Human Papillomavirus
PHAACHKCIDF

SEQ ID NO: 18478 - protein, 10 aa, Artificial Sequence
  Peptide Derived from Human Papillomavirus
QKPLNPAEKL

SEQ ID NO: 18479 - protein, 8 aa, Artificial Sequence
  Peptide Derived from Human Papillomavirus
QRRRETQV

SEQ ID NO: 18480 - protein, 9 aa, Artificial Sequence
  Peptide Derived from Human Papillomavirus
RHLNEKRRF

SEQ ID NO: 18481 - protein, 8 aa, Artificial Sequence
  Peptide Derived from Human Papillomavirus
RHYSDSVY

SEQ ID NO: 18482 - protein, 10 aa, Artificial Sequence
  Peptide Derived from Human Papillomavirus
RRFHNIAGHY

SEQ ID NO: 18483 - protein, 9 aa, Artificial Sequence
  Peptide Derived from Human Papillomavirus
RRPYKLPDL

SEQ ID NO: 18484 - protein, 9 aa, Artificial Sequence
  Peptide Derived from Human Papillomavirus
SRIRELRHY

SEQ ID NO: 18485 - protein, 10 aa, Artificial Sequence
  Peptide Derived from Human Papillomavirus
TRRPYKLPDL

SEQ ID NO: 18486 - protein, 10 aa, Artificial Sequence
  Peptide Derived from Human Papillomavirus
YKLPDLCTEL

SEQ ID NO: 18487 - protein, 8 aa, Artificial Sequence
  Peptide Derived from Human Papillomavirus
YRDSIPHA

SEQ ID NO: 18488 - protein, 9 aa, Artificial Sequence
  Peptide Derived from Human Papillomavirus
YRDSIPHAA

SEQ ID NO: 18489 - protein, 11 aa, Artificial Sequence
  Peptide Derived from Human Papillomavirus
ARIKLVVESSA

SEQ ID NO: 18490 - protein, 11 aa, Artificial Sequence
  Peptide Derived from Human Papillomavirus
ARRAEPQRHTM

SEQ ID NO: 18491 - protein, 9 aa, Artificial Sequence
  Peptide Derived from Human Papillomavirus
CKCEARIKL

SEQ ID NO: 18492 - protein, 10 aa, Artificial Sequence
  Peptide Derived from Human Papillomavirus
CKCEARIKLV

SEQ ID NO: 18493 - protein, 11 aa, Artificial Sequence
  Peptide Derived from Human Papillomavirus
CKCEARIKLVV

SEQ ID NO: 18494 - protein, 9 aa, Artificial Sequence
  Peptide Derived from Human Papillomavirus
IKLVVESSA

SEQ ID NO: 18495 - protein, 9 aa, Artificial Sequence
  Peptide Derived from Human Papillomavirus
LHLEPQNEI

SEQ ID NO: 18496 - protein, 11 aa, Artificial Sequence
  Peptide Derived from Human Papillomavirus
LHLEPQNEIPV

SEQ ID NO: 18497 - protein, 8 aa, Artificial Sequence
  Peptide Derived from Human Papillomavirus
LRAFQQLF

SEQ ID NO: 18498 - protein, 9 aa, Artificial Sequence
  Peptide Derived from Human Papillomavirus
LRAFQQLFL

SEQ ID NO: 18499 - protein, 8 aa, Artificial Sequence
  Peptide Derived from Human Papillomavirus
MHGPKATL

SEQ ID NO: 18500 - protein, 11 aa, Artificial Sequence
  Peptide Derived from Human Papillomavirus
MHGPKATLQDI

SEQ ID NO: 18501 - protein, 10 aa, Artificial Sequence
  Peptide Derived from Human Papillomavirus
NHQHLPARRA

SEQ ID NO: 18502 - protein, 8 aa, Artificial Sequence
  Peptide Derived from Human Papillomavirus
PKATLQDI

SEQ ID NO: 18503 - protein, 9 aa, Artificial Sequence
  Peptide Derived from Human Papillomavirus
PKATLQDIV

SEQ ID NO: 18504 - protein, 10 aa, Artificial Sequence
  Peptide Derived from Human Papillomavirus
PKATLQDIVL

SEQ ID NO: 18505 - protein, 8 aa, Artificial Sequence
  Peptide Derived from Human Papillomavirus
QHLPARRA

SEQ ID NO: 18506 - protein, 8 aa, Artificial Sequence
  Peptide Derived from Human Papillomavirus
QRHTMLCM

SEQ ID NO: 18507 - protein, 10 aa, Artificial Sequence
  Peptide Derived from Human Papillomavirus
RRAEPQRHTM

SEQ ID NO: 18508 - protein, 11 aa, Artificial Sequence
  Peptide Derived from Human Papillomavirus
RRAEPQRHTML

SEQ ID NO: 18509 - protein, 11 aa, Artificial Sequence
  Peptide Derived from Human Papillomavirus
AKGTACKSRPL

SEQ ID NO: 18510 - protein, 8 aa, Artificial Sequence
  Peptide Derived from Human Papillomavirus
AKRVRVRA

SEQ ID NO: 18511 - protein, 8 aa, Artificial Sequence
  Peptide Derived from Human Papillomavirus
ARHFWNRA

SEQ ID NO: 18512 - protein, 11 aa, Artificial Sequence
  Peptide Derived from Human Papillomavirus
ARHFWNRAGTM

SEQ ID NO: 18513 - protein, 9 aa, Artificial Sequence
  Peptide Derived from Human Papillomavirus
ARVVNTDDY

SEQ ID NO: 18514 - protein, 10 aa, Artificial Sequence
  Peptide Derived from Human Papillomavirus
ARVVNTDDYV

SEQ ID NO: 18515 - protein, 9 aa, Artificial Sequence
  Peptide Derived from Human Papillomavirus
CKYPDYLQM

SEQ ID NO: 18516 - protein, 11 aa, Artificial Sequence
  Peptide Derived from Human Papillomavirus
CKYPDYLQMSA

SEQ ID NO: 18517 - protein, 8 aa, Artificial Sequence
  Peptide Derived from Human Papillomavirus
DKLKFWNV

SEQ ID NO: 18518 - protein, 10 aa, Artificial Sequence
  Peptide Derived from Human Papillomavirus
DKLKFWNVDL

SEQ ID NO: 18519 - protein, 8 aa, Artificial Sequence
  Peptide Derived from Human Papillomavirus
EHWAKGTA

SEQ ID NO: 18520 - protein, 10 aa, Artificial Sequence
  Peptide Derived from Human Papillomavirus
EKFSLDLDQY

SEQ ID NO: 18521 - protein, 8 aa, Artificial Sequence
  Peptide Derived from Human Papillomavirus
FKQYSRHV

SEQ ID NO: 18522 - protein, 11 aa, Artificial Sequence
  Peptide Derived from Human Papillomavirus
FKQYSRHVEEY

SEQ ID NO: 18523 - protein, 11 aa, Artificial Sequence
  Peptide Derived from Human Papillomavirus
FRVQLPDPNKF

SEQ ID NO: 18524 - protein, 8 aa, Artificial Sequence
  Peptide Derived from Human Papillomavirus
GHNNGVCW

SEQ ID NO: 18525 - protein, 8 aa, Artificial Sequence
  Peptide Derived from Human Papillomavirus
GHPFYNKL

SEQ ID NO: 18526 - protein, 8 aa, Artificial Sequence
  Peptide Derived from Human Papillomavirus
GHYIILFL

SEQ ID NO: 18527 - protein, 11 aa, Artificial Sequence
  Peptide Derived from Human Papillomavirus
GHYIILFLRNV

SEQ ID NO: 18528 - protein, 8 aa, Artificial Sequence
  Peptide Derived from Human Papillomavirus
GRGQPLGV

SEQ ID NO: 18529 - protein, 10 aa, Artificial Sequence
  Peptide Derived from Human Papillomavirus
GRGQPLGVGL

SEQ ID NO: 18530 - protein, 8 aa, Artificial Sequence
  Peptide Derived from Human Papillomavirus
GRKFLVQA

SEQ ID NO: 18531 - protein, 10 aa, Artificial Sequence
  Peptide Derived from Human Papillomavirus
GRKFLVQAGL

SEQ ID NO: 18532 - protein, 10 aa, Artificial Sequence
  Peptide Derived from Human Papillomavirus
HKAQGHNNGV

SEQ ID NO: 18533 - protein, 8 aa, Artificial Sequence
  Peptide Derived from Human Papillomavirus
IHSMNSSI

SEQ ID NO: 18534 - protein, 9 aa, Artificial Sequence
  Peptide Derived from Human Papillomavirus
IHSMNSSIL

SEQ ID NO: 18535 - protein, 8 aa, Artificial Sequence
  Peptide Derived from Human Papillomavirus
IKGTGMPA

SEQ ID NO: 18536 - protein, 11 aa, Artificial Sequence
  Peptide Derived from Human Papillomavirus
LHKAQGHNNGV

SEQ ID NO: 18537 - protein, 8 aa, Artificial Sequence
  Peptide Derived from Human Papillomavirus
LHSILVYM

SEQ ID NO: 18538 - protein, 9 aa, Artificial Sequence
  Peptide Derived from Human Papillomavirus
LHSILVYMV

SEQ ID NO: 18539 - protein, 11 aa, Artificial Sequence
  Peptide Derived from Human Papillomavirus
LHSILVYMVHI

SEQ ID NO: 18540 - protein, 8 aa, Artificial Sequence
  Peptide Derived from Human Papillomavirus
LHYHLLPL

SEQ ID NO: 18541 - protein, 9 aa, Artificial Sequence
  Peptide Derived from Human Papillomavirus
LHYHLLPLY

SEQ ID NO: 18542 - protein, 9 aa, Artificial Sequence
  Peptide Derived from Human Papillomavirus
LKEKFSLDL

SEQ ID NO: 18543 - protein, 8 aa, Artificial Sequence
  Peptide Derived from Human Papillomavirus
LKFWNVDL

SEQ ID NO: 18544 - protein, 11 aa, Artificial Sequence
  Peptide Derived from Human Papillomavirus
LKNTVLEDGDM

SEQ ID NO: 18545 - protein, 9 aa, Artificial Sequence
  Peptide Derived from Human Papillomavirus
LRNVNVFPI

SEQ ID NO: 18546 - protein, 10 aa, Artificial Sequence
  Peptide Derived from Human Papillomavirus
LRNVNVFPIF

SEQ ID NO: 18547 - protein, 11 aa, Artificial Sequence
  Peptide Derived from Human Papillomavirus
LRNVNVFPIFL

SEQ ID NO: 18548 - protein, 8 aa, Artificial Sequence
  Peptide Derived from Human Papillomavirus
LRREQLFA

SEQ ID NO: 18549 - protein, 11 aa, Artificial Sequence
  Peptide Derived from Human Papillomavirus
LRREQLFARHF

SEQ ID NO: 18550 - protein, 8 aa, Artificial Sequence
  Peptide Derived from Human Papillomavirus
NKDPYDKL

SEQ ID NO: 18551 - protein, 10 aa, Artificial Sequence
  Peptide Derived from Human Papillomavirus
NKDPYDKLKF

SEQ ID NO: 18552 - protein, 11 aa, Artificial Sequence
  Peptide Derived from Human Papillomavirus
NKDPYDKLKFW

SEQ ID NO: 18553 - protein, 10 aa, Artificial Sequence
  Peptide Derived from Human Papillomavirus
NKFGLPDTSI

SEQ ID NO: 18554 - protein, 11 aa, Artificial Sequence
  Peptide Derived from Human Papillomavirus
NKFGLPDTSIY

SEQ ID NO: 18555 - protein, 11 aa, Artificial Sequence
  Peptide Derived from Human Papillomavirus
NKLDDTESSHA

SEQ ID NO: 18556 - protein, 9 aa, Artificial Sequence
  Peptide Derived from Human Papillomavirus
NKPYWLHKA

SEQ ID NO: 18557 - protein, 8 aa, Artificial Sequence
  Peptide Derived from Human Papillomavirus
NKQDIPKV

SEQ ID NO: 18558 - protein, 10 aa, Artificial Sequence
  Peptide Derived from Human Papillomavirus
NKQDIPKVSA

SEQ ID NO: 18559 - protein, 11 aa, Artificial Sequence
  Peptide Derived from Human Papillomavirus
NKQDIPKVSAY

SEQ ID NO: 18560 - protein, 10 aa, Artificial Sequence
  Peptide Derived from Human Papillomavirus
NRAGTMGDTV

SEQ ID NO: 18561 - protein, 8 aa, Artificial Sequence
  Peptide Derived from Human Papillomavirus
PKVSAYQY

SEQ ID NO: 18562 - protein, 10 aa, Artificial Sequence
  Peptide Derived from Human Papillomavirus
PKVSAYQYRV

SEQ ID NO: 18563 - protein, 11 aa, Artificial Sequence
  Peptide Derived from Human Papillomavirus
PKVSAYQYRVF

SEQ ID NO: 18564 - protein, 9 aa, Artificial Sequence
  Peptide Derived from Human Papillomavirus
PRKRSAPSA

SEQ ID NO: 18565 - protein, 9 aa, Artificial Sequence
  Peptide Derived from Human Papillomavirus
PRPLPLHSI

SEQ ID NO: 18566 - protein, 10 aa, Artificial Sequence
  Peptide Derived from Human Papillomavirus
PRPLPLHSIL

SEQ ID NO: 18567 - protein, 11 aa, Artificial Sequence
  Peptide Derived from Human Papillomavirus
PRPLPLHSILV

SEQ ID NO: 18568 - protein, 8 aa, Artificial Sequence
  Peptide Derived from Human Papillomavirus
QRLVWACA

SEQ ID NO: 18569 - protein, 10 aa, Artificial Sequence
  Peptide Derived from Human Papillomavirus
QRLVWACAGV

SEQ ID NO: 18570 - protein, 10 aa, Artificial Sequence
  Peptide Derived from Human Papillomavirus
RHFWNRAGTM

SEQ ID NO: 18571 - protein, 8 aa, Artificial Sequence
  Peptide Derived from Human Papillomavirus
RHVEEYDL

SEQ ID NO: 18572 - protein, 10 aa, Artificial Sequence
  Peptide Derived from Human Papillomavirus
RHVEEYDLQF

SEQ ID NO: 18573 - protein, 11 aa, Artificial Sequence
  Peptide Derived from Human Papillomavirus
RHVEEYDLQFI

SEQ ID NO: 18574 - protein, 9 aa, Artificial Sequence
  Peptide Derived from Human Papillomavirus
RKFLVQAGL

SEQ ID NO: 18575 - protein, 8 aa, Artificial Sequence
  Peptide Derived from Human Papillomavirus
RKRSAPSA

SEQ ID NO: 18576 - protein, 10 aa, Artificial Sequence
  Peptide Derived from Human Papillomavirus
RREQLFARHF

SEQ ID NO: 18577 - protein, 11 aa, Artificial Sequence
  Peptide Derived from Human Papillomavirus
RREQLFARHFW

SEQ ID NO: 18578 - protein, 8 aa, Artificial Sequence
  Peptide Derived from Human Papillomavirus
SHAATSNV

SEQ ID NO: 18579 - protein, 9 aa, Artificial Sequence
  Peptide Derived from Human Papillomavirus
SKPAKRVRV

SEQ ID NO: 18580 - protein, 11 aa, Artificial Sequence
  Peptide Derived from Human Papillomavirus
SKPAKRVRVRA

SEQ ID NO: 18581 - protein, 9 aa, Artificial Sequence
  Peptide Derived from Human Papillomavirus
SRHVEEYDL

SEQ ID NO: 18582 - protein, 11 aa, Artificial Sequence
  Peptide Derived from Human Papillomavirus
SRHVEEYDLQF

SEQ ID NO: 18583 - protein, 10 aa, Artificial Sequence
  Peptide Derived from Human Papillomavirus
SRLLTVGNPY

SEQ ID NO: 18584 - protein, 11 aa, Artificial Sequence
  Peptide Derived from Human Papillomavirus
SRLLTVGNPYF

SEQ ID NO: 18585 - protein, 9 aa, Artificial Sequence
  Peptide Derived from Human Papillomavirus
TKCEVPLDI

SEQ ID NO: 18586 - protein, 10 aa, Artificial Sequence
  Peptide Derived from Human Papillomavirus
TKFKQYSRHV

SEQ ID NO: 18587 - protein, 8 aa, Artificial Sequence
  Peptide Derived from Human Papillomavirus
TRVLILHY

SEQ ID NO: 18588 - protein, 10 aa, Artificial Sequence
  Peptide Derived from Human Papillomavirus
TRVLILHYHL

SEQ ID NO: 18589 - protein, 11 aa, Artificial Sequence
  Peptide Derived from Human Papillomavirus
TRVLILHYHLL

SEQ ID NO: 18590 - protein, 9 aa, Artificial Sequence
  Peptide Derived from Human Papillomavirus
VHIIICGHY

SEQ ID NO: 18591 - protein, 10 aa, Artificial Sequence
  Peptide Derived from Human Papillomavirus
VHIIICGHYI

SEQ ID NO: 18592 - protein, 11 aa, Artificial Sequence
  Peptide Derived from Human Papillomavirus
VHIIICGHYII

SEQ ID NO: 18593 - protein, 9 aa, Artificial Sequence
  Peptide Derived from Human Papillomavirus
VRDNVSVDY

SEQ ID NO: 18594 - protein, 9 aa, Artificial Sequence
  Peptide Derived from Human Papillomavirus
WHNQLFVTV

SEQ ID NO: 18595 - protein, 10 aa, Artificial Sequence
  Peptide Derived from Human Papillomavirus
WHNQLFVTVV

SEQ ID NO: 18596 - protein, 8 aa, Artificial Sequence
  Peptide Derived from Human Papillomavirus
WRPSDNTV

SEQ ID NO: 18597 - protein, 9 aa, Artificial Sequence
  Peptide Derived from Human Papillomavirus
WRPSDNTVY

SEQ ID NO: 18598 - protein, 10 aa, Artificial Sequence
  Peptide Derived from Human Papillomavirus
WRPSDNTVYL

SEQ ID NO: 18599 - protein, 8 aa, Artificial Sequence
  Peptide Derived from Human Papillomavirus
YHAGSSRL

SEQ ID NO: 18600 - protein, 9 aa, Artificial Sequence
  Peptide Derived from Human Papillomavirus
YHAGSSRLL

SEQ ID NO: 18601 - protein, 11 aa, Artificial Sequence
  Peptide Derived from Human Papillomavirus
YHAGSSRLLTV

SEQ ID NO: 18602 - protein, 10 aa, Artificial Sequence
  Peptide Derived from Human Papillomavirus
YHLLPLYGPL

SEQ ID NO: 18603 - protein, 11 aa, Artificial Sequence
  Peptide Derived from Human Papillomavirus
YHLLPLYGPLY

SEQ ID NO: 18604 - protein, 8 aa, Artificial Sequence
  Peptide Derived from Human Papillomavirus
YHPRPLPL

SEQ ID NO: 18605 - protein, 11 aa, Artificial Sequence
  Peptide Derived from Human Papillomavirus
YHPRPLPLHSI

SEQ ID NO: 18606 - protein, 8 aa, Artificial Sequence
  Peptide Derived from Human Papillomavirus
YKQTQLCI

SEQ ID NO: 18607 - protein, 9 aa, Artificial Sequence
  Peptide Derived from Human Papillomavirus
YKQTQLCIL

SEQ ID NO: 18608 - protein, 8 aa, Artificial Sequence
  Peptide Derived from Human Papillomavirus
YRFVQSVA

SEQ ID NO: 18609 - protein, 9 aa, Artificial Sequence
  Peptide Derived from Human Papillomavirus
YRFVQSVAI

SEQ ID NO: 18610 - protein, 8 aa, Artificial Sequence
  Peptide Derived from Human Papillomavirus
YRVFRVQL

SEQ ID NO: 18611 - protein, 8 aa, Artificial Sequence
  Peptide Derived from Human Papillomavirus
ARRKRASV

SEQ ID NO: 18612 - protein, 11 aa, Artificial Sequence
  Peptide Derived from Human Papillomavirus
ARRKRASVTDL

SEQ ID NO: 18613 - protein, 9 aa, Artificial Sequence
  Peptide Derived from Human Papillomavirus
ARVHFYHDI

SEQ ID NO: 18614 - protein, 11 aa, Artificial Sequence
  Peptide Derived from Human Papillomavirus
CKQSGTCPPDV

SEQ ID NO: 18615 - protein, 9 aa, Artificial Sequence
  Peptide Derived from Human Papillomavirus
DKILQWSSL

SEQ ID NO: 18616 - protein, 11 aa, Artificial Sequence
  Peptide Derived from Human Papillomavirus
DKILQWSSLGI

SEQ ID NO: 18617 - protein, 10 aa, Artificial Sequence
  Peptide Derived from Human Papillomavirus
FKYSPTISSA

SEQ ID NO: 18618 - protein, 9 aa, Artificial Sequence
  Peptide Derived from Human Papillomavirus
GRSNTVVDV

SEQ ID NO: 18619 - protein, 8 aa, Artificial Sequence
  Peptide Derived from Human Papillomavirus
GRTGYIPL

SEQ ID NO: 18620 - protein, 9 aa, Artificial Sequence
  Peptide Derived from Human Papillomavirus
HRAARRKRA

SEQ ID NO: 18621 - protein, 11 aa, Artificial Sequence
  Peptide Derived from Human Papillomavirus
HRAARRKRASV

SEQ ID NO: 18622 - protein, 8 aa, Artificial Sequence
  Peptide Derived from Human Papillomavirus
IHGTHYYL

SEQ ID NO: 18623 - protein, 9 aa, Artificial Sequence
  Peptide Derived from Human Papillomavirus
IHGTHYYLW

SEQ ID NO: 18624 - protein, 11 aa, Artificial Sequence
  Peptide Derived from Human Papillomavirus
IHGTHYYLWPL

SEQ ID NO: 18625 - protein, 8 aa, Artificial Sequence
  Peptide Derived from Human Papillomavirus
IRLHRPAL

SEQ ID NO: 18626 - protein, 8 aa, Artificial Sequence
  Peptide Derived from Human Papillomavirus
KKRKRVPY

SEQ ID NO: 18627 - protein, 9 aa, Artificial Sequence
  Peptide Derived from Human Papillomavirus
KKRKRVPYF

SEQ ID NO: 18628 - protein, 10 aa, Artificial Sequence
  Peptide Derived from Human Papillomavirus
KKRKRVPYFF

SEQ ID NO: 18629 - protein, 11 aa, Artificial Sequence
  Peptide Derived from Human Papillomavirus
KKRKRVPYFFA

SEQ ID NO: 18630 - protein, 8 aa, Artificial Sequence
  Peptide Derived from Human Papillomavirus
KRASVTDL

SEQ ID NO: 18631 - protein, 9 aa, Artificial Sequence
  Peptide Derived from Human Papillomavirus
KRASVTDLY

SEQ ID NO: 18632 - protein, 8 aa, Artificial Sequence
  Peptide Derived from Human Papillomavirus
KRKRVPYF

SEQ ID NO: 18633 - protein, 9 aa, Artificial Sequence
  Peptide Derived from Human Papillomavirus
KRKRVPYFF

SEQ ID NO: 18634 - protein, 10 aa, Artificial Sequence
  Peptide Derived from Human Papillomavirus
KRKRVPYFFA

SEQ ID NO: 18635 - protein, 8 aa, Artificial Sequence
  Peptide Derived from Human Papillomavirus
KRVPYFFA

SEQ ID NO: 18636 - protein, 11 aa, Artificial Sequence
  Peptide Derived from Human Papillomavirus
KRVPYFFADGF

SEQ ID NO: 18637 - protein, 9 aa, Artificial Sequence
  Peptide Derived from Human Papillomavirus
PKKRKRVPY

SEQ ID NO: 18638 - protein, 10 aa, Artificial Sequence
  Peptide Derived from Human Papillomavirus
PKKRKRVPYF

SEQ ID NO: 18639 - protein, 11 aa, Artificial Sequence
  Peptide Derived from Human Papillomavirus
PKKRKRVPYFF

SEQ ID NO: 18640 - protein, 8 aa, Artificial Sequence
  Peptide Derived from Human Papillomavirus
PKVEGTTL

SEQ ID NO: 18641 - protein, 9 aa, Artificial Sequence
  Peptide Derived from Human Papillomavirus
PKVEGTTLA

SEQ ID NO: 18642 - protein, 8 aa, Artificial Sequence
  Peptide Derived from Human Papillomavirus
PRLYSRAY

SEQ ID NO: 18643 - protein, 11 aa, Artificial Sequence
  Peptide Derived from Human Papillomavirus
PRLYSRAYQQV

SEQ ID NO: 18644 - protein, 11 aa, Artificial Sequence
  Peptide Derived from Human Papillomavirus
PRPTFTGTSGF

SEQ ID NO: 18645 - protein, 10 aa, Artificial Sequence
  Peptide Derived from Human Papillomavirus
PRSDVPDSDF

SEQ ID NO: 18646 - protein, 11 aa, Artificial Sequence
  Peptide Derived from Human Papillomavirus
PRSDVPDSDFM

SEQ ID NO: 18647 - protein, 9 aa, Artificial Sequence
  Peptide Derived from Human Papillomavirus
RKRASVTDL

SEQ ID NO: 18648 - protein, 10 aa, Artificial Sequence
  Peptide Derived from Human Papillomavirus
RKRASVTDLY

SEQ ID NO: 18649 - protein, 8 aa, Artificial Sequence
  Peptide Derived from Human Papillomavirus
RKRVPYFF

SEQ ID NO: 18650 - protein, 9 aa, Artificial Sequence
  Peptide Derived from Human Papillomavirus
RKRVPYFFA

SEQ ID NO: 18651 - protein, 10 aa, Artificial Sequence
  Peptide Derived from Human Papillomavirus
RRGTVRFSRL

SEQ ID NO: 18652 - protein, 10 aa, Artificial Sequence
  Peptide Derived from Human Papillomavirus
RRKRASVTDL

SEQ ID NO: 18653 - protein, 11 aa, Artificial Sequence
  Peptide Derived from Human Papillomavirus
RRKRASVTDLY

SEQ ID NO: 18654 - protein, 8 aa, Artificial Sequence
  Peptide Derived from Human Papillomavirus
RRVAGPRL

SEQ ID NO: 18655 - protein, 9 aa, Artificial Sequence
  Peptide Derived from Human Papillomavirus
RRVAGPRLY

SEQ ID NO: 18656 - protein, 10 aa, Artificial Sequence
  Peptide Derived from Human Papillomavirus
SHRAARRKRA

SEQ ID NO: 18657 - protein, 9 aa, Artificial Sequence
  Peptide Derived from Human Papillomavirus
SRAYQQVSV

SEQ ID NO: 18658 - protein, 10 aa, Artificial Sequence
  Peptide Derived from Human Papillomavirus
SRAYQQVSVA

SEQ ID NO: 18659 - protein, 9 aa, Artificial Sequence
  Peptide Derived from Human Papillomavirus
SRLGQRATM

SEQ ID NO: 18660 - protein, 10 aa, Artificial Sequence
  Peptide Derived from Human Papillomavirus
SRLGQRATMF

SEQ ID NO: 18661 - protein, 8 aa, Artificial Sequence
  Peptide Derived from Human Papillomavirus
SRRGTVRF

SEQ ID NO: 18662 - protein, 11 aa, Artificial Sequence
  Peptide Derived from Human Papillomavirus
SRRGTVRFSRL

SEQ ID NO: 18663 - protein, 8 aa, Artificial Sequence
  Peptide Derived from Human Papillomavirus
SRSTTSFA

SEQ ID NO: 18664 - protein, 9 aa, Artificial Sequence
  Peptide Derived from Human Papillomavirus
SRSTTSFAF

SEQ ID NO: 18665 - protein, 10 aa, Artificial Sequence
  Peptide Derived from Human Papillomavirus
SRSTTSFAFF

SEQ ID NO: 18666 - protein, 9 aa, Artificial Sequence
  Peptide Derived from Human Papillomavirus
THGYEEIPL

SEQ ID NO: 18667 - protein, 8 aa, Artificial Sequence
  Peptide Derived from Human Papillomavirus
THYYLWPL

SEQ ID NO: 18668 - protein, 9 aa, Artificial Sequence
  Peptide Derived from Human Papillomavirus
THYYLWPLY

SEQ ID NO: 18669 - protein, 10 aa, Artificial Sequence
  Peptide Derived from Human Papillomavirus
THYYLWPLYY

SEQ ID NO: 18670 - protein, 11 aa, Artificial Sequence
  Peptide Derived from Human Papillomavirus
THYYLWPLYYF

SEQ ID NO: 18671 - protein, 10 aa, Artificial Sequence
  Peptide Derived from Human Papillomavirus
TRPPVVIEPV

SEQ ID NO: 18672 - protein, 9 aa, Artificial Sequence
  Peptide Derived from Human Papillomavirus
TRPSSLITY

SEQ ID NO: 18673 - protein, 9 aa, Artificial Sequence
  Peptide Derived from Human Papillomavirus
TRSGTQIGA

SEQ ID NO: 18674 - protein, 11 aa, Artificial Sequence
  Peptide Derived from Human Papillomavirus
TRSGTQIGARV

SEQ ID NO: 18675 - protein, 10 aa, Artificial Sequence
  Peptide Derived from Human Papillomavirus
VHFYHDISPI

SEQ ID NO: 18676 - protein, 11 aa, Artificial Sequence
  Peptide Derived from Human Papillomavirus
VHFYHDISPIA

SEQ ID NO: 18677 - protein, 10 aa, Artificial Sequence
  Peptide Derived from Human Papillomavirus
VRFSRLGQRA

SEQ ID NO: 18678 - protein, 9 aa, Artificial Sequence
  Peptide Derived from Human Papillomavirus
VRRVAGPRL

SEQ ID NO: 18679 - protein, 10 aa, Artificial Sequence
  Peptide Derived from Human Papillomavirus
VRRVAGPRLY

SEQ ID NO: 18680 - protein, 8 aa, Artificial Sequence
  Peptide Derived from Human Papillomavirus
YHDISPIA

SEQ ID NO: 18681 - protein, 9 aa, Artificial Sequence
  Peptide Derived from Human Papillomavirus
AKIGMLDDA

SEQ ID NO: 18682 - protein, 10 aa, Artificial Sequence
  Peptide Derived from Human Papillomavirus
AKIVKDCGTM

SEQ ID NO: 18683 - protein, 10 aa, Artificial Sequence
  Peptide Derived from Human Papillomavirus
AKNRITIEKL

SEQ ID NO: 18684 - protein, 11 aa, Artificial Sequence
  Peptide Derived from Human Papillomavirus
AKNRITIEKLL

SEQ ID NO: 18685 - protein, 8 aa, Artificial Sequence
  Peptide Derived from Human Papillomavirus
AKRRLFEL

SEQ ID NO: 18686 - protein, 10 aa, Artificial Sequence
  Peptide Derived from Human Papillomavirus
CHLQSLACSW

SEQ ID NO: 18687 - protein, 9 aa, Artificial Sequence
  Peptide Derived from Human Papillomavirus
DKENDGDSF

SEQ ID NO: 18688 - protein, 8 aa, Artificial Sequence
  Peptide Derived from Human Papillomavirus
DKNGNPVY

SEQ ID NO: 18689 - protein, 10 aa, Artificial Sequence
  Peptide Derived from Human Papillomavirus
DKNGNPVYEL

SEQ ID NO: 18690 - protein, 8 aa, Artificial Sequence
  Peptide Derived from Human Papillomavirus
DKNWKSFF

SEQ ID NO: 18691 - protein, 9 aa, Artificial Sequence
  Peptide Derived from Human Papillomavirus
DKVSDEGDW

SEQ ID NO: 18692 - protein, 8 aa, Artificial Sequence
  Peptide Derived from Human Papillomavirus
DRQTGDNI

SEQ ID NO: 18693 - protein, 10 aa, Artificial Sequence
  Peptide Derived from Human Papillomavirus
DRWPYLHSRL

SEQ ID NO: 18694 - protein, 11 aa, Artificial Sequence
  Peptide Derived from Human Papillomavirus
DRWPYLHSRLV

SEQ ID NO: 18695 - protein, 8 aa, Artificial Sequence
  Peptide Derived from Human Papillomavirus
EHAEAVQV

SEQ ID NO: 18696 - protein, 9 aa, Artificial Sequence
  Peptide Derived from Human Papillomavirus
EHAEAVQVL

SEQ ID NO: 18697 - protein, 11 aa, Artificial Sequence
  Peptide Derived from Human Papillomavirus
EKLLCISTNCM

SEQ ID NO: 18698 - protein, 8 aa, Artificial Sequence
  Peptide Derived from Human Papillomavirus
EKLLEKLL

SEQ ID NO: 18699 - protein, 10 aa, Artificial Sequence
  Peptide Derived from Human Papillomavirus
EKLLEKLLCI

SEQ ID NO: 18700 - protein, 10 aa, Artificial Sequence
  Peptide Derived from Human Papillomavirus
EKRQMSMGQW

SEQ ID NO: 18701 - protein, 11 aa, Artificial Sequence
  Peptide Derived from Human Papillomavirus
EKRQMSMGQWI

SEQ ID NO: 18702 - protein, 11 aa, Artificial Sequence
  Peptide Derived from Human Papillomavirus
ERENETPTRNI

SEQ ID NO: 18703 - protein, 10 aa, Artificial Sequence
  Peptide Derived from Human Papillomavirus
ERQTVLQHSF

SEQ ID NO: 18704 - protein, 10 aa, Artificial Sequence
  Peptide Derived from Human Papillomavirus
FHAQEAEEHA

SEQ ID NO: 18705 - protein, 8 aa, Artificial Sequence
  Peptide Derived from Human Papillomavirus
FKCAKNRI

SEQ ID NO: 18706 - protein, 10 aa, Artificial Sequence
  Peptide Derived from Human Papillomavirus
FKCAKNRITI

SEQ ID NO: 18707 - protein, 9 aa, Artificial Sequence
  Peptide Derived from Human Papillomavirus
FKCVSGQNI

SEQ ID NO: 18708 - protein, 9 aa, Artificial Sequence
  Peptide Derived from Human Papillomavirus
FKELYGVSF

SEQ ID NO: 18709 - protein, 10 aa, Artificial Sequence
  Peptide Derived from Human Papillomavirus
FKELYGVSFM

SEQ ID NO: 18710 - protein, 8 aa, Artificial Sequence
  Peptide Derived from Human Papillomavirus
FKTLLQPY

SEQ ID NO: 18711 - protein, 10 aa, Artificial Sequence
  Peptide Derived from Human Papillomavirus
FKTLLQPYCL

SEQ ID NO: 18712 - protein, 11 aa, Artificial Sequence
  Peptide Derived from Human Papillomavirus
FKTLLQPYCLY

SEQ ID NO: 18713 - protein, 9 aa, Artificial Sequence
  Peptide Derived from Human Papillomavirus
GKAAMLGKF

SEQ ID NO: 18714 - protein, 8 aa, Artificial Sequence
  Peptide Derived from Human Papillomavirus
GKDDRWPY

SEQ ID NO: 18715 - protein, 9 aa, Artificial Sequence
  Peptide Derived from Human Papillomavirus
GKDDRWPYL

SEQ ID NO: 18716 - protein, 9 aa, Artificial Sequence
  Peptide Derived from Human Papillomavirus
GKFKELYGV

SEQ ID NO: 18717 - protein, 11 aa, Artificial Sequence
  Peptide Derived from Human Papillomavirus
GKFKELYGVSF

SEQ ID NO: 18718 - protein, 9 aa, Artificial Sequence
  Peptide Derived from Human Papillomavirus
GKSYFGMSL

SEQ ID NO: 18719 - protein, 10 aa, Artificial Sequence
  Peptide Derived from Human Papillomavirus
GKSYFGMSLI

SEQ ID NO: 18720 - protein, 11 aa, Artificial Sequence
  Peptide Derived from Human Papillomavirus
IHGAPNTGKSY

SEQ ID NO: 18721 - protein, 8 aa, Artificial Sequence
  Peptide Derived from Human Papillomavirus
IKSRCDKV

SEQ ID NO: 18722 - protein, 8 aa, Artificial Sequence
  Peptide Derived from Human Papillomavirus
KHKALMQL

SEQ ID NO: 18723 - protein, 10 aa, Artificial Sequence
  Peptide Derived from Human Papillomavirus
KKNCILIHGA

SEQ ID NO: 18724 - protein, 8 aa, Artificial Sequence
  Peptide Derived from Human Papillomavirus
KRAEKRQM

SEQ ID NO: 18725 - protein, 10 aa, Artificial Sequence
  Peptide Derived from Human Papillomavirus
KRAEKRQMSM

SEQ ID NO: 18726 - protein, 9 aa, Artificial Sequence
  Peptide Derived from Human Papillomavirus
KRKYVGSPL

SEQ ID NO: 18727 - protein, 9 aa, Artificial Sequence
  Peptide Derived from Human Papillomavirus
KRQMSMGQW

SEQ ID NO: 18728 - protein, 10 aa, Artificial Sequence
  Peptide Derived from Human Papillomavirus
KRQMSMGQWI

SEQ ID NO: 18729 - protein, 8 aa, Artificial Sequence
  Peptide Derived from Human Papillomavirus
LHSRLVVF

SEQ ID NO: 18730 - protein, 10 aa, Artificial Sequence
  Peptide Derived from Human Papillomavirus
LHSRLVVFTF

SEQ ID NO: 18731 - protein, 8 aa, Artificial Sequence
  Peptide Derived from Human Papillomavirus
LKCPPLLI

SEQ ID NO: 18732 - protein, 10 aa, Artificial Sequence
  Peptide Derived from Human Papillomavirus
LKGVPKKNCI

SEQ ID NO: 18733 - protein, 11 aa, Artificial Sequence
  Peptide Derived from Human Papillomavirus
LKGVPKKNCIL

SEQ ID NO: 18734 - protein, 8 aa, Artificial Sequence
  Peptide Derived from Human Papillomavirus
LKLFLKGV

SEQ ID NO: 18735 - protein, 10 aa, Artificial Sequence
  Peptide Derived from Human Papillomavirus
LKRKYVGSPL

SEQ ID NO: 18736 - protein, 9 aa, Artificial Sequence
  Peptide Derived from Human Papillomavirus
LKSNSQAKI

SEQ ID NO: 18737 - protein, 10 aa, Artificial Sequence
  Peptide Derived from Human Papillomavirus
LKSNSQAKIV

SEQ ID NO: 18738 - protein, 8 aa, Artificial Sequence
  Peptide Derived from Human Papillomavirus
LKTSNGKA

SEQ ID NO: 18739 - protein, 9 aa, Artificial Sequence
  Peptide Derived from Human Papillomavirus
LKTSNGKAA

SEQ ID NO: 18740 - protein, 10 aa, Artificial Sequence
  Peptide Derived from Human Papillomavirus
LKTSNGKAAM

SEQ ID NO: 18741 - protein, 11 aa, Artificial Sequence
  Peptide Derived from Human Papillomavirus
LKTSNGKAAML

SEQ ID NO: 18742 - protein, 10 aa, Artificial Sequence
  Peptide Derived from Human Papillomavirus
LRNALDGNPV

SEQ ID NO: 18743 - protein, 8 aa, Artificial Sequence
  Peptide Derived from Human Papillomavirus
LRSTAAAL

SEQ ID NO: 18744 - protein, 9 aa, Artificial Sequence
  Peptide Derived from Human Papillomavirus
LRSTAAALY

SEQ ID NO: 18745 - protein, 10 aa, Artificial Sequence
  Peptide Derived from Human Papillomavirus
LRSTAAALYW

SEQ ID NO: 18746 - protein, 11 aa, Artificial Sequence
  Peptide Derived from Human Papillomavirus
LRSTAAALYWY

SEQ ID NO: 18747 - protein, 8 aa, Artificial Sequence
  Peptide Derived from Human Papillomavirus
LRYQQIEF

SEQ ID NO: 18748 - protein, 9 aa, Artificial Sequence
  Peptide Derived from Human Papillomavirus
LRYQQIEFV

SEQ ID NO: 18749 - protein, 11 aa, Artificial Sequence
  Peptide Derived from Human Papillomavirus
LRYQQIEFVSF

SEQ ID NO: 18750 - protein, 8 aa, Artificial Sequence
  Peptide Derived from Human Papillomavirus
NKSTCTDW

SEQ ID NO: 18751 - protein, 10 aa, Artificial Sequence
  Peptide Derived from Human Papillomavirus
NKSTCTDWCV

SEQ ID NO: 18752 - protein, 11 aa, Artificial Sequence
  Peptide Derived from Human Papillomavirus
NKSTCTDWCVA

SEQ ID NO: 18753 - protein, 8 aa, Artificial Sequence
  Peptide Derived from Human Papillomavirus
NRITIEKL

SEQ ID NO: 18754 - protein, 9 aa, Artificial Sequence
  Peptide Derived from Human Papillomavirus
NRITIEKLL

SEQ ID NO: 18755 - protein, 8 aa, Artificial Sequence
  Peptide Derived from Human Papillomavirus
PKKNCILI

SEQ ID NO: 18756 - protein, 11 aa, Artificial Sequence
  Peptide Derived from Human Papillomavirus
PKKNCILIHGA

SEQ ID NO: 18757 - protein, 8 aa, Artificial Sequence
  Peptide Derived from Human Papillomavirus
PKLRSTAA

SEQ ID NO: 18758 - protein, 9 aa, Artificial Sequence
  Peptide Derived from Human Papillomavirus
PKLRSTAAA

SEQ ID NO: 18759 - protein, 10 aa, Artificial Sequence
  Peptide Derived from Human Papillomavirus
PKLRSTAAAL

SEQ ID NO: 18760 - protein, 11 aa, Artificial Sequence
  Peptide Derived from Human Papillomavirus
PKLRSTAAALY

SEQ ID NO: 18761 - protein, 8 aa, Artificial Sequence
  Peptide Derived from Human Papillomavirus
PRLKAICI

SEQ ID NO: 18762 - protein, 9 aa, Artificial Sequence
  Peptide Derived from Human Papillomavirus
QHSFNDTTF

SEQ ID NO: 18763 - protein, 11 aa, Artificial Sequence
  Peptide Derived from Human Papillomavirus
QHSFNDTTFDL

SEQ ID NO: 18764 - protein, 11 aa, Artificial Sequence
  Peptide Derived from Human Papillomavirus
RHYKRAEKRQM

SEQ ID NO: 18765 - protein, 8 aa, Artificial Sequence
  Peptide Derived from Human Papillomavirus
RKYVGSPL

SEQ ID NO: 18766 - protein, 11 aa, Artificial Sequence
  Peptide Derived from Human Papillomavirus
RKYVGSPLSDI

SEQ ID NO: 18767 - protein, 11 aa, Artificial Sequence
  Peptide Derived from Human Papillomavirus
RRLFELPDSGY

SEQ ID NO: 18768 - protein, 8 aa, Artificial Sequence
  Peptide Derived from Human Papillomavirus
SHFWLQPL

SEQ ID NO: 18769 - protein, 9 aa, Artificial Sequence
  Peptide Derived from Human Papillomavirus
SHFWLQPLA

SEQ ID NO: 18770 - protein, 11 aa, Artificial Sequence
  Peptide Derived from Human Papillomavirus
SHFWLQPLADA

SEQ ID NO: 18771 - protein, 10 aa, Artificial Sequence
  Peptide Derived from Human Papillomavirus
SKSHFWLQPL

SEQ ID NO: 18772 - protein, 11 aa, Artificial Sequence
  Peptide Derived from Human Papillomavirus
SKSHFWLQPLA

SEQ ID NO: 18773 - protein, 8 aa, Artificial Sequence
  Peptide Derived from Human Papillomavirus
SKTAKRRL

SEQ ID NO: 18774 - protein, 9 aa, Artificial Sequence
  Peptide Derived from Human Papillomavirus
SKTAKRRLF

SEQ ID NO: 18775 - protein, 11 aa, Artificial Sequence
  Peptide Derived from Human Papillomavirus
SKTAKRRLFEL

SEQ ID NO: 18776 - protein, 8 aa, Artificial Sequence
  Peptide Derived from Human Papillomavirus
SRLVVFTF

SEQ ID NO: 18777 - protein, 9 aa, Artificial Sequence
  Peptide Derived from Human Papillomavirus
SRTWCRLNL

SEQ ID NO: 18778 - protein, 8 aa, Artificial Sequence
  Peptide Derived from Human Papillomavirus
TRNILQVL

SEQ ID NO: 18779 - protein, 11 aa, Artificial Sequence
  Peptide Derived from Human Papillomavirus
VKDCGTMCRHY

SEQ ID NO: 18780 - protein, 9 aa, Artificial Sequence
  Peptide Derived from Human Papillomavirus
VKFLRYQQI

SEQ ID NO: 18781 - protein, 11 aa, Artificial Sequence
  Peptide Derived from Human Papillomavirus
VKFLRYQQIEF

SEQ ID NO: 18782 - protein, 9 aa, Artificial Sequence
  Peptide Derived from Human Papillomavirus
VKHKALMQL

SEQ ID NO: 18783 - protein, 10 aa, Artificial Sequence
  Peptide Derived from Human Papillomavirus
VRFKCAKNRI

SEQ ID NO: 18784 - protein, 8 aa, Artificial Sequence
  Peptide Derived from Human Papillomavirus
WHYIDNYL

SEQ ID NO: 18785 - protein, 11 aa, Artificial Sequence
  Peptide Derived from Human Papillomavirus
WHYIDNYLRNA

SEQ ID NO: 18786 - protein, 9 aa, Artificial Sequence
  Peptide Derived from Human Papillomavirus
WKSFFSRTW

SEQ ID NO: 18787 - protein, 8 aa, Artificial Sequence
  Peptide Derived from Human Papillomavirus
WRDIVKFL

SEQ ID NO: 18788 - protein, 10 aa, Artificial Sequence
  Peptide Derived from Human Papillomavirus
WRDIVKFLRY

SEQ ID NO: 18789 - protein, 9 aa, Artificial Sequence
  Peptide Derived from Human Papillomavirus
YKRAEKRQM

SEQ ID NO: 18790 - protein, 11 aa, Artificial Sequence
  Peptide Derived from Human Papillomavirus
YKRAEKRQMSM

SEQ ID NO: 18791 - protein, 8 aa, Artificial Sequence
  Peptide Derived from Human Papillomavirus
YRTGMSNI

SEQ ID NO: 18792 - protein, 11 aa, Artificial Sequence
  Peptide Derived from Human Papillomavirus
YRTGMSNISDV

SEQ ID NO: 18793 - protein, 9 aa, Artificial Sequence
  Peptide Derived from Human Papillomavirus
AKALQAIEL

SEQ ID NO: 18794 - protein, 11 aa, Artificial Sequence
  Peptide Derived from Human Papillomavirus
AKALQAIELQM

SEQ ID NO: 18795 - protein, 10 aa, Artificial Sequence
  Peptide Derived from Human Papillomavirus
AKKYGTGKKW

SEQ ID NO: 18796 - protein, 9 aa, Artificial Sequence
  Peptide Derived from Human Papillomavirus
AREMGIHSI

SEQ ID NO: 18797 - protein, 9 aa, Artificial Sequence
  Peptide Derived from Human Papillomavirus
DHIDYWKHI

SEQ ID NO: 18798 - protein, 11 aa, Artificial Sequence
  Peptide Derived from Human Papillomavirus
DHIDYWKHIRL

SEQ ID NO: 18799 - protein, 11 aa, Artificial Sequence
  Peptide Derived from Human Papillomavirus
EHRNTHHPNKL

SEQ ID NO: 18800 - protein, 10 aa, Artificial Sequence
  Peptide Derived from Human Papillomavirus
EHYENDSKRL

SEQ ID NO: 18801 - protein, 9 aa, Artificial Sequence
  Peptide Derived from Human Papillomavirus
GHITYFVNF

SEQ ID NO: 18802 - protein, 8 aa, Artificial Sequence
  Peptide Derived from Human Papillomavirus
GKHKNAIV

SEQ ID NO: 18803 - protein, 10 aa, Artificial Sequence
  Peptide Derived from Human Papillomavirus
GKHKNAIVTL

SEQ ID NO: 18804 - protein, 8 aa, Artificial Sequence
  Peptide Derived from Human Papillomavirus
GKKWEVHA

SEQ ID NO: 18805 - protein, 8 aa, Artificial Sequence
  Peptide Derived from Human Papillomavirus
HKNAIVTL

SEQ ID NO: 18806 - protein, 10 aa, Artificial Sequence
  Peptide Derived from Human Papillomavirus
HKNAIVTLTY

SEQ ID NO: 18807 - protein, 11 aa, Artificial Sequence
  Peptide Derived from Human Papillomavirus
HKNAIVTLTYI

SEQ ID NO: 18808 - protein, 10 aa, Artificial Sequence
  Peptide Derived from Human Papillomavirus
HRNTHHPNKL

SEQ ID NO: 18809 - protein, 11 aa, Artificial Sequence
  Peptide Derived from Human Papillomavirus
HRNTHHPNKLL

SEQ ID NO: 18810 - protein, 9 aa, Artificial Sequence
  Peptide Derived from Human Papillomavirus
IHLKGDANI

SEQ ID NO: 18811 - protein, 10 aa, Artificial Sequence
  Peptide Derived from Human Papillomavirus
IHLKGDANIL

SEQ ID NO: 18812 - protein, 8 aa, Artificial Sequence
  Peptide Derived from Human Papillomavirus
IHSINHQV

SEQ ID NO: 18813 - protein, 9 aa, Artificial Sequence
  Peptide Derived from Human Papillomavirus
IHSINHQVV

SEQ ID NO: 18814 - protein, 11 aa, Artificial Sequence
  Peptide Derived from Human Papillomavirus
IHSINHQVVPA

SEQ ID NO: 18815 - protein, 8 aa, Artificial Sequence
  Peptide Derived from Human Papillomavirus
IRLECVLM

SEQ ID NO: 18816 - protein, 9 aa, Artificial Sequence
  Peptide Derived from Human Papillomavirus
IRLECVLMY

SEQ ID NO: 18817 - protein, 11 aa, Artificial Sequence
  Peptide Derived from Human Papillomavirus
IRLECVLMYKA

SEQ ID NO: 18818 - protein, 8 aa, Artificial Sequence
  Peptide Derived from Human Papillomavirus
KHGYTVEV

SEQ ID NO: 18819 - protein, 10 aa, Artificial Sequence
  Peptide Derived from Human Papillomavirus
KHGYTVEVQF

SEQ ID NO: 18820 - protein, 8 aa, Artificial Sequence
  Peptide Derived from Human Papillomavirus
KHIRLECV

SEQ ID NO: 18821 - protein, 9 aa, Artificial Sequence
  Peptide Derived from Human Papillomavirus
KHIRLECVL

SEQ ID NO: 18822 - protein, 10 aa, Artificial Sequence
  Peptide Derived from Human Papillomavirus
KHIRLECVLM

SEQ ID NO: 18823 - protein, 11 aa, Artificial Sequence
  Peptide Derived from Human Papillomavirus
KHIRLECVLMY

SEQ ID NO: 18824 - protein, 9 aa, Artificial Sequence
  Peptide Derived from Human Papillomavirus
KHKNAIVTL

SEQ ID NO: 18825 - protein, 11 aa, Artificial Sequence
  Peptide Derived from Human Papillomavirus
KHKNAIVTLTY

SEQ ID NO: 18826 - protein, 9 aa, Artificial Sequence
  Peptide Derived from Human Papillomavirus
KKHGYTVEV

SEQ ID NO: 18827 - protein, 11 aa, Artificial Sequence
  Peptide Derived from Human Papillomavirus
KKHGYTVEVQF

SEQ ID NO: 18828 - protein, 11 aa, Artificial Sequence
  Peptide Derived from Human Papillomavirus
KKWEVHAGGQV

SEQ ID NO: 18829 - protein, 9 aa, Artificial Sequence
  Peptide Derived from Human Papillomavirus
KKYGTGKKW

SEQ ID NO: 18830 - protein, 11 aa, Artificial Sequence
  Peptide Derived from Human Papillomavirus
KKYGTGKKWEV

SEQ ID NO: 18831 - protein, 9 aa, Artificial Sequence
  Peptide Derived from Human Papillomavirus
KRLCDHIDY

SEQ ID NO: 18832 - protein, 10 aa, Artificial Sequence
  Peptide Derived from Human Papillomavirus
KRLCDHIDYW

SEQ ID NO: 18833 - protein, 8 aa, Artificial Sequence
  Peptide Derived from Human Papillomavirus
LKCLRYRL

SEQ ID NO: 18834 - protein, 11 aa, Artificial Sequence
  Peptide Derived from Human Papillomavirus
LKCLRYRLSKY

SEQ ID NO: 18835 - protein, 8 aa, Artificial Sequence
  Peptide Derived from Human Papillomavirus
LKGDANIL

SEQ ID NO: 18836 - protein, 11 aa, Artificial Sequence
  Peptide Derived from Human Papillomavirus
LKGDANILKCL

SEQ ID NO: 18837 - protein, 8 aa, Artificial Sequence
  Peptide Derived from Human Papillomavirus
LKKHGYTV

SEQ ID NO: 18838 - protein, 10 aa, Artificial Sequence
  Peptide Derived from Human Papillomavirus
LKKHGYTVEV

SEQ ID NO: 18839 - protein, 9 aa, Artificial Sequence
  Peptide Derived from Human Papillomavirus
LRGDSVDSV

SEQ ID NO: 18840 - protein, 8 aa, Artificial Sequence
  Peptide Derived from Human Papillomavirus
LRYRLSKY

SEQ ID NO: 18841 - protein, 11 aa, Artificial Sequence
  Peptide Derived from Human Papillomavirus
LRYRLSKYKQL

SEQ ID NO: 18842 - protein, 8 aa, Artificial Sequence
  Peptide Derived from Human Papillomavirus
MHYTNWKF

SEQ ID NO: 18843 - protein, 9 aa, Artificial Sequence
  Peptide Derived from Human Papillomavirus
MHYTNWKFI

SEQ ID NO: 18844 - protein, 10 aa, Artificial Sequence
  Peptide Derived from Human Papillomavirus
MHYTNWKFIY

SEQ ID NO: 18845 - protein, 11 aa, Artificial Sequence
  Peptide Derived from Human Papillomavirus
MHYTNWKFIYL

SEQ ID NO: 18846 - protein, 8 aa, Artificial Sequence
  Peptide Derived from Human Papillomavirus
NHQVVPAL

SEQ ID NO: 18847 - protein, 10 aa, Artificial Sequence
  Peptide Derived from Human Papillomavirus
NHQVVPALSV

SEQ ID NO: 18848 - protein, 9 aa, Artificial Sequence
  Peptide Derived from Human Papillomavirus
NKLLRGDSV

SEQ ID NO: 18849 - protein, 9 aa, Artificial Sequence
  Peptide Derived from Human Papillomavirus
QRDDFLNTV

SEQ ID NO: 18850 - protein, 11 aa, Artificial Sequence
  Peptide Derived from Human Papillomavirus
QRDDFLNTVKI

SEQ ID NO: 18851 - protein, 10 aa, Artificial Sequence
  Peptide Derived from Human Papillomavirus
QRLNVCQDKI

SEQ ID NO: 18852 - protein, 11 aa, Artificial Sequence
  Peptide Derived from Human Papillomavirus
QRLNVCQDKIL

SEQ ID NO: 18853 - protein, 8 aa, Artificial Sequence
  Peptide Derived from Human Papillomavirus
SKAKALQA

SEQ ID NO: 18854 - protein, 9 aa, Artificial Sequence
  Peptide Derived from Human Papillomavirus
SKAKALQAI

SEQ ID NO: 18855 - protein, 11 aa, Artificial Sequence
  Peptide Derived from Human Papillomavirus
SKAKALQAIEL

SEQ ID NO: 18856 - protein, 8 aa, Artificial Sequence
  Peptide Derived from Human Papillomavirus
SKRLCDHI

SEQ ID NO: 18857 - protein, 10 aa, Artificial Sequence
  Peptide Derived from Human Papillomavirus
SKRLCDHIDY

SEQ ID NO: 18858 - protein, 11 aa, Artificial Sequence
  Peptide Derived from Human Papillomavirus
SKRLCDHIDYW

SEQ ID NO: 18859 - protein, 10 aa, Artificial Sequence
  Peptide Derived from Human Papillomavirus
SKYKQLYEQV

SEQ ID NO: 18860 - protein, 8 aa, Artificial Sequence
  Peptide Derived from Human Papillomavirus
THHPNKLL

SEQ ID NO: 18861 - protein, 8 aa, Artificial Sequence
  Peptide Derived from Human Papillomavirus
TRAVSCPA

SEQ ID NO: 18862 - protein, 8 aa, Artificial Sequence
  Peptide Derived from Human Papillomavirus
VHAGGQVI

SEQ ID NO: 18863 - protein, 9 aa, Artificial Sequence
  Peptide Derived from Human Papillomavirus
VHAGGQVIV

SEQ ID NO: 18864 - protein, 10 aa, Artificial Sequence
  Peptide Derived from Human Papillomavirus
VHAGGQVIVF

SEQ ID NO: 18865 - protein, 8 aa, Artificial Sequence
  Peptide Derived from Human Papillomavirus
VHEGHITY

SEQ ID NO: 18866 - protein, 9 aa, Artificial Sequence
  Peptide Derived from Human Papillomavirus
VHEGHITYF

SEQ ID NO: 18867 - protein, 10 aa, Artificial Sequence
  Peptide Derived from Human Papillomavirus
VHEGHITYFV

SEQ ID NO: 18868 - protein, 10 aa, Artificial Sequence
  Peptide Derived from Human Papillomavirus
VHNTMHYTNW

SEQ ID NO: 18869 - protein, 9 aa, Artificial Sequence
  Peptide Derived from Human Papillomavirus
VKIPNTVSV

SEQ ID NO: 18870 - protein, 8 aa, Artificial Sequence
  Peptide Derived from Human Papillomavirus
WKFIYLCI

SEQ ID NO: 18871 - protein, 9 aa, Artificial Sequence
  Peptide Derived from Human Papillomavirus
WKHIRLECV

SEQ ID NO: 18872 - protein, 10 aa, Artificial Sequence
  Peptide Derived from Human Papillomavirus
WKHIRLECVL

SEQ ID NO: 18873 - protein, 11 aa, Artificial Sequence
  Peptide Derived from Human Papillomavirus
WKHIRLECVLM

SEQ ID NO: 18874 - protein, 8 aa, Artificial Sequence
  Peptide Derived from Human Papillomavirus
YKAREMGI

SEQ ID NO: 18875 - protein, 11 aa, Artificial Sequence
  Peptide Derived from Human Papillomavirus
YKAREMGIHSI

SEQ ID NO: 18876 - protein, 8 aa, Artificial Sequence
  Peptide Derived from Human Papillomavirus
YKNEDWTM

SEQ ID NO: 18877 - protein, 8 aa, Artificial Sequence
  Peptide Derived from Human Papillomavirus
YKQLYEQV

SEQ ID NO: 18878 - protein, 9 aa, Artificial Sequence
  Peptide Derived from Human Papillomavirus
YRLSKYKQL

SEQ ID NO: 18879 - protein, 10 aa, Artificial Sequence
  Peptide Derived from Human Papillomavirus
YRLSKYKQLY

SEQ ID NO: 18880 - protein, 8 aa, Artificial Sequence
  Peptide Derived from Human Papillomavirus
IHTHASFL

SEQ ID NO: 18881 - protein, 8 aa, Artificial Sequence
  Peptide Derived from Human Papillomavirus
IRPLVLSV

SEQ ID NO: 18882 - protein, 10 aa, Artificial Sequence
  Peptide Derived from Human Papillomavirus
IRPLVLSVSV

SEQ ID NO: 18883 - protein, 11 aa, Artificial Sequence
  Peptide Derived from Human Papillomavirus
IRPLVLSVSVY

SEQ ID NO: 18884 - protein, 8 aa, Artificial Sequence
  Peptide Derived from Human Papillomavirus
LRCFCIYV

SEQ ID NO: 18885 - protein, 9 aa, Artificial Sequence
  Peptide Derived from Human Papillomavirus
LRCFCIYVV

SEQ ID NO: 18886 - protein, 10 aa, Artificial Sequence
  Peptide Derived from Human Papillomavirus
LRCFCIYVVF

SEQ ID NO: 18887 - protein, 11 aa, Artificial Sequence
  Peptide Derived from Human Papillomavirus
LRCFCIYVVFI

SEQ ID NO: 18888 - protein, 10 aa, Artificial Sequence
  Peptide Derived from Human Papillomavirus
CKGQLTETEV

SEQ ID NO: 18889 - protein, 11 aa, Artificial Sequence
  Peptide Derived from Human Papillomavirus
CKGQLTETEVL

SEQ ID NO: 18890 - protein, 9 aa, Artificial Sequence
  Peptide Derived from Human Papillomavirus
DKKKRFHNI

SEQ ID NO: 18891 - protein, 8 aa, Artificial Sequence
  Peptide Derived from Human Papillomavirus
EKLTNKGI

SEQ ID NO: 18892 - protein, 11 aa, Artificial Sequence
  Peptide Derived from Human Papillomavirus
EKLTNKGICDL

SEQ ID NO: 18893 - protein, 9 aa, Artificial Sequence
  Peptide Derived from Human Papillomavirus
ERPRKLHEL

SEQ ID NO: 18894 - protein, 8 aa, Artificial Sequence
  Peptide Derived from Human Papillomavirus
FHNIGGRW

SEQ ID NO: 18895 - protein, 11 aa, Artificial Sequence
  Peptide Derived from Human Papillomavirus
FKNPAERPRKL

SEQ ID NO: 18896 - protein, 8 aa, Artificial Sequence
  Peptide Derived from Human Papillomavirus
FRWYRYSV

SEQ ID NO: 18897 - protein, 9 aa, Artificial Sequence
  Peptide Derived from Human Papillomavirus
FRWYRYSVY

SEQ ID NO: 18898 - protein, 8 aa, Artificial Sequence
  Peptide Derived from Human Papillomavirus
GRWTGRCI

SEQ ID NO: 18899 - protein, 9 aa, Artificial Sequence
  Peptide Derived from Human Papillomavirus
GRWTGRCIA

SEQ ID NO: 18900 - protein, 11 aa, Artificial Sequence
  Peptide Derived from Human Papillomavirus
GRWTGRCIACW

SEQ ID NO: 18901 - protein, 10 aa, Artificial Sequence
  Peptide Derived from Human Papillomavirus
IRCITCQRPL

SEQ ID NO: 18902 - protein, 8 aa, Artificial Sequence
  Peptide Derived from Human Papillomavirus
KKKRFHNI

SEQ ID NO: 18903 - protein, 11 aa, Artificial Sequence
  Peptide Derived from Human Papillomavirus
KKRFHNIGGRW

SEQ ID NO: 18904 - protein, 10 aa, Artificial Sequence
  Peptide Derived from Human Papillomavirus
KRFHNIGGRW

SEQ ID NO: 18905 - protein, 8 aa, Artificial Sequence
  Peptide Derived from Human Papillomavirus
LHELSSAL

SEQ ID NO: 18906 - protein, 10 aa, Artificial Sequence
  Peptide Derived from Human Papillomavirus
LHELSSALEI

SEQ ID NO: 18907 - protein, 10 aa, Artificial Sequence
  Peptide Derived from Human Papillomavirus
LRFYSKVSEF

SEQ ID NO: 18908 - protein, 8 aa, Artificial Sequence
  Peptide Derived from Human Papillomavirus
NKGICDLL

SEQ ID NO: 18909 - protein, 9 aa, Artificial Sequence
  Peptide Derived from Human Papillomavirus
NKGICDLLI

SEQ ID NO: 18910 - protein, 9 aa, Artificial Sequence
  Peptide Derived from Human Papillomavirus
PHGVCTKCL

SEQ ID NO: 18911 - protein, 11 aa, Artificial Sequence
  Peptide Derived from Human Papillomavirus
PHGVCTKCLRF

SEQ ID NO: 18912 - protein, 10 aa, Artificial Sequence
  Peptide Derived from Human Papillomavirus
PRKLHELSSA

SEQ ID NO: 18913 - protein, 11 aa, Artificial Sequence
  Peptide Derived from Human Papillomavirus
PRKLHELSSAL

SEQ ID NO: 18914 - protein, 10 aa, Artificial Sequence
  Peptide Derived from Human Papillomavirus
QRHLDKKKRF

SEQ ID NO: 18915 - protein, 9 aa, Artificial Sequence
  Peptide Derived from Human Papillomavirus
RHLDKKKRF

SEQ ID NO: 18916 - protein, 9 aa, Artificial Sequence
  Peptide Derived from Human Papillomavirus
RKLHELSSA

SEQ ID NO: 18917 - protein, 10 aa, Artificial Sequence
  Peptide Derived from Human Papillomavirus
RKLHELSSAL

SEQ ID NO: 18918 - protein, 9 aa, Artificial Sequence
  Peptide Derived from Human Papillomavirus
RRPRTETQV

SEQ ID NO: 18919 - protein, 8 aa, Artificial Sequence
  Peptide Derived from Human Papillomavirus
SKVSEFRW

SEQ ID NO: 18920 - protein, 9 aa, Artificial Sequence
  Peptide Derived from Human Papillomavirus
SKVSEFRWY

SEQ ID NO: 18921 - protein, 11 aa, Artificial Sequence
  Peptide Derived from Human Papillomavirus
SKVSEFRWYRY

SEQ ID NO: 18922 - protein, 10 aa, Artificial Sequence
  Peptide Derived from Human Papillomavirus
TKCLRFYSKV

SEQ ID NO: 18923 - protein, 10 aa, Artificial Sequence
  Peptide Derived from Human Papillomavirus
WRRPRTETQV

SEQ ID NO: 18924 - protein, 9 aa, Artificial Sequence
  Peptide Derived from Human Papillomavirus
YRDDTPHGV

SEQ ID NO: 18925 - protein, 10 aa, Artificial Sequence
  Peptide Derived from Human Papillomavirus
YRYSVYGTTL

SEQ ID NO: 18926 - protein, 9 aa, Artificial Sequence
  Peptide Derived from Human Papillomavirus
CKSTLRLCV

SEQ ID NO: 18927 - protein, 8 aa, Artificial Sequence
  Peptide Derived from Human Papillomavirus
IRILQELL

SEQ ID NO: 18928 - protein, 9 aa, Artificial Sequence
  Peptide Derived from Human Papillomavirus
IRILQELLM

SEQ ID NO: 18929 - protein, 10 aa, Artificial Sequence
  Peptide Derived from Human Papillomavirus
LRLCVQSTQV

SEQ ID NO: 18930 - protein, 8 aa, Artificial Sequence
  Peptide Derived from Human Papillomavirus
MRGETPTL

SEQ ID NO: 18931 - protein, 11 aa, Artificial Sequence
  Peptide Derived from Human Papillomavirus
MRGETPTLQDY

SEQ ID NO: 18932 - protein, 10 aa, Artificial Sequence
  Peptide Derived from Human Papillomavirus
ARLLTVGHPY

SEQ ID NO: 18933 - protein, 11 aa, Artificial Sequence
  Peptide Derived from Human Papillomavirus
ARLLTVGHPYY

SEQ ID NO: 18934 - protein, 9 aa, Artificial Sequence
  Peptide Derived from Human Papillomavirus
CKITLSADI

SEQ ID NO: 18935 - protein, 10 aa, Artificial Sequence
  Peptide Derived from Human Papillomavirus
CKITLSADIM

SEQ ID NO: 18936 - protein, 9 aa, Artificial Sequence
  Peptide Derived from Human Papillomavirus
CKPPIGEHW

SEQ ID NO: 18937 - protein, 9 aa, Artificial Sequence
  Peptide Derived from Human Papillomavirus
CKYPDYLKM

SEQ ID NO: 18938 - protein, 10 aa, Artificial Sequence
  Peptide Derived from Human Papillomavirus
CKYPDYLKMV

SEQ ID NO: 18939 - protein, 11 aa, Artificial Sequence
  Peptide Derived from Human Papillomavirus
CKYPDYLKMVA

SEQ ID NO: 18940 - protein, 10 aa, Artificial Sequence
  Peptide Derived from Human Papillomavirus
EKFSADLDQF

SEQ ID NO: 18941 - protein, 8 aa, Artificial Sequence
  Peptide Derived from Human Papillomavirus
FKAGKRSA

SEQ ID NO: 18942 - protein, 11 aa, Artificial Sequence
  Peptide Derived from Human Papillomavirus
FKAGKRSAPSA

SEQ ID NO: 18943 - protein, 9 aa, Artificial Sequence
  Peptide Derived from Human Papillomavirus
FKDYVFWEV

SEQ ID NO: 18944 - protein, 11 aa, Artificial Sequence
  Peptide Derived from Human Papillomavirus
FKDYVFWEVNL

SEQ ID NO: 18945 - protein, 11 aa, Artificial Sequence
  Peptide Derived from Human Papillomavirus
FKEYLRHGEEF

SEQ ID NO: 18946 - protein, 9 aa, Artificial Sequence
  Peptide Derived from Human Papillomavirus
FKSSNFKEY

SEQ ID NO: 18947 - protein, 10 aa, Artificial Sequence
  Peptide Derived from Human Papillomavirus
FKSSNFKEYL

SEQ ID NO: 18948 - protein, 11 aa, Artificial Sequence
  Peptide Derived from Human Papillomavirus
FRVRLPDPNKF

SEQ ID NO: 18949 - protein, 8 aa, Artificial Sequence
  Peptide Derived from Human Papillomavirus
GHNNGICW

SEQ ID NO: 18950 - protein, 8 aa, Artificial Sequence
  Peptide Derived from Human Papillomavirus
GHPLLNKF

SEQ ID NO: 18951 - protein, 10 aa, Artificial Sequence
  Peptide Derived from Human Papillomavirus
GKGSPCSNNA

SEQ ID NO: 18952 - protein, 11 aa, Artificial Sequence
  Peptide Derived from Human Papillomavirus
GKGSPCSNNAI

SEQ ID NO: 18953 - protein, 8 aa, Artificial Sequence
  Peptide Derived from Human Papillomavirus
GKRSAPSA

SEQ ID NO: 18954 - protein, 8 aa, Artificial Sequence
  Peptide Derived from Human Papillomavirus
GRGQPLGV

SEQ ID NO: 18955 - protein, 10 aa, Artificial Sequence
  Peptide Derived from Human Papillomavirus
GRGQPLGVGI

SEQ ID NO: 18956 - protein, 8 aa, Artificial Sequence
  Peptide Derived from Human Papillomavirus
GRKFLLQA

SEQ ID NO: 18957 - protein, 10 aa, Artificial Sequence
  Peptide Derived from Human Papillomavirus
GRKFLLQAGY

SEQ ID NO: 18958 - protein, 8 aa, Artificial Sequence
  Peptide Derived from Human Papillomavirus
IHSMNPAI

SEQ ID NO: 18959 - protein, 9 aa, Artificial Sequence
  Peptide Derived from Human Papillomavirus
IHSMNPAIL

SEQ ID NO: 18960 - protein, 8 aa, Artificial Sequence
  Peptide Derived from Human Papillomavirus
IKGSGSTA

SEQ ID NO: 18961 - protein, 10 aa, Artificial Sequence
  Peptide Derived from Human Papillomavirus
IKGSGSTATL

SEQ ID NO: 18962 - protein, 11 aa, Artificial Sequence
  Peptide Derived from Human Papillomavirus
IKGSGSTATLA

SEQ ID NO: 18963 - protein, 8 aa, Artificial Sequence
  Peptide Derived from Human Papillomavirus
KKIVVPKV

SEQ ID NO: 18964 - protein, 11 aa, Artificial Sequence
  Peptide Derived from Human Papillomavirus
KKIVVPKVSGL

SEQ ID NO: 18965 - protein, 9 aa, Artificial Sequence
  Peptide Derived from Human Papillomavirus
LKEKFSADL

SEQ ID NO: 18966 - protein, 8 aa, Artificial Sequence
  Peptide Derived from Human Papillomavirus
LKMVAEPY

SEQ ID NO: 18967 - protein, 11 aa, Artificial Sequence
  Peptide Derived from Human Papillomavirus
LKNSVIQDGDM

SEQ ID NO: 18968 - protein, 9 aa, Artificial Sequence
  Peptide Derived from Human Papillomavirus
LRHGEEFDL

SEQ ID NO: 18969 - protein, 11 aa, Artificial Sequence
  Peptide Derived from Human Papillomavirus
LRHGEEFDLQF

SEQ ID NO: 18970 - protein, 8 aa, Artificial Sequence
  Peptide Derived from Human Papillomavirus
LRREQMFV

SEQ ID NO: 18971 - protein, 11 aa, Artificial Sequence
  Peptide Derived from Human Papillomavirus
LRREQMFVRHF

SEQ ID NO: 18972 - protein, 10 aa, Artificial Sequence
  Peptide Derived from Human Papillomavirus
NKFGFPDTSF

SEQ ID NO: 18973 - protein, 11 aa, Artificial Sequence
  Peptide Derived from Human Papillomavirus
NKFGFPDTSFY

SEQ ID NO: 18974 - protein, 9 aa, Artificial Sequence
  Peptide Derived from Human Papillomavirus
NKPYWMQRA

SEQ ID NO: 18975 - protein, 9 aa, Artificial Sequence
  Peptide Derived from Human Papillomavirus
NRECISMDY

SEQ ID NO: 18976 - protein, 10 aa, Artificial Sequence
  Peptide Derived from Human Papillomavirus
NRSGTVGESV

SEQ ID NO: 18977 - protein, 9 aa, Artificial Sequence
  Peptide Derived from Human Papillomavirus
PKEDPFKDY

SEQ ID NO: 18978 - protein, 10 aa, Artificial Sequence
  Peptide Derived from Human Papillomavirus
PKEDPFKDYV

SEQ ID NO: 18979 - protein, 11 aa, Artificial Sequence
  Peptide Derived from Human Papillomavirus
PKEDPFKDYVF

SEQ ID NO: 18980 - protein, 10 aa, Artificial Sequence
  Peptide Derived from Human Papillomavirus
PKFKAGKRSA

SEQ ID NO: 18981 - protein, 9 aa, Artificial Sequence
  Peptide Derived from Human Papillomavirus
PKKIVVPKV

SEQ ID NO: 18982 - protein, 9 aa, Artificial Sequence
  Peptide Derived from Human Papillomavirus
PKSDNPKKI

SEQ ID NO: 18983 - protein, 10 aa, Artificial Sequence
  Peptide Derived from Human Papillomavirus
PKSDNPKKIV

SEQ ID NO: 18984 - protein, 11 aa, Artificial Sequence
  Peptide Derived from Human Papillomavirus
PKSDNPKKIVV

SEQ ID NO: 18985 - protein, 8 aa, Artificial Sequence
  Peptide Derived from Human Papillomavirus
PKVSGLQY

SEQ ID NO: 18986 - protein, 10 aa, Artificial Sequence
  Peptide Derived from Human Papillomavirus
PKVSGLQYRV

SEQ ID NO: 18987 - protein, 11 aa, Artificial Sequence
  Peptide Derived from Human Papillomavirus
PKVSGLQYRVF

SEQ ID NO: 18988 - protein, 8 aa, Artificial Sequence
  Peptide Derived from Human Papillomavirus
QKPKEDPF

SEQ ID NO: 18989 - protein, 11 aa, Artificial Sequence
  Peptide Derived from Human Papillomavirus
QKPKEDPFKDY

SEQ ID NO: 18990 - protein, 10 aa, Artificial Sequence
  Peptide Derived from Human Papillomavirus
QRAQGHNNGI

SEQ ID NO: 18991 - protein, 8 aa, Artificial Sequence
  Peptide Derived from Human Papillomavirus
QRLVWACV

SEQ ID NO: 18992 - protein, 10 aa, Artificial Sequence
  Peptide Derived from Human Papillomavirus
QRLVWACVGL

SEQ ID NO: 18993 - protein, 10 aa, Artificial Sequence
  Peptide Derived from Human Papillomavirus
RHFFNRSGTV

SEQ ID NO: 18994 - protein, 8 aa, Artificial Sequence
  Peptide Derived from Human Papillomavirus
RHGEEFDL

SEQ ID NO: 18995 - protein, 10 aa, Artificial Sequence
  Peptide Derived from Human Papillomavirus
RHGEEFDLQF

SEQ ID NO: 18996 - protein, 11 aa, Artificial Sequence
  Peptide Derived from Human Papillomavirus
RHGEEFDLQFI

SEQ ID NO: 18997 - protein, 9 aa, Artificial Sequence
  Peptide Derived from Human Papillomavirus
RKFLLQAGY

SEQ ID NO: 18998 - protein, 11 aa, Artificial Sequence
  Peptide Derived from Human Papillomavirus
RKFLLQAGYRA

SEQ ID NO: 18999 - protein, 10 aa, Artificial Sequence
  Peptide Derived from Human Papillomavirus
RREQMFVRHF

SEQ ID NO: 19000 - protein, 11 aa, Artificial Sequence
  Peptide Derived from Human Papillomavirus
RREQMFVRHFF

SEQ ID NO: 19001 - protein, 9 aa, Artificial Sequence
  Peptide Derived from Human Papillomavirus
SKVVSTDEY

SEQ ID NO: 19002 - protein, 10 aa, Artificial Sequence
  Peptide Derived from Human Papillomavirus
SKVVSTDEYV

SEQ ID NO: 19003 - protein, 9 aa, Artificial Sequence
  Peptide Derived from Human Papillomavirus
TKSNVPLDI

SEQ ID NO: 19004 - protein, 8 aa, Artificial Sequence
  Peptide Derived from Human Papillomavirus
TRSTNMSV

SEQ ID NO: 19005 - protein, 10 aa, Artificial Sequence
  Peptide Derived from Human Papillomavirus
TRSTNMSVCA

SEQ ID NO: 19006 - protein, 11 aa, Artificial Sequence
  Peptide Derived from Human Papillomavirus
TRSTNMSVCAA

SEQ ID NO: 19007 - protein, 9 aa, Artificial Sequence
  Peptide Derived from Human Papillomavirus
TRTNIYYHA

SEQ ID NO: 19008 - protein, 11 aa, Artificial Sequence
  Peptide Derived from Human Papillomavirus
VRHFFNRSGTV

SEQ ID NO: 19009 - protein, 9 aa, Artificial Sequence
  Peptide Derived from Human Papillomavirus
VRLPDPNKF

SEQ ID NO: 19010 - protein, 11 aa, Artificial Sequence
  Peptide Derived from Human Papillomavirus
VRLPDPNKFGF

SEQ ID NO: 19011 - protein, 8 aa, Artificial Sequence
  Peptide Derived from Human Papillomavirus
WRPSEATV

SEQ ID NO: 19012 - protein, 9 aa, Artificial Sequence
  Peptide Derived from Human Papillomavirus
WRPSEATVY

SEQ ID NO: 19013 - protein, 10 aa, Artificial Sequence
  Peptide Derived from Human Papillomavirus
WRPSEATVYL

SEQ ID NO: 19014 - protein, 8 aa, Artificial Sequence
  Peptide Derived from Human Papillomavirus
YHAGSARL

SEQ ID NO: 19015 - protein, 9 aa, Artificial Sequence
  Peptide Derived from Human Papillomavirus
YHAGSARLL

SEQ ID NO: 19016 - protein, 11 aa, Artificial Sequence
  Peptide Derived from Human Papillomavirus
YHAGSARLLTV

SEQ ID NO: 19017 - protein, 8 aa, Artificial Sequence
  Peptide Derived from Human Papillomavirus
YKQTQLCL

SEQ ID NO: 19018 - protein, 9 aa, Artificial Sequence
  Peptide Derived from Human Papillomavirus
YKQTQLCLL

SEQ ID NO: 19019 - protein, 9 aa, Artificial Sequence
  Peptide Derived from Human Papillomavirus
YRARPKFKA

SEQ ID NO: 19020 - protein, 8 aa, Artificial Sequence
  Peptide Derived from Human Papillomavirus
YRFVTSQA

SEQ ID NO: 19021 - protein, 9 aa, Artificial Sequence
  Peptide Derived from Human Papillomavirus
YRFVTSQAI

SEQ ID NO: 19022 - protein, 8 aa, Artificial Sequence
  Peptide Derived from Human Papillomavirus
YRVFRVRL

SEQ ID NO: 19023 - protein, 9 aa, Artificial Sequence
  Peptide Derived from Human Papillomavirus
ARLGLYSKA

SEQ ID NO: 19024 - protein, 9 aa, Artificial Sequence
  Peptide Derived from Human Papillomavirus
ARVHYYYDI

SEQ ID NO: 19025 - protein, 11 aa, Artificial Sequence
  Peptide Derived from Human Papillomavirus
CKAAGTCPSDV

SEQ ID NO: 19026 - protein, 8 aa, Artificial Sequence
  Peptide Derived from Human Papillomavirus
EHAPTQVF

SEQ ID NO: 19027 - protein, 10 aa, Artificial Sequence
  Peptide Derived from Human Papillomavirus
EHAPTQVFPF

SEQ ID NO: 19028 - protein, 9 aa, Artificial Sequence
  Peptide Derived from Human Papillomavirus
EHTTIADQI

SEQ ID NO: 19029 - protein, 10 aa, Artificial Sequence
  Peptide Derived from Human Papillomavirus
EHTTIADQIL

SEQ ID NO: 19030 - protein, 10 aa, Artificial Sequence
  Peptide Derived from Human Papillomavirus
GHLLLSSSSI

SEQ ID NO: 19031 - protein, 8 aa, Artificial Sequence
  Peptide Derived from Human Papillomavirus
GRTGYVPL

SEQ ID NO: 19032 - protein, 10 aa, Artificial Sequence
  Peptide Derived from Human Papillomavirus
IRPPVSIDPV

SEQ ID NO: 19033 - protein, 8 aa, Artificial Sequence
  Peptide Derived from Human Papillomavirus
KRASATQL

SEQ ID NO: 19034 - protein, 9 aa, Artificial Sequence
  Peptide Derived from Human Papillomavirus
KRASATQLY

SEQ ID NO: 19035 - protein, 9 aa, Artificial Sequence
  Peptide Derived from Human Papillomavirus
KRRRKRVSY

SEQ ID NO: 19036 - protein, 10 aa, Artificial Sequence
  Peptide Derived from Human Papillomavirus
KRRRKRVSYF

SEQ ID NO: 19037 - protein, 11 aa, Artificial Sequence
  Peptide Derived from Human Papillomavirus
KRRRKRVSYFF

SEQ ID NO: 19038 - protein, 10 aa, Artificial Sequence
  Peptide Derived from Human Papillomavirus
KRSTKRTKRA

SEQ ID NO: 19039 - protein, 8 aa, Artificial Sequence
  Peptide Derived from Human Papillomavirus
KRTKRASA

SEQ ID NO: 19040 - protein, 11 aa, Artificial Sequence
  Peptide Derived from Human Papillomavirus
KRTKRASATQL

SEQ ID NO: 19041 - protein, 10 aa, Artificial Sequence
  Peptide Derived from Human Papillomavirus
KRVSYFFTDV

SEQ ID NO: 19042 - protein, 8 aa, Artificial Sequence
  Peptide Derived from Human Papillomavirus
LHPSYYML

SEQ ID NO: 19043 - protein, 8 aa, Artificial Sequence
  Peptide Derived from Human Papillomavirus
LKRRRKRV

SEQ ID NO: 19044 - protein, 10 aa, Artificial Sequence
  Peptide Derived from Human Papillomavirus
LKRRRKRVSY

SEQ ID NO: 19045 - protein, 11 aa, Artificial Sequence
  Peptide Derived from Human Papillomavirus
LKRRRKRVSYF

SEQ ID NO: 19046 - protein, 9 aa, Artificial Sequence
  Peptide Derived from Human Papillomavirus
LRTRSGATI

SEQ ID NO: 19047 - protein, 11 aa, Artificial Sequence
  Peptide Derived from Human Papillomavirus
LRTRSGATIGA

SEQ ID NO: 19048 - protein, 8 aa, Artificial Sequence
  Peptide Derived from Human Papillomavirus
LRYGSMGV

SEQ ID NO: 19049 - protein, 9 aa, Artificial Sequence
  Peptide Derived from Human Papillomavirus
LRYGSMGVF

SEQ ID NO: 19050 - protein, 10 aa, Artificial Sequence
  Peptide Derived from Human Papillomavirus
LRYGSMGVFF

SEQ ID NO: 19051 - protein, 11 aa, Artificial Sequence
  Peptide Derived from Human Papillomavirus
NKQTLRTRSGA

SEQ ID NO: 19052 - protein, 9 aa, Artificial Sequence
  Peptide Derived from Human Papillomavirus
PHPPTTSGF

SEQ ID NO: 19053 - protein, 11 aa, Artificial Sequence
  Peptide Derived from Human Papillomavirus
PHPPTTSGFDI

SEQ ID NO: 19054 - protein, 8 aa, Artificial Sequence
  Peptide Derived from Human Papillomavirus
PKIEHTTI

SEQ ID NO: 19055 - protein, 9 aa, Artificial Sequence
  Peptide Derived from Human Papillomavirus
PKIEHTTIA

SEQ ID NO: 19056 - protein, 11 aa, Artificial Sequence
  Peptide Derived from Human Papillomavirus
PKQLITYENPA

SEQ ID NO: 19057 - protein, 8 aa, Artificial Sequence
  Peptide Derived from Human Papillomavirus
RKRVSYFF

SEQ ID NO: 19058 - protein, 11 aa, Artificial Sequence
  Peptide Derived from Human Papillomavirus
RKRVSYFFTDV

SEQ ID NO: 19059 - protein, 8 aa, Artificial Sequence
  Peptide Derived from Human Papillomavirus
RRKRVSYF

SEQ ID NO: 19060 - protein, 9 aa, Artificial Sequence
  Peptide Derived from Human Papillomavirus
RRKRVSYFF

SEQ ID NO: 19061 - protein, 10 aa, Artificial Sequence
  Peptide Derived from Human Papillomavirus
RRNTVRYSRL

SEQ ID NO: 19062 - protein, 8 aa, Artificial Sequence
  Peptide Derived from Human Papillomavirus
RRPARLGL

SEQ ID NO: 19063 - protein, 9 aa, Artificial Sequence
  Peptide Derived from Human Papillomavirus
RRPARLGLY

SEQ ID NO: 19064 - protein, 8 aa, Artificial Sequence
  Peptide Derived from Human Papillomavirus
RRRKRVSY

SEQ ID NO: 19065 - protein, 9 aa, Artificial Sequence
  Peptide Derived from Human Papillomavirus
RRRKRVSYF

SEQ ID NO: 19066 - protein, 10 aa, Artificial Sequence
  Peptide Derived from Human Papillomavirus
RRRKRVSYFF

SEQ ID NO: 19067 - protein, 10 aa, Artificial Sequence
  Peptide Derived from Human Papillomavirus
SHNIAPDPDF

SEQ ID NO: 19068 - protein, 11 aa, Artificial Sequence
  Peptide Derived from Human Papillomavirus
SHNIAPDPDFL

SEQ ID NO: 19069 - protein, 9 aa, Artificial Sequence
  Peptide Derived from Human Papillomavirus
SKATQQVKV

SEQ ID NO: 19070 - protein, 10 aa, Artificial Sequence
  Peptide Derived from Human Papillomavirus
SKATQQVKVI

SEQ ID NO: 19071 - protein, 11 aa, Artificial Sequence
  Peptide Derived from Human Papillomavirus
SKRSTKRTKRA

SEQ ID NO: 19072 - protein, 9 aa, Artificial Sequence
  Peptide Derived from Human Papillomavirus
SRLGNKQTL

SEQ ID NO: 19073 - protein, 8 aa, Artificial Sequence
  Peptide Derived from Human Papillomavirus
SRRNTVRY

SEQ ID NO: 19074 - protein, 11 aa, Artificial Sequence
  Peptide Derived from Human Papillomavirus
SRRNTVRYSRL

SEQ ID NO: 19075 - protein, 9 aa, Artificial Sequence
  Peptide Derived from Human Papillomavirus
THNVSPSTA

SEQ ID NO: 19076 - protein, 10 aa, Artificial Sequence
  Peptide Derived from Human Papillomavirus
THNVSPSTAV

SEQ ID NO: 19077 - protein, 9 aa, Artificial Sequence
  Peptide Derived from Human Papillomavirus
THNYEEIPM

SEQ ID NO: 19078 - protein, 9 aa, Artificial Sequence
  Peptide Derived from Human Papillomavirus
TKRASATQL

SEQ ID NO: 19079 - protein, 10 aa, Artificial Sequence
  Peptide Derived from Human Papillomavirus
TKRASATQLY

SEQ ID NO: 19080 - protein, 9 aa, Artificial Sequence
  Peptide Derived from Human Papillomavirus
TKRTKRASA

SEQ ID NO: 19081 - protein, 9 aa, Artificial Sequence
  Peptide Derived from Human Papillomavirus
TRPSTVSEA

SEQ ID NO: 19082 - protein, 11 aa, Artificial Sequence
  Peptide Derived from Human Papillomavirus
TRPSTVSEASI

SEQ ID NO: 19083 - protein, 9 aa, Artificial Sequence
  Peptide Derived from Human Papillomavirus
TRSGATIGA

SEQ ID NO: 19084 - protein, 11 aa, Artificial Sequence
  Peptide Derived from Human Papillomavirus
TRSGATIGARV

SEQ ID NO: 19085 - protein, 10 aa, Artificial Sequence
  Peptide Derived from Human Papillomavirus
VHYYYDISSI

SEQ ID NO: 19086 - protein, 8 aa, Artificial Sequence
  Peptide Derived from Human Papillomavirus
VKVIDPTF

SEQ ID NO: 19087 - protein, 9 aa, Artificial Sequence
  Peptide Derived from Human Papillomavirus
VKVIDPTFL

SEQ ID NO: 19088 - protein, 11 aa, Artificial Sequence
  Peptide Derived from Human Papillomavirus
VKVIDPTFLSA

SEQ ID NO: 19089 - protein, 9 aa, Artificial Sequence
  Peptide Derived from Human Papillomavirus
VRRPARLGL

SEQ ID NO: 19090 - protein, 10 aa, Artificial Sequence
  Peptide Derived from Human Papillomavirus
VRRPARLGLY

SEQ ID NO: 19091 - protein, 9 aa, Artificial Sequence
  Peptide Derived from Human Papillomavirus
AKIGMIDDV

SEQ ID NO: 19092 - protein, 9 aa, Artificial Sequence
  Peptide Derived from Human Papillomavirus
AKIVKDCGI

SEQ ID NO: 19093 - protein, 10 aa, Artificial Sequence
  Peptide Derived from Human Papillomavirus
AKIVKDCGIM

SEQ ID NO: 19094 - protein, 8 aa, Artificial Sequence
  Peptide Derived from Human Papillomavirus
AKLMSNLL

SEQ ID NO: 19095 - protein, 10 aa, Artificial Sequence
  Peptide Derived from Human Papillomavirus
AKLMSNLLSI

SEQ ID NO: 19096 - protein, 9 aa, Artificial Sequence
  Peptide Derived from Human Papillomavirus
DKENHGGNI

SEQ ID NO: 19097 - protein, 8 aa, Artificial Sequence
  Peptide Derived from Human Papillomavirus
DKTSCTDW

SEQ ID NO: 19098 - protein, 10 aa, Artificial Sequence
  Peptide Derived from Human Papillomavirus
DKTSCTDWCI

SEQ ID NO: 19099 - protein, 11 aa, Artificial Sequence
  Peptide Derived from Human Papillomavirus
DRAANPCRTSI

SEQ ID NO: 19100 - protein, 8 aa, Artificial Sequence
  Peptide Derived from Human Papillomavirus
DRGIIILL

SEQ ID NO: 19101 - protein, 9 aa, Artificial Sequence
  Peptide Derived from Human Papillomavirus
DRGIIILLL

SEQ ID NO: 19102 - protein, 10 aa, Artificial Sequence
  Peptide Derived from Human Papillomavirus
DRGIIILLLI

SEQ ID NO: 19103 - protein, 10 aa, Artificial Sequence
  Peptide Derived from Human Papillomavirus
DRLTVLQHSF

SEQ ID NO: 19104 - protein, 10 aa, Artificial Sequence
  Peptide Derived from Human Papillomavirus
EKRKMSIGQW

SEQ ID NO: 19105 - protein, 11 aa, Artificial Sequence
  Peptide Derived from Human Papillomavirus
EKRKMSIGQWI

SEQ ID NO: 19106 - protein, 9 aa, Artificial Sequence
  Peptide Derived from Human Papillomavirus
EKTNDGGNW

SEQ ID NO: 19107 - protein, 8 aa, Artificial Sequence
  Peptide Derived from Human Papillomavirus
ERRTGDNI

SEQ ID NO: 19108 - protein, 9 aa, Artificial Sequence
  Peptide Derived from Human Papillomavirus
FKEAYGISF

SEQ ID NO: 19109 - protein, 10 aa, Artificial Sequence
  Peptide Derived from Human Papillomavirus
FKEAYGISFM

SEQ ID NO: 19110 - protein, 8 aa, Artificial Sequence
  Peptide Derived from Human Papillomavirus
FKKFLKGI

SEQ ID NO: 19111 - protein, 11 aa, Artificial Sequence
  Peptide Derived from Human Papillomavirus
FKSDKTSCTDW

SEQ ID NO: 19112 - protein, 8 aa, Artificial Sequence
  Peptide Derived from Human Papillomavirus
FRCSKNRL

SEQ ID NO: 19113 - protein, 10 aa, Artificial Sequence
  Peptide Derived from Human Papillomavirus
FRCSKNRLTV

SEQ ID NO: 19114 - protein, 11 aa, Artificial Sequence
  Peptide Derived from Human Papillomavirus
FRCSKNRLTVA

SEQ ID NO: 19115 - protein, 8 aa, Artificial Sequence
  Peptide Derived from Human Papillomavirus
FRTAMSNI

SEQ ID NO: 19116 - protein, 11 aa, Artificial Sequence
  Peptide Derived from Human Papillomavirus
FRTAMSNISDV

SEQ ID NO: 19117 - protein, 9 aa, Artificial Sequence
  Peptide Derived from Human Papillomavirus
GKSYFGMSL

SEQ ID NO: 19118 - protein, 10 aa, Artificial Sequence
  Peptide Derived from Human Papillomavirus
GKSYFGMSLI

SEQ ID NO: 19119 - protein, 10 aa, Artificial Sequence
  Peptide Derived from Human Papillomavirus
IKQHSLYTHL

SEQ ID NO: 19120 - protein, 10 aa, Artificial Sequence
  Peptide Derived from Human Papillomavirus
IRFRCSKNRL

SEQ ID NO: 19121 - protein, 8 aa, Artificial Sequence
  Peptide Derived from Human Papillomavirus
KHRALVQL

SEQ ID NO: 19122 - protein, 8 aa, Artificial Sequence
  Peptide Derived from Human Papillomavirus
KKAEKRKM

SEQ ID NO: 19123 - protein, 10 aa, Artificial Sequence
  Peptide Derived from Human Papillomavirus
KKAEKRKMSI

SEQ ID NO: 19124 - protein, 11 aa, Artificial Sequence
  Peptide Derived from Human Papillomavirus
KKSCMLICGPA

SEQ ID NO: 19125 - protein, 11 aa, Artificial Sequence
  Peptide Derived from Human Papillomavirus
KRKFAACSQSA

SEQ ID NO: 19126 - protein, 9 aa, Artificial Sequence
  Peptide Derived from Human Papillomavirus
KRKMSIGQW

SEQ ID NO: 19127 - protein, 10 aa, Artificial Sequence
  Peptide Derived from Human Papillomavirus
KRKMSIGQWI

SEQ ID NO: 19128 - protein, 8 aa, Artificial Sequence
  Peptide Derived from Human Papillomavirus
LHSRLTVF

SEQ ID NO: 19129 - protein, 10 aa, Artificial Sequence
  Peptide Derived from Human Papillomavirus
LHSRLTVFEF

SEQ ID NO: 19130 - protein, 8 aa, Artificial Sequence
  Peptide Derived from Human Papillomavirus
LHSSNTKA

SEQ ID NO: 19131 - protein, 10 aa, Artificial Sequence
  Peptide Derived from Human Papillomavirus
LHSSNTKANI

SEQ ID NO: 19132 - protein, 11 aa, Artificial Sequence
  Peptide Derived from Human Papillomavirus
LHSSNTKANIL

SEQ ID NO: 19133 - protein, 8 aa, Artificial Sequence
  Peptide Derived from Human Papillomavirus
LKCPPLLL

SEQ ID NO: 19134 - protein, 9 aa, Artificial Sequence
  Peptide Derived from Human Papillomavirus
LKGCVISCV

SEQ ID NO: 19135 - protein, 10 aa, Artificial Sequence
  Peptide Derived from Human Papillomavirus
LKGIPKKSCM

SEQ ID NO: 19136 - protein, 11 aa, Artificial Sequence
  Peptide Derived from Human Papillomavirus
LKGIPKKSCML

SEQ ID NO: 19137 - protein, 9 aa, Artificial Sequence
  Peptide Derived from Human Papillomavirus
LKSNSQAKI

SEQ ID NO: 19138 - protein, 10 aa, Artificial Sequence
  Peptide Derived from Human Papillomavirus
LKSNSQAKIV

SEQ ID NO: 19139 - protein, 10 aa, Artificial Sequence
  Peptide Derived from Human Papillomavirus
LKVLIKQHSL

SEQ ID NO: 19140 - protein, 11 aa, Artificial Sequence
  Peptide Derived from Human Papillomavirus
LKVLIKQHSLY

SEQ ID NO: 19141 - protein, 8 aa, Artificial Sequence
  Peptide Derived from Human Papillomavirus
LRSQTCAL

SEQ ID NO: 19142 - protein, 9 aa, Artificial Sequence
  Peptide Derived from Human Papillomavirus
LRSQTCALY

SEQ ID NO: 19143 - protein, 10 aa, Artificial Sequence
  Peptide Derived from Human Papillomavirus
LRSQTCALYW

SEQ ID NO: 19144 - protein, 11 aa, Artificial Sequence
  Peptide Derived from Human Papillomavirus
LRSQTCALYWF

SEQ ID NO: 19145 - protein, 8 aa, Artificial Sequence
  Peptide Derived from Human Papillomavirus
LRYQNIEF

SEQ ID NO: 19146 - protein, 10 aa, Artificial Sequence
  Peptide Derived from Human Papillomavirus
LRYQNIEFTA

SEQ ID NO: 19147 - protein, 11 aa, Artificial Sequence
  Peptide Derived from Human Papillomavirus
LRYQNIEFTAF

SEQ ID NO: 19148 - protein, 10 aa, Artificial Sequence
  Peptide Derived from Human Papillomavirus
MRNALDGNEI

SEQ ID NO: 19149 - protein, 9 aa, Artificial Sequence
  Peptide Derived from Human Papillomavirus
NHGGNISTF

SEQ ID NO: 19150 - protein, 11 aa, Artificial Sequence
  Peptide Derived from Human Papillomavirus
NKECTYRKRKI

SEQ ID NO: 19151 - protein, 8 aa, Artificial Sequence
  Peptide Derived from Human Papillomavirus
NKNKECTY

SEQ ID NO: 19152 - protein, 8 aa, Artificial Sequence
  Peptide Derived from Human Papillomavirus
NRLTVAKL

SEQ ID NO: 19153 - protein, 9 aa, Artificial Sequence
  Peptide Derived from Human Papillomavirus
NRLTVAKLM

SEQ ID NO: 19154 - protein, 8 aa, Artificial Sequence
  Peptide Derived from Human Papillomavirus
PKKSCMLI

SEQ ID NO: 19155 - protein, 9 aa, Artificial Sequence
  Peptide Derived from Human Papillomavirus
PKLRSQTCA

SEQ ID NO: 19156 - protein, 10 aa, Artificial Sequence
  Peptide Derived from Human Papillomavirus
PKLRSQTCAL

SEQ ID NO: 19157 - protein, 11 aa, Artificial Sequence
  Peptide Derived from Human Papillomavirus
PKLRSQTCALY

SEQ ID NO: 19158 - protein, 8 aa, Artificial Sequence
  Peptide Derived from Human Papillomavirus
QHSFNDNI

SEQ ID NO: 19159 - protein, 9 aa, Artificial Sequence
  Peptide Derived from Human Papillomavirus
QHSFNDNIF

SEQ ID NO: 19160 - protein, 11 aa, Artificial Sequence
  Peptide Derived from Human Papillomavirus
QHSFNDNIFDL

SEQ ID NO: 19161 - protein, 8 aa, Artificial Sequence
  Peptide Derived from Human Papillomavirus
QHSLYTHL

SEQ ID NO: 19162 - protein, 11 aa, Artificial Sequence
  Peptide Derived from Human Papillomavirus
QHSLYTHLQCL

SEQ ID NO: 19163 - protein, 11 aa, Artificial Sequence
  Peptide Derived from Human Papillomavirus
RHYKKAEKRKM

SEQ ID NO: 19164 - protein, 10 aa, Artificial Sequence
  Peptide Derived from Human Papillomavirus
RKFAACSQSA

SEQ ID NO: 19165 - protein, 11 aa, Artificial Sequence
  Peptide Derived from Human Papillomavirus
RKFAACSQSAA

SEQ ID NO: 19166 - protein, 11 aa, Artificial Sequence
  Peptide Derived from Human Papillomavirus
RKIDELEDSGY

SEQ ID NO: 19167 - protein, 8 aa, Artificial Sequence
  Peptide Derived from Human Papillomavirus
RKMSIGQW

SEQ ID NO: 19168 - protein, 9 aa, Artificial Sequence
  Peptide Derived from Human Papillomavirus
RKMSIGQWI

SEQ ID NO: 19169 - protein, 8 aa, Artificial Sequence
  Peptide Derived from Human Papillomavirus
RKRKIDEL

SEQ ID NO: 19170 - protein, 8 aa, Artificial Sequence
  Peptide Derived from Human Papillomavirus
SHFWLQPL

SEQ ID NO: 19171 - protein, 11 aa, Artificial Sequence
  Peptide Derived from Human Papillomavirus
SHFWLQPLSDA

SEQ ID NO: 19172 - protein, 8 aa, Artificial Sequence
  Peptide Derived from Human Papillomavirus
SKNRLTVA

SEQ ID NO: 19173 - protein, 10 aa, Artificial Sequence
  Peptide Derived from Human Papillomavirus
SKNRLTVAKL

SEQ ID NO: 19174 - protein, 11 aa, Artificial Sequence
  Peptide Derived from Human Papillomavirus
SKNRLTVAKLM

SEQ ID NO: 19175 - protein, 10 aa, Artificial Sequence
  Peptide Derived from Human Papillomavirus
SKSHFWLQPL

SEQ ID NO: 19176 - protein, 8 aa, Artificial Sequence
  Peptide Derived from Human Papillomavirus
SRLTVFEF

SEQ ID NO: 19177 - protein, 9 aa, Artificial Sequence
  Peptide Derived from Human Papillomavirus
SRTWCKLDL

SEQ ID NO: 19178 - protein, 10 aa, Artificial Sequence
  Peptide Derived from Human Papillomavirus
SRTWCKLDLI

SEQ ID NO: 19179 - protein, 10 aa, Artificial Sequence
  Peptide Derived from Human Papillomavirus
SRWPYLHSRL

SEQ ID NO: 19180 - protein, 9 aa, Artificial Sequence
  Peptide Derived from Human Papillomavirus
TKANILYKF

SEQ ID NO: 19181 - protein, 11 aa, Artificial Sequence
  Peptide Derived from Human Papillomavirus
VKDCGIMCRHY

SEQ ID NO: 19182 - protein, 9 aa, Artificial Sequence
  Peptide Derived from Human Papillomavirus
VKHRALVQL

SEQ ID NO: 19183 - protein, 9 aa, Artificial Sequence
  Peptide Derived from Human Papillomavirus
WKSFFSRTW

SEQ ID NO: 19184 - protein, 8 aa, Artificial Sequence
  Peptide Derived from Human Papillomavirus
WRPIVQLL

SEQ ID NO: 19185 - protein, 10 aa, Artificial Sequence
  Peptide Derived from Human Papillomavirus
WRPIVQLLRY

SEQ ID NO: 19186 - protein, 9 aa, Artificial Sequence
  Peptide Derived from Human Papillomavirus
YKFKEAYGI

SEQ ID NO: 19187 - protein, 11 aa, Artificial Sequence
  Peptide Derived from Human Papillomavirus
YKFKEAYGISF

SEQ ID NO: 19188 - protein, 9 aa, Artificial Sequence
  Peptide Derived from Human Papillomavirus
YKKAEKRKM

SEQ ID NO: 19189 - protein, 11 aa, Artificial Sequence
  Peptide Derived from Human Papillomavirus
YKKAEKRKMSI

SEQ ID NO: 19190 - protein, 9 aa, Artificial Sequence
  Peptide Derived from Human Papillomavirus
YRKRKIDEL

SEQ ID NO: 19191 - protein, 9 aa, Artificial Sequence
  Peptide Derived from Human Papillomavirus
AKQMGFSHL

SEQ ID NO: 19192 - protein, 8 aa, Artificial Sequence
  Peptide Derived from Human Papillomavirus
AKYSKTQM

SEQ ID NO: 19193 - protein, 9 aa, Artificial Sequence
  Peptide Derived from Human Papillomavirus
AKYSKTQMW

SEQ ID NO: 19194 - protein, 11 aa, Artificial Sequence
  Peptide Derived from Human Papillomavirus
AKYSKTQMWEV

SEQ ID NO: 19195 - protein, 10 aa, Artificial Sequence
  Peptide Derived from Human Papillomavirus
ARLNAVQEKI

SEQ ID NO: 19196 - protein, 11 aa, Artificial Sequence
  Peptide Derived from Human Papillomavirus
ARLNAVQEKIL

SEQ ID NO: 19197 - protein, 8 aa, Artificial Sequence
  Peptide Derived from Human Papillomavirus
CHQVVPSL

SEQ ID NO: 19198 - protein, 9 aa, Artificial Sequence
  Peptide Derived from Human Papillomavirus
CHQVVPSLL

SEQ ID NO: 19199 - protein, 10 aa, Artificial Sequence
  Peptide Derived from Human Papillomavirus
CHQVVPSLLA

SEQ ID NO: 19200 - protein, 8 aa, Artificial Sequence
  Peptide Derived from Human Papillomavirus
DKKNTMDY

SEQ ID NO: 19201 - protein, 11 aa, Artificial Sequence
  Peptide Derived from Human Papillomavirus
DKKNTMDYTNW

SEQ ID NO: 19202 - protein, 9 aa, Artificial Sequence
  Peptide Derived from Human Papillomavirus
DKTDLPSQI

SEQ ID NO: 19203 - protein, 8 aa, Artificial Sequence
  Peptide Derived from Human Papillomavirus
EHWKLIRM

SEQ ID NO: 19204 - protein, 11 aa, Artificial Sequence
  Peptide Derived from Human Papillomavirus
EHWKLIRMECA

SEQ ID NO: 19205 - protein, 9 aa, Artificial Sequence
  Peptide Derived from Human Papillomavirus
EKILDLYEA

SEQ ID NO: 19206 - protein, 8 aa, Artificial Sequence
  Peptide Derived from Human Papillomavirus
EKVYFKYF

SEQ ID NO: 19207 - protein, 8 aa, Artificial Sequence
  Peptide Derived from Human Papillomavirus
FKEDAAKY

SEQ ID NO: 19208 - protein, 8 aa, Artificial Sequence
  Peptide Derived from Human Papillomavirus
FKKQGETV

SEQ ID NO: 19209 - protein, 10 aa, Artificial Sequence
  Peptide Derived from Human Papillomavirus
FKKQGETVTV

SEQ ID NO: 19210 - protein, 8 aa, Artificial Sequence
  Peptide Derived from Human Papillomavirus
FKYFKEDA

SEQ ID NO: 19211 - protein, 9 aa, Artificial Sequence
  Peptide Derived from Human Papillomavirus
FKYFKEDAA

SEQ ID NO: 19212 - protein, 11 aa, Artificial Sequence
  Peptide Derived from Human Papillomavirus
FKYFKEDAAKY

SEQ ID NO: 19213 - protein, 8 aa, Artificial Sequence
  Peptide Derived from Human Papillomavirus
GKVDYIGM

SEQ ID NO: 19214 - protein, 9 aa, Artificial Sequence
  Peptide Derived from Human Papillomavirus
GKVDYIGMY

SEQ ID NO: 19215 - protein, 10 aa, Artificial Sequence
  Peptide Derived from Human Papillomavirus
GKVDYIGMYY

SEQ ID NO: 19216 - protein, 11 aa, Artificial Sequence
  Peptide Derived from Human Papillomavirus
GKVDYIGMYYI

SEQ ID NO: 19217 - protein, 8 aa, Artificial Sequence
  Peptide Derived from Human Papillomavirus
IHNCEKVY

SEQ ID NO: 19218 - protein, 9 aa, Artificial Sequence
  Peptide Derived from Human Papillomavirus
IHNCEKVYF

SEQ ID NO: 19219 - protein, 11 aa, Artificial Sequence
  Peptide Derived from Human Papillomavirus
IHNCEKVYFKY

SEQ ID NO: 19220 - protein, 8 aa, Artificial Sequence
  Peptide Derived from Human Papillomavirus
IRMECALL

SEQ ID NO: 19221 - protein, 9 aa, Artificial Sequence
  Peptide Derived from Human Papillomavirus
IRMECALLY

SEQ ID NO: 19222 - protein, 11 aa, Artificial Sequence
  Peptide Derived from Human Papillomavirus
IRMECALLYTA

SEQ ID NO: 19223 - protein, 10 aa, Artificial Sequence
  Peptide Derived from Human Papillomavirus
KKNTMDYTNW

SEQ ID NO: 19224 - protein, 9 aa, Artificial Sequence
  Peptide Derived from Human Papillomavirus
KKQGETVTV

SEQ ID NO: 19225 - protein, 11 aa, Artificial Sequence
  Peptide Derived from Human Papillomavirus
KKQGETVTVQY

SEQ ID NO: 19226 - protein, 8 aa, Artificial Sequence
  Peptide Derived from Human Papillomavirus
LKCLRYRL

SEQ ID NO: 19227 - protein, 11 aa, Artificial Sequence
  Peptide Derived from Human Papillomavirus
LKCLRYRLKPY

SEQ ID NO: 19228 - protein, 8 aa, Artificial Sequence
  Peptide Derived from Human Papillomavirus
LKGESNSL

SEQ ID NO: 19229 - protein, 11 aa, Artificial Sequence
  Peptide Derived from Human Papillomavirus
LKGESNSLKCL

SEQ ID NO: 19230 - protein, 8 aa, Artificial Sequence
  Peptide Derived from Human Papillomavirus
LKPYKELY

SEQ ID NO: 19231 - protein, 11 aa, Artificial Sequence
  Peptide Derived from Human Papillomavirus
LKPYKELYSSM

SEQ ID NO: 19232 - protein, 8 aa, Artificial Sequence
  Peptide Derived from Human Papillomavirus
LRYRLKPY

SEQ ID NO: 19233 - protein, 11 aa, Artificial Sequence
  Peptide Derived from Human Papillomavirus
LRYRLKPYKEL

SEQ ID NO: 19234 - protein, 8 aa, Artificial Sequence
  Peptide Derived from Human Papillomavirus
NKNSKNGI

SEQ ID NO: 19235 - protein, 9 aa, Artificial Sequence
  Peptide Derived from Human Papillomavirus
NKNSKNGIV

SEQ ID NO: 19236 - protein, 11 aa, Artificial Sequence
  Peptide Derived from Human Papillomavirus
NKNSKNGIVTV

SEQ ID NO: 19237 - protein, 11 aa, Artificial Sequence
  Peptide Derived from Human Papillomavirus
NKQRTVCSSNV

SEQ ID NO: 19238 - protein, 8 aa, Artificial Sequence
  Peptide Derived from Human Papillomavirus
NRPPQAAA

SEQ ID NO: 19239 - protein, 11 aa, Artificial Sequence
  Peptide Derived from Human Papillomavirus
PKCFKKQGETV

SEQ ID NO: 19240 - protein, 9 aa, Artificial Sequence
  Peptide Derived from Human Papillomavirus
QRTVCSSNV

SEQ ID NO: 19241 - protein, 10 aa, Artificial Sequence
  Peptide Derived from Human Papillomavirus
QRTVCSSNVA

SEQ ID NO: 19242 - protein, 10 aa, Artificial Sequence
  Peptide Derived from Human Papillomavirus
RRPADTTDTA

SEQ ID NO: 19243 - protein, 11 aa, Artificial Sequence
  Peptide Derived from Human Papillomavirus
RRRPADTTDTA

SEQ ID NO: 19244 - protein, 8 aa, Artificial Sequence
  Peptide Derived from Human Papillomavirus
SHLCHQVV

SEQ ID NO: 19245 - protein, 11 aa, Artificial Sequence
  Peptide Derived from Human Papillomavirus
SHLCHQVVPSL

SEQ ID NO: 19246 - protein, 8 aa, Artificial Sequence
  Peptide Derived from Human Papillomavirus
SKNGIVTV

SEQ ID NO: 19247 - protein, 10 aa, Artificial Sequence
  Peptide Derived from Human Papillomavirus
SKNGIVTVTF

SEQ ID NO: 19248 - protein, 11 aa, Artificial Sequence
  Peptide Derived from Human Papillomavirus
SKNGIVTVTFV

SEQ ID NO: 19249 - protein, 10 aa, Artificial Sequence
  Peptide Derived from Human Papillomavirus
SKSQYSTSQW

SEQ ID NO: 19250 - protein, 8 aa, Artificial Sequence
  Peptide Derived from Human Papillomavirus
SKTKAFQV

SEQ ID NO: 19251 - protein, 9 aa, Artificial Sequence
  Peptide Derived from Human Papillomavirus
SKTKAFQVI

SEQ ID NO: 19252 - protein, 11 aa, Artificial Sequence
  Peptide Derived from Human Papillomavirus
SKTKAFQVIEL

SEQ ID NO: 19253 - protein, 8 aa, Artificial Sequence
  Peptide Derived from Human Papillomavirus
SKTQMWEV

SEQ ID NO: 19254 - protein, 10 aa, Artificial Sequence
  Peptide Derived from Human Papillomavirus
SKTQMWEVHV

SEQ ID NO: 19255 - protein, 9 aa, Artificial Sequence
  Peptide Derived from Human Papillomavirus
TKAFQVIEL

SEQ ID NO: 19256 - protein, 11 aa, Artificial Sequence
  Peptide Derived from Human Papillomavirus
TKAFQVIELQM

SEQ ID NO: 19257 - protein, 9 aa, Artificial Sequence
  Peptide Derived from Human Papillomavirus
TKLFCADPA

SEQ ID NO: 19258 - protein, 10 aa, Artificial Sequence
  Peptide Derived from Human Papillomavirus
TKLFCADPAL

SEQ ID NO: 19259 - protein, 10 aa, Artificial Sequence
  Peptide Derived from Human Papillomavirus
VHLKGESNSL

SEQ ID NO: 19260 - protein, 8 aa, Artificial Sequence
  Peptide Derived from Human Papillomavirus
VHVGGQVI

SEQ ID NO: 19261 - protein, 9 aa, Artificial Sequence
  Peptide Derived from Human Papillomavirus
VHVGGQVIV

SEQ ID NO: 19262 - protein, 9 aa, Artificial Sequence
  Peptide Derived from Human Papillomavirus
VKIPPTVQI

SEQ ID NO: 19263 - protein, 9 aa, Artificial Sequence
  Peptide Derived from Human Papillomavirus
WKLIRMECA

SEQ ID NO: 19264 - protein, 10 aa, Artificial Sequence
  Peptide Derived from Human Papillomavirus
WKLIRMECAL

SEQ ID NO: 19265 - protein, 11 aa, Artificial Sequence
  Peptide Derived from Human Papillomavirus
WKLIRMECALL

SEQ ID NO: 19266 - protein, 8 aa, Artificial Sequence
  Peptide Derived from Human Papillomavirus
YKELYSSM

SEQ ID NO: 19267 - protein, 9 aa, Artificial Sequence
  Peptide Derived from Human Papillomavirus
YRLKPYKEL

SEQ ID NO: 19268 - protein, 10 aa, Artificial Sequence
  Peptide Derived from Human Papillomavirus
YRLKPYKELY

SEQ ID NO: 19269 - protein, 8 aa, Artificial Sequence
  Peptide Derived from Human Papillomavirus
LKIFFCYL

SEQ ID NO: 19270 - protein, 9 aa, Artificial Sequence
  Peptide Derived from Human Papillomavirus
LKIFFCYLL

SEQ ID NO: 19271 - protein, 10 aa, Artificial Sequence
  Peptide Derived from Human Papillomavirus
LKIFFCYLLF

SEQ ID NO: 19272 - protein, 11 aa, Artificial Sequence
  Peptide Derived from Human Papillomavirus
LKIFFCYLLFL

SEQ ID NO: 19273 - protein, 8 aa, Artificial Sequence
  Peptide Derived from Human Papillomavirus
LRPLILSI

SEQ ID NO: 19274 - protein, 11 aa, Artificial Sequence
  Peptide Derived from Human Papillomavirus
LRPLILSISTY

SEQ ID NO: 19275 - protein, 10 aa, Artificial Sequence
  Peptide Derived from Human Papillomavirus
CKKPLQRSEV

SEQ ID NO: 19276 - protein, 11 aa, Artificial Sequence
  Peptide Derived from Human Papillomavirus
CKKPLQRSEVY

SEQ ID NO: 19277 - protein, 8 aa, Artificial Sequence
  Peptide Derived from Human Papillomavirus
CKLCLRFL

SEQ ID NO: 19278 - protein, 11 aa, Artificial Sequence
  Peptide Derived from Human Papillomavirus
CKLCLRFLSKI

SEQ ID NO: 19279 - protein, 8 aa, Artificial Sequence
  Peptide Derived from Human Papillomavirus
EKKRHVDL

SEQ ID NO: 19280 - protein, 9 aa, Artificial Sequence
  Peptide Derived from Human Papillomavirus
EKPRTLHDL

SEQ ID NO: 19281 - protein, 8 aa, Artificial Sequence
  Peptide Derived from Human Papillomavirus
FHNISGRW

SEQ ID NO: 19282 - protein, 9 aa, Artificial Sequence
  Peptide Derived from Human Papillomavirus
FHNISGRWA

SEQ ID NO: 19283 - protein, 8 aa, Artificial Sequence
  Peptide Derived from Human Papillomavirus
GRWAGRCA

SEQ ID NO: 19284 - protein, 9 aa, Artificial Sequence
  Peptide Derived from Human Papillomavirus
GRWAGRCAA

SEQ ID NO: 19285 - protein, 11 aa, Artificial Sequence
  Peptide Derived from Human Papillomavirus
GRWAGRCAACW

SEQ ID NO: 19286 - protein, 9 aa, Artificial Sequence
  Peptide Derived from Human Papillomavirus
IHNIELQCV

SEQ ID NO: 19287 - protein, 10 aa, Artificial Sequence
  Peptide Derived from Human Papillomavirus
IRCIICQRPL

SEQ ID NO: 19288 - protein, 8 aa, Artificial Sequence
  Peptide Derived from Human Papillomavirus
KKPLNEIL

SEQ ID NO: 19289 - protein, 9 aa, Artificial Sequence
  Peptide Derived from Human Papillomavirus
KKPLNEILI

SEQ ID NO: 19290 - protein, 9 aa, Artificial Sequence
  Peptide Derived from Human Papillomavirus
KKPLQRSEV

SEQ ID NO: 19291 - protein, 10 aa, Artificial Sequence
  Peptide Derived from Human Papillomavirus
KKPLQRSEVY

SEQ ID NO: 19292 - protein, 11 aa, Artificial Sequence
  Peptide Derived from Human Papillomavirus
KKRHVDLNKRF

SEQ ID NO: 19293 - protein, 10 aa, Artificial Sequence
  Peptide Derived from Human Papillomavirus
KRFHNISGRW

SEQ ID NO: 19294 - protein, 11 aa, Artificial Sequence
  Peptide Derived from Human Papillomavirus
KRFHNISGRWA

SEQ ID NO: 19295 - protein, 10 aa, Artificial Sequence
  Peptide Derived from Human Papillomavirus
KRHVDLNKRF

SEQ ID NO: 19296 - protein, 8 aa, Artificial Sequence
  Peptide Derived from Human Papillomavirus
LHDLCQAL

SEQ ID NO: 19297 - protein, 10 aa, Artificial Sequence
  Peptide Derived from Human Papillomavirus
LRFLSKISEY

SEQ ID NO: 19298 - protein, 11 aa, Artificial Sequence
  Peptide Derived from Human Papillomavirus
NKRFHNISGRW

SEQ ID NO: 19299 - protein, 10 aa, Artificial Sequence
  Peptide Derived from Human Papillomavirus
PRTLHDLCQA

SEQ ID NO: 19300 - protein, 11 aa, Artificial Sequence
  Peptide Derived from Human Papillomavirus
PRTLHDLCQAL

SEQ ID NO: 19301 - protein, 8 aa, Artificial Sequence
  Peptide Derived from Human Papillomavirus
QRSEVYDF

SEQ ID NO: 19302 - protein, 9 aa, Artificial Sequence
  Peptide Derived from Human Papillomavirus
QRSEVYDFA

SEQ ID NO: 19303 - protein, 10 aa, Artificial Sequence
  Peptide Derived from Human Papillomavirus
QRSEVYDFAF

SEQ ID NO: 19304 - protein, 11 aa, Artificial Sequence
  Peptide Derived from Human Papillomavirus
QRSEVYDFAFA

SEQ ID NO: 19305 - protein, 9 aa, Artificial Sequence
  Peptide Derived from Human Papillomavirus
RHVDLNKRF

SEQ ID NO: 19306 - protein, 8 aa, Artificial Sequence
  Peptide Derived from Human Papillomavirus
RHYNYSVY

SEQ ID NO: 19307 - protein, 9 aa, Artificial Sequence
  Peptide Derived from Human Papillomavirus
SKISEYRHY

SEQ ID NO: 19308 - protein, 11 aa, Artificial Sequence
  Peptide Derived from Human Papillomavirus
SKISEYRHYNY

SEQ ID NO: 19309 - protein, 8 aa, Artificial Sequence
  Peptide Derived from Human Papillomavirus
SRRRETAL

SEQ ID NO: 19310 - protein, 8 aa, Artificial Sequence
  Peptide Derived from Human Papillomavirus
VKKPLNEI

SEQ ID NO: 19311 - protein, 9 aa, Artificial Sequence
  Peptide Derived from Human Papillomavirus
VKKPLNEIL

SEQ ID NO: 19312 - protein, 10 aa, Artificial Sequence
  Peptide Derived from Human Papillomavirus
VKKPLNEILI

SEQ ID NO: 19313 - protein, 9 aa, Artificial Sequence
  Peptide Derived from Human Papillomavirus
WRSRRRETA

SEQ ID NO: 19314 - protein, 10 aa, Artificial Sequence
  Peptide Derived from Human Papillomavirus
WRSRRRETAL

SEQ ID NO: 19315 - protein, 9 aa, Artificial Sequence
  Peptide Derived from Human Papillomavirus
YREGNPFGI

SEQ ID NO: 19316 - protein, 8 aa, Artificial Sequence
  Peptide Derived from Human Papillomavirus
YRHYNYSV

SEQ ID NO: 19317 - protein, 9 aa, Artificial Sequence
  Peptide Derived from Human Papillomavirus
YRHYNYSVY

SEQ ID NO: 19318 - protein, 8 aa, Artificial Sequence
  Peptide Derived from Human Papillomavirus
CHTCNTTV

SEQ ID NO: 19319 - protein, 10 aa, Artificial Sequence
  Peptide Derived from Human Papillomavirus
CHTCNTTVRL

SEQ ID NO: 19320 - protein, 10 aa, Artificial Sequence
  Peptide Derived from Human Papillomavirus
DRPDGQAQPA

SEQ ID NO: 19321 - protein, 9 aa, Artificial Sequence
  Peptide Derived from Human Papillomavirus
GHKPTLKEY

SEQ ID NO: 19322 - protein, 10 aa, Artificial Sequence
  Peptide Derived from Human Papillomavirus
GHKPTLKEYV

SEQ ID NO: 19323 - protein, 11 aa, Artificial Sequence
  Peptide Derived from Human Papillomavirus
GHKPTLKEYVL

SEQ ID NO: 19324 - protein, 8 aa, Artificial Sequence
  Peptide Derived from Human Papillomavirus
HKPTLKEY

SEQ ID NO: 19325 - protein, 9 aa, Artificial Sequence
  Peptide Derived from Human Papillomavirus
HKPTLKEYV

SEQ ID NO: 19326 - protein, 10 aa, Artificial Sequence
  Peptide Derived from Human Papillomavirus
HKPTLKEYVL

SEQ ID NO: 19327 - protein, 8 aa, Artificial Sequence
  Peptide Derived from Human Papillomavirus
LKEYVLDL

SEQ ID NO: 19328 - protein, 9 aa, Artificial Sequence
  Peptide Derived from Human Papillomavirus
LKEYVLDLY

SEQ ID NO: 19329 - protein, 8 aa, Artificial Sequence
  Peptide Derived from Human Papillomavirus
LRTIQQLL

SEQ ID NO: 19330 - protein, 9 aa, Artificial Sequence
  Peptide Derived from Human Papillomavirus
LRTIQQLLM

SEQ ID NO: 19331 - protein, 8 aa, Artificial Sequence
  Peptide Derived from Human Papillomavirus
MRGHKPTL

SEQ ID NO: 19332 - protein, 11 aa, Artificial Sequence
  Peptide Derived from Human Papillomavirus
MRGHKPTLKEY

SEQ ID NO: 19333 - protein, 9 aa, Artificial Sequence
  Peptide Derived from Human Papillomavirus
VRLCVNSTA

SEQ ID NO: 19334 - protein, 9 aa, Artificial Sequence
  Peptide Derived from Human Papillomavirus
AKKLLVPKV

SEQ ID NO: 19335 - protein, 8 aa, Artificial Sequence
  Peptide Derived from Human Papillomavirus
AKPKLKRA

SEQ ID NO: 19336 - protein, 9 aa, Artificial Sequence
  Peptide Derived from Human Papillomavirus
AKPKLKRAA

SEQ ID NO: 19337 - protein, 9 aa, Artificial Sequence
  Peptide Derived from Human Papillomavirus
CKPPTGEHW

SEQ ID NO: 19338 - protein, 9 aa, Artificial Sequence
  Peptide Derived from Human Papillomavirus
CKVTLTAEV

SEQ ID NO: 19339 - protein, 10 aa, Artificial Sequence
  Peptide Derived from Human Papillomavirus
CKVTLTAEVM

SEQ ID NO: 19340 - protein, 9 aa, Artificial Sequence
  Peptide Derived from Human Papillomavirus
CKYPDYLKM

SEQ ID NO: 19341 - protein, 8 aa, Artificial Sequence
  Peptide Derived from Human Papillomavirus
EHWGKGVA

SEQ ID NO: 19342 - protein, 9 aa, Artificial Sequence
  Peptide Derived from Human Papillomavirus
EKEDPLGKY

SEQ ID NO: 19343 - protein, 11 aa, Artificial Sequence
  Peptide Derived from Human Papillomavirus
EKEDPLGKYTF

SEQ ID NO: 19344 - protein, 10 aa, Artificial Sequence
  Peptide Derived from Human Papillomavirus
EKFSADLDQF

SEQ ID NO: 19345 - protein, 8 aa, Artificial Sequence
  Peptide Derived from Human Papillomavirus
FKEYIRHV

SEQ ID NO: 19346 - protein, 11 aa, Artificial Sequence
  Peptide Derived from Human Papillomavirus
FKEYIRHVEEY

SEQ ID NO: 19347 - protein, 11 aa, Artificial Sequence
  Peptide Derived from Human Papillomavirus
FKTLQANKSDV

SEQ ID NO: 19348 - protein, 11 aa, Artificial Sequence
  Peptide Derived from Human Papillomavirus
FRVRLPDPNKF

SEQ ID NO: 19349 - protein, 8 aa, Artificial Sequence
  Peptide Derived from Human Papillomavirus
GHNNGICW

SEQ ID NO: 19350 - protein, 8 aa, Artificial Sequence
  Peptide Derived from Human Papillomavirus
GHPLLNKF

SEQ ID NO: 19351 - protein, 9 aa, Artificial Sequence
  Peptide Derived from Human Papillomavirus
GKGVACTNA

SEQ ID NO: 19352 - protein, 10 aa, Artificial Sequence
  Peptide Derived from Human Papillomavirus
GKGVACTNAA

SEQ ID NO: 19353 - protein, 8 aa, Artificial Sequence
  Peptide Derived from Human Papillomavirus
GKYTFWEV

SEQ ID NO: 19354 - protein, 10 aa, Artificial Sequence
  Peptide Derived from Human Papillomavirus
GKYTFWEVDL

SEQ ID NO: 19355 - protein, 8 aa, Artificial Sequence
  Peptide Derived from Human Papillomavirus
GRGQPLGV

SEQ ID NO: 19356 - protein, 10 aa, Artificial Sequence
  Peptide Derived from Human Papillomavirus
GRGQPLGVGI

SEQ ID NO: 19357 - protein, 8 aa, Artificial Sequence
  Peptide Derived from Human Papillomavirus
GRKFLLQA

SEQ ID NO: 19358 - protein, 10 aa, Artificial Sequence
  Peptide Derived from Human Papillomavirus
GRKFLLQAGL

SEQ ID NO: 19359 - protein, 8 aa, Artificial Sequence
  Peptide Derived from Human Papillomavirus
IHAMNPDI

SEQ ID NO: 19360 - protein, 9 aa, Artificial Sequence
  Peptide Derived from Human Papillomavirus
IHAMNPDIL

SEQ ID NO: 19361 - protein, 8 aa, Artificial Sequence
  Peptide Derived from Human Papillomavirus
IKGSGTTA

SEQ ID NO: 19362 - protein, 10 aa, Artificial Sequence
  Peptide Derived from Human Papillomavirus
IKGSGTTASI

SEQ ID NO: 19363 - protein, 10 aa, Artificial Sequence
  Peptide Derived from Human Papillomavirus
IKNPTNAKKL

SEQ ID NO: 19364 - protein, 11 aa, Artificial Sequence
  Peptide Derived from Human Papillomavirus
IKNPTNAKKLL

SEQ ID NO: 19365 - protein, 9 aa, Artificial Sequence
  Peptide Derived from Human Papillomavirus
IRHVEEYDL

SEQ ID NO: 19366 - protein, 11 aa, Artificial Sequence
  Peptide Derived from Human Papillomavirus
IRHVEEYDLQF

SEQ ID NO: 19367 - protein, 8 aa, Artificial Sequence
  Peptide Derived from Human Papillomavirus
KKLLVPKV

SEQ ID NO: 19368 - protein, 11 aa, Artificial Sequence
  Peptide Derived from Human Papillomavirus
KKLLVPKVSGL

SEQ ID NO: 19369 - protein, 10 aa, Artificial Sequence
  Peptide Derived from Human Papillomavirus
LKAKPKLKRA

SEQ ID NO: 19370 - protein, 11 aa, Artificial Sequence
  Peptide Derived from Human Papillomavirus
LKAKPKLKRAA

SEQ ID NO: 19371 - protein, 9 aa, Artificial Sequence
  Peptide Derived from Human Papillomavirus
LKEKFSADL

SEQ ID NO: 19372 - protein, 8 aa, Artificial Sequence
  Peptide Derived from Human Papillomavirus
LKMTSEPY

SEQ ID NO: 19373 - protein, 8 aa, Artificial Sequence
  Peptide Derived from Human Papillomavirus
LRREQMFV

SEQ ID NO: 19374 - protein, 11 aa, Artificial Sequence
  Peptide Derived from Human Papillomavirus
LRREQMFVRHF

SEQ ID NO: 19375 - protein, 10 aa, Artificial Sequence
  Peptide Derived from Human Papillomavirus
NKFGFPDTSF

SEQ ID NO: 19376 - protein, 11 aa, Artificial Sequence
  Peptide Derived from Human Papillomavirus
NKFGFPDTSFY

SEQ ID NO: 19377 - protein, 9 aa, Artificial Sequence
  Peptide Derived from Human Papillomavirus
NKPYWLQRA

SEQ ID NO: 19378 - protein, 9 aa, Artificial Sequence
  Peptide Derived from Human Papillomavirus
NKSDVPIDI

SEQ ID NO: 19379 - protein, 9 aa, Artificial Sequence
  Peptide Derived from Human Papillomavirus
NKYPGQPGA

SEQ ID NO: 19380 - protein, 9 aa, Artificial Sequence
  Peptide Derived from Human Papillomavirus
NRAGTLGEA

SEQ ID NO: 19381 - protein, 10 aa, Artificial Sequence
  Peptide Derived from Human Papillomavirus
NRAGTLGEAV

SEQ ID NO: 19382 - protein, 9 aa, Artificial Sequence
  Peptide Derived from Human Papillomavirus
NRECLSMDY

SEQ ID NO: 19383 - protein, 8 aa, Artificial Sequence
  Peptide Derived from Human Papillomavirus
PKEKEDPL

SEQ ID NO: 19384 - protein, 11 aa, Artificial Sequence
  Peptide Derived from Human Papillomavirus
PKEKEDPLGKY

SEQ ID NO: 19385 - protein, 8 aa, Artificial Sequence
  Peptide Derived from Human Papillomavirus
PKVSGLQY

SEQ ID NO: 19386 - protein, 10 aa, Artificial Sequence
  Peptide Derived from Human Papillomavirus
PKVSGLQYRV

SEQ ID NO: 19387 - protein, 11 aa, Artificial Sequence
  Peptide Derived from Human Papillomavirus
PKVSGLQYRVF

SEQ ID NO: 19388 - protein, 10 aa, Artificial Sequence
  Peptide Derived from Human Papillomavirus
QRAQGHNNGI

SEQ ID NO: 19389 - protein, 8 aa, Artificial Sequence
  Peptide Derived from Human Papillomavirus
QRLVWACV

SEQ ID NO: 19390 - protein, 10 aa, Artificial Sequence
  Peptide Derived from Human Papillomavirus
QRLVWACVGL

SEQ ID NO: 19391 - protein, 10 aa, Artificial Sequence
  Peptide Derived from Human Papillomavirus
RHFFNRAGTL

SEQ ID NO: 19392 - protein, 8 aa, Artificial Sequence
  Peptide Derived from Human Papillomavirus
RHVEEYDL

SEQ ID NO: 19393 - protein, 10 aa, Artificial Sequence
  Peptide Derived from Human Papillomavirus
RHVEEYDLQF

SEQ ID NO: 19394 - protein, 11 aa, Artificial Sequence
  Peptide Derived from Human Papillomavirus
RHVEEYDLQFV

SEQ ID NO: 19395 - protein, 9 aa, Artificial Sequence
  Peptide Derived from Human Papillomavirus
RKFLLQAGL

SEQ ID NO: 19396 - protein, 11 aa, Artificial Sequence
  Peptide Derived from Human Papillomavirus
RKFLLQAGLKA

SEQ ID NO: 19397 - protein, 10 aa, Artificial Sequence
  Peptide Derived from Human Papillomavirus
RREQMFVRHF

SEQ ID NO: 19398 - protein, 11 aa, Artificial Sequence
  Peptide Derived from Human Papillomavirus
RREQMFVRHFF

SEQ ID NO: 19399 - protein, 9 aa, Artificial Sequence
  Peptide Derived from Human Papillomavirus
SKVVSTDEY

SEQ ID NO: 19400 - protein, 10 aa, Artificial Sequence
  Peptide Derived from Human Papillomavirus
SKVVSTDEYV

SEQ ID NO: 19401 - protein, 10 aa, Artificial Sequence
  Peptide Derived from Human Papillomavirus
SRLLAVGHPY

SEQ ID NO: 19402 - protein, 11 aa, Artificial Sequence
  Peptide Derived from Human Papillomavirus
SRLLAVGHPYF

SEQ ID NO: 19403 - protein, 8 aa, Artificial Sequence
  Peptide Derived from Human Papillomavirus
SRTSIYYY

SEQ ID NO: 19404 - protein, 9 aa, Artificial Sequence
  Peptide Derived from Human Papillomavirus
SRTSIYYYA

SEQ ID NO: 19405 - protein, 8 aa, Artificial Sequence
  Peptide Derived from Human Papillomavirus
TRSTNMTL

SEQ ID NO: 19406 - protein, 11 aa, Artificial Sequence
  Peptide Derived from Human Papillomavirus
TRTSSAKRKKV

SEQ ID NO: 19407 - protein, 8 aa, Artificial Sequence
  Peptide Derived from Human Papillomavirus
VRHFFNRA

SEQ ID NO: 19408 - protein, 11 aa, Artificial Sequence
  Peptide Derived from Human Papillomavirus
VRHFFNRAGTL

SEQ ID NO: 19409 - protein, 9 aa, Artificial Sequence
  Peptide Derived from Human Papillomavirus
VRLPDPNKF

SEQ ID NO: 19410 - protein, 11 aa, Artificial Sequence
  Peptide Derived from Human Papillomavirus
VRLPDPNKFGF

SEQ ID NO: 19411 - protein, 8 aa, Artificial Sequence
  Peptide Derived from Human Papillomavirus
WRPSEATV

SEQ ID NO: 19412 - protein, 9 aa, Artificial Sequence
  Peptide Derived from Human Papillomavirus
WRPSEATVY

SEQ ID NO: 19413 - protein, 10 aa, Artificial Sequence
  Peptide Derived from Human Papillomavirus
WRPSEATVYL

SEQ ID NO: 19414 - protein, 9 aa, Artificial Sequence
  Peptide Derived from Human Papillomavirus
YKNENFKEY

SEQ ID NO: 19415 - protein, 10 aa, Artificial Sequence
  Peptide Derived from Human Papillomavirus
YKNENFKEYI

SEQ ID NO: 19416 - protein, 8 aa, Artificial Sequence
  Peptide Derived from Human Papillomavirus
YKQTQLCL

SEQ ID NO: 19417 - protein, 9 aa, Artificial Sequence
  Peptide Derived from Human Papillomavirus
YKQTQLCLL

SEQ ID NO: 19418 - protein, 8 aa, Artificial Sequence
  Peptide Derived from Human Papillomavirus
YRFVTSQA

SEQ ID NO: 19419 - protein, 9 aa, Artificial Sequence
  Peptide Derived from Human Papillomavirus
YRFVTSQAI

SEQ ID NO: 19420 - protein, 8 aa, Artificial Sequence
  Peptide Derived from Human Papillomavirus
YRVFRVRL

SEQ ID NO: 19421 - protein, 9 aa, Artificial Sequence
  Peptide Derived from Human Papillomavirus
ARIHYYQDL

SEQ ID NO: 19422 - protein, 11 aa, Artificial Sequence
  Peptide Derived from Human Papillomavirus
CKATGTCPPDV

SEQ ID NO: 19423 - protein, 9 aa, Artificial Sequence
  Peptide Derived from Human Papillomavirus
DHTVPNEQY

SEQ ID NO: 19424 - protein, 11 aa, Artificial Sequence
  Peptide Derived from Human Papillomavirus
DHTVPNEQYEL

SEQ ID NO: 19425 - protein, 10 aa, Artificial Sequence
  Peptide Derived from Human Papillomavirus
GHFIFSSPTV

SEQ ID NO: 19426 - protein, 8 aa, Artificial Sequence
  Peptide Derived from Human Papillomavirus
GKQIGARI

SEQ ID NO: 19427 - protein, 10 aa, Artificial Sequence
  Peptide Derived from Human Papillomavirus
GKQIGARIHY

SEQ ID NO: 19428 - protein, 11 aa, Artificial Sequence
  Peptide Derived from Human Papillomavirus
GKQIGARIHYY

SEQ ID NO: 19429 - protein, 8 aa, Artificial Sequence
  Peptide Derived from Human Papillomavirus
GRTGYVPI

SEQ ID NO: 19430 - protein, 10 aa, Artificial Sequence
  Peptide Derived from Human Papillomavirus
HKLITYDNPA

SEQ ID NO: 19431 - protein, 11 aa, Artificial Sequence
  Peptide Derived from Human Papillomavirus
HKLITYDNPAF

SEQ ID NO: 19432 - protein, 10 aa, Artificial Sequence
  Peptide Derived from Human Papillomavirus
HKRSTRRKRA

SEQ ID NO: 19433 - protein, 10 aa, Artificial Sequence
  Peptide Derived from Human Papillomavirus
IHYYQDLSPI

SEQ ID NO: 19434 - protein, 11 aa, Artificial Sequence
  Peptide Derived from Human Papillomavirus
IHYYQDLSPIV

SEQ ID NO: 19435 - protein, 10 aa, Artificial Sequence
  Peptide Derived from Human Papillomavirus
IRPPVTVDTV

SEQ ID NO: 19436 - protein, 8 aa, Artificial Sequence
  Peptide Derived from Human Papillomavirus
KRASATQL

SEQ ID NO: 19437 - protein, 9 aa, Artificial Sequence
  Peptide Derived from Human Papillomavirus
KRASATQLY

SEQ ID NO: 19438 - protein, 10 aa, Artificial Sequence
  Peptide Derived from Human Papillomavirus
KRFPYFFTDV

SEQ ID NO: 19439 - protein, 9 aa, Artificial Sequence
  Peptide Derived from Human Papillomavirus
KRSTRRKRA

SEQ ID NO: 19440 - protein, 11 aa, Artificial Sequence
  Peptide Derived from Human Papillomavirus
KRSTRRKRASA

SEQ ID NO: 19441 - protein, 9 aa, Artificial Sequence
  Peptide Derived from Human Papillomavirus
LHDTSTSSY

SEQ ID NO: 19442 - protein, 11 aa, Artificial Sequence
  Peptide Derived from Human Papillomavirus
LHDTSTSSYSI

SEQ ID NO: 19443 - protein, 9 aa, Artificial Sequence
  Peptide Derived from Human Papillomavirus
LHPPAPAEA

SEQ ID NO: 19444 - protein, 8 aa, Artificial Sequence
  Peptide Derived from Human Papillomavirus
LHPSYFIL

SEQ ID NO: 19445 - protein, 9 aa, Artificial Sequence
  Peptide Derived from Human Papillomavirus
LKTRSGKQI

SEQ ID NO: 19446 - protein, 11 aa, Artificial Sequence
  Peptide Derived from Human Papillomavirus
LKTRSGKQIGA

SEQ ID NO: 19447 - protein, 8 aa, Artificial Sequence
  Peptide Derived from Human Papillomavirus
LKYGSLGV

SEQ ID NO: 19448 - protein, 9 aa, Artificial Sequence
  Peptide Derived from Human Papillomavirus
LKYGSLGVF

SEQ ID NO: 19449 - protein, 10 aa, Artificial Sequence
  Peptide Derived from Human Papillomavirus
LKYGSLGVFF

SEQ ID NO: 19450 - protein, 8 aa, Artificial Sequence
  Peptide Derived from Human Papillomavirus
LRRRRKRF

SEQ ID NO: 19451 - protein, 10 aa, Artificial Sequence
  Peptide Derived from Human Papillomavirus
LRRRRKRFPY

SEQ ID NO: 19452 - protein, 11 aa, Artificial Sequence
  Peptide Derived from Human Papillomavirus
LRRRRKRFPYF

SEQ ID NO: 19453 - protein, 11 aa, Artificial Sequence
  Peptide Derived from Human Papillomavirus
PHKLITYDNPA

SEQ ID NO: 19454 - protein, 8 aa, Artificial Sequence
  Peptide Derived from Human Papillomavirus
PKVEGSTI

SEQ ID NO: 19455 - protein, 9 aa, Artificial Sequence
  Peptide Derived from Human Papillomavirus
PKVEGSTIA

SEQ ID NO: 19456 - protein, 8 aa, Artificial Sequence
  Peptide Derived from Human Papillomavirus
QHSDISPA

SEQ ID NO: 19457 - protein, 8 aa, Artificial Sequence
  Peptide Derived from Human Papillomavirus
QHSYSTFA

SEQ ID NO: 19458 - protein, 11 aa, Artificial Sequence
  Peptide Derived from Human Papillomavirus
RHKRSTRRKRA

SEQ ID NO: 19459 - protein, 9 aa, Artificial Sequence
  Peptide Derived from Human Papillomavirus
RHTVRFSRV

SEQ ID NO: 19460 - protein, 9 aa, Artificial Sequence
  Peptide Derived from Human Papillomavirus
RKRASATQL

SEQ ID NO: 19461 - protein, 10 aa, Artificial Sequence
  Peptide Derived from Human Papillomavirus
RKRASATQLY

SEQ ID NO: 19462 - protein, 8 aa, Artificial Sequence
  Peptide Derived from Human Papillomavirus
RKRFPYFF

SEQ ID NO: 19463 - protein, 11 aa, Artificial Sequence
  Peptide Derived from Human Papillomavirus
RKRFPYFFTDV

SEQ ID NO: 19464 - protein, 10 aa, Artificial Sequence
  Peptide Derived from Human Papillomavirus
RRHTVRFSRV

SEQ ID NO: 19465 - protein, 10 aa, Artificial Sequence
  Peptide Derived from Human Papillomavirus
RRKRASATQL

SEQ ID NO: 19466 - protein, 11 aa, Artificial Sequence
  Peptide Derived from Human Papillomavirus
RRKRASATQLY

SEQ ID NO: 19467 - protein, 8 aa, Artificial Sequence
  Peptide Derived from Human Papillomavirus
RRKRFPYF

SEQ ID NO: 19468 - protein, 9 aa, Artificial Sequence
  Peptide Derived from Human Papillomavirus
RRKRFPYFF

SEQ ID NO: 19469 - protein, 8 aa, Artificial Sequence
  Peptide Derived from Human Papillomavirus
RRRKRFPY

SEQ ID NO: 19470 - protein, 9 aa, Artificial Sequence
  Peptide Derived from Human Papillomavirus
RRRKRFPYF

SEQ ID NO: 19471 - protein, 10 aa, Artificial Sequence
  Peptide Derived from Human Papillomavirus
RRRKRFPYFF

SEQ ID NO: 19472 - protein, 9 aa, Artificial Sequence
  Peptide Derived from Human Papillomavirus
RRRRKRFPY

SEQ ID NO: 19473 - protein, 10 aa, Artificial Sequence
  Peptide Derived from Human Papillomavirus
RRRRKRFPYF

SEQ ID NO: 19474 - protein, 11 aa, Artificial Sequence
  Peptide Derived from Human Papillomavirus
RRRRKRFPYFF

SEQ ID NO: 19475 - protein, 9 aa, Artificial Sequence
  Peptide Derived from Human Papillomavirus
SRNTQQVKV

SEQ ID NO: 19476 - protein, 10 aa, Artificial Sequence
  Peptide Derived from Human Papillomavirus
SRNTQQVKVV

SEQ ID NO: 19477 - protein, 9 aa, Artificial Sequence
  Peptide Derived from Human Papillomavirus
SRPVARLGL

SEQ ID NO: 19478 - protein, 10 aa, Artificial Sequence
  Peptide Derived from Human Papillomavirus
SRPVARLGLY

SEQ ID NO: 19479 - protein, 8 aa, Artificial Sequence
  Peptide Derived from Human Papillomavirus
SRRHTVRF

SEQ ID NO: 19480 - protein, 11 aa, Artificial Sequence
  Peptide Derived from Human Papillomavirus
SRRHTVRFSRV

SEQ ID NO: 19481 - protein, 9 aa, Artificial Sequence
  Peptide Derived from Human Papillomavirus
SRVGQKATL

SEQ ID NO: 19482 - protein, 8 aa, Artificial Sequence
  Peptide Derived from Human Papillomavirus
TRRKRASA

SEQ ID NO: 19483 - protein, 11 aa, Artificial Sequence
  Peptide Derived from Human Papillomavirus
TRRKRASATQL

SEQ ID NO: 19484 - protein, 9 aa, Artificial Sequence
  Peptide Derived from Human Papillomavirus
TRSGKQIGA

SEQ ID NO: 19485 - protein, 11 aa, Artificial Sequence
  Peptide Derived from Human Papillomavirus
TRSGKQIGARI

SEQ ID NO: 19486 - protein, 8 aa, Artificial Sequence
  Peptide Derived from Human Papillomavirus
TRTSNVSI

SEQ ID NO: 19487 - protein, 10 aa, Artificial Sequence
  Peptide Derived from Human Papillomavirus
TRTSNVSIPL

SEQ ID NO: 19488 - protein, 9 aa, Artificial Sequence
  Peptide Derived from Human Papillomavirus
VHTPMQHSY

SEQ ID NO: 19489 - protein, 8 aa, Artificial Sequence
  Peptide Derived from Human Papillomavirus
VKVVDPAF

SEQ ID NO: 19490 - protein, 9 aa, Artificial Sequence
  Peptide Derived from Human Papillomavirus
VKVVDPAFL

SEQ ID NO: 19491 - protein, 10 aa, Artificial Sequence
  Peptide Derived from Human Papillomavirus
VRFSRVGQKA

SEQ ID NO: 19492 - protein, 10 aa, Artificial Sequence
  Peptide Derived from Human Papillomavirus
AHIQCLDCKW

SEQ ID NO: 19493 - protein, 8 aa, Artificial Sequence
  Peptide Derived from Human Papillomavirus
AKDNKWPY

SEQ ID NO: 19494 - protein, 9 aa, Artificial Sequence
  Peptide Derived from Human Papillomavirus
AKDNKWPYL

SEQ ID NO: 19495 - protein, 8 aa, Artificial Sequence
  Peptide Derived from Human Papillomavirus
AKGLSTLL

SEQ ID NO: 19496 - protein, 10 aa, Artificial Sequence
  Peptide Derived from Human Papillomavirus
AKGLSTLLHV

SEQ ID NO: 19497 - protein, 8 aa, Artificial Sequence
  Peptide Derived from Human Papillomavirus
AKRRLFTI

SEQ ID NO: 19498 - protein, 8 aa, Artificial Sequence
  Peptide Derived from Human Papillomavirus
AKYLKDCA

SEQ ID NO: 19499 - protein, 9 aa, Artificial Sequence
  Peptide Derived from Human Papillomavirus
AKYLKDCAV

SEQ ID NO: 19500 - protein, 10 aa, Artificial Sequence
  Peptide Derived from Human Papillomavirus
AKYLKDCAVM

SEQ ID NO: 19501 - protein, 8 aa, Artificial Sequence
  Peptide Derived from Human Papillomavirus
CKWGVLIL

SEQ ID NO: 19502 - protein, 9 aa, Artificial Sequence
  Peptide Derived from Human Papillomavirus
CKWGVLILA

SEQ ID NO: 19503 - protein, 10 aa, Artificial Sequence
  Peptide Derived from Human Papillomavirus
CKWGVLILAL

SEQ ID NO: 19504 - protein, 11 aa, Artificial Sequence
  Peptide Derived from Human Papillomavirus
CKWGVLILALL

SEQ ID NO: 19505 - protein, 8 aa, Artificial Sequence
  Peptide Derived from Human Papillomavirus
DKNGNPVY

SEQ ID NO: 19506 - protein, 10 aa, Artificial Sequence
  Peptide Derived from Human Papillomavirus
DKNGNPVYEI

SEQ ID NO: 19507 - protein, 8 aa, Artificial Sequence
  Peptide Derived from Human Papillomavirus
DKNWKCFF

SEQ ID NO: 19508 - protein, 8 aa, Artificial Sequence
  Peptide Derived from Human Papillomavirus
DKTTCTDW

SEQ ID NO: 19509 - protein, 9 aa, Artificial Sequence
  Peptide Derived from Human Papillomavirus
DKTTCTDWV

SEQ ID NO: 19510 - protein, 10 aa, Artificial Sequence
  Peptide Derived from Human Papillomavirus
DKTTCTDWVM

SEQ ID NO: 19511 - protein, 11 aa, Artificial Sequence
  Peptide Derived from Human Papillomavirus
DKTTCTDWVMA

SEQ ID NO: 19512 - protein, 8 aa, Artificial Sequence
  Peptide Derived from Human Papillomavirus
DRKHKPLL

SEQ ID NO: 19513 - protein, 10 aa, Artificial Sequence
  Peptide Derived from Human Papillomavirus
DRKHKPLLQL

SEQ ID NO: 19514 - protein, 8 aa, Artificial Sequence
  Peptide Derived from Human Papillomavirus
EKKTGDVI

SEQ ID NO: 19515 - protein, 9 aa, Artificial Sequence
  Peptide Derived from Human Papillomavirus
ERTWSRLDL

SEQ ID NO: 19516 - protein, 10 aa, Artificial Sequence
  Peptide Derived from Human Papillomavirus
FHAQEVQNDA

SEQ ID NO: 19517 - protein, 9 aa, Artificial Sequence
  Peptide Derived from Human Papillomavirus
FKDIYGLSF

SEQ ID NO: 19518 - protein, 11 aa, Artificial Sequence
  Peptide Derived from Human Papillomavirus
FKSDKTTCTDW

SEQ ID NO: 19519 - protein, 8 aa, Artificial Sequence
  Peptide Derived from Human Papillomavirus
FKTLIKPA

SEQ ID NO: 19520 - protein, 10 aa, Artificial Sequence
  Peptide Derived from Human Papillomavirus
FKTLIKPATL

SEQ ID NO: 19521 - protein, 11 aa, Artificial Sequence
  Peptide Derived from Human Papillomavirus
FKTLIKPATLY

SEQ ID NO: 19522 - protein, 9 aa, Artificial Sequence
  Peptide Derived from Human Papillomavirus
GHKKAKRRL

SEQ ID NO: 19523 - protein, 10 aa, Artificial Sequence
  Peptide Derived from Human Papillomavirus
GHKKAKRRLF

SEQ ID NO: 19524 - protein, 8 aa, Artificial Sequence
  Peptide Derived from Human Papillomavirus
GKNRLTVA

SEQ ID NO: 19525 - protein, 11 aa, Artificial Sequence
  Peptide Derived from Human Papillomavirus
GKNRLTVAKGL

SEQ ID NO: 19526 - protein, 9 aa, Artificial Sequence
  Peptide Derived from Human Papillomavirus
GKSYFGMSF

SEQ ID NO: 19527 - protein, 10 aa, Artificial Sequence
  Peptide Derived from Human Papillomavirus
GKSYFGMSFI

SEQ ID NO: 19528 - protein, 8 aa, Artificial Sequence
  Peptide Derived from Human Papillomavirus
HKKAKRRL

SEQ ID NO: 19529 - protein, 9 aa, Artificial Sequence
  Peptide Derived from Human Papillomavirus
HKKAKRRLF

SEQ ID NO: 19530 - protein, 11 aa, Artificial Sequence
  Peptide Derived from Human Papillomavirus
HKKAKRRLFTI

SEQ ID NO: 19531 - protein, 8 aa, Artificial Sequence
  Peptide Derived from Human Papillomavirus
IHFLQGAI

SEQ ID NO: 19532 - protein, 9 aa, Artificial Sequence
  Peptide Derived from Human Papillomavirus
IHFLQGAII

SEQ ID NO: 19533 - protein, 11 aa, Artificial Sequence
  Peptide Derived from Human Papillomavirus
IHFLQGAIISF

SEQ ID NO: 19534 - protein, 8 aa, Artificial Sequence
  Peptide Derived from Human Papillomavirus
IKPATLYA

SEQ ID NO: 19535 - protein, 10 aa, Artificial Sequence
  Peptide Derived from Human Papillomavirus
IKPATLYAHI

SEQ ID NO: 19536 - protein, 8 aa, Artificial Sequence
  Peptide Derived from Human Papillomavirus
IKYRCSKI

SEQ ID NO: 19537 - protein, 8 aa, Artificial Sequence
  Peptide Derived from Human Papillomavirus
KHKPLLQL

SEQ ID NO: 19538 - protein, 8 aa, Artificial Sequence
  Peptide Derived from Human Papillomavirus
KKAAMLAV

SEQ ID NO: 19539 - protein, 9 aa, Artificial Sequence
  Peptide Derived from Human Papillomavirus
KKAAMLAVF

SEQ ID NO: 19540 - protein, 8 aa, Artificial Sequence
  Peptide Derived from Human Papillomavirus
KKAKRRLF

SEQ ID NO: 19541 - protein, 10 aa, Artificial Sequence
  Peptide Derived from Human Papillomavirus
KKAKRRLFTI

SEQ ID NO: 19542 - protein, 8 aa, Artificial Sequence
  Peptide Derived from Human Papillomavirus
KKNCILLY

SEQ ID NO: 19543 - protein, 11 aa, Artificial Sequence
  Peptide Derived from Human Papillomavirus
KKNCILLYGPA

SEQ ID NO: 19544 - protein, 8 aa, Artificial Sequence
  Peptide Derived from Human Papillomavirus
KRAQKRQM

SEQ ID NO: 19545 - protein, 10 aa, Artificial Sequence
  Peptide Derived from Human Papillomavirus
KRAQKRQMNM

SEQ ID NO: 19546 - protein, 9 aa, Artificial Sequence
  Peptide Derived from Human Papillomavirus
KRQMNMSQW

SEQ ID NO: 19547 - protein, 10 aa, Artificial Sequence
  Peptide Derived from Human Papillomavirus
KRQMNMSQWI

SEQ ID NO: 19548 - protein, 8 aa, Artificial Sequence
  Peptide Derived from Human Papillomavirus
LHEDDEDA

SEQ ID NO: 19549 - protein, 8 aa, Artificial Sequence
  Peptide Derived from Human Papillomavirus
LHLLKRKF

SEQ ID NO: 19550 - protein, 9 aa, Artificial Sequence
  Peptide Derived from Human Papillomavirus
LHLLKRKFA

SEQ ID NO: 19551 - protein, 8 aa, Artificial Sequence
  Peptide Derived from Human Papillomavirus
LHVPETCM

SEQ ID NO: 19552 - protein, 9 aa, Artificial Sequence
  Peptide Derived from Human Papillomavirus
LHVPETCML

SEQ ID NO: 19553 - protein, 10 aa, Artificial Sequence
  Peptide Derived from Human Papillomavirus
LHVPETCMLI

SEQ ID NO: 19554 - protein, 8 aa, Artificial Sequence
  Peptide Derived from Human Papillomavirus
LKCPPILL

SEQ ID NO: 19555 - protein, 11 aa, Artificial Sequence
  Peptide Derived from Human Papillomavirus
LKDCAVMCRHY

SEQ ID NO: 19556 - protein, 10 aa, Artificial Sequence
  Peptide Derived from Human Papillomavirus
LKGTPKKNCI

SEQ ID NO: 19557 - protein, 11 aa, Artificial Sequence
  Peptide Derived from Human Papillomavirus
LKGTPKKNCIL

SEQ ID NO: 19558 - protein, 9 aa, Artificial Sequence
  Peptide Derived from Human Papillomavirus
LKSNCQAKY

SEQ ID NO: 19559 - protein, 10 aa, Artificial Sequence
  Peptide Derived from Human Papillomavirus
LKSNCQAKYL

SEQ ID NO: 19560 - protein, 8 aa, Artificial Sequence
  Peptide Derived from Human Papillomavirus
LRALKEFL

SEQ ID NO: 19561 - protein, 8 aa, Artificial Sequence
  Peptide Derived from Human Papillomavirus
LRSSVAAL

SEQ ID NO: 19562 - protein, 9 aa, Artificial Sequence
  Peptide Derived from Human Papillomavirus
LRSSVAALY

SEQ ID NO: 19563 - protein, 10 aa, Artificial Sequence
  Peptide Derived from Human Papillomavirus
LRSSVAALYW

SEQ ID NO: 19564 - protein, 11 aa, Artificial Sequence
  Peptide Derived from Human Papillomavirus
LRSSVAALYWY

SEQ ID NO: 19565 - protein, 10 aa, Artificial Sequence
  Peptide Derived from Human Papillomavirus
LRYKCGKNRL

SEQ ID NO: 19566 - protein, 8 aa, Artificial Sequence
  Peptide Derived from Human Papillomavirus
LRYQGVEF

SEQ ID NO: 19567 - protein, 9 aa, Artificial Sequence
  Peptide Derived from Human Papillomavirus
LRYQGVEFI

SEQ ID NO: 19568 - protein, 11 aa, Artificial Sequence
  Peptide Derived from Human Papillomavirus
LRYQGVEFISF

SEQ ID NO: 19569 - protein, 10 aa, Artificial Sequence
  Peptide Derived from Human Papillomavirus
MRNALDGNPI

SEQ ID NO: 19570 - protein, 8 aa, Artificial Sequence
  Peptide Derived from Human Papillomavirus
NKKAAMLA

SEQ ID NO: 19571 - protein, 9 aa, Artificial Sequence
  Peptide Derived from Human Papillomavirus
NKKAAMLAV

SEQ ID NO: 19572 - protein, 10 aa, Artificial Sequence
  Peptide Derived from Human Papillomavirus
NKKAAMLAVF

SEQ ID NO: 19573 - protein, 10 aa, Artificial Sequence
  Peptide Derived from Human Papillomavirus
NKWPYLESRV

SEQ ID NO: 19574 - protein, 9 aa, Artificial Sequence
  Peptide Derived from Human Papillomavirus
NRLTVAKGL

SEQ ID NO: 19575 - protein, 8 aa, Artificial Sequence
  Peptide Derived from Human Papillomavirus
PHCSITEL

SEQ ID NO: 19576 - protein, 11 aa, Artificial Sequence
  Peptide Derived from Human Papillomavirus
PHCSITELKEL

SEQ ID NO: 19577 - protein, 8 aa, Artificial Sequence
  Peptide Derived from Human Papillomavirus
PKKNCILL

SEQ ID NO: 19578 - protein, 9 aa, Artificial Sequence
  Peptide Derived from Human Papillomavirus
PKKNCILLY

SEQ ID NO: 19579 - protein, 8 aa, Artificial Sequence
  Peptide Derived from Human Papillomavirus
PKLRSSVA

SEQ ID NO: 19580 - protein, 9 aa, Artificial Sequence
  Peptide Derived from Human Papillomavirus
PKLRSSVAA

SEQ ID NO: 19581 - protein, 10 aa, Artificial Sequence
  Peptide Derived from Human Papillomavirus
PKLRSSVAAL

SEQ ID NO: 19582 - protein, 11 aa, Artificial Sequence
  Peptide Derived from Human Papillomavirus
PKLRSSVAALY

SEQ ID NO: 19583 - protein, 8 aa, Artificial Sequence
  Peptide Derived from Human Papillomavirus
PRLQEISL

SEQ ID NO: 19584 - protein, 9 aa, Artificial Sequence
  Peptide Derived from Human Papillomavirus
QHGIDDSNF

SEQ ID NO: 19585 - protein, 11 aa, Artificial Sequence
  Peptide Derived from Human Papillomavirus
QHGIDDSNFDL

SEQ ID NO: 19586 - protein, 10 aa, Artificial Sequence
  Peptide Derived from Human Papillomavirus
QKRQMNMSQW

SEQ ID NO: 19587 - protein, 11 aa, Artificial Sequence
  Peptide Derived from Human Papillomavirus
QKRQMNMSQWI

SEQ ID NO: 19588 - protein, 10 aa, Artificial Sequence
  Peptide Derived from Human Papillomavirus
QRLTIIQHGI

SEQ ID NO: 19589 - protein, 11 aa, Artificial Sequence
  Peptide Derived from Human Papillomavirus
RHYKRAQKRQM

SEQ ID NO: 19590 - protein, 9 aa, Artificial Sequence
  Peptide Derived from Human Papillomavirus
RKHKPLLQL

SEQ ID NO: 19591 - protein, 11 aa, Artificial Sequence
  Peptide Derived from Human Papillomavirus
RRLFTISDSGY

SEQ ID NO: 19592 - protein, 8 aa, Artificial Sequence
  Peptide Derived from Human Papillomavirus
SHFWLEPL

SEQ ID NO: 19593 - protein, 9 aa, Artificial Sequence
  Peptide Derived from Human Papillomavirus
SHFWLEPLA

SEQ ID NO: 19594 - protein, 11 aa, Artificial Sequence
  Peptide Derived from Human Papillomavirus
SKENSPLGEQL

SEQ ID NO: 19595 - protein, 9 aa, Artificial Sequence
  Peptide Derived from Human Papillomavirus
SKIDEGGDW

SEQ ID NO: 19596 - protein, 8 aa, Artificial Sequence
  Peptide Derived from Human Papillomavirus
SRVTVFTF

SEQ ID NO: 19597 - protein, 11 aa, Artificial Sequence
  Peptide Derived from Human Papillomavirus
SRVTVFTFPHA

SEQ ID NO: 19598 - protein, 8 aa, Artificial Sequence
  Peptide Derived from Human Papillomavirus
THTCWTYF

SEQ ID NO: 19599 - protein, 11 aa, Artificial Sequence
  Peptide Derived from Human Papillomavirus
THTCWTYFDNY

SEQ ID NO: 19600 - protein, 9 aa, Artificial Sequence
  Peptide Derived from Human Papillomavirus
TKVAMLDDA

SEQ ID NO: 19601 - protein, 9 aa, Artificial Sequence
  Peptide Derived from Human Papillomavirus
WKCFFERTW

SEQ ID NO: 19602 - protein, 8 aa, Artificial Sequence
  Peptide Derived from Human Papillomavirus
WRPIVQFL

SEQ ID NO: 19603 - protein, 10 aa, Artificial Sequence
  Peptide Derived from Human Papillomavirus
WRPIVQFLRY

SEQ ID NO: 19604 - protein, 8 aa, Artificial Sequence
  Peptide Derived from Human Papillomavirus
YKCGKNRL

SEQ ID NO: 19605 - protein, 10 aa, Artificial Sequence
  Peptide Derived from Human Papillomavirus
YKCGKNRLTV

SEQ ID NO: 19606 - protein, 11 aa, Artificial Sequence
  Peptide Derived from Human Papillomavirus
YKCGKNRLTVA

SEQ ID NO: 19607 - protein, 9 aa, Artificial Sequence
  Peptide Derived from Human Papillomavirus
YKRAQKRQM

SEQ ID NO: 19608 - protein, 11 aa, Artificial Sequence
  Peptide Derived from Human Papillomavirus
YKRAQKRQMNM

SEQ ID NO: 19609 - protein, 8 aa, Artificial Sequence
  Peptide Derived from Human Papillomavirus
YRTGISNI

SEQ ID NO: 19610 - protein, 11 aa, Artificial Sequence
  Peptide Derived from Human Papillomavirus
YRTGISNISEV

SEQ ID NO: 19611 - protein, 9 aa, Artificial Sequence
  Peptide Derived from Human Papillomavirus
AHKAIELQM

SEQ ID NO: 19612 - protein, 10 aa, Artificial Sequence
  Peptide Derived from Human Papillomavirus
AHKAIELQMA

SEQ ID NO: 19613 - protein, 11 aa, Artificial Sequence
  Peptide Derived from Human Papillomavirus
AHKAIELQMAL

SEQ ID NO: 19614 - protein, 9 aa, Artificial Sequence
  Peptide Derived from Human Papillomavirus
AREHGITKL

SEQ ID NO: 19615 - protein, 10 aa, Artificial Sequence
  Peptide Derived from Human Papillomavirus
DHYENDSKDI

SEQ ID NO: 19616 - protein, 10 aa, Artificial Sequence
  Peptide Derived from Human Papillomavirus
DHYSEISSTW

SEQ ID NO: 19617 - protein, 8 aa, Artificial Sequence
  Peptide Derived from Human Papillomavirus
DKNSLKCL

SEQ ID NO: 19618 - protein, 10 aa, Artificial Sequence
  Peptide Derived from Human Papillomavirus
DKNSLKCLRY

SEQ ID NO: 19619 - protein, 9 aa, Artificial Sequence
  Peptide Derived from Human Papillomavirus
DKTAACVSY

SEQ ID NO: 19620 - protein, 10 aa, Artificial Sequence
  Peptide Derived from Human Papillomavirus
DKTAACVSYW

SEQ ID NO: 19621 - protein, 11 aa, Artificial Sequence
  Peptide Derived from Human Papillomavirus
EHGITKLNHQV

SEQ ID NO: 19622 - protein, 9 aa, Artificial Sequence
  Peptide Derived from Human Papillomavirus
EKYGNSNTW

SEQ ID NO: 19623 - protein, 11 aa, Artificial Sequence
  Peptide Derived from Human Papillomavirus
EKYGNSNTWEV

SEQ ID NO: 19624 - protein, 10 aa, Artificial Sequence
  Peptide Derived from Human Papillomavirus
ERLSALQDKI

SEQ ID NO: 19625 - protein, 11 aa, Artificial Sequence
  Peptide Derived from Human Papillomavirus
ERLSALQDKIL

SEQ ID NO: 19626 - protein, 8 aa, Artificial Sequence
  Peptide Derived from Human Papillomavirus
FKKGGKTV

SEQ ID NO: 19627 - protein, 10 aa, Artificial Sequence
  Peptide Derived from Human Papillomavirus
FKKGGKTVHV

SEQ ID NO: 19628 - protein, 11 aa, Artificial Sequence
  Peptide Derived from Human Papillomavirus
FKKGGKTVHVY

SEQ ID NO: 19629 - protein, 8 aa, Artificial Sequence
  Peptide Derived from Human Papillomavirus
FKSECEKY

SEQ ID NO: 19630 - protein, 8 aa, Artificial Sequence
  Peptide Derived from Human Papillomavirus
GKTVHVYF

SEQ ID NO: 19631 - protein, 11 aa, Artificial Sequence
  Peptide Derived from Human Papillomavirus
GRVNTHVHNPL

SEQ ID NO: 19632 - protein, 9 aa, Artificial Sequence
  Peptide Derived from Human Papillomavirus
HHGRVNTHV

SEQ ID NO: 19633 - protein, 8 aa, Artificial Sequence
  Peptide Derived from Human Papillomavirus
HKAIELQM

SEQ ID NO: 19634 - protein, 9 aa, Artificial Sequence
  Peptide Derived from Human Papillomavirus
HKAIELQMA

SEQ ID NO: 19635 - protein, 10 aa, Artificial Sequence
  Peptide Derived from Human Papillomavirus
HKAIELQMAL

SEQ ID NO: 19636 - protein, 10 aa, Artificial Sequence
  Peptide Derived from Human Papillomavirus
IHLKGDKNSL

SEQ ID NO: 19637 - protein, 8 aa, Artificial Sequence
  Peptide Derived from Human Papillomavirus
IKDGDTTY

SEQ ID NO: 19638 - protein, 9 aa, Artificial Sequence
  Peptide Derived from Human Papillomavirus
IKDGDTTYY

SEQ ID NO: 19639 - protein, 10 aa, Artificial Sequence
  Peptide Derived from Human Papillomavirus
IKDGDTTYYV

SEQ ID NO: 19640 - protein, 8 aa, Artificial Sequence
  Peptide Derived from Human Papillomavirus
IRLENAIL

SEQ ID NO: 19641 - protein, 9 aa, Artificial Sequence
  Peptide Derived from Human Papillomavirus
IRLENAILF

SEQ ID NO: 19642 - protein, 11 aa, Artificial Sequence
  Peptide Derived from Human Papillomavirus
IRLENAILFTA

SEQ ID NO: 19643 - protein, 9 aa, Artificial Sequence
  Peptide Derived from Human Papillomavirus
KKGGKTVHV

SEQ ID NO: 19644 - protein, 10 aa, Artificial Sequence
  Peptide Derived from Human Papillomavirus
KKGGKTVHVY

SEQ ID NO: 19645 - protein, 11 aa, Artificial Sequence
  Peptide Derived from Human Papillomavirus
KKGGKTVHVYF

SEQ ID NO: 19646 - protein, 8 aa, Artificial Sequence
  Peptide Derived from Human Papillomavirus
KRPRQCGL

SEQ ID NO: 19647 - protein, 8 aa, Artificial Sequence
  Peptide Derived from Human Papillomavirus
LKCLRYRL

SEQ ID NO: 19648 - protein, 11 aa, Artificial Sequence
  Peptide Derived from Human Papillomavirus
LKCLRYRLRKY

SEQ ID NO: 19649 - protein, 8 aa, Artificial Sequence
  Peptide Derived from Human Papillomavirus
LKGDKNSL

SEQ ID NO: 19650 - protein, 11 aa, Artificial Sequence
  Peptide Derived from Human Papillomavirus
LKGDKNSLKCL

SEQ ID NO: 19651 - protein, 9 aa, Artificial Sequence
  Peptide Derived from Human Papillomavirus
LKGLAQSKY

SEQ ID NO: 19652 - protein, 8 aa, Artificial Sequence
  Peptide Derived from Human Papillomavirus
LRKYADHY

SEQ ID NO: 19653 - protein, 11 aa, Artificial Sequence
  Peptide Derived from Human Papillomavirus
LRKYADHYSEI

SEQ ID NO: 19654 - protein, 8 aa, Artificial Sequence
  Peptide Derived from Human Papillomavirus
LRYRLRKY

SEQ ID NO: 19655 - protein, 9 aa, Artificial Sequence
  Peptide Derived from Human Papillomavirus
LRYRLRKYA

SEQ ID NO: 19656 - protein, 10 aa, Artificial Sequence
  Peptide Derived from Human Papillomavirus
MKMQTPKESL

SEQ ID NO: 19657 - protein, 8 aa, Artificial Sequence
  Peptide Derived from Human Papillomavirus
NHQVVPPI

SEQ ID NO: 19658 - protein, 10 aa, Artificial Sequence
  Peptide Derived from Human Papillomavirus
NHQVVPPINI

SEQ ID NO: 19659 - protein, 8 aa, Artificial Sequence
  Peptide Derived from Human Papillomavirus
NKDNCMNY

SEQ ID NO: 19660 - protein, 9 aa, Artificial Sequence
  Peptide Derived from Human Papillomavirus
NKDNCMNYV

SEQ ID NO: 19661 - protein, 10 aa, Artificial Sequence
  Peptide Derived from Human Papillomavirus
NKDNCMNYVV

SEQ ID NO: 19662 - protein, 11 aa, Artificial Sequence
  Peptide Derived from Human Papillomavirus
NKDNCMNYVVW

SEQ ID NO: 19663 - protein, 9 aa, Artificial Sequence
  Peptide Derived from Human Papillomavirus
NKNTGILTV

SEQ ID NO: 19664 - protein, 11 aa, Artificial Sequence
  Peptide Derived from Human Papillomavirus
NKNTGILTVTY

SEQ ID NO: 19665 - protein, 9 aa, Artificial Sequence
  Peptide Derived from Human Papillomavirus
PKESLSERL

SEQ ID NO: 19666 - protein, 11 aa, Artificial Sequence
  Peptide Derived from Human Papillomavirus
PKESLSERLSA

SEQ ID NO: 19667 - protein, 9 aa, Artificial Sequence
  Peptide Derived from Human Papillomavirus
PKPHIQTPA

SEQ ID NO: 19668 - protein, 11 aa, Artificial Sequence
  Peptide Derived from Human Papillomavirus
QHASTSTPKTA

SEQ ID NO: 19669 - protein, 10 aa, Artificial Sequence
  Peptide Derived from Human Papillomavirus
QHHGRVNTHV

SEQ ID NO: 19670 - protein, 8 aa, Artificial Sequence
  Peptide Derived from Human Papillomavirus
QRNTFLDV

SEQ ID NO: 19671 - protein, 9 aa, Artificial Sequence
  Peptide Derived from Human Papillomavirus
QRNTFLDVV

SEQ ID NO: 19672 - protein, 11 aa, Artificial Sequence
  Peptide Derived from Human Papillomavirus
QRNTFLDVVTI

SEQ ID NO: 19673 - protein, 11 aa, Artificial Sequence
  Peptide Derived from Human Papillomavirus
RKVCSGNTTPI

SEQ ID NO: 19674 - protein, 10 aa, Artificial Sequence
  Peptide Derived from Human Papillomavirus
RKYADHYSEI

SEQ ID NO: 19675 - protein, 9 aa, Artificial Sequence
  Peptide Derived from Human Papillomavirus
SKAHKAIEL

SEQ ID NO: 19676 - protein, 11 aa, Artificial Sequence
  Peptide Derived from Human Papillomavirus
SKAHKAIELQM

SEQ ID NO: 19677 - protein, 8 aa, Artificial Sequence
  Peptide Derived from Human Papillomavirus
SKDINSQI

SEQ ID NO: 19678 - protein, 10 aa, Artificial Sequence
  Peptide Derived from Human Papillomavirus
SKDINSQISY

SEQ ID NO: 19679 - protein, 11 aa, Artificial Sequence
  Peptide Derived from Human Papillomavirus
SKDINSQISYW

SEQ ID NO: 19680 - protein, 8 aa, Artificial Sequence
  Peptide Derived from Human Papillomavirus
SKSKAHKA

SEQ ID NO: 19681 - protein, 9 aa, Artificial Sequence
  Peptide Derived from Human Papillomavirus
SKSKAHKAI

SEQ ID NO: 19682 - protein, 11 aa, Artificial Sequence
  Peptide Derived from Human Papillomavirus
SKSKAHKAIEL

SEQ ID NO: 19683 - protein, 8 aa, Artificial Sequence
  Peptide Derived from Human Papillomavirus
SKYNNEEW

SEQ ID NO: 19684 - protein, 10 aa, Artificial Sequence
  Peptide Derived from Human Papillomavirus
SKYNNEEWTL

SEQ ID NO: 19685 - protein, 8 aa, Artificial Sequence
  Peptide Derived from Human Papillomavirus
THVHNPLL

SEQ ID NO: 19686 - protein, 8 aa, Artificial Sequence
  Peptide Derived from Human Papillomavirus
TKLNHQVV

SEQ ID NO: 19687 - protein, 11 aa, Artificial Sequence
  Peptide Derived from Human Papillomavirus
TKLNHQVVPPI

SEQ ID NO: 19688 - protein, 9 aa, Artificial Sequence
  Peptide Derived from Human Papillomavirus
TKRPRQCGL

SEQ ID NO: 19689 - protein, 10 aa, Artificial Sequence
  Peptide Derived from Human Papillomavirus
YRLRKYADHY

SEQ ID NO: 19690 - protein, 11 aa, Artificial Sequence
  Peptide Derived from Human Papillomavirus
ARFDDPTQRPY

SEQ ID NO: 19691 - protein, 8 aa, Artificial Sequence
  Peptide Derived from Human Papillomavirus
CHKCIDFY

SEQ ID NO: 19692 - protein, 11 aa, Artificial Sequence
  Peptide Derived from Human Papillomavirus
CHKCIDFYSRI

SEQ ID NO: 19693 - protein, 10 aa, Artificial Sequence
  Peptide Derived from Human Papillomavirus
CKATLERTEV

SEQ ID NO: 19694 - protein, 11 aa, Artificial Sequence
  Peptide Derived from Human Papillomavirus
CKATLERTEVY

SEQ ID NO: 19695 - protein, 8 aa, Artificial Sequence
  Peptide Derived from Human Papillomavirus
DKRRFHSI

SEQ ID NO: 19696 - protein, 9 aa, Artificial Sequence
  Peptide Derived from Human Papillomavirus
DKRRFHSIA

SEQ ID NO: 19697 - protein, 8 aa, Artificial Sequence
  Peptide Derived from Human Papillomavirus
EKITNTEL

SEQ ID NO: 19698 - protein, 9 aa, Artificial Sequence
  Peptide Derived from Human Papillomavirus
EKITNTELY

SEQ ID NO: 19699 - protein, 11 aa, Artificial Sequence
  Peptide Derived from Human Papillomavirus
EKITNTELYNL

SEQ ID NO: 19700 - protein, 11 aa, Artificial Sequence
  Peptide Derived from Human Papillomavirus
ERLRRRRETQV

SEQ ID NO: 19701 - protein, 8 aa, Artificial Sequence
  Peptide Derived from Human Papillomavirus
ERTEVYQF

SEQ ID NO: 19702 - protein, 9 aa, Artificial Sequence
  Peptide Derived from Human Papillomavirus
ERTEVYQFA

SEQ ID NO: 19703 - protein, 10 aa, Artificial Sequence
  Peptide Derived from Human Papillomavirus
ERTEVYQFAF

SEQ ID NO: 19704 - protein, 8 aa, Artificial Sequence
  Peptide Derived from Human Papillomavirus
FHSIAGQY

SEQ ID NO: 19705 - protein, 8 aa, Artificial Sequence
  Peptide Derived from Human Papillomavirus
FKDLFIVY

SEQ ID NO: 19706 - protein, 10 aa, Artificial Sequence
  Peptide Derived from Human Papillomavirus
HKCIDFYSRI

SEQ ID NO: 19707 - protein, 10 aa, Artificial Sequence
  Peptide Derived from Human Papillomavirus
IRCLRCQKPL

SEQ ID NO: 19708 - protein, 11 aa, Artificial Sequence
  Peptide Derived from Human Papillomavirus
IRELRYYSNSV

SEQ ID NO: 19709 - protein, 8 aa, Artificial Sequence
  Peptide Derived from Human Papillomavirus
KRRFHSIA

SEQ ID NO: 19710 - protein, 11 aa, Artificial Sequence
  Peptide Derived from Human Papillomavirus
KRRFHSIAGQY

SEQ ID NO: 19711 - protein, 11 aa, Artificial Sequence
  Peptide Derived from Human Papillomavirus
KRRHLKDKRRF

SEQ ID NO: 19712 - protein, 10 aa, Artificial Sequence
  Peptide Derived from Human Papillomavirus
LKDKRRFHSI

SEQ ID NO: 19713 - protein, 11 aa, Artificial Sequence
  Peptide Derived from Human Papillomavirus
LKDKRRFHSIA

SEQ ID NO: 19714 - protein, 10 aa, Artificial Sequence
  Peptide Derived from Human Papillomavirus
LRCQKPLNPA

SEQ ID NO: 19715 - protein, 9 aa, Artificial Sequence
  Peptide Derived from Human Papillomavirus
LRRRRETQV

SEQ ID NO: 19716 - protein, 8 aa, Artificial Sequence
  Peptide Derived from Human Papillomavirus
LRYYSNSV

SEQ ID NO: 19717 - protein, 9 aa, Artificial Sequence
  Peptide Derived from Human Papillomavirus
LRYYSNSVY

SEQ ID NO: 19718 - protein, 9 aa, Artificial Sequence
  Peptide Derived from Human Papillomavirus
QRPYKLPDL

SEQ ID NO: 19719 - protein, 9 aa, Artificial Sequence
  Peptide Derived from Human Papillomavirus
RHLKDKRRF

SEQ ID NO: 19720 - protein, 10 aa, Artificial Sequence
  Peptide Derived from Human Papillomavirus
RRFHSIAGQY

SEQ ID NO: 19721 - protein, 10 aa, Artificial Sequence
  Peptide Derived from Human Papillomavirus
RRHLKDKRRF

SEQ ID NO: 19722 - protein, 8 aa, Artificial Sequence
  Peptide Derived from Human Papillomavirus
RRRRETQV

SEQ ID NO: 19723 - protein, 8 aa, Artificial Sequence
  Peptide Derived from Human Papillomavirus
SRIRELRY

SEQ ID NO: 19724 - protein, 9 aa, Artificial Sequence
  Peptide Derived from Human Papillomavirus
SRIRELRYY

SEQ ID NO: 19725 - protein, 10 aa, Artificial Sequence
  Peptide Derived from Human Papillomavirus
YKLPDLCTEL

SEQ ID NO: 19726 - protein, 8 aa, Artificial Sequence
  Peptide Derived from Human Papillomavirus
YRDCIAYA

SEQ ID NO: 19727 - protein, 9 aa, Artificial Sequence
  Peptide Derived from Human Papillomavirus
YRDCIAYAA

SEQ ID NO: 19728 - protein, 11 aa, Artificial Sequence
  Peptide Derived from Human Papillomavirus
ARRAEPQRHKI

SEQ ID NO: 19729 - protein, 9 aa, Artificial Sequence
  Peptide Derived from Human Papillomavirus
CKCDGRIEL

SEQ ID NO: 19730 - protein, 11 aa, Artificial Sequence
  Peptide Derived from Human Papillomavirus
CKCDGRIELTV

SEQ ID NO: 19731 - protein, 11 aa, Artificial Sequence
  Peptide Derived from Human Papillomavirus
GRIELTVESSA

SEQ ID NO: 19732 - protein, 9 aa, Artificial Sequence
  Peptide Derived from Human Papillomavirus
LHLEPQNEL

SEQ ID NO: 19733 - protein, 8 aa, Artificial Sequence
  Peptide Derived from Human Papillomavirus
LRTLQQLF

SEQ ID NO: 19734 - protein, 9 aa, Artificial Sequence
  Peptide Derived from Human Papillomavirus
LRTLQQLFL

SEQ ID NO: 19735 - protein, 8 aa, Artificial Sequence
  Peptide Derived from Human Papillomavirus
MHGPRATL

SEQ ID NO: 19736 - protein, 11 aa, Artificial Sequence
  Peptide Derived from Human Papillomavirus
MHGPRATLQEI

SEQ ID NO: 19737 - protein, 8 aa, Artificial Sequence
  Peptide Derived from Human Papillomavirus
PRATLQEI

SEQ ID NO: 19738 - protein, 9 aa, Artificial Sequence
  Peptide Derived from Human Papillomavirus
PRATLQEIV

SEQ ID NO: 19739 - protein, 10 aa, Artificial Sequence
  Peptide Derived from Human Papillomavirus
PRATLQEIVL

SEQ ID NO: 19740 - protein, 8 aa, Artificial Sequence
  Peptide Derived from Human Papillomavirus
QRHKILCV

SEQ ID NO: 19741 - protein, 10 aa, Artificial Sequence
  Peptide Derived from Human Papillomavirus
RRAEPQRHKI

SEQ ID NO: 19742 - protein, 11 aa, Artificial Sequence
  Peptide Derived from Human Papillomavirus
RRAEPQRHKIL

SEQ ID NO: 19743 - protein, 10 aa, Artificial Sequence
  Peptide Derived from Human Papillomavirus
SHAQLPARRA

SEQ ID NO: 19744 - protein, 8 aa, Artificial Sequence
  Peptide Derived from Human Papillomavirus
AHAATAVI

SEQ ID NO: 19745 - protein, 10 aa, Artificial Sequence
  Peptide Derived from Human Papillomavirus
AHNIIYGHGI

SEQ ID NO: 19746 - protein, 11 aa, Artificial Sequence
  Peptide Derived from Human Papillomavirus
AHNIIYGHGII

SEQ ID NO: 19747 - protein, 9 aa, Artificial Sequence
  Peptide Derived from Human Papillomavirus
AKGTLCKPA

SEQ ID NO: 19748 - protein, 11 aa, Artificial Sequence
  Peptide Derived from Human Papillomavirus
AKGTLCKPAQL

SEQ ID NO: 19749 - protein, 8 aa, Artificial Sequence
  Peptide Derived from Human Papillomavirus
ARHFWNRA

SEQ ID NO: 19750 - protein, 10 aa, Artificial Sequence
  Peptide Derived from Human Papillomavirus
ARHFWNRAGV

SEQ ID NO: 19751 - protein, 11 aa, Artificial Sequence
  Peptide Derived from Human Papillomavirus
ARHFWNRAGVM

SEQ ID NO: 19752 - protein, 9 aa, Artificial Sequence
  Peptide Derived from Human Papillomavirus
ARVVNTDDY

SEQ ID NO: 19753 - protein, 10 aa, Artificial Sequence
  Peptide Derived from Human Papillomavirus
ARVVNTDDYV

SEQ ID NO: 19754 - protein, 9 aa, Artificial Sequence
  Peptide Derived from Human Papillomavirus
CKYPDYLQM

SEQ ID NO: 19755 - protein, 11 aa, Artificial Sequence
  Peptide Derived from Human Papillomavirus
CKYPDYLQMSA

SEQ ID NO: 19756 - protein, 8 aa, Artificial Sequence
  Peptide Derived from Human Papillomavirus
DKLKFWTV

SEQ ID NO: 19757 - protein, 10 aa, Artificial Sequence
  Peptide Derived from Human Papillomavirus
DKLKFWTVDL

SEQ ID NO: 19758 - protein, 8 aa, Artificial Sequence
  Peptide Derived from Human Papillomavirus
EHWAKGTL

SEQ ID NO: 19759 - protein, 10 aa, Artificial Sequence
  Peptide Derived from Human Papillomavirus
EKFSSDLDQY

SEQ ID NO: 19760 - protein, 9 aa, Artificial Sequence
  Peptide Derived from Human Papillomavirus
EKQDPYDKL

SEQ ID NO: 19761 - protein, 11 aa, Artificial Sequence
  Peptide Derived from Human Papillomavirus
EKQDPYDKLKF

SEQ ID NO: 19762 - protein, 8 aa, Artificial Sequence
  Peptide Derived from Human Papillomavirus
FKHYSRHV

SEQ ID NO: 19763 - protein, 11 aa, Artificial Sequence
  Peptide Derived from Human Papillomavirus
FKHYSRHVEEY

SEQ ID NO: 19764 - protein, 11 aa, Artificial Sequence
  Peptide Derived from Human Papillomavirus
FRVALPDPNKF

SEQ ID NO: 19765 - protein, 8 aa, Artificial Sequence
  Peptide Derived from Human Papillomavirus
FRVVPSGA

SEQ ID NO: 19766 - protein, 8 aa, Artificial Sequence
  Peptide Derived from Human Papillomavirus
GHGIIIFL

SEQ ID NO: 19767 - protein, 11 aa, Artificial Sequence
  Peptide Derived from Human Papillomavirus
GHGIIIFLKNV

SEQ ID NO: 19768 - protein, 8 aa, Artificial Sequence
  Peptide Derived from Human Papillomavirus
GHNNGICW

SEQ ID NO: 19769 - protein, 8 aa, Artificial Sequence
  Peptide Derived from Human Papillomavirus
GHPFYNKL

SEQ ID NO: 19770 - protein, 8 aa, Artificial Sequence
  Peptide Derived from Human Papillomavirus
GRGQPLGI

SEQ ID NO: 19771 - protein, 10 aa, Artificial Sequence
  Peptide Derived from Human Papillomavirus
GRGQPLGIGL

SEQ ID NO: 19772 - protein, 8 aa, Artificial Sequence
  Peptide Derived from Human Papillomavirus
GRKFLVQA

SEQ ID NO: 19773 - protein, 10 aa, Artificial Sequence
  Peptide Derived from Human Papillomavirus
GRKFLVQAGL

SEQ ID NO: 19774 - protein, 10 aa, Artificial Sequence
  Peptide Derived from Human Papillomavirus
HKAQGHNNGI

SEQ ID NO: 19775 - protein, 8 aa, Artificial Sequence
  Peptide Derived from Human Papillomavirus
IHSMNSSI

SEQ ID NO: 19776 - protein, 9 aa, Artificial Sequence
  Peptide Derived from Human Papillomavirus
IHSMNSSIL

SEQ ID NO: 19777 - protein, 8 aa, Artificial Sequence
  Peptide Derived from Human Papillomavirus
IKGTSANM

SEQ ID NO: 19778 - protein, 10 aa, Artificial Sequence
  Peptide Derived from Human Papillomavirus
KHYSRHVEEY

SEQ ID NO: 19779 - protein, 10 aa, Artificial Sequence
  Peptide Derived from Human Papillomavirus
KRPAASTSTA

SEQ ID NO: 19780 - protein, 11 aa, Artificial Sequence
  Peptide Derived from Human Papillomavirus
LHKAQGHNNGI

SEQ ID NO: 19781 - protein, 9 aa, Artificial Sequence
  Peptide Derived from Human Papillomavirus
LKEKFSSDL

SEQ ID NO: 19782 - protein, 8 aa, Artificial Sequence
  Peptide Derived from Human Papillomavirus
LKFWTVDL

SEQ ID NO: 19783 - protein, 11 aa, Artificial Sequence
  Peptide Derived from Human Papillomavirus
LKNTIIEDGDM

SEQ ID NO: 19784 - protein, 9 aa, Artificial Sequence
  Peptide Derived from Human Papillomavirus
LKNVNVFPI

SEQ ID NO: 19785 - protein, 10 aa, Artificial Sequence
  Peptide Derived from Human Papillomavirus
LKNVNVFPIF

SEQ ID NO: 19786 - protein, 11 aa, Artificial Sequence
  Peptide Derived from Human Papillomavirus
LKNVNVFPIFL

SEQ ID NO: 19787 - protein, 8 aa, Artificial Sequence
  Peptide Derived from Human Papillomavirus
LRREQLFA

SEQ ID NO: 19788 - protein, 11 aa, Artificial Sequence
  Peptide Derived from Human Papillomavirus
LRREQLFARHF

SEQ ID NO: 19789 - protein, 9 aa, Artificial Sequence
  Peptide Derived from Human Papillomavirus
MRETPGSCV

SEQ ID NO: 19790 - protein, 10 aa, Artificial Sequence
  Peptide Derived from Human Papillomavirus
MRETPGSCVY

SEQ ID NO: 19791 - protein, 10 aa, Artificial Sequence
  Peptide Derived from Human Papillomavirus
NKFGLPDSTI

SEQ ID NO: 19792 - protein, 11 aa, Artificial Sequence
  Peptide Derived from Human Papillomavirus
NKFGLPDSTIY

SEQ ID NO: 19793 - protein, 9 aa, Artificial Sequence
  Peptide Derived from Human Papillomavirus
NKLDDTESA

SEQ ID NO: 19794 - protein, 11 aa, Artificial Sequence
  Peptide Derived from Human Papillomavirus
NKLDDTESAHA

SEQ ID NO: 19795 - protein, 9 aa, Artificial Sequence
  Peptide Derived from Human Papillomavirus
NKPYWLHKA

SEQ ID NO: 19796 - protein, 8 aa, Artificial Sequence
  Peptide Derived from Human Papillomavirus
NKQAVPKV

SEQ ID NO: 19797 - protein, 10 aa, Artificial Sequence
  Peptide Derived from Human Papillomavirus
NKQAVPKVSA

SEQ ID NO: 19798 - protein, 11 aa, Artificial Sequence
  Peptide Derived from Human Papillomavirus
NKQAVPKVSAY

SEQ ID NO: 19799 - protein, 10 aa, Artificial Sequence
  Peptide Derived from Human Papillomavirus
NRAGVMGDTV

SEQ ID NO: 19800 - protein, 8 aa, Artificial Sequence
  Peptide Derived from Human Papillomavirus
PKVSAYQY

SEQ ID NO: 19801 - protein, 10 aa, Artificial Sequence
  Peptide Derived from Human Papillomavirus
PKVSAYQYRV

SEQ ID NO: 19802 - protein, 11 aa, Artificial Sequence
  Peptide Derived from Human Papillomavirus
PKVSAYQYRVF

SEQ ID NO: 19803 - protein, 8 aa, Artificial Sequence
  Peptide Derived from Human Papillomavirus
QRLVWACV

SEQ ID NO: 19804 - protein, 10 aa, Artificial Sequence
  Peptide Derived from Human Papillomavirus
QRLVWACVGM

SEQ ID NO: 19805 - protein, 9 aa, Artificial Sequence
  Peptide Derived from Human Papillomavirus
RHFWNRAGV

SEQ ID NO: 19806 - protein, 10 aa, Artificial Sequence
  Peptide Derived from Human Papillomavirus
RHFWNRAGVM

SEQ ID NO: 19807 - protein, 8 aa, Artificial Sequence
  Peptide Derived from Human Papillomavirus
RHVEEYDL

SEQ ID NO: 19808 - protein, 10 aa, Artificial Sequence
  Peptide Derived from Human Papillomavirus
RHVEEYDLQF

SEQ ID NO: 19809 - protein, 11 aa, Artificial Sequence
  Peptide Derived from Human Papillomavirus
RHVEEYDLQFI

SEQ ID NO: 19810 - protein, 9 aa, Artificial Sequence
  Peptide Derived from Human Papillomavirus
RKFLVQAGL

SEQ ID NO: 19811 - protein, 11 aa, Artificial Sequence
  Peptide Derived from Human Papillomavirus
RKRPAASTSTA

SEQ ID NO: 19812 - protein, 10 aa, Artificial Sequence
  Peptide Derived from Human Papillomavirus
RREQLFARHF

SEQ ID NO: 19813 - protein, 11 aa, Artificial Sequence
  Peptide Derived from Human Papillomavirus
RREQLFARHFW

SEQ ID NO: 19814 - protein, 9 aa, Artificial Sequence
  Peptide Derived from Human Papillomavirus
SRHVEEYDL

SEQ ID NO: 19815 - protein, 11 aa, Artificial Sequence
  Peptide Derived from Human Papillomavirus
SRHVEEYDLQF

SEQ ID NO: 19816 - protein, 10 aa, Artificial Sequence
  Peptide Derived from Human Papillomavirus
SRLLTVGNPY

SEQ ID NO: 19817 - protein, 11 aa, Artificial Sequence
  Peptide Derived from Human Papillomavirus
SRLLTVGNPYF

SEQ ID NO: 19818 - protein, 9 aa, Artificial Sequence
  Peptide Derived from Human Papillomavirus
SRPAKRVRI

SEQ ID NO: 19819 - protein, 9 aa, Artificial Sequence
  Peptide Derived from Human Papillomavirus
SRTSIFYHA

SEQ ID NO: 19820 - protein, 9 aa, Artificial Sequence
  Peptide Derived from Human Papillomavirus
TKCEVPLDI

SEQ ID NO: 19821 - protein, 10 aa, Artificial Sequence
  Peptide Derived from Human Papillomavirus
TKFKHYSRHV

SEQ ID NO: 19822 - protein, 8 aa, Artificial Sequence
  Peptide Derived from Human Papillomavirus
TRSTNLTL

SEQ ID NO: 19823 - protein, 10 aa, Artificial Sequence
  Peptide Derived from Human Papillomavirus
TRSTNLTLCA

SEQ ID NO: 19824 - protein, 9 aa, Artificial Sequence
  Peptide Derived from Human Papillomavirus
VRDNVSVDY

SEQ ID NO: 19825 - protein, 9 aa, Artificial Sequence
  Peptide Derived from Human Papillomavirus
WHNQLFVTV

SEQ ID NO: 19826 - protein, 10 aa, Artificial Sequence
  Peptide Derived from Human Papillomavirus
WHNQLFVTVV

SEQ ID NO: 19827 - protein, 8 aa, Artificial Sequence
  Peptide Derived from Human Papillomavirus
WRPSDSTV

SEQ ID NO: 19828 - protein, 9 aa, Artificial Sequence
  Peptide Derived from Human Papillomavirus
WRPSDSTVY

SEQ ID NO: 19829 - protein, 10 aa, Artificial Sequence
  Peptide Derived from Human Papillomavirus
WRPSDSTVYL

SEQ ID NO: 19830 - protein, 8 aa, Artificial Sequence
  Peptide Derived from Human Papillomavirus
YHAGSSRL

SEQ ID NO: 19831 - protein, 9 aa, Artificial Sequence
  Peptide Derived from Human Papillomavirus
YHAGSSRLL

SEQ ID NO: 19832 - protein, 11 aa, Artificial Sequence
  Peptide Derived from Human Papillomavirus
YHAGSSRLLTV

SEQ ID NO: 19833 - protein, 8 aa, Artificial Sequence
  Peptide Derived from Human Papillomavirus
YKQTQLCI

SEQ ID NO: 19834 - protein, 9 aa, Artificial Sequence
  Peptide Derived from Human Papillomavirus
YKQTQLCIL

SEQ ID NO: 19835 - protein, 8 aa, Artificial Sequence
  Peptide Derived from Human Papillomavirus
YRFVQSVA

SEQ ID NO: 19836 - protein, 9 aa, Artificial Sequence
  Peptide Derived from Human Papillomavirus
YRFVQSVAV

SEQ ID NO: 19837 - protein, 8 aa, Artificial Sequence
  Peptide Derived from Human Papillomavirus
YRVFRVAL

SEQ ID NO: 19838 - protein, 8 aa, Artificial Sequence
  Peptide Derived from Human Papillomavirus
ARRKRASA

SEQ ID NO: 19839 - protein, 11 aa, Artificial Sequence
  Peptide Derived from Human Papillomavirus
ARRKRASATDL

SEQ ID NO: 19840 - protein, 11 aa, Artificial Sequence
  Peptide Derived from Human Papillomavirus
CKQSGTCPPDV

SEQ ID NO: 19841 - protein, 9 aa, Artificial Sequence
  Peptide Derived from Human Papillomavirus
DKILQWSSL

SEQ ID NO: 19842 - protein, 11 aa, Artificial Sequence
  Peptide Derived from Human Papillomavirus
DKILQWSSLGI

SEQ ID NO: 19843 - protein, 8 aa, Artificial Sequence
  Peptide Derived from Human Papillomavirus
GKQIGGRV

SEQ ID NO: 19844 - protein, 10 aa, Artificial Sequence
  Peptide Derived from Human Papillomavirus
GKQIGGRVHF

SEQ ID NO: 19845 - protein, 11 aa, Artificial Sequence
  Peptide Derived from Human Papillomavirus
GKQIGGRVHFY

SEQ ID NO: 19846 - protein, 9 aa, Artificial Sequence
  Peptide Derived from Human Papillomavirus
GRSNTVVDV

SEQ ID NO: 19847 - protein, 8 aa, Artificial Sequence
  Peptide Derived from Human Papillomavirus
GRTGYVPL

SEQ ID NO: 19848 - protein, 9 aa, Artificial Sequence
  Peptide Derived from Human Papillomavirus
GRVHFYHDI

SEQ ID NO: 19849 - protein, 9 aa, Artificial Sequence
  Peptide Derived from Human Papillomavirus
HKSFTYPKY

SEQ ID NO: 19850 - protein, 11 aa, Artificial Sequence
  Peptide Derived from Human Papillomavirus
HKSFTYPKYSL

SEQ ID NO: 19851 - protein, 9 aa, Artificial Sequence
  Peptide Derived from Human Papillomavirus
HRAARRKRA

SEQ ID NO: 19852 - protein, 11 aa, Artificial Sequence
  Peptide Derived from Human Papillomavirus
HRAARRKRASA

SEQ ID NO: 19853 - protein, 8 aa, Artificial Sequence
  Peptide Derived from Human Papillomavirus
IHGTQYYL

SEQ ID NO: 19854 - protein, 9 aa, Artificial Sequence
  Peptide Derived from Human Papillomavirus
IHGTQYYLW

SEQ ID NO: 19855 - protein, 11 aa, Artificial Sequence
  Peptide Derived from Human Papillomavirus
IHGTQYYLWPW

SEQ ID NO: 19856 - protein, 10 aa, Artificial Sequence
  Peptide Derived from Human Papillomavirus
IHKSFTYPKY

SEQ ID NO: 19857 - protein, 8 aa, Artificial Sequence
  Peptide Derived from Human Papillomavirus
IRLHRPAL

SEQ ID NO: 19858 - protein, 8 aa, Artificial Sequence
  Peptide Derived from Human Papillomavirus
KKRKRIPY

SEQ ID NO: 19859 - protein, 9 aa, Artificial Sequence
  Peptide Derived from Human Papillomavirus
KKRKRIPYF

SEQ ID NO: 19860 - protein, 10 aa, Artificial Sequence
  Peptide Derived from Human Papillomavirus
KKRKRIPYFF

SEQ ID NO: 19861 - protein, 11 aa, Artificial Sequence
  Peptide Derived from Human Papillomavirus
KKRKRIPYFFA

SEQ ID NO: 19862 - protein, 8 aa, Artificial Sequence
  Peptide Derived from Human Papillomavirus
KRASATDL

SEQ ID NO: 19863 - protein, 9 aa, Artificial Sequence
  Peptide Derived from Human Papillomavirus
KRASATDLY

SEQ ID NO: 19864 - protein, 8 aa, Artificial Sequence
  Peptide Derived from Human Papillomavirus
KRIPYFFA

SEQ ID NO: 19865 - protein, 11 aa, Artificial Sequence
  Peptide Derived from Human Papillomavirus
KRIPYFFADGF

SEQ ID NO: 19866 - protein, 8 aa, Artificial Sequence
  Peptide Derived from Human Papillomavirus
KRKRIPYF

SEQ ID NO: 19867 - protein, 9 aa, Artificial Sequence
  Peptide Derived from Human Papillomavirus
KRKRIPYFF

SEQ ID NO: 19868 - protein, 10 aa, Artificial Sequence
  Peptide Derived from Human Papillomavirus
KRKRIPYFFA

SEQ ID NO: 19869 - protein, 8 aa, Artificial Sequence
  Peptide Derived from Human Papillomavirus
NKVEGTTL

SEQ ID NO: 19870 - protein, 9 aa, Artificial Sequence
  Peptide Derived from Human Papillomavirus
NKVEGTTLA

SEQ ID NO: 19871 - protein, 9 aa, Artificial Sequence
  Peptide Derived from Human Papillomavirus
PKKRKRIPY

SEQ ID NO: 19872 - protein, 10 aa, Artificial Sequence
  Peptide Derived from Human Papillomavirus
PKKRKRIPYF

SEQ ID NO: 19873 - protein, 11 aa, Artificial Sequence
  Peptide Derived from Human Papillomavirus
PKKRKRIPYFF

SEQ ID NO: 19874 - protein, 11 aa, Artificial Sequence
  Peptide Derived from Human Papillomavirus
PKYSLTMPSTA

SEQ ID NO: 19875 - protein, 11 aa, Artificial Sequence
  Peptide Derived from Human Papillomavirus
PRLYSRANQQV

SEQ ID NO: 19876 - protein, 9 aa, Artificial Sequence
  Peptide Derived from Human Papillomavirus
RKRASATDL

SEQ ID NO: 19877 - protein, 10 aa, Artificial Sequence
  Peptide Derived from Human Papillomavirus
RKRASATDLY

SEQ ID NO: 19878 - protein, 8 aa, Artificial Sequence
  Peptide Derived from Human Papillomavirus
RKRIPYFF

SEQ ID NO: 19879 - protein, 9 aa, Artificial Sequence
  Peptide Derived from Human Papillomavirus
RKRIPYFFA

SEQ ID NO: 19880 - protein, 10 aa, Artificial Sequence
  Peptide Derived from Human Papillomavirus
RRGTVRFSRL

SEQ ID NO: 19881 - protein, 10 aa, Artificial Sequence
  Peptide Derived from Human Papillomavirus
RRKRASATDL

SEQ ID NO: 19882 - protein, 11 aa, Artificial Sequence
  Peptide Derived from Human Papillomavirus
RRKRASATDLY

SEQ ID NO: 19883 - protein, 8 aa, Artificial Sequence
  Peptide Derived from Human Papillomavirus
RRVRGPRL

SEQ ID NO: 19884 - protein, 9 aa, Artificial Sequence
  Peptide Derived from Human Papillomavirus
RRVRGPRLY

SEQ ID NO: 19885 - protein, 9 aa, Artificial Sequence
  Peptide Derived from Human Papillomavirus
SHGYEEIPL

SEQ ID NO: 19886 - protein, 10 aa, Artificial Sequence
  Peptide Derived from Human Papillomavirus
SHRAARRKRA

SEQ ID NO: 19887 - protein, 9 aa, Artificial Sequence
  Peptide Derived from Human Papillomavirus
SRANQQVRV

SEQ ID NO: 19888 - protein, 9 aa, Artificial Sequence
  Peptide Derived from Human Papillomavirus
SRLGQRATM

SEQ ID NO: 19889 - protein, 10 aa, Artificial Sequence
  Peptide Derived from Human Papillomavirus
SRLGQRATMF

SEQ ID NO: 19890 - protein, 8 aa, Artificial Sequence
  Peptide Derived from Human Papillomavirus
SRRGTVRF

SEQ ID NO: 19891 - protein, 11 aa, Artificial Sequence
  Peptide Derived from Human Papillomavirus
SRRGTVRFSRL

SEQ ID NO: 19892 - protein, 9 aa, Artificial Sequence
  Peptide Derived from Human Papillomavirus
THPSSLVTF

SEQ ID NO: 19893 - protein, 10 aa, Artificial Sequence
  Peptide Derived from Human Papillomavirus
TRPPVVIEPV

SEQ ID NO: 19894 - protein, 11 aa, Artificial Sequence
  Peptide Derived from Human Papillomavirus
TRSGKQIGGRV

SEQ ID NO: 19895 - protein, 10 aa, Artificial Sequence
  Peptide Derived from Human Papillomavirus
VHFYHDISPI

SEQ ID NO: 19896 - protein, 11 aa, Artificial Sequence
  Peptide Derived from Human Papillomavirus
VHFYHDISPIA

SEQ ID NO: 19897 - protein, 10 aa, Artificial Sequence
  Peptide Derived from Human Papillomavirus
VRFSRLGQRA

SEQ ID NO: 19898 - protein, 10 aa, Artificial Sequence
  Peptide Derived from Human Papillomavirus
VRGPRLYSRA

SEQ ID NO: 19899 - protein, 9 aa, Artificial Sequence
  Peptide Derived from Human Papillomavirus
VRRVRGPRL

SEQ ID NO: 19900 - protein, 10 aa, Artificial Sequence
  Peptide Derived from Human Papillomavirus
VRRVRGPRLY

SEQ ID NO: 19901 - protein, 8 aa, Artificial Sequence
  Peptide Derived from Human Papillomavirus
VRVSTSQF

SEQ ID NO: 19902 - protein, 9 aa, Artificial Sequence
  Peptide Derived from Human Papillomavirus
VRVSTSQFL

SEQ ID NO: 19903 - protein, 8 aa, Artificial Sequence
  Peptide Derived from Human Papillomavirus
YHDISPIA

SEQ ID NO: 19904 - protein, 9 aa, Artificial Sequence
  Peptide Derived from Human Papillomavirus
YHDISPIAA

SEQ ID NO: 19905 - protein, 9 aa, Artificial Sequence
  Peptide Derived from Human Papillomavirus
AKACSAIEV

SEQ ID NO: 19906 - protein, 11 aa, Artificial Sequence
  Peptide Derived from Human Papillomavirus
AKACSAIEVQI

SEQ ID NO: 19907 - protein, 10 aa, Artificial Sequence
  Peptide Derived from Human Papillomavirus
AKCVTTHTHI

SEQ ID NO: 19908 - protein, 9 aa, Artificial Sequence
  Peptide Derived from Human Papillomavirus
AKKFGCKNI

SEQ ID NO: 19909 - protein, 10 aa, Artificial Sequence
  Peptide Derived from Human Papillomavirus
AKKFGCKNIW

SEQ ID NO: 19910 - protein, 8 aa, Artificial Sequence
  Peptide Derived from Human Papillomavirus
CKAKACSA

SEQ ID NO: 19911 - protein, 9 aa, Artificial Sequence
  Peptide Derived from Human Papillomavirus
CKAKACSAI

SEQ ID NO: 19912 - protein, 11 aa, Artificial Sequence
  Peptide Derived from Human Papillomavirus
CKAKACSAIEV

SEQ ID NO: 19913 - protein, 9 aa, Artificial Sequence
  Peptide Derived from Human Papillomavirus
CKNIWEVHM

SEQ ID NO: 19914 - protein, 8 aa, Artificial Sequence
  Peptide Derived from Human Papillomavirus
CRYNVSPV

SEQ ID NO: 19915 - protein, 11 aa, Artificial Sequence
  Peptide Derived from Human Papillomavirus
CRYNVSPVETV

SEQ ID NO: 19916 - protein, 8 aa, Artificial Sequence
  Peptide Derived from Human Papillomavirus
CRYRFQKY

SEQ ID NO: 19917 - protein, 11 aa, Artificial Sequence
  Peptide Derived from Human Papillomavirus
CRYRFQKYKTL

SEQ ID NO: 19918 - protein, 9 aa, Artificial Sequence
  Peptide Derived from Human Papillomavirus
DKTTPVVHL

SEQ ID NO: 19919 - protein, 8 aa, Artificial Sequence
  Peptide Derived from Human Papillomavirus
FKKEGQHI

SEQ ID NO: 19920 - protein, 10 aa, Artificial Sequence
  Peptide Derived from Human Papillomavirus
FKKEGQHIEV

SEQ ID NO: 19921 - protein, 11 aa, Artificial Sequence
  Peptide Derived from Human Papillomavirus
FKKEGQHIEVW

SEQ ID NO: 19922 - protein, 9 aa, Artificial Sequence
  Peptide Derived from Human Papillomavirus
GHKTYYTDF

SEQ ID NO: 19923 - protein, 11 aa, Artificial Sequence
  Peptide Derived from Human Papillomavirus
GKRPRLRESEF

SEQ ID NO: 19924 - protein, 11 aa, Artificial Sequence
  Peptide Derived from Human Papillomavirus
HKTTTTTSTSV

SEQ ID NO: 19925 - protein, 8 aa, Artificial Sequence
  Peptide Derived from Human Papillomavirus
HKTYYTDF

SEQ ID NO: 19926 - protein, 9 aa, Artificial Sequence
  Peptide Derived from Human Papillomavirus
HRPGKRPRL

SEQ ID NO: 19927 - protein, 11 aa, Artificial Sequence
  Peptide Derived from Human Papillomavirus
KKCFKKEGQHI

SEQ ID NO: 19928 - protein, 9 aa, Artificial Sequence
  Peptide Derived from Human Papillomavirus
KKEGQHIEV

SEQ ID NO: 19929 - protein, 10 aa, Artificial Sequence
  Peptide Derived from Human Papillomavirus
KKEGQHIEVW

SEQ ID NO: 19930 - protein, 11 aa, Artificial Sequence
  Peptide Derived from Human Papillomavirus
KKEGQHIEVWF

SEQ ID NO: 19931 - protein, 8 aa, Artificial Sequence
  Peptide Derived from Human Papillomavirus
KKFGCKNI

SEQ ID NO: 19932 - protein, 9 aa, Artificial Sequence
  Peptide Derived from Human Papillomavirus
KKFGCKNIW

SEQ ID NO: 19933 - protein, 11 aa, Artificial Sequence
  Peptide Derived from Human Papillomavirus
KKFGCKNIWEV

SEQ ID NO: 19934 - protein, 10 aa, Artificial Sequence
  Peptide Derived from Human Papillomavirus
KRPRLRESEF

SEQ ID NO: 19935 - protein, 8 aa, Artificial Sequence
  Peptide Derived from Human Papillomavirus
LKCCRYRF

SEQ ID NO: 19936 - protein, 11 aa, Artificial Sequence
  Peptide Derived from Human Papillomavirus
LKCCRYRFQKY

SEQ ID NO: 19937 - protein, 8 aa, Artificial Sequence
  Peptide Derived from Human Papillomavirus
LKGEPNRL

SEQ ID NO: 19938 - protein, 8 aa, Artificial Sequence
  Peptide Derived from Human Papillomavirus
LRDTCEEL

SEQ ID NO: 19939 - protein, 9 aa, Artificial Sequence
  Peptide Derived from Human Papillomavirus
LRDTCEELW

SEQ ID NO: 19940 - protein, 10 aa, Artificial Sequence
  Peptide Derived from Human Papillomavirus
LRDTCEELWL

SEQ ID NO: 19941 - protein, 10 aa, Artificial Sequence
  Peptide Derived from Human Papillomavirus
NHPGDKTTPV

SEQ ID NO: 19942 - protein, 11 aa, Artificial Sequence
  Peptide Derived from Human Papillomavirus
NHPGDKTTPVV

SEQ ID NO: 19943 - protein, 9 aa, Artificial Sequence
  Peptide Derived from Human Papillomavirus
NKNYSIITI

SEQ ID NO: 19944 - protein, 10 aa, Artificial Sequence
  Peptide Derived from Human Papillomavirus
NKNYSIITII

SEQ ID NO: 19945 - protein, 11 aa, Artificial Sequence
  Peptide Derived from Human Papillomavirus
NKNYSIITIIY

SEQ ID NO: 19946 - protein, 8 aa, Artificial Sequence
  Peptide Derived from Human Papillomavirus
NRLKCCRY

SEQ ID NO: 19947 - protein, 10 aa, Artificial Sequence
  Peptide Derived from Human Papillomavirus
NRLKCCRYRF

SEQ ID NO: 19948 - protein, 8 aa, Artificial Sequence
  Peptide Derived from Human Papillomavirus
PRLRESEF

SEQ ID NO: 19949 - protein, 9 aa, Artificial Sequence
  Peptide Derived from Human Papillomavirus
QKVCSGVDY

SEQ ID NO: 19950 - protein, 8 aa, Artificial Sequence
  Peptide Derived from Human Papillomavirus
QKYKTLFV

SEQ ID NO: 19951 - protein, 10 aa, Artificial Sequence
  Peptide Derived from Human Papillomavirus
QKYKTLFVDV

SEQ ID NO: 19952 - protein, 9 aa, Artificial Sequence
  Peptide Derived from Human Papillomavirus
QRNSFLSHV

SEQ ID NO: 19953 - protein, 11 aa, Artificial Sequence
  Peptide Derived from Human Papillomavirus
QRNSFLSHVKI

SEQ ID NO: 19954 - protein, 10 aa, Artificial Sequence
  Peptide Derived from Human Papillomavirus
SHRPGKRPRL

SEQ ID NO: 19955 - protein, 8 aa, Artificial Sequence
  Peptide Derived from Human Papillomavirus
SHVKIPVV

SEQ ID NO: 19956 - protein, 9 aa, Artificial Sequence
  Peptide Derived from Human Papillomavirus
SHVKIPVVY

SEQ ID NO: 19957 - protein, 11 aa, Artificial Sequence
  Peptide Derived from Human Papillomavirus
SHVKIPVVYRL

SEQ ID NO: 19958 - protein, 8 aa, Artificial Sequence
  Peptide Derived from Human Papillomavirus
SKNNCMQY

SEQ ID NO: 19959 - protein, 9 aa, Artificial Sequence
  Peptide Derived from Human Papillomavirus
SKNNCMQYV

SEQ ID NO: 19960 - protein, 10 aa, Artificial Sequence
  Peptide Derived from Human Papillomavirus
SKNNCMQYVA

SEQ ID NO: 19961 - protein, 11 aa, Artificial Sequence
  Peptide Derived from Human Papillomavirus
SKNNCMQYVAW

SEQ ID NO: 19962 - protein, 9 aa, Artificial Sequence
  Peptide Derived from Human Papillomavirus
SRESHAKCV

SEQ ID NO: 19963 - protein, 8 aa, Artificial Sequence
  Peptide Derived from Human Papillomavirus
VHDGHKTY

SEQ ID NO: 19964 - protein, 9 aa, Artificial Sequence
  Peptide Derived from Human Papillomavirus
VHDGHKTYY

SEQ ID NO: 19965 - protein, 10 aa, Artificial Sequence
  Peptide Derived from Human Papillomavirus
VHLKGEPNRL

SEQ ID NO: 19966 - protein, 8 aa, Artificial Sequence
  Peptide Derived from Human Papillomavirus
VHMENESI

SEQ ID NO: 19967 - protein, 9 aa, Artificial Sequence
  Peptide Derived from Human Papillomavirus
VHMENESIY

SEQ ID NO: 19968 - protein, 9 aa, Artificial Sequence
  Peptide Derived from Human Papillomavirus
VKIPVVYRL

SEQ ID NO: 19969 - protein, 10 aa, Artificial Sequence
  Peptide Derived from Human Papillomavirus
VKIPVVYRLV

SEQ ID NO: 19970 - protein, 11 aa, Artificial Sequence
  Peptide Derived from Human Papillomavirus
VKIPVVYRLVW

SEQ ID NO: 19971 - protein, 11 aa, Artificial Sequence
  Peptide Derived from Human Papillomavirus
YHWTSTDNKNY

SEQ ID NO: 19972 - protein, 10 aa, Artificial Sequence
  Peptide Derived from Human Papillomavirus
YKDETQRNSF

SEQ ID NO: 19973 - protein, 11 aa, Artificial Sequence
  Peptide Derived from Human Papillomavirus
YKDETQRNSFL

SEQ ID NO: 19974 - protein, 8 aa, Artificial Sequence
  Peptide Derived from Human Papillomavirus
YKTLFVDV

SEQ ID NO: 19975 - protein, 9 aa, Artificial Sequence
  Peptide Derived from Human Papillomavirus
YRFQKYKTL

SEQ ID NO: 19976 - protein, 10 aa, Artificial Sequence
  Peptide Derived from Human Papillomavirus
YRFQKYKTLF

SEQ ID NO: 19977 - protein, 11 aa, Artificial Sequence
  Peptide Derived from Human Papillomavirus
YRFQKYKTLFV

SEQ ID NO: 19978 - protein, 9 aa, Artificial Sequence
  Peptide Derived from Human Papillomavirus
AHGWTGSCL

SEQ ID NO: 19979 - protein, 8 aa, Artificial Sequence
  Peptide Derived from Human Papillomavirus
CKKELTRA

SEQ ID NO: 19980 - protein, 10 aa, Artificial Sequence
  Peptide Derived from Human Papillomavirus
CKKELTRAEV

SEQ ID NO: 19981 - protein, 11 aa, Artificial Sequence
  Peptide Derived from Human Papillomavirus
CKKELTRAEVY

SEQ ID NO: 19982 - protein, 8 aa, Artificial Sequence
  Peptide Derived from Human Papillomavirus
CRVCLLFY

SEQ ID NO: 19983 - protein, 11 aa, Artificial Sequence
  Peptide Derived from Human Papillomavirus
CRVCLLFYSKV

SEQ ID NO: 19984 - protein, 8 aa, Artificial Sequence
  Peptide Derived from Human Papillomavirus
DRKRRFHL

SEQ ID NO: 19985 - protein, 9 aa, Artificial Sequence
  Peptide Derived from Human Papillomavirus
DRKRRFHLI

SEQ ID NO: 19986 - protein, 10 aa, Artificial Sequence
  Peptide Derived from Human Papillomavirus
DRKRRFHLIA

SEQ ID NO: 19987 - protein, 9 aa, Artificial Sequence
  Peptide Derived from Human Papillomavirus
ERPRSLHHL

SEQ ID NO: 19988 - protein, 8 aa, Artificial Sequence
  Peptide Derived from Human Papillomavirus
FHLIAHGW

SEQ ID NO: 19989 - protein, 9 aa, Artificial Sequence
  Peptide Derived from Human Papillomavirus
HHLSEVLEI

SEQ ID NO: 19990 - protein, 11 aa, Artificial Sequence
  Peptide Derived from Human Papillomavirus
HHLSEVLEIPL

SEQ ID NO: 19991 - protein, 10 aa, Artificial Sequence
  Peptide Derived from Human Papillomavirus
IRCYRCQSPL

SEQ ID NO: 19992 - protein, 9 aa, Artificial Sequence
  Peptide Derived from Human Papillomavirus
KKELTRAEV

SEQ ID NO: 19993 - protein, 10 aa, Artificial Sequence
  Peptide Derived from Human Papillomavirus
KKELTRAEVY

SEQ ID NO: 19994 - protein, 8 aa, Artificial Sequence
  Peptide Derived from Human Papillomavirus
KKQLCDLL

SEQ ID NO: 19995 - protein, 9 aa, Artificial Sequence
  Peptide Derived from Human Papillomavirus
KKQLCDLLI

SEQ ID NO: 19996 - protein, 8 aa, Artificial Sequence
  Peptide Derived from Human Papillomavirus
KRRFHLIA

SEQ ID NO: 19997 - protein, 11 aa, Artificial Sequence
  Peptide Derived from Human Papillomavirus
KRRFHLIAHGW

SEQ ID NO: 19998 - protein, 9 aa, Artificial Sequence
  Peptide Derived from Human Papillomavirus
LHCDRKRRF

SEQ ID NO: 19999 - protein, 11 aa, Artificial Sequence
  Peptide Derived from Human Papillomavirus
LHCDRKRRFHL

SEQ ID NO: 20000 - protein, 8 aa, Artificial Sequence
  Peptide Derived from Human Papillomavirus
LHHLSEVL

SEQ ID NO: 20001 - protein, 10 aa, Artificial Sequence
  Peptide Derived from Human Papillomavirus
LHHLSEVLEI

SEQ ID NO: 20002 - protein, 9 aa, Artificial Sequence
  Peptide Derived from Human Papillomavirus
LKLVYRDDF

SEQ ID NO: 20003 - protein, 11 aa, Artificial Sequence
  Peptide Derived from Human Papillomavirus
LKLVYRDDFPY

SEQ ID NO: 20004 - protein, 10 aa, Artificial Sequence
  Peptide Derived from Human Papillomavirus
PRSLHHLSEV

SEQ ID NO: 20005 - protein, 11 aa, Artificial Sequence
  Peptide Derived from Human Papillomavirus
PRSLHHLSEVL

SEQ ID NO: 20006 - protein, 8 aa, Artificial Sequence
  Peptide Derived from Human Papillomavirus
RKRRFHLI

SEQ ID NO: 20007 - protein, 9 aa, Artificial Sequence
  Peptide Derived from Human Papillomavirus
RKRRFHLIA

SEQ ID NO: 20008 - protein, 8 aa, Artificial Sequence
  Peptide Derived from Human Papillomavirus
RKYRYYDY

SEQ ID NO: 20009 - protein, 10 aa, Artificial Sequence
  Peptide Derived from Human Papillomavirus
RKYRYYDYSV

SEQ ID NO: 20010 - protein, 11 aa, Artificial Sequence
  Peptide Derived from Human Papillomavirus
RKYRYYDYSVY

SEQ ID NO: 20011 - protein, 10 aa, Artificial Sequence
  Peptide Derived from Human Papillomavirus
RRFHLIAHGW

SEQ ID NO: 20012 - protein, 8 aa, Artificial Sequence
  Peptide Derived from Human Papillomavirus
SKVRKYRY

SEQ ID NO: 20013 - protein, 9 aa, Artificial Sequence
  Peptide Derived from Human Papillomavirus
SKVRKYRYY

SEQ ID NO: 20014 - protein, 11 aa, Artificial Sequence
  Peptide Derived from Human Papillomavirus
SKVRKYRYYDY

SEQ ID NO: 20015 - protein, 9 aa, Artificial Sequence
  Peptide Derived from Human Papillomavirus
SREPRESTV

SEQ ID NO: 20016 - protein, 8 aa, Artificial Sequence
  Peptide Derived from Human Papillomavirus
TKKQLCDL

SEQ ID NO: 20017 - protein, 9 aa, Artificial Sequence
  Peptide Derived from Human Papillomavirus
TKKQLCDLL

SEQ ID NO: 20018 - protein, 10 aa, Artificial Sequence
  Peptide Derived from Human Papillomavirus
TKKQLCDLLI

SEQ ID NO: 20019 - protein, 8 aa, Artificial Sequence
  Peptide Derived from Human Papillomavirus
TRAEVYNF

SEQ ID NO: 20020 - protein, 9 aa, Artificial Sequence
  Peptide Derived from Human Papillomavirus
TRAEVYNFA

SEQ ID NO: 20021 - protein, 9 aa, Artificial Sequence
  Peptide Derived from Human Papillomavirus
VRKYRYYDY

SEQ ID NO: 20022 - protein, 11 aa, Artificial Sequence
  Peptide Derived from Human Papillomavirus
VRKYRYYDYSV

SEQ ID NO: 20023 - protein, 8 aa, Artificial Sequence
  Peptide Derived from Human Papillomavirus
YRDDFPYA

SEQ ID NO: 20024 - protein, 9 aa, Artificial Sequence
  Peptide Derived from Human Papillomavirus
YRDDFPYAV

SEQ ID NO: 20025 - protein, 8 aa, Artificial Sequence
  Peptide Derived from Human Papillomavirus
YRYYDYSV

SEQ ID NO: 20026 - protein, 9 aa, Artificial Sequence
  Peptide Derived from Human Papillomavirus
YRYYDYSVY

SEQ ID NO: 20027 - protein, 11 aa, Artificial Sequence
  Peptide Derived from Human Papillomavirus
YRYYDYSVYGA

SEQ ID NO: 20028 - protein, 8 aa, Artificial Sequence
  Peptide Derived from Human Papillomavirus
AKQHTCYL

SEQ ID NO: 20029 - protein, 9 aa, Artificial Sequence
  Peptide Derived from Human Papillomavirus
AKQHTCYLI

SEQ ID NO: 20030 - protein, 11 aa, Artificial Sequence
  Peptide Derived from Human Papillomavirus
AKQHTCYLIHV

SEQ ID NO: 20031 - protein, 10 aa, Artificial Sequence
  Peptide Derived from Human Papillomavirus
ARQAKQHTCY

SEQ ID NO: 20032 - protein, 11 aa, Artificial Sequence
  Peptide Derived from Human Papillomavirus
ARQAKQHTCYL

SEQ ID NO: 20033 - protein, 9 aa, Artificial Sequence
  Peptide Derived from Human Papillomavirus
CKFVVQLDI

SEQ ID NO: 20034 - protein, 10 aa, Artificial Sequence
  Peptide Derived from Human Papillomavirus
DHLQERPQQA

SEQ ID NO: 20035 - protein, 9 aa, Artificial Sequence
  Peptide Derived from Human Papillomavirus
ERPQQARQA

SEQ ID NO: 20036 - protein, 9 aa, Artificial Sequence
  Peptide Derived from Human Papillomavirus
GKVPTLQDV

SEQ ID NO: 20037 - protein, 10 aa, Artificial Sequence
  Peptide Derived from Human Papillomavirus
GKVPTLQDVV

SEQ ID NO: 20038 - protein, 11 aa, Artificial Sequence
  Peptide Derived from Human Papillomavirus
GKVPTLQDVVL

SEQ ID NO: 20039 - protein, 10 aa, Artificial Sequence
  Peptide Derived from Human Papillomavirus
IHVPCCECKF

SEQ ID NO: 20040 - protein, 11 aa, Artificial Sequence
  Peptide Derived from Human Papillomavirus
IHVPCCECKFV

SEQ ID NO: 20041 - protein, 8 aa, Artificial Sequence
  Peptide Derived from Human Papillomavirus
LRVVQQLL

SEQ ID NO: 20042 - protein, 9 aa, Artificial Sequence
  Peptide Derived from Human Papillomavirus
LRVVQQLLM

SEQ ID NO: 20043 - protein, 11 aa, Artificial Sequence
  Peptide Derived from Human Papillomavirus
LRVVQQLLMGA

SEQ ID NO: 20044 - protein, 8 aa, Artificial Sequence
  Peptide Derived from Human Papillomavirus
MHGKVPTL

SEQ ID NO: 20045 - protein, 11 aa, Artificial Sequence
  Peptide Derived from Human Papillomavirus
MHGKVPTLQDV

SEQ ID NO: 20046 - protein, 9 aa, Artificial Sequence
  Peptide Derived from Human Papillomavirus
QHTCYLIHV

SEQ ID NO: 20047 - protein, 8 aa, Artificial Sequence
  Peptide Derived from Human Papillomavirus
TKEDLRVV

SEQ ID NO: 20048 - protein, 11 aa, Artificial Sequence
  Peptide Derived from Human Papillomavirus
TKEDLRVVQQL

SEQ ID NO: 20049 - protein, 8 aa, Artificial Sequence
  Peptide Derived from Human Papillomavirus
AKYKFWDV

SEQ ID NO: 20050 - protein, 10 aa, Artificial Sequence
  Peptide Derived from Human Papillomavirus
AKYKFWDVNL

SEQ ID NO: 20051 - protein, 8 aa, Artificial Sequence
  Peptide Derived from Human Papillomavirus
ARHYFNRA

SEQ ID NO: 20052 - protein, 11 aa, Artificial Sequence
  Peptide Derived from Human Papillomavirus
ARHYFNRAGKV

SEQ ID NO: 20053 - protein, 8 aa, Artificial Sequence
  Peptide Derived from Human Papillomavirus
ARKINQYL

SEQ ID NO: 20054 - protein, 11 aa, Artificial Sequence
  Peptide Derived from Human Papillomavirus
ARKINQYLRHV

SEQ ID NO: 20055 - protein, 9 aa, Artificial Sequence
  Peptide Derived from Human Papillomavirus
CKITLSAEV

SEQ ID NO: 20056 - protein, 10 aa, Artificial Sequence
  Peptide Derived from Human Papillomavirus
CKITLSAEVM

SEQ ID NO: 20057 - protein, 11 aa, Artificial Sequence
  Peptide Derived from Human Papillomavirus
CKITLSAEVMA

SEQ ID NO: 20058 - protein, 9 aa, Artificial Sequence
  Peptide Derived from Human Papillomavirus
CKYPDYLKM

SEQ ID NO: 20059 - protein, 11 aa, Artificial Sequence
  Peptide Derived from Human Papillomavirus
CKYPDYLKMSA

SEQ ID NO: 20060 - protein, 10 aa, Artificial Sequence
  Peptide Derived from Human Papillomavirus
DKYRYVRSTA

SEQ ID NO: 20061 - protein, 11 aa, Artificial Sequence
  Peptide Derived from Human Papillomavirus
DKYRYVRSTAI

SEQ ID NO: 20062 - protein, 8 aa, Artificial Sequence
  Peptide Derived from Human Papillomavirus
EHWTKGAV

SEQ ID NO: 20063 - protein, 9 aa, Artificial Sequence
  Peptide Derived from Human Papillomavirus
EKQDPLAKY

SEQ ID NO: 20064 - protein, 11 aa, Artificial Sequence
  Peptide Derived from Human Papillomavirus
EKQDPLAKYKF

SEQ ID NO: 20065 - protein, 8 aa, Artificial Sequence
  Peptide Derived from Human Papillomavirus
ERLVWACV

SEQ ID NO: 20066 - protein, 10 aa, Artificial Sequence
  Peptide Derived from Human Papillomavirus
ERLVWACVGL

SEQ ID NO: 20067 - protein, 9 aa, Artificial Sequence
  Peptide Derived from Human Papillomavirus
FKVLQESKA

SEQ ID NO: 20068 - protein, 11 aa, Artificial Sequence
  Peptide Derived from Human Papillomavirus
FKVLQESKAEV

SEQ ID NO: 20069 - protein, 11 aa, Artificial Sequence
  Peptide Derived from Human Papillomavirus
FRVRLPDPNKF

SEQ ID NO: 20070 - protein, 8 aa, Artificial Sequence
  Peptide Derived from Human Papillomavirus
GHNNGICW

SEQ ID NO: 20071 - protein, 8 aa, Artificial Sequence
  Peptide Derived from Human Papillomavirus
GHPLFNRL

SEQ ID NO: 20072 - protein, 8 aa, Artificial Sequence
  Peptide Derived from Human Papillomavirus
GKQTQLCI

SEQ ID NO: 20073 - protein, 9 aa, Artificial Sequence
  Peptide Derived from Human Papillomavirus
GKQTQLCIV

SEQ ID NO: 20074 - protein, 9 aa, Artificial Sequence
  Peptide Derived from Human Papillomavirus
GKVGETIPA

SEQ ID NO: 20075 - protein, 11 aa, Artificial Sequence
  Peptide Derived from Human Papillomavirus
GKVGETIPAEL

SEQ ID NO: 20076 - protein, 9 aa, Artificial Sequence
  Peptide Derived from Human Papillomavirus
GREPPPSSV

SEQ ID NO: 20077 - protein, 10 aa, Artificial Sequence
  Peptide Derived from Human Papillomavirus
GREPPPSSVY

SEQ ID NO: 20078 - protein, 11 aa, Artificial Sequence
  Peptide Derived from Human Papillomavirus
GREPPPSSVYV

SEQ ID NO: 20079 - protein, 8 aa, Artificial Sequence
  Peptide Derived from Human Papillomavirus
GRGQPLGA

SEQ ID NO: 20080 - protein, 10 aa, Artificial Sequence
  Peptide Derived from Human Papillomavirus
GRGQPLGAGL

SEQ ID NO: 20081 - protein, 8 aa, Artificial Sequence
  Peptide Derived from Human Papillomavirus
GRKFLMQL

SEQ ID NO: 20082 - protein, 9 aa, Artificial Sequence
  Peptide Derived from Human Papillomavirus
KRTSIFYHA

SEQ ID NO: 20083 - protein, 8 aa, Artificial Sequence
  Peptide Derived from Human Papillomavirus
LHNMNANL

SEQ ID NO: 20084 - protein, 9 aa, Artificial Sequence
  Peptide Derived from Human Papillomavirus
LHNMNANLL

SEQ ID NO: 20085 - protein, 8 aa, Artificial Sequence
  Peptide Derived from Human Papillomavirus
LHYGLCIF

SEQ ID NO: 20086 - protein, 9 aa, Artificial Sequence
  Peptide Derived from Human Papillomavirus
LHYGLCIFL

SEQ ID NO: 20087 - protein, 11 aa, Artificial Sequence
  Peptide Derived from Human Papillomavirus
LHYGLCIFLDV

SEQ ID NO: 20088 - protein, 8 aa, Artificial Sequence
  Peptide Derived from Human Papillomavirus
LKMSADAY

SEQ ID NO: 20089 - protein, 9 aa, Artificial Sequence
  Peptide Derived from Human Papillomavirus
LRHVEEYEL

SEQ ID NO: 20090 - protein, 11 aa, Artificial Sequence
  Peptide Derived from Human Papillomavirus
LRHVEEYELQF

SEQ ID NO: 20091 - protein, 8 aa, Artificial Sequence
  Peptide Derived from Human Papillomavirus
LRREQLFA

SEQ ID NO: 20092 - protein, 11 aa, Artificial Sequence
  Peptide Derived from Human Papillomavirus
LRREQLFARHY

SEQ ID NO: 20093 - protein, 10 aa, Artificial Sequence
  Peptide Derived from Human Papillomavirus
NKFGLPDTNI

SEQ ID NO: 20094 - protein, 11 aa, Artificial Sequence
  Peptide Derived from Human Papillomavirus
NKFGLPDTNIY

SEQ ID NO: 20095 - protein, 9 aa, Artificial Sequence
  Peptide Derived from Human Papillomavirus
NKPYWLQRA

SEQ ID NO: 20096 - protein, 10 aa, Artificial Sequence
  Peptide Derived from Human Papillomavirus
NKVYLPPTPV

SEQ ID NO: 20097 - protein, 10 aa, Artificial Sequence
  Peptide Derived from Human Papillomavirus
NRAGKVGETI

SEQ ID NO: 20098 - protein, 11 aa, Artificial Sequence
  Peptide Derived from Human Papillomavirus
NRLDDTESSNL

SEQ ID NO: 20099 - protein, 8 aa, Artificial Sequence
  Peptide Derived from Human Papillomavirus
PKVSAYQY

SEQ ID NO: 20100 - protein, 10 aa, Artificial Sequence
  Peptide Derived from Human Papillomavirus
PKVSAYQYRV

SEQ ID NO: 20101 - protein, 11 aa, Artificial Sequence
  Peptide Derived from Human Papillomavirus
PKVSAYQYRVF

SEQ ID NO: 20102 - protein, 10 aa, Artificial Sequence
  Peptide Derived from Human Papillomavirus
QRAQGHNNGI

SEQ ID NO: 20103 - protein, 8 aa, Artificial Sequence
  Peptide Derived from Human Papillomavirus
RHVEEYEL

SEQ ID NO: 20104 - protein, 10 aa, Artificial Sequence
  Peptide Derived from Human Papillomavirus
RHVEEYELQF

SEQ ID NO: 20105 - protein, 11 aa, Artificial Sequence
  Peptide Derived from Human Papillomavirus
RHVEEYELQFV

SEQ ID NO: 20106 - protein, 10 aa, Artificial Sequence
  Peptide Derived from Human Papillomavirus
RHYFNRAGKV

SEQ ID NO: 20107 - protein, 10 aa, Artificial Sequence
  Peptide Derived from Human Papillomavirus
RKINQYLRHV

SEQ ID NO: 20108 - protein, 10 aa, Artificial Sequence
  Peptide Derived from Human Papillomavirus
RREQLFARHY

SEQ ID NO: 20109 - protein, 11 aa, Artificial Sequence
  Peptide Derived from Human Papillomavirus
RREQLFARHYF

SEQ ID NO: 20110 - protein, 9 aa, Artificial Sequence
  Peptide Derived from Human Papillomavirus
SKAEVPLDI

SEQ ID NO: 20111 - protein, 10 aa, Artificial Sequence
  Peptide Derived from Human Papillomavirus
SKAEVPLDIV

SEQ ID NO: 20112 - protein, 9 aa, Artificial Sequence
  Peptide Derived from Human Papillomavirus
SKVVATDSY

SEQ ID NO: 20113 - protein, 10 aa, Artificial Sequence
  Peptide Derived from Human Papillomavirus
SKVVATDSYV

SEQ ID NO: 20114 - protein, 8 aa, Artificial Sequence
  Peptide Derived from Human Papillomavirus
SKYDARKI

SEQ ID NO: 20115 - protein, 11 aa, Artificial Sequence
  Peptide Derived from Human Papillomavirus
SKYDARKINQY

SEQ ID NO: 20116 - protein, 10 aa, Artificial Sequence
  Peptide Derived from Human Papillomavirus
SRLLAVGHPY

SEQ ID NO: 20117 - protein, 11 aa, Artificial Sequence
  Peptide Derived from Human Papillomavirus
SRLLAVGHPYY

SEQ ID NO: 20118 - protein, 9 aa, Artificial Sequence
  Peptide Derived from Human Papillomavirus
TKDNTKTNI

SEQ ID NO: 20119 - protein, 11 aa, Artificial Sequence
  Peptide Derived from Human Papillomavirus
TKGAVCKSTQV

SEQ ID NO: 20120 - protein, 8 aa, Artificial Sequence
  Peptide Derived from Human Papillomavirus
TKTNIPKV

SEQ ID NO: 20121 - protein, 10 aa, Artificial Sequence
  Peptide Derived from Human Papillomavirus
TKTNIPKVSA

SEQ ID NO: 20122 - protein, 11 aa, Artificial Sequence
  Peptide Derived from Human Papillomavirus
TKTNIPKVSAY

SEQ ID NO: 20123 - protein, 8 aa, Artificial Sequence
  Peptide Derived from Human Papillomavirus
TRSKPAVA

SEQ ID NO: 20124 - protein, 8 aa, Artificial Sequence
  Peptide Derived from Human Papillomavirus
TRSTNMTI

SEQ ID NO: 20125 - protein, 11 aa, Artificial Sequence
  Peptide Derived from Human Papillomavirus
TRSTNMTISTA

SEQ ID NO: 20126 - protein, 8 aa, Artificial Sequence
  Peptide Derived from Human Papillomavirus
VKRTSIFY

SEQ ID NO: 20127 - protein, 10 aa, Artificial Sequence
  Peptide Derived from Human Papillomavirus
VKRTSIFYHA

SEQ ID NO: 20128 - protein, 9 aa, Artificial Sequence
  Peptide Derived from Human Papillomavirus
VRLPDPNKF

SEQ ID NO: 20129 - protein, 11 aa, Artificial Sequence
  Peptide Derived from Human Papillomavirus
VRLPDPNKFGL

SEQ ID NO: 20130 - protein, 8 aa, Artificial Sequence
  Peptide Derived from Human Papillomavirus
WRPSENKV

SEQ ID NO: 20131 - protein, 9 aa, Artificial Sequence
  Peptide Derived from Human Papillomavirus
WRPSENKVY

SEQ ID NO: 20132 - protein, 10 aa, Artificial Sequence
  Peptide Derived from Human Papillomavirus
WRPSENKVYL

SEQ ID NO: 20133 - protein, 8 aa, Artificial Sequence
  Peptide Derived from Human Papillomavirus
YHAGSSRL

SEQ ID NO: 20134 - protein, 9 aa, Artificial Sequence
  Peptide Derived from Human Papillomavirus
YHAGSSRLL

SEQ ID NO: 20135 - protein, 10 aa, Artificial Sequence
  Peptide Derived from Human Papillomavirus
YHAGSSRLLA

SEQ ID NO: 20136 - protein, 11 aa, Artificial Sequence
  Peptide Derived from Human Papillomavirus
YHAGSSRLLAV

SEQ ID NO: 20137 - protein, 8 aa, Artificial Sequence
  Peptide Derived from Human Papillomavirus
YKFWDVNL

SEQ ID NO: 20138 - protein, 8 aa, Artificial Sequence
  Peptide Derived from Human Papillomavirus
YRDPPLHY

SEQ ID NO: 20139 - protein, 10 aa, Artificial Sequence
  Peptide Derived from Human Papillomavirus
YRDPPLHYGL

SEQ ID NO: 20140 - protein, 8 aa, Artificial Sequence
  Peptide Derived from Human Papillomavirus
YRVFRVRL

SEQ ID NO: 20141 - protein, 8 aa, Artificial Sequence
  Peptide Derived from Human Papillomavirus
YRYVRSTA

SEQ ID NO: 20142 - protein, 9 aa, Artificial Sequence
  Peptide Derived from Human Papillomavirus
YRYVRSTAI

SEQ ID NO: 20143 - protein, 10 aa, Artificial Sequence
  Peptide Derived from Human Papillomavirus
AHLPIKPSTL

SEQ ID NO: 20144 - protein, 10 aa, Artificial Sequence
  Peptide Derived from Human Papillomavirus
AHRATRRKRA

SEQ ID NO: 20145 - protein, 10 aa, Artificial Sequence
  Peptide Derived from Human Papillomavirus
ARPPIVVESV

SEQ ID NO: 20146 - protein, 9 aa, Artificial Sequence
  Peptide Derived from Human Papillomavirus
ARVHYYYDI

SEQ ID NO: 20147 - protein, 11 aa, Artificial Sequence
  Peptide Derived from Human Papillomavirus
CKLSGTCPEDV

SEQ ID NO: 20148 - protein, 9 aa, Artificial Sequence
  Peptide Derived from Human Papillomavirus
DKILQWGSL

SEQ ID NO: 20149 - protein, 10 aa, Artificial Sequence
  Peptide Derived from Human Papillomavirus
DKILQWGSLF

SEQ ID NO: 20150 - protein, 9 aa, Artificial Sequence
  Peptide Derived from Human Papillomavirus
DRPATLVSA

SEQ ID NO: 20151 - protein, 9 aa, Artificial Sequence
  Peptide Derived from Human Papillomavirus
FRRIAAPRL

SEQ ID NO: 20152 - protein, 10 aa, Artificial Sequence
  Peptide Derived from Human Papillomavirus
FRRIAAPRLY

SEQ ID NO: 20153 - protein, 9 aa, Artificial Sequence
  Peptide Derived from Human Papillomavirus
FRRRRRKRI

SEQ ID NO: 20154 - protein, 11 aa, Artificial Sequence
  Peptide Derived from Human Papillomavirus
FRRRRRKRIPY

SEQ ID NO: 20155 - protein, 8 aa, Artificial Sequence
  Peptide Derived from Human Papillomavirus
GRAGYVPL

SEQ ID NO: 20156 - protein, 9 aa, Artificial Sequence
  Peptide Derived from Human Papillomavirus
HRATRRKRA

SEQ ID NO: 20157 - protein, 11 aa, Artificial Sequence
  Peptide Derived from Human Papillomavirus
HRATRRKRASA

SEQ ID NO: 20158 - protein, 9 aa, Artificial Sequence
  Peptide Derived from Human Papillomavirus
IHSYEEIPM

SEQ ID NO: 20159 - protein, 8 aa, Artificial Sequence
  Peptide Derived from Human Papillomavirus
IKPSTLSF

SEQ ID NO: 20160 - protein, 9 aa, Artificial Sequence
  Peptide Derived from Human Papillomavirus
IKPSTLSFA

SEQ ID NO: 20161 - protein, 8 aa, Artificial Sequence
  Peptide Derived from Human Papillomavirus
KRASATQL

SEQ ID NO: 20162 - protein, 9 aa, Artificial Sequence
  Peptide Derived from Human Papillomavirus
KRASATQLY

SEQ ID NO: 20163 - protein, 8 aa, Artificial Sequence
  Peptide Derived from Human Papillomavirus
KRIPYFFA

SEQ ID NO: 20164 - protein, 8 aa, Artificial Sequence
  Peptide Derived from Human Papillomavirus
NKIEQKTW

SEQ ID NO: 20165 - protein, 9 aa, Artificial Sequence
  Peptide Derived from Human Papillomavirus
NKIEQKTWA

SEQ ID NO: 20166 - protein, 8 aa, Artificial Sequence
  Peptide Derived from Human Papillomavirus
PRLYRKAF

SEQ ID NO: 20167 - protein, 11 aa, Artificial Sequence
  Peptide Derived from Human Papillomavirus
PRLYRKAFQQV

SEQ ID NO: 20168 - protein, 8 aa, Artificial Sequence
  Peptide Derived from Human Papillomavirus
QKTWADKI

SEQ ID NO: 20169 - protein, 9 aa, Artificial Sequence
  Peptide Derived from Human Papillomavirus
QKTWADKIL

SEQ ID NO: 20170 - protein, 11 aa, Artificial Sequence
  Peptide Derived from Human Papillomavirus
QKTWADKILQW

SEQ ID NO: 20171 - protein, 9 aa, Artificial Sequence
  Peptide Derived from Human Papillomavirus
RKAFQQVKV

SEQ ID NO: 20172 - protein, 9 aa, Artificial Sequence
  Peptide Derived from Human Papillomavirus
RKRASATQL

SEQ ID NO: 20173 - protein, 10 aa, Artificial Sequence
  Peptide Derived from Human Papillomavirus
RKRASATQLY

SEQ ID NO: 20174 - protein, 8 aa, Artificial Sequence
  Peptide Derived from Human Papillomavirus
RKRIPYFF

SEQ ID NO: 20175 - protein, 9 aa, Artificial Sequence
  Peptide Derived from Human Papillomavirus
RKRIPYFFA

SEQ ID NO: 20176 - protein, 10 aa, Artificial Sequence
  Peptide Derived from Human Papillomavirus
RRGGVRFSRL

SEQ ID NO: 20177 - protein, 8 aa, Artificial Sequence
  Peptide Derived from Human Papillomavirus
RRGTQIGA

SEQ ID NO: 20178 - protein, 10 aa, Artificial Sequence
  Peptide Derived from Human Papillomavirus
RRGTQIGARV

SEQ ID NO: 20179 - protein, 8 aa, Artificial Sequence
  Peptide Derived from Human Papillomavirus
RRIAAPRL

SEQ ID NO: 20180 - protein, 9 aa, Artificial Sequence
  Peptide Derived from Human Papillomavirus
RRIAAPRLY

SEQ ID NO: 20181 - protein, 10 aa, Artificial Sequence
  Peptide Derived from Human Papillomavirus
RRKRASATQL

SEQ ID NO: 20182 - protein, 11 aa, Artificial Sequence
  Peptide Derived from Human Papillomavirus
RRKRASATQLY

SEQ ID NO: 20183 - protein, 8 aa, Artificial Sequence
  Peptide Derived from Human Papillomavirus
RRKRIPYF

SEQ ID NO: 20184 - protein, 9 aa, Artificial Sequence
  Peptide Derived from Human Papillomavirus
RRKRIPYFF

SEQ ID NO: 20185 - protein, 10 aa, Artificial Sequence
  Peptide Derived from Human Papillomavirus
RRKRIPYFFA

SEQ ID NO: 20186 - protein, 8 aa, Artificial Sequence
  Peptide Derived from Human Papillomavirus
RRRKRIPY

SEQ ID NO: 20187 - protein, 9 aa, Artificial Sequence
  Peptide Derived from Human Papillomavirus
RRRKRIPYF

SEQ ID NO: 20188 - protein, 10 aa, Artificial Sequence
  Peptide Derived from Human Papillomavirus
RRRKRIPYFF

SEQ ID NO: 20189 - protein, 11 aa, Artificial Sequence
  Peptide Derived from Human Papillomavirus
RRRKRIPYFFA

SEQ ID NO: 20190 - protein, 9 aa, Artificial Sequence
  Peptide Derived from Human Papillomavirus
RRRRKRIPY

SEQ ID NO: 20191 - protein, 10 aa, Artificial Sequence
  Peptide Derived from Human Papillomavirus
RRRRKRIPYF

SEQ ID NO: 20192 - protein, 11 aa, Artificial Sequence
  Peptide Derived from Human Papillomavirus
RRRRKRIPYFF

SEQ ID NO: 20193 - protein, 8 aa, Artificial Sequence
  Peptide Derived from Human Papillomavirus
RRRRRKRI

SEQ ID NO: 20194 - protein, 10 aa, Artificial Sequence
  Peptide Derived from Human Papillomavirus
RRRRRKRIPY

SEQ ID NO: 20195 - protein, 11 aa, Artificial Sequence
  Peptide Derived from Human Papillomavirus
RRRRRKRIPYF

SEQ ID NO: 20196 - protein, 9 aa, Artificial Sequence
  Peptide Derived from Human Papillomavirus
SRLGRKATI

SEQ ID NO: 20197 - protein, 9 aa, Artificial Sequence
  Peptide Derived from Human Papillomavirus
SRPSTIVDV

SEQ ID NO: 20198 - protein, 11 aa, Artificial Sequence
  Peptide Derived from Human Papillomavirus
THDVYIQGSSF

SEQ ID NO: 20199 - protein, 8 aa, Artificial Sequence
  Peptide Derived from Human Papillomavirus
THITNPLF

SEQ ID NO: 20200 - protein, 9 aa, Artificial Sequence
  Peptide Derived from Human Papillomavirus
THITNPLFI

SEQ ID NO: 20201 - protein, 8 aa, Artificial Sequence
  Peptide Derived from Human Papillomavirus
TRRGGVRF

SEQ ID NO: 20202 - protein, 11 aa, Artificial Sequence
  Peptide Derived from Human Papillomavirus
TRRGGVRFSRL

SEQ ID NO: 20203 - protein, 9 aa, Artificial Sequence
  Peptide Derived from Human Papillomavirus
TRRGTQIGA

SEQ ID NO: 20204 - protein, 11 aa, Artificial Sequence
  Peptide Derived from Human Papillomavirus
TRRGTQIGARV

SEQ ID NO: 20205 - protein, 8 aa, Artificial Sequence
  Peptide Derived from Human Papillomavirus
TRRKRASA

SEQ ID NO: 20206 - protein, 11 aa, Artificial Sequence
  Peptide Derived from Human Papillomavirus
TRRKRASATQL

SEQ ID NO: 20207 - protein, 9 aa, Artificial Sequence
  Peptide Derived from Human Papillomavirus
VHGSGTEPI

SEQ ID NO: 20208 - protein, 8 aa, Artificial Sequence
  Peptide Derived from Human Papillomavirus
VHVSSTHI

SEQ ID NO: 20209 - protein, 10 aa, Artificial Sequence
  Peptide Derived from Human Papillomavirus
VHYYYDISPI

SEQ ID NO: 20210 - protein, 11 aa, Artificial Sequence
  Peptide Derived from Human Papillomavirus
VHYYYDISPIA

SEQ ID NO: 20211 - protein, 8 aa, Artificial Sequence
  Peptide Derived from Human Papillomavirus
VKVTDPAF

SEQ ID NO: 20212 - protein, 9 aa, Artificial Sequence
  Peptide Derived from Human Papillomavirus
VKVTDPAFL

SEQ ID NO: 20213 - protein, 10 aa, Artificial Sequence
  Peptide Derived from Human Papillomavirus
VRFSRLGRKA

SEQ ID NO: 20214 - protein, 8 aa, Artificial Sequence
  Peptide Derived from Human Papillomavirus
YRKAFQQV

SEQ ID NO: 20215 - protein, 10 aa, Artificial Sequence
  Peptide Derived from Human Papillomavirus
YRKAFQQVKV

SEQ ID NO: 20216 - protein, 11 aa, Artificial Sequence
  Peptide Derived from Human Papillomavirus
AAALYWYKTGI

SEQ ID NO: 20217 - protein, 9 aa, Artificial Sequence
  Peptide Derived from Human Papillomavirus
AAFGLTPSI

SEQ ID NO: 20218 - protein, 10 aa, Artificial Sequence
  Peptide Derived from Human Papillomavirus
AAFGLTPSIA

SEQ ID NO: 20219 - protein, 10 aa, Artificial Sequence
  Peptide Derived from Human Papillomavirus
AALYWYKTGI

SEQ ID NO: 20220 - protein, 10 aa, Artificial Sequence
  Peptide Derived from Human Papillomavirus
AAMLAKFKEL

SEQ ID NO: 20221 - protein, 11 aa, Artificial Sequence
  Peptide Derived from Human Papillomavirus
AAMLAKFKELY

SEQ ID NO: 20222 - protein, 8 aa, Artificial Sequence
  Peptide Derived from Human Papillomavirus
AANTGKSL

SEQ ID NO: 20223 - protein, 9 aa, Artificial Sequence
  Peptide Derived from Human Papillomavirus
AANTGKSLF

SEQ ID NO: 20224 - protein, 11 aa, Artificial Sequence
  Peptide Derived from Human Papillomavirus
AANTGKSLFGM

SEQ ID NO: 20225 - protein, 11 aa, Artificial Sequence
  Peptide Derived from Human Papillomavirus
ASAFLKSNSQA

SEQ ID NO: 20226 - protein, 10 aa, Artificial Sequence
  Peptide Derived from Human Papillomavirus
ATMCRHYKRA

SEQ ID NO: 20227 - protein, 8 aa, Artificial Sequence
  Peptide Derived from Human Papillomavirus
ATVPCWNY

SEQ ID NO: 20228 - protein, 9 aa, Artificial Sequence
  Peptide Derived from Human Papillomavirus
ATVPCWNYI

SEQ ID NO: 20229 - protein, 8 aa, Artificial Sequence
  Peptide Derived from Human Papillomavirus
CATMCRHY

SEQ ID NO: 20230 - protein, 11 aa, Artificial Sequence
  Peptide Derived from Human Papillomavirus
CATMCRHYKRA

SEQ ID NO: 20231 - protein, 8 aa, Artificial Sequence
  Peptide Derived from Human Papillomavirus
CSWGMVVL

SEQ ID NO: 20232 - protein, 9 aa, Artificial Sequence
  Peptide Derived from Human Papillomavirus
CSWGMVVLL

SEQ ID NO: 20233 - protein, 10 aa, Artificial Sequence
  Peptide Derived from Human Papillomavirus
CSWGMVVLLL

SEQ ID NO: 20234 - protein, 11 aa, Artificial Sequence
  Peptide Derived from Human Papillomavirus
CSWGMVVLLLV

SEQ ID NO: 20235 - protein, 8 aa, Artificial Sequence
  Peptide Derived from Human Papillomavirus
CTFELSQM

SEQ ID NO: 20236 - protein, 9 aa, Artificial Sequence
  Peptide Derived from Human Papillomavirus
CTFELSQMV

SEQ ID NO: 20237 - protein, 11 aa, Artificial Sequence
  Peptide Derived from Human Papillomavirus
CTFELSQMVQW

SEQ ID NO: 20238 - protein, 10 aa, Artificial Sequence
  Peptide Derived from Human Papillomavirus
DAKIGMLDDA

SEQ ID NO: 20239 - protein, 9 aa, Artificial Sequence
  Peptide Derived from Human Papillomavirus
DATVPCWNY

SEQ ID NO: 20240 - protein, 10 aa, Artificial Sequence
  Peptide Derived from Human Papillomavirus
DATVPCWNYI

SEQ ID NO: 20241 - protein, 10 aa, Artificial Sequence
  Peptide Derived from Human Papillomavirus
DAVQVLKRKY

SEQ ID NO: 20242 - protein, 11 aa, Artificial Sequence
  Peptide Derived from Human Papillomavirus
DAVQVLKRKYL

SEQ ID NO: 20243 - protein, 8 aa, Artificial Sequence
  Peptide Derived from Human Papillomavirus
DSDTGEDL

SEQ ID NO: 20244 - protein, 9 aa, Artificial Sequence
  Peptide Derived from Human Papillomavirus
DSDTGEDLV

SEQ ID NO: 20245 - protein, 11 aa, Artificial Sequence
  Peptide Derived from Human Papillomavirus
DSDTGEDLVDF

SEQ ID NO: 20246 - protein, 8 aa, Artificial Sequence
  Peptide Derived from Human Papillomavirus
DSEIAYKY

SEQ ID NO: 20247 - protein, 9 aa, Artificial Sequence
  Peptide Derived from Human Papillomavirus
DSEIAYKYA

SEQ ID NO: 20248 - protein, 11 aa, Artificial Sequence
  Peptide Derived from Human Papillomavirus
DSEIAYKYAQL

SEQ ID NO: 20249 - protein, 9 aa, Artificial Sequence
  Peptide Derived from Human Papillomavirus
DSGYGNTEV

SEQ ID NO: 20250 - protein, 10 aa, Artificial Sequence
  Peptide Derived from Human Papillomavirus
DSIKTLLQQY

SEQ ID NO: 20251 - protein, 9 aa, Artificial Sequence
  Peptide Derived from Human Papillomavirus
DSLPTFKCV

SEQ ID NO: 20252 - protein, 11 aa, Artificial Sequence
  Peptide Derived from Human Papillomavirus
DSRWPYLHNRL

SEQ ID NO: 20253 - protein, 9 aa, Artificial Sequence
  Peptide Derived from Human Papillomavirus
DTGEDLVDF

SEQ ID NO: 20254 - protein, 10 aa, Artificial Sequence
  Peptide Derived from Human Papillomavirus
DTGEDLVDFI

SEQ ID NO: 20255 - protein, 11 aa, Artificial Sequence
  Peptide Derived from Human Papillomavirus
DTGEDLVDFIV

SEQ ID NO: 20256 - protein, 8 aa, Artificial Sequence
  Peptide Derived from Human Papillomavirus
DTNSNASA

SEQ ID NO: 20257 - protein, 9 aa, Artificial Sequence
  Peptide Derived from Human Papillomavirus
DTNSNASAF

SEQ ID NO: 20258 - protein, 10 aa, Artificial Sequence
  Peptide Derived from Human Papillomavirus
DTNSNASAFL

SEQ ID NO: 20259 - protein, 11 aa, Artificial Sequence
  Peptide Derived from Human Papillomavirus
DTPEWIQRQTV

SEQ ID NO: 20260 - protein, 8 aa, Artificial Sequence
  Peptide Derived from Human Papillomavirus
EAKQHRDA

SEQ ID NO: 20261 - protein, 9 aa, Artificial Sequence
  Peptide Derived from Human Papillomavirus
EAKQHRDAV

SEQ ID NO: 20262 - protein, 11 aa, Artificial Sequence
  Peptide Derived from Human Papillomavirus
EAKQHRDAVQV

SEQ ID NO: 20263 - protein, 11 aa, Artificial Sequence
  Peptide Derived from Human Papillomavirus
EAVVEKKTGDA

SEQ ID NO: 20264 - protein, 9 aa, Artificial Sequence
  Peptide Derived from Human Papillomavirus
ETAHALFTA

SEQ ID NO: 20265 - protein, 8 aa, Artificial Sequence
  Peptide Derived from Human Papillomavirus
ETETAHAL

SEQ ID NO: 20266 - protein, 9 aa, Artificial Sequence
  Peptide Derived from Human Papillomavirus
ETETAHALF

SEQ ID NO: 20267 - protein, 11 aa, Artificial Sequence
  Peptide Derived from Human Papillomavirus
ETETAHALFTA

SEQ ID NO: 20268 - protein, 9 aa, Artificial Sequence
  Peptide Derived from Human Papillomavirus
ETETPCSQY

SEQ ID NO: 20269 - protein, 10 aa, Artificial Sequence
  Peptide Derived from Human Papillomavirus
ETIEKLLSKL

SEQ ID NO: 20270 - protein, 11 aa, Artificial Sequence
  Peptide Derived from Human Papillomavirus
ETIEKLLSKLL

SEQ ID NO: 20271 - protein, 8 aa, Artificial Sequence
  Peptide Derived from Human Papillomavirus
ETQQMLQV

SEQ ID NO: 20272 - protein, 8 aa, Artificial Sequence
  Peptide Derived from Human Papillomavirus
FSELVRPF

SEQ ID NO: 20273 - protein, 8 aa, Artificial Sequence
  Peptide Derived from Human Papillomavirus
FSRTWSRL

SEQ ID NO: 20274 - protein, 10 aa, Artificial Sequence
  Peptide Derived from Human Papillomavirus
FSRTWSRLSL

SEQ ID NO: 20275 - protein, 9 aa, Artificial Sequence
  Peptide Derived from Human Papillomavirus
FTFPNEFPF

SEQ ID NO: 20276 - protein, 9 aa, Artificial Sequence
  Peptide Derived from Human Papillomavirus
GAANTGKSL

SEQ ID NO: 20277 - protein, 10 aa, Artificial Sequence
  Peptide Derived from Human Papillomavirus
GAANTGKSLF

SEQ ID NO: 20278 - protein, 9 aa, Artificial Sequence
  Peptide Derived from Human Papillomavirus
GSGGGCSQY

SEQ ID NO: 20279 - protein, 8 aa, Artificial Sequence
  Peptide Derived from Human Papillomavirus
GTDSRWPY

SEQ ID NO: 20280 - protein, 9 aa, Artificial Sequence
  Peptide Derived from Human Papillomavirus
GTDSRWPYL

SEQ ID NO: 20281 - protein, 8 aa, Artificial Sequence
  Peptide Derived from Human Papillomavirus
GTGCNGWF

SEQ ID NO: 20282 - protein, 9 aa, Artificial Sequence
  Peptide Derived from Human Papillomavirus
GTGCNGWFY

SEQ ID NO: 20283 - protein, 10 aa, Artificial Sequence
  Peptide Derived from Human Papillomavirus
GTGCNGWFYV

SEQ ID NO: 20284 - protein, 9 aa, Artificial Sequence
  Peptide Derived from Human Papillomavirus
HALFTAQEA

SEQ ID NO: 20285 - protein, 8 aa, Artificial Sequence
  Peptide Derived from Human Papillomavirus
HSFNDCTF

SEQ ID NO: 20286 - protein, 10 aa, Artificial Sequence
  Peptide Derived from Human Papillomavirus
HSFNDCTFEL

SEQ ID NO: 20287 - protein, 8 aa, Artificial Sequence
  Peptide Derived from Human Papillomavirus
HTICQTPL

SEQ ID NO: 20288 - protein, 11 aa, Artificial Sequence
  Peptide Derived from Human Papillomavirus
HTICQTPLTNI

SEQ ID NO: 20289 - protein, 10 aa, Artificial Sequence
  Peptide Derived from Human Papillomavirus
IAAFGLTPSI

SEQ ID NO: 20290 - protein, 11 aa, Artificial Sequence
  Peptide Derived from Human Papillomavirus
IAAFGLTPSIA

SEQ ID NO: 20291 - protein, 8 aa, Artificial Sequence
  Peptide Derived from Human Papillomavirus
IADSIKTL

SEQ ID NO: 20292 - protein, 9 aa, Artificial Sequence
  Peptide Derived from Human Papillomavirus
IADSIKTLL

SEQ ID NO: 20293 - protein, 8 aa, Artificial Sequence
  Peptide Derived from Human Papillomavirus
IAYKYAQL

SEQ ID NO: 20294 - protein, 9 aa, Artificial Sequence
  Peptide Derived from Human Papillomavirus
IAYKYAQLA

SEQ ID NO: 20295 - protein, 11 aa, Artificial Sequence
  Peptide Derived from Human Papillomavirus
ISEVYGDTPEW

SEQ ID NO: 20296 - protein, 9 aa, Artificial Sequence
  Peptide Derived from Human Papillomavirus
ISGCVDNNI

SEQ ID NO: 20297 - protein, 8 aa, Artificial Sequence
  Peptide Derived from Human Papillomavirus
ISNISEVY

SEQ ID NO: 20298 - protein, 8 aa, Artificial Sequence
  Peptide Derived from Human Papillomavirus
ISPRLKAI

SEQ ID NO: 20299 - protein, 10 aa, Artificial Sequence
  Peptide Derived from Human Papillomavirus
ISPRLKAICI

SEQ ID NO: 20300 - protein, 8 aa, Artificial Sequence
  Peptide Derived from Human Papillomavirus
KAAMLAKF

SEQ ID NO: 20301 - protein, 11 aa, Artificial Sequence
  Peptide Derived from Human Papillomavirus
KAAMLAKFKEL

SEQ ID NO: 20302 - protein, 11 aa, Artificial Sequence
  Peptide Derived from Human Papillomavirus
KAICIEKQSRA

SEQ ID NO: 20303 - protein, 8 aa, Artificial Sequence
  Peptide Derived from Human Papillomavirus
KSFFSRTW

SEQ ID NO: 20304 - protein, 11 aa, Artificial Sequence
  Peptide Derived from Human Papillomavirus
KSFFSRTWSRL

SEQ ID NO: 20305 - protein, 9 aa, Artificial Sequence
  Peptide Derived from Human Papillomavirus
KSHFWLQPL

SEQ ID NO: 20306 - protein, 10 aa, Artificial Sequence
  Peptide Derived from Human Papillomavirus
KSHFWLQPLA

SEQ ID NO: 20307 - protein, 8 aa, Artificial Sequence
  Peptide Derived from Human Papillomavirus
KSLFGMSL

SEQ ID NO: 20308 - protein, 9 aa, Artificial Sequence
  Peptide Derived from Human Papillomavirus
KSLFGMSLM

SEQ ID NO: 20309 - protein, 11 aa, Artificial Sequence
  Peptide Derived from Human Papillomavirus
KSLFGMSLMKF

SEQ ID NO: 20310 - protein, 10 aa, Artificial Sequence
  Peptide Derived from Human Papillomavirus
KSNKSTCCDW

SEQ ID NO: 20311 - protein, 8 aa, Artificial Sequence
  Peptide Derived from Human Papillomavirus
KSNSQAKI

SEQ ID NO: 20312 - protein, 9 aa, Artificial Sequence
  Peptide Derived from Human Papillomavirus
KSNSQAKIV

SEQ ID NO: 20313 - protein, 9 aa, Artificial Sequence
  Peptide Derived from Human Papillomavirus
KSTCCDWCI

SEQ ID NO: 20314 - protein, 10 aa, Artificial Sequence
  Peptide Derived from Human Papillomavirus
KSTCCDWCIA

SEQ ID NO: 20315 - protein, 11 aa, Artificial Sequence
  Peptide Derived from Human Papillomavirus
KSTCCDWCIAA

SEQ ID NO: 20316 - protein, 10 aa, Artificial Sequence
  Peptide Derived from Human Papillomavirus
KTGISNISEV

SEQ ID NO: 20317 - protein, 11 aa, Artificial Sequence
  Peptide Derived from Human Papillomavirus
KTGISNISEVY

SEQ ID NO: 20318 - protein, 9 aa, Artificial Sequence
  Peptide Derived from Human Papillomavirus
KTLLQQYCL

SEQ ID NO: 20319 - protein, 10 aa, Artificial Sequence
  Peptide Derived from Human Papillomavirus
KTLLQQYCLY

SEQ ID NO: 20320 - protein, 11 aa, Artificial Sequence
  Peptide Derived from Human Papillomavirus
KTLLQQYCLYL

SEQ ID NO: 20321 - protein, 8 aa, Artificial Sequence
  Peptide Derived from Human Papillomavirus
KTSNAKAA

SEQ ID NO: 20322 - protein, 9 aa, Artificial Sequence
  Peptide Derived from Human Papillomavirus
KTSNAKAAM

SEQ ID NO: 20323 - protein, 10 aa, Artificial Sequence
  Peptide Derived from Human Papillomavirus
KTSNAKAAML

SEQ ID NO: 20324 - protein, 11 aa, Artificial Sequence
  Peptide Derived from Human Papillomavirus
KTSNAKAAMLA

SEQ ID NO: 20325 - protein, 8 aa, Artificial Sequence
  Peptide Derived from Human Papillomavirus
LACSWGMV

SEQ ID NO: 20326 - protein, 9 aa, Artificial Sequence
  Peptide Derived from Human Papillomavirus
LACSWGMVV

SEQ ID NO: 20327 - protein, 10 aa, Artificial Sequence
  Peptide Derived from Human Papillomavirus
LACSWGMVVL

SEQ ID NO: 20328 - protein, 11 aa, Artificial Sequence
  Peptide Derived from Human Papillomavirus
LACSWGMVVLL

SEQ ID NO: 20329 - protein, 8 aa, Artificial Sequence
  Peptide Derived from Human Papillomavirus
LADAKIGM

SEQ ID NO: 20330 - protein, 9 aa, Artificial Sequence
  Peptide Derived from Human Papillomavirus
LADAKIGML

SEQ ID NO: 20331 - protein, 8 aa, Artificial Sequence
  Peptide Derived from Human Papillomavirus
LADTNSNA

SEQ ID NO: 20332 - protein, 10 aa, Artificial Sequence
  Peptide Derived from Human Papillomavirus
LADTNSNASA

SEQ ID NO: 20333 - protein, 11 aa, Artificial Sequence
  Peptide Derived from Human Papillomavirus
LADTNSNASAF

SEQ ID NO: 20334 - protein, 8 aa, Artificial Sequence
  Peptide Derived from Human Papillomavirus
LAKFKELY

SEQ ID NO: 20335 - protein, 10 aa, Artificial Sequence
  Peptide Derived from Human Papillomavirus
LAKFKELYGV

SEQ ID NO: 20336 - protein, 8 aa, Artificial Sequence
  Peptide Derived from Human Papillomavirus
LSDISGCV

SEQ ID NO: 20337 - protein, 10 aa, Artificial Sequence
  Peptide Derived from Human Papillomavirus
LSKLLCVSPM

SEQ ID NO: 20338 - protein, 8 aa, Artificial Sequence
  Peptide Derived from Human Papillomavirus
LSQMVQWA

SEQ ID NO: 20339 - protein, 9 aa, Artificial Sequence
  Peptide Derived from Human Papillomavirus
LSQMVQWAY

SEQ ID NO: 20340 - protein, 8 aa, Artificial Sequence
  Peptide Derived from Human Papillomavirus
LTALKRFL

SEQ ID NO: 20341 - protein, 11 aa, Artificial Sequence
  Peptide Derived from Human Papillomavirus
LTALKRFLQGI

SEQ ID NO: 20342 - protein, 8 aa, Artificial Sequence
  Peptide Derived from Human Papillomavirus
LTNILNVL

SEQ ID NO: 20343 - protein, 9 aa, Artificial Sequence
  Peptide Derived from Human Papillomavirus
LTPSIADSI

SEQ ID NO: 20344 - protein, 9 aa, Artificial Sequence
  Peptide Derived from Human Papillomavirus
LTQAETETA

SEQ ID NO: 20345 - protein, 11 aa, Artificial Sequence
  Peptide Derived from Human Papillomavirus
LTQAETETAHA

SEQ ID NO: 20346 - protein, 10 aa, Artificial Sequence
  Peptide Derived from Human Papillomavirus
MSFLTALKRF

SEQ ID NO: 20347 - protein, 11 aa, Artificial Sequence
  Peptide Derived from Human Papillomavirus
MSFLTALKRFL

SEQ ID NO: 20348 - protein, 11 aa, Artificial Sequence
  Peptide Derived from Human Papillomavirus
MSLMKFLQGSV

SEQ ID NO: 20349 - protein, 9 aa, Artificial Sequence
  Peptide Derived from Human Papillomavirus
MSMSQWIKY

SEQ ID NO: 20350 - protein, 8 aa, Artificial Sequence
  Peptide Derived from Human Papillomavirus
NAGTDSRW

SEQ ID NO: 20351 - protein, 10 aa, Artificial Sequence
  Peptide Derived from Human Papillomavirus
NAGTDSRWPY

SEQ ID NO: 20352 - protein, 11 aa, Artificial Sequence
  Peptide Derived from Human Papillomavirus
NAGTDSRWPYL

SEQ ID NO: 20353 - protein, 8 aa, Artificial Sequence
  Peptide Derived from Human Papillomavirus
NAKAAMLA

SEQ ID NO: 20354 - protein, 10 aa, Artificial Sequence
  Peptide Derived from Human Papillomavirus
NAKAAMLAKF

SEQ ID NO: 20355 - protein, 8 aa, Artificial Sequence
  Peptide Derived from Human Papillomavirus
NALDGNLV

SEQ ID NO: 20356 - protein, 10 aa, Artificial Sequence
  Peptide Derived from Human Papillomavirus
NALDGNLVSM

SEQ ID NO: 20357 - protein, 8 aa, Artificial Sequence
  Peptide Derived from Human Papillomavirus
NSKSHFWL

SEQ ID NO: 20358 - protein, 11 aa, Artificial Sequence
  Peptide Derived from Human Papillomavirus
NSKSHFWLQPL

SEQ ID NO: 20359 - protein, 8 aa, Artificial Sequence
  Peptide Derived from Human Papillomavirus
NSNASAFL

SEQ ID NO: 20360 - protein, 11 aa, Artificial Sequence
  Peptide Derived from Human Papillomavirus
NSQAKIVKDCA

SEQ ID NO: 20361 - protein, 9 aa, Artificial Sequence
  Peptide Derived from Human Papillomavirus
NTEVETQQM

SEQ ID NO: 20362 - protein, 10 aa, Artificial Sequence
  Peptide Derived from Human Papillomavirus
NTEVETQQML

SEQ ID NO: 20363 - protein, 9 aa, Artificial Sequence
  Peptide Derived from Human Papillomavirus
NTGKSLFGM

SEQ ID NO: 20364 - protein, 11 aa, Artificial Sequence
  Peptide Derived from Human Papillomavirus
NTGKSLFGMSL

SEQ ID NO: 20365 - protein, 10 aa, Artificial Sequence
  Peptide Derived from Human Papillomavirus
PSIADSIKTL

SEQ ID NO: 20366 - protein, 11 aa, Artificial Sequence
  Peptide Derived from Human Papillomavirus
PSIADSIKTLL

SEQ ID NO: 20367 - protein, 9 aa, Artificial Sequence
  Peptide Derived from Human Papillomavirus
QAETETAHA

SEQ ID NO: 20368 - protein, 10 aa, Artificial Sequence
  Peptide Derived from Human Papillomavirus
QAETETAHAL

SEQ ID NO: 20369 - protein, 11 aa, Artificial Sequence
  Peptide Derived from Human Papillomavirus
QAETETAHALF

SEQ ID NO: 20370 - protein, 9 aa, Artificial Sequence
  Peptide Derived from Human Papillomavirus
QAKIVKDCA

SEQ ID NO: 20371 - protein, 11 aa, Artificial Sequence
  Peptide Derived from Human Papillomavirus
QAKIVKDCATM

SEQ ID NO: 20372 - protein, 9 aa, Artificial Sequence
  Peptide Derived from Human Papillomavirus
QSLACSWGM

SEQ ID NO: 20373 - protein, 10 aa, Artificial Sequence
  Peptide Derived from Human Papillomavirus
QSLACSWGMV

SEQ ID NO: 20374 - protein, 11 aa, Artificial Sequence
  Peptide Derived from Human Papillomavirus
QSLACSWGMVV

SEQ ID NO: 20375 - protein, 9 aa, Artificial Sequence
  Peptide Derived from Human Papillomavirus
QSRAAKRRL

SEQ ID NO: 20376 - protein, 10 aa, Artificial Sequence
  Peptide Derived from Human Papillomavirus
QSRAAKRRLF

SEQ ID NO: 20377 - protein, 8 aa, Artificial Sequence
  Peptide Derived from Human Papillomavirus
QTPLTNIL

SEQ ID NO: 20378 - protein, 10 aa, Artificial Sequence
  Peptide Derived from Human Papillomavirus
QTPLTNILNV

SEQ ID NO: 20379 - protein, 11 aa, Artificial Sequence
  Peptide Derived from Human Papillomavirus
QTPLTNILNVL

SEQ ID NO: 20380 - protein, 8 aa, Artificial Sequence
  Peptide Derived from Human Papillomavirus
QTVLQHSF

SEQ ID NO: 20381 - protein, 8 aa, Artificial Sequence
  Peptide Derived from Human Papillomavirus
RAAKRRLF

SEQ ID NO: 20382 - protein, 9 aa, Artificial Sequence
  Peptide Derived from Human Papillomavirus
RAEKKQMSM

SEQ ID NO: 20383 - protein, 8 aa, Artificial Sequence
  Peptide Derived from Human Papillomavirus
RSTAAALY

SEQ ID NO: 20384 - protein, 9 aa, Artificial Sequence
  Peptide Derived from Human Papillomavirus
RSTAAALYW

SEQ ID NO: 20385 - protein, 10 aa, Artificial Sequence
  Peptide Derived from Human Papillomavirus
RSTAAALYWY

SEQ ID NO: 20386 - protein, 8 aa, Artificial Sequence
  Peptide Derived from Human Papillomavirus
RTWSRLSL

SEQ ID NO: 20387 - protein, 10 aa, Artificial Sequence
  Peptide Derived from Human Papillomavirus
SAFLKSNSQA

SEQ ID NO: 20388 - protein, 9 aa, Artificial Sequence
  Peptide Derived from Human Papillomavirus
SSGSGGEGV

SEQ ID NO: 20389 - protein, 8 aa, Artificial Sequence
  Peptide Derived from Human Papillomavirus
STAAALYW

SEQ ID NO: 20390 - protein, 9 aa, Artificial Sequence
  Peptide Derived from Human Papillomavirus
STAAALYWY

SEQ ID NO: 20391 - protein, 8 aa, Artificial Sequence
  Peptide Derived from Human Papillomavirus
STCCDWCI

SEQ ID NO: 20392 - protein, 9 aa, Artificial Sequence
  Peptide Derived from Human Papillomavirus
STCCDWCIA

SEQ ID NO: 20393 - protein, 10 aa, Artificial Sequence
  Peptide Derived from Human Papillomavirus
STCCDWCIAA

SEQ ID NO: 20394 - protein, 11 aa, Artificial Sequence
  Peptide Derived from Human Papillomavirus
STCCDWCIAAF

SEQ ID NO: 20395 - protein, 8 aa, Artificial Sequence
  Peptide Derived from Human Papillomavirus
TAAALYWY

SEQ ID NO: 20396 - protein, 8 aa, Artificial Sequence
  Peptide Derived from Human Papillomavirus
TAHALFTA

SEQ ID NO: 20397 - protein, 11 aa, Artificial Sequence
  Peptide Derived from Human Papillomavirus
TAHALFTAQEA

SEQ ID NO: 20398 - protein, 10 aa, Artificial Sequence
  Peptide Derived from Human Papillomavirus
TALKRFLQGI

SEQ ID NO: 20399 - protein, 11 aa, Artificial Sequence
  Peptide Derived from Human Papillomavirus
TAQEAKQHRDA

SEQ ID NO: 20400 - protein, 8 aa, Artificial Sequence
  Peptide Derived from Human Papillomavirus
TSNAKAAM

SEQ ID NO: 20401 - protein, 9 aa, Artificial Sequence
  Peptide Derived from Human Papillomavirus
TSNAKAAML

SEQ ID NO: 20402 - protein, 10 aa, Artificial Sequence
  Peptide Derived from Human Papillomavirus
TSNAKAAMLA

SEQ ID NO: 20403 - protein, 10 aa, Artificial Sequence
  Peptide Derived from Human Papillomavirus
VSFSELVRPF

SEQ ID NO: 20404 - protein, 9 aa, Artificial Sequence
  Peptide Derived from Human Papillomavirus
VSGQNTNTL

SEQ ID NO: 20405 - protein, 10 aa, Artificial Sequence
  Peptide Derived from Human Papillomavirus
VSMDVKHRPL

SEQ ID NO: 20406 - protein, 11 aa, Artificial Sequence
  Peptide Derived from Human Papillomavirus
VSMDVKHRPLV

SEQ ID NO: 20407 - protein, 11 aa, Artificial Sequence
  Peptide Derived from Human Papillomavirus
VSPLSDISGCV

SEQ ID NO: 20408 - protein, 8 aa, Artificial Sequence
  Peptide Derived from Human Papillomavirus
VSPMCMMI

SEQ ID NO: 20409 - protein, 8 aa, Artificial Sequence
  Peptide Derived from Human Papillomavirus
WAYDNDIV

SEQ ID NO: 20410 - protein, 11 aa, Artificial Sequence
  Peptide Derived from Human Papillomavirus
YAQLADTNSNA

SEQ ID NO: 20411 - protein, 10 aa, Artificial Sequence
  Peptide Derived from Human Papillomavirus
YSSGSGGEGV

SEQ ID NO: 20412 - protein, 8 aa, Artificial Sequence
  Peptide Derived from Human Papillomavirus
AATHTKAV

SEQ ID NO: 20413 - protein, 9 aa, Artificial Sequence
  Peptide Derived from Human Papillomavirus
AATHTKAVA

SEQ ID NO: 20414 - protein, 10 aa, Artificial Sequence
  Peptide Derived from Human Papillomavirus
AATHTKAVAL

SEQ ID NO: 20415 - protein, 10 aa, Artificial Sequence
  Peptide Derived from Human Papillomavirus
ASVTVVEGQV

SEQ ID NO: 20416 - protein, 8 aa, Artificial Sequence
  Peptide Derived from Human Papillomavirus
ATHTKAVA

SEQ ID NO: 20417 - protein, 9 aa, Artificial Sequence
  Peptide Derived from Human Papillomavirus
ATHTKAVAL

SEQ ID NO: 20418 - protein, 10 aa, Artificial Sequence
  Peptide Derived from Human Papillomavirus
CAIYYKAREM

SEQ ID NO: 20419 - protein, 11 aa, Artificial Sequence
  Peptide Derived from Human Papillomavirus
CTLYTAVSSTW

SEQ ID NO: 20420 - protein, 10 aa, Artificial Sequence
  Peptide Derived from Human Papillomavirus
DAEKYSKNKV

SEQ ID NO: 20421 - protein, 11 aa, Artificial Sequence
  Peptide Derived from Human Papillomavirus
DAEKYSKNKVW

SEQ ID NO: 20422 - protein, 8 aa, Artificial Sequence
  Peptide Derived from Human Papillomavirus
DANTLKCL

SEQ ID NO: 20423 - protein, 10 aa, Artificial Sequence
  Peptide Derived from Human Papillomavirus
DANTLKCLRY

SEQ ID NO: 20424 - protein, 8 aa, Artificial Sequence
  Peptide Derived from Human Papillomavirus
DSAPILTA

SEQ ID NO: 20425 - protein, 9 aa, Artificial Sequence
  Peptide Derived from Human Papillomavirus
DSAPILTAF

SEQ ID NO: 20426 - protein, 9 aa, Artificial Sequence
  Peptide Derived from Human Papillomavirus
DSEWQRDQF

SEQ ID NO: 20427 - protein, 10 aa, Artificial Sequence
  Peptide Derived from Human Papillomavirus
DSEWQRDQFL

SEQ ID NO: 20428 - protein, 9 aa, Artificial Sequence
  Peptide Derived from Human Papillomavirus
DSTDLRDHI

SEQ ID NO: 20429 - protein, 11 aa, Artificial Sequence
  Peptide Derived from Human Papillomavirus
DSTDLRDHIDY

SEQ ID NO: 20430 - protein, 8 aa, Artificial Sequence
  Peptide Derived from Human Papillomavirus
DSVDSAPI

SEQ ID NO: 20431 - protein, 9 aa, Artificial Sequence
  Peptide Derived from Human Papillomavirus
DSVDSAPIL

SEQ ID NO: 20432 - protein, 11 aa, Artificial Sequence
  Peptide Derived from Human Papillomavirus
DSVDSAPILTA

SEQ ID NO: 20433 - protein, 11 aa, Artificial Sequence
  Peptide Derived from Human Papillomavirus
DTGNPCHTTKL

SEQ ID NO: 20434 - protein, 11 aa, Artificial Sequence
  Peptide Derived from Human Papillomavirus
EASVTVVEGQV

SEQ ID NO: 20435 - protein, 8 aa, Artificial Sequence
  Peptide Derived from Human Papillomavirus
ETIYNSQY

SEQ ID NO: 20436 - protein, 9 aa, Artificial Sequence
  Peptide Derived from Human Papillomavirus
ETLCQRLNV

SEQ ID NO: 20437 - protein, 11 aa, Artificial Sequence
  Peptide Derived from Human Papillomavirus
FSSNEVSSPEI

SEQ ID NO: 20438 - protein, 9 aa, Artificial Sequence
  Peptide Derived from Human Papillomavirus
GTEETQTTI

SEQ ID NO: 20439 - protein, 8 aa, Artificial Sequence
  Peptide Derived from Human Papillomavirus
HAGGQVIL

SEQ ID NO: 20440 - protein, 11 aa, Artificial Sequence
  Peptide Derived from Human Papillomavirus
HTTKLLHRDSV

SEQ ID NO: 20441 - protein, 8 aa, Artificial Sequence
  Peptide Derived from Human Papillomavirus
ITVSTGFM

SEQ ID NO: 20442 - protein, 10 aa, Artificial Sequence
  Peptide Derived from Human Papillomavirus
ITVSTGFMSI

SEQ ID NO: 20443 - protein, 8 aa, Artificial Sequence
  Peptide Derived from Human Papillomavirus
KALQAIEL

SEQ ID NO: 20444 - protein, 10 aa, Artificial Sequence
  Peptide Derived from Human Papillomavirus
KALQAIELQL

SEQ ID NO: 20445 - protein, 10 aa, Artificial Sequence
  Peptide Derived from Human Papillomavirus
KAREMGFKHI

SEQ ID NO: 20446 - protein, 9 aa, Artificial Sequence
  Peptide Derived from Human Papillomavirus
KSAIVTLTY

SEQ ID NO: 20447 - protein, 9 aa, Artificial Sequence
  Peptide Derived from Human Papillomavirus
KTITVSTGF

SEQ ID NO: 20448 - protein, 10 aa, Artificial Sequence
  Peptide Derived from Human Papillomavirus
KTITVSTGFM

SEQ ID NO: 20449 - protein, 8 aa, Artificial Sequence
  Peptide Derived from Human Papillomavirus
LAVSKNKA

SEQ ID NO: 20450 - protein, 9 aa, Artificial Sequence
  Peptide Derived from Human Papillomavirus
LAVSKNKAL

SEQ ID NO: 20451 - protein, 11 aa, Artificial Sequence
  Peptide Derived from Human Papillomavirus
LAVSKNKALQA

SEQ ID NO: 20452 - protein, 10 aa, Artificial Sequence
  Peptide Derived from Human Papillomavirus
LSQVKIPKTI

SEQ ID NO: 20453 - protein, 8 aa, Artificial Sequence
  Peptide Derived from Human Papillomavirus
LTAPTGCI

SEQ ID NO: 20454 - protein, 11 aa, Artificial Sequence
  Peptide Derived from Human Papillomavirus
LTHYENDSTDL

SEQ ID NO: 20455 - protein, 11 aa, Artificial Sequence
  Peptide Derived from Human Papillomavirus
LTLETIYNSQY

SEQ ID NO: 20456 - protein, 8 aa, Artificial Sequence
  Peptide Derived from Human Papillomavirus
NSNTTPIV

SEQ ID NO: 20457 - protein, 10 aa, Artificial Sequence
  Peptide Derived from Human Papillomavirus
NSNTTPIVHL

SEQ ID NO: 20458 - protein, 9 aa, Artificial Sequence
  Peptide Derived from Human Papillomavirus
NSQYSNEKW

SEQ ID NO: 20459 - protein, 11 aa, Artificial Sequence
  Peptide Derived from Human Papillomavirus
NSQYSNEKWTL

SEQ ID NO: 20460 - protein, 8 aa, Artificial Sequence
  Peptide Derived from Human Papillomavirus
NSSHKGRI

SEQ ID NO: 20461 - protein, 8 aa, Artificial Sequence
  Peptide Derived from Human Papillomavirus
NTLKCLRY

SEQ ID NO: 20462 - protein, 10 aa, Artificial Sequence
  Peptide Derived from Human Papillomavirus
NTLKCLRYRF

SEQ ID NO: 20463 - protein, 8 aa, Artificial Sequence
  Peptide Derived from Human Papillomavirus
NTMHYTNW

SEQ ID NO: 20464 - protein, 11 aa, Artificial Sequence
  Peptide Derived from Human Papillomavirus
NTMHYTNWTHI

SEQ ID NO: 20465 - protein, 8 aa, Artificial Sequence
  Peptide Derived from Human Papillomavirus
NTTPIVHL

SEQ ID NO: 20466 - protein, 8 aa, Artificial Sequence
  Peptide Derived from Human Papillomavirus
PAATHTKA

SEQ ID NO: 20467 - protein, 9 aa, Artificial Sequence
  Peptide Derived from Human Papillomavirus
PAATHTKAV

SEQ ID NO: 20468 - protein, 10 aa, Artificial Sequence
  Peptide Derived from Human Papillomavirus
PAATHTKAVA

SEQ ID NO: 20469 - protein, 11 aa, Artificial Sequence
  Peptide Derived from Human Papillomavirus
PAATHTKAVAL

SEQ ID NO: 20470 - protein, 10 aa, Artificial Sequence
  Peptide Derived from Human Papillomavirus
PTGCIKKHGY

SEQ ID NO: 20471 - protein, 10 aa, Artificial Sequence
  Peptide Derived from Human Papillomavirus
PTLAVSKNKA

SEQ ID NO: 20472 - protein, 11 aa, Artificial Sequence
  Peptide Derived from Human Papillomavirus
PTLAVSKNKAL

SEQ ID NO: 20473 - protein, 10 aa, Artificial Sequence
  Peptide Derived from Human Papillomavirus
PTSVFSSNEV

SEQ ID NO: 20474 - protein, 9 aa, Artificial Sequence
  Peptide Derived from Human Papillomavirus
QAIELQLTL

SEQ ID NO: 20475 - protein, 11 aa, Artificial Sequence
  Peptide Derived from Human Papillomavirus
RTYFVQFKDDA

SEQ ID NO: 20476 - protein, 8 aa, Artificial Sequence
  Peptide Derived from Human Papillomavirus
SAIVTLTY

SEQ ID NO: 20477 - protein, 8 aa, Artificial Sequence
  Peptide Derived from Human Papillomavirus
SAPILTAF

SEQ ID NO: 20478 - protein, 10 aa, Artificial Sequence
  Peptide Derived from Human Papillomavirus
SSNEVSSPEI

SEQ ID NO: 20479 - protein, 11 aa, Artificial Sequence
  Peptide Derived from Human Papillomavirus
SSNEVSSPEII

SEQ ID NO: 20480 - protein, 10 aa, Artificial Sequence
  Peptide Derived from Human Papillomavirus
SSPEIIRQHL

SEQ ID NO: 20481 - protein, 11 aa, Artificial Sequence
  Peptide Derived from Human Papillomavirus
SSPEIIRQHLA

SEQ ID NO: 20482 - protein, 11 aa, Artificial Sequence
  Peptide Derived from Human Papillomavirus
SSTWHWTGHNV

SEQ ID NO: 20483 - protein, 8 aa, Artificial Sequence
  Peptide Derived from Human Papillomavirus
STDLRDHI

SEQ ID NO: 20484 - protein, 10 aa, Artificial Sequence
  Peptide Derived from Human Papillomavirus
STDLRDHIDY

SEQ ID NO: 20485 - protein, 11 aa, Artificial Sequence
  Peptide Derived from Human Papillomavirus
STDLRDHIDYW

SEQ ID NO: 20486 - protein, 10 aa, Artificial Sequence
  Peptide Derived from Human Papillomavirus
STWHWTGHNV

SEQ ID NO: 20487 - protein, 11 aa, Artificial Sequence
  Peptide Derived from Human Papillomavirus
TAFNSSHKGRI

SEQ ID NO: 20488 - protein, 9 aa, Artificial Sequence
  Peptide Derived from Human Papillomavirus
TAVSSTWHW

SEQ ID NO: 20489 - protein, 9 aa, Artificial Sequence
  Peptide Derived from Human Papillomavirus
TSVFSSNEV

SEQ ID NO: 20490 - protein, 10 aa, Artificial Sequence
  Peptide Derived from Human Papillomavirus
TTKLLHRDSV

SEQ ID NO: 20491 - protein, 11 aa, Artificial Sequence
  Peptide Derived from Human Papillomavirus
TTPIVHLKGDA

SEQ ID NO: 20492 - protein, 9 aa, Artificial Sequence
  Peptide Derived from Human Papillomavirus
VSKNKALQA

SEQ ID NO: 20493 - protein, 10 aa, Artificial Sequence
  Peptide Derived from Human Papillomavirus
VSKNKALQAI

SEQ ID NO: 20494 - protein, 9 aa, Artificial Sequence
  Peptide Derived from Human Papillomavirus
VSLEVYLTA

SEQ ID NO: 20495 - protein, 11 aa, Artificial Sequence
  Peptide Derived from Human Papillomavirus
VSSPEIIRQHL

SEQ ID NO: 20496 - protein, 8 aa, Artificial Sequence
  Peptide Derived from Human Papillomavirus
VSTGFMSI

SEQ ID NO: 20497 - protein, 9 aa, Artificial Sequence
  Peptide Derived from Human Papillomavirus
VTLTYDSEW

SEQ ID NO: 20498 - protein, 8 aa, Artificial Sequence
  Peptide Derived from Human Papillomavirus
VTVVEGQV

SEQ ID NO: 20499 - protein, 10 aa, Artificial Sequence
  Peptide Derived from Human Papillomavirus
VTVVEGQVDY

SEQ ID NO: 20500 - protein, 11 aa, Artificial Sequence
  Peptide Derived from Human Papillomavirus
VTVVEGQVDYY

SEQ ID NO: 20501 - protein, 11 aa, Artificial Sequence
  Peptide Derived from Human Papillomavirus
WTGHNVKHKSA

SEQ ID NO: 20502 - protein, 10 aa, Artificial Sequence
  Peptide Derived from Human Papillomavirus
WTHIYICEEA

SEQ ID NO: 20503 - protein, 8 aa, Artificial Sequence
  Peptide Derived from Human Papillomavirus
WTLQDVSL

SEQ ID NO: 20504 - protein, 10 aa, Artificial Sequence
  Peptide Derived from Human Papillomavirus
WTLQDVSLEV

SEQ ID NO: 20505 - protein, 11 aa, Artificial Sequence
  Peptide Derived from Human Papillomavirus
WTLQDVSLEVY

SEQ ID NO: 20506 - protein, 9 aa, Artificial Sequence
  Peptide Derived from Human Papillomavirus
YSKNKVWEV

SEQ ID NO: 20507 - protein, 11 aa, Artificial Sequence
  Peptide Derived from Human Papillomavirus
YSKNKVWEVHA

SEQ ID NO: 20508 - protein, 8 aa, Artificial Sequence
  Peptide Derived from Human Papillomavirus
YSNEKWTL

SEQ ID NO: 20509 - protein, 11 aa, Artificial Sequence
  Peptide Derived from Human Papillomavirus
YSNEKWTLQDV

SEQ ID NO: 20510 - protein, 8 aa, Artificial Sequence
  Peptide Derived from Human Papillomavirus
YTAVSSTW

SEQ ID NO: 20511 - protein, 10 aa, Artificial Sequence
  Peptide Derived from Human Papillomavirus
YTAVSSTWHW

SEQ ID NO: 20512 - protein, 8 aa, Artificial Sequence
  Peptide Derived from Human Papillomavirus
YTNWTHIY

SEQ ID NO: 20513 - protein, 9 aa, Artificial Sequence
  Peptide Derived from Human Papillomavirus
YTNWTHIYI

SEQ ID NO: 20514 - protein, 11 aa, Artificial Sequence
  Peptide Derived from Human Papillomavirus
YTVEVQFDGDI

SEQ ID NO: 20515 - protein, 8 aa, Artificial Sequence
  Peptide Derived from Human Papillomavirus
AASAFRCF

SEQ ID NO: 20516 - protein, 9 aa, Artificial Sequence
  Peptide Derived from Human Papillomavirus
AASAFRCFI

SEQ ID NO: 20517 - protein, 10 aa, Artificial Sequence
  Peptide Derived from Human Papillomavirus
AASAFRCFIV

SEQ ID NO: 20518 - protein, 11 aa, Artificial Sequence
  Peptide Derived from Human Papillomavirus
AASAFRCFIVY

SEQ ID NO: 20519 - protein, 8 aa, Artificial Sequence
  Peptide Derived from Human Papillomavirus
ASAFRCFI

SEQ ID NO: 20520 - protein, 9 aa, Artificial Sequence
  Peptide Derived from Human Papillomavirus
ASAFRCFIV

SEQ ID NO: 20521 - protein, 10 aa, Artificial Sequence
  Peptide Derived from Human Papillomavirus
ASAFRCFIVY

SEQ ID NO: 20522 - protein, 11 aa, Artificial Sequence
  Peptide Derived from Human Papillomavirus
ASAFRCFIVYI

SEQ ID NO: 20523 - protein, 9 aa, Artificial Sequence
  Peptide Derived from Human Papillomavirus
ASTTLLACF

SEQ ID NO: 20524 - protein, 10 aa, Artificial Sequence
  Peptide Derived from Human Papillomavirus
ASTTLLACFL

SEQ ID NO: 20525 - protein, 11 aa, Artificial Sequence
  Peptide Derived from Human Papillomavirus
ASTTLLACFLL

SEQ ID NO: 20526 - protein, 8 aa, Artificial Sequence
  Peptide Derived from Human Papillomavirus
DTASTTLL

SEQ ID NO: 20527 - protein, 9 aa, Artificial Sequence
  Peptide Derived from Human Papillomavirus
DTASTTLLA

SEQ ID NO: 20528 - protein, 11 aa, Artificial Sequence
  Peptide Derived from Human Papillomavirus
DTASTTLLACF

SEQ ID NO: 20529 - protein, 8 aa, Artificial Sequence
  Peptide Derived from Human Papillomavirus
HTHARFLI

SEQ ID NO: 20530 - protein, 10 aa, Artificial Sequence
  Peptide Derived from Human Papillomavirus
ITAASAFRCF

SEQ ID NO: 20531 - protein, 11 aa, Artificial Sequence
  Peptide Derived from Human Papillomavirus
ITAASAFRCFI

SEQ ID NO: 20532 - protein, 8 aa, Artificial Sequence
  Peptide Derived from Human Papillomavirus
LACFLLCF

SEQ ID NO: 20533 - protein, 10 aa, Artificial Sequence
  Peptide Derived from Human Papillomavirus
LACFLLCFCV

SEQ ID NO: 20534 - protein, 11 aa, Artificial Sequence
  Peptide Derived from Human Papillomavirus
LACFLLCFCVL

SEQ ID NO: 20535 - protein, 9 aa, Artificial Sequence
  Peptide Derived from Human Papillomavirus
LSVSTYTSL

SEQ ID NO: 20536 - protein, 10 aa, Artificial Sequence
  Peptide Derived from Human Papillomavirus
LSVSTYTSLI

SEQ ID NO: 20537 - protein, 11 aa, Artificial Sequence
  Peptide Derived from Human Papillomavirus
LSVSTYTSLII

SEQ ID NO: 20538 - protein, 11 aa, Artificial Sequence
  Peptide Derived from Human Papillomavirus
MTNLDTASTTL

SEQ ID NO: 20539 - protein, 8 aa, Artificial Sequence
  Peptide Derived from Human Papillomavirus
SAFRCFIV

SEQ ID NO: 20540 - protein, 9 aa, Artificial Sequence
  Peptide Derived from Human Papillomavirus
SAFRCFIVY

SEQ ID NO: 20541 - protein, 10 aa, Artificial Sequence
  Peptide Derived from Human Papillomavirus
SAFRCFIVYI

SEQ ID NO: 20542 - protein, 11 aa, Artificial Sequence
  Peptide Derived from Human Papillomavirus
SAFRCFIVYII

SEQ ID NO: 20543 - protein, 8 aa, Artificial Sequence
  Peptide Derived from Human Papillomavirus
STTLLACF

SEQ ID NO: 20544 - protein, 9 aa, Artificial Sequence
  Peptide Derived from Human Papillomavirus
STTLLACFL

SEQ ID NO: 20545 - protein, 10 aa, Artificial Sequence
  Peptide Derived from Human Papillomavirus
STTLLACFLL

SEQ ID NO: 20546 - protein, 8 aa, Artificial Sequence
  Peptide Derived from Human Papillomavirus
STYTSLII

SEQ ID NO: 20547 - protein, 9 aa, Artificial Sequence
  Peptide Derived from Human Papillomavirus
STYTSLIIL

SEQ ID NO: 20548 - protein, 10 aa, Artificial Sequence
  Peptide Derived from Human Papillomavirus
STYTSLIILV

SEQ ID NO: 20549 - protein, 11 aa, Artificial Sequence
  Peptide Derived from Human Papillomavirus
STYTSLIILVL

SEQ ID NO: 20550 - protein, 9 aa, Artificial Sequence
  Peptide Derived from Human Papillomavirus
TAASAFRCF

SEQ ID NO: 20551 - protein, 10 aa, Artificial Sequence
  Peptide Derived from Human Papillomavirus
TAASAFRCFI

SEQ ID NO: 20552 - protein, 11 aa, Artificial Sequence
  Peptide Derived from Human Papillomavirus
TAASAFRCFIV

SEQ ID NO: 20553 - protein, 8 aa, Artificial Sequence
  Peptide Derived from Human Papillomavirus
TASTTLLA

SEQ ID NO: 20554 - protein, 10 aa, Artificial Sequence
  Peptide Derived from Human Papillomavirus
TASTTLLACF

SEQ ID NO: 20555 - protein, 11 aa, Artificial Sequence
  Peptide Derived from Human Papillomavirus
TASTTLLACFL

SEQ ID NO: 20556 - protein, 8 aa, Artificial Sequence
  Peptide Derived from Human Papillomavirus
TSLIILVL

SEQ ID NO: 20557 - protein, 9 aa, Artificial Sequence
  Peptide Derived from Human Papillomavirus
TSLIILVLL

SEQ ID NO: 20558 - protein, 10 aa, Artificial Sequence
  Peptide Derived from Human Papillomavirus
TSLIILVLLL

SEQ ID NO: 20559 - protein, 11 aa, Artificial Sequence
  Peptide Derived from Human Papillomavirus
TSLIILVLLLW

SEQ ID NO: 20560 - protein, 8 aa, Artificial Sequence
  Peptide Derived from Human Papillomavirus
TTLLACFL

SEQ ID NO: 20561 - protein, 9 aa, Artificial Sequence
  Peptide Derived from Human Papillomavirus
TTLLACFLL

SEQ ID NO: 20562 - protein, 11 aa, Artificial Sequence
  Peptide Derived from Human Papillomavirus
TTLLACFLLCF

SEQ ID NO: 20563 - protein, 8 aa, Artificial Sequence
  Peptide Derived from Human Papillomavirus
VSTYTSLI

SEQ ID NO: 20564 - protein, 9 aa, Artificial Sequence
  Peptide Derived from Human Papillomavirus
VSTYTSLII

SEQ ID NO: 20565 - protein, 10 aa, Artificial Sequence
  Peptide Derived from Human Papillomavirus
VSTYTSLIIL

SEQ ID NO: 20566 - protein, 11 aa, Artificial Sequence
  Peptide Derived from Human Papillomavirus
VSTYTSLIILV

SEQ ID NO: 20567 - protein, 8 aa, Artificial Sequence
  Peptide Derived from Human Papillomavirus
YTSLIILV

SEQ ID NO: 20568 - protein, 9 aa, Artificial Sequence
  Peptide Derived from Human Papillomavirus
YTSLIILVL

SEQ ID NO: 20569 - protein, 10 aa, Artificial Sequence
  Peptide Derived from Human Papillomavirus
YTSLIILVLL

SEQ ID NO: 20570 - protein, 11 aa, Artificial Sequence
  Peptide Derived from Human Papillomavirus
YTSLIILVLLL

SEQ ID NO: 20571 - protein, 8 aa, Artificial Sequence
  Peptide Derived from Human Papillomavirus
CTELQTTI

SEQ ID NO: 20572 - protein, 11 aa, Artificial Sequence
  Peptide Derived from Human Papillomavirus
CTELQTTIHDI

SEQ ID NO: 20573 - protein, 8 aa, Artificial Sequence
  Peptide Derived from Human Papillomavirus
FAFRDLCI

SEQ ID NO: 20574 - protein, 9 aa, Artificial Sequence
  Peptide Derived from Human Papillomavirus
FAFRDLCIV

SEQ ID NO: 20575 - protein, 10 aa, Artificial Sequence
  Peptide Derived from Human Papillomavirus
FAFRDLCIVY

SEQ ID NO: 20576 - protein, 8 aa, Artificial Sequence
  Peptide Derived from Human Papillomavirus
GTTLEQQY

SEQ ID NO: 20577 - protein, 9 aa, Artificial Sequence
  Peptide Derived from Human Papillomavirus
ISEYRHYCY

SEQ ID NO: 20578 - protein, 11 aa, Artificial Sequence
  Peptide Derived from Human Papillomavirus
ISEYRHYCYSL

SEQ ID NO: 20579 - protein, 8 aa, Artificial Sequence
  Peptide Derived from Human Papillomavirus
QTTIHDII

SEQ ID NO: 20580 - protein, 9 aa, Artificial Sequence
  Peptide Derived from Human Papillomavirus
QTTIHDIIL

SEQ ID NO: 20581 - protein, 11 aa, Artificial Sequence
  Peptide Derived from Human Papillomavirus
RSSRTRRETQL

SEQ ID NO: 20582 - protein, 8 aa, Artificial Sequence
  Peptide Derived from Human Papillomavirus
RTRRETQL

SEQ ID NO: 20583 - protein, 10 aa, Artificial Sequence
  Peptide Derived from Human Papillomavirus
SSRTRRETQL

SEQ ID NO: 20584 - protein, 8 aa, Artificial Sequence
  Peptide Derived from Human Papillomavirus
TTIHDIIL

SEQ ID NO: 20585 - protein, 11 aa, Artificial Sequence
  Peptide Derived from Human Papillomavirus
TTIHDIILECV

SEQ ID NO: 20586 - protein, 11 aa, Artificial Sequence
  Peptide Derived from Human Papillomavirus
TTLEQQYNKPL

SEQ ID NO: 20587 - protein, 8 aa, Artificial Sequence
  Peptide Derived from Human Papillomavirus
YAVCDKCL

SEQ ID NO: 20588 - protein, 10 aa, Artificial Sequence
  Peptide Derived from Human Papillomavirus
YAVCDKCLKF

SEQ ID NO: 20589 - protein, 11 aa, Artificial Sequence
  Peptide Derived from Human Papillomavirus
YAVCDKCLKFY

SEQ ID NO: 20590 - protein, 10 aa, Artificial Sequence
  Peptide Derived from Human Papillomavirus
YSKISEYRHY

SEQ ID NO: 20591 - protein, 8 aa, Artificial Sequence
  Peptide Derived from Human Papillomavirus
YSLYGTTL

SEQ ID NO: 20592 - protein, 9 aa, Artificial Sequence
  Peptide Derived from Human Papillomavirus
DSSEEEDEI

SEQ ID NO: 20593 - protein, 8 aa, Artificial Sequence
  Peptide Derived from Human Papillomavirus
DSTLRLCV

SEQ ID NO: 20594 - protein, 8 aa, Artificial Sequence
  Peptide Derived from Human Papillomavirus
DTPTLHEY

SEQ ID NO: 20595 - protein, 9 aa, Artificial Sequence
  Peptide Derived from Human Papillomavirus
DTPTLHEYM

SEQ ID NO: 20596 - protein, 10 aa, Artificial Sequence
  Peptide Derived from Human Papillomavirus
DTPTLHEYML

SEQ ID NO: 20597 - protein, 8 aa, Artificial Sequence
  Peptide Derived from Human Papillomavirus
ETTDLYCY

SEQ ID NO: 20598 - protein, 11 aa, Artificial Sequence
  Peptide Derived from Human Papillomavirus
ETTDLYCYEQL

SEQ ID NO: 20599 - protein, 9 aa, Artificial Sequence
  Peptide Derived from Human Papillomavirus
GTLGIVCPI

SEQ ID NO: 20600 - protein, 10 aa, Artificial Sequence
  Peptide Derived from Human Papillomavirus
PAGQAEPDRA

SEQ ID NO: 20601 - protein, 8 aa, Artificial Sequence
  Peptide Derived from Human Papillomavirus
PTLHEYML

SEQ ID NO: 20602 - protein, 10 aa, Artificial Sequence
  Peptide Derived from Human Papillomavirus
PTLHEYMLDL

SEQ ID NO: 20603 - protein, 9 aa, Artificial Sequence
  Peptide Derived from Human Papillomavirus
QAEPDRAHY

SEQ ID NO: 20604 - protein, 11 aa, Artificial Sequence
  Peptide Derived from Human Papillomavirus
QAEPDRAHYNI

SEQ ID NO: 20605 - protein, 10 aa, Artificial Sequence
  Peptide Derived from Human Papillomavirus
QSTHVDIRTL

SEQ ID NO: 20606 - protein, 9 aa, Artificial Sequence
  Peptide Derived from Human Papillomavirus
RAHYNIVTF

SEQ ID NO: 20607 - protein, 8 aa, Artificial Sequence
  Peptide Derived from Human Papillomavirus
RTLEDLLM

SEQ ID NO: 20608 - protein, 11 aa, Artificial Sequence
  Peptide Derived from Human Papillomavirus
RTLEDLLMGTL

SEQ ID NO: 20609 - protein, 8 aa, Artificial Sequence
  Peptide Derived from Human Papillomavirus
SSEEEDEI

SEQ ID NO: 20610 - protein, 9 aa, Artificial Sequence
  Peptide Derived from Human Papillomavirus
STHVDIRTL

SEQ ID NO: 20611 - protein, 10 aa, Artificial Sequence
  Peptide Derived from Human Papillomavirus
TTDLYCYEQL

SEQ ID NO: 20612 - protein, 11 aa, Artificial Sequence
  Peptide Derived from Human Papillomavirus
VTFCCKCDSTL

SEQ ID NO: 20613 - protein, 10 aa, Artificial Sequence
  Peptide Derived from Human Papillomavirus
AAISTSETTY

SEQ ID NO: 20614 - protein, 8 aa, Artificial Sequence
  Peptide Derived from Human Papillomavirus
ASAYAANA

SEQ ID NO: 20615 - protein, 10 aa, Artificial Sequence
  Peptide Derived from Human Papillomavirus
ASAYAANAGV

SEQ ID NO: 20616 - protein, 8 aa, Artificial Sequence
  Peptide Derived from Human Papillomavirus
ATVYLPPV

SEQ ID NO: 20617 - protein, 10 aa, Artificial Sequence
  Peptide Derived from Human Papillomavirus
ATVYLPPVPV

SEQ ID NO: 20618 - protein, 11 aa, Artificial Sequence
  Peptide Derived from Human Papillomavirus
CAAISTSETTY

SEQ ID NO: 20619 - protein, 10 aa, Artificial Sequence
  Peptide Derived from Human Papillomavirus
CTSICKYPDY

SEQ ID NO: 20620 - protein, 11 aa, Artificial Sequence
  Peptide Derived from Human Papillomavirus
CTSICKYPDYI

SEQ ID NO: 20621 - protein, 9 aa, Artificial Sequence
  Peptide Derived from Human Papillomavirus
DAQIFNKPY

SEQ ID NO: 20622 - protein, 10 aa, Artificial Sequence
  Peptide Derived from Human Papillomavirus
DAQIFNKPYW

SEQ ID NO: 20623 - protein, 11 aa, Artificial Sequence
  Peptide Derived from Human Papillomavirus
DAQIFNKPYWL

SEQ ID NO: 20624 - protein, 8 aa, Artificial Sequence
  Peptide Derived from Human Papillomavirus
DTENASAY

SEQ ID NO: 20625 - protein, 9 aa, Artificial Sequence
  Peptide Derived from Human Papillomavirus
DTENASAYA

SEQ ID NO: 20626 - protein, 10 aa, Artificial Sequence
  Peptide Derived from Human Papillomavirus
DTENASAYAA

SEQ ID NO: 20627 - protein, 9 aa, Artificial Sequence
  Peptide Derived from Human Papillomavirus
DTGFGAMDF

SEQ ID NO: 20628 - protein, 8 aa, Artificial Sequence
  Peptide Derived from Human Papillomavirus
DTQRLVWA

SEQ ID NO: 20629 - protein, 10 aa, Artificial Sequence
  Peptide Derived from Human Papillomavirus
DTQRLVWACV

SEQ ID NO: 20630 - protein, 8 aa, Artificial Sequence
  Peptide Derived from Human Papillomavirus
DTTRSTNM

SEQ ID NO: 20631 - protein, 10 aa, Artificial Sequence
  Peptide Derived from Human Papillomavirus
DTTRSTNMSL

SEQ ID NO: 20632 - protein, 10 aa, Artificial Sequence
  Peptide Derived from Human Papillomavirus
DTYRFVTSQA

SEQ ID NO: 20633 - protein, 11 aa, Artificial Sequence
  Peptide Derived from Human Papillomavirus
DTYRFVTSQAI

SEQ ID NO: 20634 - protein, 9 aa, Artificial Sequence
  Peptide Derived from Human Papillomavirus
EATVYLPPV

SEQ ID NO: 20635 - protein, 11 aa, Artificial Sequence
  Peptide Derived from Human Papillomavirus
EATVYLPPVPV

SEQ ID NO: 20636 - protein, 9 aa, Artificial Sequence
  Peptide Derived from Human Papillomavirus
ETTYKNTNF

SEQ ID NO: 20637 - protein, 8 aa, Artificial Sequence
  Peptide Derived from Human Papillomavirus
FSADLDQF

SEQ ID NO: 20638 - protein, 10 aa, Artificial Sequence
  Peptide Derived from Human Papillomavirus
FSADLDQFPL

SEQ ID NO: 20639 - protein, 8 aa, Artificial Sequence
  Peptide Derived from Human Papillomavirus
FTLGKRKA

SEQ ID NO: 20640 - protein, 11 aa, Artificial Sequence
  Peptide Derived from Human Papillomavirus
FTTLQANKSEV

SEQ ID NO: 20641 - protein, 8 aa, Artificial Sequence
  Peptide Derived from Human Papillomavirus
GAMDFTTL

SEQ ID NO: 20642 - protein, 10 aa, Artificial Sequence
  Peptide Derived from Human Papillomavirus
GAMDFTTLQA

SEQ ID NO: 20643 - protein, 11 aa, Artificial Sequence
  Peptide Derived from Human Papillomavirus
GAVGENVPDDL

SEQ ID NO: 20644 - protein, 8 aa, Artificial Sequence
  Peptide Derived from Human Papillomavirus
GSGSTANL

SEQ ID NO: 20645 - protein, 9 aa, Artificial Sequence
  Peptide Derived from Human Papillomavirus
GSGSTANLA

SEQ ID NO: 20646 - protein, 8 aa, Artificial Sequence
  Peptide Derived from Human Papillomavirus
GSMVTSDA

SEQ ID NO: 20647 - protein, 10 aa, Artificial Sequence
  Peptide Derived from Human Papillomavirus
GSMVTSDAQI

SEQ ID NO: 20648 - protein, 11 aa, Artificial Sequence
  Peptide Derived from Human Papillomavirus
GSMVTSDAQIF

SEQ ID NO: 20649 - protein, 8 aa, Artificial Sequence
  Peptide Derived from Human Papillomavirus
GSPCTNVA

SEQ ID NO: 20650 - protein, 9 aa, Artificial Sequence
  Peptide Derived from Human Papillomavirus
GSPCTNVAV

SEQ ID NO: 20651 - protein, 11 aa, Artificial Sequence
  Peptide Derived from Human Papillomavirus
GSTANLASSNY

SEQ ID NO: 20652 - protein, 9 aa, Artificial Sequence
  Peptide Derived from Human Papillomavirus
GTLEDTYRF

SEQ ID NO: 20653 - protein, 10 aa, Artificial Sequence
  Peptide Derived from Human Papillomavirus
GTLEDTYRFV

SEQ ID NO: 20654 - protein, 8 aa, Artificial Sequence
  Peptide Derived from Human Papillomavirus
GTSRLLAV

SEQ ID NO: 20655 - protein, 8 aa, Artificial Sequence
  Peptide Derived from Human Papillomavirus
HAGTSRLL

SEQ ID NO: 20656 - protein, 9 aa, Artificial Sequence
  Peptide Derived from Human Papillomavirus
HAGTSRLLA

SEQ ID NO: 20657 - protein, 10 aa, Artificial Sequence
  Peptide Derived from Human Papillomavirus
HAGTSRLLAV

SEQ ID NO: 20658 - protein, 8 aa, Artificial Sequence
  Peptide Derived from Human Papillomavirus
HSMNSTIL

SEQ ID NO: 20659 - protein, 11 aa, Artificial Sequence
  Peptide Derived from Human Papillomavirus
HSMNSTILEDW

SEQ ID NO: 20660 - protein, 11 aa, Artificial Sequence
  Peptide Derived from Human Papillomavirus
HTPPAPKEDPL

SEQ ID NO: 20661 - protein, 10 aa, Artificial Sequence
  Peptide Derived from Human Papillomavirus
IACQKHTPPA

SEQ ID NO: 20662 - protein, 10 aa, Artificial Sequence
  Peptide Derived from Human Papillomavirus
ISGHPLLNKL

SEQ ID NO: 20663 - protein, 10 aa, Artificial Sequence
  Peptide Derived from Human Papillomavirus
ISMDYKQTQL

SEQ ID NO: 20664 - protein, 8 aa, Artificial Sequence
  Peptide Derived from Human Papillomavirus
ISTSETTY

SEQ ID NO: 20665 - protein, 8 aa, Artificial Sequence
  Peptide Derived from Human Papillomavirus
ITCYENDV

SEQ ID NO: 20666 - protein, 10 aa, Artificial Sequence
  Peptide Derived from Human Papillomavirus
ITCYENDVNV

SEQ ID NO: 20667 - protein, 11 aa, Artificial Sequence
  Peptide Derived from Human Papillomavirus
ITCYENDVNVY

SEQ ID NO: 20668 - protein, 8 aa, Artificial Sequence
  Peptide Derived from Human Papillomavirus
ITLTADVM

SEQ ID NO: 20669 - protein, 10 aa, Artificial Sequence
  Peptide Derived from Human Papillomavirus
ITLTADVMTY

SEQ ID NO: 20670 - protein, 11 aa, Artificial Sequence
  Peptide Derived from Human Papillomavirus
ITLTADVMTYI

SEQ ID NO: 20671 - protein, 8 aa, Artificial Sequence
  Peptide Derived from Human Papillomavirus
KAKPKFTL

SEQ ID NO: 20672 - protein, 8 aa, Artificial Sequence
  Peptide Derived from Human Papillomavirus
KSEVPLDI

SEQ ID NO: 20673 - protein, 8 aa, Artificial Sequence
  Peptide Derived from Human Papillomavirus
LAVGHPYF

SEQ ID NO: 20674 - protein, 10 aa, Artificial Sequence
  Peptide Derived from Human Papillomavirus
LAVGHPYFPI

SEQ ID NO: 20675 - protein, 8 aa, Artificial Sequence
  Peptide Derived from Human Papillomavirus
LTADVMTY

SEQ ID NO: 20676 - protein, 9 aa, Artificial Sequence
  Peptide Derived from Human Papillomavirus
LTADVMTYI

SEQ ID NO: 20677 - protein, 9 aa, Artificial Sequence
  Peptide Derived from Human Papillomavirus
MSLWLPSEA

SEQ ID NO: 20678 - protein, 11 aa, Artificial Sequence
  Peptide Derived from Human Papillomavirus
MSLWLPSEATV

SEQ ID NO: 20679 - protein, 11 aa, Artificial Sequence
  Peptide Derived from Human Papillomavirus
MTYIHSMNSTI

SEQ ID NO: 20680 - protein, 10 aa, Artificial Sequence
  Peptide Derived from Human Papillomavirus
NAGVDNRECI

SEQ ID NO: 20681 - protein, 9 aa, Artificial Sequence
  Peptide Derived from Human Papillomavirus
NASAYAANA

SEQ ID NO: 20682 - protein, 11 aa, Artificial Sequence
  Peptide Derived from Human Papillomavirus
NASAYAANAGV

SEQ ID NO: 20683 - protein, 8 aa, Artificial Sequence
  Peptide Derived from Human Papillomavirus
NSTILEDW

SEQ ID NO: 20684 - protein, 10 aa, Artificial Sequence
  Peptide Derived from Human Papillomavirus
NSTILEDWNF

SEQ ID NO: 20685 - protein, 8 aa, Artificial Sequence
  Peptide Derived from Human Papillomavirus
NTNFKEYL

SEQ ID NO: 20686 - protein, 9 aa, Artificial Sequence
  Peptide Derived from Human Papillomavirus
NTVIQDGDM

SEQ ID NO: 20687 - protein, 10 aa, Artificial Sequence
  Peptide Derived from Human Papillomavirus
NTVIQDGDMV

SEQ ID NO: 20688 - protein, 8 aa, Artificial Sequence
  Peptide Derived from Human Papillomavirus
PAPKEDPL

SEQ ID NO: 20689 - protein, 11 aa, Artificial Sequence
  Peptide Derived from Human Papillomavirus
PAPKEDPLKKY

SEQ ID NO: 20690 - protein, 8 aa, Artificial Sequence
  Peptide Derived from Human Papillomavirus
PSEATVYL

SEQ ID NO: 20691 - protein, 11 aa, Artificial Sequence
  Peptide Derived from Human Papillomavirus
PSEATVYLPPV

SEQ ID NO: 20692 - protein, 10 aa, Artificial Sequence
  Peptide Derived from Human Papillomavirus
PSGSMVTSDA

SEQ ID NO: 20693 - protein, 8 aa, Artificial Sequence
  Peptide Derived from Human Papillomavirus
PTPSGSMV

SEQ ID NO: 20694 - protein, 10 aa, Artificial Sequence
  Peptide Derived from Human Papillomavirus
PTTSSTSTTA

SEQ ID NO: 20695 - protein, 10 aa, Artificial Sequence
  Peptide Derived from Human Papillomavirus
QAGLKAKPKF

SEQ ID NO: 20696 - protein, 9 aa, Artificial Sequence
  Peptide Derived from Human Papillomavirus
QANKSEVPL

SEQ ID NO: 20697 - protein, 11 aa, Artificial Sequence
  Peptide Derived from Human Papillomavirus
QANKSEVPLDI

SEQ ID NO: 20698 - protein, 9 aa, Artificial Sequence
  Peptide Derived from Human Papillomavirus
RAGAVGENV

SEQ ID NO: 20699 - protein, 9 aa, Artificial Sequence
  Peptide Derived from Human Papillomavirus
RAQGHNNGI

SEQ ID NO: 20700 - protein, 11 aa, Artificial Sequence
  Peptide Derived from Human Papillomavirus
RAQGHNNGICW

SEQ ID NO: 20701 - protein, 9 aa, Artificial Sequence
  Peptide Derived from Human Papillomavirus
RSTNMSLCA

SEQ ID NO: 20702 - protein, 10 aa, Artificial Sequence
  Peptide Derived from Human Papillomavirus
RSTNMSLCAA

SEQ ID NO: 20703 - protein, 11 aa, Artificial Sequence
  Peptide Derived from Human Papillomavirus
RSTNMSLCAAI

SEQ ID NO: 20704 - protein, 8 aa, Artificial Sequence
  Peptide Derived from Human Papillomavirus
RTNIYYHA

SEQ ID NO: 20705 - protein, 9 aa, Artificial Sequence
  Peptide Derived from Human Papillomavirus
SADLDQFPL

SEQ ID NO: 20706 - protein, 9 aa, Artificial Sequence
  Peptide Derived from Human Papillomavirus
SAYAANAGV

SEQ ID NO: 20707 - protein, 10 aa, Artificial Sequence
  Peptide Derived from Human Papillomavirus
STANLASSNY

SEQ ID NO: 20708 - protein, 11 aa, Artificial Sequence
  Peptide Derived from Human Papillomavirus
STANLASSNYF

SEQ ID NO: 20709 - protein, 11 aa, Artificial Sequence
  Peptide Derived from Human Papillomavirus
STDEYVARTNI

SEQ ID NO: 20710 - protein, 9 aa, Artificial Sequence
  Peptide Derived from Human Papillomavirus
STILEDWNF

SEQ ID NO: 20711 - protein, 11 aa, Artificial Sequence
  Peptide Derived from Human Papillomavirus
STILEDWNFGL

SEQ ID NO: 20712 - protein, 8 aa, Artificial Sequence
  Peptide Derived from Human Papillomavirus
STNMSLCA

SEQ ID NO: 20713 - protein, 9 aa, Artificial Sequence
  Peptide Derived from Human Papillomavirus
STNMSLCAA

SEQ ID NO: 20714 - protein, 10 aa, Artificial Sequence
  Peptide Derived from Human Papillomavirus
STNMSLCAAI

SEQ ID NO: 20715 - protein, 11 aa, Artificial Sequence
  Peptide Derived from Human Papillomavirus
STTAKRKKRKL

SEQ ID NO: 20716 - protein, 8 aa, Artificial Sequence
  Peptide Derived from Human Papillomavirus
TADVMTYI

SEQ ID NO: 20717 - protein, 11 aa, Artificial Sequence
  Peptide Derived from Human Papillomavirus
TADVMTYIHSM

SEQ ID NO: 20718 - protein, 9 aa, Artificial Sequence
  Peptide Derived from Human Papillomavirus
TAKRKKRKL

SEQ ID NO: 20719 - protein, 9 aa, Artificial Sequence
  Peptide Derived from Human Papillomavirus
TANLASSNY

SEQ ID NO: 20720 - protein, 10 aa, Artificial Sequence
  Peptide Derived from Human Papillomavirus
TANLASSNYF

SEQ ID NO: 20721 - protein, 11 aa, Artificial Sequence
  Peptide Derived from Human Papillomavirus
TSDAQIFNKPY

SEQ ID NO: 20722 - protein, 11 aa, Artificial Sequence
  Peptide Derived from Human Papillomavirus
TSETTYKNTNF

SEQ ID NO: 20723 - protein, 11 aa, Artificial Sequence
  Peptide Derived from Human Papillomavirus
TSFYNPDTQRL

SEQ ID NO: 20724 - protein, 9 aa, Artificial Sequence
  Peptide Derived from Human Papillomavirus
TSICKYPDY

SEQ ID NO: 20725 - protein, 10 aa, Artificial Sequence
  Peptide Derived from Human Papillomavirus
TSICKYPDYI

SEQ ID NO: 20726 - protein, 11 aa, Artificial Sequence
  Peptide Derived from Human Papillomavirus
TSRLLAVGHPY

SEQ ID NO: 20727 - protein, 8 aa, Artificial Sequence
  Peptide Derived from Human Papillomavirus
TSSTSTTA

SEQ ID NO: 20728 - protein, 10 aa, Artificial Sequence
  Peptide Derived from Human Papillomavirus
TTAKRKKRKL

SEQ ID NO: 20729 - protein, 10 aa, Artificial Sequence
  Peptide Derived from Human Papillomavirus
TTLQANKSEV

SEQ ID NO: 20730 - protein, 9 aa, Artificial Sequence
  Peptide Derived from Human Papillomavirus
TTRSTNMSL

SEQ ID NO: 20731 - protein, 11 aa, Artificial Sequence
  Peptide Derived from Human Papillomavirus
TTRSTNMSLCA

SEQ ID NO: 20732 - protein, 9 aa, Artificial Sequence
  Peptide Derived from Human Papillomavirus
TTSSTSTTA

SEQ ID NO: 20733 - protein, 8 aa, Artificial Sequence
  Peptide Derived from Human Papillomavirus
TTYKNTNF

SEQ ID NO: 20734 - protein, 11 aa, Artificial Sequence
  Peptide Derived from Human Papillomavirus
TTYKNTNFKEY

SEQ ID NO: 20735 - protein, 8 aa, Artificial Sequence
  Peptide Derived from Human Papillomavirus
VARTNIYY

SEQ ID NO: 20736 - protein, 10 aa, Artificial Sequence
  Peptide Derived from Human Papillomavirus
VARTNIYYHA

SEQ ID NO: 20737 - protein, 11 aa, Artificial Sequence
  Peptide Derived from Human Papillomavirus
VAVNPGDCPPL

SEQ ID NO: 20738 - protein, 9 aa, Artificial Sequence
  Peptide Derived from Human Papillomavirus
VSEPYGDSL

SEQ ID NO: 20739 - protein, 10 aa, Artificial Sequence
  Peptide Derived from Human Papillomavirus
VSEPYGDSLF

SEQ ID NO: 20740 - protein, 11 aa, Artificial Sequence
  Peptide Derived from Human Papillomavirus
VSEPYGDSLFF

SEQ ID NO: 20741 - protein, 8 aa, Artificial Sequence
  Peptide Derived from Human Papillomavirus
VSGLQYRV

SEQ ID NO: 20742 - protein, 9 aa, Artificial Sequence
  Peptide Derived from Human Papillomavirus
VSGLQYRVF

SEQ ID NO: 20743 - protein, 11 aa, Artificial Sequence
  Peptide Derived from Human Papillomavirus
VSGLQYRVFRI

SEQ ID NO: 20744 - protein, 10 aa, Artificial Sequence
  Peptide Derived from Human Papillomavirus
VSKVVSTDEY

SEQ ID NO: 20745 - protein, 11 aa, Artificial Sequence
  Peptide Derived from Human Papillomavirus
VSKVVSTDEYV

SEQ ID NO: 20746 - protein, 8 aa, Artificial Sequence
  Peptide Derived from Human Papillomavirus
VSTDEYVA

SEQ ID NO: 20747 - protein, 8 aa, Artificial Sequence
  Peptide Derived from Human Papillomavirus
VTFIYILV

SEQ ID NO: 20748 - protein, 9 aa, Artificial Sequence
  Peptide Derived from Human Papillomavirus
VTFIYILVI

SEQ ID NO: 20749 - protein, 8 aa, Artificial Sequence
  Peptide Derived from Human Papillomavirus
VTSDAQIF

SEQ ID NO: 20750 - protein, 8 aa, Artificial Sequence
  Peptide Derived from Human Papillomavirus
WACVGVEV

SEQ ID NO: 20751 - protein, 8 aa, Artificial Sequence
  Peptide Derived from Human Papillomavirus
YTFWEVNL

SEQ ID NO: 20752 - protein, 11 aa, Artificial Sequence
  Peptide Derived from Human Papillomavirus
AALPTSINNGL

SEQ ID NO: 20753 - protein, 8 aa, Artificial Sequence
  Peptide Derived from Human Papillomavirus
ATDTLAPV

SEQ ID NO: 20754 - protein, 11 aa, Artificial Sequence
  Peptide Derived from Human Papillomavirus
ATQLYKTCKQA

SEQ ID NO: 20755 - protein, 8 aa, Artificial Sequence
  Peptide Derived from Human Papillomavirus
DAGAPTSV

SEQ ID NO: 20756 - protein, 11 aa, Artificial Sequence
  Peptide Derived from Human Papillomavirus
DAGAPTSVPSI

SEQ ID NO: 20757 - protein, 11 aa, Artificial Sequence
  Peptide Derived from Human Papillomavirus
DAGDFYLHPSY

SEQ ID NO: 20758 - protein, 8 aa, Artificial Sequence
  Peptide Derived from Human Papillomavirus
DSAEEIEL

SEQ ID NO: 20759 - protein, 11 aa, Artificial Sequence
  Peptide Derived from Human Papillomavirus
DSAEEIELQTI

SEQ ID NO: 20760 - protein, 10 aa, Artificial Sequence
  Peptide Derived from Human Papillomavirus
DTLAPVRPPL

SEQ ID NO: 20761 - protein, 10 aa, Artificial Sequence
  Peptide Derived from Human Papillomavirus
DTSTTPVPSV

SEQ ID NO: 20762 - protein, 9 aa, Artificial Sequence
  Peptide Derived from Human Papillomavirus
DTTPAILDI

SEQ ID NO: 20763 - protein, 8 aa, Artificial Sequence
  Peptide Derived from Human Papillomavirus
ETGGHFTL

SEQ ID NO: 20764 - protein, 9 aa, Artificial Sequence
  Peptide Derived from Human Papillomavirus
ETSFIDAGA

SEQ ID NO: 20765 - protein, 8 aa, Artificial Sequence
  Peptide Derived from Human Papillomavirus
FSDVSLAA

SEQ ID NO: 20766 - protein, 8 aa, Artificial Sequence
  Peptide Derived from Human Papillomavirus
FSSNDNSI

SEQ ID NO: 20767 - protein, 10 aa, Artificial Sequence
  Peptide Derived from Human Papillomavirus
FSSNDNSINI

SEQ ID NO: 20768 - protein, 11 aa, Artificial Sequence
  Peptide Derived from Human Papillomavirus
FSSNDNSINIA

SEQ ID NO: 20769 - protein, 10 aa, Artificial Sequence
  Peptide Derived from Human Papillomavirus
FSTIDSAEEI

SEQ ID NO: 20770 - protein, 8 aa, Artificial Sequence
  Peptide Derived from Human Papillomavirus
FTLSSSTI

SEQ ID NO: 20771 - protein, 8 aa, Artificial Sequence
  Peptide Derived from Human Papillomavirus
GAKVHYYY

SEQ ID NO: 20772 - protein, 10 aa, Artificial Sequence
  Peptide Derived from Human Papillomavirus
GAKVHYYYDF

SEQ ID NO: 20773 - protein, 9 aa, Artificial Sequence
  Peptide Derived from Human Papillomavirus
GAPTSVPSI

SEQ ID NO: 20774 - protein, 8 aa, Artificial Sequence
  Peptide Derived from Human Papillomavirus
GAYNIPLV

SEQ ID NO: 20775 - protein, 10 aa, Artificial Sequence
  Peptide Derived from Human Papillomavirus
GSGTGGRTGY

SEQ ID NO: 20776 - protein, 11 aa, Artificial Sequence
  Peptide Derived from Human Papillomavirus
GSGTGGRTGYI

SEQ ID NO: 20777 - protein, 10 aa, Artificial Sequence
  Peptide Derived from Human Papillomavirus
GSMGVFFGGL

SEQ ID NO: 20778 - protein, 8 aa, Artificial Sequence
  Peptide Derived from Human Papillomavirus
GSPQYTII

SEQ ID NO: 20779 - protein, 9 aa, Artificial Sequence
  Peptide Derived from Human Papillomavirus
GSPQYTIIA

SEQ ID NO: 20780 - protein, 11 aa, Artificial Sequence
  Peptide Derived from Human Papillomavirus
GSPQYTIIADA

SEQ ID NO: 20781 - protein, 8 aa, Artificial Sequence
  Peptide Derived from Human Papillomavirus
GSRPVARL

SEQ ID NO: 20782 - protein, 10 aa, Artificial Sequence
  Peptide Derived from Human Papillomavirus
GSRPVARLGL

SEQ ID NO: 20783 - protein, 11 aa, Artificial Sequence
  Peptide Derived from Human Papillomavirus
GSRPVARLGLY

SEQ ID NO: 20784 - protein, 8 aa, Artificial Sequence
  Peptide Derived from Human Papillomavirus
GTCPPDII

SEQ ID NO: 20785 - protein, 11 aa, Artificial Sequence
  Peptide Derived from Human Papillomavirus
GTCPPDIIPKV

SEQ ID NO: 20786 - protein, 8 aa, Artificial Sequence
  Peptide Derived from Human Papillomavirus
GTGGRTGY

SEQ ID NO: 20787 - protein, 9 aa, Artificial Sequence
  Peptide Derived from Human Papillomavirus
GTGGRTGYI

SEQ ID NO: 20788 - protein, 11 aa, Artificial Sequence
  Peptide Derived from Human Papillomavirus
GTGGRTGYIPL

SEQ ID NO: 20789 - protein, 11 aa, Artificial Sequence
  Peptide Derived from Human Papillomavirus
GTRPPTATDTL

SEQ ID NO: 20790 - protein, 8 aa, Artificial Sequence
  Peptide Derived from Human Papillomavirus
HAALPTSI

SEQ ID NO: 20791 - protein, 8 aa, Artificial Sequence
  Peptide Derived from Human Papillomavirus
IADAGDFY

SEQ ID NO: 20792 - protein, 9 aa, Artificial Sequence
  Peptide Derived from Human Papillomavirus
IADAGDFYL

SEQ ID NO: 20793 - protein, 8 aa, Artificial Sequence
  Peptide Derived from Human Papillomavirus
IADQILQY

SEQ ID NO: 20794 - protein, 11 aa, Artificial Sequence
  Peptide Derived from Human Papillomavirus
IADQILQYGSM

SEQ ID NO: 20795 - protein, 8 aa, Artificial Sequence
  Peptide Derived from Human Papillomavirus
IAPDPDFL

SEQ ID NO: 20796 - protein, 10 aa, Artificial Sequence
  Peptide Derived from Human Papillomavirus
IAPDPDFLDI

SEQ ID NO: 20797 - protein, 11 aa, Artificial Sequence
  Peptide Derived from Human Papillomavirus
IAPDPDFLDIV

SEQ ID NO: 20798 - protein, 9 aa, Artificial Sequence
  Peptide Derived from Human Papillomavirus
ISTHNYEEI

SEQ ID NO: 20799 - protein, 11 aa, Artificial Sequence
  Peptide Derived from Human Papillomavirus
ISTHNYEEIPM

SEQ ID NO: 20800 - protein, 8 aa, Artificial Sequence
  Peptide Derived from Human Papillomavirus
ITDQAPSL

SEQ ID NO: 20801 - protein, 9 aa, Artificial Sequence
  Peptide Derived from Human Papillomavirus
ITDQAPSLI

SEQ ID NO: 20802 - protein, 11 aa, Artificial Sequence
  Peptide Derived from Human Papillomavirus
ITDQAPSLIPI

SEQ ID NO: 20803 - protein, 9 aa, Artificial Sequence
  Peptide Derived from Human Papillomavirus
ITDTSTTPV

SEQ ID NO: 20804 - protein, 8 aa, Artificial Sequence
  Peptide Derived from Human Papillomavirus
ITTPTKLI

SEQ ID NO: 20805 - protein, 10 aa, Artificial Sequence
  Peptide Derived from Human Papillomavirus
ITTPTKLITY

SEQ ID NO: 20806 - protein, 10 aa, Artificial Sequence
  Peptide Derived from Human Papillomavirus
ITTSTDTTPA

SEQ ID NO: 20807 - protein, 11 aa, Artificial Sequence
  Peptide Derived from Human Papillomavirus
ITTSTDTTPAI

SEQ ID NO: 20808 - protein, 8 aa, Artificial Sequence
  Peptide Derived from Human Papillomavirus
ITYDNPAY

SEQ ID NO: 20809 - protein, 11 aa, Artificial Sequence
  Peptide Derived from Human Papillomavirus
ITYDNPAYEGI

SEQ ID NO: 20810 - protein, 9 aa, Artificial Sequence
  Peptide Derived from Human Papillomavirus
KSIGAKVHY

SEQ ID NO: 20811 - protein, 10 aa, Artificial Sequence
  Peptide Derived from Human Papillomavirus
KSIGAKVHYY

SEQ ID NO: 20812 - protein, 11 aa, Artificial Sequence
  Peptide Derived from Human Papillomavirus
KSIGAKVHYYY

SEQ ID NO: 20813 - protein, 8 aa, Artificial Sequence
  Peptide Derived from Human Papillomavirus
KTIADQIL

SEQ ID NO: 20814 - protein, 10 aa, Artificial Sequence
  Peptide Derived from Human Papillomavirus
KTIADQILQY

SEQ ID NO: 20815 - protein, 8 aa, Artificial Sequence
  Peptide Derived from Human Papillomavirus
LAPVRPPL

SEQ ID NO: 20816 - protein, 10 aa, Artificial Sequence
  Peptide Derived from Human Papillomavirus
LAPVRPPLTV

SEQ ID NO: 20817 - protein, 11 aa, Artificial Sequence
  Peptide Derived from Human Papillomavirus
LSGYIPANTTI

SEQ ID NO: 20818 - protein, 11 aa, Artificial Sequence
  Peptide Derived from Human Papillomavirus
LSSSTISTHNY

SEQ ID NO: 20819 - protein, 8 aa, Artificial Sequence
  Peptide Derived from Human Papillomavirus
LTSRRTGI

SEQ ID NO: 20820 - protein, 10 aa, Artificial Sequence
  Peptide Derived from Human Papillomavirus
LTSRRTGIRY

SEQ ID NO: 20821 - protein, 11 aa, Artificial Sequence
  Peptide Derived from Human Papillomavirus
NSINIAPDPDF

SEQ ID NO: 20822 - protein, 9 aa, Artificial Sequence
  Peptide Derived from Human Papillomavirus
NTTIPFGGA

SEQ ID NO: 20823 - protein, 10 aa, Artificial Sequence
  Peptide Derived from Human Papillomavirus
NTTIPFGGAY

SEQ ID NO: 20824 - protein, 9 aa, Artificial Sequence
  Peptide Derived from Human Papillomavirus
NTVTSSTPI

SEQ ID NO: 20825 - protein, 8 aa, Artificial Sequence
  Peptide Derived from Human Papillomavirus
PAETGGHF

SEQ ID NO: 20826 - protein, 10 aa, Artificial Sequence
  Peptide Derived from Human Papillomavirus
PAETGGHFTL

SEQ ID NO: 20827 - protein, 10 aa, Artificial Sequence
  Peptide Derived from Human Papillomavirus
PAFITTPTKL

SEQ ID NO: 20828 - protein, 11 aa, Artificial Sequence
  Peptide Derived from Human Papillomavirus
PAFITTPTKLI

SEQ ID NO: 20829 - protein, 10 aa, Artificial Sequence
  Peptide Derived from Human Papillomavirus
PAILDINNTV

SEQ ID NO: 20830 - protein, 10 aa, Artificial Sequence
  Peptide Derived from Human Papillomavirus
PALTSRRTGI

SEQ ID NO: 20831 - protein, 8 aa, Artificial Sequence
  Peptide Derived from Human Papillomavirus
PANTTIPF

SEQ ID NO: 20832 - protein, 11 aa, Artificial Sequence
  Peptide Derived from Human Papillomavirus
PANTTIPFGGA

SEQ ID NO: 20833 - protein, 8 aa, Artificial Sequence
  Peptide Derived from Human Papillomavirus
PAYEGIDV

SEQ ID NO: 20834 - protein, 9 aa, Artificial Sequence
  Peptide Derived from Human Papillomavirus
PSDPSIVSL

SEQ ID NO: 20835 - protein, 10 aa, Artificial Sequence
  Peptide Derived from Human Papillomavirus
PSDPSIVSLV

SEQ ID NO: 20836 - protein, 10 aa, Artificial Sequence
  Peptide Derived from Human Papillomavirus
PSIPPDVSGF

SEQ ID NO: 20837 - protein, 8 aa, Artificial Sequence
  Peptide Derived from Human Papillomavirus
PSTSLSGY

SEQ ID NO: 20838 - protein, 9 aa, Artificial Sequence
  Peptide Derived from Human Papillomavirus
PSTSLSGYI

SEQ ID NO: 20839 - protein, 11 aa, Artificial Sequence
  Peptide Derived from Human Papillomavirus
PSTSLSGYIPA

SEQ ID NO: 20840 - protein, 10 aa, Artificial Sequence
  Peptide Derived from Human Papillomavirus
PSTYTTTSHA

SEQ ID NO: 20841 - protein, 11 aa, Artificial Sequence
  Peptide Derived from Human Papillomavirus
PSTYTTTSHAA

SEQ ID NO: 20842 - protein, 10 aa, Artificial Sequence
  Peptide Derived from Human Papillomavirus
PSVLQPPTPA

SEQ ID NO: 20843 - protein, 8 aa, Artificial Sequence
  Peptide Derived from Human Papillomavirus
PSVPSTSL

SEQ ID NO: 20844 - protein, 11 aa, Artificial Sequence
  Peptide Derived from Human Papillomavirus
PSVPSTSLSGY

SEQ ID NO: 20845 - protein, 8 aa, Artificial Sequence
  Peptide Derived from Human Papillomavirus
PTATDTLA

SEQ ID NO: 20846 - protein, 10 aa, Artificial Sequence
  Peptide Derived from Human Papillomavirus
PTATDTLAPV

SEQ ID NO: 20847 - protein, 8 aa, Artificial Sequence
  Peptide Derived from Human Papillomavirus
PTFTDPSV

SEQ ID NO: 20848 - protein, 9 aa, Artificial Sequence
  Peptide Derived from Human Papillomavirus
PTFTDPSVL

SEQ ID NO: 20849 - protein, 11 aa, Artificial Sequence
  Peptide Derived from Human Papillomavirus
PTKLITYDNPA

SEQ ID NO: 20850 - protein, 10 aa, Artificial Sequence
  Peptide Derived from Human Papillomavirus
PTPAETGGHF

SEQ ID NO: 20851 - protein, 8 aa, Artificial Sequence
  Peptide Derived from Human Papillomavirus
PTSINNGL

SEQ ID NO: 20852 - protein, 9 aa, Artificial Sequence
  Peptide Derived from Human Papillomavirus
PTSINNGLY

SEQ ID NO: 20853 - protein, 11 aa, Artificial Sequence
  Peptide Derived from Human Papillomavirus
PTSINNGLYDI

SEQ ID NO: 20854 - protein, 11 aa, Artificial Sequence
  Peptide Derived from Human Papillomavirus
PTSVPSIPPDV

SEQ ID NO: 20855 - protein, 9 aa, Artificial Sequence
  Peptide Derived from Human Papillomavirus
QAGTCPPDI

SEQ ID NO: 20856 - protein, 10 aa, Artificial Sequence
  Peptide Derived from Human Papillomavirus
QAGTCPPDII

SEQ ID NO: 20857 - protein, 8 aa, Artificial Sequence
  Peptide Derived from Human Papillomavirus
QAPSLIPI

SEQ ID NO: 20858 - protein, 9 aa, Artificial Sequence
  Peptide Derived from Human Papillomavirus
QAPSLIPIV

SEQ ID NO: 20859 - protein, 8 aa, Artificial Sequence
  Peptide Derived from Human Papillomavirus
QTITPSTY

SEQ ID NO: 20860 - protein, 11 aa, Artificial Sequence
  Peptide Derived from Human Papillomavirus
QTLRTRSGKSI

SEQ ID NO: 20861 - protein, 8 aa, Artificial Sequence
  Peptide Derived from Human Papillomavirus
RASATQLY

SEQ ID NO: 20862 - protein, 9 aa, Artificial Sequence
  Peptide Derived from Human Papillomavirus
RSAKRTKRA

SEQ ID NO: 20863 - protein, 11 aa, Artificial Sequence
  Peptide Derived from Human Papillomavirus
RSAKRTKRASA

SEQ ID NO: 20864 - protein, 8 aa, Artificial Sequence
  Peptide Derived from Human Papillomavirus
RSGKSIGA

SEQ ID NO: 20865 - protein, 10 aa, Artificial Sequence
  Peptide Derived from Human Papillomavirus
RSGKSIGAKV

SEQ ID NO: 20866 - protein, 9 aa, Artificial Sequence
  Peptide Derived from Human Papillomavirus
RTGIRYSRI

SEQ ID NO: 20867 - protein, 10 aa, Artificial Sequence
  Peptide Derived from Human Papillomavirus
RTKRASATQL

SEQ ID NO: 20868 - protein, 11 aa, Artificial Sequence
  Peptide Derived from Human Papillomavirus
RTKRASATQLY

SEQ ID NO: 20869 - protein, 8 aa, Artificial Sequence
  Peptide Derived from Human Papillomavirus
RTRSGKSI

SEQ ID NO: 20870 - protein, 10 aa, Artificial Sequence
  Peptide Derived from Human Papillomavirus
RTRSGKSIGA

SEQ ID NO: 20871 - protein, 8 aa, Artificial Sequence
  Peptide Derived from Human Papillomavirus
RTTQQVKV

SEQ ID NO: 20872 - protein, 9 aa, Artificial Sequence
  Peptide Derived from Human Papillomavirus
RTTQQVKVV

SEQ ID NO: 20873 - protein, 10 aa, Artificial Sequence
  Peptide Derived from Human Papillomavirus
SAEEIELQTI

SEQ ID NO: 20874 - protein, 8 aa, Artificial Sequence
  Peptide Derived from Human Papillomavirus
SAKRTKRA

SEQ ID NO: 20875 - protein, 10 aa, Artificial Sequence
  Peptide Derived from Human Papillomavirus
SAKRTKRASA

SEQ ID NO: 20876 - protein, 9 aa, Artificial Sequence
  Peptide Derived from Human Papillomavirus
SSNDNSINI

SEQ ID NO: 20877 - protein, 10 aa, Artificial Sequence
  Peptide Derived from Human Papillomavirus
SSNDNSINIA

SEQ ID NO: 20878 - protein, 10 aa, Artificial Sequence
  Peptide Derived from Human Papillomavirus
SSSTISTHNY

SEQ ID NO: 20879 - protein, 9 aa, Artificial Sequence
  Peptide Derived from Human Papillomavirus
SSTISTHNY

SEQ ID NO: 20880 - protein, 11 aa, Artificial Sequence
  Peptide Derived from Human Papillomavirus
SSTPIPGSRPV

SEQ ID NO: 20881 - protein, 8 aa, Artificial Sequence
  Peptide Derived from Human Papillomavirus
STDTTPAI

SEQ ID NO: 20882 - protein, 9 aa, Artificial Sequence
  Peptide Derived from Human Papillomavirus
STDTTPAIL

SEQ ID NO: 20883 - protein, 11 aa, Artificial Sequence
  Peptide Derived from Human Papillomavirus
STDTTPAILDI

SEQ ID NO: 20884 - protein, 8 aa, Artificial Sequence
  Peptide Derived from Human Papillomavirus
STHNYEEI

SEQ ID NO: 20885 - protein, 10 aa, Artificial Sequence
  Peptide Derived from Human Papillomavirus
STHNYEEIPM

SEQ ID NO: 20886 - protein, 9 aa, Artificial Sequence
  Peptide Derived from Human Papillomavirus
STIDSAEEI

SEQ ID NO: 20887 - protein, 11 aa, Artificial Sequence
  Peptide Derived from Human Papillomavirus
STIDSAEEIEL

SEQ ID NO: 20888 - protein, 8 aa, Artificial Sequence
  Peptide Derived from Human Papillomavirus
STISTHNY

SEQ ID NO: 20889 - protein, 11 aa, Artificial Sequence
  Peptide Derived from Human Papillomavirus
STISTHNYEEI

SEQ ID NO: 20890 - protein, 10 aa, Artificial Sequence
  Peptide Derived from Human Papillomavirus
STPIPGSRPV

SEQ ID NO: 20891 - protein, 11 aa, Artificial Sequence
  Peptide Derived from Human Papillomavirus
STPIPGSRPVA

SEQ ID NO: 20892 - protein, 8 aa, Artificial Sequence
  Peptide Derived from Human Papillomavirus
STSLSGYI

SEQ ID NO: 20893 - protein, 10 aa, Artificial Sequence
  Peptide Derived from Human Papillomavirus
STSLSGYIPA

SEQ ID NO: 20894 - protein, 8 aa, Artificial Sequence
  Peptide Derived from Human Papillomavirus
STTPVPSV

SEQ ID NO: 20895 - protein, 9 aa, Artificial Sequence
  Peptide Derived from Human Papillomavirus
STYTTTSHA

SEQ ID NO: 20896 - protein, 10 aa, Artificial Sequence
  Peptide Derived from Human Papillomavirus
STYTTTSHAA

SEQ ID NO: 20897 - protein, 11 aa, Artificial Sequence
  Peptide Derived from Human Papillomavirus
STYTTTSHAAL

SEQ ID NO: 20898 - protein, 9 aa, Artificial Sequence
  Peptide Derived from Human Papillomavirus
TATDTLAPV

SEQ ID NO: 20899 - protein, 8 aa, Artificial Sequence
  Peptide Derived from Human Papillomavirus
TSFIDAGA

SEQ ID NO: 20900 - protein, 10 aa, Artificial Sequence
  Peptide Derived from Human Papillomavirus
TSHAALPTSI

SEQ ID NO: 20901 - protein, 8 aa, Artificial Sequence
  Peptide Derived from Human Papillomavirus
TSINNGLY

SEQ ID NO: 20902 - protein, 10 aa, Artificial Sequence
  Peptide Derived from Human Papillomavirus
TSINNGLYDI

SEQ ID NO: 20903 - protein, 11 aa, Artificial Sequence
  Peptide Derived from Human Papillomavirus
TSINNGLYDIY

SEQ ID NO: 20904 - protein, 9 aa, Artificial Sequence
  Peptide Derived from Human Papillomavirus
TSLSGYIPA

SEQ ID NO: 20905 - protein, 9 aa, Artificial Sequence
  Peptide Derived from Human Papillomavirus
TSRRTGIRY

SEQ ID NO: 20906 - protein, 8 aa, Artificial Sequence
  Peptide Derived from Human Papillomavirus
TSTDTTPA

SEQ ID NO: 20907 - protein, 9 aa, Artificial Sequence
  Peptide Derived from Human Papillomavirus
TSTDTTPAI

SEQ ID NO: 20908 - protein, 10 aa, Artificial Sequence
  Peptide Derived from Human Papillomavirus
TSTDTTPAIL

SEQ ID NO: 20909 - protein, 9 aa, Artificial Sequence
  Peptide Derived from Human Papillomavirus
TSTTPVPSV

SEQ ID NO: 20910 - protein, 10 aa, Artificial Sequence
  Peptide Derived from Human Papillomavirus
TSVPSIPPDV

SEQ ID NO: 20911 - protein, 8 aa, Artificial Sequence
  Peptide Derived from Human Papillomavirus
TTHNNPTF

SEQ ID NO: 20912 - protein, 8 aa, Artificial Sequence
  Peptide Derived from Human Papillomavirus
TTIPFGGA

SEQ ID NO: 20913 - protein, 9 aa, Artificial Sequence
  Peptide Derived from Human Papillomavirus
TTIPFGGAY

SEQ ID NO: 20914 - protein, 11 aa, Artificial Sequence
  Peptide Derived from Human Papillomavirus
TTIPFGGAYNI

SEQ ID NO: 20915 - protein, 8 aa, Artificial Sequence
  Peptide Derived from Human Papillomavirus
TTPAILDI

SEQ ID NO: 20916 - protein, 9 aa, Artificial Sequence
  Peptide Derived from Human Papillomavirus
TTPTKLITY

SEQ ID NO: 20917 - protein, 8 aa, Artificial Sequence
  Peptide Derived from Human Papillomavirus
TTQQVKVV

SEQ ID NO: 20918 - protein, 11 aa, Artificial Sequence
  Peptide Derived from Human Papillomavirus
TTQQVKVVDPA

SEQ ID NO: 20919 - protein, 11 aa, Artificial Sequence
  Peptide Derived from Human Papillomavirus
TTSHAALPTSI

SEQ ID NO: 20920 - protein, 9 aa, Artificial Sequence
  Peptide Derived from Human Papillomavirus
TTSTDTTPA

SEQ ID NO: 20921 - protein, 10 aa, Artificial Sequence
  Peptide Derived from Human Papillomavirus
TTSTDTTPAI

SEQ ID NO: 20922 - protein, 11 aa, Artificial Sequence
  Peptide Derived from Human Papillomavirus
TTSTDTTPAIL

SEQ ID NO: 20923 - protein, 8 aa, Artificial Sequence
  Peptide Derived from Human Papillomavirus
TTTSHAAL

SEQ ID NO: 20924 - protein, 11 aa, Artificial Sequence
  Peptide Derived from Human Papillomavirus
TTVTTHNNPTF

SEQ ID NO: 20925 - protein, 8 aa, Artificial Sequence
  Peptide Derived from Human Papillomavirus
VALHRPAL

SEQ ID NO: 20926 - protein, 8 aa, Artificial Sequence
  Peptide Derived from Human Papillomavirus
VSGPDIPI

SEQ ID NO: 20927 - protein, 10 aa, Artificial Sequence
  Peptide Derived from Human Papillomavirus
VSGPDIPINI

SEQ ID NO: 20928 - protein, 9 aa, Artificial Sequence
  Peptide Derived from Human Papillomavirus
VSLVEETSF

SEQ ID NO: 20929 - protein, 10 aa, Artificial Sequence
  Peptide Derived from Human Papillomavirus
VSLVEETSFI

SEQ ID NO: 20930 - protein, 8 aa, Artificial Sequence
  Peptide Derived from Human Papillomavirus
VSTNPNTV

SEQ ID NO: 20931 - protein, 9 aa, Artificial Sequence
  Peptide Derived from Human Papillomavirus
VTTHNNPTF

SEQ ID NO: 20932 - protein, 10 aa, Artificial Sequence
  Peptide Derived from Human Papillomavirus
YSRIGNKQTL

SEQ ID NO: 20933 - protein, 8 aa, Artificial Sequence
  Peptide Derived from Human Papillomavirus
YSRTTQQV

SEQ ID NO: 20934 - protein, 10 aa, Artificial Sequence
  Peptide Derived from Human Papillomavirus
YSRTTQQVKV

SEQ ID NO: 20935 - protein, 11 aa, Artificial Sequence
  Peptide Derived from Human Papillomavirus
YSRTTQQVKVV

SEQ ID NO: 20936 - protein, 10 aa, Artificial Sequence
  Peptide Derived from Human Papillomavirus
YTIIADAGDF

SEQ ID NO: 20937 - protein, 11 aa, Artificial Sequence
  Peptide Derived from Human Papillomavirus
YTIIADAGDFY

SEQ ID NO: 20938 - protein, 8 aa, Artificial Sequence
  Peptide Derived from Human Papillomavirus
YTTTSHAA

SEQ ID NO: 20939 - protein, 9 aa, Artificial Sequence
  Peptide Derived from Human Papillomavirus
YTTTSHAAL

SEQ ID NO: 20940 - protein, 11 aa, Artificial Sequence
  Peptide Derived from Human Papillomavirus
AAAFLKSNCQA

SEQ ID NO: 20941 - protein, 10 aa, Artificial Sequence
  Peptide Derived from Human Papillomavirus
AAFLKSNCQA

SEQ ID NO: 20942 - protein, 10 aa, Artificial Sequence
  Peptide Derived from Human Papillomavirus
AALYWYRTGI

SEQ ID NO: 20943 - protein, 8 aa, Artificial Sequence
  Peptide Derived from Human Papillomavirus
ATDTGSDM

SEQ ID NO: 20944 - protein, 9 aa, Artificial Sequence
  Peptide Derived from Human Papillomavirus
ATDTGSDMV

SEQ ID NO: 20945 - protein, 11 aa, Artificial Sequence
  Peptide Derived from Human Papillomavirus
ATDTGSDMVDF

SEQ ID NO: 20946 - protein, 10 aa, Artificial Sequence
  Peptide Derived from Human Papillomavirus
ATMCKHYRRA

SEQ ID NO: 20947 - protein, 8 aa, Artificial Sequence
  Peptide Derived from Human Papillomavirus
ATTTCWTY

SEQ ID NO: 20948 - protein, 9 aa, Artificial Sequence
  Peptide Derived from Human Papillomavirus
ATTTCWTYF

SEQ ID NO: 20949 - protein, 8 aa, Artificial Sequence
  Peptide Derived from Human Papillomavirus
CATMCKHY

SEQ ID NO: 20950 - protein, 11 aa, Artificial Sequence
  Peptide Derived from Human Papillomavirus
CATMCKHYRRA

SEQ ID NO: 20951 - protein, 9 aa, Artificial Sequence
  Peptide Derived from Human Papillomavirus
CSEVEATQI

SEQ ID NO: 20952 - protein, 11 aa, Artificial Sequence
  Peptide Derived from Human Papillomavirus
CSEVEATQIQV

SEQ ID NO: 20953 - protein, 8 aa, Artificial Sequence
  Peptide Derived from Human Papillomavirus
CSGGSTEA

SEQ ID NO: 20954 - protein, 9 aa, Artificial Sequence
  Peptide Derived from Human Papillomavirus
CSGGSTEAI

SEQ ID NO: 20955 - protein, 10 aa, Artificial Sequence
  Peptide Derived from Human Papillomavirus
CSKIDEGGDW

SEQ ID NO: 20956 - protein, 8 aa, Artificial Sequence
  Peptide Derived from Human Papillomavirus
CTDWVTAI

SEQ ID NO: 20957 - protein, 9 aa, Artificial Sequence
  Peptide Derived from Human Papillomavirus
CTDWVTAIF

SEQ ID NO: 20958 - protein, 11 aa, Artificial Sequence
  Peptide Derived from Human Papillomavirus
CTDWVTAIFGV

SEQ ID NO: 20959 - protein, 9 aa, Artificial Sequence
  Peptide Derived from Human Papillomavirus
CTIAQLKDL

SEQ ID NO: 20960 - protein, 10 aa, Artificial Sequence
  Peptide Derived from Human Papillomavirus
CTIAQLKDLL

SEQ ID NO: 20961 - protein, 9 aa, Artificial Sequence
  Peptide Derived from Human Papillomavirus
DADTEGNPF

SEQ ID NO: 20962 - protein, 8 aa, Artificial Sequence
  Peptide Derived from Human Papillomavirus
DAQVLHVL

SEQ ID NO: 20963 - protein, 9 aa, Artificial Sequence
  Peptide Derived from Human Papillomavirus
DATTTCWTY

SEQ ID NO: 20964 - protein, 10 aa, Artificial Sequence
  Peptide Derived from Human Papillomavirus
DATTTCWTYF

SEQ ID NO: 20965 - protein, 9 aa, Artificial Sequence
  Peptide Derived from Human Papillomavirus
DSGYGCSEV

SEQ ID NO: 20966 - protein, 11 aa, Artificial Sequence
  Peptide Derived from Human Papillomavirus
DSGYGCSEVEA

SEQ ID NO: 20967 - protein, 9 aa, Artificial Sequence
  Peptide Derived from Human Papillomavirus
DSNFDLSEM

SEQ ID NO: 20968 - protein, 10 aa, Artificial Sequence
  Peptide Derived from Human Papillomavirus
DSNFDLSEMV

SEQ ID NO: 20969 - protein, 8 aa, Artificial Sequence
  Peptide Derived from Human Papillomavirus
DSNSNAAA

SEQ ID NO: 20970 - protein, 9 aa, Artificial Sequence
  Peptide Derived from Human Papillomavirus
DSNSNAAAF

SEQ ID NO: 20971 - protein, 10 aa, Artificial Sequence
  Peptide Derived from Human Papillomavirus
DSNSNAAAFL

SEQ ID NO: 20972 - protein, 10 aa, Artificial Sequence
  Peptide Derived from Human Papillomavirus
DTEGNPFGTF

SEQ ID NO: 20973 - protein, 8 aa, Artificial Sequence
  Peptide Derived from Human Papillomavirus
DTELSPRL

SEQ ID NO: 20974 - protein, 11 aa, Artificial Sequence
  Peptide Derived from Human Papillomavirus
DTELSPRLQEI

SEQ ID NO: 20975 - protein, 9 aa, Artificial Sequence
  Peptide Derived from Human Papillomavirus
DTGSDMVDF

SEQ ID NO: 20976 - protein, 10 aa, Artificial Sequence
  Peptide Derived from Human Papillomavirus
DTGSDMVDFI

SEQ ID NO: 20977 - protein, 10 aa, Artificial Sequence
  Peptide Derived from Human Papillomavirus
DTKVAMLDDA

SEQ ID NO: 20978 - protein, 9 aa, Artificial Sequence
  Peptide Derived from Human Papillomavirus
DTPEWIQRL

SEQ ID NO: 20979 - protein, 11 aa, Artificial Sequence
  Peptide Derived from Human Papillomavirus
DTPEWIQRLTI

SEQ ID NO: 20980 - protein, 10 aa, Artificial Sequence
  Peptide Derived from Human Papillomavirus
DTQGTFCEQA

SEQ ID NO: 20981 - protein, 10 aa, Artificial Sequence
  Peptide Derived from Human Papillomavirus
DTYGLSFTDL

SEQ ID NO: 20982 - protein, 11 aa, Artificial Sequence
  Peptide Derived from Human Papillomavirus
DTYGLSFTDLV

SEQ ID NO: 20983 - protein, 8 aa, Artificial Sequence
  Peptide Derived from Human Papillomavirus
DTYMRNAL

SEQ ID NO: 20984 - protein, 8 aa, Artificial Sequence
  Peptide Derived from Human Papillomavirus
ESDMAFEY

SEQ ID NO: 20985 - protein, 9 aa, Artificial Sequence
  Peptide Derived from Human Papillomavirus
ESDMAFEYA

SEQ ID NO: 20986 - protein, 10 aa, Artificial Sequence
  Peptide Derived from Human Papillomavirus
ESDMAFEYAL

SEQ ID NO: 20987 - protein, 11 aa, Artificial Sequence
  Peptide Derived from Human Papillomavirus
ESDMAFEYALL

SEQ ID NO: 20988 - protein, 9 aa, Artificial Sequence
  Peptide Derived from Human Papillomavirus
ESRITVFEF

SEQ ID NO: 20989 - protein, 9 aa, Artificial Sequence
  Peptide Derived from Human Papillomavirus
ETAQALFHA

SEQ ID NO: 20990 - protein, 11 aa, Artificial Sequence
  Peptide Derived from Human Papillomavirus
ETCMLIQPPKL

SEQ ID NO: 20991 - protein, 11 aa, Artificial Sequence
  Peptide Derived from Human Papillomavirus
FAGGSTENSPL

SEQ ID NO: 20992 - protein, 8 aa, Artificial Sequence
  Peptide Derived from Human Papillomavirus
FTDLVRNF

SEQ ID NO: 20993 - protein, 8 aa, Artificial Sequence
  Peptide Derived from Human Papillomavirus
FTISDSGY

SEQ ID NO: 20994 - protein, 11 aa, Artificial Sequence
  Peptide Derived from Human Papillomavirus
GAMLAVFKDTY

SEQ ID NO: 20995 - protein, 8 aa, Artificial Sequence
  Peptide Derived from Human Papillomavirus
GSDMVDFI

SEQ ID NO: 20996 - protein, 8 aa, Artificial Sequence
  Peptide Derived from Human Papillomavirus
GSTENSPL

SEQ ID NO: 20997 - protein, 9 aa, Artificial Sequence
  Peptide Derived from Human Papillomavirus
GTEGNNSSV

SEQ ID NO: 20998 - protein, 9 aa, Artificial Sequence
  Peptide Derived from Human Papillomavirus
GTFCEQAEL

SEQ ID NO: 20999 - protein, 8 aa, Artificial Sequence
  Peptide Derived from Human Papillomavirus
GTGCNGWF

SEQ ID NO: 21000 - protein, 9 aa, Artificial Sequence
  Peptide Derived from Human Papillomavirus
GTGCNGWFY

SEQ ID NO: 21001 - protein, 10 aa, Artificial Sequence
  Peptide Derived from Human Papillomavirus
GTGCNGWFYV

SEQ ID NO: 21002 - protein, 8 aa, Artificial Sequence
  Peptide Derived from Human Papillomavirus
GTPKKNCL

SEQ ID NO: 21003 - protein, 9 aa, Artificial Sequence
  Peptide Derived from Human Papillomavirus
GTPKKNCLV

SEQ ID NO: 21004 - protein, 10 aa, Artificial Sequence
  Peptide Derived from Human Papillomavirus
GTPKKNCLVF

SEQ ID NO: 21005 - protein, 8 aa, Artificial Sequence
  Peptide Derived from Human Papillomavirus
GTSDNSNI

SEQ ID NO: 21006 - protein, 11 aa, Artificial Sequence
  Peptide Derived from Human Papillomavirus
GTSDNSNIENV

SEQ ID NO: 21007 - protein, 9 aa, Artificial Sequence
  Peptide Derived from Human Papillomavirus
HAQEVHNDA

SEQ ID NO: 21008 - protein, 11 aa, Artificial Sequence
  Peptide Derived from Human Papillomavirus
HAQEVHNDAQV

SEQ ID NO: 21009 - protein, 8 aa, Artificial Sequence
  Peptide Derived from Human Papillomavirus
IAEGFKTL

SEQ ID NO: 21010 - protein, 9 aa, Artificial Sequence
  Peptide Derived from Human Papillomavirus
IAEGFKTLI

SEQ ID NO: 21011 - protein, 8 aa, Artificial Sequence
  Peptide Derived from Human Papillomavirus
IAQLKDLL

SEQ ID NO: 21012 - protein, 10 aa, Artificial Sequence
  Peptide Derived from Human Papillomavirus
IAQLKDLLKV

SEQ ID NO: 21013 - protein, 9 aa, Artificial Sequence
  Peptide Derived from Human Papillomavirus
ISDDEDENA

SEQ ID NO: 21014 - protein, 11 aa, Artificial Sequence
  Peptide Derived from Human Papillomavirus
ISDSGYGCSEV

SEQ ID NO: 21015 - protein, 11 aa, Artificial Sequence
  Peptide Derived from Human Papillomavirus
ISEVMGDTPEW

SEQ ID NO: 21016 - protein, 10 aa, Artificial Sequence
  Peptide Derived from Human Papillomavirus
ISFVNSTSHF

SEQ ID NO: 21017 - protein, 11 aa, Artificial Sequence
  Peptide Derived from Human Papillomavirus
ISFVNSTSHFW

SEQ ID NO: 21018 - protein, 10 aa, Artificial Sequence
  Peptide Derived from Human Papillomavirus
ISIDRKHKPL

SEQ ID NO: 21019 - protein, 11 aa, Artificial Sequence
  Peptide Derived from Human Papillomavirus
ISIDRKHKPLI

SEQ ID NO: 21020 - protein, 10 aa, Artificial Sequence
  Peptide Derived from Human Papillomavirus
ISLNSGQKKA

SEQ ID NO: 21021 - protein, 8 aa, Artificial Sequence
  Peptide Derived from Human Papillomavirus
ISNISEVM

SEQ ID NO: 21022 - protein, 10 aa, Artificial Sequence
  Peptide Derived from Human Papillomavirus
ITFLGALKSF

SEQ ID NO: 21023 - protein, 11 aa, Artificial Sequence
  Peptide Derived from Human Papillomavirus
ITFLGALKSFL

SEQ ID NO: 21024 - protein, 9 aa, Artificial Sequence
  Peptide Derived from Human Papillomavirus
ITVFEFPNA

SEQ ID NO: 21025 - protein, 10 aa, Artificial Sequence
  Peptide Derived from Human Papillomavirus
ITVFEFPNAF

SEQ ID NO: 21026 - protein, 9 aa, Artificial Sequence
  Peptide Derived from Human Papillomavirus
KAKRRLFTI

SEQ ID NO: 21027 - protein, 10 aa, Artificial Sequence
  Peptide Derived from Human Papillomavirus
KSDKTTCTDW

SEQ ID NO: 21028 - protein, 11 aa, Artificial Sequence
  Peptide Derived from Human Papillomavirus
KSDKTTCTDWV

SEQ ID NO: 21029 - protein, 8 aa, Artificial Sequence
  Peptide Derived from Human Papillomavirus
KSNCQAKY

SEQ ID NO: 21030 - protein, 9 aa, Artificial Sequence
  Peptide Derived from Human Papillomavirus
KSNCQAKYL

SEQ ID NO: 21031 - protein, 10 aa, Artificial Sequence
  Peptide Derived from Human Papillomavirus
KSRLTVAKGL

SEQ ID NO: 21032 - protein, 8 aa, Artificial Sequence
  Peptide Derived from Human Papillomavirus
KSYFGMSF

SEQ ID NO: 21033 - protein, 9 aa, Artificial Sequence
  Peptide Derived from Human Papillomavirus
KSYFGMSFI

SEQ ID NO: 21034 - protein, 11 aa, Artificial Sequence
  Peptide Derived from Human Papillomavirus
KSYFGMSFIHF

SEQ ID NO: 21035 - protein, 8 aa, Artificial Sequence
  Peptide Derived from Human Papillomavirus
KTLIQPFI

SEQ ID NO: 21036 - protein, 9 aa, Artificial Sequence
  Peptide Derived from Human Papillomavirus
KTLIQPFIL

SEQ ID NO: 21037 - protein, 10 aa, Artificial Sequence
  Peptide Derived from Human Papillomavirus
KTLIQPFILY

SEQ ID NO: 21038 - protein, 11 aa, Artificial Sequence
  Peptide Derived from Human Papillomavirus
KTLIQPFILYA

SEQ ID NO: 21039 - protein, 8 aa, Artificial Sequence
  Peptide Derived from Human Papillomavirus
KTTCTDWV

SEQ ID NO: 21040 - protein, 10 aa, Artificial Sequence
  Peptide Derived from Human Papillomavirus
KTTCTDWVTA

SEQ ID NO: 21041 - protein, 11 aa, Artificial Sequence
  Peptide Derived from Human Papillomavirus
KTTCTDWVTAI

SEQ ID NO: 21042 - protein, 8 aa, Artificial Sequence
  Peptide Derived from Human Papillomavirus
LADSNSNA

SEQ ID NO: 21043 - protein, 9 aa, Artificial Sequence
  Peptide Derived from Human Papillomavirus
LADSNSNAA

SEQ ID NO: 21044 - protein, 10 aa, Artificial Sequence
  Peptide Derived from Human Papillomavirus
LADSNSNAAA

SEQ ID NO: 21045 - protein, 11 aa, Artificial Sequence
  Peptide Derived from Human Papillomavirus
LADSNSNAAAF

SEQ ID NO: 21046 - protein, 8 aa, Artificial Sequence
  Peptide Derived from Human Papillomavirus
LAVFKDTY

SEQ ID NO: 21047 - protein, 10 aa, Artificial Sequence
  Peptide Derived from Human Papillomavirus
LAVFKDTYGL

SEQ ID NO: 21048 - protein, 8 aa, Artificial Sequence
  Peptide Derived from Human Papillomavirus
LSEMVQWA

SEQ ID NO: 21049 - protein, 9 aa, Artificial Sequence
  Peptide Derived from Human Papillomavirus
LSEMVQWAF

SEQ ID NO: 21050 - protein, 10 aa, Artificial Sequence
  Peptide Derived from Human Papillomavirus
LSFTDLVRNF

SEQ ID NO: 21051 - protein, 8 aa, Artificial Sequence
  Peptide Derived from Human Papillomavirus
LSPRLQEI

SEQ ID NO: 21052 - protein, 10 aa, Artificial Sequence
  Peptide Derived from Human Papillomavirus
LSPRLQEISL

SEQ ID NO: 21053 - protein, 8 aa, Artificial Sequence
  Peptide Derived from Human Papillomavirus
LTDESDMA

SEQ ID NO: 21054 - protein, 9 aa, Artificial Sequence
  Peptide Derived from Human Papillomavirus
LTDESDMAF

SEQ ID NO: 21055 - protein, 11 aa, Artificial Sequence
  Peptide Derived from Human Papillomavirus
LTDESDMAFEY

SEQ ID NO: 21056 - protein, 8 aa, Artificial Sequence
  Peptide Derived from Human Papillomavirus
LTDTKVAM

SEQ ID NO: 21057 - protein, 9 aa, Artificial Sequence
  Peptide Derived from Human Papillomavirus
LTDTKVAML

SEQ ID NO: 21058 - protein, 8 aa, Artificial Sequence
  Peptide Derived from Human Papillomavirus
LTIIQHGI

SEQ ID NO: 21059 - protein, 8 aa, Artificial Sequence
  Peptide Derived from Human Papillomavirus
LTTNIHPA

SEQ ID NO: 21060 - protein, 10 aa, Artificial Sequence
  Peptide Derived from Human Papillomavirus
LTVAKGLSTL

SEQ ID NO: 21061 - protein, 11 aa, Artificial Sequence
  Peptide Derived from Human Papillomavirus
LTVAKGLSTLL

SEQ ID NO: 21062 - protein, 8 aa, Artificial Sequence
  Peptide Derived from Human Papillomavirus
MAFEYALL

SEQ ID NO: 21063 - protein, 9 aa, Artificial Sequence
  Peptide Derived from Human Papillomavirus
MAFEYALLA

SEQ ID NO: 21064 - protein, 10 aa, Artificial Sequence
  Peptide Derived from Human Papillomavirus
MSFIHFIQGA

SEQ ID NO: 21065 - protein, 11 aa, Artificial Sequence
  Peptide Derived from Human Papillomavirus
MSFIHFIQGAV

SEQ ID NO: 21066 - protein, 8 aa, Artificial Sequence
  Peptide Derived from Human Papillomavirus
NALDGNPI

SEQ ID NO: 21067 - protein, 10 aa, Artificial Sequence
  Peptide Derived from Human Papillomavirus
NALDGNPISI

SEQ ID NO: 21068 - protein, 9 aa, Artificial Sequence
  Peptide Derived from Human Papillomavirus
NATDTGSDM

SEQ ID NO: 21069 - protein, 10 aa, Artificial Sequence
  Peptide Derived from Human Papillomavirus
NATDTGSDMV

SEQ ID NO: 21070 - protein, 11 aa, Artificial Sequence
  Peptide Derived from Human Papillomavirus
NSGQKKAKRRL

SEQ ID NO: 21071 - protein, 8 aa, Artificial Sequence
  Peptide Derived from Human Papillomavirus
NSNAAAFL

SEQ ID NO: 21072 - protein, 8 aa, Artificial Sequence
  Peptide Derived from Human Papillomavirus
NSPLGERL

SEQ ID NO: 21073 - protein, 10 aa, Artificial Sequence
  Peptide Derived from Human Papillomavirus
NSPLGERLEV

SEQ ID NO: 21074 - protein, 8 aa, Artificial Sequence
  Peptide Derived from Human Papillomavirus
NSTSHFWL

SEQ ID NO: 21075 - protein, 11 aa, Artificial Sequence
  Peptide Derived from Human Papillomavirus
NSTSHFWLEPL

SEQ ID NO: 21076 - protein, 9 aa, Artificial Sequence
  Peptide Derived from Human Papillomavirus
NTGKSYFGM

SEQ ID NO: 21077 - protein, 11 aa, Artificial Sequence
  Peptide Derived from Human Papillomavirus
NTGKSYFGMSF

SEQ ID NO: 21078 - protein, 9 aa, Artificial Sequence
  Peptide Derived from Human Papillomavirus
PAKDNRWPY

SEQ ID NO: 21079 - protein, 10 aa, Artificial Sequence
  Peptide Derived from Human Papillomavirus
PAKDNRWPYL

SEQ ID NO: 21080 - protein, 8 aa, Artificial Sequence
  Peptide Derived from Human Papillomavirus
PANTGKSY

SEQ ID NO: 21081 - protein, 9 aa, Artificial Sequence
  Peptide Derived from Human Papillomavirus
PANTGKSYF

SEQ ID NO: 21082 - protein, 11 aa, Artificial Sequence
  Peptide Derived from Human Papillomavirus
PANTGKSYFGM

SEQ ID NO: 21083 - protein, 10 aa, Artificial Sequence
  Peptide Derived from Human Papillomavirus
PTIAEGFKTL

SEQ ID NO: 21084 - protein, 11 aa, Artificial Sequence
  Peptide Derived from Human Papillomavirus
PTIAEGFKTLI

SEQ ID NO: 21085 - protein, 9 aa, Artificial Sequence
  Peptide Derived from Human Papillomavirus
QAELETAQA

SEQ ID NO: 21086 - protein, 10 aa, Artificial Sequence
  Peptide Derived from Human Papillomavirus
QAELETAQAL

SEQ ID NO: 21087 - protein, 11 aa, Artificial Sequence
  Peptide Derived from Human Papillomavirus
QAELETAQALF

SEQ ID NO: 21088 - protein, 11 aa, Artificial Sequence
  Peptide Derived from Human Papillomavirus
QAIVDKKTGDV

SEQ ID NO: 21089 - protein, 9 aa, Artificial Sequence
  Peptide Derived from Human Papillomavirus
QAKYLKDCA

SEQ ID NO: 21090 - protein, 11 aa, Artificial Sequence
  Peptide Derived from Human Papillomavirus
QAKYLKDCATM

SEQ ID NO: 21091 - protein, 9 aa, Artificial Sequence
  Peptide Derived from Human Papillomavirus
QALFHAQEV

SEQ ID NO: 21092 - protein, 9 aa, Artificial Sequence
  Peptide Derived from Human Papillomavirus
RAGQNHRPL

SEQ ID NO: 21093 - protein, 9 aa, Artificial Sequence
  Peptide Derived from Human Papillomavirus
RAQKRQMNM

SEQ ID NO: 21094 - protein, 8 aa, Artificial Sequence
  Peptide Derived from Human Papillomavirus
RSSVAALY

SEQ ID NO: 21095 - protein, 9 aa, Artificial Sequence
  Peptide Derived from Human Papillomavirus
RSSVAALYW

SEQ ID NO: 21096 - protein, 10 aa, Artificial Sequence
  Peptide Derived from Human Papillomavirus
RSSVAALYWY

SEQ ID NO: 21097 - protein, 10 aa, Artificial Sequence
  Peptide Derived from Human Papillomavirus
RTGISNISEV

SEQ ID NO: 21098 - protein, 11 aa, Artificial Sequence
  Peptide Derived from Human Papillomavirus
RTGISNISEVM

SEQ ID NO: 21099 - protein, 8 aa, Artificial Sequence
  Peptide Derived from Human Papillomavirus
RTWSRLDL

SEQ ID NO: 21100 - protein, 8 aa, Artificial Sequence
  Peptide Derived from Human Papillomavirus
SSVAALYW

SEQ ID NO: 21101 - protein, 9 aa, Artificial Sequence
  Peptide Derived from Human Papillomavirus
SSVAALYWY

SEQ ID NO: 21102 - protein, 11 aa, Artificial Sequence
  Peptide Derived from Human Papillomavirus
STENSPLGERL

SEQ ID NO: 21103 - protein, 11 aa, Artificial Sequence
  Peptide Derived from Human Papillomavirus
STLLHVPETCM

SEQ ID NO: 21104 - protein, 10 aa, Artificial Sequence
  Peptide Derived from Human Papillomavirus
STSHFWLEPL

SEQ ID NO: 21105 - protein, 10 aa, Artificial Sequence
  Peptide Derived from Human Papillomavirus
TAIFGVNPTI

SEQ ID NO: 21106 - protein, 11 aa, Artificial Sequence
  Peptide Derived from Human Papillomavirus
TAIFGVNPTIA

SEQ ID NO: 21107 - protein, 8 aa, Artificial Sequence
  Peptide Derived from Human Papillomavirus
TAQALFHA

SEQ ID NO: 21108 - protein, 11 aa, Artificial Sequence
  Peptide Derived from Human Papillomavirus
TAQALFHAQEV

SEQ ID NO: 21109 - protein, 10 aa, Artificial Sequence
  Peptide Derived from Human Papillomavirus
TSDNSNIENV

SEQ ID NO: 21110 - protein, 9 aa, Artificial Sequence
  Peptide Derived from Human Papillomavirus
TSHFWLEPL

SEQ ID NO: 21111 - protein, 9 aa, Artificial Sequence
  Peptide Derived from Human Papillomavirus
TTCTDWVTA

SEQ ID NO: 21112 - protein, 10 aa, Artificial Sequence
  Peptide Derived from Human Papillomavirus
TTCTDWVTAI

SEQ ID NO: 21113 - protein, 11 aa, Artificial Sequence
  Peptide Derived from Human Papillomavirus
TTCTDWVTAIF

SEQ ID NO: 21114 - protein, 10 aa, Artificial Sequence
  Peptide Derived from Human Papillomavirus
TTCWTYFDTY

SEQ ID NO: 21115 - protein, 11 aa, Artificial Sequence
  Peptide Derived from Human Papillomavirus
TTCWTYFDTYM

SEQ ID NO: 21116 - protein, 10 aa, Artificial Sequence
  Peptide Derived from Human Papillomavirus
TTNGEHGGNV

SEQ ID NO: 21117 - protein, 8 aa, Artificial Sequence
  Peptide Derived from Human Papillomavirus
TTTCWTYF

SEQ ID NO: 21118 - protein, 11 aa, Artificial Sequence
  Peptide Derived from Human Papillomavirus
TTTCWTYFDTY

SEQ ID NO: 21119 - protein, 11 aa, Artificial Sequence
  Peptide Derived from Human Papillomavirus
VAALYWYRTGI

SEQ ID NO: 21120 - protein, 8 aa, Artificial Sequence
  Peptide Derived from Human Papillomavirus
VAKGLSTL

SEQ ID NO: 21121 - protein, 9 aa, Artificial Sequence
  Peptide Derived from Human Papillomavirus
VAKGLSTLL

SEQ ID NO: 21122 - protein, 11 aa, Artificial Sequence
  Peptide Derived from Human Papillomavirus
VAKGLSTLLHV

SEQ ID NO: 21123 - protein, 11 aa, Artificial Sequence
  Peptide Derived from Human Papillomavirus
VTAIFGVNPTI

SEQ ID NO: 21124 - protein, 11 aa, Artificial Sequence
  Peptide Derived from Human Papillomavirus
VTTNGEHGGNV

SEQ ID NO: 21125 - protein, 8 aa, Artificial Sequence
  Peptide Derived from Human Papillomavirus
WTYFDTYM

SEQ ID NO: 21126 - protein, 11 aa, Artificial Sequence
  Peptide Derived from Human Papillomavirus
WTYFDTYMRNA

SEQ ID NO: 21127 - protein, 11 aa, Artificial Sequence
  Peptide Derived from Human Papillomavirus
YAHIQCLDCKW

SEQ ID NO: 21128 - protein, 11 aa, Artificial Sequence
  Peptide Derived from Human Papillomavirus
YALLADSNSNA

SEQ ID NO: 21129 - protein, 10 aa, Artificial Sequence
  Peptide Derived from Human Papillomavirus
AAREHGIQTL

SEQ ID NO: 21130 - protein, 10 aa, Artificial Sequence
  Peptide Derived from Human Papillomavirus
AATRPGHCGL

SEQ ID NO: 21131 - protein, 11 aa, Artificial Sequence
  Peptide Derived from Human Papillomavirus
AATRPGHCGLA

SEQ ID NO: 21132 - protein, 9 aa, Artificial Sequence
  Peptide Derived from Human Papillomavirus
ATCVSHRGL

SEQ ID NO: 21133 - protein, 10 aa, Artificial Sequence
  Peptide Derived from Human Papillomavirus
ATCVSHRGLY

SEQ ID NO: 21134 - protein, 11 aa, Artificial Sequence
  Peptide Derived from Human Papillomavirus
ATCVSHRGLYY

SEQ ID NO: 21135 - protein, 8 aa, Artificial Sequence
  Peptide Derived from Human Papillomavirus
ATQLVKQL

SEQ ID NO: 21136 - protein, 9 aa, Artificial Sequence
  Peptide Derived from Human Papillomavirus
ATRPGHCGL

SEQ ID NO: 21137 - protein, 10 aa, Artificial Sequence
  Peptide Derived from Human Papillomavirus
ATRPGHCGLA

SEQ ID NO: 21138 - protein, 8 aa, Artificial Sequence
  Peptide Derived from Human Papillomavirus
CSGNTTPI

SEQ ID NO: 21139 - protein, 9 aa, Artificial Sequence
  Peptide Derived from Human Papillomavirus
CSGNTTPII

SEQ ID NO: 21140 - protein, 11 aa, Artificial Sequence
  Peptide Derived from Human Papillomavirus
CSGNTTPIIHL

SEQ ID NO: 21141 - protein, 8 aa, Artificial Sequence
  Peptide Derived from Human Papillomavirus
CSTSDDTV

SEQ ID NO: 21142 - protein, 10 aa, Artificial Sequence
  Peptide Derived from Human Papillomavirus
CSTSDDTVSA

SEQ ID NO: 21143 - protein, 9 aa, Artificial Sequence
  Peptide Derived from Human Papillomavirus
DAGTWDKTA

SEQ ID NO: 21144 - protein, 9 aa, Artificial Sequence
  Peptide Derived from Human Papillomavirus
DSKDIDSQI

SEQ ID NO: 21145 - protein, 11 aa, Artificial Sequence
  Peptide Derived from Human Papillomavirus
DSKDIDSQIQY

SEQ ID NO: 21146 - protein, 11 aa, Artificial Sequence
  Peptide Derived from Human Papillomavirus
DSMCSTSDDTV

SEQ ID NO: 21147 - protein, 9 aa, Artificial Sequence
  Peptide Derived from Human Papillomavirus
DSQIQYWQL

SEQ ID NO: 21148 - protein, 10 aa, Artificial Sequence
  Peptide Derived from Human Papillomavirus
DSQIQYWQLI

SEQ ID NO: 21149 - protein, 9 aa, Artificial Sequence
  Peptide Derived from Human Papillomavirus
DSVQILVGY

SEQ ID NO: 21150 - protein, 10 aa, Artificial Sequence
  Peptide Derived from Human Papillomavirus
DSVQILVGYM

SEQ ID NO: 21151 - protein, 9 aa, Artificial Sequence
  Peptide Derived from Human Papillomavirus
DSVYYMTDA

SEQ ID NO: 21152 - protein, 8 aa, Artificial Sequence
  Peptide Derived from Human Papillomavirus
DTVSATQL

SEQ ID NO: 21153 - protein, 9 aa, Artificial Sequence
  Peptide Derived from Human Papillomavirus
DTVSATQLV

SEQ ID NO: 21154 - protein, 10 aa, Artificial Sequence
  Peptide Derived from Human Papillomavirus
ETLSERLSCV

SEQ ID NO: 21155 - protein, 8 aa, Artificial Sequence
  Peptide Derived from Human Papillomavirus
ETQRTKFL

SEQ ID NO: 21156 - protein, 11 aa, Artificial Sequence
  Peptide Derived from Human Papillomavirus
ETQRTKFLNTV

SEQ ID NO: 21157 - protein, 8 aa, Artificial Sequence
  Peptide Derived from Human Papillomavirus
FAAREHGI

SEQ ID NO: 21158 - protein, 11 aa, Artificial Sequence
  Peptide Derived from Human Papillomavirus
FAAREHGIQTL

SEQ ID NO: 21159 - protein, 9 aa, Artificial Sequence
  Peptide Derived from Human Papillomavirus
GAGNEKTGI

SEQ ID NO: 21160 - protein, 10 aa, Artificial Sequence
  Peptide Derived from Human Papillomavirus
GAGNEKTGIL

SEQ ID NO: 21161 - protein, 11 aa, Artificial Sequence
  Peptide Derived from Human Papillomavirus
GTAKTYGQTSA

SEQ ID NO: 21162 - protein, 10 aa, Artificial Sequence
  Peptide Derived from Human Papillomavirus
GTWDKTATCV

SEQ ID NO: 21163 - protein, 11 aa, Artificial Sequence
  Peptide Derived from Human Papillomavirus
GTWEVHFGNNV

SEQ ID NO: 21164 - protein, 8 aa, Artificial Sequence
  Peptide Derived from Human Papillomavirus
HSDHYRDI

SEQ ID NO: 21165 - protein, 9 aa, Artificial Sequence
  Peptide Derived from Human Papillomavirus
HSETQRTKF

SEQ ID NO: 21166 - protein, 10 aa, Artificial Sequence
  Peptide Derived from Human Papillomavirus
HSETQRTKFL

SEQ ID NO: 21167 - protein, 10 aa, Artificial Sequence
  Peptide Derived from Human Papillomavirus
HTPSPYSSTV

SEQ ID NO: 21168 - protein, 9 aa, Artificial Sequence
  Peptide Derived from Human Papillomavirus
ISKSKAHKA

SEQ ID NO: 21169 - protein, 10 aa, Artificial Sequence
  Peptide Derived from Human Papillomavirus
ISKSKAHKAI

SEQ ID NO: 21170 - protein, 10 aa, Artificial Sequence
  Peptide Derived from Human Papillomavirus
ISSTWHWTGA

SEQ ID NO: 21171 - protein, 8 aa, Artificial Sequence
  Peptide Derived from Human Papillomavirus
KAHKAIEL

SEQ ID NO: 21172 - protein, 10 aa, Artificial Sequence
  Peptide Derived from Human Papillomavirus
KAHKAIELQM

SEQ ID NO: 21173 - protein, 11 aa, Artificial Sequence
  Peptide Derived from Human Papillomavirus
KAHKAIELQMA

SEQ ID NO: 21174 - protein, 8 aa, Artificial Sequence
  Peptide Derived from Human Papillomavirus
KAIELQMA

SEQ ID NO: 21175 - protein, 9 aa, Artificial Sequence
  Peptide Derived from Human Papillomavirus
KAIELQMAL

SEQ ID NO: 21176 - protein, 8 aa, Artificial Sequence
  Peptide Derived from Human Papillomavirus
KSKAHKAI

SEQ ID NO: 21177 - protein, 10 aa, Artificial Sequence
  Peptide Derived from Human Papillomavirus
KSKAHKAIEL

SEQ ID NO: 21178 - protein, 11 aa, Artificial Sequence
  Peptide Derived from Human Papillomavirus
KTATCVSHRGL

SEQ ID NO: 21179 - protein, 9 aa, Artificial Sequence
  Peptide Derived from Human Papillomavirus
KTGILTVTY

SEQ ID NO: 21180 - protein, 8 aa, Artificial Sequence
  Peptide Derived from Human Papillomavirus
KTYGQTSA

SEQ ID NO: 21181 - protein, 9 aa, Artificial Sequence
  Peptide Derived from Human Papillomavirus
KTYGQTSAA

SEQ ID NO: 21182 - protein, 10 aa, Artificial Sequence
  Peptide Derived from Human Papillomavirus
LAEKQHCGPV

SEQ ID NO: 21183 - protein, 11 aa, Artificial Sequence
  Peptide Derived from Human Papillomavirus
LAQSRYKTEDW

SEQ ID NO: 21184 - protein, 8 aa, Artificial Sequence
  Peptide Derived from Human Papillomavirus
LSCVQDKI

SEQ ID NO: 21185 - protein, 9 aa, Artificial Sequence
  Peptide Derived from Human Papillomavirus
LSCVQDKII

SEQ ID NO: 21186 - protein, 8 aa, Artificial Sequence
  Peptide Derived from Human Papillomavirus
LSERLSCV

SEQ ID NO: 21187 - protein, 11 aa, Artificial Sequence
  Peptide Derived from Human Papillomavirus
MALQGLAQSRY

SEQ ID NO: 21188 - protein, 11 aa, Artificial Sequence
  Peptide Derived from Human Papillomavirus
MTDAGTWDKTA

SEQ ID NO: 21189 - protein, 9 aa, Artificial Sequence
  Peptide Derived from Human Papillomavirus
MTYVAWDSV

SEQ ID NO: 21190 - protein, 10 aa, Artificial Sequence
  Peptide Derived from Human Papillomavirus
MTYVAWDSVY

SEQ ID NO: 21191 - protein, 11 aa, Artificial Sequence
  Peptide Derived from Human Papillomavirus
MTYVAWDSVYY

SEQ ID NO: 21192 - protein, 8 aa, Artificial Sequence
  Peptide Derived from Human Papillomavirus
NSLKCLRY

SEQ ID NO: 21193 - protein, 10 aa, Artificial Sequence
  Peptide Derived from Human Papillomavirus
NSLKCLRYRL

SEQ ID NO: 21194 - protein, 8 aa, Artificial Sequence
  Peptide Derived from Human Papillomavirus
NTEPTHCF

SEQ ID NO: 21195 - protein, 9 aa, Artificial Sequence
  Peptide Derived from Human Papillomavirus
NTGTWEVHF

SEQ ID NO: 21196 - protein, 8 aa, Artificial Sequence
  Peptide Derived from Human Papillomavirus
NTTPIIHL

SEQ ID NO: 21197 - protein, 9 aa, Artificial Sequence
  Peptide Derived from Human Papillomavirus
NTVAIPDSV

SEQ ID NO: 21198 - protein, 11 aa, Artificial Sequence
  Peptide Derived from Human Papillomavirus
NTVAIPDSVQI

SEQ ID NO: 21199 - protein, 10 aa, Artificial Sequence
  Peptide Derived from Human Papillomavirus
PAYNISKSKA

SEQ ID NO: 21200 - protein, 8 aa, Artificial Sequence
  Peptide Derived from Human Papillomavirus
PSPYSSTV

SEQ ID NO: 21201 - protein, 10 aa, Artificial Sequence
  Peptide Derived from Human Papillomavirus
PSPYSSTVSV

SEQ ID NO: 21202 - protein, 10 aa, Artificial Sequence
  Peptide Derived from Human Papillomavirus
PTGNNKRRKL

SEQ ID NO: 21203 - protein, 9 aa, Artificial Sequence
  Peptide Derived from Human Papillomavirus
QSRYKTEDW

SEQ ID NO: 21204 - protein, 11 aa, Artificial Sequence
  Peptide Derived from Human Papillomavirus
QSRYKTEDWTL

SEQ ID NO: 21205 - protein, 8 aa, Artificial Sequence
  Peptide Derived from Human Papillomavirus
QTLNHQVV

SEQ ID NO: 21206 - protein, 10 aa, Artificial Sequence
  Peptide Derived from Human Papillomavirus
QTLNHQVVPA

SEQ ID NO: 21207 - protein, 11 aa, Artificial Sequence
  Peptide Derived from Human Papillomavirus
QTLNHQVVPAY

SEQ ID NO: 21208 - protein, 11 aa, Artificial Sequence
  Peptide Derived from Human Papillomavirus
QTPKETLSERL

SEQ ID NO: 21209 - protein, 8 aa, Artificial Sequence
  Peptide Derived from Human Papillomavirus
RTKFLNTV

SEQ ID NO: 21210 - protein, 9 aa, Artificial Sequence
  Peptide Derived from Human Papillomavirus
RTKFLNTVA

SEQ ID NO: 21211 - protein, 10 aa, Artificial Sequence
  Peptide Derived from Human Papillomavirus
RTKFLNTVAI

SEQ ID NO: 21212 - protein, 11 aa, Artificial Sequence
  Peptide Derived from Human Papillomavirus
SAATRPGHCGL

SEQ ID NO: 21213 - protein, 9 aa, Artificial Sequence
  Peptide Derived from Human Papillomavirus
SATQLVKQL

SEQ ID NO: 21214 - protein, 9 aa, Artificial Sequence
  Peptide Derived from Human Papillomavirus
SSTVSVGTA

SEQ ID NO: 21215 - protein, 9 aa, Artificial Sequence
  Peptide Derived from Human Papillomavirus
SSTWHWTGA

SEQ ID NO: 21216 - protein, 9 aa, Artificial Sequence
  Peptide Derived from Human Papillomavirus
STSDDTVSA

SEQ ID NO: 21217 - protein, 8 aa, Artificial Sequence
  Peptide Derived from Human Papillomavirus
STVSVGTA

SEQ ID NO: 21218 - protein, 11 aa, Artificial Sequence
  Peptide Derived from Human Papillomavirus
STVSVGTAKTY

SEQ ID NO: 21219 - protein, 8 aa, Artificial Sequence
  Peptide Derived from Human Papillomavirus
STWHWTGA

SEQ ID NO: 21220 - protein, 10 aa, Artificial Sequence
  Peptide Derived from Human Papillomavirus
TAKTYGQTSA

SEQ ID NO: 21221 - protein, 11 aa, Artificial Sequence
  Peptide Derived from Human Papillomavirus
TAKTYGQTSAA

SEQ ID NO: 21222 - protein, 10 aa, Artificial Sequence
  Peptide Derived from Human Papillomavirus
TATCVSHRGL

SEQ ID NO: 21223 - protein, 11 aa, Artificial Sequence
  Peptide Derived from Human Papillomavirus
TATCVSHRGLY

SEQ ID NO: 21224 - protein, 8 aa, Artificial Sequence
  Peptide Derived from Human Papillomavirus
TSDDTVSA

SEQ ID NO: 21225 - protein, 11 aa, Artificial Sequence
  Peptide Derived from Human Papillomavirus
TSDDTVSATQL

SEQ ID NO: 21226 - protein, 9 aa, Artificial Sequence
  Peptide Derived from Human Papillomavirus
VAIPDSVQI

SEQ ID NO: 21227 - protein, 10 aa, Artificial Sequence
  Peptide Derived from Human Papillomavirus
VAIPDSVQIL

SEQ ID NO: 21228 - protein, 11 aa, Artificial Sequence
  Peptide Derived from Human Papillomavirus
VAIPDSVQILV

SEQ ID NO: 21229 - protein, 8 aa, Artificial Sequence
  Peptide Derived from Human Papillomavirus
VAWDSVYY

SEQ ID NO: 21230 - protein, 9 aa, Artificial Sequence
  Peptide Derived from Human Papillomavirus
VAWDSVYYM

SEQ ID NO: 21231 - protein, 10 aa, Artificial Sequence
  Peptide Derived from Human Papillomavirus
VSATQLVKQL

SEQ ID NO: 21232 - protein, 8 aa, Artificial Sequence
  Peptide Derived from Human Papillomavirus
VSHRGLYY

SEQ ID NO: 21233 - protein, 9 aa, Artificial Sequence
  Peptide Derived from Human Papillomavirus
VSHRGLYYV

SEQ ID NO: 21234 - protein, 9 aa, Artificial Sequence
  Peptide Derived from Human Papillomavirus
VSVGTAKTY

SEQ ID NO: 21235 - protein, 11 aa, Artificial Sequence
  Peptide Derived from Human Papillomavirus
WTGAGNEKTGI

SEQ ID NO: 21236 - protein, 10 aa, Artificial Sequence
  Peptide Derived from Human Papillomavirus
WTLQDTCEEL

SEQ ID NO: 21237 - protein, 11 aa, Artificial Sequence
  Peptide Derived from Human Papillomavirus
WTLQDTCEELW

SEQ ID NO: 21238 - protein, 10 aa, Artificial Sequence
  Peptide Derived from Human Papillomavirus
YSSTVSVGTA

SEQ ID NO: 21239 - protein, 8 aa, Artificial Sequence
  Peptide Derived from Human Papillomavirus
ATAFTVYV

SEQ ID NO: 21240 - protein, 9 aa, Artificial Sequence
  Peptide Derived from Human Papillomavirus
ATAFTVYVF

SEQ ID NO: 21241 - protein, 11 aa, Artificial Sequence
  Peptide Derived from Human Papillomavirus
ATAFTVYVFCF

SEQ ID NO: 21242 - protein, 8 aa, Artificial Sequence
  Peptide Derived from Human Papillomavirus
CAYAWVLV

SEQ ID NO: 21243 - protein, 9 aa, Artificial Sequence
  Peptide Derived from Human Papillomavirus
CAYAWVLVF

SEQ ID NO: 21244 - protein, 10 aa, Artificial Sequence
  Peptide Derived from Human Papillomavirus
CAYAWVLVFV

SEQ ID NO: 21245 - protein, 11 aa, Artificial Sequence
  Peptide Derived from Human Papillomavirus
CAYAWVLVFVY

SEQ ID NO: 21246 - protein, 8 aa, Artificial Sequence
  Peptide Derived from Human Papillomavirus
FTVYVFCF

SEQ ID NO: 21247 - protein, 9 aa, Artificial Sequence
  Peptide Derived from Human Papillomavirus
FTVYVFCFL

SEQ ID NO: 21248 - protein, 10 aa, Artificial Sequence
  Peptide Derived from Human Papillomavirus
FTVYVFCFLL

SEQ ID NO: 21249 - protein, 8 aa, Artificial Sequence
  Peptide Derived from Human Papillomavirus
ITSPATAF

SEQ ID NO: 21250 - protein, 10 aa, Artificial Sequence
  Peptide Derived from Human Papillomavirus
ITSPATAFTV

SEQ ID NO: 21251 - protein, 11 aa, Artificial Sequence
  Peptide Derived from Human Papillomavirus
ITSPATAFTVY

SEQ ID NO: 21252 - protein, 9 aa, Artificial Sequence
  Peptide Derived from Human Papillomavirus
LSLIFLFCF

SEQ ID NO: 21253 - protein, 11 aa, Artificial Sequence
  Peptide Derived from Human Papillomavirus
LSLIFLFCFCV

SEQ ID NO: 21254 - protein, 8 aa, Artificial Sequence
  Peptide Derived from Human Papillomavirus
PATAFTVY

SEQ ID NO: 21255 - protein, 9 aa, Artificial Sequence
  Peptide Derived from Human Papillomavirus
PATAFTVYV

SEQ ID NO: 21256 - protein, 10 aa, Artificial Sequence
  Peptide Derived from Human Papillomavirus
PATAFTVYVF

SEQ ID NO: 21257 - protein, 8 aa, Artificial Sequence
  Peptide Derived from Human Papillomavirus
PSVCMCAY

SEQ ID NO: 21258 - protein, 9 aa, Artificial Sequence
  Peptide Derived from Human Papillomavirus
PSVCMCAYA

SEQ ID NO: 21259 - protein, 10 aa, Artificial Sequence
  Peptide Derived from Human Papillomavirus
PSVCMCAYAW

SEQ ID NO: 21260 - protein, 11 aa, Artificial Sequence
  Peptide Derived from Human Papillomavirus
PSVCMCAYAWV

SEQ ID NO: 21261 - protein, 8 aa, Artificial Sequence
  Peptide Derived from Human Papillomavirus
TAFTVYVF

SEQ ID NO: 21262 - protein, 10 aa, Artificial Sequence
  Peptide Derived from Human Papillomavirus
TAFTVYVFCF

SEQ ID NO: 21263 - protein, 11 aa, Artificial Sequence
  Peptide Derived from Human Papillomavirus
TAFTVYVFCFL

SEQ ID NO: 21264 - protein, 9 aa, Artificial Sequence
  Peptide Derived from Human Papillomavirus
TSPATAFTV

SEQ ID NO: 21265 - protein, 10 aa, Artificial Sequence
  Peptide Derived from Human Papillomavirus
TSPATAFTVY

SEQ ID NO: 21266 - protein, 11 aa, Artificial Sequence
  Peptide Derived from Human Papillomavirus
TSPATAFTVYV

SEQ ID NO: 21267 - protein, 8 aa, Artificial Sequence
  Peptide Derived from Human Papillomavirus
YAWVLVFV

SEQ ID NO: 21268 - protein, 9 aa, Artificial Sequence
  Peptide Derived from Human Papillomavirus
YAWVLVFVY

SEQ ID NO: 21269 - protein, 10 aa, Artificial Sequence
  Peptide Derived from Human Papillomavirus
YAWVLVFVYI

SEQ ID NO: 21270 - protein, 11 aa, Artificial Sequence
  Peptide Derived from Human Papillomavirus
YAWVLVFVYIV

SEQ ID NO: 21271 - protein, 9 aa, Artificial Sequence
  Peptide Derived from Human Papillomavirus
AACHKCIDF

SEQ ID NO: 21272 - protein, 10 aa, Artificial Sequence
  Peptide Derived from Human Papillomavirus
AACHKCIDFY

SEQ ID NO: 21273 - protein, 8 aa, Artificial Sequence
  Peptide Derived from Human Papillomavirus
CTELNTSL

SEQ ID NO: 21274 - protein, 11 aa, Artificial Sequence
  Peptide Derived from Human Papillomavirus
CTELNTSLQDI

SEQ ID NO: 21275 - protein, 8 aa, Artificial Sequence
  Peptide Derived from Human Papillomavirus
DSVYGDTL

SEQ ID NO: 21276 - protein, 11 aa, Artificial Sequence
  Peptide Derived from Human Papillomavirus
DSVYGDTLEKL

SEQ ID NO: 21277 - protein, 11 aa, Artificial Sequence
  Peptide Derived from Human Papillomavirus
DTLEKLTNTGL

SEQ ID NO: 21278 - protein, 8 aa, Artificial Sequence
  Peptide Derived from Human Papillomavirus
FAFKDLFV

SEQ ID NO: 21279 - protein, 9 aa, Artificial Sequence
  Peptide Derived from Human Papillomavirus
FAFKDLFVV

SEQ ID NO: 21280 - protein, 10 aa, Artificial Sequence
  Peptide Derived from Human Papillomavirus
FAFKDLFVVY

SEQ ID NO: 21281 - protein, 8 aa, Artificial Sequence
  Peptide Derived from Human Papillomavirus
HAACHKCI

SEQ ID NO: 21282 - protein, 10 aa, Artificial Sequence
  Peptide Derived from Human Papillomavirus
HAACHKCIDF

SEQ ID NO: 21283 - protein, 11 aa, Artificial Sequence
  Peptide Derived from Human Papillomavirus
HAACHKCIDFY

SEQ ID NO: 21284 - protein, 9 aa, Artificial Sequence
  Peptide Derived from Human Papillomavirus
ITCVYCKTV

SEQ ID NO: 21285 - protein, 10 aa, Artificial Sequence
  Peptide Derived from Human Papillomavirus
ITCVYCKTVL

SEQ ID NO: 21286 - protein, 9 aa, Artificial Sequence
  Peptide Derived from Human Papillomavirus
KTVLELTEV

SEQ ID NO: 21287 - protein, 10 aa, Artificial Sequence
  Peptide Derived from Human Papillomavirus
KTVLELTEVF

SEQ ID NO: 21288 - protein, 8 aa, Artificial Sequence
  Peptide Derived from Human Papillomavirus
LTEVFEFA

SEQ ID NO: 21289 - protein, 9 aa, Artificial Sequence
  Peptide Derived from Human Papillomavirus
LTEVFEFAF

SEQ ID NO: 21290 - protein, 9 aa, Artificial Sequence
  Peptide Derived from Human Papillomavirus
LTNTGLYNL

SEQ ID NO: 21291 - protein, 10 aa, Artificial Sequence
  Peptide Derived from Human Papillomavirus
LTNTGLYNLL

SEQ ID NO: 21292 - protein, 11 aa, Artificial Sequence
  Peptide Derived from Human Papillomavirus
LTNTGLYNLLI

SEQ ID NO: 21293 - protein, 8 aa, Artificial Sequence
  Peptide Derived from Human Papillomavirus
NTGLYNLL

SEQ ID NO: 21294 - protein, 9 aa, Artificial Sequence
  Peptide Derived from Human Papillomavirus
NTGLYNLLI

SEQ ID NO: 21295 - protein, 9 aa, Artificial Sequence
  Peptide Derived from Human Papillomavirus
NTSLQDIEI

SEQ ID NO: 21296 - protein, 8 aa, Artificial Sequence
  Peptide Derived from Human Papillomavirus
PAEKLRHL

SEQ ID NO: 21297 - protein, 8 aa, Artificial Sequence
  Peptide Derived from Human Papillomavirus
PTRRPYKL

SEQ ID NO: 21298 - protein, 11 aa, Artificial Sequence
  Peptide Derived from Human Papillomavirus
PTRRPYKLPDL

SEQ ID NO: 21299 - protein, 8 aa, Artificial Sequence
  Peptide Derived from Human Papillomavirus
TSLQDIEI

SEQ ID NO: 21300 - protein, 11 aa, Artificial Sequence
  Peptide Derived from Human Papillomavirus
TSLQDIEITCV

SEQ ID NO: 21301 - protein, 10 aa, Artificial Sequence
  Peptide Derived from Human Papillomavirus
YSDSVYGDTL

SEQ ID NO: 21302 - protein, 10 aa, Artificial Sequence
  Peptide Derived from Human Papillomavirus
YSRIRELRHY

SEQ ID NO: 21303 - protein, 8 aa, Artificial Sequence
  Peptide Derived from Human Papillomavirus
ATLQDIVL

SEQ ID NO: 21304 - protein, 10 aa, Artificial Sequence
  Peptide Derived from Human Papillomavirus
ATLQDIVLHL

SEQ ID NO: 21305 - protein, 9 aa, Artificial Sequence
  Peptide Derived from Human Papillomavirus
DSEEENDEI

SEQ ID NO: 21306 - protein, 8 aa, Artificial Sequence
  Peptide Derived from Human Papillomavirus
EARIKLVV

SEQ ID NO: 21307 - protein, 9 aa, Artificial Sequence
  Peptide Derived from Human Papillomavirus
ESSADDLRA

SEQ ID NO: 21308 - protein, 10 aa, Artificial Sequence
  Peptide Derived from Human Papillomavirus
ESSADDLRAF

SEQ ID NO: 21309 - protein, 8 aa, Artificial Sequence
  Peptide Derived from Human Papillomavirus
KATLQDIV

SEQ ID NO: 21310 - protein, 9 aa, Artificial Sequence
  Peptide Derived from Human Papillomavirus
KATLQDIVL

SEQ ID NO: 21311 - protein, 11 aa, Artificial Sequence
  Peptide Derived from Human Papillomavirus
KATLQDIVLHL

SEQ ID NO: 21312 - protein, 11 aa, Artificial Sequence
  Peptide Derived from Human Papillomavirus
LSDSEEENDEI

SEQ ID NO: 21313 - protein, 9 aa, Artificial Sequence
  Peptide Derived from Human Papillomavirus
LSFVCPWCA

SEQ ID NO: 21314 - protein, 9 aa, Artificial Sequence
  Peptide Derived from Human Papillomavirus
NTLSFVCPW

SEQ ID NO: 21315 - protein, 11 aa, Artificial Sequence
  Peptide Derived from Human Papillomavirus
NTLSFVCPWCA

SEQ ID NO: 21316 - protein, 9 aa, Artificial Sequence
  Peptide Derived from Human Papillomavirus
RAEPQRHTM

SEQ ID NO: 21317 - protein, 10 aa, Artificial Sequence
  Peptide Derived from Human Papillomavirus
RAEPQRHTML

SEQ ID NO: 21318 - protein, 8 aa, Artificial Sequence
  Peptide Derived from Human Papillomavirus
RAFQQLFL

SEQ ID NO: 21319 - protein, 11 aa, Artificial Sequence
  Peptide Derived from Human Papillomavirus
RAFQQLFLNTL

SEQ ID NO: 21320 - protein, 8 aa, Artificial Sequence
  Peptide Derived from Human Papillomavirus
SADDLRAF

SEQ ID NO: 21321 - protein, 11 aa, Artificial Sequence
  Peptide Derived from Human Papillomavirus
SADDLRAFQQL

SEQ ID NO: 21322 - protein, 8 aa, Artificial Sequence
  Peptide Derived from Human Papillomavirus
SSADDLRA

SEQ ID NO: 21323 - protein, 9 aa, Artificial Sequence
  Peptide Derived from Human Papillomavirus
SSADDLRAF

SEQ ID NO: 21324 - protein, 10 aa, Artificial Sequence
  Peptide Derived from Human Papillomavirus
AAPAENKDPY

SEQ ID NO: 21325 - protein, 10 aa, Artificial Sequence
  Peptide Derived from Human Papillomavirus
AATSNVSEDV

SEQ ID NO: 21326 - protein, 8 aa, Artificial Sequence
  Peptide Derived from Human Papillomavirus
ASPGSCVY

SEQ ID NO: 21327 - protein, 11 aa, Artificial Sequence
  Peptide Derived from Human Papillomavirus
ASTQSPVPGQY

SEQ ID NO: 21328 - protein, 11 aa, Artificial Sequence
  Peptide Derived from Human Papillomavirus
ATKFKQYSRHV

SEQ ID NO: 21329 - protein, 9 aa, Artificial Sequence
  Peptide Derived from Human Papillomavirus
ATSNVSEDV

SEQ ID NO: 21330 - protein, 8 aa, Artificial Sequence
  Peptide Derived from Human Papillomavirus
ATTSSKPA

SEQ ID NO: 21331 - protein, 11 aa, Artificial Sequence
  Peptide Derived from Human Papillomavirus
ATTSSKPAKRV

SEQ ID NO: 21332 - protein, 9 aa, Artificial Sequence
  Peptide Derived from Human Papillomavirus
CAPAIGEHW

SEQ ID NO: 21333 - protein, 10 aa, Artificial Sequence
  Peptide Derived from Human Papillomavirus
CAPAIGEHWA

SEQ ID NO: 21334 - protein, 8 aa, Artificial Sequence
  Peptide Derived from Human Papillomavirus
CASTQSPV

SEQ ID NO: 21335 - protein, 9 aa, Artificial Sequence
  Peptide Derived from Human Papillomavirus
CTITLTADV

SEQ ID NO: 21336 - protein, 10 aa, Artificial Sequence
  Peptide Derived from Human Papillomavirus
CTITLTADVM

SEQ ID NO: 21337 - protein, 11 aa, Artificial Sequence
  Peptide Derived from Human Papillomavirus
DAAPAENKDPY

SEQ ID NO: 21338 - protein, 8 aa, Artificial Sequence
  Peptide Derived from Human Papillomavirus
DATKFKQY

SEQ ID NO: 21339 - protein, 9 aa, Artificial Sequence
  Peptide Derived from Human Papillomavirus
DSQLFNKPY

SEQ ID NO: 21340 - protein, 10 aa, Artificial Sequence
  Peptide Derived from Human Papillomavirus
DSQLFNKPYW

SEQ ID NO: 21341 - protein, 11 aa, Artificial Sequence
  Peptide Derived from Human Papillomavirus
DSQLFNKPYWL

SEQ ID NO: 21342 - protein, 8 aa, Artificial Sequence
  Peptide Derived from Human Papillomavirus
DTESSHAA

SEQ ID NO: 21343 - protein, 9 aa, Artificial Sequence
  Peptide Derived from Human Papillomavirus
DTGYGAMDF

SEQ ID NO: 21344 - protein, 8 aa, Artificial Sequence
  Peptide Derived from Human Papillomavirus
DTKCEVPL

SEQ ID NO: 21345 - protein, 10 aa, Artificial Sequence
  Peptide Derived from Human Papillomavirus
DTKCEVPLDI

SEQ ID NO: 21346 - protein, 8 aa, Artificial Sequence
  Peptide Derived from Human Papillomavirus
DTTPSTNL

SEQ ID NO: 21347 - protein, 10 aa, Artificial Sequence
  Peptide Derived from Human Papillomavirus
DTTPSTNLTI

SEQ ID NO: 21348 - protein, 8 aa, Artificial Sequence
  Peptide Derived from Human Papillomavirus
DTVPQSLY

SEQ ID NO: 21349 - protein, 9 aa, Artificial Sequence
  Peptide Derived from Human Papillomavirus
DTVPQSLYI

SEQ ID NO: 21350 - protein, 9 aa, Artificial Sequence
  Peptide Derived from Human Papillomavirus
DTYRFVQSV

SEQ ID NO: 21351 - protein, 10 aa, Artificial Sequence
  Peptide Derived from Human Papillomavirus
DTYRFVQSVA

SEQ ID NO: 21352 - protein, 11 aa, Artificial Sequence
  Peptide Derived from Human Papillomavirus
DTYRFVQSVAI

SEQ ID NO: 21353 - protein, 10 aa, Artificial Sequence
  Peptide Derived from Human Papillomavirus
ESSHAATSNV

SEQ ID NO: 21354 - protein, 8 aa, Artificial Sequence
  Peptide Derived from Human Papillomavirus
ETQRLVWA

SEQ ID NO: 21355 - protein, 10 aa, Artificial Sequence
  Peptide Derived from Human Papillomavirus
ETQRLVWACA

SEQ ID NO: 21356 - protein, 9 aa, Artificial Sequence
  Peptide Derived from Human Papillomavirus
FARHFWNRA

SEQ ID NO: 21357 - protein, 8 aa, Artificial Sequence
  Peptide Derived from Human Papillomavirus
FSLDLDQY

SEQ ID NO: 21358 - protein, 10 aa, Artificial Sequence
  Peptide Derived from Human Papillomavirus
FSLDLDQYPL

SEQ ID NO: 21359 - protein, 11 aa, Artificial Sequence
  Peptide Derived from Human Papillomavirus
FSTLQDTKCEV

SEQ ID NO: 21360 - protein, 8 aa, Artificial Sequence
  Peptide Derived from Human Papillomavirus
GAMDFSTL

SEQ ID NO: 21361 - protein, 10 aa, Artificial Sequence
  Peptide Derived from Human Papillomavirus
GSIVTSDSQL

SEQ ID NO: 21362 - protein, 11 aa, Artificial Sequence
  Peptide Derived from Human Papillomavirus
GSIVTSDSQLF

SEQ ID NO: 21363 - protein, 8 aa, Artificial Sequence
  Peptide Derived from Human Papillomavirus
GSSRLLTV

SEQ ID NO: 21364 - protein, 9 aa, Artificial Sequence
  Peptide Derived from Human Papillomavirus
GTACKSRPL

SEQ ID NO: 21365 - protein, 11 aa, Artificial Sequence
  Peptide Derived from Human Papillomavirus
GTMGDTVPQSL

SEQ ID NO: 21366 - protein, 11 aa, Artificial Sequence
  Peptide Derived from Human Papillomavirus
HAATSNVSEDV

SEQ ID NO: 21367 - protein, 8 aa, Artificial Sequence
  Peptide Derived from Human Papillomavirus
HAGSSRLL

SEQ ID NO: 21368 - protein, 10 aa, Artificial Sequence
  Peptide Derived from Human Papillomavirus
HAGSSRLLTV

SEQ ID NO: 21369 - protein, 8 aa, Artificial Sequence
  Peptide Derived from Human Papillomavirus
HSILVYMV

SEQ ID NO: 21370 - protein, 10 aa, Artificial Sequence
  Peptide Derived from Human Papillomavirus
HSILVYMVHI

SEQ ID NO: 21371 - protein, 11 aa, Artificial Sequence
  Peptide Derived from Human Papillomavirus
HSILVYMVHII

SEQ ID NO: 21372 - protein, 8 aa, Artificial Sequence
  Peptide Derived from Human Papillomavirus
HSMNSSIL

SEQ ID NO: 21373 - protein, 11 aa, Artificial Sequence
  Peptide Derived from Human Papillomavirus
HSMNSSILEDW

SEQ ID NO: 21374 - protein, 8 aa, Artificial Sequence
  Peptide Derived from Human Papillomavirus
ITCQKDAA

SEQ ID NO: 21375 - protein, 10 aa, Artificial Sequence
  Peptide Derived from Human Papillomavirus
ITCQKDAAPA

SEQ ID NO: 21376 - protein, 8 aa, Artificial Sequence
  Peptide Derived from Human Papillomavirus
ITLTADVM

SEQ ID NO: 21377 - protein, 10 aa, Artificial Sequence
  Peptide Derived from Human Papillomavirus
ITLTADVMSY

SEQ ID NO: 21378 - protein, 11 aa, Artificial Sequence
  Peptide Derived from Human Papillomavirus
ITLTADVMSYI

SEQ ID NO: 21379 - protein, 9 aa, Artificial Sequence
  Peptide Derived from Human Papillomavirus
KAQGHNNGV

SEQ ID NO: 21380 - protein, 11 aa, Artificial Sequence
  Peptide Derived from Human Papillomavirus
KAQGHNNGVCW

SEQ ID NO: 21381 - protein, 10 aa, Artificial Sequence
  Peptide Derived from Human Papillomavirus
LSGHPFYNKL

SEQ ID NO: 21382 - protein, 9 aa, Artificial Sequence
  Peptide Derived from Human Papillomavirus
LSQGDCPPL

SEQ ID NO: 21383 - protein, 11 aa, Artificial Sequence
  Peptide Derived from Human Papillomavirus
LSQGDCPPLEL

SEQ ID NO: 21384 - protein, 8 aa, Artificial Sequence
  Peptide Derived from Human Papillomavirus
LTADVMSY

SEQ ID NO: 21385 - protein, 9 aa, Artificial Sequence
  Peptide Derived from Human Papillomavirus
LTADVMSYI

SEQ ID NO: 21386 - protein, 11 aa, Artificial Sequence
  Peptide Derived from Human Papillomavirus
LTICASTQSPV

SEQ ID NO: 21387 - protein, 8 aa, Artificial Sequence
  Peptide Derived from Human Papillomavirus
LTVGNPYF

SEQ ID NO: 21388 - protein, 10 aa, Artificial Sequence
  Peptide Derived from Human Papillomavirus
LTVGNPYFRV

SEQ ID NO: 21389 - protein, 11 aa, Artificial Sequence
  Peptide Derived from Human Papillomavirus
MALWRPSDNTV

SEQ ID NO: 21390 - protein, 10 aa, Artificial Sequence
  Peptide Derived from Human Papillomavirus
MSADPYGDSM

SEQ ID NO: 21391 - protein, 11 aa, Artificial Sequence
  Peptide Derived from Human Papillomavirus
MSADPYGDSMF

SEQ ID NO: 21392 - protein, 11 aa, Artificial Sequence
  Peptide Derived from Human Papillomavirus
MSYIHSMNSSI

SEQ ID NO: 21393 - protein, 8 aa, Artificial Sequence
  Peptide Derived from Human Papillomavirus
NSSILEDW

SEQ ID NO: 21394 - protein, 10 aa, Artificial Sequence
  Peptide Derived from Human Papillomavirus
NSSILEDWNF

SEQ ID NO: 21395 - protein, 11 aa, Artificial Sequence
  Peptide Derived from Human Papillomavirus
NTDDYVTPTSI

SEQ ID NO: 21396 - protein, 9 aa, Artificial Sequence
  Peptide Derived from Human Papillomavirus
NTVLEDGDM

SEQ ID NO: 21397 - protein, 10 aa, Artificial Sequence
  Peptide Derived from Human Papillomavirus
NTVLEDGDMV

SEQ ID NO: 21398 - protein, 10 aa, Artificial Sequence
  Peptide Derived from Human Papillomavirus
NTVYLPPPSV

SEQ ID NO: 21399 - protein, 11 aa, Artificial Sequence
  Peptide Derived from Human Papillomavirus
NTVYLPPPSVA

SEQ ID NO: 21400 - protein, 8 aa, Artificial Sequence
  Peptide Derived from Human Papillomavirus
PAENKDPY

SEQ ID NO: 21401 - protein, 11 aa, Artificial Sequence
  Peptide Derived from Human Papillomavirus
PAENKDPYDKL

SEQ ID NO: 21402 - protein, 10 aa, Artificial Sequence
  Peptide Derived from Human Papillomavirus
PAGGGNKQDI

SEQ ID NO: 21403 - protein, 8 aa, Artificial Sequence
  Peptide Derived from Human Papillomavirus
PAIGEHWA

SEQ ID NO: 21404 - protein, 9 aa, Artificial Sequence
  Peptide Derived from Human Papillomavirus
PAKRVRVRA

SEQ ID NO: 21405 - protein, 8 aa, Artificial Sequence
  Peptide Derived from Human Papillomavirus
PASPGSCV

SEQ ID NO: 21406 - protein, 9 aa, Artificial Sequence
  Peptide Derived from Human Papillomavirus
PASPGSCVY

SEQ ID NO: 21407 - protein, 10 aa, Artificial Sequence
  Peptide Derived from Human Papillomavirus
PSATTSSKPA

SEQ ID NO: 21408 - protein, 8 aa, Artificial Sequence
  Peptide Derived from Human Papillomavirus
PSDNTVYL

SEQ ID NO: 21409 - protein, 8 aa, Artificial Sequence
  Peptide Derived from Human Papillomavirus
PSPSGSIV

SEQ ID NO: 21410 - protein, 9 aa, Artificial Sequence
  Peptide Derived from Human Papillomavirus
PSTNLTICA

SEQ ID NO: 21411 - protein, 10 aa, Artificial Sequence
  Peptide Derived from Human Papillomavirus
PTIGPRKRSA

SEQ ID NO: 21412 - protein, 8 aa, Artificial Sequence
  Peptide Derived from Human Papillomavirus
PTSIFYHA

SEQ ID NO: 21413 - protein, 9 aa, Artificial Sequence
  Peptide Derived from Human Papillomavirus
PTTSLVDTY

SEQ ID NO: 21414 - protein, 11 aa, Artificial Sequence
  Peptide Derived from Human Papillomavirus
PTTSLVDTYRF

SEQ ID NO: 21415 - protein, 10 aa, Artificial Sequence
  Peptide Derived from Human Papillomavirus
QAGLRRKPTI

SEQ ID NO: 21416 - protein, 9 aa, Artificial Sequence
  Peptide Derived from Human Papillomavirus
QSICKYPDY

SEQ ID NO: 21417 - protein, 10 aa, Artificial Sequence
  Peptide Derived from Human Papillomavirus
QSICKYPDYL

SEQ ID NO: 21418 - protein, 10 aa, Artificial Sequence
  Peptide Derived from Human Papillomavirus
QSLYIKGTGM

SEQ ID NO: 21419 - protein, 8 aa, Artificial Sequence
  Peptide Derived from Human Papillomavirus
QSPVPGQY

SEQ ID NO: 21420 - protein, 10 aa, Artificial Sequence
  Peptide Derived from Human Papillomavirus
QSPVPGQYDA

SEQ ID NO: 21421 - protein, 11 aa, Artificial Sequence
  Peptide Derived from Human Papillomavirus
QSVAITCQKDA

SEQ ID NO: 21422 - protein, 10 aa, Artificial Sequence
  Peptide Derived from Human Papillomavirus
QTQLCILGCA

SEQ ID NO: 21423 - protein, 9 aa, Artificial Sequence
  Peptide Derived from Human Papillomavirus
RAGTMGDTV

SEQ ID NO: 21424 - protein, 9 aa, Artificial Sequence
  Peptide Derived from Human Papillomavirus
SADPYGDSM

SEQ ID NO: 21425 - protein, 10 aa, Artificial Sequence
  Peptide Derived from Human Papillomavirus
SADPYGDSMF

SEQ ID NO: 21426 - protein, 11 aa, Artificial Sequence
  Peptide Derived from Human Papillomavirus
SADPYGDSMFF

SEQ ID NO: 21427 - protein, 9 aa, Artificial Sequence
  Peptide Derived from Human Papillomavirus
SATTSSKPA

SEQ ID NO: 21428 - protein, 8 aa, Artificial Sequence
  Peptide Derived from Human Papillomavirus
SAYQYRVF

SEQ ID NO: 21429 - protein, 10 aa, Artificial Sequence
  Peptide Derived from Human Papillomavirus
SAYQYRVFRV

SEQ ID NO: 21430 - protein, 9 aa, Artificial Sequence
  Peptide Derived from Human Papillomavirus
SSHAATSNV

SEQ ID NO: 21431 - protein, 9 aa, Artificial Sequence
  Peptide Derived from Human Papillomavirus
SSILEDWNF

SEQ ID NO: 21432 - protein, 11 aa, Artificial Sequence
  Peptide Derived from Human Papillomavirus
SSILEDWNFGV

SEQ ID NO: 21433 - protein, 8 aa, Artificial Sequence
  Peptide Derived from Human Papillomavirus
SSKPAKRV

SEQ ID NO: 21434 - protein, 10 aa, Artificial Sequence
  Peptide Derived from Human Papillomavirus
SSKPAKRVRV

SEQ ID NO: 21435 - protein, 11 aa, Artificial Sequence
  Peptide Derived from Human Papillomavirus
SSRLLTVGNPY

SEQ ID NO: 21436 - protein, 10 aa, Artificial Sequence
  Peptide Derived from Human Papillomavirus
STLQDTKCEV

SEQ ID NO: 21437 - protein, 8 aa, Artificial Sequence
  Peptide Derived from Human Papillomavirus
STNLTICA

SEQ ID NO: 21438 - protein, 10 aa, Artificial Sequence
  Peptide Derived from Human Papillomavirus
STQSPVPGQY

SEQ ID NO: 21439 - protein, 8 aa, Artificial Sequence
  Peptide Derived from Human Papillomavirus
TACKSRPL

SEQ ID NO: 21440 - protein, 8 aa, Artificial Sequence
  Peptide Derived from Human Papillomavirus
TADVMSYI

SEQ ID NO: 21441 - protein, 11 aa, Artificial Sequence
  Peptide Derived from Human Papillomavirus
TADVMSYIHSM

SEQ ID NO: 21442 - protein, 11 aa, Artificial Sequence
  Peptide Derived from Human Papillomavirus
TSDSQLFNKPY

SEQ ID NO: 21443 - protein, 11 aa, Artificial Sequence
  Peptide Derived from Human Papillomavirus
TSIYNPETQRL

SEQ ID NO: 21444 - protein, 9 aa, Artificial Sequence
  Peptide Derived from Human Papillomavirus
TSLVDTYRF

SEQ ID NO: 21445 - protein, 10 aa, Artificial Sequence
  Peptide Derived from Human Papillomavirus
TSLVDTYRFV

SEQ ID NO: 21446 - protein, 8 aa, Artificial Sequence
  Peptide Derived from Human Papillomavirus
TSNVSEDV

SEQ ID NO: 21447 - protein, 9 aa, Artificial Sequence
  Peptide Derived from Human Papillomavirus
TSSKPAKRV

SEQ ID NO: 21448 - protein, 11 aa, Artificial Sequence
  Peptide Derived from Human Papillomavirus
TSSKPAKRVRV

SEQ ID NO: 21449 - protein, 9 aa, Artificial Sequence
  Peptide Derived from Human Papillomavirus
TTPSTNLTI

SEQ ID NO: 21450 - protein, 11 aa, Artificial Sequence
  Peptide Derived from Human Papillomavirus
TTPSTNLTICA

SEQ ID NO: 21451 - protein, 8 aa, Artificial Sequence
  Peptide Derived from Human Papillomavirus
TTSLVDTY

SEQ ID NO: 21452 - protein, 10 aa, Artificial Sequence
  Peptide Derived from Human Papillomavirus
TTSLVDTYRF

SEQ ID NO: 21453 - protein, 11 aa, Artificial Sequence
  Peptide Derived from Human Papillomavirus
TTSLVDTYRFV

SEQ ID NO: 21454 - protein, 10 aa, Artificial Sequence
  Peptide Derived from Human Papillomavirus
TTSSKPAKRV

SEQ ID NO: 21455 - protein, 9 aa, Artificial Sequence
  Peptide Derived from Human Papillomavirus
VAITCQKDA

SEQ ID NO: 21456 - protein, 10 aa, Artificial Sequence
  Peptide Derived from Human Papillomavirus
VAITCQKDAA

SEQ ID NO: 21457 - protein, 10 aa, Artificial Sequence
  Peptide Derived from Human Papillomavirus
VARVVNTDDY

SEQ ID NO: 21458 - protein, 11 aa, Artificial Sequence
  Peptide Derived from Human Papillomavirus
VARVVNTDDYV

SEQ ID NO: 21459 - protein, 8 aa, Artificial Sequence
  Peptide Derived from Human Papillomavirus
VSAYQYRV

SEQ ID NO: 21460 - protein, 9 aa, Artificial Sequence
  Peptide Derived from Human Papillomavirus
VSAYQYRVF

SEQ ID NO: 21461 - protein, 11 aa, Artificial Sequence
  Peptide Derived from Human Papillomavirus
VSAYQYRVFRV

SEQ ID NO: 21462 - protein, 9 aa, Artificial Sequence
  Peptide Derived from Human Papillomavirus
VSEDVRDNV

SEQ ID NO: 21463 - protein, 11 aa, Artificial Sequence
  Peptide Derived from Human Papillomavirus
VSEDVRDNVSV

SEQ ID NO: 21464 - protein, 10 aa, Artificial Sequence
  Peptide Derived from Human Papillomavirus
VSVDYKQTQL

SEQ ID NO: 21465 - protein, 8 aa, Artificial Sequence
  Peptide Derived from Human Papillomavirus
VTPTSIFY

SEQ ID NO: 21466 - protein, 10 aa, Artificial Sequence
  Peptide Derived from Human Papillomavirus
VTPTSIFYHA

SEQ ID NO: 21467 - protein, 8 aa, Artificial Sequence
  Peptide Derived from Human Papillomavirus
VTSDSQLF

SEQ ID NO: 21468 - protein, 8 aa, Artificial Sequence
  Peptide Derived from Human Papillomavirus
WACAGVEI

SEQ ID NO: 21469 - protein, 9 aa, Artificial Sequence
  Peptide Derived from Human Papillomavirus
YSPSPSGSI

SEQ ID NO: 21470 - protein, 10 aa, Artificial Sequence
  Peptide Derived from Human Papillomavirus
YSPSPSGSIV

SEQ ID NO: 21471 - protein, 8 aa, Artificial Sequence
  Peptide Derived from Human Papillomavirus
YSRHVEEY

SEQ ID NO: 21472 - protein, 10 aa, Artificial Sequence
  Peptide Derived from Human Papillomavirus
YSRHVEEYDL

SEQ ID NO: 21473 - protein, 9 aa, Artificial Sequence
  Peptide Derived from Human Papillomavirus
YTRVLILHY

SEQ ID NO: 21474 - protein, 11 aa, Artificial Sequence
  Peptide Derived from Human Papillomavirus
YTRVLILHYHL

SEQ ID NO: 21475 - protein, 9 aa, Artificial Sequence
  Peptide Derived from Human Papillomavirus
AARRKRASV

SEQ ID NO: 21476 - protein, 10 aa, Artificial Sequence
  Peptide Derived from Human Papillomavirus
ASSGTGEEPI

SEQ ID NO: 21477 - protein, 9 aa, Artificial Sequence
  Peptide Derived from Human Papillomavirus
ASSYSNVTV

SEQ ID NO: 21478 - protein, 11 aa, Artificial Sequence
  Peptide Derived from Human Papillomavirus
ASSYSNVTVPL

SEQ ID NO: 21479 - protein, 8 aa, Artificial Sequence
  Peptide Derived from Human Papillomavirus
ASTQYIGI

SEQ ID NO: 21480 - protein, 8 aa, Artificial Sequence
  Peptide Derived from Human Papillomavirus
ATEDNDLF

SEQ ID NO: 21481 - protein, 10 aa, Artificial Sequence
  Peptide Derived from Human Papillomavirus
ATEDNDLFDI

SEQ ID NO: 21482 - protein, 11 aa, Artificial Sequence
  Peptide Derived from Human Papillomavirus
ATEDNDLFDIY

SEQ ID NO: 21483 - protein, 11 aa, Artificial Sequence
  Peptide Derived from Human Papillomavirus
ATMFTRSGTQI

SEQ ID NO: 21484 - protein, 8 aa, Artificial Sequence
  Peptide Derived from Human Papillomavirus
DSDFMDII

SEQ ID NO: 21485 - protein, 10 aa, Artificial Sequence
  Peptide Derived from Human Papillomavirus
DSDFMDIIRL

SEQ ID NO: 21486 - protein, 9 aa, Artificial Sequence
  Peptide Derived from Human Papillomavirus
DSSVVTSGA

SEQ ID NO: 21487 - protein, 8 aa, Artificial Sequence
  Peptide Derived from Human Papillomavirus
FADGFVAA

SEQ ID NO: 21488 - protein, 10 aa, Artificial Sequence
  Peptide Derived from Human Papillomavirus
FAFFKYSPTI

SEQ ID NO: 21489 - protein, 11 aa, Artificial Sequence
  Peptide Derived from Human Papillomavirus
FASSGTGEEPI

SEQ ID NO: 21490 - protein, 9 aa, Artificial Sequence
  Peptide Derived from Human Papillomavirus
FSDPSIIEV

SEQ ID NO: 21491 - protein, 8 aa, Artificial Sequence
  Peptide Derived from Human Papillomavirus
FSRLGQRA

SEQ ID NO: 21492 - protein, 10 aa, Artificial Sequence
  Peptide Derived from Human Papillomavirus
FSRLGQRATM

SEQ ID NO: 21493 - protein, 11 aa, Artificial Sequence
  Peptide Derived from Human Papillomavirus
FSRLGQRATMF

SEQ ID NO: 21494 - protein, 9 aa, Artificial Sequence
  Peptide Derived from Human Papillomavirus
FTGTSGFDI

SEQ ID NO: 21495 - protein, 11 aa, Artificial Sequence
  Peptide Derived from Human Papillomavirus
FTNPAFSDPSI

SEQ ID NO: 21496 - protein, 8 aa, Artificial Sequence
  Peptide Derived from Human Papillomavirus
FTRSGTQI

SEQ ID NO: 21497 - protein, 10 aa, Artificial Sequence
  Peptide Derived from Human Papillomavirus
FTRSGTQIGA

SEQ ID NO: 21498 - protein, 10 aa, Artificial Sequence
  Peptide Derived from Human Papillomavirus
GARVHFYHDI

SEQ ID NO: 21499 - protein, 10 aa, Artificial Sequence
  Peptide Derived from Human Papillomavirus
GSGTGGRTGY

SEQ ID NO: 21500 - protein, 11 aa, Artificial Sequence
  Peptide Derived from Human Papillomavirus
GSGTGGRTGYI

SEQ ID NO: 21501 - protein, 8 aa, Artificial Sequence
  Peptide Derived from Human Papillomavirus
GTCPPDVV

SEQ ID NO: 21502 - protein, 11 aa, Artificial Sequence
  Peptide Derived from Human Papillomavirus
GTCPPDVVPKV

SEQ ID NO: 21503 - protein, 8 aa, Artificial Sequence
  Peptide Derived from Human Papillomavirus
GTGGRTGY

SEQ ID NO: 21504 - protein, 9 aa, Artificial Sequence
  Peptide Derived from Human Papillomavirus
GTGGRTGYI

SEQ ID NO: 21505 - protein, 11 aa, Artificial Sequence
  Peptide Derived from Human Papillomavirus
GTGGRTGYIPL

SEQ ID NO: 21506 - protein, 8 aa, Artificial Sequence
  Peptide Derived from Human Papillomavirus
GTHGYEEI

SEQ ID NO: 21507 - protein, 10 aa, Artificial Sequence
  Peptide Derived from Human Papillomavirus
GTHGYEEIPL

SEQ ID NO: 21508 - protein, 9 aa, Artificial Sequence
  Peptide Derived from Human Papillomavirus
GTHYYLWPL

SEQ ID NO: 21509 - protein, 10 aa, Artificial Sequence
  Peptide Derived from Human Papillomavirus
GTHYYLWPLY

SEQ ID NO: 21510 - protein, 11 aa, Artificial Sequence
  Peptide Derived from Human Papillomavirus
GTHYYLWPLYY

SEQ ID NO: 21511 - protein, 10 aa, Artificial Sequence
  Peptide Derived from Human Papillomavirus
GTPTSGTHGY

SEQ ID NO: 21512 - protein, 8 aa, Artificial Sequence
  Peptide Derived from Human Papillomavirus
GTQIGARV

SEQ ID NO: 21513 - protein, 10 aa, Artificial Sequence
  Peptide Derived from Human Papillomavirus
GTQIGARVHF

SEQ ID NO: 21514 - protein, 11 aa, Artificial Sequence
  Peptide Derived from Human Papillomavirus
GTQIGARVHFY

SEQ ID NO: 21515 - protein, 10 aa, Artificial Sequence
  Peptide Derived from Human Papillomavirus
GTSGFDITSA

SEQ ID NO: 21516 - protein, 8 aa, Artificial Sequence
  Peptide Derived from Human Papillomavirus
GTTLADKI

SEQ ID NO: 21517 - protein, 9 aa, Artificial Sequence
  Peptide Derived from Human Papillomavirus
GTTLADKIL

SEQ ID NO: 21518 - protein, 11 aa, Artificial Sequence
  Peptide Derived from Human Papillomavirus
GTTLADKILQW

SEQ ID NO: 21519 - protein, 8 aa, Artificial Sequence
  Peptide Derived from Human Papillomavirus
GTTTPAVL

SEQ ID NO: 21520 - protein, 10 aa, Artificial Sequence
  Peptide Derived from Human Papillomavirus
GTTTPAVLDI

SEQ ID NO: 21521 - protein, 8 aa, Artificial Sequence
  Peptide Derived from Human Papillomavirus
GTVRFSRL

SEQ ID NO: 21522 - protein, 8 aa, Artificial Sequence
  Peptide Derived from Human Papillomavirus
IAPSPEYI

SEQ ID NO: 21523 - protein, 10 aa, Artificial Sequence
  Peptide Derived from Human Papillomavirus
IAPSPEYIEL

SEQ ID NO: 21524 - protein, 10 aa, Artificial Sequence
  Peptide Derived from Human Papillomavirus
ISPIAPSPEY

SEQ ID NO: 21525 - protein, 11 aa, Artificial Sequence
  Peptide Derived from Human Papillomavirus
ISPIAPSPEYI

SEQ ID NO: 21526 - protein, 10 aa, Artificial Sequence
  Peptide Derived from Human Papillomavirus
ISSASSYSNV

SEQ ID NO: 21527 - protein, 9 aa, Artificial Sequence
  Peptide Derived from Human Papillomavirus
ISSTPLPTV

SEQ ID NO: 21528 - protein, 10 aa, Artificial Sequence
  Peptide Derived from Human Papillomavirus
ISTTNFTNPA

SEQ ID NO: 21529 - protein, 11 aa, Artificial Sequence
  Peptide Derived from Human Papillomavirus
ISTTNFTNPAF

SEQ ID NO: 21530 - protein, 9 aa, Artificial Sequence
  Peptide Derived from Human Papillomavirus
ITLPSTTSV

SEQ ID NO: 21531 - protein, 10 aa, Artificial Sequence
  Peptide Derived from Human Papillomavirus
ITLPSTTSVW

SEQ ID NO: 21532 - protein, 8 aa, Artificial Sequence
  Peptide Derived from Human Papillomavirus
ITPSSTSV

SEQ ID NO: 21533 - protein, 10 aa, Artificial Sequence
  Peptide Derived from Human Papillomavirus
ITPSSTSVSI

SEQ ID NO: 21534 - protein, 10 aa, Artificial Sequence
  Peptide Derived from Human Papillomavirus
ITSAGTTTPA

SEQ ID NO: 21535 - protein, 11 aa, Artificial Sequence
  Peptide Derived from Human Papillomavirus
ITSAGTTTPAV

SEQ ID NO: 21536 - protein, 8 aa, Artificial Sequence
  Peptide Derived from Human Papillomavirus
ITYDNPAF

SEQ ID NO: 21537 - protein, 11 aa, Artificial Sequence
  Peptide Derived from Human Papillomavirus
ITYDNPAFEPV

SEQ ID NO: 21538 - protein, 8 aa, Artificial Sequence
  Peptide Derived from Human Papillomavirus
LADKILQW

SEQ ID NO: 21539 - protein, 11 aa, Artificial Sequence
  Peptide Derived from Human Papillomavirus
LADKILQWSSL

SEQ ID NO: 21540 - protein, 9 aa, Artificial Sequence
  Peptide Derived from Human Papillomavirus
LTFDPRSDV

SEQ ID NO: 21541 - protein, 8 aa, Artificial Sequence
  Peptide Derived from Human Papillomavirus
LTRPSSLI

SEQ ID NO: 21542 - protein, 10 aa, Artificial Sequence
  Peptide Derived from Human Papillomavirus
LTRPSSLITY

SEQ ID NO: 21543 - protein, 8 aa, Artificial Sequence
  Peptide Derived from Human Papillomavirus
LTSRRGTV

SEQ ID NO: 21544 - protein, 10 aa, Artificial Sequence
  Peptide Derived from Human Papillomavirus
LTSRRGTVRF

SEQ ID NO: 21545 - protein, 9 aa, Artificial Sequence
  Peptide Derived from Human Papillomavirus
LTSSWDVPV

SEQ ID NO: 21546 - protein, 10 aa, Artificial Sequence
  Peptide Derived from Human Papillomavirus
LTSSWDVPVY

SEQ ID NO: 21547 - protein, 10 aa, Artificial Sequence
  Peptide Derived from Human Papillomavirus
PAFEPVDTTL

SEQ ID NO: 21548 - protein, 8 aa, Artificial Sequence
  Peptide Derived from Human Papillomavirus
PAFSDPSI

SEQ ID NO: 21549 - protein, 9 aa, Artificial Sequence
  Peptide Derived from Human Papillomavirus
PAFSDPSII

SEQ ID NO: 21550 - protein, 11 aa, Artificial Sequence
  Peptide Derived from Human Papillomavirus
PAFSDPSIIEV

SEQ ID NO: 21551 - protein, 10 aa, Artificial Sequence
  Peptide Derived from Human Papillomavirus
PALTSRRGTV

SEQ ID NO: 21552 - protein, 9 aa, Artificial Sequence
  Peptide Derived from Human Papillomavirus
PASTQYIGI

SEQ ID NO: 21553 - protein, 8 aa, Artificial Sequence
  Peptide Derived from Human Papillomavirus
PSPEYIEL

SEQ ID NO: 21554 - protein, 11 aa, Artificial Sequence
  Peptide Derived from Human Papillomavirus
PSPEYIELQPL

SEQ ID NO: 21555 - protein, 8 aa, Artificial Sequence
  Peptide Derived from Human Papillomavirus
PSRSTTSF

SEQ ID NO: 21556 - protein, 9 aa, Artificial Sequence
  Peptide Derived from Human Papillomavirus
PSRSTTSFA

SEQ ID NO: 21557 - protein, 10 aa, Artificial Sequence
  Peptide Derived from Human Papillomavirus
PSRSTTSFAF

SEQ ID NO: 21558 - protein, 11 aa, Artificial Sequence
  Peptide Derived from Human Papillomavirus
PSRSTTSFAFF

SEQ ID NO: 21559 - protein, 11 aa, Artificial Sequence
  Peptide Derived from Human Papillomavirus
PSSLITYDNPA

SEQ ID NO: 21560 - protein, 8 aa, Artificial Sequence
  Peptide Derived from Human Papillomavirus
PSSTSVSI

SEQ ID NO: 21561 - protein, 9 aa, Artificial Sequence
  Peptide Derived from Human Papillomavirus
PSTTSVWPI

SEQ ID NO: 21562 - protein, 10 aa, Artificial Sequence
  Peptide Derived from Human Papillomavirus
PSTTSVWPIV

SEQ ID NO: 21563 - protein, 9 aa, Artificial Sequence
  Peptide Derived from Human Papillomavirus
PTAPASTQY

SEQ ID NO: 21564 - protein, 10 aa, Artificial Sequence
  Peptide Derived from Human Papillomavirus
PTAPASTQYI

SEQ ID NO: 21565 - protein, 9 aa, Artificial Sequence
  Peptide Derived from Human Papillomavirus
PTDPSIVTL

SEQ ID NO: 21566 - protein, 10 aa, Artificial Sequence
  Peptide Derived from Human Papillomavirus
PTDPSIVTLI

SEQ ID NO: 21567 - protein, 9 aa, Artificial Sequence
  Peptide Derived from Human Papillomavirus
PTFTGTSGF

SEQ ID NO: 21568 - protein, 11 aa, Artificial Sequence
  Peptide Derived from Human Papillomavirus
PTFTGTSGFDI

SEQ ID NO: 21569 - protein, 9 aa, Artificial Sequence
  Peptide Derived from Human Papillomavirus
PTISSASSY

SEQ ID NO: 21570 - protein, 8 aa, Artificial Sequence
  Peptide Derived from Human Papillomavirus
PTRPPVVI

SEQ ID NO: 21571 - protein, 11 aa, Artificial Sequence
  Peptide Derived from Human Papillomavirus
PTRPPVVIEPV

SEQ ID NO: 21572 - protein, 8 aa, Artificial Sequence
  Peptide Derived from Human Papillomavirus
PTSGTHGY

SEQ ID NO: 21573 - protein, 11 aa, Artificial Sequence
  Peptide Derived from Human Papillomavirus
PTSGTHGYEEI

SEQ ID NO: 21574 - protein, 11 aa, Artificial Sequence
  Peptide Derived from Human Papillomavirus
PTVRRVAGPRL

SEQ ID NO: 21575 - protein, 9 aa, Artificial Sequence
  Peptide Derived from Human Papillomavirus
QSGTCPPDV

SEQ ID NO: 21576 - protein, 10 aa, Artificial Sequence
  Peptide Derived from Human Papillomavirus
QSGTCPPDVV

SEQ ID NO: 21577 - protein, 9 aa, Artificial Sequence
  Peptide Derived from Human Papillomavirus
QTGEVAGNV

SEQ ID NO: 21578 - protein, 10 aa, Artificial Sequence
  Peptide Derived from Human Papillomavirus
QTGEVAGNVF

SEQ ID NO: 21579 - protein, 11 aa, Artificial Sequence
  Peptide Derived from Human Papillomavirus
QTGEVAGNVFV

SEQ ID NO: 21580 - protein, 8 aa, Artificial Sequence
  Peptide Derived from Human Papillomavirus
RAARRKRA

SEQ ID NO: 21581 - protein, 10 aa, Artificial Sequence
  Peptide Derived from Human Papillomavirus
RAARRKRASV

SEQ ID NO: 21582 - protein, 8 aa, Artificial Sequence
  Peptide Derived from Human Papillomavirus
RASVTDLY

SEQ ID NO: 21583 - protein, 8 aa, Artificial Sequence
  Peptide Derived from Human Papillomavirus
RAYQQVSV

SEQ ID NO: 21584 - protein, 9 aa, Artificial Sequence
  Peptide Derived from Human Papillomavirus
RAYQQVSVA

SEQ ID NO: 21585 - protein, 9 aa, Artificial Sequence
  Peptide Derived from Human Papillomavirus
RSDVPDSDF

SEQ ID NO: 21586 - protein, 10 aa, Artificial Sequence
  Peptide Derived from Human Papillomavirus
RSDVPDSDFM

SEQ ID NO: 21587 - protein, 8 aa, Artificial Sequence
  Peptide Derived from Human Papillomavirus
RSGTQIGA

SEQ ID NO: 21588 - protein, 10 aa, Artificial Sequence
  Peptide Derived from Human Papillomavirus
RSGTQIGARV

SEQ ID NO: 21589 - protein, 8 aa, Artificial Sequence
  Peptide Derived from Human Papillomavirus
RSNTVVDV

SEQ ID NO: 21590 - protein, 8 aa, Artificial Sequence
  Peptide Derived from Human Papillomavirus
RSTTSFAF

SEQ ID NO: 21591 - protein, 9 aa, Artificial Sequence
  Peptide Derived from Human Papillomavirus
RSTTSFAFF

SEQ ID NO: 21592 - protein, 11 aa, Artificial Sequence
  Peptide Derived from Human Papillomavirus
RSTTSFAFFKY

SEQ ID NO: 21593 - protein, 8 aa, Artificial Sequence
  Peptide Derived from Human Papillomavirus
SAGTTTPA

SEQ ID NO: 21594 - protein, 9 aa, Artificial Sequence
  Peptide Derived from Human Papillomavirus
SAGTTTPAV

SEQ ID NO: 21595 - protein, 10 aa, Artificial Sequence
  Peptide Derived from Human Papillomavirus
SAGTTTPAVL

SEQ ID NO: 21596 - protein, 8 aa, Artificial Sequence
  Peptide Derived from Human Papillomavirus
SASSYSNV

SEQ ID NO: 21597 - protein, 10 aa, Artificial Sequence
  Peptide Derived from Human Papillomavirus
SASSYSNVTV

SEQ ID NO: 21598 - protein, 8 aa, Artificial Sequence
  Peptide Derived from Human Papillomavirus
SATEDNDL

SEQ ID NO: 21599 - protein, 9 aa, Artificial Sequence
  Peptide Derived from Human Papillomavirus
SATEDNDLF

SEQ ID NO: 21600 - protein, 11 aa, Artificial Sequence
  Peptide Derived from Human Papillomavirus
SATEDNDLFDI

SEQ ID NO: 21601 - protein, 9 aa, Artificial Sequence
  Peptide Derived from Human Papillomavirus
SSASSYSNV

SEQ ID NO: 21602 - protein, 11 aa, Artificial Sequence
  Peptide Derived from Human Papillomavirus
SSASSYSNVTV

SEQ ID NO: 21603 - protein, 9 aa, Artificial Sequence
  Peptide Derived from Human Papillomavirus
SSGTGEEPI

SEQ ID NO: 21604 - protein, 10 aa, Artificial Sequence
  Peptide Derived from Human Papillomavirus
SSLGIFLGGL

SEQ ID NO: 21605 - protein, 10 aa, Artificial Sequence
  Peptide Derived from Human Papillomavirus
SSLITYDNPA

SEQ ID NO: 21606 - protein, 11 aa, Artificial Sequence
  Peptide Derived from Human Papillomavirus
SSLITYDNPAF

SEQ ID NO: 21607 - protein, 8 aa, Artificial Sequence
  Peptide Derived from Human Papillomavirus
SSTPLPTV

SEQ ID NO: 21608 - protein, 11 aa, Artificial Sequence
  Peptide Derived from Human Papillomavirus
SSTPLPTVRRV

SEQ ID NO: 21609 - protein, 8 aa, Artificial Sequence
  Peptide Derived from Human Papillomavirus
SSVVTSGA

SEQ ID NO: 21610 - protein, 8 aa, Artificial Sequence
  Peptide Derived from Human Papillomavirus
SSWDVPVY

SEQ ID NO: 21611 - protein, 8 aa, Artificial Sequence
  Peptide Derived from Human Papillomavirus
SSYSNVTV

SEQ ID NO: 21612 - protein, 10 aa, Artificial Sequence
  Peptide Derived from Human Papillomavirus
SSYSNVTVPL

SEQ ID NO: 21613 - protein, 10 aa, Artificial Sequence
  Peptide Derived from Human Papillomavirus
STPLPTVRRV

SEQ ID NO: 21614 - protein, 11 aa, Artificial Sequence
  Peptide Derived from Human Papillomavirus
STPLPTVRRVA

SEQ ID NO: 21615 - protein, 11 aa, Artificial Sequence
  Peptide Derived from Human Papillomavirus
STSVSISTTNF

SEQ ID NO: 21616 - protein, 9 aa, Artificial Sequence
  Peptide Derived from Human Papillomavirus
STTNFTNPA

SEQ ID NO: 21617 - protein, 10 aa, Artificial Sequence
  Peptide Derived from Human Papillomavirus
STTNFTNPAF

SEQ ID NO: 21618 - protein, 8 aa, Artificial Sequence
  Peptide Derived from Human Papillomavirus
STTSFAFF

SEQ ID NO: 21619 - protein, 10 aa, Artificial Sequence
  Peptide Derived from Human Papillomavirus
STTSFAFFKY

SEQ ID NO: 21620 - protein, 8 aa, Artificial Sequence
  Peptide Derived from Human Papillomavirus
STTSVWPI

SEQ ID NO: 21621 - protein, 9 aa, Artificial Sequence
  Peptide Derived from Human Papillomavirus
STTSVWPIV

SEQ ID NO: 21622 - protein, 8 aa, Artificial Sequence
  Peptide Derived from Human Papillomavirus
TAPASTQY

SEQ ID NO: 21623 - protein, 9 aa, Artificial Sequence
  Peptide Derived from Human Papillomavirus
TAPASTQYI

SEQ ID NO: 21624 - protein, 11 aa, Artificial Sequence
  Peptide Derived from Human Papillomavirus
TAPASTQYIGI

SEQ ID NO: 21625 - protein, 9 aa, Artificial Sequence
  Peptide Derived from Human Papillomavirus
TSAGTTTPA

SEQ ID NO: 21626 - protein, 10 aa, Artificial Sequence
  Peptide Derived from Human Papillomavirus
TSAGTTTPAV

SEQ ID NO: 21627 - protein, 11 aa, Artificial Sequence
  Peptide Derived from Human Papillomavirus
TSAGTTTPAVL

SEQ ID NO: 21628 - protein, 8 aa, Artificial Sequence
  Peptide Derived from Human Papillomavirus
TSFAFFKY

SEQ ID NO: 21629 - protein, 9 aa, Artificial Sequence
  Peptide Derived from Human Papillomavirus
TSGAPRPTF

SEQ ID NO: 21630 - protein, 9 aa, Artificial Sequence
  Peptide Derived from Human Papillomavirus
TSGFDITSA

SEQ ID NO: 21631 - protein, 10 aa, Artificial Sequence
  Peptide Derived from Human Papillomavirus
TSGTHGYEEI

SEQ ID NO: 21632 - protein, 9 aa, Artificial Sequence
  Peptide Derived from Human Papillomavirus
TSRRGTVRF

SEQ ID NO: 21633 - protein, 8 aa, Artificial Sequence
  Peptide Derived from Human Papillomavirus
TSSWDVPV

SEQ ID NO: 21634 - protein, 9 aa, Artificial Sequence
  Peptide Derived from Human Papillomavirus
TSSWDVPVY

SEQ ID NO: 21635 - protein, 10 aa, Artificial Sequence
  Peptide Derived from Human Papillomavirus
TSVSISTTNF

SEQ ID NO: 21636 - protein, 11 aa, Artificial Sequence
  Peptide Derived from Human Papillomavirus
TSVWPIVSPTA

SEQ ID NO: 21637 - protein, 8 aa, Artificial Sequence
  Peptide Derived from Human Papillomavirus
TTLADKIL

SEQ ID NO: 21638 - protein, 10 aa, Artificial Sequence
  Peptide Derived from Human Papillomavirus
TTLADKILQW

SEQ ID NO: 21639 - protein, 11 aa, Artificial Sequence
  Peptide Derived from Human Papillomavirus
TTLTFDPRSDV

SEQ ID NO: 21640 - protein, 8 aa, Artificial Sequence
  Peptide Derived from Human Papillomavirus
TTNFTNPA

SEQ ID NO: 21641 - protein, 9 aa, Artificial Sequence
  Peptide Derived from Human Papillomavirus
TTNFTNPAF

SEQ ID NO: 21642 - protein, 8 aa, Artificial Sequence
  Peptide Derived from Human Papillomavirus
TTPAVLDI

SEQ ID NO: 21643 - protein, 9 aa, Artificial Sequence
  Peptide Derived from Human Papillomavirus
TTSFAFFKY

SEQ ID NO: 21644 - protein, 8 aa, Artificial Sequence
  Peptide Derived from Human Papillomavirus
TTSVWPIV

SEQ ID NO: 21645 - protein, 9 aa, Artificial Sequence
  Peptide Derived from Human Papillomavirus
TTTPAVLDI

SEQ ID NO: 21646 - protein, 10 aa, Artificial Sequence
  Peptide Derived from Human Papillomavirus
VAGPRLYSRA

SEQ ID NO: 21647 - protein, 11 aa, Artificial Sequence
  Peptide Derived from Human Papillomavirus
VAGPRLYSRAY

SEQ ID NO: 21648 - protein, 9 aa, Artificial Sequence
  Peptide Derived from Human Papillomavirus
VSATEDNDL

SEQ ID NO: 21649 - protein, 10 aa, Artificial Sequence
  Peptide Derived from Human Papillomavirus
VSATEDNDLF

SEQ ID NO: 21650 - protein, 11 aa, Artificial Sequence
  Peptide Derived from Human Papillomavirus
VSHRAARRKRA

SEQ ID NO: 21651 - protein, 8 aa, Artificial Sequence
  Peptide Derived from Human Papillomavirus
VSISTTNF

SEQ ID NO: 21652 - protein, 11 aa, Artificial Sequence
  Peptide Derived from Human Papillomavirus
VSPTAPASTQY

SEQ ID NO: 21653 - protein, 8 aa, Artificial Sequence
  Peptide Derived from Human Papillomavirus
VSVANPEF

SEQ ID NO: 21654 - protein, 9 aa, Artificial Sequence
  Peptide Derived from Human Papillomavirus
VSVANPEFL

SEQ ID NO: 21655 - protein, 9 aa, Artificial Sequence
  Peptide Derived from Human Papillomavirus
VTLIEDSSV

SEQ ID NO: 21656 - protein, 10 aa, Artificial Sequence
  Peptide Derived from Human Papillomavirus
VTLIEDSSVV

SEQ ID NO: 21657 - protein, 10 aa, Artificial Sequence
  Peptide Derived from Human Papillomavirus
VTSGAPRPTF

SEQ ID NO: 21658 - protein, 9 aa, Artificial Sequence
  Peptide Derived from Human Papillomavirus
VTVPLTSSW

SEQ ID NO: 21659 - protein, 11 aa, Artificial Sequence
  Peptide Derived from Human Papillomavirus
VTVPLTSSWDV

SEQ ID NO: 21660 - protein, 8 aa, Artificial Sequence
  Peptide Derived from Human Papillomavirus
WSSLGIFL

SEQ ID NO: 21661 - protein, 11 aa, Artificial Sequence
  Peptide Derived from Human Papillomavirus
WSSLGIFLGGL

SEQ ID NO: 21662 - protein, 8 aa, Artificial Sequence
  Peptide Derived from Human Papillomavirus
YADDMDPA

SEQ ID NO: 21663 - protein, 9 aa, Artificial Sequence
  Peptide Derived from Human Papillomavirus
YADDMDPAV

SEQ ID NO: 21664 - protein, 11 aa, Artificial Sequence
  Peptide Derived from Human Papillomavirus
YADDMDPAVPV

SEQ ID NO: 21665 - protein, 8 aa, Artificial Sequence
  Peptide Derived from Human Papillomavirus
YSNVTVPL

SEQ ID NO: 21666 - protein, 8 aa, Artificial Sequence
  Peptide Derived from Human Papillomavirus
YSPTISSA

SEQ ID NO: 21667 - protein, 11 aa, Artificial Sequence
  Peptide Derived from Human Papillomavirus
YSPTISSASSY

SEQ ID NO: 21668 - protein, 8 aa, Artificial Sequence
  Peptide Derived from Human Papillomavirus
YSRAYQQV

SEQ ID NO: 21669 - protein, 10 aa, Artificial Sequence
  Peptide Derived from Human Papillomavirus
YSRAYQQVSV

SEQ ID NO: 21670 - protein, 11 aa, Artificial Sequence
  Peptide Derived from Human Papillomavirus
YSRAYQQVSVA

SEQ ID NO: 21671 - protein, 8 aa, Artificial Sequence
  Peptide Derived from Human Papillomavirus
YTGPDITL

SEQ ID NO: 21672 - protein, 11 aa, Artificial Sequence
  Peptide Derived from Human Papillomavirus
AAALYWYRTGM

SEQ ID NO: 21673 - protein, 9 aa, Artificial Sequence
  Peptide Derived from Human Papillomavirus
AAFGVTGTV

SEQ ID NO: 21674 - protein, 10 aa, Artificial Sequence
  Peptide Derived from Human Papillomavirus
AAFGVTGTVA

SEQ ID NO: 21675 - protein, 10 aa, Artificial Sequence
  Peptide Derived from Human Papillomavirus
AALYWYRTGM

SEQ ID NO: 21676 - protein, 10 aa, Artificial Sequence
  Peptide Derived from Human Papillomavirus
AAMLGKFKEL

SEQ ID NO: 21677 - protein, 11 aa, Artificial Sequence
  Peptide Derived from Human Papillomavirus
AAMLGKFKELY

SEQ ID NO: 21678 - protein, 8 aa, Artificial Sequence
  Peptide Derived from Human Papillomavirus
ATTPCWHY

SEQ ID NO: 21679 - protein, 9 aa, Artificial Sequence
  Peptide Derived from Human Papillomavirus
ATTPCWHYI

SEQ ID NO: 21680 - protein, 10 aa, Artificial Sequence
  Peptide Derived from Human Papillomavirus
CAFLKSNSQA

SEQ ID NO: 21681 - protein, 8 aa, Artificial Sequence
  Peptide Derived from Human Papillomavirus
CAKNRITI

SEQ ID NO: 21682 - protein, 11 aa, Artificial Sequence
  Peptide Derived from Human Papillomavirus
CAKNRITIEKL

SEQ ID NO: 21683 - protein, 8 aa, Artificial Sequence
  Peptide Derived from Human Papillomavirus
CSWGMVML

SEQ ID NO: 21684 - protein, 9 aa, Artificial Sequence
  Peptide Derived from Human Papillomavirus
CSWGMVMLM

SEQ ID NO: 21685 - protein, 10 aa, Artificial Sequence
  Peptide Derived from Human Papillomavirus
CSWGMVMLML

SEQ ID NO: 21686 - protein, 11 aa, Artificial Sequence
  Peptide Derived from Human Papillomavirus
CSWGMVMLMLV

SEQ ID NO: 21687 - protein, 8 aa, Artificial Sequence
  Peptide Derived from Human Papillomavirus
CTDWCVAA

SEQ ID NO: 21688 - protein, 9 aa, Artificial Sequence
  Peptide Derived from Human Papillomavirus
CTDWCVAAF

SEQ ID NO: 21689 - protein, 11 aa, Artificial Sequence
  Peptide Derived from Human Papillomavirus
CTDWCVAAFGV

SEQ ID NO: 21690 - protein, 10 aa, Artificial Sequence
  Peptide Derived from Human Papillomavirus
DAKIGMLDDA

SEQ ID NO: 21691 - protein, 9 aa, Artificial Sequence
  Peptide Derived from Human Papillomavirus
DATTPCWHY

SEQ ID NO: 21692 - protein, 10 aa, Artificial Sequence
  Peptide Derived from Human Papillomavirus
DATTPCWHYI

SEQ ID NO: 21693 - protein, 8 aa, Artificial Sequence
  Peptide Derived from Human Papillomavirus
DSDSNACA

SEQ ID NO: 21694 - protein, 9 aa, Artificial Sequence
  Peptide Derived from Human Papillomavirus
DSDSNACAF

SEQ ID NO: 21695 - protein, 10 aa, Artificial Sequence
  Peptide Derived from Human Papillomavirus
DSDSNACAFL

SEQ ID NO: 21696 - protein, 8 aa, Artificial Sequence
  Peptide Derived from Human Papillomavirus
DSEIAYKY

SEQ ID NO: 21697 - protein, 9 aa, Artificial Sequence
  Peptide Derived from Human Papillomavirus
DSEIAYKYA

SEQ ID NO: 21698 - protein, 11 aa, Artificial Sequence
  Peptide Derived from Human Papillomavirus
DSEIAYKYAQL

SEQ ID NO: 21699 - protein, 9 aa, Artificial Sequence
  Peptide Derived from Human Papillomavirus
DSFSTFKCV

SEQ ID NO: 21700 - protein, 9 aa, Artificial Sequence
  Peptide Derived from Human Papillomavirus
DSGYGNTEV

SEQ ID NO: 21701 - protein, 8 aa, Artificial Sequence
  Peptide Derived from Human Papillomavirus
DSNACAFL

SEQ ID NO: 21702 - protein, 9 aa, Artificial Sequence
  Peptide Derived from Human Papillomavirus
DSSDTGEDM

SEQ ID NO: 21703 - protein, 10 aa, Artificial Sequence
  Peptide Derived from Human Papillomavirus
DSSDTGEDMV

SEQ ID NO: 21704 - protein, 9 aa, Artificial Sequence
  Peptide Derived from Human Papillomavirus
DTGEDMVDF

SEQ ID NO: 21705 - protein, 10 aa, Artificial Sequence
  Peptide Derived from Human Papillomavirus
DTGEDMVDFI

SEQ ID NO: 21706 - protein, 9 aa, Artificial Sequence
  Peptide Derived from Human Papillomavirus
DTTFDLSQM

SEQ ID NO: 21707 - protein, 10 aa, Artificial Sequence
  Peptide Derived from Human Papillomavirus
DTTFDLSQMV

SEQ ID NO: 21708 - protein, 8 aa, Artificial Sequence
  Peptide Derived from Human Papillomavirus
EAEEHAEA

SEQ ID NO: 21709 - protein, 9 aa, Artificial Sequence
  Peptide Derived from Human Papillomavirus
EAEEHAEAV

SEQ ID NO: 21710 - protein, 11 aa, Artificial Sequence
  Peptide Derived from Human Papillomavirus
EAEEHAEAVQV

SEQ ID NO: 21711 - protein, 8 aa, Artificial Sequence
  Peptide Derived from Human Papillomavirus
EAETAQAL

SEQ ID NO: 21712 - protein, 9 aa, Artificial Sequence
  Peptide Derived from Human Papillomavirus
EAETAQALF

SEQ ID NO: 21713 - protein, 11 aa, Artificial Sequence
  Peptide Derived from Human Papillomavirus
EAETAQALFHA

SEQ ID NO: 21714 - protein, 10 aa, Artificial Sequence
  Peptide Derived from Human Papillomavirus
EAVQVLKRKY

SEQ ID NO: 21715 - protein, 11 aa, Artificial Sequence
  Peptide Derived from Human Papillomavirus
EAVQVLKRKYV

SEQ ID NO: 21716 - protein, 9 aa, Artificial Sequence
  Peptide Derived from Human Papillomavirus
ETAQALFHA

SEQ ID NO: 21717 - protein, 11 aa, Artificial Sequence
  Peptide Derived from Human Papillomavirus
ETPEWIERQTV

SEQ ID NO: 21718 - protein, 8 aa, Artificial Sequence
  Peptide Derived from Human Papillomavirus
ETPTRNIL

SEQ ID NO: 21719 - protein, 10 aa, Artificial Sequence
  Peptide Derived from Human Papillomavirus
ETPTRNILQV

SEQ ID NO: 21720 - protein, 11 aa, Artificial Sequence
  Peptide Derived from Human Papillomavirus
ETPTRNILQVL

SEQ ID NO: 21721 - protein, 8 aa, Artificial Sequence
  Peptide Derived from Human Papillomavirus
ETQQMVQV

SEQ ID NO: 21722 - protein, 8 aa, Artificial Sequence
  Peptide Derived from Human Papillomavirus
FSRTWCRL

SEQ ID NO: 21723 - protein, 10 aa, Artificial Sequence
  Peptide Derived from Human Papillomavirus
FSRTWCRLNL

SEQ ID NO: 21724 - protein, 9 aa, Artificial Sequence
  Peptide Derived from Human Papillomavirus
FTFPNPFPF

SEQ ID NO: 21725 - protein, 9 aa, Artificial Sequence
  Peptide Derived from Human Papillomavirus
GAPNTGKSY

SEQ ID NO: 21726 - protein, 10 aa, Artificial Sequence
  Peptide Derived from Human Papillomavirus
GAPNTGKSYF

SEQ ID NO: 21727 - protein, 11 aa, Artificial Sequence
  Peptide Derived from Human Papillomavirus
GSPLSDISSCV

SEQ ID NO: 21728 - protein, 8 aa, Artificial Sequence
  Peptide Derived from Human Papillomavirus
GTGCNGWF

SEQ ID NO: 21729 - protein, 9 aa, Artificial Sequence
  Peptide Derived from Human Papillomavirus
GTGCNGWFY

SEQ ID NO: 21730 - protein, 10 aa, Artificial Sequence
  Peptide Derived from Human Papillomavirus
GTGCNGWFYV

SEQ ID NO: 21731 - protein, 10 aa, Artificial Sequence
  Peptide Derived from Human Papillomavirus
GTMCRHYKRA

SEQ ID NO: 21732 - protein, 10 aa, Artificial Sequence
  Peptide Derived from Human Papillomavirus
GTVAEGFKTL

SEQ ID NO: 21733 - protein, 11 aa, Artificial Sequence
  Peptide Derived from Human Papillomavirus
GTVAEGFKTLL

SEQ ID NO: 21734 - protein, 8 aa, Artificial Sequence
  Peptide Derived from Human Papillomavirus
HAEAVQVL

SEQ ID NO: 21735 - protein, 9 aa, Artificial Sequence
  Peptide Derived from Human Papillomavirus
HAQEAEEHA

SEQ ID NO: 21736 - protein, 11 aa, Artificial Sequence
  Peptide Derived from Human Papillomavirus
HAQEAEEHAEA

SEQ ID NO: 21737 - protein, 8 aa, Artificial Sequence
  Peptide Derived from Human Papillomavirus
HSFNDTTF

SEQ ID NO: 21738 - protein, 10 aa, Artificial Sequence
  Peptide Derived from Human Papillomavirus
HSFNDTTFDL

SEQ ID NO: 21739 - protein, 9 aa, Artificial Sequence
  Peptide Derived from Human Papillomavirus
HSRLVVFTF

SEQ ID NO: 21740 - protein, 8 aa, Artificial Sequence
  Peptide Derived from Human Papillomavirus
IAYKYAQL

SEQ ID NO: 21741 - protein, 9 aa, Artificial Sequence
  Peptide Derived from Human Papillomavirus
IAYKYAQLA

SEQ ID NO: 21742 - protein, 11 aa, Artificial Sequence
  Peptide Derived from Human Papillomavirus
ISDVYGETPEW

SEQ ID NO: 21743 - protein, 8 aa, Artificial Sequence
  Peptide Derived from Human Papillomavirus
ISFLQGCI

SEQ ID NO: 21744 - protein, 9 aa, Artificial Sequence
  Peptide Derived from Human Papillomavirus
ISFLQGCII

SEQ ID NO: 21745 - protein, 11 aa, Artificial Sequence
  Peptide Derived from Human Papillomavirus
ISFLQGCIISY

SEQ ID NO: 21746 - protein, 8 aa, Artificial Sequence
  Peptide Derived from Human Papillomavirus
ISPRLKAI

SEQ ID NO: 21747 - protein, 10 aa, Artificial Sequence
  Peptide Derived from Human Papillomavirus
ISPRLKAICI

SEQ ID NO: 21748 - protein, 9 aa, Artificial Sequence
  Peptide Derived from Human Papillomavirus
ISSCVDYNI

SEQ ID NO: 21749 - protein, 8 aa, Artificial Sequence
  Peptide Derived from Human Papillomavirus
ISTNCMLI

SEQ ID NO: 21750 - protein, 10 aa, Artificial Sequence
  Peptide Derived from Human Papillomavirus
ISYANSKSHF

SEQ ID NO: 21751 - protein, 11 aa, Artificial Sequence
  Peptide Derived from Human Papillomavirus
ISYANSKSHFW

SEQ ID NO: 21752 - protein, 10 aa, Artificial Sequence
  Peptide Derived from Human Papillomavirus
ITIEKLLEKL

SEQ ID NO: 21753 - protein, 11 aa, Artificial Sequence
  Peptide Derived from Human Papillomavirus
ITIEKLLEKLL

SEQ ID NO: 21754 - protein, 8 aa, Artificial Sequence
  Peptide Derived from Human Papillomavirus
KAAMLGKF

SEQ ID NO: 21755 - protein, 11 aa, Artificial Sequence
  Peptide Derived from Human Papillomavirus
KAAMLGKFKEL

SEQ ID NO: 21756 - protein, 11 aa, Artificial Sequence
  Peptide Derived from Human Papillomavirus
KALMQLKCPPL

SEQ ID NO: 21757 - protein, 8 aa, Artificial Sequence
  Peptide Derived from Human Papillomavirus
KSFFSRTW

SEQ ID NO: 21758 - protein, 11 aa, Artificial Sequence
  Peptide Derived from Human Papillomavirus
KSFFSRTWCRL

SEQ ID NO: 21759 - protein, 9 aa, Artificial Sequence
  Peptide Derived from Human Papillomavirus
KSHFWLQPL

SEQ ID NO: 21760 - protein, 10 aa, Artificial Sequence
  Peptide Derived from Human Papillomavirus
KSHFWLQPLA

SEQ ID NO: 21761 - protein, 8 aa, Artificial Sequence
  Peptide Derived from Human Papillomavirus
KSNSQAKI

SEQ ID NO: 21762 - protein, 9 aa, Artificial Sequence
  Peptide Derived from Human Papillomavirus
KSNSQAKIV

SEQ ID NO: 21763 - protein, 9 aa, Artificial Sequence
  Peptide Derived from Human Papillomavirus
KSTCTDWCV

SEQ ID NO: 21764 - protein, 10 aa, Artificial Sequence
  Peptide Derived from Human Papillomavirus
KSTCTDWCVA

SEQ ID NO: 21765 - protein, 11 aa, Artificial Sequence
  Peptide Derived from Human Papillomavirus
KSTCTDWCVAA

SEQ ID NO: 21766 - protein, 8 aa, Artificial Sequence
  Peptide Derived from Human Papillomavirus
KSYFGMSL

SEQ ID NO: 21767 - protein, 9 aa, Artificial Sequence
  Peptide Derived from Human Papillomavirus
KSYFGMSLI

SEQ ID NO: 21768 - protein, 11 aa, Artificial Sequence
  Peptide Derived from Human Papillomavirus
KSYFGMSLISF

SEQ ID NO: 21769 - protein, 8 aa, Artificial Sequence
  Peptide Derived from Human Papillomavirus
KTAKRRLF

SEQ ID NO: 21770 - protein, 10 aa, Artificial Sequence
  Peptide Derived from Human Papillomavirus
KTAKRRLFEL

SEQ ID NO: 21771 - protein, 9 aa, Artificial Sequence
  Peptide Derived from Human Papillomavirus
KTLLQPYCL

SEQ ID NO: 21772 - protein, 10 aa, Artificial Sequence
  Peptide Derived from Human Papillomavirus
KTLLQPYCLY

SEQ ID NO: 21773 - protein, 8 aa, Artificial Sequence
  Peptide Derived from Human Papillomavirus
KTSNGKAA

SEQ ID NO: 21774 - protein, 9 aa, Artificial Sequence
  Peptide Derived from Human Papillomavirus
KTSNGKAAM

SEQ ID NO: 21775 - protein, 10 aa, Artificial Sequence
  Peptide Derived from Human Papillomavirus
KTSNGKAAML

SEQ ID NO: 21776 - protein, 8 aa, Artificial Sequence
  Peptide Derived from Human Papillomavirus
LACSWGMV

SEQ ID NO: 21777 - protein, 9 aa, Artificial Sequence
  Peptide Derived from Human Papillomavirus
LACSWGMVM

SEQ ID NO: 21778 - protein, 10 aa, Artificial Sequence
  Peptide Derived from Human Papillomavirus
LACSWGMVML

SEQ ID NO: 21779 - protein, 11 aa, Artificial Sequence
  Peptide Derived from Human Papillomavirus
LACSWGMVMLM

SEQ ID NO: 21780 - protein, 8 aa, Artificial Sequence
  Peptide Derived from Human Papillomavirus
LADAKIGM

SEQ ID NO: 21781 - protein, 9 aa, Artificial Sequence
  Peptide Derived from Human Papillomavirus
LADAKIGML

SEQ ID NO: 21782 - protein, 8 aa, Artificial Sequence
  Peptide Derived from Human Papillomavirus
LADSDSNA

SEQ ID NO: 21783 - protein, 10 aa, Artificial Sequence
  Peptide Derived from Human Papillomavirus
LADSDSNACA

SEQ ID NO: 21784 - protein, 11 aa, Artificial Sequence
  Peptide Derived from Human Papillomavirus
LADSDSNACAF

SEQ ID NO: 21785 - protein, 8 aa, Artificial Sequence
  Peptide Derived from Human Papillomavirus
LSALKLFL

SEQ ID NO: 21786 - protein, 11 aa, Artificial Sequence
  Peptide Derived from Human Papillomavirus
LSALKLFLKGV

SEQ ID NO: 21787 - protein, 8 aa, Artificial Sequence
  Peptide Derived from Human Papillomavirus
LSDISSCV

SEQ ID NO: 21788 - protein, 10 aa, Artificial Sequence
  Peptide Derived from Human Papillomavirus
LSDISSCVDY

SEQ ID NO: 21789 - protein, 9 aa, Artificial Sequence
  Peptide Derived from Human Papillomavirus
LSDKNWKSF

SEQ ID NO: 21790 - protein, 10 aa, Artificial Sequence
  Peptide Derived from Human Papillomavirus
LSDKNWKSFF

SEQ ID NO: 21791 - protein, 8 aa, Artificial Sequence
  Peptide Derived from Human Papillomavirus
LSQMVQWA

SEQ ID NO: 21792 - protein, 9 aa, Artificial Sequence
  Peptide Derived from Human Papillomavirus
LSQMVQWAY

SEQ ID NO: 21793 - protein, 11 aa, Artificial Sequence
  Peptide Derived from Human Papillomavirus
MSLISFLQGCI

SEQ ID NO: 21794 - protein, 8 aa, Artificial Sequence
  Peptide Derived from Human Papillomavirus
MSNISDVY

SEQ ID NO: 21795 - protein, 8 aa, Artificial Sequence
  Peptide Derived from Human Papillomavirus
NAGKDDRW

SEQ ID NO: 21796 - protein, 10 aa, Artificial Sequence
  Peptide Derived from Human Papillomavirus
NAGKDDRWPY

SEQ ID NO: 21797 - protein, 11 aa, Artificial Sequence
  Peptide Derived from Human Papillomavirus
NAGKDDRWPYL

SEQ ID NO: 21798 - protein, 8 aa, Artificial Sequence
  Peptide Derived from Human Papillomavirus
NALDGNPV

SEQ ID NO: 21799 - protein, 10 aa, Artificial Sequence
  Peptide Derived from Human Papillomavirus
NALDGNPVSI

SEQ ID NO: 21800 - protein, 8 aa, Artificial Sequence
  Peptide Derived from Human Papillomavirus
NSKSHFWL

SEQ ID NO: 21801 - protein, 11 aa, Artificial Sequence
  Peptide Derived from Human Papillomavirus
NSKSHFWLQPL

SEQ ID NO: 21802 - protein, 9 aa, Artificial Sequence
  Peptide Derived from Human Papillomavirus
NSKTAKRRL

SEQ ID NO: 21803 - protein, 10 aa, Artificial Sequence
  Peptide Derived from Human Papillomavirus
NSKTAKRRLF

SEQ ID NO: 21804 - protein, 9 aa, Artificial Sequence
  Peptide Derived from Human Papillomavirus
NTEVETQQM

SEQ ID NO: 21805 - protein, 10 aa, Artificial Sequence
  Peptide Derived from Human Papillomavirus
NTEVETQQMV

SEQ ID NO: 21806 - protein, 9 aa, Artificial Sequence
  Peptide Derived from Human Papillomavirus
NTGKSYFGM

SEQ ID NO: 21807 - protein, 11 aa, Artificial Sequence
  Peptide Derived from Human Papillomavirus
NTGKSYFGMSL

SEQ ID NO: 21808 - protein, 8 aa, Artificial Sequence
  Peptide Derived from Human Papillomavirus
PTRNILQV

SEQ ID NO: 21809 - protein, 9 aa, Artificial Sequence
  Peptide Derived from Human Papillomavirus
PTRNILQVL

SEQ ID NO: 21810 - protein, 9 aa, Artificial Sequence
  Peptide Derived from Human Papillomavirus
QAEAETAQA

SEQ ID NO: 21811 - protein, 10 aa, Artificial Sequence
  Peptide Derived from Human Papillomavirus
QAEAETAQAL

SEQ ID NO: 21812 - protein, 11 aa, Artificial Sequence
  Peptide Derived from Human Papillomavirus
QAEAETAQALF

SEQ ID NO: 21813 - protein, 11 aa, Artificial Sequence
  Peptide Derived from Human Papillomavirus
QAKIVKDCGTM

SEQ ID NO: 21814 - protein, 9 aa, Artificial Sequence
  Peptide Derived from Human Papillomavirus
QALFHAQEA

SEQ ID NO: 21815 - protein, 9 aa, Artificial Sequence
  Peptide Derived from Human Papillomavirus
QSLACSWGM

SEQ ID NO: 21816 - protein, 10 aa, Artificial Sequence
  Peptide Derived from Human Papillomavirus
QSLACSWGMV

SEQ ID NO: 21817 - protein, 11 aa, Artificial Sequence
  Peptide Derived from Human Papillomavirus
QSLACSWGMVM

SEQ ID NO: 21818 - protein, 10 aa, Artificial Sequence
  Peptide Derived from Human Papillomavirus
QSNKSTCTDW

SEQ ID NO: 21819 - protein, 8 aa, Artificial Sequence
  Peptide Derived from Human Papillomavirus
QTVLQHSF

SEQ ID NO: 21820 - protein, 9 aa, Artificial Sequence
  Peptide Derived from Human Papillomavirus
RAEKRQMSM

SEQ ID NO: 21821 - protein, 8 aa, Artificial Sequence
  Peptide Derived from Human Papillomavirus
RSTAAALY

SEQ ID NO: 21822 - protein, 9 aa, Artificial Sequence
  Peptide Derived from Human Papillomavirus
RSTAAALYW

SEQ ID NO: 21823 - protein, 10 aa, Artificial Sequence
  Peptide Derived from Human Papillomavirus
RSTAAALYWY

SEQ ID NO: 21824 - protein, 10 aa, Artificial Sequence
  Peptide Derived from Human Papillomavirus
RTGMSNISDV

SEQ ID NO: 21825 - protein, 11 aa, Artificial Sequence
  Peptide Derived from Human Papillomavirus
RTGMSNISDVY

SEQ ID NO: 21826 - protein, 8 aa, Artificial Sequence
  Peptide Derived from Human Papillomavirus
RTWCRLNL

SEQ ID NO: 21827 - protein, 10 aa, Artificial Sequence
  Peptide Derived from Human Papillomavirus
SALKLFLKGV

SEQ ID NO: 21828 - protein, 8 aa, Artificial Sequence
  Peptide Derived from Human Papillomavirus
SSCVDYNI

SEQ ID NO: 21829 - protein, 8 aa, Artificial Sequence
  Peptide Derived from Human Papillomavirus
SSDTGEDM

SEQ ID NO: 21830 - protein, 9 aa, Artificial Sequence
  Peptide Derived from Human Papillomavirus
SSDTGEDMV

SEQ ID NO: 21831 - protein, 11 aa, Artificial Sequence
  Peptide Derived from Human Papillomavirus
SSDTGEDMVDF

SEQ ID NO: 21832 - protein, 8 aa, Artificial Sequence
  Peptide Derived from Human Papillomavirus
STAAALYW

SEQ ID NO: 21833 - protein, 9 aa, Artificial Sequence
  Peptide Derived from Human Papillomavirus
STAAALYWY

SEQ ID NO: 21834 - protein, 8 aa, Artificial Sequence
  Peptide Derived from Human Papillomavirus
STCTDWCV

SEQ ID NO: 21835 - protein, 9 aa, Artificial Sequence
  Peptide Derived from Human Papillomavirus
STCTDWCVA

SEQ ID NO: 21836 - protein, 10 aa, Artificial Sequence
  Peptide Derived from Human Papillomavirus
STCTDWCVAA

SEQ ID NO: 21837 - protein, 11 aa, Artificial Sequence
  Peptide Derived from Human Papillomavirus
STCTDWCVAAF

SEQ ID NO: 21838 - protein, 11 aa, Artificial Sequence
  Peptide Derived from Human Papillomavirus
STFKCVSGQNI

SEQ ID NO: 21839 - protein, 8 aa, Artificial Sequence
  Peptide Derived from Human Papillomavirus
TAAALYWY

SEQ ID NO: 21840 - protein, 9 aa, Artificial Sequence
  Peptide Derived from Human Papillomavirus
TAKRRLFEL

SEQ ID NO: 21841 - protein, 8 aa, Artificial Sequence
  Peptide Derived from Human Papillomavirus
TAQALFHA

SEQ ID NO: 21842 - protein, 11 aa, Artificial Sequence
  Peptide Derived from Human Papillomavirus
TAQALFHAQEA

SEQ ID NO: 21843 - protein, 8 aa, Artificial Sequence
  Peptide Derived from Human Papillomavirus
TSNGKAAM

SEQ ID NO: 21844 - protein, 9 aa, Artificial Sequence
  Peptide Derived from Human Papillomavirus
TSNGKAAML

SEQ ID NO: 21845 - protein, 8 aa, Artificial Sequence
  Peptide Derived from Human Papillomavirus
TTFDLSQM

SEQ ID NO: 21846 - protein, 9 aa, Artificial Sequence
  Peptide Derived from Human Papillomavirus
TTFDLSQMV

SEQ ID NO: 21847 - protein, 11 aa, Artificial Sequence
  Peptide Derived from Human Papillomavirus
TTFDLSQMVQW

SEQ ID NO: 21848 - protein, 8 aa, Artificial Sequence
  Peptide Derived from Human Papillomavirus
TTPCWHYI

SEQ ID NO: 21849 - protein, 11 aa, Artificial Sequence
  Peptide Derived from Human Papillomavirus
TTPCWHYIDNY

SEQ ID NO: 21850 - protein, 10 aa, Artificial Sequence
  Peptide Derived from Human Papillomavirus
VAAFGVTGTV

SEQ ID NO: 21851 - protein, 11 aa, Artificial Sequence
  Peptide Derived from Human Papillomavirus
VAAFGVTGTVA

SEQ ID NO: 21852 - protein, 8 aa, Artificial Sequence
  Peptide Derived from Human Papillomavirus
VAEGFKTL

SEQ ID NO: 21853 - protein, 9 aa, Artificial Sequence
  Peptide Derived from Human Papillomavirus
VAEGFKTLL

SEQ ID NO: 21854 - protein, 10 aa, Artificial Sequence
  Peptide Derived from Human Papillomavirus
VSDEGDWRDI

SEQ ID NO: 21855 - protein, 11 aa, Artificial Sequence
  Peptide Derived from Human Papillomavirus
VSDEGDWRDIV

SEQ ID NO: 21856 - protein, 9 aa, Artificial Sequence
  Peptide Derived from Human Papillomavirus
VSFLSALKL

SEQ ID NO: 21857 - protein, 10 aa, Artificial Sequence
  Peptide Derived from Human Papillomavirus
VSFLSALKLF

SEQ ID NO: 21858 - protein, 11 aa, Artificial Sequence
  Peptide Derived from Human Papillomavirus
VSFLSALKLFL

SEQ ID NO: 21859 - protein, 10 aa, Artificial Sequence
  Peptide Derived from Human Papillomavirus
VSFMELIRPF

SEQ ID NO: 21860 - protein, 9 aa, Artificial Sequence
  Peptide Derived from Human Papillomavirus
VSGQNIRTL

SEQ ID NO: 21861 - protein, 9 aa, Artificial Sequence
  Peptide Derived from Human Papillomavirus
VSIDVKHKA

SEQ ID NO: 21862 - protein, 10 aa, Artificial Sequence
  Peptide Derived from Human Papillomavirus
VSIDVKHKAL

SEQ ID NO: 21863 - protein, 11 aa, Artificial Sequence
  Peptide Derived from Human Papillomavirus
VSIDVKHKALM

SEQ ID NO: 21864 - protein, 9 aa, Artificial Sequence
  Peptide Derived from Human Papillomavirus
VTGTVAEGF

SEQ ID NO: 21865 - protein, 8 aa, Artificial Sequence
  Peptide Derived from Human Papillomavirus
WAYDNDVM

SEQ ID NO: 21866 - protein, 8 aa, Artificial Sequence
  Peptide Derived from Human Papillomavirus
YANSKSHF

SEQ ID NO: 21867 - protein, 9 aa, Artificial Sequence
  Peptide Derived from Human Papillomavirus
YANSKSHFW

SEQ ID NO: 21868 - protein, 10 aa, Artificial Sequence
  Peptide Derived from Human Papillomavirus
YANSKSHFWL

SEQ ID NO: 21869 - protein, 11 aa, Artificial Sequence
  Peptide Derived from Human Papillomavirus
YAQLADSDSNA

SEQ ID NO: 21870 - protein, 10 aa, Artificial Sequence
  Peptide Derived from Human Papillomavirus
AAACTNQTRA

SEQ ID NO: 21871 - protein, 11 aa, Artificial Sequence
  Peptide Derived from Human Papillomavirus
AAACTNQTRAV

SEQ ID NO: 21872 - protein, 9 aa, Artificial Sequence
  Peptide Derived from Human Papillomavirus
AACTNQTRA

SEQ ID NO: 21873 - protein, 10 aa, Artificial Sequence
  Peptide Derived from Human Papillomavirus
AACTNQTRAV

SEQ ID NO: 21874 - protein, 8 aa, Artificial Sequence
  Peptide Derived from Human Papillomavirus
ATTPIIHL

SEQ ID NO: 21875 - protein, 9 aa, Artificial Sequence
  Peptide Derived from Human Papillomavirus
CALGTSEGV

SEQ ID NO: 21876 - protein, 9 aa, Artificial Sequence
  Peptide Derived from Human Papillomavirus
CTDGKHKNA

SEQ ID NO: 21877 - protein, 10 aa, Artificial Sequence
  Peptide Derived from Human Papillomavirus
CTDGKHKNAI

SEQ ID NO: 21878 - protein, 11 aa, Artificial Sequence
  Peptide Derived from Human Papillomavirus
CTDGKHKNAIV

SEQ ID NO: 21879 - protein, 8 aa, Artificial Sequence
  Peptide Derived from Human Papillomavirus
CTNQTRAV

SEQ ID NO: 21880 - protein, 8 aa, Artificial Sequence
  Peptide Derived from Human Papillomavirus
CTVVEGQV

SEQ ID NO: 21881 - protein, 8 aa, Artificial Sequence
  Peptide Derived from Human Papillomavirus
DANILKCL

SEQ ID NO: 21882 - protein, 10 aa, Artificial Sequence
  Peptide Derived from Human Papillomavirus
DANILKCLRY

SEQ ID NO: 21883 - protein, 9 aa, Artificial Sequence
  Peptide Derived from Human Papillomavirus
DSKRLCDHI

SEQ ID NO: 21884 - protein, 11 aa, Artificial Sequence
  Peptide Derived from Human Papillomavirus
DSKRLCDHIDY

SEQ ID NO: 21885 - protein, 10 aa, Artificial Sequence
  Peptide Derived from Human Papillomavirus
DSVDSVNCGV

SEQ ID NO: 21886 - protein, 11 aa, Artificial Sequence
  Peptide Derived from Human Papillomavirus
DSVDSVNCGVI

SEQ ID NO: 21887 - protein, 8 aa, Artificial Sequence
  Peptide Derived from Human Papillomavirus
DSVNCGVI

SEQ ID NO: 21888 - protein, 10 aa, Artificial Sequence
  Peptide Derived from Human Papillomavirus
DSVNCGVISA

SEQ ID NO: 21889 - protein, 11 aa, Artificial Sequence
  Peptide Derived from Human Papillomavirus
DSVNCGVISAA

SEQ ID NO: 21890 - protein, 11 aa, Artificial Sequence
  Peptide Derived from Human Papillomavirus
EAKKYGTGKKW

SEQ ID NO: 21891 - protein, 9 aa, Artificial Sequence
  Peptide Derived from Human Papillomavirus
ESVFSSDEI

SEQ ID NO: 21892 - protein, 11 aa, Artificial Sequence
  Peptide Derived from Human Papillomavirus
ESVFSSDEISF

SEQ ID NO: 21893 - protein, 8 aa, Artificial Sequence
  Peptide Derived from Human Papillomavirus
ETLNNTEY

SEQ ID NO: 21894 - protein, 9 aa, Artificial Sequence
  Peptide Derived from Human Papillomavirus
ETLSQRLNV

SEQ ID NO: 21895 - protein, 8 aa, Artificial Sequence
  Peptide Derived from Human Papillomavirus
FAGIVTKL

SEQ ID NO: 21896 - protein, 11 aa, Artificial Sequence
  Peptide Derived from Human Papillomavirus
FAGIVTKLPTA

SEQ ID NO: 21897 - protein, 8 aa, Artificial Sequence
  Peptide Derived from Human Papillomavirus
FSSDEISF

SEQ ID NO: 21898 - protein, 9 aa, Artificial Sequence
  Peptide Derived from Human Papillomavirus
FSSDEISFA

SEQ ID NO: 21899 - protein, 11 aa, Artificial Sequence
  Peptide Derived from Human Papillomavirus
FSSDEISFAGI

SEQ ID NO: 21900 - protein, 8 aa, Artificial Sequence
  Peptide Derived from Human Papillomavirus
FTEEAKKY

SEQ ID NO: 21901 - protein, 8 aa, Artificial Sequence
  Peptide Derived from Human Papillomavirus
GTGKKWEV

SEQ ID NO: 21902 - protein, 10 aa, Artificial Sequence
  Peptide Derived from Human Papillomavirus
GTGKKWEVHA

SEQ ID NO: 21903 - protein, 9 aa, Artificial Sequence
  Peptide Derived from Human Papillomavirus
GTSEGVRRA

SEQ ID NO: 21904 - protein, 8 aa, Artificial Sequence
  Peptide Derived from Human Papillomavirus
HAGGQVIV

SEQ ID NO: 21905 - protein, 9 aa, Artificial Sequence
  Peptide Derived from Human Papillomavirus
HAGGQVIVF

SEQ ID NO: 21906 - protein, 8 aa, Artificial Sequence
  Peptide Derived from Human Papillomavirus
HSINHQVV

SEQ ID NO: 21907 - protein, 10 aa, Artificial Sequence
  Peptide Derived from Human Papillomavirus
HSINHQVVPA

SEQ ID NO: 21908 - protein, 11 aa, Artificial Sequence
  Peptide Derived from Human Papillomavirus
HSINHQVVPAL

SEQ ID NO: 21909 - protein, 10 aa, Artificial Sequence
  Peptide Derived from Human Papillomavirus
ISFAGIVTKL

SEQ ID NO: 21910 - protein, 9 aa, Artificial Sequence
  Peptide Derived from Human Papillomavirus
ISTSQRDDF

SEQ ID NO: 21911 - protein, 10 aa, Artificial Sequence
  Peptide Derived from Human Papillomavirus
ISTSQRDDFL

SEQ ID NO: 21912 - protein, 11 aa, Artificial Sequence
  Peptide Derived from Human Papillomavirus
ITYFVNFTEEA

SEQ ID NO: 21913 - protein, 8 aa, Artificial Sequence
  Peptide Derived from Human Papillomavirus
KAKALQAI

SEQ ID NO: 21914 - protein, 10 aa, Artificial Sequence
  Peptide Derived from Human Papillomavirus
KAKALQAIEL

SEQ ID NO: 21915 - protein, 8 aa, Artificial Sequence
  Peptide Derived from Human Papillomavirus
KALQAIEL

SEQ ID NO: 21916 - protein, 10 aa, Artificial Sequence
  Peptide Derived from Human Papillomavirus
KALQAIELQM

SEQ ID NO: 21917 - protein, 11 aa, Artificial Sequence
  Peptide Derived from Human Papillomavirus
KALQAIELQMM

SEQ ID NO: 21918 - protein, 10 aa, Artificial Sequence
  Peptide Derived from Human Papillomavirus
KAREMGIHSI

SEQ ID NO: 21919 - protein, 11 aa, Artificial Sequence
  Peptide Derived from Human Papillomavirus
KTCALGTSEGV

SEQ ID NO: 21920 - protein, 8 aa, Artificial Sequence
  Peptide Derived from Human Papillomavirus
LSKYKQLY

SEQ ID NO: 21921 - protein, 11 aa, Artificial Sequence
  Peptide Derived from Human Papillomavirus
LSKYKQLYEQV

SEQ ID NO: 21922 - protein, 8 aa, Artificial Sequence
  Peptide Derived from Human Papillomavirus
LSVSKAKA

SEQ ID NO: 21923 - protein, 9 aa, Artificial Sequence
  Peptide Derived from Human Papillomavirus
LSVSKAKAL

SEQ ID NO: 21924 - protein, 11 aa, Artificial Sequence
  Peptide Derived from Human Papillomavirus
LSVSKAKALQA

SEQ ID NO: 21925 - protein, 8 aa, Artificial Sequence
  Peptide Derived from Human Papillomavirus
LTAPTGCL

SEQ ID NO: 21926 - protein, 8 aa, Artificial Sequence
  Peptide Derived from Human Papillomavirus
NAIVTLTY

SEQ ID NO: 21927 - protein, 9 aa, Artificial Sequence
  Peptide Derived from Human Papillomavirus
NAIVTLTYI

SEQ ID NO: 21928 - protein, 9 aa, Artificial Sequence
  Peptide Derived from Human Papillomavirus
NTEYKNEDW

SEQ ID NO: 21929 - protein, 11 aa, Artificial Sequence
  Peptide Derived from Human Papillomavirus
NTEYKNEDWTM

SEQ ID NO: 21930 - protein, 8 aa, Artificial Sequence
  Peptide Derived from Human Papillomavirus
NTHHPNKL

SEQ ID NO: 21931 - protein, 9 aa, Artificial Sequence
  Peptide Derived from Human Papillomavirus
NTHHPNKLL

SEQ ID NO: 21932 - protein, 8 aa, Artificial Sequence
  Peptide Derived from Human Papillomavirus
NTMHYTNW

SEQ ID NO: 21933 - protein, 10 aa, Artificial Sequence
  Peptide Derived from Human Papillomavirus
NTMHYTNWKF

SEQ ID NO: 21934 - protein, 11 aa, Artificial Sequence
  Peptide Derived from Human Papillomavirus
NTMHYTNWKFI

SEQ ID NO: 21935 - protein, 11 aa, Artificial Sequence
  Peptide Derived from Human Papillomavirus
NTTTSNSKTCA

SEQ ID NO: 21936 - protein, 9 aa, Artificial Sequence
  Peptide Derived from Human Papillomavirus
NTVKIPNTV

SEQ ID NO: 21937 - protein, 11 aa, Artificial Sequence
  Peptide Derived from Human Papillomavirus
NTVKIPNTVSV

SEQ ID NO: 21938 - protein, 9 aa, Artificial Sequence
  Peptide Derived from Human Papillomavirus
NTVSVSTGY

SEQ ID NO: 21939 - protein, 10 aa, Artificial Sequence
  Peptide Derived from Human Papillomavirus
NTVSVSTGYM

SEQ ID NO: 21940 - protein, 8 aa, Artificial Sequence
  Peptide Derived from Human Papillomavirus
PALSVSKA

SEQ ID NO: 21941 - protein, 10 aa, Artificial Sequence
  Peptide Derived from Human Papillomavirus
PALSVSKAKA

SEQ ID NO: 21942 - protein, 11 aa, Artificial Sequence
  Peptide Derived from Human Papillomavirus
PALSVSKAKAL

SEQ ID NO: 21943 - protein, 9 aa, Artificial Sequence
  Peptide Derived from Human Papillomavirus
PATTPIIHL

SEQ ID NO: 21944 - protein, 10 aa, Artificial Sequence
  Peptide Derived from Human Papillomavirus
PTGCLKKHGY

SEQ ID NO: 21945 - protein, 8 aa, Artificial Sequence
  Peptide Derived from Human Papillomavirus
QAIELQMM

SEQ ID NO: 21946 - protein, 9 aa, Artificial Sequence
  Peptide Derived from Human Papillomavirus
QAIELQMML

SEQ ID NO: 21947 - protein, 9 aa, Artificial Sequence
  Peptide Derived from Human Papillomavirus
QTRAVSCPA

SEQ ID NO: 21948 - protein, 8 aa, Artificial Sequence
  Peptide Derived from Human Papillomavirus
QTSLELYL

SEQ ID NO: 21949 - protein, 10 aa, Artificial Sequence
  Peptide Derived from Human Papillomavirus
QTSLELYLTA

SEQ ID NO: 21950 - protein, 11 aa, Artificial Sequence
  Peptide Derived from Human Papillomavirus
RAVSCPATTPI

SEQ ID NO: 21951 - protein, 11 aa, Artificial Sequence
  Peptide Derived from Human Papillomavirus
SAAACTNQTRA

SEQ ID NO: 21952 - protein, 8 aa, Artificial Sequence
  Peptide Derived from Human Papillomavirus
SSDEISFA

SEQ ID NO: 21953 - protein, 10 aa, Artificial Sequence
  Peptide Derived from Human Papillomavirus
SSDEISFAGI

SEQ ID NO: 21954 - protein, 11 aa, Artificial Sequence
  Peptide Derived from Human Papillomavirus
SSDEISFAGIV

SEQ ID NO: 21955 - protein, 8 aa, Artificial Sequence
  Peptide Derived from Human Papillomavirus
STSQRDDF

SEQ ID NO: 21956 - protein, 9 aa, Artificial Sequence
  Peptide Derived from Human Papillomavirus
STSQRDDFL

SEQ ID NO: 21957 - protein, 8 aa, Artificial Sequence
  Peptide Derived from Human Papillomavirus
TSEGVRRA

SEQ ID NO: 21958 - protein, 9 aa, Artificial Sequence
  Peptide Derived from Human Papillomavirus
TSLELYLTA

SEQ ID NO: 21959 - protein, 8 aa, Artificial Sequence
  Peptide Derived from Human Papillomavirus
TSNSKTCA

SEQ ID NO: 21960 - protein, 9 aa, Artificial Sequence
  Peptide Derived from Human Papillomavirus
TSNSKTCAL

SEQ ID NO: 21961 - protein, 8 aa, Artificial Sequence
  Peptide Derived from Human Papillomavirus
TSQRDDFL

SEQ ID NO: 21962 - protein, 11 aa, Artificial Sequence
  Peptide Derived from Human Papillomavirus
TSQRDDFLNTV

SEQ ID NO: 21963 - protein, 11 aa, Artificial Sequence
  Peptide Derived from Human Papillomavirus
TTPIIHLKGDA

SEQ ID NO: 21964 - protein, 9 aa, Artificial Sequence
  Peptide Derived from Human Papillomavirus
TTSNSKTCA

SEQ ID NO: 21965 - protein, 10 aa, Artificial Sequence
  Peptide Derived from Human Papillomavirus
TTSNSKTCAL

SEQ ID NO: 21966 - protein, 10 aa, Artificial Sequence
  Peptide Derived from Human Papillomavirus
TTTSNSKTCA

SEQ ID NO: 21967 - protein, 11 aa, Artificial Sequence
  Peptide Derived from Human Papillomavirus
TTTSNSKTCAL

SEQ ID NO: 21968 - protein, 9 aa, Artificial Sequence
  Peptide Derived from Human Papillomavirus
VSCPATTPI

SEQ ID NO: 21969 - protein, 10 aa, Artificial Sequence
  Peptide Derived from Human Papillomavirus
VSCPATTPII

SEQ ID NO: 21970 - protein, 9 aa, Artificial Sequence
  Peptide Derived from Human Papillomavirus
VSKAKALQA

SEQ ID NO: 21971 - protein, 10 aa, Artificial Sequence
  Peptide Derived from Human Papillomavirus
VSKAKALQAI

SEQ ID NO: 21972 - protein, 8 aa, Artificial Sequence
  Peptide Derived from Human Papillomavirus
VSTGYMTI

SEQ ID NO: 21973 - protein, 8 aa, Artificial Sequence
  Peptide Derived from Human Papillomavirus
VSVSTGYM

SEQ ID NO: 21974 - protein, 10 aa, Artificial Sequence
  Peptide Derived from Human Papillomavirus
VSVSTGYMTI

SEQ ID NO: 21975 - protein, 11 aa, Artificial Sequence
  Peptide Derived from Human Papillomavirus
WTCTDGKHKNA

SEQ ID NO: 21976 - protein, 8 aa, Artificial Sequence
  Peptide Derived from Human Papillomavirus
WTMQQTSL

SEQ ID NO: 21977 - protein, 10 aa, Artificial Sequence
  Peptide Derived from Human Papillomavirus
WTMQQTSLEL

SEQ ID NO: 21978 - protein, 11 aa, Artificial Sequence
  Peptide Derived from Human Papillomavirus
WTMQQTSLELY

SEQ ID NO: 21979 - protein, 8 aa, Artificial Sequence
  Peptide Derived from Human Papillomavirus
YTNWKFIY

SEQ ID NO: 21980 - protein, 9 aa, Artificial Sequence
  Peptide Derived from Human Papillomavirus
YTNWKFIYL

SEQ ID NO: 21981 - protein, 11 aa, Artificial Sequence
  Peptide Derived from Human Papillomavirus
YTNWKFIYLCI

SEQ ID NO: 21982 - protein, 11 aa, Artificial Sequence
  Peptide Derived from Human Papillomavirus
YTVEVQFDGDV

SEQ ID NO: 21983 - protein, 8 aa, Artificial Sequence
  Peptide Derived from Human Papillomavirus
ATLLLLIV

SEQ ID NO: 21984 - protein, 9 aa, Artificial Sequence
  Peptide Derived from Human Papillomavirus
ATLLLLIVI

SEQ ID NO: 21985 - protein, 10 aa, Artificial Sequence
  Peptide Derived from Human Papillomavirus
ATLLLLIVIL

SEQ ID NO: 21986 - protein, 11 aa, Artificial Sequence
  Peptide Derived from Human Papillomavirus
ATLLLLIVILW

SEQ ID NO: 21987 - protein, 8 aa, Artificial Sequence
  Peptide Derived from Human Papillomavirus
ATSPLRCF

SEQ ID NO: 21988 - protein, 10 aa, Artificial Sequence
  Peptide Derived from Human Papillomavirus
ATSPLRCFCI

SEQ ID NO: 21989 - protein, 11 aa, Artificial Sequence
  Peptide Derived from Human Papillomavirus
ATSPLRCFCIY

SEQ ID NO: 21990 - protein, 9 aa, Artificial Sequence
  Peptide Derived from Human Papillomavirus
IATSPLRCF

SEQ ID NO: 21991 - protein, 11 aa, Artificial Sequence
  Peptide Derived from Human Papillomavirus
IATSPLRCFCI

SEQ ID NO: 21992 - protein, 8 aa, Artificial Sequence
  Peptide Derived from Human Papillomavirus
ISTVSIVL

SEQ ID NO: 21993 - protein, 10 aa, Artificial Sequence
  Peptide Derived from Human Papillomavirus
ISTVSIVLCF

SEQ ID NO: 21994 - protein, 11 aa, Artificial Sequence
  Peptide Derived from Human Papillomavirus
ISTVSIVLCFL

SEQ ID NO: 21995 - protein, 9 aa, Artificial Sequence
  Peptide Derived from Human Papillomavirus
LSVSVYATL

SEQ ID NO: 21996 - protein, 10 aa, Artificial Sequence
  Peptide Derived from Human Papillomavirus
LSVSVYATLL

SEQ ID NO: 21997 - protein, 11 aa, Artificial Sequence
  Peptide Derived from Human Papillomavirus
LSVSVYATLLL

SEQ ID NO: 21998 - protein, 9 aa, Artificial Sequence
  Peptide Derived from Human Papillomavirus
STVSIVLCF

SEQ ID NO: 21999 - protein, 10 aa, Artificial Sequence
  Peptide Derived from Human Papillomavirus
STVSIVLCFL

SEQ ID NO: 22000 - protein, 11 aa, Artificial Sequence
  Peptide Derived from Human Papillomavirus
STVSIVLCFLL

SEQ ID NO: 22001 - protein, 9 aa, Artificial Sequence
  Peptide Derived from Human Papillomavirus
TSPLRCFCI

SEQ ID NO: 22002 - protein, 10 aa, Artificial Sequence
  Peptide Derived from Human Papillomavirus
TSPLRCFCIY

SEQ ID NO: 22003 - protein, 11 aa, Artificial Sequence
  Peptide Derived from Human Papillomavirus
TSPLRCFCIYV

SEQ ID NO: 22004 - protein, 8 aa, Artificial Sequence
  Peptide Derived from Human Papillomavirus
VSIVLCFL

SEQ ID NO: 22005 - protein, 9 aa, Artificial Sequence
  Peptide Derived from Human Papillomavirus
VSIVLCFLL

SEQ ID NO: 22006 - protein, 11 aa, Artificial Sequence
  Peptide Derived from Human Papillomavirus
VSIVLCFLLCF

SEQ ID NO: 22007 - protein, 8 aa, Artificial Sequence
  Peptide Derived from Human Papillomavirus
VSVYATLL

SEQ ID NO: 22008 - protein, 9 aa, Artificial Sequence
  Peptide Derived from Human Papillomavirus
VSVYATLLL

SEQ ID NO: 22009 - protein, 10 aa, Artificial Sequence
  Peptide Derived from Human Papillomavirus
VSVYATLLLL

SEQ ID NO: 22010 - protein, 11 aa, Artificial Sequence
  Peptide Derived from Human Papillomavirus
VSVYATLLLLI

SEQ ID NO: 22011 - protein, 8 aa, Artificial Sequence
  Peptide Derived from Human Papillomavirus
YATLLLLI

SEQ ID NO: 22012 - protein, 9 aa, Artificial Sequence
  Peptide Derived from Human Papillomavirus
YATLLLLIV

SEQ ID NO: 22013 - protein, 10 aa, Artificial Sequence
  Peptide Derived from Human Papillomavirus
YATLLLLIVI

SEQ ID NO: 22014 - protein, 11 aa, Artificial Sequence
  Peptide Derived from Human Papillomavirus
YATLLLLIVIL

SEQ ID NO: 22015 - protein, 8 aa, Artificial Sequence
  Peptide Derived from Human Papillomavirus
CTKCLRFY

SEQ ID NO: 22016 - protein, 11 aa, Artificial Sequence
  Peptide Derived from Human Papillomavirus
CTKCLRFYSKV

SEQ ID NO: 22017 - protein, 11 aa, Artificial Sequence
  Peptide Derived from Human Papillomavirus
DTPHGVCTKCL

SEQ ID NO: 22018 - protein, 8 aa, Artificial Sequence
  Peptide Derived from Human Papillomavirus
ETEVLDFA

SEQ ID NO: 22019 - protein, 9 aa, Artificial Sequence
  Peptide Derived from Human Papillomavirus
ETEVLDFAF

SEQ ID NO: 22020 - protein, 8 aa, Artificial Sequence
  Peptide Derived from Human Papillomavirus
FAFTDLTI

SEQ ID NO: 22021 - protein, 9 aa, Artificial Sequence
  Peptide Derived from Human Papillomavirus
FAFTDLTIV

SEQ ID NO: 22022 - protein, 10 aa, Artificial Sequence
  Peptide Derived from Human Papillomavirus
FAFTDLTIVY

SEQ ID NO: 22023 - protein, 8 aa, Artificial Sequence
  Peptide Derived from Human Papillomavirus
FTDLTIVY

SEQ ID NO: 22024 - protein, 9 aa, Artificial Sequence
  Peptide Derived from Human Papillomavirus
LSSALEIPY

SEQ ID NO: 22025 - protein, 9 aa, Artificial Sequence
  Peptide Derived from Human Papillomavirus
LTETEVLDF

SEQ ID NO: 22026 - protein, 10 aa, Artificial Sequence
  Peptide Derived from Human Papillomavirus
LTETEVLDFA

SEQ ID NO: 22027 - protein, 11 aa, Artificial Sequence
  Peptide Derived from Human Papillomavirus
LTETEVLDFAF

SEQ ID NO: 22028 - protein, 9 aa, Artificial Sequence
  Peptide Derived from Human Papillomavirus
LTNKGICDL

SEQ ID NO: 22029 - protein, 10 aa, Artificial Sequence
  Peptide Derived from Human Papillomavirus
LTNKGICDLL

SEQ ID NO: 22030 - protein, 11 aa, Artificial Sequence
  Peptide Derived from Human Papillomavirus
LTNKGICDLLI

SEQ ID NO: 22031 - protein, 8 aa, Artificial Sequence
  Peptide Derived from Human Papillomavirus
PAERPRKL

SEQ ID NO: 22032 - protein, 11 aa, Artificial Sequence
  Peptide Derived from Human Papillomavirus
PAERPRKLHEL

SEQ ID NO: 22033 - protein, 10 aa, Artificial Sequence
  Peptide Derived from Human Papillomavirus
SALEIPYDEL

SEQ ID NO: 22034 - protein, 8 aa, Artificial Sequence
  Peptide Derived from Human Papillomavirus
SSALEIPY

SEQ ID NO: 22035 - protein, 11 aa, Artificial Sequence
  Peptide Derived from Human Papillomavirus
SSALEIPYDEL

SEQ ID NO: 22036 - protein, 11 aa, Artificial Sequence
  Peptide Derived from Human Papillomavirus
TTLEKLTNKGI

SEQ ID NO: 22037 - protein, 9 aa, Artificial Sequence
  Peptide Derived from Human Papillomavirus
VSEFRWYRY

SEQ ID NO: 22038 - protein, 11 aa, Artificial Sequence
  Peptide Derived from Human Papillomavirus
VSEFRWYRYSV

SEQ ID NO: 22039 - protein, 9 aa, Artificial Sequence
  Peptide Derived from Human Papillomavirus
WTGRCIACW

SEQ ID NO: 22040 - protein, 9 aa, Artificial Sequence
  Peptide Derived from Human Papillomavirus
YSKVSEFRW

SEQ ID NO: 22041 - protein, 10 aa, Artificial Sequence
  Peptide Derived from Human Papillomavirus
YSKVSEFRWY

SEQ ID NO: 22042 - protein, 8 aa, Artificial Sequence
  Peptide Derived from Human Papillomavirus
YSVYGTTL

SEQ ID NO: 22043 - protein, 11 aa, Artificial Sequence
  Peptide Derived from Human Papillomavirus
YSVYGTTLEKL

SEQ ID NO: 22044 - protein, 10 aa, Artificial Sequence
  Peptide Derived from Human Papillomavirus
ATDLHCYEQL

SEQ ID NO: 22045 - protein, 8 aa, Artificial Sequence
  Peptide Derived from Human Papillomavirus
DSSDEEDV

SEQ ID NO: 22046 - protein, 9 aa, Artificial Sequence
  Peptide Derived from Human Papillomavirus
DSSDEEDVI

SEQ ID NO: 22047 - protein, 8 aa, Artificial Sequence
  Peptide Derived from Human Papillomavirus
DTSNYNIV

SEQ ID NO: 22048 - protein, 10 aa, Artificial Sequence
  Peptide Derived from Human Papillomavirus
DTSNYNIVTF

SEQ ID NO: 22049 - protein, 8 aa, Artificial Sequence
  Peptide Derived from Human Papillomavirus
EATDLHCY

SEQ ID NO: 22050 - protein, 11 aa, Artificial Sequence
  Peptide Derived from Human Papillomavirus
EATDLHCYEQL

SEQ ID NO: 22051 - protein, 8 aa, Artificial Sequence
  Peptide Derived from Human Papillomavirus
ETPTLQDY

SEQ ID NO: 22052 - protein, 9 aa, Artificial Sequence
  Peptide Derived from Human Papillomavirus
ETPTLQDYV

SEQ ID NO: 22053 - protein, 10 aa, Artificial Sequence
  Peptide Derived from Human Papillomavirus
ETPTLQDYVL

SEQ ID NO: 22054 - protein, 8 aa, Artificial Sequence
  Peptide Derived from Human Papillomavirus
KSTLRLCV

SEQ ID NO: 22055 - protein, 8 aa, Artificial Sequence
  Peptide Derived from Human Papillomavirus
PTLQDYVL

SEQ ID NO: 22056 - protein, 10 aa, Artificial Sequence
  Peptide Derived from Human Papillomavirus
PTLQDYVLDL

SEQ ID NO: 22057 - protein, 9 aa, Artificial Sequence
  Peptide Derived from Human Papillomavirus
QAEPDTSNY

SEQ ID NO: 22058 - protein, 11 aa, Artificial Sequence
  Peptide Derived from Human Papillomavirus
QAEPDTSNYNI

SEQ ID NO: 22059 - protein, 9 aa, Artificial Sequence
  Peptide Derived from Human Papillomavirus
QSTQVDIRI

SEQ ID NO: 22060 - protein, 10 aa, Artificial Sequence
  Peptide Derived from Human Papillomavirus
QSTQVDIRIL

SEQ ID NO: 22061 - protein, 8 aa, Artificial Sequence
  Peptide Derived from Human Papillomavirus
SSDEEDVI

SEQ ID NO: 22062 - protein, 8 aa, Artificial Sequence
  Peptide Derived from Human Papillomavirus
STQVDIRI

SEQ ID NO: 22063 - protein, 9 aa, Artificial Sequence
  Peptide Derived from Human Papillomavirus
STQVDIRIL

SEQ ID NO: 22064 - protein, 9 aa, Artificial Sequence
  Peptide Derived from Human Papillomavirus
TSNYNIVTF

SEQ ID NO: 22065 - protein, 11 aa, Artificial Sequence
  Peptide Derived from Human Papillomavirus
VTFCCQCKSTL

SEQ ID NO: 22066 - protein, 10 aa, Artificial Sequence
  Peptide Derived from Human Papillomavirus
AAIANSDTTF

SEQ ID NO: 22067 - protein, 8 aa, Artificial Sequence
  Peptide Derived from Human Papillomavirus
ATLANSTY

SEQ ID NO: 22068 - protein, 9 aa, Artificial Sequence
  Peptide Derived from Human Papillomavirus
ATLANSTYF

SEQ ID NO: 22069 - protein, 8 aa, Artificial Sequence
  Peptide Derived from Human Papillomavirus
ATVYLPPV

SEQ ID NO: 22070 - protein, 10 aa, Artificial Sequence
  Peptide Derived from Human Papillomavirus
ATVYLPPVPV

SEQ ID NO: 22071 - protein, 11 aa, Artificial Sequence
  Peptide Derived from Human Papillomavirus
CAAIANSDTTF

SEQ ID NO: 22072 - protein, 9 aa, Artificial Sequence
  Peptide Derived from Human Papillomavirus
DAQIFNKPY

SEQ ID NO: 22073 - protein, 10 aa, Artificial Sequence
  Peptide Derived from Human Papillomavirus
DAQIFNKPYW

SEQ ID NO: 22074 - protein, 11 aa, Artificial Sequence
  Peptide Derived from Human Papillomavirus
DAQIFNKPYWM

SEQ ID NO: 22075 - protein, 8 aa, Artificial Sequence
  Peptide Derived from Human Papillomavirus
DTENSNRY

SEQ ID NO: 22076 - protein, 9 aa, Artificial Sequence
  Peptide Derived from Human Papillomavirus
DTENSNRYA

SEQ ID NO: 22077 - protein, 9 aa, Artificial Sequence
  Peptide Derived from Human Papillomavirus
DTGFGAMDF

SEQ ID NO: 22078 - protein, 11 aa, Artificial Sequence
  Peptide Derived from Human Papillomavirus
DTGFGAMDFTA

SEQ ID NO: 22079 - protein, 8 aa, Artificial Sequence
  Peptide Derived from Human Papillomavirus
DTKSNVPL

SEQ ID NO: 22080 - protein, 10 aa, Artificial Sequence
  Peptide Derived from Human Papillomavirus
DTKSNVPLDI

SEQ ID NO: 22081 - protein, 9 aa, Artificial Sequence
  Peptide Derived from Human Papillomavirus
DTTFKSSNF

SEQ ID NO: 22082 - protein, 8 aa, Artificial Sequence
  Peptide Derived from Human Papillomavirus
DTTRSTNM

SEQ ID NO: 22083 - protein, 10 aa, Artificial Sequence
  Peptide Derived from Human Papillomavirus
DTTRSTNMSV

SEQ ID NO: 22084 - protein, 10 aa, Artificial Sequence
  Peptide Derived from Human Papillomavirus
DTYRFVTSQA

SEQ ID NO: 22085 - protein, 11 aa, Artificial Sequence
  Peptide Derived from Human Papillomavirus
DTYRFVTSQAI

SEQ ID NO: 22086 - protein, 9 aa, Artificial Sequence
  Peptide Derived from Human Papillomavirus
EATVYLPPV

SEQ ID NO: 22087 - protein, 11 aa, Artificial Sequence
  Peptide Derived from Human Papillomavirus
EATVYLPPVPV

SEQ ID NO: 22088 - protein, 8 aa, Artificial Sequence
  Peptide Derived from Human Papillomavirus
ESVPTDLY

SEQ ID NO: 22089 - protein, 9 aa, Artificial Sequence
  Peptide Derived from Human Papillomavirus
ESVPTDLYI

SEQ ID NO: 22090 - protein, 8 aa, Artificial Sequence
  Peptide Derived from Human Papillomavirus
ETQRLVWA

SEQ ID NO: 22091 - protein, 10 aa, Artificial Sequence
  Peptide Derived from Human Papillomavirus
ETQRLVWACV

SEQ ID NO: 22092 - protein, 8 aa, Artificial Sequence
  Peptide Derived from Human Papillomavirus
FSADLDQF

SEQ ID NO: 22093 - protein, 10 aa, Artificial Sequence
  Peptide Derived from Human Papillomavirus
FSADLDQFPL

SEQ ID NO: 22094 - protein, 11 aa, Artificial Sequence
  Peptide Derived from Human Papillomavirus
FTALQDTKSNV

SEQ ID NO: 22095 - protein, 8 aa, Artificial Sequence
  Peptide Derived from Human Papillomavirus
GAMDFTAL

SEQ ID NO: 22096 - protein, 8 aa, Artificial Sequence
  Peptide Derived from Human Papillomavirus
GSARLLTV

SEQ ID NO: 22097 - protein, 8 aa, Artificial Sequence
  Peptide Derived from Human Papillomavirus
GSGSTATL

SEQ ID NO: 22098 - protein, 9 aa, Artificial Sequence
  Peptide Derived from Human Papillomavirus
GSGSTATLA

SEQ ID NO: 22099 - protein, 9 aa, Artificial Sequence
  Peptide Derived from Human Papillomavirus
GSLEDTYRF

SEQ ID NO: 22100 - protein, 10 aa, Artificial Sequence
  Peptide Derived from Human Papillomavirus
GSLEDTYRFV

SEQ ID NO: 22101 - protein, 8 aa, Artificial Sequence
  Peptide Derived from Human Papillomavirus
GSMVTSDA

SEQ ID NO: 22102 - protein, 10 aa, Artificial Sequence
  Peptide Derived from Human Papillomavirus
GSMVTSDAQI

SEQ ID NO: 22103 - protein, 11 aa, Artificial Sequence
  Peptide Derived from Human Papillomavirus
GSMVTSDAQIF

SEQ ID NO: 22104 - protein, 8 aa, Artificial Sequence
  Peptide Derived from Human Papillomavirus
GSPCSNNA

SEQ ID NO: 22105 - protein, 9 aa, Artificial Sequence
  Peptide Derived from Human Papillomavirus
GSPCSNNAI

SEQ ID NO: 22106 - protein, 11 aa, Artificial Sequence
  Peptide Derived from Human Papillomavirus
GSTATLANSTY

SEQ ID NO: 22107 - protein, 8 aa, Artificial Sequence
  Peptide Derived from Human Papillomavirus
GTDNRECI

SEQ ID NO: 22108 - protein, 10 aa, Artificial Sequence
  Peptide Derived from Human Papillomavirus
GTDNRECISM

SEQ ID NO: 22109 - protein, 11 aa, Artificial Sequence
  Peptide Derived from Human Papillomavirus
GTVGESVPTDL

SEQ ID NO: 22110 - protein, 8 aa, Artificial Sequence
  Peptide Derived from Human Papillomavirus
HAGSARLL

SEQ ID NO: 22111 - protein, 10 aa, Artificial Sequence
  Peptide Derived from Human Papillomavirus
HAGSARLLTV

SEQ ID NO: 22112 - protein, 8 aa, Artificial Sequence
  Peptide Derived from Human Papillomavirus
HSMNPAIL

SEQ ID NO: 22113 - protein, 11 aa, Artificial Sequence
  Peptide Derived from Human Papillomavirus
HSMNPAILEDW

SEQ ID NO: 22114 - protein, 8 aa, Artificial Sequence
  Peptide Derived from Human Papillomavirus
IANSDTTF

SEQ ID NO: 22115 - protein, 10 aa, Artificial Sequence
  Peptide Derived from Human Papillomavirus
ISGHPLLNKF

SEQ ID NO: 22116 - protein, 10 aa, Artificial Sequence
  Peptide Derived from Human Papillomavirus
ISMDYKQTQL

SEQ ID NO: 22117 - protein, 8 aa, Artificial Sequence
  Peptide Derived from Human Papillomavirus
ITLSADIM

SEQ ID NO: 22118 - protein, 10 aa, Artificial Sequence
  Peptide Derived from Human Papillomavirus
ITLSADIMTY

SEQ ID NO: 22119 - protein, 11 aa, Artificial Sequence
  Peptide Derived from Human Papillomavirus
ITLSADIMTYI

SEQ ID NO: 22120 - protein, 9 aa, Artificial Sequence
  Peptide Derived from Human Papillomavirus
ITPGDCPPL

SEQ ID NO: 22121 - protein, 11 aa, Artificial Sequence
  Peptide Derived from Human Papillomavirus
ITPGDCPPLEL

SEQ ID NO: 22122 - protein, 10 aa, Artificial Sequence
  Peptide Derived from Human Papillomavirus
KAGKRSAPSA

SEQ ID NO: 22123 - protein, 8 aa, Artificial Sequence
  Peptide Derived from Human Papillomavirus
KSDNPKKI

SEQ ID NO: 22124 - protein, 9 aa, Artificial Sequence
  Peptide Derived from Human Papillomavirus
KSDNPKKIV

SEQ ID NO: 22125 - protein, 10 aa, Artificial Sequence
  Peptide Derived from Human Papillomavirus
KSDNPKKIVV

SEQ ID NO: 22126 - protein, 8 aa, Artificial Sequence
  Peptide Derived from Human Papillomavirus
KSNVPLDI

SEQ ID NO: 22127 - protein, 8 aa, Artificial Sequence
  Peptide Derived from Human Papillomavirus
KSSNFKEY

SEQ ID NO: 22128 - protein, 9 aa, Artificial Sequence
  Peptide Derived from Human Papillomavirus
KSSNFKEYL

SEQ ID NO: 22129 - protein, 8 aa, Artificial Sequence
  Peptide Derived from Human Papillomavirus
LSADIMTY

SEQ ID NO: 22130 - protein, 9 aa, Artificial Sequence
  Peptide Derived from Human Papillomavirus
LSADIMTYI

SEQ ID NO: 22131 - protein, 9 aa, Artificial Sequence
  Peptide Derived from Human Papillomavirus
LTTPPSGSL

SEQ ID NO: 22132 - protein, 8 aa, Artificial Sequence
  Peptide Derived from Human Papillomavirus
LTVGHPYY

SEQ ID NO: 22133 - protein, 10 aa, Artificial Sequence
  Peptide Derived from Human Papillomavirus
LTVGHPYYSI

SEQ ID NO: 22134 - protein, 9 aa, Artificial Sequence
  Peptide Derived from Human Papillomavirus
MSLWRPSEA

SEQ ID NO: 22135 - protein, 11 aa, Artificial Sequence
  Peptide Derived from Human Papillomavirus
MSLWRPSEATV

SEQ ID NO: 22136 - protein, 8 aa, Artificial Sequence
  Peptide Derived from Human Papillomavirus
MSVCAAIA

SEQ ID NO: 22137 - protein, 10 aa, Artificial Sequence
  Peptide Derived from Human Papillomavirus
MTYIHSMNPA

SEQ ID NO: 22138 - protein, 11 aa, Artificial Sequence
  Peptide Derived from Human Papillomavirus
MTYIHSMNPAI

SEQ ID NO: 22139 - protein, 11 aa, Artificial Sequence
  Peptide Derived from Human Papillomavirus
NAITPGDCPPL

SEQ ID NO: 22140 - protein, 11 aa, Artificial Sequence
  Peptide Derived from Human Papillomavirus
NSDTTFKSSNF

SEQ ID NO: 22141 - protein, 9 aa, Artificial Sequence
  Peptide Derived from Human Papillomavirus
NSICKYPDY

SEQ ID NO: 22142 - protein, 10 aa, Artificial Sequence
  Peptide Derived from Human Papillomavirus
NSICKYPDYL

SEQ ID NO: 22143 - protein, 9 aa, Artificial Sequence
  Peptide Derived from Human Papillomavirus
NSVIQDGDM

SEQ ID NO: 22144 - protein, 10 aa, Artificial Sequence
  Peptide Derived from Human Papillomavirus
NSVIQDGDMV

SEQ ID NO: 22145 - protein, 9 aa, Artificial Sequence
  Peptide Derived from Human Papillomavirus
PAILEDWNF

SEQ ID NO: 22146 - protein, 11 aa, Artificial Sequence
  Peptide Derived from Human Papillomavirus
PAILEDWNFGL

SEQ ID NO: 22147 - protein, 9 aa, Artificial Sequence
  Peptide Derived from Human Papillomavirus
PSASTTTPA

SEQ ID NO: 22148 - protein, 8 aa, Artificial Sequence
  Peptide Derived from Human Papillomavirus
PSEATVYL

SEQ ID NO: 22149 - protein, 11 aa, Artificial Sequence
  Peptide Derived from Human Papillomavirus
PSEATVYLPPV

SEQ ID NO: 22150 - protein, 9 aa, Artificial Sequence
  Peptide Derived from Human Papillomavirus
PSGSLEDTY

SEQ ID NO: 22151 - protein, 11 aa, Artificial Sequence
  Peptide Derived from Human Papillomavirus
PSGSLEDTYRF

SEQ ID NO: 22152 - protein, 10 aa, Artificial Sequence
  Peptide Derived from Human Papillomavirus
PSGSMVTSDA

SEQ ID NO: 22153 - protein, 8 aa, Artificial Sequence
  Peptide Derived from Human Papillomavirus
PTPSGSMV

SEQ ID NO: 22154 - protein, 10 aa, Artificial Sequence
  Peptide Derived from Human Papillomavirus
QAGYRARPKF

SEQ ID NO: 22155 - protein, 9 aa, Artificial Sequence
  Peptide Derived from Human Papillomavirus
QAITCQKTA

SEQ ID NO: 22156 - protein, 9 aa, Artificial Sequence
  Peptide Derived from Human Papillomavirus
RAQGHNNGI

SEQ ID NO: 22157 - protein, 11 aa, Artificial Sequence
  Peptide Derived from Human Papillomavirus
RAQGHNNGICW

SEQ ID NO: 22158 - protein, 8 aa, Artificial Sequence
  Peptide Derived from Human Papillomavirus
RARPKFKA

SEQ ID NO: 22159 - protein, 9 aa, Artificial Sequence
  Peptide Derived from Human Papillomavirus
RSGTVGESV

SEQ ID NO: 22160 - protein, 9 aa, Artificial Sequence
  Peptide Derived from Human Papillomavirus
RSTNMSVCA

SEQ ID NO: 22161 - protein, 10 aa, Artificial Sequence
  Peptide Derived from Human Papillomavirus
RSTNMSVCAA

SEQ ID NO: 22162 - protein, 11 aa, Artificial Sequence
  Peptide Derived from Human Papillomavirus
RSTNMSVCAAI

SEQ ID NO: 22163 - protein, 8 aa, Artificial Sequence
  Peptide Derived from Human Papillomavirus
RTNIYYHA

SEQ ID NO: 22164 - protein, 11 aa, Artificial Sequence
  Peptide Derived from Human Papillomavirus
RTNIYYHAGSA

SEQ ID NO: 22165 - protein, 8 aa, Artificial Sequence
  Peptide Derived from Human Papillomavirus
SADIMTYI

SEQ ID NO: 22166 - protein, 11 aa, Artificial Sequence
  Peptide Derived from Human Papillomavirus
SADIMTYIHSM

SEQ ID NO: 22167 - protein, 9 aa, Artificial Sequence
  Peptide Derived from Human Papillomavirus
SADLDQFPL

SEQ ID NO: 22168 - protein, 11 aa, Artificial Sequence
  Peptide Derived from Human Papillomavirus
SAPSASTTTPA

SEQ ID NO: 22169 - protein, 11 aa, Artificial Sequence
  Peptide Derived from Human Papillomavirus
SARLLTVGHPY

SEQ ID NO: 22170 - protein, 8 aa, Artificial Sequence
  Peptide Derived from Human Papillomavirus
SASTTTPA

SEQ ID NO: 22171 - protein, 8 aa, Artificial Sequence
  Peptide Derived from Human Papillomavirus
SSNFKEYL

SEQ ID NO: 22172 - protein, 10 aa, Artificial Sequence
  Peptide Derived from Human Papillomavirus
STATLANSTY

SEQ ID NO: 22173 - protein, 11 aa, Artificial Sequence
  Peptide Derived from Human Papillomavirus
STATLANSTYF

SEQ ID NO: 22174 - protein, 11 aa, Artificial Sequence
  Peptide Derived from Human Papillomavirus
STDEYVTRTNI

SEQ ID NO: 22175 - protein, 8 aa, Artificial Sequence
  Peptide Derived from Human Papillomavirus
STNMSVCA

SEQ ID NO: 22176 - protein, 9 aa, Artificial Sequence
  Peptide Derived from Human Papillomavirus
STNMSVCAA

SEQ ID NO: 22177 - protein, 10 aa, Artificial Sequence
  Peptide Derived from Human Papillomavirus
STNMSVCAAI

SEQ ID NO: 22178 - protein, 11 aa, Artificial Sequence
  Peptide Derived from Human Papillomavirus
STNMSVCAAIA

SEQ ID NO: 22179 - protein, 11 aa, Artificial Sequence
  Peptide Derived from Human Papillomavirus
STYFPTPSGSM

SEQ ID NO: 22180 - protein, 10 aa, Artificial Sequence
  Peptide Derived from Human Papillomavirus
TALQDTKSNV

SEQ ID NO: 22181 - protein, 11 aa, Artificial Sequence
  Peptide Derived from Human Papillomavirus
TAPQKPKEDPF

SEQ ID NO: 22182 - protein, 9 aa, Artificial Sequence
  Peptide Derived from Human Papillomavirus
TATLANSTY

SEQ ID NO: 22183 - protein, 10 aa, Artificial Sequence
  Peptide Derived from Human Papillomavirus
TATLANSTYF

SEQ ID NO: 22184 - protein, 11 aa, Artificial Sequence
  Peptide Derived from Human Papillomavirus
TSDAQIFNKPY

SEQ ID NO: 22185 - protein, 11 aa, Artificial Sequence
  Peptide Derived from Human Papillomavirus
TSFYNPETQRL

SEQ ID NO: 22186 - protein, 11 aa, Artificial Sequence
  Peptide Derived from Human Papillomavirus
TSQAITCQKTA

SEQ ID NO: 22187 - protein, 8 aa, Artificial Sequence
  Peptide Derived from Human Papillomavirus
TTFKSSNF

SEQ ID NO: 22188 - protein, 11 aa, Artificial Sequence
  Peptide Derived from Human Papillomavirus
TTFKSSNFKEY

SEQ ID NO: 22189 - protein, 8 aa, Artificial Sequence
  Peptide Derived from Human Papillomavirus
TTPPSGSL

SEQ ID NO: 22190 - protein, 9 aa, Artificial Sequence
  Peptide Derived from Human Papillomavirus
TTRSTNMSV

SEQ ID NO: 22191 - protein, 11 aa, Artificial Sequence
  Peptide Derived from Human Papillomavirus
TTRSTNMSVCA

SEQ ID NO: 22192 - protein, 9 aa, Artificial Sequence
  Peptide Derived from Human Papillomavirus
VAEPYGDTL

SEQ ID NO: 22193 - protein, 10 aa, Artificial Sequence
  Peptide Derived from Human Papillomavirus
VAEPYGDTLF

SEQ ID NO: 22194 - protein, 11 aa, Artificial Sequence
  Peptide Derived from Human Papillomavirus
VAEPYGDTLFF

SEQ ID NO: 22195 - protein, 8 aa, Artificial Sequence
  Peptide Derived from Human Papillomavirus
VSGLQYRV

SEQ ID NO: 22196 - protein, 9 aa, Artificial Sequence
  Peptide Derived from Human Papillomavirus
VSGLQYRVF

SEQ ID NO: 22197 - protein, 11 aa, Artificial Sequence
  Peptide Derived from Human Papillomavirus
VSGLQYRVFRV

SEQ ID NO: 22198 - protein, 10 aa, Artificial Sequence
  Peptide Derived from Human Papillomavirus
VSKVVSTDEY

SEQ ID NO: 22199 - protein, 11 aa, Artificial Sequence
  Peptide Derived from Human Papillomavirus
VSKVVSTDEYV

SEQ ID NO: 22200 - protein, 8 aa, Artificial Sequence
  Peptide Derived from Human Papillomavirus
VTRTNIYY

SEQ ID NO: 22201 - protein, 10 aa, Artificial Sequence
  Peptide Derived from Human Papillomavirus
VTRTNIYYHA

SEQ ID NO: 22202 - protein, 8 aa, Artificial Sequence
  Peptide Derived from Human Papillomavirus
VTSDAQIF

SEQ ID NO: 22203 - protein, 8 aa, Artificial Sequence
  Peptide Derived from Human Papillomavirus
WACVGLEV

SEQ ID NO: 22204 - protein, 9 aa, Artificial Sequence
  Peptide Derived from Human Papillomavirus
AAGTCPSDV

SEQ ID NO: 22205 - protein, 10 aa, Artificial Sequence
  Peptide Derived from Human Papillomavirus
AAGTCPSDVI

SEQ ID NO: 22206 - protein, 9 aa, Artificial Sequence
  Peptide Derived from Human Papillomavirus
ASATTTSTL

SEQ ID NO: 22207 - protein, 9 aa, Artificial Sequence
  Peptide Derived from Human Papillomavirus
ASIPIRPPV

SEQ ID NO: 22208 - protein, 11 aa, Artificial Sequence
  Peptide Derived from Human Papillomavirus
ASIPIRPPVSI

SEQ ID NO: 22209 - protein, 10 aa, Artificial Sequence
  Peptide Derived from Human Papillomavirus
ATHNVSPSTA

SEQ ID NO: 22210 - protein, 11 aa, Artificial Sequence
  Peptide Derived from Human Papillomavirus
ATHNVSPSTAV

SEQ ID NO: 22211 - protein, 9 aa, Artificial Sequence
  Peptide Derived from Human Papillomavirus
ATIGARVHY

SEQ ID NO: 22212 - protein, 10 aa, Artificial Sequence
  Peptide Derived from Human Papillomavirus
ATIGARVHYY

SEQ ID NO: 22213 - protein, 11 aa, Artificial Sequence
  Peptide Derived from Human Papillomavirus
ATIGARVHYYY

SEQ ID NO: 22214 - protein, 10 aa, Artificial Sequence
  Peptide Derived from Human Papillomavirus
ATQLYQTCKA

SEQ ID NO: 22215 - protein, 11 aa, Artificial Sequence
  Peptide Derived from Human Papillomavirus
ATQLYQTCKAA

SEQ ID NO: 22216 - protein, 8 aa, Artificial Sequence
  Peptide Derived from Human Papillomavirus
ATQQVKVI

SEQ ID NO: 22217 - protein, 9 aa, Artificial Sequence
  Peptide Derived from Human Papillomavirus
ATTADTTPA

SEQ ID NO: 22218 - protein, 10 aa, Artificial Sequence
  Peptide Derived from Human Papillomavirus
ATTADTTPAI

SEQ ID NO: 22219 - protein, 11 aa, Artificial Sequence
  Peptide Derived from Human Papillomavirus
ATTADTTPAIL

SEQ ID NO: 22220 - protein, 11 aa, Artificial Sequence
  Peptide Derived from Human Papillomavirus
ATTTSTLNDGL

SEQ ID NO: 22221 - protein, 10 aa, Artificial Sequence
  Peptide Derived from Human Papillomavirus
DTDFTVDTPA

SEQ ID NO: 22222 - protein, 8 aa, Artificial Sequence
  Peptide Derived from Human Papillomavirus
DTPATHNV

SEQ ID NO: 22223 - protein, 9 aa, Artificial Sequence
  Peptide Derived from Human Papillomavirus
DTTPAILDV

SEQ ID NO: 22224 - protein, 10 aa, Artificial Sequence
  Peptide Derived from Human Papillomavirus
EASIPIRPPV

SEQ ID NO: 22225 - protein, 9 aa, Artificial Sequence
  Peptide Derived from Human Papillomavirus
ESGIVDVGA

SEQ ID NO: 22226 - protein, 11 aa, Artificial Sequence
  Peptide Derived from Human Papillomavirus
ESGIVDVGAPA

SEQ ID NO: 22227 - protein, 8 aa, Artificial Sequence
  Peptide Derived from Human Papillomavirus
ESIEMQPL

SEQ ID NO: 22228 - protein, 10 aa, Artificial Sequence
  Peptide Derived from Human Papillomavirus
ESIEMQPLGA

SEQ ID NO: 22229 - protein, 8 aa, Artificial Sequence
  Peptide Derived from Human Papillomavirus
ETSGHLLL

SEQ ID NO: 22230 - protein, 9 aa, Artificial Sequence
  Peptide Derived from Human Papillomavirus
ETVNAEESL

SEQ ID NO: 22231 - protein, 10 aa, Artificial Sequence
  Peptide Derived from Human Papillomavirus
ETVNAEESLY

SEQ ID NO: 22232 - protein, 11 aa, Artificial Sequence
  Peptide Derived from Human Papillomavirus
ETVNAEESLYF

SEQ ID NO: 22233 - protein, 8 aa, Artificial Sequence
  Peptide Derived from Human Papillomavirus
FSGPDVPI

SEQ ID NO: 22234 - protein, 11 aa, Artificial Sequence
  Peptide Derived from Human Papillomavirus
FSGPDVPIEHA

SEQ ID NO: 22235 - protein, 8 aa, Artificial Sequence
  Peptide Derived from Human Papillomavirus
FSNTSHNI

SEQ ID NO: 22236 - protein, 9 aa, Artificial Sequence
  Peptide Derived from Human Papillomavirus
FSNTSHNIA

SEQ ID NO: 22237 - protein, 8 aa, Artificial Sequence
  Peptide Derived from Human Papillomavirus
FTDVSVAA

SEQ ID NO: 22238 - protein, 11 aa, Artificial Sequence
  Peptide Derived from Human Papillomavirus
FTVDTPATHNV

SEQ ID NO: 22239 - protein, 8 aa, Artificial Sequence
  Peptide Derived from Human Papillomavirus
GARVHYYY

SEQ ID NO: 22240 - protein, 10 aa, Artificial Sequence
  Peptide Derived from Human Papillomavirus
GARVHYYYDI

SEQ ID NO: 22241 - protein, 10 aa, Artificial Sequence
  Peptide Derived from Human Papillomavirus
GASATTTSTL

SEQ ID NO: 22242 - protein, 8 aa, Artificial Sequence
  Peptide Derived from Human Papillomavirus
GATIGARV

SEQ ID NO: 22243 - protein, 10 aa, Artificial Sequence
  Peptide Derived from Human Papillomavirus
GATIGARVHY

SEQ ID NO: 22244 - protein, 11 aa, Artificial Sequence
  Peptide Derived from Human Papillomavirus
GATIGARVHYY

SEQ ID NO: 22245 - protein, 10 aa, Artificial Sequence
  Peptide Derived from Human Papillomavirus
GSGTGGRTGY

SEQ ID NO: 22246 - protein, 11 aa, Artificial Sequence
  Peptide Derived from Human Papillomavirus
GSGTGGRTGYV

SEQ ID NO: 22247 - protein, 10 aa, Artificial Sequence
  Peptide Derived from Human Papillomavirus
GSMGVFFGGL

SEQ ID NO: 22248 - protein, 8 aa, Artificial Sequence
  Peptide Derived from Human Papillomavirus
GTCPSDVI

SEQ ID NO: 22249 - protein, 11 aa, Artificial Sequence
  Peptide Derived from Human Papillomavirus
GTCPSDVIPKI

SEQ ID NO: 22250 - protein, 8 aa, Artificial Sequence
  Peptide Derived from Human Papillomavirus
GTGGRTGY

SEQ ID NO: 22251 - protein, 9 aa, Artificial Sequence
  Peptide Derived from Human Papillomavirus
GTGGRTGYV

SEQ ID NO: 22252 - protein, 11 aa, Artificial Sequence
  Peptide Derived from Human Papillomavirus
GTGGRTGYVPL

SEQ ID NO: 22253 - protein, 9 aa, Artificial Sequence
  Peptide Derived from Human Papillomavirus
HAPTQVFPF

SEQ ID NO: 22254 - protein, 11 aa, Artificial Sequence
  Peptide Derived from Human Papillomavirus
HAPTQVFPFPL

SEQ ID NO: 22255 - protein, 8 aa, Artificial Sequence
  Peptide Derived from Human Papillomavirus
HTTIADQI

SEQ ID NO: 22256 - protein, 9 aa, Artificial Sequence
  Peptide Derived from Human Papillomavirus
HTTIADQIL

SEQ ID NO: 22257 - protein, 11 aa, Artificial Sequence
  Peptide Derived from Human Papillomavirus
HTTIADQILRY

SEQ ID NO: 22258 - protein, 8 aa, Artificial Sequence
  Peptide Derived from Human Papillomavirus
IADQILRY

SEQ ID NO: 22259 - protein, 11 aa, Artificial Sequence
  Peptide Derived from Human Papillomavirus
IADQILRYGSM

SEQ ID NO: 22260 - protein, 8 aa, Artificial Sequence
  Peptide Derived from Human Papillomavirus
IALHRPAL

SEQ ID NO: 22261 - protein, 8 aa, Artificial Sequence
  Peptide Derived from Human Papillomavirus
IAPDPDFL

SEQ ID NO: 22262 - protein, 10 aa, Artificial Sequence
  Peptide Derived from Human Papillomavirus
IAPDPDFLDI

SEQ ID NO: 22263 - protein, 11 aa, Artificial Sequence
  Peptide Derived from Human Papillomavirus
IAPDPDFLDII

SEQ ID NO: 22264 - protein, 10 aa, Artificial Sequence
  Peptide Derived from Human Papillomavirus
IATTADTTPA

SEQ ID NO: 22265 - protein, 11 aa, Artificial Sequence
  Peptide Derived from Human Papillomavirus
IATTADTTPAI

SEQ ID NO: 22266 - protein, 11 aa, Artificial Sequence
  Peptide Derived from Human Papillomavirus
ISSINPAGESI

SEQ ID NO: 22267 - protein, 9 aa, Artificial Sequence
  Peptide Derived from Human Papillomavirus
ISTHNYEEI

SEQ ID NO: 22268 - protein, 11 aa, Artificial Sequence
  Peptide Derived from Human Papillomavirus
ISTHNYEEIPM

SEQ ID NO: 22269 - protein, 10 aa, Artificial Sequence
  Peptide Derived from Human Papillomavirus
ITSSTPIPGV

SEQ ID NO: 22270 - protein, 8 aa, Artificial Sequence
  Peptide Derived from Human Papillomavirus
ITYENPAY

SEQ ID NO: 22271 - protein, 11 aa, Artificial Sequence
  Peptide Derived from Human Papillomavirus
ITYENPAYETV

SEQ ID NO: 22272 - protein, 10 aa, Artificial Sequence
  Peptide Derived from Human Papillomavirus
KAAGTCPSDV

SEQ ID NO: 22273 - protein, 11 aa, Artificial Sequence
  Peptide Derived from Human Papillomavirus
KAAGTCPSDVI

SEQ ID NO: 22274 - protein, 8 aa, Artificial Sequence
  Peptide Derived from Human Papillomavirus
KATQQVKV

SEQ ID NO: 22275 - protein, 9 aa, Artificial Sequence
  Peptide Derived from Human Papillomavirus
KATQQVKVI

SEQ ID NO: 22276 - protein, 8 aa, Artificial Sequence
  Peptide Derived from Human Papillomavirus
LAPTTPQV

SEQ ID NO: 22277 - protein, 10 aa, Artificial Sequence
  Peptide Derived from Human Papillomavirus
LAPTTPQVSI

SEQ ID NO: 22278 - protein, 11 aa, Artificial Sequence
  Peptide Derived from Human Papillomavirus
LAPTTPQVSIF

SEQ ID NO: 22279 - protein, 8 aa, Artificial Sequence
  Peptide Derived from Human Papillomavirus
LSAPKQLI

SEQ ID NO: 22280 - protein, 10 aa, Artificial Sequence
  Peptide Derived from Human Papillomavirus
LSAPKQLITY

SEQ ID NO: 22281 - protein, 11 aa, Artificial Sequence
  Peptide Derived from Human Papillomavirus
LSSSSISTHNY

SEQ ID NO: 22282 - protein, 9 aa, Artificial Sequence
  Peptide Derived from Human Papillomavirus
LSTGFDIPI

SEQ ID NO: 22283 - protein, 10 aa, Artificial Sequence
  Peptide Derived from Human Papillomavirus
LSTGFDIPIF

SEQ ID NO: 22284 - protein, 8 aa, Artificial Sequence
  Peptide Derived from Human Papillomavirus
LSTRPSTV

SEQ ID NO: 22285 - protein, 11 aa, Artificial Sequence
  Peptide Derived from Human Papillomavirus
LSTRPSTVSEA

SEQ ID NO: 22286 - protein, 8 aa, Artificial Sequence
  Peptide Derived from Human Papillomavirus
LTSRRNTV

SEQ ID NO: 22287 - protein, 10 aa, Artificial Sequence
  Peptide Derived from Human Papillomavirus
LTSRRNTVRY

SEQ ID NO: 22288 - protein, 8 aa, Artificial Sequence
  Peptide Derived from Human Papillomavirus
NAEESLYF

SEQ ID NO: 22289 - protein, 10 aa, Artificial Sequence
  Peptide Derived from Human Papillomavirus
NTTVPLSTGF

SEQ ID NO: 22290 - protein, 8 aa, Artificial Sequence
  Peptide Derived from Human Papillomavirus
NTVRYSRL

SEQ ID NO: 22291 - protein, 8 aa, Artificial Sequence
  Peptide Derived from Human Papillomavirus
PAETSGHL

SEQ ID NO: 22292 - protein, 9 aa, Artificial Sequence
  Peptide Derived from Human Papillomavirus
PAETSGHLL

SEQ ID NO: 22293 - protein, 10 aa, Artificial Sequence
  Peptide Derived from Human Papillomavirus
PAETSGHLLL

SEQ ID NO: 22294 - protein, 8 aa, Artificial Sequence
  Peptide Derived from Human Papillomavirus
PAGESIEM

SEQ ID NO: 22295 - protein, 11 aa, Artificial Sequence
  Peptide Derived from Human Papillomavirus
PAGESIEMQPL

SEQ ID NO: 22296 - protein, 9 aa, Artificial Sequence
  Peptide Derived from Human Papillomavirus
PAILDVTSV

SEQ ID NO: 22297 - protein, 10 aa, Artificial Sequence
  Peptide Derived from Human Papillomavirus
PALTSRRNTV

SEQ ID NO: 22298 - protein, 10 aa, Artificial Sequence
  Peptide Derived from Human Papillomavirus
PARLGLYSKA

SEQ ID NO: 22299 - protein, 11 aa, Artificial Sequence
  Peptide Derived from Human Papillomavirus
PATHNVSPSTA

SEQ ID NO: 22300 - protein, 8 aa, Artificial Sequence
  Peptide Derived from Human Papillomavirus
PAYETVNA

SEQ ID NO: 22301 - protein, 8 aa, Artificial Sequence
  Peptide Derived from Human Papillomavirus
PSDVIPKI

SEQ ID NO: 22302 - protein, 10 aa, Artificial Sequence
  Peptide Derived from Human Papillomavirus
PSTAVQSTSA

SEQ ID NO: 22303 - protein, 11 aa, Artificial Sequence
  Peptide Derived from Human Papillomavirus
PSTAVQSTSAV

SEQ ID NO: 22304 - protein, 9 aa, Artificial Sequence
  Peptide Derived from Human Papillomavirus
PSTVSEASI

SEQ ID NO: 22305 - protein, 11 aa, Artificial Sequence
  Peptide Derived from Human Papillomavirus
PSTVSEASIPI

SEQ ID NO: 22306 - protein, 10 aa, Artificial Sequence
  Peptide Derived from Human Papillomavirus
PSVLQPPTPA

SEQ ID NO: 22307 - protein, 10 aa, Artificial Sequence
  Peptide Derived from Human Papillomavirus
PTFLSAPKQL

SEQ ID NO: 22308 - protein, 11 aa, Artificial Sequence
  Peptide Derived from Human Papillomavirus
PTFLSAPKQLI

SEQ ID NO: 22309 - protein, 8 aa, Artificial Sequence
  Peptide Derived from Human Papillomavirus
PTFTDPSV

SEQ ID NO: 22310 - protein, 9 aa, Artificial Sequence
  Peptide Derived from Human Papillomavirus
PTFTDPSVL

SEQ ID NO: 22311 - protein, 8 aa, Artificial Sequence
  Peptide Derived from Human Papillomavirus
PTNTTVPL

SEQ ID NO: 22312 - protein, 10 aa, Artificial Sequence
  Peptide Derived from Human Papillomavirus
PTPAETSGHL

SEQ ID NO: 22313 - protein, 11 aa, Artificial Sequence
  Peptide Derived from Human Papillomavirus
PTPAETSGHLL

SEQ ID NO: 22314 - protein, 9 aa, Artificial Sequence
  Peptide Derived from Human Papillomavirus
PTQVFPFPL

SEQ ID NO: 22315 - protein, 10 aa, Artificial Sequence
  Peptide Derived from Human Papillomavirus
PTQVFPFPLA

SEQ ID NO: 22316 - protein, 8 aa, Artificial Sequence
  Peptide Derived from Human Papillomavirus
PTTPQVSI

SEQ ID NO: 22317 - protein, 9 aa, Artificial Sequence
  Peptide Derived from Human Papillomavirus
PTTPQVSIF

SEQ ID NO: 22318 - protein, 10 aa, Artificial Sequence
  Peptide Derived from Human Papillomavirus
PTTPQVSIFV

SEQ ID NO: 22319 - protein, 8 aa, Artificial Sequence
  Peptide Derived from Human Papillomavirus
PTTSGFDI

SEQ ID NO: 22320 - protein, 9 aa, Artificial Sequence
  Peptide Derived from Human Papillomavirus
PTTSGFDIA

SEQ ID NO: 22321 - protein, 8 aa, Artificial Sequence
  Peptide Derived from Human Papillomavirus
QSTSAVSA

SEQ ID NO: 22322 - protein, 9 aa, Artificial Sequence
  Peptide Derived from Human Papillomavirus
QSTSAVSAY

SEQ ID NO: 22323 - protein, 10 aa, Artificial Sequence
  Peptide Derived from Human Papillomavirus
QSTSAVSAYV

SEQ ID NO: 22324 - protein, 9 aa, Artificial Sequence
  Peptide Derived from Human Papillomavirus
QTLRTRSGA

SEQ ID NO: 22325 - protein, 11 aa, Artificial Sequence
  Peptide Derived from Human Papillomavirus
QTLRTRSGATI

SEQ ID NO: 22326 - protein, 8 aa, Artificial Sequence
  Peptide Derived from Human Papillomavirus
RASATQLY

SEQ ID NO: 22327 - protein, 8 aa, Artificial Sequence
  Peptide Derived from Human Papillomavirus
RSGATIGA

SEQ ID NO: 22328 - protein, 10 aa, Artificial Sequence
  Peptide Derived from Human Papillomavirus
RSGATIGARV

SEQ ID NO: 22329 - protein, 9 aa, Artificial Sequence
  Peptide Derived from Human Papillomavirus
RSTKRTKRA

SEQ ID NO: 22330 - protein, 11 aa, Artificial Sequence
  Peptide Derived from Human Papillomavirus
RSTKRTKRASA

SEQ ID NO: 22331 - protein, 10 aa, Artificial Sequence
  Peptide Derived from Human Papillomavirus
RTKRASATQL

SEQ ID NO: 22332 - protein, 11 aa, Artificial Sequence
  Peptide Derived from Human Papillomavirus
RTKRASATQLY

SEQ ID NO: 22333 - protein, 8 aa, Artificial Sequence
  Peptide Derived from Human Papillomavirus
RTRSGATI

SEQ ID NO: 22334 - protein, 10 aa, Artificial Sequence
  Peptide Derived from Human Papillomavirus
RTRSGATIGA

SEQ ID NO: 22335 - protein, 9 aa, Artificial Sequence
  Peptide Derived from Human Papillomavirus
SAPKQLITY

SEQ ID NO: 22336 - protein, 11 aa, Artificial Sequence
  Peptide Derived from Human Papillomavirus
SATQLYQTCKA

SEQ ID NO: 22337 - protein, 8 aa, Artificial Sequence
  Peptide Derived from Human Papillomavirus
SATTTSTL

SEQ ID NO: 22338 - protein, 10 aa, Artificial Sequence
  Peptide Derived from Human Papillomavirus
SAYVPTNTTV

SEQ ID NO: 22339 - protein, 10 aa, Artificial Sequence
  Peptide Derived from Human Papillomavirus
SSINPAGESI

SEQ ID NO: 22340 - protein, 8 aa, Artificial Sequence
  Peptide Derived from Human Papillomavirus
SSISTHNY

SEQ ID NO: 22341 - protein, 11 aa, Artificial Sequence
  Peptide Derived from Human Papillomavirus
SSISTHNYEEI

SEQ ID NO: 22342 - protein, 9 aa, Artificial Sequence
  Peptide Derived from Human Papillomavirus
SSSISTHNY

SEQ ID NO: 22343 - protein, 10 aa, Artificial Sequence
  Peptide Derived from Human Papillomavirus
SSSSISTHNY

SEQ ID NO: 22344 - protein, 8 aa, Artificial Sequence
  Peptide Derived from Human Papillomavirus
SSTPIPGV

SEQ ID NO: 22345 - protein, 9 aa, Artificial Sequence
  Peptide Derived from Human Papillomavirus
STAVQSTSA

SEQ ID NO: 22346 - protein, 10 aa, Artificial Sequence
  Peptide Derived from Human Papillomavirus
STAVQSTSAV

SEQ ID NO: 22347 - protein, 8 aa, Artificial Sequence
  Peptide Derived from Human Papillomavirus
STGFDIPI

SEQ ID NO: 22348 - protein, 9 aa, Artificial Sequence
  Peptide Derived from Human Papillomavirus
STGFDIPIF

SEQ ID NO: 22349 - protein, 8 aa, Artificial Sequence
  Peptide Derived from Human Papillomavirus
STHENPTF

SEQ ID NO: 22350 - protein, 8 aa, Artificial Sequence
  Peptide Derived from Human Papillomavirus
STHNYEEI

SEQ ID NO: 22351 - protein, 10 aa, Artificial Sequence
  Peptide Derived from Human Papillomavirus
STHNYEEIPM

SEQ ID NO: 22352 - protein, 8 aa, Artificial Sequence
  Peptide Derived from Human Papillomavirus
STKRTKRA

SEQ ID NO: 22353 - protein, 10 aa, Artificial Sequence
  Peptide Derived from Human Papillomavirus
STKRTKRASA

SEQ ID NO: 22354 - protein, 8 aa, Artificial Sequence
  Peptide Derived from Human Papillomavirus
STLNDGLY

SEQ ID NO: 22355 - protein, 10 aa, Artificial Sequence
  Peptide Derived from Human Papillomavirus
STLNDGLYDI

SEQ ID NO: 22356 - protein, 11 aa, Artificial Sequence
  Peptide Derived from Human Papillomavirus
STLNDGLYDIY

SEQ ID NO: 22357 - protein, 11 aa, Artificial Sequence
  Peptide Derived from Human Papillomavirus
STPIPGVRRPA

SEQ ID NO: 22358 - protein, 10 aa, Artificial Sequence
  Peptide Derived from Human Papillomavirus
STRPSTVSEA

SEQ ID NO: 22359 - protein, 8 aa, Artificial Sequence
  Peptide Derived from Human Papillomavirus
STSAVSAY

SEQ ID NO: 22360 - protein, 9 aa, Artificial Sequence
  Peptide Derived from Human Papillomavirus
STSAVSAYV

SEQ ID NO: 22361 - protein, 8 aa, Artificial Sequence
  Peptide Derived from Human Papillomavirus
STVSEASI

SEQ ID NO: 22362 - protein, 10 aa, Artificial Sequence
  Peptide Derived from Human Papillomavirus
STVSEASIPI

SEQ ID NO: 22363 - protein, 8 aa, Artificial Sequence
  Peptide Derived from Human Papillomavirus
TADTTPAI

SEQ ID NO: 22364 - protein, 9 aa, Artificial Sequence
  Peptide Derived from Human Papillomavirus
TADTTPAIL

SEQ ID NO: 22365 - protein, 11 aa, Artificial Sequence
  Peptide Derived from Human Papillomavirus
TADTTPAILDV

SEQ ID NO: 22366 - protein, 8 aa, Artificial Sequence
  Peptide Derived from Human Papillomavirus
TAVQSTSA

SEQ ID NO: 22367 - protein, 9 aa, Artificial Sequence
  Peptide Derived from Human Papillomavirus
TAVQSTSAV

SEQ ID NO: 22368 - protein, 11 aa, Artificial Sequence
  Peptide Derived from Human Papillomavirus
TAVQSTSAVSA

SEQ ID NO: 22369 - protein, 8 aa, Artificial Sequence
  Peptide Derived from Human Papillomavirus
TSAVSAYV

SEQ ID NO: 22370 - protein, 10 aa, Artificial Sequence
  Peptide Derived from Human Papillomavirus
TSGFDIATTA

SEQ ID NO: 22371 - protein, 11 aa, Artificial Sequence
  Peptide Derived from Human Papillomavirus
TSHNIAPDPDF

SEQ ID NO: 22372 - protein, 9 aa, Artificial Sequence
  Peptide Derived from Human Papillomavirus
TSRRNTVRY

SEQ ID NO: 22373 - protein, 9 aa, Artificial Sequence
  Peptide Derived from Human Papillomavirus
TSSTPIPGV

SEQ ID NO: 22374 - protein, 8 aa, Artificial Sequence
  Peptide Derived from Human Papillomavirus
TSTLNDGL

SEQ ID NO: 22375 - protein, 9 aa, Artificial Sequence
  Peptide Derived from Human Papillomavirus
TSTLNDGLY

SEQ ID NO: 22376 - protein, 11 aa, Artificial Sequence
  Peptide Derived from Human Papillomavirus
TSTLNDGLYDI

SEQ ID NO: 22377 - protein, 11 aa, Artificial Sequence
  Peptide Derived from Human Papillomavirus
TSVSTHENPTF

SEQ ID NO: 22378 - protein, 8 aa, Artificial Sequence
  Peptide Derived from Human Papillomavirus
TTADTTPA

SEQ ID NO: 22379 - protein, 9 aa, Artificial Sequence
  Peptide Derived from Human Papillomavirus
TTADTTPAI

SEQ ID NO: 22380 - protein, 10 aa, Artificial Sequence
  Peptide Derived from Human Papillomavirus
TTADTTPAIL

SEQ ID NO: 22381 - protein, 8 aa, Artificial Sequence
  Peptide Derived from Human Papillomavirus
TTIADQIL

SEQ ID NO: 22382 - protein, 10 aa, Artificial Sequence
  Peptide Derived from Human Papillomavirus
TTIADQILRY

SEQ ID NO: 22383 - protein, 8 aa, Artificial Sequence
  Peptide Derived from Human Papillomavirus
TTPAILDV

SEQ ID NO: 22384 - protein, 11 aa, Artificial Sequence
  Peptide Derived from Human Papillomavirus
TTPAILDVTSV

SEQ ID NO: 22385 - protein, 8 aa, Artificial Sequence
  Peptide Derived from Human Papillomavirus
TTPQVSIF

SEQ ID NO: 22386 - protein, 9 aa, Artificial Sequence
  Peptide Derived from Human Papillomavirus
TTPQVSIFV

SEQ ID NO: 22387 - protein, 8 aa, Artificial Sequence
  Peptide Derived from Human Papillomavirus
TTSGFDIA

SEQ ID NO: 22388 - protein, 11 aa, Artificial Sequence
  Peptide Derived from Human Papillomavirus
TTSGFDIATTA

SEQ ID NO: 22389 - protein, 9 aa, Artificial Sequence
  Peptide Derived from Human Papillomavirus
TTSTLNDGL

SEQ ID NO: 22390 - protein, 10 aa, Artificial Sequence
  Peptide Derived from Human Papillomavirus
TTSTLNDGLY

SEQ ID NO: 22391 - protein, 10 aa, Artificial Sequence
  Peptide Derived from Human Papillomavirus
TTTSTLNDGL

SEQ ID NO: 22392 - protein, 11 aa, Artificial Sequence
  Peptide Derived from Human Papillomavirus
TTTSTLNDGLY

SEQ ID NO: 22393 - protein, 9 aa, Artificial Sequence
  Peptide Derived from Human Papillomavirus
TTVPLSTGF

SEQ ID NO: 22394 - protein, 11 aa, Artificial Sequence
  Peptide Derived from Human Papillomavirus
TTVPLSTGFDI

SEQ ID NO: 22395 - protein, 11 aa, Artificial Sequence
  Peptide Derived from Human Papillomavirus
VSAYVPTNTTV

SEQ ID NO: 22396 - protein, 8 aa, Artificial Sequence
  Peptide Derived from Human Papillomavirus
VSEASIPI

SEQ ID NO: 22397 - protein, 9 aa, Artificial Sequence
  Peptide Derived from Human Papillomavirus
VSIDPVGPL

SEQ ID NO: 22398 - protein, 10 aa, Artificial Sequence
  Peptide Derived from Human Papillomavirus
VSIFVDGGDF

SEQ ID NO: 22399 - protein, 11 aa, Artificial Sequence
  Peptide Derived from Human Papillomavirus
VSIFVDGGDFY

SEQ ID NO: 22400 - protein, 9 aa, Artificial Sequence
  Peptide Derived from Human Papillomavirus
VSLVEESGI

SEQ ID NO: 22401 - protein, 10 aa, Artificial Sequence
  Peptide Derived from Human Papillomavirus
VSLVEESGIV

SEQ ID NO: 22402 - protein, 9 aa, Artificial Sequence
  Peptide Derived from Human Papillomavirus
VSTHENPTF

SEQ ID NO: 22403 - protein, 8 aa, Artificial Sequence
  Peptide Derived from Human Papillomavirus
VSTNNENI

SEQ ID NO: 22404 - protein, 8 aa, Artificial Sequence
  Peptide Derived from Human Papillomavirus
VSYFFTDV

SEQ ID NO: 22405 - protein, 10 aa, Artificial Sequence
  Peptide Derived from Human Papillomavirus
VSYFFTDVSV

SEQ ID NO: 22406 - protein, 11 aa, Artificial Sequence
  Peptide Derived from Human Papillomavirus
VSYFFTDVSVA

SEQ ID NO: 22407 - protein, 8 aa, Artificial Sequence
  Peptide Derived from Human Papillomavirus
YADTDFTV

SEQ ID NO: 22408 - protein, 8 aa, Artificial Sequence
  Peptide Derived from Human Papillomavirus
YSKATQQV

SEQ ID NO: 22409 - protein, 10 aa, Artificial Sequence
  Peptide Derived from Human Papillomavirus
YSKATQQVKV

SEQ ID NO: 22410 - protein, 11 aa, Artificial Sequence
  Peptide Derived from Human Papillomavirus
YSKATQQVKVI

SEQ ID NO: 22411 - protein, 10 aa, Artificial Sequence
  Peptide Derived from Human Papillomavirus
YSRLGNKQTL

SEQ ID NO: 22412 - protein, 11 aa, Artificial Sequence
  Peptide Derived from Human Papillomavirus
AAAFLKSNSQA

SEQ ID NO: 22413 - protein, 8 aa, Artificial Sequence
  Peptide Derived from Human Papillomavirus
AACSQSAA

SEQ ID NO: 22414 - protein, 11 aa, Artificial Sequence
  Peptide Derived from Human Papillomavirus
AACSQSAAEDV

SEQ ID NO: 22415 - protein, 9 aa, Artificial Sequence
  Peptide Derived from Human Papillomavirus
AAEDVVDRA

SEQ ID NO: 22416 - protein, 10 aa, Artificial Sequence
  Peptide Derived from Human Papillomavirus
AAEDVVDRAA

SEQ ID NO: 22417 - protein, 10 aa, Artificial Sequence
  Peptide Derived from Human Papillomavirus
AAFLKSNSQA

SEQ ID NO: 22418 - protein, 9 aa, Artificial Sequence
  Peptide Derived from Human Papillomavirus
AANPCRTSI

SEQ ID NO: 22419 - protein, 8 aa, Artificial Sequence
  Peptide Derived from Human Papillomavirus
AARALFNI

SEQ ID NO: 22420 - protein, 8 aa, Artificial Sequence
  Peptide Derived from Human Papillomavirus
CALKRKFA

SEQ ID NO: 22421 - protein, 9 aa, Artificial Sequence
  Peptide Derived from Human Papillomavirus
CALKRKFAA

SEQ ID NO: 22422 - protein, 9 aa, Artificial Sequence
  Peptide Derived from Human Papillomavirus
CALYWFRTA

SEQ ID NO: 22423 - protein, 10 aa, Artificial Sequence
  Peptide Derived from Human Papillomavirus
CALYWFRTAM

SEQ ID NO: 22424 - protein, 10 aa, Artificial Sequence
  Peptide Derived from Human Papillomavirus
CSAGENTRSL

SEQ ID NO: 22425 - protein, 8 aa, Artificial Sequence
  Peptide Derived from Human Papillomavirus
CSKNRLTV

SEQ ID NO: 22426 - protein, 9 aa, Artificial Sequence
  Peptide Derived from Human Papillomavirus
CSKNRLTVA

SEQ ID NO: 22427 - protein, 11 aa, Artificial Sequence
  Peptide Derived from Human Papillomavirus
CSKNRLTVAKL

SEQ ID NO: 22428 - protein, 9 aa, Artificial Sequence
  Peptide Derived from Human Papillomavirus
CSQSAAEDV

SEQ ID NO: 22429 - protein, 10 aa, Artificial Sequence
  Peptide Derived from Human Papillomavirus
CSQSAAEDVV

SEQ ID NO: 22430 - protein, 9 aa, Artificial Sequence
  Peptide Derived from Human Papillomavirus
CTDWCITGY

SEQ ID NO: 22431 - protein, 11 aa, Artificial Sequence
  Peptide Derived from Human Papillomavirus
CTDWCITGYGI

SEQ ID NO: 22432 - protein, 9 aa, Artificial Sequence
  Peptide Derived from Human Papillomavirus
CTGWFEVEA

SEQ ID NO: 22433 - protein, 10 aa, Artificial Sequence
  Peptide Derived from Human Papillomavirus
CTGWFEVEAV

SEQ ID NO: 22434 - protein, 11 aa, Artificial Sequence
  Peptide Derived from Human Papillomavirus
CTGWFEVEAVI

SEQ ID NO: 22435 - protein, 8 aa, Artificial Sequence
  Peptide Derived from Human Papillomavirus
CTYRKRKI

SEQ ID NO: 22436 - protein, 11 aa, Artificial Sequence
  Peptide Derived from Human Papillomavirus
CTYRKRKIDEL

SEQ ID NO: 22437 - protein, 10 aa, Artificial Sequence
  Peptide Derived from Human Papillomavirus
DAKIGMIDDV

SEQ ID NO: 22438 - protein, 8 aa, Artificial Sequence
  Peptide Derived from Human Papillomavirus
DSCENVTL

SEQ ID NO: 22439 - protein, 11 aa, Artificial Sequence
  Peptide Derived from Human Papillomavirus
DSCENVTLQEI

SEQ ID NO: 22440 - protein, 8 aa, Artificial Sequence
  Peptide Derived from Human Papillomavirus
DSDIAYYY

SEQ ID NO: 22441 - protein, 9 aa, Artificial Sequence
  Peptide Derived from Human Papillomavirus
DSDIAYYYA

SEQ ID NO: 22442 - protein, 11 aa, Artificial Sequence
  Peptide Derived from Human Papillomavirus
DSDIAYYYAQL

SEQ ID NO: 22443 - protein, 10 aa, Artificial Sequence
  Peptide Derived from Human Papillomavirus
DSEVSCETNV

SEQ ID NO: 22444 - protein, 9 aa, Artificial Sequence
  Peptide Derived from Human Papillomavirus
DSGTDLLEF

SEQ ID NO: 22445 - protein, 10 aa, Artificial Sequence
  Peptide Derived from Human Papillomavirus
DSGTDLLEFI

SEQ ID NO: 22446 - protein, 9 aa, Artificial Sequence
  Peptide Derived from Human Papillomavirus
DSGYGNTEV

SEQ ID NO: 22447 - protein, 9 aa, Artificial Sequence
  Peptide Derived from Human Papillomavirus
DSMENSIQA

SEQ ID NO: 22448 - protein, 8 aa, Artificial Sequence
  Peptide Derived from Human Papillomavirus
DSNSNAAA

SEQ ID NO: 22449 - protein, 9 aa, Artificial Sequence
  Peptide Derived from Human Papillomavirus
DSNSNAAAF

SEQ ID NO: 22450 - protein, 10 aa, Artificial Sequence
  Peptide Derived from Human Papillomavirus
DSNSNAAAFL

SEQ ID NO: 22451 - protein, 11 aa, Artificial Sequence
  Peptide Derived from Human Papillomavirus
DSRWPYLHSRL

SEQ ID NO: 22452 - protein, 8 aa, Artificial Sequence
  Peptide Derived from Human Papillomavirus
DTEAARAL

SEQ ID NO: 22453 - protein, 9 aa, Artificial Sequence
  Peptide Derived from Human Papillomavirus
DTEAARALF

SEQ ID NO: 22454 - protein, 11 aa, Artificial Sequence
  Peptide Derived from Human Papillomavirus
DTEAARALFNI

SEQ ID NO: 22455 - protein, 9 aa, Artificial Sequence
  Peptide Derived from Human Papillomavirus
EAARALFNI

SEQ ID NO: 22456 - protein, 8 aa, Artificial Sequence
  Peptide Derived from Human Papillomavirus
EAYGISFM

SEQ ID NO: 22457 - protein, 10 aa, Artificial Sequence
  Peptide Derived from Human Papillomavirus
EAYGISFMEL

SEQ ID NO: 22458 - protein, 11 aa, Artificial Sequence
  Peptide Derived from Human Papillomavirus
EAYGISFMELV

SEQ ID NO: 22459 - protein, 9 aa, Artificial Sequence
  Peptide Derived from Human Papillomavirus
ESQNGDTNL

SEQ ID NO: 22460 - protein, 11 aa, Artificial Sequence
  Peptide Derived from Human Papillomavirus
ESSGVGDDSEV

SEQ ID NO: 22461 - protein, 10 aa, Artificial Sequence
  Peptide Derived from Human Papillomavirus
ETADDSGTDL

SEQ ID NO: 22462 - protein, 11 aa, Artificial Sequence
  Peptide Derived from Human Papillomavirus
ETADDSGTDLL

SEQ ID NO: 22463 - protein, 11 aa, Artificial Sequence
  Peptide Derived from Human Papillomavirus
ETCMVIEPPKL

SEQ ID NO: 22464 - protein, 10 aa, Artificial Sequence
  Peptide Derived from Human Papillomavirus
ETNVDSCENV

SEQ ID NO: 22465 - protein, 9 aa, Artificial Sequence
  Peptide Derived from Human Papillomavirus
ETQQMVQQV

SEQ ID NO: 22466 - protein, 8 aa, Artificial Sequence
  Peptide Derived from Human Papillomavirus
FAACSQSA

SEQ ID NO: 22467 - protein, 9 aa, Artificial Sequence
  Peptide Derived from Human Papillomavirus
FAACSQSAA

SEQ ID NO: 22468 - protein, 8 aa, Artificial Sequence
  Peptide Derived from Human Papillomavirus
FSRTWCKL

SEQ ID NO: 22469 - protein, 10 aa, Artificial Sequence
  Peptide Derived from Human Papillomavirus
FSRTWCKLDL

SEQ ID NO: 22470 - protein, 11 aa, Artificial Sequence
  Peptide Derived from Human Papillomavirus
FSRTWCKLDLI

SEQ ID NO: 22471 - protein, 8 aa, Artificial Sequence
  Peptide Derived from Human Papillomavirus
FTAFLGAF

SEQ ID NO: 22472 - protein, 11 aa, Artificial Sequence
  Peptide Derived from Human Papillomavirus
FTAFLGAFKKF

SEQ ID NO: 22473 - protein, 10 aa, Artificial Sequence
  Peptide Derived from Human Papillomavirus
GAFKKFLKGI

SEQ ID NO: 22474 - protein, 9 aa, Artificial Sequence
  Peptide Derived from Human Papillomavirus
GAGMGCTGW

SEQ ID NO: 22475 - protein, 10 aa, Artificial Sequence
  Peptide Derived from Human Papillomavirus
GAGMGCTGWF

SEQ ID NO: 22476 - protein, 8 aa, Artificial Sequence
  Peptide Derived from Human Papillomavirus
GTDLLEFI

SEQ ID NO: 22477 - protein, 8 aa, Artificial Sequence
  Peptide Derived from Human Papillomavirus
GTDSRWPY

SEQ ID NO: 22478 - protein, 9 aa, Artificial Sequence
  Peptide Derived from Human Papillomavirus
GTDSRWPYL

SEQ ID NO: 22479 - protein, 10 aa, Artificial Sequence
  Peptide Derived from Human Papillomavirus
GTTPEWIDRL

SEQ ID NO: 22480 - protein, 8 aa, Artificial Sequence
  Peptide Derived from Human Papillomavirus
HSFNDNIF

SEQ ID NO: 22481 - protein, 10 aa, Artificial Sequence
  Peptide Derived from Human Papillomavirus
HSFNDNIFDL

SEQ ID NO: 22482 - protein, 10 aa, Artificial Sequence
  Peptide Derived from Human Papillomavirus
HSLYTHLQCL

SEQ ID NO: 22483 - protein, 9 aa, Artificial Sequence
  Peptide Derived from Human Papillomavirus
HSRLTVFEF

SEQ ID NO: 22484 - protein, 9 aa, Artificial Sequence
  Peptide Derived from Human Papillomavirus
HSSNTKANI

SEQ ID NO: 22485 - protein, 10 aa, Artificial Sequence
  Peptide Derived from Human Papillomavirus
HSSNTKANIL

SEQ ID NO: 22486 - protein, 11 aa, Artificial Sequence
  Peptide Derived from Human Papillomavirus
HSSNTKANILY

SEQ ID NO: 22487 - protein, 8 aa, Artificial Sequence
  Peptide Derived from Human Papillomavirus
IAYYYAQL

SEQ ID NO: 22488 - protein, 9 aa, Artificial Sequence
  Peptide Derived from Human Papillomavirus
IAYYYAQLA

SEQ ID NO: 22489 - protein, 10 aa, Artificial Sequence
  Peptide Derived from Human Papillomavirus
ISCVNSKSHF

SEQ ID NO: 22490 - protein, 11 aa, Artificial Sequence
  Peptide Derived from Human Papillomavirus
ISCVNSKSHFW

SEQ ID NO: 22491 - protein, 11 aa, Artificial Sequence
  Peptide Derived from Human Papillomavirus
ISDVQGTTPEW

SEQ ID NO: 22492 - protein, 9 aa, Artificial Sequence
  Peptide Derived from Human Papillomavirus
ISEDEDETA

SEQ ID NO: 22493 - protein, 10 aa, Artificial Sequence
  Peptide Derived from Human Papillomavirus
ISFMELVRPF

SEQ ID NO: 22494 - protein, 9 aa, Artificial Sequence
  Peptide Derived from Human Papillomavirus
ISIDVKHRA

SEQ ID NO: 22495 - protein, 10 aa, Artificial Sequence
  Peptide Derived from Human Papillomavirus
ISIDVKHRAL

SEQ ID NO: 22496 - protein, 11 aa, Artificial Sequence
  Peptide Derived from Human Papillomavirus
ISIDVKHRALV

SEQ ID NO: 22497 - protein, 9 aa, Artificial Sequence
  Peptide Derived from Human Papillomavirus
ISPSVAESL

SEQ ID NO: 22498 - protein, 11 aa, Artificial Sequence
  Peptide Derived from Human Papillomavirus
ISPSVAESLKV

SEQ ID NO: 22499 - protein, 8 aa, Artificial Sequence
  Peptide Derived from Human Papillomavirus
ISTFKCSA

SEQ ID NO: 22500 - protein, 9 aa, Artificial Sequence
  Peptide Derived from Human Papillomavirus
ISWTYIDDY

SEQ ID NO: 22501 - protein, 10 aa, Artificial Sequence
  Peptide Derived from Human Papillomavirus
ISWTYIDDYM

SEQ ID NO: 22502 - protein, 10 aa, Artificial Sequence
  Peptide Derived from Human Papillomavirus
ITGYGISPSV

SEQ ID NO: 22503 - protein, 11 aa, Artificial Sequence
  Peptide Derived from Human Papillomavirus
ITGYGISPSVA

SEQ ID NO: 22504 - protein, 9 aa, Artificial Sequence
  Peptide Derived from Human Papillomavirus
KAEKRKMSI

SEQ ID NO: 22505 - protein, 8 aa, Artificial Sequence
  Peptide Derived from Human Papillomavirus
KANILYKF

SEQ ID NO: 22506 - protein, 11 aa, Artificial Sequence
  Peptide Derived from Human Papillomavirus
KANILYKFKEA

SEQ ID NO: 22507 - protein, 10 aa, Artificial Sequence
  Peptide Derived from Human Papillomavirus
KSCMLICGPA

SEQ ID NO: 22508 - protein, 10 aa, Artificial Sequence
  Peptide Derived from Human Papillomavirus
KSDKTSCTDW

SEQ ID NO: 22509 - protein, 8 aa, Artificial Sequence
  Peptide Derived from Human Papillomavirus
KSFFSRTW

SEQ ID NO: 22510 - protein, 11 aa, Artificial Sequence
  Peptide Derived from Human Papillomavirus
KSFFSRTWCKL

SEQ ID NO: 22511 - protein, 9 aa, Artificial Sequence
  Peptide Derived from Human Papillomavirus
KSHFWLQPL

SEQ ID NO: 22512 - protein, 8 aa, Artificial Sequence
  Peptide Derived from Human Papillomavirus
KSNSQAKI

SEQ ID NO: 22513 - protein, 9 aa, Artificial Sequence
  Peptide Derived from Human Papillomavirus
KSNSQAKIV

SEQ ID NO: 22514 - protein, 8 aa, Artificial Sequence
  Peptide Derived from Human Papillomavirus
KSYFGMSL

SEQ ID NO: 22515 - protein, 9 aa, Artificial Sequence
  Peptide Derived from Human Papillomavirus
KSYFGMSLI

SEQ ID NO: 22516 - protein, 11 aa, Artificial Sequence
  Peptide Derived from Human Papillomavirus
KSYFGMSLIQF

SEQ ID NO: 22517 - protein, 8 aa, Artificial Sequence
  Peptide Derived from Human Papillomavirus
KTNDGGNW

SEQ ID NO: 22518 - protein, 11 aa, Artificial Sequence
  Peptide Derived from Human Papillomavirus
KTNDGGNWRPI

SEQ ID NO: 22519 - protein, 9 aa, Artificial Sequence
  Peptide Derived from Human Papillomavirus
KTSCTDWCI

SEQ ID NO: 22520 - protein, 8 aa, Artificial Sequence
  Peptide Derived from Human Papillomavirus
LADSNSNA

SEQ ID NO: 22521 - protein, 9 aa, Artificial Sequence
  Peptide Derived from Human Papillomavirus
LADSNSNAA

SEQ ID NO: 22522 - protein, 10 aa, Artificial Sequence
  Peptide Derived from Human Papillomavirus
LADSNSNAAA

SEQ ID NO: 22523 - protein, 11 aa, Artificial Sequence
  Peptide Derived from Human Papillomavirus
LADSNSNAAAF

SEQ ID NO: 22524 - protein, 8 aa, Artificial Sequence
  Peptide Derived from Human Papillomavirus
LSDAKIGM

SEQ ID NO: 22525 - protein, 9 aa, Artificial Sequence
  Peptide Derived from Human Papillomavirus
LSDAKIGMI

SEQ ID NO: 22526 - protein, 8 aa, Artificial Sequence
  Peptide Derived from Human Papillomavirus
LSEMVQWA

SEQ ID NO: 22527 - protein, 9 aa, Artificial Sequence
  Peptide Derived from Human Papillomavirus
LSEMVQWAY

SEQ ID NO: 22528 - protein, 8 aa, Artificial Sequence
  Peptide Derived from Human Papillomavirus
LSIPETCM

SEQ ID NO: 22529 - protein, 9 aa, Artificial Sequence
  Peptide Derived from Human Papillomavirus
LSIPETCMV

SEQ ID NO: 22530 - protein, 10 aa, Artificial Sequence
  Peptide Derived from Human Papillomavirus
LSIPETCMVI

SEQ ID NO: 22531 - protein, 8 aa, Artificial Sequence
  Peptide Derived from Human Papillomavirus
LTCDRGII

SEQ ID NO: 22532 - protein, 9 aa, Artificial Sequence
  Peptide Derived from Human Papillomavirus
LTCDRGIII

SEQ ID NO: 22533 - protein, 10 aa, Artificial Sequence
  Peptide Derived from Human Papillomavirus
LTCDRGIIIL

SEQ ID NO: 22534 - protein, 11 aa, Artificial Sequence
  Peptide Derived from Human Papillomavirus
LTCDRGIIILL

SEQ ID NO: 22535 - protein, 8 aa, Artificial Sequence
  Peptide Derived from Human Papillomavirus
LTDDSDIA

SEQ ID NO: 22536 - protein, 9 aa, Artificial Sequence
  Peptide Derived from Human Papillomavirus
LTDDSDIAY

SEQ ID NO: 22537 - protein, 10 aa, Artificial Sequence
  Peptide Derived from Human Papillomavirus
LTDDSDIAYY

SEQ ID NO: 22538 - protein, 11 aa, Artificial Sequence
  Peptide Derived from Human Papillomavirus
LTDDSDIAYYY

SEQ ID NO: 22539 - protein, 10 aa, Artificial Sequence
  Peptide Derived from Human Papillomavirus
LTVAKLMSNL

SEQ ID NO: 22540 - protein, 11 aa, Artificial Sequence
  Peptide Derived from Human Papillomavirus
LTVAKLMSNLL

SEQ ID NO: 22541 - protein, 10 aa, Artificial Sequence
  Peptide Derived from Human Papillomavirus
LTVFEFKNPF

SEQ ID NO: 22542 - protein, 8 aa, Artificial Sequence
  Peptide Derived from Human Papillomavirus
LTVLQHSF

SEQ ID NO: 22543 - protein, 10 aa, Artificial Sequence
  Peptide Derived from Human Papillomavirus
MADPEGTNGA

SEQ ID NO: 22544 - protein, 11 aa, Artificial Sequence
  Peptide Derived from Human Papillomavirus
MSLIQFLKGCV

SEQ ID NO: 22545 - protein, 8 aa, Artificial Sequence
  Peptide Derived from Human Papillomavirus
NAGTDSRW

SEQ ID NO: 22546 - protein, 10 aa, Artificial Sequence
  Peptide Derived from Human Papillomavirus
NAGTDSRWPY

SEQ ID NO: 22547 - protein, 11 aa, Artificial Sequence
  Peptide Derived from Human Papillomavirus
NAGTDSRWPYL

SEQ ID NO: 22548 - protein, 8 aa, Artificial Sequence
  Peptide Derived from Human Papillomavirus
NALDGNEI

SEQ ID NO: 22549 - protein, 10 aa, Artificial Sequence
  Peptide Derived from Human Papillomavirus
NALDGNEISI

SEQ ID NO: 22550 - protein, 10 aa, Artificial Sequence
  Peptide Derived from Human Papillomavirus
NAVCALKRKF

SEQ ID NO: 22551 - protein, 11 aa, Artificial Sequence
  Peptide Derived from Human Papillomavirus
NAVCALKRKFA

SEQ ID NO: 22552 - protein, 9 aa, Artificial Sequence
  Peptide Derived from Human Papillomavirus
NSIQADTEA

SEQ ID NO: 22553 - protein, 10 aa, Artificial Sequence
  Peptide Derived from Human Papillomavirus
NSIQADTEAA

SEQ ID NO: 22554 - protein, 8 aa, Artificial Sequence
  Peptide Derived from Human Papillomavirus
NSKSHFWL

SEQ ID NO: 22555 - protein, 11 aa, Artificial Sequence
  Peptide Derived from Human Papillomavirus
NSKSHFWLQPL

SEQ ID NO: 22556 - protein, 8 aa, Artificial Sequence
  Peptide Derived from Human Papillomavirus
NSNAAAFL

SEQ ID NO: 22557 - protein, 9 aa, Artificial Sequence
  Peptide Derived from Human Papillomavirus
NTEVETQQM

SEQ ID NO: 22558 - protein, 10 aa, Artificial Sequence
  Peptide Derived from Human Papillomavirus
NTEVETQQMV

SEQ ID NO: 22559 - protein, 9 aa, Artificial Sequence
  Peptide Derived from Human Papillomavirus
NTGKSYFGM

SEQ ID NO: 22560 - protein, 11 aa, Artificial Sequence
  Peptide Derived from Human Papillomavirus
NTGKSYFGMSL

SEQ ID NO: 22561 - protein, 8 aa, Artificial Sequence
  Peptide Derived from Human Papillomavirus
NTKANILY

SEQ ID NO: 22562 - protein, 10 aa, Artificial Sequence
  Peptide Derived from Human Papillomavirus
NTKANILYKF

SEQ ID NO: 22563 - protein, 10 aa, Artificial Sequence
  Peptide Derived from Human Papillomavirus
NTNAGTDSRW

SEQ ID NO: 22564 - protein, 8 aa, Artificial Sequence
  Peptide Derived from Human Papillomavirus
PANTGKSY

SEQ ID NO: 22565 - protein, 9 aa, Artificial Sequence
  Peptide Derived from Human Papillomavirus
PANTGKSYF

SEQ ID NO: 22566 - protein, 11 aa, Artificial Sequence
  Peptide Derived from Human Papillomavirus
PANTGKSYFGM

SEQ ID NO: 22567 - protein, 9 aa, Artificial Sequence
  Peptide Derived from Human Papillomavirus
PSVAESLKV

SEQ ID NO: 22568 - protein, 10 aa, Artificial Sequence
  Peptide Derived from Human Papillomavirus
PSVAESLKVL

SEQ ID NO: 22569 - protein, 11 aa, Artificial Sequence
  Peptide Derived from Human Papillomavirus
PSVAESLKVLI

SEQ ID NO: 22570 - protein, 9 aa, Artificial Sequence
  Peptide Derived from Human Papillomavirus
QADTEAARA

SEQ ID NO: 22571 - protein, 10 aa, Artificial Sequence
  Peptide Derived from Human Papillomavirus
QADTEAARAL

SEQ ID NO: 22572 - protein, 11 aa, Artificial Sequence
  Peptide Derived from Human Papillomavirus
QADTEAARALF

SEQ ID NO: 22573 - protein, 10 aa, Artificial Sequence
  Peptide Derived from Human Papillomavirus
QAKIVKDCGI

SEQ ID NO: 22574 - protein, 11 aa, Artificial Sequence
  Peptide Derived from Human Papillomavirus
QAKIVKDCGIM

SEQ ID NO: 22575 - protein, 8 aa, Artificial Sequence
  Peptide Derived from Human Papillomavirus
QSAAEDVV

SEQ ID NO: 22576 - protein, 11 aa, Artificial Sequence
  Peptide Derived from Human Papillomavirus
QSAAEDVVDRA

SEQ ID NO: 22577 - protein, 8 aa, Artificial Sequence
  Peptide Derived from Human Papillomavirus
QTCALYWF

SEQ ID NO: 22578 - protein, 11 aa, Artificial Sequence
  Peptide Derived from Human Papillomavirus
QTCALYWFRTA

SEQ ID NO: 22579 - protein, 10 aa, Artificial Sequence
  Peptide Derived from Human Papillomavirus
RAANPCRTSI

SEQ ID NO: 22580 - protein, 11 aa, Artificial Sequence
  Peptide Derived from Human Papillomavirus
RALVQLKCPPL

SEQ ID NO: 22581 - protein, 8 aa, Artificial Sequence
  Peptide Derived from Human Papillomavirus
RSQTCALY

SEQ ID NO: 22582 - protein, 9 aa, Artificial Sequence
  Peptide Derived from Human Papillomavirus
RSQTCALYW

SEQ ID NO: 22583 - protein, 10 aa, Artificial Sequence
  Peptide Derived from Human Papillomavirus
RSQTCALYWF

SEQ ID NO: 22584 - protein, 10 aa, Artificial Sequence
  Peptide Derived from Human Papillomavirus
RTAMSNISDV

SEQ ID NO: 22585 - protein, 8 aa, Artificial Sequence
  Peptide Derived from Human Papillomavirus
RTWCKLDL

SEQ ID NO: 22586 - protein, 9 aa, Artificial Sequence
  Peptide Derived from Human Papillomavirus
RTWCKLDLI

SEQ ID NO: 22587 - protein, 10 aa, Artificial Sequence
  Peptide Derived from Human Papillomavirus
SAAEDVVDRA

SEQ ID NO: 22588 - protein, 11 aa, Artificial Sequence
  Peptide Derived from Human Papillomavirus
SAAEDVVDRAA

SEQ ID NO: 22589 - protein, 9 aa, Artificial Sequence
  Peptide Derived from Human Papillomavirus
SAGENTRSL

SEQ ID NO: 22590 - protein, 10 aa, Artificial Sequence
  Peptide Derived from Human Papillomavirus
SSGVGDDSEV

SEQ ID NO: 22591 - protein, 8 aa, Artificial Sequence
  Peptide Derived from Human Papillomavirus
SSNTKANI

SEQ ID NO: 22592 - protein, 9 aa, Artificial Sequence
  Peptide Derived from Human Papillomavirus
SSNTKANIL

SEQ ID NO: 22593 - protein, 10 aa, Artificial Sequence
  Peptide Derived from Human Papillomavirus
SSNTKANILY

SEQ ID NO: 22594 - protein, 9 aa, Artificial Sequence
  Peptide Derived from Human Papillomavirus
TADDSGTDL

SEQ ID NO: 22595 - protein, 10 aa, Artificial Sequence
  Peptide Derived from Human Papillomavirus
TADDSGTDLL

SEQ ID NO: 22596 - protein, 10 aa, Artificial Sequence
  Peptide Derived from Human Papillomavirus
TAFLGAFKKF

SEQ ID NO: 22597 - protein, 11 aa, Artificial Sequence
  Peptide Derived from Human Papillomavirus
TAFLGAFKKFL

SEQ ID NO: 22598 - protein, 9 aa, Artificial Sequence
  Peptide Derived from Human Papillomavirus
TAMSNISDV

SEQ ID NO: 22599 - protein, 8 aa, Artificial Sequence
  Peptide Derived from Human Papillomavirus
TSCTDWCI

SEQ ID NO: 22600 - protein, 11 aa, Artificial Sequence
  Peptide Derived from Human Papillomavirus
TSCTDWCITGY

SEQ ID NO: 22601 - protein, 11 aa, Artificial Sequence
  Peptide Derived from Human Papillomavirus
TSINKNKECTY

SEQ ID NO: 22602 - protein, 9 aa, Artificial Sequence
  Peptide Derived from Human Papillomavirus
TTPEWIDRL

SEQ ID NO: 22603 - protein, 11 aa, Artificial Sequence
  Peptide Derived from Human Papillomavirus
TTPEWIDRLTV

SEQ ID NO: 22604 - protein, 8 aa, Artificial Sequence
  Peptide Derived from Human Papillomavirus
VAESLKVL

SEQ ID NO: 22605 - protein, 9 aa, Artificial Sequence
  Peptide Derived from Human Papillomavirus
VAESLKVLI

SEQ ID NO: 22606 - protein, 8 aa, Artificial Sequence
  Peptide Derived from Human Papillomavirus
VAKLMSNL

SEQ ID NO: 22607 - protein, 9 aa, Artificial Sequence
  Peptide Derived from Human Papillomavirus
VAKLMSNLL

SEQ ID NO: 22608 - protein, 11 aa, Artificial Sequence
  Peptide Derived from Human Papillomavirus
VAKLMSNLLSI

SEQ ID NO: 22609 - protein, 9 aa, Artificial Sequence
  Peptide Derived from Human Papillomavirus
VTLQEISNV

SEQ ID NO: 22610 - protein, 10 aa, Artificial Sequence
  Peptide Derived from Human Papillomavirus
VTLQEISNVL

SEQ ID NO: 22611 - protein, 8 aa, Artificial Sequence
  Peptide Derived from Human Papillomavirus
VTPISWTY

SEQ ID NO: 22612 - protein, 9 aa, Artificial Sequence
  Peptide Derived from Human Papillomavirus
VTPISWTYI

SEQ ID NO: 22613 - protein, 8 aa, Artificial Sequence
  Peptide Derived from Human Papillomavirus
WTYIDDYM

SEQ ID NO: 22614 - protein, 11 aa, Artificial Sequence
  Peptide Derived from Human Papillomavirus
WTYIDDYMRNA

SEQ ID NO: 22615 - protein, 8 aa, Artificial Sequence
  Peptide Derived from Human Papillomavirus
YAINDENW

SEQ ID NO: 22616 - protein, 11 aa, Artificial Sequence
  Peptide Derived from Human Papillomavirus
YAINDENWKSF

SEQ ID NO: 22617 - protein, 11 aa, Artificial Sequence
  Peptide Derived from Human Papillomavirus
YAQLADSNSNA

SEQ ID NO: 22618 - protein, 9 aa, Artificial Sequence
  Peptide Derived from Human Papillomavirus
AAAKRRRPA

SEQ ID NO: 22619 - protein, 8 aa, Artificial Sequence
  Peptide Derived from Human Papillomavirus
AAKRRRPA

SEQ ID NO: 22620 - protein, 9 aa, Artificial Sequence
  Peptide Derived from Human Papillomavirus
AAKYSKTQM

SEQ ID NO: 22621 - protein, 10 aa, Artificial Sequence
  Peptide Derived from Human Papillomavirus
AAKYSKTQMW

SEQ ID NO: 22622 - protein, 9 aa, Artificial Sequence
  Peptide Derived from Human Papillomavirus
ASKTKAFQV

SEQ ID NO: 22623 - protein, 10 aa, Artificial Sequence
  Peptide Derived from Human Papillomavirus
ASKTKAFQVI

SEQ ID NO: 22624 - protein, 11 aa, Artificial Sequence
  Peptide Derived from Human Papillomavirus
ATNCTNKQRTV

SEQ ID NO: 22625 - protein, 11 aa, Artificial Sequence
  Peptide Derived from Human Papillomavirus
CADPALDNRTA

SEQ ID NO: 22626 - protein, 10 aa, Artificial Sequence
  Peptide Derived from Human Papillomavirus
CALLYTAKQM

SEQ ID NO: 22627 - protein, 8 aa, Artificial Sequence
  Peptide Derived from Human Papillomavirus
CSSNVAPI

SEQ ID NO: 22628 - protein, 9 aa, Artificial Sequence
  Peptide Derived from Human Papillomavirus
CSSNVAPIV

SEQ ID NO: 22629 - protein, 11 aa, Artificial Sequence
  Peptide Derived from Human Papillomavirus
CSSNVAPIVHL

SEQ ID NO: 22630 - protein, 8 aa, Artificial Sequence
  Peptide Derived from Human Papillomavirus
CTMVTGKV

SEQ ID NO: 22631 - protein, 10 aa, Artificial Sequence
  Peptide Derived from Human Papillomavirus
CTMVTGKVDY

SEQ ID NO: 22632 - protein, 11 aa, Artificial Sequence
  Peptide Derived from Human Papillomavirus
CTMVTGKVDYI

SEQ ID NO: 22633 - protein, 8 aa, Artificial Sequence
  Peptide Derived from Human Papillomavirus
CTNKQRTV

SEQ ID NO: 22634 - protein, 10 aa, Artificial Sequence
  Peptide Derived from Human Papillomavirus
DAAKYSKTQM

SEQ ID NO: 22635 - protein, 11 aa, Artificial Sequence
  Peptide Derived from Human Papillomavirus
DAAKYSKTQMW

SEQ ID NO: 22636 - protein, 9 aa, Artificial Sequence
  Peptide Derived from Human Papillomavirus
DTAQPLTKL

SEQ ID NO: 22637 - protein, 10 aa, Artificial Sequence
  Peptide Derived from Human Papillomavirus
DTAQPLTKLF

SEQ ID NO: 22638 - protein, 10 aa, Artificial Sequence
  Peptide Derived from Human Papillomavirus
DTCTMVTGKV

SEQ ID NO: 22639 - protein, 9 aa, Artificial Sequence
  Peptide Derived from Human Papillomavirus
DTTDTAQPL

SEQ ID NO: 22640 - protein, 11 aa, Artificial Sequence
  Peptide Derived from Human Papillomavirus
EADKTDLPSQI

SEQ ID NO: 22641 - protein, 8 aa, Artificial Sequence
  Peptide Derived from Human Papillomavirus
ESNSLKCL

SEQ ID NO: 22642 - protein, 10 aa, Artificial Sequence
  Peptide Derived from Human Papillomavirus
ESNSLKCLRY

SEQ ID NO: 22643 - protein, 8 aa, Artificial Sequence
  Peptide Derived from Human Papillomavirus
ETLSKSQY

SEQ ID NO: 22644 - protein, 8 aa, Artificial Sequence
  Peptide Derived from Human Papillomavirus
FSHLCHQV

SEQ ID NO: 22645 - protein, 9 aa, Artificial Sequence
  Peptide Derived from Human Papillomavirus
FSHLCHQVV

SEQ ID NO: 22646 - protein, 9 aa, Artificial Sequence
  Peptide Derived from Human Papillomavirus
GTVKIPPTV

SEQ ID NO: 22647 - protein, 11 aa, Artificial Sequence
  Peptide Derived from Human Papillomavirus
GTVKIPPTVQI

SEQ ID NO: 22648 - protein, 8 aa, Artificial Sequence
  Peptide Derived from Human Papillomavirus
ISARLNAV

SEQ ID NO: 22649 - protein, 8 aa, Artificial Sequence
  Peptide Derived from Human Papillomavirus
ISTGFMTL

SEQ ID NO: 22650 - protein, 9 aa, Artificial Sequence
  Peptide Derived from Human Papillomavirus
ISTTETADI

SEQ ID NO: 22651 - protein, 8 aa, Artificial Sequence
  Peptide Derived from Human Papillomavirus
KAFQVIEL

SEQ ID NO: 22652 - protein, 10 aa, Artificial Sequence
  Peptide Derived from Human Papillomavirus
KAFQVIELQM

SEQ ID NO: 22653 - protein, 11 aa, Artificial Sequence
  Peptide Derived from Human Papillomavirus
KAFQVIELQMA

SEQ ID NO: 22654 - protein, 9 aa, Artificial Sequence
  Peptide Derived from Human Papillomavirus
KSQYSTSQW

SEQ ID NO: 22655 - protein, 11 aa, Artificial Sequence
  Peptide Derived from Human Papillomavirus
KSQYSTSQWTL

SEQ ID NO: 22656 - protein, 8 aa, Artificial Sequence
  Peptide Derived from Human Papillomavirus
KTDLPSQI

SEQ ID NO: 22657 - protein, 11 aa, Artificial Sequence
  Peptide Derived from Human Papillomavirus
KTDLPSQIEHW

SEQ ID NO: 22658 - protein, 8 aa, Artificial Sequence
  Peptide Derived from Human Papillomavirus
KTKAFQVI

SEQ ID NO: 22659 - protein, 10 aa, Artificial Sequence
  Peptide Derived from Human Papillomavirus
KTKAFQVIEL

SEQ ID NO: 22660 - protein, 9 aa, Artificial Sequence
  Peptide Derived from Human Papillomavirus
KTQMWEVHV

SEQ ID NO: 22661 - protein, 8 aa, Artificial Sequence
  Peptide Derived from Human Papillomavirus
LASKTKAF

SEQ ID NO: 22662 - protein, 10 aa, Artificial Sequence
  Peptide Derived from Human Papillomavirus
LASKTKAFQV

SEQ ID NO: 22663 - protein, 11 aa, Artificial Sequence
  Peptide Derived from Human Papillomavirus
LASKTKAFQVI

SEQ ID NO: 22664 - protein, 11 aa, Artificial Sequence
  Peptide Derived from Human Papillomavirus
LSKSQYSTSQW

SEQ ID NO: 22665 - protein, 10 aa, Artificial Sequence
  Peptide Derived from Human Papillomavirus
LTKLFCADPA

SEQ ID NO: 22666 - protein, 11 aa, Artificial Sequence
  Peptide Derived from Human Papillomavirus
LTKLFCADPAL

SEQ ID NO: 22667 - protein, 11 aa, Artificial Sequence
  Peptide Derived from Human Papillomavirus
MALETLSKSQY

SEQ ID NO: 22668 - protein, 8 aa, Artificial Sequence
  Peptide Derived from Human Papillomavirus
NAVQEKIL

SEQ ID NO: 22669 - protein, 10 aa, Artificial Sequence
  Peptide Derived from Human Papillomavirus
NAVQEKILDL

SEQ ID NO: 22670 - protein, 11 aa, Artificial Sequence
  Peptide Derived from Human Papillomavirus
NAVQEKILDLY

SEQ ID NO: 22671 - protein, 9 aa, Artificial Sequence
  Peptide Derived from Human Papillomavirus
NSKNGIVTV

SEQ ID NO: 22672 - protein, 11 aa, Artificial Sequence
  Peptide Derived from Human Papillomavirus
NSKNGIVTVTF

SEQ ID NO: 22673 - protein, 8 aa, Artificial Sequence
  Peptide Derived from Human Papillomavirus
NSLKCLRY

SEQ ID NO: 22674 - protein, 10 aa, Artificial Sequence
  Peptide Derived from Human Papillomavirus
NSLKCLRYRL

SEQ ID NO: 22675 - protein, 8 aa, Artificial Sequence
  Peptide Derived from Human Papillomavirus
NTMDYTNW

SEQ ID NO: 22676 - protein, 11 aa, Artificial Sequence
  Peptide Derived from Human Papillomavirus
NTMDYTNWGEI

SEQ ID NO: 22677 - protein, 8 aa, Artificial Sequence
  Peptide Derived from Human Papillomavirus
PADTTDTA

SEQ ID NO: 22678 - protein, 11 aa, Artificial Sequence
  Peptide Derived from Human Papillomavirus
PADTTDTAQPL

SEQ ID NO: 22679 - protein, 8 aa, Artificial Sequence
  Peptide Derived from Human Papillomavirus
PALDNRTA

SEQ ID NO: 22680 - protein, 11 aa, Artificial Sequence
  Peptide Derived from Human Papillomavirus
PALDNRTARTA

SEQ ID NO: 22681 - protein, 10 aa, Artificial Sequence
  Peptide Derived from Human Papillomavirus
PSLLASKTKA

SEQ ID NO: 22682 - protein, 11 aa, Artificial Sequence
  Peptide Derived from Human Papillomavirus
PSLLASKTKAF

SEQ ID NO: 22683 - protein, 9 aa, Artificial Sequence
  Peptide Derived from Human Papillomavirus
PSQIEHWKL

SEQ ID NO: 22684 - protein, 10 aa, Artificial Sequence
  Peptide Derived from Human Papillomavirus
PSQIEHWKLI

SEQ ID NO: 22685 - protein, 9 aa, Artificial Sequence
  Peptide Derived from Human Papillomavirus
PTSISSNQI

SEQ ID NO: 22686 - protein, 9 aa, Artificial Sequence
  Peptide Derived from Human Papillomavirus
PTVQISTGF

SEQ ID NO: 22687 - protein, 10 aa, Artificial Sequence
  Peptide Derived from Human Papillomavirus
PTVQISTGFM

SEQ ID NO: 22688 - protein, 10 aa, Artificial Sequence
  Peptide Derived from Human Papillomavirus
QAAAKRRRPA

SEQ ID NO: 22689 - protein, 11 aa, Artificial Sequence
  Peptide Derived from Human Papillomavirus
QTDNDNRPPQA

SEQ ID NO: 22690 - protein, 8 aa, Artificial Sequence
  Peptide Derived from Human Papillomavirus
QTSLEVWL

SEQ ID NO: 22691 - protein, 8 aa, Artificial Sequence
  Peptide Derived from Human Papillomavirus
RTVCSSNV

SEQ ID NO: 22692 - protein, 9 aa, Artificial Sequence
  Peptide Derived from Human Papillomavirus
RTVCSSNVA

SEQ ID NO: 22693 - protein, 11 aa, Artificial Sequence
  Peptide Derived from Human Papillomavirus
RTVCSSNVAPI

SEQ ID NO: 22694 - protein, 11 aa, Artificial Sequence
  Peptide Derived from Human Papillomavirus
SARLNAVQEKI

SEQ ID NO: 22695 - protein, 9 aa, Artificial Sequence
  Peptide Derived from Human Papillomavirus
SSMSSTWHW

SEQ ID NO: 22696 - protein, 11 aa, Artificial Sequence
  Peptide Derived from Human Papillomavirus
SSNQISTTETA

SEQ ID NO: 22697 - protein, 8 aa, Artificial Sequence
  Peptide Derived from Human Papillomavirus
SSNVAPIV

SEQ ID NO: 22698 - protein, 10 aa, Artificial Sequence
  Peptide Derived from Human Papillomavirus
SSNVAPIVHL

SEQ ID NO: 22699 - protein, 8 aa, Artificial Sequence
  Peptide Derived from Human Papillomavirus
STTETADI

SEQ ID NO: 22700 - protein, 10 aa, Artificial Sequence
  Peptide Derived from Human Papillomavirus
TAKQMGFSHL

SEQ ID NO: 22701 - protein, 8 aa, Artificial Sequence
  Peptide Derived from Human Papillomavirus
TAQPLTKL

SEQ ID NO: 22702 - protein, 9 aa, Artificial Sequence
  Peptide Derived from Human Papillomavirus
TAQPLTKLF

SEQ ID NO: 22703 - protein, 11 aa, Artificial Sequence
  Peptide Derived from Human Papillomavirus
TAQPLTKLFCA

SEQ ID NO: 22704 - protein, 11 aa, Artificial Sequence
  Peptide Derived from Human Papillomavirus
TSDNKNSKNGI

SEQ ID NO: 22705 - protein, 8 aa, Artificial Sequence
  Peptide Derived from Human Papillomavirus
TSISSNQI

SEQ ID NO: 22706 - protein, 11 aa, Artificial Sequence
  Peptide Derived from Human Papillomavirus
TSQWTLQQTSL

SEQ ID NO: 22707 - protein, 8 aa, Artificial Sequence
  Peptide Derived from Human Papillomavirus
TTDTAQPL

SEQ ID NO: 22708 - protein, 11 aa, Artificial Sequence
  Peptide Derived from Human Papillomavirus
TTDTAQPLTKL

SEQ ID NO: 22709 - protein, 8 aa, Artificial Sequence
  Peptide Derived from Human Papillomavirus
VTEQQQQM

SEQ ID NO: 22710 - protein, 9 aa, Artificial Sequence
  Peptide Derived from Human Papillomavirus
VTEQQQQMF

SEQ ID NO: 22711 - protein, 10 aa, Artificial Sequence
  Peptide Derived from Human Papillomavirus
VTEQQQQMFL

SEQ ID NO: 22712 - protein, 11 aa, Artificial Sequence
  Peptide Derived from Human Papillomavirus
VTFVTEQQQQM

SEQ ID NO: 22713 - protein, 8 aa, Artificial Sequence
  Peptide Derived from Human Papillomavirus
VTGKVDYI

SEQ ID NO: 22714 - protein, 10 aa, Artificial Sequence
  Peptide Derived from Human Papillomavirus
VTGKVDYIGM

SEQ ID NO: 22715 - protein, 11 aa, Artificial Sequence
  Peptide Derived from Human Papillomavirus
VTGKVDYIGMY

SEQ ID NO: 22716 - protein, 8 aa, Artificial Sequence
  Peptide Derived from Human Papillomavirus
WTLQQTSL

SEQ ID NO: 22717 - protein, 10 aa, Artificial Sequence
  Peptide Derived from Human Papillomavirus
WTLQQTSLEV

SEQ ID NO: 22718 - protein, 11 aa, Artificial Sequence
  Peptide Derived from Human Papillomavirus
WTLQQTSLEVW

SEQ ID NO: 22719 - protein, 9 aa, Artificial Sequence
  Peptide Derived from Human Papillomavirus
YSKTQMWEV

SEQ ID NO: 22720 - protein, 11 aa, Artificial Sequence
  Peptide Derived from Human Papillomavirus
YSKTQMWEVHV

SEQ ID NO: 22721 - protein, 8 aa, Artificial Sequence
  Peptide Derived from Human Papillomavirus
YSSMSSTW

SEQ ID NO: 22722 - protein, 10 aa, Artificial Sequence
  Peptide Derived from Human Papillomavirus
YSSMSSTWHW

SEQ ID NO: 22723 - protein, 8 aa, Artificial Sequence
  Peptide Derived from Human Papillomavirus
YSTSQWTL

SEQ ID NO: 22724 - protein, 8 aa, Artificial Sequence
  Peptide Derived from Human Papillomavirus
YTAKQMGF

SEQ ID NO: 22725 - protein, 11 aa, Artificial Sequence
  Peptide Derived from Human Papillomavirus
YTAKQMGFSHL

SEQ ID NO: 22726 - protein, 8 aa, Artificial Sequence
  Peptide Derived from Human Papillomavirus
YTNWGEIY

SEQ ID NO: 22727 - protein, 9 aa, Artificial Sequence
  Peptide Derived from Human Papillomavirus
YTNWGEIYI

SEQ ID NO: 22728 - protein, 10 aa, Artificial Sequence
  Peptide Derived from Human Papillomavirus
YTNWGEIYII

SEQ ID NO: 22729 - protein, 8 aa, Artificial Sequence
  Peptide Derived from Human Papillomavirus
GSPLKIFF

SEQ ID NO: 22730 - protein, 10 aa, Artificial Sequence
  Peptide Derived from Human Papillomavirus
GSPLKIFFCY

SEQ ID NO: 22731 - protein, 11 aa, Artificial Sequence
  Peptide Derived from Human Papillomavirus
GSPLKIFFCYL

SEQ ID NO: 22732 - protein, 8 aa, Artificial Sequence
  Peptide Derived from Human Papillomavirus
ISTYAWLL

SEQ ID NO: 22733 - protein, 9 aa, Artificial Sequence
  Peptide Derived from Human Papillomavirus
ISTYAWLLV

SEQ ID NO: 22734 - protein, 10 aa, Artificial Sequence
  Peptide Derived from Human Papillomavirus
ISTYAWLLVL

SEQ ID NO: 22735 - protein, 11 aa, Artificial Sequence
  Peptide Derived from Human Papillomavirus
ISTYAWLLVLV

SEQ ID NO: 22736 - protein, 8 aa, Artificial Sequence
  Peptide Derived from Human Papillomavirus
LSISTYAW

SEQ ID NO: 22737 - protein, 9 aa, Artificial Sequence
  Peptide Derived from Human Papillomavirus
LSISTYAWL

SEQ ID NO: 22738 - protein, 10 aa, Artificial Sequence
  Peptide Derived from Human Papillomavirus
LSISTYAWLL

SEQ ID NO: 22739 - protein, 11 aa, Artificial Sequence
  Peptide Derived from Human Papillomavirus
LSISTYAWLLV

SEQ ID NO: 22740 - protein, 8 aa, Artificial Sequence
  Peptide Derived from Human Papillomavirus
LSLLLRPL

SEQ ID NO: 22741 - protein, 9 aa, Artificial Sequence
  Peptide Derived from Human Papillomavirus
LSLLLRPLI

SEQ ID NO: 22742 - protein, 10 aa, Artificial Sequence
  Peptide Derived from Human Papillomavirus
LSLLLRPLIL

SEQ ID NO: 22743 - protein, 8 aa, Artificial Sequence
  Peptide Derived from Human Papillomavirus
STYAWLLV

SEQ ID NO: 22744 - protein, 9 aa, Artificial Sequence
  Peptide Derived from Human Papillomavirus
STYAWLLVL

SEQ ID NO: 22745 - protein, 10 aa, Artificial Sequence
  Peptide Derived from Human Papillomavirus
STYAWLLVLV

SEQ ID NO: 22746 - protein, 11 aa, Artificial Sequence
  Peptide Derived from Human Papillomavirus
STYAWLLVLVL

SEQ ID NO: 22747 - protein, 8 aa, Artificial Sequence
  Peptide Derived from Human Papillomavirus
YAWLLVLV

SEQ ID NO: 22748 - protein, 9 aa, Artificial Sequence
  Peptide Derived from Human Papillomavirus
YAWLLVLVL

SEQ ID NO: 22749 - protein, 10 aa, Artificial Sequence
  Peptide Derived from Human Papillomavirus
YAWLLVLVLL

SEQ ID NO: 22750 - protein, 11 aa, Artificial Sequence
  Peptide Derived from Human Papillomavirus
YAWLLVLVLLL

SEQ ID NO: 22751 - protein, 9 aa, Artificial Sequence
  Peptide Derived from Human Papillomavirus
DTEEKPRTL

SEQ ID NO: 22752 - protein, 9 aa, Artificial Sequence
  Peptide Derived from Human Papillomavirus
ETTIHNIEL

SEQ ID NO: 22753 - protein, 8 aa, Artificial Sequence
  Peptide Derived from Human Papillomavirus
FADLTVVY

SEQ ID NO: 22754 - protein, 8 aa, Artificial Sequence
  Peptide Derived from Human Papillomavirus
FAFADLTV

SEQ ID NO: 22755 - protein, 9 aa, Artificial Sequence
  Peptide Derived from Human Papillomavirus
FAFADLTVV

SEQ ID NO: 22756 - protein, 10 aa, Artificial Sequence
  Peptide Derived from Human Papillomavirus
FAFADLTVVY

SEQ ID NO: 22757 - protein, 9 aa, Artificial Sequence
  Peptide Derived from Human Papillomavirus
ISEYRHYNY

SEQ ID NO: 22758 - protein, 11 aa, Artificial Sequence
  Peptide Derived from Human Papillomavirus
ISEYRHYNYSV

SEQ ID NO: 22759 - protein, 10 aa, Artificial Sequence
  Peptide Derived from Human Papillomavirus
ISGRWAGRCA

SEQ ID NO: 22760 - protein, 11 aa, Artificial Sequence
  Peptide Derived from Human Papillomavirus
ISGRWAGRCAA

SEQ ID NO: 22761 - protein, 10 aa, Artificial Sequence
  Peptide Derived from Human Papillomavirus
LSKISEYRHY

SEQ ID NO: 22762 - protein, 11 aa, Artificial Sequence
  Peptide Derived from Human Papillomavirus
LTVVYREGNPF

SEQ ID NO: 22763 - protein, 11 aa, Artificial Sequence
  Peptide Derived from Human Papillomavirus
NTLEQTVKKPL

SEQ ID NO: 22764 - protein, 10 aa, Artificial Sequence
  Peptide Derived from Human Papillomavirus
QALETTIHNI

SEQ ID NO: 22765 - protein, 10 aa, Artificial Sequence
  Peptide Derived from Human Papillomavirus
QTVKKPLNEI

SEQ ID NO: 22766 - protein, 11 aa, Artificial Sequence
  Peptide Derived from Human Papillomavirus
QTVKKPLNEIL

SEQ ID NO: 22767 - protein, 8 aa, Artificial Sequence
  Peptide Derived from Human Papillomavirus
RSEVYDFA

SEQ ID NO: 22768 - protein, 9 aa, Artificial Sequence
  Peptide Derived from Human Papillomavirus
RSEVYDFAF

SEQ ID NO: 22769 - protein, 10 aa, Artificial Sequence
  Peptide Derived from Human Papillomavirus
RSEVYDFAFA

SEQ ID NO: 22770 - protein, 8 aa, Artificial Sequence
  Peptide Derived from Human Papillomavirus
RSRRRETA

SEQ ID NO: 22771 - protein, 9 aa, Artificial Sequence
  Peptide Derived from Human Papillomavirus
RSRRRETAL

SEQ ID NO: 22772 - protein, 9 aa, Artificial Sequence
  Peptide Derived from Human Papillomavirus
RTLHDLCQA

SEQ ID NO: 22773 - protein, 10 aa, Artificial Sequence
  Peptide Derived from Human Papillomavirus
RTLHDLCQAL

SEQ ID NO: 22774 - protein, 8 aa, Artificial Sequence
  Peptide Derived from Human Papillomavirus
TTIHNIEL

SEQ ID NO: 22775 - protein, 11 aa, Artificial Sequence
  Peptide Derived from Human Papillomavirus
TTIHNIELQCV

SEQ ID NO: 22776 - protein, 9 aa, Artificial Sequence
  Peptide Derived from Human Papillomavirus
WAGRCAACW

SEQ ID NO: 22777 - protein, 8 aa, Artificial Sequence
  Peptide Derived from Human Papillomavirus
YSVYGNTL

SEQ ID NO: 22778 - protein, 10 aa, Artificial Sequence
  Peptide Derived from Human Papillomavirus
ASDLRTIQQL

SEQ ID NO: 22779 - protein, 11 aa, Artificial Sequence
  Peptide Derived from Human Papillomavirus
ASDLRTIQQLL

SEQ ID NO: 22780 - protein, 8 aa, Artificial Sequence
  Peptide Derived from Human Papillomavirus
ATADYYIV

SEQ ID NO: 22781 - protein, 9 aa, Artificial Sequence
  Peptide Derived from Human Papillomavirus
DSSDEDEGL

SEQ ID NO: 22782 - protein, 11 aa, Artificial Sequence
  Peptide Derived from Human Papillomavirus
GTVNIVCPTCA

SEQ ID NO: 22783 - protein, 9 aa, Artificial Sequence
  Peptide Derived from Human Papillomavirus
HTCNTTVRL

SEQ ID NO: 22784 - protein, 11 aa, Artificial Sequence
  Peptide Derived from Human Papillomavirus
HTCNTTVRLCV

SEQ ID NO: 22785 - protein, 11 aa, Artificial Sequence
  Peptide Derived from Human Papillomavirus
LSDSSDEDEGL

SEQ ID NO: 22786 - protein, 10 aa, Artificial Sequence
  Peptide Derived from Human Papillomavirus
NSTASDLRTI

SEQ ID NO: 22787 - protein, 8 aa, Artificial Sequence
  Peptide Derived from Human Papillomavirus
NTTVRLCV

SEQ ID NO: 22788 - protein, 8 aa, Artificial Sequence
  Peptide Derived from Human Papillomavirus
PATADYYI

SEQ ID NO: 22789 - protein, 9 aa, Artificial Sequence
  Peptide Derived from Human Papillomavirus
PATADYYIV

SEQ ID NO: 22790 - protein, 10 aa, Artificial Sequence
  Peptide Derived from Human Papillomavirus
PTDLYCYEQL

SEQ ID NO: 22791 - protein, 8 aa, Artificial Sequence
  Peptide Derived from Human Papillomavirus
PTLKEYVL

SEQ ID NO: 22792 - protein, 10 aa, Artificial Sequence
  Peptide Derived from Human Papillomavirus
PTLKEYVLDL

SEQ ID NO: 22793 - protein, 11 aa, Artificial Sequence
  Peptide Derived from Human Papillomavirus
PTLKEYVLDLY

SEQ ID NO: 22794 - protein, 9 aa, Artificial Sequence
  Peptide Derived from Human Papillomavirus
QAQPATADY

SEQ ID NO: 22795 - protein, 10 aa, Artificial Sequence
  Peptide Derived from Human Papillomavirus
QAQPATADYY

SEQ ID NO: 22796 - protein, 11 aa, Artificial Sequence
  Peptide Derived from Human Papillomavirus
QAQPATADYYI

SEQ ID NO: 22797 - protein, 8 aa, Artificial Sequence
  Peptide Derived from Human Papillomavirus
RTIQQLLM

SEQ ID NO: 22798 - protein, 11 aa, Artificial Sequence
  Peptide Derived from Human Papillomavirus
RTIQQLLMGTV

SEQ ID NO: 22799 - protein, 8 aa, Artificial Sequence
  Peptide Derived from Human Papillomavirus
SSDEDEGL

SEQ ID NO: 22800 - protein, 9 aa, Artificial Sequence
  Peptide Derived from Human Papillomavirus
STASDLRTI

SEQ ID NO: 22801 - protein, 8 aa, Artificial Sequence
  Peptide Derived from Human Papillomavirus
TASDLRTI

SEQ ID NO: 22802 - protein, 11 aa, Artificial Sequence
  Peptide Derived from Human Papillomavirus
TASDLRTIQQL

SEQ ID NO: 22803 - protein, 11 aa, Artificial Sequence
  Peptide Derived from Human Papillomavirus
TTVRLCVNSTA

SEQ ID NO: 22804 - protein, 11 aa, Artificial Sequence
  Peptide Derived from Human Papillomavirus
VTCCHTCNTTV

SEQ ID NO: 22805 - protein, 10 aa, Artificial Sequence
  Peptide Derived from Human Papillomavirus
AAPANDCPPL

SEQ ID NO: 22806 - protein, 11 aa, Artificial Sequence
  Peptide Derived from Human Papillomavirus
AAPTSTRTSSA

SEQ ID NO: 22807 - protein, 8 aa, Artificial Sequence
  Peptide Derived from Human Papillomavirus
ASIQSSAF

SEQ ID NO: 22808 - protein, 9 aa, Artificial Sequence
  Peptide Derived from Human Papillomavirus
ASIQSSAFF

SEQ ID NO: 22809 - protein, 9 aa, Artificial Sequence
  Peptide Derived from Human Papillomavirus
ASLQDTYRF

SEQ ID NO: 22810 - protein, 10 aa, Artificial Sequence
  Peptide Derived from Human Papillomavirus
ASLQDTYRFV

SEQ ID NO: 22811 - protein, 8 aa, Artificial Sequence
  Peptide Derived from Human Papillomavirus
ATVYLPPV

SEQ ID NO: 22812 - protein, 10 aa, Artificial Sequence
  Peptide Derived from Human Papillomavirus
ATVYLPPVPV

SEQ ID NO: 22813 - protein, 10 aa, Artificial Sequence
  Peptide Derived from Human Papillomavirus
CTQVTSDSTY

SEQ ID NO: 22814 - protein, 9 aa, Artificial Sequence
  Peptide Derived from Human Papillomavirus
DSTYKNENF

SEQ ID NO: 22815 - protein, 8 aa, Artificial Sequence
  Peptide Derived from Human Papillomavirus
DTETGNKY

SEQ ID NO: 22816 - protein, 9 aa, Artificial Sequence
  Peptide Derived from Human Papillomavirus
DTGFGCMDF

SEQ ID NO: 22817 - protein, 8 aa, Artificial Sequence
  Peptide Derived from Human Papillomavirus
DTQRLVWA

SEQ ID NO: 22818 - protein, 10 aa, Artificial Sequence
  Peptide Derived from Human Papillomavirus
DTQRLVWACV

SEQ ID NO: 22819 - protein, 8 aa, Artificial Sequence
  Peptide Derived from Human Papillomavirus
DTTRSTNM

SEQ ID NO: 22820 - protein, 10 aa, Artificial Sequence
  Peptide Derived from Human Papillomavirus
DTTRSTNMTL

SEQ ID NO: 22821 - protein, 10 aa, Artificial Sequence
  Peptide Derived from Human Papillomavirus
DTYRFVTSQA

SEQ ID NO: 22822 - protein, 11 aa, Artificial Sequence
  Peptide Derived from Human Papillomavirus
DTYRFVTSQAI

SEQ ID NO: 22823 - protein, 9 aa, Artificial Sequence
  Peptide Derived from Human Papillomavirus
EATVYLPPV

SEQ ID NO: 22824 - protein, 11 aa, Artificial Sequence
  Peptide Derived from Human Papillomavirus
EATVYLPPVPV

SEQ ID NO: 22825 - protein, 8 aa, Artificial Sequence
  Peptide Derived from Human Papillomavirus
EAVPDDLY

SEQ ID NO: 22826 - protein, 9 aa, Artificial Sequence
  Peptide Derived from Human Papillomavirus
EAVPDDLYI

SEQ ID NO: 22827 - protein, 9 aa, Artificial Sequence
  Peptide Derived from Human Papillomavirus
ESQLFNKPY

SEQ ID NO: 22828 - protein, 10 aa, Artificial Sequence
  Peptide Derived from Human Papillomavirus
ESQLFNKPYW

SEQ ID NO: 22829 - protein, 11 aa, Artificial Sequence
  Peptide Derived from Human Papillomavirus
ESQLFNKPYWL

SEQ ID NO: 22830 - protein, 8 aa, Artificial Sequence
  Peptide Derived from Human Papillomavirus
FSADLDQF

SEQ ID NO: 22831 - protein, 10 aa, Artificial Sequence
  Peptide Derived from Human Papillomavirus
FSADLDQFPL

SEQ ID NO: 22832 - protein, 9 aa, Artificial Sequence
  Peptide Derived from Human Papillomavirus
FSIKNPTNA

SEQ ID NO: 22833 - protein, 8 aa, Artificial Sequence
  Peptide Derived from Human Papillomavirus
GADNRECL

SEQ ID NO: 22834 - protein, 10 aa, Artificial Sequence
  Peptide Derived from Human Papillomavirus
GADNRECLSM

SEQ ID NO: 22835 - protein, 8 aa, Artificial Sequence
  Peptide Derived from Human Papillomavirus
GSGTTASI

SEQ ID NO: 22836 - protein, 10 aa, Artificial Sequence
  Peptide Derived from Human Papillomavirus
GSMVTSESQL

SEQ ID NO: 22837 - protein, 11 aa, Artificial Sequence
  Peptide Derived from Human Papillomavirus
GSMVTSESQLF

SEQ ID NO: 22838 - protein, 8 aa, Artificial Sequence
  Peptide Derived from Human Papillomavirus
GSSRLLAV

SEQ ID NO: 22839 - protein, 9 aa, Artificial Sequence
  Peptide Derived from Human Papillomavirus
GSTCKYPDY

SEQ ID NO: 22840 - protein, 10 aa, Artificial Sequence
  Peptide Derived from Human Papillomavirus
GSTCKYPDYL

SEQ ID NO: 22841 - protein, 11 aa, Artificial Sequence
  Peptide Derived from Human Papillomavirus
GTLGEAVPDDL

SEQ ID NO: 22842 - protein, 10 aa, Artificial Sequence
  Peptide Derived from Human Papillomavirus
GTTASIQSSA

SEQ ID NO: 22843 - protein, 11 aa, Artificial Sequence
  Peptide Derived from Human Papillomavirus
GTTASIQSSAF

SEQ ID NO: 22844 - protein, 8 aa, Artificial Sequence
  Peptide Derived from Human Papillomavirus
HAMNPDIL

SEQ ID NO: 22845 - protein, 11 aa, Artificial Sequence
  Peptide Derived from Human Papillomavirus
HAMNPDILEDW

SEQ ID NO: 22846 - protein, 10 aa, Artificial Sequence
  Peptide Derived from Human Papillomavirus
ISGHPLLNKF

SEQ ID NO: 22847 - protein, 9 aa, Artificial Sequence
  Peptide Derived from Human Papillomavirus
KAKPKLKRA

SEQ ID NO: 22848 - protein, 10 aa, Artificial Sequence
  Peptide Derived from Human Papillomavirus
KAKPKLKRAA

SEQ ID NO: 22849 - protein, 8 aa, Artificial Sequence
  Peptide Derived from Human Papillomavirus
KSDVPIDI

SEQ ID NO: 22850 - protein, 10 aa, Artificial Sequence
  Peptide Derived from Human Papillomavirus
KTLQANKSDV

SEQ ID NO: 22851 - protein, 8 aa, Artificial Sequence
  Peptide Derived from Human Papillomavirus
LAVGHPYF

SEQ ID NO: 22852 - protein, 10 aa, Artificial Sequence
  Peptide Derived from Human Papillomavirus
LAVGHPYFSI

SEQ ID NO: 22853 - protein, 10 aa, Artificial Sequence
  Peptide Derived from Human Papillomavirus
LSMDYKQTQL

SEQ ID NO: 22854 - protein, 8 aa, Artificial Sequence
  Peptide Derived from Human Papillomavirus
LTAEVMTY

SEQ ID NO: 22855 - protein, 9 aa, Artificial Sequence
  Peptide Derived from Human Papillomavirus
LTAEVMTYI

SEQ ID NO: 22856 - protein, 11 aa, Artificial Sequence
  Peptide Derived from Human Papillomavirus
LTAEVMTYIHA

SEQ ID NO: 22857 - protein, 9 aa, Artificial Sequence
  Peptide Derived from Human Papillomavirus
LTPPPSASL

SEQ ID NO: 22858 - protein, 9 aa, Artificial Sequence
  Peptide Derived from Human Papillomavirus
MSVWRPSEA

SEQ ID NO: 22859 - protein, 11 aa, Artificial Sequence
  Peptide Derived from Human Papillomavirus
MSVWRPSEATV

SEQ ID NO: 22860 - protein, 10 aa, Artificial Sequence
  Peptide Derived from Human Papillomavirus
MTSEPYGDSL

SEQ ID NO: 22861 - protein, 11 aa, Artificial Sequence
  Peptide Derived from Human Papillomavirus
MTSEPYGDSLF

SEQ ID NO: 22862 - protein, 11 aa, Artificial Sequence
  Peptide Derived from Human Papillomavirus
MTYIHAMNPDI

SEQ ID NO: 22863 - protein, 11 aa, Artificial Sequence
  Peptide Derived from Human Papillomavirus
NAAPANDCPPL

SEQ ID NO: 22864 - protein, 10 aa, Artificial Sequence
  Peptide Derived from Human Papillomavirus
NAKKLLVPKV

SEQ ID NO: 22865 - protein, 9 aa, Artificial Sequence
  Peptide Derived from Human Papillomavirus
NTIIEDGDM

SEQ ID NO: 22866 - protein, 10 aa, Artificial Sequence
  Peptide Derived from Human Papillomavirus
NTIIEDGDMV

SEQ ID NO: 22867 - protein, 8 aa, Artificial Sequence
  Peptide Derived from Human Papillomavirus
PANDCPPL

SEQ ID NO: 22868 - protein, 10 aa, Artificial Sequence
  Peptide Derived from Human Papillomavirus
PANDCPPLEL

SEQ ID NO: 22869 - protein, 11 aa, Artificial Sequence
  Peptide Derived from Human Papillomavirus
PANDCPPLELI

SEQ ID NO: 22870 - protein, 9 aa, Artificial Sequence
  Peptide Derived from Human Papillomavirus
PSASLQDTY

SEQ ID NO: 22871 - protein, 11 aa, Artificial Sequence
  Peptide Derived from Human Papillomavirus
PSASLQDTYRF

SEQ ID NO: 22872 - protein, 8 aa, Artificial Sequence
  Peptide Derived from Human Papillomavirus
PSEATVYL

SEQ ID NO: 22873 - protein, 11 aa, Artificial Sequence
  Peptide Derived from Human Papillomavirus
PSEATVYLPPV

SEQ ID NO: 22874 - protein, 10 aa, Artificial Sequence
  Peptide Derived from Human Papillomavirus
PTGEHWGKGV

SEQ ID NO: 22875 - protein, 11 aa, Artificial Sequence
  Peptide Derived from Human Papillomavirus
PTGEHWGKGVA

SEQ ID NO: 22876 - protein, 8 aa, Artificial Sequence
  Peptide Derived from Human Papillomavirus
PTNAKKLL

SEQ ID NO: 22877 - protein, 9 aa, Artificial Sequence
  Peptide Derived from Human Papillomavirus
PTNAKKLLV

SEQ ID NO: 22878 - protein, 8 aa, Artificial Sequence
  Peptide Derived from Human Papillomavirus
PTPSGSMV

SEQ ID NO: 22879 - protein, 9 aa, Artificial Sequence
  Peptide Derived from Human Papillomavirus
PTSTRTSSA

SEQ ID NO: 22880 - protein, 10 aa, Artificial Sequence
  Peptide Derived from Human Papillomavirus
QAGLKAKPKL

SEQ ID NO: 22881 - protein, 9 aa, Artificial Sequence
  Peptide Derived from Human Papillomavirus
QAITCQKTV

SEQ ID NO: 22882 - protein, 9 aa, Artificial Sequence
  Peptide Derived from Human Papillomavirus
QANKSDVPI

SEQ ID NO: 22883 - protein, 11 aa, Artificial Sequence
  Peptide Derived from Human Papillomavirus
QANKSDVPIDI

SEQ ID NO: 22884 - protein, 8 aa, Artificial Sequence
  Peptide Derived from Human Papillomavirus
RAGTLGEA

SEQ ID NO: 22885 - protein, 9 aa, Artificial Sequence
  Peptide Derived from Human Papillomavirus
RAGTLGEAV

SEQ ID NO: 22886 - protein, 9 aa, Artificial Sequence
  Peptide Derived from Human Papillomavirus
RAQGHNNGI

SEQ ID NO: 22887 - protein, 11 aa, Artificial Sequence
  Peptide Derived from Human Papillomavirus
RAQGHNNGICW

SEQ ID NO: 22888 - protein, 11 aa, Artificial Sequence
  Peptide Derived from Human Papillomavirus
RSTNMTLCTQV

SEQ ID NO: 22889 - protein, 8 aa, Artificial Sequence
  Peptide Derived from Human Papillomavirus
RTSIYYYA

SEQ ID NO: 22890 - protein, 10 aa, Artificial Sequence
  Peptide Derived from Human Papillomavirus
RTSSAKRKKV

SEQ ID NO: 22891 - protein, 9 aa, Artificial Sequence
  Peptide Derived from Human Papillomavirus
SADLDQFPL

SEQ ID NO: 22892 - protein, 11 aa, Artificial Sequence
  Peptide Derived from Human Papillomavirus
SAFFPTPSGSM

SEQ ID NO: 22893 - protein, 8 aa, Artificial Sequence
  Peptide Derived from Human Papillomavirus
SASLQDTY

SEQ ID NO: 22894 - protein, 10 aa, Artificial Sequence
  Peptide Derived from Human Papillomavirus
SASLQDTYRF

SEQ ID NO: 22895 - protein, 11 aa, Artificial Sequence
  Peptide Derived from Human Papillomavirus
SASLQDTYRFV

SEQ ID NO: 22896 - protein, 8 aa, Artificial Sequence
  Peptide Derived from Human Papillomavirus
SSAKRKKV

SEQ ID NO: 22897 - protein, 11 aa, Artificial Sequence
  Peptide Derived from Human Papillomavirus
SSRLLAVGHPY

SEQ ID NO: 22898 - protein, 8 aa, Artificial Sequence
  Peptide Derived from Human Papillomavirus
STCKYPDY

SEQ ID NO: 22899 - protein, 9 aa, Artificial Sequence
  Peptide Derived from Human Papillomavirus
STCKYPDYL

SEQ ID NO: 22900 - protein, 11 aa, Artificial Sequence
  Peptide Derived from Human Papillomavirus
STCKYPDYLKM

SEQ ID NO: 22901 - protein, 11 aa, Artificial Sequence
  Peptide Derived from Human Papillomavirus
STDEYVSRTSI

SEQ ID NO: 22902 - protein, 10 aa, Artificial Sequence
  Peptide Derived from Human Papillomavirus
STNMTLCTQV

SEQ ID NO: 22903 - protein, 8 aa, Artificial Sequence
  Peptide Derived from Human Papillomavirus
STYKNENF

SEQ ID NO: 22904 - protein, 11 aa, Artificial Sequence
  Peptide Derived from Human Papillomavirus
STYKNENFKEY

SEQ ID NO: 22905 - protein, 8 aa, Artificial Sequence
  Peptide Derived from Human Papillomavirus
TAEVMTYI

SEQ ID NO: 22906 - protein, 10 aa, Artificial Sequence
  Peptide Derived from Human Papillomavirus
TAEVMTYIHA

SEQ ID NO: 22907 - protein, 11 aa, Artificial Sequence
  Peptide Derived from Human Papillomavirus
TAEVMTYIHAM

SEQ ID NO: 22908 - protein, 8 aa, Artificial Sequence
  Peptide Derived from Human Papillomavirus
TASIQSSA

SEQ ID NO: 22909 - protein, 9 aa, Artificial Sequence
  Peptide Derived from Human Papillomavirus
TASIQSSAF

SEQ ID NO: 22910 - protein, 10 aa, Artificial Sequence
  Peptide Derived from Human Papillomavirus
TASIQSSAFF

SEQ ID NO: 22911 - protein, 11 aa, Artificial Sequence
  Peptide Derived from Human Papillomavirus
TSDSTYKNENF

SEQ ID NO: 22912 - protein, 9 aa, Artificial Sequence
  Peptide Derived from Human Papillomavirus
TSEPYGDSL

SEQ ID NO: 22913 - protein, 10 aa, Artificial Sequence
  Peptide Derived from Human Papillomavirus
TSEPYGDSLF

SEQ ID NO: 22914 - protein, 11 aa, Artificial Sequence
  Peptide Derived from Human Papillomavirus
TSEPYGDSLFF

SEQ ID NO: 22915 - protein, 11 aa, Artificial Sequence
  Peptide Derived from Human Papillomavirus
TSESQLFNKPY

SEQ ID NO: 22916 - protein, 11 aa, Artificial Sequence
  Peptide Derived from Human Papillomavirus
TSFYNPDTQRL

SEQ ID NO: 22917 - protein, 11 aa, Artificial Sequence
  Peptide Derived from Human Papillomavirus
TSQAITCQKTV

SEQ ID NO: 22918 - protein, 9 aa, Artificial Sequence
  Peptide Derived from Human Papillomavirus
TSSAKRKKV

SEQ ID NO: 22919 - protein, 8 aa, Artificial Sequence
  Peptide Derived from Human Papillomavirus
TSTRTSSA

SEQ ID NO: 22920 - protein, 9 aa, Artificial Sequence
  Peptide Derived from Human Papillomavirus
TTASIQSSA

SEQ ID NO: 22921 - protein, 10 aa, Artificial Sequence
  Peptide Derived from Human Papillomavirus
TTASIQSSAF

SEQ ID NO: 22922 - protein, 11 aa, Artificial Sequence
  Peptide Derived from Human Papillomavirus
TTASIQSSAFF

SEQ ID NO: 22923 - protein, 9 aa, Artificial Sequence
  Peptide Derived from Human Papillomavirus
TTRSTNMTL

SEQ ID NO: 22924 - protein, 9 aa, Artificial Sequence
  Peptide Derived from Human Papillomavirus
VACTNAAPA

SEQ ID NO: 22925 - protein, 8 aa, Artificial Sequence
  Peptide Derived from Human Papillomavirus
VSGLQYRV

SEQ ID NO: 22926 - protein, 9 aa, Artificial Sequence
  Peptide Derived from Human Papillomavirus
VSGLQYRVF

SEQ ID NO: 22927 - protein, 11 aa, Artificial Sequence
  Peptide Derived from Human Papillomavirus
VSGLQYRVFRV

SEQ ID NO: 22928 - protein, 10 aa, Artificial Sequence
  Peptide Derived from Human Papillomavirus
VSKVVSTDEY

SEQ ID NO: 22929 - protein, 11 aa, Artificial Sequence
  Peptide Derived from Human Papillomavirus
VSKVVSTDEYV

SEQ ID NO: 22930 - protein, 8 aa, Artificial Sequence
  Peptide Derived from Human Papillomavirus
VSRTSIYY

SEQ ID NO: 22931 - protein, 9 aa, Artificial Sequence
  Peptide Derived from Human Papillomavirus
VSRTSIYYY

SEQ ID NO: 22932 - protein, 10 aa, Artificial Sequence
  Peptide Derived from Human Papillomavirus
VSRTSIYYYA

SEQ ID NO: 22933 - protein, 8 aa, Artificial Sequence
  Peptide Derived from Human Papillomavirus
VTLTAEVM

SEQ ID NO: 22934 - protein, 10 aa, Artificial Sequence
  Peptide Derived from Human Papillomavirus
VTLTAEVMTY

SEQ ID NO: 22935 - protein, 11 aa, Artificial Sequence
  Peptide Derived from Human Papillomavirus
VTLTAEVMTYI

SEQ ID NO: 22936 - protein, 8 aa, Artificial Sequence
  Peptide Derived from Human Papillomavirus
VTSESQLF

SEQ ID NO: 22937 - protein, 8 aa, Artificial Sequence
  Peptide Derived from Human Papillomavirus
WACVGLEI

SEQ ID NO: 22938 - protein, 8 aa, Artificial Sequence
  Peptide Derived from Human Papillomavirus
YAGSSRLL

SEQ ID NO: 22939 - protein, 9 aa, Artificial Sequence
  Peptide Derived from Human Papillomavirus
YAGSSRLLA

SEQ ID NO: 22940 - protein, 10 aa, Artificial Sequence
  Peptide Derived from Human Papillomavirus
YAGSSRLLAV

SEQ ID NO: 22941 - protein, 8 aa, Artificial Sequence
  Peptide Derived from Human Papillomavirus
YTFWEVDL

SEQ ID NO: 22942 - protein, 8 aa, Artificial Sequence
  Peptide Derived from Human Papillomavirus
AAIPLQPI

SEQ ID NO: 22943 - protein, 9 aa, Artificial Sequence
  Peptide Derived from Human Papillomavirus
ATGTCPPDV

SEQ ID NO: 22944 - protein, 10 aa, Artificial Sequence
  Peptide Derived from Human Papillomavirus
ATGTCPPDVI

SEQ ID NO: 22945 - protein, 11 aa, Artificial Sequence
  Peptide Derived from Human Papillomavirus
ATLKTRSGKQI

SEQ ID NO: 22946 - protein, 10 aa, Artificial Sequence
  Peptide Derived from Human Papillomavirus
ATQLYQTCKA

SEQ ID NO: 22947 - protein, 8 aa, Artificial Sequence
  Peptide Derived from Human Papillomavirus
ATTRTSNV

SEQ ID NO: 22948 - protein, 10 aa, Artificial Sequence
  Peptide Derived from Human Papillomavirus
ATTRTSNVSI

SEQ ID NO: 22949 - protein, 8 aa, Artificial Sequence
  Peptide Derived from Human Papillomavirus
DSSIVSLI

SEQ ID NO: 22950 - protein, 11 aa, Artificial Sequence
  Peptide Derived from Human Papillomavirus
DSSNVTSSTPI

SEQ ID NO: 22951 - protein, 8 aa, Artificial Sequence
  Peptide Derived from Human Papillomavirus
DTIVVDGA

SEQ ID NO: 22952 - protein, 10 aa, Artificial Sequence
  Peptide Derived from Human Papillomavirus
DTIVVDGADF

SEQ ID NO: 22953 - protein, 11 aa, Artificial Sequence
  Peptide Derived from Human Papillomavirus
DTIVVDGADFV

SEQ ID NO: 22954 - protein, 10 aa, Artificial Sequence
  Peptide Derived from Human Papillomavirus
DTLQFQHSDI

SEQ ID NO: 22955 - protein, 10 aa, Artificial Sequence
  Peptide Derived from Human Papillomavirus
DTPVMSGPDI

SEQ ID NO: 22956 - protein, 9 aa, Artificial Sequence
  Peptide Derived from Human Papillomavirus
DTSTSSYSI

SEQ ID NO: 22957 - protein, 9 aa, Artificial Sequence
  Peptide Derived from Human Papillomavirus
DTTPAIINV

SEQ ID NO: 22958 - protein, 10 aa, Artificial Sequence
  Peptide Derived from Human Papillomavirus
DTVGPLDSSI

SEQ ID NO: 22959 - protein, 11 aa, Artificial Sequence
  Peptide Derived from Human Papillomavirus
DTVGPLDSSIV

SEQ ID NO: 22960 - protein, 9 aa, Artificial Sequence
  Peptide Derived from Human Papillomavirus
EAGAPAPSI

SEQ ID NO: 22961 - protein, 8 aa, Artificial Sequence
  Peptide Derived from Human Papillomavirus
EASGHFIF

SEQ ID NO: 22962 - protein, 9 aa, Artificial Sequence
  Peptide Derived from Human Papillomavirus
ESFDPEDTL

SEQ ID NO: 22963 - protein, 11 aa, Artificial Sequence
  Peptide Derived from Human Papillomavirus
ESFDPEDTLQF

SEQ ID NO: 22964 - protein, 11 aa, Artificial Sequence
  Peptide Derived from Human Papillomavirus
ESSIQTISTHL

SEQ ID NO: 22965 - protein, 9 aa, Artificial Sequence
  Peptide Derived from Human Papillomavirus
ETSFIEAGA

SEQ ID NO: 22966 - protein, 11 aa, Artificial Sequence
  Peptide Derived from Human Papillomavirus
ETSFIEAGAPA

SEQ ID NO: 22967 - protein, 9 aa, Artificial Sequence
  Peptide Derived from Human Papillomavirus
FATTRTSNV

SEQ ID NO: 22968 - protein, 11 aa, Artificial Sequence
  Peptide Derived from Human Papillomavirus
FATTRTSNVSI

SEQ ID NO: 22969 - protein, 8 aa, Artificial Sequence
  Peptide Derived from Human Papillomavirus
FSRVGQKA

SEQ ID NO: 22970 - protein, 10 aa, Artificial Sequence
  Peptide Derived from Human Papillomavirus
FSRVGQKATL

SEQ ID NO: 22971 - protein, 11 aa, Artificial Sequence
  Peptide Derived from Human Papillomavirus
FSSPTVSTQSY

SEQ ID NO: 22972 - protein, 8 aa, Artificial Sequence
  Peptide Derived from Human Papillomavirus
FTDVRVAA

SEQ ID NO: 22973 - protein, 11 aa, Artificial Sequence
  Peptide Derived from Human Papillomavirus
FTEPSVLHPPA

SEQ ID NO: 22974 - protein, 10 aa, Artificial Sequence
  Peptide Derived from Human Papillomavirus
GADFVLHPSY

SEQ ID NO: 22975 - protein, 11 aa, Artificial Sequence
  Peptide Derived from Human Papillomavirus
GADFVLHPSYF

SEQ ID NO: 22976 - protein, 10 aa, Artificial Sequence
  Peptide Derived from Human Papillomavirus
GARIHYYQDL

SEQ ID NO: 22977 - protein, 8 aa, Artificial Sequence
  Peptide Derived from Human Papillomavirus
GSGGRTGY

SEQ ID NO: 22978 - protein, 9 aa, Artificial Sequence
  Peptide Derived from Human Papillomavirus
GSGGRTGYV

SEQ ID NO: 22979 - protein, 11 aa, Artificial Sequence
  Peptide Derived from Human Papillomavirus
GSGGRTGYVPI

SEQ ID NO: 22980 - protein, 10 aa, Artificial Sequence
  Peptide Derived from Human Papillomavirus
GSGSGGRTGY

SEQ ID NO: 22981 - protein, 11 aa, Artificial Sequence
  Peptide Derived from Human Papillomavirus
GSGSGGRTGYV

SEQ ID NO: 22982 - protein, 10 aa, Artificial Sequence
  Peptide Derived from Human Papillomavirus
GSLGVFFGGL

SEQ ID NO: 22983 - protein, 8 aa, Artificial Sequence
  Peptide Derived from Human Papillomavirus
GSRPVARL

SEQ ID NO: 22984 - protein, 10 aa, Artificial Sequence
  Peptide Derived from Human Papillomavirus
GSRPVARLGL

SEQ ID NO: 22985 - protein, 11 aa, Artificial Sequence
  Peptide Derived from Human Papillomavirus
GSRPVARLGLY

SEQ ID NO: 22986 - protein, 8 aa, Artificial Sequence
  Peptide Derived from Human Papillomavirus
GSTIADQI

SEQ ID NO: 22987 - protein, 9 aa, Artificial Sequence
  Peptide Derived from Human Papillomavirus
GSTIADQIL

SEQ ID NO: 22988 - protein, 11 aa, Artificial Sequence
  Peptide Derived from Human Papillomavirus
GSTIADQILKY

SEQ ID NO: 22989 - protein, 8 aa, Artificial Sequence
  Peptide Derived from Human Papillomavirus
GTCPPDVI

SEQ ID NO: 22990 - protein, 11 aa, Artificial Sequence
  Peptide Derived from Human Papillomavirus
GTCPPDVIPKV

SEQ ID NO: 22991 - protein, 8 aa, Artificial Sequence
  Peptide Derived from Human Papillomavirus
GTDPPTAA

SEQ ID NO: 22992 - protein, 9 aa, Artificial Sequence
  Peptide Derived from Human Papillomavirus
GTDPPTAAI

SEQ ID NO: 22993 - protein, 11 aa, Artificial Sequence
  Peptide Derived from Human Papillomavirus
GTDPPTAAIPL

SEQ ID NO: 22994 - protein, 8 aa, Artificial Sequence
  Peptide Derived from Human Papillomavirus
HTPMQHSY

SEQ ID NO: 22995 - protein, 11 aa, Artificial Sequence
  Peptide Derived from Human Papillomavirus
HTPMQHSYSTF

SEQ ID NO: 22996 - protein, 8 aa, Artificial Sequence
  Peptide Derived from Human Papillomavirus
HTVPNEQY

SEQ ID NO: 22997 - protein, 10 aa, Artificial Sequence
  Peptide Derived from Human Papillomavirus
HTVPNEQYEL

SEQ ID NO: 22998 - protein, 8 aa, Artificial Sequence
  Peptide Derived from Human Papillomavirus
HTVRFSRV

SEQ ID NO: 22999 - protein, 8 aa, Artificial Sequence
  Peptide Derived from Human Papillomavirus
IADQILKY

SEQ ID NO: 23000 - protein, 11 aa, Artificial Sequence
  Peptide Derived from Human Papillomavirus
IADQILKYGSL

SEQ ID NO: 23001 - protein, 8 aa, Artificial Sequence
  Peptide Derived from Human Papillomavirus
IALHRPAI

SEQ ID NO: 23002 - protein, 9 aa, Artificial Sequence
  Peptide Derived from Human Papillomavirus
ISPAPDPDF

SEQ ID NO: 23003 - protein, 10 aa, Artificial Sequence
  Peptide Derived from Human Papillomavirus
ISPAPDPDFL

SEQ ID NO: 23004 - protein, 10 aa, Artificial Sequence
  Peptide Derived from Human Papillomavirus
ISPFFPFDTI

SEQ ID NO: 23005 - protein, 11 aa, Artificial Sequence
  Peptide Derived from Human Papillomavirus
ISPFFPFDTIV

SEQ ID NO: 23006 - protein, 9 aa, Artificial Sequence
  Peptide Derived from Human Papillomavirus
ISTHLNPTF

SEQ ID NO: 23007 - protein, 8 aa, Artificial Sequence
  Peptide Derived from Human Papillomavirus
ITSRRHTV

SEQ ID NO: 23008 - protein, 10 aa, Artificial Sequence
  Peptide Derived from Human Papillomavirus
ITSRRHTVRF

SEQ ID NO: 23009 - protein, 8 aa, Artificial Sequence
  Peptide Derived from Human Papillomavirus
ITYDNPAF

SEQ ID NO: 23010 - protein, 11 aa, Artificial Sequence
  Peptide Derived from Human Papillomavirus
ITYDNPAFESF

SEQ ID NO: 23011 - protein, 10 aa, Artificial Sequence
  Peptide Derived from Human Papillomavirus
KATGTCPPDV

SEQ ID NO: 23012 - protein, 11 aa, Artificial Sequence
  Peptide Derived from Human Papillomavirus
KATGTCPPDVI

SEQ ID NO: 23013 - protein, 8 aa, Artificial Sequence
  Peptide Derived from Human Papillomavirus
KTRSGKQI

SEQ ID NO: 23014 - protein, 10 aa, Artificial Sequence
  Peptide Derived from Human Papillomavirus
KTRSGKQIGA

SEQ ID NO: 23015 - protein, 11 aa, Artificial Sequence
  Peptide Derived from Human Papillomavirus
LSPIVPLDHTV

SEQ ID NO: 23016 - protein, 8 aa, Artificial Sequence
  Peptide Derived from Human Papillomavirus
LTSPHKLI

SEQ ID NO: 23017 - protein, 10 aa, Artificial Sequence
  Peptide Derived from Human Papillomavirus
LTSPHKLITY

SEQ ID NO: 23018 - protein, 10 aa, Artificial Sequence
  Peptide Derived from Human Papillomavirus
MSGPDIPSPL

SEQ ID NO: 23019 - protein, 11 aa, Artificial Sequence
  Peptide Derived from Human Papillomavirus
MSGPDIPSPLF

SEQ ID NO: 23020 - protein, 8 aa, Artificial Sequence
  Peptide Derived from Human Papillomavirus
NTGFDTPV

SEQ ID NO: 23021 - protein, 9 aa, Artificial Sequence
  Peptide Derived from Human Papillomavirus
NTGFDTPVM

SEQ ID NO: 23022 - protein, 8 aa, Artificial Sequence
  Peptide Derived from Human Papillomavirus
NTQQVKVV

SEQ ID NO: 23023 - protein, 11 aa, Artificial Sequence
  Peptide Derived from Human Papillomavirus
NTQQVKVVDPA

SEQ ID NO: 23024 - protein, 8 aa, Artificial Sequence
  Peptide Derived from Human Papillomavirus
PAEASGHF

SEQ ID NO: 23025 - protein, 9 aa, Artificial Sequence
  Peptide Derived from Human Papillomavirus
PAEASGHFI

SEQ ID NO: 23026 - protein, 10 aa, Artificial Sequence
  Peptide Derived from Human Papillomavirus
PAEASGHFIF

SEQ ID NO: 23027 - protein, 10 aa, Artificial Sequence
  Peptide Derived from Human Papillomavirus
PAFLTSPHKL

SEQ ID NO: 23028 - protein, 11 aa, Artificial Sequence
  Peptide Derived from Human Papillomavirus
PAFLTSPHKLI

SEQ ID NO: 23029 - protein, 9 aa, Artificial Sequence
  Peptide Derived from Human Papillomavirus
PAIINVSSV

SEQ ID NO: 23030 - protein, 10 aa, Artificial Sequence
  Peptide Derived from Human Papillomavirus
PAITSRRHTV

SEQ ID NO: 23031 - protein, 10 aa, Artificial Sequence
  Peptide Derived from Human Papillomavirus
PAPAEASGHF

SEQ ID NO: 23032 - protein, 11 aa, Artificial Sequence
  Peptide Derived from Human Papillomavirus
PAPAEASGHFI

SEQ ID NO: 23033 - protein, 8 aa, Artificial Sequence
  Peptide Derived from Human Papillomavirus
PAPDPDFL

SEQ ID NO: 23034 - protein, 10 aa, Artificial Sequence
  Peptide Derived from Human Papillomavirus
PAPDPDFLDI

SEQ ID NO: 23035 - protein, 11 aa, Artificial Sequence
  Peptide Derived from Human Papillomavirus
PAPDPDFLDII

SEQ ID NO: 23036 - protein, 11 aa, Artificial Sequence
  Peptide Derived from Human Papillomavirus
PAPSIPTPSGF

SEQ ID NO: 23037 - protein, 10 aa, Artificial Sequence
  Peptide Derived from Human Papillomavirus
PSGFDVTTSA

SEQ ID NO: 23038 - protein, 9 aa, Artificial Sequence
  Peptide Derived from Human Papillomavirus
PSIPTPSGF

SEQ ID NO: 23039 - protein, 11 aa, Artificial Sequence
  Peptide Derived from Human Papillomavirus
PSIPTPSGFDV

SEQ ID NO: 23040 - protein, 11 aa, Artificial Sequence
  Peptide Derived from Human Papillomavirus
PSPLFPTSSPF

SEQ ID NO: 23041 - protein, 8 aa, Artificial Sequence
  Peptide Derived from Human Papillomavirus
PSVLHPPA

SEQ ID NO: 23042 - protein, 10 aa, Artificial Sequence
  Peptide Derived from Human Papillomavirus
PSVLHPPAPA

SEQ ID NO: 23043 - protein, 10 aa, Artificial Sequence
  Peptide Derived from Human Papillomavirus
PTAAIPLQPI

SEQ ID NO: 23044 - protein, 8 aa, Artificial Sequence
  Peptide Derived from Human Papillomavirus
PTFTEPSV

SEQ ID NO: 23045 - protein, 9 aa, Artificial Sequence
  Peptide Derived from Human Papillomavirus
PTFTEPSVL

SEQ ID NO: 23046 - protein, 8 aa, Artificial Sequence
  Peptide Derived from Human Papillomavirus
PTPSGFDV

SEQ ID NO: 23047 - protein, 9 aa, Artificial Sequence
  Peptide Derived from Human Papillomavirus
PTSSPFVPI

SEQ ID NO: 23048 - protein, 8 aa, Artificial Sequence
  Peptide Derived from Human Papillomavirus
PTVSTQSY

SEQ ID NO: 23049 - protein, 11 aa, Artificial Sequence
  Peptide Derived from Human Papillomavirus
PTVSTQSYENI

SEQ ID NO: 23050 - protein, 8 aa, Artificial Sequence
  Peptide Derived from Human Papillomavirus
QSYENIPM

SEQ ID NO: 23051 - protein, 11 aa, Artificial Sequence
  Peptide Derived from Human Papillomavirus
QSYENIPMDTF

SEQ ID NO: 23052 - protein, 11 aa, Artificial Sequence
  Peptide Derived from Human Papillomavirus
QTISTHLNPTF

SEQ ID NO: 23053 - protein, 8 aa, Artificial Sequence
  Peptide Derived from Human Papillomavirus
RASATQLY

SEQ ID NO: 23054 - protein, 8 aa, Artificial Sequence
  Peptide Derived from Human Papillomavirus
RSGKQIGA

SEQ ID NO: 23055 - protein, 10 aa, Artificial Sequence
  Peptide Derived from Human Papillomavirus
RSGKQIGARI

SEQ ID NO: 23056 - protein, 8 aa, Artificial Sequence
  Peptide Derived from Human Papillomavirus
RSTRRKRA

SEQ ID NO: 23057 - protein, 10 aa, Artificial Sequence
  Peptide Derived from Human Papillomavirus
RSTRRKRASA

SEQ ID NO: 23058 - protein, 9 aa, Artificial Sequence
  Peptide Derived from Human Papillomavirus
RTSNVSIPL

SEQ ID NO: 23059 - protein, 8 aa, Artificial Sequence
  Peptide Derived from Human Papillomavirus
SADTTPAI

SEQ ID NO: 23060 - protein, 9 aa, Artificial Sequence
  Peptide Derived from Human Papillomavirus
SADTTPAII

SEQ ID NO: 23061 - protein, 11 aa, Artificial Sequence
  Peptide Derived from Human Papillomavirus
SADTTPAIINV

SEQ ID NO: 23062 - protein, 11 aa, Artificial Sequence
  Peptide Derived from Human Papillomavirus
SATQLYQTCKA

SEQ ID NO: 23063 - protein, 10 aa, Artificial Sequence
  Peptide Derived from Human Papillomavirus
SSIQTISTHL

SEQ ID NO: 23064 - protein, 10 aa, Artificial Sequence
  Peptide Derived from Human Papillomavirus
SSNVTSSTPI

SEQ ID NO: 23065 - protein, 10 aa, Artificial Sequence
  Peptide Derived from Human Papillomavirus
SSPFVPISPF

SEQ ID NO: 23066 - protein, 11 aa, Artificial Sequence
  Peptide Derived from Human Papillomavirus
SSPFVPISPFF

SEQ ID NO: 23067 - protein, 10 aa, Artificial Sequence
  Peptide Derived from Human Papillomavirus
SSPTVSTQSY

SEQ ID NO: 23068 - protein, 11 aa, Artificial Sequence
  Peptide Derived from Human Papillomavirus
SSTPIPGSRPV

SEQ ID NO: 23069 - protein, 8 aa, Artificial Sequence
  Peptide Derived from Human Papillomavirus
SSVGESSI

SEQ ID NO: 23070 - protein, 11 aa, Artificial Sequence
  Peptide Derived from Human Papillomavirus
SSVGESSIQTI

SEQ ID NO: 23071 - protein, 9 aa, Artificial Sequence
  Peptide Derived from Human Papillomavirus
SSYSINDGL

SEQ ID NO: 23072 - protein, 10 aa, Artificial Sequence
  Peptide Derived from Human Papillomavirus
SSYSINDGLY

SEQ ID NO: 23073 - protein, 11 aa, Artificial Sequence
  Peptide Derived from Human Papillomavirus
STFATTRTSNV

SEQ ID NO: 23074 - protein, 8 aa, Artificial Sequence
  Peptide Derived from Human Papillomavirus
STHLNPTF

SEQ ID NO: 23075 - protein, 8 aa, Artificial Sequence
  Peptide Derived from Human Papillomavirus
STIADQIL

SEQ ID NO: 23076 - protein, 10 aa, Artificial Sequence
  Peptide Derived from Human Papillomavirus
STIADQILKY

SEQ ID NO: 23077 - protein, 10 aa, Artificial Sequence
  Peptide Derived from Human Papillomavirus
STPIPGSRPV

SEQ ID NO: 23078 - protein, 11 aa, Artificial Sequence
  Peptide Derived from Human Papillomavirus
STPIPGSRPVA

SEQ ID NO: 23079 - protein, 8 aa, Artificial Sequence
  Peptide Derived from Human Papillomavirus
STQSYENI

SEQ ID NO: 23080 - protein, 10 aa, Artificial Sequence
  Peptide Derived from Human Papillomavirus
STQSYENIPM

SEQ ID NO: 23081 - protein, 9 aa, Artificial Sequence
  Peptide Derived from Human Papillomavirus
STRRKRASA

SEQ ID NO: 23082 - protein, 11 aa, Artificial Sequence
  Peptide Derived from Human Papillomavirus
STSSYSINDGL

SEQ ID NO: 23083 - protein, 9 aa, Artificial Sequence
  Peptide Derived from Human Papillomavirus
TAAIPLQPI

SEQ ID NO: 23084 - protein, 8 aa, Artificial Sequence
  Peptide Derived from Human Papillomavirus
TSADTTPA

SEQ ID NO: 23085 - protein, 9 aa, Artificial Sequence
  Peptide Derived from Human Papillomavirus
TSADTTPAI

SEQ ID NO: 23086 - protein, 10 aa, Artificial Sequence
  Peptide Derived from Human Papillomavirus
TSADTTPAII

SEQ ID NO: 23087 - protein, 8 aa, Artificial Sequence
  Peptide Derived from Human Papillomavirus
TSFIEAGA

SEQ ID NO: 23088 - protein, 10 aa, Artificial Sequence
  Peptide Derived from Human Papillomavirus
TSFIEAGAPA

SEQ ID NO: 23089 - protein, 8 aa, Artificial Sequence
  Peptide Derived from Human Papillomavirus
TSNVSIPL

SEQ ID NO: 23090 - protein, 9 aa, Artificial Sequence
  Peptide Derived from Human Papillomavirus
TSPHKLITY

SEQ ID NO: 23091 - protein, 9 aa, Artificial Sequence
  Peptide Derived from Human Papillomavirus
TSRRHTVRF

SEQ ID NO: 23092 - protein, 8 aa, Artificial Sequence
  Peptide Derived from Human Papillomavirus
TSSPFVPI

SEQ ID NO: 23093 - protein, 11 aa, Artificial Sequence
  Peptide Derived from Human Papillomavirus
TSSPFVPISPF

SEQ ID NO: 23094 - protein, 10 aa, Artificial Sequence
  Peptide Derived from Human Papillomavirus
TSSYSINDGL

SEQ ID NO: 23095 - protein, 11 aa, Artificial Sequence
  Peptide Derived from Human Papillomavirus
TSSYSINDGLY

SEQ ID NO: 23096 - protein, 8 aa, Artificial Sequence
  Peptide Derived from Human Papillomavirus
TSTSSYSI

SEQ ID NO: 23097 - protein, 8 aa, Artificial Sequence
  Peptide Derived from Human Papillomavirus
TTPAIINV

SEQ ID NO: 23098 - protein, 11 aa, Artificial Sequence
  Peptide Derived from Human Papillomavirus
TTPAIINVSSV

SEQ ID NO: 23099 - protein, 9 aa, Artificial Sequence
  Peptide Derived from Human Papillomavirus
TTRTSNVSI

SEQ ID NO: 23100 - protein, 11 aa, Artificial Sequence
  Peptide Derived from Human Papillomavirus
TTRTSNVSIPL

SEQ ID NO: 23101 - protein, 9 aa, Artificial Sequence
  Peptide Derived from Human Papillomavirus
TTSADTTPA

SEQ ID NO: 23102 - protein, 10 aa, Artificial Sequence
  Peptide Derived from Human Papillomavirus
TTSADTTPAI

SEQ ID NO: 23103 - protein, 11 aa, Artificial Sequence
  Peptide Derived from Human Papillomavirus
TTSADTTPAII

SEQ ID NO: 23104 - protein, 9 aa, Artificial Sequence
  Peptide Derived from Human Papillomavirus
VSIPLNTGF

SEQ ID NO: 23105 - protein, 9 aa, Artificial Sequence
  Peptide Derived from Human Papillomavirus
VSLIEETSF

SEQ ID NO: 23106 - protein, 10 aa, Artificial Sequence
  Peptide Derived from Human Papillomavirus
VSLIEETSFI

SEQ ID NO: 23107 - protein, 9 aa, Artificial Sequence
  Peptide Derived from Human Papillomavirus
VSSVGESSI

SEQ ID NO: 23108 - protein, 8 aa, Artificial Sequence
  Peptide Derived from Human Papillomavirus
VSTDSSNV

SEQ ID NO: 23109 - protein, 9 aa, Artificial Sequence
  Peptide Derived from Human Papillomavirus
VSTQSYENI

SEQ ID NO: 23110 - protein, 11 aa, Artificial Sequence
  Peptide Derived from Human Papillomavirus
VSTQSYENIPM

SEQ ID NO: 23111 - protein, 10 aa, Artificial Sequence
  Peptide Derived from Human Papillomavirus
VTTSADTTPA

SEQ ID NO: 23112 - protein, 11 aa, Artificial Sequence
  Peptide Derived from Human Papillomavirus
VTTSADTTPAI

SEQ ID NO: 23113 - protein, 9 aa, Artificial Sequence
  Peptide Derived from Human Papillomavirus
VTVDTVGPL

SEQ ID NO: 23114 - protein, 8 aa, Artificial Sequence
  Peptide Derived from Human Papillomavirus
YADDVDNV

SEQ ID NO: 23115 - protein, 8 aa, Artificial Sequence
  Peptide Derived from Human Papillomavirus
YSINDGLY

SEQ ID NO: 23116 - protein, 10 aa, Artificial Sequence
  Peptide Derived from Human Papillomavirus
YSINDGLYDV

SEQ ID NO: 23117 - protein, 11 aa, Artificial Sequence
  Peptide Derived from Human Papillomavirus
YSINDGLYDVY

SEQ ID NO: 23118 - protein, 8 aa, Artificial Sequence
  Peptide Derived from Human Papillomavirus
YSRNTQQV

SEQ ID NO: 23119 - protein, 10 aa, Artificial Sequence
  Peptide Derived from Human Papillomavirus
YSRNTQQVKV

SEQ ID NO: 23120 - protein, 11 aa, Artificial Sequence
  Peptide Derived from Human Papillomavirus
YSRNTQQVKVV

SEQ ID NO: 23121 - protein, 11 aa, Artificial Sequence
  Peptide Derived from Human Papillomavirus
AAAFLKSNCQA

SEQ ID NO: 23122 - protein, 8 aa, Artificial Sequence
  Peptide Derived from Human Papillomavirus
AAETQVTV

SEQ ID NO: 23123 - protein, 10 aa, Artificial Sequence
  Peptide Derived from Human Papillomavirus
AAFLKSNCQA

SEQ ID NO: 23124 - protein, 10 aa, Artificial Sequence
  Peptide Derived from Human Papillomavirus
AALYWYRTGI

SEQ ID NO: 23125 - protein, 10 aa, Artificial Sequence
  Peptide Derived from Human Papillomavirus
AAMLAVFKDI

SEQ ID NO: 23126 - protein, 11 aa, Artificial Sequence
  Peptide Derived from Human Papillomavirus
AAMLAVFKDIY

SEQ ID NO: 23127 - protein, 8 aa, Artificial Sequence
  Peptide Derived from Human Papillomavirus
ASNKKAAM

SEQ ID NO: 23128 - protein, 9 aa, Artificial Sequence
  Peptide Derived from Human Papillomavirus
ASNKKAAML

SEQ ID NO: 23129 - protein, 10 aa, Artificial Sequence
  Peptide Derived from Human Papillomavirus
ASNKKAAMLA

SEQ ID NO: 23130 - protein, 11 aa, Artificial Sequence
  Peptide Derived from Human Papillomavirus
ASNKKAAMLAV

SEQ ID NO: 23131 - protein, 8 aa, Artificial Sequence
  Peptide Derived from Human Papillomavirus
ATDTGSDM

SEQ ID NO: 23132 - protein, 9 aa, Artificial Sequence
  Peptide Derived from Human Papillomavirus
ATDTGSDMV

SEQ ID NO: 23133 - protein, 11 aa, Artificial Sequence
  Peptide Derived from Human Papillomavirus
ATDTGSDMVDF

SEQ ID NO: 23134 - protein, 8 aa, Artificial Sequence
  Peptide Derived from Human Papillomavirus
ATHTCWTY

SEQ ID NO: 23135 - protein, 9 aa, Artificial Sequence
  Peptide Derived from Human Papillomavirus
ATHTCWTYF

SEQ ID NO: 23136 - protein, 10 aa, Artificial Sequence
  Peptide Derived from Human Papillomavirus
ATLYAHIQCL

SEQ ID NO: 23137 - protein, 8 aa, Artificial Sequence
  Peptide Derived from Human Papillomavirus
CAVMCRHY

SEQ ID NO: 23138 - protein, 11 aa, Artificial Sequence
  Peptide Derived from Human Papillomavirus
CAVMCRHYKRA

SEQ ID NO: 23139 - protein, 11 aa, Artificial Sequence
  Peptide Derived from Human Papillomavirus
CSEVEAAETQV

SEQ ID NO: 23140 - protein, 9 aa, Artificial Sequence
  Peptide Derived from Human Papillomavirus
CSITELKEL

SEQ ID NO: 23141 - protein, 10 aa, Artificial Sequence
  Peptide Derived from Human Papillomavirus
CSITELKELL

SEQ ID NO: 23142 - protein, 10 aa, Artificial Sequence
  Peptide Derived from Human Papillomavirus
CSKIDEGGDW

SEQ ID NO: 23143 - protein, 8 aa, Artificial Sequence
  Peptide Derived from Human Papillomavirus
CTDWVMAI

SEQ ID NO: 23144 - protein, 9 aa, Artificial Sequence
  Peptide Derived from Human Papillomavirus
CTDWVMAIF

SEQ ID NO: 23145 - protein, 11 aa, Artificial Sequence
  Peptide Derived from Human Papillomavirus
CTDWVMAIFGV

SEQ ID NO: 23146 - protein, 9 aa, Artificial Sequence
  Peptide Derived from Human Papillomavirus
DADTEGIPF

SEQ ID NO: 23147 - protein, 8 aa, Artificial Sequence
  Peptide Derived from Human Papillomavirus
DAQVLHLL

SEQ ID NO: 23148 - protein, 9 aa, Artificial Sequence
  Peptide Derived from Human Papillomavirus
DATHTCWTY

SEQ ID NO: 23149 - protein, 10 aa, Artificial Sequence
  Peptide Derived from Human Papillomavirus
DATHTCWTYF

SEQ ID NO: 23150 - protein, 9 aa, Artificial Sequence
  Peptide Derived from Human Papillomavirus
DSGYGCSEV

SEQ ID NO: 23151 - protein, 11 aa, Artificial Sequence
  Peptide Derived from Human Papillomavirus
DSGYGCSEVEA

SEQ ID NO: 23152 - protein, 9 aa, Artificial Sequence
  Peptide Derived from Human Papillomavirus
DSNFDLSDM

SEQ ID NO: 23153 - protein, 10 aa, Artificial Sequence
  Peptide Derived from Human Papillomavirus
DSNFDLSDMV

SEQ ID NO: 23154 - protein, 9 aa, Artificial Sequence
  Peptide Derived from Human Papillomavirus
DSSDNAENV

SEQ ID NO: 23155 - protein, 8 aa, Artificial Sequence
  Peptide Derived from Human Papillomavirus
DTDLSPRL

SEQ ID NO: 23156 - protein, 11 aa, Artificial Sequence
  Peptide Derived from Human Papillomavirus
DTDLSPRLQEI

SEQ ID NO: 23157 - protein, 10 aa, Artificial Sequence
  Peptide Derived from Human Papillomavirus
DTEGIPFGTF

SEQ ID NO: 23158 - protein, 9 aa, Artificial Sequence
  Peptide Derived from Human Papillomavirus
DTGSDMVDF

SEQ ID NO: 23159 - protein, 10 aa, Artificial Sequence
  Peptide Derived from Human Papillomavirus
DTGSDMVDFI

SEQ ID NO: 23160 - protein, 10 aa, Artificial Sequence
  Peptide Derived from Human Papillomavirus
DTKVAMLDDA

SEQ ID NO: 23161 - protein, 9 aa, Artificial Sequence
  Peptide Derived from Human Papillomavirus
DTPEWIQRL

SEQ ID NO: 23162 - protein, 11 aa, Artificial Sequence
  Peptide Derived from Human Papillomavirus
DTPEWIQRLTI

SEQ ID NO: 23163 - protein, 10 aa, Artificial Sequence
  Peptide Derived from Human Papillomavirus
DTQLSICEQA

SEQ ID NO: 23164 - protein, 9 aa, Artificial Sequence
  Peptide Derived from Human Papillomavirus
EAAETQVTV

SEQ ID NO: 23165 - protein, 8 aa, Artificial Sequence
  Peptide Derived from Human Papillomavirus
ESDMAFQY

SEQ ID NO: 23166 - protein, 9 aa, Artificial Sequence
  Peptide Derived from Human Papillomavirus
ESDMAFQYA

SEQ ID NO: 23167 - protein, 11 aa, Artificial Sequence
  Peptide Derived from Human Papillomavirus
ESDMAFQYAQL

SEQ ID NO: 23168 - protein, 9 aa, Artificial Sequence
  Peptide Derived from Human Papillomavirus
ESRVTVFTF

SEQ ID NO: 23169 - protein, 9 aa, Artificial Sequence
  Peptide Derived from Human Papillomavirus
ETAQALFHA

SEQ ID NO: 23170 - protein, 10 aa, Artificial Sequence
  Peptide Derived from Human Papillomavirus
ETATDTGSDM

SEQ ID NO: 23171 - protein, 11 aa, Artificial Sequence
  Peptide Derived from Human Papillomavirus
ETATDTGSDMV

SEQ ID NO: 23172 - protein, 11 aa, Artificial Sequence
  Peptide Derived from Human Papillomavirus
ETCMLIEPPKL

SEQ ID NO: 23173 - protein, 11 aa, Artificial Sequence
  Peptide Derived from Human Papillomavirus
ETIVEKKTGDV

SEQ ID NO: 23174 - protein, 10 aa, Artificial Sequence
  Peptide Derived from Human Papillomavirus
ETQVTVNTNA

SEQ ID NO: 23175 - protein, 11 aa, Artificial Sequence
  Peptide Derived from Human Papillomavirus
FAGGSKENSPL

SEQ ID NO: 23176 - protein, 8 aa, Artificial Sequence
  Peptide Derived from Human Papillomavirus
FTDLVRNF

SEQ ID NO: 23177 - protein, 9 aa, Artificial Sequence
  Peptide Derived from Human Papillomavirus
FTFPHAFPF

SEQ ID NO: 23178 - protein, 8 aa, Artificial Sequence
  Peptide Derived from Human Papillomavirus
FTISDSGY

SEQ ID NO: 23179 - protein, 8 aa, Artificial Sequence
  Peptide Derived from Human Papillomavirus
GSDMVDFI

SEQ ID NO: 23180 - protein, 8 aa, Artificial Sequence
  Peptide Derived from Human Papillomavirus
GSKENSPL

SEQ ID NO: 23181 - protein, 8 aa, Artificial Sequence
  Peptide Derived from Human Papillomavirus
GTGCNGWF

SEQ ID NO: 23182 - protein, 9 aa, Artificial Sequence
  Peptide Derived from Human Papillomavirus
GTGCNGWFF

SEQ ID NO: 23183 - protein, 10 aa, Artificial Sequence
  Peptide Derived from Human Papillomavirus
GTGCNGWFFV

SEQ ID NO: 23184 - protein, 8 aa, Artificial Sequence
  Peptide Derived from Human Papillomavirus
GTPKKNCI

SEQ ID NO: 23185 - protein, 9 aa, Artificial Sequence
  Peptide Derived from Human Papillomavirus
GTPKKNCIL

SEQ ID NO: 23186 - protein, 10 aa, Artificial Sequence
  Peptide Derived from Human Papillomavirus
GTPKKNCILL

SEQ ID NO: 23187 - protein, 11 aa, Artificial Sequence
  Peptide Derived from Human Papillomavirus
GTPKKNCILLY

SEQ ID NO: 23188 - protein, 9 aa, Artificial Sequence
  Peptide Derived from Human Papillomavirus
HAQEVQNDA

SEQ ID NO: 23189 - protein, 11 aa, Artificial Sequence
  Peptide Derived from Human Papillomavirus
HAQEVQNDAQV

SEQ ID NO: 23190 - protein, 10 aa, Artificial Sequence
  Peptide Derived from Human Papillomavirus
HTCWTYFDNY

SEQ ID NO: 23191 - protein, 11 aa, Artificial Sequence
  Peptide Derived from Human Papillomavirus
HTCWTYFDNYM

SEQ ID NO: 23192 - protein, 9 aa, Artificial Sequence
  Peptide Derived from Human Papillomavirus
ISDDEDETA

SEQ ID NO: 23193 - protein, 11 aa, Artificial Sequence
  Peptide Derived from Human Papillomavirus
ISDSGYGCSEV

SEQ ID NO: 23194 - protein, 11 aa, Artificial Sequence
  Peptide Derived from Human Papillomavirus
ISEVSGDTPEW

SEQ ID NO: 23195 - protein, 10 aa, Artificial Sequence
  Peptide Derived from Human Papillomavirus
ISFLRALKEF

SEQ ID NO: 23196 - protein, 11 aa, Artificial Sequence
  Peptide Derived from Human Papillomavirus
ISFLRALKEFL

SEQ ID NO: 23197 - protein, 10 aa, Artificial Sequence
  Peptide Derived from Human Papillomavirus
ISFVNSNSHF

SEQ ID NO: 23198 - protein, 11 aa, Artificial Sequence
  Peptide Derived from Human Papillomavirus
ISFVNSNSHFW

SEQ ID NO: 23199 - protein, 10 aa, Artificial Sequence
  Peptide Derived from Human Papillomavirus
ISIDRKHKPL

SEQ ID NO: 23200 - protein, 11 aa, Artificial Sequence
  Peptide Derived from Human Papillomavirus
ISIDRKHKPLL

SEQ ID NO: 23201 - protein, 10 aa, Artificial Sequence
  Peptide Derived from Human Papillomavirus
ISLNSGHKKA

SEQ ID NO: 23202 - protein, 8 aa, Artificial Sequence
  Peptide Derived from Human Papillomavirus
ITELKELL

SEQ ID NO: 23203 - protein, 10 aa, Artificial Sequence
  Peptide Derived from Human Papillomavirus
ITELKELLQA

SEQ ID NO: 23204 - protein, 8 aa, Artificial Sequence
  Peptide Derived from Human Papillomavirus
KAAMLAVF

SEQ ID NO: 23205 - protein, 11 aa, Artificial Sequence
  Peptide Derived from Human Papillomavirus
KAAMLAVFKDI

SEQ ID NO: 23206 - protein, 9 aa, Artificial Sequence
  Peptide Derived from Human Papillomavirus
KAKRRLFTI

SEQ ID NO: 23207 - protein, 10 aa, Artificial Sequence
  Peptide Derived from Human Papillomavirus
KSDKTTCTDW

SEQ ID NO: 23208 - protein, 11 aa, Artificial Sequence
  Peptide Derived from Human Papillomavirus
KSDKTTCTDWV

SEQ ID NO: 23209 - protein, 8 aa, Artificial Sequence
  Peptide Derived from Human Papillomavirus
KSNCQAKY

SEQ ID NO: 23210 - protein, 9 aa, Artificial Sequence
  Peptide Derived from Human Papillomavirus
KSNCQAKYL

SEQ ID NO: 23211 - protein, 8 aa, Artificial Sequence
  Peptide Derived from Human Papillomavirus
KSYFGMSF

SEQ ID NO: 23212 - protein, 9 aa, Artificial Sequence
  Peptide Derived from Human Papillomavirus
KSYFGMSFI

SEQ ID NO: 23213 - protein, 11 aa, Artificial Sequence
  Peptide Derived from Human Papillomavirus
KSYFGMSFIHF

SEQ ID NO: 23214 - protein, 9 aa, Artificial Sequence
  Peptide Derived from Human Papillomavirus
KTLIKPATL

SEQ ID NO: 23215 - protein, 10 aa, Artificial Sequence
  Peptide Derived from Human Papillomavirus
KTLIKPATLY

SEQ ID NO: 23216 - protein, 11 aa, Artificial Sequence
  Peptide Derived from Human Papillomavirus
KTLIKPATLYA

SEQ ID NO: 23217 - protein, 8 aa, Artificial Sequence
  Peptide Derived from Human Papillomavirus
KTTCTDWV

SEQ ID NO: 23218 - protein, 9 aa, Artificial Sequence
  Peptide Derived from Human Papillomavirus
KTTCTDWVM

SEQ ID NO: 23219 - protein, 10 aa, Artificial Sequence
  Peptide Derived from Human Papillomavirus
KTTCTDWVMA

SEQ ID NO: 23220 - protein, 11 aa, Artificial Sequence
  Peptide Derived from Human Papillomavirus
KTTCTDWVMAI

SEQ ID NO: 23221 - protein, 8 aa, Artificial Sequence
  Peptide Derived from Human Papillomavirus
LADCNSNA

SEQ ID NO: 23222 - protein, 9 aa, Artificial Sequence
  Peptide Derived from Human Papillomavirus
LADCNSNAA

SEQ ID NO: 23223 - protein, 10 aa, Artificial Sequence
  Peptide Derived from Human Papillomavirus
LADCNSNAAA

SEQ ID NO: 23224 - protein, 11 aa, Artificial Sequence
  Peptide Derived from Human Papillomavirus
LADCNSNAAAF

SEQ ID NO: 23225 - protein, 8 aa, Artificial Sequence
  Peptide Derived from Human Papillomavirus
LADTKVAM

SEQ ID NO: 23226 - protein, 9 aa, Artificial Sequence
  Peptide Derived from Human Papillomavirus
LADTKVAML

SEQ ID NO: 23227 - protein, 8 aa, Artificial Sequence
  Peptide Derived from Human Papillomavirus
LAVFKDIY

SEQ ID NO: 23228 - protein, 10 aa, Artificial Sequence
  Peptide Derived from Human Papillomavirus
LAVFKDIYGL

SEQ ID NO: 23229 - protein, 8 aa, Artificial Sequence
  Peptide Derived from Human Papillomavirus
LSDMVQWA

SEQ ID NO: 23230 - protein, 9 aa, Artificial Sequence
  Peptide Derived from Human Papillomavirus
LSDMVQWAF

SEQ ID NO: 23231 - protein, 10 aa, Artificial Sequence
  Peptide Derived from Human Papillomavirus
LSFTDLVRNF

SEQ ID NO: 23232 - protein, 8 aa, Artificial Sequence
  Peptide Derived from Human Papillomavirus
LSPRLQEI

SEQ ID NO: 23233 - protein, 10 aa, Artificial Sequence
  Peptide Derived from Human Papillomavirus
LSPRLQEISL

SEQ ID NO: 23234 - protein, 11 aa, Artificial Sequence
  Peptide Derived from Human Papillomavirus
LSVDTDLSPRL

SEQ ID NO: 23235 - protein, 8 aa, Artificial Sequence
  Peptide Derived from Human Papillomavirus
LTDESDMA

SEQ ID NO: 23236 - protein, 9 aa, Artificial Sequence
  Peptide Derived from Human Papillomavirus
LTDESDMAF

SEQ ID NO: 23237 - protein, 11 aa, Artificial Sequence
  Peptide Derived from Human Papillomavirus
LTDESDMAFQY

SEQ ID NO: 23238 - protein, 8 aa, Artificial Sequence
  Peptide Derived from Human Papillomavirus
LTIIQHGI

SEQ ID NO: 23239 - protein, 8 aa, Artificial Sequence
  Peptide Derived from Human Papillomavirus
LTSNIDPA

SEQ ID NO: 23240 - protein, 10 aa, Artificial Sequence
  Peptide Derived from Human Papillomavirus
LTVAKGLSTL

SEQ ID NO: 23241 - protein, 11 aa, Artificial Sequence
  Peptide Derived from Human Papillomavirus
LTVAKGLSTLL

SEQ ID NO: 23242 - protein, 8 aa, Artificial Sequence
  Peptide Derived from Human Papillomavirus
MAFQYAQL

SEQ ID NO: 23243 - protein, 9 aa, Artificial Sequence
  Peptide Derived from Human Papillomavirus
MAFQYAQLA

SEQ ID NO: 23244 - protein, 10 aa, Artificial Sequence
  Peptide Derived from Human Papillomavirus
MAIFGVNPTV

SEQ ID NO: 23245 - protein, 11 aa, Artificial Sequence
  Peptide Derived from Human Papillomavirus
MAIFGVNPTVA

SEQ ID NO: 23246 - protein, 10 aa, Artificial Sequence
  Peptide Derived from Human Papillomavirus
MSFIHFLQGA

SEQ ID NO: 23247 - protein, 11 aa, Artificial Sequence
  Peptide Derived from Human Papillomavirus
MSFIHFLQGAI

SEQ ID NO: 23248 - protein, 8 aa, Artificial Sequence
  Peptide Derived from Human Papillomavirus
NAENGGSV

SEQ ID NO: 23249 - protein, 11 aa, Artificial Sequence
  Peptide Derived from Human Papillomavirus
NAENVDPHCSI

SEQ ID NO: 23250 - protein, 8 aa, Artificial Sequence
  Peptide Derived from Human Papillomavirus
NALDGNPI

SEQ ID NO: 23251 - protein, 10 aa, Artificial Sequence
  Peptide Derived from Human Papillomavirus
NALDGNPISI

SEQ ID NO: 23252 - protein, 11 aa, Artificial Sequence
  Peptide Derived from Human Papillomavirus
NSGHKKAKRRL

SEQ ID NO: 23253 - protein, 9 aa, Artificial Sequence
  Peptide Derived from Human Papillomavirus
NSHFWLEPL

SEQ ID NO: 23254 - protein, 10 aa, Artificial Sequence
  Peptide Derived from Human Papillomavirus
NSHFWLEPLA

SEQ ID NO: 23255 - protein, 8 aa, Artificial Sequence
  Peptide Derived from Human Papillomavirus
NSNAAAFL

SEQ ID NO: 23256 - protein, 8 aa, Artificial Sequence
  Peptide Derived from Human Papillomavirus
NSNSHFWL

SEQ ID NO: 23257 - protein, 11 aa, Artificial Sequence
  Peptide Derived from Human Papillomavirus
NSNSHFWLEPL

SEQ ID NO: 23258 - protein, 8 aa, Artificial Sequence
  Peptide Derived from Human Papillomavirus
NSPLGEQL

SEQ ID NO: 23259 - protein, 10 aa, Artificial Sequence
  Peptide Derived from Human Papillomavirus
NSPLGEQLSV

SEQ ID NO: 23260 - protein, 9 aa, Artificial Sequence
  Peptide Derived from Human Papillomavirus
NTGKSYFGM

SEQ ID NO: 23261 - protein, 11 aa, Artificial Sequence
  Peptide Derived from Human Papillomavirus
NTGKSYFGMSF

SEQ ID NO: 23262 - protein, 10 aa, Artificial Sequence
  Peptide Derived from Human Papillomavirus
NTNAENGGSV

SEQ ID NO: 23263 - protein, 9 aa, Artificial Sequence
  Peptide Derived from Human Papillomavirus
PAKDNKWPY

SEQ ID NO: 23264 - protein, 10 aa, Artificial Sequence
  Peptide Derived from Human Papillomavirus
PAKDNKWPYL

SEQ ID NO: 23265 - protein, 8 aa, Artificial Sequence
  Peptide Derived from Human Papillomavirus
PANTGKSY

SEQ ID NO: 23266 - protein, 9 aa, Artificial Sequence
  Peptide Derived from Human Papillomavirus
PANTGKSYF

SEQ ID NO: 23267 - protein, 11 aa, Artificial Sequence
  Peptide Derived from Human Papillomavirus
PANTGKSYFGM

SEQ ID NO: 23268 - protein, 8 aa, Artificial Sequence
  Peptide Derived from Human Papillomavirus
PATLYAHI

SEQ ID NO: 23269 - protein, 11 aa, Artificial Sequence
  Peptide Derived from Human Papillomavirus
PATLYAHIQCL

SEQ ID NO: 23270 - protein, 10 aa, Artificial Sequence
  Peptide Derived from Human Papillomavirus
PTVAEGFKTL

SEQ ID NO: 23271 - protein, 11 aa, Artificial Sequence
  Peptide Derived from Human Papillomavirus
PTVAEGFKTLI

SEQ ID NO: 23272 - protein, 9 aa, Artificial Sequence
  Peptide Derived from Human Papillomavirus
QAEQETAQA

SEQ ID NO: 23273 - protein, 10 aa, Artificial Sequence
  Peptide Derived from Human Papillomavirus
QAEQETAQAL

SEQ ID NO: 23274 - protein, 11 aa, Artificial Sequence
  Peptide Derived from Human Papillomavirus
QAEQETAQALF

SEQ ID NO: 23275 - protein, 9 aa, Artificial Sequence
  Peptide Derived from Human Papillomavirus
QAKYLKDCA

SEQ ID NO: 23276 - protein, 10 aa, Artificial Sequence
  Peptide Derived from Human Papillomavirus
QAKYLKDCAV

SEQ ID NO: 23277 - protein, 11 aa, Artificial Sequence
  Peptide Derived from Human Papillomavirus
QAKYLKDCAVM

SEQ ID NO: 23278 - protein, 9 aa, Artificial Sequence
  Peptide Derived from Human Papillomavirus
QALFHAQEV

SEQ ID NO: 23279 - protein, 8 aa, Artificial Sequence
  Peptide Derived from Human Papillomavirus
QASNKKAA

SEQ ID NO: 23280 - protein, 9 aa, Artificial Sequence
  Peptide Derived from Human Papillomavirus
QASNKKAAM

SEQ ID NO: 23281 - protein, 10 aa, Artificial Sequence
  Peptide Derived from Human Papillomavirus
QASNKKAAML

SEQ ID NO: 23282 - protein, 11 aa, Artificial Sequence
  Peptide Derived from Human Papillomavirus
QASNKKAAMLA

SEQ ID NO: 23283 - protein, 11 aa, Artificial Sequence
  Peptide Derived from Human Papillomavirus
QSSGGDSSDNA

SEQ ID NO: 23284 - protein, 9 aa, Artificial Sequence
  Peptide Derived from Human Papillomavirus
RAQKRQMNM

SEQ ID NO: 23285 - protein, 8 aa, Artificial Sequence
  Peptide Derived from Human Papillomavirus
RSSVAALY

SEQ ID NO: 23286 - protein, 9 aa, Artificial Sequence
  Peptide Derived from Human Papillomavirus
RSSVAALYW

SEQ ID NO: 23287 - protein, 10 aa, Artificial Sequence
  Peptide Derived from Human Papillomavirus
RSSVAALYWY

SEQ ID NO: 23288 - protein, 10 aa, Artificial Sequence
  Peptide Derived from Human Papillomavirus
RTGISNISEV

SEQ ID NO: 23289 - protein, 8 aa, Artificial Sequence
  Peptide Derived from Human Papillomavirus
RTWSRLDL

SEQ ID NO: 23290 - protein, 8 aa, Artificial Sequence
  Peptide Derived from Human Papillomavirus
SSDNAENV

SEQ ID NO: 23291 - protein, 10 aa, Artificial Sequence
  Peptide Derived from Human Papillomavirus
SSGGDSSDNA

SEQ ID NO: 23292 - protein, 8 aa, Artificial Sequence
  Peptide Derived from Human Papillomavirus
SSVAALYW

SEQ ID NO: 23293 - protein, 9 aa, Artificial Sequence
  Peptide Derived from Human Papillomavirus
SSVAALYWY

SEQ ID NO: 23294 - protein, 11 aa, Artificial Sequence
  Peptide Derived from Human Papillomavirus
STLLHVPETCM

SEQ ID NO: 23295 - protein, 8 aa, Artificial Sequence
  Peptide Derived from Human Papillomavirus
TAQALFHA

SEQ ID NO: 23296 - protein, 11 aa, Artificial Sequence
  Peptide Derived from Human Papillomavirus
TAQALFHAQEV

SEQ ID NO: 23297 - protein, 9 aa, Artificial Sequence
  Peptide Derived from Human Papillomavirus
TATDTGSDM

SEQ ID NO: 23298 - protein, 10 aa, Artificial Sequence
  Peptide Derived from Human Papillomavirus
TATDTGSDMV

SEQ ID NO: 23299 - protein, 8 aa, Artificial Sequence
  Peptide Derived from Human Papillomavirus
TTCTDWVM

SEQ ID NO: 23300 - protein, 9 aa, Artificial Sequence
  Peptide Derived from Human Papillomavirus
TTCTDWVMA

SEQ ID NO: 23301 - protein, 10 aa, Artificial Sequence
  Peptide Derived from Human Papillomavirus
TTCTDWVMAI

SEQ ID NO: 23302 - protein, 11 aa, Artificial Sequence
  Peptide Derived from Human Papillomavirus
TTCTDWVMAIF

SEQ ID NO: 23303 - protein, 11 aa, Artificial Sequence
  Peptide Derived from Human Papillomavirus
VAALYWYRTGI

SEQ ID NO: 23304 - protein, 8 aa, Artificial Sequence
  Peptide Derived from Human Papillomavirus
VAEGFKTL

SEQ ID NO: 23305 - protein, 9 aa, Artificial Sequence
  Peptide Derived from Human Papillomavirus
VAEGFKTLI

SEQ ID NO: 23306 - protein, 8 aa, Artificial Sequence
  Peptide Derived from Human Papillomavirus
VAKGLSTL

SEQ ID NO: 23307 - protein, 9 aa, Artificial Sequence
  Peptide Derived from Human Papillomavirus
VAKGLSTLL

SEQ ID NO: 23308 - protein, 11 aa, Artificial Sequence
  Peptide Derived from Human Papillomavirus
VAKGLSTLLHV

SEQ ID NO: 23309 - protein, 8 aa, Artificial Sequence
  Peptide Derived from Human Papillomavirus
VSGDTPEW

SEQ ID NO: 23310 - protein, 9 aa, Artificial Sequence
  Peptide Derived from Human Papillomavirus
VSGDTPEWI

SEQ ID NO: 23311 - protein, 9 aa, Artificial Sequence
  Peptide Derived from Human Papillomavirus
VTGQNTRPL

SEQ ID NO: 23312 - protein, 9 aa, Artificial Sequence
  Peptide Derived from Human Papillomavirus
VTVFTFPHA

SEQ ID NO: 23313 - protein, 10 aa, Artificial Sequence
  Peptide Derived from Human Papillomavirus
VTVFTFPHAF

SEQ ID NO: 23314 - protein, 8 aa, Artificial Sequence
  Peptide Derived from Human Papillomavirus
WTYFDNYM

SEQ ID NO: 23315 - protein, 11 aa, Artificial Sequence
  Peptide Derived from Human Papillomavirus
WTYFDNYMRNA

SEQ ID NO: 23316 - protein, 11 aa, Artificial Sequence
  Peptide Derived from Human Papillomavirus
YAHIQCLDCKW

SEQ ID NO: 23317 - protein, 11 aa, Artificial Sequence
  Peptide Derived from Human Papillomavirus
YAQLADCNSNA

SEQ ID NO: 23318 - protein, 9 aa, Artificial Sequence
  Peptide Derived from Human Papillomavirus
AACVSYWGV

SEQ ID NO: 23319 - protein, 10 aa, Artificial Sequence
  Peptide Derived from Human Papillomavirus
AACVSYWGVY

SEQ ID NO: 23320 - protein, 11 aa, Artificial Sequence
  Peptide Derived from Human Papillomavirus
AACVSYWGVYY

SEQ ID NO: 23321 - protein, 9 aa, Artificial Sequence
  Peptide Derived from Human Papillomavirus
ASTSTPKTA

SEQ ID NO: 23322 - protein, 11 aa, Artificial Sequence
  Peptide Derived from Human Papillomavirus
ASTSTPKTASV

SEQ ID NO: 23323 - protein, 10 aa, Artificial Sequence
  Peptide Derived from Human Papillomavirus
ASVGTPKPHI

SEQ ID NO: 23324 - protein, 10 aa, Artificial Sequence
  Peptide Derived from Human Papillomavirus
ATKRPRQCGL

SEQ ID NO: 23325 - protein, 8 aa, Artificial Sequence
  Peptide Derived from Human Papillomavirus
ATQIVRQL

SEQ ID NO: 23326 - protein, 11 aa, Artificial Sequence
  Peptide Derived from Human Papillomavirus
ATQIVRQLQHA

SEQ ID NO: 23327 - protein, 8 aa, Artificial Sequence
  Peptide Derived from Human Papillomavirus
CSGNTTPI

SEQ ID NO: 23328 - protein, 9 aa, Artificial Sequence
  Peptide Derived from Human Papillomavirus
CSGNTTPII

SEQ ID NO: 23329 - protein, 11 aa, Artificial Sequence
  Peptide Derived from Human Papillomavirus
CSGNTTPIIHL

SEQ ID NO: 23330 - protein, 8 aa, Artificial Sequence
  Peptide Derived from Human Papillomavirus
CSTSDDTV

SEQ ID NO: 23331 - protein, 10 aa, Artificial Sequence
  Peptide Derived from Human Papillomavirus
CSTSDDTVSA

SEQ ID NO: 23332 - protein, 11 aa, Artificial Sequence
  Peptide Derived from Human Papillomavirus
DSIYYITETGI

SEQ ID NO: 23333 - protein, 9 aa, Artificial Sequence
  Peptide Derived from Human Papillomavirus
DSKDINSQI

SEQ ID NO: 23334 - protein, 11 aa, Artificial Sequence
  Peptide Derived from Human Papillomavirus
DSKDINSQISY

SEQ ID NO: 23335 - protein, 11 aa, Artificial Sequence
  Peptide Derived from Human Papillomavirus
DSMCSTSDDTV

SEQ ID NO: 23336 - protein, 8 aa, Artificial Sequence
  Peptide Derived from Human Papillomavirus
DTTYYVQF

SEQ ID NO: 23337 - protein, 8 aa, Artificial Sequence
  Peptide Derived from Human Papillomavirus
DTVSATQI

SEQ ID NO: 23338 - protein, 9 aa, Artificial Sequence
  Peptide Derived from Human Papillomavirus
DTVSATQIV

SEQ ID NO: 23339 - protein, 9 aa, Artificial Sequence
  Peptide Derived from Human Papillomavirus
ESLSERLSA

SEQ ID NO: 23340 - protein, 10 aa, Artificial Sequence
  Peptide Derived from Human Papillomavirus
ESLSERLSAL

SEQ ID NO: 23341 - protein, 9 aa, Artificial Sequence
  Peptide Derived from Human Papillomavirus
ETGIWDKTA

SEQ ID NO: 23342 - protein, 10 aa, Artificial Sequence
  Peptide Derived from Human Papillomavirus
ETGIWDKTAA

SEQ ID NO: 23343 - protein, 8 aa, Artificial Sequence
  Peptide Derived from Human Papillomavirus
FTAREHGI

SEQ ID NO: 23344 - protein, 11 aa, Artificial Sequence
  Peptide Derived from Human Papillomavirus
FTAREHGITKL

SEQ ID NO: 23345 - protein, 11 aa, Artificial Sequence
  Peptide Derived from Human Papillomavirus
GTPKPHIQTPA

SEQ ID NO: 23346 - protein, 10 aa, Artificial Sequence
  Peptide Derived from Human Papillomavirus
HASTSTPKTA

SEQ ID NO: 23347 - protein, 9 aa, Artificial Sequence
  Peptide Derived from Human Papillomavirus
ISKSKAHKA

SEQ ID NO: 23348 - protein, 10 aa, Artificial Sequence
  Peptide Derived from Human Papillomavirus
ISKSKAHKAI

SEQ ID NO: 23349 - protein, 8 aa, Artificial Sequence
  Peptide Derived from Human Papillomavirus
ISVGYMTI

SEQ ID NO: 23350 - protein, 9 aa, Artificial Sequence
  Peptide Derived from Human Papillomavirus
ISYWQLIRL

SEQ ID NO: 23351 - protein, 11 aa, Artificial Sequence
  Peptide Derived from Human Papillomavirus
ITETGIWDKTA

SEQ ID NO: 23352 - protein, 8 aa, Artificial Sequence
  Peptide Derived from Human Papillomavirus
ITKLNHQV

SEQ ID NO: 23353 - protein, 9 aa, Artificial Sequence
  Peptide Derived from Human Papillomavirus
ITKLNHQVV

SEQ ID NO: 23354 - protein, 8 aa, Artificial Sequence
  Peptide Derived from Human Papillomavirus
KAHKAIEL

SEQ ID NO: 23355 - protein, 10 aa, Artificial Sequence
  Peptide Derived from Human Papillomavirus
KAHKAIELQM

SEQ ID NO: 23356 - protein, 11 aa, Artificial Sequence
  Peptide Derived from Human Papillomavirus
KAHKAIELQMA

SEQ ID NO: 23357 - protein, 8 aa, Artificial Sequence
  Peptide Derived from Human Papillomavirus
KAIELQMA

SEQ ID NO: 23358 - protein, 9 aa, Artificial Sequence
  Peptide Derived from Human Papillomavirus
KAIELQMAL

SEQ ID NO: 23359 - protein, 8 aa, Artificial Sequence
  Peptide Derived from Human Papillomavirus
KSKAHKAI

SEQ ID NO: 23360 - protein, 10 aa, Artificial Sequence
  Peptide Derived from Human Papillomavirus
KSKAHKAIEL

SEQ ID NO: 23361 - protein, 8 aa, Artificial Sequence
  Peptide Derived from Human Papillomavirus
KTAACVSY

SEQ ID NO: 23362 - protein, 9 aa, Artificial Sequence
  Peptide Derived from Human Papillomavirus
KTAACVSYW

SEQ ID NO: 23363 - protein, 11 aa, Artificial Sequence
  Peptide Derived from Human Papillomavirus
KTAACVSYWGV

SEQ ID NO: 23364 - protein, 11 aa, Artificial Sequence
  Peptide Derived from Human Papillomavirus
LAQSKYNNEEW

SEQ ID NO: 23365 - protein, 8 aa, Artificial Sequence
  Peptide Derived from Human Papillomavirus
LSALQDKI

SEQ ID NO: 23366 - protein, 9 aa, Artificial Sequence
  Peptide Derived from Human Papillomavirus
LSALQDKIL

SEQ ID NO: 23367 - protein, 8 aa, Artificial Sequence
  Peptide Derived from Human Papillomavirus
LSERLSAL

SEQ ID NO: 23368 - protein, 9 aa, Artificial Sequence
  Peptide Derived from Human Papillomavirus
LTEQHHGRV

SEQ ID NO: 23369 - protein, 9 aa, Artificial Sequence
  Peptide Derived from Human Papillomavirus
LTVTYNSEV

SEQ ID NO: 23370 - protein, 11 aa, Artificial Sequence
  Peptide Derived from Human Papillomavirus
MALKGLAQSKY

SEQ ID NO: 23371 - protein, 9 aa, Artificial Sequence
  Peptide Derived from Human Papillomavirus
NSEVQRNTF

SEQ ID NO: 23372 - protein, 10 aa, Artificial Sequence
  Peptide Derived from Human Papillomavirus
NSEVQRNTFL

SEQ ID NO: 23373 - protein, 8 aa, Artificial Sequence
  Peptide Derived from Human Papillomavirus
NSLKCLRY

SEQ ID NO: 23374 - protein, 10 aa, Artificial Sequence
  Peptide Derived from Human Papillomavirus
NSLKCLRYRL

SEQ ID NO: 23375 - protein, 9 aa, Artificial Sequence
  Peptide Derived from Human Papillomavirus
NSNTWEVQY

SEQ ID NO: 23376 - protein, 9 aa, Artificial Sequence
  Peptide Derived from Human Papillomavirus
NSQISYWQL

SEQ ID NO: 23377 - protein, 10 aa, Artificial Sequence
  Peptide Derived from Human Papillomavirus
NSQISYWQLI

SEQ ID NO: 23378 - protein, 9 aa, Artificial Sequence
  Peptide Derived from Human Papillomavirus
NSVQISVGY

SEQ ID NO: 23379 - protein, 10 aa, Artificial Sequence
  Peptide Derived from Human Papillomavirus
NSVQISVGYM

SEQ ID NO: 23380 - protein, 8 aa, Artificial Sequence
  Peptide Derived from Human Papillomavirus
NTEPSQCF

SEQ ID NO: 23381 - protein, 9 aa, Artificial Sequence
  Peptide Derived from Human Papillomavirus
NTFLDVVTI

SEQ ID NO: 23382 - protein, 9 aa, Artificial Sequence
  Peptide Derived from Human Papillomavirus
NTGILTVTY

SEQ ID NO: 23383 - protein, 8 aa, Artificial Sequence
  Peptide Derived from Human Papillomavirus
NTHVHNPL

SEQ ID NO: 23384 - protein, 9 aa, Artificial Sequence
  Peptide Derived from Human Papillomavirus
NTHVHNPLL

SEQ ID NO: 23385 - protein, 8 aa, Artificial Sequence
  Peptide Derived from Human Papillomavirus
NTTPIIHL

SEQ ID NO: 23386 - protein, 11 aa, Artificial Sequence
  Peptide Derived from Human Papillomavirus
NTWEVQYGGNV

SEQ ID NO: 23387 - protein, 11 aa, Artificial Sequence
  Peptide Derived from Human Papillomavirus
PATKRPRQCGL

SEQ ID NO: 23388 - protein, 9 aa, Artificial Sequence
  Peptide Derived from Human Papillomavirus
QSKYNNEEW

SEQ ID NO: 23389 - protein, 11 aa, Artificial Sequence
  Peptide Derived from Human Papillomavirus
QSKYNNEEWTL

SEQ ID NO: 23390 - protein, 11 aa, Artificial Sequence
  Peptide Derived from Human Papillomavirus
QTPKESLSERL

SEQ ID NO: 23391 - protein, 8 aa, Artificial Sequence
  Peptide Derived from Human Papillomavirus
SALQDKIL

SEQ ID NO: 23392 - protein, 11 aa, Artificial Sequence
  Peptide Derived from Human Papillomavirus
SALQDKILDHY

SEQ ID NO: 23393 - protein, 9 aa, Artificial Sequence
  Peptide Derived from Human Papillomavirus
SATQIVRQL

SEQ ID NO: 23394 - protein, 11 aa, Artificial Sequence
  Peptide Derived from Human Papillomavirus
SSTSNNKRRKV

SEQ ID NO: 23395 - protein, 8 aa, Artificial Sequence
  Peptide Derived from Human Papillomavirus
STPKTASV

SEQ ID NO: 23396 - protein, 9 aa, Artificial Sequence
  Peptide Derived from Human Papillomavirus
STSDDTVSA

SEQ ID NO: 23397 - protein, 10 aa, Artificial Sequence
  Peptide Derived from Human Papillomavirus
STSNNKRRKV

SEQ ID NO: 23398 - protein, 8 aa, Artificial Sequence
  Peptide Derived from Human Papillomavirus
STSTPKTA

SEQ ID NO: 23399 - protein, 10 aa, Artificial Sequence
  Peptide Derived from Human Papillomavirus
STSTPKTASV

SEQ ID NO: 23400 - protein, 8 aa, Artificial Sequence
  Peptide Derived from Human Papillomavirus
TAACVSYW

SEQ ID NO: 23401 - protein, 10 aa, Artificial Sequence
  Peptide Derived from Human Papillomavirus
TAACVSYWGV

SEQ ID NO: 23402 - protein, 11 aa, Artificial Sequence
  Peptide Derived from Human Papillomavirus
TAACVSYWGVY

SEQ ID NO: 23403 - protein, 10 aa, Artificial Sequence
  Peptide Derived from Human Papillomavirus
TAREHGITKL

SEQ ID NO: 23404 - protein, 11 aa, Artificial Sequence
  Peptide Derived from Human Papillomavirus
TASVGTPKPHI

SEQ ID NO: 23405 - protein, 8 aa, Artificial Sequence
  Peptide Derived from Human Papillomavirus
TSDDTVSA

SEQ ID NO: 23406 - protein, 11 aa, Artificial Sequence
  Peptide Derived from Human Papillomavirus
TSDDTVSATQI

SEQ ID NO: 23407 - protein, 9 aa, Artificial Sequence
  Peptide Derived from Human Papillomavirus
TSNNKRRKV

SEQ ID NO: 23408 - protein, 9 aa, Artificial Sequence
  Peptide Derived from Human Papillomavirus
TSTPKTASV

SEQ ID NO: 23409 - protein, 10 aa, Artificial Sequence
  Peptide Derived from Human Papillomavirus
VSATQIVRQL

SEQ ID NO: 23410 - protein, 8 aa, Artificial Sequence
  Peptide Derived from Human Papillomavirus
VSYWGVYY

SEQ ID NO: 23411 - protein, 9 aa, Artificial Sequence
  Peptide Derived from Human Papillomavirus
VSYWGVYYI

SEQ ID NO: 23412 - protein, 9 aa, Artificial Sequence
  Peptide Derived from Human Papillomavirus
VTIPNSVQI

SEQ ID NO: 23413 - protein, 11 aa, Artificial Sequence
  Peptide Derived from Human Papillomavirus
VTIPNSVQISV

SEQ ID NO: 23414 - protein, 10 aa, Artificial Sequence
  Peptide Derived from Human Papillomavirus
WTGCNKNTGI

SEQ ID NO: 23415 - protein, 11 aa, Artificial Sequence
  Peptide Derived from Human Papillomavirus
WTGCNKNTGIL

SEQ ID NO: 23416 - protein, 10 aa, Artificial Sequence
  Peptide Derived from Human Papillomavirus
WTLQDTCEEL

SEQ ID NO: 23417 - protein, 11 aa, Artificial Sequence
  Peptide Derived from Human Papillomavirus
WTLQDTCEELW

SEQ ID NO: 23418 - protein, 8 aa, Artificial Sequence
  Peptide Derived from Human Papillomavirus
YADHYSEI

SEQ ID NO: 23419 - protein, 8 aa, Artificial Sequence
  Peptide Derived from Human Papillomavirus
YSEISSTW

SEQ ID NO: 23420 - protein, 10 aa, Artificial Sequence
  Peptide Derived from Human Papillomavirus
YSEISSTWHW

SEQ ID NO: 23421 - protein, 9 aa, Artificial Sequence
  Peptide Derived from Human Papillomavirus
AACHKCIDF

SEQ ID NO: 23422 - protein, 10 aa, Artificial Sequence
  Peptide Derived from Human Papillomavirus
AACHKCIDFY

SEQ ID NO: 23423 - protein, 8 aa, Artificial Sequence
  Peptide Derived from Human Papillomavirus
ATLERTEV

SEQ ID NO: 23424 - protein, 9 aa, Artificial Sequence
  Peptide Derived from Human Papillomavirus
ATLERTEVY

SEQ ID NO: 23425 - protein, 11 aa, Artificial Sequence
  Peptide Derived from Human Papillomavirus
ATLERTEVYQF

SEQ ID NO: 23426 - protein, 8 aa, Artificial Sequence
  Peptide Derived from Human Papillomavirus
CTELNTSL

SEQ ID NO: 23427 - protein, 11 aa, Artificial Sequence
  Peptide Derived from Human Papillomavirus
CTELNTSLQDV

SEQ ID NO: 23428 - protein, 11 aa, Artificial Sequence
  Peptide Derived from Human Papillomavirus
ETLEKITNTEL

SEQ ID NO: 23429 - protein, 8 aa, Artificial Sequence
  Peptide Derived from Human Papillomavirus
FAFKDLFI

SEQ ID NO: 23430 - protein, 9 aa, Artificial Sequence
  Peptide Derived from Human Papillomavirus
FAFKDLFIV

SEQ ID NO: 23431 - protein, 10 aa, Artificial Sequence
  Peptide Derived from Human Papillomavirus
FAFKDLFIVY

SEQ ID NO: 23432 - protein, 8 aa, Artificial Sequence
  Peptide Derived from Human Papillomavirus
IACVYCKA

SEQ ID NO: 23433 - protein, 10 aa, Artificial Sequence
  Peptide Derived from Human Papillomavirus
IACVYCKATL

SEQ ID NO: 23434 - protein, 10 aa, Artificial Sequence
  Peptide Derived from Human Papillomavirus
IAYAACHKCI

SEQ ID NO: 23435 - protein, 9 aa, Artificial Sequence
  Peptide Derived from Human Papillomavirus
ITNTELYNL

SEQ ID NO: 23436 - protein, 10 aa, Artificial Sequence
  Peptide Derived from Human Papillomavirus
ITNTELYNLL

SEQ ID NO: 23437 - protein, 11 aa, Artificial Sequence
  Peptide Derived from Human Papillomavirus
ITNTELYNLLI

SEQ ID NO: 23438 - protein, 9 aa, Artificial Sequence
  Peptide Derived from Human Papillomavirus
KATLERTEV

SEQ ID NO: 23439 - protein, 10 aa, Artificial Sequence
  Peptide Derived from Human Papillomavirus
KATLERTEVY

SEQ ID NO: 23440 - protein, 8 aa, Artificial Sequence
  Peptide Derived from Human Papillomavirus
NSVYGETL

SEQ ID NO: 23441 - protein, 11 aa, Artificial Sequence
  Peptide Derived from Human Papillomavirus
NSVYGETLEKI

SEQ ID NO: 23442 - protein, 8 aa, Artificial Sequence
  Peptide Derived from Human Papillomavirus
NTELYNLL

SEQ ID NO: 23443 - protein, 9 aa, Artificial Sequence
  Peptide Derived from Human Papillomavirus
NTELYNLLI

SEQ ID NO: 23444 - protein, 9 aa, Artificial Sequence
  Peptide Derived from Human Papillomavirus
NTSLQDVSI

SEQ ID NO: 23445 - protein, 10 aa, Artificial Sequence
  Peptide Derived from Human Papillomavirus
NTSLQDVSIA

SEQ ID NO: 23446 - protein, 8 aa, Artificial Sequence
  Peptide Derived from Human Papillomavirus
PAEKRRHL

SEQ ID NO: 23447 - protein, 8 aa, Artificial Sequence
  Peptide Derived from Human Papillomavirus
PTQRPYKL

SEQ ID NO: 23448 - protein, 11 aa, Artificial Sequence
  Peptide Derived from Human Papillomavirus
PTQRPYKLPDL

SEQ ID NO: 23449 - protein, 8 aa, Artificial Sequence
  Peptide Derived from Human Papillomavirus
RTEVYQFA

SEQ ID NO: 23450 - protein, 9 aa, Artificial Sequence
  Peptide Derived from Human Papillomavirus
RTEVYQFAF

SEQ ID NO: 23451 - protein, 8 aa, Artificial Sequence
  Peptide Derived from Human Papillomavirus
TSLQDVSI

SEQ ID NO: 23452 - protein, 9 aa, Artificial Sequence
  Peptide Derived from Human Papillomavirus
TSLQDVSIA

SEQ ID NO: 23453 - protein, 11 aa, Artificial Sequence
  Peptide Derived from Human Papillomavirus
TSLQDVSIACV

SEQ ID NO: 23454 - protein, 10 aa, Artificial Sequence
  Peptide Derived from Human Papillomavirus
VSIACVYCKA

SEQ ID NO: 23455 - protein, 8 aa, Artificial Sequence
  Peptide Derived from Human Papillomavirus
YAACHKCI

SEQ ID NO: 23456 - protein, 10 aa, Artificial Sequence
  Peptide Derived from Human Papillomavirus
YAACHKCIDF

SEQ ID NO: 23457 - protein, 11 aa, Artificial Sequence
  Peptide Derived from Human Papillomavirus
YAACHKCIDFY

SEQ ID NO: 23458 - protein, 10 aa, Artificial Sequence
  Peptide Derived from Human Papillomavirus
YSNSVYGETL

SEQ ID NO: 23459 - protein, 9 aa, Artificial Sequence
  Peptide Derived from Human Papillomavirus
YSRIRELRY

SEQ ID NO: 23460 - protein, 10 aa, Artificial Sequence
  Peptide Derived from Human Papillomavirus
YSRIRELRYY

SEQ ID NO: 23461 - protein, 8 aa, Artificial Sequence
  Peptide Derived from Human Papillomavirus
ATLQEIVL

SEQ ID NO: 23462 - protein, 10 aa, Artificial Sequence
  Peptide Derived from Human Papillomavirus
ATLQEIVLHL

SEQ ID NO: 23463 - protein, 8 aa, Artificial Sequence
  Peptide Derived from Human Papillomavirus
EADGVSHA

SEQ ID NO: 23464 - protein, 10 aa, Artificial Sequence
  Peptide Derived from Human Papillomavirus
EADGVSHAQL

SEQ ID NO: 23465 - protein, 9 aa, Artificial Sequence
  Peptide Derived from Human Papillomavirus
ESEEENDEA

SEQ ID NO: 23466 - protein, 10 aa, Artificial Sequence
  Peptide Derived from Human Papillomavirus
ESSADDLRTL

SEQ ID NO: 23467 - protein, 9 aa, Artificial Sequence
  Peptide Derived from Human Papillomavirus
HAQLPARRA

SEQ ID NO: 23468 - protein, 11 aa, Artificial Sequence
  Peptide Derived from Human Papillomavirus
LSESEEENDEA

SEQ ID NO: 23469 - protein, 9 aa, Artificial Sequence
  Peptide Derived from Human Papillomavirus
LSFVCPWCA

SEQ ID NO: 23470 - protein, 10 aa, Artificial Sequence
  Peptide Derived from Human Papillomavirus
LSTLSFVCPW

SEQ ID NO: 23471 - protein, 10 aa, Artificial Sequence
  Peptide Derived from Human Papillomavirus
LTVESSADDL

SEQ ID NO: 23472 - protein, 9 aa, Artificial Sequence
  Peptide Derived from Human Papillomavirus
RAEPQRHKI

SEQ ID NO: 23473 - protein, 10 aa, Artificial Sequence
  Peptide Derived from Human Papillomavirus
RAEPQRHKIL

SEQ ID NO: 23474 - protein, 8 aa, Artificial Sequence
  Peptide Derived from Human Papillomavirus
RATLQEIV

SEQ ID NO: 23475 - protein, 9 aa, Artificial Sequence
  Peptide Derived from Human Papillomavirus
RATLQEIVL

SEQ ID NO: 23476 - protein, 11 aa, Artificial Sequence
  Peptide Derived from Human Papillomavirus
RATLQEIVLHL

SEQ ID NO: 23477 - protein, 8 aa, Artificial Sequence
  Peptide Derived from Human Papillomavirus
RTLQQLFL

SEQ ID NO: 23478 - protein, 11 aa, Artificial Sequence
  Peptide Derived from Human Papillomavirus
RTLQQLFLSTL

SEQ ID NO: 23479 - protein, 8 aa, Artificial Sequence
  Peptide Derived from Human Papillomavirus
SADDLRTL

SEQ ID NO: 23480 - protein, 11 aa, Artificial Sequence
  Peptide Derived from Human Papillomavirus
SADDLRTLQQL

SEQ ID NO: 23481 - protein, 9 aa, Artificial Sequence
  Peptide Derived from Human Papillomavirus
SSADDLRTL

SEQ ID NO: 23482 - protein, 9 aa, Artificial Sequence
  Peptide Derived from Human Papillomavirus
STLSFVCPW

SEQ ID NO: 23483 - protein, 11 aa, Artificial Sequence
  Peptide Derived from Human Papillomavirus
STLSFVCPWCA

SEQ ID NO: 23484 - protein, 8 aa, Artificial Sequence
  Peptide Derived from Human Papillomavirus
VSHAQLPA

SEQ ID NO: 23485 - protein, 11 aa, Artificial Sequence
  Peptide Derived from Human Papillomavirus
VSHAQLPARRA

SEQ ID NO: 23486 - protein, 11 aa, Artificial Sequence
  Peptide Derived from Human Papillomavirus
AASTSTASRPA

SEQ ID NO: 23487 - protein, 10 aa, Artificial Sequence
  Peptide Derived from Human Papillomavirus
AATAVITQDV

SEQ ID NO: 23488 - protein, 8 aa, Artificial Sequence
  Peptide Derived from Human Papillomavirus
ASRPAKRV

SEQ ID NO: 23489 - protein, 10 aa, Artificial Sequence
  Peptide Derived from Human Papillomavirus
ASRPAKRVRI

SEQ ID NO: 23490 - protein, 11 aa, Artificial Sequence
  Peptide Derived from Human Papillomavirus
ASTQNPVPNTY

SEQ ID NO: 23491 - protein, 10 aa, Artificial Sequence
  Peptide Derived from Human Papillomavirus
ASTSTASRPA

SEQ ID NO: 23492 - protein, 9 aa, Artificial Sequence
  Peptide Derived from Human Papillomavirus
ATAVITQDV

SEQ ID NO: 23493 - protein, 8 aa, Artificial Sequence
  Peptide Derived from Human Papillomavirus
CASTQNPV

SEQ ID NO: 23494 - protein, 9 aa, Artificial Sequence
  Peptide Derived from Human Papillomavirus
CTITLTAEV

SEQ ID NO: 23495 - protein, 10 aa, Artificial Sequence
  Peptide Derived from Human Papillomavirus
CTITLTAEVM

SEQ ID NO: 23496 - protein, 9 aa, Artificial Sequence
  Peptide Derived from Human Papillomavirus
DSQLFNKPY

SEQ ID NO: 23497 - protein, 10 aa, Artificial Sequence
  Peptide Derived from Human Papillomavirus
DSQLFNKPYW

SEQ ID NO: 23498 - protein, 11 aa, Artificial Sequence
  Peptide Derived from Human Papillomavirus
DSQLFNKPYWL

SEQ ID NO: 23499 - protein, 11 aa, Artificial Sequence
  Peptide Derived from Human Papillomavirus
DSTVYLPPPSV

SEQ ID NO: 23500 - protein, 8 aa, Artificial Sequence
  Peptide Derived from Human Papillomavirus
DTESAHAA

SEQ ID NO: 23501 - protein, 10 aa, Artificial Sequence
  Peptide Derived from Human Papillomavirus
DTESAHAATA

SEQ ID NO: 23502 - protein, 11 aa, Artificial Sequence
  Peptide Derived from Human Papillomavirus
DTESAHAATAV

SEQ ID NO: 23503 - protein, 9 aa, Artificial Sequence
  Peptide Derived from Human Papillomavirus
DTGYGAMDF

SEQ ID NO: 23504 - protein, 8 aa, Artificial Sequence
  Peptide Derived from Human Papillomavirus
DTKCEVPL

SEQ ID NO: 23505 - protein, 10 aa, Artificial Sequence
  Peptide Derived from Human Papillomavirus
DTKCEVPLDI

SEQ ID NO: 23506 - protein, 11 aa, Artificial Sequence
  Peptide Derived from Human Papillomavirus
DTTPPEKQDPY

SEQ ID NO: 23507 - protein, 8 aa, Artificial Sequence
  Peptide Derived from Human Papillomavirus
DTTRSTNL

SEQ ID NO: 23508 - protein, 10 aa, Artificial Sequence
  Peptide Derived from Human Papillomavirus
DTTRSTNLTL

SEQ ID NO: 23509 - protein, 8 aa, Artificial Sequence
  Peptide Derived from Human Papillomavirus
DTVPTDLY

SEQ ID NO: 23510 - protein, 9 aa, Artificial Sequence
  Peptide Derived from Human Papillomavirus
DTVPTDLYI

SEQ ID NO: 23511 - protein, 9 aa, Artificial Sequence
  Peptide Derived from Human Papillomavirus
DTYRFVQSV

SEQ ID NO: 23512 - protein, 10 aa, Artificial Sequence
  Peptide Derived from Human Papillomavirus
DTYRFVQSVA

SEQ ID NO: 23513 - protein, 11 aa, Artificial Sequence
  Peptide Derived from Human Papillomavirus
DTYRFVQSVAV

SEQ ID NO: 23514 - protein, 8 aa, Artificial Sequence
  Peptide Derived from Human Papillomavirus
ESAHAATA

SEQ ID NO: 23515 - protein, 9 aa, Artificial Sequence
  Peptide Derived from Human Papillomavirus
ESAHAATAV

SEQ ID NO: 23516 - protein, 10 aa, Artificial Sequence
  Peptide Derived from Human Papillomavirus
ESAHAATAVI

SEQ ID NO: 23517 - protein, 8 aa, Artificial Sequence
  Peptide Derived from Human Papillomavirus
ETPGSCVY

SEQ ID NO: 23518 - protein, 8 aa, Artificial Sequence
  Peptide Derived from Human Papillomavirus
ETQRLVWA

SEQ ID NO: 23519 - protein, 10 aa, Artificial Sequence
  Peptide Derived from Human Papillomavirus
ETQRLVWACV

SEQ ID NO: 23520 - protein, 9 aa, Artificial Sequence
  Peptide Derived from Human Papillomavirus
FARHFWNRA

SEQ ID NO: 23521 - protein, 11 aa, Artificial Sequence
  Peptide Derived from Human Papillomavirus
FARHFWNRAGV

SEQ ID NO: 23522 - protein, 8 aa, Artificial Sequence
  Peptide Derived from Human Papillomavirus
FSSDLDQY

SEQ ID NO: 23523 - protein, 10 aa, Artificial Sequence
  Peptide Derived from Human Papillomavirus
FSSDLDQYPL

SEQ ID NO: 23524 - protein, 11 aa, Artificial Sequence
  Peptide Derived from Human Papillomavirus
FSTLQDTKCEV

SEQ ID NO: 23525 - protein, 8 aa, Artificial Sequence
  Peptide Derived from Human Papillomavirus
GAGNKQAV

SEQ ID NO: 23526 - protein, 11 aa, Artificial Sequence
  Peptide Derived from Human Papillomavirus
GAGNKQAVPKV

SEQ ID NO: 23527 - protein, 8 aa, Artificial Sequence
  Peptide Derived from Human Papillomavirus
GAMDFSTL

SEQ ID NO: 23528 - protein, 10 aa, Artificial Sequence
  Peptide Derived from Human Papillomavirus
GSITTSDSQL

SEQ ID NO: 23529 - protein, 11 aa, Artificial Sequence
  Peptide Derived from Human Papillomavirus
GSITTSDSQLF

SEQ ID NO: 23530 - protein, 8 aa, Artificial Sequence
  Peptide Derived from Human Papillomavirus
GSSRLLTV

SEQ ID NO: 23531 - protein, 9 aa, Artificial Sequence
  Peptide Derived from Human Papillomavirus
GTLCKPAQL

SEQ ID NO: 23532 - protein, 11 aa, Artificial Sequence
  Peptide Derived from Human Papillomavirus
HAATAVITQDV

SEQ ID NO: 23533 - protein, 8 aa, Artificial Sequence
  Peptide Derived from Human Papillomavirus
HAGSSRLL

SEQ ID NO: 23534 - protein, 10 aa, Artificial Sequence
  Peptide Derived from Human Papillomavirus
HAGSSRLLTV

SEQ ID NO: 23535 - protein, 8 aa, Artificial Sequence
  Peptide Derived from Human Papillomavirus
HSMNSSIL

SEQ ID NO: 23536 - protein, 11 aa, Artificial Sequence
  Peptide Derived from Human Papillomavirus
HSMNSSILENW

SEQ ID NO: 23537 - protein, 8 aa, Artificial Sequence
  Peptide Derived from Human Papillomavirus
ITLTAEVM

SEQ ID NO: 23538 - protein, 10 aa, Artificial Sequence
  Peptide Derived from Human Papillomavirus
ITLTAEVMSY

SEQ ID NO: 23539 - protein, 11 aa, Artificial Sequence
  Peptide Derived from Human Papillomavirus
ITLTAEVMSYI

SEQ ID NO: 23540 - protein, 9 aa, Artificial Sequence
  Peptide Derived from Human Papillomavirus
ITQDVRDNV

SEQ ID NO: 23541 - protein, 11 aa, Artificial Sequence
  Peptide Derived from Human Papillomavirus
ITQDVRDNVSV

SEQ ID NO: 23542 - protein, 8 aa, Artificial Sequence
  Peptide Derived from Human Papillomavirus
ITTSDSQL

SEQ ID NO: 23543 - protein, 9 aa, Artificial Sequence
  Peptide Derived from Human Papillomavirus
ITTSDSQLF

SEQ ID NO: 23544 - protein, 9 aa, Artificial Sequence
  Peptide Derived from Human Papillomavirus
KAQGHNNGI

SEQ ID NO: 23545 - protein, 11 aa, Artificial Sequence
  Peptide Derived from Human Papillomavirus
KAQGHNNGICW

SEQ ID NO: 23546 - protein, 10 aa, Artificial Sequence
  Peptide Derived from Human Papillomavirus
LSGHPFYNKL

SEQ ID NO: 23547 - protein, 8 aa, Artificial Sequence
  Peptide Derived from Human Papillomavirus
LTAEVMSY

SEQ ID NO: 23548 - protein, 9 aa, Artificial Sequence
  Peptide Derived from Human Papillomavirus
LTAEVMSYI

SEQ ID NO: 23549 - protein, 11 aa, Artificial Sequence
  Peptide Derived from Human Papillomavirus
LTLCASTQNPV

SEQ ID NO: 23550 - protein, 8 aa, Artificial Sequence
  Peptide Derived from Human Papillomavirus
LTVGNPYF

SEQ ID NO: 23551 - protein, 10 aa, Artificial Sequence
  Peptide Derived from Human Papillomavirus
LTVGNPYFRV

SEQ ID NO: 23552 - protein, 11 aa, Artificial Sequence
  Peptide Derived from Human Papillomavirus
LTVGNPYFRVV

SEQ ID NO: 23553 - protein, 11 aa, Artificial Sequence
  Peptide Derived from Human Papillomavirus
MAHNIIYGHGI

SEQ ID NO: 23554 - protein, 11 aa, Artificial Sequence
  Peptide Derived from Human Papillomavirus
MALWRPSDSTV

SEQ ID NO: 23555 - protein, 10 aa, Artificial Sequence
  Peptide Derived from Human Papillomavirus
MSADPYGDSM

SEQ ID NO: 23556 - protein, 11 aa, Artificial Sequence
  Peptide Derived from Human Papillomavirus
MSADPYGDSMF

SEQ ID NO: 23557 - protein, 11 aa, Artificial Sequence
  Peptide Derived from Human Papillomavirus
MSYIHSMNSSI

SEQ ID NO: 23558 - protein, 8 aa, Artificial Sequence
  Peptide Derived from Human Papillomavirus
NSSILENW

SEQ ID NO: 23559 - protein, 10 aa, Artificial Sequence
  Peptide Derived from Human Papillomavirus
NSSILENWNF

SEQ ID NO: 23560 - protein, 11 aa, Artificial Sequence
  Peptide Derived from Human Papillomavirus
NTDDYVSRTSI

SEQ ID NO: 23561 - protein, 9 aa, Artificial Sequence
  Peptide Derived from Human Papillomavirus
NTIIEDGDM

SEQ ID NO: 23562 - protein, 10 aa, Artificial Sequence
  Peptide Derived from Human Papillomavirus
NTIIEDGDMV

SEQ ID NO: 23563 - protein, 8 aa, Artificial Sequence
  Peptide Derived from Human Papillomavirus
NTYDPTKF

SEQ ID NO: 23564 - protein, 11 aa, Artificial Sequence
  Peptide Derived from Human Papillomavirus
NTYDPTKFKHY

SEQ ID NO: 23565 - protein, 8 aa, Artificial Sequence
  Peptide Derived from Human Papillomavirus
PAASTSTA

SEQ ID NO: 23566 - protein, 8 aa, Artificial Sequence
  Peptide Derived from Human Papillomavirus
PAIGEHWA

SEQ ID NO: 23567 - protein, 8 aa, Artificial Sequence
  Peptide Derived from Human Papillomavirus
PSDSTVYL

SEQ ID NO: 23568 - protein, 9 aa, Artificial Sequence
  Peptide Derived from Human Papillomavirus
PSGAGNKQA

SEQ ID NO: 23569 - protein, 10 aa, Artificial Sequence
  Peptide Derived from Human Papillomavirus
PSGAGNKQAV

SEQ ID NO: 23570 - protein, 11 aa, Artificial Sequence
  Peptide Derived from Human Papillomavirus
PTDLYIKGTSA

SEQ ID NO: 23571 - protein, 10 aa, Artificial Sequence
  Peptide Derived from Human Papillomavirus
PTIGPRKRPA

SEQ ID NO: 23572 - protein, 11 aa, Artificial Sequence
  Peptide Derived from Human Papillomavirus
PTIGPRKRPAA

SEQ ID NO: 23573 - protein, 11 aa, Artificial Sequence
  Peptide Derived from Human Papillomavirus
PTKFKHYSRHV

SEQ ID NO: 23574 - protein, 9 aa, Artificial Sequence
  Peptide Derived from Human Papillomavirus
PTTSLVDTY

SEQ ID NO: 23575 - protein, 11 aa, Artificial Sequence
  Peptide Derived from Human Papillomavirus
PTTSLVDTYRF

SEQ ID NO: 23576 - protein, 10 aa, Artificial Sequence
  Peptide Derived from Human Papillomavirus
QAGLRRRPTI

SEQ ID NO: 23577 - protein, 8 aa, Artificial Sequence
  Peptide Derived from Human Papillomavirus
QAVPKVSA

SEQ ID NO: 23578 - protein, 9 aa, Artificial Sequence
  Peptide Derived from Human Papillomavirus
QAVPKVSAY

SEQ ID NO: 23579 - protein, 11 aa, Artificial Sequence
  Peptide Derived from Human Papillomavirus
QAVPKVSAYQY

SEQ ID NO: 23580 - protein, 9 aa, Artificial Sequence
  Peptide Derived from Human Papillomavirus
QSICKYPDY

SEQ ID NO: 23581 - protein, 10 aa, Artificial Sequence
  Peptide Derived from Human Papillomavirus
QSICKYPDYL

SEQ ID NO: 23582 - protein, 10 aa, Artificial Sequence
  Peptide Derived from Human Papillomavirus
QTQLCILGCV

SEQ ID NO: 23583 - protein, 9 aa, Artificial Sequence
  Peptide Derived from Human Papillomavirus
RAGVMGDTV

SEQ ID NO: 23584 - protein, 9 aa, Artificial Sequence
  Peptide Derived from Human Papillomavirus
RSTNLTLCA

SEQ ID NO: 23585 - protein, 8 aa, Artificial Sequence
  Peptide Derived from Human Papillomavirus
RTSIFYHA

SEQ ID NO: 23586 - protein, 9 aa, Artificial Sequence
  Peptide Derived from Human Papillomavirus
SADPYGDSM

SEQ ID NO: 23587 - protein, 10 aa, Artificial Sequence
  Peptide Derived from Human Papillomavirus
SADPYGDSMF

SEQ ID NO: 23588 - protein, 11 aa, Artificial Sequence
  Peptide Derived from Human Papillomavirus
SADPYGDSMFF

SEQ ID NO: 23589 - protein, 8 aa, Artificial Sequence
  Peptide Derived from Human Papillomavirus
SAHAATAV

SEQ ID NO: 23590 - protein, 9 aa, Artificial Sequence
  Peptide Derived from Human Papillomavirus
SAHAATAVI

SEQ ID NO: 23591 - protein, 8 aa, Artificial Sequence
  Peptide Derived from Human Papillomavirus
SAYQYRVF

SEQ ID NO: 23592 - protein, 10 aa, Artificial Sequence
  Peptide Derived from Human Papillomavirus
SAYQYRVFRV

SEQ ID NO: 23593 - protein, 11 aa, Artificial Sequence
  Peptide Derived from Human Papillomavirus
SAYQYRVFRVA

SEQ ID NO: 23594 - protein, 9 aa, Artificial Sequence
  Peptide Derived from Human Papillomavirus
SSDLDQYPL

SEQ ID NO: 23595 - protein, 9 aa, Artificial Sequence
  Peptide Derived from Human Papillomavirus
SSILENWNF

SEQ ID NO: 23596 - protein, 11 aa, Artificial Sequence
  Peptide Derived from Human Papillomavirus
SSILENWNFGV

SEQ ID NO: 23597 - protein, 11 aa, Artificial Sequence
  Peptide Derived from Human Papillomavirus
SSRLLTVGNPY

SEQ ID NO: 23598 - protein, 10 aa, Artificial Sequence
  Peptide Derived from Human Papillomavirus
STASRPAKRV

SEQ ID NO: 23599 - protein, 11 aa, Artificial Sequence
  Peptide Derived from Human Papillomavirus
STIYNPETQRL

SEQ ID NO: 23600 - protein, 10 aa, Artificial Sequence
  Peptide Derived from Human Papillomavirus
STLQDTKCEV

SEQ ID NO: 23601 - protein, 8 aa, Artificial Sequence
  Peptide Derived from Human Papillomavirus
STNLTLCA

SEQ ID NO: 23602 - protein, 10 aa, Artificial Sequence
  Peptide Derived from Human Papillomavirus
STQNPVPNTY

SEQ ID NO: 23603 - protein, 9 aa, Artificial Sequence
  Peptide Derived from Human Papillomavirus
STSTASRPA

SEQ ID NO: 23604 - protein, 10 aa, Artificial Sequence
  Peptide Derived from Human Papillomavirus
STVYLPPPSV

SEQ ID NO: 23605 - protein, 11 aa, Artificial Sequence
  Peptide Derived from Human Papillomavirus
STVYLPPPSVA

SEQ ID NO: 23606 - protein, 8 aa, Artificial Sequence
  Peptide Derived from Human Papillomavirus
TAEVMSYI

SEQ ID NO: 23607 - protein, 11 aa, Artificial Sequence
  Peptide Derived from Human Papillomavirus
TAEVMSYIHSM

SEQ ID NO: 23608 - protein, 9 aa, Artificial Sequence
  Peptide Derived from Human Papillomavirus
TASRPAKRV

SEQ ID NO: 23609 - protein, 11 aa, Artificial Sequence
  Peptide Derived from Human Papillomavirus
TASRPAKRVRI

SEQ ID NO: 23610 - protein, 8 aa, Artificial Sequence
  Peptide Derived from Human Papillomavirus
TAVITQDV

SEQ ID NO: 23611 - protein, 11 aa, Artificial Sequence
  Peptide Derived from Human Papillomavirus
TSDSQLFNKPY

SEQ ID NO: 23612 - protein, 9 aa, Artificial Sequence
  Peptide Derived from Human Papillomavirus
TSLVDTYRF

SEQ ID NO: 23613 - protein, 10 aa, Artificial Sequence
  Peptide Derived from Human Papillomavirus
TSLVDTYRFV

SEQ ID NO: 23614 - protein, 8 aa, Artificial Sequence
  Peptide Derived from Human Papillomavirus
TSTASRPA

SEQ ID NO: 23615 - protein, 11 aa, Artificial Sequence
  Peptide Derived from Human Papillomavirus
TSTASRPAKRV

SEQ ID NO: 23616 - protein, 10 aa, Artificial Sequence
  Peptide Derived from Human Papillomavirus
TTPPEKQDPY

SEQ ID NO: 23617 - protein, 9 aa, Artificial Sequence
  Peptide Derived from Human Papillomavirus
TTRSTNLTL

SEQ ID NO: 23618 - protein, 11 aa, Artificial Sequence
  Peptide Derived from Human Papillomavirus
TTRSTNLTLCA

SEQ ID NO: 23619 - protein, 8 aa, Artificial Sequence
  Peptide Derived from Human Papillomavirus
TTSDSQLF

SEQ ID NO: 23620 - protein, 8 aa, Artificial Sequence
  Peptide Derived from Human Papillomavirus
TTSLVDTY

SEQ ID NO: 23621 - protein, 10 aa, Artificial Sequence
  Peptide Derived from Human Papillomavirus
TTSLVDTYRF

SEQ ID NO: 23622 - protein, 11 aa, Artificial Sequence
  Peptide Derived from Human Papillomavirus
TTSLVDTYRFV

SEQ ID NO: 23623 - protein, 9 aa, Artificial Sequence
  Peptide Derived from Human Papillomavirus
VALPDPNKF

SEQ ID NO: 23624 - protein, 11 aa, Artificial Sequence
  Peptide Derived from Human Papillomavirus
VALPDPNKFGL

SEQ ID NO: 23625 - protein, 10 aa, Artificial Sequence
  Peptide Derived from Human Papillomavirus
VARVVNTDDY

SEQ ID NO: 23626 - protein, 11 aa, Artificial Sequence
  Peptide Derived from Human Papillomavirus
VARVVNTDDYV

SEQ ID NO: 23627 - protein, 8 aa, Artificial Sequence
  Peptide Derived from Human Papillomavirus
VSAYQYRV

SEQ ID NO: 23628 - protein, 9 aa, Artificial Sequence
  Peptide Derived from Human Papillomavirus
VSAYQYRVF

SEQ ID NO: 23629 - protein, 11 aa, Artificial Sequence
  Peptide Derived from Human Papillomavirus
VSAYQYRVFRV

SEQ ID NO: 23630 - protein, 8 aa, Artificial Sequence
  Peptide Derived from Human Papillomavirus
VSRTSIFY

SEQ ID NO: 23631 - protein, 10 aa, Artificial Sequence
  Peptide Derived from Human Papillomavirus
VSRTSIFYHA

SEQ ID NO: 23632 - protein, 10 aa, Artificial Sequence
  Peptide Derived from Human Papillomavirus
VSVDYKQTQL

SEQ ID NO: 23633 - protein, 8 aa, Artificial Sequence
  Peptide Derived from Human Papillomavirus
WACVGMEI

SEQ ID NO: 23634 - protein, 10 aa, Artificial Sequence
  Peptide Derived from Human Papillomavirus
WAKGTLCKPA

SEQ ID NO: 23635 - protein, 9 aa, Artificial Sequence
  Peptide Derived from Human Papillomavirus
WTVDLKEKF

SEQ ID NO: 23636 - protein, 9 aa, Artificial Sequence
  Peptide Derived from Human Papillomavirus
YSPSPSGSI

SEQ ID NO: 23637 - protein, 8 aa, Artificial Sequence
  Peptide Derived from Human Papillomavirus
YSRHVEEY

SEQ ID NO: 23638 - protein, 10 aa, Artificial Sequence
  Peptide Derived from Human Papillomavirus
YSRHVEEYDL

SEQ ID NO: 23639 - protein, 9 aa, Artificial Sequence
  Peptide Derived from Human Papillomavirus
AARRKRASA

SEQ ID NO: 23640 - protein, 8 aa, Artificial Sequence
  Peptide Derived from Human Papillomavirus
AASSYSNV

SEQ ID NO: 23641 - protein, 10 aa, Artificial Sequence
  Peptide Derived from Human Papillomavirus
AASSYSNVTV

SEQ ID NO: 23642 - protein, 8 aa, Artificial Sequence
  Peptide Derived from Human Papillomavirus
AATEEIEL

SEQ ID NO: 23643 - protein, 11 aa, Artificial Sequence
  Peptide Derived from Human Papillomavirus
AATEEIELQPL

SEQ ID NO: 23644 - protein, 9 aa, Artificial Sequence
  Peptide Derived from Human Papillomavirus
ASGAPVPTF

SEQ ID NO: 23645 - protein, 10 aa, Artificial Sequence
  Peptide Derived from Human Papillomavirus
ASSGSGTEPI

SEQ ID NO: 23646 - protein, 9 aa, Artificial Sequence
  Peptide Derived from Human Papillomavirus
ASSYSNVTV

SEQ ID NO: 23647 - protein, 11 aa, Artificial Sequence
  Peptide Derived from Human Papillomavirus
ASSYSNVTVPL

SEQ ID NO: 23648 - protein, 8 aa, Artificial Sequence
  Peptide Derived from Human Papillomavirus
ASTTPSTI

SEQ ID NO: 23649 - protein, 9 aa, Artificial Sequence
  Peptide Derived from Human Papillomavirus
ASTTTYIGI

SEQ ID NO: 23650 - protein, 10 aa, Artificial Sequence
  Peptide Derived from Human Papillomavirus
ATEEIELQPL

SEQ ID NO: 23651 - protein, 11 aa, Artificial Sequence
  Peptide Derived from Human Papillomavirus
ATEEIELQPLI

SEQ ID NO: 23652 - protein, 11 aa, Artificial Sequence
  Peptide Derived from Human Papillomavirus
ATMFTRSGKQI

SEQ ID NO: 23653 - protein, 8 aa, Artificial Sequence
  Peptide Derived from Human Papillomavirus
ATNDSDLF

SEQ ID NO: 23654 - protein, 10 aa, Artificial Sequence
  Peptide Derived from Human Papillomavirus
ATNDSDLFDV

SEQ ID NO: 23655 - protein, 11 aa, Artificial Sequence
  Peptide Derived from Human Papillomavirus
ATNDSDLFDVY

SEQ ID NO: 23656 - protein, 8 aa, Artificial Sequence
  Peptide Derived from Human Papillomavirus
DSDFMDII

SEQ ID NO: 23657 - protein, 10 aa, Artificial Sequence
  Peptide Derived from Human Papillomavirus
DSDFMDIIRL

SEQ ID NO: 23658 - protein, 8 aa, Artificial Sequence
  Peptide Derived from Human Papillomavirus
DSDLFDVY

SEQ ID NO: 23659 - protein, 9 aa, Artificial Sequence
  Peptide Derived from Human Papillomavirus
DSDLFDVYA

SEQ ID NO: 23660 - protein, 11 aa, Artificial Sequence
  Peptide Derived from Human Papillomavirus
DSDLFDVYADF

SEQ ID NO: 23661 - protein, 9 aa, Artificial Sequence
  Peptide Derived from Human Papillomavirus
DSSVVASGA

SEQ ID NO: 23662 - protein, 11 aa, Artificial Sequence
  Peptide Derived from Human Papillomavirus
DSSVVASGAPV

SEQ ID NO: 23663 - protein, 10 aa, Artificial Sequence
  Peptide Derived from Human Papillomavirus
DSVSISSTSF

SEQ ID NO: 23664 - protein, 8 aa, Artificial Sequence
  Peptide Derived from Human Papillomavirus
FADGFVAA

SEQ ID NO: 23665 - protein, 11 aa, Artificial Sequence
  Peptide Derived from Human Papillomavirus
FASSGSGTEPI

SEQ ID NO: 23666 - protein, 9 aa, Artificial Sequence
  Peptide Derived from Human Papillomavirus
FSDPSIIEV

SEQ ID NO: 23667 - protein, 8 aa, Artificial Sequence
  Peptide Derived from Human Papillomavirus
FSRLGQRA

SEQ ID NO: 23668 - protein, 10 aa, Artificial Sequence
  Peptide Derived from Human Papillomavirus
FSRLGQRATM

SEQ ID NO: 23669 - protein, 11 aa, Artificial Sequence
  Peptide Derived from Human Papillomavirus
FSRLGQRATMF

SEQ ID NO: 23670 - protein, 9 aa, Artificial Sequence
  Peptide Derived from Human Papillomavirus
FTGTSGFEI

SEQ ID NO: 23671 - protein, 11 aa, Artificial Sequence
  Peptide Derived from Human Papillomavirus
FTNPAFSDPSI

SEQ ID NO: 23672 - protein, 8 aa, Artificial Sequence
  Peptide Derived from Human Papillomavirus
FTRSGKQI

SEQ ID NO: 23673 - protein, 8 aa, Artificial Sequence
  Peptide Derived from Human Papillomavirus
FTYPKYSL

SEQ ID NO: 23674 - protein, 10 aa, Artificial Sequence
  Peptide Derived from Human Papillomavirus
FTYPKYSLTM

SEQ ID NO: 23675 - protein, 8 aa, Artificial Sequence
  Peptide Derived from Human Papillomavirus
GSGGRTGY

SEQ ID NO: 23676 - protein, 9 aa, Artificial Sequence
  Peptide Derived from Human Papillomavirus
GSGGRTGYV

SEQ ID NO: 23677 - protein, 11 aa, Artificial Sequence
  Peptide Derived from Human Papillomavirus
GSGGRTGYVPL

SEQ ID NO: 23678 - protein, 10 aa, Artificial Sequence
  Peptide Derived from Human Papillomavirus
GSGSGGRTGY

SEQ ID NO: 23679 - protein, 11 aa, Artificial Sequence
  Peptide Derived from Human Papillomavirus
GSGSGGRTGYV

SEQ ID NO: 23680 - protein, 8 aa, Artificial Sequence
  Peptide Derived from Human Papillomavirus
GSHGYEEI

SEQ ID NO: 23681 - protein, 10 aa, Artificial Sequence
  Peptide Derived from Human Papillomavirus
GSHGYEEIPL

SEQ ID NO: 23682 - protein, 8 aa, Artificial Sequence
  Peptide Derived from Human Papillomavirus
GTCPPDVI

SEQ ID NO: 23683 - protein, 11 aa, Artificial Sequence
  Peptide Derived from Human Papillomavirus
GTCPPDVINKV

SEQ ID NO: 23684 - protein, 10 aa, Artificial Sequence
  Peptide Derived from Human Papillomavirus
GTEPISSTPL

SEQ ID NO: 23685 - protein, 10 aa, Artificial Sequence
  Peptide Derived from Human Papillomavirus
GTPTSGSHGY

SEQ ID NO: 23686 - protein, 9 aa, Artificial Sequence
  Peptide Derived from Human Papillomavirus
GTQYYLWPW

SEQ ID NO: 23687 - protein, 10 aa, Artificial Sequence
  Peptide Derived from Human Papillomavirus
GTQYYLWPWY

SEQ ID NO: 23688 - protein, 11 aa, Artificial Sequence
  Peptide Derived from Human Papillomavirus
GTQYYLWPWYY

SEQ ID NO: 23689 - protein, 8 aa, Artificial Sequence
  Peptide Derived from Human Papillomavirus
GTTLADKI

SEQ ID NO: 23690 - protein, 9 aa, Artificial Sequence
  Peptide Derived from Human Papillomavirus
GTTLADKIL

SEQ ID NO: 23691 - protein, 11 aa, Artificial Sequence
  Peptide Derived from Human Papillomavirus
GTTLADKILQW

SEQ ID NO: 23692 - protein, 8 aa, Artificial Sequence
  Peptide Derived from Human Papillomavirus
GTTTPAVL

SEQ ID NO: 23693 - protein, 10 aa, Artificial Sequence
  Peptide Derived from Human Papillomavirus
GTTTPAVLDI

SEQ ID NO: 23694 - protein, 8 aa, Artificial Sequence
  Peptide Derived from Human Papillomavirus
GTVRFSRL

SEQ ID NO: 23695 - protein, 9 aa, Artificial Sequence
  Peptide Derived from Human Papillomavirus
IAATEEIEL

SEQ ID NO: 23696 - protein, 9 aa, Artificial Sequence
  Peptide Derived from Human Papillomavirus
ISATNDSDL

SEQ ID NO: 23697 - protein, 10 aa, Artificial Sequence
  Peptide Derived from Human Papillomavirus
ISATNDSDLF

SEQ ID NO: 23698 - protein, 10 aa, Artificial Sequence
  Peptide Derived from Human Papillomavirus
ISPIAATEEI

SEQ ID NO: 23699 - protein, 9 aa, Artificial Sequence
  Peptide Derived from Human Papillomavirus
ISSTPLPTV

SEQ ID NO: 23700 - protein, 10 aa, Artificial Sequence
  Peptide Derived from Human Papillomavirus
ISSTSFTNPA

SEQ ID NO: 23701 - protein, 11 aa, Artificial Sequence
  Peptide Derived from Human Papillomavirus
ISSTSFTNPAF

SEQ ID NO: 23702 - protein, 8 aa, Artificial Sequence
  Peptide Derived from Human Papillomavirus
ITPTVDSV

SEQ ID NO: 23703 - protein, 10 aa, Artificial Sequence
  Peptide Derived from Human Papillomavirus
ITPTVDSVSI

SEQ ID NO: 23704 - protein, 10 aa, Artificial Sequence
  Peptide Derived from Human Papillomavirus
ITSSGTTTPA

SEQ ID NO: 23705 - protein, 11 aa, Artificial Sequence
  Peptide Derived from Human Papillomavirus
ITSSGTTTPAV

SEQ ID NO: 23706 - protein, 8 aa, Artificial Sequence
  Peptide Derived from Human Papillomavirus
KSFTYPKY

SEQ ID NO: 23707 - protein, 10 aa, Artificial Sequence
  Peptide Derived from Human Papillomavirus
KSFTYPKYSL

SEQ ID NO: 23708 - protein, 8 aa, Artificial Sequence
  Peptide Derived from Human Papillomavirus
LADKILQW

SEQ ID NO: 23709 - protein, 11 aa, Artificial Sequence
  Peptide Derived from Human Papillomavirus
LADKILQWSSL

SEQ ID NO: 23710 - protein, 9 aa, Artificial Sequence
  Peptide Derived from Human Papillomavirus
LSFEPTSNV

SEQ ID NO: 23711 - protein, 8 aa, Artificial Sequence
  Peptide Derived from Human Papillomavirus
LSSRRGTV

SEQ ID NO: 23712 - protein, 10 aa, Artificial Sequence
  Peptide Derived from Human Papillomavirus
LSSRRGTVRF

SEQ ID NO: 23713 - protein, 8 aa, Artificial Sequence
  Peptide Derived from Human Papillomavirus
LTHPSSLV

SEQ ID NO: 23714 - protein, 10 aa, Artificial Sequence
  Peptide Derived from Human Papillomavirus
LTHPSSLVTF

SEQ ID NO: 23715 - protein, 8 aa, Artificial Sequence
  Peptide Derived from Human Papillomavirus
LTMPSTAA

SEQ ID NO: 23716 - protein, 11 aa, Artificial Sequence
  Peptide Derived from Human Papillomavirus
LTMPSTAASSY

SEQ ID NO: 23717 - protein, 9 aa, Artificial Sequence
  Peptide Derived from Human Papillomavirus
LTSAWDVPI

SEQ ID NO: 23718 - protein, 10 aa, Artificial Sequence
  Peptide Derived from Human Papillomavirus
LTSAWDVPIY

SEQ ID NO: 23719 - protein, 8 aa, Artificial Sequence
  Peptide Derived from Human Papillomavirus
NASTTTYI

SEQ ID NO: 23720 - protein, 10 aa, Artificial Sequence
  Peptide Derived from Human Papillomavirus
NASTTTYIGI

SEQ ID NO: 23721 - protein, 8 aa, Artificial Sequence
  Peptide Derived from Human Papillomavirus
PAFSDPSI

SEQ ID NO: 23722 - protein, 9 aa, Artificial Sequence
  Peptide Derived from Human Papillomavirus
PAFSDPSII

SEQ ID NO: 23723 - protein, 11 aa, Artificial Sequence
  Peptide Derived from Human Papillomavirus
PAFSDPSIIEV

SEQ ID NO: 23724 - protein, 10 aa, Artificial Sequence
  Peptide Derived from Human Papillomavirus
PALSSRRGTV

SEQ ID NO: 23725 - protein, 9 aa, Artificial Sequence
  Peptide Derived from Human Papillomavirus
PASTTPSTI

SEQ ID NO: 23726 - protein, 10 aa, Artificial Sequence
  Peptide Derived from Human Papillomavirus
PAVLDITPTV

SEQ ID NO: 23727 - protein, 10 aa, Artificial Sequence
  Peptide Derived from Human Papillomavirus
PAYEPLDTTL

SEQ ID NO: 23728 - protein, 11 aa, Artificial Sequence
  Peptide Derived from Human Papillomavirus
PSSLVTFDNPA

SEQ ID NO: 23729 - protein, 8 aa, Artificial Sequence
  Peptide Derived from Human Papillomavirus
PSTAASSY

SEQ ID NO: 23730 - protein, 11 aa, Artificial Sequence
  Peptide Derived from Human Papillomavirus
PSTAASSYSNV

SEQ ID NO: 23731 - protein, 8 aa, Artificial Sequence
  Peptide Derived from Human Papillomavirus
PSTIHKSF

SEQ ID NO: 23732 - protein, 10 aa, Artificial Sequence
  Peptide Derived from Human Papillomavirus
PSTIHKSFTY

SEQ ID NO: 23733 - protein, 8 aa, Artificial Sequence
  Peptide Derived from Human Papillomavirus
PSTSPTNA

SEQ ID NO: 23734 - protein, 9 aa, Artificial Sequence
  Peptide Derived from Human Papillomavirus
PTDPSIVTL

SEQ ID NO: 23735 - protein, 10 aa, Artificial Sequence
  Peptide Derived from Human Papillomavirus
PTDPSIVTLV

SEQ ID NO: 23736 - protein, 9 aa, Artificial Sequence
  Peptide Derived from Human Papillomavirus
PTFTGTSGF

SEQ ID NO: 23737 - protein, 11 aa, Artificial Sequence
  Peptide Derived from Human Papillomavirus
PTFTGTSGFEI

SEQ ID NO: 23738 - protein, 9 aa, Artificial Sequence
  Peptide Derived from Human Papillomavirus
PTNASTTTY

SEQ ID NO: 23739 - protein, 10 aa, Artificial Sequence
  Peptide Derived from Human Papillomavirus
PTNASTTTYI

SEQ ID NO: 23740 - protein, 8 aa, Artificial Sequence
  Peptide Derived from Human Papillomavirus
PTRPPVVI

SEQ ID NO: 23741 - protein, 11 aa, Artificial Sequence
  Peptide Derived from Human Papillomavirus
PTRPPVVIEPV

SEQ ID NO: 23742 - protein, 8 aa, Artificial Sequence
  Peptide Derived from Human Papillomavirus
PTSGSHGY

SEQ ID NO: 23743 - protein, 11 aa, Artificial Sequence
  Peptide Derived from Human Papillomavirus
PTSGSHGYEEI

SEQ ID NO: 23744 - protein, 10 aa, Artificial Sequence
  Peptide Derived from Human Papillomavirus
PTSNVPDSDF

SEQ ID NO: 23745 - protein, 11 aa, Artificial Sequence
  Peptide Derived from Human Papillomavirus
PTSNVPDSDFM

SEQ ID NO: 23746 - protein, 8 aa, Artificial Sequence
  Peptide Derived from Human Papillomavirus
PTVDSVSI

SEQ ID NO: 23747 - protein, 11 aa, Artificial Sequence
  Peptide Derived from Human Papillomavirus
PTVRRVRGPRL

SEQ ID NO: 23748 - protein, 9 aa, Artificial Sequence
  Peptide Derived from Human Papillomavirus
QSGTCPPDV

SEQ ID NO: 23749 - protein, 10 aa, Artificial Sequence
  Peptide Derived from Human Papillomavirus
QSGTCPPDVI

SEQ ID NO: 23750 - protein, 9 aa, Artificial Sequence
  Peptide Derived from Human Papillomavirus
QTGEVSGNI

SEQ ID NO: 23751 - protein, 10 aa, Artificial Sequence
  Peptide Derived from Human Papillomavirus
QTGEVSGNIF

SEQ ID NO: 23752 - protein, 11 aa, Artificial Sequence
  Peptide Derived from Human Papillomavirus
QTGEVSGNIFV

SEQ ID NO: 23753 - protein, 8 aa, Artificial Sequence
  Peptide Derived from Human Papillomavirus
RAARRKRA

SEQ ID NO: 23754 - protein, 10 aa, Artificial Sequence
  Peptide Derived from Human Papillomavirus
RAARRKRASA

SEQ ID NO: 23755 - protein, 8 aa, Artificial Sequence
  Peptide Derived from Human Papillomavirus
RANQQVRV

SEQ ID NO: 23756 - protein, 8 aa, Artificial Sequence
  Peptide Derived from Human Papillomavirus
RASATDLY

SEQ ID NO: 23757 - protein, 10 aa, Artificial Sequence
  Peptide Derived from Human Papillomavirus
RSGKQIGGRV

SEQ ID NO: 23758 - protein, 8 aa, Artificial Sequence
  Peptide Derived from Human Papillomavirus
RSNTVVDV

SEQ ID NO: 23759 - protein, 8 aa, Artificial Sequence
  Peptide Derived from Human Papillomavirus
SATNDSDL

SEQ ID NO: 23760 - protein, 9 aa, Artificial Sequence
  Peptide Derived from Human Papillomavirus
SATNDSDLF

SEQ ID NO: 23761 - protein, 11 aa, Artificial Sequence
  Peptide Derived from Human Papillomavirus
SATNDSDLFDV

SEQ ID NO: 23762 - protein, 8 aa, Artificial Sequence
  Peptide Derived from Human Papillomavirus
SAWDVPIY

SEQ ID NO: 23763 - protein, 9 aa, Artificial Sequence
  Peptide Derived from Human Papillomavirus
SSGSGTEPI

SEQ ID NO: 23764 - protein, 8 aa, Artificial Sequence
  Peptide Derived from Human Papillomavirus
SSGTTTPA

SEQ ID NO: 23765 - protein, 9 aa, Artificial Sequence
  Peptide Derived from Human Papillomavirus
SSGTTTPAV

SEQ ID NO: 23766 - protein, 10 aa, Artificial Sequence
  Peptide Derived from Human Papillomavirus
SSGTTTPAVL

SEQ ID NO: 23767 - protein, 10 aa, Artificial Sequence
  Peptide Derived from Human Papillomavirus
SSLGIFLGGL

SEQ ID NO: 23768 - protein, 10 aa, Artificial Sequence
  Peptide Derived from Human Papillomavirus
SSLVTFDNPA

SEQ ID NO: 23769 - protein, 11 aa, Artificial Sequence
  Peptide Derived from Human Papillomavirus
SSLVTFDNPAY

SEQ ID NO: 23770 - protein, 9 aa, Artificial Sequence
  Peptide Derived from Human Papillomavirus
SSRRGTVRF

SEQ ID NO: 23771 - protein, 8 aa, Artificial Sequence
  Peptide Derived from Human Papillomavirus
SSTPLPTV

SEQ ID NO: 23772 - protein, 11 aa, Artificial Sequence
  Peptide Derived from Human Papillomavirus
SSTPLPTVRRV

SEQ ID NO: 23773 - protein, 9 aa, Artificial Sequence
  Peptide Derived from Human Papillomavirus
SSTSFTNPA

SEQ ID NO: 23774 - protein, 10 aa, Artificial Sequence
  Peptide Derived from Human Papillomavirus
SSTSFTNPAF

SEQ ID NO: 23775 - protein, 8 aa, Artificial Sequence
  Peptide Derived from Human Papillomavirus
SSVVASGA

SEQ ID NO: 23776 - protein, 10 aa, Artificial Sequence
  Peptide Derived from Human Papillomavirus
SSVVASGAPV

SEQ ID NO: 23777 - protein, 8 aa, Artificial Sequence
  Peptide Derived from Human Papillomavirus
SSYSNVTV

SEQ ID NO: 23778 - protein, 10 aa, Artificial Sequence
  Peptide Derived from Human Papillomavirus
SSYSNVTVPL

SEQ ID NO: 23779 - protein, 10 aa, Artificial Sequence
  Peptide Derived from Human Papillomavirus
STAASSYSNV

SEQ ID NO: 23780 - protein, 9 aa, Artificial Sequence
  Peptide Derived from Human Papillomavirus
STIHKSFTY

SEQ ID NO: 23781 - protein, 10 aa, Artificial Sequence
  Peptide Derived from Human Papillomavirus
STPLPTVRRV

SEQ ID NO: 23782 - protein, 8 aa, Artificial Sequence
  Peptide Derived from Human Papillomavirus
STSFTNPA

SEQ ID NO: 23783 - protein, 9 aa, Artificial Sequence
  Peptide Derived from Human Papillomavirus
STSFTNPAF

SEQ ID NO: 23784 - protein, 11 aa, Artificial Sequence
  Peptide Derived from Human Papillomavirus
STTPSTIHKSF

SEQ ID NO: 23785 - protein, 8 aa, Artificial Sequence
  Peptide Derived from Human Papillomavirus
STTTYIGI

SEQ ID NO: 23786 - protein, 9 aa, Artificial Sequence
  Peptide Derived from Human Papillomavirus
TAASSYSNV

SEQ ID NO: 23787 - protein, 11 aa, Artificial Sequence
  Peptide Derived from Human Papillomavirus
TAASSYSNVTV

SEQ ID NO: 23788 - protein, 8 aa, Artificial Sequence
  Peptide Derived from Human Papillomavirus
TSAWDVPI

SEQ ID NO: 23789 - protein, 9 aa, Artificial Sequence
  Peptide Derived from Human Papillomavirus
TSAWDVPIY

SEQ ID NO: 23790 - protein, 8 aa, Artificial Sequence
  Peptide Derived from Human Papillomavirus
TSFTNPAF

SEQ ID NO: 23791 - protein, 10 aa, Artificial Sequence
  Peptide Derived from Human Papillomavirus
TSGSHGYEEI

SEQ ID NO: 23792 - protein, 9 aa, Artificial Sequence
  Peptide Derived from Human Papillomavirus
TSNVPDSDF

SEQ ID NO: 23793 - protein, 10 aa, Artificial Sequence
  Peptide Derived from Human Papillomavirus
TSNVPDSDFM

SEQ ID NO: 23794 - protein, 11 aa, Artificial Sequence
  Peptide Derived from Human Papillomavirus
TSPTNASTTTY

SEQ ID NO: 23795 - protein, 11 aa, Artificial Sequence
  Peptide Derived from Human Papillomavirus
TSQFLTHPSSL

SEQ ID NO: 23796 - protein, 9 aa, Artificial Sequence
  Peptide Derived from Human Papillomavirus
TSSGTTTPA

SEQ ID NO: 23797 - protein, 10 aa, Artificial Sequence
  Peptide Derived from Human Papillomavirus
TSSGTTTPAV

SEQ ID NO: 23798 - protein, 11 aa, Artificial Sequence
  Peptide Derived from Human Papillomavirus
TSSGTTTPAVL

SEQ ID NO: 23799 - protein, 8 aa, Artificial Sequence
  Peptide Derived from Human Papillomavirus
TTLADKIL

SEQ ID NO: 23800 - protein, 10 aa, Artificial Sequence
  Peptide Derived from Human Papillomavirus
TTLADKILQW

SEQ ID NO: 23801 - protein, 11 aa, Artificial Sequence
  Peptide Derived from Human Papillomavirus
TTLSFEPTSNV

SEQ ID NO: 23802 - protein, 8 aa, Artificial Sequence
  Peptide Derived from Human Papillomavirus
TTPAVLDI

SEQ ID NO: 23803 - protein, 10 aa, Artificial Sequence
  Peptide Derived from Human Papillomavirus
TTPSTIHKSF

SEQ ID NO: 23804 - protein, 9 aa, Artificial Sequence
  Peptide Derived from Human Papillomavirus
TTTPAVLDI

SEQ ID NO: 23805 - protein, 11 aa, Artificial Sequence
  Peptide Derived from Human Papillomavirus
TTYIGIHGTQY

SEQ ID NO: 23806 - protein, 10 aa, Artificial Sequence
  Peptide Derived from Human Papillomavirus
VASGAPVPTF

SEQ ID NO: 23807 - protein, 11 aa, Artificial Sequence
  Peptide Derived from Human Papillomavirus
VSHRAARRKRA

SEQ ID NO: 23808 - protein, 8 aa, Artificial Sequence
  Peptide Derived from Human Papillomavirus
VSISSTSF

SEQ ID NO: 23809 - protein, 8 aa, Artificial Sequence
  Peptide Derived from Human Papillomavirus
VTFDNPAY

SEQ ID NO: 23810 - protein, 11 aa, Artificial Sequence
  Peptide Derived from Human Papillomavirus
VTFDNPAYEPL

SEQ ID NO: 23811 - protein, 9 aa, Artificial Sequence
  Peptide Derived from Human Papillomavirus
VTLVEDSSV

SEQ ID NO: 23812 - protein, 10 aa, Artificial Sequence
  Peptide Derived from Human Papillomavirus
VTLVEDSSVV

SEQ ID NO: 23813 - protein, 11 aa, Artificial Sequence
  Peptide Derived from Human Papillomavirus
VTLVEDSSVVA

SEQ ID NO: 23814 - protein, 8 aa, Artificial Sequence
  Peptide Derived from Human Papillomavirus
VTVPLTSA

SEQ ID NO: 23815 - protein, 9 aa, Artificial Sequence
  Peptide Derived from Human Papillomavirus
VTVPLTSAW

SEQ ID NO: 23816 - protein, 11 aa, Artificial Sequence
  Peptide Derived from Human Papillomavirus
VTVPLTSAWDV

SEQ ID NO: 23817 - protein, 8 aa, Artificial Sequence
  Peptide Derived from Human Papillomavirus
WSSLGIFL

SEQ ID NO: 23818 - protein, 11 aa, Artificial Sequence
  Peptide Derived from Human Papillomavirus
WSSLGIFLGGL

SEQ ID NO: 23819 - protein, 8 aa, Artificial Sequence
  Peptide Derived from Human Papillomavirus
YADFPPPA

SEQ ID NO: 23820 - protein, 9 aa, Artificial Sequence
  Peptide Derived from Human Papillomavirus
YSLTMPSTA

SEQ ID NO: 23821 - protein, 10 aa, Artificial Sequence
  Peptide Derived from Human Papillomavirus
YSLTMPSTAA

SEQ ID NO: 23822 - protein, 8 aa, Artificial Sequence
  Peptide Derived from Human Papillomavirus
YSNVTVPL

SEQ ID NO: 23823 - protein, 11 aa, Artificial Sequence
  Peptide Derived from Human Papillomavirus
YSNVTVPLTSA

SEQ ID NO: 23824 - protein, 8 aa, Artificial Sequence
  Peptide Derived from Human Papillomavirus
YSRANQQV

SEQ ID NO: 23825 - protein, 10 aa, Artificial Sequence
  Peptide Derived from Human Papillomavirus
YSRANQQVRV

SEQ ID NO: 23826 - protein, 8 aa, Artificial Sequence
  Peptide Derived from Human Papillomavirus
YTGPDIIL

SEQ ID NO: 23827 - protein, 8 aa, Artificial Sequence
  Peptide Derived from Human Papillomavirus
CSAIEVQI

SEQ ID NO: 23828 - protein, 9 aa, Artificial Sequence
  Peptide Derived from Human Papillomavirus
CSAIEVQIA

SEQ ID NO: 23829 - protein, 10 aa, Artificial Sequence
  Peptide Derived from Human Papillomavirus
CSAIEVQIAL

SEQ ID NO: 23830 - protein, 9 aa, Artificial Sequence
  Peptide Derived from Human Papillomavirus
CSGVDYRGI

SEQ ID NO: 23831 - protein, 10 aa, Artificial Sequence
  Peptide Derived from Human Papillomavirus
CSGVDYRGIY

SEQ ID NO: 23832 - protein, 11 aa, Artificial Sequence
  Peptide Derived from Human Papillomavirus
CSGVDYRGIYY

SEQ ID NO: 23833 - protein, 8 aa, Artificial Sequence
  Peptide Derived from Human Papillomavirus
DSSRESHA

SEQ ID NO: 23834 - protein, 11 aa, Artificial Sequence
  Peptide Derived from Human Papillomavirus
DSSRESHAKCV

SEQ ID NO: 23835 - protein, 9 aa, Artificial Sequence
  Peptide Derived from Human Papillomavirus
DSVSSTCRY

SEQ ID NO: 23836 - protein, 11 aa, Artificial Sequence
  Peptide Derived from Human Papillomavirus
DSVSSTCRYNV

SEQ ID NO: 23837 - protein, 8 aa, Artificial Sequence
  Peptide Derived from Human Papillomavirus
DTCEELWL

SEQ ID NO: 23838 - protein, 10 aa, Artificial Sequence
  Peptide Derived from Human Papillomavirus
EAKKFGCKNI

SEQ ID NO: 23839 - protein, 11 aa, Artificial Sequence
  Peptide Derived from Human Papillomavirus
EAKKFGCKNIW

SEQ ID NO: 23840 - protein, 9 aa, Artificial Sequence
  Peptide Derived from Human Papillomavirus
ESIYCPDSV

SEQ ID NO: 23841 - protein, 8 aa, Artificial Sequence
  Peptide Derived from Human Papillomavirus
ESLSTTIY

SEQ ID NO: 23842 - protein, 8 aa, Artificial Sequence
  Peptide Derived from Human Papillomavirus
ETQRNSFL

SEQ ID NO: 23843 - protein, 11 aa, Artificial Sequence
  Peptide Derived from Human Papillomavirus
ETQRNSFLSHV

SEQ ID NO: 23844 - protein, 9 aa, Artificial Sequence
  Peptide Derived from Human Papillomavirus
GSKNNCMQY

SEQ ID NO: 23845 - protein, 10 aa, Artificial Sequence
  Peptide Derived from Human Papillomavirus
GSKNNCMQYV

SEQ ID NO: 23846 - protein, 11 aa, Artificial Sequence
  Peptide Derived from Human Papillomavirus
GSKNNCMQYVA

SEQ ID NO: 23847 - protein, 11 aa, Artificial Sequence
  Peptide Derived from Human Papillomavirus
HAKCVTTHTHI

SEQ ID NO: 23848 - protein, 10 aa, Artificial Sequence
  Peptide Derived from Human Papillomavirus
IALESLSTTI

SEQ ID NO: 23849 - protein, 11 aa, Artificial Sequence
  Peptide Derived from Human Papillomavirus
IALESLSTTIY

SEQ ID NO: 23850 - protein, 8 aa, Artificial Sequence
  Peptide Derived from Human Papillomavirus
KACSAIEV

SEQ ID NO: 23851 - protein, 10 aa, Artificial Sequence
  Peptide Derived from Human Papillomavirus
KACSAIEVQI

SEQ ID NO: 23852 - protein, 11 aa, Artificial Sequence
  Peptide Derived from Human Papillomavirus
KACSAIEVQIA

SEQ ID NO: 23853 - protein, 8 aa, Artificial Sequence
  Peptide Derived from Human Papillomavirus
KAKACSAI

SEQ ID NO: 23854 - protein, 10 aa, Artificial Sequence
  Peptide Derived from Human Papillomavirus
KAKACSAIEV

SEQ ID NO: 23855 - protein, 11 aa, Artificial Sequence
  Peptide Derived from Human Papillomavirus
KTLFVDVTSTY

SEQ ID NO: 23856 - protein, 8 aa, Artificial Sequence
  Peptide Derived from Human Papillomavirus
KTTPVVHL

SEQ ID NO: 23857 - protein, 10 aa, Artificial Sequence
  Peptide Derived from Human Papillomavirus
KTTTTTSTSV

SEQ ID NO: 23858 - protein, 11 aa, Artificial Sequence
  Peptide Derived from Human Papillomavirus
KTYYTDFEQEA

SEQ ID NO: 23859 - protein, 8 aa, Artificial Sequence
  Peptide Derived from Human Papillomavirus
LSHVKIPV

SEQ ID NO: 23860 - protein, 9 aa, Artificial Sequence
  Peptide Derived from Human Papillomavirus
LSHVKIPVV

SEQ ID NO: 23861 - protein, 10 aa, Artificial Sequence
  Peptide Derived from Human Papillomavirus
LSHVKIPVVY

SEQ ID NO: 23862 - protein, 11 aa, Artificial Sequence
  Peptide Derived from Human Papillomavirus
LSTTIYNNEEW

SEQ ID NO: 23863 - protein, 8 aa, Artificial Sequence
  Peptide Derived from Human Papillomavirus
LTEPKKCF

SEQ ID NO: 23864 - protein, 9 aa, Artificial Sequence
  Peptide Derived from Human Papillomavirus
NSFLSHVKI

SEQ ID NO: 23865 - protein, 11 aa, Artificial Sequence
  Peptide Derived from Human Papillomavirus
NSFLSHVKIPV

SEQ ID NO: 23866 - protein, 9 aa, Artificial Sequence
  Peptide Derived from Human Papillomavirus
NTDSRSRSI

SEQ ID NO: 23867 - protein, 8 aa, Artificial Sequence
  Peptide Derived from Human Papillomavirus
SAIEVQIA

SEQ ID NO: 23868 - protein, 9 aa, Artificial Sequence
  Peptide Derived from Human Papillomavirus
SAIEVQIAL

SEQ ID NO: 23869 - protein, 10 aa, Artificial Sequence
  Peptide Derived from Human Papillomavirus
SSRESHAKCV

SEQ ID NO: 23870 - protein, 8 aa, Artificial Sequence
  Peptide Derived from Human Papillomavirus
SSTCRYNV

SEQ ID NO: 23871 - protein, 11 aa, Artificial Sequence
  Peptide Derived from Human Papillomavirus
SSTCRYNVSPV

SEQ ID NO: 23872 - protein, 10 aa, Artificial Sequence
  Peptide Derived from Human Papillomavirus
STCRYNVSPV

SEQ ID NO: 23873 - protein, 9 aa, Artificial Sequence
  Peptide Derived from Human Papillomavirus
STDNKNYSI

SEQ ID NO: 23874 - protein, 10 aa, Artificial Sequence
  Peptide Derived from Human Papillomavirus
STDNKNYSII

SEQ ID NO: 23875 - protein, 9 aa, Artificial Sequence
  Peptide Derived from Human Papillomavirus
STSVGNQDA

SEQ ID NO: 23876 - protein, 10 aa, Artificial Sequence
  Peptide Derived from Human Papillomavirus
STSVGNQDAA

SEQ ID NO: 23877 - protein, 11 aa, Artificial Sequence
  Peptide Derived from Human Papillomavirus
STSVGNQDAAV

SEQ ID NO: 23878 - protein, 10 aa, Artificial Sequence
  Peptide Derived from Human Papillomavirus
STTIYNNEEW

SEQ ID NO: 23879 - protein, 8 aa, Artificial Sequence
  Peptide Derived from Human Papillomavirus
TSTDNKNY

SEQ ID NO: 23880 - protein, 10 aa, Artificial Sequence
  Peptide Derived from Human Papillomavirus
TSTDNKNYSI

SEQ ID NO: 23881 - protein, 11 aa, Artificial Sequence
  Peptide Derived from Human Papillomavirus
TSTDNKNYSII

SEQ ID NO: 23882 - protein, 10 aa, Artificial Sequence
  Peptide Derived from Human Papillomavirus
TSTSVGNQDA

SEQ ID NO: 23883 - protein, 11 aa, Artificial Sequence
  Peptide Derived from Human Papillomavirus
TSTSVGNQDAA

SEQ ID NO: 23884 - protein, 8 aa, Artificial Sequence
  Peptide Derived from Human Papillomavirus
TSVGNQDA

SEQ ID NO: 23885 - protein, 9 aa, Artificial Sequence
  Peptide Derived from Human Papillomavirus
TSVGNQDAA

SEQ ID NO: 23886 - protein, 10 aa, Artificial Sequence
  Peptide Derived from Human Papillomavirus
TSVGNQDAAV

SEQ ID NO: 23887 - protein, 9 aa, Artificial Sequence
  Peptide Derived from Human Papillomavirus
TTIYNNEEW

SEQ ID NO: 23888 - protein, 11 aa, Artificial Sequence
  Peptide Derived from Human Papillomavirus
TTIYNNEEWTL

SEQ ID NO: 23889 - protein, 11 aa, Artificial Sequence
  Peptide Derived from Human Papillomavirus
TTSTSVGNQDA

SEQ ID NO: 23890 - protein, 8 aa, Artificial Sequence
  Peptide Derived from Human Papillomavirus
TTTTSTSV

SEQ ID NO: 23891 - protein, 9 aa, Artificial Sequence
  Peptide Derived from Human Papillomavirus
TTTTTSTSV

SEQ ID NO: 23892 - protein, 8 aa, Artificial Sequence
  Peptide Derived from Human Papillomavirus
VAWKYIYY

SEQ ID NO: 23893 - protein, 11 aa, Artificial Sequence
  Peptide Derived from Human Papillomavirus
VSHRPGKRPRL

SEQ ID NO: 23894 - protein, 10 aa, Artificial Sequence
  Peptide Derived from Human Papillomavirus
VSPVETVNEY

SEQ ID NO: 23895 - protein, 9 aa, Artificial Sequence
  Peptide Derived from Human Papillomavirus
VSSTCRYNV

SEQ ID NO: 23896 - protein, 10 aa, Artificial Sequence
  Peptide Derived from Human Papillomavirus
WTLRDTCEEL

SEQ ID NO: 23897 - protein, 11 aa, Artificial Sequence
  Peptide Derived from Human Papillomavirus
WTLRDTCEELW

SEQ ID NO: 23898 - protein, 9 aa, Artificial Sequence
  Peptide Derived from Human Papillomavirus
WTSTDNKNY

SEQ ID NO: 23899 - protein, 11 aa, Artificial Sequence
  Peptide Derived from Human Papillomavirus
WTSTDNKNYSI

SEQ ID NO: 23900 - protein, 8 aa, Artificial Sequence
  Peptide Derived from Human Papillomavirus
YSIITIIY

SEQ ID NO: 23901 - protein, 8 aa, Artificial Sequence
  Peptide Derived from Human Papillomavirus
YTDFEQEA

SEQ ID NO: 23902 - protein, 11 aa, Artificial Sequence
  Peptide Derived from Human Papillomavirus
YTDFEQEAKKF

SEQ ID NO: 23903 - protein, 11 aa, Artificial Sequence
  Peptide Derived from Human Papillomavirus
ATLESITKKQL

SEQ ID NO: 23904 - protein, 8 aa, Artificial Sequence
  Peptide Derived from Human Papillomavirus
CTELKLVY

SEQ ID NO: 23905 - protein, 8 aa, Artificial Sequence
  Peptide Derived from Human Papillomavirus
ESITKKQL

SEQ ID NO: 23906 - protein, 11 aa, Artificial Sequence
  Peptide Derived from Human Papillomavirus
ESITKKQLCDL

SEQ ID NO: 23907 - protein, 8 aa, Artificial Sequence
  Peptide Derived from Human Papillomavirus
FACTELKL

SEQ ID NO: 23908 - protein, 9 aa, Artificial Sequence
  Peptide Derived from Human Papillomavirus
FACTELKLV

SEQ ID NO: 23909 - protein, 10 aa, Artificial Sequence
  Peptide Derived from Human Papillomavirus
FACTELKLVY

SEQ ID NO: 23910 - protein, 10 aa, Artificial Sequence
  Peptide Derived from Human Papillomavirus
IAHGWTGSCL

SEQ ID NO: 23911 - protein, 9 aa, Artificial Sequence
  Peptide Derived from Human Papillomavirus
ITKKQLCDL

SEQ ID NO: 23912 - protein, 10 aa, Artificial Sequence
  Peptide Derived from Human Papillomavirus
ITKKQLCDLL

SEQ ID NO: 23913 - protein, 11 aa, Artificial Sequence
  Peptide Derived from Human Papillomavirus
ITKKQLCDLLI

SEQ ID NO: 23914 - protein, 10 aa, Artificial Sequence
  Peptide Derived from Human Papillomavirus
LSCVYCKKEL

SEQ ID NO: 23915 - protein, 9 aa, Artificial Sequence
  Peptide Derived from Human Papillomavirus
LSEVLEIPL

SEQ ID NO: 23916 - protein, 10 aa, Artificial Sequence
  Peptide Derived from Human Papillomavirus
LSEVLEIPLI

SEQ ID NO: 23917 - protein, 8 aa, Artificial Sequence
  Peptide Derived from Human Papillomavirus
LTPEEKQL

SEQ ID NO: 23918 - protein, 9 aa, Artificial Sequence
  Peptide Derived from Human Papillomavirus
LTRAEVYNF

SEQ ID NO: 23919 - protein, 10 aa, Artificial Sequence
  Peptide Derived from Human Papillomavirus
LTRAEVYNFA

SEQ ID NO: 23920 - protein, 11 aa, Artificial Sequence
  Peptide Derived from Human Papillomavirus
QSPLTPEEKQL

SEQ ID NO: 23921 - protein, 11 aa, Artificial Sequence
  Peptide Derived from Human Papillomavirus
QTSREPRESTV

SEQ ID NO: 23922 - protein, 8 aa, Artificial Sequence
  Peptide Derived from Human Papillomavirus
RAEVYNFA

SEQ ID NO: 23923 - protein, 9 aa, Artificial Sequence
  Peptide Derived from Human Papillomavirus
RSLHHLSEV

SEQ ID NO: 23924 - protein, 10 aa, Artificial Sequence
  Peptide Derived from Human Papillomavirus
RSLHHLSEVL

SEQ ID NO: 23925 - protein, 10 aa, Artificial Sequence
  Peptide Derived from Human Papillomavirus
TSREPRESTV

SEQ ID NO: 23926 - protein, 9 aa, Artificial Sequence
  Peptide Derived from Human Papillomavirus
WTGSCLGCW

SEQ ID NO: 23927 - protein, 8 aa, Artificial Sequence
  Peptide Derived from Human Papillomavirus
YAVCRVCL

SEQ ID NO: 23928 - protein, 9 aa, Artificial Sequence
  Peptide Derived from Human Papillomavirus
YAVCRVCLL

SEQ ID NO: 23929 - protein, 10 aa, Artificial Sequence
  Peptide Derived from Human Papillomavirus
YAVCRVCLLF

SEQ ID NO: 23930 - protein, 11 aa, Artificial Sequence
  Peptide Derived from Human Papillomavirus
YAVCRVCLLFY

SEQ ID NO: 23931 - protein, 9 aa, Artificial Sequence
  Peptide Derived from Human Papillomavirus
YSKVRKYRY

SEQ ID NO: 23932 - protein, 10 aa, Artificial Sequence
  Peptide Derived from Human Papillomavirus
YSKVRKYRYY

SEQ ID NO: 23933 - protein, 8 aa, Artificial Sequence
  Peptide Derived from Human Papillomavirus
YSVYGATL

SEQ ID NO: 23934 - protein, 11 aa, Artificial Sequence
  Peptide Derived from Human Papillomavirus
YSVYGATLESI

SEQ ID NO: 23935 - protein, 11 aa, Artificial Sequence
  Peptide Derived from Human Papillomavirus
DSSEDEDEDEV

SEQ ID NO: 23936 - protein, 9 aa, Artificial Sequence
  Peptide Derived from Human Papillomavirus
GALTVTCPL

SEQ ID NO: 23937 - protein, 11 aa, Artificial Sequence
  Peptide Derived from Human Papillomavirus
GALTVTCPLCA

SEQ ID NO: 23938 - protein, 8 aa, Artificial Sequence
  Peptide Derived from Human Papillomavirus
HTCYLIHV

SEQ ID NO: 23939 - protein, 9 aa, Artificial Sequence
  Peptide Derived from Human Papillomavirus
LTPQTEIDL

SEQ ID NO: 23940 - protein, 9 aa, Artificial Sequence
  Peptide Derived from Human Papillomavirus
LTVTCPLCA

SEQ ID NO: 23941 - protein, 8 aa, Artificial Sequence
  Peptide Derived from Human Papillomavirus
PTLQDVVL

SEQ ID NO: 23942 - protein, 10 aa, Artificial Sequence
  Peptide Derived from Human Papillomavirus
PTLQDVVLEL

SEQ ID NO: 23943 - protein, 8 aa, Artificial Sequence
  Peptide Derived from Human Papillomavirus
QAKQHTCY

SEQ ID NO: 23944 - protein, 9 aa, Artificial Sequence
  Peptide Derived from Human Papillomavirus
QAKQHTCYL

SEQ ID NO: 23945 - protein, 10 aa, Artificial Sequence
  Peptide Derived from Human Papillomavirus
QAKQHTCYLI

SEQ ID NO: 23946 - protein, 11 aa, Artificial Sequence
  Peptide Derived from Human Papillomavirus
QARQAKQHTCY

SEQ ID NO: 23947 - protein, 9 aa, Artificial Sequence
  Peptide Derived from Human Papillomavirus
QSTKEDLRV

SEQ ID NO: 23948 - protein, 10 aa, Artificial Sequence
  Peptide Derived from Human Papillomavirus
QSTKEDLRVV

SEQ ID NO: 23949 - protein, 10 aa, Artificial Sequence
  Peptide Derived from Human Papillomavirus
SSEDEDEDEV

SEQ ID NO: 23950 - protein, 8 aa, Artificial Sequence
  Peptide Derived from Human Papillomavirus
STKEDLRV

SEQ ID NO: 23951 - protein, 9 aa, Artificial Sequence
  Peptide Derived from Human Papillomavirus
STKEDLRVV

SEQ ID NO: 23952 - protein, 11 aa, Artificial Sequence
  Peptide Derived from Human Papillomavirus
ATDSYVKRTSI

SEQ ID NO: 23953 - protein, 8 aa, Artificial Sequence
  Peptide Derived from Human Papillomavirus
ATEQLSKY

SEQ ID NO: 23954 - protein, 10 aa, Artificial Sequence
  Peptide Derived from Human Papillomavirus
ATEQLSKYDA

SEQ ID NO: 23955 - protein, 8 aa, Artificial Sequence
  Peptide Derived from Human Papillomavirus
ATPSGSMI

SEQ ID NO: 23956 - protein, 8 aa, Artificial Sequence
  Peptide Derived from Human Papillomavirus
ATSKKRSA

SEQ ID NO: 23957 - protein, 8 aa, Artificial Sequence
  Peptide Derived from Human Papillomavirus
ATSLEDKY

SEQ ID NO: 23958 - protein, 10 aa, Artificial Sequence
  Peptide Derived from Human Papillomavirus
ATSLEDKYRY

SEQ ID NO: 23959 - protein, 11 aa, Artificial Sequence
  Peptide Derived from Human Papillomavirus
ATSLEDKYRYV

SEQ ID NO: 23960 - protein, 10 aa, Artificial Sequence
  Peptide Derived from Human Papillomavirus
ATWRPSENKV

SEQ ID NO: 23961 - protein, 11 aa, Artificial Sequence
  Peptide Derived from Human Papillomavirus
ATWRPSENKVY

SEQ ID NO: 23962 - protein, 9 aa, Artificial Sequence
  Peptide Derived from Human Papillomavirus
CTPAMGEHW

SEQ ID NO: 23963 - protein, 8 aa, Artificial Sequence
  Peptide Derived from Human Papillomavirus
DARKINQY

SEQ ID NO: 23964 - protein, 9 aa, Artificial Sequence
  Peptide Derived from Human Papillomavirus
DARKINQYL

SEQ ID NO: 23965 - protein, 8 aa, Artificial Sequence
  Peptide Derived from Human Papillomavirus
DAYGDSMW

SEQ ID NO: 23966 - protein, 9 aa, Artificial Sequence
  Peptide Derived from Human Papillomavirus
DAYGDSMWF

SEQ ID NO: 23967 - protein, 10 aa, Artificial Sequence
  Peptide Derived from Human Papillomavirus
DAYGDSMWFY

SEQ ID NO: 23968 - protein, 11 aa, Artificial Sequence
  Peptide Derived from Human Papillomavirus
DAYGDSMWFYL

SEQ ID NO: 23969 - protein, 10 aa, Artificial Sequence
  Peptide Derived from Human Papillomavirus
DSFSTDLDQF

SEQ ID NO: 23970 - protein, 8 aa, Artificial Sequence
  Peptide Derived from Human Papillomavirus
DSRDNISV

SEQ ID NO: 23971 - protein, 9 aa, Artificial Sequence
  Peptide Derived from Human Papillomavirus
DSYVKRTSI

SEQ ID NO: 23972 - protein, 10 aa, Artificial Sequence
  Peptide Derived from Human Papillomavirus
DSYVKRTSIF

SEQ ID NO: 23973 - protein, 11 aa, Artificial Sequence
  Peptide Derived from Human Papillomavirus
DSYVKRTSIFY

SEQ ID NO: 23974 - protein, 8 aa, Artificial Sequence
  Peptide Derived from Human Papillomavirus
DTESSNLA

SEQ ID NO: 23975 - protein, 9 aa, Artificial Sequence
  Peptide Derived from Human Papillomavirus
DTGFGAMDF

SEQ ID NO: 23976 - protein, 11 aa, Artificial Sequence
  Peptide Derived from Human Papillomavirus
DTGFGAMDFKV

SEQ ID NO: 23977 - protein, 8 aa, Artificial Sequence
  Peptide Derived from Human Papillomavirus
DTTRSTNM

SEQ ID NO: 23978 - protein, 10 aa, Artificial Sequence
  Peptide Derived from Human Papillomavirus
DTTRSTNMTI

SEQ ID NO: 23979 - protein, 9 aa, Artificial Sequence
  Peptide Derived from Human Papillomavirus
EAQLFNKPY

SEQ ID NO: 23980 - protein, 10 aa, Artificial Sequence
  Peptide Derived from Human Papillomavirus
EAQLFNKPYW

SEQ ID NO: 23981 - protein, 11 aa, Artificial Sequence
  Peptide Derived from Human Papillomavirus
EAQLFNKPYWL

SEQ ID NO: 23982 - protein, 8 aa, Artificial Sequence
  Peptide Derived from Human Papillomavirus
ESKAEVPL

SEQ ID NO: 23983 - protein, 10 aa, Artificial Sequence
  Peptide Derived from Human Papillomavirus
ESKAEVPLDI

SEQ ID NO: 23984 - protein, 11 aa, Artificial Sequence
  Peptide Derived from Human Papillomavirus
ESKAEVPLDIV

SEQ ID NO: 23985 - protein, 10 aa, Artificial Sequence
  Peptide Derived from Human Papillomavirus
ESSNLANNNV

SEQ ID NO: 23986 - protein, 11 aa, Artificial Sequence
  Peptide Derived from Human Papillomavirus
ESSNLANNNVI

SEQ ID NO: 23987 - protein, 8 aa, Artificial Sequence
  Peptide Derived from Human Papillomavirus
ETIPAELY

SEQ ID NO: 23988 - protein, 9 aa, Artificial Sequence
  Peptide Derived from Human Papillomavirus
ETIPAELYL

SEQ ID NO: 23989 - protein, 9 aa, Artificial Sequence
  Peptide Derived from Human Papillomavirus
FARHYFNRA

SEQ ID NO: 23990 - protein, 8 aa, Artificial Sequence
  Peptide Derived from Human Papillomavirus
FSTDLDQF

SEQ ID NO: 23991 - protein, 10 aa, Artificial Sequence
  Peptide Derived from Human Papillomavirus
FSTDLDQFPL

SEQ ID NO: 23992 - protein, 9 aa, Artificial Sequence
  Peptide Derived from Human Papillomavirus
GAGLSGHPL

SEQ ID NO: 23993 - protein, 10 aa, Artificial Sequence
  Peptide Derived from Human Papillomavirus
GAGLSGHPLF

SEQ ID NO: 23994 - protein, 8 aa, Artificial Sequence
  Peptide Derived from Human Papillomavirus
GAMDFKVL

SEQ ID NO: 23995 - protein, 9 aa, Artificial Sequence
  Peptide Derived from Human Papillomavirus
GAVCKSTQV

SEQ ID NO: 23996 - protein, 8 aa, Artificial Sequence
  Peptide Derived from Human Papillomavirus
GAVNVFPI

SEQ ID NO: 23997 - protein, 9 aa, Artificial Sequence
  Peptide Derived from Human Papillomavirus
GAVNVFPIF

SEQ ID NO: 23998 - protein, 10 aa, Artificial Sequence
  Peptide Derived from Human Papillomavirus
GAVNVFPIFL

SEQ ID NO: 23999 - protein, 8 aa, Artificial Sequence
  Peptide Derived from Human Papillomavirus
GSMITSEA

SEQ ID NO: 24000 - protein, 10 aa, Artificial Sequence
  Peptide Derived from Human Papillomavirus
GSMITSEAQL

SEQ ID NO: 24001 - protein, 11 aa, Artificial Sequence
  Peptide Derived from Human Papillomavirus
GSMITSEAQLF

SEQ ID NO: 24002 - protein, 8 aa, Artificial Sequence
  Peptide Derived from Human Papillomavirus
GSSRLLAV

SEQ ID NO: 24003 - protein, 8 aa, Artificial Sequence
  Peptide Derived from Human Papillomavirus
GTRSKPAV

SEQ ID NO: 24004 - protein, 9 aa, Artificial Sequence
  Peptide Derived from Human Papillomavirus
GTRSKPAVA

SEQ ID NO: 24005 - protein, 8 aa, Artificial Sequence
  Peptide Derived from Human Papillomavirus
HAGSSRLL

SEQ ID NO: 24006 - protein, 9 aa, Artificial Sequence
  Peptide Derived from Human Papillomavirus
HAGSSRLLA

SEQ ID NO: 24007 - protein, 10 aa, Artificial Sequence
  Peptide Derived from Human Papillomavirus
HAGSSRLLAV

SEQ ID NO: 24008 - protein, 8 aa, Artificial Sequence
  Peptide Derived from Human Papillomavirus
ISTATEQL

SEQ ID NO: 24009 - protein, 11 aa, Artificial Sequence
  Peptide Derived from Human Papillomavirus
ISTATEQLSKY

SEQ ID NO: 24010 - protein, 10 aa, Artificial Sequence
  Peptide Derived from Human Papillomavirus
ISVDGKQTQL

SEQ ID NO: 24011 - protein, 8 aa, Artificial Sequence
  Peptide Derived from Human Papillomavirus
ITLSAEVM

SEQ ID NO: 24012 - protein, 9 aa, Artificial Sequence
  Peptide Derived from Human Papillomavirus
ITLSAEVMA

SEQ ID NO: 24013 - protein, 10 aa, Artificial Sequence
  Peptide Derived from Human Papillomavirus
ITLSAEVMAY

SEQ ID NO: 24014 - protein, 11 aa, Artificial Sequence
  Peptide Derived from Human Papillomavirus
ITLSAEVMAYL

SEQ ID NO: 24015 - protein, 8 aa, Artificial Sequence
  Peptide Derived from Human Papillomavirus
ITSEAQLF

SEQ ID NO: 24016 - protein, 8 aa, Artificial Sequence
  Peptide Derived from Human Papillomavirus
KAEVPLDI

SEQ ID NO: 24017 - protein, 9 aa, Artificial Sequence
  Peptide Derived from Human Papillomavirus
KAEVPLDIV

SEQ ID NO: 24018 - protein, 9 aa, Artificial Sequence
  Peptide Derived from Human Papillomavirus
KTNIPKVSA

SEQ ID NO: 24019 - protein, 10 aa, Artificial Sequence
  Peptide Derived from Human Papillomavirus
KTNIPKVSAY

SEQ ID NO: 24020 - protein, 9 aa, Artificial Sequence
  Peptide Derived from Human Papillomavirus
LAKYKFWDV

SEQ ID NO: 24021 - protein, 11 aa, Artificial Sequence
  Peptide Derived from Human Papillomavirus
LAKYKFWDVNL

SEQ ID NO: 24022 - protein, 8 aa, Artificial Sequence
  Peptide Derived from Human Papillomavirus
LALINTPI

SEQ ID NO: 24023 - protein, 8 aa, Artificial Sequence
  Peptide Derived from Human Papillomavirus
LAVGHPYY

SEQ ID NO: 24024 - protein, 10 aa, Artificial Sequence
  Peptide Derived from Human Papillomavirus
LAVGHPYYSV

SEQ ID NO: 24025 - protein, 8 aa, Artificial Sequence
  Peptide Derived from Human Papillomavirus
LSAEVMAY

SEQ ID NO: 24026 - protein, 9 aa, Artificial Sequence
  Peptide Derived from Human Papillomavirus
LSAEVMAYL

SEQ ID NO: 24027 - protein, 10 aa, Artificial Sequence
  Peptide Derived from Human Papillomavirus
LSGHPLFNRL

SEQ ID NO: 24028 - protein, 9 aa, Artificial Sequence
  Peptide Derived from Human Papillomavirus
LSKYDARKI

SEQ ID NO: 24029 - protein, 9 aa, Artificial Sequence
  Peptide Derived from Human Papillomavirus
LSPPVATSL

SEQ ID NO: 24030 - protein, 11 aa, Artificial Sequence
  Peptide Derived from Human Papillomavirus
MATWRPSENKV

SEQ ID NO: 24031 - protein, 9 aa, Artificial Sequence
  Peptide Derived from Human Papillomavirus
MAYLHNMNA

SEQ ID NO: 24032 - protein, 11 aa, Artificial Sequence
  Peptide Derived from Human Papillomavirus
MAYLHNMNANL

SEQ ID NO: 24033 - protein, 10 aa, Artificial Sequence
  Peptide Derived from Human Papillomavirus
MSADAYGDSM

SEQ ID NO: 24034 - protein, 11 aa, Artificial Sequence
  Peptide Derived from Human Papillomavirus
MSADAYGDSMW

SEQ ID NO: 24035 - protein, 10 aa, Artificial Sequence
  Peptide Derived from Human Papillomavirus
MTISTATEQL

SEQ ID NO: 24036 - protein, 8 aa, Artificial Sequence
  Peptide Derived from Human Papillomavirus
NANLLEDW

SEQ ID NO: 24037 - protein, 10 aa, Artificial Sequence
  Peptide Derived from Human Papillomavirus
NANLLEDWNI

SEQ ID NO: 24038 - protein, 9 aa, Artificial Sequence
  Peptide Derived from Human Papillomavirus
NTKTNIPKV

SEQ ID NO: 24039 - protein, 11 aa, Artificial Sequence
  Peptide Derived from Human Papillomavirus
NTKTNIPKVSA

SEQ ID NO: 24040 - protein, 9 aa, Artificial Sequence
  Peptide Derived from Human Papillomavirus
NTPIEDGDM

SEQ ID NO: 24041 - protein, 10 aa, Artificial Sequence
  Peptide Derived from Human Papillomavirus
NTPIEDGDMI

SEQ ID NO: 24042 - protein, 11 aa, Artificial Sequence
  Peptide Derived from Human Papillomavirus
PAMGEHWTKGA

SEQ ID NO: 24043 - protein, 11 aa, Artificial Sequence
  Peptide Derived from Human Papillomavirus
PAVATSKKRSA

SEQ ID NO: 24044 - protein, 8 aa, Artificial Sequence
  Peptide Derived from Human Papillomavirus
PSENKVYL

SEQ ID NO: 24045 - protein, 10 aa, Artificial Sequence
  Peptide Derived from Human Papillomavirus
PSGSMITSEA

SEQ ID NO: 24046 - protein, 8 aa, Artificial Sequence
  Peptide Derived from Human Papillomavirus
PTEKQDPL

SEQ ID NO: 24047 - protein, 9 aa, Artificial Sequence
  Peptide Derived from Human Papillomavirus
PTEKQDPLA

SEQ ID NO: 24048 - protein, 11 aa, Artificial Sequence
  Peptide Derived from Human Papillomavirus
PTEKQDPLAKY

SEQ ID NO: 24049 - protein, 8 aa, Artificial Sequence
  Peptide Derived from Human Papillomavirus
PTPVSKVV

SEQ ID NO: 24050 - protein, 9 aa, Artificial Sequence
  Peptide Derived from Human Papillomavirus
PTPVSKVVA

SEQ ID NO: 24051 - protein, 8 aa, Artificial Sequence
  Peptide Derived from Human Papillomavirus
PTSTSTPA

SEQ ID NO: 24052 - protein, 9 aa, Artificial Sequence
  Peptide Derived from Human Papillomavirus
QSTCKYPDY

SEQ ID NO: 24053 - protein, 10 aa, Artificial Sequence
  Peptide Derived from Human Papillomavirus
QSTCKYPDYL

SEQ ID NO: 24054 - protein, 9 aa, Artificial Sequence
  Peptide Derived from Human Papillomavirus
RAGKVGETI

SEQ ID NO: 24055 - protein, 11 aa, Artificial Sequence
  Peptide Derived from Human Papillomavirus
RAGKVGETIPA

SEQ ID NO: 24056 - protein, 9 aa, Artificial Sequence
  Peptide Derived from Human Papillomavirus
RAQGHNNGI

SEQ ID NO: 24057 - protein, 11 aa, Artificial Sequence
  Peptide Derived from Human Papillomavirus
RAQGHNNGICW

SEQ ID NO: 24058 - protein, 11 aa, Artificial Sequence
  Peptide Derived from Human Papillomavirus
RSAPTSTSTPA

SEQ ID NO: 24059 - protein, 10 aa, Artificial Sequence
  Peptide Derived from Human Papillomavirus
RSTNMTISTA

SEQ ID NO: 24060 - protein, 8 aa, Artificial Sequence
  Peptide Derived from Human Papillomavirus
RTSIFYHA

SEQ ID NO: 24061 - protein, 9 aa, Artificial Sequence
  Peptide Derived from Human Papillomavirus
SADAYGDSM

SEQ ID NO: 24062 - protein, 10 aa, Artificial Sequence
  Peptide Derived from Human Papillomavirus
SADAYGDSMW

SEQ ID NO: 24063 - protein, 11 aa, Artificial Sequence
  Peptide Derived from Human Papillomavirus
SADAYGDSMWF

SEQ ID NO: 24064 - protein, 8 aa, Artificial Sequence
  Peptide Derived from Human Papillomavirus
SAEVMAYL

SEQ ID NO: 24065 - protein, 11 aa, Artificial Sequence
  Peptide Derived from Human Papillomavirus
SAEVMAYLHNM

SEQ ID NO: 24066 - protein, 10 aa, Artificial Sequence
  Peptide Derived from Human Papillomavirus
SAPTSTSTPA

SEQ ID NO: 24067 - protein, 8 aa, Artificial Sequence
  Peptide Derived from Human Papillomavirus
SAYQYRVF

SEQ ID NO: 24068 - protein, 10 aa, Artificial Sequence
  Peptide Derived from Human Papillomavirus
SAYQYRVFRV

SEQ ID NO: 24069 - protein, 9 aa, Artificial Sequence
  Peptide Derived from Human Papillomavirus
SSNLANNNV

SEQ ID NO: 24070 - protein, 10 aa, Artificial Sequence
  Peptide Derived from Human Papillomavirus
SSNLANNNVI

SEQ ID NO: 24071 - protein, 11 aa, Artificial Sequence
  Peptide Derived from Human Papillomavirus
SSRLLAVGHPY

SEQ ID NO: 24072 - protein, 10 aa, Artificial Sequence
  Peptide Derived from Human Papillomavirus
STATEQLSKY

SEQ ID NO: 24073 - protein, 8 aa, Artificial Sequence
  Peptide Derived from Human Papillomavirus
STCKYPDY

SEQ ID NO: 24074 - protein, 9 aa, Artificial Sequence
  Peptide Derived from Human Papillomavirus
STCKYPDYL

SEQ ID NO: 24075 - protein, 11 aa, Artificial Sequence
  Peptide Derived from Human Papillomavirus
STCKYPDYLKM

SEQ ID NO: 24076 - protein, 9 aa, Artificial Sequence
  Peptide Derived from Human Papillomavirus
STDLDQFPL

SEQ ID NO: 24077 - protein, 9 aa, Artificial Sequence
  Peptide Derived from Human Papillomavirus
STNMTISTA

SEQ ID NO: 24078 - protein, 9 aa, Artificial Sequence
  Peptide Derived from Human Papillomavirus
TATEQLSKY

SEQ ID NO: 24079 - protein, 11 aa, Artificial Sequence
  Peptide Derived from Human Papillomavirus
TATEQLSKYDA

SEQ ID NO: 24080 - protein, 11 aa, Artificial Sequence
  Peptide Derived from Human Papillomavirus
TSEAQLFNKPY

SEQ ID NO: 24081 - protein, 9 aa, Artificial Sequence
  Peptide Derived from Human Papillomavirus
TSLEDKYRY

SEQ ID NO: 24082 - protein, 10 aa, Artificial Sequence
  Peptide Derived from Human Papillomavirus
TSLEDKYRYV

SEQ ID NO: 24083 - protein, 8 aa, Artificial Sequence
  Peptide Derived from Human Papillomavirus
TTGDCPPL

SEQ ID NO: 24084 - protein, 9 aa, Artificial Sequence
  Peptide Derived from Human Papillomavirus
TTGDCPPLA

SEQ ID NO: 24085 - protein, 10 aa, Artificial Sequence
  Peptide Derived from Human Papillomavirus
TTGDCPPLAL

SEQ ID NO: 24086 - protein, 11 aa, Artificial Sequence
  Peptide Derived from Human Papillomavirus
TTGDCPPLALI

SEQ ID NO: 24087 - protein, 9 aa, Artificial Sequence
  Peptide Derived from Human Papillomavirus
TTRSTNMTI

SEQ ID NO: 24088 - protein, 8 aa, Artificial Sequence
  Peptide Derived from Human Papillomavirus
VATPSGSM

SEQ ID NO: 24089 - protein, 9 aa, Artificial Sequence
  Peptide Derived from Human Papillomavirus
VATPSGSMI

SEQ ID NO: 24090 - protein, 9 aa, Artificial Sequence
  Peptide Derived from Human Papillomavirus
VATSKKRSA

SEQ ID NO: 24091 - protein, 9 aa, Artificial Sequence
  Peptide Derived from Human Papillomavirus
VATSLEDKY

SEQ ID NO: 24092 - protein, 11 aa, Artificial Sequence
  Peptide Derived from Human Papillomavirus
VATSLEDKYRY

SEQ ID NO: 24093 - protein, 8 aa, Artificial Sequence
  Peptide Derived from Human Papillomavirus
VSAYQYRV

SEQ ID NO: 24094 - protein, 9 aa, Artificial Sequence
  Peptide Derived from Human Papillomavirus
VSAYQYRVF

SEQ ID NO: 24095 - protein, 11 aa, Artificial Sequence
  Peptide Derived from Human Papillomavirus
VSAYQYRVFRV

SEQ ID NO: 24096 - protein, 10 aa, Artificial Sequence
  Peptide Derived from Human Papillomavirus
VSKVVATDSY

SEQ ID NO: 24097 - protein, 11 aa, Artificial Sequence
  Peptide Derived from Human Papillomavirus
VSKVVATDSYV

SEQ ID NO: 24098 - protein, 10 aa, Artificial Sequence
  Peptide Derived from Human Papillomavirus
VTKDNTKTNI

SEQ ID NO: 24099 - protein, 9 aa, Artificial Sequence
  Peptide Derived from Human Papillomavirus
VTTGDCPPL

SEQ ID NO: 24100 - protein, 10 aa, Artificial Sequence
  Peptide Derived from Human Papillomavirus
VTTGDCPPLA

SEQ ID NO: 24101 - protein, 11 aa, Artificial Sequence
  Peptide Derived from Human Papillomavirus
VTTGDCPPLAL

SEQ ID NO: 24102 - protein, 8 aa, Artificial Sequence
  Peptide Derived from Human Papillomavirus
WACVGLEV

SEQ ID NO: 24103 - protein, 9 aa, Artificial Sequence
  Peptide Derived from Human Papillomavirus
AAPRLYRKA

SEQ ID NO: 24104 - protein, 10 aa, Artificial Sequence
  Peptide Derived from Human Papillomavirus
AAPRLYRKAF

SEQ ID NO: 24105 - protein, 9 aa, Artificial Sequence
  Peptide Derived from Human Papillomavirus
ASNTTNVTA

SEQ ID NO: 24106 - protein, 11 aa, Artificial Sequence
  Peptide Derived from Human Papillomavirus
ASNTTNVTAPL

SEQ ID NO: 24107 - protein, 11 aa, Artificial Sequence
  Peptide Derived from Human Papillomavirus
ATIQTRRGTQI

SEQ ID NO: 24108 - protein, 10 aa, Artificial Sequence
  Peptide Derived from Human Papillomavirus
ATLVSADNPL

SEQ ID NO: 24109 - protein, 11 aa, Artificial Sequence
  Peptide Derived from Human Papillomavirus
ATLVSADNPLF

SEQ ID NO: 24110 - protein, 9 aa, Artificial Sequence
  Peptide Derived from Human Papillomavirus
ATPSAHLPI

SEQ ID NO: 24111 - protein, 10 aa, Artificial Sequence
  Peptide Derived from Human Papillomavirus
ATQLYKTCKL

SEQ ID NO: 24112 - protein, 9 aa, Artificial Sequence
  Peptide Derived from Human Papillomavirus
ATRRKRASA

SEQ ID NO: 24113 - protein, 11 aa, Artificial Sequence
  Peptide Derived from Human Papillomavirus
DTSLAFSPSGV

SEQ ID NO: 24114 - protein, 10 aa, Artificial Sequence
  Peptide Derived from Human Papillomavirus
EAPGLSSQSV

SEQ ID NO: 24115 - protein, 11 aa, Artificial Sequence
  Peptide Derived from Human Papillomavirus
EAPGLSSQSVA

SEQ ID NO: 24116 - protein, 8 aa, Artificial Sequence
  Peptide Derived from Human Papillomavirus
EAPQTGEV

SEQ ID NO: 24117 - protein, 9 aa, Artificial Sequence
  Peptide Derived from Human Papillomavirus
ESGAGIPNF

SEQ ID NO: 24118 - protein, 9 aa, Artificial Sequence
  Peptide Derived from Human Papillomavirus
ESSVIESGA

SEQ ID NO: 24119 - protein, 11 aa, Artificial Sequence
  Peptide Derived from Human Papillomavirus
ESSVIESGAGI

SEQ ID NO: 24120 - protein, 10 aa, Artificial Sequence
  Peptide Derived from Human Papillomavirus
ESVGPTDPSI

SEQ ID NO: 24121 - protein, 11 aa, Artificial Sequence
  Peptide Derived from Human Papillomavirus
ESVGPTDPSIV

SEQ ID NO: 24122 - protein, 10 aa, Artificial Sequence
  Peptide Derived from Human Papillomavirus
ETPFYSGPDI

SEQ ID NO: 24123 - protein, 11 aa, Artificial Sequence
  Peptide Derived from Human Papillomavirus
ETPFYSGPDIV

SEQ ID NO: 24124 - protein, 8 aa, Artificial Sequence
  Peptide Derived from Human Papillomavirus
FADGDVAA

SEQ ID NO: 24125 - protein, 8 aa, Artificial Sequence
  Peptide Derived from Human Papillomavirus
FALWPVYF

SEQ ID NO: 24126 - protein, 9 aa, Artificial Sequence
  Peptide Derived from Human Papillomavirus
FALWPVYFF

SEQ ID NO: 24127 - protein, 8 aa, Artificial Sequence
  Peptide Derived from Human Papillomavirus
FASNTTNV

SEQ ID NO: 24128 - protein, 10 aa, Artificial Sequence
  Peptide Derived from Human Papillomavirus
FASNTTNVTA

SEQ ID NO: 24129 - protein, 11 aa, Artificial Sequence
  Peptide Derived from Human Papillomavirus
FAVHGSGTEPI

SEQ ID NO: 24130 - protein, 8 aa, Artificial Sequence
  Peptide Derived from Human Papillomavirus
FSRLGRKA

SEQ ID NO: 24131 - protein, 10 aa, Artificial Sequence
  Peptide Derived from Human Papillomavirus
FSRLGRKATI

SEQ ID NO: 24132 - protein, 9 aa, Artificial Sequence
  Peptide Derived from Human Papillomavirus
FTGSGGFEI

SEQ ID NO: 24133 - protein, 8 aa, Artificial Sequence
  Peptide Derived from Human Papillomavirus
FTTRRGGV

SEQ ID NO: 24134 - protein, 10 aa, Artificial Sequence
  Peptide Derived from Human Papillomavirus
FTTRRGGVRF

SEQ ID NO: 24135 - protein, 9 aa, Artificial Sequence
  Peptide Derived from Human Papillomavirus
FTYFGGLGI

SEQ ID NO: 24136 - protein, 8 aa, Artificial Sequence
  Peptide Derived from Human Papillomavirus
GARVHYYY

SEQ ID NO: 24137 - protein, 10 aa, Artificial Sequence
  Peptide Derived from Human Papillomavirus
GARVHYYYDI

SEQ ID NO: 24138 - protein, 8 aa, Artificial Sequence
  Peptide Derived from Human Papillomavirus
GSGGRAGY

SEQ ID NO: 24139 - protein, 9 aa, Artificial Sequence
  Peptide Derived from Human Papillomavirus
GSGGRAGYV

SEQ ID NO: 24140 - protein, 11 aa, Artificial Sequence
  Peptide Derived from Human Papillomavirus
GSGGRAGYVPL

SEQ ID NO: 24141 - protein, 10 aa, Artificial Sequence
  Peptide Derived from Human Papillomavirus
GSLFTYFGGL

SEQ ID NO: 24142 - protein, 8 aa, Artificial Sequence
  Peptide Derived from Human Papillomavirus
GSRPSTIV

SEQ ID NO: 24143 - protein, 10 aa, Artificial Sequence
  Peptide Derived from Human Papillomavirus
GSRPSTIVDV

SEQ ID NO: 24144 - protein, 9 aa, Artificial Sequence
  Peptide Derived from Human Papillomavirus
GSSFALWPV

SEQ ID NO: 24145 - protein, 10 aa, Artificial Sequence
  Peptide Derived from Human Papillomavirus
GSSFALWPVY

SEQ ID NO: 24146 - protein, 11 aa, Artificial Sequence
  Peptide Derived from Human Papillomavirus
GSSFALWPVYF

SEQ ID NO: 24147 - protein, 8 aa, Artificial Sequence
  Peptide Derived from Human Papillomavirus
GTCPEDVV

SEQ ID NO: 24148 - protein, 11 aa, Artificial Sequence
  Peptide Derived from Human Papillomavirus
GTCPEDVVNKI

SEQ ID NO: 24149 - protein, 8 aa, Artificial Sequence
  Peptide Derived from Human Papillomavirus
GTDTSLAF

SEQ ID NO: 24150 - protein, 10 aa, Artificial Sequence
  Peptide Derived from Human Papillomavirus
GTEPISSTPI

SEQ ID NO: 24151 - protein, 8 aa, Artificial Sequence
  Peptide Derived from Human Papillomavirus
GTGSGGRA

SEQ ID NO: 24152 - protein, 10 aa, Artificial Sequence
  Peptide Derived from Human Papillomavirus
GTGSGGRAGY

SEQ ID NO: 24153 - protein, 11 aa, Artificial Sequence
  Peptide Derived from Human Papillomavirus
GTGSGGRAGYV

SEQ ID NO: 24154 - protein, 10 aa, Artificial Sequence
  Peptide Derived from Human Papillomavirus
GTGTGSGGRA

SEQ ID NO: 24155 - protein, 8 aa, Artificial Sequence
  Peptide Derived from Human Papillomavirus
GTQIGARV

SEQ ID NO: 24156 - protein, 10 aa, Artificial Sequence
  Peptide Derived from Human Papillomavirus
GTQIGARVHY

SEQ ID NO: 24157 - protein, 11 aa, Artificial Sequence
  Peptide Derived from Human Papillomavirus
GTQIGARVHYY

SEQ ID NO: 24158 - protein, 8 aa, Artificial Sequence
  Peptide Derived from Human Papillomavirus
HSYEEIPM

SEQ ID NO: 24159 - protein, 11 aa, Artificial Sequence
  Peptide Derived from Human Papillomavirus
HSYEEIPMQTF

SEQ ID NO: 24160 - protein, 10 aa, Artificial Sequence
  Peptide Derived from Human Papillomavirus
IAAPRLYRKA

SEQ ID NO: 24161 - protein, 11 aa, Artificial Sequence
  Peptide Derived from Human Papillomavirus
IAAPRLYRKAF

SEQ ID NO: 24162 - protein, 9 aa, Artificial Sequence
  Peptide Derived from Human Papillomavirus
IAQAEEIEM

SEQ ID NO: 24163 - protein, 10 aa, Artificial Sequence
  Peptide Derived from Human Papillomavirus
ISPIAQAEEI

SEQ ID NO: 24164 - protein, 9 aa, Artificial Sequence
  Peptide Derived from Human Papillomavirus
ISSTPIPGF

SEQ ID NO: 24165 - protein, 8 aa, Artificial Sequence
  Peptide Derived from Human Papillomavirus
ISTPTSGI

SEQ ID NO: 24166 - protein, 11 aa, Artificial Sequence
  Peptide Derived from Human Papillomavirus
ISTPTSGIHSY

SEQ ID NO: 24167 - protein, 11 aa, Artificial Sequence
  Peptide Derived from Human Papillomavirus
ITNPLFIDPPV

SEQ ID NO: 24168 - protein, 8 aa, Artificial Sequence
  Peptide Derived from Human Papillomavirus
ITPTSSTV

SEQ ID NO: 24169 - protein, 10 aa, Artificial Sequence
  Peptide Derived from Human Papillomavirus
ITPTSSTVHV

SEQ ID NO: 24170 - protein, 10 aa, Artificial Sequence
  Peptide Derived from Human Papillomavirus
ITSSSTTTPA

SEQ ID NO: 24171 - protein, 11 aa, Artificial Sequence
  Peptide Derived from Human Papillomavirus
ITSSSTTTPAV

SEQ ID NO: 24172 - protein, 8 aa, Artificial Sequence
  Peptide Derived from Human Papillomavirus
KAFQQVKV

SEQ ID NO: 24173 - protein, 8 aa, Artificial Sequence
  Peptide Derived from Human Papillomavirus
KTWADKIL

SEQ ID NO: 24174 - protein, 10 aa, Artificial Sequence
  Peptide Derived from Human Papillomavirus
KTWADKILQW

SEQ ID NO: 24175 - protein, 8 aa, Artificial Sequence
  Peptide Derived from Human Papillomavirus
LAFSPSGV

SEQ ID NO: 24176 - protein, 9 aa, Artificial Sequence
  Peptide Derived from Human Papillomavirus
LAFSPSGVA

SEQ ID NO: 24177 - protein, 10 aa, Artificial Sequence
  Peptide Derived from Human Papillomavirus
LSANNSFDGL

SEQ ID NO: 24178 - protein, 11 aa, Artificial Sequence
  Peptide Derived from Human Papillomavirus
LSANNSFDGLY

SEQ ID NO: 24179 - protein, 10 aa, Artificial Sequence
  Peptide Derived from Human Papillomavirus
LSFASNTTNV

SEQ ID NO: 24180 - protein, 9 aa, Artificial Sequence
  Peptide Derived from Human Papillomavirus
LSGTCPEDV

SEQ ID NO: 24181 - protein, 10 aa, Artificial Sequence
  Peptide Derived from Human Papillomavirus
LSGTCPEDVV

SEQ ID NO: 24182 - protein, 11 aa, Artificial Sequence
  Peptide Derived from Human Papillomavirus
LSSQSVATPSA

SEQ ID NO: 24183 - protein, 9 aa, Artificial Sequence
  Peptide Derived from Human Papillomavirus
NSFDGLYDI

SEQ ID NO: 24184 - protein, 10 aa, Artificial Sequence
  Peptide Derived from Human Papillomavirus
NSFDGLYDIY

SEQ ID NO: 24185 - protein, 11 aa, Artificial Sequence
  Peptide Derived from Human Papillomavirus
NSFDGLYDIYA

SEQ ID NO: 24186 - protein, 9 aa, Artificial Sequence
  Peptide Derived from Human Papillomavirus
NTTNVTAPL

SEQ ID NO: 24187 - protein, 8 aa, Artificial Sequence
  Peptide Derived from Human Papillomavirus
PAFLDRPA

SEQ ID NO: 24188 - protein, 10 aa, Artificial Sequence
  Peptide Derived from Human Papillomavirus
PAFLDRPATL

SEQ ID NO: 24189 - protein, 11 aa, Artificial Sequence
  Peptide Derived from Human Papillomavirus
PAFLDRPATLV

SEQ ID NO: 24190 - protein, 10 aa, Artificial Sequence
  Peptide Derived from Human Papillomavirus
PAFTTRRGGV

SEQ ID NO: 24191 - protein, 8 aa, Artificial Sequence
  Peptide Derived from Human Papillomavirus
PARPPIVV

SEQ ID NO: 24192 - protein, 11 aa, Artificial Sequence
  Peptide Derived from Human Papillomavirus
PARPPIVVESV

SEQ ID NO: 24193 - protein, 11 aa, Artificial Sequence
  Peptide Derived from Human Papillomavirus
PATLVSADNPL

SEQ ID NO: 24194 - protein, 10 aa, Artificial Sequence
  Peptide Derived from Human Papillomavirus
PSGVAPDPDF

SEQ ID NO: 24195 - protein, 11 aa, Artificial Sequence
  Peptide Derived from Human Papillomavirus
PSGVAPDPDFM

SEQ ID NO: 24196 - protein, 10 aa, Artificial Sequence
  Peptide Derived from Human Papillomavirus
PSTIVDVTPA

SEQ ID NO: 24197 - protein, 9 aa, Artificial Sequence
  Peptide Derived from Human Papillomavirus
PTDPSIVTL

SEQ ID NO: 24198 - protein, 10 aa, Artificial Sequence
  Peptide Derived from Human Papillomavirus
PTDPSIVTLV

SEQ ID NO: 24199 - protein, 9 aa, Artificial Sequence
  Peptide Derived from Human Papillomavirus
PTGPSTWPF

SEQ ID NO: 24200 - protein, 10 aa, Artificial Sequence
  Peptide Derived from Human Papillomavirus
PTGPSTWPFV

SEQ ID NO: 24201 - protein, 8 aa, Artificial Sequence
  Peptide Derived from Human Papillomavirus
PTSGIHSY

SEQ ID NO: 24202 - protein, 11 aa, Artificial Sequence
  Peptide Derived from Human Papillomavirus
PTSGIHSYEEI

SEQ ID NO: 24203 - protein, 8 aa, Artificial Sequence
  Peptide Derived from Human Papillomavirus
PTSSTVHV

SEQ ID NO: 24204 - protein, 10 aa, Artificial Sequence
  Peptide Derived from Human Papillomavirus
QAEEIEMQPL

SEQ ID NO: 24205 - protein, 11 aa, Artificial Sequence
  Peptide Derived from Human Papillomavirus
QAEEIEMQPLL

SEQ ID NO: 24206 - protein, 10 aa, Artificial Sequence
  Peptide Derived from Human Papillomavirus
QSPYDVTHDV

SEQ ID NO: 24207 - protein, 11 aa, Artificial Sequence
  Peptide Derived from Human Papillomavirus
QSPYDVTHDVY

SEQ ID NO: 24208 - protein, 8 aa, Artificial Sequence
  Peptide Derived from Human Papillomavirus
QSVATPSA

SEQ ID NO: 24209 - protein, 10 aa, Artificial Sequence
  Peptide Derived from Human Papillomavirus
QSVATPSAHL

SEQ ID NO: 24210 - protein, 9 aa, Artificial Sequence
  Peptide Derived from Human Papillomavirus
QTGEVSGNI

SEQ ID NO: 24211 - protein, 10 aa, Artificial Sequence
  Peptide Derived from Human Papillomavirus
QTGEVSGNIL

SEQ ID NO: 24212 - protein, 11 aa, Artificial Sequence
  Peptide Derived from Human Papillomavirus
QTGEVSGNILI

SEQ ID NO: 24213 - protein, 8 aa, Artificial Sequence
  Peptide Derived from Human Papillomavirus
QTRRGTQI

SEQ ID NO: 24214 - protein, 10 aa, Artificial Sequence
  Peptide Derived from Human Papillomavirus
QTRRGTQIGA

SEQ ID NO: 24215 - protein, 8 aa, Artificial Sequence
  Peptide Derived from Human Papillomavirus
RASATQLY

SEQ ID NO: 24216 - protein, 8 aa, Artificial Sequence
  Peptide Derived from Human Papillomavirus
RATRRKRA

SEQ ID NO: 24217 - protein, 10 aa, Artificial Sequence
  Peptide Derived from Human Papillomavirus
RATRRKRASA

SEQ ID NO: 24218 - protein, 11 aa, Artificial Sequence
  Peptide Derived from Human Papillomavirus
SAHLPIKPSTL

SEQ ID NO: 24219 - protein, 9 aa, Artificial Sequence
  Peptide Derived from Human Papillomavirus
SANNSFDGL

SEQ ID NO: 24220 - protein, 10 aa, Artificial Sequence
  Peptide Derived from Human Papillomavirus
SANNSFDGLY

SEQ ID NO: 24221 - protein, 11 aa, Artificial Sequence
  Peptide Derived from Human Papillomavirus
SATQLYKTCKL

SEQ ID NO: 24222 - protein, 8 aa, Artificial Sequence
  Peptide Derived from Human Papillomavirus
SSFALWPV

SEQ ID NO: 24223 - protein, 9 aa, Artificial Sequence
  Peptide Derived from Human Papillomavirus
SSFALWPVY

SEQ ID NO: 24224 - protein, 10 aa, Artificial Sequence
  Peptide Derived from Human Papillomavirus
SSFALWPVYF

SEQ ID NO: 24225 - protein, 11 aa, Artificial Sequence
  Peptide Derived from Human Papillomavirus
SSFALWPVYFF

SEQ ID NO: 24226 - protein, 10 aa, Artificial Sequence
  Peptide Derived from Human Papillomavirus
SSQSVATPSA

SEQ ID NO: 24227 - protein, 8 aa, Artificial Sequence
  Peptide Derived from Human Papillomavirus
SSSTTTPA

SEQ ID NO: 24228 - protein, 9 aa, Artificial Sequence
  Peptide Derived from Human Papillomavirus
SSSTTTPAV

SEQ ID NO: 24229 - protein, 10 aa, Artificial Sequence
  Peptide Derived from Human Papillomavirus
SSSTTTPAVL

SEQ ID NO: 24230 - protein, 9 aa, Artificial Sequence
  Peptide Derived from Human Papillomavirus
SSTHITNPL

SEQ ID NO: 24231 - protein, 10 aa, Artificial Sequence
  Peptide Derived from Human Papillomavirus
SSTHITNPLF

SEQ ID NO: 24232 - protein, 11 aa, Artificial Sequence
  Peptide Derived from Human Papillomavirus
SSTHITNPLFI

SEQ ID NO: 24233 - protein, 8 aa, Artificial Sequence
  Peptide Derived from Human Papillomavirus
SSTPIPGF

SEQ ID NO: 24234 - protein, 11 aa, Artificial Sequence
  Peptide Derived from Human Papillomavirus
SSTPIPGFRRI

SEQ ID NO: 24235 - protein, 8 aa, Artificial Sequence
  Peptide Derived from Human Papillomavirus
SSTTTPAV

SEQ ID NO: 24236 - protein, 9 aa, Artificial Sequence
  Peptide Derived from Human Papillomavirus
SSTTTPAVL

SEQ ID NO: 24237 - protein, 11 aa, Artificial Sequence
  Peptide Derived from Human Papillomavirus
SSTTTPAVLDI

SEQ ID NO: 24238 - protein, 11 aa, Artificial Sequence
  Peptide Derived from Human Papillomavirus
SSTVHVSSTHI

SEQ ID NO: 24239 - protein, 8 aa, Artificial Sequence
  Peptide Derived from Human Papillomavirus
SSVIESGA

SEQ ID NO: 24240 - protein, 10 aa, Artificial Sequence
  Peptide Derived from Human Papillomavirus
SSVIESGAGI

SEQ ID NO: 24241 - protein, 8 aa, Artificial Sequence
  Peptide Derived from Human Papillomavirus
STHITNPL

SEQ ID NO: 24242 - protein, 9 aa, Artificial Sequence
  Peptide Derived from Human Papillomavirus
STHITNPLF

SEQ ID NO: 24243 - protein, 10 aa, Artificial Sequence
  Peptide Derived from Human Papillomavirus
STHITNPLFI

SEQ ID NO: 24244 - protein, 9 aa, Artificial Sequence
  Peptide Derived from Human Papillomavirus
STIVDVTPA

SEQ ID NO: 24245 - protein, 10 aa, Artificial Sequence
  Peptide Derived from Human Papillomavirus
STPIPGFRRI

SEQ ID NO: 24246 - protein, 11 aa, Artificial Sequence
  Peptide Derived from Human Papillomavirus
STPIPGFRRIA

SEQ ID NO: 24247 - protein, 10 aa, Artificial Sequence
  Peptide Derived from Human Papillomavirus
STPTSGIHSY

SEQ ID NO: 24248 - protein, 8 aa, Artificial Sequence
  Peptide Derived from Human Papillomavirus
STTTPAVL

SEQ ID NO: 24249 - protein, 10 aa, Artificial Sequence
  Peptide Derived from Human Papillomavirus
STTTPAVLDI

SEQ ID NO: 24250 - protein, 10 aa, Artificial Sequence
  Peptide Derived from Human Papillomavirus
STVHVSSTHI

SEQ ID NO: 24251 - protein, 11 aa, Artificial Sequence
  Peptide Derived from Human Papillomavirus
STWPFVPQSPY

SEQ ID NO: 24252 - protein, 8 aa, Artificial Sequence
  Peptide Derived from Human Papillomavirus
TAPLGNVW

SEQ ID NO: 24253 - protein, 10 aa, Artificial Sequence
  Peptide Derived from Human Papillomavirus
TSGIHSYEEI

SEQ ID NO: 24254 - protein, 10 aa, Artificial Sequence
  Peptide Derived from Human Papillomavirus
TSLAFSPSGV

SEQ ID NO: 24255 - protein, 11 aa, Artificial Sequence
  Peptide Derived from Human Papillomavirus
TSLAFSPSGVA

SEQ ID NO: 24256 - protein, 9 aa, Artificial Sequence
  Peptide Derived from Human Papillomavirus
TSSSTTTPA

SEQ ID NO: 24257 - protein, 10 aa, Artificial Sequence
  Peptide Derived from Human Papillomavirus
TSSSTTTPAV

SEQ ID NO: 24258 - protein, 11 aa, Artificial Sequence
  Peptide Derived from Human Papillomavirus
TSSSTTTPAVL

SEQ ID NO: 24259 - protein, 8 aa, Artificial Sequence
  Peptide Derived from Human Papillomavirus
TTNVTAPL

SEQ ID NO: 24260 - protein, 11 aa, Artificial Sequence
  Peptide Derived from Human Papillomavirus
TTNVTAPLGNV

SEQ ID NO: 24261 - protein, 8 aa, Artificial Sequence
  Peptide Derived from Human Papillomavirus
TTPAVLDI

SEQ ID NO: 24262 - protein, 9 aa, Artificial Sequence
  Peptide Derived from Human Papillomavirus
TTRRGGVRF

SEQ ID NO: 24263 - protein, 9 aa, Artificial Sequence
  Peptide Derived from Human Papillomavirus
TTTPAVLDI

SEQ ID NO: 24264 - protein, 11 aa, Artificial Sequence
  Peptide Derived from Human Papillomavirus
VAHRATRRKRA

SEQ ID NO: 24265 - protein, 8 aa, Artificial Sequence
  Peptide Derived from Human Papillomavirus
VALHRPAF

SEQ ID NO: 24266 - protein, 8 aa, Artificial Sequence
  Peptide Derived from Human Papillomavirus
VAPDPDFM

SEQ ID NO: 24267 - protein, 10 aa, Artificial Sequence
  Peptide Derived from Human Papillomavirus
VAPDPDFMNI

SEQ ID NO: 24268 - protein, 11 aa, Artificial Sequence
  Peptide Derived from Human Papillomavirus
VAPDPDFMNIV

SEQ ID NO: 24269 - protein, 8 aa, Artificial Sequence
  Peptide Derived from Human Papillomavirus
VATPSAHL

SEQ ID NO: 24270 - protein, 10 aa, Artificial Sequence
  Peptide Derived from Human Papillomavirus
VATPSAHLPI

SEQ ID NO: 24271 - protein, 8 aa, Artificial Sequence
  Peptide Derived from Human Papillomavirus
VSADNPLF

SEQ ID NO: 24272 - protein, 10 aa, Artificial Sequence
  Peptide Derived from Human Papillomavirus
VSSTHITNPL

SEQ ID NO: 24273 - protein, 11 aa, Artificial Sequence
  Peptide Derived from Human Papillomavirus
VSSTHITNPLF

SEQ ID NO: 24274 - protein, 8 aa, Artificial Sequence
  Peptide Derived from Human Papillomavirus
VTAPLGNV

SEQ ID NO: 24275 - protein, 9 aa, Artificial Sequence
  Peptide Derived from Human Papillomavirus
VTAPLGNVW

SEQ ID NO: 24276 - protein, 11 aa, Artificial Sequence
  Peptide Derived from Human Papillomavirus
VTDPAFLDRPA

SEQ ID NO: 24277 - protein, 9 aa, Artificial Sequence
  Peptide Derived from Human Papillomavirus
VTLVEESSV

SEQ ID NO: 24278 - protein, 10 aa, Artificial Sequence
  Peptide Derived from Human Papillomavirus
VTLVEESSVI

SEQ ID NO: 24279 - protein, 8 aa, Artificial Sequence
  Peptide Derived from Human Papillomavirus
VTPARPPI

SEQ ID NO: 24280 - protein, 9 aa, Artificial Sequence
  Peptide Derived from Human Papillomavirus
VTPARPPIV

SEQ ID NO: 24281 - protein, 10 aa, Artificial Sequence
  Peptide Derived from Human Papillomavirus
VTPARPPIVV

SEQ ID NO: 24282 - protein, 8 aa, Artificial Sequence
  Peptide Derived from Human Papillomavirus
WADKILQW

SEQ ID NO: 24283 - protein, 11 aa, Artificial Sequence
  Peptide Derived from Human Papillomavirus
WADKILQWGSL

SEQ ID NO: 24284 - protein, 8 aa, Artificial Sequence
  Peptide Derived from Human Papillomavirus
YANIDDEA

SEQ ID NO: 24285 - protein, 11 aa, Artificial Sequence
  Peptide Derived from Human Papillomavirus
YANIDDEAPGL

SEQ ID NO: 24286 - protein, 8 aa, Artificial Sequence
  Peptide Derived from Human Papillomavirus
YSGPDIVL

SEQ ID NO: 24287 - protein, 10 aa, Artificial Sequence
  Peptide Derived from Human Papillomavirus
AICIEKQSRA

SEQ ID NO: 24288 - protein, 11 aa, Artificial Sequence
  Peptide Derived from Human Papillomavirus
AICIEKQSRAA

SEQ ID NO: 24289 - protein, 9 aa, Artificial Sequence
  Peptide Derived from Human Papillomavirus
ALDGNLVSM

SEQ ID NO: 24290 - protein, 11 aa, Artificial Sequence
  Peptide Derived from Human Papillomavirus
ALDGNLVSMDV

SEQ ID NO: 24291 - protein, 8 aa, Artificial Sequence
  Peptide Derived from Human Papillomavirus
ALFTAQEA

SEQ ID NO: 24292 - protein, 9 aa, Artificial Sequence
  Peptide Derived from Human Papillomavirus
ALKRFLQGI

SEQ ID NO: 24293 - protein, 9 aa, Artificial Sequence
  Peptide Derived from Human Papillomavirus
ALYWYKTGI

SEQ ID NO: 24294 - protein, 9 aa, Artificial Sequence
  Peptide Derived from Human Papillomavirus
AMLAKFKEL

SEQ ID NO: 24295 - protein, 10 aa, Artificial Sequence
  Peptide Derived from Human Papillomavirus
AMLAKFKELY

SEQ ID NO: 24296 - protein, 10 aa, Artificial Sequence
  Peptide Derived from Human Papillomavirus
AQEAKQHRDA

SEQ ID NO: 24297 - protein, 11 aa, Artificial Sequence
  Peptide Derived from Human Papillomavirus
AQEAKQHRDAV

SEQ ID NO: 24298 - protein, 10 aa, Artificial Sequence
  Peptide Derived from Human Papillomavirus
AQLADTNSNA

SEQ ID NO: 24299 - protein, 9 aa, Artificial Sequence
  Peptide Derived from Human Papillomavirus
AVQVLKRKY

SEQ ID NO: 24300 - protein, 10 aa, Artificial Sequence
  Peptide Derived from Human Papillomavirus
AVQVLKRKYL

SEQ ID NO: 24301 - protein, 11 aa, Artificial Sequence
  Peptide Derived from Human Papillomavirus
AVQVLKRKYLV

SEQ ID NO: 24302 - protein, 10 aa, Artificial Sequence
  Peptide Derived from Human Papillomavirus
AVVEKKTGDA

SEQ ID NO: 24303 - protein, 11 aa, Artificial Sequence
  Peptide Derived from Human Papillomavirus
AVVEKKTGDAI

SEQ ID NO: 24304 - protein, 11 aa, Artificial Sequence
  Peptide Derived from Human Papillomavirus
CIAAFGLTPSI

SEQ ID NO: 24305 - protein, 8 aa, Artificial Sequence
  Peptide Derived from Human Papillomavirus
CIEKQSRA

SEQ ID NO: 24306 - protein, 9 aa, Artificial Sequence
  Peptide Derived from Human Papillomavirus
CIEKQSRAA

SEQ ID NO: 24307 - protein, 8 aa, Artificial Sequence
  Peptide Derived from Human Papillomavirus
CILLYGAA

SEQ ID NO: 24308 - protein, 9 aa, Artificial Sequence
  Peptide Derived from Human Papillomavirus
CLYLHIQSL

SEQ ID NO: 24309 - protein, 10 aa, Artificial Sequence
  Peptide Derived from Human Papillomavirus
CLYLHIQSLA

SEQ ID NO: 24310 - protein, 9 aa, Artificial Sequence
  Peptide Derived from Human Papillomavirus
CMMIEPPKL

SEQ ID NO: 24311 - protein, 10 aa, Artificial Sequence
  Peptide Derived from Human Papillomavirus
CPPLLITSNI

SEQ ID NO: 24312 - protein, 8 aa, Artificial Sequence
  Peptide Derived from Human Papillomavirus
CQTPLTNI

SEQ ID NO: 24313 - protein, 9 aa, Artificial Sequence
  Peptide Derived from Human Papillomavirus
CQTPLTNIL

SEQ ID NO: 24314 - protein, 11 aa, Artificial Sequence
  Peptide Derived from Human Papillomavirus
CQTPLTNILNV

SEQ ID NO: 24315 - protein, 10 aa, Artificial Sequence
  Peptide Derived from Human Papillomavirus
CVDNNISPRL

SEQ ID NO: 24316 - protein, 10 aa, Artificial Sequence
  Peptide Derived from Human Papillomavirus
CVSGQNTNTL

SEQ ID NO: 24317 - protein, 8 aa, Artificial Sequence
  Peptide Derived from Human Papillomavirus
CVSPMCMM

SEQ ID NO: 24318 - protein, 9 aa, Artificial Sequence
  Peptide Derived from Human Papillomavirus
CVSPMCMMI

SEQ ID NO: 24319 - protein, 10 aa, Artificial Sequence
  Peptide Derived from Human Papillomavirus
DISGCVDNNI

SEQ ID NO: 24320 - protein, 8 aa, Artificial Sequence
  Peptide Derived from Human Papillomavirus
DIVDDSEI

SEQ ID NO: 24321 - protein, 9 aa, Artificial Sequence
  Peptide Derived from Human Papillomavirus
DIVDDSEIA

SEQ ID NO: 24322 - protein, 10 aa, Artificial Sequence
  Peptide Derived from Human Papillomavirus
DIVDDSEIAY

SEQ ID NO: 24323 - protein, 8 aa, Artificial Sequence
  Peptide Derived from Human Papillomavirus
DVKHRPLV

SEQ ID NO: 24324 - protein, 10 aa, Artificial Sequence
  Peptide Derived from Human Papillomavirus
DVKHRPLVQL

SEQ ID NO: 24325 - protein, 9 aa, Artificial Sequence
  Peptide Derived from Human Papillomavirus
EIAYKYAQL

SEQ ID NO: 24326 - protein, 10 aa, Artificial Sequence
  Peptide Derived from Human Papillomavirus
EIAYKYAQLA

SEQ ID NO: 24327 - protein, 10 aa, Artificial Sequence
  Peptide Derived from Human Papillomavirus
ELNDKNWKSF

SEQ ID NO: 24328 - protein, 11 aa, Artificial Sequence
  Peptide Derived from Human Papillomavirus
ELNDKNWKSFF

SEQ ID NO: 24329 - protein, 8 aa, Artificial Sequence
  Peptide Derived from Human Papillomavirus
ELSQMVQW

SEQ ID NO: 24330 - protein, 9 aa, Artificial Sequence
  Peptide Derived from Human Papillomavirus
ELSQMVQWA

SEQ ID NO: 24331 - protein, 10 aa, Artificial Sequence
  Peptide Derived from Human Papillomavirus
ELSQMVQWAY

SEQ ID NO: 24332 - protein, 10 aa, Artificial Sequence
  Peptide Derived from Human Papillomavirus
ELYGVSFSEL

SEQ ID NO: 24333 - protein, 11 aa, Artificial Sequence
  Peptide Derived from Human Papillomavirus
ELYGVSFSELV

SEQ ID NO: 24334 - protein, 9 aa, Artificial Sequence
  Peptide Derived from Human Papillomavirus
EPPKLRSTA

SEQ ID NO: 24335 - protein, 10 aa, Artificial Sequence
  Peptide Derived from Human Papillomavirus
EPPKLRSTAA

SEQ ID NO: 24336 - protein, 11 aa, Artificial Sequence
  Peptide Derived from Human Papillomavirus
EPPKLRSTAAA

SEQ ID NO: 24337 - protein, 8 aa, Artificial Sequence
  Peptide Derived from Human Papillomavirus
EVETQQML

SEQ ID NO: 24338 - protein, 10 aa, Artificial Sequence
  Peptide Derived from Human Papillomavirus
EVETQQMLQV

SEQ ID NO: 24339 - protein, 9 aa, Artificial Sequence
  Peptide Derived from Human Papillomavirus
EVYGDTPEW

SEQ ID NO: 24340 - protein, 10 aa, Artificial Sequence
  Peptide Derived from Human Papillomavirus
EVYGDTPEWI

SEQ ID NO: 24341 - protein, 8 aa, Artificial Sequence
  Peptide Derived from Human Papillomavirus
FIVNDNDY

SEQ ID NO: 24342 - protein, 9 aa, Artificial Sequence
  Peptide Derived from Human Papillomavirus
FIVNDNDYL

SEQ ID NO: 24343 - protein, 8 aa, Artificial Sequence
  Peptide Derived from Human Papillomavirus
FLKSNSQA

SEQ ID NO: 24344 - protein, 10 aa, Artificial Sequence
  Peptide Derived from Human Papillomavirus
FLKSNSQAKI

SEQ ID NO: 24345 - protein, 11 aa, Artificial Sequence
  Peptide Derived from Human Papillomavirus
FLKSNSQAKIV

SEQ ID NO: 24346 - protein, 11 aa, Artificial Sequence
  Peptide Derived from Human Papillomavirus
FLQGIPKKNCI

SEQ ID NO: 24347 - protein, 9 aa, Artificial Sequence
  Peptide Derived from Human Papillomavirus
FLQGSVICF

SEQ ID NO: 24348 - protein, 10 aa, Artificial Sequence
  Peptide Derived from Human Papillomavirus
FLQGSVICFV

SEQ ID NO: 24349 - protein, 9 aa, Artificial Sequence
  Peptide Derived from Human Papillomavirus
FLRYQGVEF

SEQ ID NO: 24350 - protein, 10 aa, Artificial Sequence
  Peptide Derived from Human Papillomavirus
FLRYQGVEFM

SEQ ID NO: 24351 - protein, 8 aa, Artificial Sequence
  Peptide Derived from Human Papillomavirus
FLTALKRF

SEQ ID NO: 24352 - protein, 9 aa, Artificial Sequence
  Peptide Derived from Human Papillomavirus
FLTALKRFL

SEQ ID NO: 24353 - protein, 8 aa, Artificial Sequence
  Peptide Derived from Human Papillomavirus
FMSFLTAL

SEQ ID NO: 24354 - protein, 11 aa, Artificial Sequence
  Peptide Derived from Human Papillomavirus
FMSFLTALKRF

SEQ ID NO: 24355 - protein, 10 aa, Artificial Sequence
  Peptide Derived from Human Papillomavirus
FPFDENGNPV

SEQ ID NO: 24356 - protein, 11 aa, Artificial Sequence
  Peptide Derived from Human Papillomavirus
FPFDENGNPVY

SEQ ID NO: 24357 - protein, 8 aa, Artificial Sequence
  Peptide Derived from Human Papillomavirus
FVNSKSHF

SEQ ID NO: 24358 - protein, 9 aa, Artificial Sequence
  Peptide Derived from Human Papillomavirus
FVNSKSHFW

SEQ ID NO: 24359 - protein, 10 aa, Artificial Sequence
  Peptide Derived from Human Papillomavirus
FVNSKSHFWL

SEQ ID NO: 24360 - protein, 8 aa, Artificial Sequence
  Peptide Derived from Human Papillomavirus
GIPKKNCI

SEQ ID NO: 24361 - protein, 9 aa, Artificial Sequence
  Peptide Derived from Human Papillomavirus
GIPKKNCIL

SEQ ID NO: 24362 - protein, 10 aa, Artificial Sequence
  Peptide Derived from Human Papillomavirus
GIPKKNCILL

SEQ ID NO: 24363 - protein, 11 aa, Artificial Sequence
  Peptide Derived from Human Papillomavirus
GIPKKNCILLY

SEQ ID NO: 24364 - protein, 8 aa, Artificial Sequence
  Peptide Derived from Human Papillomavirus
GISNISEV

SEQ ID NO: 24365 - protein, 9 aa, Artificial Sequence
  Peptide Derived from Human Papillomavirus
GISNISEVY

SEQ ID NO: 24366 - protein, 10 aa, Artificial Sequence
  Peptide Derived from Human Papillomavirus
GLTPSIADSI

SEQ ID NO: 24367 - protein, 8 aa, Artificial Sequence
  Peptide Derived from Human Papillomavirus
GMLDDATV

SEQ ID NO: 24368 - protein, 11 aa, Artificial Sequence
  Peptide Derived from Human Papillomavirus
GMLDDATVPCW

SEQ ID NO: 24369 - protein, 8 aa, Artificial Sequence
  Peptide Derived from Human Papillomavirus
GMSLMKFL

SEQ ID NO: 24370 - protein, 8 aa, Artificial Sequence
  Peptide Derived from Human Papillomavirus
GMVVLLLV

SEQ ID NO: 24371 - protein, 10 aa, Artificial Sequence
  Peptide Derived from Human Papillomavirus
GMVVLLLVRY

SEQ ID NO: 24372 - protein, 8 aa, Artificial Sequence
  Peptide Derived from Human Papillomavirus
GVEFMSFL

SEQ ID NO: 24373 - protein, 10 aa, Artificial Sequence
  Peptide Derived from Human Papillomavirus
GVEFMSFLTA

SEQ ID NO: 24374 - protein, 11 aa, Artificial Sequence
  Peptide Derived from Human Papillomavirus
GVEFMSFLTAL

SEQ ID NO: 24375 - protein, 8 aa, Artificial Sequence
  Peptide Derived from Human Papillomavirus
GVSERHTI

SEQ ID NO: 24376 - protein, 8 aa, Artificial Sequence
  Peptide Derived from Human Papillomavirus
GVSFSELV

SEQ ID NO: 24377 - protein, 11 aa, Artificial Sequence
  Peptide Derived from Human Papillomavirus
GVSFSELVRPF

SEQ ID NO: 24378 - protein, 9 aa, Artificial Sequence
  Peptide Derived from Human Papillomavirus
HIQSLACSW

SEQ ID NO: 24379 - protein, 11 aa, Artificial Sequence
  Peptide Derived from Human Papillomavirus
HIQSLACSWGM

SEQ ID NO: 24380 - protein, 10 aa, Artificial Sequence
  Peptide Derived from Human Papillomavirus
ILNVLKTSNA

SEQ ID NO: 24381 - protein, 8 aa, Artificial Sequence
  Peptide Derived from Human Papillomavirus
IPKKNCIL

SEQ ID NO: 24382 - protein, 9 aa, Artificial Sequence
  Peptide Derived from Human Papillomavirus
IPKKNCILL

SEQ ID NO: 24383 - protein, 10 aa, Artificial Sequence
  Peptide Derived from Human Papillomavirus
IPKKNCILLY

SEQ ID NO: 24384 - protein, 11 aa, Artificial Sequence
  Peptide Derived from Human Papillomavirus
IQRQTVLQHSF

SEQ ID NO: 24385 - protein, 8 aa, Artificial Sequence
  Peptide Derived from Human Papillomavirus
IQSLACSW

SEQ ID NO: 24386 - protein, 10 aa, Artificial Sequence
  Peptide Derived from Human Papillomavirus
IQSLACSWGM

SEQ ID NO: 24387 - protein, 11 aa, Artificial Sequence
  Peptide Derived from Human Papillomavirus
IQSLACSWGMV

SEQ ID NO: 24388 - protein, 8 aa, Artificial Sequence
  Peptide Derived from Human Papillomavirus
IVDDSEIA

SEQ ID NO: 24389 - protein, 9 aa, Artificial Sequence
  Peptide Derived from Human Papillomavirus
IVDDSEIAY

SEQ ID NO: 24390 - protein, 11 aa, Artificial Sequence
  Peptide Derived from Human Papillomavirus
IVDDSEIAYKY

SEQ ID NO: 24391 - protein, 8 aa, Artificial Sequence
  Peptide Derived from Human Papillomavirus
IVKDCATM

SEQ ID NO: 24392 - protein, 10 aa, Artificial Sequence
  Peptide Derived from Human Papillomavirus
IVMFLRYQGV

SEQ ID NO: 24393 - protein, 8 aa, Artificial Sequence
  Peptide Derived from Human Papillomavirus
IVNDNDYL

SEQ ID NO: 24394 - protein, 11 aa, Artificial Sequence
  Peptide Derived from Human Papillomavirus
IVNDNDYLTQA

SEQ ID NO: 24395 - protein, 8 aa, Artificial Sequence
  Peptide Derived from Human Papillomavirus
KIGMLDDA

SEQ ID NO: 24396 - protein, 10 aa, Artificial Sequence
  Peptide Derived from Human Papillomavirus
KIGMLDDATV

SEQ ID NO: 24397 - protein, 9 aa, Artificial Sequence
  Peptide Derived from Human Papillomavirus
KIVKDCATM

SEQ ID NO: 24398 - protein, 8 aa, Artificial Sequence
  Peptide Derived from Human Papillomavirus
KLLCVSPM

SEQ ID NO: 24399 - protein, 10 aa, Artificial Sequence
  Peptide Derived from Human Papillomavirus
KLLCVSPMCM

SEQ ID NO: 24400 - protein, 11 aa, Artificial Sequence
  Peptide Derived from Human Papillomavirus
KLLCVSPMCMM

SEQ ID NO: 24401 - protein, 9 aa, Artificial Sequence
  Peptide Derived from Human Papillomavirus
KLLSKLLCV

SEQ ID NO: 24402 - protein, 8 aa, Artificial Sequence
  Peptide Derived from Human Papillomavirus
KLRSTAAA

SEQ ID NO: 24403 - protein, 9 aa, Artificial Sequence
  Peptide Derived from Human Papillomavirus
KLRSTAAAL

SEQ ID NO: 24404 - protein, 10 aa, Artificial Sequence
  Peptide Derived from Human Papillomavirus
KLRSTAAALY

SEQ ID NO: 24405 - protein, 11 aa, Artificial Sequence
  Peptide Derived from Human Papillomavirus
KLRSTAAALYW

SEQ ID NO: 24406 - protein, 9 aa, Artificial Sequence
  Peptide Derived from Human Papillomavirus
KQHRDAVQV

SEQ ID NO: 24407 - protein, 10 aa, Artificial Sequence
  Peptide Derived from Human Papillomavirus
KQHRDAVQVL

SEQ ID NO: 24408 - protein, 9 aa, Artificial Sequence
  Peptide Derived from Human Papillomavirus
KQIVMFLRY

SEQ ID NO: 24409 - protein, 8 aa, Artificial Sequence
  Peptide Derived from Human Papillomavirus
KQMSMSQW

SEQ ID NO: 24410 - protein, 9 aa, Artificial Sequence
  Peptide Derived from Human Papillomavirus
KQMSMSQWI

SEQ ID NO: 24411 - protein, 11 aa, Artificial Sequence
  Peptide Derived from Human Papillomavirus
KQMSMSQWIKY

SEQ ID NO: 24412 - protein, 10 aa, Artificial Sequence
  Peptide Derived from Human Papillomavirus
KQSRAAKRRL

SEQ ID NO: 24413 - protein, 11 aa, Artificial Sequence
  Peptide Derived from Human Papillomavirus
KQSRAAKRRLF

SEQ ID NO: 24414 - protein, 8 aa, Artificial Sequence
  Peptide Derived from Human Papillomavirus
LITSNINA

SEQ ID NO: 24415 - protein, 9 aa, Artificial Sequence
  Peptide Derived from Human Papillomavirus
LLCVSPMCM

SEQ ID NO: 24416 - protein, 10 aa, Artificial Sequence
  Peptide Derived from Human Papillomavirus
LLCVSPMCMM

SEQ ID NO: 24417 - protein, 11 aa, Artificial Sequence
  Peptide Derived from Human Papillomavirus
LLCVSPMCMMI

SEQ ID NO: 24418 - protein, 9 aa, Artificial Sequence
  Peptide Derived from Human Papillomavirus
LLITSNINA

SEQ ID NO: 24419 - protein, 8 aa, Artificial Sequence
  Peptide Derived from Human Papillomavirus
LLQQYCLY

SEQ ID NO: 24420 - protein, 9 aa, Artificial Sequence
  Peptide Derived from Human Papillomavirus
LLQQYCLYL

SEQ ID NO: 24421 - protein, 11 aa, Artificial Sequence
  Peptide Derived from Human Papillomavirus
LLQQYCLYLHI

SEQ ID NO: 24422 - protein, 8 aa, Artificial Sequence
  Peptide Derived from Human Papillomavirus
LLSKLLCV

SEQ ID NO: 24423 - protein, 11 aa, Artificial Sequence
  Peptide Derived from Human Papillomavirus
LLSKLLCVSPM

SEQ ID NO: 24424 - protein, 9 aa, Artificial Sequence
  Peptide Derived from Human Papillomavirus
LMKFLQGSV

SEQ ID NO: 24425 - protein, 10 aa, Artificial Sequence
  Peptide Derived from Human Papillomavirus
LMKFLQGSVI

SEQ ID NO: 24426 - protein, 10 aa, Artificial Sequence
  Peptide Derived from Human Papillomavirus
LQGIPKKNCI

SEQ ID NO: 24427 - protein, 11 aa, Artificial Sequence
  Peptide Derived from Human Papillomavirus
LQGIPKKNCIL

SEQ ID NO: 24428 - protein, 8 aa, Artificial Sequence
  Peptide Derived from Human Papillomavirus
LQGSVICF

SEQ ID NO: 24429 - protein, 9 aa, Artificial Sequence
  Peptide Derived from Human Papillomavirus
LQGSVICFV

SEQ ID NO: 24430 - protein, 10 aa, Artificial Sequence
  Peptide Derived from Human Papillomavirus
LQHSFNDCTF

SEQ ID NO: 24431 - protein, 9 aa, Artificial Sequence
  Peptide Derived from Human Papillomavirus
LQPLADAKI

SEQ ID NO: 24432 - protein, 11 aa, Artificial Sequence
  Peptide Derived from Human Papillomavirus
LQPLADAKIGM

SEQ ID NO: 24433 - protein, 8 aa, Artificial Sequence
  Peptide Derived from Human Papillomavirus
LQQYCLYL

SEQ ID NO: 24434 - protein, 10 aa, Artificial Sequence
  Peptide Derived from Human Papillomavirus
LQQYCLYLHI

SEQ ID NO: 24435 - protein, 11 aa, Artificial Sequence
  Peptide Derived from Human Papillomavirus
LVDFIVNDNDY

SEQ ID NO: 24436 - protein, 9 aa, Artificial Sequence
  Peptide Derived from Human Papillomavirus
LVQLKCPPL

SEQ ID NO: 24437 - protein, 10 aa, Artificial Sequence
  Peptide Derived from Human Papillomavirus
LVQLKCPPLL

SEQ ID NO: 24438 - protein, 11 aa, Artificial Sequence
  Peptide Derived from Human Papillomavirus
LVQLKCPPLLI

SEQ ID NO: 24439 - protein, 11 aa, Artificial Sequence
  Peptide Derived from Human Papillomavirus
LVSMDVKHRPL

SEQ ID NO: 24440 - protein, 8 aa, Artificial Sequence
  Peptide Derived from Human Papillomavirus
LVSPLSDI

SEQ ID NO: 24441 - protein, 10 aa, Artificial Sequence
  Peptide Derived from Human Papillomavirus
LVVFTFPNEF

SEQ ID NO: 24442 - protein, 11 aa, Artificial Sequence
  Peptide Derived from Human Papillomavirus
MIEPPKLRSTA

SEQ ID NO: 24443 - protein, 8 aa, Artificial Sequence
  Peptide Derived from Human Papillomavirus
MLAKFKEL

SEQ ID NO: 24444 - protein, 9 aa, Artificial Sequence
  Peptide Derived from Human Papillomavirus
MLAKFKELY

SEQ ID NO: 24445 - protein, 11 aa, Artificial Sequence
  Peptide Derived from Human Papillomavirus
MLAKFKELYGV

SEQ ID NO: 24446 - protein, 10 aa, Artificial Sequence
  Peptide Derived from Human Papillomavirus
MLDDATVPCW

SEQ ID NO: 24447 - protein, 8 aa, Artificial Sequence
  Peptide Derived from Human Papillomavirus
MMIEPPKL

SEQ ID NO: 24448 - protein, 10 aa, Artificial Sequence
  Peptide Derived from Human Papillomavirus
MVQWAYDNDI

SEQ ID NO: 24449 - protein, 11 aa, Artificial Sequence
  Peptide Derived from Human Papillomavirus
MVQWAYDNDIV

SEQ ID NO: 24450 - protein, 9 aa, Artificial Sequence
  Peptide Derived from Human Papillomavirus
MVVLLLVRY

SEQ ID NO: 24451 - protein, 11 aa, Artificial Sequence
  Peptide Derived from Human Papillomavirus
NILNVLKTSNA

SEQ ID NO: 24452 - protein, 10 aa, Artificial Sequence
  Peptide Derived from Human Papillomavirus
NINAGTDSRW

SEQ ID NO: 24453 - protein, 8 aa, Artificial Sequence
  Peptide Derived from Human Papillomavirus
NISPRLKA

SEQ ID NO: 24454 - protein, 9 aa, Artificial Sequence
  Peptide Derived from Human Papillomavirus
NISPRLKAI

SEQ ID NO: 24455 - protein, 11 aa, Artificial Sequence
  Peptide Derived from Human Papillomavirus
NISPRLKAICI

SEQ ID NO: 24456 - protein, 10 aa, Artificial Sequence
  Peptide Derived from Human Papillomavirus
NLRNALDGNL

SEQ ID NO: 24457 - protein, 11 aa, Artificial Sequence
  Peptide Derived from Human Papillomavirus
NLRNALDGNLV

SEQ ID NO: 24458 - protein, 11 aa, Artificial Sequence
  Peptide Derived from Human Papillomavirus
NPVYELNDKNW

SEQ ID NO: 24459 - protein, 8 aa, Artificial Sequence
  Peptide Derived from Human Papillomavirus
NVLKTSNA

SEQ ID NO: 24460 - protein, 10 aa, Artificial Sequence
  Peptide Derived from Human Papillomavirus
NVLKTSNAKA

SEQ ID NO: 24461 - protein, 11 aa, Artificial Sequence
  Peptide Derived from Human Papillomavirus
NVLKTSNAKAA

SEQ ID NO: 24462 - protein, 9 aa, Artificial Sequence
  Peptide Derived from Human Papillomavirus
PLADAKIGM

SEQ ID NO: 24463 - protein, 10 aa, Artificial Sequence
  Peptide Derived from Human Papillomavirus
PLADAKIGML

SEQ ID NO: 24464 - protein, 8 aa, Artificial Sequence
  Peptide Derived from Human Papillomavirus
PLLITSNI

SEQ ID NO: 24465 - protein, 10 aa, Artificial Sequence
  Peptide Derived from Human Papillomavirus
PLLITSNINA

SEQ ID NO: 24466 - protein, 9 aa, Artificial Sequence
  Peptide Derived from Human Papillomavirus
PLSDISGCV

SEQ ID NO: 24467 - protein, 8 aa, Artificial Sequence
  Peptide Derived from Human Papillomavirus
PLTNILNV

SEQ ID NO: 24468 - protein, 9 aa, Artificial Sequence
  Peptide Derived from Human Papillomavirus
PLTNILNVL

SEQ ID NO: 24469 - protein, 10 aa, Artificial Sequence
  Peptide Derived from Human Papillomavirus
PLVQLKCPPL

SEQ ID NO: 24470 - protein, 11 aa, Artificial Sequence
  Peptide Derived from Human Papillomavirus
PLVQLKCPPLL

SEQ ID NO: 24471 - protein, 11 aa, Artificial Sequence
  Peptide Derived from Human Papillomavirus
PMCMMIEPPKL

SEQ ID NO: 24472 - protein, 8 aa, Artificial Sequence
  Peptide Derived from Human Papillomavirus
PPKLRSTA

SEQ ID NO: 24473 - protein, 9 aa, Artificial Sequence
  Peptide Derived from Human Papillomavirus
PPKLRSTAA

SEQ ID NO: 24474 - protein, 10 aa, Artificial Sequence
  Peptide Derived from Human Papillomavirus
PPKLRSTAAA

SEQ ID NO: 24475 - protein, 11 aa, Artificial Sequence
  Peptide Derived from Human Papillomavirus
PPKLRSTAAAL

SEQ ID NO: 24476 - protein, 9 aa, Artificial Sequence
  Peptide Derived from Human Papillomavirus
PPLLITSNI

SEQ ID NO: 24477 - protein, 11 aa, Artificial Sequence
  Peptide Derived from Human Papillomavirus
PPLLITSNINA

SEQ ID NO: 24478 - protein, 10 aa, Artificial Sequence
  Peptide Derived from Human Papillomavirus
PVYELNDKNW

SEQ ID NO: 24479 - protein, 8 aa, Artificial Sequence
  Peptide Derived from Human Papillomavirus
QIVMFLRY

SEQ ID NO: 24480 - protein, 11 aa, Artificial Sequence
  Peptide Derived from Human Papillomavirus
QIVMFLRYQGV

SEQ ID NO: 24481 - protein, 9 aa, Artificial Sequence
  Peptide Derived from Human Papillomavirus
QLADTNSNA

SEQ ID NO: 24482 - protein, 11 aa, Artificial Sequence
  Peptide Derived from Human Papillomavirus
QLADTNSNASA

SEQ ID NO: 24483 - protein, 8 aa, Artificial Sequence
  Peptide Derived from Human Papillomavirus
QLKCPPLL

SEQ ID NO: 24484 - protein, 9 aa, Artificial Sequence
  Peptide Derived from Human Papillomavirus
QLKCPPLLI

SEQ ID NO: 24485 - protein, 8 aa, Artificial Sequence
  Peptide Derived from Human Papillomavirus
QMSMSQWI

SEQ ID NO: 24486 - protein, 10 aa, Artificial Sequence
  Peptide Derived from Human Papillomavirus
QMSMSQWIKY

SEQ ID NO: 24487 - protein, 11 aa, Artificial Sequence
  Peptide Derived from Human Papillomavirus
QMVQWAYDNDI

SEQ ID NO: 24488 - protein, 8 aa, Artificial Sequence
  Peptide Derived from Human Papillomavirus
QPLADAKI

SEQ ID NO: 24489 - protein, 10 aa, Artificial Sequence
  Peptide Derived from Human Papillomavirus
QPLADAKIGM

SEQ ID NO: 24490 - protein, 11 aa, Artificial Sequence
  Peptide Derived from Human Papillomavirus
QPLADAKIGML

SEQ ID NO: 24491 - protein, 9 aa, Artificial Sequence
  Peptide Derived from Human Papillomavirus
QQYCLYLHI

SEQ ID NO: 24492 - protein, 8 aa, Artificial Sequence
  Peptide Derived from Human Papillomavirus
QVLKRKYL

SEQ ID NO: 24493 - protein, 9 aa, Artificial Sequence
  Peptide Derived from Human Papillomavirus
QVLKRKYLV

SEQ ID NO: 24494 - protein, 10 aa, Artificial Sequence
  Peptide Derived from Human Papillomavirus
RLFESEDSGY

SEQ ID NO: 24495 - protein, 11 aa, Artificial Sequence
  Peptide Derived from Human Papillomavirus
RLVVFTFPNEF

SEQ ID NO: 24496 - protein, 11 aa, Artificial Sequence
  Peptide Derived from Human Papillomavirus
RPLVQLKCPPL

SEQ ID NO: 24497 - protein, 9 aa, Artificial Sequence
  Peptide Derived from Human Papillomavirus
RQTVLQHSF

SEQ ID NO: 24498 - protein, 8 aa, Artificial Sequence
  Peptide Derived from Human Papillomavirus
RVDDGGDW

SEQ ID NO: 24499 - protein, 11 aa, Artificial Sequence
  Peptide Derived from Human Papillomavirus
RVDDGGDWKQI

SEQ ID NO: 24500 - protein, 9 aa, Artificial Sequence
  Peptide Derived from Human Papillomavirus
SIADSIKTL

SEQ ID NO: 24501 - protein, 10 aa, Artificial Sequence
  Peptide Derived from Human Papillomavirus
SIADSIKTLL

SEQ ID NO: 24502 - protein, 9 aa, Artificial Sequence
  Peptide Derived from Human Papillomavirus
SIKTLLQQY

SEQ ID NO: 24503 - protein, 11 aa, Artificial Sequence
  Peptide Derived from Human Papillomavirus
SIKTLLQQYCL

SEQ ID NO: 24504 - protein, 8 aa, Artificial Sequence
  Peptide Derived from Human Papillomavirus
SLACSWGM

SEQ ID NO: 24505 - protein, 9 aa, Artificial Sequence
  Peptide Derived from Human Papillomavirus
SLACSWGMV

SEQ ID NO: 24506 - protein, 10 aa, Artificial Sequence
  Peptide Derived from Human Papillomavirus
SLACSWGMVV

SEQ ID NO: 24507 - protein, 11 aa, Artificial Sequence
  Peptide Derived from Human Papillomavirus
SLACSWGMVVL

SEQ ID NO: 24508 - protein, 8 aa, Artificial Sequence
  Peptide Derived from Human Papillomavirus
SLFGMSLM

SEQ ID NO: 24509 - protein, 10 aa, Artificial Sequence
  Peptide Derived from Human Papillomavirus
SLFGMSLMKF

SEQ ID NO: 24510 - protein, 11 aa, Artificial Sequence
  Peptide Derived from Human Papillomavirus
SLFGMSLMKFL

SEQ ID NO: 24511 - protein, 10 aa, Artificial Sequence
  Peptide Derived from Human Papillomavirus
SLMKFLQGSV

SEQ ID NO: 24512 - protein, 11 aa, Artificial Sequence
  Peptide Derived from Human Papillomavirus
SLMKFLQGSVI

SEQ ID NO: 24513 - protein, 8 aa, Artificial Sequence
  Peptide Derived from Human Papillomavirus
SLPTFKCV

SEQ ID NO: 24514 - protein, 9 aa, Artificial Sequence
  Peptide Derived from Human Papillomavirus
SMDVKHRPL

SEQ ID NO: 24515 - protein, 10 aa, Artificial Sequence
  Peptide Derived from Human Papillomavirus
SMDVKHRPLV

SEQ ID NO: 24516 - protein, 8 aa, Artificial Sequence
  Peptide Derived from Human Papillomavirus
SMSQWIKY

SEQ ID NO: 24517 - protein, 10 aa, Artificial Sequence
  Peptide Derived from Human Papillomavirus
SPLSDISGCV

SEQ ID NO: 24518 - protein, 9 aa, Artificial Sequence
  Peptide Derived from Human Papillomavirus
SPRLKAICI

SEQ ID NO: 24519 - protein, 10 aa, Artificial Sequence
  Peptide Derived from Human Papillomavirus
SQAKIVKDCA

SEQ ID NO: 24520 - protein, 8 aa, Artificial Sequence
  Peptide Derived from Human Papillomavirus
SQMVQWAY

SEQ ID NO: 24521 - protein, 11 aa, Artificial Sequence
  Peptide Derived from Human Papillomavirus
SQWIKYRCDRV

SEQ ID NO: 24522 - protein, 10 aa, Artificial Sequence
  Peptide Derived from Human Papillomavirus
TICQTPLTNI

SEQ ID NO: 24523 - protein, 11 aa, Artificial Sequence
  Peptide Derived from Human Papillomavirus
TICQTPLTNIL

SEQ ID NO: 24524 - protein, 9 aa, Artificial Sequence
  Peptide Derived from Human Papillomavirus
TIEKLLSKL

SEQ ID NO: 24525 - protein, 10 aa, Artificial Sequence
  Peptide Derived from Human Papillomavirus
TIEKLLSKLL

SEQ ID NO: 24526 - protein, 8 aa, Artificial Sequence
  Peptide Derived from Human Papillomavirus
TLLQQYCL

SEQ ID NO: 24527 - protein, 9 aa, Artificial Sequence
  Peptide Derived from Human Papillomavirus
TLLQQYCLY

SEQ ID NO: 24528 - protein, 10 aa, Artificial Sequence
  Peptide Derived from Human Papillomavirus
TLLQQYCLYL

SEQ ID NO: 24529 - protein, 9 aa, Artificial Sequence
  Peptide Derived from Human Papillomavirus
TMCRHYKRA

SEQ ID NO: 24530 - protein, 10 aa, Artificial Sequence
  Peptide Derived from Human Papillomavirus
TPEWIQRQTV

SEQ ID NO: 24531 - protein, 11 aa, Artificial Sequence
  Peptide Derived from Human Papillomavirus
TPEWIQRQTVL

SEQ ID NO: 24532 - protein, 9 aa, Artificial Sequence
  Peptide Derived from Human Papillomavirus
TPLTNILNV

SEQ ID NO: 24533 - protein, 10 aa, Artificial Sequence
  Peptide Derived from Human Papillomavirus
TPLTNILNVL

SEQ ID NO: 24534 - protein, 8 aa, Artificial Sequence
  Peptide Derived from Human Papillomavirus
TPSIADSI

SEQ ID NO: 24535 - protein, 11 aa, Artificial Sequence
  Peptide Derived from Human Papillomavirus
TPSIADSIKTL

SEQ ID NO: 24536 - protein, 8 aa, Artificial Sequence
  Peptide Derived from Human Papillomavirus
TQAETETA

SEQ ID NO: 24537 - protein, 10 aa, Artificial Sequence
  Peptide Derived from Human Papillomavirus
TQAETETAHA

SEQ ID NO: 24538 - protein, 11 aa, Artificial Sequence
  Peptide Derived from Human Papillomavirus
TQAETETAHAL

SEQ ID NO: 24539 - protein, 8 aa, Artificial Sequence
  Peptide Derived from Human Papillomavirus
TVPCWNYI

SEQ ID NO: 24540 - protein, 11 aa, Artificial Sequence
  Peptide Derived from Human Papillomavirus
VICFVNSKSHF

SEQ ID NO: 24541 - protein, 8 aa, Artificial Sequence
  Peptide Derived from Human Papillomavirus
VLKRKYLV

SEQ ID NO: 24542 - protein, 11 aa, Artificial Sequence
  Peptide Derived from Human Papillomavirus
VLKRKYLVSPL

SEQ ID NO: 24543 - protein, 9 aa, Artificial Sequence
  Peptide Derived from Human Papillomavirus
VLKTSNAKA

SEQ ID NO: 24544 - protein, 10 aa, Artificial Sequence
  Peptide Derived from Human Papillomavirus
VLKTSNAKAA

SEQ ID NO: 24545 - protein, 11 aa, Artificial Sequence
  Peptide Derived from Human Papillomavirus
VLKTSNAKAAM

SEQ ID NO: 24546 - protein, 11 aa, Artificial Sequence
  Peptide Derived from Human Papillomavirus
VLQHSFNDCTF

SEQ ID NO: 24547 - protein, 9 aa, Artificial Sequence
  Peptide Derived from Human Papillomavirus
VMFLRYQGV

SEQ ID NO: 24548 - protein, 11 aa, Artificial Sequence
  Peptide Derived from Human Papillomavirus
VMFLRYQGVEF

SEQ ID NO: 24549 - protein, 11 aa, Artificial Sequence
  Peptide Derived from Human Papillomavirus
VPCWNYIDDNL

SEQ ID NO: 24550 - protein, 8 aa, Artificial Sequence
  Peptide Derived from Human Papillomavirus
VQLKCPPL

SEQ ID NO: 24551 - protein, 9 aa, Artificial Sequence
  Peptide Derived from Human Papillomavirus
VQLKCPPLL

SEQ ID NO: 24552 - protein, 10 aa, Artificial Sequence
  Peptide Derived from Human Papillomavirus
VQLKCPPLLI

SEQ ID NO: 24553 - protein, 8 aa, Artificial Sequence
  Peptide Derived from Human Papillomavirus
VQVLKRKY

SEQ ID NO: 24554 - protein, 9 aa, Artificial Sequence
  Peptide Derived from Human Papillomavirus
VQVLKRKYL

SEQ ID NO: 24555 - protein, 10 aa, Artificial Sequence
  Peptide Derived from Human Papillomavirus
VQVLKRKYLV

SEQ ID NO: 24556 - protein, 9 aa, Artificial Sequence
  Peptide Derived from Human Papillomavirus
VQWAYDNDI

SEQ ID NO: 24557 - protein, 10 aa, Artificial Sequence
  Peptide Derived from Human Papillomavirus
VQWAYDNDIV

SEQ ID NO: 24558 - protein, 9 aa, Artificial Sequence
  Peptide Derived from Human Papillomavirus
VVEKKTGDA

SEQ ID NO: 24559 - protein, 10 aa, Artificial Sequence
  Peptide Derived from Human Papillomavirus
VVEKKTGDAI

SEQ ID NO: 24560 - protein, 9 aa, Artificial Sequence
  Peptide Derived from Human Papillomavirus
VVFTFPNEF

SEQ ID NO: 24561 - protein, 11 aa, Artificial Sequence
  Peptide Derived from Human Papillomavirus
VVFTFPNEFPF

SEQ ID NO: 24562 - protein, 8 aa, Artificial Sequence
  Peptide Derived from Human Papillomavirus
VVLLLVRY

SEQ ID NO: 24563 - protein, 9 aa, Artificial Sequence
  Peptide Derived from Human Papillomavirus
WIKYRCDRV

SEQ ID NO: 24564 - protein, 8 aa, Artificial Sequence
  Peptide Derived from Human Papillomavirus
WIQRQTVL

SEQ ID NO: 24565 - protein, 8 aa, Artificial Sequence
  Peptide Derived from Human Papillomavirus
WLQPLADA

SEQ ID NO: 24566 - protein, 10 aa, Artificial Sequence
  Peptide Derived from Human Papillomavirus
WLQPLADAKI

SEQ ID NO: 24567 - protein, 8 aa, Artificial Sequence
  Peptide Derived from Human Papillomavirus
WPYLHNRL

SEQ ID NO: 24568 - protein, 9 aa, Artificial Sequence
  Peptide Derived from Human Papillomavirus
WPYLHNRLV

SEQ ID NO: 24569 - protein, 10 aa, Artificial Sequence
  Peptide Derived from Human Papillomavirus
WPYLHNRLVV

SEQ ID NO: 24570 - protein, 11 aa, Artificial Sequence
  Peptide Derived from Human Papillomavirus
WPYLHNRLVVF

SEQ ID NO: 24571 - protein, 9 aa, Artificial Sequence
  Peptide Derived from Human Papillomavirus
YIDDNLRNA

SEQ ID NO: 24572 - protein, 10 aa, Artificial Sequence
  Peptide Derived from Human Papillomavirus
YIDDNLRNAL

SEQ ID NO: 24573 - protein, 8 aa, Artificial Sequence
  Peptide Derived from Human Papillomavirus
YLHIQSLA

SEQ ID NO: 24574 - protein, 11 aa, Artificial Sequence
  Peptide Derived from Human Papillomavirus
YLHIQSLACSW

SEQ ID NO: 24575 - protein, 8 aa, Artificial Sequence
  Peptide Derived from Human Papillomavirus
YLHNRLVV

SEQ ID NO: 24576 - protein, 9 aa, Artificial Sequence
  Peptide Derived from Human Papillomavirus
YLHNRLVVF

SEQ ID NO: 24577 - protein, 11 aa, Artificial Sequence
  Peptide Derived from Human Papillomavirus
YLHNRLVVFTF

SEQ ID NO: 24578 - protein, 10 aa, Artificial Sequence
  Peptide Derived from Human Papillomavirus
YLTQAETETA

SEQ ID NO: 24579 - protein, 9 aa, Artificial Sequence
  Peptide Derived from Human Papillomavirus
YLVSPLSDI

SEQ ID NO: 24580 - protein, 9 aa, Artificial Sequence
  Peptide Derived from Human Papillomavirus
YQGVEFMSF

SEQ ID NO: 24581 - protein, 10 aa, Artificial Sequence
  Peptide Derived from Human Papillomavirus
YQGVEFMSFL

SEQ ID NO: 24582 - protein, 8 aa, Artificial Sequence
  Peptide Derived from Human Papillomavirus
AIELQLTL

SEQ ID NO: 24583 - protein, 11 aa, Artificial Sequence
  Peptide Derived from Human Papillomavirus
AIELQLTLETI

SEQ ID NO: 24584 - protein, 11 aa, Artificial Sequence
  Peptide Derived from Human Papillomavirus
AIVTLTYDSEW

SEQ ID NO: 24585 - protein, 9 aa, Artificial Sequence
  Peptide Derived from Human Papillomavirus
AIYYKAREM

SEQ ID NO: 24586 - protein, 11 aa, Artificial Sequence
  Peptide Derived from Human Papillomavirus
AIYYKAREMGF

SEQ ID NO: 24587 - protein, 11 aa, Artificial Sequence
  Peptide Derived from Human Papillomavirus
ALGTEETQTTI

SEQ ID NO: 24588 - protein, 9 aa, Artificial Sequence
  Peptide Derived from Human Papillomavirus
ALQAIELQL

SEQ ID NO: 24589 - protein, 11 aa, Artificial Sequence
  Peptide Derived from Human Papillomavirus
ALQAIELQLTL

SEQ ID NO: 24590 - protein, 11 aa, Artificial Sequence
  Peptide Derived from Human Papillomavirus
APTGCIKKHGY

SEQ ID NO: 24591 - protein, 8 aa, Artificial Sequence
  Peptide Derived from Human Papillomavirus
AVSKNKAL

SEQ ID NO: 24592 - protein, 10 aa, Artificial Sequence
  Peptide Derived from Human Papillomavirus
AVSKNKALQA

SEQ ID NO: 24593 - protein, 11 aa, Artificial Sequence
  Peptide Derived from Human Papillomavirus
AVSKNKALQAI

SEQ ID NO: 24594 - protein, 8 aa, Artificial Sequence
  Peptide Derived from Human Papillomavirus
AVSSTWHW

SEQ ID NO: 24595 - protein, 9 aa, Artificial Sequence
  Peptide Derived from Human Papillomavirus
CIKKHGYTV

SEQ ID NO: 24596 - protein, 11 aa, Artificial Sequence
  Peptide Derived from Human Papillomavirus
CIKKHGYTVEV

SEQ ID NO: 24597 - protein, 11 aa, Artificial Sequence
  Peptide Derived from Human Papillomavirus
CPTSVFSSNEV

SEQ ID NO: 24598 - protein, 9 aa, Artificial Sequence
  Peptide Derived from Human Papillomavirus
CQDKILTHY

SEQ ID NO: 24599 - protein, 11 aa, Artificial Sequence
  Peptide Derived from Human Papillomavirus
CQRLNVCQDKI

SEQ ID NO: 24600 - protein, 8 aa, Artificial Sequence
  Peptide Derived from Human Papillomavirus
DICNTMHY

SEQ ID NO: 24601 - protein, 11 aa, Artificial Sequence
  Peptide Derived from Human Papillomavirus
DICNTMHYTNW

SEQ ID NO: 24602 - protein, 8 aa, Artificial Sequence
  Peptide Derived from Human Papillomavirus
DLRDHIDY

SEQ ID NO: 24603 - protein, 9 aa, Artificial Sequence
  Peptide Derived from Human Papillomavirus
DLRDHIDYW

SEQ ID NO: 24604 - protein, 9 aa, Artificial Sequence
  Peptide Derived from Human Papillomavirus
DQFLSQVKI

SEQ ID NO: 24605 - protein, 8 aa, Artificial Sequence
  Peptide Derived from Human Papillomavirus
DVSLEVYL

SEQ ID NO: 24606 - protein, 10 aa, Artificial Sequence
  Peptide Derived from Human Papillomavirus
DVSLEVYLTA

SEQ ID NO: 24607 - protein, 8 aa, Artificial Sequence
  Peptide Derived from Human Papillomavirus
EIIRQHLA

SEQ ID NO: 24608 - protein, 9 aa, Artificial Sequence
  Peptide Derived from Human Papillomavirus
ELQLTLETI

SEQ ID NO: 24609 - protein, 10 aa, Artificial Sequence
  Peptide Derived from Human Papillomavirus
ELQLTLETIY

SEQ ID NO: 24610 - protein, 11 aa, Artificial Sequence
  Peptide Derived from Human Papillomavirus
EMGFKHINHQV

SEQ ID NO: 24611 - protein, 8 aa, Artificial Sequence
  Peptide Derived from Human Papillomavirus
EVHAGGQV

SEQ ID NO: 24612 - protein, 9 aa, Artificial Sequence
  Peptide Derived from Human Papillomavirus
EVHAGGQVI

SEQ ID NO: 24613 - protein, 10 aa, Artificial Sequence
  Peptide Derived from Human Papillomavirus
EVHAGGQVIL

SEQ ID NO: 24614 - protein, 8 aa, Artificial Sequence
  Peptide Derived from Human Papillomavirus
EVQFDGDI

SEQ ID NO: 24615 - protein, 8 aa, Artificial Sequence
  Peptide Derived from Human Papillomavirus
EVSSPEII

SEQ ID NO: 24616 - protein, 11 aa, Artificial Sequence
  Peptide Derived from Human Papillomavirus
EVYLTAPTGCI

SEQ ID NO: 24617 - protein, 11 aa, Artificial Sequence
  Peptide Derived from Human Papillomavirus
FLSQVKIPKTI

SEQ ID NO: 24618 - protein, 8 aa, Artificial Sequence
  Peptide Derived from Human Papillomavirus
FVQFKDDA

SEQ ID NO: 24619 - protein, 11 aa, Artificial Sequence
  Peptide Derived from Human Papillomavirus
FVQFKDDAEKY

SEQ ID NO: 24620 - protein, 9 aa, Artificial Sequence
  Peptide Derived from Human Papillomavirus
GIRTYFVQF

SEQ ID NO: 24621 - protein, 9 aa, Artificial Sequence
  Peptide Derived from Human Papillomavirus
GLYYVHEGI

SEQ ID NO: 24622 - protein, 8 aa, Artificial Sequence
  Peptide Derived from Human Papillomavirus
GQVDYYGL

SEQ ID NO: 24623 - protein, 9 aa, Artificial Sequence
  Peptide Derived from Human Papillomavirus
GQVDYYGLY

SEQ ID NO: 24624 - protein, 10 aa, Artificial Sequence
  Peptide Derived from Human Papillomavirus
GQVDYYGLYY

SEQ ID NO: 24625 - protein, 11 aa, Artificial Sequence
  Peptide Derived from Human Papillomavirus
GQVDYYGLYYV

SEQ ID NO: 24626 - protein, 10 aa, Artificial Sequence
  Peptide Derived from Human Papillomavirus
GQVILCPTSV

SEQ ID NO: 24627 - protein, 11 aa, Artificial Sequence
  Peptide Derived from Human Papillomavirus
GQVILCPTSVF

SEQ ID NO: 24628 - protein, 8 aa, Artificial Sequence
  Peptide Derived from Human Papillomavirus
HIDYWKHM

SEQ ID NO: 24629 - protein, 10 aa, Artificial Sequence
  Peptide Derived from Human Papillomavirus
HIDYWKHMRL

SEQ ID NO: 24630 - protein, 10 aa, Artificial Sequence
  Peptide Derived from Human Papillomavirus
HINHQVVPTL

SEQ ID NO: 24631 - protein, 11 aa, Artificial Sequence
  Peptide Derived from Human Papillomavirus
HINHQVVPTLA

SEQ ID NO: 24632 - protein, 8 aa, Artificial Sequence
  Peptide Derived from Human Papillomavirus
HIYICEEA

SEQ ID NO: 24633 - protein, 10 aa, Artificial Sequence
  Peptide Derived from Human Papillomavirus
HIYICEEASV

SEQ ID NO: 24634 - protein, 8 aa, Artificial Sequence
  Peptide Derived from Human Papillomavirus
HLANHPAA

SEQ ID NO: 24635 - protein, 9 aa, Artificial Sequence
  Peptide Derived from Human Papillomavirus
HLKGDANTL

SEQ ID NO: 24636 - protein, 8 aa, Artificial Sequence
  Peptide Derived from Human Papillomavirus
HMRLECAI

SEQ ID NO: 24637 - protein, 9 aa, Artificial Sequence
  Peptide Derived from Human Papillomavirus
HMRLECAIY

SEQ ID NO: 24638 - protein, 10 aa, Artificial Sequence
  Peptide Derived from Human Papillomavirus
HMRLECAIYY

SEQ ID NO: 24639 - protein, 9 aa, Artificial Sequence
  Peptide Derived from Human Papillomavirus
HPAATHTKA

SEQ ID NO: 24640 - protein, 10 aa, Artificial Sequence
  Peptide Derived from Human Papillomavirus
HPAATHTKAV

SEQ ID NO: 24641 - protein, 11 aa, Artificial Sequence
  Peptide Derived from Human Papillomavirus
HPAATHTKAVA

SEQ ID NO: 24642 - protein, 8 aa, Artificial Sequence
  Peptide Derived from Human Papillomavirus
HQVVPTLA

SEQ ID NO: 24643 - protein, 9 aa, Artificial Sequence
  Peptide Derived from Human Papillomavirus
HQVVPTLAV

SEQ ID NO: 24644 - protein, 11 aa, Artificial Sequence
  Peptide Derived from Human Papillomavirus
IIRQHLANHPA

SEQ ID NO: 24645 - protein, 8 aa, Artificial Sequence
  Peptide Derived from Human Papillomavirus
ILCPTSVF

SEQ ID NO: 24646 - protein, 11 aa, Artificial Sequence
  Peptide Derived from Human Papillomavirus
IPKTITVSTGF

SEQ ID NO: 24647 - protein, 8 aa, Artificial Sequence
  Peptide Derived from Human Papillomavirus
IVHLKGDA

SEQ ID NO: 24648 - protein, 11 aa, Artificial Sequence
  Peptide Derived from Human Papillomavirus
IVHLKGDANTL

SEQ ID NO: 24649 - protein, 10 aa, Artificial Sequence
  Peptide Derived from Human Papillomavirus
IVTLTYDSEW

SEQ ID NO: 24650 - protein, 8 aa, Artificial Sequence
  Peptide Derived from Human Papillomavirus
KIPKTITV

SEQ ID NO: 24651 - protein, 8 aa, Artificial Sequence
  Peptide Derived from Human Papillomavirus
KLLHRDSV

SEQ ID NO: 24652 - protein, 11 aa, Artificial Sequence
  Peptide Derived from Human Papillomavirus
KLLHRDSVDSA

SEQ ID NO: 24653 - protein, 11 aa, Artificial Sequence
  Peptide Derived from Human Papillomavirus
KVWEVHAGGQV

SEQ ID NO: 24654 - protein, 10 aa, Artificial Sequence
  Peptide Derived from Human Papillomavirus
LLHRDSVDSA

SEQ ID NO: 24655 - protein, 8 aa, Artificial Sequence
  Peptide Derived from Human Papillomavirus
LQAIELQL

SEQ ID NO: 24656 - protein, 10 aa, Artificial Sequence
  Peptide Derived from Human Papillomavirus
LQAIELQLTL

SEQ ID NO: 24657 - protein, 8 aa, Artificial Sequence
  Peptide Derived from Human Papillomavirus
LQDVSLEV

SEQ ID NO: 24658 - protein, 9 aa, Artificial Sequence
  Peptide Derived from Human Papillomavirus
LQDVSLEVY

SEQ ID NO: 24659 - protein, 10 aa, Artificial Sequence
  Peptide Derived from Human Papillomavirus
LQDVSLEVYL

SEQ ID NO: 24660 - protein, 8 aa, Artificial Sequence
  Peptide Derived from Human Papillomavirus
LQLTLETI

SEQ ID NO: 24661 - protein, 9 aa, Artificial Sequence
  Peptide Derived from Human Papillomavirus
LQLTLETIY

SEQ ID NO: 24662 - protein, 8 aa, Artificial Sequence
  Peptide Derived from Human Papillomavirus
NPCHTTKL

SEQ ID NO: 24663 - protein, 9 aa, Artificial Sequence
  Peptide Derived from Human Papillomavirus
NPCHTTKLL

SEQ ID NO: 24664 - protein, 8 aa, Artificial Sequence
  Peptide Derived from Human Papillomavirus
NVCQDKIL

SEQ ID NO: 24665 - protein, 11 aa, Artificial Sequence
  Peptide Derived from Human Papillomavirus
NVCQDKILTHY

SEQ ID NO: 24666 - protein, 8 aa, Artificial Sequence
  Peptide Derived from Human Papillomavirus
NVKHKSAI

SEQ ID NO: 24667 - protein, 9 aa, Artificial Sequence
  Peptide Derived from Human Papillomavirus
NVKHKSAIV

SEQ ID NO: 24668 - protein, 11 aa, Artificial Sequence
  Peptide Derived from Human Papillomavirus
NVKHKSAIVTL

SEQ ID NO: 24669 - protein, 9 aa, Artificial Sequence
  Peptide Derived from Human Papillomavirus
PIVHLKGDA

SEQ ID NO: 24670 - protein, 8 aa, Artificial Sequence
  Peptide Derived from Human Papillomavirus
QLTLETIY

SEQ ID NO: 24671 - protein, 8 aa, Artificial Sequence
  Peptide Derived from Human Papillomavirus
QVDYYGLY

SEQ ID NO: 24672 - protein, 9 aa, Artificial Sequence
  Peptide Derived from Human Papillomavirus
QVDYYGLYY

SEQ ID NO: 24673 - protein, 10 aa, Artificial Sequence
  Peptide Derived from Human Papillomavirus
QVDYYGLYYV

SEQ ID NO: 24674 - protein, 9 aa, Artificial Sequence
  Peptide Derived from Human Papillomavirus
QVILCPTSV

SEQ ID NO: 24675 - protein, 10 aa, Artificial Sequence
  Peptide Derived from Human Papillomavirus
QVILCPTSVF

SEQ ID NO: 24676 - protein, 8 aa, Artificial Sequence
  Peptide Derived from Human Papillomavirus
QVKIPKTI

SEQ ID NO: 24677 - protein, 10 aa, Artificial Sequence
  Peptide Derived from Human Papillomavirus
QVKIPKTITV

SEQ ID NO: 24678 - protein, 8 aa, Artificial Sequence
  Peptide Derived from Human Papillomavirus
QVVPTLAV

SEQ ID NO: 24679 - protein, 11 aa, Artificial Sequence
  Peptide Derived from Human Papillomavirus
RINCNSNTTPI

SEQ ID NO: 24680 - protein, 8 aa, Artificial Sequence
  Peptide Derived from Human Papillomavirus
RLECAIYY

SEQ ID NO: 24681 - protein, 10 aa, Artificial Sequence
  Peptide Derived from Human Papillomavirus
RLECAIYYKA

SEQ ID NO: 24682 - protein, 9 aa, Artificial Sequence
  Peptide Derived from Human Papillomavirus
RLNVCQDKI

SEQ ID NO: 24683 - protein, 10 aa, Artificial Sequence
  Peptide Derived from Human Papillomavirus
RLNVCQDKIL

SEQ ID NO: 24684 - protein, 9 aa, Artificial Sequence
  Peptide Derived from Human Papillomavirus
RQHLANHPA

SEQ ID NO: 24685 - protein, 10 aa, Artificial Sequence
  Peptide Derived from Human Papillomavirus
RQHLANHPAA

SEQ ID NO: 24686 - protein, 8 aa, Artificial Sequence
  Peptide Derived from Human Papillomavirus
SLEVYLTA

SEQ ID NO: 24687 - protein, 9 aa, Artificial Sequence
  Peptide Derived from Human Papillomavirus
SPEIIRQHL

SEQ ID NO: 24688 - protein, 10 aa, Artificial Sequence
  Peptide Derived from Human Papillomavirus
SPEIIRQHLA

SEQ ID NO: 24689 - protein, 9 aa, Artificial Sequence
  Peptide Derived from Human Papillomavirus
SQVKIPKTI

SEQ ID NO: 24690 - protein, 11 aa, Artificial Sequence
  Peptide Derived from Human Papillomavirus
SQVKIPKTITV

SEQ ID NO: 24691 - protein, 8 aa, Artificial Sequence
  Peptide Derived from Human Papillomavirus
SQYSNEKW

SEQ ID NO: 24692 - protein, 10 aa, Artificial Sequence
  Peptide Derived from Human Papillomavirus
SQYSNEKWTL

SEQ ID NO: 24693 - protein, 8 aa, Artificial Sequence
  Peptide Derived from Human Papillomavirus
SVDSAPIL

SEQ ID NO: 24694 - protein, 10 aa, Artificial Sequence
  Peptide Derived from Human Papillomavirus
SVDSAPILTA

SEQ ID NO: 24695 - protein, 11 aa, Artificial Sequence
  Peptide Derived from Human Papillomavirus
SVDSAPILTAF

SEQ ID NO: 24696 - protein, 8 aa, Artificial Sequence
  Peptide Derived from Human Papillomavirus
SVFSSNEV

SEQ ID NO: 24697 - protein, 9 aa, Artificial Sequence
  Peptide Derived from Human Papillomavirus
SVTVVEGQV

SEQ ID NO: 24698 - protein, 11 aa, Artificial Sequence
  Peptide Derived from Human Papillomavirus
SVTVVEGQVDY

SEQ ID NO: 24699 - protein, 8 aa, Artificial Sequence
  Peptide Derived from Human Papillomavirus
TITVSTGF

SEQ ID NO: 24700 - protein, 9 aa, Artificial Sequence
  Peptide Derived from Human Papillomavirus
TITVSTGFM

SEQ ID NO: 24701 - protein, 11 aa, Artificial Sequence
  Peptide Derived from Human Papillomavirus
TITVSTGFMSI

SEQ ID NO: 24702 - protein, 9 aa, Artificial Sequence
  Peptide Derived from Human Papillomavirus
TLAVSKNKA

SEQ ID NO: 24703 - protein, 10 aa, Artificial Sequence
  Peptide Derived from Human Papillomavirus
TLAVSKNKAL

SEQ ID NO: 24704 - protein, 8 aa, Artificial Sequence
  Peptide Derived from Human Papillomavirus
TLCQRLNV

SEQ ID NO: 24705 - protein, 10 aa, Artificial Sequence
  Peptide Derived from Human Papillomavirus
TLETIYNSQY

SEQ ID NO: 24706 - protein, 9 aa, Artificial Sequence
  Peptide Derived from Human Papillomavirus
TLKCLRYRF

SEQ ID NO: 24707 - protein, 9 aa, Artificial Sequence
  Peptide Derived from Human Papillomavirus
TLQDVSLEV

SEQ ID NO: 24708 - protein, 10 aa, Artificial Sequence
  Peptide Derived from Human Papillomavirus
TLQDVSLEVY

SEQ ID NO: 24709 - protein, 11 aa, Artificial Sequence
  Peptide Derived from Human Papillomavirus
TLQDVSLEVYL

SEQ ID NO: 24710 - protein, 8 aa, Artificial Sequence
  Peptide Derived from Human Papillomavirus
TLTYDSEW

SEQ ID NO: 24711 - protein, 10 aa, Artificial Sequence
  Peptide Derived from Human Papillomavirus
TLYTAVSSTW

SEQ ID NO: 24712 - protein, 10 aa, Artificial Sequence
  Peptide Derived from Human Papillomavirus
TMHYTNWTHI

SEQ ID NO: 24713 - protein, 11 aa, Artificial Sequence
  Peptide Derived from Human Papillomavirus
TMHYTNWTHIY

SEQ ID NO: 24714 - protein, 10 aa, Artificial Sequence
  Peptide Derived from Human Papillomavirus
TPIVHLKGDA

SEQ ID NO: 24715 - protein, 10 aa, Artificial Sequence
  Peptide Derived from Human Papillomavirus
TVEVQFDGDI

SEQ ID NO: 24716 - protein, 9 aa, Artificial Sequence
  Peptide Derived from Human Papillomavirus
TVSTGFMSI

SEQ ID NO: 24717 - protein, 9 aa, Artificial Sequence
  Peptide Derived from Human Papillomavirus
TVVEGQVDY

SEQ ID NO: 24718 - protein, 10 aa, Artificial Sequence
  Peptide Derived from Human Papillomavirus
TVVEGQVDYY

SEQ ID NO: 24719 - protein, 8 aa, Artificial Sequence
  Peptide Derived from Human Papillomavirus
VILCPTSV

SEQ ID NO: 24720 - protein, 9 aa, Artificial Sequence
  Peptide Derived from Human Papillomavirus
VILCPTSVF

SEQ ID NO: 24721 - protein, 11 aa, Artificial Sequence
  Peptide Derived from Human Papillomavirus
VPTLAVSKNKA

SEQ ID NO: 24722 - protein, 11 aa, Artificial Sequence
  Peptide Derived from Human Papillomavirus
VQFDGDICNTM

SEQ ID NO: 24723 - protein, 10 aa, Artificial Sequence
  Peptide Derived from Human Papillomavirus
VQFKDDAEKY

SEQ ID NO: 24724 - protein, 8 aa, Artificial Sequence
  Peptide Derived from Human Papillomavirus
VVEGQVDY

SEQ ID NO: 24725 - protein, 9 aa, Artificial Sequence
  Peptide Derived from Human Papillomavirus
VVEGQVDYY

SEQ ID NO: 24726 - protein, 11 aa, Artificial Sequence
  Peptide Derived from Human Papillomavirus
VVEGQVDYYGL

SEQ ID NO: 24727 - protein, 10 aa, Artificial Sequence
  Peptide Derived from Human Papillomavirus
WQRDQFLSQV

SEQ ID NO: 24728 - protein, 8 aa, Artificial Sequence
  Peptide Derived from Human Papillomavirus
YICEEASV

SEQ ID NO: 24729 - protein, 10 aa, Artificial Sequence
  Peptide Derived from Human Papillomavirus
YICEEASVTV

SEQ ID NO: 24730 - protein, 11 aa, Artificial Sequence
  Peptide Derived from Human Papillomavirus
YICEEASVTVV

SEQ ID NO: 24731 - protein, 9 aa, Artificial Sequence
  Peptide Derived from Human Papillomavirus
YLTAPTGCI

SEQ ID NO: 24732 - protein, 9 aa, Artificial Sequence
  Peptide Derived from Human Papillomavirus
YVHEGIRTY

SEQ ID NO: 24733 - protein, 10 aa, Artificial Sequence
  Peptide Derived from Human Papillomavirus
YVHEGIRTYF

SEQ ID NO: 24734 - protein, 11 aa, Artificial Sequence
  Peptide Derived from Human Papillomavirus
YVHEGIRTYFV

SEQ ID NO: 24735 - protein, 8 aa, Artificial Sequence
  Peptide Derived from Human Papillomavirus
CLLIRPLL

SEQ ID NO: 24736 - protein, 9 aa, Artificial Sequence
  Peptide Derived from Human Papillomavirus
CLLIRPLLL

SEQ ID NO: 24737 - protein, 11 aa, Artificial Sequence
  Peptide Derived from Human Papillomavirus
CLLIRPLLLSV

SEQ ID NO: 24738 - protein, 9 aa, Artificial Sequence
  Peptide Derived from Human Papillomavirus
CVCLLIRPL

SEQ ID NO: 24739 - protein, 10 aa, Artificial Sequence
  Peptide Derived from Human Papillomavirus
CVCLLIRPLL

SEQ ID NO: 24740 - protein, 11 aa, Artificial Sequence
  Peptide Derived from Human Papillomavirus
CVCLLIRPLLL

SEQ ID NO: 24741 - protein, 8 aa, Artificial Sequence
  Peptide Derived from Human Papillomavirus
CVLLCVCL

SEQ ID NO: 24742 - protein, 9 aa, Artificial Sequence
  Peptide Derived from Human Papillomavirus
CVLLCVCLL

SEQ ID NO: 24743 - protein, 10 aa, Artificial Sequence
  Peptide Derived from Human Papillomavirus
CVLLCVCLLI

SEQ ID NO: 24744 - protein, 8 aa, Artificial Sequence
  Peptide Derived from Human Papillomavirus
FIVYIIFV

SEQ ID NO: 24745 - protein, 9 aa, Artificial Sequence
  Peptide Derived from Human Papillomavirus
FIVYIIFVY

SEQ ID NO: 24746 - protein, 10 aa, Artificial Sequence
  Peptide Derived from Human Papillomavirus
FIVYIIFVYI

SEQ ID NO: 24747 - protein, 9 aa, Artificial Sequence
  Peptide Derived from Human Papillomavirus
FLIHTHARF

SEQ ID NO: 24748 - protein, 10 aa, Artificial Sequence
  Peptide Derived from Human Papillomavirus
FLIHTHARFL

SEQ ID NO: 24749 - protein, 11 aa, Artificial Sequence
  Peptide Derived from Human Papillomavirus
FLIHTHARFLI

SEQ ID NO: 24750 - protein, 8 aa, Artificial Sequence
  Peptide Derived from Human Papillomavirus
FLLCFCVL

SEQ ID NO: 24751 - protein, 9 aa, Artificial Sequence
  Peptide Derived from Human Papillomavirus
FLLCFCVLL

SEQ ID NO: 24752 - protein, 11 aa, Artificial Sequence
  Peptide Derived from Human Papillomavirus
FLLCFCVLLCV

SEQ ID NO: 24753 - protein, 8 aa, Artificial Sequence
  Peptide Derived from Human Papillomavirus
FVYIPLFL

SEQ ID NO: 24754 - protein, 9 aa, Artificial Sequence
  Peptide Derived from Human Papillomavirus
FVYIPLFLI

SEQ ID NO: 24755 - protein, 8 aa, Artificial Sequence
  Peptide Derived from Human Papillomavirus
IIFVYIPL

SEQ ID NO: 24756 - protein, 9 aa, Artificial Sequence
  Peptide Derived from Human Papillomavirus
IIFVYIPLF

SEQ ID NO: 24757 - protein, 10 aa, Artificial Sequence
  Peptide Derived from Human Papillomavirus
IIFVYIPLFL

SEQ ID NO: 24758 - protein, 11 aa, Artificial Sequence
  Peptide Derived from Human Papillomavirus
IIFVYIPLFLI

SEQ ID NO: 24759 - protein, 8 aa, Artificial Sequence
  Peptide Derived from Human Papillomavirus
IILVLLLW

SEQ ID NO: 24760 - protein, 9 aa, Artificial Sequence
  Peptide Derived from Human Papillomavirus
IILVLLLWI

SEQ ID NO: 24761 - protein, 11 aa, Artificial Sequence
  Peptide Derived from Human Papillomavirus
IILVLLLWITA

SEQ ID NO: 24762 - protein, 8 aa, Artificial Sequence
  Peptide Derived from Human Papillomavirus
ILVLLLWI

SEQ ID NO: 24763 - protein, 10 aa, Artificial Sequence
  Peptide Derived from Human Papillomavirus
ILVLLLWITA

SEQ ID NO: 24764 - protein, 11 aa, Artificial Sequence
  Peptide Derived from Human Papillomavirus
ILVLLLWITAA

SEQ ID NO: 24765 - protein, 10 aa, Artificial Sequence
  Peptide Derived from Human Papillomavirus
IPLFLIHTHA

SEQ ID NO: 24766 - protein, 8 aa, Artificial Sequence
  Peptide Derived from Human Papillomavirus
IVYIIFVY

SEQ ID NO: 24767 - protein, 9 aa, Artificial Sequence
  Peptide Derived from Human Papillomavirus
IVYIIFVYI

SEQ ID NO: 24768 - protein, 11 aa, Artificial Sequence
  Peptide Derived from Human Papillomavirus
IVYIIFVYIPL

SEQ ID NO: 24769 - protein, 8 aa, Artificial Sequence
  Peptide Derived from Human Papillomavirus
LIHTHARF

SEQ ID NO: 24770 - protein, 9 aa, Artificial Sequence
  Peptide Derived from Human Papillomavirus
LIHTHARFL

SEQ ID NO: 24771 - protein, 10 aa, Artificial Sequence
  Peptide Derived from Human Papillomavirus
LIHTHARFLI

SEQ ID NO: 24772 - protein, 8 aa, Artificial Sequence
  Peptide Derived from Human Papillomavirus
LIILVLLL

SEQ ID NO: 24773 - protein, 9 aa, Artificial Sequence
  Peptide Derived from Human Papillomavirus
LIILVLLLW

SEQ ID NO: 24774 - protein, 10 aa, Artificial Sequence
  Peptide Derived from Human Papillomavirus
LIILVLLLWI

SEQ ID NO: 24775 - protein, 9 aa, Artificial Sequence
  Peptide Derived from Human Papillomavirus
LIRPLLLSV

SEQ ID NO: 24776 - protein, 9 aa, Artificial Sequence
  Peptide Derived from Human Papillomavirus
LLACFLLCF

SEQ ID NO: 24777 - protein, 11 aa, Artificial Sequence
  Peptide Derived from Human Papillomavirus
LLACFLLCFCV

SEQ ID NO: 24778 - protein, 8 aa, Artificial Sequence
  Peptide Derived from Human Papillomavirus
LLCFCVLL

SEQ ID NO: 24779 - protein, 10 aa, Artificial Sequence
  Peptide Derived from Human Papillomavirus
LLCFCVLLCV

SEQ ID NO: 24780 - protein, 8 aa, Artificial Sequence
  Peptide Derived from Human Papillomavirus
LLCVCLLI

SEQ ID NO: 24781 - protein, 11 aa, Artificial Sequence
  Peptide Derived from Human Papillomavirus
LLCVCLLIRPL

SEQ ID NO: 24782 - protein, 8 aa, Artificial Sequence
  Peptide Derived from Human Papillomavirus
LLIRPLLL

SEQ ID NO: 24783 - protein, 10 aa, Artificial Sequence
  Peptide Derived from Human Papillomavirus
LLIRPLLLSV

SEQ ID NO: 24784 - protein, 8 aa, Artificial Sequence
  Peptide Derived from Human Papillomavirus
LLLSVSTY

SEQ ID NO: 24785 - protein, 11 aa, Artificial Sequence
  Peptide Derived from Human Papillomavirus
LLLSVSTYTSL

SEQ ID NO: 24786 - protein, 8 aa, Artificial Sequence
  Peptide Derived from Human Papillomavirus
LLLWITAA

SEQ ID NO: 24787 - protein, 10 aa, Artificial Sequence
  Peptide Derived from Human Papillomavirus
LLLWITAASA

SEQ ID NO: 24788 - protein, 11 aa, Artificial Sequence
  Peptide Derived from Human Papillomavirus
LLLWITAASAF

SEQ ID NO: 24789 - protein, 10 aa, Artificial Sequence
  Peptide Derived from Human Papillomavirus
LLSVSTYTSL

SEQ ID NO: 24790 - protein, 11 aa, Artificial Sequence
  Peptide Derived from Human Papillomavirus
LLSVSTYTSLI

SEQ ID NO: 24791 - protein, 9 aa, Artificial Sequence
  Peptide Derived from Human Papillomavirus
LLWITAASA

SEQ ID NO: 24792 - protein, 10 aa, Artificial Sequence
  Peptide Derived from Human Papillomavirus
LLWITAASAF

SEQ ID NO: 24793 - protein, 9 aa, Artificial Sequence
  Peptide Derived from Human Papillomavirus
LVLLLWITA

SEQ ID NO: 24794 - protein, 10 aa, Artificial Sequence
  Peptide Derived from Human Papillomavirus
LVLLLWITAA

SEQ ID NO: 24795 - protein, 9 aa, Artificial Sequence
  Peptide Derived from Human Papillomavirus
NLDTASTTL

SEQ ID NO: 24796 - protein, 10 aa, Artificial Sequence
  Peptide Derived from Human Papillomavirus
NLDTASTTLL

SEQ ID NO: 24797 - protein, 11 aa, Artificial Sequence
  Peptide Derived from Human Papillomavirus
NLDTASTTLLA

SEQ ID NO: 24798 - protein, 9 aa, Artificial Sequence
  Peptide Derived from Human Papillomavirus
PLFLIHTHA

SEQ ID NO: 24799 - protein, 11 aa, Artificial Sequence
  Peptide Derived from Human Papillomavirus
PLFLIHTHARF

SEQ ID NO: 24800 - protein, 9 aa, Artificial Sequence
  Peptide Derived from Human Papillomavirus
PLLLSVSTY

SEQ ID NO: 24801 - protein, 10 aa, Artificial Sequence
  Peptide Derived from Human Papillomavirus
RPLLLSVSTY

SEQ ID NO: 24802 - protein, 8 aa, Artificial Sequence
  Peptide Derived from Human Papillomavirus
SLIILVLL

SEQ ID NO: 24803 - protein, 9 aa, Artificial Sequence
  Peptide Derived from Human Papillomavirus
SLIILVLLL

SEQ ID NO: 24804 - protein, 10 aa, Artificial Sequence
  Peptide Derived from Human Papillomavirus
SLIILVLLLW

SEQ ID NO: 24805 - protein, 11 aa, Artificial Sequence
  Peptide Derived from Human Papillomavirus
SLIILVLLLWI

SEQ ID NO: 24806 - protein, 8 aa, Artificial Sequence
  Peptide Derived from Human Papillomavirus
SVSTYTSL

SEQ ID NO: 24807 - protein, 9 aa, Artificial Sequence
  Peptide Derived from Human Papillomavirus
SVSTYTSLI

SEQ ID NO: 24808 - protein, 10 aa, Artificial Sequence
  Peptide Derived from Human Papillomavirus
SVSTYTSLII

SEQ ID NO: 24809 - protein, 11 aa, Artificial Sequence
  Peptide Derived from Human Papillomavirus
SVSTYTSLIIL

SEQ ID NO: 24810 - protein, 8 aa, Artificial Sequence
  Peptide Derived from Human Papillomavirus
TLLACFLL

SEQ ID NO: 24811 - protein, 10 aa, Artificial Sequence
  Peptide Derived from Human Papillomavirus
TLLACFLLCF

SEQ ID NO: 24812 - protein, 8 aa, Artificial Sequence
  Peptide Derived from Human Papillomavirus
VLLCVCLL

SEQ ID NO: 24813 - protein, 9 aa, Artificial Sequence
  Peptide Derived from Human Papillomavirus
VLLCVCLLI

SEQ ID NO: 24814 - protein, 8 aa, Artificial Sequence
  Peptide Derived from Human Papillomavirus
VLLLWITA

SEQ ID NO: 24815 - protein, 9 aa, Artificial Sequence
  Peptide Derived from Human Papillomavirus
VLLLWITAA

SEQ ID NO: 24816 - protein, 11 aa, Artificial Sequence
  Peptide Derived from Human Papillomavirus
VLLLWITAASA

SEQ ID NO: 24817 - protein, 8 aa, Artificial Sequence
  Peptide Derived from Human Papillomavirus
WITAASAF

SEQ ID NO: 24818 - protein, 11 aa, Artificial Sequence
  Peptide Derived from Human Papillomavirus
WITAASAFRCF

SEQ ID NO: 24819 - protein, 9 aa, Artificial Sequence
  Peptide Derived from Human Papillomavirus
YIIFVYIPL

SEQ ID NO: 24820 - protein, 10 aa, Artificial Sequence
  Peptide Derived from Human Papillomavirus
YIIFVYIPLF

SEQ ID NO: 24821 - protein, 11 aa, Artificial Sequence
  Peptide Derived from Human Papillomavirus
YIIFVYIPLFL

SEQ ID NO: 24822 - protein, 11 aa, Artificial Sequence
  Peptide Derived from Human Papillomavirus
YIPLFLIHTHA

SEQ ID NO: 24823 - protein, 9 aa, Artificial Sequence
  Peptide Derived from Human Papillomavirus
AVCDKCLKF

SEQ ID NO: 24824 - protein, 10 aa, Artificial Sequence
  Peptide Derived from Human Papillomavirus
AVCDKCLKFY

SEQ ID NO: 24825 - protein, 8 aa, Artificial Sequence
  Peptide Derived from Human Papillomavirus
CINCQKPL

SEQ ID NO: 24826 - protein, 10 aa, Artificial Sequence
  Peptide Derived from Human Papillomavirus
CIVYRDGNPY

SEQ ID NO: 24827 - protein, 11 aa, Artificial Sequence
  Peptide Derived from Human Papillomavirus
CIVYRDGNPYA

SEQ ID NO: 24828 - protein, 8 aa, Artificial Sequence
  Peptide Derived from Human Papillomavirus
CLKFYSKI

SEQ ID NO: 24829 - protein, 11 aa, Artificial Sequence
  Peptide Derived from Human Papillomavirus
CLKFYSKISEY

SEQ ID NO: 24830 - protein, 9 aa, Artificial Sequence
  Peptide Derived from Human Papillomavirus
CPEEKQRHL

SEQ ID NO: 24831 - protein, 8 aa, Artificial Sequence
  Peptide Derived from Human Papillomavirus
CVYCKQQL

SEQ ID NO: 24832 - protein, 9 aa, Artificial Sequence
  Peptide Derived from Human Papillomavirus
CVYCKQQLL

SEQ ID NO: 24833 - protein, 8 aa, Artificial Sequence
  Peptide Derived from Human Papillomavirus
DIILECVY

SEQ ID NO: 24834 - protein, 9 aa, Artificial Sequence
  Peptide Derived from Human Papillomavirus
DPQERPRKL

SEQ ID NO: 24835 - protein, 9 aa, Artificial Sequence
  Peptide Derived from Human Papillomavirus
ELQTTIHDI

SEQ ID NO: 24836 - protein, 10 aa, Artificial Sequence
  Peptide Derived from Human Papillomavirus
ELQTTIHDII

SEQ ID NO: 24837 - protein, 11 aa, Artificial Sequence
  Peptide Derived from Human Papillomavirus
ELQTTIHDIIL

SEQ ID NO: 24838 - protein, 8 aa, Artificial Sequence
  Peptide Derived from Human Papillomavirus
EQQYNKPL

SEQ ID NO: 24839 - protein, 11 aa, Artificial Sequence
  Peptide Derived from Human Papillomavirus
EQQYNKPLCDL

SEQ ID NO: 24840 - protein, 10 aa, Artificial Sequence
  Peptide Derived from Human Papillomavirus
EVYDFAFRDL

SEQ ID NO: 24841 - protein, 11 aa, Artificial Sequence
  Peptide Derived from Human Papillomavirus
FQDPQERPRKL

SEQ ID NO: 24842 - protein, 8 aa, Artificial Sequence
  Peptide Derived from Human Papillomavirus
HLDKKQRF

SEQ ID NO: 24843 - protein, 11 aa, Artificial Sequence
  Peptide Derived from Human Papillomavirus
HLDKKQRFHNI

SEQ ID NO: 24844 - protein, 8 aa, Artificial Sequence
  Peptide Derived from Human Papillomavirus
HQKRTAMF

SEQ ID NO: 24845 - protein, 11 aa, Artificial Sequence
  Peptide Derived from Human Papillomavirus
ILECVYCKQQL

SEQ ID NO: 24846 - protein, 9 aa, Artificial Sequence
  Peptide Derived from Human Papillomavirus
IVYRDGNPY

SEQ ID NO: 24847 - protein, 10 aa, Artificial Sequence
  Peptide Derived from Human Papillomavirus
IVYRDGNPYA

SEQ ID NO: 24848 - protein, 11 aa, Artificial Sequence
  Peptide Derived from Human Papillomavirus
IVYRDGNPYAV

SEQ ID NO: 24849 - protein, 8 aa, Artificial Sequence
  Peptide Derived from Human Papillomavirus
KISEYRHY

SEQ ID NO: 24850 - protein, 10 aa, Artificial Sequence
  Peptide Derived from Human Papillomavirus
KISEYRHYCY

SEQ ID NO: 24851 - protein, 9 aa, Artificial Sequence
  Peptide Derived from Human Papillomavirus
KLPQLCTEL

SEQ ID NO: 24852 - protein, 8 aa, Artificial Sequence
  Peptide Derived from Human Papillomavirus
KPLCDLLI

SEQ ID NO: 24853 - protein, 11 aa, Artificial Sequence
  Peptide Derived from Human Papillomavirus
KPLCDLLIRCI

SEQ ID NO: 24854 - protein, 9 aa, Artificial Sequence
  Peptide Derived from Human Papillomavirus
KQQLLRREV

SEQ ID NO: 24855 - protein, 10 aa, Artificial Sequence
  Peptide Derived from Human Papillomavirus
KQQLLRREVY

SEQ ID NO: 24856 - protein, 11 aa, Artificial Sequence
  Peptide Derived from Human Papillomavirus
KQRFHNIRGRW

SEQ ID NO: 24857 - protein, 11 aa, Artificial Sequence
  Peptide Derived from Human Papillomavirus
KQRHLDKKQRF

SEQ ID NO: 24858 - protein, 11 aa, Artificial Sequence
  Peptide Derived from Human Papillomavirus
LIRCINCQKPL

SEQ ID NO: 24859 - protein, 9 aa, Artificial Sequence
  Peptide Derived from Human Papillomavirus
LLRREVYDF

SEQ ID NO: 24860 - protein, 10 aa, Artificial Sequence
  Peptide Derived from Human Papillomavirus
LLRREVYDFA

SEQ ID NO: 24861 - protein, 11 aa, Artificial Sequence
  Peptide Derived from Human Papillomavirus
LLRREVYDFAF

SEQ ID NO: 24862 - protein, 8 aa, Artificial Sequence
  Peptide Derived from Human Papillomavirus
LPQLCTEL

SEQ ID NO: 24863 - protein, 8 aa, Artificial Sequence
  Peptide Derived from Human Papillomavirus
LQTTIHDI

SEQ ID NO: 24864 - protein, 9 aa, Artificial Sequence
  Peptide Derived from Human Papillomavirus
LQTTIHDII

SEQ ID NO: 24865 - protein, 10 aa, Artificial Sequence
  Peptide Derived from Human Papillomavirus
LQTTIHDIIL

SEQ ID NO: 24866 - protein, 11 aa, Artificial Sequence
  Peptide Derived from Human Papillomavirus
NIRGRWTGRCM

SEQ ID NO: 24867 - protein, 10 aa, Artificial Sequence
  Peptide Derived from Human Papillomavirus
NPYAVCDKCL

SEQ ID NO: 24868 - protein, 10 aa, Artificial Sequence
  Peptide Derived from Human Papillomavirus
PLCDLLIRCI

SEQ ID NO: 24869 - protein, 11 aa, Artificial Sequence
  Peptide Derived from Human Papillomavirus
PLCPEEKQRHL

SEQ ID NO: 24870 - protein, 8 aa, Artificial Sequence
  Peptide Derived from Human Papillomavirus
PQERPRKL

SEQ ID NO: 24871 - protein, 11 aa, Artificial Sequence
  Peptide Derived from Human Papillomavirus
PQERPRKLPQL

SEQ ID NO: 24872 - protein, 11 aa, Artificial Sequence
  Peptide Derived from Human Papillomavirus
PQLCTELQTTI

SEQ ID NO: 24873 - protein, 10 aa, Artificial Sequence
  Peptide Derived from Human Papillomavirus
QLCTELQTTI

SEQ ID NO: 24874 - protein, 8 aa, Artificial Sequence
  Peptide Derived from Human Papillomavirus
QLLRREVY

SEQ ID NO: 24875 - protein, 10 aa, Artificial Sequence
  Peptide Derived from Human Papillomavirus
QLLRREVYDF

SEQ ID NO: 24876 - protein, 11 aa, Artificial Sequence
  Peptide Derived from Human Papillomavirus
QLLRREVYDFA

SEQ ID NO: 24877 - protein, 8 aa, Artificial Sequence
  Peptide Derived from Human Papillomavirus
QQLLRREV

SEQ ID NO: 24878 - protein, 9 aa, Artificial Sequence
  Peptide Derived from Human Papillomavirus
QQLLRREVY

SEQ ID NO: 24879 - protein, 11 aa, Artificial Sequence
  Peptide Derived from Human Papillomavirus
QQLLRREVYDF

SEQ ID NO: 24880 - protein, 10 aa, Artificial Sequence
  Peptide Derived from Human Papillomavirus
QQYNKPLCDL

SEQ ID NO: 24881 - protein, 11 aa, Artificial Sequence
  Peptide Derived from Human Papillomavirus
QQYNKPLCDLL

SEQ ID NO: 24882 - protein, 8 aa, Artificial Sequence
  Peptide Derived from Human Papillomavirus
RPRKLPQL

SEQ ID NO: 24883 - protein, 11 aa, Artificial Sequence
  Peptide Derived from Human Papillomavirus
SLYGTTLEQQY

SEQ ID NO: 24884 - protein, 10 aa, Artificial Sequence
  Peptide Derived from Human Papillomavirus
TIHDIILECV

SEQ ID NO: 24885 - protein, 11 aa, Artificial Sequence
  Peptide Derived from Human Papillomavirus
TIHDIILECVY

SEQ ID NO: 24886 - protein, 10 aa, Artificial Sequence
  Peptide Derived from Human Papillomavirus
TLEQQYNKPL

SEQ ID NO: 24887 - protein, 9 aa, Artificial Sequence
  Peptide Derived from Human Papillomavirus
CVQSTHVDI

SEQ ID NO: 24888 - protein, 8 aa, Artificial Sequence
  Peptide Derived from Human Papillomavirus
DIRTLEDL

SEQ ID NO: 24889 - protein, 9 aa, Artificial Sequence
  Peptide Derived from Human Papillomavirus
DIRTLEDLL

SEQ ID NO: 24890 - protein, 10 aa, Artificial Sequence
  Peptide Derived from Human Papillomavirus
DIRTLEDLLM

SEQ ID NO: 24891 - protein, 9 aa, Artificial Sequence
  Peptide Derived from Human Papillomavirus
DLLMGTLGI

SEQ ID NO: 24892 - protein, 10 aa, Artificial Sequence
  Peptide Derived from Human Papillomavirus
DLLMGTLGIV

SEQ ID NO: 24893 - protein, 9 aa, Artificial Sequence
  Peptide Derived from Human Papillomavirus
DLQPETTDL

SEQ ID NO: 24894 - protein, 10 aa, Artificial Sequence
  Peptide Derived from Human Papillomavirus
DLQPETTDLY

SEQ ID NO: 24895 - protein, 8 aa, Artificial Sequence
  Peptide Derived from Human Papillomavirus
DLYCYEQL

SEQ ID NO: 24896 - protein, 9 aa, Artificial Sequence
  Peptide Derived from Human Papillomavirus
EIDGPAGQA

SEQ ID NO: 24897 - protein, 9 aa, Artificial Sequence
  Peptide Derived from Human Papillomavirus
EPDRAHYNI

SEQ ID NO: 24898 - protein, 10 aa, Artificial Sequence
  Peptide Derived from Human Papillomavirus
EPDRAHYNIV

SEQ ID NO: 24899 - protein, 11 aa, Artificial Sequence
  Peptide Derived from Human Papillomavirus
GPAGQAEPDRA

SEQ ID NO: 24900 - protein, 8 aa, Artificial Sequence
  Peptide Derived from Human Papillomavirus
GQAEPDRA

SEQ ID NO: 24901 - protein, 10 aa, Artificial Sequence
  Peptide Derived from Human Papillomavirus
GQAEPDRAHY

SEQ ID NO: 24902 - protein, 10 aa, Artificial Sequence
  Peptide Derived from Human Papillomavirus
HVDIRTLEDL

SEQ ID NO: 24903 - protein, 11 aa, Artificial Sequence
  Peptide Derived from Human Papillomavirus
HVDIRTLEDLL

SEQ ID NO: 24904 - protein, 8 aa, Artificial Sequence
  Peptide Derived from Human Papillomavirus
LLMGTLGI

SEQ ID NO: 24905 - protein, 9 aa, Artificial Sequence
  Peptide Derived from Human Papillomavirus
LLMGTLGIV

SEQ ID NO: 24906 - protein, 8 aa, Artificial Sequence
  Peptide Derived from Human Papillomavirus
LMGTLGIV

SEQ ID NO: 24907 - protein, 11 aa, Artificial Sequence
  Peptide Derived from Human Papillomavirus
LMGTLGIVCPI

SEQ ID NO: 24908 - protein, 8 aa, Artificial Sequence
  Peptide Derived from Human Papillomavirus
LQPETTDL

SEQ ID NO: 24909 - protein, 9 aa, Artificial Sequence
  Peptide Derived from Human Papillomavirus
LQPETTDLY

SEQ ID NO: 24910 - protein, 11 aa, Artificial Sequence
  Peptide Derived from Human Papillomavirus
LQPETTDLYCY

SEQ ID NO: 24911 - protein, 11 aa, Artificial Sequence
  Peptide Derived from Human Papillomavirus
MLDLQPETTDL

SEQ ID NO: 24912 - protein, 8 aa, Artificial Sequence
  Peptide Derived from Human Papillomavirus
QPETTDLY

SEQ ID NO: 24913 - protein, 10 aa, Artificial Sequence
  Peptide Derived from Human Papillomavirus
QPETTDLYCY

SEQ ID NO: 24914 - protein, 9 aa, Artificial Sequence
  Peptide Derived from Human Papillomavirus
RLCVQSTHV

SEQ ID NO: 24915 - protein, 11 aa, Artificial Sequence
  Peptide Derived from Human Papillomavirus
RLCVQSTHVDI

SEQ ID NO: 24916 - protein, 10 aa, Artificial Sequence
  Peptide Derived from Human Papillomavirus
TLEDLLMGTL

SEQ ID NO: 24917 - protein, 8 aa, Artificial Sequence
  Peptide Derived from Human Papillomavirus
TLGIVCPI

SEQ ID NO: 24918 - protein, 9 aa, Artificial Sequence
  Peptide Derived from Human Papillomavirus
TLHEYMLDL

SEQ ID NO: 24919 - protein, 11 aa, Artificial Sequence
  Peptide Derived from Human Papillomavirus
TLRLCVQSTHV

SEQ ID NO: 24920 - protein, 8 aa, Artificial Sequence
  Peptide Derived from Human Papillomavirus
TPTLHEYM

SEQ ID NO: 24921 - protein, 9 aa, Artificial Sequence
  Peptide Derived from Human Papillomavirus
TPTLHEYML

SEQ ID NO: 24922 - protein, 11 aa, Artificial Sequence
  Peptide Derived from Human Papillomavirus
TPTLHEYMLDL

SEQ ID NO: 24923 - protein, 8 aa, Artificial Sequence
  Peptide Derived from Human Papillomavirus
VQSTHVDI

SEQ ID NO: 24924 - protein, 11 aa, Artificial Sequence
  Peptide Derived from Human Papillomavirus
VQSTHVDIRTL

SEQ ID NO: 24925 - protein, 11 aa, Artificial Sequence
  Peptide Derived from Human Papillomavirus
AIACQKHTPPA

SEQ ID NO: 24926 - protein, 9 aa, Artificial Sequence
  Peptide Derived from Human Papillomavirus
AISTSETTY

SEQ ID NO: 24927 - protein, 9 aa, Artificial Sequence
  Peptide Derived from Human Papillomavirus
AMDFTTLQA

SEQ ID NO: 24928 - protein, 10 aa, Artificial Sequence
  Peptide Derived from Human Papillomavirus
APKEDPLKKY

SEQ ID NO: 24929 - protein, 8 aa, Artificial Sequence
  Peptide Derived from Human Papillomavirus
AQGHNNGI

SEQ ID NO: 24930 - protein, 10 aa, Artificial Sequence
  Peptide Derived from Human Papillomavirus
AQGHNNGICW

SEQ ID NO: 24931 - protein, 8 aa, Artificial Sequence
  Peptide Derived from Human Papillomavirus
AQIFNKPY

SEQ ID NO: 24932 - protein, 9 aa, Artificial Sequence
  Peptide Derived from Human Papillomavirus
AQIFNKPYW

SEQ ID NO: 24933 - protein, 10 aa, Artificial Sequence
  Peptide Derived from Human Papillomavirus
AQIFNKPYWL

SEQ ID NO: 24934 - protein, 10 aa, Artificial Sequence
  Peptide Derived from Human Papillomavirus
AVGENVPDDL

SEQ ID NO: 24935 - protein, 11 aa, Artificial Sequence
  Peptide Derived from Human Papillomavirus
AVGENVPDDLY

SEQ ID NO: 24936 - protein, 9 aa, Artificial Sequence
  Peptide Derived from Human Papillomavirus
AVGHPYFPI

SEQ ID NO: 24937 - protein, 10 aa, Artificial Sequence
  Peptide Derived from Human Papillomavirus
AVNPGDCPPL

SEQ ID NO: 24938 - protein, 11 aa, Artificial Sequence
  Peptide Derived from Human Papillomavirus
CISMDYKQTQL

SEQ ID NO: 24939 - protein, 9 aa, Artificial Sequence
  Peptide Derived from Human Papillomavirus
CLIGCKPPI

SEQ ID NO: 24940 - protein, 10 aa, Artificial Sequence
  Peptide Derived from Human Papillomavirus
CPPLELINTV

SEQ ID NO: 24941 - protein, 11 aa, Artificial Sequence
  Peptide Derived from Human Papillomavirus
CPPLELINTVI

SEQ ID NO: 24942 - protein, 8 aa, Artificial Sequence
  Peptide Derived from Human Papillomavirus
CQKHTPPA

SEQ ID NO: 24943 - protein, 9 aa, Artificial Sequence
  Peptide Derived from Human Papillomavirus
DICTSICKY

SEQ ID NO: 24944 - protein, 11 aa, Artificial Sequence
  Peptide Derived from Human Papillomavirus
DLDQFPLGRKF

SEQ ID NO: 24945 - protein, 8 aa, Artificial Sequence
  Peptide Derived from Human Papillomavirus
DLQFIFQL

SEQ ID NO: 24946 - protein, 11 aa, Artificial Sequence
  Peptide Derived from Human Papillomavirus
DLQFIFQLCKI

SEQ ID NO: 24947 - protein, 11 aa, Artificial Sequence
  Peptide Derived from Human Papillomavirus
DLYIKGSGSTA

SEQ ID NO: 24948 - protein, 9 aa, Artificial Sequence
  Peptide Derived from Human Papillomavirus
DMVDTGFGA

SEQ ID NO: 24949 - protein, 10 aa, Artificial Sequence
  Peptide Derived from Human Papillomavirus
DMVDTGFGAM

SEQ ID NO: 24950 - protein, 8 aa, Artificial Sequence
  Peptide Derived from Human Papillomavirus
DPLKKYTF

SEQ ID NO: 24951 - protein, 9 aa, Artificial Sequence
  Peptide Derived from Human Papillomavirus
DPLKKYTFW

SEQ ID NO: 24952 - protein, 11 aa, Artificial Sequence
  Peptide Derived from Human Papillomavirus
DPLKKYTFWEV

SEQ ID NO: 24953 - protein, 9 aa, Artificial Sequence
  Peptide Derived from Human Papillomavirus
DQFPLGRKF

SEQ ID NO: 24954 - protein, 10 aa, Artificial Sequence
  Peptide Derived from Human Papillomavirus
DQFPLGRKFL

SEQ ID NO: 24955 - protein, 11 aa, Artificial Sequence
  Peptide Derived from Human Papillomavirus
DQFPLGRKFLL

SEQ ID NO: 24956 - protein, 9 aa, Artificial Sequence
  Peptide Derived from Human Papillomavirus
DVMTYIHSM

SEQ ID NO: 24957 - protein, 8 aa, Artificial Sequence
  Peptide Derived from Human Papillomavirus
DVNVYHIF

SEQ ID NO: 24958 - protein, 9 aa, Artificial Sequence
  Peptide Derived from Human Papillomavirus
DVNVYHIFF

SEQ ID NO: 24959 - protein, 11 aa, Artificial Sequence
  Peptide Derived from Human Papillomavirus
DVNVYHIFFQM

SEQ ID NO: 24960 - protein, 8 aa, Artificial Sequence
  Peptide Derived from Human Papillomavirus
EPYGDSLF

SEQ ID NO: 24961 - protein, 9 aa, Artificial Sequence
  Peptide Derived from Human Papillomavirus
EPYGDSLFF

SEQ ID NO: 24962 - protein, 10 aa, Artificial Sequence
  Peptide Derived from Human Papillomavirus
EPYGDSLFFY

SEQ ID NO: 24963 - protein, 11 aa, Artificial Sequence
  Peptide Derived from Human Papillomavirus
EPYGDSLFFYL

SEQ ID NO: 24964 - protein, 8 aa, Artificial Sequence
  Peptide Derived from Human Papillomavirus
EQMFVRHL

SEQ ID NO: 24965 - protein, 9 aa, Artificial Sequence
  Peptide Derived from Human Papillomavirus
EQMFVRHLF

SEQ ID NO: 24966 - protein, 8 aa, Artificial Sequence
  Peptide Derived from Human Papillomavirus
EVGRGQPL

SEQ ID NO: 24967 - protein, 10 aa, Artificial Sequence
  Peptide Derived from Human Papillomavirus
EVGRGQPLGV

SEQ ID NO: 24968 - protein, 8 aa, Artificial Sequence
  Peptide Derived from Human Papillomavirus
EVNLKEKF

SEQ ID NO: 24969 - protein, 10 aa, Artificial Sequence
  Peptide Derived from Human Papillomavirus
EVNLKEKFSA

SEQ ID NO: 24970 - protein, 10 aa, Artificial Sequence
  Peptide Derived from Human Papillomavirus
EVPLDICTSI

SEQ ID NO: 24971 - protein, 8 aa, Artificial Sequence
  Peptide Derived from Human Papillomavirus
FIFQLCKI

SEQ ID NO: 24972 - protein, 10 aa, Artificial Sequence
  Peptide Derived from Human Papillomavirus
FIFQLCKITL

SEQ ID NO: 24973 - protein, 10 aa, Artificial Sequence
  Peptide Derived from Human Papillomavirus
FIYILVITCY

SEQ ID NO: 24974 - protein, 9 aa, Artificial Sequence
  Peptide Derived from Human Papillomavirus
FLLQAGLKA

SEQ ID NO: 24975 - protein, 11 aa, Artificial Sequence
  Peptide Derived from Human Papillomavirus
FPIKKPNNNKI

SEQ ID NO: 24976 - protein, 8 aa, Artificial Sequence
  Peptide Derived from Human Papillomavirus
FPLGRKFL

SEQ ID NO: 24977 - protein, 9 aa, Artificial Sequence
  Peptide Derived from Human Papillomavirus
FPLGRKFLL

SEQ ID NO: 24978 - protein, 11 aa, Artificial Sequence
  Peptide Derived from Human Papillomavirus
FPLGRKFLLQA

SEQ ID NO: 24979 - protein, 8 aa, Artificial Sequence
  Peptide Derived from Human Papillomavirus
FPTPSGSM

SEQ ID NO: 24980 - protein, 9 aa, Artificial Sequence
  Peptide Derived from Human Papillomavirus
FPTPSGSMV

SEQ ID NO: 24981 - protein, 8 aa, Artificial Sequence
  Peptide Derived from Human Papillomavirus
FQLCKITL

SEQ ID NO: 24982 - protein, 10 aa, Artificial Sequence
  Peptide Derived from Human Papillomavirus
FQLCKITLTA

SEQ ID NO: 24983 - protein, 11 aa, Artificial Sequence
  Peptide Derived from Human Papillomavirus
FQMSLWLPSEA

SEQ ID NO: 24984 - protein, 9 aa, Artificial Sequence
  Peptide Derived from Human Papillomavirus
FVRHLFNRA

SEQ ID NO: 24985 - protein, 11 aa, Artificial Sequence
  Peptide Derived from Human Papillomavirus
FVRHLFNRAGA

SEQ ID NO: 24986 - protein, 8 aa, Artificial Sequence
  Peptide Derived from Human Papillomavirus
FVTSQAIA

SEQ ID NO: 24987 - protein, 8 aa, Artificial Sequence
  Peptide Derived from Human Papillomavirus
GICWGNQL

SEQ ID NO: 24988 - protein, 9 aa, Artificial Sequence
  Peptide Derived from Human Papillomavirus
GICWGNQLF

SEQ ID NO: 24989 - protein, 10 aa, Artificial Sequence
  Peptide Derived from Human Papillomavirus
GICWGNQLFV

SEQ ID NO: 24990 - protein, 8 aa, Artificial Sequence
  Peptide Derived from Human Papillomavirus
GISGHPLL

SEQ ID NO: 24991 - protein, 11 aa, Artificial Sequence
  Peptide Derived from Human Papillomavirus
GISGHPLLNKL

SEQ ID NO: 24992 - protein, 8 aa, Artificial Sequence
  Peptide Derived from Human Papillomavirus
GLKAKPKF

SEQ ID NO: 24993 - protein, 10 aa, Artificial Sequence
  Peptide Derived from Human Papillomavirus
GLKAKPKFTL

SEQ ID NO: 24994 - protein, 10 aa, Artificial Sequence
  Peptide Derived from Human Papillomavirus
GLQPPPGGTL

SEQ ID NO: 24995 - protein, 9 aa, Artificial Sequence
  Peptide Derived from Human Papillomavirus
GLQYRVFRI

SEQ ID NO: 24996 - protein, 11 aa, Artificial Sequence
  Peptide Derived from Human Papillomavirus
GLQYRVFRIHL

SEQ ID NO: 24997 - protein, 8 aa, Artificial Sequence
  Peptide Derived from Human Papillomavirus
GQPLGVGI

SEQ ID NO: 24998 - protein, 8 aa, Artificial Sequence
  Peptide Derived from Human Papillomavirus
GVDNRECI

SEQ ID NO: 24999 - protein, 10 aa, Artificial Sequence
  Peptide Derived from Human Papillomavirus
GVDNRECISM

SEQ ID NO: 25000 - protein, 10 aa, Artificial Sequence
  Peptide Derived from Human Papillomavirus
GVEVGRGQPL

SEQ ID NO: 25001 - protein, 9 aa, Artificial Sequence
  Peptide Derived from Human Papillomavirus
GVGISGHPL

SEQ ID NO: 25002 - protein, 10 aa, Artificial Sequence
  Peptide Derived from Human Papillomavirus
GVGISGHPLL

SEQ ID NO: 25003 - protein, 8 aa, Artificial Sequence
  Peptide Derived from Human Papillomavirus
HIFFQMSL

SEQ ID NO: 25004 - protein, 9 aa, Artificial Sequence
  Peptide Derived from Human Papillomavirus
HIFFQMSLW

SEQ ID NO: 25005 - protein, 10 aa, Artificial Sequence
  Peptide Derived from Human Papillomavirus
HIFFQMSLWL

SEQ ID NO: 25006 - protein, 8 aa, Artificial Sequence
  Peptide Derived from Human Papillomavirus
HLFNRAGA

SEQ ID NO: 25007 - protein, 9 aa, Artificial Sequence
  Peptide Derived from Human Papillomavirus
HLFNRAGAV

SEQ ID NO: 25008 - protein, 8 aa, Artificial Sequence
  Peptide Derived from Human Papillomavirus
HLPDPNKF

SEQ ID NO: 25009 - protein, 10 aa, Artificial Sequence
  Peptide Derived from Human Papillomavirus
HLPDPNKFGF

SEQ ID NO: 25010 - protein, 9 aa, Artificial Sequence
  Peptide Derived from Human Papillomavirus
ILEDWNFGL

SEQ ID NO: 25011 - protein, 11 aa, Artificial Sequence
  Peptide Derived from Human Papillomavirus
ILVITCYENDV

SEQ ID NO: 25012 - protein, 9 aa, Artificial Sequence
  Peptide Derived from Human Papillomavirus
ILVPKVSGL

SEQ ID NO: 25013 - protein, 11 aa, Artificial Sequence
  Peptide Derived from Human Papillomavirus
ILVPKVSGLQY

SEQ ID NO: 25014 - protein, 11 aa, Artificial Sequence
  Peptide Derived from Human Papillomavirus
IQDGDMVDTGF

SEQ ID NO: 25015 - protein, 10 aa, Artificial Sequence
  Peptide Derived from Human Papillomavirus
KILVPKVSGL

SEQ ID NO: 25016 - protein, 8 aa, Artificial Sequence
  Peptide Derived from Human Papillomavirus
KITLTADV

SEQ ID NO: 25017 - protein, 9 aa, Artificial Sequence
  Peptide Derived from Human Papillomavirus
KITLTADVM

SEQ ID NO: 25018 - protein, 11 aa, Artificial Sequence
  Peptide Derived from Human Papillomavirus
KITLTADVMTY

SEQ ID NO: 25019 - protein, 8 aa, Artificial Sequence
  Peptide Derived from Human Papillomavirus
KLDDTENA

SEQ ID NO: 25020 - protein, 10 aa, Artificial Sequence
  Peptide Derived from Human Papillomavirus
KLDDTENASA

SEQ ID NO: 25021 - protein, 11 aa, Artificial Sequence
  Peptide Derived from Human Papillomavirus
KLDDTENASAY

SEQ ID NO: 25022 - protein, 11 aa, Artificial Sequence
  Peptide Derived from Human Papillomavirus
KMVSEPYGDSL

SEQ ID NO: 25023 - protein, 11 aa, Artificial Sequence
  Peptide Derived from Human Papillomavirus
KPKFTLGKRKA

SEQ ID NO: 25024 - protein, 8 aa, Artificial Sequence
  Peptide Derived from Human Papillomavirus
KPNNNKIL

SEQ ID NO: 25025 - protein, 9 aa, Artificial Sequence
  Peptide Derived from Human Papillomavirus
KPNNNKILV

SEQ ID NO: 25026 - protein, 8 aa, Artificial Sequence
  Peptide Derived from Human Papillomavirus
KPPIGEHW

SEQ ID NO: 25027 - protein, 8 aa, Artificial Sequence
  Peptide Derived from Human Papillomavirus
KPYWLQRA

SEQ ID NO: 25028 - protein, 8 aa, Artificial Sequence
  Peptide Derived from Human Papillomavirus
KQTQLCLI

SEQ ID NO: 25029 - protein, 9 aa, Artificial Sequence
  Peptide Derived from Human Papillomavirus
KVSGLQYRV

SEQ ID NO: 25030 - protein, 10 aa, Artificial Sequence
  Peptide Derived from Human Papillomavirus
KVSGLQYRVF

SEQ ID NO: 25031 - protein, 8 aa, Artificial Sequence
  Peptide Derived from Human Papillomavirus
KVVSTDEY

SEQ ID NO: 25032 - protein, 9 aa, Artificial Sequence
  Peptide Derived from Human Papillomavirus
KVVSTDEYV

SEQ ID NO: 25033 - protein, 10 aa, Artificial Sequence
  Peptide Derived from Human Papillomavirus
KVVSTDEYVA

SEQ ID NO: 25034 - protein, 8 aa, Artificial Sequence
  Peptide Derived from Human Papillomavirus
LIGCKPPI

SEQ ID NO: 25035 - protein, 11 aa, Artificial Sequence
  Peptide Derived from Human Papillomavirus
LINTVIQDGDM

SEQ ID NO: 25036 - protein, 8 aa, Artificial Sequence
  Peptide Derived from Human Papillomavirus
LLAVGHPY

SEQ ID NO: 25037 - protein, 9 aa, Artificial Sequence
  Peptide Derived from Human Papillomavirus
LLAVGHPYF

SEQ ID NO: 25038 - protein, 11 aa, Artificial Sequence
  Peptide Derived from Human Papillomavirus
LLAVGHPYFPI

SEQ ID NO: 25039 - protein, 11 aa, Artificial Sequence
  Peptide Derived from Human Papillomavirus
LLNKLDDTENA

SEQ ID NO: 25040 - protein, 8 aa, Artificial Sequence
  Peptide Derived from Human Papillomavirus
LLQAGLKA

SEQ ID NO: 25041 - protein, 9 aa, Artificial Sequence
  Peptide Derived from Human Papillomavirus
LPDPNKFGF

SEQ ID NO: 25042 - protein, 9 aa, Artificial Sequence
  Peptide Derived from Human Papillomavirus
LPPVPVSKV

SEQ ID NO: 25043 - protein, 10 aa, Artificial Sequence
  Peptide Derived from Human Papillomavirus
LPPVPVSKVV

SEQ ID NO: 25044 - protein, 8 aa, Artificial Sequence
  Peptide Derived from Human Papillomavirus
LPSEATVY

SEQ ID NO: 25045 - protein, 9 aa, Artificial Sequence
  Peptide Derived from Human Papillomavirus
LPSEATVYL

SEQ ID NO: 25046 - protein, 11 aa, Artificial Sequence
  Peptide Derived from Human Papillomavirus
LQAGLKAKPKF

SEQ ID NO: 25047 - protein, 8 aa, Artificial Sequence
  Peptide Derived from Human Papillomavirus
LQANKSEV

SEQ ID NO: 25048 - protein, 10 aa, Artificial Sequence
  Peptide Derived from Human Papillomavirus
LQANKSEVPL

SEQ ID NO: 25049 - protein, 10 aa, Artificial Sequence
  Peptide Derived from Human Papillomavirus
LQFIFQLCKI

SEQ ID NO: 25050 - protein, 9 aa, Artificial Sequence
  Peptide Derived from Human Papillomavirus
LQPPPGGTL

SEQ ID NO: 25051 - protein, 11 aa, Artificial Sequence
  Peptide Derived from Human Papillomavirus
LQRAQGHNNGI

SEQ ID NO: 25052 - protein, 8 aa, Artificial Sequence
  Peptide Derived from Human Papillomavirus
LQYRVFRI

SEQ ID NO: 25053 - protein, 10 aa, Artificial Sequence
  Peptide Derived from Human Papillomavirus
LQYRVFRIHL

SEQ ID NO: 25054 - protein, 10 aa, Artificial Sequence
  Peptide Derived from Human Papillomavirus
LVITCYENDV

SEQ ID NO: 25055 - protein, 8 aa, Artificial Sequence
  Peptide Derived from Human Papillomavirus
LVPKVSGL

SEQ ID NO: 25056 - protein, 10 aa, Artificial Sequence
  Peptide Derived from Human Papillomavirus
LVPKVSGLQY

SEQ ID NO: 25057 - protein, 8 aa, Artificial Sequence
  Peptide Derived from Human Papillomavirus
LVWACVGV

SEQ ID NO: 25058 - protein, 10 aa, Artificial Sequence
  Peptide Derived from Human Papillomavirus
LVWACVGVEV

SEQ ID NO: 25059 - protein, 8 aa, Artificial Sequence
  Peptide Derived from Human Papillomavirus
MQVTFIYI

SEQ ID NO: 25060 - protein, 9 aa, Artificial Sequence
  Peptide Derived from Human Papillomavirus
MQVTFIYIL

SEQ ID NO: 25061 - protein, 10 aa, Artificial Sequence
  Peptide Derived from Human Papillomavirus
MQVTFIYILV

SEQ ID NO: 25062 - protein, 11 aa, Artificial Sequence
  Peptide Derived from Human Papillomavirus
MQVTFIYILVI

SEQ ID NO: 25063 - protein, 8 aa, Artificial Sequence
  Peptide Derived from Human Papillomavirus
MVDTGFGA

SEQ ID NO: 25064 - protein, 9 aa, Artificial Sequence
  Peptide Derived from Human Papillomavirus
MVDTGFGAM

SEQ ID NO: 25065 - protein, 11 aa, Artificial Sequence
  Peptide Derived from Human Papillomavirus
MVDTGFGAMDF

SEQ ID NO: 25066 - protein, 10 aa, Artificial Sequence
  Peptide Derived from Human Papillomavirus
MVSEPYGDSL

SEQ ID NO: 25067 - protein, 11 aa, Artificial Sequence
  Peptide Derived from Human Papillomavirus
MVSEPYGDSLF

SEQ ID NO: 25068 - protein, 8 aa, Artificial Sequence
  Peptide Derived from Human Papillomavirus
MVTSDAQI

SEQ ID NO: 25069 - protein, 9 aa, Artificial Sequence
  Peptide Derived from Human Papillomavirus
MVTSDAQIF

SEQ ID NO: 25070 - protein, 11 aa, Artificial Sequence
  Peptide Derived from Human Papillomavirus
NIYYHAGTSRL

SEQ ID NO: 25071 - protein, 8 aa, Artificial Sequence
  Peptide Derived from Human Papillomavirus
NLASSNYF

SEQ ID NO: 25072 - protein, 8 aa, Artificial Sequence
  Peptide Derived from Human Papillomavirus
NLKEKFSA

SEQ ID NO: 25073 - protein, 10 aa, Artificial Sequence
  Peptide Derived from Human Papillomavirus
NLKEKFSADL

SEQ ID NO: 25074 - protein, 8 aa, Artificial Sequence
  Peptide Derived from Human Papillomavirus
NMSLCAAI

SEQ ID NO: 25075 - protein, 8 aa, Artificial Sequence
  Peptide Derived from Human Papillomavirus
NPDTQRLV

SEQ ID NO: 25076 - protein, 9 aa, Artificial Sequence
  Peptide Derived from Human Papillomavirus
NPDTQRLVW

SEQ ID NO: 25077 - protein, 10 aa, Artificial Sequence
  Peptide Derived from Human Papillomavirus
NPDTQRLVWA

SEQ ID NO: 25078 - protein, 8 aa, Artificial Sequence
  Peptide Derived from Human Papillomavirus
NPGDCPPL

SEQ ID NO: 25079 - protein, 10 aa, Artificial Sequence
  Peptide Derived from Human Papillomavirus
NPGDCPPLEL

SEQ ID NO: 25080 - protein, 11 aa, Artificial Sequence
  Peptide Derived from Human Papillomavirus
NPGDCPPLELI

SEQ ID NO: 25081 - protein, 8 aa, Artificial Sequence
  Peptide Derived from Human Papillomavirus
NQLFVTVV

SEQ ID NO: 25082 - protein, 8 aa, Artificial Sequence
  Peptide Derived from Human Papillomavirus
NVPDDLYI

SEQ ID NO: 25083 - protein, 9 aa, Artificial Sequence
  Peptide Derived from Human Papillomavirus
NVYHIFFQM

SEQ ID NO: 25084 - protein, 11 aa, Artificial Sequence
  Peptide Derived from Human Papillomavirus
NVYHIFFQMSL

SEQ ID NO: 25085 - protein, 10 aa, Artificial Sequence
  Peptide Derived from Human Papillomavirus
PIKKPNNNKI

SEQ ID NO: 25086 - protein, 11 aa, Artificial Sequence
  Peptide Derived from Human Papillomavirus
PIKKPNNNKIL

SEQ ID NO: 25087 - protein, 8 aa, Artificial Sequence
  Peptide Derived from Human Papillomavirus
PLDICTSI

SEQ ID NO: 25088 - protein, 11 aa, Artificial Sequence
  Peptide Derived from Human Papillomavirus
PLDICTSICKY

SEQ ID NO: 25089 - protein, 8 aa, Artificial Sequence
  Peptide Derived from Human Papillomavirus
PLELINTV

SEQ ID NO: 25090 - protein, 9 aa, Artificial Sequence
  Peptide Derived from Human Papillomavirus
PLELINTVI

SEQ ID NO: 25091 - protein, 8 aa, Artificial Sequence
  Peptide Derived from Human Papillomavirus
PLGRKFLL

SEQ ID NO: 25092 - protein, 10 aa, Artificial Sequence
  Peptide Derived from Human Papillomavirus
PLGRKFLLQA

SEQ ID NO: 25093 - protein, 11 aa, Artificial Sequence
  Peptide Derived from Human Papillomavirus
PLGVGISGHPL

SEQ ID NO: 25094 - protein, 8 aa, Artificial Sequence
  Peptide Derived from Human Papillomavirus
PLKKYTFW

SEQ ID NO: 25095 - protein, 10 aa, Artificial Sequence
  Peptide Derived from Human Papillomavirus
PLKKYTFWEV

SEQ ID NO: 25096 - protein, 9 aa, Artificial Sequence
  Peptide Derived from Human Papillomavirus
PPAPKEDPL

SEQ ID NO: 25097 - protein, 10 aa, Artificial Sequence
  Peptide Derived from Human Papillomavirus
PPGGTLEDTY

SEQ ID NO: 25098 - protein, 9 aa, Artificial Sequence
  Peptide Derived from Human Papillomavirus
PPLELINTV

SEQ ID NO: 25099 - protein, 10 aa, Artificial Sequence
  Peptide Derived from Human Papillomavirus
PPLELINTVI

SEQ ID NO: 25100 - protein, 11 aa, Artificial Sequence
  Peptide Derived from Human Papillomavirus
PPPGGTLEDTY

SEQ ID NO: 25101 - protein, 8 aa, Artificial Sequence
  Peptide Derived from Human Papillomavirus
PPVPVSKV

SEQ ID NO: 25102 - protein, 9 aa, Artificial Sequence
  Peptide Derived from Human Papillomavirus
PPVPVSKVV

SEQ ID NO: 25103 - protein, 8 aa, Artificial Sequence
  Peptide Derived from Human Papillomavirus
PVPVSKVV

SEQ ID NO: 25104 - protein, 11 aa, Artificial Sequence
  Peptide Derived from Human Papillomavirus
PVSKVVSTDEY

SEQ ID NO: 25105 - protein, 8 aa, Artificial Sequence
  Peptide Derived from Human Papillomavirus
QIFNKPYW

SEQ ID NO: 25106 - protein, 9 aa, Artificial Sequence
  Peptide Derived from Human Papillomavirus
QIFNKPYWL

SEQ ID NO: 25107 - protein, 9 aa, Artificial Sequence
  Peptide Derived from Human Papillomavirus
QLCKITLTA

SEQ ID NO: 25108 - protein, 11 aa, Artificial Sequence
  Peptide Derived from Human Papillomavirus
QLCKITLTADV

SEQ ID NO: 25109 - protein, 11 aa, Artificial Sequence
  Peptide Derived from Human Papillomavirus
QLCLIGCKPPI

SEQ ID NO: 25110 - protein, 8 aa, Artificial Sequence
  Peptide Derived from Human Papillomavirus
QMFVRHLF

SEQ ID NO: 25111 - protein, 11 aa, Artificial Sequence
  Peptide Derived from Human Papillomavirus
QMFVRHLFNRA

SEQ ID NO: 25112 - protein, 10 aa, Artificial Sequence
  Peptide Derived from Human Papillomavirus
QMSLWLPSEA

SEQ ID NO: 25113 - protein, 8 aa, Artificial Sequence
  Peptide Derived from Human Papillomavirus
QPPPGGTL

SEQ ID NO: 25114 - protein, 8 aa, Artificial Sequence
  Peptide Derived from Human Papillomavirus
QVTFIYIL

SEQ ID NO: 25115 - protein, 9 aa, Artificial Sequence
  Peptide Derived from Human Papillomavirus
QVTFIYILV

SEQ ID NO: 25116 - protein, 10 aa, Artificial Sequence
  Peptide Derived from Human Papillomavirus
QVTFIYILVI

SEQ ID NO: 25117 - protein, 10 aa, Artificial Sequence
  Peptide Derived from Human Papillomavirus
RIHLPDPNKF

SEQ ID NO: 25118 - protein, 9 aa, Artificial Sequence
  Peptide Derived from Human Papillomavirus
RLLAVGHPY

SEQ ID NO: 25119 - protein, 10 aa, Artificial Sequence
  Peptide Derived from Human Papillomavirus
RLLAVGHPYF

SEQ ID NO: 25120 - protein, 9 aa, Artificial Sequence
  Peptide Derived from Human Papillomavirus
RLVWACVGV

SEQ ID NO: 25121 - protein, 11 aa, Artificial Sequence
  Peptide Derived from Human Papillomavirus
RLVWACVGVEV

SEQ ID NO: 25122 - protein, 8 aa, Artificial Sequence
  Peptide Derived from Human Papillomavirus
SICKYPDY

SEQ ID NO: 25123 - protein, 9 aa, Artificial Sequence
  Peptide Derived from Human Papillomavirus
SICKYPDYI

SEQ ID NO: 25124 - protein, 11 aa, Artificial Sequence
  Peptide Derived from Human Papillomavirus
SICKYPDYIKM

SEQ ID NO: 25125 - protein, 11 aa, Artificial Sequence
  Peptide Derived from Human Papillomavirus
SLFFYLRREQM

SEQ ID NO: 25126 - protein, 8 aa, Artificial Sequence
  Peptide Derived from Human Papillomavirus
SLWLPSEA

SEQ ID NO: 25127 - protein, 10 aa, Artificial Sequence
  Peptide Derived from Human Papillomavirus
SLWLPSEATV

SEQ ID NO: 25128 - protein, 11 aa, Artificial Sequence
  Peptide Derived from Human Papillomavirus
SLWLPSEATVY

SEQ ID NO: 25129 - protein, 9 aa, Artificial Sequence
  Peptide Derived from Human Papillomavirus
SMDYKQTQL

SEQ ID NO: 25130 - protein, 11 aa, Artificial Sequence
  Peptide Derived from Human Papillomavirus
SMDYKQTQLCL

SEQ ID NO: 25131 - protein, 10 aa, Artificial Sequence
  Peptide Derived from Human Papillomavirus
SMNSTILEDW

SEQ ID NO: 25132 - protein, 9 aa, Artificial Sequence
  Peptide Derived from Human Papillomavirus
SMVTSDAQI

SEQ ID NO: 25133 - protein, 10 aa, Artificial Sequence
  Peptide Derived from Human Papillomavirus
SMVTSDAQIF

SEQ ID NO: 25134 - protein, 8 aa, Artificial Sequence
  Peptide Derived from Human Papillomavirus
SPCTNVAV

SEQ ID NO: 25135 - protein, 8 aa, Artificial Sequence
  Peptide Derived from Human Papillomavirus
TILEDWNF

SEQ ID NO: 25136 - protein, 10 aa, Artificial Sequence
  Peptide Derived from Human Papillomavirus
TILEDWNFGL

SEQ ID NO: 25137 - protein, 8 aa, Artificial Sequence
  Peptide Derived from Human Papillomavirus
TLEDTYRF

SEQ ID NO: 25138 - protein, 9 aa, Artificial Sequence
  Peptide Derived from Human Papillomavirus
TLEDTYRFV

SEQ ID NO: 25139 - protein, 9 aa, Artificial Sequence
  Peptide Derived from Human Papillomavirus
TLQANKSEV

SEQ ID NO: 25140 - protein, 11 aa, Artificial Sequence
  Peptide Derived from Human Papillomavirus
TLQANKSEVPL

SEQ ID NO: 25141 - protein, 9 aa, Artificial Sequence
  Peptide Derived from Human Papillomavirus
TLTADVMTY

SEQ ID NO: 25142 - protein, 10 aa, Artificial Sequence
  Peptide Derived from Human Papillomavirus
TLTADVMTYI

SEQ ID NO: 25143 - protein, 10 aa, Artificial Sequence
  Peptide Derived from Human Papillomavirus
TPPAPKEDPL

SEQ ID NO: 25144 - protein, 11 aa, Artificial Sequence
  Peptide Derived from Human Papillomavirus
TPSGSMVTSDA

SEQ ID NO: 25145 - protein, 11 aa, Artificial Sequence
  Peptide Derived from Human Papillomavirus
TPTTSSTSTTA

SEQ ID NO: 25146 - protein, 9 aa, Artificial Sequence
  Peptide Derived from Human Papillomavirus
TQRLVWACV

SEQ ID NO: 25147 - protein, 11 aa, Artificial Sequence
  Peptide Derived from Human Papillomavirus
TQRLVWACVGV

SEQ ID NO: 25148 - protein, 8 aa, Artificial Sequence
  Peptide Derived from Human Papillomavirus
TVIQDGDM

SEQ ID NO: 25149 - protein, 9 aa, Artificial Sequence
  Peptide Derived from Human Papillomavirus
TVIQDGDMV

SEQ ID NO: 25150 - protein, 11 aa, Artificial Sequence
  Peptide Derived from Human Papillomavirus
TVVDTTRSTNM

SEQ ID NO: 25151 - protein, 9 aa, Artificial Sequence
  Peptide Derived from Human Papillomavirus
TVYLPPVPV

SEQ ID NO: 25152 - protein, 8 aa, Artificial Sequence
  Peptide Derived from Human Papillomavirus
VIQDGDMV

SEQ ID NO: 25153 - protein, 9 aa, Artificial Sequence
  Peptide Derived from Human Papillomavirus
VITCYENDV

SEQ ID NO: 25154 - protein, 11 aa, Artificial Sequence
  Peptide Derived from Human Papillomavirus
VITCYENDVNV

SEQ ID NO: 25155 - protein, 8 aa, Artificial Sequence
  Peptide Derived from Human Papillomavirus
VMTYIHSM

SEQ ID NO: 25156 - protein, 9 aa, Artificial Sequence
  Peptide Derived from Human Papillomavirus
VPKVSGLQY

SEQ ID NO: 25157 - protein, 11 aa, Artificial Sequence
  Peptide Derived from Human Papillomavirus
VPKVSGLQYRV

SEQ ID NO: 25158 - protein, 9 aa, Artificial Sequence
  Peptide Derived from Human Papillomavirus
VPLDICTSI

SEQ ID NO: 25159 - protein, 10 aa, Artificial Sequence
  Peptide Derived from Human Papillomavirus
VVDTTRSTNM

SEQ ID NO: 25160 - protein, 8 aa, Artificial Sequence
  Peptide Derived from Human Papillomavirus
VVSTDEYV

SEQ ID NO: 25161 - protein, 9 aa, Artificial Sequence
  Peptide Derived from Human Papillomavirus
VVSTDEYVA

SEQ ID NO: 25162 - protein, 8 aa, Artificial Sequence
  Peptide Derived from Human Papillomavirus
WLPSEATV

SEQ ID NO: 25163 - protein, 9 aa, Artificial Sequence
  Peptide Derived from Human Papillomavirus
WLPSEATVY

SEQ ID NO: 25164 - protein, 10 aa, Artificial Sequence
  Peptide Derived from Human Papillomavirus
WLPSEATVYL

SEQ ID NO: 25165 - protein, 9 aa, Artificial Sequence
  Peptide Derived from Human Papillomavirus
YIHSMNSTI

SEQ ID NO: 25166 - protein, 10 aa, Artificial Sequence
  Peptide Derived from Human Papillomavirus
YIHSMNSTIL

SEQ ID NO: 25167 - protein, 9 aa, Artificial Sequence
  Peptide Derived from Human Papillomavirus
YIKGSGSTA

SEQ ID NO: 25168 - protein, 11 aa, Artificial Sequence
  Peptide Derived from Human Papillomavirus
YIKGSGSTANL

SEQ ID NO: 25169 - protein, 9 aa, Artificial Sequence
  Peptide Derived from Human Papillomavirus
YIKMVSEPY

SEQ ID NO: 25170 - protein, 8 aa, Artificial Sequence
  Peptide Derived from Human Papillomavirus
YILVITCY

SEQ ID NO: 25171 - protein, 10 aa, Artificial Sequence
  Peptide Derived from Human Papillomavirus
YLPPVPVSKV

SEQ ID NO: 25172 - protein, 11 aa, Artificial Sequence
  Peptide Derived from Human Papillomavirus
YLPPVPVSKVV

SEQ ID NO: 25173 - protein, 8 aa, Artificial Sequence
  Peptide Derived from Human Papillomavirus
YLRHGEEY

SEQ ID NO: 25174 - protein, 10 aa, Artificial Sequence
  Peptide Derived from Human Papillomavirus
YLRHGEEYDL

SEQ ID NO: 25175 - protein, 8 aa, Artificial Sequence
  Peptide Derived from Human Papillomavirus
YLRREQMF

SEQ ID NO: 25176 - protein, 9 aa, Artificial Sequence
  Peptide Derived from Human Papillomavirus
YLRREQMFV

SEQ ID NO: 25177 - protein, 8 aa, Artificial Sequence
  Peptide Derived from Human Papillomavirus
YPDYIKMV

SEQ ID NO: 25178 - protein, 8 aa, Artificial Sequence
  Peptide Derived from Human Papillomavirus
YVARTNIY

SEQ ID NO: 25179 - protein, 9 aa, Artificial Sequence
  Peptide Derived from Human Papillomavirus
YVARTNIYY

SEQ ID NO: 25180 - protein, 11 aa, Artificial Sequence
  Peptide Derived from Human Papillomavirus
YVARTNIYYHA

SEQ ID NO: 25181 - protein, 9 aa, Artificial Sequence
  Peptide Derived from Human Papillomavirus
AILDINNTV

SEQ ID NO: 25182 - protein, 10 aa, Artificial Sequence
  Peptide Derived from Human Papillomavirus
ALPTSINNGL

SEQ ID NO: 25183 - protein, 11 aa, Artificial Sequence
  Peptide Derived from Human Papillomavirus
ALPTSINNGLY

SEQ ID NO: 25184 - protein, 9 aa, Artificial Sequence
  Peptide Derived from Human Papillomavirus
ALTSRRTGI

SEQ ID NO: 25185 - protein, 11 aa, Artificial Sequence
  Peptide Derived from Human Papillomavirus
ALTSRRTGIRY

SEQ ID NO: 25186 - protein, 9 aa, Artificial Sequence
  Peptide Derived from Human Papillomavirus
APDPDFLDI

SEQ ID NO: 25187 - protein, 10 aa, Artificial Sequence
  Peptide Derived from Human Papillomavirus
APDPDFLDIV

SEQ ID NO: 25188 - protein, 11 aa, Artificial Sequence
  Peptide Derived from Human Papillomavirus
APDPDFLDIVA

SEQ ID NO: 25189 - protein, 8 aa, Artificial Sequence
  Peptide Derived from Human Papillomavirus
APSLIPIV

SEQ ID NO: 25190 - protein, 8 aa, Artificial Sequence
  Peptide Derived from Human Papillomavirus
APTSVPSI

SEQ ID NO: 25191 - protein, 9 aa, Artificial Sequence
  Peptide Derived from Human Papillomavirus
APVRPPLTV

SEQ ID NO: 25192 - protein, 9 aa, Artificial Sequence
  Peptide Derived from Human Papillomavirus
CPPDIIPKV

SEQ ID NO: 25193 - protein, 11 aa, Artificial Sequence
  Peptide Derived from Human Papillomavirus
DIIPKVEGKTI

SEQ ID NO: 25194 - protein, 9 aa, Artificial Sequence
  Peptide Derived from Human Papillomavirus
DINNTVTTV

SEQ ID NO: 25195 - protein, 10 aa, Artificial Sequence
  Peptide Derived from Human Papillomavirus
DIPINITDQA

SEQ ID NO: 25196 - protein, 9 aa, Artificial Sequence
  Peptide Derived from Human Papillomavirus
DIVALHRPA

SEQ ID NO: 25197 - protein, 10 aa, Artificial Sequence
  Peptide Derived from Human Papillomavirus
DIVALHRPAL

SEQ ID NO: 25198 - protein, 8 aa, Artificial Sequence
  Peptide Derived from Human Papillomavirus
DIYADDFI

SEQ ID NO: 25199 - protein, 11 aa, Artificial Sequence
  Peptide Derived from Human Papillomavirus
DPAFITTPTKL

SEQ ID NO: 25200 - protein, 8 aa, Artificial Sequence
  Peptide Derived from Human Papillomavirus
DPDFLDIV

SEQ ID NO: 25201 - protein, 9 aa, Artificial Sequence
  Peptide Derived from Human Papillomavirus
DPDFLDIVA

SEQ ID NO: 25202 - protein, 10 aa, Artificial Sequence
  Peptide Derived from Human Papillomavirus
DPDFLDIVAL

SEQ ID NO: 25203 - protein, 8 aa, Artificial Sequence
  Peptide Derived from Human Papillomavirus
DPSIVSLV

SEQ ID NO: 25204 - protein, 11 aa, Artificial Sequence
  Peptide Derived from Human Papillomavirus
DPSVLQPPTPA

SEQ ID NO: 25205 - protein, 10 aa, Artificial Sequence
  Peptide Derived from Human Papillomavirus
DPVGPSDPSI

SEQ ID NO: 25206 - protein, 11 aa, Artificial Sequence
  Peptide Derived from Human Papillomavirus
DPVGPSDPSIV

SEQ ID NO: 25207 - protein, 9 aa, Artificial Sequence
  Peptide Derived from Human Papillomavirus
DQAPSLIPI

SEQ ID NO: 25208 - protein, 10 aa, Artificial Sequence
  Peptide Derived from Human Papillomavirus
DQAPSLIPIV

SEQ ID NO: 25209 - protein, 9 aa, Artificial Sequence
  Peptide Derived from Human Papillomavirus
DQILQYGSM

SEQ ID NO: 25210 - protein, 11 aa, Artificial Sequence
  Peptide Derived from Human Papillomavirus
DQILQYGSMGV

SEQ ID NO: 25211 - protein, 8 aa, Artificial Sequence
  Peptide Derived from Human Papillomavirus
DVDNTLYF

SEQ ID NO: 25212 - protein, 8 aa, Artificial Sequence
  Peptide Derived from Human Papillomavirus
EIPMDTFI

SEQ ID NO: 25213 - protein, 9 aa, Artificial Sequence
  Peptide Derived from Human Papillomavirus
EIPMDTFIV

SEQ ID NO: 25214 - protein, 10 aa, Artificial Sequence
  Peptide Derived from Human Papillomavirus
ELQTITPSTY

SEQ ID NO: 25215 - protein, 10 aa, Artificial Sequence
  Peptide Derived from Human Papillomavirus
FIDAGAPTSV

SEQ ID NO: 25216 - protein, 10 aa, Artificial Sequence
  Peptide Derived from Human Papillomavirus
FITDTSTTPV

SEQ ID NO: 25217 - protein, 8 aa, Artificial Sequence
  Peptide Derived from Human Papillomavirus
FITTPTKL

SEQ ID NO: 25218 - protein, 9 aa, Artificial Sequence
  Peptide Derived from Human Papillomavirus
FITTPTKLI

SEQ ID NO: 25219 - protein, 11 aa, Artificial Sequence
  Peptide Derived from Human Papillomavirus
FITTPTKLITY

SEQ ID NO: 25220 - protein, 10 aa, Artificial Sequence
  Peptide Derived from Human Papillomavirus
FIVSTNPNTV

SEQ ID NO: 25221 - protein, 11 aa, Artificial Sequence
  Peptide Derived from Human Papillomavirus
FLDIVALHRPA

SEQ ID NO: 25222 - protein, 8 aa, Artificial Sequence
  Peptide Derived from Human Papillomavirus
GIDVDNTL

SEQ ID NO: 25223 - protein, 9 aa, Artificial Sequence
  Peptide Derived from Human Papillomavirus
GIDVDNTLY

SEQ ID NO: 25224 - protein, 10 aa, Artificial Sequence
  Peptide Derived from Human Papillomavirus
GIDVDNTLYF

SEQ ID NO: 25225 - protein, 10 aa, Artificial Sequence
  Peptide Derived from Human Papillomavirus
GLYDIYADDF

SEQ ID NO: 25226 - protein, 11 aa, Artificial Sequence
  Peptide Derived from Human Papillomavirus
GLYDIYADDFI

SEQ ID NO: 25227 - protein, 10 aa, Artificial Sequence
  Peptide Derived from Human Papillomavirus
GLYSRTTQQV

SEQ ID NO: 25228 - protein, 8 aa, Artificial Sequence
  Peptide Derived from Human Papillomavirus
GPDIPINI

SEQ ID NO: 25229 - protein, 8 aa, Artificial Sequence
  Peptide Derived from Human Papillomavirus
GPSDPSIV

SEQ ID NO: 25230 - protein, 10 aa, Artificial Sequence
  Peptide Derived from Human Papillomavirus
GPSDPSIVSL

SEQ ID NO: 25231 - protein, 11 aa, Artificial Sequence
  Peptide Derived from Human Papillomavirus
GPSDPSIVSLV

SEQ ID NO: 25232 - protein, 9 aa, Artificial Sequence
  Peptide Derived from Human Papillomavirus
GVFFGGLGI

SEQ ID NO: 25233 - protein, 8 aa, Artificial Sequence
  Peptide Derived from Human Papillomavirus
IIADAGDF

SEQ ID NO: 25234 - protein, 9 aa, Artificial Sequence
  Peptide Derived from Human Papillomavirus
IIADAGDFY

SEQ ID NO: 25235 - protein, 10 aa, Artificial Sequence
  Peptide Derived from Human Papillomavirus
IIADAGDFYL

SEQ ID NO: 25236 - protein, 10 aa, Artificial Sequence
  Peptide Derived from Human Papillomavirus
IIPKVEGKTI

SEQ ID NO: 25237 - protein, 11 aa, Artificial Sequence
  Peptide Derived from Human Papillomavirus
IIPKVEGKTIA

SEQ ID NO: 25238 - protein, 8 aa, Artificial Sequence
  Peptide Derived from Human Papillomavirus
ILDINNTV

SEQ ID NO: 25239 - protein, 11 aa, Artificial Sequence
  Peptide Derived from Human Papillomavirus
ILDINNTVTTV

SEQ ID NO: 25240 - protein, 9 aa, Artificial Sequence
  Peptide Derived from Human Papillomavirus
ILQYGSMGV

SEQ ID NO: 25241 - protein, 10 aa, Artificial Sequence
  Peptide Derived from Human Papillomavirus
ILQYGSMGVF

SEQ ID NO: 25242 - protein, 11 aa, Artificial Sequence
  Peptide Derived from Human Papillomavirus
ILQYGSMGVFF

SEQ ID NO: 25243 - protein, 9 aa, Artificial Sequence
  Peptide Derived from Human Papillomavirus
IPANTTIPF

SEQ ID NO: 25244 - protein, 9 aa, Artificial Sequence
  Peptide Derived from Human Papillomavirus
IPFGGAYNI

SEQ ID NO: 25245 - protein, 11 aa, Artificial Sequence
  Peptide Derived from Human Papillomavirus
IPFGGAYNIPL

SEQ ID NO: 25246 - protein, 8 aa, Artificial Sequence
  Peptide Derived from Human Papillomavirus
IPGSRPVA

SEQ ID NO: 25247 - protein, 10 aa, Artificial Sequence
  Peptide Derived from Human Papillomavirus
IPGSRPVARL

SEQ ID NO: 25248 - protein, 9 aa, Artificial Sequence
  Peptide Derived from Human Papillomavirus
IPINITDQA

SEQ ID NO: 25249 - protein, 10 aa, Artificial Sequence
  Peptide Derived from Human Papillomavirus
IPIVPGSPQY

SEQ ID NO: 25250 - protein, 9 aa, Artificial Sequence
  Peptide Derived from Human Papillomavirus
IPKVEGKTI

SEQ ID NO: 25251 - protein, 10 aa, Artificial Sequence
  Peptide Derived from Human Papillomavirus
IPKVEGKTIA

SEQ ID NO: 25252 - protein, 10 aa, Artificial Sequence
  Peptide Derived from Human Papillomavirus
IPLGTRPPTA

SEQ ID NO: 25253 - protein, 9 aa, Artificial Sequence
  Peptide Derived from Human Papillomavirus
IPLVSGPDI

SEQ ID NO: 25254 - protein, 11 aa, Artificial Sequence
  Peptide Derived from Human Papillomavirus
IPLVSGPDIPI

SEQ ID NO: 25255 - protein, 8 aa, Artificial Sequence
  Peptide Derived from Human Papillomavirus
IPMDTFIV

SEQ ID NO: 25256 - protein, 8 aa, Artificial Sequence
  Peptide Derived from Human Papillomavirus
IPPDVSGF

SEQ ID NO: 25257 - protein, 10 aa, Artificial Sequence
  Peptide Derived from Human Papillomavirus
IPPDVSGFSI

SEQ ID NO: 25258 - protein, 8 aa, Artificial Sequence
  Peptide Derived from Human Papillomavirus
IVALHRPA

SEQ ID NO: 25259 - protein, 9 aa, Artificial Sequence
  Peptide Derived from Human Papillomavirus
IVALHRPAL

SEQ ID NO: 25260 - protein, 8 aa, Artificial Sequence
  Peptide Derived from Human Papillomavirus
IVPGSPQY

SEQ ID NO: 25261 - protein, 10 aa, Artificial Sequence
  Peptide Derived from Human Papillomavirus
IVPGSPQYTI

SEQ ID NO: 25262 - protein, 11 aa, Artificial Sequence
  Peptide Derived from Human Papillomavirus
IVPGSPQYTII

SEQ ID NO: 25263 - protein, 10 aa, Artificial Sequence
  Peptide Derived from Human Papillomavirus
IVSLVEETSF

SEQ ID NO: 25264 - protein, 11 aa, Artificial Sequence
  Peptide Derived from Human Papillomavirus
IVSLVEETSFI

SEQ ID NO: 25265 - protein, 9 aa, Artificial Sequence
  Peptide Derived from Human Papillomavirus
IVSTNPNTV

SEQ ID NO: 25266 - protein, 9 aa, Artificial Sequence
  Peptide Derived from Human Papillomavirus
KLITYDNPA

SEQ ID NO: 25267 - protein, 10 aa, Artificial Sequence
  Peptide Derived from Human Papillomavirus
KLITYDNPAY

SEQ ID NO: 25268 - protein, 10 aa, Artificial Sequence
  Peptide Derived from Human Papillomavirus
KQAGTCPPDI

SEQ ID NO: 25269 - protein, 11 aa, Artificial Sequence
  Peptide Derived from Human Papillomavirus
KQAGTCPPDII

SEQ ID NO: 25270 - protein, 8 aa, Artificial Sequence
  Peptide Derived from Human Papillomavirus
KVEGKTIA

SEQ ID NO: 25271 - protein, 11 aa, Artificial Sequence
  Peptide Derived from Human Papillomavirus
KVEGKTIADQI

SEQ ID NO: 25272 - protein, 8 aa, Artificial Sequence
  Peptide Derived from Human Papillomavirus
KVHYYYDF

SEQ ID NO: 25273 - protein, 11 aa, Artificial Sequence
  Peptide Derived from Human Papillomavirus
KVHYYYDFSTI

SEQ ID NO: 25274 - protein, 8 aa, Artificial Sequence
  Peptide Derived from Human Papillomavirus
KVVDPAFI

SEQ ID NO: 25275 - protein, 11 aa, Artificial Sequence
  Peptide Derived from Human Papillomavirus
LIPIVPGSPQY

SEQ ID NO: 25276 - protein, 8 aa, Artificial Sequence
  Peptide Derived from Human Papillomavirus
LITYDNPA

SEQ ID NO: 25277 - protein, 9 aa, Artificial Sequence
  Peptide Derived from Human Papillomavirus
LITYDNPAY

SEQ ID NO: 25278 - protein, 9 aa, Artificial Sequence
  Peptide Derived from Human Papillomavirus
LPTSINNGL

SEQ ID NO: 25279 - protein, 10 aa, Artificial Sequence
  Peptide Derived from Human Papillomavirus
LPTSINNGLY

SEQ ID NO: 25280 - protein, 8 aa, Artificial Sequence
  Peptide Derived from Human Papillomavirus
LPYFFSDV

SEQ ID NO: 25281 - protein, 10 aa, Artificial Sequence
  Peptide Derived from Human Papillomavirus
LPYFFSDVSL

SEQ ID NO: 25282 - protein, 11 aa, Artificial Sequence
  Peptide Derived from Human Papillomavirus
LPYFFSDVSLA

SEQ ID NO: 25283 - protein, 9 aa, Artificial Sequence
  Peptide Derived from Human Papillomavirus
LQTITPSTY

SEQ ID NO: 25284 - protein, 8 aa, Artificial Sequence
  Peptide Derived from Human Papillomavirus
LQYGSMGV

SEQ ID NO: 25285 - protein, 9 aa, Artificial Sequence
  Peptide Derived from Human Papillomavirus
LQYGSMGVF

SEQ ID NO: 25286 - protein, 10 aa, Artificial Sequence
  Peptide Derived from Human Papillomavirus
LQYGSMGVFF

SEQ ID NO: 25287 - protein, 8 aa, Artificial Sequence
  Peptide Derived from Human Papillomavirus
LVEETSFI

SEQ ID NO: 25288 - protein, 10 aa, Artificial Sequence
  Peptide Derived from Human Papillomavirus
LVEETSFIDA

SEQ ID NO: 25289 - protein, 9 aa, Artificial Sequence
  Peptide Derived from Human Papillomavirus
LVSGPDIPI

SEQ ID NO: 25290 - protein, 11 aa, Artificial Sequence
  Peptide Derived from Human Papillomavirus
LVSGPDIPINI

SEQ ID NO: 25291 - protein, 9 aa, Artificial Sequence
  Peptide Derived from Human Papillomavirus
MLRKRRKRL

SEQ ID NO: 25292 - protein, 11 aa, Artificial Sequence
  Peptide Derived from Human Papillomavirus
MLRKRRKRLPY

SEQ ID NO: 25293 - protein, 8 aa, Artificial Sequence
  Peptide Derived from Human Papillomavirus
NIAPDPDF

SEQ ID NO: 25294 - protein, 9 aa, Artificial Sequence
  Peptide Derived from Human Papillomavirus
NIAPDPDFL

SEQ ID NO: 25295 - protein, 11 aa, Artificial Sequence
  Peptide Derived from Human Papillomavirus
NIAPDPDFLDI

SEQ ID NO: 25296 - protein, 10 aa, Artificial Sequence
  Peptide Derived from Human Papillomavirus
NIPLVSGPDI

SEQ ID NO: 25297 - protein, 9 aa, Artificial Sequence
  Peptide Derived from Human Papillomavirus
NITDQAPSL

SEQ ID NO: 25298 - protein, 10 aa, Artificial Sequence
  Peptide Derived from Human Papillomavirus
NITDQAPSLI

SEQ ID NO: 25299 - protein, 9 aa, Artificial Sequence
  Peptide Derived from Human Papillomavirus
NPAYEGIDV

SEQ ID NO: 25300 - protein, 11 aa, Artificial Sequence
  Peptide Derived from Human Papillomavirus
NPNTVTSSTPI

SEQ ID NO: 25301 - protein, 9 aa, Artificial Sequence
  Peptide Derived from Human Papillomavirus
NPTFTDPSV

SEQ ID NO: 25302 - protein, 10 aa, Artificial Sequence
  Peptide Derived from Human Papillomavirus
NPTFTDPSVL

SEQ ID NO: 25303 - protein, 8 aa, Artificial Sequence
  Peptide Derived from Human Papillomavirus
PINITDQA

SEQ ID NO: 25304 - protein, 11 aa, Artificial Sequence
  Peptide Derived from Human Papillomavirus
PINITDQAPSL

SEQ ID NO: 25305 - protein, 8 aa, Artificial Sequence
  Peptide Derived from Human Papillomavirus
PIPGSRPV

SEQ ID NO: 25306 - protein, 9 aa, Artificial Sequence
  Peptide Derived from Human Papillomavirus
PIPGSRPVA

SEQ ID NO: 25307 - protein, 11 aa, Artificial Sequence
  Peptide Derived from Human Papillomavirus
PIPGSRPVARL

SEQ ID NO: 25308 - protein, 9 aa, Artificial Sequence
  Peptide Derived from Human Papillomavirus
PIVPGSPQY

SEQ ID NO: 25309 - protein, 11 aa, Artificial Sequence
  Peptide Derived from Human Papillomavirus
PIVPGSPQYTI

SEQ ID NO: 25310 - protein, 9 aa, Artificial Sequence
  Peptide Derived from Human Papillomavirus
PLGTRPPTA

SEQ ID NO: 25311 - protein, 8 aa, Artificial Sequence
  Peptide Derived from Human Papillomavirus
PLVSGPDI

SEQ ID NO: 25312 - protein, 10 aa, Artificial Sequence
  Peptide Derived from Human Papillomavirus
PLVSGPDIPI

SEQ ID NO: 25313 - protein, 8 aa, Artificial Sequence
  Peptide Derived from Human Papillomavirus
PPDIIPKV

SEQ ID NO: 25314 - protein, 9 aa, Artificial Sequence
  Peptide Derived from Human Papillomavirus
PPDVSGFSI

SEQ ID NO: 25315 - protein, 8 aa, Artificial Sequence
  Peptide Derived from Human Papillomavirus
PPLTVDPV

SEQ ID NO: 25316 - protein, 8 aa, Artificial Sequence
  Peptide Derived from Human Papillomavirus
PPTATDTL

SEQ ID NO: 25317 - protein, 9 aa, Artificial Sequence
  Peptide Derived from Human Papillomavirus
PPTATDTLA

SEQ ID NO: 25318 - protein, 11 aa, Artificial Sequence
  Peptide Derived from Human Papillomavirus
PPTATDTLAPV

SEQ ID NO: 25319 - protein, 11 aa, Artificial Sequence
  Peptide Derived from Human Papillomavirus
PPTPAETGGHF

SEQ ID NO: 25320 - protein, 9 aa, Artificial Sequence
  Peptide Derived from Human Papillomavirus
PQYTIIADA

SEQ ID NO: 25321 - protein, 8 aa, Artificial Sequence
  Peptide Derived from Human Papillomavirus
PVARLGLY

SEQ ID NO: 25322 - protein, 9 aa, Artificial Sequence
  Peptide Derived from Human Papillomavirus
PVGPSDPSI

SEQ ID NO: 25323 - protein, 10 aa, Artificial Sequence
  Peptide Derived from Human Papillomavirus
PVGPSDPSIV

SEQ ID NO: 25324 - protein, 10 aa, Artificial Sequence
  Peptide Derived from Human Papillomavirus
PVPSVPSTSL

SEQ ID NO: 25325 - protein, 8 aa, Artificial Sequence
  Peptide Derived from Human Papillomavirus
PVRPPLTV

SEQ ID NO: 25326 - protein, 11 aa, Artificial Sequence
  Peptide Derived from Human Papillomavirus
PVRPPLTVDPV

SEQ ID NO: 25327 - protein, 8 aa, Artificial Sequence
  Peptide Derived from Human Papillomavirus
QILQYGSM

SEQ ID NO: 25328 - protein, 10 aa, Artificial Sequence
  Peptide Derived from Human Papillomavirus
QILQYGSMGV

SEQ ID NO: 25329 - protein, 11 aa, Artificial Sequence
  Peptide Derived from Human Papillomavirus
QILQYGSMGVF

SEQ ID NO: 25330 - protein, 9 aa, Artificial Sequence
  Peptide Derived from Human Papillomavirus
QLYKTCKQA

SEQ ID NO: 25331 - protein, 9 aa, Artificial Sequence
  Peptide Derived from Human Papillomavirus
QQVKVVDPA

SEQ ID NO: 25332 - protein, 10 aa, Artificial Sequence
  Peptide Derived from Human Papillomavirus
QQVKVVDPAF

SEQ ID NO: 25333 - protein, 11 aa, Artificial Sequence
  Peptide Derived from Human Papillomavirus
QQVKVVDPAFI

SEQ ID NO: 25334 - protein, 8 aa, Artificial Sequence
  Peptide Derived from Human Papillomavirus
QVKVVDPA

SEQ ID NO: 25335 - protein, 9 aa, Artificial Sequence
  Peptide Derived from Human Papillomavirus
QVKVVDPAF

SEQ ID NO: 25336 - protein, 10 aa, Artificial Sequence
  Peptide Derived from Human Papillomavirus
QVKVVDPAFI

SEQ ID NO: 25337 - protein, 8 aa, Artificial Sequence
  Peptide Derived from Human Papillomavirus
RIGNKQTL

SEQ ID NO: 25338 - protein, 9 aa, Artificial Sequence
  Peptide Derived from Human Papillomavirus
RLPYFFSDV

SEQ ID NO: 25339 - protein, 11 aa, Artificial Sequence
  Peptide Derived from Human Papillomavirus
RLPYFFSDVSL

SEQ ID NO: 25340 - protein, 11 aa, Artificial Sequence
  Peptide Derived from Human Papillomavirus
RPALTSRRTGI

SEQ ID NO: 25341 - protein, 9 aa, Artificial Sequence
  Peptide Derived from Human Papillomavirus
RPPLTVDPV

SEQ ID NO: 25342 - protein, 9 aa, Artificial Sequence
  Peptide Derived from Human Papillomavirus
RPPTATDTL

SEQ ID NO: 25343 - protein, 10 aa, Artificial Sequence
  Peptide Derived from Human Papillomavirus
RPPTATDTLA

SEQ ID NO: 25344 - protein, 8 aa, Artificial Sequence
  Peptide Derived from Human Papillomavirus
RPVARLGL

SEQ ID NO: 25345 - protein, 9 aa, Artificial Sequence
  Peptide Derived from Human Papillomavirus
RPVARLGLY

SEQ ID NO: 25346 - protein, 8 aa, Artificial Sequence
  Peptide Derived from Human Papillomavirus
SIGAKVHY

SEQ ID NO: 25347 - protein, 9 aa, Artificial Sequence
  Peptide Derived from Human Papillomavirus
SIGAKVHYY

SEQ ID NO: 25348 - protein, 10 aa, Artificial Sequence
  Peptide Derived from Human Papillomavirus
SIGAKVHYYY

SEQ ID NO: 25349 - protein, 10 aa, Artificial Sequence
  Peptide Derived from Human Papillomavirus
SINIAPDPDF

SEQ ID NO: 25350 - protein, 11 aa, Artificial Sequence
  Peptide Derived from Human Papillomavirus
SINIAPDPDFL

SEQ ID NO: 25351 - protein, 9 aa, Artificial Sequence
  Peptide Derived from Human Papillomavirus
SINNGLYDI

SEQ ID NO: 25352 - protein, 10 aa, Artificial Sequence
  Peptide Derived from Human Papillomavirus
SINNGLYDIY

SEQ ID NO: 25353 - protein, 11 aa, Artificial Sequence
  Peptide Derived from Human Papillomavirus
SINNGLYDIYA

SEQ ID NO: 25354 - protein, 9 aa, Artificial Sequence
  Peptide Derived from Human Papillomavirus
SIPPDVSGF

SEQ ID NO: 25355 - protein, 11 aa, Artificial Sequence
  Peptide Derived from Human Papillomavirus
SIPPDVSGFSI

SEQ ID NO: 25356 - protein, 11 aa, Artificial Sequence
  Peptide Derived from Human Papillomavirus
SITTSTDTTPA

SEQ ID NO: 25357 - protein, 11 aa, Artificial Sequence
  Peptide Derived from Human Papillomavirus
SIVSLVEETSF

SEQ ID NO: 25358 - protein, 8 aa, Artificial Sequence
  Peptide Derived from Human Papillomavirus
SLSGYIPA

SEQ ID NO: 25359 - protein, 8 aa, Artificial Sequence
  Peptide Derived from Human Papillomavirus
SLVEETSF

SEQ ID NO: 25360 - protein, 9 aa, Artificial Sequence
  Peptide Derived from Human Papillomavirus
SLVEETSFI

SEQ ID NO: 25361 - protein, 11 aa, Artificial Sequence
  Peptide Derived from Human Papillomavirus
SLVEETSFIDA

SEQ ID NO: 25362 - protein, 9 aa, Artificial Sequence
  Peptide Derived from Human Papillomavirus
SMGVFFGGL

SEQ ID NO: 25363 - protein, 11 aa, Artificial Sequence
  Peptide Derived from Human Papillomavirus
SMGVFFGGLGI

SEQ ID NO: 25364 - protein, 8 aa, Artificial Sequence
  Peptide Derived from Human Papillomavirus
SPQYTIIA

SEQ ID NO: 25365 - protein, 10 aa, Artificial Sequence
  Peptide Derived from Human Papillomavirus
SPQYTIIADA

SEQ ID NO: 25366 - protein, 9 aa, Artificial Sequence
  Peptide Derived from Human Papillomavirus
SVLQPPTPA

SEQ ID NO: 25367 - protein, 9 aa, Artificial Sequence
  Peptide Derived from Human Papillomavirus
SVPSIPPDV

SEQ ID NO: 25368 - protein, 10 aa, Artificial Sequence
  Peptide Derived from Human Papillomavirus
SVPSTSLSGY

SEQ ID NO: 25369 - protein, 11 aa, Artificial Sequence
  Peptide Derived from Human Papillomavirus
SVPSTSLSGYI

SEQ ID NO: 25370 - protein, 9 aa, Artificial Sequence
  Peptide Derived from Human Papillomavirus
TIADQILQY

SEQ ID NO: 25371 - protein, 8 aa, Artificial Sequence
  Peptide Derived from Human Papillomavirus
TIDSAEEI

SEQ ID NO: 25372 - protein, 10 aa, Artificial Sequence
  Peptide Derived from Human Papillomavirus
TIDSAEEIEL

SEQ ID NO: 25373 - protein, 9 aa, Artificial Sequence
  Peptide Derived from Human Papillomavirus
TIIADAGDF

SEQ ID NO: 25374 - protein, 10 aa, Artificial Sequence
  Peptide Derived from Human Papillomavirus
TIIADAGDFY

SEQ ID NO: 25375 - protein, 11 aa, Artificial Sequence
  Peptide Derived from Human Papillomavirus
TIIADAGDFYL

SEQ ID NO: 25376 - protein, 8 aa, Artificial Sequence
  Peptide Derived from Human Papillomavirus
TIPFGGAY

SEQ ID NO: 25377 - protein, 10 aa, Artificial Sequence
  Peptide Derived from Human Papillomavirus
TIPFGGAYNI

SEQ ID NO: 25378 - protein, 10 aa, Artificial Sequence
  Peptide Derived from Human Papillomavirus
TISTHNYEEI

SEQ ID NO: 25379 - protein, 9 aa, Artificial Sequence
  Peptide Derived from Human Papillomavirus
TLAPVRPPL

SEQ ID NO: 25380 - protein, 11 aa, Artificial Sequence
  Peptide Derived from Human Papillomavirus
TLAPVRPPLTV

SEQ ID NO: 25381 - protein, 10 aa, Artificial Sequence
  Peptide Derived from Human Papillomavirus
TLRTRSGKSI

SEQ ID NO: 25382 - protein, 11 aa, Artificial Sequence
  Peptide Derived from Human Papillomavirus
TLYFSSNDNSI

SEQ ID NO: 25383 - protein, 9 aa, Artificial Sequence
  Peptide Derived from Human Papillomavirus
TPAETGGHF

SEQ ID NO: 25384 - protein, 11 aa, Artificial Sequence
  Peptide Derived from Human Papillomavirus
TPAETGGHFTL

SEQ ID NO: 25385 - protein, 11 aa, Artificial Sequence
  Peptide Derived from Human Papillomavirus
TPAILDINNTV

SEQ ID NO: 25386 - protein, 9 aa, Artificial Sequence
  Peptide Derived from Human Papillomavirus
TPIPGSRPV

SEQ ID NO: 25387 - protein, 10 aa, Artificial Sequence
  Peptide Derived from Human Papillomavirus
TPIPGSRPVA

SEQ ID NO: 25388 - protein, 11 aa, Artificial Sequence
  Peptide Derived from Human Papillomavirus
TPSTYTTTSHA

SEQ ID NO: 25389 - protein, 8 aa, Artificial Sequence
  Peptide Derived from Human Papillomavirus
TPTKLITY

SEQ ID NO: 25390 - protein, 11 aa, Artificial Sequence
  Peptide Derived from Human Papillomavirus
TPVPSVPSTSL

SEQ ID NO: 25391 - protein, 10 aa, Artificial Sequence
  Peptide Derived from Human Papillomavirus
TQLYKTCKQA

SEQ ID NO: 25392 - protein, 10 aa, Artificial Sequence
  Peptide Derived from Human Papillomavirus
TQQVKVVDPA

SEQ ID NO: 25393 - protein, 11 aa, Artificial Sequence
  Peptide Derived from Human Papillomavirus
TQQVKVVDPAF

SEQ ID NO: 25394 - protein, 8 aa, Artificial Sequence
  Peptide Derived from Human Papillomavirus
TVTSSTPI

SEQ ID NO: 25395 - protein, 10 aa, Artificial Sequence
  Peptide Derived from Human Papillomavirus
TVTTHNNPTF

SEQ ID NO: 25396 - protein, 8 aa, Artificial Sequence
  Peptide Derived from Human Papillomavirus
VLQPPTPA

SEQ ID NO: 25397 - protein, 9 aa, Artificial Sequence
  Peptide Derived from Human Papillomavirus
VPGSPQYTI

SEQ ID NO: 25398 - protein, 10 aa, Artificial Sequence
  Peptide Derived from Human Papillomavirus
VPGSPQYTII

SEQ ID NO: 25399 - protein, 11 aa, Artificial Sequence
  Peptide Derived from Human Papillomavirus
VPGSPQYTIIA

SEQ ID NO: 25400 - protein, 8 aa, Artificial Sequence
  Peptide Derived from Human Papillomavirus
VPSIPPDV

SEQ ID NO: 25401 - protein, 11 aa, Artificial Sequence
  Peptide Derived from Human Papillomavirus
VPSIPPDVSGF

SEQ ID NO: 25402 - protein, 9 aa, Artificial Sequence
  Peptide Derived from Human Papillomavirus
VPSTSLSGY

SEQ ID NO: 25403 - protein, 10 aa, Artificial Sequence
  Peptide Derived from Human Papillomavirus
VPSTSLSGYI

SEQ ID NO: 25404 - protein, 9 aa, Artificial Sequence
  Peptide Derived from Human Papillomavirus
VPSVPSTSL

SEQ ID NO: 25405 - protein, 8 aa, Artificial Sequence
  Peptide Derived from Human Papillomavirus
YIPANTTI

SEQ ID NO: 25406 - protein, 10 aa, Artificial Sequence
  Peptide Derived from Human Papillomavirus
YIPANTTIPF

SEQ ID NO: 25407 - protein, 11 aa, Artificial Sequence
  Peptide Derived from Human Papillomavirus
YIPLGTRPPTA

SEQ ID NO: 25408 - protein, 8 aa, Artificial Sequence
  Peptide Derived from Human Papillomavirus
YLHPSYYM

SEQ ID NO: 25409 - protein, 9 aa, Artificial Sequence
  Peptide Derived from Human Papillomavirus
YLHPSYYML

SEQ ID NO: 25410 - protein, 10 aa, Artificial Sequence
  Peptide Derived from Human Papillomavirus
YMLRKRRKRL

SEQ ID NO: 25411 - protein, 9 aa, Artificial Sequence
  Peptide Derived from Human Papillomavirus
AIFGVNPTI

SEQ ID NO: 25412 - protein, 10 aa, Artificial Sequence
  Peptide Derived from Human Papillomavirus
AIFGVNPTIA

SEQ ID NO: 25413 - protein, 10 aa, Artificial Sequence
  Peptide Derived from Human Papillomavirus
AIVDKKTGDV

SEQ ID NO: 25414 - protein, 11 aa, Artificial Sequence
  Peptide Derived from Human Papillomavirus
AIVDKKTGDVI

SEQ ID NO: 25415 - protein, 9 aa, Artificial Sequence
  Peptide Derived from Human Papillomavirus
ALDGNPISI

SEQ ID NO: 25416 - protein, 8 aa, Artificial Sequence
  Peptide Derived from Human Papillomavirus
ALFHAQEV

SEQ ID NO: 25417 - protein, 10 aa, Artificial Sequence
  Peptide Derived from Human Papillomavirus
ALLADSNSNA

SEQ ID NO: 25418 - protein, 11 aa, Artificial Sequence
  Peptide Derived from Human Papillomavirus
ALLADSNSNAA

SEQ ID NO: 25419 - protein, 9 aa, Artificial Sequence
  Peptide Derived from Human Papillomavirus
ALYWYRTGI

SEQ ID NO: 25420 - protein, 10 aa, Artificial Sequence
  Peptide Derived from Human Papillomavirus
AMLAVFKDTY

SEQ ID NO: 25421 - protein, 11 aa, Artificial Sequence
  Peptide Derived from Human Papillomavirus
AMLDDATTTCW

SEQ ID NO: 25422 - protein, 10 aa, Artificial Sequence
  Peptide Derived from Human Papillomavirus
AQALFHAQEV

SEQ ID NO: 25423 - protein, 8 aa, Artificial Sequence
  Peptide Derived from Human Papillomavirus
AQEVHNDA

SEQ ID NO: 25424 - protein, 10 aa, Artificial Sequence
  Peptide Derived from Human Papillomavirus
AQEVHNDAQV

SEQ ID NO: 25425 - protein, 11 aa, Artificial Sequence
  Peptide Derived from Human Papillomavirus
AQEVHNDAQVL

SEQ ID NO: 25426 - protein, 8 aa, Artificial Sequence
  Peptide Derived from Human Papillomavirus
AQKRQMNM

SEQ ID NO: 25427 - protein, 11 aa, Artificial Sequence
  Peptide Derived from Human Papillomavirus
AQKRQMNMSQW

SEQ ID NO: 25428 - protein, 9 aa, Artificial Sequence
  Peptide Derived from Human Papillomavirus
AQLKDLLKV

SEQ ID NO: 25429 - protein, 11 aa, Artificial Sequence
  Peptide Derived from Human Papillomavirus
AQVLHVLKRKF

SEQ ID NO: 25430 - protein, 9 aa, Artificial Sequence
  Peptide Derived from Human Papillomavirus
AVFKDTYGL

SEQ ID NO: 25431 - protein, 11 aa, Artificial Sequence
  Peptide Derived from Human Papillomavirus
AVFKDTYGLSF

SEQ ID NO: 25432 - protein, 8 aa, Artificial Sequence
  Peptide Derived from Human Papillomavirus
CLDCKWGV

SEQ ID NO: 25433 - protein, 9 aa, Artificial Sequence
  Peptide Derived from Human Papillomavirus
CLDCKWGVL

SEQ ID NO: 25434 - protein, 10 aa, Artificial Sequence
  Peptide Derived from Human Papillomavirus
CLDCKWGVLI

SEQ ID NO: 25435 - protein, 11 aa, Artificial Sequence
  Peptide Derived from Human Papillomavirus
CLDCKWGVLIL

SEQ ID NO: 25436 - protein, 8 aa, Artificial Sequence
  Peptide Derived from Human Papillomavirus
CLVFCGPA

SEQ ID NO: 25437 - protein, 9 aa, Artificial Sequence
  Peptide Derived from Human Papillomavirus
CMLIQPPKL

SEQ ID NO: 25438 - protein, 10 aa, Artificial Sequence
  Peptide Derived from Human Papillomavirus
CPPILLTTNI

SEQ ID NO: 25439 - protein, 10 aa, Artificial Sequence
  Peptide Derived from Human Papillomavirus
CQAKYLKDCA

SEQ ID NO: 25440 - protein, 9 aa, Artificial Sequence
  Peptide Derived from Human Papillomavirus
DLHEEEEDA

SEQ ID NO: 25441 - protein, 11 aa, Artificial Sequence
  Peptide Derived from Human Papillomavirus
DLLKVNNKQGA

SEQ ID NO: 25442 - protein, 8 aa, Artificial Sequence
  Peptide Derived from Human Papillomavirus
DLSEMVQW

SEQ ID NO: 25443 - protein, 9 aa, Artificial Sequence
  Peptide Derived from Human Papillomavirus
DLSEMVQWA

SEQ ID NO: 25444 - protein, 10 aa, Artificial Sequence
  Peptide Derived from Human Papillomavirus
DLSEMVQWAF

SEQ ID NO: 25445 - protein, 8 aa, Artificial Sequence
  Peptide Derived from Human Papillomavirus
DMAFEYAL

SEQ ID NO: 25446 - protein, 9 aa, Artificial Sequence
  Peptide Derived from Human Papillomavirus
DMAFEYALL

SEQ ID NO: 25447 - protein, 10 aa, Artificial Sequence
  Peptide Derived from Human Papillomavirus
DMAFEYALLA

SEQ ID NO: 25448 - protein, 11 aa, Artificial Sequence
  Peptide Derived from Human Papillomavirus
DVISDDEDENA

SEQ ID NO: 25449 - protein, 10 aa, Artificial Sequence
  Peptide Derived from Human Papillomavirus
EINDKNWKCF

SEQ ID NO: 25450 - protein, 11 aa, Artificial Sequence
  Peptide Derived from Human Papillomavirus
EINDKNWKCFF

SEQ ID NO: 25451 - protein, 11 aa, Artificial Sequence
  Peptide Derived from Human Papillomavirus
EISLNSGQKKA

SEQ ID NO: 25452 - protein, 8 aa, Artificial Sequence
  Peptide Derived from Human Papillomavirus
ELETAQAL

SEQ ID NO: 25453 - protein, 9 aa, Artificial Sequence
  Peptide Derived from Human Papillomavirus
ELETAQALF

SEQ ID NO: 25454 - protein, 11 aa, Artificial Sequence
  Peptide Derived from Human Papillomavirus
ELETAQALFHA

SEQ ID NO: 25455 - protein, 9 aa, Artificial Sequence
  Peptide Derived from Human Papillomavirus
ELSPRLQEI

SEQ ID NO: 25456 - protein, 11 aa, Artificial Sequence
  Peptide Derived from Human Papillomavirus
ELSPRLQEISL

SEQ ID NO: 25457 - protein, 8 aa, Artificial Sequence
  Peptide Derived from Human Papillomavirus
ELTDESDM

SEQ ID NO: 25458 - protein, 9 aa, Artificial Sequence
  Peptide Derived from Human Papillomavirus
ELTDESDMA

SEQ ID NO: 25459 - protein, 10 aa, Artificial Sequence
  Peptide Derived from Human Papillomavirus
ELTDESDMAF

SEQ ID NO: 25460 - protein, 11 aa, Artificial Sequence
  Peptide Derived from Human Papillomavirus
EMVQWAFDNEL

SEQ ID NO: 25461 - protein, 8 aa, Artificial Sequence
  Peptide Derived from Human Papillomavirus
EPLTDTKV

SEQ ID NO: 25462 - protein, 9 aa, Artificial Sequence
  Peptide Derived from Human Papillomavirus
EPLTDTKVA

SEQ ID NO: 25463 - protein, 10 aa, Artificial Sequence
  Peptide Derived from Human Papillomavirus
EPLTDTKVAM

SEQ ID NO: 25464 - protein, 11 aa, Artificial Sequence
  Peptide Derived from Human Papillomavirus
EPLTDTKVAML

SEQ ID NO: 25465 - protein, 8 aa, Artificial Sequence
  Peptide Derived from Human Papillomavirus
EQAELETA

SEQ ID NO: 25466 - protein, 10 aa, Artificial Sequence
  Peptide Derived from Human Papillomavirus
EQAELETAQA

SEQ ID NO: 25467 - protein, 11 aa, Artificial Sequence
  Peptide Derived from Human Papillomavirus
EQAELETAQAL

SEQ ID NO: 25468 - protein, 10 aa, Artificial Sequence
  Peptide Derived from Human Papillomavirus
EVDTELSPRL

SEQ ID NO: 25469 - protein, 9 aa, Artificial Sequence
  Peptide Derived from Human Papillomavirus
EVEATQIQV

SEQ ID NO: 25470 - protein, 8 aa, Artificial Sequence
  Peptide Derived from Human Papillomavirus
EVHNDAQV

SEQ ID NO: 25471 - protein, 9 aa, Artificial Sequence
  Peptide Derived from Human Papillomavirus
EVHNDAQVL

SEQ ID NO: 25472 - protein, 11 aa, Artificial Sequence
  Peptide Derived from Human Papillomavirus
EVHNDAQVLHV

SEQ ID NO: 25473 - protein, 9 aa, Artificial Sequence
  Peptide Derived from Human Papillomavirus
EVMGDTPEW

SEQ ID NO: 25474 - protein, 10 aa, Artificial Sequence
  Peptide Derived from Human Papillomavirus
EVMGDTPEWI

SEQ ID NO: 25475 - protein, 8 aa, Artificial Sequence
  Peptide Derived from Human Papillomavirus
FIDTQGTF

SEQ ID NO: 25476 - protein, 8 aa, Artificial Sequence
  Peptide Derived from Human Papillomavirus
FIHFIQGA

SEQ ID NO: 25477 - protein, 9 aa, Artificial Sequence
  Peptide Derived from Human Papillomavirus
FIHFIQGAV

SEQ ID NO: 25478 - protein, 10 aa, Artificial Sequence
  Peptide Derived from Human Papillomavirus
FIHFIQGAVI

SEQ ID NO: 25479 - protein, 10 aa, Artificial Sequence
  Peptide Derived from Human Papillomavirus
FILYAHIQCL

SEQ ID NO: 25480 - protein, 9 aa, Artificial Sequence
  Peptide Derived from Human Papillomavirus
FIQGAVISF

SEQ ID NO: 25481 - protein, 10 aa, Artificial Sequence
  Peptide Derived from Human Papillomavirus
FIQGAVISFV

SEQ ID NO: 25482 - protein, 8 aa, Artificial Sequence
  Peptide Derived from Human Papillomavirus
FITFLGAL

SEQ ID NO: 25483 - protein, 11 aa, Artificial Sequence
  Peptide Derived from Human Papillomavirus
FITFLGALKSF

SEQ ID NO: 25484 - protein, 8 aa, Artificial Sequence
  Peptide Derived from Human Papillomavirus
FLGALKSF

SEQ ID NO: 25485 - protein, 9 aa, Artificial Sequence
  Peptide Derived from Human Papillomavirus
FLGALKSFL

SEQ ID NO: 25486 - protein, 11 aa, Artificial Sequence
  Peptide Derived from Human Papillomavirus
FLKGTPKKNCL

SEQ ID NO: 25487 - protein, 8 aa, Artificial Sequence
  Peptide Derived from Human Papillomavirus
FLKSNCQA

SEQ ID NO: 25488 - protein, 10 aa, Artificial Sequence
  Peptide Derived from Human Papillomavirus
FLKSNCQAKY

SEQ ID NO: 25489 - protein, 11 aa, Artificial Sequence
  Peptide Derived from Human Papillomavirus
FLKSNCQAKYL

SEQ ID NO: 25490 - protein, 9 aa, Artificial Sequence
  Peptide Derived from Human Papillomavirus
FLRYQQIEF

SEQ ID NO: 25491 - protein, 10 aa, Artificial Sequence
  Peptide Derived from Human Papillomavirus
FLRYQQIEFI

SEQ ID NO: 25492 - protein, 10 aa, Artificial Sequence
  Peptide Derived from Human Papillomavirus
FPFDKNGNPV

SEQ ID NO: 25493 - protein, 11 aa, Artificial Sequence
  Peptide Derived from Human Papillomavirus
FPFDKNGNPVY

SEQ ID NO: 25494 - protein, 8 aa, Artificial Sequence
  Peptide Derived from Human Papillomavirus
FVNSTSHF

SEQ ID NO: 25495 - protein, 9 aa, Artificial Sequence
  Peptide Derived from Human Papillomavirus
FVNSTSHFW

SEQ ID NO: 25496 - protein, 10 aa, Artificial Sequence
  Peptide Derived from Human Papillomavirus
FVNSTSHFWL

SEQ ID NO: 25497 - protein, 9 aa, Artificial Sequence
  Peptide Derived from Human Papillomavirus
GIDDSNFDL

SEQ ID NO: 25498 - protein, 8 aa, Artificial Sequence
  Peptide Derived from Human Papillomavirus
GISNISEV

SEQ ID NO: 25499 - protein, 9 aa, Artificial Sequence
  Peptide Derived from Human Papillomavirus
GISNISEVM

SEQ ID NO: 25500 - protein, 8 aa, Artificial Sequence
  Peptide Derived from Human Papillomavirus
GLSFTDLV

SEQ ID NO: 25501 - protein, 11 aa, Artificial Sequence
  Peptide Derived from Human Papillomavirus
GLSFTDLVRNF

SEQ ID NO: 25502 - protein, 8 aa, Artificial Sequence
  Peptide Derived from Human Papillomavirus
GLSTLLHV

SEQ ID NO: 25503 - protein, 8 aa, Artificial Sequence
  Peptide Derived from Human Papillomavirus
GMSFIHFI

SEQ ID NO: 25504 - protein, 11 aa, Artificial Sequence
  Peptide Derived from Human Papillomavirus
GMSFIHFIQGA

SEQ ID NO: 25505 - protein, 9 aa, Artificial Sequence
  Peptide Derived from Human Papillomavirus
GPANTGKSY

SEQ ID NO: 25506 - protein, 10 aa, Artificial Sequence
  Peptide Derived from Human Papillomavirus
GPANTGKSYF

SEQ ID NO: 25507 - protein, 9 aa, Artificial Sequence
  Peptide Derived from Human Papillomavirus
GQKKAKRRL

SEQ ID NO: 25508 - protein, 10 aa, Artificial Sequence
  Peptide Derived from Human Papillomavirus
GQKKAKRRLF

SEQ ID NO: 25509 - protein, 8 aa, Artificial Sequence
  Peptide Derived from Human Papillomavirus
GVLILALL

SEQ ID NO: 25510 - protein, 10 aa, Artificial Sequence
  Peptide Derived from Human Papillomavirus
GVLILALLRY

SEQ ID NO: 25511 - protein, 10 aa, Artificial Sequence
  Peptide Derived from Human Papillomavirus
GVNPTIAEGF

SEQ ID NO: 25512 - protein, 9 aa, Artificial Sequence
  Peptide Derived from Human Papillomavirus
HIQCLDCKW

SEQ ID NO: 25513 - protein, 11 aa, Artificial Sequence
  Peptide Derived from Human Papillomavirus
HIQCLDCKWGV

SEQ ID NO: 25514 - protein, 8 aa, Artificial Sequence
  Peptide Derived from Human Papillomavirus
HPAKDNRW

SEQ ID NO: 25515 - protein, 10 aa, Artificial Sequence
  Peptide Derived from Human Papillomavirus
HPAKDNRWPY

SEQ ID NO: 25516 - protein, 11 aa, Artificial Sequence
  Peptide Derived from Human Papillomavirus
HPAKDNRWPYL

SEQ ID NO: 25517 - protein, 8 aa, Artificial Sequence
  Peptide Derived from Human Papillomavirus
HVLKRKFA

SEQ ID NO: 25518 - protein, 8 aa, Artificial Sequence
  Peptide Derived from Human Papillomavirus
HVPETCML

SEQ ID NO: 25519 - protein, 9 aa, Artificial Sequence
  Peptide Derived from Human Papillomavirus
HVPETCMLI

SEQ ID NO: 25520 - protein, 11 aa, Artificial Sequence
  Peptide Derived from Human Papillomavirus
IIQHGIDDSNF

SEQ ID NO: 25521 - protein, 10 aa, Artificial Sequence
  Peptide Derived from Human Papillomavirus
ILLTTNIHPA

SEQ ID NO: 25522 - protein, 9 aa, Artificial Sequence
  Peptide Derived from Human Papillomavirus
ILYAHIQCL

SEQ ID NO: 25523 - protein, 8 aa, Artificial Sequence
  Peptide Derived from Human Papillomavirus
IQCLDCKW

SEQ ID NO: 25524 - protein, 10 aa, Artificial Sequence
  Peptide Derived from Human Papillomavirus
IQCLDCKWGV

SEQ ID NO: 25525 - protein, 11 aa, Artificial Sequence
  Peptide Derived from Human Papillomavirus
IQCLDCKWGVL

SEQ ID NO: 25526 - protein, 8 aa, Artificial Sequence
  Peptide Derived from Human Papillomavirus
IQGAVISF

SEQ ID NO: 25527 - protein, 9 aa, Artificial Sequence
  Peptide Derived from Human Papillomavirus
IQGAVISFV

SEQ ID NO: 25528 - protein, 10 aa, Artificial Sequence
  Peptide Derived from Human Papillomavirus
IQHGIDDSNF

SEQ ID NO: 25529 - protein, 8 aa, Artificial Sequence
  Peptide Derived from Human Papillomavirus
IQLKCPPI

SEQ ID NO: 25530 - protein, 9 aa, Artificial Sequence
  Peptide Derived from Human Papillomavirus
IQLKCPPIL

SEQ ID NO: 25531 - protein, 10 aa, Artificial Sequence
  Peptide Derived from Human Papillomavirus
IQLKCPPILL

SEQ ID NO: 25532 - protein, 8 aa, Artificial Sequence
  Peptide Derived from Human Papillomavirus
IQPFILYA

SEQ ID NO: 25533 - protein, 10 aa, Artificial Sequence
  Peptide Derived from Human Papillomavirus
IQPFILYAHI

SEQ ID NO: 25534 - protein, 10 aa, Artificial Sequence
  Peptide Derived from Human Papillomavirus
IQPPKLRSSV

SEQ ID NO: 25535 - protein, 11 aa, Artificial Sequence
  Peptide Derived from Human Papillomavirus
IQPPKLRSSVA

SEQ ID NO: 25536 - protein, 11 aa, Artificial Sequence
  Peptide Derived from Human Papillomavirus
IQRLTIIQHGI

SEQ ID NO: 25537 - protein, 9 aa, Artificial Sequence
  Peptide Derived from Human Papillomavirus
IVDKKTGDV

SEQ ID NO: 25538 - protein, 10 aa, Artificial Sequence
  Peptide Derived from Human Papillomavirus
IVDKKTGDVI

SEQ ID NO: 25539 - protein, 10 aa, Artificial Sequence
  Peptide Derived from Human Papillomavirus
IVQFLRYQQI

SEQ ID NO: 25540 - protein, 8 aa, Artificial Sequence
  Peptide Derived from Human Papillomavirus
KIDEGGDW

SEQ ID NO: 25541 - protein, 11 aa, Artificial Sequence
  Peptide Derived from Human Papillomavirus
KIDEGGDWRPI

SEQ ID NO: 25542 - protein, 11 aa, Artificial Sequence
  Peptide Derived from Human Papillomavirus
KLRAGQNHRPL

SEQ ID NO: 25543 - protein, 8 aa, Artificial Sequence
  Peptide Derived from Human Papillomavirus
KLRSSVAA

SEQ ID NO: 25544 - protein, 9 aa, Artificial Sequence
  Peptide Derived from Human Papillomavirus
KLRSSVAAL

SEQ ID NO: 25545 - protein, 10 aa, Artificial Sequence
  Peptide Derived from Human Papillomavirus
KLRSSVAALY

SEQ ID NO: 25546 - protein, 11 aa, Artificial Sequence
  Peptide Derived from Human Papillomavirus
KLRSSVAALYW

SEQ ID NO: 25547 - protein, 11 aa, Artificial Sequence
  Peptide Derived from Human Papillomavirus
KPLIQLKCPPI

SEQ ID NO: 25548 - protein, 8 aa, Artificial Sequence
  Peptide Derived from Human Papillomavirus
KQGAMLAV

SEQ ID NO: 25549 - protein, 9 aa, Artificial Sequence
  Peptide Derived from Human Papillomavirus
KQGAMLAVF

SEQ ID NO: 25550 - protein, 8 aa, Artificial Sequence
  Peptide Derived from Human Papillomavirus
KVAMLDDA

SEQ ID NO: 25551 - protein, 8 aa, Artificial Sequence
  Peptide Derived from Human Papillomavirus
KVNNKQGA

SEQ ID NO: 25552 - protein, 9 aa, Artificial Sequence
  Peptide Derived from Human Papillomavirus
KVNNKQGAM

SEQ ID NO: 25553 - protein, 10 aa, Artificial Sequence
  Peptide Derived from Human Papillomavirus
KVNNKQGAML

SEQ ID NO: 25554 - protein, 11 aa, Artificial Sequence
  Peptide Derived from Human Papillomavirus
KVNNKQGAMLA

SEQ ID NO: 25555 - protein, 8 aa, Artificial Sequence
  Peptide Derived from Human Papillomavirus
LILALLRY

SEQ ID NO: 25556 - protein, 9 aa, Artificial Sequence
  Peptide Derived from Human Papillomavirus
LIQLKCPPI

SEQ ID NO: 25557 - protein, 10 aa, Artificial Sequence
  Peptide Derived from Human Papillomavirus
LIQLKCPPIL

SEQ ID NO: 25558 - protein, 11 aa, Artificial Sequence
  Peptide Derived from Human Papillomavirus
LIQLKCPPILL

SEQ ID NO: 25559 - protein, 8 aa, Artificial Sequence
  Peptide Derived from Human Papillomavirus
LIQPFILY

SEQ ID NO: 25560 - protein, 9 aa, Artificial Sequence
  Peptide Derived from Human Papillomavirus
LIQPFILYA

SEQ ID NO: 25561 - protein, 11 aa, Artificial Sequence
  Peptide Derived from Human Papillomavirus
LIQPFILYAHI

SEQ ID NO: 25562 - protein, 11 aa, Artificial Sequence
  Peptide Derived from Human Papillomavirus
LIQPPKLRSSV

SEQ ID NO: 25563 - protein, 9 aa, Artificial Sequence
  Peptide Derived from Human Papillomavirus
LLADSNSNA

SEQ ID NO: 25564 - protein, 10 aa, Artificial Sequence
  Peptide Derived from Human Papillomavirus
LLADSNSNAA

SEQ ID NO: 25565 - protein, 11 aa, Artificial Sequence
  Peptide Derived from Human Papillomavirus
LLADSNSNAAA

SEQ ID NO: 25566 - protein, 9 aa, Artificial Sequence
  Peptide Derived from Human Papillomavirus
LLHVPETCM

SEQ ID NO: 25567 - protein, 10 aa, Artificial Sequence
  Peptide Derived from Human Papillomavirus
LLHVPETCML

SEQ ID NO: 25568 - protein, 11 aa, Artificial Sequence
  Peptide Derived from Human Papillomavirus
LLHVPETCMLI

SEQ ID NO: 25569 - protein, 10 aa, Artificial Sequence
  Peptide Derived from Human Papillomavirus
LLKVNNKQGA

SEQ ID NO: 25570 - protein, 11 aa, Artificial Sequence
  Peptide Derived from Human Papillomavirus
LLKVNNKQGAM

SEQ ID NO: 25571 - protein, 11 aa, Artificial Sequence
  Peptide Derived from Human Papillomavirus
LLRYKCGKSRL

SEQ ID NO: 25572 - protein, 9 aa, Artificial Sequence
  Peptide Derived from Human Papillomavirus
LLTTNIHPA

SEQ ID NO: 25573 - protein, 9 aa, Artificial Sequence
  Peptide Derived from Human Papillomavirus
MLAVFKDTY

SEQ ID NO: 25574 - protein, 11 aa, Artificial Sequence
  Peptide Derived from Human Papillomavirus
MLAVFKDTYGL

SEQ ID NO: 25575 - protein, 10 aa, Artificial Sequence
  Peptide Derived from Human Papillomavirus
MLDDATTTCW

SEQ ID NO: 25576 - protein, 8 aa, Artificial Sequence
  Peptide Derived from Human Papillomavirus
MLIQPPKL

SEQ ID NO: 25577 - protein, 11 aa, Artificial Sequence
  Peptide Derived from Human Papillomavirus
MVDFIDTQGTF

SEQ ID NO: 25578 - protein, 10 aa, Artificial Sequence
  Peptide Derived from Human Papillomavirus
MVQWAFDNEL

SEQ ID NO: 25579 - protein, 11 aa, Artificial Sequence
  Peptide Derived from Human Papillomavirus
NIENVNPQCTI

SEQ ID NO: 25580 - protein, 10 aa, Artificial Sequence
  Peptide Derived from Human Papillomavirus
NIHPAKDNRW

SEQ ID NO: 25581 - protein, 8 aa, Artificial Sequence
  Peptide Derived from Human Papillomavirus
NMSQWIRF

SEQ ID NO: 25582 - protein, 8 aa, Artificial Sequence
  Peptide Derived from Human Papillomavirus
NPFGTFKL

SEQ ID NO: 25583 - protein, 10 aa, Artificial Sequence
  Peptide Derived from Human Papillomavirus
NPFGTFKLRA

SEQ ID NO: 25584 - protein, 9 aa, Artificial Sequence
  Peptide Derived from Human Papillomavirus
NPQCTIAQL

SEQ ID NO: 25585 - protein, 8 aa, Artificial Sequence
  Peptide Derived from Human Papillomavirus
NPTIAEGF

SEQ ID NO: 25586 - protein, 11 aa, Artificial Sequence
  Peptide Derived from Human Papillomavirus
NPTIAEGFKTL

SEQ ID NO: 25587 - protein, 11 aa, Artificial Sequence
  Peptide Derived from Human Papillomavirus
NPVYEINDKNW

SEQ ID NO: 25588 - protein, 10 aa, Artificial Sequence
  Peptide Derived from Human Papillomavirus
NVCSGGSTEA

SEQ ID NO: 25589 - protein, 11 aa, Artificial Sequence
  Peptide Derived from Human Papillomavirus
NVCSGGSTEAI

SEQ ID NO: 25590 - protein, 8 aa, Artificial Sequence
  Peptide Derived from Human Papillomavirus
NVNPQCTI

SEQ ID NO: 25591 - protein, 9 aa, Artificial Sequence
  Peptide Derived from Human Papillomavirus
NVNPQCTIA

SEQ ID NO: 25592 - protein, 11 aa, Artificial Sequence
  Peptide Derived from Human Papillomavirus
NVNPQCTIAQL

SEQ ID NO: 25593 - protein, 8 aa, Artificial Sequence
  Peptide Derived from Human Papillomavirus
PILLTTNI

SEQ ID NO: 25594 - protein, 11 aa, Artificial Sequence
  Peptide Derived from Human Papillomavirus
PILLTTNIHPA

SEQ ID NO: 25595 - protein, 11 aa, Artificial Sequence
  Peptide Derived from Human Papillomavirus
PISIDRKHKPL

SEQ ID NO: 25596 - protein, 8 aa, Artificial Sequence
  Peptide Derived from Human Papillomavirus
PIVQFLRY

SEQ ID NO: 25597 - protein, 11 aa, Artificial Sequence
  Peptide Derived from Human Papillomavirus
PIVQFLRYQQI

SEQ ID NO: 25598 - protein, 8 aa, Artificial Sequence
  Peptide Derived from Human Papillomavirus
PLGERLEV

SEQ ID NO: 25599 - protein, 10 aa, Artificial Sequence
  Peptide Derived from Human Papillomavirus
PLIQLKCPPI

SEQ ID NO: 25600 - protein, 11 aa, Artificial Sequence
  Peptide Derived from Human Papillomavirus
PLIQLKCPPIL

SEQ ID NO: 25601 - protein, 8 aa, Artificial Sequence
  Peptide Derived from Human Papillomavirus
PLTDTKVA

SEQ ID NO: 25602 - protein, 9 aa, Artificial Sequence
  Peptide Derived from Human Papillomavirus
PLTDTKVAM

SEQ ID NO: 25603 - protein, 10 aa, Artificial Sequence
  Peptide Derived from Human Papillomavirus
PLTDTKVAML

SEQ ID NO: 25604 - protein, 9 aa, Artificial Sequence
  Peptide Derived from Human Papillomavirus
PPILLTTNI

SEQ ID NO: 25605 - protein, 8 aa, Artificial Sequence
  Peptide Derived from Human Papillomavirus
PPKLRSSV

SEQ ID NO: 25606 - protein, 9 aa, Artificial Sequence
  Peptide Derived from Human Papillomavirus
PPKLRSSVA

SEQ ID NO: 25607 - protein, 10 aa, Artificial Sequence
  Peptide Derived from Human Papillomavirus
PPKLRSSVAA

SEQ ID NO: 25608 - protein, 11 aa, Artificial Sequence
  Peptide Derived from Human Papillomavirus
PPKLRSSVAAL

SEQ ID NO: 25609 - protein, 8 aa, Artificial Sequence
  Peptide Derived from Human Papillomavirus
PQCTIAQL

SEQ ID NO: 25610 - protein, 11 aa, Artificial Sequence
  Peptide Derived from Human Papillomavirus
PQCTIAQLKDL

SEQ ID NO: 25611 - protein, 10 aa, Artificial Sequence
  Peptide Derived from Human Papillomavirus
PVYEINDKNW

SEQ ID NO: 25612 - protein, 8 aa, Artificial Sequence
  Peptide Derived from Human Papillomavirus
QIEFITFL

SEQ ID NO: 25613 - protein, 10 aa, Artificial Sequence
  Peptide Derived from Human Papillomavirus
QIEFITFLGA

SEQ ID NO: 25614 - protein, 11 aa, Artificial Sequence
  Peptide Derived from Human Papillomavirus
QIEFITFLGAL

SEQ ID NO: 25615 - protein, 8 aa, Artificial Sequence
  Peptide Derived from Human Papillomavirus
QLKCPPIL

SEQ ID NO: 25616 - protein, 9 aa, Artificial Sequence
  Peptide Derived from Human Papillomavirus
QLKCPPILL

SEQ ID NO: 25617 - protein, 8 aa, Artificial Sequence
  Peptide Derived from Human Papillomavirus
QLKDLLKV

SEQ ID NO: 25618 - protein, 8 aa, Artificial Sequence
  Peptide Derived from Human Papillomavirus
QMNMSQWI

SEQ ID NO: 25619 - protein, 10 aa, Artificial Sequence
  Peptide Derived from Human Papillomavirus
QMNMSQWIRF

SEQ ID NO: 25620 - protein, 9 aa, Artificial Sequence
  Peptide Derived from Human Papillomavirus
QPFILYAHI

SEQ ID NO: 25621 - protein, 9 aa, Artificial Sequence
  Peptide Derived from Human Papillomavirus
QPPKLRSSV

SEQ ID NO: 25622 - protein, 10 aa, Artificial Sequence
  Peptide Derived from Human Papillomavirus
QPPKLRSSVA

SEQ ID NO: 25623 - protein, 11 aa, Artificial Sequence
  Peptide Derived from Human Papillomavirus
QPPKLRSSVAA

SEQ ID NO: 25624 - protein, 8 aa, Artificial Sequence
  Peptide Derived from Human Papillomavirus
QQIEFITF

SEQ ID NO: 25625 - protein, 9 aa, Artificial Sequence
  Peptide Derived from Human Papillomavirus
QQIEFITFL

SEQ ID NO: 25626 - protein, 11 aa, Artificial Sequence
  Peptide Derived from Human Papillomavirus
QQIEFITFLGA

SEQ ID NO: 25627 - protein, 10 aa, Artificial Sequence
  Peptide Derived from Human Papillomavirus
QVLHVLKRKF

SEQ ID NO: 25628 - protein, 11 aa, Artificial Sequence
  Peptide Derived from Human Papillomavirus
QVLHVLKRKFA

SEQ ID NO: 25629 - protein, 10 aa, Artificial Sequence
  Peptide Derived from Human Papillomavirus
RITVFEFPNA

SEQ ID NO: 25630 - protein, 11 aa, Artificial Sequence
  Peptide Derived from Human Papillomavirus
RITVFEFPNAF

SEQ ID NO: 25631 - protein, 11 aa, Artificial Sequence
  Peptide Derived from Human Papillomavirus
RLDLHEEEEDA

SEQ ID NO: 25632 - protein, 8 aa, Artificial Sequence
  Peptide Derived from Human Papillomavirus
RLEVDTEL

SEQ ID NO: 25633 - protein, 10 aa, Artificial Sequence
  Peptide Derived from Human Papillomavirus
RLFTISDSGY

SEQ ID NO: 25634 - protein, 9 aa, Artificial Sequence
  Peptide Derived from Human Papillomavirus
RLTIIQHGI

SEQ ID NO: 25635 - protein, 8 aa, Artificial Sequence
  Peptide Derived from Human Papillomavirus
RLTVAKGL

SEQ ID NO: 25636 - protein, 11 aa, Artificial Sequence
  Peptide Derived from Human Papillomavirus
RLTVAKGLSTL

SEQ ID NO: 25637 - protein, 9 aa, Artificial Sequence
  Peptide Derived from Human Papillomavirus
RPIVQFLRY

SEQ ID NO: 25638 - protein, 8 aa, Artificial Sequence
  Peptide Derived from Human Papillomavirus
RQMNMSQW

SEQ ID NO: 25639 - protein, 9 aa, Artificial Sequence
  Peptide Derived from Human Papillomavirus
RQMNMSQWI

SEQ ID NO: 25640 - protein, 11 aa, Artificial Sequence
  Peptide Derived from Human Papillomavirus
RQMNMSQWIRF

SEQ ID NO: 25641 - protein, 9 aa, Artificial Sequence
  Peptide Derived from Human Papillomavirus
SIDRKHKPL

SEQ ID NO: 25642 - protein, 10 aa, Artificial Sequence
  Peptide Derived from Human Papillomavirus
SIDRKHKPLI

SEQ ID NO: 25643 - protein, 9 aa, Artificial Sequence
  Peptide Derived from Human Papillomavirus
SLNSGQKKA

SEQ ID NO: 25644 - protein, 9 aa, Artificial Sequence
  Peptide Derived from Human Papillomavirus
SPLGERLEV

SEQ ID NO: 25645 - protein, 9 aa, Artificial Sequence
  Peptide Derived from Human Papillomavirus
SPRLQEISL

SEQ ID NO: 25646 - protein, 11 aa, Artificial Sequence
  Peptide Derived from Human Papillomavirus
SQWIRFRCSKI

SEQ ID NO: 25647 - protein, 8 aa, Artificial Sequence
  Peptide Derived from Human Papillomavirus
SVAALYWY

SEQ ID NO: 25648 - protein, 11 aa, Artificial Sequence
  Peptide Derived from Human Papillomavirus
SVDGTSDNSNI

SEQ ID NO: 25649 - protein, 9 aa, Artificial Sequence
  Peptide Derived from Human Papillomavirus
TIAEGFKTL

SEQ ID NO: 25650 - protein, 10 aa, Artificial Sequence
  Peptide Derived from Human Papillomavirus
TIAEGFKTLI

SEQ ID NO: 25651 - protein, 8 aa, Artificial Sequence
  Peptide Derived from Human Papillomavirus
TIAQLKDL

SEQ ID NO: 25652 - protein, 9 aa, Artificial Sequence
  Peptide Derived from Human Papillomavirus
TIAQLKDLL

SEQ ID NO: 25653 - protein, 11 aa, Artificial Sequence
  Peptide Derived from Human Papillomavirus
TIAQLKDLLKV

SEQ ID NO: 25654 - protein, 8 aa, Artificial Sequence
  Peptide Derived from Human Papillomavirus
TLIQPFIL

SEQ ID NO: 25655 - protein, 9 aa, Artificial Sequence
  Peptide Derived from Human Papillomavirus
TLIQPFILY

SEQ ID NO: 25656 - protein, 10 aa, Artificial Sequence
  Peptide Derived from Human Papillomavirus
TLIQPFILYA

SEQ ID NO: 25657 - protein, 10 aa, Artificial Sequence
  Peptide Derived from Human Papillomavirus
TLLHVPETCM

SEQ ID NO: 25658 - protein, 11 aa, Artificial Sequence
  Peptide Derived from Human Papillomavirus
TLLHVPETCML

SEQ ID NO: 25659 - protein, 9 aa, Artificial Sequence
  Peptide Derived from Human Papillomavirus
TMCKHYRRA

SEQ ID NO: 25660 - protein, 8 aa, Artificial Sequence
  Peptide Derived from Human Papillomavirus
TPEWIQRL

SEQ ID NO: 25661 - protein, 10 aa, Artificial Sequence
  Peptide Derived from Human Papillomavirus
TPEWIQRLTI

SEQ ID NO: 25662 - protein, 11 aa, Artificial Sequence
  Peptide Derived from Human Papillomavirus
TPEWIQRLTII

SEQ ID NO: 25663 - protein, 8 aa, Artificial Sequence
  Peptide Derived from Human Papillomavirus
TPKKNCLV

SEQ ID NO: 25664 - protein, 9 aa, Artificial Sequence
  Peptide Derived from Human Papillomavirus
TPKKNCLVF

SEQ ID NO: 25665 - protein, 9 aa, Artificial Sequence
  Peptide Derived from Human Papillomavirus
TQGTFCEQA

SEQ ID NO: 25666 - protein, 11 aa, Artificial Sequence
  Peptide Derived from Human Papillomavirus
TQGTFCEQAEL

SEQ ID NO: 25667 - protein, 9 aa, Artificial Sequence
  Peptide Derived from Human Papillomavirus
TVAKGLSTL

SEQ ID NO: 25668 - protein, 10 aa, Artificial Sequence
  Peptide Derived from Human Papillomavirus
TVAKGLSTLL

SEQ ID NO: 25669 - protein, 8 aa, Artificial Sequence
  Peptide Derived from Human Papillomavirus
TVFEFPNA

SEQ ID NO: 25670 - protein, 9 aa, Artificial Sequence
  Peptide Derived from Human Papillomavirus
TVFEFPNAF

SEQ ID NO: 25671 - protein, 11 aa, Artificial Sequence
  Peptide Derived from Human Papillomavirus
TVFEFPNAFPF

SEQ ID NO: 25672 - protein, 10 aa, Artificial Sequence
  Peptide Derived from Human Papillomavirus
VISDDEDENA

SEQ ID NO: 25673 - protein, 11 aa, Artificial Sequence
  Peptide Derived from Human Papillomavirus
VISFVNSTSHF

SEQ ID NO: 25674 - protein, 9 aa, Artificial Sequence
  Peptide Derived from Human Papillomavirus
VLHVLKRKF

SEQ ID NO: 25675 - protein, 10 aa, Artificial Sequence
  Peptide Derived from Human Papillomavirus
VLHVLKRKFA

SEQ ID NO: 25676 - protein, 9 aa, Artificial Sequence
  Peptide Derived from Human Papillomavirus
VLILALLRY

SEQ ID NO: 25677 - protein, 8 aa, Artificial Sequence
  Peptide Derived from Human Papillomavirus
VMGDTPEW

SEQ ID NO: 25678 - protein, 9 aa, Artificial Sequence
  Peptide Derived from Human Papillomavirus
VMGDTPEWI

SEQ ID NO: 25679 - protein, 8 aa, Artificial Sequence
  Peptide Derived from Human Papillomavirus
VPETCMLI

SEQ ID NO: 25680 - protein, 9 aa, Artificial Sequence
  Peptide Derived from Human Papillomavirus
VQFLRYQQI

SEQ ID NO: 25681 - protein, 11 aa, Artificial Sequence
  Peptide Derived from Human Papillomavirus
VQFLRYQQIEF

SEQ ID NO: 25682 - protein, 9 aa, Artificial Sequence
  Peptide Derived from Human Papillomavirus
VQWAFDNEL

SEQ ID NO: 25683 - protein, 8 aa, Artificial Sequence
  Peptide Derived from Human Papillomavirus
WIQRLTII

SEQ ID NO: 25684 - protein, 9 aa, Artificial Sequence
  Peptide Derived from Human Papillomavirus
WIRFRCSKI

SEQ ID NO: 25685 - protein, 10 aa, Artificial Sequence
  Peptide Derived from Human Papillomavirus
WLEPLTDTKV

SEQ ID NO: 25686 - protein, 11 aa, Artificial Sequence
  Peptide Derived from Human Papillomavirus
WLEPLTDTKVA

SEQ ID NO: 25687 - protein, 8 aa, Artificial Sequence
  Peptide Derived from Human Papillomavirus
WPYLESRI

SEQ ID NO: 25688 - protein, 10 aa, Artificial Sequence
  Peptide Derived from Human Papillomavirus
WPYLESRITV

SEQ ID NO: 25689 - protein, 11 aa, Artificial Sequence
  Peptide Derived from Human Papillomavirus
WPYLESRITVF

SEQ ID NO: 25690 - protein, 8 aa, Artificial Sequence
  Peptide Derived from Human Papillomavirus
WVTAIFGV

SEQ ID NO: 25691 - protein, 8 aa, Artificial Sequence
  Peptide Derived from Human Papillomavirus
YLESRITV

SEQ ID NO: 25692 - protein, 9 aa, Artificial Sequence
  Peptide Derived from Human Papillomavirus
YLESRITVF

SEQ ID NO: 25693 - protein, 11 aa, Artificial Sequence
  Peptide Derived from Human Papillomavirus
YLESRITVFEF

SEQ ID NO: 25694 - protein, 8 aa, Artificial Sequence
  Peptide Derived from Human Papillomavirus
YLKDCATM

SEQ ID NO: 25695 - protein, 11 aa, Artificial Sequence
  Peptide Derived from Human Papillomavirus
YMRNALDGNPI

SEQ ID NO: 25696 - protein, 9 aa, Artificial Sequence
  Peptide Derived from Human Papillomavirus
YQQIEFITF

SEQ ID NO: 25697 - protein, 10 aa, Artificial Sequence
  Peptide Derived from Human Papillomavirus
YQQIEFITFL

SEQ ID NO: 25698 - protein, 8 aa, Artificial Sequence
  Peptide Derived from Human Papillomavirus
AIELQMAL

SEQ ID NO: 25699 - protein, 11 aa, Artificial Sequence
  Peptide Derived from Human Papillomavirus
AIELQMALQGL

SEQ ID NO: 25700 - protein, 11 aa, Artificial Sequence
  Peptide Derived from Human Papillomavirus
AIFFAAREHGI

SEQ ID NO: 25701 - protein, 8 aa, Artificial Sequence
  Peptide Derived from Human Papillomavirus
AIPDSVQI

SEQ ID NO: 25702 - protein, 9 aa, Artificial Sequence
  Peptide Derived from Human Papillomavirus
AIPDSVQIL

SEQ ID NO: 25703 - protein, 10 aa, Artificial Sequence
  Peptide Derived from Human Papillomavirus
AIPDSVQILV

SEQ ID NO: 25704 - protein, 10 aa, Artificial Sequence
  Peptide Derived from Human Papillomavirus
ALQGLAQSRY

SEQ ID NO: 25705 - protein, 10 aa, Artificial Sequence
  Peptide Derived from Human Papillomavirus
AQSRYKTEDW

SEQ ID NO: 25706 - protein, 10 aa, Artificial Sequence
  Peptide Derived from Human Papillomavirus
CMTYVAWDSV

SEQ ID NO: 25707 - protein, 11 aa, Artificial Sequence
  Peptide Derived from Human Papillomavirus
CMTYVAWDSVY

SEQ ID NO: 25708 - protein, 10 aa, Artificial Sequence
  Peptide Derived from Human Papillomavirus
CVQDKIIDHY

SEQ ID NO: 25709 - protein, 8 aa, Artificial Sequence
  Peptide Derived from Human Papillomavirus
CVSHRGLY

SEQ ID NO: 25710 - protein, 9 aa, Artificial Sequence
  Peptide Derived from Human Papillomavirus
CVSHRGLYY

SEQ ID NO: 25711 - protein, 10 aa, Artificial Sequence
  Peptide Derived from Human Papillomavirus
CVSHRGLYYV

SEQ ID NO: 25712 - protein, 8 aa, Artificial Sequence
  Peptide Derived from Human Papillomavirus
DIDSQIQY

SEQ ID NO: 25713 - protein, 9 aa, Artificial Sequence
  Peptide Derived from Human Papillomavirus
DIDSQIQYW

SEQ ID NO: 25714 - protein, 11 aa, Artificial Sequence
  Peptide Derived from Human Papillomavirus
DIDSQIQYWQL

SEQ ID NO: 25715 - protein, 8 aa, Artificial Sequence
  Peptide Derived from Human Papillomavirus
DISSTWHW

SEQ ID NO: 25716 - protein, 11 aa, Artificial Sequence
  Peptide Derived from Human Papillomavirus
DISSTWHWTGA

SEQ ID NO: 25717 - protein, 9 aa, Artificial Sequence
  Peptide Derived from Human Papillomavirus
ELQMALQGL

SEQ ID NO: 25718 - protein, 10 aa, Artificial Sequence
  Peptide Derived from Human Papillomavirus
ELQMALQGLA

SEQ ID NO: 25719 - protein, 11 aa, Artificial Sequence
  Peptide Derived from Human Papillomavirus
ELWNTEPTHCF

SEQ ID NO: 25720 - protein, 8 aa, Artificial Sequence
  Peptide Derived from Human Papillomavirus
EVHFGNNV

SEQ ID NO: 25721 - protein, 9 aa, Artificial Sequence
  Peptide Derived from Human Papillomavirus
EVHFGNNVI

SEQ ID NO: 25722 - protein, 11 aa, Artificial Sequence
  Peptide Derived from Human Papillomavirus
FLNTVAIPDSV

SEQ ID NO: 25723 - protein, 9 aa, Artificial Sequence
  Peptide Derived from Human Papillomavirus
GIQTLNHQV

SEQ ID NO: 25724 - protein, 10 aa, Artificial Sequence
  Peptide Derived from Human Papillomavirus
GIQTLNHQVV

SEQ ID NO: 25725 - protein, 11 aa, Artificial Sequence
  Peptide Derived from Human Papillomavirus
GLAEKQHCGPV

SEQ ID NO: 25726 - protein, 9 aa, Artificial Sequence
  Peptide Derived from Human Papillomavirus
GLYYVKEGY

SEQ ID NO: 25727 - protein, 9 aa, Artificial Sequence
  Peptide Derived from Human Papillomavirus
GPVNPLLGA

SEQ ID NO: 25728 - protein, 10 aa, Artificial Sequence
  Peptide Derived from Human Papillomavirus
GPVNPLLGAA

SEQ ID NO: 25729 - protein, 8 aa, Artificial Sequence
  Peptide Derived from Human Papillomavirus
GQTVQVYF

SEQ ID NO: 25730 - protein, 9 aa, Artificial Sequence
  Peptide Derived from Human Papillomavirus
HLKGDRNSL

SEQ ID NO: 25731 - protein, 9 aa, Artificial Sequence
  Peptide Derived from Human Papillomavirus
HQVVPAYNI

SEQ ID NO: 25732 - protein, 11 aa, Artificial Sequence
  Peptide Derived from Human Papillomavirus
IIHLKGDRNSL

SEQ ID NO: 25733 - protein, 8 aa, Artificial Sequence
  Peptide Derived from Human Papillomavirus
ILVGYMTM

SEQ ID NO: 25734 - protein, 8 aa, Artificial Sequence
  Peptide Derived from Human Papillomavirus
IPDSVQIL

SEQ ID NO: 25735 - protein, 9 aa, Artificial Sequence
  Peptide Derived from Human Papillomavirus
IPDSVQILV

SEQ ID NO: 25736 - protein, 11 aa, Artificial Sequence
  Peptide Derived from Human Papillomavirus
IPDSVQILVGY

SEQ ID NO: 25737 - protein, 8 aa, Artificial Sequence
  Peptide Derived from Human Papillomavirus
IQTLNHQV

SEQ ID NO: 25738 - protein, 9 aa, Artificial Sequence
  Peptide Derived from Human Papillomavirus
IQTLNHQVV

SEQ ID NO: 25739 - protein, 11 aa, Artificial Sequence
  Peptide Derived from Human Papillomavirus
IQTLNHQVVPA

SEQ ID NO: 25740 - protein, 9 aa, Artificial Sequence
  Peptide Derived from Human Papillomavirus
IQYWQLIRW

SEQ ID NO: 25741 - protein, 10 aa, Artificial Sequence
  Peptide Derived from Human Papillomavirus
KLCSGNTTPI

SEQ ID NO: 25742 - protein, 11 aa, Artificial Sequence
  Peptide Derived from Human Papillomavirus
KLCSGNTTPII

SEQ ID NO: 25743 - protein, 10 aa, Artificial Sequence
  Peptide Derived from Human Papillomavirus
KQHCGPVNPL

SEQ ID NO: 25744 - protein, 11 aa, Artificial Sequence
  Peptide Derived from Human Papillomavirus
KQHCGPVNPLL

SEQ ID NO: 25745 - protein, 10 aa, Artificial Sequence
  Peptide Derived from Human Papillomavirus
KQLQHTPSPY

SEQ ID NO: 25746 - protein, 8 aa, Artificial Sequence
  Peptide Derived from Human Papillomavirus
LIRWENAI

SEQ ID NO: 25747 - protein, 9 aa, Artificial Sequence
  Peptide Derived from Human Papillomavirus
LIRWENAIF

SEQ ID NO: 25748 - protein, 10 aa, Artificial Sequence
  Peptide Derived from Human Papillomavirus
LIRWENAIFF

SEQ ID NO: 25749 - protein, 11 aa, Artificial Sequence
  Peptide Derived from Human Papillomavirus
LIRWENAIFFA

SEQ ID NO: 25750 - protein, 8 aa, Artificial Sequence
  Peptide Derived from Human Papillomavirus
LQDTCEEL

SEQ ID NO: 25751 - protein, 9 aa, Artificial Sequence
  Peptide Derived from Human Papillomavirus
LQDTCEELW

SEQ ID NO: 25752 - protein, 9 aa, Artificial Sequence
  Peptide Derived from Human Papillomavirus
LQGLAQSRY

SEQ ID NO: 25753 - protein, 8 aa, Artificial Sequence
  Peptide Derived from Human Papillomavirus
LQHTPSPY

SEQ ID NO: 25754 - protein, 8 aa, Artificial Sequence
  Peptide Derived from Human Papillomavirus
LQMALQGL

SEQ ID NO: 25755 - protein, 9 aa, Artificial Sequence
  Peptide Derived from Human Papillomavirus
LQMALQGLA

SEQ ID NO: 25756 - protein, 8 aa, Artificial Sequence
  Peptide Derived from Human Papillomavirus
MQTPKETL

SEQ ID NO: 25757 - protein, 10 aa, Artificial Sequence
  Peptide Derived from Human Papillomavirus
NISKSKAHKA

SEQ ID NO: 25758 - protein, 11 aa, Artificial Sequence
  Peptide Derived from Human Papillomavirus
NISKSKAHKAI

SEQ ID NO: 25759 - protein, 9 aa, Artificial Sequence
  Peptide Derived from Human Papillomavirus
NVIDCNDSM

SEQ ID NO: 25760 - protein, 8 aa, Artificial Sequence
  Peptide Derived from Human Papillomavirus
PVNPLLGA

SEQ ID NO: 25761 - protein, 9 aa, Artificial Sequence
  Peptide Derived from Human Papillomavirus
PVNPLLGAA

SEQ ID NO: 25762 - protein, 9 aa, Artificial Sequence
  Peptide Derived from Human Papillomavirus
QILVGYMTM

SEQ ID NO: 25763 - protein, 8 aa, Artificial Sequence
  Peptide Derived from Human Papillomavirus
QIQYWQLI

SEQ ID NO: 25764 - protein, 10 aa, Artificial Sequence
  Peptide Derived from Human Papillomavirus
QIQYWQLIRW

SEQ ID NO: 25765 - protein, 8 aa, Artificial Sequence
  Peptide Derived from Human Papillomavirus
QLIRWENA

SEQ ID NO: 25766 - protein, 9 aa, Artificial Sequence
  Peptide Derived from Human Papillomavirus
QLIRWENAI

SEQ ID NO: 25767 - protein, 10 aa, Artificial Sequence
  Peptide Derived from Human Papillomavirus
QLIRWENAIF

SEQ ID NO: 25768 - protein, 11 aa, Artificial Sequence
  Peptide Derived from Human Papillomavirus
QLIRWENAIFF

SEQ ID NO: 25769 - protein, 9 aa, Artificial Sequence
  Peptide Derived from Human Papillomavirus
QLQHTPSPY

SEQ ID NO: 25770 - protein, 8 aa, Artificial Sequence
  Peptide Derived from Human Papillomavirus
QMALQGLA

SEQ ID NO: 25771 - protein, 8 aa, Artificial Sequence
  Peptide Derived from Human Papillomavirus
QVVPAYNI

SEQ ID NO: 25772 - protein, 9 aa, Artificial Sequence
  Peptide Derived from Human Papillomavirus
RLRKHSDHY

SEQ ID NO: 25773 - protein, 9 aa, Artificial Sequence
  Peptide Derived from Human Papillomavirus
RLSCVQDKI

SEQ ID NO: 25774 - protein, 10 aa, Artificial Sequence
  Peptide Derived from Human Papillomavirus
RLSCVQDKII

SEQ ID NO: 25775 - protein, 8 aa, Artificial Sequence
  Peptide Derived from Human Papillomavirus
RPGHCGLA

SEQ ID NO: 25776 - protein, 9 aa, Artificial Sequence
  Peptide Derived from Human Papillomavirus
SLKCLRYRL

SEQ ID NO: 25777 - protein, 10 aa, Artificial Sequence
  Peptide Derived from Human Papillomavirus
SMCSTSDDTV

SEQ ID NO: 25778 - protein, 9 aa, Artificial Sequence
  Peptide Derived from Human Papillomavirus
SPYSSTVSV

SEQ ID NO: 25779 - protein, 8 aa, Artificial Sequence
  Peptide Derived from Human Papillomavirus
SQIQYWQL

SEQ ID NO: 25780 - protein, 9 aa, Artificial Sequence
  Peptide Derived from Human Papillomavirus
SQIQYWQLI

SEQ ID NO: 25781 - protein, 11 aa, Artificial Sequence
  Peptide Derived from Human Papillomavirus
SQIQYWQLIRW

SEQ ID NO: 25782 - protein, 8 aa, Artificial Sequence
  Peptide Derived from Human Papillomavirus
SVGTAKTY

SEQ ID NO: 25783 - protein, 8 aa, Artificial Sequence
  Peptide Derived from Human Papillomavirus
SVQILVGY

SEQ ID NO: 25784 - protein, 9 aa, Artificial Sequence
  Peptide Derived from Human Papillomavirus
SVQILVGYM

SEQ ID NO: 25785 - protein, 11 aa, Artificial Sequence
  Peptide Derived from Human Papillomavirus
SVQILVGYMTM

SEQ ID NO: 25786 - protein, 8 aa, Artificial Sequence
  Peptide Derived from Human Papillomavirus
SVYYMTDA

SEQ ID NO: 25787 - protein, 11 aa, Artificial Sequence
  Peptide Derived from Human Papillomavirus
SVYYMTDAGTW

SEQ ID NO: 25788 - protein, 9 aa, Artificial Sequence
  Peptide Derived from Human Papillomavirus
TLNHQVVPA

SEQ ID NO: 25789 - protein, 10 aa, Artificial Sequence
  Peptide Derived from Human Papillomavirus
TLNHQVVPAY

SEQ ID NO: 25790 - protein, 9 aa, Artificial Sequence
  Peptide Derived from Human Papillomavirus
TLQDTCEEL

SEQ ID NO: 25791 - protein, 10 aa, Artificial Sequence
  Peptide Derived from Human Papillomavirus
TLQDTCEELW

SEQ ID NO: 25792 - protein, 9 aa, Artificial Sequence
  Peptide Derived from Human Papillomavirus
TLSERLSCV

SEQ ID NO: 25793 - protein, 10 aa, Artificial Sequence
  Peptide Derived from Human Papillomavirus
TPKETLSERL

SEQ ID NO: 25794 - protein, 9 aa, Artificial Sequence
  Peptide Derived from Human Papillomavirus
TPSPYSSTV

SEQ ID NO: 25795 - protein, 11 aa, Artificial Sequence
  Peptide Derived from Human Papillomavirus
TPSPYSSTVSV

SEQ ID NO: 25796 - protein, 11 aa, Artificial Sequence
  Peptide Derived from Human Papillomavirus
TPTGNNKRRKL

SEQ ID NO: 25797 - protein, 10 aa, Artificial Sequence
  Peptide Derived from Human Papillomavirus
TQRTKFLNTV

SEQ ID NO: 25798 - protein, 11 aa, Artificial Sequence
  Peptide Derived from Human Papillomavirus
TQRTKFLNTVA

SEQ ID NO: 25799 - protein, 8 aa, Artificial Sequence
  Peptide Derived from Human Papillomavirus
TVAIPDSV

SEQ ID NO: 25800 - protein, 10 aa, Artificial Sequence
  Peptide Derived from Human Papillomavirus
TVAIPDSVQI

SEQ ID NO: 25801 - protein, 11 aa, Artificial Sequence
  Peptide Derived from Human Papillomavirus
TVAIPDSVQIL

SEQ ID NO: 25802 - protein, 8 aa, Artificial Sequence
  Peptide Derived from Human Papillomavirus
TVSATQLV

SEQ ID NO: 25803 - protein, 11 aa, Artificial Sequence
  Peptide Derived from Human Papillomavirus
TVSATQLVKQL

SEQ ID NO: 25804 - protein, 10 aa, Artificial Sequence
  Peptide Derived from Human Papillomavirus
TVSVGTAKTY

SEQ ID NO: 25805 - protein, 8 aa, Artificial Sequence
  Peptide Derived from Human Papillomavirus
VIDCNDSM

SEQ ID NO: 25806 - protein, 11 aa, Artificial Sequence
  Peptide Derived from Human Papillomavirus
VPAYNISKSKA

SEQ ID NO: 25807 - protein, 9 aa, Artificial Sequence
  Peptide Derived from Human Papillomavirus
VQDKIIDHY

SEQ ID NO: 25808 - protein, 8 aa, Artificial Sequence
  Peptide Derived from Human Papillomavirus
VQILVGYM

SEQ ID NO: 25809 - protein, 10 aa, Artificial Sequence
  Peptide Derived from Human Papillomavirus
VQILVGYMTM

SEQ ID NO: 25810 - protein, 9 aa, Artificial Sequence
  Peptide Derived from Human Papillomavirus
WQLIRWENA

SEQ ID NO: 25811 - protein, 10 aa, Artificial Sequence
  Peptide Derived from Human Papillomavirus
WQLIRWENAI

SEQ ID NO: 25812 - protein, 11 aa, Artificial Sequence
  Peptide Derived from Human Papillomavirus
WQLIRWENAIF

SEQ ID NO: 25813 - protein, 11 aa, Artificial Sequence
  Peptide Derived from Human Papillomavirus
YIEFKSECEKY

SEQ ID NO: 25814 - protein, 8 aa, Artificial Sequence
  Peptide Derived from Human Papillomavirus
YMTDAGTW

SEQ ID NO: 25815 - protein, 8 aa, Artificial Sequence
  Peptide Derived from Human Papillomavirus
YVAWDSVY

SEQ ID NO: 25816 - protein, 9 aa, Artificial Sequence
  Peptide Derived from Human Papillomavirus
YVAWDSVYY

SEQ ID NO: 25817 - protein, 10 aa, Artificial Sequence
  Peptide Derived from Human Papillomavirus
YVAWDSVYYM

SEQ ID NO: 25818 - protein, 9 aa, Artificial Sequence
  Peptide Derived from Human Papillomavirus
YVKEGYNTF

SEQ ID NO: 25819 - protein, 10 aa, Artificial Sequence
  Peptide Derived from Human Papillomavirus
YVKEGYNTFY

SEQ ID NO: 25820 - protein, 11 aa, Artificial Sequence
  Peptide Derived from Human Papillomavirus
YVKEGYNTFYI

SEQ ID NO: 25821 - protein, 8 aa, Artificial Sequence
  Peptide Derived from Human Papillomavirus
CMCAYAWV

SEQ ID NO: 25822 - protein, 9 aa, Artificial Sequence
  Peptide Derived from Human Papillomavirus
CMCAYAWVL

SEQ ID NO: 25823 - protein, 10 aa, Artificial Sequence
  Peptide Derived from Human Papillomavirus
CMCAYAWVLV

SEQ ID NO: 25824 - protein, 11 aa, Artificial Sequence
  Peptide Derived from Human Papillomavirus
CMCAYAWVLVF

SEQ ID NO: 25825 - protein, 8 aa, Artificial Sequence
  Peptide Derived from Human Papillomavirus
CMYVCCHV

SEQ ID NO: 25826 - protein, 10 aa, Artificial Sequence
  Peptide Derived from Human Papillomavirus
CMYVCCHVPL

SEQ ID NO: 25827 - protein, 11 aa, Artificial Sequence
  Peptide Derived from Human Papillomavirus
CMYVCCHVPLL

SEQ ID NO: 25828 - protein, 10 aa, Artificial Sequence
  Peptide Derived from Human Papillomavirus
CVCMYVCCHV

SEQ ID NO: 25829 - protein, 9 aa, Artificial Sequence
  Peptide Derived from Human Papillomavirus
FLFCFCVCM

SEQ ID NO: 25830 - protein, 10 aa, Artificial Sequence
  Peptide Derived from Human Papillomavirus
FLFCFCVCMY

SEQ ID NO: 25831 - protein, 11 aa, Artificial Sequence
  Peptide Derived from Human Papillomavirus
FLFCFCVCMYV

SEQ ID NO: 25832 - protein, 8 aa, Artificial Sequence
  Peptide Derived from Human Papillomavirus
FLLPMLLL

SEQ ID NO: 25833 - protein, 10 aa, Artificial Sequence
  Peptide Derived from Human Papillomavirus
FLLPMLLLHI

SEQ ID NO: 25834 - protein, 11 aa, Artificial Sequence
  Peptide Derived from Human Papillomavirus
FVYIVVITSPA

SEQ ID NO: 25835 - protein, 8 aa, Artificial Sequence
  Peptide Derived from Human Papillomavirus
HIHAILSL

SEQ ID NO: 25836 - protein, 8 aa, Artificial Sequence
  Peptide Derived from Human Papillomavirus
HVPLLPSV

SEQ ID NO: 25837 - protein, 10 aa, Artificial Sequence
  Peptide Derived from Human Papillomavirus
HVPLLPSVCM

SEQ ID NO: 25838 - protein, 8 aa, Artificial Sequence
  Peptide Derived from Human Papillomavirus
IVVITSPA

SEQ ID NO: 25839 - protein, 10 aa, Artificial Sequence
  Peptide Derived from Human Papillomavirus
IVVITSPATA

SEQ ID NO: 25840 - protein, 11 aa, Artificial Sequence
  Peptide Derived from Human Papillomavirus
IVVITSPATAF

SEQ ID NO: 25841 - protein, 9 aa, Artificial Sequence
  Peptide Derived from Human Papillomavirus
LIFLFCFCV

SEQ ID NO: 25842 - protein, 11 aa, Artificial Sequence
  Peptide Derived from Human Papillomavirus
LIFLFCFCVCM

SEQ ID NO: 25843 - protein, 8 aa, Artificial Sequence
  Peptide Derived from Human Papillomavirus
LLHIHAIL

SEQ ID NO: 25844 - protein, 10 aa, Artificial Sequence
  Peptide Derived from Human Papillomavirus
LLHIHAILSL

SEQ ID NO: 25845 - protein, 8 aa, Artificial Sequence
  Peptide Derived from Human Papillomavirus
LLLHIHAI

SEQ ID NO: 25846 - protein, 9 aa, Artificial Sequence
  Peptide Derived from Human Papillomavirus
LLLHIHAIL

SEQ ID NO: 25847 - protein, 11 aa, Artificial Sequence
  Peptide Derived from Human Papillomavirus
LLLHIHAILSL

SEQ ID NO: 25848 - protein, 9 aa, Artificial Sequence
  Peptide Derived from Human Papillomavirus
LLPMLLLHI

SEQ ID NO: 25849 - protein, 11 aa, Artificial Sequence
  Peptide Derived from Human Papillomavirus
LLPMLLLHIHA

SEQ ID NO: 25850 - protein, 9 aa, Artificial Sequence
  Peptide Derived from Human Papillomavirus
LLPSVCMCA

SEQ ID NO: 25851 - protein, 10 aa, Artificial Sequence
  Peptide Derived from Human Papillomavirus
LLPSVCMCAY

SEQ ID NO: 25852 - protein, 11 aa, Artificial Sequence
  Peptide Derived from Human Papillomavirus
LLPSVCMCAYA

SEQ ID NO: 25853 - protein, 8 aa, Artificial Sequence
  Peptide Derived from Human Papillomavirus
LPMLLLHI

SEQ ID NO: 25854 - protein, 10 aa, Artificial Sequence
  Peptide Derived from Human Papillomavirus
LPMLLLHIHA

SEQ ID NO: 25855 - protein, 11 aa, Artificial Sequence
  Peptide Derived from Human Papillomavirus
LPMLLLHIHAI

SEQ ID NO: 25856 - protein, 8 aa, Artificial Sequence
  Peptide Derived from Human Papillomavirus
LPSVCMCA

SEQ ID NO: 25857 - protein, 9 aa, Artificial Sequence
  Peptide Derived from Human Papillomavirus
LPSVCMCAY

SEQ ID NO: 25858 - protein, 10 aa, Artificial Sequence
  Peptide Derived from Human Papillomavirus
LPSVCMCAYA

SEQ ID NO: 25859 - protein, 11 aa, Artificial Sequence
  Peptide Derived from Human Papillomavirus
LPSVCMCAYAW

SEQ ID NO: 25860 - protein, 8 aa, Artificial Sequence
  Peptide Derived from Human Papillomavirus
LVFVYIVV

SEQ ID NO: 25861 - protein, 9 aa, Artificial Sequence
  Peptide Derived from Human Papillomavirus
LVFVYIVVI

SEQ ID NO: 25862 - protein, 8 aa, Artificial Sequence
  Peptide Derived from Human Papillomavirus
MLLLHIHA

SEQ ID NO: 25863 - protein, 9 aa, Artificial Sequence
  Peptide Derived from Human Papillomavirus
MLLLHIHAI

SEQ ID NO: 25864 - protein, 10 aa, Artificial Sequence
  Peptide Derived from Human Papillomavirus
MLLLHIHAIL

SEQ ID NO: 25865 - protein, 8 aa, Artificial Sequence
  Peptide Derived from Human Papillomavirus
MLSLIFLF

SEQ ID NO: 25866 - protein, 10 aa, Artificial Sequence
  Peptide Derived from Human Papillomavirus
MLSLIFLFCF

SEQ ID NO: 25867 - protein, 8 aa, Artificial Sequence
  Peptide Derived from Human Papillomavirus
PLLPSVCM

SEQ ID NO: 25868 - protein, 10 aa, Artificial Sequence
  Peptide Derived from Human Papillomavirus
PLLPSVCMCA

SEQ ID NO: 25869 - protein, 11 aa, Artificial Sequence
  Peptide Derived from Human Papillomavirus
PLLPSVCMCAY

SEQ ID NO: 25870 - protein, 9 aa, Artificial Sequence
  Peptide Derived from Human Papillomavirus
PMLLLHIHA

SEQ ID NO: 25871 - protein, 10 aa, Artificial Sequence
  Peptide Derived from Human Papillomavirus
PMLLLHIHAI

SEQ ID NO: 25872 - protein, 11 aa, Artificial Sequence
  Peptide Derived from Human Papillomavirus
PMLLLHIHAIL

SEQ ID NO: 25873 - protein, 8 aa, Artificial Sequence
  Peptide Derived from Human Papillomavirus
SLIFLFCF

SEQ ID NO: 25874 - protein, 10 aa, Artificial Sequence
  Peptide Derived from Human Papillomavirus
SLIFLFCFCV

SEQ ID NO: 25875 - protein, 8 aa, Artificial Sequence
  Peptide Derived from Human Papillomavirus
SPATAFTV

SEQ ID NO: 25876 - protein, 9 aa, Artificial Sequence
  Peptide Derived from Human Papillomavirus
SPATAFTVY

SEQ ID NO: 25877 - protein, 10 aa, Artificial Sequence
  Peptide Derived from Human Papillomavirus
SPATAFTVYV

SEQ ID NO: 25878 - protein, 11 aa, Artificial Sequence
  Peptide Derived from Human Papillomavirus
SPATAFTVYVF

SEQ ID NO: 25879 - protein, 8 aa, Artificial Sequence
  Peptide Derived from Human Papillomavirus
SVCMCAYA

SEQ ID NO: 25880 - protein, 9 aa, Artificial Sequence
  Peptide Derived from Human Papillomavirus
SVCMCAYAW

SEQ ID NO: 25881 - protein, 10 aa, Artificial Sequence
  Peptide Derived from Human Papillomavirus
SVCMCAYAWV

SEQ ID NO: 25882 - protein, 11 aa, Artificial Sequence
  Peptide Derived from Human Papillomavirus
SVCMCAYAWVL

SEQ ID NO: 25883 - protein, 8 aa, Artificial Sequence
  Peptide Derived from Human Papillomavirus
TVYVFCFL

SEQ ID NO: 25884 - protein, 9 aa, Artificial Sequence
  Peptide Derived from Human Papillomavirus
TVYVFCFLL

SEQ ID NO: 25885 - protein, 11 aa, Artificial Sequence
  Peptide Derived from Human Papillomavirus
TVYVFCFLLPM

SEQ ID NO: 25886 - protein, 8 aa, Artificial Sequence
  Peptide Derived from Human Papillomavirus
VITSPATA

SEQ ID NO: 25887 - protein, 9 aa, Artificial Sequence
  Peptide Derived from Human Papillomavirus
VITSPATAF

SEQ ID NO: 25888 - protein, 11 aa, Artificial Sequence
  Peptide Derived from Human Papillomavirus
VITSPATAFTV

SEQ ID NO: 25889 - protein, 8 aa, Artificial Sequence
  Peptide Derived from Human Papillomavirus
VLVFVYIV

SEQ ID NO: 25890 - protein, 9 aa, Artificial Sequence
  Peptide Derived from Human Papillomavirus
VLVFVYIVV

SEQ ID NO: 25891 - protein, 10 aa, Artificial Sequence
  Peptide Derived from Human Papillomavirus
VLVFVYIVVI

SEQ ID NO: 25892 - protein, 9 aa, Artificial Sequence
  Peptide Derived from Human Papillomavirus
VPLLPSVCM

SEQ ID NO: 25893 - protein, 11 aa, Artificial Sequence
  Peptide Derived from Human Papillomavirus
VPLLPSVCMCA

SEQ ID NO: 25894 - protein, 9 aa, Artificial Sequence
  Peptide Derived from Human Papillomavirus
VVITSPATA

SEQ ID NO: 25895 - protein, 10 aa, Artificial Sequence
  Peptide Derived from Human Papillomavirus
VVITSPATAF

SEQ ID NO: 25896 - protein, 8 aa, Artificial Sequence
  Peptide Derived from Human Papillomavirus
WVLVFVYI

SEQ ID NO: 25897 - protein, 9 aa, Artificial Sequence
  Peptide Derived from Human Papillomavirus
WVLVFVYIV

SEQ ID NO: 25898 - protein, 10 aa, Artificial Sequence
  Peptide Derived from Human Papillomavirus
WVLVFVYIVV

SEQ ID NO: 25899 - protein, 11 aa, Artificial Sequence
  Peptide Derived from Human Papillomavirus
WVLVFVYIVVI

SEQ ID NO: 25900 - protein, 9 aa, Artificial Sequence
  Peptide Derived from Human Papillomavirus
YIVVITSPA

SEQ ID NO: 25901 - protein, 11 aa, Artificial Sequence
  Peptide Derived from Human Papillomavirus
YIVVITSPATA

SEQ ID NO: 25902 - protein, 8 aa, Artificial Sequence
  Peptide Derived from Human Papillomavirus
YVCCHVPL

SEQ ID NO: 25903 - protein, 9 aa, Artificial Sequence
  Peptide Derived from Human Papillomavirus
YVCCHVPLL

SEQ ID NO: 25904 - protein, 9 aa, Artificial Sequence
  Peptide Derived from Human Papillomavirus
YVFCFLLPM

SEQ ID NO: 25905 - protein, 10 aa, Artificial Sequence
  Peptide Derived from Human Papillomavirus
YVFCFLLPML

SEQ ID NO: 25906 - protein, 11 aa, Artificial Sequence
  Peptide Derived from Human Papillomavirus
YVFCFLLPMLL

SEQ ID NO: 25907 - protein, 8 aa, Artificial Sequence
  Peptide Derived from Human Papillomavirus
CIDFYSRI

SEQ ID NO: 25908 - protein, 11 aa, Artificial Sequence
  Peptide Derived from Human Papillomavirus
CIDFYSRIREL

SEQ ID NO: 25909 - protein, 8 aa, Artificial Sequence
  Peptide Derived from Human Papillomavirus
CLRCQKPL

SEQ ID NO: 25910 - protein, 11 aa, Artificial Sequence
  Peptide Derived from Human Papillomavirus
CLRCQKPLNPA

SEQ ID NO: 25911 - protein, 8 aa, Artificial Sequence
  Peptide Derived from Human Papillomavirus
CQKPLNPA

SEQ ID NO: 25912 - protein, 11 aa, Artificial Sequence
  Peptide Derived from Human Papillomavirus
CQKPLNPAEKL

SEQ ID NO: 25913 - protein, 8 aa, Artificial Sequence
  Peptide Derived from Human Papillomavirus
CVYCKTVL

SEQ ID NO: 25914 - protein, 10 aa, Artificial Sequence
  Peptide Derived from Human Papillomavirus
CVYCKTVLEL

SEQ ID NO: 25915 - protein, 8 aa, Artificial Sequence
  Peptide Derived from Human Papillomavirus
DIEITCVY

SEQ ID NO: 25916 - protein, 10 aa, Artificial Sequence
  Peptide Derived from Human Papillomavirus
DLCTELNTSL

SEQ ID NO: 25917 - protein, 10 aa, Artificial Sequence
  Peptide Derived from Human Papillomavirus
DLFVVYRDSI

SEQ ID NO: 25918 - protein, 9 aa, Artificial Sequence
  Peptide Derived from Human Papillomavirus
DPTRRPYKL

SEQ ID NO: 25919 - protein, 10 aa, Artificial Sequence
  Peptide Derived from Human Papillomavirus
EITCVYCKTV

SEQ ID NO: 25920 - protein, 11 aa, Artificial Sequence
  Peptide Derived from Human Papillomavirus
EITCVYCKTVL

SEQ ID NO: 25921 - protein, 9 aa, Artificial Sequence
  Peptide Derived from Human Papillomavirus
ELNTSLQDI

SEQ ID NO: 25922 - protein, 11 aa, Artificial Sequence
  Peptide Derived from Human Papillomavirus
ELNTSLQDIEI

SEQ ID NO: 25923 - protein, 9 aa, Artificial Sequence
  Peptide Derived from Human Papillomavirus
ELRHYSDSV

SEQ ID NO: 25924 - protein, 10 aa, Artificial Sequence
  Peptide Derived from Human Papillomavirus
ELRHYSDSVY

SEQ ID NO: 25925 - protein, 8 aa, Artificial Sequence
  Peptide Derived from Human Papillomavirus
ELTEVFEF

SEQ ID NO: 25926 - protein, 9 aa, Artificial Sequence
  Peptide Derived from Human Papillomavirus
ELTEVFEFA

SEQ ID NO: 25927 - protein, 10 aa, Artificial Sequence
  Peptide Derived from Human Papillomavirus
ELTEVFEFAF

SEQ ID NO: 25928 - protein, 10 aa, Artificial Sequence
  Peptide Derived from Human Papillomavirus
EVFEFAFKDL

SEQ ID NO: 25929 - protein, 11 aa, Artificial Sequence
  Peptide Derived from Human Papillomavirus
EVFEFAFKDLF

SEQ ID NO: 25930 - protein, 8 aa, Artificial Sequence
  Peptide Derived from Human Papillomavirus
FVVYRDSI

SEQ ID NO: 25931 - protein, 11 aa, Artificial Sequence
  Peptide Derived from Human Papillomavirus
FVVYRDSIPHA

SEQ ID NO: 25932 - protein, 10 aa, Artificial Sequence
  Peptide Derived from Human Papillomavirus
GLYNLLIRCL

SEQ ID NO: 25933 - protein, 10 aa, Artificial Sequence
  Peptide Derived from Human Papillomavirus
GQCHSCCNRA

SEQ ID NO: 25934 - protein, 8 aa, Artificial Sequence
  Peptide Derived from Human Papillomavirus
HLNEKRRF

SEQ ID NO: 25935 - protein, 11 aa, Artificial Sequence
  Peptide Derived from Human Papillomavirus
HLNEKRRFHNI

SEQ ID NO: 25936 - protein, 10 aa, Artificial Sequence
  Peptide Derived from Human Papillomavirus
IPHAACHKCI

SEQ ID NO: 25937 - protein, 9 aa, Artificial Sequence
  Peptide Derived from Human Papillomavirus
KLPDLCTEL

SEQ ID NO: 25938 - protein, 11 aa, Artificial Sequence
  Peptide Derived from Human Papillomavirus
KLRHLNEKRRF

SEQ ID NO: 25939 - protein, 8 aa, Artificial Sequence
  Peptide Derived from Human Papillomavirus
KLTNTGLY

SEQ ID NO: 25940 - protein, 10 aa, Artificial Sequence
  Peptide Derived from Human Papillomavirus
KLTNTGLYNL

SEQ ID NO: 25941 - protein, 11 aa, Artificial Sequence
  Peptide Derived from Human Papillomavirus
KLTNTGLYNLL

SEQ ID NO: 25942 - protein, 9 aa, Artificial Sequence
  Peptide Derived from Human Papillomavirus
KPLNPAEKL

SEQ ID NO: 25943 - protein, 11 aa, Artificial Sequence
  Peptide Derived from Human Papillomavirus
LIRCLRCQKPL

SEQ ID NO: 25944 - protein, 8 aa, Artificial Sequence
  Peptide Derived from Human Papillomavirus
LPDLCTEL

SEQ ID NO: 25945 - protein, 9 aa, Artificial Sequence
  Peptide Derived from Human Papillomavirus
LQDIEITCV

SEQ ID NO: 25946 - protein, 10 aa, Artificial Sequence
  Peptide Derived from Human Papillomavirus
LQDIEITCVY

SEQ ID NO: 25947 - protein, 9 aa, Artificial Sequence
  Peptide Derived from Human Papillomavirus
LQRRRETQV

SEQ ID NO: 25948 - protein, 9 aa, Artificial Sequence
  Peptide Derived from Human Papillomavirus
NPAEKLRHL

SEQ ID NO: 25949 - protein, 8 aa, Artificial Sequence
  Peptide Derived from Human Papillomavirus
PLNPAEKL

SEQ ID NO: 25950 - protein, 11 aa, Artificial Sequence
  Peptide Derived from Human Papillomavirus
PLNPAEKLRHL

SEQ ID NO: 25951 - protein, 8 aa, Artificial Sequence
  Peptide Derived from Human Papillomavirus
RIRELRHY

SEQ ID NO: 25952 - protein, 10 aa, Artificial Sequence
  Peptide Derived from Human Papillomavirus
RLQRRRETQV

SEQ ID NO: 25953 - protein, 8 aa, Artificial Sequence
  Peptide Derived from Human Papillomavirus
RPYKLPDL

SEQ ID NO: 25954 - protein, 11 aa, Artificial Sequence
  Peptide Derived from Human Papillomavirus
SIPHAACHKCI

SEQ ID NO: 25955 - protein, 10 aa, Artificial Sequence
  Peptide Derived from Human Papillomavirus
SLQDIEITCV

SEQ ID NO: 25956 - protein, 11 aa, Artificial Sequence
  Peptide Derived from Human Papillomavirus
SLQDIEITCVY

SEQ ID NO: 25957 - protein, 10 aa, Artificial Sequence
  Peptide Derived from Human Papillomavirus
SVYGDTLEKL

SEQ ID NO: 25958 - protein, 10 aa, Artificial Sequence
  Peptide Derived from Human Papillomavirus
TLEKLTNTGL

SEQ ID NO: 25959 - protein, 11 aa, Artificial Sequence
  Peptide Derived from Human Papillomavirus
TLEKLTNTGLY

SEQ ID NO: 25960 - protein, 8 aa, Artificial Sequence
  Peptide Derived from Human Papillomavirus
TVLELTEV

SEQ ID NO: 25961 - protein, 9 aa, Artificial Sequence
  Peptide Derived from Human Papillomavirus
TVLELTEVF

SEQ ID NO: 25962 - protein, 11 aa, Artificial Sequence
  Peptide Derived from Human Papillomavirus
TVLELTEVFEF

SEQ ID NO: 25963 - protein, 8 aa, Artificial Sequence
  Peptide Derived from Human Papillomavirus
VLELTEVF

SEQ ID NO: 25964 - protein, 10 aa, Artificial Sequence
  Peptide Derived from Human Papillomavirus
VLELTEVFEF

SEQ ID NO: 25965 - protein, 11 aa, Artificial Sequence
  Peptide Derived from Human Papillomavirus
VLELTEVFEFA

SEQ ID NO: 25966 - protein, 10 aa, Artificial Sequence
  Peptide Derived from Human Papillomavirus
VVYRDSIPHA

SEQ ID NO: 25967 - protein, 11 aa, Artificial Sequence
  Peptide Derived from Human Papillomavirus
VVYRDSIPHAA

SEQ ID NO: 25968 - protein, 8 aa, Artificial Sequence
  Peptide Derived from Human Papillomavirus
CMCCKCEA

SEQ ID NO: 25969 - protein, 10 aa, Artificial Sequence
  Peptide Derived from Human Papillomavirus
CMCCKCEARI

SEQ ID NO: 25970 - protein, 8 aa, Artificial Sequence
  Peptide Derived from Human Papillomavirus
DLLCHEQL

SEQ ID NO: 25971 - protein, 8 aa, Artificial Sequence
  Peptide Derived from Human Papillomavirus
DLRAFQQL

SEQ ID NO: 25972 - protein, 9 aa, Artificial Sequence
  Peptide Derived from Human Papillomavirus
DLRAFQQLF

SEQ ID NO: 25973 - protein, 10 aa, Artificial Sequence
  Peptide Derived from Human Papillomavirus
DLRAFQQLFL

SEQ ID NO: 25974 - protein, 10 aa, Artificial Sequence
  Peptide Derived from Human Papillomavirus
EIDGVNHQHL

SEQ ID NO: 25975 - protein, 8 aa, Artificial Sequence
  Peptide Derived from Human Papillomavirus
EPQNEIPV

SEQ ID NO: 25976 - protein, 10 aa, Artificial Sequence
  Peptide Derived from Human Papillomavirus
EPQNEIPVDL

SEQ ID NO: 25977 - protein, 11 aa, Artificial Sequence
  Peptide Derived from Human Papillomavirus
EPQNEIPVDLL

SEQ ID NO: 25978 - protein, 8 aa, Artificial Sequence
  Peptide Derived from Human Papillomavirus
EPQRHTML

SEQ ID NO: 25979 - protein, 10 aa, Artificial Sequence
  Peptide Derived from Human Papillomavirus
EPQRHTMLCM

SEQ ID NO: 25980 - protein, 8 aa, Artificial Sequence
  Peptide Derived from Human Papillomavirus
FLNTLSFV

SEQ ID NO: 25981 - protein, 11 aa, Artificial Sequence
  Peptide Derived from Human Papillomavirus
FLNTLSFVCPW

SEQ ID NO: 25982 - protein, 9 aa, Artificial Sequence
  Peptide Derived from Human Papillomavirus
FQQLFLNTL

SEQ ID NO: 25983 - protein, 11 aa, Artificial Sequence
  Peptide Derived from Human Papillomavirus
FQQLFLNTLSF

SEQ ID NO: 25984 - protein, 9 aa, Artificial Sequence
  Peptide Derived from Human Papillomavirus
GPKATLQDI

SEQ ID NO: 25985 - protein, 10 aa, Artificial Sequence
  Peptide Derived from Human Papillomavirus
GPKATLQDIV

SEQ ID NO: 25986 - protein, 11 aa, Artificial Sequence
  Peptide Derived from Human Papillomavirus
GPKATLQDIVL

SEQ ID NO: 25987 - protein, 9 aa, Artificial Sequence
  Peptide Derived from Human Papillomavirus
GVNHQHLPA

SEQ ID NO: 25988 - protein, 8 aa, Artificial Sequence
  Peptide Derived from Human Papillomavirus
HLEPQNEI

SEQ ID NO: 25989 - protein, 10 aa, Artificial Sequence
  Peptide Derived from Human Papillomavirus
HLEPQNEIPV

SEQ ID NO: 25990 - protein, 9 aa, Artificial Sequence
  Peptide Derived from Human Papillomavirus
HQHLPARRA

SEQ ID NO: 25991 - protein, 11 aa, Artificial Sequence
  Peptide Derived from Human Papillomavirus
IPVDLLCHEQL

SEQ ID NO: 25992 - protein, 11 aa, Artificial Sequence
  Peptide Derived from Human Papillomavirus
IVLHLEPQNEI

SEQ ID NO: 25993 - protein, 8 aa, Artificial Sequence
  Peptide Derived from Human Papillomavirus
KLVVESSA

SEQ ID NO: 25994 - protein, 11 aa, Artificial Sequence
  Peptide Derived from Human Papillomavirus
KLVVESSADDL

SEQ ID NO: 25995 - protein, 8 aa, Artificial Sequence
  Peptide Derived from Human Papillomavirus
LQDIVLHL

SEQ ID NO: 25996 - protein, 10 aa, Artificial Sequence
  Peptide Derived from Human Papillomavirus
LVVESSADDL

SEQ ID NO: 25997 - protein, 10 aa, Artificial Sequence
  Peptide Derived from Human Papillomavirus
MLCMCCKCEA

SEQ ID NO: 25998 - protein, 9 aa, Artificial Sequence
  Peptide Derived from Human Papillomavirus
PQNEIPVDL

SEQ ID NO: 25999 - protein, 10 aa, Artificial Sequence
  Peptide Derived from Human Papillomavirus
PQNEIPVDLL

SEQ ID NO: 26000 - protein, 9 aa, Artificial Sequence
  Peptide Derived from Human Papillomavirus
PQRHTMLCM

SEQ ID NO: 26001 - protein, 10 aa, Artificial Sequence
  Peptide Derived from Human Papillomavirus
PVDLLCHEQL

SEQ ID NO: 26002 - protein, 9 aa, Artificial Sequence
  Peptide Derived from Human Papillomavirus
QLFLNTLSF

SEQ ID NO: 26003 - protein, 10 aa, Artificial Sequence
  Peptide Derived from Human Papillomavirus
QLFLNTLSFV

SEQ ID NO: 26004 - protein, 8 aa, Artificial Sequence
  Peptide Derived from Human Papillomavirus
QQLFLNTL

SEQ ID NO: 26005 - protein, 10 aa, Artificial Sequence
  Peptide Derived from Human Papillomavirus
QQLFLNTLSF

SEQ ID NO: 26006 - protein, 11 aa, Artificial Sequence
  Peptide Derived from Human Papillomavirus
QQLFLNTLSFV

SEQ ID NO: 26007 - protein, 10 aa, Artificial Sequence
  Peptide Derived from Human Papillomavirus
RIKLVVESSA

SEQ ID NO: 26008 - protein, 9 aa, Artificial Sequence
  Peptide Derived from Human Papillomavirus
TLQDIVLHL

SEQ ID NO: 26009 - protein, 8 aa, Artificial Sequence
  Peptide Derived from Human Papillomavirus
TLSFVCPW

SEQ ID NO: 26010 - protein, 10 aa, Artificial Sequence
  Peptide Derived from Human Papillomavirus
TLSFVCPWCA

SEQ ID NO: 26011 - protein, 11 aa, Artificial Sequence
  Peptide Derived from Human Papillomavirus
TMLCMCCKCEA

SEQ ID NO: 26012 - protein, 10 aa, Artificial Sequence
  Peptide Derived from Human Papillomavirus
VLHLEPQNEI

SEQ ID NO: 26013 - protein, 9 aa, Artificial Sequence
  Peptide Derived from Human Papillomavirus
VVESSADDL

SEQ ID NO: 26014 - protein, 11 aa, Artificial Sequence
  Peptide Derived from Human Papillomavirus
VVESSADDLRA

SEQ ID NO: 26015 - protein, 11 aa, Artificial Sequence
  Peptide Derived from Human Papillomavirus
AIGEHWAKGTA

SEQ ID NO: 26016 - protein, 8 aa, Artificial Sequence
  Peptide Derived from Human Papillomavirus
AITCQKDA

SEQ ID NO: 26017 - protein, 9 aa, Artificial Sequence
  Peptide Derived from Human Papillomavirus
AITCQKDAA

SEQ ID NO: 26018 - protein, 11 aa, Artificial Sequence
  Peptide Derived from Human Papillomavirus
AITCQKDAAPA

SEQ ID NO: 26019 - protein, 10 aa, Artificial Sequence
  Peptide Derived from Human Papillomavirus
ALWRPSDNTV

SEQ ID NO: 26020 - protein, 11 aa, Artificial Sequence
  Peptide Derived from Human Papillomavirus
ALWRPSDNTVY

SEQ ID NO: 26021 - protein, 9 aa, Artificial Sequence
  Peptide Derived from Human Papillomavirus
APAENKDPY

SEQ ID NO: 26022 - protein, 8 aa, Artificial Sequence
  Peptide Derived from Human Papillomavirus
APAIGEHW

SEQ ID NO: 26023 - protein, 9 aa, Artificial Sequence
  Peptide Derived from Human Papillomavirus
APAIGEHWA

SEQ ID NO: 26024 - protein, 11 aa, Artificial Sequence
  Peptide Derived from Human Papillomavirus
APSATTSSKPA

SEQ ID NO: 26025 - protein, 8 aa, Artificial Sequence
  Peptide Derived from Human Papillomavirus
AQGHNNGV

SEQ ID NO: 26026 - protein, 10 aa, Artificial Sequence
  Peptide Derived from Human Papillomavirus
AQGHNNGVCW

SEQ ID NO: 26027 - protein, 8 aa, Artificial Sequence
  Peptide Derived from Human Papillomavirus
CILGCAPA

SEQ ID NO: 26028 - protein, 9 aa, Artificial Sequence
  Peptide Derived from Human Papillomavirus
CILGCAPAI

SEQ ID NO: 26029 - protein, 8 aa, Artificial Sequence
  Peptide Derived from Human Papillomavirus
CLRREQLF

SEQ ID NO: 26030 - protein, 9 aa, Artificial Sequence
  Peptide Derived from Human Papillomavirus
CLRREQLFA

SEQ ID NO: 26031 - protein, 8 aa, Artificial Sequence
  Peptide Derived from Human Papillomavirus
CLYTRVLI

SEQ ID NO: 26032 - protein, 9 aa, Artificial Sequence
  Peptide Derived from Human Papillomavirus
CLYTRVLIL

SEQ ID NO: 26033 - protein, 11 aa, Artificial Sequence
  Peptide Derived from Human Papillomavirus
CLYTRVLILHY

SEQ ID NO: 26034 - protein, 10 aa, Artificial Sequence
  Peptide Derived from Human Papillomavirus
CPPLELKNTV

SEQ ID NO: 26035 - protein, 11 aa, Artificial Sequence
  Peptide Derived from Human Papillomavirus
CPPLELKNTVL

SEQ ID NO: 26036 - protein, 8 aa, Artificial Sequence
  Peptide Derived from Human Papillomavirus
CQKDAAPA

SEQ ID NO: 26037 - protein, 10 aa, Artificial Sequence
  Peptide Derived from Human Papillomavirus
CQSICKYPDY

SEQ ID NO: 26038 - protein, 11 aa, Artificial Sequence
  Peptide Derived from Human Papillomavirus
CQSICKYPDYL

SEQ ID NO: 26039 - protein, 11 aa, Artificial Sequence
  Peptide Derived from Human Papillomavirus
CVYSPSPSGSI

SEQ ID NO: 26040 - protein, 9 aa, Artificial Sequence
  Peptide Derived from Human Papillomavirus
DICQSICKY

SEQ ID NO: 26041 - protein, 8 aa, Artificial Sequence
  Peptide Derived from Human Papillomavirus
DIPKVSAY

SEQ ID NO: 26042 - protein, 10 aa, Artificial Sequence
  Peptide Derived from Human Papillomavirus
DIPKVSAYQY

SEQ ID NO: 26043 - protein, 11 aa, Artificial Sequence
  Peptide Derived from Human Papillomavirus
DLDQYPLGRKF

SEQ ID NO: 26044 - protein, 8 aa, Artificial Sequence
  Peptide Derived from Human Papillomavirus
DLKEKFSL

SEQ ID NO: 26045 - protein, 10 aa, Artificial Sequence
  Peptide Derived from Human Papillomavirus
DLKEKFSLDL

SEQ ID NO: 26046 - protein, 8 aa, Artificial Sequence
  Peptide Derived from Human Papillomavirus
DLQFIFQL

SEQ ID NO: 26047 - protein, 11 aa, Artificial Sequence
  Peptide Derived from Human Papillomavirus
DLQFIFQLCTI

SEQ ID NO: 26048 - protein, 9 aa, Artificial Sequence
  Peptide Derived from Human Papillomavirus
DMVDTGYGA

SEQ ID NO: 26049 - protein, 10 aa, Artificial Sequence
  Peptide Derived from Human Papillomavirus
DMVDTGYGAM

SEQ ID NO: 26050 - protein, 8 aa, Artificial Sequence
  Peptide Derived from Human Papillomavirus
DPYDKLKF

SEQ ID NO: 26051 - protein, 9 aa, Artificial Sequence
  Peptide Derived from Human Papillomavirus
DPYDKLKFW

SEQ ID NO: 26052 - protein, 11 aa, Artificial Sequence
  Peptide Derived from Human Papillomavirus
DPYDKLKFWNV

SEQ ID NO: 26053 - protein, 8 aa, Artificial Sequence
  Peptide Derived from Human Papillomavirus
DPYGDSMF

SEQ ID NO: 26054 - protein, 9 aa, Artificial Sequence
  Peptide Derived from Human Papillomavirus
DPYGDSMFF

SEQ ID NO: 26055 - protein, 11 aa, Artificial Sequence
  Peptide Derived from Human Papillomavirus
DPYGDSMFFCL

SEQ ID NO: 26056 - protein, 9 aa, Artificial Sequence
  Peptide Derived from Human Papillomavirus
DQYPLGRKF

SEQ ID NO: 26057 - protein, 10 aa, Artificial Sequence
  Peptide Derived from Human Papillomavirus
DQYPLGRKFL

SEQ ID NO: 26058 - protein, 11 aa, Artificial Sequence
  Peptide Derived from Human Papillomavirus
DQYPLGRKFLV

SEQ ID NO: 26059 - protein, 9 aa, Artificial Sequence
  Peptide Derived from Human Papillomavirus
DVMSYIHSM

SEQ ID NO: 26060 - protein, 8 aa, Artificial Sequence
  Peptide Derived from Human Papillomavirus
DVRDNVSV

SEQ ID NO: 26061 - protein, 10 aa, Artificial Sequence
  Peptide Derived from Human Papillomavirus
DVRDNVSVDY

SEQ ID NO: 26062 - protein, 8 aa, Artificial Sequence
  Peptide Derived from Human Papillomavirus
EIGRGQPL

SEQ ID NO: 26063 - protein, 10 aa, Artificial Sequence
  Peptide Derived from Human Papillomavirus
EIGRGQPLGV

SEQ ID NO: 26064 - protein, 8 aa, Artificial Sequence
  Peptide Derived from Human Papillomavirus
EQLFARHF

SEQ ID NO: 26065 - protein, 9 aa, Artificial Sequence
  Peptide Derived from Human Papillomavirus
EQLFARHFW

SEQ ID NO: 26066 - protein, 10 aa, Artificial Sequence
  Peptide Derived from Human Papillomavirus
EVPLDICQSI

SEQ ID NO: 26067 - protein, 8 aa, Artificial Sequence
  Peptide Derived from Human Papillomavirus
FIFQLCTI

SEQ ID NO: 26068 - protein, 10 aa, Artificial Sequence
  Peptide Derived from Human Papillomavirus
FIFQLCTITL

SEQ ID NO: 26069 - protein, 8 aa, Artificial Sequence
  Peptide Derived from Human Papillomavirus
FLRNVNVF

SEQ ID NO: 26070 - protein, 10 aa, Artificial Sequence
  Peptide Derived from Human Papillomavirus
FLRNVNVFPI

SEQ ID NO: 26071 - protein, 11 aa, Artificial Sequence
  Peptide Derived from Human Papillomavirus
FLRNVNVFPIF

SEQ ID NO: 26072 - protein, 8 aa, Artificial Sequence
  Peptide Derived from Human Papillomavirus
FPIFLQMA

SEQ ID NO: 26073 - protein, 9 aa, Artificial Sequence
  Peptide Derived from Human Papillomavirus
FPIFLQMAL

SEQ ID NO: 26074 - protein, 10 aa, Artificial Sequence
  Peptide Derived from Human Papillomavirus
FPIFLQMALW

SEQ ID NO: 26075 - protein, 8 aa, Artificial Sequence
  Peptide Derived from Human Papillomavirus
FQLCTITL

SEQ ID NO: 26076 - protein, 10 aa, Artificial Sequence
  Peptide Derived from Human Papillomavirus
FQLCTITLTA

SEQ ID NO: 26077 - protein, 8 aa, Artificial Sequence
  Peptide Derived from Human Papillomavirus
GLPDTSIY

SEQ ID NO: 26078 - protein, 8 aa, Artificial Sequence
  Peptide Derived from Human Papillomavirus
GLRRKPTI

SEQ ID NO: 26079 - protein, 8 aa, Artificial Sequence
  Peptide Derived from Human Papillomavirus
GLSGHPFY

SEQ ID NO: 26080 - protein, 11 aa, Artificial Sequence
  Peptide Derived from Human Papillomavirus
GLSGHPFYNKL

SEQ ID NO: 26081 - protein, 10 aa, Artificial Sequence
  Peptide Derived from Human Papillomavirus
GMPASPGSCV

SEQ ID NO: 26082 - protein, 11 aa, Artificial Sequence
  Peptide Derived from Human Papillomavirus
GMPASPGSCVY

SEQ ID NO: 26083 - protein, 9 aa, Artificial Sequence
  Peptide Derived from Human Papillomavirus
GPLYHPRPL

SEQ ID NO: 26084 - protein, 11 aa, Artificial Sequence
  Peptide Derived from Human Papillomavirus
GPLYHPRPLPL

SEQ ID NO: 26085 - protein, 10 aa, Artificial Sequence
  Peptide Derived from Human Papillomavirus
GPRKRSAPSA

SEQ ID NO: 26086 - protein, 8 aa, Artificial Sequence
  Peptide Derived from Human Papillomavirus
GQPLGVGL

SEQ ID NO: 26087 - protein, 8 aa, Artificial Sequence
  Peptide Derived from Human Papillomavirus
GQYDATKF

SEQ ID NO: 26088 - protein, 11 aa, Artificial Sequence
  Peptide Derived from Human Papillomavirus
GQYDATKFKQY

SEQ ID NO: 26089 - protein, 8 aa, Artificial Sequence
  Peptide Derived from Human Papillomavirus
GVCWHNQL

SEQ ID NO: 26090 - protein, 9 aa, Artificial Sequence
  Peptide Derived from Human Papillomavirus
GVCWHNQLF

SEQ ID NO: 26091 - protein, 10 aa, Artificial Sequence
  Peptide Derived from Human Papillomavirus
GVCWHNQLFV

SEQ ID NO: 26092 - protein, 10 aa, Artificial Sequence
  Peptide Derived from Human Papillomavirus
GVEIGRGQPL

SEQ ID NO: 26093 - protein, 9 aa, Artificial Sequence
  Peptide Derived from Human Papillomavirus
GVGLSGHPF

SEQ ID NO: 26094 - protein, 10 aa, Artificial Sequence
  Peptide Derived from Human Papillomavirus
GVGLSGHPFY

SEQ ID NO: 26095 - protein, 10 aa, Artificial Sequence
  Peptide Derived from Human Papillomavirus
GVPPPPTTSL

SEQ ID NO: 26096 - protein, 11 aa, Artificial Sequence
  Peptide Derived from Human Papillomavirus
GVPPPPTTSLV

SEQ ID NO: 26097 - protein, 8 aa, Artificial Sequence
  Peptide Derived from Human Papillomavirus
HIIICGHY

SEQ ID NO: 26098 - protein, 9 aa, Artificial Sequence
  Peptide Derived from Human Papillomavirus
HIIICGHYI

SEQ ID NO: 26099 - protein, 10 aa, Artificial Sequence
  Peptide Derived from Human Papillomavirus
HIIICGHYII

SEQ ID NO: 26100 - protein, 11 aa, Artificial Sequence
  Peptide Derived from Human Papillomavirus
HIIICGHYIIL

SEQ ID NO: 26101 - protein, 9 aa, Artificial Sequence
  Peptide Derived from Human Papillomavirus
HLLPLYGPL

SEQ ID NO: 26102 - protein, 10 aa, Artificial Sequence
  Peptide Derived from Human Papillomavirus
HLLPLYGPLY

SEQ ID NO: 26103 - protein, 10 aa, Artificial Sequence
  Peptide Derived from Human Papillomavirus
HPRPLPLHSI

SEQ ID NO: 26104 - protein, 11 aa, Artificial Sequence
  Peptide Derived from Human Papillomavirus
HPRPLPLHSIL

SEQ ID NO: 26105 - protein, 9 aa, Artificial Sequence
  Peptide Derived from Human Papillomavirus
HVEEYDLQF

SEQ ID NO: 26106 - protein, 10 aa, Artificial Sequence
  Peptide Derived from Human Papillomavirus
HVEEYDLQFI

SEQ ID NO: 26107 - protein, 11 aa, Artificial Sequence
  Peptide Derived from Human Papillomavirus
HVEEYDLQFIF

SEQ ID NO: 26108 - protein, 8 aa, Artificial Sequence
  Peptide Derived from Human Papillomavirus
IICGHYII

SEQ ID NO: 26109 - protein, 9 aa, Artificial Sequence
  Peptide Derived from Human Papillomavirus
IICGHYIIL

SEQ ID NO: 26110 - protein, 10 aa, Artificial Sequence
  Peptide Derived from Human Papillomavirus
IICGHYIILF

SEQ ID NO: 26111 - protein, 11 aa, Artificial Sequence
  Peptide Derived from Human Papillomavirus
IICGHYIILFL

SEQ ID NO: 26112 - protein, 8 aa, Artificial Sequence
  Peptide Derived from Human Papillomavirus
IIICGHYI

SEQ ID NO: 26113 - protein, 9 aa, Artificial Sequence
  Peptide Derived from Human Papillomavirus
IIICGHYII

SEQ ID NO: 26114 - protein, 10 aa, Artificial Sequence
  Peptide Derived from Human Papillomavirus
IIICGHYIIL

SEQ ID NO: 26115 - protein, 11 aa, Artificial Sequence
  Peptide Derived from Human Papillomavirus
IIICGHYIILF

SEQ ID NO: 26116 - protein, 8 aa, Artificial Sequence
  Peptide Derived from Human Papillomavirus
IILFLRNV

SEQ ID NO: 26117 - protein, 10 aa, Artificial Sequence
  Peptide Derived from Human Papillomavirus
IILFLRNVNV

SEQ ID NO: 26118 - protein, 11 aa, Artificial Sequence
  Peptide Derived from Human Papillomavirus
IILFLRNVNVF

SEQ ID NO: 26119 - protein, 9 aa, Artificial Sequence
  Peptide Derived from Human Papillomavirus
ILEDWNFGV

SEQ ID NO: 26120 - protein, 9 aa, Artificial Sequence
  Peptide Derived from Human Papillomavirus
ILFLRNVNV

SEQ ID NO: 26121 - protein, 10 aa, Artificial Sequence
  Peptide Derived from Human Papillomavirus
ILFLRNVNVF

SEQ ID NO: 26122 - protein, 8 aa, Artificial Sequence
  Peptide Derived from Human Papillomavirus
ILGCAPAI

SEQ ID NO: 26123 - protein, 9 aa, Artificial Sequence
  Peptide Derived from Human Papillomavirus
ILHYHLLPL

SEQ ID NO: 26124 - protein, 10 aa, Artificial Sequence
  Peptide Derived from Human Papillomavirus
ILHYHLLPLY

SEQ ID NO: 26125 - protein, 8 aa, Artificial Sequence
  Peptide Derived from Human Papillomavirus
ILVYMVHI

SEQ ID NO: 26126 - protein, 9 aa, Artificial Sequence
  Peptide Derived from Human Papillomavirus
ILVYMVHII

SEQ ID NO: 26127 - protein, 10 aa, Artificial Sequence
  Peptide Derived from Human Papillomavirus
ILVYMVHIII

SEQ ID NO: 26128 - protein, 9 aa, Artificial Sequence
  Peptide Derived from Human Papillomavirus
IPKVSAYQY

SEQ ID NO: 26129 - protein, 11 aa, Artificial Sequence
  Peptide Derived from Human Papillomavirus
IPKVSAYQYRV

SEQ ID NO: 26130 - protein, 8 aa, Artificial Sequence
  Peptide Derived from Human Papillomavirus
IVTSDSQL

SEQ ID NO: 26131 - protein, 9 aa, Artificial Sequence
  Peptide Derived from Human Papillomavirus
IVTSDSQLF

SEQ ID NO: 26132 - protein, 10 aa, Artificial Sequence
  Peptide Derived from Human Papillomavirus
KLDDTESSHA

SEQ ID NO: 26133 - protein, 11 aa, Artificial Sequence
  Peptide Derived from Human Papillomavirus
KLDDTESSHAA

SEQ ID NO: 26134 - protein, 9 aa, Artificial Sequence
  Peptide Derived from Human Papillomavirus
KLKFWNVDL

SEQ ID NO: 26135 - protein, 8 aa, Artificial Sequence
  Peptide Derived from Human Papillomavirus
KPAKRVRV

SEQ ID NO: 26136 - protein, 10 aa, Artificial Sequence
  Peptide Derived from Human Papillomavirus
KPAKRVRVRA

SEQ ID NO: 26137 - protein, 11 aa, Artificial Sequence
  Peptide Derived from Human Papillomavirus
KPTIGPRKRSA

SEQ ID NO: 26138 - protein, 8 aa, Artificial Sequence
  Peptide Derived from Human Papillomavirus
KPYWLHKA

SEQ ID NO: 26139 - protein, 9 aa, Artificial Sequence
  Peptide Derived from Human Papillomavirus
KQDIPKVSA

SEQ ID NO: 26140 - protein, 10 aa, Artificial Sequence
  Peptide Derived from Human Papillomavirus
KQDIPKVSAY

SEQ ID NO: 26141 - protein, 8 aa, Artificial Sequence
  Peptide Derived from Human Papillomavirus
KQTQLCIL

SEQ ID NO: 26142 - protein, 11 aa, Artificial Sequence
  Peptide Derived from Human Papillomavirus
KQTQLCILGCA

SEQ ID NO: 26143 - protein, 10 aa, Artificial Sequence
  Peptide Derived from Human Papillomavirus
KQYSRHVEEY

SEQ ID NO: 26144 - protein, 9 aa, Artificial Sequence
  Peptide Derived from Human Papillomavirus
KVSAYQYRV

SEQ ID NO: 26145 - protein, 10 aa, Artificial Sequence
  Peptide Derived from Human Papillomavirus
KVSAYQYRVF

SEQ ID NO: 26146 - protein, 8 aa, Artificial Sequence
  Peptide Derived from Human Papillomavirus
LILHYHLL

SEQ ID NO: 26147 - protein, 10 aa, Artificial Sequence
  Peptide Derived from Human Papillomavirus
LILHYHLLPL

SEQ ID NO: 26148 - protein, 11 aa, Artificial Sequence
  Peptide Derived from Human Papillomavirus
LILHYHLLPLY

SEQ ID NO: 26149 - protein, 8 aa, Artificial Sequence
  Peptide Derived from Human Papillomavirus
LLPLYGPL

SEQ ID NO: 26150 - protein, 9 aa, Artificial Sequence
  Peptide Derived from Human Papillomavirus
LLPLYGPLY

SEQ ID NO: 26151 - protein, 8 aa, Artificial Sequence
  Peptide Derived from Human Papillomavirus
LLTVGNPY

SEQ ID NO: 26152 - protein, 9 aa, Artificial Sequence
  Peptide Derived from Human Papillomavirus
LLTVGNPYF

SEQ ID NO: 26153 - protein, 11 aa, Artificial Sequence
  Peptide Derived from Human Papillomavirus
LLTVGNPYFRV

SEQ ID NO: 26154 - protein, 9 aa, Artificial Sequence
  Peptide Derived from Human Papillomavirus
LPDPNKFGL

SEQ ID NO: 26155 - protein, 8 aa, Artificial Sequence
  Peptide Derived from Human Papillomavirus
LPLHSILV

SEQ ID NO: 26156 - protein, 9 aa, Artificial Sequence
  Peptide Derived from Human Papillomavirus
LPLHSILVY

SEQ ID NO: 26157 - protein, 10 aa, Artificial Sequence
  Peptide Derived from Human Papillomavirus
LPLHSILVYM

SEQ ID NO: 26158 - protein, 11 aa, Artificial Sequence
  Peptide Derived from Human Papillomavirus
LPLHSILVYMV

SEQ ID NO: 26159 - protein, 8 aa, Artificial Sequence
  Peptide Derived from Human Papillomavirus
LPLYGPLY

SEQ ID NO: 26160 - protein, 9 aa, Artificial Sequence
  Peptide Derived from Human Papillomavirus
LPPPSVARV

SEQ ID NO: 26161 - protein, 10 aa, Artificial Sequence
  Peptide Derived from Human Papillomavirus
LPPPSVARVV

SEQ ID NO: 26162 - protein, 8 aa, Artificial Sequence
  Peptide Derived from Human Papillomavirus
LQDTKCEV

SEQ ID NO: 26163 - protein, 10 aa, Artificial Sequence
  Peptide Derived from Human Papillomavirus
LQDTKCEVPL

SEQ ID NO: 26164 - protein, 10 aa, Artificial Sequence
  Peptide Derived from Human Papillomavirus
LQFIFQLCTI

SEQ ID NO: 26165 - protein, 8 aa, Artificial Sequence
  Peptide Derived from Human Papillomavirus
LQMSADPY

SEQ ID NO: 26166 - protein, 8 aa, Artificial Sequence
  Peptide Derived from Human Papillomavirus
LVDTYRFV

SEQ ID NO: 26167 - protein, 11 aa, Artificial Sequence
  Peptide Derived from Human Papillomavirus
LVDTYRFVQSV

SEQ ID NO: 26168 - protein, 8 aa, Artificial Sequence
  Peptide Derived from Human Papillomavirus
LVWACAGV

SEQ ID NO: 26169 - protein, 10 aa, Artificial Sequence
  Peptide Derived from Human Papillomavirus
LVWACAGVEI

SEQ ID NO: 26170 - protein, 8 aa, Artificial Sequence
  Peptide Derived from Human Papillomavirus
LVYMVHII

SEQ ID NO: 26171 - protein, 9 aa, Artificial Sequence
  Peptide Derived from Human Papillomavirus
LVYMVHIII

SEQ ID NO: 26172 - protein, 9 aa, Artificial Sequence
  Peptide Derived from Human Papillomavirus
MPASPGSCV

SEQ ID NO: 26173 - protein, 10 aa, Artificial Sequence
  Peptide Derived from Human Papillomavirus
MPASPGSCVY

SEQ ID NO: 26174 - protein, 8 aa, Artificial Sequence
  Peptide Derived from Human Papillomavirus
MVDTGYGA

SEQ ID NO: 26175 - protein, 9 aa, Artificial Sequence
  Peptide Derived from Human Papillomavirus
MVDTGYGAM

SEQ ID NO: 26176 - protein, 11 aa, Artificial Sequence
  Peptide Derived from Human Papillomavirus
MVDTGYGAMDF

SEQ ID NO: 26177 - protein, 10 aa, Artificial Sequence
  Peptide Derived from Human Papillomavirus
MVHIIICGHY

SEQ ID NO: 26178 - protein, 11 aa, Artificial Sequence
  Peptide Derived from Human Papillomavirus
MVHIIICGHYI

SEQ ID NO: 26179 - protein, 8 aa, Artificial Sequence
  Peptide Derived from Human Papillomavirus
NPETQRLV

SEQ ID NO: 26180 - protein, 9 aa, Artificial Sequence
  Peptide Derived from Human Papillomavirus
NPETQRLVW

SEQ ID NO: 26181 - protein, 10 aa, Artificial Sequence
  Peptide Derived from Human Papillomavirus
NPETQRLVWA

SEQ ID NO: 26182 - protein, 8 aa, Artificial Sequence
  Peptide Derived from Human Papillomavirus
NPYFRVPA

SEQ ID NO: 26183 - protein, 8 aa, Artificial Sequence
  Peptide Derived from Human Papillomavirus
NQLFVTVV

SEQ ID NO: 26184 - protein, 8 aa, Artificial Sequence
  Peptide Derived from Human Papillomavirus
NVDLKEKF

SEQ ID NO: 26185 - protein, 10 aa, Artificial Sequence
  Peptide Derived from Human Papillomavirus
NVDLKEKFSL

SEQ ID NO: 26186 - protein, 9 aa, Artificial Sequence
  Peptide Derived from Human Papillomavirus
NVFPIFLQM

SEQ ID NO: 26187 - protein, 10 aa, Artificial Sequence
  Peptide Derived from Human Papillomavirus
NVFPIFLQMA

SEQ ID NO: 26188 - protein, 11 aa, Artificial Sequence
  Peptide Derived from Human Papillomavirus
NVFPIFLQMAL

SEQ ID NO: 26189 - protein, 8 aa, Artificial Sequence
  Peptide Derived from Human Papillomavirus
NVNVFPIF

SEQ ID NO: 26190 - protein, 9 aa, Artificial Sequence
  Peptide Derived from Human Papillomavirus
NVNVFPIFL

SEQ ID NO: 26191 - protein, 11 aa, Artificial Sequence
  Peptide Derived from Human Papillomavirus
NVNVFPIFLQM

SEQ ID NO: 26192 - protein, 10 aa, Artificial Sequence
  Peptide Derived from Human Papillomavirus
NVSEDVRDNV

SEQ ID NO: 26193 - protein, 11 aa, Artificial Sequence
  Peptide Derived from Human Papillomavirus
NVSVDYKQTQL

SEQ ID NO: 26194 - protein, 8 aa, Artificial Sequence
  Peptide Derived from Human Papillomavirus
PIFLQMAL

SEQ ID NO: 26195 - protein, 9 aa, Artificial Sequence
  Peptide Derived from Human Papillomavirus
PIFLQMALW

SEQ ID NO: 26196 - protein, 8 aa, Artificial Sequence
  Peptide Derived from Human Papillomavirus
PLDICQSI

SEQ ID NO: 26197 - protein, 11 aa, Artificial Sequence
  Peptide Derived from Human Papillomavirus
PLDICQSICKY

SEQ ID NO: 26198 - protein, 8 aa, Artificial Sequence
  Peptide Derived from Human Papillomavirus
PLELKNTV

SEQ ID NO: 26199 - protein, 9 aa, Artificial Sequence
  Peptide Derived from Human Papillomavirus
PLELKNTVL

SEQ ID NO: 26200 - protein, 8 aa, Artificial Sequence
  Peptide Derived from Human Papillomavirus
PLGRKFLV

SEQ ID NO: 26201 - protein, 10 aa, Artificial Sequence
  Peptide Derived from Human Papillomavirus
PLGRKFLVQA

SEQ ID NO: 26202 - protein, 11 aa, Artificial Sequence
  Peptide Derived from Human Papillomavirus
PLGVGLSGHPF

SEQ ID NO: 26203 - protein, 8 aa, Artificial Sequence
  Peptide Derived from Human Papillomavirus
PLHSILVY

SEQ ID NO: 26204 - protein, 9 aa, Artificial Sequence
  Peptide Derived from Human Papillomavirus
PLHSILVYM

SEQ ID NO: 26205 - protein, 10 aa, Artificial Sequence
  Peptide Derived from Human Papillomavirus
PLHSILVYMV

SEQ ID NO: 26206 - protein, 8 aa, Artificial Sequence
  Peptide Derived from Human Papillomavirus
PLPLHSIL

SEQ ID NO: 26207 - protein, 9 aa, Artificial Sequence
  Peptide Derived from Human Papillomavirus
PLPLHSILV

SEQ ID NO: 26208 - protein, 10 aa, Artificial Sequence
  Peptide Derived from Human Papillomavirus
PLPLHSILVY

SEQ ID NO: 26209 - protein, 11 aa, Artificial Sequence
  Peptide Derived from Human Papillomavirus
PLPLHSILVYM

SEQ ID NO: 26210 - protein, 10 aa, Artificial Sequence
  Peptide Derived from Human Papillomavirus
PLSQGDCPPL

SEQ ID NO: 26211 - protein, 8 aa, Artificial Sequence
  Peptide Derived from Human Papillomavirus
PLYHPRPL

SEQ ID NO: 26212 - protein, 10 aa, Artificial Sequence
  Peptide Derived from Human Papillomavirus
PLYHPRPLPL

SEQ ID NO: 26213 - protein, 9 aa, Artificial Sequence
  Peptide Derived from Human Papillomavirus
PPLELKNTV

SEQ ID NO: 26214 - protein, 10 aa, Artificial Sequence
  Peptide Derived from Human Papillomavirus
PPLELKNTVL

SEQ ID NO: 26215 - protein, 8 aa, Artificial Sequence
  Peptide Derived from Human Papillomavirus
PPPPTTSL

SEQ ID NO: 26216 - protein, 9 aa, Artificial Sequence
  Peptide Derived from Human Papillomavirus
PPPPTTSLV

SEQ ID NO: 26217 - protein, 8 aa, Artificial Sequence
  Peptide Derived from Human Papillomavirus
PPPSVARV

SEQ ID NO: 26218 - protein, 9 aa, Artificial Sequence
  Peptide Derived from Human Papillomavirus
PPPSVARVV

SEQ ID NO: 26219 - protein, 8 aa, Artificial Sequence
  Peptide Derived from Human Papillomavirus
PPPTTSLV

SEQ ID NO: 26220 - protein, 11 aa, Artificial Sequence
  Peptide Derived from Human Papillomavirus
PPPTTSLVDTY

SEQ ID NO: 26221 - protein, 8 aa, Artificial Sequence
  Peptide Derived from Human Papillomavirus
PPSVARVV

SEQ ID NO: 26222 - protein, 10 aa, Artificial Sequence
  Peptide Derived from Human Papillomavirus
PPTTSLVDTY

SEQ ID NO: 26223 - protein, 11 aa, Artificial Sequence
  Peptide Derived from Human Papillomavirus
PQSLYIKGTGM

SEQ ID NO: 26224 - protein, 8 aa, Artificial Sequence
  Peptide Derived from Human Papillomavirus
PVPGQYDA

SEQ ID NO: 26225 - protein, 11 aa, Artificial Sequence
  Peptide Derived from Human Papillomavirus
PVPGQYDATKF

SEQ ID NO: 26226 - protein, 8 aa, Artificial Sequence
  Peptide Derived from Human Papillomavirus
QLCILGCA

SEQ ID NO: 26227 - protein, 10 aa, Artificial Sequence
  Peptide Derived from Human Papillomavirus
QLCILGCAPA

SEQ ID NO: 26228 - protein, 11 aa, Artificial Sequence
  Peptide Derived from Human Papillomavirus
QLCILGCAPAI

SEQ ID NO: 26229 - protein, 9 aa, Artificial Sequence
  Peptide Derived from Human Papillomavirus
QLCTITLTA

SEQ ID NO: 26230 - protein, 11 aa, Artificial Sequence
  Peptide Derived from Human Papillomavirus
QLCTITLTADV

SEQ ID NO: 26231 - protein, 8 aa, Artificial Sequence
  Peptide Derived from Human Papillomavirus
QLFARHFW

SEQ ID NO: 26232 - protein, 11 aa, Artificial Sequence
  Peptide Derived from Human Papillomavirus
QLFARHFWNRA

SEQ ID NO: 26233 - protein, 8 aa, Artificial Sequence
  Peptide Derived from Human Papillomavirus
QLFNKPYW

SEQ ID NO: 26234 - protein, 9 aa, Artificial Sequence
  Peptide Derived from Human Papillomavirus
QLFNKPYWL

SEQ ID NO: 26235 - protein, 8 aa, Artificial Sequence
  Peptide Derived from Human Papillomavirus
QLPDPNKF

SEQ ID NO: 26236 - protein, 10 aa, Artificial Sequence
  Peptide Derived from Human Papillomavirus
QLPDPNKFGL

SEQ ID NO: 26237 - protein, 11 aa, Artificial Sequence
  Peptide Derived from Human Papillomavirus
QMSADPYGDSM

SEQ ID NO: 26238 - protein, 9 aa, Artificial Sequence
  Peptide Derived from Human Papillomavirus
RLLTVGNPY

SEQ ID NO: 26239 - protein, 10 aa, Artificial Sequence
  Peptide Derived from Human Papillomavirus
RLLTVGNPYF

SEQ ID NO: 26240 - protein, 9 aa, Artificial Sequence
  Peptide Derived from Human Papillomavirus
RLVWACAGV

SEQ ID NO: 26241 - protein, 11 aa, Artificial Sequence
  Peptide Derived from Human Papillomavirus
RLVWACAGVEI

SEQ ID NO: 26242 - protein, 8 aa, Artificial Sequence
  Peptide Derived from Human Papillomavirus
RPLPLHSI

SEQ ID NO: 26243 - protein, 9 aa, Artificial Sequence
  Peptide Derived from Human Papillomavirus
RPLPLHSIL

SEQ ID NO: 26244 - protein, 10 aa, Artificial Sequence
  Peptide Derived from Human Papillomavirus
RPLPLHSILV

SEQ ID NO: 26245 - protein, 11 aa, Artificial Sequence
  Peptide Derived from Human Papillomavirus
RPLPLHSILVY

SEQ ID NO: 26246 - protein, 11 aa, Artificial Sequence
  Peptide Derived from Human Papillomavirus
RPLSQGDCPPL

SEQ ID NO: 26247 - protein, 8 aa, Artificial Sequence
  Peptide Derived from Human Papillomavirus
RPSDNTVY

SEQ ID NO: 26248 - protein, 9 aa, Artificial Sequence
  Peptide Derived from Human Papillomavirus
RPSDNTVYL

SEQ ID NO: 26249 - protein, 9 aa, Artificial Sequence
  Peptide Derived from Human Papillomavirus
RVLILHYHL

SEQ ID NO: 26250 - protein, 10 aa, Artificial Sequence
  Peptide Derived from Human Papillomavirus
RVLILHYHLL

SEQ ID NO: 26251 - protein, 10 aa, Artificial Sequence
  Peptide Derived from Human Papillomavirus
RVQLPDPNKF

SEQ ID NO: 26252 - protein, 8 aa, Artificial Sequence
  Peptide Derived from Human Papillomavirus
RVVNTDDY

SEQ ID NO: 26253 - protein, 9 aa, Artificial Sequence
  Peptide Derived from Human Papillomavirus
RVVNTDDYV

SEQ ID NO: 26254 - protein, 8 aa, Artificial Sequence
  Peptide Derived from Human Papillomavirus
SICKYPDY

SEQ ID NO: 26255 - protein, 9 aa, Artificial Sequence
  Peptide Derived from Human Papillomavirus
SICKYPDYL

SEQ ID NO: 26256 - protein, 11 aa, Artificial Sequence
  Peptide Derived from Human Papillomavirus
SICKYPDYLQM

SEQ ID NO: 26257 - protein, 11 aa, Artificial Sequence
  Peptide Derived from Human Papillomavirus
SIFYHAGSSRL

SEQ ID NO: 26258 - protein, 8 aa, Artificial Sequence
  Peptide Derived from Human Papillomavirus
SILEDWNF

SEQ ID NO: 26259 - protein, 10 aa, Artificial Sequence
  Peptide Derived from Human Papillomavirus
SILEDWNFGV

SEQ ID NO: 26260 - protein, 9 aa, Artificial Sequence
  Peptide Derived from Human Papillomavirus
SILVYMVHI

SEQ ID NO: 26261 - protein, 10 aa, Artificial Sequence
  Peptide Derived from Human Papillomavirus
SILVYMVHII

SEQ ID NO: 26262 - protein, 11 aa, Artificial Sequence
  Peptide Derived from Human Papillomavirus
SILVYMVHIII

SEQ ID NO: 26263 - protein, 9 aa, Artificial Sequence
  Peptide Derived from Human Papillomavirus
SIVTSDSQL

SEQ ID NO: 26264 - protein, 10 aa, Artificial Sequence
  Peptide Derived from Human Papillomavirus
SIVTSDSQLF

SEQ ID NO: 26265 - protein, 10 aa, Artificial Sequence
  Peptide Derived from Human Papillomavirus
SIYNPETQRL

SEQ ID NO: 26266 - protein, 11 aa, Artificial Sequence
  Peptide Derived from Human Papillomavirus
SIYNPETQRLV

SEQ ID NO: 26267 - protein, 9 aa, Artificial Sequence
  Peptide Derived from Human Papillomavirus
SLDLDQYPL

SEQ ID NO: 26268 - protein, 8 aa, Artificial Sequence
  Peptide Derived from Human Papillomavirus
SLVDTYRF

SEQ ID NO: 26269 - protein, 9 aa, Artificial Sequence
  Peptide Derived from Human Papillomavirus
SLVDTYRFV

SEQ ID NO: 26270 - protein, 9 aa, Artificial Sequence
  Peptide Derived from Human Papillomavirus
SLYIKGTGM

SEQ ID NO: 26271 - protein, 11 aa, Artificial Sequence
  Peptide Derived from Human Papillomavirus
SLYIKGTGMPA

SEQ ID NO: 26272 - protein, 11 aa, Artificial Sequence
  Peptide Derived from Human Papillomavirus
SMFFCLRREQL

SEQ ID NO: 26273 - protein, 10 aa, Artificial Sequence
  Peptide Derived from Human Papillomavirus
SMNSSILEDW

SEQ ID NO: 26274 - protein, 8 aa, Artificial Sequence
  Peptide Derived from Human Papillomavirus
SPSPSGSI

SEQ ID NO: 26275 - protein, 9 aa, Artificial Sequence
  Peptide Derived from Human Papillomavirus
SPSPSGSIV

SEQ ID NO: 26276 - protein, 9 aa, Artificial Sequence
  Peptide Derived from Human Papillomavirus
SPVPGQYDA

SEQ ID NO: 26277 - protein, 8 aa, Artificial Sequence
  Peptide Derived from Human Papillomavirus
SQGDCPPL

SEQ ID NO: 26278 - protein, 10 aa, Artificial Sequence
  Peptide Derived from Human Papillomavirus
SQGDCPPLEL

SEQ ID NO: 26279 - protein, 8 aa, Artificial Sequence
  Peptide Derived from Human Papillomavirus
SQLFNKPY

SEQ ID NO: 26280 - protein, 9 aa, Artificial Sequence
  Peptide Derived from Human Papillomavirus
SQLFNKPYW

SEQ ID NO: 26281 - protein, 10 aa, Artificial Sequence
  Peptide Derived from Human Papillomavirus
SQLFNKPYWL

SEQ ID NO: 26282 - protein, 10 aa, Artificial Sequence
  Peptide Derived from Human Papillomavirus
SVAITCQKDA

SEQ ID NO: 26283 - protein, 11 aa, Artificial Sequence
  Peptide Derived from Human Papillomavirus
SVAITCQKDAA

SEQ ID NO: 26284 - protein, 11 aa, Artificial Sequence
  Peptide Derived from Human Papillomavirus
SVARVVNTDDY

SEQ ID NO: 26285 - protein, 9 aa, Artificial Sequence
  Peptide Derived from Human Papillomavirus
SVDYKQTQL

SEQ ID NO: 26286 - protein, 11 aa, Artificial Sequence
  Peptide Derived from Human Papillomavirus
SVDYKQTQLCI

SEQ ID NO: 26287 - protein, 10 aa, Artificial Sequence
  Peptide Derived from Human Papillomavirus
TICASTQSPV

SEQ ID NO: 26288 - protein, 9 aa, Artificial Sequence
  Peptide Derived from Human Papillomavirus
TIGPRKRSA

SEQ ID NO: 26289 - protein, 8 aa, Artificial Sequence
  Peptide Derived from Human Papillomavirus
TITLTADV

SEQ ID NO: 26290 - protein, 9 aa, Artificial Sequence
  Peptide Derived from Human Papillomavirus
TITLTADVM

SEQ ID NO: 26291 - protein, 11 aa, Artificial Sequence
  Peptide Derived from Human Papillomavirus
TITLTADVMSY

SEQ ID NO: 26292 - protein, 9 aa, Artificial Sequence
  Peptide Derived from Human Papillomavirus
TLQDTKCEV

SEQ ID NO: 26293 - protein, 11 aa, Artificial Sequence
  Peptide Derived from Human Papillomavirus
TLQDTKCEVPL

SEQ ID NO: 26294 - protein, 9 aa, Artificial Sequence
  Peptide Derived from Human Papillomavirus
TLTADVMSY

SEQ ID NO: 26295 - protein, 10 aa, Artificial Sequence
  Peptide Derived from Human Papillomavirus
TLTADVMSYI

SEQ ID NO: 26296 - protein, 10 aa, Artificial Sequence
  Peptide Derived from Human Papillomavirus
TMGDTVPQSL

SEQ ID NO: 26297 - protein, 11 aa, Artificial Sequence
  Peptide Derived from Human Papillomavirus
TMGDTVPQSLY

SEQ ID NO: 26298 - protein, 8 aa, Artificial Sequence
  Peptide Derived from Human Papillomavirus
TPSTNLTI

SEQ ID NO: 26299 - protein, 10 aa, Artificial Sequence
  Peptide Derived from Human Papillomavirus
TPSTNLTICA

SEQ ID NO: 26300 - protein, 9 aa, Artificial Sequence
  Peptide Derived from Human Papillomavirus
TPTSIFYHA

SEQ ID NO: 26301 - protein, 9 aa, Artificial Sequence
  Peptide Derived from Human Papillomavirus
TQLCILGCA

SEQ ID NO: 26302 - protein, 11 aa, Artificial Sequence
  Peptide Derived from Human Papillomavirus
TQLCILGCAPA

SEQ ID NO: 26303 - protein, 9 aa, Artificial Sequence
  Peptide Derived from Human Papillomavirus
TQRLVWACA

SEQ ID NO: 26304 - protein, 11 aa, Artificial Sequence
  Peptide Derived from Human Papillomavirus
TQRLVWACAGV

SEQ ID NO: 26305 - protein, 9 aa, Artificial Sequence
  Peptide Derived from Human Papillomavirus
TQSPVPGQY

SEQ ID NO: 26306 - protein, 11 aa, Artificial Sequence
  Peptide Derived from Human Papillomavirus
TQSPVPGQYDA

SEQ ID NO: 26307 - protein, 9 aa, Artificial Sequence
  Peptide Derived from Human Papillomavirus
TVGNPYFRV

SEQ ID NO: 26308 - protein, 11 aa, Artificial Sequence
  Peptide Derived from Human Papillomavirus
TVGNPYFRVPA

SEQ ID NO: 26309 - protein, 8 aa, Artificial Sequence
  Peptide Derived from Human Papillomavirus
TVLEDGDM

SEQ ID NO: 26310 - protein, 9 aa, Artificial Sequence
  Peptide Derived from Human Papillomavirus
TVLEDGDMV

SEQ ID NO: 26311 - protein, 8 aa, Artificial Sequence
  Peptide Derived from Human Papillomavirus
TVPQSLYI

SEQ ID NO: 26312 - protein, 11 aa, Artificial Sequence
  Peptide Derived from Human Papillomavirus
TVVDTTPSTNL

SEQ ID NO: 26313 - protein, 9 aa, Artificial Sequence
  Peptide Derived from Human Papillomavirus
TVYLPPPSV

SEQ ID NO: 26314 - protein, 10 aa, Artificial Sequence
  Peptide Derived from Human Papillomavirus
TVYLPPPSVA

SEQ ID NO: 26315 - protein, 8 aa, Artificial Sequence
  Peptide Derived from Human Papillomavirus
VLEDGDMV

SEQ ID NO: 26316 - protein, 8 aa, Artificial Sequence
  Peptide Derived from Human Papillomavirus
VLILHYHL

SEQ ID NO: 26317 - protein, 9 aa, Artificial Sequence
  Peptide Derived from Human Papillomavirus
VLILHYHLL

SEQ ID NO: 26318 - protein, 11 aa, Artificial Sequence
  Peptide Derived from Human Papillomavirus
VLILHYHLLPL

SEQ ID NO: 26319 - protein, 8 aa, Artificial Sequence
  Peptide Derived from Human Papillomavirus
VMSYIHSM

SEQ ID NO: 26320 - protein, 11 aa, Artificial Sequence
  Peptide Derived from Human Papillomavirus
VPAGGGNKQDI

SEQ ID NO: 26321 - protein, 10 aa, Artificial Sequence
  Peptide Derived from Human Papillomavirus
VPGQYDATKF

SEQ ID NO: 26322 - protein, 9 aa, Artificial Sequence
  Peptide Derived from Human Papillomavirus
VPLDICQSI

SEQ ID NO: 26323 - protein, 9 aa, Artificial Sequence
  Peptide Derived from Human Papillomavirus
VPPPPTTSL

SEQ ID NO: 26324 - protein, 10 aa, Artificial Sequence
  Peptide Derived from Human Papillomavirus
VPPPPTTSLV

SEQ ID NO: 26325 - protein, 11 aa, Artificial Sequence
  Peptide Derived from Human Papillomavirus
VQAGLRRKPTI

SEQ ID NO: 26326 - protein, 9 aa, Artificial Sequence
  Peptide Derived from Human Papillomavirus
VQLPDPNKF

SEQ ID NO: 26327 - protein, 11 aa, Artificial Sequence
  Peptide Derived from Human Papillomavirus
VQLPDPNKFGL

SEQ ID NO: 26328 - protein, 10 aa, Artificial Sequence
  Peptide Derived from Human Papillomavirus
VVDTTPSTNL

SEQ ID NO: 26329 - protein, 8 aa, Artificial Sequence
  Peptide Derived from Human Papillomavirus
VVNTDDYV

SEQ ID NO: 26330 - protein, 9 aa, Artificial Sequence
  Peptide Derived from Human Papillomavirus
YIHSMNSSI

SEQ ID NO: 26331 - protein, 10 aa, Artificial Sequence
  Peptide Derived from Human Papillomavirus
YIHSMNSSIL

SEQ ID NO: 26332 - protein, 9 aa, Artificial Sequence
  Peptide Derived from Human Papillomavirus
YIILFLRNV

SEQ ID NO: 26333 - protein, 11 aa, Artificial Sequence
  Peptide Derived from Human Papillomavirus
YIILFLRNVNV

SEQ ID NO: 26334 - protein, 9 aa, Artificial Sequence
  Peptide Derived from Human Papillomavirus
YIKGTGMPA

SEQ ID NO: 26335 - protein, 8 aa, Artificial Sequence
  Peptide Derived from Human Papillomavirus
YLPPPSVA

SEQ ID NO: 26336 - protein, 10 aa, Artificial Sequence
  Peptide Derived from Human Papillomavirus
YLPPPSVARV

SEQ ID NO: 26337 - protein, 11 aa, Artificial Sequence
  Peptide Derived from Human Papillomavirus
YLPPPSVARVV

SEQ ID NO: 26338 - protein, 9 aa, Artificial Sequence
  Peptide Derived from Human Papillomavirus
YLQMSADPY

SEQ ID NO: 26339 - protein, 11 aa, Artificial Sequence
  Peptide Derived from Human Papillomavirus
YMVHIIICGHY

SEQ ID NO: 26340 - protein, 9 aa, Artificial Sequence
  Peptide Derived from Human Papillomavirus
YPDYLQMSA

SEQ ID NO: 26341 - protein, 8 aa, Artificial Sequence
  Peptide Derived from Human Papillomavirus
YPLGRKFL

SEQ ID NO: 26342 - protein, 9 aa, Artificial Sequence
  Peptide Derived from Human Papillomavirus
YPLGRKFLV

SEQ ID NO: 26343 - protein, 11 aa, Artificial Sequence
  Peptide Derived from Human Papillomavirus
YPLGRKFLVQA

SEQ ID NO: 26344 - protein, 8 aa, Artificial Sequence
  Peptide Derived from Human Papillomavirus
YQYRVFRV

SEQ ID NO: 26345 - protein, 10 aa, Artificial Sequence
  Peptide Derived from Human Papillomavirus
YQYRVFRVQL

SEQ ID NO: 26346 - protein, 8 aa, Artificial Sequence
  Peptide Derived from Human Papillomavirus
YVTPTSIF

SEQ ID NO: 26347 - protein, 9 aa, Artificial Sequence
  Peptide Derived from Human Papillomavirus
YVTPTSIFY

SEQ ID NO: 26348 - protein, 11 aa, Artificial Sequence
  Peptide Derived from Human Papillomavirus
YVTPTSIFYHA

SEQ ID NO: 26349 - protein, 9 aa, Artificial Sequence
  Peptide Derived from Human Papillomavirus
ALTSRRGTV

SEQ ID NO: 26350 - protein, 11 aa, Artificial Sequence
  Peptide Derived from Human Papillomavirus
ALTSRRGTVRF

SEQ ID NO: 26351 - protein, 8 aa, Artificial Sequence
  Peptide Derived from Human Papillomavirus
APASTQYI

SEQ ID NO: 26352 - protein, 10 aa, Artificial Sequence
  Peptide Derived from Human Papillomavirus
APASTQYIGI

SEQ ID NO: 26353 - protein, 9 aa, Artificial Sequence
  Peptide Derived from Human Papillomavirus
APSPEYIEL

SEQ ID NO: 26354 - protein, 9 aa, Artificial Sequence
  Peptide Derived from Human Papillomavirus
CPPDVVPKV

SEQ ID NO: 26355 - protein, 9 aa, Artificial Sequence
  Peptide Derived from Human Papillomavirus
DIIRLHRPA

SEQ ID NO: 26356 - protein, 10 aa, Artificial Sequence
  Peptide Derived from Human Papillomavirus
DIIRLHRPAL

SEQ ID NO: 26357 - protein, 11 aa, Artificial Sequence
  Peptide Derived from Human Papillomavirus
DISPIAPSPEY

SEQ ID NO: 26358 - protein, 10 aa, Artificial Sequence
  Peptide Derived from Human Papillomavirus
DITLPSTTSV

SEQ ID NO: 26359 - protein, 11 aa, Artificial Sequence
  Peptide Derived from Human Papillomavirus
DITLPSTTSVW

SEQ ID NO: 26360 - protein, 9 aa, Artificial Sequence
  Peptide Derived from Human Papillomavirus
DITPSSTSV

SEQ ID NO: 26361 - protein, 11 aa, Artificial Sequence
  Peptide Derived from Human Papillomavirus
DITPSSTSVSI

SEQ ID NO: 26362 - protein, 11 aa, Artificial Sequence
  Peptide Derived from Human Papillomavirus
DITSAGTTTPA

SEQ ID NO: 26363 - protein, 10 aa, Artificial Sequence
  Peptide Derived from Human Papillomavirus
DIYADDMDPA

SEQ ID NO: 26364 - protein, 11 aa, Artificial Sequence
  Peptide Derived from Human Papillomavirus
DIYADDMDPAV

SEQ ID NO: 26365 - protein, 10 aa, Artificial Sequence
  Peptide Derived from Human Papillomavirus
DLFDIYADDM

SEQ ID NO: 26366 - protein, 8 aa, Artificial Sequence
  Peptide Derived from Human Papillomavirus
DMDPAVPV

SEQ ID NO: 26367 - protein, 11 aa, Artificial Sequence
  Peptide Derived from Human Papillomavirus
DPRSDVPDSDF

SEQ ID NO: 26368 - protein, 8 aa, Artificial Sequence
  Peptide Derived from Human Papillomavirus
DPSIVTLI

SEQ ID NO: 26369 - protein, 9 aa, Artificial Sequence
  Peptide Derived from Human Papillomavirus
DVGPTRPPV

SEQ ID NO: 26370 - protein, 10 aa, Artificial Sequence
  Peptide Derived from Human Papillomavirus
DVGPTRPPVV

SEQ ID NO: 26371 - protein, 11 aa, Artificial Sequence
  Peptide Derived from Human Papillomavirus
DVGPTRPPVVI

SEQ ID NO: 26372 - protein, 8 aa, Artificial Sequence
  Peptide Derived from Human Papillomavirus
DVPDSDFM

SEQ ID NO: 26373 - protein, 10 aa, Artificial Sequence
  Peptide Derived from Human Papillomavirus
DVPDSDFMDI

SEQ ID NO: 26374 - protein, 11 aa, Artificial Sequence
  Peptide Derived from Human Papillomavirus
DVPDSDFMDII

SEQ ID NO: 26375 - protein, 10 aa, Artificial Sequence
  Peptide Derived from Human Papillomavirus
DVPVYTGPDI

SEQ ID NO: 26376 - protein, 11 aa, Artificial Sequence
  Peptide Derived from Human Papillomavirus
DVVPKVEGTTL

SEQ ID NO: 26377 - protein, 8 aa, Artificial Sequence
  Peptide Derived from Human Papillomavirus
EIPLQTFA

SEQ ID NO: 26378 - protein, 8 aa, Artificial Sequence
  Peptide Derived from Human Papillomavirus
ELQPLVSA

SEQ ID NO: 26379 - protein, 8 aa, Artificial Sequence
  Peptide Derived from Human Papillomavirus
EPISSTPL

SEQ ID NO: 26380 - protein, 11 aa, Artificial Sequence
  Peptide Derived from Human Papillomavirus
EPISSTPLPTV

SEQ ID NO: 26381 - protein, 9 aa, Artificial Sequence
  Peptide Derived from Human Papillomavirus
EPVDTTLTF

SEQ ID NO: 26382 - protein, 10 aa, Artificial Sequence
  Peptide Derived from Human Papillomavirus
EPVGPTDPSI

SEQ ID NO: 26383 - protein, 11 aa, Artificial Sequence
  Peptide Derived from Human Papillomavirus
EPVGPTDPSIV

SEQ ID NO: 26384 - protein, 8 aa, Artificial Sequence
  Peptide Derived from Human Papillomavirus
EVAGNVFV

SEQ ID NO: 26385 - protein, 8 aa, Artificial Sequence
  Peptide Derived from Human Papillomavirus
EVPQTGEV

SEQ ID NO: 26386 - protein, 9 aa, Artificial Sequence
  Peptide Derived from Human Papillomavirus
EVPQTGEVA

SEQ ID NO: 26387 - protein, 9 aa, Artificial Sequence
  Peptide Derived from Human Papillomavirus
FIPKKRKRV

SEQ ID NO: 26388 - protein, 11 aa, Artificial Sequence
  Peptide Derived from Human Papillomavirus
FIPKKRKRVPY

SEQ ID NO: 26389 - protein, 8 aa, Artificial Sequence
  Peptide Derived from Human Papillomavirus
FLTRPSSL

SEQ ID NO: 26390 - protein, 9 aa, Artificial Sequence
  Peptide Derived from Human Papillomavirus
FLTRPSSLI

SEQ ID NO: 26391 - protein, 11 aa, Artificial Sequence
  Peptide Derived from Human Papillomavirus
FLTRPSSLITY

SEQ ID NO: 26392 - protein, 11 aa, Artificial Sequence
  Peptide Derived from Human Papillomavirus
FMDIIRLHRPA

SEQ ID NO: 26393 - protein, 9 aa, Artificial Sequence
  Peptide Derived from Human Papillomavirus
GIFLGGLGI

SEQ ID NO: 26394 - protein, 8 aa, Artificial Sequence
  Peptide Derived from Human Papillomavirus
GIHGTHYY

SEQ ID NO: 26395 - protein, 9 aa, Artificial Sequence
  Peptide Derived from Human Papillomavirus
GIHGTHYYL

SEQ ID NO: 26396 - protein, 10 aa, Artificial Sequence
  Peptide Derived from Human Papillomavirus
GIHGTHYYLW

SEQ ID NO: 26397 - protein, 8 aa, Artificial Sequence
  Peptide Derived from Human Papillomavirus
GPRLYSRA

SEQ ID NO: 26398 - protein, 9 aa, Artificial Sequence
  Peptide Derived from Human Papillomavirus
GPRLYSRAY

SEQ ID NO: 26399 - protein, 8 aa, Artificial Sequence
  Peptide Derived from Human Papillomavirus
GPTDPSIV

SEQ ID NO: 26400 - protein, 10 aa, Artificial Sequence
  Peptide Derived from Human Papillomavirus
GPTDPSIVTL

SEQ ID NO: 26401 - protein, 11 aa, Artificial Sequence
  Peptide Derived from Human Papillomavirus
GPTDPSIVTLI

SEQ ID NO: 26402 - protein, 8 aa, Artificial Sequence
  Peptide Derived from Human Papillomavirus
GPTRPPVV

SEQ ID NO: 26403 - protein, 9 aa, Artificial Sequence
  Peptide Derived from Human Papillomavirus
GPTRPPVVI

SEQ ID NO: 26404 - protein, 10 aa, Artificial Sequence
  Peptide Derived from Human Papillomavirus
IIEVPQTGEV

SEQ ID NO: 26405 - protein, 11 aa, Artificial Sequence
  Peptide Derived from Human Papillomavirus
IIEVPQTGEVA

SEQ ID NO: 26406 - protein, 8 aa, Artificial Sequence
  Peptide Derived from Human Papillomavirus
IIRLHRPA

SEQ ID NO: 26407 - protein, 9 aa, Artificial Sequence
  Peptide Derived from Human Papillomavirus
IIRLHRPAL

SEQ ID NO: 26408 - protein, 9 aa, Artificial Sequence
  Peptide Derived from Human Papillomavirus
ILQWSSLGI

SEQ ID NO: 26409 - protein, 10 aa, Artificial Sequence
  Peptide Derived from Human Papillomavirus
ILQWSSLGIF

SEQ ID NO: 26410 - protein, 11 aa, Artificial Sequence
  Peptide Derived from Human Papillomavirus
ILQWSSLGIFL

SEQ ID NO: 26411 - protein, 8 aa, Artificial Sequence
  Peptide Derived from Human Papillomavirus
IPKKRKRV

SEQ ID NO: 26412 - protein, 10 aa, Artificial Sequence
  Peptide Derived from Human Papillomavirus
IPKKRKRVPY

SEQ ID NO: 26413 - protein, 11 aa, Artificial Sequence
  Peptide Derived from Human Papillomavirus
IPKKRKRVPYF

SEQ ID NO: 26414 - protein, 10 aa, Artificial Sequence
  Peptide Derived from Human Papillomavirus
IPLGGRSNTV

SEQ ID NO: 26415 - protein, 11 aa, Artificial Sequence
  Peptide Derived from Human Papillomavirus
IPLGGRSNTVV

SEQ ID NO: 26416 - protein, 8 aa, Artificial Sequence
  Peptide Derived from Human Papillomavirus
IVSPTAPA

SEQ ID NO: 26417 - protein, 10 aa, Artificial Sequence
  Peptide Derived from Human Papillomavirus
IVTLIEDSSV

SEQ ID NO: 26418 - protein, 11 aa, Artificial Sequence
  Peptide Derived from Human Papillomavirus
IVTLIEDSSVV

SEQ ID NO: 26419 - protein, 8 aa, Artificial Sequence
  Peptide Derived from Human Papillomavirus
KILQWSSL

SEQ ID NO: 26420 - protein, 10 aa, Artificial Sequence
  Peptide Derived from Human Papillomavirus
KILQWSSLGI

SEQ ID NO: 26421 - protein, 11 aa, Artificial Sequence
  Peptide Derived from Human Papillomavirus
KILQWSSLGIF

SEQ ID NO: 26422 - protein, 10 aa, Artificial Sequence
  Peptide Derived from Human Papillomavirus
KQSGTCPPDV

SEQ ID NO: 26423 - protein, 11 aa, Artificial Sequence
  Peptide Derived from Human Papillomavirus
KQSGTCPPDVV

SEQ ID NO: 26424 - protein, 8 aa, Artificial Sequence
  Peptide Derived from Human Papillomavirus
KVEGTTLA

SEQ ID NO: 26425 - protein, 11 aa, Artificial Sequence
  Peptide Derived from Human Papillomavirus
KVEGTTLADKI

SEQ ID NO: 26426 - protein, 8 aa, Artificial Sequence
  Peptide Derived from Human Papillomavirus
LIEDSSVV

SEQ ID NO: 26427 - protein, 8 aa, Artificial Sequence
  Peptide Derived from Human Papillomavirus
LITYDNPA

SEQ ID NO: 26428 - protein, 9 aa, Artificial Sequence
  Peptide Derived from Human Papillomavirus
LITYDNPAF

SEQ ID NO: 26429 - protein, 8 aa, Artificial Sequence
  Peptide Derived from Human Papillomavirus
LPSTTSVW

SEQ ID NO: 26430 - protein, 10 aa, Artificial Sequence
  Peptide Derived from Human Papillomavirus
LPSTTSVWPI

SEQ ID NO: 26431 - protein, 11 aa, Artificial Sequence
  Peptide Derived from Human Papillomavirus
LPSTTSVWPIV

SEQ ID NO: 26432 - protein, 8 aa, Artificial Sequence
  Peptide Derived from Human Papillomavirus
LPTVRRVA

SEQ ID NO: 26433 - protein, 8 aa, Artificial Sequence
  Peptide Derived from Human Papillomavirus
LQWSSLGI

SEQ ID NO: 26434 - protein, 9 aa, Artificial Sequence
  Peptide Derived from Human Papillomavirus
LQWSSLGIF

SEQ ID NO: 26435 - protein, 10 aa, Artificial Sequence
  Peptide Derived from Human Papillomavirus
LQWSSLGIFL

SEQ ID NO: 26436 - protein, 10 aa, Artificial Sequence
  Peptide Derived from Human Papillomavirus
LVSATEDNDL

SEQ ID NO: 26437 - protein, 11 aa, Artificial Sequence
  Peptide Derived from Human Papillomavirus
LVSATEDNDLF

SEQ ID NO: 26438 - protein, 11 aa, Artificial Sequence
  Peptide Derived from Human Papillomavirus
NPAFEPVDTTL

SEQ ID NO: 26439 - protein, 9 aa, Artificial Sequence
  Peptide Derived from Human Papillomavirus
NPAFSDPSI

SEQ ID NO: 26440 - protein, 10 aa, Artificial Sequence
  Peptide Derived from Human Papillomavirus
NPAFSDPSII

SEQ ID NO: 26441 - protein, 11 aa, Artificial Sequence
  Peptide Derived from Human Papillomavirus
NPEFLTRPSSL

SEQ ID NO: 26442 - protein, 10 aa, Artificial Sequence
  Peptide Derived from Human Papillomavirus
NVTVPLTSSW

SEQ ID NO: 26443 - protein, 8 aa, Artificial Sequence
  Peptide Derived from Human Papillomavirus
PIAPSPEY

SEQ ID NO: 26444 - protein, 9 aa, Artificial Sequence
  Peptide Derived from Human Papillomavirus
PIAPSPEYI

SEQ ID NO: 26445 - protein, 11 aa, Artificial Sequence
  Peptide Derived from Human Papillomavirus
PIAPSPEYIEL

SEQ ID NO: 26446 - protein, 10 aa, Artificial Sequence
  Peptide Derived from Human Papillomavirus
PISSTPLPTV

SEQ ID NO: 26447 - protein, 9 aa, Artificial Sequence
  Peptide Derived from Human Papillomavirus
PIVSPTAPA

SEQ ID NO: 26448 - protein, 9 aa, Artificial Sequence
  Peptide Derived from Human Papillomavirus
PLGGRSNTV

SEQ ID NO: 26449 - protein, 10 aa, Artificial Sequence
  Peptide Derived from Human Papillomavirus
PLGGRSNTVV

SEQ ID NO: 26450 - protein, 8 aa, Artificial Sequence
  Peptide Derived from Human Papillomavirus
PLPTVRRV

SEQ ID NO: 26451 - protein, 9 aa, Artificial Sequence
  Peptide Derived from Human Papillomavirus
PLPTVRRVA

SEQ ID NO: 26452 - protein, 8 aa, Artificial Sequence
  Peptide Derived from Human Papillomavirus
PLTSSWDV

SEQ ID NO: 26453 - protein, 10 aa, Artificial Sequence
  Peptide Derived from Human Papillomavirus
PLTSSWDVPV

SEQ ID NO: 26454 - protein, 11 aa, Artificial Sequence
  Peptide Derived from Human Papillomavirus
PLTSSWDVPVY

SEQ ID NO: 26455 - protein, 11 aa, Artificial Sequence
  Peptide Derived from Human Papillomavirus
PLVSATEDNDL

SEQ ID NO: 26456 - protein, 8 aa, Artificial Sequence
  Peptide Derived from Human Papillomavirus
PPDVVPKV

SEQ ID NO: 26457 - protein, 8 aa, Artificial Sequence
  Peptide Derived from Human Papillomavirus
PPVVIEPV

SEQ ID NO: 26458 - protein, 10 aa, Artificial Sequence
  Peptide Derived from Human Papillomavirus
PQTGEVAGNV

SEQ ID NO: 26459 - protein, 11 aa, Artificial Sequence
  Peptide Derived from Human Papillomavirus
PQTGEVAGNVF

SEQ ID NO: 26460 - protein, 8 aa, Artificial Sequence
  Peptide Derived from Human Papillomavirus
PVDTTLTF

SEQ ID NO: 26461 - protein, 9 aa, Artificial Sequence
  Peptide Derived from Human Papillomavirus
PVGPTDPSI

SEQ ID NO: 26462 - protein, 10 aa, Artificial Sequence
  Peptide Derived from Human Papillomavirus
PVGPTDPSIV

SEQ ID NO: 26463 - protein, 10 aa, Artificial Sequence
  Peptide Derived from Human Papillomavirus
PVPSRSTTSF

SEQ ID NO: 26464 - protein, 11 aa, Artificial Sequence
  Peptide Derived from Human Papillomavirus
PVPSRSTTSFA

SEQ ID NO: 26465 - protein, 8 aa, Artificial Sequence
  Peptide Derived from Human Papillomavirus
PVYTGPDI

SEQ ID NO: 26466 - protein, 10 aa, Artificial Sequence
  Peptide Derived from Human Papillomavirus
PVYTGPDITL

SEQ ID NO: 26467 - protein, 8 aa, Artificial Sequence
  Peptide Derived from Human Papillomavirus
QIGARVHF

SEQ ID NO: 26468 - protein, 9 aa, Artificial Sequence
  Peptide Derived from Human Papillomavirus
QIGARVHFY

SEQ ID NO: 26469 - protein, 10 aa, Artificial Sequence
  Peptide Derived from Human Papillomavirus
QQVSVANPEF

SEQ ID NO: 26470 - protein, 11 aa, Artificial Sequence
  Peptide Derived from Human Papillomavirus
QQVSVANPEFL

SEQ ID NO: 26471 - protein, 9 aa, Artificial Sequence
  Peptide Derived from Human Papillomavirus
QVSVANPEF

SEQ ID NO: 26472 - protein, 10 aa, Artificial Sequence
  Peptide Derived from Human Papillomavirus
QVSVANPEFL

SEQ ID NO: 26473 - protein, 8 aa, Artificial Sequence
  Peptide Derived from Human Papillomavirus
RLGQRATM

SEQ ID NO: 26474 - protein, 9 aa, Artificial Sequence
  Peptide Derived from Human Papillomavirus
RLGQRATMF

SEQ ID NO: 26475 - protein, 10 aa, Artificial Sequence
  Peptide Derived from Human Papillomavirus
RLYSRAYQQV

SEQ ID NO: 26476 - protein, 11 aa, Artificial Sequence
  Peptide Derived from Human Papillomavirus
RPALTSRRGTV

SEQ ID NO: 26477 - protein, 9 aa, Artificial Sequence
  Peptide Derived from Human Papillomavirus
RPPVVIEPV

SEQ ID NO: 26478 - protein, 8 aa, Artificial Sequence
  Peptide Derived from Human Papillomavirus
RPSSLITY

SEQ ID NO: 26479 - protein, 10 aa, Artificial Sequence
  Peptide Derived from Human Papillomavirus
RPTFTGTSGF

SEQ ID NO: 26480 - protein, 8 aa, Artificial Sequence
  Peptide Derived from Human Papillomavirus
RVAGPRLY

SEQ ID NO: 26481 - protein, 11 aa, Artificial Sequence
  Peptide Derived from Human Papillomavirus
RVAGPRLYSRA

SEQ ID NO: 26482 - protein, 8 aa, Artificial Sequence
  Peptide Derived from Human Papillomavirus
RVHFYHDI

SEQ ID NO: 26483 - protein, 11 aa, Artificial Sequence
  Peptide Derived from Human Papillomavirus
RVHFYHDISPI

SEQ ID NO: 26484 - protein, 10 aa, Artificial Sequence
  Peptide Derived from Human Papillomavirus
RVPYFFADGF

SEQ ID NO: 26485 - protein, 11 aa, Artificial Sequence
  Peptide Derived from Human Papillomavirus
RVPYFFADGFV

SEQ ID NO: 26486 - protein, 11 aa, Artificial Sequence
  Peptide Derived from Human Papillomavirus
SIIEVPQTGEV

SEQ ID NO: 26487 - protein, 11 aa, Artificial Sequence
  Peptide Derived from Human Papillomavirus
SISTTNFTNPA

SEQ ID NO: 26488 - protein, 11 aa, Artificial Sequence
  Peptide Derived from Human Papillomavirus
SIVTLIEDSSV

SEQ ID NO: 26489 - protein, 9 aa, Artificial Sequence
  Peptide Derived from Human Papillomavirus
SLGIFLGGL

SEQ ID NO: 26490 - protein, 11 aa, Artificial Sequence
  Peptide Derived from Human Papillomavirus
SLGIFLGGLGI

SEQ ID NO: 26491 - protein, 9 aa, Artificial Sequence
  Peptide Derived from Human Papillomavirus
SLITYDNPA

SEQ ID NO: 26492 - protein, 10 aa, Artificial Sequence
  Peptide Derived from Human Papillomavirus
SLITYDNPAF

SEQ ID NO: 26493 - protein, 10 aa, Artificial Sequence
  Peptide Derived from Human Papillomavirus
SPEYIELQPL

SEQ ID NO: 26494 - protein, 11 aa, Artificial Sequence
  Peptide Derived from Human Papillomavirus
SPEYIELQPLV

SEQ ID NO: 26495 - protein, 9 aa, Artificial Sequence
  Peptide Derived from Human Papillomavirus
SPIAPSPEY

SEQ ID NO: 26496 - protein, 10 aa, Artificial Sequence
  Peptide Derived from Human Papillomavirus
SPIAPSPEYI

SEQ ID NO: 26497 - protein, 10 aa, Artificial Sequence
  Peptide Derived from Human Papillomavirus
SPTAPASTQY

SEQ ID NO: 26498 - protein, 11 aa, Artificial Sequence
  Peptide Derived from Human Papillomavirus
SPTAPASTQYI

SEQ ID NO: 26499 - protein, 10 aa, Artificial Sequence
  Peptide Derived from Human Papillomavirus
SPTISSASSY

SEQ ID NO: 26500 - protein, 8 aa, Artificial Sequence
  Peptide Derived from Human Papillomavirus
SVANPEFL

SEQ ID NO: 26501 - protein, 9 aa, Artificial Sequence
  Peptide Derived from Human Papillomavirus
SVSISTTNF

SEQ ID NO: 26502 - protein, 10 aa, Artificial Sequence
  Peptide Derived from Human Papillomavirus
SVWPIVSPTA

SEQ ID NO: 26503 - protein, 8 aa, Artificial Sequence
  Peptide Derived from Human Papillomavirus
TISSASSY

SEQ ID NO: 26504 - protein, 11 aa, Artificial Sequence
  Peptide Derived from Human Papillomavirus
TISSASSYSNV

SEQ ID NO: 26505 - protein, 9 aa, Artificial Sequence
  Peptide Derived from Human Papillomavirus
TLADKILQW

SEQ ID NO: 26506 - protein, 8 aa, Artificial Sequence
  Peptide Derived from Human Papillomavirus
TLIEDSSV

SEQ ID NO: 26507 - protein, 9 aa, Artificial Sequence
  Peptide Derived from Human Papillomavirus
TLIEDSSVV

SEQ ID NO: 26508 - protein, 8 aa, Artificial Sequence
  Peptide Derived from Human Papillomavirus
TLPSTTSV

SEQ ID NO: 26509 - protein, 9 aa, Artificial Sequence
  Peptide Derived from Human Papillomavirus
TLPSTTSVW

SEQ ID NO: 26510 - protein, 11 aa, Artificial Sequence
  Peptide Derived from Human Papillomavirus
TLPSTTSVWPI

SEQ ID NO: 26511 - protein, 10 aa, Artificial Sequence
  Peptide Derived from Human Papillomavirus
TLTFDPRSDV

SEQ ID NO: 26512 - protein, 10 aa, Artificial Sequence
  Peptide Derived from Human Papillomavirus
TMFTRSGTQI

SEQ ID NO: 26513 - protein, 9 aa, Artificial Sequence
  Peptide Derived from Human Papillomavirus
TPLPTVRRV

SEQ ID NO: 26514 - protein, 10 aa, Artificial Sequence
  Peptide Derived from Human Papillomavirus
TPLPTVRRVA

SEQ ID NO: 26515 - protein, 9 aa, Artificial Sequence
  Peptide Derived from Human Papillomavirus
TPSSTSVSI

SEQ ID NO: 26516 - protein, 9 aa, Artificial Sequence
  Peptide Derived from Human Papillomavirus
TPTSGTHGY

SEQ ID NO: 26517 - protein, 9 aa, Artificial Sequence
  Peptide Derived from Human Papillomavirus
TQIGARVHF

SEQ ID NO: 26518 - protein, 10 aa, Artificial Sequence
  Peptide Derived from Human Papillomavirus
TQIGARVHFY

SEQ ID NO: 26519 - protein, 11 aa, Artificial Sequence
  Peptide Derived from Human Papillomavirus
TQYIGIHGTHY

SEQ ID NO: 26520 - protein, 8 aa, Artificial Sequence
  Peptide Derived from Human Papillomavirus
TVPLTSSW

SEQ ID NO: 26521 - protein, 10 aa, Artificial Sequence
  Peptide Derived from Human Papillomavirus
TVPLTSSWDV

SEQ ID NO: 26522 - protein, 11 aa, Artificial Sequence
  Peptide Derived from Human Papillomavirus
TVRFSRLGQRA

SEQ ID NO: 26523 - protein, 10 aa, Artificial Sequence
  Peptide Derived from Human Papillomavirus
TVRRVAGPRL

SEQ ID NO: 26524 - protein, 11 aa, Artificial Sequence
  Peptide Derived from Human Papillomavirus
TVRRVAGPRLY

SEQ ID NO: 26525 - protein, 11 aa, Artificial Sequence
  Peptide Derived from Human Papillomavirus
VLDITPSSTSV

SEQ ID NO: 26526 - protein, 9 aa, Artificial Sequence
  Peptide Derived from Human Papillomavirus
VPDSDFMDI

SEQ ID NO: 26527 - protein, 10 aa, Artificial Sequence
  Peptide Derived from Human Papillomavirus
VPDSDFMDII

SEQ ID NO: 26528 - protein, 9 aa, Artificial Sequence
  Peptide Derived from Human Papillomavirus
VPKVEGTTL

SEQ ID NO: 26529 - protein, 10 aa, Artificial Sequence
  Peptide Derived from Human Papillomavirus
VPKVEGTTLA

SEQ ID NO: 26530 - protein, 9 aa, Artificial Sequence
  Peptide Derived from Human Papillomavirus
VPLTSSWDV

SEQ ID NO: 26531 - protein, 11 aa, Artificial Sequence
  Peptide Derived from Human Papillomavirus
VPLTSSWDVPV

SEQ ID NO: 26532 - protein, 8 aa, Artificial Sequence
  Peptide Derived from Human Papillomavirus
VPQTGEVA

SEQ ID NO: 26533 - protein, 11 aa, Artificial Sequence
  Peptide Derived from Human Papillomavirus
VPQTGEVAGNV

SEQ ID NO: 26534 - protein, 9 aa, Artificial Sequence
  Peptide Derived from Human Papillomavirus
VPSRSTTSF

SEQ ID NO: 26535 - protein, 10 aa, Artificial Sequence
  Peptide Derived from Human Papillomavirus
VPSRSTTSFA

SEQ ID NO: 26536 - protein, 11 aa, Artificial Sequence
  Peptide Derived from Human Papillomavirus
VPSRSTTSFAF

SEQ ID NO: 26537 - protein, 11 aa, Artificial Sequence
  Peptide Derived from Human Papillomavirus
VPVPSRSTTSF

SEQ ID NO: 26538 - protein, 9 aa, Artificial Sequence
  Peptide Derived from Human Papillomavirus
VPVYTGPDI

SEQ ID NO: 26539 - protein, 11 aa, Artificial Sequence
  Peptide Derived from Human Papillomavirus
VPVYTGPDITL

SEQ ID NO: 26540 - protein, 9 aa, Artificial Sequence
  Peptide Derived from Human Papillomavirus
VPYFFADGF

SEQ ID NO: 26541 - protein, 10 aa, Artificial Sequence
  Peptide Derived from Human Papillomavirus
VPYFFADGFV

SEQ ID NO: 26542 - protein, 11 aa, Artificial Sequence
  Peptide Derived from Human Papillomavirus
VPYFFADGFVA

SEQ ID NO: 26543 - protein, 11 aa, Artificial Sequence
  Peptide Derived from Human Papillomavirus
VVDVGPTRPPV

SEQ ID NO: 26544 - protein, 10 aa, Artificial Sequence
  Peptide Derived from Human Papillomavirus
VVPKVEGTTL

SEQ ID NO: 26545 - protein, 11 aa, Artificial Sequence
  Peptide Derived from Human Papillomavirus
VVPKVEGTTLA

SEQ ID NO: 26546 - protein, 11 aa, Artificial Sequence
  Peptide Derived from Human Papillomavirus
VVTSGAPRPTF

SEQ ID NO: 26547 - protein, 8 aa, Artificial Sequence
  Peptide Derived from Human Papillomavirus
WPIVSPTA

SEQ ID NO: 26548 - protein, 10 aa, Artificial Sequence
  Peptide Derived from Human Papillomavirus
WPIVSPTAPA

SEQ ID NO: 26549 - protein, 8 aa, Artificial Sequence
  Peptide Derived from Human Papillomavirus
YIELQPLV

SEQ ID NO: 26550 - protein, 10 aa, Artificial Sequence
  Peptide Derived from Human Papillomavirus
YIELQPLVSA

SEQ ID NO: 26551 - protein, 9 aa, Artificial Sequence
  Peptide Derived from Human Papillomavirus
YIGIHGTHY

SEQ ID NO: 26552 - protein, 10 aa, Artificial Sequence
  Peptide Derived from Human Papillomavirus
YIGIHGTHYY

SEQ ID NO: 26553 - protein, 11 aa, Artificial Sequence
  Peptide Derived from Human Papillomavirus
YIGIHGTHYYL

SEQ ID NO: 26554 - protein, 11 aa, Artificial Sequence
  Peptide Derived from Human Papillomavirus
YIPLGGRSNTV

SEQ ID NO: 26555 - protein, 8 aa, Artificial Sequence
  Peptide Derived from Human Papillomavirus
YLWPLYYF

SEQ ID NO: 26556 - protein, 9 aa, Artificial Sequence
  Peptide Derived from Human Papillomavirus
YLWPLYYFI

SEQ ID NO: 26557 - protein, 11 aa, Artificial Sequence
  Peptide Derived from Human Papillomavirus
YQQVSVANPEF

SEQ ID NO: 26558 - protein, 11 aa, Artificial Sequence
  Peptide Derived from Human Papillomavirus
AICIENNSKTA

SEQ ID NO: 26559 - protein, 9 aa, Artificial Sequence
  Peptide Derived from Human Papillomavirus
ALDGNPVSI

SEQ ID NO: 26560 - protein, 11 aa, Artificial Sequence
  Peptide Derived from Human Papillomavirus
ALDGNPVSIDV

SEQ ID NO: 26561 - protein, 8 aa, Artificial Sequence
  Peptide Derived from Human Papillomavirus
ALFHAQEA

SEQ ID NO: 26562 - protein, 9 aa, Artificial Sequence
  Peptide Derived from Human Papillomavirus
ALKLFLKGV

SEQ ID NO: 26563 - protein, 10 aa, Artificial Sequence
  Peptide Derived from Human Papillomavirus
ALMQLKCPPL

SEQ ID NO: 26564 - protein, 11 aa, Artificial Sequence
  Peptide Derived from Human Papillomavirus
ALMQLKCPPLL

SEQ ID NO: 26565 - protein, 9 aa, Artificial Sequence
  Peptide Derived from Human Papillomavirus
ALYWYRTGM

SEQ ID NO: 26566 - protein, 9 aa, Artificial Sequence
  Peptide Derived from Human Papillomavirus
AMLGKFKEL

SEQ ID NO: 26567 - protein, 10 aa, Artificial Sequence
  Peptide Derived from Human Papillomavirus
AMLGKFKELY

SEQ ID NO: 26568 - protein, 8 aa, Artificial Sequence
  Peptide Derived from Human Papillomavirus
APNTGKSY

SEQ ID NO: 26569 - protein, 9 aa, Artificial Sequence
  Peptide Derived from Human Papillomavirus
APNTGKSYF

SEQ ID NO: 26570 - protein, 11 aa, Artificial Sequence
  Peptide Derived from Human Papillomavirus
APNTGKSYFGM

SEQ ID NO: 26571 - protein, 10 aa, Artificial Sequence
  Peptide Derived from Human Papillomavirus
AQALFHAQEA

SEQ ID NO: 26572 - protein, 8 aa, Artificial Sequence
  Peptide Derived from Human Papillomavirus
AQEAEEHA

SEQ ID NO: 26573 - protein, 10 aa, Artificial Sequence
  Peptide Derived from Human Papillomavirus
AQEAEEHAEA

SEQ ID NO: 26574 - protein, 11 aa, Artificial Sequence
  Peptide Derived from Human Papillomavirus
AQEAEEHAEAV

SEQ ID NO: 26575 - protein, 10 aa, Artificial Sequence
  Peptide Derived from Human Papillomavirus
AQLADSDSNA

SEQ ID NO: 26576 - protein, 11 aa, Artificial Sequence
  Peptide Derived from Human Papillomavirus
AVIDRQTGDNI

SEQ ID NO: 26577 - protein, 9 aa, Artificial Sequence
  Peptide Derived from Human Papillomavirus
AVQVLKRKY

SEQ ID NO: 26578 - protein, 10 aa, Artificial Sequence
  Peptide Derived from Human Papillomavirus
AVQVLKRKYV

SEQ ID NO: 26579 - protein, 9 aa, Artificial Sequence
  Peptide Derived from Human Papillomavirus
CIENNSKTA

SEQ ID NO: 26580 - protein, 8 aa, Artificial Sequence
  Peptide Derived from Human Papillomavirus
CISTNCML

SEQ ID NO: 26581 - protein, 9 aa, Artificial Sequence
  Peptide Derived from Human Papillomavirus
CISTNCMLI

SEQ ID NO: 26582 - protein, 9 aa, Artificial Sequence
  Peptide Derived from Human Papillomavirus
CLYCHLQSL

SEQ ID NO: 26583 - protein, 10 aa, Artificial Sequence
  Peptide Derived from Human Papillomavirus
CLYCHLQSLA

SEQ ID NO: 26584 - protein, 9 aa, Artificial Sequence
  Peptide Derived from Human Papillomavirus
CMLIQPPKL

SEQ ID NO: 26585 - protein, 10 aa, Artificial Sequence
  Peptide Derived from Human Papillomavirus
CPPLLITSNI

SEQ ID NO: 26586 - protein, 11 aa, Artificial Sequence
  Peptide Derived from Human Papillomavirus
CVAAFGVTGTV

SEQ ID NO: 26587 - protein, 10 aa, Artificial Sequence
  Peptide Derived from Human Papillomavirus
CVDYNISPRL

SEQ ID NO: 26588 - protein, 10 aa, Artificial Sequence
  Peptide Derived from Human Papillomavirus
CVSGQNIRTL

SEQ ID NO: 26589 - protein, 8 aa, Artificial Sequence
  Peptide Derived from Human Papillomavirus
DISSCVDY

SEQ ID NO: 26590 - protein, 10 aa, Artificial Sequence
  Peptide Derived from Human Papillomavirus
DISSCVDYNI

SEQ ID NO: 26591 - protein, 8 aa, Artificial Sequence
  Peptide Derived from Human Papillomavirus
DIVKFLRY

SEQ ID NO: 26592 - protein, 11 aa, Artificial Sequence
  Peptide Derived from Human Papillomavirus
DIVKFLRYQQI

SEQ ID NO: 26593 - protein, 8 aa, Artificial Sequence
  Peptide Derived from Human Papillomavirus
DLSQMVQW

SEQ ID NO: 26594 - protein, 9 aa, Artificial Sequence
  Peptide Derived from Human Papillomavirus
DLSQMVQWA

SEQ ID NO: 26595 - protein, 10 aa, Artificial Sequence
  Peptide Derived from Human Papillomavirus
DLSQMVQWAY

SEQ ID NO: 26596 - protein, 11 aa, Artificial Sequence
  Peptide Derived from Human Papillomavirus
DMVDFIDNCNV

SEQ ID NO: 26597 - protein, 8 aa, Artificial Sequence
  Peptide Derived from Human Papillomavirus
DVKHKALM

SEQ ID NO: 26598 - protein, 10 aa, Artificial Sequence
  Peptide Derived from Human Papillomavirus
DVKHKALMQL

SEQ ID NO: 26599 - protein, 8 aa, Artificial Sequence
  Peptide Derived from Human Papillomavirus
DVMDDSEI

SEQ ID NO: 26600 - protein, 9 aa, Artificial Sequence
  Peptide Derived from Human Papillomavirus
DVMDDSEIA

SEQ ID NO: 26601 - protein, 10 aa, Artificial Sequence
  Peptide Derived from Human Papillomavirus
DVMDDSEIAY

SEQ ID NO: 26602 - protein, 9 aa, Artificial Sequence
  Peptide Derived from Human Papillomavirus
DVYGETPEW

SEQ ID NO: 26603 - protein, 10 aa, Artificial Sequence
  Peptide Derived from Human Papillomavirus
DVYGETPEWI

SEQ ID NO: 26604 - protein, 9 aa, Artificial Sequence
  Peptide Derived from Human Papillomavirus
EIAYKYAQL

SEQ ID NO: 26605 - protein, 10 aa, Artificial Sequence
  Peptide Derived from Human Papillomavirus
EIAYKYAQLA

SEQ ID NO: 26606 - protein, 10 aa, Artificial Sequence
  Peptide Derived from Human Papillomavirus
ELSDKNWKSF

SEQ ID NO: 26607 - protein, 11 aa, Artificial Sequence
  Peptide Derived from Human Papillomavirus
ELSDKNWKSFF

SEQ ID NO: 26608 - protein, 8 aa, Artificial Sequence
  Peptide Derived from Human Papillomavirus
ELYGVSFM

SEQ ID NO: 26609 - protein, 10 aa, Artificial Sequence
  Peptide Derived from Human Papillomavirus
ELYGVSFMEL

SEQ ID NO: 26610 - protein, 11 aa, Artificial Sequence
  Peptide Derived from Human Papillomavirus
ELYGVSFMELI

SEQ ID NO: 26611 - protein, 8 aa, Artificial Sequence
  Peptide Derived from Human Papillomavirus
EVETQQMV

SEQ ID NO: 26612 - protein, 10 aa, Artificial Sequence
  Peptide Derived from Human Papillomavirus
EVETQQMVQV

SEQ ID NO: 26613 - protein, 8 aa, Artificial Sequence
  Peptide Derived from Human Papillomavirus
FIDNCNVY

SEQ ID NO: 26614 - protein, 11 aa, Artificial Sequence
  Peptide Derived from Human Papillomavirus
FLKGVPKKNCI

SEQ ID NO: 26615 - protein, 8 aa, Artificial Sequence
  Peptide Derived from Human Papillomavirus
FLKSNSQA

SEQ ID NO: 26616 - protein, 10 aa, Artificial Sequence
  Peptide Derived from Human Papillomavirus
FLKSNSQAKI

SEQ ID NO: 26617 - protein, 11 aa, Artificial Sequence
  Peptide Derived from Human Papillomavirus
FLKSNSQAKIV

SEQ ID NO: 26618 - protein, 9 aa, Artificial Sequence
  Peptide Derived from Human Papillomavirus
FLQGCIISY

SEQ ID NO: 26619 - protein, 10 aa, Artificial Sequence
  Peptide Derived from Human Papillomavirus
FLQGCIISYA

SEQ ID NO: 26620 - protein, 9 aa, Artificial Sequence
  Peptide Derived from Human Papillomavirus
FLRYQQIEF

SEQ ID NO: 26621 - protein, 10 aa, Artificial Sequence
  Peptide Derived from Human Papillomavirus
FLRYQQIEFV

SEQ ID NO: 26622 - protein, 8 aa, Artificial Sequence
  Peptide Derived from Human Papillomavirus
FLSALKLF

SEQ ID NO: 26623 - protein, 9 aa, Artificial Sequence
  Peptide Derived from Human Papillomavirus
FLSALKLFL

SEQ ID NO: 26624 - protein, 8 aa, Artificial Sequence
  Peptide Derived from Human Papillomavirus
FMELIRPF

SEQ ID NO: 26625 - protein, 10 aa, Artificial Sequence
  Peptide Derived from Human Papillomavirus
FPFDKNGNPV

SEQ ID NO: 26626 - protein, 11 aa, Artificial Sequence
  Peptide Derived from Human Papillomavirus
FPFDKNGNPVY

SEQ ID NO: 26627 - protein, 11 aa, Artificial Sequence
  Peptide Derived from Human Papillomavirus
FQSNKSTCTDW

SEQ ID NO: 26628 - protein, 8 aa, Artificial Sequence
  Peptide Derived from Human Papillomavirus
FVSFLSAL

SEQ ID NO: 26629 - protein, 10 aa, Artificial Sequence
  Peptide Derived from Human Papillomavirus
FVSFLSALKL

SEQ ID NO: 26630 - protein, 11 aa, Artificial Sequence
  Peptide Derived from Human Papillomavirus
FVSFLSALKLF

SEQ ID NO: 26631 - protein, 11 aa, Artificial Sequence
  Peptide Derived from Human Papillomavirus
GMLDDATTPCW

SEQ ID NO: 26632 - protein, 8 aa, Artificial Sequence
  Peptide Derived from Human Papillomavirus
GMSLISFL

SEQ ID NO: 26633 - protein, 8 aa, Artificial Sequence
  Peptide Derived from Human Papillomavirus
GMSNISDV

SEQ ID NO: 26634 - protein, 9 aa, Artificial Sequence
  Peptide Derived from Human Papillomavirus
GMSNISDVY

SEQ ID NO: 26635 - protein, 8 aa, Artificial Sequence
  Peptide Derived from Human Papillomavirus
GMVMLMLV

SEQ ID NO: 26636 - protein, 10 aa, Artificial Sequence
  Peptide Derived from Human Papillomavirus
GMVMLMLVRF

SEQ ID NO: 26637 - protein, 11 aa, Artificial Sequence
  Peptide Derived from Human Papillomavirus
GQWIKSRCDKV

SEQ ID NO: 26638 - protein, 8 aa, Artificial Sequence
  Peptide Derived from Human Papillomavirus
GVPKKNCI

SEQ ID NO: 26639 - protein, 9 aa, Artificial Sequence
  Peptide Derived from Human Papillomavirus
GVPKKNCIL

SEQ ID NO: 26640 - protein, 10 aa, Artificial Sequence
  Peptide Derived from Human Papillomavirus
GVPKKNCILI

SEQ ID NO: 26641 - protein, 8 aa, Artificial Sequence
  Peptide Derived from Human Papillomavirus
GVSFMELI

SEQ ID NO: 26642 - protein, 11 aa, Artificial Sequence
  Peptide Derived from Human Papillomavirus
GVSFMELIRPF

SEQ ID NO: 26643 - protein, 10 aa, Artificial Sequence
  Peptide Derived from Human Papillomavirus
GVTGTVAEGF

SEQ ID NO: 26644 - protein, 9 aa, Artificial Sequence
  Peptide Derived from Human Papillomavirus
HLQSLACSW

SEQ ID NO: 26645 - protein, 11 aa, Artificial Sequence
  Peptide Derived from Human Papillomavirus
HLQSLACSWGM

SEQ ID NO: 26646 - protein, 11 aa, Artificial Sequence
  Peptide Derived from Human Papillomavirus
IISYANSKSHF

SEQ ID NO: 26647 - protein, 10 aa, Artificial Sequence
  Peptide Derived from Human Papillomavirus
IQPPKLRSTA

SEQ ID NO: 26648 - protein, 11 aa, Artificial Sequence
  Peptide Derived from Human Papillomavirus
IQPPKLRSTAA

SEQ ID NO: 26649 - protein, 8 aa, Artificial Sequence
  Peptide Derived from Human Papillomavirus
IVKDCGTM

SEQ ID NO: 26650 - protein, 10 aa, Artificial Sequence
  Peptide Derived from Human Papillomavirus
IVKFLRYQQI

SEQ ID NO: 26651 - protein, 8 aa, Artificial Sequence
  Peptide Derived from Human Papillomavirus
KIGMLDDA

SEQ ID NO: 26652 - protein, 9 aa, Artificial Sequence
  Peptide Derived from Human Papillomavirus
KIVKDCGTM

SEQ ID NO: 26653 - protein, 10 aa, Artificial Sequence
  Peptide Derived from Human Papillomavirus
KLLCISTNCM

SEQ ID NO: 26654 - protein, 11 aa, Artificial Sequence
  Peptide Derived from Human Papillomavirus
KLLCISTNCML

SEQ ID NO: 26655 - protein, 9 aa, Artificial Sequence
  Peptide Derived from Human Papillomavirus
KLLEKLLCI

SEQ ID NO: 26656 - protein, 8 aa, Artificial Sequence
  Peptide Derived from Human Papillomavirus
KLRSTAAA

SEQ ID NO: 26657 - protein, 9 aa, Artificial Sequence
  Peptide Derived from Human Papillomavirus
KLRSTAAAL

SEQ ID NO: 26658 - protein, 10 aa, Artificial Sequence
  Peptide Derived from Human Papillomavirus
KLRSTAAALY

SEQ ID NO: 26659 - protein, 11 aa, Artificial Sequence
  Peptide Derived from Human Papillomavirus
KLRSTAAALYW

SEQ ID NO: 26660 - protein, 8 aa, Artificial Sequence
  Peptide Derived from Human Papillomavirus
KVSDEGDW

SEQ ID NO: 26661 - protein, 11 aa, Artificial Sequence
  Peptide Derived from Human Papillomavirus
KVSDEGDWRDI

SEQ ID NO: 26662 - protein, 11 aa, Artificial Sequence
  Peptide Derived from Human Papillomavirus
LIQPPKLRSTA

SEQ ID NO: 26663 - protein, 9 aa, Artificial Sequence
  Peptide Derived from Human Papillomavirus
LISFLQGCI

SEQ ID NO: 26664 - protein, 10 aa, Artificial Sequence
  Peptide Derived from Human Papillomavirus
LISFLQGCII

SEQ ID NO: 26665 - protein, 8 aa, Artificial Sequence
  Peptide Derived from Human Papillomavirus
LITSNINA

SEQ ID NO: 26666 - protein, 9 aa, Artificial Sequence
  Peptide Derived from Human Papillomavirus
LLCISTNCM

SEQ ID NO: 26667 - protein, 10 aa, Artificial Sequence
  Peptide Derived from Human Papillomavirus
LLCISTNCML

SEQ ID NO: 26668 - protein, 11 aa, Artificial Sequence
  Peptide Derived from Human Papillomavirus
LLCISTNCMLI

SEQ ID NO: 26669 - protein, 8 aa, Artificial Sequence
  Peptide Derived from Human Papillomavirus
LLEKLLCI

SEQ ID NO: 26670 - protein, 9 aa, Artificial Sequence
  Peptide Derived from Human Papillomavirus
LLITSNINA

SEQ ID NO: 26671 - protein, 8 aa, Artificial Sequence
  Peptide Derived from Human Papillomavirus
LLQPYCLY

SEQ ID NO: 26672 - protein, 11 aa, Artificial Sequence
  Peptide Derived from Human Papillomavirus
LLQPYCLYCHL

SEQ ID NO: 26673 - protein, 9 aa, Artificial Sequence
  Peptide Derived from Human Papillomavirus
LMLVRFKCA

SEQ ID NO: 26674 - protein, 9 aa, Artificial Sequence
  Peptide Derived from Human Papillomavirus
LMQLKCPPL

SEQ ID NO: 26675 - protein, 10 aa, Artificial Sequence
  Peptide Derived from Human Papillomavirus
LMQLKCPPLL

SEQ ID NO: 26676 - protein, 11 aa, Artificial Sequence
  Peptide Derived from Human Papillomavirus
LMQLKCPPLLI

SEQ ID NO: 26677 - protein, 11 aa, Artificial Sequence
  Peptide Derived from Human Papillomavirus
LPDSGYGNTEV

SEQ ID NO: 26678 - protein, 8 aa, Artificial Sequence
  Peptide Derived from Human Papillomavirus
LQGCIISY

SEQ ID NO: 26679 - protein, 9 aa, Artificial Sequence
  Peptide Derived from Human Papillomavirus
LQGCIISYA

SEQ ID NO: 26680 - protein, 10 aa, Artificial Sequence
  Peptide Derived from Human Papillomavirus
LQHSFNDTTF

SEQ ID NO: 26681 - protein, 9 aa, Artificial Sequence
  Peptide Derived from Human Papillomavirus
LQPLADAKI

SEQ ID NO: 26682 - protein, 11 aa, Artificial Sequence
  Peptide Derived from Human Papillomavirus
LQPLADAKIGM

SEQ ID NO: 26683 - protein, 10 aa, Artificial Sequence
  Peptide Derived from Human Papillomavirus
LQPYCLYCHL

SEQ ID NO: 26684 - protein, 8 aa, Artificial Sequence
  Peptide Derived from Human Papillomavirus
LQSLACSW

SEQ ID NO: 26685 - protein, 10 aa, Artificial Sequence
  Peptide Derived from Human Papillomavirus
LQSLACSWGM

SEQ ID NO: 26686 - protein, 11 aa, Artificial Sequence
  Peptide Derived from Human Papillomavirus
LQSLACSWGMV

SEQ ID NO: 26687 - protein, 11 aa, Artificial Sequence
  Peptide Derived from Human Papillomavirus
LQVLKTSNGKA

SEQ ID NO: 26688 - protein, 11 aa, Artificial Sequence
  Peptide Derived from Human Papillomavirus
LVRFKCAKNRI

SEQ ID NO: 26689 - protein, 10 aa, Artificial Sequence
  Peptide Derived from Human Papillomavirus
LVVFTFPNPF

SEQ ID NO: 26690 - protein, 10 aa, Artificial Sequence
  Peptide Derived from Human Papillomavirus
MLDDATTPCW

SEQ ID NO: 26691 - protein, 8 aa, Artificial Sequence
  Peptide Derived from Human Papillomavirus
MLGKFKEL

SEQ ID NO: 26692 - protein, 9 aa, Artificial Sequence
  Peptide Derived from Human Papillomavirus
MLGKFKELY

SEQ ID NO: 26693 - protein, 11 aa, Artificial Sequence
  Peptide Derived from Human Papillomavirus
MLGKFKELYGV

SEQ ID NO: 26694 - protein, 8 aa, Artificial Sequence
  Peptide Derived from Human Papillomavirus
MLIQPPKL

SEQ ID NO: 26695 - protein, 10 aa, Artificial Sequence
  Peptide Derived from Human Papillomavirus
MLMLVRFKCA

SEQ ID NO: 26696 - protein, 8 aa, Artificial Sequence
  Peptide Derived from Human Papillomavirus
MLVRFKCA

SEQ ID NO: 26697 - protein, 8 aa, Artificial Sequence
  Peptide Derived from Human Papillomavirus
MQLKCPPL

SEQ ID NO: 26698 - protein, 9 aa, Artificial Sequence
  Peptide Derived from Human Papillomavirus
MQLKCPPLL

SEQ ID NO: 26699 - protein, 10 aa, Artificial Sequence
  Peptide Derived from Human Papillomavirus
MQLKCPPLLI

SEQ ID NO: 26700 - protein, 10 aa, Artificial Sequence
  Peptide Derived from Human Papillomavirus
MVDFIDNCNV

SEQ ID NO: 26701 - protein, 11 aa, Artificial Sequence
  Peptide Derived from Human Papillomavirus
MVDFIDNCNVY

SEQ ID NO: 26702 - protein, 9 aa, Artificial Sequence
  Peptide Derived from Human Papillomavirus
MVMLMLVRF

SEQ ID NO: 26703 - protein, 11 aa, Artificial Sequence
  Peptide Derived from Human Papillomavirus
MVQVEEQQTTL

SEQ ID NO: 26704 - protein, 10 aa, Artificial Sequence
  Peptide Derived from Human Papillomavirus
MVQWAYDNDV

SEQ ID NO: 26705 - protein, 11 aa, Artificial Sequence
  Peptide Derived from Human Papillomavirus
MVQWAYDNDVM

SEQ ID NO: 26706 - protein, 10 aa, Artificial Sequence
  Peptide Derived from Human Papillomavirus
NINAGKDDRW

SEQ ID NO: 26707 - protein, 8 aa, Artificial Sequence
  Peptide Derived from Human Papillomavirus
NISPRLKA

SEQ ID NO: 26708 - protein, 9 aa, Artificial Sequence
  Peptide Derived from Human Papillomavirus
NISPRLKAI

SEQ ID NO: 26709 - protein, 11 aa, Artificial Sequence
  Peptide Derived from Human Papillomavirus
NISPRLKAICI

SEQ ID NO: 26710 - protein, 11 aa, Artificial Sequence
  Peptide Derived from Human Papillomavirus
NPVSIDVKHKA

SEQ ID NO: 26711 - protein, 11 aa, Artificial Sequence
  Peptide Derived from Human Papillomavirus
NPVYELSDKNW

SEQ ID NO: 26712 - protein, 8 aa, Artificial Sequence
  Peptide Derived from Human Papillomavirus
NQAEAETA

SEQ ID NO: 26713 - protein, 10 aa, Artificial Sequence
  Peptide Derived from Human Papillomavirus
NQAEAETAQA

SEQ ID NO: 26714 - protein, 11 aa, Artificial Sequence
  Peptide Derived from Human Papillomavirus
NQAEAETAQAL

SEQ ID NO: 26715 - protein, 9 aa, Artificial Sequence
  Peptide Derived from Human Papillomavirus
NVYNNQAEA

SEQ ID NO: 26716 - protein, 9 aa, Artificial Sequence
  Peptide Derived from Human Papillomavirus
PLADAKIGM

SEQ ID NO: 26717 - protein, 10 aa, Artificial Sequence
  Peptide Derived from Human Papillomavirus
PLADAKIGML

SEQ ID NO: 26718 - protein, 8 aa, Artificial Sequence
  Peptide Derived from Human Papillomavirus
PLLITSNI

SEQ ID NO: 26719 - protein, 10 aa, Artificial Sequence
  Peptide Derived from Human Papillomavirus
PLLITSNINA

SEQ ID NO: 26720 - protein, 9 aa, Artificial Sequence
  Peptide Derived from Human Papillomavirus
PLSDISSCV

SEQ ID NO: 26721 - protein, 11 aa, Artificial Sequence
  Peptide Derived from Human Papillomavirus
PLSDISSCVDY

SEQ ID NO: 26722 - protein, 8 aa, Artificial Sequence
  Peptide Derived from Human Papillomavirus
PPKLRSTA

SEQ ID NO: 26723 - protein, 9 aa, Artificial Sequence
  Peptide Derived from Human Papillomavirus
PPKLRSTAA

SEQ ID NO: 26724 - protein, 10 aa, Artificial Sequence
  Peptide Derived from Human Papillomavirus
PPKLRSTAAA

SEQ ID NO: 26725 - protein, 11 aa, Artificial Sequence
  Peptide Derived from Human Papillomavirus
PPKLRSTAAAL

SEQ ID NO: 26726 - protein, 9 aa, Artificial Sequence
  Peptide Derived from Human Papillomavirus
PPLLITSNI

SEQ ID NO: 26727 - protein, 11 aa, Artificial Sequence
  Peptide Derived from Human Papillomavirus
PPLLITSNINA

SEQ ID NO: 26728 - protein, 10 aa, Artificial Sequence
  Peptide Derived from Human Papillomavirus
PVSIDVKHKA

SEQ ID NO: 26729 - protein, 11 aa, Artificial Sequence
  Peptide Derived from Human Papillomavirus
PVSIDVKHKAL

SEQ ID NO: 26730 - protein, 10 aa, Artificial Sequence
  Peptide Derived from Human Papillomavirus
PVYELSDKNW

SEQ ID NO: 26731 - protein, 8 aa, Artificial Sequence
  Peptide Derived from Human Papillomavirus
QIEFVSFL

SEQ ID NO: 26732 - protein, 10 aa, Artificial Sequence
  Peptide Derived from Human Papillomavirus
QIEFVSFLSA

SEQ ID NO: 26733 - protein, 11 aa, Artificial Sequence
  Peptide Derived from Human Papillomavirus
QIEFVSFLSAL

SEQ ID NO: 26734 - protein, 9 aa, Artificial Sequence
  Peptide Derived from Human Papillomavirus
QLADSDSNA

SEQ ID NO: 26735 - protein, 11 aa, Artificial Sequence
  Peptide Derived from Human Papillomavirus
QLADSDSNACA

SEQ ID NO: 26736 - protein, 8 aa, Artificial Sequence
  Peptide Derived from Human Papillomavirus
QLKCPPLL

SEQ ID NO: 26737 - protein, 9 aa, Artificial Sequence
  Peptide Derived from Human Papillomavirus
QLKCPPLLI

SEQ ID NO: 26738 - protein, 8 aa, Artificial Sequence
  Peptide Derived from Human Papillomavirus
QMSMGQWI

SEQ ID NO: 26739 - protein, 11 aa, Artificial Sequence
  Peptide Derived from Human Papillomavirus
QMVQWAYDNDV

SEQ ID NO: 26740 - protein, 8 aa, Artificial Sequence
  Peptide Derived from Human Papillomavirus
QPLADAKI

SEQ ID NO: 26741 - protein, 10 aa, Artificial Sequence
  Peptide Derived from Human Papillomavirus
QPLADAKIGM

SEQ ID NO: 26742 - protein, 11 aa, Artificial Sequence
  Peptide Derived from Human Papillomavirus
QPLADAKIGML

SEQ ID NO: 26743 - protein, 9 aa, Artificial Sequence
  Peptide Derived from Human Papillomavirus
QPPKLRSTA

SEQ ID NO: 26744 - protein, 10 aa, Artificial Sequence
  Peptide Derived from Human Papillomavirus
QPPKLRSTAA

SEQ ID NO: 26745 - protein, 11 aa, Artificial Sequence
  Peptide Derived from Human Papillomavirus
QPPKLRSTAAA

SEQ ID NO: 26746 - protein, 9 aa, Artificial Sequence
  Peptide Derived from Human Papillomavirus
QPYCLYCHL

SEQ ID NO: 26747 - protein, 8 aa, Artificial Sequence
  Peptide Derived from Human Papillomavirus
QQIEFVSF

SEQ ID NO: 26748 - protein, 9 aa, Artificial Sequence
  Peptide Derived from Human Papillomavirus
QQIEFVSFL

SEQ ID NO: 26749 - protein, 11 aa, Artificial Sequence
  Peptide Derived from Human Papillomavirus
QQIEFVSFLSA

SEQ ID NO: 26750 - protein, 9 aa, Artificial Sequence
  Peptide Derived from Human Papillomavirus
QVEEQQTTL

SEQ ID NO: 26751 - protein, 8 aa, Artificial Sequence
  Peptide Derived from Human Papillomavirus
QVLKRKYV

SEQ ID NO: 26752 - protein, 10 aa, Artificial Sequence
  Peptide Derived from Human Papillomavirus
QVLKTSNGKA

SEQ ID NO: 26753 - protein, 11 aa, Artificial Sequence
  Peptide Derived from Human Papillomavirus
QVLKTSNGKAA

SEQ ID NO: 26754 - protein, 8 aa, Artificial Sequence
  Peptide Derived from Human Papillomavirus
RITIEKLL

SEQ ID NO: 26755 - protein, 11 aa, Artificial Sequence
  Peptide Derived from Human Papillomavirus
RITIEKLLEKL

SEQ ID NO: 26756 - protein, 10 aa, Artificial Sequence
  Peptide Derived from Human Papillomavirus
RLFELPDSGY

SEQ ID NO: 26757 - protein, 11 aa, Artificial Sequence
  Peptide Derived from Human Papillomavirus
RLVVFTFPNPF

SEQ ID NO: 26758 - protein, 8 aa, Artificial Sequence
  Peptide Derived from Human Papillomavirus
RQMSMGQW

SEQ ID NO: 26759 - protein, 9 aa, Artificial Sequence
  Peptide Derived from Human Papillomavirus
RQMSMGQWI

SEQ ID NO: 26760 - protein, 9 aa, Artificial Sequence
  Peptide Derived from Human Papillomavirus
RQTVLQHSF

SEQ ID NO: 26761 - protein, 8 aa, Artificial Sequence
  Peptide Derived from Human Papillomavirus
SIDVKHKA

SEQ ID NO: 26762 - protein, 9 aa, Artificial Sequence
  Peptide Derived from Human Papillomavirus
SIDVKHKAL

SEQ ID NO: 26763 - protein, 10 aa, Artificial Sequence
  Peptide Derived from Human Papillomavirus
SIDVKHKALM

SEQ ID NO: 26764 - protein, 8 aa, Artificial Sequence
  Peptide Derived from Human Papillomavirus
SLACSWGM

SEQ ID NO: 26765 - protein, 9 aa, Artificial Sequence
  Peptide Derived from Human Papillomavirus
SLACSWGMV

SEQ ID NO: 26766 - protein, 10 aa, Artificial Sequence
  Peptide Derived from Human Papillomavirus
SLACSWGMVM

SEQ ID NO: 26767 - protein, 11 aa, Artificial Sequence
  Peptide Derived from Human Papillomavirus
SLACSWGMVML

SEQ ID NO: 26768 - protein, 10 aa, Artificial Sequence
  Peptide Derived from Human Papillomavirus
SLISFLQGCI

SEQ ID NO: 26769 - protein, 11 aa, Artificial Sequence
  Peptide Derived from Human Papillomavirus
SLISFLQGCII

SEQ ID NO: 26770 - protein, 10 aa, Artificial Sequence
  Peptide Derived from Human Papillomavirus
SPLSDISSCV

SEQ ID NO: 26771 - protein, 9 aa, Artificial Sequence
  Peptide Derived from Human Papillomavirus
SPRLKAICI

SEQ ID NO: 26772 - protein, 8 aa, Artificial Sequence
  Peptide Derived from Human Papillomavirus
SQMVQWAY

SEQ ID NO: 26773 - protein, 9 aa, Artificial Sequence
  Peptide Derived from Human Papillomavirus
TIEKLLEKL

SEQ ID NO: 26774 - protein, 10 aa, Artificial Sequence
  Peptide Derived from Human Papillomavirus
TIEKLLEKLL

SEQ ID NO: 26775 - protein, 8 aa, Artificial Sequence
  Peptide Derived from Human Papillomavirus
TLLQPYCL

SEQ ID NO: 26776 - protein, 9 aa, Artificial Sequence
  Peptide Derived from Human Papillomavirus
TLLQPYCLY

SEQ ID NO: 26777 - protein, 9 aa, Artificial Sequence
  Peptide Derived from Human Papillomavirus
TMCRHYKRA

SEQ ID NO: 26778 - protein, 10 aa, Artificial Sequence
  Peptide Derived from Human Papillomavirus
TPCWHYIDNY

SEQ ID NO: 26779 - protein, 11 aa, Artificial Sequence
  Peptide Derived from Human Papillomavirus
TPCWHYIDNYL

SEQ ID NO: 26780 - protein, 10 aa, Artificial Sequence
  Peptide Derived from Human Papillomavirus
TPEWIERQTV

SEQ ID NO: 26781 - protein, 11 aa, Artificial Sequence
  Peptide Derived from Human Papillomavirus
TPEWIERQTVL

SEQ ID NO: 26782 - protein, 9 aa, Artificial Sequence
  Peptide Derived from Human Papillomavirus
TPTRNILQV

SEQ ID NO: 26783 - protein, 10 aa, Artificial Sequence
  Peptide Derived from Human Papillomavirus
TPTRNILQVL

SEQ ID NO: 26784 - protein, 9 aa, Artificial Sequence
  Peptide Derived from Human Papillomavirus
TVAEGFKTL

SEQ ID NO: 26785 - protein, 10 aa, Artificial Sequence
  Peptide Derived from Human Papillomavirus
TVAEGFKTLL

SEQ ID NO: 26786 - protein, 10 aa, Artificial Sequence
  Peptide Derived from Human Papillomavirus
VIDRQTGDNI

SEQ ID NO: 26787 - protein, 11 aa, Artificial Sequence
  Peptide Derived from Human Papillomavirus
VLKRKYVGSPL

SEQ ID NO: 26788 - protein, 9 aa, Artificial Sequence
  Peptide Derived from Human Papillomavirus
VLKTSNGKA

SEQ ID NO: 26789 - protein, 10 aa, Artificial Sequence
  Peptide Derived from Human Papillomavirus
VLKTSNGKAA

SEQ ID NO: 26790 - protein, 11 aa, Artificial Sequence
  Peptide Derived from Human Papillomavirus
VLKTSNGKAAM

SEQ ID NO: 26791 - protein, 11 aa, Artificial Sequence
  Peptide Derived from Human Papillomavirus
VLQHSFNDTTF

SEQ ID NO: 26792 - protein, 8 aa, Artificial Sequence
  Peptide Derived from Human Papillomavirus
VMDDSEIA

SEQ ID NO: 26793 - protein, 9 aa, Artificial Sequence
  Peptide Derived from Human Papillomavirus
VMDDSEIAY

SEQ ID NO: 26794 - protein, 11 aa, Artificial Sequence
  Peptide Derived from Human Papillomavirus
VMDDSEIAYKY

SEQ ID NO: 26795 - protein, 8 aa, Artificial Sequence
  Peptide Derived from Human Papillomavirus
VMLMLVRF

SEQ ID NO: 26796 - protein, 11 aa, Artificial Sequence
  Peptide Derived from Human Papillomavirus
VMLMLVRFKCA

SEQ ID NO: 26797 - protein, 8 aa, Artificial Sequence
  Peptide Derived from Human Papillomavirus
VPKKNCIL

SEQ ID NO: 26798 - protein, 9 aa, Artificial Sequence
  Peptide Derived from Human Papillomavirus
VPKKNCILI

SEQ ID NO: 26799 - protein, 10 aa, Artificial Sequence
  Peptide Derived from Human Papillomavirus
VQVEEQQTTL

SEQ ID NO: 26800 - protein, 8 aa, Artificial Sequence
  Peptide Derived from Human Papillomavirus
VQVLKRKY

SEQ ID NO: 26801 - protein, 9 aa, Artificial Sequence
  Peptide Derived from Human Papillomavirus
VQVLKRKYV

SEQ ID NO: 26802 - protein, 9 aa, Artificial Sequence
  Peptide Derived from Human Papillomavirus
VQWAYDNDV

SEQ ID NO: 26803 - protein, 10 aa, Artificial Sequence
  Peptide Derived from Human Papillomavirus
VQWAYDNDVM

SEQ ID NO: 26804 - protein, 9 aa, Artificial Sequence
  Peptide Derived from Human Papillomavirus
VVFTFPNPF

SEQ ID NO: 26805 - protein, 11 aa, Artificial Sequence
  Peptide Derived from Human Papillomavirus
VVFTFPNPFPF

SEQ ID NO: 26806 - protein, 8 aa, Artificial Sequence
  Peptide Derived from Human Papillomavirus
WIERQTVL

SEQ ID NO: 26807 - protein, 9 aa, Artificial Sequence
  Peptide Derived from Human Papillomavirus
WIKSRCDKV

SEQ ID NO: 26808 - protein, 8 aa, Artificial Sequence
  Peptide Derived from Human Papillomavirus
WLQPLADA

SEQ ID NO: 26809 - protein, 10 aa, Artificial Sequence
  Peptide Derived from Human Papillomavirus
WLQPLADAKI

SEQ ID NO: 26810 - protein, 8 aa, Artificial Sequence
  Peptide Derived from Human Papillomavirus
WPYLHSRL

SEQ ID NO: 26811 - protein, 9 aa, Artificial Sequence
  Peptide Derived from Human Papillomavirus
WPYLHSRLV

SEQ ID NO: 26812 - protein, 10 aa, Artificial Sequence
  Peptide Derived from Human Papillomavirus
WPYLHSRLVV

SEQ ID NO: 26813 - protein, 11 aa, Artificial Sequence
  Peptide Derived from Human Papillomavirus
WPYLHSRLVVF

SEQ ID NO: 26814 - protein, 9 aa, Artificial Sequence
  Peptide Derived from Human Papillomavirus
YIDNYLRNA

SEQ ID NO: 26815 - protein, 10 aa, Artificial Sequence
  Peptide Derived from Human Papillomavirus
YIDNYLRNAL

SEQ ID NO: 26816 - protein, 8 aa, Artificial Sequence
  Peptide Derived from Human Papillomavirus
YLHSRLVV

SEQ ID NO: 26817 - protein, 9 aa, Artificial Sequence
  Peptide Derived from Human Papillomavirus
YLHSRLVVF

SEQ ID NO: 26818 - protein, 11 aa, Artificial Sequence
  Peptide Derived from Human Papillomavirus
YLHSRLVVFTF

SEQ ID NO: 26819 - protein, 11 aa, Artificial Sequence
  Peptide Derived from Human Papillomavirus
YLRNALDGNPV

SEQ ID NO: 26820 - protein, 9 aa, Artificial Sequence
  Peptide Derived from Human Papillomavirus
YQQIEFVSF

SEQ ID NO: 26821 - protein, 10 aa, Artificial Sequence
  Peptide Derived from Human Papillomavirus
YQQIEFVSFL

SEQ ID NO: 26822 - protein, 9 aa, Artificial Sequence
  Peptide Derived from Human Papillomavirus
YVGSPLSDI

SEQ ID NO: 26823 - protein, 8 aa, Artificial Sequence
  Peptide Derived from Human Papillomavirus
AIELQMML

SEQ ID NO: 26824 - protein, 11 aa, Artificial Sequence
  Peptide Derived from Human Papillomavirus
AIELQMMLETL

SEQ ID NO: 26825 - protein, 8 aa, Artificial Sequence
  Peptide Derived from Human Papillomavirus
AIVTLTYI

SEQ ID NO: 26826 - protein, 8 aa, Artificial Sequence
  Peptide Derived from Human Papillomavirus
ALGTSEGV

SEQ ID NO: 26827 - protein, 11 aa, Artificial Sequence
  Peptide Derived from Human Papillomavirus
ALGTSEGVRRA

SEQ ID NO: 26828 - protein, 9 aa, Artificial Sequence
  Peptide Derived from Human Papillomavirus
ALQAIELQM

SEQ ID NO: 26829 - protein, 10 aa, Artificial Sequence
  Peptide Derived from Human Papillomavirus
ALQAIELQMM

SEQ ID NO: 26830 - protein, 11 aa, Artificial Sequence
  Peptide Derived from Human Papillomavirus
ALQAIELQMML

SEQ ID NO: 26831 - protein, 9 aa, Artificial Sequence
  Peptide Derived from Human Papillomavirus
ALSVSKAKA

SEQ ID NO: 26832 - protein, 10 aa, Artificial Sequence
  Peptide Derived from Human Papillomavirus
ALSVSKAKAL

SEQ ID NO: 26833 - protein, 11 aa, Artificial Sequence
  Peptide Derived from Human Papillomavirus
APTGCLKKHGY

SEQ ID NO: 26834 - protein, 10 aa, Artificial Sequence
  Peptide Derived from Human Papillomavirus
AVSCPATTPI

SEQ ID NO: 26835 - protein, 11 aa, Artificial Sequence
  Peptide Derived from Human Papillomavirus
AVSCPATTPII

SEQ ID NO: 26836 - protein, 8 aa, Artificial Sequence
  Peptide Derived from Human Papillomavirus
CIDGQCTV

SEQ ID NO: 26837 - protein, 9 aa, Artificial Sequence
  Peptide Derived from Human Papillomavirus
CIDGQCTVV

SEQ ID NO: 26838 - protein, 9 aa, Artificial Sequence
  Peptide Derived from Human Papillomavirus
CLKKHGYTV

SEQ ID NO: 26839 - protein, 11 aa, Artificial Sequence
  Peptide Derived from Human Papillomavirus
CLKKHGYTVEV

SEQ ID NO: 26840 - protein, 9 aa, Artificial Sequence
  Peptide Derived from Human Papillomavirus
CLRYRLSKY

SEQ ID NO: 26841 - protein, 8 aa, Artificial Sequence
  Peptide Derived from Human Papillomavirus
CPATTPII

SEQ ID NO: 26842 - protein, 10 aa, Artificial Sequence
  Peptide Derived from Human Papillomavirus
CPATTPIIHL

SEQ ID NO: 26843 - protein, 9 aa, Artificial Sequence
  Peptide Derived from Human Papillomavirus
CQDKILEHY

SEQ ID NO: 26844 - protein, 10 aa, Artificial Sequence
  Peptide Derived from Human Papillomavirus
CVLMYKAREM

SEQ ID NO: 26845 - protein, 8 aa, Artificial Sequence
  Peptide Derived from Human Papillomavirus
DVHNTMHY

SEQ ID NO: 26846 - protein, 11 aa, Artificial Sequence
  Peptide Derived from Human Papillomavirus
DVHNTMHYTNW

SEQ ID NO: 26847 - protein, 8 aa, Artificial Sequence
  Peptide Derived from Human Papillomavirus
EISFAGIV

SEQ ID NO: 26848 - protein, 11 aa, Artificial Sequence
  Peptide Derived from Human Papillomavirus
EISFAGIVTKL

SEQ ID NO: 26849 - protein, 9 aa, Artificial Sequence
  Peptide Derived from Human Papillomavirus
ELQMMLETL

SEQ ID NO: 26850 - protein, 11 aa, Artificial Sequence
  Peptide Derived from Human Papillomavirus
ELYLTAPTGCL

SEQ ID NO: 26851 - protein, 11 aa, Artificial Sequence
  Peptide Derived from Human Papillomavirus
EMGIHSINHQV

SEQ ID NO: 26852 - protein, 9 aa, Artificial Sequence
  Peptide Derived from Human Papillomavirus
EQVSSTWHW

SEQ ID NO: 26853 - protein, 8 aa, Artificial Sequence
  Peptide Derived from Human Papillomavirus
EVHAGGQV

SEQ ID NO: 26854 - protein, 9 aa, Artificial Sequence
  Peptide Derived from Human Papillomavirus
EVHAGGQVI

SEQ ID NO: 26855 - protein, 10 aa, Artificial Sequence
  Peptide Derived from Human Papillomavirus
EVHAGGQVIV

SEQ ID NO: 26856 - protein, 11 aa, Artificial Sequence
  Peptide Derived from Human Papillomavirus
EVHAGGQVIVF

SEQ ID NO: 26857 - protein, 8 aa, Artificial Sequence
  Peptide Derived from Human Papillomavirus
EVQFDGDV

SEQ ID NO: 26858 - protein, 11 aa, Artificial Sequence
  Peptide Derived from Human Papillomavirus
FLNTVKIPNTV

SEQ ID NO: 26859 - protein, 11 aa, Artificial Sequence
  Peptide Derived from Human Papillomavirus
FPESVFSSDEI

SEQ ID NO: 26860 - protein, 8 aa, Artificial Sequence
  Peptide Derived from Human Papillomavirus
FVNFTEEA

SEQ ID NO: 26861 - protein, 11 aa, Artificial Sequence
  Peptide Derived from Human Papillomavirus
FVNFTEEAKKY

SEQ ID NO: 26862 - protein, 9 aa, Artificial Sequence
  Peptide Derived from Human Papillomavirus
GIHSINHQV

SEQ ID NO: 26863 - protein, 10 aa, Artificial Sequence
  Peptide Derived from Human Papillomavirus
GIHSINHQVV

SEQ ID NO: 26864 - protein, 9 aa, Artificial Sequence
  Peptide Derived from Human Papillomavirus
GIVTKLPTA

SEQ ID NO: 26865 - protein, 10 aa, Artificial Sequence
  Peptide Derived from Human Papillomavirus
GIYYVHEGHI

SEQ ID NO: 26866 - protein, 10 aa, Artificial Sequence
  Peptide Derived from Human Papillomavirus
GQCTVVEGQV

SEQ ID NO: 26867 - protein, 10 aa, Artificial Sequence
  Peptide Derived from Human Papillomavirus
GQVIVFPESV

SEQ ID NO: 26868 - protein, 11 aa, Artificial Sequence
  Peptide Derived from Human Papillomavirus
GQVIVFPESVF

SEQ ID NO: 26869 - protein, 8 aa, Artificial Sequence
  Peptide Derived from Human Papillomavirus
GQVNCKGI

SEQ ID NO: 26870 - protein, 9 aa, Artificial Sequence
  Peptide Derived from Human Papillomavirus
GQVNCKGIY

SEQ ID NO: 26871 - protein, 10 aa, Artificial Sequence
  Peptide Derived from Human Papillomavirus
GQVNCKGIYY

SEQ ID NO: 26872 - protein, 11 aa, Artificial Sequence
  Peptide Derived from Human Papillomavirus
GQVNCKGIYYV

SEQ ID NO: 26873 - protein, 8 aa, Artificial Sequence
  Peptide Derived from Human Papillomavirus
HIDYWKHI

SEQ ID NO: 26874 - protein, 10 aa, Artificial Sequence
  Peptide Derived from Human Papillomavirus
HIDYWKHIRL

SEQ ID NO: 26875 - protein, 8 aa, Artificial Sequence
  Peptide Derived from Human Papillomavirus
HIRLECVL

SEQ ID NO: 26876 - protein, 9 aa, Artificial Sequence
  Peptide Derived from Human Papillomavirus
HIRLECVLM

SEQ ID NO: 26877 - protein, 10 aa, Artificial Sequence
  Peptide Derived from Human Papillomavirus
HIRLECVLMY

SEQ ID NO: 26878 - protein, 8 aa, Artificial Sequence
  Peptide Derived from Human Papillomavirus
HITYFVNF

SEQ ID NO: 26879 - protein, 8 aa, Artificial Sequence
  Peptide Derived from Human Papillomavirus
HLKGDANI

SEQ ID NO: 26880 - protein, 9 aa, Artificial Sequence
  Peptide Derived from Human Papillomavirus
HLKGDANIL

SEQ ID NO: 26881 - protein, 11 aa, Artificial Sequence
  Peptide Derived from Human Papillomavirus
HPNKLLRGDSV

SEQ ID NO: 26882 - protein, 9 aa, Artificial Sequence
  Peptide Derived from Human Papillomavirus
HQVVPALSV

SEQ ID NO: 26883 - protein, 8 aa, Artificial Sequence
  Peptide Derived from Human Papillomavirus
IIHLKGDA

SEQ ID NO: 26884 - protein, 10 aa, Artificial Sequence
  Peptide Derived from Human Papillomavirus
IIHLKGDANI

SEQ ID NO: 26885 - protein, 11 aa, Artificial Sequence
  Peptide Derived from Human Papillomavirus
IIHLKGDANIL

SEQ ID NO: 26886 - protein, 9 aa, Artificial Sequence
  Peptide Derived from Human Papillomavirus
ILKCLRYRL

SEQ ID NO: 26887 - protein, 11 aa, Artificial Sequence
  Peptide Derived from Human Papillomavirus
IPNTVSVSTGY

SEQ ID NO: 26888 - protein, 8 aa, Artificial Sequence
  Peptide Derived from Human Papillomavirus
IVFPESVF

SEQ ID NO: 26889 - protein, 8 aa, Artificial Sequence
  Peptide Derived from Human Papillomavirus
IVTKLPTA

SEQ ID NO: 26890 - protein, 8 aa, Artificial Sequence
  Peptide Derived from Human Papillomavirus
KIPNTVSV

SEQ ID NO: 26891 - protein, 8 aa, Artificial Sequence
  Peptide Derived from Human Papillomavirus
KLLRGDSV

SEQ ID NO: 26892 - protein, 11 aa, Artificial Sequence
  Peptide Derived from Human Papillomavirus
KLLRGDSVDSV

SEQ ID NO: 26893 - protein, 11 aa, Artificial Sequence
  Peptide Derived from Human Papillomavirus
KQLYEQVSSTW

SEQ ID NO: 26894 - protein, 10 aa, Artificial Sequence
  Peptide Derived from Human Papillomavirus
LLRGDSVDSV

SEQ ID NO: 26895 - protein, 8 aa, Artificial Sequence
  Peptide Derived from Human Papillomavirus
LMYKAREM

SEQ ID NO: 26896 - protein, 10 aa, Artificial Sequence
  Peptide Derived from Human Papillomavirus
LMYKAREMGI

SEQ ID NO: 26897 - protein, 8 aa, Artificial Sequence
  Peptide Derived from Human Papillomavirus
LQAIELQM

SEQ ID NO: 26898 - protein, 9 aa, Artificial Sequence
  Peptide Derived from Human Papillomavirus
LQAIELQMM

SEQ ID NO: 26899 - protein, 10 aa, Artificial Sequence
  Peptide Derived from Human Papillomavirus
LQAIELQMML

SEQ ID NO: 26900 - protein, 8 aa, Artificial Sequence
  Peptide Derived from Human Papillomavirus
LQMMLETL

SEQ ID NO: 26901 - protein, 10 aa, Artificial Sequence
  Peptide Derived from Human Papillomavirus
MLETLNNTEY

SEQ ID NO: 26902 - protein, 11 aa, Artificial Sequence
  Peptide Derived from Human Papillomavirus
MMLETLNNTEY

SEQ ID NO: 26903 - protein, 8 aa, Artificial Sequence
  Peptide Derived from Human Papillomavirus
MQQTSLEL

SEQ ID NO: 26904 - protein, 9 aa, Artificial Sequence
  Peptide Derived from Human Papillomavirus
MQQTSLELY

SEQ ID NO: 26905 - protein, 10 aa, Artificial Sequence
  Peptide Derived from Human Papillomavirus
MQQTSLELYL

SEQ ID NO: 26906 - protein, 8 aa, Artificial Sequence
  Peptide Derived from Human Papillomavirus
NILKCLRY

SEQ ID NO: 26907 - protein, 10 aa, Artificial Sequence
  Peptide Derived from Human Papillomavirus
NILKCLRYRL

SEQ ID NO: 26908 - protein, 10 aa, Artificial Sequence
  Peptide Derived from Human Papillomavirus
NQTRAVSCPA

SEQ ID NO: 26909 - protein, 8 aa, Artificial Sequence
  Peptide Derived from Human Papillomavirus
NVCQDKIL

SEQ ID NO: 26910 - protein, 11 aa, Artificial Sequence
  Peptide Derived from Human Papillomavirus
NVCQDKILEHY

SEQ ID NO: 26911 - protein, 9 aa, Artificial Sequence
  Peptide Derived from Human Papillomavirus
PIIHLKGDA

SEQ ID NO: 26912 - protein, 11 aa, Artificial Sequence
  Peptide Derived from Human Papillomavirus
PIIHLKGDANI

SEQ ID NO: 26913 - protein, 10 aa, Artificial Sequence
  Peptide Derived from Human Papillomavirus
QLYEQVSSTW

SEQ ID NO: 26914 - protein, 8 aa, Artificial Sequence
  Peptide Derived from Human Papillomavirus
QQTSLELY

SEQ ID NO: 26915 - protein, 9 aa, Artificial Sequence
  Peptide Derived from Human Papillomavirus
QQTSLELYL

SEQ ID NO: 26916 - protein, 11 aa, Artificial Sequence
  Peptide Derived from Human Papillomavirus
QQTSLELYLTA

SEQ ID NO: 26917 - protein, 9 aa, Artificial Sequence
  Peptide Derived from Human Papillomavirus
QVIVFPESV

SEQ ID NO: 26918 - protein, 10 aa, Artificial Sequence
  Peptide Derived from Human Papillomavirus
QVIVFPESVF

SEQ ID NO: 26919 - protein, 8 aa, Artificial Sequence
  Peptide Derived from Human Papillomavirus
QVNCKGIY

SEQ ID NO: 26920 - protein, 9 aa, Artificial Sequence
  Peptide Derived from Human Papillomavirus
QVNCKGIYY

SEQ ID NO: 26921 - protein, 10 aa, Artificial Sequence
  Peptide Derived from Human Papillomavirus
QVNCKGIYYV

SEQ ID NO: 26922 - protein, 8 aa, Artificial Sequence
  Peptide Derived from Human Papillomavirus
QVSSTWHW

SEQ ID NO: 26923 - protein, 8 aa, Artificial Sequence
  Peptide Derived from Human Papillomavirus
QVVPALSV

SEQ ID NO: 26924 - protein, 11 aa, Artificial Sequence
  Peptide Derived from Human Papillomavirus
QVVPALSVSKA

SEQ ID NO: 26925 - protein, 8 aa, Artificial Sequence
  Peptide Derived from Human Papillomavirus
RLCDHIDY

SEQ ID NO: 26926 - protein, 9 aa, Artificial Sequence
  Peptide Derived from Human Papillomavirus
RLCDHIDYW

SEQ ID NO: 26927 - protein, 8 aa, Artificial Sequence
  Peptide Derived from Human Papillomavirus
RLECVLMY

SEQ ID NO: 26928 - protein, 10 aa, Artificial Sequence
  Peptide Derived from Human Papillomavirus
RLECVLMYKA

SEQ ID NO: 26929 - protein, 9 aa, Artificial Sequence
  Peptide Derived from Human Papillomavirus
RLNVCQDKI

SEQ ID NO: 26930 - protein, 10 aa, Artificial Sequence
  Peptide Derived from Human Papillomavirus
RLNVCQDKIL

SEQ ID NO: 26931 - protein, 8 aa, Artificial Sequence
  Peptide Derived from Human Papillomavirus
RLSKYKQL

SEQ ID NO: 26932 - protein, 9 aa, Artificial Sequence
  Peptide Derived from Human Papillomavirus
RLSKYKQLY

SEQ ID NO: 26933 - protein, 9 aa, Artificial Sequence
  Peptide Derived from Human Papillomavirus
SINHQVVPA

SEQ ID NO: 26934 - protein, 10 aa, Artificial Sequence
  Peptide Derived from Human Papillomavirus
SINHQVVPAL

SEQ ID NO: 26935 - protein, 8 aa, Artificial Sequence
  Peptide Derived from Human Papillomavirus
SLELYLTA

SEQ ID NO: 26936 - protein, 10 aa, Artificial Sequence
  Peptide Derived from Human Papillomavirus
SQRDDFLNTV

SEQ ID NO: 26937 - protein, 11 aa, Artificial Sequence
  Peptide Derived from Human Papillomavirus
SQRLNVCQDKI

SEQ ID NO: 26938 - protein, 9 aa, Artificial Sequence
  Peptide Derived from Human Papillomavirus
SVDSVNCGV

SEQ ID NO: 26939 - protein, 10 aa, Artificial Sequence
  Peptide Derived from Human Papillomavirus
SVDSVNCGVI

SEQ ID NO: 26940 - protein, 8 aa, Artificial Sequence
  Peptide Derived from Human Papillomavirus
SVFSSDEI

SEQ ID NO: 26941 - protein, 10 aa, Artificial Sequence
  Peptide Derived from Human Papillomavirus
SVFSSDEISF

SEQ ID NO: 26942 - protein, 11 aa, Artificial Sequence
  Peptide Derived from Human Papillomavirus
SVFSSDEISFA

SEQ ID NO: 26943 - protein, 9 aa, Artificial Sequence
  Peptide Derived from Human Papillomavirus
SVNCGVISA

SEQ ID NO: 26944 - protein, 10 aa, Artificial Sequence
  Peptide Derived from Human Papillomavirus
SVNCGVISAA

SEQ ID NO: 26945 - protein, 11 aa, Artificial Sequence
  Peptide Derived from Human Papillomavirus
SVNCGVISAAA

SEQ ID NO: 26946 - protein, 8 aa, Artificial Sequence
  Peptide Derived from Human Papillomavirus
SVSKAKAL

SEQ ID NO: 26947 - protein, 10 aa, Artificial Sequence
  Peptide Derived from Human Papillomavirus
SVSKAKALQA

SEQ ID NO: 26948 - protein, 11 aa, Artificial Sequence
  Peptide Derived from Human Papillomavirus
SVSKAKALQAI

SEQ ID NO: 26949 - protein, 9 aa, Artificial Sequence
  Peptide Derived from Human Papillomavirus
SVSTGYMTI

SEQ ID NO: 26950 - protein, 8 aa, Artificial Sequence
  Peptide Derived from Human Papillomavirus
TLSQRLNV

SEQ ID NO: 26951 - protein, 9 aa, Artificial Sequence
  Peptide Derived from Human Papillomavirus
TMHYTNWKF

SEQ ID NO: 26952 - protein, 10 aa, Artificial Sequence
  Peptide Derived from Human Papillomavirus
TMHYTNWKFI

SEQ ID NO: 26953 - protein, 11 aa, Artificial Sequence
  Peptide Derived from Human Papillomavirus
TMHYTNWKFIY

SEQ ID NO: 26954 - protein, 9 aa, Artificial Sequence
  Peptide Derived from Human Papillomavirus
TMQQTSLEL

SEQ ID NO: 26955 - protein, 10 aa, Artificial Sequence
  Peptide Derived from Human Papillomavirus
TMQQTSLELY

SEQ ID NO: 26956 - protein, 11 aa, Artificial Sequence
  Peptide Derived from Human Papillomavirus
TMQQTSLELYL

SEQ ID NO: 26957 - protein, 10 aa, Artificial Sequence
  Peptide Derived from Human Papillomavirus
TPIIHLKGDA

SEQ ID NO: 26958 - protein, 10 aa, Artificial Sequence
  Peptide Derived from Human Papillomavirus
TVEVQFDGDV

SEQ ID NO: 26959 - protein, 8 aa, Artificial Sequence
  Peptide Derived from Human Papillomavirus
TVKIPNTV

SEQ ID NO: 26960 - protein, 10 aa, Artificial Sequence
  Peptide Derived from Human Papillomavirus
TVKIPNTVSV

SEQ ID NO: 26961 - protein, 8 aa, Artificial Sequence
  Peptide Derived from Human Papillomavirus
TVSVSTGY

SEQ ID NO: 26962 - protein, 9 aa, Artificial Sequence
  Peptide Derived from Human Papillomavirus
TVSVSTGYM

SEQ ID NO: 26963 - protein, 11 aa, Artificial Sequence
  Peptide Derived from Human Papillomavirus
TVSVSTGYMTI

SEQ ID NO: 26964 - protein, 8 aa, Artificial Sequence
  Peptide Derived from Human Papillomavirus
VIVFPESV

SEQ ID NO: 26965 - protein, 9 aa, Artificial Sequence
  Peptide Derived from Human Papillomavirus
VIVFPESVF

SEQ ID NO: 26966 - protein, 9 aa, Artificial Sequence
  Peptide Derived from Human Papillomavirus
VLMYKAREM

SEQ ID NO: 26967 - protein, 11 aa, Artificial Sequence
  Peptide Derived from Human Papillomavirus
VLMYKAREMGI

SEQ ID NO: 26968 - protein, 9 aa, Artificial Sequence
  Peptide Derived from Human Papillomavirus
VPALSVSKA

SEQ ID NO: 26969 - protein, 11 aa, Artificial Sequence
  Peptide Derived from Human Papillomavirus
VPALSVSKAKA

SEQ ID NO: 26970 - protein, 11 aa, Artificial Sequence
  Peptide Derived from Human Papillomavirus
VQFDGDVHNTM

SEQ ID NO: 26971 - protein, 11 aa, Artificial Sequence
  Peptide Derived from Human Papillomavirus
VVEGQVNCKGI

SEQ ID NO: 26972 - protein, 10 aa, Artificial Sequence
  Peptide Derived from Human Papillomavirus
VVPALSVSKA

SEQ ID NO: 26973 - protein, 10 aa, Artificial Sequence
  Peptide Derived from Human Papillomavirus
YISTSQRDDF

SEQ ID NO: 26974 - protein, 11 aa, Artificial Sequence
  Peptide Derived from Human Papillomavirus
YISTSQRDDFL

SEQ ID NO: 26975 - protein, 10 aa, Artificial Sequence
  Peptide Derived from Human Papillomavirus
YLCIDGQCTV

SEQ ID NO: 26976 - protein, 11 aa, Artificial Sequence
  Peptide Derived from Human Papillomavirus
YLCIDGQCTVV

SEQ ID NO: 26977 - protein, 9 aa, Artificial Sequence
  Peptide Derived from Human Papillomavirus
YLTAPTGCL

SEQ ID NO: 26978 - protein, 9 aa, Artificial Sequence
  Peptide Derived from Human Papillomavirus
YVHEGHITY

SEQ ID NO: 26979 - protein, 10 aa, Artificial Sequence
  Peptide Derived from Human Papillomavirus
YVHEGHITYF

SEQ ID NO: 26980 - protein, 11 aa, Artificial Sequence
  Peptide Derived from Human Papillomavirus
YVHEGHITYFV

SEQ ID NO: 26981 - protein, 8 aa, Artificial Sequence
  Peptide Derived from Human Papillomavirus
CIYVVFIY

SEQ ID NO: 26982 - protein, 9 aa, Artificial Sequence
  Peptide Derived from Human Papillomavirus
CIYVVFIYI

SEQ ID NO: 26983 - protein, 11 aa, Artificial Sequence
  Peptide Derived from Human Papillomavirus
CIYVVFIYIPL

SEQ ID NO: 26984 - protein, 8 aa, Artificial Sequence
  Peptide Derived from Human Papillomavirus
CLVIRPLV

SEQ ID NO: 26985 - protein, 9 aa, Artificial Sequence
  Peptide Derived from Human Papillomavirus
CLVIRPLVL

SEQ ID NO: 26986 - protein, 11 aa, Artificial Sequence
  Peptide Derived from Human Papillomavirus
CLVIRPLVLSV

SEQ ID NO: 26987 - protein, 8 aa, Artificial Sequence
  Peptide Derived from Human Papillomavirus
CVLLFVCL

SEQ ID NO: 26988 - protein, 9 aa, Artificial Sequence
  Peptide Derived from Human Papillomavirus
CVLLFVCLV

SEQ ID NO: 26989 - protein, 10 aa, Artificial Sequence
  Peptide Derived from Human Papillomavirus
CVLLFVCLVI

SEQ ID NO: 26990 - protein, 9 aa, Artificial Sequence
  Peptide Derived from Human Papillomavirus
ELNISTVSI

SEQ ID NO: 26991 - protein, 10 aa, Artificial Sequence
  Peptide Derived from Human Papillomavirus
ELNISTVSIV

SEQ ID NO: 26992 - protein, 11 aa, Artificial Sequence
  Peptide Derived from Human Papillomavirus
ELNISTVSIVL

SEQ ID NO: 26993 - protein, 8 aa, Artificial Sequence
  Peptide Derived from Human Papillomavirus
FIYIPLFV

SEQ ID NO: 26994 - protein, 9 aa, Artificial Sequence
  Peptide Derived from Human Papillomavirus
FIYIPLFVI

SEQ ID NO: 26995 - protein, 8 aa, Artificial Sequence
  Peptide Derived from Human Papillomavirus
FLLCFCVL

SEQ ID NO: 26996 - protein, 9 aa, Artificial Sequence
  Peptide Derived from Human Papillomavirus
FLLCFCVLL

SEQ ID NO: 26997 - protein, 10 aa, Artificial Sequence
  Peptide Derived from Human Papillomavirus
FLLCFCVLLF

SEQ ID NO: 26998 - protein, 11 aa, Artificial Sequence
  Peptide Derived from Human Papillomavirus
FLLCFCVLLFV

SEQ ID NO: 26999 - protein, 9 aa, Artificial Sequence
  Peptide Derived from Human Papillomavirus
FVCLVIRPL

SEQ ID NO: 27000 - protein, 10 aa, Artificial Sequence
  Peptide Derived from Human Papillomavirus
FVCLVIRPLV

SEQ ID NO: 27001 - protein, 11 aa, Artificial Sequence
  Peptide Derived from Human Papillomavirus
FVCLVIRPLVL

SEQ ID NO: 27002 - protein, 9 aa, Artificial Sequence
  Peptide Derived from Human Papillomavirus
FVIHTHASF

SEQ ID NO: 27003 - protein, 10 aa, Artificial Sequence
  Peptide Derived from Human Papillomavirus
FVIHTHASFL

SEQ ID NO: 27004 - protein, 10 aa, Artificial Sequence
  Peptide Derived from Human Papillomavirus
ILWVIATSPL

SEQ ID NO: 27005 - protein, 10 aa, Artificial Sequence
  Peptide Derived from Human Papillomavirus
IPLFVIHTHA

SEQ ID NO: 27006 - protein, 8 aa, Artificial Sequence
  Peptide Derived from Human Papillomavirus
IVILWVIA

SEQ ID NO: 27007 - protein, 9 aa, Artificial Sequence
  Peptide Derived from Human Papillomavirus
IVLCFLLCF

SEQ ID NO: 27008 - protein, 11 aa, Artificial Sequence
  Peptide Derived from Human Papillomavirus
IVLCFLLCFCV

SEQ ID NO: 27009 - protein, 8 aa, Artificial Sequence
  Peptide Derived from Human Papillomavirus
LIVILWVI

SEQ ID NO: 27010 - protein, 9 aa, Artificial Sequence
  Peptide Derived from Human Papillomavirus
LIVILWVIA

SEQ ID NO: 27011 - protein, 8 aa, Artificial Sequence
  Peptide Derived from Human Papillomavirus
LLCFCVLL

SEQ ID NO: 27012 - protein, 9 aa, Artificial Sequence
  Peptide Derived from Human Papillomavirus
LLCFCVLLF

SEQ ID NO: 27013 - protein, 10 aa, Artificial Sequence
  Peptide Derived from Human Papillomavirus
LLCFCVLLFV

SEQ ID NO: 27014 - protein, 8 aa, Artificial Sequence
  Peptide Derived from Human Papillomavirus
LLFVCLVI

SEQ ID NO: 27015 - protein, 11 aa, Artificial Sequence
  Peptide Derived from Human Papillomavirus
LLFVCLVIRPL

SEQ ID NO: 27016 - protein, 8 aa, Artificial Sequence
  Peptide Derived from Human Papillomavirus
LLIVILWV

SEQ ID NO: 27017 - protein, 9 aa, Artificial Sequence
  Peptide Derived from Human Papillomavirus
LLIVILWVI

SEQ ID NO: 27018 - protein, 10 aa, Artificial Sequence
  Peptide Derived from Human Papillomavirus
LLIVILWVIA

SEQ ID NO: 27019 - protein, 8 aa, Artificial Sequence
  Peptide Derived from Human Papillomavirus
LLLIVILW

SEQ ID NO: 27020 - protein, 9 aa, Artificial Sequence
  Peptide Derived from Human Papillomavirus
LLLIVILWV

SEQ ID NO: 27021 - protein, 10 aa, Artificial Sequence
  Peptide Derived from Human Papillomavirus
LLLIVILWVI

SEQ ID NO: 27022 - protein, 11 aa, Artificial Sequence
  Peptide Derived from Human Papillomavirus
LLLIVILWVIA

SEQ ID NO: 27023 - protein, 8 aa, Artificial Sequence
  Peptide Derived from Human Papillomavirus
LLLLIVIL

SEQ ID NO: 27024 - protein, 9 aa, Artificial Sequence
  Peptide Derived from Human Papillomavirus
LLLLIVILW

SEQ ID NO: 27025 - protein, 10 aa, Artificial Sequence
  Peptide Derived from Human Papillomavirus
LLLLIVILWV

SEQ ID NO: 27026 - protein, 11 aa, Artificial Sequence
  Peptide Derived from Human Papillomavirus
LLLLIVILWVI

SEQ ID NO: 27027 - protein, 8 aa, Artificial Sequence
  Peptide Derived from Human Papillomavirus
LVIRPLVL

SEQ ID NO: 27028 - protein, 10 aa, Artificial Sequence
  Peptide Derived from Human Papillomavirus
LVIRPLVLSV

SEQ ID NO: 27029 - protein, 8 aa, Artificial Sequence
  Peptide Derived from Human Papillomavirus
LVLSVSVY

SEQ ID NO: 27030 - protein, 9 aa, Artificial Sequence
  Peptide Derived from Human Papillomavirus
LVLSVSVYA

SEQ ID NO: 27031 - protein, 11 aa, Artificial Sequence
  Peptide Derived from Human Papillomavirus
LVLSVSVYATL

SEQ ID NO: 27032 - protein, 9 aa, Artificial Sequence
  Peptide Derived from Human Papillomavirus
MIELNISTV

SEQ ID NO: 27033 - protein, 11 aa, Artificial Sequence
  Peptide Derived from Human Papillomavirus
MIELNISTVSI

SEQ ID NO: 27034 - protein, 8 aa, Artificial Sequence
  Peptide Derived from Human Papillomavirus
NISTVSIV

SEQ ID NO: 27035 - protein, 9 aa, Artificial Sequence
  Peptide Derived from Human Papillomavirus
NISTVSIVL

SEQ ID NO: 27036 - protein, 11 aa, Artificial Sequence
  Peptide Derived from Human Papillomavirus
NISTVSIVLCF

SEQ ID NO: 27037 - protein, 9 aa, Artificial Sequence
  Peptide Derived from Human Papillomavirus
PLFVIHTHA

SEQ ID NO: 27038 - protein, 11 aa, Artificial Sequence
  Peptide Derived from Human Papillomavirus
PLFVIHTHASF

SEQ ID NO: 27039 - protein, 8 aa, Artificial Sequence
  Peptide Derived from Human Papillomavirus
PLRCFCIY

SEQ ID NO: 27040 - protein, 9 aa, Artificial Sequence
  Peptide Derived from Human Papillomavirus
PLRCFCIYV

SEQ ID NO: 27041 - protein, 10 aa, Artificial Sequence
  Peptide Derived from Human Papillomavirus
PLRCFCIYVV

SEQ ID NO: 27042 - protein, 11 aa, Artificial Sequence
  Peptide Derived from Human Papillomavirus
PLRCFCIYVVF

SEQ ID NO: 27043 - protein, 8 aa, Artificial Sequence
  Peptide Derived from Human Papillomavirus
PLVLSVSV

SEQ ID NO: 27044 - protein, 9 aa, Artificial Sequence
  Peptide Derived from Human Papillomavirus
PLVLSVSVY

SEQ ID NO: 27045 - protein, 10 aa, Artificial Sequence
  Peptide Derived from Human Papillomavirus
PLVLSVSVYA

SEQ ID NO: 27046 - protein, 9 aa, Artificial Sequence
  Peptide Derived from Human Papillomavirus
RPLVLSVSV

SEQ ID NO: 27047 - protein, 10 aa, Artificial Sequence
  Peptide Derived from Human Papillomavirus
RPLVLSVSVY

SEQ ID NO: 27048 - protein, 11 aa, Artificial Sequence
  Peptide Derived from Human Papillomavirus
RPLVLSVSVYA

SEQ ID NO: 27049 - protein, 8 aa, Artificial Sequence
  Peptide Derived from Human Papillomavirus
SIVLCFLL

SEQ ID NO: 27050 - protein, 10 aa, Artificial Sequence
  Peptide Derived from Human Papillomavirus
SIVLCFLLCF

SEQ ID NO: 27051 - protein, 8 aa, Artificial Sequence
  Peptide Derived from Human Papillomavirus
SPLRCFCI

SEQ ID NO: 27052 - protein, 9 aa, Artificial Sequence
  Peptide Derived from Human Papillomavirus
SPLRCFCIY

SEQ ID NO: 27053 - protein, 10 aa, Artificial Sequence
  Peptide Derived from Human Papillomavirus
SPLRCFCIYV

SEQ ID NO: 27054 - protein, 11 aa, Artificial Sequence
  Peptide Derived from Human Papillomavirus
SPLRCFCIYVV

SEQ ID NO: 27055 - protein, 8 aa, Artificial Sequence
  Peptide Derived from Human Papillomavirus
SVSVYATL

SEQ ID NO: 27056 - protein, 9 aa, Artificial Sequence
  Peptide Derived from Human Papillomavirus
SVSVYATLL

SEQ ID NO: 27057 - protein, 10 aa, Artificial Sequence
  Peptide Derived from Human Papillomavirus
SVSVYATLLL

SEQ ID NO: 27058 - protein, 11 aa, Artificial Sequence
  Peptide Derived from Human Papillomavirus
SVSVYATLLLL

SEQ ID NO: 27059 - protein, 8 aa, Artificial Sequence
  Peptide Derived from Human Papillomavirus
SVYATLLL

SEQ ID NO: 27060 - protein, 9 aa, Artificial Sequence
  Peptide Derived from Human Papillomavirus
SVYATLLLL

SEQ ID NO: 27061 - protein, 10 aa, Artificial Sequence
  Peptide Derived from Human Papillomavirus
SVYATLLLLI

SEQ ID NO: 27062 - protein, 11 aa, Artificial Sequence
  Peptide Derived from Human Papillomavirus
SVYATLLLLIV

SEQ ID NO: 27063 - protein, 8 aa, Artificial Sequence
  Peptide Derived from Human Papillomavirus
TLLLLIVI

SEQ ID NO: 27064 - protein, 9 aa, Artificial Sequence
  Peptide Derived from Human Papillomavirus
TLLLLIVIL

SEQ ID NO: 27065 - protein, 10 aa, Artificial Sequence
  Peptide Derived from Human Papillomavirus
TLLLLIVILW

SEQ ID NO: 27066 - protein, 11 aa, Artificial Sequence
  Peptide Derived from Human Papillomavirus
TLLLLIVILWV

SEQ ID NO: 27067 - protein, 8 aa, Artificial Sequence
  Peptide Derived from Human Papillomavirus
TVSIVLCF

SEQ ID NO: 27068 - protein, 9 aa, Artificial Sequence
  Peptide Derived from Human Papillomavirus
TVSIVLCFL

SEQ ID NO: 27069 - protein, 10 aa, Artificial Sequence
  Peptide Derived from Human Papillomavirus
TVSIVLCFLL

SEQ ID NO: 27070 - protein, 10 aa, Artificial Sequence
  Peptide Derived from Human Papillomavirus
VIATSPLRCF

SEQ ID NO: 27071 - protein, 8 aa, Artificial Sequence
  Peptide Derived from Human Papillomavirus
VIHTHASF

SEQ ID NO: 27072 - protein, 9 aa, Artificial Sequence
  Peptide Derived from Human Papillomavirus
VIHTHASFL

SEQ ID NO: 27073 - protein, 11 aa, Artificial Sequence
  Peptide Derived from Human Papillomavirus
VILWVIATSPL

SEQ ID NO: 27074 - protein, 9 aa, Artificial Sequence
  Peptide Derived from Human Papillomavirus
VIRPLVLSV

SEQ ID NO: 27075 - protein, 11 aa, Artificial Sequence
  Peptide Derived from Human Papillomavirus
VIRPLVLSVSV

SEQ ID NO: 27076 - protein, 8 aa, Artificial Sequence
  Peptide Derived from Human Papillomavirus
VLCFLLCF

SEQ ID NO: 27077 - protein, 10 aa, Artificial Sequence
  Peptide Derived from Human Papillomavirus
VLCFLLCFCV

SEQ ID NO: 27078 - protein, 11 aa, Artificial Sequence
  Peptide Derived from Human Papillomavirus
VLCFLLCFCVL

SEQ ID NO: 27079 - protein, 8 aa, Artificial Sequence
  Peptide Derived from Human Papillomavirus
VLLFVCLV

SEQ ID NO: 27080 - protein, 9 aa, Artificial Sequence
  Peptide Derived from Human Papillomavirus
VLLFVCLVI

SEQ ID NO: 27081 - protein, 8 aa, Artificial Sequence
  Peptide Derived from Human Papillomavirus
VLSVSVYA

SEQ ID NO: 27082 - protein, 10 aa, Artificial Sequence
  Peptide Derived from Human Papillomavirus
VLSVSVYATL

SEQ ID NO: 27083 - protein, 11 aa, Artificial Sequence
  Peptide Derived from Human Papillomavirus
VLSVSVYATLL

SEQ ID NO: 27084 - protein, 8 aa, Artificial Sequence
  Peptide Derived from Human Papillomavirus
VVFIYIPL

SEQ ID NO: 27085 - protein, 9 aa, Artificial Sequence
  Peptide Derived from Human Papillomavirus
VVFIYIPLF

SEQ ID NO: 27086 - protein, 10 aa, Artificial Sequence
  Peptide Derived from Human Papillomavirus
VVFIYIPLFV

SEQ ID NO: 27087 - protein, 11 aa, Artificial Sequence
  Peptide Derived from Human Papillomavirus
VVFIYIPLFVI

SEQ ID NO: 27088 - protein, 8 aa, Artificial Sequence
  Peptide Derived from Human Papillomavirus
WVIATSPL

SEQ ID NO: 27089 - protein, 11 aa, Artificial Sequence
  Peptide Derived from Human Papillomavirus
WVIATSPLRCF

SEQ ID NO: 27090 - protein, 11 aa, Artificial Sequence
  Peptide Derived from Human Papillomavirus
YIPLFVIHTHA

SEQ ID NO: 27091 - protein, 9 aa, Artificial Sequence
  Peptide Derived from Human Papillomavirus
YVVFIYIPL

SEQ ID NO: 27092 - protein, 10 aa, Artificial Sequence
  Peptide Derived from Human Papillomavirus
YVVFIYIPLF

SEQ ID NO: 27093 - protein, 11 aa, Artificial Sequence
  Peptide Derived from Human Papillomavirus
YVVFIYIPLFV

SEQ ID NO: 27094 - protein, 9 aa, Artificial Sequence
  Peptide Derived from Human Papillomavirus
ALEIPYDEL

SEQ ID NO: 27095 - protein, 11 aa, Artificial Sequence
  Peptide Derived from Human Papillomavirus
ALEIPYDELRL

SEQ ID NO: 27096 - protein, 8 aa, Artificial Sequence
  Peptide Derived from Human Papillomavirus
CITCQRPL

SEQ ID NO: 27097 - protein, 8 aa, Artificial Sequence
  Peptide Derived from Human Papillomavirus
CLRFYSKV

SEQ ID NO: 27098 - protein, 11 aa, Artificial Sequence
  Peptide Derived from Human Papillomavirus
CLRFYSKVSEF

SEQ ID NO: 27099 - protein, 9 aa, Artificial Sequence
  Peptide Derived from Human Papillomavirus
CPEEKQRHL

SEQ ID NO: 27100 - protein, 8 aa, Artificial Sequence
  Peptide Derived from Human Papillomavirus
CVYCKGQL

SEQ ID NO: 27101 - protein, 9 aa, Artificial Sequence
  Peptide Derived from Human Papillomavirus
EIPYDELRL

SEQ ID NO: 27102 - protein, 8 aa, Artificial Sequence
  Peptide Derived from Human Papillomavirus
ELRLNCVY

SEQ ID NO: 27103 - protein, 8 aa, Artificial Sequence
  Peptide Derived from Human Papillomavirus
ELSSALEI

SEQ ID NO: 27104 - protein, 10 aa, Artificial Sequence
  Peptide Derived from Human Papillomavirus
ELSSALEIPY

SEQ ID NO: 27105 - protein, 10 aa, Artificial Sequence
  Peptide Derived from Human Papillomavirus
EVLDFAFTDL

SEQ ID NO: 27106 - protein, 10 aa, Artificial Sequence
  Peptide Derived from Human Papillomavirus
GICDLLIRCI

SEQ ID NO: 27107 - protein, 8 aa, Artificial Sequence
  Peptide Derived from Human Papillomavirus
GQLTETEV

SEQ ID NO: 27108 - protein, 9 aa, Artificial Sequence
  Peptide Derived from Human Papillomavirus
GQLTETEVL

SEQ ID NO: 27109 - protein, 11 aa, Artificial Sequence
  Peptide Derived from Human Papillomavirus
GQLTETEVLDF

SEQ ID NO: 27110 - protein, 9 aa, Artificial Sequence
  Peptide Derived from Human Papillomavirus
GVCTKCLRF

SEQ ID NO: 27111 - protein, 10 aa, Artificial Sequence
  Peptide Derived from Human Papillomavirus
GVCTKCLRFY

SEQ ID NO: 27112 - protein, 8 aa, Artificial Sequence
  Peptide Derived from Human Papillomavirus
HLDKKKRF

SEQ ID NO: 27113 - protein, 11 aa, Artificial Sequence
  Peptide Derived from Human Papillomavirus
HLDKKKRFHNI

SEQ ID NO: 27114 - protein, 8 aa, Artificial Sequence
  Peptide Derived from Human Papillomavirus
IPYDELRL

SEQ ID NO: 27115 - protein, 11 aa, Artificial Sequence
  Peptide Derived from Human Papillomavirus
IPYDELRLNCV

SEQ ID NO: 27116 - protein, 11 aa, Artificial Sequence
  Peptide Derived from Human Papillomavirus
IVYRDDTPHGV

SEQ ID NO: 27117 - protein, 8 aa, Artificial Sequence
  Peptide Derived from Human Papillomavirus
KLHELSSA

SEQ ID NO: 27118 - protein, 9 aa, Artificial Sequence
  Peptide Derived from Human Papillomavirus
KLHELSSAL

SEQ ID NO: 27119 - protein, 11 aa, Artificial Sequence
  Peptide Derived from Human Papillomavirus
KLHELSSALEI

SEQ ID NO: 27120 - protein, 10 aa, Artificial Sequence
  Peptide Derived from Human Papillomavirus
KLTNKGICDL

SEQ ID NO: 27121 - protein, 11 aa, Artificial Sequence
  Peptide Derived from Human Papillomavirus
KLTNKGICDLL

SEQ ID NO: 27122 - protein, 11 aa, Artificial Sequence
  Peptide Derived from Human Papillomavirus
KQRHLDKKKRF

SEQ ID NO: 27123 - protein, 8 aa, Artificial Sequence
  Peptide Derived from Human Papillomavirus
KVSEFRWY

SEQ ID NO: 27124 - protein, 10 aa, Artificial Sequence
  Peptide Derived from Human Papillomavirus
KVSEFRWYRY

SEQ ID NO: 27125 - protein, 11 aa, Artificial Sequence
  Peptide Derived from Human Papillomavirus
LIRCITCQRPL

SEQ ID NO: 27126 - protein, 11 aa, Artificial Sequence
  Peptide Derived from Human Papillomavirus
NIGGRWTGRCI

SEQ ID NO: 27127 - protein, 9 aa, Artificial Sequence
  Peptide Derived from Human Papillomavirus
NPAERPRKL

SEQ ID NO: 27128 - protein, 11 aa, Artificial Sequence
  Peptide Derived from Human Papillomavirus
PLCPEEKQRHL

SEQ ID NO: 27129 - protein, 8 aa, Artificial Sequence
  Peptide Derived from Human Papillomavirus
QLTETEVL

SEQ ID NO: 27130 - protein, 10 aa, Artificial Sequence
  Peptide Derived from Human Papillomavirus
QLTETEVLDF

SEQ ID NO: 27131 - protein, 11 aa, Artificial Sequence
  Peptide Derived from Human Papillomavirus
QLTETEVLDFA

SEQ ID NO: 27132 - protein, 11 aa, Artificial Sequence
  Peptide Derived from Human Papillomavirus
RLNCVYCKGQL

SEQ ID NO: 27133 - protein, 8 aa, Artificial Sequence
  Peptide Derived from Human Papillomavirus
RPRKLHEL

SEQ ID NO: 27134 - protein, 11 aa, Artificial Sequence
  Peptide Derived from Human Papillomavirus
RPRKLHELSSA

SEQ ID NO: 27135 - protein, 8 aa, Artificial Sequence
  Peptide Derived from Human Papillomavirus
RPRTETQV

SEQ ID NO: 27136 - protein, 10 aa, Artificial Sequence
  Peptide Derived from Human Papillomavirus
SVYGTTLEKL

SEQ ID NO: 27137 - protein, 10 aa, Artificial Sequence
  Peptide Derived from Human Papillomavirus
TLEKLTNKGI

SEQ ID NO: 27138 - protein, 10 aa, Artificial Sequence
  Peptide Derived from Human Papillomavirus
TPHGVCTKCL

SEQ ID NO: 27139 - protein, 9 aa, Artificial Sequence
  Peptide Derived from Human Papillomavirus
VLDFAFTDL

SEQ ID NO: 27140 - protein, 11 aa, Artificial Sequence
  Peptide Derived from Human Papillomavirus
VLDFAFTDLTI

SEQ ID NO: 27141 - protein, 8 aa, Artificial Sequence
  Peptide Derived from Human Papillomavirus
CPNCSTRL

SEQ ID NO: 27142 - protein, 9 aa, Artificial Sequence
  Peptide Derived from Human Papillomavirus
CQCKSTLRL

SEQ ID NO: 27143 - protein, 11 aa, Artificial Sequence
  Peptide Derived from Human Papillomavirus
CQCKSTLRLCV

SEQ ID NO: 27144 - protein, 9 aa, Artificial Sequence
  Peptide Derived from Human Papillomavirus
CVQSTQVDI

SEQ ID NO: 27145 - protein, 11 aa, Artificial Sequence
  Peptide Derived from Human Papillomavirus
CVQSTQVDIRI

SEQ ID NO: 27146 - protein, 8 aa, Artificial Sequence
  Peptide Derived from Human Papillomavirus
DIRILQEL

SEQ ID NO: 27147 - protein, 9 aa, Artificial Sequence
  Peptide Derived from Human Papillomavirus
DIRILQELL

SEQ ID NO: 27148 - protein, 10 aa, Artificial Sequence
  Peptide Derived from Human Papillomavirus
DIRILQELLM

SEQ ID NO: 27149 - protein, 8 aa, Artificial Sequence
  Peptide Derived from Human Papillomavirus
DLHCYEQL

SEQ ID NO: 27150 - protein, 9 aa, Artificial Sequence
  Peptide Derived from Human Papillomavirus
DLQPEATDL

SEQ ID NO: 27151 - protein, 10 aa, Artificial Sequence
  Peptide Derived from Human Papillomavirus
DVIDSPAGQA

SEQ ID NO: 27152 - protein, 9 aa, Artificial Sequence
  Peptide Derived from Human Papillomavirus
ELLMGSFGI

SEQ ID NO: 27153 - protein, 10 aa, Artificial Sequence
  Peptide Derived from Human Papillomavirus
ELLMGSFGIV

SEQ ID NO: 27154 - protein, 9 aa, Artificial Sequence
  Peptide Derived from Human Papillomavirus
EPDTSNYNI

SEQ ID NO: 27155 - protein, 10 aa, Artificial Sequence
  Peptide Derived from Human Papillomavirus
EPDTSNYNIV

SEQ ID NO: 27156 - protein, 11 aa, Artificial Sequence
  Peptide Derived from Human Papillomavirus
GIVCPNCSTRL

SEQ ID NO: 27157 - protein, 10 aa, Artificial Sequence
  Peptide Derived from Human Papillomavirus
GQAEPDTSNY

SEQ ID NO: 27158 - protein, 10 aa, Artificial Sequence
  Peptide Derived from Human Papillomavirus
ILQELLMGSF

SEQ ID NO: 27159 - protein, 10 aa, Artificial Sequence
  Peptide Derived from Human Papillomavirus
IVCPNCSTRL

SEQ ID NO: 27160 - protein, 8 aa, Artificial Sequence
  Peptide Derived from Human Papillomavirus
LLMGSFGI

SEQ ID NO: 27161 - protein, 9 aa, Artificial Sequence
  Peptide Derived from Human Papillomavirus
LLMGSFGIV

SEQ ID NO: 27162 - protein, 8 aa, Artificial Sequence
  Peptide Derived from Human Papillomavirus
LMGSFGIV

SEQ ID NO: 27163 - protein, 10 aa, Artificial Sequence
  Peptide Derived from Human Papillomavirus
LPDSSDEEDV

SEQ ID NO: 27164 - protein, 11 aa, Artificial Sequence
  Peptide Derived from Human Papillomavirus
LPDSSDEEDVI

SEQ ID NO: 27165 - protein, 8 aa, Artificial Sequence
  Peptide Derived from Human Papillomavirus
LQDYVLDL

SEQ ID NO: 27166 - protein, 9 aa, Artificial Sequence
  Peptide Derived from Human Papillomavirus
LQELLMGSF

SEQ ID NO: 27167 - protein, 11 aa, Artificial Sequence
  Peptide Derived from Human Papillomavirus
LQELLMGSFGI

SEQ ID NO: 27168 - protein, 8 aa, Artificial Sequence
  Peptide Derived from Human Papillomavirus
LQPEATDL

SEQ ID NO: 27169 - protein, 11 aa, Artificial Sequence
  Peptide Derived from Human Papillomavirus
LQPEATDLHCY

SEQ ID NO: 27170 - protein, 11 aa, Artificial Sequence
  Peptide Derived from Human Papillomavirus
QLPDSSDEEDV

SEQ ID NO: 27171 - protein, 10 aa, Artificial Sequence
  Peptide Derived from Human Papillomavirus
QPEATDLHCY

SEQ ID NO: 27172 - protein, 10 aa, Artificial Sequence
  Peptide Derived from Human Papillomavirus
QVDIRILQEL

SEQ ID NO: 27173 - protein, 11 aa, Artificial Sequence
  Peptide Derived from Human Papillomavirus
QVDIRILQELL

SEQ ID NO: 27174 - protein, 8 aa, Artificial Sequence
  Peptide Derived from Human Papillomavirus
RILQELLM

SEQ ID NO: 27175 - protein, 11 aa, Artificial Sequence
  Peptide Derived from Human Papillomavirus
RILQELLMGSF

SEQ ID NO: 27176 - protein, 9 aa, Artificial Sequence
  Peptide Derived from Human Papillomavirus
RLCVQSTQV

SEQ ID NO: 27177 - protein, 11 aa, Artificial Sequence
  Peptide Derived from Human Papillomavirus
RLCVQSTQVDI

SEQ ID NO: 27178 - protein, 9 aa, Artificial Sequence
  Peptide Derived from Human Papillomavirus
TLQDYVLDL

SEQ ID NO: 27179 - protein, 11 aa, Artificial Sequence
  Peptide Derived from Human Papillomavirus
TLRLCVQSTQV

SEQ ID NO: 27180 - protein, 8 aa, Artificial Sequence
  Peptide Derived from Human Papillomavirus
TPTLQDYV

SEQ ID NO: 27181 - protein, 9 aa, Artificial Sequence
  Peptide Derived from Human Papillomavirus
TPTLQDYVL

SEQ ID NO: 27182 - protein, 11 aa, Artificial Sequence
  Peptide Derived from Human Papillomavirus
TPTLQDYVLDL

SEQ ID NO: 27183 - protein, 8 aa, Artificial Sequence
  Peptide Derived from Human Papillomavirus
TQVDIRIL

SEQ ID NO: 27184 - protein, 11 aa, Artificial Sequence
  Peptide Derived from Human Papillomavirus
TQVDIRILQEL

SEQ ID NO: 27185 - protein, 9 aa, Artificial Sequence
  Peptide Derived from Human Papillomavirus
VIDSPAGQA

SEQ ID NO: 27186 - protein, 8 aa, Artificial Sequence
  Peptide Derived from Human Papillomavirus
VLDLQPEA

SEQ ID NO: 27187 - protein, 11 aa, Artificial Sequence
  Peptide Derived from Human Papillomavirus
VLDLQPEATDL

SEQ ID NO: 27188 - protein, 8 aa, Artificial Sequence
  Peptide Derived from Human Papillomavirus
VQSTQVDI

SEQ ID NO: 27189 - protein, 10 aa, Artificial Sequence
  Peptide Derived from Human Papillomavirus
VQSTQVDIRI

SEQ ID NO: 27190 - protein, 11 aa, Artificial Sequence
  Peptide Derived from Human Papillomavirus
VQSTQVDIRIL

SEQ ID NO: 27191 - protein, 9 aa, Artificial Sequence
  Peptide Derived from Human Papillomavirus
YVLDLQPEA

SEQ ID NO: 27192 - protein, 9 aa, Artificial Sequence
  Peptide Derived from Human Papillomavirus
AIANSDTTF

SEQ ID NO: 27193 - protein, 8 aa, Artificial Sequence
  Peptide Derived from Human Papillomavirus
AILEDWNF

SEQ ID NO: 27194 - protein, 10 aa, Artificial Sequence
  Peptide Derived from Human Papillomavirus
AILEDWNFGL

SEQ ID NO: 27195 - protein, 8 aa, Artificial Sequence
  Peptide Derived from Human Papillomavirus
AITCQKTA

SEQ ID NO: 27196 - protein, 10 aa, Artificial Sequence
  Peptide Derived from Human Papillomavirus
AITPGDCPPL

SEQ ID NO: 27197 - protein, 9 aa, Artificial Sequence
  Peptide Derived from Human Papillomavirus
ALQDTKSNV

SEQ ID NO: 27198 - protein, 11 aa, Artificial Sequence
  Peptide Derived from Human Papillomavirus
ALQDTKSNVPL

SEQ ID NO: 27199 - protein, 10 aa, Artificial Sequence
  Peptide Derived from Human Papillomavirus
APQKPKEDPF

SEQ ID NO: 27200 - protein, 10 aa, Artificial Sequence
  Peptide Derived from Human Papillomavirus
APSASTTTPA

SEQ ID NO: 27201 - protein, 8 aa, Artificial Sequence
  Peptide Derived from Human Papillomavirus
AQGHNNGI

SEQ ID NO: 27202 - protein, 10 aa, Artificial Sequence
  Peptide Derived from Human Papillomavirus
AQGHNNGICW

SEQ ID NO: 27203 - protein, 8 aa, Artificial Sequence
  Peptide Derived from Human Papillomavirus
AQIFNKPY

SEQ ID NO: 27204 - protein, 9 aa, Artificial Sequence
  Peptide Derived from Human Papillomavirus
AQIFNKPYW

SEQ ID NO: 27205 - protein, 10 aa, Artificial Sequence
  Peptide Derived from Human Papillomavirus
AQIFNKPYWM

SEQ ID NO: 27206 - protein, 11 aa, Artificial Sequence
  Peptide Derived from Human Papillomavirus
CISMDYKQTQL

SEQ ID NO: 27207 - protein, 9 aa, Artificial Sequence
  Peptide Derived from Human Papillomavirus
CLLGCKPPI

SEQ ID NO: 27208 - protein, 10 aa, Artificial Sequence
  Peptide Derived from Human Papillomavirus
CPPLELKNSV

SEQ ID NO: 27209 - protein, 11 aa, Artificial Sequence
  Peptide Derived from Human Papillomavirus
CPPLELKNSVI

SEQ ID NO: 27210 - protein, 9 aa, Artificial Sequence
  Peptide Derived from Human Papillomavirus
DICNSICKY

SEQ ID NO: 27211 - protein, 9 aa, Artificial Sequence
  Peptide Derived from Human Papillomavirus
DIMTYIHSM

SEQ ID NO: 27212 - protein, 11 aa, Artificial Sequence
  Peptide Derived from Human Papillomavirus
DLDQFPLGRKF

SEQ ID NO: 27213 - protein, 8 aa, Artificial Sequence
  Peptide Derived from Human Papillomavirus
DLQFIFQL

SEQ ID NO: 27214 - protein, 11 aa, Artificial Sequence
  Peptide Derived from Human Papillomavirus
DLQFIFQLCKI

SEQ ID NO: 27215 - protein, 11 aa, Artificial Sequence
  Peptide Derived from Human Papillomavirus
DLYIKGSGSTA

SEQ ID NO: 27216 - protein, 9 aa, Artificial Sequence
  Peptide Derived from Human Papillomavirus
DMVDTGFGA

SEQ ID NO: 27217 - protein, 10 aa, Artificial Sequence
  Peptide Derived from Human Papillomavirus
DMVDTGFGAM

SEQ ID NO: 27218 - protein, 8 aa, Artificial Sequence
  Peptide Derived from Human Papillomavirus
DPFKDYVF

SEQ ID NO: 27219 - protein, 9 aa, Artificial Sequence
  Peptide Derived from Human Papillomavirus
DPFKDYVFW

SEQ ID NO: 27220 - protein, 11 aa, Artificial Sequence
  Peptide Derived from Human Papillomavirus
DPFKDYVFWEV

SEQ ID NO: 27221 - protein, 9 aa, Artificial Sequence
  Peptide Derived from Human Papillomavirus
DQFPLGRKF

SEQ ID NO: 27222 - protein, 10 aa, Artificial Sequence
  Peptide Derived from Human Papillomavirus
DQFPLGRKFL

SEQ ID NO: 27223 - protein, 11 aa, Artificial Sequence
  Peptide Derived from Human Papillomavirus
DQFPLGRKFLL

SEQ ID NO: 27224 - protein, 8 aa, Artificial Sequence
  Peptide Derived from Human Papillomavirus
EPYGDTLF

SEQ ID NO: 27225 - protein, 9 aa, Artificial Sequence
  Peptide Derived from Human Papillomavirus
EPYGDTLFF

SEQ ID NO: 27226 - protein, 10 aa, Artificial Sequence
  Peptide Derived from Human Papillomavirus
EPYGDTLFFY

SEQ ID NO: 27227 - protein, 11 aa, Artificial Sequence
  Peptide Derived from Human Papillomavirus
EPYGDTLFFYL

SEQ ID NO: 27228 - protein, 8 aa, Artificial Sequence
  Peptide Derived from Human Papillomavirus
EQMFVRHF

SEQ ID NO: 27229 - protein, 9 aa, Artificial Sequence
  Peptide Derived from Human Papillomavirus
EQMFVRHFF

SEQ ID NO: 27230 - protein, 8 aa, Artificial Sequence
  Peptide Derived from Human Papillomavirus
EVGRGQPL

SEQ ID NO: 27231 - protein, 10 aa, Artificial Sequence
  Peptide Derived from Human Papillomavirus
EVGRGQPLGV

SEQ ID NO: 27232 - protein, 8 aa, Artificial Sequence
  Peptide Derived from Human Papillomavirus
EVNLKEKF

SEQ ID NO: 27233 - protein, 10 aa, Artificial Sequence
  Peptide Derived from Human Papillomavirus
EVNLKEKFSA

SEQ ID NO: 27234 - protein, 8 aa, Artificial Sequence
  Peptide Derived from Human Papillomavirus
FIFQLCKI

SEQ ID NO: 27235 - protein, 10 aa, Artificial Sequence
  Peptide Derived from Human Papillomavirus
FIFQLCKITL

SEQ ID NO: 27236 - protein, 9 aa, Artificial Sequence
  Peptide Derived from Human Papillomavirus
FLLQAGYRA

SEQ ID NO: 27237 - protein, 8 aa, Artificial Sequence
  Peptide Derived from Human Papillomavirus
FPLGRKFL

SEQ ID NO: 27238 - protein, 9 aa, Artificial Sequence
  Peptide Derived from Human Papillomavirus
FPLGRKFLL

SEQ ID NO: 27239 - protein, 11 aa, Artificial Sequence
  Peptide Derived from Human Papillomavirus
FPLGRKFLLQA

SEQ ID NO: 27240 - protein, 8 aa, Artificial Sequence
  Peptide Derived from Human Papillomavirus
FPTPSGSM

SEQ ID NO: 27241 - protein, 9 aa, Artificial Sequence
  Peptide Derived from Human Papillomavirus
FPTPSGSMV

SEQ ID NO: 27242 - protein, 8 aa, Artificial Sequence
  Peptide Derived from Human Papillomavirus
FQLCKITL

SEQ ID NO: 27243 - protein, 10 aa, Artificial Sequence
  Peptide Derived from Human Papillomavirus
FQLCKITLSA

SEQ ID NO: 27244 - protein, 8 aa, Artificial Sequence
  Peptide Derived from Human Papillomavirus
GICWGNQL

SEQ ID NO: 27245 - protein, 9 aa, Artificial Sequence
  Peptide Derived from Human Papillomavirus
GICWGNQLF

SEQ ID NO: 27246 - protein, 10 aa, Artificial Sequence
  Peptide Derived from Human Papillomavirus
GICWGNQLFV

SEQ ID NO: 27247 - protein, 8 aa, Artificial Sequence
  Peptide Derived from Human Papillomavirus
GISGHPLL

SEQ ID NO: 27248 - protein, 11 aa, Artificial Sequence
  Peptide Derived from Human Papillomavirus
GISGHPLLNKF

SEQ ID NO: 27249 - protein, 10 aa, Artificial Sequence
  Peptide Derived from Human Papillomavirus
GLEVGRGQPL

SEQ ID NO: 27250 - protein, 9 aa, Artificial Sequence
  Peptide Derived from Human Papillomavirus
GLQYRVFRV

SEQ ID NO: 27251 - protein, 11 aa, Artificial Sequence
  Peptide Derived from Human Papillomavirus
GLQYRVFRVRL

SEQ ID NO: 27252 - protein, 10 aa, Artificial Sequence
  Peptide Derived from Human Papillomavirus
GLTTPPSGSL

SEQ ID NO: 27253 - protein, 10 aa, Artificial Sequence
  Peptide Derived from Human Papillomavirus
GPGTDNRECI

SEQ ID NO: 27254 - protein, 8 aa, Artificial Sequence
  Peptide Derived from Human Papillomavirus
GQPLGVGI

SEQ ID NO: 27255 - protein, 9 aa, Artificial Sequence
  Peptide Derived from Human Papillomavirus
GVGISGHPL

SEQ ID NO: 27256 - protein, 10 aa, Artificial Sequence
  Peptide Derived from Human Papillomavirus
GVGISGHPLL

SEQ ID NO: 27257 - protein, 9 aa, Artificial Sequence
  Peptide Derived from Human Papillomavirus
ILEDWNFGL

SEQ ID NO: 27258 - protein, 8 aa, Artificial Sequence
  Peptide Derived from Human Papillomavirus
IMTYIHSM

SEQ ID NO: 27259 - protein, 11 aa, Artificial Sequence
  Peptide Derived from Human Papillomavirus
IMTYIHSMNPA

SEQ ID NO: 27260 - protein, 10 aa, Artificial Sequence
  Peptide Derived from Human Papillomavirus
IPKSDNPKKI

SEQ ID NO: 27261 - protein, 11 aa, Artificial Sequence
  Peptide Derived from Human Papillomavirus
IPKSDNPKKIV

SEQ ID NO: 27262 - protein, 11 aa, Artificial Sequence
  Peptide Derived from Human Papillomavirus
IQDGDMVDTGF

SEQ ID NO: 27263 - protein, 9 aa, Artificial Sequence
  Peptide Derived from Human Papillomavirus
IVVPKVSGL

SEQ ID NO: 27264 - protein, 11 aa, Artificial Sequence
  Peptide Derived from Human Papillomavirus
IVVPKVSGLQY

SEQ ID NO: 27265 - protein, 8 aa, Artificial Sequence
  Peptide Derived from Human Papillomavirus
KITLSADI

SEQ ID NO: 27266 - protein, 9 aa, Artificial Sequence
  Peptide Derived from Human Papillomavirus
KITLSADIM

SEQ ID NO: 27267 - protein, 11 aa, Artificial Sequence
  Peptide Derived from Human Papillomavirus
KITLSADIMTY

SEQ ID NO: 27268 - protein, 10 aa, Artificial Sequence
  Peptide Derived from Human Papillomavirus
KIVVPKVSGL

SEQ ID NO: 27269 - protein, 11 aa, Artificial Sequence
  Peptide Derived from Human Papillomavirus
KMVAEPYGDTL

SEQ ID NO: 27270 - protein, 10 aa, Artificial Sequence
  Peptide Derived from Human Papillomavirus
KPKEDPFKDY

SEQ ID NO: 27271 - protein, 11 aa, Artificial Sequence
  Peptide Derived from Human Papillomavirus
KPKEDPFKDYV

SEQ ID NO: 27272 - protein, 8 aa, Artificial Sequence
  Peptide Derived from Human Papillomavirus
KPPIGEHW

SEQ ID NO: 27273 - protein, 8 aa, Artificial Sequence
  Peptide Derived from Human Papillomavirus
KPYWMQRA

SEQ ID NO: 27274 - protein, 8 aa, Artificial Sequence
  Peptide Derived from Human Papillomavirus
KQTQLCLL

SEQ ID NO: 27275 - protein, 9 aa, Artificial Sequence
  Peptide Derived from Human Papillomavirus
KVSGLQYRV

SEQ ID NO: 27276 - protein, 10 aa, Artificial Sequence
  Peptide Derived from Human Papillomavirus
KVSGLQYRVF

SEQ ID NO: 27277 - protein, 8 aa, Artificial Sequence
  Peptide Derived from Human Papillomavirus
KVVSTDEY

SEQ ID NO: 27278 - protein, 9 aa, Artificial Sequence
  Peptide Derived from Human Papillomavirus
KVVSTDEYV

SEQ ID NO: 27279 - protein, 8 aa, Artificial Sequence
  Peptide Derived from Human Papillomavirus
LLGCKPPI

SEQ ID NO: 27280 - protein, 8 aa, Artificial Sequence
  Peptide Derived from Human Papillomavirus
LLQAGYRA

SEQ ID NO: 27281 - protein, 8 aa, Artificial Sequence
  Peptide Derived from Human Papillomavirus
LLTVGHPY

SEQ ID NO: 27282 - protein, 9 aa, Artificial Sequence
  Peptide Derived from Human Papillomavirus
LLTVGHPYY

SEQ ID NO: 27283 - protein, 11 aa, Artificial Sequence
  Peptide Derived from Human Papillomavirus
LLTVGHPYYSI

SEQ ID NO: 27284 - protein, 9 aa, Artificial Sequence
  Peptide Derived from Human Papillomavirus
LPDPNKFGF

SEQ ID NO: 27285 - protein, 9 aa, Artificial Sequence
  Peptide Derived from Human Papillomavirus
LPPVPVSKV

SEQ ID NO: 27286 - protein, 10 aa, Artificial Sequence
  Peptide Derived from Human Papillomavirus
LPPVPVSKVV

SEQ ID NO: 27287 - protein, 11 aa, Artificial Sequence
  Peptide Derived from Human Papillomavirus
LQAGYRARPKF

SEQ ID NO: 27288 - protein, 8 aa, Artificial Sequence
  Peptide Derived from Human Papillomavirus
LQDTKSNV

SEQ ID NO: 27289 - protein, 10 aa, Artificial Sequence
  Peptide Derived from Human Papillomavirus
LQDTKSNVPL

SEQ ID NO: 27290 - protein, 10 aa, Artificial Sequence
  Peptide Derived from Human Papillomavirus
LQFIFQLCKI

SEQ ID NO: 27291 - protein, 8 aa, Artificial Sequence
  Peptide Derived from Human Papillomavirus
LQYRVFRV

SEQ ID NO: 27292 - protein, 10 aa, Artificial Sequence
  Peptide Derived from Human Papillomavirus
LQYRVFRVRL

SEQ ID NO: 27293 - protein, 8 aa, Artificial Sequence
  Peptide Derived from Human Papillomavirus
LVWACVGL

SEQ ID NO: 27294 - protein, 10 aa, Artificial Sequence
  Peptide Derived from Human Papillomavirus
LVWACVGLEV

SEQ ID NO: 27295 - protein, 11 aa, Artificial Sequence
  Peptide Derived from Human Papillomavirus
MQRAQGHNNGI

SEQ ID NO: 27296 - protein, 10 aa, Artificial Sequence
  Peptide Derived from Human Papillomavirus
MVAEPYGDTL

SEQ ID NO: 27297 - protein, 11 aa, Artificial Sequence
  Peptide Derived from Human Papillomavirus
MVAEPYGDTLF

SEQ ID NO: 27298 - protein, 8 aa, Artificial Sequence
  Peptide Derived from Human Papillomavirus
MVDTGFGA

SEQ ID NO: 27299 - protein, 9 aa, Artificial Sequence
  Peptide Derived from Human Papillomavirus
MVDTGFGAM

SEQ ID NO: 27300 - protein, 11 aa, Artificial Sequence
  Peptide Derived from Human Papillomavirus
MVDTGFGAMDF

SEQ ID NO: 27301 - protein, 8 aa, Artificial Sequence
  Peptide Derived from Human Papillomavirus
MVTSDAQI

SEQ ID NO: 27302 - protein, 9 aa, Artificial Sequence
  Peptide Derived from Human Papillomavirus
MVTSDAQIF

SEQ ID NO: 27303 - protein, 9 aa, Artificial Sequence
  Peptide Derived from Human Papillomavirus
NIYYHAGSA

SEQ ID NO: 27304 - protein, 11 aa, Artificial Sequence
  Peptide Derived from Human Papillomavirus
NIYYHAGSARL

SEQ ID NO: 27305 - protein, 8 aa, Artificial Sequence
  Peptide Derived from Human Papillomavirus
NLKEKFSA

SEQ ID NO: 27306 - protein, 10 aa, Artificial Sequence
  Peptide Derived from Human Papillomavirus
NLKEKFSADL

SEQ ID NO: 27307 - protein, 8 aa, Artificial Sequence
  Peptide Derived from Human Papillomavirus
NMSVCAAI

SEQ ID NO: 27308 - protein, 9 aa, Artificial Sequence
  Peptide Derived from Human Papillomavirus
NMSVCAAIA

SEQ ID NO: 27309 - protein, 8 aa, Artificial Sequence
  Peptide Derived from Human Papillomavirus
NPAILEDW

SEQ ID NO: 27310 - protein, 10 aa, Artificial Sequence
  Peptide Derived from Human Papillomavirus
NPAILEDWNF

SEQ ID NO: 27311 - protein, 8 aa, Artificial Sequence
  Peptide Derived from Human Papillomavirus
NPETQRLV

SEQ ID NO: 27312 - protein, 9 aa, Artificial Sequence
  Peptide Derived from Human Papillomavirus
NPETQRLVW

SEQ ID NO: 27313 - protein, 10 aa, Artificial Sequence
  Peptide Derived from Human Papillomavirus
NPETQRLVWA

SEQ ID NO: 27314 - protein, 10 aa, Artificial Sequence
  Peptide Derived from Human Papillomavirus
NPKKIVVPKV

SEQ ID NO: 27315 - protein, 8 aa, Artificial Sequence
  Peptide Derived from Human Papillomavirus
NQLFVTVV

SEQ ID NO: 27316 - protein, 10 aa, Artificial Sequence
  Peptide Derived from Human Papillomavirus
NVPLDICNSI

SEQ ID NO: 27317 - protein, 8 aa, Artificial Sequence
  Peptide Derived from Human Papillomavirus
PLDICNSI

SEQ ID NO: 27318 - protein, 11 aa, Artificial Sequence
  Peptide Derived from Human Papillomavirus
PLDICNSICKY

SEQ ID NO: 27319 - protein, 8 aa, Artificial Sequence
  Peptide Derived from Human Papillomavirus
PLELKNSV

SEQ ID NO: 27320 - protein, 9 aa, Artificial Sequence
  Peptide Derived from Human Papillomavirus
PLELKNSVI

SEQ ID NO: 27321 - protein, 8 aa, Artificial Sequence
  Peptide Derived from Human Papillomavirus
PLGRKFLL

SEQ ID NO: 27322 - protein, 10 aa, Artificial Sequence
  Peptide Derived from Human Papillomavirus
PLGRKFLLQA

SEQ ID NO: 27323 - protein, 11 aa, Artificial Sequence
  Peptide Derived from Human Papillomavirus
PLGVGISGHPL

SEQ ID NO: 27324 - protein, 9 aa, Artificial Sequence
  Peptide Derived from Human Papillomavirus
PPLELKNSV

SEQ ID NO: 27325 - protein, 10 aa, Artificial Sequence
  Peptide Derived from Human Papillomavirus
PPLELKNSVI

SEQ ID NO: 27326 - protein, 10 aa, Artificial Sequence
  Peptide Derived from Human Papillomavirus
PPSGSLEDTY

SEQ ID NO: 27327 - protein, 8 aa, Artificial Sequence
  Peptide Derived from Human Papillomavirus
PPVPVSKV

SEQ ID NO: 27328 - protein, 9 aa, Artificial Sequence
  Peptide Derived from Human Papillomavirus
PPVPVSKVV

SEQ ID NO: 27329 - protein, 9 aa, Artificial Sequence
  Peptide Derived from Human Papillomavirus
PQKPKEDPF

SEQ ID NO: 27330 - protein, 8 aa, Artificial Sequence
  Peptide Derived from Human Papillomavirus
PVPVSKVV

SEQ ID NO: 27331 - protein, 11 aa, Artificial Sequence
  Peptide Derived from Human Papillomavirus
PVSKVVSTDEY

SEQ ID NO: 27332 - protein, 8 aa, Artificial Sequence
  Peptide Derived from Human Papillomavirus
QIFNKPYW

SEQ ID NO: 27333 - protein, 9 aa, Artificial Sequence
  Peptide Derived from Human Papillomavirus
QIFNKPYWM

SEQ ID NO: 27334 - protein, 9 aa, Artificial Sequence
  Peptide Derived from Human Papillomavirus
QLCKITLSA

SEQ ID NO: 27335 - protein, 11 aa, Artificial Sequence
  Peptide Derived from Human Papillomavirus
QLCKITLSADI

SEQ ID NO: 27336 - protein, 11 aa, Artificial Sequence
  Peptide Derived from Human Papillomavirus
QLCLLGCKPPI

SEQ ID NO: 27337 - protein, 8 aa, Artificial Sequence
  Peptide Derived from Human Papillomavirus
QMFVRHFF

SEQ ID NO: 27338 - protein, 9 aa, Artificial Sequence
  Peptide Derived from Human Papillomavirus
RLLTVGHPY

SEQ ID NO: 27339 - protein, 10 aa, Artificial Sequence
  Peptide Derived from Human Papillomavirus
RLLTVGHPYY

SEQ ID NO: 27340 - protein, 8 aa, Artificial Sequence
  Peptide Derived from Human Papillomavirus
RLPDPNKF

SEQ ID NO: 27341 - protein, 10 aa, Artificial Sequence
  Peptide Derived from Human Papillomavirus
RLPDPNKFGF

SEQ ID NO: 27342 - protein, 9 aa, Artificial Sequence
  Peptide Derived from Human Papillomavirus
RLVWACVGL

SEQ ID NO: 27343 - protein, 11 aa, Artificial Sequence
  Peptide Derived from Human Papillomavirus
RLVWACVGLEV

SEQ ID NO: 27344 - protein, 11 aa, Artificial Sequence
  Peptide Derived from Human Papillomavirus
RPKFKAGKRSA

SEQ ID NO: 27345 - protein, 8 aa, Artificial Sequence
  Peptide Derived from Human Papillomavirus
RPSEATVY

SEQ ID NO: 27346 - protein, 9 aa, Artificial Sequence
  Peptide Derived from Human Papillomavirus
RPSEATVYL

SEQ ID NO: 27347 - protein, 10 aa, Artificial Sequence
  Peptide Derived from Human Papillomavirus
RVRLPDPNKF

SEQ ID NO: 27348 - protein, 8 aa, Artificial Sequence
  Peptide Derived from Human Papillomavirus
SICKYPDY

SEQ ID NO: 27349 - protein, 9 aa, Artificial Sequence
  Peptide Derived from Human Papillomavirus
SICKYPDYL

SEQ ID NO: 27350 - protein, 11 aa, Artificial Sequence
  Peptide Derived from Human Papillomavirus
SICKYPDYLKM

SEQ ID NO: 27351 - protein, 11 aa, Artificial Sequence
  Peptide Derived from Human Papillomavirus
SIPKSDNPKKI

SEQ ID NO: 27352 - protein, 8 aa, Artificial Sequence
  Peptide Derived from Human Papillomavirus
SLEDTYRF

SEQ ID NO: 27353 - protein, 9 aa, Artificial Sequence
  Peptide Derived from Human Papillomavirus
SLEDTYRFV

SEQ ID NO: 27354 - protein, 8 aa, Artificial Sequence
  Peptide Derived from Human Papillomavirus
SLWRPSEA

SEQ ID NO: 27355 - protein, 10 aa, Artificial Sequence
  Peptide Derived from Human Papillomavirus
SLWRPSEATV

SEQ ID NO: 27356 - protein, 11 aa, Artificial Sequence
  Peptide Derived from Human Papillomavirus
SLWRPSEATVY

SEQ ID NO: 27357 - protein, 9 aa, Artificial Sequence
  Peptide Derived from Human Papillomavirus
SMDYKQTQL

SEQ ID NO: 27358 - protein, 11 aa, Artificial Sequence
  Peptide Derived from Human Papillomavirus
SMDYKQTQLCL

SEQ ID NO: 27359 - protein, 10 aa, Artificial Sequence
  Peptide Derived from Human Papillomavirus
SMNPAILEDW

SEQ ID NO: 27360 - protein, 9 aa, Artificial Sequence
  Peptide Derived from Human Papillomavirus
SMVTSDAQI

SEQ ID NO: 27361 - protein, 10 aa, Artificial Sequence
  Peptide Derived from Human Papillomavirus
SMVTSDAQIF

SEQ ID NO: 27362 - protein, 8 aa, Artificial Sequence
  Peptide Derived from Human Papillomavirus
SPCSNNAI

SEQ ID NO: 27363 - protein, 10 aa, Artificial Sequence
  Peptide Derived from Human Papillomavirus
SQAITCQKTA

SEQ ID NO: 27364 - protein, 8 aa, Artificial Sequence
  Peptide Derived from Human Papillomavirus
SVIQDGDM

SEQ ID NO: 27365 - protein, 9 aa, Artificial Sequence
  Peptide Derived from Human Papillomavirus
SVIQDGDMV

SEQ ID NO: 27366 - protein, 8 aa, Artificial Sequence
  Peptide Derived from Human Papillomavirus
SVPTDLYI

SEQ ID NO: 27367 - protein, 8 aa, Artificial Sequence
  Peptide Derived from Human Papillomavirus
TLANSTYF

SEQ ID NO: 27368 - protein, 11 aa, Artificial Sequence
  Peptide Derived from Human Papillomavirus
TLFFYLRREQM

SEQ ID NO: 27369 - protein, 9 aa, Artificial Sequence
  Peptide Derived from Human Papillomavirus
TLSADIMTY

SEQ ID NO: 27370 - protein, 10 aa, Artificial Sequence
  Peptide Derived from Human Papillomavirus
TLSADIMTYI

SEQ ID NO: 27371 - protein, 8 aa, Artificial Sequence
  Peptide Derived from Human Papillomavirus
TPGDCPPL

SEQ ID NO: 27372 - protein, 10 aa, Artificial Sequence
  Peptide Derived from Human Papillomavirus
TPGDCPPLEL

SEQ ID NO: 27373 - protein, 11 aa, Artificial Sequence
  Peptide Derived from Human Papillomavirus
TPPSGSLEDTY

SEQ ID NO: 27374 - protein, 11 aa, Artificial Sequence
  Peptide Derived from Human Papillomavirus
TPSGSMVTSDA

SEQ ID NO: 27375 - protein, 9 aa, Artificial Sequence
  Peptide Derived from Human Papillomavirus
TQRLVWACV

SEQ ID NO: 27376 - protein, 11 aa, Artificial Sequence
  Peptide Derived from Human Papillomavirus
TQRLVWACVGL

SEQ ID NO: 27377 - protein, 10 aa, Artificial Sequence
  Peptide Derived from Human Papillomavirus
TVGESVPTDL

SEQ ID NO: 27378 - protein, 11 aa, Artificial Sequence
  Peptide Derived from Human Papillomavirus
TVGESVPTDLY

SEQ ID NO: 27379 - protein, 9 aa, Artificial Sequence
  Peptide Derived from Human Papillomavirus
TVGHPYYSI

SEQ ID NO: 27380 - protein, 11 aa, Artificial Sequence
  Peptide Derived from Human Papillomavirus
TVVDTTRSTNM

SEQ ID NO: 27381 - protein, 9 aa, Artificial Sequence
  Peptide Derived from Human Papillomavirus
TVYLPPVPV

SEQ ID NO: 27382 - protein, 8 aa, Artificial Sequence
  Peptide Derived from Human Papillomavirus
VIQDGDMV

SEQ ID NO: 27383 - protein, 9 aa, Artificial Sequence
  Peptide Derived from Human Papillomavirus
VPKVSGLQY

SEQ ID NO: 27384 - protein, 11 aa, Artificial Sequence
  Peptide Derived from Human Papillomavirus
VPKVSGLQYRV

SEQ ID NO: 27385 - protein, 9 aa, Artificial Sequence
  Peptide Derived from Human Papillomavirus
VPLDICNSI

SEQ ID NO: 27386 - protein, 10 aa, Artificial Sequence
  Peptide Derived from Human Papillomavirus
VVDTTRSTNM

SEQ ID NO: 27387 - protein, 8 aa, Artificial Sequence
  Peptide Derived from Human Papillomavirus
VVPKVSGL

SEQ ID NO: 27388 - protein, 10 aa, Artificial Sequence
  Peptide Derived from Human Papillomavirus
VVPKVSGLQY

SEQ ID NO: 27389 - protein, 8 aa, Artificial Sequence
  Peptide Derived from Human Papillomavirus
VVSTDEYV

SEQ ID NO: 27390 - protein, 8 aa, Artificial Sequence
  Peptide Derived from Human Papillomavirus
YIHSMNPA

SEQ ID NO: 27391 - protein, 9 aa, Artificial Sequence
  Peptide Derived from Human Papillomavirus
YIHSMNPAI

SEQ ID NO: 27392 - protein, 10 aa, Artificial Sequence
  Peptide Derived from Human Papillomavirus
YIHSMNPAIL

SEQ ID NO: 27393 - protein, 9 aa, Artificial Sequence
  Peptide Derived from Human Papillomavirus
YIKGSGSTA

SEQ ID NO: 27394 - protein, 11 aa, Artificial Sequence
  Peptide Derived from Human Papillomavirus
YIKGSGSTATL

SEQ ID NO: 27395 - protein, 9 aa, Artificial Sequence
  Peptide Derived from Human Papillomavirus
YLKMVAEPY

SEQ ID NO: 27396 - protein, 10 aa, Artificial Sequence
  Peptide Derived from Human Papillomavirus
YLPPVPVSKV

SEQ ID NO: 27397 - protein, 11 aa, Artificial Sequence
  Peptide Derived from Human Papillomavirus
YLPPVPVSKVV

SEQ ID NO: 27398 - protein, 8 aa, Artificial Sequence
  Peptide Derived from Human Papillomavirus
YLRHGEEF

SEQ ID NO: 27399 - protein, 10 aa, Artificial Sequence
  Peptide Derived from Human Papillomavirus
YLRHGEEFDL

SEQ ID NO: 27400 - protein, 8 aa, Artificial Sequence
  Peptide Derived from Human Papillomavirus
YLRREQMF

SEQ ID NO: 27401 - protein, 9 aa, Artificial Sequence
  Peptide Derived from Human Papillomavirus
YLRREQMFV

SEQ ID NO: 27402 - protein, 8 aa, Artificial Sequence
  Peptide Derived from Human Papillomavirus
YPDYLKMV

SEQ ID NO: 27403 - protein, 9 aa, Artificial Sequence
  Peptide Derived from Human Papillomavirus
YPDYLKMVA

SEQ ID NO: 27404 - protein, 8 aa, Artificial Sequence
  Peptide Derived from Human Papillomavirus
YVFWEVNL

SEQ ID NO: 27405 - protein, 8 aa, Artificial Sequence
  Peptide Derived from Human Papillomavirus
YVTRTNIY

SEQ ID NO: 27406 - protein, 9 aa, Artificial Sequence
  Peptide Derived from Human Papillomavirus
YVTRTNIYY

SEQ ID NO: 27407 - protein, 11 aa, Artificial Sequence
  Peptide Derived from Human Papillomavirus
YVTRTNIYYHA

SEQ ID NO: 27408 - protein, 8 aa, Artificial Sequence
  Peptide Derived from Human Papillomavirus
AILDVTSV

SEQ ID NO: 27409 - protein, 9 aa, Artificial Sequence
  Peptide Derived from Human Papillomavirus
ALTSRRNTV

SEQ ID NO: 27410 - protein, 11 aa, Artificial Sequence
  Peptide Derived from Human Papillomavirus
ALTSRRNTVRY

SEQ ID NO: 27411 - protein, 9 aa, Artificial Sequence
  Peptide Derived from Human Papillomavirus
APDPDFLDI

SEQ ID NO: 27412 - protein, 10 aa, Artificial Sequence
  Peptide Derived from Human Papillomavirus
APDPDFLDII

SEQ ID NO: 27413 - protein, 11 aa, Artificial Sequence
  Peptide Derived from Human Papillomavirus
APDPDFLDIIA

SEQ ID NO: 27414 - protein, 8 aa, Artificial Sequence
  Peptide Derived from Human Papillomavirus
APKQLITY

SEQ ID NO: 27415 - protein, 8 aa, Artificial Sequence
  Peptide Derived from Human Papillomavirus
APTQVFPF

SEQ ID NO: 27416 - protein, 10 aa, Artificial Sequence
  Peptide Derived from Human Papillomavirus
APTQVFPFPL

SEQ ID NO: 27417 - protein, 11 aa, Artificial Sequence
  Peptide Derived from Human Papillomavirus
APTQVFPFPLA

SEQ ID NO: 27418 - protein, 9 aa, Artificial Sequence
  Peptide Derived from Human Papillomavirus
APTTPQVSI

SEQ ID NO: 27419 - protein, 10 aa, Artificial Sequence
  Peptide Derived from Human Papillomavirus
APTTPQVSIF

SEQ ID NO: 27420 - protein, 11 aa, Artificial Sequence
  Peptide Derived from Human Papillomavirus
APTTPQVSIFV

SEQ ID NO: 27421 - protein, 8 aa, Artificial Sequence
  Peptide Derived from Human Papillomavirus
AVQSTSAV

SEQ ID NO: 27422 - protein, 10 aa, Artificial Sequence
  Peptide Derived from Human Papillomavirus
AVQSTSAVSA

SEQ ID NO: 27423 - protein, 11 aa, Artificial Sequence
  Peptide Derived from Human Papillomavirus
AVQSTSAVSAY

SEQ ID NO: 27424 - protein, 9 aa, Artificial Sequence
  Peptide Derived from Human Papillomavirus
CPSDVIPKI

SEQ ID NO: 27425 - protein, 11 aa, Artificial Sequence
  Peptide Derived from Human Papillomavirus
DIATTADTTPA

SEQ ID NO: 27426 - protein, 9 aa, Artificial Sequence
  Peptide Derived from Human Papillomavirus
DIIALHRPA

SEQ ID NO: 27427 - protein, 10 aa, Artificial Sequence
  Peptide Derived from Human Papillomavirus
DIIALHRPAL

SEQ ID NO: 27428 - protein, 10 aa, Artificial Sequence
  Peptide Derived from Human Papillomavirus
DIPIFSGPDV

SEQ ID NO: 27429 - protein, 8 aa, Artificial Sequence
  Peptide Derived from Human Papillomavirus
DISSINPA

SEQ ID NO: 27430 - protein, 8 aa, Artificial Sequence
  Peptide Derived from Human Papillomavirus
DIYADTDF

SEQ ID NO: 27431 - protein, 10 aa, Artificial Sequence
  Peptide Derived from Human Papillomavirus
DIYADTDFTV

SEQ ID NO: 27432 - protein, 8 aa, Artificial Sequence
  Peptide Derived from Human Papillomavirus
DPDFLDII

SEQ ID NO: 27433 - protein, 9 aa, Artificial Sequence
  Peptide Derived from Human Papillomavirus
DPDFLDIIA

SEQ ID NO: 27434 - protein, 10 aa, Artificial Sequence
  Peptide Derived from Human Papillomavirus
DPDFLDIIAL

SEQ ID NO: 27435 - protein, 8 aa, Artificial Sequence
  Peptide Derived from Human Papillomavirus
DPSIVSLV

SEQ ID NO: 27436 - protein, 11 aa, Artificial Sequence
  Peptide Derived from Human Papillomavirus
DPSVLQPPTPA

SEQ ID NO: 27437 - protein, 11 aa, Artificial Sequence
  Peptide Derived from Human Papillomavirus
DPTFLSAPKQL

SEQ ID NO: 27438 - protein, 10 aa, Artificial Sequence
  Peptide Derived from Human Papillomavirus
DPVGPLDPSI

SEQ ID NO: 27439 - protein, 11 aa, Artificial Sequence
  Peptide Derived from Human Papillomavirus
DPVGPLDPSIV

SEQ ID NO: 27440 - protein, 9 aa, Artificial Sequence
  Peptide Derived from Human Papillomavirus
DQILRYGSM

SEQ ID NO: 27441 - protein, 11 aa, Artificial Sequence
  Peptide Derived from Human Papillomavirus
DQILRYGSMGV

SEQ ID NO: 27442 - protein, 8 aa, Artificial Sequence
  Peptide Derived from Human Papillomavirus
DVGAPAPI

SEQ ID NO: 27443 - protein, 11 aa, Artificial Sequence
  Peptide Derived from Human Papillomavirus
DVIPKIEHTTI

SEQ ID NO: 27444 - protein, 11 aa, Artificial Sequence
  Peptide Derived from Human Papillomavirus
DVPIEHAPTQV

SEQ ID NO: 27445 - protein, 8 aa, Artificial Sequence
  Peptide Derived from Human Papillomavirus
EIPMDTFI

SEQ ID NO: 27446 - protein, 9 aa, Artificial Sequence
  Peptide Derived from Human Papillomavirus
EIPMDTFIV

SEQ ID NO: 27447 - protein, 9 aa, Artificial Sequence
  Peptide Derived from Human Papillomavirus
EMQPLGASA

SEQ ID NO: 27448 - protein, 10 aa, Artificial Sequence
  Peptide Derived from Human Papillomavirus
FIVSTNNENI

SEQ ID NO: 27449 - protein, 11 aa, Artificial Sequence
  Peptide Derived from Human Papillomavirus
FLDIIALHRPA

SEQ ID NO: 27450 - protein, 8 aa, Artificial Sequence
  Peptide Derived from Human Papillomavirus
FLSAPKQL

SEQ ID NO: 27451 - protein, 9 aa, Artificial Sequence
  Peptide Derived from Human Papillomavirus
FLSAPKQLI

SEQ ID NO: 27452 - protein, 11 aa, Artificial Sequence
  Peptide Derived from Human Papillomavirus
FLSAPKQLITY

SEQ ID NO: 27453 - protein, 10 aa, Artificial Sequence
  Peptide Derived from Human Papillomavirus
FPLAPTTPQV

SEQ ID NO: 27454 - protein, 8 aa, Artificial Sequence
  Peptide Derived from Human Papillomavirus
FVDGGDFY

SEQ ID NO: 27455 - protein, 9 aa, Artificial Sequence
  Peptide Derived from Human Papillomavirus
FVDGGDFYL

SEQ ID NO: 27456 - protein, 9 aa, Artificial Sequence
  Peptide Derived from Human Papillomavirus
GIVDVGAPA

SEQ ID NO: 27457 - protein, 11 aa, Artificial Sequence
  Peptide Derived from Human Papillomavirus
GIVDVGAPAPI

SEQ ID NO: 27458 - protein, 11 aa, Artificial Sequence
  Peptide Derived from Human Papillomavirus
GLYDIYADTDF

SEQ ID NO: 27459 - protein, 10 aa, Artificial Sequence
  Peptide Derived from Human Papillomavirus
GLYSKATQQV

SEQ ID NO: 27460 - protein, 9 aa, Artificial Sequence
  Peptide Derived from Human Papillomavirus
GPDVPIEHA

SEQ ID NO: 27461 - protein, 8 aa, Artificial Sequence
  Peptide Derived from Human Papillomavirus
GPLDPSIV

SEQ ID NO: 27462 - protein, 10 aa, Artificial Sequence
  Peptide Derived from Human Papillomavirus
GPLDPSIVSL

SEQ ID NO: 27463 - protein, 11 aa, Artificial Sequence
  Peptide Derived from Human Papillomavirus
GPLDPSIVSLV

SEQ ID NO: 27464 - protein, 9 aa, Artificial Sequence
  Peptide Derived from Human Papillomavirus
GVFFGGLGI

SEQ ID NO: 27465 - protein, 8 aa, Artificial Sequence
  Peptide Derived from Human Papillomavirus
GVRRPARL

SEQ ID NO: 27466 - protein, 10 aa, Artificial Sequence
  Peptide Derived from Human Papillomavirus
GVRRPARLGL

SEQ ID NO: 27467 - protein, 11 aa, Artificial Sequence
  Peptide Derived from Human Papillomavirus
GVRRPARLGLY

SEQ ID NO: 27468 - protein, 9 aa, Artificial Sequence
  Peptide Derived from Human Papillomavirus
HLLLSSSSI

SEQ ID NO: 27469 - protein, 8 aa, Artificial Sequence
  Peptide Derived from Human Papillomavirus
HPPTTSGF

SEQ ID NO: 27470 - protein, 10 aa, Artificial Sequence
  Peptide Derived from Human Papillomavirus
HPPTTSGFDI

SEQ ID NO: 27471 - protein, 11 aa, Artificial Sequence
  Peptide Derived from Human Papillomavirus
HPPTTSGFDIA

SEQ ID NO: 27472 - protein, 8 aa, Artificial Sequence
  Peptide Derived from Human Papillomavirus
IIALHRPA

SEQ ID NO: 27473 - protein, 9 aa, Artificial Sequence
  Peptide Derived from Human Papillomavirus
IIALHRPAL

SEQ ID NO: 27474 - protein, 9 aa, Artificial Sequence
  Peptide Derived from Human Papillomavirus
ILRYGSMGV

SEQ ID NO: 27475 - protein, 10 aa, Artificial Sequence
  Peptide Derived from Human Papillomavirus
ILRYGSMGVF

SEQ ID NO: 27476 - protein, 11 aa, Artificial Sequence
  Peptide Derived from Human Papillomavirus
ILRYGSMGVFF

SEQ ID NO: 27477 - protein, 8 aa, Artificial Sequence
  Peptide Derived from Human Papillomavirus
IPGVRRPA

SEQ ID NO: 27478 - protein, 10 aa, Artificial Sequence
  Peptide Derived from Human Papillomavirus
IPGVRRPARL

SEQ ID NO: 27479 - protein, 10 aa, Artificial Sequence
  Peptide Derived from Human Papillomavirus
IPHPPTTSGF

SEQ ID NO: 27480 - protein, 9 aa, Artificial Sequence
  Peptide Derived from Human Papillomavirus
IPIFSGPDV

SEQ ID NO: 27481 - protein, 11 aa, Artificial Sequence
  Peptide Derived from Human Papillomavirus
IPIFSGPDVPI

SEQ ID NO: 27482 - protein, 9 aa, Artificial Sequence
  Peptide Derived from Human Papillomavirus
IPIRPPVSI

SEQ ID NO: 27483 - protein, 9 aa, Artificial Sequence
  Peptide Derived from Human Papillomavirus
IPKIEHTTI

SEQ ID NO: 27484 - protein, 10 aa, Artificial Sequence
  Peptide Derived from Human Papillomavirus
IPKIEHTTIA

SEQ ID NO: 27485 - protein, 8 aa, Artificial Sequence
  Peptide Derived from Human Papillomavirus
IPMDTFIV

SEQ ID NO: 27486 - protein, 8 aa, Artificial Sequence
  Peptide Derived from Human Papillomavirus
IVDVGAPA

SEQ ID NO: 27487 - protein, 10 aa, Artificial Sequence
  Peptide Derived from Human Papillomavirus
IVDVGAPAPI

SEQ ID NO: 27488 - protein, 10 aa, Artificial Sequence
  Peptide Derived from Human Papillomavirus
IVSLVEESGI

SEQ ID NO: 27489 - protein, 11 aa, Artificial Sequence
  Peptide Derived from Human Papillomavirus
IVSLVEESGIV

SEQ ID NO: 27490 - protein, 9 aa, Artificial Sequence
  Peptide Derived from Human Papillomavirus
IVSTNNENI

SEQ ID NO: 27491 - protein, 8 aa, Artificial Sequence
  Peptide Derived from Human Papillomavirus
KIEHTTIA

SEQ ID NO: 27492 - protein, 11 aa, Artificial Sequence
  Peptide Derived from Human Papillomavirus
KIEHTTIADQI

SEQ ID NO: 27493 - protein, 10 aa, Artificial Sequence
  Peptide Derived from Human Papillomavirus
KQLITYENPA

SEQ ID NO: 27494 - protein, 11 aa, Artificial Sequence
  Peptide Derived from Human Papillomavirus
KQLITYENPAY

SEQ ID NO: 27495 - protein, 10 aa, Artificial Sequence
  Peptide Derived from Human Papillomavirus
KQTLRTRSGA

SEQ ID NO: 27496 - protein, 8 aa, Artificial Sequence
  Peptide Derived from Human Papillomavirus
KVIDPTFL

SEQ ID NO: 27497 - protein, 10 aa, Artificial Sequence
  Peptide Derived from Human Papillomavirus
KVIDPTFLSA

SEQ ID NO: 27498 - protein, 8 aa, Artificial Sequence
  Peptide Derived from Human Papillomavirus
LITYENPA

SEQ ID NO: 27499 - protein, 9 aa, Artificial Sequence
  Peptide Derived from Human Papillomavirus
LITYENPAY

SEQ ID NO: 27500 - protein, 8 aa, Artificial Sequence
  Peptide Derived from Human Papillomavirus
LLLSSSSI

SEQ ID NO: 27501 - protein, 8 aa, Artificial Sequence
  Peptide Derived from Human Papillomavirus
LVEESGIV

SEQ ID NO: 27502 - protein, 10 aa, Artificial Sequence
  Peptide Derived from Human Papillomavirus
LVEESGIVDV

SEQ ID NO: 27503 - protein, 9 aa, Artificial Sequence
  Peptide Derived from Human Papillomavirus
MLKRRRKRV

SEQ ID NO: 27504 - protein, 11 aa, Artificial Sequence
  Peptide Derived from Human Papillomavirus
MLKRRRKRVSY

SEQ ID NO: 27505 - protein, 8 aa, Artificial Sequence
  Peptide Derived from Human Papillomavirus
MQPLGASA

SEQ ID NO: 27506 - protein, 8 aa, Artificial Sequence
  Peptide Derived from Human Papillomavirus
NIAPDPDF

SEQ ID NO: 27507 - protein, 9 aa, Artificial Sequence
  Peptide Derived from Human Papillomavirus
NIAPDPDFL

SEQ ID NO: 27508 - protein, 11 aa, Artificial Sequence
  Peptide Derived from Human Papillomavirus
NIAPDPDFLDI

SEQ ID NO: 27509 - protein, 8 aa, Artificial Sequence
  Peptide Derived from Human Papillomavirus
NITSSTPI

SEQ ID NO: 27510 - protein, 11 aa, Artificial Sequence
  Peptide Derived from Human Papillomavirus
NITSSTPIPGV

SEQ ID NO: 27511 - protein, 9 aa, Artificial Sequence
  Peptide Derived from Human Papillomavirus
NPAGESIEM

SEQ ID NO: 27512 - protein, 9 aa, Artificial Sequence
  Peptide Derived from Human Papillomavirus
NPAYETVNA

SEQ ID NO: 27513 - protein, 9 aa, Artificial Sequence
  Peptide Derived from Human Papillomavirus
NPTFTDPSV

SEQ ID NO: 27514 - protein, 10 aa, Artificial Sequence
  Peptide Derived from Human Papillomavirus
NPTFTDPSVL

SEQ ID NO: 27515 - protein, 8 aa, Artificial Sequence
  Peptide Derived from Human Papillomavirus
NVSPSTAV

SEQ ID NO: 27516 - protein, 9 aa, Artificial Sequence
  Peptide Derived from Human Papillomavirus
PIEHAPTQV

SEQ ID NO: 27517 - protein, 10 aa, Artificial Sequence
  Peptide Derived from Human Papillomavirus
PIEHAPTQVF

SEQ ID NO: 27518 - protein, 8 aa, Artificial Sequence
  Peptide Derived from Human Papillomavirus
PIFSGPDV

SEQ ID NO: 27519 - protein, 10 aa, Artificial Sequence
  Peptide Derived from Human Papillomavirus
PIFSGPDVPI

SEQ ID NO: 27520 - protein, 9 aa, Artificial Sequence
  Peptide Derived from Human Papillomavirus
PIPGVRRPA

SEQ ID NO: 27521 - protein, 11 aa, Artificial Sequence
  Peptide Derived from Human Papillomavirus
PIPGVRRPARL

SEQ ID NO: 27522 - protein, 11 aa, Artificial Sequence
  Peptide Derived from Human Papillomavirus
PIPHPPTTSGF

SEQ ID NO: 27523 - protein, 8 aa, Artificial Sequence
  Peptide Derived from Human Papillomavirus
PIRPPVSI

SEQ ID NO: 27524 - protein, 11 aa, Artificial Sequence
  Peptide Derived from Human Papillomavirus
PIRPPVSIDPV

SEQ ID NO: 27525 - protein, 9 aa, Artificial Sequence
  Peptide Derived from Human Papillomavirus
PLAPTTPQV

SEQ ID NO: 27526 - protein, 11 aa, Artificial Sequence
  Peptide Derived from Human Papillomavirus
PLAPTTPQVSI

SEQ ID NO: 27527 - protein, 9 aa, Artificial Sequence
  Peptide Derived from Human Papillomavirus
PLDPSIVSL

SEQ ID NO: 27528 - protein, 10 aa, Artificial Sequence
  Peptide Derived from Human Papillomavirus
PLDPSIVSLV

SEQ ID NO: 27529 - protein, 8 aa, Artificial Sequence
  Peptide Derived from Human Papillomavirus
PLSTGFDI

SEQ ID NO: 27530 - protein, 10 aa, Artificial Sequence
  Peptide Derived from Human Papillomavirus
PLSTGFDIPI

SEQ ID NO: 27531 - protein, 11 aa, Artificial Sequence
  Peptide Derived from Human Papillomavirus
PLSTGFDIPIF

SEQ ID NO: 27532 - protein, 9 aa, Artificial Sequence
  Peptide Derived from Human Papillomavirus
PLSTRPSTV

SEQ ID NO: 27533 - protein, 11 aa, Artificial Sequence
  Peptide Derived from Human Papillomavirus
PPTPAETSGHL

SEQ ID NO: 27534 - protein, 9 aa, Artificial Sequence
  Peptide Derived from Human Papillomavirus
PPTTSGFDI

SEQ ID NO: 27535 - protein, 10 aa, Artificial Sequence
  Peptide Derived from Human Papillomavirus
PPTTSGFDIA

SEQ ID NO: 27536 - protein, 8 aa, Artificial Sequence
  Peptide Derived from Human Papillomavirus
PPVSIDPV

SEQ ID NO: 27537 - protein, 11 aa, Artificial Sequence
  Peptide Derived from Human Papillomavirus
PPVSIDPVGPL

SEQ ID NO: 27538 - protein, 9 aa, Artificial Sequence
  Peptide Derived from Human Papillomavirus
PVGPLDPSI

SEQ ID NO: 27539 - protein, 10 aa, Artificial Sequence
  Peptide Derived from Human Papillomavirus
PVGPLDPSIV

SEQ ID NO: 27540 - protein, 10 aa, Artificial Sequence
  Peptide Derived from Human Papillomavirus
PVSIDPVGPL

SEQ ID NO: 27541 - protein, 8 aa, Artificial Sequence
  Peptide Derived from Human Papillomavirus
QILRYGSM

SEQ ID NO: 27542 - protein, 10 aa, Artificial Sequence
  Peptide Derived from Human Papillomavirus
QILRYGSMGV

SEQ ID NO: 27543 - protein, 11 aa, Artificial Sequence
  Peptide Derived from Human Papillomavirus
QILRYGSMGVF

SEQ ID NO: 27544 - protein, 9 aa, Artificial Sequence
  Peptide Derived from Human Papillomavirus
QLITYENPA

SEQ ID NO: 27545 - protein, 10 aa, Artificial Sequence
  Peptide Derived from Human Papillomavirus
QLITYENPAY

SEQ ID NO: 27546 - protein, 8 aa, Artificial Sequence
  Peptide Derived from Human Papillomavirus
QLYQTCKA

SEQ ID NO: 27547 - protein, 9 aa, Artificial Sequence
  Peptide Derived from Human Papillomavirus
QLYQTCKAA

SEQ ID NO: 27548 - protein, 10 aa, Artificial Sequence
  Peptide Derived from Human Papillomavirus
QQVKVIDPTF

SEQ ID NO: 27549 - protein, 11 aa, Artificial Sequence
  Peptide Derived from Human Papillomavirus
QQVKVIDPTFL

SEQ ID NO: 27550 - protein, 8 aa, Artificial Sequence
  Peptide Derived from Human Papillomavirus
QVFPFPLA

SEQ ID NO: 27551 - protein, 9 aa, Artificial Sequence
  Peptide Derived from Human Papillomavirus
QVKVIDPTF

SEQ ID NO: 27552 - protein, 10 aa, Artificial Sequence
  Peptide Derived from Human Papillomavirus
QVKVIDPTFL

SEQ ID NO: 27553 - protein, 11 aa, Artificial Sequence
  Peptide Derived from Human Papillomavirus
QVSIFVDGGDF

SEQ ID NO: 27554 - protein, 8 aa, Artificial Sequence
  Peptide Derived from Human Papillomavirus
RLGLYSKA

SEQ ID NO: 27555 - protein, 8 aa, Artificial Sequence
  Peptide Derived from Human Papillomavirus
RLGNKQTL

SEQ ID NO: 27556 - protein, 11 aa, Artificial Sequence
  Peptide Derived from Human Papillomavirus
RPALTSRRNTV

SEQ ID NO: 27557 - protein, 8 aa, Artificial Sequence
  Peptide Derived from Human Papillomavirus
RPARLGLY

SEQ ID NO: 27558 - protein, 11 aa, Artificial Sequence
  Peptide Derived from Human Papillomavirus
RPARLGLYSKA

SEQ ID NO: 27559 - protein, 9 aa, Artificial Sequence
  Peptide Derived from Human Papillomavirus
RPPVSIDPV

SEQ ID NO: 27560 - protein, 8 aa, Artificial Sequence
  Peptide Derived from Human Papillomavirus
RPSTVSEA

SEQ ID NO: 27561 - protein, 10 aa, Artificial Sequence
  Peptide Derived from Human Papillomavirus
RPSTVSEASI

SEQ ID NO: 27562 - protein, 8 aa, Artificial Sequence
  Peptide Derived from Human Papillomavirus
RVHYYYDI

SEQ ID NO: 27563 - protein, 11 aa, Artificial Sequence
  Peptide Derived from Human Papillomavirus
RVHYYYDISSI

SEQ ID NO: 27564 - protein, 9 aa, Artificial Sequence
  Peptide Derived from Human Papillomavirus
RVSYFFTDV

SEQ ID NO: 27565 - protein, 11 aa, Artificial Sequence
  Peptide Derived from Human Papillomavirus
RVSYFFTDVSV

SEQ ID NO: 27566 - protein, 8 aa, Artificial Sequence
  Peptide Derived from Human Papillomavirus
SIDPVGPL

SEQ ID NO: 27567 - protein, 9 aa, Artificial Sequence
  Peptide Derived from Human Papillomavirus
SIEMQPLGA

SEQ ID NO: 27568 - protein, 11 aa, Artificial Sequence
  Peptide Derived from Human Papillomavirus
SIEMQPLGASA

SEQ ID NO: 27569 - protein, 9 aa, Artificial Sequence
  Peptide Derived from Human Papillomavirus
SIFVDGGDF

SEQ ID NO: 27570 - protein, 10 aa, Artificial Sequence
  Peptide Derived from Human Papillomavirus
SIFVDGGDFY

SEQ ID NO: 27571 - protein, 11 aa, Artificial Sequence
  Peptide Derived from Human Papillomavirus
SIFVDGGDFYL

SEQ ID NO: 27572 - protein, 9 aa, Artificial Sequence
  Peptide Derived from Human Papillomavirus
SINPAGESI

SEQ ID NO: 27573 - protein, 11 aa, Artificial Sequence
  Peptide Derived from Human Papillomavirus
SINPAGESIEM

SEQ ID NO: 27574 - protein, 8 aa, Artificial Sequence
  Peptide Derived from Human Papillomavirus
SIPIRPPV

SEQ ID NO: 27575 - protein, 10 aa, Artificial Sequence
  Peptide Derived from Human Papillomavirus
SIPIRPPVSI

SEQ ID NO: 27576 - protein, 10 aa, Artificial Sequence
  Peptide Derived from Human Papillomavirus
SISTHNYEEI

SEQ ID NO: 27577 - protein, 11 aa, Artificial Sequence
  Peptide Derived from Human Papillomavirus
SIVSLVEESGI

SEQ ID NO: 27578 - protein, 8 aa, Artificial Sequence
  Peptide Derived from Human Papillomavirus
SLVEESGI

SEQ ID NO: 27579 - protein, 9 aa, Artificial Sequence
  Peptide Derived from Human Papillomavirus
SLVEESGIV

SEQ ID NO: 27580 - protein, 11 aa, Artificial Sequence
  Peptide Derived from Human Papillomavirus
SLVEESGIVDV

SEQ ID NO: 27581 - protein, 11 aa, Artificial Sequence
  Peptide Derived from Human Papillomavirus
SLYFSNTSHNI

SEQ ID NO: 27582 - protein, 9 aa, Artificial Sequence
  Peptide Derived from Human Papillomavirus
SMGVFFGGL

SEQ ID NO: 27583 - protein, 11 aa, Artificial Sequence
  Peptide Derived from Human Papillomavirus
SMGVFFGGLGI

SEQ ID NO: 27584 - protein, 11 aa, Artificial Sequence
  Peptide Derived from Human Papillomavirus
SPSTAVQSTSA

SEQ ID NO: 27585 - protein, 9 aa, Artificial Sequence
  Peptide Derived from Human Papillomavirus
SVLQPPTPA

SEQ ID NO: 27586 - protein, 10 aa, Artificial Sequence
  Peptide Derived from Human Papillomavirus
SVSTHENPTF

SEQ ID NO: 27587 - protein, 9 aa, Artificial Sequence
  Peptide Derived from Human Papillomavirus
TIADQILRY

SEQ ID NO: 27588 - protein, 8 aa, Artificial Sequence
  Peptide Derived from Human Papillomavirus
TIGARVHY

SEQ ID NO: 27589 - protein, 9 aa, Artificial Sequence
  Peptide Derived from Human Papillomavirus
TIGARVHYY

SEQ ID NO: 27590 - protein, 10 aa, Artificial Sequence
  Peptide Derived from Human Papillomavirus
TIGARVHYYY

SEQ ID NO: 27591 - protein, 9 aa, Artificial Sequence
  Peptide Derived from Human Papillomavirus
TLNDGLYDI

SEQ ID NO: 27592 - protein, 10 aa, Artificial Sequence
  Peptide Derived from Human Papillomavirus
TLNDGLYDIY

SEQ ID NO: 27593 - protein, 11 aa, Artificial Sequence
  Peptide Derived from Human Papillomavirus
TLNDGLYDIYA

SEQ ID NO: 27594 - protein, 8 aa, Artificial Sequence
  Peptide Derived from Human Papillomavirus
TLRTRSGA

SEQ ID NO: 27595 - protein, 10 aa, Artificial Sequence
  Peptide Derived from Human Papillomavirus
TLRTRSGATI

SEQ ID NO: 27596 - protein, 9 aa, Artificial Sequence
  Peptide Derived from Human Papillomavirus
TPAETSGHL

SEQ ID NO: 27597 - protein, 10 aa, Artificial Sequence
  Peptide Derived from Human Papillomavirus
TPAETSGHLL

SEQ ID NO: 27598 - protein, 11 aa, Artificial Sequence
  Peptide Derived from Human Papillomavirus
TPAETSGHLLL

SEQ ID NO: 27599 - protein, 10 aa, Artificial Sequence
  Peptide Derived from Human Papillomavirus
TPAILDVTSV

SEQ ID NO: 27600 - protein, 10 aa, Artificial Sequence
  Peptide Derived from Human Papillomavirus
TPIPGVRRPA

SEQ ID NO: 27601 - protein, 8 aa, Artificial Sequence
  Peptide Derived from Human Papillomavirus
TPQVSIFV

SEQ ID NO: 27602 - protein, 9 aa, Artificial Sequence
  Peptide Derived from Human Papillomavirus
TQLYQTCKA

SEQ ID NO: 27603 - protein, 10 aa, Artificial Sequence
  Peptide Derived from Human Papillomavirus
TQLYQTCKAA

SEQ ID NO: 27604 - protein, 11 aa, Artificial Sequence
  Peptide Derived from Human Papillomavirus
TQQVKVIDPTF

SEQ ID NO: 27605 - protein, 8 aa, Artificial Sequence
  Peptide Derived from Human Papillomavirus
TQVFPFPL

SEQ ID NO: 27606 - protein, 9 aa, Artificial Sequence
  Peptide Derived from Human Papillomavirus
TQVFPFPLA

SEQ ID NO: 27607 - protein, 10 aa, Artificial Sequence
  Peptide Derived from Human Papillomavirus
TVDTPATHNV

SEQ ID NO: 27608 - protein, 8 aa, Artificial Sequence
  Peptide Derived from Human Papillomavirus
TVNAEESL

SEQ ID NO: 27609 - protein, 9 aa, Artificial Sequence
  Peptide Derived from Human Papillomavirus
TVNAEESLY

SEQ ID NO: 27610 - protein, 10 aa, Artificial Sequence
  Peptide Derived from Human Papillomavirus
TVNAEESLYF

SEQ ID NO: 27611 - protein, 8 aa, Artificial Sequence
  Peptide Derived from Human Papillomavirus
TVPLSTGF

SEQ ID NO: 27612 - protein, 10 aa, Artificial Sequence
  Peptide Derived from Human Papillomavirus
TVPLSTGFDI

SEQ ID NO: 27613 - protein, 9 aa, Artificial Sequence
  Peptide Derived from Human Papillomavirus
TVSEASIPI

SEQ ID NO: 27614 - protein, 9 aa, Artificial Sequence
  Peptide Derived from Human Papillomavirus
VIDPTFLSA

SEQ ID NO: 27615 - protein, 10 aa, Artificial Sequence
  Peptide Derived from Human Papillomavirus
VIPKIEHTTI

SEQ ID NO: 27616 - protein, 11 aa, Artificial Sequence
  Peptide Derived from Human Papillomavirus
VIPKIEHTTIA

SEQ ID NO: 27617 - protein, 8 aa, Artificial Sequence
  Peptide Derived from Human Papillomavirus
VLQPPTPA

SEQ ID NO: 27618 - protein, 10 aa, Artificial Sequence
  Peptide Derived from Human Papillomavirus
VPIEHAPTQV

SEQ ID NO: 27619 - protein, 11 aa, Artificial Sequence
  Peptide Derived from Human Papillomavirus
VPIEHAPTQVF

SEQ ID NO: 27620 - protein, 9 aa, Artificial Sequence
  Peptide Derived from Human Papillomavirus
VPLSTGFDI

SEQ ID NO: 27621 - protein, 11 aa, Artificial Sequence
  Peptide Derived from Human Papillomavirus
VPLSTGFDIPI

SEQ ID NO: 27622 - protein, 10 aa, Artificial Sequence
  Peptide Derived from Human Papillomavirus
VPLSTRPSTV

SEQ ID NO: 27623 - protein, 9 aa, Artificial Sequence
  Peptide Derived from Human Papillomavirus
VPTNTTVPL

SEQ ID NO: 27624 - protein, 9 aa, Artificial Sequence
  Peptide Derived from Human Papillomavirus
VQSTSAVSA

SEQ ID NO: 27625 - protein, 10 aa, Artificial Sequence
  Peptide Derived from Human Papillomavirus
VQSTSAVSAY

SEQ ID NO: 27626 - protein, 11 aa, Artificial Sequence
  Peptide Derived from Human Papillomavirus
VQSTSAVSAYV

SEQ ID NO: 27627 - protein, 8 aa, Artificial Sequence
  Peptide Derived from Human Papillomavirus
YLHPSYYM

SEQ ID NO: 27628 - protein, 9 aa, Artificial Sequence
  Peptide Derived from Human Papillomavirus
YLHPSYYML

SEQ ID NO: 27629 - protein, 10 aa, Artificial Sequence
  Peptide Derived from Human Papillomavirus
YMLKRRRKRV

SEQ ID NO: 27630 - protein, 11 aa, Artificial Sequence
  Peptide Derived from Human Papillomavirus
YVPLSTRPSTV

SEQ ID NO: 27631 - protein, 8 aa, Artificial Sequence
  Peptide Derived from Human Papillomavirus
YVPTNTTV

SEQ ID NO: 27632 - protein, 10 aa, Artificial Sequence
  Peptide Derived from Human Papillomavirus
YVPTNTTVPL

SEQ ID NO: 27633 - protein, 10 aa, Artificial Sequence
  Peptide Derived from Human Papillomavirus
AINDENWKSF

SEQ ID NO: 27634 - protein, 11 aa, Artificial Sequence
  Peptide Derived from Human Papillomavirus
AINDENWKSFF

SEQ ID NO: 27635 - protein, 9 aa, Artificial Sequence
  Peptide Derived from Human Papillomavirus
ALDGNEISI

SEQ ID NO: 27636 - protein, 11 aa, Artificial Sequence
  Peptide Derived from Human Papillomavirus
ALDGNEISIDV

SEQ ID NO: 27637 - protein, 8 aa, Artificial Sequence
  Peptide Derived from Human Papillomavirus
ALKRKFAA

SEQ ID NO: 27638 - protein, 10 aa, Artificial Sequence
  Peptide Derived from Human Papillomavirus
ALVQLKCPPL

SEQ ID NO: 27639 - protein, 11 aa, Artificial Sequence
  Peptide Derived from Human Papillomavirus
ALVQLKCPPLL

SEQ ID NO: 27640 - protein, 8 aa, Artificial Sequence
  Peptide Derived from Human Papillomavirus
ALYWFRTA

SEQ ID NO: 27641 - protein, 9 aa, Artificial Sequence
  Peptide Derived from Human Papillomavirus
ALYWFRTAM

SEQ ID NO: 27642 - protein, 8 aa, Artificial Sequence
  Peptide Derived from Human Papillomavirus
AMSNISDV

SEQ ID NO: 27643 - protein, 10 aa, Artificial Sequence
  Peptide Derived from Human Papillomavirus
AQLADSNSNA

SEQ ID NO: 27644 - protein, 11 aa, Artificial Sequence
  Peptide Derived from Human Papillomavirus
AQLADSNSNAA

SEQ ID NO: 27645 - protein, 9 aa, Artificial Sequence
  Peptide Derived from Human Papillomavirus
AVCALKRKF

SEQ ID NO: 27646 - protein, 10 aa, Artificial Sequence
  Peptide Derived from Human Papillomavirus
AVCALKRKFA

SEQ ID NO: 27647 - protein, 11 aa, Artificial Sequence
  Peptide Derived from Human Papillomavirus
AVCALKRKFAA

SEQ ID NO: 27648 - protein, 11 aa, Artificial Sequence
  Peptide Derived from Human Papillomavirus
AVIERRTGDNI

SEQ ID NO: 27649 - protein, 11 aa, Artificial Sequence
  Peptide Derived from Human Papillomavirus
CITGYGISPSV

SEQ ID NO: 27650 - protein, 8 aa, Artificial Sequence
  Peptide Derived from Human Papillomavirus
CLTCDRGI

SEQ ID NO: 27651 - protein, 9 aa, Artificial Sequence
  Peptide Derived from Human Papillomavirus
CLTCDRGII

SEQ ID NO: 27652 - protein, 10 aa, Artificial Sequence
  Peptide Derived from Human Papillomavirus
CLTCDRGIII

SEQ ID NO: 27653 - protein, 11 aa, Artificial Sequence
  Peptide Derived from Human Papillomavirus
CLTCDRGIIIL

SEQ ID NO: 27654 - protein, 8 aa, Artificial Sequence
  Peptide Derived from Human Papillomavirus
CMLICGPA

SEQ ID NO: 27655 - protein, 9 aa, Artificial Sequence
  Peptide Derived from Human Papillomavirus
CMVIEPPKL

SEQ ID NO: 27656 - protein, 8 aa, Artificial Sequence
  Peptide Derived from Human Papillomavirus
CVNSKSHF

SEQ ID NO: 27657 - protein, 9 aa, Artificial Sequence
  Peptide Derived from Human Papillomavirus
CVNSKSHFW

SEQ ID NO: 27658 - protein, 10 aa, Artificial Sequence
  Peptide Derived from Human Papillomavirus
CVNSKSHFWL

SEQ ID NO: 27659 - protein, 9 aa, Artificial Sequence
  Peptide Derived from Human Papillomavirus
DIAYYYAQL

SEQ ID NO: 27660 - protein, 10 aa, Artificial Sequence
  Peptide Derived from Human Papillomavirus
DIAYYYAQLA

SEQ ID NO: 27661 - protein, 10 aa, Artificial Sequence
  Peptide Derived from Human Papillomavirus
DLLEFIDDSM

SEQ ID NO: 27662 - protein, 8 aa, Artificial Sequence
  Peptide Derived from Human Papillomavirus
DLNAVCAL

SEQ ID NO: 27663 - protein, 8 aa, Artificial Sequence
  Peptide Derived from Human Papillomavirus
DLSEMVQW

SEQ ID NO: 27664 - protein, 9 aa, Artificial Sequence
  Peptide Derived from Human Papillomavirus
DLSEMVQWA

SEQ ID NO: 27665 - protein, 10 aa, Artificial Sequence
  Peptide Derived from Human Papillomavirus
DLSEMVQWAY

SEQ ID NO: 27666 - protein, 8 aa, Artificial Sequence
  Peptide Derived from Human Papillomavirus
DPEGTNGA

SEQ ID NO: 27667 - protein, 10 aa, Artificial Sequence
  Peptide Derived from Human Papillomavirus
DPEGTNGAGM

SEQ ID NO: 27668 - protein, 8 aa, Artificial Sequence
  Peptide Derived from Human Papillomavirus
DVKHRALV

SEQ ID NO: 27669 - protein, 10 aa, Artificial Sequence
  Peptide Derived from Human Papillomavirus
DVKHRALVQL

SEQ ID NO: 27670 - protein, 9 aa, Artificial Sequence
  Peptide Derived from Human Papillomavirus
DVQGTTPEW

SEQ ID NO: 27671 - protein, 10 aa, Artificial Sequence
  Peptide Derived from Human Papillomavirus
DVQGTTPEWI

SEQ ID NO: 27672 - protein, 9 aa, Artificial Sequence
  Peptide Derived from Human Papillomavirus
DVTPISWTY

SEQ ID NO: 27673 - protein, 10 aa, Artificial Sequence
  Peptide Derived from Human Papillomavirus
DVTPISWTYI

SEQ ID NO: 27674 - protein, 10 aa, Artificial Sequence
  Peptide Derived from Human Papillomavirus
EISIDVKHRA

SEQ ID NO: 27675 - protein, 11 aa, Artificial Sequence
  Peptide Derived from Human Papillomavirus
EISIDVKHRAL

SEQ ID NO: 27676 - protein, 8 aa, Artificial Sequence
  Peptide Derived from Human Papillomavirus
ELTDDSDI

SEQ ID NO: 27677 - protein, 9 aa, Artificial Sequence
  Peptide Derived from Human Papillomavirus
ELTDDSDIA

SEQ ID NO: 27678 - protein, 10 aa, Artificial Sequence
  Peptide Derived from Human Papillomavirus
ELTDDSDIAY

SEQ ID NO: 27679 - protein, 11 aa, Artificial Sequence
  Peptide Derived from Human Papillomavirus
ELTDDSDIAYY

SEQ ID NO: 27680 - protein, 11 aa, Artificial Sequence
  Peptide Derived from Human Papillomavirus
EMVQWAYDNEL

SEQ ID NO: 27681 - protein, 11 aa, Artificial Sequence
  Peptide Derived from Human Papillomavirus
EPPKLRSQTCA

SEQ ID NO: 27682 - protein, 8 aa, Artificial Sequence
  Peptide Derived from Human Papillomavirus
EVETQQMV

SEQ ID NO: 27683 - protein, 11 aa, Artificial Sequence
  Peptide Derived from Human Papillomavirus
EVETQQMVQQV

SEQ ID NO: 27684 - protein, 8 aa, Artificial Sequence
  Peptide Derived from Human Papillomavirus
EVSCETNV

SEQ ID NO: 27685 - protein, 10 aa, Artificial Sequence
  Peptide Derived from Human Papillomavirus
FIDDSMENSI

SEQ ID NO: 27686 - protein, 8 aa, Artificial Sequence
  Peptide Derived from Human Papillomavirus
FLGAFKKF

SEQ ID NO: 27687 - protein, 9 aa, Artificial Sequence
  Peptide Derived from Human Papillomavirus
FLGAFKKFL

SEQ ID NO: 27688 - protein, 10 aa, Artificial Sequence
  Peptide Derived from Human Papillomavirus
FLKGCVISCV

SEQ ID NO: 27689 - protein, 11 aa, Artificial Sequence
  Peptide Derived from Human Papillomavirus
FLKGIPKKSCM

SEQ ID NO: 27690 - protein, 8 aa, Artificial Sequence
  Peptide Derived from Human Papillomavirus
FLKSNSQA

SEQ ID NO: 27691 - protein, 10 aa, Artificial Sequence
  Peptide Derived from Human Papillomavirus
FLKSNSQAKI

SEQ ID NO: 27692 - protein, 11 aa, Artificial Sequence
  Peptide Derived from Human Papillomavirus
FLKSNSQAKIV

SEQ ID NO: 27693 - protein, 8 aa, Artificial Sequence
  Peptide Derived from Human Papillomavirus
FMELVRPF

SEQ ID NO: 27694 - protein, 10 aa, Artificial Sequence
  Peptide Derived from Human Papillomavirus
FPFDENGNPV

SEQ ID NO: 27695 - protein, 11 aa, Artificial Sequence
  Peptide Derived from Human Papillomavirus
FPFDENGNPVY

SEQ ID NO: 27696 - protein, 8 aa, Artificial Sequence
  Peptide Derived from Human Papillomavirus
GIIILLLI

SEQ ID NO: 27697 - protein, 10 aa, Artificial Sequence
  Peptide Derived from Human Papillomavirus
GIIILLLIRF

SEQ ID NO: 27698 - protein, 10 aa, Artificial Sequence
  Peptide Derived from Human Papillomavirus
GIMCRHYKKA

SEQ ID NO: 27699 - protein, 8 aa, Artificial Sequence
  Peptide Derived from Human Papillomavirus
GIPKKSCM

SEQ ID NO: 27700 - protein, 9 aa, Artificial Sequence
  Peptide Derived from Human Papillomavirus
GIPKKSCML

SEQ ID NO: 27701 - protein, 10 aa, Artificial Sequence
  Peptide Derived from Human Papillomavirus
GIPKKSCMLI

SEQ ID NO: 27702 - protein, 8 aa, Artificial Sequence
  Peptide Derived from Human Papillomavirus
GISFMELV

SEQ ID NO: 27703 - protein, 11 aa, Artificial Sequence
  Peptide Derived from Human Papillomavirus
GISFMELVRPF

SEQ ID NO: 27704 - protein, 10 aa, Artificial Sequence
  Peptide Derived from Human Papillomavirus
GISPSVAESL

SEQ ID NO: 27705 - protein, 8 aa, Artificial Sequence
  Peptide Derived from Human Papillomavirus
GMGCTGWF

SEQ ID NO: 27706 - protein, 10 aa, Artificial Sequence
  Peptide Derived from Human Papillomavirus
GMGCTGWFEV

SEQ ID NO: 27707 - protein, 9 aa, Artificial Sequence
  Peptide Derived from Human Papillomavirus
GMIDDVTPI

SEQ ID NO: 27708 - protein, 11 aa, Artificial Sequence
  Peptide Derived from Human Papillomavirus
GMIDDVTPISW

SEQ ID NO: 27709 - protein, 8 aa, Artificial Sequence
  Peptide Derived from Human Papillomavirus
GMSLIQFL

SEQ ID NO: 27710 - protein, 9 aa, Artificial Sequence
  Peptide Derived from Human Papillomavirus
GPANTGKSY

SEQ ID NO: 27711 - protein, 10 aa, Artificial Sequence
  Peptide Derived from Human Papillomavirus
GPANTGKSYF

SEQ ID NO: 27712 - protein, 8 aa, Artificial Sequence
  Peptide Derived from Human Papillomavirus
GVGDDSEV

SEQ ID NO: 27713 - protein, 11 aa, Artificial Sequence
  Peptide Derived from Human Papillomavirus
HLQCLTCDRGI

SEQ ID NO: 27714 - protein, 9 aa, Artificial Sequence
  Peptide Derived from Human Papillomavirus
IIILLLIRF

SEQ ID NO: 27715 - protein, 8 aa, Artificial Sequence
  Peptide Derived from Human Papillomavirus
IILLLIRF

SEQ ID NO: 27716 - protein, 8 aa, Artificial Sequence
  Peptide Derived from Human Papillomavirus
ILYKFKEA

SEQ ID NO: 27717 - protein, 9 aa, Artificial Sequence
  Peptide Derived from Human Papillomavirus
ILYKFKEAY

SEQ ID NO: 27718 - protein, 11 aa, Artificial Sequence
  Peptide Derived from Human Papillomavirus
ILYKFKEAYGI

SEQ ID NO: 27719 - protein, 9 aa, Artificial Sequence
  Peptide Derived from Human Papillomavirus
IMCRHYKKA

SEQ ID NO: 27720 - protein, 8 aa, Artificial Sequence
  Peptide Derived from Human Papillomavirus
IPETCMVI

SEQ ID NO: 27721 - protein, 8 aa, Artificial Sequence
  Peptide Derived from Human Papillomavirus
IPKKSCML

SEQ ID NO: 27722 - protein, 9 aa, Artificial Sequence
  Peptide Derived from Human Papillomavirus
IPKKSCMLI

SEQ ID NO: 27723 - protein, 8 aa, Artificial Sequence
  Peptide Derived from Human Papillomavirus
IQADTEAA

SEQ ID NO: 27724 - protein, 10 aa, Artificial Sequence
  Peptide Derived from Human Papillomavirus
IQADTEAARA

SEQ ID NO: 27725 - protein, 11 aa, Artificial Sequence
  Peptide Derived from Human Papillomavirus
IQADTEAARAL

SEQ ID NO: 27726 - protein, 8 aa, Artificial Sequence
  Peptide Derived from Human Papillomavirus
IQEGEDDL

SEQ ID NO: 27727 - protein, 10 aa, Artificial Sequence
  Peptide Derived from Human Papillomavirus
IQEGEDDLNA

SEQ ID NO: 27728 - protein, 11 aa, Artificial Sequence
  Peptide Derived from Human Papillomavirus
IQEGEDDLNAV

SEQ ID NO: 27729 - protein, 8 aa, Artificial Sequence
  Peptide Derived from Human Papillomavirus
IQFLKGCV

SEQ ID NO: 27730 - protein, 9 aa, Artificial Sequence
  Peptide Derived from Human Papillomavirus
IQFLKGCVI

SEQ ID NO: 27731 - protein, 8 aa, Artificial Sequence
  Peptide Derived from Human Papillomavirus
IVKDCGIM

SEQ ID NO: 27732 - protein, 10 aa, Artificial Sequence
  Peptide Derived from Human Papillomavirus
IVQLLRYQNI

SEQ ID NO: 27733 - protein, 10 aa, Artificial Sequence
  Peptide Derived from Human Papillomavirus
KIDELEDSGY

SEQ ID NO: 27734 - protein, 8 aa, Artificial Sequence
  Peptide Derived from Human Papillomavirus
KIGMIDDV

SEQ ID NO: 27735 - protein, 11 aa, Artificial Sequence
  Peptide Derived from Human Papillomavirus
KIGMIDDVTPI

SEQ ID NO: 27736 - protein, 8 aa, Artificial Sequence
  Peptide Derived from Human Papillomavirus
KIVKDCGI

SEQ ID NO: 27737 - protein, 9 aa, Artificial Sequence
  Peptide Derived from Human Papillomavirus
KIVKDCGIM

SEQ ID NO: 27738 - protein, 9 aa, Artificial Sequence
  Peptide Derived from Human Papillomavirus
KLMSNLLSI

SEQ ID NO: 27739 - protein, 8 aa, Artificial Sequence
  Peptide Derived from Human Papillomavirus
KLRSQTCA

SEQ ID NO: 27740 - protein, 9 aa, Artificial Sequence
  Peptide Derived from Human Papillomavirus
KLRSQTCAL

SEQ ID NO: 27741 - protein, 10 aa, Artificial Sequence
  Peptide Derived from Human Papillomavirus
KLRSQTCALY

SEQ ID NO: 27742 - protein, 11 aa, Artificial Sequence
  Peptide Derived from Human Papillomavirus
KLRSQTCALYW

SEQ ID NO: 27743 - protein, 8 aa, Artificial Sequence
  Peptide Derived from Human Papillomavirus
KMSIGQWI

SEQ ID NO: 27744 - protein, 9 aa, Artificial Sequence
  Peptide Derived from Human Papillomavirus
KQHSLYTHL

SEQ ID NO: 27745 - protein, 9 aa, Artificial Sequence
  Peptide Derived from Human Papillomavirus
KVLIKQHSL

SEQ ID NO: 27746 - protein, 10 aa, Artificial Sequence
  Peptide Derived from Human Papillomavirus
KVLIKQHSLY

SEQ ID NO: 27747 - protein, 8 aa, Artificial Sequence
  Peptide Derived from Human Papillomavirus
LIKQHSLY

SEQ ID NO: 27748 - protein, 11 aa, Artificial Sequence
  Peptide Derived from Human Papillomavirus
LIKQHSLYTHL

SEQ ID NO: 27749 - protein, 9 aa, Artificial Sequence
  Peptide Derived from Human Papillomavirus
LIQFLKGCV

SEQ ID NO: 27750 - protein, 10 aa, Artificial Sequence
  Peptide Derived from Human Papillomavirus
LIQFLKGCVI

SEQ ID NO: 27751 - protein, 11 aa, Artificial Sequence
  Peptide Derived from Human Papillomavirus
LIRFRCSKNRL

SEQ ID NO: 27752 - protein, 9 aa, Artificial Sequence
  Peptide Derived from Human Papillomavirus
LLEFIDDSM

SEQ ID NO: 27753 - protein, 9 aa, Artificial Sequence
  Peptide Derived from Human Papillomavirus
LLLTSNTNA

SEQ ID NO: 27754 - protein, 9 aa, Artificial Sequence
  Peptide Derived from Human Papillomavirus
LLRYQNIEF

SEQ ID NO: 27755 - protein, 11 aa, Artificial Sequence
  Peptide Derived from Human Papillomavirus
LLRYQNIEFTA

SEQ ID NO: 27756 - protein, 9 aa, Artificial Sequence
  Peptide Derived from Human Papillomavirus
LLSIPETCM

SEQ ID NO: 27757 - protein, 10 aa, Artificial Sequence
  Peptide Derived from Human Papillomavirus
LLSIPETCMV

SEQ ID NO: 27758 - protein, 11 aa, Artificial Sequence
  Peptide Derived from Human Papillomavirus
LLSIPETCMVI

SEQ ID NO: 27759 - protein, 8 aa, Artificial Sequence
  Peptide Derived from Human Papillomavirus
LLTSNTNA

SEQ ID NO: 27760 - protein, 8 aa, Artificial Sequence
  Peptide Derived from Human Papillomavirus
LMSNLLSI

SEQ ID NO: 27761 - protein, 10 aa, Artificial Sequence
  Peptide Derived from Human Papillomavirus
LQCLTCDRGI

SEQ ID NO: 27762 - protein, 11 aa, Artificial Sequence
  Peptide Derived from Human Papillomavirus
LQCLTCDRGII

SEQ ID NO: 27763 - protein, 8 aa, Artificial Sequence
  Peptide Derived from Human Papillomavirus
LQEISNVL

SEQ ID NO: 27764 - protein, 9 aa, Artificial Sequence
  Peptide Derived from Human Papillomavirus
LQHSFNDNI

SEQ ID NO: 27765 - protein, 10 aa, Artificial Sequence
  Peptide Derived from Human Papillomavirus
LQHSFNDNIF

SEQ ID NO: 27766 - protein, 9 aa, Artificial Sequence
  Peptide Derived from Human Papillomavirus
LQPLSDAKI

SEQ ID NO: 27767 - protein, 11 aa, Artificial Sequence
  Peptide Derived from Human Papillomavirus
LQPLSDAKIGM

SEQ ID NO: 27768 - protein, 9 aa, Artificial Sequence
  Peptide Derived from Human Papillomavirus
LVQLKCPPL

SEQ ID NO: 27769 - protein, 10 aa, Artificial Sequence
  Peptide Derived from Human Papillomavirus
LVQLKCPPLL

SEQ ID NO: 27770 - protein, 11 aa, Artificial Sequence
  Peptide Derived from Human Papillomavirus
LVQLKCPPLLL

SEQ ID NO: 27771 - protein, 8 aa, Artificial Sequence
  Peptide Derived from Human Papillomavirus
MIDDVTPI

SEQ ID NO: 27772 - protein, 10 aa, Artificial Sequence
  Peptide Derived from Human Papillomavirus
MIDDVTPISW

SEQ ID NO: 27773 - protein, 8 aa, Artificial Sequence
  Peptide Derived from Human Papillomavirus
MVIEPPKL

SEQ ID NO: 27774 - protein, 10 aa, Artificial Sequence
  Peptide Derived from Human Papillomavirus
MVQWAYDNEL

SEQ ID NO: 27775 - protein, 8 aa, Artificial Sequence
  Peptide Derived from Human Papillomavirus
NIEFTAFL

SEQ ID NO: 27776 - protein, 10 aa, Artificial Sequence
  Peptide Derived from Human Papillomavirus
NIEFTAFLGA

SEQ ID NO: 27777 - protein, 11 aa, Artificial Sequence
  Peptide Derived from Human Papillomavirus
NIEFTAFLGAF

SEQ ID NO: 27778 - protein, 8 aa, Artificial Sequence
  Peptide Derived from Human Papillomavirus
NIFDLSEM

SEQ ID NO: 27779 - protein, 9 aa, Artificial Sequence
  Peptide Derived from Human Papillomavirus
NIFDLSEMV

SEQ ID NO: 27780 - protein, 11 aa, Artificial Sequence
  Peptide Derived from Human Papillomavirus
NIFDLSEMVQW

SEQ ID NO: 27781 - protein, 9 aa, Artificial Sequence
  Peptide Derived from Human Papillomavirus
NILYKFKEA

SEQ ID NO: 27782 - protein, 10 aa, Artificial Sequence
  Peptide Derived from Human Papillomavirus
NILYKFKEAY

SEQ ID NO: 27783 - protein, 9 aa, Artificial Sequence
  Peptide Derived from Human Papillomavirus
NIQEGEDDL

SEQ ID NO: 27784 - protein, 11 aa, Artificial Sequence
  Peptide Derived from Human Papillomavirus
NIQEGEDDLNA

SEQ ID NO: 27785 - protein, 10 aa, Artificial Sequence
  Peptide Derived from Human Papillomavirus
NISEDEDETA

SEQ ID NO: 27786 - protein, 9 aa, Artificial Sequence
  Peptide Derived from Human Papillomavirus
NISTFKCSA

SEQ ID NO: 27787 - protein, 10 aa, Artificial Sequence
  Peptide Derived from Human Papillomavirus
NLLSIPETCM

SEQ ID NO: 27788 - protein, 11 aa, Artificial Sequence
  Peptide Derived from Human Papillomavirus
NLLSIPETCMV

SEQ ID NO: 27789 - protein, 10 aa, Artificial Sequence
  Peptide Derived from Human Papillomavirus
NLNDLESSGV

SEQ ID NO: 27790 - protein, 11 aa, Artificial Sequence
  Peptide Derived from Human Papillomavirus
NPVYAINDENW

SEQ ID NO: 27791 - protein, 8 aa, Artificial Sequence
  Peptide Derived from Human Papillomavirus
NVDSCENV

SEQ ID NO: 27792 - protein, 10 aa, Artificial Sequence
  Peptide Derived from Human Papillomavirus
NVDSCENVTL

SEQ ID NO: 27793 - protein, 10 aa, Artificial Sequence
  Peptide Derived from Human Papillomavirus
NVLHSSNTKA

SEQ ID NO: 27794 - protein, 10 aa, Artificial Sequence
  Peptide Derived from Human Papillomavirus
NVTLQEISNV

SEQ ID NO: 27795 - protein, 11 aa, Artificial Sequence
  Peptide Derived from Human Papillomavirus
NVTLQEISNVL

SEQ ID NO: 27796 - protein, 10 aa, Artificial Sequence
  Peptide Derived from Human Papillomavirus
PISWTYIDDY

SEQ ID NO: 27797 - protein, 11 aa, Artificial Sequence
  Peptide Derived from Human Papillomavirus
PISWTYIDDYM

SEQ ID NO: 27798 - protein, 8 aa, Artificial Sequence
  Peptide Derived from Human Papillomavirus
PIVQLLRY

SEQ ID NO: 27799 - protein, 11 aa, Artificial Sequence
  Peptide Derived from Human Papillomavirus
PIVQLLRYQNI

SEQ ID NO: 27800 - protein, 10 aa, Artificial Sequence
  Peptide Derived from Human Papillomavirus
PLLLTSNTNA

SEQ ID NO: 27801 - protein, 9 aa, Artificial Sequence
  Peptide Derived from Human Papillomavirus
PLSDAKIGM

SEQ ID NO: 27802 - protein, 10 aa, Artificial Sequence
  Peptide Derived from Human Papillomavirus
PLSDAKIGMI

SEQ ID NO: 27803 - protein, 10 aa, Artificial Sequence
  Peptide Derived from Human Papillomavirus
PPKLRSQTCA

SEQ ID NO: 27804 - protein, 11 aa, Artificial Sequence
  Peptide Derived from Human Papillomavirus
PPKLRSQTCAL

SEQ ID NO: 27805 - protein, 11 aa, Artificial Sequence
  Peptide Derived from Human Papillomavirus
PPLLLTSNTNA

SEQ ID NO: 27806 - protein, 10 aa, Artificial Sequence
  Peptide Derived from Human Papillomavirus
PVYAINDENW

SEQ ID NO: 27807 - protein, 9 aa, Artificial Sequence
  Peptide Derived from Human Papillomavirus
QLADSNSNA

SEQ ID NO: 27808 - protein, 10 aa, Artificial Sequence
  Peptide Derived from Human Papillomavirus
QLADSNSNAA

SEQ ID NO: 27809 - protein, 11 aa, Artificial Sequence
  Peptide Derived from Human Papillomavirus
QLADSNSNAAA

SEQ ID NO: 27810 - protein, 8 aa, Artificial Sequence
  Peptide Derived from Human Papillomavirus
QLKCPPLL

SEQ ID NO: 27811 - protein, 9 aa, Artificial Sequence
  Peptide Derived from Human Papillomavirus
QLKCPPLLL

SEQ ID NO: 27812 - protein, 8 aa, Artificial Sequence
  Peptide Derived from Human Papillomavirus
QLLRYQNI

SEQ ID NO: 27813 - protein, 10 aa, Artificial Sequence
  Peptide Derived from Human Papillomavirus
QLLRYQNIEF

SEQ ID NO: 27814 - protein, 8 aa, Artificial Sequence
  Peptide Derived from Human Papillomavirus
QPLSDAKI

SEQ ID NO: 27815 - protein, 10 aa, Artificial Sequence
  Peptide Derived from Human Papillomavirus
QPLSDAKIGM

SEQ ID NO: 27816 - protein, 11 aa, Artificial Sequence
  Peptide Derived from Human Papillomavirus
QPLSDAKIGMI

SEQ ID NO: 27817 - protein, 11 aa, Artificial Sequence
  Peptide Derived from Human Papillomavirus
QVESQNGDTNL

SEQ ID NO: 27818 - protein, 8 aa, Artificial Sequence
  Peptide Derived from Human Papillomavirus
RLTVAKLM

SEQ ID NO: 27819 - protein, 11 aa, Artificial Sequence
  Peptide Derived from Human Papillomavirus
RLTVAKLMSNL

SEQ ID NO: 27820 - protein, 11 aa, Artificial Sequence
  Peptide Derived from Human Papillomavirus
RLTVFEFKNPF

SEQ ID NO: 27821 - protein, 9 aa, Artificial Sequence
  Peptide Derived from Human Papillomavirus
RLTVLQHSF

SEQ ID NO: 27822 - protein, 9 aa, Artificial Sequence
  Peptide Derived from Human Papillomavirus
RPIVQLLRY

SEQ ID NO: 27823 - protein, 8 aa, Artificial Sequence
  Peptide Derived from Human Papillomavirus
SIDVKHRA

SEQ ID NO: 27824 - protein, 9 aa, Artificial Sequence
  Peptide Derived from Human Papillomavirus
SIDVKHRAL

SEQ ID NO: 27825 - protein, 10 aa, Artificial Sequence
  Peptide Derived from Human Papillomavirus
SIDVKHRALV

SEQ ID NO: 27826 - protein, 10 aa, Artificial Sequence
  Peptide Derived from Human Papillomavirus
SINKNKECTY

SEQ ID NO: 27827 - protein, 8 aa, Artificial Sequence
  Peptide Derived from Human Papillomavirus
SIPETCMV

SEQ ID NO: 27828 - protein, 9 aa, Artificial Sequence
  Peptide Derived from Human Papillomavirus
SIPETCMVI

SEQ ID NO: 27829 - protein, 8 aa, Artificial Sequence
  Peptide Derived from Human Papillomavirus
SIQADTEA

SEQ ID NO: 27830 - protein, 9 aa, Artificial Sequence
  Peptide Derived from Human Papillomavirus
SIQADTEAA

SEQ ID NO: 27831 - protein, 11 aa, Artificial Sequence
  Peptide Derived from Human Papillomavirus
SIQADTEAARA

SEQ ID NO: 27832 - protein, 10 aa, Artificial Sequence
  Peptide Derived from Human Papillomavirus
SLIQFLKGCV

SEQ ID NO: 27833 - protein, 11 aa, Artificial Sequence
  Peptide Derived from Human Papillomavirus
SLIQFLKGCVI

SEQ ID NO: 27834 - protein, 11 aa, Artificial Sequence
  Peptide Derived from Human Papillomavirus
SLKVLIKQHSL

SEQ ID NO: 27835 - protein, 9 aa, Artificial Sequence
  Peptide Derived from Human Papillomavirus
SLYTHLQCL

SEQ ID NO: 27836 - protein, 8 aa, Artificial Sequence
  Peptide Derived from Human Papillomavirus
SMENSIQA

SEQ ID NO: 27837 - protein, 8 aa, Artificial Sequence
  Peptide Derived from Human Papillomavirus
SPSVAESL

SEQ ID NO: 27838 - protein, 10 aa, Artificial Sequence
  Peptide Derived from Human Papillomavirus
SPSVAESLKV

SEQ ID NO: 27839 - protein, 11 aa, Artificial Sequence
  Peptide Derived from Human Papillomavirus
SPSVAESLKVL

SEQ ID NO: 27840 - protein, 11 aa, Artificial Sequence
  Peptide Derived from Human Papillomavirus
SQAKIVKDCGI

SEQ ID NO: 27841 - protein, 8 aa, Artificial Sequence
  Peptide Derived from Human Papillomavirus
SQNGDTNL

SEQ ID NO: 27842 - protein, 11 aa, Artificial Sequence
  Peptide Derived from Human Papillomavirus
SQNGDTNLNDL

SEQ ID NO: 27843 - protein, 8 aa, Artificial Sequence
  Peptide Derived from Human Papillomavirus
SQSAAEDV

SEQ ID NO: 27844 - protein, 9 aa, Artificial Sequence
  Peptide Derived from Human Papillomavirus
SQSAAEDVV

SEQ ID NO: 27845 - protein, 8 aa, Artificial Sequence
  Peptide Derived from Human Papillomavirus
SQTCALYW

SEQ ID NO: 27846 - protein, 9 aa, Artificial Sequence
  Peptide Derived from Human Papillomavirus
SQTCALYWF

SEQ ID NO: 27847 - protein, 8 aa, Artificial Sequence
  Peptide Derived from Human Papillomavirus
SVAESLKV

SEQ ID NO: 27848 - protein, 9 aa, Artificial Sequence
  Peptide Derived from Human Papillomavirus
SVAESLKVL

SEQ ID NO: 27849 - protein, 10 aa, Artificial Sequence
  Peptide Derived from Human Papillomavirus
SVAESLKVLI

SEQ ID NO: 27850 - protein, 8 aa, Artificial Sequence
  Peptide Derived from Human Papillomavirus
TLQEISNV

SEQ ID NO: 27851 - protein, 9 aa, Artificial Sequence
  Peptide Derived from Human Papillomavirus
TLQEISNVL

SEQ ID NO: 27852 - protein, 8 aa, Artificial Sequence
  Peptide Derived from Human Papillomavirus
TPEWIDRL

SEQ ID NO: 27853 - protein, 10 aa, Artificial Sequence
  Peptide Derived from Human Papillomavirus
TPEWIDRLTV

SEQ ID NO: 27854 - protein, 11 aa, Artificial Sequence
  Peptide Derived from Human Papillomavirus
TPEWIDRLTVL

SEQ ID NO: 27855 - protein, 8 aa, Artificial Sequence
  Peptide Derived from Human Papillomavirus
TPISWTYI

SEQ ID NO: 27856 - protein, 11 aa, Artificial Sequence
  Peptide Derived from Human Papillomavirus
TPISWTYIDDY

SEQ ID NO: 27857 - protein, 8 aa, Artificial Sequence
  Peptide Derived from Human Papillomavirus
TQQMVQQV

SEQ ID NO: 27858 - protein, 9 aa, Artificial Sequence
  Peptide Derived from Human Papillomavirus
TVAKLMSNL

SEQ ID NO: 27859 - protein, 10 aa, Artificial Sequence
  Peptide Derived from Human Papillomavirus
TVAKLMSNLL

SEQ ID NO: 27860 - protein, 9 aa, Artificial Sequence
  Peptide Derived from Human Papillomavirus
TVFEFKNPF

SEQ ID NO: 27861 - protein, 11 aa, Artificial Sequence
  Peptide Derived from Human Papillomavirus
TVFEFKNPFPF

SEQ ID NO: 27862 - protein, 11 aa, Artificial Sequence
  Peptide Derived from Human Papillomavirus
TVLQHSFNDNI

SEQ ID NO: 27863 - protein, 10 aa, Artificial Sequence
  Peptide Derived from Human Papillomavirus
VIERRTGDNI

SEQ ID NO: 27864 - protein, 11 aa, Artificial Sequence
  Peptide Derived from Human Papillomavirus
VISCVNSKSHF

SEQ ID NO: 27865 - protein, 9 aa, Artificial Sequence
  Peptide Derived from Human Papillomavirus
VLHSSNTKA

SEQ ID NO: 27866 - protein, 11 aa, Artificial Sequence
  Peptide Derived from Human Papillomavirus
VLHSSNTKANI

SEQ ID NO: 27867 - protein, 8 aa, Artificial Sequence
  Peptide Derived from Human Papillomavirus
VLIKQHSL

SEQ ID NO: 27868 - protein, 9 aa, Artificial Sequence
  Peptide Derived from Human Papillomavirus
VLIKQHSLY

SEQ ID NO: 27869 - protein, 10 aa, Artificial Sequence
  Peptide Derived from Human Papillomavirus
VLQHSFNDNI

SEQ ID NO: 27870 - protein, 11 aa, Artificial Sequence
  Peptide Derived from Human Papillomavirus
VLQHSFNDNIF

SEQ ID NO: 27871 - protein, 8 aa, Artificial Sequence
  Peptide Derived from Human Papillomavirus
VQGTTPEW

SEQ ID NO: 27872 - protein, 9 aa, Artificial Sequence
  Peptide Derived from Human Papillomavirus
VQGTTPEWI

SEQ ID NO: 27873 - protein, 8 aa, Artificial Sequence
  Peptide Derived from Human Papillomavirus
VQLKCPPL

SEQ ID NO: 27874 - protein, 9 aa, Artificial Sequence
  Peptide Derived from Human Papillomavirus
VQLKCPPLL

SEQ ID NO: 27875 - protein, 10 aa, Artificial Sequence
  Peptide Derived from Human Papillomavirus
VQLKCPPLLL

SEQ ID NO: 27876 - protein, 9 aa, Artificial Sequence
  Peptide Derived from Human Papillomavirus
VQLLRYQNI

SEQ ID NO: 27877 - protein, 11 aa, Artificial Sequence
  Peptide Derived from Human Papillomavirus
VQLLRYQNIEF

SEQ ID NO: 27878 - protein, 9 aa, Artificial Sequence
  Peptide Derived from Human Papillomavirus
VQWAYDNEL

SEQ ID NO: 27879 - protein, 8 aa, Artificial Sequence
  Peptide Derived from Human Papillomavirus
WIDRLTVL

SEQ ID NO: 27880 - protein, 8 aa, Artificial Sequence
  Peptide Derived from Human Papillomavirus
WLQPLSDA

SEQ ID NO: 27881 - protein, 10 aa, Artificial Sequence
  Peptide Derived from Human Papillomavirus
WLQPLSDAKI

SEQ ID NO: 27882 - protein, 8 aa, Artificial Sequence
  Peptide Derived from Human Papillomavirus
WPYLHSRL

SEQ ID NO: 27883 - protein, 10 aa, Artificial Sequence
  Peptide Derived from Human Papillomavirus
WPYLHSRLTV

SEQ ID NO: 27884 - protein, 11 aa, Artificial Sequence
  Peptide Derived from Human Papillomavirus
WPYLHSRLTVF

SEQ ID NO: 27885 - protein, 9 aa, Artificial Sequence
  Peptide Derived from Human Papillomavirus
YIDDYMRNA

SEQ ID NO: 27886 - protein, 10 aa, Artificial Sequence
  Peptide Derived from Human Papillomavirus
YIDDYMRNAL

SEQ ID NO: 27887 - protein, 8 aa, Artificial Sequence
  Peptide Derived from Human Papillomavirus
YLHSRLTV

SEQ ID NO: 27888 - protein, 9 aa, Artificial Sequence
  Peptide Derived from Human Papillomavirus
YLHSRLTVF

SEQ ID NO: 27889 - protein, 11 aa, Artificial Sequence
  Peptide Derived from Human Papillomavirus
YLHSRLTVFEF

SEQ ID NO: 27890 - protein, 11 aa, Artificial Sequence
  Peptide Derived from Human Papillomavirus
YMRNALDGNEI

SEQ ID NO: 27891 - protein, 8 aa, Artificial Sequence
  Peptide Derived from Human Papillomavirus
YQNIEFTA

SEQ ID NO: 27892 - protein, 9 aa, Artificial Sequence
  Peptide Derived from Human Papillomavirus
YQNIEFTAF

SEQ ID NO: 27893 - protein, 10 aa, Artificial Sequence
  Peptide Derived from Human Papillomavirus
YQNIEFTAFL

SEQ ID NO: 27894 - protein, 10 aa, Artificial Sequence
  Peptide Derived from Human Papillomavirus
ALDNRTARTA

SEQ ID NO: 27895 - protein, 10 aa, Artificial Sequence
  Peptide Derived from Human Papillomavirus
ALETLSKSQY

SEQ ID NO: 27896 - protein, 9 aa, Artificial Sequence
  Peptide Derived from Human Papillomavirus
ALLYTAKQM

SEQ ID NO: 27897 - protein, 11 aa, Artificial Sequence
  Peptide Derived from Human Papillomavirus
ALLYTAKQMGF

SEQ ID NO: 27898 - protein, 8 aa, Artificial Sequence
  Peptide Derived from Human Papillomavirus
AQPLTKLF

SEQ ID NO: 27899 - protein, 10 aa, Artificial Sequence
  Peptide Derived from Human Papillomavirus
AQPLTKLFCA

SEQ ID NO: 27900 - protein, 9 aa, Artificial Sequence
  Peptide Derived from Human Papillomavirus
AVQEKILDL

SEQ ID NO: 27901 - protein, 10 aa, Artificial Sequence
  Peptide Derived from Human Papillomavirus
AVQEKILDLY

SEQ ID NO: 27902 - protein, 9 aa, Artificial Sequence
  Peptide Derived from Human Papillomavirus
CLRYRLKPY

SEQ ID NO: 27903 - protein, 10 aa, Artificial Sequence
  Peptide Derived from Human Papillomavirus
CPTSISSNQI

SEQ ID NO: 27904 - protein, 9 aa, Artificial Sequence
  Peptide Derived from Human Papillomavirus
DLPSQIEHW

SEQ ID NO: 27905 - protein, 11 aa, Artificial Sequence
  Peptide Derived from Human Papillomavirus
DLPSQIEHWKL

SEQ ID NO: 27906 - protein, 10 aa, Artificial Sequence
  Peptide Derived from Human Papillomavirus
DLYEADKTDL

SEQ ID NO: 27907 - protein, 9 aa, Artificial Sequence
  Peptide Derived from Human Papillomavirus
DPALDNRTA

SEQ ID NO: 27908 - protein, 8 aa, Artificial Sequence
  Peptide Derived from Human Papillomavirus
EISARLNA

SEQ ID NO: 27909 - protein, 9 aa, Artificial Sequence
  Peptide Derived from Human Papillomavirus
EISARLNAV

SEQ ID NO: 27910 - protein, 9 aa, Artificial Sequence
  Peptide Derived from Human Papillomavirus
ELQMALETL

SEQ ID NO: 27911 - protein, 10 aa, Artificial Sequence
  Peptide Derived from Human Papillomavirus
ELYSSMSSTW

SEQ ID NO: 27912 - protein, 8 aa, Artificial Sequence
  Peptide Derived from Human Papillomavirus
EQQQQMFL

SEQ ID NO: 27913 - protein, 11 aa, Artificial Sequence
  Peptide Derived from Human Papillomavirus
EQQQQMFLGTV

SEQ ID NO: 27914 - protein, 8 aa, Artificial Sequence
  Peptide Derived from Human Papillomavirus
EVHVGGQV

SEQ ID NO: 27915 - protein, 9 aa, Artificial Sequence
  Peptide Derived from Human Papillomavirus
EVHVGGQVI

SEQ ID NO: 27916 - protein, 10 aa, Artificial Sequence
  Peptide Derived from Human Papillomavirus
EVHVGGQVIV

SEQ ID NO: 27917 - protein, 11 aa, Artificial Sequence
  Peptide Derived from Human Papillomavirus
EVWLCEPPKCF

SEQ ID NO: 27918 - protein, 11 aa, Artificial Sequence
  Peptide Derived from Human Papillomavirus
FLGTVKIPPTV

SEQ ID NO: 27919 - protein, 8 aa, Artificial Sequence
  Peptide Derived from Human Papillomavirus
FQVIELQM

SEQ ID NO: 27920 - protein, 9 aa, Artificial Sequence
  Peptide Derived from Human Papillomavirus
FQVIELQMA

SEQ ID NO: 27921 - protein, 10 aa, Artificial Sequence
  Peptide Derived from Human Papillomavirus
FQVIELQMAL

SEQ ID NO: 27922 - protein, 9 aa, Artificial Sequence
  Peptide Derived from Human Papillomavirus
FVTEQQQQM

SEQ ID NO: 27923 - protein, 10 aa, Artificial Sequence
  Peptide Derived from Human Papillomavirus
FVTEQQQQMF

SEQ ID NO: 27924 - protein, 11 aa, Artificial Sequence
  Peptide Derived from Human Papillomavirus
FVTEQQQQMFL

SEQ ID NO: 27925 - protein, 8 aa, Artificial Sequence
  Peptide Derived from Human Papillomavirus
GIVTVTFV

SEQ ID NO: 27926 - protein, 11 aa, Artificial Sequence
  Peptide Derived from Human Papillomavirus
GMYYIHNCEKV

SEQ ID NO: 27927 - protein, 10 aa, Artificial Sequence
  Peptide Derived from Human Papillomavirus
GQVIVCPTSI

SEQ ID NO: 27928 - protein, 10 aa, Artificial Sequence
  Peptide Derived from Human Papillomavirus
HLCHQVVPSL

SEQ ID NO: 27929 - protein, 11 aa, Artificial Sequence
  Peptide Derived from Human Papillomavirus
HLCHQVVPSLL

SEQ ID NO: 27930 - protein, 9 aa, Artificial Sequence
  Peptide Derived from Human Papillomavirus
HLKGESNSL

SEQ ID NO: 27931 - protein, 8 aa, Artificial Sequence
  Peptide Derived from Human Papillomavirus
HQVVPSLL

SEQ ID NO: 27932 - protein, 9 aa, Artificial Sequence
  Peptide Derived from Human Papillomavirus
HQVVPSLLA

SEQ ID NO: 27933 - protein, 8 aa, Artificial Sequence
  Peptide Derived from Human Papillomavirus
HVGGQVIV

SEQ ID NO: 27934 - protein, 9 aa, Artificial Sequence
  Peptide Derived from Human Papillomavirus
IIEEDTCTM

SEQ ID NO: 27935 - protein, 10 aa, Artificial Sequence
  Peptide Derived from Human Papillomavirus
IIEEDTCTMV

SEQ ID NO: 27936 - protein, 11 aa, Artificial Sequence
  Peptide Derived from Human Papillomavirus
IPPTVQISTGF

SEQ ID NO: 27937 - protein, 11 aa, Artificial Sequence
  Peptide Derived from Human Papillomavirus
IVHLKGESNSL

SEQ ID NO: 27938 - protein, 8 aa, Artificial Sequence
  Peptide Derived from Human Papillomavirus
KILDLYEA

SEQ ID NO: 27939 - protein, 8 aa, Artificial Sequence
  Peptide Derived from Human Papillomavirus
KIPPTVQI

SEQ ID NO: 27940 - protein, 8 aa, Artificial Sequence
  Peptide Derived from Human Papillomavirus
KLFCADPA

SEQ ID NO: 27941 - protein, 9 aa, Artificial Sequence
  Peptide Derived from Human Papillomavirus
KLFCADPAL

SEQ ID NO: 27942 - protein, 8 aa, Artificial Sequence
  Peptide Derived from Human Papillomavirus
KLIRMECA

SEQ ID NO: 27943 - protein, 9 aa, Artificial Sequence
  Peptide Derived from Human Papillomavirus
KLIRMECAL

SEQ ID NO: 27944 - protein, 10 aa, Artificial Sequence
  Peptide Derived from Human Papillomavirus
KLIRMECALL

SEQ ID NO: 27945 - protein, 11 aa, Artificial Sequence
  Peptide Derived from Human Papillomavirus
KLIRMECALLY

SEQ ID NO: 27946 - protein, 10 aa, Artificial Sequence
  Peptide Derived from Human Papillomavirus
KPYKELYSSM

SEQ ID NO: 27947 - protein, 8 aa, Artificial Sequence
  Peptide Derived from Human Papillomavirus
KQGETVTV

SEQ ID NO: 27948 - protein, 10 aa, Artificial Sequence
  Peptide Derived from Human Papillomavirus
KQGETVTVQY

SEQ ID NO: 27949 - protein, 8 aa, Artificial Sequence
  Peptide Derived from Human Papillomavirus
KQMGFSHL

SEQ ID NO: 27950 - protein, 10 aa, Artificial Sequence
  Peptide Derived from Human Papillomavirus
KQRTVCSSNV

SEQ ID NO: 27951 - protein, 11 aa, Artificial Sequence
  Peptide Derived from Human Papillomavirus
KQRTVCSSNVA

SEQ ID NO: 27952 - protein, 8 aa, Artificial Sequence
  Peptide Derived from Human Papillomavirus
KVDYIGMY

SEQ ID NO: 27953 - protein, 9 aa, Artificial Sequence
  Peptide Derived from Human Papillomavirus
KVDYIGMYY

SEQ ID NO: 27954 - protein, 10 aa, Artificial Sequence
  Peptide Derived from Human Papillomavirus
KVDYIGMYYI

SEQ ID NO: 27955 - protein, 11 aa, Artificial Sequence
  Peptide Derived from Human Papillomavirus
KVYFKYFKEDA

SEQ ID NO: 27956 - protein, 8 aa, Artificial Sequence
  Peptide Derived from Human Papillomavirus
LIRMECAL

SEQ ID NO: 27957 - protein, 9 aa, Artificial Sequence
  Peptide Derived from Human Papillomavirus
LIRMECALL

SEQ ID NO: 27958 - protein, 10 aa, Artificial Sequence
  Peptide Derived from Human Papillomavirus
LIRMECALLY

SEQ ID NO: 27959 - protein, 8 aa, Artificial Sequence
  Peptide Derived from Human Papillomavirus
LLASKTKA

SEQ ID NO: 27960 - protein, 9 aa, Artificial Sequence
  Peptide Derived from Human Papillomavirus
LLASKTKAF

SEQ ID NO: 27961 - protein, 11 aa, Artificial Sequence
  Peptide Derived from Human Papillomavirus
LLASKTKAFQV

SEQ ID NO: 27962 - protein, 8 aa, Artificial Sequence
  Peptide Derived from Human Papillomavirus
LLYTAKQM

SEQ ID NO: 27963 - protein, 10 aa, Artificial Sequence
  Peptide Derived from Human Papillomavirus
LLYTAKQMGF

SEQ ID NO: 27964 - protein, 8 aa, Artificial Sequence
  Peptide Derived from Human Papillomavirus
LPSQIEHW

SEQ ID NO: 27965 - protein, 10 aa, Artificial Sequence
  Peptide Derived from Human Papillomavirus
LPSQIEHWKL

SEQ ID NO: 27966 - protein, 11 aa, Artificial Sequence
  Peptide Derived from Human Papillomavirus
LPSQIEHWKLI

SEQ ID NO: 27967 - protein, 8 aa, Artificial Sequence
  Peptide Derived from Human Papillomavirus
LQMALETL

SEQ ID NO: 27968 - protein, 8 aa, Artificial Sequence
  Peptide Derived from Human Papillomavirus
LQQTSLEV

SEQ ID NO: 27969 - protein, 9 aa, Artificial Sequence
  Peptide Derived from Human Papillomavirus
LQQTSLEVW

SEQ ID NO: 27970 - protein, 10 aa, Artificial Sequence
  Peptide Derived from Human Papillomavirus
LQQTSLEVWL

SEQ ID NO: 27971 - protein, 8 aa, Artificial Sequence
  Peptide Derived from Human Papillomavirus
MVTGKVDY

SEQ ID NO: 27972 - protein, 9 aa, Artificial Sequence
  Peptide Derived from Human Papillomavirus
MVTGKVDYI

SEQ ID NO: 27973 - protein, 11 aa, Artificial Sequence
  Peptide Derived from Human Papillomavirus
MVTGKVDYIGM

SEQ ID NO: 27974 - protein, 9 aa, Artificial Sequence
  Peptide Derived from Human Papillomavirus
NQISTTETA

SEQ ID NO: 27975 - protein, 11 aa, Artificial Sequence
  Peptide Derived from Human Papillomavirus
NQISTTETADI

SEQ ID NO: 27976 - protein, 8 aa, Artificial Sequence
  Peptide Derived from Human Papillomavirus
NVAPIVHL

SEQ ID NO: 27977 - protein, 8 aa, Artificial Sequence
  Peptide Derived from Human Papillomavirus
PLTKLFCA

SEQ ID NO: 27978 - protein, 11 aa, Artificial Sequence
  Peptide Derived from Human Papillomavirus
PLTKLFCADPA

SEQ ID NO: 27979 - protein, 10 aa, Artificial Sequence
  Peptide Derived from Human Papillomavirus
PPTVQISTGF

SEQ ID NO: 27980 - protein, 11 aa, Artificial Sequence
  Peptide Derived from Human Papillomavirus
PPTVQISTGFM

SEQ ID NO: 27981 - protein, 11 aa, Artificial Sequence
  Peptide Derived from Human Papillomavirus
PQAAAKRRRPA

SEQ ID NO: 27982 - protein, 8 aa, Artificial Sequence
  Peptide Derived from Human Papillomavirus
QIEHWKLI

SEQ ID NO: 27983 - protein, 10 aa, Artificial Sequence
  Peptide Derived from Human Papillomavirus
QIEHWKLIRM

SEQ ID NO: 27984 - protein, 9 aa, Artificial Sequence
  Peptide Derived from Human Papillomavirus
QISTGFMTL

SEQ ID NO: 27985 - protein, 8 aa, Artificial Sequence
  Peptide Derived from Human Papillomavirus
QISTTETA

SEQ ID NO: 27986 - protein, 10 aa, Artificial Sequence
  Peptide Derived from Human Papillomavirus
QISTTETADI

SEQ ID NO: 27987 - protein, 9 aa, Artificial Sequence
  Peptide Derived from Human Papillomavirus
QMFLGTVKI

SEQ ID NO: 27988 - protein, 11 aa, Artificial Sequence
  Peptide Derived from Human Papillomavirus
QMGFSHLCHQV

SEQ ID NO: 27989 - protein, 11 aa, Artificial Sequence
  Peptide Derived from Human Papillomavirus
QMWEVHVGGQV

SEQ ID NO: 27990 - protein, 9 aa, Artificial Sequence
  Peptide Derived from Human Papillomavirus
QPLTKLFCA

SEQ ID NO: 27991 - protein, 8 aa, Artificial Sequence
  Peptide Derived from Human Papillomavirus
QQMFLGTV

SEQ ID NO: 27992 - protein, 10 aa, Artificial Sequence
  Peptide Derived from Human Papillomavirus
QQMFLGTVKI

SEQ ID NO: 27993 - protein, 9 aa, Artificial Sequence
  Peptide Derived from Human Papillomavirus
QQQMFLGTV

SEQ ID NO: 27994 - protein, 11 aa, Artificial Sequence
  Peptide Derived from Human Papillomavirus
QQQMFLGTVKI

SEQ ID NO: 27995 - protein, 10 aa, Artificial Sequence
  Peptide Derived from Human Papillomavirus
QQQQMFLGTV

SEQ ID NO: 27996 - protein, 8 aa, Artificial Sequence
  Peptide Derived from Human Papillomavirus
QQTSLEVW

SEQ ID NO: 27997 - protein, 9 aa, Artificial Sequence
  Peptide Derived from Human Papillomavirus
QQTSLEVWL

SEQ ID NO: 27998 - protein, 8 aa, Artificial Sequence
  Peptide Derived from Human Papillomavirus
QVIELQMA

SEQ ID NO: 27999 - protein, 9 aa, Artificial Sequence
  Peptide Derived from Human Papillomavirus
QVIELQMAL

SEQ ID NO: 28000 - protein, 9 aa, Artificial Sequence
  Peptide Derived from Human Papillomavirus
QVIVCPTSI

SEQ ID NO: 28001 - protein, 8 aa, Artificial Sequence
  Peptide Derived from Human Papillomavirus
QVVPSLLA

SEQ ID NO: 28002 - protein, 8 aa, Artificial Sequence
  Peptide Derived from Human Papillomavirus
RLKPYKEL

SEQ ID NO: 28003 - protein, 9 aa, Artificial Sequence
  Peptide Derived from Human Papillomavirus
RLKPYKELY

SEQ ID NO: 28004 - protein, 9 aa, Artificial Sequence
  Peptide Derived from Human Papillomavirus
RLNAVQEKI

SEQ ID NO: 28005 - protein, 10 aa, Artificial Sequence
  Peptide Derived from Human Papillomavirus
RLNAVQEKIL

SEQ ID NO: 28006 - protein, 8 aa, Artificial Sequence
  Peptide Derived from Human Papillomavirus
RMECALLY

SEQ ID NO: 28007 - protein, 10 aa, Artificial Sequence
  Peptide Derived from Human Papillomavirus
RMECALLYTA

SEQ ID NO: 28008 - protein, 9 aa, Artificial Sequence
  Peptide Derived from Human Papillomavirus
RPADTTDTA

SEQ ID NO: 28009 - protein, 9 aa, Artificial Sequence
  Peptide Derived from Human Papillomavirus
SLKCLRYRL

SEQ ID NO: 28010 - protein, 9 aa, Artificial Sequence
  Peptide Derived from Human Papillomavirus
SLLASKTKA

SEQ ID NO: 28011 - protein, 10 aa, Artificial Sequence
  Peptide Derived from Human Papillomavirus
SLLASKTKAF

SEQ ID NO: 28012 - protein, 8 aa, Artificial Sequence
  Peptide Derived from Human Papillomavirus
SMSSTWHW

SEQ ID NO: 28013 - protein, 8 aa, Artificial Sequence
  Peptide Derived from Human Papillomavirus
SQIEHWKL

SEQ ID NO: 28014 - protein, 9 aa, Artificial Sequence
  Peptide Derived from Human Papillomavirus
SQIEHWKLI

SEQ ID NO: 28015 - protein, 11 aa, Artificial Sequence
  Peptide Derived from Human Papillomavirus
SQIEHWKLIRM

SEQ ID NO: 28016 - protein, 10 aa, Artificial Sequence
  Peptide Derived from Human Papillomavirus
SQWTLQQTSL

SEQ ID NO: 28017 - protein, 8 aa, Artificial Sequence
  Peptide Derived from Human Papillomavirus
SQYSTSQW

SEQ ID NO: 28018 - protein, 10 aa, Artificial Sequence
  Peptide Derived from Human Papillomavirus
SQYSTSQWTL

SEQ ID NO: 28019 - protein, 9 aa, Artificial Sequence
  Peptide Derived from Human Papillomavirus
TLQQTSLEV

SEQ ID NO: 28020 - protein, 10 aa, Artificial Sequence
  Peptide Derived from Human Papillomavirus
TLQQTSLEVW

SEQ ID NO: 28021 - protein, 11 aa, Artificial Sequence
  Peptide Derived from Human Papillomavirus
TLQQTSLEVWL

SEQ ID NO: 28022 - protein, 10 aa, Artificial Sequence
  Peptide Derived from Human Papillomavirus
TMDYTNWGEI

SEQ ID NO: 28023 - protein, 11 aa, Artificial Sequence
  Peptide Derived from Human Papillomavirus
TMDYTNWGEIY

SEQ ID NO: 28024 - protein, 9 aa, Artificial Sequence
  Peptide Derived from Human Papillomavirus
TMVTGKVDY

SEQ ID NO: 28025 - protein, 10 aa, Artificial Sequence
  Peptide Derived from Human Papillomavirus
TMVTGKVDYI

SEQ ID NO: 28026 - protein, 8 aa, Artificial Sequence
  Peptide Derived from Human Papillomavirus
TQMWEVHV

SEQ ID NO: 28027 - protein, 8 aa, Artificial Sequence
  Peptide Derived from Human Papillomavirus
TVCSSNVA

SEQ ID NO: 28028 - protein, 10 aa, Artificial Sequence
  Peptide Derived from Human Papillomavirus
TVCSSNVAPI

SEQ ID NO: 28029 - protein, 11 aa, Artificial Sequence
  Peptide Derived from Human Papillomavirus
TVCSSNVAPIV

SEQ ID NO: 28030 - protein, 8 aa, Artificial Sequence
  Peptide Derived from Human Papillomavirus
TVKIPPTV

SEQ ID NO: 28031 - protein, 10 aa, Artificial Sequence
  Peptide Derived from Human Papillomavirus
TVKIPPTVQI

SEQ ID NO: 28032 - protein, 8 aa, Artificial Sequence
  Peptide Derived from Human Papillomavirus
TVQISTGF

SEQ ID NO: 28033 - protein, 9 aa, Artificial Sequence
  Peptide Derived from Human Papillomavirus
TVQISTGFM

SEQ ID NO: 28034 - protein, 11 aa, Artificial Sequence
  Peptide Derived from Human Papillomavirus
TVQISTGFMTL

SEQ ID NO: 28035 - protein, 8 aa, Artificial Sequence
  Peptide Derived from Human Papillomavirus
VIELQMAL

SEQ ID NO: 28036 - protein, 11 aa, Artificial Sequence
  Peptide Derived from Human Papillomavirus
VIELQMALETL

SEQ ID NO: 28037 - protein, 8 aa, Artificial Sequence
  Peptide Derived from Human Papillomavirus
VIVCPTSI

SEQ ID NO: 28038 - protein, 11 aa, Artificial Sequence
  Peptide Derived from Human Papillomavirus
VPSLLASKTKA

SEQ ID NO: 28039 - protein, 8 aa, Artificial Sequence
  Peptide Derived from Human Papillomavirus
VQEKILDL

SEQ ID NO: 28040 - protein, 9 aa, Artificial Sequence
  Peptide Derived from Human Papillomavirus
VQEKILDLY

SEQ ID NO: 28041 - protein, 11 aa, Artificial Sequence
  Peptide Derived from Human Papillomavirus
VQEKILDLYEA

SEQ ID NO: 28042 - protein, 8 aa, Artificial Sequence
  Peptide Derived from Human Papillomavirus
VQISTGFM

SEQ ID NO: 28043 - protein, 10 aa, Artificial Sequence
  Peptide Derived from Human Papillomavirus
VQISTGFMTL

SEQ ID NO: 28044 - protein, 11 aa, Artificial Sequence
  Peptide Derived from Human Papillomavirus
VQYDNDKKNTM

SEQ ID NO: 28045 - protein, 9 aa, Artificial Sequence
  Peptide Derived from Human Papillomavirus
WLCEPPKCF

SEQ ID NO: 28046 - protein, 8 aa, Artificial Sequence
  Peptide Derived from Human Papillomavirus
YIHNCEKV

SEQ ID NO: 28047 - protein, 9 aa, Artificial Sequence
  Peptide Derived from Human Papillomavirus
YIHNCEKVY

SEQ ID NO: 28048 - protein, 10 aa, Artificial Sequence
  Peptide Derived from Human Papillomavirus
YIHNCEKVYF

SEQ ID NO: 28049 - protein, 10 aa, Artificial Sequence
  Peptide Derived from Human Papillomavirus
YIIEEDTCTM

SEQ ID NO: 28050 - protein, 11 aa, Artificial Sequence
  Peptide Derived from Human Papillomavirus
YIIEEDTCTMV

SEQ ID NO: 28051 - protein, 9 aa, Artificial Sequence
  Peptide Derived from Human Papillomavirus
CINFHAQHM

SEQ ID NO: 28052 - protein, 9 aa, Artificial Sequence
  Peptide Derived from Human Papillomavirus
CLSLLLRPL

SEQ ID NO: 28053 - protein, 10 aa, Artificial Sequence
  Peptide Derived from Human Papillomavirus
CLSLLLRPLI

SEQ ID NO: 28054 - protein, 11 aa, Artificial Sequence
  Peptide Derived from Human Papillomavirus
CLSLLLRPLIL

SEQ ID NO: 28055 - protein, 9 aa, Artificial Sequence
  Peptide Derived from Human Papillomavirus
FILFLCLSL

SEQ ID NO: 28056 - protein, 10 aa, Artificial Sequence
  Peptide Derived from Human Papillomavirus
FILFLCLSLL

SEQ ID NO: 28057 - protein, 11 aa, Artificial Sequence
  Peptide Derived from Human Papillomavirus
FILFLCLSLLL

SEQ ID NO: 28058 - protein, 8 aa, Artificial Sequence
  Peptide Derived from Human Papillomavirus
FLCLSLLL

SEQ ID NO: 28059 - protein, 11 aa, Artificial Sequence
  Peptide Derived from Human Papillomavirus
FLCLSLLLRPL

SEQ ID NO: 28060 - protein, 9 aa, Artificial Sequence
  Peptide Derived from Human Papillomavirus
FLYLPMMCI

SEQ ID NO: 28061 - protein, 11 aa, Artificial Sequence
  Peptide Derived from Human Papillomavirus
FLYLPMMCINF

SEQ ID NO: 28062 - protein, 8 aa, Artificial Sequence
  Peptide Derived from Human Papillomavirus
FVFVLCFI

SEQ ID NO: 28063 - protein, 9 aa, Artificial Sequence
  Peptide Derived from Human Papillomavirus
FVFVLCFIL

SEQ ID NO: 28064 - protein, 10 aa, Artificial Sequence
  Peptide Derived from Human Papillomavirus
FVFVLCFILF

SEQ ID NO: 28065 - protein, 11 aa, Artificial Sequence
  Peptide Derived from Human Papillomavirus
FVFVLCFILFL

SEQ ID NO: 28066 - protein, 8 aa, Artificial Sequence
  Peptide Derived from Human Papillomavirus
FVGSPLKI

SEQ ID NO: 28067 - protein, 9 aa, Artificial Sequence
  Peptide Derived from Human Papillomavirus
FVGSPLKIF

SEQ ID NO: 28068 - protein, 10 aa, Artificial Sequence
  Peptide Derived from Human Papillomavirus
FVGSPLKIFF

SEQ ID NO: 28069 - protein, 8 aa, Artificial Sequence
  Peptide Derived from Human Papillomavirus
FVLCFILF

SEQ ID NO: 28070 - protein, 9 aa, Artificial Sequence
  Peptide Derived from Human Papillomavirus
FVLCFILFL

SEQ ID NO: 28071 - protein, 11 aa, Artificial Sequence
  Peptide Derived from Human Papillomavirus
FVLCFILFLCL

SEQ ID NO: 28072 - protein, 8 aa, Artificial Sequence
  Peptide Derived from Human Papillomavirus
ILFLCLSL

SEQ ID NO: 28073 - protein, 9 aa, Artificial Sequence
  Peptide Derived from Human Papillomavirus
ILFLCLSLL

SEQ ID NO: 28074 - protein, 10 aa, Artificial Sequence
  Peptide Derived from Human Papillomavirus
ILFLCLSLLL

SEQ ID NO: 28075 - protein, 8 aa, Artificial Sequence
  Peptide Derived from Human Papillomavirus
ILSISTYA

SEQ ID NO: 28076 - protein, 9 aa, Artificial Sequence
  Peptide Derived from Human Papillomavirus
ILSISTYAW

SEQ ID NO: 28077 - protein, 10 aa, Artificial Sequence
  Peptide Derived from Human Papillomavirus
ILSISTYAWL

SEQ ID NO: 28078 - protein, 11 aa, Artificial Sequence
  Peptide Derived from Human Papillomavirus
ILSISTYAWLL

SEQ ID NO: 28079 - protein, 8 aa, Artificial Sequence
  Peptide Derived from Human Papillomavirus
KIFFCYLL

SEQ ID NO: 28080 - protein, 9 aa, Artificial Sequence
  Peptide Derived from Human Papillomavirus
KIFFCYLLF

SEQ ID NO: 28081 - protein, 10 aa, Artificial Sequence
  Peptide Derived from Human Papillomavirus
KIFFCYLLFL

SEQ ID NO: 28082 - protein, 11 aa, Artificial Sequence
  Peptide Derived from Human Papillomavirus
KIFFCYLLFLY

SEQ ID NO: 28083 - protein, 8 aa, Artificial Sequence
  Peptide Derived from Human Papillomavirus
LILSISTY

SEQ ID NO: 28084 - protein, 9 aa, Artificial Sequence
  Peptide Derived from Human Papillomavirus
LILSISTYA

SEQ ID NO: 28085 - protein, 10 aa, Artificial Sequence
  Peptide Derived from Human Papillomavirus
LILSISTYAW

SEQ ID NO: 28086 - protein, 11 aa, Artificial Sequence
  Peptide Derived from Human Papillomavirus
LILSISTYAWL

SEQ ID NO: 28087 - protein, 8 aa, Artificial Sequence
  Peptide Derived from Human Papillomavirus
LLFLYLPM

SEQ ID NO: 28088 - protein, 9 aa, Artificial Sequence
  Peptide Derived from Human Papillomavirus
LLFLYLPMM

SEQ ID NO: 28089 - protein, 11 aa, Artificial Sequence
  Peptide Derived from Human Papillomavirus
LLFLYLPMMCI

SEQ ID NO: 28090 - protein, 8 aa, Artificial Sequence
  Peptide Derived from Human Papillomavirus
LLLRPLIL

SEQ ID NO: 28091 - protein, 10 aa, Artificial Sequence
  Peptide Derived from Human Papillomavirus
LLLRPLILSI

SEQ ID NO: 28092 - protein, 11 aa, Artificial Sequence
  Peptide Derived from Human Papillomavirus
LLLWVFVGSPL

SEQ ID NO: 28093 - protein, 9 aa, Artificial Sequence
  Peptide Derived from Human Papillomavirus
LLRPLILSI

SEQ ID NO: 28094 - protein, 8 aa, Artificial Sequence
  Peptide Derived from Human Papillomavirus
LLVLVLLL

SEQ ID NO: 28095 - protein, 9 aa, Artificial Sequence
  Peptide Derived from Human Papillomavirus
LLVLVLLLW

SEQ ID NO: 28096 - protein, 10 aa, Artificial Sequence
  Peptide Derived from Human Papillomavirus
LLVLVLLLWV

SEQ ID NO: 28097 - protein, 11 aa, Artificial Sequence
  Peptide Derived from Human Papillomavirus
LLVLVLLLWVF

SEQ ID NO: 28098 - protein, 10 aa, Artificial Sequence
  Peptide Derived from Human Papillomavirus
LLWVFVGSPL

SEQ ID NO: 28099 - protein, 8 aa, Artificial Sequence
  Peptide Derived from Human Papillomavirus
LPMMCINF

SEQ ID NO: 28100 - protein, 10 aa, Artificial Sequence
  Peptide Derived from Human Papillomavirus
LPMMCINFHA

SEQ ID NO: 28101 - protein, 8 aa, Artificial Sequence
  Peptide Derived from Human Papillomavirus
LVLLLWVF

SEQ ID NO: 28102 - protein, 9 aa, Artificial Sequence
  Peptide Derived from Human Papillomavirus
LVLLLWVFV

SEQ ID NO: 28103 - protein, 8 aa, Artificial Sequence
  Peptide Derived from Human Papillomavirus
LVLVLLLW

SEQ ID NO: 28104 - protein, 9 aa, Artificial Sequence
  Peptide Derived from Human Papillomavirus
LVLVLLLWV

SEQ ID NO: 28105 - protein, 10 aa, Artificial Sequence
  Peptide Derived from Human Papillomavirus
LVLVLLLWVF

SEQ ID NO: 28106 - protein, 11 aa, Artificial Sequence
  Peptide Derived from Human Papillomavirus
LVLVLLLWVFV

SEQ ID NO: 28107 - protein, 9 aa, Artificial Sequence
  Peptide Derived from Human Papillomavirus
MIFVFVLCF

SEQ ID NO: 28108 - protein, 10 aa, Artificial Sequence
  Peptide Derived from Human Papillomavirus
MIFVFVLCFI

SEQ ID NO: 28109 - protein, 11 aa, Artificial Sequence
  Peptide Derived from Human Papillomavirus
MIFVFVLCFIL

SEQ ID NO: 28110 - protein, 8 aa, Artificial Sequence
  Peptide Derived from Human Papillomavirus
MMCINFHA

SEQ ID NO: 28111 - protein, 11 aa, Artificial Sequence
  Peptide Derived from Human Papillomavirus
MMCINFHAQHM

SEQ ID NO: 28112 - protein, 9 aa, Artificial Sequence
  Peptide Derived from Human Papillomavirus
PLILSISTY

SEQ ID NO: 28113 - protein, 10 aa, Artificial Sequence
  Peptide Derived from Human Papillomavirus
PLILSISTYA

SEQ ID NO: 28114 - protein, 11 aa, Artificial Sequence
  Peptide Derived from Human Papillomavirus
PLILSISTYAW

SEQ ID NO: 28115 - protein, 8 aa, Artificial Sequence
  Peptide Derived from Human Papillomavirus
PLKIFFCY

SEQ ID NO: 28116 - protein, 9 aa, Artificial Sequence
  Peptide Derived from Human Papillomavirus
PLKIFFCYL

SEQ ID NO: 28117 - protein, 10 aa, Artificial Sequence
  Peptide Derived from Human Papillomavirus
PLKIFFCYLL

SEQ ID NO: 28118 - protein, 11 aa, Artificial Sequence
  Peptide Derived from Human Papillomavirus
PLKIFFCYLLF

SEQ ID NO: 28119 - protein, 9 aa, Artificial Sequence
  Peptide Derived from Human Papillomavirus
PMMCINFHA

SEQ ID NO: 28120 - protein, 10 aa, Artificial Sequence
  Peptide Derived from Human Papillomavirus
RPLILSISTY

SEQ ID NO: 28121 - protein, 11 aa, Artificial Sequence
  Peptide Derived from Human Papillomavirus
RPLILSISTYA

SEQ ID NO: 28122 - protein, 8 aa, Artificial Sequence
  Peptide Derived from Human Papillomavirus
SISTYAWL

SEQ ID NO: 28123 - protein, 9 aa, Artificial Sequence
  Peptide Derived from Human Papillomavirus
SISTYAWLL

SEQ ID NO: 28124 - protein, 10 aa, Artificial Sequence
  Peptide Derived from Human Papillomavirus
SISTYAWLLV

SEQ ID NO: 28125 - protein, 11 aa, Artificial Sequence
  Peptide Derived from Human Papillomavirus
SISTYAWLLVL

SEQ ID NO: 28126 - protein, 8 aa, Artificial Sequence
  Peptide Derived from Human Papillomavirus
SLLLRPLI

SEQ ID NO: 28127 - protein, 9 aa, Artificial Sequence
  Peptide Derived from Human Papillomavirus
SLLLRPLIL

SEQ ID NO: 28128 - protein, 11 aa, Artificial Sequence
  Peptide Derived from Human Papillomavirus
SLLLRPLILSI

SEQ ID NO: 28129 - protein, 9 aa, Artificial Sequence
  Peptide Derived from Human Papillomavirus
SPLKIFFCY

SEQ ID NO: 28130 - protein, 10 aa, Artificial Sequence
  Peptide Derived from Human Papillomavirus
SPLKIFFCYL

SEQ ID NO: 28131 - protein, 11 aa, Artificial Sequence
  Peptide Derived from Human Papillomavirus
SPLKIFFCYLL

SEQ ID NO: 28132 - protein, 8 aa, Artificial Sequence
  Peptide Derived from Human Papillomavirus
VLCFILFL

SEQ ID NO: 28133 - protein, 10 aa, Artificial Sequence
  Peptide Derived from Human Papillomavirus
VLCFILFLCL

SEQ ID NO: 28134 - protein, 8 aa, Artificial Sequence
  Peptide Derived from Human Papillomavirus
VLLLWVFV

SEQ ID NO: 28135 - protein, 8 aa, Artificial Sequence
  Peptide Derived from Human Papillomavirus
VLVLLLWV

SEQ ID NO: 28136 - protein, 9 aa, Artificial Sequence
  Peptide Derived from Human Papillomavirus
VLVLLLWVF

SEQ ID NO: 28137 - protein, 10 aa, Artificial Sequence
  Peptide Derived from Human Papillomavirus
VLVLLLWVFV

SEQ ID NO: 28138 - protein, 8 aa, Artificial Sequence
  Peptide Derived from Human Papillomavirus
WLLVLVLL

SEQ ID NO: 28139 - protein, 9 aa, Artificial Sequence
  Peptide Derived from Human Papillomavirus
WLLVLVLLL

SEQ ID NO: 28140 - protein, 10 aa, Artificial Sequence
  Peptide Derived from Human Papillomavirus
WLLVLVLLLW

SEQ ID NO: 28141 - protein, 11 aa, Artificial Sequence
  Peptide Derived from Human Papillomavirus
WLLVLVLLLWV

SEQ ID NO: 28142 - protein, 8 aa, Artificial Sequence
  Peptide Derived from Human Papillomavirus
WVFVGSPL

SEQ ID NO: 28143 - protein, 10 aa, Artificial Sequence
  Peptide Derived from Human Papillomavirus
WVFVGSPLKI

SEQ ID NO: 28144 - protein, 11 aa, Artificial Sequence
  Peptide Derived from Human Papillomavirus
WVFVGSPLKIF

SEQ ID NO: 28145 - protein, 9 aa, Artificial Sequence
  Peptide Derived from Human Papillomavirus
YLLFLYLPM

SEQ ID NO: 28146 - protein, 10 aa, Artificial Sequence
  Peptide Derived from Human Papillomavirus
YLLFLYLPMM

SEQ ID NO: 28147 - protein, 9 aa, Artificial Sequence
  Peptide Derived from Human Papillomavirus
YLPMMCINF

SEQ ID NO: 28148 - protein, 11 aa, Artificial Sequence
  Peptide Derived from Human Papillomavirus
YLPMMCINFHA

SEQ ID NO: 28149 - protein, 9 aa, Artificial Sequence
  Peptide Derived from Human Papillomavirus
ALETTIHNI

SEQ ID NO: 28150 - protein, 11 aa, Artificial Sequence
  Peptide Derived from Human Papillomavirus
ALETTIHNIEL

SEQ ID NO: 28151 - protein, 8 aa, Artificial Sequence
  Peptide Derived from Human Papillomavirus
CIICQRPL

SEQ ID NO: 28152 - protein, 8 aa, Artificial Sequence
  Peptide Derived from Human Papillomavirus
CLRFLSKI

SEQ ID NO: 28153 - protein, 11 aa, Artificial Sequence
  Peptide Derived from Human Papillomavirus
CLRFLSKISEY

SEQ ID NO: 28154 - protein, 9 aa, Artificial Sequence
  Peptide Derived from Human Papillomavirus
CPQEKKRHV

SEQ ID NO: 28155 - protein, 11 aa, Artificial Sequence
  Peptide Derived from Human Papillomavirus
CPQEKKRHVDL

SEQ ID NO: 28156 - protein, 8 aa, Artificial Sequence
  Peptide Derived from Human Papillomavirus
CQALETTI

SEQ ID NO: 28157 - protein, 11 aa, Artificial Sequence
  Peptide Derived from Human Papillomavirus
CQALETTIHNI

SEQ ID NO: 28158 - protein, 8 aa, Artificial Sequence
  Peptide Derived from Human Papillomavirus
CVECKKPL

SEQ ID NO: 28159 - protein, 10 aa, Artificial Sequence
  Peptide Derived from Human Papillomavirus
DLCQALETTI

SEQ ID NO: 28160 - protein, 9 aa, Artificial Sequence
  Peptide Derived from Human Papillomavirus
DLNKRFHNI

SEQ ID NO: 28161 - protein, 8 aa, Artificial Sequence
  Peptide Derived from Human Papillomavirus
EILIRCII

SEQ ID NO: 28162 - protein, 11 aa, Artificial Sequence
  Peptide Derived from Human Papillomavirus
ELQCVECKKPL

SEQ ID NO: 28163 - protein, 8 aa, Artificial Sequence
  Peptide Derived from Human Papillomavirus
EQTVKKPL

SEQ ID NO: 28164 - protein, 11 aa, Artificial Sequence
  Peptide Derived from Human Papillomavirus
EQTVKKPLNEI

SEQ ID NO: 28165 - protein, 8 aa, Artificial Sequence
  Peptide Derived from Human Papillomavirus
EVYDFAFA

SEQ ID NO: 28166 - protein, 10 aa, Artificial Sequence
  Peptide Derived from Human Papillomavirus
EVYDFAFADL

SEQ ID NO: 28167 - protein, 8 aa, Artificial Sequence
  Peptide Derived from Human Papillomavirus
FLSKISEY

SEQ ID NO: 28168 - protein, 11 aa, Artificial Sequence
  Peptide Derived from Human Papillomavirus
FLSKISEYRHY

SEQ ID NO: 28169 - protein, 11 aa, Artificial Sequence
  Peptide Derived from Human Papillomavirus
FQDTEEKPRTL

SEQ ID NO: 28170 - protein, 9 aa, Artificial Sequence
  Peptide Derived from Human Papillomavirus
GICKLCLRF

SEQ ID NO: 28171 - protein, 10 aa, Artificial Sequence
  Peptide Derived from Human Papillomavirus
GICKLCLRFL

SEQ ID NO: 28172 - protein, 8 aa, Artificial Sequence
  Peptide Derived from Human Papillomavirus
HVDLNKRF

SEQ ID NO: 28173 - protein, 11 aa, Artificial Sequence
  Peptide Derived from Human Papillomavirus
HVDLNKRFHNI

SEQ ID NO: 28174 - protein, 8 aa, Artificial Sequence
  Peptide Derived from Human Papillomavirus
KISEYRHY

SEQ ID NO: 28175 - protein, 10 aa, Artificial Sequence
  Peptide Derived from Human Papillomavirus
KISEYRHYNY

SEQ ID NO: 28176 - protein, 10 aa, Artificial Sequence
  Peptide Derived from Human Papillomavirus
KLCLRFLSKI

SEQ ID NO: 28177 - protein, 8 aa, Artificial Sequence
  Peptide Derived from Human Papillomavirus
KPLNEILI

SEQ ID NO: 28178 - protein, 11 aa, Artificial Sequence
  Peptide Derived from Human Papillomavirus
KPLNEILIRCI

SEQ ID NO: 28179 - protein, 8 aa, Artificial Sequence
  Peptide Derived from Human Papillomavirus
KPLQRSEV

SEQ ID NO: 28180 - protein, 9 aa, Artificial Sequence
  Peptide Derived from Human Papillomavirus
KPLQRSEVY

SEQ ID NO: 28181 - protein, 11 aa, Artificial Sequence
  Peptide Derived from Human Papillomavirus
KPLQRSEVYDF

SEQ ID NO: 28182 - protein, 8 aa, Artificial Sequence
  Peptide Derived from Human Papillomavirus
KPRTLHDL

SEQ ID NO: 28183 - protein, 11 aa, Artificial Sequence
  Peptide Derived from Human Papillomavirus
KPRTLHDLCQA

SEQ ID NO: 28184 - protein, 11 aa, Artificial Sequence
  Peptide Derived from Human Papillomavirus
LIRCIICQRPL

SEQ ID NO: 28185 - protein, 10 aa, Artificial Sequence
  Peptide Derived from Human Papillomavirus
LQCVECKKPL

SEQ ID NO: 28186 - protein, 9 aa, Artificial Sequence
  Peptide Derived from Human Papillomavirus
LQRSEVYDF

SEQ ID NO: 28187 - protein, 10 aa, Artificial Sequence
  Peptide Derived from Human Papillomavirus
LQRSEVYDFA

SEQ ID NO: 28188 - protein, 11 aa, Artificial Sequence
  Peptide Derived from Human Papillomavirus
LQRSEVYDFAF

SEQ ID NO: 28189 - protein, 11 aa, Artificial Sequence
  Peptide Derived from Human Papillomavirus
NISGRWAGRCA

SEQ ID NO: 28190 - protein, 8 aa, Artificial Sequence
  Peptide Derived from Human Papillomavirus
NPFGICKL

SEQ ID NO: 28191 - protein, 10 aa, Artificial Sequence
  Peptide Derived from Human Papillomavirus
NPFGICKLCL

SEQ ID NO: 28192 - protein, 11 aa, Artificial Sequence
  Peptide Derived from Human Papillomavirus
PLCPQEKKRHV

SEQ ID NO: 28193 - protein, 10 aa, Artificial Sequence
  Peptide Derived from Human Papillomavirus
PLNEILIRCI

SEQ ID NO: 28194 - protein, 11 aa, Artificial Sequence
  Peptide Derived from Human Papillomavirus
PLNEILIRCII

SEQ ID NO: 28195 - protein, 8 aa, Artificial Sequence
  Peptide Derived from Human Papillomavirus
PLQRSEVY

SEQ ID NO: 28196 - protein, 10 aa, Artificial Sequence
  Peptide Derived from Human Papillomavirus
PLQRSEVYDF

SEQ ID NO: 28197 - protein, 11 aa, Artificial Sequence
  Peptide Derived from Human Papillomavirus
PLQRSEVYDFA

SEQ ID NO: 28198 - protein, 8 aa, Artificial Sequence
  Peptide Derived from Human Papillomavirus
PQEKKRHV

SEQ ID NO: 28199 - protein, 10 aa, Artificial Sequence
  Peptide Derived from Human Papillomavirus
PQEKKRHVDL

SEQ ID NO: 28200 - protein, 11 aa, Artificial Sequence
  Peptide Derived from Human Papillomavirus
SVYGNTLEQTV

SEQ ID NO: 28201 - protein, 10 aa, Artificial Sequence
  Peptide Derived from Human Papillomavirus
TIHNIELQCV

SEQ ID NO: 28202 - protein, 10 aa, Artificial Sequence
  Peptide Derived from Human Papillomavirus
TLEQTVKKPL

SEQ ID NO: 28203 - protein, 8 aa, Artificial Sequence
  Peptide Derived from Human Papillomavirus
TLHDLCQA

SEQ ID NO: 28204 - protein, 9 aa, Artificial Sequence
  Peptide Derived from Human Papillomavirus
TLHDLCQAL

SEQ ID NO: 28205 - protein, 9 aa, Artificial Sequence
  Peptide Derived from Human Papillomavirus
TVKKPLNEI

SEQ ID NO: 28206 - protein, 10 aa, Artificial Sequence
  Peptide Derived from Human Papillomavirus
TVKKPLNEIL

SEQ ID NO: 28207 - protein, 11 aa, Artificial Sequence
  Peptide Derived from Human Papillomavirus
TVKKPLNEILI

SEQ ID NO: 28208 - protein, 10 aa, Artificial Sequence
  Peptide Derived from Human Papillomavirus
TVVYREGNPF

SEQ ID NO: 28209 - protein, 9 aa, Artificial Sequence
  Peptide Derived from Human Papillomavirus
VVYREGNPF

SEQ ID NO: 28210 - protein, 11 aa, Artificial Sequence
  Peptide Derived from Human Papillomavirus
VVYREGNPFGI

SEQ ID NO: 28211 - protein, 8 aa, Artificial Sequence
  Peptide Derived from Human Papillomavirus
AQPATADY

SEQ ID NO: 28212 - protein, 9 aa, Artificial Sequence
  Peptide Derived from Human Papillomavirus
AQPATADYY

SEQ ID NO: 28213 - protein, 10 aa, Artificial Sequence
  Peptide Derived from Human Papillomavirus
AQPATADYYI

SEQ ID NO: 28214 - protein, 11 aa, Artificial Sequence
  Peptide Derived from Human Papillomavirus
AQPATADYYIV

SEQ ID NO: 28215 - protein, 9 aa, Artificial Sequence
  Peptide Derived from Human Papillomavirus
CVNSTASDL

SEQ ID NO: 28216 - protein, 8 aa, Artificial Sequence
  Peptide Derived from Human Papillomavirus
DLRTIQQL

SEQ ID NO: 28217 - protein, 9 aa, Artificial Sequence
  Peptide Derived from Human Papillomavirus
DLRTIQQLL

SEQ ID NO: 28218 - protein, 10 aa, Artificial Sequence
  Peptide Derived from Human Papillomavirus
DLRTIQQLLM

SEQ ID NO: 28219 - protein, 8 aa, Artificial Sequence
  Peptide Derived from Human Papillomavirus
DLYCYEQL

SEQ ID NO: 28220 - protein, 9 aa, Artificial Sequence
  Peptide Derived from Human Papillomavirus
DLYPEPTDL

SEQ ID NO: 28221 - protein, 10 aa, Artificial Sequence
  Peptide Derived from Human Papillomavirus
DLYPEPTDLY

SEQ ID NO: 28222 - protein, 8 aa, Artificial Sequence
  Peptide Derived from Human Papillomavirus
EPTDLYCY

SEQ ID NO: 28223 - protein, 11 aa, Artificial Sequence
  Peptide Derived from Human Papillomavirus
EPTDLYCYEQL

SEQ ID NO: 28224 - protein, 9 aa, Artificial Sequence
  Peptide Derived from Human Papillomavirus
GLDRPDGQA

SEQ ID NO: 28225 - protein, 8 aa, Artificial Sequence
  Peptide Derived from Human Papillomavirus
GQAQPATA

SEQ ID NO: 28226 - protein, 10 aa, Artificial Sequence
  Peptide Derived from Human Papillomavirus
GQAQPATADY

SEQ ID NO: 28227 - protein, 11 aa, Artificial Sequence
  Peptide Derived from Human Papillomavirus
GQAQPATADYY

SEQ ID NO: 28228 - protein, 9 aa, Artificial Sequence
  Peptide Derived from Human Papillomavirus
IQQLLMGTV

SEQ ID NO: 28229 - protein, 11 aa, Artificial Sequence
  Peptide Derived from Human Papillomavirus
IQQLLMGTVNI

SEQ ID NO: 28230 - protein, 8 aa, Artificial Sequence
  Peptide Derived from Human Papillomavirus
KPTLKEYV

SEQ ID NO: 28231 - protein, 9 aa, Artificial Sequence
  Peptide Derived from Human Papillomavirus
KPTLKEYVL

SEQ ID NO: 28232 - protein, 11 aa, Artificial Sequence
  Peptide Derived from Human Papillomavirus
KPTLKEYVLDL

SEQ ID NO: 28233 - protein, 8 aa, Artificial Sequence
  Peptide Derived from Human Papillomavirus
LLMGTVNI

SEQ ID NO: 28234 - protein, 9 aa, Artificial Sequence
  Peptide Derived from Human Papillomavirus
LLMGTVNIV

SEQ ID NO: 28235 - protein, 8 aa, Artificial Sequence
  Peptide Derived from Human Papillomavirus
LMGTVNIV

SEQ ID NO: 28236 - protein, 8 aa, Artificial Sequence
  Peptide Derived from Human Papillomavirus
NIVCPTCA

SEQ ID NO: 28237 - protein, 9 aa, Artificial Sequence
  Peptide Derived from Human Papillomavirus
QLLMGTVNI

SEQ ID NO: 28238 - protein, 10 aa, Artificial Sequence
  Peptide Derived from Human Papillomavirus
QLLMGTVNIV

SEQ ID NO: 28239 - protein, 8 aa, Artificial Sequence
  Peptide Derived from Human Papillomavirus
QPATADYY

SEQ ID NO: 28240 - protein, 9 aa, Artificial Sequence
  Peptide Derived from Human Papillomavirus
QPATADYYI

SEQ ID NO: 28241 - protein, 10 aa, Artificial Sequence
  Peptide Derived from Human Papillomavirus
QPATADYYIV

SEQ ID NO: 28242 - protein, 8 aa, Artificial Sequence
  Peptide Derived from Human Papillomavirus
QQLLMGTV

SEQ ID NO: 28243 - protein, 10 aa, Artificial Sequence
  Peptide Derived from Human Papillomavirus
QQLLMGTVNI

SEQ ID NO: 28244 - protein, 11 aa, Artificial Sequence
  Peptide Derived from Human Papillomavirus
QQLLMGTVNIV

SEQ ID NO: 28245 - protein, 8 aa, Artificial Sequence
  Peptide Derived from Human Papillomavirus
RLCVNSTA

SEQ ID NO: 28246 - protein, 11 aa, Artificial Sequence
  Peptide Derived from Human Papillomavirus
RLCVNSTASDL

SEQ ID NO: 28247 - protein, 9 aa, Artificial Sequence
  Peptide Derived from Human Papillomavirus
RPDGQAQPA

SEQ ID NO: 28248 - protein, 11 aa, Artificial Sequence
  Peptide Derived from Human Papillomavirus
RPDGQAQPATA

SEQ ID NO: 28249 - protein, 10 aa, Artificial Sequence
  Peptide Derived from Human Papillomavirus
TIQQLLMGTV

SEQ ID NO: 28250 - protein, 9 aa, Artificial Sequence
  Peptide Derived from Human Papillomavirus
TLKEYVLDL

SEQ ID NO: 28251 - protein, 10 aa, Artificial Sequence
  Peptide Derived from Human Papillomavirus
TLKEYVLDLY

SEQ ID NO: 28252 - protein, 10 aa, Artificial Sequence
  Peptide Derived from Human Papillomavirus
TVNIVCPTCA

SEQ ID NO: 28253 - protein, 10 aa, Artificial Sequence
  Peptide Derived from Human Papillomavirus
TVRLCVNSTA

SEQ ID NO: 28254 - protein, 11 aa, Artificial Sequence
  Peptide Derived from Human Papillomavirus
VLDLYPEPTDL

SEQ ID NO: 28255 - protein, 8 aa, Artificial Sequence
  Peptide Derived from Human Papillomavirus
YPEPTDLY

SEQ ID NO: 28256 - protein, 10 aa, Artificial Sequence
  Peptide Derived from Human Papillomavirus
YPEPTDLYCY

SEQ ID NO: 28257 - protein, 8 aa, Artificial Sequence
  Peptide Derived from Human Papillomavirus
AITCQKTV

SEQ ID NO: 28258 - protein, 10 aa, Artificial Sequence
  Peptide Derived from Human Papillomavirus
AMNPDILEDW

SEQ ID NO: 28259 - protein, 9 aa, Artificial Sequence
  Peptide Derived from Human Papillomavirus
APANDCPPL

SEQ ID NO: 28260 - protein, 11 aa, Artificial Sequence
  Peptide Derived from Human Papillomavirus
APANDCPPLEL

SEQ ID NO: 28261 - protein, 10 aa, Artificial Sequence
  Peptide Derived from Human Papillomavirus
APTSTRTSSA

SEQ ID NO: 28262 - protein, 8 aa, Artificial Sequence
  Peptide Derived from Human Papillomavirus
AQGHNNGI

SEQ ID NO: 28263 - protein, 10 aa, Artificial Sequence
  Peptide Derived from Human Papillomavirus
AQGHNNGICW

SEQ ID NO: 28264 - protein, 9 aa, Artificial Sequence
  Peptide Derived from Human Papillomavirus
AVGHPYFSI

SEQ ID NO: 28265 - protein, 8 aa, Artificial Sequence
  Peptide Derived from Human Papillomavirus
AVPDDLYI

SEQ ID NO: 28266 - protein, 11 aa, Artificial Sequence
  Peptide Derived from Human Papillomavirus
CLSMDYKQTQL

SEQ ID NO: 28267 - protein, 9 aa, Artificial Sequence
  Peptide Derived from Human Papillomavirus
CMDFKTLQA

SEQ ID NO: 28268 - protein, 10 aa, Artificial Sequence
  Peptide Derived from Human Papillomavirus
CPPLELINTI

SEQ ID NO: 28269 - protein, 11 aa, Artificial Sequence
  Peptide Derived from Human Papillomavirus
CPPLELINTII

SEQ ID NO: 28270 - protein, 9 aa, Artificial Sequence
  Peptide Derived from Human Papillomavirus
DICGSTCKY

SEQ ID NO: 28271 - protein, 8 aa, Artificial Sequence
  Peptide Derived from Human Papillomavirus
DILEDWQF

SEQ ID NO: 28272 - protein, 10 aa, Artificial Sequence
  Peptide Derived from Human Papillomavirus
DILEDWQFGL

SEQ ID NO: 28273 - protein, 11 aa, Artificial Sequence
  Peptide Derived from Human Papillomavirus
DLDQFPLGRKF

SEQ ID NO: 28274 - protein, 8 aa, Artificial Sequence
  Peptide Derived from Human Papillomavirus
DLKEKFSA

SEQ ID NO: 28275 - protein, 10 aa, Artificial Sequence
  Peptide Derived from Human Papillomavirus
DLKEKFSADL

SEQ ID NO: 28276 - protein, 8 aa, Artificial Sequence
  Peptide Derived from Human Papillomavirus
DLQFVFQL

SEQ ID NO: 28277 - protein, 11 aa, Artificial Sequence
  Peptide Derived from Human Papillomavirus
DLQFVFQLCKV

SEQ ID NO: 28278 - protein, 11 aa, Artificial Sequence
  Peptide Derived from Human Papillomavirus
DLYIKGSGTTA

SEQ ID NO: 28279 - protein, 10 aa, Artificial Sequence
  Peptide Derived from Human Papillomavirus
DMVDTGFGCM

SEQ ID NO: 28280 - protein, 8 aa, Artificial Sequence
  Peptide Derived from Human Papillomavirus
DPLGKYTF

SEQ ID NO: 28281 - protein, 9 aa, Artificial Sequence
  Peptide Derived from Human Papillomavirus
DPLGKYTFW

SEQ ID NO: 28282 - protein, 11 aa, Artificial Sequence
  Peptide Derived from Human Papillomavirus
DPLGKYTFWEV

SEQ ID NO: 28283 - protein, 9 aa, Artificial Sequence
  Peptide Derived from Human Papillomavirus
DQFPLGRKF

SEQ ID NO: 28284 - protein, 10 aa, Artificial Sequence
  Peptide Derived from Human Papillomavirus
DQFPLGRKFL

SEQ ID NO: 28285 - protein, 11 aa, Artificial Sequence
  Peptide Derived from Human Papillomavirus
DQFPLGRKFLL

SEQ ID NO: 28286 - protein, 8 aa, Artificial Sequence
  Peptide Derived from Human Papillomavirus
EIGRGQPL

SEQ ID NO: 28287 - protein, 10 aa, Artificial Sequence
  Peptide Derived from Human Papillomavirus
EIGRGQPLGV

SEQ ID NO: 28288 - protein, 8 aa, Artificial Sequence
  Peptide Derived from Human Papillomavirus
EPYGDSLF

SEQ ID NO: 28289 - protein, 9 aa, Artificial Sequence
  Peptide Derived from Human Papillomavirus
EPYGDSLFF

SEQ ID NO: 28290 - protein, 10 aa, Artificial Sequence
  Peptide Derived from Human Papillomavirus
EPYGDSLFFF

SEQ ID NO: 28291 - protein, 11 aa, Artificial Sequence
  Peptide Derived from Human Papillomavirus
EPYGDSLFFFL

SEQ ID NO: 28292 - protein, 8 aa, Artificial Sequence
  Peptide Derived from Human Papillomavirus
EQMFVRHF

SEQ ID NO: 28293 - protein, 9 aa, Artificial Sequence
  Peptide Derived from Human Papillomavirus
EQMFVRHFF

SEQ ID NO: 28294 - protein, 8 aa, Artificial Sequence
  Peptide Derived from Human Papillomavirus
EVDLKEKF

SEQ ID NO: 28295 - protein, 10 aa, Artificial Sequence
  Peptide Derived from Human Papillomavirus
EVDLKEKFSA

SEQ ID NO: 28296 - protein, 8 aa, Artificial Sequence
  Peptide Derived from Human Papillomavirus
EVMTYIHA

SEQ ID NO: 28297 - protein, 9 aa, Artificial Sequence
  Peptide Derived from Human Papillomavirus
EVMTYIHAM

SEQ ID NO: 28298 - protein, 9 aa, Artificial Sequence
  Peptide Derived from Human Papillomavirus
FLLQAGLKA

SEQ ID NO: 28299 - protein, 8 aa, Artificial Sequence
  Peptide Derived from Human Papillomavirus
FLRREQMF

SEQ ID NO: 28300 - protein, 9 aa, Artificial Sequence
  Peptide Derived from Human Papillomavirus
FLRREQMFV

SEQ ID NO: 28301 - protein, 8 aa, Artificial Sequence
  Peptide Derived from Human Papillomavirus
FPLGRKFL

SEQ ID NO: 28302 - protein, 9 aa, Artificial Sequence
  Peptide Derived from Human Papillomavirus
FPLGRKFLL

SEQ ID NO: 28303 - protein, 11 aa, Artificial Sequence
  Peptide Derived from Human Papillomavirus
FPLGRKFLLQA

SEQ ID NO: 28304 - protein, 8 aa, Artificial Sequence
  Peptide Derived from Human Papillomavirus
FPTPSGSM

SEQ ID NO: 28305 - protein, 9 aa, Artificial Sequence
  Peptide Derived from Human Papillomavirus
FPTPSGSMV

SEQ ID NO: 28306 - protein, 8 aa, Artificial Sequence
  Peptide Derived from Human Papillomavirus
FQLCKVTL

SEQ ID NO: 28307 - protein, 10 aa, Artificial Sequence
  Peptide Derived from Human Papillomavirus
FQLCKVTLTA

SEQ ID NO: 28308 - protein, 8 aa, Artificial Sequence
  Peptide Derived from Human Papillomavirus
FVFQLCKV

SEQ ID NO: 28309 - protein, 10 aa, Artificial Sequence
  Peptide Derived from Human Papillomavirus
FVFQLCKVTL

SEQ ID NO: 28310 - protein, 9 aa, Artificial Sequence
  Peptide Derived from Human Papillomavirus
FVRHFFNRA

SEQ ID NO: 28311 - protein, 8 aa, Artificial Sequence
  Peptide Derived from Human Papillomavirus
GICWGNQV

SEQ ID NO: 28312 - protein, 9 aa, Artificial Sequence
  Peptide Derived from Human Papillomavirus
GICWGNQVF

SEQ ID NO: 28313 - protein, 10 aa, Artificial Sequence
  Peptide Derived from Human Papillomavirus
GICWGNQVFV

SEQ ID NO: 28314 - protein, 8 aa, Artificial Sequence
  Peptide Derived from Human Papillomavirus
GISGHPLL

SEQ ID NO: 28315 - protein, 11 aa, Artificial Sequence
  Peptide Derived from Human Papillomavirus
GISGHPLLNKF

SEQ ID NO: 28316 - protein, 10 aa, Artificial Sequence
  Peptide Derived from Human Papillomavirus
GLEIGRGQPL

SEQ ID NO: 28317 - protein, 8 aa, Artificial Sequence
  Peptide Derived from Human Papillomavirus
GLKAKPKL

SEQ ID NO: 28318 - protein, 11 aa, Artificial Sequence
  Peptide Derived from Human Papillomavirus
GLKAKPKLKRA

SEQ ID NO: 28319 - protein, 9 aa, Artificial Sequence
  Peptide Derived from Human Papillomavirus
GLQYRVFRV

SEQ ID NO: 28320 - protein, 11 aa, Artificial Sequence
  Peptide Derived from Human Papillomavirus
GLQYRVFRVRL

SEQ ID NO: 28321 - protein, 8 aa, Artificial Sequence
  Peptide Derived from Human Papillomavirus
GLTPPPSA

SEQ ID NO: 28322 - protein, 10 aa, Artificial Sequence
  Peptide Derived from Human Papillomavirus
GLTPPPSASL

SEQ ID NO: 28323 - protein, 11 aa, Artificial Sequence
  Peptide Derived from Human Papillomavirus
GQPGADNRECL

SEQ ID NO: 28324 - protein, 8 aa, Artificial Sequence
  Peptide Derived from Human Papillomavirus
GQPLGVGI

SEQ ID NO: 28325 - protein, 8 aa, Artificial Sequence
  Peptide Derived from Human Papillomavirus
GVACTNAA

SEQ ID NO: 28326 - protein, 10 aa, Artificial Sequence
  Peptide Derived from Human Papillomavirus
GVACTNAAPA

SEQ ID NO: 28327 - protein, 9 aa, Artificial Sequence
  Peptide Derived from Human Papillomavirus
GVGISGHPL

SEQ ID NO: 28328 - protein, 10 aa, Artificial Sequence
  Peptide Derived from Human Papillomavirus
GVGISGHPLL

SEQ ID NO: 28329 - protein, 9 aa, Artificial Sequence
  Peptide Derived from Human Papillomavirus
HVEEYDLQF

SEQ ID NO: 28330 - protein, 10 aa, Artificial Sequence
  Peptide Derived from Human Papillomavirus
HVEEYDLQFV

SEQ ID NO: 28331 - protein, 11 aa, Artificial Sequence
  Peptide Derived from Human Papillomavirus
HVEEYDLQFVF

SEQ ID NO: 28332 - protein, 8 aa, Artificial Sequence
  Peptide Derived from Human Papillomavirus
IIEDGDMV

SEQ ID NO: 28333 - protein, 9 aa, Artificial Sequence
  Peptide Derived from Human Papillomavirus
ILEDWQFGL

SEQ ID NO: 28334 - protein, 10 aa, Artificial Sequence
  Peptide Derived from Human Papillomavirus
KLLVPKVSGL

SEQ ID NO: 28335 - protein, 11 aa, Artificial Sequence
  Peptide Derived from Human Papillomavirus
KMTSEPYGDSL

SEQ ID NO: 28336 - protein, 8 aa, Artificial Sequence
  Peptide Derived from Human Papillomavirus
KPKLKRAA

SEQ ID NO: 28337 - protein, 8 aa, Artificial Sequence
  Peptide Derived from Human Papillomavirus
KPPTGEHW

SEQ ID NO: 28338 - protein, 8 aa, Artificial Sequence
  Peptide Derived from Human Papillomavirus
KPYWLQRA

SEQ ID NO: 28339 - protein, 8 aa, Artificial Sequence
  Peptide Derived from Human Papillomavirus
KQTQLCLL

SEQ ID NO: 28340 - protein, 9 aa, Artificial Sequence
  Peptide Derived from Human Papillomavirus
KVSGLQYRV

SEQ ID NO: 28341 - protein, 10 aa, Artificial Sequence
  Peptide Derived from Human Papillomavirus
KVSGLQYRVF

SEQ ID NO: 28342 - protein, 8 aa, Artificial Sequence
  Peptide Derived from Human Papillomavirus
KVTLTAEV

SEQ ID NO: 28343 - protein, 9 aa, Artificial Sequence
  Peptide Derived from Human Papillomavirus
KVTLTAEVM

SEQ ID NO: 28344 - protein, 11 aa, Artificial Sequence
  Peptide Derived from Human Papillomavirus
KVTLTAEVMTY

SEQ ID NO: 28345 - protein, 8 aa, Artificial Sequence
  Peptide Derived from Human Papillomavirus
KVVSTDEY

SEQ ID NO: 28346 - protein, 9 aa, Artificial Sequence
  Peptide Derived from Human Papillomavirus
KVVSTDEYV

SEQ ID NO: 28347 - protein, 11 aa, Artificial Sequence
  Peptide Derived from Human Papillomavirus
LINTIIEDGDM

SEQ ID NO: 28348 - protein, 8 aa, Artificial Sequence
  Peptide Derived from Human Papillomavirus
LLAVGHPY

SEQ ID NO: 28349 - protein, 9 aa, Artificial Sequence
  Peptide Derived from Human Papillomavirus
LLAVGHPYF

SEQ ID NO: 28350 - protein, 11 aa, Artificial Sequence
  Peptide Derived from Human Papillomavirus
LLAVGHPYFSI

SEQ ID NO: 28351 - protein, 8 aa, Artificial Sequence
  Peptide Derived from Human Papillomavirus
LLQAGLKA

SEQ ID NO: 28352 - protein, 9 aa, Artificial Sequence
  Peptide Derived from Human Papillomavirus
LLVPKVSGL

SEQ ID NO: 28353 - protein, 11 aa, Artificial Sequence
  Peptide Derived from Human Papillomavirus
LLVPKVSGLQY

SEQ ID NO: 28354 - protein, 9 aa, Artificial Sequence
  Peptide Derived from Human Papillomavirus
LPDPNKFGF

SEQ ID NO: 28355 - protein, 9 aa, Artificial Sequence
  Peptide Derived from Human Papillomavirus
LPPVPVSKV

SEQ ID NO: 28356 - protein, 10 aa, Artificial Sequence
  Peptide Derived from Human Papillomavirus
LPPVPVSKVV

SEQ ID NO: 28357 - protein, 11 aa, Artificial Sequence
  Peptide Derived from Human Papillomavirus
LQAGLKAKPKL

SEQ ID NO: 28358 - protein, 8 aa, Artificial Sequence
  Peptide Derived from Human Papillomavirus
LQANKSDV

SEQ ID NO: 28359 - protein, 10 aa, Artificial Sequence
  Peptide Derived from Human Papillomavirus
LQANKSDVPI

SEQ ID NO: 28360 - protein, 8 aa, Artificial Sequence
  Peptide Derived from Human Papillomavirus
LQDTYRFV

SEQ ID NO: 28361 - protein, 10 aa, Artificial Sequence
  Peptide Derived from Human Papillomavirus
LQFVFQLCKV

SEQ ID NO: 28362 - protein, 11 aa, Artificial Sequence
  Peptide Derived from Human Papillomavirus
LQRAQGHNNGI

SEQ ID NO: 28363 - protein, 8 aa, Artificial Sequence
  Peptide Derived from Human Papillomavirus
LQYRVFRV

SEQ ID NO: 28364 - protein, 10 aa, Artificial Sequence
  Peptide Derived from Human Papillomavirus
LQYRVFRVRL

SEQ ID NO: 28365 - protein, 8 aa, Artificial Sequence
  Peptide Derived from Human Papillomavirus
LVPKVSGL

SEQ ID NO: 28366 - protein, 10 aa, Artificial Sequence
  Peptide Derived from Human Papillomavirus
LVPKVSGLQY

SEQ ID NO: 28367 - protein, 8 aa, Artificial Sequence
  Peptide Derived from Human Papillomavirus
LVWACVGL

SEQ ID NO: 28368 - protein, 10 aa, Artificial Sequence
  Peptide Derived from Human Papillomavirus
LVWACVGLEI

SEQ ID NO: 28369 - protein, 9 aa, Artificial Sequence
  Peptide Derived from Human Papillomavirus
MVDTGFGCM

SEQ ID NO: 28370 - protein, 11 aa, Artificial Sequence
  Peptide Derived from Human Papillomavirus
MVDTGFGCMDF

SEQ ID NO: 28371 - protein, 8 aa, Artificial Sequence
  Peptide Derived from Human Papillomavirus
MVTSESQL

SEQ ID NO: 28372 - protein, 9 aa, Artificial Sequence
  Peptide Derived from Human Papillomavirus
MVTSESQLF

SEQ ID NO: 28373 - protein, 8 aa, Artificial Sequence
  Peptide Derived from Human Papillomavirus
NMTLCTQV

SEQ ID NO: 28374 - protein, 8 aa, Artificial Sequence
  Peptide Derived from Human Papillomavirus
NPDILEDW

SEQ ID NO: 28375 - protein, 10 aa, Artificial Sequence
  Peptide Derived from Human Papillomavirus
NPDILEDWQF

SEQ ID NO: 28376 - protein, 8 aa, Artificial Sequence
  Peptide Derived from Human Papillomavirus
NPDTQRLV

SEQ ID NO: 28377 - protein, 9 aa, Artificial Sequence
  Peptide Derived from Human Papillomavirus
NPDTQRLVW

SEQ ID NO: 28378 - protein, 10 aa, Artificial Sequence
  Peptide Derived from Human Papillomavirus
NPDTQRLVWA

SEQ ID NO: 28379 - protein, 8 aa, Artificial Sequence
  Peptide Derived from Human Papillomavirus
NPTNAKKL

SEQ ID NO: 28380 - protein, 9 aa, Artificial Sequence
  Peptide Derived from Human Papillomavirus
NPTNAKKLL

SEQ ID NO: 28381 - protein, 10 aa, Artificial Sequence
  Peptide Derived from Human Papillomavirus
NPTNAKKLLV

SEQ ID NO: 28382 - protein, 8 aa, Artificial Sequence
  Peptide Derived from Human Papillomavirus
NQVFVTVV

SEQ ID NO: 28383 - protein, 11 aa, Artificial Sequence
  Peptide Derived from Human Papillomavirus
PIDICGSTCKY

SEQ ID NO: 28384 - protein, 8 aa, Artificial Sequence
  Peptide Derived from Human Papillomavirus
PLELINTI

SEQ ID NO: 28385 - protein, 9 aa, Artificial Sequence
  Peptide Derived from Human Papillomavirus
PLELINTII

SEQ ID NO: 28386 - protein, 8 aa, Artificial Sequence
  Peptide Derived from Human Papillomavirus
PLGKYTFW

SEQ ID NO: 28387 - protein, 10 aa, Artificial Sequence
  Peptide Derived from Human Papillomavirus
PLGKYTFWEV

SEQ ID NO: 28388 - protein, 8 aa, Artificial Sequence
  Peptide Derived from Human Papillomavirus
PLGRKFLL

SEQ ID NO: 28389 - protein, 10 aa, Artificial Sequence
  Peptide Derived from Human Papillomavirus
PLGRKFLLQA

SEQ ID NO: 28390 - protein, 11 aa, Artificial Sequence
  Peptide Derived from Human Papillomavirus
PLGVGISGHPL

SEQ ID NO: 28391 - protein, 9 aa, Artificial Sequence
  Peptide Derived from Human Papillomavirus
PPKEKEDPL

SEQ ID NO: 28392 - protein, 9 aa, Artificial Sequence
  Peptide Derived from Human Papillomavirus
PPLELINTI

SEQ ID NO: 28393 - protein, 10 aa, Artificial Sequence
  Peptide Derived from Human Papillomavirus
PPLELINTII

SEQ ID NO: 28394 - protein, 11 aa, Artificial Sequence
  Peptide Derived from Human Papillomavirus
PPPSASLQDTY

SEQ ID NO: 28395 - protein, 10 aa, Artificial Sequence
  Peptide Derived from Human Papillomavirus
PPSASLQDTY

SEQ ID NO: 28396 - protein, 11 aa, Artificial Sequence
  Peptide Derived from Human Papillomavirus
PPTGEHWGKGV

SEQ ID NO: 28397 - protein, 8 aa, Artificial Sequence
  Peptide Derived from Human Papillomavirus
PPVPVSKV

SEQ ID NO: 28398 - protein, 9 aa, Artificial Sequence
  Peptide Derived from Human Papillomavirus
PPVPVSKVV

SEQ ID NO: 28399 - protein, 8 aa, Artificial Sequence
  Peptide Derived from Human Papillomavirus
PVPVSKVV

SEQ ID NO: 28400 - protein, 11 aa, Artificial Sequence
  Peptide Derived from Human Papillomavirus
PVSKVVSTDEY

SEQ ID NO: 28401 - protein, 9 aa, Artificial Sequence
  Peptide Derived from Human Papillomavirus
QLCKVTLTA

SEQ ID NO: 28402 - protein, 11 aa, Artificial Sequence
  Peptide Derived from Human Papillomavirus
QLCKVTLTAEV

SEQ ID NO: 28403 - protein, 8 aa, Artificial Sequence
  Peptide Derived from Human Papillomavirus
QLFNKPYW

SEQ ID NO: 28404 - protein, 9 aa, Artificial Sequence
  Peptide Derived from Human Papillomavirus
QLFNKPYWL

SEQ ID NO: 28405 - protein, 8 aa, Artificial Sequence
  Peptide Derived from Human Papillomavirus
QMFVRHFF

SEQ ID NO: 28406 - protein, 11 aa, Artificial Sequence
  Peptide Derived from Human Papillomavirus
QMFVRHFFNRA

SEQ ID NO: 28407 - protein, 10 aa, Artificial Sequence
  Peptide Derived from Human Papillomavirus
QPGADNRECL

SEQ ID NO: 28408 - protein, 8 aa, Artificial Sequence
  Peptide Derived from Human Papillomavirus
QVTSDSTY

SEQ ID NO: 28409 - protein, 9 aa, Artificial Sequence
  Peptide Derived from Human Papillomavirus
RLLAVGHPY

SEQ ID NO: 28410 - protein, 10 aa, Artificial Sequence
  Peptide Derived from Human Papillomavirus
RLLAVGHPYF

SEQ ID NO: 28411 - protein, 8 aa, Artificial Sequence
  Peptide Derived from Human Papillomavirus
RLPDPNKF

SEQ ID NO: 28412 - protein, 10 aa, Artificial Sequence
  Peptide Derived from Human Papillomavirus
RLPDPNKFGF

SEQ ID NO: 28413 - protein, 9 aa, Artificial Sequence
  Peptide Derived from Human Papillomavirus
RLVWACVGL

SEQ ID NO: 28414 - protein, 11 aa, Artificial Sequence
  Peptide Derived from Human Papillomavirus
RLVWACVGLEI

SEQ ID NO: 28415 - protein, 8 aa, Artificial Sequence
  Peptide Derived from Human Papillomavirus
RPSEATVY

SEQ ID NO: 28416 - protein, 9 aa, Artificial Sequence
  Peptide Derived from Human Papillomavirus
RPSEATVYL

SEQ ID NO: 28417 - protein, 10 aa, Artificial Sequence
  Peptide Derived from Human Papillomavirus
RVRLPDPNKF

SEQ ID NO: 28418 - protein, 8 aa, Artificial Sequence
  Peptide Derived from Human Papillomavirus
SIKNPTNA

SEQ ID NO: 28419 - protein, 11 aa, Artificial Sequence
  Peptide Derived from Human Papillomavirus
SIKNPTNAKKL

SEQ ID NO: 28420 - protein, 8 aa, Artificial Sequence
  Peptide Derived from Human Papillomavirus
SIQSSAFF

SEQ ID NO: 28421 - protein, 11 aa, Artificial Sequence
  Peptide Derived from Human Papillomavirus
SIYYYAGSSRL

SEQ ID NO: 28422 - protein, 11 aa, Artificial Sequence
  Peptide Derived from Human Papillomavirus
SLFFFLRREQM

SEQ ID NO: 28423 - protein, 8 aa, Artificial Sequence
  Peptide Derived from Human Papillomavirus
SLQDTYRF

SEQ ID NO: 28424 - protein, 9 aa, Artificial Sequence
  Peptide Derived from Human Papillomavirus
SLQDTYRFV

SEQ ID NO: 28425 - protein, 9 aa, Artificial Sequence
  Peptide Derived from Human Papillomavirus
SMDYKQTQL

SEQ ID NO: 28426 - protein, 11 aa, Artificial Sequence
  Peptide Derived from Human Papillomavirus
SMDYKQTQLCL

SEQ ID NO: 28427 - protein, 9 aa, Artificial Sequence
  Peptide Derived from Human Papillomavirus
SMVTSESQL

SEQ ID NO: 28428 - protein, 10 aa, Artificial Sequence
  Peptide Derived from Human Papillomavirus
SMVTSESQLF

SEQ ID NO: 28429 - protein, 10 aa, Artificial Sequence
  Peptide Derived from Human Papillomavirus
SQAITCQKTV

SEQ ID NO: 28430 - protein, 8 aa, Artificial Sequence
  Peptide Derived from Human Papillomavirus
SQLFNKPY

SEQ ID NO: 28431 - protein, 9 aa, Artificial Sequence
  Peptide Derived from Human Papillomavirus
SQLFNKPYW

SEQ ID NO: 28432 - protein, 10 aa, Artificial Sequence
  Peptide Derived from Human Papillomavirus
SQLFNKPYWL

SEQ ID NO: 28433 - protein, 8 aa, Artificial Sequence
  Peptide Derived from Human Papillomavirus
SVWRPSEA

SEQ ID NO: 28434 - protein, 10 aa, Artificial Sequence
  Peptide Derived from Human Papillomavirus
SVWRPSEATV

SEQ ID NO: 28435 - protein, 11 aa, Artificial Sequence
  Peptide Derived from Human Papillomavirus
SVWRPSEATVY

SEQ ID NO: 28436 - protein, 8 aa, Artificial Sequence
  Peptide Derived from Human Papillomavirus
TIIEDGDM

SEQ ID NO: 28437 - protein, 9 aa, Artificial Sequence
  Peptide Derived from Human Papillomavirus
TIIEDGDMV

SEQ ID NO: 28438 - protein, 10 aa, Artificial Sequence
  Peptide Derived from Human Papillomavirus
TLGEAVPDDL

SEQ ID NO: 28439 - protein, 11 aa, Artificial Sequence
  Peptide Derived from Human Papillomavirus
TLGEAVPDDLY

SEQ ID NO: 28440 - protein, 9 aa, Artificial Sequence
  Peptide Derived from Human Papillomavirus
TLQANKSDV

SEQ ID NO: 28441 - protein, 11 aa, Artificial Sequence
  Peptide Derived from Human Papillomavirus
TLQANKSDVPI

SEQ ID NO: 28442 - protein, 9 aa, Artificial Sequence
  Peptide Derived from Human Papillomavirus
TLTAEVMTY

SEQ ID NO: 28443 - protein, 10 aa, Artificial Sequence
  Peptide Derived from Human Papillomavirus
TLTAEVMTYI

SEQ ID NO: 28444 - protein, 8 aa, Artificial Sequence
  Peptide Derived from Human Papillomavirus
TPPPSASL

SEQ ID NO: 28445 - protein, 9 aa, Artificial Sequence
  Peptide Derived from Human Papillomavirus
TQRLVWACV

SEQ ID NO: 28446 - protein, 11 aa, Artificial Sequence
  Peptide Derived from Human Papillomavirus
TQRLVWACVGL

SEQ ID NO: 28447 - protein, 9 aa, Artificial Sequence
  Peptide Derived from Human Papillomavirus
TQVTSDSTY

SEQ ID NO: 28448 - protein, 11 aa, Artificial Sequence
  Peptide Derived from Human Papillomavirus
TVPPKEKEDPL

SEQ ID NO: 28449 - protein, 11 aa, Artificial Sequence
  Peptide Derived from Human Papillomavirus
TVVDTTRSTNM

SEQ ID NO: 28450 - protein, 9 aa, Artificial Sequence
  Peptide Derived from Human Papillomavirus
TVYLPPVPV

SEQ ID NO: 28451 - protein, 8 aa, Artificial Sequence
  Peptide Derived from Human Papillomavirus
VMTYIHAM

SEQ ID NO: 28452 - protein, 9 aa, Artificial Sequence
  Peptide Derived from Human Papillomavirus
VPKVSGLQY

SEQ ID NO: 28453 - protein, 11 aa, Artificial Sequence
  Peptide Derived from Human Papillomavirus
VPKVSGLQYRV

SEQ ID NO: 28454 - protein, 10 aa, Artificial Sequence
  Peptide Derived from Human Papillomavirus
VPPKEKEDPL

SEQ ID NO: 28455 - protein, 10 aa, Artificial Sequence
  Peptide Derived from Human Papillomavirus
VVDTTRSTNM

SEQ ID NO: 28456 - protein, 8 aa, Artificial Sequence
  Peptide Derived from Human Papillomavirus
VVSTDEYV

SEQ ID NO: 28457 - protein, 11 aa, Artificial Sequence
  Peptide Derived from Human Papillomavirus
WQFGLTPPPSA

SEQ ID NO: 28458 - protein, 9 aa, Artificial Sequence
  Peptide Derived from Human Papillomavirus
YIHAMNPDI

SEQ ID NO: 28459 - protein, 10 aa, Artificial Sequence
  Peptide Derived from Human Papillomavirus
YIHAMNPDIL

SEQ ID NO: 28460 - protein, 9 aa, Artificial Sequence
  Peptide Derived from Human Papillomavirus
YIKGSGTTA

SEQ ID NO: 28461 - protein, 11 aa, Artificial Sequence
  Peptide Derived from Human Papillomavirus
YIKGSGTTASI

SEQ ID NO: 28462 - protein, 8 aa, Artificial Sequence
  Peptide Derived from Human Papillomavirus
YIRHVEEY

SEQ ID NO: 28463 - protein, 10 aa, Artificial Sequence
  Peptide Derived from Human Papillomavirus
YIRHVEEYDL

SEQ ID NO: 28464 - protein, 9 aa, Artificial Sequence
  Peptide Derived from Human Papillomavirus
YLKMTSEPY

SEQ ID NO: 28465 - protein, 10 aa, Artificial Sequence
  Peptide Derived from Human Papillomavirus
YLPPVPVSKV

SEQ ID NO: 28466 - protein, 11 aa, Artificial Sequence
  Peptide Derived from Human Papillomavirus
YLPPVPVSKVV

SEQ ID NO: 28467 - protein, 8 aa, Artificial Sequence
  Peptide Derived from Human Papillomavirus
YVSRTSIY

SEQ ID NO: 28468 - protein, 9 aa, Artificial Sequence
  Peptide Derived from Human Papillomavirus
YVSRTSIYY

SEQ ID NO: 28469 - protein, 10 aa, Artificial Sequence
  Peptide Derived from Human Papillomavirus
YVSRTSIYYY

SEQ ID NO: 28470 - protein, 11 aa, Artificial Sequence
  Peptide Derived from Human Papillomavirus
YVSRTSIYYYA

SEQ ID NO: 28471 - protein, 8 aa, Artificial Sequence
  Peptide Derived from Human Papillomavirus
AIINVSSV

SEQ ID NO: 28472 - protein, 11 aa, Artificial Sequence
  Peptide Derived from Human Papillomavirus
AIPLQPIRPPV

SEQ ID NO: 28473 - protein, 9 aa, Artificial Sequence
  Peptide Derived from Human Papillomavirus
AITSRRHTV

SEQ ID NO: 28474 - protein, 11 aa, Artificial Sequence
  Peptide Derived from Human Papillomavirus
AITSRRHTVRF

SEQ ID NO: 28475 - protein, 9 aa, Artificial Sequence
  Peptide Derived from Human Papillomavirus
APAEASGHF

SEQ ID NO: 28476 - protein, 10 aa, Artificial Sequence
  Peptide Derived from Human Papillomavirus
APAEASGHFI

SEQ ID NO: 28477 - protein, 11 aa, Artificial Sequence
  Peptide Derived from Human Papillomavirus
APAEASGHFIF

SEQ ID NO: 28478 - protein, 9 aa, Artificial Sequence
  Peptide Derived from Human Papillomavirus
APDPDFLDI

SEQ ID NO: 28479 - protein, 10 aa, Artificial Sequence
  Peptide Derived from Human Papillomavirus
APDPDFLDII

SEQ ID NO: 28480 - protein, 11 aa, Artificial Sequence
  Peptide Derived from Human Papillomavirus
APDPDFLDIIA

SEQ ID NO: 28481 - protein, 10 aa, Artificial Sequence
  Peptide Derived from Human Papillomavirus
APSIPTPSGF

SEQ ID NO: 28482 - protein, 9 aa, Artificial Sequence
  Peptide Derived from Human Papillomavirus
CPPDVIPKV

SEQ ID NO: 28483 - protein, 9 aa, Artificial Sequence
  Peptide Derived from Human Papillomavirus
DIIALHRPA

SEQ ID NO: 28484 - protein, 10 aa, Artificial Sequence
  Peptide Derived from Human Papillomavirus
DIIALHRPAI

SEQ ID NO: 28485 - protein, 10 aa, Artificial Sequence
  Peptide Derived from Human Papillomavirus
DISPAPDPDF

SEQ ID NO: 28486 - protein, 11 aa, Artificial Sequence
  Peptide Derived from Human Papillomavirus
DISPAPDPDFL

SEQ ID NO: 28487 - protein, 8 aa, Artificial Sequence
  Peptide Derived from Human Papillomavirus
DLSPIVPL

SEQ ID NO: 28488 - protein, 11 aa, Artificial Sequence
  Peptide Derived from Human Papillomavirus
DPAFLTSPHKL

SEQ ID NO: 28489 - protein, 8 aa, Artificial Sequence
  Peptide Derived from Human Papillomavirus
DPDFLDII

SEQ ID NO: 28490 - protein, 9 aa, Artificial Sequence
  Peptide Derived from Human Papillomavirus
DPDFLDIIA

SEQ ID NO: 28491 - protein, 10 aa, Artificial Sequence
  Peptide Derived from Human Papillomavirus
DPDFLDIIAL

SEQ ID NO: 28492 - protein, 8 aa, Artificial Sequence
  Peptide Derived from Human Papillomavirus
DPEDTLQF

SEQ ID NO: 28493 - protein, 9 aa, Artificial Sequence
  Peptide Derived from Human Papillomavirus
DPPTAAIPL

SEQ ID NO: 28494 - protein, 9 aa, Artificial Sequence
  Peptide Derived from Human Papillomavirus
DQILKYGSL

SEQ ID NO: 28495 - protein, 11 aa, Artificial Sequence
  Peptide Derived from Human Papillomavirus
DQILKYGSLGV

SEQ ID NO: 28496 - protein, 9 aa, Artificial Sequence
  Peptide Derived from Human Papillomavirus
DVDNVHTPM

SEQ ID NO: 28497 - protein, 11 aa, Artificial Sequence
  Peptide Derived from Human Papillomavirus
DVIPKVEGSTI

SEQ ID NO: 28498 - protein, 11 aa, Artificial Sequence
  Peptide Derived from Human Papillomavirus
DVTTSADTTPA

SEQ ID NO: 28499 - protein, 10 aa, Artificial Sequence
  Peptide Derived from Human Papillomavirus
DVYADDVDNV

SEQ ID NO: 28500 - protein, 9 aa, Artificial Sequence
  Peptide Derived from Human Papillomavirus
EPSVLHPPA

SEQ ID NO: 28501 - protein, 11 aa, Artificial Sequence
  Peptide Derived from Human Papillomavirus
EPSVLHPPAPA

SEQ ID NO: 28502 - protein, 8 aa, Artificial Sequence
  Peptide Derived from Human Papillomavirus
EQYELQPL

SEQ ID NO: 28503 - protein, 8 aa, Artificial Sequence
  Peptide Derived from Human Papillomavirus
FIEAGAPA

SEQ ID NO: 28504 - protein, 11 aa, Artificial Sequence
  Peptide Derived from Human Papillomavirus
FIEAGAPAPSI

SEQ ID NO: 28505 - protein, 8 aa, Artificial Sequence
  Peptide Derived from Human Papillomavirus
FIFSSPTV

SEQ ID NO: 28506 - protein, 10 aa, Artificial Sequence
  Peptide Derived from Human Papillomavirus
FILRRRRKRF

SEQ ID NO: 28507 - protein, 11 aa, Artificial Sequence
  Peptide Derived from Human Papillomavirus
FLDIIALHRPA

SEQ ID NO: 28508 - protein, 8 aa, Artificial Sequence
  Peptide Derived from Human Papillomavirus
FLTSPHKL

SEQ ID NO: 28509 - protein, 9 aa, Artificial Sequence
  Peptide Derived from Human Papillomavirus
FLTSPHKLI

SEQ ID NO: 28510 - protein, 11 aa, Artificial Sequence
  Peptide Derived from Human Papillomavirus
FLTSPHKLITY

SEQ ID NO: 28511 - protein, 8 aa, Artificial Sequence
  Peptide Derived from Human Papillomavirus
FPFDTIVV

SEQ ID NO: 28512 - protein, 11 aa, Artificial Sequence
  Peptide Derived from Human Papillomavirus
FPFDTIVVDGA

SEQ ID NO: 28513 - protein, 8 aa, Artificial Sequence
  Peptide Derived from Human Papillomavirus
FPTSSPFV

SEQ ID NO: 28514 - protein, 10 aa, Artificial Sequence
  Peptide Derived from Human Papillomavirus
FPTSSPFVPI

SEQ ID NO: 28515 - protein, 8 aa, Artificial Sequence
  Peptide Derived from Human Papillomavirus
FPYFFTDV

SEQ ID NO: 28516 - protein, 10 aa, Artificial Sequence
  Peptide Derived from Human Papillomavirus
FPYFFTDVRV

SEQ ID NO: 28517 - protein, 11 aa, Artificial Sequence
  Peptide Derived from Human Papillomavirus
FPYFFTDVRVA

SEQ ID NO: 28518 - protein, 9 aa, Artificial Sequence
  Peptide Derived from Human Papillomavirus
FQHSDISPA

SEQ ID NO: 28519 - protein, 8 aa, Artificial Sequence
  Peptide Derived from Human Papillomavirus
FVLHPSYF

SEQ ID NO: 28520 - protein, 9 aa, Artificial Sequence
  Peptide Derived from Human Papillomavirus
FVLHPSYFI

SEQ ID NO: 28521 - protein, 10 aa, Artificial Sequence
  Peptide Derived from Human Papillomavirus
FVLHPSYFIL

SEQ ID NO: 28522 - protein, 8 aa, Artificial Sequence
  Peptide Derived from Human Papillomavirus
FVPISPFF

SEQ ID NO: 28523 - protein, 10 aa, Artificial Sequence
  Peptide Derived from Human Papillomavirus
FVPISPFFPF

SEQ ID NO: 28524 - protein, 10 aa, Artificial Sequence
  Peptide Derived from Human Papillomavirus
FVVSTDSSNV

SEQ ID NO: 28525 - protein, 10 aa, Artificial Sequence
  Peptide Derived from Human Papillomavirus
GLYDVYADDV

SEQ ID NO: 28526 - protein, 10 aa, Artificial Sequence
  Peptide Derived from Human Papillomavirus
GLYSRNTQQV

SEQ ID NO: 28527 - protein, 8 aa, Artificial Sequence
  Peptide Derived from Human Papillomavirus
GPDIPSPL

SEQ ID NO: 28528 - protein, 9 aa, Artificial Sequence
  Peptide Derived from Human Papillomavirus
GPDIPSPLF

SEQ ID NO: 28529 - protein, 8 aa, Artificial Sequence
  Peptide Derived from Human Papillomavirus
GPLDSSIV

SEQ ID NO: 28530 - protein, 10 aa, Artificial Sequence
  Peptide Derived from Human Papillomavirus
GPLDSSIVSL

SEQ ID NO: 28531 - protein, 11 aa, Artificial Sequence
  Peptide Derived from Human Papillomavirus
GPLDSSIVSLI

SEQ ID NO: 28532 - protein, 9 aa, Artificial Sequence
  Peptide Derived from Human Papillomavirus
GVFFGGLGI

SEQ ID NO: 28533 - protein, 11 aa, Artificial Sequence
  Peptide Derived from Human Papillomavirus
HLNPTFTEPSV

SEQ ID NO: 28534 - protein, 8 aa, Artificial Sequence
  Peptide Derived from Human Papillomavirus
HPPAPAEA

SEQ ID NO: 28535 - protein, 8 aa, Artificial Sequence
  Peptide Derived from Human Papillomavirus
IIALHRPA

SEQ ID NO: 28536 - protein, 9 aa, Artificial Sequence
  Peptide Derived from Human Papillomavirus
IIALHRPAI

SEQ ID NO: 28537 - protein, 9 aa, Artificial Sequence
  Peptide Derived from Human Papillomavirus
ILKYGSLGV

SEQ ID NO: 28538 - protein, 10 aa, Artificial Sequence
  Peptide Derived from Human Papillomavirus
ILKYGSLGVF

SEQ ID NO: 28539 - protein, 11 aa, Artificial Sequence
  Peptide Derived from Human Papillomavirus
ILKYGSLGVFF

SEQ ID NO: 28540 - protein, 9 aa, Artificial Sequence
  Peptide Derived from Human Papillomavirus
ILRRRRKRF

SEQ ID NO: 28541 - protein, 11 aa, Artificial Sequence
  Peptide Derived from Human Papillomavirus
ILRRRRKRFPY

SEQ ID NO: 28542 - protein, 8 aa, Artificial Sequence
  Peptide Derived from Human Papillomavirus
IPGSRPVA

SEQ ID NO: 28543 - protein, 10 aa, Artificial Sequence
  Peptide Derived from Human Papillomavirus
IPGSRPVARL

SEQ ID NO: 28544 - protein, 9 aa, Artificial Sequence
  Peptide Derived from Human Papillomavirus
IPKVEGSTI

SEQ ID NO: 28545 - protein, 10 aa, Artificial Sequence
  Peptide Derived from Human Papillomavirus
IPKVEGSTIA

SEQ ID NO: 28546 - protein, 11 aa, Artificial Sequence
  Peptide Derived from Human Papillomavirus
IPLNTGFDTPV

SEQ ID NO: 28547 - protein, 10 aa, Artificial Sequence
  Peptide Derived from Human Papillomavirus
IPLQPIRPPV

SEQ ID NO: 28548 - protein, 8 aa, Artificial Sequence
  Peptide Derived from Human Papillomavirus
IPMDTFVV

SEQ ID NO: 28549 - protein, 9 aa, Artificial Sequence
  Peptide Derived from Human Papillomavirus
IPTPSGFDV

SEQ ID NO: 28550 - protein, 8 aa, Artificial Sequence
  Peptide Derived from Human Papillomavirus
IQTISTHL

SEQ ID NO: 28551 - protein, 8 aa, Artificial Sequence
  Peptide Derived from Human Papillomavirus
IVPLDHTV

SEQ ID NO: 28552 - protein, 10 aa, Artificial Sequence
  Peptide Derived from Human Papillomavirus
IVSLIEETSF

SEQ ID NO: 28553 - protein, 11 aa, Artificial Sequence
  Peptide Derived from Human Papillomavirus
IVSLIEETSFI

SEQ ID NO: 28554 - protein, 8 aa, Artificial Sequence
  Peptide Derived from Human Papillomavirus
IVVDGADF

SEQ ID NO: 28555 - protein, 9 aa, Artificial Sequence
  Peptide Derived from Human Papillomavirus
IVVDGADFV

SEQ ID NO: 28556 - protein, 10 aa, Artificial Sequence
  Peptide Derived from Human Papillomavirus
IVVDGADFVL

SEQ ID NO: 28557 - protein, 9 aa, Artificial Sequence
  Peptide Derived from Human Papillomavirus
KLITYDNPA

SEQ ID NO: 28558 - protein, 10 aa, Artificial Sequence
  Peptide Derived from Human Papillomavirus
KLITYDNPAF

SEQ ID NO: 28559 - protein, 9 aa, Artificial Sequence
  Peptide Derived from Human Papillomavirus
KQIGARIHY

SEQ ID NO: 28560 - protein, 10 aa, Artificial Sequence
  Peptide Derived from Human Papillomavirus
KQIGARIHYY

SEQ ID NO: 28561 - protein, 8 aa, Artificial Sequence
  Peptide Derived from Human Papillomavirus
KVEGSTIA

SEQ ID NO: 28562 - protein, 11 aa, Artificial Sequence
  Peptide Derived from Human Papillomavirus
KVEGSTIADQI

SEQ ID NO: 28563 - protein, 8 aa, Artificial Sequence
  Peptide Derived from Human Papillomavirus
KVVDPAFL

SEQ ID NO: 28564 - protein, 8 aa, Artificial Sequence
  Peptide Derived from Human Papillomavirus
LIEETSFI

SEQ ID NO: 28565 - protein, 10 aa, Artificial Sequence
  Peptide Derived from Human Papillomavirus
LIEETSFIEA

SEQ ID NO: 28566 - protein, 8 aa, Artificial Sequence
  Peptide Derived from Human Papillomavirus
LITYDNPA

SEQ ID NO: 28567 - protein, 9 aa, Artificial Sequence
  Peptide Derived from Human Papillomavirus
LITYDNPAF

SEQ ID NO: 28568 - protein, 8 aa, Artificial Sequence
  Peptide Derived from Human Papillomavirus
LQFQHSDI

SEQ ID NO: 28569 - protein, 11 aa, Artificial Sequence
  Peptide Derived from Human Papillomavirus
LQFQHSDISPA

SEQ ID NO: 28570 - protein, 8 aa, Artificial Sequence
  Peptide Derived from Human Papillomavirus
LQPIRPPV

SEQ ID NO: 28571 - protein, 10 aa, Artificial Sequence
  Peptide Derived from Human Papillomavirus
LQPIRPPVTV

SEQ ID NO: 28572 - protein, 8 aa, Artificial Sequence
  Peptide Derived from Human Papillomavirus
MQHSYSTF

SEQ ID NO: 28573 - protein, 9 aa, Artificial Sequence
  Peptide Derived from Human Papillomavirus
MQHSYSTFA

SEQ ID NO: 28574 - protein, 8 aa, Artificial Sequence
  Peptide Derived from Human Papillomavirus
NIPMDTFV

SEQ ID NO: 28575 - protein, 9 aa, Artificial Sequence
  Peptide Derived from Human Papillomavirus
NIPMDTFVV

SEQ ID NO: 28576 - protein, 9 aa, Artificial Sequence
  Peptide Derived from Human Papillomavirus
NPTFTEPSV

SEQ ID NO: 28577 - protein, 10 aa, Artificial Sequence
  Peptide Derived from Human Papillomavirus
NPTFTEPSVL

SEQ ID NO: 28578 - protein, 10 aa, Artificial Sequence
  Peptide Derived from Human Papillomavirus
NVHTPMQHSY

SEQ ID NO: 28579 - protein, 10 aa, Artificial Sequence
  Peptide Derived from Human Papillomavirus
NVSIPLNTGF

SEQ ID NO: 28580 - protein, 10 aa, Artificial Sequence
  Peptide Derived from Human Papillomavirus
NVSSVGESSI

SEQ ID NO: 28581 - protein, 8 aa, Artificial Sequence
  Peptide Derived from Human Papillomavirus
NVTSSTPI

SEQ ID NO: 28582 - protein, 9 aa, Artificial Sequence
  Peptide Derived from Human Papillomavirus
PIGTDPPTA

SEQ ID NO: 28583 - protein, 10 aa, Artificial Sequence
  Peptide Derived from Human Papillomavirus
PIGTDPPTAA

SEQ ID NO: 28584 - protein, 11 aa, Artificial Sequence
  Peptide Derived from Human Papillomavirus
PIGTDPPTAAI

SEQ ID NO: 28585 - protein, 8 aa, Artificial Sequence
  Peptide Derived from Human Papillomavirus
PIPGSRPV

SEQ ID NO: 28586 - protein, 9 aa, Artificial Sequence
  Peptide Derived from Human Papillomavirus
PIPGSRPVA

SEQ ID NO: 28587 - protein, 11 aa, Artificial Sequence
  Peptide Derived from Human Papillomavirus
PIPGSRPVARL

SEQ ID NO: 28588 - protein, 8 aa, Artificial Sequence
  Peptide Derived from Human Papillomavirus
PIRPPVTV

SEQ ID NO: 28589 - protein, 11 aa, Artificial Sequence
  Peptide Derived from Human Papillomavirus
PIRPPVTVDTV

SEQ ID NO: 28590 - protein, 8 aa, Artificial Sequence
  Peptide Derived from Human Papillomavirus
PISPFFPF

SEQ ID NO: 28591 - protein, 11 aa, Artificial Sequence
  Peptide Derived from Human Papillomavirus
PISPFFPFDTI

SEQ ID NO: 28592 - protein, 9 aa, Artificial Sequence
  Peptide Derived from Human Papillomavirus
PIVPLDHTV

SEQ ID NO: 28593 - protein, 11 aa, Artificial Sequence
  Peptide Derived from Human Papillomavirus
PLDHTVPNEQY

SEQ ID NO: 28594 - protein, 9 aa, Artificial Sequence
  Peptide Derived from Human Papillomavirus
PLDSSIVSL

SEQ ID NO: 28595 - protein, 10 aa, Artificial Sequence
  Peptide Derived from Human Papillomavirus
PLDSSIVSLI

SEQ ID NO: 28596 - protein, 9 aa, Artificial Sequence
  Peptide Derived from Human Papillomavirus
PLFPTSSPF

SEQ ID NO: 28597 - protein, 10 aa, Artificial Sequence
  Peptide Derived from Human Papillomavirus
PLFPTSSPFV

SEQ ID NO: 28598 - protein, 10 aa, Artificial Sequence
  Peptide Derived from Human Papillomavirus
PLHDTSTSSY

SEQ ID NO: 28599 - protein, 10 aa, Artificial Sequence
  Peptide Derived from Human Papillomavirus
PLNTGFDTPV

SEQ ID NO: 28600 - protein, 11 aa, Artificial Sequence
  Peptide Derived from Human Papillomavirus
PLNTGFDTPVM

SEQ ID NO: 28601 - protein, 9 aa, Artificial Sequence
  Peptide Derived from Human Papillomavirus
PLQPIRPPV

SEQ ID NO: 28602 - protein, 11 aa, Artificial Sequence
  Peptide Derived from Human Papillomavirus
PLQPIRPPVTV

SEQ ID NO: 28603 - protein, 9 aa, Artificial Sequence
  Peptide Derived from Human Papillomavirus
PMQHSYSTF

SEQ ID NO: 28604 - protein, 10 aa, Artificial Sequence
  Peptide Derived from Human Papillomavirus
PMQHSYSTFA

SEQ ID NO: 28605 - protein, 11 aa, Artificial Sequence
  Peptide Derived from Human Papillomavirus
PPAPAEASGHF

SEQ ID NO: 28606 - protein, 8 aa, Artificial Sequence
  Peptide Derived from Human Papillomavirus
PPDVIPKV

SEQ ID NO: 28607 - protein, 8 aa, Artificial Sequence
  Peptide Derived from Human Papillomavirus
PPTAAIPL

SEQ ID NO: 28608 - protein, 11 aa, Artificial Sequence
  Peptide Derived from Human Papillomavirus
PPTAAIPLQPI

SEQ ID NO: 28609 - protein, 8 aa, Artificial Sequence
  Peptide Derived from Human Papillomavirus
PPVTVDTV

SEQ ID NO: 28610 - protein, 11 aa, Artificial Sequence
  Peptide Derived from Human Papillomavirus
PPVTVDTVGPL

SEQ ID NO: 28611 - protein, 8 aa, Artificial Sequence
  Peptide Derived from Human Papillomavirus
PVARLGLY

SEQ ID NO: 28612 - protein, 8 aa, Artificial Sequence
  Peptide Derived from Human Papillomavirus
PVMSGPDI

SEQ ID NO: 28613 - protein, 10 aa, Artificial Sequence
  Peptide Derived from Human Papillomavirus
PVTVDTVGPL

SEQ ID NO: 28614 - protein, 8 aa, Artificial Sequence
  Peptide Derived from Human Papillomavirus
QIGARIHY

SEQ ID NO: 28615 - protein, 9 aa, Artificial Sequence
  Peptide Derived from Human Papillomavirus
QIGARIHYY

SEQ ID NO: 28616 - protein, 8 aa, Artificial Sequence
  Peptide Derived from Human Papillomavirus
QILKYGSL

SEQ ID NO: 28617 - protein, 10 aa, Artificial Sequence
  Peptide Derived from Human Papillomavirus
QILKYGSLGV

SEQ ID NO: 28618 - protein, 11 aa, Artificial Sequence
  Peptide Derived from Human Papillomavirus
QILKYGSLGVF

SEQ ID NO: 28619 - protein, 8 aa, Artificial Sequence
  Peptide Derived from Human Papillomavirus
QLYQTCKA

SEQ ID NO: 28620 - protein, 9 aa, Artificial Sequence
  Peptide Derived from Human Papillomavirus
QPIRPPVTV

SEQ ID NO: 28621 - protein, 11 aa, Artificial Sequence
  Peptide Derived from Human Papillomavirus
QPLHDTSTSSY

SEQ ID NO: 28622 - protein, 9 aa, Artificial Sequence
  Peptide Derived from Human Papillomavirus
QQVKVVDPA

SEQ ID NO: 28623 - protein, 10 aa, Artificial Sequence
  Peptide Derived from Human Papillomavirus
QQVKVVDPAF

SEQ ID NO: 28624 - protein, 11 aa, Artificial Sequence
  Peptide Derived from Human Papillomavirus
QQVKVVDPAFL

SEQ ID NO: 28625 - protein, 8 aa, Artificial Sequence
  Peptide Derived from Human Papillomavirus
QVKVVDPA

SEQ ID NO: 28626 - protein, 9 aa, Artificial Sequence
  Peptide Derived from Human Papillomavirus
QVKVVDPAF

SEQ ID NO: 28627 - protein, 10 aa, Artificial Sequence
  Peptide Derived from Human Papillomavirus
QVKVVDPAFL

SEQ ID NO: 28628 - protein, 8 aa, Artificial Sequence
  Peptide Derived from Human Papillomavirus
RIHYYQDL

SEQ ID NO: 28629 - protein, 11 aa, Artificial Sequence
  Peptide Derived from Human Papillomavirus
RIHYYQDLSPI

SEQ ID NO: 28630 - protein, 11 aa, Artificial Sequence
  Peptide Derived from Human Papillomavirus
RPAITSRRHTV

SEQ ID NO: 28631 - protein, 9 aa, Artificial Sequence
  Peptide Derived from Human Papillomavirus
RPPVTVDTV

SEQ ID NO: 28632 - protein, 8 aa, Artificial Sequence
  Peptide Derived from Human Papillomavirus
RPVARLGL

SEQ ID NO: 28633 - protein, 9 aa, Artificial Sequence
  Peptide Derived from Human Papillomavirus
RPVARLGLY

SEQ ID NO: 28634 - protein, 8 aa, Artificial Sequence
  Peptide Derived from Human Papillomavirus
RVGQKATL

SEQ ID NO: 28635 - protein, 9 aa, Artificial Sequence
  Peptide Derived from Human Papillomavirus
SINDGLYDV

SEQ ID NO: 28636 - protein, 10 aa, Artificial Sequence
  Peptide Derived from Human Papillomavirus
SINDGLYDVY

SEQ ID NO: 28637 - protein, 11 aa, Artificial Sequence
  Peptide Derived from Human Papillomavirus
SINDGLYDVYA

SEQ ID NO: 28638 - protein, 8 aa, Artificial Sequence
  Peptide Derived from Human Papillomavirus
SIPLNTGF

SEQ ID NO: 28639 - protein, 8 aa, Artificial Sequence
  Peptide Derived from Human Papillomavirus
SIPTPSGF

SEQ ID NO: 28640 - protein, 10 aa, Artificial Sequence
  Peptide Derived from Human Papillomavirus
SIPTPSGFDV

SEQ ID NO: 28641 - protein, 9 aa, Artificial Sequence
  Peptide Derived from Human Papillomavirus
SIQTISTHL

SEQ ID NO: 28642 - protein, 11 aa, Artificial Sequence
  Peptide Derived from Human Papillomavirus
SIVSLIEETSF

SEQ ID NO: 28643 - protein, 9 aa, Artificial Sequence
  Peptide Derived from Human Papillomavirus
SLGVFFGGL

SEQ ID NO: 28644 - protein, 11 aa, Artificial Sequence
  Peptide Derived from Human Papillomavirus
SLGVFFGGLGI

SEQ ID NO: 28645 - protein, 8 aa, Artificial Sequence
  Peptide Derived from Human Papillomavirus
SLIEETSF

SEQ ID NO: 28646 - protein, 9 aa, Artificial Sequence
  Peptide Derived from Human Papillomavirus
SLIEETSFI

SEQ ID NO: 28647 - protein, 11 aa, Artificial Sequence
  Peptide Derived from Human Papillomavirus
SLIEETSFIEA

SEQ ID NO: 28648 - protein, 8 aa, Artificial Sequence
  Peptide Derived from Human Papillomavirus
SPAPDPDF

SEQ ID NO: 28649 - protein, 9 aa, Artificial Sequence
  Peptide Derived from Human Papillomavirus
SPAPDPDFL

SEQ ID NO: 28650 - protein, 11 aa, Artificial Sequence
  Peptide Derived from Human Papillomavirus
SPAPDPDFLDI

SEQ ID NO: 28651 - protein, 9 aa, Artificial Sequence
  Peptide Derived from Human Papillomavirus
SPFFPFDTI

SEQ ID NO: 28652 - protein, 10 aa, Artificial Sequence
  Peptide Derived from Human Papillomavirus
SPFFPFDTIV

SEQ ID NO: 28653 - protein, 11 aa, Artificial Sequence
  Peptide Derived from Human Papillomavirus
SPFFPFDTIVV

SEQ ID NO: 28654 - protein, 9 aa, Artificial Sequence
  Peptide Derived from Human Papillomavirus
SPFVPISPF

SEQ ID NO: 28655 - protein, 10 aa, Artificial Sequence
  Peptide Derived from Human Papillomavirus
SPFVPISPFF

SEQ ID NO: 28656 - protein, 8 aa, Artificial Sequence
  Peptide Derived from Human Papillomavirus
SPHKLITY

SEQ ID NO: 28657 - protein, 10 aa, Artificial Sequence
  Peptide Derived from Human Papillomavirus
SPIVPLDHTV

SEQ ID NO: 28658 - protein, 10 aa, Artificial Sequence
  Peptide Derived from Human Papillomavirus
SPLFPTSSPF

SEQ ID NO: 28659 - protein, 11 aa, Artificial Sequence
  Peptide Derived from Human Papillomavirus
SPLFPTSSPFV

SEQ ID NO: 28660 - protein, 9 aa, Artificial Sequence
  Peptide Derived from Human Papillomavirus
SPTVSTQSY

SEQ ID NO: 28661 - protein, 10 aa, Artificial Sequence
  Peptide Derived from Human Papillomavirus
SVGESSIQTI

SEQ ID NO: 28662 - protein, 9 aa, Artificial Sequence
  Peptide Derived from Human Papillomavirus
SVLHPPAPA

SEQ ID NO: 28663 - protein, 11 aa, Artificial Sequence
  Peptide Derived from Human Papillomavirus
SVLHPPAPAEA

SEQ ID NO: 28664 - protein, 9 aa, Artificial Sequence
  Peptide Derived from Human Papillomavirus
TIADQILKY

SEQ ID NO: 28665 - protein, 10 aa, Artificial Sequence
  Peptide Derived from Human Papillomavirus
TISTHLNPTF

SEQ ID NO: 28666 - protein, 9 aa, Artificial Sequence
  Peptide Derived from Human Papillomavirus
TIVVDGADF

SEQ ID NO: 28667 - protein, 10 aa, Artificial Sequence
  Peptide Derived from Human Papillomavirus
TIVVDGADFV

SEQ ID NO: 28668 - protein, 11 aa, Artificial Sequence
  Peptide Derived from Human Papillomavirus
TIVVDGADFVL

SEQ ID NO: 28669 - protein, 10 aa, Artificial Sequence
  Peptide Derived from Human Papillomavirus
TLKTRSGKQI

SEQ ID NO: 28670 - protein, 9 aa, Artificial Sequence
  Peptide Derived from Human Papillomavirus
TLQFQHSDI

SEQ ID NO: 28671 - protein, 10 aa, Artificial Sequence
  Peptide Derived from Human Papillomavirus
TPAIINVSSV

SEQ ID NO: 28672 - protein, 9 aa, Artificial Sequence
  Peptide Derived from Human Papillomavirus
TPIPGSRPV

SEQ ID NO: 28673 - protein, 10 aa, Artificial Sequence
  Peptide Derived from Human Papillomavirus
TPIPGSRPVA

SEQ ID NO: 28674 - protein, 10 aa, Artificial Sequence
  Peptide Derived from Human Papillomavirus
TPMQHSYSTF

SEQ ID NO: 28675 - protein, 11 aa, Artificial Sequence
  Peptide Derived from Human Papillomavirus
TPMQHSYSTFA

SEQ ID NO: 28676 - protein, 11 aa, Artificial Sequence
  Peptide Derived from Human Papillomavirus
TPSGFDVTTSA

SEQ ID NO: 28677 - protein, 9 aa, Artificial Sequence
  Peptide Derived from Human Papillomavirus
TPVMSGPDI

SEQ ID NO: 28678 - protein, 9 aa, Artificial Sequence
  Peptide Derived from Human Papillomavirus
TQLYQTCKA

SEQ ID NO: 28679 - protein, 10 aa, Artificial Sequence
  Peptide Derived from Human Papillomavirus
TQQVKVVDPA

SEQ ID NO: 28680 - protein, 11 aa, Artificial Sequence
  Peptide Derived from Human Papillomavirus
TQQVKVVDPAF

SEQ ID NO: 28681 - protein, 9 aa, Artificial Sequence
  Peptide Derived from Human Papillomavirus
TQSYENIPM

SEQ ID NO: 28682 - protein, 8 aa, Artificial Sequence
  Peptide Derived from Human Papillomavirus
TVDTVGPL

SEQ ID NO: 28683 - protein, 9 aa, Artificial Sequence
  Peptide Derived from Human Papillomavirus
TVGPLDSSI

SEQ ID NO: 28684 - protein, 10 aa, Artificial Sequence
  Peptide Derived from Human Papillomavirus
TVGPLDSSIV

SEQ ID NO: 28685 - protein, 9 aa, Artificial Sequence
  Peptide Derived from Human Papillomavirus
TVPNEQYEL

SEQ ID NO: 28686 - protein, 11 aa, Artificial Sequence
  Peptide Derived from Human Papillomavirus
TVRFSRVGQKA

SEQ ID NO: 28687 - protein, 10 aa, Artificial Sequence
  Peptide Derived from Human Papillomavirus
TVSTQSYENI

SEQ ID NO: 28688 - protein, 10 aa, Artificial Sequence
  Peptide Derived from Human Papillomavirus
VIPKVEGSTI

SEQ ID NO: 28689 - protein, 11 aa, Artificial Sequence
  Peptide Derived from Human Papillomavirus
VIPKVEGSTIA

SEQ ID NO: 28690 - protein, 8 aa, Artificial Sequence
  Peptide Derived from Human Papillomavirus
VLHPPAPA

SEQ ID NO: 28691 - protein, 10 aa, Artificial Sequence
  Peptide Derived from Human Papillomavirus
VLHPPAPAEA

SEQ ID NO: 28692 - protein, 8 aa, Artificial Sequence
  Peptide Derived from Human Papillomavirus
VLHPSYFI

SEQ ID NO: 28693 - protein, 9 aa, Artificial Sequence
  Peptide Derived from Human Papillomavirus
VLHPSYFIL

SEQ ID NO: 28694 - protein, 11 aa, Artificial Sequence
  Peptide Derived from Human Papillomavirus
VMSGPDIPSPL

SEQ ID NO: 28695 - protein, 10 aa, Artificial Sequence
  Peptide Derived from Human Papillomavirus
VPIGTDPPTA

SEQ ID NO: 28696 - protein, 11 aa, Artificial Sequence
  Peptide Derived from Human Papillomavirus
VPIGTDPPTAA

SEQ ID NO: 28697 - protein, 9 aa, Artificial Sequence
  Peptide Derived from Human Papillomavirus
VPISPFFPF

SEQ ID NO: 28698 - protein, 8 aa, Artificial Sequence
  Peptide Derived from Human Papillomavirus
VPNEQYEL

SEQ ID NO: 28699 - protein, 11 aa, Artificial Sequence
  Peptide Derived from Human Papillomavirus
VPNEQYELQPL

SEQ ID NO: 28700 - protein, 8 aa, Artificial Sequence
  Peptide Derived from Human Papillomavirus
VVDGADFV

SEQ ID NO: 28701 - protein, 9 aa, Artificial Sequence
  Peptide Derived from Human Papillomavirus
VVDGADFVL

SEQ ID NO: 28702 - protein, 9 aa, Artificial Sequence
  Peptide Derived from Human Papillomavirus
VVSTDSSNV

SEQ ID NO: 28703 - protein, 8 aa, Artificial Sequence
  Peptide Derived from Human Papillomavirus
YQDLSPIV

SEQ ID NO: 28704 - protein, 10 aa, Artificial Sequence
  Peptide Derived from Human Papillomavirus
YQDLSPIVPL

SEQ ID NO: 28705 - protein, 11 aa, Artificial Sequence
  Peptide Derived from Human Papillomavirus
YVPIGTDPPTA

SEQ ID NO: 28706 - protein, 9 aa, Artificial Sequence
  Peptide Derived from Human Papillomavirus
AIFGVNPTV

SEQ ID NO: 28707 - protein, 10 aa, Artificial Sequence
  Peptide Derived from Human Papillomavirus
AIFGVNPTVA

SEQ ID NO: 28708 - protein, 9 aa, Artificial Sequence
  Peptide Derived from Human Papillomavirus
ALDGNPISI

SEQ ID NO: 28709 - protein, 8 aa, Artificial Sequence
  Peptide Derived from Human Papillomavirus
ALFHAQEV

SEQ ID NO: 28710 - protein, 9 aa, Artificial Sequence
  Peptide Derived from Human Papillomavirus
ALYWYRTGI

SEQ ID NO: 28711 - protein, 9 aa, Artificial Sequence
  Peptide Derived from Human Papillomavirus
AMLAVFKDI

SEQ ID NO: 28712 - protein, 10 aa, Artificial Sequence
  Peptide Derived from Human Papillomavirus
AMLAVFKDIY

SEQ ID NO: 28713 - protein, 11 aa, Artificial Sequence
  Peptide Derived from Human Papillomavirus
AMLDDATHTCW

SEQ ID NO: 28714 - protein, 10 aa, Artificial Sequence
  Peptide Derived from Human Papillomavirus
AQALFHAQEV

SEQ ID NO: 28715 - protein, 8 aa, Artificial Sequence
  Peptide Derived from Human Papillomavirus
AQEVQNDA

SEQ ID NO: 28716 - protein, 10 aa, Artificial Sequence
  Peptide Derived from Human Papillomavirus
AQEVQNDAQV

SEQ ID NO: 28717 - protein, 11 aa, Artificial Sequence
  Peptide Derived from Human Papillomavirus
AQEVQNDAQVL

SEQ ID NO: 28718 - protein, 8 aa, Artificial Sequence
  Peptide Derived from Human Papillomavirus
AQKRQMNM

SEQ ID NO: 28719 - protein, 11 aa, Artificial Sequence
  Peptide Derived from Human Papillomavirus
AQKRQMNMSQW

SEQ ID NO: 28720 - protein, 10 aa, Artificial Sequence
  Peptide Derived from Human Papillomavirus
AQLADCNSNA

SEQ ID NO: 28721 - protein, 11 aa, Artificial Sequence
  Peptide Derived from Human Papillomavirus
AQLADCNSNAA

SEQ ID NO: 28722 - protein, 11 aa, Artificial Sequence
  Peptide Derived from Human Papillomavirus
AQVLHLLKRKF

SEQ ID NO: 28723 - protein, 9 aa, Artificial Sequence
  Peptide Derived from Human Papillomavirus
AVFKDIYGL

SEQ ID NO: 28724 - protein, 11 aa, Artificial Sequence
  Peptide Derived from Human Papillomavirus
AVFKDIYGLSF

SEQ ID NO: 28725 - protein, 10 aa, Artificial Sequence
  Peptide Derived from Human Papillomavirus
AVMCRHYKRA

SEQ ID NO: 28726 - protein, 8 aa, Artificial Sequence
  Peptide Derived from Human Papillomavirus
CILLYGPA

SEQ ID NO: 28727 - protein, 8 aa, Artificial Sequence
  Peptide Derived from Human Papillomavirus
CLDCKWGV

SEQ ID NO: 28728 - protein, 9 aa, Artificial Sequence
  Peptide Derived from Human Papillomavirus
CLDCKWGVL

SEQ ID NO: 28729 - protein, 10 aa, Artificial Sequence
  Peptide Derived from Human Papillomavirus
CLDCKWGVLI

SEQ ID NO: 28730 - protein, 11 aa, Artificial Sequence
  Peptide Derived from Human Papillomavirus
CLDCKWGVLIL

SEQ ID NO: 28731 - protein, 9 aa, Artificial Sequence
  Peptide Derived from Human Papillomavirus
CMLIEPPKL

SEQ ID NO: 28732 - protein, 10 aa, Artificial Sequence
  Peptide Derived from Human Papillomavirus
CPPILLTSNI

SEQ ID NO: 28733 - protein, 10 aa, Artificial Sequence
  Peptide Derived from Human Papillomavirus
CQAKYLKDCA

SEQ ID NO: 28734 - protein, 11 aa, Artificial Sequence
  Peptide Derived from Human Papillomavirus
CQAKYLKDCAV

SEQ ID NO: 28735 - protein, 10 aa, Artificial Sequence
  Peptide Derived from Human Papillomavirus
CVTGQNTRPL

SEQ ID NO: 28736 - protein, 10 aa, Artificial Sequence
  Peptide Derived from Human Papillomavirus
DIYGLSFTDL

SEQ ID NO: 28737 - protein, 11 aa, Artificial Sequence
  Peptide Derived from Human Papillomavirus
DIYGLSFTDLV

SEQ ID NO: 28738 - protein, 9 aa, Artificial Sequence
  Peptide Derived from Human Papillomavirus
DLHEDDEDA

SEQ ID NO: 28739 - protein, 8 aa, Artificial Sequence
  Peptide Derived from Human Papillomavirus
DLSDMVQW

SEQ ID NO: 28740 - protein, 9 aa, Artificial Sequence
  Peptide Derived from Human Papillomavirus
DLSDMVQWA

SEQ ID NO: 28741 - protein, 10 aa, Artificial Sequence
  Peptide Derived from Human Papillomavirus
DLSDMVQWAF

SEQ ID NO: 28742 - protein, 9 aa, Artificial Sequence
  Peptide Derived from Human Papillomavirus
DLSPRLQEI

SEQ ID NO: 28743 - protein, 11 aa, Artificial Sequence
  Peptide Derived from Human Papillomavirus
DLSPRLQEISL

SEQ ID NO: 28744 - protein, 8 aa, Artificial Sequence
  Peptide Derived from Human Papillomavirus
DLTDESDM

SEQ ID NO: 28745 - protein, 9 aa, Artificial Sequence
  Peptide Derived from Human Papillomavirus
DLTDESDMA

SEQ ID NO: 28746 - protein, 10 aa, Artificial Sequence
  Peptide Derived from Human Papillomavirus
DLTDESDMAF

SEQ ID NO: 28747 - protein, 9 aa, Artificial Sequence
  Peptide Derived from Human Papillomavirus
DMAFQYAQL

SEQ ID NO: 28748 - protein, 10 aa, Artificial Sequence
  Peptide Derived from Human Papillomavirus
DMAFQYAQLA

SEQ ID NO: 28749 - protein, 10 aa, Artificial Sequence
  Peptide Derived from Human Papillomavirus
DMVDFIDTQL

SEQ ID NO: 28750 - protein, 11 aa, Artificial Sequence
  Peptide Derived from Human Papillomavirus
DMVQWAFDNDL

SEQ ID NO: 28751 - protein, 8 aa, Artificial Sequence
  Peptide Derived from Human Papillomavirus
DPAKDNKW

SEQ ID NO: 28752 - protein, 10 aa, Artificial Sequence
  Peptide Derived from Human Papillomavirus
DPAKDNKWPY

SEQ ID NO: 28753 - protein, 11 aa, Artificial Sequence
  Peptide Derived from Human Papillomavirus
DPAKDNKWPYL

SEQ ID NO: 28754 - protein, 9 aa, Artificial Sequence
  Peptide Derived from Human Papillomavirus
DPHCSITEL

SEQ ID NO: 28755 - protein, 11 aa, Artificial Sequence
  Peptide Derived from Human Papillomavirus
DVISDDEDETA

SEQ ID NO: 28756 - protein, 10 aa, Artificial Sequence
  Peptide Derived from Human Papillomavirus
EINDKNWKCF

SEQ ID NO: 28757 - protein, 11 aa, Artificial Sequence
  Peptide Derived from Human Papillomavirus
EINDKNWKCFF

SEQ ID NO: 28758 - protein, 11 aa, Artificial Sequence
  Peptide Derived from Human Papillomavirus
EISLNSGHKKA

SEQ ID NO: 28759 - protein, 8 aa, Artificial Sequence
  Peptide Derived from Human Papillomavirus
ELKELLQA

SEQ ID NO: 28760 - protein, 10 aa, Artificial Sequence
  Peptide Derived from Human Papillomavirus
ELLQASNKKA

SEQ ID NO: 28761 - protein, 11 aa, Artificial Sequence
  Peptide Derived from Human Papillomavirus
ELLQASNKKAA

SEQ ID NO: 28762 - protein, 8 aa, Artificial Sequence
  Peptide Derived from Human Papillomavirus
EPLADTKV

SEQ ID NO: 28763 - protein, 9 aa, Artificial Sequence
  Peptide Derived from Human Papillomavirus
EPLADTKVA

SEQ ID NO: 28764 - protein, 10 aa, Artificial Sequence
  Peptide Derived from Human Papillomavirus
EPLADTKVAM

SEQ ID NO: 28765 - protein, 11 aa, Artificial Sequence
  Peptide Derived from Human Papillomavirus
EPLADTKVAML

SEQ ID NO: 28766 - protein, 9 aa, Artificial Sequence
  Peptide Derived from Human Papillomavirus
EPPKLRSSV

SEQ ID NO: 28767 - protein, 10 aa, Artificial Sequence
  Peptide Derived from Human Papillomavirus
EPPKLRSSVA

SEQ ID NO: 28768 - protein, 11 aa, Artificial Sequence
  Peptide Derived from Human Papillomavirus
EPPKLRSSVAA

SEQ ID NO: 28769 - protein, 8 aa, Artificial Sequence
  Peptide Derived from Human Papillomavirus
EQAEQETA

SEQ ID NO: 28770 - protein, 10 aa, Artificial Sequence
  Peptide Derived from Human Papillomavirus
EQAEQETAQA

SEQ ID NO: 28771 - protein, 11 aa, Artificial Sequence
  Peptide Derived from Human Papillomavirus
EQAEQETAQAL

SEQ ID NO: 28772 - protein, 8 aa, Artificial Sequence
  Peptide Derived from Human Papillomavirus
EQETAQAL

SEQ ID NO: 28773 - protein, 9 aa, Artificial Sequence
  Peptide Derived from Human Papillomavirus
EQETAQALF

SEQ ID NO: 28774 - protein, 11 aa, Artificial Sequence
  Peptide Derived from Human Papillomavirus
EQETAQALFHA

SEQ ID NO: 28775 - protein, 9 aa, Artificial Sequence
  Peptide Derived from Human Papillomavirus
EQLSVDTDL

SEQ ID NO: 28776 - protein, 9 aa, Artificial Sequence
  Peptide Derived from Human Papillomavirus
EVEAAETQV

SEQ ID NO: 28777 - protein, 11 aa, Artificial Sequence
  Peptide Derived from Human Papillomavirus
EVEAAETQVTV

SEQ ID NO: 28778 - protein, 8 aa, Artificial Sequence
  Peptide Derived from Human Papillomavirus
EVQNDAQV

SEQ ID NO: 28779 - protein, 9 aa, Artificial Sequence
  Peptide Derived from Human Papillomavirus
EVQNDAQVL

SEQ ID NO: 28780 - protein, 11 aa, Artificial Sequence
  Peptide Derived from Human Papillomavirus
EVQNDAQVLHL

SEQ ID NO: 28781 - protein, 9 aa, Artificial Sequence
  Peptide Derived from Human Papillomavirus
EVSGDTPEW

SEQ ID NO: 28782 - protein, 10 aa, Artificial Sequence
  Peptide Derived from Human Papillomavirus
EVSGDTPEWI

SEQ ID NO: 28783 - protein, 8 aa, Artificial Sequence
  Peptide Derived from Human Papillomavirus
FIDTQLSI

SEQ ID NO: 28784 - protein, 8 aa, Artificial Sequence
  Peptide Derived from Human Papillomavirus
FIHFLQGA

SEQ ID NO: 28785 - protein, 9 aa, Artificial Sequence
  Peptide Derived from Human Papillomavirus
FIHFLQGAI

SEQ ID NO: 28786 - protein, 10 aa, Artificial Sequence
  Peptide Derived from Human Papillomavirus
FIHFLQGAII

SEQ ID NO: 28787 - protein, 8 aa, Artificial Sequence
  Peptide Derived from Human Papillomavirus
FISFLRAL

SEQ ID NO: 28788 - protein, 11 aa, Artificial Sequence
  Peptide Derived from Human Papillomavirus
FISFLRALKEF

SEQ ID NO: 28789 - protein, 11 aa, Artificial Sequence
  Peptide Derived from Human Papillomavirus
FLKGTPKKNCI

SEQ ID NO: 28790 - protein, 8 aa, Artificial Sequence
  Peptide Derived from Human Papillomavirus
FLKSNCQA

SEQ ID NO: 28791 - protein, 10 aa, Artificial Sequence
  Peptide Derived from Human Papillomavirus
FLKSNCQAKY

SEQ ID NO: 28792 - protein, 11 aa, Artificial Sequence
  Peptide Derived from Human Papillomavirus
FLKSNCQAKYL

SEQ ID NO: 28793 - protein, 9 aa, Artificial Sequence
  Peptide Derived from Human Papillomavirus
FLQGAIISF

SEQ ID NO: 28794 - protein, 10 aa, Artificial Sequence
  Peptide Derived from Human Papillomavirus
FLQGAIISFV

SEQ ID NO: 28795 - protein, 8 aa, Artificial Sequence
  Peptide Derived from Human Papillomavirus
FLRALKEF

SEQ ID NO: 28796 - protein, 9 aa, Artificial Sequence
  Peptide Derived from Human Papillomavirus
FLRALKEFL

SEQ ID NO: 28797 - protein, 9 aa, Artificial Sequence
  Peptide Derived from Human Papillomavirus
FLRYQGVEF

SEQ ID NO: 28798 - protein, 10 aa, Artificial Sequence
  Peptide Derived from Human Papillomavirus
FLRYQGVEFI

SEQ ID NO: 28799 - protein, 10 aa, Artificial Sequence
  Peptide Derived from Human Papillomavirus
FPFDKNGNPV

SEQ ID NO: 28800 - protein, 11 aa, Artificial Sequence
  Peptide Derived from Human Papillomavirus
FPFDKNGNPVY

SEQ ID NO: 28801 - protein, 8 aa, Artificial Sequence
  Peptide Derived from Human Papillomavirus
FVNSNSHF

SEQ ID NO: 28802 - protein, 9 aa, Artificial Sequence
  Peptide Derived from Human Papillomavirus
FVNSNSHFW

SEQ ID NO: 28803 - protein, 10 aa, Artificial Sequence
  Peptide Derived from Human Papillomavirus
FVNSNSHFWL

SEQ ID NO: 28804 - protein, 9 aa, Artificial Sequence
  Peptide Derived from Human Papillomavirus
GIDDSNFDL

SEQ ID NO: 28805 - protein, 10 aa, Artificial Sequence
  Peptide Derived from Human Papillomavirus
GIPFGTFKCV

SEQ ID NO: 28806 - protein, 8 aa, Artificial Sequence
  Peptide Derived from Human Papillomavirus
GISNISEV

SEQ ID NO: 28807 - protein, 8 aa, Artificial Sequence
  Peptide Derived from Human Papillomavirus
GLSFTDLV

SEQ ID NO: 28808 - protein, 11 aa, Artificial Sequence
  Peptide Derived from Human Papillomavirus
GLSFTDLVRNF

SEQ ID NO: 28809 - protein, 8 aa, Artificial Sequence
  Peptide Derived from Human Papillomavirus
GLSTLLHV

SEQ ID NO: 28810 - protein, 8 aa, Artificial Sequence
  Peptide Derived from Human Papillomavirus
GMSFIHFL

SEQ ID NO: 28811 - protein, 11 aa, Artificial Sequence
  Peptide Derived from Human Papillomavirus
GMSFIHFLQGA

SEQ ID NO: 28812 - protein, 9 aa, Artificial Sequence
  Peptide Derived from Human Papillomavirus
GPANTGKSY

SEQ ID NO: 28813 - protein, 10 aa, Artificial Sequence
  Peptide Derived from Human Papillomavirus
GPANTGKSYF

SEQ ID NO: 28814 - protein, 8 aa, Artificial Sequence
  Peptide Derived from Human Papillomavirus
GVEFISFL

SEQ ID NO: 28815 - protein, 10 aa, Artificial Sequence
  Peptide Derived from Human Papillomavirus
GVEFISFLRA

SEQ ID NO: 28816 - protein, 11 aa, Artificial Sequence
  Peptide Derived from Human Papillomavirus
GVEFISFLRAL

SEQ ID NO: 28817 - protein, 8 aa, Artificial Sequence
  Peptide Derived from Human Papillomavirus
GVLILALL

SEQ ID NO: 28818 - protein, 10 aa, Artificial Sequence
  Peptide Derived from Human Papillomavirus
GVLILALLRY

SEQ ID NO: 28819 - protein, 10 aa, Artificial Sequence
  Peptide Derived from Human Papillomavirus
GVNPTVAEGF

SEQ ID NO: 28820 - protein, 9 aa, Artificial Sequence
  Peptide Derived from Human Papillomavirus
HIQCLDCKW

SEQ ID NO: 28821 - protein, 11 aa, Artificial Sequence
  Peptide Derived from Human Papillomavirus
HIQCLDCKWGV

SEQ ID NO: 28822 - protein, 8 aa, Artificial Sequence
  Peptide Derived from Human Papillomavirus
HLLKRKFA

SEQ ID NO: 28823 - protein, 8 aa, Artificial Sequence
  Peptide Derived from Human Papillomavirus
HVPETCML

SEQ ID NO: 28824 - protein, 9 aa, Artificial Sequence
  Peptide Derived from Human Papillomavirus
HVPETCMLI

SEQ ID NO: 28825 - protein, 11 aa, Artificial Sequence
  Peptide Derived from Human Papillomavirus
IIQHGIDDSNF

SEQ ID NO: 28826 - protein, 11 aa, Artificial Sequence
  Peptide Derived from Human Papillomavirus
IISFVNSNSHF

SEQ ID NO: 28827 - protein, 10 aa, Artificial Sequence
  Peptide Derived from Human Papillomavirus
ILLTSNIDPA

SEQ ID NO: 28828 - protein, 9 aa, Artificial Sequence
  Peptide Derived from Human Papillomavirus
IPFGTFKCV

SEQ ID NO: 28829 - protein, 8 aa, Artificial Sequence
  Peptide Derived from Human Papillomavirus
IQCLDCKW

SEQ ID NO: 28830 - protein, 10 aa, Artificial Sequence
  Peptide Derived from Human Papillomavirus
IQCLDCKWGV

SEQ ID NO: 28831 - protein, 11 aa, Artificial Sequence
  Peptide Derived from Human Papillomavirus
IQCLDCKWGVL

SEQ ID NO: 28832 - protein, 10 aa, Artificial Sequence
  Peptide Derived from Human Papillomavirus
IQHGIDDSNF

SEQ ID NO: 28833 - protein, 11 aa, Artificial Sequence
  Peptide Derived from Human Papillomavirus
IQRLTIIQHGI

SEQ ID NO: 28834 - protein, 9 aa, Artificial Sequence
  Peptide Derived from Human Papillomavirus
IVEKKTGDV

SEQ ID NO: 28835 - protein, 10 aa, Artificial Sequence
  Peptide Derived from Human Papillomavirus
IVEKKTGDVI

SEQ ID NO: 28836 - protein, 10 aa, Artificial Sequence
  Peptide Derived from Human Papillomavirus
IVQFLRYQGV

SEQ ID NO: 28837 - protein, 8 aa, Artificial Sequence
  Peptide Derived from Human Papillomavirus
KIDEGGDW

SEQ ID NO: 28838 - protein, 11 aa, Artificial Sequence
  Peptide Derived from Human Papillomavirus
KIDEGGDWRPI

SEQ ID NO: 28839 - protein, 8 aa, Artificial Sequence
  Peptide Derived from Human Papillomavirus
KLRSSVAA

SEQ ID NO: 28840 - protein, 9 aa, Artificial Sequence
  Peptide Derived from Human Papillomavirus
KLRSSVAAL

SEQ ID NO: 28841 - protein, 10 aa, Artificial Sequence
  Peptide Derived from Human Papillomavirus
KLRSSVAALY

SEQ ID NO: 28842 - protein, 11 aa, Artificial Sequence
  Peptide Derived from Human Papillomavirus
KLRSSVAALYW

SEQ ID NO: 28843 - protein, 9 aa, Artificial Sequence
  Peptide Derived from Human Papillomavirus
KPATLYAHI

SEQ ID NO: 28844 - protein, 11 aa, Artificial Sequence
  Peptide Derived from Human Papillomavirus
KPLLQLKCPPI

SEQ ID NO: 28845 - protein, 8 aa, Artificial Sequence
  Peptide Derived from Human Papillomavirus
KVAMLDDA

SEQ ID NO: 28846 - protein, 11 aa, Artificial Sequence
  Peptide Derived from Human Papillomavirus
LIEPPKLRSSV

SEQ ID NO: 28847 - protein, 8 aa, Artificial Sequence
  Peptide Derived from Human Papillomavirus
LIKPATLY

SEQ ID NO: 28848 - protein, 9 aa, Artificial Sequence
  Peptide Derived from Human Papillomavirus
LIKPATLYA

SEQ ID NO: 28849 - protein, 11 aa, Artificial Sequence
  Peptide Derived from Human Papillomavirus
LIKPATLYAHI

SEQ ID NO: 28850 - protein, 8 aa, Artificial Sequence
  Peptide Derived from Human Papillomavirus
LILALLRY

SEQ ID NO: 28851 - protein, 9 aa, Artificial Sequence
  Peptide Derived from Human Papillomavirus
LLHVPETCM

SEQ ID NO: 28852 - protein, 10 aa, Artificial Sequence
  Peptide Derived from Human Papillomavirus
LLHVPETCML

SEQ ID NO: 28853 - protein, 11 aa, Artificial Sequence
  Peptide Derived from Human Papillomavirus
LLHVPETCMLI

SEQ ID NO: 28854 - protein, 9 aa, Artificial Sequence
  Peptide Derived from Human Papillomavirus
LLQASNKKA

SEQ ID NO: 28855 - protein, 10 aa, Artificial Sequence
  Peptide Derived from Human Papillomavirus
LLQASNKKAA

SEQ ID NO: 28856 - protein, 11 aa, Artificial Sequence
  Peptide Derived from Human Papillomavirus
LLQASNKKAAM

SEQ ID NO: 28857 - protein, 9 aa, Artificial Sequence
  Peptide Derived from Human Papillomavirus
LLQLKCPPI

SEQ ID NO: 28858 - protein, 10 aa, Artificial Sequence
  Peptide Derived from Human Papillomavirus
LLQLKCPPIL

SEQ ID NO: 28859 - protein, 11 aa, Artificial Sequence
  Peptide Derived from Human Papillomavirus
LLQLKCPPILL

SEQ ID NO: 28860 - protein, 11 aa, Artificial Sequence
  Peptide Derived from Human Papillomavirus
LLRYKCGKNRL

SEQ ID NO: 28861 - protein, 9 aa, Artificial Sequence
  Peptide Derived from Human Papillomavirus
LLTSNIDPA

SEQ ID NO: 28862 - protein, 8 aa, Artificial Sequence
  Peptide Derived from Human Papillomavirus
LQASNKKA

SEQ ID NO: 28863 - protein, 9 aa, Artificial Sequence
  Peptide Derived from Human Papillomavirus
LQASNKKAA

SEQ ID NO: 28864 - protein, 10 aa, Artificial Sequence
  Peptide Derived from Human Papillomavirus
LQASNKKAAM

SEQ ID NO: 28865 - protein, 11 aa, Artificial Sequence
  Peptide Derived from Human Papillomavirus
LQASNKKAAML

SEQ ID NO: 28866 - protein, 8 aa, Artificial Sequence
  Peptide Derived from Human Papillomavirus
LQGAIISF

SEQ ID NO: 28867 - protein, 9 aa, Artificial Sequence
  Peptide Derived from Human Papillomavirus
LQGAIISFV

SEQ ID NO: 28868 - protein, 8 aa, Artificial Sequence
  Peptide Derived from Human Papillomavirus
LQLKCPPI

SEQ ID NO: 28869 - protein, 9 aa, Artificial Sequence
  Peptide Derived from Human Papillomavirus
LQLKCPPIL

SEQ ID NO: 28870 - protein, 10 aa, Artificial Sequence
  Peptide Derived from Human Papillomavirus
LQLKCPPILL

SEQ ID NO: 28871 - protein, 8 aa, Artificial Sequence
  Peptide Derived from Human Papillomavirus
MLAVFKDI

SEQ ID NO: 28872 - protein, 9 aa, Artificial Sequence
  Peptide Derived from Human Papillomavirus
MLAVFKDIY

SEQ ID NO: 28873 - protein, 11 aa, Artificial Sequence
  Peptide Derived from Human Papillomavirus
MLAVFKDIYGL

SEQ ID NO: 28874 - protein, 10 aa, Artificial Sequence
  Peptide Derived from Human Papillomavirus
MLDDATHTCW

SEQ ID NO: 28875 - protein, 8 aa, Artificial Sequence
  Peptide Derived from Human Papillomavirus
MLIEPPKL

SEQ ID NO: 28876 - protein, 9 aa, Artificial Sequence
  Peptide Derived from Human Papillomavirus
MVDFIDTQL

SEQ ID NO: 28877 - protein, 11 aa, Artificial Sequence
  Peptide Derived from Human Papillomavirus
MVDFIDTQLSI

SEQ ID NO: 28878 - protein, 10 aa, Artificial Sequence
  Peptide Derived from Human Papillomavirus
MVQWAFDNDL

SEQ ID NO: 28879 - protein, 10 aa, Artificial Sequence
  Peptide Derived from Human Papillomavirus
NIDPAKDNKW

SEQ ID NO: 28880 - protein, 8 aa, Artificial Sequence
  Peptide Derived from Human Papillomavirus
NMSQWIKY

SEQ ID NO: 28881 - protein, 8 aa, Artificial Sequence
  Peptide Derived from Human Papillomavirus
NPTVAEGF

SEQ ID NO: 28882 - protein, 11 aa, Artificial Sequence
  Peptide Derived from Human Papillomavirus
NPTVAEGFKTL

SEQ ID NO: 28883 - protein, 11 aa, Artificial Sequence
  Peptide Derived from Human Papillomavirus
NPVYEINDKNW

SEQ ID NO: 28884 - protein, 8 aa, Artificial Sequence
  Peptide Derived from Human Papillomavirus
NVDPHCSI

SEQ ID NO: 28885 - protein, 11 aa, Artificial Sequence
  Peptide Derived from Human Papillomavirus
NVDPHCSITEL

SEQ ID NO: 28886 - protein, 8 aa, Artificial Sequence
  Peptide Derived from Human Papillomavirus
PILLTSNI

SEQ ID NO: 28887 - protein, 11 aa, Artificial Sequence
  Peptide Derived from Human Papillomavirus
PILLTSNIDPA

SEQ ID NO: 28888 - protein, 11 aa, Artificial Sequence
  Peptide Derived from Human Papillomavirus
PISIDRKHKPL

SEQ ID NO: 28889 - protein, 8 aa, Artificial Sequence
  Peptide Derived from Human Papillomavirus
PIVQFLRY

SEQ ID NO: 28890 - protein, 11 aa, Artificial Sequence
  Peptide Derived from Human Papillomavirus
PIVQFLRYQGV

SEQ ID NO: 28891 - protein, 8 aa, Artificial Sequence
  Peptide Derived from Human Papillomavirus
PLADTKVA

SEQ ID NO: 28892 - protein, 9 aa, Artificial Sequence
  Peptide Derived from Human Papillomavirus
PLADTKVAM

SEQ ID NO: 28893 - protein, 10 aa, Artificial Sequence
  Peptide Derived from Human Papillomavirus
PLADTKVAML

SEQ ID NO: 28894 - protein, 8 aa, Artificial Sequence
  Peptide Derived from Human Papillomavirus
PLGEQLSV

SEQ ID NO: 28895 - protein, 10 aa, Artificial Sequence
  Peptide Derived from Human Papillomavirus
PLLQLKCPPI

SEQ ID NO: 28896 - protein, 11 aa, Artificial Sequence
  Peptide Derived from Human Papillomavirus
PLLQLKCPPIL

SEQ ID NO: 28897 - protein, 9 aa, Artificial Sequence
  Peptide Derived from Human Papillomavirus
PPILLTSNI

SEQ ID NO: 28898 - protein, 8 aa, Artificial Sequence
  Peptide Derived from Human Papillomavirus
PPKLRSSV

SEQ ID NO: 28899 - protein, 9 aa, Artificial Sequence
  Peptide Derived from Human Papillomavirus
PPKLRSSVA

SEQ ID NO: 28900 - protein, 10 aa, Artificial Sequence
  Peptide Derived from Human Papillomavirus
PPKLRSSVAA

SEQ ID NO: 28901 - protein, 11 aa, Artificial Sequence
  Peptide Derived from Human Papillomavirus
PPKLRSSVAAL

SEQ ID NO: 28902 - protein, 10 aa, Artificial Sequence
  Peptide Derived from Human Papillomavirus
PVYEINDKNW

SEQ ID NO: 28903 - protein, 9 aa, Artificial Sequence
  Peptide Derived from Human Papillomavirus
QLADCNSNA

SEQ ID NO: 28904 - protein, 10 aa, Artificial Sequence
  Peptide Derived from Human Papillomavirus
QLADCNSNAA

SEQ ID NO: 28905 - protein, 11 aa, Artificial Sequence
  Peptide Derived from Human Papillomavirus
QLADCNSNAAA

SEQ ID NO: 28906 - protein, 8 aa, Artificial Sequence
  Peptide Derived from Human Papillomavirus
QLKCPPIL

SEQ ID NO: 28907 - protein, 9 aa, Artificial Sequence
  Peptide Derived from Human Papillomavirus
QLKCPPILL

SEQ ID NO: 28908 - protein, 8 aa, Artificial Sequence
  Peptide Derived from Human Papillomavirus
QLSICEQA

SEQ ID NO: 28909 - protein, 8 aa, Artificial Sequence
  Peptide Derived from Human Papillomavirus
QLSVDTDL

SEQ ID NO: 28910 - protein, 8 aa, Artificial Sequence
  Peptide Derived from Human Papillomavirus
QMNMSQWI

SEQ ID NO: 28911 - protein, 10 aa, Artificial Sequence
  Peptide Derived from Human Papillomavirus
QMNMSQWIKY

SEQ ID NO: 28912 - protein, 10 aa, Artificial Sequence
  Peptide Derived from Human Papillomavirus
QVLHLLKRKF

SEQ ID NO: 28913 - protein, 11 aa, Artificial Sequence
  Peptide Derived from Human Papillomavirus
QVLHLLKRKFA

SEQ ID NO: 28914 - protein, 8 aa, Artificial Sequence
  Peptide Derived from Human Papillomavirus
QVTVNTNA

SEQ ID NO: 28915 - protein, 11 aa, Artificial Sequence
  Peptide Derived from Human Papillomavirus
RLDLHEDDEDA

SEQ ID NO: 28916 - protein, 10 aa, Artificial Sequence
  Peptide Derived from Human Papillomavirus
RLFTISDSGY

SEQ ID NO: 28917 - protein, 9 aa, Artificial Sequence
  Peptide Derived from Human Papillomavirus
RLTIIQHGI

SEQ ID NO: 28918 - protein, 8 aa, Artificial Sequence
  Peptide Derived from Human Papillomavirus
RLTVAKGL

SEQ ID NO: 28919 - protein, 11 aa, Artificial Sequence
  Peptide Derived from Human Papillomavirus
RLTVAKGLSTL

SEQ ID NO: 28920 - protein, 9 aa, Artificial Sequence
  Peptide Derived from Human Papillomavirus
RPIVQFLRY

SEQ ID NO: 28921 - protein, 8 aa, Artificial Sequence
  Peptide Derived from Human Papillomavirus
RQMNMSQW

SEQ ID NO: 28922 - protein, 9 aa, Artificial Sequence
  Peptide Derived from Human Papillomavirus
RQMNMSQWI

SEQ ID NO: 28923 - protein, 11 aa, Artificial Sequence
  Peptide Derived from Human Papillomavirus
RQMNMSQWIKY

SEQ ID NO: 28924 - protein, 10 aa, Artificial Sequence
  Peptide Derived from Human Papillomavirus
RVTVFTFPHA

SEQ ID NO: 28925 - protein, 11 aa, Artificial Sequence
  Peptide Derived from Human Papillomavirus
RVTVFTFPHAF

SEQ ID NO: 28926 - protein, 11 aa, Artificial Sequence
  Peptide Derived from Human Papillomavirus
SICEQAEQETA

SEQ ID NO: 28927 - protein, 9 aa, Artificial Sequence
  Peptide Derived from Human Papillomavirus
SIDRKHKPL

SEQ ID NO: 28928 - protein, 10 aa, Artificial Sequence
  Peptide Derived from Human Papillomavirus
SIDRKHKPLL

SEQ ID NO: 28929 - protein, 8 aa, Artificial Sequence
  Peptide Derived from Human Papillomavirus
SITELKEL

SEQ ID NO: 28930 - protein, 9 aa, Artificial Sequence
  Peptide Derived from Human Papillomavirus
SITELKELL

SEQ ID NO: 28931 - protein, 11 aa, Artificial Sequence
  Peptide Derived from Human Papillomavirus
SITELKELLQA

SEQ ID NO: 28932 - protein, 9 aa, Artificial Sequence
  Peptide Derived from Human Papillomavirus
SLNSGHKKA

SEQ ID NO: 28933 - protein, 9 aa, Artificial Sequence
  Peptide Derived from Human Papillomavirus
SPLGEQLSV

SEQ ID NO: 28934 - protein, 9 aa, Artificial Sequence
  Peptide Derived from Human Papillomavirus
SPRLQEISL

SEQ ID NO: 28935 - protein, 11 aa, Artificial Sequence
  Peptide Derived from Human Papillomavirus
SQWIKYRCSKI

SEQ ID NO: 28936 - protein, 8 aa, Artificial Sequence
  Peptide Derived from Human Papillomavirus
SVAALYWY

SEQ ID NO: 28937 - protein, 10 aa, Artificial Sequence
  Peptide Derived from Human Papillomavirus
SVDTDLSPRL

SEQ ID NO: 28938 - protein, 10 aa, Artificial Sequence
  Peptide Derived from Human Papillomavirus
TIVEKKTGDV

SEQ ID NO: 28939 - protein, 11 aa, Artificial Sequence
  Peptide Derived from Human Papillomavirus
TIVEKKTGDVI

SEQ ID NO: 28940 - protein, 8 aa, Artificial Sequence
  Peptide Derived from Human Papillomavirus
TLIKPATL

SEQ ID NO: 28941 - protein, 9 aa, Artificial Sequence
  Peptide Derived from Human Papillomavirus
TLIKPATLY

SEQ ID NO: 28942 - protein, 10 aa, Artificial Sequence
  Peptide Derived from Human Papillomavirus
TLIKPATLYA

SEQ ID NO: 28943 - protein, 10 aa, Artificial Sequence
  Peptide Derived from Human Papillomavirus
TLLHVPETCM

SEQ ID NO: 28944 - protein, 11 aa, Artificial Sequence
  Peptide Derived from Human Papillomavirus
TLLHVPETCML

SEQ ID NO: 28945 - protein, 9 aa, Artificial Sequence
  Peptide Derived from Human Papillomavirus
TLYAHIQCL

SEQ ID NO: 28946 - protein, 8 aa, Artificial Sequence
  Peptide Derived from Human Papillomavirus
TPEWIQRL

SEQ ID NO: 28947 - protein, 10 aa, Artificial Sequence
  Peptide Derived from Human Papillomavirus
TPEWIQRLTI

SEQ ID NO: 28948 - protein, 11 aa, Artificial Sequence
  Peptide Derived from Human Papillomavirus
TPEWIQRLTII

SEQ ID NO: 28949 - protein, 8 aa, Artificial Sequence
  Peptide Derived from Human Papillomavirus
TPKKNCIL

SEQ ID NO: 28950 - protein, 9 aa, Artificial Sequence
  Peptide Derived from Human Papillomavirus
TPKKNCILL

SEQ ID NO: 28951 - protein, 10 aa, Artificial Sequence
  Peptide Derived from Human Papillomavirus
TPKKNCILLY

SEQ ID NO: 28952 - protein, 9 aa, Artificial Sequence
  Peptide Derived from Human Papillomavirus
TQLSICEQA

SEQ ID NO: 28953 - protein, 9 aa, Artificial Sequence
  Peptide Derived from Human Papillomavirus
TQVTVNTNA

SEQ ID NO: 28954 - protein, 9 aa, Artificial Sequence
  Peptide Derived from Human Papillomavirus
TVAEGFKTL

SEQ ID NO: 28955 - protein, 10 aa, Artificial Sequence
  Peptide Derived from Human Papillomavirus
TVAEGFKTLI

SEQ ID NO: 28956 - protein, 9 aa, Artificial Sequence
  Peptide Derived from Human Papillomavirus
TVAKGLSTL

SEQ ID NO: 28957 - protein, 10 aa, Artificial Sequence
  Peptide Derived from Human Papillomavirus
TVAKGLSTLL

SEQ ID NO: 28958 - protein, 8 aa, Artificial Sequence
  Peptide Derived from Human Papillomavirus
TVFTFPHA

SEQ ID NO: 28959 - protein, 9 aa, Artificial Sequence
  Peptide Derived from Human Papillomavirus
TVFTFPHAF

SEQ ID NO: 28960 - protein, 11 aa, Artificial Sequence
  Peptide Derived from Human Papillomavirus
TVFTFPHAFPF

SEQ ID NO: 28961 - protein, 10 aa, Artificial Sequence
  Peptide Derived from Human Papillomavirus
VISDDEDETA

SEQ ID NO: 28962 - protein, 9 aa, Artificial Sequence
  Peptide Derived from Human Papillomavirus
VLHLLKRKF

SEQ ID NO: 28963 - protein, 10 aa, Artificial Sequence
  Peptide Derived from Human Papillomavirus
VLHLLKRKFA

SEQ ID NO: 28964 - protein, 9 aa, Artificial Sequence
  Peptide Derived from Human Papillomavirus
VLILALLRY

SEQ ID NO: 28965 - protein, 11 aa, Artificial Sequence
  Peptide Derived from Human Papillomavirus
VMAIFGVNPTV

SEQ ID NO: 28966 - protein, 9 aa, Artificial Sequence
  Peptide Derived from Human Papillomavirus
VMCRHYKRA

SEQ ID NO: 28967 - protein, 8 aa, Artificial Sequence
  Peptide Derived from Human Papillomavirus
VPETCMLI

SEQ ID NO: 28968 - protein, 9 aa, Artificial Sequence
  Peptide Derived from Human Papillomavirus
VQFLRYQGV

SEQ ID NO: 28969 - protein, 11 aa, Artificial Sequence
  Peptide Derived from Human Papillomavirus
VQFLRYQGVEF

SEQ ID NO: 28970 - protein, 8 aa, Artificial Sequence
  Peptide Derived from Human Papillomavirus
VQNDAQVL

SEQ ID NO: 28971 - protein, 10 aa, Artificial Sequence
  Peptide Derived from Human Papillomavirus
VQNDAQVLHL

SEQ ID NO: 28972 - protein, 11 aa, Artificial Sequence
  Peptide Derived from Human Papillomavirus
VQNDAQVLHLL

SEQ ID NO: 28973 - protein, 9 aa, Artificial Sequence
  Peptide Derived from Human Papillomavirus
VQWAFDNDL

SEQ ID NO: 28974 - protein, 9 aa, Artificial Sequence
  Peptide Derived from Human Papillomavirus
WIKYRCSKI

SEQ ID NO: 28975 - protein, 8 aa, Artificial Sequence
  Peptide Derived from Human Papillomavirus
WIQRLTII

SEQ ID NO: 28976 - protein, 10 aa, Artificial Sequence
  Peptide Derived from Human Papillomavirus
WLEPLADTKV

SEQ ID NO: 28977 - protein, 11 aa, Artificial Sequence
  Peptide Derived from Human Papillomavirus
WLEPLADTKVA

SEQ ID NO: 28978 - protein, 8 aa, Artificial Sequence
  Peptide Derived from Human Papillomavirus
WPYLESRV

SEQ ID NO: 28979 - protein, 10 aa, Artificial Sequence
  Peptide Derived from Human Papillomavirus
WPYLESRVTV

SEQ ID NO: 28980 - protein, 11 aa, Artificial Sequence
  Peptide Derived from Human Papillomavirus
WPYLESRVTVF

SEQ ID NO: 28981 - protein, 8 aa, Artificial Sequence
  Peptide Derived from Human Papillomavirus
WVMAIFGV

SEQ ID NO: 28982 - protein, 8 aa, Artificial Sequence
  Peptide Derived from Human Papillomavirus
YLESRVTV

SEQ ID NO: 28983 - protein, 9 aa, Artificial Sequence
  Peptide Derived from Human Papillomavirus
YLESRVTVF

SEQ ID NO: 28984 - protein, 11 aa, Artificial Sequence
  Peptide Derived from Human Papillomavirus
YLESRVTVFTF

SEQ ID NO: 28985 - protein, 8 aa, Artificial Sequence
  Peptide Derived from Human Papillomavirus
YLKDCAVM

SEQ ID NO: 28986 - protein, 11 aa, Artificial Sequence
  Peptide Derived from Human Papillomavirus
YMRNALDGNPI

SEQ ID NO: 28987 - protein, 9 aa, Artificial Sequence
  Peptide Derived from Human Papillomavirus
YQGVEFISF

SEQ ID NO: 28988 - protein, 10 aa, Artificial Sequence
  Peptide Derived from Human Papillomavirus
YQGVEFISFL

SEQ ID NO: 28989 - protein, 8 aa, Artificial Sequence
  Peptide Derived from Human Papillomavirus
AIELQMAL

SEQ ID NO: 28990 - protein, 11 aa, Artificial Sequence
  Peptide Derived from Human Papillomavirus
AIELQMALKGL

SEQ ID NO: 28991 - protein, 11 aa, Artificial Sequence
  Peptide Derived from Human Papillomavirus
AILFTAREHGI

SEQ ID NO: 28992 - protein, 10 aa, Artificial Sequence
  Peptide Derived from Human Papillomavirus
ALKGLAQSKY

SEQ ID NO: 28993 - protein, 10 aa, Artificial Sequence
  Peptide Derived from Human Papillomavirus
ALQDKILDHY

SEQ ID NO: 28994 - protein, 10 aa, Artificial Sequence
  Peptide Derived from Human Papillomavirus
AQSKYNNEEW

SEQ ID NO: 28995 - protein, 9 aa, Artificial Sequence
  Peptide Derived from Human Papillomavirus
CLRYRLRKY

SEQ ID NO: 28996 - protein, 10 aa, Artificial Sequence
  Peptide Derived from Human Papillomavirus
CLRYRLRKYA

SEQ ID NO: 28997 - protein, 10 aa, Artificial Sequence
  Peptide Derived from Human Papillomavirus
CMNYVVWDSI

SEQ ID NO: 28998 - protein, 11 aa, Artificial Sequence
  Peptide Derived from Human Papillomavirus
CMNYVVWDSIY

SEQ ID NO: 28999 - protein, 8 aa, Artificial Sequence
  Peptide Derived from Human Papillomavirus
CVSYWGVY

SEQ ID NO: 29000 - protein, 9 aa, Artificial Sequence
  Peptide Derived from Human Papillomavirus
CVSYWGVYY

SEQ ID NO: 29001 - protein, 10 aa, Artificial Sequence
  Peptide Derived from Human Papillomavirus
CVSYWGVYYI

SEQ ID NO: 29002 - protein, 8 aa, Artificial Sequence
  Peptide Derived from Human Papillomavirus
DINSQISY

SEQ ID NO: 29003 - protein, 9 aa, Artificial Sequence
  Peptide Derived from Human Papillomavirus
DINSQISYW

SEQ ID NO: 29004 - protein, 11 aa, Artificial Sequence
  Peptide Derived from Human Papillomavirus
DINSQISYWQL

SEQ ID NO: 29005 - protein, 9 aa, Artificial Sequence
  Peptide Derived from Human Papillomavirus
DVVTIPNSV

SEQ ID NO: 29006 - protein, 11 aa, Artificial Sequence
  Peptide Derived from Human Papillomavirus
DVVTIPNSVQI

SEQ ID NO: 29007 - protein, 8 aa, Artificial Sequence
  Peptide Derived from Human Papillomavirus
EISSTWHW

SEQ ID NO: 29008 - protein, 9 aa, Artificial Sequence
  Peptide Derived from Human Papillomavirus
ELQMALKGL

SEQ ID NO: 29009 - protein, 10 aa, Artificial Sequence
  Peptide Derived from Human Papillomavirus
ELQMALKGLA

SEQ ID NO: 29010 - protein, 11 aa, Artificial Sequence
  Peptide Derived from Human Papillomavirus
ELWNTEPSQCF

SEQ ID NO: 29011 - protein, 11 aa, Artificial Sequence
  Peptide Derived from Human Papillomavirus
EQHHGRVNTHV

SEQ ID NO: 29012 - protein, 8 aa, Artificial Sequence
  Peptide Derived from Human Papillomavirus
EVQRNTFL

SEQ ID NO: 29013 - protein, 10 aa, Artificial Sequence
  Peptide Derived from Human Papillomavirus
EVQRNTFLDV

SEQ ID NO: 29014 - protein, 11 aa, Artificial Sequence
  Peptide Derived from Human Papillomavirus
EVQRNTFLDVV

SEQ ID NO: 29015 - protein, 8 aa, Artificial Sequence
  Peptide Derived from Human Papillomavirus
EVQYGGNV

SEQ ID NO: 29016 - protein, 9 aa, Artificial Sequence
  Peptide Derived from Human Papillomavirus
EVQYGGNVI

SEQ ID NO: 29017 - protein, 11 aa, Artificial Sequence
  Peptide Derived from Human Papillomavirus
FLDVVTIPNSV

SEQ ID NO: 29018 - protein, 11 aa, Artificial Sequence
  Peptide Derived from Human Papillomavirus
GILTVTYNSEV

SEQ ID NO: 29019 - protein, 9 aa, Artificial Sequence
  Peptide Derived from Human Papillomavirus
GITKLNHQV

SEQ ID NO: 29020 - protein, 10 aa, Artificial Sequence
  Peptide Derived from Human Papillomavirus
GITKLNHQVV

SEQ ID NO: 29021 - protein, 8 aa, Artificial Sequence
  Peptide Derived from Human Papillomavirus
GIWDKTAA

SEQ ID NO: 29022 - protein, 10 aa, Artificial Sequence
  Peptide Derived from Human Papillomavirus
GIWDKTAACV

SEQ ID NO: 29023 - protein, 10 aa, Artificial Sequence
  Peptide Derived from Human Papillomavirus
GLTEQHHGRV

SEQ ID NO: 29024 - protein, 9 aa, Artificial Sequence
  Peptide Derived from Human Papillomavirus
HLKGDKNSL

SEQ ID NO: 29025 - protein, 9 aa, Artificial Sequence
  Peptide Derived from Human Papillomavirus
HQVVPPINI

SEQ ID NO: 29026 - protein, 11 aa, Artificial Sequence
  Peptide Derived from Human Papillomavirus
IIHLKGDKNSL

SEQ ID NO: 29027 - protein, 10 aa, Artificial Sequence
  Peptide Derived from Human Papillomavirus
ILFTAREHGI

SEQ ID NO: 29028 - protein, 10 aa, Artificial Sequence
  Peptide Derived from Human Papillomavirus
ILTVTYNSEV

SEQ ID NO: 29029 - protein, 9 aa, Artificial Sequence
  Peptide Derived from Human Papillomavirus
IPNSVQISV

SEQ ID NO: 29030 - protein, 11 aa, Artificial Sequence
  Peptide Derived from Human Papillomavirus
IPNSVQISVGY

SEQ ID NO: 29031 - protein, 8 aa, Artificial Sequence
  Peptide Derived from Human Papillomavirus
IVRQLQHA

SEQ ID NO: 29032 - protein, 10 aa, Artificial Sequence
  Peptide Derived from Human Papillomavirus
KLNHQVVPPI

SEQ ID NO: 29033 - protein, 9 aa, Artificial Sequence
  Peptide Derived from Human Papillomavirus
KMQTPKESL

SEQ ID NO: 29034 - protein, 8 aa, Artificial Sequence
  Peptide Derived from Human Papillomavirus
KPHIQTPA

SEQ ID NO: 29035 - protein, 10 aa, Artificial Sequence
  Peptide Derived from Human Papillomavirus
KVCSGNTTPI

SEQ ID NO: 29036 - protein, 11 aa, Artificial Sequence
  Peptide Derived from Human Papillomavirus
KVCSGNTTPII

SEQ ID NO: 29037 - protein, 8 aa, Artificial Sequence
  Peptide Derived from Human Papillomavirus
LIRLENAI

SEQ ID NO: 29038 - protein, 9 aa, Artificial Sequence
  Peptide Derived from Human Papillomavirus
LIRLENAIL

SEQ ID NO: 29039 - protein, 10 aa, Artificial Sequence
  Peptide Derived from Human Papillomavirus
LIRLENAILF

SEQ ID NO: 29040 - protein, 9 aa, Artificial Sequence
  Peptide Derived from Human Papillomavirus
LQDKILDHY

SEQ ID NO: 29041 - protein, 8 aa, Artificial Sequence
  Peptide Derived from Human Papillomavirus
LQDTCEEL

SEQ ID NO: 29042 - protein, 9 aa, Artificial Sequence
  Peptide Derived from Human Papillomavirus
LQDTCEELW

SEQ ID NO: 29043 - protein, 8 aa, Artificial Sequence
  Peptide Derived from Human Papillomavirus
LQMALKGL

SEQ ID NO: 29044 - protein, 9 aa, Artificial Sequence
  Peptide Derived from Human Papillomavirus
LQMALKGLA

SEQ ID NO: 29045 - protein, 8 aa, Artificial Sequence
  Peptide Derived from Human Papillomavirus
MQTPKESL

SEQ ID NO: 29046 - protein, 10 aa, Artificial Sequence
  Peptide Derived from Human Papillomavirus
NISKSKAHKA

SEQ ID NO: 29047 - protein, 11 aa, Artificial Sequence
  Peptide Derived from Human Papillomavirus
NISKSKAHKAI

SEQ ID NO: 29048 - protein, 9 aa, Artificial Sequence
  Peptide Derived from Human Papillomavirus
NVIDCNDSM

SEQ ID NO: 29049 - protein, 9 aa, Artificial Sequence
  Peptide Derived from Human Papillomavirus
PINISKSKA

SEQ ID NO: 29050 - protein, 10 aa, Artificial Sequence
  Peptide Derived from Human Papillomavirus
PPINISKSKA

SEQ ID NO: 29051 - protein, 9 aa, Artificial Sequence
  Peptide Derived from Human Papillomavirus
QISVGYMTI

SEQ ID NO: 29052 - protein, 8 aa, Artificial Sequence
  Peptide Derived from Human Papillomavirus
QISYWQLI

SEQ ID NO: 29053 - protein, 10 aa, Artificial Sequence
  Peptide Derived from Human Papillomavirus
QISYWQLIRL

SEQ ID NO: 29054 - protein, 9 aa, Artificial Sequence
  Peptide Derived from Human Papillomavirus
QIVRQLQHA

SEQ ID NO: 29055 - protein, 8 aa, Artificial Sequence
  Peptide Derived from Human Papillomavirus
QLIRLENA

SEQ ID NO: 29056 - protein, 9 aa, Artificial Sequence
  Peptide Derived from Human Papillomavirus
QLIRLENAI

SEQ ID NO: 29057 - protein, 10 aa, Artificial Sequence
  Peptide Derived from Human Papillomavirus
QLIRLENAIL

SEQ ID NO: 29058 - protein, 11 aa, Artificial Sequence
  Peptide Derived from Human Papillomavirus
QLIRLENAILF

SEQ ID NO: 29059 - protein, 8 aa, Artificial Sequence
  Peptide Derived from Human Papillomavirus
QMALKGLA

SEQ ID NO: 29060 - protein, 8 aa, Artificial Sequence
  Peptide Derived from Human Papillomavirus
QVVPPINI

SEQ ID NO: 29061 - protein, 8 aa, Artificial Sequence
  Peptide Derived from Human Papillomavirus
RLENAILF

SEQ ID NO: 29062 - protein, 10 aa, Artificial Sequence
  Peptide Derived from Human Papillomavirus
RLENAILFTA

SEQ ID NO: 29063 - protein, 9 aa, Artificial Sequence
  Peptide Derived from Human Papillomavirus
RLRKYADHY

SEQ ID NO: 29064 - protein, 9 aa, Artificial Sequence
  Peptide Derived from Human Papillomavirus
RLSALQDKI

SEQ ID NO: 29065 - protein, 10 aa, Artificial Sequence
  Peptide Derived from Human Papillomavirus
RLSALQDKIL

SEQ ID NO: 29066 - protein, 10 aa, Artificial Sequence
  Peptide Derived from Human Papillomavirus
RVNTHVHNPL

SEQ ID NO: 29067 - protein, 11 aa, Artificial Sequence
  Peptide Derived from Human Papillomavirus
RVNTHVHNPLL

SEQ ID NO: 29068 - protein, 10 aa, Artificial Sequence
  Peptide Derived from Human Papillomavirus
SIYYITETGI

SEQ ID NO: 29069 - protein, 11 aa, Artificial Sequence
  Peptide Derived from Human Papillomavirus
SIYYITETGIW

SEQ ID NO: 29070 - protein, 9 aa, Artificial Sequence
  Peptide Derived from Human Papillomavirus
SLKCLRYRL

SEQ ID NO: 29071 - protein, 8 aa, Artificial Sequence
  Peptide Derived from Human Papillomavirus
SLSERLSA

SEQ ID NO: 29072 - protein, 9 aa, Artificial Sequence
  Peptide Derived from Human Papillomavirus
SLSERLSAL

SEQ ID NO: 29073 - protein, 10 aa, Artificial Sequence
  Peptide Derived from Human Papillomavirus
SMCSTSDDTV

SEQ ID NO: 29074 - protein, 11 aa, Artificial Sequence
  Peptide Derived from Human Papillomavirus
SQCFKKGGKTV

SEQ ID NO: 29075 - protein, 8 aa, Artificial Sequence
  Peptide Derived from Human Papillomavirus
SQISYWQL

SEQ ID NO: 29076 - protein, 9 aa, Artificial Sequence
  Peptide Derived from Human Papillomavirus
SQISYWQLI

SEQ ID NO: 29077 - protein, 11 aa, Artificial Sequence
  Peptide Derived from Human Papillomavirus
SQISYWQLIRL

SEQ ID NO: 29078 - protein, 9 aa, Artificial Sequence
  Peptide Derived from Human Papillomavirus
SVGTPKPHI

SEQ ID NO: 29079 - protein, 8 aa, Artificial Sequence
  Peptide Derived from Human Papillomavirus
SVQISVGY

SEQ ID NO: 29080 - protein, 9 aa, Artificial Sequence
  Peptide Derived from Human Papillomavirus
SVQISVGYM

SEQ ID NO: 29081 - protein, 11 aa, Artificial Sequence
  Peptide Derived from Human Papillomavirus
SVQISVGYMTI

SEQ ID NO: 29082 - protein, 8 aa, Artificial Sequence
  Peptide Derived from Human Papillomavirus
TIPNSVQI

SEQ ID NO: 29083 - protein, 10 aa, Artificial Sequence
  Peptide Derived from Human Papillomavirus
TIPNSVQISV

SEQ ID NO: 29084 - protein, 9 aa, Artificial Sequence
  Peptide Derived from Human Papillomavirus
TLQDTCEEL

SEQ ID NO: 29085 - protein, 10 aa, Artificial Sequence
  Peptide Derived from Human Papillomavirus
TLQDTCEELW

SEQ ID NO: 29086 - protein, 10 aa, Artificial Sequence
  Peptide Derived from Human Papillomavirus
TPKESLSERL

SEQ ID NO: 29087 - protein, 10 aa, Artificial Sequence
  Peptide Derived from Human Papillomavirus
TPKPHIQTPA

SEQ ID NO: 29088 - protein, 10 aa, Artificial Sequence
  Peptide Derived from Human Papillomavirus
TQIVRQLQHA

SEQ ID NO: 29089 - protein, 8 aa, Artificial Sequence
  Peptide Derived from Human Papillomavirus
TVSATQIV

SEQ ID NO: 29090 - protein, 11 aa, Artificial Sequence
  Peptide Derived from Human Papillomavirus
TVSATQIVRQL

SEQ ID NO: 29091 - protein, 8 aa, Artificial Sequence
  Peptide Derived from Human Papillomavirus
TVTYNSEV

SEQ ID NO: 29092 - protein, 8 aa, Artificial Sequence
  Peptide Derived from Human Papillomavirus
VIDCNDSM

SEQ ID NO: 29093 - protein, 11 aa, Artificial Sequence
  Peptide Derived from Human Papillomavirus
VPPINISKSKA

SEQ ID NO: 29094 - protein, 10 aa, Artificial Sequence
  Peptide Derived from Human Papillomavirus
VQFKSECEKY

SEQ ID NO: 29095 - protein, 8 aa, Artificial Sequence
  Peptide Derived from Human Papillomavirus
VQISVGYM

SEQ ID NO: 29096 - protein, 10 aa, Artificial Sequence
  Peptide Derived from Human Papillomavirus
VQISVGYMTI

SEQ ID NO: 29097 - protein, 9 aa, Artificial Sequence
  Peptide Derived from Human Papillomavirus
VQRNTFLDV

SEQ ID NO: 29098 - protein, 10 aa, Artificial Sequence
  Peptide Derived from Human Papillomavirus
VQRNTFLDVV

SEQ ID NO: 29099 - protein, 8 aa, Artificial Sequence
  Peptide Derived from Human Papillomavirus
VQYGGNVI

SEQ ID NO: 29100 - protein, 8 aa, Artificial Sequence
  Peptide Derived from Human Papillomavirus
VVTIPNSV

SEQ ID NO: 29101 - protein, 10 aa, Artificial Sequence
  Peptide Derived from Human Papillomavirus
VVTIPNSVQI

SEQ ID NO: 29102 - protein, 8 aa, Artificial Sequence
  Peptide Derived from Human Papillomavirus
VVWDSIYY

SEQ ID NO: 29103 - protein, 9 aa, Artificial Sequence
  Peptide Derived from Human Papillomavirus
VVWDSIYYI

SEQ ID NO: 29104 - protein, 9 aa, Artificial Sequence
  Peptide Derived from Human Papillomavirus
WQLIRLENA

SEQ ID NO: 29105 - protein, 10 aa, Artificial Sequence
  Peptide Derived from Human Papillomavirus
WQLIRLENAI

SEQ ID NO: 29106 - protein, 11 aa, Artificial Sequence
  Peptide Derived from Human Papillomavirus
WQLIRLENAIL

SEQ ID NO: 29107 - protein, 9 aa, Artificial Sequence
  Peptide Derived from Human Papillomavirus
YIKDGDTTY

SEQ ID NO: 29108 - protein, 10 aa, Artificial Sequence
  Peptide Derived from Human Papillomavirus
YIKDGDTTYY

SEQ ID NO: 29109 - protein, 11 aa, Artificial Sequence
  Peptide Derived from Human Papillomavirus
YIKDGDTTYYV

SEQ ID NO: 29110 - protein, 8 aa, Artificial Sequence
  Peptide Derived from Human Papillomavirus
YITETGIW

SEQ ID NO: 29111 - protein, 11 aa, Artificial Sequence
  Peptide Derived from Human Papillomavirus
YVQFKSECEKY

SEQ ID NO: 29112 - protein, 8 aa, Artificial Sequence
  Peptide Derived from Human Papillomavirus
YVVWDSIY

SEQ ID NO: 29113 - protein, 9 aa, Artificial Sequence
  Peptide Derived from Human Papillomavirus
YVVWDSIYY

SEQ ID NO: 29114 - protein, 10 aa, Artificial Sequence
  Peptide Derived from Human Papillomavirus
YVVWDSIYYI

SEQ ID NO: 29115 - protein, 11 aa, Artificial Sequence
  Peptide Derived from Human Papillomavirus
CIAYAACHKCI

SEQ ID NO: 29116 - protein, 8 aa, Artificial Sequence
  Peptide Derived from Human Papillomavirus
CIDFYSRI

SEQ ID NO: 29117 - protein, 11 aa, Artificial Sequence
  Peptide Derived from Human Papillomavirus
CIDFYSRIREL

SEQ ID NO: 29118 - protein, 8 aa, Artificial Sequence
  Peptide Derived from Human Papillomavirus
CLRCQKPL

SEQ ID NO: 29119 - protein, 11 aa, Artificial Sequence
  Peptide Derived from Human Papillomavirus
CLRCQKPLNPA

SEQ ID NO: 29120 - protein, 8 aa, Artificial Sequence
  Peptide Derived from Human Papillomavirus
CQKPLNPA

SEQ ID NO: 29121 - protein, 8 aa, Artificial Sequence
  Peptide Derived from Human Papillomavirus
CVYCKATL

SEQ ID NO: 29122 - protein, 10 aa, Artificial Sequence
  Peptide Derived from Human Papillomavirus
DLCTELNTSL

SEQ ID NO: 29123 - protein, 10 aa, Artificial Sequence
  Peptide Derived from Human Papillomavirus
DLFIVYRDCI

SEQ ID NO: 29124 - protein, 11 aa, Artificial Sequence
  Peptide Derived from Human Papillomavirus
DLFIVYRDCIA

SEQ ID NO: 29125 - protein, 9 aa, Artificial Sequence
  Peptide Derived from Human Papillomavirus
DPTQRPYKL

SEQ ID NO: 29126 - protein, 8 aa, Artificial Sequence
  Peptide Derived from Human Papillomavirus
DQARQERL

SEQ ID NO: 29127 - protein, 8 aa, Artificial Sequence
  Peptide Derived from Human Papillomavirus
DVSIACVY

SEQ ID NO: 29128 - protein, 11 aa, Artificial Sequence
  Peptide Derived from Human Papillomavirus
DVSIACVYCKA

SEQ ID NO: 29129 - protein, 9 aa, Artificial Sequence
  Peptide Derived from Human Papillomavirus
ELNTSLQDV

SEQ ID NO: 29130 - protein, 11 aa, Artificial Sequence
  Peptide Derived from Human Papillomavirus
ELNTSLQDVSI

SEQ ID NO: 29131 - protein, 9 aa, Artificial Sequence
  Peptide Derived from Human Papillomavirus
ELRYYSNSV

SEQ ID NO: 29132 - protein, 10 aa, Artificial Sequence
  Peptide Derived from Human Papillomavirus
ELRYYSNSVY

SEQ ID NO: 29133 - protein, 10 aa, Artificial Sequence
  Peptide Derived from Human Papillomavirus
ELYNLLIRCL

SEQ ID NO: 29134 - protein, 10 aa, Artificial Sequence
  Peptide Derived from Human Papillomavirus
EVYQFAFKDL

SEQ ID NO: 29135 - protein, 11 aa, Artificial Sequence
  Peptide Derived from Human Papillomavirus
EVYQFAFKDLF

SEQ ID NO: 29136 - protein, 8 aa, Artificial Sequence
  Peptide Derived from Human Papillomavirus
FIVYRDCI

SEQ ID NO: 29137 - protein, 9 aa, Artificial Sequence
  Peptide Derived from Human Papillomavirus
FIVYRDCIA

SEQ ID NO: 29138 - protein, 10 aa, Artificial Sequence
  Peptide Derived from Human Papillomavirus
FIVYRDCIAY

SEQ ID NO: 29139 - protein, 11 aa, Artificial Sequence
  Peptide Derived from Human Papillomavirus
FIVYRDCIAYA

SEQ ID NO: 29140 - protein, 10 aa, Artificial Sequence
  Peptide Derived from Human Papillomavirus
GQCNTCCDQA

SEQ ID NO: 29141 - protein, 8 aa, Artificial Sequence
  Peptide Derived from Human Papillomavirus
HLKDKRRF

SEQ ID NO: 29142 - protein, 11 aa, Artificial Sequence
  Peptide Derived from Human Papillomavirus
HLKDKRRFHSI

SEQ ID NO: 29143 - protein, 8 aa, Artificial Sequence
  Peptide Derived from Human Papillomavirus
IVYRDCIA

SEQ ID NO: 29144 - protein, 9 aa, Artificial Sequence
  Peptide Derived from Human Papillomavirus
IVYRDCIAY

SEQ ID NO: 29145 - protein, 10 aa, Artificial Sequence
  Peptide Derived from Human Papillomavirus
IVYRDCIAYA

SEQ ID NO: 29146 - protein, 11 aa, Artificial Sequence
  Peptide Derived from Human Papillomavirus
IVYRDCIAYAA

SEQ ID NO: 29147 - protein, 8 aa, Artificial Sequence
  Peptide Derived from Human Papillomavirus
KITNTELY

SEQ ID NO: 29148 - protein, 10 aa, Artificial Sequence
  Peptide Derived from Human Papillomavirus
KITNTELYNL

SEQ ID NO: 29149 - protein, 11 aa, Artificial Sequence
  Peptide Derived from Human Papillomavirus
KITNTELYNLL

SEQ ID NO: 29150 - protein, 9 aa, Artificial Sequence
  Peptide Derived from Human Papillomavirus
KLPDLCTEL

SEQ ID NO: 29151 - protein, 11 aa, Artificial Sequence
  Peptide Derived from Human Papillomavirus
LIRCLRCQKPL

SEQ ID NO: 29152 - protein, 8 aa, Artificial Sequence
  Peptide Derived from Human Papillomavirus
LPDLCTEL

SEQ ID NO: 29153 - protein, 9 aa, Artificial Sequence
  Peptide Derived from Human Papillomavirus
LQDVSIACV

SEQ ID NO: 29154 - protein, 10 aa, Artificial Sequence
  Peptide Derived from Human Papillomavirus
LQDVSIACVY

SEQ ID NO: 29155 - protein, 9 aa, Artificial Sequence
  Peptide Derived from Human Papillomavirus
NPAEKRRHL

SEQ ID NO: 29156 - protein, 11 aa, Artificial Sequence
  Peptide Derived from Human Papillomavirus
PLNPAEKRRHL

SEQ ID NO: 29157 - protein, 8 aa, Artificial Sequence
  Peptide Derived from Human Papillomavirus
RIRELRYY

SEQ ID NO: 29158 - protein, 10 aa, Artificial Sequence
  Peptide Derived from Human Papillomavirus
RLRRRRETQV

SEQ ID NO: 29159 - protein, 8 aa, Artificial Sequence
  Peptide Derived from Human Papillomavirus
RPYKLPDL

SEQ ID NO: 29160 - protein, 9 aa, Artificial Sequence
  Peptide Derived from Human Papillomavirus
SIACVYCKA

SEQ ID NO: 29161 - protein, 11 aa, Artificial Sequence
  Peptide Derived from Human Papillomavirus
SIACVYCKATL

SEQ ID NO: 29162 - protein, 8 aa, Artificial Sequence
  Peptide Derived from Human Papillomavirus
SLQDVSIA

SEQ ID NO: 29163 - protein, 10 aa, Artificial Sequence
  Peptide Derived from Human Papillomavirus
SLQDVSIACV

SEQ ID NO: 29164 - protein, 11 aa, Artificial Sequence
  Peptide Derived from Human Papillomavirus
SLQDVSIACVY

SEQ ID NO: 29165 - protein, 10 aa, Artificial Sequence
  Peptide Derived from Human Papillomavirus
SVYGETLEKI

SEQ ID NO: 29166 - protein, 10 aa, Artificial Sequence
  Peptide Derived from Human Papillomavirus
TLEKITNTEL

SEQ ID NO: 29167 - protein, 11 aa, Artificial Sequence
  Peptide Derived from Human Papillomavirus
TLEKITNTELY

SEQ ID NO: 29168 - protein, 8 aa, Artificial Sequence
  Peptide Derived from Human Papillomavirus
TLERTEVY

SEQ ID NO: 29169 - protein, 10 aa, Artificial Sequence
  Peptide Derived from Human Papillomavirus
TLERTEVYQF

SEQ ID NO: 29170 - protein, 11 aa, Artificial Sequence
  Peptide Derived from Human Papillomavirus
TLERTEVYQFA

SEQ ID NO: 29171 - protein, 10 aa, Artificial Sequence
  Peptide Derived from Human Papillomavirus
TQRPYKLPDL

SEQ ID NO: 29172 - protein, 8 aa, Artificial Sequence
  Peptide Derived from Human Papillomavirus
YQFAFKDL

SEQ ID NO: 29173 - protein, 9 aa, Artificial Sequence
  Peptide Derived from Human Papillomavirus
YQFAFKDLF

SEQ ID NO: 29174 - protein, 10 aa, Artificial Sequence
  Peptide Derived from Human Papillomavirus
YQFAFKDLFI

SEQ ID NO: 29175 - protein, 11 aa, Artificial Sequence
  Peptide Derived from Human Papillomavirus
YQFAFKDLFIV

SEQ ID NO: 29176 - protein, 8 aa, Artificial Sequence
  Peptide Derived from Human Papillomavirus
AQLPARRA

SEQ ID NO: 29177 - protein, 10 aa, Artificial Sequence
  Peptide Derived from Human Papillomavirus
CVCCKCDGRI

SEQ ID NO: 29178 - protein, 8 aa, Artificial Sequence
  Peptide Derived from Human Papillomavirus
DLLCYEQL

SEQ ID NO: 29179 - protein, 8 aa, Artificial Sequence
  Peptide Derived from Human Papillomavirus
DLRTLQQL

SEQ ID NO: 29180 - protein, 9 aa, Artificial Sequence
  Peptide Derived from Human Papillomavirus
DLRTLQQLF

SEQ ID NO: 29181 - protein, 10 aa, Artificial Sequence
  Peptide Derived from Human Papillomavirus
DLRTLQQLFL

SEQ ID NO: 29182 - protein, 8 aa, Artificial Sequence
  Peptide Derived from Human Papillomavirus
DPVDLLCY

SEQ ID NO: 29183 - protein, 11 aa, Artificial Sequence
  Peptide Derived from Human Papillomavirus
DPVDLLCYEQL

SEQ ID NO: 29184 - protein, 8 aa, Artificial Sequence
  Peptide Derived from Human Papillomavirus
ELDPVDLL

SEQ ID NO: 29185 - protein, 10 aa, Artificial Sequence
  Peptide Derived from Human Papillomavirus
ELDPVDLLCY

SEQ ID NO: 29186 - protein, 8 aa, Artificial Sequence
  Peptide Derived from Human Papillomavirus
ELTVESSA

SEQ ID NO: 29187 - protein, 11 aa, Artificial Sequence
  Peptide Derived from Human Papillomavirus
ELTVESSADDL

SEQ ID NO: 29188 - protein, 9 aa, Artificial Sequence
  Peptide Derived from Human Papillomavirus
EPQNELDPV

SEQ ID NO: 29189 - protein, 11 aa, Artificial Sequence
  Peptide Derived from Human Papillomavirus
EPQNELDPVDL

SEQ ID NO: 29190 - protein, 8 aa, Artificial Sequence
  Peptide Derived from Human Papillomavirus
EPQRHKIL

SEQ ID NO: 29191 - protein, 10 aa, Artificial Sequence
  Peptide Derived from Human Papillomavirus
EPQRHKILCV

SEQ ID NO: 29192 - protein, 8 aa, Artificial Sequence
  Peptide Derived from Human Papillomavirus
FLSTLSFV

SEQ ID NO: 29193 - protein, 11 aa, Artificial Sequence
  Peptide Derived from Human Papillomavirus
FLSTLSFVCPW

SEQ ID NO: 29194 - protein, 9 aa, Artificial Sequence
  Peptide Derived from Human Papillomavirus
GPRATLQEI

SEQ ID NO: 29195 - protein, 10 aa, Artificial Sequence
  Peptide Derived from Human Papillomavirus
GPRATLQEIV

SEQ ID NO: 29196 - protein, 11 aa, Artificial Sequence
  Peptide Derived from Human Papillomavirus
GPRATLQEIVL

SEQ ID NO: 29197 - protein, 9 aa, Artificial Sequence
  Peptide Derived from Human Papillomavirus
GVSHAQLPA

SEQ ID NO: 29198 - protein, 8 aa, Artificial Sequence
  Peptide Derived from Human Papillomavirus
HLEPQNEL

SEQ ID NO: 29199 - protein, 11 aa, Artificial Sequence
  Peptide Derived from Human Papillomavirus
HLEPQNELDPV

SEQ ID NO: 29200 - protein, 11 aa, Artificial Sequence
  Peptide Derived from Human Papillomavirus
IVLHLEPQNEL

SEQ ID NO: 29201 - protein, 8 aa, Artificial Sequence
  Peptide Derived from Human Papillomavirus
LQEIVLHL

SEQ ID NO: 29202 - protein, 9 aa, Artificial Sequence
  Peptide Derived from Human Papillomavirus
LQQLFLSTL

SEQ ID NO: 29203 - protein, 11 aa, Artificial Sequence
  Peptide Derived from Human Papillomavirus
LQQLFLSTLSF

SEQ ID NO: 29204 - protein, 8 aa, Artificial Sequence
  Peptide Derived from Human Papillomavirus
PQNELDPV

SEQ ID NO: 29205 - protein, 10 aa, Artificial Sequence
  Peptide Derived from Human Papillomavirus
PQNELDPVDL

SEQ ID NO: 29206 - protein, 11 aa, Artificial Sequence
  Peptide Derived from Human Papillomavirus
PQNELDPVDLL

SEQ ID NO: 29207 - protein, 9 aa, Artificial Sequence
  Peptide Derived from Human Papillomavirus
PQRHKILCV

SEQ ID NO: 29208 - protein, 10 aa, Artificial Sequence
  Peptide Derived from Human Papillomavirus
PVDLLCYEQL

SEQ ID NO: 29209 - protein, 9 aa, Artificial Sequence
  Peptide Derived from Human Papillomavirus
QLFLSTLSF

SEQ ID NO: 29210 - protein, 10 aa, Artificial Sequence
  Peptide Derived from Human Papillomavirus
QLFLSTLSFV

SEQ ID NO: 29211 - protein, 8 aa, Artificial Sequence
  Peptide Derived from Human Papillomavirus
QQLFLSTL

SEQ ID NO: 29212 - protein, 10 aa, Artificial Sequence
  Peptide Derived from Human Papillomavirus
QQLFLSTLSF

SEQ ID NO: 29213 - protein, 11 aa, Artificial Sequence
  Peptide Derived from Human Papillomavirus
QQLFLSTLSFV

SEQ ID NO: 29214 - protein, 10 aa, Artificial Sequence
  Peptide Derived from Human Papillomavirus
RIELTVESSA

SEQ ID NO: 29215 - protein, 9 aa, Artificial Sequence
  Peptide Derived from Human Papillomavirus
TLQEIVLHL

SEQ ID NO: 29216 - protein, 10 aa, Artificial Sequence
  Peptide Derived from Human Papillomavirus
TLQQLFLSTL

SEQ ID NO: 29217 - protein, 8 aa, Artificial Sequence
  Peptide Derived from Human Papillomavirus
TLSFVCPW

SEQ ID NO: 29218 - protein, 10 aa, Artificial Sequence
  Peptide Derived from Human Papillomavirus
TLSFVCPWCA

SEQ ID NO: 29219 - protein, 9 aa, Artificial Sequence
  Peptide Derived from Human Papillomavirus
TVESSADDL

SEQ ID NO: 29220 - protein, 10 aa, Artificial Sequence
  Peptide Derived from Human Papillomavirus
VLHLEPQNEL

SEQ ID NO: 29221 - protein, 11 aa, Artificial Sequence
  Peptide Derived from Human Papillomavirus
AIGEHWAKGTL

SEQ ID NO: 29222 - protein, 8 aa, Artificial Sequence
  Peptide Derived from Human Papillomavirus
ALPDPNKF

SEQ ID NO: 29223 - protein, 10 aa, Artificial Sequence
  Peptide Derived from Human Papillomavirus
ALPDPNKFGL

SEQ ID NO: 29224 - protein, 10 aa, Artificial Sequence
  Peptide Derived from Human Papillomavirus
ALWRPSDSTV

SEQ ID NO: 29225 - protein, 11 aa, Artificial Sequence
  Peptide Derived from Human Papillomavirus
ALWRPSDSTVY

SEQ ID NO: 29226 - protein, 8 aa, Artificial Sequence
  Peptide Derived from Human Papillomavirus
AQGHNNGI

SEQ ID NO: 29227 - protein, 10 aa, Artificial Sequence
  Peptide Derived from Human Papillomavirus
AQGHNNGICW

SEQ ID NO: 29228 - protein, 11 aa, Artificial Sequence
  Peptide Derived from Human Papillomavirus
AQLQPGDCPPL

SEQ ID NO: 29229 - protein, 11 aa, Artificial Sequence
  Peptide Derived from Human Papillomavirus
AVITQDVRDNV

SEQ ID NO: 29230 - protein, 8 aa, Artificial Sequence
  Peptide Derived from Human Papillomavirus
AVPKVSAY

SEQ ID NO: 29231 - protein, 10 aa, Artificial Sequence
  Peptide Derived from Human Papillomavirus
AVPKVSAYQY

SEQ ID NO: 29232 - protein, 8 aa, Artificial Sequence
  Peptide Derived from Human Papillomavirus
CILGCVPA

SEQ ID NO: 29233 - protein, 9 aa, Artificial Sequence
  Peptide Derived from Human Papillomavirus
CILGCVPAI

SEQ ID NO: 29234 - protein, 8 aa, Artificial Sequence
  Peptide Derived from Human Papillomavirus
CLRREQLF

SEQ ID NO: 29235 - protein, 9 aa, Artificial Sequence
  Peptide Derived from Human Papillomavirus
CLRREQLFA

SEQ ID NO: 29236 - protein, 10 aa, Artificial Sequence
  Peptide Derived from Human Papillomavirus
CPPLELKNTI

SEQ ID NO: 29237 - protein, 11 aa, Artificial Sequence
  Peptide Derived from Human Papillomavirus
CPPLELKNTII

SEQ ID NO: 29238 - protein, 10 aa, Artificial Sequence
  Peptide Derived from Human Papillomavirus
CQSICKYPDY

SEQ ID NO: 29239 - protein, 11 aa, Artificial Sequence
  Peptide Derived from Human Papillomavirus
CQSICKYPDYL

SEQ ID NO: 29240 - protein, 9 aa, Artificial Sequence
  Peptide Derived from Human Papillomavirus
CVPAIGEHW

SEQ ID NO: 29241 - protein, 10 aa, Artificial Sequence
  Peptide Derived from Human Papillomavirus
CVPAIGEHWA

SEQ ID NO: 29242 - protein, 11 aa, Artificial Sequence
  Peptide Derived from Human Papillomavirus
CVYSPSPSGSI

SEQ ID NO: 29243 - protein, 9 aa, Artificial Sequence
  Peptide Derived from Human Papillomavirus
DICQSICKY

SEQ ID NO: 29244 - protein, 11 aa, Artificial Sequence
  Peptide Derived from Human Papillomavirus
DLDQYPLGRKF

SEQ ID NO: 29245 - protein, 10 aa, Artificial Sequence
  Peptide Derived from Human Papillomavirus
DLKEKFSSDL

SEQ ID NO: 29246 - protein, 8 aa, Artificial Sequence
  Peptide Derived from Human Papillomavirus
DLQFIFQL

SEQ ID NO: 29247 - protein, 11 aa, Artificial Sequence
  Peptide Derived from Human Papillomavirus
DLQFIFQLCTI

SEQ ID NO: 29248 - protein, 9 aa, Artificial Sequence
  Peptide Derived from Human Papillomavirus
DLYIKGTSA

SEQ ID NO: 29249 - protein, 11 aa, Artificial Sequence
  Peptide Derived from Human Papillomavirus
DLYIKGTSANM

SEQ ID NO: 29250 - protein, 9 aa, Artificial Sequence
  Peptide Derived from Human Papillomavirus
DMVDTGYGA

SEQ ID NO: 29251 - protein, 10 aa, Artificial Sequence
  Peptide Derived from Human Papillomavirus
DMVDTGYGAM

SEQ ID NO: 29252 - protein, 8 aa, Artificial Sequence
  Peptide Derived from Human Papillomavirus
DPTKFKHY

SEQ ID NO: 29253 - protein, 8 aa, Artificial Sequence
  Peptide Derived from Human Papillomavirus
DPYDKLKF

SEQ ID NO: 29254 - protein, 9 aa, Artificial Sequence
  Peptide Derived from Human Papillomavirus
DPYDKLKFW

SEQ ID NO: 29255 - protein, 11 aa, Artificial Sequence
  Peptide Derived from Human Papillomavirus
DPYDKLKFWTV

SEQ ID NO: 29256 - protein, 8 aa, Artificial Sequence
  Peptide Derived from Human Papillomavirus
DPYGDSMF

SEQ ID NO: 29257 - protein, 9 aa, Artificial Sequence
  Peptide Derived from Human Papillomavirus
DPYGDSMFF

SEQ ID NO: 29258 - protein, 11 aa, Artificial Sequence
  Peptide Derived from Human Papillomavirus
DPYGDSMFFCL

SEQ ID NO: 29259 - protein, 9 aa, Artificial Sequence
  Peptide Derived from Human Papillomavirus
DQYPLGRKF

SEQ ID NO: 29260 - protein, 10 aa, Artificial Sequence
  Peptide Derived from Human Papillomavirus
DQYPLGRKFL

SEQ ID NO: 29261 - protein, 11 aa, Artificial Sequence
  Peptide Derived from Human Papillomavirus
DQYPLGRKFLV

SEQ ID NO: 29262 - protein, 8 aa, Artificial Sequence
  Peptide Derived from Human Papillomavirus
DVRDNVSV

SEQ ID NO: 29263 - protein, 10 aa, Artificial Sequence
  Peptide Derived from Human Papillomavirus
DVRDNVSVDY

SEQ ID NO: 29264 - protein, 8 aa, Artificial Sequence
  Peptide Derived from Human Papillomavirus
EIGRGQPL

SEQ ID NO: 29265 - protein, 10 aa, Artificial Sequence
  Peptide Derived from Human Papillomavirus
EIGRGQPLGI

SEQ ID NO: 29266 - protein, 8 aa, Artificial Sequence
  Peptide Derived from Human Papillomavirus
EQLFARHF

SEQ ID NO: 29267 - protein, 9 aa, Artificial Sequence
  Peptide Derived from Human Papillomavirus
EQLFARHFW

SEQ ID NO: 29268 - protein, 9 aa, Artificial Sequence
  Peptide Derived from Human Papillomavirus
EVMSYIHSM

SEQ ID NO: 29269 - protein, 10 aa, Artificial Sequence
  Peptide Derived from Human Papillomavirus
EVPLDICQSI

SEQ ID NO: 29270 - protein, 8 aa, Artificial Sequence
  Peptide Derived from Human Papillomavirus
FIFQLCTI

SEQ ID NO: 29271 - protein, 10 aa, Artificial Sequence
  Peptide Derived from Human Papillomavirus
FIFQLCTITL

SEQ ID NO: 29272 - protein, 8 aa, Artificial Sequence
  Peptide Derived from Human Papillomavirus
FLKNVNVF

SEQ ID NO: 29273 - protein, 10 aa, Artificial Sequence
  Peptide Derived from Human Papillomavirus
FLKNVNVFPI

SEQ ID NO: 29274 - protein, 11 aa, Artificial Sequence
  Peptide Derived from Human Papillomavirus
FLKNVNVFPIF

SEQ ID NO: 29275 - protein, 8 aa, Artificial Sequence
  Peptide Derived from Human Papillomavirus
FPIFLQMA

SEQ ID NO: 29276 - protein, 9 aa, Artificial Sequence
  Peptide Derived from Human Papillomavirus
FPIFLQMAL

SEQ ID NO: 29277 - protein, 10 aa, Artificial Sequence
  Peptide Derived from Human Papillomavirus
FPIFLQMALW

SEQ ID NO: 29278 - protein, 8 aa, Artificial Sequence
  Peptide Derived from Human Papillomavirus
FQLCTITL

SEQ ID NO: 29279 - protein, 10 aa, Artificial Sequence
  Peptide Derived from Human Papillomavirus
FQLCTITLTA

SEQ ID NO: 29280 - protein, 8 aa, Artificial Sequence
  Peptide Derived from Human Papillomavirus
GICWHNQL

SEQ ID NO: 29281 - protein, 9 aa, Artificial Sequence
  Peptide Derived from Human Papillomavirus
GICWHNQLF

SEQ ID NO: 29282 - protein, 10 aa, Artificial Sequence
  Peptide Derived from Human Papillomavirus
GICWHNQLFV

SEQ ID NO: 29283 - protein, 9 aa, Artificial Sequence
  Peptide Derived from Human Papillomavirus
GIGLSGHPF

SEQ ID NO: 29284 - protein, 10 aa, Artificial Sequence
  Peptide Derived from Human Papillomavirus
GIGLSGHPFY

SEQ ID NO: 29285 - protein, 9 aa, Artificial Sequence
  Peptide Derived from Human Papillomavirus
GIIIFLKNV

SEQ ID NO: 29286 - protein, 11 aa, Artificial Sequence
  Peptide Derived from Human Papillomavirus
GIIIFLKNVNV

SEQ ID NO: 29287 - protein, 8 aa, Artificial Sequence
  Peptide Derived from Human Papillomavirus
GLPDSTIY

SEQ ID NO: 29288 - protein, 8 aa, Artificial Sequence
  Peptide Derived from Human Papillomavirus
GLRRRPTI

SEQ ID NO: 29289 - protein, 8 aa, Artificial Sequence
  Peptide Derived from Human Papillomavirus
GLSGHPFY

SEQ ID NO: 29290 - protein, 11 aa, Artificial Sequence
  Peptide Derived from Human Papillomavirus
GLSGHPFYNKL

SEQ ID NO: 29291 - protein, 10 aa, Artificial Sequence
  Peptide Derived from Human Papillomavirus
GMEIGRGQPL

SEQ ID NO: 29292 - protein, 8 aa, Artificial Sequence
  Peptide Derived from Human Papillomavirus
GPRKRPAA

SEQ ID NO: 29293 - protein, 8 aa, Artificial Sequence
  Peptide Derived from Human Papillomavirus
GQPLGIGL

SEQ ID NO: 29294 - protein, 11 aa, Artificial Sequence
  Peptide Derived from Human Papillomavirus
GVMGDTVPTDL

SEQ ID NO: 29295 - protein, 10 aa, Artificial Sequence
  Peptide Derived from Human Papillomavirus
GVPPPPTTSL

SEQ ID NO: 29296 - protein, 11 aa, Artificial Sequence
  Peptide Derived from Human Papillomavirus
GVPPPPTTSLV

SEQ ID NO: 29297 - protein, 9 aa, Artificial Sequence
  Peptide Derived from Human Papillomavirus
HVEEYDLQF

SEQ ID NO: 29298 - protein, 10 aa, Artificial Sequence
  Peptide Derived from Human Papillomavirus
HVEEYDLQFI

SEQ ID NO: 29299 - protein, 11 aa, Artificial Sequence
  Peptide Derived from Human Papillomavirus
HVEEYDLQFIF

SEQ ID NO: 29300 - protein, 8 aa, Artificial Sequence
  Peptide Derived from Human Papillomavirus
IIEDGDMV

SEQ ID NO: 29301 - protein, 9 aa, Artificial Sequence
  Peptide Derived from Human Papillomavirus
IIFLKNVNV

SEQ ID NO: 29302 - protein, 10 aa, Artificial Sequence
  Peptide Derived from Human Papillomavirus
IIFLKNVNVF

SEQ ID NO: 29303 - protein, 8 aa, Artificial Sequence
  Peptide Derived from Human Papillomavirus
IIIFLKNV

SEQ ID NO: 29304 - protein, 10 aa, Artificial Sequence
  Peptide Derived from Human Papillomavirus
IIIFLKNVNV

SEQ ID NO: 29305 - protein, 11 aa, Artificial Sequence
  Peptide Derived from Human Papillomavirus
IIIFLKNVNVF

SEQ ID NO: 29306 - protein, 8 aa, Artificial Sequence
  Peptide Derived from Human Papillomavirus
IIYGHGII

SEQ ID NO: 29307 - protein, 9 aa, Artificial Sequence
  Peptide Derived from Human Papillomavirus
IIYGHGIII

SEQ ID NO: 29308 - protein, 10 aa, Artificial Sequence
  Peptide Derived from Human Papillomavirus
IIYGHGIIIF

SEQ ID NO: 29309 - protein, 11 aa, Artificial Sequence
  Peptide Derived from Human Papillomavirus
IIYGHGIIIFL

SEQ ID NO: 29310 - protein, 9 aa, Artificial Sequence
  Peptide Derived from Human Papillomavirus
ILENWNFGV

SEQ ID NO: 29311 - protein, 8 aa, Artificial Sequence
  Peptide Derived from Human Papillomavirus
ILGCVPAI

SEQ ID NO: 29312 - protein, 8 aa, Artificial Sequence
  Peptide Derived from Human Papillomavirus
KLDDTESA

SEQ ID NO: 29313 - protein, 10 aa, Artificial Sequence
  Peptide Derived from Human Papillomavirus
KLDDTESAHA

SEQ ID NO: 29314 - protein, 11 aa, Artificial Sequence
  Peptide Derived from Human Papillomavirus
KLDDTESAHAA

SEQ ID NO: 29315 - protein, 9 aa, Artificial Sequence
  Peptide Derived from Human Papillomavirus
KLKFWTVDL

SEQ ID NO: 29316 - protein, 8 aa, Artificial Sequence
  Peptide Derived from Human Papillomavirus
KPYWLHKA

SEQ ID NO: 29317 - protein, 9 aa, Artificial Sequence
  Peptide Derived from Human Papillomavirus
KQAVPKVSA

SEQ ID NO: 29318 - protein, 10 aa, Artificial Sequence
  Peptide Derived from Human Papillomavirus
KQAVPKVSAY

SEQ ID NO: 29319 - protein, 8 aa, Artificial Sequence
  Peptide Derived from Human Papillomavirus
KQDPYDKL

SEQ ID NO: 29320 - protein, 10 aa, Artificial Sequence
  Peptide Derived from Human Papillomavirus
KQDPYDKLKF

SEQ ID NO: 29321 - protein, 11 aa, Artificial Sequence
  Peptide Derived from Human Papillomavirus
KQDPYDKLKFW

SEQ ID NO: 29322 - protein, 8 aa, Artificial Sequence
  Peptide Derived from Human Papillomavirus
KQTQLCIL

SEQ ID NO: 29323 - protein, 11 aa, Artificial Sequence
  Peptide Derived from Human Papillomavirus
KQTQLCILGCV

SEQ ID NO: 29324 - protein, 9 aa, Artificial Sequence
  Peptide Derived from Human Papillomavirus
KVSAYQYRV

SEQ ID NO: 29325 - protein, 10 aa, Artificial Sequence
  Peptide Derived from Human Papillomavirus
KVSAYQYRVF

SEQ ID NO: 29326 - protein, 8 aa, Artificial Sequence
  Peptide Derived from Human Papillomavirus
LLTVGNPY

SEQ ID NO: 29327 - protein, 9 aa, Artificial Sequence
  Peptide Derived from Human Papillomavirus
LLTVGNPYF

SEQ ID NO: 29328 - protein, 11 aa, Artificial Sequence
  Peptide Derived from Human Papillomavirus
LLTVGNPYFRV

SEQ ID NO: 29329 - protein, 9 aa, Artificial Sequence
  Peptide Derived from Human Papillomavirus
LPDPNKFGL

SEQ ID NO: 29330 - protein, 9 aa, Artificial Sequence
  Peptide Derived from Human Papillomavirus
LPPPSVARV

SEQ ID NO: 29331 - protein, 10 aa, Artificial Sequence
  Peptide Derived from Human Papillomavirus
LPPPSVARVV

SEQ ID NO: 29332 - protein, 8 aa, Artificial Sequence
  Peptide Derived from Human Papillomavirus
LQDTKCEV

SEQ ID NO: 29333 - protein, 10 aa, Artificial Sequence
  Peptide Derived from Human Papillomavirus
LQDTKCEVPL

SEQ ID NO: 29334 - protein, 10 aa, Artificial Sequence
  Peptide Derived from Human Papillomavirus
LQFIFQLCTI

SEQ ID NO: 29335 - protein, 8 aa, Artificial Sequence
  Peptide Derived from Human Papillomavirus
LQMSADPY

SEQ ID NO: 29336 - protein, 9 aa, Artificial Sequence
  Peptide Derived from Human Papillomavirus
LQPGDCPPL

SEQ ID NO: 29337 - protein, 11 aa, Artificial Sequence
  Peptide Derived from Human Papillomavirus
LQPGDCPPLEL

SEQ ID NO: 29338 - protein, 8 aa, Artificial Sequence
  Peptide Derived from Human Papillomavirus
LVDTYRFV

SEQ ID NO: 29339 - protein, 11 aa, Artificial Sequence
  Peptide Derived from Human Papillomavirus
LVDTYRFVQSV

SEQ ID NO: 29340 - protein, 8 aa, Artificial Sequence
  Peptide Derived from Human Papillomavirus
LVWACVGM

SEQ ID NO: 29341 - protein, 10 aa, Artificial Sequence
  Peptide Derived from Human Papillomavirus
LVWACVGMEI

SEQ ID NO: 29342 - protein, 8 aa, Artificial Sequence
  Peptide Derived from Human Papillomavirus
MVDTGYGA

SEQ ID NO: 29343 - protein, 9 aa, Artificial Sequence
  Peptide Derived from Human Papillomavirus
MVDTGYGAM

SEQ ID NO: 29344 - protein, 11 aa, Artificial Sequence
  Peptide Derived from Human Papillomavirus
MVDTGYGAMDF

SEQ ID NO: 29345 - protein, 8 aa, Artificial Sequence
  Peptide Derived from Human Papillomavirus
NIIYGHGI

SEQ ID NO: 29346 - protein, 9 aa, Artificial Sequence
  Peptide Derived from Human Papillomavirus
NIIYGHGII

SEQ ID NO: 29347 - protein, 10 aa, Artificial Sequence
  Peptide Derived from Human Papillomavirus
NIIYGHGIII

SEQ ID NO: 29348 - protein, 11 aa, Artificial Sequence
  Peptide Derived from Human Papillomavirus
NIIYGHGIIIF

SEQ ID NO: 29349 - protein, 10 aa, Artificial Sequence
  Peptide Derived from Human Papillomavirus
NMRETPGSCV

SEQ ID NO: 29350 - protein, 11 aa, Artificial Sequence
  Peptide Derived from Human Papillomavirus
NMRETPGSCVY

SEQ ID NO: 29351 - protein, 8 aa, Artificial Sequence
  Peptide Derived from Human Papillomavirus
NPETQRLV

SEQ ID NO: 29352 - protein, 9 aa, Artificial Sequence
  Peptide Derived from Human Papillomavirus
NPETQRLVW

SEQ ID NO: 29353 - protein, 10 aa, Artificial Sequence
  Peptide Derived from Human Papillomavirus
NPETQRLVWA

SEQ ID NO: 29354 - protein, 11 aa, Artificial Sequence
  Peptide Derived from Human Papillomavirus
NPYFRVVPSGA

SEQ ID NO: 29355 - protein, 8 aa, Artificial Sequence
  Peptide Derived from Human Papillomavirus
NQLFVTVV

SEQ ID NO: 29356 - protein, 9 aa, Artificial Sequence
  Peptide Derived from Human Papillomavirus
NVFPIFLQM

SEQ ID NO: 29357 - protein, 10 aa, Artificial Sequence
  Peptide Derived from Human Papillomavirus
NVFPIFLQMA

SEQ ID NO: 29358 - protein, 11 aa, Artificial Sequence
  Peptide Derived from Human Papillomavirus
NVFPIFLQMAL

SEQ ID NO: 29359 - protein, 8 aa, Artificial Sequence
  Peptide Derived from Human Papillomavirus
NVNVFPIF

SEQ ID NO: 29360 - protein, 9 aa, Artificial Sequence
  Peptide Derived from Human Papillomavirus
NVNVFPIFL

SEQ ID NO: 29361 - protein, 11 aa, Artificial Sequence
  Peptide Derived from Human Papillomavirus
NVNVFPIFLQM

SEQ ID NO: 29362 - protein, 11 aa, Artificial Sequence
  Peptide Derived from Human Papillomavirus
NVSVDYKQTQL

SEQ ID NO: 29363 - protein, 8 aa, Artificial Sequence
  Peptide Derived from Human Papillomavirus
PIFLQMAL

SEQ ID NO: 29364 - protein, 9 aa, Artificial Sequence
  Peptide Derived from Human Papillomavirus
PIFLQMALW

SEQ ID NO: 29365 - protein, 8 aa, Artificial Sequence
  Peptide Derived from Human Papillomavirus
PLDICQSI

SEQ ID NO: 29366 - protein, 11 aa, Artificial Sequence
  Peptide Derived from Human Papillomavirus
PLDICQSICKY

SEQ ID NO: 29367 - protein, 8 aa, Artificial Sequence
  Peptide Derived from Human Papillomavirus
PLELKNTI

SEQ ID NO: 29368 - protein, 9 aa, Artificial Sequence
  Peptide Derived from Human Papillomavirus
PLELKNTII

SEQ ID NO: 29369 - protein, 11 aa, Artificial Sequence
  Peptide Derived from Human Papillomavirus
PLGIGLSGHPF

SEQ ID NO: 29370 - protein, 8 aa, Artificial Sequence
  Peptide Derived from Human Papillomavirus
PLGRKFLV

SEQ ID NO: 29371 - protein, 10 aa, Artificial Sequence
  Peptide Derived from Human Papillomavirus
PLGRKFLVQA

SEQ ID NO: 29372 - protein, 8 aa, Artificial Sequence
  Peptide Derived from Human Papillomavirus
PPEKQDPY

SEQ ID NO: 29373 - protein, 11 aa, Artificial Sequence
  Peptide Derived from Human Papillomavirus
PPEKQDPYDKL

SEQ ID NO: 29374 - protein, 9 aa, Artificial Sequence
  Peptide Derived from Human Papillomavirus
PPLELKNTI

SEQ ID NO: 29375 - protein, 10 aa, Artificial Sequence
  Peptide Derived from Human Papillomavirus
PPLELKNTII

SEQ ID NO: 29376 - protein, 8 aa, Artificial Sequence
  Peptide Derived from Human Papillomavirus
PPPPTTSL

SEQ ID NO: 29377 - protein, 9 aa, Artificial Sequence
  Peptide Derived from Human Papillomavirus
PPPPTTSLV

SEQ ID NO: 29378 - protein, 8 aa, Artificial Sequence
  Peptide Derived from Human Papillomavirus
PPPSVARV

SEQ ID NO: 29379 - protein, 9 aa, Artificial Sequence
  Peptide Derived from Human Papillomavirus
PPPSVARVV

SEQ ID NO: 29380 - protein, 8 aa, Artificial Sequence
  Peptide Derived from Human Papillomavirus
PPPTTSLV

SEQ ID NO: 29381 - protein, 11 aa, Artificial Sequence
  Peptide Derived from Human Papillomavirus
PPPTTSLVDTY

SEQ ID NO: 29382 - protein, 8 aa, Artificial Sequence
  Peptide Derived from Human Papillomavirus
PPSVARVV

SEQ ID NO: 29383 - protein, 10 aa, Artificial Sequence
  Peptide Derived from Human Papillomavirus
PPTTSLVDTY

SEQ ID NO: 29384 - protein, 11 aa, Artificial Sequence
  Peptide Derived from Human Papillomavirus
PVPNTYDPTKF

SEQ ID NO: 29385 - protein, 8 aa, Artificial Sequence
  Peptide Derived from Human Papillomavirus
QLCILGCV

SEQ ID NO: 29386 - protein, 10 aa, Artificial Sequence
  Peptide Derived from Human Papillomavirus
QLCILGCVPA

SEQ ID NO: 29387 - protein, 11 aa, Artificial Sequence
  Peptide Derived from Human Papillomavirus
QLCILGCVPAI

SEQ ID NO: 29388 - protein, 9 aa, Artificial Sequence
  Peptide Derived from Human Papillomavirus
QLCTITLTA

SEQ ID NO: 29389 - protein, 11 aa, Artificial Sequence
  Peptide Derived from Human Papillomavirus
QLCTITLTAEV

SEQ ID NO: 29390 - protein, 8 aa, Artificial Sequence
  Peptide Derived from Human Papillomavirus
QLFARHFW

SEQ ID NO: 29391 - protein, 11 aa, Artificial Sequence
  Peptide Derived from Human Papillomavirus
QLFARHFWNRA

SEQ ID NO: 29392 - protein, 8 aa, Artificial Sequence
  Peptide Derived from Human Papillomavirus
QLFNKPYW

SEQ ID NO: 29393 - protein, 9 aa, Artificial Sequence
  Peptide Derived from Human Papillomavirus
QLFNKPYWL

SEQ ID NO: 29394 - protein, 10 aa, Artificial Sequence
  Peptide Derived from Human Papillomavirus
QLQPGDCPPL

SEQ ID NO: 29395 - protein, 11 aa, Artificial Sequence
  Peptide Derived from Human Papillomavirus
QMSADPYGDSM

SEQ ID NO: 29396 - protein, 8 aa, Artificial Sequence
  Peptide Derived from Human Papillomavirus
QPGDCPPL

SEQ ID NO: 29397 - protein, 10 aa, Artificial Sequence
  Peptide Derived from Human Papillomavirus
QPGDCPPLEL

SEQ ID NO: 29398 - protein, 9 aa, Artificial Sequence
  Peptide Derived from Human Papillomavirus
RLLTVGNPY

SEQ ID NO: 29399 - protein, 10 aa, Artificial Sequence
  Peptide Derived from Human Papillomavirus
RLLTVGNPYF

SEQ ID NO: 29400 - protein, 9 aa, Artificial Sequence
  Peptide Derived from Human Papillomavirus
RLVWACVGM

SEQ ID NO: 29401 - protein, 11 aa, Artificial Sequence
  Peptide Derived from Human Papillomavirus
RLVWACVGMEI

SEQ ID NO: 29402 - protein, 9 aa, Artificial Sequence
  Peptide Derived from Human Papillomavirus
RPAASTSTA

SEQ ID NO: 29403 - protein, 8 aa, Artificial Sequence
  Peptide Derived from Human Papillomavirus
RPAKRVRI

SEQ ID NO: 29404 - protein, 8 aa, Artificial Sequence
  Peptide Derived from Human Papillomavirus
RPSDSTVY

SEQ ID NO: 29405 - protein, 9 aa, Artificial Sequence
  Peptide Derived from Human Papillomavirus
RPSDSTVYL

SEQ ID NO: 29406 - protein, 11 aa, Artificial Sequence
  Peptide Derived from Human Papillomavirus
RPTIGPRKRPA

SEQ ID NO: 29407 - protein, 10 aa, Artificial Sequence
  Peptide Derived from Human Papillomavirus
RVALPDPNKF

SEQ ID NO: 29408 - protein, 8 aa, Artificial Sequence
  Peptide Derived from Human Papillomavirus
RVVNTDDY

SEQ ID NO: 29409 - protein, 9 aa, Artificial Sequence
  Peptide Derived from Human Papillomavirus
RVVNTDDYV

SEQ ID NO: 29410 - protein, 8 aa, Artificial Sequence
  Peptide Derived from Human Papillomavirus
SICKYPDY

SEQ ID NO: 29411 - protein, 9 aa, Artificial Sequence
  Peptide Derived from Human Papillomavirus
SICKYPDYL

SEQ ID NO: 29412 - protein, 11 aa, Artificial Sequence
  Peptide Derived from Human Papillomavirus
SICKYPDYLQM

SEQ ID NO: 29413 - protein, 11 aa, Artificial Sequence
  Peptide Derived from Human Papillomavirus
SIFYHAGSSRL

SEQ ID NO: 29414 - protein, 8 aa, Artificial Sequence
  Peptide Derived from Human Papillomavirus
SILENWNF

SEQ ID NO: 29415 - protein, 10 aa, Artificial Sequence
  Peptide Derived from Human Papillomavirus
SILENWNFGV

SEQ ID NO: 29416 - protein, 9 aa, Artificial Sequence
  Peptide Derived from Human Papillomavirus
SITTSDSQL

SEQ ID NO: 29417 - protein, 10 aa, Artificial Sequence
  Peptide Derived from Human Papillomavirus
SITTSDSQLF

SEQ ID NO: 29418 - protein, 8 aa, Artificial Sequence
  Peptide Derived from Human Papillomavirus
SLVDTYRF

SEQ ID NO: 29419 - protein, 9 aa, Artificial Sequence
  Peptide Derived from Human Papillomavirus
SLVDTYRFV

SEQ ID NO: 29420 - protein, 11 aa, Artificial Sequence
  Peptide Derived from Human Papillomavirus
SMFFCLRREQL

SEQ ID NO: 29421 - protein, 10 aa, Artificial Sequence
  Peptide Derived from Human Papillomavirus
SMNSSILENW

SEQ ID NO: 29422 - protein, 8 aa, Artificial Sequence
  Peptide Derived from Human Papillomavirus
SPSPSGSI

SEQ ID NO: 29423 - protein, 8 aa, Artificial Sequence
  Peptide Derived from Human Papillomavirus
SQLFNKPY

SEQ ID NO: 29424 - protein, 9 aa, Artificial Sequence
  Peptide Derived from Human Papillomavirus
SQLFNKPYW

SEQ ID NO: 29425 - protein, 10 aa, Artificial Sequence
  Peptide Derived from Human Papillomavirus
SQLFNKPYWL

SEQ ID NO: 29426 - protein, 11 aa, Artificial Sequence
  Peptide Derived from Human Papillomavirus
SVARVVNTDDY

SEQ ID NO: 29427 - protein, 9 aa, Artificial Sequence
  Peptide Derived from Human Papillomavirus
SVDYKQTQL

SEQ ID NO: 29428 - protein, 11 aa, Artificial Sequence
  Peptide Derived from Human Papillomavirus
SVDYKQTQLCI

SEQ ID NO: 29429 - protein, 9 aa, Artificial Sequence
  Peptide Derived from Human Papillomavirus
TIGPRKRPA

SEQ ID NO: 29430 - protein, 10 aa, Artificial Sequence
  Peptide Derived from Human Papillomavirus
TIGPRKRPAA

SEQ ID NO: 29431 - protein, 8 aa, Artificial Sequence
  Peptide Derived from Human Papillomavirus
TIIEDGDM

SEQ ID NO: 29432 - protein, 9 aa, Artificial Sequence
  Peptide Derived from Human Papillomavirus
TIIEDGDMV

SEQ ID NO: 29433 - protein, 8 aa, Artificial Sequence
  Peptide Derived from Human Papillomavirus
TITLTAEV

SEQ ID NO: 29434 - protein, 9 aa, Artificial Sequence
  Peptide Derived from Human Papillomavirus
TITLTAEVM

SEQ ID NO: 29435 - protein, 11 aa, Artificial Sequence
  Peptide Derived from Human Papillomavirus
TITLTAEVMSY

SEQ ID NO: 29436 - protein, 10 aa, Artificial Sequence
  Peptide Derived from Human Papillomavirus
TIYNPETQRL

SEQ ID NO: 29437 - protein, 11 aa, Artificial Sequence
  Peptide Derived from Human Papillomavirus
TIYNPETQRLV

SEQ ID NO: 29438 - protein, 10 aa, Artificial Sequence
  Peptide Derived from Human Papillomavirus
TLCASTQNPV

SEQ ID NO: 29439 - protein, 8 aa, Artificial Sequence
  Peptide Derived from Human Papillomavirus
TLCKPAQL

SEQ ID NO: 29440 - protein, 9 aa, Artificial Sequence
  Peptide Derived from Human Papillomavirus
TLQDTKCEV

SEQ ID NO: 29441 - protein, 11 aa, Artificial Sequence
  Peptide Derived from Human Papillomavirus
TLQDTKCEVPL

SEQ ID NO: 29442 - protein, 9 aa, Artificial Sequence
  Peptide Derived from Human Papillomavirus
TLTAEVMSY

SEQ ID NO: 29443 - protein, 10 aa, Artificial Sequence
  Peptide Derived from Human Papillomavirus
TLTAEVMSYI

SEQ ID NO: 29444 - protein, 9 aa, Artificial Sequence
  Peptide Derived from Human Papillomavirus
TPPEKQDPY

SEQ ID NO: 29445 - protein, 8 aa, Artificial Sequence
  Peptide Derived from Human Papillomavirus
TQDVRDNV

SEQ ID NO: 29446 - protein, 10 aa, Artificial Sequence
  Peptide Derived from Human Papillomavirus
TQDVRDNVSV

SEQ ID NO: 29447 - protein, 9 aa, Artificial Sequence
  Peptide Derived from Human Papillomavirus
TQLCILGCV

SEQ ID NO: 29448 - protein, 11 aa, Artificial Sequence
  Peptide Derived from Human Papillomavirus
TQLCILGCVPA

SEQ ID NO: 29449 - protein, 9 aa, Artificial Sequence
  Peptide Derived from Human Papillomavirus
TQNPVPNTY

SEQ ID NO: 29450 - protein, 9 aa, Artificial Sequence
  Peptide Derived from Human Papillomavirus
TQRLVWACV

SEQ ID NO: 29451 - protein, 11 aa, Artificial Sequence
  Peptide Derived from Human Papillomavirus
TQRLVWACVGM

SEQ ID NO: 29452 - protein, 8 aa, Artificial Sequence
  Peptide Derived from Human Papillomavirus
TVDLKEKF

SEQ ID NO: 29453 - protein, 9 aa, Artificial Sequence
  Peptide Derived from Human Papillomavirus
TVGNPYFRV

SEQ ID NO: 29454 - protein, 10 aa, Artificial Sequence
  Peptide Derived from Human Papillomavirus
TVGNPYFRVV

SEQ ID NO: 29455 - protein, 8 aa, Artificial Sequence
  Peptide Derived from Human Papillomavirus
TVPTDLYI

SEQ ID NO: 29456 - protein, 11 aa, Artificial Sequence
  Peptide Derived from Human Papillomavirus
TVVDTTRSTNL

SEQ ID NO: 29457 - protein, 9 aa, Artificial Sequence
  Peptide Derived from Human Papillomavirus
TVYLPPPSV

SEQ ID NO: 29458 - protein, 10 aa, Artificial Sequence
  Peptide Derived from Human Papillomavirus
TVYLPPPSVA

SEQ ID NO: 29459 - protein, 10 aa, Artificial Sequence
  Peptide Derived from Human Papillomavirus
VITQDVRDNV

SEQ ID NO: 29460 - protein, 10 aa, Artificial Sequence
  Peptide Derived from Human Papillomavirus
VMGDTVPTDL

SEQ ID NO: 29461 - protein, 11 aa, Artificial Sequence
  Peptide Derived from Human Papillomavirus
VMGDTVPTDLY

SEQ ID NO: 29462 - protein, 8 aa, Artificial Sequence
  Peptide Derived from Human Papillomavirus
VMSYIHSM

SEQ ID NO: 29463 - protein, 8 aa, Artificial Sequence
  Peptide Derived from Human Papillomavirus
VPAIGEHW

SEQ ID NO: 29464 - protein, 9 aa, Artificial Sequence
  Peptide Derived from Human Papillomavirus
VPAIGEHWA

SEQ ID NO: 29465 - protein, 9 aa, Artificial Sequence
  Peptide Derived from Human Papillomavirus
VPKVSAYQY

SEQ ID NO: 29466 - protein, 11 aa, Artificial Sequence
  Peptide Derived from Human Papillomavirus
VPKVSAYQYRV

SEQ ID NO: 29467 - protein, 9 aa, Artificial Sequence
  Peptide Derived from Human Papillomavirus
VPLDICQSI

SEQ ID NO: 29468 - protein, 10 aa, Artificial Sequence
  Peptide Derived from Human Papillomavirus
VPNTYDPTKF

SEQ ID NO: 29469 - protein, 9 aa, Artificial Sequence
  Peptide Derived from Human Papillomavirus
VPPPPTTSL

SEQ ID NO: 29470 - protein, 10 aa, Artificial Sequence
  Peptide Derived from Human Papillomavirus
VPPPPTTSLV

SEQ ID NO: 29471 - protein, 10 aa, Artificial Sequence
  Peptide Derived from Human Papillomavirus
VPSGAGNKQA

SEQ ID NO: 29472 - protein, 11 aa, Artificial Sequence
  Peptide Derived from Human Papillomavirus
VPSGAGNKQAV

SEQ ID NO: 29473 - protein, 11 aa, Artificial Sequence
  Peptide Derived from Human Papillomavirus
VQAGLRRRPTI

SEQ ID NO: 29474 - protein, 10 aa, Artificial Sequence
  Peptide Derived from Human Papillomavirus
VVDTTRSTNL

SEQ ID NO: 29475 - protein, 8 aa, Artificial Sequence
  Peptide Derived from Human Papillomavirus
VVNTDDYV

SEQ ID NO: 29476 - protein, 11 aa, Artificial Sequence
  Peptide Derived from Human Papillomavirus
VVPSGAGNKQA

SEQ ID NO: 29477 - protein, 9 aa, Artificial Sequence
  Peptide Derived from Human Papillomavirus
YIHSMNSSI

SEQ ID NO: 29478 - protein, 10 aa, Artificial Sequence
  Peptide Derived from Human Papillomavirus
YIHSMNSSIL

SEQ ID NO: 29479 - protein, 9 aa, Artificial Sequence
  Peptide Derived from Human Papillomavirus
YIKGTSANM

SEQ ID NO: 29480 - protein, 8 aa, Artificial Sequence
  Peptide Derived from Human Papillomavirus
YLPPPSVA

SEQ ID NO: 29481 - protein, 10 aa, Artificial Sequence
  Peptide Derived from Human Papillomavirus
YLPPPSVARV

SEQ ID NO: 29482 - protein, 11 aa, Artificial Sequence
  Peptide Derived from Human Papillomavirus
YLPPPSVARVV

SEQ ID NO: 29483 - protein, 9 aa, Artificial Sequence
  Peptide Derived from Human Papillomavirus
YLQMSADPY

SEQ ID NO: 29484 - protein, 9 aa, Artificial Sequence
  Peptide Derived from Human Papillomavirus
YPDYLQMSA

SEQ ID NO: 29485 - protein, 8 aa, Artificial Sequence
  Peptide Derived from Human Papillomavirus
YPLGRKFL

SEQ ID NO: 29486 - protein, 9 aa, Artificial Sequence
  Peptide Derived from Human Papillomavirus
YPLGRKFLV

SEQ ID NO: 29487 - protein, 11 aa, Artificial Sequence
  Peptide Derived from Human Papillomavirus
YPLGRKFLVQA

SEQ ID NO: 29488 - protein, 8 aa, Artificial Sequence
  Peptide Derived from Human Papillomavirus
YQYRVFRV

SEQ ID NO: 29489 - protein, 9 aa, Artificial Sequence
  Peptide Derived from Human Papillomavirus
YQYRVFRVA

SEQ ID NO: 29490 - protein, 10 aa, Artificial Sequence
  Peptide Derived from Human Papillomavirus
YQYRVFRVAL

SEQ ID NO: 29491 - protein, 8 aa, Artificial Sequence
  Peptide Derived from Human Papillomavirus
YVSRTSIF

SEQ ID NO: 29492 - protein, 9 aa, Artificial Sequence
  Peptide Derived from Human Papillomavirus
YVSRTSIFY

SEQ ID NO: 29493 - protein, 11 aa, Artificial Sequence
  Peptide Derived from Human Papillomavirus
YVSRTSIFYHA

SEQ ID NO: 29494 - protein, 9 aa, Artificial Sequence
  Peptide Derived from Human Papillomavirus
ALSSRRGTV

SEQ ID NO: 29495 - protein, 11 aa, Artificial Sequence
  Peptide Derived from Human Papillomavirus
ALSSRRGTVRF

SEQ ID NO: 29496 - protein, 9 aa, Artificial Sequence
  Peptide Derived from Human Papillomavirus
AVLDITPTV

SEQ ID NO: 29497 - protein, 9 aa, Artificial Sequence
  Peptide Derived from Human Papillomavirus
CPPDVINKV

SEQ ID NO: 29498 - protein, 10 aa, Artificial Sequence
  Peptide Derived from Human Papillomavirus
DIILPSHTPM

SEQ ID NO: 29499 - protein, 11 aa, Artificial Sequence
  Peptide Derived from Human Papillomavirus
DIILPSHTPMW

SEQ ID NO: 29500 - protein, 9 aa, Artificial Sequence
  Peptide Derived from Human Papillomavirus
DIIRLHRPA

SEQ ID NO: 29501 - protein, 10 aa, Artificial Sequence
  Peptide Derived from Human Papillomavirus
DIIRLHRPAL

SEQ ID NO: 29502 - protein, 11 aa, Artificial Sequence
  Peptide Derived from Human Papillomavirus
DISPIAATEEI

SEQ ID NO: 29503 - protein, 9 aa, Artificial Sequence
  Peptide Derived from Human Papillomavirus
DITPTVDSV

SEQ ID NO: 29504 - protein, 11 aa, Artificial Sequence
  Peptide Derived from Human Papillomavirus
DITPTVDSVSI

SEQ ID NO: 29505 - protein, 9 aa, Artificial Sequence
  Peptide Derived from Human Papillomavirus
DLFDVYADF

SEQ ID NO: 29506 - protein, 8 aa, Artificial Sequence
  Peptide Derived from Human Papillomavirus
DPSIVTLV

SEQ ID NO: 29507 - protein, 9 aa, Artificial Sequence
  Peptide Derived from Human Papillomavirus
DVGPTRPPV

SEQ ID NO: 29508 - protein, 10 aa, Artificial Sequence
  Peptide Derived from Human Papillomavirus
DVGPTRPPVV

SEQ ID NO: 29509 - protein, 11 aa, Artificial Sequence
  Peptide Derived from Human Papillomavirus
DVGPTRPPVVI

SEQ ID NO: 29510 - protein, 11 aa, Artificial Sequence
  Peptide Derived from Human Papillomavirus
DVINKVEGTTL

SEQ ID NO: 29511 - protein, 10 aa, Artificial Sequence
  Peptide Derived from Human Papillomavirus
DVPIYTGPDI

SEQ ID NO: 29512 - protein, 11 aa, Artificial Sequence
  Peptide Derived from Human Papillomavirus
DVPIYTGPDII

SEQ ID NO: 29513 - protein, 10 aa, Artificial Sequence
  Peptide Derived from Human Papillomavirus
DVYADFPPPA

SEQ ID NO: 29514 - protein, 8 aa, Artificial Sequence
  Peptide Derived from Human Papillomavirus
EIELQPLI

SEQ ID NO: 29515 - protein, 10 aa, Artificial Sequence
  Peptide Derived from Human Papillomavirus
EIELQPLISA

SEQ ID NO: 29516 - protein, 8 aa, Artificial Sequence
  Peptide Derived from Human Papillomavirus
EIPLQTFA

SEQ ID NO: 29517 - protein, 11 aa, Artificial Sequence
  Peptide Derived from Human Papillomavirus
EITSSGTTTPA

SEQ ID NO: 29518 - protein, 8 aa, Artificial Sequence
  Peptide Derived from Human Papillomavirus
ELQPLISA

SEQ ID NO: 29519 - protein, 8 aa, Artificial Sequence
  Peptide Derived from Human Papillomavirus
EPISSTPL

SEQ ID NO: 29520 - protein, 11 aa, Artificial Sequence
  Peptide Derived from Human Papillomavirus
EPISSTPLPTV

SEQ ID NO: 29521 - protein, 9 aa, Artificial Sequence
  Peptide Derived from Human Papillomavirus
EPLDTTLSF

SEQ ID NO: 29522 - protein, 11 aa, Artificial Sequence
  Peptide Derived from Human Papillomavirus
EPTSNVPDSDF

SEQ ID NO: 29523 - protein, 10 aa, Artificial Sequence
  Peptide Derived from Human Papillomavirus
EPVGPTDPSI

SEQ ID NO: 29524 - protein, 11 aa, Artificial Sequence
  Peptide Derived from Human Papillomavirus
EPVGPTDPSIV

SEQ ID NO: 29525 - protein, 8 aa, Artificial Sequence
  Peptide Derived from Human Papillomavirus
EVPQTGEV

SEQ ID NO: 29526 - protein, 8 aa, Artificial Sequence
  Peptide Derived from Human Papillomavirus
EVSGNIFV

SEQ ID NO: 29527 - protein, 8 aa, Artificial Sequence
  Peptide Derived from Human Papillomavirus
FLTHPSSL

SEQ ID NO: 29528 - protein, 9 aa, Artificial Sequence
  Peptide Derived from Human Papillomavirus
FLTHPSSLV

SEQ ID NO: 29529 - protein, 11 aa, Artificial Sequence
  Peptide Derived from Human Papillomavirus
FLTHPSSLVTF

SEQ ID NO: 29530 - protein, 11 aa, Artificial Sequence
  Peptide Derived from Human Papillomavirus
FMDIIRLHRPA

SEQ ID NO: 29531 - protein, 8 aa, Artificial Sequence
  Peptide Derived from Human Papillomavirus
FPKKRKRI

SEQ ID NO: 29532 - protein, 10 aa, Artificial Sequence
  Peptide Derived from Human Papillomavirus
FPKKRKRIPY

SEQ ID NO: 29533 - protein, 11 aa, Artificial Sequence
  Peptide Derived from Human Papillomavirus
FPKKRKRIPYF

SEQ ID NO: 29534 - protein, 9 aa, Artificial Sequence
  Peptide Derived from Human Papillomavirus
GIFLGGLGI

SEQ ID NO: 29535 - protein, 8 aa, Artificial Sequence
  Peptide Derived from Human Papillomavirus
GIHGTQYY

SEQ ID NO: 29536 - protein, 9 aa, Artificial Sequence
  Peptide Derived from Human Papillomavirus
GIHGTQYYL

SEQ ID NO: 29537 - protein, 10 aa, Artificial Sequence
  Peptide Derived from Human Papillomavirus
GIHGTQYYLW

SEQ ID NO: 29538 - protein, 8 aa, Artificial Sequence
  Peptide Derived from Human Papillomavirus
GPRLYSRA

SEQ ID NO: 29539 - protein, 8 aa, Artificial Sequence
  Peptide Derived from Human Papillomavirus
GPTDPSIV

SEQ ID NO: 29540 - protein, 10 aa, Artificial Sequence
  Peptide Derived from Human Papillomavirus
GPTDPSIVTL

SEQ ID NO: 29541 - protein, 11 aa, Artificial Sequence
  Peptide Derived from Human Papillomavirus
GPTDPSIVTLV

SEQ ID NO: 29542 - protein, 8 aa, Artificial Sequence
  Peptide Derived from Human Papillomavirus
GPTRPPVV

SEQ ID NO: 29543 - protein, 9 aa, Artificial Sequence
  Peptide Derived from Human Papillomavirus
GPTRPPVVI

SEQ ID NO: 29544 - protein, 8 aa, Artificial Sequence
  Peptide Derived from Human Papillomavirus
HPSSLVTF

SEQ ID NO: 29545 - protein, 10 aa, Artificial Sequence
  Peptide Derived from Human Papillomavirus
IIEVPQTGEV

SEQ ID NO: 29546 - protein, 9 aa, Artificial Sequence
  Peptide Derived from Human Papillomavirus
IILPSHTPM

SEQ ID NO: 29547 - protein, 10 aa, Artificial Sequence
  Peptide Derived from Human Papillomavirus
IILPSHTPMW

SEQ ID NO: 29548 - protein, 8 aa, Artificial Sequence
  Peptide Derived from Human Papillomavirus
IIRLHRPA

SEQ ID NO: 29549 - protein, 9 aa, Artificial Sequence
  Peptide Derived from Human Papillomavirus
IIRLHRPAL

SEQ ID NO: 29550 - protein, 8 aa, Artificial Sequence
  Peptide Derived from Human Papillomavirus
ILPSHTPM

SEQ ID NO: 29551 - protein, 9 aa, Artificial Sequence
  Peptide Derived from Human Papillomavirus
ILPSHTPMW

SEQ ID NO: 29552 - protein, 9 aa, Artificial Sequence
  Peptide Derived from Human Papillomavirus
ILQWSSLGI

SEQ ID NO: 29553 - protein, 10 aa, Artificial Sequence
  Peptide Derived from Human Papillomavirus
ILQWSSLGIF

SEQ ID NO: 29554 - protein, 11 aa, Artificial Sequence
  Peptide Derived from Human Papillomavirus
ILQWSSLGIFL

SEQ ID NO: 29555 - protein, 9 aa, Artificial Sequence
  Peptide Derived from Human Papillomavirus
IPYFFADGF

SEQ ID NO: 29556 - protein, 10 aa, Artificial Sequence
  Peptide Derived from Human Papillomavirus
IPYFFADGFV

SEQ ID NO: 29557 - protein, 11 aa, Artificial Sequence
  Peptide Derived from Human Papillomavirus
IPYFFADGFVA

SEQ ID NO: 29558 - protein, 10 aa, Artificial Sequence
  Peptide Derived from Human Papillomavirus
IVTLVEDSSV

SEQ ID NO: 29559 - protein, 11 aa, Artificial Sequence
  Peptide Derived from Human Papillomavirus
IVTLVEDSSVV

SEQ ID NO: 29560 - protein, 8 aa, Artificial Sequence
  Peptide Derived from Human Papillomavirus
KILQWSSL

SEQ ID NO: 29561 - protein, 10 aa, Artificial Sequence
  Peptide Derived from Human Papillomavirus
KILQWSSLGI

SEQ ID NO: 29562 - protein, 11 aa, Artificial Sequence
  Peptide Derived from Human Papillomavirus
KILQWSSLGIF

SEQ ID NO: 29563 - protein, 9 aa, Artificial Sequence
  Peptide Derived from Human Papillomavirus
KQIGGRVHF

SEQ ID NO: 29564 - protein, 10 aa, Artificial Sequence
  Peptide Derived from Human Papillomavirus
KQIGGRVHFY

SEQ ID NO: 29565 - protein, 10 aa, Artificial Sequence
  Peptide Derived from Human Papillomavirus
KQSGTCPPDV

SEQ ID NO: 29566 - protein, 11 aa, Artificial Sequence
  Peptide Derived from Human Papillomavirus
KQSGTCPPDVI

SEQ ID NO: 29567 - protein, 8 aa, Artificial Sequence
  Peptide Derived from Human Papillomavirus
KVEGTTLA

SEQ ID NO: 29568 - protein, 11 aa, Artificial Sequence
  Peptide Derived from Human Papillomavirus
KVEGTTLADKI

SEQ ID NO: 29569 - protein, 10 aa, Artificial Sequence
  Peptide Derived from Human Papillomavirus
LISATNDSDL

SEQ ID NO: 29570 - protein, 11 aa, Artificial Sequence
  Peptide Derived from Human Papillomavirus
LISATNDSDLF

SEQ ID NO: 29571 - protein, 8 aa, Artificial Sequence
  Peptide Derived from Human Papillomavirus
LPSHTPMW

SEQ ID NO: 29572 - protein, 8 aa, Artificial Sequence
  Peptide Derived from Human Papillomavirus
LQWSSLGI

SEQ ID NO: 29573 - protein, 9 aa, Artificial Sequence
  Peptide Derived from Human Papillomavirus
LQWSSLGIF

SEQ ID NO: 29574 - protein, 10 aa, Artificial Sequence
  Peptide Derived from Human Papillomavirus
LQWSSLGIFL

SEQ ID NO: 29575 - protein, 8 aa, Artificial Sequence
  Peptide Derived from Human Papillomavirus
LVEDSSVV

SEQ ID NO: 29576 - protein, 9 aa, Artificial Sequence
  Peptide Derived from Human Papillomavirus
LVEDSSVVA

SEQ ID NO: 29577 - protein, 8 aa, Artificial Sequence
  Peptide Derived from Human Papillomavirus
LVTFDNPA

SEQ ID NO: 29578 - protein, 9 aa, Artificial Sequence
  Peptide Derived from Human Papillomavirus
LVTFDNPAY

SEQ ID NO: 29579 - protein, 9 aa, Artificial Sequence
  Peptide Derived from Human Papillomavirus
MPSTAASSY

SEQ ID NO: 29580 - protein, 9 aa, Artificial Sequence
  Peptide Derived from Human Papillomavirus
NPAFSDPSI

SEQ ID NO: 29581 - protein, 10 aa, Artificial Sequence
  Peptide Derived from Human Papillomavirus
NPAFSDPSII

SEQ ID NO: 29582 - protein, 11 aa, Artificial Sequence
  Peptide Derived from Human Papillomavirus
NPAYEPLDTTL

SEQ ID NO: 29583 - protein, 11 aa, Artificial Sequence
  Peptide Derived from Human Papillomavirus
NQQVRVSTSQF

SEQ ID NO: 29584 - protein, 8 aa, Artificial Sequence
  Peptide Derived from Human Papillomavirus
NVPDSDFM

SEQ ID NO: 29585 - protein, 10 aa, Artificial Sequence
  Peptide Derived from Human Papillomavirus
NVPDSDFMDI

SEQ ID NO: 29586 - protein, 11 aa, Artificial Sequence
  Peptide Derived from Human Papillomavirus
NVPDSDFMDII

SEQ ID NO: 29587 - protein, 9 aa, Artificial Sequence
  Peptide Derived from Human Papillomavirus
NVTVPLTSA

SEQ ID NO: 29588 - protein, 10 aa, Artificial Sequence
  Peptide Derived from Human Papillomavirus
NVTVPLTSAW

SEQ ID NO: 29589 - protein, 8 aa, Artificial Sequence
  Peptide Derived from Human Papillomavirus
PIAATEEI

SEQ ID NO: 29590 - protein, 10 aa, Artificial Sequence
  Peptide Derived from Human Papillomavirus
PIAATEEIEL

SEQ ID NO: 29591 - protein, 10 aa, Artificial Sequence
  Peptide Derived from Human Papillomavirus
PISSTPLPTV

SEQ ID NO: 29592 - protein, 8 aa, Artificial Sequence
  Peptide Derived from Human Papillomavirus
PIYTGPDI

SEQ ID NO: 29593 - protein, 9 aa, Artificial Sequence
  Peptide Derived from Human Papillomavirus
PIYTGPDII

SEQ ID NO: 29594 - protein, 10 aa, Artificial Sequence
  Peptide Derived from Human Papillomavirus
PIYTGPDIIL

SEQ ID NO: 29595 - protein, 8 aa, Artificial Sequence
  Peptide Derived from Human Papillomavirus
PLDTTLSF

SEQ ID NO: 29596 - protein, 9 aa, Artificial Sequence
  Peptide Derived from Human Papillomavirus
PLGGRSNTV

SEQ ID NO: 29597 - protein, 10 aa, Artificial Sequence
  Peptide Derived from Human Papillomavirus
PLGGRSNTVV

SEQ ID NO: 29598 - protein, 11 aa, Artificial Sequence
  Peptide Derived from Human Papillomavirus
PLISATNDSDL

SEQ ID NO: 29599 - protein, 8 aa, Artificial Sequence
  Peptide Derived from Human Papillomavirus
PLPTVRRV

SEQ ID NO: 29600 - protein, 8 aa, Artificial Sequence
  Peptide Derived from Human Papillomavirus
PLTSAWDV

SEQ ID NO: 29601 - protein, 10 aa, Artificial Sequence
  Peptide Derived from Human Papillomavirus
PLTSAWDVPI

SEQ ID NO: 29602 - protein, 11 aa, Artificial Sequence
  Peptide Derived from Human Papillomavirus
PLTSAWDVPIY

SEQ ID NO: 29603 - protein, 11 aa, Artificial Sequence
  Peptide Derived from Human Papillomavirus
PMWPSTSPTNA

SEQ ID NO: 29604 - protein, 10 aa, Artificial Sequence
  Peptide Derived from Human Papillomavirus
PPASTTPSTI

SEQ ID NO: 29605 - protein, 8 aa, Artificial Sequence
  Peptide Derived from Human Papillomavirus
PPDVINKV

SEQ ID NO: 29606 - protein, 11 aa, Artificial Sequence
  Peptide Derived from Human Papillomavirus
PPPASTTPSTI

SEQ ID NO: 29607 - protein, 8 aa, Artificial Sequence
  Peptide Derived from Human Papillomavirus
PPVVIEPV

SEQ ID NO: 29608 - protein, 10 aa, Artificial Sequence
  Peptide Derived from Human Papillomavirus
PQTGEVSGNI

SEQ ID NO: 29609 - protein, 11 aa, Artificial Sequence
  Peptide Derived from Human Papillomavirus
PQTGEVSGNIF

SEQ ID NO: 29610 - protein, 9 aa, Artificial Sequence
  Peptide Derived from Human Papillomavirus
PVGPTDPSI

SEQ ID NO: 29611 - protein, 10 aa, Artificial Sequence
  Peptide Derived from Human Papillomavirus
PVGPTDPSIV

SEQ ID NO: 29612 - protein, 11 aa, Artificial Sequence
  Peptide Derived from Human Papillomavirus
PVPTFTGTSGF

SEQ ID NO: 29613 - protein, 8 aa, Artificial Sequence
  Peptide Derived from Human Papillomavirus
QIGGRVHF

SEQ ID NO: 29614 - protein, 9 aa, Artificial Sequence
  Peptide Derived from Human Papillomavirus
QIGGRVHFY

SEQ ID NO: 29615 - protein, 10 aa, Artificial Sequence
  Peptide Derived from Human Papillomavirus
QQVRVSTSQF

SEQ ID NO: 29616 - protein, 11 aa, Artificial Sequence
  Peptide Derived from Human Papillomavirus
QQVRVSTSQFL

SEQ ID NO: 29617 - protein, 9 aa, Artificial Sequence
  Peptide Derived from Human Papillomavirus
QVRVSTSQF

SEQ ID NO: 29618 - protein, 10 aa, Artificial Sequence
  Peptide Derived from Human Papillomavirus
QVRVSTSQFL

SEQ ID NO: 29619 - protein, 10 aa, Artificial Sequence
  Peptide Derived from Human Papillomavirus
RIPYFFADGF

SEQ ID NO: 29620 - protein, 11 aa, Artificial Sequence
  Peptide Derived from Human Papillomavirus
RIPYFFADGFV

SEQ ID NO: 29621 - protein, 8 aa, Artificial Sequence
  Peptide Derived from Human Papillomavirus
RLGQRATM

SEQ ID NO: 29622 - protein, 9 aa, Artificial Sequence
  Peptide Derived from Human Papillomavirus
RLGQRATMF

SEQ ID NO: 29623 - protein, 10 aa, Artificial Sequence
  Peptide Derived from Human Papillomavirus
RLYSRANQQV

SEQ ID NO: 29624 - protein, 11 aa, Artificial Sequence
  Peptide Derived from Human Papillomavirus
RPALSSRRGTV

SEQ ID NO: 29625 - protein, 9 aa, Artificial Sequence
  Peptide Derived from Human Papillomavirus
RPPVVIEPV

SEQ ID NO: 29626 - protein, 8 aa, Artificial Sequence
  Peptide Derived from Human Papillomavirus
RVHFYHDI

SEQ ID NO: 29627 - protein, 11 aa, Artificial Sequence
  Peptide Derived from Human Papillomavirus
RVHFYHDISPI

SEQ ID NO: 29628 - protein, 8 aa, Artificial Sequence
  Peptide Derived from Human Papillomavirus
RVRGPRLY

SEQ ID NO: 29629 - protein, 11 aa, Artificial Sequence
  Peptide Derived from Human Papillomavirus
RVRGPRLYSRA

SEQ ID NO: 29630 - protein, 8 aa, Artificial Sequence
  Peptide Derived from Human Papillomavirus
RVSTSQFL

SEQ ID NO: 29631 - protein, 11 aa, Artificial Sequence
  Peptide Derived from Human Papillomavirus
SIIEVPQTGEV

SEQ ID NO: 29632 - protein, 11 aa, Artificial Sequence
  Peptide Derived from Human Papillomavirus
SISSTSFTNPA

SEQ ID NO: 29633 - protein, 11 aa, Artificial Sequence
  Peptide Derived from Human Papillomavirus
SIVTLVEDSSV

SEQ ID NO: 29634 - protein, 9 aa, Artificial Sequence
  Peptide Derived from Human Papillomavirus
SLGIFLGGL

SEQ ID NO: 29635 - protein, 11 aa, Artificial Sequence
  Peptide Derived from Human Papillomavirus
SLGIFLGGLGI

SEQ ID NO: 29636 - protein, 8 aa, Artificial Sequence
  Peptide Derived from Human Papillomavirus
SLTMPSTA

SEQ ID NO: 29637 - protein, 9 aa, Artificial Sequence
  Peptide Derived from Human Papillomavirus
SLTMPSTAA

SEQ ID NO: 29638 - protein, 9 aa, Artificial Sequence
  Peptide Derived from Human Papillomavirus
SLVTFDNPA

SEQ ID NO: 29639 - protein, 10 aa, Artificial Sequence
  Peptide Derived from Human Papillomavirus
SLVTFDNPAY

SEQ ID NO: 29640 - protein, 9 aa, Artificial Sequence
  Peptide Derived from Human Papillomavirus
SPIAATEEI

SEQ ID NO: 29641 - protein, 11 aa, Artificial Sequence
  Peptide Derived from Human Papillomavirus
SPIAATEEIEL

SEQ ID NO: 29642 - protein, 10 aa, Artificial Sequence
  Peptide Derived from Human Papillomavirus
SPTNASTTTY

SEQ ID NO: 29643 - protein, 11 aa, Artificial Sequence
  Peptide Derived from Human Papillomavirus
SPTNASTTTYI

SEQ ID NO: 29644 - protein, 10 aa, Artificial Sequence
  Peptide Derived from Human Papillomavirus
SQFLTHPSSL

SEQ ID NO: 29645 - protein, 11 aa, Artificial Sequence
  Peptide Derived from Human Papillomavirus
SQFLTHPSSLV

SEQ ID NO: 29646 - protein, 9 aa, Artificial Sequence
  Peptide Derived from Human Papillomavirus
SVSISSTSF

SEQ ID NO: 29647 - protein, 9 aa, Artificial Sequence
  Peptide Derived from Human Papillomavirus
SVVASGAPV

SEQ ID NO: 29648 - protein, 8 aa, Artificial Sequence
  Peptide Derived from Human Papillomavirus
TIHKSFTY

SEQ ID NO: 29649 - protein, 11 aa, Artificial Sequence
  Peptide Derived from Human Papillomavirus
TIHKSFTYPKY

SEQ ID NO: 29650 - protein, 9 aa, Artificial Sequence
  Peptide Derived from Human Papillomavirus
TLADKILQW

SEQ ID NO: 29651 - protein, 10 aa, Artificial Sequence
  Peptide Derived from Human Papillomavirus
TLSFEPTSNV

SEQ ID NO: 29652 - protein, 8 aa, Artificial Sequence
  Peptide Derived from Human Papillomavirus
TLVEDSSV

SEQ ID NO: 29653 - protein, 9 aa, Artificial Sequence
  Peptide Derived from Human Papillomavirus
TLVEDSSVV

SEQ ID NO: 29654 - protein, 10 aa, Artificial Sequence
  Peptide Derived from Human Papillomavirus
TLVEDSSVVA

SEQ ID NO: 29655 - protein, 10 aa, Artificial Sequence
  Peptide Derived from Human Papillomavirus
TMFTRSGKQI

SEQ ID NO: 29656 - protein, 10 aa, Artificial Sequence
  Peptide Derived from Human Papillomavirus
TMPSTAASSY

SEQ ID NO: 29657 - protein, 11 aa, Artificial Sequence
  Peptide Derived from Human Papillomavirus
TPAVLDITPTV

SEQ ID NO: 29658 - protein, 9 aa, Artificial Sequence
  Peptide Derived from Human Papillomavirus
TPLPTVRRV

SEQ ID NO: 29659 - protein, 9 aa, Artificial Sequence
  Peptide Derived from Human Papillomavirus
TPSTIHKSF

SEQ ID NO: 29660 - protein, 11 aa, Artificial Sequence
  Peptide Derived from Human Papillomavirus
TPSTIHKSFTY

SEQ ID NO: 29661 - protein, 9 aa, Artificial Sequence
  Peptide Derived from Human Papillomavirus
TPTSGSHGY

SEQ ID NO: 29662 - protein, 9 aa, Artificial Sequence
  Peptide Derived from Human Papillomavirus
TPTVDSVSI

SEQ ID NO: 29663 - protein, 8 aa, Artificial Sequence
  Peptide Derived from Human Papillomavirus
TQYYLWPW

SEQ ID NO: 29664 - protein, 9 aa, Artificial Sequence
  Peptide Derived from Human Papillomavirus
TQYYLWPWY

SEQ ID NO: 29665 - protein, 10 aa, Artificial Sequence
  Peptide Derived from Human Papillomavirus
TQYYLWPWYY

SEQ ID NO: 29666 - protein, 11 aa, Artificial Sequence
  Peptide Derived from Human Papillomavirus
TQYYLWPWYYY

SEQ ID NO: 29667 - protein, 8 aa, Artificial Sequence
  Peptide Derived from Human Papillomavirus
TVPLTSAW

SEQ ID NO: 29668 - protein, 10 aa, Artificial Sequence
  Peptide Derived from Human Papillomavirus
TVPLTSAWDV

SEQ ID NO: 29669 - protein, 11 aa, Artificial Sequence
  Peptide Derived from Human Papillomavirus
TVRFSRLGQRA

SEQ ID NO: 29670 - protein, 10 aa, Artificial Sequence
  Peptide Derived from Human Papillomavirus
TVRRVRGPRL

SEQ ID NO: 29671 - protein, 11 aa, Artificial Sequence
  Peptide Derived from Human Papillomavirus
TVRRVRGPRLY

SEQ ID NO: 29672 - protein, 10 aa, Artificial Sequence
  Peptide Derived from Human Papillomavirus
VINKVEGTTL

SEQ ID NO: 29673 - protein, 11 aa, Artificial Sequence
  Peptide Derived from Human Papillomavirus
VINKVEGTTLA

SEQ ID NO: 29674 - protein, 8 aa, Artificial Sequence
  Peptide Derived from Human Papillomavirus
VLDITPTV

SEQ ID NO: 29675 - protein, 11 aa, Artificial Sequence
  Peptide Derived from Human Papillomavirus
VLDITPTVDSV

SEQ ID NO: 29676 - protein, 9 aa, Artificial Sequence
  Peptide Derived from Human Papillomavirus
VPDSDFMDI

SEQ ID NO: 29677 - protein, 10 aa, Artificial Sequence
  Peptide Derived from Human Papillomavirus
VPDSDFMDII

SEQ ID NO: 29678 - protein, 9 aa, Artificial Sequence
  Peptide Derived from Human Papillomavirus
VPIYTGPDI

SEQ ID NO: 29679 - protein, 10 aa, Artificial Sequence
  Peptide Derived from Human Papillomavirus
VPIYTGPDII

SEQ ID NO: 29680 - protein, 11 aa, Artificial Sequence
  Peptide Derived from Human Papillomavirus
VPIYTGPDIIL

SEQ ID NO: 29681 - protein, 10 aa, Artificial Sequence
  Peptide Derived from Human Papillomavirus
VPLGGRSNTV

SEQ ID NO: 29682 - protein, 11 aa, Artificial Sequence
  Peptide Derived from Human Papillomavirus
VPLGGRSNTVV

SEQ ID NO: 29683 - protein, 9 aa, Artificial Sequence
  Peptide Derived from Human Papillomavirus
VPLTSAWDV

SEQ ID NO: 29684 - protein, 11 aa, Artificial Sequence
  Peptide Derived from Human Papillomavirus
VPLTSAWDVPI

SEQ ID NO: 29685 - protein, 11 aa, Artificial Sequence
  Peptide Derived from Human Papillomavirus
VPQTGEVSGNI

SEQ ID NO: 29686 - protein, 10 aa, Artificial Sequence
  Peptide Derived from Human Papillomavirus
VPTFTGTSGF

SEQ ID NO: 29687 - protein, 8 aa, Artificial Sequence
  Peptide Derived from Human Papillomavirus
VVASGAPV

SEQ ID NO: 29688 - protein, 11 aa, Artificial Sequence
  Peptide Derived from Human Papillomavirus
VVASGAPVPTF

SEQ ID NO: 29689 - protein, 11 aa, Artificial Sequence
  Peptide Derived from Human Papillomavirus
VVDVGPTRPPV

SEQ ID NO: 29690 - protein, 9 aa, Artificial Sequence
  Peptide Derived from Human Papillomavirus
WPSTSPTNA

SEQ ID NO: 29691 - protein, 9 aa, Artificial Sequence
  Peptide Derived from Human Papillomavirus
YIGIHGTQY

SEQ ID NO: 29692 - protein, 10 aa, Artificial Sequence
  Peptide Derived from Human Papillomavirus
YIGIHGTQYY

SEQ ID NO: 29693 - protein, 11 aa, Artificial Sequence
  Peptide Derived from Human Papillomavirus
YIGIHGTQYYL

SEQ ID NO: 29694 - protein, 8 aa, Artificial Sequence
  Peptide Derived from Human Papillomavirus
YLWPWYYY

SEQ ID NO: 29695 - protein, 9 aa, Artificial Sequence
  Peptide Derived from Human Papillomavirus
YLWPWYYYF

SEQ ID NO: 29696 - protein, 8 aa, Artificial Sequence
  Peptide Derived from Human Papillomavirus
YPKYSLTM

SEQ ID NO: 29697 - protein, 11 aa, Artificial Sequence
  Peptide Derived from Human Papillomavirus
YVPLGGRSNTV

SEQ ID NO: 29698 - protein, 8 aa, Artificial Sequence
  Peptide Derived from Human Papillomavirus
AIEVQIAL

SEQ ID NO: 29699 - protein, 11 aa, Artificial Sequence
  Peptide Derived from Human Papillomavirus
AIEVQIALESL

SEQ ID NO: 29700 - protein, 9 aa, Artificial Sequence
  Peptide Derived from Human Papillomavirus
ALESLSTTI

SEQ ID NO: 29701 - protein, 10 aa, Artificial Sequence
  Peptide Derived from Human Papillomavirus
ALESLSTTIY

SEQ ID NO: 29702 - protein, 9 aa, Artificial Sequence
  Peptide Derived from Human Papillomavirus
CLQVCKAKA

SEQ ID NO: 29703 - protein, 9 aa, Artificial Sequence
  Peptide Derived from Human Papillomavirus
CMQYVAWKY

SEQ ID NO: 29704 - protein, 10 aa, Artificial Sequence
  Peptide Derived from Human Papillomavirus
CMQYVAWKYI

SEQ ID NO: 29705 - protein, 11 aa, Artificial Sequence
  Peptide Derived from Human Papillomavirus
CMQYVAWKYIY

SEQ ID NO: 29706 - protein, 11 aa, Artificial Sequence
  Peptide Derived from Human Papillomavirus
CPDSVSSTCRY

SEQ ID NO: 29707 - protein, 8 aa, Artificial Sequence
  Peptide Derived from Human Papillomavirus
CVTTHTHI

SEQ ID NO: 29708 - protein, 8 aa, Artificial Sequence
  Peptide Derived from Human Papillomavirus
DVTSTYHW

SEQ ID NO: 29709 - protein, 11 aa, Artificial Sequence
  Peptide Derived from Human Papillomavirus
ELWLTEPKKCF

SEQ ID NO: 29710 - protein, 10 aa, Artificial Sequence
  Peptide Derived from Human Papillomavirus
EPNRLKCCRY

SEQ ID NO: 29711 - protein, 9 aa, Artificial Sequence
  Peptide Derived from Human Papillomavirus
EVHMENESI

SEQ ID NO: 29712 - protein, 10 aa, Artificial Sequence
  Peptide Derived from Human Papillomavirus
EVHMENESIY

SEQ ID NO: 29713 - protein, 9 aa, Artificial Sequence
  Peptide Derived from Human Papillomavirus
EVQIALESL

SEQ ID NO: 29714 - protein, 9 aa, Artificial Sequence
  Peptide Derived from Human Papillomavirus
FLSHVKIPV

SEQ ID NO: 29715 - protein, 10 aa, Artificial Sequence
  Peptide Derived from Human Papillomavirus
FLSHVKIPVV

SEQ ID NO: 29716 - protein, 11 aa, Artificial Sequence
  Peptide Derived from Human Papillomavirus
FLSHVKIPVVY

SEQ ID NO: 29717 - protein, 8 aa, Artificial Sequence
  Peptide Derived from Human Papillomavirus
FQKYKTLF

SEQ ID NO: 29718 - protein, 9 aa, Artificial Sequence
  Peptide Derived from Human Papillomavirus
FQKYKTLFV

SEQ ID NO: 29719 - protein, 11 aa, Artificial Sequence
  Peptide Derived from Human Papillomavirus
FQKYKTLFVDV

SEQ ID NO: 29720 - protein, 8 aa, Artificial Sequence
  Peptide Derived from Human Papillomavirus
FVDVTSTY

SEQ ID NO: 29721 - protein, 10 aa, Artificial Sequence
  Peptide Derived from Human Papillomavirus
FVDVTSTYHW

SEQ ID NO: 29722 - protein, 8 aa, Artificial Sequence
  Peptide Derived from Human Papillomavirus
GQHIEVWF

SEQ ID NO: 29723 - protein, 8 aa, Artificial Sequence
  Peptide Derived from Human Papillomavirus
GVDYRGIY

SEQ ID NO: 29724 - protein, 9 aa, Artificial Sequence
  Peptide Derived from Human Papillomavirus
GVDYRGIYY

SEQ ID NO: 29725 - protein, 10 aa, Artificial Sequence
  Peptide Derived from Human Papillomavirus
GVDYRGIYYV

SEQ ID NO: 29726 - protein, 9 aa, Artificial Sequence
  Peptide Derived from Human Papillomavirus
HLKGEPNRL

SEQ ID NO: 29727 - protein, 8 aa, Artificial Sequence
  Peptide Derived from Human Papillomavirus
HMENESIY

SEQ ID NO: 29728 - protein, 9 aa, Artificial Sequence
  Peptide Derived from Human Papillomavirus
HPGDKTTPV

SEQ ID NO: 29729 - protein, 10 aa, Artificial Sequence
  Peptide Derived from Human Papillomavirus
HPGDKTTPVV

SEQ ID NO: 29730 - protein, 8 aa, Artificial Sequence
  Peptide Derived from Human Papillomavirus
HVKIPVVY

SEQ ID NO: 29731 - protein, 10 aa, Artificial Sequence
  Peptide Derived from Human Papillomavirus
HVKIPVVYRL

SEQ ID NO: 29732 - protein, 11 aa, Artificial Sequence
  Peptide Derived from Human Papillomavirus
HVKIPVVYRLV

SEQ ID NO: 29733 - protein, 8 aa, Artificial Sequence
  Peptide Derived from Human Papillomavirus
IPVVYRLV

SEQ ID NO: 29734 - protein, 9 aa, Artificial Sequence
  Peptide Derived from Human Papillomavirus
IPVVYRLVW

SEQ ID NO: 29735 - protein, 8 aa, Artificial Sequence
  Peptide Derived from Human Papillomavirus
KIPVVYRL

SEQ ID NO: 29736 - protein, 9 aa, Artificial Sequence
  Peptide Derived from Human Papillomavirus
KIPVVYRLV

SEQ ID NO: 29737 - protein, 10 aa, Artificial Sequence
  Peptide Derived from Human Papillomavirus
KIPVVYRLVW

SEQ ID NO: 29738 - protein, 8 aa, Artificial Sequence
  Peptide Derived from Human Papillomavirus
KVCSGVDY

SEQ ID NO: 29739 - protein, 11 aa, Artificial Sequence
  Peptide Derived from Human Papillomavirus
KVCSGVDYRGI

SEQ ID NO: 29740 - protein, 8 aa, Artificial Sequence
  Peptide Derived from Human Papillomavirus
LQVCKAKA

SEQ ID NO: 29741 - protein, 11 aa, Artificial Sequence
  Peptide Derived from Human Papillomavirus
LQVCKAKACSA

SEQ ID NO: 29742 - protein, 8 aa, Artificial Sequence
  Peptide Derived from Human Papillomavirus
MQYVAWKY

SEQ ID NO: 29743 - protein, 9 aa, Artificial Sequence
  Peptide Derived from Human Papillomavirus
MQYVAWKYI

SEQ ID NO: 29744 - protein, 10 aa, Artificial Sequence
  Peptide Derived from Human Papillomavirus
MQYVAWKYIY

SEQ ID NO: 29745 - protein, 11 aa, Artificial Sequence
  Peptide Derived from Human Papillomavirus
MQYVAWKYIYY

SEQ ID NO: 29746 - protein, 10 aa, Artificial Sequence
  Peptide Derived from Human Papillomavirus
MVPCLQVCKA

SEQ ID NO: 29747 - protein, 8 aa, Artificial Sequence
  Peptide Derived from Human Papillomavirus
NVSPVETV

SEQ ID NO: 29748 - protein, 11 aa, Artificial Sequence
  Peptide Derived from Human Papillomavirus
NVSPVETVNEY

SEQ ID NO: 29749 - protein, 8 aa, Artificial Sequence
  Peptide Derived from Human Papillomavirus
PVETVNEY

SEQ ID NO: 29750 - protein, 8 aa, Artificial Sequence
  Peptide Derived from Human Papillomavirus
PVVYRLVW

SEQ ID NO: 29751 - protein, 11 aa, Artificial Sequence
  Peptide Derived from Human Papillomavirus
QIALESLSTTI

SEQ ID NO: 29752 - protein, 10 aa, Artificial Sequence
  Peptide Derived from Human Papillomavirus
QVCKAKACSA

SEQ ID NO: 29753 - protein, 11 aa, Artificial Sequence
  Peptide Derived from Human Papillomavirus
QVCKAKACSAI

SEQ ID NO: 29754 - protein, 9 aa, Artificial Sequence
  Peptide Derived from Human Papillomavirus
RLKCCRYRF

SEQ ID NO: 29755 - protein, 8 aa, Artificial Sequence
  Peptide Derived from Human Papillomavirus
RPGKRPRL

SEQ ID NO: 29756 - protein, 9 aa, Artificial Sequence
  Peptide Derived from Human Papillomavirus
RPRLRESEF

SEQ ID NO: 29757 - protein, 8 aa, Artificial Sequence
  Peptide Derived from Human Papillomavirus
SIYCPDSV

SEQ ID NO: 29758 - protein, 9 aa, Artificial Sequence
  Peptide Derived from Human Papillomavirus
SPVETVNEY

SEQ ID NO: 29759 - protein, 8 aa, Artificial Sequence
  Peptide Derived from Human Papillomavirus
SVGNQDAA

SEQ ID NO: 29760 - protein, 9 aa, Artificial Sequence
  Peptide Derived from Human Papillomavirus
SVGNQDAAV

SEQ ID NO: 29761 - protein, 8 aa, Artificial Sequence
  Peptide Derived from Human Papillomavirus
SVSSTCRY

SEQ ID NO: 29762 - protein, 10 aa, Artificial Sequence
  Peptide Derived from Human Papillomavirus
SVSSTCRYNV

SEQ ID NO: 29763 - protein, 8 aa, Artificial Sequence
  Peptide Derived from Human Papillomavirus
TIYNNEEW

SEQ ID NO: 29764 - protein, 10 aa, Artificial Sequence
  Peptide Derived from Human Papillomavirus
TIYNNEEWTL

SEQ ID NO: 29765 - protein, 10 aa, Artificial Sequence
  Peptide Derived from Human Papillomavirus
TLFVDVTSTY

SEQ ID NO: 29766 - protein, 9 aa, Artificial Sequence
  Peptide Derived from Human Papillomavirus
TLRDTCEEL

SEQ ID NO: 29767 - protein, 10 aa, Artificial Sequence
  Peptide Derived from Human Papillomavirus
TLRDTCEELW

SEQ ID NO: 29768 - protein, 11 aa, Artificial Sequence
  Peptide Derived from Human Papillomavirus
TLRDTCEELWL

SEQ ID NO: 29769 - protein, 10 aa, Artificial Sequence
  Peptide Derived from Human Papillomavirus
TQRNSFLSHV

SEQ ID NO: 29770 - protein, 9 aa, Artificial Sequence
  Peptide Derived from Human Papillomavirus
VPCLQVCKA

SEQ ID NO: 29771 - protein, 11 aa, Artificial Sequence
  Peptide Derived from Human Papillomavirus
VPCLQVCKAKA

SEQ ID NO: 29772 - protein, 8 aa, Artificial Sequence
  Peptide Derived from Human Papillomavirus
VQIALESL

SEQ ID NO: 29773 - protein, 11 aa, Artificial Sequence
  Peptide Derived from Human Papillomavirus
VVHLKGEPNRL

SEQ ID NO: 29774 - protein, 9 aa, Artificial Sequence
  Peptide Derived from Human Papillomavirus
WLTEPKKCF

SEQ ID NO: 29775 - protein, 8 aa, Artificial Sequence
  Peptide Derived from Human Papillomavirus
WQKVCSGV

SEQ ID NO: 29776 - protein, 10 aa, Artificial Sequence
  Peptide Derived from Human Papillomavirus
WQKVCSGVDY

SEQ ID NO: 29777 - protein, 10 aa, Artificial Sequence
  Peptide Derived from Human Papillomavirus
YIYYNGDCGW

SEQ ID NO: 29778 - protein, 8 aa, Artificial Sequence
  Peptide Derived from Human Papillomavirus
YVAWKYIY

SEQ ID NO: 29779 - protein, 9 aa, Artificial Sequence
  Peptide Derived from Human Papillomavirus
YVAWKYIYY

SEQ ID NO: 29780 - protein, 9 aa, Artificial Sequence
  Peptide Derived from Human Papillomavirus
YVHDGHKTY

SEQ ID NO: 29781 - protein, 10 aa, Artificial Sequence
  Peptide Derived from Human Papillomavirus
YVHDGHKTYY

SEQ ID NO: 29782 - protein, 8 aa, Artificial Sequence
  Peptide Derived from Human Papillomavirus
AVCRVCLL

SEQ ID NO: 29783 - protein, 9 aa, Artificial Sequence
  Peptide Derived from Human Papillomavirus
AVCRVCLLF

SEQ ID NO: 29784 - protein, 10 aa, Artificial Sequence
  Peptide Derived from Human Papillomavirus
AVCRVCLLFY

SEQ ID NO: 29785 - protein, 8 aa, Artificial Sequence
  Peptide Derived from Human Papillomavirus
CLLFYSKV

SEQ ID NO: 29786 - protein, 11 aa, Artificial Sequence
  Peptide Derived from Human Papillomavirus
CLLFYSKVRKY

SEQ ID NO: 29787 - protein, 8 aa, Artificial Sequence
  Peptide Derived from Human Papillomavirus
CVYCKKEL

SEQ ID NO: 29788 - protein, 11 aa, Artificial Sequence
  Peptide Derived from Human Papillomavirus
CVYCKKELTRA

SEQ ID NO: 29789 - protein, 8 aa, Artificial Sequence
  Peptide Derived from Human Papillomavirus
DLRLSCVY

SEQ ID NO: 29790 - protein, 9 aa, Artificial Sequence
  Peptide Derived from Human Papillomavirus
EIPLIDLRL

SEQ ID NO: 29791 - protein, 10 aa, Artificial Sequence
  Peptide Derived from Human Papillomavirus
ELKLVYRDDF

SEQ ID NO: 29792 - protein, 8 aa, Artificial Sequence
  Peptide Derived from Human Papillomavirus
ELTRAEVY

SEQ ID NO: 29793 - protein, 10 aa, Artificial Sequence
  Peptide Derived from Human Papillomavirus
ELTRAEVYNF

SEQ ID NO: 29794 - protein, 11 aa, Artificial Sequence
  Peptide Derived from Human Papillomavirus
ELTRAEVYNFA

SEQ ID NO: 29795 - protein, 8 aa, Artificial Sequence
  Peptide Derived from Human Papillomavirus
EVLEIPLI

SEQ ID NO: 29796 - protein, 10 aa, Artificial Sequence
  Peptide Derived from Human Papillomavirus
EVLEIPLIDL

SEQ ID NO: 29797 - protein, 10 aa, Artificial Sequence
  Peptide Derived from Human Papillomavirus
EVYNFACTEL

SEQ ID NO: 29798 - protein, 8 aa, Artificial Sequence
  Peptide Derived from Human Papillomavirus
FPYAVCRV

SEQ ID NO: 29799 - protein, 10 aa, Artificial Sequence
  Peptide Derived from Human Papillomavirus
FPYAVCRVCL

SEQ ID NO: 29800 - protein, 11 aa, Artificial Sequence
  Peptide Derived from Human Papillomavirus
FPYAVCRVCLL

SEQ ID NO: 29801 - protein, 8 aa, Artificial Sequence
  Peptide Derived from Human Papillomavirus
HLSEVLEI

SEQ ID NO: 29802 - protein, 10 aa, Artificial Sequence
  Peptide Derived from Human Papillomavirus
HLSEVLEIPL

SEQ ID NO: 29803 - protein, 11 aa, Artificial Sequence
  Peptide Derived from Human Papillomavirus
HLSEVLEIPLI

SEQ ID NO: 29804 - protein, 8 aa, Artificial Sequence
  Peptide Derived from Human Papillomavirus
IPLIDLRL

SEQ ID NO: 29805 - protein, 11 aa, Artificial Sequence
  Peptide Derived from Human Papillomavirus
IPLIDLRLSCV

SEQ ID NO: 29806 - protein, 8 aa, Artificial Sequence
  Peptide Derived from Human Papillomavirus
KLVYRDDF

SEQ ID NO: 29807 - protein, 10 aa, Artificial Sequence
  Peptide Derived from Human Papillomavirus
KLVYRDDFPY

SEQ ID NO: 29808 - protein, 11 aa, Artificial Sequence
  Peptide Derived from Human Papillomavirus
KLVYRDDFPYA

SEQ ID NO: 29809 - protein, 8 aa, Artificial Sequence
  Peptide Derived from Human Papillomavirus
KQLCDLLI

SEQ ID NO: 29810 - protein, 11 aa, Artificial Sequence
  Peptide Derived from Human Papillomavirus
KQLCDLLIRCY

SEQ ID NO: 29811 - protein, 11 aa, Artificial Sequence
  Peptide Derived from Human Papillomavirus
KQLHCDRKRRF

SEQ ID NO: 29812 - protein, 8 aa, Artificial Sequence
  Peptide Derived from Human Papillomavirus
KVRKYRYY

SEQ ID NO: 29813 - protein, 10 aa, Artificial Sequence
  Peptide Derived from Human Papillomavirus
KVRKYRYYDY

SEQ ID NO: 29814 - protein, 11 aa, Artificial Sequence
  Peptide Derived from Human Papillomavirus
LIAHGWTGSCL

SEQ ID NO: 29815 - protein, 9 aa, Artificial Sequence
  Peptide Derived from Human Papillomavirus
LIDLRLSCV

SEQ ID NO: 29816 - protein, 10 aa, Artificial Sequence
  Peptide Derived from Human Papillomavirus
LIDLRLSCVY

SEQ ID NO: 29817 - protein, 11 aa, Artificial Sequence
  Peptide Derived from Human Papillomavirus
LIRCYRCQSPL

SEQ ID NO: 29818 - protein, 10 aa, Artificial Sequence
  Peptide Derived from Human Papillomavirus
LLFYSKVRKY

SEQ ID NO: 29819 - protein, 9 aa, Artificial Sequence
  Peptide Derived from Human Papillomavirus
LVYRDDFPY

SEQ ID NO: 29820 - protein, 10 aa, Artificial Sequence
  Peptide Derived from Human Papillomavirus
LVYRDDFPYA

SEQ ID NO: 29821 - protein, 11 aa, Artificial Sequence
  Peptide Derived from Human Papillomavirus
LVYRDDFPYAV

SEQ ID NO: 29822 - protein, 9 aa, Artificial Sequence
  Peptide Derived from Human Papillomavirus
NPQERPRSL

SEQ ID NO: 29823 - protein, 10 aa, Artificial Sequence
  Peptide Derived from Human Papillomavirus
PLIDLRLSCV

SEQ ID NO: 29824 - protein, 11 aa, Artificial Sequence
  Peptide Derived from Human Papillomavirus
PLIDLRLSCVY

SEQ ID NO: 29825 - protein, 9 aa, Artificial Sequence
  Peptide Derived from Human Papillomavirus
PLTPEEKQL

SEQ ID NO: 29826 - protein, 8 aa, Artificial Sequence
  Peptide Derived from Human Papillomavirus
PQERPRSL

SEQ ID NO: 29827 - protein, 11 aa, Artificial Sequence
  Peptide Derived from Human Papillomavirus
PQERPRSLHHL

SEQ ID NO: 29828 - protein, 10 aa, Artificial Sequence
  Peptide Derived from Human Papillomavirus
QLCDLLIRCY

SEQ ID NO: 29829 - protein, 10 aa, Artificial Sequence
  Peptide Derived from Human Papillomavirus
QLHCDRKRRF

SEQ ID NO: 29830 - protein, 11 aa, Artificial Sequence
  Peptide Derived from Human Papillomavirus
RLSCVYCKKEL

SEQ ID NO: 29831 - protein, 8 aa, Artificial Sequence
  Peptide Derived from Human Papillomavirus
RPRSLHHL

SEQ ID NO: 29832 - protein, 11 aa, Artificial Sequence
  Peptide Derived from Human Papillomavirus
RPRSLHHLSEV

SEQ ID NO: 29833 - protein, 10 aa, Artificial Sequence
  Peptide Derived from Human Papillomavirus
RVCLLFYSKV

SEQ ID NO: 29834 - protein, 10 aa, Artificial Sequence
  Peptide Derived from Human Papillomavirus
SITKKQLCDL

SEQ ID NO: 29835 - protein, 11 aa, Artificial Sequence
  Peptide Derived from Human Papillomavirus
SITKKQLCDLL

SEQ ID NO: 29836 - protein, 8 aa, Artificial Sequence
  Peptide Derived from Human Papillomavirus
SLHHLSEV

SEQ ID NO: 29837 - protein, 9 aa, Artificial Sequence
  Peptide Derived from Human Papillomavirus
SLHHLSEVL

SEQ ID NO: 29838 - protein, 11 aa, Artificial Sequence
  Peptide Derived from Human Papillomavirus
SLHHLSEVLEI

SEQ ID NO: 29839 - protein, 10 aa, Artificial Sequence
  Peptide Derived from Human Papillomavirus
SPLTPEEKQL

SEQ ID NO: 29840 - protein, 10 aa, Artificial Sequence
  Peptide Derived from Human Papillomavirus
SVYGATLESI

SEQ ID NO: 29841 - protein, 10 aa, Artificial Sequence
  Peptide Derived from Human Papillomavirus
TLESITKKQL

SEQ ID NO: 29842 - protein, 9 aa, Artificial Sequence
  Peptide Derived from Human Papillomavirus
VLEIPLIDL

SEQ ID NO: 29843 - protein, 11 aa, Artificial Sequence
  Peptide Derived from Human Papillomavirus
VLEIPLIDLRL

SEQ ID NO: 29844 - protein, 8 aa, Artificial Sequence
  Peptide Derived from Human Papillomavirus
ALTVTCPL

SEQ ID NO: 29845 - protein, 10 aa, Artificial Sequence
  Peptide Derived from Human Papillomavirus
ALTVTCPLCA

SEQ ID NO: 29846 - protein, 9 aa, Artificial Sequence
  Peptide Derived from Human Papillomavirus
DIQSTKEDL

SEQ ID NO: 29847 - protein, 11 aa, Artificial Sequence
  Peptide Derived from Human Papillomavirus
DIQSTKEDLRV

SEQ ID NO: 29848 - protein, 8 aa, Artificial Sequence
  Peptide Derived from Human Papillomavirus
DLQCNEQL

SEQ ID NO: 29849 - protein, 8 aa, Artificial Sequence
  Peptide Derived from Human Papillomavirus
DLRVVQQL

SEQ ID NO: 29850 - protein, 9 aa, Artificial Sequence
  Peptide Derived from Human Papillomavirus
DLRVVQQLL

SEQ ID NO: 29851 - protein, 10 aa, Artificial Sequence
  Peptide Derived from Human Papillomavirus
DLRVVQQLLM

SEQ ID NO: 29852 - protein, 10 aa, Artificial Sequence
  Peptide Derived from Human Papillomavirus
EIDLQCNEQL

SEQ ID NO: 29853 - protein, 8 aa, Artificial Sequence
  Peptide Derived from Human Papillomavirus
ELTPQTEI

SEQ ID NO: 29854 - protein, 10 aa, Artificial Sequence
  Peptide Derived from Human Papillomavirus
ELTPQTEIDL

SEQ ID NO: 29855 - protein, 9 aa, Artificial Sequence
  Peptide Derived from Human Papillomavirus
HLQERPQQA

SEQ ID NO: 29856 - protein, 9 aa, Artificial Sequence
  Peptide Derived from Human Papillomavirus
HVPCCECKF

SEQ ID NO: 29857 - protein, 10 aa, Artificial Sequence
  Peptide Derived from Human Papillomavirus
HVPCCECKFV

SEQ ID NO: 29858 - protein, 11 aa, Artificial Sequence
  Peptide Derived from Human Papillomavirus
HVPCCECKFVV

SEQ ID NO: 29859 - protein, 8 aa, Artificial Sequence
  Peptide Derived from Human Papillomavirus
IQSTKEDL

SEQ ID NO: 29860 - protein, 10 aa, Artificial Sequence
  Peptide Derived from Human Papillomavirus
IQSTKEDLRV

SEQ ID NO: 29861 - protein, 11 aa, Artificial Sequence
  Peptide Derived from Human Papillomavirus
IQSTKEDLRVV

SEQ ID NO: 29862 - protein, 8 aa, Artificial Sequence
  Peptide Derived from Human Papillomavirus
KQHTCYLI

SEQ ID NO: 29863 - protein, 10 aa, Artificial Sequence
  Peptide Derived from Human Papillomavirus
KQHTCYLIHV

SEQ ID NO: 29864 - protein, 8 aa, Artificial Sequence
  Peptide Derived from Human Papillomavirus
KVPTLQDV

SEQ ID NO: 29865 - protein, 9 aa, Artificial Sequence
  Peptide Derived from Human Papillomavirus
KVPTLQDVV

SEQ ID NO: 29866 - protein, 10 aa, Artificial Sequence
  Peptide Derived from Human Papillomavirus
KVPTLQDVVL

SEQ ID NO: 29867 - protein, 11 aa, Artificial Sequence
  Peptide Derived from Human Papillomavirus
LIHVPCCECKF

SEQ ID NO: 29868 - protein, 8 aa, Artificial Sequence
  Peptide Derived from Human Papillomavirus
LLMGALTV

SEQ ID NO: 29869 - protein, 11 aa, Artificial Sequence
  Peptide Derived from Human Papillomavirus
LMGALTVTCPL

SEQ ID NO: 29870 - protein, 8 aa, Artificial Sequence
  Peptide Derived from Human Papillomavirus
LQDVVLEL

SEQ ID NO: 29871 - protein, 8 aa, Artificial Sequence
  Peptide Derived from Human Papillomavirus
LQERPQQA

SEQ ID NO: 29872 - protein, 11 aa, Artificial Sequence
  Peptide Derived from Human Papillomavirus
LQERPQQARQA

SEQ ID NO: 29873 - protein, 11 aa, Artificial Sequence
  Peptide Derived from Human Papillomavirus
QLDIQSTKEDL

SEQ ID NO: 29874 - protein, 9 aa, Artificial Sequence
  Peptide Derived from Human Papillomavirus
QLLMGALTV

SEQ ID NO: 29875 - protein, 8 aa, Artificial Sequence
  Peptide Derived from Human Papillomavirus
QQLLMGAL

SEQ ID NO: 29876 - protein, 10 aa, Artificial Sequence
  Peptide Derived from Human Papillomavirus
QQLLMGALTV

SEQ ID NO: 29877 - protein, 8 aa, Artificial Sequence
  Peptide Derived from Human Papillomavirus
RPQQARQA

SEQ ID NO: 29878 - protein, 9 aa, Artificial Sequence
  Peptide Derived from Human Papillomavirus
RQAKQHTCY

SEQ ID NO: 29879 - protein, 10 aa, Artificial Sequence
  Peptide Derived from Human Papillomavirus
RQAKQHTCYL

SEQ ID NO: 29880 - protein, 11 aa, Artificial Sequence
  Peptide Derived from Human Papillomavirus
RQAKQHTCYLI

SEQ ID NO: 29881 - protein, 8 aa, Artificial Sequence
  Peptide Derived from Human Papillomavirus
RVVQQLLM

SEQ ID NO: 29882 - protein, 10 aa, Artificial Sequence
  Peptide Derived from Human Papillomavirus
RVVQQLLMGA

SEQ ID NO: 29883 - protein, 11 aa, Artificial Sequence
  Peptide Derived from Human Papillomavirus
RVVQQLLMGAL

SEQ ID NO: 29884 - protein, 9 aa, Artificial Sequence
  Peptide Derived from Human Papillomavirus
TLQDVVLEL

SEQ ID NO: 29885 - protein, 8 aa, Artificial Sequence
  Peptide Derived from Human Papillomavirus
TPQTEIDL

SEQ ID NO: 29886 - protein, 8 aa, Artificial Sequence
  Peptide Derived from Human Papillomavirus
TVTCPLCA

SEQ ID NO: 29887 - protein, 10 aa, Artificial Sequence
  Peptide Derived from Human Papillomavirus
VLELTPQTEI

SEQ ID NO: 29888 - protein, 8 aa, Artificial Sequence
  Peptide Derived from Human Papillomavirus
VPCCECKF

SEQ ID NO: 29889 - protein, 9 aa, Artificial Sequence
  Peptide Derived from Human Papillomavirus
VPCCECKFV

SEQ ID NO: 29890 - protein, 10 aa, Artificial Sequence
  Peptide Derived from Human Papillomavirus
VPCCECKFVV

SEQ ID NO: 29891 - protein, 8 aa, Artificial Sequence
  Peptide Derived from Human Papillomavirus
VPTLQDVV

SEQ ID NO: 29892 - protein, 9 aa, Artificial Sequence
  Peptide Derived from Human Papillomavirus
VPTLQDVVL

SEQ ID NO: 29893 - protein, 11 aa, Artificial Sequence
  Peptide Derived from Human Papillomavirus
VPTLQDVVLEL

SEQ ID NO: 29894 - protein, 8 aa, Artificial Sequence
  Peptide Derived from Human Papillomavirus
VQQLLMGA

SEQ ID NO: 29895 - protein, 9 aa, Artificial Sequence
  Peptide Derived from Human Papillomavirus
VQQLLMGAL

SEQ ID NO: 29896 - protein, 11 aa, Artificial Sequence
  Peptide Derived from Human Papillomavirus
VQQLLMGALTV

SEQ ID NO: 29897 - protein, 11 aa, Artificial Sequence
  Peptide Derived from Human Papillomavirus
VVLELTPQTEI

SEQ ID NO: 29898 - protein, 9 aa, Artificial Sequence
  Peptide Derived from Human Papillomavirus
VVQQLLMGA

SEQ ID NO: 29899 - protein, 10 aa, Artificial Sequence
  Peptide Derived from Human Papillomavirus
VVQQLLMGAL

SEQ ID NO: 29900 - protein, 10 aa, Artificial Sequence
  Peptide Derived from Human Papillomavirus
AMGEHWTKGA

SEQ ID NO: 29901 - protein, 11 aa, Artificial Sequence
  Peptide Derived from Human Papillomavirus
AMGEHWTKGAV

SEQ ID NO: 29902 - protein, 9 aa, Artificial Sequence
  Peptide Derived from Human Papillomavirus
APTSTSTPA

SEQ ID NO: 29903 - protein, 8 aa, Artificial Sequence
  Peptide Derived from Human Papillomavirus
AQGHNNGI

SEQ ID NO: 29904 - protein, 10 aa, Artificial Sequence
  Peptide Derived from Human Papillomavirus
AQGHNNGICW

SEQ ID NO: 29905 - protein, 8 aa, Artificial Sequence
  Peptide Derived from Human Papillomavirus
AQLFNKPY

SEQ ID NO: 29906 - protein, 9 aa, Artificial Sequence
  Peptide Derived from Human Papillomavirus
AQLFNKPYW

SEQ ID NO: 29907 - protein, 10 aa, Artificial Sequence
  Peptide Derived from Human Papillomavirus
AQLFNKPYWL

SEQ ID NO: 29908 - protein, 10 aa, Artificial Sequence
  Peptide Derived from Human Papillomavirus
AVATSKKRSA

SEQ ID NO: 29909 - protein, 8 aa, Artificial Sequence
  Peptide Derived from Human Papillomavirus
AVCKSTQV

SEQ ID NO: 29910 - protein, 9 aa, Artificial Sequence
  Peptide Derived from Human Papillomavirus
AVGHPYYSV

SEQ ID NO: 29911 - protein, 8 aa, Artificial Sequence
  Peptide Derived from Human Papillomavirus
AVNVFPIF

SEQ ID NO: 29912 - protein, 9 aa, Artificial Sequence
  Peptide Derived from Human Papillomavirus
AVNVFPIFL

SEQ ID NO: 29913 - protein, 11 aa, Artificial Sequence
  Peptide Derived from Human Papillomavirus
AVNVFPIFLQM

SEQ ID NO: 29914 - protein, 8 aa, Artificial Sequence
  Peptide Derived from Human Papillomavirus
CIFLDVGA

SEQ ID NO: 29915 - protein, 9 aa, Artificial Sequence
  Peptide Derived from Human Papillomavirus
CIFLDVGAV

SEQ ID NO: 29916 - protein, 11 aa, Artificial Sequence
  Peptide Derived from Human Papillomavirus
CIFLDVGAVNV

SEQ ID NO: 29917 - protein, 8 aa, Artificial Sequence
  Peptide Derived from Human Papillomavirus
CIVGCTPA

SEQ ID NO: 29918 - protein, 9 aa, Artificial Sequence
  Peptide Derived from Human Papillomavirus
CIVGCTPAM

SEQ ID NO: 29919 - protein, 11 aa, Artificial Sequence
  Peptide Derived from Human Papillomavirus
CPPLALINTPI

SEQ ID NO: 29920 - protein, 9 aa, Artificial Sequence
  Peptide Derived from Human Papillomavirus
DIVQSTCKY

SEQ ID NO: 29921 - protein, 11 aa, Artificial Sequence
  Peptide Derived from Human Papillomavirus
DLDQFPLGRKF

SEQ ID NO: 29922 - protein, 9 aa, Artificial Sequence
  Peptide Derived from Human Papillomavirus
DMIDTGFGA

SEQ ID NO: 29923 - protein, 10 aa, Artificial Sequence
  Peptide Derived from Human Papillomavirus
DMIDTGFGAM

SEQ ID NO: 29924 - protein, 8 aa, Artificial Sequence
  Peptide Derived from Human Papillomavirus
DPLAKYKF

SEQ ID NO: 29925 - protein, 9 aa, Artificial Sequence
  Peptide Derived from Human Papillomavirus
DPLAKYKFW

SEQ ID NO: 29926 - protein, 11 aa, Artificial Sequence
  Peptide Derived from Human Papillomavirus
DPLAKYKFWDV

SEQ ID NO: 29927 - protein, 8 aa, Artificial Sequence
  Peptide Derived from Human Papillomavirus
DPPLHYGL

SEQ ID NO: 29928 - protein, 10 aa, Artificial Sequence
  Peptide Derived from Human Papillomavirus
DPPLHYGLCI

SEQ ID NO: 29929 - protein, 11 aa, Artificial Sequence
  Peptide Derived from Human Papillomavirus
DPPLHYGLCIF

SEQ ID NO: 29930 - protein, 8 aa, Artificial Sequence
  Peptide Derived from Human Papillomavirus
DQERLVWA

SEQ ID NO: 29931 - protein, 10 aa, Artificial Sequence
  Peptide Derived from Human Papillomavirus
DQERLVWACV

SEQ ID NO: 29932 - protein, 9 aa, Artificial Sequence
  Peptide Derived from Human Papillomavirus
DQFPLGRKF

SEQ ID NO: 29933 - protein, 10 aa, Artificial Sequence
  Peptide Derived from Human Papillomavirus
DQFPLGRKFL

SEQ ID NO: 29934 - protein, 11 aa, Artificial Sequence
  Peptide Derived from Human Papillomavirus
DQFPLGRKFLM

SEQ ID NO: 29935 - protein, 8 aa, Artificial Sequence
  Peptide Derived from Human Papillomavirus
DVGAVNVF

SEQ ID NO: 29936 - protein, 10 aa, Artificial Sequence
  Peptide Derived from Human Papillomavirus
DVGAVNVFPI

SEQ ID NO: 29937 - protein, 11 aa, Artificial Sequence
  Peptide Derived from Human Papillomavirus
DVGAVNVFPIF

SEQ ID NO: 29938 - protein, 8 aa, Artificial Sequence
  Peptide Derived from Human Papillomavirus
DVNLQDSF

SEQ ID NO: 29939 - protein, 8 aa, Artificial Sequence
  Peptide Derived from Human Papillomavirus
ELQFVFQL

SEQ ID NO: 29940 - protein, 11 aa, Artificial Sequence
  Peptide Derived from Human Papillomavirus
ELQFVFQLCKI

SEQ ID NO: 29941 - protein, 8 aa, Artificial Sequence
  Peptide Derived from Human Papillomavirus
EPPPSSVY

SEQ ID NO: 29942 - protein, 9 aa, Artificial Sequence
  Peptide Derived from Human Papillomavirus
EPPPSSVYV

SEQ ID NO: 29943 - protein, 10 aa, Artificial Sequence
  Peptide Derived from Human Papillomavirus
EPPPSSVYVA

SEQ ID NO: 29944 - protein, 8 aa, Artificial Sequence
  Peptide Derived from Human Papillomavirus
EQLFARHY

SEQ ID NO: 29945 - protein, 9 aa, Artificial Sequence
  Peptide Derived from Human Papillomavirus
EQLFARHYF

SEQ ID NO: 29946 - protein, 8 aa, Artificial Sequence
  Peptide Derived from Human Papillomavirus
EQLSKYDA

SEQ ID NO: 29947 - protein, 11 aa, Artificial Sequence
  Peptide Derived from Human Papillomavirus
EQLSKYDARKI

SEQ ID NO: 29948 - protein, 11 aa, Artificial Sequence
  Peptide Derived from Human Papillomavirus
EQPPTEKQDPL

SEQ ID NO: 29949 - protein, 8 aa, Artificial Sequence
  Peptide Derived from Human Papillomavirus
EVGRGQPL

SEQ ID NO: 29950 - protein, 10 aa, Artificial Sequence
  Peptide Derived from Human Papillomavirus
EVGRGQPLGA

SEQ ID NO: 29951 - protein, 9 aa, Artificial Sequence
  Peptide Derived from Human Papillomavirus
EVMAYLHNM

SEQ ID NO: 29952 - protein, 11 aa, Artificial Sequence
  Peptide Derived from Human Papillomavirus
EVMAYLHNMNA

SEQ ID NO: 29953 - protein, 9 aa, Artificial Sequence
  Peptide Derived from Human Papillomavirus
FLDVGAVNV

SEQ ID NO: 29954 - protein, 10 aa, Artificial Sequence
  Peptide Derived from Human Papillomavirus
FLDVGAVNVF

SEQ ID NO: 29955 - protein, 8 aa, Artificial Sequence
  Peptide Derived from Human Papillomavirus
FPIFLQMA

SEQ ID NO: 29956 - protein, 10 aa, Artificial Sequence
  Peptide Derived from Human Papillomavirus
FPIFLQMATW

SEQ ID NO: 29957 - protein, 8 aa, Artificial Sequence
  Peptide Derived from Human Papillomavirus
FPLGRKFL

SEQ ID NO: 29958 - protein, 9 aa, Artificial Sequence
  Peptide Derived from Human Papillomavirus
FPLGRKFLM

SEQ ID NO: 29959 - protein, 11 aa, Artificial Sequence
  Peptide Derived from Human Papillomavirus
FPLGRKFLMQL

SEQ ID NO: 29960 - protein, 8 aa, Artificial Sequence
  Peptide Derived from Human Papillomavirus
FQLCKITL

SEQ ID NO: 29961 - protein, 10 aa, Artificial Sequence
  Peptide Derived from Human Papillomavirus
FQLCKITLSA

SEQ ID NO: 29962 - protein, 8 aa, Artificial Sequence
  Peptide Derived from Human Papillomavirus
FVFQLCKI

SEQ ID NO: 29963 - protein, 10 aa, Artificial Sequence
  Peptide Derived from Human Papillomavirus
FVFQLCKITL

SEQ ID NO: 29964 - protein, 8 aa, Artificial Sequence
  Peptide Derived from Human Papillomavirus
GICWGNQL

SEQ ID NO: 29965 - protein, 9 aa, Artificial Sequence
  Peptide Derived from Human Papillomavirus
GICWGNQLF

SEQ ID NO: 29966 - protein, 10 aa, Artificial Sequence
  Peptide Derived from Human Papillomavirus
GICWGNQLFV

SEQ ID NO: 29967 - protein, 8 aa, Artificial Sequence
  Peptide Derived from Human Papillomavirus
GLCIFLDV

SEQ ID NO: 29968 - protein, 10 aa, Artificial Sequence
  Peptide Derived from Human Papillomavirus
GLCIFLDVGA

SEQ ID NO: 29969 - protein, 11 aa, Artificial Sequence
  Peptide Derived from Human Papillomavirus
GLCIFLDVGAV

SEQ ID NO: 29970 - protein, 10 aa, Artificial Sequence
  Peptide Derived from Human Papillomavirus
GLEVGRGQPL

SEQ ID NO: 29971 - protein, 8 aa, Artificial Sequence
  Peptide Derived from Human Papillomavirus
GLPDTNIY

SEQ ID NO: 29972 - protein, 8 aa, Artificial Sequence
  Peptide Derived from Human Papillomavirus
GLSGHPLF

SEQ ID NO: 29973 - protein, 11 aa, Artificial Sequence
  Peptide Derived from Human Papillomavirus
GLSGHPLFNRL

SEQ ID NO: 29974 - protein, 10 aa, Artificial Sequence
  Peptide Derived from Human Papillomavirus
GLSPPVATSL

SEQ ID NO: 29975 - protein, 8 aa, Artificial Sequence
  Peptide Derived from Human Papillomavirus
GQPLGAGL

SEQ ID NO: 29976 - protein, 9 aa, Artificial Sequence
  Peptide Derived from Human Papillomavirus
HVEEYELQF

SEQ ID NO: 29977 - protein, 10 aa, Artificial Sequence
  Peptide Derived from Human Papillomavirus
HVEEYELQFV

SEQ ID NO: 29978 - protein, 11 aa, Artificial Sequence
  Peptide Derived from Human Papillomavirus
HVEEYELQFVF

SEQ ID NO: 29979 - protein, 9 aa, Artificial Sequence
  Peptide Derived from Human Papillomavirus
IPKVSAYQY

SEQ ID NO: 29980 - protein, 11 aa, Artificial Sequence
  Peptide Derived from Human Papillomavirus
IPKVSAYQYRV

SEQ ID NO: 29981 - protein, 8 aa, Artificial Sequence
  Peptide Derived from Human Papillomavirus
IVGCTPAM

SEQ ID NO: 29982 - protein, 8 aa, Artificial Sequence
  Peptide Derived from Human Papillomavirus
IVQSTCKY

SEQ ID NO: 29983 - protein, 11 aa, Artificial Sequence
  Peptide Derived from Human Papillomavirus
IVQSTCKYPDY

SEQ ID NO: 29984 - protein, 9 aa, Artificial Sequence
  Peptide Derived from Human Papillomavirus
KINQYLRHV

SEQ ID NO: 29985 - protein, 8 aa, Artificial Sequence
  Peptide Derived from Human Papillomavirus
KITLSAEV

SEQ ID NO: 29986 - protein, 9 aa, Artificial Sequence
  Peptide Derived from Human Papillomavirus
KITLSAEVM

SEQ ID NO: 29987 - protein, 10 aa, Artificial Sequence
  Peptide Derived from Human Papillomavirus
KITLSAEVMA

SEQ ID NO: 29988 - protein, 11 aa, Artificial Sequence
  Peptide Derived from Human Papillomavirus
KITLSAEVMAY

SEQ ID NO: 29989 - protein, 11 aa, Artificial Sequence
  Peptide Derived from Human Papillomavirus
KMSADAYGDSM

SEQ ID NO: 29990 - protein, 8 aa, Artificial Sequence
  Peptide Derived from Human Papillomavirus
KPYWLQRA

SEQ ID NO: 29991 - protein, 8 aa, Artificial Sequence
  Peptide Derived from Human Papillomavirus
KQDPLAKY

SEQ ID NO: 29992 - protein, 10 aa, Artificial Sequence
  Peptide Derived from Human Papillomavirus
KQDPLAKYKF

SEQ ID NO: 29993 - protein, 11 aa, Artificial Sequence
  Peptide Derived from Human Papillomavirus
KQDPLAKYKFW

SEQ ID NO: 29994 - protein, 8 aa, Artificial Sequence
  Peptide Derived from Human Papillomavirus
KQTQLCIV

SEQ ID NO: 29995 - protein, 8 aa, Artificial Sequence
  Peptide Derived from Human Papillomavirus
KVGETIPA

SEQ ID NO: 29996 - protein, 10 aa, Artificial Sequence
  Peptide Derived from Human Papillomavirus
KVGETIPAEL

SEQ ID NO: 29997 - protein, 11 aa, Artificial Sequence
  Peptide Derived from Human Papillomavirus
KVGETIPAELY

SEQ ID NO: 29998 - protein, 8 aa, Artificial Sequence
  Peptide Derived from Human Papillomavirus
KVLQESKA

SEQ ID NO: 29999 - protein, 10 aa, Artificial Sequence
  Peptide Derived from Human Papillomavirus
KVLQESKAEV

SEQ ID NO: 30000 - protein, 9 aa, Artificial Sequence
  Peptide Derived from Human Papillomavirus
KVSAYQYRV

SEQ ID NO: 30001 - protein, 10 aa, Artificial Sequence
  Peptide Derived from Human Papillomavirus
KVSAYQYRVF

SEQ ID NO: 30002 - protein, 8 aa, Artificial Sequence
  Peptide Derived from Human Papillomavirus
KVVATDSY

SEQ ID NO: 30003 - protein, 9 aa, Artificial Sequence
  Peptide Derived from Human Papillomavirus
KVVATDSYV

SEQ ID NO: 30004 - protein, 9 aa, Artificial Sequence
  Peptide Derived from Human Papillomavirus
KVYLPPTPV

SEQ ID NO: 30005 - protein, 11 aa, Artificial Sequence
  Peptide Derived from Human Papillomavirus
LINTPIEDGDM

SEQ ID NO: 30006 - protein, 8 aa, Artificial Sequence
  Peptide Derived from Human Papillomavirus
LLAVGHPY

SEQ ID NO: 30007 - protein, 9 aa, Artificial Sequence
  Peptide Derived from Human Papillomavirus
LLAVGHPYY

SEQ ID NO: 30008 - protein, 11 aa, Artificial Sequence
  Peptide Derived from Human Papillomavirus
LLAVGHPYYSV

SEQ ID NO: 30009 - protein, 9 aa, Artificial Sequence
  Peptide Derived from Human Papillomavirus
LLEDWNIGL

SEQ ID NO: 30010 - protein, 11 aa, Artificial Sequence
  Peptide Derived from Human Papillomavirus
LMQLGTRSKPA

SEQ ID NO: 30011 - protein, 9 aa, Artificial Sequence
  Peptide Derived from Human Papillomavirus
LPDPNKFGL

SEQ ID NO: 30012 - protein, 9 aa, Artificial Sequence
  Peptide Derived from Human Papillomavirus
LPPTPVSKV

SEQ ID NO: 30013 - protein, 10 aa, Artificial Sequence
  Peptide Derived from Human Papillomavirus
LPPTPVSKVV

SEQ ID NO: 30014 - protein, 11 aa, Artificial Sequence
  Peptide Derived from Human Papillomavirus
LPPTPVSKVVA

SEQ ID NO: 30015 - protein, 9 aa, Artificial Sequence
  Peptide Derived from Human Papillomavirus
LQDSFSTDL

SEQ ID NO: 30016 - protein, 8 aa, Artificial Sequence
  Peptide Derived from Human Papillomavirus
LQESKAEV

SEQ ID NO: 30017 - protein, 10 aa, Artificial Sequence
  Peptide Derived from Human Papillomavirus
LQESKAEVPL

SEQ ID NO: 30018 - protein, 10 aa, Artificial Sequence
  Peptide Derived from Human Papillomavirus
LQFVFQLCKI

SEQ ID NO: 30019 - protein, 11 aa, Artificial Sequence
  Peptide Derived from Human Papillomavirus
LQRAQGHNNGI

SEQ ID NO: 30020 - protein, 8 aa, Artificial Sequence
  Peptide Derived from Human Papillomavirus
LVWACVGL

SEQ ID NO: 30021 - protein, 10 aa, Artificial Sequence
  Peptide Derived from Human Papillomavirus
LVWACVGLEV

SEQ ID NO: 30022 - protein, 8 aa, Artificial Sequence
  Peptide Derived from Human Papillomavirus
MIDTGFGA

SEQ ID NO: 30023 - protein, 9 aa, Artificial Sequence
  Peptide Derived from Human Papillomavirus
MIDTGFGAM

SEQ ID NO: 30024 - protein, 11 aa, Artificial Sequence
  Peptide Derived from Human Papillomavirus
MIDTGFGAMDF

SEQ ID NO: 30025 - protein, 8 aa, Artificial Sequence
  Peptide Derived from Human Papillomavirus
MITSEAQL

SEQ ID NO: 30026 - protein, 9 aa, Artificial Sequence
  Peptide Derived from Human Papillomavirus
MITSEAQLF

SEQ ID NO: 30027 - protein, 8 aa, Artificial Sequence
  Peptide Derived from Human Papillomavirus
MLPMMYIY

SEQ ID NO: 30028 - protein, 8 aa, Artificial Sequence
  Peptide Derived from Human Papillomavirus
MMLPMMYI

SEQ ID NO: 30029 - protein, 9 aa, Artificial Sequence
  Peptide Derived from Human Papillomavirus
MMLPMMYIY

SEQ ID NO: 30030 - protein, 10 aa, Artificial Sequence
  Peptide Derived from Human Papillomavirus
MMYIYRDPPL

SEQ ID NO: 30031 - protein, 10 aa, Artificial Sequence
  Peptide Derived from Human Papillomavirus
MQLGTRSKPA

SEQ ID NO: 30032 - protein, 11 aa, Artificial Sequence
  Peptide Derived from Human Papillomavirus
MQLGTRSKPAV

SEQ ID NO: 30033 - protein, 8 aa, Artificial Sequence
  Peptide Derived from Human Papillomavirus
NIGLSPPV

SEQ ID NO: 30034 - protein, 9 aa, Artificial Sequence
  Peptide Derived from Human Papillomavirus
NIGLSPPVA

SEQ ID NO: 30035 - protein, 8 aa, Artificial Sequence
  Peptide Derived from Human Papillomavirus
NIPKVSAY

SEQ ID NO: 30036 - protein, 10 aa, Artificial Sequence
  Peptide Derived from Human Papillomavirus
NIPKVSAYQY

SEQ ID NO: 30037 - protein, 11 aa, Artificial Sequence
  Peptide Derived from Human Papillomavirus
NISVDGKQTQL

SEQ ID NO: 30038 - protein, 10 aa, Artificial Sequence
  Peptide Derived from Human Papillomavirus
NIYNPDQERL

SEQ ID NO: 30039 - protein, 11 aa, Artificial Sequence
  Peptide Derived from Human Papillomavirus
NIYNPDQERLV

SEQ ID NO: 30040 - protein, 8 aa, Artificial Sequence
  Peptide Derived from Human Papillomavirus
NLANNNVI

SEQ ID NO: 30041 - protein, 8 aa, Artificial Sequence
  Peptide Derived from Human Papillomavirus
NLLEDWNI

SEQ ID NO: 30042 - protein, 10 aa, Artificial Sequence
  Peptide Derived from Human Papillomavirus
NLLEDWNIGL

SEQ ID NO: 30043 - protein, 10 aa, Artificial Sequence
  Peptide Derived from Human Papillomavirus
NLQDSFSTDL

SEQ ID NO: 30044 - protein, 10 aa, Artificial Sequence
  Peptide Derived from Human Papillomavirus
NMNANLLEDW

SEQ ID NO: 30045 - protein, 11 aa, Artificial Sequence
  Peptide Derived from Human Papillomavirus
NMTISTATEQL

SEQ ID NO: 30046 - protein, 8 aa, Artificial Sequence
  Peptide Derived from Human Papillomavirus
NPDQERLV

SEQ ID NO: 30047 - protein, 9 aa, Artificial Sequence
  Peptide Derived from Human Papillomavirus
NPDQERLVW

SEQ ID NO: 30048 - protein, 10 aa, Artificial Sequence
  Peptide Derived from Human Papillomavirus
NPDQERLVWA

SEQ ID NO: 30049 - protein, 8 aa, Artificial Sequence
  Peptide Derived from Human Papillomavirus
NQLFVTVV

SEQ ID NO: 30050 - protein, 10 aa, Artificial Sequence
  Peptide Derived from Human Papillomavirus
NQYLRHVEEY

SEQ ID NO: 30051 - protein, 9 aa, Artificial Sequence
  Peptide Derived from Human Papillomavirus
NVFPIFLQM

SEQ ID NO: 30052 - protein, 10 aa, Artificial Sequence
  Peptide Derived from Human Papillomavirus
NVFPIFLQMA

SEQ ID NO: 30053 - protein, 10 aa, Artificial Sequence
  Peptide Derived from Human Papillomavirus
NVIEDSRDNI

SEQ ID NO: 30054 - protein, 8 aa, Artificial Sequence
  Peptide Derived from Human Papillomavirus
PIEDGDMI

SEQ ID NO: 30055 - protein, 9 aa, Artificial Sequence
  Peptide Derived from Human Papillomavirus
PIFLQMATW

SEQ ID NO: 30056 - protein, 8 aa, Artificial Sequence
  Peptide Derived from Human Papillomavirus
PLAKYKFW

SEQ ID NO: 30057 - protein, 10 aa, Artificial Sequence
  Peptide Derived from Human Papillomavirus
PLAKYKFWDV

SEQ ID NO: 30058 - protein, 9 aa, Artificial Sequence
  Peptide Derived from Human Papillomavirus
PLALINTPI

SEQ ID NO: 30059 - protein, 11 aa, Artificial Sequence
  Peptide Derived from Human Papillomavirus
PLDIVQSTCKY

SEQ ID NO: 30060 - protein, 11 aa, Artificial Sequence
  Peptide Derived from Human Papillomavirus
PLGAGLSGHPL

SEQ ID NO: 30061 - protein, 8 aa, Artificial Sequence
  Peptide Derived from Human Papillomavirus
PLGRKFLM

SEQ ID NO: 30062 - protein, 10 aa, Artificial Sequence
  Peptide Derived from Human Papillomavirus
PLGRKFLMQL

SEQ ID NO: 30063 - protein, 8 aa, Artificial Sequence
  Peptide Derived from Human Papillomavirus
PLHYGLCI

SEQ ID NO: 30064 - protein, 9 aa, Artificial Sequence
  Peptide Derived from Human Papillomavirus
PLHYGLCIF

SEQ ID NO: 30065 - protein, 10 aa, Artificial Sequence
  Peptide Derived from Human Papillomavirus
PLHYGLCIFL

SEQ ID NO: 30066 - protein, 11 aa, Artificial Sequence
  Peptide Derived from Human Papillomavirus
PMMYIYRDPPL

SEQ ID NO: 30067 - protein, 10 aa, Artificial Sequence
  Peptide Derived from Human Papillomavirus
PPLALINTPI

SEQ ID NO: 30068 - protein, 9 aa, Artificial Sequence
  Peptide Derived from Human Papillomavirus
PPLHYGLCI

SEQ ID NO: 30069 - protein, 10 aa, Artificial Sequence
  Peptide Derived from Human Papillomavirus
PPLHYGLCIF

SEQ ID NO: 30070 - protein, 11 aa, Artificial Sequence
  Peptide Derived from Human Papillomavirus
PPLHYGLCIFL

SEQ ID NO: 30071 - protein, 8 aa, Artificial Sequence
  Peptide Derived from Human Papillomavirus
PPPSSVYV

SEQ ID NO: 30072 - protein, 9 aa, Artificial Sequence
  Peptide Derived from Human Papillomavirus
PPPSSVYVA

SEQ ID NO: 30073 - protein, 8 aa, Artificial Sequence
  Peptide Derived from Human Papillomavirus
PPSSVYVA

SEQ ID NO: 30074 - protein, 9 aa, Artificial Sequence
  Peptide Derived from Human Papillomavirus
PPTEKQDPL

SEQ ID NO: 30075 - protein, 10 aa, Artificial Sequence
  Peptide Derived from Human Papillomavirus
PPTEKQDPLA

SEQ ID NO: 30076 - protein, 8 aa, Artificial Sequence
  Peptide Derived from Human Papillomavirus
PPTPVSKV

SEQ ID NO: 30077 - protein, 9 aa, Artificial Sequence
  Peptide Derived from Human Papillomavirus
PPTPVSKVV

SEQ ID NO: 30078 - protein, 10 aa, Artificial Sequence
  Peptide Derived from Human Papillomavirus
PPTPVSKVVA

SEQ ID NO: 30079 - protein, 11 aa, Artificial Sequence
  Peptide Derived from Human Papillomavirus
PPVATSLEDKY

SEQ ID NO: 30080 - protein, 10 aa, Artificial Sequence
  Peptide Derived from Human Papillomavirus
PVATSLEDKY

SEQ ID NO: 30081 - protein, 11 aa, Artificial Sequence
  Peptide Derived from Human Papillomavirus
PVSKVVATDSY

SEQ ID NO: 30082 - protein, 10 aa, Artificial Sequence
  Peptide Derived from Human Papillomavirus
QLCIVGCTPA

SEQ ID NO: 30083 - protein, 11 aa, Artificial Sequence
  Peptide Derived from Human Papillomavirus
QLCIVGCTPAM

SEQ ID NO: 30084 - protein, 9 aa, Artificial Sequence
  Peptide Derived from Human Papillomavirus
QLCKITLSA

SEQ ID NO: 30085 - protein, 11 aa, Artificial Sequence
  Peptide Derived from Human Papillomavirus
QLCKITLSAEV

SEQ ID NO: 30086 - protein, 8 aa, Artificial Sequence
  Peptide Derived from Human Papillomavirus
QLFARHYF

SEQ ID NO: 30087 - protein, 11 aa, Artificial Sequence
  Peptide Derived from Human Papillomavirus
QLFARHYFNRA

SEQ ID NO: 30088 - protein, 8 aa, Artificial Sequence
  Peptide Derived from Human Papillomavirus
QLFNKPYW

SEQ ID NO: 30089 - protein, 9 aa, Artificial Sequence
  Peptide Derived from Human Papillomavirus
QLFNKPYWL

SEQ ID NO: 30090 - protein, 9 aa, Artificial Sequence
  Peptide Derived from Human Papillomavirus
QLGTRSKPA

SEQ ID NO: 30091 - protein, 10 aa, Artificial Sequence
  Peptide Derived from Human Papillomavirus
QLGTRSKPAV

SEQ ID NO: 30092 - protein, 11 aa, Artificial Sequence
  Peptide Derived from Human Papillomavirus
QLGTRSKPAVA

SEQ ID NO: 30093 - protein, 10 aa, Artificial Sequence
  Peptide Derived from Human Papillomavirus
QLSKYDARKI

SEQ ID NO: 30094 - protein, 10 aa, Artificial Sequence
  Peptide Derived from Human Papillomavirus
QPPTEKQDPL

SEQ ID NO: 30095 - protein, 11 aa, Artificial Sequence
  Peptide Derived from Human Papillomavirus
QPPTEKQDPLA

SEQ ID NO: 30096 - protein, 10 aa, Artificial Sequence
  Peptide Derived from Human Papillomavirus
QVTTGDCPPL

SEQ ID NO: 30097 - protein, 11 aa, Artificial Sequence
  Peptide Derived from Human Papillomavirus
QVTTGDCPPLA

SEQ ID NO: 30098 - protein, 10 aa, Artificial Sequence
  Peptide Derived from Human Papillomavirus
RLDDTESSNL

SEQ ID NO: 30099 - protein, 11 aa, Artificial Sequence
  Peptide Derived from Human Papillomavirus
RLDDTESSNLA

SEQ ID NO: 30100 - protein, 9 aa, Artificial Sequence
  Peptide Derived from Human Papillomavirus
RLLAVGHPY

SEQ ID NO: 30101 - protein, 10 aa, Artificial Sequence
  Peptide Derived from Human Papillomavirus
RLLAVGHPYY

SEQ ID NO: 30102 - protein, 8 aa, Artificial Sequence
  Peptide Derived from Human Papillomavirus
RLPDPNKF

SEQ ID NO: 30103 - protein, 10 aa, Artificial Sequence
  Peptide Derived from Human Papillomavirus
RLPDPNKFGL

SEQ ID NO: 30104 - protein, 9 aa, Artificial Sequence
  Peptide Derived from Human Papillomavirus
RLVWACVGL

SEQ ID NO: 30105 - protein, 11 aa, Artificial Sequence
  Peptide Derived from Human Papillomavirus
RLVWACVGLEV

SEQ ID NO: 30106 - protein, 8 aa, Artificial Sequence
  Peptide Derived from Human Papillomavirus
RPSENKVY

SEQ ID NO: 30107 - protein, 9 aa, Artificial Sequence
  Peptide Derived from Human Papillomavirus
RPSENKVYL

SEQ ID NO: 30108 - protein, 10 aa, Artificial Sequence
  Peptide Derived from Human Papillomavirus
RVRLPDPNKF

SEQ ID NO: 30109 - protein, 11 aa, Artificial Sequence
  Peptide Derived from Human Papillomavirus
SIFYHAGSSRL

SEQ ID NO: 30110 - protein, 8 aa, Artificial Sequence
  Peptide Derived from Human Papillomavirus
SLEDKYRY

SEQ ID NO: 30111 - protein, 9 aa, Artificial Sequence
  Peptide Derived from Human Papillomavirus
SLEDKYRYV

SEQ ID NO: 30112 - protein, 9 aa, Artificial Sequence
  Peptide Derived from Human Papillomavirus
SMITSEAQL

SEQ ID NO: 30113 - protein, 10 aa, Artificial Sequence
  Peptide Derived from Human Papillomavirus
SMITSEAQLF

SEQ ID NO: 30114 - protein, 11 aa, Artificial Sequence
  Peptide Derived from Human Papillomavirus
SMWFYLRREQL

SEQ ID NO: 30115 - protein, 8 aa, Artificial Sequence
  Peptide Derived from Human Papillomavirus
SPPVATSL

SEQ ID NO: 30116 - protein, 9 aa, Artificial Sequence
  Peptide Derived from Human Papillomavirus
SVDGKQTQL

SEQ ID NO: 30117 - protein, 11 aa, Artificial Sequence
  Peptide Derived from Human Papillomavirus
SVDGKQTQLCI

SEQ ID NO: 30118 - protein, 11 aa, Artificial Sequence
  Peptide Derived from Human Papillomavirus
SVTKDNTKTNI

SEQ ID NO: 30119 - protein, 11 aa, Artificial Sequence
  Peptide Derived from Human Papillomavirus
SVYVATPSGSM

SEQ ID NO: 30120 - protein, 8 aa, Artificial Sequence
  Peptide Derived from Human Papillomavirus
TIPAELYL

SEQ ID NO: 30121 - protein, 9 aa, Artificial Sequence
  Peptide Derived from Human Papillomavirus
TISTATEQL

SEQ ID NO: 30122 - protein, 8 aa, Artificial Sequence
  Peptide Derived from Human Papillomavirus
TLSAEVMA

SEQ ID NO: 30123 - protein, 9 aa, Artificial Sequence
  Peptide Derived from Human Papillomavirus
TLSAEVMAY

SEQ ID NO: 30124 - protein, 10 aa, Artificial Sequence
  Peptide Derived from Human Papillomavirus
TLSAEVMAYL

SEQ ID NO: 30125 - protein, 8 aa, Artificial Sequence
  Peptide Derived from Human Papillomavirus
TPAMGEHW

SEQ ID NO: 30126 - protein, 8 aa, Artificial Sequence
  Peptide Derived from Human Papillomavirus
TPIEDGDM

SEQ ID NO: 30127 - protein, 9 aa, Artificial Sequence
  Peptide Derived from Human Papillomavirus
TPIEDGDMI

SEQ ID NO: 30128 - protein, 11 aa, Artificial Sequence
  Peptide Derived from Human Papillomavirus
TPSGSMITSEA

SEQ ID NO: 30129 - protein, 8 aa, Artificial Sequence
  Peptide Derived from Human Papillomavirus
TPVSKVVA

SEQ ID NO: 30130 - protein, 11 aa, Artificial Sequence
  Peptide Derived from Human Papillomavirus
TQLCIVGCTPA

SEQ ID NO: 30131 - protein, 11 aa, Artificial Sequence
  Peptide Derived from Human Papillomavirus
TQVTTGDCPPL

SEQ ID NO: 30132 - protein, 11 aa, Artificial Sequence
  Peptide Derived from Human Papillomavirus
TVVDTTRSTNM

SEQ ID NO: 30133 - protein, 9 aa, Artificial Sequence
  Peptide Derived from Human Papillomavirus
VIEDSRDNI

SEQ ID NO: 30134 - protein, 11 aa, Artificial Sequence
  Peptide Derived from Human Papillomavirus
VIEDSRDNISV

SEQ ID NO: 30135 - protein, 9 aa, Artificial Sequence
  Peptide Derived from Human Papillomavirus
VLQESKAEV

SEQ ID NO: 30136 - protein, 11 aa, Artificial Sequence
  Peptide Derived from Human Papillomavirus
VLQESKAEVPL

SEQ ID NO: 30137 - protein, 8 aa, Artificial Sequence
  Peptide Derived from Human Papillomavirus
VMAYLHNM

SEQ ID NO: 30138 - protein, 10 aa, Artificial Sequence
  Peptide Derived from Human Papillomavirus
VMAYLHNMNA

SEQ ID NO: 30139 - protein, 10 aa, Artificial Sequence
  Peptide Derived from Human Papillomavirus
VQSTCKYPDY

SEQ ID NO: 30140 - protein, 11 aa, Artificial Sequence
  Peptide Derived from Human Papillomavirus
VQSTCKYPDYL

SEQ ID NO: 30141 - protein, 8 aa, Artificial Sequence
  Peptide Derived from Human Papillomavirus
VVATDSYV

SEQ ID NO: 30142 - protein, 10 aa, Artificial Sequence
  Peptide Derived from Human Papillomavirus
VVDTTRSTNM

SEQ ID NO: 30143 - protein, 8 aa, Artificial Sequence
  Peptide Derived from Human Papillomavirus
YIYRDPPL

SEQ ID NO: 30144 - protein, 10 aa, Artificial Sequence
  Peptide Derived from Human Papillomavirus
YIYRDPPLHY

SEQ ID NO: 30145 - protein, 9 aa, Artificial Sequence
  Peptide Derived from Human Papillomavirus
YLHNMNANL

SEQ ID NO: 30146 - protein, 10 aa, Artificial Sequence
  Peptide Derived from Human Papillomavirus
YLHNMNANLL

SEQ ID NO: 30147 - protein, 8 aa, Artificial Sequence
  Peptide Derived from Human Papillomavirus
YLKMSADA

SEQ ID NO: 30148 - protein, 9 aa, Artificial Sequence
  Peptide Derived from Human Papillomavirus
YLKMSADAY

SEQ ID NO: 30149 - protein, 10 aa, Artificial Sequence
  Peptide Derived from Human Papillomavirus
YLPPTPVSKV

SEQ ID NO: 30150 - protein, 11 aa, Artificial Sequence
  Peptide Derived from Human Papillomavirus
YLPPTPVSKVV

SEQ ID NO: 30151 - protein, 8 aa, Artificial Sequence
  Peptide Derived from Human Papillomavirus
YLRHVEEY

SEQ ID NO: 30152 - protein, 10 aa, Artificial Sequence
  Peptide Derived from Human Papillomavirus
YLRHVEEYEL

SEQ ID NO: 30153 - protein, 8 aa, Artificial Sequence
  Peptide Derived from Human Papillomavirus
YLRREQLF

SEQ ID NO: 30154 - protein, 9 aa, Artificial Sequence
  Peptide Derived from Human Papillomavirus
YLRREQLFA

SEQ ID NO: 30155 - protein, 9 aa, Artificial Sequence
  Peptide Derived from Human Papillomavirus
YPDYLKMSA

SEQ ID NO: 30156 - protein, 11 aa, Artificial Sequence
  Peptide Derived from Human Papillomavirus
YPDYLKMSADA

SEQ ID NO: 30157 - protein, 8 aa, Artificial Sequence
  Peptide Derived from Human Papillomavirus
YQYRVFRV

SEQ ID NO: 30158 - protein, 10 aa, Artificial Sequence
  Peptide Derived from Human Papillomavirus
YQYRVFRVRL

SEQ ID NO: 30159 - protein, 9 aa, Artificial Sequence
  Peptide Derived from Human Papillomavirus
YVATPSGSM

SEQ ID NO: 30160 - protein, 10 aa, Artificial Sequence
  Peptide Derived from Human Papillomavirus
YVATPSGSMI

SEQ ID NO: 30161 - protein, 8 aa, Artificial Sequence
  Peptide Derived from Human Papillomavirus
YVKRTSIF

SEQ ID NO: 30162 - protein, 9 aa, Artificial Sequence
  Peptide Derived from Human Papillomavirus
YVKRTSIFY

SEQ ID NO: 30163 - protein, 11 aa, Artificial Sequence
  Peptide Derived from Human Papillomavirus
YVKRTSIFYHA

SEQ ID NO: 30164 - protein, 8 aa, Artificial Sequence
  Peptide Derived from Human Papillomavirus
ALWPVYFF

SEQ ID NO: 30165 - protein, 9 aa, Artificial Sequence
  Peptide Derived from Human Papillomavirus
APDPDFMNI

SEQ ID NO: 30166 - protein, 10 aa, Artificial Sequence
  Peptide Derived from Human Papillomavirus
APDPDFMNIV

SEQ ID NO: 30167 - protein, 11 aa, Artificial Sequence
  Peptide Derived from Human Papillomavirus
APDPDFMNIVA

SEQ ID NO: 30168 - protein, 9 aa, Artificial Sequence
  Peptide Derived from Human Papillomavirus
APGLSSQSV

SEQ ID NO: 30169 - protein, 10 aa, Artificial Sequence
  Peptide Derived from Human Papillomavirus
APGLSSQSVA

SEQ ID NO: 30170 - protein, 11 aa, Artificial Sequence
  Peptide Derived from Human Papillomavirus
APLGNVWETPF

SEQ ID NO: 30171 - protein, 11 aa, Artificial Sequence
  Peptide Derived from Human Papillomavirus
APQTGEVSGNI

SEQ ID NO: 30172 - protein, 8 aa, Artificial Sequence
  Peptide Derived from Human Papillomavirus
APRLYRKA

SEQ ID NO: 30173 - protein, 9 aa, Artificial Sequence
  Peptide Derived from Human Papillomavirus
APRLYRKAF

SEQ ID NO: 30174 - protein, 8 aa, Artificial Sequence
  Peptide Derived from Human Papillomavirus
AQAEEIEM

SEQ ID NO: 30175 - protein, 11 aa, Artificial Sequence
  Peptide Derived from Human Papillomavirus
AQAEEIEMQPL

SEQ ID NO: 30176 - protein, 10 aa, Artificial Sequence
  Peptide Derived from Human Papillomavirus
AVHGSGTEPI

SEQ ID NO: 30177 - protein, 9 aa, Artificial Sequence
  Peptide Derived from Human Papillomavirus
CPEDVVNKI

SEQ ID NO: 30178 - protein, 8 aa, Artificial Sequence
  Peptide Derived from Human Papillomavirus
DISPIAQA

SEQ ID NO: 30179 - protein, 11 aa, Artificial Sequence
  Peptide Derived from Human Papillomavirus
DISPIAQAEEI

SEQ ID NO: 30180 - protein, 9 aa, Artificial Sequence
  Peptide Derived from Human Papillomavirus
DITPTSSTV

SEQ ID NO: 30181 - protein, 11 aa, Artificial Sequence
  Peptide Derived from Human Papillomavirus
DITPTSSTVHV

SEQ ID NO: 30182 - protein, 11 aa, Artificial Sequence
  Peptide Derived from Human Papillomavirus
DIVLPTGPSTW

SEQ ID NO: 30183 - protein, 10 aa, Artificial Sequence
  Peptide Derived from Human Papillomavirus
DIYANIDDEA

SEQ ID NO: 30184 - protein, 9 aa, Artificial Sequence
  Peptide Derived from Human Papillomavirus
DPAFLDRPA

SEQ ID NO: 30185 - protein, 11 aa, Artificial Sequence
  Peptide Derived from Human Papillomavirus
DPAFLDRPATL

SEQ ID NO: 30186 - protein, 8 aa, Artificial Sequence
  Peptide Derived from Human Papillomavirus
DPDFMNIV

SEQ ID NO: 30187 - protein, 9 aa, Artificial Sequence
  Peptide Derived from Human Papillomavirus
DPDFMNIVA

SEQ ID NO: 30188 - protein, 10 aa, Artificial Sequence
  Peptide Derived from Human Papillomavirus
DPDFMNIVAL

SEQ ID NO: 30189 - protein, 8 aa, Artificial Sequence
  Peptide Derived from Human Papillomavirus
DPSIVTLV

SEQ ID NO: 30190 - protein, 8 aa, Artificial Sequence
  Peptide Derived from Human Papillomavirus
DVTHDVYI

SEQ ID NO: 30191 - protein, 9 aa, Artificial Sequence
  Peptide Derived from Human Papillomavirus
DVTPARPPI

SEQ ID NO: 30192 - protein, 10 aa, Artificial Sequence
  Peptide Derived from Human Papillomavirus
DVTPARPPIV

SEQ ID NO: 30193 - protein, 11 aa, Artificial Sequence
  Peptide Derived from Human Papillomavirus
DVTPARPPIVV

SEQ ID NO: 30194 - protein, 11 aa, Artificial Sequence
  Peptide Derived from Human Papillomavirus
DVVNKIEQKTW

SEQ ID NO: 30195 - protein, 9 aa, Artificial Sequence
  Peptide Derived from Human Papillomavirus
DVYIQGSSF

SEQ ID NO: 30196 - protein, 10 aa, Artificial Sequence
  Peptide Derived from Human Papillomavirus
DVYIQGSSFA

SEQ ID NO: 30197 - protein, 11 aa, Artificial Sequence
  Peptide Derived from Human Papillomavirus
DVYIQGSSFAL

SEQ ID NO: 30198 - protein, 8 aa, Artificial Sequence
  Peptide Derived from Human Papillomavirus
EIEMQPLL

SEQ ID NO: 30199 - protein, 10 aa, Artificial Sequence
  Peptide Derived from Human Papillomavirus
EIEMQPLLSA

SEQ ID NO: 30200 - protein, 8 aa, Artificial Sequence
  Peptide Derived from Human Papillomavirus
EIPMQTFA

SEQ ID NO: 30201 - protein, 9 aa, Artificial Sequence
  Peptide Derived from Human Papillomavirus
EIPMQTFAV

SEQ ID NO: 30202 - protein, 11 aa, Artificial Sequence
  Peptide Derived from Human Papillomavirus
EITSSSTTTPA

SEQ ID NO: 30203 - protein, 8 aa, Artificial Sequence
  Peptide Derived from Human Papillomavirus
EMQPLLSA

SEQ ID NO: 30204 - protein, 8 aa, Artificial Sequence
  Peptide Derived from Human Papillomavirus
EPISSTPI

SEQ ID NO: 30205 - protein, 11 aa, Artificial Sequence
  Peptide Derived from Human Papillomavirus
EPISSTPIPGF

SEQ ID NO: 30206 - protein, 9 aa, Artificial Sequence
  Peptide Derived from Human Papillomavirus
EQKTWADKI

SEQ ID NO: 30207 - protein, 10 aa, Artificial Sequence
  Peptide Derived from Human Papillomavirus
EQKTWADKIL

SEQ ID NO: 30208 - protein, 8 aa, Artificial Sequence
  Peptide Derived from Human Papillomavirus
EVSGNILI

SEQ ID NO: 30209 - protein, 9 aa, Artificial Sequence
  Peptide Derived from Human Papillomavirus
FIDPPVIEA

SEQ ID NO: 30210 - protein, 8 aa, Artificial Sequence
  Peptide Derived from Human Papillomavirus
FLDRPATL

SEQ ID NO: 30211 - protein, 9 aa, Artificial Sequence
  Peptide Derived from Human Papillomavirus
FLDRPATLV

SEQ ID NO: 30212 - protein, 11 aa, Artificial Sequence
  Peptide Derived from Human Papillomavirus
FLDRPATLVSA

SEQ ID NO: 30213 - protein, 11 aa, Artificial Sequence
  Peptide Derived from Human Papillomavirus
FMNIVALHRPA

SEQ ID NO: 30214 - protein, 10 aa, Artificial Sequence
  Peptide Derived from Human Papillomavirus
FQQVKVTDPA

SEQ ID NO: 30215 - protein, 11 aa, Artificial Sequence
  Peptide Derived from Human Papillomavirus
FQQVKVTDPAF

SEQ ID NO: 30216 - protein, 9 aa, Artificial Sequence
  Peptide Derived from Human Papillomavirus
FVPQSPYDV

SEQ ID NO: 30217 - protein, 8 aa, Artificial Sequence
  Peptide Derived from Human Papillomavirus
GIHSYEEI

SEQ ID NO: 30218 - protein, 10 aa, Artificial Sequence
  Peptide Derived from Human Papillomavirus
GIHSYEEIPM

SEQ ID NO: 30219 - protein, 11 aa, Artificial Sequence
  Peptide Derived from Human Papillomavirus
GIPNFTGSGGF

SEQ ID NO: 30220 - protein, 8 aa, Artificial Sequence
  Peptide Derived from Human Papillomavirus
GLSSQSVA

SEQ ID NO: 30221 - protein, 9 aa, Artificial Sequence
  Peptide Derived from Human Papillomavirus
GLYDIYANI

SEQ ID NO: 30222 - protein, 8 aa, Artificial Sequence
  Peptide Derived from Human Papillomavirus
GPSTWPFV

SEQ ID NO: 30223 - protein, 8 aa, Artificial Sequence
  Peptide Derived from Human Papillomavirus
GPTDPSIV

SEQ ID NO: 30224 - protein, 10 aa, Artificial Sequence
  Peptide Derived from Human Papillomavirus
GPTDPSIVTL

SEQ ID NO: 30225 - protein, 11 aa, Artificial Sequence
  Peptide Derived from Human Papillomavirus
GPTDPSIVTLV

SEQ ID NO: 30226 - protein, 8 aa, Artificial Sequence
  Peptide Derived from Human Papillomavirus
GVAPDPDF

SEQ ID NO: 30227 - protein, 9 aa, Artificial Sequence
  Peptide Derived from Human Papillomavirus
GVAPDPDFM

SEQ ID NO: 30228 - protein, 11 aa, Artificial Sequence
  Peptide Derived from Human Papillomavirus
GVAPDPDFMNI

SEQ ID NO: 30229 - protein, 11 aa, Artificial Sequence
  Peptide Derived from Human Papillomavirus
GVRFSRLGRKA

SEQ ID NO: 30230 - protein, 8 aa, Artificial Sequence
  Peptide Derived from Human Papillomavirus
HITNPLFI

SEQ ID NO: 30231 - protein, 9 aa, Artificial Sequence
  Peptide Derived from Human Papillomavirus
HLPIKPSTL

SEQ ID NO: 30232 - protein, 11 aa, Artificial Sequence
  Peptide Derived from Human Papillomavirus
HLPIKPSTLSF

SEQ ID NO: 30233 - protein, 11 aa, Artificial Sequence
  Peptide Derived from Human Papillomavirus
HVSSTHITNPL

SEQ ID NO: 30234 - protein, 10 aa, Artificial Sequence
  Peptide Derived from Human Papillomavirus
ILISTPTSGI

SEQ ID NO: 30235 - protein, 8 aa, Artificial Sequence
  Peptide Derived from Human Papillomavirus
ILQWGSLF

SEQ ID NO: 30236 - protein, 10 aa, Artificial Sequence
  Peptide Derived from Human Papillomavirus
ILQWGSLFTY

SEQ ID NO: 30237 - protein, 11 aa, Artificial Sequence
  Peptide Derived from Human Papillomavirus
ILQWGSLFTYF

SEQ ID NO: 30238 - protein, 8 aa, Artificial Sequence
  Peptide Derived from Human Papillomavirus
IPGFRRIA

SEQ ID NO: 30239 - protein, 9 aa, Artificial Sequence
  Peptide Derived from Human Papillomavirus
IPGFRRIAA

SEQ ID NO: 30240 - protein, 8 aa, Artificial Sequence
  Peptide Derived from Human Papillomavirus
IPMQTFAV

SEQ ID NO: 30241 - protein, 10 aa, Artificial Sequence
  Peptide Derived from Human Papillomavirus
IPNFTGSGGF

SEQ ID NO: 30242 - protein, 10 aa, Artificial Sequence
  Peptide Derived from Human Papillomavirus
IPYFFADGDV

SEQ ID NO: 30243 - protein, 11 aa, Artificial Sequence
  Peptide Derived from Human Papillomavirus
IPYFFADGDVA

SEQ ID NO: 30244 - protein, 8 aa, Artificial Sequence
  Peptide Derived from Human Papillomavirus
IQGSSFAL

SEQ ID NO: 30245 - protein, 9 aa, Artificial Sequence
  Peptide Derived from Human Papillomavirus
IQGSSFALW

SEQ ID NO: 30246 - protein, 11 aa, Artificial Sequence
  Peptide Derived from Human Papillomavirus
IQGSSFALWPV

SEQ ID NO: 30247 - protein, 9 aa, Artificial Sequence
  Peptide Derived from Human Papillomavirus
IQTRRGTQI

SEQ ID NO: 30248 - protein, 11 aa, Artificial Sequence
  Peptide Derived from Human Papillomavirus
IQTRRGTQIGA

SEQ ID NO: 30249 - protein, 8 aa, Artificial Sequence
  Peptide Derived from Human Papillomavirus
IVALHRPA

SEQ ID NO: 30250 - protein, 9 aa, Artificial Sequence
  Peptide Derived from Human Papillomavirus
IVALHRPAF

SEQ ID NO: 30251 - protein, 11 aa, Artificial Sequence
  Peptide Derived from Human Papillomavirus
IVDVTPARPPI

SEQ ID NO: 30252 - protein, 10 aa, Artificial Sequence
  Peptide Derived from Human Papillomavirus
IVLPTGPSTW

SEQ ID NO: 30253 - protein, 10 aa, Artificial Sequence
  Peptide Derived from Human Papillomavirus
IVTLVEESSV

SEQ ID NO: 30254 - protein, 11 aa, Artificial Sequence
  Peptide Derived from Human Papillomavirus
IVTLVEESSVI

SEQ ID NO: 30255 - protein, 8 aa, Artificial Sequence
  Peptide Derived from Human Papillomavirus
KIEQKTWA

SEQ ID NO: 30256 - protein, 11 aa, Artificial Sequence
  Peptide Derived from Human Papillomavirus
KIEQKTWADKI

SEQ ID NO: 30257 - protein, 8 aa, Artificial Sequence
  Peptide Derived from Human Papillomavirus
KILQWGSL

SEQ ID NO: 30258 - protein, 9 aa, Artificial Sequence
  Peptide Derived from Human Papillomavirus
KILQWGSLF

SEQ ID NO: 30259 - protein, 11 aa, Artificial Sequence
  Peptide Derived from Human Papillomavirus
KILQWGSLFTY

SEQ ID NO: 30260 - protein, 10 aa, Artificial Sequence
  Peptide Derived from Human Papillomavirus
KLSGTCPEDV

SEQ ID NO: 30261 - protein, 11 aa, Artificial Sequence
  Peptide Derived from Human Papillomavirus
KLSGTCPEDVV

SEQ ID NO: 30262 - protein, 8 aa, Artificial Sequence
  Peptide Derived from Human Papillomavirus
KPSTLSFA

SEQ ID NO: 30263 - protein, 8 aa, Artificial Sequence
  Peptide Derived from Human Papillomavirus
KVTDPAFL

SEQ ID NO: 30264 - protein, 9 aa, Artificial Sequence
  Peptide Derived from Human Papillomavirus
LISTPTSGI

SEQ ID NO: 30265 - protein, 8 aa, Artificial Sequence
  Peptide Derived from Human Papillomavirus
LLSANNSF

SEQ ID NO: 30266 - protein, 11 aa, Artificial Sequence
  Peptide Derived from Human Papillomavirus
LLSANNSFDGL

SEQ ID NO: 30267 - protein, 8 aa, Artificial Sequence
  Peptide Derived from Human Papillomavirus
LPIKPSTL

SEQ ID NO: 30268 - protein, 10 aa, Artificial Sequence
  Peptide Derived from Human Papillomavirus
LPIKPSTLSF

SEQ ID NO: 30269 - protein, 11 aa, Artificial Sequence
  Peptide Derived from Human Papillomavirus
LPIKPSTLSFA

SEQ ID NO: 30270 - protein, 8 aa, Artificial Sequence
  Peptide Derived from Human Papillomavirus
LPTGPSTW

SEQ ID NO: 30271 - protein, 10 aa, Artificial Sequence
  Peptide Derived from Human Papillomavirus
LPTGPSTWPF

SEQ ID NO: 30272 - protein, 11 aa, Artificial Sequence
  Peptide Derived from Human Papillomavirus
LPTGPSTWPFV

SEQ ID NO: 30273 - protein, 9 aa, Artificial Sequence
  Peptide Derived from Human Papillomavirus
LQWGSLFTY

SEQ ID NO: 30274 - protein, 10 aa, Artificial Sequence
  Peptide Derived from Human Papillomavirus
LQWGSLFTYF

SEQ ID NO: 30275 - protein, 8 aa, Artificial Sequence
  Peptide Derived from Human Papillomavirus
LVEESSVI

SEQ ID NO: 30276 - protein, 8 aa, Artificial Sequence
  Peptide Derived from Human Papillomavirus
LVSADNPL

SEQ ID NO: 30277 - protein, 9 aa, Artificial Sequence
  Peptide Derived from Human Papillomavirus
LVSADNPLF

SEQ ID NO: 30278 - protein, 11 aa, Artificial Sequence
  Peptide Derived from Human Papillomavirus
MQPLLSANNSF

SEQ ID NO: 30279 - protein, 9 aa, Artificial Sequence
  Peptide Derived from Human Papillomavirus
NIDDEAPGL

SEQ ID NO: 30280 - protein, 11 aa, Artificial Sequence
  Peptide Derived from Human Papillomavirus
NILISTPTSGI

SEQ ID NO: 30281 - protein, 9 aa, Artificial Sequence
  Peptide Derived from Human Papillomavirus
NIVALHRPA

SEQ ID NO: 30282 - protein, 10 aa, Artificial Sequence
  Peptide Derived from Human Papillomavirus
NIVALHRPAF

SEQ ID NO: 30283 - protein, 11 aa, Artificial Sequence
  Peptide Derived from Human Papillomavirus
NPLFEGTDTSL

SEQ ID NO: 30284 - protein, 9 aa, Artificial Sequence
  Peptide Derived from Human Papillomavirus
NPLFIDPPV

SEQ ID NO: 30285 - protein, 10 aa, Artificial Sequence
  Peptide Derived from Human Papillomavirus
NPLFIDPPVI

SEQ ID NO: 30286 - protein, 9 aa, Artificial Sequence
  Peptide Derived from Human Papillomavirus
NVTAPLGNV

SEQ ID NO: 30287 - protein, 10 aa, Artificial Sequence
  Peptide Derived from Human Papillomavirus
NVTAPLGNVW

SEQ ID NO: 30288 - protein, 8 aa, Artificial Sequence
  Peptide Derived from Human Papillomavirus
NVWETPFY

SEQ ID NO: 30289 - protein, 8 aa, Artificial Sequence
  Peptide Derived from Human Papillomavirus
PIAQAEEI

SEQ ID NO: 30290 - protein, 10 aa, Artificial Sequence
  Peptide Derived from Human Papillomavirus
PIAQAEEIEM

SEQ ID NO: 30291 - protein, 9 aa, Artificial Sequence
  Peptide Derived from Human Papillomavirus
PIKPSTLSF

SEQ ID NO: 30292 - protein, 10 aa, Artificial Sequence
  Peptide Derived from Human Papillomavirus
PIKPSTLSFA

SEQ ID NO: 30293 - protein, 8 aa, Artificial Sequence
  Peptide Derived from Human Papillomavirus
PIPGFRRI

SEQ ID NO: 30294 - protein, 9 aa, Artificial Sequence
  Peptide Derived from Human Papillomavirus
PIPGFRRIA

SEQ ID NO: 30295 - protein, 10 aa, Artificial Sequence
  Peptide Derived from Human Papillomavirus
PIPGFRRIAA

SEQ ID NO: 30296 - protein, 10 aa, Artificial Sequence
  Peptide Derived from Human Papillomavirus
PISSTPIPGF

SEQ ID NO: 30297 - protein, 10 aa, Artificial Sequence
  Peptide Derived from Human Papillomavirus
PLFEGTDTSL

SEQ ID NO: 30298 - protein, 11 aa, Artificial Sequence
  Peptide Derived from Human Papillomavirus
PLFEGTDTSLA

SEQ ID NO: 30299 - protein, 8 aa, Artificial Sequence
  Peptide Derived from Human Papillomavirus
PLFIDPPV

SEQ ID NO: 30300 - protein, 9 aa, Artificial Sequence
  Peptide Derived from Human Papillomavirus
PLFIDPPVI

SEQ ID NO: 30301 - protein, 11 aa, Artificial Sequence
  Peptide Derived from Human Papillomavirus
PLFIDPPVIEA

SEQ ID NO: 30302 - protein, 10 aa, Artificial Sequence
  Peptide Derived from Human Papillomavirus
PLGNVWETPF

SEQ ID NO: 30303 - protein, 11 aa, Artificial Sequence
  Peptide Derived from Human Papillomavirus
PLGNVWETPFY

SEQ ID NO: 30304 - protein, 9 aa, Artificial Sequence
  Peptide Derived from Human Papillomavirus
PLGSRPSTI

SEQ ID NO: 30305 - protein, 10 aa, Artificial Sequence
  Peptide Derived from Human Papillomavirus
PLGSRPSTIV

SEQ ID NO: 30306 - protein, 9 aa, Artificial Sequence
  Peptide Derived from Human Papillomavirus
PLLSANNSF

SEQ ID NO: 30307 - protein, 8 aa, Artificial Sequence
  Peptide Derived from Human Papillomavirus
PPIVVESV

SEQ ID NO: 30308 - protein, 11 aa, Artificial Sequence
  Peptide Derived from Human Papillomavirus
PQSPYDVTHDV

SEQ ID NO: 30309 - protein, 10 aa, Artificial Sequence
  Peptide Derived from Human Papillomavirus
PQTGEVSGNI

SEQ ID NO: 30310 - protein, 11 aa, Artificial Sequence
  Peptide Derived from Human Papillomavirus
PQTGEVSGNIL

SEQ ID NO: 30311 - protein, 11 aa, Artificial Sequence
  Peptide Derived from Human Papillomavirus
PVIEAPQTGEV

SEQ ID NO: 30312 - protein, 8 aa, Artificial Sequence
  Peptide Derived from Human Papillomavirus
QIGARVHY

SEQ ID NO: 30313 - protein, 9 aa, Artificial Sequence
  Peptide Derived from Human Papillomavirus
QIGARVHYY

SEQ ID NO: 30314 - protein, 10 aa, Artificial Sequence
  Peptide Derived from Human Papillomavirus
QIGARVHYYY

SEQ ID NO: 30315 - protein, 8 aa, Artificial Sequence
  Peptide Derived from Human Papillomavirus
QLYKTCKL

SEQ ID NO: 30316 - protein, 10 aa, Artificial Sequence
  Peptide Derived from Human Papillomavirus
QPLLSANNSF

SEQ ID NO: 30317 - protein, 9 aa, Artificial Sequence
  Peptide Derived from Human Papillomavirus
QQVKVTDPA

SEQ ID NO: 30318 - protein, 10 aa, Artificial Sequence
  Peptide Derived from Human Papillomavirus
QQVKVTDPAF

SEQ ID NO: 30319 - protein, 11 aa, Artificial Sequence
  Peptide Derived from Human Papillomavirus
QQVKVTDPAFL

SEQ ID NO: 30320 - protein, 8 aa, Artificial Sequence
  Peptide Derived from Human Papillomavirus
QVKVTDPA

SEQ ID NO: 30321 - protein, 9 aa, Artificial Sequence
  Peptide Derived from Human Papillomavirus
QVKVTDPAF

SEQ ID NO: 30322 - protein, 10 aa, Artificial Sequence
  Peptide Derived from Human Papillomavirus
QVKVTDPAFL

SEQ ID NO: 30323 - protein, 8 aa, Artificial Sequence
  Peptide Derived from Human Papillomavirus
RIAAPRLY

SEQ ID NO: 30324 - protein, 11 aa, Artificial Sequence
  Peptide Derived from Human Papillomavirus
RIAAPRLYRKA

SEQ ID NO: 30325 - protein, 11 aa, Artificial Sequence
  Peptide Derived from Human Papillomavirus
RIPYFFADGDV

SEQ ID NO: 30326 - protein, 8 aa, Artificial Sequence
  Peptide Derived from Human Papillomavirus
RLGRKATI

SEQ ID NO: 30327 - protein, 10 aa, Artificial Sequence
  Peptide Derived from Human Papillomavirus
RLYRKAFQQV

SEQ ID NO: 30328 - protein, 11 aa, Artificial Sequence
  Peptide Derived from Human Papillomavirus
RPAFTTRRGGV

SEQ ID NO: 30329 - protein, 8 aa, Artificial Sequence
  Peptide Derived from Human Papillomavirus
RPATLVSA

SEQ ID NO: 30330 - protein, 9 aa, Artificial Sequence
  Peptide Derived from Human Papillomavirus
RPPIVVESV

SEQ ID NO: 30331 - protein, 8 aa, Artificial Sequence
  Peptide Derived from Human Papillomavirus
RPSTIVDV

SEQ ID NO: 30332 - protein, 11 aa, Artificial Sequence
  Peptide Derived from Human Papillomavirus
RPSTIVDVTPA

SEQ ID NO: 30333 - protein, 8 aa, Artificial Sequence
  Peptide Derived from Human Papillomavirus
RVHYYYDI

SEQ ID NO: 30334 - protein, 11 aa, Artificial Sequence
  Peptide Derived from Human Papillomavirus
RVHYYYDISPI

SEQ ID NO: 30335 - protein, 11 aa, Artificial Sequence
  Peptide Derived from Human Papillomavirus
SIVTLVEESSV

SEQ ID NO: 30336 - protein, 9 aa, Artificial Sequence
  Peptide Derived from Human Papillomavirus
SLAFSPSGV

SEQ ID NO: 30337 - protein, 10 aa, Artificial Sequence
  Peptide Derived from Human Papillomavirus
SLAFSPSGVA

SEQ ID NO: 30338 - protein, 9 aa, Artificial Sequence
  Peptide Derived from Human Papillomavirus
SLFTYFGGL

SEQ ID NO: 30339 - protein, 11 aa, Artificial Sequence
  Peptide Derived from Human Papillomavirus
SLFTYFGGLGI

SEQ ID NO: 30340 - protein, 9 aa, Artificial Sequence
  Peptide Derived from Human Papillomavirus
SPIAQAEEI

SEQ ID NO: 30341 - protein, 11 aa, Artificial Sequence
  Peptide Derived from Human Papillomavirus
SPIAQAEEIEM

SEQ ID NO: 30342 - protein, 11 aa, Artificial Sequence
  Peptide Derived from Human Papillomavirus
SPSGVAPDPDF

SEQ ID NO: 30343 - protein, 9 aa, Artificial Sequence
  Peptide Derived from Human Papillomavirus
SPYDVTHDV

SEQ ID NO: 30344 - protein, 10 aa, Artificial Sequence
  Peptide Derived from Human Papillomavirus
SPYDVTHDVY

SEQ ID NO: 30345 - protein, 11 aa, Artificial Sequence
  Peptide Derived from Human Papillomavirus
SPYDVTHDVYI

SEQ ID NO: 30346 - protein, 9 aa, Artificial Sequence
  Peptide Derived from Human Papillomavirus
SQSVATPSA

SEQ ID NO: 30347 - protein, 11 aa, Artificial Sequence
  Peptide Derived from Human Papillomavirus
SQSVATPSAHL

SEQ ID NO: 30348 - protein, 9 aa, Artificial Sequence
  Peptide Derived from Human Papillomavirus
SVATPSAHL

SEQ ID NO: 30349 - protein, 11 aa, Artificial Sequence
  Peptide Derived from Human Papillomavirus
SVATPSAHLPI

SEQ ID NO: 30350 - protein, 9 aa, Artificial Sequence
  Peptide Derived from Human Papillomavirus
SVGPTDPSI

SEQ ID NO: 30351 - protein, 10 aa, Artificial Sequence
  Peptide Derived from Human Papillomavirus
SVGPTDPSIV

SEQ ID NO: 30352 - protein, 9 aa, Artificial Sequence
  Peptide Derived from Human Papillomavirus
SVIESGAGI

SEQ ID NO: 30353 - protein, 10 aa, Artificial Sequence
  Peptide Derived from Human Papillomavirus
TIQTRRGTQI

SEQ ID NO: 30354 - protein, 8 aa, Artificial Sequence
  Peptide Derived from Human Papillomavirus
TIVDVTPA

SEQ ID NO: 30355 - protein, 11 aa, Artificial Sequence
  Peptide Derived from Human Papillomavirus
TLSFASNTTNV

SEQ ID NO: 30356 - protein, 8 aa, Artificial Sequence
  Peptide Derived from Human Papillomavirus
TLVEESSV

SEQ ID NO: 30357 - protein, 9 aa, Artificial Sequence
  Peptide Derived from Human Papillomavirus
TLVEESSVI

SEQ ID NO: 30358 - protein, 9 aa, Artificial Sequence
  Peptide Derived from Human Papillomavirus
TLVSADNPL

SEQ ID NO: 30359 - protein, 10 aa, Artificial Sequence
  Peptide Derived from Human Papillomavirus
TLVSADNPLF

SEQ ID NO: 30360 - protein, 8 aa, Artificial Sequence
  Peptide Derived from Human Papillomavirus
TPARPPIV

SEQ ID NO: 30361 - protein, 9 aa, Artificial Sequence
  Peptide Derived from Human Papillomavirus
TPARPPIVV

SEQ ID NO: 30362 - protein, 9 aa, Artificial Sequence
  Peptide Derived from Human Papillomavirus
TPFYSGPDI

SEQ ID NO: 30363 - protein, 10 aa, Artificial Sequence
  Peptide Derived from Human Papillomavirus
TPFYSGPDIV

SEQ ID NO: 30364 - protein, 11 aa, Artificial Sequence
  Peptide Derived from Human Papillomavirus
TPFYSGPDIVL

SEQ ID NO: 30365 - protein, 9 aa, Artificial Sequence
  Peptide Derived from Human Papillomavirus
TPIPGFRRI

SEQ ID NO: 30366 - protein, 10 aa, Artificial Sequence
  Peptide Derived from Human Papillomavirus
TPIPGFRRIA

SEQ ID NO: 30367 - protein, 11 aa, Artificial Sequence
  Peptide Derived from Human Papillomavirus
TPIPGFRRIAA

SEQ ID NO: 30368 - protein, 8 aa, Artificial Sequence
  Peptide Derived from Human Papillomavirus
TPSAHLPI

SEQ ID NO: 30369 - protein, 9 aa, Artificial Sequence
  Peptide Derived from Human Papillomavirus
TPTSGIHSY

SEQ ID NO: 30370 - protein, 9 aa, Artificial Sequence
  Peptide Derived from Human Papillomavirus
TPTSSTVHV

SEQ ID NO: 30371 - protein, 9 aa, Artificial Sequence
  Peptide Derived from Human Papillomavirus
TQIGARVHY

SEQ ID NO: 30372 - protein, 10 aa, Artificial Sequence
  Peptide Derived from Human Papillomavirus
TQIGARVHYY

SEQ ID NO: 30373 - protein, 11 aa, Artificial Sequence
  Peptide Derived from Human Papillomavirus
TQIGARVHYYY

SEQ ID NO: 30374 - protein, 9 aa, Artificial Sequence
  Peptide Derived from Human Papillomavirus
TQLYKTCKL

SEQ ID NO: 30375 - protein, 9 aa, Artificial Sequence
  Peptide Derived from Human Papillomavirus
TVHVSSTHI

SEQ ID NO: 30376 - protein, 10 aa, Artificial Sequence
  Peptide Derived from Human Papillomavirus
VIEAPQTGEV

SEQ ID NO: 30377 - protein, 8 aa, Artificial Sequence
  Peptide Derived from Human Papillomavirus
VIESGAGI

SEQ ID NO: 30378 - protein, 11 aa, Artificial Sequence
  Peptide Derived from Human Papillomavirus
VIESGAGIPNF

SEQ ID NO: 30379 - protein, 11 aa, Artificial Sequence
  Peptide Derived from Human Papillomavirus
VLDITPTSSTV

SEQ ID NO: 30380 - protein, 9 aa, Artificial Sequence
  Peptide Derived from Human Papillomavirus
VLPTGPSTW

SEQ ID NO: 30381 - protein, 11 aa, Artificial Sequence
  Peptide Derived from Human Papillomavirus
VLPTGPSTWPF

SEQ ID NO: 30382 - protein, 10 aa, Artificial Sequence
  Peptide Derived from Human Papillomavirus
VPLGSRPSTI

SEQ ID NO: 30383 - protein, 11 aa, Artificial Sequence
  Peptide Derived from Human Papillomavirus
VPLGSRPSTIV

SEQ ID NO: 30384 - protein, 8 aa, Artificial Sequence
  Peptide Derived from Human Papillomavirus
VPQSPYDV

SEQ ID NO: 30385 - protein, 10 aa, Artificial Sequence
  Peptide Derived from Human Papillomavirus
VVNKIEQKTW

SEQ ID NO: 30386 - protein, 11 aa, Artificial Sequence
  Peptide Derived from Human Papillomavirus
VVNKIEQKTWA

SEQ ID NO: 30387 - protein, 9 aa, Artificial Sequence
  Peptide Derived from Human Papillomavirus
WPFVPQSPY

SEQ ID NO: 30388 - protein, 11 aa, Artificial Sequence
  Peptide Derived from Human Papillomavirus
WPFVPQSPYDV

SEQ ID NO: 30389 - protein, 8 aa, Artificial Sequence
  Peptide Derived from Human Papillomavirus
YIQGSSFA

SEQ ID NO: 30390 - protein, 9 aa, Artificial Sequence
  Peptide Derived from Human Papillomavirus
YIQGSSFAL

SEQ ID NO: 30391 - protein, 10 aa, Artificial Sequence
  Peptide Derived from Human Papillomavirus
YIQGSSFALW

SEQ ID NO: 30392 - protein, 11 aa, Artificial Sequence
  Peptide Derived from Human Papillomavirus
YVPLGSRPSTI

SEQ ID NO: 30393 - protein, 11 aa, Artificial Sequence
  Peptide Derived from Human Papillomavirus
ADSIKTLLQQY

SEQ ID NO: 30394 - protein, 10 aa, Artificial Sequence
  Peptide Derived from Human Papillomavirus
AMLAKFKELY

SEQ ID NO: 30395 - protein, 8 aa, Artificial Sequence
  Peptide Derived from Human Papillomavirus
ATVPCWNY

SEQ ID NO: 30396 - protein, 9 aa, Artificial Sequence
  Peptide Derived from Human Papillomavirus
DCATMCRHY

SEQ ID NO: 30397 - protein, 10 aa, Artificial Sequence
  Peptide Derived from Human Papillomavirus
DDATVPCWNY

SEQ ID NO: 30398 - protein, 9 aa, Artificial Sequence
  Peptide Derived from Human Papillomavirus
DDSEIAYKY

SEQ ID NO: 30399 - protein, 8 aa, Artificial Sequence
  Peptide Derived from Human Papillomavirus
DSEIAYKY

SEQ ID NO: 30400 - protein, 10 aa, Artificial Sequence
  Peptide Derived from Human Papillomavirus
DSIKTLLQQY

SEQ ID NO: 30401 - protein, 10 aa, Artificial Sequence
  Peptide Derived from Human Papillomavirus
ELSQMVQWAY

SEQ ID NO: 30402 - protein, 9 aa, Artificial Sequence
  Peptide Derived from Human Papillomavirus
ETETPCSQY

SEQ ID NO: 30403 - protein, 9 aa, Artificial Sequence
  Peptide Derived from Human Papillomavirus
FDENGNPVY

SEQ ID NO: 30404 - protein, 8 aa, Artificial Sequence
  Peptide Derived from Human Papillomavirus
FESEDSGY

SEQ ID NO: 30405 - protein, 10 aa, Artificial Sequence
  Peptide Derived from Human Papillomavirus
GGSGGGCSQY

SEQ ID NO: 30406 - protein, 9 aa, Artificial Sequence
  Peptide Derived from Human Papillomavirus
GISNISEVY

SEQ ID NO: 30407 - protein, 10 aa, Artificial Sequence
  Peptide Derived from Human Papillomavirus
GMVVLLLVRY

SEQ ID NO: 30408 - protein, 9 aa, Artificial Sequence
  Peptide Derived from Human Papillomavirus
GSGGGCSQY

SEQ ID NO: 30409 - protein, 8 aa, Artificial Sequence
  Peptide Derived from Human Papillomavirus
GTDSRWPY

SEQ ID NO: 30410 - protein, 9 aa, Artificial Sequence
  Peptide Derived from Human Papillomavirus
GTGCNGWFY

SEQ ID NO: 30411 - protein, 11 aa, Artificial Sequence
  Peptide Derived from Human Papillomavirus
INAGTDSRWPY

SEQ ID NO: 30412 - protein, 8 aa, Artificial Sequence
  Peptide Derived from Human Papillomavirus
ISNISEVY

SEQ ID NO: 30413 - protein, 9 aa, Artificial Sequence
  Peptide Derived from Human Papillomavirus
IVDDSEIAY

SEQ ID NO: 30414 - protein, 11 aa, Artificial Sequence
  Peptide Derived from Human Papillomavirus
IVDDSEIAYKY

SEQ ID NO: 30415 - protein, 11 aa, Artificial Sequence
  Peptide Derived from Human Papillomavirus
KTGISNISEVY

SEQ ID NO: 30416 - protein, 10 aa, Artificial Sequence
  Peptide Derived from Human Papillomavirus
KTLLQQYCLY

SEQ ID NO: 30417 - protein, 11 aa, Artificial Sequence
  Peptide Derived from Human Papillomavirus
LDDATVPCWNY

SEQ ID NO: 30418 - protein, 9 aa, Artificial Sequence
  Peptide Derived from Human Papillomavirus
LFESEDSGY

SEQ ID NO: 30419 - protein, 9 aa, Artificial Sequence
  Peptide Derived from Human Papillomavirus
LRSTAAALY

SEQ ID NO: 30420 - protein, 11 aa, Artificial Sequence
  Peptide Derived from Human Papillomavirus
LRSTAAALYWY

SEQ ID NO: 30421 - protein, 9 aa, Artificial Sequence
  Peptide Derived from Human Papillomavirus
LSQMVQWAY

SEQ ID NO: 30422 - protein, 11 aa, Artificial Sequence
  Peptide Derived from Human Papillomavirus
LVDFIVNDNDY

SEQ ID NO: 30423 - protein, 9 aa, Artificial Sequence
  Peptide Derived from Human Papillomavirus
MLAKFKELY

SEQ ID NO: 30424 - protein, 9 aa, Artificial Sequence
  Peptide Derived from Human Papillomavirus
MSMSQWIKY

SEQ ID NO: 30425 - protein, 10 aa, Artificial Sequence
  Peptide Derived from Human Papillomavirus
PFDENGNPVY

SEQ ID NO: 30426 - protein, 10 aa, Artificial Sequence
  Peptide Derived from Human Papillomavirus
QMSMSQWIKY

SEQ ID NO: 30427 - protein, 11 aa, Artificial Sequence
  Peptide Derived from Human Papillomavirus
RDAVQVLKRKY

SEQ ID NO: 30428 - protein, 11 aa, Artificial Sequence
  Peptide Derived from Human Papillomavirus
RHETETPCSQY

SEQ ID NO: 30429 - protein, 8 aa, Artificial Sequence
  Peptide Derived from Human Papillomavirus
RSTAAALY

SEQ ID NO: 30430 - protein, 10 aa, Artificial Sequence
  Peptide Derived from Human Papillomavirus
RSTAAALYWY

SEQ ID NO: 30431 - protein, 8 aa, Artificial Sequence
  Peptide Derived from Human Papillomavirus
SMSQWIKY

SEQ ID NO: 30432 - protein, 9 aa, Artificial Sequence
  Peptide Derived from Human Papillomavirus
STAAALYWY

SEQ ID NO: 30433 - protein, 8 aa, Artificial Sequence
  Peptide Derived from Human Papillomavirus
TAAALYWY

SEQ ID NO: 30434 - protein, 8 aa, Artificial Sequence
  Peptide Derived from Human Papillomavirus
VDDSEIAY

SEQ ID NO: 30435 - protein, 10 aa, Artificial Sequence
  Peptide Derived from Human Papillomavirus
VDDSEIAYKY

SEQ ID NO: 30436 - protein, 11 aa, Artificial Sequence
  Peptide Derived from Human Papillomavirus
VKDCATMCRHY

SEQ ID NO: 30437 - protein, 9 aa, Artificial Sequence
  Peptide Derived from Human Papillomavirus
CQDKILTHY

SEQ ID NO: 30438 - protein, 10 aa, Artificial Sequence
  Peptide Derived from Human Papillomavirus
DGDICNTMHY

SEQ ID NO: 30439 - protein, 11 aa, Artificial Sequence
  Peptide Derived from Human Papillomavirus
DSTDLRDHIDY

SEQ ID NO: 30440 - protein, 8 aa, Artificial Sequence
  Peptide Derived from Human Papillomavirus
ETIYNSQY

SEQ ID NO: 30441 - protein, 8 aa, Artificial Sequence
  Peptide Derived from Human Papillomavirus
FKDDAEKY

SEQ ID NO: 30442 - protein, 11 aa, Artificial Sequence
  Peptide Derived from Human Papillomavirus
GDANTLKCLRY

SEQ ID NO: 30443 - protein, 10 aa, Artificial Sequence
  Peptide Derived from Human Papillomavirus
HKSAIVTLTY

SEQ ID NO: 30444 - protein, 9 aa, Artificial Sequence
  Peptide Derived from Human Papillomavirus
HMRLECAIY

SEQ ID NO: 30445 - protein, 10 aa, Artificial Sequence
  Peptide Derived from Human Papillomavirus
HMRLECAIYY

SEQ ID NO: 30446 - protein, 9 aa, Artificial Sequence
  Peptide Derived from Human Papillomavirus
KSAIVTLTY

SEQ ID NO: 30447 - protein, 9 aa, Artificial Sequence
  Peptide Derived from Human Papillomavirus
LQDVSLEVY

SEQ ID NO: 30448 - protein, 11 aa, Artificial Sequence
  Peptide Derived from Human Papillomavirus
LTLETIYNSQY

SEQ ID NO: 30449 - protein, 8 aa, Artificial Sequence
  Peptide Derived from Human Papillomavirus
NTLKCLRY

SEQ ID NO: 30450 - protein, 10 aa, Artificial Sequence
  Peptide Derived from Human Papillomavirus
PTGCIKKHGY

SEQ ID NO: 30451 - protein, 8 aa, Artificial Sequence
  Peptide Derived from Human Papillomavirus
QVDYYGLY

SEQ ID NO: 30452 - protein, 9 aa, Artificial Sequence
  Peptide Derived from Human Papillomavirus
QVDYYGLYY

SEQ ID NO: 30453 - protein, 8 aa, Artificial Sequence
  Peptide Derived from Human Papillomavirus
RLECAIYY

SEQ ID NO: 30454 - protein, 10 aa, Artificial Sequence
  Peptide Derived from Human Papillomavirus
STDLRDHIDY

SEQ ID NO: 30455 - protein, 10 aa, Artificial Sequence
  Peptide Derived from Human Papillomavirus
TLETIYNSQY

SEQ ID NO: 30456 - protein, 11 aa, Artificial Sequence
  Peptide Derived from Human Papillomavirus
TMHYTNWTHIY

SEQ ID NO: 30457 - protein, 8 aa, Artificial Sequence
  Peptide Derived from Human Papillomavirus
VHEGIRTY

SEQ ID NO: 30458 - protein, 10 aa, Artificial Sequence
  Peptide Derived from Human Papillomavirus
VTVVEGQVDY

SEQ ID NO: 30459 - protein, 11 aa, Artificial Sequence
  Peptide Derived from Human Papillomavirus
VTVVEGQVDYY

SEQ ID NO: 30460 - protein, 8 aa, Artificial Sequence
  Peptide Derived from Human Papillomavirus
VVEGQVDY

SEQ ID NO: 30461 - protein, 9 aa, Artificial Sequence
  Peptide Derived from Human Papillomavirus
VVEGQVDYY

SEQ ID NO: 30462 - protein, 11 aa, Artificial Sequence
  Peptide Derived from Human Papillomavirus
WTLQDVSLEVY

SEQ ID NO: 30463 - protein, 8 aa, Artificial Sequence
  Peptide Derived from Human Papillomavirus
YTNWTHIY

SEQ ID NO: 30464 - protein, 11 aa, Artificial Sequence
  Peptide Derived from Human Papillomavirus
AASAFRCFIVY

SEQ ID NO: 30465 - protein, 10 aa, Artificial Sequence
  Peptide Derived from Human Papillomavirus
ASAFRCFIVY

SEQ ID NO: 30466 - protein, 11 aa, Artificial Sequence
  Peptide Derived from Human Papillomavirus
DFAFRDLCIVY

SEQ ID NO: 30467 - protein, 8 aa, Artificial Sequence
  Peptide Derived from Human Papillomavirus
FRDLCIVY

SEQ ID NO: 30468 - protein, 8 aa, Artificial Sequence
  Peptide Derived from Human Papillomavirus
FYSKISEY

SEQ ID NO: 30469 - protein, 11 aa, Artificial Sequence
  Peptide Derived from Human Papillomavirus
FYSKISEYRHY

SEQ ID NO: 30470 - protein, 8 aa, Artificial Sequence
  Peptide Derived from Human Papillomavirus
GTTLEQQY

SEQ ID NO: 30471 - protein, 10 aa, Artificial Sequence
  Peptide Derived from Human Papillomavirus
IHDIILECVY

SEQ ID NO: 30472 - protein, 9 aa, Artificial Sequence
  Peptide Derived from Human Papillomavirus
ISEYRHYCY

SEQ ID NO: 30473 - protein, 8 aa, Artificial Sequence
  Peptide Derived from Human Papillomavirus
KISEYRHY

SEQ ID NO: 30474 - protein, 10 aa, Artificial Sequence
  Peptide Derived from Human Papillomavirus
KISEYRHYCY

SEQ ID NO: 30475 - protein, 9 aa, Artificial Sequence
  Peptide Derived from Human Papillomavirus
VCDKCLKFY

SEQ ID NO: 30476 - protein, 10 aa, Artificial Sequence
  Peptide Derived from Human Papillomavirus
YSKISEYRHY

SEQ ID NO: 30477 - protein, 8 aa, Artificial Sequence
  Peptide Derived from Human Papillomavirus
DTPTLHEY

SEQ ID NO: 30478 - protein, 8 aa, Artificial Sequence
  Peptide Derived from Human Papillomavirus
ETTDLYCY

SEQ ID NO: 30479 - protein, 10 aa, Artificial Sequence
  Peptide Derived from Human Papillomavirus
GQAEPDRAHY

SEQ ID NO: 30480 - protein, 10 aa, Artificial Sequence
  Peptide Derived from Human Papillomavirus
HGDTPTLHEY

SEQ ID NO: 30481 - protein, 9 aa, Artificial Sequence
  Peptide Derived from Human Papillomavirus
QAEPDRAHY

SEQ ID NO: 30482 - protein, 8 aa, Artificial Sequence
  Peptide Derived from Human Papillomavirus
QPETTDLY

SEQ ID NO: 30483 - protein, 10 aa, Artificial Sequence
  Peptide Derived from Human Papillomavirus
QPETTDLYCY

SEQ ID NO: 30484 - protein, 9 aa, Artificial Sequence
  Peptide Derived from Human Papillomavirus
AISTSETTY

SEQ ID NO: 30485 - protein, 11 aa, Artificial Sequence
  Peptide Derived from Human Papillomavirus
CAAISTSETTY

SEQ ID NO: 30486 - protein, 10 aa, Artificial Sequence
  Peptide Derived from Human Papillomavirus
CTSICKYPDY

SEQ ID NO: 30487 - protein, 9 aa, Artificial Sequence
  Peptide Derived from Human Papillomavirus
CYENDVNVY

SEQ ID NO: 30488 - protein, 8 aa, Artificial Sequence
  Peptide Derived from Human Papillomavirus
DTENASAY

SEQ ID NO: 30489 - protein, 11 aa, Artificial Sequence
  Peptide Derived from Human Papillomavirus
FKEYLRHGEEY

SEQ ID NO: 30490 - protein, 11 aa, Artificial Sequence
  Peptide Derived from Human Papillomavirus
GSTANLASSNY

SEQ ID NO: 30491 - protein, 8 aa, Artificial Sequence
  Peptide Derived from Human Papillomavirus
ISTSETTY

SEQ ID NO: 30492 - protein, 11 aa, Artificial Sequence
  Peptide Derived from Human Papillomavirus
ITCYENDVNVY

SEQ ID NO: 30493 - protein, 10 aa, Artificial Sequence
  Peptide Derived from Human Papillomavirus
ITLTADVMTY

SEQ ID NO: 30494 - protein, 8 aa, Artificial Sequence
  Peptide Derived from Human Papillomavirus
KEDPLKKY

SEQ ID NO: 30495 - protein, 11 aa, Artificial Sequence
  Peptide Derived from Human Papillomavirus
KLDDTENASAY

SEQ ID NO: 30496 - protein, 10 aa, Artificial Sequence
  Peptide Derived from Human Papillomavirus
LDDTENASAY

SEQ ID NO: 30497 - protein, 8 aa, Artificial Sequence
  Peptide Derived from Human Papillomavirus
LLAVGHPY

SEQ ID NO: 30498 - protein, 8 aa, Artificial Sequence
  Peptide Derived from Human Papillomavirus
LPSEATVY

SEQ ID NO: 30499 - protein, 8 aa, Artificial Sequence
  Peptide Derived from Human Papillomavirus
LTADVMTY

SEQ ID NO: 30500 - protein, 9 aa, Artificial Sequence
  Peptide Derived from Human Papillomavirus
NRECISMDY

SEQ ID NO: 30501 - protein, 9 aa, Artificial Sequence
  Peptide Derived from Human Papillomavirus
PKEDPLKKY

SEQ ID NO: 30502 - protein, 11 aa, Artificial Sequence
  Peptide Derived from Human Papillomavirus
PLDICTSICKY

SEQ ID NO: 30503 - protein, 11 aa, Artificial Sequence
  Peptide Derived from Human Papillomavirus
PVSKVVSTDEY

SEQ ID NO: 30504 - protein, 10 aa, Artificial Sequence
  Peptide Derived from Human Papillomavirus
SDAQIFNKPY

SEQ ID NO: 30505 - protein, 10 aa, Artificial Sequence
  Peptide Derived from Human Papillomavirus
STANLASSNY

SEQ ID NO: 30506 - protein, 11 aa, Artificial Sequence
  Peptide Derived from Human Papillomavirus
TDEYVARTNIY

SEQ ID NO: 30507 - protein, 11 aa, Artificial Sequence
  Peptide Derived from Human Papillomavirus
TSDAQIFNKPY

SEQ ID NO: 30508 - protein, 9 aa, Artificial Sequence
  Peptide Derived from Human Papillomavirus
TSICKYPDY

SEQ ID NO: 30509 - protein, 11 aa, Artificial Sequence
  Peptide Derived from Human Papillomavirus
TSRLLAVGHPY

SEQ ID NO: 30510 - protein, 11 aa, Artificial Sequence
  Peptide Derived from Human Papillomavirus
TTYKNTNFKEY

SEQ ID NO: 30511 - protein, 10 aa, Artificial Sequence
  Peptide Derived from Human Papillomavirus
VGENVPDDLY

SEQ ID NO: 30512 - protein, 10 aa, Artificial Sequence
  Peptide Derived from Human Papillomavirus
VSKVVSTDEY

SEQ ID NO: 30513 - protein, 8 aa, Artificial Sequence
  Peptide Derived from Human Papillomavirus
YGDSLFFY

SEQ ID NO: 30514 - protein, 8 aa, Artificial Sequence
  Peptide Derived from Human Papillomavirus
YVARTNIY

SEQ ID NO: 30515 - protein, 9 aa, Artificial Sequence
  Peptide Derived from Human Papillomavirus
YVARTNIYY

SEQ ID NO: 30516 - protein, 10 aa, Artificial Sequence
  Peptide Derived from Human Papillomavirus
AGDFYLHPSY

SEQ ID NO: 30517 - protein, 11 aa, Artificial Sequence
  Peptide Derived from Human Papillomavirus
AGDFYLHPSYY

SEQ ID NO: 30518 - protein, 9 aa, Artificial Sequence
  Peptide Derived from Human Papillomavirus
GIDVDNTLY

SEQ ID NO: 30519 - protein, 10 aa, Artificial Sequence
  Peptide Derived from Human Papillomavirus
GKSIGAKVHY

SEQ ID NO: 30520 - protein, 11 aa, Artificial Sequence
  Peptide Derived from Human Papillomavirus
GKSIGAKVHYY

SEQ ID NO: 30521 - protein, 10 aa, Artificial Sequence
  Peptide Derived from Human Papillomavirus
GSGTGGRTGY

SEQ ID NO: 30522 - protein, 11 aa, Artificial Sequence
  Peptide Derived from Human Papillomavirus
GSRPVARLGLY

SEQ ID NO: 30523 - protein, 8 aa, Artificial Sequence
  Peptide Derived from Human Papillomavirus
GTGGRTGY

SEQ ID NO: 30524 - protein, 8 aa, Artificial Sequence
  Peptide Derived from Human Papillomavirus
IADAGDFY

SEQ ID NO: 30525 - protein, 8 aa, Artificial Sequence
  Peptide Derived from Human Papillomavirus
IADQILQY

SEQ ID NO: 30526 - protein, 8 aa, Artificial Sequence
  Peptide Derived from Human Papillomavirus
IGAKVHYY

SEQ ID NO: 30527 - protein, 9 aa, Artificial Sequence
  Peptide Derived from Human Papillomavirus
IGAKVHYYY

SEQ ID NO: 30528 - protein, 9 aa, Artificial Sequence
  Peptide Derived from Human Papillomavirus
IIADAGDFY

SEQ ID NO: 30529 - protein, 10 aa, Artificial Sequence
  Peptide Derived from Human Papillomavirus
ITTPTKLITY

SEQ ID NO: 30530 - protein, 8 aa, Artificial Sequence
  Peptide Derived from Human Papillomavirus
ITYDNPAY

SEQ ID NO: 30531 - protein, 9 aa, Artificial Sequence
  Peptide Derived from Human Papillomavirus
KRASATQLY

SEQ ID NO: 30532 - protein, 9 aa, Artificial Sequence
  Peptide Derived from Human Papillomavirus
KSIGAKVHY

SEQ ID NO: 30533 - protein, 10 aa, Artificial Sequence
  Peptide Derived from Human Papillomavirus
KSIGAKVHYY

SEQ ID NO: 30534 - protein, 11 aa, Artificial Sequence
  Peptide Derived from Human Papillomavirus
KSIGAKVHYYY

SEQ ID NO: 30535 - protein, 10 aa, Artificial Sequence
  Peptide Derived from Human Papillomavirus
KTIADQILQY

SEQ ID NO: 30536 - protein, 11 aa, Artificial Sequence
  Peptide Derived from Human Papillomavirus
LSSSTISTHNY

SEQ ID NO: 30537 - protein, 10 aa, Artificial Sequence
  Peptide Derived from Human Papillomavirus
LTSRRTGIRY

SEQ ID NO: 30538 - protein, 10 aa, Artificial Sequence
  Peptide Derived from Human Papillomavirus
NTTIPFGGAY

SEQ ID NO: 30539 - protein, 8 aa, Artificial Sequence
  Peptide Derived from Human Papillomavirus
PSTSLSGY

SEQ ID NO: 30540 - protein, 11 aa, Artificial Sequence
  Peptide Derived from Human Papillomavirus
PSVPSTSLSGY

SEQ ID NO: 30541 - protein, 9 aa, Artificial Sequence
  Peptide Derived from Human Papillomavirus
PTSINNGLY

SEQ ID NO: 30542 - protein, 8 aa, Artificial Sequence
  Peptide Derived from Human Papillomavirus
PVARLGLY

SEQ ID NO: 30543 - protein, 8 aa, Artificial Sequence
  Peptide Derived from Human Papillomavirus
QTITPSTY

SEQ ID NO: 30544 - protein, 8 aa, Artificial Sequence
  Peptide Derived from Human Papillomavirus
RASATQLY

SEQ ID NO: 30545 - protein, 11 aa, Artificial Sequence
  Peptide Derived from Human Papillomavirus
RTKRASATQLY

SEQ ID NO: 30546 - protein, 10 aa, Artificial Sequence
  Peptide Derived from Human Papillomavirus
SSSTISTHNY

SEQ ID NO: 30547 - protein, 9 aa, Artificial Sequence
  Peptide Derived from Human Papillomavirus
SSTISTHNY

SEQ ID NO: 30548 - protein, 8 aa, Artificial Sequence
  Peptide Derived from Human Papillomavirus
STISTHNY

SEQ ID NO: 30549 - protein, 11 aa, Artificial Sequence
  Peptide Derived from Human Papillomavirus
TGSGTGGRTGY

SEQ ID NO: 30550 - protein, 9 aa, Artificial Sequence
  Peptide Derived from Human Papillomavirus
TIADQILQY

SEQ ID NO: 30551 - protein, 8 aa, Artificial Sequence
  Peptide Derived from Human Papillomavirus
TSINNGLY

SEQ ID NO: 30552 - protein, 11 aa, Artificial Sequence
  Peptide Derived from Human Papillomavirus
TSINNGLYDIY

SEQ ID NO: 30553 - protein, 9 aa, Artificial Sequence
  Peptide Derived from Human Papillomavirus
TSRRTGIRY

SEQ ID NO: 30554 - protein, 9 aa, Artificial Sequence
  Peptide Derived from Human Papillomavirus
TTIPFGGAY

SEQ ID NO: 30555 - protein, 9 aa, Artificial Sequence
  Peptide Derived from Human Papillomavirus
TTPTKLITY

SEQ ID NO: 30556 - protein, 9 aa, Artificial Sequence
  Peptide Derived from Human Papillomavirus
VPSTSLSGY

SEQ ID NO: 30557 - protein, 11 aa, Artificial Sequence
  Peptide Derived from Human Papillomavirus
YTIIADAGDFY

SEQ ID NO: 30558 - protein, 8 aa, Artificial Sequence
  Peptide Derived from Human Papillomavirus
AKDNRWPY

SEQ ID NO: 30559 - protein, 10 aa, Artificial Sequence
  Peptide Derived from Human Papillomavirus
AMLAVFKDTY

SEQ ID NO: 30560 - protein, 8 aa, Artificial Sequence
  Peptide Derived from Human Papillomavirus
ATTTCWTY

SEQ ID NO: 30561 - protein, 9 aa, Artificial Sequence
  Peptide Derived from Human Papillomavirus
DCATMCKHY

SEQ ID NO: 30562 - protein, 10 aa, Artificial Sequence
  Peptide Derived from Human Papillomavirus
DDATTTCWTY

SEQ ID NO: 30563 - protein, 9 aa, Artificial Sequence
  Peptide Derived from Human Papillomavirus
DESDMAFEY

SEQ ID NO: 30564 - protein, 8 aa, Artificial Sequence
  Peptide Derived from Human Papillomavirus
ESDMAFEY

SEQ ID NO: 30565 - protein, 8 aa, Artificial Sequence
  Peptide Derived from Human Papillomavirus
FTISDSGY

SEQ ID NO: 30566 - protein, 9 aa, Artificial Sequence
  Peptide Derived from Human Papillomavirus
GPANTGKSY

SEQ ID NO: 30567 - protein, 9 aa, Artificial Sequence
  Peptide Derived from Human Papillomavirus
GTGCNGWFY

SEQ ID NO: 30568 - protein, 10 aa, Artificial Sequence
  Peptide Derived from Human Papillomavirus
HPAKDNRWPY

SEQ ID NO: 30569 - protein, 8 aa, Artificial Sequence
  Peptide Derived from Human Papillomavirus
KSNCQAKY

SEQ ID NO: 30570 - protein, 10 aa, Artificial Sequence
  Peptide Derived from Human Papillomavirus
KTLIQPFILY

SEQ ID NO: 30571 - protein, 11 aa, Artificial Sequence
  Peptide Derived from Human Papillomavirus
LDDATTTCWTY

SEQ ID NO: 30572 - protein, 11 aa, Artificial Sequence
  Peptide Derived from Human Papillomavirus
LKDCATMCKHY

SEQ ID NO: 30573 - protein, 9 aa, Artificial Sequence
  Peptide Derived from Human Papillomavirus
LKSNCQAKY

SEQ ID NO: 30574 - protein, 9 aa, Artificial Sequence
  Peptide Derived from Human Papillomavirus
LRSSVAALY

SEQ ID NO: 30575 - protein, 11 aa, Artificial Sequence
  Peptide Derived from Human Papillomavirus
LRSSVAALYWY

SEQ ID NO: 30576 - protein, 11 aa, Artificial Sequence
  Peptide Derived from Human Papillomavirus
LTDESDMAFEY

SEQ ID NO: 30577 - protein, 9 aa, Artificial Sequence
  Peptide Derived from Human Papillomavirus
MLAVFKDTY

SEQ ID NO: 30578 - protein, 10 aa, Artificial Sequence
  Peptide Derived from Human Papillomavirus
PFDKNGNPVY

SEQ ID NO: 30579 - protein, 8 aa, Artificial Sequence
  Peptide Derived from Human Papillomavirus
RSSVAALY

SEQ ID NO: 30580 - protein, 10 aa, Artificial Sequence
  Peptide Derived from Human Papillomavirus
RSSVAALYWY

SEQ ID NO: 30581 - protein, 9 aa, Artificial Sequence
  Peptide Derived from Human Papillomavirus
SSVAALYWY

SEQ ID NO: 30582 - protein, 8 aa, Artificial Sequence
  Peptide Derived from Human Papillomavirus
SVAALYWY

SEQ ID NO: 30583 - protein, 10 aa, Artificial Sequence
  Peptide Derived from Human Papillomavirus
TDESDMAFEY

SEQ ID NO: 30584 - protein, 10 aa, Artificial Sequence
  Peptide Derived from Human Papillomavirus
TTCWTYFDTY

SEQ ID NO: 30585 - protein, 11 aa, Artificial Sequence
  Peptide Derived from Human Papillomavirus
TTTCWTYFDTY

SEQ ID NO: 30586 - protein, 10 aa, Artificial Sequence
  Peptide Derived from Human Papillomavirus
ATCVSHRGLY

SEQ ID NO: 30587 - protein, 11 aa, Artificial Sequence
  Peptide Derived from Human Papillomavirus
ATCVSHRGLYY

SEQ ID NO: 30588 - protein, 11 aa, Artificial Sequence
  Peptide Derived from Human Papillomavirus
CMTYVAWDSVY

SEQ ID NO: 30589 - protein, 8 aa, Artificial Sequence
  Peptide Derived from Human Papillomavirus
CVSHRGLY

SEQ ID NO: 30590 - protein, 9 aa, Artificial Sequence
  Peptide Derived from Human Papillomavirus
CVSHRGLYY

SEQ ID NO: 30591 - protein, 8 aa, Artificial Sequence
  Peptide Derived from Human Papillomavirus
DIDSQIQY

SEQ ID NO: 30592 - protein, 11 aa, Artificial Sequence
  Peptide Derived from Human Papillomavirus
DSKDIDSQIQY

SEQ ID NO: 30593 - protein, 9 aa, Artificial Sequence
  Peptide Derived from Human Papillomavirus
DSVQILVGY

SEQ ID NO: 30594 - protein, 8 aa, Artificial Sequence
  Peptide Derived from Human Papillomavirus
FKSECEKY

SEQ ID NO: 30595 - protein, 11 aa, Artificial Sequence
  Peptide Derived from Human Papillomavirus
IPDSVQILVGY

SEQ ID NO: 30596 - protein, 9 aa, Artificial Sequence
  Peptide Derived from Human Papillomavirus
KTGILTVTY

SEQ ID NO: 30597 - protein, 10 aa, Artificial Sequence
  Peptide Derived from Human Papillomavirus
MTYVAWDSVY

SEQ ID NO: 30598 - protein, 11 aa, Artificial Sequence
  Peptide Derived from Human Papillomavirus
MTYVAWDSVYY

SEQ ID NO: 30599 - protein, 8 aa, Artificial Sequence
  Peptide Derived from Human Papillomavirus
NKDNCMTY

SEQ ID NO: 30600 - protein, 8 aa, Artificial Sequence
  Peptide Derived from Human Papillomavirus
NSLKCLRY

SEQ ID NO: 30601 - protein, 10 aa, Artificial Sequence
  Peptide Derived from Human Papillomavirus
PDSVQILVGY

SEQ ID NO: 30602 - protein, 11 aa, Artificial Sequence
  Peptide Derived from Human Papillomavirus
QTLNHQVVPAY

SEQ ID NO: 30603 - protein, 9 aa, Artificial Sequence
  Peptide Derived from Human Papillomavirus
RNSLKCLRY

SEQ ID NO: 30604 - protein, 10 aa, Artificial Sequence
  Peptide Derived from Human Papillomavirus
SKDIDSQIQY

SEQ ID NO: 30605 - protein, 11 aa, Artificial Sequence
  Peptide Derived from Human Papillomavirus
STVSVGTAKTY

SEQ ID NO: 30606 - protein, 10 aa, Artificial Sequence
  Peptide Derived from Human Papillomavirus
TVSVGTAKTY

SEQ ID NO: 30607 - protein, 9 aa, Artificial Sequence
  Peptide Derived from Human Papillomavirus
VKEGYNTFY

SEQ ID NO: 30608 - protein, 9 aa, Artificial Sequence
  Peptide Derived from Human Papillomavirus
VQDKIIDHY

SEQ ID NO: 30609 - protein, 8 aa, Artificial Sequence
  Peptide Derived from Human Papillomavirus
VSHRGLYY

SEQ ID NO: 30610 - protein, 9 aa, Artificial Sequence
  Peptide Derived from Human Papillomavirus
VSVGTAKTY

SEQ ID NO: 30611 - protein, 11 aa, Artificial Sequence
  Peptide Derived from Human Papillomavirus
YIEFKSECEKY

SEQ ID NO: 30612 - protein, 8 aa, Artificial Sequence
  Peptide Derived from Human Papillomavirus
YVAWDSVY

SEQ ID NO: 30613 - protein, 9 aa, Artificial Sequence
  Peptide Derived from Human Papillomavirus
YVAWDSVYY

SEQ ID NO: 30614 - protein, 10 aa, Artificial Sequence
  Peptide Derived from Human Papillomavirus
AYAWVLVFVY

SEQ ID NO: 30615 - protein, 11 aa, Artificial Sequence
  Peptide Derived from Human Papillomavirus
ITSPATAFTVY

SEQ ID NO: 30616 - protein, 9 aa, Artificial Sequence
  Peptide Derived from Human Papillomavirus
LPSVCMCAY

SEQ ID NO: 30617 - protein, 8 aa, Artificial Sequence
  Peptide Derived from Human Papillomavirus
PSVCMCAY

SEQ ID NO: 30618 - protein, 9 aa, Artificial Sequence
  Peptide Derived from Human Papillomavirus
SPATAFTVY

SEQ ID NO: 30619 - protein, 10 aa, Artificial Sequence
  Peptide Derived from Human Papillomavirus
TSPATAFTVY

SEQ ID NO: 30620 - protein, 8 aa, Artificial Sequence
  Peptide Derived from Human Papillomavirus
DIEITCVY

SEQ ID NO: 30621 - protein, 11 aa, Artificial Sequence
  Peptide Derived from Human Papillomavirus
EFAFKDLFVVY

SEQ ID NO: 30622 - protein, 9 aa, Artificial Sequence
  Peptide Derived from Human Papillomavirus
FEDPTRRPY

SEQ ID NO: 30623 - protein, 8 aa, Artificial Sequence
  Peptide Derived from Human Papillomavirus
FKDLFVVY

SEQ ID NO: 30624 - protein, 11 aa, Artificial Sequence
  Peptide Derived from Human Papillomavirus
FYSRIRELRHY

SEQ ID NO: 30625 - protein, 11 aa, Artificial Sequence
  Peptide Derived from Human Papillomavirus
HAACHKCIDFY

SEQ ID NO: 30626 - protein, 10 aa, Artificial Sequence
  Peptide Derived from Human Papillomavirus
LQDIEITCVY

SEQ ID NO: 30627 - protein, 10 aa, Artificial Sequence
  Peptide Derived from Human Papillomavirus
RFEDPTRRPY

SEQ ID NO: 30628 - protein, 11 aa, Artificial Sequence
  Peptide Derived from Human Papillomavirus
TLEKLTNTGLY

SEQ ID NO: 30629 - protein, 10 aa, Artificial Sequence
  Peptide Derived from Human Papillomavirus
YSRIRELRHY

SEQ ID NO: 30630 - protein, 9 aa, Artificial Sequence
  Peptide Derived from Human Papillomavirus
APAENKDPY

SEQ ID NO: 30631 - protein, 8 aa, Artificial Sequence
  Peptide Derived from Human Papillomavirus
ASPGSCVY

SEQ ID NO: 30632 - protein, 11 aa, Artificial Sequence
  Peptide Derived from Human Papillomavirus
ASTQSPVPGQY

SEQ ID NO: 30633 - protein, 10 aa, Artificial Sequence
  Peptide Derived from Human Papillomavirus
CQSICKYPDY

SEQ ID NO: 30634 - protein, 11 aa, Artificial Sequence
  Peptide Derived from Human Papillomavirus
DAAPAENKDPY

SEQ ID NO: 30635 - protein, 9 aa, Artificial Sequence
  Peptide Derived from Human Papillomavirus
DGDMVDTGY

SEQ ID NO: 30636 - protein, 9 aa, Artificial Sequence
  Peptide Derived from Human Papillomavirus
DSQLFNKPY

SEQ ID NO: 30637 - protein, 8 aa, Artificial Sequence
  Peptide Derived from Human Papillomavirus
DTVPQSLY

SEQ ID NO: 30638 - protein, 8 aa, Artificial Sequence
  Peptide Derived from Human Papillomavirus
FSLDLDQY

SEQ ID NO: 30639 - protein, 8 aa, Artificial Sequence
  Peptide Derived from Human Papillomavirus
GLSGHPFY

SEQ ID NO: 30640 - protein, 11 aa, Artificial Sequence
  Peptide Derived from Human Papillomavirus
GMPASPGSCVY

SEQ ID NO: 30641 - protein, 10 aa, Artificial Sequence
  Peptide Derived from Human Papillomavirus
ITLTADVMSY

SEQ ID NO: 30642 - protein, 9 aa, Artificial Sequence
  Peptide Derived from Human Papillomavirus
KFSLDLDQY

SEQ ID NO: 30643 - protein, 10 aa, Artificial Sequence
  Peptide Derived from Human Papillomavirus
KQDIPKVSAY

SEQ ID NO: 30644 - protein, 11 aa, Artificial Sequence
  Peptide Derived from Human Papillomavirus
LEDGDMVDTGY

SEQ ID NO: 30645 - protein, 8 aa, Artificial Sequence
  Peptide Derived from Human Papillomavirus
LTADVMSY

SEQ ID NO: 30646 - protein, 10 aa, Artificial Sequence
  Peptide Derived from Human Papillomavirus
MGDTVPQSLY

SEQ ID NO: 30647 - protein, 10 aa, Artificial Sequence
  Peptide Derived from Human Papillomavirus
MPASPGSCVY

SEQ ID NO: 30648 - protein, 8 aa, Artificial Sequence
  Peptide Derived from Human Papillomavirus
PAENKDPY

SEQ ID NO: 30649 - protein, 9 aa, Artificial Sequence
  Peptide Derived from Human Papillomavirus
PASPGSCVY

SEQ ID NO: 30650 - protein, 11 aa, Artificial Sequence
  Peptide Derived from Human Papillomavirus
PLDICQSICKY

SEQ ID NO: 30651 - protein, 9 aa, Artificial Sequence
  Peptide Derived from Human Papillomavirus
PTTSLVDTY

SEQ ID NO: 30652 - protein, 9 aa, Artificial Sequence
  Peptide Derived from Human Papillomavirus
QSICKYPDY

SEQ ID NO: 30653 - protein, 8 aa, Artificial Sequence
  Peptide Derived from Human Papillomavirus
QSPVPGQY

SEQ ID NO: 30654 - protein, 10 aa, Artificial Sequence
  Peptide Derived from Human Papillomavirus
QYDATKFKQY

SEQ ID NO: 30655 - protein, 9 aa, Artificial Sequence
  Peptide Derived from Human Papillomavirus
QYSRHVEEY

SEQ ID NO: 30656 - protein, 8 aa, Artificial Sequence
  Peptide Derived from Human Papillomavirus
RPSDNTVY

SEQ ID NO: 30657 - protein, 10 aa, Artificial Sequence
  Peptide Derived from Human Papillomavirus
SDSQLFNKPY

SEQ ID NO: 30658 - protein, 11 aa, Artificial Sequence
  Peptide Derived from Human Papillomavirus
SSRLLTVGNPY

SEQ ID NO: 30659 - protein, 10 aa, Artificial Sequence
  Peptide Derived from Human Papillomavirus
STQSPVPGQY

SEQ ID NO: 30660 - protein, 11 aa, Artificial Sequence
  Peptide Derived from Human Papillomavirus
SVARVVNTDDY

SEQ ID NO: 30661 - protein, 11 aa, Artificial Sequence
  Peptide Derived from Human Papillomavirus
TMGDTVPQSLY

SEQ ID NO: 30662 - protein, 9 aa, Artificial Sequence
  Peptide Derived from Human Papillomavirus
TQSPVPGQY

SEQ ID NO: 30663 - protein, 11 aa, Artificial Sequence
  Peptide Derived from Human Papillomavirus
TSDSQLFNKPY

SEQ ID NO: 30664 - protein, 8 aa, Artificial Sequence
  Peptide Derived from Human Papillomavirus
TTSLVDTY

SEQ ID NO: 30665 - protein, 9 aa, Artificial Sequence
  Peptide Derived from Human Papillomavirus
VRDNVSVDY

SEQ ID NO: 30666 - protein, 8 aa, Artificial Sequence
  Peptide Derived from Human Papillomavirus
VTPTSIFY

SEQ ID NO: 30667 - protein, 9 aa, Artificial Sequence
  Peptide Derived from Human Papillomavirus
YDATKFKQY

SEQ ID NO: 30668 - protein, 11 aa, Artificial Sequence
  Peptide Derived from Human Papillomavirus
YMVHIIICGHY

SEQ ID NO: 30669 - protein, 8 aa, Artificial Sequence
  Peptide Derived from Human Papillomavirus
YSRHVEEY

SEQ ID NO: 30670 - protein, 9 aa, Artificial Sequence
  Peptide Derived from Human Papillomavirus
YTRVLILHY

SEQ ID NO: 30671 - protein, 11 aa, Artificial Sequence
  Peptide Derived from Human Papillomavirus
ATEDNDLFDIY

SEQ ID NO: 30672 - protein, 11 aa, Artificial Sequence
  Peptide Derived from Human Papillomavirus
DISPIAPSPEY

SEQ ID NO: 30673 - protein, 8 aa, Artificial Sequence
  Peptide Derived from Human Papillomavirus
DNDLFDIY

SEQ ID NO: 30674 - protein, 10 aa, Artificial Sequence
  Peptide Derived from Human Papillomavirus
GSGTGGRTGY

SEQ ID NO: 30675 - protein, 8 aa, Artificial Sequence
  Peptide Derived from Human Papillomavirus
GTGGRTGY

SEQ ID NO: 30676 - protein, 10 aa, Artificial Sequence
  Peptide Derived from Human Papillomavirus
GTHYYLWPLY

SEQ ID NO: 30677 - protein, 11 aa, Artificial Sequence
  Peptide Derived from Human Papillomavirus
GTHYYLWPLYY

SEQ ID NO: 30678 - protein, 10 aa, Artificial Sequence
  Peptide Derived from Human Papillomavirus
GTPTSGTHGY

SEQ ID NO: 30679 - protein, 11 aa, Artificial Sequence
  Peptide Derived from Human Papillomavirus
GTQIGARVHFY

SEQ ID NO: 30680 - protein, 8 aa, Artificial Sequence
  Peptide Derived from Human Papillomavirus
IGARVHFY

SEQ ID NO: 30681 - protein, 10 aa, Artificial Sequence
  Peptide Derived from Human Papillomavirus
ISPIAPSPEY

SEQ ID NO: 30682 - protein, 9 aa, Artificial Sequence
  Peptide Derived from Human Papillomavirus
KRASVTDLY

SEQ ID NO: 30683 - protein, 10 aa, Artificial Sequence
  Peptide Derived from Human Papillomavirus
LTRPSSLITY

SEQ ID NO: 30684 - protein, 10 aa, Artificial Sequence
  Peptide Derived from Human Papillomavirus
LTSSWDVPVY

SEQ ID NO: 30685 - protein, 8 aa, Artificial Sequence
  Peptide Derived from Human Papillomavirus
PIAPSPEY

SEQ ID NO: 30686 - protein, 9 aa, Artificial Sequence
  Peptide Derived from Human Papillomavirus
PTAPASTQY

SEQ ID NO: 30687 - protein, 9 aa, Artificial Sequence
  Peptide Derived from Human Papillomavirus
PTISSASSY

SEQ ID NO: 30688 - protein, 8 aa, Artificial Sequence
  Peptide Derived from Human Papillomavirus
PTSGTHGY

SEQ ID NO: 30689 - protein, 8 aa, Artificial Sequence
  Peptide Derived from Human Papillomavirus
RASVTDLY

SEQ ID NO: 30690 - protein, 8 aa, Artificial Sequence
  Peptide Derived from Human Papillomavirus
RPSSLITY

SEQ ID NO: 30691 - protein, 11 aa, Artificial Sequence
  Peptide Derived from Human Papillomavirus
RSTTSFAFFKY

SEQ ID NO: 30692 - protein, 8 aa, Artificial Sequence
  Peptide Derived from Human Papillomavirus
RVAGPRLY

SEQ ID NO: 30693 - protein, 8 aa, Artificial Sequence
  Peptide Derived from Human Papillomavirus
SSWDVPVY

SEQ ID NO: 30694 - protein, 10 aa, Artificial Sequence
  Peptide Derived from Human Papillomavirus
STTSFAFFKY

SEQ ID NO: 30695 - protein, 10 aa, Artificial Sequence
  Peptide Derived from Human Papillomavirus
TEDNDLFDIY

SEQ ID NO: 30696 - protein, 11 aa, Artificial Sequence
  Peptide Derived from Human Papillomavirus
TGSGTGGRTGY

SEQ ID NO: 30697 - protein, 8 aa, Artificial Sequence
  Peptide Derived from Human Papillomavirus
TISSASSY

SEQ ID NO: 30698 - protein, 8 aa, Artificial Sequence
  Peptide Derived from Human Papillomavirus
TSFAFFKY

SEQ ID NO: 30699 - protein, 9 aa, Artificial Sequence
  Peptide Derived from Human Papillomavirus
TSSWDVPVY

SEQ ID NO: 30700 - protein, 9 aa, Artificial Sequence
  Peptide Derived from Human Papillomavirus
TTSFAFFKY

SEQ ID NO: 30701 - protein, 11 aa, Artificial Sequence
  Peptide Derived from Human Papillomavirus
VSPTAPASTQY

SEQ ID NO: 30702 - protein, 11 aa, Artificial Sequence
  Peptide Derived from Human Papillomavirus
YSPTISSASSY

SEQ ID NO: 30703 - protein, 11 aa, Artificial Sequence
  Peptide Derived from Human Papillomavirus
AEAVQVLKRKY

SEQ ID NO: 30704 - protein, 10 aa, Artificial Sequence
  Peptide Derived from Human Papillomavirus
AMLGKFKELY

SEQ ID NO: 30705 - protein, 8 aa, Artificial Sequence
  Peptide Derived from Human Papillomavirus
ATTPCWHY

SEQ ID NO: 30706 - protein, 10 aa, Artificial Sequence
  Peptide Derived from Human Papillomavirus
DDATTPCWHY

SEQ ID NO: 30707 - protein, 9 aa, Artificial Sequence
  Peptide Derived from Human Papillomavirus
DDSEIAYKY

SEQ ID NO: 30708 - protein, 8 aa, Artificial Sequence
  Peptide Derived from Human Papillomavirus
DISSCVDY

SEQ ID NO: 30709 - protein, 10 aa, Artificial Sequence
  Peptide Derived from Human Papillomavirus
DLSQMVQWAY

SEQ ID NO: 30710 - protein, 8 aa, Artificial Sequence
  Peptide Derived from Human Papillomavirus
DSEIAYKY

SEQ ID NO: 30711 - protein, 8 aa, Artificial Sequence
  Peptide Derived from Human Papillomavirus
FIDNCNVY

SEQ ID NO: 30712 - protein, 8 aa, Artificial Sequence
  Peptide Derived from Human Papillomavirus
GKDDRWPY

SEQ ID NO: 30713 - protein, 9 aa, Artificial Sequence
  Peptide Derived from Human Papillomavirus
GMSNISDVY

SEQ ID NO: 30714 - protein, 9 aa, Artificial Sequence
  Peptide Derived from Human Papillomavirus
GTGCNGWFY

SEQ ID NO: 30715 - protein, 10 aa, Artificial Sequence
  Peptide Derived from Human Papillomavirus
HGAPNTGKSY

SEQ ID NO: 30716 - protein, 11 aa, Artificial Sequence
  Peptide Derived from Human Papillomavirus
INAGKDDRWPY

SEQ ID NO: 30717 - protein, 11 aa, Artificial Sequence
  Peptide Derived from Human Papillomavirus
ISFLQGCIISY

SEQ ID NO: 30718 - protein, 10 aa, Artificial Sequence
  Peptide Derived from Human Papillomavirus
KTLLQPYCLY

SEQ ID NO: 30719 - protein, 11 aa, Artificial Sequence
  Peptide Derived from Human Papillomavirus
LDDATTPCWHY

SEQ ID NO: 30720 - protein, 9 aa, Artificial Sequence
  Peptide Derived from Human Papillomavirus
LFELPDSGY

SEQ ID NO: 30721 - protein, 9 aa, Artificial Sequence
  Peptide Derived from Human Papillomavirus
LRSTAAALY

SEQ ID NO: 30722 - protein, 11 aa, Artificial Sequence
  Peptide Derived from Human Papillomavirus
LRSTAAALYWY

SEQ ID NO: 30723 - protein, 10 aa, Artificial Sequence
  Peptide Derived from Human Papillomavirus
LSDISSCVDY

SEQ ID NO: 30724 - protein, 9 aa, Artificial Sequence
  Peptide Derived from Human Papillomavirus
LSQMVQWAY

SEQ ID NO: 30725 - protein, 8 aa, Artificial Sequence
  Peptide Derived from Human Papillomavirus
MDDSEIAY

SEQ ID NO: 30726 - protein, 10 aa, Artificial Sequence
  Peptide Derived from Human Papillomavirus
MDDSEIAYKY

SEQ ID NO: 30727 - protein, 8 aa, Artificial Sequence
  Peptide Derived from Human Papillomavirus
MSNISDVY

SEQ ID NO: 30728 - protein, 11 aa, Artificial Sequence
  Peptide Derived from Human Papillomavirus
MVDFIDNCNVY

SEQ ID NO: 30729 - protein, 10 aa, Artificial Sequence
  Peptide Derived from Human Papillomavirus
PFDKNGNPVY

SEQ ID NO: 30730 - protein, 11 aa, Artificial Sequence
  Peptide Derived from Human Papillomavirus
PLSDISSCVDY

SEQ ID NO: 30731 - protein, 8 aa, Artificial Sequence
  Peptide Derived from Human Papillomavirus
RSTAAALY

SEQ ID NO: 30732 - protein, 10 aa, Artificial Sequence
  Peptide Derived from Human Papillomavirus
RSTAAALYWY

SEQ ID NO: 30733 - protein, 11 aa, Artificial Sequence
  Peptide Derived from Human Papillomavirus
RTGMSNISDVY

SEQ ID NO: 30734 - protein, 9 aa, Artificial Sequence
  Peptide Derived from Human Papillomavirus
STAAALYWY

SEQ ID NO: 30735 - protein, 8 aa, Artificial Sequence
  Peptide Derived from Human Papillomavirus
TAAALYWY

SEQ ID NO: 30736 - protein, 11 aa, Artificial Sequence
  Peptide Derived from Human Papillomavirus
TTPCWHYIDNY

SEQ ID NO: 30737 - protein, 11 aa, Artificial Sequence
  Peptide Derived from Human Papillomavirus
VKDCGTMCRHY

SEQ ID NO: 30738 - protein, 9 aa, Artificial Sequence
  Peptide Derived from Human Papillomavirus
VMDDSEIAY

SEQ ID NO: 30739 - protein, 11 aa, Artificial Sequence
  Peptide Derived from Human Papillomavirus
VMDDSEIAYKY

SEQ ID NO: 30740 - protein, 10 aa, Artificial Sequence
  Peptide Derived from Human Papillomavirus
WRDIVKFLRY

SEQ ID NO: 30741 - protein, 9 aa, Artificial Sequence
  Peptide Derived from Human Papillomavirus
CQDKILEHY

SEQ ID NO: 30742 - protein, 10 aa, Artificial Sequence
  Peptide Derived from Human Papillomavirus
DGDVHNTMHY

SEQ ID NO: 30743 - protein, 11 aa, Artificial Sequence
  Peptide Derived from Human Papillomavirus
DSKRLCDHIDY

SEQ ID NO: 30744 - protein, 8 aa, Artificial Sequence
  Peptide Derived from Human Papillomavirus
ETLNNTEY

SEQ ID NO: 30745 - protein, 8 aa, Artificial Sequence
  Peptide Derived from Human Papillomavirus
FTEEAKKY

SEQ ID NO: 30746 - protein, 11 aa, Artificial Sequence
  Peptide Derived from Human Papillomavirus
GDANILKCLRY

SEQ ID NO: 30747 - protein, 9 aa, Artificial Sequence
  Peptide Derived from Human Papillomavirus
KNAIVTLTY

SEQ ID NO: 30748 - protein, 8 aa, Artificial Sequence
  Peptide Derived from Human Papillomavirus
LSKYKQLY

SEQ ID NO: 30749 - protein, 10 aa, Artificial Sequence
  Peptide Derived from Human Papillomavirus
MLETLNNTEY

SEQ ID NO: 30750 - protein, 11 aa, Artificial Sequence
  Peptide Derived from Human Papillomavirus
MMLETLNNTEY

SEQ ID NO: 30751 - protein, 9 aa, Artificial Sequence
  Peptide Derived from Human Papillomavirus
NTVSVSTGY

SEQ ID NO: 30752 - protein, 10 aa, Artificial Sequence
  Peptide Derived from Human Papillomavirus
PTGCLKKHGY

SEQ ID NO: 30753 - protein, 8 aa, Artificial Sequence
  Peptide Derived from Human Papillomavirus
RLECVLMY

SEQ ID NO: 30754 - protein, 9 aa, Artificial Sequence
  Peptide Derived from Human Papillomavirus
RLSKYKQLY

SEQ ID NO: 30755 - protein, 11 aa, Artificial Sequence
  Peptide Derived from Human Papillomavirus
TMHYTNWKFIY

SEQ ID NO: 30756 - protein, 10 aa, Artificial Sequence
  Peptide Derived from Human Papillomavirus
TMQQTSLELY

SEQ ID NO: 30757 - protein, 8 aa, Artificial Sequence
  Peptide Derived from Human Papillomavirus
TVSVSTGY

SEQ ID NO: 30758 - protein, 8 aa, Artificial Sequence
  Peptide Derived from Human Papillomavirus
VHEGHITY

SEQ ID NO: 30759 - protein, 11 aa, Artificial Sequence
  Peptide Derived from Human Papillomavirus
WTMQQTSLELY

SEQ ID NO: 30760 - protein, 8 aa, Artificial Sequence
  Peptide Derived from Human Papillomavirus
YTNWKFIY

SEQ ID NO: 30761 - protein, 11 aa, Artificial Sequence
  Peptide Derived from Human Papillomavirus
ATSPLRCFCIY

SEQ ID NO: 30762 - protein, 10 aa, Artificial Sequence
  Peptide Derived from Human Papillomavirus
TSPLRCFCIY

SEQ ID NO: 30763 - protein, 8 aa, Artificial Sequence
  Peptide Derived from Human Papillomavirus
CTKCLRFY

SEQ ID NO: 30764 - protein, 11 aa, Artificial Sequence
  Peptide Derived from Human Papillomavirus
DFAFTDLTIVY

SEQ ID NO: 30765 - protein, 10 aa, Artificial Sequence
  Peptide Derived from Human Papillomavirus
ELSSALEIPY

SEQ ID NO: 30766 - protein, 8 aa, Artificial Sequence
  Peptide Derived from Human Papillomavirus
FTDLTIVY

SEQ ID NO: 30767 - protein, 11 aa, Artificial Sequence
  Peptide Derived from Human Papillomavirus
FYSKVSEFRWY

SEQ ID NO: 30768 - protein, 8 aa, Artificial Sequence
  Peptide Derived from Human Papillomavirus
KVSEFRWY

SEQ ID NO: 30769 - protein, 10 aa, Artificial Sequence
  Peptide Derived from Human Papillomavirus
KVSEFRWYRY

SEQ ID NO: 30770 - protein, 9 aa, Artificial Sequence
  Peptide Derived from Human Papillomavirus
LSSALEIPY

SEQ ID NO: 30771 - protein, 11 aa, Artificial Sequence
  Peptide Derived from Human Papillomavirus
PYDELRLNCVY

SEQ ID NO: 30772 - protein, 8 aa, Artificial Sequence
  Peptide Derived from Human Papillomavirus
SSALEIPY

SEQ ID NO: 30773 - protein, 9 aa, Artificial Sequence
  Peptide Derived from Human Papillomavirus
VSEFRWYRY

SEQ ID NO: 30774 - protein, 10 aa, Artificial Sequence
  Peptide Derived from Human Papillomavirus
YDELRLNCVY

SEQ ID NO: 30775 - protein, 10 aa, Artificial Sequence
  Peptide Derived from Human Papillomavirus
YSKVSEFRWY

SEQ ID NO: 30776 - protein, 8 aa, Artificial Sequence
  Peptide Derived from Human Papillomavirus
ETPTLQDY

SEQ ID NO: 30777 - protein, 10 aa, Artificial Sequence
  Peptide Derived from Human Papillomavirus
GQAEPDTSNY

SEQ ID NO: 30778 - protein, 9 aa, Artificial Sequence
  Peptide Derived from Human Papillomavirus
PEATDLHCY

SEQ ID NO: 30779 - protein, 9 aa, Artificial Sequence
  Peptide Derived from Human Papillomavirus
QAEPDTSNY

SEQ ID NO: 30780 - protein, 10 aa, Artificial Sequence
  Peptide Derived from Human Papillomavirus
QPEATDLHCY

SEQ ID NO: 30781 - protein, 10 aa, Artificial Sequence
  Peptide Derived from Human Papillomavirus
RGETPTLQDY

SEQ ID NO: 30782 - protein, 8 aa, Artificial Sequence
  Peptide Derived from Human Papillomavirus
ATLANSTY

SEQ ID NO: 30783 - protein, 10 aa, Artificial Sequence
  Peptide Derived from Human Papillomavirus
CNSICKYPDY

SEQ ID NO: 30784 - protein, 8 aa, Artificial Sequence
  Peptide Derived from Human Papillomavirus
DTENSNRY

SEQ ID NO: 30785 - protein, 8 aa, Artificial Sequence
  Peptide Derived from Human Papillomavirus
ESVPTDLY

SEQ ID NO: 30786 - protein, 10 aa, Artificial Sequence
  Peptide Derived from Human Papillomavirus
FDDTENSNRY

SEQ ID NO: 30787 - protein, 9 aa, Artificial Sequence
  Peptide Derived from Human Papillomavirus
FKSSNFKEY

SEQ ID NO: 30788 - protein, 9 aa, Artificial Sequence
  Peptide Derived from Human Papillomavirus
GESVPTDLY

SEQ ID NO: 30789 - protein, 11 aa, Artificial Sequence
  Peptide Derived from Human Papillomavirus
GSTATLANSTY

SEQ ID NO: 30790 - protein, 10 aa, Artificial Sequence
  Peptide Derived from Human Papillomavirus
ITLSADIMTY

SEQ ID NO: 30791 - protein, 8 aa, Artificial Sequence
  Peptide Derived from Human Papillomavirus
KEDPFKDY

SEQ ID NO: 30792 - protein, 11 aa, Artificial Sequence
  Peptide Derived from Human Papillomavirus
KFDDTENSNRY

SEQ ID NO: 30793 - protein, 8 aa, Artificial Sequence
  Peptide Derived from Human Papillomavirus
KSSNFKEY

SEQ ID NO: 30794 - protein, 8 aa, Artificial Sequence
  Peptide Derived from Human Papillomavirus
LSADIMTY

SEQ ID NO: 30795 - protein, 8 aa, Artificial Sequence
  Peptide Derived from Human Papillomavirus
LTVGHPYY

SEQ ID NO: 30796 - protein, 9 aa, Artificial Sequence
  Peptide Derived from Human Papillomavirus
NRECISMDY

SEQ ID NO: 30797 - protein, 9 aa, Artificial Sequence
  Peptide Derived from Human Papillomavirus
NSICKYPDY

SEQ ID NO: 30798 - protein, 9 aa, Artificial Sequence
  Peptide Derived from Human Papillomavirus
PKEDPFKDY

SEQ ID NO: 30799 - protein, 11 aa, Artificial Sequence
  Peptide Derived from Human Papillomavirus
PLDICNSICKY

SEQ ID NO: 30800 - protein, 10 aa, Artificial Sequence
  Peptide Derived from Human Papillomavirus
PPSGSLEDTY

SEQ ID NO: 30801 - protein, 9 aa, Artificial Sequence
  Peptide Derived from Human Papillomavirus
PSGSLEDTY

SEQ ID NO: 30802 - protein, 11 aa, Artificial Sequence
  Peptide Derived from Human Papillomavirus
PVSKVVSTDEY

SEQ ID NO: 30803 - protein, 8 aa, Artificial Sequence
  Peptide Derived from Human Papillomavirus
RPSEATVY

SEQ ID NO: 30804 - protein, 10 aa, Artificial Sequence
  Peptide Derived from Human Papillomavirus
SDAQIFNKPY

SEQ ID NO: 30805 - protein, 8 aa, Artificial Sequence
  Peptide Derived from Human Papillomavirus
SGSLEDTY

SEQ ID NO: 30806 - protein, 10 aa, Artificial Sequence
  Peptide Derived from Human Papillomavirus
STATLANSTY

SEQ ID NO: 30807 - protein, 11 aa, Artificial Sequence
  Peptide Derived from Human Papillomavirus
TDEYVTRTNIY

SEQ ID NO: 30808 - protein, 9 aa, Artificial Sequence
  Peptide Derived from Human Papillomavirus
TLSADIMTY

SEQ ID NO: 30809 - protein, 11 aa, Artificial Sequence
  Peptide Derived from Human Papillomavirus
TSDAQIFNKPY

SEQ ID NO: 30810 - protein, 11 aa, Artificial Sequence
  Peptide Derived from Human Papillomavirus
TTFKSSNFKEY

SEQ ID NO: 30811 - protein, 10 aa, Artificial Sequence
  Peptide Derived from Human Papillomavirus
VGESVPTDLY

SEQ ID NO: 30812 - protein, 10 aa, Artificial Sequence
  Peptide Derived from Human Papillomavirus
VSKVVSTDEY

SEQ ID NO: 30813 - protein, 8 aa, Artificial Sequence
  Peptide Derived from Human Papillomavirus
VTRTNIYY

SEQ ID NO: 30814 - protein, 8 aa, Artificial Sequence
  Peptide Derived from Human Papillomavirus
YGDTLFFY

SEQ ID NO: 30815 - protein, 9 aa, Artificial Sequence
  Peptide Derived from Human Papillomavirus
ATIGARVHY

SEQ ID NO: 30816 - protein, 10 aa, Artificial Sequence
  Peptide Derived from Human Papillomavirus
ATIGARVHYY

SEQ ID NO: 30817 - protein, 11 aa, Artificial Sequence
  Peptide Derived from Human Papillomavirus
ATIGARVHYYY

SEQ ID NO: 30818 - protein, 10 aa, Artificial Sequence
  Peptide Derived from Human Papillomavirus
ETVNAEESLY

SEQ ID NO: 30819 - protein, 11 aa, Artificial Sequence
  Peptide Derived from Human Papillomavirus
FLSAPKQLITY

SEQ ID NO: 30820 - protein, 8 aa, Artificial Sequence
  Peptide Derived from Human Papillomavirus
FVDGGDFY

SEQ ID NO: 30821 - protein, 10 aa, Artificial Sequence
  Peptide Derived from Human Papillomavirus
GGDFYLHPSY

SEQ ID NO: 30822 - protein, 11 aa, Artificial Sequence
  Peptide Derived from Human Papillomavirus
GGDFYLHPSYY

SEQ ID NO: 30823 - protein, 10 aa, Artificial Sequence
  Peptide Derived from Human Papillomavirus
GSGTGGRTGY

SEQ ID NO: 30824 - protein, 8 aa, Artificial Sequence
  Peptide Derived from Human Papillomavirus
GTGGRTGY

SEQ ID NO: 30825 - protein, 11 aa, Artificial Sequence
  Peptide Derived from Human Papillomavirus
HTTIADQILRY

SEQ ID NO: 30826 - protein, 8 aa, Artificial Sequence
  Peptide Derived from Human Papillomavirus
IADQILRY

SEQ ID NO: 30827 - protein, 8 aa, Artificial Sequence
  Peptide Derived from Human Papillomavirus
IGARVHYY

SEQ ID NO: 30828 - protein, 9 aa, Artificial Sequence
  Peptide Derived from Human Papillomavirus
IGARVHYYY

SEQ ID NO: 30829 - protein, 8 aa, Artificial Sequence
  Peptide Derived from Human Papillomavirus
ITYENPAY

SEQ ID NO: 30830 - protein, 9 aa, Artificial Sequence
  Peptide Derived from Human Papillomavirus
KRASATQLY

SEQ ID NO: 30831 - protein, 9 aa, Artificial Sequence
  Peptide Derived from Human Papillomavirus
LNDGLYDIY

SEQ ID NO: 30832 - protein, 10 aa, Artificial Sequence
  Peptide Derived from Human Papillomavirus
LSAPKQLITY

SEQ ID NO: 30833 - protein, 11 aa, Artificial Sequence
  Peptide Derived from Human Papillomavirus
LSSSSISTHNY

SEQ ID NO: 30834 - protein, 10 aa, Artificial Sequence
  Peptide Derived from Human Papillomavirus
LTSRRNTVRY

SEQ ID NO: 30835 - protein, 9 aa, Artificial Sequence
  Peptide Derived from Human Papillomavirus
QSTSAVSAY

SEQ ID NO: 30836 - protein, 8 aa, Artificial Sequence
  Peptide Derived from Human Papillomavirus
RASATQLY

SEQ ID NO: 30837 - protein, 8 aa, Artificial Sequence
  Peptide Derived from Human Papillomavirus
RPARLGLY

SEQ ID NO: 30838 - protein, 11 aa, Artificial Sequence
  Peptide Derived from Human Papillomavirus
RTKRASATQLY

SEQ ID NO: 30839 - protein, 11 aa, Artificial Sequence
  Peptide Derived from Human Papillomavirus
SGATIGARVHY

SEQ ID NO: 30840 - protein, 11 aa, Artificial Sequence
  Peptide Derived from Human Papillomavirus
SGSGTGGRTGY

SEQ ID NO: 30841 - protein, 8 aa, Artificial Sequence
  Peptide Derived from Human Papillomavirus
SSISTHNY

SEQ ID NO: 30842 - protein, 9 aa, Artificial Sequence
  Peptide Derived from Human Papillomavirus
SSSISTHNY

SEQ ID NO: 30843 - protein, 10 aa, Artificial Sequence
  Peptide Derived from Human Papillomavirus
SSSSISTHNY

SEQ ID NO: 30844 - protein, 8 aa, Artificial Sequence
  Peptide Derived from Human Papillomavirus
STLNDGLY

SEQ ID NO: 30845 - protein, 11 aa, Artificial Sequence
  Peptide Derived from Human Papillomavirus
STLNDGLYDIY

SEQ ID NO: 30846 - protein, 8 aa, Artificial Sequence
  Peptide Derived from Human Papillomavirus
STSAVSAY

SEQ ID NO: 30847 - protein, 9 aa, Artificial Sequence
  Peptide Derived from Human Papillomavirus
TIADQILRY

SEQ ID NO: 30848 - protein, 9 aa, Artificial Sequence
  Peptide Derived from Human Papillomavirus
TSRRNTVRY

SEQ ID NO: 30849 - protein, 9 aa, Artificial Sequence
  Peptide Derived from Human Papillomavirus
TSTLNDGLY

SEQ ID NO: 30850 - protein, 10 aa, Artificial Sequence
  Peptide Derived from Human Papillomavirus
TTIADQILRY

SEQ ID NO: 30851 - protein, 10 aa, Artificial Sequence
  Peptide Derived from Human Papillomavirus
TTSTLNDGLY

SEQ ID NO: 30852 - protein, 11 aa, Artificial Sequence
  Peptide Derived from Human Papillomavirus
TTTSTLNDGLY

SEQ ID NO: 30853 - protein, 8 aa, Artificial Sequence
  Peptide Derived from Human Papillomavirus
VNAEESLY

SEQ ID NO: 30854 - protein, 10 aa, Artificial Sequence
  Peptide Derived from Human Papillomavirus
VQSTSAVSAY

SEQ ID NO: 30855 - protein, 11 aa, Artificial Sequence
  Peptide Derived from Human Papillomavirus
VSIFVDGGDFY

SEQ ID NO: 30856 - protein, 9 aa, Artificial Sequence
  Peptide Derived from Human Papillomavirus
CTDWCITGY

SEQ ID NO: 30857 - protein, 8 aa, Artificial Sequence
  Peptide Derived from Human Papillomavirus
DDSDIAYY

SEQ ID NO: 30858 - protein, 9 aa, Artificial Sequence
  Peptide Derived from Human Papillomavirus
DDSDIAYYY

SEQ ID NO: 30859 - protein, 10 aa, Artificial Sequence
  Peptide Derived from Human Papillomavirus
DLSEMVQWAY

SEQ ID NO: 30860 - protein, 8 aa, Artificial Sequence
  Peptide Derived from Human Papillomavirus
DSDIAYYY

SEQ ID NO: 30861 - protein, 9 aa, Artificial Sequence
  Peptide Derived from Human Papillomavirus
FDENGNPVY

SEQ ID NO: 30862 - protein, 9 aa, Artificial Sequence
  Peptide Derived from Human Papillomavirus
GPANTGKSY

SEQ ID NO: 30863 - protein, 8 aa, Artificial Sequence
  Peptide Derived from Human Papillomavirus
GTDSRWPY

SEQ ID NO: 30864 - protein, 11 aa, Artificial Sequence
  Peptide Derived from Human Papillomavirus
HSSNTKANILY

SEQ ID NO: 30865 - protein, 11 aa, Artificial Sequence
  Peptide Derived from Human Papillomavirus
IDDVTPISWTY

SEQ ID NO: 30866 - protein, 9 aa, Artificial Sequence
  Peptide Derived from Human Papillomavirus
IDELEDSGY

SEQ ID NO: 30867 - protein, 9 aa, Artificial Sequence
  Peptide Derived from Human Papillomavirus
ISWTYIDDY

SEQ ID NO: 30868 - protein, 10 aa, Artificial Sequence
  Peptide Derived from Human Papillomavirus
KIDELEDSGY

SEQ ID NO: 30869 - protein, 9 aa, Artificial Sequence
  Peptide Derived from Human Papillomavirus
LRSQTCALY

SEQ ID NO: 30870 - protein, 9 aa, Artificial Sequence
  Peptide Derived from Human Papillomavirus
LSEMVQWAY

SEQ ID NO: 30871 - protein, 9 aa, Artificial Sequence
  Peptide Derived from Human Papillomavirus
LTDDSDIAY

SEQ ID NO: 30872 - protein, 10 aa, Artificial Sequence
  Peptide Derived from Human Papillomavirus
LTDDSDIAYY

SEQ ID NO: 30873 - protein, 11 aa, Artificial Sequence
  Peptide Derived from Human Papillomavirus
LTDDSDIAYYY

SEQ ID NO: 30874 - protein, 8 aa, Artificial Sequence
  Peptide Derived from Human Papillomavirus
NTKANILY

SEQ ID NO: 30875 - protein, 10 aa, Artificial Sequence
  Peptide Derived from Human Papillomavirus
PFDENGNPVY

SEQ ID NO: 30876 - protein, 10 aa, Artificial Sequence
  Peptide Derived from Human Papillomavirus
PISWTYIDDY

SEQ ID NO: 30877 - protein, 8 aa, Artificial Sequence
  Peptide Derived from Human Papillomavirus
RSQTCALY

SEQ ID NO: 30878 - protein, 10 aa, Artificial Sequence
  Peptide Derived from Human Papillomavirus
SSNTKANILY

SEQ ID NO: 30879 - protein, 8 aa, Artificial Sequence
  Peptide Derived from Human Papillomavirus
TDDSDIAY

SEQ ID NO: 30880 - protein, 9 aa, Artificial Sequence
  Peptide Derived from Human Papillomavirus
TDDSDIAYY

SEQ ID NO: 30881 - protein, 10 aa, Artificial Sequence
  Peptide Derived from Human Papillomavirus
TDDSDIAYYY

SEQ ID NO: 30882 - protein, 11 aa, Artificial Sequence
  Peptide Derived from Human Papillomavirus
TNAGTDSRWPY

SEQ ID NO: 30883 - protein, 11 aa, Artificial Sequence
  Peptide Derived from Human Papillomavirus
TSCTDWCITGY

SEQ ID NO: 30884 - protein, 11 aa, Artificial Sequence
  Peptide Derived from Human Papillomavirus
TSINKNKECTY

SEQ ID NO: 30885 - protein, 11 aa, Artificial Sequence
  Peptide Derived from Human Papillomavirus
VKDCGIMCRHY

SEQ ID NO: 30886 - protein, 8 aa, Artificial Sequence
  Peptide Derived from Human Papillomavirus
VTPISWTY

SEQ ID NO: 30887 - protein, 10 aa, Artificial Sequence
  Peptide Derived from Human Papillomavirus
ALETLSKSQY

SEQ ID NO: 30888 - protein, 10 aa, Artificial Sequence
  Peptide Derived from Human Papillomavirus
CTMVTGKVDY

SEQ ID NO: 30889 - protein, 10 aa, Artificial Sequence
  Peptide Derived from Human Papillomavirus
DNDKKNTMDY

SEQ ID NO: 30890 - protein, 10 aa, Artificial Sequence
  Peptide Derived from Human Papillomavirus
ESNSLKCLRY

SEQ ID NO: 30891 - protein, 8 aa, Artificial Sequence
  Peptide Derived from Human Papillomavirus
ETLSKSQY

SEQ ID NO: 30892 - protein, 8 aa, Artificial Sequence
  Peptide Derived from Human Papillomavirus
FKEDAAKY

SEQ ID NO: 30893 - protein, 11 aa, Artificial Sequence
  Peptide Derived from Human Papillomavirus
GESNSLKCLRY

SEQ ID NO: 30894 - protein, 8 aa, Artificial Sequence
  Peptide Derived from Human Papillomavirus
KVDYIGMY

SEQ ID NO: 30895 - protein, 9 aa, Artificial Sequence
  Peptide Derived from Human Papillomavirus
KVDYIGMYY

SEQ ID NO: 30896 - protein, 9 aa, Artificial Sequence
  Peptide Derived from Human Papillomavirus
NCEKVYFKY

SEQ ID NO: 30897 - protein, 8 aa, Artificial Sequence
  Peptide Derived from Human Papillomavirus
NSLKCLRY

SEQ ID NO: 30898 - protein, 9 aa, Artificial Sequence
  Peptide Derived from Human Papillomavirus
QGETVTVQY

SEQ ID NO: 30899 - protein, 8 aa, Artificial Sequence
  Peptide Derived from Human Papillomavirus
RMECALLY

SEQ ID NO: 30900 - protein, 9 aa, Artificial Sequence
  Peptide Derived from Human Papillomavirus
SNSLKCLRY

SEQ ID NO: 30901 - protein, 11 aa, Artificial Sequence
  Peptide Derived from Human Papillomavirus
TMDYTNWGEIY

SEQ ID NO: 30902 - protein, 9 aa, Artificial Sequence
  Peptide Derived from Human Papillomavirus
TMVTGKVDY

SEQ ID NO: 30903 - protein, 9 aa, Artificial Sequence
  Peptide Derived from Human Papillomavirus
VQEKILDLY

SEQ ID NO: 30904 - protein, 11 aa, Artificial Sequence
  Peptide Derived from Human Papillomavirus
VTGKVDYIGMY

SEQ ID NO: 30905 - protein, 8 aa, Artificial Sequence
  Peptide Derived from Human Papillomavirus
YTNWGEIY

SEQ ID NO: 30906 - protein, 10 aa, Artificial Sequence
  Peptide Derived from Human Papillomavirus
GSPLKIFFCY

SEQ ID NO: 30907 - protein, 11 aa, Artificial Sequence
  Peptide Derived from Human Papillomavirus
VGSPLKIFFCY

SEQ ID NO: 30908 - protein, 9 aa, Artificial Sequence
  Peptide Derived from Human Papillomavirus
AFADLTVVY

SEQ ID NO: 30909 - protein, 11 aa, Artificial Sequence
  Peptide Derived from Human Papillomavirus
DFAFADLTVVY

SEQ ID NO: 30910 - protein, 8 aa, Artificial Sequence
  Peptide Derived from Human Papillomavirus
FADLTVVY

SEQ ID NO: 30911 - protein, 8 aa, Artificial Sequence
  Peptide Derived from Human Papillomavirus
FLSKISEY

SEQ ID NO: 30912 - protein, 11 aa, Artificial Sequence
  Peptide Derived from Human Papillomavirus
FLSKISEYRHY

SEQ ID NO: 30913 - protein, 9 aa, Artificial Sequence
  Peptide Derived from Human Papillomavirus
ISEYRHYNY

SEQ ID NO: 30914 - protein, 8 aa, Artificial Sequence
  Peptide Derived from Human Papillomavirus
KISEYRHY

SEQ ID NO: 30915 - protein, 10 aa, Artificial Sequence
  Peptide Derived from Human Papillomavirus
KISEYRHYNY

SEQ ID NO: 30916 - protein, 10 aa, Artificial Sequence
  Peptide Derived from Human Papillomavirus
LSKISEYRHY

SEQ ID NO: 30917 - protein, 10 aa, Artificial Sequence
  Peptide Derived from Human Papillomavirus
GQAQPATADY

SEQ ID NO: 30918 - protein, 11 aa, Artificial Sequence
  Peptide Derived from Human Papillomavirus
GQAQPATADYY

SEQ ID NO: 30919 - protein, 9 aa, Artificial Sequence
  Peptide Derived from Human Papillomavirus
LKEYVLDLY

SEQ ID NO: 30920 - protein, 11 aa, Artificial Sequence
  Peptide Derived from Human Papillomavirus
PTLKEYVLDLY

SEQ ID NO: 30921 - protein, 8 aa, Artificial Sequence
  Peptide Derived from Human Papillomavirus
QPATADYY

SEQ ID NO: 30922 - protein, 8 aa, Artificial Sequence
  Peptide Derived from Human Papillomavirus
YPEPTDLY

SEQ ID NO: 30923 - protein, 10 aa, Artificial Sequence
  Peptide Derived from Human Papillomavirus
YPEPTDLYCY

SEQ ID NO: 30924 - protein, 10 aa, Artificial Sequence
  Peptide Derived from Human Papillomavirus
CGSTCKYPDY

SEQ ID NO: 30925 - protein, 10 aa, Artificial Sequence
  Peptide Derived from Human Papillomavirus
CTQVTSDSTY

SEQ ID NO: 30926 - protein, 8 aa, Artificial Sequence
  Peptide Derived from Human Papillomavirus
DTETGNKY

SEQ ID NO: 30927 - protein, 9 aa, Artificial Sequence
  Peptide Derived from Human Papillomavirus
EKEDPLGKY

SEQ ID NO: 30928 - protein, 9 aa, Artificial Sequence
  Peptide Derived from Human Papillomavirus
ESQLFNKPY

SEQ ID NO: 30929 - protein, 10 aa, Artificial Sequence
  Peptide Derived from Human Papillomavirus
FDDTETGNKY

SEQ ID NO: 30930 - protein, 11 aa, Artificial Sequence
  Peptide Derived from Human Papillomavirus
FKEYIRHVEEY

SEQ ID NO: 30931 - protein, 9 aa, Artificial Sequence
  Peptide Derived from Human Papillomavirus
GEAVPDDLY

SEQ ID NO: 30932 - protein, 9 aa, Artificial Sequence
  Peptide Derived from Human Papillomavirus
GSTCKYPDY

SEQ ID NO: 30933 - protein, 8 aa, Artificial Sequence
  Peptide Derived from Human Papillomavirus
KEDPLGKY

SEQ ID NO: 30934 - protein, 11 aa, Artificial Sequence
  Peptide Derived from Human Papillomavirus
KFDDTETGNKY

SEQ ID NO: 30935 - protein, 8 aa, Artificial Sequence
  Peptide Derived from Human Papillomavirus
KNENFKEY

SEQ ID NO: 30936 - protein, 10 aa, Artificial Sequence
  Peptide Derived from Human Papillomavirus
LGEAVPDDLY

SEQ ID NO: 30937 - protein, 8 aa, Artificial Sequence
  Peptide Derived from Human Papillomavirus
LLAVGHPY

SEQ ID NO: 30938 - protein, 8 aa, Artificial Sequence
  Peptide Derived from Human Papillomavirus
LTAEVMTY

SEQ ID NO: 30939 - protein, 9 aa, Artificial Sequence
  Peptide Derived from Human Papillomavirus
NRECLSMDY

SEQ ID NO: 30940 - protein, 11 aa, Artificial Sequence
  Peptide Derived from Human Papillomavirus
PIDICGSTCKY

SEQ ID NO: 30941 - protein, 11 aa, Artificial Sequence
  Peptide Derived from Human Papillomavirus
PKEKEDPLGKY

SEQ ID NO: 30942 - protein, 10 aa, Artificial Sequence
  Peptide Derived from Human Papillomavirus
PPSASLQDTY

SEQ ID NO: 30943 - protein, 9 aa, Artificial Sequence
  Peptide Derived from Human Papillomavirus
PSASLQDTY

SEQ ID NO: 30944 - protein, 11 aa, Artificial Sequence
  Peptide Derived from Human Papillomavirus
PVSKVVSTDEY

SEQ ID NO: 30945 - protein, 8 aa, Artificial Sequence
  Peptide Derived from Human Papillomavirus
RPSEATVY

SEQ ID NO: 30946 - protein, 8 aa, Artificial Sequence
  Peptide Derived from Human Papillomavirus
SASLQDTY

SEQ ID NO: 30947 - protein, 10 aa, Artificial Sequence
  Peptide Derived from Human Papillomavirus
SESQLFNKPY

SEQ ID NO: 30948 - protein, 11 aa, Artificial Sequence
  Peptide Derived from Human Papillomavirus
SSRLLAVGHPY

SEQ ID NO: 30949 - protein, 8 aa, Artificial Sequence
  Peptide Derived from Human Papillomavirus
STCKYPDY

SEQ ID NO: 30950 - protein, 11 aa, Artificial Sequence
  Peptide Derived from Human Papillomavirus
STYKNENFKEY

SEQ ID NO: 30951 - protein, 11 aa, Artificial Sequence
  Peptide Derived from Human Papillomavirus
TDEYVSRTSIY

SEQ ID NO: 30952 - protein, 11 aa, Artificial Sequence
  Peptide Derived from Human Papillomavirus
TSESQLFNKPY

SEQ ID NO: 30953 - protein, 10 aa, Artificial Sequence
  Peptide Derived from Human Papillomavirus
VSKVVSTDEY

SEQ ID NO: 30954 - protein, 8 aa, Artificial Sequence
  Peptide Derived from Human Papillomavirus
VSRTSIYY

SEQ ID NO: 30955 - protein, 9 aa, Artificial Sequence
  Peptide Derived from Human Papillomavirus
VSRTSIYYY

SEQ ID NO: 30956 - protein, 10 aa, Artificial Sequence
  Peptide Derived from Human Papillomavirus
VTLTAEVMTY

SEQ ID NO: 30957 - protein, 8 aa, Artificial Sequence
  Peptide Derived from Human Papillomavirus
YVSRTSIY

SEQ ID NO: 30958 - protein, 9 aa, Artificial Sequence
  Peptide Derived from Human Papillomavirus
YVSRTSIYY

SEQ ID NO: 30959 - protein, 10 aa, Artificial Sequence
  Peptide Derived from Human Papillomavirus
YVSRTSIYYY

SEQ ID NO: 30960 - protein, 11 aa, Artificial Sequence
  Peptide Derived from Human Papillomavirus
DGADFVLHPSY

SEQ ID NO: 30961 - protein, 11 aa, Artificial Sequence
  Peptide Derived from Human Papillomavirus
FSSPTVSTQSY

SEQ ID NO: 30962 - protein, 10 aa, Artificial Sequence
  Peptide Derived from Human Papillomavirus
GADFVLHPSY

SEQ ID NO: 30963 - protein, 8 aa, Artificial Sequence
  Peptide Derived from Human Papillomavirus
GSGGRTGY

SEQ ID NO: 30964 - protein, 10 aa, Artificial Sequence
  Peptide Derived from Human Papillomavirus
GSGSGGRTGY

SEQ ID NO: 30965 - protein, 11 aa, Artificial Sequence
  Peptide Derived from Human Papillomavirus
GSRPVARLGLY

SEQ ID NO: 30966 - protein, 11 aa, Artificial Sequence
  Peptide Derived from Human Papillomavirus
GSTIADQILKY

SEQ ID NO: 30967 - protein, 8 aa, Artificial Sequence
  Peptide Derived from Human Papillomavirus
HTPMQHSY

SEQ ID NO: 30968 - protein, 8 aa, Artificial Sequence
  Peptide Derived from Human Papillomavirus
HTVPNEQY

SEQ ID NO: 30969 - protein, 8 aa, Artificial Sequence
  Peptide Derived from Human Papillomavirus
IADQILKY

SEQ ID NO: 30970 - protein, 8 aa, Artificial Sequence
  Peptide Derived from Human Papillomavirus
IGARIHYY

SEQ ID NO: 30971 - protein, 9 aa, Artificial Sequence
  Peptide Derived from Human Papillomavirus
INDGLYDVY

SEQ ID NO: 30972 - protein, 9 aa, Artificial Sequence
  Peptide Derived from Human Papillomavirus
KRASATQLY

SEQ ID NO: 30973 - protein, 9 aa, Artificial Sequence
  Peptide Derived from Human Papillomavirus
LHDTSTSSY

SEQ ID NO: 30974 - protein, 10 aa, Artificial Sequence
  Peptide Derived from Human Papillomavirus
LTSPHKLITY

SEQ ID NO: 30975 - protein, 11 aa, Artificial Sequence
  Peptide Derived from Human Papillomavirus
PLDHTVPNEQY

SEQ ID NO: 30976 - protein, 8 aa, Artificial Sequence
  Peptide Derived from Human Papillomavirus
PTVSTQSY

SEQ ID NO: 30977 - protein, 8 aa, Artificial Sequence
  Peptide Derived from Human Papillomavirus
PVARLGLY

SEQ ID NO: 30978 - protein, 8 aa, Artificial Sequence
  Peptide Derived from Human Papillomavirus
RASATQLY

SEQ ID NO: 30979 - protein, 9 aa, Artificial Sequence
  Peptide Derived from Human Papillomavirus
SGSGGRTGY

SEQ ID NO: 30980 - protein, 10 aa, Artificial Sequence
  Peptide Derived from Human Papillomavirus
SSPTVSTQSY

SEQ ID NO: 30981 - protein, 10 aa, Artificial Sequence
  Peptide Derived from Human Papillomavirus
SSYSINDGLY

SEQ ID NO: 30982 - protein, 10 aa, Artificial Sequence
  Peptide Derived from Human Papillomavirus
STIADQILKY

SEQ ID NO: 30983 - protein, 9 aa, Artificial Sequence
  Peptide Derived from Human Papillomavirus
SYSINDGLY

SEQ ID NO: 30984 - protein, 11 aa, Artificial Sequence
  Peptide Derived from Human Papillomavirus
TGSGSGGRTGY

SEQ ID NO: 30985 - protein, 9 aa, Artificial Sequence
  Peptide Derived from Human Papillomavirus
TIADQILKY

SEQ ID NO: 30986 - protein, 9 aa, Artificial Sequence
  Peptide Derived from Human Papillomavirus
TSPHKLITY

SEQ ID NO: 30987 - protein, 11 aa, Artificial Sequence
  Peptide Derived from Human Papillomavirus
TSSYSINDGLY

SEQ ID NO: 30988 - protein, 8 aa, Artificial Sequence
  Peptide Derived from Human Papillomavirus
YSINDGLY

SEQ ID NO: 30989 - protein, 11 aa, Artificial Sequence
  Peptide Derived from Human Papillomavirus
YSINDGLYDVY

SEQ ID NO: 30990 - protein, 8 aa, Artificial Sequence
  Peptide Derived from Human Papillomavirus
AKDNKWPY

SEQ ID NO: 30991 - protein, 10 aa, Artificial Sequence
  Peptide Derived from Human Papillomavirus
AMLAVFKDIY

SEQ ID NO: 30992 - protein, 8 aa, Artificial Sequence
  Peptide Derived from Human Papillomavirus
ATHTCWTY

SEQ ID NO: 30993 - protein, 9 aa, Artificial Sequence
  Peptide Derived from Human Papillomavirus
DCAVMCRHY

SEQ ID NO: 30994 - protein, 10 aa, Artificial Sequence
  Peptide Derived from Human Papillomavirus
DDATHTCWTY

SEQ ID NO: 30995 - protein, 9 aa, Artificial Sequence
  Peptide Derived from Human Papillomavirus
DESDMAFQY

SEQ ID NO: 30996 - protein, 10 aa, Artificial Sequence
  Peptide Derived from Human Papillomavirus
DPAKDNKWPY

SEQ ID NO: 30997 - protein, 8 aa, Artificial Sequence
  Peptide Derived from Human Papillomavirus
ESDMAFQY

SEQ ID NO: 30998 - protein, 8 aa, Artificial Sequence
  Peptide Derived from Human Papillomavirus
FTISDSGY

SEQ ID NO: 30999 - protein, 9 aa, Artificial Sequence
  Peptide Derived from Human Papillomavirus
GPANTGKSY

SEQ ID NO: 31000 - protein, 11 aa, Artificial Sequence
  Peptide Derived from Human Papillomavirus
GTPKKNCILLY

SEQ ID NO: 31001 - protein, 10 aa, Artificial Sequence
  Peptide Derived from Human Papillomavirus
HTCWTYFDNY

SEQ ID NO: 31002 - protein, 8 aa, Artificial Sequence
  Peptide Derived from Human Papillomavirus
KSNCQAKY

SEQ ID NO: 31003 - protein, 10 aa, Artificial Sequence
  Peptide Derived from Human Papillomavirus
KTLIKPATLY

SEQ ID NO: 31004 - protein, 11 aa, Artificial Sequence
  Peptide Derived from Human Papillomavirus
LDDATHTCWTY

SEQ ID NO: 31005 - protein, 11 aa, Artificial Sequence
  Peptide Derived from Human Papillomavirus
LKDCAVMCRHY

SEQ ID NO: 31006 - protein, 9 aa, Artificial Sequence
  Peptide Derived from Human Papillomavirus
LKSNCQAKY

SEQ ID NO: 31007 - protein, 9 aa, Artificial Sequence
  Peptide Derived from Human Papillomavirus
LRSSVAALY

SEQ ID NO: 31008 - protein, 11 aa, Artificial Sequence
  Peptide Derived from Human Papillomavirus
LRSSVAALYWY

SEQ ID NO: 31009 - protein, 11 aa, Artificial Sequence
  Peptide Derived from Human Papillomavirus
LTDESDMAFQY

SEQ ID NO: 31010 - protein, 9 aa, Artificial Sequence
  Peptide Derived from Human Papillomavirus
MLAVFKDIY

SEQ ID NO: 31011 - protein, 8 aa, Artificial Sequence
  Peptide Derived from Human Papillomavirus
NMSQWIKY

SEQ ID NO: 31012 - protein, 10 aa, Artificial Sequence
  Peptide Derived from Human Papillomavirus
PFDKNGNPVY

SEQ ID NO: 31013 - protein, 10 aa, Artificial Sequence
  Peptide Derived from Human Papillomavirus
QMNMSQWIKY

SEQ ID NO: 31014 - protein, 8 aa, Artificial Sequence
  Peptide Derived from Human Papillomavirus
RSSVAALY

SEQ ID NO: 31015 - protein, 10 aa, Artificial Sequence
  Peptide Derived from Human Papillomavirus
RSSVAALYWY

SEQ ID NO: 31016 - protein, 9 aa, Artificial Sequence
  Peptide Derived from Human Papillomavirus
SSVAALYWY

SEQ ID NO: 31017 - protein, 8 aa, Artificial Sequence
  Peptide Derived from Human Papillomavirus
SVAALYWY

SEQ ID NO: 31018 - protein, 10 aa, Artificial Sequence
  Peptide Derived from Human Papillomavirus
TDESDMAFQY

SEQ ID NO: 31019 - protein, 11 aa, Artificial Sequence
  Peptide Derived from Human Papillomavirus
CMNYVVWDSIY

SEQ ID NO: 31020 - protein, 8 aa, Artificial Sequence
  Peptide Derived from Human Papillomavirus
CVSYWGVY

SEQ ID NO: 31021 - protein, 9 aa, Artificial Sequence
  Peptide Derived from Human Papillomavirus
CVSYWGVYY

SEQ ID NO: 31022 - protein, 11 aa, Artificial Sequence
  Peptide Derived from Human Papillomavirus
DSKDINSQISY

SEQ ID NO: 31023 - protein, 8 aa, Artificial Sequence
  Peptide Derived from Human Papillomavirus
FKSECEKY

SEQ ID NO: 31024 - protein, 10 aa, Artificial Sequence
  Peptide Derived from Human Papillomavirus
GNSNTWEVQY

SEQ ID NO: 31025 - protein, 8 aa, Artificial Sequence
  Peptide Derived from Human Papillomavirus
IKDGDTTY

SEQ ID NO: 31026 - protein, 9 aa, Artificial Sequence
  Peptide Derived from Human Papillomavirus
IKDGDTTYY

SEQ ID NO: 31027 - protein, 11 aa, Artificial Sequence
  Peptide Derived from Human Papillomavirus
IWDKTAACVSY

SEQ ID NO: 31028 - protein, 9 aa, Artificial Sequence
  Peptide Derived from Human Papillomavirus
KNSLKCLRY

SEQ ID NO: 31029 - protein, 8 aa, Artificial Sequence
  Peptide Derived from Human Papillomavirus
KTAACVSY

SEQ ID NO: 31030 - protein, 9 aa, Artificial Sequence
  Peptide Derived from Human Papillomavirus
LQDKILDHY

SEQ ID NO: 31031 - protein, 8 aa, Artificial Sequence
  Peptide Derived from Human Papillomavirus
NKDNCMNY

SEQ ID NO: 31032 - protein, 8 aa, Artificial Sequence
  Peptide Derived from Human Papillomavirus
NSLKCLRY

SEQ ID NO: 31033 - protein, 9 aa, Artificial Sequence
  Peptide Derived from Human Papillomavirus
NSNTWEVQY

SEQ ID NO: 31034 - protein, 9 aa, Artificial Sequence
  Peptide Derived from Human Papillomavirus
NSVQISVGY

SEQ ID NO: 31035 - protein, 9 aa, Artificial Sequence
  Peptide Derived from Human Papillomavirus
NTGILTVTY

SEQ ID NO: 31036 - protein, 10 aa, Artificial Sequence
  Peptide Derived from Human Papillomavirus
PNSVQISVGY

SEQ ID NO: 31037 - protein, 10 aa, Artificial Sequence
  Peptide Derived from Human Papillomavirus
SKDINSQISY

SEQ ID NO: 31038 - protein, 11 aa, Artificial Sequence
  Peptide Derived from Human Papillomavirus
TAACVSYWGVY

SEQ ID NO: 31039 - protein, 8 aa, Artificial Sequence
  Peptide Derived from Human Papillomavirus
VSYWGVYY

SEQ ID NO: 31040 - protein, 9 aa, Artificial Sequence
  Peptide Derived from Human Papillomavirus
ATLERTEVY

SEQ ID NO: 31041 - protein, 11 aa, Artificial Sequence
  Peptide Derived from Human Papillomavirus
CKATLERTEVY

SEQ ID NO: 31042 - protein, 8 aa, Artificial Sequence
  Peptide Derived from Human Papillomavirus
DVSIACVY

SEQ ID NO: 31043 - protein, 9 aa, Artificial Sequence
  Peptide Derived from Human Papillomavirus
FDDPTQRPY

SEQ ID NO: 31044 - protein, 8 aa, Artificial Sequence
  Peptide Derived from Human Papillomavirus
FHSIAGQY

SEQ ID NO: 31045 - protein, 8 aa, Artificial Sequence
  Peptide Derived from Human Papillomavirus
FKDLFIVY

SEQ ID NO: 31046 - protein, 10 aa, Artificial Sequence
  Peptide Derived from Human Papillomavirus
FYSRIRELRY

SEQ ID NO: 31047 - protein, 11 aa, Artificial Sequence
  Peptide Derived from Human Papillomavirus
FYSRIRELRYY

SEQ ID NO: 31048 - protein, 10 aa, Artificial Sequence
  Peptide Derived from Human Papillomavirus
LQDVSIACVY

SEQ ID NO: 31049 - protein, 11 aa, Artificial Sequence
  Peptide Derived from Human Papillomavirus
QFAFKDLFIVY

SEQ ID NO: 31050 - protein, 10 aa, Artificial Sequence
  Peptide Derived from Human Papillomavirus
RFDDPTQRPY

SEQ ID NO: 31051 - protein, 11 aa, Artificial Sequence
  Peptide Derived from Human Papillomavirus
TLEKITNTELY

SEQ ID NO: 31052 - protein, 8 aa, Artificial Sequence
  Peptide Derived from Human Papillomavirus
TLERTEVY

SEQ ID NO: 31053 - protein, 11 aa, Artificial Sequence
  Peptide Derived from Human Papillomavirus
YAACHKCIDFY

SEQ ID NO: 31054 - protein, 9 aa, Artificial Sequence
  Peptide Derived from Human Papillomavirus
YSRIRELRY

SEQ ID NO: 31055 - protein, 10 aa, Artificial Sequence
  Peptide Derived from Human Papillomavirus
YSRIRELRYY

SEQ ID NO: 31056 - protein, 10 aa, Artificial Sequence
  Peptide Derived from Human Papillomavirus
ELDPVDLLCY

SEQ ID NO: 31057 - protein, 11 aa, Artificial Sequence
  Peptide Derived from Human Papillomavirus
ASTQNPVPNTY

SEQ ID NO: 31058 - protein, 10 aa, Artificial Sequence
  Peptide Derived from Human Papillomavirus
CQSICKYPDY

SEQ ID NO: 31059 - protein, 9 aa, Artificial Sequence
  Peptide Derived from Human Papillomavirus
DGDMVDTGY

SEQ ID NO: 31060 - protein, 9 aa, Artificial Sequence
  Peptide Derived from Human Papillomavirus
DSQLFNKPY

SEQ ID NO: 31061 - protein, 11 aa, Artificial Sequence
  Peptide Derived from Human Papillomavirus
DTTPPEKQDPY

SEQ ID NO: 31062 - protein, 8 aa, Artificial Sequence
  Peptide Derived from Human Papillomavirus
DTVPTDLY

SEQ ID NO: 31063 - protein, 8 aa, Artificial Sequence
  Peptide Derived from Human Papillomavirus
ETPGSCVY

SEQ ID NO: 31064 - protein, 8 aa, Artificial Sequence
  Peptide Derived from Human Papillomavirus
FSSDLDQY

SEQ ID NO: 31065 - protein, 8 aa, Artificial Sequence
  Peptide Derived from Human Papillomavirus
GLSGHPFY

SEQ ID NO: 31066 - protein, 9 aa, Artificial Sequence
  Peptide Derived from Human Papillomavirus
HYSRHVEEY

SEQ ID NO: 31067 - protein, 11 aa, Artificial Sequence
  Peptide Derived from Human Papillomavirus
IEDGDMVDTGY

SEQ ID NO: 31068 - protein, 10 aa, Artificial Sequence
  Peptide Derived from Human Papillomavirus
ITLTAEVMSY

SEQ ID NO: 31069 - protein, 9 aa, Artificial Sequence
  Peptide Derived from Human Papillomavirus
KFSSDLDQY

SEQ ID NO: 31070 - protein, 10 aa, Artificial Sequence
  Peptide Derived from Human Papillomavirus
KQAVPKVSAY

SEQ ID NO: 31071 - protein, 8 aa, Artificial Sequence
  Peptide Derived from Human Papillomavirus
LTAEVMSY

SEQ ID NO: 31072 - protein, 10 aa, Artificial Sequence
  Peptide Derived from Human Papillomavirus
MGDTVPTDLY

SEQ ID NO: 31073 - protein, 10 aa, Artificial Sequence
  Peptide Derived from Human Papillomavirus
MRETPGSCVY

SEQ ID NO: 31074 - protein, 11 aa, Artificial Sequence
  Peptide Derived from Human Papillomavirus
NMRETPGSCVY

SEQ ID NO: 31075 - protein, 11 aa, Artificial Sequence
  Peptide Derived from Human Papillomavirus
NTYDPTKFKHY

SEQ ID NO: 31076 - protein, 11 aa, Artificial Sequence
  Peptide Derived from Human Papillomavirus
PLDICQSICKY

SEQ ID NO: 31077 - protein, 8 aa, Artificial Sequence
  Peptide Derived from Human Papillomavirus
PPEKQDPY

SEQ ID NO: 31078 - protein, 9 aa, Artificial Sequence
  Peptide Derived from Human Papillomavirus
PTTSLVDTY

SEQ ID NO: 31079 - protein, 9 aa, Artificial Sequence
  Peptide Derived from Human Papillomavirus
QSICKYPDY

SEQ ID NO: 31080 - protein, 8 aa, Artificial Sequence
  Peptide Derived from Human Papillomavirus
RPSDSTVY

SEQ ID NO: 31081 - protein, 10 aa, Artificial Sequence
  Peptide Derived from Human Papillomavirus
SDSQLFNKPY

SEQ ID NO: 31082 - protein, 11 aa, Artificial Sequence
  Peptide Derived from Human Papillomavirus
SSRLLTVGNPY

SEQ ID NO: 31083 - protein, 10 aa, Artificial Sequence
  Peptide Derived from Human Papillomavirus
STQNPVPNTY

SEQ ID NO: 31084 - protein, 11 aa, Artificial Sequence
  Peptide Derived from Human Papillomavirus
SVARVVNTDDY

SEQ ID NO: 31085 - protein, 11 aa, Artificial Sequence
  Peptide Derived from Human Papillomavirus
TSDSQLFNKPY

SEQ ID NO: 31086 - protein, 10 aa, Artificial Sequence
  Peptide Derived from Human Papillomavirus
TTPPEKQDPY

SEQ ID NO: 31087 - protein, 8 aa, Artificial Sequence
  Peptide Derived from Human Papillomavirus
TTSLVDTY

SEQ ID NO: 31088 - protein, 10 aa, Artificial Sequence
  Peptide Derived from Human Papillomavirus
TYDPTKFKHY

SEQ ID NO: 31089 - protein, 11 aa, Artificial Sequence
  Peptide Derived from Human Papillomavirus
VMGDTVPTDLY

SEQ ID NO: 31090 - protein, 9 aa, Artificial Sequence
  Peptide Derived from Human Papillomavirus
VRDNVSVDY

SEQ ID NO: 31091 - protein, 8 aa, Artificial Sequence
  Peptide Derived from Human Papillomavirus
VSRTSIFY

SEQ ID NO: 31092 - protein, 8 aa, Artificial Sequence
  Peptide Derived from Human Papillomavirus
YSRHVEEY

SEQ ID NO: 31093 - protein, 9 aa, Artificial Sequence
  Peptide Derived from Human Papillomavirus
YVSRTSIFY

SEQ ID NO: 31094 - protein, 11 aa, Artificial Sequence
  Peptide Derived from Human Papillomavirus
ATNDSDLFDVY

SEQ ID NO: 31095 - protein, 8 aa, Artificial Sequence
  Peptide Derived from Human Papillomavirus
DSDLFDVY

SEQ ID NO: 31096 - protein, 8 aa, Artificial Sequence
  Peptide Derived from Human Papillomavirus
GSGGRTGY

SEQ ID NO: 31097 - protein, 10 aa, Artificial Sequence
  Peptide Derived from Human Papillomavirus
GSGSGGRTGY

SEQ ID NO: 31098 - protein, 10 aa, Artificial Sequence
  Peptide Derived from Human Papillomavirus
GTPTSGSHGY

SEQ ID NO: 31099 - protein, 10 aa, Artificial Sequence
  Peptide Derived from Human Papillomavirus
GTQYYLWPWY

SEQ ID NO: 31100 - protein, 11 aa, Artificial Sequence
  Peptide Derived from Human Papillomavirus
GTQYYLWPWYY

SEQ ID NO: 31101 - protein, 9 aa, Artificial Sequence
  Peptide Derived from Human Papillomavirus
HKSFTYPKY

SEQ ID NO: 31102 - protein, 9 aa, Artificial Sequence
  Peptide Derived from Human Papillomavirus
KRASATDLY

SEQ ID NO: 31103 - protein, 8 aa, Artificial Sequence
  Peptide Derived from Human Papillomavirus
KSFTYPKY

SEQ ID NO: 31104 - protein, 11 aa, Artificial Sequence
  Peptide Derived from Human Papillomavirus
LTMPSTAASSY

SEQ ID NO: 31105 - protein, 10 aa, Artificial Sequence
  Peptide Derived from Human Papillomavirus
LTSAWDVPIY

SEQ ID NO: 31106 - protein, 9 aa, Artificial Sequence
  Peptide Derived from Human Papillomavirus
MPSTAASSY

SEQ ID NO: 31107 - protein, 9 aa, Artificial Sequence
  Peptide Derived from Human Papillomavirus
NDSDLFDVY

SEQ ID NO: 31108 - protein, 8 aa, Artificial Sequence
  Peptide Derived from Human Papillomavirus
PSTAASSY

SEQ ID NO: 31109 - protein, 10 aa, Artificial Sequence
  Peptide Derived from Human Papillomavirus
PSTIHKSFTY

SEQ ID NO: 31110 - protein, 9 aa, Artificial Sequence
  Peptide Derived from Human Papillomavirus
PTNASTTTY

SEQ ID NO: 31111 - protein, 8 aa, Artificial Sequence
  Peptide Derived from Human Papillomavirus
PTSGSHGY

SEQ ID NO: 31112 - protein, 8 aa, Artificial Sequence
  Peptide Derived from Human Papillomavirus
RASATDLY

SEQ ID NO: 31113 - protein, 9 aa, Artificial Sequence
  Peptide Derived from Human Papillomavirus
SGSGGRTGY

SEQ ID NO: 31114 - protein, 11 aa, Artificial Sequence
  Peptide Derived from Human Papillomavirus
SSLVTFDNPAY

SEQ ID NO: 31115 - protein, 9 aa, Artificial Sequence
  Peptide Derived from Human Papillomavirus
STIHKSFTY

SEQ ID NO: 31116 - protein, 11 aa, Artificial Sequence
  Peptide Derived from Human Papillomavirus
TGSGSGGRTGY

SEQ ID NO: 31117 - protein, 10 aa, Artificial Sequence
  Peptide Derived from Human Papillomavirus
TMPSTAASSY

SEQ ID NO: 31118 - protein, 8 aa, Artificial Sequence
  Peptide Derived from Human Papillomavirus
TNASTTTY

SEQ ID NO: 31119 - protein, 10 aa, Artificial Sequence
  Peptide Derived from Human Papillomavirus
TNDSDLFDVY

SEQ ID NO: 31120 - protein, 11 aa, Artificial Sequence
  Peptide Derived from Human Papillomavirus
TPSTIHKSFTY

SEQ ID NO: 31121 - protein, 9 aa, Artificial Sequence
  Peptide Derived from Human Papillomavirus
TSAWDVPIY

SEQ ID NO: 31122 - protein, 11 aa, Artificial Sequence
  Peptide Derived from Human Papillomavirus
TSPTNASTTTY

SEQ ID NO: 31123 - protein, 11 aa, Artificial Sequence
  Peptide Derived from Human Papillomavirus
TTYIGIHGTQY

SEQ ID NO: 31124 - protein, 8 aa, Artificial Sequence
  Peptide Derived from Human Papillomavirus
VTFDNPAY

SEQ ID NO: 31125 - protein, 10 aa, Artificial Sequence
  Peptide Derived from Human Papillomavirus
ALESLSTTIY

SEQ ID NO: 31126 - protein, 9 aa, Artificial Sequence
  Peptide Derived from Human Papillomavirus
CMQYVAWKY

SEQ ID NO: 31127 - protein, 11 aa, Artificial Sequence
  Peptide Derived from Human Papillomavirus
CMQYVAWKYIY

SEQ ID NO: 31128 - protein, 11 aa, Artificial Sequence
  Peptide Derived from Human Papillomavirus
CPDSVSSTCRY

SEQ ID NO: 31129 - protein, 10 aa, Artificial Sequence
  Peptide Derived from Human Papillomavirus
CSGVDYRGIY

SEQ ID NO: 31130 - protein, 11 aa, Artificial Sequence
  Peptide Derived from Human Papillomavirus
CSGVDYRGIYY

SEQ ID NO: 31131 - protein, 10 aa, Artificial Sequence
  Peptide Derived from Human Papillomavirus
DGSKNNCMQY

SEQ ID NO: 31132 - protein, 9 aa, Artificial Sequence
  Peptide Derived from Human Papillomavirus
DSVSSTCRY

SEQ ID NO: 31133 - protein, 8 aa, Artificial Sequence
  Peptide Derived from Human Papillomavirus
ESLSTTIY

SEQ ID NO: 31134 - protein, 11 aa, Artificial Sequence
  Peptide Derived from Human Papillomavirus
FLSHVKIPVVY

SEQ ID NO: 31135 - protein, 8 aa, Artificial Sequence
  Peptide Derived from Human Papillomavirus
FVDVTSTY

SEQ ID NO: 31136 - protein, 9 aa, Artificial Sequence
  Peptide Derived from Human Papillomavirus
GSKNNCMQY

SEQ ID NO: 31137 - protein, 8 aa, Artificial Sequence
  Peptide Derived from Human Papillomavirus
GVDYRGIY

SEQ ID NO: 31138 - protein, 9 aa, Artificial Sequence
  Peptide Derived from Human Papillomavirus
GVDYRGIYY

SEQ ID NO: 31139 - protein, 8 aa, Artificial Sequence
  Peptide Derived from Human Papillomavirus
HMENESIY

SEQ ID NO: 31140 - protein, 11 aa, Artificial Sequence
  Peptide Derived from Human Papillomavirus
KTLFVDVTSTY

SEQ ID NO: 31141 - protein, 9 aa, Artificial Sequence
  Peptide Derived from Human Papillomavirus
LESLSTTIY

SEQ ID NO: 31142 - protein, 10 aa, Artificial Sequence
  Peptide Derived from Human Papillomavirus
LSHVKIPVVY

SEQ ID NO: 31143 - protein, 11 aa, Artificial Sequence
  Peptide Derived from Human Papillomavirus
NVSPVETVNEY

SEQ ID NO: 31144 - protein, 9 aa, Artificial Sequence
  Peptide Derived from Human Papillomavirus
NYSIITIIY

SEQ ID NO: 31145 - protein, 10 aa, Artificial Sequence
  Peptide Derived from Human Papillomavirus
PDSVSSTCRY

SEQ ID NO: 31146 - protein, 8 aa, Artificial Sequence
  Peptide Derived from Human Papillomavirus
PVETVNEY

SEQ ID NO: 31147 - protein, 8 aa, Artificial Sequence
  Peptide Derived from Human Papillomavirus
SVSSTCRY

SEQ ID NO: 31148 - protein, 8 aa, Artificial Sequence
  Peptide Derived from Human Papillomavirus
TSTDNKNY

SEQ ID NO: 31149 - protein, 11 aa, Artificial Sequence
  Peptide Derived from Human Papillomavirus
VCSGVDYRGIY

SEQ ID NO: 31150 - protein, 8 aa, Artificial Sequence
  Peptide Derived from Human Papillomavirus
VHDGHKTY

SEQ ID NO: 31151 - protein, 9 aa, Artificial Sequence
  Peptide Derived from Human Papillomavirus
VHDGHKTYY

SEQ ID NO: 31152 - protein, 10 aa, Artificial Sequence
  Peptide Derived from Human Papillomavirus
VSPVETVNEY

SEQ ID NO: 31153 - protein, 9 aa, Artificial Sequence
  Peptide Derived from Human Papillomavirus
WTSTDNKNY

SEQ ID NO: 31154 - protein, 8 aa, Artificial Sequence
  Peptide Derived from Human Papillomavirus
YSIITIIY

SEQ ID NO: 31155 - protein, 8 aa, Artificial Sequence
  Peptide Derived from Human Papillomavirus
YVAWKYIY

SEQ ID NO: 31156 - protein, 9 aa, Artificial Sequence
  Peptide Derived from Human Papillomavirus
YVAWKYIYY

SEQ ID NO: 31157 - protein, 8 aa, Artificial Sequence
  Peptide Derived from Human Papillomavirus
CTELKLVY

SEQ ID NO: 31158 - protein, 8 aa, Artificial Sequence
  Peptide Derived from Human Papillomavirus
FYSKVRKY

SEQ ID NO: 31159 - protein, 10 aa, Artificial Sequence
  Peptide Derived from Human Papillomavirus
FYSKVRKYRY

SEQ ID NO: 31160 - protein, 11 aa, Artificial Sequence
  Peptide Derived from Human Papillomavirus
FYSKVRKYRYY

SEQ ID NO: 31161 - protein, 10 aa, Artificial Sequence
  Peptide Derived from Human Papillomavirus
KKELTRAEVY

SEQ ID NO: 31162 - protein, 9 aa, Artificial Sequence
  Peptide Derived from Human Papillomavirus
LCDLLIRCY

SEQ ID NO: 31163 - protein, 10 aa, Artificial Sequence
  Peptide Derived from Human Papillomavirus
LIDLRLSCVY

SEQ ID NO: 31164 - protein, 11 aa, Artificial Sequence
  Peptide Derived from Human Papillomavirus
NFACTELKLVY

SEQ ID NO: 31165 - protein, 9 aa, Artificial Sequence
  Peptide Derived from Human Papillomavirus
YSKVRKYRY

SEQ ID NO: 31166 - protein, 10 aa, Artificial Sequence
  Peptide Derived from Human Papillomavirus
YSKVRKYRYY

SEQ ID NO: 31167 - protein, 9 aa, Artificial Sequence
  Peptide Derived from Human Papillomavirus
RQAKQHTCY

SEQ ID NO: 31168 - protein, 11 aa, Artificial Sequence
  Peptide Derived from Human Papillomavirus
ADAYGDSMWFY

SEQ ID NO: 31169 - protein, 8 aa, Artificial Sequence
  Peptide Derived from Human Papillomavirus
ATEQLSKY

SEQ ID NO: 31170 - protein, 8 aa, Artificial Sequence
  Peptide Derived from Human Papillomavirus
ATSLEDKY

SEQ ID NO: 31171 - protein, 10 aa, Artificial Sequence
  Peptide Derived from Human Papillomavirus
ATSLEDKYRY

SEQ ID NO: 31172 - protein, 11 aa, Artificial Sequence
  Peptide Derived from Human Papillomavirus
ATWRPSENKVY

SEQ ID NO: 31173 - protein, 11 aa, Artificial Sequence
  Peptide Derived from Human Papillomavirus
DSYVKRTSIFY

SEQ ID NO: 31174 - protein, 8 aa, Artificial Sequence
  Peptide Derived from Human Papillomavirus
ETIPAELY

SEQ ID NO: 31175 - protein, 10 aa, Artificial Sequence
  Peptide Derived from Human Papillomavirus
GREPPPSSVY

SEQ ID NO: 31176 - protein, 11 aa, Artificial Sequence
  Peptide Derived from Human Papillomavirus
ISTATEQLSKY

SEQ ID NO: 31177 - protein, 10 aa, Artificial Sequence
  Peptide Derived from Human Papillomavirus
ITLSAEVMAY

SEQ ID NO: 31178 - protein, 8 aa, Artificial Sequence
  Peptide Derived from Human Papillomavirus
KQDPLAKY

SEQ ID NO: 31179 - protein, 10 aa, Artificial Sequence
  Peptide Derived from Human Papillomavirus
KTNIPKVSAY

SEQ ID NO: 31180 - protein, 10 aa, Artificial Sequence
  Peptide Derived from Human Papillomavirus
KYDARKINQY

SEQ ID NO: 31181 - protein, 8 aa, Artificial Sequence
  Peptide Derived from Human Papillomavirus
LLAVGHPY

SEQ ID NO: 31182 - protein, 9 aa, Artificial Sequence
  Peptide Derived from Human Papillomavirus
LLAVGHPYY

SEQ ID NO: 31183 - protein, 8 aa, Artificial Sequence
  Peptide Derived from Human Papillomavirus
LSAEVMAY

SEQ ID NO: 31184 - protein, 9 aa, Artificial Sequence
  Peptide Derived from Human Papillomavirus
MMLPMMYIY

SEQ ID NO: 31185 - protein, 11 aa, Artificial Sequence
  Peptide Derived from Human Papillomavirus
PLDIVQSTCKY

SEQ ID NO: 31186 - protein, 11 aa, Artificial Sequence
  Peptide Derived from Human Papillomavirus
PTEKQDPLAKY

SEQ ID NO: 31187 - protein, 10 aa, Artificial Sequence
  Peptide Derived from Human Papillomavirus
PVATSLEDKY

SEQ ID NO: 31188 - protein, 11 aa, Artificial Sequence
  Peptide Derived from Human Papillomavirus
PVSKVVATDSY

SEQ ID NO: 31189 - protein, 9 aa, Artificial Sequence
  Peptide Derived from Human Papillomavirus
QSTCKYPDY

SEQ ID NO: 31190 - protein, 8 aa, Artificial Sequence
  Peptide Derived from Human Papillomavirus
RPSENKVY

SEQ ID NO: 31191 - protein, 10 aa, Artificial Sequence
  Peptide Derived from Human Papillomavirus
RREQLFARHY

SEQ ID NO: 31192 - protein, 10 aa, Artificial Sequence
  Peptide Derived from Human Papillomavirus
SEAQLFNKPY

SEQ ID NO: 31193 - protein, 8 aa, Artificial Sequence
  Peptide Derived from Human Papillomavirus
SLEDKYRY

SEQ ID NO: 31194 - protein, 11 aa, Artificial Sequence
  Peptide Derived from Human Papillomavirus
SSRLLAVGHPY

SEQ ID NO: 31195 - protein, 10 aa, Artificial Sequence
  Peptide Derived from Human Papillomavirus
STATEQLSKY

SEQ ID NO: 31196 - protein, 8 aa, Artificial Sequence
  Peptide Derived from Human Papillomavirus
STCKYPDY

SEQ ID NO: 31197 - protein, 9 aa, Artificial Sequence
  Peptide Derived from Human Papillomavirus
TLSAEVMAY

SEQ ID NO: 31198 - protein, 11 aa, Artificial Sequence
  Peptide Derived from Human Papillomavirus
TSEAQLFNKPY

SEQ ID NO: 31199 - protein, 9 aa, Artificial Sequence
  Peptide Derived from Human Papillomavirus
TSLEDKYRY

SEQ ID NO: 31200 - protein, 10 aa, Artificial Sequence
  Peptide Derived from Human Papillomavirus
VGETIPAELY

SEQ ID NO: 31201 - protein, 10 aa, Artificial Sequence
  Peptide Derived from Human Papillomavirus
VQSTCKYPDY

SEQ ID NO: 31202 - protein, 10 aa, Artificial Sequence
  Peptide Derived from Human Papillomavirus
VSKVVATDSY

SEQ ID NO: 31203 - protein, 9 aa, Artificial Sequence
  Peptide Derived from Human Papillomavirus
YDARKINQY

SEQ ID NO: 31204 - protein, 8 aa, Artificial Sequence
  Peptide Derived from Human Papillomavirus
YGDSMWFY

SEQ ID NO: 31205 - protein, 8 aa, Artificial Sequence
  Peptide Derived from Human Papillomavirus
YRDPPLHY

SEQ ID NO: 31206 - protein, 8 aa, Artificial Sequence
  Peptide Derived from Human Papillomavirus
GSGGRAGY

SEQ ID NO: 31207 - protein, 10 aa, Artificial Sequence
  Peptide Derived from Human Papillomavirus
GSSFALWPVY

SEQ ID NO: 31208 - protein, 10 aa, Artificial Sequence
  Peptide Derived from Human Papillomavirus
GTGSGGRAGY

SEQ ID NO: 31209 - protein, 10 aa, Artificial Sequence
  Peptide Derived from Human Papillomavirus
GTQIGARVHY

SEQ ID NO: 31210 - protein, 11 aa, Artificial Sequence
  Peptide Derived from Human Papillomavirus
GTQIGARVHYY

SEQ ID NO: 31211 - protein, 8 aa, Artificial Sequence
  Peptide Derived from Human Papillomavirus
IGARVHYY

SEQ ID NO: 31212 - protein, 9 aa, Artificial Sequence
  Peptide Derived from Human Papillomavirus
IGARVHYYY

SEQ ID NO: 31213 - protein, 11 aa, Artificial Sequence
  Peptide Derived from Human Papillomavirus
ISTPTSGIHSY

SEQ ID NO: 31214 - protein, 9 aa, Artificial Sequence
  Peptide Derived from Human Papillomavirus
KRASATQLY

SEQ ID NO: 31215 - protein, 11 aa, Artificial Sequence
  Peptide Derived from Human Papillomavirus
LSANNSFDGLY

SEQ ID NO: 31216 - protein, 8 aa, Artificial Sequence
  Peptide Derived from Human Papillomavirus
NNSFDGLY

SEQ ID NO: 31217 - protein, 11 aa, Artificial Sequence
  Peptide Derived from Human Papillomavirus
NNSFDGLYDIY

SEQ ID NO: 31218 - protein, 10 aa, Artificial Sequence
  Peptide Derived from Human Papillomavirus
NSFDGLYDIY

SEQ ID NO: 31219 - protein, 8 aa, Artificial Sequence
  Peptide Derived from Human Papillomavirus
PTSGIHSY

SEQ ID NO: 31220 - protein, 9 aa, Artificial Sequence
  Peptide Derived from Human Papillomavirus
PYDVTHDVY

SEQ ID NO: 31221 - protein, 11 aa, Artificial Sequence
  Peptide Derived from Human Papillomavirus
QGSSFALWPVY

SEQ ID NO: 31222 - protein, 11 aa, Artificial Sequence
  Peptide Derived from Human Papillomavirus
QSPYDVTHDVY

SEQ ID NO: 31223 - protein, 8 aa, Artificial Sequence
  Peptide Derived from Human Papillomavirus
RASATQLY

SEQ ID NO: 31224 - protein, 8 aa, Artificial Sequence
  Peptide Derived from Human Papillomavirus
RIAAPRLY

SEQ ID NO: 31225 - protein, 8 aa, Artificial Sequence
  Peptide Derived from Human Papillomavirus
SFALWPVY

SEQ ID NO: 31226 - protein, 9 aa, Artificial Sequence
  Peptide Derived from Human Papillomavirus
SFDGLYDIY

SEQ ID NO: 31227 - protein, 9 aa, Artificial Sequence
  Peptide Derived from Human Papillomavirus
SSFALWPVY

SEQ ID NO: 31228 - protein, 10 aa, Artificial Sequence
  Peptide Derived from Human Papillomavirus
STPTSGIHSY

SEQ ID NO: 31229 - protein, 11 aa, Artificial Sequence
  Peptide Derived from Human Papillomavirus
STWPFVPQSPY

SEQ ID NO: 31230 - protein, 9 aa, Artificial Sequence
  Peptide Derived from Human Papillomavirus
TGSGGRAGY

SEQ ID NO: 31231 - protein, 8 aa, Artificial Sequence
  Peptide Derived from Human Papillomavirus
AAALYWYK

SEQ ID NO: 31232 - protein, 10 aa, Artificial Sequence
  Peptide Derived from Human Papillomavirus
AAFGLTPSIA

SEQ ID NO: 31233 - protein, 8 aa, Artificial Sequence
  Peptide Derived from Human Papillomavirus
AAMLAKFK

SEQ ID NO: 31234 - protein, 11 aa, Artificial Sequence
  Peptide Derived from Human Papillomavirus
AAMLAKFKELY

SEQ ID NO: 31235 - protein, 9 aa, Artificial Sequence
  Peptide Derived from Human Papillomavirus
AANTGKSLF

SEQ ID NO: 31236 - protein, 11 aa, Artificial Sequence
  Peptide Derived from Human Papillomavirus
ADAKIGMLDDA

SEQ ID NO: 31237 - protein, 11 aa, Artificial Sequence
  Peptide Derived from Human Papillomavirus
ADSIKTLLQQY

SEQ ID NO: 31238 - protein, 9 aa, Artificial Sequence
  Peptide Derived from Human Papillomavirus
ADTNSNASA

SEQ ID NO: 31239 - protein, 10 aa, Artificial Sequence
  Peptide Derived from Human Papillomavirus
ADTNSNASAF

SEQ ID NO: 31240 - protein, 9 aa, Artificial Sequence
  Peptide Derived from Human Papillomavirus
AFGLTPSIA

SEQ ID NO: 31241 - protein, 9 aa, Artificial Sequence
  Peptide Derived from Human Papillomavirus
AFLKSNSQA

SEQ ID NO: 31242 - protein, 10 aa, Artificial Sequence
  Peptide Derived from Human Papillomavirus
AFLKSNSQAK

SEQ ID NO: 31243 - protein, 9 aa, Artificial Sequence
  Peptide Derived from Human Papillomavirus
AGTDSRWPY

SEQ ID NO: 31244 - protein, 11 aa, Artificial Sequence
  Peptide Derived from Human Papillomavirus
AGTDSRWPYLH

SEQ ID NO: 31245 - protein, 9 aa, Artificial Sequence
  Peptide Derived from Human Papillomavirus
AICIEKQSR

SEQ ID NO: 31246 - protein, 10 aa, Artificial Sequence
  Peptide Derived from Human Papillomavirus
AICIEKQSRA

SEQ ID NO: 31247 - protein, 11 aa, Artificial Sequence
  Peptide Derived from Human Papillomavirus
AICIEKQSRAA

SEQ ID NO: 31248 - protein, 8 aa, Artificial Sequence
  Peptide Derived from Human Papillomavirus
ALFTAQEA

SEQ ID NO: 31249 - protein, 9 aa, Artificial Sequence
  Peptide Derived from Human Papillomavirus
ALFTAQEAK

SEQ ID NO: 31250 - protein, 11 aa, Artificial Sequence
  Peptide Derived from Human Papillomavirus
ALFTAQEAKQH

SEQ ID NO: 31251 - protein, 11 aa, Artificial Sequence
  Peptide Derived from Human Papillomavirus
ALKRFLQGIPK

SEQ ID NO: 31252 - protein, 10 aa, Artificial Sequence
  Peptide Derived from Human Papillomavirus
AMLAKFKELY

SEQ ID NO: 31253 - protein, 11 aa, Artificial Sequence
  Peptide Derived from Human Papillomavirus
ASAFLKSNSQA

SEQ ID NO: 31254 - protein, 8 aa, Artificial Sequence
  Peptide Derived from Human Papillomavirus
ATMCRHYK

SEQ ID NO: 31255 - protein, 9 aa, Artificial Sequence
  Peptide Derived from Human Papillomavirus
ATMCRHYKR

SEQ ID NO: 31256 - protein, 10 aa, Artificial Sequence
  Peptide Derived from Human Papillomavirus
ATMCRHYKRA

SEQ ID NO: 31257 - protein, 8 aa, Artificial Sequence
  Peptide Derived from Human Papillomavirus
ATVPCWNY

SEQ ID NO: 31258 - protein, 8 aa, Artificial Sequence
  Peptide Derived from Human Papillomavirus
AVQVLKRK

SEQ ID NO: 31259 - protein, 9 aa, Artificial Sequence
  Peptide Derived from Human Papillomavirus
AVQVLKRKY

SEQ ID NO: 31260 - protein, 10 aa, Artificial Sequence
  Peptide Derived from Human Papillomavirus
AVVEKKTGDA

SEQ ID NO: 31261 - protein, 8 aa, Artificial Sequence
  Peptide Derived from Human Papillomavirus
CATMCRHY

SEQ ID NO: 31262 - protein, 9 aa, Artificial Sequence
  Peptide Derived from Human Papillomavirus
CATMCRHYK

SEQ ID NO: 31263 - protein, 10 aa, Artificial Sequence
  Peptide Derived from Human Papillomavirus
CATMCRHYKR

SEQ ID NO: 31264 - protein, 11 aa, Artificial Sequence
  Peptide Derived from Human Papillomavirus
CATMCRHYKRA

SEQ ID NO: 31265 - protein, 8 aa, Artificial Sequence
  Peptide Derived from Human Papillomavirus
CCDWCIAA

SEQ ID NO: 31266 - protein, 9 aa, Artificial Sequence
  Peptide Derived from Human Papillomavirus
CCDWCIAAF

SEQ ID NO: 31267 - protein, 11 aa, Artificial Sequence
  Peptide Derived from Human Papillomavirus
CDRVDDGGDWK

SEQ ID NO: 31268 - protein, 8 aa, Artificial Sequence
  Peptide Derived from Human Papillomavirus
CDWCIAAF

SEQ ID NO: 31269 - protein, 8 aa, Artificial Sequence
  Peptide Derived from Human Papillomavirus
CFVNSKSH

SEQ ID NO: 31270 - protein, 9 aa, Artificial Sequence
  Peptide Derived from Human Papillomavirus
CFVNSKSHF

SEQ ID NO: 31271 - protein, 10 aa, Artificial Sequence
  Peptide Derived from Human Papillomavirus
CGKNRETIEK

SEQ ID NO: 31272 - protein, 8 aa, Artificial Sequence
  Peptide Derived from Human Papillomavirus
CIEKQSRA

SEQ ID NO: 31273 - protein, 9 aa, Artificial Sequence
  Peptide Derived from Human Papillomavirus
CIEKQSRAA

SEQ ID NO: 31274 - protein, 10 aa, Artificial Sequence
  Peptide Derived from Human Papillomavirus
CIEKQSRAAK

SEQ ID NO: 31275 - protein, 11 aa, Artificial Sequence
  Peptide Derived from Human Papillomavirus
CIEKQSRAAKR

SEQ ID NO: 31276 - protein, 8 aa, Artificial Sequence
  Peptide Derived from Human Papillomavirus
CILLYGAA

SEQ ID NO: 31277 - protein, 10 aa, Artificial Sequence
  Peptide Derived from Human Papillomavirus
CLYLHIQSLA

SEQ ID NO: 31278 - protein, 8 aa, Artificial Sequence
  Peptide Derived from Human Papillomavirus
CMMIEPPK

SEQ ID NO: 31279 - protein, 10 aa, Artificial Sequence
  Peptide Derived from Human Papillomavirus
CMMIEPPKLR

SEQ ID NO: 31280 - protein, 9 aa, Artificial Sequence
  Peptide Derived from Human Papillomavirus
CVDNNISPR

SEQ ID NO: 31281 - protein, 11 aa, Artificial Sequence
  Peptide Derived from Human Papillomavirus
CVDNNISPRLK

SEQ ID NO: 31282 - protein, 10 aa, Artificial Sequence
  Peptide Derived from Human Papillomavirus
DAKIGMLDDA

SEQ ID NO: 31283 - protein, 9 aa, Artificial Sequence
  Peptide Derived from Human Papillomavirus
DATVPCWNY

SEQ ID NO: 31284 - protein, 8 aa, Artificial Sequence
  Peptide Derived from Human Papillomavirus
DAVQVLKR

SEQ ID NO: 31285 - protein, 9 aa, Artificial Sequence
  Peptide Derived from Human Papillomavirus
DAVQVLKRK

SEQ ID NO: 31286 - protein, 10 aa, Artificial Sequence
  Peptide Derived from Human Papillomavirus
DAVQVLKRKY

SEQ ID NO: 31287 - protein, 8 aa, Artificial Sequence
  Peptide Derived from Human Papillomavirus
DCATMCRH

SEQ ID NO: 31288 - protein, 9 aa, Artificial Sequence
  Peptide Derived from Human Papillomavirus
DCATMCRHY

SEQ ID NO: 31289 - protein, 10 aa, Artificial Sequence
  Peptide Derived from Human Papillomavirus
DCATMCRHYK

SEQ ID NO: 31290 - protein, 11 aa, Artificial Sequence
  Peptide Derived from Human Papillomavirus
DCATMCRHYKR

SEQ ID NO: 31291 - protein, 10 aa, Artificial Sequence
  Peptide Derived from Human Papillomavirus
DDATVPCWNY

SEQ ID NO: 31292 - protein, 8 aa, Artificial Sequence
  Peptide Derived from Human Papillomavirus
DDSEIAYK

SEQ ID NO: 31293 - protein, 9 aa, Artificial Sequence
  Peptide Derived from Human Papillomavirus
DDSEIAYKY

SEQ ID NO: 31294 - protein, 10 aa, Artificial Sequence
  Peptide Derived from Human Papillomavirus
DDSEIAYKYA

SEQ ID NO: 31295 - protein, 9 aa, Artificial Sequence
  Peptide Derived from Human Papillomavirus
DFIVNDNDY

SEQ ID NO: 31296 - protein, 8 aa, Artificial Sequence
  Peptide Derived from Human Papillomavirus
DGDSLPTF

SEQ ID NO: 31297 - protein, 9 aa, Artificial Sequence
  Peptide Derived from Human Papillomavirus
DGDSLPTFK

SEQ ID NO: 31298 - protein, 11 aa, Artificial Sequence
  Peptide Derived from Human Papillomavirus
DGGDWKQIVMF

SEQ ID NO: 31299 - protein, 10 aa, Artificial Sequence
  Peptide Derived from Human Papillomavirus
DGNLVSMDVK

SEQ ID NO: 31300 - protein, 11 aa, Artificial Sequence
  Peptide Derived from Human Papillomavirus
DGNLVSMDVKH

SEQ ID NO: 31301 - protein, 9 aa, Artificial Sequence
  Peptide Derived from Human Papillomavirus
DIVDDSEIA

SEQ ID NO: 31302 - protein, 10 aa, Artificial Sequence
  Peptide Derived from Human Papillomavirus
DIVDDSEIAY

SEQ ID NO: 31303 - protein, 11 aa, Artificial Sequence
  Peptide Derived from Human Papillomavirus
DIVDDSEIAYK

SEQ ID NO: 31304 - protein, 11 aa, Artificial Sequence
  Peptide Derived from Human Papillomavirus
DSDTGEDLVDF

SEQ ID NO: 31305 - protein, 8 aa, Artificial Sequence
  Peptide Derived from Human Papillomavirus
DSEIAYKY

SEQ ID NO: 31306 - protein, 9 aa, Artificial Sequence
  Peptide Derived from Human Papillomavirus
DSEIAYKYA

SEQ ID NO: 31307 - protein, 10 aa, Artificial Sequence
  Peptide Derived from Human Papillomavirus
DSIKTLLQQY

SEQ ID NO: 31308 - protein, 8 aa, Artificial Sequence
  Peptide Derived from Human Papillomavirus
DSRWPYLH

SEQ ID NO: 31309 - protein, 10 aa, Artificial Sequence
  Peptide Derived from Human Papillomavirus
DSRWPYLHNR

SEQ ID NO: 31310 - protein, 9 aa, Artificial Sequence
  Peptide Derived from Human Papillomavirus
DTGEDLVDF

SEQ ID NO: 31311 - protein, 8 aa, Artificial Sequence
  Peptide Derived from Human Papillomavirus
DTNSNASA

SEQ ID NO: 31312 - protein, 9 aa, Artificial Sequence
  Peptide Derived from Human Papillomavirus
DTNSNASAF

SEQ ID NO: 31313 - protein, 11 aa, Artificial Sequence
  Peptide Derived from Human Papillomavirus
DTNSNASAFLK

SEQ ID NO: 31314 - protein, 8 aa, Artificial Sequence
  Peptide Derived from Human Papillomavirus
DTPEWIQR

SEQ ID NO: 31315 - protein, 11 aa, Artificial Sequence
  Peptide Derived from Human Papillomavirus
DVKHRPLVQLK

SEQ ID NO: 31316 - protein, 8 aa, Artificial Sequence
  Peptide Derived from Human Papillomavirus
EAKQHRDA

SEQ ID NO: 31317 - protein, 11 aa, Artificial Sequence
  Peptide Derived from Human Papillomavirus
EAVVEKKTGDA

SEQ ID NO: 31318 - protein, 8 aa, Artificial Sequence
  Peptide Derived from Human Papillomavirus
EFMSFLTA

SEQ ID NO: 31319 - protein, 10 aa, Artificial Sequence
  Peptide Derived from Human Papillomavirus
EFMSFLTALK

SEQ ID NO: 31320 - protein, 11 aa, Artificial Sequence
  Peptide Derived from Human Papillomavirus
EFMSFLTALKR

SEQ ID NO: 31321 - protein, 9 aa, Artificial Sequence
  Peptide Derived from Human Papillomavirus
EGTGCNGWF

SEQ ID NO: 31322 - protein, 10 aa, Artificial Sequence
  Peptide Derived from Human Papillomavirus
EGTGCNGWFY

SEQ ID NO: 31323 - protein, 10 aa, Artificial Sequence
  Peptide Derived from Human Papillomavirus
EIAYKYAQLA

SEQ ID NO: 31324 - protein, 8 aa, Artificial Sequence
  Peptide Derived from Human Papillomavirus
ELNDKNWK

SEQ ID NO: 31325 - protein, 10 aa, Artificial Sequence
  Peptide Derived from Human Papillomavirus
ELNDKNWKSF

SEQ ID NO: 31326 - protein, 11 aa, Artificial Sequence
  Peptide Derived from Human Papillomavirus
ELNDKNWKSFF

SEQ ID NO: 31327 - protein, 9 aa, Artificial Sequence
  Peptide Derived from Human Papillomavirus
ELSQMVQWA

SEQ ID NO: 31328 - protein, 10 aa, Artificial Sequence
  Peptide Derived from Human Papillomavirus
ELSQMVQWAY

SEQ ID NO: 31329 - protein, 10 aa, Artificial Sequence
  Peptide Derived from Human Papillomavirus
ELVRPFKSNK

SEQ ID NO: 31330 - protein, 9 aa, Artificial Sequence
  Peptide Derived from Human Papillomavirus
ETAHALFTA

SEQ ID NO: 31331 - protein, 9 aa, Artificial Sequence
  Peptide Derived from Human Papillomavirus
ETETAHALF

SEQ ID NO: 31332 - protein, 11 aa, Artificial Sequence
  Peptide Derived from Human Papillomavirus
ETETAHALFTA

SEQ ID NO: 31333 - protein, 9 aa, Artificial Sequence
  Peptide Derived from Human Papillomavirus
ETETPCSQY

SEQ ID NO: 31334 - protein, 9 aa, Artificial Sequence
  Peptide Derived from Human Papillomavirus
ETIEKLLSK

SEQ ID NO: 31335 - protein, 11 aa, Artificial Sequence
  Peptide Derived from Human Papillomavirus
ETQQMLQVEGR

SEQ ID NO: 31336 - protein, 9 aa, Artificial Sequence
  Peptide Derived from Human Papillomavirus
FDENGNPVY

SEQ ID NO: 31337 - protein, 8 aa, Artificial Sequence
  Peptide Derived from Human Papillomavirus
FFSRTWSR

SEQ ID NO: 31338 - protein, 8 aa, Artificial Sequence
  Peptide Derived from Human Papillomavirus
FGLTPSIA

SEQ ID NO: 31339 - protein, 8 aa, Artificial Sequence
  Peptide Derived from Human Papillomavirus
FGMSLMKF

SEQ ID NO: 31340 - protein, 8 aa, Artificial Sequence
  Peptide Derived from Human Papillomavirus
FIVNDNDY

SEQ ID NO: 31341 - protein, 8 aa, Artificial Sequence
  Peptide Derived from Human Papillomavirus
FLKSNSQA

SEQ ID NO: 31342 - protein, 9 aa, Artificial Sequence
  Peptide Derived from Human Papillomavirus
FLKSNSQAK

SEQ ID NO: 31343 - protein, 8 aa, Artificial Sequence
  Peptide Derived from Human Papillomavirus
FLQGIPKK

SEQ ID NO: 31344 - protein, 9 aa, Artificial Sequence
  Peptide Derived from Human Papillomavirus
FLQGSVICF

SEQ ID NO: 31345 - protein, 9 aa, Artificial Sequence
  Peptide Derived from Human Papillomavirus
FLRYQGVEF

SEQ ID NO: 31346 - protein, 8 aa, Artificial Sequence
  Peptide Derived from Human Papillomavirus
FLTALKRF

SEQ ID NO: 31347 - protein, 9 aa, Artificial Sequence
  Peptide Derived from Human Papillomavirus
FMSFLTALK

SEQ ID NO: 31348 - protein, 10 aa, Artificial Sequence
  Peptide Derived from Human Papillomavirus
FMSFLTALKR

SEQ ID NO: 31349 - protein, 11 aa, Artificial Sequence
  Peptide Derived from Human Papillomavirus
FMSFLTALKRF

SEQ ID NO: 31350 - protein, 8 aa, Artificial Sequence
  Peptide Derived from Human Papillomavirus
FSELVRPF

SEQ ID NO: 31351 - protein, 9 aa, Artificial Sequence
  Peptide Derived from Human Papillomavirus
FSELVRPFK

SEQ ID NO: 31352 - protein, 11 aa, Artificial Sequence
  Peptide Derived from Human Papillomavirus
FSRTWSRLSLH

SEQ ID NO: 31353 - protein, 9 aa, Artificial Sequence
  Peptide Derived from Human Papillomavirus
FTAQEAKQH

SEQ ID NO: 31354 - protein, 10 aa, Artificial Sequence
  Peptide Derived from Human Papillomavirus
FTAQEAKQHR

SEQ ID NO: 31355 - protein, 9 aa, Artificial Sequence
  Peptide Derived from Human Papillomavirus
FTFPNEFPF

SEQ ID NO: 31356 - protein, 8 aa, Artificial Sequence
  Peptide Derived from Human Papillomavirus
FVNSKSHF

SEQ ID NO: 31357 - protein, 10 aa, Artificial Sequence
  Peptide Derived from Human Papillomavirus
GAANTGKSLF

SEQ ID NO: 31358 - protein, 10 aa, Artificial Sequence
  Peptide Derived from Human Papillomavirus
GCNGWFYVEA

SEQ ID NO: 31359 - protein, 10 aa, Artificial Sequence
  Peptide Derived from Human Papillomavirus
GCVDNNISPR

SEQ ID NO: 31360 - protein, 8 aa, Artificial Sequence
  Peptide Derived from Human Papillomavirus
GDSLPTFK

SEQ ID NO: 31361 - protein, 9 aa, Artificial Sequence
  Peptide Derived from Human Papillomavirus
GDTPEWIQR

SEQ ID NO: 31362 - protein, 9 aa, Artificial Sequence
  Peptide Derived from Human Papillomavirus
GDWKQIVMF

SEQ ID NO: 31363 - protein, 11 aa, Artificial Sequence
  Peptide Derived from Human Papillomavirus
GDWKQIVMFLR

SEQ ID NO: 31364 - protein, 10 aa, Artificial Sequence
  Peptide Derived from Human Papillomavirus
GGDWKQIVMF

SEQ ID NO: 31365 - protein, 8 aa, Artificial Sequence
  Peptide Derived from Human Papillomavirus
GGEGVSER

SEQ ID NO: 31366 - protein, 9 aa, Artificial Sequence
  Peptide Derived from Human Papillomavirus
GGEGVSERH

SEQ ID NO: 31367 - protein, 10 aa, Artificial Sequence
  Peptide Derived from Human Papillomavirus
GGSGGGCSQY

SEQ ID NO: 31368 - protein, 11 aa, Artificial Sequence
  Peptide Derived from Human Papillomavirus
GIPKKNCILLY

SEQ ID NO: 31369 - protein, 9 aa, Artificial Sequence
  Peptide Derived from Human Papillomavirus
GISNISEVY

SEQ ID NO: 31370 - protein, 11 aa, Artificial Sequence
  Peptide Derived from Human Papillomavirus
GLTPSIADSIK

SEQ ID NO: 31371 - protein, 9 aa, Artificial Sequence
  Peptide Derived from Human Papillomavirus
GMVVLLLVR

SEQ ID NO: 31372 - protein, 10 aa, Artificial Sequence
  Peptide Derived from Human Papillomavirus
GMVVLLLVRY

SEQ ID NO: 31373 - protein, 11 aa, Artificial Sequence
  Peptide Derived from Human Papillomavirus
GMVVLLLVRYK

SEQ ID NO: 31374 - protein, 10 aa, Artificial Sequence
  Peptide Derived from Human Papillomavirus
GSGGEGVSER

SEQ ID NO: 31375 - protein, 11 aa, Artificial Sequence
  Peptide Derived from Human Papillomavirus
GSGGEGVSERH

SEQ ID NO: 31376 - protein, 9 aa, Artificial Sequence
  Peptide Derived from Human Papillomavirus
GSGGGCSQY

SEQ ID NO: 31377 - protein, 10 aa, Artificial Sequence
  Peptide Derived from Human Papillomavirus
GSVICFVNSK

SEQ ID NO: 31378 - protein, 8 aa, Artificial Sequence
  Peptide Derived from Human Papillomavirus
GTDSRWPY

SEQ ID NO: 31379 - protein, 10 aa, Artificial Sequence
  Peptide Derived from Human Papillomavirus
GTDSRWPYLH

SEQ ID NO: 31380 - protein, 8 aa, Artificial Sequence
  Peptide Derived from Human Papillomavirus
GTGCNGWF

SEQ ID NO: 31381 - protein, 9 aa, Artificial Sequence
  Peptide Derived from Human Papillomavirus
GTGCNGWFY

SEQ ID NO: 31382 - protein, 10 aa, Artificial Sequence
  Peptide Derived from Human Papillomavirus
GVEFMSFLTA

SEQ ID NO: 31383 - protein, 9 aa, Artificial Sequence
  Peptide Derived from Human Papillomavirus
GVSFSELVR

SEQ ID NO: 31384 - protein, 11 aa, Artificial Sequence
  Peptide Derived from Human Papillomavirus
GVSFSELVRPF

SEQ ID NO: 31385 - protein, 9 aa, Artificial Sequence
  Peptide Derived from Human Papillomavirus
HALFTAQEA

SEQ ID NO: 31386 - protein, 10 aa, Artificial Sequence
  Peptide Derived from Human Papillomavirus
HALFTAQEAK

SEQ ID NO: 31387 - protein, 8 aa, Artificial Sequence
  Peptide Derived from Human Papillomavirus
HFWLQPLA

SEQ ID NO: 31388 - protein, 10 aa, Artificial Sequence
  Peptide Derived from Human Papillomavirus
HFWLQPLADA

SEQ ID NO: 31389 - protein, 11 aa, Artificial Sequence
  Peptide Derived from Human Papillomavirus
HFWLQPLADAK

SEQ ID NO: 31390 - protein, 8 aa, Artificial Sequence
  Peptide Derived from Human Papillomavirus
HSFNDCTF

SEQ ID NO: 31391 - protein, 11 aa, Artificial Sequence
  Peptide Derived from Human Papillomavirus
IAAFGLTPSIA

SEQ ID NO: 31392 - protein, 9 aa, Artificial Sequence
  Peptide Derived from Human Papillomavirus
IAYKYAQLA

SEQ ID NO: 31393 - protein, 9 aa, Artificial Sequence
  Peptide Derived from Human Papillomavirus
ICFVNSKSH

SEQ ID NO: 31394 - protein, 10 aa, Artificial Sequence
  Peptide Derived from Human Papillomavirus
ICFVNSKSHF

SEQ ID NO: 31395 - protein, 8 aa, Artificial Sequence
  Peptide Derived from Human Papillomavirus
ICIEKQSR

SEQ ID NO: 31396 - protein, 9 aa, Artificial Sequence
  Peptide Derived from Human Papillomavirus
ICIEKQSRA

SEQ ID NO: 31397 - protein, 10 aa, Artificial Sequence
  Peptide Derived from Human Papillomavirus
ICIEKQSRAA

SEQ ID NO: 31398 - protein, 11 aa, Artificial Sequence
  Peptide Derived from Human Papillomavirus
ICIEKQSRAAK

SEQ ID NO: 31399 - protein, 8 aa, Artificial Sequence
  Peptide Derived from Human Papillomavirus
IDDNLRNA

SEQ ID NO: 31400 - protein, 11 aa, Artificial Sequence
  Peptide Derived from Human Papillomavirus
ILLYGAANTGK

SEQ ID NO: 31401 - protein, 10 aa, Artificial Sequence
  Peptide Derived from Human Papillomavirus
ILNVLKTSNA

SEQ ID NO: 31402 - protein, 11 aa, Artificial Sequence
  Peptide Derived from Human Papillomavirus
ILNVLKTSNAK

SEQ ID NO: 31403 - protein, 8 aa, Artificial Sequence
  Peptide Derived from Human Papillomavirus
ISNISEVY

SEQ ID NO: 31404 - protein, 8 aa, Artificial Sequence
  Peptide Derived from Human Papillomavirus
IVDDSEIA

SEQ ID NO: 31405 - protein, 9 aa, Artificial Sequence
  Peptide Derived from Human Papillomavirus
IVDDSEIAY

SEQ ID NO: 31406 - protein, 10 aa, Artificial Sequence
  Peptide Derived from Human Papillomavirus
IVDDSEIAYK

SEQ ID NO: 31407 - protein, 11 aa, Artificial Sequence
  Peptide Derived from Human Papillomavirus
IVDDSEIAYKY

SEQ ID NO: 31408 - protein, 10 aa, Artificial Sequence
  Peptide Derived from Human Papillomavirus
IVKDCATMCR

SEQ ID NO: 31409 - protein, 11 aa, Artificial Sequence
  Peptide Derived from Human Papillomavirus
IVKDCATMCRH

SEQ ID NO: 31410 - protein, 11 aa, Artificial Sequence
  Peptide Derived from Human Papillomavirus
IVNDNDYLTQA

SEQ ID NO: 31411 - protein, 8 aa, Artificial Sequence
  Peptide Derived from Human Papillomavirus
KAAMLAKF

SEQ ID NO: 31412 - protein, 9 aa, Artificial Sequence
  Peptide Derived from Human Papillomavirus
KAAMLAKFK

SEQ ID NO: 31413 - protein, 10 aa, Artificial Sequence
  Peptide Derived from Human Papillomavirus
KAICIEKQSR

SEQ ID NO: 31414 - protein, 11 aa, Artificial Sequence
  Peptide Derived from Human Papillomavirus
KAICIEKQSRA

SEQ ID NO: 31415 - protein, 11 aa, Artificial Sequence
  Peptide Derived from Human Papillomavirus
KCGKNRETIEK

SEQ ID NO: 31416 - protein, 8 aa, Artificial Sequence
  Peptide Derived from Human Papillomavirus
KDCATMCR

SEQ ID NO: 31417 - protein, 9 aa, Artificial Sequence
  Peptide Derived from Human Papillomavirus
KDCATMCRH

SEQ ID NO: 31418 - protein, 10 aa, Artificial Sequence
  Peptide Derived from Human Papillomavirus
KDCATMCRHY

SEQ ID NO: 31419 - protein, 11 aa, Artificial Sequence
  Peptide Derived from Human Papillomavirus
KDCATMCRHYK

SEQ ID NO: 31420 - protein, 10 aa, Artificial Sequence
  Peptide Derived from Human Papillomavirus
KFKELYGVSF

SEQ ID NO: 31421 - protein, 10 aa, Artificial Sequence
  Peptide Derived from Human Papillomavirus
KFLQGSVICF

SEQ ID NO: 31422 - protein, 8 aa, Artificial Sequence
  Peptide Derived from Human Papillomavirus
KIGMLDDA

SEQ ID NO: 31423 - protein, 11 aa, Artificial Sequence
  Peptide Derived from Human Papillomavirus
KIVKDCATMCR

SEQ ID NO: 31424 - protein, 8 aa, Artificial Sequence
  Peptide Derived from Human Papillomavirus
KLRSTAAA

SEQ ID NO: 31425 - protein, 10 aa, Artificial Sequence
  Peptide Derived from Human Papillomavirus
KLRSTAAALY

SEQ ID NO: 31426 - protein, 10 aa, Artificial Sequence
  Peptide Derived from Human Papillomavirus
KSFFSRTWSR

SEQ ID NO: 31427 - protein, 10 aa, Artificial Sequence
  Peptide Derived from Human Papillomavirus
KSHFWLQPLA

SEQ ID NO: 31428 - protein, 10 aa, Artificial Sequence
  Peptide Derived from Human Papillomavirus
KSLFGMSLMK

SEQ ID NO: 31429 - protein, 11 aa, Artificial Sequence
  Peptide Derived from Human Papillomavirus
KSLFGMSLMKF

SEQ ID NO: 31430 - protein, 10 aa, Artificial Sequence
  Peptide Derived from Human Papillomavirus
KSNSQAKIVK

SEQ ID NO: 31431 - protein, 10 aa, Artificial Sequence
  Peptide Derived from Human Papillomavirus
KSTCCDWCIA

SEQ ID NO: 31432 - protein, 11 aa, Artificial Sequence
  Peptide Derived from Human Papillomavirus
KSTCCDWCIAA

SEQ ID NO: 31433 - protein, 11 aa, Artificial Sequence
  Peptide Derived from Human Papillomavirus
KTGISNISEVY

SEQ ID NO: 31434 - protein, 10 aa, Artificial Sequence
  Peptide Derived from Human Papillomavirus
KTLLQQYCLY

SEQ ID NO: 31435 - protein, 8 aa, Artificial Sequence
  Peptide Derived from Human Papillomavirus
KTSNAKAA

SEQ ID NO: 31436 - protein, 11 aa, Artificial Sequence
  Peptide Derived from Human Papillomavirus
KTSNAKAAMLA

SEQ ID NO: 31437 - protein, 8 aa, Artificial Sequence
  Peptide Derived from Human Papillomavirus
LADTNSNA

SEQ ID NO: 31438 - protein, 10 aa, Artificial Sequence
  Peptide Derived from Human Papillomavirus
LADTNSNASA

SEQ ID NO: 31439 - protein, 11 aa, Artificial Sequence
  Peptide Derived from Human Papillomavirus
LADTNSNASAF

SEQ ID NO: 31440 - protein, 8 aa, Artificial Sequence
  Peptide Derived from Human Papillomavirus
LAKFKELY

SEQ ID NO: 31441 - protein, 11 aa, Artificial Sequence
  Peptide Derived from Human Papillomavirus
LDDATVPCWNY

SEQ ID NO: 31442 - protein, 11 aa, Artificial Sequence
  Peptide Derived from Human Papillomavirus
LDGNLVSMDVK

SEQ ID NO: 31443 - protein, 9 aa, Artificial Sequence
  Peptide Derived from Human Papillomavirus
LFESEDSGY

SEQ ID NO: 31444 - protein, 8 aa, Artificial Sequence
  Peptide Derived from Human Papillomavirus
LFGMSLMK

SEQ ID NO: 31445 - protein, 9 aa, Artificial Sequence
  Peptide Derived from Human Papillomavirus
LFGMSLMKF

SEQ ID NO: 31446 - protein, 8 aa, Artificial Sequence
  Peptide Derived from Human Papillomavirus
LFTAQEAK

SEQ ID NO: 31447 - protein, 10 aa, Artificial Sequence
  Peptide Derived from Human Papillomavirus
LFTAQEAKQH

SEQ ID NO: 31448 - protein, 11 aa, Artificial Sequence
  Peptide Derived from Human Papillomavirus
LFTAQEAKQHR

SEQ ID NO: 31449 - protein, 8 aa, Artificial Sequence
  Peptide Derived from Human Papillomavirus
LITSNINA

SEQ ID NO: 31450 - protein, 9 aa, Artificial Sequence
  Peptide Derived from Human Papillomavirus
LLITSNINA

SEQ ID NO: 31451 - protein, 10 aa, Artificial Sequence
  Peptide Derived from Human Papillomavirus
LLLVRYKCGK

SEQ ID NO: 31452 - protein, 8 aa, Artificial Sequence
  Peptide Derived from Human Papillomavirus
LLQQYCLY

SEQ ID NO: 31453 - protein, 10 aa, Artificial Sequence
  Peptide Derived from Human Papillomavirus
LLQQYCLYLH

SEQ ID NO: 31454 - protein, 9 aa, Artificial Sequence
  Peptide Derived from Human Papillomavirus
LLVRYKCGK

SEQ ID NO: 31455 - protein, 11 aa, Artificial Sequence
  Peptide Derived from Human Papillomavirus
LLVRYKCGKNR

SEQ ID NO: 31456 - protein, 10 aa, Artificial Sequence
  Peptide Derived from Human Papillomavirus
LLYGAANTGK

SEQ ID NO: 31457 - protein, 9 aa, Artificial Sequence
  Peptide Derived from Human Papillomavirus
LSLHEDEDK

SEQ ID NO: 31458 - protein, 8 aa, Artificial Sequence
  Peptide Derived from Human Papillomavirus
LSQMVQWA

SEQ ID NO: 31459 - protein, 9 aa, Artificial Sequence
  Peptide Derived from Human Papillomavirus
LSQMVQWAY

SEQ ID NO: 31460 - protein, 9 aa, Artificial Sequence
  Peptide Derived from Human Papillomavirus
LTNILNVLK

SEQ ID NO: 31461 - protein, 10 aa, Artificial Sequence
  Peptide Derived from Human Papillomavirus
LTPSIADSIK

SEQ ID NO: 31462 - protein, 9 aa, Artificial Sequence
  Peptide Derived from Human Papillomavirus
LTQAETETA

SEQ ID NO: 31463 - protein, 10 aa, Artificial Sequence
  Peptide Derived from Human Papillomavirus
LTQAETETAH

SEQ ID NO: 31464 - protein, 11 aa, Artificial Sequence
  Peptide Derived from Human Papillomavirus
LTQAETETAHA

SEQ ID NO: 31465 - protein, 11 aa, Artificial Sequence
  Peptide Derived from Human Papillomavirus
LVDFIVNDNDY

SEQ ID NO: 31466 - protein, 9 aa, Artificial Sequence
  Peptide Derived from Human Papillomavirus
LVRPFKSNK

SEQ ID NO: 31467 - protein, 8 aa, Artificial Sequence
  Peptide Derived from Human Papillomavirus
LVRYKCGK

SEQ ID NO: 31468 - protein, 10 aa, Artificial Sequence
  Peptide Derived from Human Papillomavirus
LVRYKCGKNR

SEQ ID NO: 31469 - protein, 8 aa, Artificial Sequence
  Peptide Derived from Human Papillomavirus
LVSMDVKH

SEQ ID NO: 31470 - protein, 9 aa, Artificial Sequence
  Peptide Derived from Human Papillomavirus
LVSMDVKHR

SEQ ID NO: 31471 - protein, 10 aa, Artificial Sequence
  Peptide Derived from Human Papillomavirus
LVVFTFPNEF

SEQ ID NO: 31472 - protein, 9 aa, Artificial Sequence
  Peptide Derived from Human Papillomavirus
MCMMIEPPK

SEQ ID NO: 31473 - protein, 11 aa, Artificial Sequence
  Peptide Derived from Human Papillomavirus
MCMMIEPPKLR

SEQ ID NO: 31474 - protein, 8 aa, Artificial Sequence
  Peptide Derived from Human Papillomavirus
MCRHYKRA

SEQ ID NO: 31475 - protein, 10 aa, Artificial Sequence
  Peptide Derived from Human Papillomavirus
MCRHYKRAEK

SEQ ID NO: 31476 - protein, 11 aa, Artificial Sequence
  Peptide Derived from Human Papillomavirus
MCRHYKRAEKK

SEQ ID NO: 31477 - protein, 10 aa, Artificial Sequence
  Peptide Derived from Human Papillomavirus
MFLRYQGVEF

SEQ ID NO: 31478 - protein, 8 aa, Artificial Sequence
  Peptide Derived from Human Papillomavirus
MIEPPKLR

SEQ ID NO: 31479 - protein, 11 aa, Artificial Sequence
  Peptide Derived from Human Papillomavirus
MIEPPKLRSTA

SEQ ID NO: 31480 - protein, 9 aa, Artificial Sequence
  Peptide Derived from Human Papillomavirus
MLAKFKELY

SEQ ID NO: 31481 - protein, 8 aa, Artificial Sequence
  Peptide Derived from Human Papillomavirus
MLQVEGRH

SEQ ID NO: 31482 - protein, 9 aa, Artificial Sequence
  Peptide Derived from Human Papillomavirus
MMIEPPKLR

SEQ ID NO: 31483 - protein, 8 aa, Artificial Sequence
  Peptide Derived from Human Papillomavirus
MSFLTALK

SEQ ID NO: 31484 - protein, 9 aa, Artificial Sequence
  Peptide Derived from Human Papillomavirus
MSFLTALKR

SEQ ID NO: 31485 - protein, 10 aa, Artificial Sequence
  Peptide Derived from Human Papillomavirus
MSFLTALKRF

SEQ ID NO: 31486 - protein, 8 aa, Artificial Sequence
  Peptide Derived from Human Papillomavirus
MSMSQWIK

SEQ ID NO: 31487 - protein, 9 aa, Artificial Sequence
  Peptide Derived from Human Papillomavirus
MSMSQWIKY

SEQ ID NO: 31488 - protein, 10 aa, Artificial Sequence
  Peptide Derived from Human Papillomavirus
MSMSQWIKYR

SEQ ID NO: 31489 - protein, 8 aa, Artificial Sequence
  Peptide Derived from Human Papillomavirus
MSQWIKYR

SEQ ID NO: 31490 - protein, 11 aa, Artificial Sequence
  Peptide Derived from Human Papillomavirus
MSQWIKYRCDR

SEQ ID NO: 31491 - protein, 8 aa, Artificial Sequence
  Peptide Derived from Human Papillomavirus
MVVLLLVR

SEQ ID NO: 31492 - protein, 9 aa, Artificial Sequence
  Peptide Derived from Human Papillomavirus
MVVLLLVRY

SEQ ID NO: 31493 - protein, 10 aa, Artificial Sequence
  Peptide Derived from Human Papillomavirus
MVVLLLVRYK

SEQ ID NO: 31494 - protein, 10 aa, Artificial Sequence
  Peptide Derived from Human Papillomavirus
NAGTDSRWPY

SEQ ID NO: 31495 - protein, 8 aa, Artificial Sequence
  Peptide Derived from Human Papillomavirus
NAKAAMLA

SEQ ID NO: 31496 - protein, 9 aa, Artificial Sequence
  Peptide Derived from Human Papillomavirus
NAKAAMLAK

SEQ ID NO: 31497 - protein, 10 aa, Artificial Sequence
  Peptide Derived from Human Papillomavirus
NAKAAMLAKF

SEQ ID NO: 31498 - protein, 11 aa, Artificial Sequence
  Peptide Derived from Human Papillomavirus
NAKAAMLAKFK

SEQ ID NO: 31499 - protein, 8 aa, Artificial Sequence
  Peptide Derived from Human Papillomavirus
NCILLYGA

SEQ ID NO: 31500 - protein, 9 aa, Artificial Sequence
  Peptide Derived from Human Papillomavirus
NCILLYGAA

SEQ ID NO: 31501 - protein, 9 aa, Artificial Sequence
  Peptide Derived from Human Papillomavirus
NDGDSLPTF

SEQ ID NO: 31502 - protein, 10 aa, Artificial Sequence
  Peptide Derived from Human Papillomavirus
NDGDSLPTFK

SEQ ID NO: 31503 - protein, 10 aa, Artificial Sequence
  Peptide Derived from Human Papillomavirus
NDIVDDSEIA

SEQ ID NO: 31504 - protein, 11 aa, Artificial Sequence
  Peptide Derived from Human Papillomavirus
NDIVDDSEIAY

SEQ ID NO: 31505 - protein, 8 aa, Artificial Sequence
  Peptide Derived from Human Papillomavirus
NDKNWKSF

SEQ ID NO: 31506 - protein, 9 aa, Artificial Sequence
  Peptide Derived from Human Papillomavirus
NDKNWKSFF

SEQ ID NO: 31507 - protein, 11 aa, Artificial Sequence
  Peptide Derived from Human Papillomavirus
NDKNWKSFFSR

SEQ ID NO: 31508 - protein, 9 aa, Artificial Sequence
  Peptide Derived from Human Papillomavirus
NDNDYLTQA

SEQ ID NO: 31509 - protein, 11 aa, Artificial Sequence
  Peptide Derived from Human Papillomavirus
NGNPVYELNDK

SEQ ID NO: 31510 - protein, 8 aa, Artificial Sequence
  Peptide Derived from Human Papillomavirus
NGWFYVEA

SEQ ID NO: 31511 - protein, 11 aa, Artificial Sequence
  Peptide Derived from Human Papillomavirus
NILNVLKTSNA

SEQ ID NO: 31512 - protein, 9 aa, Artificial Sequence
  Peptide Derived from Human Papillomavirus
NINAGTDSR

SEQ ID NO: 31513 - protein, 8 aa, Artificial Sequence
  Peptide Derived from Human Papillomavirus
NISPRLKA

SEQ ID NO: 31514 - protein, 8 aa, Artificial Sequence
  Peptide Derived from Human Papillomavirus
NLVSMDVK

SEQ ID NO: 31515 - protein, 9 aa, Artificial Sequence
  Peptide Derived from Human Papillomavirus
NLVSMDVKH

SEQ ID NO: 31516 - protein, 10 aa, Artificial Sequence
  Peptide Derived from Human Papillomavirus
NLVSMDVKHR

SEQ ID NO: 31517 - protein, 9 aa, Artificial Sequence
  Peptide Derived from Human Papillomavirus
NSNASAFLK

SEQ ID NO: 31518 - protein, 8 aa, Artificial Sequence
  Peptide Derived from Human Papillomavirus
NSQAKIVK

SEQ ID NO: 31519 - protein, 11 aa, Artificial Sequence
  Peptide Derived from Human Papillomavirus
NSQAKIVKDCA

SEQ ID NO: 31520 - protein, 8 aa, Artificial Sequence
  Peptide Derived from Human Papillomavirus
NVLKTSNA

SEQ ID NO: 31521 - protein, 9 aa, Artificial Sequence
  Peptide Derived from Human Papillomavirus
NVLKTSNAK

SEQ ID NO: 31522 - protein, 10 aa, Artificial Sequence
  Peptide Derived from Human Papillomavirus
NVLKTSNAKA

SEQ ID NO: 31523 - protein, 11 aa, Artificial Sequence
  Peptide Derived from Human Papillomavirus
NVLKTSNAKAA

SEQ ID NO: 31524 - protein, 11 aa, Artificial Sequence
  Peptide Derived from Human Papillomavirus
PCWNYIDDNLR

SEQ ID NO: 31525 - protein, 10 aa, Artificial Sequence
  Peptide Derived from Human Papillomavirus
PFDENGNPVY

SEQ ID NO: 31526 - protein, 10 aa, Artificial Sequence
  Peptide Derived from Human Papillomavirus
PLLITSNINA

SEQ ID NO: 31527 - protein, 10 aa, Artificial Sequence
  Peptide Derived from Human Papillomavirus
PLTNILNVLK

SEQ ID NO: 31528 - protein, 10 aa, Artificial Sequence
  Peptide Derived from Human Papillomavirus
PMCMMIEPPK

SEQ ID NO: 31529 - protein, 8 aa, Artificial Sequence
  Peptide Derived from Human Papillomavirus
PSIADSIK

SEQ ID NO: 31530 - protein, 8 aa, Artificial Sequence
  Peptide Derived from Human Papillomavirus
PVYELNDK

SEQ ID NO: 31531 - protein, 11 aa, Artificial Sequence
  Peptide Derived from Human Papillomavirus
PVYELNDKNWK

SEQ ID NO: 31532 - protein, 8 aa, Artificial Sequence
  Peptide Derived from Human Papillomavirus
QAETETAH

SEQ ID NO: 31533 - protein, 9 aa, Artificial Sequence
  Peptide Derived from Human Papillomavirus
QAETETAHA

SEQ ID NO: 31534 - protein, 11 aa, Artificial Sequence
  Peptide Derived from Human Papillomavirus
QAETETAHALF

SEQ ID NO: 31535 - protein, 9 aa, Artificial Sequence
  Peptide Derived from Human Papillomavirus
QAKIVKDCA

SEQ ID NO: 31536 - protein, 11 aa, Artificial Sequence
  Peptide Derived from Human Papillomavirus
QGSVICFVNSK

SEQ ID NO: 31537 - protein, 8 aa, Artificial Sequence
  Peptide Derived from Human Papillomavirus
QGVEFMSF

SEQ ID NO: 31538 - protein, 11 aa, Artificial Sequence
  Peptide Derived from Human Papillomavirus
QGVEFMSFLTA

SEQ ID NO: 31539 - protein, 8 aa, Artificial Sequence
  Peptide Derived from Human Papillomavirus
QIVMFLRY

SEQ ID NO: 31540 - protein, 9 aa, Artificial Sequence
  Peptide Derived from Human Papillomavirus
QLADTNSNA

SEQ ID NO: 31541 - protein, 11 aa, Artificial Sequence
  Peptide Derived from Human Papillomavirus
QLADTNSNASA

SEQ ID NO: 31542 - protein, 8 aa, Artificial Sequence
  Peptide Derived from Human Papillomavirus
QMLQVEGR

SEQ ID NO: 31543 - protein, 9 aa, Artificial Sequence
  Peptide Derived from Human Papillomavirus
QMLQVEGRH

SEQ ID NO: 31544 - protein, 9 aa, Artificial Sequence
  Peptide Derived from Human Papillomavirus
QMSMSQWIK

SEQ ID NO: 31545 - protein, 10 aa, Artificial Sequence
  Peptide Derived from Human Papillomavirus
QMSMSQWIKY

SEQ ID NO: 31546 - protein, 11 aa, Artificial Sequence
  Peptide Derived from Human Papillomavirus
QMSMSQWIKYR

SEQ ID NO: 31547 - protein, 8 aa, Artificial Sequence
  Peptide Derived from Human Papillomavirus
QSRAAKRR

SEQ ID NO: 31548 - protein, 10 aa, Artificial Sequence
  Peptide Derived from Human Papillomavirus
QSRAAKRRLF

SEQ ID NO: 31549 - protein, 8 aa, Artificial Sequence
  Peptide Derived from Human Papillomavirus
QTVLQHSF

SEQ ID NO: 31550 - protein, 8 aa, Artificial Sequence
  Peptide Derived from Human Papillomavirus
RAAKRRLF

SEQ ID NO: 31551 - protein, 8 aa, Artificial Sequence
  Peptide Derived from Human Papillomavirus
RDAVQVLK

SEQ ID NO: 31552 - protein, 9 aa, Artificial Sequence
  Peptide Derived from Human Papillomavirus
RDAVQVLKR

SEQ ID NO: 31553 - protein, 10 aa, Artificial Sequence
  Peptide Derived from Human Papillomavirus
RDAVQVLKRK

SEQ ID NO: 31554 - protein, 11 aa, Artificial Sequence
  Peptide Derived from Human Papillomavirus
RDAVQVLKRKY

SEQ ID NO: 31555 - protein, 8 aa, Artificial Sequence
  Peptide Derived from Human Papillomavirus
RFLQGIPK

SEQ ID NO: 31556 - protein, 9 aa, Artificial Sequence
  Peptide Derived from Human Papillomavirus
RFLQGIPKK

SEQ ID NO: 31557 - protein, 10 aa, Artificial Sequence
  Peptide Derived from Human Papillomavirus
RLFESEDSGY

SEQ ID NO: 31558 - protein, 9 aa, Artificial Sequence
  Peptide Derived from Human Papillomavirus
RLKAICIEK

SEQ ID NO: 31559 - protein, 10 aa, Artificial Sequence
  Peptide Derived from Human Papillomavirus
RLSLHEDEDK

SEQ ID NO: 31560 - protein, 11 aa, Artificial Sequence
  Peptide Derived from Human Papillomavirus
RLVVFTFPNEF

SEQ ID NO: 31561 - protein, 8 aa, Artificial Sequence
  Peptide Derived from Human Papillomavirus
RSTAAALY

SEQ ID NO: 31562 - protein, 10 aa, Artificial Sequence
  Peptide Derived from Human Papillomavirus
RSTAAALYWY

SEQ ID NO: 31563 - protein, 11 aa, Artificial Sequence
  Peptide Derived from Human Papillomavirus
RSTAAALYWYK

SEQ ID NO: 31564 - protein, 9 aa, Artificial Sequence
  Peptide Derived from Human Papillomavirus
RTWSRLSLH

SEQ ID NO: 31565 - protein, 9 aa, Artificial Sequence
  Peptide Derived from Human Papillomavirus
RVDDGGDWK

SEQ ID NO: 31566 - protein, 10 aa, Artificial Sequence
  Peptide Derived from Human Papillomavirus
SAFLKSNSQA

SEQ ID NO: 31567 - protein, 11 aa, Artificial Sequence
  Peptide Derived from Human Papillomavirus
SAFLKSNSQAK

SEQ ID NO: 31568 - protein, 10 aa, Artificial Sequence
  Peptide Derived from Human Papillomavirus
SDTGEDLVDF

SEQ ID NO: 31569 - protein, 9 aa, Artificial Sequence
  Peptide Derived from Human Papillomavirus
SFFSRTWSR

SEQ ID NO: 31570 - protein, 8 aa, Artificial Sequence
  Peptide Derived from Human Papillomavirus
SFLTALKR

SEQ ID NO: 31571 - protein, 9 aa, Artificial Sequence
  Peptide Derived from Human Papillomavirus
SFLTALKRF

SEQ ID NO: 31572 - protein, 9 aa, Artificial Sequence
  Peptide Derived from Human Papillomavirus
SFSELVRPF

SEQ ID NO: 31573 - protein, 10 aa, Artificial Sequence
  Peptide Derived from Human Papillomavirus
SFSELVRPFK

SEQ ID NO: 31574 - protein, 11 aa, Artificial Sequence
  Peptide Derived from Human Papillomavirus
SGCVDNNISPR

SEQ ID NO: 31575 - protein, 9 aa, Artificial Sequence
  Peptide Derived from Human Papillomavirus
SGGEGVSER

SEQ ID NO: 31576 - protein, 10 aa, Artificial Sequence
  Peptide Derived from Human Papillomavirus
SGGEGVSERH

SEQ ID NO: 31577 - protein, 8 aa, Artificial Sequence
  Peptide Derived from Human Papillomavirus
SGGGCSQY

SEQ ID NO: 31578 - protein, 11 aa, Artificial Sequence
  Peptide Derived from Human Papillomavirus
SGGSGGGCSQY

SEQ ID NO: 31579 - protein, 11 aa, Artificial Sequence
  Peptide Derived from Human Papillomavirus
SGSGGEGVSER

SEQ ID NO: 31580 - protein, 9 aa, Artificial Sequence
  Peptide Derived from Human Papillomavirus
SIKTLLQQY

SEQ ID NO: 31581 - protein, 9 aa, Artificial Sequence
  Peptide Derived from Human Papillomavirus
SLFGMSLMK

SEQ ID NO: 31582 - protein, 10 aa, Artificial Sequence
  Peptide Derived from Human Papillomavirus
SLFGMSLMKF

SEQ ID NO: 31583 - protein, 8 aa, Artificial Sequence
  Peptide Derived from Human Papillomavirus
SLHEDEDK

SEQ ID NO: 31584 - protein, 8 aa, Artificial Sequence
  Peptide Derived from Human Papillomavirus
SMSQWIKY

SEQ ID NO: 31585 - protein, 9 aa, Artificial Sequence
  Peptide Derived from Human Papillomavirus
SMSQWIKYR

SEQ ID NO: 31586 - protein, 9 aa, Artificial Sequence
  Peptide Derived from Human Papillomavirus
STAAALYWY

SEQ ID NO: 31587 - protein, 10 aa, Artificial Sequence
  Peptide Derived from Human Papillomavirus
STAAALYWYK

SEQ ID NO: 31588 - protein, 9 aa, Artificial Sequence
  Peptide Derived from Human Papillomavirus
STCCDWCIA

SEQ ID NO: 31589 - protein, 10 aa, Artificial Sequence
  Peptide Derived from Human Papillomavirus
STCCDWCIAA

SEQ ID NO: 31590 - protein, 11 aa, Artificial Sequence
  Peptide Derived from Human Papillomavirus
STCCDWCIAAF

SEQ ID NO: 31591 - protein, 9 aa, Artificial Sequence
  Peptide Derived from Human Papillomavirus
SVICFVNSK

SEQ ID NO: 31592 - protein, 11 aa, Artificial Sequence
  Peptide Derived from Human Papillomavirus
SVICFVNSKSH

SEQ ID NO: 31593 - protein, 8 aa, Artificial Sequence
  Peptide Derived from Human Papillomavirus
TAAALYWY

SEQ ID NO: 31594 - protein, 9 aa, Artificial Sequence
  Peptide Derived from Human Papillomavirus
TAAALYWYK

SEQ ID NO: 31595 - protein, 8 aa, Artificial Sequence
  Peptide Derived from Human Papillomavirus
TAHALFTA

SEQ ID NO: 31596 - protein, 11 aa, Artificial Sequence
  Peptide Derived from Human Papillomavirus
TAHALFTAQEA

SEQ ID NO: 31597 - protein, 8 aa, Artificial Sequence
  Peptide Derived from Human Papillomavirus
TAQEAKQH

SEQ ID NO: 31598 - protein, 9 aa, Artificial Sequence
  Peptide Derived from Human Papillomavirus
TAQEAKQHR

SEQ ID NO: 31599 - protein, 11 aa, Artificial Sequence
  Peptide Derived from Human Papillomavirus
TAQEAKQHRDA

SEQ ID NO: 31600 - protein, 8 aa, Artificial Sequence
  Peptide Derived from Human Papillomavirus
TCCDWCIA

SEQ ID NO: 31601 - protein, 9 aa, Artificial Sequence
  Peptide Derived from Human Papillomavirus
TCCDWCIAA

SEQ ID NO: 31602 - protein, 10 aa, Artificial Sequence
  Peptide Derived from Human Papillomavirus
TCCDWCIAAF

SEQ ID NO: 31603 - protein, 9 aa, Artificial Sequence
  Peptide Derived from Human Papillomavirus
TDSRWPYLH

SEQ ID NO: 31604 - protein, 11 aa, Artificial Sequence
  Peptide Derived from Human Papillomavirus
TDSRWPYLHNR

SEQ ID NO: 31605 - protein, 11 aa, Artificial Sequence
  Peptide Derived from Human Papillomavirus
TFELSQMVQWA

SEQ ID NO: 31606 - protein, 8 aa, Artificial Sequence
  Peptide Derived from Human Papillomavirus
TFPNEFPF

SEQ ID NO: 31607 - protein, 8 aa, Artificial Sequence
  Peptide Derived from Human Papillomavirus
TGCNGWFY

SEQ ID NO: 31608 - protein, 11 aa, Artificial Sequence
  Peptide Derived from Human Papillomavirus
TGCNGWFYVEA

SEQ ID NO: 31609 - protein, 8 aa, Artificial Sequence
  Peptide Derived from Human Papillomavirus
TGEDLVDF

SEQ ID NO: 31610 - protein, 10 aa, Artificial Sequence
  Peptide Derived from Human Papillomavirus
TGISNISEVY

SEQ ID NO: 31611 - protein, 8 aa, Artificial Sequence
  Peptide Derived from Human Papillomavirus
TIEKLLSK

SEQ ID NO: 31612 - protein, 9 aa, Artificial Sequence
  Peptide Derived from Human Papillomavirus
TLLQQYCLY

SEQ ID NO: 31613 - protein, 11 aa, Artificial Sequence
  Peptide Derived from Human Papillomavirus
TLLQQYCLYLH

SEQ ID NO: 31614 - protein, 8 aa, Artificial Sequence
  Peptide Derived from Human Papillomavirus
TMCRHYKR

SEQ ID NO: 31615 - protein, 9 aa, Artificial Sequence
  Peptide Derived from Human Papillomavirus
TMCRHYKRA

SEQ ID NO: 31616 - protein, 11 aa, Artificial Sequence
  Peptide Derived from Human Papillomavirus
TMCRHYKRAEK

SEQ ID NO: 31617 - protein, 10 aa, Artificial Sequence
  Peptide Derived from Human Papillomavirus
TSNAKAAMLA

SEQ ID NO: 31618 - protein, 11 aa, Artificial Sequence
  Peptide Derived from Human Papillomavirus
TSNAKAAMLAK

SEQ ID NO: 31619 - protein, 11 aa, Artificial Sequence
  Peptide Derived from Human Papillomavirus
TSNINAGTDSR

SEQ ID NO: 31620 - protein, 8 aa, Artificial Sequence
  Peptide Derived from Human Papillomavirus
VDDGGDWK

SEQ ID NO: 31621 - protein, 8 aa, Artificial Sequence
  Peptide Derived from Human Papillomavirus
VDDSEIAY

SEQ ID NO: 31622 - protein, 9 aa, Artificial Sequence
  Peptide Derived from Human Papillomavirus
VDDSEIAYK

SEQ ID NO: 31623 - protein, 10 aa, Artificial Sequence
  Peptide Derived from Human Papillomavirus
VDDSEIAYKY

SEQ ID NO: 31624 - protein, 11 aa, Artificial Sequence
  Peptide Derived from Human Papillomavirus
VDDSEIAYKYA

SEQ ID NO: 31625 - protein, 10 aa, Artificial Sequence
  Peptide Derived from Human Papillomavirus
VDFIVNDNDY

SEQ ID NO: 31626 - protein, 8 aa, Artificial Sequence
  Peptide Derived from Human Papillomavirus
VDNNISPR

SEQ ID NO: 31627 - protein, 10 aa, Artificial Sequence
  Peptide Derived from Human Papillomavirus
VDNNISPRLK

SEQ ID NO: 31628 - protein, 11 aa, Artificial Sequence
  Peptide Derived from Human Papillomavirus
VDNNISPRLKA

SEQ ID NO: 31629 - protein, 8 aa, Artificial Sequence
  Peptide Derived from Human Papillomavirus
VFTFPNEF

SEQ ID NO: 31630 - protein, 10 aa, Artificial Sequence
  Peptide Derived from Human Papillomavirus
VFTFPNEFPF

SEQ ID NO: 31631 - protein, 8 aa, Artificial Sequence
  Peptide Derived from Human Papillomavirus
VICFVNSK

SEQ ID NO: 31632 - protein, 10 aa, Artificial Sequence
  Peptide Derived from Human Papillomavirus
VICFVNSKSH

SEQ ID NO: 31633 - protein, 11 aa, Artificial Sequence
  Peptide Derived from Human Papillomavirus
VICFVNSKSHF

SEQ ID NO: 31634 - protein, 8 aa, Artificial Sequence
  Peptide Derived from Human Papillomavirus
VLKTSNAK

SEQ ID NO: 31635 - protein, 9 aa, Artificial Sequence
  Peptide Derived from Human Papillomavirus
VLKTSNAKA

SEQ ID NO: 31636 - protein, 10 aa, Artificial Sequence
  Peptide Derived from Human Papillomavirus
VLKTSNAKAA

SEQ ID NO: 31637 - protein, 8 aa, Artificial Sequence
  Peptide Derived from Human Papillomavirus
VLLLVRYK

SEQ ID NO: 31638 - protein, 11 aa, Artificial Sequence
  Peptide Derived from Human Papillomavirus
VLLLVRYKCGK

SEQ ID NO: 31639 - protein, 11 aa, Artificial Sequence
  Peptide Derived from Human Papillomavirus
VLQHSFNDCTF

SEQ ID NO: 31640 - protein, 11 aa, Artificial Sequence
  Peptide Derived from Human Papillomavirus
VMFLRYQGVEF

SEQ ID NO: 31641 - protein, 8 aa, Artificial Sequence
  Peptide Derived from Human Papillomavirus
VSFSELVR

SEQ ID NO: 31642 - protein, 10 aa, Artificial Sequence
  Peptide Derived from Human Papillomavirus
VSFSELVRPF

SEQ ID NO: 31643 - protein, 11 aa, Artificial Sequence
  Peptide Derived from Human Papillomavirus
VSFSELVRPFK

SEQ ID NO: 31644 - protein, 8 aa, Artificial Sequence
  Peptide Derived from Human Papillomavirus
VSMDVKHR

SEQ ID NO: 31645 - protein, 9 aa, Artificial Sequence
  Peptide Derived from Human Papillomavirus
VVEKKTGDA

SEQ ID NO: 31646 - protein, 9 aa, Artificial Sequence
  Peptide Derived from Human Papillomavirus
VVFTFPNEF

SEQ ID NO: 31647 - protein, 11 aa, Artificial Sequence
  Peptide Derived from Human Papillomavirus
VVFTFPNEFPF

SEQ ID NO: 31648 - protein, 8 aa, Artificial Sequence
  Peptide Derived from Human Papillomavirus
VVLLLVRY

SEQ ID NO: 31649 - protein, 9 aa, Artificial Sequence
  Peptide Derived from Human Papillomavirus
VVLLLVRYK

SEQ ID NO: 31650 - protein, 10 aa, Artificial Sequence
  Peptide Derived from Human Papillomavirus
WFYVEAVVEK

SEQ ID NO: 31651 - protein, 11 aa, Artificial Sequence
  Peptide Derived from Human Papillomavirus
WFYVEAVVEKK

SEQ ID NO: 31652 - protein, 10 aa, Artificial Sequence
  Peptide Derived from Human Papillomavirus
WGMVVLLLVR

SEQ ID NO: 31653 - protein, 11 aa, Artificial Sequence
  Peptide Derived from Human Papillomavirus
WGMVVLLLVRY

SEQ ID NO: 31654 - protein, 8 aa, Artificial Sequence
  Peptide Derived from Human Papillomavirus
WIKYRCDR

SEQ ID NO: 31655 - protein, 10 aa, Artificial Sequence
  Peptide Derived from Human Papillomavirus
WIQRQTVLQH

SEQ ID NO: 31656 - protein, 8 aa, Artificial Sequence
  Peptide Derived from Human Papillomavirus
WLQPLADA

SEQ ID NO: 31657 - protein, 9 aa, Artificial Sequence
  Peptide Derived from Human Papillomavirus
WLQPLADAK

SEQ ID NO: 31658 - protein, 11 aa, Artificial Sequence
  Peptide Derived from Human Papillomavirus
YAQLADTNSNA

SEQ ID NO: 31659 - protein, 11 aa, Artificial Sequence
  Peptide Derived from Human Papillomavirus
YCLYLHIQSLA

SEQ ID NO: 31660 - protein, 8 aa, Artificial Sequence
  Peptide Derived from Human Papillomavirus
YGAANTGK

SEQ ID NO: 31661 - protein, 11 aa, Artificial Sequence
  Peptide Derived from Human Papillomavirus
YGAANTGKSLF

SEQ ID NO: 31662 - protein, 10 aa, Artificial Sequence
  Peptide Derived from Human Papillomavirus
YGDTPEWIQR

SEQ ID NO: 31663 - protein, 10 aa, Artificial Sequence
  Peptide Derived from Human Papillomavirus
YGVSFSELVR

SEQ ID NO: 31664 - protein, 9 aa, Artificial Sequence
  Peptide Derived from Human Papillomavirus
YIDDNLRNA

SEQ ID NO: 31665 - protein, 8 aa, Artificial Sequence
  Peptide Derived from Human Papillomavirus
YLHIQSLA

SEQ ID NO: 31666 - protein, 9 aa, Artificial Sequence
  Peptide Derived from Human Papillomavirus
YLHNRLVVF

SEQ ID NO: 31667 - protein, 11 aa, Artificial Sequence
  Peptide Derived from Human Papillomavirus
YLHNRLVVFTF

SEQ ID NO: 31668 - protein, 10 aa, Artificial Sequence
  Peptide Derived from Human Papillomavirus
YLTQAETETA

SEQ ID NO: 31669 - protein, 11 aa, Artificial Sequence
  Peptide Derived from Human Papillomavirus
YLTQAETETAH

SEQ ID NO: 31670 - protein, 8 aa, Artificial Sequence
  Peptide Derived from Human Papillomavirus
YVEAVVEK

SEQ ID NO: 31671 - protein, 9 aa, Artificial Sequence
  Peptide Derived from Human Papillomavirus
YVEAVVEKK

SEQ ID NO: 31672 - protein, 9 aa, Artificial Sequence
  Peptide Derived from Human Papillomavirus
AATHTKAVA

SEQ ID NO: 31673 - protein, 9 aa, Artificial Sequence
  Peptide Derived from Human Papillomavirus
AFNSSHKGR

SEQ ID NO: 31674 - protein, 11 aa, Artificial Sequence
  Peptide Derived from Human Papillomavirus
AIYYKAREMGF

SEQ ID NO: 31675 - protein, 8 aa, Artificial Sequence
  Peptide Derived from Human Papillomavirus
ATHTKAVA

SEQ ID NO: 31676 - protein, 10 aa, Artificial Sequence
  Peptide Derived from Human Papillomavirus
AVSKNKALQA

SEQ ID NO: 31677 - protein, 11 aa, Artificial Sequence
  Peptide Derived from Human Papillomavirus
AVSSTWHWTGH

SEQ ID NO: 31678 - protein, 8 aa, Artificial Sequence
  Peptide Derived from Human Papillomavirus
CAIYYKAR

SEQ ID NO: 31679 - protein, 8 aa, Artificial Sequence
  Peptide Derived from Human Papillomavirus
CLRYRFKK

SEQ ID NO: 31680 - protein, 9 aa, Artificial Sequence
  Peptide Derived from Human Papillomavirus
CLRYRFKKH

SEQ ID NO: 31681 - protein, 9 aa, Artificial Sequence
  Peptide Derived from Human Papillomavirus
DAEKYSKNK

SEQ ID NO: 31682 - protein, 9 aa, Artificial Sequence
  Peptide Derived from Human Papillomavirus
DANTLKCLR

SEQ ID NO: 31683 - protein, 10 aa, Artificial Sequence
  Peptide Derived from Human Papillomavirus
DANTLKCLRY

SEQ ID NO: 31684 - protein, 11 aa, Artificial Sequence
  Peptide Derived from Human Papillomavirus
DANTLKCLRYR

SEQ ID NO: 31685 - protein, 8 aa, Artificial Sequence
  Peptide Derived from Human Papillomavirus
DDAEKYSK

SEQ ID NO: 31686 - protein, 10 aa, Artificial Sequence
  Peptide Derived from Human Papillomavirus
DDAEKYSKNK

SEQ ID NO: 31687 - protein, 9 aa, Artificial Sequence
  Peptide Derived from Human Papillomavirus
DGDICNTMH

SEQ ID NO: 31688 - protein, 10 aa, Artificial Sequence
  Peptide Derived from Human Papillomavirus
DGDICNTMHY

SEQ ID NO: 31689 - protein, 8 aa, Artificial Sequence
  Peptide Derived from Human Papillomavirus
DICNTMHY

SEQ ID NO: 31690 - protein, 8 aa, Artificial Sequence
  Peptide Derived from Human Papillomavirus
DLRDHIDY

SEQ ID NO: 31691 - protein, 10 aa, Artificial Sequence
  Peptide Derived from Human Papillomavirus
DLRDHIDYWK

SEQ ID NO: 31692 - protein, 11 aa, Artificial Sequence
  Peptide Derived from Human Papillomavirus
DLRDHIDYWKH

SEQ ID NO: 31693 - protein, 8 aa, Artificial Sequence
  Peptide Derived from Human Papillomavirus
DSAPILTA

SEQ ID NO: 31694 - protein, 9 aa, Artificial Sequence
  Peptide Derived from Human Papillomavirus
DSAPILTAF

SEQ ID NO: 31695 - protein, 9 aa, Artificial Sequence
  Peptide Derived from Human Papillomavirus
DSEWQRDQF

SEQ ID NO: 31696 - protein, 8 aa, Artificial Sequence
  Peptide Derived from Human Papillomavirus
DSTDLRDH

SEQ ID NO: 31697 - protein, 11 aa, Artificial Sequence
  Peptide Derived from Human Papillomavirus
DSTDLRDHIDY

SEQ ID NO: 31698 - protein, 11 aa, Artificial Sequence
  Peptide Derived from Human Papillomavirus
DSVDSAPILTA

SEQ ID NO: 31699 - protein, 10 aa, Artificial Sequence
  Peptide Derived from Human Papillomavirus
DTGNPCHTTK

SEQ ID NO: 31700 - protein, 10 aa, Artificial Sequence
  Peptide Derived from Human Papillomavirus
DVSLEVYLTA

SEQ ID NO: 31701 - protein, 8 aa, Artificial Sequence
  Peptide Derived from Human Papillomavirus
ECAIYYKA

SEQ ID NO: 31702 - protein, 9 aa, Artificial Sequence
  Peptide Derived from Human Papillomavirus
ECAIYYKAR

SEQ ID NO: 31703 - protein, 10 aa, Artificial Sequence
  Peptide Derived from Human Papillomavirus
EGIRTYFVQF

SEQ ID NO: 31704 - protein, 11 aa, Artificial Sequence
  Peptide Derived from Human Papillomavirus
EGIRTYFVQFK

SEQ ID NO: 31705 - protein, 10 aa, Artificial Sequence
  Peptide Derived from Human Papillomavirus
EGQVDYYGLY

SEQ ID NO: 31706 - protein, 11 aa, Artificial Sequence
  Peptide Derived from Human Papillomavirus
EGQVDYYGLYY

SEQ ID NO: 31707 - protein, 8 aa, Artificial Sequence
  Peptide Derived from Human Papillomavirus
EIIRQHLA

SEQ ID NO: 31708 - protein, 10 aa, Artificial Sequence
  Peptide Derived from Human Papillomavirus
EIIRQHLANH

SEQ ID NO: 31709 - protein, 10 aa, Artificial Sequence
  Peptide Derived from Human Papillomavirus
ELQLTLETIY

SEQ ID NO: 31710 - protein, 9 aa, Artificial Sequence
  Peptide Derived from Human Papillomavirus
EMGFKHINH

SEQ ID NO: 31711 - protein, 8 aa, Artificial Sequence
  Peptide Derived from Human Papillomavirus
ETIYNSQY

SEQ ID NO: 31712 - protein, 8 aa, Artificial Sequence
  Peptide Derived from Human Papillomavirus
ETQTTIQR

SEQ ID NO: 31713 - protein, 10 aa, Artificial Sequence
  Peptide Derived from Human Papillomavirus
ETQTTIQRPR

SEQ ID NO: 31714 - protein, 9 aa, Artificial Sequence
  Peptide Derived from Human Papillomavirus
EVSSPEIIR

SEQ ID NO: 31715 - protein, 11 aa, Artificial Sequence
  Peptide Derived from Human Papillomavirus
EVSSPEIIRQH

SEQ ID NO: 31716 - protein, 10 aa, Artificial Sequence
  Peptide Derived from Human Papillomavirus
FDGDICNTMH

SEQ ID NO: 31717 - protein, 11 aa, Artificial Sequence
  Peptide Derived from Human Papillomavirus
FDGDICNTMHY

SEQ ID NO: 31718 - protein, 9 aa, Artificial Sequence
  Peptide Derived from Human Papillomavirus
FLSQVKIPK

SEQ ID NO: 31719 - protein, 8 aa, Artificial Sequence
  Peptide Derived from Human Papillomavirus
FVQFKDDA

SEQ ID NO: 31720 - protein, 10 aa, Artificial Sequence
  Peptide Derived from Human Papillomavirus
FVQFKDDAEK

SEQ ID NO: 31721 - protein, 11 aa, Artificial Sequence
  Peptide Derived from Human Papillomavirus
FVQFKDDAEKY

SEQ ID NO: 31722 - protein, 8 aa, Artificial Sequence
  Peptide Derived from Human Papillomavirus
GCIKKHGY

SEQ ID NO: 31723 - protein, 10 aa, Artificial Sequence
  Peptide Derived from Human Papillomavirus
GDANTLKCLR

SEQ ID NO: 31724 - protein, 11 aa, Artificial Sequence
  Peptide Derived from Human Papillomavirus
GDANTLKCLRY

SEQ ID NO: 31725 - protein, 8 aa, Artificial Sequence
  Peptide Derived from Human Papillomavirus
GDICNTMH

SEQ ID NO: 31726 - protein, 9 aa, Artificial Sequence
  Peptide Derived from Human Papillomavirus
GDICNTMHY

SEQ ID NO: 31727 - protein, 9 aa, Artificial Sequence
  Peptide Derived from Human Papillomavirus
GIRTYFVQF

SEQ ID NO: 31728 - protein, 10 aa, Artificial Sequence
  Peptide Derived from Human Papillomavirus
GIRTYFVQFK

SEQ ID NO: 31729 - protein, 10 aa, Artificial Sequence
  Peptide Derived from Human Papillomavirus
GLYYVHEGIR

SEQ ID NO: 31730 - protein, 11 aa, Artificial Sequence
  Peptide Derived from Human Papillomavirus
GTEETQTTIQR

SEQ ID NO: 31731 - protein, 9 aa, Artificial Sequence
  Peptide Derived from Human Papillomavirus
HGYTVEVQF

SEQ ID NO: 31732 - protein, 9 aa, Artificial Sequence
  Peptide Derived from Human Papillomavirus
HIDYWKHMR

SEQ ID NO: 31733 - protein, 11 aa, Artificial Sequence
  Peptide Derived from Human Papillomavirus
HINHQVVPTLA

SEQ ID NO: 31734 - protein, 8 aa, Artificial Sequence
  Peptide Derived from Human Papillomavirus
HIYICEEA

SEQ ID NO: 31735 - protein, 8 aa, Artificial Sequence
  Peptide Derived from Human Papillomavirus
HLANHPAA

SEQ ID NO: 31736 - protein, 10 aa, Artificial Sequence
  Peptide Derived from Human Papillomavirus
HLANHPAATH

SEQ ID NO: 31737 - protein, 10 aa, Artificial Sequence
  Peptide Derived from Human Papillomavirus
HLKGDANTLK

SEQ ID NO: 31738 - protein, 9 aa, Artificial Sequence
  Peptide Derived from Human Papillomavirus
HMRLECAIY

SEQ ID NO: 31739 - protein, 10 aa, Artificial Sequence
  Peptide Derived from Human Papillomavirus
HMRLECAIYY

SEQ ID NO: 31740 - protein, 11 aa, Artificial Sequence
  Peptide Derived from Human Papillomavirus
HMRLECAIYYK

SEQ ID NO: 31741 - protein, 8 aa, Artificial Sequence
  Peptide Derived from Human Papillomavirus
HTTKLLHR

SEQ ID NO: 31742 - protein, 8 aa, Artificial Sequence
  Peptide Derived from Human Papillomavirus
IDYWKHMR

SEQ ID NO: 31743 - protein, 9 aa, Artificial Sequence
  Peptide Derived from Human Papillomavirus
IIRQHLANH

SEQ ID NO: 31744 - protein, 11 aa, Artificial Sequence
  Peptide Derived from Human Papillomavirus
IIRQHLANHPA

SEQ ID NO: 31745 - protein, 8 aa, Artificial Sequence
  Peptide Derived from Human Papillomavirus
ILCPTSVF

SEQ ID NO: 31746 - protein, 9 aa, Artificial Sequence
  Peptide Derived from Human Papillomavirus
ILTAFNSSH

SEQ ID NO: 31747 - protein, 10 aa, Artificial Sequence
  Peptide Derived from Human Papillomavirus
ILTAFNSSHK

SEQ ID NO: 31748 - protein, 8 aa, Artificial Sequence
  Peptide Derived from Human Papillomavirus
IVHLKGDA

SEQ ID NO: 31749 - protein, 8 aa, Artificial Sequence
  Peptide Derived from Human Papillomavirus
KAREMGFK

SEQ ID NO: 31750 - protein, 9 aa, Artificial Sequence
  Peptide Derived from Human Papillomavirus
KAREMGFKH

SEQ ID NO: 31751 - protein, 8 aa, Artificial Sequence
  Peptide Derived from Human Papillomavirus
KCLRYRFK

SEQ ID NO: 31752 - protein, 9 aa, Artificial Sequence
  Peptide Derived from Human Papillomavirus
KCLRYRFKK

SEQ ID NO: 31753 - protein, 10 aa, Artificial Sequence
  Peptide Derived from Human Papillomavirus
KCLRYRFKKH

SEQ ID NO: 31754 - protein, 9 aa, Artificial Sequence
  Peptide Derived from Human Papillomavirus
KDDAEKYSK

SEQ ID NO: 31755 - protein, 11 aa, Artificial Sequence
  Peptide Derived from Human Papillomavirus
KDDAEKYSKNK

SEQ ID NO: 31756 - protein, 8 aa, Artificial Sequence
  Peptide Derived from Human Papillomavirus
KGDANTLK

SEQ ID NO: 31757 - protein, 11 aa, Artificial Sequence
  Peptide Derived from Human Papillomavirus
KGDANTLKCLR

SEQ ID NO: 31758 - protein, 11 aa, Artificial Sequence
  Peptide Derived from Human Papillomavirus
KLLHRDSVDSA

SEQ ID NO: 31759 - protein, 9 aa, Artificial Sequence
  Peptide Derived from Human Papillomavirus
KSAIVTLTY

SEQ ID NO: 31760 - protein, 9 aa, Artificial Sequence
  Peptide Derived from Human Papillomavirus
KTITVSTGF

SEQ ID NO: 31761 - protein, 9 aa, Artificial Sequence
  Peptide Derived from Human Papillomavirus
LANHPAATH

SEQ ID NO: 31762 - protein, 11 aa, Artificial Sequence
  Peptide Derived from Human Papillomavirus
LANHPAATHTK

SEQ ID NO: 31763 - protein, 8 aa, Artificial Sequence
  Peptide Derived from Human Papillomavirus
LAVSKNKA

SEQ ID NO: 31764 - protein, 11 aa, Artificial Sequence
  Peptide Derived from Human Papillomavirus
LAVSKNKALQA

SEQ ID NO: 31765 - protein, 11 aa, Artificial Sequence
  Peptide Derived from Human Papillomavirus
LCQRLNVCQDK

SEQ ID NO: 31766 - protein, 10 aa, Artificial Sequence
  Peptide Derived from Human Papillomavirus
LLHRDSVDSA

SEQ ID NO: 31767 - protein, 8 aa, Artificial Sequence
  Peptide Derived from Human Papillomavirus
LSQVKIPK

SEQ ID NO: 31768 - protein, 8 aa, Artificial Sequence
  Peptide Derived from Human Papillomavirus
LTAFNSSH

SEQ ID NO: 31769 - protein, 9 aa, Artificial Sequence
  Peptide Derived from Human Papillomavirus
LTAFNSSHK

SEQ ID NO: 31770 - protein, 11 aa, Artificial Sequence
  Peptide Derived from Human Papillomavirus
LTAFNSSHKGR

SEQ ID NO: 31771 - protein, 9 aa, Artificial Sequence
  Peptide Derived from Human Papillomavirus
LTAPTGCIK

SEQ ID NO: 31772 - protein, 10 aa, Artificial Sequence
  Peptide Derived from Human Papillomavirus
LTAPTGCIKK

SEQ ID NO: 31773 - protein, 11 aa, Artificial Sequence
  Peptide Derived from Human Papillomavirus
LTAPTGCIKKH

SEQ ID NO: 31774 - protein, 11 aa, Artificial Sequence
  Peptide Derived from Human Papillomavirus
LTLETIYNSQY

SEQ ID NO: 31775 - protein, 9 aa, Artificial Sequence
  Peptide Derived from Human Papillomavirus
LTYDSEWQR

SEQ ID NO: 31776 - protein, 8 aa, Artificial Sequence
  Peptide Derived from Human Papillomavirus
MGFKHINH

SEQ ID NO: 31777 - protein, 11 aa, Artificial Sequence
  Peptide Derived from Human Papillomavirus
NCNSNTTPIVH

SEQ ID NO: 31778 - protein, 9 aa, Artificial Sequence
  Peptide Derived from Human Papillomavirus
NDSTDLRDH

SEQ ID NO: 31779 - protein, 9 aa, Artificial Sequence
  Peptide Derived from Human Papillomavirus
NSNTTPIVH

SEQ ID NO: 31780 - protein, 11 aa, Artificial Sequence
  Peptide Derived from Human Papillomavirus
NSNTTPIVHLK

SEQ ID NO: 31781 - protein, 8 aa, Artificial Sequence
  Peptide Derived from Human Papillomavirus
NSQYSNEK

SEQ ID NO: 31782 - protein, 8 aa, Artificial Sequence
  Peptide Derived from Human Papillomavirus
NTLKCLRY

SEQ ID NO: 31783 - protein, 9 aa, Artificial Sequence
  Peptide Derived from Human Papillomavirus
NTLKCLRYR

SEQ ID NO: 31784 - protein, 10 aa, Artificial Sequence
  Peptide Derived from Human Papillomavirus
NTLKCLRYRF

SEQ ID NO: 31785 - protein, 11 aa, Artificial Sequence
  Peptide Derived from Human Papillomavirus
NTLKCLRYRFK

SEQ ID NO: 31786 - protein, 10 aa, Artificial Sequence
  Peptide Derived from Human Papillomavirus
NTMHYTNWTH

SEQ ID NO: 31787 - protein, 9 aa, Artificial Sequence
  Peptide Derived from Human Papillomavirus
NTTPIVHLK

SEQ ID NO: 31788 - protein, 10 aa, Artificial Sequence
  Peptide Derived from Human Papillomavirus
NVCQDKILTH

SEQ ID NO: 31789 - protein, 11 aa, Artificial Sequence
  Peptide Derived from Human Papillomavirus
NVCQDKILTHY

SEQ ID NO: 31790 - protein, 8 aa, Artificial Sequence
  Peptide Derived from Human Papillomavirus
PAATHTKA

SEQ ID NO: 31791 - protein, 10 aa, Artificial Sequence
  Peptide Derived from Human Papillomavirus
PAATHTKAVA

SEQ ID NO: 31792 - protein, 9 aa, Artificial Sequence
  Peptide Derived from Human Papillomavirus
PCHTTKLLH

SEQ ID NO: 31793 - protein, 10 aa, Artificial Sequence
  Peptide Derived from Human Papillomavirus
PCHTTKLLHR

SEQ ID NO: 31794 - protein, 8 aa, Artificial Sequence
  Peptide Derived from Human Papillomavirus
PDTGNPCH

SEQ ID NO: 31795 - protein, 11 aa, Artificial Sequence
  Peptide Derived from Human Papillomavirus
PDTGNPCHTTK

SEQ ID NO: 31796 - protein, 10 aa, Artificial Sequence
  Peptide Derived from Human Papillomavirus
PILTAFNSSH

SEQ ID NO: 31797 - protein, 11 aa, Artificial Sequence
  Peptide Derived from Human Papillomavirus
PILTAFNSSHK

SEQ ID NO: 31798 - protein, 9 aa, Artificial Sequence
  Peptide Derived from Human Papillomavirus
PIVHLKGDA

SEQ ID NO: 31799 - protein, 8 aa, Artificial Sequence
  Peptide Derived from Human Papillomavirus
PTGCIKKH

SEQ ID NO: 31800 - protein, 10 aa, Artificial Sequence
  Peptide Derived from Human Papillomavirus
PTGCIKKHGY

SEQ ID NO: 31801 - protein, 9 aa, Artificial Sequence
  Peptide Derived from Human Papillomavirus
PTLAVSKNK

SEQ ID NO: 31802 - protein, 10 aa, Artificial Sequence
  Peptide Derived from Human Papillomavirus
PTLAVSKNKA

SEQ ID NO: 31803 - protein, 8 aa, Artificial Sequence
  Peptide Derived from Human Papillomavirus
QDKILTHY

SEQ ID NO: 31804 - protein, 8 aa, Artificial Sequence
  Peptide Derived from Human Papillomavirus
QDVSLEVY

SEQ ID NO: 31805 - protein, 11 aa, Artificial Sequence
  Peptide Derived from Human Papillomavirus
QDVSLEVYLTA

SEQ ID NO: 31806 - protein, 11 aa, Artificial Sequence
  Peptide Derived from Human Papillomavirus
QFDGDICNTMH

SEQ ID NO: 31807 - protein, 8 aa, Artificial Sequence
  Peptide Derived from Human Papillomavirus
QFKDDAEK

SEQ ID NO: 31808 - protein, 9 aa, Artificial Sequence
  Peptide Derived from Human Papillomavirus
QFKDDAEKY

SEQ ID NO: 31809 - protein, 11 aa, Artificial Sequence
  Peptide Derived from Human Papillomavirus
QFKDDAEKYSK

SEQ ID NO: 31810 - protein, 10 aa, Artificial Sequence
  Peptide Derived from Human Papillomavirus
QFLSQVKIPK

SEQ ID NO: 31811 - protein, 8 aa, Artificial Sequence
  Peptide Derived from Human Papillomavirus
QLTLETIY

SEQ ID NO: 31812 - protein, 8 aa, Artificial Sequence
  Peptide Derived from Human Papillomavirus
QTTIQRPR

SEQ ID NO: 31813 - protein, 8 aa, Artificial Sequence
  Peptide Derived from Human Papillomavirus
QVDYYGLY

SEQ ID NO: 31814 - protein, 9 aa, Artificial Sequence
  Peptide Derived from Human Papillomavirus
QVDYYGLYY

SEQ ID NO: 31815 - protein, 11 aa, Artificial Sequence
  Peptide Derived from Human Papillomavirus
QVDYYGLYYVH

SEQ ID NO: 31816 - protein, 10 aa, Artificial Sequence
  Peptide Derived from Human Papillomavirus
QVILCPTSVF

SEQ ID NO: 31817 - protein, 10 aa, Artificial Sequence
  Peptide Derived from Human Papillomavirus
QVVPTLAVSK

SEQ ID NO: 31818 - protein, 8 aa, Artificial Sequence
  Peptide Derived from Human Papillomavirus
RDHIDYWK

SEQ ID NO: 31819 - protein, 9 aa, Artificial Sequence
  Peptide Derived from Human Papillomavirus
RDHIDYWKH

SEQ ID NO: 31820 - protein, 11 aa, Artificial Sequence
  Peptide Derived from Human Papillomavirus
RDHIDYWKHMR

SEQ ID NO: 31821 - protein, 9 aa, Artificial Sequence
  Peptide Derived from Human Papillomavirus
RDQFLSQVK

SEQ ID NO: 31822 - protein, 9 aa, Artificial Sequence
  Peptide Derived from Human Papillomavirus
RFKKHCTLY

SEQ ID NO: 31823 - protein, 11 aa, Artificial Sequence
  Peptide Derived from Human Papillomavirus
RFKKHCTLYTA

SEQ ID NO: 31824 - protein, 8 aa, Artificial Sequence
  Peptide Derived from Human Papillomavirus
RLECAIYY

SEQ ID NO: 31825 - protein, 9 aa, Artificial Sequence
  Peptide Derived from Human Papillomavirus
RLECAIYYK

SEQ ID NO: 31826 - protein, 10 aa, Artificial Sequence
  Peptide Derived from Human Papillomavirus
RLECAIYYKA

SEQ ID NO: 31827 - protein, 11 aa, Artificial Sequence
  Peptide Derived from Human Papillomavirus
RLECAIYYKAR

SEQ ID NO: 31828 - protein, 8 aa, Artificial Sequence
  Peptide Derived from Human Papillomavirus
RLNVCQDK

SEQ ID NO: 31829 - protein, 11 aa, Artificial Sequence
  Peptide Derived from Human Papillomavirus
RSEPDTGNPCH

SEQ ID NO: 31830 - protein, 8 aa, Artificial Sequence
  Peptide Derived from Human Papillomavirus
RTYFVQFK

SEQ ID NO: 31831 - protein, 11 aa, Artificial Sequence
  Peptide Derived from Human Papillomavirus
RTYFVQFKDDA

SEQ ID NO: 31832 - protein, 8 aa, Artificial Sequence
  Peptide Derived from Human Papillomavirus
SAIVTLTY

SEQ ID NO: 31833 - protein, 8 aa, Artificial Sequence
  Peptide Derived from Human Papillomavirus
SAPILTAF

SEQ ID NO: 31834 - protein, 8 aa, Artificial Sequence
  Peptide Derived from Human Papillomavirus
SLEVYLTA

SEQ ID NO: 31835 - protein, 9 aa, Artificial Sequence
  Peptide Derived from Human Papillomavirus
SSPEIIRQH

SEQ ID NO: 31836 - protein, 11 aa, Artificial Sequence
  Peptide Derived from Human Papillomavirus
SSPEIIRQHLA

SEQ ID NO: 31837 - protein, 9 aa, Artificial Sequence
  Peptide Derived from Human Papillomavirus
SSTWHWTGH

SEQ ID NO: 31838 - protein, 10 aa, Artificial Sequence
  Peptide Derived from Human Papillomavirus
STDLRDHIDY

SEQ ID NO: 31839 - protein, 8 aa, Artificial Sequence
  Peptide Derived from Human Papillomavirus
STWHWTGH

SEQ ID NO: 31840 - protein, 11 aa, Artificial Sequence
  Peptide Derived from Human Papillomavirus
STWHWTGHNVK

SEQ ID NO: 31841 - protein, 10 aa, Artificial Sequence
  Peptide Derived from Human Papillomavirus
SVDSAPILTA

SEQ ID NO: 31842 - protein, 11 aa, Artificial Sequence
  Peptide Derived from Human Papillomavirus
SVDSAPILTAF

SEQ ID NO: 31843 - protein, 11 aa, Artificial Sequence
  Peptide Derived from Human Papillomavirus
SVTVVEGQVDY

SEQ ID NO: 31844 - protein, 8 aa, Artificial Sequence
  Peptide Derived from Human Papillomavirus
TAFNSSHK

SEQ ID NO: 31845 - protein, 10 aa, Artificial Sequence
  Peptide Derived from Human Papillomavirus
TAFNSSHKGR

SEQ ID NO: 31846 - protein, 8 aa, Artificial Sequence
  Peptide Derived from Human Papillomavirus
TAPTGCIK

SEQ ID NO: 31847 - protein, 9 aa, Artificial Sequence
  Peptide Derived from Human Papillomavirus
TAPTGCIKK

SEQ ID NO: 31848 - protein, 10 aa, Artificial Sequence
  Peptide Derived from Human Papillomavirus
TAPTGCIKKH

SEQ ID NO: 31849 - protein, 8 aa, Artificial Sequence
  Peptide Derived from Human Papillomavirus
TAVSSTWH

SEQ ID NO: 31850 - protein, 9 aa, Artificial Sequence
  Peptide Derived from Human Papillomavirus
TDLRDHIDY

SEQ ID NO: 31851 - protein, 11 aa, Artificial Sequence
  Peptide Derived from Human Papillomavirus
TDLRDHIDYWK

SEQ ID NO: 31852 - protein, 9 aa, Artificial Sequence
  Peptide Derived from Human Papillomavirus
TGCIKKHGY

SEQ ID NO: 31853 - protein, 8 aa, Artificial Sequence
  Peptide Derived from Human Papillomavirus
TGHNVKHK

SEQ ID NO: 31854 - protein, 10 aa, Artificial Sequence
  Peptide Derived from Human Papillomavirus
TGHNVKHKSA

SEQ ID NO: 31855 - protein, 9 aa, Artificial Sequence
  Peptide Derived from Human Papillomavirus
TGNPCHTTK

SEQ ID NO: 31856 - protein, 8 aa, Artificial Sequence
  Peptide Derived from Human Papillomavirus
TITVSTGF

SEQ ID NO: 31857 - protein, 11 aa, Artificial Sequence
  Peptide Derived from Human Papillomavirus
TIYNSQYSNEK

SEQ ID NO: 31858 - protein, 8 aa, Artificial Sequence
  Peptide Derived from Human Papillomavirus
TLAVSKNK

SEQ ID NO: 31859 - protein, 9 aa, Artificial Sequence
  Peptide Derived from Human Papillomavirus
TLAVSKNKA

SEQ ID NO: 31860 - protein, 10 aa, Artificial Sequence
  Peptide Derived from Human Papillomavirus
TLETIYNSQY

SEQ ID NO: 31861 - protein, 8 aa, Artificial Sequence
  Peptide Derived from Human Papillomavirus
TLKCLRYR

SEQ ID NO: 31862 - protein, 9 aa, Artificial Sequence
  Peptide Derived from Human Papillomavirus
TLKCLRYRF

SEQ ID NO: 31863 - protein, 10 aa, Artificial Sequence
  Peptide Derived from Human Papillomavirus
TLKCLRYRFK

SEQ ID NO: 31864 - protein, 11 aa, Artificial Sequence
  Peptide Derived from Human Papillomavirus
TLKCLRYRFKK

SEQ ID NO: 31865 - protein, 10 aa, Artificial Sequence
  Peptide Derived from Human Papillomavirus
TLQDVSLEVY

SEQ ID NO: 31866 - protein, 10 aa, Artificial Sequence
  Peptide Derived from Human Papillomavirus
TLTYDSEWQR

SEQ ID NO: 31867 - protein, 11 aa, Artificial Sequence
  Peptide Derived from Human Papillomavirus
TLYTAVSSTWH

SEQ ID NO: 31868 - protein, 9 aa, Artificial Sequence
  Peptide Derived from Human Papillomavirus
TMHYTNWTH

SEQ ID NO: 31869 - protein, 11 aa, Artificial Sequence
  Peptide Derived from Human Papillomavirus
TMHYTNWTHIY

SEQ ID NO: 31870 - protein, 8 aa, Artificial Sequence
  Peptide Derived from Human Papillomavirus
TTPIVHLK

SEQ ID NO: 31871 - protein, 11 aa, Artificial Sequence
  Peptide Derived from Human Papillomavirus
TTPIVHLKGDA

SEQ ID NO: 31872 - protein, 9 aa, Artificial Sequence
  Peptide Derived from Human Papillomavirus
TVVEGQVDY

SEQ ID NO: 31873 - protein, 10 aa, Artificial Sequence
  Peptide Derived from Human Papillomavirus
TVVEGQVDYY

SEQ ID NO: 31874 - protein, 9 aa, Artificial Sequence
  Peptide Derived from Human Papillomavirus
VCQDKILTH

SEQ ID NO: 31875 - protein, 10 aa, Artificial Sequence
  Peptide Derived from Human Papillomavirus
VCQDKILTHY

SEQ ID NO: 31876 - protein, 9 aa, Artificial Sequence
  Peptide Derived from Human Papillomavirus
VDSAPILTA

SEQ ID NO: 31877 - protein, 10 aa, Artificial Sequence
  Peptide Derived from Human Papillomavirus
VDSAPILTAF

SEQ ID NO: 31878 - protein, 8 aa, Artificial Sequence
  Peptide Derived from Human Papillomavirus
VDYYGLYY

SEQ ID NO: 31879 - protein, 10 aa, Artificial Sequence
  Peptide Derived from Human Papillomavirus
VDYYGLYYVH

SEQ ID NO: 31880 - protein, 9 aa, Artificial Sequence
  Peptide Derived from Human Papillomavirus
VILCPTSVF

SEQ ID NO: 31881 - protein, 9 aa, Artificial Sequence
  Peptide Derived from Human Papillomavirus
VSKNKALQA

SEQ ID NO: 31882 - protein, 9 aa, Artificial Sequence
  Peptide Derived from Human Papillomavirus
VSLEVYLTA

SEQ ID NO: 31883 - protein, 8 aa, Artificial Sequence
  Peptide Derived from Human Papillomavirus
VSSPEIIR

SEQ ID NO: 31884 - protein, 10 aa, Artificial Sequence
  Peptide Derived from Human Papillomavirus
VSSPEIIRQH

SEQ ID NO: 31885 - protein, 10 aa, Artificial Sequence
  Peptide Derived from Human Papillomavirus
VSSTWHWTGH

SEQ ID NO: 31886 - protein, 11 aa, Artificial Sequence
  Peptide Derived from Human Papillomavirus
VTLTYDSEWQR

SEQ ID NO: 31887 - protein, 10 aa, Artificial Sequence
  Peptide Derived from Human Papillomavirus
VTVVEGQVDY

SEQ ID NO: 31888 - protein, 11 aa, Artificial Sequence
  Peptide Derived from Human Papillomavirus
VTVVEGQVDYY

SEQ ID NO: 31889 - protein, 8 aa, Artificial Sequence
  Peptide Derived from Human Papillomavirus
VVEGQVDY

SEQ ID NO: 31890 - protein, 9 aa, Artificial Sequence
  Peptide Derived from Human Papillomavirus
VVEGQVDYY

SEQ ID NO: 31891 - protein, 9 aa, Artificial Sequence
  Peptide Derived from Human Papillomavirus
VVPTLAVSK

SEQ ID NO: 31892 - protein, 11 aa, Artificial Sequence
  Peptide Derived from Human Papillomavirus
VVPTLAVSKNK

SEQ ID NO: 31893 - protein, 8 aa, Artificial Sequence
  Peptide Derived from Human Papillomavirus
WTGHNVKH

SEQ ID NO: 31894 - protein, 9 aa, Artificial Sequence
  Peptide Derived from Human Papillomavirus
WTGHNVKHK

SEQ ID NO: 31895 - protein, 11 aa, Artificial Sequence
  Peptide Derived from Human Papillomavirus
WTGHNVKHKSA

SEQ ID NO: 31896 - protein, 10 aa, Artificial Sequence
  Peptide Derived from Human Papillomavirus
WTHIYICEEA

SEQ ID NO: 31897 - protein, 11 aa, Artificial Sequence
  Peptide Derived from Human Papillomavirus
WTLQDVSLEVY

SEQ ID NO: 31898 - protein, 10 aa, Artificial Sequence
  Peptide Derived from Human Papillomavirus
YDSEWQRDQF

SEQ ID NO: 31899 - protein, 9 aa, Artificial Sequence
  Peptide Derived from Human Papillomavirus
YFVQFKDDA

SEQ ID NO: 31900 - protein, 11 aa, Artificial Sequence
  Peptide Derived from Human Papillomavirus
YFVQFKDDAEK

SEQ ID NO: 31901 - protein, 11 aa, Artificial Sequence
  Peptide Derived from Human Papillomavirus
YGLYYVHEGIR

SEQ ID NO: 31902 - protein, 10 aa, Artificial Sequence
  Peptide Derived from Human Papillomavirus
YLTAPTGCIK

SEQ ID NO: 31903 - protein, 11 aa, Artificial Sequence
  Peptide Derived from Human Papillomavirus
YLTAPTGCIKK

SEQ ID NO: 31904 - protein, 10 aa, Artificial Sequence
  Peptide Derived from Human Papillomavirus
YSKNKVWEVH

SEQ ID NO: 31905 - protein, 11 aa, Artificial Sequence
  Peptide Derived from Human Papillomavirus
YSKNKVWEVHA

SEQ ID NO: 31906 - protein, 9 aa, Artificial Sequence
  Peptide Derived from Human Papillomavirus
YTAVSSTWH

SEQ ID NO: 31907 - protein, 8 aa, Artificial Sequence
  Peptide Derived from Human Papillomavirus
YTNWTHIY

SEQ ID NO: 31908 - protein, 9 aa, Artificial Sequence
  Peptide Derived from Human Papillomavirus
YVHEGIRTY

SEQ ID NO: 31909 - protein, 10 aa, Artificial Sequence
  Peptide Derived from Human Papillomavirus
YVHEGIRTYF

SEQ ID NO: 31910 - protein, 8 aa, Artificial Sequence
  Peptide Derived from Human Papillomavirus
AASAFRCF

SEQ ID NO: 31911 - protein, 11 aa, Artificial Sequence
  Peptide Derived from Human Papillomavirus
AASAFRCFIVY

SEQ ID NO: 31912 - protein, 8 aa, Artificial Sequence
  Peptide Derived from Human Papillomavirus
AFRCFIVY

SEQ ID NO: 31913 - protein, 11 aa, Artificial Sequence
  Peptide Derived from Human Papillomavirus
AFRCFIVYIIF

SEQ ID NO: 31914 - protein, 10 aa, Artificial Sequence
  Peptide Derived from Human Papillomavirus
ASAFRCFIVY

SEQ ID NO: 31915 - protein, 9 aa, Artificial Sequence
  Peptide Derived from Human Papillomavirus
ASTTLLACF

SEQ ID NO: 31916 - protein, 8 aa, Artificial Sequence
  Peptide Derived from Human Papillomavirus
CFIVYIIF

SEQ ID NO: 31917 - protein, 10 aa, Artificial Sequence
  Peptide Derived from Human Papillomavirus
CFIVYIIFVY

SEQ ID NO: 31918 - protein, 11 aa, Artificial Sequence
  Peptide Derived from Human Papillomavirus
CVLLCVCLLIR

SEQ ID NO: 31919 - protein, 9 aa, Artificial Sequence
  Peptide Derived from Human Papillomavirus
DTASTTLLA

SEQ ID NO: 31920 - protein, 11 aa, Artificial Sequence
  Peptide Derived from Human Papillomavirus
DTASTTLLACF

SEQ ID NO: 31921 - protein, 9 aa, Artificial Sequence
  Peptide Derived from Human Papillomavirus
FIVYIIFVY

SEQ ID NO: 31922 - protein, 8 aa, Artificial Sequence
  Peptide Derived from Human Papillomavirus
FLIHTHAR

SEQ ID NO: 31923 - protein, 9 aa, Artificial Sequence
  Peptide Derived from Human Papillomavirus
FLIHTHARF

SEQ ID NO: 31924 - protein, 10 aa, Artificial Sequence
  Peptide Derived from Human Papillomavirus
FVYIPLFLIH

SEQ ID NO: 31925 - protein, 8 aa, Artificial Sequence
  Peptide Derived from Human Papillomavirus
IFVYIPLF

SEQ ID NO: 31926 - protein, 11 aa, Artificial Sequence
  Peptide Derived from Human Papillomavirus
IFVYIPLFLIH

SEQ ID NO: 31927 - protein, 9 aa, Artificial Sequence
  Peptide Derived from Human Papillomavirus
IIFVYIPLF

SEQ ID NO: 31928 - protein, 11 aa, Artificial Sequence
  Peptide Derived from Human Papillomavirus
IILVLLLWITA

SEQ ID NO: 31929 - protein, 10 aa, Artificial Sequence
  Peptide Derived from Human Papillomavirus
ILVLLLWITA

SEQ ID NO: 31930 - protein, 11 aa, Artificial Sequence
  Peptide Derived from Human Papillomavirus
ILVLLLWITAA

SEQ ID NO: 31931 - protein, 8 aa, Artificial Sequence
  Peptide Derived from Human Papillomavirus
ITAASAFR

SEQ ID NO: 31932 - protein, 10 aa, Artificial Sequence
  Peptide Derived from Human Papillomavirus
ITAASAFRCF

SEQ ID NO: 31933 - protein, 8 aa, Artificial Sequence
  Peptide Derived from Human Papillomavirus
IVYIIFVY

SEQ ID NO: 31934 - protein, 8 aa, Artificial Sequence
  Peptide Derived from Human Papillomavirus
LACFLLCF

SEQ ID NO: 31935 - protein, 8 aa, Artificial Sequence
  Peptide Derived from Human Papillomavirus
LCVCLLIR

SEQ ID NO: 31936 - protein, 10 aa, Artificial Sequence
  Peptide Derived from Human Papillomavirus
LDTASTTLLA

SEQ ID NO: 31937 - protein, 8 aa, Artificial Sequence
  Peptide Derived from Human Papillomavirus
LFLIHTHA

SEQ ID NO: 31938 - protein, 9 aa, Artificial Sequence
  Peptide Derived from Human Papillomavirus
LFLIHTHAR

SEQ ID NO: 31939 - protein, 10 aa, Artificial Sequence
  Peptide Derived from Human Papillomavirus
LFLIHTHARF

SEQ ID NO: 31940 - protein, 8 aa, Artificial Sequence
  Peptide Derived from Human Papillomavirus
LIHTHARF

SEQ ID NO: 31941 - protein, 9 aa, Artificial Sequence
  Peptide Derived from Human Papillomavirus
LLACFLLCF

SEQ ID NO: 31942 - protein, 9 aa, Artificial Sequence
  Peptide Derived from Human Papillomavirus
LLCVCLLIR

SEQ ID NO: 31943 - protein, 8 aa, Artificial Sequence
  Peptide Derived from Human Papillomavirus
LLLSVSTY

SEQ ID NO: 31944 - protein, 8 aa, Artificial Sequence
  Peptide Derived from Human Papillomavirus
LLLWITAA

SEQ ID NO: 31945 - protein, 10 aa, Artificial Sequence
  Peptide Derived from Human Papillomavirus
LLLWITAASA

SEQ ID NO: 31946 - protein, 11 aa, Artificial Sequence
  Peptide Derived from Human Papillomavirus
LLLWITAASAF

SEQ ID NO: 31947 - protein, 9 aa, Artificial Sequence
  Peptide Derived from Human Papillomavirus
LLWITAASA

SEQ ID NO: 31948 - protein, 10 aa, Artificial Sequence
  Peptide Derived from Human Papillomavirus
LLWITAASAF

SEQ ID NO: 31949 - protein, 11 aa, Artificial Sequence
  Peptide Derived from Human Papillomavirus
LLWITAASAFR

SEQ ID NO: 31950 - protein, 9 aa, Artificial Sequence
  Peptide Derived from Human Papillomavirus
LVLLLWITA

SEQ ID NO: 31951 - protein, 10 aa, Artificial Sequence
  Peptide Derived from Human Papillomavirus
LVLLLWITAA

SEQ ID NO: 31952 - protein, 11 aa, Artificial Sequence
  Peptide Derived from Human Papillomavirus
NLDTASTTLLA

SEQ ID NO: 31953 - protein, 8 aa, Artificial Sequence
  Peptide Derived from Human Papillomavirus
PLFLIHTH

SEQ ID NO: 31954 - protein, 9 aa, Artificial Sequence
  Peptide Derived from Human Papillomavirus
PLFLIHTHA

SEQ ID NO: 31955 - protein, 10 aa, Artificial Sequence
  Peptide Derived from Human Papillomavirus
PLFLIHTHAR

SEQ ID NO: 31956 - protein, 11 aa, Artificial Sequence
  Peptide Derived from Human Papillomavirus
PLFLIHTHARF

SEQ ID NO: 31957 - protein, 9 aa, Artificial Sequence
  Peptide Derived from Human Papillomavirus
PLLLSVSTY

SEQ ID NO: 31958 - protein, 9 aa, Artificial Sequence
  Peptide Derived from Human Papillomavirus
RCFIVYIIF

SEQ ID NO: 31959 - protein, 11 aa, Artificial Sequence
  Peptide Derived from Human Papillomavirus
RCFIVYIIFVY

SEQ ID NO: 31960 - protein, 9 aa, Artificial Sequence
  Peptide Derived from Human Papillomavirus
SAFRCFIVY

SEQ ID NO: 31961 - protein, 8 aa, Artificial Sequence
  Peptide Derived from Human Papillomavirus
STTLLACF

SEQ ID NO: 31962 - protein, 9 aa, Artificial Sequence
  Peptide Derived from Human Papillomavirus
TAASAFRCF

SEQ ID NO: 31963 - protein, 8 aa, Artificial Sequence
  Peptide Derived from Human Papillomavirus
TASTTLLA

SEQ ID NO: 31964 - protein, 10 aa, Artificial Sequence
  Peptide Derived from Human Papillomavirus
TASTTLLACF

SEQ ID NO: 31965 - protein, 10 aa, Artificial Sequence
  Peptide Derived from Human Papillomavirus
TLLACFLLCF

SEQ ID NO: 31966 - protein, 11 aa, Artificial Sequence
  Peptide Derived from Human Papillomavirus
TTLLACFLLCF

SEQ ID NO: 31967 - protein, 10 aa, Artificial Sequence
  Peptide Derived from Human Papillomavirus
VLLCVCLLIR

SEQ ID NO: 31968 - protein, 8 aa, Artificial Sequence
  Peptide Derived from Human Papillomavirus
VLLLWITA

SEQ ID NO: 31969 - protein, 9 aa, Artificial Sequence
  Peptide Derived from Human Papillomavirus
VLLLWITAA

SEQ ID NO: 31970 - protein, 11 aa, Artificial Sequence
  Peptide Derived from Human Papillomavirus
VLLLWITAASA

SEQ ID NO: 31971 - protein, 8 aa, Artificial Sequence
  Peptide Derived from Human Papillomavirus
WITAASAF

SEQ ID NO: 31972 - protein, 9 aa, Artificial Sequence
  Peptide Derived from Human Papillomavirus
WITAASAFR

SEQ ID NO: 31973 - protein, 11 aa, Artificial Sequence
  Peptide Derived from Human Papillomavirus
WITAASAFRCF

SEQ ID NO: 31974 - protein, 10 aa, Artificial Sequence
  Peptide Derived from Human Papillomavirus
YIIFVYIPLF

SEQ ID NO: 31975 - protein, 8 aa, Artificial Sequence
  Peptide Derived from Human Papillomavirus
YIPLFLIH

SEQ ID NO: 31976 - protein, 10 aa, Artificial Sequence
  Peptide Derived from Human Papillomavirus
YIPLFLIHTH

SEQ ID NO: 31977 - protein, 11 aa, Artificial Sequence
  Peptide Derived from Human Papillomavirus
YIPLFLIHTHA

SEQ ID NO: 31978 - protein, 9 aa, Artificial Sequence
  Peptide Derived from Human Papillomavirus
AFRDLCIVY

SEQ ID NO: 31979 - protein, 10 aa, Artificial Sequence
  Peptide Derived from Human Papillomavirus
AFRDLCIVYR

SEQ ID NO: 31980 - protein, 9 aa, Artificial Sequence
  Peptide Derived from Human Papillomavirus
AMFQDPQER

SEQ ID NO: 31981 - protein, 11 aa, Artificial Sequence
  Peptide Derived from Human Papillomavirus
AMFQDPQERPR

SEQ ID NO: 31982 - protein, 8 aa, Artificial Sequence
  Peptide Derived from Human Papillomavirus
AVCDKCLK

SEQ ID NO: 31983 - protein, 9 aa, Artificial Sequence
  Peptide Derived from Human Papillomavirus
AVCDKCLKF

SEQ ID NO: 31984 - protein, 10 aa, Artificial Sequence
  Peptide Derived from Human Papillomavirus
AVCDKCLKFY

SEQ ID NO: 31985 - protein, 8 aa, Artificial Sequence
  Peptide Derived from Human Papillomavirus
CCRSSRTR

SEQ ID NO: 31986 - protein, 9 aa, Artificial Sequence
  Peptide Derived from Human Papillomavirus
CCRSSRTRR

SEQ ID NO: 31987 - protein, 8 aa, Artificial Sequence
  Peptide Derived from Human Papillomavirus
CDKCLKFY

SEQ ID NO: 31988 - protein, 10 aa, Artificial Sequence
  Peptide Derived from Human Papillomavirus
CDKCLKFYSK

SEQ ID NO: 31989 - protein, 10 aa, Artificial Sequence
  Peptide Derived from Human Papillomavirus
CIVYRDGNPY

SEQ ID NO: 31990 - protein, 11 aa, Artificial Sequence
  Peptide Derived from Human Papillomavirus
CIVYRDGNPYA

SEQ ID NO: 31991 - protein, 11 aa, Artificial Sequence
  Peptide Derived from Human Papillomavirus
CLKFYSKISEY

SEQ ID NO: 31992 - protein, 9 aa, Artificial Sequence
  Peptide Derived from Human Papillomavirus
CMSCCRSSR

SEQ ID NO: 31993 - protein, 11 aa, Artificial Sequence
  Peptide Derived from Human Papillomavirus
CMSCCRSSRTR

SEQ ID NO: 31994 - protein, 9 aa, Artificial Sequence
  Peptide Derived from Human Papillomavirus
CTELQTTIH

SEQ ID NO: 31995 - protein, 10 aa, Artificial Sequence
  Peptide Derived from Human Papillomavirus
CVYCKQQLLR

SEQ ID NO: 31996 - protein, 11 aa, Artificial Sequence
  Peptide Derived from Human Papillomavirus
CVYCKQQLLRR

SEQ ID NO: 31997 - protein, 11 aa, Artificial Sequence
  Peptide Derived from Human Papillomavirus
DFAFRDLCIVY

SEQ ID NO: 31998 - protein, 10 aa, Artificial Sequence
  Peptide Derived from Human Papillomavirus
DGNPYAVCDK

SEQ ID NO: 31999 - protein, 8 aa, Artificial Sequence
  Peptide Derived from Human Papillomavirus
DIILECVY

SEQ ID NO: 32000 - protein, 10 aa, Artificial Sequence
  Peptide Derived from Human Papillomavirus
DIILECVYCK

SEQ ID NO: 32001 - protein, 11 aa, Artificial Sequence
  Peptide Derived from Human Papillomavirus
DLLIRCINCQK

SEQ ID NO: 32002 - protein, 11 aa, Artificial Sequence
  Peptide Derived from Human Papillomavirus
ECVYCKQQLLR

SEQ ID NO: 32003 - protein, 8 aa, Artificial Sequence
  Peptide Derived from Human Papillomavirus
EVYDFAFR

SEQ ID NO: 32004 - protein, 10 aa, Artificial Sequence
  Peptide Derived from Human Papillomavirus
FAFRDLCIVY

SEQ ID NO: 32005 - protein, 11 aa, Artificial Sequence
  Peptide Derived from Human Papillomavirus
FAFRDLCIVYR

SEQ ID NO: 32006 - protein, 8 aa, Artificial Sequence
  Peptide Derived from Human Papillomavirus
GTTLEQQY

SEQ ID NO: 32007 - protein, 10 aa, Artificial Sequence
  Peptide Derived from Human Papillomavirus
GTTLEQQYNK

SEQ ID NO: 32008 - protein, 9 aa, Artificial Sequence
  Peptide Derived from Human Papillomavirus
HDIILECVY

SEQ ID NO: 32009 - protein, 11 aa, Artificial Sequence
  Peptide Derived from Human Papillomavirus
HDIILECVYCK

SEQ ID NO: 32010 - protein, 8 aa, Artificial Sequence
  Peptide Derived from Human Papillomavirus
HLDKKQRF

SEQ ID NO: 32011 - protein, 9 aa, Artificial Sequence
  Peptide Derived from Human Papillomavirus
HLDKKQRFH

SEQ ID NO: 32012 - protein, 9 aa, Artificial Sequence
  Peptide Derived from Human Papillomavirus
IILECVYCK

SEQ ID NO: 32013 - protein, 8 aa, Artificial Sequence
  Peptide Derived from Human Papillomavirus
ILECVYCK

SEQ ID NO: 32014 - protein, 9 aa, Artificial Sequence
  Peptide Derived from Human Papillomavirus
ISEYRHYCY

SEQ ID NO: 32015 - protein, 9 aa, Artificial Sequence
  Peptide Derived from Human Papillomavirus
IVYRDGNPY

SEQ ID NO: 32016 - protein, 10 aa, Artificial Sequence
  Peptide Derived from Human Papillomavirus
IVYRDGNPYA

SEQ ID NO: 32017 - protein, 8 aa, Artificial Sequence
  Peptide Derived from Human Papillomavirus
KCLKFYSK

SEQ ID NO: 32018 - protein, 9 aa, Artificial Sequence
  Peptide Derived from Human Papillomavirus
KFYSKISEY

SEQ ID NO: 32019 - protein, 10 aa, Artificial Sequence
  Peptide Derived from Human Papillomavirus
KFYSKISEYR

SEQ ID NO: 32020 - protein, 11 aa, Artificial Sequence
  Peptide Derived from Human Papillomavirus
KFYSKISEYRH

SEQ ID NO: 32021 - protein, 8 aa, Artificial Sequence
  Peptide Derived from Human Papillomavirus
KISEYRHY

SEQ ID NO: 32022 - protein, 10 aa, Artificial Sequence
  Peptide Derived from Human Papillomavirus
KISEYRHYCY

SEQ ID NO: 32023 - protein, 11 aa, Artificial Sequence
  Peptide Derived from Human Papillomavirus
LCIVYRDGNPY

SEQ ID NO: 32024 - protein, 8 aa, Artificial Sequence
  Peptide Derived from Human Papillomavirus
LCPEEKQR

SEQ ID NO: 32025 - protein, 9 aa, Artificial Sequence
  Peptide Derived from Human Papillomavirus
LCPEEKQRH

SEQ ID NO: 32026 - protein, 10 aa, Artificial Sequence
  Peptide Derived from Human Papillomavirus
LCTELQTTIH

SEQ ID NO: 32027 - protein, 8 aa, Artificial Sequence
  Peptide Derived from Human Papillomavirus
LDKKQRFH

SEQ ID NO: 32028 - protein, 11 aa, Artificial Sequence
  Peptide Derived from Human Papillomavirus
LDKKQRFHNIR

SEQ ID NO: 32029 - protein, 9 aa, Artificial Sequence
  Peptide Derived from Human Papillomavirus
LIRCINCQK

SEQ ID NO: 32030 - protein, 10 aa, Artificial Sequence
  Peptide Derived from Human Papillomavirus
LLIRCINCQK

SEQ ID NO: 32031 - protein, 9 aa, Artificial Sequence
  Peptide Derived from Human Papillomavirus
LLRREVYDF

SEQ ID NO: 32032 - protein, 10 aa, Artificial Sequence
  Peptide Derived from Human Papillomavirus
LLRREVYDFA

SEQ ID NO: 32033 - protein, 11 aa, Artificial Sequence
  Peptide Derived from Human Papillomavirus
LLRREVYDFAF

SEQ ID NO: 32034 - protein, 8 aa, Artificial Sequence
  Peptide Derived from Human Papillomavirus
MFQDPQER

SEQ ID NO: 32035 - protein, 10 aa, Artificial Sequence
  Peptide Derived from Human Papillomavirus
MFQDPQERPR

SEQ ID NO: 32036 - protein, 11 aa, Artificial Sequence
  Peptide Derived from Human Papillomavirus
MFQDPQERPRK

SEQ ID NO: 32037 - protein, 8 aa, Artificial Sequence
  Peptide Derived from Human Papillomavirus
MSCCRSSR

SEQ ID NO: 32038 - protein, 10 aa, Artificial Sequence
  Peptide Derived from Human Papillomavirus
MSCCRSSRTR

SEQ ID NO: 32039 - protein, 11 aa, Artificial Sequence
  Peptide Derived from Human Papillomavirus
MSCCRSSRTRR

SEQ ID NO: 32040 - protein, 11 aa, Artificial Sequence
  Peptide Derived from Human Papillomavirus
NCQKPLCPEEK

SEQ ID NO: 32041 - protein, 9 aa, Artificial Sequence
  Peptide Derived from Human Papillomavirus
NIRGRWTGR

SEQ ID NO: 32042 - protein, 8 aa, Artificial Sequence
  Peptide Derived from Human Papillomavirus
PLCDLLIR

SEQ ID NO: 32043 - protein, 9 aa, Artificial Sequence
  Peptide Derived from Human Papillomavirus
PLCPEEKQR

SEQ ID NO: 32044 - protein, 10 aa, Artificial Sequence
  Peptide Derived from Human Papillomavirus
PLCPEEKQRH

SEQ ID NO: 32045 - protein, 8 aa, Artificial Sequence
  Peptide Derived from Human Papillomavirus
QDPQERPR

SEQ ID NO: 32046 - protein, 9 aa, Artificial Sequence
  Peptide Derived from Human Papillomavirus
QDPQERPRK

SEQ ID NO: 32047 - protein, 11 aa, Artificial Sequence
  Peptide Derived from Human Papillomavirus
QLCTELQTTIH

SEQ ID NO: 32048 - protein, 8 aa, Artificial Sequence
  Peptide Derived from Human Papillomavirus
QLLRREVY

SEQ ID NO: 32049 - protein, 10 aa, Artificial Sequence
  Peptide Derived from Human Papillomavirus
QLLRREVYDF

SEQ ID NO: 32050 - protein, 11 aa, Artificial Sequence
  Peptide Derived from Human Papillomavirus
QLLRREVYDFA

SEQ ID NO: 32051 - protein, 10 aa, Artificial Sequence
  Peptide Derived from Human Papillomavirus
RCMSCCRSSR

SEQ ID NO: 32052 - protein, 11 aa, Artificial Sequence
  Peptide Derived from Human Papillomavirus
RDGNPYAVCDK

SEQ ID NO: 32053 - protein, 8 aa, Artificial Sequence
  Peptide Derived from Human Papillomavirus
RDLCIVYR

SEQ ID NO: 32054 - protein, 8 aa, Artificial Sequence
  Peptide Derived from Human Papillomavirus
RFHNIRGR

SEQ ID NO: 32055 - protein, 11 aa, Artificial Sequence
  Peptide Derived from Human Papillomavirus
RTAMFQDPQER

SEQ ID NO: 32056 - protein, 9 aa, Artificial Sequence
  Peptide Derived from Human Papillomavirus
SCCRSSRTR

SEQ ID NO: 32057 - protein, 10 aa, Artificial Sequence
  Peptide Derived from Human Papillomavirus
SCCRSSRTRR

SEQ ID NO: 32058 - protein, 11 aa, Artificial Sequence
  Peptide Derived from Human Papillomavirus
SLYGTTLEQQY

SEQ ID NO: 32059 - protein, 10 aa, Artificial Sequence
  Peptide Derived from Human Papillomavirus
TAMFQDPQER

SEQ ID NO: 32060 - protein, 9 aa, Artificial Sequence
  Peptide Derived from Human Papillomavirus
TGRCMSCCR

SEQ ID NO: 32061 - protein, 11 aa, Artificial Sequence
  Peptide Derived from Human Papillomavirus
TIHDIILECVY

SEQ ID NO: 32062 - protein, 8 aa, Artificial Sequence
  Peptide Derived from Human Papillomavirus
TLEQQYNK

SEQ ID NO: 32063 - protein, 9 aa, Artificial Sequence
  Peptide Derived from Human Papillomavirus
TTLEQQYNK

SEQ ID NO: 32064 - protein, 8 aa, Artificial Sequence
  Peptide Derived from Human Papillomavirus
VCDKCLKF

SEQ ID NO: 32065 - protein, 9 aa, Artificial Sequence
  Peptide Derived from Human Papillomavirus
VCDKCLKFY

SEQ ID NO: 32066 - protein, 11 aa, Artificial Sequence
  Peptide Derived from Human Papillomavirus
VCDKCLKFYSK

SEQ ID NO: 32067 - protein, 10 aa, Artificial Sequence
  Peptide Derived from Human Papillomavirus
WTGRCMSCCR

SEQ ID NO: 32068 - protein, 9 aa, Artificial Sequence
  Peptide Derived from Human Papillomavirus
YAVCDKCLK

SEQ ID NO: 32069 - protein, 10 aa, Artificial Sequence
  Peptide Derived from Human Papillomavirus
YAVCDKCLKF

SEQ ID NO: 32070 - protein, 11 aa, Artificial Sequence
  Peptide Derived from Human Papillomavirus
YAVCDKCLKFY

SEQ ID NO: 32071 - protein, 8 aa, Artificial Sequence
  Peptide Derived from Human Papillomavirus
YCKQQLLR

SEQ ID NO: 32072 - protein, 9 aa, Artificial Sequence
  Peptide Derived from Human Papillomavirus
YCKQQLLRR

SEQ ID NO: 32073 - protein, 9 aa, Artificial Sequence
  Peptide Derived from Human Papillomavirus
YGTTLEQQY

SEQ ID NO: 32074 - protein, 11 aa, Artificial Sequence
  Peptide Derived from Human Papillomavirus
YGTTLEQQYNK

SEQ ID NO: 32075 - protein, 8 aa, Artificial Sequence
  Peptide Derived from Human Papillomavirus
YSKISEYR

SEQ ID NO: 32076 - protein, 9 aa, Artificial Sequence
  Peptide Derived from Human Papillomavirus
YSKISEYRH

SEQ ID NO: 32077 - protein, 10 aa, Artificial Sequence
  Peptide Derived from Human Papillomavirus
YSKISEYRHY

SEQ ID NO: 32078 - protein, 8 aa, Artificial Sequence
  Peptide Derived from Human Papillomavirus
AGQAEPDR

SEQ ID NO: 32079 - protein, 9 aa, Artificial Sequence
  Peptide Derived from Human Papillomavirus
AGQAEPDRA

SEQ ID NO: 32080 - protein, 10 aa, Artificial Sequence
  Peptide Derived from Human Papillomavirus
AGQAEPDRAH

SEQ ID NO: 32081 - protein, 11 aa, Artificial Sequence
  Peptide Derived from Human Papillomavirus
AGQAEPDRAHY

SEQ ID NO: 32082 - protein, 9 aa, Artificial Sequence
  Peptide Derived from Human Papillomavirus
CCKCDSTLR

SEQ ID NO: 32083 - protein, 10 aa, Artificial Sequence
  Peptide Derived from Human Papillomavirus
CVQSTHVDIR

SEQ ID NO: 32084 - protein, 11 aa, Artificial Sequence
  Peptide Derived from Human Papillomavirus
DGPAGQAEPDR

SEQ ID NO: 32085 - protein, 10 aa, Artificial Sequence
  Peptide Derived from Human Papillomavirus
DLQPETTDLY

SEQ ID NO: 32086 - protein, 8 aa, Artificial Sequence
  Peptide Derived from Human Papillomavirus
DTPTLHEY

SEQ ID NO: 32087 - protein, 8 aa, Artificial Sequence
  Peptide Derived from Human Papillomavirus
EDEIDGPA

SEQ ID NO: 32088 - protein, 11 aa, Artificial Sequence
  Peptide Derived from Human Papillomavirus
EDEIDGPAGQA

SEQ ID NO: 32089 - protein, 9 aa, Artificial Sequence
  Peptide Derived from Human Papillomavirus
EIDGPAGQA

SEQ ID NO: 32090 - protein, 8 aa, Artificial Sequence
  Peptide Derived from Human Papillomavirus
ETTDLYCY

SEQ ID NO: 32091 - protein, 10 aa, Artificial Sequence
  Peptide Derived from Human Papillomavirus
FCCKCDSTLR

SEQ ID NO: 32092 - protein, 9 aa, Artificial Sequence
  Peptide Derived from Human Papillomavirus
GDTPTLHEY

SEQ ID NO: 32093 - protein, 10 aa, Artificial Sequence
  Peptide Derived from Human Papillomavirus
GIVCPICSQK

SEQ ID NO: 32094 - protein, 8 aa, Artificial Sequence
  Peptide Derived from Human Papillomavirus
HGDTPTLH

SEQ ID NO: 32095 - protein, 10 aa, Artificial Sequence
  Peptide Derived from Human Papillomavirus
HGDTPTLHEY

SEQ ID NO: 32096 - protein, 8 aa, Artificial Sequence
  Peptide Derived from Human Papillomavirus
IDGPAGQA

SEQ ID NO: 32097 - protein, 9 aa, Artificial Sequence
  Peptide Derived from Human Papillomavirus
IVCPICSQK

SEQ ID NO: 32098 - protein, 11 aa, Artificial Sequence
  Peptide Derived from Human Papillomavirus
LCVQSTHVDIR

SEQ ID NO: 32099 - protein, 11 aa, Artificial Sequence
  Peptide Derived from Human Papillomavirus
LDLQPETTDLY

SEQ ID NO: 32100 - protein, 11 aa, Artificial Sequence
  Peptide Derived from Human Papillomavirus
LGIVCPICSQK

SEQ ID NO: 32101 - protein, 8 aa, Artificial Sequence
  Peptide Derived from Human Papillomavirus
NIVTFCCK

SEQ ID NO: 32102 - protein, 9 aa, Artificial Sequence
  Peptide Derived from Human Papillomavirus
PAGQAEPDR

SEQ ID NO: 32103 - protein, 10 aa, Artificial Sequence
  Peptide Derived from Human Papillomavirus
PAGQAEPDRA

SEQ ID NO: 32104 - protein, 11 aa, Artificial Sequence
  Peptide Derived from Human Papillomavirus
PAGQAEPDRAH

SEQ ID NO: 32105 - protein, 11 aa, Artificial Sequence
  Peptide Derived from Human Papillomavirus
PDRAHYNIVTF

SEQ ID NO: 32106 - protein, 8 aa, Artificial Sequence
  Peptide Derived from Human Papillomavirus
QAEPDRAH

SEQ ID NO: 32107 - protein, 9 aa, Artificial Sequence
  Peptide Derived from Human Papillomavirus
QAEPDRAHY

SEQ ID NO: 32108 - protein, 8 aa, Artificial Sequence
  Peptide Derived from Human Papillomavirus
QSTHVDIR

SEQ ID NO: 32109 - protein, 9 aa, Artificial Sequence
  Peptide Derived from Human Papillomavirus
RAHYNIVTF

SEQ ID NO: 32110 - protein, 8 aa, Artificial Sequence
  Peptide Derived from Human Papillomavirus
RLCVQSTH

SEQ ID NO: 32111 - protein, 11 aa, Artificial Sequence
  Peptide Derived from Human Papillomavirus
STLRLCVQSTH

SEQ ID NO: 32112 - protein, 11 aa, Artificial Sequence
  Peptide Derived from Human Papillomavirus
TFCCKCDSTLR

SEQ ID NO: 32113 - protein, 10 aa, Artificial Sequence
  Peptide Derived from Human Papillomavirus
TLRLCVQSTH

SEQ ID NO: 32114 - protein, 8 aa, Artificial Sequence
  Peptide Derived from Human Papillomavirus
VCPICSQK

SEQ ID NO: 32115 - protein, 10 aa, Artificial Sequence
  Peptide Derived from Human Papillomavirus
AAISTSETTY

SEQ ID NO: 32116 - protein, 11 aa, Artificial Sequence
  Peptide Derived from Human Papillomavirus
AAISTSETTYK

SEQ ID NO: 32117 - protein, 9 aa, Artificial Sequence
  Peptide Derived from Human Papillomavirus
AANAGVDNR

SEQ ID NO: 32118 - protein, 9 aa, Artificial Sequence
  Peptide Derived from Human Papillomavirus
ACQKHTPPA

SEQ ID NO: 32119 - protein, 11 aa, Artificial Sequence
  Peptide Derived from Human Papillomavirus
ACQKHTPPAPK

SEQ ID NO: 32120 - protein, 9 aa, Artificial Sequence
  Peptide Derived from Human Papillomavirus
ACVGVEVGR

SEQ ID NO: 32121 - protein, 10 aa, Artificial Sequence
  Peptide Derived from Human Papillomavirus
ADLDQFPLGR

SEQ ID NO: 32122 - protein, 11 aa, Artificial Sequence
  Peptide Derived from Human Papillomavirus
ADLDQFPLGRK

SEQ ID NO: 32123 - protein, 8 aa, Artificial Sequence
  Peptide Derived from Human Papillomavirus
ADVMTYIH

SEQ ID NO: 32124 - protein, 8 aa, Artificial Sequence
  Peptide Derived from Human Papillomavirus
AGLKAKPK

SEQ ID NO: 32125 - protein, 9 aa, Artificial Sequence
  Peptide Derived from Human Papillomavirus
AGLKAKPKF

SEQ ID NO: 32126 - protein, 8 aa, Artificial Sequence
  Peptide Derived from Human Papillomavirus
AGTSRLLA

SEQ ID NO: 32127 - protein, 11 aa, Artificial Sequence
  Peptide Derived from Human Papillomavirus
AGTSRLLAVGH

SEQ ID NO: 32128 - protein, 11 aa, Artificial Sequence
  Peptide Derived from Human Papillomavirus
AIACQKHTPPA

SEQ ID NO: 32129 - protein, 9 aa, Artificial Sequence
  Peptide Derived from Human Papillomavirus
AISTSETTY

SEQ ID NO: 32130 - protein, 10 aa, Artificial Sequence
  Peptide Derived from Human Papillomavirus
AISTSETTYK

SEQ ID NO: 32131 - protein, 9 aa, Artificial Sequence
  Peptide Derived from Human Papillomavirus
AMDFTTLQA

SEQ ID NO: 32132 - protein, 11 aa, Artificial Sequence
  Peptide Derived from Human Papillomavirus
AMDFTTLQANK

SEQ ID NO: 32133 - protein, 8 aa, Artificial Sequence
  Peptide Derived from Human Papillomavirus
ASAYAANA

SEQ ID NO: 32134 - protein, 11 aa, Artificial Sequence
  Peptide Derived from Human Papillomavirus
AVGENVPDDLY

SEQ ID NO: 32135 - protein, 10 aa, Artificial Sequence
  Peptide Derived from Human Papillomavirus
AVGHPYFPIK

SEQ ID NO: 32136 - protein, 11 aa, Artificial Sequence
  Peptide Derived from Human Papillomavirus
AVGHPYFPIKK

SEQ ID NO: 32137 - protein, 11 aa, Artificial Sequence
  Peptide Derived from Human Papillomavirus
CAAISTSETTY

SEQ ID NO: 32138 - protein, 10 aa, Artificial Sequence
  Peptide Derived from Human Papillomavirus
CTSICKYPDY

SEQ ID NO: 32139 - protein, 8 aa, Artificial Sequence
  Peptide Derived from Human Papillomavirus
CVGVEVGR

SEQ ID NO: 32140 - protein, 9 aa, Artificial Sequence
  Peptide Derived from Human Papillomavirus
DAQIFNKPY

SEQ ID NO: 32141 - protein, 8 aa, Artificial Sequence
  Peptide Derived from Human Papillomavirus
DDTENASA

SEQ ID NO: 32142 - protein, 9 aa, Artificial Sequence
  Peptide Derived from Human Papillomavirus
DDTENASAY

SEQ ID NO: 32143 - protein, 10 aa, Artificial Sequence
  Peptide Derived from Human Papillomavirus
DDTENASAYA

SEQ ID NO: 32144 - protein, 11 aa, Artificial Sequence
  Peptide Derived from Human Papillomavirus
DDTENASAYAA

SEQ ID NO: 32145 - protein, 9 aa, Artificial Sequence
  Peptide Derived from Human Papillomavirus
DFTTLQANK

SEQ ID NO: 32146 - protein, 9 aa, Artificial Sequence
  Peptide Derived from Human Papillomavirus
DGDMVDTGF

SEQ ID NO: 32147 - protein, 11 aa, Artificial Sequence
  Peptide Derived from Human Papillomavirus
DGDMVDTGFGA

SEQ ID NO: 32148 - protein, 8 aa, Artificial Sequence
  Peptide Derived from Human Papillomavirus
DICTSICK

SEQ ID NO: 32149 - protein, 9 aa, Artificial Sequence
  Peptide Derived from Human Papillomavirus
DICTSICKY

SEQ ID NO: 32150 - protein, 9 aa, Artificial Sequence
  Peptide Derived from Human Papillomavirus
DLDQFPLGR

SEQ ID NO: 32151 - protein, 10 aa, Artificial Sequence
  Peptide Derived from Human Papillomavirus
DLDQFPLGRK

SEQ ID NO: 32152 - protein, 11 aa, Artificial Sequence
  Peptide Derived from Human Papillomavirus
DLDQFPLGRKF

SEQ ID NO: 32153 - protein, 10 aa, Artificial Sequence
  Peptide Derived from Human Papillomavirus
DLQFIFQLCK

SEQ ID NO: 32154 - protein, 11 aa, Artificial Sequence
  Peptide Derived from Human Papillomavirus
DLYIKGSGSTA

SEQ ID NO: 32155 - protein, 9 aa, Artificial Sequence
  Peptide Derived from Human Papillomavirus
DMVDTGFGA

SEQ ID NO: 32156 - protein, 8 aa, Artificial Sequence
  Peptide Derived from Human Papillomavirus
DSLFFYLR

SEQ ID NO: 32157 - protein, 9 aa, Artificial Sequence
  Peptide Derived from Human Papillomavirus
DSLFFYLRR

SEQ ID NO: 32158 - protein, 8 aa, Artificial Sequence
  Peptide Derived from Human Papillomavirus
DTENASAY

SEQ ID NO: 32159 - protein, 9 aa, Artificial Sequence
  Peptide Derived from Human Papillomavirus
DTENASAYA

SEQ ID NO: 32160 - protein, 10 aa, Artificial Sequence
  Peptide Derived from Human Papillomavirus
DTENASAYAA

SEQ ID NO: 32161 - protein, 9 aa, Artificial Sequence
  Peptide Derived from Human Papillomavirus
DTGFGAMDF

SEQ ID NO: 32162 - protein, 8 aa, Artificial Sequence
  Peptide Derived from Human Papillomavirus
DTQRLVWA

SEQ ID NO: 32163 - protein, 11 aa, Artificial Sequence
  Peptide Derived from Human Papillomavirus
DTSFYNPDTQR

SEQ ID NO: 32164 - protein, 10 aa, Artificial Sequence
  Peptide Derived from Human Papillomavirus
DTYRFVTSQA

SEQ ID NO: 32165 - protein, 8 aa, Artificial Sequence
  Peptide Derived from Human Papillomavirus
DVNVYHIF

SEQ ID NO: 32166 - protein, 9 aa, Artificial Sequence
  Peptide Derived from Human Papillomavirus
DVNVYHIFF

SEQ ID NO: 32167 - protein, 8 aa, Artificial Sequence
  Peptide Derived from Human Papillomavirus
ECISMDYK

SEQ ID NO: 32168 - protein, 9 aa, Artificial Sequence
  Peptide Derived from Human Papillomavirus
EDPLKKYTF

SEQ ID NO: 32169 - protein, 11 aa, Artificial Sequence
  Peptide Derived from Human Papillomavirus
EDTYRFVTSQA

SEQ ID NO: 32170 - protein, 9 aa, Artificial Sequence
  Peptide Derived from Human Papillomavirus
ETTYKNTNF

SEQ ID NO: 32171 - protein, 10 aa, Artificial Sequence
  Peptide Derived from Human Papillomavirus
ETTYKNTNFK

SEQ ID NO: 32172 - protein, 8 aa, Artificial Sequence
  Peptide Derived from Human Papillomavirus
EVNLKEKF

SEQ ID NO: 32173 - protein, 10 aa, Artificial Sequence
  Peptide Derived from Human Papillomavirus
EVNLKEKFSA

SEQ ID NO: 32174 - protein, 10 aa, Artificial Sequence
  Peptide Derived from Human Papillomavirus
FFYLRREQMF

SEQ ID NO: 32175 - protein, 11 aa, Artificial Sequence
  Peptide Derived from Human Papillomavirus
FGAMDFTTLQA

SEQ ID NO: 32176 - protein, 8 aa, Artificial Sequence
  Peptide Derived from Human Papillomavirus
FGFPDTSF

SEQ ID NO: 32177 - protein, 9 aa, Artificial Sequence
  Peptide Derived from Human Papillomavirus
FGFPDTSFY

SEQ ID NO: 32178 - protein, 10 aa, Artificial Sequence
  Peptide Derived from Human Papillomavirus
FIYILVITCY

SEQ ID NO: 32179 - protein, 8 aa, Artificial Sequence
  Peptide Derived from Human Papillomavirus
FLLQAGLK

SEQ ID NO: 32180 - protein, 9 aa, Artificial Sequence
  Peptide Derived from Human Papillomavirus
FLLQAGLKA

SEQ ID NO: 32181 - protein, 10 aa, Artificial Sequence
  Peptide Derived from Human Papillomavirus
FLLQAGLKAK

SEQ ID NO: 32182 - protein, 8 aa, Artificial Sequence
  Peptide Derived from Human Papillomavirus
FSADLDQF

SEQ ID NO: 32183 - protein, 8 aa, Artificial Sequence
  Peptide Derived from Human Papillomavirus
FTLGKRKA

SEQ ID NO: 32184 - protein, 8 aa, Artificial Sequence
  Peptide Derived from Human Papillomavirus
FTTLQANK

SEQ ID NO: 32185 - protein, 8 aa, Artificial Sequence
  Peptide Derived from Human Papillomavirus
FVRHLFNR

SEQ ID NO: 32186 - protein, 9 aa, Artificial Sequence
  Peptide Derived from Human Papillomavirus
FVRHLFNRA

SEQ ID NO: 32187 - protein, 11 aa, Artificial Sequence
  Peptide Derived from Human Papillomavirus
FVRHLFNRAGA

SEQ ID NO: 32188 - protein, 8 aa, Artificial Sequence
  Peptide Derived from Human Papillomavirus
FVTSQAIA

SEQ ID NO: 32189 - protein, 11 aa, Artificial Sequence
  Peptide Derived from Human Papillomavirus
FVTSQAIACQK

SEQ ID NO: 32190 - protein, 9 aa, Artificial Sequence
  Peptide Derived from Human Papillomavirus
FVTVVDTTR

SEQ ID NO: 32191 - protein, 10 aa, Artificial Sequence
  Peptide Derived from Human Papillomavirus
GAMDFTTLQA

SEQ ID NO: 32192 - protein, 9 aa, Artificial Sequence
  Peptide Derived from Human Papillomavirus
GCKPPIGEH

SEQ ID NO: 32193 - protein, 8 aa, Artificial Sequence
  Peptide Derived from Human Papillomavirus
GDMVDTGF

SEQ ID NO: 32194 - protein, 10 aa, Artificial Sequence
  Peptide Derived from Human Papillomavirus
GDMVDTGFGA

SEQ ID NO: 32195 - protein, 9 aa, Artificial Sequence
  Peptide Derived from Human Papillomavirus
GDSLFFYLR

SEQ ID NO: 32196 - protein, 10 aa, Artificial Sequence
  Peptide Derived from Human Papillomavirus
GDSLFFYLRR

SEQ ID NO: 32197 - protein, 8 aa, Artificial Sequence
  Peptide Derived from Human Papillomavirus
GFPDTSFY

SEQ ID NO: 32198 - protein, 8 aa, Artificial Sequence
  Peptide Derived from Human Papillomavirus
GGTLEDTY

SEQ ID NO: 32199 - protein, 9 aa, Artificial Sequence
  Peptide Derived from Human Papillomavirus
GGTLEDTYR

SEQ ID NO: 32200 - protein, 10 aa, Artificial Sequence
  Peptide Derived from Human Papillomavirus
GGTLEDTYRF

SEQ ID NO: 32201 - protein, 9 aa, Artificial Sequence
  Peptide Derived from Human Papillomavirus
GICWGNQLF

SEQ ID NO: 32202 - protein, 10 aa, Artificial Sequence
  Peptide Derived from Human Papillomavirus
GISGHPLLNK

SEQ ID NO: 32203 - protein, 8 aa, Artificial Sequence
  Peptide Derived from Human Papillomavirus
GLKAKPKF

SEQ ID NO: 32204 - protein, 8 aa, Artificial Sequence
  Peptide Derived from Human Papillomavirus
GLQYRVFR

SEQ ID NO: 32205 - protein, 10 aa, Artificial Sequence
  Peptide Derived from Human Papillomavirus
GLQYRVFRIH

SEQ ID NO: 32206 - protein, 9 aa, Artificial Sequence
  Peptide Derived from Human Papillomavirus
GSGSTANLA

SEQ ID NO: 32207 - protein, 8 aa, Artificial Sequence
  Peptide Derived from Human Papillomavirus
GSMVTSDA

SEQ ID NO: 32208 - protein, 11 aa, Artificial Sequence
  Peptide Derived from Human Papillomavirus
GSMVTSDAQIF

SEQ ID NO: 32209 - protein, 8 aa, Artificial Sequence
  Peptide Derived from Human Papillomavirus
GSPCTNVA

SEQ ID NO: 32210 - protein, 11 aa, Artificial Sequence
  Peptide Derived from Human Papillomavirus
GSTANLASSNY

SEQ ID NO: 32211 - protein, 8 aa, Artificial Sequence
  Peptide Derived from Human Papillomavirus
GTLEDTYR

SEQ ID NO: 32212 - protein, 9 aa, Artificial Sequence
  Peptide Derived from Human Papillomavirus
GTLEDTYRF

SEQ ID NO: 32213 - protein, 10 aa, Artificial Sequence
  Peptide Derived from Human Papillomavirus
GTSRLLAVGH

SEQ ID NO: 32214 - protein, 9 aa, Artificial Sequence
  Peptide Derived from Human Papillomavirus
HAGTSRLLA

SEQ ID NO: 32215 - protein, 9 aa, Artificial Sequence
  Peptide Derived from Human Papillomavirus
HGEEYDLQF

SEQ ID NO: 32216 - protein, 11 aa, Artificial Sequence
  Peptide Derived from Human Papillomavirus
HGEEYDLQFIF

SEQ ID NO: 32217 - protein, 8 aa, Artificial Sequence
  Peptide Derived from Human Papillomavirus
HLFNRAGA

SEQ ID NO: 32218 - protein, 8 aa, Artificial Sequence
  Peptide Derived from Human Papillomavirus
HLPDPNKF

SEQ ID NO: 32219 - protein, 10 aa, Artificial Sequence
  Peptide Derived from Human Papillomavirus
HLPDPNKFGF

SEQ ID NO: 32220 - protein, 10 aa, Artificial Sequence
  Peptide Derived from Human Papillomavirus
IACQKHTPPA

SEQ ID NO: 32221 - protein, 9 aa, Artificial Sequence
  Peptide Derived from Human Papillomavirus
ICKYPDYIK

SEQ ID NO: 32222 - protein, 8 aa, Artificial Sequence
  Peptide Derived from Human Papillomavirus
ICTSICKY

SEQ ID NO: 32223 - protein, 11 aa, Artificial Sequence
  Peptide Derived from Human Papillomavirus
ICTSICKYPDY

SEQ ID NO: 32224 - protein, 8 aa, Artificial Sequence
  Peptide Derived from Human Papillomavirus
ICWGNQLF

SEQ ID NO: 32225 - protein, 10 aa, Artificial Sequence
  Peptide Derived from Human Papillomavirus
IFNKPYWLQR

SEQ ID NO: 32226 - protein, 11 aa, Artificial Sequence
  Peptide Derived from Human Papillomavirus
IFNKPYWLQRA

SEQ ID NO: 32227 - protein, 11 aa, Artificial Sequence
  Peptide Derived from Human Papillomavirus
IFQLCKITLTA

SEQ ID NO: 32228 - protein, 10 aa, Artificial Sequence
  Peptide Derived from Human Papillomavirus
IGCKPPIGEH

SEQ ID NO: 32229 - protein, 11 aa, Artificial Sequence
  Peptide Derived from Human Papillomavirus
ILVPKVSGLQY

SEQ ID NO: 32230 - protein, 9 aa, Artificial Sequence
  Peptide Derived from Human Papillomavirus
ISGHPLLNK

SEQ ID NO: 32231 - protein, 8 aa, Artificial Sequence
  Peptide Derived from Human Papillomavirus
ISTSETTY

SEQ ID NO: 32232 - protein, 9 aa, Artificial Sequence
  Peptide Derived from Human Papillomavirus
ISTSETTYK

SEQ ID NO: 32233 - protein, 11 aa, Artificial Sequence
  Peptide Derived from Human Papillomavirus
ITCYENDVNVY

SEQ ID NO: 32234 - protein, 10 aa, Artificial Sequence
  Peptide Derived from Human Papillomavirus
ITLTADVMTY

SEQ ID NO: 32235 - protein, 10 aa, Artificial Sequence
  Peptide Derived from Human Papillomavirus
KAKPKFTLGK

SEQ ID NO: 32236 - protein, 11 aa, Artificial Sequence
  Peptide Derived from Human Papillomavirus
KAKPKFTLGKR

SEQ ID NO: 32237 - protein, 9 aa, Artificial Sequence
  Peptide Derived from Human Papillomavirus
KFGFPDTSF

SEQ ID NO: 32238 - protein, 10 aa, Artificial Sequence
  Peptide Derived from Human Papillomavirus
KFGFPDTSFY

SEQ ID NO: 32239 - protein, 9 aa, Artificial Sequence
  Peptide Derived from Human Papillomavirus
KFLLQAGLK

SEQ ID NO: 32240 - protein, 10 aa, Artificial Sequence
  Peptide Derived from Human Papillomavirus
KFLLQAGLKA

SEQ ID NO: 32241 - protein, 11 aa, Artificial Sequence
  Peptide Derived from Human Papillomavirus
KFLLQAGLKAK

SEQ ID NO: 32242 - protein, 9 aa, Artificial Sequence
  Peptide Derived from Human Papillomavirus
KFSADLDQF

SEQ ID NO: 32243 - protein, 8 aa, Artificial Sequence
  Peptide Derived from Human Papillomavirus
KFTLGKRK

SEQ ID NO: 32244 - protein, 9 aa, Artificial Sequence
  Peptide Derived from Human Papillomavirus
KFTLGKRKA

SEQ ID NO: 32245 - protein, 10 aa, Artificial Sequence
  Peptide Derived from Human Papillomavirus
KGSGSTANLA

SEQ ID NO: 32246 - protein, 9 aa, Artificial Sequence
  Peptide Derived from Human Papillomavirus
KGSPCTNVA

SEQ ID NO: 32247 - protein, 11 aa, Artificial Sequence
  Peptide Derived from Human Papillomavirus
KITLTADVMTY

SEQ ID NO: 32248 - protein, 8 aa, Artificial Sequence
  Peptide Derived from Human Papillomavirus
KLDDTENA

SEQ ID NO: 32249 - protein, 10 aa, Artificial Sequence
  Peptide Derived from Human Papillomavirus
KLDDTENASA

SEQ ID NO: 32250 - protein, 11 aa, Artificial Sequence
  Peptide Derived from Human Papillomavirus
KLDDTENASAY

SEQ ID NO: 32251 - protein, 8 aa, Artificial Sequence
  Peptide Derived from Human Papillomavirus
KVSGLQYR

SEQ ID NO: 32252 - protein, 10 aa, Artificial Sequence
  Peptide Derived from Human Papillomavirus
KVSGLQYRVF

SEQ ID NO: 32253 - protein, 11 aa, Artificial Sequence
  Peptide Derived from Human Papillomavirus
KVSGLQYRVFR

SEQ ID NO: 32254 - protein, 8 aa, Artificial Sequence
  Peptide Derived from Human Papillomavirus
KVVSTDEY

SEQ ID NO: 32255 - protein, 10 aa, Artificial Sequence
  Peptide Derived from Human Papillomavirus
KVVSTDEYVA

SEQ ID NO: 32256 - protein, 11 aa, Artificial Sequence
  Peptide Derived from Human Papillomavirus
KVVSTDEYVAR

SEQ ID NO: 32257 - protein, 8 aa, Artificial Sequence
  Peptide Derived from Human Papillomavirus
LAVGHPYF

SEQ ID NO: 32258 - protein, 11 aa, Artificial Sequence
  Peptide Derived from Human Papillomavirus
LAVGHPYFPIK

SEQ ID NO: 32259 - protein, 8 aa, Artificial Sequence
  Peptide Derived from Human Papillomavirus
LCKITLTA

SEQ ID NO: 32260 - protein, 9 aa, Artificial Sequence
  Peptide Derived from Human Papillomavirus
LDDTENASA

SEQ ID NO: 32261 - protein, 10 aa, Artificial Sequence
  Peptide Derived from Human Papillomavirus
LDDTENASAY

SEQ ID NO: 32262 - protein, 11 aa, Artificial Sequence
  Peptide Derived from Human Papillomavirus
LDDTENASAYA

SEQ ID NO: 32263 - protein, 9 aa, Artificial Sequence
  Peptide Derived from Human Papillomavirus
LDICTSICK

SEQ ID NO: 32264 - protein, 10 aa, Artificial Sequence
  Peptide Derived from Human Papillomavirus
LDICTSICKY

SEQ ID NO: 32265 - protein, 8 aa, Artificial Sequence
  Peptide Derived from Human Papillomavirus
LDQFPLGR

SEQ ID NO: 32266 - protein, 9 aa, Artificial Sequence
  Peptide Derived from Human Papillomavirus
LDQFPLGRK

SEQ ID NO: 32267 - protein, 10 aa, Artificial Sequence
  Peptide Derived from Human Papillomavirus
LDQFPLGRKF

SEQ ID NO: 32268 - protein, 11 aa, Artificial Sequence
  Peptide Derived from Human Papillomavirus
LFFYLRREQMF

SEQ ID NO: 32269 - protein, 10 aa, Artificial Sequence
  Peptide Derived from Human Papillomavirus
LFVTVVDTTR

SEQ ID NO: 32270 - protein, 9 aa, Artificial Sequence
  Peptide Derived from Human Papillomavirus
LGRKFLLQA

SEQ ID NO: 32271 - protein, 8 aa, Artificial Sequence
  Peptide Derived from Human Papillomavirus
LGVGISGH

SEQ ID NO: 32272 - protein, 11 aa, Artificial Sequence
  Peptide Derived from Human Papillomavirus
LIGCKPPIGEH

SEQ ID NO: 32273 - protein, 8 aa, Artificial Sequence
  Peptide Derived from Human Papillomavirus
LLAVGHPY

SEQ ID NO: 32274 - protein, 9 aa, Artificial Sequence
  Peptide Derived from Human Papillomavirus
LLAVGHPYF

SEQ ID NO: 32275 - protein, 11 aa, Artificial Sequence
  Peptide Derived from Human Papillomavirus
LLNKLDDTENA

SEQ ID NO: 32276 - protein, 8 aa, Artificial Sequence
  Peptide Derived from Human Papillomavirus
LLQAGLKA

SEQ ID NO: 32277 - protein, 9 aa, Artificial Sequence
  Peptide Derived from Human Papillomavirus
LLQAGLKAK

SEQ ID NO: 32278 - protein, 11 aa, Artificial Sequence
  Peptide Derived from Human Papillomavirus
LLQAGLKAKPK

SEQ ID NO: 32279 - protein, 8 aa, Artificial Sequence
  Peptide Derived from Human Papillomavirus
LTADVMTY

SEQ ID NO: 32280 - protein, 10 aa, Artificial Sequence
  Peptide Derived from Human Papillomavirus
LTADVMTYIH

SEQ ID NO: 32281 - protein, 10 aa, Artificial Sequence
  Peptide Derived from Human Papillomavirus
LVPKVSGLQY

SEQ ID NO: 32282 - protein, 11 aa, Artificial Sequence
  Peptide Derived from Human Papillomavirus
LVPKVSGLQYR

SEQ ID NO: 32283 - protein, 8 aa, Artificial Sequence
  Peptide Derived from Human Papillomavirus
MDFTTLQA

SEQ ID NO: 32284 - protein, 10 aa, Artificial Sequence
  Peptide Derived from Human Papillomavirus
MDFTTLQANK

SEQ ID NO: 32285 - protein, 9 aa, Artificial Sequence
  Peptide Derived from Human Papillomavirus
MFVRHLFNR

SEQ ID NO: 32286 - protein, 10 aa, Artificial Sequence
  Peptide Derived from Human Papillomavirus
MFVRHLFNRA

SEQ ID NO: 32287 - protein, 9 aa, Artificial Sequence
  Peptide Derived from Human Papillomavirus
MSLWLPSEA

SEQ ID NO: 32288 - protein, 8 aa, Artificial Sequence
  Peptide Derived from Human Papillomavirus
MVDTGFGA

SEQ ID NO: 32289 - protein, 11 aa, Artificial Sequence
  Peptide Derived from Human Papillomavirus
MVDTGFGAMDF

SEQ ID NO: 32290 - protein, 11 aa, Artificial Sequence
  Peptide Derived from Human Papillomavirus
MVSEPYGDSLF

SEQ ID NO: 32291 - protein, 9 aa, Artificial Sequence
  Peptide Derived from Human Papillomavirus
MVTSDAQIF

SEQ ID NO: 32292 - protein, 11 aa, Artificial Sequence
  Peptide Derived from Human Papillomavirus
MVTSDAQIFNK

SEQ ID NO: 32293 - protein, 9 aa, Artificial Sequence
  Peptide Derived from Human Papillomavirus
NASAYAANA

SEQ ID NO: 32294 - protein, 9 aa, Artificial Sequence
  Peptide Derived from Human Papillomavirus
NDVNVYHIF

SEQ ID NO: 32295 - protein, 10 aa, Artificial Sequence
  Peptide Derived from Human Papillomavirus
NDVNVYHIFF

SEQ ID NO: 32296 - protein, 8 aa, Artificial Sequence
  Peptide Derived from Human Papillomavirus
NFKEYLRH

SEQ ID NO: 32297 - protein, 10 aa, Artificial Sequence
  Peptide Derived from Human Papillomavirus
NGICWGNQLF

SEQ ID NO: 32298 - protein, 10 aa, Artificial Sequence
  Peptide Derived from Human Papillomavirus
NIYYHAGTSR

SEQ ID NO: 32299 - protein, 8 aa, Artificial Sequence
  Peptide Derived from Human Papillomavirus
NLASSNYF

SEQ ID NO: 32300 - protein, 8 aa, Artificial Sequence
  Peptide Derived from Human Papillomavirus
NLKEKFSA

SEQ ID NO: 32301 - protein, 10 aa, Artificial Sequence
  Peptide Derived from Human Papillomavirus
NSTILEDWNF

SEQ ID NO: 32302 - protein, 9 aa, Artificial Sequence
  Peptide Derived from Human Papillomavirus
NTNFKEYLR

SEQ ID NO: 32303 - protein, 10 aa, Artificial Sequence
  Peptide Derived from Human Papillomavirus
NTNFKEYLRH

SEQ ID NO: 32304 - protein, 9 aa, Artificial Sequence
  Peptide Derived from Human Papillomavirus
NVPDDLYIK

SEQ ID NO: 32305 - protein, 9 aa, Artificial Sequence
  Peptide Derived from Human Papillomavirus
PAPKEDPLK

SEQ ID NO: 32306 - protein, 10 aa, Artificial Sequence
  Peptide Derived from Human Papillomavirus
PAPKEDPLKK

SEQ ID NO: 32307 - protein, 11 aa, Artificial Sequence
  Peptide Derived from Human Papillomavirus
PAPKEDPLKKY

SEQ ID NO: 32308 - protein, 8 aa, Artificial Sequence
  Peptide Derived from Human Papillomavirus
PDPNKFGF

SEQ ID NO: 32309 - protein, 9 aa, Artificial Sequence
  Peptide Derived from Human Papillomavirus
PDTQRLVWA

SEQ ID NO: 32310 - protein, 11 aa, Artificial Sequence
  Peptide Derived from Human Papillomavirus
PDYIKMVSEPY

SEQ ID NO: 32311 - protein, 9 aa, Artificial Sequence
  Peptide Derived from Human Papillomavirus
PGGTLEDTY

SEQ ID NO: 32312 - protein, 10 aa, Artificial Sequence
  Peptide Derived from Human Papillomavirus
PGGTLEDTYR

SEQ ID NO: 32313 - protein, 11 aa, Artificial Sequence
  Peptide Derived from Human Papillomavirus
PGGTLEDTYRF

SEQ ID NO: 32314 - protein, 8 aa, Artificial Sequence
  Peptide Derived from Human Papillomavirus
PIGEHWGK

SEQ ID NO: 32315 - protein, 9 aa, Artificial Sequence
  Peptide Derived from Human Papillomavirus
PIKKPNNNK

SEQ ID NO: 32316 - protein, 10 aa, Artificial Sequence
  Peptide Derived from Human Papillomavirus
PLDICTSICK

SEQ ID NO: 32317 - protein, 11 aa, Artificial Sequence
  Peptide Derived from Human Papillomavirus
PLDICTSICKY

SEQ ID NO: 32318 - protein, 10 aa, Artificial Sequence
  Peptide Derived from Human Papillomavirus
PLGRKFLLQA

SEQ ID NO: 32319 - protein, 9 aa, Artificial Sequence
  Peptide Derived from Human Papillomavirus
PLGVGISGH

SEQ ID NO: 32320 - protein, 10 aa, Artificial Sequence
  Peptide Derived from Human Papillomavirus
PSGSMVTSDA

SEQ ID NO: 32321 - protein, 10 aa, Artificial Sequence
  Peptide Derived from Human Papillomavirus
PTTSSTSTTA

SEQ ID NO: 32322 - protein, 11 aa, Artificial Sequence
  Peptide Derived from Human Papillomavirus
PTTSSTSTTAK

SEQ ID NO: 32323 - protein, 11 aa, Artificial Sequence
  Peptide Derived from Human Papillomavirus
PVSKVVSTDEY

SEQ ID NO: 32324 - protein, 9 aa, Artificial Sequence
  Peptide Derived from Human Papillomavirus
QAGLKAKPK

SEQ ID NO: 32325 - protein, 10 aa, Artificial Sequence
  Peptide Derived from Human Papillomavirus
QAGLKAKPKF

SEQ ID NO: 32326 - protein, 8 aa, Artificial Sequence
  Peptide Derived from Human Papillomavirus
QAIACQKH

SEQ ID NO: 32327 - protein, 10 aa, Artificial Sequence
  Peptide Derived from Human Papillomavirus
QDGDMVDTGF

SEQ ID NO: 32328 - protein, 8 aa, Artificial Sequence
  Peptide Derived from Human Papillomavirus
QFIFQLCK

SEQ ID NO: 32329 - protein, 8 aa, Artificial Sequence
  Peptide Derived from Human Papillomavirus
QFPLGRKF

SEQ ID NO: 32330 - protein, 11 aa, Artificial Sequence
  Peptide Derived from Human Papillomavirus
QIFNKPYWLQR

SEQ ID NO: 32331 - protein, 9 aa, Artificial Sequence
  Peptide Derived from Human Papillomavirus
QLCKITLTA

SEQ ID NO: 32332 - protein, 8 aa, Artificial Sequence
  Peptide Derived from Human Papillomavirus
QLCLIGCK

SEQ ID NO: 32333 - protein, 11 aa, Artificial Sequence
  Peptide Derived from Human Papillomavirus
QLFVTVVDTTR

SEQ ID NO: 32334 - protein, 8 aa, Artificial Sequence
  Peptide Derived from Human Papillomavirus
QMFVRHLF

SEQ ID NO: 32335 - protein, 10 aa, Artificial Sequence
  Peptide Derived from Human Papillomavirus
QMFVRHLFNR

SEQ ID NO: 32336 - protein, 11 aa, Artificial Sequence
  Peptide Derived from Human Papillomavirus
QMFVRHLFNRA

SEQ ID NO: 32337 - protein, 10 aa, Artificial Sequence
  Peptide Derived from Human Papillomavirus
QMSLWLPSEA

SEQ ID NO: 32338 - protein, 10 aa, Artificial Sequence
  Peptide Derived from Human Papillomavirus
QTQLCLIGCK

SEQ ID NO: 32339 - protein, 9 aa, Artificial Sequence
  Peptide Derived from Human Papillomavirus
RFVTSQAIA

SEQ ID NO: 32340 - protein, 9 aa, Artificial Sequence
  Peptide Derived from Human Papillomavirus
RIHLPDPNK

SEQ ID NO: 32341 - protein, 10 aa, Artificial Sequence
  Peptide Derived from Human Papillomavirus
RIHLPDPNKF

SEQ ID NO: 32342 - protein, 9 aa, Artificial Sequence
  Peptide Derived from Human Papillomavirus
RLLAVGHPY

SEQ ID NO: 32343 - protein, 10 aa, Artificial Sequence
  Peptide Derived from Human Papillomavirus
RLLAVGHPYF

SEQ ID NO: 32344 - protein, 9 aa, Artificial Sequence
  Peptide Derived from Human Papillomavirus
RSTNMSLCA

SEQ ID NO: 32345 - protein, 10 aa, Artificial Sequence
  Peptide Derived from Human Papillomavirus
RSTNMSLCAA

SEQ ID NO: 32346 - protein, 8 aa, Artificial Sequence
  Peptide Derived from Human Papillomavirus
RTNIYYHA

SEQ ID NO: 32347 - protein, 11 aa, Artificial Sequence
  Peptide Derived from Human Papillomavirus
SADLDQFPLGR

SEQ ID NO: 32348 - protein, 8 aa, Artificial Sequence
  Peptide Derived from Human Papillomavirus
SDAQIFNK

SEQ ID NO: 32349 - protein, 10 aa, Artificial Sequence
  Peptide Derived from Human Papillomavirus
SDAQIFNKPY

SEQ ID NO: 32350 - protein, 9 aa, Artificial Sequence
  Peptide Derived from Human Papillomavirus
SFYNPDTQR

SEQ ID NO: 32351 - protein, 8 aa, Artificial Sequence
  Peptide Derived from Human Papillomavirus
SGHPLLNK

SEQ ID NO: 32352 - protein, 8 aa, Artificial Sequence
  Peptide Derived from Human Papillomavirus
SGLQYRVF

SEQ ID NO: 32353 - protein, 9 aa, Artificial Sequence
  Peptide Derived from Human Papillomavirus
SGLQYRVFR

SEQ ID NO: 32354 - protein, 11 aa, Artificial Sequence
  Peptide Derived from Human Papillomavirus
SGLQYRVFRIH

SEQ ID NO: 32355 - protein, 9 aa, Artificial Sequence
  Peptide Derived from Human Papillomavirus
SGSMVTSDA

SEQ ID NO: 32356 - protein, 8 aa, Artificial Sequence
  Peptide Derived from Human Papillomavirus
SGSTANLA

SEQ ID NO: 32357 - protein, 8 aa, Artificial Sequence
  Peptide Derived from Human Papillomavirus
SICKYPDY

SEQ ID NO: 32358 - protein, 10 aa, Artificial Sequence
  Peptide Derived from Human Papillomavirus
SICKYPDYIK

SEQ ID NO: 32359 - protein, 8 aa, Artificial Sequence
  Peptide Derived from Human Papillomavirus
SLFFYLRR

SEQ ID NO: 32360 - protein, 8 aa, Artificial Sequence
  Peptide Derived from Human Papillomavirus
SLWLPSEA

SEQ ID NO: 32361 - protein, 11 aa, Artificial Sequence
  Peptide Derived from Human Papillomavirus
SLWLPSEATVY

SEQ ID NO: 32362 - protein, 10 aa, Artificial Sequence
  Peptide Derived from Human Papillomavirus
SMVTSDAQIF

SEQ ID NO: 32363 - protein, 8 aa, Artificial Sequence
  Peptide Derived from Human Papillomavirus
SSTSTTAK

SEQ ID NO: 32364 - protein, 9 aa, Artificial Sequence
  Peptide Derived from Human Papillomavirus
SSTSTTAKR

SEQ ID NO: 32365 - protein, 10 aa, Artificial Sequence
  Peptide Derived from Human Papillomavirus
SSTSTTAKRK

SEQ ID NO: 32366 - protein, 11 aa, Artificial Sequence
  Peptide Derived from Human Papillomavirus
SSTSTTAKRKK

SEQ ID NO: 32367 - protein, 10 aa, Artificial Sequence
  Peptide Derived from Human Papillomavirus
STANLASSNY

SEQ ID NO: 32368 - protein, 11 aa, Artificial Sequence
  Peptide Derived from Human Papillomavirus
STANLASSNYF

SEQ ID NO: 32369 - protein, 8 aa, Artificial Sequence
  Peptide Derived from Human Papillomavirus
STDEYVAR

SEQ ID NO: 32370 - protein, 9 aa, Artificial Sequence
  Peptide Derived from Human Papillomavirus
STILEDWNF

SEQ ID NO: 32371 - protein, 8 aa, Artificial Sequence
  Peptide Derived from Human Papillomavirus
STNMSLCA

SEQ ID NO: 32372 - protein, 9 aa, Artificial Sequence
  Peptide Derived from Human Papillomavirus
STNMSLCAA

SEQ ID NO: 32373 - protein, 8 aa, Artificial Sequence
  Peptide Derived from Human Papillomavirus
STSETTYK

SEQ ID NO: 32374 - protein, 8 aa, Artificial Sequence
  Peptide Derived from Human Papillomavirus
STSTTAKR

SEQ ID NO: 32375 - protein, 9 aa, Artificial Sequence
  Peptide Derived from Human Papillomavirus
STSTTAKRK

SEQ ID NO: 32376 - protein, 10 aa, Artificial Sequence
  Peptide Derived from Human Papillomavirus
STSTTAKRKK

SEQ ID NO: 32377 - protein, 11 aa, Artificial Sequence
  Peptide Derived from Human Papillomavirus
STSTTAKRKKR

SEQ ID NO: 32378 - protein, 8 aa, Artificial Sequence
  Peptide Derived from Human Papillomavirus
STTAKRKK

SEQ ID NO: 32379 - protein, 9 aa, Artificial Sequence
  Peptide Derived from Human Papillomavirus
STTAKRKKR

SEQ ID NO: 32380 - protein, 10 aa, Artificial Sequence
  Peptide Derived from Human Papillomavirus
STTAKRKKRK

SEQ ID NO: 32381 - protein, 9 aa, Artificial Sequence
  Peptide Derived from Human Papillomavirus
TADVMTYIH

SEQ ID NO: 32382 - protein, 8 aa, Artificial Sequence
  Peptide Derived from Human Papillomavirus
TAKRKKRK

SEQ ID NO: 32383 - protein, 9 aa, Artificial Sequence
  Peptide Derived from Human Papillomavirus
TANLASSNY

SEQ ID NO: 32384 - protein, 10 aa, Artificial Sequence
  Peptide Derived from Human Papillomavirus
TANLASSNYF

SEQ ID NO: 32385 - protein, 10 aa, Artificial Sequence
  Peptide Derived from Human Papillomavirus
TCYENDVNVY

SEQ ID NO: 32386 - protein, 11 aa, Artificial Sequence
  Peptide Derived from Human Papillomavirus
TCYENDVNVYH

SEQ ID NO: 32387 - protein, 11 aa, Artificial Sequence
  Peptide Derived from Human Papillomavirus
TDEYVARTNIY

SEQ ID NO: 32388 - protein, 11 aa, Artificial Sequence
  Peptide Derived from Human Papillomavirus
TFIYILVITCY

SEQ ID NO: 32389 - protein, 8 aa, Artificial Sequence
  Peptide Derived from Human Papillomavirus
TFWEVNLK

SEQ ID NO: 32390 - protein, 10 aa, Artificial Sequence
  Peptide Derived from Human Papillomavirus
TFWEVNLKEK

SEQ ID NO: 32391 - protein, 11 aa, Artificial Sequence
  Peptide Derived from Human Papillomavirus
TFWEVNLKEKF

SEQ ID NO: 32392 - protein, 8 aa, Artificial Sequence
  Peptide Derived from Human Papillomavirus
TGFGAMDF

SEQ ID NO: 32393 - protein, 8 aa, Artificial Sequence
  Peptide Derived from Human Papillomavirus
TILEDWNF

SEQ ID NO: 32394 - protein, 8 aa, Artificial Sequence
  Peptide Derived from Human Papillomavirus
TLEDTYRF

SEQ ID NO: 32395 - protein, 9 aa, Artificial Sequence
  Peptide Derived from Human Papillomavirus
TLTADVMTY

SEQ ID NO: 32396 - protein, 11 aa, Artificial Sequence
  Peptide Derived from Human Papillomavirus
TLTADVMTYIH

SEQ ID NO: 32397 - protein, 9 aa, Artificial Sequence
  Peptide Derived from Human Papillomavirus
TSDAQIFNK

SEQ ID NO: 32398 - protein, 11 aa, Artificial Sequence
  Peptide Derived from Human Papillomavirus
TSDAQIFNKPY

SEQ ID NO: 32399 - protein, 11 aa, Artificial Sequence
  Peptide Derived from Human Papillomavirus
TSETTYKNTNF

SEQ ID NO: 32400 - protein, 10 aa, Artificial Sequence
  Peptide Derived from Human Papillomavirus
TSFYNPDTQR

SEQ ID NO: 32401 - protein, 9 aa, Artificial Sequence
  Peptide Derived from Human Papillomavirus
TSICKYPDY

SEQ ID NO: 32402 - protein, 11 aa, Artificial Sequence
  Peptide Derived from Human Papillomavirus
TSICKYPDYIK

SEQ ID NO: 32403 - protein, 9 aa, Artificial Sequence
  Peptide Derived from Human Papillomavirus
TSQAIACQK

SEQ ID NO: 32404 - protein, 10 aa, Artificial Sequence
  Peptide Derived from Human Papillomavirus
TSQAIACQKH

SEQ ID NO: 32405 - protein, 9 aa, Artificial Sequence
  Peptide Derived from Human Papillomavirus
TSRLLAVGH

SEQ ID NO: 32406 - protein, 11 aa, Artificial Sequence
  Peptide Derived from Human Papillomavirus
TSRLLAVGHPY

SEQ ID NO: 32407 - protein, 8 aa, Artificial Sequence
  Peptide Derived from Human Papillomavirus
TSSTSTTA

SEQ ID NO: 32408 - protein, 9 aa, Artificial Sequence
  Peptide Derived from Human Papillomavirus
TSSTSTTAK

SEQ ID NO: 32409 - protein, 10 aa, Artificial Sequence
  Peptide Derived from Human Papillomavirus
TSSTSTTAKR

SEQ ID NO: 32410 - protein, 11 aa, Artificial Sequence
  Peptide Derived from Human Papillomavirus
TSSTSTTAKRK

SEQ ID NO: 32411 - protein, 8 aa, Artificial Sequence
  Peptide Derived from Human Papillomavirus
TSTTAKRK

SEQ ID NO: 32412 - protein, 9 aa, Artificial Sequence
  Peptide Derived from Human Papillomavirus
TSTTAKRKK

SEQ ID NO: 32413 - protein, 10 aa, Artificial Sequence
  Peptide Derived from Human Papillomavirus
TSTTAKRKKR

SEQ ID NO: 32414 - protein, 11 aa, Artificial Sequence
  Peptide Derived from Human Papillomavirus
TSTTAKRKKRK

SEQ ID NO: 32415 - protein, 8 aa, Artificial Sequence
  Peptide Derived from Human Papillomavirus
TTAKRKKR

SEQ ID NO: 32416 - protein, 9 aa, Artificial Sequence
  Peptide Derived from Human Papillomavirus
TTAKRKKRK

SEQ ID NO: 32417 - protein, 11 aa, Artificial Sequence
  Peptide Derived from Human Papillomavirus
TTRSTNMSLCA

SEQ ID NO: 32418 - protein, 9 aa, Artificial Sequence
  Peptide Derived from Human Papillomavirus
TTSSTSTTA

SEQ ID NO: 32419 - protein, 10 aa, Artificial Sequence
  Peptide Derived from Human Papillomavirus
TTSSTSTTAK

SEQ ID NO: 32420 - protein, 11 aa, Artificial Sequence
  Peptide Derived from Human Papillomavirus
TTSSTSTTAKR

SEQ ID NO: 32421 - protein, 8 aa, Artificial Sequence
  Peptide Derived from Human Papillomavirus
TTYKNTNF

SEQ ID NO: 32422 - protein, 9 aa, Artificial Sequence
  Peptide Derived from Human Papillomavirus
TTYKNTNFK

SEQ ID NO: 32423 - protein, 11 aa, Artificial Sequence
  Peptide Derived from Human Papillomavirus
TTYKNTNFKEY

SEQ ID NO: 32424 - protein, 11 aa, Artificial Sequence
  Peptide Derived from Human Papillomavirus
TVYLPPVPVSK

SEQ ID NO: 32425 - protein, 8 aa, Artificial Sequence
  Peptide Derived from Human Papillomavirus
VARTNIYY

SEQ ID NO: 32426 - protein, 9 aa, Artificial Sequence
  Peptide Derived from Human Papillomavirus
VARTNIYYH

SEQ ID NO: 32427 - protein, 10 aa, Artificial Sequence
  Peptide Derived from Human Papillomavirus
VARTNIYYHA

SEQ ID NO: 32428 - protein, 11 aa, Artificial Sequence
  Peptide Derived from Human Papillomavirus
VDNRECISMDY

SEQ ID NO: 32429 - protein, 10 aa, Artificial Sequence
  Peptide Derived from Human Papillomavirus
VDTGFGAMDF

SEQ ID NO: 32430 - protein, 11 aa, Artificial Sequence
  Peptide Derived from Human Papillomavirus
VFRIHLPDPNK

SEQ ID NO: 32431 - protein, 10 aa, Artificial Sequence
  Peptide Derived from Human Papillomavirus
VGENVPDDLY

SEQ ID NO: 32432 - protein, 9 aa, Artificial Sequence
  Peptide Derived from Human Papillomavirus
VGHPYFPIK

SEQ ID NO: 32433 - protein, 10 aa, Artificial Sequence
  Peptide Derived from Human Papillomavirus
VGHPYFPIKK

SEQ ID NO: 32434 - protein, 11 aa, Artificial Sequence
  Peptide Derived from Human Papillomavirus
VGISGHPLLNK

SEQ ID NO: 32435 - protein, 10 aa, Artificial Sequence
  Peptide Derived from Human Papillomavirus
VSEPYGDSLF

SEQ ID NO: 32436 - protein, 11 aa, Artificial Sequence
  Peptide Derived from Human Papillomavirus
VSEPYGDSLFF

SEQ ID NO: 32437 - protein, 9 aa, Artificial Sequence
  Peptide Derived from Human Papillomavirus
VSGLQYRVF

SEQ ID NO: 32438 - protein, 10 aa, Artificial Sequence
  Peptide Derived from Human Papillomavirus
VSGLQYRVFR

SEQ ID NO: 32439 - protein, 10 aa, Artificial Sequence
  Peptide Derived from Human Papillomavirus
VSKVVSTDEY

SEQ ID NO: 32440 - protein, 8 aa, Artificial Sequence
  Peptide Derived from Human Papillomavirus
VSTDEYVA

SEQ ID NO: 32441 - protein, 9 aa, Artificial Sequence
  Peptide Derived from Human Papillomavirus
VSTDEYVAR

SEQ ID NO: 32442 - protein, 8 aa, Artificial Sequence
  Peptide Derived from Human Papillomavirus
VTSDAQIF

SEQ ID NO: 32443 - protein, 10 aa, Artificial Sequence
  Peptide Derived from Human Papillomavirus
VTSDAQIFNK

SEQ ID NO: 32444 - protein, 10 aa, Artificial Sequence
  Peptide Derived from Human Papillomavirus
VTSQAIACQK

SEQ ID NO: 32445 - protein, 11 aa, Artificial Sequence
  Peptide Derived from Human Papillomavirus
VTSQAIACQKH

SEQ ID NO: 32446 - protein, 8 aa, Artificial Sequence
  Peptide Derived from Human Papillomavirus
VTVVDTTR

SEQ ID NO: 32447 - protein, 9 aa, Artificial Sequence
  Peptide Derived from Human Papillomavirus
VVSTDEYVA

SEQ ID NO: 32448 - protein, 10 aa, Artificial Sequence
  Peptide Derived from Human Papillomavirus
VVSTDEYVAR

SEQ ID NO: 32449 - protein, 10 aa, Artificial Sequence
  Peptide Derived from Human Papillomavirus
WACVGVEVGR

SEQ ID NO: 32450 - protein, 11 aa, Artificial Sequence
  Peptide Derived from Human Papillomavirus
WGKGSPCTNVA

SEQ ID NO: 32451 - protein, 9 aa, Artificial Sequence
  Peptide Derived from Human Papillomavirus
WLPSEATVY

SEQ ID NO: 32452 - protein, 8 aa, Artificial Sequence
  Peptide Derived from Human Papillomavirus
WLQRAQGH

SEQ ID NO: 32453 - protein, 10 aa, Artificial Sequence
  Peptide Derived from Human Papillomavirus
YAANAGVDNR

SEQ ID NO: 32454 - protein, 11 aa, Artificial Sequence
  Peptide Derived from Human Papillomavirus
YDLQFIFQLCK

SEQ ID NO: 32455 - protein, 11 aa, Artificial Sequence
  Peptide Derived from Human Papillomavirus
YFPIKKPNNNK

SEQ ID NO: 32456 - protein, 8 aa, Artificial Sequence
  Peptide Derived from Human Papillomavirus
YGDSLFFY

SEQ ID NO: 32457 - protein, 10 aa, Artificial Sequence
  Peptide Derived from Human Papillomavirus
YGDSLFFYLR

SEQ ID NO: 32458 - protein, 11 aa, Artificial Sequence
  Peptide Derived from Human Papillomavirus
YGDSLFFYLRR

SEQ ID NO: 32459 - protein, 9 aa, Artificial Sequence
  Peptide Derived from Human Papillomavirus
YIKGSGSTA

SEQ ID NO: 32460 - protein, 9 aa, Artificial Sequence
  Peptide Derived from Human Papillomavirus
YIKMVSEPY

SEQ ID NO: 32461 - protein, 8 aa, Artificial Sequence
  Peptide Derived from Human Papillomavirus
YILVITCY

SEQ ID NO: 32462 - protein, 9 aa, Artificial Sequence
  Peptide Derived from Human Papillomavirus
YLPPVPVSK

SEQ ID NO: 32463 - protein, 8 aa, Artificial Sequence
  Peptide Derived from Human Papillomavirus
YLRHGEEY

SEQ ID NO: 32464 - protein, 8 aa, Artificial Sequence
  Peptide Derived from Human Papillomavirus
YLRREQMF

SEQ ID NO: 32465 - protein, 10 aa, Artificial Sequence
  Peptide Derived from Human Papillomavirus
YLRREQMFVR

SEQ ID NO: 32466 - protein, 11 aa, Artificial Sequence
  Peptide Derived from Human Papillomavirus
YLRREQMFVRH

SEQ ID NO: 32467 - protein, 9 aa, Artificial Sequence
  Peptide Derived from Human Papillomavirus
YTFWEVNLK

SEQ ID NO: 32468 - protein, 11 aa, Artificial Sequence
  Peptide Derived from Human Papillomavirus
YTFWEVNLKEK

SEQ ID NO: 32469 - protein, 8 aa, Artificial Sequence
  Peptide Derived from Human Papillomavirus
YVARTNIY

SEQ ID NO: 32470 - protein, 9 aa, Artificial Sequence
  Peptide Derived from Human Papillomavirus
YVARTNIYY

SEQ ID NO: 32471 - protein, 10 aa, Artificial Sequence
  Peptide Derived from Human Papillomavirus
YVARTNIYYH

SEQ ID NO: 32472 - protein, 11 aa, Artificial Sequence
  Peptide Derived from Human Papillomavirus
YVARTNIYYHA

SEQ ID NO: 32473 - protein, 9 aa, Artificial Sequence
  Peptide Derived from Human Papillomavirus
ADAGDFYLH

SEQ ID NO: 32474 - protein, 8 aa, Artificial Sequence
  Peptide Derived from Human Papillomavirus
AFITTPTK

SEQ ID NO: 32475 - protein, 10 aa, Artificial Sequence
  Peptide Derived from Human Papillomavirus
AGDFYLHPSY

SEQ ID NO: 32476 - protein, 11 aa, Artificial Sequence
  Peptide Derived from Human Papillomavirus
AGDFYLHPSYY

SEQ ID NO: 32477 - protein, 11 aa, Artificial Sequence
  Peptide Derived from Human Papillomavirus
AGTCPPDIIPK

SEQ ID NO: 32478 - protein, 10 aa, Artificial Sequence
  Peptide Derived from Human Papillomavirus
ALHRPALTSR

SEQ ID NO: 32479 - protein, 11 aa, Artificial Sequence
  Peptide Derived from Human Papillomavirus
ALHRPALTSRR

SEQ ID NO: 32480 - protein, 11 aa, Artificial Sequence
  Peptide Derived from Human Papillomavirus
ALPTSINNGLY

SEQ ID NO: 32481 - protein, 10 aa, Artificial Sequence
  Peptide Derived from Human Papillomavirus
ALTSRRTGIR

SEQ ID NO: 32482 - protein, 11 aa, Artificial Sequence
  Peptide Derived from Human Papillomavirus
ALTSRRTGIRY

SEQ ID NO: 32483 - protein, 8 aa, Artificial Sequence
  Peptide Derived from Human Papillomavirus
ASATQLYK

SEQ ID NO: 32484 - protein, 11 aa, Artificial Sequence
  Peptide Derived from Human Papillomavirus
ASATQLYKTCK

SEQ ID NO: 32485 - protein, 9 aa, Artificial Sequence
  Peptide Derived from Human Papillomavirus
ATDTLAPVR

SEQ ID NO: 32486 - protein, 9 aa, Artificial Sequence
  Peptide Derived from Human Papillomavirus
ATQLYKTCK

SEQ ID NO: 32487 - protein, 11 aa, Artificial Sequence
  Peptide Derived from Human Papillomavirus
ATQLYKTCKQA

SEQ ID NO: 32488 - protein, 8 aa, Artificial Sequence
  Peptide Derived from Human Papillomavirus
DAGDFYLH

SEQ ID NO: 32489 - protein, 11 aa, Artificial Sequence
  Peptide Derived from Human Papillomavirus
DAGDFYLHPSY

SEQ ID NO: 32490 - protein, 9 aa, Artificial Sequence
  Peptide Derived from Human Papillomavirus
DFLDIVALH

SEQ ID NO: 32491 - protein, 10 aa, Artificial Sequence
  Peptide Derived from Human Papillomavirus
DFLDIVALHR

SEQ ID NO: 32492 - protein, 8 aa, Artificial Sequence
  Peptide Derived from Human Papillomavirus
DFSTIDSA

SEQ ID NO: 32493 - protein, 8 aa, Artificial Sequence
  Peptide Derived from Human Papillomavirus
DFYLHPSY

SEQ ID NO: 32494 - protein, 9 aa, Artificial Sequence
  Peptide Derived from Human Papillomavirus
DFYLHPSYY

SEQ ID NO: 32495 - protein, 9 aa, Artificial Sequence
  Peptide Derived from Human Papillomavirus
DIIPKVEGK

SEQ ID NO: 32496 - protein, 10 aa, Artificial Sequence
  Peptide Derived from Human Papillomavirus
DIPINITDQA

SEQ ID NO: 32497 - protein, 9 aa, Artificial Sequence
  Peptide Derived from Human Papillomavirus
DIVALHRPA

SEQ ID NO: 32498 - protein, 8 aa, Artificial Sequence
  Peptide Derived from Human Papillomavirus
DVDNTLYF

SEQ ID NO: 32499 - protein, 10 aa, Artificial Sequence
  Peptide Derived from Human Papillomavirus
EGIDVDNTLY

SEQ ID NO: 32500 - protein, 11 aa, Artificial Sequence
  Peptide Derived from Human Papillomavirus
EGIDVDNTLYF

SEQ ID NO: 32501 - protein, 10 aa, Artificial Sequence
  Peptide Derived from Human Papillomavirus
ELQTITPSTY

SEQ ID NO: 32502 - protein, 9 aa, Artificial Sequence
  Peptide Derived from Human Papillomavirus
ETSFIDAGA

SEQ ID NO: 32503 - protein, 8 aa, Artificial Sequence
  Peptide Derived from Human Papillomavirus
FFSDVSLA

SEQ ID NO: 32504 - protein, 9 aa, Artificial Sequence
  Peptide Derived from Human Papillomavirus
FFSDVSLAA

SEQ ID NO: 32505 - protein, 11 aa, Artificial Sequence
  Peptide Derived from Human Papillomavirus
FITTPTKLITY

SEQ ID NO: 32506 - protein, 8 aa, Artificial Sequence
  Peptide Derived from Human Papillomavirus
FLDIVALH

SEQ ID NO: 32507 - protein, 9 aa, Artificial Sequence
  Peptide Derived from Human Papillomavirus
FLDIVALHR

SEQ ID NO: 32508 - protein, 11 aa, Artificial Sequence
  Peptide Derived from Human Papillomavirus
FLDIVALHRPA

SEQ ID NO: 32509 - protein, 8 aa, Artificial Sequence
  Peptide Derived from Human Papillomavirus
FSDVSLAA

SEQ ID NO: 32510 - protein, 11 aa, Artificial Sequence
  Peptide Derived from Human Papillomavirus
FSSNDNSINIA

SEQ ID NO: 32511 - protein, 11 aa, Artificial Sequence
  Peptide Derived from Human Papillomavirus
FTLSSSTISTH

SEQ ID NO: 32512 - protein, 8 aa, Artificial Sequence
  Peptide Derived from Human Papillomavirus
GAKVHYYY

SEQ ID NO: 32513 - protein, 10 aa, Artificial Sequence
  Peptide Derived from Human Papillomavirus
GAKVHYYYDF

SEQ ID NO: 32514 - protein, 9 aa, Artificial Sequence
  Peptide Derived from Human Papillomavirus
GDFYLHPSY

SEQ ID NO: 32515 - protein, 10 aa, Artificial Sequence
  Peptide Derived from Human Papillomavirus
GDFYLHPSYY

SEQ ID NO: 32516 - protein, 9 aa, Artificial Sequence
  Peptide Derived from Human Papillomavirus
GIDVDNTLY

SEQ ID NO: 32517 - protein, 10 aa, Artificial Sequence
  Peptide Derived from Human Papillomavirus
GIDVDNTLYF

SEQ ID NO: 32518 - protein, 11 aa, Artificial Sequence
  Peptide Derived from Human Papillomavirus
GIGTGSGTGGR

SEQ ID NO: 32519 - protein, 10 aa, Artificial Sequence
  Peptide Derived from Human Papillomavirus
GIRYSRIGNK

SEQ ID NO: 32520 - protein, 10 aa, Artificial Sequence
  Peptide Derived from Human Papillomavirus
GLYDIYADDF

SEQ ID NO: 32521 - protein, 11 aa, Artificial Sequence
  Peptide Derived from Human Papillomavirus
GLYSRTTQQVK

SEQ ID NO: 32522 - protein, 10 aa, Artificial Sequence
  Peptide Derived from Human Papillomavirus
GSGTGGRTGY

SEQ ID NO: 32523 - protein, 9 aa, Artificial Sequence
  Peptide Derived from Human Papillomavirus
GSPQYTIIA

SEQ ID NO: 32524 - protein, 11 aa, Artificial Sequence
  Peptide Derived from Human Papillomavirus
GSPQYTIIADA

SEQ ID NO: 32525 - protein, 11 aa, Artificial Sequence
  Peptide Derived from Human Papillomavirus
GSRPVARLGLY

SEQ ID NO: 32526 - protein, 10 aa, Artificial Sequence
  Peptide Derived from Human Papillomavirus
GTCPPDIIPK

SEQ ID NO: 32527 - protein, 8 aa, Artificial Sequence
  Peptide Derived from Human Papillomavirus
GTGGRTGY

SEQ ID NO: 32528 - protein, 9 aa, Artificial Sequence
  Peptide Derived from Human Papillomavirus
GTGSGTGGR

SEQ ID NO: 32529 - protein, 8 aa, Artificial Sequence
  Peptide Derived from Human Papillomavirus
IADAGDFY

SEQ ID NO: 32530 - protein, 10 aa, Artificial Sequence
  Peptide Derived from Human Papillomavirus
IADAGDFYLH

SEQ ID NO: 32531 - protein, 8 aa, Artificial Sequence
  Peptide Derived from Human Papillomavirus
IADQILQY

SEQ ID NO: 32532 - protein, 8 aa, Artificial Sequence
  Peptide Derived from Human Papillomavirus
IDVDNTLY

SEQ ID NO: 32533 - protein, 9 aa, Artificial Sequence
  Peptide Derived from Human Papillomavirus
IDVDNTLYF

SEQ ID NO: 32534 - protein, 8 aa, Artificial Sequence
  Peptide Derived from Human Papillomavirus
IGAKVHYY

SEQ ID NO: 32535 - protein, 9 aa, Artificial Sequence
  Peptide Derived from Human Papillomavirus
IGAKVHYYY

SEQ ID NO: 32536 - protein, 11 aa, Artificial Sequence
  Peptide Derived from Human Papillomavirus
IGAKVHYYYDF

SEQ ID NO: 32537 - protein, 8 aa, Artificial Sequence
  Peptide Derived from Human Papillomavirus
IGNKQTLR

SEQ ID NO: 32538 - protein, 10 aa, Artificial Sequence
  Peptide Derived from Human Papillomavirus
IGNKQTLRTR

SEQ ID NO: 32539 - protein, 10 aa, Artificial Sequence
  Peptide Derived from Human Papillomavirus
IGTGSGTGGR

SEQ ID NO: 32540 - protein, 8 aa, Artificial Sequence
  Peptide Derived from Human Papillomavirus
IIADAGDF

SEQ ID NO: 32541 - protein, 9 aa, Artificial Sequence
  Peptide Derived from Human Papillomavirus
IIADAGDFY

SEQ ID NO: 32542 - protein, 11 aa, Artificial Sequence
  Peptide Derived from Human Papillomavirus
IIADAGDFYLH

SEQ ID NO: 32543 - protein, 8 aa, Artificial Sequence
  Peptide Derived from Human Papillomavirus
IIPKVEGK

SEQ ID NO: 32544 - protein, 11 aa, Artificial Sequence
  Peptide Derived from Human Papillomavirus
IIPKVEGKTIA

SEQ ID NO: 32545 - protein, 10 aa, Artificial Sequence
  Peptide Derived from Human Papillomavirus
ILQYGSMGVF

SEQ ID NO: 32546 - protein, 11 aa, Artificial Sequence
  Peptide Derived from Human Papillomavirus
ILQYGSMGVFF

SEQ ID NO: 32547 - protein, 11 aa, Artificial Sequence
  Peptide Derived from Human Papillomavirus
ITPSTYTTTSH

SEQ ID NO: 32548 - protein, 10 aa, Artificial Sequence
  Peptide Derived from Human Papillomavirus
ITTPTKLITY

SEQ ID NO: 32549 - protein, 10 aa, Artificial Sequence
  Peptide Derived from Human Papillomavirus
ITTSTDTTPA

SEQ ID NO: 32550 - protein, 8 aa, Artificial Sequence
  Peptide Derived from Human Papillomavirus
ITYDNPAY

SEQ ID NO: 32551 - protein, 8 aa, Artificial Sequence
  Peptide Derived from Human Papillomavirus
IVALHRPA

SEQ ID NO: 32552 - protein, 8 aa, Artificial Sequence
  Peptide Derived from Human Papillomavirus
IVPGSPQY

SEQ ID NO: 32553 - protein, 10 aa, Artificial Sequence
  Peptide Derived from Human Papillomavirus
IVSLVEETSF

SEQ ID NO: 32554 - protein, 9 aa, Artificial Sequence
  Peptide Derived from Human Papillomavirus
KLITYDNPA

SEQ ID NO: 32555 - protein, 10 aa, Artificial Sequence
  Peptide Derived from Human Papillomavirus
KLITYDNPAY

SEQ ID NO: 32556 - protein, 8 aa, Artificial Sequence
  Peptide Derived from Human Papillomavirus
KSIGAKVH

SEQ ID NO: 32557 - protein, 9 aa, Artificial Sequence
  Peptide Derived from Human Papillomavirus
KSIGAKVHY

SEQ ID NO: 32558 - protein, 10 aa, Artificial Sequence
  Peptide Derived from Human Papillomavirus
KSIGAKVHYY

SEQ ID NO: 32559 - protein, 11 aa, Artificial Sequence
  Peptide Derived from Human Papillomavirus
KSIGAKVHYYY

SEQ ID NO: 32560 - protein, 10 aa, Artificial Sequence
  Peptide Derived from Human Papillomavirus
KTIADQILQY

SEQ ID NO: 32561 - protein, 8 aa, Artificial Sequence
  Peptide Derived from Human Papillomavirus
KVEGKTIA

SEQ ID NO: 32562 - protein, 8 aa, Artificial Sequence
  Peptide Derived from Human Papillomavirus
KVHYYYDF

SEQ ID NO: 32563 - protein, 8 aa, Artificial Sequence
  Peptide Derived from Human Papillomavirus
LDIVALHR

SEQ ID NO: 32564 - protein, 10 aa, Artificial Sequence
  Peptide Derived from Human Papillomavirus
LDIVALHRPA

SEQ ID NO: 32565 - protein, 8 aa, Artificial Sequence
  Peptide Derived from Human Papillomavirus
LGTRPPTA

SEQ ID NO: 32566 - protein, 11 aa, Artificial Sequence
  Peptide Derived from Human Papillomavirus
LIPIVPGSPQY

SEQ ID NO: 32567 - protein, 8 aa, Artificial Sequence
  Peptide Derived from Human Papillomavirus
LITYDNPA

SEQ ID NO: 32568 - protein, 9 aa, Artificial Sequence
  Peptide Derived from Human Papillomavirus
LITYDNPAY

SEQ ID NO: 32569 - protein, 9 aa, Artificial Sequence
  Peptide Derived from Human Papillomavirus
LSSSTISTH

SEQ ID NO: 32570 - protein, 11 aa, Artificial Sequence
  Peptide Derived from Human Papillomavirus
LSSSTISTHNY

SEQ ID NO: 32571 - protein, 9 aa, Artificial Sequence
  Peptide Derived from Human Papillomavirus
LTSRRTGIR

SEQ ID NO: 32572 - protein, 10 aa, Artificial Sequence
  Peptide Derived from Human Papillomavirus
LTSRRTGIRY

SEQ ID NO: 32573 - protein, 10 aa, Artificial Sequence
  Peptide Derived from Human Papillomavirus
LVEETSFIDA

SEQ ID NO: 32574 - protein, 8 aa, Artificial Sequence
  Peptide Derived from Human Papillomavirus
MLRKRRKR

SEQ ID NO: 32575 - protein, 11 aa, Artificial Sequence
  Peptide Derived from Human Papillomavirus
MLRKRRKRLPY

SEQ ID NO: 32576 - protein, 8 aa, Artificial Sequence
  Peptide Derived from Human Papillomavirus
NDNSINIA

SEQ ID NO: 32577 - protein, 8 aa, Artificial Sequence
  Peptide Derived from Human Papillomavirus
NGLYDIYA

SEQ ID NO: 32578 - protein, 11 aa, Artificial Sequence
  Peptide Derived from Human Papillomavirus
NGLYDIYADDF

SEQ ID NO: 32579 - protein, 8 aa, Artificial Sequence
  Peptide Derived from Human Papillomavirus
NIAPDPDF

SEQ ID NO: 32580 - protein, 11 aa, Artificial Sequence
  Peptide Derived from Human Papillomavirus
NSINIAPDPDF

SEQ ID NO: 32581 - protein, 9 aa, Artificial Sequence
  Peptide Derived from Human Papillomavirus
NTTIPFGGA

SEQ ID NO: 32582 - protein, 10 aa, Artificial Sequence
  Peptide Derived from Human Papillomavirus
NTTIPFGGAY

SEQ ID NO: 32583 - protein, 9 aa, Artificial Sequence
  Peptide Derived from Human Papillomavirus
NTVTTVTTH

SEQ ID NO: 32584 - protein, 8 aa, Artificial Sequence
  Peptide Derived from Human Papillomavirus
PAETGGHF

SEQ ID NO: 32585 - protein, 9 aa, Artificial Sequence
  Peptide Derived from Human Papillomavirus
PAFITTPTK

SEQ ID NO: 32586 - protein, 11 aa, Artificial Sequence
  Peptide Derived from Human Papillomavirus
PALTSRRTGIR

SEQ ID NO: 32587 - protein, 8 aa, Artificial Sequence
  Peptide Derived from Human Papillomavirus
PANTTIPF

SEQ ID NO: 32588 - protein, 11 aa, Artificial Sequence
  Peptide Derived from Human Papillomavirus
PANTTIPFGGA

SEQ ID NO: 32589 - protein, 8 aa, Artificial Sequence
  Peptide Derived from Human Papillomavirus
PDFLDIVA

SEQ ID NO: 32590 - protein, 10 aa, Artificial Sequence
  Peptide Derived from Human Papillomavirus
PDFLDIVALH

SEQ ID NO: 32591 - protein, 11 aa, Artificial Sequence
  Peptide Derived from Human Papillomavirus
PDFLDIVALHR

SEQ ID NO: 32592 - protein, 10 aa, Artificial Sequence
  Peptide Derived from Human Papillomavirus
PDIIPKVEGK

SEQ ID NO: 32593 - protein, 11 aa, Artificial Sequence
  Peptide Derived from Human Papillomavirus
PDIPINITDQA

SEQ ID NO: 32594 - protein, 10 aa, Artificial Sequence
  Peptide Derived from Human Papillomavirus
PDPDFLDIVA

SEQ ID NO: 32595 - protein, 10 aa, Artificial Sequence
  Peptide Derived from Human Papillomavirus
PGSPQYTIIA

SEQ ID NO: 32596 - protein, 8 aa, Artificial Sequence
  Peptide Derived from Human Papillomavirus
PGSRPVAR

SEQ ID NO: 32597 - protein, 8 aa, Artificial Sequence
  Peptide Derived from Human Papillomavirus
PINITDQA

SEQ ID NO: 32598 - protein, 9 aa, Artificial Sequence
  Peptide Derived from Human Papillomavirus
PIPGSRPVA

SEQ ID NO: 32599 - protein, 10 aa, Artificial Sequence
  Peptide Derived from Human Papillomavirus
PIPGSRPVAR

SEQ ID NO: 32600 - protein, 9 aa, Artificial Sequence
  Peptide Derived from Human Papillomavirus
PIVPGSPQY

SEQ ID NO: 32601 - protein, 9 aa, Artificial Sequence
  Peptide Derived from Human Papillomavirus
PLGTRPPTA

SEQ ID NO: 32602 - protein, 10 aa, Artificial Sequence
  Peptide Derived from Human Papillomavirus
PSIPPDVSGF

SEQ ID NO: 32603 - protein, 8 aa, Artificial Sequence
  Peptide Derived from Human Papillomavirus
PSTSLSGY

SEQ ID NO: 32604 - protein, 11 aa, Artificial Sequence
  Peptide Derived from Human Papillomavirus
PSTSLSGYIPA

SEQ ID NO: 32605 - protein, 9 aa, Artificial Sequence
  Peptide Derived from Human Papillomavirus
PSTYTTTSH

SEQ ID NO: 32606 - protein, 10 aa, Artificial Sequence
  Peptide Derived from Human Papillomavirus
PSTYTTTSHA

SEQ ID NO: 32607 - protein, 11 aa, Artificial Sequence
  Peptide Derived from Human Papillomavirus
PSTYTTTSHAA

SEQ ID NO: 32608 - protein, 10 aa, Artificial Sequence
  Peptide Derived from Human Papillomavirus
PSVLQPPTPA

SEQ ID NO: 32609 - protein, 11 aa, Artificial Sequence
  Peptide Derived from Human Papillomavirus
PSVPSTSLSGY

SEQ ID NO: 32610 - protein, 8 aa, Artificial Sequence
  Peptide Derived from Human Papillomavirus
PSYYMLRK

SEQ ID NO: 32611 - protein, 9 aa, Artificial Sequence
  Peptide Derived from Human Papillomavirus
PSYYMLRKR

SEQ ID NO: 32612 - protein, 10 aa, Artificial Sequence
  Peptide Derived from Human Papillomavirus
PSYYMLRKRR

SEQ ID NO: 32613 - protein, 11 aa, Artificial Sequence
  Peptide Derived from Human Papillomavirus
PSYYMLRKRRK

SEQ ID NO: 32614 - protein, 8 aa, Artificial Sequence
  Peptide Derived from Human Papillomavirus
PTATDTLA

SEQ ID NO: 32615 - protein, 11 aa, Artificial Sequence
  Peptide Derived from Human Papillomavirus
PTATDTLAPVR

SEQ ID NO: 32616 - protein, 11 aa, Artificial Sequence
  Peptide Derived from Human Papillomavirus
PTKLITYDNPA

SEQ ID NO: 32617 - protein, 9 aa, Artificial Sequence
  Peptide Derived from Human Papillomavirus
PTPAETGGH

SEQ ID NO: 32618 - protein, 10 aa, Artificial Sequence
  Peptide Derived from Human Papillomavirus
PTPAETGGHF

SEQ ID NO: 32619 - protein, 9 aa, Artificial Sequence
  Peptide Derived from Human Papillomavirus
PTSINNGLY

SEQ ID NO: 32620 - protein, 8 aa, Artificial Sequence
  Peptide Derived from Human Papillomavirus
PVARLGLY

SEQ ID NO: 32621 - protein, 10 aa, Artificial Sequence
  Peptide Derived from Human Papillomavirus
PVARLGLYSR

SEQ ID NO: 32622 - protein, 11 aa, Artificial Sequence
  Peptide Derived from Human Papillomavirus
QILQYGSMGVF

SEQ ID NO: 32623 - protein, 9 aa, Artificial Sequence
  Peptide Derived from Human Papillomavirus
QLYKTCKQA

SEQ ID NO: 32624 - protein, 8 aa, Artificial Sequence
  Peptide Derived from Human Papillomavirus
QTITPSTY

SEQ ID NO: 32625 - protein, 9 aa, Artificial Sequence
  Peptide Derived from Human Papillomavirus
QTLRTRSGK

SEQ ID NO: 32626 - protein, 8 aa, Artificial Sequence
  Peptide Derived from Human Papillomavirus
QVKVVDPA

SEQ ID NO: 32627 - protein, 9 aa, Artificial Sequence
  Peptide Derived from Human Papillomavirus
QVKVVDPAF

SEQ ID NO: 32628 - protein, 8 aa, Artificial Sequence
  Peptide Derived from Human Papillomavirus
RASATQLY

SEQ ID NO: 32629 - protein, 9 aa, Artificial Sequence
  Peptide Derived from Human Papillomavirus
RASATQLYK

SEQ ID NO: 32630 - protein, 9 aa, Artificial Sequence
  Peptide Derived from Human Papillomavirus
RIGNKQTLR

SEQ ID NO: 32631 - protein, 11 aa, Artificial Sequence
  Peptide Derived from Human Papillomavirus
RIGNKQTLRTR

SEQ ID NO: 32632 - protein, 8 aa, Artificial Sequence
  Peptide Derived from Human Papillomavirus
RSAKRTKR

SEQ ID NO: 32633 - protein, 9 aa, Artificial Sequence
  Peptide Derived from Human Papillomavirus
RSAKRTKRA

SEQ ID NO: 32634 - protein, 11 aa, Artificial Sequence
  Peptide Derived from Human Papillomavirus
RSAKRTKRASA

SEQ ID NO: 32635 - protein, 8 aa, Artificial Sequence
  Peptide Derived from Human Papillomavirus
RSGKSIGA

SEQ ID NO: 32636 - protein, 9 aa, Artificial Sequence
  Peptide Derived from Human Papillomavirus
RSGKSIGAK

SEQ ID NO: 32637 - protein, 11 aa, Artificial Sequence
  Peptide Derived from Human Papillomavirus
RSGKSIGAKVH

SEQ ID NO: 32638 - protein, 8 aa, Artificial Sequence
  Peptide Derived from Human Papillomavirus
RTGIRYSR

SEQ ID NO: 32639 - protein, 10 aa, Artificial Sequence
  Peptide Derived from Human Papillomavirus
RTGYIPLGTR

SEQ ID NO: 32640 - protein, 11 aa, Artificial Sequence
  Peptide Derived from Human Papillomavirus
RTKRASATQLY

SEQ ID NO: 32641 - protein, 10 aa, Artificial Sequence
  Peptide Derived from Human Papillomavirus
RTRSGKSIGA

SEQ ID NO: 32642 - protein, 11 aa, Artificial Sequence
  Peptide Derived from Human Papillomavirus
RTRSGKSIGAK

SEQ ID NO: 32643 - protein, 8 aa, Artificial Sequence
  Peptide Derived from Human Papillomavirus
SAKRTKRA

SEQ ID NO: 32644 - protein, 10 aa, Artificial Sequence
  Peptide Derived from Human Papillomavirus
SAKRTKRASA

SEQ ID NO: 32645 - protein, 10 aa, Artificial Sequence
  Peptide Derived from Human Papillomavirus
SATQLYKTCK

SEQ ID NO: 32646 - protein, 8 aa, Artificial Sequence
  Peptide Derived from Human Papillomavirus
SGKSIGAK

SEQ ID NO: 32647 - protein, 10 aa, Artificial Sequence
  Peptide Derived from Human Papillomavirus
SGKSIGAKVH

SEQ ID NO: 32648 - protein, 11 aa, Artificial Sequence
  Peptide Derived from Human Papillomavirus
SGKSIGAKVHY

SEQ ID NO: 32649 - protein, 9 aa, Artificial Sequence
  Peptide Derived from Human Papillomavirus
SGTGGRTGY

SEQ ID NO: 32650 - protein, 8 aa, Artificial Sequence
  Peptide Derived from Human Papillomavirus
SIGAKVHY

SEQ ID NO: 32651 - protein, 9 aa, Artificial Sequence
  Peptide Derived from Human Papillomavirus
SIGAKVHYY

SEQ ID NO: 32652 - protein, 10 aa, Artificial Sequence
  Peptide Derived from Human Papillomavirus
SIGAKVHYYY

SEQ ID NO: 32653 - protein, 10 aa, Artificial Sequence
  Peptide Derived from Human Papillomavirus
SINIAPDPDF

SEQ ID NO: 32654 - protein, 10 aa, Artificial Sequence
  Peptide Derived from Human Papillomavirus
SINNGLYDIY

SEQ ID NO: 32655 - protein, 11 aa, Artificial Sequence
  Peptide Derived from Human Papillomavirus
SINNGLYDIYA

SEQ ID NO: 32656 - protein, 9 aa, Artificial Sequence
  Peptide Derived from Human Papillomavirus
SIPPDVSGF

SEQ ID NO: 32657 - protein, 11 aa, Artificial Sequence
  Peptide Derived from Human Papillomavirus
SITTSTDTTPA

SEQ ID NO: 32658 - protein, 11 aa, Artificial Sequence
  Peptide Derived from Human Papillomavirus
SIVSLVEETSF

SEQ ID NO: 32659 - protein, 8 aa, Artificial Sequence
  Peptide Derived from Human Papillomavirus
SLSGYIPA

SEQ ID NO: 32660 - protein, 8 aa, Artificial Sequence
  Peptide Derived from Human Papillomavirus
SLVEETSF

SEQ ID NO: 32661 - protein, 11 aa, Artificial Sequence
  Peptide Derived from Human Papillomavirus
SLVEETSFIDA

SEQ ID NO: 32662 - protein, 10 aa, Artificial Sequence
  Peptide Derived from Human Papillomavirus
SSNDNSINIA

SEQ ID NO: 32663 - protein, 8 aa, Artificial Sequence
  Peptide Derived from Human Papillomavirus
SSSTISTH

SEQ ID NO: 32664 - protein, 10 aa, Artificial Sequence
  Peptide Derived from Human Papillomavirus
SSSTISTHNY

SEQ ID NO: 32665 - protein, 9 aa, Artificial Sequence
  Peptide Derived from Human Papillomavirus
SSTISTHNY

SEQ ID NO: 32666 - protein, 9 aa, Artificial Sequence
  Peptide Derived from Human Papillomavirus
SSTPIPGSR

SEQ ID NO: 32667 - protein, 8 aa, Artificial Sequence
  Peptide Derived from Human Papillomavirus
STISTHNY

SEQ ID NO: 32668 - protein, 8 aa, Artificial Sequence
  Peptide Derived from Human Papillomavirus
STPIPGSR

SEQ ID NO: 32669 - protein, 11 aa, Artificial Sequence
  Peptide Derived from Human Papillomavirus
STPIPGSRPVA

SEQ ID NO: 32670 - protein, 10 aa, Artificial Sequence
  Peptide Derived from Human Papillomavirus
STSLSGYIPA

SEQ ID NO: 32671 - protein, 8 aa, Artificial Sequence
  Peptide Derived from Human Papillomavirus
STYTTTSH

SEQ ID NO: 32672 - protein, 9 aa, Artificial Sequence
  Peptide Derived from Human Papillomavirus
STYTTTSHA

SEQ ID NO: 32673 - protein, 10 aa, Artificial Sequence
  Peptide Derived from Human Papillomavirus
STYTTTSHAA

SEQ ID NO: 32674 - protein, 9 aa, Artificial Sequence
  Peptide Derived from Human Papillomavirus
SVLQPPTPA

SEQ ID NO: 32675 - protein, 10 aa, Artificial Sequence
  Peptide Derived from Human Papillomavirus
SVPSTSLSGY

SEQ ID NO: 32676 - protein, 10 aa, Artificial Sequence
  Peptide Derived from Human Papillomavirus
TATDTLAPVR

SEQ ID NO: 32677 - protein, 9 aa, Artificial Sequence
  Peptide Derived from Human Papillomavirus
TCPPDIIPK

SEQ ID NO: 32678 - protein, 8 aa, Artificial Sequence
  Peptide Derived from Human Papillomavirus
TDTLAPVR

SEQ ID NO: 32679 - protein, 11 aa, Artificial Sequence
  Peptide Derived from Human Papillomavirus
TGIRYSRIGNK

SEQ ID NO: 32680 - protein, 8 aa, Artificial Sequence
  Peptide Derived from Human Papillomavirus
TGSGTGGR

SEQ ID NO: 32681 - protein, 11 aa, Artificial Sequence
  Peptide Derived from Human Papillomavirus
TGSGTGGRTGY

SEQ ID NO: 32682 - protein, 9 aa, Artificial Sequence
  Peptide Derived from Human Papillomavirus
TGYIPLGTR

SEQ ID NO: 32683 - protein, 9 aa, Artificial Sequence
  Peptide Derived from Human Papillomavirus
TIADQILQY

SEQ ID NO: 32684 - protein, 9 aa, Artificial Sequence
  Peptide Derived from Human Papillomavirus
TIIADAGDF

SEQ ID NO: 32685 - protein, 10 aa, Artificial Sequence
  Peptide Derived from Human Papillomavirus
TIIADAGDFY

SEQ ID NO: 32686 - protein, 8 aa, Artificial Sequence
  Peptide Derived from Human Papillomavirus
TIPFGGAY

SEQ ID NO: 32687 - protein, 8 aa, Artificial Sequence
  Peptide Derived from Human Papillomavirus
TLRTRSGK

SEQ ID NO: 32688 - protein, 10 aa, Artificial Sequence
  Peptide Derived from Human Papillomavirus
TLSSSTISTH

SEQ ID NO: 32689 - protein, 8 aa, Artificial Sequence
  Peptide Derived from Human Papillomavirus
TSFIDAGA

SEQ ID NO: 32690 - protein, 8 aa, Artificial Sequence
  Peptide Derived from Human Papillomavirus
TSINNGLY

SEQ ID NO: 32691 - protein, 11 aa, Artificial Sequence
  Peptide Derived from Human Papillomavirus
TSINNGLYDIY

SEQ ID NO: 32692 - protein, 9 aa, Artificial Sequence
  Peptide Derived from Human Papillomavirus
TSLSGYIPA

SEQ ID NO: 32693 - protein, 8 aa, Artificial Sequence
  Peptide Derived from Human Papillomavirus
TSRRTGIR

SEQ ID NO: 32694 - protein, 9 aa, Artificial Sequence
  Peptide Derived from Human Papillomavirus
TSRRTGIRY

SEQ ID NO: 32695 - protein, 11 aa, Artificial Sequence
  Peptide Derived from Human Papillomavirus
TSRRTGIRYSR

SEQ ID NO: 32696 - protein, 10 aa, Artificial Sequence
  Peptide Derived from Human Papillomavirus
TSSTPIPGSR

SEQ ID NO: 32697 - protein, 8 aa, Artificial Sequence
  Peptide Derived from Human Papillomavirus
TSTDTTPA

SEQ ID NO: 32698 - protein, 8 aa, Artificial Sequence
  Peptide Derived from Human Papillomavirus
TTHNNPTF

SEQ ID NO: 32699 - protein, 8 aa, Artificial Sequence
  Peptide Derived from Human Papillomavirus
TTIPFGGA

SEQ ID NO: 32700 - protein, 9 aa, Artificial Sequence
  Peptide Derived from Human Papillomavirus
TTIPFGGAY

SEQ ID NO: 32701 - protein, 9 aa, Artificial Sequence
  Peptide Derived from Human Papillomavirus
TTPTKLITY

SEQ ID NO: 32702 - protein, 11 aa, Artificial Sequence
  Peptide Derived from Human Papillomavirus
TTQQVKVVDPA

SEQ ID NO: 32703 - protein, 9 aa, Artificial Sequence
  Peptide Derived from Human Papillomavirus
TTSTDTTPA

SEQ ID NO: 32704 - protein, 11 aa, Artificial Sequence
  Peptide Derived from Human Papillomavirus
TTVTTHNNPTF

SEQ ID NO: 32705 - protein, 10 aa, Artificial Sequence
  Peptide Derived from Human Papillomavirus
TVTTHNNPTF

SEQ ID NO: 32706 - protein, 8 aa, Artificial Sequence
  Peptide Derived from Human Papillomavirus
TVTTVTTH

SEQ ID NO: 32707 - protein, 11 aa, Artificial Sequence
  Peptide Derived from Human Papillomavirus
VALHRPALTSR

SEQ ID NO: 32708 - protein, 9 aa, Artificial Sequence
  Peptide Derived from Human Papillomavirus
VARLGLYSR

SEQ ID NO: 32709 - protein, 11 aa, Artificial Sequence
  Peptide Derived from Human Papillomavirus
VDPAFITTPTK

SEQ ID NO: 32710 - protein, 8 aa, Artificial Sequence
  Peptide Derived from Human Papillomavirus
VLQPPTPA

SEQ ID NO: 32711 - protein, 9 aa, Artificial Sequence
  Peptide Derived from Human Papillomavirus
VSLVEETSF

SEQ ID NO: 32712 - protein, 11 aa, Artificial Sequence
  Peptide Derived from Human Papillomavirus
VTSSTPIPGSR

SEQ ID NO: 32713 - protein, 9 aa, Artificial Sequence
  Peptide Derived from Human Papillomavirus
VTTHNNPTF

SEQ ID NO: 32714 - protein, 9 aa, Artificial Sequence
  Peptide Derived from Human Papillomavirus
YDFSTIDSA

SEQ ID NO: 32715 - protein, 8 aa, Artificial Sequence
  Peptide Derived from Human Papillomavirus
YDIYADDF

SEQ ID NO: 32716 - protein, 9 aa, Artificial Sequence
  Peptide Derived from Human Papillomavirus
YFFSDVSLA

SEQ ID NO: 32717 - protein, 10 aa, Artificial Sequence
  Peptide Derived from Human Papillomavirus
YFFSDVSLAA

SEQ ID NO: 32718 - protein, 8 aa, Artificial Sequence
  Peptide Derived from Human Papillomavirus
YGSMGVFF

SEQ ID NO: 32719 - protein, 10 aa, Artificial Sequence
  Peptide Derived from Human Papillomavirus
YIPANTTIPF

SEQ ID NO: 32720 - protein, 11 aa, Artificial Sequence
  Peptide Derived from Human Papillomavirus
YIPLGTRPPTA

SEQ ID NO: 32721 - protein, 10 aa, Artificial Sequence
  Peptide Derived from Human Papillomavirus
YLHPSYYMLR

SEQ ID NO: 32722 - protein, 11 aa, Artificial Sequence
  Peptide Derived from Human Papillomavirus
YLHPSYYMLRK

SEQ ID NO: 32723 - protein, 8 aa, Artificial Sequence
  Peptide Derived from Human Papillomavirus
YMLRKRRK

SEQ ID NO: 32724 - protein, 9 aa, Artificial Sequence
  Peptide Derived from Human Papillomavirus
YMLRKRRKR

SEQ ID NO: 32725 - protein, 11 aa, Artificial Sequence
  Peptide Derived from Human Papillomavirus
YSRIGNKQTLR

SEQ ID NO: 32726 - protein, 9 aa, Artificial Sequence
  Peptide Derived from Human Papillomavirus
YSRTTQQVK

SEQ ID NO: 32727 - protein, 10 aa, Artificial Sequence
  Peptide Derived from Human Papillomavirus
YTIIADAGDF

SEQ ID NO: 32728 - protein, 11 aa, Artificial Sequence
  Peptide Derived from Human Papillomavirus
YTIIADAGDFY

SEQ ID NO: 32729 - protein, 8 aa, Artificial Sequence
  Peptide Derived from Human Papillomavirus
YTTTSHAA

SEQ ID NO: 32730 - protein, 11 aa, Artificial Sequence
  Peptide Derived from Human Papillomavirus
AAAFLKSNCQA

SEQ ID NO: 32731 - protein, 10 aa, Artificial Sequence
  Peptide Derived from Human Papillomavirus
AAFLKSNCQA

SEQ ID NO: 32732 - protein, 11 aa, Artificial Sequence
  Peptide Derived from Human Papillomavirus
AAFLKSNCQAK

SEQ ID NO: 32733 - protein, 8 aa, Artificial Sequence
  Peptide Derived from Human Papillomavirus
ADSNSNAA

SEQ ID NO: 32734 - protein, 9 aa, Artificial Sequence
  Peptide Derived from Human Papillomavirus
ADSNSNAAA

SEQ ID NO: 32735 - protein, 10 aa, Artificial Sequence
  Peptide Derived from Human Papillomavirus
ADSNSNAAAF

SEQ ID NO: 32736 - protein, 8 aa, Artificial Sequence
  Peptide Derived from Human Papillomavirus
ADTEGNPF

SEQ ID NO: 32737 - protein, 11 aa, Artificial Sequence
  Peptide Derived from Human Papillomavirus
ADTEGNPFGTF

SEQ ID NO: 32738 - protein, 8 aa, Artificial Sequence
  Peptide Derived from Human Papillomavirus
AFEYALLA

SEQ ID NO: 32739 - protein, 9 aa, Artificial Sequence
  Peptide Derived from Human Papillomavirus
AFLKSNCQA

SEQ ID NO: 32740 - protein, 10 aa, Artificial Sequence
  Peptide Derived from Human Papillomavirus
AFLKSNCQAK

SEQ ID NO: 32741 - protein, 11 aa, Artificial Sequence
  Peptide Derived from Human Papillomavirus
AFLKSNCQAKY

SEQ ID NO: 32742 - protein, 10 aa, Artificial Sequence
  Peptide Derived from Human Papillomavirus
AIFGVNPTIA

SEQ ID NO: 32743 - protein, 11 aa, Artificial Sequence
  Peptide Derived from Human Papillomavirus
ALDGNPISIDR

SEQ ID NO: 32744 - protein, 9 aa, Artificial Sequence
  Peptide Derived from Human Papillomavirus
ALFHAQEVH

SEQ ID NO: 32745 - protein, 11 aa, Artificial Sequence
  Peptide Derived from Human Papillomavirus
ALKSFLKGTPK

SEQ ID NO: 32746 - protein, 10 aa, Artificial Sequence
  Peptide Derived from Human Papillomavirus
ALLADSNSNA

SEQ ID NO: 32747 - protein, 11 aa, Artificial Sequence
  Peptide Derived from Human Papillomavirus
ALLADSNSNAA

SEQ ID NO: 32748 - protein, 9 aa, Artificial Sequence
  Peptide Derived from Human Papillomavirus
ALLRYKCGK

SEQ ID NO: 32749 - protein, 11 aa, Artificial Sequence
  Peptide Derived from Human Papillomavirus
ALLRYKCGKSR

SEQ ID NO: 32750 - protein, 10 aa, Artificial Sequence
  Peptide Derived from Human Papillomavirus
AMLAVFKDTY

SEQ ID NO: 32751 - protein, 11 aa, Artificial Sequence
  Peptide Derived from Human Papillomavirus
ATDTGSDMVDF

SEQ ID NO: 32752 - protein, 8 aa, Artificial Sequence
  Peptide Derived from Human Papillomavirus
ATMCKHYR

SEQ ID NO: 32753 - protein, 9 aa, Artificial Sequence
  Peptide Derived from Human Papillomavirus
ATMCKHYRR

SEQ ID NO: 32754 - protein, 10 aa, Artificial Sequence
  Peptide Derived from Human Papillomavirus
ATMCKHYRRA

SEQ ID NO: 32755 - protein, 8 aa, Artificial Sequence
  Peptide Derived from Human Papillomavirus
ATTTCWTY

SEQ ID NO: 32756 - protein, 9 aa, Artificial Sequence
  Peptide Derived from Human Papillomavirus
ATTTCWTYF

SEQ ID NO: 32757 - protein, 11 aa, Artificial Sequence
  Peptide Derived from Human Papillomavirus
AVFKDTYGLSF

SEQ ID NO: 32758 - protein, 11 aa, Artificial Sequence
  Peptide Derived from Human Papillomavirus
AVISFVNSTSH

SEQ ID NO: 32759 - protein, 8 aa, Artificial Sequence
  Peptide Derived from Human Papillomavirus
CATMCKHY

SEQ ID NO: 32760 - protein, 9 aa, Artificial Sequence
  Peptide Derived from Human Papillomavirus
CATMCKHYR

SEQ ID NO: 32761 - protein, 10 aa, Artificial Sequence
  Peptide Derived from Human Papillomavirus
CATMCKHYRR

SEQ ID NO: 32762 - protein, 11 aa, Artificial Sequence
  Peptide Derived from Human Papillomavirus
CATMCKHYRRA

SEQ ID NO: 32763 - protein, 9 aa, Artificial Sequence
  Peptide Derived from Human Papillomavirus
CFFERTWSR

SEQ ID NO: 32764 - protein, 9 aa, Artificial Sequence
  Peptide Derived from Human Papillomavirus
CGKSRLTVA

SEQ ID NO: 32765 - protein, 10 aa, Artificial Sequence
  Peptide Derived from Human Papillomavirus
CGKSRLTVAK

SEQ ID NO: 32766 - protein, 8 aa, Artificial Sequence
  Peptide Derived from Human Papillomavirus
CGPANTGK

SEQ ID NO: 32767 - protein, 10 aa, Artificial Sequence
  Peptide Derived from Human Papillomavirus
CGPANTGKSY

SEQ ID NO: 32768 - protein, 11 aa, Artificial Sequence
  Peptide Derived from Human Papillomavirus
CGPANTGKSYF

SEQ ID NO: 32769 - protein, 8 aa, Artificial Sequence
  Peptide Derived from Human Papillomavirus
CLVFCGPA

SEQ ID NO: 32770 - protein, 8 aa, Artificial Sequence
  Peptide Derived from Human Papillomavirus
CMLIQPPK

SEQ ID NO: 32771 - protein, 10 aa, Artificial Sequence
  Peptide Derived from Human Papillomavirus
CMLIQPPKLR

SEQ ID NO: 32772 - protein, 8 aa, Artificial Sequence
  Peptide Derived from Human Papillomavirus
CSGGSTEA

SEQ ID NO: 32773 - protein, 11 aa, Artificial Sequence
  Peptide Derived from Human Papillomavirus
CSKIDEGGDWR

SEQ ID NO: 32774 - protein, 9 aa, Artificial Sequence
  Peptide Derived from Human Papillomavirus
CTDWVTAIF

SEQ ID NO: 32775 - protein, 11 aa, Artificial Sequence
  Peptide Derived from Human Papillomavirus
CTIAQLKDLLK

SEQ ID NO: 32776 - protein, 9 aa, Artificial Sequence
  Peptide Derived from Human Papillomavirus
DADTEGNPF

SEQ ID NO: 32777 - protein, 9 aa, Artificial Sequence
  Peptide Derived from Human Papillomavirus
DAQVLHVLK

SEQ ID NO: 32778 - protein, 10 aa, Artificial Sequence
  Peptide Derived from Human Papillomavirus
DAQVLHVLKR

SEQ ID NO: 32779 - protein, 11 aa, Artificial Sequence
  Peptide Derived from Human Papillomavirus
DAQVLHVLKRK

SEQ ID NO: 32780 - protein, 9 aa, Artificial Sequence
  Peptide Derived from Human Papillomavirus
DATTTCWTY

SEQ ID NO: 32781 - protein, 10 aa, Artificial Sequence
  Peptide Derived from Human Papillomavirus
DATTTCWTYF

SEQ ID NO: 32782 - protein, 8 aa, Artificial Sequence
  Peptide Derived from Human Papillomavirus
DCATMCKH

SEQ ID NO: 32783 - protein, 9 aa, Artificial Sequence
  Peptide Derived from Human Papillomavirus
DCATMCKHY

SEQ ID NO: 32784 - protein, 10 aa, Artificial Sequence
  Peptide Derived from Human Papillomavirus
DCATMCKHYR

SEQ ID NO: 32785 - protein, 11 aa, Artificial Sequence
  Peptide Derived from Human Papillomavirus
DCATMCKHYRR

SEQ ID NO: 32786 - protein, 10 aa, Artificial Sequence
  Peptide Derived from Human Papillomavirus
DCKWGVLILA

SEQ ID NO: 32787 - protein, 10 aa, Artificial Sequence
  Peptide Derived from Human Papillomavirus
DDATTTCWTY

SEQ ID NO: 32788 - protein, 11 aa, Artificial Sequence
  Peptide Derived from Human Papillomavirus
DDATTTCWTYF

SEQ ID NO: 32789 - protein, 9 aa, Artificial Sequence
  Peptide Derived from Human Papillomavirus
DFIDTQGTF

SEQ ID NO: 32790 - protein, 11 aa, Artificial Sequence
  Peptide Derived from Human Papillomavirus
DGEGTGCNGWF

SEQ ID NO: 32791 - protein, 9 aa, Artificial Sequence
  Peptide Derived from Human Papillomavirus
DGNPISIDR

SEQ ID NO: 32792 - protein, 10 aa, Artificial Sequence
  Peptide Derived from Human Papillomavirus
DGNPISIDRK

SEQ ID NO: 32793 - protein, 11 aa, Artificial Sequence
  Peptide Derived from Human Papillomavirus
DGNPISIDRKH

SEQ ID NO: 32794 - protein, 9 aa, Artificial Sequence
  Peptide Derived from Human Papillomavirus
DLHEEEEDA

SEQ ID NO: 32795 - protein, 8 aa, Artificial Sequence
  Peptide Derived from Human Papillomavirus
DLLKVNNK

SEQ ID NO: 32796 - protein, 11 aa, Artificial Sequence
  Peptide Derived from Human Papillomavirus
DLLKVNNKQGA

SEQ ID NO: 32797 - protein, 9 aa, Artificial Sequence
  Peptide Derived from Human Papillomavirus
DLSEMVQWA

SEQ ID NO: 32798 - protein, 10 aa, Artificial Sequence
  Peptide Derived from Human Papillomavirus
DLSEMVQWAF

SEQ ID NO: 32799 - protein, 10 aa, Artificial Sequence
  Peptide Derived from Human Papillomavirus
DLVRNFKSDK

SEQ ID NO: 32800 - protein, 10 aa, Artificial Sequence
  Peptide Derived from Human Papillomavirus
DMAFEYALLA

SEQ ID NO: 32801 - protein, 11 aa, Artificial Sequence
  Peptide Derived from Human Papillomavirus
DSGYGCSEVEA

SEQ ID NO: 32802 - protein, 8 aa, Artificial Sequence
  Peptide Derived from Human Papillomavirus
DSNSNAAA

SEQ ID NO: 32803 - protein, 9 aa, Artificial Sequence
  Peptide Derived from Human Papillomavirus
DSNSNAAAF

SEQ ID NO: 32804 - protein, 11 aa, Artificial Sequence
  Peptide Derived from Human Papillomavirus
DSNSNAAAFLK

SEQ ID NO: 32805 - protein, 10 aa, Artificial Sequence
  Peptide Derived from Human Papillomavirus
DTEGNPFGTF

SEQ ID NO: 32806 - protein, 11 aa, Artificial Sequence
  Peptide Derived from Human Papillomavirus
DTEGNPFGTFK

SEQ ID NO: 32807 - protein, 9 aa, Artificial Sequence
  Peptide Derived from Human Papillomavirus
DTGSDMVDF

SEQ ID NO: 32808 - protein, 10 aa, Artificial Sequence
  Peptide Derived from Human Papillomavirus
DTKVAMLDDA

SEQ ID NO: 32809 - protein, 8 aa, Artificial Sequence
  Peptide Derived from Human Papillomavirus
DTPEWIQR

SEQ ID NO: 32810 - protein, 10 aa, Artificial Sequence
  Peptide Derived from Human Papillomavirus
DTQGTFCEQA

SEQ ID NO: 32811 - protein, 11 aa, Artificial Sequence
  Peptide Derived from Human Papillomavirus
DVISDDEDENA

SEQ ID NO: 32812 - protein, 10 aa, Artificial Sequence
  Peptide Derived from Human Papillomavirus
EDADTEGNPF

SEQ ID NO: 32813 - protein, 8 aa, Artificial Sequence
  Peptide Derived from Human Papillomavirus
EFITFLGA

SEQ ID NO: 32814 - protein, 10 aa, Artificial Sequence
  Peptide Derived from Human Papillomavirus
EFITFLGALK

SEQ ID NO: 32815 - protein, 8 aa, Artificial Sequence
  Peptide Derived from Human Papillomavirus
EFPNAFPF

SEQ ID NO: 32816 - protein, 10 aa, Artificial Sequence
  Peptide Derived from Human Papillomavirus
EFPNAFPFDK

SEQ ID NO: 32817 - protein, 10 aa, Artificial Sequence
  Peptide Derived from Human Papillomavirus
EGFKTLIQPF

SEQ ID NO: 32818 - protein, 11 aa, Artificial Sequence
  Peptide Derived from Human Papillomavirus
EGGDWRPIVQF

SEQ ID NO: 32819 - protein, 8 aa, Artificial Sequence
  Peptide Derived from Human Papillomavirus
EGNPFGTF

SEQ ID NO: 32820 - protein, 9 aa, Artificial Sequence
  Peptide Derived from Human Papillomavirus
EGNPFGTFK

SEQ ID NO: 32821 - protein, 11 aa, Artificial Sequence
  Peptide Derived from Human Papillomavirus
EGNPFGTFKLR

SEQ ID NO: 32822 - protein, 9 aa, Artificial Sequence
  Peptide Derived from Human Papillomavirus
EGTGCNGWF

SEQ ID NO: 32823 - protein, 10 aa, Artificial Sequence
  Peptide Derived from Human Papillomavirus
EGTGCNGWFY

SEQ ID NO: 32824 - protein, 8 aa, Artificial Sequence
  Peptide Derived from Human Papillomavirus
EINDKNWK

SEQ ID NO: 32825 - protein, 10 aa, Artificial Sequence
  Peptide Derived from Human Papillomavirus
EINDKNWKCF

SEQ ID NO: 32826 - protein, 11 aa, Artificial Sequence
  Peptide Derived from Human Papillomavirus
EINDKNWKCFF

SEQ ID NO: 32827 - protein, 9 aa, Artificial Sequence
  Peptide Derived from Human Papillomavirus
EISLNSGQK

SEQ ID NO: 32828 - protein, 10 aa, Artificial Sequence
  Peptide Derived from Human Papillomavirus
EISLNSGQKK

SEQ ID NO: 32829 - protein, 11 aa, Artificial Sequence
  Peptide Derived from Human Papillomavirus
EISLNSGQKKA

SEQ ID NO: 32830 - protein, 9 aa, Artificial Sequence
  Peptide Derived from Human Papillomavirus
ELETAQALF

SEQ ID NO: 32831 - protein, 10 aa, Artificial Sequence
  Peptide Derived from Human Papillomavirus
ELETAQALFH

SEQ ID NO: 32832 - protein, 11 aa, Artificial Sequence
  Peptide Derived from Human Papillomavirus
ELETAQALFHA

SEQ ID NO: 32833 - protein, 9 aa, Artificial Sequence
  Peptide Derived from Human Papillomavirus
ELTDESDMA

SEQ ID NO: 32834 - protein, 10 aa, Artificial Sequence
  Peptide Derived from Human Papillomavirus
ELTDESDMAF

SEQ ID NO: 32835 - protein, 8 aa, Artificial Sequence
  Peptide Derived from Human Papillomavirus
ESDMAFEY

SEQ ID NO: 32836 - protein, 9 aa, Artificial Sequence
  Peptide Derived from Human Papillomavirus
ESDMAFEYA

SEQ ID NO: 32837 - protein, 9 aa, Artificial Sequence
  Peptide Derived from Human Papillomavirus
ESRITVFEF

SEQ ID NO: 32838 - protein, 8 aa, Artificial Sequence
  Peptide Derived from Human Papillomavirus
ETAQALFH

SEQ ID NO: 32839 - protein, 9 aa, Artificial Sequence
  Peptide Derived from Human Papillomavirus
ETAQALFHA

SEQ ID NO: 32840 - protein, 10 aa, Artificial Sequence
  Peptide Derived from Human Papillomavirus
ETCMLIQPPK

SEQ ID NO: 32841 - protein, 9 aa, Artificial Sequence
  Peptide Derived from Human Papillomavirus
EVDTELSPR

SEQ ID NO: 32842 - protein, 10 aa, Artificial Sequence
  Peptide Derived from Human Papillomavirus
EVHNDAQVLH

SEQ ID NO: 32843 - protein, 10 aa, Artificial Sequence
  Peptide Derived from Human Papillomavirus
FCEQAELETA

SEQ ID NO: 32844 - protein, 9 aa, Artificial Sequence
  Peptide Derived from Human Papillomavirus
FCGPANTGK

SEQ ID NO: 32845 - protein, 11 aa, Artificial Sequence
  Peptide Derived from Human Papillomavirus
FCGPANTGKSY

SEQ ID NO: 32846 - protein, 9 aa, Artificial Sequence
  Peptide Derived from Human Papillomavirus
FDKNGNPVY

SEQ ID NO: 32847 - protein, 10 aa, Artificial Sequence
  Peptide Derived from Human Papillomavirus
FDLSEMVQWA

SEQ ID NO: 32848 - protein, 11 aa, Artificial Sequence
  Peptide Derived from Human Papillomavirus
FDLSEMVQWAF

SEQ ID NO: 32849 - protein, 8 aa, Artificial Sequence
  Peptide Derived from Human Papillomavirus
FDTYMRNA

SEQ ID NO: 32850 - protein, 8 aa, Artificial Sequence
  Peptide Derived from Human Papillomavirus
FFERTWSR

SEQ ID NO: 32851 - protein, 8 aa, Artificial Sequence
  Peptide Derived from Human Papillomavirus
FGMSFIHF

SEQ ID NO: 32852 - protein, 8 aa, Artificial Sequence
  Peptide Derived from Human Papillomavirus
FGTFKLRA

SEQ ID NO: 32853 - protein, 8 aa, Artificial Sequence
  Peptide Derived from Human Papillomavirus
FGVNPTIA

SEQ ID NO: 32854 - protein, 11 aa, Artificial Sequence
  Peptide Derived from Human Papillomavirus
FGVNPTIAEGF

SEQ ID NO: 32855 - protein, 8 aa, Artificial Sequence
  Peptide Derived from Human Papillomavirus
FIDTQGTF

SEQ ID NO: 32856 - protein, 8 aa, Artificial Sequence
  Peptide Derived from Human Papillomavirus
FIHFIQGA

SEQ ID NO: 32857 - protein, 9 aa, Artificial Sequence
  Peptide Derived from Human Papillomavirus
FIQGAVISF

SEQ ID NO: 32858 - protein, 9 aa, Artificial Sequence
  Peptide Derived from Human Papillomavirus
FITFLGALK

SEQ ID NO: 32859 - protein, 11 aa, Artificial Sequence
  Peptide Derived from Human Papillomavirus
FITFLGALKSF

SEQ ID NO: 32860 - protein, 8 aa, Artificial Sequence
  Peptide Derived from Human Papillomavirus
FLGALKSF

SEQ ID NO: 32861 - protein, 10 aa, Artificial Sequence
  Peptide Derived from Human Papillomavirus
FLGALKSFLK

SEQ ID NO: 32862 - protein, 8 aa, Artificial Sequence
  Peptide Derived from Human Papillomavirus
FLKGTPKK

SEQ ID NO: 32863 - protein, 8 aa, Artificial Sequence
  Peptide Derived from Human Papillomavirus
FLKSNCQA

SEQ ID NO: 32864 - protein, 9 aa, Artificial Sequence
  Peptide Derived from Human Papillomavirus
FLKSNCQAK

SEQ ID NO: 32865 - protein, 10 aa, Artificial Sequence
  Peptide Derived from Human Papillomavirus
FLKSNCQAKY

SEQ ID NO: 32866 - protein, 9 aa, Artificial Sequence
  Peptide Derived from Human Papillomavirus
FLRYQQIEF

SEQ ID NO: 32867 - protein, 8 aa, Artificial Sequence
  Peptide Derived from Human Papillomavirus
FTDLVRNF

SEQ ID NO: 32868 - protein, 9 aa, Artificial Sequence
  Peptide Derived from Human Papillomavirus
FTDLVRNFK

SEQ ID NO: 32869 - protein, 8 aa, Artificial Sequence
  Peptide Derived from Human Papillomavirus
FTISDSGY

SEQ ID NO: 32870 - protein, 8 aa, Artificial Sequence
  Peptide Derived from Human Papillomavirus
FVNSTSHF

SEQ ID NO: 32871 - protein, 8 aa, Artificial Sequence
  Peptide Derived from Human Papillomavirus
GALKSFLK

SEQ ID NO: 32872 - protein, 8 aa, Artificial Sequence
  Peptide Derived from Human Papillomavirus
GAMLAVFK

SEQ ID NO: 32873 - protein, 11 aa, Artificial Sequence
  Peptide Derived from Human Papillomavirus
GAMLAVFKDTY

SEQ ID NO: 32874 - protein, 10 aa, Artificial Sequence
  Peptide Derived from Human Papillomavirus
GCNGWFYVQA

SEQ ID NO: 32875 - protein, 9 aa, Artificial Sequence
  Peptide Derived from Human Papillomavirus
GDTPEWIQR

SEQ ID NO: 32876 - protein, 9 aa, Artificial Sequence
  Peptide Derived from Human Papillomavirus
GDWRPIVQF

SEQ ID NO: 32877 - protein, 11 aa, Artificial Sequence
  Peptide Derived from Human Papillomavirus
GDWRPIVQFLR

SEQ ID NO: 32878 - protein, 9 aa, Artificial Sequence
  Peptide Derived from Human Papillomavirus
GFKTLIQPF

SEQ ID NO: 32879 - protein, 10 aa, Artificial Sequence
  Peptide Derived from Human Papillomavirus
GGDWRPIVQF

SEQ ID NO: 32880 - protein, 9 aa, Artificial Sequence
  Peptide Derived from Human Papillomavirus
GLSFTDLVR

SEQ ID NO: 32881 - protein, 11 aa, Artificial Sequence
  Peptide Derived from Human Papillomavirus
GLSFTDLVRNF

SEQ ID NO: 32882 - protein, 11 aa, Artificial Sequence
  Peptide Derived from Human Papillomavirus
GMSFIHFIQGA

SEQ ID NO: 32883 - protein, 11 aa, Artificial Sequence
  Peptide Derived from Human Papillomavirus
GSTENSPLGER

SEQ ID NO: 32884 - protein, 11 aa, Artificial Sequence
  Peptide Derived from Human Papillomavirus
GTFKLRAGQNH

SEQ ID NO: 32885 - protein, 8 aa, Artificial Sequence
  Peptide Derived from Human Papillomavirus
GTGCNGWF

SEQ ID NO: 32886 - protein, 9 aa, Artificial Sequence
  Peptide Derived from Human Papillomavirus
GTGCNGWFY

SEQ ID NO: 32887 - protein, 10 aa, Artificial Sequence
  Peptide Derived from Human Papillomavirus
GTPKKNCLVF

SEQ ID NO: 32888 - protein, 9 aa, Artificial Sequence
  Peptide Derived from Human Papillomavirus
GVLILALLR

SEQ ID NO: 32889 - protein, 10 aa, Artificial Sequence
  Peptide Derived from Human Papillomavirus
GVLILALLRY

SEQ ID NO: 32890 - protein, 11 aa, Artificial Sequence
  Peptide Derived from Human Papillomavirus
GVLILALLRYK

SEQ ID NO: 32891 - protein, 10 aa, Artificial Sequence
  Peptide Derived from Human Papillomavirus
GVNPTIAEGF

SEQ ID NO: 32892 - protein, 11 aa, Artificial Sequence
  Peptide Derived from Human Papillomavirus
GVNPTIAEGFK

SEQ ID NO: 32893 - protein, 9 aa, Artificial Sequence
  Peptide Derived from Human Papillomavirus
HAQEVHNDA

SEQ ID NO: 32894 - protein, 10 aa, Artificial Sequence
  Peptide Derived from Human Papillomavirus
HFIQGAVISF

SEQ ID NO: 32895 - protein, 11 aa, Artificial Sequence
  Peptide Derived from Human Papillomavirus
HFWLEPLTDTK

SEQ ID NO: 32896 - protein, 8 aa, Artificial Sequence
  Peptide Derived from Human Papillomavirus
HGIDDSNF

SEQ ID NO: 32897 - protein, 8 aa, Artificial Sequence
  Peptide Derived from Human Papillomavirus
HIQCLDCK

SEQ ID NO: 32898 - protein, 8 aa, Artificial Sequence
  Peptide Derived from Human Papillomavirus
HVLKRKFA

SEQ ID NO: 32899 - protein, 9 aa, Artificial Sequence
  Peptide Derived from Human Papillomavirus
IAQLKDLLK

SEQ ID NO: 32900 - protein, 8 aa, Artificial Sequence
  Peptide Derived from Human Papillomavirus
IDEGGDWR

SEQ ID NO: 32901 - protein, 11 aa, Artificial Sequence
  Peptide Derived from Human Papillomavirus
IDTQGTFCEQA

SEQ ID NO: 32902 - protein, 9 aa, Artificial Sequence
  Peptide Derived from Human Papillomavirus
IFGVNPTIA

SEQ ID NO: 32903 - protein, 11 aa, Artificial Sequence
  Peptide Derived from Human Papillomavirus
IIQHGIDDSNF

SEQ ID NO: 32904 - protein, 8 aa, Artificial Sequence
  Peptide Derived from Human Papillomavirus
ILALLRYK

SEQ ID NO: 32905 - protein, 11 aa, Artificial Sequence
  Peptide Derived from Human Papillomavirus
ILALLRYKCGK

SEQ ID NO: 32906 - protein, 8 aa, Artificial Sequence
  Peptide Derived from Human Papillomavirus
ILLTTNIH

SEQ ID NO: 32907 - protein, 10 aa, Artificial Sequence
  Peptide Derived from Human Papillomavirus
ILLTTNIHPA

SEQ ID NO: 32908 - protein, 11 aa, Artificial Sequence
  Peptide Derived from Human Papillomavirus
ILLTTNIHPAK

SEQ ID NO: 32909 - protein, 9 aa, Artificial Sequence
  Peptide Derived from Human Papillomavirus
ISDDEDENA

SEQ ID NO: 32910 - protein, 9 aa, Artificial Sequence
  Peptide Derived from Human Papillomavirus
ISFVNSTSH

SEQ ID NO: 32911 - protein, 10 aa, Artificial Sequence
  Peptide Derived from Human Papillomavirus
ISFVNSTSHF

SEQ ID NO: 32912 - protein, 8 aa, Artificial Sequence
  Peptide Derived from Human Papillomavirus
ISIDRKHK

SEQ ID NO: 32913 - protein, 8 aa, Artificial Sequence
  Peptide Derived from Human Papillomavirus
ISLNSGQK

SEQ ID NO: 32914 - protein, 9 aa, Artificial Sequence
  Peptide Derived from Human Papillomavirus
ISLNSGQKK

SEQ ID NO: 32915 - protein, 10 aa, Artificial Sequence
  Peptide Derived from Human Papillomavirus
ISLNSGQKKA

SEQ ID NO: 32916 - protein, 11 aa, Artificial Sequence
  Peptide Derived from Human Papillomavirus
ISLNSGQKKAK

SEQ ID NO: 32917 - protein, 8 aa, Artificial Sequence
  Peptide Derived from Human Papillomavirus
ITFLGALK

SEQ ID NO: 32918 - protein, 10 aa, Artificial Sequence
  Peptide Derived from Human Papillomavirus
ITFLGALKSF

SEQ ID NO: 32919 - protein, 9 aa, Artificial Sequence
  Peptide Derived from Human Papillomavirus
ITVFEFPNA

SEQ ID NO: 32920 - protein, 10 aa, Artificial Sequence
  Peptide Derived from Human Papillomavirus
ITVFEFPNAF

SEQ ID NO: 32921 - protein, 10 aa, Artificial Sequence
  Peptide Derived from Human Papillomavirus
KCFFERTWSR

SEQ ID NO: 32922 - protein, 10 aa, Artificial Sequence
  Peptide Derived from Human Papillomavirus
KCGKSRLTVA

SEQ ID NO: 32923 - protein, 11 aa, Artificial Sequence
  Peptide Derived from Human Papillomavirus
KCGKSRLTVAK

SEQ ID NO: 32924 - protein, 8 aa, Artificial Sequence
  Peptide Derived from Human Papillomavirus
KDCATMCK

SEQ ID NO: 32925 - protein, 9 aa, Artificial Sequence
  Peptide Derived from Human Papillomavirus
KDCATMCKH

SEQ ID NO: 32926 - protein, 10 aa, Artificial Sequence
  Peptide Derived from Human Papillomavirus
KDCATMCKHY

SEQ ID NO: 32927 - protein, 11 aa, Artificial Sequence
  Peptide Derived from Human Papillomavirus
KDCATMCKHYR

SEQ ID NO: 32928 - protein, 9 aa, Artificial Sequence
  Peptide Derived from Human Papillomavirus
KDLLKVNNK

SEQ ID NO: 32929 - protein, 11 aa, Artificial Sequence
  Peptide Derived from Human Papillomavirus
KDNRWPYLESR

SEQ ID NO: 32930 - protein, 8 aa, Artificial Sequence
  Peptide Derived from Human Papillomavirus
KDTYGLSF

SEQ ID NO: 32931 - protein, 8 aa, Artificial Sequence
  Peptide Derived from Human Papillomavirus
KGLSTLLH

SEQ ID NO: 32932 - protein, 11 aa, Artificial Sequence
  Peptide Derived from Human Papillomavirus
KGTPKKNCLVF

SEQ ID NO: 32933 - protein, 9 aa, Artificial Sequence
  Peptide Derived from Human Papillomavirus
KIDEGGDWR

SEQ ID NO: 32934 - protein, 8 aa, Artificial Sequence
  Peptide Derived from Human Papillomavirus
KLRAGQNH

SEQ ID NO: 32935 - protein, 9 aa, Artificial Sequence
  Peptide Derived from Human Papillomavirus
KLRAGQNHR

SEQ ID NO: 32936 - protein, 8 aa, Artificial Sequence
  Peptide Derived from Human Papillomavirus
KLRSSVAA

SEQ ID NO: 32937 - protein, 10 aa, Artificial Sequence
  Peptide Derived from Human Papillomavirus
KLRSSVAALY

SEQ ID NO: 32938 - protein, 9 aa, Artificial Sequence
  Peptide Derived from Human Papillomavirus
KSFLKGTPK

SEQ ID NO: 32939 - protein, 10 aa, Artificial Sequence
  Peptide Derived from Human Papillomavirus
KSFLKGTPKK

SEQ ID NO: 32940 - protein, 8 aa, Artificial Sequence
  Peptide Derived from Human Papillomavirus
KSNCQAKY

SEQ ID NO: 32941 - protein, 10 aa, Artificial Sequence
  Peptide Derived from Human Papillomavirus
KSNCQAKYLK

SEQ ID NO: 32942 - protein, 8 aa, Artificial Sequence
  Peptide Derived from Human Papillomavirus
KSRLTVAK

SEQ ID NO: 32943 - protein, 8 aa, Artificial Sequence
  Peptide Derived from Human Papillomavirus
KSYFGMSF

SEQ ID NO: 32944 - protein, 10 aa, Artificial Sequence
  Peptide Derived from Human Papillomavirus
KSYFGMSFIH

SEQ ID NO: 32945 - protein, 11 aa, Artificial Sequence
  Peptide Derived from Human Papillomavirus
KSYFGMSFIHF

SEQ ID NO: 32946 - protein, 10 aa, Artificial Sequence
  Peptide Derived from Human Papillomavirus
KTLIQPFILY

SEQ ID NO: 32947 - protein, 11 aa, Artificial Sequence
  Peptide Derived from Human Papillomavirus
KTLIQPFILYA

SEQ ID NO: 32948 - protein, 10 aa, Artificial Sequence
  Peptide Derived from Human Papillomavirus
KTTCTDWVTA

SEQ ID NO: 32949 - protein, 8 aa, Artificial Sequence
  Peptide Derived from Human Papillomavirus
KVAMLDDA

SEQ ID NO: 32950 - protein, 8 aa, Artificial Sequence
  Peptide Derived from Human Papillomavirus
KVNNKQGA

SEQ ID NO: 32951 - protein, 11 aa, Artificial Sequence
  Peptide Derived from Human Papillomavirus
KVNNKQGAMLA

SEQ ID NO: 32952 - protein, 8 aa, Artificial Sequence
  Peptide Derived from Human Papillomavirus
LADSNSNA

SEQ ID NO: 32953 - protein, 9 aa, Artificial Sequence
  Peptide Derived from Human Papillomavirus
LADSNSNAA

SEQ ID NO: 32954 - protein, 10 aa, Artificial Sequence
  Peptide Derived from Human Papillomavirus
LADSNSNAAA

SEQ ID NO: 32955 - protein, 11 aa, Artificial Sequence
  Peptide Derived from Human Papillomavirus
LADSNSNAAAF

SEQ ID NO: 32956 - protein, 10 aa, Artificial Sequence
  Peptide Derived from Human Papillomavirus
LALLRYKCGK

SEQ ID NO: 32957 - protein, 8 aa, Artificial Sequence
  Peptide Derived from Human Papillomavirus
LAVFKDTY

SEQ ID NO: 32958 - protein, 11 aa, Artificial Sequence
  Peptide Derived from Human Papillomavirus
LDCKWGVLILA

SEQ ID NO: 32959 - protein, 11 aa, Artificial Sequence
  Peptide Derived from Human Papillomavirus
LDDATTTCWTY

SEQ ID NO: 32960 - protein, 10 aa, Artificial Sequence
  Peptide Derived from Human Papillomavirus
LDGNPISIDR

SEQ ID NO: 32961 - protein, 11 aa, Artificial Sequence
  Peptide Derived from Human Papillomavirus
LDGNPISIDRK

SEQ ID NO: 32962 - protein, 10 aa, Artificial Sequence
  Peptide Derived from Human Papillomavirus
LDLHEEEEDA

SEQ ID NO: 32963 - protein, 8 aa, Artificial Sequence
  Peptide Derived from Human Papillomavirus
LFHAQEVH

SEQ ID NO: 32964 - protein, 11 aa, Artificial Sequence
  Peptide Derived from Human Papillomavirus
LFHAQEVHNDA

SEQ ID NO: 32965 - protein, 9 aa, Artificial Sequence
  Peptide Derived from Human Papillomavirus
LFTISDSGY

SEQ ID NO: 32966 - protein, 9 aa, Artificial Sequence
  Peptide Derived from Human Papillomavirus
LGALKSFLK

SEQ ID NO: 32967 - protein, 8 aa, Artificial Sequence
  Peptide Derived from Human Papillomavirus
LILALLRY

SEQ ID NO: 32968 - protein, 9 aa, Artificial Sequence
  Peptide Derived from Human Papillomavirus
LILALLRYK

SEQ ID NO: 32969 - protein, 8 aa, Artificial Sequence
  Peptide Derived from Human Papillomavirus
LIQPFILY

SEQ ID NO: 32970 - protein, 9 aa, Artificial Sequence
  Peptide Derived from Human Papillomavirus
LIQPFILYA

SEQ ID NO: 32971 - protein, 10 aa, Artificial Sequence
  Peptide Derived from Human Papillomavirus
LIQPFILYAH

SEQ ID NO: 32972 - protein, 8 aa, Artificial Sequence
  Peptide Derived from Human Papillomavirus
LIQPPKLR

SEQ ID NO: 32973 - protein, 9 aa, Artificial Sequence
  Peptide Derived from Human Papillomavirus
LLADSNSNA

SEQ ID NO: 32974 - protein, 10 aa, Artificial Sequence
  Peptide Derived from Human Papillomavirus
LLADSNSNAA

SEQ ID NO: 32975 - protein, 11 aa, Artificial Sequence
  Peptide Derived from Human Papillomavirus
LLADSNSNAAA

SEQ ID NO: 32976 - protein, 10 aa, Artificial Sequence
  Peptide Derived from Human Papillomavirus
LLKVNNKQGA

SEQ ID NO: 32977 - protein, 8 aa, Artificial Sequence
  Peptide Derived from Human Papillomavirus
LLRYKCGK

SEQ ID NO: 32978 - protein, 10 aa, Artificial Sequence
  Peptide Derived from Human Papillomavirus
LLRYKCGKSR

SEQ ID NO: 32979 - protein, 9 aa, Artificial Sequence
  Peptide Derived from Human Papillomavirus
LLTTNIHPA

SEQ ID NO: 32980 - protein, 10 aa, Artificial Sequence
  Peptide Derived from Human Papillomavirus
LLTTNIHPAK

SEQ ID NO: 32981 - protein, 8 aa, Artificial Sequence
  Peptide Derived from Human Papillomavirus
LSEMVQWA

SEQ ID NO: 32982 - protein, 9 aa, Artificial Sequence
  Peptide Derived from Human Papillomavirus
LSEMVQWAF

SEQ ID NO: 32983 - protein, 8 aa, Artificial Sequence
  Peptide Derived from Human Papillomavirus
LSFTDLVR

SEQ ID NO: 32984 - protein, 10 aa, Artificial Sequence
  Peptide Derived from Human Papillomavirus
LSFTDLVRNF

SEQ ID NO: 32985 - protein, 11 aa, Artificial Sequence
  Peptide Derived from Human Papillomavirus
LSFTDLVRNFK

SEQ ID NO: 32986 - protein, 8 aa, Artificial Sequence
  Peptide Derived from Human Papillomavirus
LTDESDMA

SEQ ID NO: 32987 - protein, 9 aa, Artificial Sequence
  Peptide Derived from Human Papillomavirus
LTDESDMAF

SEQ ID NO: 32988 - protein, 11 aa, Artificial Sequence
  Peptide Derived from Human Papillomavirus
LTDESDMAFEY

SEQ ID NO: 32989 - protein, 8 aa, Artificial Sequence
  Peptide Derived from Human Papillomavirus
LTTNIHPA

SEQ ID NO: 32990 - protein, 9 aa, Artificial Sequence
  Peptide Derived from Human Papillomavirus
LTTNIHPAK

SEQ ID NO: 32991 - protein, 11 aa, Artificial Sequence
  Peptide Derived from Human Papillomavirus
LVFCGPANTGK

SEQ ID NO: 32992 - protein, 9 aa, Artificial Sequence
  Peptide Derived from Human Papillomavirus
LVRNFKSDK

SEQ ID NO: 32993 - protein, 9 aa, Artificial Sequence
  Peptide Derived from Human Papillomavirus
MAFEYALLA

SEQ ID NO: 32994 - protein, 8 aa, Artificial Sequence
  Peptide Derived from Human Papillomavirus
MCKHYRRA

SEQ ID NO: 32995 - protein, 10 aa, Artificial Sequence
  Peptide Derived from Human Papillomavirus
MCKHYRRAQK

SEQ ID NO: 32996 - protein, 11 aa, Artificial Sequence
  Peptide Derived from Human Papillomavirus
MCKHYRRAQKR

SEQ ID NO: 32997 - protein, 10 aa, Artificial Sequence
  Peptide Derived from Human Papillomavirus
MGDTPEWIQR

SEQ ID NO: 32998 - protein, 9 aa, Artificial Sequence
  Peptide Derived from Human Papillomavirus
MLAVFKDTY

SEQ ID NO: 32999 - protein, 9 aa, Artificial Sequence
  Peptide Derived from Human Papillomavirus
MLIQPPKLR

SEQ ID NO: 33000 - protein, 10 aa, Artificial Sequence
  Peptide Derived from Human Papillomavirus
MSFIHFIQGA

SEQ ID NO: 33001 - protein, 8 aa, Artificial Sequence
  Peptide Derived from Human Papillomavirus
MSQWIRFR

SEQ ID NO: 33002 - protein, 11 aa, Artificial Sequence
  Peptide Derived from Human Papillomavirus
MSQWIRFRCSK

SEQ ID NO: 33003 - protein, 11 aa, Artificial Sequence
  Peptide Derived from Human Papillomavirus
MVDFIDTQGTF

SEQ ID NO: 33004 - protein, 9 aa, Artificial Sequence
  Peptide Derived from Human Papillomavirus
NCLVFCGPA

SEQ ID NO: 33005 - protein, 8 aa, Artificial Sequence
  Peptide Derived from Human Papillomavirus
NCQAKYLK

SEQ ID NO: 33006 - protein, 11 aa, Artificial Sequence
  Peptide Derived from Human Papillomavirus
NCQAKYLKDCA

SEQ ID NO: 33007 - protein, 10 aa, Artificial Sequence
  Peptide Derived from Human Papillomavirus
NDAQVLHVLK

SEQ ID NO: 33008 - protein, 11 aa, Artificial Sequence
  Peptide Derived from Human Papillomavirus
NDAQVLHVLKR

SEQ ID NO: 33009 - protein, 8 aa, Artificial Sequence
  Peptide Derived from Human Papillomavirus
NDKNWKCF

SEQ ID NO: 33010 - protein, 9 aa, Artificial Sequence
  Peptide Derived from Human Papillomavirus
NDKNWKCFF

SEQ ID NO: 33011 - protein, 11 aa, Artificial Sequence
  Peptide Derived from Human Papillomavirus
NDKNWKCFFER

SEQ ID NO: 33012 - protein, 11 aa, Artificial Sequence
  Peptide Derived from Human Papillomavirus
NFDLSEMVQWA

SEQ ID NO: 33013 - protein, 11 aa, Artificial Sequence
  Peptide Derived from Human Papillomavirus
NGNPVYEINDK

SEQ ID NO: 33014 - protein, 8 aa, Artificial Sequence
  Peptide Derived from Human Papillomavirus
NGWFYVQA

SEQ ID NO: 33015 - protein, 9 aa, Artificial Sequence
  Peptide Derived from Human Papillomavirus
NIHPAKDNR

SEQ ID NO: 33016 - protein, 8 aa, Artificial Sequence
  Peptide Derived from Human Papillomavirus
NMSQWIRF

SEQ ID NO: 33017 - protein, 9 aa, Artificial Sequence
  Peptide Derived from Human Papillomavirus
NMSQWIRFR

SEQ ID NO: 33018 - protein, 8 aa, Artificial Sequence
  Peptide Derived from Human Papillomavirus
NSGQKKAK

SEQ ID NO: 33019 - protein, 9 aa, Artificial Sequence
  Peptide Derived from Human Papillomavirus
NSGQKKAKR

SEQ ID NO: 33020 - protein, 10 aa, Artificial Sequence
  Peptide Derived from Human Papillomavirus
NSGQKKAKRR

SEQ ID NO: 33021 - protein, 9 aa, Artificial Sequence
  Peptide Derived from Human Papillomavirus
NSNAAAFLK

SEQ ID NO: 33022 - protein, 11 aa, Artificial Sequence
  Peptide Derived from Human Papillomavirus
NTGKSYFGMSF

SEQ ID NO: 33023 - protein, 10 aa, Artificial Sequence
  Peptide Derived from Human Papillomavirus
NVCSGGSTEA

SEQ ID NO: 33024 - protein, 9 aa, Artificial Sequence
  Peptide Derived from Human Papillomavirus
NVNPQCTIA

SEQ ID NO: 33025 - protein, 9 aa, Artificial Sequence
  Peptide Derived from Human Papillomavirus
PAKDNRWPY

SEQ ID NO: 33026 - protein, 8 aa, Artificial Sequence
  Peptide Derived from Human Papillomavirus
PANTGKSY

SEQ ID NO: 33027 - protein, 9 aa, Artificial Sequence
  Peptide Derived from Human Papillomavirus
PANTGKSYF

SEQ ID NO: 33028 - protein, 10 aa, Artificial Sequence
  Peptide Derived from Human Papillomavirus
PFDKNGNPVY

SEQ ID NO: 33029 - protein, 8 aa, Artificial Sequence
  Peptide Derived from Human Papillomavirus
PFGTFKLR

SEQ ID NO: 33030 - protein, 9 aa, Artificial Sequence
  Peptide Derived from Human Papillomavirus
PFGTFKLRA

SEQ ID NO: 33031 - protein, 9 aa, Artificial Sequence
  Peptide Derived from Human Papillomavirus
PILLTTNIH

SEQ ID NO: 33032 - protein, 11 aa, Artificial Sequence
  Peptide Derived from Human Papillomavirus
PILLTTNIHPA

SEQ ID NO: 33033 - protein, 8 aa, Artificial Sequence
  Peptide Derived from Human Papillomavirus
PISIDRKH

SEQ ID NO: 33034 - protein, 9 aa, Artificial Sequence
  Peptide Derived from Human Papillomavirus
PISIDRKHK

SEQ ID NO: 33035 - protein, 8 aa, Artificial Sequence
  Peptide Derived from Human Papillomavirus
PIVQFLRY

SEQ ID NO: 33036 - protein, 8 aa, Artificial Sequence
  Peptide Derived from Human Papillomavirus
PLTDTKVA

SEQ ID NO: 33037 - protein, 8 aa, Artificial Sequence
  Peptide Derived from Human Papillomavirus
PTIAEGFK

SEQ ID NO: 33038 - protein, 8 aa, Artificial Sequence
  Peptide Derived from Human Papillomavirus
PVYEINDK

SEQ ID NO: 33039 - protein, 11 aa, Artificial Sequence
  Peptide Derived from Human Papillomavirus
PVYEINDKNWK

SEQ ID NO: 33040 - protein, 9 aa, Artificial Sequence
  Peptide Derived from Human Papillomavirus
QAELETAQA

SEQ ID NO: 33041 - protein, 11 aa, Artificial Sequence
  Peptide Derived from Human Papillomavirus
QAELETAQALF

SEQ ID NO: 33042 - protein, 9 aa, Artificial Sequence
  Peptide Derived from Human Papillomavirus
QAKYLKDCA

SEQ ID NO: 33043 - protein, 10 aa, Artificial Sequence
  Peptide Derived from Human Papillomavirus
QALFHAQEVH

SEQ ID NO: 33044 - protein, 8 aa, Artificial Sequence
  Peptide Derived from Human Papillomavirus
QCTIAQLK

SEQ ID NO: 33045 - protein, 10 aa, Artificial Sequence
  Peptide Derived from Human Papillomavirus
QFLRYQQIEF

SEQ ID NO: 33046 - protein, 8 aa, Artificial Sequence
  Peptide Derived from Human Papillomavirus
QGAMLAVF

SEQ ID NO: 33047 - protein, 9 aa, Artificial Sequence
  Peptide Derived from Human Papillomavirus
QGAMLAVFK

SEQ ID NO: 33048 - protein, 8 aa, Artificial Sequence
  Peptide Derived from Human Papillomavirus
QGTFCEQA

SEQ ID NO: 33049 - protein, 10 aa, Artificial Sequence
  Peptide Derived from Human Papillomavirus
QIEFITFLGA

SEQ ID NO: 33050 - protein, 10 aa, Artificial Sequence
  Peptide Derived from Human Papillomavirus
QIQVTTNGEH

SEQ ID NO: 33051 - protein, 11 aa, Artificial Sequence
  Peptide Derived from Human Papillomavirus
QLKDLLKVNNK

SEQ ID NO: 33052 - protein, 9 aa, Artificial Sequence
  Peptide Derived from Human Papillomavirus
QMNMSQWIR

SEQ ID NO: 33053 - protein, 10 aa, Artificial Sequence
  Peptide Derived from Human Papillomavirus
QMNMSQWIRF

SEQ ID NO: 33054 - protein, 11 aa, Artificial Sequence
  Peptide Derived from Human Papillomavirus
QMNMSQWIRFR

SEQ ID NO: 33055 - protein, 8 aa, Artificial Sequence
  Peptide Derived from Human Papillomavirus
QVLHVLKR

SEQ ID NO: 33056 - protein, 9 aa, Artificial Sequence
  Peptide Derived from Human Papillomavirus
QVLHVLKRK

SEQ ID NO: 33057 - protein, 10 aa, Artificial Sequence
  Peptide Derived from Human Papillomavirus
QVLHVLKRKF

SEQ ID NO: 33058 - protein, 11 aa, Artificial Sequence
  Peptide Derived from Human Papillomavirus
QVLHVLKRKFA

SEQ ID NO: 33059 - protein, 8 aa, Artificial Sequence
  Peptide Derived from Human Papillomavirus
QVTTNGEH

SEQ ID NO: 33060 - protein, 10 aa, Artificial Sequence
  Peptide Derived from Human Papillomavirus
RITVFEFPNA

SEQ ID NO: 33061 - protein, 11 aa, Artificial Sequence
  Peptide Derived from Human Papillomavirus
RITVFEFPNAF

SEQ ID NO: 33062 - protein, 11 aa, Artificial Sequence
  Peptide Derived from Human Papillomavirus
RLDLHEEEEDA

SEQ ID NO: 33063 - protein, 11 aa, Artificial Sequence
  Peptide Derived from Human Papillomavirus
RLEVDTELSPR

SEQ ID NO: 33064 - protein, 10 aa, Artificial Sequence
  Peptide Derived from Human Papillomavirus
RLFTISDSGY

SEQ ID NO: 33065 - protein, 8 aa, Artificial Sequence
  Peptide Derived from Human Papillomavirus
RSSVAALY

SEQ ID NO: 33066 - protein, 10 aa, Artificial Sequence
  Peptide Derived from Human Papillomavirus
RSSVAALYWY

SEQ ID NO: 33067 - protein, 11 aa, Artificial Sequence
  Peptide Derived from Human Papillomavirus
RSSVAALYWYR

SEQ ID NO: 33068 - protein, 9 aa, Artificial Sequence
  Peptide Derived from Human Papillomavirus
RTWSRLDLH

SEQ ID NO: 33069 - protein, 8 aa, Artificial Sequence
  Peptide Derived from Human Papillomavirus
SDDEDENA

SEQ ID NO: 33070 - protein, 8 aa, Artificial Sequence
  Peptide Derived from Human Papillomavirus
SDMAFEYA

SEQ ID NO: 33071 - protein, 11 aa, Artificial Sequence
  Peptide Derived from Human Papillomavirus
SDMAFEYALLA

SEQ ID NO: 33072 - protein, 9 aa, Artificial Sequence
  Peptide Derived from Human Papillomavirus
SFIHFIQGA

SEQ ID NO: 33073 - protein, 8 aa, Artificial Sequence
  Peptide Derived from Human Papillomavirus
SFLKGTPK

SEQ ID NO: 33074 - protein, 9 aa, Artificial Sequence
  Peptide Derived from Human Papillomavirus
SFLKGTPKK

SEQ ID NO: 33075 - protein, 9 aa, Artificial Sequence
  Peptide Derived from Human Papillomavirus
SFTDLVRNF

SEQ ID NO: 33076 - protein, 10 aa, Artificial Sequence
  Peptide Derived from Human Papillomavirus
SFTDLVRNFK

SEQ ID NO: 33077 - protein, 8 aa, Artificial Sequence
  Peptide Derived from Human Papillomavirus
SFVNSTSH

SEQ ID NO: 33078 - protein, 9 aa, Artificial Sequence
  Peptide Derived from Human Papillomavirus
SFVNSTSHF

SEQ ID NO: 33079 - protein, 8 aa, Artificial Sequence
  Peptide Derived from Human Papillomavirus
SGQKKAKR

SEQ ID NO: 33080 - protein, 9 aa, Artificial Sequence
  Peptide Derived from Human Papillomavirus
SGQKKAKRR

SEQ ID NO: 33081 - protein, 11 aa, Artificial Sequence
  Peptide Derived from Human Papillomavirus
SGQKKAKRRLF

SEQ ID NO: 33082 - protein, 10 aa, Artificial Sequence
  Peptide Derived from Human Papillomavirus
SGYGCSEVEA

SEQ ID NO: 33083 - protein, 8 aa, Artificial Sequence
  Peptide Derived from Human Papillomavirus
SLNSGQKK

SEQ ID NO: 33084 - protein, 9 aa, Artificial Sequence
  Peptide Derived from Human Papillomavirus
SLNSGQKKA

SEQ ID NO: 33085 - protein, 10 aa, Artificial Sequence
  Peptide Derived from Human Papillomavirus
SLNSGQKKAK

SEQ ID NO: 33086 - protein, 11 aa, Artificial Sequence
  Peptide Derived from Human Papillomavirus
SLNSGQKKAKR

SEQ ID NO: 33087 - protein, 9 aa, Artificial Sequence
  Peptide Derived from Human Papillomavirus
SSVAALYWY

SEQ ID NO: 33088 - protein, 10 aa, Artificial Sequence
  Peptide Derived from Human Papillomavirus
SSVAALYWYR

SEQ ID NO: 33089 - protein, 10 aa, Artificial Sequence
  Peptide Derived from Human Papillomavirus
STENSPLGER

SEQ ID NO: 33090 - protein, 8 aa, Artificial Sequence
  Peptide Derived from Human Papillomavirus
SVAALYWY

SEQ ID NO: 33091 - protein, 9 aa, Artificial Sequence
  Peptide Derived from Human Papillomavirus
SVAALYWYR

SEQ ID NO: 33092 - protein, 11 aa, Artificial Sequence
  Peptide Derived from Human Papillomavirus
TAIFGVNPTIA

SEQ ID NO: 33093 - protein, 8 aa, Artificial Sequence
  Peptide Derived from Human Papillomavirus
TAQALFHA

SEQ ID NO: 33094 - protein, 9 aa, Artificial Sequence
  Peptide Derived from Human Papillomavirus
TCMLIQPPK

SEQ ID NO: 33095 - protein, 11 aa, Artificial Sequence
  Peptide Derived from Human Papillomavirus
TCMLIQPPKLR

SEQ ID NO: 33096 - protein, 8 aa, Artificial Sequence
  Peptide Derived from Human Papillomavirus
TCTDWVTA

SEQ ID NO: 33097 - protein, 10 aa, Artificial Sequence
  Peptide Derived from Human Papillomavirus
TCTDWVTAIF

SEQ ID NO: 33098 - protein, 9 aa, Artificial Sequence
  Peptide Derived from Human Papillomavirus
TCWTYFDTY

SEQ ID NO: 33099 - protein, 11 aa, Artificial Sequence
  Peptide Derived from Human Papillomavirus
TCWTYFDTYMR

SEQ ID NO: 33100 - protein, 8 aa, Artificial Sequence
  Peptide Derived from Human Papillomavirus
TDESDMAF

SEQ ID NO: 33101 - protein, 10 aa, Artificial Sequence
  Peptide Derived from Human Papillomavirus
TDESDMAFEY

SEQ ID NO: 33102 - protein, 11 aa, Artificial Sequence
  Peptide Derived from Human Papillomavirus
TDESDMAFEYA

SEQ ID NO: 33103 - protein, 8 aa, Artificial Sequence
  Peptide Derived from Human Papillomavirus
TDLVRNFK

SEQ ID NO: 33104 - protein, 11 aa, Artificial Sequence
  Peptide Derived from Human Papillomavirus
TDLVRNFKSDK

SEQ ID NO: 33105 - protein, 10 aa, Artificial Sequence
  Peptide Derived from Human Papillomavirus
TDTGSDMVDF

SEQ ID NO: 33106 - protein, 11 aa, Artificial Sequence
  Peptide Derived from Human Papillomavirus
TDTKVAMLDDA

SEQ ID NO: 33107 - protein, 8 aa, Artificial Sequence
  Peptide Derived from Human Papillomavirus
TDWVTAIF

SEQ ID NO: 33108 - protein, 11 aa, Artificial Sequence
  Peptide Derived from Human Papillomavirus
TFCEQAELETA

SEQ ID NO: 33109 - protein, 10 aa, Artificial Sequence
  Peptide Derived from Human Papillomavirus
TFKLRAGQNH

SEQ ID NO: 33110 - protein, 11 aa, Artificial Sequence
  Peptide Derived from Human Papillomavirus
TFKLRAGQNHR

SEQ ID NO: 33111 - protein, 9 aa, Artificial Sequence
  Peptide Derived from Human Papillomavirus
TFLGALKSF

SEQ ID NO: 33112 - protein, 11 aa, Artificial Sequence
  Peptide Derived from Human Papillomavirus
TFLGALKSFLK

SEQ ID NO: 33113 - protein, 8 aa, Artificial Sequence
  Peptide Derived from Human Papillomavirus
TGCNGWFY

SEQ ID NO: 33114 - protein, 11 aa, Artificial Sequence
  Peptide Derived from Human Papillomavirus
TGCNGWFYVQA

SEQ ID NO: 33115 - protein, 10 aa, Artificial Sequence
  Peptide Derived from Human Papillomavirus
TGKSYFGMSF

SEQ ID NO: 33116 - protein, 8 aa, Artificial Sequence
  Peptide Derived from Human Papillomavirus
TGSDMVDF

SEQ ID NO: 33117 - protein, 10 aa, Artificial Sequence
  Peptide Derived from Human Papillomavirus
TIAQLKDLLK

SEQ ID NO: 33118 - protein, 9 aa, Artificial Sequence
  Peptide Derived from Human Papillomavirus
TLIQPFILY

SEQ ID NO: 33119 - protein, 10 aa, Artificial Sequence
  Peptide Derived from Human Papillomavirus
TLIQPFILYA

SEQ ID NO: 33120 - protein, 11 aa, Artificial Sequence
  Peptide Derived from Human Papillomavirus
TLIQPFILYAH

SEQ ID NO: 33121 - protein, 8 aa, Artificial Sequence
  Peptide Derived from Human Papillomavirus
TMCKHYRR

SEQ ID NO: 33122 - protein, 9 aa, Artificial Sequence
  Peptide Derived from Human Papillomavirus
TMCKHYRRA

SEQ ID NO: 33123 - protein, 11 aa, Artificial Sequence
  Peptide Derived from Human Papillomavirus
TMCKHYRRAQK

SEQ ID NO: 33124 - protein, 9 aa, Artificial Sequence
  Peptide Derived from Human Papillomavirus
TTCTDWVTA

SEQ ID NO: 33125 - protein, 11 aa, Artificial Sequence
  Peptide Derived from Human Papillomavirus
TTCTDWVTAIF

SEQ ID NO: 33126 - protein, 10 aa, Artificial Sequence
  Peptide Derived from Human Papillomavirus
TTCWTYFDTY

SEQ ID NO: 33127 - protein, 8 aa, Artificial Sequence
  Peptide Derived from Human Papillomavirus
TTNIHPAK

SEQ ID NO: 33128 - protein, 11 aa, Artificial Sequence
  Peptide Derived from Human Papillomavirus
TTNIHPAKDNR

SEQ ID NO: 33129 - protein, 8 aa, Artificial Sequence
  Peptide Derived from Human Papillomavirus
TTTCWTYF

SEQ ID NO: 33130 - protein, 11 aa, Artificial Sequence
  Peptide Derived from Human Papillomavirus
TTTCWTYFDTY

SEQ ID NO: 33131 - protein, 11 aa, Artificial Sequence
  Peptide Derived from Human Papillomavirus
TVAKGLSTLLH

SEQ ID NO: 33132 - protein, 8 aa, Artificial Sequence
  Peptide Derived from Human Papillomavirus
TVFEFPNA

SEQ ID NO: 33133 - protein, 9 aa, Artificial Sequence
  Peptide Derived from Human Papillomavirus
TVFEFPNAF

SEQ ID NO: 33134 - protein, 11 aa, Artificial Sequence
  Peptide Derived from Human Papillomavirus
TVFEFPNAFPF

SEQ ID NO: 33135 - protein, 8 aa, Artificial Sequence
  Peptide Derived from Human Papillomavirus
VAALYWYR

SEQ ID NO: 33136 - protein, 10 aa, Artificial Sequence
  Peptide Derived from Human Papillomavirus
VAKGLSTLLH

SEQ ID NO: 33137 - protein, 9 aa, Artificial Sequence
  Peptide Derived from Human Papillomavirus
VCSGGSTEA

SEQ ID NO: 33138 - protein, 10 aa, Artificial Sequence
  Peptide Derived from Human Papillomavirus
VDFIDTQGTF

SEQ ID NO: 33139 - protein, 8 aa, Artificial Sequence
  Peptide Derived from Human Papillomavirus
VDTELSPR

SEQ ID NO: 33140 - protein, 10 aa, Artificial Sequence
  Peptide Derived from Human Papillomavirus
VFCGPANTGK

SEQ ID NO: 33141 - protein, 8 aa, Artificial Sequence
  Peptide Derived from Human Papillomavirus
VFEFPNAF

SEQ ID NO: 33142 - protein, 10 aa, Artificial Sequence
  Peptide Derived from Human Papillomavirus
VFEFPNAFPF

SEQ ID NO: 33143 - protein, 10 aa, Artificial Sequence
  Peptide Derived from Human Papillomavirus
VFKDTYGLSF

SEQ ID NO: 33144 - protein, 10 aa, Artificial Sequence
  Peptide Derived from Human Papillomavirus
VISDDEDENA

SEQ ID NO: 33145 - protein, 10 aa, Artificial Sequence
  Peptide Derived from Human Papillomavirus
VISFVNSTSH

SEQ ID NO: 33146 - protein, 11 aa, Artificial Sequence
  Peptide Derived from Human Papillomavirus
VISFVNSTSHF

SEQ ID NO: 33147 - protein, 8 aa, Artificial Sequence
  Peptide Derived from Human Papillomavirus
VLHVLKRK

SEQ ID NO: 33148 - protein, 9 aa, Artificial Sequence
  Peptide Derived from Human Papillomavirus
VLHVLKRKF

SEQ ID NO: 33149 - protein, 10 aa, Artificial Sequence
  Peptide Derived from Human Papillomavirus
VLHVLKRKFA

SEQ ID NO: 33150 - protein, 8 aa, Artificial Sequence
  Peptide Derived from Human Papillomavirus
VLILALLR

SEQ ID NO: 33151 - protein, 9 aa, Artificial Sequence
  Peptide Derived from Human Papillomavirus
VLILALLRY

SEQ ID NO: 33152 - protein, 10 aa, Artificial Sequence
  Peptide Derived from Human Papillomavirus
VLILALLRYK

SEQ ID NO: 33153 - protein, 11 aa, Artificial Sequence
  Peptide Derived from Human Papillomavirus
VMGDTPEWIQR

SEQ ID NO: 33154 - protein, 10 aa, Artificial Sequence
  Peptide Derived from Human Papillomavirus
WFYVQAIVDK

SEQ ID NO: 33155 - protein, 11 aa, Artificial Sequence
  Peptide Derived from Human Papillomavirus
WFYVQAIVDKK

SEQ ID NO: 33156 - protein, 10 aa, Artificial Sequence
  Peptide Derived from Human Papillomavirus
WGVLILALLR

SEQ ID NO: 33157 - protein, 11 aa, Artificial Sequence
  Peptide Derived from Human Papillomavirus
WGVLILALLRY

SEQ ID NO: 33158 - protein, 10 aa, Artificial Sequence
  Peptide Derived from Human Papillomavirus
WIQRLTIIQH

SEQ ID NO: 33159 - protein, 8 aa, Artificial Sequence
  Peptide Derived from Human Papillomavirus
WIRFRCSK

SEQ ID NO: 33160 - protein, 9 aa, Artificial Sequence
  Peptide Derived from Human Papillomavirus
WLEPLTDTK

SEQ ID NO: 33161 - protein, 11 aa, Artificial Sequence
  Peptide Derived from Human Papillomavirus
WLEPLTDTKVA

SEQ ID NO: 33162 - protein, 9 aa, Artificial Sequence
  Peptide Derived from Human Papillomavirus
WTYFDTYMR

SEQ ID NO: 33163 - protein, 11 aa, Artificial Sequence
  Peptide Derived from Human Papillomavirus
WTYFDTYMRNA

SEQ ID NO: 33164 - protein, 10 aa, Artificial Sequence
  Peptide Derived from Human Papillomavirus
YAHIQCLDCK

SEQ ID NO: 33165 - protein, 11 aa, Artificial Sequence
  Peptide Derived from Human Papillomavirus
YALLADSNSNA

SEQ ID NO: 33166 - protein, 9 aa, Artificial Sequence
  Peptide Derived from Human Papillomavirus
YFDTYMRNA

SEQ ID NO: 33167 - protein, 8 aa, Artificial Sequence
  Peptide Derived from Human Papillomavirus
YFGMSFIH

SEQ ID NO: 33168 - protein, 9 aa, Artificial Sequence
  Peptide Derived from Human Papillomavirus
YFGMSFIHF

SEQ ID NO: 33169 - protein, 8 aa, Artificial Sequence
  Peptide Derived from Human Papillomavirus
YGCSEVEA

SEQ ID NO: 33170 - protein, 10 aa, Artificial Sequence
  Peptide Derived from Human Papillomavirus
YGLSFTDLVR

SEQ ID NO: 33171 - protein, 9 aa, Artificial Sequence
  Peptide Derived from Human Papillomavirus
YLESRITVF

SEQ ID NO: 33172 - protein, 11 aa, Artificial Sequence
  Peptide Derived from Human Papillomavirus
YLESRITVFEF

SEQ ID NO: 33173 - protein, 10 aa, Artificial Sequence
  Peptide Derived from Human Papillomavirus
YLKDCATMCK

SEQ ID NO: 33174 - protein, 11 aa, Artificial Sequence
  Peptide Derived from Human Papillomavirus
YLKDCATMCKH

SEQ ID NO: 33175 - protein, 8 aa, Artificial Sequence
  Peptide Derived from Human Papillomavirus
YVQAIVDK

SEQ ID NO: 33176 - protein, 9 aa, Artificial Sequence
  Peptide Derived from Human Papillomavirus
YVQAIVDKK

SEQ ID NO: 33177 - protein, 9 aa, Artificial Sequence
  Peptide Derived from Human Papillomavirus
AATPTGNNK

SEQ ID NO: 33178 - protein, 10 aa, Artificial Sequence
  Peptide Derived from Human Papillomavirus
AATPTGNNKR

SEQ ID NO: 33179 - protein, 11 aa, Artificial Sequence
  Peptide Derived from Human Papillomavirus
AATPTGNNKRR

SEQ ID NO: 33180 - protein, 11 aa, Artificial Sequence
  Peptide Derived from Human Papillomavirus
AATRPGHCGLA

SEQ ID NO: 33181 - protein, 8 aa, Artificial Sequence
  Peptide Derived from Human Papillomavirus
AGTWDKTA

SEQ ID NO: 33182 - protein, 9 aa, Artificial Sequence
  Peptide Derived from Human Papillomavirus
AIFFAAREH

SEQ ID NO: 33183 - protein, 9 aa, Artificial Sequence
  Peptide Derived from Human Papillomavirus
ALQGLAQSR

SEQ ID NO: 33184 - protein, 10 aa, Artificial Sequence
  Peptide Derived from Human Papillomavirus
ALQGLAQSRY

SEQ ID NO: 33185 - protein, 11 aa, Artificial Sequence
  Peptide Derived from Human Papillomavirus
ALQGLAQSRYK

SEQ ID NO: 33186 - protein, 10 aa, Artificial Sequence
  Peptide Derived from Human Papillomavirus
ATCVSHRGLY

SEQ ID NO: 33187 - protein, 11 aa, Artificial Sequence
  Peptide Derived from Human Papillomavirus
ATCVSHRGLYY

SEQ ID NO: 33188 - protein, 8 aa, Artificial Sequence
  Peptide Derived from Human Papillomavirus
ATPTGNNK

SEQ ID NO: 33189 - protein, 9 aa, Artificial Sequence
  Peptide Derived from Human Papillomavirus
ATPTGNNKR

SEQ ID NO: 33190 - protein, 10 aa, Artificial Sequence
  Peptide Derived from Human Papillomavirus
ATPTGNNKRR

SEQ ID NO: 33191 - protein, 11 aa, Artificial Sequence
  Peptide Derived from Human Papillomavirus
ATPTGNNKRRK

SEQ ID NO: 33192 - protein, 10 aa, Artificial Sequence
  Peptide Derived from Human Papillomavirus
ATQLVKQLQH

SEQ ID NO: 33193 - protein, 10 aa, Artificial Sequence
  Peptide Derived from Human Papillomavirus
ATRPGHCGLA

SEQ ID NO: 33194 - protein, 8 aa, Artificial Sequence
  Peptide Derived from Human Papillomavirus
CGLAEKQH

SEQ ID NO: 33195 - protein, 10 aa, Artificial Sequence
  Peptide Derived from Human Papillomavirus
CGPVNPLLGA

SEQ ID NO: 33196 - protein, 11 aa, Artificial Sequence
  Peptide Derived from Human Papillomavirus
CGPVNPLLGAA

SEQ ID NO: 33197 - protein, 8 aa, Artificial Sequence
  Peptide Derived from Human Papillomavirus
CLRYRLRK

SEQ ID NO: 33198 - protein, 9 aa, Artificial Sequence
  Peptide Derived from Human Papillomavirus
CLRYRLRKH

SEQ ID NO: 33199 - protein, 11 aa, Artificial Sequence
  Peptide Derived from Human Papillomavirus
CMTYVAWDSVY

SEQ ID NO: 33200 - protein, 10 aa, Artificial Sequence
  Peptide Derived from Human Papillomavirus
CSGNTTPIIH

SEQ ID NO: 33201 - protein, 10 aa, Artificial Sequence
  Peptide Derived from Human Papillomavirus
CSTSDDTVSA

SEQ ID NO: 33202 - protein, 9 aa, Artificial Sequence
  Peptide Derived from Human Papillomavirus
CVQDKIIDH

SEQ ID NO: 33203 - protein, 10 aa, Artificial Sequence
  Peptide Derived from Human Papillomavirus
CVQDKIIDHY

SEQ ID NO: 33204 - protein, 8 aa, Artificial Sequence
  Peptide Derived from Human Papillomavirus
CVSHRGLY

SEQ ID NO: 33205 - protein, 9 aa, Artificial Sequence
  Peptide Derived from Human Papillomavirus
CVSHRGLYY

SEQ ID NO: 33206 - protein, 11 aa, Artificial Sequence
  Peptide Derived from Human Papillomavirus
CVSHRGLYYVK

SEQ ID NO: 33207 - protein, 9 aa, Artificial Sequence
  Peptide Derived from Human Papillomavirus
DAGTWDKTA

SEQ ID NO: 33208 - protein, 11 aa, Artificial Sequence
  Peptide Derived from Human Papillomavirus
DDTVSATQLVK

SEQ ID NO: 33209 - protein, 10 aa, Artificial Sequence
  Peptide Derived from Human Papillomavirus
DGNKDNCMTY

SEQ ID NO: 33210 - protein, 8 aa, Artificial Sequence
  Peptide Derived from Human Papillomavirus
DIDSQIQY

SEQ ID NO: 33211 - protein, 11 aa, Artificial Sequence
  Peptide Derived from Human Papillomavirus
DISSTWHWTGA

SEQ ID NO: 33212 - protein, 11 aa, Artificial Sequence
  Peptide Derived from Human Papillomavirus
DSKDIDSQIQY

SEQ ID NO: 33213 - protein, 11 aa, Artificial Sequence
  Peptide Derived from Human Papillomavirus
DSQIQYWQLIR

SEQ ID NO: 33214 - protein, 9 aa, Artificial Sequence
  Peptide Derived from Human Papillomavirus
DSVQILVGY

SEQ ID NO: 33215 - protein, 9 aa, Artificial Sequence
  Peptide Derived from Human Papillomavirus
DSVYYMTDA

SEQ ID NO: 33216 - protein, 10 aa, Artificial Sequence
  Peptide Derived from Human Papillomavirus
DTVSATQLVK

SEQ ID NO: 33217 - protein, 8 aa, Artificial Sequence
  Peptide Derived from Human Papillomavirus
EFKSECEK

SEQ ID NO: 33218 - protein, 9 aa, Artificial Sequence
  Peptide Derived from Human Papillomavirus
EFKSECEKY

SEQ ID NO: 33219 - protein, 10 aa, Artificial Sequence
  Peptide Derived from Human Papillomavirus
EGYNTFYIEF

SEQ ID NO: 33220 - protein, 11 aa, Artificial Sequence
  Peptide Derived from Human Papillomavirus
EGYNTFYIEFK

SEQ ID NO: 33221 - protein, 10 aa, Artificial Sequence
  Peptide Derived from Human Papillomavirus
ELQMALQGLA

SEQ ID NO: 33222 - protein, 9 aa, Artificial Sequence
  Peptide Derived from Human Papillomavirus
ELWNTEPTH

SEQ ID NO: 33223 - protein, 11 aa, Artificial Sequence
  Peptide Derived from Human Papillomavirus
ELWNTEPTHCF

SEQ ID NO: 33224 - protein, 11 aa, Artificial Sequence
  Peptide Derived from Human Papillomavirus
FDGNKDNCMTY

SEQ ID NO: 33225 - protein, 10 aa, Artificial Sequence
  Peptide Derived from Human Papillomavirus
GAATPTGNNK

SEQ ID NO: 33226 - protein, 11 aa, Artificial Sequence
  Peptide Derived from Human Papillomavirus
GAATPTGNNKR

SEQ ID NO: 33227 - protein, 10 aa, Artificial Sequence
  Peptide Derived from Human Papillomavirus
GDRNSLKCLR

SEQ ID NO: 33228 - protein, 11 aa, Artificial Sequence
  Peptide Derived from Human Papillomavirus
GDRNSLKCLRY

SEQ ID NO: 33229 - protein, 8 aa, Artificial Sequence
  Peptide Derived from Human Papillomavirus
GGQTVQVY

SEQ ID NO: 33230 - protein, 9 aa, Artificial Sequence
  Peptide Derived from Human Papillomavirus
GGQTVQVYF

SEQ ID NO: 33231 - protein, 8 aa, Artificial Sequence
  Peptide Derived from Human Papillomavirus
GILTVTYH

SEQ ID NO: 33232 - protein, 8 aa, Artificial Sequence
  Peptide Derived from Human Papillomavirus
GLAQSRYK

SEQ ID NO: 33233 - protein, 9 aa, Artificial Sequence
  Peptide Derived from Human Papillomavirus
GLYYVKEGY

SEQ ID NO: 33234 - protein, 11 aa, Artificial Sequence
  Peptide Derived from Human Papillomavirus
GTAKTYGQTSA

SEQ ID NO: 33235 - protein, 9 aa, Artificial Sequence
  Peptide Derived from Human Papillomavirus
HCGLAEKQH

SEQ ID NO: 33236 - protein, 11 aa, Artificial Sequence
  Peptide Derived from Human Papillomavirus
HCGPVNPLLGA

SEQ ID NO: 33237 - protein, 8 aa, Artificial Sequence
  Peptide Derived from Human Papillomavirus
HGIQTLNH

SEQ ID NO: 33238 - protein, 10 aa, Artificial Sequence
  Peptide Derived from Human Papillomavirus
HLKGDRNSLK

SEQ ID NO: 33239 - protein, 8 aa, Artificial Sequence
  Peptide Derived from Human Papillomavirus
HSETQRTK

SEQ ID NO: 33240 - protein, 9 aa, Artificial Sequence
  Peptide Derived from Human Papillomavirus
HSETQRTKF

SEQ ID NO: 33241 - protein, 9 aa, Artificial Sequence
  Peptide Derived from Human Papillomavirus
IDHYENDSK

SEQ ID NO: 33242 - protein, 8 aa, Artificial Sequence
  Peptide Derived from Human Papillomavirus
IFFAAREH

SEQ ID NO: 33243 - protein, 10 aa, Artificial Sequence
  Peptide Derived from Human Papillomavirus
IIDHYENDSK

SEQ ID NO: 33244 - protein, 8 aa, Artificial Sequence
  Peptide Derived from Human Papillomavirus
IIHLKGDR

SEQ ID NO: 33245 - protein, 8 aa, Artificial Sequence
  Peptide Derived from Human Papillomavirus
ISKSKAHK

SEQ ID NO: 33246 - protein, 9 aa, Artificial Sequence
  Peptide Derived from Human Papillomavirus
ISKSKAHKA

SEQ ID NO: 33247 - protein, 10 aa, Artificial Sequence
  Peptide Derived from Human Papillomavirus
ISSTWHWTGA

SEQ ID NO: 33248 - protein, 11 aa, Artificial Sequence
  Peptide Derived from Human Papillomavirus
KAHKAIELQMA

SEQ ID NO: 33249 - protein, 8 aa, Artificial Sequence
  Peptide Derived from Human Papillomavirus
KAIELQMA

SEQ ID NO: 33250 - protein, 8 aa, Artificial Sequence
  Peptide Derived from Human Papillomavirus
KCLRYRLR

SEQ ID NO: 33251 - protein, 9 aa, Artificial Sequence
  Peptide Derived from Human Papillomavirus
KCLRYRLRK

SEQ ID NO: 33252 - protein, 10 aa, Artificial Sequence
  Peptide Derived from Human Papillomavirus
KCLRYRLRKH

SEQ ID NO: 33253 - protein, 9 aa, Artificial Sequence
  Peptide Derived from Human Papillomavirus
KDIDSQIQY

SEQ ID NO: 33254 - protein, 9 aa, Artificial Sequence
  Peptide Derived from Human Papillomavirus
KDNCMTYVA

SEQ ID NO: 33255 - protein, 8 aa, Artificial Sequence
  Peptide Derived from Human Papillomavirus
KGDRNSLK

SEQ ID NO: 33256 - protein, 11 aa, Artificial Sequence
  Peptide Derived from Human Papillomavirus
KGDRNSLKCLR

SEQ ID NO: 33257 - protein, 9 aa, Artificial Sequence
  Peptide Derived from Human Papillomavirus
KGGQTVQVY

SEQ ID NO: 33258 - protein, 10 aa, Artificial Sequence
  Peptide Derived from Human Papillomavirus
KGGQTVQVYF

SEQ ID NO: 33259 - protein, 11 aa, Artificial Sequence
  Peptide Derived from Human Papillomavirus
KIIDHYENDSK

SEQ ID NO: 33260 - protein, 8 aa, Artificial Sequence
  Peptide Derived from Human Papillomavirus
KTATCVSH

SEQ ID NO: 33261 - protein, 9 aa, Artificial Sequence
  Peptide Derived from Human Papillomavirus
KTATCVSHR

SEQ ID NO: 33262 - protein, 9 aa, Artificial Sequence
  Peptide Derived from Human Papillomavirus
KTGILTVTY

SEQ ID NO: 33263 - protein, 10 aa, Artificial Sequence
  Peptide Derived from Human Papillomavirus
KTGILTVTYH

SEQ ID NO: 33264 - protein, 8 aa, Artificial Sequence
  Peptide Derived from Human Papillomavirus
KTYGQTSA

SEQ ID NO: 33265 - protein, 9 aa, Artificial Sequence
  Peptide Derived from Human Papillomavirus
KTYGQTSAA

SEQ ID NO: 33266 - protein, 11 aa, Artificial Sequence
  Peptide Derived from Human Papillomavirus
KTYGQTSAATR

SEQ ID NO: 33267 - protein, 11 aa, Artificial Sequence
  Peptide Derived from Human Papillomavirus
LCSGNTTPIIH

SEQ ID NO: 33268 - protein, 11 aa, Artificial Sequence
  Peptide Derived from Human Papillomavirus
LGAATPTGNNK

SEQ ID NO: 33269 - protein, 9 aa, Artificial Sequence
  Peptide Derived from Human Papillomavirus
LIRWENAIF

SEQ ID NO: 33270 - protein, 10 aa, Artificial Sequence
  Peptide Derived from Human Papillomavirus
LIRWENAIFF

SEQ ID NO: 33271 - protein, 11 aa, Artificial Sequence
  Peptide Derived from Human Papillomavirus
LIRWENAIFFA

SEQ ID NO: 33272 - protein, 11 aa, Artificial Sequence
  Peptide Derived from Human Papillomavirus
LSCVQDKIIDH

SEQ ID NO: 33273 - protein, 11 aa, Artificial Sequence
  Peptide Derived from Human Papillomavirus
LSERLSCVQDK

SEQ ID NO: 33274 - protein, 11 aa, Artificial Sequence
  Peptide Derived from Human Papillomavirus
LTVTYHSETQR

SEQ ID NO: 33275 - protein, 10 aa, Artificial Sequence
  Peptide Derived from Human Papillomavirus
MALQGLAQSR

SEQ ID NO: 33276 - protein, 11 aa, Artificial Sequence
  Peptide Derived from Human Papillomavirus
MALQGLAQSRY

SEQ ID NO: 33277 - protein, 11 aa, Artificial Sequence
  Peptide Derived from Human Papillomavirus
MCSTSDDTVSA

SEQ ID NO: 33278 - protein, 9 aa, Artificial Sequence
  Peptide Derived from Human Papillomavirus
MTDAGTWDK

SEQ ID NO: 33279 - protein, 11 aa, Artificial Sequence
  Peptide Derived from Human Papillomavirus
MTDAGTWDKTA

SEQ ID NO: 33280 - protein, 10 aa, Artificial Sequence
  Peptide Derived from Human Papillomavirus
MTYVAWDSVY

SEQ ID NO: 33281 - protein, 11 aa, Artificial Sequence
  Peptide Derived from Human Papillomavirus
MTYVAWDSVYY

SEQ ID NO: 33282 - protein, 8 aa, Artificial Sequence
  Peptide Derived from Human Papillomavirus
NAIFFAAR

SEQ ID NO: 33283 - protein, 10 aa, Artificial Sequence
  Peptide Derived from Human Papillomavirus
NAIFFAAREH

SEQ ID NO: 33284 - protein, 8 aa, Artificial Sequence
  Peptide Derived from Human Papillomavirus
NISKSKAH

SEQ ID NO: 33285 - protein, 9 aa, Artificial Sequence
  Peptide Derived from Human Papillomavirus
NISKSKAHK

SEQ ID NO: 33286 - protein, 10 aa, Artificial Sequence
  Peptide Derived from Human Papillomavirus
NISKSKAHKA

SEQ ID NO: 33287 - protein, 8 aa, Artificial Sequence
  Peptide Derived from Human Papillomavirus
NSLKCLRY

SEQ ID NO: 33288 - protein, 9 aa, Artificial Sequence
  Peptide Derived from Human Papillomavirus
NSLKCLRYR

SEQ ID NO: 33289 - protein, 11 aa, Artificial Sequence
  Peptide Derived from Human Papillomavirus
NSLKCLRYRLR

SEQ ID NO: 33290 - protein, 8 aa, Artificial Sequence
  Peptide Derived from Human Papillomavirus
NTEPTHCF

SEQ ID NO: 33291 - protein, 9 aa, Artificial Sequence
  Peptide Derived from Human Papillomavirus
NTEPTHCFK

SEQ ID NO: 33292 - protein, 10 aa, Artificial Sequence
  Peptide Derived from Human Papillomavirus
NTEPTHCFKK

SEQ ID NO: 33293 - protein, 8 aa, Artificial Sequence
  Peptide Derived from Human Papillomavirus
NTFYIEFK

SEQ ID NO: 33294 - protein, 8 aa, Artificial Sequence
  Peptide Derived from Human Papillomavirus
NTGTWEVH

SEQ ID NO: 33295 - protein, 9 aa, Artificial Sequence
  Peptide Derived from Human Papillomavirus
NTGTWEVHF

SEQ ID NO: 33296 - protein, 9 aa, Artificial Sequence
  Peptide Derived from Human Papillomavirus
NTTPIIHLK

SEQ ID NO: 33297 - protein, 9 aa, Artificial Sequence
  Peptide Derived from Human Papillomavirus
PAYNISKSK

SEQ ID NO: 33298 - protein, 10 aa, Artificial Sequence
  Peptide Derived from Human Papillomavirus
PAYNISKSKA

SEQ ID NO: 33299 - protein, 11 aa, Artificial Sequence
  Peptide Derived from Human Papillomavirus
PAYNISKSKAH

SEQ ID NO: 33300 - protein, 10 aa, Artificial Sequence
  Peptide Derived from Human Papillomavirus
PDSVQILVGY

SEQ ID NO: 33301 - protein, 9 aa, Artificial Sequence
  Peptide Derived from Human Papillomavirus
PGHCGLAEK

SEQ ID NO: 33302 - protein, 11 aa, Artificial Sequence
  Peptide Derived from Human Papillomavirus
PGHCGLAEKQH

SEQ ID NO: 33303 - protein, 9 aa, Artificial Sequence
  Peptide Derived from Human Papillomavirus
PIIHLKGDR

SEQ ID NO: 33304 - protein, 8 aa, Artificial Sequence
  Peptide Derived from Human Papillomavirus
PTGNNKRR

SEQ ID NO: 33305 - protein, 9 aa, Artificial Sequence
  Peptide Derived from Human Papillomavirus
PTGNNKRRK

SEQ ID NO: 33306 - protein, 8 aa, Artificial Sequence
  Peptide Derived from Human Papillomavirus
PVNPLLGA

SEQ ID NO: 33307 - protein, 9 aa, Artificial Sequence
  Peptide Derived from Human Papillomavirus
PVNPLLGAA

SEQ ID NO: 33308 - protein, 8 aa, Artificial Sequence
  Peptide Derived from Human Papillomavirus
QDKIIDHY

SEQ ID NO: 33309 - protein, 8 aa, Artificial Sequence
  Peptide Derived from Human Papillomavirus
QGLAQSRY

SEQ ID NO: 33310 - protein, 9 aa, Artificial Sequence
  Peptide Derived from Human Papillomavirus
QGLAQSRYK

SEQ ID NO: 33311 - protein, 9 aa, Artificial Sequence
  Peptide Derived from Human Papillomavirus
QIQYWQLIR

SEQ ID NO: 33312 - protein, 8 aa, Artificial Sequence
  Peptide Derived from Human Papillomavirus
QLIRWENA

SEQ ID NO: 33313 - protein, 10 aa, Artificial Sequence
  Peptide Derived from Human Papillomavirus
QLIRWENAIF

SEQ ID NO: 33314 - protein, 11 aa, Artificial Sequence
  Peptide Derived from Human Papillomavirus
QLIRWENAIFF

SEQ ID NO: 33315 - protein, 9 aa, Artificial Sequence
  Peptide Derived from Human Papillomavirus
QLQHTPSPY

SEQ ID NO: 33316 - protein, 8 aa, Artificial Sequence
  Peptide Derived from Human Papillomavirus
QLVKQLQH

SEQ ID NO: 33317 - protein, 8 aa, Artificial Sequence
  Peptide Derived from Human Papillomavirus
QMALQGLA

SEQ ID NO: 33318 - protein, 11 aa, Artificial Sequence
  Peptide Derived from Human Papillomavirus
QMALQGLAQSR

SEQ ID NO: 33319 - protein, 10 aa, Artificial Sequence
  Peptide Derived from Human Papillomavirus
QTLNHQVVPA

SEQ ID NO: 33320 - protein, 11 aa, Artificial Sequence
  Peptide Derived from Human Papillomavirus
QTLNHQVVPAY

SEQ ID NO: 33321 - protein, 10 aa, Artificial Sequence
  Peptide Derived from Human Papillomavirus
QTPKETLSER

SEQ ID NO: 33322 - protein, 10 aa, Artificial Sequence
  Peptide Derived from Human Papillomavirus
QTSAATRPGH

SEQ ID NO: 33323 - protein, 11 aa, Artificial Sequence
  Peptide Derived from Human Papillomavirus
QTVQVYFDGNK

SEQ ID NO: 33324 - protein, 10 aa, Artificial Sequence
  Peptide Derived from Human Papillomavirus
QVVPAYNISK

SEQ ID NO: 33325 - protein, 8 aa, Artificial Sequence
  Peptide Derived from Human Papillomavirus
QVYFDGNK

SEQ ID NO: 33326 - protein, 8 aa, Artificial Sequence
  Peptide Derived from Human Papillomavirus
RDISSTWH

SEQ ID NO: 33327 - protein, 10 aa, Artificial Sequence
  Peptide Derived from Human Papillomavirus
RGLYYVKEGY

SEQ ID NO: 33328 - protein, 8 aa, Artificial Sequence
  Peptide Derived from Human Papillomavirus
RLRKHSDH

SEQ ID NO: 33329 - protein, 9 aa, Artificial Sequence
  Peptide Derived from Human Papillomavirus
RLRKHSDHY

SEQ ID NO: 33330 - protein, 10 aa, Artificial Sequence
  Peptide Derived from Human Papillomavirus
RLRKHSDHYR

SEQ ID NO: 33331 - protein, 8 aa, Artificial Sequence
  Peptide Derived from Human Papillomavirus
RLSCVQDK

SEQ ID NO: 33332 - protein, 9 aa, Artificial Sequence
  Peptide Derived from Human Papillomavirus
RTKFLNTVA

SEQ ID NO: 33333 - protein, 8 aa, Artificial Sequence
  Peptide Derived from Human Papillomavirus
SAATRPGH

SEQ ID NO: 33334 - protein, 11 aa, Artificial Sequence
  Peptide Derived from Human Papillomavirus
SATQLVKQLQH

SEQ ID NO: 33335 - protein, 10 aa, Artificial Sequence
  Peptide Derived from Human Papillomavirus
SCVQDKIIDH

SEQ ID NO: 33336 - protein, 11 aa, Artificial Sequence
  Peptide Derived from Human Papillomavirus
SCVQDKIIDHY

SEQ ID NO: 33337 - protein, 9 aa, Artificial Sequence
  Peptide Derived from Human Papillomavirus
SGNTTPIIH

SEQ ID NO: 33338 - protein, 11 aa, Artificial Sequence
  Peptide Derived from Human Papillomavirus
SGNTTPIIHLK

SEQ ID NO: 33339 - protein, 8 aa, Artificial Sequence
  Peptide Derived from Human Papillomavirus
SLKCLRYR

SEQ ID NO: 33340 - protein, 10 aa, Artificial Sequence
  Peptide Derived from Human Papillomavirus
SLKCLRYRLR

SEQ ID NO: 33341 - protein, 11 aa, Artificial Sequence
  Peptide Derived from Human Papillomavirus
SLKCLRYRLRK

SEQ ID NO: 33342 - protein, 9 aa, Artificial Sequence
  Peptide Derived from Human Papillomavirus
SSTVSVGTA

SEQ ID NO: 33343 - protein, 10 aa, Artificial Sequence
  Peptide Derived from Human Papillomavirus
SSTVSVGTAK

SEQ ID NO: 33344 - protein, 9 aa, Artificial Sequence
  Peptide Derived from Human Papillomavirus
SSTWHWTGA

SEQ ID NO: 33345 - protein, 9 aa, Artificial Sequence
  Peptide Derived from Human Papillomavirus
STSDDTVSA

SEQ ID NO: 33346 - protein, 8 aa, Artificial Sequence
  Peptide Derived from Human Papillomavirus
STVSVGTA

SEQ ID NO: 33347 - protein, 9 aa, Artificial Sequence
  Peptide Derived from Human Papillomavirus
STVSVGTAK

SEQ ID NO: 33348 - protein, 11 aa, Artificial Sequence
  Peptide Derived from Human Papillomavirus
STVSVGTAKTY

SEQ ID NO: 33349 - protein, 8 aa, Artificial Sequence
  Peptide Derived from Human Papillomavirus
STWHWTGA

SEQ ID NO: 33350 - protein, 8 aa, Artificial Sequence
  Peptide Derived from Human Papillomavirus
SVGTAKTY

SEQ ID NO: 33351 - protein, 8 aa, Artificial Sequence
  Peptide Derived from Human Papillomavirus
SVQILVGY

SEQ ID NO: 33352 - protein, 8 aa, Artificial Sequence
  Peptide Derived from Human Papillomavirus
SVYYMTDA

SEQ ID NO: 33353 - protein, 10 aa, Artificial Sequence
  Peptide Derived from Human Papillomavirus
TAKTYGQTSA

SEQ ID NO: 33354 - protein, 11 aa, Artificial Sequence
  Peptide Derived from Human Papillomavirus
TAKTYGQTSAA

SEQ ID NO: 33355 - protein, 8 aa, Artificial Sequence
  Peptide Derived from Human Papillomavirus
TATCVSHR

SEQ ID NO: 33356 - protein, 11 aa, Artificial Sequence
  Peptide Derived from Human Papillomavirus
TATCVSHRGLY

SEQ ID NO: 33357 - protein, 9 aa, Artificial Sequence
  Peptide Derived from Human Papillomavirus
TCVSHRGLY

SEQ ID NO: 33358 - protein, 10 aa, Artificial Sequence
  Peptide Derived from Human Papillomavirus
TCVSHRGLYY

SEQ ID NO: 33359 - protein, 8 aa, Artificial Sequence
  Peptide Derived from Human Papillomavirus
TDAGTWDK

SEQ ID NO: 33360 - protein, 10 aa, Artificial Sequence
  Peptide Derived from Human Papillomavirus
TDAGTWDKTA

SEQ ID NO: 33361 - protein, 8 aa, Artificial Sequence
  Peptide Derived from Human Papillomavirus
TGILTVTY

SEQ ID NO: 33362 - protein, 9 aa, Artificial Sequence
  Peptide Derived from Human Papillomavirus
TGILTVTYH

SEQ ID NO: 33363 - protein, 8 aa, Artificial Sequence
  Peptide Derived from Human Papillomavirus
TGNNKRRK

SEQ ID NO: 33364 - protein, 8 aa, Artificial Sequence
  Peptide Derived from Human Papillomavirus
TGTWEVHF

SEQ ID NO: 33365 - protein, 9 aa, Artificial Sequence
  Peptide Derived from Human Papillomavirus
TLNHQVVPA

SEQ ID NO: 33366 - protein, 10 aa, Artificial Sequence
  Peptide Derived from Human Papillomavirus
TLNHQVVPAY

SEQ ID NO: 33367 - protein, 9 aa, Artificial Sequence
  Peptide Derived from Human Papillomavirus
TSAATRPGH

SEQ ID NO: 33368 - protein, 8 aa, Artificial Sequence
  Peptide Derived from Human Papillomavirus
TSDDTVSA

SEQ ID NO: 33369 - protein, 8 aa, Artificial Sequence
  Peptide Derived from Human Papillomavirus
TTPIIHLK

SEQ ID NO: 33370 - protein, 11 aa, Artificial Sequence
  Peptide Derived from Human Papillomavirus
TTPIIHLKGDR

SEQ ID NO: 33371 - protein, 10 aa, Artificial Sequence
  Peptide Derived from Human Papillomavirus
TVQVYFDGNK

SEQ ID NO: 33372 - protein, 9 aa, Artificial Sequence
  Peptide Derived from Human Papillomavirus
TVSATQLVK

SEQ ID NO: 33373 - protein, 8 aa, Artificial Sequence
  Peptide Derived from Human Papillomavirus
TVSVGTAK

SEQ ID NO: 33374 - protein, 10 aa, Artificial Sequence
  Peptide Derived from Human Papillomavirus
TVSVGTAKTY

SEQ ID NO: 33375 - protein, 10 aa, Artificial Sequence
  Peptide Derived from Human Papillomavirus
TVTYHSETQR

SEQ ID NO: 33376 - protein, 8 aa, Artificial Sequence
  Peptide Derived from Human Papillomavirus
VAWDSVYY

SEQ ID NO: 33377 - protein, 8 aa, Artificial Sequence
  Peptide Derived from Human Papillomavirus
VSATQLVK

SEQ ID NO: 33378 - protein, 8 aa, Artificial Sequence
  Peptide Derived from Human Papillomavirus
VSHRGLYY

SEQ ID NO: 33379 - protein, 10 aa, Artificial Sequence
  Peptide Derived from Human Papillomavirus
VSHRGLYYVK

SEQ ID NO: 33380 - protein, 9 aa, Artificial Sequence
  Peptide Derived from Human Papillomavirus
VSVGTAKTY

SEQ ID NO: 33381 - protein, 9 aa, Artificial Sequence
  Peptide Derived from Human Papillomavirus
VTYHSETQR

SEQ ID NO: 33382 - protein, 11 aa, Artificial Sequence
  Peptide Derived from Human Papillomavirus
VTYHSETQRTK

SEQ ID NO: 33383 - protein, 9 aa, Artificial Sequence
  Peptide Derived from Human Papillomavirus
VVPAYNISK

SEQ ID NO: 33384 - protein, 11 aa, Artificial Sequence
  Peptide Derived from Human Papillomavirus
VVPAYNISKSK

SEQ ID NO: 33385 - protein, 10 aa, Artificial Sequence
  Peptide Derived from Human Papillomavirus
WDKTATCVSH

SEQ ID NO: 33386 - protein, 11 aa, Artificial Sequence
  Peptide Derived from Human Papillomavirus
WDKTATCVSHR

SEQ ID NO: 33387 - protein, 10 aa, Artificial Sequence
  Peptide Derived from Human Papillomavirus
WDSVYYMTDA

SEQ ID NO: 33388 - protein, 8 aa, Artificial Sequence
  Peptide Derived from Human Papillomavirus
WTGAGNEK

SEQ ID NO: 33389 - protein, 10 aa, Artificial Sequence
  Peptide Derived from Human Papillomavirus
YGNTGTWEVH

SEQ ID NO: 33390 - protein, 11 aa, Artificial Sequence
  Peptide Derived from Human Papillomavirus
YGNTGTWEVHF

SEQ ID NO: 33391 - protein, 9 aa, Artificial Sequence
  Peptide Derived from Human Papillomavirus
YGQTSAATR

SEQ ID NO: 33392 - protein, 10 aa, Artificial Sequence
  Peptide Derived from Human Papillomavirus
YIEFKSECEK

SEQ ID NO: 33393 - protein, 11 aa, Artificial Sequence
  Peptide Derived from Human Papillomavirus
YIEFKSECEKY

SEQ ID NO: 33394 - protein, 10 aa, Artificial Sequence
  Peptide Derived from Human Papillomavirus
YMTDAGTWDK

SEQ ID NO: 33395 - protein, 10 aa, Artificial Sequence
  Peptide Derived from Human Papillomavirus
YSSTVSVGTA

SEQ ID NO: 33396 - protein, 11 aa, Artificial Sequence
  Peptide Derived from Human Papillomavirus
YSSTVSVGTAK

SEQ ID NO: 33397 - protein, 8 aa, Artificial Sequence
  Peptide Derived from Human Papillomavirus
YVAWDSVY

SEQ ID NO: 33398 - protein, 9 aa, Artificial Sequence
  Peptide Derived from Human Papillomavirus
YVAWDSVYY

SEQ ID NO: 33399 - protein, 9 aa, Artificial Sequence
  Peptide Derived from Human Papillomavirus
YVKEGYNTF

SEQ ID NO: 33400 - protein, 10 aa, Artificial Sequence
  Peptide Derived from Human Papillomavirus
YVKEGYNTFY

SEQ ID NO: 33401 - protein, 9 aa, Artificial Sequence
  Peptide Derived from Human Papillomavirus
AFTVYVFCF

SEQ ID NO: 33402 - protein, 9 aa, Artificial Sequence
  Peptide Derived from Human Papillomavirus
ATAFTVYVF

SEQ ID NO: 33403 - protein, 11 aa, Artificial Sequence
  Peptide Derived from Human Papillomavirus
ATAFTVYVFCF

SEQ ID NO: 33404 - protein, 9 aa, Artificial Sequence
  Peptide Derived from Human Papillomavirus
CAYAWVLVF

SEQ ID NO: 33405 - protein, 11 aa, Artificial Sequence
  Peptide Derived from Human Papillomavirus
CAYAWVLVFVY

SEQ ID NO: 33406 - protein, 11 aa, Artificial Sequence
  Peptide Derived from Human Papillomavirus
CFCVCMYVCCH

SEQ ID NO: 33407 - protein, 10 aa, Artificial Sequence
  Peptide Derived from Human Papillomavirus
CFLLPMLLLH

SEQ ID NO: 33408 - protein, 11 aa, Artificial Sequence
  Peptide Derived from Human Papillomavirus
CMCAYAWVLVF

SEQ ID NO: 33409 - protein, 9 aa, Artificial Sequence
  Peptide Derived from Human Papillomavirus
CVCMYVCCH

SEQ ID NO: 33410 - protein, 8 aa, Artificial Sequence
  Peptide Derived from Human Papillomavirus
FCFCVCMY

SEQ ID NO: 33411 - protein, 11 aa, Artificial Sequence
  Peptide Derived from Human Papillomavirus
FCFLLPMLLLH

SEQ ID NO: 33412 - protein, 10 aa, Artificial Sequence
  Peptide Derived from Human Papillomavirus
FCVCMYVCCH

SEQ ID NO: 33413 - protein, 10 aa, Artificial Sequence
  Peptide Derived from Human Papillomavirus
FLFCFCVCMY

SEQ ID NO: 33414 - protein, 9 aa, Artificial Sequence
  Peptide Derived from Human Papillomavirus
FLLPMLLLH

SEQ ID NO: 33415 - protein, 11 aa, Artificial Sequence
  Peptide Derived from Human Papillomavirus
FLLPMLLLHIH

SEQ ID NO: 33416 - protein, 8 aa, Artificial Sequence
  Peptide Derived from Human Papillomavirus
FTVYVFCF

SEQ ID NO: 33417 - protein, 11 aa, Artificial Sequence
  Peptide Derived from Human Papillomavirus
FVYIVVITSPA

SEQ ID NO: 33418 - protein, 11 aa, Artificial Sequence
  Peptide Derived from Human Papillomavirus
IFLFCFCVCMY

SEQ ID NO: 33419 - protein, 8 aa, Artificial Sequence
  Peptide Derived from Human Papillomavirus
ITSPATAF

SEQ ID NO: 33420 - protein, 11 aa, Artificial Sequence
  Peptide Derived from Human Papillomavirus
ITSPATAFTVY

SEQ ID NO: 33421 - protein, 8 aa, Artificial Sequence
  Peptide Derived from Human Papillomavirus
IVVITSPA

SEQ ID NO: 33422 - protein, 10 aa, Artificial Sequence
  Peptide Derived from Human Papillomavirus
IVVITSPATA

SEQ ID NO: 33423 - protein, 11 aa, Artificial Sequence
  Peptide Derived from Human Papillomavirus
IVVITSPATAF

SEQ ID NO: 33424 - protein, 9 aa, Artificial Sequence
  Peptide Derived from Human Papillomavirus
LFCFCVCMY

SEQ ID NO: 33425 - protein, 8 aa, Artificial Sequence
  Peptide Derived from Human Papillomavirus
LLPMLLLH

SEQ ID NO: 33426 - protein, 10 aa, Artificial Sequence
  Peptide Derived from Human Papillomavirus
LLPMLLLHIH

SEQ ID NO: 33427 - protein, 11 aa, Artificial Sequence
  Peptide Derived from Human Papillomavirus
LLPMLLLHIHA

SEQ ID NO: 33428 - protein, 9 aa, Artificial Sequence
  Peptide Derived from Human Papillomavirus
LLPSVCMCA

SEQ ID NO: 33429 - protein, 10 aa, Artificial Sequence
  Peptide Derived from Human Papillomavirus
LLPSVCMCAY

SEQ ID NO: 33430 - protein, 11 aa, Artificial Sequence
  Peptide Derived from Human Papillomavirus
LLPSVCMCAYA

SEQ ID NO: 33431 - protein, 9 aa, Artificial Sequence
  Peptide Derived from Human Papillomavirus
LSLIFLFCF

SEQ ID NO: 33432 - protein, 10 aa, Artificial Sequence
  Peptide Derived from Human Papillomavirus
MCAYAWVLVF

SEQ ID NO: 33433 - protein, 8 aa, Artificial Sequence
  Peptide Derived from Human Papillomavirus
MLLLHIHA

SEQ ID NO: 33434 - protein, 8 aa, Artificial Sequence
  Peptide Derived from Human Papillomavirus
MLSLIFLF

SEQ ID NO: 33435 - protein, 10 aa, Artificial Sequence
  Peptide Derived from Human Papillomavirus
MLSLIFLFCF

SEQ ID NO: 33436 - protein, 8 aa, Artificial Sequence
  Peptide Derived from Human Papillomavirus
PATAFTVY

SEQ ID NO: 33437 - protein, 10 aa, Artificial Sequence
  Peptide Derived from Human Papillomavirus
PATAFTVYVF

SEQ ID NO: 33438 - protein, 10 aa, Artificial Sequence
  Peptide Derived from Human Papillomavirus
PLLPSVCMCA

SEQ ID NO: 33439 - protein, 11 aa, Artificial Sequence
  Peptide Derived from Human Papillomavirus
PLLPSVCMCAY

SEQ ID NO: 33440 - protein, 8 aa, Artificial Sequence
  Peptide Derived from Human Papillomavirus
PMLLLHIH

SEQ ID NO: 33441 - protein, 9 aa, Artificial Sequence
  Peptide Derived from Human Papillomavirus
PMLLLHIHA

SEQ ID NO: 33442 - protein, 8 aa, Artificial Sequence
  Peptide Derived from Human Papillomavirus
PSVCMCAY

SEQ ID NO: 33443 - protein, 9 aa, Artificial Sequence
  Peptide Derived from Human Papillomavirus
PSVCMCAYA

SEQ ID NO: 33444 - protein, 8 aa, Artificial Sequence
  Peptide Derived from Human Papillomavirus
SLIFLFCF

SEQ ID NO: 33445 - protein, 8 aa, Artificial Sequence
  Peptide Derived from Human Papillomavirus
SVCMCAYA

SEQ ID NO: 33446 - protein, 8 aa, Artificial Sequence
  Peptide Derived from Human Papillomavirus
TAFTVYVF

SEQ ID NO: 33447 - protein, 10 aa, Artificial Sequence
  Peptide Derived from Human Papillomavirus
TAFTVYVFCF

SEQ ID NO: 33448 - protein, 10 aa, Artificial Sequence
  Peptide Derived from Human Papillomavirus
TSPATAFTVY

SEQ ID NO: 33449 - protein, 8 aa, Artificial Sequence
  Peptide Derived from Human Papillomavirus
VCMYVCCH

SEQ ID NO: 33450 - protein, 8 aa, Artificial Sequence
  Peptide Derived from Human Papillomavirus
VITSPATA

SEQ ID NO: 33451 - protein, 9 aa, Artificial Sequence
  Peptide Derived from Human Papillomavirus
VITSPATAF

SEQ ID NO: 33452 - protein, 9 aa, Artificial Sequence
  Peptide Derived from Human Papillomavirus
VVITSPATA

SEQ ID NO: 33453 - protein, 10 aa, Artificial Sequence
  Peptide Derived from Human Papillomavirus
VVITSPATAF

SEQ ID NO: 33454 - protein, 9 aa, Artificial Sequence
  Peptide Derived from Human Papillomavirus
YAWVLVFVY

SEQ ID NO: 33455 - protein, 9 aa, Artificial Sequence
  Peptide Derived from Human Papillomavirus
YIVVITSPA

SEQ ID NO: 33456 - protein, 11 aa, Artificial Sequence
  Peptide Derived from Human Papillomavirus
YIVVITSPATA

SEQ ID NO: 33457 - protein, 9 aa, Artificial Sequence
  Peptide Derived from Human Papillomavirus
AACHKCIDF

SEQ ID NO: 33458 - protein, 10 aa, Artificial Sequence
  Peptide Derived from Human Papillomavirus
AACHKCIDFY

SEQ ID NO: 33459 - protein, 8 aa, Artificial Sequence
  Peptide Derived from Human Papillomavirus
ACHKCIDF

SEQ ID NO: 33460 - protein, 9 aa, Artificial Sequence
  Peptide Derived from Human Papillomavirus
ACHKCIDFY

SEQ ID NO: 33461 - protein, 11 aa, Artificial Sequence
  Peptide Derived from Human Papillomavirus
ACHKCIDFYSR

SEQ ID NO: 33462 - protein, 9 aa, Artificial Sequence
  Peptide Derived from Human Papillomavirus
AFKDLFVVY

SEQ ID NO: 33463 - protein, 10 aa, Artificial Sequence
  Peptide Derived from Human Papillomavirus
AFKDLFVVYR

SEQ ID NO: 33464 - protein, 9 aa, Artificial Sequence
  Peptide Derived from Human Papillomavirus
AGHYRGQCH

SEQ ID NO: 33465 - protein, 9 aa, Artificial Sequence
  Peptide Derived from Human Papillomavirus
CCNRARQER

SEQ ID NO: 33466 - protein, 9 aa, Artificial Sequence
  Peptide Derived from Human Papillomavirus
CIDFYSRIR

SEQ ID NO: 33467 - protein, 11 aa, Artificial Sequence
  Peptide Derived from Human Papillomavirus
CLRCQKPLNPA

SEQ ID NO: 33468 - protein, 10 aa, Artificial Sequence
  Peptide Derived from Human Papillomavirus
DFYSRIRELR

SEQ ID NO: 33469 - protein, 11 aa, Artificial Sequence
  Peptide Derived from Human Papillomavirus
DFYSRIRELRH

SEQ ID NO: 33470 - protein, 8 aa, Artificial Sequence
  Peptide Derived from Human Papillomavirus
DIEITCVY

SEQ ID NO: 33471 - protein, 10 aa, Artificial Sequence
  Peptide Derived from Human Papillomavirus
DIEITCVYCK

SEQ ID NO: 33472 - protein, 9 aa, Artificial Sequence
  Peptide Derived from Human Papillomavirus
DSIPHAACH

SEQ ID NO: 33473 - protein, 10 aa, Artificial Sequence
  Peptide Derived from Human Papillomavirus
DSIPHAACHK

SEQ ID NO: 33474 - protein, 10 aa, Artificial Sequence
  Peptide Derived from Human Papillomavirus
DSVYGDTLEK

SEQ ID NO: 33475 - protein, 8 aa, Artificial Sequence
  Peptide Derived from Human Papillomavirus
EDPTRRPY

SEQ ID NO: 33476 - protein, 9 aa, Artificial Sequence
  Peptide Derived from Human Papillomavirus
EDPTRRPYK

SEQ ID NO: 33477 - protein, 8 aa, Artificial Sequence
  Peptide Derived from Human Papillomavirus
EFAFKDLF

SEQ ID NO: 33478 - protein, 11 aa, Artificial Sequence
  Peptide Derived from Human Papillomavirus
EFAFKDLFVVY

SEQ ID NO: 33479 - protein, 8 aa, Artificial Sequence
  Peptide Derived from Human Papillomavirus
EITCVYCK

SEQ ID NO: 33480 - protein, 10 aa, Artificial Sequence
  Peptide Derived from Human Papillomavirus
ELRHYSDSVY

SEQ ID NO: 33481 - protein, 8 aa, Artificial Sequence
  Peptide Derived from Human Papillomavirus
ELTEVFEF

SEQ ID NO: 33482 - protein, 9 aa, Artificial Sequence
  Peptide Derived from Human Papillomavirus
ELTEVFEFA

SEQ ID NO: 33483 - protein, 10 aa, Artificial Sequence
  Peptide Derived from Human Papillomavirus
ELTEVFEFAF

SEQ ID NO: 33484 - protein, 11 aa, Artificial Sequence
  Peptide Derived from Human Papillomavirus
ELTEVFEFAFK

SEQ ID NO: 33485 - protein, 8 aa, Artificial Sequence
  Peptide Derived from Human Papillomavirus
EVFEFAFK

SEQ ID NO: 33486 - protein, 11 aa, Artificial Sequence
  Peptide Derived from Human Papillomavirus
EVFEFAFKDLF

SEQ ID NO: 33487 - protein, 10 aa, Artificial Sequence
  Peptide Derived from Human Papillomavirus
FAFKDLFVVY

SEQ ID NO: 33488 - protein, 11 aa, Artificial Sequence
  Peptide Derived from Human Papillomavirus
FAFKDLFVVYR

SEQ ID NO: 33489 - protein, 10 aa, Artificial Sequence
  Peptide Derived from Human Papillomavirus
FVVYRDSIPH

SEQ ID NO: 33490 - protein, 11 aa, Artificial Sequence
  Peptide Derived from Human Papillomavirus
FVVYRDSIPHA

SEQ ID NO: 33491 - protein, 8 aa, Artificial Sequence
  Peptide Derived from Human Papillomavirus
GLYNLLIR

SEQ ID NO: 33492 - protein, 11 aa, Artificial Sequence
  Peptide Derived from Human Papillomavirus
GLYNLLIRCLR

SEQ ID NO: 33493 - protein, 10 aa, Artificial Sequence
  Peptide Derived from Human Papillomavirus
HAACHKCIDF

SEQ ID NO: 33494 - protein, 11 aa, Artificial Sequence
  Peptide Derived from Human Papillomavirus
HAACHKCIDFY

SEQ ID NO: 33495 - protein, 8 aa, Artificial Sequence
  Peptide Derived from Human Papillomavirus
HLNEKRRF

SEQ ID NO: 33496 - protein, 9 aa, Artificial Sequence
  Peptide Derived from Human Papillomavirus
HLNEKRRFH

SEQ ID NO: 33497 - protein, 8 aa, Artificial Sequence
  Peptide Derived from Human Papillomavirus
HSCCNRAR

SEQ ID NO: 33498 - protein, 11 aa, Artificial Sequence
  Peptide Derived from Human Papillomavirus
HSCCNRARQER

SEQ ID NO: 33499 - protein, 10 aa, Artificial Sequence
  Peptide Derived from Human Papillomavirus
IAGHYRGQCH

SEQ ID NO: 33500 - protein, 8 aa, Artificial Sequence
  Peptide Derived from Human Papillomavirus
IDFYSRIR

SEQ ID NO: 33501 - protein, 11 aa, Artificial Sequence
  Peptide Derived from Human Papillomavirus
IDFYSRIRELR

SEQ ID NO: 33502 - protein, 8 aa, Artificial Sequence
  Peptide Derived from Human Papillomavirus
KCIDFYSR

SEQ ID NO: 33503 - protein, 10 aa, Artificial Sequence
  Peptide Derived from Human Papillomavirus
KCIDFYSRIR

SEQ ID NO: 33504 - protein, 8 aa, Artificial Sequence
  Peptide Derived from Human Papillomavirus
KDLFVVYR

SEQ ID NO: 33505 - protein, 8 aa, Artificial Sequence
  Peptide Derived from Human Papillomavirus
KLRHLNEK

SEQ ID NO: 33506 - protein, 9 aa, Artificial Sequence
  Peptide Derived from Human Papillomavirus
KLRHLNEKR

SEQ ID NO: 33507 - protein, 10 aa, Artificial Sequence
  Peptide Derived from Human Papillomavirus
KLRHLNEKRR

SEQ ID NO: 33508 - protein, 11 aa, Artificial Sequence
  Peptide Derived from Human Papillomavirus
KLRHLNEKRRF

SEQ ID NO: 33509 - protein, 8 aa, Artificial Sequence
  Peptide Derived from Human Papillomavirus
KLTNTGLY

SEQ ID NO: 33510 - protein, 10 aa, Artificial Sequence
  Peptide Derived from Human Papillomavirus
KTVLELTEVF

SEQ ID NO: 33511 - protein, 11 aa, Artificial Sequence
  Peptide Derived from Human Papillomavirus
LFVVYRDSIPH

SEQ ID NO: 33512 - protein, 9 aa, Artificial Sequence
  Peptide Derived from Human Papillomavirus
LIRCLRCQK

SEQ ID NO: 33513 - protein, 10 aa, Artificial Sequence
  Peptide Derived from Human Papillomavirus
LLIRCLRCQK

SEQ ID NO: 33514 - protein, 8 aa, Artificial Sequence
  Peptide Derived from Human Papillomavirus
LTEVFEFA

SEQ ID NO: 33515 - protein, 9 aa, Artificial Sequence
  Peptide Derived from Human Papillomavirus
LTEVFEFAF

SEQ ID NO: 33516 - protein, 10 aa, Artificial Sequence
  Peptide Derived from Human Papillomavirus
LTEVFEFAFK

SEQ ID NO: 33517 - protein, 9 aa, Artificial Sequence
  Peptide Derived from Human Papillomavirus
MARFEDPTR

SEQ ID NO: 33518 - protein, 10 aa, Artificial Sequence
  Peptide Derived from Human Papillomavirus
MARFEDPTRR

SEQ ID NO: 33519 - protein, 11 aa, Artificial Sequence
  Peptide Derived from Human Papillomavirus
NIAGHYRGQCH

SEQ ID NO: 33520 - protein, 8 aa, Artificial Sequence
  Peptide Derived from Human Papillomavirus
NLLIRCLR

SEQ ID NO: 33521 - protein, 11 aa, Artificial Sequence
  Peptide Derived from Human Papillomavirus
NLLIRCLRCQK

SEQ ID NO: 33522 - protein, 10 aa, Artificial Sequence
  Peptide Derived from Human Papillomavirus
NTGLYNLLIR

SEQ ID NO: 33523 - protein, 11 aa, Artificial Sequence
  Peptide Derived from Human Papillomavirus
PAEKLRHLNEK

SEQ ID NO: 33524 - protein, 9 aa, Artificial Sequence
  Peptide Derived from Human Papillomavirus
PLNPAEKLR

SEQ ID NO: 33525 - protein, 10 aa, Artificial Sequence
  Peptide Derived from Human Papillomavirus
PLNPAEKLRH

SEQ ID NO: 33526 - protein, 8 aa, Artificial Sequence
  Peptide Derived from Human Papillomavirus
QCHSCCNR

SEQ ID NO: 33527 - protein, 9 aa, Artificial Sequence
  Peptide Derived from Human Papillomavirus
QCHSCCNRA

SEQ ID NO: 33528 - protein, 10 aa, Artificial Sequence
  Peptide Derived from Human Papillomavirus
QCHSCCNRAR

SEQ ID NO: 33529 - protein, 9 aa, Artificial Sequence
  Peptide Derived from Human Papillomavirus
QDIEITCVY

SEQ ID NO: 33530 - protein, 11 aa, Artificial Sequence
  Peptide Derived from Human Papillomavirus
QDIEITCVYCK

SEQ ID NO: 33531 - protein, 9 aa, Artificial Sequence
  Peptide Derived from Human Papillomavirus
RARQERLQR

SEQ ID NO: 33532 - protein, 10 aa, Artificial Sequence
  Peptide Derived from Human Papillomavirus
RARQERLQRR

SEQ ID NO: 33533 - protein, 11 aa, Artificial Sequence
  Peptide Derived from Human Papillomavirus
RARQERLQRRR

SEQ ID NO: 33534 - protein, 9 aa, Artificial Sequence
  Peptide Derived from Human Papillomavirus
RCQKPLNPA

SEQ ID NO: 33535 - protein, 11 aa, Artificial Sequence
  Peptide Derived from Human Papillomavirus
RCQKPLNPAEK

SEQ ID NO: 33536 - protein, 8 aa, Artificial Sequence
  Peptide Derived from Human Papillomavirus
RDSIPHAA

SEQ ID NO: 33537 - protein, 10 aa, Artificial Sequence
  Peptide Derived from Human Papillomavirus
RDSIPHAACH

SEQ ID NO: 33538 - protein, 11 aa, Artificial Sequence
  Peptide Derived from Human Papillomavirus
RDSIPHAACHK

SEQ ID NO: 33539 - protein, 8 aa, Artificial Sequence
  Peptide Derived from Human Papillomavirus
RFEDPTRR

SEQ ID NO: 33540 - protein, 10 aa, Artificial Sequence
  Peptide Derived from Human Papillomavirus
RFEDPTRRPY

SEQ ID NO: 33541 - protein, 11 aa, Artificial Sequence
  Peptide Derived from Human Papillomavirus
RFEDPTRRPYK

SEQ ID NO: 33542 - protein, 8 aa, Artificial Sequence
  Peptide Derived from Human Papillomavirus
RFHNIAGH

SEQ ID NO: 33543 - protein, 9 aa, Artificial Sequence
  Peptide Derived from Human Papillomavirus
RFHNIAGHY

SEQ ID NO: 33544 - protein, 10 aa, Artificial Sequence
  Peptide Derived from Human Papillomavirus
RFHNIAGHYR

SEQ ID NO: 33545 - protein, 10 aa, Artificial Sequence
  Peptide Derived from Human Papillomavirus
RGQCHSCCNR

SEQ ID NO: 33546 - protein, 11 aa, Artificial Sequence
  Peptide Derived from Human Papillomavirus
RGQCHSCCNRA

SEQ ID NO: 33547 - protein, 8 aa, Artificial Sequence
  Peptide Derived from Human Papillomavirus
RIRELRHY

SEQ ID NO: 33548 - protein, 10 aa, Artificial Sequence
  Peptide Derived from Human Papillomavirus
SCCNRARQER

SEQ ID NO: 33549 - protein, 11 aa, Artificial Sequence
  Peptide Derived from Human Papillomavirus
SDSVYGDTLEK

SEQ ID NO: 33550 - protein, 8 aa, Artificial Sequence
  Peptide Derived from Human Papillomavirus
SIPHAACH

SEQ ID NO: 33551 - protein, 9 aa, Artificial Sequence
  Peptide Derived from Human Papillomavirus
SIPHAACHK

SEQ ID NO: 33552 - protein, 11 aa, Artificial Sequence
  Peptide Derived from Human Papillomavirus
SLQDIEITCVY

SEQ ID NO: 33553 - protein, 9 aa, Artificial Sequence
  Peptide Derived from Human Papillomavirus
SVYGDTLEK

SEQ ID NO: 33554 - protein, 9 aa, Artificial Sequence
  Peptide Derived from Human Papillomavirus
TGLYNLLIR

SEQ ID NO: 33555 - protein, 11 aa, Artificial Sequence
  Peptide Derived from Human Papillomavirus
TLEKLTNTGLY

SEQ ID NO: 33556 - protein, 9 aa, Artificial Sequence
  Peptide Derived from Human Papillomavirus
TVLELTEVF

SEQ ID NO: 33557 - protein, 11 aa, Artificial Sequence
  Peptide Derived from Human Papillomavirus
TVLELTEVFEF

SEQ ID NO: 33558 - protein, 10 aa, Artificial Sequence
  Peptide Derived from Human Papillomavirus
VFEFAFKDLF

SEQ ID NO: 33559 - protein, 8 aa, Artificial Sequence
  Peptide Derived from Human Papillomavirus
VLELTEVF

SEQ ID NO: 33560 - protein, 10 aa, Artificial Sequence
  Peptide Derived from Human Papillomavirus
VLELTEVFEF

SEQ ID NO: 33561 - protein, 11 aa, Artificial Sequence
  Peptide Derived from Human Papillomavirus
VLELTEVFEFA

SEQ ID NO: 33562 - protein, 9 aa, Artificial Sequence
  Peptide Derived from Human Papillomavirus
VVYRDSIPH

SEQ ID NO: 33563 - protein, 10 aa, Artificial Sequence
  Peptide Derived from Human Papillomavirus
VVYRDSIPHA

SEQ ID NO: 33564 - protein, 11 aa, Artificial Sequence
  Peptide Derived from Human Papillomavirus
VVYRDSIPHAA

SEQ ID NO: 33565 - protein, 8 aa, Artificial Sequence
  Peptide Derived from Human Papillomavirus
YSRIRELR

SEQ ID NO: 33566 - protein, 9 aa, Artificial Sequence
  Peptide Derived from Human Papillomavirus
YSRIRELRH

SEQ ID NO: 33567 - protein, 10 aa, Artificial Sequence
  Peptide Derived from Human Papillomavirus
YSRIRELRHY

SEQ ID NO: 33568 - protein, 11 aa, Artificial Sequence
  Peptide Derived from Human Papillomavirus
ADDLRAFQQLF

SEQ ID NO: 33569 - protein, 9 aa, Artificial Sequence
  Peptide Derived from Human Papillomavirus
ATLQDIVLH

SEQ ID NO: 33570 - protein, 9 aa, Artificial Sequence
  Peptide Derived from Human Papillomavirus
CCKCEARIK

SEQ ID NO: 33571 - protein, 8 aa, Artificial Sequence
  Peptide Derived from Human Papillomavirus
CMCCKCEA

SEQ ID NO: 33572 - protein, 9 aa, Artificial Sequence
  Peptide Derived from Human Papillomavirus
CMCCKCEAR

SEQ ID NO: 33573 - protein, 11 aa, Artificial Sequence
  Peptide Derived from Human Papillomavirus
CMCCKCEARIK

SEQ ID NO: 33574 - protein, 10 aa, Artificial Sequence
  Peptide Derived from Human Papillomavirus
DDLRAFQQLF

SEQ ID NO: 33575 - protein, 10 aa, Artificial Sequence
  Peptide Derived from Human Papillomavirus
DGVNHQHLPA

SEQ ID NO: 33576 - protein, 11 aa, Artificial Sequence
  Peptide Derived from Human Papillomavirus
DGVNHQHLPAR

SEQ ID NO: 33577 - protein, 9 aa, Artificial Sequence
  Peptide Derived from Human Papillomavirus
DLRAFQQLF

SEQ ID NO: 33578 - protein, 9 aa, Artificial Sequence
  Peptide Derived from Human Papillomavirus
EIDGVNHQH

SEQ ID NO: 33579 - protein, 9 aa, Artificial Sequence
  Peptide Derived from Human Papillomavirus
EIPVDLLCH

SEQ ID NO: 33580 - protein, 8 aa, Artificial Sequence
  Peptide Derived from Human Papillomavirus
ESSADDLR

SEQ ID NO: 33581 - protein, 9 aa, Artificial Sequence
  Peptide Derived from Human Papillomavirus
ESSADDLRA

SEQ ID NO: 33582 - protein, 10 aa, Artificial Sequence
  Peptide Derived from Human Papillomavirus
ESSADDLRAF

SEQ ID NO: 33583 - protein, 9 aa, Artificial Sequence
  Peptide Derived from Human Papillomavirus
GVNHQHLPA

SEQ ID NO: 33584 - protein, 10 aa, Artificial Sequence
  Peptide Derived from Human Papillomavirus
GVNHQHLPAR

SEQ ID NO: 33585 - protein, 11 aa, Artificial Sequence
  Peptide Derived from Human Papillomavirus
GVNHQHLPARR

SEQ ID NO: 33586 - protein, 11 aa, Artificial Sequence
  Peptide Derived from Human Papillomavirus
HLPARRAEPQR

SEQ ID NO: 33587 - protein, 9 aa, Artificial Sequence
  Peptide Derived from Human Papillomavirus
HTMLCMCCK

SEQ ID NO: 33588 - protein, 8 aa, Artificial Sequence
  Peptide Derived from Human Papillomavirus
IDGVNHQH

SEQ ID NO: 33589 - protein, 11 aa, Artificial Sequence
  Peptide Derived from Human Papillomavirus
IDGVNHQHLPA

SEQ ID NO: 33590 - protein, 10 aa, Artificial Sequence
  Peptide Derived from Human Papillomavirus
KATLQDIVLH

SEQ ID NO: 33591 - protein, 8 aa, Artificial Sequence
  Peptide Derived from Human Papillomavirus
KLVVESSA

SEQ ID NO: 33592 - protein, 9 aa, Artificial Sequence
  Peptide Derived from Human Papillomavirus
LCMCCKCEA

SEQ ID NO: 33593 - protein, 10 aa, Artificial Sequence
  Peptide Derived from Human Papillomavirus
LCMCCKCEAR

SEQ ID NO: 33594 - protein, 8 aa, Artificial Sequence
  Peptide Derived from Human Papillomavirus
LFLNTLSF

SEQ ID NO: 33595 - protein, 9 aa, Artificial Sequence
  Peptide Derived from Human Papillomavirus
LSFVCPWCA

SEQ ID NO: 33596 - protein, 11 aa, Artificial Sequence
  Peptide Derived from Human Papillomavirus
LVVESSADDLR

SEQ ID NO: 33597 - protein, 8 aa, Artificial Sequence
  Peptide Derived from Human Papillomavirus
MCCKCEAR

SEQ ID NO: 33598 - protein, 10 aa, Artificial Sequence
  Peptide Derived from Human Papillomavirus
MCCKCEARIK

SEQ ID NO: 33599 - protein, 10 aa, Artificial Sequence
  Peptide Derived from Human Papillomavirus
MLCMCCKCEA

SEQ ID NO: 33600 - protein, 11 aa, Artificial Sequence
  Peptide Derived from Human Papillomavirus
MLCMCCKCEAR

SEQ ID NO: 33601 - protein, 9 aa, Artificial Sequence
  Peptide Derived from Human Papillomavirus
NDEIDGVNH

SEQ ID NO: 33602 - protein, 11 aa, Artificial Sequence
  Peptide Derived from Human Papillomavirus
NDEIDGVNHQH

SEQ ID NO: 33603 - protein, 11 aa, Artificial Sequence
  Peptide Derived from Human Papillomavirus
NTLSFVCPWCA

SEQ ID NO: 33604 - protein, 9 aa, Artificial Sequence
  Peptide Derived from Human Papillomavirus
PARRAEPQR

SEQ ID NO: 33605 - protein, 10 aa, Artificial Sequence
  Peptide Derived from Human Papillomavirus
PARRAEPQRH

SEQ ID NO: 33606 - protein, 9 aa, Artificial Sequence
  Peptide Derived from Human Papillomavirus
QLFLNTLSF

SEQ ID NO: 33607 - protein, 10 aa, Artificial Sequence
  Peptide Derived from Human Papillomavirus
RIKLVVESSA

SEQ ID NO: 33608 - protein, 8 aa, Artificial Sequence
  Peptide Derived from Human Papillomavirus
SADDLRAF

SEQ ID NO: 33609 - protein, 8 aa, Artificial Sequence
  Peptide Derived from Human Papillomavirus
SFVCPWCA

SEQ ID NO: 33610 - protein, 8 aa, Artificial Sequence
  Peptide Derived from Human Papillomavirus
SSADDLRA

SEQ ID NO: 33611 - protein, 9 aa, Artificial Sequence
  Peptide Derived from Human Papillomavirus
SSADDLRAF

SEQ ID NO: 33612 - protein, 8 aa, Artificial Sequence
  Peptide Derived from Human Papillomavirus
TLQDIVLH

SEQ ID NO: 33613 - protein, 10 aa, Artificial Sequence
  Peptide Derived from Human Papillomavirus
TLSFVCPWCA

SEQ ID NO: 33614 - protein, 8 aa, Artificial Sequence
  Peptide Derived from Human Papillomavirus
TMLCMCCK

SEQ ID NO: 33615 - protein, 11 aa, Artificial Sequence
  Peptide Derived from Human Papillomavirus
TMLCMCCKCEA

SEQ ID NO: 33616 - protein, 10 aa, Artificial Sequence
  Peptide Derived from Human Papillomavirus
VVESSADDLR

SEQ ID NO: 33617 - protein, 11 aa, Artificial Sequence
  Peptide Derived from Human Papillomavirus
VVESSADDLRA

SEQ ID NO: 33618 - protein, 10 aa, Artificial Sequence
  Peptide Derived from Human Papillomavirus
AAPAENKDPY

SEQ ID NO: 33619 - protein, 11 aa, Artificial Sequence
  Peptide Derived from Human Papillomavirus
AATSNVSEDVR

SEQ ID NO: 33620 - protein, 9 aa, Artificial Sequence
  Peptide Derived from Human Papillomavirus
ACAGVEIGR

SEQ ID NO: 33621 - protein, 9 aa, Artificial Sequence
  Peptide Derived from Human Papillomavirus
ADPYGDSMF

SEQ ID NO: 33622 - protein, 10 aa, Artificial Sequence
  Peptide Derived from Human Papillomavirus
ADPYGDSMFF

SEQ ID NO: 33623 - protein, 8 aa, Artificial Sequence
  Peptide Derived from Human Papillomavirus
ADVMSYIH

SEQ ID NO: 33624 - protein, 11 aa, Artificial Sequence
  Peptide Derived from Human Papillomavirus
AGGGNKQDIPK

SEQ ID NO: 33625 - protein, 8 aa, Artificial Sequence
  Peptide Derived from Human Papillomavirus
AIGEHWAK

SEQ ID NO: 33626 - protein, 11 aa, Artificial Sequence
  Peptide Derived from Human Papillomavirus
AIGEHWAKGTA

SEQ ID NO: 33627 - protein, 8 aa, Artificial Sequence
  Peptide Derived from Human Papillomavirus
AITCQKDA

SEQ ID NO: 33628 - protein, 9 aa, Artificial Sequence
  Peptide Derived from Human Papillomavirus
AITCQKDAA

SEQ ID NO: 33629 - protein, 11 aa, Artificial Sequence
  Peptide Derived from Human Papillomavirus
AITCQKDAAPA

SEQ ID NO: 33630 - protein, 11 aa, Artificial Sequence
  Peptide Derived from Human Papillomavirus
ALWRPSDNTVY

SEQ ID NO: 33631 - protein, 11 aa, Artificial Sequence
  Peptide Derived from Human Papillomavirus
AMDFSTLQDTK

SEQ ID NO: 33632 - protein, 8 aa, Artificial Sequence
  Peptide Derived from Human Papillomavirus
ASPGSCVY

SEQ ID NO: 33633 - protein, 11 aa, Artificial Sequence
  Peptide Derived from Human Papillomavirus
ASTQSPVPGQY

SEQ ID NO: 33634 - protein, 9 aa, Artificial Sequence
  Peptide Derived from Human Papillomavirus
ATKFKQYSR

SEQ ID NO: 33635 - protein, 10 aa, Artificial Sequence
  Peptide Derived from Human Papillomavirus
ATKFKQYSRH

SEQ ID NO: 33636 - protein, 10 aa, Artificial Sequence
  Peptide Derived from Human Papillomavirus
ATSNVSEDVR

SEQ ID NO: 33637 - protein, 8 aa, Artificial Sequence
  Peptide Derived from Human Papillomavirus
ATTSSKPA

SEQ ID NO: 33638 - protein, 9 aa, Artificial Sequence
  Peptide Derived from Human Papillomavirus
ATTSSKPAK

SEQ ID NO: 33639 - protein, 10 aa, Artificial Sequence
  Peptide Derived from Human Papillomavirus
ATTSSKPAKR

SEQ ID NO: 33640 - protein, 8 aa, Artificial Sequence
  Peptide Derived from Human Papillomavirus
CAGVEIGR

SEQ ID NO: 33641 - protein, 8 aa, Artificial Sequence
  Peptide Derived from Human Papillomavirus
CAPAIGEH

SEQ ID NO: 33642 - protein, 10 aa, Artificial Sequence
  Peptide Derived from Human Papillomavirus
CAPAIGEHWA

SEQ ID NO: 33643 - protein, 11 aa, Artificial Sequence
  Peptide Derived from Human Papillomavirus
CAPAIGEHWAK

SEQ ID NO: 33644 - protein, 8 aa, Artificial Sequence
  Peptide Derived from Human Papillomavirus
CGHYIILF

SEQ ID NO: 33645 - protein, 10 aa, Artificial Sequence
  Peptide Derived from Human Papillomavirus
CGHYIILFLR

SEQ ID NO: 33646 - protein, 8 aa, Artificial Sequence
  Peptide Derived from Human Papillomavirus
CILGCAPA

SEQ ID NO: 33647 - protein, 8 aa, Artificial Sequence
  Peptide Derived from Human Papillomavirus
CLRREQLF

SEQ ID NO: 33648 - protein, 9 aa, Artificial Sequence
  Peptide Derived from Human Papillomavirus
CLRREQLFA

SEQ ID NO: 33649 - protein, 10 aa, Artificial Sequence
  Peptide Derived from Human Papillomavirus
CLRREQLFAR

SEQ ID NO: 33650 - protein, 11 aa, Artificial Sequence
  Peptide Derived from Human Papillomavirus
CLRREQLFARH

SEQ ID NO: 33651 - protein, 10 aa, Artificial Sequence
  Peptide Derived from Human Papillomavirus
CLYTRVLILH

SEQ ID NO: 33652 - protein, 11 aa, Artificial Sequence
  Peptide Derived from Human Papillomavirus
CLYTRVLILHY

SEQ ID NO: 33653 - protein, 8 aa, Artificial Sequence
  Peptide Derived from Human Papillomavirus
DAAPAENK

SEQ ID NO: 33654 - protein, 11 aa, Artificial Sequence
  Peptide Derived from Human Papillomavirus
DAAPAENKDPY

SEQ ID NO: 33655 - protein, 8 aa, Artificial Sequence
  Peptide Derived from Human Papillomavirus
DATKFKQY

SEQ ID NO: 33656 - protein, 10 aa, Artificial Sequence
  Peptide Derived from Human Papillomavirus
DATKFKQYSR

SEQ ID NO: 33657 - protein, 11 aa, Artificial Sequence
  Peptide Derived from Human Papillomavirus
DATKFKQYSRH

SEQ ID NO: 33658 - protein, 8 aa, Artificial Sequence
  Peptide Derived from Human Papillomavirus
DCPPLELK

SEQ ID NO: 33659 - protein, 8 aa, Artificial Sequence
  Peptide Derived from Human Papillomavirus
DDTESSHA

SEQ ID NO: 33660 - protein, 9 aa, Artificial Sequence
  Peptide Derived from Human Papillomavirus
DDTESSHAA

SEQ ID NO: 33661 - protein, 10 aa, Artificial Sequence
  Peptide Derived from Human Papillomavirus
DDYVTPTSIF

SEQ ID NO: 33662 - protein, 11 aa, Artificial Sequence
  Peptide Derived from Human Papillomavirus
DDYVTPTSIFY

SEQ ID NO: 33663 - protein, 9 aa, Artificial Sequence
  Peptide Derived from Human Papillomavirus
DFSTLQDTK

SEQ ID NO: 33664 - protein, 9 aa, Artificial Sequence
  Peptide Derived from Human Papillomavirus
DGDMVDTGY

SEQ ID NO: 33665 - protein, 11 aa, Artificial Sequence
  Peptide Derived from Human Papillomavirus
DGDMVDTGYGA

SEQ ID NO: 33666 - protein, 8 aa, Artificial Sequence
  Peptide Derived from Human Papillomavirus
DICQSICK

SEQ ID NO: 33667 - protein, 9 aa, Artificial Sequence
  Peptide Derived from Human Papillomavirus
DICQSICKY

SEQ ID NO: 33668 - protein, 8 aa, Artificial Sequence
  Peptide Derived from Human Papillomavirus
DIPKVSAY

SEQ ID NO: 33669 - protein, 10 aa, Artificial Sequence
  Peptide Derived from Human Papillomavirus
DIPKVSAYQY

SEQ ID NO: 33670 - protein, 11 aa, Artificial Sequence
  Peptide Derived from Human Papillomavirus
DIPKVSAYQYR

SEQ ID NO: 33671 - protein, 9 aa, Artificial Sequence
  Peptide Derived from Human Papillomavirus
DLDQYPLGR

SEQ ID NO: 33672 - protein, 10 aa, Artificial Sequence
  Peptide Derived from Human Papillomavirus
DLDQYPLGRK

SEQ ID NO: 33673 - protein, 11 aa, Artificial Sequence
  Peptide Derived from Human Papillomavirus
DLDQYPLGRKF

SEQ ID NO: 33674 - protein, 9 aa, Artificial Sequence
  Peptide Derived from Human Papillomavirus
DMVDTGYGA

SEQ ID NO: 33675 - protein, 8 aa, Artificial Sequence
  Peptide Derived from Human Papillomavirus
DSMFFCLR

SEQ ID NO: 33676 - protein, 9 aa, Artificial Sequence
  Peptide Derived from Human Papillomavirus
DSMFFCLRR

SEQ ID NO: 33677 - protein, 9 aa, Artificial Sequence
  Peptide Derived from Human Papillomavirus
DSQLFNKPY

SEQ ID NO: 33678 - protein, 8 aa, Artificial Sequence
  Peptide Derived from Human Papillomavirus
DTESSHAA

SEQ ID NO: 33679 - protein, 9 aa, Artificial Sequence
  Peptide Derived from Human Papillomavirus
DTGYGAMDF

SEQ ID NO: 33680 - protein, 11 aa, Artificial Sequence
  Peptide Derived from Human Papillomavirus
DTSIYNPETQR

SEQ ID NO: 33681 - protein, 8 aa, Artificial Sequence
  Peptide Derived from Human Papillomavirus
DTVPQSLY

SEQ ID NO: 33682 - protein, 10 aa, Artificial Sequence
  Peptide Derived from Human Papillomavirus
DTVPQSLYIK

SEQ ID NO: 33683 - protein, 10 aa, Artificial Sequence
  Peptide Derived from Human Papillomavirus
DTYRFVQSVA

SEQ ID NO: 33684 - protein, 10 aa, Artificial Sequence
  Peptide Derived from Human Papillomavirus
DVRDNVSVDY

SEQ ID NO: 33685 - protein, 11 aa, Artificial Sequence
  Peptide Derived from Human Papillomavirus
DVRDNVSVDYK

SEQ ID NO: 33686 - protein, 10 aa, Artificial Sequence
  Peptide Derived from Human Papillomavirus
EDGDMVDTGY

SEQ ID NO: 33687 - protein, 11 aa, Artificial Sequence
  Peptide Derived from Human Papillomavirus
EDVRDNVSVDY

SEQ ID NO: 33688 - protein, 8 aa, Artificial Sequence
  Peptide Derived from Human Papillomavirus
ETQRLVWA

SEQ ID NO: 33689 - protein, 10 aa, Artificial Sequence
  Peptide Derived from Human Papillomavirus
ETQRLVWACA

SEQ ID NO: 33690 - protein, 8 aa, Artificial Sequence
  Peptide Derived from Human Papillomavirus
FARHFWNR

SEQ ID NO: 33691 - protein, 9 aa, Artificial Sequence
  Peptide Derived from Human Papillomavirus
FARHFWNRA

SEQ ID NO: 33692 - protein, 9 aa, Artificial Sequence
  Peptide Derived from Human Papillomavirus
FCLRREQLF

SEQ ID NO: 33693 - protein, 10 aa, Artificial Sequence
  Peptide Derived from Human Papillomavirus
FCLRREQLFA

SEQ ID NO: 33694 - protein, 11 aa, Artificial Sequence
  Peptide Derived from Human Papillomavirus
FCLRREQLFAR

SEQ ID NO: 33695 - protein, 10 aa, Artificial Sequence
  Peptide Derived from Human Papillomavirus
FFCLRREQLF

SEQ ID NO: 33696 - protein, 11 aa, Artificial Sequence
  Peptide Derived from Human Papillomavirus
FFCLRREQLFA

SEQ ID NO: 33697 - protein, 9 aa, Artificial Sequence
  Peptide Derived from Human Papillomavirus
FGLPDTSIY

SEQ ID NO: 33698 - protein, 8 aa, Artificial Sequence
  Peptide Derived from Human Papillomavirus
FLQMALWR

SEQ ID NO: 33699 - protein, 8 aa, Artificial Sequence
  Peptide Derived from Human Papillomavirus
FLRNVNVF

SEQ ID NO: 33700 - protein, 11 aa, Artificial Sequence
  Peptide Derived from Human Papillomavirus
FLRNVNVFPIF

SEQ ID NO: 33701 - protein, 8 aa, Artificial Sequence
  Peptide Derived from Human Papillomavirus
FLVQAGLR

SEQ ID NO: 33702 - protein, 9 aa, Artificial Sequence
  Peptide Derived from Human Papillomavirus
FLVQAGLRR

SEQ ID NO: 33703 - protein, 10 aa, Artificial Sequence
  Peptide Derived from Human Papillomavirus
FLVQAGLRRK

SEQ ID NO: 33704 - protein, 8 aa, Artificial Sequence
  Peptide Derived from Human Papillomavirus
FSLDLDQY

SEQ ID NO: 33705 - protein, 8 aa, Artificial Sequence
  Peptide Derived from Human Papillomavirus
FSTLQDTK

SEQ ID NO: 33706 - protein, 11 aa, Artificial Sequence
  Peptide Derived from Human Papillomavirus
FVQSVAITCQK

SEQ ID NO: 33707 - protein, 9 aa, Artificial Sequence
  Peptide Derived from Human Papillomavirus
GCAPAIGEH

SEQ ID NO: 33708 - protein, 11 aa, Artificial Sequence
  Peptide Derived from Human Papillomavirus
GCAPAIGEHWA

SEQ ID NO: 33709 - protein, 9 aa, Artificial Sequence
  Peptide Derived from Human Papillomavirus
GDCPPLELK

SEQ ID NO: 33710 - protein, 8 aa, Artificial Sequence
  Peptide Derived from Human Papillomavirus
GDMVDTGY

SEQ ID NO: 33711 - protein, 10 aa, Artificial Sequence
  Peptide Derived from Human Papillomavirus
GDMVDTGYGA

SEQ ID NO: 33712 - protein, 9 aa, Artificial Sequence
  Peptide Derived from Human Papillomavirus
GDSMFFCLR

SEQ ID NO: 33713 - protein, 10 aa, Artificial Sequence
  Peptide Derived from Human Papillomavirus
GDSMFFCLRR

SEQ ID NO: 33714 - protein, 9 aa, Artificial Sequence
  Peptide Derived from Human Papillomavirus
GDTVPQSLY

SEQ ID NO: 33715 - protein, 11 aa, Artificial Sequence
  Peptide Derived from Human Papillomavirus
GDTVPQSLYIK

SEQ ID NO: 33716 - protein, 10 aa, Artificial Sequence
  Peptide Derived from Human Papillomavirus
GGGNKQDIPK

SEQ ID NO: 33717 - protein, 9 aa, Artificial Sequence
  Peptide Derived from Human Papillomavirus
GGNKQDIPK

SEQ ID NO: 33718 - protein, 8 aa, Artificial Sequence
  Peptide Derived from Human Papillomavirus
GLPDTSIY

SEQ ID NO: 33719 - protein, 11 aa, Artificial Sequence
  Peptide Derived from Human Papillomavirus
GLRRKPTIGPR

SEQ ID NO: 33720 - protein, 8 aa, Artificial Sequence
  Peptide Derived from Human Papillomavirus
GLSGHPFY

SEQ ID NO: 33721 - protein, 10 aa, Artificial Sequence
  Peptide Derived from Human Papillomavirus
GLSGHPFYNK

SEQ ID NO: 33722 - protein, 11 aa, Artificial Sequence
  Peptide Derived from Human Papillomavirus
GMPASPGSCVY

SEQ ID NO: 33723 - protein, 11 aa, Artificial Sequence
  Peptide Derived from Human Papillomavirus
GSIVTSDSQLF

SEQ ID NO: 33724 - protein, 9 aa, Artificial Sequence
  Peptide Derived from Human Papillomavirus
GVCWHNQLF

SEQ ID NO: 33725 - protein, 9 aa, Artificial Sequence
  Peptide Derived from Human Papillomavirus
GVGLSGHPF

SEQ ID NO: 33726 - protein, 10 aa, Artificial Sequence
  Peptide Derived from Human Papillomavirus
GVGLSGHPFY

SEQ ID NO: 33727 - protein, 8 aa, Artificial Sequence
  Peptide Derived from Human Papillomavirus
HIIICGHY

SEQ ID NO: 33728 - protein, 10 aa, Artificial Sequence
  Peptide Derived from Human Papillomavirus
HLLPLYGPLY

SEQ ID NO: 33729 - protein, 11 aa, Artificial Sequence
  Peptide Derived from Human Papillomavirus
HLLPLYGPLYH

SEQ ID NO: 33730 - protein, 9 aa, Artificial Sequence
  Peptide Derived from Human Papillomavirus
HSILVYMVH

SEQ ID NO: 33731 - protein, 9 aa, Artificial Sequence
  Peptide Derived from Human Papillomavirus
HVEEYDLQF

SEQ ID NO: 33732 - protein, 11 aa, Artificial Sequence
  Peptide Derived from Human Papillomavirus
HVEEYDLQFIF

SEQ ID NO: 33733 - protein, 9 aa, Artificial Sequence
  Peptide Derived from Human Papillomavirus
ICGHYIILF

SEQ ID NO: 33734 - protein, 11 aa, Artificial Sequence
  Peptide Derived from Human Papillomavirus
ICGHYIILFLR

SEQ ID NO: 33735 - protein, 8 aa, Artificial Sequence
  Peptide Derived from Human Papillomavirus
ICQSICKY

SEQ ID NO: 33736 - protein, 11 aa, Artificial Sequence
  Peptide Derived from Human Papillomavirus
ICQSICKYPDY

SEQ ID NO: 33737 - protein, 9 aa, Artificial Sequence
  Peptide Derived from Human Papillomavirus
IFLQMALWR

SEQ ID NO: 33738 - protein, 11 aa, Artificial Sequence
  Peptide Derived from Human Papillomavirus
IFQLCTITLTA

SEQ ID NO: 33739 - protein, 9 aa, Artificial Sequence
  Peptide Derived from Human Papillomavirus
IFYHAGSSR

SEQ ID NO: 33740 - protein, 10 aa, Artificial Sequence
  Peptide Derived from Human Papillomavirus
IGEHWAKGTA

SEQ ID NO: 33741 - protein, 8 aa, Artificial Sequence
  Peptide Derived from Human Papillomavirus
IGPRKRSA

SEQ ID NO: 33742 - protein, 11 aa, Artificial Sequence
  Peptide Derived from Human Papillomavirus
IGPRKRSAPSA

SEQ ID NO: 33743 - protein, 10 aa, Artificial Sequence
  Peptide Derived from Human Papillomavirus
IICGHYIILF

SEQ ID NO: 33744 - protein, 11 aa, Artificial Sequence
  Peptide Derived from Human Papillomavirus
IIICGHYIILF

SEQ ID NO: 33745 - protein, 11 aa, Artificial Sequence
  Peptide Derived from Human Papillomavirus
IILFLRNVNVF

SEQ ID NO: 33746 - protein, 10 aa, Artificial Sequence
  Peptide Derived from Human Papillomavirus
ILFLRNVNVF

SEQ ID NO: 33747 - protein, 11 aa, Artificial Sequence
  Peptide Derived from Human Papillomavirus
ILGCAPAIGEH

SEQ ID NO: 33748 - protein, 10 aa, Artificial Sequence
  Peptide Derived from Human Papillomavirus
ILHYHLLPLY

SEQ ID NO: 33749 - protein, 8 aa, Artificial Sequence
  Peptide Derived from Human Papillomavirus
ITCQKDAA

SEQ ID NO: 33750 - protein, 10 aa, Artificial Sequence
  Peptide Derived from Human Papillomavirus
ITCQKDAAPA

SEQ ID NO: 33751 - protein, 10 aa, Artificial Sequence
  Peptide Derived from Human Papillomavirus
ITLTADVMSY

SEQ ID NO: 33752 - protein, 9 aa, Artificial Sequence
  Peptide Derived from Human Papillomavirus
IVTSDSQLF

SEQ ID NO: 33753 - protein, 11 aa, Artificial Sequence
  Peptide Derived from Human Papillomavirus
IVTSDSQLFNK

SEQ ID NO: 33754 - protein, 9 aa, Artificial Sequence
  Peptide Derived from Human Papillomavirus
KDAAPAENK

SEQ ID NO: 33755 - protein, 8 aa, Artificial Sequence
  Peptide Derived from Human Papillomavirus
KDPYDKLK

SEQ ID NO: 33756 - protein, 9 aa, Artificial Sequence
  Peptide Derived from Human Papillomavirus
KDPYDKLKF

SEQ ID NO: 33757 - protein, 10 aa, Artificial Sequence
  Peptide Derived from Human Papillomavirus
KFGLPDTSIY

SEQ ID NO: 33758 - protein, 8 aa, Artificial Sequence
  Peptide Derived from Human Papillomavirus
KFKQYSRH

SEQ ID NO: 33759 - protein, 9 aa, Artificial Sequence
  Peptide Derived from Human Papillomavirus
KFLVQAGLR

SEQ ID NO: 33760 - protein, 10 aa, Artificial Sequence
  Peptide Derived from Human Papillomavirus
KFLVQAGLRR

SEQ ID NO: 33761 - protein, 11 aa, Artificial Sequence
  Peptide Derived from Human Papillomavirus
KFLVQAGLRRK

SEQ ID NO: 33762 - protein, 9 aa, Artificial Sequence
  Peptide Derived from Human Papillomavirus
KFSLDLDQY

SEQ ID NO: 33763 - protein, 8 aa, Artificial Sequence
  Peptide Derived from Human Papillomavirus
KFWNVDLK

SEQ ID NO: 33764 - protein, 10 aa, Artificial Sequence
  Peptide Derived from Human Papillomavirus
KFWNVDLKEK

SEQ ID NO: 33765 - protein, 11 aa, Artificial Sequence
  Peptide Derived from Human Papillomavirus
KFWNVDLKEKF

SEQ ID NO: 33766 - protein, 8 aa, Artificial Sequence
  Peptide Derived from Human Papillomavirus
KGTACKSR

SEQ ID NO: 33767 - protein, 9 aa, Artificial Sequence
  Peptide Derived from Human Papillomavirus
KLDDTESSH

SEQ ID NO: 33768 - protein, 10 aa, Artificial Sequence
  Peptide Derived from Human Papillomavirus
KLDDTESSHA

SEQ ID NO: 33769 - protein, 11 aa, Artificial Sequence
  Peptide Derived from Human Papillomavirus
KLDDTESSHAA

SEQ ID NO: 33770 - protein, 10 aa, Artificial Sequence
  Peptide Derived from Human Papillomavirus
KLKFWNVDLK

SEQ ID NO: 33771 - protein, 8 aa, Artificial Sequence
  Peptide Derived from Human Papillomavirus
KVSAYQYR

SEQ ID NO: 33772 - protein, 10 aa, Artificial Sequence
  Peptide Derived from Human Papillomavirus
KVSAYQYRVF

SEQ ID NO: 33773 - protein, 11 aa, Artificial Sequence
  Peptide Derived from Human Papillomavirus
KVSAYQYRVFR

SEQ ID NO: 33774 - protein, 9 aa, Artificial Sequence
  Peptide Derived from Human Papillomavirus
LCILGCAPA

SEQ ID NO: 33775 - protein, 8 aa, Artificial Sequence
  Peptide Derived from Human Papillomavirus
LCTITLTA

SEQ ID NO: 33776 - protein, 8 aa, Artificial Sequence
  Peptide Derived from Human Papillomavirus
LDDTESSH

SEQ ID NO: 33777 - protein, 9 aa, Artificial Sequence
  Peptide Derived from Human Papillomavirus
LDDTESSHA

SEQ ID NO: 33778 - protein, 10 aa, Artificial Sequence
  Peptide Derived from Human Papillomavirus
LDDTESSHAA

SEQ ID NO: 33779 - protein, 9 aa, Artificial Sequence
  Peptide Derived from Human Papillomavirus
LDICQSICK

SEQ ID NO: 33780 - protein, 10 aa, Artificial Sequence
  Peptide Derived from Human Papillomavirus
LDICQSICKY

SEQ ID NO: 33781 - protein, 10 aa, Artificial Sequence
  Peptide Derived from Human Papillomavirus
LDLDQYPLGR

SEQ ID NO: 33782 - protein, 11 aa, Artificial Sequence
  Peptide Derived from Human Papillomavirus
LDLDQYPLGRK

SEQ ID NO: 33783 - protein, 8 aa, Artificial Sequence
  Peptide Derived from Human Papillomavirus
LDQYPLGR

SEQ ID NO: 33784 - protein, 9 aa, Artificial Sequence
  Peptide Derived from Human Papillomavirus
LDQYPLGRK

SEQ ID NO: 33785 - protein, 10 aa, Artificial Sequence
  Peptide Derived from Human Papillomavirus
LDQYPLGRKF

SEQ ID NO: 33786 - protein, 9 aa, Artificial Sequence
  Peptide Derived from Human Papillomavirus
LFARHFWNR

SEQ ID NO: 33787 - protein, 10 aa, Artificial Sequence
  Peptide Derived from Human Papillomavirus
LFARHFWNRA

SEQ ID NO: 33788 - protein, 9 aa, Artificial Sequence
  Peptide Derived from Human Papillomavirus
LFLRNVNVF

SEQ ID NO: 33789 - protein, 9 aa, Artificial Sequence
  Peptide Derived from Human Papillomavirus
LFNKPYWLH

SEQ ID NO: 33790 - protein, 10 aa, Artificial Sequence
  Peptide Derived from Human Papillomavirus
LFNKPYWLHK

SEQ ID NO: 33791 - protein, 11 aa, Artificial Sequence
  Peptide Derived from Human Papillomavirus
LFNKPYWLHKA

SEQ ID NO: 33792 - protein, 10 aa, Artificial Sequence
  Peptide Derived from Human Papillomavirus
LGCAPAIGEH

SEQ ID NO: 33793 - protein, 9 aa, Artificial Sequence
  Peptide Derived from Human Papillomavirus
LGRKFLVQA

SEQ ID NO: 33794 - protein, 8 aa, Artificial Sequence
  Peptide Derived from Human Papillomavirus
LGVGLSGH

SEQ ID NO: 33795 - protein, 10 aa, Artificial Sequence
  Peptide Derived from Human Papillomavirus
LGVGLSGHPF

SEQ ID NO: 33796 - protein, 11 aa, Artificial Sequence
  Peptide Derived from Human Papillomavirus
LGVGLSGHPFY

SEQ ID NO: 33797 - protein, 11 aa, Artificial Sequence
  Peptide Derived from Human Papillomavirus
LILHYHLLPLY

SEQ ID NO: 33798 - protein, 9 aa, Artificial Sequence
  Peptide Derived from Human Papillomavirus
LLPLYGPLY

SEQ ID NO: 33799 - protein, 10 aa, Artificial Sequence
  Peptide Derived from Human Papillomavirus
LLPLYGPLYH

SEQ ID NO: 33800 - protein, 8 aa, Artificial Sequence
  Peptide Derived from Human Papillomavirus
LLTVGNPY

SEQ ID NO: 33801 - protein, 9 aa, Artificial Sequence
  Peptide Derived from Human Papillomavirus
LLTVGNPYF

SEQ ID NO: 33802 - protein, 10 aa, Artificial Sequence
  Peptide Derived from Human Papillomavirus
LLTVGNPYFR

SEQ ID NO: 33803 - protein, 9 aa, Artificial Sequence
  Peptide Derived from Human Papillomavirus
LSGHPFYNK

SEQ ID NO: 33804 - protein, 8 aa, Artificial Sequence
  Peptide Derived from Human Papillomavirus
LTADVMSY

SEQ ID NO: 33805 - protein, 10 aa, Artificial Sequence
  Peptide Derived from Human Papillomavirus
LTADVMSYIH

SEQ ID NO: 33806 - protein, 8 aa, Artificial Sequence
  Peptide Derived from Human Papillomavirus
LTVGNPYF

SEQ ID NO: 33807 - protein, 9 aa, Artificial Sequence
  Peptide Derived from Human Papillomavirus
LTVGNPYFR

SEQ ID NO: 33808 - protein, 8 aa, Artificial Sequence
  Peptide Derived from Human Papillomavirus
LVQAGLRR

SEQ ID NO: 33809 - protein, 9 aa, Artificial Sequence
  Peptide Derived from Human Papillomavirus
LVQAGLRRK

SEQ ID NO: 33810 - protein, 11 aa, Artificial Sequence
  Peptide Derived from Human Papillomavirus
MCLYTRVLILH

SEQ ID NO: 33811 - protein, 10 aa, Artificial Sequence
  Peptide Derived from Human Papillomavirus
MDFSTLQDTK

SEQ ID NO: 33812 - protein, 11 aa, Artificial Sequence
  Peptide Derived from Human Papillomavirus
MFFCLRREQLF

SEQ ID NO: 33813 - protein, 10 aa, Artificial Sequence
  Peptide Derived from Human Papillomavirus
MGDTVPQSLY

SEQ ID NO: 33814 - protein, 11 aa, Artificial Sequence
  Peptide Derived from Human Papillomavirus
MSADPYGDSMF

SEQ ID NO: 33815 - protein, 8 aa, Artificial Sequence
  Peptide Derived from Human Papillomavirus
MVDTGYGA

SEQ ID NO: 33816 - protein, 11 aa, Artificial Sequence
  Peptide Derived from Human Papillomavirus
MVDTGYGAMDF

SEQ ID NO: 33817 - protein, 9 aa, Artificial Sequence
  Peptide Derived from Human Papillomavirus
MVHIIICGH

SEQ ID NO: 33818 - protein, 10 aa, Artificial Sequence
  Peptide Derived from Human Papillomavirus
MVHIIICGHY

SEQ ID NO: 33819 - protein, 10 aa, Artificial Sequence
  Peptide Derived from Human Papillomavirus
NGVCWHNQLF

SEQ ID NO: 33820 - protein, 10 aa, Artificial Sequence
  Peptide Derived from Human Papillomavirus
NSSILEDWNF

SEQ ID NO: 33821 - protein, 11 aa, Artificial Sequence
  Peptide Derived from Human Papillomavirus
NTVYLPPPSVA

SEQ ID NO: 33822 - protein, 8 aa, Artificial Sequence
  Peptide Derived from Human Papillomavirus
NVDLKEKF

SEQ ID NO: 33823 - protein, 10 aa, Artificial Sequence
  Peptide Derived from Human Papillomavirus
NVFPIFLQMA

SEQ ID NO: 33824 - protein, 8 aa, Artificial Sequence
  Peptide Derived from Human Papillomavirus
NVNVFPIF

SEQ ID NO: 33825 - protein, 8 aa, Artificial Sequence
  Peptide Derived from Human Papillomavirus
PAENKDPY

SEQ ID NO: 33826 - protein, 10 aa, Artificial Sequence
  Peptide Derived from Human Papillomavirus
PAENKDPYDK

SEQ ID NO: 33827 - protein, 8 aa, Artificial Sequence
  Peptide Derived from Human Papillomavirus
PAIGEHWA

SEQ ID NO: 33828 - protein, 9 aa, Artificial Sequence
  Peptide Derived from Human Papillomavirus
PAIGEHWAK

SEQ ID NO: 33829 - protein, 8 aa, Artificial Sequence
  Peptide Derived from Human Papillomavirus
PAKRVRVR

SEQ ID NO: 33830 - protein, 9 aa, Artificial Sequence
  Peptide Derived from Human Papillomavirus
PAKRVRVRA

SEQ ID NO: 33831 - protein, 10 aa, Artificial Sequence
  Peptide Derived from Human Papillomavirus
PAKRVRVRAR

SEQ ID NO: 33832 - protein, 11 aa, Artificial Sequence
  Peptide Derived from Human Papillomavirus
PAKRVRVRARK

SEQ ID NO: 33833 - protein, 9 aa, Artificial Sequence
  Peptide Derived from Human Papillomavirus
PASPGSCVY

SEQ ID NO: 33834 - protein, 8 aa, Artificial Sequence
  Peptide Derived from Human Papillomavirus
PDYLQMSA

SEQ ID NO: 33835 - protein, 11 aa, Artificial Sequence
  Peptide Derived from Human Papillomavirus
PDYLQMSADPY

SEQ ID NO: 33836 - protein, 8 aa, Artificial Sequence
  Peptide Derived from Human Papillomavirus
PGQYDATK

SEQ ID NO: 33837 - protein, 9 aa, Artificial Sequence
  Peptide Derived from Human Papillomavirus
PGQYDATKF

SEQ ID NO: 33838 - protein, 10 aa, Artificial Sequence
  Peptide Derived from Human Papillomavirus
PGQYDATKFK

SEQ ID NO: 33839 - protein, 10 aa, Artificial Sequence
  Peptide Derived from Human Papillomavirus
PIFLQMALWR

SEQ ID NO: 33840 - protein, 10 aa, Artificial Sequence
  Peptide Derived from Human Papillomavirus
PLDICQSICK

SEQ ID NO: 33841 - protein, 11 aa, Artificial Sequence
  Peptide Derived from Human Papillomavirus
PLDICQSICKY

SEQ ID NO: 33842 - protein, 10 aa, Artificial Sequence
  Peptide Derived from Human Papillomavirus
PLGRKFLVQA

SEQ ID NO: 33843 - protein, 9 aa, Artificial Sequence
  Peptide Derived from Human Papillomavirus
PLGVGLSGH

SEQ ID NO: 33844 - protein, 11 aa, Artificial Sequence
  Peptide Derived from Human Papillomavirus
PLGVGLSGHPF

SEQ ID NO: 33845 - protein, 8 aa, Artificial Sequence
  Peptide Derived from Human Papillomavirus
PLHSILVY

SEQ ID NO: 33846 - protein, 11 aa, Artificial Sequence
  Peptide Derived from Human Papillomavirus
PLHSILVYMVH

SEQ ID NO: 33847 - protein, 10 aa, Artificial Sequence
  Peptide Derived from Human Papillomavirus
PLPLHSILVY

SEQ ID NO: 33848 - protein, 8 aa, Artificial Sequence
  Peptide Derived from Human Papillomavirus
PLYGPLYH

SEQ ID NO: 33849 - protein, 10 aa, Artificial Sequence
  Peptide Derived from Human Papillomavirus
PLYGPLYHPR

SEQ ID NO: 33850 - protein, 11 aa, Artificial Sequence
  Peptide Derived from Human Papillomavirus
PLYHPRPLPLH

SEQ ID NO: 33851 - protein, 8 aa, Artificial Sequence
  Peptide Derived from Human Papillomavirus
PSATTSSK

SEQ ID NO: 33852 - protein, 10 aa, Artificial Sequence
  Peptide Derived from Human Papillomavirus
PSATTSSKPA

SEQ ID NO: 33853 - protein, 11 aa, Artificial Sequence
  Peptide Derived from Human Papillomavirus
PSATTSSKPAK

SEQ ID NO: 33854 - protein, 9 aa, Artificial Sequence
  Peptide Derived from Human Papillomavirus
PSTNLTICA

SEQ ID NO: 33855 - protein, 8 aa, Artificial Sequence
  Peptide Derived from Human Papillomavirus
PTIGPRKR

SEQ ID NO: 33856 - protein, 10 aa, Artificial Sequence
  Peptide Derived from Human Papillomavirus
PTIGPRKRSA

SEQ ID NO: 33857 - protein, 8 aa, Artificial Sequence
  Peptide Derived from Human Papillomavirus
PTSIFYHA

SEQ ID NO: 33858 - protein, 9 aa, Artificial Sequence
  Peptide Derived from Human Papillomavirus
PTTSLVDTY

SEQ ID NO: 33859 - protein, 10 aa, Artificial Sequence
  Peptide Derived from Human Papillomavirus
PTTSLVDTYR

SEQ ID NO: 33860 - protein, 11 aa, Artificial Sequence
  Peptide Derived from Human Papillomavirus
PTTSLVDTYRF

SEQ ID NO: 33861 - protein, 8 aa, Artificial Sequence
  Peptide Derived from Human Papillomavirus
PVPGQYDA

SEQ ID NO: 33862 - protein, 10 aa, Artificial Sequence
  Peptide Derived from Human Papillomavirus
PVPGQYDATK

SEQ ID NO: 33863 - protein, 11 aa, Artificial Sequence
  Peptide Derived from Human Papillomavirus
PVPGQYDATKF

SEQ ID NO: 33864 - protein, 8 aa, Artificial Sequence
  Peptide Derived from Human Papillomavirus
QDIPKVSA

SEQ ID NO: 33865 - protein, 9 aa, Artificial Sequence
  Peptide Derived from Human Papillomavirus
QDIPKVSAY

SEQ ID NO: 33866 - protein, 11 aa, Artificial Sequence
  Peptide Derived from Human Papillomavirus
QDIPKVSAYQY

SEQ ID NO: 33867 - protein, 10 aa, Artificial Sequence
  Peptide Derived from Human Papillomavirus
QGDCPPLELK

SEQ ID NO: 33868 - protein, 10 aa, Artificial Sequence
  Peptide Derived from Human Papillomavirus
QGHNNGVCWH

SEQ ID NO: 33869 - protein, 8 aa, Artificial Sequence
  Peptide Derived from Human Papillomavirus
QLCILGCA

SEQ ID NO: 33870 - protein, 10 aa, Artificial Sequence
  Peptide Derived from Human Papillomavirus
QLCILGCAPA

SEQ ID NO: 33871 - protein, 9 aa, Artificial Sequence
  Peptide Derived from Human Papillomavirus
QLCTITLTA

SEQ ID NO: 33872 - protein, 10 aa, Artificial Sequence
  Peptide Derived from Human Papillomavirus
QLFARHFWNR

SEQ ID NO: 33873 - protein, 11 aa, Artificial Sequence
  Peptide Derived from Human Papillomavirus
QLFARHFWNRA

SEQ ID NO: 33874 - protein, 10 aa, Artificial Sequence
  Peptide Derived from Human Papillomavirus
QLFNKPYWLH

SEQ ID NO: 33875 - protein, 11 aa, Artificial Sequence
  Peptide Derived from Human Papillomavirus
QLFNKPYWLHK

SEQ ID NO: 33876 - protein, 8 aa, Artificial Sequence
  Peptide Derived from Human Papillomavirus
QLPDPNKF

SEQ ID NO: 33877 - protein, 9 aa, Artificial Sequence
  Peptide Derived from Human Papillomavirus
QSICKYPDY

SEQ ID NO: 33878 - protein, 8 aa, Artificial Sequence
  Peptide Derived from Human Papillomavirus
QSPVPGQY

SEQ ID NO: 33879 - protein, 10 aa, Artificial Sequence
  Peptide Derived from Human Papillomavirus
QSPVPGQYDA

SEQ ID NO: 33880 - protein, 9 aa, Artificial Sequence
  Peptide Derived from Human Papillomavirus
QSVAITCQK

SEQ ID NO: 33881 - protein, 11 aa, Artificial Sequence
  Peptide Derived from Human Papillomavirus
QSVAITCQKDA

SEQ ID NO: 33882 - protein, 10 aa, Artificial Sequence
  Peptide Derived from Human Papillomavirus
QTQLCILGCA

SEQ ID NO: 33883 - protein, 8 aa, Artificial Sequence
  Peptide Derived from Human Papillomavirus
RDNVSVDY

SEQ ID NO: 33884 - protein, 9 aa, Artificial Sequence
  Peptide Derived from Human Papillomavirus
RDNVSVDYK

SEQ ID NO: 33885 - protein, 9 aa, Artificial Sequence
  Peptide Derived from Human Papillomavirus
RLLTVGNPY

SEQ ID NO: 33886 - protein, 10 aa, Artificial Sequence
  Peptide Derived from Human Papillomavirus
RLLTVGNPYF

SEQ ID NO: 33887 - protein, 11 aa, Artificial Sequence
  Peptide Derived from Human Papillomavirus
RLLTVGNPYFR

SEQ ID NO: 33888 - protein, 11 aa, Artificial Sequence
  Peptide Derived from Human Papillomavirus
RSAPSATTSSK

SEQ ID NO: 33889 - protein, 8 aa, Artificial Sequence
  Peptide Derived from Human Papillomavirus
RVLILHYH

SEQ ID NO: 33890 - protein, 9 aa, Artificial Sequence
  Peptide Derived from Human Papillomavirus
RVPAGGGNK

SEQ ID NO: 33891 - protein, 9 aa, Artificial Sequence
  Peptide Derived from Human Papillomavirus
RVQLPDPNK

SEQ ID NO: 33892 - protein, 10 aa, Artificial Sequence
  Peptide Derived from Human Papillomavirus
RVQLPDPNKF

SEQ ID NO: 33893 - protein, 8 aa, Artificial Sequence
  Peptide Derived from Human Papillomavirus
RVRVRARK

SEQ ID NO: 33894 - protein, 8 aa, Artificial Sequence
  Peptide Derived from Human Papillomavirus
RVVNTDDY

SEQ ID NO: 33895 - protein, 10 aa, Artificial Sequence
  Peptide Derived from Human Papillomavirus
SADPYGDSMF

SEQ ID NO: 33896 - protein, 11 aa, Artificial Sequence
  Peptide Derived from Human Papillomavirus
SADPYGDSMFF

SEQ ID NO: 33897 - protein, 10 aa, Artificial Sequence
  Peptide Derived from Human Papillomavirus
SAPSATTSSK

SEQ ID NO: 33898 - protein, 9 aa, Artificial Sequence
  Peptide Derived from Human Papillomavirus
SATTSSKPA

SEQ ID NO: 33899 - protein, 10 aa, Artificial Sequence
  Peptide Derived from Human Papillomavirus
SATTSSKPAK

SEQ ID NO: 33900 - protein, 11 aa, Artificial Sequence
  Peptide Derived from Human Papillomavirus
SATTSSKPAKR

SEQ ID NO: 33901 - protein, 8 aa, Artificial Sequence
  Peptide Derived from Human Papillomavirus
SAYQYRVF

SEQ ID NO: 33902 - protein, 9 aa, Artificial Sequence
  Peptide Derived from Human Papillomavirus
SAYQYRVFR

SEQ ID NO: 33903 - protein, 8 aa, Artificial Sequence
  Peptide Derived from Human Papillomavirus
SDSQLFNK

SEQ ID NO: 33904 - protein, 10 aa, Artificial Sequence
  Peptide Derived from Human Papillomavirus
SDSQLFNKPY

SEQ ID NO: 33905 - protein, 8 aa, Artificial Sequence
  Peptide Derived from Human Papillomavirus
SGHPFYNK

SEQ ID NO: 33906 - protein, 8 aa, Artificial Sequence
  Peptide Derived from Human Papillomavirus
SICKYPDY

SEQ ID NO: 33907 - protein, 10 aa, Artificial Sequence
  Peptide Derived from Human Papillomavirus
SIFYHAGSSR

SEQ ID NO: 33908 - protein, 8 aa, Artificial Sequence
  Peptide Derived from Human Papillomavirus
SILEDWNF

SEQ ID NO: 33909 - protein, 8 aa, Artificial Sequence
  Peptide Derived from Human Papillomavirus
SILVYMVH

SEQ ID NO: 33910 - protein, 10 aa, Artificial Sequence
  Peptide Derived from Human Papillomavirus
SIVTSDSQLF

SEQ ID NO: 33911 - protein, 9 aa, Artificial Sequence
  Peptide Derived from Human Papillomavirus
SIYNPETQR

SEQ ID NO: 33912 - protein, 11 aa, Artificial Sequence
  Peptide Derived from Human Papillomavirus
SLDLDQYPLGR

SEQ ID NO: 33913 - protein, 8 aa, Artificial Sequence
  Peptide Derived from Human Papillomavirus
SLVDTYRF

SEQ ID NO: 33914 - protein, 11 aa, Artificial Sequence
  Peptide Derived from Human Papillomavirus
SLYIKGTGMPA

SEQ ID NO: 33915 - protein, 8 aa, Artificial Sequence
  Peptide Derived from Human Papillomavirus
SMFFCLRR

SEQ ID NO: 33916 - protein, 9 aa, Artificial Sequence
  Peptide Derived from Human Papillomavirus
SSILEDWNF

SEQ ID NO: 33917 - protein, 9 aa, Artificial Sequence
  Peptide Derived from Human Papillomavirus
SSKPAKRVR

SEQ ID NO: 33918 - protein, 11 aa, Artificial Sequence
  Peptide Derived from Human Papillomavirus
SSKPAKRVRVR

SEQ ID NO: 33919 - protein, 11 aa, Artificial Sequence
  Peptide Derived from Human Papillomavirus
SSRLLTVGNPY

SEQ ID NO: 33920 - protein, 8 aa, Artificial Sequence
  Peptide Derived from Human Papillomavirus
STNLTICA

SEQ ID NO: 33921 - protein, 10 aa, Artificial Sequence
  Peptide Derived from Human Papillomavirus
STQSPVPGQY

SEQ ID NO: 33922 - protein, 8 aa, Artificial Sequence
  Peptide Derived from Human Papillomavirus
SVAITCQK

SEQ ID NO: 33923 - protein, 10 aa, Artificial Sequence
  Peptide Derived from Human Papillomavirus
SVAITCQKDA

SEQ ID NO: 33924 - protein, 11 aa, Artificial Sequence
  Peptide Derived from Human Papillomavirus
SVAITCQKDAA

SEQ ID NO: 33925 - protein, 11 aa, Artificial Sequence
  Peptide Derived from Human Papillomavirus
SVARVVNTDDY

SEQ ID NO: 33926 - protein, 9 aa, Artificial Sequence
  Peptide Derived from Human Papillomavirus
TADVMSYIH

SEQ ID NO: 33927 - protein, 9 aa, Artificial Sequence
  Peptide Derived from Human Papillomavirus
TCQKDAAPA

SEQ ID NO: 33928 - protein, 11 aa, Artificial Sequence
  Peptide Derived from Human Papillomavirus
TDDYVTPTSIF

SEQ ID NO: 33929 - protein, 8 aa, Artificial Sequence
  Peptide Derived from Human Papillomavirus
TGYGAMDF

SEQ ID NO: 33930 - protein, 9 aa, Artificial Sequence
  Peptide Derived from Human Papillomavirus
TIGPRKRSA

SEQ ID NO: 33931 - protein, 11 aa, Artificial Sequence
  Peptide Derived from Human Papillomavirus
TITLTADVMSY

SEQ ID NO: 33932 - protein, 9 aa, Artificial Sequence
  Peptide Derived from Human Papillomavirus
TLTADVMSY

SEQ ID NO: 33933 - protein, 11 aa, Artificial Sequence
  Peptide Derived from Human Papillomavirus
TLTADVMSYIH

SEQ ID NO: 33934 - protein, 11 aa, Artificial Sequence
  Peptide Derived from Human Papillomavirus
TMGDTVPQSLY

SEQ ID NO: 33935 - protein, 9 aa, Artificial Sequence
  Peptide Derived from Human Papillomavirus
TSDSQLFNK

SEQ ID NO: 33936 - protein, 11 aa, Artificial Sequence
  Peptide Derived from Human Papillomavirus
TSDSQLFNKPY

SEQ ID NO: 33937 - protein, 11 aa, Artificial Sequence
  Peptide Derived from Human Papillomavirus
TSIFYHAGSSR

SEQ ID NO: 33938 - protein, 10 aa, Artificial Sequence
  Peptide Derived from Human Papillomavirus
TSIYNPETQR

SEQ ID NO: 33939 - protein, 8 aa, Artificial Sequence
  Peptide Derived from Human Papillomavirus
TSLVDTYR

SEQ ID NO: 33940 - protein, 9 aa, Artificial Sequence
  Peptide Derived from Human Papillomavirus
TSLVDTYRF

SEQ ID NO: 33941 - protein, 9 aa, Artificial Sequence
  Peptide Derived from Human Papillomavirus
TSNVSEDVR

SEQ ID NO: 33942 - protein, 8 aa, Artificial Sequence
  Peptide Derived from Human Papillomavirus
TSSKPAKR

SEQ ID NO: 33943 - protein, 10 aa, Artificial Sequence
  Peptide Derived from Human Papillomavirus
TSSKPAKRVR

SEQ ID NO: 33944 - protein, 11 aa, Artificial Sequence
  Peptide Derived from Human Papillomavirus
TTPSTNLTICA

SEQ ID NO: 33945 - protein, 8 aa, Artificial Sequence
  Peptide Derived from Human Papillomavirus
TTSLVDTY

SEQ ID NO: 33946 - protein, 9 aa, Artificial Sequence
  Peptide Derived from Human Papillomavirus
TTSLVDTYR

SEQ ID NO: 33947 - protein, 10 aa, Artificial Sequence
  Peptide Derived from Human Papillomavirus
TTSLVDTYRF

SEQ ID NO: 33948 - protein, 8 aa, Artificial Sequence
  Peptide Derived from Human Papillomavirus
TTSSKPAK

SEQ ID NO: 33949 - protein, 9 aa, Artificial Sequence
  Peptide Derived from Human Papillomavirus
TTSSKPAKR

SEQ ID NO: 33950 - protein, 11 aa, Artificial Sequence
  Peptide Derived from Human Papillomavirus
TTSSKPAKRVR

SEQ ID NO: 33951 - protein, 8 aa, Artificial Sequence
  Peptide Derived from Human Papillomavirus
TVGNPYFR

SEQ ID NO: 33952 - protein, 11 aa, Artificial Sequence
  Peptide Derived from Human Papillomavirus
TVGNPYFRVPA

SEQ ID NO: 33953 - protein, 9 aa, Artificial Sequence
  Peptide Derived from Human Papillomavirus
TVPQSLYIK

SEQ ID NO: 33954 - protein, 10 aa, Artificial Sequence
  Peptide Derived from Human Papillomavirus
TVYLPPPSVA

SEQ ID NO: 33955 - protein, 11 aa, Artificial Sequence
  Peptide Derived from Human Papillomavirus
TVYLPPPSVAR

SEQ ID NO: 33956 - protein, 9 aa, Artificial Sequence
  Peptide Derived from Human Papillomavirus
VAITCQKDA

SEQ ID NO: 33957 - protein, 10 aa, Artificial Sequence
  Peptide Derived from Human Papillomavirus
VAITCQKDAA

SEQ ID NO: 33958 - protein, 10 aa, Artificial Sequence
  Peptide Derived from Human Papillomavirus
VARVVNTDDY

SEQ ID NO: 33959 - protein, 8 aa, Artificial Sequence
  Peptide Derived from Human Papillomavirus
VCWHNQLF

SEQ ID NO: 33960 - protein, 10 aa, Artificial Sequence
  Peptide Derived from Human Papillomavirus
VDTGYGAMDF

SEQ ID NO: 33961 - protein, 11 aa, Artificial Sequence
  Peptide Derived from Human Papillomavirus
VDTYRFVQSVA

SEQ ID NO: 33962 - protein, 9 aa, Artificial Sequence
  Peptide Derived from Human Papillomavirus
VFPIFLQMA

SEQ ID NO: 33963 - protein, 11 aa, Artificial Sequence
  Peptide Derived from Human Papillomavirus
VFRVQLPDPNK

SEQ ID NO: 33964 - protein, 8 aa, Artificial Sequence
  Peptide Derived from Human Papillomavirus
VGLSGHPF

SEQ ID NO: 33965 - protein, 9 aa, Artificial Sequence
  Peptide Derived from Human Papillomavirus
VGLSGHPFY

SEQ ID NO: 33966 - protein, 11 aa, Artificial Sequence
  Peptide Derived from Human Papillomavirus
VGLSGHPFYNK

SEQ ID NO: 33967 - protein, 10 aa, Artificial Sequence
  Peptide Derived from Human Papillomavirus
VGNPYFRVPA

SEQ ID NO: 33968 - protein, 9 aa, Artificial Sequence
  Peptide Derived from Human Papillomavirus
VSAYQYRVF

SEQ ID NO: 33969 - protein, 10 aa, Artificial Sequence
  Peptide Derived from Human Papillomavirus
VSAYQYRVFR

SEQ ID NO: 33970 - protein, 8 aa, Artificial Sequence
  Peptide Derived from Human Papillomavirus
VTPTSIFY

SEQ ID NO: 33971 - protein, 9 aa, Artificial Sequence
  Peptide Derived from Human Papillomavirus
VTPTSIFYH

SEQ ID NO: 33972 - protein, 10 aa, Artificial Sequence
  Peptide Derived from Human Papillomavirus
VTPTSIFYHA

SEQ ID NO: 33973 - protein, 8 aa, Artificial Sequence
  Peptide Derived from Human Papillomavirus
VTSDSQLF

SEQ ID NO: 33974 - protein, 10 aa, Artificial Sequence
  Peptide Derived from Human Papillomavirus
VTSDSQLFNK

SEQ ID NO: 33975 - protein, 10 aa, Artificial Sequence
  Peptide Derived from Human Papillomavirus
WACAGVEIGR

SEQ ID NO: 33976 - protein, 8 aa, Artificial Sequence
  Peptide Derived from Human Papillomavirus
WAKGTACK

SEQ ID NO: 33977 - protein, 10 aa, Artificial Sequence
  Peptide Derived from Human Papillomavirus
WAKGTACKSR

SEQ ID NO: 33978 - protein, 8 aa, Artificial Sequence
  Peptide Derived from Human Papillomavirus
WLHKAQGH

SEQ ID NO: 33979 - protein, 9 aa, Artificial Sequence
  Peptide Derived from Human Papillomavirus
YDATKFKQY

SEQ ID NO: 33980 - protein, 11 aa, Artificial Sequence
  Peptide Derived from Human Papillomavirus
YDATKFKQYSR

SEQ ID NO: 33981 - protein, 11 aa, Artificial Sequence
  Peptide Derived from Human Papillomavirus
YFRVPAGGGNK

SEQ ID NO: 33982 - protein, 10 aa, Artificial Sequence
  Peptide Derived from Human Papillomavirus
YGDSMFFCLR

SEQ ID NO: 33983 - protein, 11 aa, Artificial Sequence
  Peptide Derived from Human Papillomavirus
YGDSMFFCLRR

SEQ ID NO: 33984 - protein, 8 aa, Artificial Sequence
  Peptide Derived from Human Papillomavirus
YGPLYHPR

SEQ ID NO: 33985 - protein, 9 aa, Artificial Sequence
  Peptide Derived from Human Papillomavirus
YIKGTGMPA

SEQ ID NO: 33986 - protein, 8 aa, Artificial Sequence
  Peptide Derived from Human Papillomavirus
YLPPPSVA

SEQ ID NO: 33987 - protein, 9 aa, Artificial Sequence
  Peptide Derived from Human Papillomavirus
YLPPPSVAR

SEQ ID NO: 33988 - protein, 9 aa, Artificial Sequence
  Peptide Derived from Human Papillomavirus
YLQMSADPY

SEQ ID NO: 33989 - protein, 10 aa, Artificial Sequence
  Peptide Derived from Human Papillomavirus
YMVHIIICGH

SEQ ID NO: 33990 - protein, 11 aa, Artificial Sequence
  Peptide Derived from Human Papillomavirus
YMVHIIICGHY

SEQ ID NO: 33991 - protein, 8 aa, Artificial Sequence
  Peptide Derived from Human Papillomavirus
YSRHVEEY

SEQ ID NO: 33992 - protein, 8 aa, Artificial Sequence
  Peptide Derived from Human Papillomavirus
YTRVLILH

SEQ ID NO: 33993 - protein, 9 aa, Artificial Sequence
  Peptide Derived from Human Papillomavirus
YTRVLILHY

SEQ ID NO: 33994 - protein, 10 aa, Artificial Sequence
  Peptide Derived from Human Papillomavirus
YTRVLILHYH

SEQ ID NO: 33995 - protein, 8 aa, Artificial Sequence
  Peptide Derived from Human Papillomavirus
YVTPTSIF

SEQ ID NO: 33996 - protein, 9 aa, Artificial Sequence
  Peptide Derived from Human Papillomavirus
YVTPTSIFY

SEQ ID NO: 33997 - protein, 10 aa, Artificial Sequence
  Peptide Derived from Human Papillomavirus
YVTPTSIFYH

SEQ ID NO: 33998 - protein, 11 aa, Artificial Sequence
  Peptide Derived from Human Papillomavirus
YVTPTSIFYHA

SEQ ID NO: 33999 - protein, 11 aa, Artificial Sequence
  Peptide Derived from Human Papillomavirus
AFEPVDTTLTF

SEQ ID NO: 34000 - protein, 8 aa, Artificial Sequence
  Peptide Derived from Human Papillomavirus
AGPRLYSR

SEQ ID NO: 34001 - protein, 9 aa, Artificial Sequence
  Peptide Derived from Human Papillomavirus
AGPRLYSRA

SEQ ID NO: 34002 - protein, 10 aa, Artificial Sequence
  Peptide Derived from Human Papillomavirus
AGPRLYSRAY

SEQ ID NO: 34003 - protein, 10 aa, Artificial Sequence
  Peptide Derived from Human Papillomavirus
ALTSRRGTVR

SEQ ID NO: 34004 - protein, 11 aa, Artificial Sequence
  Peptide Derived from Human Papillomavirus
ALTSRRGTVRF

SEQ ID NO: 34005 - protein, 9 aa, Artificial Sequence
  Peptide Derived from Human Papillomavirus
ASTQYIGIH

SEQ ID NO: 34006 - protein, 8 aa, Artificial Sequence
  Peptide Derived from Human Papillomavirus
ASVTDLYK

SEQ ID NO: 34007 - protein, 11 aa, Artificial Sequence
  Peptide Derived from Human Papillomavirus
ASVTDLYKTCK

SEQ ID NO: 34008 - protein, 8 aa, Artificial Sequence
  Peptide Derived from Human Papillomavirus
ATEDNDLF

SEQ ID NO: 34009 - protein, 11 aa, Artificial Sequence
  Peptide Derived from Human Papillomavirus
ATEDNDLFDIY

SEQ ID NO: 34010 - protein, 9 aa, Artificial Sequence
  Peptide Derived from Human Papillomavirus
DFMDIIRLH

SEQ ID NO: 34011 - protein, 10 aa, Artificial Sequence
  Peptide Derived from Human Papillomavirus
DFMDIIRLHR

SEQ ID NO: 34012 - protein, 9 aa, Artificial Sequence
  Peptide Derived from Human Papillomavirus
DIIRLHRPA

SEQ ID NO: 34013 - protein, 11 aa, Artificial Sequence
  Peptide Derived from Human Papillomavirus
DISPIAPSPEY

SEQ ID NO: 34014 - protein, 11 aa, Artificial Sequence
  Peptide Derived from Human Papillomavirus
DITSAGTTTPA

SEQ ID NO: 34015 - protein, 10 aa, Artificial Sequence
  Peptide Derived from Human Papillomavirus
DIYADDMDPA

SEQ ID NO: 34016 - protein, 11 aa, Artificial Sequence
  Peptide Derived from Human Papillomavirus
DMDPAVPVPSR

SEQ ID NO: 34017 - protein, 9 aa, Artificial Sequence
  Peptide Derived from Human Papillomavirus
DSDFMDIIR

SEQ ID NO: 34018 - protein, 11 aa, Artificial Sequence
  Peptide Derived from Human Papillomavirus
DSDFMDIIRLH

SEQ ID NO: 34019 - protein, 9 aa, Artificial Sequence
  Peptide Derived from Human Papillomavirus
DSSVVTSGA

SEQ ID NO: 34020 - protein, 11 aa, Artificial Sequence
  Peptide Derived from Human Papillomavirus
DSSVVTSGAPR

SEQ ID NO: 34021 - protein, 9 aa, Artificial Sequence
  Peptide Derived from Human Papillomavirus
DTTLTFDPR

SEQ ID NO: 34022 - protein, 9 aa, Artificial Sequence
  Peptide Derived from Human Papillomavirus
EDNDLFDIY

SEQ ID NO: 34023 - protein, 10 aa, Artificial Sequence
  Peptide Derived from Human Papillomavirus
EDNDLFDIYA

SEQ ID NO: 34024 - protein, 10 aa, Artificial Sequence
  Peptide Derived from Human Papillomavirus
EDSSVVTSGA

SEQ ID NO: 34025 - protein, 8 aa, Artificial Sequence
  Peptide Derived from Human Papillomavirus
EGTTLADK

SEQ ID NO: 34026 - protein, 8 aa, Artificial Sequence
  Peptide Derived from Human Papillomavirus
EIPLQTFA

SEQ ID NO: 34027 - protein, 8 aa, Artificial Sequence
  Peptide Derived from Human Papillomavirus
ELQPLVSA

SEQ ID NO: 34028 - protein, 9 aa, Artificial Sequence
  Peptide Derived from Human Papillomavirus
EVPQTGEVA

SEQ ID NO: 34029 - protein, 8 aa, Artificial Sequence
  Peptide Derived from Human Papillomavirus
FADGFVAA

SEQ ID NO: 34030 - protein, 11 aa, Artificial Sequence
  Peptide Derived from Human Papillomavirus
FDIYADDMDPA

SEQ ID NO: 34031 - protein, 8 aa, Artificial Sequence
  Peptide Derived from Human Papillomavirus
FFADGFVA

SEQ ID NO: 34032 - protein, 9 aa, Artificial Sequence
  Peptide Derived from Human Papillomavirus
FFADGFVAA

SEQ ID NO: 34033 - protein, 11 aa, Artificial Sequence
  Peptide Derived from Human Papillomavirus
FFKYSPTISSA

SEQ ID NO: 34034 - protein, 8 aa, Artificial Sequence
  Peptide Derived from Human Papillomavirus
FIPKKRKR

SEQ ID NO: 34035 - protein, 11 aa, Artificial Sequence
  Peptide Derived from Human Papillomavirus
FIPKKRKRVPY

SEQ ID NO: 34036 - protein, 11 aa, Artificial Sequence
  Peptide Derived from Human Papillomavirus
FLTRPSSLITY

SEQ ID NO: 34037 - protein, 8 aa, Artificial Sequence
  Peptide Derived from Human Papillomavirus
FMDIIRLH

SEQ ID NO: 34038 - protein, 9 aa, Artificial Sequence
  Peptide Derived from Human Papillomavirus
FMDIIRLHR

SEQ ID NO: 34039 - protein, 11 aa, Artificial Sequence
  Peptide Derived from Human Papillomavirus
FMDIIRLHRPA

SEQ ID NO: 34040 - protein, 8 aa, Artificial Sequence
  Peptide Derived from Human Papillomavirus
FSRLGQRA

SEQ ID NO: 34041 - protein, 11 aa, Artificial Sequence
  Peptide Derived from Human Papillomavirus
FSRLGQRATMF

SEQ ID NO: 34042 - protein, 10 aa, Artificial Sequence
  Peptide Derived from Human Papillomavirus
FTRSGTQIGA

SEQ ID NO: 34043 - protein, 11 aa, Artificial Sequence
  Peptide Derived from Human Papillomavirus
FTRSGTQIGAR

SEQ ID NO: 34044 - protein, 10 aa, Artificial Sequence
  Peptide Derived from Human Papillomavirus
FVGTPTSGTH

SEQ ID NO: 34045 - protein, 8 aa, Artificial Sequence
  Peptide Derived from Human Papillomavirus
GARVHFYH

SEQ ID NO: 34046 - protein, 11 aa, Artificial Sequence
  Peptide Derived from Human Papillomavirus
GIGTGSGTGGR

SEQ ID NO: 34047 - protein, 8 aa, Artificial Sequence
  Peptide Derived from Human Papillomavirus
GIHGTHYY

SEQ ID NO: 34048 - protein, 10 aa, Artificial Sequence
  Peptide Derived from Human Papillomavirus
GSGTGGRTGY

SEQ ID NO: 34049 - protein, 10 aa, Artificial Sequence
  Peptide Derived from Human Papillomavirus
GTCPPDVVPK

SEQ ID NO: 34050 - protein, 8 aa, Artificial Sequence
  Peptide Derived from Human Papillomavirus
GTGGRTGY

SEQ ID NO: 34051 - protein, 9 aa, Artificial Sequence
  Peptide Derived from Human Papillomavirus
GTGSGTGGR

SEQ ID NO: 34052 - protein, 10 aa, Artificial Sequence
  Peptide Derived from Human Papillomavirus
GTHYYLWPLY

SEQ ID NO: 34053 - protein, 11 aa, Artificial Sequence
  Peptide Derived from Human Papillomavirus
GTHYYLWPLYY

SEQ ID NO: 34054 - protein, 8 aa, Artificial Sequence
  Peptide Derived from Human Papillomavirus
GTPTSGTH

SEQ ID NO: 34055 - protein, 10 aa, Artificial Sequence
  Peptide Derived from Human Papillomavirus
GTPTSGTHGY

SEQ ID NO: 34056 - protein, 9 aa, Artificial Sequence
  Peptide Derived from Human Papillomavirus
GTQIGARVH

SEQ ID NO: 34057 - protein, 10 aa, Artificial Sequence
  Peptide Derived from Human Papillomavirus
GTQIGARVHF

SEQ ID NO: 34058 - protein, 11 aa, Artificial Sequence
  Peptide Derived from Human Papillomavirus
GTQIGARVHFY

SEQ ID NO: 34059 - protein, 10 aa, Artificial Sequence
  Peptide Derived from Human Papillomavirus
GTSGFDITSA

SEQ ID NO: 34060 - protein, 11 aa, Artificial Sequence
  Peptide Derived from Human Papillomavirus
GTVRFSRLGQR

SEQ ID NO: 34061 - protein, 10 aa, Artificial Sequence
  Peptide Derived from Human Papillomavirus
HFYHDISPIA

SEQ ID NO: 34062 - protein, 11 aa, Artificial Sequence
  Peptide Derived from Human Papillomavirus
HGTHYYLWPLY

SEQ ID NO: 34063 - protein, 11 aa, Artificial Sequence
  Peptide Derived from Human Papillomavirus
HGYEEIPLQTF

SEQ ID NO: 34064 - protein, 8 aa, Artificial Sequence
  Peptide Derived from Human Papillomavirus
IGARVHFY

SEQ ID NO: 34065 - protein, 9 aa, Artificial Sequence
  Peptide Derived from Human Papillomavirus
IGARVHFYH

SEQ ID NO: 34066 - protein, 8 aa, Artificial Sequence
  Peptide Derived from Human Papillomavirus
IGIHGTHY

SEQ ID NO: 34067 - protein, 9 aa, Artificial Sequence
  Peptide Derived from Human Papillomavirus
IGIHGTHYY

SEQ ID NO: 34068 - protein, 10 aa, Artificial Sequence
  Peptide Derived from Human Papillomavirus
IGTGSGTGGR

SEQ ID NO: 34069 - protein, 11 aa, Artificial Sequence
  Peptide Derived from Human Papillomavirus
IIEVPQTGEVA

SEQ ID NO: 34070 - protein, 8 aa, Artificial Sequence
  Peptide Derived from Human Papillomavirus
IIRLHRPA

SEQ ID NO: 34071 - protein, 10 aa, Artificial Sequence
  Peptide Derived from Human Papillomavirus
ILQWSSLGIF

SEQ ID NO: 34072 - protein, 10 aa, Artificial Sequence
  Peptide Derived from Human Papillomavirus
ISPIAPSPEY

SEQ ID NO: 34073 - protein, 10 aa, Artificial Sequence
  Peptide Derived from Human Papillomavirus
ISSTPLPTVR

SEQ ID NO: 34074 - protein, 11 aa, Artificial Sequence
  Peptide Derived from Human Papillomavirus
ISSTPLPTVRR

SEQ ID NO: 34075 - protein, 10 aa, Artificial Sequence
  Peptide Derived from Human Papillomavirus
ISTTNFTNPA

SEQ ID NO: 34076 - protein, 11 aa, Artificial Sequence
  Peptide Derived from Human Papillomavirus
ISTTNFTNPAF

SEQ ID NO: 34077 - protein, 10 aa, Artificial Sequence
  Peptide Derived from Human Papillomavirus
ITSAGTTTPA

SEQ ID NO: 34078 - protein, 8 aa, Artificial Sequence
  Peptide Derived from Human Papillomavirus
ITYDNPAF

SEQ ID NO: 34079 - protein, 8 aa, Artificial Sequence
  Peptide Derived from Human Papillomavirus
IVSPTAPA

SEQ ID NO: 34080 - protein, 11 aa, Artificial Sequence
  Peptide Derived from Human Papillomavirus
KILQWSSLGIF

SEQ ID NO: 34081 - protein, 8 aa, Artificial Sequence
  Peptide Derived from Human Papillomavirus
KVEGTTLA

SEQ ID NO: 34082 - protein, 10 aa, Artificial Sequence
  Peptide Derived from Human Papillomavirus
KVEGTTLADK

SEQ ID NO: 34083 - protein, 8 aa, Artificial Sequence
  Peptide Derived from Human Papillomavirus
LGQRATMF

SEQ ID NO: 34084 - protein, 10 aa, Artificial Sequence
  Peptide Derived from Human Papillomavirus
LGQRATMFTR

SEQ ID NO: 34085 - protein, 8 aa, Artificial Sequence
  Peptide Derived from Human Papillomavirus
LITYDNPA

SEQ ID NO: 34086 - protein, 9 aa, Artificial Sequence
  Peptide Derived from Human Papillomavirus
LITYDNPAF

SEQ ID NO: 34087 - protein, 10 aa, Artificial Sequence
  Peptide Derived from Human Papillomavirus
LTRPSSLITY

SEQ ID NO: 34088 - protein, 9 aa, Artificial Sequence
  Peptide Derived from Human Papillomavirus
LTSRRGTVR

SEQ ID NO: 34089 - protein, 10 aa, Artificial Sequence
  Peptide Derived from Human Papillomavirus
LTSRRGTVRF

SEQ ID NO: 34090 - protein, 10 aa, Artificial Sequence
  Peptide Derived from Human Papillomavirus
LTSSWDVPVY

SEQ ID NO: 34091 - protein, 11 aa, Artificial Sequence
  Peptide Derived from Human Papillomavirus
LVSATEDNDLF

SEQ ID NO: 34092 - protein, 8 aa, Artificial Sequence
  Peptide Derived from Human Papillomavirus
MDIIRLHR

SEQ ID NO: 34093 - protein, 10 aa, Artificial Sequence
  Peptide Derived from Human Papillomavirus
MDIIRLHRPA

SEQ ID NO: 34094 - protein, 10 aa, Artificial Sequence
  Peptide Derived from Human Papillomavirus
MDPAVPVPSR

SEQ ID NO: 34095 - protein, 11 aa, Artificial Sequence
  Peptide Derived from Human Papillomavirus
MFTRSGTQIGA

SEQ ID NO: 34096 - protein, 8 aa, Artificial Sequence
  Peptide Derived from Human Papillomavirus
MVSHRAAR

SEQ ID NO: 34097 - protein, 9 aa, Artificial Sequence
  Peptide Derived from Human Papillomavirus
MVSHRAARR

SEQ ID NO: 34098 - protein, 10 aa, Artificial Sequence
  Peptide Derived from Human Papillomavirus
MVSHRAARRK

SEQ ID NO: 34099 - protein, 11 aa, Artificial Sequence
  Peptide Derived from Human Papillomavirus
MVSHRAARRKR

SEQ ID NO: 34100 - protein, 8 aa, Artificial Sequence
  Peptide Derived from Human Papillomavirus
NDLFDIYA

SEQ ID NO: 34101 - protein, 10 aa, Artificial Sequence
  Peptide Derived from Human Papillomavirus
NTVVDVGPTR

SEQ ID NO: 34102 - protein, 11 aa, Artificial Sequence
  Peptide Derived from Human Papillomavirus
PALTSRRGTVR

SEQ ID NO: 34103 - protein, 10 aa, Artificial Sequence
  Peptide Derived from Human Papillomavirus
PASTQYIGIH

SEQ ID NO: 34104 - protein, 8 aa, Artificial Sequence
  Peptide Derived from Human Papillomavirus
PAVPVPSR

SEQ ID NO: 34105 - protein, 10 aa, Artificial Sequence
  Peptide Derived from Human Papillomavirus
PDSDFMDIIR

SEQ ID NO: 34106 - protein, 8 aa, Artificial Sequence
  Peptide Derived from Human Papillomavirus
PIAPSPEY

SEQ ID NO: 34107 - protein, 11 aa, Artificial Sequence
  Peptide Derived from Human Papillomavirus
PISSTPLPTVR

SEQ ID NO: 34108 - protein, 9 aa, Artificial Sequence
  Peptide Derived from Human Papillomavirus
PIVSPTAPA

SEQ ID NO: 34109 - protein, 9 aa, Artificial Sequence
  Peptide Derived from Human Papillomavirus
PLPTVRRVA

SEQ ID NO: 34110 - protein, 11 aa, Artificial Sequence
  Peptide Derived from Human Papillomavirus
PLTSSWDVPVY

SEQ ID NO: 34111 - protein, 8 aa, Artificial Sequence
  Peptide Derived from Human Papillomavirus
PLYYFIPK

SEQ ID NO: 34112 - protein, 9 aa, Artificial Sequence
  Peptide Derived from Human Papillomavirus
PLYYFIPKK

SEQ ID NO: 34113 - protein, 10 aa, Artificial Sequence
  Peptide Derived from Human Papillomavirus
PLYYFIPKKR

SEQ ID NO: 34114 - protein, 11 aa, Artificial Sequence
  Peptide Derived from Human Papillomavirus
PLYYFIPKKRK

SEQ ID NO: 34115 - protein, 8 aa, Artificial Sequence
  Peptide Derived from Human Papillomavirus
PSRSTTSF

SEQ ID NO: 34116 - protein, 9 aa, Artificial Sequence
  Peptide Derived from Human Papillomavirus
PSRSTTSFA

SEQ ID NO: 34117 - protein, 10 aa, Artificial Sequence
  Peptide Derived from Human Papillomavirus
PSRSTTSFAF

SEQ ID NO: 34118 - protein, 11 aa, Artificial Sequence
  Peptide Derived from Human Papillomavirus
PSRSTTSFAFF

SEQ ID NO: 34119 - protein, 11 aa, Artificial Sequence
  Peptide Derived from Human Papillomavirus
PSSLITYDNPA

SEQ ID NO: 34120 - protein, 9 aa, Artificial Sequence
  Peptide Derived from Human Papillomavirus
PTAPASTQY

SEQ ID NO: 34121 - protein, 9 aa, Artificial Sequence
  Peptide Derived from Human Papillomavirus
PTFTGTSGF

SEQ ID NO: 34122 - protein, 9 aa, Artificial Sequence
  Peptide Derived from Human Papillomavirus
PTISSASSY

SEQ ID NO: 34123 - protein, 8 aa, Artificial Sequence
  Peptide Derived from Human Papillomavirus
PTSGTHGY

SEQ ID NO: 34124 - protein, 10 aa, Artificial Sequence
  Peptide Derived from Human Papillomavirus
PTVRRVAGPR

SEQ ID NO: 34125 - protein, 8 aa, Artificial Sequence
  Peptide Derived from Human Papillomavirus
PVDTTLTF

SEQ ID NO: 34126 - protein, 11 aa, Artificial Sequence
  Peptide Derived from Human Papillomavirus
PVDTTLTFDPR

SEQ ID NO: 34127 - protein, 10 aa, Artificial Sequence
  Peptide Derived from Human Papillomavirus
PVPSRSTTSF

SEQ ID NO: 34128 - protein, 11 aa, Artificial Sequence
  Peptide Derived from Human Papillomavirus
PVPSRSTTSFA

SEQ ID NO: 34129 - protein, 8 aa, Artificial Sequence
  Peptide Derived from Human Papillomavirus
QIGARVHF

SEQ ID NO: 34130 - protein, 9 aa, Artificial Sequence
  Peptide Derived from Human Papillomavirus
QIGARVHFY

SEQ ID NO: 34131 - protein, 10 aa, Artificial Sequence
  Peptide Derived from Human Papillomavirus
QIGARVHFYH

SEQ ID NO: 34132 - protein, 10 aa, Artificial Sequence
  Peptide Derived from Human Papillomavirus
QTGEVAGNVF

SEQ ID NO: 34133 - protein, 9 aa, Artificial Sequence
  Peptide Derived from Human Papillomavirus
QVSVANPEF

SEQ ID NO: 34134 - protein, 8 aa, Artificial Sequence
  Peptide Derived from Human Papillomavirus
RAARRKRA

SEQ ID NO: 34135 - protein, 8 aa, Artificial Sequence
  Peptide Derived from Human Papillomavirus
RASVTDLY

SEQ ID NO: 34136 - protein, 9 aa, Artificial Sequence
  Peptide Derived from Human Papillomavirus
RASVTDLYK

SEQ ID NO: 34137 - protein, 9 aa, Artificial Sequence
  Peptide Derived from Human Papillomavirus
RAYQQVSVA

SEQ ID NO: 34138 - protein, 8 aa, Artificial Sequence
  Peptide Derived from Human Papillomavirus
RFSRLGQR

SEQ ID NO: 34139 - protein, 9 aa, Artificial Sequence
  Peptide Derived from Human Papillomavirus
RFSRLGQRA

SEQ ID NO: 34140 - protein, 8 aa, Artificial Sequence
  Peptide Derived from Human Papillomavirus
RGTVRFSR

SEQ ID NO: 34141 - protein, 9 aa, Artificial Sequence
  Peptide Derived from Human Papillomavirus
RLGQRATMF

SEQ ID NO: 34142 - protein, 11 aa, Artificial Sequence
  Peptide Derived from Human Papillomavirus
RLGQRATMFTR

SEQ ID NO: 34143 - protein, 10 aa, Artificial Sequence
  Peptide Derived from Human Papillomavirus
RLHRPALTSR

SEQ ID NO: 34144 - protein, 11 aa, Artificial Sequence
  Peptide Derived from Human Papillomavirus
RLHRPALTSRR

SEQ ID NO: 34145 - protein, 9 aa, Artificial Sequence
  Peptide Derived from Human Papillomavirus
RSDVPDSDF

SEQ ID NO: 34146 - protein, 8 aa, Artificial Sequence
  Peptide Derived from Human Papillomavirus
RSGTQIGA

SEQ ID NO: 34147 - protein, 9 aa, Artificial Sequence
  Peptide Derived from Human Papillomavirus
RSGTQIGAR

SEQ ID NO: 34148 - protein, 11 aa, Artificial Sequence
  Peptide Derived from Human Papillomavirus
RSGTQIGARVH

SEQ ID NO: 34149 - protein, 8 aa, Artificial Sequence
  Peptide Derived from Human Papillomavirus
RSTTSFAF

SEQ ID NO: 34150 - protein, 9 aa, Artificial Sequence
  Peptide Derived from Human Papillomavirus
RSTTSFAFF

SEQ ID NO: 34151 - protein, 10 aa, Artificial Sequence
  Peptide Derived from Human Papillomavirus
RSTTSFAFFK

SEQ ID NO: 34152 - protein, 11 aa, Artificial Sequence
  Peptide Derived from Human Papillomavirus
RSTTSFAFFKY

SEQ ID NO: 34153 - protein, 10 aa, Artificial Sequence
  Peptide Derived from Human Papillomavirus
RTGYIPLGGR

SEQ ID NO: 34154 - protein, 8 aa, Artificial Sequence
  Peptide Derived from Human Papillomavirus
RVAGPRLY

SEQ ID NO: 34155 - protein, 10 aa, Artificial Sequence
  Peptide Derived from Human Papillomavirus
RVAGPRLYSR

SEQ ID NO: 34156 - protein, 11 aa, Artificial Sequence
  Peptide Derived from Human Papillomavirus
RVAGPRLYSRA

SEQ ID NO: 34157 - protein, 10 aa, Artificial Sequence
  Peptide Derived from Human Papillomavirus
RVPYFFADGF

SEQ ID NO: 34158 - protein, 8 aa, Artificial Sequence
  Peptide Derived from Human Papillomavirus
SAGTTTPA

SEQ ID NO: 34159 - protein, 9 aa, Artificial Sequence
  Peptide Derived from Human Papillomavirus
SATEDNDLF

SEQ ID NO: 34160 - protein, 8 aa, Artificial Sequence
  Peptide Derived from Human Papillomavirus
SDFMDIIR

SEQ ID NO: 34161 - protein, 10 aa, Artificial Sequence
  Peptide Derived from Human Papillomavirus
SDFMDIIRLH

SEQ ID NO: 34162 - protein, 11 aa, Artificial Sequence
  Peptide Derived from Human Papillomavirus
SDFMDIIRLHR

SEQ ID NO: 34163 - protein, 8 aa, Artificial Sequence
  Peptide Derived from Human Papillomavirus
SDVPDSDF

SEQ ID NO: 34164 - protein, 8 aa, Artificial Sequence
  Peptide Derived from Human Papillomavirus
SGAPRPTF

SEQ ID NO: 34165 - protein, 8 aa, Artificial Sequence
  Peptide Derived from Human Papillomavirus
SGFDITSA

SEQ ID NO: 34166 - protein, 11 aa, Artificial Sequence
  Peptide Derived from Human Papillomavirus
SGTCPPDVVPK

SEQ ID NO: 34167 - protein, 9 aa, Artificial Sequence
  Peptide Derived from Human Papillomavirus
SGTGGRTGY

SEQ ID NO: 34168 - protein, 8 aa, Artificial Sequence
  Peptide Derived from Human Papillomavirus
SGTQIGAR

SEQ ID NO: 34169 - protein, 10 aa, Artificial Sequence
  Peptide Derived from Human Papillomavirus
SGTQIGARVH

SEQ ID NO: 34170 - protein, 11 aa, Artificial Sequence
  Peptide Derived from Human Papillomavirus
SGTQIGARVHF

SEQ ID NO: 34171 - protein, 11 aa, Artificial Sequence
  Peptide Derived from Human Papillomavirus
SISTTNFTNPA

SEQ ID NO: 34172 - protein, 9 aa, Artificial Sequence
  Peptide Derived from Human Papillomavirus
SLITYDNPA

SEQ ID NO: 34173 - protein, 10 aa, Artificial Sequence
  Peptide Derived from Human Papillomavirus
SLITYDNPAF

SEQ ID NO: 34174 - protein, 10 aa, Artificial Sequence
  Peptide Derived from Human Papillomavirus
SSLITYDNPA

SEQ ID NO: 34175 - protein, 11 aa, Artificial Sequence
  Peptide Derived from Human Papillomavirus
SSLITYDNPAF

SEQ ID NO: 34176 - protein, 9 aa, Artificial Sequence
  Peptide Derived from Human Papillomavirus
SSTPLPTVR

SEQ ID NO: 34177 - protein, 10 aa, Artificial Sequence
  Peptide Derived from Human Papillomavirus
SSTPLPTVRR

SEQ ID NO: 34178 - protein, 8 aa, Artificial Sequence
  Peptide Derived from Human Papillomavirus
SSVVTSGA

SEQ ID NO: 34179 - protein, 10 aa, Artificial Sequence
  Peptide Derived from Human Papillomavirus
SSVVTSGAPR

SEQ ID NO: 34180 - protein, 8 aa, Artificial Sequence
  Peptide Derived from Human Papillomavirus
SSWDVPVY

SEQ ID NO: 34181 - protein, 8 aa, Artificial Sequence
  Peptide Derived from Human Papillomavirus
STPLPTVR

SEQ ID NO: 34182 - protein, 9 aa, Artificial Sequence
  Peptide Derived from Human Papillomavirus
STPLPTVRR

SEQ ID NO: 34183 - protein, 11 aa, Artificial Sequence
  Peptide Derived from Human Papillomavirus
STPLPTVRRVA

SEQ ID NO: 34184 - protein, 8 aa, Artificial Sequence
  Peptide Derived from Human Papillomavirus
STQYIGIH

SEQ ID NO: 34185 - protein, 11 aa, Artificial Sequence
  Peptide Derived from Human Papillomavirus
STQYIGIHGTH

SEQ ID NO: 34186 - protein, 11 aa, Artificial Sequence
  Peptide Derived from Human Papillomavirus
STSVSISTTNF

SEQ ID NO: 34187 - protein, 9 aa, Artificial Sequence
  Peptide Derived from Human Papillomavirus
STTNFTNPA

SEQ ID NO: 34188 - protein, 10 aa, Artificial Sequence
  Peptide Derived from Human Papillomavirus
STTNFTNPAF

SEQ ID NO: 34189 - protein, 8 aa, Artificial Sequence
  Peptide Derived from Human Papillomavirus
STTSFAFF

SEQ ID NO: 34190 - protein, 9 aa, Artificial Sequence
  Peptide Derived from Human Papillomavirus
STTSFAFFK

SEQ ID NO: 34191 - protein, 10 aa, Artificial Sequence
  Peptide Derived from Human Papillomavirus
STTSFAFFKY

SEQ ID NO: 34192 - protein, 10 aa, Artificial Sequence
  Peptide Derived from Human Papillomavirus
SVANPEFLTR

SEQ ID NO: 34193 - protein, 9 aa, Artificial Sequence
  Peptide Derived from Human Papillomavirus
SVSISTTNF

SEQ ID NO: 34194 - protein, 10 aa, Artificial Sequence
  Peptide Derived from Human Papillomavirus
SVTDLYKTCK

SEQ ID NO: 34195 - protein, 9 aa, Artificial Sequence
  Peptide Derived from Human Papillomavirus
SVVTSGAPR

SEQ ID NO: 34196 - protein, 10 aa, Artificial Sequence
  Peptide Derived from Human Papillomavirus
SVWPIVSPTA

SEQ ID NO: 34197 - protein, 8 aa, Artificial Sequence
  Peptide Derived from Human Papillomavirus
TAPASTQY

SEQ ID NO: 34198 - protein, 9 aa, Artificial Sequence
  Peptide Derived from Human Papillomavirus
TCPPDVVPK

SEQ ID NO: 34199 - protein, 8 aa, Artificial Sequence
  Peptide Derived from Human Papillomavirus
TDLYKTCK

SEQ ID NO: 34200 - protein, 8 aa, Artificial Sequence
  Peptide Derived from Human Papillomavirus
TFTGTSGF

SEQ ID NO: 34201 - protein, 9 aa, Artificial Sequence
  Peptide Derived from Human Papillomavirus
TGEVAGNVF

SEQ ID NO: 34202 - protein, 8 aa, Artificial Sequence
  Peptide Derived from Human Papillomavirus
TGSGTGGR

SEQ ID NO: 34203 - protein, 11 aa, Artificial Sequence
  Peptide Derived from Human Papillomavirus
TGSGTGGRTGY

SEQ ID NO: 34204 - protein, 11 aa, Artificial Sequence
  Peptide Derived from Human Papillomavirus
TGTSGFDITSA

SEQ ID NO: 34205 - protein, 9 aa, Artificial Sequence
  Peptide Derived from Human Papillomavirus
TGYIPLGGR

SEQ ID NO: 34206 - protein, 8 aa, Artificial Sequence
  Peptide Derived from Human Papillomavirus
TISSASSY

SEQ ID NO: 34207 - protein, 9 aa, Artificial Sequence
  Peptide Derived from Human Papillomavirus
TSAGTTTPA

SEQ ID NO: 34208 - protein, 8 aa, Artificial Sequence
  Peptide Derived from Human Papillomavirus
TSFAFFKY

SEQ ID NO: 34209 - protein, 9 aa, Artificial Sequence
  Peptide Derived from Human Papillomavirus
TSGAPRPTF

SEQ ID NO: 34210 - protein, 9 aa, Artificial Sequence
  Peptide Derived from Human Papillomavirus
TSGFDITSA

SEQ ID NO: 34211 - protein, 8 aa, Artificial Sequence
  Peptide Derived from Human Papillomavirus
TSRRGTVR

SEQ ID NO: 34212 - protein, 9 aa, Artificial Sequence
  Peptide Derived from Human Papillomavirus
TSRRGTVRF

SEQ ID NO: 34213 - protein, 11 aa, Artificial Sequence
  Peptide Derived from Human Papillomavirus
TSRRGTVRFSR

SEQ ID NO: 34214 - protein, 9 aa, Artificial Sequence
  Peptide Derived from Human Papillomavirus
TSSWDVPVY

SEQ ID NO: 34215 - protein, 10 aa, Artificial Sequence
  Peptide Derived from Human Papillomavirus
TSVSISTTNF

SEQ ID NO: 34216 - protein, 11 aa, Artificial Sequence
  Peptide Derived from Human Papillomavirus
TSVWPIVSPTA

SEQ ID NO: 34217 - protein, 8 aa, Artificial Sequence
  Peptide Derived from Human Papillomavirus
TTLTFDPR

SEQ ID NO: 34218 - protein, 8 aa, Artificial Sequence
  Peptide Derived from Human Papillomavirus
TTNFTNPA

SEQ ID NO: 34219 - protein, 9 aa, Artificial Sequence
  Peptide Derived from Human Papillomavirus
TTNFTNPAF

SEQ ID NO: 34220 - protein, 8 aa, Artificial Sequence
  Peptide Derived from Human Papillomavirus
TTSFAFFK

SEQ ID NO: 34221 - protein, 9 aa, Artificial Sequence
  Peptide Derived from Human Papillomavirus
TTSFAFFKY

SEQ ID NO: 34222 - protein, 10 aa, Artificial Sequence
  Peptide Derived from Human Papillomavirus
TVRFSRLGQR

SEQ ID NO: 34223 - protein, 11 aa, Artificial Sequence
  Peptide Derived from Human Papillomavirus
TVRFSRLGQRA

SEQ ID NO: 34224 - protein, 9 aa, Artificial Sequence
  Peptide Derived from Human Papillomavirus
TVRRVAGPR

SEQ ID NO: 34225 - protein, 11 aa, Artificial Sequence
  Peptide Derived from Human Papillomavirus
TVRRVAGPRLY

SEQ ID NO: 34226 - protein, 9 aa, Artificial Sequence
  Peptide Derived from Human Papillomavirus
TVVDVGPTR

SEQ ID NO: 34227 - protein, 9 aa, Artificial Sequence
  Peptide Derived from Human Papillomavirus
VAGPRLYSR

SEQ ID NO: 34228 - protein, 10 aa, Artificial Sequence
  Peptide Derived from Human Papillomavirus
VAGPRLYSRA

SEQ ID NO: 34229 - protein, 11 aa, Artificial Sequence
  Peptide Derived from Human Papillomavirus
VAGPRLYSRAY

SEQ ID NO: 34230 - protein, 9 aa, Artificial Sequence
  Peptide Derived from Human Papillomavirus
VANPEFLTR

SEQ ID NO: 34231 - protein, 10 aa, Artificial Sequence
  Peptide Derived from Human Papillomavirus
VDTTLTFDPR

SEQ ID NO: 34232 - protein, 11 aa, Artificial Sequence
  Peptide Derived from Human Papillomavirus
VFVGTPTSGTH

SEQ ID NO: 34233 - protein, 9 aa, Artificial Sequence
  Peptide Derived from Human Papillomavirus
VGTPTSGTH

SEQ ID NO: 34234 - protein, 11 aa, Artificial Sequence
  Peptide Derived from Human Papillomavirus
VGTPTSGTHGY

SEQ ID NO: 34235 - protein, 10 aa, Artificial Sequence
  Peptide Derived from Human Papillomavirus
VSATEDNDLF

SEQ ID NO: 34236 - protein, 8 aa, Artificial Sequence
  Peptide Derived from Human Papillomavirus
VSHRAARR

SEQ ID NO: 34237 - protein, 9 aa, Artificial Sequence
  Peptide Derived from Human Papillomavirus
VSHRAARRK

SEQ ID NO: 34238 - protein, 10 aa, Artificial Sequence
  Peptide Derived from Human Papillomavirus
VSHRAARRKR

SEQ ID NO: 34239 - protein, 11 aa, Artificial Sequence
  Peptide Derived from Human Papillomavirus
VSHRAARRKRA

SEQ ID NO: 34240 - protein, 8 aa, Artificial Sequence
  Peptide Derived from Human Papillomavirus
VSISTTNF

SEQ ID NO: 34241 - protein, 11 aa, Artificial Sequence
  Peptide Derived from Human Papillomavirus
VSPTAPASTQY

SEQ ID NO: 34242 - protein, 8 aa, Artificial Sequence
  Peptide Derived from Human Papillomavirus
VSVANPEF

SEQ ID NO: 34243 - protein, 11 aa, Artificial Sequence
  Peptide Derived from Human Papillomavirus
VSVANPEFLTR

SEQ ID NO: 34244 - protein, 9 aa, Artificial Sequence
  Peptide Derived from Human Papillomavirus
VTDLYKTCK

SEQ ID NO: 34245 - protein, 10 aa, Artificial Sequence
  Peptide Derived from Human Papillomavirus
VTSGAPRPTF

SEQ ID NO: 34246 - protein, 8 aa, Artificial Sequence
  Peptide Derived from Human Papillomavirus
VVDVGPTR

SEQ ID NO: 34247 - protein, 11 aa, Artificial Sequence
  Peptide Derived from Human Papillomavirus
VVPKVEGTTLA

SEQ ID NO: 34248 - protein, 8 aa, Artificial Sequence
  Peptide Derived from Human Papillomavirus
VVTSGAPR

SEQ ID NO: 34249 - protein, 11 aa, Artificial Sequence
  Peptide Derived from Human Papillomavirus
VVTSGAPRPTF

SEQ ID NO: 34250 - protein, 8 aa, Artificial Sequence
  Peptide Derived from Human Papillomavirus
YADDMDPA

SEQ ID NO: 34251 - protein, 9 aa, Artificial Sequence
  Peptide Derived from Human Papillomavirus
YFFADGFVA

SEQ ID NO: 34252 - protein, 10 aa, Artificial Sequence
  Peptide Derived from Human Papillomavirus
YFFADGFVAA

SEQ ID NO: 34253 - protein, 8 aa, Artificial Sequence
  Peptide Derived from Human Papillomavirus
YFIPKKRK

SEQ ID NO: 34254 - protein, 9 aa, Artificial Sequence
  Peptide Derived from Human Papillomavirus
YFIPKKRKR

SEQ ID NO: 34255 - protein, 10 aa, Artificial Sequence
  Peptide Derived from Human Papillomavirus
YIELQPLVSA

SEQ ID NO: 34256 - protein, 8 aa, Artificial Sequence
  Peptide Derived from Human Papillomavirus
YIGIHGTH

SEQ ID NO: 34257 - protein, 9 aa, Artificial Sequence
  Peptide Derived from Human Papillomavirus
YIGIHGTHY

SEQ ID NO: 34258 - protein, 10 aa, Artificial Sequence
  Peptide Derived from Human Papillomavirus
YIGIHGTHYY

SEQ ID NO: 34259 - protein, 8 aa, Artificial Sequence
  Peptide Derived from Human Papillomavirus
YLWPLYYF

SEQ ID NO: 34260 - protein, 11 aa, Artificial Sequence
  Peptide Derived from Human Papillomavirus
YLWPLYYFIPK

SEQ ID NO: 34261 - protein, 8 aa, Artificial Sequence
  Peptide Derived from Human Papillomavirus
YSPTISSA

SEQ ID NO: 34262 - protein, 11 aa, Artificial Sequence
  Peptide Derived from Human Papillomavirus
YSPTISSASSY

SEQ ID NO: 34263 - protein, 11 aa, Artificial Sequence
  Peptide Derived from Human Papillomavirus
YSRAYQQVSVA

SEQ ID NO: 34264 - protein, 8 aa, Artificial Sequence
  Peptide Derived from Human Papillomavirus
AAALYWYR

SEQ ID NO: 34265 - protein, 10 aa, Artificial Sequence
  Peptide Derived from Human Papillomavirus
AAFGVTGTVA

SEQ ID NO: 34266 - protein, 8 aa, Artificial Sequence
  Peptide Derived from Human Papillomavirus
AAMLGKFK

SEQ ID NO: 34267 - protein, 11 aa, Artificial Sequence
  Peptide Derived from Human Papillomavirus
AAMLGKFKELY

SEQ ID NO: 34268 - protein, 11 aa, Artificial Sequence
  Peptide Derived from Human Papillomavirus
ACAFLKSNSQA

SEQ ID NO: 34269 - protein, 11 aa, Artificial Sequence
  Peptide Derived from Human Papillomavirus
ADAKIGMLDDA

SEQ ID NO: 34270 - protein, 9 aa, Artificial Sequence
  Peptide Derived from Human Papillomavirus
ADSDSNACA

SEQ ID NO: 34271 - protein, 10 aa, Artificial Sequence
  Peptide Derived from Human Papillomavirus
ADSDSNACAF

SEQ ID NO: 34272 - protein, 9 aa, Artificial Sequence
  Peptide Derived from Human Papillomavirus
AFGVTGTVA

SEQ ID NO: 34273 - protein, 9 aa, Artificial Sequence
  Peptide Derived from Human Papillomavirus
AFLKSNSQA

SEQ ID NO: 34274 - protein, 10 aa, Artificial Sequence
  Peptide Derived from Human Papillomavirus
AFLKSNSQAK

SEQ ID NO: 34275 - protein, 9 aa, Artificial Sequence
  Peptide Derived from Human Papillomavirus
AGKDDRWPY

SEQ ID NO: 34276 - protein, 11 aa, Artificial Sequence
  Peptide Derived from Human Papillomavirus
AGKDDRWPYLH

SEQ ID NO: 34277 - protein, 9 aa, Artificial Sequence
  Peptide Derived from Human Papillomavirus
AICIENNSK

SEQ ID NO: 34278 - protein, 11 aa, Artificial Sequence
  Peptide Derived from Human Papillomavirus
AICIENNSKTA

SEQ ID NO: 34279 - protein, 8 aa, Artificial Sequence
  Peptide Derived from Human Papillomavirus
ALFHAQEA

SEQ ID NO: 34280 - protein, 11 aa, Artificial Sequence
  Peptide Derived from Human Papillomavirus
ALFHAQEAEEH

SEQ ID NO: 34281 - protein, 11 aa, Artificial Sequence
  Peptide Derived from Human Papillomavirus
ALKLFLKGVPK

SEQ ID NO: 34282 - protein, 10 aa, Artificial Sequence
  Peptide Derived from Human Papillomavirus
AMLGKFKELY

SEQ ID NO: 34283 - protein, 8 aa, Artificial Sequence
  Peptide Derived from Human Papillomavirus
ATTPCWHY

SEQ ID NO: 34284 - protein, 8 aa, Artificial Sequence
  Peptide Derived from Human Papillomavirus
AVQVLKRK

SEQ ID NO: 34285 - protein, 9 aa, Artificial Sequence
  Peptide Derived from Human Papillomavirus
AVQVLKRKY

SEQ ID NO: 34286 - protein, 10 aa, Artificial Sequence
  Peptide Derived from Human Papillomavirus
CAFLKSNSQA

SEQ ID NO: 34287 - protein, 11 aa, Artificial Sequence
  Peptide Derived from Human Papillomavirus
CAFLKSNSQAK

SEQ ID NO: 34288 - protein, 10 aa, Artificial Sequence
  Peptide Derived from Human Papillomavirus
CAKNRITIEK

SEQ ID NO: 34289 - protein, 11 aa, Artificial Sequence
  Peptide Derived from Human Papillomavirus
CDKVSDEGDWR

SEQ ID NO: 34290 - protein, 8 aa, Artificial Sequence
  Peptide Derived from Human Papillomavirus
CGTMCRHY

SEQ ID NO: 34291 - protein, 9 aa, Artificial Sequence
  Peptide Derived from Human Papillomavirus
CGTMCRHYK

SEQ ID NO: 34292 - protein, 10 aa, Artificial Sequence
  Peptide Derived from Human Papillomavirus
CGTMCRHYKR

SEQ ID NO: 34293 - protein, 11 aa, Artificial Sequence
  Peptide Derived from Human Papillomavirus
CGTMCRHYKRA

SEQ ID NO: 34294 - protein, 9 aa, Artificial Sequence
  Peptide Derived from Human Papillomavirus
CIENNSKTA

SEQ ID NO: 34295 - protein, 10 aa, Artificial Sequence
  Peptide Derived from Human Papillomavirus
CIENNSKTAK

SEQ ID NO: 34296 - protein, 11 aa, Artificial Sequence
  Peptide Derived from Human Papillomavirus
CIENNSKTAKR

SEQ ID NO: 34297 - protein, 9 aa, Artificial Sequence
  Peptide Derived from Human Papillomavirus
CIISYANSK

SEQ ID NO: 34298 - protein, 11 aa, Artificial Sequence
  Peptide Derived from Human Papillomavirus
CIISYANSKSH

SEQ ID NO: 34299 - protein, 10 aa, Artificial Sequence
  Peptide Derived from Human Papillomavirus
CLYCHLQSLA

SEQ ID NO: 34300 - protein, 8 aa, Artificial Sequence
  Peptide Derived from Human Papillomavirus
CMLIQPPK

SEQ ID NO: 34301 - protein, 10 aa, Artificial Sequence
  Peptide Derived from Human Papillomavirus
CMLIQPPKLR

SEQ ID NO: 34302 - protein, 8 aa, Artificial Sequence
  Peptide Derived from Human Papillomavirus
CTDWCVAA

SEQ ID NO: 34303 - protein, 9 aa, Artificial Sequence
  Peptide Derived from Human Papillomavirus
CTDWCVAAF

SEQ ID NO: 34304 - protein, 9 aa, Artificial Sequence
  Peptide Derived from Human Papillomavirus
CVDYNISPR

SEQ ID NO: 34305 - protein, 11 aa, Artificial Sequence
  Peptide Derived from Human Papillomavirus
CVDYNISPRLK

SEQ ID NO: 34306 - protein, 8 aa, Artificial Sequence
  Peptide Derived from Human Papillomavirus
CVSGQNIR

SEQ ID NO: 34307 - protein, 10 aa, Artificial Sequence
  Peptide Derived from Human Papillomavirus
DAKIGMLDDA

SEQ ID NO: 34308 - protein, 8 aa, Artificial Sequence
  Peptide Derived from Human Papillomavirus
DATTPCWH

SEQ ID NO: 34309 - protein, 9 aa, Artificial Sequence
  Peptide Derived from Human Papillomavirus
DATTPCWHY

SEQ ID NO: 34310 - protein, 8 aa, Artificial Sequence
  Peptide Derived from Human Papillomavirus
DCGTMCRH

SEQ ID NO: 34311 - protein, 9 aa, Artificial Sequence
  Peptide Derived from Human Papillomavirus
DCGTMCRHY

SEQ ID NO: 34312 - protein, 10 aa, Artificial Sequence
  Peptide Derived from Human Papillomavirus
DCGTMCRHYK

SEQ ID NO: 34313 - protein, 11 aa, Artificial Sequence
  Peptide Derived from Human Papillomavirus
DCGTMCRHYKR

SEQ ID NO: 34314 - protein, 9 aa, Artificial Sequence
  Peptide Derived from Human Papillomavirus
DDATTPCWH

SEQ ID NO: 34315 - protein, 10 aa, Artificial Sequence
  Peptide Derived from Human Papillomavirus
DDATTPCWHY

SEQ ID NO: 34316 - protein, 8 aa, Artificial Sequence
  Peptide Derived from Human Papillomavirus
DDRWPYLH

SEQ ID NO: 34317 - protein, 10 aa, Artificial Sequence
  Peptide Derived from Human Papillomavirus
DDRWPYLHSR

SEQ ID NO: 34318 - protein, 8 aa, Artificial Sequence
  Peptide Derived from Human Papillomavirus
DDSEIAYK

SEQ ID NO: 34319 - protein, 9 aa, Artificial Sequence
  Peptide Derived from Human Papillomavirus
DDSEIAYKY

SEQ ID NO: 34320 - protein, 10 aa, Artificial Sequence
  Peptide Derived from Human Papillomavirus
DDSEIAYKYA

SEQ ID NO: 34321 - protein, 9 aa, Artificial Sequence
  Peptide Derived from Human Papillomavirus
DFIDNCNVY

SEQ ID NO: 34322 - protein, 8 aa, Artificial Sequence
  Peptide Derived from Human Papillomavirus
DGDSFSTF

SEQ ID NO: 34323 - protein, 9 aa, Artificial Sequence
  Peptide Derived from Human Papillomavirus
DGDSFSTFK

SEQ ID NO: 34324 - protein, 11 aa, Artificial Sequence
  Peptide Derived from Human Papillomavirus
DGEGTGCNGWF

SEQ ID NO: 34325 - protein, 10 aa, Artificial Sequence
  Peptide Derived from Human Papillomavirus
DGNPVSIDVK

SEQ ID NO: 34326 - protein, 11 aa, Artificial Sequence
  Peptide Derived from Human Papillomavirus
DGNPVSIDVKH

SEQ ID NO: 34327 - protein, 8 aa, Artificial Sequence
  Peptide Derived from Human Papillomavirus
DISSCVDY

SEQ ID NO: 34328 - protein, 8 aa, Artificial Sequence
  Peptide Derived from Human Papillomavirus
DIVKFLRY

SEQ ID NO: 34329 - protein, 9 aa, Artificial Sequence
  Peptide Derived from Human Papillomavirus
DLSQMVQWA

SEQ ID NO: 34330 - protein, 10 aa, Artificial Sequence
  Peptide Derived from Human Papillomavirus
DLSQMVQWAY

SEQ ID NO: 34331 - protein, 8 aa, Artificial Sequence
  Peptide Derived from Human Papillomavirus
DSDSNACA

SEQ ID NO: 34332 - protein, 9 aa, Artificial Sequence
  Peptide Derived from Human Papillomavirus
DSDSNACAF

SEQ ID NO: 34333 - protein, 11 aa, Artificial Sequence
  Peptide Derived from Human Papillomavirus
DSDSNACAFLK

SEQ ID NO: 34334 - protein, 8 aa, Artificial Sequence
  Peptide Derived from Human Papillomavirus
DSEIAYKY

SEQ ID NO: 34335 - protein, 9 aa, Artificial Sequence
  Peptide Derived from Human Papillomavirus
DSEIAYKYA

SEQ ID NO: 34336 - protein, 9 aa, Artificial Sequence
  Peptide Derived from Human Papillomavirus
DSNACAFLK

SEQ ID NO: 34337 - protein, 9 aa, Artificial Sequence
  Peptide Derived from Human Papillomavirus
DTGEDMVDF

SEQ ID NO: 34338 - protein, 11 aa, Artificial Sequence
  Peptide Derived from Human Papillomavirus
DVKHKALMQLK

SEQ ID NO: 34339 - protein, 9 aa, Artificial Sequence
  Peptide Derived from Human Papillomavirus
DVMDDSEIA

SEQ ID NO: 34340 - protein, 10 aa, Artificial Sequence
  Peptide Derived from Human Papillomavirus
DVMDDSEIAY

SEQ ID NO: 34341 - protein, 11 aa, Artificial Sequence
  Peptide Derived from Human Papillomavirus
DVMDDSEIAYK

SEQ ID NO: 34342 - protein, 8 aa, Artificial Sequence
  Peptide Derived from Human Papillomavirus
EAEEHAEA

SEQ ID NO: 34343 - protein, 9 aa, Artificial Sequence
  Peptide Derived from Human Papillomavirus
EAETAQALF

SEQ ID NO: 34344 - protein, 10 aa, Artificial Sequence
  Peptide Derived from Human Papillomavirus
EAETAQALFH

SEQ ID NO: 34345 - protein, 11 aa, Artificial Sequence
  Peptide Derived from Human Papillomavirus
EAETAQALFHA

SEQ ID NO: 34346 - protein, 8 aa, Artificial Sequence
  Peptide Derived from Human Papillomavirus
EAVQVLKR

SEQ ID NO: 34347 - protein, 9 aa, Artificial Sequence
  Peptide Derived from Human Papillomavirus
EAVQVLKRK

SEQ ID NO: 34348 - protein, 10 aa, Artificial Sequence
  Peptide Derived from Human Papillomavirus
EAVQVLKRKY

SEQ ID NO: 34349 - protein, 10 aa, Artificial Sequence
  Peptide Derived from Human Papillomavirus
EDKENDGDSF

SEQ ID NO: 34350 - protein, 8 aa, Artificial Sequence
  Peptide Derived from Human Papillomavirus
EFVSFLSA

SEQ ID NO: 34351 - protein, 10 aa, Artificial Sequence
  Peptide Derived from Human Papillomavirus
EFVSFLSALK

SEQ ID NO: 34352 - protein, 9 aa, Artificial Sequence
  Peptide Derived from Human Papillomavirus
EGDWRDIVK

SEQ ID NO: 34353 - protein, 10 aa, Artificial Sequence
  Peptide Derived from Human Papillomavirus
EGDWRDIVKF

SEQ ID NO: 34354 - protein, 10 aa, Artificial Sequence
  Peptide Derived from Human Papillomavirus
EGFKTLLQPY

SEQ ID NO: 34355 - protein, 9 aa, Artificial Sequence
  Peptide Derived from Human Papillomavirus
EGTGCNGWF

SEQ ID NO: 34356 - protein, 10 aa, Artificial Sequence
  Peptide Derived from Human Papillomavirus
EGTGCNGWFY

SEQ ID NO: 34357 - protein, 10 aa, Artificial Sequence
  Peptide Derived from Human Papillomavirus
EIAYKYAQLA

SEQ ID NO: 34358 - protein, 10 aa, Artificial Sequence
  Peptide Derived from Human Papillomavirus
ELIRPFQSNK

SEQ ID NO: 34359 - protein, 8 aa, Artificial Sequence
  Peptide Derived from Human Papillomavirus
ELSDKNWK

SEQ ID NO: 34360 - protein, 10 aa, Artificial Sequence
  Peptide Derived from Human Papillomavirus
ELSDKNWKSF

SEQ ID NO: 34361 - protein, 11 aa, Artificial Sequence
  Peptide Derived from Human Papillomavirus
ELSDKNWKSFF

SEQ ID NO: 34362 - protein, 8 aa, Artificial Sequence
  Peptide Derived from Human Papillomavirus
ETAQALFH

SEQ ID NO: 34363 - protein, 9 aa, Artificial Sequence
  Peptide Derived from Human Papillomavirus
ETAQALFHA

SEQ ID NO: 34364 - protein, 8 aa, Artificial Sequence
  Peptide Derived from Human Papillomavirus
ETPEWIER

SEQ ID NO: 34365 - protein, 9 aa, Artificial Sequence
  Peptide Derived from Human Papillomavirus
FDKNGNPVY

SEQ ID NO: 34366 - protein, 10 aa, Artificial Sequence
  Peptide Derived from Human Papillomavirus
FDLSQMVQWA

SEQ ID NO: 34367 - protein, 11 aa, Artificial Sequence
  Peptide Derived from Human Papillomavirus
FDLSQMVQWAY

SEQ ID NO: 34368 - protein, 8 aa, Artificial Sequence
  Peptide Derived from Human Papillomavirus
FFSRTWCR

SEQ ID NO: 34369 - protein, 8 aa, Artificial Sequence
  Peptide Derived from Human Papillomavirus
FGMSLISF

SEQ ID NO: 34370 - protein, 8 aa, Artificial Sequence
  Peptide Derived from Human Papillomavirus
FGVTGTVA

SEQ ID NO: 34371 - protein, 11 aa, Artificial Sequence
  Peptide Derived from Human Papillomavirus
FGVTGTVAEGF

SEQ ID NO: 34372 - protein, 8 aa, Artificial Sequence
  Peptide Derived from Human Papillomavirus
FIDNCNVY

SEQ ID NO: 34373 - protein, 8 aa, Artificial Sequence
  Peptide Derived from Human Papillomavirus
FLKGVPKK

SEQ ID NO: 34374 - protein, 8 aa, Artificial Sequence
  Peptide Derived from Human Papillomavirus
FLKSNSQA

SEQ ID NO: 34375 - protein, 9 aa, Artificial Sequence
  Peptide Derived from Human Papillomavirus
FLKSNSQAK

SEQ ID NO: 34376 - protein, 9 aa, Artificial Sequence
  Peptide Derived from Human Papillomavirus
FLQGCIISY

SEQ ID NO: 34377 - protein, 10 aa, Artificial Sequence
  Peptide Derived from Human Papillomavirus
FLQGCIISYA

SEQ ID NO: 34378 - protein, 9 aa, Artificial Sequence
  Peptide Derived from Human Papillomavirus
FLRYQQIEF

SEQ ID NO: 34379 - protein, 8 aa, Artificial Sequence
  Peptide Derived from Human Papillomavirus
FLSALKLF

SEQ ID NO: 34380 - protein, 10 aa, Artificial Sequence
  Peptide Derived from Human Papillomavirus
FLSALKLFLK

SEQ ID NO: 34381 - protein, 8 aa, Artificial Sequence
  Peptide Derived from Human Papillomavirus
FMELIRPF

SEQ ID NO: 34382 - protein, 11 aa, Artificial Sequence
  Peptide Derived from Human Papillomavirus
FSRTWCRLNLH

SEQ ID NO: 34383 - protein, 9 aa, Artificial Sequence
  Peptide Derived from Human Papillomavirus
FTFPNPFPF

SEQ ID NO: 34384 - protein, 11 aa, Artificial Sequence
  Peptide Derived from Human Papillomavirus
FTFPNPFPFDK

SEQ ID NO: 34385 - protein, 9 aa, Artificial Sequence
  Peptide Derived from Human Papillomavirus
FVSFLSALK

SEQ ID NO: 34386 - protein, 11 aa, Artificial Sequence
  Peptide Derived from Human Papillomavirus
FVSFLSALKLF

SEQ ID NO: 34387 - protein, 9 aa, Artificial Sequence
  Peptide Derived from Human Papillomavirus
GAPNTGKSY

SEQ ID NO: 34388 - protein, 10 aa, Artificial Sequence
  Peptide Derived from Human Papillomavirus
GAPNTGKSYF

SEQ ID NO: 34389 - protein, 10 aa, Artificial Sequence
  Peptide Derived from Human Papillomavirus
GCIISYANSK

SEQ ID NO: 34390 - protein, 10 aa, Artificial Sequence
  Peptide Derived from Human Papillomavirus
GCNGWFYVEA

SEQ ID NO: 34391 - protein, 8 aa, Artificial Sequence
  Peptide Derived from Human Papillomavirus
GDSFSTFK

SEQ ID NO: 34392 - protein, 8 aa, Artificial Sequence
  Peptide Derived from Human Papillomavirus
GDWRDIVK

SEQ ID NO: 34393 - protein, 9 aa, Artificial Sequence
  Peptide Derived from Human Papillomavirus
GDWRDIVKF

SEQ ID NO: 34394 - protein, 11 aa, Artificial Sequence
  Peptide Derived from Human Papillomavirus
GDWRDIVKFLR

SEQ ID NO: 34395 - protein, 9 aa, Artificial Sequence
  Peptide Derived from Human Papillomavirus
GFKTLLQPY

SEQ ID NO: 34396 - protein, 9 aa, Artificial Sequence
  Peptide Derived from Human Papillomavirus
GMSNISDVY

SEQ ID NO: 34397 - protein, 9 aa, Artificial Sequence
  Peptide Derived from Human Papillomavirus
GMVMLMLVR

SEQ ID NO: 34398 - protein, 10 aa, Artificial Sequence
  Peptide Derived from Human Papillomavirus
GMVMLMLVRF

SEQ ID NO: 34399 - protein, 11 aa, Artificial Sequence
  Peptide Derived from Human Papillomavirus
GMVMLMLVRFK

SEQ ID NO: 34400 - protein, 9 aa, Artificial Sequence
  Peptide Derived from Human Papillomavirus
GSDGTHSER

SEQ ID NO: 34401 - protein, 8 aa, Artificial Sequence
  Peptide Derived from Human Papillomavirus
GTGCNGWF

SEQ ID NO: 34402 - protein, 9 aa, Artificial Sequence
  Peptide Derived from Human Papillomavirus
GTGCNGWFY

SEQ ID NO: 34403 - protein, 8 aa, Artificial Sequence
  Peptide Derived from Human Papillomavirus
GTMCRHYK

SEQ ID NO: 34404 - protein, 9 aa, Artificial Sequence
  Peptide Derived from Human Papillomavirus
GTMCRHYKR

SEQ ID NO: 34405 - protein, 10 aa, Artificial Sequence
  Peptide Derived from Human Papillomavirus
GTMCRHYKRA

SEQ ID NO: 34406 - protein, 8 aa, Artificial Sequence
  Peptide Derived from Human Papillomavirus
GTVAEGFK

SEQ ID NO: 34407 - protein, 11 aa, Artificial Sequence
  Peptide Derived from Human Papillomavirus
GVPKKNCILIH

SEQ ID NO: 34408 - protein, 9 aa, Artificial Sequence
  Peptide Derived from Human Papillomavirus
GVSFMELIR

SEQ ID NO: 34409 - protein, 11 aa, Artificial Sequence
  Peptide Derived from Human Papillomavirus
GVSFMELIRPF

SEQ ID NO: 34410 - protein, 10 aa, Artificial Sequence
  Peptide Derived from Human Papillomavirus
GVTGTVAEGF

SEQ ID NO: 34411 - protein, 11 aa, Artificial Sequence
  Peptide Derived from Human Papillomavirus
GVTGTVAEGFK

SEQ ID NO: 34412 - protein, 9 aa, Artificial Sequence
  Peptide Derived from Human Papillomavirus
HAEAVQVLK

SEQ ID NO: 34413 - protein, 10 aa, Artificial Sequence
  Peptide Derived from Human Papillomavirus
HAEAVQVLKR

SEQ ID NO: 34414 - protein, 11 aa, Artificial Sequence
  Peptide Derived from Human Papillomavirus
HAEAVQVLKRK

SEQ ID NO: 34415 - protein, 8 aa, Artificial Sequence
  Peptide Derived from Human Papillomavirus
HAQEAEEH

SEQ ID NO: 34416 - protein, 9 aa, Artificial Sequence
  Peptide Derived from Human Papillomavirus
HAQEAEEHA

SEQ ID NO: 34417 - protein, 11 aa, Artificial Sequence
  Peptide Derived from Human Papillomavirus
HAQEAEEHAEA

SEQ ID NO: 34418 - protein, 8 aa, Artificial Sequence
  Peptide Derived from Human Papillomavirus
HFWLQPLA

SEQ ID NO: 34419 - protein, 10 aa, Artificial Sequence
  Peptide Derived from Human Papillomavirus
HFWLQPLADA

SEQ ID NO: 34420 - protein, 11 aa, Artificial Sequence
  Peptide Derived from Human Papillomavirus
HFWLQPLADAK

SEQ ID NO: 34421 - protein, 8 aa, Artificial Sequence
  Peptide Derived from Human Papillomavirus
HGAPNTGK

SEQ ID NO: 34422 - protein, 10 aa, Artificial Sequence
  Peptide Derived from Human Papillomavirus
HGAPNTGKSY

SEQ ID NO: 34423 - protein, 11 aa, Artificial Sequence
  Peptide Derived from Human Papillomavirus
HGAPNTGKSYF

SEQ ID NO: 34424 - protein, 11 aa, Artificial Sequence
  Peptide Derived from Human Papillomavirus
HSERENETPTR

SEQ ID NO: 34425 - protein, 8 aa, Artificial Sequence
  Peptide Derived from Human Papillomavirus
HSFNDTTF

SEQ ID NO: 34426 - protein, 9 aa, Artificial Sequence
  Peptide Derived from Human Papillomavirus
HSRLVVFTF

SEQ ID NO: 34427 - protein, 9 aa, Artificial Sequence
  Peptide Derived from Human Papillomavirus
IAYKYAQLA

SEQ ID NO: 34428 - protein, 8 aa, Artificial Sequence
  Peptide Derived from Human Papillomavirus
ICIENNSK

SEQ ID NO: 34429 - protein, 10 aa, Artificial Sequence
  Peptide Derived from Human Papillomavirus
ICIENNSKTA

SEQ ID NO: 34430 - protein, 11 aa, Artificial Sequence
  Peptide Derived from Human Papillomavirus
ICIENNSKTAK

SEQ ID NO: 34431 - protein, 11 aa, Artificial Sequence
  Peptide Derived from Human Papillomavirus
IDNCNVYNNQA

SEQ ID NO: 34432 - protein, 8 aa, Artificial Sequence
  Peptide Derived from Human Papillomavirus
IDNYLRNA

SEQ ID NO: 34433 - protein, 8 aa, Artificial Sequence
  Peptide Derived from Human Papillomavirus
IISYANSK

SEQ ID NO: 34434 - protein, 10 aa, Artificial Sequence
  Peptide Derived from Human Papillomavirus
IISYANSKSH

SEQ ID NO: 34435 - protein, 11 aa, Artificial Sequence
  Peptide Derived from Human Papillomavirus
IISYANSKSHF

SEQ ID NO: 34436 - protein, 11 aa, Artificial Sequence
  Peptide Derived from Human Papillomavirus
ILIHGAPNTGK

SEQ ID NO: 34437 - protein, 11 aa, Artificial Sequence
  Peptide Derived from Human Papillomavirus
ILQVLKTSNGK

SEQ ID NO: 34438 - protein, 11 aa, Artificial Sequence
  Peptide Derived from Human Papillomavirus
ISFLQGCIISY

SEQ ID NO: 34439 - protein, 9 aa, Artificial Sequence
  Peptide Derived from Human Papillomavirus
ISYANSKSH

SEQ ID NO: 34440 - protein, 10 aa, Artificial Sequence
  Peptide Derived from Human Papillomavirus
ISYANSKSHF

SEQ ID NO: 34441 - protein, 9 aa, Artificial Sequence
  Peptide Derived from Human Papillomavirus
ITIEKLLEK

SEQ ID NO: 34442 - protein, 9 aa, Artificial Sequence
  Peptide Derived from Human Papillomavirus
ITSNINAGK

SEQ ID NO: 34443 - protein, 10 aa, Artificial Sequence
  Peptide Derived from Human Papillomavirus
IVKDCGTMCR

SEQ ID NO: 34444 - protein, 11 aa, Artificial Sequence
  Peptide Derived from Human Papillomavirus
IVKDCGTMCRH

SEQ ID NO: 34445 - protein, 8 aa, Artificial Sequence
  Peptide Derived from Human Papillomavirus
KAAMLGKF

SEQ ID NO: 34446 - protein, 9 aa, Artificial Sequence
  Peptide Derived from Human Papillomavirus
KAAMLGKFK

SEQ ID NO: 34447 - protein, 10 aa, Artificial Sequence
  Peptide Derived from Human Papillomavirus
KAICIENNSK

SEQ ID NO: 34448 - protein, 11 aa, Artificial Sequence
  Peptide Derived from Human Papillomavirus
KCAKNRITIEK

SEQ ID NO: 34449 - protein, 9 aa, Artificial Sequence
  Peptide Derived from Human Papillomavirus
KCVSGQNIR

SEQ ID NO: 34450 - protein, 8 aa, Artificial Sequence
  Peptide Derived from Human Papillomavirus
KDCGTMCR

SEQ ID NO: 34451 - protein, 9 aa, Artificial Sequence
  Peptide Derived from Human Papillomavirus
KDCGTMCRH

SEQ ID NO: 34452 - protein, 10 aa, Artificial Sequence
  Peptide Derived from Human Papillomavirus
KDCGTMCRHY

SEQ ID NO: 34453 - protein, 11 aa, Artificial Sequence
  Peptide Derived from Human Papillomavirus
KDCGTMCRHYK

SEQ ID NO: 34454 - protein, 9 aa, Artificial Sequence
  Peptide Derived from Human Papillomavirus
KDDRWPYLH

SEQ ID NO: 34455 - protein, 11 aa, Artificial Sequence
  Peptide Derived from Human Papillomavirus
KDDRWPYLHSR

SEQ ID NO: 34456 - protein, 10 aa, Artificial Sequence
  Peptide Derived from Human Papillomavirus
KFKELYGVSF

SEQ ID NO: 34457 - protein, 10 aa, Artificial Sequence
  Peptide Derived from Human Papillomavirus
KFLRYQQIEF

SEQ ID NO: 34458 - protein, 8 aa, Artificial Sequence
  Peptide Derived from Human Papillomavirus
KIGMLDDA

SEQ ID NO: 34459 - protein, 11 aa, Artificial Sequence
  Peptide Derived from Human Papillomavirus
KIVKDCGTMCR

SEQ ID NO: 34460 - protein, 9 aa, Artificial Sequence
  Peptide Derived from Human Papillomavirus
KLFLKGVPK

SEQ ID NO: 34461 - protein, 10 aa, Artificial Sequence
  Peptide Derived from Human Papillomavirus
KLFLKGVPKK

SEQ ID NO: 34462 - protein, 8 aa, Artificial Sequence
  Peptide Derived from Human Papillomavirus
KLRSTAAA

SEQ ID NO: 34463 - protein, 10 aa, Artificial Sequence
  Peptide Derived from Human Papillomavirus
KLRSTAAALY

SEQ ID NO: 34464 - protein, 10 aa, Artificial Sequence
  Peptide Derived from Human Papillomavirus
KSFFSRTWCR

SEQ ID NO: 34465 - protein, 10 aa, Artificial Sequence
  Peptide Derived from Human Papillomavirus
KSHFWLQPLA

SEQ ID NO: 34466 - protein, 10 aa, Artificial Sequence
  Peptide Derived from Human Papillomavirus
KSNSQAKIVK

SEQ ID NO: 34467 - protein, 10 aa, Artificial Sequence
  Peptide Derived from Human Papillomavirus
KSTCTDWCVA

SEQ ID NO: 34468 - protein, 11 aa, Artificial Sequence
  Peptide Derived from Human Papillomavirus
KSTCTDWCVAA

SEQ ID NO: 34469 - protein, 11 aa, Artificial Sequence
  Peptide Derived from Human Papillomavirus
KSYFGMSLISF

SEQ ID NO: 34470 - protein, 8 aa, Artificial Sequence
  Peptide Derived from Human Papillomavirus
KTAKRRLF

SEQ ID NO: 34471 - protein, 10 aa, Artificial Sequence
  Peptide Derived from Human Papillomavirus
KTLLQPYCLY

SEQ ID NO: 34472 - protein, 8 aa, Artificial Sequence
  Peptide Derived from Human Papillomavirus
KTSNGKAA

SEQ ID NO: 34473 - protein, 9 aa, Artificial Sequence
  Peptide Derived from Human Papillomavirus
KVSDEGDWR

SEQ ID NO: 34474 - protein, 8 aa, Artificial Sequence
  Peptide Derived from Human Papillomavirus
LADSDSNA

SEQ ID NO: 34475 - protein, 10 aa, Artificial Sequence
  Peptide Derived from Human Papillomavirus
LADSDSNACA

SEQ ID NO: 34476 - protein, 11 aa, Artificial Sequence
  Peptide Derived from Human Papillomavirus
LADSDSNACAF

SEQ ID NO: 34477 - protein, 10 aa, Artificial Sequence
  Peptide Derived from Human Papillomavirus
LDDATTPCWH

SEQ ID NO: 34478 - protein, 11 aa, Artificial Sequence
  Peptide Derived from Human Papillomavirus
LDDATTPCWHY

SEQ ID NO: 34479 - protein, 11 aa, Artificial Sequence
  Peptide Derived from Human Papillomavirus
LDGNPVSIDVK

SEQ ID NO: 34480 - protein, 9 aa, Artificial Sequence
  Peptide Derived from Human Papillomavirus
LFELPDSGY

SEQ ID NO: 34481 - protein, 10 aa, Artificial Sequence
  Peptide Derived from Human Papillomavirus
LFHAQEAEEH

SEQ ID NO: 34482 - protein, 11 aa, Artificial Sequence
  Peptide Derived from Human Papillomavirus
LFHAQEAEEHA

SEQ ID NO: 34483 - protein, 8 aa, Artificial Sequence
  Peptide Derived from Human Papillomavirus
LFLKGVPK

SEQ ID NO: 34484 - protein, 9 aa, Artificial Sequence
  Peptide Derived from Human Papillomavirus
LFLKGVPKK

SEQ ID NO: 34485 - protein, 8 aa, Artificial Sequence
  Peptide Derived from Human Papillomavirus
LGKFKELY

SEQ ID NO: 34486 - protein, 10 aa, Artificial Sequence
  Peptide Derived from Human Papillomavirus
LIHGAPNTGK

SEQ ID NO: 34487 - protein, 8 aa, Artificial Sequence
  Peptide Derived from Human Papillomavirus
LIQPPKLR

SEQ ID NO: 34488 - protein, 11 aa, Artificial Sequence
  Peptide Derived from Human Papillomavirus
LIQPPKLRSTA

SEQ ID NO: 34489 - protein, 9 aa, Artificial Sequence
  Peptide Derived from Human Papillomavirus
LIRPFQSNK

SEQ ID NO: 34490 - protein, 8 aa, Artificial Sequence
  Peptide Derived from Human Papillomavirus
LITSNINA

SEQ ID NO: 34491 - protein, 10 aa, Artificial Sequence
  Peptide Derived from Human Papillomavirus
LITSNINAGK

SEQ ID NO: 34492 - protein, 9 aa, Artificial Sequence
  Peptide Derived from Human Papillomavirus
LLITSNINA

SEQ ID NO: 34493 - protein, 11 aa, Artificial Sequence
  Peptide Derived from Human Papillomavirus
LLITSNINAGK

SEQ ID NO: 34494 - protein, 8 aa, Artificial Sequence
  Peptide Derived from Human Papillomavirus
LLQPYCLY

SEQ ID NO: 34495 - protein, 10 aa, Artificial Sequence
  Peptide Derived from Human Papillomavirus
LLQPYCLYCH

SEQ ID NO: 34496 - protein, 9 aa, Artificial Sequence
  Peptide Derived from Human Papillomavirus
LMLVRFKCA

SEQ ID NO: 34497 - protein, 10 aa, Artificial Sequence
  Peptide Derived from Human Papillomavirus
LMLVRFKCAK

SEQ ID NO: 34498 - protein, 9 aa, Artificial Sequence
  Peptide Derived from Human Papillomavirus
LSALKLFLK

SEQ ID NO: 34499 - protein, 10 aa, Artificial Sequence
  Peptide Derived from Human Papillomavirus
LSCNGSDGTH

SEQ ID NO: 34500 - protein, 10 aa, Artificial Sequence
  Peptide Derived from Human Papillomavirus
LSDISSCVDY

SEQ ID NO: 34501 - protein, 9 aa, Artificial Sequence
  Peptide Derived from Human Papillomavirus
LSDKNWKSF

SEQ ID NO: 34502 - protein, 10 aa, Artificial Sequence
  Peptide Derived from Human Papillomavirus
LSDKNWKSFF

SEQ ID NO: 34503 - protein, 8 aa, Artificial Sequence
  Peptide Derived from Human Papillomavirus
LSQMVQWA

SEQ ID NO: 34504 - protein, 9 aa, Artificial Sequence
  Peptide Derived from Human Papillomavirus
LSQMVQWAY

SEQ ID NO: 34505 - protein, 8 aa, Artificial Sequence
  Peptide Derived from Human Papillomavirus
LVRFKCAK

SEQ ID NO: 34506 - protein, 10 aa, Artificial Sequence
  Peptide Derived from Human Papillomavirus
LVRFKCAKNR

SEQ ID NO: 34507 - protein, 10 aa, Artificial Sequence
  Peptide Derived from Human Papillomavirus
LVVFTFPNPF

SEQ ID NO: 34508 - protein, 8 aa, Artificial Sequence
  Peptide Derived from Human Papillomavirus
MCRHYKRA

SEQ ID NO: 34509 - protein, 10 aa, Artificial Sequence
  Peptide Derived from Human Papillomavirus
MCRHYKRAEK

SEQ ID NO: 34510 - protein, 11 aa, Artificial Sequence
  Peptide Derived from Human Papillomavirus
MCRHYKRAEKR

SEQ ID NO: 34511 - protein, 8 aa, Artificial Sequence
  Peptide Derived from Human Papillomavirus
MDDSEIAY

SEQ ID NO: 34512 - protein, 9 aa, Artificial Sequence
  Peptide Derived from Human Papillomavirus
MDDSEIAYK

SEQ ID NO: 34513 - protein, 10 aa, Artificial Sequence
  Peptide Derived from Human Papillomavirus
MDDSEIAYKY

SEQ ID NO: 34514 - protein, 11 aa, Artificial Sequence
  Peptide Derived from Human Papillomavirus
MDDSEIAYKYA

SEQ ID NO: 34515 - protein, 8 aa, Artificial Sequence
  Peptide Derived from Human Papillomavirus
MGQWIKSR

SEQ ID NO: 34516 - protein, 11 aa, Artificial Sequence
  Peptide Derived from Human Papillomavirus
MGQWIKSRCDK

SEQ ID NO: 34517 - protein, 11 aa, Artificial Sequence
  Peptide Derived from Human Papillomavirus
MLDDATTPCWH

SEQ ID NO: 34518 - protein, 9 aa, Artificial Sequence
  Peptide Derived from Human Papillomavirus
MLGKFKELY

SEQ ID NO: 34519 - protein, 9 aa, Artificial Sequence
  Peptide Derived from Human Papillomavirus
MLIQPPKLR

SEQ ID NO: 34520 - protein, 8 aa, Artificial Sequence
  Peptide Derived from Human Papillomavirus
MLMLVRFK

SEQ ID NO: 34521 - protein, 10 aa, Artificial Sequence
  Peptide Derived from Human Papillomavirus
MLMLVRFKCA

SEQ ID NO: 34522 - protein, 11 aa, Artificial Sequence
  Peptide Derived from Human Papillomavirus
MLMLVRFKCAK

SEQ ID NO: 34523 - protein, 8 aa, Artificial Sequence
  Peptide Derived from Human Papillomavirus
MLVRFKCA

SEQ ID NO: 34524 - protein, 9 aa, Artificial Sequence
  Peptide Derived from Human Papillomavirus
MLVRFKCAK

SEQ ID NO: 34525 - protein, 11 aa, Artificial Sequence
  Peptide Derived from Human Papillomavirus
MLVRFKCAKNR

SEQ ID NO: 34526 - protein, 8 aa, Artificial Sequence
  Peptide Derived from Human Papillomavirus
MSMGQWIK

SEQ ID NO: 34527 - protein, 10 aa, Artificial Sequence
  Peptide Derived from Human Papillomavirus
MSMGQWIKSR

SEQ ID NO: 34528 - protein, 8 aa, Artificial Sequence
  Peptide Derived from Human Papillomavirus
MSNISDVY

SEQ ID NO: 34529 - protein, 11 aa, Artificial Sequence
  Peptide Derived from Human Papillomavirus
MVDFIDNCNVY

SEQ ID NO: 34530 - protein, 8 aa, Artificial Sequence
  Peptide Derived from Human Papillomavirus
MVMLMLVR

SEQ ID NO: 34531 - protein, 9 aa, Artificial Sequence
  Peptide Derived from Human Papillomavirus
MVMLMLVRF

SEQ ID NO: 34532 - protein, 10 aa, Artificial Sequence
  Peptide Derived from Human Papillomavirus
MVMLMLVRFK

SEQ ID NO: 34533 - protein, 10 aa, Artificial Sequence
  Peptide Derived from Human Papillomavirus
NAGKDDRWPY

SEQ ID NO: 34534 - protein, 8 aa, Artificial Sequence
  Peptide Derived from Human Papillomavirus
NCILIHGA

SEQ ID NO: 34535 - protein, 9 aa, Artificial Sequence
  Peptide Derived from Human Papillomavirus
NCMLIQPPK

SEQ ID NO: 34536 - protein, 11 aa, Artificial Sequence
  Peptide Derived from Human Papillomavirus
NCMLIQPPKLR

SEQ ID NO: 34537 - protein, 9 aa, Artificial Sequence
  Peptide Derived from Human Papillomavirus
NCNVYNNQA

SEQ ID NO: 34538 - protein, 11 aa, Artificial Sequence
  Peptide Derived from Human Papillomavirus
NCNVYNNQAEA

SEQ ID NO: 34539 - protein, 9 aa, Artificial Sequence
  Peptide Derived from Human Papillomavirus
NDGDSFSTF

SEQ ID NO: 34540 - protein, 10 aa, Artificial Sequence
  Peptide Derived from Human Papillomavirus
NDGDSFSTFK

SEQ ID NO: 34541 - protein, 10 aa, Artificial Sequence
  Peptide Derived from Human Papillomavirus
NDVMDDSEIA

SEQ ID NO: 34542 - protein, 11 aa, Artificial Sequence
  Peptide Derived from Human Papillomavirus
NDVMDDSEIAY

SEQ ID NO: 34543 - protein, 9 aa, Artificial Sequence
  Peptide Derived from Human Papillomavirus
NGKAAMLGK

SEQ ID NO: 34544 - protein, 10 aa, Artificial Sequence
  Peptide Derived from Human Papillomavirus
NGKAAMLGKF

SEQ ID NO: 34545 - protein, 11 aa, Artificial Sequence
  Peptide Derived from Human Papillomavirus
NGKAAMLGKFK

SEQ ID NO: 34546 - protein, 11 aa, Artificial Sequence
  Peptide Derived from Human Papillomavirus
NGNPVYELSDK

SEQ ID NO: 34547 - protein, 10 aa, Artificial Sequence
  Peptide Derived from Human Papillomavirus
NGSDGTHSER

SEQ ID NO: 34548 - protein, 8 aa, Artificial Sequence
  Peptide Derived from Human Papillomavirus
NGWFYVEA

SEQ ID NO: 34549 - protein, 9 aa, Artificial Sequence
  Peptide Derived from Human Papillomavirus
NINAGKDDR

SEQ ID NO: 34550 - protein, 8 aa, Artificial Sequence
  Peptide Derived from Human Papillomavirus
NISPRLKA

SEQ ID NO: 34551 - protein, 8 aa, Artificial Sequence
  Peptide Derived from Human Papillomavirus
NLHEEEDK

SEQ ID NO: 34552 - protein, 8 aa, Artificial Sequence
  Peptide Derived from Human Papillomavirus
NSKTAKRR

SEQ ID NO: 34553 - protein, 10 aa, Artificial Sequence
  Peptide Derived from Human Papillomavirus
NSKTAKRRLF

SEQ ID NO: 34554 - protein, 8 aa, Artificial Sequence
  Peptide Derived from Human Papillomavirus
NSQAKIVK

SEQ ID NO: 34555 - protein, 9 aa, Artificial Sequence
  Peptide Derived from Human Papillomavirus
NVYNNQAEA

SEQ ID NO: 34556 - protein, 9 aa, Artificial Sequence
  Peptide Derived from Human Papillomavirus
PCWHYIDNY

SEQ ID NO: 34557 - protein, 11 aa, Artificial Sequence
  Peptide Derived from Human Papillomavirus
PCWHYIDNYLR

SEQ ID NO: 34558 - protein, 10 aa, Artificial Sequence
  Peptide Derived from Human Papillomavirus
PFDKNGNPVY

SEQ ID NO: 34559 - protein, 10 aa, Artificial Sequence
  Peptide Derived from Human Papillomavirus
PLLITSNINA

SEQ ID NO: 34560 - protein, 11 aa, Artificial Sequence
  Peptide Derived from Human Papillomavirus
PLSDISSCVDY

SEQ ID NO: 34561 - protein, 10 aa, Artificial Sequence
  Peptide Derived from Human Papillomavirus
PTRNILQVLK

SEQ ID NO: 34562 - protein, 8 aa, Artificial Sequence
  Peptide Derived from Human Papillomavirus
PVSIDVKH

SEQ ID NO: 34563 - protein, 9 aa, Artificial Sequence
  Peptide Derived from Human Papillomavirus
PVSIDVKHK

SEQ ID NO: 34564 - protein, 10 aa, Artificial Sequence
  Peptide Derived from Human Papillomavirus
PVSIDVKHKA

SEQ ID NO: 34565 - protein, 8 aa, Artificial Sequence
  Peptide Derived from Human Papillomavirus
PVYELSDK

SEQ ID NO: 34566 - protein, 11 aa, Artificial Sequence
  Peptide Derived from Human Papillomavirus
PVYELSDKNWK

SEQ ID NO: 34567 - protein, 9 aa, Artificial Sequence
  Peptide Derived from Human Papillomavirus
QAEAETAQA

SEQ ID NO: 34568 - protein, 11 aa, Artificial Sequence
  Peptide Derived from Human Papillomavirus
QAEAETAQALF

SEQ ID NO: 34569 - protein, 9 aa, Artificial Sequence
  Peptide Derived from Human Papillomavirus
QALFHAQEA

SEQ ID NO: 34570 - protein, 8 aa, Artificial Sequence
  Peptide Derived from Human Papillomavirus
QGCIISYA

SEQ ID NO: 34571 - protein, 11 aa, Artificial Sequence
  Peptide Derived from Human Papillomavirus
QGCIISYANSK

SEQ ID NO: 34572 - protein, 10 aa, Artificial Sequence
  Peptide Derived from Human Papillomavirus
QIEFVSFLSA

SEQ ID NO: 34573 - protein, 9 aa, Artificial Sequence
  Peptide Derived from Human Papillomavirus
QLADSDSNA

SEQ ID NO: 34574 - protein, 11 aa, Artificial Sequence
  Peptide Derived from Human Papillomavirus
QLADSDSNACA

SEQ ID NO: 34575 - protein, 9 aa, Artificial Sequence
  Peptide Derived from Human Papillomavirus
QMSMGQWIK

SEQ ID NO: 34576 - protein, 11 aa, Artificial Sequence
  Peptide Derived from Human Papillomavirus
QMSMGQWIKSR

SEQ ID NO: 34577 - protein, 8 aa, Artificial Sequence
  Peptide Derived from Human Papillomavirus
QTVLQHSF

SEQ ID NO: 34578 - protein, 9 aa, Artificial Sequence
  Peptide Derived from Human Papillomavirus
QVLKTSNGK

SEQ ID NO: 34579 - protein, 10 aa, Artificial Sequence
  Peptide Derived from Human Papillomavirus
QVLKTSNGKA

SEQ ID NO: 34580 - protein, 11 aa, Artificial Sequence
  Peptide Derived from Human Papillomavirus
QVLKTSNGKAA

SEQ ID NO: 34581 - protein, 8 aa, Artificial Sequence
  Peptide Derived from Human Papillomavirus
RDIVKFLR

SEQ ID NO: 34582 - protein, 9 aa, Artificial Sequence
  Peptide Derived from Human Papillomavirus
RDIVKFLRY

SEQ ID NO: 34583 - protein, 8 aa, Artificial Sequence
  Peptide Derived from Human Papillomavirus
RFKCAKNR

SEQ ID NO: 34584 - protein, 10 aa, Artificial Sequence
  Peptide Derived from Human Papillomavirus
RITIEKLLEK

SEQ ID NO: 34585 - protein, 10 aa, Artificial Sequence
  Peptide Derived from Human Papillomavirus
RLFELPDSGY

SEQ ID NO: 34586 - protein, 10 aa, Artificial Sequence
  Peptide Derived from Human Papillomavirus
RLNLHEEEDK

SEQ ID NO: 34587 - protein, 11 aa, Artificial Sequence
  Peptide Derived from Human Papillomavirus
RLVVFTFPNPF

SEQ ID NO: 34588 - protein, 8 aa, Artificial Sequence
  Peptide Derived from Human Papillomavirus
RSTAAALY

SEQ ID NO: 34589 - protein, 10 aa, Artificial Sequence
  Peptide Derived from Human Papillomavirus
RSTAAALYWY

SEQ ID NO: 34590 - protein, 11 aa, Artificial Sequence
  Peptide Derived from Human Papillomavirus
RSTAAALYWYR

SEQ ID NO: 34591 - protein, 11 aa, Artificial Sequence
  Peptide Derived from Human Papillomavirus
RTGMSNISDVY

SEQ ID NO: 34592 - protein, 9 aa, Artificial Sequence
  Peptide Derived from Human Papillomavirus
RTWCRLNLH

SEQ ID NO: 34593 - protein, 8 aa, Artificial Sequence
  Peptide Derived from Human Papillomavirus
SALKLFLK

SEQ ID NO: 34594 - protein, 9 aa, Artificial Sequence
  Peptide Derived from Human Papillomavirus
SCNGSDGTH

SEQ ID NO: 34595 - protein, 10 aa, Artificial Sequence
  Peptide Derived from Human Papillomavirus
SCVDYNISPR

SEQ ID NO: 34596 - protein, 11 aa, Artificial Sequence
  Peptide Derived from Human Papillomavirus
SDEGDWRDIVK

SEQ ID NO: 34597 - protein, 8 aa, Artificial Sequence
  Peptide Derived from Human Papillomavirus
SDGTHSER

SEQ ID NO: 34598 - protein, 9 aa, Artificial Sequence
  Peptide Derived from Human Papillomavirus
SDISSCVDY

SEQ ID NO: 34599 - protein, 8 aa, Artificial Sequence
  Peptide Derived from Human Papillomavirus
SDKNWKSF

SEQ ID NO: 34600 - protein, 9 aa, Artificial Sequence
  Peptide Derived from Human Papillomavirus
SDKNWKSFF

SEQ ID NO: 34601 - protein, 11 aa, Artificial Sequence
  Peptide Derived from Human Papillomavirus
SDKNWKSFFSR

SEQ ID NO: 34602 - protein, 8 aa, Artificial Sequence
  Peptide Derived from Human Papillomavirus
SDSNACAF

SEQ ID NO: 34603 - protein, 10 aa, Artificial Sequence
  Peptide Derived from Human Papillomavirus
SDSNACAFLK

SEQ ID NO: 34604 - protein, 10 aa, Artificial Sequence
  Peptide Derived from Human Papillomavirus
SDTGEDMVDF

SEQ ID NO: 34605 - protein, 9 aa, Artificial Sequence
  Peptide Derived from Human Papillomavirus
SFFSRTWCR

SEQ ID NO: 34606 - protein, 10 aa, Artificial Sequence
  Peptide Derived from Human Papillomavirus
SFLQGCIISY

SEQ ID NO: 34607 - protein, 11 aa, Artificial Sequence
  Peptide Derived from Human Papillomavirus
SFLQGCIISYA

SEQ ID NO: 34608 - protein, 9 aa, Artificial Sequence
  Peptide Derived from Human Papillomavirus
SFLSALKLF

SEQ ID NO: 34609 - protein, 11 aa, Artificial Sequence
  Peptide Derived from Human Papillomavirus
SFLSALKLFLK

SEQ ID NO: 34610 - protein, 9 aa, Artificial Sequence
  Peptide Derived from Human Papillomavirus
SFMELIRPF

SEQ ID NO: 34611 - protein, 8 aa, Artificial Sequence
  Peptide Derived from Human Papillomavirus
SIDVKHKA

SEQ ID NO: 34612 - protein, 9 aa, Artificial Sequence
  Peptide Derived from Human Papillomavirus
SMGQWIKSR

SEQ ID NO: 34613 - protein, 11 aa, Artificial Sequence
  Peptide Derived from Human Papillomavirus
SSCVDYNISPR

SEQ ID NO: 34614 - protein, 11 aa, Artificial Sequence
  Peptide Derived from Human Papillomavirus
SSDTGEDMVDF

SEQ ID NO: 34615 - protein, 9 aa, Artificial Sequence
  Peptide Derived from Human Papillomavirus
STAAALYWY

SEQ ID NO: 34616 - protein, 10 aa, Artificial Sequence
  Peptide Derived from Human Papillomavirus
STAAALYWYR

SEQ ID NO: 34617 - protein, 9 aa, Artificial Sequence
  Peptide Derived from Human Papillomavirus
STCTDWCVA

SEQ ID NO: 34618 - protein, 10 aa, Artificial Sequence
  Peptide Derived from Human Papillomavirus
STCTDWCVAA

SEQ ID NO: 34619 - protein, 11 aa, Artificial Sequence
  Peptide Derived from Human Papillomavirus
STCTDWCVAAF

SEQ ID NO: 34620 - protein, 11 aa, Artificial Sequence
  Peptide Derived from Human Papillomavirus
STNCMLIQPPK

SEQ ID NO: 34621 - protein, 8 aa, Artificial Sequence
  Peptide Derived from Human Papillomavirus
TAAALYWY

SEQ ID NO: 34622 - protein, 9 aa, Artificial Sequence
  Peptide Derived from Human Papillomavirus
TAAALYWYR

SEQ ID NO: 34623 - protein, 8 aa, Artificial Sequence
  Peptide Derived from Human Papillomavirus
TAQALFHA

SEQ ID NO: 34624 - protein, 11 aa, Artificial Sequence
  Peptide Derived from Human Papillomavirus
TAQALFHAQEA

SEQ ID NO: 34625 - protein, 8 aa, Artificial Sequence
  Peptide Derived from Human Papillomavirus
TCTDWCVA

SEQ ID NO: 34626 - protein, 9 aa, Artificial Sequence
  Peptide Derived from Human Papillomavirus
TCTDWCVAA

SEQ ID NO: 34627 - protein, 10 aa, Artificial Sequence
  Peptide Derived from Human Papillomavirus
TCTDWCVAAF

SEQ ID NO: 34628 - protein, 8 aa, Artificial Sequence
  Peptide Derived from Human Papillomavirus
TDWCVAAF

SEQ ID NO: 34629 - protein, 11 aa, Artificial Sequence
  Peptide Derived from Human Papillomavirus
TFDLSQMVQWA

SEQ ID NO: 34630 - protein, 11 aa, Artificial Sequence
  Peptide Derived from Human Papillomavirus
TFKCVSGQNIR

SEQ ID NO: 34631 - protein, 8 aa, Artificial Sequence
  Peptide Derived from Human Papillomavirus
TFPNPFPF

SEQ ID NO: 34632 - protein, 10 aa, Artificial Sequence
  Peptide Derived from Human Papillomavirus
TFPNPFPFDK

SEQ ID NO: 34633 - protein, 8 aa, Artificial Sequence
  Peptide Derived from Human Papillomavirus
TGCNGWFY

SEQ ID NO: 34634 - protein, 11 aa, Artificial Sequence
  Peptide Derived from Human Papillomavirus
TGCNGWFYVEA

SEQ ID NO: 34635 - protein, 8 aa, Artificial Sequence
  Peptide Derived from Human Papillomavirus
TGEDMVDF

SEQ ID NO: 34636 - protein, 10 aa, Artificial Sequence
  Peptide Derived from Human Papillomavirus
TGMSNISDVY

SEQ ID NO: 34637 - protein, 8 aa, Artificial Sequence
  Peptide Derived from Human Papillomavirus
TGTVAEGF

SEQ ID NO: 34638 - protein, 9 aa, Artificial Sequence
  Peptide Derived from Human Papillomavirus
TGTVAEGFK

SEQ ID NO: 34639 - protein, 8 aa, Artificial Sequence
  Peptide Derived from Human Papillomavirus
TIEKLLEK

SEQ ID NO: 34640 - protein, 9 aa, Artificial Sequence
  Peptide Derived from Human Papillomavirus
TLLQPYCLY

SEQ ID NO: 34641 - protein, 11 aa, Artificial Sequence
  Peptide Derived from Human Papillomavirus
TLLQPYCLYCH

SEQ ID NO: 34642 - protein, 11 aa, Artificial Sequence
  Peptide Derived from Human Papillomavirus
TLSCNGSDGTH

SEQ ID NO: 34643 - protein, 8 aa, Artificial Sequence
  Peptide Derived from Human Papillomavirus
TMCRHYKR

SEQ ID NO: 34644 - protein, 9 aa, Artificial Sequence
  Peptide Derived from Human Papillomavirus
TMCRHYKRA

SEQ ID NO: 34645 - protein, 11 aa, Artificial Sequence
  Peptide Derived from Human Papillomavirus
TMCRHYKRAEK

SEQ ID NO: 34646 - protein, 11 aa, Artificial Sequence
  Peptide Derived from Human Papillomavirus
TSNGKAAMLGK

SEQ ID NO: 34647 - protein, 8 aa, Artificial Sequence
  Peptide Derived from Human Papillomavirus
TSNINAGK

SEQ ID NO: 34648 - protein, 11 aa, Artificial Sequence
  Peptide Derived from Human Papillomavirus
TSNINAGKDDR

SEQ ID NO: 34649 - protein, 11 aa, Artificial Sequence
  Peptide Derived from Human Papillomavirus
TTPCWHYIDNY

SEQ ID NO: 34650 - protein, 11 aa, Artificial Sequence
  Peptide Derived from Human Papillomavirus
VAAFGVTGTVA

SEQ ID NO: 34651 - protein, 10 aa, Artificial Sequence
  Peptide Derived from Human Papillomavirus
VDFIDNCNVY

SEQ ID NO: 34652 - protein, 8 aa, Artificial Sequence
  Peptide Derived from Human Papillomavirus
VDYNISPR

SEQ ID NO: 34653 - protein, 10 aa, Artificial Sequence
  Peptide Derived from Human Papillomavirus
VDYNISPRLK

SEQ ID NO: 34654 - protein, 11 aa, Artificial Sequence
  Peptide Derived from Human Papillomavirus
VDYNISPRLKA

SEQ ID NO: 34655 - protein, 8 aa, Artificial Sequence
  Peptide Derived from Human Papillomavirus
VFTFPNPF

SEQ ID NO: 34656 - protein, 10 aa, Artificial Sequence
  Peptide Derived from Human Papillomavirus
VFTFPNPFPF

SEQ ID NO: 34657 - protein, 8 aa, Artificial Sequence
  Peptide Derived from Human Papillomavirus
VLKTSNGK

SEQ ID NO: 34658 - protein, 9 aa, Artificial Sequence
  Peptide Derived from Human Papillomavirus
VLKTSNGKA

SEQ ID NO: 34659 - protein, 10 aa, Artificial Sequence
  Peptide Derived from Human Papillomavirus
VLKTSNGKAA

SEQ ID NO: 34660 - protein, 11 aa, Artificial Sequence
  Peptide Derived from Human Papillomavirus
VLQHSFNDTTF

SEQ ID NO: 34661 - protein, 8 aa, Artificial Sequence
  Peptide Derived from Human Papillomavirus
VMDDSEIA

SEQ ID NO: 34662 - protein, 9 aa, Artificial Sequence
  Peptide Derived from Human Papillomavirus
VMDDSEIAY

SEQ ID NO: 34663 - protein, 10 aa, Artificial Sequence
  Peptide Derived from Human Papillomavirus
VMDDSEIAYK

SEQ ID NO: 34664 - protein, 11 aa, Artificial Sequence
  Peptide Derived from Human Papillomavirus
VMDDSEIAYKY

SEQ ID NO: 34665 - protein, 8 aa, Artificial Sequence
  Peptide Derived from Human Papillomavirus
VMLMLVRF

SEQ ID NO: 34666 - protein, 9 aa, Artificial Sequence
  Peptide Derived from Human Papillomavirus
VMLMLVRFK

SEQ ID NO: 34667 - protein, 11 aa, Artificial Sequence
  Peptide Derived from Human Papillomavirus
VMLMLVRFKCA

SEQ ID NO: 34668 - protein, 8 aa, Artificial Sequence
  Peptide Derived from Human Papillomavirus
VSDEGDWR

SEQ ID NO: 34669 - protein, 8 aa, Artificial Sequence
  Peptide Derived from Human Papillomavirus
VSFLSALK

SEQ ID NO: 34670 - protein, 10 aa, Artificial Sequence
  Peptide Derived from Human Papillomavirus
VSFLSALKLF

SEQ ID NO: 34671 - protein, 8 aa, Artificial Sequence
  Peptide Derived from Human Papillomavirus
VSFMELIR

SEQ ID NO: 34672 - protein, 10 aa, Artificial Sequence
  Peptide Derived from Human Papillomavirus
VSFMELIRPF

SEQ ID NO: 34673 - protein, 8 aa, Artificial Sequence
  Peptide Derived from Human Papillomavirus
VSIDVKHK

SEQ ID NO: 34674 - protein, 9 aa, Artificial Sequence
  Peptide Derived from Human Papillomavirus
VSIDVKHKA

SEQ ID NO: 34675 - protein, 9 aa, Artificial Sequence
  Peptide Derived from Human Papillomavirus
VTGTVAEGF

SEQ ID NO: 34676 - protein, 10 aa, Artificial Sequence
  Peptide Derived from Human Papillomavirus
VTGTVAEGFK

SEQ ID NO: 34677 - protein, 9 aa, Artificial Sequence
  Peptide Derived from Human Papillomavirus
VVFTFPNPF

SEQ ID NO: 34678 - protein, 11 aa, Artificial Sequence
  Peptide Derived from Human Papillomavirus
VVFTFPNPFPF

SEQ ID NO: 34679 - protein, 10 aa, Artificial Sequence
  Peptide Derived from Human Papillomavirus
WFYVEAVIDR

SEQ ID NO: 34680 - protein, 10 aa, Artificial Sequence
  Peptide Derived from Human Papillomavirus
WGMVMLMLVR

SEQ ID NO: 34681 - protein, 11 aa, Artificial Sequence
  Peptide Derived from Human Papillomavirus
WGMVMLMLVRF

SEQ ID NO: 34682 - protein, 10 aa, Artificial Sequence
  Peptide Derived from Human Papillomavirus
WIERQTVLQH

SEQ ID NO: 34683 - protein, 8 aa, Artificial Sequence
  Peptide Derived from Human Papillomavirus
WIKSRCDK

SEQ ID NO: 34684 - protein, 8 aa, Artificial Sequence
  Peptide Derived from Human Papillomavirus
WLQPLADA

SEQ ID NO: 34685 - protein, 9 aa, Artificial Sequence
  Peptide Derived from Human Papillomavirus
WLQPLADAK

SEQ ID NO: 34686 - protein, 8 aa, Artificial Sequence
  Peptide Derived from Human Papillomavirus
YANSKSHF

SEQ ID NO: 34687 - protein, 11 aa, Artificial Sequence
  Peptide Derived from Human Papillomavirus
YAQLADSDSNA

SEQ ID NO: 34688 - protein, 8 aa, Artificial Sequence
  Peptide Derived from Human Papillomavirus
YCHLQSLA

SEQ ID NO: 34689 - protein, 11 aa, Artificial Sequence
  Peptide Derived from Human Papillomavirus
YCLYCHLQSLA

SEQ ID NO: 34690 - protein, 9 aa, Artificial Sequence
  Peptide Derived from Human Papillomavirus
YFGMSLISF

SEQ ID NO: 34691 - protein, 10 aa, Artificial Sequence
  Peptide Derived from Human Papillomavirus
YGETPEWIER

SEQ ID NO: 34692 - protein, 10 aa, Artificial Sequence
  Peptide Derived from Human Papillomavirus
YGVSFMELIR

SEQ ID NO: 34693 - protein, 9 aa, Artificial Sequence
  Peptide Derived from Human Papillomavirus
YIDNYLRNA

SEQ ID NO: 34694 - protein, 9 aa, Artificial Sequence
  Peptide Derived from Human Papillomavirus
YLHSRLVVF

SEQ ID NO: 34695 - protein, 11 aa, Artificial Sequence
  Peptide Derived from Human Papillomavirus
YLHSRLVVFTF

SEQ ID NO: 34696 - protein, 8 aa, Artificial Sequence
  Peptide Derived from Human Papillomavirus
YVEAVIDR

SEQ ID NO: 34697 - protein, 9 aa, Artificial Sequence
  Peptide Derived from Human Papillomavirus
AAACTNQTR

SEQ ID NO: 34698 - protein, 10 aa, Artificial Sequence
  Peptide Derived from Human Papillomavirus
AAACTNQTRA

SEQ ID NO: 34699 - protein, 8 aa, Artificial Sequence
  Peptide Derived from Human Papillomavirus
AACTNQTR

SEQ ID NO: 34700 - protein, 9 aa, Artificial Sequence
  Peptide Derived from Human Papillomavirus
AACTNQTRA

SEQ ID NO: 34701 - protein, 8 aa, Artificial Sequence
  Peptide Derived from Human Papillomavirus
ACTNQTRA

SEQ ID NO: 34702 - protein, 8 aa, Artificial Sequence
  Peptide Derived from Human Papillomavirus
AGGQVIVF

SEQ ID NO: 34703 - protein, 10 aa, Artificial Sequence
  Peptide Derived from Human Papillomavirus
AGIVTKLPTA

SEQ ID NO: 34704 - protein, 9 aa, Artificial Sequence
  Peptide Derived from Human Papillomavirus
ALGTSEGVR

SEQ ID NO: 34705 - protein, 10 aa, Artificial Sequence
  Peptide Derived from Human Papillomavirus
ALGTSEGVRR

SEQ ID NO: 34706 - protein, 11 aa, Artificial Sequence
  Peptide Derived from Human Papillomavirus
ALGTSEGVRRA

SEQ ID NO: 34707 - protein, 8 aa, Artificial Sequence
  Peptide Derived from Human Papillomavirus
ALSVSKAK

SEQ ID NO: 34708 - protein, 9 aa, Artificial Sequence
  Peptide Derived from Human Papillomavirus
ALSVSKAKA

SEQ ID NO: 34709 - protein, 9 aa, Artificial Sequence
  Peptide Derived from Human Papillomavirus
ATTPIIHLK

SEQ ID NO: 34710 - protein, 9 aa, Artificial Sequence
  Peptide Derived from Human Papillomavirus
ATTSTKRPR

SEQ ID NO: 34711 - protein, 10 aa, Artificial Sequence
  Peptide Derived from Human Papillomavirus
CALGTSEGVR

SEQ ID NO: 34712 - protein, 11 aa, Artificial Sequence
  Peptide Derived from Human Papillomavirus
CALGTSEGVRR

SEQ ID NO: 34713 - protein, 8 aa, Artificial Sequence
  Peptide Derived from Human Papillomavirus
CDHIDYWK

SEQ ID NO: 34714 - protein, 9 aa, Artificial Sequence
  Peptide Derived from Human Papillomavirus
CDHIDYWKH

SEQ ID NO: 34715 - protein, 11 aa, Artificial Sequence
  Peptide Derived from Human Papillomavirus
CDHIDYWKHIR

SEQ ID NO: 34716 - protein, 8 aa, Artificial Sequence
  Peptide Derived from Human Papillomavirus
CGVISAAA

SEQ ID NO: 34717 - protein, 8 aa, Artificial Sequence
  Peptide Derived from Human Papillomavirus
CLRYRLSK

SEQ ID NO: 34718 - protein, 9 aa, Artificial Sequence
  Peptide Derived from Human Papillomavirus
CLRYRLSKY

SEQ ID NO: 34719 - protein, 10 aa, Artificial Sequence
  Peptide Derived from Human Papillomavirus
CLRYRLSKYK

SEQ ID NO: 34720 - protein, 9 aa, Artificial Sequence
  Peptide Derived from Human Papillomavirus
CTDGKHKNA

SEQ ID NO: 34721 - protein, 11 aa, Artificial Sequence
  Peptide Derived from Human Papillomavirus
CTVVEGQVNCK

SEQ ID NO: 34722 - protein, 8 aa, Artificial Sequence
  Peptide Derived from Human Papillomavirus
CVLMYKAR

SEQ ID NO: 34723 - protein, 9 aa, Artificial Sequence
  Peptide Derived from Human Papillomavirus
DANILKCLR

SEQ ID NO: 34724 - protein, 10 aa, Artificial Sequence
  Peptide Derived from Human Papillomavirus
DANILKCLRY

SEQ ID NO: 34725 - protein, 11 aa, Artificial Sequence
  Peptide Derived from Human Papillomavirus
DANILKCLRYR

SEQ ID NO: 34726 - protein, 8 aa, Artificial Sequence
  Peptide Derived from Human Papillomavirus
DDFLNTVK

SEQ ID NO: 34727 - protein, 9 aa, Artificial Sequence
  Peptide Derived from Human Papillomavirus
DGDVHNTMH

SEQ ID NO: 34728 - protein, 10 aa, Artificial Sequence
  Peptide Derived from Human Papillomavirus
DGDVHNTMHY

SEQ ID NO: 34729 - protein, 8 aa, Artificial Sequence
  Peptide Derived from Human Papillomavirus
DSKRLCDH

SEQ ID NO: 34730 - protein, 11 aa, Artificial Sequence
  Peptide Derived from Human Papillomavirus
DSKRLCDHIDY

SEQ ID NO: 34731 - protein, 10 aa, Artificial Sequence
  Peptide Derived from Human Papillomavirus
DSVNCGVISA

SEQ ID NO: 34732 - protein, 11 aa, Artificial Sequence
  Peptide Derived from Human Papillomavirus
DSVNCGVISAA

SEQ ID NO: 34733 - protein, 8 aa, Artificial Sequence
  Peptide Derived from Human Papillomavirus
DVHNTMHY

SEQ ID NO: 34734 - protein, 9 aa, Artificial Sequence
  Peptide Derived from Human Papillomavirus
EAKKYGTGK

SEQ ID NO: 34735 - protein, 10 aa, Artificial Sequence
  Peptide Derived from Human Papillomavirus
EAKKYGTGKK

SEQ ID NO: 34736 - protein, 8 aa, Artificial Sequence
  Peptide Derived from Human Papillomavirus
ECVLMYKA

SEQ ID NO: 34737 - protein, 9 aa, Artificial Sequence
  Peptide Derived from Human Papillomavirus
ECVLMYKAR

SEQ ID NO: 34738 - protein, 10 aa, Artificial Sequence
  Peptide Derived from Human Papillomavirus
EGHITYFVNF

SEQ ID NO: 34739 - protein, 10 aa, Artificial Sequence
  Peptide Derived from Human Papillomavirus
EGQVNCKGIY

SEQ ID NO: 34740 - protein, 11 aa, Artificial Sequence
  Peptide Derived from Human Papillomavirus
EGQVNCKGIYY

SEQ ID NO: 34741 - protein, 11 aa, Artificial Sequence
  Peptide Derived from Human Papillomavirus
EGVRRATTSTK

SEQ ID NO: 34742 - protein, 10 aa, Artificial Sequence
  Peptide Derived from Human Papillomavirus
EISFAGIVTK

SEQ ID NO: 34743 - protein, 9 aa, Artificial Sequence
  Peptide Derived from Human Papillomavirus
EMGIHSINH

SEQ ID NO: 34744 - protein, 11 aa, Artificial Sequence
  Peptide Derived from Human Papillomavirus
ESVFSSDEISF

SEQ ID NO: 34745 - protein, 8 aa, Artificial Sequence
  Peptide Derived from Human Papillomavirus
ETLNNTEY

SEQ ID NO: 34746 - protein, 9 aa, Artificial Sequence
  Peptide Derived from Human Papillomavirus
ETLNNTEYK

SEQ ID NO: 34747 - protein, 11 aa, Artificial Sequence
  Peptide Derived from Human Papillomavirus
EVHAGGQVIVF

SEQ ID NO: 34748 - protein, 9 aa, Artificial Sequence
  Peptide Derived from Human Papillomavirus
EVQFDGDVH

SEQ ID NO: 34749 - protein, 11 aa, Artificial Sequence
  Peptide Derived from Human Papillomavirus
FAGIVTKLPTA

SEQ ID NO: 34750 - protein, 10 aa, Artificial Sequence
  Peptide Derived from Human Papillomavirus
FDGDVHNTMH

SEQ ID NO: 34751 - protein, 11 aa, Artificial Sequence
  Peptide Derived from Human Papillomavirus
FDGDVHNTMHY

SEQ ID NO: 34752 - protein, 8 aa, Artificial Sequence
  Peptide Derived from Human Papillomavirus
FSSDEISF

SEQ ID NO: 34753 - protein, 9 aa, Artificial Sequence
  Peptide Derived from Human Papillomavirus
FSSDEISFA

SEQ ID NO: 34754 - protein, 8 aa, Artificial Sequence
  Peptide Derived from Human Papillomavirus
FTEEAKKY

SEQ ID NO: 34755 - protein, 8 aa, Artificial Sequence
  Peptide Derived from Human Papillomavirus
FVNFTEEA

SEQ ID NO: 34756 - protein, 9 aa, Artificial Sequence
  Peptide Derived from Human Papillomavirus
FVNFTEEAK

SEQ ID NO: 34757 - protein, 10 aa, Artificial Sequence
  Peptide Derived from Human Papillomavirus
FVNFTEEAKK

SEQ ID NO: 34758 - protein, 11 aa, Artificial Sequence
  Peptide Derived from Human Papillomavirus
FVNFTEEAKKY

SEQ ID NO: 34759 - protein, 8 aa, Artificial Sequence
  Peptide Derived from Human Papillomavirus
GCLKKHGY

SEQ ID NO: 34760 - protein, 10 aa, Artificial Sequence
  Peptide Derived from Human Papillomavirus
GDANILKCLR

SEQ ID NO: 34761 - protein, 11 aa, Artificial Sequence
  Peptide Derived from Human Papillomavirus
GDANILKCLRY

SEQ ID NO: 34762 - protein, 8 aa, Artificial Sequence
  Peptide Derived from Human Papillomavirus
GDVHNTMH

SEQ ID NO: 34763 - protein, 9 aa, Artificial Sequence
  Peptide Derived from Human Papillomavirus
GDVHNTMHY

SEQ ID NO: 34764 - protein, 9 aa, Artificial Sequence
  Peptide Derived from Human Papillomavirus
GIVTKLPTA

SEQ ID NO: 34765 - protein, 9 aa, Artificial Sequence
  Peptide Derived from Human Papillomavirus
GIYYVHEGH

SEQ ID NO: 34766 - protein, 9 aa, Artificial Sequence
  Peptide Derived from Human Papillomavirus
GTGKKWEVH

SEQ ID NO: 34767 - protein, 10 aa, Artificial Sequence
  Peptide Derived from Human Papillomavirus
GTGKKWEVHA

SEQ ID NO: 34768 - protein, 8 aa, Artificial Sequence
  Peptide Derived from Human Papillomavirus
GTSEGVRR

SEQ ID NO: 34769 - protein, 9 aa, Artificial Sequence
  Peptide Derived from Human Papillomavirus
GTSEGVRRA

SEQ ID NO: 34770 - protein, 10 aa, Artificial Sequence
  Peptide Derived from Human Papillomavirus
GVRRATTSTK

SEQ ID NO: 34771 - protein, 11 aa, Artificial Sequence
  Peptide Derived from Human Papillomavirus
GVRRATTSTKR

SEQ ID NO: 34772 - protein, 9 aa, Artificial Sequence
  Peptide Derived from Human Papillomavirus
HAGGQVIVF

SEQ ID NO: 34773 - protein, 9 aa, Artificial Sequence
  Peptide Derived from Human Papillomavirus
HGYTVEVQF

SEQ ID NO: 34774 - protein, 9 aa, Artificial Sequence
  Peptide Derived from Human Papillomavirus
HIDYWKHIR

SEQ ID NO: 34775 - protein, 10 aa, Artificial Sequence
  Peptide Derived from Human Papillomavirus
HIRLECVLMY

SEQ ID NO: 34776 - protein, 11 aa, Artificial Sequence
  Peptide Derived from Human Papillomavirus
HIRLECVLMYK

SEQ ID NO: 34777 - protein, 8 aa, Artificial Sequence
  Peptide Derived from Human Papillomavirus
HITYFVNF

SEQ ID NO: 34778 - protein, 10 aa, Artificial Sequence
  Peptide Derived from Human Papillomavirus
HLKGDANILK

SEQ ID NO: 34779 - protein, 10 aa, Artificial Sequence
  Peptide Derived from Human Papillomavirus
HSINHQVVPA

SEQ ID NO: 34780 - protein, 8 aa, Artificial Sequence
  Peptide Derived from Human Papillomavirus
IDYWKHIR

SEQ ID NO: 34781 - protein, 8 aa, Artificial Sequence
  Peptide Derived from Human Papillomavirus
IIHLKGDA

SEQ ID NO: 34782 - protein, 10 aa, Artificial Sequence
  Peptide Derived from Human Papillomavirus
ILEHYENDSK

SEQ ID NO: 34783 - protein, 11 aa, Artificial Sequence
  Peptide Derived from Human Papillomavirus
ILEHYENDSKR

SEQ ID NO: 34784 - protein, 8 aa, Artificial Sequence
  Peptide Derived from Human Papillomavirus
ILKCLRYR

SEQ ID NO: 34785 - protein, 11 aa, Artificial Sequence
  Peptide Derived from Human Papillomavirus
ILKCLRYRLSK

SEQ ID NO: 34786 - protein, 11 aa, Artificial Sequence
  Peptide Derived from Human Papillomavirus
ISAAACTNQTR

SEQ ID NO: 34787 - protein, 9 aa, Artificial Sequence
  Peptide Derived from Human Papillomavirus
ISFAGIVTK

SEQ ID NO: 34788 - protein, 9 aa, Artificial Sequence
  Peptide Derived from Human Papillomavirus
ISTSQRDDF

SEQ ID NO: 34789 - protein, 11 aa, Artificial Sequence
  Peptide Derived from Human Papillomavirus
ITYFVNFTEEA

SEQ ID NO: 34790 - protein, 8 aa, Artificial Sequence
  Peptide Derived from Human Papillomavirus
IVFPESVF

SEQ ID NO: 34791 - protein, 8 aa, Artificial Sequence
  Peptide Derived from Human Papillomavirus
IVTKLPTA

SEQ ID NO: 34792 - protein, 8 aa, Artificial Sequence
  Peptide Derived from Human Papillomavirus
KAREMGIH

SEQ ID NO: 34793 - protein, 9 aa, Artificial Sequence
  Peptide Derived from Human Papillomavirus
KCLRYRLSK

SEQ ID NO: 34794 - protein, 10 aa, Artificial Sequence
  Peptide Derived from Human Papillomavirus
KCLRYRLSKY

SEQ ID NO: 34795 - protein, 11 aa, Artificial Sequence
  Peptide Derived from Human Papillomavirus
KCLRYRLSKYK

SEQ ID NO: 34796 - protein, 8 aa, Artificial Sequence
  Peptide Derived from Human Papillomavirus
KGDANILK

SEQ ID NO: 34797 - protein, 11 aa, Artificial Sequence
  Peptide Derived from Human Papillomavirus
KGDANILKCLR

SEQ ID NO: 34798 - protein, 10 aa, Artificial Sequence
  Peptide Derived from Human Papillomavirus
KGIYYVHEGH

SEQ ID NO: 34799 - protein, 11 aa, Artificial Sequence
  Peptide Derived from Human Papillomavirus
KILEHYENDSK

SEQ ID NO: 34800 - protein, 9 aa, Artificial Sequence
  Peptide Derived from Human Papillomavirus
LCDHIDYWK

SEQ ID NO: 34801 - protein, 10 aa, Artificial Sequence
  Peptide Derived from Human Papillomavirus
LCDHIDYWKH

SEQ ID NO: 34802 - protein, 8 aa, Artificial Sequence
  Peptide Derived from Human Papillomavirus
LGTSEGVR

SEQ ID NO: 34803 - protein, 9 aa, Artificial Sequence
  Peptide Derived from Human Papillomavirus
LGTSEGVRR

SEQ ID NO: 34804 - protein, 10 aa, Artificial Sequence
  Peptide Derived from Human Papillomavirus
LGTSEGVRRA

SEQ ID NO: 34805 - protein, 11 aa, Artificial Sequence
  Peptide Derived from Human Papillomavirus
LMYKAREMGIH

SEQ ID NO: 34806 - protein, 8 aa, Artificial Sequence
  Peptide Derived from Human Papillomavirus
LSKYKQLY

SEQ ID NO: 34807 - protein, 11 aa, Artificial Sequence
  Peptide Derived from Human Papillomavirus
LSQRLNVCQDK

SEQ ID NO: 34808 - protein, 8 aa, Artificial Sequence
  Peptide Derived from Human Papillomavirus
LSVSKAKA

SEQ ID NO: 34809 - protein, 11 aa, Artificial Sequence
  Peptide Derived from Human Papillomavirus
LSVSKAKALQA

SEQ ID NO: 34810 - protein, 9 aa, Artificial Sequence
  Peptide Derived from Human Papillomavirus
LTAPTGCLK

SEQ ID NO: 34811 - protein, 10 aa, Artificial Sequence
  Peptide Derived from Human Papillomavirus
LTAPTGCLKK

SEQ ID NO: 34812 - protein, 11 aa, Artificial Sequence
  Peptide Derived from Human Papillomavirus
LTAPTGCLKKH

SEQ ID NO: 34813 - protein, 9 aa, Artificial Sequence
  Peptide Derived from Human Papillomavirus
LTYISTSQR

SEQ ID NO: 34814 - protein, 8 aa, Artificial Sequence
  Peptide Derived from Human Papillomavirus
MGIHSINH

SEQ ID NO: 34815 - protein, 10 aa, Artificial Sequence
  Peptide Derived from Human Papillomavirus
MLETLNNTEY

SEQ ID NO: 34816 - protein, 11 aa, Artificial Sequence
  Peptide Derived from Human Papillomavirus
MLETLNNTEYK

SEQ ID NO: 34817 - protein, 11 aa, Artificial Sequence
  Peptide Derived from Human Papillomavirus
MMLETLNNTEY

SEQ ID NO: 34818 - protein, 8 aa, Artificial Sequence
  Peptide Derived from Human Papillomavirus
NAIVTLTY

SEQ ID NO: 34819 - protein, 8 aa, Artificial Sequence
  Peptide Derived from Human Papillomavirus
NCGVISAA

SEQ ID NO: 34820 - protein, 9 aa, Artificial Sequence
  Peptide Derived from Human Papillomavirus
NCGVISAAA

SEQ ID NO: 34821 - protein, 9 aa, Artificial Sequence
  Peptide Derived from Human Papillomavirus
NCKGIYYVH

SEQ ID NO: 34822 - protein, 9 aa, Artificial Sequence
  Peptide Derived from Human Papillomavirus
NDSKRLCDH

SEQ ID NO: 34823 - protein, 8 aa, Artificial Sequence
  Peptide Derived from Human Papillomavirus
NFTEEAKK

SEQ ID NO: 34824 - protein, 9 aa, Artificial Sequence
  Peptide Derived from Human Papillomavirus
NFTEEAKKY

SEQ ID NO: 34825 - protein, 8 aa, Artificial Sequence
  Peptide Derived from Human Papillomavirus
NILKCLRY

SEQ ID NO: 34826 - protein, 9 aa, Artificial Sequence
  Peptide Derived from Human Papillomavirus
NILKCLRYR

SEQ ID NO: 34827 - protein, 10 aa, Artificial Sequence
  Peptide Derived from Human Papillomavirus
NTHHPNKLLR

SEQ ID NO: 34828 - protein, 9 aa, Artificial Sequence
  Peptide Derived from Human Papillomavirus
NTMHYTNWK

SEQ ID NO: 34829 - protein, 10 aa, Artificial Sequence
  Peptide Derived from Human Papillomavirus
NTMHYTNWKF

SEQ ID NO: 34830 - protein, 8 aa, Artificial Sequence
  Peptide Derived from Human Papillomavirus
NTTTSNSK

SEQ ID NO: 34831 - protein, 11 aa, Artificial Sequence
  Peptide Derived from Human Papillomavirus
NTTTSNSKTCA

SEQ ID NO: 34832 - protein, 9 aa, Artificial Sequence
  Peptide Derived from Human Papillomavirus
NTVSVSTGY

SEQ ID NO: 34833 - protein, 10 aa, Artificial Sequence
  Peptide Derived from Human Papillomavirus
NVCQDKILEH

SEQ ID NO: 34834 - protein, 11 aa, Artificial Sequence
  Peptide Derived from Human Papillomavirus
NVCQDKILEHY

SEQ ID NO: 34835 - protein, 8 aa, Artificial Sequence
  Peptide Derived from Human Papillomavirus
PALSVSKA

SEQ ID NO: 34836 - protein, 9 aa, Artificial Sequence
  Peptide Derived from Human Papillomavirus
PALSVSKAK

SEQ ID NO: 34837 - protein, 10 aa, Artificial Sequence
  Peptide Derived from Human Papillomavirus
PALSVSKAKA

SEQ ID NO: 34838 - protein, 8 aa, Artificial Sequence
  Peptide Derived from Human Papillomavirus
PATTPIIH

SEQ ID NO: 34839 - protein, 10 aa, Artificial Sequence
  Peptide Derived from Human Papillomavirus
PATTPIIHLK

SEQ ID NO: 34840 - protein, 9 aa, Artificial Sequence
  Peptide Derived from Human Papillomavirus
PIIHLKGDA

SEQ ID NO: 34841 - protein, 8 aa, Artificial Sequence
  Peptide Derived from Human Papillomavirus
PTGCLKKH

SEQ ID NO: 34842 - protein, 10 aa, Artificial Sequence
  Peptide Derived from Human Papillomavirus
PTGCLKKHGY

SEQ ID NO: 34843 - protein, 8 aa, Artificial Sequence
  Peptide Derived from Human Papillomavirus
QDKILEHY

SEQ ID NO: 34844 - protein, 11 aa, Artificial Sequence
  Peptide Derived from Human Papillomavirus
QFDGDVHNTMH

SEQ ID NO: 34845 - protein, 11 aa, Artificial Sequence
  Peptide Derived from Human Papillomavirus
QLYEQVSSTWH

SEQ ID NO: 34846 - protein, 9 aa, Artificial Sequence
  Peptide Derived from Human Papillomavirus
QTRAVSCPA

SEQ ID NO: 34847 - protein, 10 aa, Artificial Sequence
  Peptide Derived from Human Papillomavirus
QTSLELYLTA

SEQ ID NO: 34848 - protein, 10 aa, Artificial Sequence
  Peptide Derived from Human Papillomavirus
QVIVFPESVF

SEQ ID NO: 34849 - protein, 8 aa, Artificial Sequence
  Peptide Derived from Human Papillomavirus
QVNCKGIY

SEQ ID NO: 34850 - protein, 9 aa, Artificial Sequence
  Peptide Derived from Human Papillomavirus
QVNCKGIYY

SEQ ID NO: 34851 - protein, 11 aa, Artificial Sequence
  Peptide Derived from Human Papillomavirus
QVNCKGIYYVH

SEQ ID NO: 34852 - protein, 10 aa, Artificial Sequence
  Peptide Derived from Human Papillomavirus
QVVPALSVSK

SEQ ID NO: 34853 - protein, 11 aa, Artificial Sequence
  Peptide Derived from Human Papillomavirus
QVVPALSVSKA

SEQ ID NO: 34854 - protein, 8 aa, Artificial Sequence
  Peptide Derived from Human Papillomavirus
RATTSTKR

SEQ ID NO: 34855 - protein, 10 aa, Artificial Sequence
  Peptide Derived from Human Papillomavirus
RATTSTKRPR

SEQ ID NO: 34856 - protein, 9 aa, Artificial Sequence
  Peptide Derived from Human Papillomavirus
RDDFLNTVK

SEQ ID NO: 34857 - protein, 8 aa, Artificial Sequence
  Peptide Derived from Human Papillomavirus
RLCDHIDY

SEQ ID NO: 34858 - protein, 10 aa, Artificial Sequence
  Peptide Derived from Human Papillomavirus
RLCDHIDYWK

SEQ ID NO: 34859 - protein, 11 aa, Artificial Sequence
  Peptide Derived from Human Papillomavirus
RLCDHIDYWKH

SEQ ID NO: 34860 - protein, 8 aa, Artificial Sequence
  Peptide Derived from Human Papillomavirus
RLECVLMY

SEQ ID NO: 34861 - protein, 9 aa, Artificial Sequence
  Peptide Derived from Human Papillomavirus
RLECVLMYK

SEQ ID NO: 34862 - protein, 10 aa, Artificial Sequence
  Peptide Derived from Human Papillomavirus
RLECVLMYKA

SEQ ID NO: 34863 - protein, 11 aa, Artificial Sequence
  Peptide Derived from Human Papillomavirus
RLECVLMYKAR

SEQ ID NO: 34864 - protein, 8 aa, Artificial Sequence
  Peptide Derived from Human Papillomavirus
RLNVCQDK

SEQ ID NO: 34865 - protein, 9 aa, Artificial Sequence
  Peptide Derived from Human Papillomavirus
RLSKYKQLY

SEQ ID NO: 34866 - protein, 10 aa, Artificial Sequence
  Peptide Derived from Human Papillomavirus
RTEPEHRNTH

SEQ ID NO: 34867 - protein, 11 aa, Artificial Sequence
  Peptide Derived from Human Papillomavirus
RTEPEHRNTHH

SEQ ID NO: 34868 - protein, 10 aa, Artificial Sequence
  Peptide Derived from Human Papillomavirus
SAAACTNQTR

SEQ ID NO: 34869 - protein, 11 aa, Artificial Sequence
  Peptide Derived from Human Papillomavirus
SAAACTNQTRA

SEQ ID NO: 34870 - protein, 10 aa, Artificial Sequence
  Peptide Derived from Human Papillomavirus
SCPATTPIIH

SEQ ID NO: 34871 - protein, 8 aa, Artificial Sequence
  Peptide Derived from Human Papillomavirus
SFAGIVTK

SEQ ID NO: 34872 - protein, 9 aa, Artificial Sequence
  Peptide Derived from Human Papillomavirus
SINHQVVPA

SEQ ID NO: 34873 - protein, 8 aa, Artificial Sequence
  Peptide Derived from Human Papillomavirus
SLELYLTA

SEQ ID NO: 34874 - protein, 8 aa, Artificial Sequence
  Peptide Derived from Human Papillomavirus
SSDEISFA

SEQ ID NO: 34875 - protein, 11 aa, Artificial Sequence
  Peptide Derived from Human Papillomavirus
STKRPRTEPEH

SEQ ID NO: 34876 - protein, 8 aa, Artificial Sequence
  Peptide Derived from Human Papillomavirus
STSQRDDF

SEQ ID NO: 34877 - protein, 11 aa, Artificial Sequence
  Peptide Derived from Human Papillomavirus
STWHWTCTDGK

SEQ ID NO: 34878 - protein, 10 aa, Artificial Sequence
  Peptide Derived from Human Papillomavirus
SVFSSDEISF

SEQ ID NO: 34879 - protein, 11 aa, Artificial Sequence
  Peptide Derived from Human Papillomavirus
SVFSSDEISFA

SEQ ID NO: 34880 - protein, 9 aa, Artificial Sequence
  Peptide Derived from Human Papillomavirus
SVNCGVISA

SEQ ID NO: 34881 - protein, 10 aa, Artificial Sequence
  Peptide Derived from Human Papillomavirus
SVNCGVISAA

SEQ ID NO: 34882 - protein, 11 aa, Artificial Sequence
  Peptide Derived from Human Papillomavirus
SVNCGVISAAA

SEQ ID NO: 34883 - protein, 10 aa, Artificial Sequence
  Peptide Derived from Human Papillomavirus
SVSKAKALQA

SEQ ID NO: 34884 - protein, 11 aa, Artificial Sequence
  Peptide Derived from Human Papillomavirus
TANNTTTSNSK

SEQ ID NO: 34885 - protein, 8 aa, Artificial Sequence
  Peptide Derived from Human Papillomavirus
TAPTGCLK

SEQ ID NO: 34886 - protein, 9 aa, Artificial Sequence
  Peptide Derived from Human Papillomavirus
TAPTGCLKK

SEQ ID NO: 34887 - protein, 10 aa, Artificial Sequence
  Peptide Derived from Human Papillomavirus
TAPTGCLKKH

SEQ ID NO: 34888 - protein, 11 aa, Artificial Sequence
  Peptide Derived from Human Papillomavirus
TCALGTSEGVR

SEQ ID NO: 34889 - protein, 8 aa, Artificial Sequence
  Peptide Derived from Human Papillomavirus
TCTDGKHK

SEQ ID NO: 34890 - protein, 10 aa, Artificial Sequence
  Peptide Derived from Human Papillomavirus
TCTDGKHKNA

SEQ ID NO: 34891 - protein, 8 aa, Artificial Sequence
  Peptide Derived from Human Papillomavirus
TDGKHKNA

SEQ ID NO: 34892 - protein, 9 aa, Artificial Sequence
  Peptide Derived from Human Papillomavirus
TGCLKKHGY

SEQ ID NO: 34893 - protein, 8 aa, Artificial Sequence
  Peptide Derived from Human Papillomavirus
TGKKWEVH

SEQ ID NO: 34894 - protein, 9 aa, Artificial Sequence
  Peptide Derived from Human Papillomavirus
TGKKWEVHA

SEQ ID NO: 34895 - protein, 8 aa, Artificial Sequence
  Peptide Derived from Human Papillomavirus
TLNNTEYK

SEQ ID NO: 34896 - protein, 10 aa, Artificial Sequence
  Peptide Derived from Human Papillomavirus
TLTYISTSQR

SEQ ID NO: 34897 - protein, 8 aa, Artificial Sequence
  Peptide Derived from Human Papillomavirus
TMHYTNWK

SEQ ID NO: 34898 - protein, 9 aa, Artificial Sequence
  Peptide Derived from Human Papillomavirus
TMHYTNWKF

SEQ ID NO: 34899 - protein, 11 aa, Artificial Sequence
  Peptide Derived from Human Papillomavirus
TMHYTNWKFIY

SEQ ID NO: 34900 - protein, 10 aa, Artificial Sequence
  Peptide Derived from Human Papillomavirus
TMQQTSLELY

SEQ ID NO: 34901 - protein, 8 aa, Artificial Sequence
  Peptide Derived from Human Papillomavirus
TSEGVRRA

SEQ ID NO: 34902 - protein, 9 aa, Artificial Sequence
  Peptide Derived from Human Papillomavirus
TSLELYLTA

SEQ ID NO: 34903 - protein, 8 aa, Artificial Sequence
  Peptide Derived from Human Papillomavirus
TSNSKTCA

SEQ ID NO: 34904 - protein, 8 aa, Artificial Sequence
  Peptide Derived from Human Papillomavirus
TTPIIHLK

SEQ ID NO: 34905 - protein, 11 aa, Artificial Sequence
  Peptide Derived from Human Papillomavirus
TTPIIHLKGDA

SEQ ID NO: 34906 - protein, 9 aa, Artificial Sequence
  Peptide Derived from Human Papillomavirus
TTSNSKTCA

SEQ ID NO: 34907 - protein, 8 aa, Artificial Sequence
  Peptide Derived from Human Papillomavirus
TTSTKRPR

SEQ ID NO: 34908 - protein, 10 aa, Artificial Sequence
  Peptide Derived from Human Papillomavirus
TTTSNSKTCA

SEQ ID NO: 34909 - protein, 11 aa, Artificial Sequence
  Peptide Derived from Human Papillomavirus
TVEVQFDGDVH

SEQ ID NO: 34910 - protein, 8 aa, Artificial Sequence
  Peptide Derived from Human Papillomavirus
TVSVSTGY

SEQ ID NO: 34911 - protein, 10 aa, Artificial Sequence
  Peptide Derived from Human Papillomavirus
TVVEGQVNCK

SEQ ID NO: 34912 - protein, 9 aa, Artificial Sequence
  Peptide Derived from Human Papillomavirus
VCQDKILEH

SEQ ID NO: 34913 - protein, 10 aa, Artificial Sequence
  Peptide Derived from Human Papillomavirus
VCQDKILEHY

SEQ ID NO: 34914 - protein, 11 aa, Artificial Sequence
  Peptide Derived from Human Papillomavirus
VDSVNCGVISA

SEQ ID NO: 34915 - protein, 9 aa, Artificial Sequence
  Peptide Derived from Human Papillomavirus
VFSSDEISF

SEQ ID NO: 34916 - protein, 10 aa, Artificial Sequence
  Peptide Derived from Human Papillomavirus
VFSSDEISFA

SEQ ID NO: 34917 - protein, 9 aa, Artificial Sequence
  Peptide Derived from Human Papillomavirus
VIVFPESVF

SEQ ID NO: 34918 - protein, 11 aa, Artificial Sequence
  Peptide Derived from Human Papillomavirus
VSCPATTPIIH

SEQ ID NO: 34919 - protein, 9 aa, Artificial Sequence
  Peptide Derived from Human Papillomavirus
VSKAKALQA

SEQ ID NO: 34920 - protein, 11 aa, Artificial Sequence
  Peptide Derived from Human Papillomavirus
VTLTYISTSQR

SEQ ID NO: 34921 - protein, 9 aa, Artificial Sequence
  Peptide Derived from Human Papillomavirus
VVEGQVNCK

SEQ ID NO: 34922 - protein, 9 aa, Artificial Sequence
  Peptide Derived from Human Papillomavirus
VVPALSVSK

SEQ ID NO: 34923 - protein, 10 aa, Artificial Sequence
  Peptide Derived from Human Papillomavirus
VVPALSVSKA

SEQ ID NO: 34924 - protein, 11 aa, Artificial Sequence
  Peptide Derived from Human Papillomavirus
VVPALSVSKAK

SEQ ID NO: 34925 - protein, 8 aa, Artificial Sequence
  Peptide Derived from Human Papillomavirus
WTCTDGKH

SEQ ID NO: 34926 - protein, 9 aa, Artificial Sequence
  Peptide Derived from Human Papillomavirus
WTCTDGKHK

SEQ ID NO: 34927 - protein, 11 aa, Artificial Sequence
  Peptide Derived from Human Papillomavirus
WTCTDGKHKNA

SEQ ID NO: 34928 - protein, 11 aa, Artificial Sequence
  Peptide Derived from Human Papillomavirus
WTMQQTSLELY

SEQ ID NO: 34929 - protein, 9 aa, Artificial Sequence
  Peptide Derived from Human Papillomavirus
YFVNFTEEA

SEQ ID NO: 34930 - protein, 10 aa, Artificial Sequence
  Peptide Derived from Human Papillomavirus
YFVNFTEEAK

SEQ ID NO: 34931 - protein, 11 aa, Artificial Sequence
  Peptide Derived from Human Papillomavirus
YFVNFTEEAKK

SEQ ID NO: 34932 - protein, 10 aa, Artificial Sequence
  Peptide Derived from Human Papillomavirus
YGTGKKWEVH

SEQ ID NO: 34933 - protein, 11 aa, Artificial Sequence
  Peptide Derived from Human Papillomavirus
YGTGKKWEVHA

SEQ ID NO: 34934 - protein, 10 aa, Artificial Sequence
  Peptide Derived from Human Papillomavirus
YISTSQRDDF

SEQ ID NO: 34935 - protein, 10 aa, Artificial Sequence
  Peptide Derived from Human Papillomavirus
YLTAPTGCLK

SEQ ID NO: 34936 - protein, 11 aa, Artificial Sequence
  Peptide Derived from Human Papillomavirus
YLTAPTGCLKK

SEQ ID NO: 34937 - protein, 8 aa, Artificial Sequence
  Peptide Derived from Human Papillomavirus
YTNWKFIY

SEQ ID NO: 34938 - protein, 9 aa, Artificial Sequence
  Peptide Derived from Human Papillomavirus
YVHEGHITY

SEQ ID NO: 34939 - protein, 10 aa, Artificial Sequence
  Peptide Derived from Human Papillomavirus
YVHEGHITYF

SEQ ID NO: 34940 - protein, 8 aa, Artificial Sequence
  Peptide Derived from Human Papillomavirus
ATSPLRCF

SEQ ID NO: 34941 - protein, 11 aa, Artificial Sequence
  Peptide Derived from Human Papillomavirus
ATSPLRCFCIY

SEQ ID NO: 34942 - protein, 8 aa, Artificial Sequence
  Peptide Derived from Human Papillomavirus
CFCIYVVF

SEQ ID NO: 34943 - protein, 10 aa, Artificial Sequence
  Peptide Derived from Human Papillomavirus
CFCIYVVFIY

SEQ ID NO: 34944 - protein, 11 aa, Artificial Sequence
  Peptide Derived from Human Papillomavirus
CFLLCFCVLLF

SEQ ID NO: 34945 - protein, 8 aa, Artificial Sequence
  Peptide Derived from Human Papillomavirus
CIYVVFIY

SEQ ID NO: 34946 - protein, 11 aa, Artificial Sequence
  Peptide Derived from Human Papillomavirus
CVLLFVCLVIR

SEQ ID NO: 34947 - protein, 9 aa, Artificial Sequence
  Peptide Derived from Human Papillomavirus
FCIYVVFIY

SEQ ID NO: 34948 - protein, 10 aa, Artificial Sequence
  Peptide Derived from Human Papillomavirus
FIYIPLFVIH

SEQ ID NO: 34949 - protein, 10 aa, Artificial Sequence
  Peptide Derived from Human Papillomavirus
FLLCFCVLLF

SEQ ID NO: 34950 - protein, 9 aa, Artificial Sequence
  Peptide Derived from Human Papillomavirus
FVIHTHASF

SEQ ID NO: 34951 - protein, 9 aa, Artificial Sequence
  Peptide Derived from Human Papillomavirus
IATSPLRCF

SEQ ID NO: 34952 - protein, 11 aa, Artificial Sequence
  Peptide Derived from Human Papillomavirus
ILWVIATSPLR

SEQ ID NO: 34953 - protein, 10 aa, Artificial Sequence
  Peptide Derived from Human Papillomavirus
ISTVSIVLCF

SEQ ID NO: 34954 - protein, 8 aa, Artificial Sequence
  Peptide Derived from Human Papillomavirus
IVILWVIA

SEQ ID NO: 34955 - protein, 9 aa, Artificial Sequence
  Peptide Derived from Human Papillomavirus
IVLCFLLCF

SEQ ID NO: 34956 - protein, 8 aa, Artificial Sequence
  Peptide Derived from Human Papillomavirus
LCFCVLLF

SEQ ID NO: 34957 - protein, 8 aa, Artificial Sequence
  Peptide Derived from Human Papillomavirus
LFVCLVIR

SEQ ID NO: 34958 - protein, 8 aa, Artificial Sequence
  Peptide Derived from Human Papillomavirus
LFVIHTHA

SEQ ID NO: 34959 - protein, 10 aa, Artificial Sequence
  Peptide Derived from Human Papillomavirus
LFVIHTHASF

SEQ ID NO: 34960 - protein, 9 aa, Artificial Sequence
  Peptide Derived from Human Papillomavirus
LIVILWVIA

SEQ ID NO: 34961 - protein, 9 aa, Artificial Sequence
  Peptide Derived from Human Papillomavirus
LLCFCVLLF

SEQ ID NO: 34962 - protein, 9 aa, Artificial Sequence
  Peptide Derived from Human Papillomavirus
LLFVCLVIR

SEQ ID NO: 34963 - protein, 10 aa, Artificial Sequence
  Peptide Derived from Human Papillomavirus
LLIVILWVIA

SEQ ID NO: 34964 - protein, 11 aa, Artificial Sequence
  Peptide Derived from Human Papillomavirus
LLLIVILWVIA

SEQ ID NO: 34965 - protein, 8 aa, Artificial Sequence
  Peptide Derived from Human Papillomavirus
LVLSVSVY

SEQ ID NO: 34966 - protein, 9 aa, Artificial Sequence
  Peptide Derived from Human Papillomavirus
LVLSVSVYA

SEQ ID NO: 34967 - protein, 11 aa, Artificial Sequence
  Peptide Derived from Human Papillomavirus
NISTVSIVLCF

SEQ ID NO: 34968 - protein, 8 aa, Artificial Sequence
  Peptide Derived from Human Papillomavirus
PLFVIHTH

SEQ ID NO: 34969 - protein, 9 aa, Artificial Sequence
  Peptide Derived from Human Papillomavirus
PLFVIHTHA

SEQ ID NO: 34970 - protein, 11 aa, Artificial Sequence
  Peptide Derived from Human Papillomavirus
PLFVIHTHASF

SEQ ID NO: 34971 - protein, 8 aa, Artificial Sequence
  Peptide Derived from Human Papillomavirus
PLRCFCIY

SEQ ID NO: 34972 - protein, 11 aa, Artificial Sequence
  Peptide Derived from Human Papillomavirus
PLRCFCIYVVF

SEQ ID NO: 34973 - protein, 9 aa, Artificial Sequence
  Peptide Derived from Human Papillomavirus
PLVLSVSVY

SEQ ID NO: 34974 - protein, 10 aa, Artificial Sequence
  Peptide Derived from Human Papillomavirus
PLVLSVSVYA

SEQ ID NO: 34975 - protein, 9 aa, Artificial Sequence
  Peptide Derived from Human Papillomavirus
RCFCIYVVF

SEQ ID NO: 34976 - protein, 11 aa, Artificial Sequence
  Peptide Derived from Human Papillomavirus
RCFCIYVVFIY

SEQ ID NO: 34977 - protein, 10 aa, Artificial Sequence
  Peptide Derived from Human Papillomavirus
SIVLCFLLCF

SEQ ID NO: 34978 - protein, 9 aa, Artificial Sequence
  Peptide Derived from Human Papillomavirus
STVSIVLCF

SEQ ID NO: 34979 - protein, 10 aa, Artificial Sequence
  Peptide Derived from Human Papillomavirus
TSPLRCFCIY

SEQ ID NO: 34980 - protein, 8 aa, Artificial Sequence
  Peptide Derived from Human Papillomavirus
TVSIVLCF

SEQ ID NO: 34981 - protein, 8 aa, Artificial Sequence
  Peptide Derived from Human Papillomavirus
VFIYIPLF

SEQ ID NO: 34982 - protein, 11 aa, Artificial Sequence
  Peptide Derived from Human Papillomavirus
VFIYIPLFVIH

SEQ ID NO: 34983 - protein, 8 aa, Artificial Sequence
  Peptide Derived from Human Papillomavirus
VIATSPLR

SEQ ID NO: 34984 - protein, 10 aa, Artificial Sequence
  Peptide Derived from Human Papillomavirus
VIATSPLRCF

SEQ ID NO: 34985 - protein, 8 aa, Artificial Sequence
  Peptide Derived from Human Papillomavirus
VIHTHASF

SEQ ID NO: 34986 - protein, 8 aa, Artificial Sequence
  Peptide Derived from Human Papillomavirus
VLCFLLCF

SEQ ID NO: 34987 - protein, 10 aa, Artificial Sequence
  Peptide Derived from Human Papillomavirus
VLLFVCLVIR

SEQ ID NO: 34988 - protein, 8 aa, Artificial Sequence
  Peptide Derived from Human Papillomavirus
VLSVSVYA

SEQ ID NO: 34989 - protein, 11 aa, Artificial Sequence
  Peptide Derived from Human Papillomavirus
VSIVLCFLLCF

SEQ ID NO: 34990 - protein, 9 aa, Artificial Sequence
  Peptide Derived from Human Papillomavirus
VVFIYIPLF

SEQ ID NO: 34991 - protein, 9 aa, Artificial Sequence
  Peptide Derived from Human Papillomavirus
WVIATSPLR

SEQ ID NO: 34992 - protein, 11 aa, Artificial Sequence
  Peptide Derived from Human Papillomavirus
WVIATSPLRCF

SEQ ID NO: 34993 - protein, 8 aa, Artificial Sequence
  Peptide Derived from Human Papillomavirus
YIPLFVIH

SEQ ID NO: 34994 - protein, 10 aa, Artificial Sequence
  Peptide Derived from Human Papillomavirus
YIPLFVIHTH

SEQ ID NO: 34995 - protein, 11 aa, Artificial Sequence
  Peptide Derived from Human Papillomavirus
YIPLFVIHTHA

SEQ ID NO: 34996 - protein, 10 aa, Artificial Sequence
  Peptide Derived from Human Papillomavirus
YVVFIYIPLF

SEQ ID NO: 34997 - protein, 9 aa, Artificial Sequence
  Peptide Derived from Human Papillomavirus
AFTDLTIVY

SEQ ID NO: 34998 - protein, 10 aa, Artificial Sequence
  Peptide Derived from Human Papillomavirus
AFTDLTIVYR

SEQ ID NO: 34999 - protein, 10 aa, Artificial Sequence
  Peptide Derived from Human Papillomavirus
ALEIPYDELR

SEQ ID NO: 35000 - protein, 9 aa, Artificial Sequence
  Peptide Derived from Human Papillomavirus
CIACWRRPR

SEQ ID NO: 35001 - protein, 11 aa, Artificial Sequence
  Peptide Derived from Human Papillomavirus
CLRFYSKVSEF

SEQ ID NO: 35002 - protein, 8 aa, Artificial Sequence
  Peptide Derived from Human Papillomavirus
CTKCLRFY

SEQ ID NO: 35003 - protein, 10 aa, Artificial Sequence
  Peptide Derived from Human Papillomavirus
CTKCLRFYSK

SEQ ID NO: 35004 - protein, 10 aa, Artificial Sequence
  Peptide Derived from Human Papillomavirus
DDTPHGVCTK

SEQ ID NO: 35005 - protein, 11 aa, Artificial Sequence
  Peptide Derived from Human Papillomavirus
DFAFTDLTIVY

SEQ ID NO: 35006 - protein, 11 aa, Artificial Sequence
  Peptide Derived from Human Papillomavirus
DLLIRCITCQR

SEQ ID NO: 35007 - protein, 9 aa, Artificial Sequence
  Peptide Derived from Human Papillomavirus
DTPHGVCTK

SEQ ID NO: 35008 - protein, 10 aa, Artificial Sequence
  Peptide Derived from Human Papillomavirus
EFRWYRYSVY

SEQ ID NO: 35009 - protein, 8 aa, Artificial Sequence
  Peptide Derived from Human Papillomavirus
EIPYDELR

SEQ ID NO: 35010 - protein, 8 aa, Artificial Sequence
  Peptide Derived from Human Papillomavirus
ELRLNCVY

SEQ ID NO: 35011 - protein, 10 aa, Artificial Sequence
  Peptide Derived from Human Papillomavirus
ELRLNCVYCK

SEQ ID NO: 35012 - protein, 10 aa, Artificial Sequence
  Peptide Derived from Human Papillomavirus
ELSSALEIPY

SEQ ID NO: 35013 - protein, 8 aa, Artificial Sequence
  Peptide Derived from Human Papillomavirus
ETEVLDFA

SEQ ID NO: 35014 - protein, 9 aa, Artificial Sequence
  Peptide Derived from Human Papillomavirus
ETEVLDFAF

SEQ ID NO: 35015 - protein, 10 aa, Artificial Sequence
  Peptide Derived from Human Papillomavirus
FAFTDLTIVY

SEQ ID NO: 35016 - protein, 11 aa, Artificial Sequence
  Peptide Derived from Human Papillomavirus
FAFTDLTIVYR

SEQ ID NO: 35017 - protein, 8 aa, Artificial Sequence
  Peptide Derived from Human Papillomavirus
FTDLTIVY

SEQ ID NO: 35018 - protein, 9 aa, Artificial Sequence
  Peptide Derived from Human Papillomavirus
FTDLTIVYR

SEQ ID NO: 35019 - protein, 10 aa, Artificial Sequence
  Peptide Derived from Human Papillomavirus
GGRWTGRCIA

SEQ ID NO: 35020 - protein, 8 aa, Artificial Sequence
  Peptide Derived from Human Papillomavirus
GICDLLIR

SEQ ID NO: 35021 - protein, 10 aa, Artificial Sequence
  Peptide Derived from Human Papillomavirus
GTTLEKLTNK

SEQ ID NO: 35022 - protein, 8 aa, Artificial Sequence
  Peptide Derived from Human Papillomavirus
GVCTKCLR

SEQ ID NO: 35023 - protein, 9 aa, Artificial Sequence
  Peptide Derived from Human Papillomavirus
GVCTKCLRF

SEQ ID NO: 35024 - protein, 10 aa, Artificial Sequence
  Peptide Derived from Human Papillomavirus
GVCTKCLRFY

SEQ ID NO: 35025 - protein, 9 aa, Artificial Sequence
  Peptide Derived from Human Papillomavirus
HGVCTKCLR

SEQ ID NO: 35026 - protein, 10 aa, Artificial Sequence
  Peptide Derived from Human Papillomavirus
HGVCTKCLRF

SEQ ID NO: 35027 - protein, 11 aa, Artificial Sequence
  Peptide Derived from Human Papillomavirus
HGVCTKCLRFY

SEQ ID NO: 35028 - protein, 8 aa, Artificial Sequence
  Peptide Derived from Human Papillomavirus
HLDKKKRF

SEQ ID NO: 35029 - protein, 9 aa, Artificial Sequence
  Peptide Derived from Human Papillomavirus
HLDKKKRFH

SEQ ID NO: 35030 - protein, 8 aa, Artificial Sequence
  Peptide Derived from Human Papillomavirus
IACWRRPR

SEQ ID NO: 35031 - protein, 8 aa, Artificial Sequence
  Peptide Derived from Human Papillomavirus
IGGRWTGR

SEQ ID NO: 35032 - protein, 11 aa, Artificial Sequence
  Peptide Derived from Human Papillomavirus
IGGRWTGRCIA

SEQ ID NO: 35033 - protein, 9 aa, Artificial Sequence
  Peptide Derived from Human Papillomavirus
IVYRDDTPH

SEQ ID NO: 35034 - protein, 8 aa, Artificial Sequence
  Peptide Derived from Human Papillomavirus
KCLRFYSK

SEQ ID NO: 35035 - protein, 9 aa, Artificial Sequence
  Peptide Derived from Human Papillomavirus
KGICDLLIR

SEQ ID NO: 35036 - protein, 8 aa, Artificial Sequence
  Peptide Derived from Human Papillomavirus
KLHELSSA

SEQ ID NO: 35037 - protein, 8 aa, Artificial Sequence
  Peptide Derived from Human Papillomavirus
KVSEFRWY

SEQ ID NO: 35038 - protein, 9 aa, Artificial Sequence
  Peptide Derived from Human Papillomavirus
KVSEFRWYR

SEQ ID NO: 35039 - protein, 10 aa, Artificial Sequence
  Peptide Derived from Human Papillomavirus
KVSEFRWYRY

SEQ ID NO: 35040 - protein, 8 aa, Artificial Sequence
  Peptide Derived from Human Papillomavirus
LCPEEKQR

SEQ ID NO: 35041 - protein, 9 aa, Artificial Sequence
  Peptide Derived from Human Papillomavirus
LCPEEKQRH

SEQ ID NO: 35042 - protein, 8 aa, Artificial Sequence
  Peptide Derived from Human Papillomavirus
LDKKKRFH

SEQ ID NO: 35043 - protein, 9 aa, Artificial Sequence
  Peptide Derived from Human Papillomavirus
LIRCITCQR

SEQ ID NO: 35044 - protein, 10 aa, Artificial Sequence
  Peptide Derived from Human Papillomavirus
LLIRCITCQR

SEQ ID NO: 35045 - protein, 9 aa, Artificial Sequence
  Peptide Derived from Human Papillomavirus
LSSALEIPY

SEQ ID NO: 35046 - protein, 9 aa, Artificial Sequence
  Peptide Derived from Human Papillomavirus
LTETEVLDF

SEQ ID NO: 35047 - protein, 10 aa, Artificial Sequence
  Peptide Derived from Human Papillomavirus
LTETEVLDFA

SEQ ID NO: 35048 - protein, 11 aa, Artificial Sequence
  Peptide Derived from Human Papillomavirus
LTETEVLDFAF

SEQ ID NO: 35049 - protein, 11 aa, Artificial Sequence
  Peptide Derived from Human Papillomavirus
LTIVYRDDTPH

SEQ ID NO: 35050 - protein, 8 aa, Artificial Sequence
  Peptide Derived from Human Papillomavirus
MFKNPAER

SEQ ID NO: 35051 - protein, 10 aa, Artificial Sequence
  Peptide Derived from Human Papillomavirus
MFKNPAERPR

SEQ ID NO: 35052 - protein, 11 aa, Artificial Sequence
  Peptide Derived from Human Papillomavirus
MFKNPAERPRK

SEQ ID NO: 35053 - protein, 9 aa, Artificial Sequence
  Peptide Derived from Human Papillomavirus
NIGGRWTGR

SEQ ID NO: 35054 - protein, 9 aa, Artificial Sequence
  Peptide Derived from Human Papillomavirus
PAERPRKLH

SEQ ID NO: 35055 - protein, 9 aa, Artificial Sequence
  Peptide Derived from Human Papillomavirus
PLCPEEKQR

SEQ ID NO: 35056 - protein, 10 aa, Artificial Sequence
  Peptide Derived from Human Papillomavirus
PLCPEEKQRH

SEQ ID NO: 35057 - protein, 10 aa, Artificial Sequence
  Peptide Derived from Human Papillomavirus
QLTETEVLDF

SEQ ID NO: 35058 - protein, 11 aa, Artificial Sequence
  Peptide Derived from Human Papillomavirus
QLTETEVLDFA

SEQ ID NO: 35059 - protein, 8 aa, Artificial Sequence
  Peptide Derived from Human Papillomavirus
RCIACWRR

SEQ ID NO: 35060 - protein, 10 aa, Artificial Sequence
  Peptide Derived from Human Papillomavirus
RCIACWRRPR

SEQ ID NO: 35061 - protein, 11 aa, Artificial Sequence
  Peptide Derived from Human Papillomavirus
RDDTPHGVCTK

SEQ ID NO: 35062 - protein, 8 aa, Artificial Sequence
  Peptide Derived from Human Papillomavirus
RFHNIGGR

SEQ ID NO: 35063 - protein, 9 aa, Artificial Sequence
  Peptide Derived from Human Papillomavirus
RFYSKVSEF

SEQ ID NO: 35064 - protein, 10 aa, Artificial Sequence
  Peptide Derived from Human Papillomavirus
RFYSKVSEFR

SEQ ID NO: 35065 - protein, 8 aa, Artificial Sequence
  Peptide Derived from Human Papillomavirus
RLNCVYCK

SEQ ID NO: 35066 - protein, 11 aa, Artificial Sequence
  Peptide Derived from Human Papillomavirus
SALEIPYDELR

SEQ ID NO: 35067 - protein, 8 aa, Artificial Sequence
  Peptide Derived from Human Papillomavirus
SSALEIPY

SEQ ID NO: 35068 - protein, 9 aa, Artificial Sequence
  Peptide Derived from Human Papillomavirus
SVYGTTLEK

SEQ ID NO: 35069 - protein, 11 aa, Artificial Sequence
  Peptide Derived from Human Papillomavirus
TCQRPLCPEEK

SEQ ID NO: 35070 - protein, 8 aa, Artificial Sequence
  Peptide Derived from Human Papillomavirus
TDLTIVYR

SEQ ID NO: 35071 - protein, 9 aa, Artificial Sequence
  Peptide Derived from Human Papillomavirus
TGRCIACWR

SEQ ID NO: 35072 - protein, 10 aa, Artificial Sequence
  Peptide Derived from Human Papillomavirus
TGRCIACWRR

SEQ ID NO: 35073 - protein, 10 aa, Artificial Sequence
  Peptide Derived from Human Papillomavirus
TIVYRDDTPH

SEQ ID NO: 35074 - protein, 8 aa, Artificial Sequence
  Peptide Derived from Human Papillomavirus
TLEKLTNK

SEQ ID NO: 35075 - protein, 9 aa, Artificial Sequence
  Peptide Derived from Human Papillomavirus
TTLEKLTNK

SEQ ID NO: 35076 - protein, 8 aa, Artificial Sequence
  Peptide Derived from Human Papillomavirus
VCTKCLRF

SEQ ID NO: 35077 - protein, 9 aa, Artificial Sequence
  Peptide Derived from Human Papillomavirus
VCTKCLRFY

SEQ ID NO: 35078 - protein, 11 aa, Artificial Sequence
  Peptide Derived from Human Papillomavirus
VCTKCLRFYSK

SEQ ID NO: 35079 - protein, 8 aa, Artificial Sequence
  Peptide Derived from Human Papillomavirus
VSEFRWYR

SEQ ID NO: 35080 - protein, 9 aa, Artificial Sequence
  Peptide Derived from Human Papillomavirus
VSEFRWYRY

SEQ ID NO: 35081 - protein, 10 aa, Artificial Sequence
  Peptide Derived from Human Papillomavirus
WTGRCIACWR

SEQ ID NO: 35082 - protein, 11 aa, Artificial Sequence
  Peptide Derived from Human Papillomavirus
WTGRCIACWRR

SEQ ID NO: 35083 - protein, 10 aa, Artificial Sequence
  Peptide Derived from Human Papillomavirus
YDELRLNCVY

SEQ ID NO: 35084 - protein, 11 aa, Artificial Sequence
  Peptide Derived from Human Papillomavirus
YGTTLEKLTNK

SEQ ID NO: 35085 - protein, 8 aa, Artificial Sequence
  Peptide Derived from Human Papillomavirus
YSKVSEFR

SEQ ID NO: 35086 - protein, 10 aa, Artificial Sequence
  Peptide Derived from Human Papillomavirus
YSKVSEFRWY

SEQ ID NO: 35087 - protein, 11 aa, Artificial Sequence
  Peptide Derived from Human Papillomavirus
YSKVSEFRWYR

SEQ ID NO: 35088 - protein, 10 aa, Artificial Sequence
  Peptide Derived from Human Papillomavirus
YSVYGTTLEK

SEQ ID NO: 35089 - protein, 11 aa, Artificial Sequence
  Peptide Derived from Human Papillomavirus
AGQAEPDTSNY

SEQ ID NO: 35090 - protein, 9 aa, Artificial Sequence
  Peptide Derived from Human Papillomavirus
CCQCKSTLR

SEQ ID NO: 35091 - protein, 10 aa, Artificial Sequence
  Peptide Derived from Human Papillomavirus
CVQSTQVDIR

SEQ ID NO: 35092 - protein, 10 aa, Artificial Sequence
  Peptide Derived from Human Papillomavirus
DLQPEATDLH

SEQ ID NO: 35093 - protein, 10 aa, Artificial Sequence
  Peptide Derived from Human Papillomavirus
DTSNYNIVTF

SEQ ID NO: 35094 - protein, 10 aa, Artificial Sequence
  Peptide Derived from Human Papillomavirus
DVIDSPAGQA

SEQ ID NO: 35095 - protein, 8 aa, Artificial Sequence
  Peptide Derived from Human Papillomavirus
EATDLHCY

SEQ ID NO: 35096 - protein, 8 aa, Artificial Sequence
  Peptide Derived from Human Papillomavirus
EDVIDSPA

SEQ ID NO: 35097 - protein, 11 aa, Artificial Sequence
  Peptide Derived from Human Papillomavirus
EDVIDSPAGQA

SEQ ID NO: 35098 - protein, 8 aa, Artificial Sequence
  Peptide Derived from Human Papillomavirus
ETPTLQDY

SEQ ID NO: 35099 - protein, 10 aa, Artificial Sequence
  Peptide Derived from Human Papillomavirus
FCCQCKSTLR

SEQ ID NO: 35100 - protein, 11 aa, Artificial Sequence
  Peptide Derived from Human Papillomavirus
FGIVCPNCSTR

SEQ ID NO: 35101 - protein, 10 aa, Artificial Sequence
  Peptide Derived from Human Papillomavirus
GIVCPNCSTR

SEQ ID NO: 35102 - protein, 8 aa, Artificial Sequence
  Peptide Derived from Human Papillomavirus
IDSPAGQA

SEQ ID NO: 35103 - protein, 10 aa, Artificial Sequence
  Peptide Derived from Human Papillomavirus
ILQELLMGSF

SEQ ID NO: 35104 - protein, 9 aa, Artificial Sequence
  Peptide Derived from Human Papillomavirus
IVCPNCSTR

SEQ ID NO: 35105 - protein, 9 aa, Artificial Sequence
  Peptide Derived from Human Papillomavirus
IVTFCCQCK

SEQ ID NO: 35106 - protein, 11 aa, Artificial Sequence
  Peptide Derived from Human Papillomavirus
LCVQSTQVDIR

SEQ ID NO: 35107 - protein, 11 aa, Artificial Sequence
  Peptide Derived from Human Papillomavirus
LDLQPEATDLH

SEQ ID NO: 35108 - protein, 10 aa, Artificial Sequence
  Peptide Derived from Human Papillomavirus
NIVTFCCQCK

SEQ ID NO: 35109 - protein, 11 aa, Artificial Sequence
  Peptide Derived from Human Papillomavirus
PDTSNYNIVTF

SEQ ID NO: 35110 - protein, 9 aa, Artificial Sequence
  Peptide Derived from Human Papillomavirus
QAEPDTSNY

SEQ ID NO: 35111 - protein, 11 aa, Artificial Sequence
  Peptide Derived from Human Papillomavirus
QDYVLDLQPEA

SEQ ID NO: 35112 - protein, 8 aa, Artificial Sequence
  Peptide Derived from Human Papillomavirus
QSTQVDIR

SEQ ID NO: 35113 - protein, 10 aa, Artificial Sequence
  Peptide Derived from Human Papillomavirus
RGETPTLQDY

SEQ ID NO: 35114 - protein, 11 aa, Artificial Sequence
  Peptide Derived from Human Papillomavirus
RILQELLMGSF

SEQ ID NO: 35115 - protein, 11 aa, Artificial Sequence
  Peptide Derived from Human Papillomavirus
SDEEDVIDSPA

SEQ ID NO: 35116 - protein, 11 aa, Artificial Sequence
  Peptide Derived from Human Papillomavirus
TFCCQCKSTLR

SEQ ID NO: 35117 - protein, 9 aa, Artificial Sequence
  Peptide Derived from Human Papillomavirus
TSNYNIVTF

SEQ ID NO: 35118 - protein, 8 aa, Artificial Sequence
  Peptide Derived from Human Papillomavirus
VCPNCSTR

SEQ ID NO: 35119 - protein, 9 aa, Artificial Sequence
  Peptide Derived from Human Papillomavirus
VIDSPAGQA

SEQ ID NO: 35120 - protein, 8 aa, Artificial Sequence
  Peptide Derived from Human Papillomavirus
VLDLQPEA

SEQ ID NO: 35121 - protein, 8 aa, Artificial Sequence
  Peptide Derived from Human Papillomavirus
VTFCCQCK

SEQ ID NO: 35122 - protein, 9 aa, Artificial Sequence
  Peptide Derived from Human Papillomavirus
YVLDLQPEA

SEQ ID NO: 35123 - protein, 10 aa, Artificial Sequence
  Peptide Derived from Human Papillomavirus
AAIANSDTTF

SEQ ID NO: 35124 - protein, 11 aa, Artificial Sequence
  Peptide Derived from Human Papillomavirus
AAIANSDTTFK

SEQ ID NO: 35125 - protein, 9 aa, Artificial Sequence
  Peptide Derived from Human Papillomavirus
ACVGLEVGR

SEQ ID NO: 35126 - protein, 8 aa, Artificial Sequence
  Peptide Derived from Human Papillomavirus
ADIMTYIH

SEQ ID NO: 35127 - protein, 10 aa, Artificial Sequence
  Peptide Derived from Human Papillomavirus
ADLDQFPLGR

SEQ ID NO: 35128 - protein, 11 aa, Artificial Sequence
  Peptide Derived from Human Papillomavirus
ADLDQFPLGRK

SEQ ID NO: 35129 - protein, 9 aa, Artificial Sequence
  Peptide Derived from Human Papillomavirus
AGGPGTDNR

SEQ ID NO: 35130 - protein, 9 aa, Artificial Sequence
  Peptide Derived from Human Papillomavirus
AGKRSAPSA

SEQ ID NO: 35131 - protein, 11 aa, Artificial Sequence
  Peptide Derived from Human Papillomavirus
AGSARLLTVGH

SEQ ID NO: 35132 - protein, 8 aa, Artificial Sequence
  Peptide Derived from Human Papillomavirus
AGYRARPK

SEQ ID NO: 35133 - protein, 9 aa, Artificial Sequence
  Peptide Derived from Human Papillomavirus
AGYRARPKF

SEQ ID NO: 35134 - protein, 10 aa, Artificial Sequence
  Peptide Derived from Human Papillomavirus
AGYRARPKFK

SEQ ID NO: 35135 - protein, 11 aa, Artificial Sequence
  Peptide Derived from Human Papillomavirus
AGYRARPKFKA

SEQ ID NO: 35136 - protein, 9 aa, Artificial Sequence
  Peptide Derived from Human Papillomavirus
AIANSDTTF

SEQ ID NO: 35137 - protein, 10 aa, Artificial Sequence
  Peptide Derived from Human Papillomavirus
AIANSDTTFK

SEQ ID NO: 35138 - protein, 8 aa, Artificial Sequence
  Peptide Derived from Human Papillomavirus
AILEDWNF

SEQ ID NO: 35139 - protein, 8 aa, Artificial Sequence
  Peptide Derived from Human Papillomavirus
AITCQKTA

SEQ ID NO: 35140 - protein, 11 aa, Artificial Sequence
  Peptide Derived from Human Papillomavirus
AITCQKTAPQK

SEQ ID NO: 35141 - protein, 11 aa, Artificial Sequence
  Peptide Derived from Human Papillomavirus
AMDFTALQDTK

SEQ ID NO: 35142 - protein, 8 aa, Artificial Sequence
  Peptide Derived from Human Papillomavirus
ASTTTPAK

SEQ ID NO: 35143 - protein, 9 aa, Artificial Sequence
  Peptide Derived from Human Papillomavirus
ASTTTPAKR

SEQ ID NO: 35144 - protein, 10 aa, Artificial Sequence
  Peptide Derived from Human Papillomavirus
ASTTTPAKRK

SEQ ID NO: 35145 - protein, 11 aa, Artificial Sequence
  Peptide Derived from Human Papillomavirus
ASTTTPAKRKK

SEQ ID NO: 35146 - protein, 8 aa, Artificial Sequence
  Peptide Derived from Human Papillomavirus
ATLANSTY

SEQ ID NO: 35147 - protein, 9 aa, Artificial Sequence
  Peptide Derived from Human Papillomavirus
ATLANSTYF

SEQ ID NO: 35148 - protein, 11 aa, Artificial Sequence
  Peptide Derived from Human Papillomavirus
CAAIANSDTTF

SEQ ID NO: 35149 - protein, 8 aa, Artificial Sequence
  Peptide Derived from Human Papillomavirus
CVGLEVGR

SEQ ID NO: 35150 - protein, 9 aa, Artificial Sequence
  Peptide Derived from Human Papillomavirus
DAQIFNKPY

SEQ ID NO: 35151 - protein, 8 aa, Artificial Sequence
  Peptide Derived from Human Papillomavirus
DCPPLELK

SEQ ID NO: 35152 - protein, 8 aa, Artificial Sequence
  Peptide Derived from Human Papillomavirus
DDTENSNR

SEQ ID NO: 35153 - protein, 9 aa, Artificial Sequence
  Peptide Derived from Human Papillomavirus
DDTENSNRY

SEQ ID NO: 35154 - protein, 10 aa, Artificial Sequence
  Peptide Derived from Human Papillomavirus
DDTENSNRYA

SEQ ID NO: 35155 - protein, 9 aa, Artificial Sequence
  Peptide Derived from Human Papillomavirus
DFTALQDTK

SEQ ID NO: 35156 - protein, 9 aa, Artificial Sequence
  Peptide Derived from Human Papillomavirus
DGDMVDTGF

SEQ ID NO: 35157 - protein, 11 aa, Artificial Sequence
  Peptide Derived from Human Papillomavirus
DGDMVDTGFGA

SEQ ID NO: 35158 - protein, 8 aa, Artificial Sequence
  Peptide Derived from Human Papillomavirus
DICNSICK

SEQ ID NO: 35159 - protein, 9 aa, Artificial Sequence
  Peptide Derived from Human Papillomavirus
DICNSICKY

SEQ ID NO: 35160 - protein, 9 aa, Artificial Sequence
  Peptide Derived from Human Papillomavirus
DLDQFPLGR

SEQ ID NO: 35161 - protein, 10 aa, Artificial Sequence
  Peptide Derived from Human Papillomavirus
DLDQFPLGRK

SEQ ID NO: 35162 - protein, 11 aa, Artificial Sequence
  Peptide Derived from Human Papillomavirus
DLDQFPLGRKF

SEQ ID NO: 35163 - protein, 10 aa, Artificial Sequence
  Peptide Derived from Human Papillomavirus
DLQFIFQLCK

SEQ ID NO: 35164 - protein, 11 aa, Artificial Sequence
  Peptide Derived from Human Papillomavirus
DLYIKGSGSTA

SEQ ID NO: 35165 - protein, 9 aa, Artificial Sequence
  Peptide Derived from Human Papillomavirus
DMVDTGFGA

SEQ ID NO: 35166 - protein, 8 aa, Artificial Sequence
  Peptide Derived from Human Papillomavirus
DTENSNRY

SEQ ID NO: 35167 - protein, 9 aa, Artificial Sequence
  Peptide Derived from Human Papillomavirus
DTENSNRYA

SEQ ID NO: 35168 - protein, 9 aa, Artificial Sequence
  Peptide Derived from Human Papillomavirus
DTGFGAMDF

SEQ ID NO: 35169 - protein, 11 aa, Artificial Sequence
  Peptide Derived from Human Papillomavirus
DTGFGAMDFTA

SEQ ID NO: 35170 - protein, 8 aa, Artificial Sequence
  Peptide Derived from Human Papillomavirus
DTLFFYLR

SEQ ID NO: 35171 - protein, 9 aa, Artificial Sequence
  Peptide Derived from Human Papillomavirus
DTLFFYLRR

SEQ ID NO: 35172 - protein, 11 aa, Artificial Sequence
  Peptide Derived from Human Papillomavirus
DTSFYNPETQR

SEQ ID NO: 35173 - protein, 9 aa, Artificial Sequence
  Peptide Derived from Human Papillomavirus
DTTFKSSNF

SEQ ID NO: 35174 - protein, 10 aa, Artificial Sequence
  Peptide Derived from Human Papillomavirus
DTTFKSSNFK

SEQ ID NO: 35175 - protein, 10 aa, Artificial Sequence
  Peptide Derived from Human Papillomavirus
DTYRFVTSQA

SEQ ID NO: 35176 - protein, 8 aa, Artificial Sequence
  Peptide Derived from Human Papillomavirus
ECISMDYK

SEQ ID NO: 35177 - protein, 9 aa, Artificial Sequence
  Peptide Derived from Human Papillomavirus
EDPFKDYVF

SEQ ID NO: 35178 - protein, 11 aa, Artificial Sequence
  Peptide Derived from Human Papillomavirus
EDTYRFVTSQA

SEQ ID NO: 35179 - protein, 8 aa, Artificial Sequence
  Peptide Derived from Human Papillomavirus
EFDLQFIF

SEQ ID NO: 35180 - protein, 8 aa, Artificial Sequence
  Peptide Derived from Human Papillomavirus
ESVPTDLY

SEQ ID NO: 35181 - protein, 10 aa, Artificial Sequence
  Peptide Derived from Human Papillomavirus
ESVPTDLYIK

SEQ ID NO: 35182 - protein, 8 aa, Artificial Sequence
  Peptide Derived from Human Papillomavirus
ETQRLVWA

SEQ ID NO: 35183 - protein, 8 aa, Artificial Sequence
  Peptide Derived from Human Papillomavirus
EVNLKEKF

SEQ ID NO: 35184 - protein, 10 aa, Artificial Sequence
  Peptide Derived from Human Papillomavirus
EVNLKEKFSA

SEQ ID NO: 35185 - protein, 9 aa, Artificial Sequence
  Peptide Derived from Human Papillomavirus
FDDTENSNR

SEQ ID NO: 35186 - protein, 10 aa, Artificial Sequence
  Peptide Derived from Human Papillomavirus
FDDTENSNRY

SEQ ID NO: 35187 - protein, 11 aa, Artificial Sequence
  Peptide Derived from Human Papillomavirus
FDDTENSNRYA

SEQ ID NO: 35188 - protein, 11 aa, Artificial Sequence
  Peptide Derived from Human Papillomavirus
FDLQFIFQLCK

SEQ ID NO: 35189 - protein, 10 aa, Artificial Sequence
  Peptide Derived from Human Papillomavirus
FFYLRREQMF

SEQ ID NO: 35190 - protein, 8 aa, Artificial Sequence
  Peptide Derived from Human Papillomavirus
FGAMDFTA

SEQ ID NO: 35191 - protein, 8 aa, Artificial Sequence
  Peptide Derived from Human Papillomavirus
FGFPDTSF

SEQ ID NO: 35192 - protein, 9 aa, Artificial Sequence
  Peptide Derived from Human Papillomavirus
FGFPDTSFY

SEQ ID NO: 35193 - protein, 8 aa, Artificial Sequence
  Peptide Derived from Human Papillomavirus
FLLQAGYR

SEQ ID NO: 35194 - protein, 9 aa, Artificial Sequence
  Peptide Derived from Human Papillomavirus
FLLQAGYRA

SEQ ID NO: 35195 - protein, 10 aa, Artificial Sequence
  Peptide Derived from Human Papillomavirus
FLLQAGYRAR

SEQ ID NO: 35196 - protein, 8 aa, Artificial Sequence
  Peptide Derived from Human Papillomavirus
FSADLDQF

SEQ ID NO: 35197 - protein, 8 aa, Artificial Sequence
  Peptide Derived from Human Papillomavirus
FTALQDTK

SEQ ID NO: 35198 - protein, 8 aa, Artificial Sequence
  Peptide Derived from Human Papillomavirus
FVRHFFNR

SEQ ID NO: 35199 - protein, 11 aa, Artificial Sequence
  Peptide Derived from Human Papillomavirus
FVTSQAITCQK

SEQ ID NO: 35200 - protein, 9 aa, Artificial Sequence
  Peptide Derived from Human Papillomavirus
FVTVVDTTR

SEQ ID NO: 35201 - protein, 9 aa, Artificial Sequence
  Peptide Derived from Human Papillomavirus
GCKPPIGEH

SEQ ID NO: 35202 - protein, 9 aa, Artificial Sequence
  Peptide Derived from Human Papillomavirus
GDCPPLELK

SEQ ID NO: 35203 - protein, 8 aa, Artificial Sequence
  Peptide Derived from Human Papillomavirus
GDMVDTGF

SEQ ID NO: 35204 - protein, 10 aa, Artificial Sequence
  Peptide Derived from Human Papillomavirus
GDMVDTGFGA

SEQ ID NO: 35205 - protein, 9 aa, Artificial Sequence
  Peptide Derived from Human Papillomavirus
GDTLFFYLR

SEQ ID NO: 35206 - protein, 10 aa, Artificial Sequence
  Peptide Derived from Human Papillomavirus
GDTLFFYLRR

SEQ ID NO: 35207 - protein, 9 aa, Artificial Sequence
  Peptide Derived from Human Papillomavirus
GFGAMDFTA

SEQ ID NO: 35208 - protein, 8 aa, Artificial Sequence
  Peptide Derived from Human Papillomavirus
GFPDTSFY

SEQ ID NO: 35209 - protein, 8 aa, Artificial Sequence
  Peptide Derived from Human Papillomavirus
GGPGTDNR

SEQ ID NO: 35210 - protein, 9 aa, Artificial Sequence
  Peptide Derived from Human Papillomavirus
GICWGNQLF

SEQ ID NO: 35211 - protein, 10 aa, Artificial Sequence
  Peptide Derived from Human Papillomavirus
GISGHPLLNK

SEQ ID NO: 35212 - protein, 11 aa, Artificial Sequence
  Peptide Derived from Human Papillomavirus
GISGHPLLNKF

SEQ ID NO: 35213 - protein, 8 aa, Artificial Sequence
  Peptide Derived from Human Papillomavirus
GLQYRVFR

SEQ ID NO: 35214 - protein, 10 aa, Artificial Sequence
  Peptide Derived from Human Papillomavirus
GLQYRVFRVR

SEQ ID NO: 35215 - protein, 10 aa, Artificial Sequence
  Peptide Derived from Human Papillomavirus
GSARLLTVGH

SEQ ID NO: 35216 - protein, 9 aa, Artificial Sequence
  Peptide Derived from Human Papillomavirus
GSGSTATLA

SEQ ID NO: 35217 - protein, 8 aa, Artificial Sequence
  Peptide Derived from Human Papillomavirus
GSLEDTYR

SEQ ID NO: 35218 - protein, 9 aa, Artificial Sequence
  Peptide Derived from Human Papillomavirus
GSLEDTYRF

SEQ ID NO: 35219 - protein, 8 aa, Artificial Sequence
  Peptide Derived from Human Papillomavirus
GSMVTSDA

SEQ ID NO: 35220 - protein, 11 aa, Artificial Sequence
  Peptide Derived from Human Papillomavirus
GSMVTSDAQIF

SEQ ID NO: 35221 - protein, 8 aa, Artificial Sequence
  Peptide Derived from Human Papillomavirus
GSPCSNNA

SEQ ID NO: 35222 - protein, 11 aa, Artificial Sequence
  Peptide Derived from Human Papillomavirus
GSTATLANSTY

SEQ ID NO: 35223 - protein, 9 aa, Artificial Sequence
  Peptide Derived from Human Papillomavirus
HGEEFDLQF

SEQ ID NO: 35224 - protein, 11 aa, Artificial Sequence
  Peptide Derived from Human Papillomavirus
HGEEFDLQFIF

SEQ ID NO: 35225 - protein, 8 aa, Artificial Sequence
  Peptide Derived from Human Papillomavirus
IANSDTTF

SEQ ID NO: 35226 - protein, 9 aa, Artificial Sequence
  Peptide Derived from Human Papillomavirus
IANSDTTFK

SEQ ID NO: 35227 - protein, 9 aa, Artificial Sequence
  Peptide Derived from Human Papillomavirus
ICKYPDYLK

SEQ ID NO: 35228 - protein, 8 aa, Artificial Sequence
  Peptide Derived from Human Papillomavirus
ICNSICKY

SEQ ID NO: 35229 - protein, 11 aa, Artificial Sequence
  Peptide Derived from Human Papillomavirus
ICNSICKYPDY

SEQ ID NO: 35230 - protein, 8 aa, Artificial Sequence
  Peptide Derived from Human Papillomavirus
ICWGNQLF

SEQ ID NO: 35231 - protein, 10 aa, Artificial Sequence
  Peptide Derived from Human Papillomavirus
IFNKPYWMQR

SEQ ID NO: 35232 - protein, 11 aa, Artificial Sequence
  Peptide Derived from Human Papillomavirus
IFNKPYWMQRA

SEQ ID NO: 35233 - protein, 11 aa, Artificial Sequence
  Peptide Derived from Human Papillomavirus
IFQLCKITLSA

SEQ ID NO: 35234 - protein, 11 aa, Artificial Sequence
  Peptide Derived from Human Papillomavirus
IMTYIHSMNPA

SEQ ID NO: 35235 - protein, 9 aa, Artificial Sequence
  Peptide Derived from Human Papillomavirus
ISGHPLLNK

SEQ ID NO: 35236 - protein, 10 aa, Artificial Sequence
  Peptide Derived from Human Papillomavirus
ISGHPLLNKF

SEQ ID NO: 35237 - protein, 10 aa, Artificial Sequence
  Peptide Derived from Human Papillomavirus
ITCQKTAPQK

SEQ ID NO: 35238 - protein, 10 aa, Artificial Sequence
  Peptide Derived from Human Papillomavirus
ITLSADIMTY

SEQ ID NO: 35239 - protein, 11 aa, Artificial Sequence
  Peptide Derived from Human Papillomavirus
IVVPKVSGLQY

SEQ ID NO: 35240 - protein, 10 aa, Artificial Sequence
  Peptide Derived from Human Papillomavirus
KAGKRSAPSA

SEQ ID NO: 35241 - protein, 11 aa, Artificial Sequence
  Peptide Derived from Human Papillomavirus
KDYVFWEVNLK

SEQ ID NO: 35242 - protein, 10 aa, Artificial Sequence
  Peptide Derived from Human Papillomavirus
KFDDTENSNR

SEQ ID NO: 35243 - protein, 11 aa, Artificial Sequence
  Peptide Derived from Human Papillomavirus
KFDDTENSNRY

SEQ ID NO: 35244 - protein, 9 aa, Artificial Sequence
  Peptide Derived from Human Papillomavirus
KFGFPDTSF

SEQ ID NO: 35245 - protein, 10 aa, Artificial Sequence
  Peptide Derived from Human Papillomavirus
KFGFPDTSFY

SEQ ID NO: 35246 - protein, 9 aa, Artificial Sequence
  Peptide Derived from Human Papillomavirus
KFKAGKRSA

SEQ ID NO: 35247 - protein, 8 aa, Artificial Sequence
  Peptide Derived from Human Papillomavirus
KFLLQAGY

SEQ ID NO: 35248 - protein, 9 aa, Artificial Sequence
  Peptide Derived from Human Papillomavirus
KFLLQAGYR

SEQ ID NO: 35249 - protein, 10 aa, Artificial Sequence
  Peptide Derived from Human Papillomavirus
KFLLQAGYRA

SEQ ID NO: 35250 - protein, 11 aa, Artificial Sequence
  Peptide Derived from Human Papillomavirus
KFLLQAGYRAR

SEQ ID NO: 35251 - protein, 9 aa, Artificial Sequence
  Peptide Derived from Human Papillomavirus
KFSADLDQF

SEQ ID NO: 35252 - protein, 10 aa, Artificial Sequence
  Peptide Derived from Human Papillomavirus
KGSGSTATLA

SEQ ID NO: 35253 - protein, 9 aa, Artificial Sequence
  Peptide Derived from Human Papillomavirus
KGSPCSNNA

SEQ ID NO: 35254 - protein, 11 aa, Artificial Sequence
  Peptide Derived from Human Papillomavirus
KITLSADIMTY

SEQ ID NO: 35255 - protein, 8 aa, Artificial Sequence
  Peptide Derived from Human Papillomavirus
KSSNFKEY

SEQ ID NO: 35256 - protein, 10 aa, Artificial Sequence
  Peptide Derived from Human Papillomavirus
KSSNFKEYLR

SEQ ID NO: 35257 - protein, 11 aa, Artificial Sequence
  Peptide Derived from Human Papillomavirus
KSSNFKEYLRH

SEQ ID NO: 35258 - protein, 8 aa, Artificial Sequence
  Peptide Derived from Human Papillomavirus
KTAPQKPK

SEQ ID NO: 35259 - protein, 8 aa, Artificial Sequence
  Peptide Derived from Human Papillomavirus
KVSGLQYR

SEQ ID NO: 35260 - protein, 10 aa, Artificial Sequence
  Peptide Derived from Human Papillomavirus
KVSGLQYRVF

SEQ ID NO: 35261 - protein, 11 aa, Artificial Sequence
  Peptide Derived from Human Papillomavirus
KVSGLQYRVFR

SEQ ID NO: 35262 - protein, 8 aa, Artificial Sequence
  Peptide Derived from Human Papillomavirus
KVVSTDEY

SEQ ID NO: 35263 - protein, 11 aa, Artificial Sequence
  Peptide Derived from Human Papillomavirus
KVVSTDEYVTR

SEQ ID NO: 35264 - protein, 8 aa, Artificial Sequence
  Peptide Derived from Human Papillomavirus
LCKITLSA

SEQ ID NO: 35265 - protein, 9 aa, Artificial Sequence
  Peptide Derived from Human Papillomavirus
LDICNSICK

SEQ ID NO: 35266 - protein, 10 aa, Artificial Sequence
  Peptide Derived from Human Papillomavirus
LDICNSICKY

SEQ ID NO: 35267 - protein, 8 aa, Artificial Sequence
  Peptide Derived from Human Papillomavirus
LDQFPLGR

SEQ ID NO: 35268 - protein, 9 aa, Artificial Sequence
  Peptide Derived from Human Papillomavirus
LDQFPLGRK

SEQ ID NO: 35269 - protein, 10 aa, Artificial Sequence
  Peptide Derived from Human Papillomavirus
LDQFPLGRKF

SEQ ID NO: 35270 - protein, 11 aa, Artificial Sequence
  Peptide Derived from Human Papillomavirus
LFFYLRREQMF

SEQ ID NO: 35271 - protein, 10 aa, Artificial Sequence
  Peptide Derived from Human Papillomavirus
LFVTVVDTTR

SEQ ID NO: 35272 - protein, 10 aa, Artificial Sequence
  Peptide Derived from Human Papillomavirus
LGCKPPIGEH

SEQ ID NO: 35273 - protein, 9 aa, Artificial Sequence
  Peptide Derived from Human Papillomavirus
LGRKFLLQA

SEQ ID NO: 35274 - protein, 11 aa, Artificial Sequence
  Peptide Derived from Human Papillomavirus
LGRKFLLQAGY

SEQ ID NO: 35275 - protein, 8 aa, Artificial Sequence
  Peptide Derived from Human Papillomavirus
LGVGISGH

SEQ ID NO: 35276 - protein, 11 aa, Artificial Sequence
  Peptide Derived from Human Papillomavirus
LLGCKPPIGEH

SEQ ID NO: 35277 - protein, 8 aa, Artificial Sequence
  Peptide Derived from Human Papillomavirus
LLQAGYRA

SEQ ID NO: 35278 - protein, 9 aa, Artificial Sequence
  Peptide Derived from Human Papillomavirus
LLQAGYRAR

SEQ ID NO: 35279 - protein, 11 aa, Artificial Sequence
  Peptide Derived from Human Papillomavirus
LLQAGYRARPK

SEQ ID NO: 35280 - protein, 8 aa, Artificial Sequence
  Peptide Derived from Human Papillomavirus
LLTVGHPY

SEQ ID NO: 35281 - protein, 9 aa, Artificial Sequence
  Peptide Derived from Human Papillomavirus
LLTVGHPYY

SEQ ID NO: 35282 - protein, 8 aa, Artificial Sequence
  Peptide Derived from Human Papillomavirus
LSADIMTY

SEQ ID NO: 35283 - protein, 10 aa, Artificial Sequence
  Peptide Derived from Human Papillomavirus
LSADIMTYIH

SEQ ID NO: 35284 - protein, 8 aa, Artificial Sequence
  Peptide Derived from Human Papillomavirus
LTVGHPYY

SEQ ID NO: 35285 - protein, 10 aa, Artificial Sequence
  Peptide Derived from Human Papillomavirus
MDFTALQDTK

SEQ ID NO: 35286 - protein, 9 aa, Artificial Sequence
  Peptide Derived from Human Papillomavirus
MFVRHFFNR

SEQ ID NO: 35287 - protein, 9 aa, Artificial Sequence
  Peptide Derived from Human Papillomavirus
MSLWRPSEA

SEQ ID NO: 35288 - protein, 8 aa, Artificial Sequence
  Peptide Derived from Human Papillomavirus
MSVCAAIA

SEQ ID NO: 35289 - protein, 10 aa, Artificial Sequence
  Peptide Derived from Human Papillomavirus
MTYIHSMNPA

SEQ ID NO: 35290 - protein, 11 aa, Artificial Sequence
  Peptide Derived from Human Papillomavirus
MVAEPYGDTLF

SEQ ID NO: 35291 - protein, 8 aa, Artificial Sequence
  Peptide Derived from Human Papillomavirus
MVDTGFGA

SEQ ID NO: 35292 - protein, 11 aa, Artificial Sequence
  Peptide Derived from Human Papillomavirus
MVDTGFGAMDF

SEQ ID NO: 35293 - protein, 9 aa, Artificial Sequence
  Peptide Derived from Human Papillomavirus
MVTSDAQIF

SEQ ID NO: 35294 - protein, 11 aa, Artificial Sequence
  Peptide Derived from Human Papillomavirus
MVTSDAQIFNK

SEQ ID NO: 35295 - protein, 8 aa, Artificial Sequence
  Peptide Derived from Human Papillomavirus
NFKEYLRH

SEQ ID NO: 35296 - protein, 10 aa, Artificial Sequence
  Peptide Derived from Human Papillomavirus
NGICWGNQLF

SEQ ID NO: 35297 - protein, 9 aa, Artificial Sequence
  Peptide Derived from Human Papillomavirus
NIYYHAGSA

SEQ ID NO: 35298 - protein, 10 aa, Artificial Sequence
  Peptide Derived from Human Papillomavirus
NIYYHAGSAR

SEQ ID NO: 35299 - protein, 8 aa, Artificial Sequence
  Peptide Derived from Human Papillomavirus
NLKEKFSA

SEQ ID NO: 35300 - protein, 9 aa, Artificial Sequence
  Peptide Derived from Human Papillomavirus
NMSVCAAIA

SEQ ID NO: 35301 - protein, 11 aa, Artificial Sequence
  Peptide Derived from Human Papillomavirus
NSDTTFKSSNF

SEQ ID NO: 35302 - protein, 9 aa, Artificial Sequence
  Peptide Derived from Human Papillomavirus
NSICKYPDY

SEQ ID NO: 35303 - protein, 11 aa, Artificial Sequence
  Peptide Derived from Human Papillomavirus
NSICKYPDYLK

SEQ ID NO: 35304 - protein, 9 aa, Artificial Sequence
  Peptide Derived from Human Papillomavirus
PAILEDWNF

SEQ ID NO: 35305 - protein, 8 aa, Artificial Sequence
  Peptide Derived from Human Papillomavirus
PAKRKKTK

SEQ ID NO: 35306 - protein, 9 aa, Artificial Sequence
  Peptide Derived from Human Papillomavirus
PAKRKKTKK

SEQ ID NO: 35307 - protein, 8 aa, Artificial Sequence
  Peptide Derived from Human Papillomavirus
PDPNKFGF

SEQ ID NO: 35308 - protein, 8 aa, Artificial Sequence
  Peptide Derived from Human Papillomavirus
PDYLKMVA

SEQ ID NO: 35309 - protein, 11 aa, Artificial Sequence
  Peptide Derived from Human Papillomavirus
PDYLKMVAEPY

SEQ ID NO: 35310 - protein, 10 aa, Artificial Sequence
  Peptide Derived from Human Papillomavirus
PGDCPPLELK

SEQ ID NO: 35311 - protein, 8 aa, Artificial Sequence
  Peptide Derived from Human Papillomavirus
PIGEHWGK

SEQ ID NO: 35312 - protein, 10 aa, Artificial Sequence
  Peptide Derived from Human Papillomavirus
PLDICNSICK

SEQ ID NO: 35313 - protein, 11 aa, Artificial Sequence
  Peptide Derived from Human Papillomavirus
PLDICNSICKY

SEQ ID NO: 35314 - protein, 10 aa, Artificial Sequence
  Peptide Derived from Human Papillomavirus
PLGRKFLLQA

SEQ ID NO: 35315 - protein, 9 aa, Artificial Sequence
  Peptide Derived from Human Papillomavirus
PLGVGISGH

SEQ ID NO: 35316 - protein, 9 aa, Artificial Sequence
  Peptide Derived from Human Papillomavirus
PSASTTTPA

SEQ ID NO: 35317 - protein, 10 aa, Artificial Sequence
  Peptide Derived from Human Papillomavirus
PSASTTTPAK

SEQ ID NO: 35318 - protein, 11 aa, Artificial Sequence
  Peptide Derived from Human Papillomavirus
PSASTTTPAKR

SEQ ID NO: 35319 - protein, 9 aa, Artificial Sequence
  Peptide Derived from Human Papillomavirus
PSGSLEDTY

SEQ ID NO: 35320 - protein, 10 aa, Artificial Sequence
  Peptide Derived from Human Papillomavirus
PSGSLEDTYR

SEQ ID NO: 35321 - protein, 11 aa, Artificial Sequence
  Peptide Derived from Human Papillomavirus
PSGSLEDTYRF

SEQ ID NO: 35322 - protein, 10 aa, Artificial Sequence
  Peptide Derived from Human Papillomavirus
PSGSMVTSDA

SEQ ID NO: 35323 - protein, 11 aa, Artificial Sequence
  Peptide Derived from Human Papillomavirus
PVSKVVSTDEY

SEQ ID NO: 35324 - protein, 9 aa, Artificial Sequence
  Peptide Derived from Human Papillomavirus
QAGYRARPK

SEQ ID NO: 35325 - protein, 10 aa, Artificial Sequence
  Peptide Derived from Human Papillomavirus
QAGYRARPKF

SEQ ID NO: 35326 - protein, 11 aa, Artificial Sequence
  Peptide Derived from Human Papillomavirus
QAGYRARPKFK

SEQ ID NO: 35327 - protein, 9 aa, Artificial Sequence
  Peptide Derived from Human Papillomavirus
QAITCQKTA

SEQ ID NO: 35328 - protein, 10 aa, Artificial Sequence
  Peptide Derived from Human Papillomavirus
QDGDMVDTGF

SEQ ID NO: 35329 - protein, 8 aa, Artificial Sequence
  Peptide Derived from Human Papillomavirus
QFIFQLCK

SEQ ID NO: 35330 - protein, 8 aa, Artificial Sequence
  Peptide Derived from Human Papillomavirus
QFPLGRKF

SEQ ID NO: 35331 - protein, 11 aa, Artificial Sequence
  Peptide Derived from Human Papillomavirus
QIFNKPYWMQR

SEQ ID NO: 35332 - protein, 9 aa, Artificial Sequence
  Peptide Derived from Human Papillomavirus
QLCKITLSA

SEQ ID NO: 35333 - protein, 8 aa, Artificial Sequence
  Peptide Derived from Human Papillomavirus
QLCLLGCK

SEQ ID NO: 35334 - protein, 11 aa, Artificial Sequence
  Peptide Derived from Human Papillomavirus
QLFVTVVDTTR

SEQ ID NO: 35335 - protein, 8 aa, Artificial Sequence
  Peptide Derived from Human Papillomavirus
QMFVRHFF

SEQ ID NO: 35336 - protein, 10 aa, Artificial Sequence
  Peptide Derived from Human Papillomavirus
QMFVRHFFNR

SEQ ID NO: 35337 - protein, 10 aa, Artificial Sequence
  Peptide Derived from Human Papillomavirus
QTQLCLLGCK

SEQ ID NO: 35338 - protein, 8 aa, Artificial Sequence
  Peptide Derived from Human Papillomavirus
RARPKFKA

SEQ ID NO: 35339 - protein, 10 aa, Artificial Sequence
  Peptide Derived from Human Papillomavirus
RARPKFKAGK

SEQ ID NO: 35340 - protein, 11 aa, Artificial Sequence
  Peptide Derived from Human Papillomavirus
RARPKFKAGKR

SEQ ID NO: 35341 - protein, 9 aa, Artificial Sequence
  Peptide Derived from Human Papillomavirus
RLLTVGHPY

SEQ ID NO: 35342 - protein, 10 aa, Artificial Sequence
  Peptide Derived from Human Papillomavirus
RLLTVGHPYY

SEQ ID NO: 35343 - protein, 8 aa, Artificial Sequence
  Peptide Derived from Human Papillomavirus
RLPDPNKF

SEQ ID NO: 35344 - protein, 10 aa, Artificial Sequence
  Peptide Derived from Human Papillomavirus
RLPDPNKFGF

SEQ ID NO: 35345 - protein, 9 aa, Artificial Sequence
  Peptide Derived from Human Papillomavirus
RSTNMSVCA

SEQ ID NO: 35346 - protein, 10 aa, Artificial Sequence
  Peptide Derived from Human Papillomavirus
RSTNMSVCAA

SEQ ID NO: 35347 - protein, 8 aa, Artificial Sequence
  Peptide Derived from Human Papillomavirus
RTNIYYHA

SEQ ID NO: 35348 - protein, 11 aa, Artificial Sequence
  Peptide Derived from Human Papillomavirus
RTNIYYHAGSA

SEQ ID NO: 35349 - protein, 9 aa, Artificial Sequence
  Peptide Derived from Human Papillomavirus
RVRLPDPNK

SEQ ID NO: 35350 - protein, 10 aa, Artificial Sequence
  Peptide Derived from Human Papillomavirus
RVRLPDPNKF

SEQ ID NO: 35351 - protein, 9 aa, Artificial Sequence
  Peptide Derived from Human Papillomavirus
SADIMTYIH

SEQ ID NO: 35352 - protein, 11 aa, Artificial Sequence
  Peptide Derived from Human Papillomavirus
SADLDQFPLGR

SEQ ID NO: 35353 - protein, 11 aa, Artificial Sequence
  Peptide Derived from Human Papillomavirus
SAPSASTTTPA

SEQ ID NO: 35354 - protein, 9 aa, Artificial Sequence
  Peptide Derived from Human Papillomavirus
SARLLTVGH

SEQ ID NO: 35355 - protein, 11 aa, Artificial Sequence
  Peptide Derived from Human Papillomavirus
SARLLTVGHPY

SEQ ID NO: 35356 - protein, 8 aa, Artificial Sequence
  Peptide Derived from Human Papillomavirus
SASTTTPA

SEQ ID NO: 35357 - protein, 9 aa, Artificial Sequence
  Peptide Derived from Human Papillomavirus
SASTTTPAK

SEQ ID NO: 35358 - protein, 10 aa, Artificial Sequence
  Peptide Derived from Human Papillomavirus
SASTTTPAKR

SEQ ID NO: 35359 - protein, 11 aa, Artificial Sequence
  Peptide Derived from Human Papillomavirus
SASTTTPAKRK

SEQ ID NO: 35360 - protein, 8 aa, Artificial Sequence
  Peptide Derived from Human Papillomavirus
SDAQIFNK

SEQ ID NO: 35361 - protein, 10 aa, Artificial Sequence
  Peptide Derived from Human Papillomavirus
SDAQIFNKPY

SEQ ID NO: 35362 - protein, 11 aa, Artificial Sequence
  Peptide Derived from Human Papillomavirus
SDNPKKIVVPK

SEQ ID NO: 35363 - protein, 10 aa, Artificial Sequence
  Peptide Derived from Human Papillomavirus
SDTTFKSSNF

SEQ ID NO: 35364 - protein, 11 aa, Artificial Sequence
  Peptide Derived from Human Papillomavirus
SDTTFKSSNFK

SEQ ID NO: 35365 - protein, 9 aa, Artificial Sequence
  Peptide Derived from Human Papillomavirus
SFYNPETQR

SEQ ID NO: 35366 - protein, 8 aa, Artificial Sequence
  Peptide Derived from Human Papillomavirus
SGHPLLNK

SEQ ID NO: 35367 - protein, 9 aa, Artificial Sequence
  Peptide Derived from Human Papillomavirus
SGHPLLNKF

SEQ ID NO: 35368 - protein, 8 aa, Artificial Sequence
  Peptide Derived from Human Papillomavirus
SGLQYRVF

SEQ ID NO: 35369 - protein, 9 aa, Artificial Sequence
  Peptide Derived from Human Papillomavirus
SGLQYRVFR

SEQ ID NO: 35370 - protein, 11 aa, Artificial Sequence
  Peptide Derived from Human Papillomavirus
SGLQYRVFRVR

SEQ ID NO: 35371 - protein, 8 aa, Artificial Sequence
  Peptide Derived from Human Papillomavirus
SGSLEDTY

SEQ ID NO: 35372 - protein, 9 aa, Artificial Sequence
  Peptide Derived from Human Papillomavirus
SGSLEDTYR

SEQ ID NO: 35373 - protein, 10 aa, Artificial Sequence
  Peptide Derived from Human Papillomavirus
SGSLEDTYRF

SEQ ID NO: 35374 - protein, 9 aa, Artificial Sequence
  Peptide Derived from Human Papillomavirus
SGSMVTSDA

SEQ ID NO: 35375 - protein, 8 aa, Artificial Sequence
  Peptide Derived from Human Papillomavirus
SGSTATLA

SEQ ID NO: 35376 - protein, 8 aa, Artificial Sequence
  Peptide Derived from Human Papillomavirus
SICKYPDY

SEQ ID NO: 35377 - protein, 10 aa, Artificial Sequence
  Peptide Derived from Human Papillomavirus
SICKYPDYLK

SEQ ID NO: 35378 - protein, 9 aa, Artificial Sequence
  Peptide Derived from Human Papillomavirus
SIPKSDNPK

SEQ ID NO: 35379 - protein, 10 aa, Artificial Sequence
  Peptide Derived from Human Papillomavirus
SIPKSDNPKK

SEQ ID NO: 35380 - protein, 8 aa, Artificial Sequence
  Peptide Derived from Human Papillomavirus
SLEDTYRF

SEQ ID NO: 35381 - protein, 8 aa, Artificial Sequence
  Peptide Derived from Human Papillomavirus
SLWRPSEA

SEQ ID NO: 35382 - protein, 11 aa, Artificial Sequence
  Peptide Derived from Human Papillomavirus
SLWRPSEATVY

SEQ ID NO: 35383 - protein, 10 aa, Artificial Sequence
  Peptide Derived from Human Papillomavirus
SMVTSDAQIF

SEQ ID NO: 35384 - protein, 9 aa, Artificial Sequence
  Peptide Derived from Human Papillomavirus
SSNFKEYLR

SEQ ID NO: 35385 - protein, 10 aa, Artificial Sequence
  Peptide Derived from Human Papillomavirus
SSNFKEYLRH

SEQ ID NO: 35386 - protein, 10 aa, Artificial Sequence
  Peptide Derived from Human Papillomavirus
STATLANSTY

SEQ ID NO: 35387 - protein, 11 aa, Artificial Sequence
  Peptide Derived from Human Papillomavirus
STATLANSTYF

SEQ ID NO: 35388 - protein, 8 aa, Artificial Sequence
  Peptide Derived from Human Papillomavirus
STDEYVTR

SEQ ID NO: 35389 - protein, 8 aa, Artificial Sequence
  Peptide Derived from Human Papillomavirus
STNMSVCA

SEQ ID NO: 35390 - protein, 9 aa, Artificial Sequence
  Peptide Derived from Human Papillomavirus
STNMSVCAA

SEQ ID NO: 35391 - protein, 11 aa, Artificial Sequence
  Peptide Derived from Human Papillomavirus
STNMSVCAAIA

SEQ ID NO: 35392 - protein, 8 aa, Artificial Sequence
  Peptide Derived from Human Papillomavirus
STTTPAKR

SEQ ID NO: 35393 - protein, 9 aa, Artificial Sequence
  Peptide Derived from Human Papillomavirus
STTTPAKRK

SEQ ID NO: 35394 - protein, 10 aa, Artificial Sequence
  Peptide Derived from Human Papillomavirus
STTTPAKRKK

SEQ ID NO: 35395 - protein, 9 aa, Artificial Sequence
  Peptide Derived from Human Papillomavirus
SVPTDLYIK

SEQ ID NO: 35396 - protein, 11 aa, Artificial Sequence
  Peptide Derived from Human Papillomavirus
TAPQKPKEDPF

SEQ ID NO: 35397 - protein, 9 aa, Artificial Sequence
  Peptide Derived from Human Papillomavirus
TATLANSTY

SEQ ID NO: 35398 - protein, 10 aa, Artificial Sequence
  Peptide Derived from Human Papillomavirus
TATLANSTYF

SEQ ID NO: 35399 - protein, 9 aa, Artificial Sequence
  Peptide Derived from Human Papillomavirus
TCQKTAPQK

SEQ ID NO: 35400 - protein, 11 aa, Artificial Sequence
  Peptide Derived from Human Papillomavirus
TCQKTAPQKPK

SEQ ID NO: 35401 - protein, 11 aa, Artificial Sequence
  Peptide Derived from Human Papillomavirus
TDEYVTRTNIY

SEQ ID NO: 35402 - protein, 11 aa, Artificial Sequence
  Peptide Derived from Human Papillomavirus
TDNRECISMDY

SEQ ID NO: 35403 - protein, 8 aa, Artificial Sequence
  Peptide Derived from Human Papillomavirus
TFKSSNFK

SEQ ID NO: 35404 - protein, 10 aa, Artificial Sequence
  Peptide Derived from Human Papillomavirus
TFKSSNFKEY

SEQ ID NO: 35405 - protein, 8 aa, Artificial Sequence
  Peptide Derived from Human Papillomavirus
TGFGAMDF

SEQ ID NO: 35406 - protein, 10 aa, Artificial Sequence
  Peptide Derived from Human Papillomavirus
TGFGAMDFTA

SEQ ID NO: 35407 - protein, 8 aa, Artificial Sequence
  Peptide Derived from Human Papillomavirus
TLANSTYF

SEQ ID NO: 35408 - protein, 8 aa, Artificial Sequence
  Peptide Derived from Human Papillomavirus
TLFFYLRR

SEQ ID NO: 35409 - protein, 9 aa, Artificial Sequence
  Peptide Derived from Human Papillomavirus
TLSADIMTY

SEQ ID NO: 35410 - protein, 11 aa, Artificial Sequence
  Peptide Derived from Human Papillomavirus
TLSADIMTYIH

SEQ ID NO: 35411 - protein, 9 aa, Artificial Sequence
  Peptide Derived from Human Papillomavirus
TSDAQIFNK

SEQ ID NO: 35412 - protein, 11 aa, Artificial Sequence
  Peptide Derived from Human Papillomavirus
TSDAQIFNKPY

SEQ ID NO: 35413 - protein, 10 aa, Artificial Sequence
  Peptide Derived from Human Papillomavirus
TSFYNPETQR

SEQ ID NO: 35414 - protein, 9 aa, Artificial Sequence
  Peptide Derived from Human Papillomavirus
TSQAITCQK

SEQ ID NO: 35415 - protein, 11 aa, Artificial Sequence
  Peptide Derived from Human Papillomavirus
TSQAITCQKTA

SEQ ID NO: 35416 - protein, 8 aa, Artificial Sequence
  Peptide Derived from Human Papillomavirus
TTFKSSNF

SEQ ID NO: 35417 - protein, 9 aa, Artificial Sequence
  Peptide Derived from Human Papillomavirus
TTFKSSNFK

SEQ ID NO: 35418 - protein, 11 aa, Artificial Sequence
  Peptide Derived from Human Papillomavirus
TTFKSSNFKEY

SEQ ID NO: 35419 - protein, 8 aa, Artificial Sequence
  Peptide Derived from Human Papillomavirus
TTPAKRKK

SEQ ID NO: 35420 - protein, 10 aa, Artificial Sequence
  Peptide Derived from Human Papillomavirus
TTPAKRKKTK

SEQ ID NO: 35421 - protein, 11 aa, Artificial Sequence
  Peptide Derived from Human Papillomavirus
TTPAKRKKTKK

SEQ ID NO: 35422 - protein, 11 aa, Artificial Sequence
  Peptide Derived from Human Papillomavirus
TTRSTNMSVCA

SEQ ID NO: 35423 - protein, 8 aa, Artificial Sequence
  Peptide Derived from Human Papillomavirus
TTTPAKRK

SEQ ID NO: 35424 - protein, 9 aa, Artificial Sequence
  Peptide Derived from Human Papillomavirus
TTTPAKRKK

SEQ ID NO: 35425 - protein, 11 aa, Artificial Sequence
  Peptide Derived from Human Papillomavirus
TTTPAKRKKTK

SEQ ID NO: 35426 - protein, 11 aa, Artificial Sequence
  Peptide Derived from Human Papillomavirus
TVGESVPTDLY

SEQ ID NO: 35427 - protein, 11 aa, Artificial Sequence
  Peptide Derived from Human Papillomavirus
TVGHPYYSIPK

SEQ ID NO: 35428 - protein, 11 aa, Artificial Sequence
  Peptide Derived from Human Papillomavirus
TVYLPPVPVSK

SEQ ID NO: 35429 - protein, 10 aa, Artificial Sequence
  Peptide Derived from Human Papillomavirus
VAEPYGDTLF

SEQ ID NO: 35430 - protein, 11 aa, Artificial Sequence
  Peptide Derived from Human Papillomavirus
VAEPYGDTLFF

SEQ ID NO: 35431 - protein, 10 aa, Artificial Sequence
  Peptide Derived from Human Papillomavirus
VDTGFGAMDF

SEQ ID NO: 35432 - protein, 11 aa, Artificial Sequence
  Peptide Derived from Human Papillomavirus
VFRVRLPDPNK

SEQ ID NO: 35433 - protein, 8 aa, Artificial Sequence
  Peptide Derived from Human Papillomavirus
VFWEVNLK

SEQ ID NO: 35434 - protein, 10 aa, Artificial Sequence
  Peptide Derived from Human Papillomavirus
VFWEVNLKEK

SEQ ID NO: 35435 - protein, 11 aa, Artificial Sequence
  Peptide Derived from Human Papillomavirus
VFWEVNLKEKF

SEQ ID NO: 35436 - protein, 10 aa, Artificial Sequence
  Peptide Derived from Human Papillomavirus
VGESVPTDLY

SEQ ID NO: 35437 - protein, 10 aa, Artificial Sequence
  Peptide Derived from Human Papillomavirus
VGHPYYSIPK

SEQ ID NO: 35438 - protein, 11 aa, Artificial Sequence
  Peptide Derived from Human Papillomavirus
VGISGHPLLNK

SEQ ID NO: 35439 - protein, 9 aa, Artificial Sequence
  Peptide Derived from Human Papillomavirus
VSGLQYRVF

SEQ ID NO: 35440 - protein, 10 aa, Artificial Sequence
  Peptide Derived from Human Papillomavirus
VSGLQYRVFR

SEQ ID NO: 35441 - protein, 10 aa, Artificial Sequence
  Peptide Derived from Human Papillomavirus
VSKVVSTDEY

SEQ ID NO: 35442 - protein, 9 aa, Artificial Sequence
  Peptide Derived from Human Papillomavirus
VSTDEYVTR

SEQ ID NO: 35443 - protein, 8 aa, Artificial Sequence
  Peptide Derived from Human Papillomavirus
VTRTNIYY

SEQ ID NO: 35444 - protein, 9 aa, Artificial Sequence
  Peptide Derived from Human Papillomavirus
VTRTNIYYH

SEQ ID NO: 35445 - protein, 10 aa, Artificial Sequence
  Peptide Derived from Human Papillomavirus
VTRTNIYYHA

SEQ ID NO: 35446 - protein, 8 aa, Artificial Sequence
  Peptide Derived from Human Papillomavirus
VTSDAQIF

SEQ ID NO: 35447 - protein, 10 aa, Artificial Sequence
  Peptide Derived from Human Papillomavirus
VTSDAQIFNK

SEQ ID NO: 35448 - protein, 10 aa, Artificial Sequence
  Peptide Derived from Human Papillomavirus
VTSQAITCQK

SEQ ID NO: 35449 - protein, 8 aa, Artificial Sequence
  Peptide Derived from Human Papillomavirus
VTVVDTTR

SEQ ID NO: 35450 - protein, 10 aa, Artificial Sequence
  Peptide Derived from Human Papillomavirus
VVPKVSGLQY

SEQ ID NO: 35451 - protein, 11 aa, Artificial Sequence
  Peptide Derived from Human Papillomavirus
VVPKVSGLQYR

SEQ ID NO: 35452 - protein, 10 aa, Artificial Sequence
  Peptide Derived from Human Papillomavirus
VVSTDEYVTR

SEQ ID NO: 35453 - protein, 10 aa, Artificial Sequence
  Peptide Derived from Human Papillomavirus
WACVGLEVGR

SEQ ID NO: 35454 - protein, 11 aa, Artificial Sequence
  Peptide Derived from Human Papillomavirus
WGKGSPCSNNA

SEQ ID NO: 35455 - protein, 8 aa, Artificial Sequence
  Peptide Derived from Human Papillomavirus
WMQRAQGH

SEQ ID NO: 35456 - protein, 10 aa, Artificial Sequence
  Peptide Derived from Human Papillomavirus
YAGGPGTDNR

SEQ ID NO: 35457 - protein, 8 aa, Artificial Sequence
  Peptide Derived from Human Papillomavirus
YGDTLFFY

SEQ ID NO: 35458 - protein, 10 aa, Artificial Sequence
  Peptide Derived from Human Papillomavirus
YGDTLFFYLR

SEQ ID NO: 35459 - protein, 11 aa, Artificial Sequence
  Peptide Derived from Human Papillomavirus
YGDTLFFYLRR

SEQ ID NO: 35460 - protein, 8 aa, Artificial Sequence
  Peptide Derived from Human Papillomavirus
YIHSMNPA

SEQ ID NO: 35461 - protein, 9 aa, Artificial Sequence
  Peptide Derived from Human Papillomavirus
YIKGSGSTA

SEQ ID NO: 35462 - protein, 9 aa, Artificial Sequence
  Peptide Derived from Human Papillomavirus
YLKMVAEPY

SEQ ID NO: 35463 - protein, 9 aa, Artificial Sequence
  Peptide Derived from Human Papillomavirus
YLPPVPVSK

SEQ ID NO: 35464 - protein, 8 aa, Artificial Sequence
  Peptide Derived from Human Papillomavirus
YLRHGEEF

SEQ ID NO: 35465 - protein, 8 aa, Artificial Sequence
  Peptide Derived from Human Papillomavirus
YLRREQMF

SEQ ID NO: 35466 - protein, 10 aa, Artificial Sequence
  Peptide Derived from Human Papillomavirus
YLRREQMFVR

SEQ ID NO: 35467 - protein, 11 aa, Artificial Sequence
  Peptide Derived from Human Papillomavirus
YLRREQMFVRH

SEQ ID NO: 35468 - protein, 10 aa, Artificial Sequence
  Peptide Derived from Human Papillomavirus
YSIPKSDNPK

SEQ ID NO: 35469 - protein, 11 aa, Artificial Sequence
  Peptide Derived from Human Papillomavirus
YSIPKSDNPKK

SEQ ID NO: 35470 - protein, 9 aa, Artificial Sequence
  Peptide Derived from Human Papillomavirus
YVFWEVNLK

SEQ ID NO: 35471 - protein, 11 aa, Artificial Sequence
  Peptide Derived from Human Papillomavirus
YVFWEVNLKEK

SEQ ID NO: 35472 - protein, 8 aa, Artificial Sequence
  Peptide Derived from Human Papillomavirus
YVTRTNIY

SEQ ID NO: 35473 - protein, 9 aa, Artificial Sequence
  Peptide Derived from Human Papillomavirus
YVTRTNIYY

SEQ ID NO: 35474 - protein, 10 aa, Artificial Sequence
  Peptide Derived from Human Papillomavirus
YVTRTNIYYH

SEQ ID NO: 35475 - protein, 11 aa, Artificial Sequence
  Peptide Derived from Human Papillomavirus
YVTRTNIYYHA

SEQ ID NO: 35476 - protein, 11 aa, Artificial Sequence
  Peptide Derived from Human Papillomavirus
ADTDFTVDTPA

SEQ ID NO: 35477 - protein, 11 aa, Artificial Sequence
  Peptide Derived from Human Papillomavirus
AGTCPSDVIPK

SEQ ID NO: 35478 - protein, 11 aa, Artificial Sequence
  Peptide Derived from Human Papillomavirus
AILDVTSVSTH

SEQ ID NO: 35479 - protein, 10 aa, Artificial Sequence
  Peptide Derived from Human Papillomavirus
ALHRPALTSR

SEQ ID NO: 35480 - protein, 11 aa, Artificial Sequence
  Peptide Derived from Human Papillomavirus
ALHRPALTSRR

SEQ ID NO: 35481 - protein, 10 aa, Artificial Sequence
  Peptide Derived from Human Papillomavirus
ALTSRRNTVR

SEQ ID NO: 35482 - protein, 11 aa, Artificial Sequence
  Peptide Derived from Human Papillomavirus
ALTSRRNTVRY

SEQ ID NO: 35483 - protein, 11 aa, Artificial Sequence
  Peptide Derived from Human Papillomavirus
ASATQLYQTCK

SEQ ID NO: 35484 - protein, 10 aa, Artificial Sequence
  Peptide Derived from Human Papillomavirus
ATHNVSPSTA

SEQ ID NO: 35485 - protein, 8 aa, Artificial Sequence
  Peptide Derived from Human Papillomavirus
ATIGARVH

SEQ ID NO: 35486 - protein, 9 aa, Artificial Sequence
  Peptide Derived from Human Papillomavirus
ATIGARVHY

SEQ ID NO: 35487 - protein, 10 aa, Artificial Sequence
  Peptide Derived from Human Papillomavirus
ATIGARVHYY

SEQ ID NO: 35488 - protein, 11 aa, Artificial Sequence
  Peptide Derived from Human Papillomavirus
ATIGARVHYYY

SEQ ID NO: 35489 - protein, 9 aa, Artificial Sequence
  Peptide Derived from Human Papillomavirus
ATQLYQTCK

SEQ ID NO: 35490 - protein, 10 aa, Artificial Sequence
  Peptide Derived from Human Papillomavirus
ATQLYQTCKA

SEQ ID NO: 35491 - protein, 11 aa, Artificial Sequence
  Peptide Derived from Human Papillomavirus
ATQLYQTCKAA

SEQ ID NO: 35492 - protein, 9 aa, Artificial Sequence
  Peptide Derived from Human Papillomavirus
ATTADTTPA

SEQ ID NO: 35493 - protein, 10 aa, Artificial Sequence
  Peptide Derived from Human Papillomavirus
AVQSTSAVSA

SEQ ID NO: 35494 - protein, 11 aa, Artificial Sequence
  Peptide Derived from Human Papillomavirus
AVQSTSAVSAY

SEQ ID NO: 35495 - protein, 9 aa, Artificial Sequence
  Peptide Derived from Human Papillomavirus
DFLDIIALH

SEQ ID NO: 35496 - protein, 10 aa, Artificial Sequence
  Peptide Derived from Human Papillomavirus
DFLDIIALHR

SEQ ID NO: 35497 - protein, 8 aa, Artificial Sequence
  Peptide Derived from Human Papillomavirus
DFTVDTPA

SEQ ID NO: 35498 - protein, 10 aa, Artificial Sequence
  Peptide Derived from Human Papillomavirus
DFTVDTPATH

SEQ ID NO: 35499 - protein, 8 aa, Artificial Sequence
  Peptide Derived from Human Papillomavirus
DFYLHPSY

SEQ ID NO: 35500 - protein, 9 aa, Artificial Sequence
  Peptide Derived from Human Papillomavirus
DFYLHPSYY

SEQ ID NO: 35501 - protein, 8 aa, Artificial Sequence
  Peptide Derived from Human Papillomavirus
DGGDFYLH

SEQ ID NO: 35502 - protein, 11 aa, Artificial Sequence
  Peptide Derived from Human Papillomavirus
DGGDFYLHPSY

SEQ ID NO: 35503 - protein, 8 aa, Artificial Sequence
  Peptide Derived from Human Papillomavirus
DGLYDIYA

SEQ ID NO: 35504 - protein, 11 aa, Artificial Sequence
  Peptide Derived from Human Papillomavirus
DIATTADTTPA

SEQ ID NO: 35505 - protein, 9 aa, Artificial Sequence
  Peptide Derived from Human Papillomavirus
DIIALHRPA

SEQ ID NO: 35506 - protein, 8 aa, Artificial Sequence
  Peptide Derived from Human Papillomavirus
DISSINPA

SEQ ID NO: 35507 - protein, 8 aa, Artificial Sequence
  Peptide Derived from Human Papillomavirus
DIYADTDF

SEQ ID NO: 35508 - protein, 10 aa, Artificial Sequence
  Peptide Derived from Human Papillomavirus
DTDFTVDTPA

SEQ ID NO: 35509 - protein, 10 aa, Artificial Sequence
  Peptide Derived from Human Papillomavirus
DVGAPAPIPH

SEQ ID NO: 35510 - protein, 8 aa, Artificial Sequence
  Peptide Derived from Human Papillomavirus
DVIPKIEH

SEQ ID NO: 35511 - protein, 8 aa, Artificial Sequence
  Peptide Derived from Human Papillomavirus
DVTSVSTH

SEQ ID NO: 35512 - protein, 9 aa, Artificial Sequence
  Peptide Derived from Human Papillomavirus
EMQPLGASA

SEQ ID NO: 35513 - protein, 9 aa, Artificial Sequence
  Peptide Derived from Human Papillomavirus
ESGIVDVGA

SEQ ID NO: 35514 - protein, 11 aa, Artificial Sequence
  Peptide Derived from Human Papillomavirus
ESGIVDVGAPA

SEQ ID NO: 35515 - protein, 10 aa, Artificial Sequence
  Peptide Derived from Human Papillomavirus
ESIEMQPLGA

SEQ ID NO: 35516 - protein, 10 aa, Artificial Sequence
  Peptide Derived from Human Papillomavirus
ESLYFSNTSH

SEQ ID NO: 35517 - protein, 10 aa, Artificial Sequence
  Peptide Derived from Human Papillomavirus
ETVNAEESLY

SEQ ID NO: 35518 - protein, 11 aa, Artificial Sequence
  Peptide Derived from Human Papillomavirus
ETVNAEESLYF

SEQ ID NO: 35519 - protein, 8 aa, Artificial Sequence
  Peptide Derived from Human Papillomavirus
FFTDVSVA

SEQ ID NO: 35520 - protein, 9 aa, Artificial Sequence
  Peptide Derived from Human Papillomavirus
FFTDVSVAA

SEQ ID NO: 35521 - protein, 8 aa, Artificial Sequence
  Peptide Derived from Human Papillomavirus
FLDIIALH

SEQ ID NO: 35522 - protein, 9 aa, Artificial Sequence
  Peptide Derived from Human Papillomavirus
FLDIIALHR

SEQ ID NO: 35523 - protein, 11 aa, Artificial Sequence
  Peptide Derived from Human Papillomavirus
FLDIIALHRPA

SEQ ID NO: 35524 - protein, 11 aa, Artificial Sequence
  Peptide Derived from Human Papillomavirus
FLSAPKQLITY

SEQ ID NO: 35525 - protein, 10 aa, Artificial Sequence
  Peptide Derived from Human Papillomavirus
FSGPDVPIEH

SEQ ID NO: 35526 - protein, 11 aa, Artificial Sequence
  Peptide Derived from Human Papillomavirus
FSGPDVPIEHA

SEQ ID NO: 35527 - protein, 9 aa, Artificial Sequence
  Peptide Derived from Human Papillomavirus
FSNTSHNIA

SEQ ID NO: 35528 - protein, 8 aa, Artificial Sequence
  Peptide Derived from Human Papillomavirus
FTDVSVAA

SEQ ID NO: 35529 - protein, 9 aa, Artificial Sequence
  Peptide Derived from Human Papillomavirus
FTVDTPATH

SEQ ID NO: 35530 - protein, 8 aa, Artificial Sequence
  Peptide Derived from Human Papillomavirus
FVDGGDFY

SEQ ID NO: 35531 - protein, 10 aa, Artificial Sequence
  Peptide Derived from Human Papillomavirus
FVDGGDFYLH

SEQ ID NO: 35532 - protein, 8 aa, Artificial Sequence
  Peptide Derived from Human Papillomavirus
GAPAPIPH

SEQ ID NO: 35533 - protein, 8 aa, Artificial Sequence
  Peptide Derived from Human Papillomavirus
GARVHYYY

SEQ ID NO: 35534 - protein, 9 aa, Artificial Sequence
  Peptide Derived from Human Papillomavirus
GATIGARVH

SEQ ID NO: 35535 - protein, 10 aa, Artificial Sequence
  Peptide Derived from Human Papillomavirus
GATIGARVHY

SEQ ID NO: 35536 - protein, 11 aa, Artificial Sequence
  Peptide Derived from Human Papillomavirus
GATIGARVHYY

SEQ ID NO: 35537 - protein, 9 aa, Artificial Sequence
  Peptide Derived from Human Papillomavirus
GDFYLHPSY

SEQ ID NO: 35538 - protein, 10 aa, Artificial Sequence
  Peptide Derived from Human Papillomavirus
GDFYLHPSYY

SEQ ID NO: 35539 - protein, 8 aa, Artificial Sequence
  Peptide Derived from Human Papillomavirus
GFDIATTA

SEQ ID NO: 35540 - protein, 10 aa, Artificial Sequence
  Peptide Derived from Human Papillomavirus
GGDFYLHPSY

SEQ ID NO: 35541 - protein, 11 aa, Artificial Sequence
  Peptide Derived from Human Papillomavirus
GGDFYLHPSYY

SEQ ID NO: 35542 - protein, 11 aa, Artificial Sequence
  Peptide Derived from Human Papillomavirus
GIGSGSGTGGR

SEQ ID NO: 35543 - protein, 9 aa, Artificial Sequence
  Peptide Derived from Human Papillomavirus
GIVDVGAPA

SEQ ID NO: 35544 - protein, 11 aa, Artificial Sequence
  Peptide Derived from Human Papillomavirus
GLYDIYADTDF

SEQ ID NO: 35545 - protein, 11 aa, Artificial Sequence
  Peptide Derived from Human Papillomavirus
GLYSKATQQVK

SEQ ID NO: 35546 - protein, 9 aa, Artificial Sequence
  Peptide Derived from Human Papillomavirus
GSGSGTGGR

SEQ ID NO: 35547 - protein, 10 aa, Artificial Sequence
  Peptide Derived from Human Papillomavirus
GSGTGGRTGY

SEQ ID NO: 35548 - protein, 10 aa, Artificial Sequence
  Peptide Derived from Human Papillomavirus
GTCPSDVIPK

SEQ ID NO: 35549 - protein, 8 aa, Artificial Sequence
  Peptide Derived from Human Papillomavirus
GTGGRTGY

SEQ ID NO: 35550 - protein, 11 aa, Artificial Sequence
  Peptide Derived from Human Papillomavirus
GVRRPARLGLY

SEQ ID NO: 35551 - protein, 9 aa, Artificial Sequence
  Peptide Derived from Human Papillomavirus
HAPTQVFPF

SEQ ID NO: 35552 - protein, 10 aa, Artificial Sequence
  Peptide Derived from Human Papillomavirus
HTTIADQILR

SEQ ID NO: 35553 - protein, 11 aa, Artificial Sequence
  Peptide Derived from Human Papillomavirus
HTTIADQILRY

SEQ ID NO: 35554 - protein, 8 aa, Artificial Sequence
  Peptide Derived from Human Papillomavirus
IADQILRY

SEQ ID NO: 35555 - protein, 11 aa, Artificial Sequence
  Peptide Derived from Human Papillomavirus
IALHRPALTSR

SEQ ID NO: 35556 - protein, 10 aa, Artificial Sequence
  Peptide Derived from Human Papillomavirus
IATTADTTPA

SEQ ID NO: 35557 - protein, 8 aa, Artificial Sequence
  Peptide Derived from Human Papillomavirus
IDPTFLSA

SEQ ID NO: 35558 - protein, 10 aa, Artificial Sequence
  Peptide Derived from Human Papillomavirus
IDPTFLSAPK

SEQ ID NO: 35559 - protein, 11 aa, Artificial Sequence
  Peptide Derived from Human Papillomavirus
IFSGPDVPIEH

SEQ ID NO: 35560 - protein, 8 aa, Artificial Sequence
  Peptide Derived from Human Papillomavirus
IFVDGGDF

SEQ ID NO: 35561 - protein, 9 aa, Artificial Sequence
  Peptide Derived from Human Papillomavirus
IFVDGGDFY

SEQ ID NO: 35562 - protein, 11 aa, Artificial Sequence
  Peptide Derived from Human Papillomavirus
IFVDGGDFYLH

SEQ ID NO: 35563 - protein, 8 aa, Artificial Sequence
  Peptide Derived from Human Papillomavirus
IGARVHYY

SEQ ID NO: 35564 - protein, 9 aa, Artificial Sequence
  Peptide Derived from Human Papillomavirus
IGARVHYYY

SEQ ID NO: 35565 - protein, 10 aa, Artificial Sequence
  Peptide Derived from Human Papillomavirus
IGSGSGTGGR

SEQ ID NO: 35566 - protein, 8 aa, Artificial Sequence
  Peptide Derived from Human Papillomavirus
IIALHRPA

SEQ ID NO: 35567 - protein, 10 aa, Artificial Sequence
  Peptide Derived from Human Papillomavirus
ILDVTSVSTH

SEQ ID NO: 35568 - protein, 10 aa, Artificial Sequence
  Peptide Derived from Human Papillomavirus
ILRYGSMGVF

SEQ ID NO: 35569 - protein, 11 aa, Artificial Sequence
  Peptide Derived from Human Papillomavirus
ILRYGSMGVFF

SEQ ID NO: 35570 - protein, 11 aa, Artificial Sequence
  Peptide Derived from Human Papillomavirus
ITSSTPIPGVR

SEQ ID NO: 35571 - protein, 8 aa, Artificial Sequence
  Peptide Derived from Human Papillomavirus
ITYENPAY

SEQ ID NO: 35572 - protein, 8 aa, Artificial Sequence
  Peptide Derived from Human Papillomavirus
IVDVGAPA

SEQ ID NO: 35573 - protein, 8 aa, Artificial Sequence
  Peptide Derived from Human Papillomavirus
KIEHTTIA

SEQ ID NO: 35574 - protein, 10 aa, Artificial Sequence
  Peptide Derived from Human Papillomavirus
KVIDPTFLSA

SEQ ID NO: 35575 - protein, 11 aa, Artificial Sequence
  Peptide Derived from Human Papillomavirus
LAPTTPQVSIF

SEQ ID NO: 35576 - protein, 8 aa, Artificial Sequence
  Peptide Derived from Human Papillomavirus
LDIIALHR

SEQ ID NO: 35577 - protein, 10 aa, Artificial Sequence
  Peptide Derived from Human Papillomavirus
LDIIALHRPA

SEQ ID NO: 35578 - protein, 9 aa, Artificial Sequence
  Peptide Derived from Human Papillomavirus
LDVTSVSTH

SEQ ID NO: 35579 - protein, 8 aa, Artificial Sequence
  Peptide Derived from Human Papillomavirus
LGNKQTLR

SEQ ID NO: 35580 - protein, 10 aa, Artificial Sequence
  Peptide Derived from Human Papillomavirus
LGNKQTLRTR

SEQ ID NO: 35581 - protein, 8 aa, Artificial Sequence
  Peptide Derived from Human Papillomavirus
LITYENPA

SEQ ID NO: 35582 - protein, 9 aa, Artificial Sequence
  Peptide Derived from Human Papillomavirus
LITYENPAY

SEQ ID NO: 35583 - protein, 11 aa, Artificial Sequence
  Peptide Derived from Human Papillomavirus
LLLSSSSISTH

SEQ ID NO: 35584 - protein, 10 aa, Artificial Sequence
  Peptide Derived from Human Papillomavirus
LLSSSSISTH

SEQ ID NO: 35585 - protein, 10 aa, Artificial Sequence
  Peptide Derived from Human Papillomavirus
LSAPKQLITY

SEQ ID NO: 35586 - protein, 9 aa, Artificial Sequence
  Peptide Derived from Human Papillomavirus
LSSSSISTH

SEQ ID NO: 35587 - protein, 11 aa, Artificial Sequence
  Peptide Derived from Human Papillomavirus
LSSSSISTHNY

SEQ ID NO: 35588 - protein, 10 aa, Artificial Sequence
  Peptide Derived from Human Papillomavirus
LSTGFDIPIF

SEQ ID NO: 35589 - protein, 11 aa, Artificial Sequence
  Peptide Derived from Human Papillomavirus
LSTRPSTVSEA

SEQ ID NO: 35590 - protein, 9 aa, Artificial Sequence
  Peptide Derived from Human Papillomavirus
LTSRRNTVR

SEQ ID NO: 35591 - protein, 10 aa, Artificial Sequence
  Peptide Derived from Human Papillomavirus
LTSRRNTVRY

SEQ ID NO: 35592 - protein, 8 aa, Artificial Sequence
  Peptide Derived from Human Papillomavirus
MLKRRRKR

SEQ ID NO: 35593 - protein, 11 aa, Artificial Sequence
  Peptide Derived from Human Papillomavirus
MLKRRRKRVSY

SEQ ID NO: 35594 - protein, 8 aa, Artificial Sequence
  Peptide Derived from Human Papillomavirus
NAEESLYF

SEQ ID NO: 35595 - protein, 8 aa, Artificial Sequence
  Peptide Derived from Human Papillomavirus
NDGLYDIY

SEQ ID NO: 35596 - protein, 9 aa, Artificial Sequence
  Peptide Derived from Human Papillomavirus
NDGLYDIYA

SEQ ID NO: 35597 - protein, 8 aa, Artificial Sequence
  Peptide Derived from Human Papillomavirus
NIAPDPDF

SEQ ID NO: 35598 - protein, 10 aa, Artificial Sequence
  Peptide Derived from Human Papillomavirus
NTTVPLSTGF

SEQ ID NO: 35599 - protein, 11 aa, Artificial Sequence
  Peptide Derived from Human Papillomavirus
NTVRYSRLGNK

SEQ ID NO: 35600 - protein, 11 aa, Artificial Sequence
  Peptide Derived from Human Papillomavirus
PALTSRRNTVR

SEQ ID NO: 35601 - protein, 9 aa, Artificial Sequence
  Peptide Derived from Human Papillomavirus
PARLGLYSK

SEQ ID NO: 35602 - protein, 10 aa, Artificial Sequence
  Peptide Derived from Human Papillomavirus
PARLGLYSKA

SEQ ID NO: 35603 - protein, 11 aa, Artificial Sequence
  Peptide Derived from Human Papillomavirus
PATHNVSPSTA

SEQ ID NO: 35604 - protein, 8 aa, Artificial Sequence
  Peptide Derived from Human Papillomavirus
PAYETVNA

SEQ ID NO: 35605 - protein, 8 aa, Artificial Sequence
  Peptide Derived from Human Papillomavirus
PDFLDIIA

SEQ ID NO: 35606 - protein, 10 aa, Artificial Sequence
  Peptide Derived from Human Papillomavirus
PDFLDIIALH

SEQ ID NO: 35607 - protein, 11 aa, Artificial Sequence
  Peptide Derived from Human Papillomavirus
PDFLDIIALHR

SEQ ID NO: 35608 - protein, 10 aa, Artificial Sequence
  Peptide Derived from Human Papillomavirus
PDPDFLDIIA

SEQ ID NO: 35609 - protein, 8 aa, Artificial Sequence
  Peptide Derived from Human Papillomavirus
PDVPIEHA

SEQ ID NO: 35610 - protein, 8 aa, Artificial Sequence
  Peptide Derived from Human Papillomavirus
PGVRRPAR

SEQ ID NO: 35611 - protein, 10 aa, Artificial Sequence
  Peptide Derived from Human Papillomavirus
PIEHAPTQVF

SEQ ID NO: 35612 - protein, 9 aa, Artificial Sequence
  Peptide Derived from Human Papillomavirus
PIPGVRRPA

SEQ ID NO: 35613 - protein, 10 aa, Artificial Sequence
  Peptide Derived from Human Papillomavirus
PIPGVRRPAR

SEQ ID NO: 35614 - protein, 11 aa, Artificial Sequence
  Peptide Derived from Human Papillomavirus
PIPHPPTTSGF

SEQ ID NO: 35615 - protein, 11 aa, Artificial Sequence
  Peptide Derived from Human Papillomavirus
PLSTGFDIPIF

SEQ ID NO: 35616 - protein, 10 aa, Artificial Sequence
  Peptide Derived from Human Papillomavirus
PSDVIPKIEH

SEQ ID NO: 35617 - protein, 10 aa, Artificial Sequence
  Peptide Derived from Human Papillomavirus
PSTAVQSTSA

SEQ ID NO: 35618 - protein, 10 aa, Artificial Sequence
  Peptide Derived from Human Papillomavirus
PSVLQPPTPA

SEQ ID NO: 35619 - protein, 8 aa, Artificial Sequence
  Peptide Derived from Human Papillomavirus
PSYYMLKR

SEQ ID NO: 35620 - protein, 9 aa, Artificial Sequence
  Peptide Derived from Human Papillomavirus
PSYYMLKRR

SEQ ID NO: 35621 - protein, 10 aa, Artificial Sequence
  Peptide Derived from Human Papillomavirus
PSYYMLKRRR

SEQ ID NO: 35622 - protein, 11 aa, Artificial Sequence
  Peptide Derived from Human Papillomavirus
PSYYMLKRRRK

SEQ ID NO: 35623 - protein, 8 aa, Artificial Sequence
  Peptide Derived from Human Papillomavirus
PTFLSAPK

SEQ ID NO: 35624 - protein, 9 aa, Artificial Sequence
  Peptide Derived from Human Papillomavirus
PTPAETSGH

SEQ ID NO: 35625 - protein, 10 aa, Artificial Sequence
  Peptide Derived from Human Papillomavirus
PTQVFPFPLA

SEQ ID NO: 35626 - protein, 9 aa, Artificial Sequence
  Peptide Derived from Human Papillomavirus
PTTPQVSIF

SEQ ID NO: 35627 - protein, 9 aa, Artificial Sequence
  Peptide Derived from Human Papillomavirus
PTTSGFDIA

SEQ ID NO: 35628 - protein, 11 aa, Artificial Sequence
  Peptide Derived from Human Papillomavirus
QILRYGSMGVF

SEQ ID NO: 35629 - protein, 9 aa, Artificial Sequence
  Peptide Derived from Human Papillomavirus
QLITYENPA

SEQ ID NO: 35630 - protein, 10 aa, Artificial Sequence
  Peptide Derived from Human Papillomavirus
QLITYENPAY

SEQ ID NO: 35631 - protein, 8 aa, Artificial Sequence
  Peptide Derived from Human Papillomavirus
QLYQTCKA

SEQ ID NO: 35632 - protein, 9 aa, Artificial Sequence
  Peptide Derived from Human Papillomavirus
QLYQTCKAA

SEQ ID NO: 35633 - protein, 8 aa, Artificial Sequence
  Peptide Derived from Human Papillomavirus
QSTSAVSA

SEQ ID NO: 35634 - protein, 9 aa, Artificial Sequence
  Peptide Derived from Human Papillomavirus
QSTSAVSAY

SEQ ID NO: 35635 - protein, 9 aa, Artificial Sequence
  Peptide Derived from Human Papillomavirus
QTLRTRSGA

SEQ ID NO: 35636 - protein, 8 aa, Artificial Sequence
  Peptide Derived from Human Papillomavirus
QVFPFPLA

SEQ ID NO: 35637 - protein, 9 aa, Artificial Sequence
  Peptide Derived from Human Papillomavirus
QVKVIDPTF

SEQ ID NO: 35638 - protein, 11 aa, Artificial Sequence
  Peptide Derived from Human Papillomavirus
QVSIFVDGGDF

SEQ ID NO: 35639 - protein, 8 aa, Artificial Sequence
  Peptide Derived from Human Papillomavirus
RASATQLY

SEQ ID NO: 35640 - protein, 8 aa, Artificial Sequence
  Peptide Derived from Human Papillomavirus
RLGLYSKA

SEQ ID NO: 35641 - protein, 9 aa, Artificial Sequence
  Peptide Derived from Human Papillomavirus
RLGNKQTLR

SEQ ID NO: 35642 - protein, 11 aa, Artificial Sequence
  Peptide Derived from Human Papillomavirus
RLGNKQTLRTR

SEQ ID NO: 35643 - protein, 8 aa, Artificial Sequence
  Peptide Derived from Human Papillomavirus
RSGATIGA

SEQ ID NO: 35644 - protein, 9 aa, Artificial Sequence
  Peptide Derived from Human Papillomavirus
RSGATIGAR

SEQ ID NO: 35645 - protein, 11 aa, Artificial Sequence
  Peptide Derived from Human Papillomavirus
RSGATIGARVH

SEQ ID NO: 35646 - protein, 8 aa, Artificial Sequence
  Peptide Derived from Human Papillomavirus
RSKRSTKR

SEQ ID NO: 35647 - protein, 10 aa, Artificial Sequence
  Peptide Derived from Human Papillomavirus
RSKRSTKRTK

SEQ ID NO: 35648 - protein, 11 aa, Artificial Sequence
  Peptide Derived from Human Papillomavirus
RSKRSTKRTKR

SEQ ID NO: 35649 - protein, 8 aa, Artificial Sequence
  Peptide Derived from Human Papillomavirus
RSTKRTKR

SEQ ID NO: 35650 - protein, 9 aa, Artificial Sequence
  Peptide Derived from Human Papillomavirus
RSTKRTKRA

SEQ ID NO: 35651 - protein, 11 aa, Artificial Sequence
  Peptide Derived from Human Papillomavirus
RSTKRTKRASA

SEQ ID NO: 35652 - protein, 10 aa, Artificial Sequence
  Peptide Derived from Human Papillomavirus
RTGYVPLSTR

SEQ ID NO: 35653 - protein, 11 aa, Artificial Sequence
  Peptide Derived from Human Papillomavirus
RTKRASATQLY

SEQ ID NO: 35654 - protein, 10 aa, Artificial Sequence
  Peptide Derived from Human Papillomavirus
RTRSGATIGA

SEQ ID NO: 35655 - protein, 11 aa, Artificial Sequence
  Peptide Derived from Human Papillomavirus
RTRSGATIGAR

SEQ ID NO: 35656 - protein, 9 aa, Artificial Sequence
  Peptide Derived from Human Papillomavirus
SAPKQLITY

SEQ ID NO: 35657 - protein, 10 aa, Artificial Sequence
  Peptide Derived from Human Papillomavirus
SATQLYQTCK

SEQ ID NO: 35658 - protein, 11 aa, Artificial Sequence
  Peptide Derived from Human Papillomavirus
SATQLYQTCKA

SEQ ID NO: 35659 - protein, 9 aa, Artificial Sequence
  Peptide Derived from Human Papillomavirus
SDVIPKIEH

SEQ ID NO: 35660 - protein, 8 aa, Artificial Sequence
  Peptide Derived from Human Papillomavirus
SGATIGAR

SEQ ID NO: 35661 - protein, 10 aa, Artificial Sequence
  Peptide Derived from Human Papillomavirus
SGATIGARVH

SEQ ID NO: 35662 - protein, 11 aa, Artificial Sequence
  Peptide Derived from Human Papillomavirus
SGATIGARVHY

SEQ ID NO: 35663 - protein, 9 aa, Artificial Sequence
  Peptide Derived from Human Papillomavirus
SGFDIATTA

SEQ ID NO: 35664 - protein, 8 aa, Artificial Sequence
  Peptide Derived from Human Papillomavirus
SGIVDVGA

SEQ ID NO: 35665 - protein, 10 aa, Artificial Sequence
  Peptide Derived from Human Papillomavirus
SGIVDVGAPA

SEQ ID NO: 35666 - protein, 9 aa, Artificial Sequence
  Peptide Derived from Human Papillomavirus
SGPDVPIEH

SEQ ID NO: 35667 - protein, 10 aa, Artificial Sequence
  Peptide Derived from Human Papillomavirus
SGPDVPIEHA

SEQ ID NO: 35668 - protein, 8 aa, Artificial Sequence
  Peptide Derived from Human Papillomavirus
SGSGTGGR

SEQ ID NO: 35669 - protein, 11 aa, Artificial Sequence
  Peptide Derived from Human Papillomavirus
SGSGTGGRTGY

SEQ ID NO: 35670 - protein, 9 aa, Artificial Sequence
  Peptide Derived from Human Papillomavirus
SGTGGRTGY

SEQ ID NO: 35671 - protein, 9 aa, Artificial Sequence
  Peptide Derived from Human Papillomavirus
SIEMQPLGA

SEQ ID NO: 35672 - protein, 11 aa, Artificial Sequence
  Peptide Derived from Human Papillomavirus
SIEMQPLGASA

SEQ ID NO: 35673 - protein, 9 aa, Artificial Sequence
  Peptide Derived from Human Papillomavirus
SIFVDGGDF

SEQ ID NO: 35674 - protein, 10 aa, Artificial Sequence
  Peptide Derived from Human Papillomavirus
SIFVDGGDFY

SEQ ID NO: 35675 - protein, 9 aa, Artificial Sequence
  Peptide Derived from Human Papillomavirus
SLYFSNTSH

SEQ ID NO: 35676 - protein, 8 aa, Artificial Sequence
  Peptide Derived from Human Papillomavirus
SSISTHNY

SEQ ID NO: 35677 - protein, 9 aa, Artificial Sequence
  Peptide Derived from Human Papillomavirus
SSSISTHNY

SEQ ID NO: 35678 - protein, 8 aa, Artificial Sequence
  Peptide Derived from Human Papillomavirus
SSSSISTH

SEQ ID NO: 35679 - protein, 10 aa, Artificial Sequence
  Peptide Derived from Human Papillomavirus
SSSSISTHNY

SEQ ID NO: 35680 - protein, 9 aa, Artificial Sequence
  Peptide Derived from Human Papillomavirus
SSTPIPGVR

SEQ ID NO: 35681 - protein, 10 aa, Artificial Sequence
  Peptide Derived from Human Papillomavirus
SSTPIPGVRR

SEQ ID NO: 35682 - protein, 9 aa, Artificial Sequence
  Peptide Derived from Human Papillomavirus
STAVQSTSA

SEQ ID NO: 35683 - protein, 9 aa, Artificial Sequence
  Peptide Derived from Human Papillomavirus
STGFDIPIF

SEQ ID NO: 35684 - protein, 8 aa, Artificial Sequence
  Peptide Derived from Human Papillomavirus
STHENPTF

SEQ ID NO: 35685 - protein, 8 aa, Artificial Sequence
  Peptide Derived from Human Papillomavirus
STKRTKRA

SEQ ID NO: 35686 - protein, 10 aa, Artificial Sequence
  Peptide Derived from Human Papillomavirus
STKRTKRASA

SEQ ID NO: 35687 - protein, 8 aa, Artificial Sequence
  Peptide Derived from Human Papillomavirus
STLNDGLY

SEQ ID NO: 35688 - protein, 11 aa, Artificial Sequence
  Peptide Derived from Human Papillomavirus
STLNDGLYDIY

SEQ ID NO: 35689 - protein, 8 aa, Artificial Sequence
  Peptide Derived from Human Papillomavirus
STPIPGVR

SEQ ID NO: 35690 - protein, 9 aa, Artificial Sequence
  Peptide Derived from Human Papillomavirus
STPIPGVRR

SEQ ID NO: 35691 - protein, 11 aa, Artificial Sequence
  Peptide Derived from Human Papillomavirus
STPIPGVRRPA

SEQ ID NO: 35692 - protein, 10 aa, Artificial Sequence
  Peptide Derived from Human Papillomavirus
STRPSTVSEA

SEQ ID NO: 35693 - protein, 8 aa, Artificial Sequence
  Peptide Derived from Human Papillomavirus
STSAVSAY

SEQ ID NO: 35694 - protein, 11 aa, Artificial Sequence
  Peptide Derived from Human Papillomavirus
STVSEASIPIR

SEQ ID NO: 35695 - protein, 9 aa, Artificial Sequence
  Peptide Derived from Human Papillomavirus
SVLQPPTPA

SEQ ID NO: 35696 - protein, 10 aa, Artificial Sequence
  Peptide Derived from Human Papillomavirus
SVSTHENPTF

SEQ ID NO: 35697 - protein, 8 aa, Artificial Sequence
  Peptide Derived from Human Papillomavirus
TAVQSTSA

SEQ ID NO: 35698 - protein, 11 aa, Artificial Sequence
  Peptide Derived from Human Papillomavirus
TAVQSTSAVSA

SEQ ID NO: 35699 - protein, 9 aa, Artificial Sequence
  Peptide Derived from Human Papillomavirus
TCPSDVIPK

SEQ ID NO: 35700 - protein, 9 aa, Artificial Sequence
  Peptide Derived from Human Papillomavirus
TDFTVDTPA

SEQ ID NO: 35701 - protein, 11 aa, Artificial Sequence
  Peptide Derived from Human Papillomavirus
TDFTVDTPATH

SEQ ID NO: 35702 - protein, 8 aa, Artificial Sequence
  Peptide Derived from Human Papillomavirus
TGFDIPIF

SEQ ID NO: 35703 - protein, 9 aa, Artificial Sequence
  Peptide Derived from Human Papillomavirus
TGYVPLSTR

SEQ ID NO: 35704 - protein, 8 aa, Artificial Sequence
  Peptide Derived from Human Papillomavirus
TIADQILR

SEQ ID NO: 35705 - protein, 9 aa, Artificial Sequence
  Peptide Derived from Human Papillomavirus
TIADQILRY

SEQ ID NO: 35706 - protein, 8 aa, Artificial Sequence
  Peptide Derived from Human Papillomavirus
TIGARVHY

SEQ ID NO: 35707 - protein, 9 aa, Artificial Sequence
  Peptide Derived from Human Papillomavirus
TIGARVHYY

SEQ ID NO: 35708 - protein, 10 aa, Artificial Sequence
  Peptide Derived from Human Papillomavirus
TIGARVHYYY

SEQ ID NO: 35709 - protein, 10 aa, Artificial Sequence
  Peptide Derived from Human Papillomavirus
TLNDGLYDIY

SEQ ID NO: 35710 - protein, 11 aa, Artificial Sequence
  Peptide Derived from Human Papillomavirus
TLNDGLYDIYA

SEQ ID NO: 35711 - protein, 8 aa, Artificial Sequence
  Peptide Derived from Human Papillomavirus
TLRTRSGA

SEQ ID NO: 35712 - protein, 10 aa, Artificial Sequence
  Peptide Derived from Human Papillomavirus
TSGFDIATTA

SEQ ID NO: 35713 - protein, 11 aa, Artificial Sequence
  Peptide Derived from Human Papillomavirus
TSHNIAPDPDF

SEQ ID NO: 35714 - protein, 8 aa, Artificial Sequence
  Peptide Derived from Human Papillomavirus
TSRRNTVR

SEQ ID NO: 35715 - protein, 9 aa, Artificial Sequence
  Peptide Derived from Human Papillomavirus
TSRRNTVRY

SEQ ID NO: 35716 - protein, 11 aa, Artificial Sequence
  Peptide Derived from Human Papillomavirus
TSRRNTVRYSR

SEQ ID NO: 35717 - protein, 10 aa, Artificial Sequence
  Peptide Derived from Human Papillomavirus
TSSTPIPGVR

SEQ ID NO: 35718 - protein, 11 aa, Artificial Sequence
  Peptide Derived from Human Papillomavirus
TSSTPIPGVRR

SEQ ID NO: 35719 - protein, 9 aa, Artificial Sequence
  Peptide Derived from Human Papillomavirus
TSTLNDGLY

SEQ ID NO: 35720 - protein, 11 aa, Artificial Sequence
  Peptide Derived from Human Papillomavirus
TSVSTHENPTF

SEQ ID NO: 35721 - protein, 8 aa, Artificial Sequence
  Peptide Derived from Human Papillomavirus
TTADTTPA

SEQ ID NO: 35722 - protein, 9 aa, Artificial Sequence
  Peptide Derived from Human Papillomavirus
TTIADQILR

SEQ ID NO: 35723 - protein, 10 aa, Artificial Sequence
  Peptide Derived from Human Papillomavirus
TTIADQILRY

SEQ ID NO: 35724 - protein, 8 aa, Artificial Sequence
  Peptide Derived from Human Papillomavirus
TTPQVSIF

SEQ ID NO: 35725 - protein, 8 aa, Artificial Sequence
  Peptide Derived from Human Papillomavirus
TTSGFDIA

SEQ ID NO: 35726 - protein, 11 aa, Artificial Sequence
  Peptide Derived from Human Papillomavirus
TTSGFDIATTA

SEQ ID NO: 35727 - protein, 10 aa, Artificial Sequence
  Peptide Derived from Human Papillomavirus
TTSTLNDGLY

SEQ ID NO: 35728 - protein, 11 aa, Artificial Sequence
  Peptide Derived from Human Papillomavirus
TTTSTLNDGLY

SEQ ID NO: 35729 - protein, 9 aa, Artificial Sequence
  Peptide Derived from Human Papillomavirus
TTVPLSTGF

SEQ ID NO: 35730 - protein, 8 aa, Artificial Sequence
  Peptide Derived from Human Papillomavirus
TVDTPATH

SEQ ID NO: 35731 - protein, 9 aa, Artificial Sequence
  Peptide Derived from Human Papillomavirus
TVNAEESLY

SEQ ID NO: 35732 - protein, 10 aa, Artificial Sequence
  Peptide Derived from Human Papillomavirus
TVNAEESLYF

SEQ ID NO: 35733 - protein, 8 aa, Artificial Sequence
  Peptide Derived from Human Papillomavirus
TVPLSTGF

SEQ ID NO: 35734 - protein, 10 aa, Artificial Sequence
  Peptide Derived from Human Papillomavirus
TVRYSRLGNK

SEQ ID NO: 35735 - protein, 10 aa, Artificial Sequence
  Peptide Derived from Human Papillomavirus
TVSEASIPIR

SEQ ID NO: 35736 - protein, 9 aa, Artificial Sequence
  Peptide Derived from Human Papillomavirus
VDGGDFYLH

SEQ ID NO: 35737 - protein, 11 aa, Artificial Sequence
  Peptide Derived from Human Papillomavirus
VDVGAPAPIPH

SEQ ID NO: 35738 - protein, 9 aa, Artificial Sequence
  Peptide Derived from Human Papillomavirus
VGAPAPIPH

SEQ ID NO: 35739 - protein, 9 aa, Artificial Sequence
  Peptide Derived from Human Papillomavirus
VIDPTFLSA

SEQ ID NO: 35740 - protein, 11 aa, Artificial Sequence
  Peptide Derived from Human Papillomavirus
VIDPTFLSAPK

SEQ ID NO: 35741 - protein, 11 aa, Artificial Sequence
  Peptide Derived from Human Papillomavirus
VIPKIEHTTIA

SEQ ID NO: 35742 - protein, 8 aa, Artificial Sequence
  Peptide Derived from Human Papillomavirus
VLQPPTPA

SEQ ID NO: 35743 - protein, 9 aa, Artificial Sequence
  Peptide Derived from Human Papillomavirus
VSEASIPIR

SEQ ID NO: 35744 - protein, 10 aa, Artificial Sequence
  Peptide Derived from Human Papillomavirus
VSIFVDGGDF

SEQ ID NO: 35745 - protein, 11 aa, Artificial Sequence
  Peptide Derived from Human Papillomavirus
VSIFVDGGDFY

SEQ ID NO: 35746 - protein, 9 aa, Artificial Sequence
  Peptide Derived from Human Papillomavirus
VSTHENPTF

SEQ ID NO: 35747 - protein, 11 aa, Artificial Sequence
  Peptide Derived from Human Papillomavirus
VSYFFTDVSVA

SEQ ID NO: 35748 - protein, 9 aa, Artificial Sequence
  Peptide Derived from Human Papillomavirus
YDISSINPA

SEQ ID NO: 35749 - protein, 9 aa, Artificial Sequence
  Peptide Derived from Human Papillomavirus
YDIYADTDF

SEQ ID NO: 35750 - protein, 9 aa, Artificial Sequence
  Peptide Derived from Human Papillomavirus
YFFTDVSVA

SEQ ID NO: 35751 - protein, 10 aa, Artificial Sequence
  Peptide Derived from Human Papillomavirus
YFFTDVSVAA

SEQ ID NO: 35752 - protein, 10 aa, Artificial Sequence
  Peptide Derived from Human Papillomavirus
YFSNTSHNIA

SEQ ID NO: 35753 - protein, 8 aa, Artificial Sequence
  Peptide Derived from Human Papillomavirus
YGSMGVFF

SEQ ID NO: 35754 - protein, 10 aa, Artificial Sequence
  Peptide Derived from Human Papillomavirus
YLHPSYYMLK

SEQ ID NO: 35755 - protein, 11 aa, Artificial Sequence
  Peptide Derived from Human Papillomavirus
YLHPSYYMLKR

SEQ ID NO: 35756 - protein, 8 aa, Artificial Sequence
  Peptide Derived from Human Papillomavirus
YMLKRRRK

SEQ ID NO: 35757 - protein, 9 aa, Artificial Sequence
  Peptide Derived from Human Papillomavirus
YMLKRRRKR

SEQ ID NO: 35758 - protein, 9 aa, Artificial Sequence
  Peptide Derived from Human Papillomavirus
YSKATQQVK

SEQ ID NO: 35759 - protein, 11 aa, Artificial Sequence
  Peptide Derived from Human Papillomavirus
YSRLGNKQTLR

SEQ ID NO: 35760 - protein, 11 aa, Artificial Sequence
  Peptide Derived from Human Papillomavirus
AAAFLKSNSQA

SEQ ID NO: 35761 - protein, 8 aa, Artificial Sequence
  Peptide Derived from Human Papillomavirus
AACSQSAA

SEQ ID NO: 35762 - protein, 8 aa, Artificial Sequence
  Peptide Derived from Human Papillomavirus
AAEDVVDR

SEQ ID NO: 35763 - protein, 9 aa, Artificial Sequence
  Peptide Derived from Human Papillomavirus
AAEDVVDRA

SEQ ID NO: 35764 - protein, 10 aa, Artificial Sequence
  Peptide Derived from Human Papillomavirus
AAEDVVDRAA

SEQ ID NO: 35765 - protein, 10 aa, Artificial Sequence
  Peptide Derived from Human Papillomavirus
AAFLKSNSQA

SEQ ID NO: 35766 - protein, 11 aa, Artificial Sequence
  Peptide Derived from Human Papillomavirus
AAFLKSNSQAK

SEQ ID NO: 35767 - protein, 11 aa, Artificial Sequence
  Peptide Derived from Human Papillomavirus
AANPCRTSINK

SEQ ID NO: 35768 - protein, 11 aa, Artificial Sequence
  Peptide Derived from Human Papillomavirus
ADDSGTDLLEF

SEQ ID NO: 35769 - protein, 9 aa, Artificial Sequence
  Peptide Derived from Human Papillomavirus
ADPEGTNGA

SEQ ID NO: 35770 - protein, 8 aa, Artificial Sequence
  Peptide Derived from Human Papillomavirus
ADSNSNAA

SEQ ID NO: 35771 - protein, 9 aa, Artificial Sequence
  Peptide Derived from Human Papillomavirus
ADSNSNAAA

SEQ ID NO: 35772 - protein, 10 aa, Artificial Sequence
  Peptide Derived from Human Papillomavirus
ADSNSNAAAF

SEQ ID NO: 35773 - protein, 8 aa, Artificial Sequence
  Peptide Derived from Human Papillomavirus
ADTEAARA

SEQ ID NO: 35774 - protein, 10 aa, Artificial Sequence
  Peptide Derived from Human Papillomavirus
ADTEAARALF

SEQ ID NO: 35775 - protein, 11 aa, Artificial Sequence
  Peptide Derived from Human Papillomavirus
AFKKFLKGIPK

SEQ ID NO: 35776 - protein, 8 aa, Artificial Sequence
  Peptide Derived from Human Papillomavirus
AFLGAFKK

SEQ ID NO: 35777 - protein, 9 aa, Artificial Sequence
  Peptide Derived from Human Papillomavirus
AFLGAFKKF

SEQ ID NO: 35778 - protein, 11 aa, Artificial Sequence
  Peptide Derived from Human Papillomavirus
AFLGAFKKFLK

SEQ ID NO: 35779 - protein, 9 aa, Artificial Sequence
  Peptide Derived from Human Papillomavirus
AFLKSNSQA

SEQ ID NO: 35780 - protein, 10 aa, Artificial Sequence
  Peptide Derived from Human Papillomavirus
AFLKSNSQAK

SEQ ID NO: 35781 - protein, 9 aa, Artificial Sequence
  Peptide Derived from Human Papillomavirus
AGENTRSLR

SEQ ID NO: 35782 - protein, 9 aa, Artificial Sequence
  Peptide Derived from Human Papillomavirus
AGMGCTGWF

SEQ ID NO: 35783 - protein, 9 aa, Artificial Sequence
  Peptide Derived from Human Papillomavirus
AGTDSRWPY

SEQ ID NO: 35784 - protein, 11 aa, Artificial Sequence
  Peptide Derived from Human Papillomavirus
AGTDSRWPYLH

SEQ ID NO: 35785 - protein, 8 aa, Artificial Sequence
  Peptide Derived from Human Papillomavirus
AINDENWK

SEQ ID NO: 35786 - protein, 10 aa, Artificial Sequence
  Peptide Derived from Human Papillomavirus
AINDENWKSF

SEQ ID NO: 35787 - protein, 11 aa, Artificial Sequence
  Peptide Derived from Human Papillomavirus
AINDENWKSFF

SEQ ID NO: 35788 - protein, 8 aa, Artificial Sequence
  Peptide Derived from Human Papillomavirus
ALKRKFAA

SEQ ID NO: 35789 - protein, 8 aa, Artificial Sequence
  Peptide Derived from Human Papillomavirus
ALYWFRTA

SEQ ID NO: 35790 - protein, 8 aa, Artificial Sequence
  Peptide Derived from Human Papillomavirus
AVCALKRK

SEQ ID NO: 35791 - protein, 9 aa, Artificial Sequence
  Peptide Derived from Human Papillomavirus
AVCALKRKF

SEQ ID NO: 35792 - protein, 10 aa, Artificial Sequence
  Peptide Derived from Human Papillomavirus
AVCALKRKFA

SEQ ID NO: 35793 - protein, 11 aa, Artificial Sequence
  Peptide Derived from Human Papillomavirus
AVCALKRKFAA

SEQ ID NO: 35794 - protein, 8 aa, Artificial Sequence
  Peptide Derived from Human Papillomavirus
CALKRKFA

SEQ ID NO: 35795 - protein, 9 aa, Artificial Sequence
  Peptide Derived from Human Papillomavirus
CALKRKFAA

SEQ ID NO: 35796 - protein, 9 aa, Artificial Sequence
  Peptide Derived from Human Papillomavirus
CALYWFRTA

SEQ ID NO: 35797 - protein, 8 aa, Artificial Sequence
  Peptide Derived from Human Papillomavirus
CGIMCRHY

SEQ ID NO: 35798 - protein, 9 aa, Artificial Sequence
  Peptide Derived from Human Papillomavirus
CGIMCRHYK

SEQ ID NO: 35799 - protein, 10 aa, Artificial Sequence
  Peptide Derived from Human Papillomavirus
CGIMCRHYKK

SEQ ID NO: 35800 - protein, 11 aa, Artificial Sequence
  Peptide Derived from Human Papillomavirus
CGIMCRHYKKA

SEQ ID NO: 35801 - protein, 8 aa, Artificial Sequence
  Peptide Derived from Human Papillomavirus
CGPANTGK

SEQ ID NO: 35802 - protein, 10 aa, Artificial Sequence
  Peptide Derived from Human Papillomavirus
CGPANTGKSY

SEQ ID NO: 35803 - protein, 11 aa, Artificial Sequence
  Peptide Derived from Human Papillomavirus
CGPANTGKSYF

SEQ ID NO: 35804 - protein, 8 aa, Artificial Sequence
  Peptide Derived from Human Papillomavirus
CMLICGPA

SEQ ID NO: 35805 - protein, 8 aa, Artificial Sequence
  Peptide Derived from Human Papillomavirus
CMVIEPPK

SEQ ID NO: 35806 - protein, 10 aa, Artificial Sequence
  Peptide Derived from Human Papillomavirus
CMVIEPPKLR

SEQ ID NO: 35807 - protein, 8 aa, Artificial Sequence
  Peptide Derived from Human Papillomavirus
CSAGENTR

SEQ ID NO: 35808 - protein, 11 aa, Artificial Sequence
  Peptide Derived from Human Papillomavirus
CSAGENTRSLR

SEQ ID NO: 35809 - protein, 9 aa, Artificial Sequence
  Peptide Derived from Human Papillomavirus
CSKNRLTVA

SEQ ID NO: 35810 - protein, 10 aa, Artificial Sequence
  Peptide Derived from Human Papillomavirus
CSKNRLTVAK

SEQ ID NO: 35811 - protein, 9 aa, Artificial Sequence
  Peptide Derived from Human Papillomavirus
CTDWCITGY

SEQ ID NO: 35812 - protein, 9 aa, Artificial Sequence
  Peptide Derived from Human Papillomavirus
CTGWFEVEA

SEQ ID NO: 35813 - protein, 9 aa, Artificial Sequence
  Peptide Derived from Human Papillomavirus
CVISCVNSK

SEQ ID NO: 35814 - protein, 11 aa, Artificial Sequence
  Peptide Derived from Human Papillomavirus
CVISCVNSKSH

SEQ ID NO: 35815 - protein, 8 aa, Artificial Sequence
  Peptide Derived from Human Papillomavirus
CVNSKSHF

SEQ ID NO: 35816 - protein, 8 aa, Artificial Sequence
  Peptide Derived from Human Papillomavirus
DCGIMCRH

SEQ ID NO: 35817 - protein, 9 aa, Artificial Sequence
  Peptide Derived from Human Papillomavirus
DCGIMCRHY

SEQ ID NO: 35818 - protein, 10 aa, Artificial Sequence
  Peptide Derived from Human Papillomavirus
DCGIMCRHYK

SEQ ID NO: 35819 - protein, 11 aa, Artificial Sequence
  Peptide Derived from Human Papillomavirus
DCGIMCRHYKK

SEQ ID NO: 35820 - protein, 8 aa, Artificial Sequence
  Peptide Derived from Human Papillomavirus
DDLNAVCA

SEQ ID NO: 35821 - protein, 10 aa, Artificial Sequence
  Peptide Derived from Human Papillomavirus
DDLNAVCALK

SEQ ID NO: 35822 - protein, 11 aa, Artificial Sequence
  Peptide Derived from Human Papillomavirus
DDLNAVCALKR

SEQ ID NO: 35823 - protein, 8 aa, Artificial Sequence
  Peptide Derived from Human Papillomavirus
DDSDIAYY

SEQ ID NO: 35824 - protein, 9 aa, Artificial Sequence
  Peptide Derived from Human Papillomavirus
DDSDIAYYY

SEQ ID NO: 35825 - protein, 10 aa, Artificial Sequence
  Peptide Derived from Human Papillomavirus
DDSDIAYYYA

SEQ ID NO: 35826 - protein, 10 aa, Artificial Sequence
  Peptide Derived from Human Papillomavirus
DDSGTDLLEF

SEQ ID NO: 35827 - protein, 10 aa, Artificial Sequence
  Peptide Derived from Human Papillomavirus
DDSMENSIQA

SEQ ID NO: 35828 - protein, 10 aa, Artificial Sequence
  Peptide Derived from Human Papillomavirus
DDVTPISWTY

SEQ ID NO: 35829 - protein, 10 aa, Artificial Sequence
  Peptide Derived from Human Papillomavirus
DGNEISIDVK

SEQ ID NO: 35830 - protein, 11 aa, Artificial Sequence
  Peptide Derived from Human Papillomavirus
DGNEISIDVKH

SEQ ID NO: 35831 - protein, 10 aa, Artificial Sequence
  Peptide Derived from Human Papillomavirus
DIAYYYAQLA

SEQ ID NO: 35832 - protein, 8 aa, Artificial Sequence
  Peptide Derived from Human Papillomavirus
DLIEEEDK

SEQ ID NO: 35833 - protein, 11 aa, Artificial Sequence
  Peptide Derived from Human Papillomavirus
DLIEEEDKENH

SEQ ID NO: 35834 - protein, 9 aa, Artificial Sequence
  Peptide Derived from Human Papillomavirus
DLNAVCALK

SEQ ID NO: 35835 - protein, 10 aa, Artificial Sequence
  Peptide Derived from Human Papillomavirus
DLNAVCALKR

SEQ ID NO: 35836 - protein, 11 aa, Artificial Sequence
  Peptide Derived from Human Papillomavirus
DLNAVCALKRK

SEQ ID NO: 35837 - protein, 9 aa, Artificial Sequence
  Peptide Derived from Human Papillomavirus
DLSEMVQWA

SEQ ID NO: 35838 - protein, 10 aa, Artificial Sequence
  Peptide Derived from Human Papillomavirus
DLSEMVQWAY

SEQ ID NO: 35839 - protein, 8 aa, Artificial Sequence
  Peptide Derived from Human Papillomavirus
DSDIAYYY

SEQ ID NO: 35840 - protein, 9 aa, Artificial Sequence
  Peptide Derived from Human Papillomavirus
DSDIAYYYA

SEQ ID NO: 35841 - protein, 9 aa, Artificial Sequence
  Peptide Derived from Human Papillomavirus
DSGTDLLEF

SEQ ID NO: 35842 - protein, 9 aa, Artificial Sequence
  Peptide Derived from Human Papillomavirus
DSMENSIQA

SEQ ID NO: 35843 - protein, 8 aa, Artificial Sequence
  Peptide Derived from Human Papillomavirus
DSNSNAAA

SEQ ID NO: 35844 - protein, 9 aa, Artificial Sequence
  Peptide Derived from Human Papillomavirus
DSNSNAAAF

SEQ ID NO: 35845 - protein, 11 aa, Artificial Sequence
  Peptide Derived from Human Papillomavirus
DSNSNAAAFLK

SEQ ID NO: 35846 - protein, 8 aa, Artificial Sequence
  Peptide Derived from Human Papillomavirus
DSRWPYLH

SEQ ID NO: 35847 - protein, 10 aa, Artificial Sequence
  Peptide Derived from Human Papillomavirus
DSRWPYLHSR

SEQ ID NO: 35848 - protein, 9 aa, Artificial Sequence
  Peptide Derived from Human Papillomavirus
DTEAARALF

SEQ ID NO: 35849 - protein, 11 aa, Artificial Sequence
  Peptide Derived from Human Papillomavirus
DVKHRALVQLK

SEQ ID NO: 35850 - protein, 9 aa, Artificial Sequence
  Peptide Derived from Human Papillomavirus
DVTPISWTY

SEQ ID NO: 35851 - protein, 11 aa, Artificial Sequence
  Peptide Derived from Human Papillomavirus
DVVDRAANPCR

SEQ ID NO: 35852 - protein, 8 aa, Artificial Sequence
  Peptide Derived from Human Papillomavirus
ECTYRKRK

SEQ ID NO: 35853 - protein, 9 aa, Artificial Sequence
  Peptide Derived from Human Papillomavirus
EDDLNAVCA

SEQ ID NO: 35854 - protein, 11 aa, Artificial Sequence
  Peptide Derived from Human Papillomavirus
EDDLNAVCALK

SEQ ID NO: 35855 - protein, 8 aa, Artificial Sequence
  Peptide Derived from Human Papillomavirus
EDVVDRAA

SEQ ID NO: 35856 - protein, 8 aa, Artificial Sequence
  Peptide Derived from Human Papillomavirus
EFKNPFPF

SEQ ID NO: 35857 - protein, 8 aa, Artificial Sequence
  Peptide Derived from Human Papillomavirus
EFTAFLGA

SEQ ID NO: 35858 - protein, 9 aa, Artificial Sequence
  Peptide Derived from Human Papillomavirus
EFTAFLGAF

SEQ ID NO: 35859 - protein, 10 aa, Artificial Sequence
  Peptide Derived from Human Papillomavirus
EFTAFLGAFK

SEQ ID NO: 35860 - protein, 11 aa, Artificial Sequence
  Peptide Derived from Human Papillomavirus
EFTAFLGAFKK

SEQ ID NO: 35861 - protein, 8 aa, Artificial Sequence
  Peptide Derived from Human Papillomavirus
EGEDDLNA

SEQ ID NO: 35862 - protein, 11 aa, Artificial Sequence
  Peptide Derived from Human Papillomavirus
EGEDDLNAVCA

SEQ ID NO: 35863 - protein, 8 aa, Artificial Sequence
  Peptide Derived from Human Papillomavirus
EISIDVKH

SEQ ID NO: 35864 - protein, 9 aa, Artificial Sequence
  Peptide Derived from Human Papillomavirus
EISIDVKHR

SEQ ID NO: 35865 - protein, 10 aa, Artificial Sequence
  Peptide Derived from Human Papillomavirus
EISIDVKHRA

SEQ ID NO: 35866 - protein, 9 aa, Artificial Sequence
  Peptide Derived from Human Papillomavirus
ELTDDSDIA

SEQ ID NO: 35867 - protein, 10 aa, Artificial Sequence
  Peptide Derived from Human Papillomavirus
ELTDDSDIAY

SEQ ID NO: 35868 - protein, 11 aa, Artificial Sequence
  Peptide Derived from Human Papillomavirus
ELTDDSDIAYY

SEQ ID NO: 35869 - protein, 10 aa, Artificial Sequence
  Peptide Derived from Human Papillomavirus
ELVRPFKSDK

SEQ ID NO: 35870 - protein, 8 aa, Artificial Sequence
  Peptide Derived from Human Papillomavirus
ESLKVLIK

SEQ ID NO: 35871 - protein, 10 aa, Artificial Sequence
  Peptide Derived from Human Papillomavirus
ESLKVLIKQH

SEQ ID NO: 35872 - protein, 10 aa, Artificial Sequence
  Peptide Derived from Human Papillomavirus
ETCMVIEPPK

SEQ ID NO: 35873 - protein, 8 aa, Artificial Sequence
  Peptide Derived from Human Papillomavirus
EVEAVIER

SEQ ID NO: 35874 - protein, 9 aa, Artificial Sequence
  Peptide Derived from Human Papillomavirus
EVEAVIERR

SEQ ID NO: 35875 - protein, 8 aa, Artificial Sequence
  Peptide Derived from Human Papillomavirus
FAACSQSA

SEQ ID NO: 35876 - protein, 9 aa, Artificial Sequence
  Peptide Derived from Human Papillomavirus
FAACSQSAA

SEQ ID NO: 35877 - protein, 9 aa, Artificial Sequence
  Peptide Derived from Human Papillomavirus
FDENGNPVY

SEQ ID NO: 35878 - protein, 10 aa, Artificial Sequence
  Peptide Derived from Human Papillomavirus
FDENGNPVYA

SEQ ID NO: 35879 - protein, 10 aa, Artificial Sequence
  Peptide Derived from Human Papillomavirus
FDLSEMVQWA

SEQ ID NO: 35880 - protein, 11 aa, Artificial Sequence
  Peptide Derived from Human Papillomavirus
FDLSEMVQWAY

SEQ ID NO: 35881 - protein, 8 aa, Artificial Sequence
  Peptide Derived from Human Papillomavirus
FFSRTWCK

SEQ ID NO: 35882 - protein, 8 aa, Artificial Sequence
  Peptide Derived from Human Papillomavirus
FGMSLIQF

SEQ ID NO: 35883 - protein, 10 aa, Artificial Sequence
  Peptide Derived from Human Papillomavirus
FGMSLIQFLK

SEQ ID NO: 35884 - protein, 8 aa, Artificial Sequence
  Peptide Derived from Human Papillomavirus
FLGAFKKF

SEQ ID NO: 35885 - protein, 10 aa, Artificial Sequence
  Peptide Derived from Human Papillomavirus
FLGAFKKFLK

SEQ ID NO: 35886 - protein, 8 aa, Artificial Sequence
  Peptide Derived from Human Papillomavirus
FLKGIPKK

SEQ ID NO: 35887 - protein, 8 aa, Artificial Sequence
  Peptide Derived from Human Papillomavirus
FLKSNSQA

SEQ ID NO: 35888 - protein, 9 aa, Artificial Sequence
  Peptide Derived from Human Papillomavirus
FLKSNSQAK

SEQ ID NO: 35889 - protein, 8 aa, Artificial Sequence
  Peptide Derived from Human Papillomavirus
FMELVRPF

SEQ ID NO: 35890 - protein, 9 aa, Artificial Sequence
  Peptide Derived from Human Papillomavirus
FMELVRPFK

SEQ ID NO: 35891 - protein, 8 aa, Artificial Sequence
  Peptide Derived from Human Papillomavirus
FTAFLGAF

SEQ ID NO: 35892 - protein, 9 aa, Artificial Sequence
  Peptide Derived from Human Papillomavirus
FTAFLGAFK

SEQ ID NO: 35893 - protein, 10 aa, Artificial Sequence
  Peptide Derived from Human Papillomavirus
FTAFLGAFKK

SEQ ID NO: 35894 - protein, 11 aa, Artificial Sequence
  Peptide Derived from Human Papillomavirus
FTAFLGAFKKF

SEQ ID NO: 35895 - protein, 8 aa, Artificial Sequence
  Peptide Derived from Human Papillomavirus
GAFKKFLK

SEQ ID NO: 35896 - protein, 10 aa, Artificial Sequence
  Peptide Derived from Human Papillomavirus
GAGMGCTGWF

SEQ ID NO: 35897 - protein, 10 aa, Artificial Sequence
  Peptide Derived from Human Papillomavirus
GCTGWFEVEA

SEQ ID NO: 35898 - protein, 10 aa, Artificial Sequence
  Peptide Derived from Human Papillomavirus
GCVISCVNSK

SEQ ID NO: 35899 - protein, 8 aa, Artificial Sequence
  Peptide Derived from Human Papillomavirus
GGNISTFK

SEQ ID NO: 35900 - protein, 11 aa, Artificial Sequence
  Peptide Derived from Human Papillomavirus
GGNISTFKCSA

SEQ ID NO: 35901 - protein, 9 aa, Artificial Sequence
  Peptide Derived from Human Papillomavirus
GIIILLLIR

SEQ ID NO: 35902 - protein, 10 aa, Artificial Sequence
  Peptide Derived from Human Papillomavirus
GIIILLLIRF

SEQ ID NO: 35903 - protein, 11 aa, Artificial Sequence
  Peptide Derived from Human Papillomavirus
GIIILLLIRFR

SEQ ID NO: 35904 - protein, 8 aa, Artificial Sequence
  Peptide Derived from Human Papillomavirus
GIMCRHYK

SEQ ID NO: 35905 - protein, 9 aa, Artificial Sequence
  Peptide Derived from Human Papillomavirus
GIMCRHYKK

SEQ ID NO: 35906 - protein, 10 aa, Artificial Sequence
  Peptide Derived from Human Papillomavirus
GIMCRHYKKA

SEQ ID NO: 35907 - protein, 9 aa, Artificial Sequence
  Peptide Derived from Human Papillomavirus
GISFMELVR
